United States Patent 10,738,302 (COMPOSITIONS AND METHODS FOR IDENTIFYING POLYNUCLEOTIDES OF INTEREST) - sequence listing, part 2

SEQ ID NO: 33372 - DNA, 18 bp, Artificial Sequence
  Synthetic DNA
ttatcagacacactatag

SEQ ID NO: 33373 - DNA, 18 bp, Artificial Sequence
  Synthetic DNA
ttctacgtctcaatatag

SEQ ID NO: 33374 - DNA, 18 bp, Artificial Sequence
  Synthetic DNA
ttttatgactcactttag

SEQ ID NO: 33375 - DNA, 18 bp, Artificial Sequence
  Synthetic DNA
ttttatgagtcactatag

SEQ ID NO: 33376 - DNA, 18 bp, Artificial Sequence
  Synthetic DNA
tatttctactctctatag

SEQ ID NO: 33377 - DNA, 18 bp, Artificial Sequence
  Synthetic DNA
aattatgactcactattg

SEQ ID NO: 33378 - DNA, 18 bp, Artificial Sequence
  Synthetic DNA
acatacgattcactattg

SEQ ID NO: 33379 - DNA, 18 bp, Artificial Sequence
  Synthetic DNA
caaatcaactcactatag

SEQ ID NO: 33380 - DNA, 18 bp, Artificial Sequence
  Synthetic DNA
taaaacaacttactattg

SEQ ID NO: 33381 - DNA, 18 bp, Artificial Sequence
  Synthetic DNA
taaaacgactcaataatg

SEQ ID NO: 33382 - DNA, 18 bp, Artificial Sequence
  Synthetic DNA
taaatagactcacaatag

SEQ ID NO: 33383 - DNA, 18 bp, Artificial Sequence
  Synthetic DNA
taatacaacacactaatg

SEQ ID NO: 33384 - DNA, 18 bp, Artificial Sequence
  Synthetic DNA
taatacaacaccctattg

SEQ ID NO: 33385 - DNA, 18 bp, Artificial Sequence
  Synthetic DNA
taataccactaattattg

SEQ ID NO: 33386 - DNA, 18 bp, Artificial Sequence
  Synthetic DNA
taatacgacaaattattg

SEQ ID NO: 33387 - DNA, 18 bp, Artificial Sequence
  Synthetic DNA
taatacgacatactaatg

SEQ ID NO: 33388 - DNA, 18 bp, Artificial Sequence
  Synthetic DNA
taatacgactaacttatg

SEQ ID NO: 33389 - DNA, 18 bp, Artificial Sequence
  Synthetic DNA
taatacgactatcaattg

SEQ ID NO: 33390 - DNA, 18 bp, Artificial Sequence
  Synthetic DNA
taatacgactcacccatg

SEQ ID NO: 33391 - DNA, 18 bp, Artificial Sequence
  Synthetic DNA
taatatgacttattattg

SEQ ID NO: 33392 - DNA, 18 bp, Artificial Sequence
  Synthetic DNA
taatatgtttcactattg

SEQ ID NO: 33393 - DNA, 18 bp, Artificial Sequence
  Synthetic DNA
taattcgccacactaaag

SEQ ID NO: 33394 - DNA, 18 bp, Artificial Sequence
  Synthetic DNA
tacttcgtctcaatatag

SEQ ID NO: 33395 - DNA, 18 bp, Artificial Sequence
  Synthetic DNA
tattacgagtcactcttg

SEQ ID NO: 33396 - DNA, 18 bp, Artificial Sequence
  Synthetic DNA
tatttcgatacactatag

SEQ ID NO: 33397 - DNA, 18 bp, Artificial Sequence
  Synthetic DNA
tcattcgtctcactctag

SEQ ID NO: 33398 - DNA, 18 bp, Artificial Sequence
  Synthetic DNA
tgatttgcctcactatag

SEQ ID NO: 33399 - DNA, 18 bp, Artificial Sequence
  Synthetic DNA
ttatacgaaacactattg

SEQ ID NO: 33400 - DNA, 18 bp, Artificial Sequence
  Synthetic DNA
ttatttcactcactatag

SEQ ID NO: 33401 - DNA, 18 bp, Artificial Sequence
  Synthetic DNA
tttttcgacacactatag

SEQ ID NO: 33402 - DNA, 18 bp, Artificial Sequence
  Synthetic DNA
aaaaacgactaactaaag

SEQ ID NO: 33403 - DNA, 18 bp, Artificial Sequence
  Synthetic DNA
aaatacgactcataaaag

SEQ ID NO: 33404 - DNA, 18 bp, Artificial Sequence
  Synthetic DNA
aaatacgtcccaatatag

SEQ ID NO: 33405 - DNA, 18 bp, Artificial Sequence
  Synthetic DNA
aaatccgtctcactttag

SEQ ID NO: 33406 - DNA, 18 bp, Artificial Sequence
  Synthetic DNA
aagaacgtctcactatag

SEQ ID NO: 33407 - DNA, 18 bp, Artificial Sequence
  Synthetic DNA
aattacaattcactatag

SEQ ID NO: 33408 - DNA, 18 bp, Artificial Sequence
  Synthetic DNA
aattacgacacacaatag

SEQ ID NO: 33409 - DNA, 18 bp, Artificial Sequence
  Synthetic DNA
atatacgactcagtttag

SEQ ID NO: 33410 - DNA, 18 bp, Artificial Sequence
  Synthetic DNA
atgtacgactaactatag

SEQ ID NO: 33411 - DNA, 18 bp, Artificial Sequence
  Synthetic DNA
caatacgtctcagtttag

SEQ ID NO: 33412 - DNA, 18 bp, Artificial Sequence
  Synthetic DNA
taaaaagacttactatgg

SEQ ID NO: 33413 - DNA, 18 bp, Artificial Sequence
  Synthetic DNA
taaaacaactccctaaag

SEQ ID NO: 33414 - DNA, 18 bp, Artificial Sequence
  Synthetic DNA
taaaacgaatcacttaag

SEQ ID NO: 33415 - DNA, 18 bp, Artificial Sequence
  Synthetic DNA
taaaatgacactctatag

SEQ ID NO: 33416 - DNA, 18 bp, Artificial Sequence
  Synthetic DNA
taacacgactctataaag

SEQ ID NO: 33417 - DNA, 18 bp, Artificial Sequence
  Synthetic DNA
taacacgagtcacttaag

SEQ ID NO: 33418 - DNA, 18 bp, Artificial Sequence
  Synthetic DNA
taacacgattttctatag

SEQ ID NO: 33419 - DNA, 18 bp, Artificial Sequence
  Synthetic DNA
taacacgtctctctttag

SEQ ID NO: 33420 - DNA, 18 bp, Artificial Sequence
  Synthetic DNA
taataagactaacattag

SEQ ID NO: 33421 - DNA, 18 bp, Artificial Sequence
  Synthetic DNA
taataagactaacttaag

SEQ ID NO: 33422 - DNA, 18 bp, Artificial Sequence
  Synthetic DNA
taatacaactctcttcag

SEQ ID NO: 33423 - DNA, 18 bp, Artificial Sequence
  Synthetic DNA
taatacatctctctacag

SEQ ID NO: 33424 - DNA, 18 bp, Artificial Sequence
  Synthetic DNA
taatacctctctcaatag

SEQ ID NO: 33425 - DNA, 18 bp, Artificial Sequence
  Synthetic DNA
taatacgaaactttatag

SEQ ID NO: 33426 - DNA, 18 bp, Artificial Sequence
  Synthetic DNA
taatacgacactcaaaag

SEQ ID NO: 33427 - DNA, 18 bp, Artificial Sequence
  Synthetic DNA
taatacgacatacaatcg

SEQ ID NO: 33428 - DNA, 18 bp, Artificial Sequence
  Synthetic DNA
taatacgactcactgacc

SEQ ID NO: 33429 - DNA, 18 bp, Artificial Sequence
  Synthetic DNA
taatacgactctccaacg

SEQ ID NO: 33430 - DNA, 18 bp, Artificial Sequence
  Synthetic DNA
taatacgattctatttag

SEQ ID NO: 33431 - DNA, 18 bp, Artificial Sequence
  Synthetic DNA
taatacgtcacatgatag

SEQ ID NO: 33432 - DNA, 18 bp, Artificial Sequence
  Synthetic DNA
taatacgtcatactaaag

SEQ ID NO: 33433 - DNA, 18 bp, Artificial Sequence
  Synthetic DNA
taatacgtcttaataaag

SEQ ID NO: 33434 - DNA, 18 bp, Artificial Sequence
  Synthetic DNA
taatactacactctttag

SEQ ID NO: 33435 - DNA, 18 bp, Artificial Sequence
  Synthetic DNA
taatactactttttatag

SEQ ID NO: 33436 - DNA, 18 bp, Artificial Sequence
  Synthetic DNA
taataggtctctctttag

SEQ ID NO: 33437 - DNA, 18 bp, Artificial Sequence
  Synthetic DNA
taatgcgactcacataag

SEQ ID NO: 33438 - DNA, 18 bp, Artificial Sequence
  Synthetic DNA
tacaacgactcacttaag

SEQ ID NO: 33439 - DNA, 18 bp, Artificial Sequence
  Synthetic DNA
tactacgataaactatag

SEQ ID NO: 33440 - DNA, 18 bp, Artificial Sequence
  Synthetic DNA
tagtacgtctcattttag

SEQ ID NO: 33441 - DNA, 18 bp, Artificial Sequence
  Synthetic DNA
tataacaacacactatag

SEQ ID NO: 33442 - DNA, 18 bp, Artificial Sequence
  Synthetic DNA
tataacgactcaatttag

SEQ ID NO: 33443 - DNA, 18 bp, Artificial Sequence
  Synthetic DNA
tataacgactcacactag

SEQ ID NO: 33444 - DNA, 18 bp, Artificial Sequence
  Synthetic DNA
tataacgactctatatag

SEQ ID NO: 33445 - DNA, 18 bp, Artificial Sequence
  Synthetic DNA
tattaagactctttatag

SEQ ID NO: 33446 - DNA, 18 bp, Artificial Sequence
  Synthetic DNA
tattaatactctctatag

SEQ ID NO: 33447 - DNA, 18 bp, Artificial Sequence
  Synthetic DNA
tattacgtcacactaaag

SEQ ID NO: 33448 - DNA, 18 bp, Artificial Sequence
  Synthetic DNA
tattatgattcactttag

SEQ ID NO: 33449 - DNA, 18 bp, Artificial Sequence
  Synthetic DNA
tattatgtctcactacag

SEQ ID NO: 33450 - DNA, 18 bp, Artificial Sequence
  Synthetic DNA
tcaaacgactcacattag

SEQ ID NO: 33451 - DNA, 18 bp, Artificial Sequence
  Synthetic DNA
tcaaacgactgacaatag

SEQ ID NO: 33452 - DNA, 18 bp, Artificial Sequence
  Synthetic DNA
tcaaacgattcactttag

SEQ ID NO: 33453 - DNA, 18 bp, Artificial Sequence
  Synthetic DNA
tgatacgtctcaataaag

SEQ ID NO: 33454 - DNA, 18 bp, Artificial Sequence
  Synthetic DNA
ttaaacaactaactatag

SEQ ID NO: 33455 - DNA, 18 bp, Artificial Sequence
  Synthetic DNA
ttaaacgacatactatag

SEQ ID NO: 33456 - DNA, 18 bp, Artificial Sequence
  Synthetic DNA
ttacacgaatcactttag

SEQ ID NO: 33457 - DNA, 18 bp, Artificial Sequence
  Synthetic DNA
ttacacgactcacttaag

SEQ ID NO: 33458 - DNA, 18 bp, Artificial Sequence
  Synthetic DNA
ttacacgtctcactctag

SEQ ID NO: 33459 - DNA, 18 bp, Artificial Sequence
  Synthetic DNA
ttataagactaacaatag

SEQ ID NO: 33460 - DNA, 18 bp, Artificial Sequence
  Synthetic DNA
ttataagattcactaaag

SEQ ID NO: 33461 - DNA, 18 bp, Artificial Sequence
  Synthetic DNA
ttatacatcacactatag

SEQ ID NO: 33462 - DNA, 18 bp, Artificial Sequence
  Synthetic DNA
ttatacgacaaactatcg

SEQ ID NO: 33463 - DNA, 18 bp, Artificial Sequence
  Synthetic DNA
ttatacgactcataacag

SEQ ID NO: 33464 - DNA, 18 bp, Artificial Sequence
  Synthetic DNA
ttgtacgtcacactatag

SEQ ID NO: 33465 - DNA, 18 bp, Artificial Sequence
  Synthetic DNA
ttttaagactctctatag

SEQ ID NO: 33466 - DNA, 18 bp, Artificial Sequence
  Synthetic DNA
ttttacgactcagtgtag

SEQ ID NO: 33467 - DNA, 18 bp, Artificial Sequence
  Synthetic DNA
tattacgaatctctattg

SEQ ID NO: 33468 - DNA, 18 bp, Artificial Sequence
  Synthetic DNA
ttattcgtctcaatatag

SEQ ID NO: 33469 - DNA, 18 bp, Artificial Sequence
  Synthetic DNA
taacacgtctcacttaag

SEQ ID NO: 33470 - DNA, 18 bp, Artificial Sequence
  Synthetic DNA
taatacgtatcacaaaag

SEQ ID NO: 33471 - DNA, 18 bp, Artificial Sequence
  Synthetic DNA
taatacgtttcacattag

SEQ ID NO: 33472 - DNA, 18 bp, Artificial Sequence
  Synthetic DNA
taatatgtctcacattag

SEQ ID NO: 33473 - DNA, 18 bp, Artificial Sequence
  Synthetic DNA
tattacgacttacattag

SEQ ID NO: 33474 - DNA, 18 bp, Artificial Sequence
  Synthetic DNA
atttacgactcactattg

SEQ ID NO: 33475 - DNA, 18 bp, Artificial Sequence
  Synthetic DNA
taatacttctcactaatg

SEQ ID NO: 33476 - DNA, 18 bp, Artificial Sequence
  Synthetic DNA
caattcgactctctattg

SEQ ID NO: 33477 - DNA, 18 bp, Artificial Sequence
  Synthetic DNA
taaatcgactcaccattg

SEQ ID NO: 33478 - DNA, 18 bp, Artificial Sequence
  Synthetic DNA
tatttcgcctcactattg

SEQ ID NO: 33479 - DNA, 18 bp, Artificial Sequence
  Synthetic DNA
tcattcgaatcactattg

SEQ ID NO: 33480 - DNA, 18 bp, Artificial Sequence
  Synthetic DNA
aaaaacgactcacttttg

SEQ ID NO: 33481 - DNA, 18 bp, Artificial Sequence
  Synthetic DNA
aaaatcgactctctatag

SEQ ID NO: 33482 - DNA, 18 bp, Artificial Sequence
  Synthetic DNA
aacttcgtctcactatag

SEQ ID NO: 33483 - DNA, 18 bp, Artificial Sequence
  Synthetic DNA
cattacgaatcactattg

SEQ ID NO: 33484 - DNA, 18 bp, Artificial Sequence
  Synthetic DNA
taaaacgactgacttttg

SEQ ID NO: 33485 - DNA, 18 bp, Artificial Sequence
  Synthetic DNA
taaaactactcaatattg

SEQ ID NO: 33486 - DNA, 18 bp, Artificial Sequence
  Synthetic DNA
taaatcgactcccaatag

SEQ ID NO: 33487 - DNA, 18 bp, Artificial Sequence
  Synthetic DNA
taactcgactctgtatag

SEQ ID NO: 33488 - DNA, 18 bp, Artificial Sequence
  Synthetic DNA
taatacaacacattattg

SEQ ID NO: 33489 - DNA, 18 bp, Artificial Sequence
  Synthetic DNA
taatacctctcattattg

SEQ ID NO: 33490 - DNA, 18 bp, Artificial Sequence
  Synthetic DNA
taatacgaatcacatttg

SEQ ID NO: 33491 - DNA, 18 bp, Artificial Sequence
  Synthetic DNA
taatacgacttaataatg

SEQ ID NO: 33492 - DNA, 18 bp, Artificial Sequence
  Synthetic DNA
taatacgattctcttttg

SEQ ID NO: 33493 - DNA, 18 bp, Artificial Sequence
  Synthetic DNA
taattcaattcactacag

SEQ ID NO: 33494 - DNA, 18 bp, Artificial Sequence
  Synthetic DNA
taattcgaattactttag

SEQ ID NO: 33495 - DNA, 18 bp, Artificial Sequence
  Synthetic DNA
taattcgactcaattaag

SEQ ID NO: 33496 - DNA, 18 bp, Artificial Sequence
  Synthetic DNA
taatttgacacacaatag

SEQ ID NO: 33497 - DNA, 18 bp, Artificial Sequence
  Synthetic DNA
taatttgactctctaaag

SEQ ID NO: 33498 - DNA, 18 bp, Artificial Sequence
  Synthetic DNA
taatttgtatcactatag

SEQ ID NO: 33499 - DNA, 18 bp, Artificial Sequence
  Synthetic DNA
tagatcgtctcactatag

SEQ ID NO: 33500 - DNA, 18 bp, Artificial Sequence
  Synthetic DNA
tagtactactctctattg

SEQ ID NO: 33501 - DNA, 18 bp, Artificial Sequence
  Synthetic DNA
tgatacgtatcactattg

SEQ ID NO: 33502 - DNA, 18 bp, Artificial Sequence
  Synthetic DNA
tgattcgaatcattatag

SEQ ID NO: 33503 - DNA, 18 bp, Artificial Sequence
  Synthetic DNA
ttatacgactaacaattg

SEQ ID NO: 33504 - DNA, 18 bp, Artificial Sequence
  Synthetic DNA
ttatacgagtcacaattg

SEQ ID NO: 33505 - DNA, 18 bp, Artificial Sequence
  Synthetic DNA
ttatacgatacactattg

SEQ ID NO: 33506 - DNA, 18 bp, Artificial Sequence
  Synthetic DNA
ttatatgtctcactattg

SEQ ID NO: 33507 - DNA, 18 bp, Artificial Sequence
  Synthetic DNA
ttatccgactcaccattg

SEQ ID NO: 33508 - DNA, 18 bp, Artificial Sequence
  Synthetic DNA
ttattctactcactgtag

SEQ ID NO: 33509 - DNA, 18 bp, Artificial Sequence
  Synthetic DNA
aaatacgacactctaaag

SEQ ID NO: 33510 - DNA, 18 bp, Artificial Sequence
  Synthetic DNA
aaatattactcacaatag

SEQ ID NO: 33511 - DNA, 18 bp, Artificial Sequence
  Synthetic DNA
ataaacaactcactatag

SEQ ID NO: 33512 - DNA, 18 bp, Artificial Sequence
  Synthetic DNA
atttacgactcaatatag

SEQ ID NO: 33513 - DNA, 18 bp, Artificial Sequence
  Synthetic DNA
gcatacgactatctatag

SEQ ID NO: 33514 - DNA, 18 bp, Artificial Sequence
  Synthetic DNA
taaaacgccacactttag

SEQ ID NO: 33515 - DNA, 18 bp, Artificial Sequence
  Synthetic DNA
taaaacgtctcatcatag

SEQ ID NO: 33516 - DNA, 18 bp, Artificial Sequence
  Synthetic DNA
taaaacttctcacaatag

SEQ ID NO: 33517 - DNA, 18 bp, Artificial Sequence
  Synthetic DNA
taaaccgtctctctatag

SEQ ID NO: 33518 - DNA, 18 bp, Artificial Sequence
  Synthetic DNA
taaactgacttactatag

SEQ ID NO: 33519 - DNA, 18 bp, Artificial Sequence
  Synthetic DNA
taacacgtctcacttcag

SEQ ID NO: 33520 - DNA, 18 bp, Artificial Sequence
  Synthetic DNA
taatacaactttctaaag

SEQ ID NO: 33521 - DNA, 18 bp, Artificial Sequence
  Synthetic DNA
taatacgacaatatatag

SEQ ID NO: 33522 - DNA, 18 bp, Artificial Sequence
  Synthetic DNA
taatacgacacaaattag

SEQ ID NO: 33523 - DNA, 18 bp, Artificial Sequence
  Synthetic DNA
taatacgactaacaaagg

SEQ ID NO: 33524 - DNA, 18 bp, Artificial Sequence
  Synthetic DNA
taatacgattcttaatag

SEQ ID NO: 33525 - DNA, 18 bp, Artificial Sequence
  Synthetic DNA
taatatgacactcaatag

SEQ ID NO: 33526 - DNA, 18 bp, Artificial Sequence
  Synthetic DNA
taatatgattctttatag

SEQ ID NO: 33527 - DNA, 18 bp, Artificial Sequence
  Synthetic DNA
taatgcgtctctcaatag

SEQ ID NO: 33528 - DNA, 18 bp, Artificial Sequence
  Synthetic DNA
tattaacactcactttag

SEQ ID NO: 33529 - DNA, 18 bp, Artificial Sequence
  Synthetic DNA
tattaatacttactatag

SEQ ID NO: 33530 - DNA, 18 bp, Artificial Sequence
  Synthetic DNA
tattaccattcattatag

SEQ ID NO: 33531 - DNA, 18 bp, Artificial Sequence
  Synthetic DNA
tattacgactctccaaag

SEQ ID NO: 33532 - DNA, 18 bp, Artificial Sequence
  Synthetic DNA
tattactaatctctatag

SEQ ID NO: 33533 - DNA, 18 bp, Artificial Sequence
  Synthetic DNA
tcacacgattcacaatag

SEQ ID NO: 33534 - DNA, 18 bp, Artificial Sequence
  Synthetic DNA
tgataagtctcactgtag

SEQ ID NO: 33535 - DNA, 18 bp, Artificial Sequence
  Synthetic DNA
ttaaaaggctcactatag

SEQ ID NO: 33536 - DNA, 18 bp, Artificial Sequence
  Synthetic DNA
ttacacgactctctttag

SEQ ID NO: 33537 - DNA, 18 bp, Artificial Sequence
  Synthetic DNA
ttatacaacacactacag

SEQ ID NO: 33538 - DNA, 18 bp, Artificial Sequence
  Synthetic DNA
ttatacatcttactatag

SEQ ID NO: 33539 - DNA, 18 bp, Artificial Sequence
  Synthetic DNA
ttataccactctcaatag

SEQ ID NO: 33540 - DNA, 18 bp, Artificial Sequence
  Synthetic DNA
ttatacgattcaatgtag

SEQ ID NO: 33541 - DNA, 18 bp, Artificial Sequence
  Synthetic DNA
ttatacgtctccctttag

SEQ ID NO: 33542 - DNA, 18 bp, Artificial Sequence
  Synthetic DNA
ttatacgtttcaccatag

SEQ ID NO: 33543 - DNA, 18 bp, Artificial Sequence
  Synthetic DNA
ttatccgacctactatag

SEQ ID NO: 33544 - DNA, 18 bp, Artificial Sequence
  Synthetic DNA
taaaacgactcacttatg

SEQ ID NO: 33545 - DNA, 18 bp, Artificial Sequence
  Synthetic DNA
taattcaacacactttag

SEQ ID NO: 33546 - DNA, 18 bp, Artificial Sequence
  Synthetic DNA
ttatatgactcactaatg

SEQ ID NO: 33547 - DNA, 18 bp, Artificial Sequence
  Synthetic DNA
ttatacgatacacaatag

SEQ ID NO: 33548 - DNA, 18 bp, Artificial Sequence
  Synthetic DNA
tattacgtctcacaattg

SEQ ID NO: 33549 - DNA, 18 bp, Artificial Sequence
  Synthetic DNA
taaatcaactcactattg

SEQ ID NO: 33550 - DNA, 18 bp, Artificial Sequence
  Synthetic DNA
taattccactcacttttg

SEQ ID NO: 33551 - DNA, 18 bp, Artificial Sequence
  Synthetic DNA
tcattctactcactattg

SEQ ID NO: 33552 - DNA, 18 bp, Artificial Sequence
  Synthetic DNA
ttattcgacttactattg

SEQ ID NO: 33553 - DNA, 18 bp, Artificial Sequence
  Synthetic DNA
atatacaactcactattg

SEQ ID NO: 33554 - DNA, 18 bp, Artificial Sequence
  Synthetic DNA
caattcaaatcactatag

SEQ ID NO: 33555 - DNA, 18 bp, Artificial Sequence
  Synthetic DNA
cattacgactctctattg

SEQ ID NO: 33556 - DNA, 18 bp, Artificial Sequence
  Synthetic DNA
taaaacaagtcactattg

SEQ ID NO: 33557 - DNA, 18 bp, Artificial Sequence
  Synthetic DNA
taaaacgacttactgttg

SEQ ID NO: 33558 - DNA, 18 bp, Artificial Sequence
  Synthetic DNA
taaaacgtctctctattg

SEQ ID NO: 33559 - DNA, 18 bp, Artificial Sequence
  Synthetic DNA
taaaatgaatcactattg

SEQ ID NO: 33560 - DNA, 18 bp, Artificial Sequence
  Synthetic DNA
taatacaactaactaatg

SEQ ID NO: 33561 - DNA, 18 bp, Artificial Sequence
  Synthetic DNA
taatacatttcactattg

SEQ ID NO: 33562 - DNA, 18 bp, Artificial Sequence
  Synthetic DNA
taatacgacttaccaatg

SEQ ID NO: 33563 - DNA, 18 bp, Artificial Sequence
  Synthetic DNA
taatacgatacaatattg

SEQ ID NO: 33564 - DNA, 18 bp, Artificial Sequence
  Synthetic DNA
taatactactaacaattg

SEQ ID NO: 33565 - DNA, 18 bp, Artificial Sequence
  Synthetic DNA
taattcgtctcagtttag

SEQ ID NO: 33566 - DNA, 18 bp, Artificial Sequence
  Synthetic DNA
taatttgaatctctatag

SEQ ID NO: 33567 - DNA, 18 bp, Artificial Sequence
  Synthetic DNA
taatttgactcactttcg

SEQ ID NO: 33568 - DNA, 18 bp, Artificial Sequence
  Synthetic DNA
tagtactaatcactattg

SEQ ID NO: 33569 - DNA, 18 bp, Artificial Sequence
  Synthetic DNA
tatatcgactcactacag

SEQ ID NO: 33570 - DNA, 18 bp, Artificial Sequence
  Synthetic DNA
tattacgactcgcttaag

SEQ ID NO: 33571 - DNA, 18 bp, Artificial Sequence
  Synthetic DNA
tcatacgattcacaattg

SEQ ID NO: 33572 - DNA, 18 bp, Artificial Sequence
  Synthetic DNA
tcatacgtctcactactg

SEQ ID NO: 33573 - DNA, 18 bp, Artificial Sequence
  Synthetic DNA
tgatacgacacattattg

SEQ ID NO: 33574 - DNA, 18 bp, Artificial Sequence
  Synthetic DNA
ttaaacgactcaatattg

SEQ ID NO: 33575 - DNA, 18 bp, Artificial Sequence
  Synthetic DNA
ttatacgactagctatgg

SEQ ID NO: 33576 - DNA, 18 bp, Artificial Sequence
  Synthetic DNA
ttataggtctcactattg

SEQ ID NO: 33577 - DNA, 18 bp, Artificial Sequence
  Synthetic DNA
ttattcgacacaccatag

SEQ ID NO: 33578 - DNA, 18 bp, Artificial Sequence
  Synthetic DNA
aaaaaagacttactatag

SEQ ID NO: 33579 - DNA, 18 bp, Artificial Sequence
  Synthetic DNA
aaataagactcacattag

SEQ ID NO: 33580 - DNA, 18 bp, Artificial Sequence
  Synthetic DNA
aaatacaactttctatag

SEQ ID NO: 33581 - DNA, 18 bp, Artificial Sequence
  Synthetic DNA
aaatacgtctcactaacg

SEQ ID NO: 33582 - DNA, 18 bp, Artificial Sequence
  Synthetic DNA
aaatactattcactttag

SEQ ID NO: 33583 - DNA, 18 bp, Artificial Sequence
  Synthetic DNA
aaatatctctcactatag

SEQ ID NO: 33584 - DNA, 18 bp, Artificial Sequence
  Synthetic DNA
aattacgactgactttag

SEQ ID NO: 33585 - DNA, 18 bp, Artificial Sequence
  Synthetic DNA
aattccgactcactaaag

SEQ ID NO: 33586 - DNA, 18 bp, Artificial Sequence
  Synthetic DNA
acatacgtttcactatag

SEQ ID NO: 33587 - DNA, 18 bp, Artificial Sequence
  Synthetic DNA
acatatgtctcactatag

SEQ ID NO: 33588 - DNA, 18 bp, Artificial Sequence
  Synthetic DNA
atataccactcactaaag

SEQ ID NO: 33589 - DNA, 18 bp, Artificial Sequence
  Synthetic DNA
atatacgacacacaatag

SEQ ID NO: 33590 - DNA, 18 bp, Artificial Sequence
  Synthetic DNA
atatacgccacactatag

SEQ ID NO: 33591 - DNA, 18 bp, Artificial Sequence
  Synthetic DNA
atatccgactcactaaag

SEQ ID NO: 33592 - DNA, 18 bp, Artificial Sequence
  Synthetic DNA
caaaacgacactctatag

SEQ ID NO: 33593 - DNA, 18 bp, Artificial Sequence
  Synthetic DNA
ctatacgaatctctatag

SEQ ID NO: 33594 - DNA, 18 bp, Artificial Sequence
  Synthetic DNA
taaaacaactctatatag

SEQ ID NO: 33595 - DNA, 18 bp, Artificial Sequence
  Synthetic DNA
taaaacgaatcataatag

SEQ ID NO: 33596 - DNA, 18 bp, Artificial Sequence
  Synthetic DNA
taaaacgacattctatag

SEQ ID NO: 33597 - DNA, 18 bp, Artificial Sequence
  Synthetic DNA
taaaacgtctctcaatag

SEQ ID NO: 33598 - DNA, 18 bp, Artificial Sequence
  Synthetic DNA
taataaggcacactaaag

SEQ ID NO: 33599 - DNA, 18 bp, Artificial Sequence
  Synthetic DNA
taatacatctcaccttag

SEQ ID NO: 33600 - DNA, 18 bp, Artificial Sequence
  Synthetic DNA
taatacgaatcatattag

SEQ ID NO: 33601 - DNA, 18 bp, Artificial Sequence
  Synthetic DNA
taatacgaatctcattag

SEQ ID NO: 33602 - DNA, 18 bp, Artificial Sequence
  Synthetic DNA
taatacgacttacattcg

SEQ ID NO: 33603 - DNA, 18 bp, Artificial Sequence
  Synthetic DNA
taatacgtcacataatag

SEQ ID NO: 33604 - DNA, 18 bp, Artificial Sequence
  Synthetic DNA
taatacgtcccaccaaag

SEQ ID NO: 33605 - DNA, 18 bp, Artificial Sequence
  Synthetic DNA
taatactacttcccatag

SEQ ID NO: 33606 - DNA, 18 bp, Artificial Sequence
  Synthetic DNA
taataggtctcattttag

SEQ ID NO: 33607 - DNA, 18 bp, Artificial Sequence
  Synthetic DNA
taatatgacactctacag

SEQ ID NO: 33608 - DNA, 18 bp, Artificial Sequence
  Synthetic DNA
taatcaaacacactatag

SEQ ID NO: 33609 - DNA, 18 bp, Artificial Sequence
  Synthetic DNA
tagtacgattcattaaag

SEQ ID NO: 33610 - DNA, 18 bp, Artificial Sequence
  Synthetic DNA
tagtactattcactttag

SEQ ID NO: 33611 - DNA, 18 bp, Artificial Sequence
  Synthetic DNA
tataacgacccacaatag

SEQ ID NO: 33612 - DNA, 18 bp, Artificial Sequence
  Synthetic DNA
tattacaactaactttag

SEQ ID NO: 33613 - DNA, 18 bp, Artificial Sequence
  Synthetic DNA
tattacaactctcaatag

SEQ ID NO: 33614 - DNA, 18 bp, Artificial Sequence
  Synthetic DNA
tattacgacactctttag

SEQ ID NO: 33615 - DNA, 18 bp, Artificial Sequence
  Synthetic DNA
tattacgactatcaatag

SEQ ID NO: 33616 - DNA, 18 bp, Artificial Sequence
  Synthetic DNA
tattacgactcccttaag

SEQ ID NO: 33617 - DNA, 18 bp, Artificial Sequence
  Synthetic DNA
tattacgacttaccaaag

SEQ ID NO: 33618 - DNA, 18 bp, Artificial Sequence
  Synthetic DNA
tattacgatatactatag

SEQ ID NO: 33619 - DNA, 18 bp, Artificial Sequence
  Synthetic DNA
tattactacacaccatag

SEQ ID NO: 33620 - DNA, 18 bp, Artificial Sequence
  Synthetic DNA
tcatacgacttacttaag

SEQ ID NO: 33621 - DNA, 18 bp, Artificial Sequence
  Synthetic DNA
tcatacgactttatatag

SEQ ID NO: 33622 - DNA, 18 bp, Artificial Sequence
  Synthetic DNA
tgaaactactcacaatag

SEQ ID NO: 33623 - DNA, 18 bp, Artificial Sequence
  Synthetic DNA
tgaaacttctcactatag

SEQ ID NO: 33624 - DNA, 18 bp, Artificial Sequence
  Synthetic DNA
ttaaaccacacactatag

SEQ ID NO: 33625 - DNA, 18 bp, Artificial Sequence
  Synthetic DNA
ttatacgatactctatag

SEQ ID NO: 33626 - DNA, 18 bp, Artificial Sequence
  Synthetic DNA
ttatacgccactctatag

SEQ ID NO: 33627 - DNA, 18 bp, Artificial Sequence
  Synthetic DNA
ttatacgtcttactctag

SEQ ID NO: 33628 - DNA, 18 bp, Artificial Sequence
  Synthetic DNA
ttatccgtctcaatatag

SEQ ID NO: 33629 - DNA, 18 bp, Artificial Sequence
  Synthetic DNA
ttctaagactcactttag

SEQ ID NO: 33630 - DNA, 18 bp, Artificial Sequence
  Synthetic DNA
ttgcacgtctcactatag

SEQ ID NO: 33631 - DNA, 18 bp, Artificial Sequence
  Synthetic DNA
ttttacgtctcaatatag

SEQ ID NO: 33632 - DNA, 18 bp, Artificial Sequence
  Synthetic DNA
ttttgcaactcactatag

SEQ ID NO: 33633 - DNA, 18 bp, Artificial Sequence
  Synthetic DNA
taatacaactcacatttg

SEQ ID NO: 33634 - DNA, 18 bp, Artificial Sequence
  Synthetic DNA
taatacgaatctcttaag

SEQ ID NO: 33635 - DNA, 18 bp, Artificial Sequence
  Synthetic DNA
tattacgacactttatag

SEQ ID NO: 33636 - DNA, 18 bp, Artificial Sequence
  Synthetic DNA
tattacgtctctctaaag

SEQ ID NO: 33637 - DNA, 18 bp, Artificial Sequence
  Synthetic DNA
ttatacttctcacaatag

SEQ ID NO: 33638 - DNA, 18 bp, Artificial Sequence
  Synthetic DNA
taattcgattcacttttg

SEQ ID NO: 33639 - DNA, 18 bp, Artificial Sequence
  Synthetic DNA
taattctattcactattg

SEQ ID NO: 33640 - DNA, 18 bp, Artificial Sequence
  Synthetic DNA
aaaaacgactcattattg

SEQ ID NO: 33641 - DNA, 18 bp, Artificial Sequence
  Synthetic DNA
aaatttgactcactaaag

SEQ ID NO: 33642 - DNA, 18 bp, Artificial Sequence
  Synthetic DNA
aagtacgactcacaattg

SEQ ID NO: 33643 - DNA, 18 bp, Artificial Sequence
  Synthetic DNA
atataccactcactattg

SEQ ID NO: 33644 - DNA, 18 bp, Artificial Sequence
  Synthetic DNA
taaaacgtctaactattg

SEQ ID NO: 33645 - DNA, 18 bp, Artificial Sequence
  Synthetic DNA
taaatcgattcacaatag

SEQ ID NO: 33646 - DNA, 18 bp, Artificial Sequence
  Synthetic DNA
taatacctctcacttttg

SEQ ID NO: 33647 - DNA, 18 bp, Artificial Sequence
  Synthetic DNA
taatacgactctccaatg

SEQ ID NO: 33648 - DNA, 18 bp, Artificial Sequence
  Synthetic DNA
taatacgtctcattaatg

SEQ ID NO: 33649 - DNA, 18 bp, Artificial Sequence
  Synthetic DNA
taattcgactctacatag

SEQ ID NO: 33650 - DNA, 18 bp, Artificial Sequence
  Synthetic DNA
taattcgtcccattatag

SEQ ID NO: 33651 - DNA, 18 bp, Artificial Sequence
  Synthetic DNA
taattcgtctaactatcg

SEQ ID NO: 33652 - DNA, 18 bp, Artificial Sequence
  Synthetic DNA
taattcgtctcacaaaag

SEQ ID NO: 33653 - DNA, 18 bp, Artificial Sequence
  Synthetic DNA
tatatcgaatcactatag

SEQ ID NO: 33654 - DNA, 18 bp, Artificial Sequence
  Synthetic DNA
tattacgactaaatattg

SEQ ID NO: 33655 - DNA, 18 bp, Artificial Sequence
  Synthetic DNA
tatttcgacacattatag

SEQ ID NO: 33656 - DNA, 18 bp, Artificial Sequence
  Synthetic DNA
tattttgtctcactatag

SEQ ID NO: 33657 - DNA, 18 bp, Artificial Sequence
  Synthetic DNA
ttatacggctcacttttg

SEQ ID NO: 33658 - DNA, 18 bp, Artificial Sequence
  Synthetic DNA
ttatactcctcactattg

SEQ ID NO: 33659 - DNA, 18 bp, Artificial Sequence
  Synthetic DNA
aaatacgactctccttag

SEQ ID NO: 33660 - DNA, 18 bp, Artificial Sequence
  Synthetic DNA
aaatactattcaatatag

SEQ ID NO: 33661 - DNA, 18 bp, Artificial Sequence
  Synthetic DNA
aaatatgacttacaatag

SEQ ID NO: 33662 - DNA, 18 bp, Artificial Sequence
  Synthetic DNA
aaatatgtctcattatag

SEQ ID NO: 33663 - DNA, 18 bp, Artificial Sequence
  Synthetic DNA
aataactactcactatag

SEQ ID NO: 33664 - DNA, 18 bp, Artificial Sequence
  Synthetic DNA
aattacgactcactttcg

SEQ ID NO: 33665 - DNA, 18 bp, Artificial Sequence
  Synthetic DNA
aattacgacttacaatag

SEQ ID NO: 33666 - DNA, 18 bp, Artificial Sequence
  Synthetic DNA
aattacgtctgactatag

SEQ ID NO: 33667 - DNA, 18 bp, Artificial Sequence
  Synthetic DNA
atacacgactcactttag

SEQ ID NO: 33668 - DNA, 18 bp, Artificial Sequence
  Synthetic DNA
atatacgactaactttag

SEQ ID NO: 33669 - DNA, 18 bp, Artificial Sequence
  Synthetic DNA
atctacgattcactatag

SEQ ID NO: 33670 - DNA, 18 bp, Artificial Sequence
  Synthetic DNA
atgtacgactcattatag

SEQ ID NO: 33671 - DNA, 18 bp, Artificial Sequence
  Synthetic DNA
caatacaacttactaaag

SEQ ID NO: 33672 - DNA, 18 bp, Artificial Sequence
  Synthetic DNA
taaaaacactctctatag

SEQ ID NO: 33673 - DNA, 18 bp, Artificial Sequence
  Synthetic DNA
taaaacgaattacaatag

SEQ ID NO: 33674 - DNA, 18 bp, Artificial Sequence
  Synthetic DNA
taaaacgccttactttag

SEQ ID NO: 33675 - DNA, 18 bp, Artificial Sequence
  Synthetic DNA
taaaacgtcacactttag

SEQ ID NO: 33676 - DNA, 18 bp, Artificial Sequence
  Synthetic DNA
taaaacttctaactatag

SEQ ID NO: 33677 - DNA, 18 bp, Artificial Sequence
  Synthetic DNA
taacaaaactcacaatag

SEQ ID NO: 33678 - DNA, 18 bp, Artificial Sequence
  Synthetic DNA
taacacgtatcactttag

SEQ ID NO: 33679 - DNA, 18 bp, Artificial Sequence
  Synthetic DNA
taatacaacacactcaag

SEQ ID NO: 33680 - DNA, 18 bp, Artificial Sequence
  Synthetic DNA
taatacgactcacatacg

SEQ ID NO: 33681 - DNA, 18 bp, Artificial Sequence
  Synthetic DNA
taatacgactctcattac

SEQ ID NO: 33682 - DNA, 18 bp, Artificial Sequence
  Synthetic DNA
taatacgtatctctaaag

SEQ ID NO: 33683 - DNA, 18 bp, Artificial Sequence
  Synthetic DNA
taatacgtcacacttaag

SEQ ID NO: 33684 - DNA, 18 bp, Artificial Sequence
  Synthetic DNA
taatactaatctttatag

SEQ ID NO: 33685 - DNA, 18 bp, Artificial Sequence
  Synthetic DNA
taatactactctcttaag

SEQ ID NO: 33686 - DNA, 18 bp, Artificial Sequence
  Synthetic DNA
taatacttctctatatag

SEQ ID NO: 33687 - DNA, 18 bp, Artificial Sequence
  Synthetic DNA
taatatgactctcaaaag

SEQ ID NO: 33688 - DNA, 18 bp, Artificial Sequence
  Synthetic DNA
taatatgacttacaaaag

SEQ ID NO: 33689 - DNA, 18 bp, Artificial Sequence
  Synthetic DNA
taatgcgacactctaaag

SEQ ID NO: 33690 - DNA, 18 bp, Artificial Sequence
  Synthetic DNA
taatgtgactcacttaag

SEQ ID NO: 33691 - DNA, 18 bp, Artificial Sequence
  Synthetic DNA
tactacgtctcactcaag

SEQ ID NO: 33692 - DNA, 18 bp, Artificial Sequence
  Synthetic DNA
tattaagacacactacag

SEQ ID NO: 33693 - DNA, 18 bp, Artificial Sequence
  Synthetic DNA
tattaagactttctatag

SEQ ID NO: 33694 - DNA, 18 bp, Artificial Sequence
  Synthetic DNA
tattacgaaacactaaag

SEQ ID NO: 33695 - DNA, 18 bp, Artificial Sequence
  Synthetic DNA
tattacgactctaaatag

SEQ ID NO: 33696 - DNA, 18 bp, Artificial Sequence
  Synthetic DNA
tattacgattctttatag

SEQ ID NO: 33697 - DNA, 18 bp, Artificial Sequence
  Synthetic DNA
tattactattcactatgg

SEQ ID NO: 33698 - DNA, 18 bp, Artificial Sequence
  Synthetic DNA
tattatgacttactacag

SEQ ID NO: 33699 - DNA, 18 bp, Artificial Sequence
  Synthetic DNA
tgaagcgactcactttag

SEQ ID NO: 33700 - DNA, 18 bp, Artificial Sequence
  Synthetic DNA
tgctacttctcactatag

SEQ ID NO: 33701 - DNA, 18 bp, Artificial Sequence
  Synthetic DNA
tgttacgactctttatag

SEQ ID NO: 33702 - DNA, 18 bp, Artificial Sequence
  Synthetic DNA
ttaaaagacacactatag

SEQ ID NO: 33703 - DNA, 18 bp, Artificial Sequence
  Synthetic DNA
ttaaaagactcactttag

SEQ ID NO: 33704 - DNA, 18 bp, Artificial Sequence
  Synthetic DNA
ttataagattcacaatag

SEQ ID NO: 33705 - DNA, 18 bp, Artificial Sequence
  Synthetic DNA
ttataatactcactaaag

SEQ ID NO: 33706 - DNA, 18 bp, Artificial Sequence
  Synthetic DNA
ttatacatctcattatag

SEQ ID NO: 33707 - DNA, 18 bp, Artificial Sequence
  Synthetic DNA
ttataccacaccctatag

SEQ ID NO: 33708 - DNA, 18 bp, Artificial Sequence
  Synthetic DNA
ttatacgacacattaaag

SEQ ID NO: 33709 - DNA, 18 bp, Artificial Sequence
  Synthetic DNA
ttatacgactcattttgg

SEQ ID NO: 33710 - DNA, 18 bp, Artificial Sequence
  Synthetic DNA
ttatacgactctcactag

SEQ ID NO: 33711 - DNA, 18 bp, Artificial Sequence
  Synthetic DNA
ttataggacatactatag

SEQ ID NO: 33712 - DNA, 18 bp, Artificial Sequence
  Synthetic DNA
ttatatgcctcactaaag

SEQ ID NO: 33713 - DNA, 18 bp, Artificial Sequence
  Synthetic DNA
tttaactactcactatag

SEQ ID NO: 33714 - DNA, 18 bp, Artificial Sequence
  Synthetic DNA
ttttaatactcactatag

SEQ ID NO: 33715 - DNA, 18 bp, Artificial Sequence
  Synthetic DNA
ttttacgaatcacaatag

SEQ ID NO: 33716 - DNA, 18 bp, Artificial Sequence
  Synthetic DNA
taatacgactatcattag

SEQ ID NO: 33717 - DNA, 18 bp, Artificial Sequence
  Synthetic DNA
taattctactcacaattg

SEQ ID NO: 33718 - DNA, 18 bp, Artificial Sequence
  Synthetic DNA
aaatacgaatcactaatg

SEQ ID NO: 33719 - DNA, 18 bp, Artificial Sequence
  Synthetic DNA
aaatacttctcactattg

SEQ ID NO: 33720 - DNA, 18 bp, Artificial Sequence
  Synthetic DNA
aattacgacttgctatag

SEQ ID NO: 33721 - DNA, 18 bp, Artificial Sequence
  Synthetic DNA
ctatacgtctcactattg

SEQ ID NO: 33722 - DNA, 18 bp, Artificial Sequence
  Synthetic DNA
taaaacgactgtctattg

SEQ ID NO: 33723 - DNA, 18 bp, Artificial Sequence
  Synthetic DNA
taactcaactcactaaag

SEQ ID NO: 33724 - DNA, 18 bp, Artificial Sequence
  Synthetic DNA
taatacctctcactgttg

SEQ ID NO: 33725 - DNA, 18 bp, Artificial Sequence
  Synthetic DNA
taatacgaatttctattg

SEQ ID NO: 33726 - DNA, 18 bp, Artificial Sequence
  Synthetic DNA
taatacgattccatattg

SEQ ID NO: 33727 - DNA, 18 bp, Artificial Sequence
  Synthetic DNA
taatacgtctcacagttg

SEQ ID NO: 33728 - DNA, 18 bp, Artificial Sequence
  Synthetic DNA
taatacgtctctttattg

SEQ ID NO: 33729 - DNA, 18 bp, Artificial Sequence
  Synthetic DNA
taatactaatctctattg

SEQ ID NO: 33730 - DNA, 18 bp, Artificial Sequence
  Synthetic DNA
taatacttctcaatattg

SEQ ID NO: 33731 - DNA, 18 bp, Artificial Sequence
  Synthetic DNA
taatgcgaatcacaattg

SEQ ID NO: 33732 - DNA, 18 bp, Artificial Sequence
  Synthetic DNA
taattcctctctctatag

SEQ ID NO: 33733 - DNA, 18 bp, Artificial Sequence
  Synthetic DNA
taattcgacaaattatag

SEQ ID NO: 33734 - DNA, 18 bp, Artificial Sequence
  Synthetic DNA
taattcgatccactaaag

SEQ ID NO: 33735 - DNA, 18 bp, Artificial Sequence
  Synthetic DNA
taattcgattcactgtcg

SEQ ID NO: 33736 - DNA, 18 bp, Artificial Sequence
  Synthetic DNA
taattcgcctcaatatgg

SEQ ID NO: 33737 - DNA, 18 bp, Artificial Sequence
  Synthetic DNA
taattctactcactaacg

SEQ ID NO: 33738 - DNA, 18 bp, Artificial Sequence
  Synthetic DNA
taattctactctctttag

SEQ ID NO: 33739 - DNA, 18 bp, Artificial Sequence
  Synthetic DNA
tacttcaactcactttag

SEQ ID NO: 33740 - DNA, 18 bp, Artificial Sequence
  Synthetic DNA
tattacgacacactagtg

SEQ ID NO: 33741 - DNA, 18 bp, Artificial Sequence
  Synthetic DNA
tatttcgaataactatag

SEQ ID NO: 33742 - DNA, 18 bp, Artificial Sequence
  Synthetic DNA
ttatacgacacaatattg

SEQ ID NO: 33743 - DNA, 18 bp, Artificial Sequence
  Synthetic DNA
ttattccattcactatag

SEQ ID NO: 33744 - DNA, 18 bp, Artificial Sequence
  Synthetic DNA
ttattctactcactagag

SEQ ID NO: 33745 - DNA, 18 bp, Artificial Sequence
  Synthetic DNA
caatacaactcaaaatag

SEQ ID NO: 33746 - DNA, 18 bp, Artificial Sequence
  Synthetic DNA
caatacgactctcattag

SEQ ID NO: 33747 - DNA, 18 bp, Artificial Sequence
  Synthetic DNA
ctataagactcactttag

SEQ ID NO: 33748 - DNA, 18 bp, Artificial Sequence
  Synthetic DNA
taaaacgaccctctaaag

SEQ ID NO: 33749 - DNA, 18 bp, Artificial Sequence
  Synthetic DNA
taataacacccactttag

SEQ ID NO: 33750 - DNA, 18 bp, Artificial Sequence
  Synthetic DNA
taataagtctctctaaag

SEQ ID NO: 33751 - DNA, 18 bp, Artificial Sequence
  Synthetic DNA
taatacaactcttaatag

SEQ ID NO: 33752 - DNA, 18 bp, Artificial Sequence
  Synthetic DNA
taatacgaaacacattag

SEQ ID NO: 33753 - DNA, 18 bp, Artificial Sequence
  Synthetic DNA
taatacgactcatttagg

SEQ ID NO: 33754 - DNA, 18 bp, Artificial Sequence
  Synthetic DNA
taatacgtctcatattag

SEQ ID NO: 33755 - DNA, 18 bp, Artificial Sequence
  Synthetic DNA
taatactactaaaaatag

SEQ ID NO: 33756 - DNA, 18 bp, Artificial Sequence
  Synthetic DNA
taatacttctaactaaag

SEQ ID NO: 33757 - DNA, 18 bp, Artificial Sequence
  Synthetic DNA
taatatgacactttatag

SEQ ID NO: 33758 - DNA, 18 bp, Artificial Sequence
  Synthetic DNA
taatgcgactttctttag

SEQ ID NO: 33759 - DNA, 18 bp, Artificial Sequence
  Synthetic DNA
tacaacgtctcattatag

SEQ ID NO: 33760 - DNA, 18 bp, Artificial Sequence
  Synthetic DNA
tactacgtctctctaaag

SEQ ID NO: 33761 - DNA, 18 bp, Artificial Sequence
  Synthetic DNA
tataactactcattatag

SEQ ID NO: 33762 - DNA, 18 bp, Artificial Sequence
  Synthetic DNA
tattaagactcaataaag

SEQ ID NO: 33763 - DNA, 18 bp, Artificial Sequence
  Synthetic DNA
tattacaattcactacag

SEQ ID NO: 33764 - DNA, 18 bp, Artificial Sequence
  Synthetic DNA
tattacgacacattttag

SEQ ID NO: 33765 - DNA, 18 bp, Artificial Sequence
  Synthetic DNA
tattactactcattaaag

SEQ ID NO: 33766 - DNA, 18 bp, Artificial Sequence
  Synthetic DNA
tcatacgacacacttaag

SEQ ID NO: 33767 - DNA, 18 bp, Artificial Sequence
  Synthetic DNA
tgatacgtctctcaatag

SEQ ID NO: 33768 - DNA, 18 bp, Artificial Sequence
  Synthetic DNA
ttataagtctaactatag

SEQ ID NO: 33769 - DNA, 18 bp, Artificial Sequence
  Synthetic DNA
ttatacctctcactaaag

SEQ ID NO: 33770 - DNA, 18 bp, Artificial Sequence
  Synthetic DNA
ttatacgacaccctttag

SEQ ID NO: 33771 - DNA, 18 bp, Artificial Sequence
  Synthetic DNA
ttatacgacttattatgg

SEQ ID NO: 33772 - DNA, 18 bp, Artificial Sequence
  Synthetic DNA
ttatactacacactatgg

SEQ ID NO: 33773 - DNA, 18 bp, Artificial Sequence
  Synthetic DNA
taaatcgactcacaaaag

SEQ ID NO: 33774 - DNA, 18 bp, Artificial Sequence
  Synthetic DNA
ttatacgattcattattg

SEQ ID NO: 33775 - DNA, 18 bp, Artificial Sequence
  Synthetic DNA
ttttttgactcactatag

SEQ ID NO: 33776 - DNA, 18 bp, Artificial Sequence
  Synthetic DNA
tataactactcaatatag

SEQ ID NO: 33777 - DNA, 18 bp, Artificial Sequence
  Synthetic DNA
taattcgtctcactcttg

SEQ ID NO: 33778 - DNA, 18 bp, Artificial Sequence
  Synthetic DNA
tcattcaactcactattg

SEQ ID NO: 33779 - DNA, 18 bp, Artificial Sequence
  Synthetic DNA
aaatacgactcattactg

SEQ ID NO: 33780 - DNA, 18 bp, Artificial Sequence
  Synthetic DNA
aaattcaattcactatag

SEQ ID NO: 33781 - DNA, 18 bp, Artificial Sequence
  Synthetic DNA
atattcgactcaatatag

SEQ ID NO: 33782 - DNA, 18 bp, Artificial Sequence
  Synthetic DNA
caattcgacacattatag

SEQ ID NO: 33783 - DNA, 18 bp, Artificial Sequence
  Synthetic DNA
taaaacgacttacttttg

SEQ ID NO: 33784 - DNA, 18 bp, Artificial Sequence
  Synthetic DNA
taaaacgactttctattg

SEQ ID NO: 33785 - DNA, 18 bp, Artificial Sequence
  Synthetic DNA
taaattgtctcactatag

SEQ ID NO: 33786 - DNA, 18 bp, Artificial Sequence
  Synthetic DNA
taataagacttactaatg

SEQ ID NO: 33787 - DNA, 18 bp, Artificial Sequence
  Synthetic DNA
taatacaactcacaactg

SEQ ID NO: 33788 - DNA, 18 bp, Artificial Sequence
  Synthetic DNA
taatacaactctcttttg

SEQ ID NO: 33789 - DNA, 18 bp, Artificial Sequence
  Synthetic DNA
taatacgactaccttttg

SEQ ID NO: 33790 - DNA, 18 bp, Artificial Sequence
  Synthetic DNA
taatacgtctaactcttg

SEQ ID NO: 33791 - DNA, 18 bp, Artificial Sequence
  Synthetic DNA
taatactactcacctttg

SEQ ID NO: 33792 - DNA, 18 bp, Artificial Sequence
  Synthetic DNA
taatacttatcactattg

SEQ ID NO: 33793 - DNA, 18 bp, Artificial Sequence
  Synthetic DNA
taattcgaatcattttag

SEQ ID NO: 33794 - DNA, 18 bp, Artificial Sequence
  Synthetic DNA
taattcgactaaataaag

SEQ ID NO: 33795 - DNA, 18 bp, Artificial Sequence
  Synthetic DNA
taattcgtttcactctag

SEQ ID NO: 33796 - DNA, 18 bp, Artificial Sequence
  Synthetic DNA
taattctacatactatag

SEQ ID NO: 33797 - DNA, 18 bp, Artificial Sequence
  Synthetic DNA
tattacgaatcactaatg

SEQ ID NO: 33798 - DNA, 18 bp, Artificial Sequence
  Synthetic DNA
tattacgaattgctatag

SEQ ID NO: 33799 - DNA, 18 bp, Artificial Sequence
  Synthetic DNA
tattactacttactattg

SEQ ID NO: 33800 - DNA, 18 bp, Artificial Sequence
  Synthetic DNA
tattccgactcacaattg

SEQ ID NO: 33801 - DNA, 18 bp, Artificial Sequence
  Synthetic DNA
tattttgactcactatgg

SEQ ID NO: 33802 - DNA, 18 bp, Artificial Sequence
  Synthetic DNA
ttatacgacttattattg

SEQ ID NO: 33803 - DNA, 18 bp, Artificial Sequence
  Synthetic DNA
ttatacgactttctattg

SEQ ID NO: 33804 - DNA, 18 bp, Artificial Sequence
  Synthetic DNA
ttattagaatcactatag

SEQ ID NO: 33805 - DNA, 18 bp, Artificial Sequence
  Synthetic DNA
aaatacatctcaatatag

SEQ ID NO: 33806 - DNA, 18 bp, Artificial Sequence
  Synthetic DNA
aaatacgaatctctaaag

SEQ ID NO: 33807 - DNA, 18 bp, Artificial Sequence
  Synthetic DNA
aagtacgattcactaaag

SEQ ID NO: 33808 - DNA, 18 bp, Artificial Sequence
  Synthetic DNA
aattacgattcactaaag

SEQ ID NO: 33809 - DNA, 18 bp, Artificial Sequence
  Synthetic DNA
atttacgactcactatgg

SEQ ID NO: 33810 - DNA, 18 bp, Artificial Sequence
  Synthetic DNA
taaaacgtttcactaaag

SEQ ID NO: 33811 - DNA, 18 bp, Artificial Sequence
  Synthetic DNA
taaaatgtttcactatag

SEQ ID NO: 33812 - DNA, 18 bp, Artificial Sequence
  Synthetic DNA
taatacctctctctttag

SEQ ID NO: 33813 - DNA, 18 bp, Artificial Sequence
  Synthetic DNA
taatacgtctcacttagg

SEQ ID NO: 33814 - DNA, 18 bp, Artificial Sequence
  Synthetic DNA
taatacgttacactaaag

SEQ ID NO: 33815 - DNA, 18 bp, Artificial Sequence
  Synthetic DNA
taatacttctcacagtag

SEQ ID NO: 33816 - DNA, 18 bp, Artificial Sequence
  Synthetic DNA
taatccgtctcacaaaag

SEQ ID NO: 33817 - DNA, 18 bp, Artificial Sequence
  Synthetic DNA
tactacgtctctcaatag

SEQ ID NO: 33818 - DNA, 18 bp, Artificial Sequence
  Synthetic DNA
tagtacatcacactatag

SEQ ID NO: 33819 - DNA, 18 bp, Artificial Sequence
  Synthetic DNA
tataacgactaactacag

SEQ ID NO: 33820 - DNA, 18 bp, Artificial Sequence
  Synthetic DNA
tataacgattaactatag

SEQ ID NO: 33821 - DNA, 18 bp, Artificial Sequence
  Synthetic DNA
tataacgcctaactatag

SEQ ID NO: 33822 - DNA, 18 bp, Artificial Sequence
  Synthetic DNA
tataactactcactaaag

SEQ ID NO: 33823 - DNA, 18 bp, Artificial Sequence
  Synthetic DNA
tatcatgtctcactatag

SEQ ID NO: 33824 - DNA, 18 bp, Artificial Sequence
  Synthetic DNA
tattacgacactctacag

SEQ ID NO: 33825 - DNA, 18 bp, Artificial Sequence
  Synthetic DNA
tattacgactaaatacag

SEQ ID NO: 33826 - DNA, 18 bp, Artificial Sequence
  Synthetic DNA
tattacgattcaataaag

SEQ ID NO: 33827 - DNA, 18 bp, Artificial Sequence
  Synthetic DNA
tattacgattcataatag

SEQ ID NO: 33828 - DNA, 18 bp, Artificial Sequence
  Synthetic DNA
tattacgtctctctatcg

SEQ ID NO: 33829 - DNA, 18 bp, Artificial Sequence
  Synthetic DNA
tattactacacattatag

SEQ ID NO: 33830 - DNA, 18 bp, Artificial Sequence
  Synthetic DNA
tattactactctcaatag

SEQ ID NO: 33831 - DNA, 18 bp, Artificial Sequence
  Synthetic DNA
tattccgactcaatttag

SEQ ID NO: 33832 - DNA, 18 bp, Artificial Sequence
  Synthetic DNA
ttataagtcttactatag

SEQ ID NO: 33833 - DNA, 18 bp, Artificial Sequence
  Synthetic DNA
ttataccacatactatag

SEQ ID NO: 33834 - DNA, 18 bp, Artificial Sequence
  Synthetic DNA
ttatacgaaatactatag

SEQ ID NO: 33835 - DNA, 18 bp, Artificial Sequence
  Synthetic DNA
ttatacgaatctctctag

SEQ ID NO: 33836 - DNA, 18 bp, Artificial Sequence
  Synthetic DNA
tttaacgactctctatag

SEQ ID NO: 33837 - DNA, 18 bp, Artificial Sequence
  Synthetic DNA
tatttcgactctctaaag

SEQ ID NO: 33838 - DNA, 18 bp, Artificial Sequence
  Synthetic DNA
taatacgtttcactaatg

SEQ ID NO: 33839 - DNA, 18 bp, Artificial Sequence
  Synthetic DNA
taatacgtcaaactttag

SEQ ID NO: 33840 - DNA, 18 bp, Artificial Sequence
  Synthetic DNA
taatacgtctttctaaag

SEQ ID NO: 33841 - DNA, 18 bp, Artificial Sequence
  Synthetic DNA
tattacgtctcaccaaag

SEQ ID NO: 33842 - DNA, 18 bp, Artificial Sequence
  Synthetic DNA
ttatacttcacactatag

SEQ ID NO: 33843 - DNA, 18 bp, Artificial Sequence
  Synthetic DNA
taattagaatcactattg

SEQ ID NO: 33844 - DNA, 18 bp, Artificial Sequence
  Synthetic DNA
tagtttgactcactattg

SEQ ID NO: 33845 - DNA, 18 bp, Artificial Sequence
  Synthetic DNA
ttattcgactcaatattg

SEQ ID NO: 33846 - DNA, 18 bp, Artificial Sequence
  Synthetic DNA
aattacgacacactattg

SEQ ID NO: 33847 - DNA, 18 bp, Artificial Sequence
  Synthetic DNA
taatacaacacactactg

SEQ ID NO: 33848 - DNA, 18 bp, Artificial Sequence
  Synthetic DNA
taatacctctcactaatg

SEQ ID NO: 33849 - DNA, 18 bp, Artificial Sequence
  Synthetic DNA
taatacgacacacttatg

SEQ ID NO: 33850 - DNA, 18 bp, Artificial Sequence
  Synthetic DNA
taatacgattctctaatg

SEQ ID NO: 33851 - DNA, 18 bp, Artificial Sequence
  Synthetic DNA
taatactactctcaattg

SEQ ID NO: 33852 - DNA, 18 bp, Artificial Sequence
  Synthetic DNA
taatactattcacgattg

SEQ ID NO: 33853 - DNA, 18 bp, Artificial Sequence
  Synthetic DNA
taatatgacacacaattg

SEQ ID NO: 33854 - DNA, 18 bp, Artificial Sequence
  Synthetic DNA
taattatactcactttag

SEQ ID NO: 33855 - DNA, 18 bp, Artificial Sequence
  Synthetic DNA
taattcatctcactaaag

SEQ ID NO: 33856 - DNA, 18 bp, Artificial Sequence
  Synthetic DNA
taattcgactttctaaag

SEQ ID NO: 33857 - DNA, 18 bp, Artificial Sequence
  Synthetic DNA
taattcgtttaactatag

SEQ ID NO: 33858 - DNA, 18 bp, Artificial Sequence
  Synthetic DNA
taatttgactcacttcag

SEQ ID NO: 33859 - DNA, 18 bp, Artificial Sequence
  Synthetic DNA
tcatgcgactcacttttg

SEQ ID NO: 33860 - DNA, 18 bp, Artificial Sequence
  Synthetic DNA
tgatacgtctcactgttg

SEQ ID NO: 33861 - DNA, 18 bp, Artificial Sequence
  Synthetic DNA
ttaatcgattcactatag

SEQ ID NO: 33862 - DNA, 18 bp, Artificial Sequence
  Synthetic DNA
ttatacgcctcacttttg

SEQ ID NO: 33863 - DNA, 18 bp, Artificial Sequence
  Synthetic DNA
ttattcgaatcactatcg

SEQ ID NO: 33864 - DNA, 18 bp, Artificial Sequence
  Synthetic DNA
aacaacgactctctatag

SEQ ID NO: 33865 - DNA, 18 bp, Artificial Sequence
  Synthetic DNA
aattacgactccctttag

SEQ ID NO: 33866 - DNA, 18 bp, Artificial Sequence
  Synthetic DNA
aattacgactctttatag

SEQ ID NO: 33867 - DNA, 18 bp, Artificial Sequence
  Synthetic DNA
ataaacgactcaatatag

SEQ ID NO: 33868 - DNA, 18 bp, Artificial Sequence
  Synthetic DNA
atatacgtatcactatag

SEQ ID NO: 33869 - DNA, 18 bp, Artificial Sequence
  Synthetic DNA
caatgcgtctcactttag

SEQ ID NO: 33870 - DNA, 18 bp, Artificial Sequence
  Synthetic DNA
taaaacatctcactaaag

SEQ ID NO: 33871 - DNA, 18 bp, Artificial Sequence
  Synthetic DNA
taaaacgactaacaaaag

SEQ ID NO: 33872 - DNA, 18 bp, Artificial Sequence
  Synthetic DNA
taaaactaaacactatag

SEQ ID NO: 33873 - DNA, 18 bp, Artificial Sequence
  Synthetic DNA
taatacaaaacactaaag

SEQ ID NO: 33874 - DNA, 18 bp, Artificial Sequence
  Synthetic DNA
taatacaaatctctttag

SEQ ID NO: 33875 - DNA, 18 bp, Artificial Sequence
  Synthetic DNA
taatacgaatctcttcag

SEQ ID NO: 33876 - DNA, 18 bp, Artificial Sequence
  Synthetic DNA
taatacgatatacaatag

SEQ ID NO: 33877 - DNA, 18 bp, Artificial Sequence
  Synthetic DNA
taatacgattttctctag

SEQ ID NO: 33878 - DNA, 18 bp, Artificial Sequence
  Synthetic DNA
taatacgtatcactttcg

SEQ ID NO: 33879 - DNA, 18 bp, Artificial Sequence
  Synthetic DNA
taatacgtcagattatag

SEQ ID NO: 33880 - DNA, 18 bp, Artificial Sequence
  Synthetic DNA
taatacgtctcacagaag

SEQ ID NO: 33881 - DNA, 18 bp, Artificial Sequence
  Synthetic DNA
taatactactctatttag

SEQ ID NO: 33882 - DNA, 18 bp, Artificial Sequence
  Synthetic DNA
taataggtctcacttcag

SEQ ID NO: 33883 - DNA, 18 bp, Artificial Sequence
  Synthetic DNA
taatgctactctcaatag

SEQ ID NO: 33884 - DNA, 18 bp, Artificial Sequence
  Synthetic DNA
tattaccaaacactatag

SEQ ID NO: 33885 - DNA, 18 bp, Artificial Sequence
  Synthetic DNA
tattacgtatcacaatag

SEQ ID NO: 33886 - DNA, 18 bp, Artificial Sequence
  Synthetic DNA
tattactacttactaaag

SEQ ID NO: 33887 - DNA, 18 bp, Artificial Sequence
  Synthetic DNA
tgatacaacttacaatag

SEQ ID NO: 33888 - DNA, 18 bp, Artificial Sequence
  Synthetic DNA
ttaaacaattcactatag

SEQ ID NO: 33889 - DNA, 18 bp, Artificial Sequence
  Synthetic DNA
ttaaacgattcaatatag

SEQ ID NO: 33890 - DNA, 18 bp, Artificial Sequence
  Synthetic DNA
ttacacgactcacaaaag

SEQ ID NO: 33891 - DNA, 18 bp, Artificial Sequence
  Synthetic DNA
ttataagactctctaaag

SEQ ID NO: 33892 - DNA, 18 bp, Artificial Sequence
  Synthetic DNA
ttatacaactctctatcg

SEQ ID NO: 33893 - DNA, 18 bp, Artificial Sequence
  Synthetic DNA
ttatacgtctcaaaatag

SEQ ID NO: 33894 - DNA, 18 bp, Artificial Sequence
  Synthetic DNA
ttatacgtctcacaacag

SEQ ID NO: 33895 - DNA, 18 bp, Artificial Sequence
  Synthetic DNA
ttttacggctcactttag

SEQ ID NO: 33896 - DNA, 18 bp, Artificial Sequence
  Synthetic DNA
ttttccgactcactaaag

SEQ ID NO: 33897 - DNA, 18 bp, Artificial Sequence
  Synthetic DNA
atttacgtctcactatag

SEQ ID NO: 33898 - DNA, 18 bp, Artificial Sequence
  Synthetic DNA
taattcgattctctattg

SEQ ID NO: 33899 - DNA, 18 bp, Artificial Sequence
  Synthetic DNA
taatacgattcacatttg

SEQ ID NO: 33900 - DNA, 18 bp, Artificial Sequence
  Synthetic DNA
tattacgtctcacttttg

SEQ ID NO: 33901 - DNA, 18 bp, Artificial Sequence
  Synthetic DNA
taatacgtcactcaatag

SEQ ID NO: 33902 - DNA, 18 bp, Artificial Sequence
  Synthetic DNA
aaatacgactgaatattg

SEQ ID NO: 33903 - DNA, 18 bp, Artificial Sequence
  Synthetic DNA
aaatacgtcacactattg

SEQ ID NO: 33904 - DNA, 18 bp, Artificial Sequence
  Synthetic DNA
ctattcgactcacaatag

SEQ ID NO: 33905 - DNA, 18 bp, Artificial Sequence
  Synthetic DNA
taaatctactctctatag

SEQ ID NO: 33906 - DNA, 18 bp, Artificial Sequence
  Synthetic DNA
taactcgactcacattag

SEQ ID NO: 33907 - DNA, 18 bp, Artificial Sequence
  Synthetic DNA
taattagtcacactatag

SEQ ID NO: 33908 - DNA, 18 bp, Artificial Sequence
  Synthetic DNA
taattagtctcactaaag

SEQ ID NO: 33909 - DNA, 18 bp, Artificial Sequence
  Synthetic DNA
taattcgattaaatatag

SEQ ID NO: 33910 - DNA, 18 bp, Artificial Sequence
  Synthetic DNA
taattcgattctctaaag

SEQ ID NO: 33911 - DNA, 18 bp, Artificial Sequence
  Synthetic DNA
tactacgtctcacttttg

SEQ ID NO: 33912 - DNA, 18 bp, Artificial Sequence
  Synthetic DNA
tattaagacttactattg

SEQ ID NO: 33913 - DNA, 18 bp, Artificial Sequence
  Synthetic DNA
tattacgtctcaatattg

SEQ ID NO: 33914 - DNA, 18 bp, Artificial Sequence
  Synthetic DNA
tattacgtctcgcaatag

SEQ ID NO: 33915 - DNA, 18 bp, Artificial Sequence
  Synthetic DNA
tatttcaaatcactatag

SEQ ID NO: 33916 - DNA, 18 bp, Artificial Sequence
  Synthetic DNA
tatttcgaatcacaatag

SEQ ID NO: 33917 - DNA, 18 bp, Artificial Sequence
  Synthetic DNA
ttataccactcactaatg

SEQ ID NO: 33918 - DNA, 18 bp, Artificial Sequence
  Synthetic DNA
ttatacgattcaatattg

SEQ ID NO: 33919 - DNA, 18 bp, Artificial Sequence
  Synthetic DNA
ttattcgactcattaaag

SEQ ID NO: 33920 - DNA, 18 bp, Artificial Sequence
  Synthetic DNA
aaataagattctctatag

SEQ ID NO: 33921 - DNA, 18 bp, Artificial Sequence
  Synthetic DNA
aaatactacaaactatag

SEQ ID NO: 33922 - DNA, 18 bp, Artificial Sequence
  Synthetic DNA
aataacgattcactatag

SEQ ID NO: 33923 - DNA, 18 bp, Artificial Sequence
  Synthetic DNA
taaaacaactctctttag

SEQ ID NO: 33924 - DNA, 18 bp, Artificial Sequence
  Synthetic DNA
taaaacatctcacaatag

SEQ ID NO: 33925 - DNA, 18 bp, Artificial Sequence
  Synthetic DNA
taaaacgactcataaaag

SEQ ID NO: 33926 - DNA, 18 bp, Artificial Sequence
  Synthetic DNA
taataaaactctctttag

SEQ ID NO: 33927 - DNA, 18 bp, Artificial Sequence
  Synthetic DNA
taataagactcagattag

SEQ ID NO: 33928 - DNA, 18 bp, Artificial Sequence
  Synthetic DNA
taataagattcactttgg

SEQ ID NO: 33929 - DNA, 18 bp, Artificial Sequence
  Synthetic DNA
taatacatctaacaatag

SEQ ID NO: 33930 - DNA, 18 bp, Artificial Sequence
  Synthetic DNA
taatacatctcactaagg

SEQ ID NO: 33931 - DNA, 18 bp, Artificial Sequence
  Synthetic DNA
taatacgattcacctaag

SEQ ID NO: 33932 - DNA, 18 bp, Artificial Sequence
  Synthetic DNA
taatacgatttattaaag

SEQ ID NO: 33933 - DNA, 18 bp, Artificial Sequence
  Synthetic DNA
taatacgtcaaactaaag

SEQ ID NO: 33934 - DNA, 18 bp, Artificial Sequence
  Synthetic DNA
taatacgtcacactaacg

SEQ ID NO: 33935 - DNA, 18 bp, Artificial Sequence
  Synthetic DNA
taatactactctataaag

SEQ ID NO: 33936 - DNA, 18 bp, Artificial Sequence
  Synthetic DNA
taatacttattactatag

SEQ ID NO: 33937 - DNA, 18 bp, Artificial Sequence
  Synthetic DNA
taatacttctctctaaag

SEQ ID NO: 33938 - DNA, 18 bp, Artificial Sequence
  Synthetic DNA
taatcctactctctaaag

SEQ ID NO: 33939 - DNA, 18 bp, Artificial Sequence
  Synthetic DNA
tattaaaactctctatag

SEQ ID NO: 33940 - DNA, 18 bp, Artificial Sequence
  Synthetic DNA
tattaccactcattttag

SEQ ID NO: 33941 - DNA, 18 bp, Artificial Sequence
  Synthetic DNA
tattacgacaaacaatag

SEQ ID NO: 33942 - DNA, 18 bp, Artificial Sequence
  Synthetic DNA
tattacgacacaatttag

SEQ ID NO: 33943 - DNA, 18 bp, Artificial Sequence
  Synthetic DNA
tattacgcctctctttag

SEQ ID NO: 33944 - DNA, 18 bp, Artificial Sequence
  Synthetic DNA
tattacgtttcactaaag

SEQ ID NO: 33945 - DNA, 18 bp, Artificial Sequence
  Synthetic DNA
tattacgttttactatag

SEQ ID NO: 33946 - DNA, 18 bp, Artificial Sequence
  Synthetic DNA
tattactacttactacag

SEQ ID NO: 33947 - DNA, 18 bp, Artificial Sequence
  Synthetic DNA
tattatgtctcactctag

SEQ ID NO: 33948 - DNA, 18 bp, Artificial Sequence
  Synthetic DNA
tattgcgactctctttag

SEQ ID NO: 33949 - DNA, 18 bp, Artificial Sequence
  Synthetic DNA
tgttgcgacacactatag

SEQ ID NO: 33950 - DNA, 18 bp, Artificial Sequence
  Synthetic DNA
ttaaacttctcactatag

SEQ ID NO: 33951 - DNA, 18 bp, Artificial Sequence
  Synthetic DNA
ttataccacccactaaag

SEQ ID NO: 33952 - DNA, 18 bp, Artificial Sequence
  Synthetic DNA
ttatacgacatactttag

SEQ ID NO: 33953 - DNA, 18 bp, Artificial Sequence
  Synthetic DNA
ttatacgactacctaaag

SEQ ID NO: 33954 - DNA, 18 bp, Artificial Sequence
  Synthetic DNA
ttatactactctctacag

SEQ ID NO: 33955 - DNA, 18 bp, Artificial Sequence
  Synthetic DNA
ttatactactgacaatag

SEQ ID NO: 33956 - DNA, 18 bp, Artificial Sequence
  Synthetic DNA
ttatacttctcactttag

SEQ ID NO: 33957 - DNA, 18 bp, Artificial Sequence
  Synthetic DNA
ttatccgtctcacaatag

SEQ ID NO: 33958 - DNA, 18 bp, Artificial Sequence
  Synthetic DNA
ttatgcgactctcaatag

SEQ ID NO: 33959 - DNA, 18 bp, Artificial Sequence
  Synthetic DNA
ttttacgacacactaaag

SEQ ID NO: 33960 - DNA, 18 bp, Artificial Sequence
  Synthetic DNA
tatttcgtctctctatag

SEQ ID NO: 33961 - DNA, 18 bp, Artificial Sequence
  Synthetic DNA
tattacttctcactttag

SEQ ID NO: 33962 - DNA, 18 bp, Artificial Sequence
  Synthetic DNA
aaaatcaactcactatag

SEQ ID NO: 33963 - DNA, 18 bp, Artificial Sequence
  Synthetic DNA
aaattcgtctctctatag

SEQ ID NO: 33964 - DNA, 18 bp, Artificial Sequence
  Synthetic DNA
aaattctacacactatag

SEQ ID NO: 33965 - DNA, 18 bp, Artificial Sequence
  Synthetic DNA
aattactactcactattg

SEQ ID NO: 33966 - DNA, 18 bp, Artificial Sequence
  Synthetic DNA
aatttcgaatcactatag

SEQ ID NO: 33967 - DNA, 18 bp, Artificial Sequence
  Synthetic DNA
taaatcgactctcaatag

SEQ ID NO: 33968 - DNA, 18 bp, Artificial Sequence
  Synthetic DNA
taacactactcactaatg

SEQ ID NO: 33969 - DNA, 18 bp, Artificial Sequence
  Synthetic DNA
taataagacacacttttg

SEQ ID NO: 33970 - DNA, 18 bp, Artificial Sequence
  Synthetic DNA
taatacatctcaccattg

SEQ ID NO: 33971 - DNA, 18 bp, Artificial Sequence
  Synthetic DNA
taatacgacttagtaatg

SEQ ID NO: 33972 - DNA, 18 bp, Artificial Sequence
  Synthetic DNA
taatgccactcacttttg

SEQ ID NO: 33973 - DNA, 18 bp, Artificial Sequence
  Synthetic DNA
taattagacttacaatag

SEQ ID NO: 33974 - DNA, 18 bp, Artificial Sequence
  Synthetic DNA
taattcaattcacaatag

SEQ ID NO: 33975 - DNA, 18 bp, Artificial Sequence
  Synthetic DNA
taattcgacttaataaag

SEQ ID NO: 33976 - DNA, 18 bp, Artificial Sequence
  Synthetic DNA
tatttcgacttacaatag

SEQ ID NO: 33977 - DNA, 18 bp, Artificial Sequence
  Synthetic DNA
tgatacgactcacttatg

SEQ ID NO: 33978 - DNA, 18 bp, Artificial Sequence
  Synthetic DNA
tgtttcgacacactatag

SEQ ID NO: 33979 - DNA, 18 bp, Artificial Sequence
  Synthetic DNA
ttatacgcctcaatattg

SEQ ID NO: 33980 - DNA, 18 bp, Artificial Sequence
  Synthetic DNA
aaatacaacacacaatag

SEQ ID NO: 33981 - DNA, 18 bp, Artificial Sequence
  Synthetic DNA
aaatacgactatctaaag

SEQ ID NO: 33982 - DNA, 18 bp, Artificial Sequence
  Synthetic DNA
aaatacgactcacctaag

SEQ ID NO: 33983 - DNA, 18 bp, Artificial Sequence
  Synthetic DNA
aaatacgtttcaatatag

SEQ ID NO: 33984 - DNA, 18 bp, Artificial Sequence
  Synthetic DNA
aaatatgactctctttag

SEQ ID NO: 33985 - DNA, 18 bp, Artificial Sequence
  Synthetic DNA
ataaacgattcactatag

SEQ ID NO: 33986 - DNA, 18 bp, Artificial Sequence
  Synthetic DNA
atatacgactctttatag

SEQ ID NO: 33987 - DNA, 18 bp, Artificial Sequence
  Synthetic DNA
atatactactaactatag

SEQ ID NO: 33988 - DNA, 18 bp, Artificial Sequence
  Synthetic DNA
caatacgacactcaatag

SEQ ID NO: 33989 - DNA, 18 bp, Artificial Sequence
  Synthetic DNA
caatacgatttactttag

SEQ ID NO: 33990 - DNA, 18 bp, Artificial Sequence
  Synthetic DNA
ctatatgattcactatag

SEQ ID NO: 33991 - DNA, 18 bp, Artificial Sequence
  Synthetic DNA
taaaacgactctttaaag

SEQ ID NO: 33992 - DNA, 18 bp, Artificial Sequence
  Synthetic DNA
taatacaatactctatag

SEQ ID NO: 33993 - DNA, 18 bp, Artificial Sequence
  Synthetic DNA
taatacgacatacaaaag

SEQ ID NO: 33994 - DNA, 18 bp, Artificial Sequence
  Synthetic DNA
taatacgattcacaaacg

SEQ ID NO: 33995 - DNA, 18 bp, Artificial Sequence
  Synthetic DNA
taatacgatttacattag

SEQ ID NO: 33996 - DNA, 18 bp, Artificial Sequence
  Synthetic DNA
taatactactctcaacag

SEQ ID NO: 33997 - DNA, 18 bp, Artificial Sequence
  Synthetic DNA
taatatcactttctatag

SEQ ID NO: 33998 - DNA, 18 bp, Artificial Sequence
  Synthetic DNA
tactacgactctcttaag

SEQ ID NO: 33999 - DNA, 18 bp, Artificial Sequence
  Synthetic DNA
tattacgtcacacaatag

SEQ ID NO: 34000 - DNA, 18 bp, Artificial Sequence
  Synthetic DNA
tattacgtcccacgatag

SEQ ID NO: 34001 - DNA, 18 bp, Artificial Sequence
  Synthetic DNA
tcatacgactatcaatag

SEQ ID NO: 34002 - DNA, 18 bp, Artificial Sequence
  Synthetic DNA
tcatacgtcacactttag

SEQ ID NO: 34003 - DNA, 18 bp, Artificial Sequence
  Synthetic DNA
ttacacttctcactatag

SEQ ID NO: 34004 - DNA, 18 bp, Artificial Sequence
  Synthetic DNA
ttatacgacttataatag

SEQ ID NO: 34005 - DNA, 18 bp, Artificial Sequence
  Synthetic DNA
ttatacgattttctatag

SEQ ID NO: 34006 - DNA, 18 bp, Artificial Sequence
  Synthetic DNA
ttatatatctcactatag

SEQ ID NO: 34007 - DNA, 18 bp, Artificial Sequence
  Synthetic DNA
ttgtacgtctcacaatag

SEQ ID NO: 34008 - DNA, 18 bp, Artificial Sequence
  Synthetic DNA
taatacttcacactttag

SEQ ID NO: 34009 - DNA, 18 bp, Artificial Sequence
  Synthetic DNA
taatacttctcacttaag

SEQ ID NO: 34010 - DNA, 18 bp, Artificial Sequence
  Synthetic DNA
aaataagactctctattg

SEQ ID NO: 34011 - DNA, 18 bp, Artificial Sequence
  Synthetic DNA
aaatactactcaccattg

SEQ ID NO: 34012 - DNA, 18 bp, Artificial Sequence
  Synthetic DNA
aagaacgactcactattg

SEQ ID NO: 34013 - DNA, 18 bp, Artificial Sequence
  Synthetic DNA
caatacgactcaaaattg

SEQ ID NO: 34014 - DNA, 18 bp, Artificial Sequence
  Synthetic DNA
caattcgactctctttag

SEQ ID NO: 34015 - DNA, 18 bp, Artificial Sequence
  Synthetic DNA
taaaacgaataactattg

SEQ ID NO: 34016 - DNA, 18 bp, Artificial Sequence
  Synthetic DNA
taaaacgacatactattg

SEQ ID NO: 34017 - DNA, 18 bp, Artificial Sequence
  Synthetic DNA
taaatcgactcacttaag

SEQ ID NO: 34018 - DNA, 18 bp, Artificial Sequence
  Synthetic DNA
taatacgtctcactcatg

SEQ ID NO: 34019 - DNA, 18 bp, Artificial Sequence
  Synthetic DNA
taatactactcaattttg

SEQ ID NO: 34020 - DNA, 18 bp, Artificial Sequence
  Synthetic DNA
taatatgactcacaaatg

SEQ ID NO: 34021 - DNA, 18 bp, Artificial Sequence
  Synthetic DNA
taattcctctcacaatag

SEQ ID NO: 34022 - DNA, 18 bp, Artificial Sequence
  Synthetic DNA
tataacgactcacttttg

SEQ ID NO: 34023 - DNA, 18 bp, Artificial Sequence
  Synthetic DNA
tatatctactcactatag

SEQ ID NO: 34024 - DNA, 18 bp, Artificial Sequence
  Synthetic DNA
tattacaaatcactattg

SEQ ID NO: 34025 - DNA, 18 bp, Artificial Sequence
  Synthetic DNA
tattacgactctttattg

SEQ ID NO: 34026 - DNA, 18 bp, Artificial Sequence
  Synthetic DNA
tattatgactcactaatg

SEQ ID NO: 34027 - DNA, 18 bp, Artificial Sequence
  Synthetic DNA
tatttcgactcattttag

SEQ ID NO: 34028 - DNA, 18 bp, Artificial Sequence
  Synthetic DNA
tcatacgactctctaatg

SEQ ID NO: 34029 - DNA, 18 bp, Artificial Sequence
  Synthetic DNA
ttatactactcactgttg

SEQ ID NO: 34030 - DNA, 18 bp, Artificial Sequence
  Synthetic DNA
ttattctactctctatag

SEQ ID NO: 34031 - DNA, 18 bp, Artificial Sequence
  Synthetic DNA
tttatcgactcactatag

SEQ ID NO: 34032 - DNA, 18 bp, Artificial Sequence
  Synthetic DNA
aaaaacgattcactaaag

SEQ ID NO: 34033 - DNA, 18 bp, Artificial Sequence
  Synthetic DNA
aagtacaactctctatag

SEQ ID NO: 34034 - DNA, 18 bp, Artificial Sequence
  Synthetic DNA
aataacgactcattatag

SEQ ID NO: 34035 - DNA, 18 bp, Artificial Sequence
  Synthetic DNA
atatacgatacactatag

SEQ ID NO: 34036 - DNA, 18 bp, Artificial Sequence
  Synthetic DNA
ctatactactcactaaag

SEQ ID NO: 34037 - DNA, 18 bp, Artificial Sequence
  Synthetic DNA
taaaacaactttctatag

SEQ ID NO: 34038 - DNA, 18 bp, Artificial Sequence
  Synthetic DNA
taatactacttacaaaag

SEQ ID NO: 34039 - DNA, 18 bp, Artificial Sequence
  Synthetic DNA
taatactatactctatag

SEQ ID NO: 34040 - DNA, 18 bp, Artificial Sequence
  Synthetic DNA
taatacttcacactatcg

SEQ ID NO: 34041 - DNA, 18 bp, Artificial Sequence
  Synthetic DNA
taatatgactctttaaag

SEQ ID NO: 34042 - DNA, 18 bp, Artificial Sequence
  Synthetic DNA
taatccttcacactatag

SEQ ID NO: 34043 - DNA, 18 bp, Artificial Sequence
  Synthetic DNA
ttaaatgactaactatag

SEQ ID NO: 34044 - DNA, 18 bp, Artificial Sequence
  Synthetic DNA
ttataccactctctaaag

SEQ ID NO: 34045 - DNA, 18 bp, Artificial Sequence
  Synthetic DNA
ttatacgactatctttag

SEQ ID NO: 34046 - DNA, 18 bp, Artificial Sequence
  Synthetic DNA
ttatacgactatttatag

SEQ ID NO: 34047 - DNA, 18 bp, Artificial Sequence
  Synthetic DNA
ttatacgtcacaccatag

SEQ ID NO: 34048 - DNA, 18 bp, Artificial Sequence
  Synthetic DNA
ttatatgtctctctatag

SEQ ID NO: 34049 - DNA, 18 bp, Artificial Sequence
  Synthetic DNA
ttttacgacacactttag

SEQ ID NO: 34050 - DNA, 18 bp, Artificial Sequence
  Synthetic DNA
ttttacgtctcacgatag

SEQ ID NO: 34051 - DNA, 18 bp, Artificial Sequence
  Synthetic DNA
tatttcgattcactattg

SEQ ID NO: 34052 - DNA, 18 bp, Artificial Sequence
  Synthetic DNA
taattcaacacactattg

SEQ ID NO: 34053 - DNA, 18 bp, Artificial Sequence
  Synthetic DNA
tcattcgactcactaatg

SEQ ID NO: 34054 - DNA, 18 bp, Artificial Sequence
  Synthetic DNA
aatcacgactcactattg

SEQ ID NO: 34055 - DNA, 18 bp, Artificial Sequence
  Synthetic DNA
atatacgaatcactattg

SEQ ID NO: 34056 - DNA, 18 bp, Artificial Sequence
  Synthetic DNA
atattcgactcattatag

SEQ ID NO: 34057 - DNA, 18 bp, Artificial Sequence
  Synthetic DNA
taaatcatctcactatag

SEQ ID NO: 34058 - DNA, 18 bp, Artificial Sequence
  Synthetic DNA
taataagattcacaattg

SEQ ID NO: 34059 - DNA, 18 bp, Artificial Sequence
  Synthetic DNA
taatacgactctcacttg

SEQ ID NO: 34060 - DNA, 18 bp, Artificial Sequence
  Synthetic DNA
taatacgtcacaatattg

SEQ ID NO: 34061 - DNA, 18 bp, Artificial Sequence
  Synthetic DNA
taatacgtcttaatattg

SEQ ID NO: 34062 - DNA, 18 bp, Artificial Sequence
  Synthetic DNA
taatttgactatctatag

SEQ ID NO: 34063 - DNA, 18 bp, Artificial Sequence
  Synthetic DNA
tacttagactctctatag

SEQ ID NO: 34064 - DNA, 18 bp, Artificial Sequence
  Synthetic DNA
tatatcgactcacaatag

SEQ ID NO: 34065 - DNA, 18 bp, Artificial Sequence
  Synthetic DNA
tatttccactcactatcg

SEQ ID NO: 34066 - DNA, 18 bp, Artificial Sequence
  Synthetic DNA
tatttcgactctccatag

SEQ ID NO: 34067 - DNA, 18 bp, Artificial Sequence
  Synthetic DNA
tcatacgtcacactattg

SEQ ID NO: 34068 - DNA, 18 bp, Artificial Sequence
  Synthetic DNA
ttactcgactcactttag

SEQ ID NO: 34069 - DNA, 18 bp, Artificial Sequence
  Synthetic DNA
ttatacgactctccattg

SEQ ID NO: 34070 - DNA, 18 bp, Artificial Sequence
  Synthetic DNA
ttattcgactcacaatgg

SEQ ID NO: 34071 - DNA, 18 bp, Artificial Sequence
  Synthetic DNA
ttatttgacacactatag

SEQ ID NO: 34072 - DNA, 18 bp, Artificial Sequence
  Synthetic DNA
aaaaacttctcactatag

SEQ ID NO: 34073 - DNA, 18 bp, Artificial Sequence
  Synthetic DNA
aattacgaatcactaaag

SEQ ID NO: 34074 - DNA, 18 bp, Artificial Sequence
  Synthetic DNA
atatacgactcactttgg

SEQ ID NO: 34075 - DNA, 18 bp, Artificial Sequence
  Synthetic DNA
cataacgactctctatag

SEQ ID NO: 34076 - DNA, 18 bp, Artificial Sequence
  Synthetic DNA
taaaacgatttcctatag

SEQ ID NO: 34077 - DNA, 18 bp, Artificial Sequence
  Synthetic DNA
taaaacgtcttacaatag

SEQ ID NO: 34078 - DNA, 18 bp, Artificial Sequence
  Synthetic DNA
taataagattctcaatag

SEQ ID NO: 34079 - DNA, 18 bp, Artificial Sequence
  Synthetic DNA
taatacgactctcttagg

SEQ ID NO: 34080 - DNA, 18 bp, Artificial Sequence
  Synthetic DNA
taatacgtttttctatag

SEQ ID NO: 34081 - DNA, 18 bp, Artificial Sequence
  Synthetic DNA
taatactaaacactaaag

SEQ ID NO: 34082 - DNA, 18 bp, Artificial Sequence
  Synthetic DNA
taatatgtcactctatag

SEQ ID NO: 34083 - DNA, 18 bp, Artificial Sequence
  Synthetic DNA
tataacgacactctatag

SEQ ID NO: 34084 - DNA, 18 bp, Artificial Sequence
  Synthetic DNA
tattacgaatctctacag

SEQ ID NO: 34085 - DNA, 18 bp, Artificial Sequence
  Synthetic DNA
tattacgactttctaaag

SEQ ID NO: 34086 - DNA, 18 bp, Artificial Sequence
  Synthetic DNA
tattacgtctctgtatag

SEQ ID NO: 34087 - DNA, 18 bp, Artificial Sequence
  Synthetic DNA
tgatacgtttcacaatag

SEQ ID NO: 34088 - DNA, 18 bp, Artificial Sequence
  Synthetic DNA
tgttacgtctcacaatag

SEQ ID NO: 34089 - DNA, 18 bp, Artificial Sequence
  Synthetic DNA
ttatactactcactgaag

SEQ ID NO: 34090 - DNA, 18 bp, Artificial Sequence
  Synthetic DNA
ttatatttctcactatag

SEQ ID NO: 34091 - DNA, 18 bp, Artificial Sequence
  Synthetic DNA
taattagactcgctttag

SEQ ID NO: 34092 - DNA, 18 bp, Artificial Sequence
  Synthetic DNA
taattcgacacactaatg

SEQ ID NO: 34093 - DNA, 18 bp, Artificial Sequence
  Synthetic DNA
atatatgactcactattg

SEQ ID NO: 34094 - DNA, 18 bp, Artificial Sequence
  Synthetic DNA
taataagactcacatttg

SEQ ID NO: 34095 - DNA, 18 bp, Artificial Sequence
  Synthetic DNA
taatacgcctcacaaatg

SEQ ID NO: 34096 - DNA, 18 bp, Artificial Sequence
  Synthetic DNA
taattcgactctttttag

SEQ ID NO: 34097 - DNA, 18 bp, Artificial Sequence
  Synthetic DNA
tattacgactaacaattg

SEQ ID NO: 34098 - DNA, 18 bp, Artificial Sequence
  Synthetic DNA
aataacgactcactaaag

SEQ ID NO: 34099 - DNA, 18 bp, Artificial Sequence
  Synthetic DNA
acatactactcactttag

SEQ ID NO: 34100 - DNA, 18 bp, Artificial Sequence
  Synthetic DNA
taaaactactctatatag

SEQ ID NO: 34101 - DNA, 18 bp, Artificial Sequence
  Synthetic DNA
taaaactactctctaaag

SEQ ID NO: 34102 - DNA, 18 bp, Artificial Sequence
  Synthetic DNA
taaaacttctcactttag

SEQ ID NO: 34103 - DNA, 18 bp, Artificial Sequence
  Synthetic DNA
taacacgactcacataag

SEQ ID NO: 34104 - DNA, 18 bp, Artificial Sequence
  Synthetic DNA
tataacaaatcactatag

SEQ ID NO: 34105 - DNA, 18 bp, Artificial Sequence
  Synthetic DNA
tataacgccacactatag

SEQ ID NO: 34106 - DNA, 18 bp, Artificial Sequence
  Synthetic DNA
tataatgactcactttag

SEQ ID NO: 34107 - DNA, 18 bp, Artificial Sequence
  Synthetic DNA
tattacgacaatctatag

SEQ ID NO: 34108 - DNA, 18 bp, Artificial Sequence
  Synthetic DNA
tattccaactcacaatag

SEQ ID NO: 34109 - DNA, 18 bp, Artificial Sequence
  Synthetic DNA
ttataagtcacactatag

SEQ ID NO: 34110 - DNA, 18 bp, Artificial Sequence
  Synthetic DNA
ttatacgattcaccaaag

SEQ ID NO: 34111 - DNA, 18 bp, Artificial Sequence
  Synthetic DNA
ttatactacacacaatag

SEQ ID NO: 34112 - DNA, 18 bp, Artificial Sequence
  Synthetic DNA
ttttacgactaaatatag

SEQ ID NO: 34113 - DNA, 18 bp, Artificial Sequence
  Synthetic DNA
tatttcgtctcacaatag

SEQ ID NO: 34114 - DNA, 18 bp, Artificial Sequence
  Synthetic DNA
aaatacgactcactgatg

SEQ ID NO: 34115 - DNA, 18 bp, Artificial Sequence
  Synthetic DNA
taatacgacaaacttttg

SEQ ID NO: 34116 - DNA, 18 bp, Artificial Sequence
  Synthetic DNA
taatactactaacttttg

SEQ ID NO: 34117 - DNA, 18 bp, Artificial Sequence
  Synthetic DNA
taataggactctatattg

SEQ ID NO: 34118 - DNA, 18 bp, Artificial Sequence
  Synthetic DNA
taatccgactcacaaatg

SEQ ID NO: 34119 - DNA, 18 bp, Artificial Sequence
  Synthetic DNA
taattcgattcattaaag

SEQ ID NO: 34120 - DNA, 18 bp, Artificial Sequence
  Synthetic DNA
tactacatctcactattg

SEQ ID NO: 34121 - DNA, 18 bp, Artificial Sequence
  Synthetic DNA
tactacgactctcttttg

SEQ ID NO: 34122 - DNA, 18 bp, Artificial Sequence
  Synthetic DNA
tattataactcactattg

SEQ ID NO: 34123 - DNA, 18 bp, Artificial Sequence
  Synthetic DNA
tatttcgaatcactttag

SEQ ID NO: 34124 - DNA, 18 bp, Artificial Sequence
  Synthetic DNA
tatttcgacatactatag

SEQ ID NO: 34125 - DNA, 18 bp, Artificial Sequence
  Synthetic DNA
ttatacaactcattattg

SEQ ID NO: 34126 - DNA, 18 bp, Artificial Sequence
  Synthetic DNA
ttatacgactcccaattg

SEQ ID NO: 34127 - DNA, 18 bp, Artificial Sequence
  Synthetic DNA
ttatacgattccctattg

SEQ ID NO: 34128 - DNA, 18 bp, Artificial Sequence
  Synthetic DNA
aaatacatctcactaaag

SEQ ID NO: 34129 - DNA, 18 bp, Artificial Sequence
  Synthetic DNA
aaatatgactcacaatgg

SEQ ID NO: 34130 - DNA, 18 bp, Artificial Sequence
  Synthetic DNA
atttacgactcattatag

SEQ ID NO: 34131 - DNA, 18 bp, Artificial Sequence
  Synthetic DNA
taaaaccacccactttag

SEQ ID NO: 34132 - DNA, 18 bp, Artificial Sequence
  Synthetic DNA
taaaacgtatcactttag

SEQ ID NO: 34133 - DNA, 18 bp, Artificial Sequence
  Synthetic DNA
taaagcgactctctttag

SEQ ID NO: 34134 - DNA, 18 bp, Artificial Sequence
  Synthetic DNA
taatacatctcacattag

SEQ ID NO: 34135 - DNA, 18 bp, Artificial Sequence
  Synthetic DNA
taatacgacacaacttag

SEQ ID NO: 34136 - DNA, 18 bp, Artificial Sequence
  Synthetic DNA
taatacgacactcaatgg

SEQ ID NO: 34137 - DNA, 18 bp, Artificial Sequence
  Synthetic DNA
taatacgtatcattaaag

SEQ ID NO: 34138 - DNA, 18 bp, Artificial Sequence
  Synthetic DNA
taatacgtcacacactag

SEQ ID NO: 34139 - DNA, 18 bp, Artificial Sequence
  Synthetic DNA
taatacgtctaacaaaag

SEQ ID NO: 34140 - DNA, 18 bp, Artificial Sequence
  Synthetic DNA
taatactacacacattag

SEQ ID NO: 34141 - DNA, 18 bp, Artificial Sequence
  Synthetic DNA
taatactactctccaaag

SEQ ID NO: 34142 - DNA, 18 bp, Artificial Sequence
  Synthetic DNA
taatattactctcaatag

SEQ ID NO: 34143 - DNA, 18 bp, Artificial Sequence
  Synthetic DNA
tataactacacactatag

SEQ ID NO: 34144 - DNA, 18 bp, Artificial Sequence
  Synthetic DNA
tattacgactcacatcag

SEQ ID NO: 34145 - DNA, 18 bp, Artificial Sequence
  Synthetic DNA
tcatacaaatcattatag

SEQ ID NO: 34146 - DNA, 18 bp, Artificial Sequence
  Synthetic DNA
tgatacgactttctaaag

SEQ ID NO: 34147 - DNA, 18 bp, Artificial Sequence
  Synthetic DNA
ttaaatgactctctatag

SEQ ID NO: 34148 - DNA, 18 bp, Artificial Sequence
  Synthetic DNA
ttataaatctcactatag

SEQ ID NO: 34149 - DNA, 18 bp, Artificial Sequence
  Synthetic DNA
ttatacgaattacaatag

SEQ ID NO: 34150 - DNA, 18 bp, Artificial Sequence
  Synthetic DNA
ttttacaattcactatag

SEQ ID NO: 34151 - DNA, 18 bp, Artificial Sequence
  Synthetic DNA
ttttaccactctctatag

SEQ ID NO: 34152 - DNA, 18 bp, Artificial Sequence
  Synthetic DNA
ttttacgactcacagtag

SEQ ID NO: 34153 - DNA, 18 bp, Artificial Sequence
  Synthetic DNA
taaaacgactcacacaag

SEQ ID NO: 34154 - DNA, 18 bp, Artificial Sequence
  Synthetic DNA
taaaacgtttcacaatag

SEQ ID NO: 34155 - DNA, 18 bp, Artificial Sequence
  Synthetic DNA
taattacactcactattg

SEQ ID NO: 34156 - DNA, 18 bp, Artificial Sequence
  Synthetic DNA
taattagactcacaattg

SEQ ID NO: 34157 - DNA, 18 bp, Artificial Sequence
  Synthetic DNA
taattagattcactattg

SEQ ID NO: 34158 - DNA, 18 bp, Artificial Sequence
  Synthetic DNA
taattccattcactattg

SEQ ID NO: 34159 - DNA, 18 bp, Artificial Sequence
  Synthetic DNA
taattcgactcataattg

SEQ ID NO: 34160 - DNA, 18 bp, Artificial Sequence
  Synthetic DNA
taattcgtatcactattg

SEQ ID NO: 34161 - DNA, 18 bp, Artificial Sequence
  Synthetic DNA
taattctactcattattg

SEQ ID NO: 34162 - DNA, 18 bp, Artificial Sequence
  Synthetic DNA
aaatacgaatcacttttg

SEQ ID NO: 34163 - DNA, 18 bp, Artificial Sequence
  Synthetic DNA
aaatacgactcaataatg

SEQ ID NO: 34164 - DNA, 18 bp, Artificial Sequence
  Synthetic DNA
aaattcaactctctatag

SEQ ID NO: 34165 - DNA, 18 bp, Artificial Sequence
  Synthetic DNA
aattttgactcactatag

SEQ ID NO: 34166 - DNA, 18 bp, Artificial Sequence
  Synthetic DNA
taaaacgacacactaatg

SEQ ID NO: 34167 - DNA, 18 bp, Artificial Sequence
  Synthetic DNA
taatacaactcacttgtg

SEQ ID NO: 34168 - DNA, 18 bp, Artificial Sequence
  Synthetic DNA
taatactactcaataatg

SEQ ID NO: 34169 - DNA, 18 bp, Artificial Sequence
  Synthetic DNA
taatagatctcactattg

SEQ ID NO: 34170 - DNA, 18 bp, Artificial Sequence
  Synthetic DNA
taatatgactcactcatg

SEQ ID NO: 34171 - DNA, 18 bp, Artificial Sequence
  Synthetic DNA
taattagactcacattag

SEQ ID NO: 34172 - DNA, 18 bp, Artificial Sequence
  Synthetic DNA
tagtacgtctcacaattg

SEQ ID NO: 34173 - DNA, 18 bp, Artificial Sequence
  Synthetic DNA
tattaagactcattattg

SEQ ID NO: 34174 - DNA, 18 bp, Artificial Sequence
  Synthetic DNA
tattacgactaacttttg

SEQ ID NO: 34175 - DNA, 18 bp, Artificial Sequence
  Synthetic DNA
tattactactcactgttg

SEQ ID NO: 34176 - DNA, 18 bp, Artificial Sequence
  Synthetic DNA
tatttcgactatctatag

SEQ ID NO: 34177 - DNA, 18 bp, Artificial Sequence
  Synthetic DNA
ttattcgactgactaaag

SEQ ID NO: 34178 - DNA, 18 bp, Artificial Sequence
  Synthetic DNA
ttatttgacttactatag

SEQ ID NO: 34179 - DNA, 18 bp, Artificial Sequence
  Synthetic DNA
agatatgactcactttag

SEQ ID NO: 34180 - DNA, 18 bp, Artificial Sequence
  Synthetic DNA
ataaacgacttactatag

SEQ ID NO: 34181 - DNA, 18 bp, Artificial Sequence
  Synthetic DNA
atatatgactcattatag

SEQ ID NO: 34182 - DNA, 18 bp, Artificial Sequence
  Synthetic DNA
atttacgaatcactatag

SEQ ID NO: 34183 - DNA, 18 bp, Artificial Sequence
  Synthetic DNA
taaaacgactctcttaag

SEQ ID NO: 34184 - DNA, 18 bp, Artificial Sequence
  Synthetic DNA
taacacgactctcaaaag

SEQ ID NO: 34185 - DNA, 18 bp, Artificial Sequence
  Synthetic DNA
taacacgcttcactttag

SEQ ID NO: 34186 - DNA, 18 bp, Artificial Sequence
  Synthetic DNA
taataagtctaactttag

SEQ ID NO: 34187 - DNA, 18 bp, Artificial Sequence
  Synthetic DNA
taatacgatacacaaaag

SEQ ID NO: 34188 - DNA, 18 bp, Artificial Sequence
  Synthetic DNA
taatactacactctaaag

SEQ ID NO: 34189 - DNA, 18 bp, Artificial Sequence
  Synthetic DNA
taatactactcaattaag

SEQ ID NO: 34190 - DNA, 18 bp, Artificial Sequence
  Synthetic DNA
taataggattcacttaag

SEQ ID NO: 34191 - DNA, 18 bp, Artificial Sequence
  Synthetic DNA
taatatgttacactatag

SEQ ID NO: 34192 - DNA, 18 bp, Artificial Sequence
  Synthetic DNA
taatattactctctaaag

SEQ ID NO: 34193 - DNA, 18 bp, Artificial Sequence
  Synthetic DNA
tatcacgactctcaatag

SEQ ID NO: 34194 - DNA, 18 bp, Artificial Sequence
  Synthetic DNA
tattacgaatctctatcg

SEQ ID NO: 34195 - DNA, 18 bp, Artificial Sequence
  Synthetic DNA
tattacgtcttactttag

SEQ ID NO: 34196 - DNA, 18 bp, Artificial Sequence
  Synthetic DNA
tattactacacacaatag

SEQ ID NO: 34197 - DNA, 18 bp, Artificial Sequence
  Synthetic DNA
tgaaacgactctctttag

SEQ ID NO: 34198 - DNA, 18 bp, Artificial Sequence
  Synthetic DNA
tgatacaactcacattag

SEQ ID NO: 34199 - DNA, 18 bp, Artificial Sequence
  Synthetic DNA
ttatacgaccctctaaag

SEQ ID NO: 34200 - DNA, 18 bp, Artificial Sequence
  Synthetic DNA
aaattcgacacactattg

SEQ ID NO: 34201 - DNA, 18 bp, Artificial Sequence
  Synthetic DNA
tttttcgactcactattg

SEQ ID NO: 34202 - DNA, 18 bp, Artificial Sequence
  Synthetic DNA
taatacaatacactattg

SEQ ID NO: 34203 - DNA, 18 bp, Artificial Sequence
  Synthetic DNA
taatacgtatctctattg

SEQ ID NO: 34204 - DNA, 18 bp, Artificial Sequence
  Synthetic DNA
taatactacacacaattg

SEQ ID NO: 34205 - DNA, 18 bp, Artificial Sequence
  Synthetic DNA
taatactactcatcattg

SEQ ID NO: 34206 - DNA, 18 bp, Artificial Sequence
  Synthetic DNA
taatgcgactcacatttg

SEQ ID NO: 34207 - DNA, 18 bp, Artificial Sequence
  Synthetic DNA
taattccactcaataaag

SEQ ID NO: 34208 - DNA, 18 bp, Artificial Sequence
  Synthetic DNA
taattcgatttacaatag

SEQ ID NO: 34209 - DNA, 18 bp, Artificial Sequence
  Synthetic DNA
taattcgtctatctatag

SEQ ID NO: 34210 - DNA, 18 bp, Artificial Sequence
  Synthetic DNA
tattacgtctcactgttg

SEQ ID NO: 34211 - DNA, 18 bp, Artificial Sequence
  Synthetic DNA
tatttagattcactatag

SEQ ID NO: 34212 - DNA, 18 bp, Artificial Sequence
  Synthetic DNA
tatttcgacacactaaag

SEQ ID NO: 34213 - DNA, 18 bp, Artificial Sequence
  Synthetic DNA
ttataagacacactattg

SEQ ID NO: 34214 - DNA, 18 bp, Artificial Sequence
  Synthetic DNA
ttattcgacacactaaag

SEQ ID NO: 34215 - DNA, 18 bp, Artificial Sequence
  Synthetic DNA
ttattcgtatcactatag

SEQ ID NO: 34216 - DNA, 18 bp, Artificial Sequence
  Synthetic DNA
ttatttgattcactatag

SEQ ID NO: 34217 - DNA, 18 bp, Artificial Sequence
  Synthetic DNA
ttctacaactcactattg

SEQ ID NO: 34218 - DNA, 18 bp, Artificial Sequence
  Synthetic DNA
atataagactcaatatag

SEQ ID NO: 34219 - DNA, 18 bp, Artificial Sequence
  Synthetic DNA
atatacaactcacaatag

SEQ ID NO: 34220 - DNA, 18 bp, Artificial Sequence
  Synthetic DNA
atatacgacacattatag

SEQ ID NO: 34221 - DNA, 18 bp, Artificial Sequence
  Synthetic DNA
atatacgacactctatag

SEQ ID NO: 34222 - DNA, 18 bp, Artificial Sequence
  Synthetic DNA
caatacatctcactaaag

SEQ ID NO: 34223 - DNA, 18 bp, Artificial Sequence
  Synthetic DNA
taaaatgaatctctatag

SEQ ID NO: 34224 - DNA, 18 bp, Artificial Sequence
  Synthetic DNA
taaaatgtctctctatag

SEQ ID NO: 34225 - DNA, 18 bp, Artificial Sequence
  Synthetic DNA
taaagctactcactaaag

SEQ ID NO: 34226 - DNA, 18 bp, Artificial Sequence
  Synthetic DNA
taatacgtcttattttag

SEQ ID NO: 34227 - DNA, 18 bp, Artificial Sequence
  Synthetic DNA
tagtacgtatctctatag

SEQ ID NO: 34228 - DNA, 18 bp, Artificial Sequence
  Synthetic DNA
tataaggattcactatag

SEQ ID NO: 34229 - DNA, 18 bp, Artificial Sequence
  Synthetic DNA
tataatgactcactaaag

SEQ ID NO: 34230 - DNA, 18 bp, Artificial Sequence
  Synthetic DNA
tattacaattctctatag

SEQ ID NO: 34231 - DNA, 18 bp, Artificial Sequence
  Synthetic DNA
tattacgattttctatag

SEQ ID NO: 34232 - DNA, 18 bp, Artificial Sequence
  Synthetic DNA
tattactactcacttaag

SEQ ID NO: 34233 - DNA, 18 bp, Artificial Sequence
  Synthetic DNA
tattatgactcacattag

SEQ ID NO: 34234 - DNA, 18 bp, Artificial Sequence
  Synthetic DNA
tgaaacgtctcactaaag

SEQ ID NO: 34235 - DNA, 18 bp, Artificial Sequence
  Synthetic DNA
tgatacaacatactatag

SEQ ID NO: 34236 - DNA, 18 bp, Artificial Sequence
  Synthetic DNA
ttatacaacttacaatag

SEQ ID NO: 34237 - DNA, 18 bp, Artificial Sequence
  Synthetic DNA
ttatacgacactttatag

SEQ ID NO: 34238 - DNA, 18 bp, Artificial Sequence
  Synthetic DNA
taatacgacactcttttg

SEQ ID NO: 34239 - DNA, 18 bp, Artificial Sequence
  Synthetic DNA
tattacaactctctttag

SEQ ID NO: 34240 - DNA, 18 bp, Artificial Sequence
  Synthetic DNA
ttatacttctctctatag

SEQ ID NO: 34241 - DNA, 18 bp, Artificial Sequence
  Synthetic DNA
aaatacgtctctctattg

SEQ ID NO: 34242 - DNA, 18 bp, Artificial Sequence
  Synthetic DNA
taattcgactcttaatag

SEQ ID NO: 34243 - DNA, 18 bp, Artificial Sequence
  Synthetic DNA
ttctactactcactattg

SEQ ID NO: 34244 - DNA, 18 bp, Artificial Sequence
  Synthetic DNA
tttcacgactcactattg

SEQ ID NO: 34245 - DNA, 18 bp, Artificial Sequence
  Synthetic DNA
aaatacttctcaccatag

SEQ ID NO: 34246 - DNA, 18 bp, Artificial Sequence
  Synthetic DNA
aattacgactctctttag

SEQ ID NO: 34247 - DNA, 18 bp, Artificial Sequence
  Synthetic DNA
ctaaatgactcactatag

SEQ ID NO: 34248 - DNA, 18 bp, Artificial Sequence
  Synthetic DNA
taaaacaaatcacaatag

SEQ ID NO: 34249 - DNA, 18 bp, Artificial Sequence
  Synthetic DNA
taaaacgaccctctttag

SEQ ID NO: 34250 - DNA, 18 bp, Artificial Sequence
  Synthetic DNA
taataaatctcactaaag

SEQ ID NO: 34251 - DNA, 18 bp, Artificial Sequence
  Synthetic DNA
taatacaactaacaaaag

SEQ ID NO: 34252 - DNA, 18 bp, Artificial Sequence
  Synthetic DNA
taataccacccacttaag

SEQ ID NO: 34253 - DNA, 18 bp, Artificial Sequence
  Synthetic DNA
taatactactctcttcag

SEQ ID NO: 34254 - DNA, 18 bp, Artificial Sequence
  Synthetic DNA
taatacttcacacaatag

SEQ ID NO: 34255 - DNA, 18 bp, Artificial Sequence
  Synthetic DNA
tacaacgtctctctatag

SEQ ID NO: 34256 - DNA, 18 bp, Artificial Sequence
  Synthetic DNA
tataacgtatcactatag

SEQ ID NO: 34257 - DNA, 18 bp, Artificial Sequence
  Synthetic DNA
tattaagacttcctatag

SEQ ID NO: 34258 - DNA, 18 bp, Artificial Sequence
  Synthetic DNA
tattaatactcactaaag

SEQ ID NO: 34259 - DNA, 18 bp, Artificial Sequence
  Synthetic DNA
tattaattctcactatag

SEQ ID NO: 34260 - DNA, 18 bp, Artificial Sequence
  Synthetic DNA
tattacaactctctaaag

SEQ ID NO: 34261 - DNA, 18 bp, Artificial Sequence
  Synthetic DNA
tcttacaattcactatag

SEQ ID NO: 34262 - DNA, 18 bp, Artificial Sequence
  Synthetic DNA
ttaaacgactctctatcg

SEQ ID NO: 34263 - DNA, 18 bp, Artificial Sequence
  Synthetic DNA
ttttatgactctctatag

SEQ ID NO: 34264 - DNA, 18 bp, Artificial Sequence
  Synthetic DNA
ttattcgactcacaaaag

SEQ ID NO: 34265 - DNA, 18 bp, Artificial Sequence
  Synthetic DNA
taattagactctctattg

SEQ ID NO: 34266 - DNA, 18 bp, Artificial Sequence
  Synthetic DNA
aaattcgattcactaaag

SEQ ID NO: 34267 - DNA, 18 bp, Artificial Sequence
  Synthetic DNA
taaaacgactctcaattg

SEQ ID NO: 34268 - DNA, 18 bp, Artificial Sequence
  Synthetic DNA
taaaacgactctcttttg

SEQ ID NO: 34269 - DNA, 18 bp, Artificial Sequence
  Synthetic DNA
taatacatctcaatattg

SEQ ID NO: 34270 - DNA, 18 bp, Artificial Sequence
  Synthetic DNA
taatcctactcacaattg

SEQ ID NO: 34271 - DNA, 18 bp, Artificial Sequence
  Synthetic DNA
taattcgtaacactatag

SEQ ID NO: 34272 - DNA, 18 bp, Artificial Sequence
  Synthetic DNA
taattcgtctctctaaag

SEQ ID NO: 34273 - DNA, 18 bp, Artificial Sequence
  Synthetic DNA
tagttctactcactaaag

SEQ ID NO: 34274 - DNA, 18 bp, Artificial Sequence
  Synthetic DNA
tattaagactcaccattg

SEQ ID NO: 34275 - DNA, 18 bp, Artificial Sequence
  Synthetic DNA
ttattcgattcacaatag

SEQ ID NO: 34276 - DNA, 18 bp, Artificial Sequence
  Synthetic DNA
ttattcgattctctatag

SEQ ID NO: 34277 - DNA, 18 bp, Artificial Sequence
  Synthetic DNA
aaatacgaatcacaaaag

SEQ ID NO: 34278 - DNA, 18 bp, Artificial Sequence
  Synthetic DNA
aaatacgaatctcaatag

SEQ ID NO: 34279 - DNA, 18 bp, Artificial Sequence
  Synthetic DNA
aataacgacttactatag

SEQ ID NO: 34280 - DNA, 18 bp, Artificial Sequence
  Synthetic DNA
aattaccactcactttag

SEQ ID NO: 34281 - DNA, 18 bp, Artificial Sequence
  Synthetic DNA
aattacgattctctatag

SEQ ID NO: 34282 - DNA, 18 bp, Artificial Sequence
  Synthetic DNA
aattacgtcacactatag

SEQ ID NO: 34283 - DNA, 18 bp, Artificial Sequence
  Synthetic DNA
taataagactttcaatag

SEQ ID NO: 34284 - DNA, 18 bp, Artificial Sequence
  Synthetic DNA
taataccacacacaaaag

SEQ ID NO: 34285 - DNA, 18 bp, Artificial Sequence
  Synthetic DNA
taatacgaatttcaatag

SEQ ID NO: 34286 - DNA, 18 bp, Artificial Sequence
  Synthetic DNA
taatacgtcaccctaaag

SEQ ID NO: 34287 - DNA, 18 bp, Artificial Sequence
  Synthetic DNA
taatactaatcacactag

SEQ ID NO: 34288 - DNA, 18 bp, Artificial Sequence
  Synthetic DNA
taatactattctctttag

SEQ ID NO: 34289 - DNA, 18 bp, Artificial Sequence
  Synthetic DNA
taatacttctcactcaag

SEQ ID NO: 34290 - DNA, 18 bp, Artificial Sequence
  Synthetic DNA
taatatgactctcttaag

SEQ ID NO: 34291 - DNA, 18 bp, Artificial Sequence
  Synthetic DNA
taatgctacactctatag

SEQ ID NO: 34292 - DNA, 18 bp, Artificial Sequence
  Synthetic DNA
tattacgtctaacaatag

SEQ ID NO: 34293 - DNA, 18 bp, Artificial Sequence
  Synthetic DNA
tattacgtctcaatttag

SEQ ID NO: 34294 - DNA, 18 bp, Artificial Sequence
  Synthetic DNA
tattacgtttaactatag

SEQ ID NO: 34295 - DNA, 18 bp, Artificial Sequence
  Synthetic DNA
tattatgtttcactatag

SEQ ID NO: 34296 - DNA, 18 bp, Artificial Sequence
  Synthetic DNA
tcttacgactaactttag

SEQ ID NO: 34297 - DNA, 18 bp, Artificial Sequence
  Synthetic DNA
ttacacgtttcactatag

SEQ ID NO: 34298 - DNA, 18 bp, Artificial Sequence
  Synthetic DNA
ttataagactcacttaag

SEQ ID NO: 34299 - DNA, 18 bp, Artificial Sequence
  Synthetic DNA
ttataagtctctctatag

SEQ ID NO: 34300 - DNA, 18 bp, Artificial Sequence
  Synthetic DNA
ttatacgagacaatatag

SEQ ID NO: 34301 - DNA, 18 bp, Artificial Sequence
  Synthetic DNA
taattcgtcacactttag

SEQ ID NO: 34302 - DNA, 18 bp, Artificial Sequence
  Synthetic DNA
tatttcgactcacattag

SEQ ID NO: 34303 - DNA, 18 bp, Artificial Sequence
  Synthetic DNA
aatttggactcactatag

SEQ ID NO: 34304 - DNA, 18 bp, Artificial Sequence
  Synthetic DNA
taactcgtctaactatag

SEQ ID NO: 34305 - DNA, 18 bp, Artificial Sequence
  Synthetic DNA
taatacgattcaataatg

SEQ ID NO: 34306 - DNA, 18 bp, Artificial Sequence
  Synthetic DNA
taatacgtctctcttttg

SEQ ID NO: 34307 - DNA, 18 bp, Artificial Sequence
  Synthetic DNA
taattccactcaatttag

SEQ ID NO: 34308 - DNA, 18 bp, Artificial Sequence
  Synthetic DNA
tataaccactcactattg

SEQ ID NO: 34309 - DNA, 18 bp, Artificial Sequence
  Synthetic DNA
tatatcgactaactatag

SEQ ID NO: 34310 - DNA, 18 bp, Artificial Sequence
  Synthetic DNA
tattacgacacattattg

SEQ ID NO: 34311 - DNA, 18 bp, Artificial Sequence
  Synthetic DNA
tcatacttctcactattg

SEQ ID NO: 34312 - DNA, 18 bp, Artificial Sequence
  Synthetic DNA
ttatacgactctcaattg

SEQ ID NO: 34313 - DNA, 18 bp, Artificial Sequence
  Synthetic DNA
aaatacgtcttactaaag

SEQ ID NO: 34314 - DNA, 18 bp, Artificial Sequence
  Synthetic DNA
aattactactcactttag

SEQ ID NO: 34315 - DNA, 18 bp, Artificial Sequence
  Synthetic DNA
taaaacgtctcaaaatag

SEQ ID NO: 34316 - DNA, 18 bp, Artificial Sequence
  Synthetic DNA
taaaattactcactttag

SEQ ID NO: 34317 - DNA, 18 bp, Artificial Sequence
  Synthetic DNA
taatacgcctctcattag

SEQ ID NO: 34318 - DNA, 18 bp, Artificial Sequence
  Synthetic DNA
taatacgtttaactttag

SEQ ID NO: 34319 - DNA, 18 bp, Artificial Sequence
  Synthetic DNA
taatactactcacataag

SEQ ID NO: 34320 - DNA, 18 bp, Artificial Sequence
  Synthetic DNA
taatactcctcattaaag

SEQ ID NO: 34321 - DNA, 18 bp, Artificial Sequence
  Synthetic DNA
taatacttcacactaaag

SEQ ID NO: 34322 - DNA, 18 bp, Artificial Sequence
  Synthetic DNA
tattacgacttacaaaag

SEQ ID NO: 34323 - DNA, 18 bp, Artificial Sequence
  Synthetic DNA
tattacgtttctctatag

SEQ ID NO: 34324 - DNA, 18 bp, Artificial Sequence
  Synthetic DNA
tattatgactcacttaag

SEQ ID NO: 34325 - DNA, 18 bp, Artificial Sequence
  Synthetic DNA
ttatacctctcacaatag

SEQ ID NO: 34326 - DNA, 18 bp, Artificial Sequence
  Synthetic DNA
ttatactaatcaccatag

SEQ ID NO: 34327 - DNA, 18 bp, Artificial Sequence
  Synthetic DNA
ttcaacgattcactatag

SEQ ID NO: 34328 - DNA, 18 bp, Artificial Sequence
  Synthetic DNA
tatttcaactcactattg

SEQ ID NO: 34329 - DNA, 18 bp, Artificial Sequence
  Synthetic DNA
tatttcgactcactaatg

SEQ ID NO: 34330 - DNA, 18 bp, Artificial Sequence
  Synthetic DNA
tgattcgaatcactattg

SEQ ID NO: 34331 - DNA, 18 bp, Artificial Sequence
  Synthetic DNA
aaataagactcacaattg

SEQ ID NO: 34332 - DNA, 18 bp, Artificial Sequence
  Synthetic DNA
aaatatgactcaatattg

SEQ ID NO: 34333 - DNA, 18 bp, Artificial Sequence
  Synthetic DNA
aaattcgacactctatag

SEQ ID NO: 34334 - DNA, 18 bp, Artificial Sequence
  Synthetic DNA
atattcgactcacaatag

SEQ ID NO: 34335 - DNA, 18 bp, Artificial Sequence
  Synthetic DNA
taatacatctcacttttg

SEQ ID NO: 34336 - DNA, 18 bp, Artificial Sequence
  Synthetic DNA
taatacgacaaagtattg

SEQ ID NO: 34337 - DNA, 18 bp, Artificial Sequence
  Synthetic DNA
taatacgtaacactattg

SEQ ID NO: 34338 - DNA, 18 bp, Artificial Sequence
  Synthetic DNA
taattagactctctaaag

SEQ ID NO: 34339 - DNA, 18 bp, Artificial Sequence
  Synthetic DNA
tataacgacttactattg

SEQ ID NO: 34340 - DNA, 18 bp, Artificial Sequence
  Synthetic DNA
tattacaactctctattg

SEQ ID NO: 34341 - DNA, 18 bp, Artificial Sequence
  Synthetic DNA
aaatacgtcacactttag

SEQ ID NO: 34342 - DNA, 18 bp, Artificial Sequence
  Synthetic DNA
taatacaactcaattaag

SEQ ID NO: 34343 - DNA, 18 bp, Artificial Sequence
  Synthetic DNA
taatacaatacactacag

SEQ ID NO: 34344 - DNA, 18 bp, Artificial Sequence
  Synthetic DNA
taatacgacactctttgg

SEQ ID NO: 34345 - DNA, 18 bp, Artificial Sequence
  Synthetic DNA
taatacgtctctcttcag

SEQ ID NO: 34346 - DNA, 18 bp, Artificial Sequence
  Synthetic DNA
tataacgacacactaaag

SEQ ID NO: 34347 - DNA, 18 bp, Artificial Sequence
  Synthetic DNA
tattaccactctctttag

SEQ ID NO: 34348 - DNA, 18 bp, Artificial Sequence
  Synthetic DNA
ttaaacgactatctatag

SEQ ID NO: 34349 - DNA, 18 bp, Artificial Sequence
  Synthetic DNA
ttatacaattctctatag

SEQ ID NO: 34350 - DNA, 18 bp, Artificial Sequence
  Synthetic DNA
ttatacgtcacactttag

SEQ ID NO: 34351 - DNA, 18 bp, Artificial Sequence
  Synthetic DNA
ttatacgtctaactaaag

SEQ ID NO: 34352 - DNA, 18 bp, Artificial Sequence
  Synthetic DNA
ttctacgtctctctatag

SEQ ID NO: 34353 - DNA, 18 bp, Artificial Sequence
  Synthetic DNA
ttattcgactcattattg

SEQ ID NO: 34354 - DNA, 18 bp, Artificial Sequence
  Synthetic DNA
aattacgactcattattg

SEQ ID NO: 34355 - DNA, 18 bp, Artificial Sequence
  Synthetic DNA
atattctactcactatag

SEQ ID NO: 34356 - DNA, 18 bp, Artificial Sequence
  Synthetic DNA
taaaacgacacacaattg

SEQ ID NO: 34357 - DNA, 18 bp, Artificial Sequence
  Synthetic DNA
taatacaactctttattg

SEQ ID NO: 34358 - DNA, 18 bp, Artificial Sequence
  Synthetic DNA
taatactacttaccattg

SEQ ID NO: 34359 - DNA, 18 bp, Artificial Sequence
  Synthetic DNA
taattcgacaatctatag

SEQ ID NO: 34360 - DNA, 18 bp, Artificial Sequence
  Synthetic DNA
taattcgactctctcaag

SEQ ID NO: 34361 - DNA, 18 bp, Artificial Sequence
  Synthetic DNA
taattcgtcacactaaag

SEQ ID NO: 34362 - DNA, 18 bp, Artificial Sequence
  Synthetic DNA
taattcttttcactatag

SEQ ID NO: 34363 - DNA, 18 bp, Artificial Sequence
  Synthetic DNA
taatttgtttcactatag

SEQ ID NO: 34364 - DNA, 18 bp, Artificial Sequence
  Synthetic DNA
tcattcgactcacttaag

SEQ ID NO: 34365 - DNA, 18 bp, Artificial Sequence
  Synthetic DNA
ttattcgacacaatatag

SEQ ID NO: 34366 - DNA, 18 bp, Artificial Sequence
  Synthetic DNA
taaaacgtctttctatag

SEQ ID NO: 34367 - DNA, 18 bp, Artificial Sequence
  Synthetic DNA
taatacgaatcatttaag

SEQ ID NO: 34368 - DNA, 18 bp, Artificial Sequence
  Synthetic DNA
taatacttttcattatag

SEQ ID NO: 34369 - DNA, 18 bp, Artificial Sequence
  Synthetic DNA
tattacaactcacaaaag

SEQ ID NO: 34370 - DNA, 18 bp, Artificial Sequence
  Synthetic DNA
tattacgtctaactaaag

SEQ ID NO: 34371 - DNA, 18 bp, Artificial Sequence
  Synthetic DNA
tattgcgactctctaaag

SEQ ID NO: 34372 - DNA, 18 bp, Artificial Sequence
  Synthetic DNA
tgatacgactcacataag

SEQ ID NO: 34373 - DNA, 18 bp, Artificial Sequence
  Synthetic DNA
ttatacaacacactatcg

SEQ ID NO: 34374 - DNA, 18 bp, Artificial Sequence
  Synthetic DNA
ttatactactcactacgg

SEQ ID NO: 34375 - DNA, 18 bp, Artificial Sequence
  Synthetic DNA
ttatattacacactatag

SEQ ID NO: 34376 - DNA, 18 bp, Artificial Sequence
  Synthetic DNA
ttttacgtctcacaatag

SEQ ID NO: 34377 - DNA, 18 bp, Artificial Sequence
  Synthetic DNA
ttatacgtctctctttag

SEQ ID NO: 34378 - DNA, 18 bp, Artificial Sequence
  Synthetic DNA
tatttcgacacactattg

SEQ ID NO: 34379 - DNA, 18 bp, Artificial Sequence
  Synthetic DNA
aaatacgactcccttttg

SEQ ID NO: 34380 - DNA, 18 bp, Artificial Sequence
  Synthetic DNA
aaattcgaatcactttag

SEQ ID NO: 34381 - DNA, 18 bp, Artificial Sequence
  Synthetic DNA
aaattcgacacattatag

SEQ ID NO: 34382 - DNA, 18 bp, Artificial Sequence
  Synthetic DNA
taatacgacactttattg

SEQ ID NO: 34383 - DNA, 18 bp, Artificial Sequence
  Synthetic DNA
taatacgactctcaaatg

SEQ ID NO: 34384 - DNA, 18 bp, Artificial Sequence
  Synthetic DNA
taattcgtatcactaaag

SEQ ID NO: 34385 - DNA, 18 bp, Artificial Sequence
  Synthetic DNA
taatttgaattactatag

SEQ ID NO: 34386 - DNA, 18 bp, Artificial Sequence
  Synthetic DNA
tattacgactgtctattg

SEQ ID NO: 34387 - DNA, 18 bp, Artificial Sequence
  Synthetic DNA
tatttcgactcacttaag

SEQ ID NO: 34388 - DNA, 18 bp, Artificial Sequence
  Synthetic DNA
tatttcgtctcaccatag

SEQ ID NO: 34389 - DNA, 18 bp, Artificial Sequence
  Synthetic DNA
ttattcgactctctctag

SEQ ID NO: 34390 - DNA, 18 bp, Artificial Sequence
  Synthetic DNA
ttattcgacttacaatag

SEQ ID NO: 34391 - DNA, 18 bp, Artificial Sequence
  Synthetic DNA
aaatacgtctcacaaaag

SEQ ID NO: 34392 - DNA, 18 bp, Artificial Sequence
  Synthetic DNA
cattacgactctctaaag

SEQ ID NO: 34393 - DNA, 18 bp, Artificial Sequence
  Synthetic DNA
taaaacgtatctctatag

SEQ ID NO: 34394 - DNA, 18 bp, Artificial Sequence
  Synthetic DNA
taaaatgtcacactatag

SEQ ID NO: 34395 - DNA, 18 bp, Artificial Sequence
  Synthetic DNA
taataagtctctctttag

SEQ ID NO: 34396 - DNA, 18 bp, Artificial Sequence
  Synthetic DNA
taatactactctcaaaag

SEQ ID NO: 34397 - DNA, 18 bp, Artificial Sequence
  Synthetic DNA
tacaacgactatctatag

SEQ ID NO: 34398 - DNA, 18 bp, Artificial Sequence
  Synthetic DNA
tataacgacttactaaag

SEQ ID NO: 34399 - DNA, 18 bp, Artificial Sequence
  Synthetic DNA
tattacgactaattttag

SEQ ID NO: 34400 - DNA, 18 bp, Artificial Sequence
  Synthetic DNA
tattacgtctctccatag

SEQ ID NO: 34401 - DNA, 18 bp, Artificial Sequence
  Synthetic DNA
ttaaacaactctctatag

SEQ ID NO: 34402 - DNA, 18 bp, Artificial Sequence
  Synthetic DNA
ttatacgtctcattaaag

SEQ ID NO: 34403 - DNA, 18 bp, Artificial Sequence
  Synthetic DNA
ttttaagactcactttag

SEQ ID NO: 34404 - DNA, 18 bp, Artificial Sequence
  Synthetic DNA
ttttacgactttctatag

SEQ ID NO: 34405 - DNA, 18 bp, Artificial Sequence
  Synthetic DNA
tacttcgtctcactattg

SEQ ID NO: 34406 - DNA, 18 bp, Artificial Sequence
  Synthetic DNA
aaaatcgtctcactatag

SEQ ID NO: 34407 - DNA, 18 bp, Artificial Sequence
  Synthetic DNA
aatttcgactcactaaag

SEQ ID NO: 34408 - DNA, 18 bp, Artificial Sequence
  Synthetic DNA
taattcgttttactatag

SEQ ID NO: 34409 - DNA, 18 bp, Artificial Sequence
  Synthetic DNA
aattacgtatcactatag

SEQ ID NO: 34410 - DNA, 18 bp, Artificial Sequence
  Synthetic DNA
ataaactactcactatag

SEQ ID NO: 34411 - DNA, 18 bp, Artificial Sequence
  Synthetic DNA
atatacgactatctatag

SEQ ID NO: 34412 - DNA, 18 bp, Artificial Sequence
  Synthetic DNA
taaaacgactcatttaag

SEQ ID NO: 34413 - DNA, 18 bp, Artificial Sequence
  Synthetic DNA
taataattctctctatag

SEQ ID NO: 34414 - DNA, 18 bp, Artificial Sequence
  Synthetic DNA
taatacgattctcattag

SEQ ID NO: 34415 - DNA, 18 bp, Artificial Sequence
  Synthetic DNA
taatactactatctaaag

SEQ ID NO: 34416 - DNA, 18 bp, Artificial Sequence
  Synthetic DNA
tactacgtctcacttcag

SEQ ID NO: 34417 - DNA, 18 bp, Artificial Sequence
  Synthetic DNA
tattacgaatcacttaag

SEQ ID NO: 34418 - DNA, 18 bp, Artificial Sequence
  Synthetic DNA
tattacgactctttaaag

SEQ ID NO: 34419 - DNA, 18 bp, Artificial Sequence
  Synthetic DNA
tattacgatacactacag

SEQ ID NO: 34420 - DNA, 18 bp, Artificial Sequence
  Synthetic DNA
tattacttctcattatag

SEQ ID NO: 34421 - DNA, 18 bp, Artificial Sequence
  Synthetic DNA
ttaaactactctctatag

SEQ ID NO: 34422 - DNA, 18 bp, Artificial Sequence
  Synthetic DNA
tttaacaactcactatag

SEQ ID NO: 34423 - DNA, 18 bp, Artificial Sequence
  Synthetic DNA
ttttacgacacacaatag

SEQ ID NO: 34424 - DNA, 18 bp, Artificial Sequence
  Synthetic DNA
ttttacgacactctatag

SEQ ID NO: 34425 - DNA, 18 bp, Artificial Sequence
  Synthetic DNA
taactcgactcactaatg

SEQ ID NO: 34426 - DNA, 18 bp, Artificial Sequence
  Synthetic DNA
taaaacgacttactaatg

SEQ ID NO: 34427 - DNA, 18 bp, Artificial Sequence
  Synthetic DNA
taataagtcacactattg

SEQ ID NO: 34428 - DNA, 18 bp, Artificial Sequence
  Synthetic DNA
taatacgaaacaatattg

SEQ ID NO: 34429 - DNA, 18 bp, Artificial Sequence
  Synthetic DNA
taatacgactctcatttg

SEQ ID NO: 34430 - DNA, 18 bp, Artificial Sequence
  Synthetic DNA
taatactacactctattg

SEQ ID NO: 34431 - DNA, 18 bp, Artificial Sequence
  Synthetic DNA
taatatgacactctattg

SEQ ID NO: 34432 - DNA, 18 bp, Artificial Sequence
  Synthetic DNA
taattcgacactctaaag

SEQ ID NO: 34433 - DNA, 18 bp, Artificial Sequence
  Synthetic DNA
taattctactcacaaaag

SEQ ID NO: 34434 - DNA, 18 bp, Artificial Sequence
  Synthetic DNA
tataacgactctctattg

SEQ ID NO: 34435 - DNA, 18 bp, Artificial Sequence
  Synthetic DNA
tattacgacatactattg

SEQ ID NO: 34436 - DNA, 18 bp, Artificial Sequence
  Synthetic DNA
tattacgatacactattg

SEQ ID NO: 34437 - DNA, 18 bp, Artificial Sequence
  Synthetic DNA
tattacgtctctctattg

SEQ ID NO: 34438 - DNA, 18 bp, Artificial Sequence
  Synthetic DNA
ttatacaactcacaattg

SEQ ID NO: 34439 - DNA, 18 bp, Artificial Sequence
  Synthetic DNA
ttattcgactcccaatag

SEQ ID NO: 34440 - DNA, 18 bp, Artificial Sequence
  Synthetic DNA
taataagattcaatttag

SEQ ID NO: 34441 - DNA, 18 bp, Artificial Sequence
  Synthetic DNA
taatacaattcacttaag

SEQ ID NO: 34442 - DNA, 18 bp, Artificial Sequence
  Synthetic DNA
taatacgactctaaacag

SEQ ID NO: 34443 - DNA, 18 bp, Artificial Sequence
  Synthetic DNA
taatactactatctttag

SEQ ID NO: 34444 - DNA, 18 bp, Artificial Sequence
  Synthetic DNA
taatacttatctctatag

SEQ ID NO: 34445 - DNA, 18 bp, Artificial Sequence
  Synthetic DNA
taatatatctcacaatag

SEQ ID NO: 34446 - DNA, 18 bp, Artificial Sequence
  Synthetic DNA
tattatgactttctatag

SEQ ID NO: 34447 - DNA, 18 bp, Artificial Sequence
  Synthetic DNA
ttatacgactatccatag

SEQ ID NO: 34448 - DNA, 18 bp, Artificial Sequence
  Synthetic DNA
ttatacgattctcaatag

SEQ ID NO: 34449 - DNA, 18 bp, Artificial Sequence
  Synthetic DNA
ttataggtctcactttag

SEQ ID NO: 34450 - DNA, 18 bp, Artificial Sequence
  Synthetic DNA
aaatacgacactctattg

SEQ ID NO: 34451 - DNA, 18 bp, Artificial Sequence
  Synthetic DNA
taatacaattcacttttg

SEQ ID NO: 34452 - DNA, 18 bp, Artificial Sequence
  Synthetic DNA
tatttcgactaactaaag

SEQ ID NO: 34453 - DNA, 18 bp, Artificial Sequence
  Synthetic DNA
aaatactactctttatag

SEQ ID NO: 34454 - DNA, 18 bp, Artificial Sequence
  Synthetic DNA
taatacgacacatattag

SEQ ID NO: 34455 - DNA, 18 bp, Artificial Sequence
  Synthetic DNA
taatatgtctctttatag

SEQ ID NO: 34456 - DNA, 18 bp, Artificial Sequence
  Synthetic DNA
taatatgtttctctatag

SEQ ID NO: 34457 - DNA, 18 bp, Artificial Sequence
  Synthetic DNA
taatattactatctatag

SEQ ID NO: 34458 - DNA, 18 bp, Artificial Sequence
  Synthetic DNA
tattaagtctcactttag

SEQ ID NO: 34459 - DNA, 18 bp, Artificial Sequence
  Synthetic DNA
taattcgacacacttttg

SEQ ID NO: 34460 - DNA, 18 bp, Artificial Sequence
  Synthetic DNA
ttattcgacacactattg

SEQ ID NO: 34461 - DNA, 18 bp, Artificial Sequence
  Synthetic DNA
aaattcttctcactatag

SEQ ID NO: 34462 - DNA, 18 bp, Artificial Sequence
  Synthetic DNA
taatacgaatctcttttg

SEQ ID NO: 34463 - DNA, 18 bp, Artificial Sequence
  Synthetic DNA
taatacgacttacaaatg

SEQ ID NO: 34464 - DNA, 18 bp, Artificial Sequence
  Synthetic DNA
taatacgactttttattg

SEQ ID NO: 34465 - DNA, 18 bp, Artificial Sequence
  Synthetic DNA
taattcgactctttaaag

SEQ ID NO: 34466 - DNA, 18 bp, Artificial Sequence
  Synthetic DNA
tattacgactcatttttg

SEQ ID NO: 34467 - DNA, 18 bp, Artificial Sequence
  Synthetic DNA
tattacgattcactaatg

SEQ ID NO: 34468 - DNA, 18 bp, Artificial Sequence
  Synthetic DNA
ttattcgacacactatgg

SEQ ID NO: 34469 - DNA, 18 bp, Artificial Sequence
  Synthetic DNA
aattacgacactctatag

SEQ ID NO: 34470 - DNA, 18 bp, Artificial Sequence
  Synthetic DNA
taaaacaactctctaaag

SEQ ID NO: 34471 - DNA, 18 bp, Artificial Sequence
  Synthetic DNA
taatacgtatctctttag

SEQ ID NO: 34472 - DNA, 18 bp, Artificial Sequence
  Synthetic DNA
taatacgtctctaaatag

SEQ ID NO: 34473 - DNA, 18 bp, Artificial Sequence
  Synthetic DNA
taatataactcacttaag

SEQ ID NO: 34474 - DNA, 18 bp, Artificial Sequence
  Synthetic DNA
tatcacgtctcattatag

SEQ ID NO: 34475 - DNA, 18 bp, Artificial Sequence
  Synthetic DNA
ttatacgacttactctcg

SEQ ID NO: 34476 - DNA, 18 bp, Artificial Sequence
  Synthetic DNA
ttatacgattctctttag

SEQ ID NO: 34477 - DNA, 18 bp, Artificial Sequence
  Synthetic DNA
ttttacgactatctatag

SEQ ID NO: 34478 - DNA, 18 bp, Artificial Sequence
  Synthetic DNA
atatacgtctcactttag

SEQ ID NO: 34479 - DNA, 18 bp, Artificial Sequence
  Synthetic DNA
taattcgtttcactattg

SEQ ID NO: 34480 - DNA, 18 bp, Artificial Sequence
  Synthetic DNA
ctatacgactcactaatg

SEQ ID NO: 34481 - DNA, 18 bp, Artificial Sequence
  Synthetic DNA
taaaacgactcattaatg

SEQ ID NO: 34482 - DNA, 18 bp, Artificial Sequence
  Synthetic DNA
ttatacgactccctaatg

SEQ ID NO: 34483 - DNA, 18 bp, Artificial Sequence
  Synthetic DNA
taaaacgcctctcaatag

SEQ ID NO: 34484 - DNA, 18 bp, Artificial Sequence
  Synthetic DNA
taatactcctctctttag

SEQ ID NO: 34485 - DNA, 18 bp, Artificial Sequence
  Synthetic DNA
taatacttcactctatag

SEQ ID NO: 34486 - DNA, 18 bp, Artificial Sequence
  Synthetic DNA
taatacttttcacaatag

SEQ ID NO: 34487 - DNA, 18 bp, Artificial Sequence
  Synthetic DNA
taatatatctcactaaag

SEQ ID NO: 34488 - DNA, 18 bp, Artificial Sequence
  Synthetic DNA
taatgcgactttcaatag

SEQ ID NO: 34489 - DNA, 18 bp, Artificial Sequence
  Synthetic DNA
tattacgtctcacattag

SEQ ID NO: 34490 - DNA, 18 bp, Artificial Sequence
  Synthetic DNA
tattacgtctctttatag

SEQ ID NO: 34491 - DNA, 18 bp, Artificial Sequence
  Synthetic DNA
ttatacgatacactaaag

SEQ ID NO: 34492 - DNA, 18 bp, Artificial Sequence
  Synthetic DNA
ttatacgttacactatag

SEQ ID NO: 34493 - DNA, 18 bp, Artificial Sequence
  Synthetic DNA
aaattcgtcacactatag

SEQ ID NO: 34494 - DNA, 18 bp, Artificial Sequence
  Synthetic DNA
atatacgactcactaatg

SEQ ID NO: 34495 - DNA, 18 bp, Artificial Sequence
  Synthetic DNA
taatacaattctctattg

SEQ ID NO: 34496 - DNA, 18 bp, Artificial Sequence
  Synthetic DNA
tattacgactcaattttg

SEQ ID NO: 34497 - DNA, 18 bp, Artificial Sequence
  Synthetic DNA
ttatacgaatctctattg

SEQ ID NO: 34498 - DNA, 18 bp, Artificial Sequence
  Synthetic DNA
ttattctactcacaatag

SEQ ID NO: 34499 - DNA, 18 bp, Artificial Sequence
  Synthetic DNA
taaaacgtttcactttag

SEQ ID NO: 34500 - DNA, 18 bp, Artificial Sequence
  Synthetic DNA
taataagagacacaatag

SEQ ID NO: 34501 - DNA, 18 bp, Artificial Sequence
  Synthetic DNA
taatgctaatctctatag

SEQ ID NO: 34502 - DNA, 18 bp, Artificial Sequence
  Synthetic DNA
ttatacaactctatatag

SEQ ID NO: 34503 - DNA, 18 bp, Artificial Sequence
  Synthetic DNA
taaatcaactcacaatag

SEQ ID NO: 34504 - DNA, 18 bp, Artificial Sequence
  Synthetic DNA
taatacgactcacatatg

SEQ ID NO: 34505 - DNA, 18 bp, Artificial Sequence
  Synthetic DNA
taattcgtctttctatag

SEQ ID NO: 34506 - DNA, 18 bp, Artificial Sequence
  Synthetic DNA
tactacgtctcaatattg

SEQ ID NO: 34507 - DNA, 18 bp, Artificial Sequence
  Synthetic DNA
tattacaactcacaattg

SEQ ID NO: 34508 - DNA, 18 bp, Artificial Sequence
  Synthetic DNA
taaaacgactatcaatag

SEQ ID NO: 34509 - DNA, 18 bp, Artificial Sequence
  Synthetic DNA
taatacatcacacaatag

SEQ ID NO: 34510 - DNA, 18 bp, Artificial Sequence
  Synthetic DNA
taataccacactctaaag

SEQ ID NO: 34511 - DNA, 18 bp, Artificial Sequence
  Synthetic DNA
taatatttctcactaaag

SEQ ID NO: 34512 - DNA, 18 bp, Artificial Sequence
  Synthetic DNA
tattacgtctctatatag

SEQ ID NO: 34513 - DNA, 18 bp, Artificial Sequence
  Synthetic DNA
ttaaacgactcataatag

SEQ ID NO: 34514 - DNA, 18 bp, Artificial Sequence
  Synthetic DNA
ttatacgattcacttaag

SEQ ID NO: 34515 - DNA, 18 bp, Artificial Sequence
  Synthetic DNA
taaaacgtctcacaattg

SEQ ID NO: 34516 - DNA, 18 bp, Artificial Sequence
  Synthetic DNA
taatacgtcttacaattg

SEQ ID NO: 34517 - DNA, 18 bp, Artificial Sequence
  Synthetic DNA
taattcgacactcaatag

SEQ ID NO: 34518 - DNA, 18 bp, Artificial Sequence
  Synthetic DNA
ttaaacgactcattattg

SEQ ID NO: 34519 - DNA, 18 bp, Artificial Sequence
  Synthetic DNA
atataagtctcactatag

SEQ ID NO: 34520 - DNA, 18 bp, Artificial Sequence
  Synthetic DNA
taaaacgtcactctatag

SEQ ID NO: 34521 - DNA, 18 bp, Artificial Sequence
  Synthetic DNA
taatacgttacactttag

SEQ ID NO: 34522 - DNA, 18 bp, Artificial Sequence
  Synthetic DNA
tacaacgtctcactttag

SEQ ID NO: 34523 - DNA, 18 bp, Artificial Sequence
  Synthetic DNA
aaatacatctcactattg

SEQ ID NO: 34524 - DNA, 18 bp, Artificial Sequence
  Synthetic DNA
taattcatctctctatag

SEQ ID NO: 34525 - DNA, 18 bp, Artificial Sequence
  Synthetic DNA
taattcgtctaactttag

SEQ ID NO: 34526 - DNA, 18 bp, Artificial Sequence
  Synthetic DNA
tattacgtctaactattg

SEQ ID NO: 34527 - DNA, 18 bp, Artificial Sequence
  Synthetic DNA
tgttacgactcacttttg

SEQ ID NO: 34528 - DNA, 18 bp, Artificial Sequence
  Synthetic DNA
ttatacaacacgctatag

SEQ ID NO: 34529 - DNA, 18 bp, Artificial Sequence
  Synthetic DNA
aaatacttctctctatag

SEQ ID NO: 34530 - DNA, 18 bp, Artificial Sequence
  Synthetic DNA
taaagcgacacactaaag

SEQ ID NO: 34531 - DNA, 18 bp, Artificial Sequence
  Synthetic DNA
tattacgtcaaactatag

SEQ ID NO: 34532 - DNA, 18 bp, Artificial Sequence
  Synthetic DNA
tattacgtttcactctag

SEQ ID NO: 34533 - DNA, 18 bp, Artificial Sequence
  Synthetic DNA
tattactactcacaaaag

SEQ ID NO: 34534 - DNA, 18 bp, Artificial Sequence
  Synthetic DNA
ttaaacgactctctaaag

SEQ ID NO: 34535 - DNA, 18 bp, Artificial Sequence
  Synthetic DNA
ttatacatttcactatag

SEQ ID NO: 34536 - DNA, 18 bp, Artificial Sequence
  Synthetic DNA
ttatatgacacactaaag

SEQ ID NO: 34537 - DNA, 18 bp, Artificial Sequence
  Synthetic DNA
ttactcgactcactattg

SEQ ID NO: 34538 - DNA, 18 bp, Artificial Sequence
  Synthetic DNA
taaatccactcattatag

SEQ ID NO: 34539 - DNA, 18 bp, Artificial Sequence
  Synthetic DNA
taatacgaatctcaattg

SEQ ID NO: 34540 - DNA, 18 bp, Artificial Sequence
  Synthetic DNA
taatacgacacaattttg

SEQ ID NO: 34541 - DNA, 18 bp, Artificial Sequence
  Synthetic DNA
taatacgtttcacaattg

SEQ ID NO: 34542 - DNA, 18 bp, Artificial Sequence
  Synthetic DNA
ttattcgactcaatttag

SEQ ID NO: 34543 - DNA, 18 bp, Artificial Sequence
  Synthetic DNA
tttaacgactcgctatag

SEQ ID NO: 34544 - DNA, 18 bp, Artificial Sequence
  Synthetic DNA
taatacgtcattctatag

SEQ ID NO: 34545 - DNA, 18 bp, Artificial Sequence
  Synthetic DNA
taatacgtctttcaatag

SEQ ID NO: 34546 - DNA, 18 bp, Artificial Sequence
  Synthetic DNA
tattaagactctctttag

SEQ ID NO: 34547 - DNA, 18 bp, Artificial Sequence
  Synthetic DNA
ttatacgtctctctatcg

SEQ ID NO: 34548 - DNA, 18 bp, Artificial Sequence
  Synthetic DNA
attttcgactcactatag

SEQ ID NO: 34549 - DNA, 18 bp, Artificial Sequence
  Synthetic DNA
taatacgtcacaccattg

SEQ ID NO: 34550 - DNA, 18 bp, Artificial Sequence
  Synthetic DNA
taatactattcactaatg

SEQ ID NO: 34551 - DNA, 18 bp, Artificial Sequence
  Synthetic DNA
ttattcgattcactttag

SEQ ID NO: 34552 - DNA, 18 bp, Artificial Sequence
  Synthetic DNA
aaatacgactctcttaag

SEQ ID NO: 34553 - DNA, 18 bp, Artificial Sequence
  Synthetic DNA
aaatatgactctctaaag

SEQ ID NO: 34554 - DNA, 18 bp, Artificial Sequence
  Synthetic DNA
taatacgattcaattaag

SEQ ID NO: 34555 - DNA, 18 bp, Artificial Sequence
  Synthetic DNA
tattacaacactctatag

SEQ ID NO: 34556 - DNA, 18 bp, Artificial Sequence
  Synthetic DNA
ttataatacacactatag

SEQ ID NO: 34557 - DNA, 18 bp, Artificial Sequence
  Synthetic DNA
ttatacaactcacattag

SEQ ID NO: 34558 - DNA, 18 bp, Artificial Sequence
  Synthetic DNA
ttatacgtcacactctag

SEQ ID NO: 34559 - DNA, 18 bp, Artificial Sequence
  Synthetic DNA
ttatactacttactttag

SEQ ID NO: 34560 - DNA, 18 bp, Artificial Sequence
  Synthetic DNA
ttttacgattcactaaag

SEQ ID NO: 34561 - DNA, 18 bp, Artificial Sequence
  Synthetic DNA
taaaacgtcacactattg

SEQ ID NO: 34562 - DNA, 18 bp, Artificial Sequence
  Synthetic DNA
taattctacactctatag

SEQ ID NO: 34563 - DNA, 18 bp, Artificial Sequence
  Synthetic DNA
ttatacgactcataattg

SEQ ID NO: 34564 - DNA, 18 bp, Artificial Sequence
  Synthetic DNA
ttatacgacttacaattg

SEQ ID NO: 34565 - DNA, 18 bp, Artificial Sequence
  Synthetic DNA
aaaaacgtctcactttag

SEQ ID NO: 34566 - DNA, 18 bp, Artificial Sequence
  Synthetic DNA
taatatgattctctttag

SEQ ID NO: 34567 - DNA, 18 bp, Artificial Sequence
  Synthetic DNA
tataacgactcacattag

SEQ ID NO: 34568 - DNA, 18 bp, Artificial Sequence
  Synthetic DNA
tattacgaatctcaatag

SEQ ID NO: 34569 - DNA, 18 bp, Artificial Sequence
  Synthetic DNA
ttatacttttcactatag

SEQ ID NO: 34570 - DNA, 18 bp, Artificial Sequence
  Synthetic DNA
taaatcgattcactattg

SEQ ID NO: 34571 - DNA, 18 bp, Artificial Sequence
  Synthetic DNA
tattacgtatcactattg

SEQ ID NO: 34572 - DNA, 18 bp, Artificial Sequence
  Synthetic DNA
aattacgtcttactatag

SEQ ID NO: 34573 - DNA, 18 bp, Artificial Sequence
  Synthetic DNA
taatactactttctttag

SEQ ID NO: 34574 - DNA, 18 bp, Artificial Sequence
  Synthetic DNA
taatatgtctctctaaag

SEQ ID NO: 34575 - DNA, 18 bp, Artificial Sequence
  Synthetic DNA
ttatacgaaacactttag

SEQ ID NO: 34576 - DNA, 18 bp, Artificial Sequence
  Synthetic DNA
ttatacgactcactgtcc

SEQ ID NO: 34577 - DNA, 18 bp, Artificial Sequence
  Synthetic DNA
ttatacgtctatctatag

SEQ ID NO: 34578 - DNA, 18 bp, Artificial Sequence
  Synthetic DNA
tttaacgactcattatag

SEQ ID NO: 34579 - DNA, 18 bp, Artificial Sequence
  Synthetic DNA
taaatcgacacactattg

SEQ ID NO: 34580 - DNA, 18 bp, Artificial Sequence
  Synthetic DNA
taattcgattcactaatg

SEQ ID NO: 34581 - DNA, 18 bp, Artificial Sequence
  Synthetic DNA
taatacatctcacaattg

SEQ ID NO: 34582 - DNA, 18 bp, Artificial Sequence
  Synthetic DNA
taatacgattctcaattg

SEQ ID NO: 34583 - DNA, 18 bp, Artificial Sequence
  Synthetic DNA
taattcgactctcattag

SEQ ID NO: 34584 - DNA, 18 bp, Artificial Sequence
  Synthetic DNA
taattcgtcatactatag

SEQ ID NO: 34585 - DNA, 18 bp, Artificial Sequence
  Synthetic DNA
ttaatcggctcactatag

SEQ ID NO: 34586 - DNA, 18 bp, Artificial Sequence
  Synthetic DNA
ttatacgatccactattg

SEQ ID NO: 34587 - DNA, 18 bp, Artificial Sequence
  Synthetic DNA
tcatacgaatctcaatag

SEQ ID NO: 34588 - DNA, 18 bp, Artificial Sequence
  Synthetic DNA
ttatacgacactctaaag

SEQ ID NO: 34589 - DNA, 18 bp, Artificial Sequence
  Synthetic DNA
ttatacgtcacactacag

SEQ ID NO: 34590 - DNA, 18 bp, Artificial Sequence
  Synthetic DNA
taatatgtctcactaatg

SEQ ID NO: 34591 - DNA, 18 bp, Artificial Sequence
  Synthetic DNA
tataacgattcactaaag

SEQ ID NO: 34592 - DNA, 18 bp, Artificial Sequence
  Synthetic DNA
tattaggtctcactttag

SEQ ID NO: 34593 - DNA, 18 bp, Artificial Sequence
  Synthetic DNA
ttatacgaatctctaaag

SEQ ID NO: 34594 - DNA, 18 bp, Artificial Sequence
  Synthetic DNA
ttatactactcacattag

SEQ ID NO: 34595 - DNA, 18 bp, Artificial Sequence
  Synthetic DNA
atatacgtctctctatag

SEQ ID NO: 34596 - DNA, 18 bp, Artificial Sequence
  Synthetic DNA
taatacttcacactattg

SEQ ID NO: 34597 - DNA, 18 bp, Artificial Sequence
  Synthetic DNA
ttatacgtatcactattg

SEQ ID NO: 34598 - DNA, 18 bp, Artificial Sequence
  Synthetic DNA
ttattcgacacactttag

SEQ ID NO: 34599 - DNA, 18 bp, Artificial Sequence
  Synthetic DNA
aaatacgtctctctttag

SEQ ID NO: 34600 - DNA, 18 bp, Artificial Sequence
  Synthetic DNA
acatacgactctctttag

SEQ ID NO: 34601 - DNA, 18 bp, Artificial Sequence
  Synthetic DNA
taatactactctcattag

SEQ ID NO: 34602 - DNA, 18 bp, Artificial Sequence
  Synthetic DNA
ttatacgactaacattag

SEQ ID NO: 34603 - DNA, 18 bp, Artificial Sequence
  Synthetic DNA
taattcgaatcacaaaag

SEQ ID NO: 34604 - DNA, 18 bp, Artificial Sequence
  Synthetic DNA
tattacgactatctattg

SEQ ID NO: 34605 - DNA, 18 bp, Artificial Sequence
  Synthetic DNA
aattacgtctctctatag

SEQ ID NO: 34606 - DNA, 18 bp, Artificial Sequence
  Synthetic DNA
taaaaagactcacaaaag

SEQ ID NO: 34607 - DNA, 18 bp, Artificial Sequence
  Synthetic DNA
taatacgaaactcaatag

SEQ ID NO: 34608 - DNA, 18 bp, Artificial Sequence
  Synthetic DNA
taatacgtctaattaaag

SEQ ID NO: 34609 - DNA, 18 bp, Artificial Sequence
  Synthetic DNA
tattacgacacacttaag

SEQ ID NO: 34610 - DNA, 18 bp, Artificial Sequence
  Synthetic DNA
taatacgattcattaatg

SEQ ID NO: 34611 - DNA, 18 bp, Artificial Sequence
  Synthetic DNA
taatacgtctctctaatg

SEQ ID NO: 34612 - DNA, 18 bp, Artificial Sequence
  Synthetic DNA
taattcgtctctctttag

SEQ ID NO: 34613 - DNA, 18 bp, Artificial Sequence
  Synthetic DNA
taaaacgattctctaaag

SEQ ID NO: 34614 - DNA, 18 bp, Artificial Sequence
  Synthetic DNA
taatactaatcacaaaag

SEQ ID NO: 34615 - DNA, 18 bp, Artificial Sequence
  Synthetic DNA
ttatgcgattctctatag

SEQ ID NO: 34616 - DNA, 18 bp, Artificial Sequence
  Synthetic DNA
ttttacatctcactatag

SEQ ID NO: 34617 - DNA, 18 bp, Artificial Sequence
  Synthetic DNA
tatttctactcacaatag

SEQ ID NO: 34618 - DNA, 18 bp, Artificial Sequence
  Synthetic DNA
taatacaactctcaattg

SEQ ID NO: 34619 - DNA, 18 bp, Artificial Sequence
  Synthetic DNA
tatcacgactcattattg

SEQ ID NO: 34620 - DNA, 18 bp, Artificial Sequence
  Synthetic DNA
ttattcgacttactaaag

SEQ ID NO: 34621 - DNA, 18 bp, Artificial Sequence
  Synthetic DNA
atatacgactcattttag

SEQ ID NO: 34622 - DNA, 18 bp, Artificial Sequence
  Synthetic DNA
taatacgtcactctaaag

SEQ ID NO: 34623 - DNA, 18 bp, Artificial Sequence
  Synthetic DNA
taatacgtctttctttag

SEQ ID NO: 34624 - DNA, 18 bp, Artificial Sequence
  Synthetic DNA
taaatcgacactctatag

SEQ ID NO: 34625 - DNA, 18 bp, Artificial Sequence
  Synthetic DNA
ttatacgactctcttaag

SEQ ID NO: 34626 - DNA, 18 bp, Artificial Sequence
  Synthetic DNA
tattacgacacacaattg

SEQ ID NO: 34627 - DNA, 18 bp, Artificial Sequence
  Synthetic DNA
ttatacaacacactattg

SEQ ID NO: 34628 - DNA, 18 bp, Artificial Sequence
  Synthetic DNA
ttatacgacactctattg

SEQ ID NO: 34629 - DNA, 18 bp, Artificial Sequence
  Synthetic DNA
aaatacgacacacaaaag

SEQ ID NO: 34630 - DNA, 18 bp, Artificial Sequence
  Synthetic DNA
taaaacgtctcattttag

SEQ ID NO: 34631 - DNA, 18 bp, Artificial Sequence
  Synthetic DNA
tattacctctcacaatag

SEQ ID NO: 34632 - DNA, 18 bp, Artificial Sequence
  Synthetic DNA
tattactactcaatttag

SEQ ID NO: 34633 - DNA, 18 bp, Artificial Sequence
  Synthetic DNA
ttaaacgactctcaatag

SEQ ID NO: 34634 - DNA, 18 bp, Artificial Sequence
  Synthetic DNA
taaatcgactcactaatg

SEQ ID NO: 34635 - DNA, 18 bp, Artificial Sequence
  Synthetic DNA
taatacgtctcatttttg

SEQ ID NO: 34636 - DNA, 18 bp, Artificial Sequence
  Synthetic DNA
taaaactaatctctatag

SEQ ID NO: 34637 - DNA, 18 bp, Artificial Sequence
  Synthetic DNA
taatacgacatacttaag

SEQ ID NO: 34638 - DNA, 18 bp, Artificial Sequence
  Synthetic DNA
taatacgttacactattg

SEQ ID NO: 34639 - DNA, 18 bp, Artificial Sequence
  Synthetic DNA
ttattcgactcaataaag

SEQ ID NO: 34640 - DNA, 18 bp, Artificial Sequence
  Synthetic DNA
taattcgacacacattag

SEQ ID NO: 34641 - DNA, 18 bp, Artificial Sequence
  Synthetic DNA
tattccgactctctattg

SEQ ID NO: 34642 - DNA, 18 bp, Artificial Sequence
  Synthetic DNA
ttatactactcacaattg

SEQ ID NO: 34643 - DNA, 18 bp, Artificial Sequence
  Synthetic DNA
aaatacgacactcaatag

SEQ ID NO: 34644 - DNA, 18 bp, Artificial Sequence
  Synthetic DNA
ttttacgactcaatttag

SEQ ID NO: 34645 - DNA, 18 bp, Artificial Sequence
  Synthetic DNA
ttttacgtcttactatag

SEQ ID NO: 34646 - DNA, 18 bp, Artificial Sequence
  Synthetic DNA
ttatacgtctcactcttg

SEQ ID NO: 34647 - DNA, 18 bp, Artificial Sequence
  Synthetic DNA
taatacaactctcattag

SEQ ID NO: 34648 - DNA, 18 bp, Artificial Sequence
  Synthetic DNA
ctattcgactcactaaag

SEQ ID NO: 34649 - DNA, 18 bp, Artificial Sequence
  Synthetic DNA
tatttcgacactctatag

SEQ ID NO: 34650 - DNA, 18 bp, Artificial Sequence
  Synthetic DNA
ttatacgtctcataatag

SEQ ID NO: 34651 - DNA, 18 bp, Artificial Sequence
  Synthetic DNA
atatacgactcaatttag

SEQ ID NO: 34652 - DNA, 18 bp, Artificial Sequence
  Synthetic DNA
tattacgactcaattaag

SEQ ID NO: 34653 - DNA, 18 bp, Artificial Sequence
  Synthetic DNA
taaaacgtctctttatag

SEQ ID NO: 34654 - DNA, 18 bp, Artificial Sequence
  Synthetic DNA
taatacgatactcaatag

SEQ ID NO: 34655 - DNA, 18 bp, Artificial Sequence
  Synthetic DNA
taatacgtcatactttag

SEQ ID NO: 34656 - DNA, 18 bp, Artificial Sequence
  Synthetic DNA
tattacatctcactaaag

SEQ ID NO: 34657 - DNA, 18 bp, Artificial Sequence
  Synthetic DNA
aaatacaactcacaattg

SEQ ID NO: 34658 - DNA, 18 bp, Artificial Sequence
  Synthetic DNA
atatacgactcacttaag

SEQ ID NO: 34659 - DNA, 18 bp, Artificial Sequence
  Synthetic DNA
taaaacgacactctttag

SEQ ID NO: 34660 - DNA, 18 bp, Artificial Sequence
  Synthetic DNA
ttatacgtcacacaatag

SEQ ID NO: 34661 - DNA, 18 bp, Artificial Sequence
  Synthetic DNA
ttatacgtctctcaatag

SEQ ID NO: 34662 - DNA, 18 bp, Artificial Sequence
  Synthetic DNA
taatacgtcacactaatg

SEQ ID NO: 34663 - DNA, 18 bp, Artificial Sequence
  Synthetic DNA
taattcgtcactctatag

SEQ ID NO: 34664 - DNA, 18 bp, Artificial Sequence
  Synthetic DNA
taattcgacacattattg

SEQ ID NO: 34665 - DNA, 18 bp, Artificial Sequence
  Synthetic DNA
tattacgactcacatttg

SEQ ID NO: 34666 - DNA, 18 bp, Artificial Sequence
  Synthetic DNA
taaaacgacacacattag

SEQ ID NO: 34667 - DNA, 18 bp, Artificial Sequence
  Synthetic DNA
ttatacgtctcacaaaag

SEQ ID NO: 34668 - DNA, 18 bp, Artificial Sequence
  Synthetic DNA
ttatacttctcactattg

SEQ ID NO: 34669 - DNA, 18 bp, Artificial Sequence
  Synthetic DNA
ttatacgtctcacattag

SEQ ID NO: 34670 - DNA, 18 bp, Artificial Sequence
  Synthetic DNA
ttattcgaatcactattg

SEQ ID NO: 34671 - DNA, 18 bp, Artificial Sequence
  Synthetic DNA
taatacgtctcatttaag

SEQ ID NO: 34672 - DNA, 18 bp, Artificial Sequence
  Synthetic DNA
tattacgacacacaaaag

SEQ ID NO: 34673 - DNA, 18 bp, Artificial Sequence
  Synthetic DNA
ttaaacgacacacaatag

SEQ ID NO: 34674 - DNA, 18 bp, Artificial Sequence
  Synthetic DNA
ttattcgactctctaaag

SEQ ID NO: 34675 - DNA, 18 bp, Artificial Sequence
  Synthetic DNA
taatacgattatctattg

SEQ ID NO: 34676 - DNA, 18 bp, Artificial Sequence
  Synthetic DNA
taatacgtctctcattag

SEQ ID NO: 34677 - DNA, 18 bp, Artificial Sequence
  Synthetic DNA
taatacgacactcttaag

SEQ ID NO: 34678 - DNA, 18 bp, Artificial Sequence
  Synthetic DNA
ttatacgtctaactattg

SEQ ID NO: 34679 - DNA, 18 bp, Artificial Sequence
  Synthetic DNA
atttacgactcactaaag

SEQ ID NO: 34680 - DNA, 18 bp, Artificial Sequence
  Synthetic DNA
ttatactactctctttag

SEQ ID NO: 34681 - DNA, 18 bp, Artificial Sequence
  Synthetic DNA
taatactactcacttatg

SEQ ID NO: 34682 - DNA, 18 bp, Artificial Sequence
  Synthetic DNA
ttatacgacacacaattg

SEQ ID NO: 34683 - DNA, 18 bp, Artificial Sequence
  Synthetic DNA
tattacgacacacattag

SEQ ID NO: 34684 - DNA, 18 bp, Artificial Sequence
  Synthetic DNA
ttatacgactcatttaag

SEQ ID NO: 34685 - DNA, 18 bp, Artificial Sequence
  Synthetic DNA
ttatacgactcacaaatg

SEQ ID NO: 34686 - DNA, 18 bp, Artificial Sequence
  Synthetic DNA
tattacgactcacataag

SEQ ID NO: 34687 - DNA, 18 bp, Artificial Sequence
  Synthetic DNA
taattcgtttcactttag

SEQ ID NO: 34688 - DNA, 18 bp, Artificial Sequence
  Synthetic DNA
ttatacaactcacttttg

SEQ ID NO: 34689 - DNA, 18 bp, Artificial Sequence
  Synthetic DNA
atatacgtctcactaaag

SEQ ID NO: 34690 - DNA, 18 bp, Artificial Sequence
  Synthetic DNA
tattacgtcttactattg

SEQ ID NO: 34691 - DNA, 18 bp, Artificial Sequence
  Synthetic DNA
aaatacgactcactgtcc

SEQ ID NO: 34692 - DNA, 18 bp, Artificial Sequence
  Synthetic DNA
acgtaagactcgctatcg

SEQ ID NO: 34693 - DNA, 18 bp, Artificial Sequence
  Synthetic DNA
taatgcgactgtcaatcg

SEQ ID NO: 34694 - DNA, 18 bp, Artificial Sequence
  Synthetic DNA
tgatgcgacaacccattg

SEQ ID NO: 34695 - DNA, 18 bp, Artificial Sequence
  Synthetic DNA
taatatgtgttacactag

SEQ ID NO: 34696 - DNA, 18 bp, Artificial Sequence
  Synthetic DNA
gaataattcgcgctatag

SEQ ID NO: 34697 - DNA, 18 bp, Artificial Sequence
  Synthetic DNA
taaggcgactcccaacag

SEQ ID NO: 34698 - DNA, 18 bp, Artificial Sequence
  Synthetic DNA
tgttacggctcacattag

SEQ ID NO: 34699 - DNA, 18 bp, Artificial Sequence
  Synthetic DNA
ttcatcgaatcaccattg

SEQ ID NO: 34700 - DNA, 18 bp, Artificial Sequence
  Synthetic DNA
gcatttgtatcaccgaag

SEQ ID NO: 34701 - DNA, 18 bp, Artificial Sequence
  Synthetic DNA
taataagactctctcgtg

SEQ ID NO: 34702 - DNA, 18 bp, Artificial Sequence
  Synthetic DNA
taatccgagccgctattg

SEQ ID NO: 34703 - DNA, 18 bp, Artificial Sequence
  Synthetic DNA
ttagccgtctcacaattg

SEQ ID NO: 34704 - DNA, 18 bp, Artificial Sequence
  Synthetic DNA
tgatacgataccctaaag

SEQ ID NO: 34705 - DNA, 18 bp, Artificial Sequence
  Synthetic DNA
tggtgtgtttcactaaag

SEQ ID NO: 34706 - DNA, 18 bp, Artificial Sequence
  Synthetic DNA
taaaatgaccaattctag

SEQ ID NO: 34707 - DNA, 18 bp, Artificial Sequence
  Synthetic DNA
tatagaaacacactattg

SEQ ID NO: 34708 - DNA, 18 bp, Artificial Sequence
  Synthetic DNA
taatgcggctcgcactag

SEQ ID NO: 34709 - DNA, 18 bp, Artificial Sequence
  Synthetic DNA
taaaacgacacgtctttg

SEQ ID NO: 34710 - DNA, 18 bp, Artificial Sequence
  Synthetic DNA
taataaggttctctattg

SEQ ID NO: 34711 - DNA, 18 bp, Artificial Sequence
  Synthetic DNA
tattacggggcgcaatag

SEQ ID NO: 34712 - DNA, 18 bp, Artificial Sequence
  Synthetic DNA
taatgcgcttcactaatg

SEQ ID NO: 34713 - DNA, 18 bp, Artificial Sequence
  Synthetic DNA
tgattcgacttgccatag

SEQ ID NO: 34714 - DNA, 18 bp, Artificial Sequence
  Synthetic DNA
tgataagatcctctagag

SEQ ID NO: 34715 - DNA, 18 bp, Artificial Sequence
  Synthetic DNA
ttctctgactccgtttag

SEQ ID NO: 34716 - DNA, 18 bp, Artificial Sequence
  Synthetic DNA
taaaaagattcgccaaag

SEQ ID NO: 34717 - DNA, 18 bp, Artificial Sequence
  Synthetic DNA
taaaaatacgaacgctag

SEQ ID NO: 34718 - DNA, 18 bp, Artificial Sequence
  Synthetic DNA
ttaaggaactcactatag

SEQ ID NO: 34719 - DNA, 18 bp, Artificial Sequence
  Synthetic DNA
ttaatcgactcactgatg

SEQ ID NO: 34720 - DNA, 18 bp, Artificial Sequence
  Synthetic DNA
ttatgcgactcaccaacg

SEQ ID NO: 34721 - DNA, 18 bp, Artificial Sequence
  Synthetic DNA
tgatgcgacgaacactag

SEQ ID NO: 34722 - DNA, 18 bp, Artificial Sequence
  Synthetic DNA
tcatacggcgctctattg

SEQ ID NO: 34723 - DNA, 18 bp, Artificial Sequence
  Synthetic DNA
ttatatgattccctacag

SEQ ID NO: 34724 - DNA, 18 bp, Artificial Sequence
  Synthetic DNA
aaattcgtggcactatcg

SEQ ID NO: 34725 - DNA, 18 bp, Artificial Sequence
  Synthetic DNA
taaaacgcgtcaatcaag

SEQ ID NO: 34726 - DNA, 18 bp, Artificial Sequence
  Synthetic DNA
tccttcgcttcactgtag

SEQ ID NO: 34727 - DNA, 18 bp, Artificial Sequence
  Synthetic DNA
ttacttggctctcactag

SEQ ID NO: 34728 - DNA, 18 bp, Artificial Sequence
  Synthetic DNA
taacacgtgacactttag

SEQ ID NO: 34729 - DNA, 18 bp, Artificial Sequence
  Synthetic DNA
ttatgcaacgcactattg

SEQ ID NO: 34730 - DNA, 18 bp, Artificial Sequence
  Synthetic DNA
taatacgatactccctag

SEQ ID NO: 34731 - DNA, 18 bp, Artificial Sequence
  Synthetic DNA
tattaccactctttgtag

SEQ ID NO: 34732 - DNA, 18 bp, Artificial Sequence
  Synthetic DNA
tgaaacaactcattacag

SEQ ID NO: 34733 - DNA, 18 bp, Artificial Sequence
  Synthetic DNA
gcttcagactcactatag

SEQ ID NO: 34734 - DNA, 18 bp, Artificial Sequence
  Synthetic DNA
tatatcggctcgcttttg

SEQ ID NO: 34735 - DNA, 18 bp, Artificial Sequence
  Synthetic DNA
cctttcgcctcactatag

SEQ ID NO: 34736 - DNA, 18 bp, Artificial Sequence
  Synthetic DNA
taaatcgactcccttaag

SEQ ID NO: 34737 - DNA, 18 bp, Artificial Sequence
  Synthetic DNA
ttttcgaactcactaaag

SEQ ID NO: 34738 - DNA, 18 bp, Artificial Sequence
  Synthetic DNA
aaatacgtctcgccatcg

SEQ ID NO: 34739 - DNA, 18 bp, Artificial Sequence
  Synthetic DNA
ttattcgcatcacactag

SEQ ID NO: 34740 - DNA, 18 bp, Artificial Sequence
  Synthetic DNA
taatatgacagccaattg

SEQ ID NO: 34741 - DNA, 18 bp, Artificial Sequence
  Synthetic DNA
ttatgggaatcgatatag

SEQ ID NO: 34742 - DNA, 18 bp, Artificial Sequence
  Synthetic DNA
caattagactcgctattg

SEQ ID NO: 34743 - DNA, 18 bp, Artificial Sequence
  Synthetic DNA
caatcggactccctattg

SEQ ID NO: 34744 - DNA, 18 bp, Artificial Sequence
  Synthetic DNA
tgctacaactctcaattg

SEQ ID NO: 34745 - DNA, 18 bp, Artificial Sequence
  Synthetic DNA
ttatcctactctgtatag

SEQ ID NO: 34746 - DNA, 18 bp, Artificial Sequence
  Synthetic DNA
tagcaggacactctatag

SEQ ID NO: 34747 - DNA, 18 bp, Artificial Sequence
  Synthetic DNA
ttaatctactcactcttg

SEQ ID NO: 34748 - DNA, 18 bp, Artificial Sequence
  Synthetic DNA
tttatcgactcactgtag

SEQ ID NO: 34749 - DNA, 18 bp, Artificial Sequence
  Synthetic DNA
taaaaaggctcgctacag

SEQ ID NO: 34750 - DNA, 18 bp, Artificial Sequence
  Synthetic DNA
tttaagcgctacctatcg

SEQ ID NO: 34751 - DNA, 18 bp, Artificial Sequence
  Synthetic DNA
tgatatcgctaaaactag

SEQ ID NO: 34752 - DNA, 18 bp, Artificial Sequence
  Synthetic DNA
taaaaggactgacttttg

SEQ ID NO: 34753 - DNA, 18 bp, Artificial Sequence
  Synthetic DNA
tggaaagagtctctatcg

SEQ ID NO: 34754 - DNA, 18 bp, Artificial Sequence
  Synthetic DNA
tatttcgtcacactcttg

SEQ ID NO: 34755 - DNA, 18 bp, Artificial Sequence
  Synthetic DNA
tcatacaacatgctattg

SEQ ID NO: 34756 - DNA, 18 bp, Artificial Sequence
  Synthetic DNA
tgataactcacactatag

SEQ ID NO: 34757 - DNA, 18 bp, Artificial Sequence
  Synthetic DNA
ttagacaactctccaaag

SEQ ID NO: 34758 - DNA, 18 bp, Artificial Sequence
  Synthetic DNA
tagtacatctcacctttg

SEQ ID NO: 34759 - DNA, 18 bp, Artificial Sequence
  Synthetic DNA
tacttcggctcgttacag

SEQ ID NO: 34760 - DNA, 18 bp, Artificial Sequence
  Synthetic DNA
aaatttaactcactgttg

SEQ ID NO: 34761 - DNA, 18 bp, Artificial Sequence
  Synthetic DNA
aaattcaactctaagcag

SEQ ID NO: 34762 - DNA, 18 bp, Artificial Sequence
  Synthetic DNA
actttcggctcactattg

SEQ ID NO: 34763 - DNA, 18 bp, Artificial Sequence
  Synthetic DNA
tattaagtgtcactgcag

SEQ ID NO: 34764 - DNA, 18 bp, Artificial Sequence
  Synthetic DNA
tgccactactctctattg

SEQ ID NO: 34765 - DNA, 18 bp, Artificial Sequence
  Synthetic DNA
ttctaagagtcacttaag

SEQ ID NO: 34766 - DNA, 18 bp, Artificial Sequence
  Synthetic DNA
tattacgcgtcacttttg

SEQ ID NO: 34767 - DNA, 18 bp, Artificial Sequence
  Synthetic DNA
tgataggtctctgtttag

SEQ ID NO: 34768 - DNA, 18 bp, Artificial Sequence
  Synthetic DNA
atttaggactcagaccag

SEQ ID NO: 34769 - DNA, 18 bp, Artificial Sequence
  Synthetic DNA
taattcgtctcaccactg

SEQ ID NO: 34770 - DNA, 18 bp, Artificial Sequence
  Synthetic DNA
taataaggcgacctaaag

SEQ ID NO: 34771 - DNA, 18 bp, Artificial Sequence
  Synthetic DNA
ttattcaactcgctaaag

SEQ ID NO: 34772 - DNA, 18 bp, Artificial Sequence
  Synthetic DNA
caatacgattcgttattg

SEQ ID NO: 34773 - DNA, 18 bp, Artificial Sequence
  Synthetic DNA
cgattctactccctttag

SEQ ID NO: 34774 - DNA, 18 bp, Artificial Sequence
  Synthetic DNA
taatttgactcacgaatg

SEQ ID NO: 34775 - DNA, 18 bp, Artificial Sequence
  Synthetic DNA
tactacaactctctaccg

SEQ ID NO: 34776 - DNA, 18 bp, Artificial Sequence
  Synthetic DNA
ttataagtctctccatag

SEQ ID NO: 34777 - DNA, 18 bp, Artificial Sequence
  Synthetic DNA
ttgtacaactcacagtag

SEQ ID NO: 34778 - DNA, 18 bp, Artificial Sequence
  Synthetic DNA
gtatgcgactcgctattg

SEQ ID NO: 34779 - DNA, 18 bp, Artificial Sequence
  Synthetic DNA
tctaacgacaagctatag

SEQ ID NO: 34780 - DNA, 18 bp, Artificial Sequence
  Synthetic DNA
gtagactacactctttcg

SEQ ID NO: 34781 - DNA, 18 bp, Artificial Sequence
  Synthetic DNA
taatttgagggactatag

SEQ ID NO: 34782 - DNA, 18 bp, Artificial Sequence
  Synthetic DNA
tactacgtgacactacag

SEQ ID NO: 34783 - DNA, 18 bp, Artificial Sequence
  Synthetic DNA
tgcaacgtgtctataaag

SEQ ID NO: 34784 - DNA, 18 bp, Artificial Sequence
  Synthetic DNA
ttaagcgactctctttag

SEQ ID NO: 34785 - DNA, 18 bp, Artificial Sequence
  Synthetic DNA
tttatagactctctatcg

SEQ ID NO: 34786 - DNA, 18 bp, Artificial Sequence
  Synthetic DNA
aaacaagtccctctatgg

SEQ ID NO: 34787 - DNA, 18 bp, Artificial Sequence
  Synthetic DNA
tatttacactccctacag

SEQ ID NO: 34788 - DNA, 18 bp, Artificial Sequence
  Synthetic DNA
ttattcgactcacaccag

SEQ ID NO: 34789 - DNA, 18 bp, Artificial Sequence
  Synthetic DNA
tagaacgtcactctattg

SEQ ID NO: 34790 - DNA, 18 bp, Artificial Sequence
  Synthetic DNA
acagacgactttggtttg

SEQ ID NO: 34791 - DNA, 18 bp, Artificial Sequence
  Synthetic DNA
cgtttcggcttatgatag

SEQ ID NO: 34792 - DNA, 18 bp, Artificial Sequence
  Synthetic DNA
tattaggactcacattcg

SEQ ID NO: 34793 - DNA, 18 bp, Artificial Sequence
  Synthetic DNA
ttatacgaaacactaaaa

SEQ ID NO: 34794 - DNA, 18 bp, Artificial Sequence
  Synthetic DNA
ttattcggctcacactag

SEQ ID NO: 34795 - DNA, 18 bp, Artificial Sequence
  Synthetic DNA
taataagactttgtattg

SEQ ID NO: 34796 - DNA, 18 bp, Artificial Sequence
  Synthetic DNA
taatgcgattcacttgtg

SEQ ID NO: 34797 - DNA, 18 bp, Artificial Sequence
  Synthetic DNA
ttataagactcgctatta

SEQ ID NO: 34798 - DNA, 18 bp, Artificial Sequence
  Synthetic DNA
gataacgtctcacttttg

SEQ ID NO: 34799 - DNA, 18 bp, Artificial Sequence
  Synthetic DNA
aaatccgtctcaaaattg

SEQ ID NO: 34800 - DNA, 18 bp, Artificial Sequence
  Synthetic DNA
tagtacaacttagctgtg

SEQ ID NO: 34801 - DNA, 18 bp, Artificial Sequence
  Synthetic DNA
tagtacgacaggtcattg

SEQ ID NO: 34802 - DNA, 18 bp, Artificial Sequence
  Synthetic DNA
tattgcgtgtcacaaaag

SEQ ID NO: 34803 - DNA, 18 bp, Artificial Sequence
  Synthetic DNA
tcactcgactcaccttag

SEQ ID NO: 34804 - DNA, 18 bp, Artificial Sequence
  Synthetic DNA
tcattctcgtcactatag

SEQ ID NO: 34805 - DNA, 18 bp, Artificial Sequence
  Synthetic DNA
tgatacaactctttaaag

SEQ ID NO: 34806 - DNA, 18 bp, Artificial Sequence
  Synthetic DNA
tgatagagcgcactatag

SEQ ID NO: 34807 - DNA, 18 bp, Artificial Sequence
  Synthetic DNA
ttacaagactcacttttg

SEQ ID NO: 34808 - DNA, 18 bp, Artificial Sequence
  Synthetic DNA
tgaagcgattcacaagag

SEQ ID NO: 34809 - DNA, 18 bp, Artificial Sequence
  Synthetic DNA
ttaaatggctcactattg

SEQ ID NO: 34810 - DNA, 18 bp, Artificial Sequence
  Synthetic DNA
taatatgcctcgccactg

SEQ ID NO: 34811 - DNA, 18 bp, Artificial Sequence
  Synthetic DNA
taaaacgtatctttatag

SEQ ID NO: 34812 - DNA, 18 bp, Artificial Sequence
  Synthetic DNA
ctaaacgactctctttag

SEQ ID NO: 34813 - DNA, 18 bp, Artificial Sequence
  Synthetic DNA
taattcgtctcgcattag

SEQ ID NO: 34814 - DNA, 18 bp, Artificial Sequence
  Synthetic DNA
aattagaactcactatca

SEQ ID NO: 34815 - DNA, 18 bp, Artificial Sequence
  Synthetic DNA
taacacgaatctcattag

SEQ ID NO: 34816 - DNA, 18 bp, Artificial Sequence
  Synthetic DNA
taagaaaacacaccatag

SEQ ID NO: 34817 - DNA, 18 bp, Artificial Sequence
  Synthetic DNA
taatacgctcctctccag

SEQ ID NO: 34818 - DNA, 18 bp, Artificial Sequence
  Synthetic DNA
tctgacgacacactctag

SEQ ID NO: 34819 - DNA, 18 bp, Artificial Sequence
  Synthetic DNA
ttataagttacactattg

SEQ ID NO: 34820 - DNA, 18 bp, Artificial Sequence
  Synthetic DNA
atatacgcttcactttag

SEQ ID NO: 34821 - DNA, 18 bp, Artificial Sequence
  Synthetic DNA
taatccagcacaccattg

SEQ ID NO: 34822 - DNA, 18 bp, Artificial Sequence
  Synthetic DNA
cacaacgaatctcgagtg

SEQ ID NO: 34823 - DNA, 18 bp, Artificial Sequence
  Synthetic DNA
ggaaacgactcgctattg

SEQ ID NO: 34824 - DNA, 18 bp, Artificial Sequence
  Synthetic DNA
tattgcgtctctctatgg

SEQ ID NO: 34825 - DNA, 18 bp, Artificial Sequence
  Synthetic DNA
tatctcgtctcactttag

SEQ ID NO: 34826 - DNA, 18 bp, Artificial Sequence
  Synthetic DNA
aaaaatgactacctacgg

SEQ ID NO: 34827 - DNA, 18 bp, Artificial Sequence
  Synthetic DNA
aaaaacaagttactcaag

SEQ ID NO: 34828 - DNA, 18 bp, Artificial Sequence
  Synthetic DNA
aaatgcgacgccccatag

SEQ ID NO: 34829 - DNA, 18 bp, Artificial Sequence
  Synthetic DNA
catttcgactcacttcag

SEQ ID NO: 34830 - DNA, 18 bp, Artificial Sequence
  Synthetic DNA
ttttgcgactcactgttg

SEQ ID NO: 34831 - DNA, 18 bp, Artificial Sequence
  Synthetic DNA
aaactcgactcacttcag

SEQ ID NO: 34832 - DNA, 18 bp, Artificial Sequence
  Synthetic DNA
ttatgtgactctaactag

SEQ ID NO: 34833 - DNA, 18 bp, Artificial Sequence
  Synthetic DNA
agatacgtcgtatccttg

SEQ ID NO: 34834 - DNA, 18 bp, Artificial Sequence
  Synthetic DNA
atatacgactcagtgtgg

SEQ ID NO: 34835 - DNA, 18 bp, Artificial Sequence
  Synthetic DNA
gaatacggctcaattcag

SEQ ID NO: 34836 - DNA, 18 bp, Artificial Sequence
  Synthetic DNA
taacacgtcactatatag

SEQ ID NO: 34837 - DNA, 18 bp, Artificial Sequence
  Synthetic DNA
taatacagctcagttcag

SEQ ID NO: 34838 - DNA, 18 bp, Artificial Sequence
  Synthetic DNA
tagatcgagcctctctag

SEQ ID NO: 34839 - DNA, 18 bp, Artificial Sequence
  Synthetic DNA
tataagcagacacgccag

SEQ ID NO: 34840 - DNA, 18 bp, Artificial Sequence
  Synthetic DNA
tattaggacccaatatgg

SEQ ID NO: 34841 - DNA, 18 bp, Artificial Sequence
  Synthetic DNA
tattgcgatcctctattg

SEQ ID NO: 34842 - DNA, 18 bp, Artificial Sequence
  Synthetic DNA
ttatccgtctcattaatg

SEQ ID NO: 34843 - DNA, 18 bp, Artificial Sequence
  Synthetic DNA
tttaacgactcatgttag

SEQ ID NO: 34844 - DNA, 18 bp, Artificial Sequence
  Synthetic DNA
ttttgcgactcgctatcg

SEQ ID NO: 34845 - DNA, 18 bp, Artificial Sequence
  Synthetic DNA
tttttcgtgtcactaaag

SEQ ID NO: 34846 - DNA, 18 bp, Artificial Sequence
  Synthetic DNA
taataggactctgtttgg

SEQ ID NO: 34847 - DNA, 18 bp, Artificial Sequence
  Synthetic DNA
tgcaaaacgtcactatag

SEQ ID NO: 34848 - DNA, 18 bp, Artificial Sequence
  Synthetic DNA
taattctacggtctatag

SEQ ID NO: 34849 - DNA, 18 bp, Artificial Sequence
  Synthetic DNA
tgttatgtctgactatcg

SEQ ID NO: 34850 - DNA, 18 bp, Artificial Sequence
  Synthetic DNA
ttatgcgactgcctctag

SEQ ID NO: 34851 - DNA, 18 bp, Artificial Sequence
  Synthetic DNA
tattgcaactcactgaag

SEQ ID NO: 34852 - DNA, 18 bp, Artificial Sequence
  Synthetic DNA
taatacgccaatcactag

SEQ ID NO: 34853 - DNA, 18 bp, Artificial Sequence
  Synthetic DNA
taataggggccactctag

SEQ ID NO: 34854 - DNA, 18 bp, Artificial Sequence
  Synthetic DNA
ttaaacgactcacacttg

SEQ ID NO: 34855 - DNA, 18 bp, Artificial Sequence
  Synthetic DNA
ttttaggactcaccacag

SEQ ID NO: 34856 - DNA, 18 bp, Artificial Sequence
  Synthetic DNA
tgttacgcatcaccgtag

SEQ ID NO: 34857 - DNA, 18 bp, Artificial Sequence
  Synthetic DNA
taaatcggctctctagtg

SEQ ID NO: 34858 - DNA, 18 bp, Artificial Sequence
  Synthetic DNA
tttatcgactcgctattg

SEQ ID NO: 34859 - DNA, 18 bp, Artificial Sequence
  Synthetic DNA
tgaagcgaatcactaaag

SEQ ID NO: 34860 - DNA, 18 bp, Artificial Sequence
  Synthetic DNA
atttacgactcgctatta

SEQ ID NO: 34861 - DNA, 18 bp, Artificial Sequence
  Synthetic DNA
taaaagaaccttctatag

SEQ ID NO: 34862 - DNA, 18 bp, Artificial Sequence
  Synthetic DNA
taaagtgattcactgaag

SEQ ID NO: 34863 - DNA, 18 bp, Artificial Sequence
  Synthetic DNA
ctatacgactcgctagtg

SEQ ID NO: 34864 - DNA, 18 bp, Artificial Sequence
  Synthetic DNA
aaaatcgacttacaatag

SEQ ID NO: 34865 - DNA, 18 bp, Artificial Sequence
  Synthetic DNA
aaaatcgcctcacaaaag

SEQ ID NO: 34866 - DNA, 18 bp, Artificial Sequence
  Synthetic DNA
aaagacaactcacttcag

SEQ ID NO: 34867 - DNA, 18 bp, Artificial Sequence
  Synthetic DNA
aattgcgactcacttaag

SEQ ID NO: 34868 - DNA, 18 bp, Artificial Sequence
  Synthetic DNA
ataatcgcgtcactactg

SEQ ID NO: 34869 - DNA, 18 bp, Artificial Sequence
  Synthetic DNA
atttaggactcactctag

SEQ ID NO: 34870 - DNA, 18 bp, Artificial Sequence
  Synthetic DNA
taacacatctgactatcg

SEQ ID NO: 34871 - DNA, 18 bp, Artificial Sequence
  Synthetic DNA
taatgcgtcatactattg

SEQ ID NO: 34872 - DNA, 18 bp, Artificial Sequence
  Synthetic DNA
tagtgcgtctcactcaag

SEQ ID NO: 34873 - DNA, 18 bp, Artificial Sequence
  Synthetic DNA
tattttgtgtcactttag

SEQ ID NO: 34874 - DNA, 18 bp, Artificial Sequence
  Synthetic DNA
tggtactactgacaatag

SEQ ID NO: 34875 - DNA, 18 bp, Artificial Sequence
  Synthetic DNA
ttacacaacttattttag

SEQ ID NO: 34876 - DNA, 18 bp, Artificial Sequence
  Synthetic DNA
ttataggtgtcacattag

SEQ ID NO: 34877 - DNA, 18 bp, Artificial Sequence
  Synthetic DNA
ttgtgcgactctaattcg

SEQ ID NO: 34878 - DNA, 18 bp, Artificial Sequence
  Synthetic DNA
ttgttagacactcttcag

SEQ ID NO: 34879 - DNA, 18 bp, Artificial Sequence
  Synthetic DNA
ttaacggactcacgttag

SEQ ID NO: 34880 - DNA, 18 bp, Artificial Sequence
  Synthetic DNA
tttttggactcactgtag

SEQ ID NO: 34881 - DNA, 18 bp, Artificial Sequence
  Synthetic DNA
taaaacgacacacatcag

SEQ ID NO: 34882 - DNA, 18 bp, Artificial Sequence
  Synthetic DNA
tagttcgtgtcgctattg

SEQ ID NO: 34883 - DNA, 18 bp, Artificial Sequence
  Synthetic DNA
ttgtacgactctcggtag

SEQ ID NO: 34884 - DNA, 18 bp, Artificial Sequence
  Synthetic DNA
caattcggcactctaacg

SEQ ID NO: 34885 - DNA, 18 bp, Artificial Sequence
  Synthetic DNA
tgatagtaagcattacag

SEQ ID NO: 34886 - DNA, 18 bp, Artificial Sequence
  Synthetic DNA
ttatactgtacgctattg

SEQ ID NO: 34887 - DNA, 18 bp, Artificial Sequence
  Synthetic DNA
ttttacggcgctctatag

SEQ ID NO: 34888 - DNA, 18 bp, Artificial Sequence
  Synthetic DNA
aaatacgcttcactcatg

SEQ ID NO: 34889 - DNA, 18 bp, Artificial Sequence
  Synthetic DNA
taacccctatctcacgag

SEQ ID NO: 34890 - DNA, 18 bp, Artificial Sequence
  Synthetic DNA
tattaagactcactcctg

SEQ ID NO: 34891 - DNA, 18 bp, Artificial Sequence
  Synthetic DNA
tgattcggcactcgctag

SEQ ID NO: 34892 - DNA, 18 bp, Artificial Sequence
  Synthetic DNA
ttttgcgactcgctattg

SEQ ID NO: 34893 - DNA, 18 bp, Artificial Sequence
  Synthetic DNA
tttttcgacttactgaag

SEQ ID NO: 34894 - DNA, 18 bp, Artificial Sequence
  Synthetic DNA
caagtagactcactgtag

SEQ ID NO: 34895 - DNA, 18 bp, Artificial Sequence
  Synthetic DNA
tattatgtcttaccatcg

SEQ ID NO: 34896 - DNA, 18 bp, Artificial Sequence
  Synthetic DNA
acgttcgactcaccattg

SEQ ID NO: 34897 - DNA, 18 bp, Artificial Sequence
  Synthetic DNA
tattgcgtctcacttcag

SEQ ID NO: 34898 - DNA, 18 bp, Artificial Sequence
  Synthetic DNA
caataggactcacgtttg

SEQ ID NO: 34899 - DNA, 18 bp, Artificial Sequence
  Synthetic DNA
aaacgcgaatcactaatg

SEQ ID NO: 34900 - DNA, 18 bp, Artificial Sequence
  Synthetic DNA
catttcgactcgctactg

SEQ ID NO: 34901 - DNA, 18 bp, Artificial Sequence
  Synthetic DNA
taattcgtgtctcgatag

SEQ ID NO: 34902 - DNA, 18 bp, Artificial Sequence
  Synthetic DNA
ttctacttctcactactg

SEQ ID NO: 34903 - DNA, 18 bp, Artificial Sequence
  Synthetic DNA
taattcggcttgataaag

SEQ ID NO: 34904 - DNA, 18 bp, Artificial Sequence
  Synthetic DNA
aattccgaaacactatag

SEQ ID NO: 34905 - DNA, 18 bp, Artificial Sequence
  Synthetic DNA
tattaggtctcattcttg

SEQ ID NO: 34906 - DNA, 18 bp, Artificial Sequence
  Synthetic DNA
taaaagttctcttttcag

SEQ ID NO: 34907 - DNA, 18 bp, Artificial Sequence
  Synthetic DNA
taaatcgactcgccattg

SEQ ID NO: 34908 - DNA, 18 bp, Artificial Sequence
  Synthetic DNA
taattaagctcactatcg

SEQ ID NO: 34909 - DNA, 18 bp, Artificial Sequence
  Synthetic DNA
ttacacgtcacgctaacg

SEQ ID NO: 34910 - DNA, 18 bp, Artificial Sequence
  Synthetic DNA
ttatacgctttactaccg

SEQ ID NO: 34911 - DNA, 18 bp, Artificial Sequence
  Synthetic DNA
atatatgactcacgaaag

SEQ ID NO: 34912 - DNA, 18 bp, Artificial Sequence
  Synthetic DNA
cattgcgactaacaatag

SEQ ID NO: 34913 - DNA, 18 bp, Artificial Sequence
  Synthetic DNA
tcattggcgtcactatag

SEQ ID NO: 34914 - DNA, 18 bp, Artificial Sequence
  Synthetic DNA
tttaacgacacacaatag

SEQ ID NO: 34915 - DNA, 18 bp, Artificial Sequence
  Synthetic DNA
acttacgacaatctatag

SEQ ID NO: 34916 - DNA, 18 bp, Artificial Sequence
  Synthetic DNA
agtttcgtatcagtatag

SEQ ID NO: 34917 - DNA, 18 bp, Artificial Sequence
  Synthetic DNA
attggccactgactgtcg

SEQ ID NO: 34918 - DNA, 18 bp, Artificial Sequence
  Synthetic DNA
cgttagaactcacaatag

SEQ ID NO: 34919 - DNA, 18 bp, Artificial Sequence
  Synthetic DNA
gtatactccacactgtag

SEQ ID NO: 34920 - DNA, 18 bp, Artificial Sequence
  Synthetic DNA
taaaacaactcttttcag

SEQ ID NO: 34921 - DNA, 18 bp, Artificial Sequence
  Synthetic DNA
taaaattacacgctatcg

SEQ ID NO: 34922 - DNA, 18 bp, Artificial Sequence
  Synthetic DNA
taacacgaatccctactg

SEQ ID NO: 34923 - DNA, 18 bp, Artificial Sequence
  Synthetic DNA
taatatatatcacttttg

SEQ ID NO: 34924 - DNA, 18 bp, Artificial Sequence
  Synthetic DNA
taatcctacacacttcgg

SEQ ID NO: 34925 - DNA, 18 bp, Artificial Sequence
  Synthetic DNA
taattagattaactaaag

SEQ ID NO: 34926 - DNA, 18 bp, Artificial Sequence
  Synthetic DNA
tacaacgtctctcaatgg

SEQ ID NO: 34927 - DNA, 18 bp, Artificial Sequence
  Synthetic DNA
tagtaagtattacaaaag

SEQ ID NO: 34928 - DNA, 18 bp, Artificial Sequence
  Synthetic DNA
tatttcgcctcactttgg

SEQ ID NO: 34929 - DNA, 18 bp, Artificial Sequence
  Synthetic DNA
tcactcgtctcattaaag

SEQ ID NO: 34930 - DNA, 18 bp, Artificial Sequence
  Synthetic DNA
tcttaggactctccattg

SEQ ID NO: 34931 - DNA, 18 bp, Artificial Sequence
  Synthetic DNA
ttaaaggattccttgtcg

SEQ ID NO: 34932 - DNA, 18 bp, Artificial Sequence
  Synthetic DNA
ttataagccactctattg

SEQ ID NO: 34933 - DNA, 18 bp, Artificial Sequence
  Synthetic DNA
ttatatgactcgtaatag

SEQ ID NO: 34934 - DNA, 18 bp, Artificial Sequence
  Synthetic DNA
ttatgcgattttttatag

SEQ ID NO: 34935 - DNA, 18 bp, Artificial Sequence
  Synthetic DNA
ttattagacactctaaag

SEQ ID NO: 34936 - DNA, 18 bp, Artificial Sequence
  Synthetic DNA
ttattggactcactgttg

SEQ ID NO: 34937 - DNA, 18 bp, Artificial Sequence
  Synthetic DNA
tttaacgactctcaatag

SEQ ID NO: 34938 - DNA, 18 bp, Artificial Sequence
  Synthetic DNA
tttttcgactcactcttg

SEQ ID NO: 34939 - DNA, 18 bp, Artificial Sequence
  Synthetic DNA
ttaaatgactcactcttg

SEQ ID NO: 34940 - DNA, 18 bp, Artificial Sequence
  Synthetic DNA
ttataggactctcaattg

SEQ ID NO: 34941 - DNA, 18 bp, Artificial Sequence
  Synthetic DNA
ttaagcgactcactcaag

SEQ ID NO: 34942 - DNA, 18 bp, Artificial Sequence
  Synthetic DNA
tattgcgcctcactaatg

SEQ ID NO: 34943 - DNA, 18 bp, Artificial Sequence
  Synthetic DNA
ttgttcgactctctacag

SEQ ID NO: 34944 - DNA, 18 bp, Artificial Sequence
  Synthetic DNA
tttcatcactcgctatcg

SEQ ID NO: 34945 - DNA, 18 bp, Artificial Sequence
  Synthetic DNA
ttgaacggctaactattg

SEQ ID NO: 34946 - DNA, 18 bp, Artificial Sequence
  Synthetic DNA
tttcaggactcactattg

SEQ ID NO: 34947 - DNA, 18 bp, Artificial Sequence
  Synthetic DNA
tgctactgcccactatag

SEQ ID NO: 34948 - DNA, 18 bp, Artificial Sequence
  Synthetic DNA
ctattcgactcaccattg

SEQ ID NO: 34949 - DNA, 18 bp, Artificial Sequence
  Synthetic DNA
taagtcgtctcacattag

SEQ ID NO: 34950 - DNA, 18 bp, Artificial Sequence
  Synthetic DNA
tactacgtttctggatag

SEQ ID NO: 34951 - DNA, 18 bp, Artificial Sequence
  Synthetic DNA
tagaacgactccctctgg

SEQ ID NO: 34952 - DNA, 18 bp, Artificial Sequence
  Synthetic DNA
tataacgactcagtagtg

SEQ ID NO: 34953 - DNA, 18 bp, Artificial Sequence
  Synthetic DNA
taacacctcgcactctag

SEQ ID NO: 34954 - DNA, 18 bp, Artificial Sequence
  Synthetic DNA
taaaaggacttagtatcg

SEQ ID NO: 34955 - DNA, 18 bp, Artificial Sequence
  Synthetic DNA
ttaatggactcaccttag

SEQ ID NO: 34956 - DNA, 18 bp, Artificial Sequence
  Synthetic DNA
taacacgtataactattg

SEQ ID NO: 34957 - DNA, 18 bp, Artificial Sequence
  Synthetic DNA
taatagtactctctcaag

SEQ ID NO: 34958 - DNA, 18 bp, Artificial Sequence
  Synthetic DNA
tagtacgctacagattag

SEQ ID NO: 34959 - DNA, 18 bp, Artificial Sequence
  Synthetic DNA
tcttacgaccaaacatag

SEQ ID NO: 34960 - DNA, 18 bp, Artificial Sequence
  Synthetic DNA
ttgttcgacttagtaaag

SEQ ID NO: 34961 - DNA, 18 bp, Artificial Sequence
  Synthetic DNA
ttatgcaactcacgattg

SEQ ID NO: 34962 - DNA, 18 bp, Artificial Sequence
  Synthetic DNA
aagaacgactcaccatcg

SEQ ID NO: 34963 - DNA, 18 bp, Artificial Sequence
  Synthetic DNA
aaattagactcagaatag

SEQ ID NO: 34964 - DNA, 18 bp, Artificial Sequence
  Synthetic DNA
taaatggactcacttttg

SEQ ID NO: 34965 - DNA, 18 bp, Artificial Sequence
  Synthetic DNA
taataggtctcagttttg

SEQ ID NO: 34966 - DNA, 18 bp, Artificial Sequence
  Synthetic DNA
tctttcgtctgttcaaag

SEQ ID NO: 34967 - DNA, 18 bp, Artificial Sequence
  Synthetic DNA
ttatacggcacgctattg

SEQ ID NO: 34968 - DNA, 18 bp, Artificial Sequence
  Synthetic DNA
ttattcggcgcactattg

SEQ ID NO: 34969 - DNA, 18 bp, Artificial Sequence
  Synthetic DNA
ttataccagtgcctatag

SEQ ID NO: 34970 - DNA, 18 bp, Artificial Sequence
  Synthetic DNA
aaattcgcatcgccctag

SEQ ID NO: 34971 - DNA, 18 bp, Artificial Sequence
  Synthetic DNA
tgattcgtctcacactag

SEQ ID NO: 34972 - DNA, 18 bp, Artificial Sequence
  Synthetic DNA
atttaggactcactttag

SEQ ID NO: 34973 - DNA, 18 bp, Artificial Sequence
  Synthetic DNA
taatactagacaccaaag

SEQ ID NO: 34974 - DNA, 18 bp, Artificial Sequence
  Synthetic DNA
taattccgtactcaatag

SEQ ID NO: 34975 - DNA, 18 bp, Artificial Sequence
  Synthetic DNA
tatatcgacactctgaag

SEQ ID NO: 34976 - DNA, 18 bp, Artificial Sequence
  Synthetic DNA
tattacttcacactactg

SEQ ID NO: 34977 - DNA, 18 bp, Artificial Sequence
  Synthetic DNA
taatttgtcgcactattg

SEQ ID NO: 34978 - DNA, 18 bp, Artificial Sequence
  Synthetic DNA
tataaggacacagtatag

SEQ ID NO: 34979 - DNA, 18 bp, Artificial Sequence
  Synthetic DNA
ttatcagactcactaatg

SEQ ID NO: 34980 - DNA, 18 bp, Artificial Sequence
  Synthetic DNA
tacatcgcatcaccatag

SEQ ID NO: 34981 - DNA, 18 bp, Artificial Sequence
  Synthetic DNA
ccaggtgactcactctag

SEQ ID NO: 34982 - DNA, 18 bp, Artificial Sequence
  Synthetic DNA
ttatgtgagtcactttag

SEQ ID NO: 34983 - DNA, 18 bp, Artificial Sequence
  Synthetic DNA
taaagcgccttattacag

SEQ ID NO: 34984 - DNA, 18 bp, Artificial Sequence
  Synthetic DNA
ccatactactttctatag

SEQ ID NO: 34985 - DNA, 18 bp, Artificial Sequence
  Synthetic DNA
taagagtactgaaaattg

SEQ ID NO: 34986 - DNA, 18 bp, Artificial Sequence
  Synthetic DNA
taattcgacacacaggag

SEQ ID NO: 34987 - DNA, 18 bp, Artificial Sequence
  Synthetic DNA
tgatggaactcactaaag

SEQ ID NO: 34988 - DNA, 18 bp, Artificial Sequence
  Synthetic DNA
aaattcgaatctctaatg

SEQ ID NO: 34989 - DNA, 18 bp, Artificial Sequence
  Synthetic DNA
cgattcgactcacgattg

SEQ ID NO: 34990 - DNA, 18 bp, Artificial Sequence
  Synthetic DNA
taatagaactctgtaatg

SEQ ID NO: 34991 - DNA, 18 bp, Artificial Sequence
  Synthetic DNA
taatcgcactcacttatg

SEQ ID NO: 34992 - DNA, 18 bp, Artificial Sequence
  Synthetic DNA
tagagcgacacactattg

SEQ ID NO: 34993 - DNA, 18 bp, Artificial Sequence
  Synthetic DNA
tcacacgactccctcatg

SEQ ID NO: 34994 - DNA, 18 bp, Artificial Sequence
  Synthetic DNA
tcaggctattaactttag

SEQ ID NO: 34995 - DNA, 18 bp, Artificial Sequence
  Synthetic DNA
tgatgagtcttaccattg

SEQ ID NO: 34996 - DNA, 18 bp, Artificial Sequence
  Synthetic DNA
aacaaagactcactattg

SEQ ID NO: 34997 - DNA, 18 bp, Artificial Sequence
  Synthetic DNA
acatacgactcgcttttg

SEQ ID NO: 34998 - DNA, 18 bp, Artificial Sequence
  Synthetic DNA
ccatacgactctcttttg

SEQ ID NO: 34999 - DNA, 18 bp, Artificial Sequence
  Synthetic DNA
taaaacgtctctccattg

SEQ ID NO: 35000 - DNA, 18 bp, Artificial Sequence
  Synthetic DNA
taacacaaccctcaatag

SEQ ID NO: 35001 - DNA, 18 bp, Artificial Sequence
  Synthetic DNA
taataagactctattcag

SEQ ID NO: 35002 - DNA, 18 bp, Artificial Sequence
  Synthetic DNA
tgtcgcgactcactttag

SEQ ID NO: 35003 - DNA, 18 bp, Artificial Sequence
  Synthetic DNA
ttaaaggtctcactatcg

SEQ ID NO: 35004 - DNA, 18 bp, Artificial Sequence
  Synthetic DNA
ttatcggtctcactacag

SEQ ID NO: 35005 - DNA, 18 bp, Artificial Sequence
  Synthetic DNA
ttattcgcctcatcatag

SEQ ID NO: 35006 - DNA, 18 bp, Artificial Sequence
  Synthetic DNA
aaaaaagtcccactgtag

SEQ ID NO: 35007 - DNA, 18 bp, Artificial Sequence
  Synthetic DNA
aaaaacgacaaacattag

SEQ ID NO: 35008 - DNA, 18 bp, Artificial Sequence
  Synthetic DNA
aaaaatgactcagtctag

SEQ ID NO: 35009 - DNA, 18 bp, Artificial Sequence
  Synthetic DNA
aaaagcgtctcactattg

SEQ ID NO: 35010 - DNA, 18 bp, Artificial Sequence
  Synthetic DNA
aaagaagacttaatatag

SEQ ID NO: 35011 - DNA, 18 bp, Artificial Sequence
  Synthetic DNA
aaatacaatacattatag

SEQ ID NO: 35012 - DNA, 18 bp, Artificial Sequence
  Synthetic DNA
aaatacatctaactttag

SEQ ID NO: 35013 - DNA, 18 bp, Artificial Sequence
  Synthetic DNA
aaatacgacaagcaatag

SEQ ID NO: 35014 - DNA, 18 bp, Artificial Sequence
  Synthetic DNA
aaatacgagataccatgg

SEQ ID NO: 35015 - DNA, 18 bp, Artificial Sequence
  Synthetic DNA
aaataggactgtagatag

SEQ ID NO: 35016 - DNA, 18 bp, Artificial Sequence
  Synthetic DNA
aaataggtctaactattg

SEQ ID NO: 35017 - DNA, 18 bp, Artificial Sequence
  Synthetic DNA
aaatatatctcaccttag

SEQ ID NO: 35018 - DNA, 18 bp, Artificial Sequence
  Synthetic DNA
aaatatgaacctaaattg

SEQ ID NO: 35019 - DNA, 18 bp, Artificial Sequence
  Synthetic DNA
aaatatgactaacctttg

SEQ ID NO: 35020 - DNA, 18 bp, Artificial Sequence
  Synthetic DNA
aaatccctctctctatag

SEQ ID NO: 35021 - DNA, 18 bp, Artificial Sequence
  Synthetic DNA
aaatccgaaaaactattg

SEQ ID NO: 35022 - DNA, 18 bp, Artificial Sequence
  Synthetic DNA
aaatccgactcaaggcgg

SEQ ID NO: 35023 - DNA, 18 bp, Artificial Sequence
  Synthetic DNA
aaattcgactcatctttg

SEQ ID NO: 35024 - DNA, 18 bp, Artificial Sequence
  Synthetic DNA
aacaatgtttcactatag

SEQ ID NO: 35025 - DNA, 18 bp, Artificial Sequence
  Synthetic DNA
aactacaactattttttg

SEQ ID NO: 35026 - DNA, 18 bp, Artificial Sequence
  Synthetic DNA
aactacgactcacctttg

SEQ ID NO: 35027 - DNA, 18 bp, Artificial Sequence
  Synthetic DNA
aactatgacccacgattg

SEQ ID NO: 35028 - DNA, 18 bp, Artificial Sequence
  Synthetic DNA
aagtacgacttacaattg

SEQ ID NO: 35029 - DNA, 18 bp, Artificial Sequence
  Synthetic DNA
aagtacgatttccaatag

SEQ ID NO: 35030 - DNA, 18 bp, Artificial Sequence
  Synthetic DNA
aatgtcacctcaagaaag

SEQ ID NO: 35031 - DNA, 18 bp, Artificial Sequence
  Synthetic DNA
aattacaactatcaatag

SEQ ID NO: 35032 - DNA, 18 bp, Artificial Sequence
  Synthetic DNA
aattacgtctcgccatag

SEQ ID NO: 35033 - DNA, 18 bp, Artificial Sequence
  Synthetic DNA
aattccgcctctctgtag

SEQ ID NO: 35034 - DNA, 18 bp, Artificial Sequence
  Synthetic DNA
aatttgaactcactatag

SEQ ID NO: 35035 - DNA, 18 bp, Artificial Sequence
  Synthetic DNA
acataggacacgctatag

SEQ ID NO: 35036 - DNA, 18 bp, Artificial Sequence
  Synthetic DNA
acatatgagtcactaaag

SEQ ID NO: 35037 - DNA, 18 bp, Artificial Sequence
  Synthetic DNA
actattggcgctctttag

SEQ ID NO: 35038 - DNA, 18 bp, Artificial Sequence
  Synthetic DNA
acttacgtctcactactg

SEQ ID NO: 35039 - DNA, 18 bp, Artificial Sequence
  Synthetic DNA
agatacgagttcctaccg

SEQ ID NO: 35040 - DNA, 18 bp, Artificial Sequence
  Synthetic DNA
agatacgttttgcttttg

SEQ ID NO: 35041 - DNA, 18 bp, Artificial Sequence
  Synthetic DNA
agattcgacatacttagg

SEQ ID NO: 35042 - DNA, 18 bp, Artificial Sequence
  Synthetic DNA
ataaaggactctctttag

SEQ ID NO: 35043 - DNA, 18 bp, Artificial Sequence
  Synthetic DNA
atatatgactcactgcag

SEQ ID NO: 35044 - DNA, 18 bp, Artificial Sequence
  Synthetic DNA
atatgagagactctaaag

SEQ ID NO: 35045 - DNA, 18 bp, Artificial Sequence
  Synthetic DNA
atgtaagacttactttag

SEQ ID NO: 35046 - DNA, 18 bp, Artificial Sequence
  Synthetic DNA
atgttcgcctctccatag

SEQ ID NO: 35047 - DNA, 18 bp, Artificial Sequence
  Synthetic DNA
attatagtctcactatag

SEQ ID NO: 35048 - DNA, 18 bp, Artificial Sequence
  Synthetic DNA
atttaagactcactacag

SEQ ID NO: 35049 - DNA, 18 bp, Artificial Sequence
  Synthetic DNA
atttacgtcttactatcg

SEQ ID NO: 35050 - DNA, 18 bp, Artificial Sequence
  Synthetic DNA
atttaggacacacaatag

SEQ ID NO: 35051 - DNA, 18 bp, Artificial Sequence
  Synthetic DNA
atttccgaccctatttag

SEQ ID NO: 35052 - DNA, 18 bp, Artificial Sequence
  Synthetic DNA
atttttaatttaccaaag

SEQ ID NO: 35053 - DNA, 18 bp, Artificial Sequence
  Synthetic DNA
caaaaagatcccctctag

SEQ ID NO: 35054 - DNA, 18 bp, Artificial Sequence
  Synthetic DNA
caaaacgcctcaatcatg

SEQ ID NO: 35055 - DNA, 18 bp, Artificial Sequence
  Synthetic DNA
caaactgactgactatag

SEQ ID NO: 35056 - DNA, 18 bp, Artificial Sequence
  Synthetic DNA
caacacctgtcagttttg

SEQ ID NO: 35057 - DNA, 18 bp, Artificial Sequence
  Synthetic DNA
caataaaactcactagcg

SEQ ID NO: 35058 - DNA, 18 bp, Artificial Sequence
  Synthetic DNA
caatatgaaacactattg

SEQ ID NO: 35059 - DNA, 18 bp, Artificial Sequence
  Synthetic DNA
cacaatgaataactttag

SEQ ID NO: 35060 - DNA, 18 bp, Artificial Sequence
  Synthetic DNA
cactacaacacacgatag

SEQ ID NO: 35061 - DNA, 18 bp, Artificial Sequence
  Synthetic DNA
cactagaattcactaaag

SEQ ID NO: 35062 - DNA, 18 bp, Artificial Sequence
  Synthetic DNA
cagaacgcctcttcttgg

SEQ ID NO: 35063 - DNA, 18 bp, Artificial Sequence
  Synthetic DNA
caggtcaactcacattag

SEQ ID NO: 35064 - DNA, 18 bp, Artificial Sequence
  Synthetic DNA
cagttagtcacacttttg

SEQ ID NO: 35065 - DNA, 18 bp, Artificial Sequence
  Synthetic DNA
catcacgatacccttttg

SEQ ID NO: 35066 - DNA, 18 bp, Artificial Sequence
  Synthetic DNA
cattaaaactccctatag

SEQ ID NO: 35067 - DNA, 18 bp, Artificial Sequence
  Synthetic DNA
cgatacatcacactaaag

SEQ ID NO: 35068 - DNA, 18 bp, Artificial Sequence
  Synthetic DNA
cgatgctacacaaaatag

SEQ ID NO: 35069 - DNA, 18 bp, Artificial Sequence
  Synthetic DNA
cttaatgacccagcttag

SEQ ID NO: 35070 - DNA, 18 bp, Artificial Sequence
  Synthetic DNA
gaatagtactcattaaaa

SEQ ID NO: 35071 - DNA, 18 bp, Artificial Sequence
  Synthetic DNA
taaaacaagacaatatag

SEQ ID NO: 35072 - DNA, 18 bp, Artificial Sequence
  Synthetic DNA
taaaacgtcatagtttag

SEQ ID NO: 35073 - DNA, 18 bp, Artificial Sequence
  Synthetic DNA
taaaaggtctcaatatcg

SEQ ID NO: 35074 - DNA, 18 bp, Artificial Sequence
  Synthetic DNA
taaaatgactcgatttag

SEQ ID NO: 35075 - DNA, 18 bp, Artificial Sequence
  Synthetic DNA
taaaattactcacagtag

SEQ ID NO: 35076 - DNA, 18 bp, Artificial Sequence
  Synthetic DNA
taaacctacaccctatag

SEQ ID NO: 35077 - DNA, 18 bp, Artificial Sequence
  Synthetic DNA
taaagcgacacgctattg

SEQ ID NO: 35078 - DNA, 18 bp, Artificial Sequence
  Synthetic DNA
taaagctacccacattag

SEQ ID NO: 35079 - DNA, 18 bp, Artificial Sequence
  Synthetic DNA
taaataaactcactatcg

SEQ ID NO: 35080 - DNA, 18 bp, Artificial Sequence
  Synthetic DNA
taaatcgaccctttttcg

SEQ ID NO: 35081 - DNA, 18 bp, Artificial Sequence
  Synthetic DNA
taaatcggatcgctatcg

SEQ ID NO: 35082 - DNA, 18 bp, Artificial Sequence
  Synthetic DNA
taaattgcgcaactaaag

SEQ ID NO: 35083 - DNA, 18 bp, Artificial Sequence
  Synthetic DNA
taacaagaatctcaaaag

SEQ ID NO: 35084 - DNA, 18 bp, Artificial Sequence
  Synthetic DNA
taacaagatccaatatag

SEQ ID NO: 35085 - DNA, 18 bp, Artificial Sequence
  Synthetic DNA
taacactacttacttttg

SEQ ID NO: 35086 - DNA, 18 bp, Artificial Sequence
  Synthetic DNA
taacatttatcacaatag

SEQ ID NO: 35087 - DNA, 18 bp, Artificial Sequence
  Synthetic DNA
taagaggggtgacattag

SEQ ID NO: 35088 - DNA, 18 bp, Artificial Sequence
  Synthetic DNA
taagtaatcactctatag

SEQ ID NO: 35089 - DNA, 18 bp, Artificial Sequence
  Synthetic DNA
taataagatagtccttag

SEQ ID NO: 35090 - DNA, 18 bp, Artificial Sequence
  Synthetic DNA
taataagccatactgtag

SEQ ID NO: 35091 - DNA, 18 bp, Artificial Sequence
  Synthetic DNA
taataaggctaatgatag

SEQ ID NO: 35092 - DNA, 18 bp, Artificial Sequence
  Synthetic DNA
taataagtcacagcatag

SEQ ID NO: 35093 - DNA, 18 bp, Artificial Sequence
  Synthetic DNA
taatacaacataatgctg

SEQ ID NO: 35094 - DNA, 18 bp, Artificial Sequence
  Synthetic DNA
taatacactgcacaatag

SEQ ID NO: 35095 - DNA, 18 bp, Artificial Sequence
  Synthetic DNA
taataccacacgccttag

SEQ ID NO: 35096 - DNA, 18 bp, Artificial Sequence
  Synthetic DNA
taataccgctctcatttg

SEQ ID NO: 35097 - DNA, 18 bp, Artificial Sequence
  Synthetic DNA
taatacgactcaaatgcg

SEQ ID NO: 35098 - DNA, 18 bp, Artificial Sequence
  Synthetic DNA
taatacgagtcctatttg

SEQ ID NO: 35099 - DNA, 18 bp, Artificial Sequence
  Synthetic DNA
taatacgagtctggaaag

SEQ ID NO: 35100 - DNA, 18 bp, Artificial Sequence
  Synthetic DNA
taatacgattcgttgcag

SEQ ID NO: 35101 - DNA, 18 bp, Artificial Sequence
  Synthetic DNA
taatacgccttataaaag

SEQ ID NO: 35102 - DNA, 18 bp, Artificial Sequence
  Synthetic DNA
taatacgtatcaatttcg

SEQ ID NO: 35103 - DNA, 18 bp, Artificial Sequence
  Synthetic DNA
taatacgtcgccttattg

SEQ ID NO: 35104 - DNA, 18 bp, Artificial Sequence
  Synthetic DNA
taatagaacgctcaattg

SEQ ID NO: 35105 - DNA, 18 bp, Artificial Sequence
  Synthetic DNA
taatagaacttagtcaag

SEQ ID NO: 35106 - DNA, 18 bp, Artificial Sequence
  Synthetic DNA
taataggtcttgatgtag

SEQ ID NO: 35107 - DNA, 18 bp, Artificial Sequence
  Synthetic DNA
taatccgactcctcattg

SEQ ID NO: 35108 - DNA, 18 bp, Artificial Sequence
  Synthetic DNA
taatccgagtctcactag

SEQ ID NO: 35109 - DNA, 18 bp, Artificial Sequence
  Synthetic DNA
taatccggcacagaatgg

SEQ ID NO: 35110 - DNA, 18 bp, Artificial Sequence
  Synthetic DNA
taatcttactcaacttag

SEQ ID NO: 35111 - DNA, 18 bp, Artificial Sequence
  Synthetic DNA
taatgctacagaccaaag

SEQ ID NO: 35112 - DNA, 18 bp, Artificial Sequence
  Synthetic DNA
taatgctacccaggatag

SEQ ID NO: 35113 - DNA, 18 bp, Artificial Sequence
  Synthetic DNA
taatgcttttcactaaag

SEQ ID NO: 35114 - DNA, 18 bp, Artificial Sequence
  Synthetic DNA
taatgggacctactttag

SEQ ID NO: 35115 - DNA, 18 bp, Artificial Sequence
  Synthetic DNA
taattagactctctcaag

SEQ ID NO: 35116 - DNA, 18 bp, Artificial Sequence
  Synthetic DNA
taattagtctcacgattg

SEQ ID NO: 35117 - DNA, 18 bp, Artificial Sequence
  Synthetic DNA
taattcgactttgtgcag

SEQ ID NO: 35118 - DNA, 18 bp, Artificial Sequence
  Synthetic DNA
taattcgatttataaaag

SEQ ID NO: 35119 - DNA, 18 bp, Artificial Sequence
  Synthetic DNA
taattcgcctaacaattg

SEQ ID NO: 35120 - DNA, 18 bp, Artificial Sequence
  Synthetic DNA
taattctacccgcttaag

SEQ ID NO: 35121 - DNA, 18 bp, Artificial Sequence
  Synthetic DNA
taatttaacttcctaaag

SEQ ID NO: 35122 - DNA, 18 bp, Artificial Sequence
  Synthetic DNA
taatttcacccatttttg

SEQ ID NO: 35123 - DNA, 18 bp, Artificial Sequence
  Synthetic DNA
taatttgcctccctttag

SEQ ID NO: 35124 - DNA, 18 bp, Artificial Sequence
  Synthetic DNA
taattttactcattaaag

SEQ ID NO: 35125 - DNA, 18 bp, Artificial Sequence
  Synthetic DNA
tacaaccactccctttag

SEQ ID NO: 35126 - DNA, 18 bp, Artificial Sequence
  Synthetic DNA
tacagcgactctccattg

SEQ ID NO: 35127 - DNA, 18 bp, Artificial Sequence
  Synthetic DNA
tactttgtctcacaatag

SEQ ID NO: 35128 - DNA, 18 bp, Artificial Sequence
  Synthetic DNA
tagaaaaactaacaatag

SEQ ID NO: 35129 - DNA, 18 bp, Artificial Sequence
  Synthetic DNA
tagaaagacctcttatag

SEQ ID NO: 35130 - DNA, 18 bp, Artificial Sequence
  Synthetic DNA
tagatccacacactattg

SEQ ID NO: 35131 - DNA, 18 bp, Artificial Sequence
  Synthetic DNA
tagcacgaatgacaatcg

SEQ ID NO: 35132 - DNA, 18 bp, Artificial Sequence
  Synthetic DNA
tagtaaaagccactatag

SEQ ID NO: 35133 - DNA, 18 bp, Artificial Sequence
  Synthetic DNA
tagtaagaataactatcg

SEQ ID NO: 35134 - DNA, 18 bp, Artificial Sequence
  Synthetic DNA
tagtacgtctcacatctg

SEQ ID NO: 35135 - DNA, 18 bp, Artificial Sequence
  Synthetic DNA
tagtacgtctcacggaag

SEQ ID NO: 35136 - DNA, 18 bp, Artificial Sequence
  Synthetic DNA
tagtactctacactacag

SEQ ID NO: 35137 - DNA, 18 bp, Artificial Sequence
  Synthetic DNA
tagttcgtctaactaaag

SEQ ID NO: 35138 - DNA, 18 bp, Artificial Sequence
  Synthetic DNA
tataaagactcgcaattg

SEQ ID NO: 35139 - DNA, 18 bp, Artificial Sequence
  Synthetic DNA
tataacgacacactcttg

SEQ ID NO: 35140 - DNA, 18 bp, Artificial Sequence
  Synthetic DNA
tataacgactaacgaaag

SEQ ID NO: 35141 - DNA, 18 bp, Artificial Sequence
  Synthetic DNA
tataacgcccaacaatag

SEQ ID NO: 35142 - DNA, 18 bp, Artificial Sequence
  Synthetic DNA
tatacgaactcactatag

SEQ ID NO: 35143 - DNA, 18 bp, Artificial Sequence
  Synthetic DNA
tatagagtatctctacag

SEQ ID NO: 35144 - DNA, 18 bp, Artificial Sequence
  Synthetic DNA
tatcacgactcaaagctg

SEQ ID NO: 35145 - DNA, 18 bp, Artificial Sequence
  Synthetic DNA
tatcctgactcacattag

SEQ ID NO: 35146 - DNA, 18 bp, Artificial Sequence
  Synthetic DNA
tatgaacactctctatcg

SEQ ID NO: 35147 - DNA, 18 bp, Artificial Sequence
  Synthetic DNA
tattaagcatcaccatag

SEQ ID NO: 35148 - DNA, 18 bp, Artificial Sequence
  Synthetic DNA
tattaagtatcaccatcg

SEQ ID NO: 35149 - DNA, 18 bp, Artificial Sequence
  Synthetic DNA
tattaagtctgacactag

SEQ ID NO: 35150 - DNA, 18 bp, Artificial Sequence
  Synthetic DNA
tattacgacctattattg

SEQ ID NO: 35151 - DNA, 18 bp, Artificial Sequence
  Synthetic DNA
tattactactaattacag

SEQ ID NO: 35152 - DNA, 18 bp, Artificial Sequence
  Synthetic DNA
tattatcacgcactttag

SEQ ID NO: 35153 - DNA, 18 bp, Artificial Sequence
  Synthetic DNA
tattatgattcgctaatg

SEQ ID NO: 35154 - DNA, 18 bp, Artificial Sequence
  Synthetic DNA
tattgcgccactaaatag

SEQ ID NO: 35155 - DNA, 18 bp, Artificial Sequence
  Synthetic DNA
tatttcgaataacgatag

SEQ ID NO: 35156 - DNA, 18 bp, Artificial Sequence
  Synthetic DNA
tatttcgaattactattg

SEQ ID NO: 35157 - DNA, 18 bp, Artificial Sequence
  Synthetic DNA
tattttgaccctttaaag

SEQ ID NO: 35158 - DNA, 18 bp, Artificial Sequence
  Synthetic DNA
tatttttactctcaatag

SEQ ID NO: 35159 - DNA, 18 bp, Artificial Sequence
  Synthetic DNA
tcacacaccccactatag

SEQ ID NO: 35160 - DNA, 18 bp, Artificial Sequence
  Synthetic DNA
tcaggcgaatgaaaatag

SEQ ID NO: 35161 - DNA, 18 bp, Artificial Sequence
  Synthetic DNA
tcatacgactcgcagggg

SEQ ID NO: 35162 - DNA, 18 bp, Artificial Sequence
  Synthetic DNA
tcatactacagacttcag

SEQ ID NO: 35163 - DNA, 18 bp, Artificial Sequence
  Synthetic DNA
tcatatgactctcataag

SEQ ID NO: 35164 - DNA, 18 bp, Artificial Sequence
  Synthetic DNA
tcatatgactttatgtag

SEQ ID NO: 35165 - DNA, 18 bp, Artificial Sequence
  Synthetic DNA
tcatgcgacaccatctag

SEQ ID NO: 35166 - DNA, 18 bp, Artificial Sequence
  Synthetic DNA
tcattccacacagtgttg

SEQ ID NO: 35167 - DNA, 18 bp, Artificial Sequence
  Synthetic DNA
tcattcgactcactcatg

SEQ ID NO: 35168 - DNA, 18 bp, Artificial Sequence
  Synthetic DNA
tcctaggactctctaaag

SEQ ID NO: 35169 - DNA, 18 bp, Artificial Sequence
  Synthetic DNA
tctgacgaaccactatag

SEQ ID NO: 35170 - DNA, 18 bp, Artificial Sequence
  Synthetic DNA
tcttacgtctcaccttag

SEQ ID NO: 35171 - DNA, 18 bp, Artificial Sequence
  Synthetic DNA
tcttatgtctcacaatag

SEQ ID NO: 35172 - DNA, 18 bp, Artificial Sequence
  Synthetic DNA
tgaaatgactagctatag

SEQ ID NO: 35173 - DNA, 18 bp, Artificial Sequence
  Synthetic DNA
tgagaacacacactatag

SEQ ID NO: 35174 - DNA, 18 bp, Artificial Sequence
  Synthetic DNA
tgagaggactcacttttg

SEQ ID NO: 35175 - DNA, 18 bp, Artificial Sequence
  Synthetic DNA
tgataagacttattgatg

SEQ ID NO: 35176 - DNA, 18 bp, Artificial Sequence
  Synthetic DNA
tgataccactccattttg

SEQ ID NO: 35177 - DNA, 18 bp, Artificial Sequence
  Synthetic DNA
tgatacgatactctctag

SEQ ID NO: 35178 - DNA, 18 bp, Artificial Sequence
  Synthetic DNA
tgatatgtctcaattttg

SEQ ID NO: 35179 - DNA, 18 bp, Artificial Sequence
  Synthetic DNA
tgcaacaaatgactatag

SEQ ID NO: 35180 - DNA, 18 bp, Artificial Sequence
  Synthetic DNA
tgtaacgtcttacggttg

SEQ ID NO: 35181 - DNA, 18 bp, Artificial Sequence
  Synthetic DNA
tgtatcacatcaatatag

SEQ ID NO: 35182 - DNA, 18 bp, Artificial Sequence
  Synthetic DNA
tgttacgacaaactattg

SEQ ID NO: 35183 - DNA, 18 bp, Artificial Sequence
  Synthetic DNA
tgttcggatttagcatag

SEQ ID NO: 35184 - DNA, 18 bp, Artificial Sequence
  Synthetic DNA
tgtttggacttactatag

SEQ ID NO: 35185 - DNA, 18 bp, Artificial Sequence
  Synthetic DNA
ttaaaagaatcactattg

SEQ ID NO: 35186 - DNA, 18 bp, Artificial Sequence
  Synthetic DNA
ttaaacgactcgtaatag

SEQ ID NO: 35187 - DNA, 18 bp, Artificial Sequence
  Synthetic DNA
ttaaatgactcaatatcg

SEQ ID NO: 35188 - DNA, 18 bp, Artificial Sequence
  Synthetic DNA
ttaaatgtatctatatag

SEQ ID NO: 35189 - DNA, 18 bp, Artificial Sequence
  Synthetic DNA
ttaatggattcactcatg

SEQ ID NO: 35190 - DNA, 18 bp, Artificial Sequence
  Synthetic DNA
ttacaagtctctctatgg

SEQ ID NO: 35191 - DNA, 18 bp, Artificial Sequence
  Synthetic DNA
ttactaaacccattaagg

SEQ ID NO: 35192 - DNA, 18 bp, Artificial Sequence
  Synthetic DNA
ttagtcgtctcaccatag

SEQ ID NO: 35193 - DNA, 18 bp, Artificial Sequence
  Synthetic DNA
ttatacaacacacagatg

SEQ ID NO: 35194 - DNA, 18 bp, Artificial Sequence
  Synthetic DNA
ttatacaattgaattcag

SEQ ID NO: 35195 - DNA, 18 bp, Artificial Sequence
  Synthetic DNA
ttatacacttcaattttg

SEQ ID NO: 35196 - DNA, 18 bp, Artificial Sequence
  Synthetic DNA
ttatacgacactctcttg

SEQ ID NO: 35197 - DNA, 18 bp, Artificial Sequence
  Synthetic DNA
ttatacgagtatttatag

SEQ ID NO: 35198 - DNA, 18 bp, Artificial Sequence
  Synthetic DNA
ttatacgtcgctccatag

SEQ ID NO: 35199 - DNA, 18 bp, Artificial Sequence
  Synthetic DNA
ttatactacataccaaag

SEQ ID NO: 35200 - DNA, 18 bp, Artificial Sequence
  Synthetic DNA
ttatactactcatatgag

SEQ ID NO: 35201 - DNA, 18 bp, Artificial Sequence
  Synthetic DNA
ttatactcatcactatcg

SEQ ID NO: 35202 - DNA, 18 bp, Artificial Sequence
  Synthetic DNA
ttatattacacattattg

SEQ ID NO: 35203 - DNA, 18 bp, Artificial Sequence
  Synthetic DNA
ttatcactcaaccattag

SEQ ID NO: 35204 - DNA, 18 bp, Artificial Sequence
  Synthetic DNA
ttatcagactcactgtgg

SEQ ID NO: 35205 - DNA, 18 bp, Artificial Sequence
  Synthetic DNA
ttatccaaagctctattg

SEQ ID NO: 35206 - DNA, 18 bp, Artificial Sequence
  Synthetic DNA
ttatcctaatagctatag

SEQ ID NO: 35207 - DNA, 18 bp, Artificial Sequence
  Synthetic DNA
ttatcctgtacaatatag

SEQ ID NO: 35208 - DNA, 18 bp, Artificial Sequence
  Synthetic DNA
ttatgcgattaacttctg

SEQ ID NO: 35209 - DNA, 18 bp, Artificial Sequence
  Synthetic DNA
ttattaatctcacgatag

SEQ ID NO: 35210 - DNA, 18 bp, Artificial Sequence
  Synthetic DNA
ttattagactataaaaag

SEQ ID NO: 35211 - DNA, 18 bp, Artificial Sequence
  Synthetic DNA
ttattcgagccactttag

SEQ ID NO: 35212 - DNA, 18 bp, Artificial Sequence
  Synthetic DNA
ttattctacacaatatag

SEQ ID NO: 35213 - DNA, 18 bp, Artificial Sequence
  Synthetic DNA
ttattctactcattctag

SEQ ID NO: 35214 - DNA, 18 bp, Artificial Sequence
  Synthetic DNA
ttgtaagactctttaaag

SEQ ID NO: 35215 - DNA, 18 bp, Artificial Sequence
  Synthetic DNA
ttgtacttctcagtgttg

SEQ ID NO: 35216 - DNA, 18 bp, Artificial Sequence
  Synthetic DNA
ttttacgtctcataattg

SEQ ID NO: 35217 - DNA, 18 bp, Artificial Sequence
  Synthetic DNA
ttttacgtctgactttag

SEQ ID NO: 35218 - DNA, 18 bp, Artificial Sequence
  Synthetic DNA
ttttactaattactctag

SEQ ID NO: 35219 - DNA, 18 bp, Artificial Sequence
  Synthetic DNA
ttttagaacacactagag

SEQ ID NO: 35220 - DNA, 18 bp, Artificial Sequence
  Synthetic DNA
ttttccgactcattacag

SEQ ID NO: 35221 - DNA, 18 bp, Artificial Sequence
  Synthetic DNA
ttattcaactctctacag

SEQ ID NO: 35222 - DNA, 18 bp, Artificial Sequence
  Synthetic DNA
ctaaactactcactaaag

SEQ ID NO: 35223 - DNA, 18 bp, Artificial Sequence
  Synthetic DNA
ttaaatgactcgctattg

SEQ ID NO: 35224 - DNA, 18 bp, Artificial Sequence
  Synthetic DNA
taataggcgttctaatag

SEQ ID NO: 35225 - DNA, 18 bp, Artificial Sequence
  Synthetic DNA
taaaactagccactaaag

SEQ ID NO: 35226 - DNA, 18 bp, Artificial Sequence
  Synthetic DNA
aaatgcgcctcaccaaag

SEQ ID NO: 35227 - DNA, 18 bp, Artificial Sequence
  Synthetic DNA
taaaacggtacactatcg

SEQ ID NO: 35228 - DNA, 18 bp, Artificial Sequence
  Synthetic DNA
taaaacttctcaccatcg

SEQ ID NO: 35229 - DNA, 18 bp, Artificial Sequence
  Synthetic DNA
tataaccacactcttaag

SEQ ID NO: 35230 - DNA, 18 bp, Artificial Sequence
  Synthetic DNA
ttgtgtgactgaatacag

SEQ ID NO: 35231 - DNA, 18 bp, Artificial Sequence
  Synthetic DNA
taatgaggttcactattg

SEQ ID NO: 35232 - DNA, 18 bp, Artificial Sequence
  Synthetic DNA
ttacgcgactcactactg

SEQ ID NO: 35233 - DNA, 18 bp, Artificial Sequence
  Synthetic DNA
cgttaagactcgctattg

SEQ ID NO: 35234 - DNA, 18 bp, Artificial Sequence
  Synthetic DNA
caattaggctcactattg

SEQ ID NO: 35235 - DNA, 18 bp, Artificial Sequence
  Synthetic DNA
cgataggactcactaatg

SEQ ID NO: 35236 - DNA, 18 bp, Artificial Sequence
  Synthetic DNA
caatatgacagactgttg

SEQ ID NO: 35237 - DNA, 18 bp, Artificial Sequence
  Synthetic DNA
ctttgcgactcactaaag

SEQ ID NO: 35238 - DNA, 18 bp, Artificial Sequence
  Synthetic DNA
ttaaagatctctgtatag

SEQ ID NO: 35239 - DNA, 18 bp, Artificial Sequence
  Synthetic DNA
ttatgcgtctcactaagg

SEQ ID NO: 35240 - DNA, 18 bp, Artificial Sequence
  Synthetic DNA
ttgaaccactaacttccg

SEQ ID NO: 35241 - DNA, 18 bp, Artificial Sequence
  Synthetic DNA
ttgtacgttccactatag

SEQ ID NO: 35242 - DNA, 18 bp, Artificial Sequence
  Synthetic DNA
ttttagaactcacattag

SEQ ID NO: 35243 - DNA, 18 bp, Artificial Sequence
  Synthetic DNA
caatgcgtctcacacctg

SEQ ID NO: 35244 - DNA, 18 bp, Artificial Sequence
  Synthetic DNA
ttatacgcatcactaagg

SEQ ID NO: 35245 - DNA, 18 bp, Artificial Sequence
  Synthetic DNA
atattagactcactacag

SEQ ID NO: 35246 - DNA, 18 bp, Artificial Sequence
  Synthetic DNA
caattccgctccatttag

SEQ ID NO: 35247 - DNA, 18 bp, Artificial Sequence
  Synthetic DNA
taaaactacactctaaag

SEQ ID NO: 35248 - DNA, 18 bp, Artificial Sequence
  Synthetic DNA
ttataagacagcctttag

SEQ ID NO: 35249 - DNA, 18 bp, Artificial Sequence
  Synthetic DNA
gtttaagtctcactattg

SEQ ID NO: 35250 - DNA, 18 bp, Artificial Sequence
  Synthetic DNA
aaatacgactaaccccag

SEQ ID NO: 35251 - DNA, 18 bp, Artificial Sequence
  Synthetic DNA
aaattagactcactcaag

SEQ ID NO: 35252 - DNA, 18 bp, Artificial Sequence
  Synthetic DNA
tattgcgacagtctttag

SEQ ID NO: 35253 - DNA, 18 bp, Artificial Sequence
  Synthetic DNA
ttattggactcgctatcg

SEQ ID NO: 35254 - DNA, 18 bp, Artificial Sequence
  Synthetic DNA
ttatttgactcgctattg

SEQ ID NO: 35255 - DNA, 18 bp, Artificial Sequence
  Synthetic DNA
aaatacgccacaatttag

SEQ ID NO: 35256 - DNA, 18 bp, Artificial Sequence
  Synthetic DNA
aaatacttctctttgtag

SEQ ID NO: 35257 - DNA, 18 bp, Artificial Sequence
  Synthetic DNA
aaataggactcagtgaag

SEQ ID NO: 35258 - DNA, 18 bp, Artificial Sequence
  Synthetic DNA
acagactacccaatatag

SEQ ID NO: 35259 - DNA, 18 bp, Artificial Sequence
  Synthetic DNA
actttcgactcgctatag

SEQ ID NO: 35260 - DNA, 18 bp, Artificial Sequence
  Synthetic DNA
atagacgactcagcaatg

SEQ ID NO: 35261 - DNA, 18 bp, Artificial Sequence
  Synthetic DNA
caataagactcactcccg

SEQ ID NO: 35262 - DNA, 18 bp, Artificial Sequence
  Synthetic DNA
cattacgccttaatattg

SEQ ID NO: 35263 - DNA, 18 bp, Artificial Sequence
  Synthetic DNA
ctattcgactcgctctag

SEQ ID NO: 35264 - DNA, 18 bp, Artificial Sequence
  Synthetic DNA
gatttcgtcgcactaatg

SEQ ID NO: 35265 - DNA, 18 bp, Artificial Sequence
  Synthetic DNA
gtagacgactgaatttag

SEQ ID NO: 35266 - DNA, 18 bp, Artificial Sequence
  Synthetic DNA
taacaaggctcgatttag

SEQ ID NO: 35267 - DNA, 18 bp, Artificial Sequence
  Synthetic DNA
taataccactgtcttttg

SEQ ID NO: 35268 - DNA, 18 bp, Artificial Sequence
  Synthetic DNA
taattccactacctattg

SEQ ID NO: 35269 - DNA, 18 bp, Artificial Sequence
  Synthetic DNA
taatttgtctcgctattg

SEQ ID NO: 35270 - DNA, 18 bp, Artificial Sequence
  Synthetic DNA
tacaacgactctatttag

SEQ ID NO: 35271 - DNA, 18 bp, Artificial Sequence
  Synthetic DNA
tactacggttcgctgtag

SEQ ID NO: 35272 - DNA, 18 bp, Artificial Sequence
  Synthetic DNA
tactatgactctctggag

SEQ ID NO: 35273 - DNA, 18 bp, Artificial Sequence
  Synthetic DNA
tactgcgtcttcctaaag

SEQ ID NO: 35274 - DNA, 18 bp, Artificial Sequence
  Synthetic DNA
tagtacaactttatcttg

SEQ ID NO: 35275 - DNA, 18 bp, Artificial Sequence
  Synthetic DNA
tagtacgactcttcgtag

SEQ ID NO: 35276 - DNA, 18 bp, Artificial Sequence
  Synthetic DNA
tagtttaacaaactatag

SEQ ID NO: 35277 - DNA, 18 bp, Artificial Sequence
  Synthetic DNA
tatatcgacacattatag

SEQ ID NO: 35278 - DNA, 18 bp, Artificial Sequence
  Synthetic DNA
tattacgaccaaatatgg

SEQ ID NO: 35279 - DNA, 18 bp, Artificial Sequence
  Synthetic DNA
tattacgcctcatcatcg

SEQ ID NO: 35280 - DNA, 18 bp, Artificial Sequence
  Synthetic DNA
tattaggaccatctatag

SEQ ID NO: 35281 - DNA, 18 bp, Artificial Sequence
  Synthetic DNA
tattgatactcactattg

SEQ ID NO: 35282 - DNA, 18 bp, Artificial Sequence
  Synthetic DNA
tgatacgattctataaag

SEQ ID NO: 35283 - DNA, 18 bp, Artificial Sequence
  Synthetic DNA
ttatacgtctcgctccag

SEQ ID NO: 35284 - DNA, 18 bp, Artificial Sequence
  Synthetic DNA
ttatatgtatctgtatag

SEQ ID NO: 35285 - DNA, 18 bp, Artificial Sequence
  Synthetic DNA
ttgtacgactcatttaag

SEQ ID NO: 35286 - DNA, 18 bp, Artificial Sequence
  Synthetic DNA
taaagcgcaacacttttg

SEQ ID NO: 35287 - DNA, 18 bp, Artificial Sequence
  Synthetic DNA
taatacttgccacaccag

SEQ ID NO: 35288 - DNA, 18 bp, Artificial Sequence
  Synthetic DNA
taatgcatctcacttaag

SEQ ID NO: 35289 - DNA, 18 bp, Artificial Sequence
  Synthetic DNA
ttttcggactcactgtag

SEQ ID NO: 35290 - DNA, 18 bp, Artificial Sequence
  Synthetic DNA
atattcgactcactgaag

SEQ ID NO: 35291 - DNA, 18 bp, Artificial Sequence
  Synthetic DNA
tcaaacaacacactatcg

SEQ ID NO: 35292 - DNA, 18 bp, Artificial Sequence
  Synthetic DNA
aaattcgactcgctaatg

SEQ ID NO: 35293 - DNA, 18 bp, Artificial Sequence
  Synthetic DNA
cattgcgactcaccaaag

SEQ ID NO: 35294 - DNA, 18 bp, Artificial Sequence
  Synthetic DNA
tagtacgctcgtctatag

SEQ ID NO: 35295 - DNA, 18 bp, Artificial Sequence
  Synthetic DNA
tgttacgaagcactttag

SEQ ID NO: 35296 - DNA, 18 bp, Artificial Sequence
  Synthetic DNA
taattgaactcacttcag

SEQ ID NO: 35297 - DNA, 18 bp, Artificial Sequence
  Synthetic DNA
aatttcgactcactaccg

SEQ ID NO: 35298 - DNA, 18 bp, Artificial Sequence
  Synthetic DNA
ttgtaagaagctctttcg

SEQ ID NO: 35299 - DNA, 18 bp, Artificial Sequence
  Synthetic DNA
taatgcgatttttcatag

SEQ ID NO: 35300 - DNA, 18 bp, Artificial Sequence
  Synthetic DNA
tagtacgtataaccatag

SEQ ID NO: 35301 - DNA, 18 bp, Artificial Sequence
  Synthetic DNA
ttatacgtctaactactg

SEQ ID NO: 35302 - DNA, 18 bp, Artificial Sequence
  Synthetic DNA
tttaaggatccactattg

SEQ ID NO: 35303 - DNA, 18 bp, Artificial Sequence
  Synthetic DNA
aaaaggtagtccctatag

SEQ ID NO: 35304 - DNA, 18 bp, Artificial Sequence
  Synthetic DNA
aaattcggctcgctatgg

SEQ ID NO: 35305 - DNA, 18 bp, Artificial Sequence
  Synthetic DNA
aagttcgattctctatag

SEQ ID NO: 35306 - DNA, 18 bp, Artificial Sequence
  Synthetic DNA
atatatgaatcacaatag

SEQ ID NO: 35307 - DNA, 18 bp, Artificial Sequence
  Synthetic DNA
catcgcgactcactctag

SEQ ID NO: 35308 - DNA, 18 bp, Artificial Sequence
  Synthetic DNA
taaaacgtctctctaccg

SEQ ID NO: 35309 - DNA, 18 bp, Artificial Sequence
  Synthetic DNA
taatatgtcacacgtaag

SEQ ID NO: 35310 - DNA, 18 bp, Artificial Sequence
  Synthetic DNA
tactacgacacgcaaaag

SEQ ID NO: 35311 - DNA, 18 bp, Artificial Sequence
  Synthetic DNA
tatgacgtctgactattg

SEQ ID NO: 35312 - DNA, 18 bp, Artificial Sequence
  Synthetic DNA
ttattaaactcactacag

SEQ ID NO: 35313 - DNA, 18 bp, Artificial Sequence
  Synthetic DNA
aattatgtctcactattg

SEQ ID NO: 35314 - DNA, 18 bp, Artificial Sequence
  Synthetic DNA
caatgcgactcacttatg

SEQ ID NO: 35315 - DNA, 18 bp, Artificial Sequence
  Synthetic DNA
cactgcgtcttacaattg

SEQ ID NO: 35316 - DNA, 18 bp, Artificial Sequence
  Synthetic DNA
ttaaacgactctcatttg

SEQ ID NO: 35317 - DNA, 18 bp, Artificial Sequence
  Synthetic DNA
taaagcgtctcactactg

SEQ ID NO: 35318 - DNA, 18 bp, Artificial Sequence
  Synthetic DNA
tgttagaactcactgaag

SEQ ID NO: 35319 - DNA, 18 bp, Artificial Sequence
  Synthetic DNA
tgatgcgatttatactag

SEQ ID NO: 35320 - DNA, 18 bp, Artificial Sequence
  Synthetic DNA
tattaccgttcactttag

SEQ ID NO: 35321 - DNA, 18 bp, Artificial Sequence
  Synthetic DNA
ttatacgactcacatatg

SEQ ID NO: 35322 - DNA, 18 bp, Artificial Sequence
  Synthetic DNA
tagttcgtcacactctag

SEQ ID NO: 35323 - DNA, 18 bp, Artificial Sequence
  Synthetic DNA
tatttcgactcgctaacg

SEQ ID NO: 35324 - DNA, 18 bp, Artificial Sequence
  Synthetic DNA
aagtgcgtctctctttgg

SEQ ID NO: 35325 - DNA, 18 bp, Artificial Sequence
  Synthetic DNA
cgattcgactcgctacag

SEQ ID NO: 35326 - DNA, 18 bp, Artificial Sequence
  Synthetic DNA
taaaacgactcagatttg

SEQ ID NO: 35327 - DNA, 18 bp, Artificial Sequence
  Synthetic DNA
tgtttcgactcgcgatag

SEQ ID NO: 35328 - DNA, 18 bp, Artificial Sequence
  Synthetic DNA
ttttaagactcactgttg

SEQ ID NO: 35329 - DNA, 18 bp, Artificial Sequence
  Synthetic DNA
gattgcgcctcacttaag

SEQ ID NO: 35330 - DNA, 18 bp, Artificial Sequence
  Synthetic DNA
ttatctgcctcactatcg

SEQ ID NO: 35331 - DNA, 18 bp, Artificial Sequence
  Synthetic DNA
catatcgactcacaatag

SEQ ID NO: 35332 - DNA, 18 bp, Artificial Sequence
  Synthetic DNA
tgctgccacttaccatag

SEQ ID NO: 35333 - DNA, 18 bp, Artificial Sequence
  Synthetic DNA
gaaatcgtctcactaatg

SEQ ID NO: 35334 - DNA, 18 bp, Artificial Sequence
  Synthetic DNA
tcatacgactctattttg

SEQ ID NO: 35335 - DNA, 18 bp, Artificial Sequence
  Synthetic DNA
ttattcgactcgcttcag

SEQ ID NO: 35336 - DNA, 18 bp, Artificial Sequence
  Synthetic DNA
ttattcgagccactacag

SEQ ID NO: 35337 - DNA, 18 bp, Artificial Sequence
  Synthetic DNA
taatacagcacaccactg

SEQ ID NO: 35338 - DNA, 18 bp, Artificial Sequence
  Synthetic DNA
taacacgtgtccctctag

SEQ ID NO: 35339 - DNA, 18 bp, Artificial Sequence
  Synthetic DNA
taccgcgactcacttaag

SEQ ID NO: 35340 - DNA, 18 bp, Artificial Sequence
  Synthetic DNA
ttaaagcacactttcaag

SEQ ID NO: 35341 - DNA, 18 bp, Artificial Sequence
  Synthetic DNA
taatccgtatcactccag

SEQ ID NO: 35342 - DNA, 18 bp, Artificial Sequence
  Synthetic DNA
gtatgcgacttgctttag

SEQ ID NO: 35343 - DNA, 18 bp, Artificial Sequence
  Synthetic DNA
taaataaactcacaatag

SEQ ID NO: 35344 - DNA, 18 bp, Artificial Sequence
  Synthetic DNA
tattagaactcaccaaag

SEQ ID NO: 35345 - DNA, 18 bp, Artificial Sequence
  Synthetic DNA
tagtacgtgtcaattctg

SEQ ID NO: 35346 - DNA, 18 bp, Artificial Sequence
  Synthetic DNA
taagagtgctttctatgg

SEQ ID NO: 35347 - DNA, 18 bp, Artificial Sequence
  Synthetic DNA
cttagggactagctcttg

SEQ ID NO: 35348 - DNA, 18 bp, Artificial Sequence
  Synthetic DNA
taagacttctcgctacag

SEQ ID NO: 35349 - DNA, 18 bp, Artificial Sequence
  Synthetic DNA
taacgcgacacactgcag

SEQ ID NO: 35350 - DNA, 18 bp, Artificial Sequence
  Synthetic DNA
taatgcgtcacaccctag

SEQ ID NO: 35351 - DNA, 18 bp, Artificial Sequence
  Synthetic DNA
taatagaactcgctaatg

SEQ ID NO: 35352 - DNA, 18 bp, Artificial Sequence
  Synthetic DNA
tatttcgactctccattg

SEQ ID NO: 35353 - DNA, 18 bp, Artificial Sequence
  Synthetic DNA
aattaggactcactctcg

SEQ ID NO: 35354 - DNA, 18 bp, Artificial Sequence
  Synthetic DNA
taaaaagaagcaccattg

SEQ ID NO: 35355 - DNA, 18 bp, Artificial Sequence
  Synthetic DNA
taatttgtctcgccatag

SEQ ID NO: 35356 - DNA, 18 bp, Artificial Sequence
  Synthetic DNA
tgaatctcgtcactagag

SEQ ID NO: 35357 - DNA, 18 bp, Artificial Sequence
  Synthetic DNA
ttacacgactcactcatg

SEQ ID NO: 35358 - DNA, 18 bp, Artificial Sequence
  Synthetic DNA
tatgaaggctcaatatag

SEQ ID NO: 35359 - DNA, 18 bp, Artificial Sequence
  Synthetic DNA
tttattgactcactctag

SEQ ID NO: 35360 - DNA, 18 bp, Artificial Sequence
  Synthetic DNA
taattaaactcgctacag

SEQ ID NO: 35361 - DNA, 18 bp, Artificial Sequence
  Synthetic DNA
taattgaactcagtatgg

SEQ ID NO: 35362 - DNA, 18 bp, Artificial Sequence
  Synthetic DNA
tagtgcgtctcgctatcg

SEQ ID NO: 35363 - DNA, 18 bp, Artificial Sequence
  Synthetic DNA
tatttggactcgctattg

SEQ ID NO: 35364 - DNA, 18 bp, Artificial Sequence
  Synthetic DNA
tgaaacggctcgcattag

SEQ ID NO: 35365 - DNA, 18 bp, Artificial Sequence
  Synthetic DNA
ttaaacgagtttctatag

SEQ ID NO: 35366 - DNA, 18 bp, Artificial Sequence
  Synthetic DNA
ttaagccactcactaaag

SEQ ID NO: 35367 - DNA, 18 bp, Artificial Sequence
  Synthetic DNA
ttattggtctcactatgg

SEQ ID NO: 35368 - DNA, 18 bp, Artificial Sequence
  Synthetic DNA
atttgcgactcttagtag

SEQ ID NO: 35369 - DNA, 18 bp, Artificial Sequence
  Synthetic DNA
attttagactcagtaaag

SEQ ID NO: 35370 - DNA, 18 bp, Artificial Sequence
  Synthetic DNA
ctaagcgcctcactttag

SEQ ID NO: 35371 - DNA, 18 bp, Artificial Sequence
  Synthetic DNA
taaaacggtactctatag

SEQ ID NO: 35372 - DNA, 18 bp, Artificial Sequence
  Synthetic DNA
taaatagtgttactatag

SEQ ID NO: 35373 - DNA, 18 bp, Artificial Sequence
  Synthetic DNA
taatatgactgacgactg

SEQ ID NO: 35374 - DNA, 18 bp, Artificial Sequence
  Synthetic DNA
taattagactcacagttg

SEQ ID NO: 35375 - DNA, 18 bp, Artificial Sequence
  Synthetic DNA
taggtcctcacactatcg

SEQ ID NO: 35376 - DNA, 18 bp, Artificial Sequence
  Synthetic DNA
tataacgacttgcttttg

SEQ ID NO: 35377 - DNA, 18 bp, Artificial Sequence
  Synthetic DNA
tataatgaattactacag

SEQ ID NO: 35378 - DNA, 18 bp, Artificial Sequence
  Synthetic DNA
tattgcgtctcgctgcag

SEQ ID NO: 35379 - DNA, 18 bp, Artificial Sequence
  Synthetic DNA
tattgggacaccctattg

SEQ ID NO: 35380 - DNA, 18 bp, Artificial Sequence
  Synthetic DNA
tatttcgtcccaatctag

SEQ ID NO: 35381 - DNA, 18 bp, Artificial Sequence
  Synthetic DNA
tatttggactcacgtttg

SEQ ID NO: 35382 - DNA, 18 bp, Artificial Sequence
  Synthetic DNA
ttaatggactcactaatg

SEQ ID NO: 35383 - DNA, 18 bp, Artificial Sequence
  Synthetic DNA
ttataagactcgccattg

SEQ ID NO: 35384 - DNA, 18 bp, Artificial Sequence
  Synthetic DNA
ttatacgacttttaacag

SEQ ID NO: 35385 - DNA, 18 bp, Artificial Sequence
  Synthetic DNA
ttatgcggctctcaattg

SEQ ID NO: 35386 - DNA, 18 bp, Artificial Sequence
  Synthetic DNA
ttctatgattctcttcgg

SEQ ID NO: 35387 - DNA, 18 bp, Artificial Sequence
  Synthetic DNA
ttgtaccacacaccattg

SEQ ID NO: 35388 - DNA, 18 bp, Artificial Sequence
  Synthetic DNA
aaaaacgactgacaatgg

SEQ ID NO: 35389 - DNA, 18 bp, Artificial Sequence
  Synthetic DNA
aaaaacgcatcactttag

SEQ ID NO: 35390 - DNA, 18 bp, Artificial Sequence
  Synthetic DNA
aaaaacgccgcactagag

SEQ ID NO: 35391 - DNA, 18 bp, Artificial Sequence
  Synthetic DNA
aaaaccggctaactaaag

SEQ ID NO: 35392 - DNA, 18 bp, Artificial Sequence
  Synthetic DNA
aaaatagattctatagag

SEQ ID NO: 35393 - DNA, 18 bp, Artificial Sequence
  Synthetic DNA
aaagacgactcaatctgg

SEQ ID NO: 35394 - DNA, 18 bp, Artificial Sequence
  Synthetic DNA
aaagtcacctaactgtag

SEQ ID NO: 35395 - DNA, 18 bp, Artificial Sequence
  Synthetic DNA
aaataattctcactactg

SEQ ID NO: 35396 - DNA, 18 bp, Artificial Sequence
  Synthetic DNA
aaatacaacttaccattg

SEQ ID NO: 35397 - DNA, 18 bp, Artificial Sequence
  Synthetic DNA
aaataccgcacactttag

SEQ ID NO: 35398 - DNA, 18 bp, Artificial Sequence
  Synthetic DNA
aaataggcctcacgactg

SEQ ID NO: 35399 - DNA, 18 bp, Artificial Sequence
  Synthetic DNA
aaataggtcgccccattg

SEQ ID NO: 35400 - DNA, 18 bp, Artificial Sequence
  Synthetic DNA
aaatatagctcatcataa

SEQ ID NO: 35401 - DNA, 18 bp, Artificial Sequence
  Synthetic DNA
aaatatcactcagtaaag

SEQ ID NO: 35402 - DNA, 18 bp, Artificial Sequence
  Synthetic DNA
aaatgcgactccccaaag

SEQ ID NO: 35403 - DNA, 18 bp, Artificial Sequence
  Synthetic DNA
aaattccactcaatgtag

SEQ ID NO: 35404 - DNA, 18 bp, Artificial Sequence
  Synthetic DNA
aaattcgactctctctcg

SEQ ID NO: 35405 - DNA, 18 bp, Artificial Sequence
  Synthetic DNA
aaattcggatcgccatag

SEQ ID NO: 35406 - DNA, 18 bp, Artificial Sequence
  Synthetic DNA
aaatttgtcttagtttgg

SEQ ID NO: 35407 - DNA, 18 bp, Artificial Sequence
  Synthetic DNA
aaggactactaactatag

SEQ ID NO: 35408 - DNA, 18 bp, Artificial Sequence
  Synthetic DNA
aattagaactcactgtag

SEQ ID NO: 35409 - DNA, 18 bp, Artificial Sequence
  Synthetic DNA
acaaaagactcactacag

SEQ ID NO: 35410 - DNA, 18 bp, Artificial Sequence
  Synthetic DNA
acagaatatacacttcag

SEQ ID NO: 35411 - DNA, 18 bp, Artificial Sequence
  Synthetic DNA
acatacgaatatctaccg

SEQ ID NO: 35412 - DNA, 18 bp, Artificial Sequence
  Synthetic DNA
agatactacacaccctag

SEQ ID NO: 35413 - DNA, 18 bp, Artificial Sequence
  Synthetic DNA
aggttagattcacattgg

SEQ ID NO: 35414 - DNA, 18 bp, Artificial Sequence
  Synthetic DNA
agtaacgactgactatag

SEQ ID NO: 35415 - DNA, 18 bp, Artificial Sequence
  Synthetic DNA
ataaaagactcaatatcg

SEQ ID NO: 35416 - DNA, 18 bp, Artificial Sequence
  Synthetic DNA
ataatcgtgtatcaatag

SEQ ID NO: 35417 - DNA, 18 bp, Artificial Sequence
  Synthetic DNA
atacaacactaactatag

SEQ ID NO: 35418 - DNA, 18 bp, Artificial Sequence
  Synthetic DNA
atatactacttacaacag

SEQ ID NO: 35419 - DNA, 18 bp, Artificial Sequence
  Synthetic DNA
atattagtctcacgatag

SEQ ID NO: 35420 - DNA, 18 bp, Artificial Sequence
  Synthetic DNA
atattcgactcgctcaag

SEQ ID NO: 35421 - DNA, 18 bp, Artificial Sequence
  Synthetic DNA
atttaccagcccctaaag

SEQ ID NO: 35422 - DNA, 18 bp, Artificial Sequence
  Synthetic DNA
atttaggactcactattg

SEQ ID NO: 35423 - DNA, 18 bp, Artificial Sequence
  Synthetic DNA
caaagcaactcactctag

SEQ ID NO: 35424 - DNA, 18 bp, Artificial Sequence
  Synthetic DNA
caatacatttaacaatcg

SEQ ID NO: 35425 - DNA, 18 bp, Artificial Sequence
  Synthetic DNA
caatacgaaccaatacag

SEQ ID NO: 35426 - DNA, 18 bp, Artificial Sequence
  Synthetic DNA
caatacgacagtcaattg

SEQ ID NO: 35427 - DNA, 18 bp, Artificial Sequence
  Synthetic DNA
caatacgactttgtttag

SEQ ID NO: 35428 - DNA, 18 bp, Artificial Sequence
  Synthetic DNA
caatagaactcaccaaag

SEQ ID NO: 35429 - DNA, 18 bp, Artificial Sequence
  Synthetic DNA
caattcgactgactcaag

SEQ ID NO: 35430 - DNA, 18 bp, Artificial Sequence
  Synthetic DNA
cagtttatctcacaatag

SEQ ID NO: 35431 - DNA, 18 bp, Artificial Sequence
  Synthetic DNA
cataatgactatctatca

SEQ ID NO: 35432 - DNA, 18 bp, Artificial Sequence
  Synthetic DNA
cattacgattctttacag

SEQ ID NO: 35433 - DNA, 18 bp, Artificial Sequence
  Synthetic DNA
catttcgactcacttttg

SEQ ID NO: 35434 - DNA, 18 bp, Artificial Sequence
  Synthetic DNA
cctaacgtctcaatatag

SEQ ID NO: 35435 - DNA, 18 bp, Artificial Sequence
  Synthetic DNA
cgatacatctcactctag

SEQ ID NO: 35436 - DNA, 18 bp, Artificial Sequence
  Synthetic DNA
cggtacaagtgagtatag

SEQ ID NO: 35437 - DNA, 18 bp, Artificial Sequence
  Synthetic DNA
ctatactgctccctatag

SEQ ID NO: 35438 - DNA, 18 bp, Artificial Sequence
  Synthetic DNA
ctcaacgcttcacggtag

SEQ ID NO: 35439 - DNA, 18 bp, Artificial Sequence
  Synthetic DNA
cttaacgccacactatag

SEQ ID NO: 35440 - DNA, 18 bp, Artificial Sequence
  Synthetic DNA
ctttacaatatactttag

SEQ ID NO: 35441 - DNA, 18 bp, Artificial Sequence
  Synthetic DNA
ctttttgactcactatag

SEQ ID NO: 35442 - DNA, 18 bp, Artificial Sequence
  Synthetic DNA
gaaaaaaactcactctag

SEQ ID NO: 35443 - DNA, 18 bp, Artificial Sequence
  Synthetic DNA
gaaaaaatctgattattg

SEQ ID NO: 35444 - DNA, 18 bp, Artificial Sequence
  Synthetic DNA
gaatacgatagtctattg

SEQ ID NO: 35445 - DNA, 18 bp, Artificial Sequence
  Synthetic DNA
gagaactgctcactaatg

SEQ ID NO: 35446 - DNA, 18 bp, Artificial Sequence
  Synthetic DNA
gagtacgactcgctcttg

SEQ ID NO: 35447 - DNA, 18 bp, Artificial Sequence
  Synthetic DNA
ggtaacgactcactcttg

SEQ ID NO: 35448 - DNA, 18 bp, Artificial Sequence
  Synthetic DNA
ggttactactgactattg

SEQ ID NO: 35449 - DNA, 18 bp, Artificial Sequence
  Synthetic DNA
gtatatgactaatgatcg

SEQ ID NO: 35450 - DNA, 18 bp, Artificial Sequence
  Synthetic DNA
gtgtacgtctcactacag

SEQ ID NO: 35451 - DNA, 18 bp, Artificial Sequence
  Synthetic DNA
taaaaagactctctgtgg

SEQ ID NO: 35452 - DNA, 18 bp, Artificial Sequence
  Synthetic DNA
taaaaagactgtctaaag

SEQ ID NO: 35453 - DNA, 18 bp, Artificial Sequence
  Synthetic DNA
taaaaatacttcatacag

SEQ ID NO: 35454 - DNA, 18 bp, Artificial Sequence
  Synthetic DNA
taaaacatttcgctatag

SEQ ID NO: 35455 - DNA, 18 bp, Artificial Sequence
  Synthetic DNA
taaaaccattcataattg

SEQ ID NO: 35456 - DNA, 18 bp, Artificial Sequence
  Synthetic DNA
taaaacgacactctaatg

SEQ ID NO: 35457 - DNA, 18 bp, Artificial Sequence
  Synthetic DNA
taaaacgccaaattaaag

SEQ ID NO: 35458 - DNA, 18 bp, Artificial Sequence
  Synthetic DNA
taaaaggtcttaataaag

SEQ ID NO: 35459 - DNA, 18 bp, Artificial Sequence
  Synthetic DNA
taaagctactatatttag

SEQ ID NO: 35460 - DNA, 18 bp, Artificial Sequence
  Synthetic DNA
taaatcagttcactatag

SEQ ID NO: 35461 - DNA, 18 bp, Artificial Sequence
  Synthetic DNA
taaattgacacaatatag

SEQ ID NO: 35462 - DNA, 18 bp, Artificial Sequence
  Synthetic DNA
taaattgacttcctttag

SEQ ID NO: 35463 - DNA, 18 bp, Artificial Sequence
  Synthetic DNA
taaatttattgactattg

SEQ ID NO: 35464 - DNA, 18 bp, Artificial Sequence
  Synthetic DNA
taacacgtctctcattag

SEQ ID NO: 35465 - DNA, 18 bp, Artificial Sequence
  Synthetic DNA
taataaaaatcacaattg

SEQ ID NO: 35466 - DNA, 18 bp, Artificial Sequence
  Synthetic DNA
taataagattcgcaattg

SEQ ID NO: 35467 - DNA, 18 bp, Artificial Sequence
  Synthetic DNA
taatacaactcacatgtg

SEQ ID NO: 35468 - DNA, 18 bp, Artificial Sequence
  Synthetic DNA
taatacctcttcgtttag

SEQ ID NO: 35469 - DNA, 18 bp, Artificial Sequence
  Synthetic DNA
taatacctttctctttgg

SEQ ID NO: 35470 - DNA, 18 bp, Artificial Sequence
  Synthetic DNA
taatacgaaattcgatag

SEQ ID NO: 35471 - DNA, 18 bp, Artificial Sequence
  Synthetic DNA
taatacgaatagtcatag

SEQ ID NO: 35472 - DNA, 18 bp, Artificial Sequence
  Synthetic DNA
taatacgataaacactag

SEQ ID NO: 35473 - DNA, 18 bp, Artificial Sequence
  Synthetic DNA
taatacgatacgcccaag

SEQ ID NO: 35474 - DNA, 18 bp, Artificial Sequence
  Synthetic DNA
taatacgattccatttgg

SEQ ID NO: 35475 - DNA, 18 bp, Artificial Sequence
  Synthetic DNA
taatacggcagtataaag

SEQ ID NO: 35476 - DNA, 18 bp, Artificial Sequence
  Synthetic DNA
taatacgtatctctaatg

SEQ ID NO: 35477 - DNA, 18 bp, Artificial Sequence
  Synthetic DNA
taatacgtcattctaaag

SEQ ID NO: 35478 - DNA, 18 bp, Artificial Sequence
  Synthetic DNA
taatacttcgcacataag

SEQ ID NO: 35479 - DNA, 18 bp, Artificial Sequence
  Synthetic DNA
taatagtataccctttag

SEQ ID NO: 35480 - DNA, 18 bp, Artificial Sequence
  Synthetic DNA
taatatagatcactattg

SEQ ID NO: 35481 - DNA, 18 bp, Artificial Sequence
  Synthetic DNA
taatatatctcgcaaatg

SEQ ID NO: 35482 - DNA, 18 bp, Artificial Sequence
  Synthetic DNA
taatatgacccccaaagg

SEQ ID NO: 35483 - DNA, 18 bp, Artificial Sequence
  Synthetic DNA
taatcagacatactattg

SEQ ID NO: 35484 - DNA, 18 bp, Artificial Sequence
  Synthetic DNA
taatcatgcttactgtag

SEQ ID NO: 35485 - DNA, 18 bp, Artificial Sequence
  Synthetic DNA
taatccgatatcctattg

SEQ ID NO: 35486 - DNA, 18 bp, Artificial Sequence
  Synthetic DNA
taatccgattcacgttcg

SEQ ID NO: 35487 - DNA, 18 bp, Artificial Sequence
  Synthetic DNA
taatcgatcttaatatag

SEQ ID NO: 35488 - DNA, 18 bp, Artificial Sequence
  Synthetic DNA
taatgcgaccagcgtaag

SEQ ID NO: 35489 - DNA, 18 bp, Artificial Sequence
  Synthetic DNA
taatgcgactcttattag

SEQ ID NO: 35490 - DNA, 18 bp, Artificial Sequence
  Synthetic DNA
taattcaaaatactatag

SEQ ID NO: 35491 - DNA, 18 bp, Artificial Sequence
  Synthetic DNA
taattcgacgcaattggg

SEQ ID NO: 35492 - DNA, 18 bp, Artificial Sequence
  Synthetic DNA
taattcggaactctatag

SEQ ID NO: 35493 - DNA, 18 bp, Artificial Sequence
  Synthetic DNA
taattcgtataaatattg

SEQ ID NO: 35494 - DNA, 18 bp, Artificial Sequence
  Synthetic DNA
taattcgtctacctttag

SEQ ID NO: 35495 - DNA, 18 bp, Artificial Sequence
  Synthetic DNA
taattctgctgtctacag

SEQ ID NO: 35496 - DNA, 18 bp, Artificial Sequence
  Synthetic DNA
taattggattcactgaag

SEQ ID NO: 35497 - DNA, 18 bp, Artificial Sequence
  Synthetic DNA
tacaaagtctcactttag

SEQ ID NO: 35498 - DNA, 18 bp, Artificial Sequence
  Synthetic DNA
tacaactactctctcttg

SEQ ID NO: 35499 - DNA, 18 bp, Artificial Sequence
  Synthetic DNA
tacaatgacgcacaatag

SEQ ID NO: 35500 - DNA, 18 bp, Artificial Sequence
  Synthetic DNA
taccactagtcacctcag

SEQ ID NO: 35501 - DNA, 18 bp, Artificial Sequence
  Synthetic DNA
tactacctctcaatctag

SEQ ID NO: 35502 - DNA, 18 bp, Artificial Sequence
  Synthetic DNA
tactacgacaagttattg

SEQ ID NO: 35503 - DNA, 18 bp, Artificial Sequence
  Synthetic DNA
tactacgtctatgtacag

SEQ ID NO: 35504 - DNA, 18 bp, Artificial Sequence
  Synthetic DNA
tactgcgtgtcatttaag

SEQ ID NO: 35505 - DNA, 18 bp, Artificial Sequence
  Synthetic DNA
tagaacgacgtacaattg

SEQ ID NO: 35506 - DNA, 18 bp, Artificial Sequence
  Synthetic DNA
tagcacccttcactatag

SEQ ID NO: 35507 - DNA, 18 bp, Artificial Sequence
  Synthetic DNA
tagtacgtcataaaatag

SEQ ID NO: 35508 - DNA, 18 bp, Artificial Sequence
  Synthetic DNA
tagtactactctcaatgg

SEQ ID NO: 35509 - DNA, 18 bp, Artificial Sequence
  Synthetic DNA
tagtataacatcctatag

SEQ ID NO: 35510 - DNA, 18 bp, Artificial Sequence
  Synthetic DNA
tataacgactcacatatg

SEQ ID NO: 35511 - DNA, 18 bp, Artificial Sequence
  Synthetic DNA
tataactacactctatag

SEQ ID NO: 35512 - DNA, 18 bp, Artificial Sequence
  Synthetic DNA
tataactactcactgaag

SEQ ID NO: 35513 - DNA, 18 bp, Artificial Sequence
  Synthetic DNA
tataatgacccacgattg

SEQ ID NO: 35514 - DNA, 18 bp, Artificial Sequence
  Synthetic DNA
tataatgtctcacttgtg

SEQ ID NO: 35515 - DNA, 18 bp, Artificial Sequence
  Synthetic DNA
tatatcgacaatctatag

SEQ ID NO: 35516 - DNA, 18 bp, Artificial Sequence
  Synthetic DNA
tatatcgactcaccctag

SEQ ID NO: 35517 - DNA, 18 bp, Artificial Sequence
  Synthetic DNA
tattaaaaatccctatag

SEQ ID NO: 35518 - DNA, 18 bp, Artificial Sequence
  Synthetic DNA
tattacaacttgctgtag

SEQ ID NO: 35519 - DNA, 18 bp, Artificial Sequence
  Synthetic DNA
tattacgattcaaattag

SEQ ID NO: 35520 - DNA, 18 bp, Artificial Sequence
  Synthetic DNA
tattacgtttcacattcg

SEQ ID NO: 35521 - DNA, 18 bp, Artificial Sequence
  Synthetic DNA
tattatgacccacattag

SEQ ID NO: 35522 - DNA, 18 bp, Artificial Sequence
  Synthetic DNA
tattccatcacaatatag

SEQ ID NO: 35523 - DNA, 18 bp, Artificial Sequence
  Synthetic DNA
tatttagcatcactatag

SEQ ID NO: 35524 - DNA, 18 bp, Artificial Sequence
  Synthetic DNA
tatttctaatttcattag

SEQ ID NO: 35525 - DNA, 18 bp, Artificial Sequence
  Synthetic DNA
tcaaacaacgcactattg

SEQ ID NO: 35526 - DNA, 18 bp, Artificial Sequence
  Synthetic DNA
tcaaaccacaaactctag

SEQ ID NO: 35527 - DNA, 18 bp, Artificial Sequence
  Synthetic DNA
tcaaaccattcattatag

SEQ ID NO: 35528 - DNA, 18 bp, Artificial Sequence
  Synthetic DNA
tcaaactaatcactagag

SEQ ID NO: 35529 - DNA, 18 bp, Artificial Sequence
  Synthetic DNA
tcaatcgacacaaattag

SEQ ID NO: 35530 - DNA, 18 bp, Artificial Sequence
  Synthetic DNA
tcataagactcatcgcag

SEQ ID NO: 35531 - DNA, 18 bp, Artificial Sequence
  Synthetic DNA
tcatacgatcaaaaaatg

SEQ ID NO: 35532 - DNA, 18 bp, Artificial Sequence
  Synthetic DNA
tcatagaacattatatgg

SEQ ID NO: 35533 - DNA, 18 bp, Artificial Sequence
  Synthetic DNA
tcatagtactctcaattg

SEQ ID NO: 35534 - DNA, 18 bp, Artificial Sequence
  Synthetic DNA
tcatcaggctcactattg

SEQ ID NO: 35535 - DNA, 18 bp, Artificial Sequence
  Synthetic DNA
tcatcggacaaactacag

SEQ ID NO: 35536 - DNA, 18 bp, Artificial Sequence
  Synthetic DNA
tcgtactacacaagctag

SEQ ID NO: 35537 - DNA, 18 bp, Artificial Sequence
  Synthetic DNA
tctaacgactcactaatg

SEQ ID NO: 35538 - DNA, 18 bp, Artificial Sequence
  Synthetic DNA
tcttacgtcccattttag

SEQ ID NO: 35539 - DNA, 18 bp, Artificial Sequence
  Synthetic DNA
tcttaggactcgctaaag

SEQ ID NO: 35540 - DNA, 18 bp, Artificial Sequence
  Synthetic DNA
tgaaacaactctcatttg

SEQ ID NO: 35541 - DNA, 18 bp, Artificial Sequence
  Synthetic DNA
tgaaatgaatctatctag

SEQ ID NO: 35542 - DNA, 18 bp, Artificial Sequence
  Synthetic DNA
tgaatcgactctttaaag

SEQ ID NO: 35543 - DNA, 18 bp, Artificial Sequence
  Synthetic DNA
tgacacgtgccactaatg

SEQ ID NO: 35544 - DNA, 18 bp, Artificial Sequence
  Synthetic DNA
tgactggacacactaaag

SEQ ID NO: 35545 - DNA, 18 bp, Artificial Sequence
  Synthetic DNA
tgataattctcgtttttg

SEQ ID NO: 35546 - DNA, 18 bp, Artificial Sequence
  Synthetic DNA
tgataccctatactatag

SEQ ID NO: 35547 - DNA, 18 bp, Artificial Sequence
  Synthetic DNA
tgatacgagtaacttaag

SEQ ID NO: 35548 - DNA, 18 bp, Artificial Sequence
  Synthetic DNA
tgatacggctaataattg

SEQ ID NO: 35549 - DNA, 18 bp, Artificial Sequence
  Synthetic DNA
tgatccctctcactttag

SEQ ID NO: 35550 - DNA, 18 bp, Artificial Sequence
  Synthetic DNA
tgatctaaatctcattag

SEQ ID NO: 35551 - DNA, 18 bp, Artificial Sequence
  Synthetic DNA
tgatgatactcattatag

SEQ ID NO: 35552 - DNA, 18 bp, Artificial Sequence
  Synthetic DNA
tgatggcacaaactatag

SEQ ID NO: 35553 - DNA, 18 bp, Artificial Sequence
  Synthetic DNA
tgatgtgtctgacattag

SEQ ID NO: 35554 - DNA, 18 bp, Artificial Sequence
  Synthetic DNA
tgattcataaccctttag

SEQ ID NO: 35555 - DNA, 18 bp, Artificial Sequence
  Synthetic DNA
tggaacgattcaaaatag

SEQ ID NO: 35556 - DNA, 18 bp, Artificial Sequence
  Synthetic DNA
tgttacgactatctaaag

SEQ ID NO: 35557 - DNA, 18 bp, Artificial Sequence
  Synthetic DNA
tgttagaactcactaaag

SEQ ID NO: 35558 - DNA, 18 bp, Artificial Sequence
  Synthetic DNA
tgtttcgacacacttcag

SEQ ID NO: 35559 - DNA, 18 bp, Artificial Sequence
  Synthetic DNA
ttaagccaatcactatag

SEQ ID NO: 35560 - DNA, 18 bp, Artificial Sequence
  Synthetic DNA
ttaatagactcactttag

SEQ ID NO: 35561 - DNA, 18 bp, Artificial Sequence
  Synthetic DNA
ttaatccactcactaatg

SEQ ID NO: 35562 - DNA, 18 bp, Artificial Sequence
  Synthetic DNA
ttacaagattcacgcaag

SEQ ID NO: 35563 - DNA, 18 bp, Artificial Sequence
  Synthetic DNA
ttacacgcaatacttaag

SEQ ID NO: 35564 - DNA, 18 bp, Artificial Sequence
  Synthetic DNA
ttacgcgactcactcttg

SEQ ID NO: 35565 - DNA, 18 bp, Artificial Sequence
  Synthetic DNA
ttagacgactaactccag

SEQ ID NO: 35566 - DNA, 18 bp, Artificial Sequence
  Synthetic DNA
ttatacaactcgcagtag

SEQ ID NO: 35567 - DNA, 18 bp, Artificial Sequence
  Synthetic DNA
ttatacaccaaattaaag

SEQ ID NO: 35568 - DNA, 18 bp, Artificial Sequence
  Synthetic DNA
ttatacatctccctgcag

SEQ ID NO: 35569 - DNA, 18 bp, Artificial Sequence
  Synthetic DNA
ttataccagcttctgaag

SEQ ID NO: 35570 - DNA, 18 bp, Artificial Sequence
  Synthetic DNA
ttatacgaattaaaaaag

SEQ ID NO: 35571 - DNA, 18 bp, Artificial Sequence
  Synthetic DNA
ttatacgattcccaaatg

SEQ ID NO: 35572 - DNA, 18 bp, Artificial Sequence
  Synthetic DNA
ttatacgtataactttag

SEQ ID NO: 35573 - DNA, 18 bp, Artificial Sequence
  Synthetic DNA
ttataggtcgcaacttag

SEQ ID NO: 35574 - DNA, 18 bp, Artificial Sequence
  Synthetic DNA
ttatatgtttcagtatag

SEQ ID NO: 35575 - DNA, 18 bp, Artificial Sequence
  Synthetic DNA
ttatcccacccaccattg

SEQ ID NO: 35576 - DNA, 18 bp, Artificial Sequence
  Synthetic DNA
ttatgggaatgtctaaag

SEQ ID NO: 35577 - DNA, 18 bp, Artificial Sequence
  Synthetic DNA
ttattagactcgcccttg

SEQ ID NO: 35578 - DNA, 18 bp, Artificial Sequence
  Synthetic DNA
ttattctactaactctag

SEQ ID NO: 35579 - DNA, 18 bp, Artificial Sequence
  Synthetic DNA
ttccacgacatactttag

SEQ ID NO: 35580 - DNA, 18 bp, Artificial Sequence
  Synthetic DNA
ttctattactctctaaag

SEQ ID NO: 35581 - DNA, 18 bp, Artificial Sequence
  Synthetic DNA
tttaacgtctcagttaag

SEQ ID NO: 35582 - DNA, 18 bp, Artificial Sequence
  Synthetic DNA
ttttaaaactcacactag

SEQ ID NO: 35583 - DNA, 18 bp, Artificial Sequence
  Synthetic DNA
ttttacgcttcactattg

SEQ ID NO: 35584 - DNA, 18 bp, Artificial Sequence
  Synthetic DNA
ttttataacttgctatag

SEQ ID NO: 35585 - DNA, 18 bp, Artificial Sequence
  Synthetic DNA
ttttgcgactcaataaag

SEQ ID NO: 35586 - DNA, 18 bp, Artificial Sequence
  Synthetic DNA
tttttcgacttactatgg

SEQ ID NO: 35587 - DNA, 18 bp, Artificial Sequence
  Synthetic DNA
aaaaacaactctgttaag

SEQ ID NO: 35588 - DNA, 18 bp, Artificial Sequence
  Synthetic DNA
aaaaaccacactctattg

SEQ ID NO: 35589 - DNA, 18 bp, Artificial Sequence
  Synthetic DNA
aaaaaccatttttgatag

SEQ ID NO: 35590 - DNA, 18 bp, Artificial Sequence
  Synthetic DNA
aaaaacccctcccaatag

SEQ ID NO: 35591 - DNA, 18 bp, Artificial Sequence
  Synthetic DNA
aaaaacgaaacactcgag

SEQ ID NO: 35592 - DNA, 18 bp, Artificial Sequence
  Synthetic DNA
aaaaacgacacacttcag

SEQ ID NO: 35593 - DNA, 18 bp, Artificial Sequence
  Synthetic DNA
aaaaacgactcaatatta

SEQ ID NO: 35594 - DNA, 18 bp, Artificial Sequence
  Synthetic DNA
aaaaacgactcacagttg

SEQ ID NO: 35595 - DNA, 18 bp, Artificial Sequence
  Synthetic DNA
aaaaacgactcacatttg

SEQ ID NO: 35596 - DNA, 18 bp, Artificial Sequence
  Synthetic DNA
aaaaacgccctactaaag

SEQ ID NO: 35597 - DNA, 18 bp, Artificial Sequence
  Synthetic DNA
aaaaacggcccattatag

SEQ ID NO: 35598 - DNA, 18 bp, Artificial Sequence
  Synthetic DNA
aaaaacgtcttaagaaag

SEQ ID NO: 35599 - DNA, 18 bp, Artificial Sequence
  Synthetic DNA
aaaaactactcacaataa

SEQ ID NO: 35600 - DNA, 18 bp, Artificial Sequence
  Synthetic DNA
aaaaactactcactaatg

SEQ ID NO: 35601 - DNA, 18 bp, Artificial Sequence
  Synthetic DNA
aaaaaggagtctcattag

SEQ ID NO: 35602 - DNA, 18 bp, Artificial Sequence
  Synthetic DNA
aaaaatgtctctctttag

SEQ ID NO: 35603 - DNA, 18 bp, Artificial Sequence
  Synthetic DNA
aaaaccgacacatttcag

SEQ ID NO: 35604 - DNA, 18 bp, Artificial Sequence
  Synthetic DNA
aaaacctacttactatag

SEQ ID NO: 35605 - DNA, 18 bp, Artificial Sequence
  Synthetic DNA
aaaagagacttactaacg

SEQ ID NO: 35606 - DNA, 18 bp, Artificial Sequence
  Synthetic DNA
aaaagagtctcactatag

SEQ ID NO: 35607 - DNA, 18 bp, Artificial Sequence
  Synthetic DNA
aaaagcaagtcactatag

SEQ ID NO: 35608 - DNA, 18 bp, Artificial Sequence
  Synthetic DNA
aaaagcatcccactatag

SEQ ID NO: 35609 - DNA, 18 bp, Artificial Sequence
  Synthetic DNA
aaaagcgaccaactatag

SEQ ID NO: 35610 - DNA, 18 bp, Artificial Sequence
  Synthetic DNA
aaaagcgactaactggag

SEQ ID NO: 35611 - DNA, 18 bp, Artificial Sequence
  Synthetic DNA
aaaagcgactaattatag

SEQ ID NO: 35612 - DNA, 18 bp, Artificial Sequence
  Synthetic DNA
aaaagcgactcaatttag

SEQ ID NO: 35613 - DNA, 18 bp, Artificial Sequence
  Synthetic DNA
aaaagcgatttattatag

SEQ ID NO: 35614 - DNA, 18 bp, Artificial Sequence
  Synthetic DNA
aaaagggactcaatatag

SEQ ID NO: 35615 - DNA, 18 bp, Artificial Sequence
  Synthetic DNA
aaaatagtctaactttag

SEQ ID NO: 35616 - DNA, 18 bp, Artificial Sequence
  Synthetic DNA
aaaatcaagtcactatag

SEQ ID NO: 35617 - DNA, 18 bp, Artificial Sequence
  Synthetic DNA
aaaatcgactcagtttag

SEQ ID NO: 35618 - DNA, 18 bp, Artificial Sequence
  Synthetic DNA
aaaatcgattcacttcag

SEQ ID NO: 35619 - DNA, 18 bp, Artificial Sequence
  Synthetic DNA
aaaatcgtgtcacaatag

SEQ ID NO: 35620 - DNA, 18 bp, Artificial Sequence
  Synthetic DNA
aaaatctactcactgtag

SEQ ID NO: 35621 - DNA, 18 bp, Artificial Sequence
  Synthetic DNA
aaacaagacgctctagag

SEQ ID NO: 35622 - DNA, 18 bp, Artificial Sequence
  Synthetic DNA
aaacaagtctcacattag

SEQ ID NO: 35623 - DNA, 18 bp, Artificial Sequence
  Synthetic DNA
aaacaccccagactaaag

SEQ ID NO: 35624 - DNA, 18 bp, Artificial Sequence
  Synthetic DNA
aaacacgactaactaatg

SEQ ID NO: 35625 - DNA, 18 bp, Artificial Sequence
  Synthetic DNA
aaacacgactgacaacag

SEQ ID NO: 35626 - DNA, 18 bp, Artificial Sequence
  Synthetic DNA
aaacacgaggcgctaaag

SEQ ID NO: 35627 - DNA, 18 bp, Artificial Sequence
  Synthetic DNA
aaacacgcgttacaatag

SEQ ID NO: 35628 - DNA, 18 bp, Artificial Sequence
  Synthetic DNA
aaacacgtctctgtaaag

SEQ ID NO: 35629 - DNA, 18 bp, Artificial Sequence
  Synthetic DNA
aaacactactaactaaag

SEQ ID NO: 35630 - DNA, 18 bp, Artificial Sequence
  Synthetic DNA
aaacactactcagtatcg

SEQ ID NO: 35631 - DNA, 18 bp, Artificial Sequence
  Synthetic DNA
aaacactgctcacttatg

SEQ ID NO: 35632 - DNA, 18 bp, Artificial Sequence
  Synthetic DNA
aaacaggtaatgataacg

SEQ ID NO: 35633 - DNA, 18 bp, Artificial Sequence
  Synthetic DNA
aaacccgacttacaatag

SEQ ID NO: 35634 - DNA, 18 bp, Artificial Sequence
  Synthetic DNA
aaactcgactctctgcag

SEQ ID NO: 35635 - DNA, 18 bp, Artificial Sequence
  Synthetic DNA
aaactcgactgactacag

SEQ ID NO: 35636 - DNA, 18 bp, Artificial Sequence
  Synthetic DNA
aaactcttatcacattag

SEQ ID NO: 35637 - DNA, 18 bp, Artificial Sequence
  Synthetic DNA
aaagaagactcaatttag

SEQ ID NO: 35638 - DNA, 18 bp, Artificial Sequence
  Synthetic DNA
aaagaattctgacaattg

SEQ ID NO: 35639 - DNA, 18 bp, Artificial Sequence
  Synthetic DNA
aaagacaacacactattg

SEQ ID NO: 35640 - DNA, 18 bp, Artificial Sequence
  Synthetic DNA
aaagacaaggttctatag

SEQ ID NO: 35641 - DNA, 18 bp, Artificial Sequence
  Synthetic DNA
aaagacgttacgctcttg

SEQ ID NO: 35642 - DNA, 18 bp, Artificial Sequence
  Synthetic DNA
aaagaggatacaatatag

SEQ ID NO: 35643 - DNA, 18 bp, Artificial Sequence
  Synthetic DNA
aaagatgtttcactattg

SEQ ID NO: 35644 - DNA, 18 bp, Artificial Sequence
  Synthetic DNA
aaataagaacaactctag

SEQ ID NO: 35645 - DNA, 18 bp, Artificial Sequence
  Synthetic DNA
aaataagacattttagag

SEQ ID NO: 35646 - DNA, 18 bp, Artificial Sequence
  Synthetic DNA
aaataagactttgtattg

SEQ ID NO: 35647 - DNA, 18 bp, Artificial Sequence
  Synthetic DNA
aaataagattctctgttg

SEQ ID NO: 35648 - DNA, 18 bp, Artificial Sequence
  Synthetic DNA
aaataagcctttctccag

SEQ ID NO: 35649 - DNA, 18 bp, Artificial Sequence
  Synthetic DNA
aaataagtatggcattag

SEQ ID NO: 35650 - DNA, 18 bp, Artificial Sequence
  Synthetic DNA
aaataagtctcagtatgg

SEQ ID NO: 35651 - DNA, 18 bp, Artificial Sequence
  Synthetic DNA
aaataatactcaccgccg

SEQ ID NO: 35652 - DNA, 18 bp, Artificial Sequence
  Synthetic DNA
aaataattctcaatatag

SEQ ID NO: 35653 - DNA, 18 bp, Artificial Sequence
  Synthetic DNA
aaatacaacatgctaatg

SEQ ID NO: 35654 - DNA, 18 bp, Artificial Sequence
  Synthetic DNA
aaatacaactcatttttg

SEQ ID NO: 35655 - DNA, 18 bp, Artificial Sequence
  Synthetic DNA
aaatacaattaaaattag

SEQ ID NO: 35656 - DNA, 18 bp, Artificial Sequence
  Synthetic DNA
aaatacaattcacttttg

SEQ ID NO: 35657 - DNA, 18 bp, Artificial Sequence
  Synthetic DNA
aaatacacctcgctttag

SEQ ID NO: 35658 - DNA, 18 bp, Artificial Sequence
  Synthetic DNA
aaatacacctctcttcag

SEQ ID NO: 35659 - DNA, 18 bp, Artificial Sequence
  Synthetic DNA
aaatacatcgctctattg

SEQ ID NO: 35660 - DNA, 18 bp, Artificial Sequence
  Synthetic DNA
aaatacatgtctcaaaag

SEQ ID NO: 35661 - DNA, 18 bp, Artificial Sequence
  Synthetic DNA
aaataccacactcaatag

SEQ ID NO: 35662 - DNA, 18 bp, Artificial Sequence
  Synthetic DNA
aaataccactcatatctg

SEQ ID NO: 35663 - DNA, 18 bp, Artificial Sequence
  Synthetic DNA
aaataccattcacactag

SEQ ID NO: 35664 - DNA, 18 bp, Artificial Sequence
  Synthetic DNA
aaataccgctcactactg

SEQ ID NO: 35665 - DNA, 18 bp, Artificial Sequence
  Synthetic DNA
aaatacgaaaaataacag

SEQ ID NO: 35666 - DNA, 18 bp, Artificial Sequence
  Synthetic DNA
aaatacgaactacaatag

SEQ ID NO: 35667 - DNA, 18 bp, Artificial Sequence
  Synthetic DNA
aaatacgaccgccaatag

SEQ ID NO: 35668 - DNA, 18 bp, Artificial Sequence
  Synthetic DNA
aaatacgacgccttcttg

SEQ ID NO: 35669 - DNA, 18 bp, Artificial Sequence
  Synthetic DNA
aaatacgactaaatttcg

SEQ ID NO: 35670 - DNA, 18 bp, Artificial Sequence
  Synthetic DNA
aaatacgactcagctttg

SEQ ID NO: 35671 - DNA, 18 bp, Artificial Sequence
  Synthetic DNA
aaatacgactctaaattg

SEQ ID NO: 35672 - DNA, 18 bp, Artificial Sequence
  Synthetic DNA
aaatacgactctttacgg

SEQ ID NO: 35673 - DNA, 18 bp, Artificial Sequence
  Synthetic DNA
aaatacgactttttaaag

SEQ ID NO: 35674 - DNA, 18 bp, Artificial Sequence
  Synthetic DNA
aaatacgagggactttag

SEQ ID NO: 35675 - DNA, 18 bp, Artificial Sequence
  Synthetic DNA
aaatacgatatactaaag

SEQ ID NO: 35676 - DNA, 18 bp, Artificial Sequence
  Synthetic DNA
aaatacgattctcgtccg

SEQ ID NO: 35677 - DNA, 18 bp, Artificial Sequence
  Synthetic DNA
aaatacgccccaatttag

SEQ ID NO: 35678 - DNA, 18 bp, Artificial Sequence
  Synthetic DNA
aaatacgcctcaacaaag

SEQ ID NO: 35679 - DNA, 18 bp, Artificial Sequence
  Synthetic DNA
aaatacggctgaacatgg

SEQ ID NO: 35680 - DNA, 18 bp, Artificial Sequence
  Synthetic DNA
aaatacgggttacaatag

SEQ ID NO: 35681 - DNA, 18 bp, Artificial Sequence
  Synthetic DNA
aaatacgtcaatcgttag

SEQ ID NO: 35682 - DNA, 18 bp, Artificial Sequence
  Synthetic DNA
aaatacgtcactctaatg

SEQ ID NO: 35683 - DNA, 18 bp, Artificial Sequence
  Synthetic DNA
aaatacgtctaaatctag

SEQ ID NO: 35684 - DNA, 18 bp, Artificial Sequence
  Synthetic DNA
aaatacgtctcacatcag

SEQ ID NO: 35685 - DNA, 18 bp, Artificial Sequence
  Synthetic DNA
aaatacgtcttatttttg

SEQ ID NO: 35686 - DNA, 18 bp, Artificial Sequence
  Synthetic DNA
aaatacgtgtcgcaaaag

SEQ ID NO: 35687 - DNA, 18 bp, Artificial Sequence
  Synthetic DNA
aaatacgttgccctatag

SEQ ID NO: 35688 - DNA, 18 bp, Artificial Sequence
  Synthetic DNA
aaatacgtttcacattgg

SEQ ID NO: 35689 - DNA, 18 bp, Artificial Sequence
  Synthetic DNA
aaatactacacaatagag

SEQ ID NO: 35690 - DNA, 18 bp, Artificial Sequence
  Synthetic DNA
aaatactacactatactg

SEQ ID NO: 35691 - DNA, 18 bp, Artificial Sequence
  Synthetic DNA
aaatactagtccacctag

SEQ ID NO: 35692 - DNA, 18 bp, Artificial Sequence
  Synthetic DNA
aaatactgcacagtgtag

SEQ ID NO: 35693 - DNA, 18 bp, Artificial Sequence
  Synthetic DNA
aaatactgctaacatttg

SEQ ID NO: 35694 - DNA, 18 bp, Artificial Sequence
  Synthetic DNA
aaatacttctcactactg

SEQ ID NO: 35695 - DNA, 18 bp, Artificial Sequence
  Synthetic DNA
aaatagatcccaccatgg

SEQ ID NO: 35696 - DNA, 18 bp, Artificial Sequence
  Synthetic DNA
aaatagcactctatatag

SEQ ID NO: 35697 - DNA, 18 bp, Artificial Sequence
  Synthetic DNA
aaataggacacaatattg

SEQ ID NO: 35698 - DNA, 18 bp, Artificial Sequence
  Synthetic DNA
aaataggacgtactatgg

SEQ ID NO: 35699 - DNA, 18 bp, Artificial Sequence
  Synthetic DNA
aaataggactcaaaaaag

SEQ ID NO: 35700 - DNA, 18 bp, Artificial Sequence
  Synthetic DNA
aaataggactcagcattg

SEQ ID NO: 35701 - DNA, 18 bp, Artificial Sequence
  Synthetic DNA
aaataggactcgttgaag

SEQ ID NO: 35702 - DNA, 18 bp, Artificial Sequence
  Synthetic DNA
aaataggcctaacaatag

SEQ ID NO: 35703 - DNA, 18 bp, Artificial Sequence
  Synthetic DNA
aaataggcgtcactattg

SEQ ID NO: 35704 - DNA, 18 bp, Artificial Sequence
  Synthetic DNA
aaatagggtaccataaag

SEQ ID NO: 35705 - DNA, 18 bp, Artificial Sequence
  Synthetic DNA
aaataggtctaaaaatag

SEQ ID NO: 35706 - DNA, 18 bp, Artificial Sequence
  Synthetic DNA
aaatagtactgattgtag

SEQ ID NO: 35707 - DNA, 18 bp, Artificial Sequence
  Synthetic DNA
aaatagtattcactatcg

SEQ ID NO: 35708 - DNA, 18 bp, Artificial Sequence
  Synthetic DNA
aaatatatatcgcttaag

SEQ ID NO: 35709 - DNA, 18 bp, Artificial Sequence
  Synthetic DNA
aaatatatctcccaaatg

SEQ ID NO: 35710 - DNA, 18 bp, Artificial Sequence
  Synthetic DNA
aaatatcaatttctattg

SEQ ID NO: 35711 - DNA, 18 bp, Artificial Sequence
  Synthetic DNA
aaatatgactctctaacg

SEQ ID NO: 35712 - DNA, 18 bp, Artificial Sequence
  Synthetic DNA
aaatatgactgacttaag

SEQ ID NO: 35713 - DNA, 18 bp, Artificial Sequence
  Synthetic DNA
aaatatgatgaactttag

SEQ ID NO: 35714 - DNA, 18 bp, Artificial Sequence
  Synthetic DNA
aaatatgattcattattg

SEQ ID NO: 35715 - DNA, 18 bp, Artificial Sequence
  Synthetic DNA
aaatatgcttcactatcg

SEQ ID NO: 35716 - DNA, 18 bp, Artificial Sequence
  Synthetic DNA
aaatatggtacaccgtag

SEQ ID NO: 35717 - DNA, 18 bp, Artificial Sequence
  Synthetic DNA
aaatatgtcttactttcg

SEQ ID NO: 35718 - DNA, 18 bp, Artificial Sequence
  Synthetic DNA
aaatattacgtattctcg

SEQ ID NO: 35719 - DNA, 18 bp, Artificial Sequence
  Synthetic DNA
aaatattacttacaaatg

SEQ ID NO: 35720 - DNA, 18 bp, Artificial Sequence
  Synthetic DNA
aaatattcctcactacag

SEQ ID NO: 35721 - DNA, 18 bp, Artificial Sequence
  Synthetic DNA
aaatcatactcaatacag

SEQ ID NO: 35722 - DNA, 18 bp, Artificial Sequence
  Synthetic DNA
aaatccaaatatatattg

SEQ ID NO: 35723 - DNA, 18 bp, Artificial Sequence
  Synthetic DNA
aaatccgacttacttctg

SEQ ID NO: 35724 - DNA, 18 bp, Artificial Sequence
  Synthetic DNA
aaatccgacttcatatag

SEQ ID NO: 35725 - DNA, 18 bp, Artificial Sequence
  Synthetic DNA
aaatccgataatctattg

SEQ ID NO: 35726 - DNA, 18 bp, Artificial Sequence
  Synthetic DNA
aaatccgcctccctttag

SEQ ID NO: 35727 - DNA, 18 bp, Artificial Sequence
  Synthetic DNA
aaatccggcttttgaaag

SEQ ID NO: 35728 - DNA, 18 bp, Artificial Sequence
  Synthetic DNA
aaatcggactcatcatag

SEQ ID NO: 35729 - DNA, 18 bp, Artificial Sequence
  Synthetic DNA
aaatctgacacactaagg

SEQ ID NO: 35730 - DNA, 18 bp, Artificial Sequence
  Synthetic DNA
aaatctgactcatgaaag

SEQ ID NO: 35731 - DNA, 18 bp, Artificial Sequence
  Synthetic DNA
aaatctggctcagtaaag

SEQ ID NO: 35732 - DNA, 18 bp, Artificial Sequence
  Synthetic DNA
aaatgagcctaactgtag

SEQ ID NO: 35733 - DNA, 18 bp, Artificial Sequence
  Synthetic DNA
aaatgcgaaacagtattg

SEQ ID NO: 35734 - DNA, 18 bp, Artificial Sequence
  Synthetic DNA
aaatgcgactaactctgg

SEQ ID NO: 35735 - DNA, 18 bp, Artificial Sequence
  Synthetic DNA
aaatgcgattcacttcag

SEQ ID NO: 35736 - DNA, 18 bp, Artificial Sequence
  Synthetic DNA
aaatgcgtcacactatcg

SEQ ID NO: 35737 - DNA, 18 bp, Artificial Sequence
  Synthetic DNA
aaatgcgtctctcaatag

SEQ ID NO: 35738 - DNA, 18 bp, Artificial Sequence
  Synthetic DNA
aaatgcgtgtcactatat

SEQ ID NO: 35739 - DNA, 18 bp, Artificial Sequence
  Synthetic DNA
aaatgtcactcactttag

SEQ ID NO: 35740 - DNA, 18 bp, Artificial Sequence
  Synthetic DNA
aaatgtgattcccaatag

SEQ ID NO: 35741 - DNA, 18 bp, Artificial Sequence
  Synthetic DNA
aaatgttactcactgtag

SEQ ID NO: 35742 - DNA, 18 bp, Artificial Sequence
  Synthetic DNA
aaattagacacactattg

SEQ ID NO: 35743 - DNA, 18 bp, Artificial Sequence
  Synthetic DNA
aaattagactcggaacag

SEQ ID NO: 35744 - DNA, 18 bp, Artificial Sequence
  Synthetic DNA
aaattagactcgttaaag

SEQ ID NO: 35745 - DNA, 18 bp, Artificial Sequence
  Synthetic DNA
aaattatcattacttaag

SEQ ID NO: 35746 - DNA, 18 bp, Artificial Sequence
  Synthetic DNA
aaattcaaaacactagtg

SEQ ID NO: 35747 - DNA, 18 bp, Artificial Sequence
  Synthetic DNA
aaattcaacttactagag

SEQ ID NO: 35748 - DNA, 18 bp, Artificial Sequence
  Synthetic DNA
aaattcaattcactgaag

SEQ ID NO: 35749 - DNA, 18 bp, Artificial Sequence
  Synthetic DNA
aaattcagcccattatag

SEQ ID NO: 35750 - DNA, 18 bp, Artificial Sequence
  Synthetic DNA
aaattccacaccctattg

SEQ ID NO: 35751 - DNA, 18 bp, Artificial Sequence
  Synthetic DNA
aaattccactatctttag

SEQ ID NO: 35752 - DNA, 18 bp, Artificial Sequence
  Synthetic DNA
aaattccactctttctag

SEQ ID NO: 35753 - DNA, 18 bp, Artificial Sequence
  Synthetic DNA
aaattcgaatcaatatcg

SEQ ID NO: 35754 - DNA, 18 bp, Artificial Sequence
  Synthetic DNA
aaattcgaatcacaatcg

SEQ ID NO: 35755 - DNA, 18 bp, Artificial Sequence
  Synthetic DNA
aaattcgaatcataattg

SEQ ID NO: 35756 - DNA, 18 bp, Artificial Sequence
  Synthetic DNA
aaattcgactcaacctag

SEQ ID NO: 35757 - DNA, 18 bp, Artificial Sequence
  Synthetic DNA
aaattcgactcaatcttg

SEQ ID NO: 35758 - DNA, 18 bp, Artificial Sequence
  Synthetic DNA
aaattcgactccttccag

SEQ ID NO: 35759 - DNA, 18 bp, Artificial Sequence
  Synthetic DNA
aaattcgactcgcttcag

SEQ ID NO: 35760 - DNA, 18 bp, Artificial Sequence
  Synthetic DNA
aaattcgatacaaaatag

SEQ ID NO: 35761 - DNA, 18 bp, Artificial Sequence
  Synthetic DNA
aaattcgcttcacaattg

SEQ ID NO: 35762 - DNA, 18 bp, Artificial Sequence
  Synthetic DNA
aaattcggctaactacag

SEQ ID NO: 35763 - DNA, 18 bp, Artificial Sequence
  Synthetic DNA
aaattcggctcacaatgg

SEQ ID NO: 35764 - DNA, 18 bp, Artificial Sequence
  Synthetic DNA
aaattcgtcacattaaag

SEQ ID NO: 35765 - DNA, 18 bp, Artificial Sequence
  Synthetic DNA
aaattcgtcactatctag

SEQ ID NO: 35766 - DNA, 18 bp, Artificial Sequence
  Synthetic DNA
aaattcgtctcattaatg

SEQ ID NO: 35767 - DNA, 18 bp, Artificial Sequence
  Synthetic DNA
aaattcgtttcacttacg

SEQ ID NO: 35768 - DNA, 18 bp, Artificial Sequence
  Synthetic DNA
aaattctaatgactatag

SEQ ID NO: 35769 - DNA, 18 bp, Artificial Sequence
  Synthetic DNA
aaattcttctgactaacg

SEQ ID NO: 35770 - DNA, 18 bp, Artificial Sequence
  Synthetic DNA
aaattggactcacgaatg

SEQ ID NO: 35771 - DNA, 18 bp, Artificial Sequence
  Synthetic DNA
aaatttctctcattatag

SEQ ID NO: 35772 - DNA, 18 bp, Artificial Sequence
  Synthetic DNA
aaatttgactaaacacag

SEQ ID NO: 35773 - DNA, 18 bp, Artificial Sequence
  Synthetic DNA
aaatttgactgacaatag

SEQ ID NO: 35774 - DNA, 18 bp, Artificial Sequence
  Synthetic DNA
aaatttggcatactacag

SEQ ID NO: 35775 - DNA, 18 bp, Artificial Sequence
  Synthetic DNA
aaatttttatctctatag

SEQ ID NO: 35776 - DNA, 18 bp, Artificial Sequence
  Synthetic DNA
aacaaatactcaccgtcg

SEQ ID NO: 35777 - DNA, 18 bp, Artificial Sequence
  Synthetic DNA
aacaacaacacactacag

SEQ ID NO: 35778 - DNA, 18 bp, Artificial Sequence
  Synthetic DNA
aacaacgacccacaatag

SEQ ID NO: 35779 - DNA, 18 bp, Artificial Sequence
  Synthetic DNA
aacaacgagttagtctag

SEQ ID NO: 35780 - DNA, 18 bp, Artificial Sequence
  Synthetic DNA
aacaactaatcacattag

SEQ ID NO: 35781 - DNA, 18 bp, Artificial Sequence
  Synthetic DNA
aacaattacttactatag

SEQ ID NO: 35782 - DNA, 18 bp, Artificial Sequence
  Synthetic DNA
aacagcgactccctatag

SEQ ID NO: 35783 - DNA, 18 bp, Artificial Sequence
  Synthetic DNA
aactaagactcataatag

SEQ ID NO: 35784 - DNA, 18 bp, Artificial Sequence
  Synthetic DNA
aactacccttcactatag

SEQ ID NO: 35785 - DNA, 18 bp, Artificial Sequence
  Synthetic DNA
aactacgacacacaacaa

SEQ ID NO: 35786 - DNA, 18 bp, Artificial Sequence
  Synthetic DNA
aactacgactcacaactg

SEQ ID NO: 35787 - DNA, 18 bp, Artificial Sequence
  Synthetic DNA
aactacgactttttagag

SEQ ID NO: 35788 - DNA, 18 bp, Artificial Sequence
  Synthetic DNA
aactacgatgacgtattg

SEQ ID NO: 35789 - DNA, 18 bp, Artificial Sequence
  Synthetic DNA
aactacggctcacaagag

SEQ ID NO: 35790 - DNA, 18 bp, Artificial Sequence
  Synthetic DNA
aactacgtaacaatatag

SEQ ID NO: 35791 - DNA, 18 bp, Artificial Sequence
  Synthetic DNA
aactacgtcttactaaag

SEQ ID NO: 35792 - DNA, 18 bp, Artificial Sequence
  Synthetic DNA
aactaggactgaataaag

SEQ ID NO: 35793 - DNA, 18 bp, Artificial Sequence
  Synthetic DNA
aactccaactcacatttg

SEQ ID NO: 35794 - DNA, 18 bp, Artificial Sequence
  Synthetic DNA
aactccgacacactattg

SEQ ID NO: 35795 - DNA, 18 bp, Artificial Sequence
  Synthetic DNA
aacttagacaatccatag

SEQ ID NO: 35796 - DNA, 18 bp, Artificial Sequence
  Synthetic DNA
aacttagactcactaaag

SEQ ID NO: 35797 - DNA, 18 bp, Artificial Sequence
  Synthetic DNA
aacttcgagccagtttag

SEQ ID NO: 35798 - DNA, 18 bp, Artificial Sequence
  Synthetic DNA
aacttctactcactacag

SEQ ID NO: 35799 - DNA, 18 bp, Artificial Sequence
  Synthetic DNA
aagaaagaatctcaatag

SEQ ID NO: 35800 - DNA, 18 bp, Artificial Sequence
  Synthetic DNA
aagaacgacacacttgag

SEQ ID NO: 35801 - DNA, 18 bp, Artificial Sequence
  Synthetic DNA
aagaacgacacgctagag

SEQ ID NO: 35802 - DNA, 18 bp, Artificial Sequence
  Synthetic DNA
aagaacgactcacaatcg

SEQ ID NO: 35803 - DNA, 18 bp, Artificial Sequence
  Synthetic DNA
aagaacgagagagtatcg

SEQ ID NO: 35804 - DNA, 18 bp, Artificial Sequence
  Synthetic DNA
aagaacgtgtcactatag

SEQ ID NO: 35805 - DNA, 18 bp, Artificial Sequence
  Synthetic DNA
aagagcgacttagaatag

SEQ ID NO: 35806 - DNA, 18 bp, Artificial Sequence
  Synthetic DNA
aagcacaacttagttttg

SEQ ID NO: 35807 - DNA, 18 bp, Artificial Sequence
  Synthetic DNA
aagtaaaacgcgttaaag

SEQ ID NO: 35808 - DNA, 18 bp, Artificial Sequence
  Synthetic DNA
aagtacaactgtctatag

SEQ ID NO: 35809 - DNA, 18 bp, Artificial Sequence
  Synthetic DNA
aagtacggctcaaattag

SEQ ID NO: 35810 - DNA, 18 bp, Artificial Sequence
  Synthetic DNA
aagtacggctcgcttatg

SEQ ID NO: 35811 - DNA, 18 bp, Artificial Sequence
  Synthetic DNA
aagtactaatcaccaaag

SEQ ID NO: 35812 - DNA, 18 bp, Artificial Sequence
  Synthetic DNA
aagtactagtcacttacg

SEQ ID NO: 35813 - DNA, 18 bp, Artificial Sequence
  Synthetic DNA
aagtactgctcacgaaag

SEQ ID NO: 35814 - DNA, 18 bp, Artificial Sequence
  Synthetic DNA
aagtagatcttactatag

SEQ ID NO: 35815 - DNA, 18 bp, Artificial Sequence
  Synthetic DNA
aagtaggtctcacaatag

SEQ ID NO: 35816 - DNA, 18 bp, Artificial Sequence
  Synthetic DNA
aagtccgactcaattctg

SEQ ID NO: 35817 - DNA, 18 bp, Artificial Sequence
  Synthetic DNA
aagtccgtctcactagag

SEQ ID NO: 35818 - DNA, 18 bp, Artificial Sequence
  Synthetic DNA
aagtcctacaaattatag

SEQ ID NO: 35819 - DNA, 18 bp, Artificial Sequence
  Synthetic DNA
aagtctttctcattatag

SEQ ID NO: 35820 - DNA, 18 bp, Artificial Sequence
  Synthetic DNA
aagtgacacactctattg

SEQ ID NO: 35821 - DNA, 18 bp, Artificial Sequence
  Synthetic DNA
aagttcaactcactaatg

SEQ ID NO: 35822 - DNA, 18 bp, Artificial Sequence
  Synthetic DNA
aagttcgactctctttgg

SEQ ID NO: 35823 - DNA, 18 bp, Artificial Sequence
  Synthetic DNA
aagtttgactcgctatag

SEQ ID NO: 35824 - DNA, 18 bp, Artificial Sequence
  Synthetic DNA
aataaagccttacattag

SEQ ID NO: 35825 - DNA, 18 bp, Artificial Sequence
  Synthetic DNA
aataacaattcattatag

SEQ ID NO: 35826 - DNA, 18 bp, Artificial Sequence
  Synthetic DNA
aataaccaaccactatag

SEQ ID NO: 35827 - DNA, 18 bp, Artificial Sequence
  Synthetic DNA
aataacgactctctgttg

SEQ ID NO: 35828 - DNA, 18 bp, Artificial Sequence
  Synthetic DNA
aataacgactgacttaag

SEQ ID NO: 35829 - DNA, 18 bp, Artificial Sequence
  Synthetic DNA
aataacgagtcacttttg

SEQ ID NO: 35830 - DNA, 18 bp, Artificial Sequence
  Synthetic DNA
aataacgtccccttatcg

SEQ ID NO: 35831 - DNA, 18 bp, Artificial Sequence
  Synthetic DNA
aataacgtctcaataaag

SEQ ID NO: 35832 - DNA, 18 bp, Artificial Sequence
  Synthetic DNA
aataactacttactatag

SEQ ID NO: 35833 - DNA, 18 bp, Artificial Sequence
  Synthetic DNA
aataactcctcactaaag

SEQ ID NO: 35834 - DNA, 18 bp, Artificial Sequence
  Synthetic DNA
aataatgacttactatag

SEQ ID NO: 35835 - DNA, 18 bp, Artificial Sequence
  Synthetic DNA
aataccgccactctttcg

SEQ ID NO: 35836 - DNA, 18 bp, Artificial Sequence
  Synthetic DNA
aatagtgactcacatcag

SEQ ID NO: 35837 - DNA, 18 bp, Artificial Sequence
  Synthetic DNA
aatagtgactctccattg

SEQ ID NO: 35838 - DNA, 18 bp, Artificial Sequence
  Synthetic DNA
aatatatcatcactgaag

SEQ ID NO: 35839 - DNA, 18 bp, Artificial Sequence
  Synthetic DNA
aatatcgattaactatag

SEQ ID NO: 35840 - DNA, 18 bp, Artificial Sequence
  Synthetic DNA
aatatcgcctcacttaag

SEQ ID NO: 35841 - DNA, 18 bp, Artificial Sequence
  Synthetic DNA
aatattgactccctttag

SEQ ID NO: 35842 - DNA, 18 bp, Artificial Sequence
  Synthetic DNA
aatattgagtcctaaaag

SEQ ID NO: 35843 - DNA, 18 bp, Artificial Sequence
  Synthetic DNA
aatcaatactctctattg

SEQ ID NO: 35844 - DNA, 18 bp, Artificial Sequence
  Synthetic DNA
aatcacgacacacttaag

SEQ ID NO: 35845 - DNA, 18 bp, Artificial Sequence
  Synthetic DNA
aatcacgatccactaaag

SEQ ID NO: 35846 - DNA, 18 bp, Artificial Sequence
  Synthetic DNA
aatcacgtctcacaattg

SEQ ID NO: 35847 - DNA, 18 bp, Artificial Sequence
  Synthetic DNA
aatctcacataactattg

SEQ ID NO: 35848 - DNA, 18 bp, Artificial Sequence
  Synthetic DNA
aatgaggacttagaaaag

SEQ ID NO: 35849 - DNA, 18 bp, Artificial Sequence
  Synthetic DNA
aattaaaactctatatag

SEQ ID NO: 35850 - DNA, 18 bp, Artificial Sequence
  Synthetic DNA
aattaaagaccactatag

SEQ ID NO: 35851 - DNA, 18 bp, Artificial Sequence
  Synthetic DNA
aattaaatctcaccatag

SEQ ID NO: 35852 - DNA, 18 bp, Artificial Sequence
  Synthetic DNA
aattaacactctttatag

SEQ ID NO: 35853 - DNA, 18 bp, Artificial Sequence
  Synthetic DNA
aattaatactaactatag

SEQ ID NO: 35854 - DNA, 18 bp, Artificial Sequence
  Synthetic DNA
aattacaaagcaatttag

SEQ ID NO: 35855 - DNA, 18 bp, Artificial Sequence
  Synthetic DNA
aattacaacagactttag

SEQ ID NO: 35856 - DNA, 18 bp, Artificial Sequence
  Synthetic DNA
aattacctctcagtatag

SEQ ID NO: 35857 - DNA, 18 bp, Artificial Sequence
  Synthetic DNA
aattacgacacactgcag

SEQ ID NO: 35858 - DNA, 18 bp, Artificial Sequence
  Synthetic DNA
aattacgacccattaacg

SEQ ID NO: 35859 - DNA, 18 bp, Artificial Sequence
  Synthetic DNA
aattacgacccgtaatag

SEQ ID NO: 35860 - DNA, 18 bp, Artificial Sequence
  Synthetic DNA
aattacgactctctaccg

SEQ ID NO: 35861 - DNA, 18 bp, Artificial Sequence
  Synthetic DNA
aattacgactctttatcg

SEQ ID NO: 35862 - DNA, 18 bp, Artificial Sequence
  Synthetic DNA
aattacgactgacttgag

SEQ ID NO: 35863 - DNA, 18 bp, Artificial Sequence
  Synthetic DNA
aattacgagacactagag

SEQ ID NO: 35864 - DNA, 18 bp, Artificial Sequence
  Synthetic DNA
aattacgagtgtctaatg

SEQ ID NO: 35865 - DNA, 18 bp, Artificial Sequence
  Synthetic DNA
aattacgatacattagag

SEQ ID NO: 35866 - DNA, 18 bp, Artificial Sequence
  Synthetic DNA
aattacgatgcacaatag

SEQ ID NO: 35867 - DNA, 18 bp, Artificial Sequence
  Synthetic DNA
aattacgcctcacttttg

SEQ ID NO: 35868 - DNA, 18 bp, Artificial Sequence
  Synthetic DNA
aattacgccttagtatag

SEQ ID NO: 35869 - DNA, 18 bp, Artificial Sequence
  Synthetic DNA
aattacgtgacatttaag

SEQ ID NO: 35870 - DNA, 18 bp, Artificial Sequence
  Synthetic DNA
aattacgtgtccttacag

SEQ ID NO: 35871 - DNA, 18 bp, Artificial Sequence
  Synthetic DNA
aattacgtttctttatag

SEQ ID NO: 35872 - DNA, 18 bp, Artificial Sequence
  Synthetic DNA
aattactaaccattatag

SEQ ID NO: 35873 - DNA, 18 bp, Artificial Sequence
  Synthetic DNA
aattactacacacgatag

SEQ ID NO: 35874 - DNA, 18 bp, Artificial Sequence
  Synthetic DNA
aattactacacattatag

SEQ ID NO: 35875 - DNA, 18 bp, Artificial Sequence
  Synthetic DNA
aattactactcagtaacg

SEQ ID NO: 35876 - DNA, 18 bp, Artificial Sequence
  Synthetic DNA
aattactagttactttag

SEQ ID NO: 35877 - DNA, 18 bp, Artificial Sequence
  Synthetic DNA
aattaggtctctctaaag

SEQ ID NO: 35878 - DNA, 18 bp, Artificial Sequence
  Synthetic DNA
aattatctcttactatag

SEQ ID NO: 35879 - DNA, 18 bp, Artificial Sequence
  Synthetic DNA
aattatgtctccctatag

SEQ ID NO: 35880 - DNA, 18 bp, Artificial Sequence
  Synthetic DNA
aattctttattactatag

SEQ ID NO: 35881 - DNA, 18 bp, Artificial Sequence
  Synthetic DNA
aattgcaatcctcaattg

SEQ ID NO: 35882 - DNA, 18 bp, Artificial Sequence
  Synthetic DNA
aattgcgacactctattg

SEQ ID NO: 35883 - DNA, 18 bp, Artificial Sequence
  Synthetic DNA
aatttagactaactatag

SEQ ID NO: 35884 - DNA, 18 bp, Artificial Sequence
  Synthetic DNA
aatttagacttacacttg

SEQ ID NO: 35885 - DNA, 18 bp, Artificial Sequence
  Synthetic DNA
aatttagagacactattg

SEQ ID NO: 35886 - DNA, 18 bp, Artificial Sequence
  Synthetic DNA
aatttcaactcactatgg

SEQ ID NO: 35887 - DNA, 18 bp, Artificial Sequence
  Synthetic DNA
aatttcaactcccttttg

SEQ ID NO: 35888 - DNA, 18 bp, Artificial Sequence
  Synthetic DNA
aatttcctcactctatag

SEQ ID NO: 35889 - DNA, 18 bp, Artificial Sequence
  Synthetic DNA
aatttcgacaaactattg

SEQ ID NO: 35890 - DNA, 18 bp, Artificial Sequence
  Synthetic DNA
aatttcgactcaccaaag

SEQ ID NO: 35891 - DNA, 18 bp, Artificial Sequence
  Synthetic DNA
aatttcgactctcaattg

SEQ ID NO: 35892 - DNA, 18 bp, Artificial Sequence
  Synthetic DNA
aatttcgccacagtatag

SEQ ID NO: 35893 - DNA, 18 bp, Artificial Sequence
  Synthetic DNA
aatttctactatcaatag

SEQ ID NO: 35894 - DNA, 18 bp, Artificial Sequence
  Synthetic DNA
aatttctcctcacttttg

SEQ ID NO: 35895 - DNA, 18 bp, Artificial Sequence
  Synthetic DNA
aatttcttgtcacttaag

SEQ ID NO: 35896 - DNA, 18 bp, Artificial Sequence
  Synthetic DNA
acaaaaaagtcacaatag

SEQ ID NO: 35897 - DNA, 18 bp, Artificial Sequence
  Synthetic DNA
acaaaattcacactttag

SEQ ID NO: 35898 - DNA, 18 bp, Artificial Sequence
  Synthetic DNA
acaaacgacatcctatag

SEQ ID NO: 35899 - DNA, 18 bp, Artificial Sequence
  Synthetic DNA
acaaacgactaactaagg

SEQ ID NO: 35900 - DNA, 18 bp, Artificial Sequence
  Synthetic DNA
acaaacgactcaataaag

SEQ ID NO: 35901 - DNA, 18 bp, Artificial Sequence
  Synthetic DNA
acaagcaactcaatatag

SEQ ID NO: 35902 - DNA, 18 bp, Artificial Sequence
  Synthetic DNA
acaatccactctcattag

SEQ ID NO: 35903 - DNA, 18 bp, Artificial Sequence
  Synthetic DNA
acaatcgtcttactatag

SEQ ID NO: 35904 - DNA, 18 bp, Artificial Sequence
  Synthetic DNA
acacacaactaactaaag

SEQ ID NO: 35905 - DNA, 18 bp, Artificial Sequence
  Synthetic DNA
acacacggctcactaaag

SEQ ID NO: 35906 - DNA, 18 bp, Artificial Sequence
  Synthetic DNA
acaggcgacactctatgg

SEQ ID NO: 35907 - DNA, 18 bp, Artificial Sequence
  Synthetic DNA
acatacaacgcactttag

SEQ ID NO: 35908 - DNA, 18 bp, Artificial Sequence
  Synthetic DNA
acatacaacttgctgtag

SEQ ID NO: 35909 - DNA, 18 bp, Artificial Sequence
  Synthetic DNA
acataccaatcactccag

SEQ ID NO: 35910 - DNA, 18 bp, Artificial Sequence
  Synthetic DNA
acataccactaacaatag

SEQ ID NO: 35911 - DNA, 18 bp, Artificial Sequence
  Synthetic DNA
acatacgacactgtattg

SEQ ID NO: 35912 - DNA, 18 bp, Artificial Sequence
  Synthetic DNA
acatacgacccagattag

SEQ ID NO: 35913 - DNA, 18 bp, Artificial Sequence
  Synthetic DNA
acatacgactcaccgaag

SEQ ID NO: 35914 - DNA, 18 bp, Artificial Sequence
  Synthetic DNA
acatacgcctctctttag

SEQ ID NO: 35915 - DNA, 18 bp, Artificial Sequence
  Synthetic DNA
acatacgtctccctatcg

SEQ ID NO: 35916 - DNA, 18 bp, Artificial Sequence
  Synthetic DNA
acataggattcaccatag

SEQ ID NO: 35917 - DNA, 18 bp, Artificial Sequence
  Synthetic DNA
acatccgacacactatcg

SEQ ID NO: 35918 - DNA, 18 bp, Artificial Sequence
  Synthetic DNA
acatccgtatcactatcg

SEQ ID NO: 35919 - DNA, 18 bp, Artificial Sequence
  Synthetic DNA
acatgcgagtcaccatag

SEQ ID NO: 35920 - DNA, 18 bp, Artificial Sequence
  Synthetic DNA
acatgcgtctaacaaatg

SEQ ID NO: 35921 - DNA, 18 bp, Artificial Sequence
  Synthetic DNA
acatgcgtctgacttaag

SEQ ID NO: 35922 - DNA, 18 bp, Artificial Sequence
  Synthetic DNA
acatgtcacccactatag

SEQ ID NO: 35923 - DNA, 18 bp, Artificial Sequence
  Synthetic DNA
acattcaacagactttag

SEQ ID NO: 35924 - DNA, 18 bp, Artificial Sequence
  Synthetic DNA
acattcgattcactgtag

SEQ ID NO: 35925 - DNA, 18 bp, Artificial Sequence
  Synthetic DNA
acctactacccataaaag

SEQ ID NO: 35926 - DNA, 18 bp, Artificial Sequence
  Synthetic DNA
acgaacgaatcactatcg

SEQ ID NO: 35927 - DNA, 18 bp, Artificial Sequence
  Synthetic DNA
acgagagaaacgcaatag

SEQ ID NO: 35928 - DNA, 18 bp, Artificial Sequence
  Synthetic DNA
acgctccaaacaccttag

SEQ ID NO: 35929 - DNA, 18 bp, Artificial Sequence
  Synthetic DNA
actaaagaatcactatag

SEQ ID NO: 35930 - DNA, 18 bp, Artificial Sequence
  Synthetic DNA
actaccgtctgactcaag

SEQ ID NO: 35931 - DNA, 18 bp, Artificial Sequence
  Synthetic DNA
acttaaaacacactatag

SEQ ID NO: 35932 - DNA, 18 bp, Artificial Sequence
  Synthetic DNA
acttaagactttctatag

SEQ ID NO: 35933 - DNA, 18 bp, Artificial Sequence
  Synthetic DNA
acttacgaaccactccag

SEQ ID NO: 35934 - DNA, 18 bp, Artificial Sequence
  Synthetic DNA
acttacgtctaacattag

SEQ ID NO: 35935 - DNA, 18 bp, Artificial Sequence
  Synthetic DNA
acttgggactctctttag

SEQ ID NO: 35936 - DNA, 18 bp, Artificial Sequence
  Synthetic DNA
actttccacgctccatag

SEQ ID NO: 35937 - DNA, 18 bp, Artificial Sequence
  Synthetic DNA
actttggcctcacactag

SEQ ID NO: 35938 - DNA, 18 bp, Artificial Sequence
  Synthetic DNA
agaactaacttacttaag

SEQ ID NO: 35939 - DNA, 18 bp, Artificial Sequence
  Synthetic DNA
agacacgattctctatag

SEQ ID NO: 35940 - DNA, 18 bp, Artificial Sequence
  Synthetic DNA
agagtctattctctatag

SEQ ID NO: 35941 - DNA, 18 bp, Artificial Sequence
  Synthetic DNA
agataaaaatctctaaag

SEQ ID NO: 35942 - DNA, 18 bp, Artificial Sequence
  Synthetic DNA
agataagactggcaatag

SEQ ID NO: 35943 - DNA, 18 bp, Artificial Sequence
  Synthetic DNA
agataccactgactacag

SEQ ID NO: 35944 - DNA, 18 bp, Artificial Sequence
  Synthetic DNA
agatacgactcaatactg

SEQ ID NO: 35945 - DNA, 18 bp, Artificial Sequence
  Synthetic DNA
agatacgactccctccag

SEQ ID NO: 35946 - DNA, 18 bp, Artificial Sequence
  Synthetic DNA
agatacgactgaccattg

SEQ ID NO: 35947 - DNA, 18 bp, Artificial Sequence
  Synthetic DNA
agatacgattccctttag

SEQ ID NO: 35948 - DNA, 18 bp, Artificial Sequence
  Synthetic DNA
agatacgtatcactttag

SEQ ID NO: 35949 - DNA, 18 bp, Artificial Sequence
  Synthetic DNA
agatactactcacactag

SEQ ID NO: 35950 - DNA, 18 bp, Artificial Sequence
  Synthetic DNA
agataggacttttagtag

SEQ ID NO: 35951 - DNA, 18 bp, Artificial Sequence
  Synthetic DNA
agatataactcactctag

SEQ ID NO: 35952 - DNA, 18 bp, Artificial Sequence
  Synthetic DNA
agatccgacccacttaag

SEQ ID NO: 35953 - DNA, 18 bp, Artificial Sequence
  Synthetic DNA
agattaggctccttatag

SEQ ID NO: 35954 - DNA, 18 bp, Artificial Sequence
  Synthetic DNA
agattcgcttgacaatag

SEQ ID NO: 35955 - DNA, 18 bp, Artificial Sequence
  Synthetic DNA
agcctcttctcactttag

SEQ ID NO: 35956 - DNA, 18 bp, Artificial Sequence
  Synthetic DNA
agctacgattcaatatag

SEQ ID NO: 35957 - DNA, 18 bp, Artificial Sequence
  Synthetic DNA
aggaacgattcactatag

SEQ ID NO: 35958 - DNA, 18 bp, Artificial Sequence
  Synthetic DNA
aggaactactcgctaatg

SEQ ID NO: 35959 - DNA, 18 bp, Artificial Sequence
  Synthetic DNA
aggcagaattcactattg

SEQ ID NO: 35960 - DNA, 18 bp, Artificial Sequence
  Synthetic DNA
aggcaggactcacaacag

SEQ ID NO: 35961 - DNA, 18 bp, Artificial Sequence
  Synthetic DNA
aggtacgtctatcaatag

SEQ ID NO: 35962 - DNA, 18 bp, Artificial Sequence
  Synthetic DNA
aggtatgagacggtatcg

SEQ ID NO: 35963 - DNA, 18 bp, Artificial Sequence
  Synthetic DNA
agttacagcacactatag

SEQ ID NO: 35964 - DNA, 18 bp, Artificial Sequence
  Synthetic DNA
agttacagctcactaaag

SEQ ID NO: 35965 - DNA, 18 bp, Artificial Sequence
  Synthetic DNA
agttacgtctcaatttag

SEQ ID NO: 35966 - DNA, 18 bp, Artificial Sequence
  Synthetic DNA
agttgcgactaactatag

SEQ ID NO: 35967 - DNA, 18 bp, Artificial Sequence
  Synthetic DNA
agttgcgactctctgagg

SEQ ID NO: 35968 - DNA, 18 bp, Artificial Sequence
  Synthetic DNA
ataaacaaacctctcaag

SEQ ID NO: 35969 - DNA, 18 bp, Artificial Sequence
  Synthetic DNA
ataaacaactctcaaaag

SEQ ID NO: 35970 - DNA, 18 bp, Artificial Sequence
  Synthetic DNA
ataaacaagagactattg

SEQ ID NO: 35971 - DNA, 18 bp, Artificial Sequence
  Synthetic DNA
ataaacgaatctctatcg

SEQ ID NO: 35972 - DNA, 18 bp, Artificial Sequence
  Synthetic DNA
ataaacgaatgaataaag

SEQ ID NO: 35973 - DNA, 18 bp, Artificial Sequence
  Synthetic DNA
ataaacgactttcaactg

SEQ ID NO: 35974 - DNA, 18 bp, Artificial Sequence
  Synthetic DNA
ataaacgagtcattaaag

SEQ ID NO: 35975 - DNA, 18 bp, Artificial Sequence
  Synthetic DNA
ataaacgcctgactatag

SEQ ID NO: 35976 - DNA, 18 bp, Artificial Sequence
  Synthetic DNA
ataaacgctttgttagag

SEQ ID NO: 35977 - DNA, 18 bp, Artificial Sequence
  Synthetic DNA
ataaacgtatatcataag

SEQ ID NO: 35978 - DNA, 18 bp, Artificial Sequence
  Synthetic DNA
ataactgactcactatcg

SEQ ID NO: 35979 - DNA, 18 bp, Artificial Sequence
  Synthetic DNA
ataagcaacttagcctag

SEQ ID NO: 35980 - DNA, 18 bp, Artificial Sequence
  Synthetic DNA
ataatcgactcactttgg

SEQ ID NO: 35981 - DNA, 18 bp, Artificial Sequence
  Synthetic DNA
ataatggactctctatag

SEQ ID NO: 35982 - DNA, 18 bp, Artificial Sequence
  Synthetic DNA
atacaacgctcacaattg

SEQ ID NO: 35983 - DNA, 18 bp, Artificial Sequence
  Synthetic DNA
atacaagtctctctagcg

SEQ ID NO: 35984 - DNA, 18 bp, Artificial Sequence
  Synthetic DNA
atacacatctctctatag

SEQ ID NO: 35985 - DNA, 18 bp, Artificial Sequence
  Synthetic DNA
atacacgactcacaaacg

SEQ ID NO: 35986 - DNA, 18 bp, Artificial Sequence
  Synthetic DNA
atacactactctttaaag

SEQ ID NO: 35987 - DNA, 18 bp, Artificial Sequence
  Synthetic DNA
atacatgactcgctattg

SEQ ID NO: 35988 - DNA, 18 bp, Artificial Sequence
  Synthetic DNA
atacatgatacaccacag

SEQ ID NO: 35989 - DNA, 18 bp, Artificial Sequence
  Synthetic DNA
atacccaactctcttaag

SEQ ID NO: 35990 - DNA, 18 bp, Artificial Sequence
  Synthetic DNA
atacccgtatcactatag

SEQ ID NO: 35991 - DNA, 18 bp, Artificial Sequence
  Synthetic DNA
atagaagacccactattg

SEQ ID NO: 35992 - DNA, 18 bp, Artificial Sequence
  Synthetic DNA
atagtcggctctctatag

SEQ ID NO: 35993 - DNA, 18 bp, Artificial Sequence
  Synthetic DNA
atagtcgtcttaataaag

SEQ ID NO: 35994 - DNA, 18 bp, Artificial Sequence
  Synthetic DNA
atataaaactcaatatag

SEQ ID NO: 35995 - DNA, 18 bp, Artificial Sequence
  Synthetic DNA
atataacacttactctag

SEQ ID NO: 35996 - DNA, 18 bp, Artificial Sequence
  Synthetic DNA
atataagacacactacgg

SEQ ID NO: 35997 - DNA, 18 bp, Artificial Sequence
  Synthetic DNA
atataagactcatccttg

SEQ ID NO: 35998 - DNA, 18 bp, Artificial Sequence
  Synthetic DNA
atataagactcattatta

SEQ ID NO: 35999 - DNA, 18 bp, Artificial Sequence
  Synthetic DNA
atataagactctctaagg

SEQ ID NO: 36000 - DNA, 18 bp, Artificial Sequence
  Synthetic DNA
atataatagtcactatcg

SEQ ID NO: 36001 - DNA, 18 bp, Artificial Sequence
  Synthetic DNA
atatacaaaacagtatag

SEQ ID NO: 36002 - DNA, 18 bp, Artificial Sequence
  Synthetic DNA
atatacaacacaatttag

SEQ ID NO: 36003 - DNA, 18 bp, Artificial Sequence
  Synthetic DNA
atatacaacatactttag

SEQ ID NO: 36004 - DNA, 18 bp, Artificial Sequence
  Synthetic DNA
atatacacctcccttttg

SEQ ID NO: 36005 - DNA, 18 bp, Artificial Sequence
  Synthetic DNA
atatacacgtcacaatag

SEQ ID NO: 36006 - DNA, 18 bp, Artificial Sequence
  Synthetic DNA
atatacatcacagtaaag

SEQ ID NO: 36007 - DNA, 18 bp, Artificial Sequence
  Synthetic DNA
atataccaactactattg

SEQ ID NO: 36008 - DNA, 18 bp, Artificial Sequence
  Synthetic DNA
atataccaattaataacg

SEQ ID NO: 36009 - DNA, 18 bp, Artificial Sequence
  Synthetic DNA
atataccacatactaaag

SEQ ID NO: 36010 - DNA, 18 bp, Artificial Sequence
  Synthetic DNA
atataccactatctattg

SEQ ID NO: 36011 - DNA, 18 bp, Artificial Sequence
  Synthetic DNA
atatacgaaagtcaaaag

SEQ ID NO: 36012 - DNA, 18 bp, Artificial Sequence
  Synthetic DNA
atatacgacacacttccg

SEQ ID NO: 36013 - DNA, 18 bp, Artificial Sequence
  Synthetic DNA
atatacgacctaccattg

SEQ ID NO: 36014 - DNA, 18 bp, Artificial Sequence
  Synthetic DNA
atatacgactctcagaag

SEQ ID NO: 36015 - DNA, 18 bp, Artificial Sequence
  Synthetic DNA
atatacgacttattacag

SEQ ID NO: 36016 - DNA, 18 bp, Artificial Sequence
  Synthetic DNA
atatacgagacccaatag

SEQ ID NO: 36017 - DNA, 18 bp, Artificial Sequence
  Synthetic DNA
atatacgattcatctttg

SEQ ID NO: 36018 - DNA, 18 bp, Artificial Sequence
  Synthetic DNA
atatacgtctcatattcg

SEQ ID NO: 36019 - DNA, 18 bp, Artificial Sequence
  Synthetic DNA
atatactaccgaataaag

SEQ ID NO: 36020 - DNA, 18 bp, Artificial Sequence
  Synthetic DNA
atatactacgctctatag

SEQ ID NO: 36021 - DNA, 18 bp, Artificial Sequence
  Synthetic DNA
atatactattcaccatag

SEQ ID NO: 36022 - DNA, 18 bp, Artificial Sequence
  Synthetic DNA
atatactgcacactattg

SEQ ID NO: 36023 - DNA, 18 bp, Artificial Sequence
  Synthetic DNA
atatacttctcattaaag

SEQ ID NO: 36024 - DNA, 18 bp, Artificial Sequence
  Synthetic DNA
atataggactcactaatg

SEQ ID NO: 36025 - DNA, 18 bp, Artificial Sequence
  Synthetic DNA
atataggactctcaaaag

SEQ ID NO: 36026 - DNA, 18 bp, Artificial Sequence
  Synthetic DNA
atataggtctcaataaag

SEQ ID NO: 36027 - DNA, 18 bp, Artificial Sequence
  Synthetic DNA
atatagttttcactatag

SEQ ID NO: 36028 - DNA, 18 bp, Artificial Sequence
  Synthetic DNA
atatatgaatctaaatgg

SEQ ID NO: 36029 - DNA, 18 bp, Artificial Sequence
  Synthetic DNA
atatatgattcactaaag

SEQ ID NO: 36030 - DNA, 18 bp, Artificial Sequence
  Synthetic DNA
atatatgcctcactattg

SEQ ID NO: 36031 - DNA, 18 bp, Artificial Sequence
  Synthetic DNA
atatcaaactcactctag

SEQ ID NO: 36032 - DNA, 18 bp, Artificial Sequence
  Synthetic DNA
atatcagacacactatag

SEQ ID NO: 36033 - DNA, 18 bp, Artificial Sequence
  Synthetic DNA
atatcagactcactatcg

SEQ ID NO: 36034 - DNA, 18 bp, Artificial Sequence
  Synthetic DNA
atatccaacacaataatg

SEQ ID NO: 36035 - DNA, 18 bp, Artificial Sequence
  Synthetic DNA
atatccaacccattatag

SEQ ID NO: 36036 - DNA, 18 bp, Artificial Sequence
  Synthetic DNA
atatcctagtccctatag

SEQ ID NO: 36037 - DNA, 18 bp, Artificial Sequence
  Synthetic DNA
atatgccgatgattattg

SEQ ID NO: 36038 - DNA, 18 bp, Artificial Sequence
  Synthetic DNA
atatgccttttactaaag

SEQ ID NO: 36039 - DNA, 18 bp, Artificial Sequence
  Synthetic DNA
atatgcgaaccactctag

SEQ ID NO: 36040 - DNA, 18 bp, Artificial Sequence
  Synthetic DNA
atatgcgactcacaatcg

SEQ ID NO: 36041 - DNA, 18 bp, Artificial Sequence
  Synthetic DNA
atatgtgactcattttag

SEQ ID NO: 36042 - DNA, 18 bp, Artificial Sequence
  Synthetic DNA
atatgtgactctctatag

SEQ ID NO: 36043 - DNA, 18 bp, Artificial Sequence
  Synthetic DNA
atatgttacccataatag

SEQ ID NO: 36044 - DNA, 18 bp, Artificial Sequence
  Synthetic DNA
atattaaactcactatag

SEQ ID NO: 36045 - DNA, 18 bp, Artificial Sequence
  Synthetic DNA
atattagacggactaaag

SEQ ID NO: 36046 - DNA, 18 bp, Artificial Sequence
  Synthetic DNA
atattcatttcccaatag

SEQ ID NO: 36047 - DNA, 18 bp, Artificial Sequence
  Synthetic DNA
atattccactcaaaatag

SEQ ID NO: 36048 - DNA, 18 bp, Artificial Sequence
  Synthetic DNA
atattcctctcactaaag

SEQ ID NO: 36049 - DNA, 18 bp, Artificial Sequence
  Synthetic DNA
atattcgatacagtagag

SEQ ID NO: 36050 - DNA, 18 bp, Artificial Sequence
  Synthetic DNA
atattcgtttcgcttaag

SEQ ID NO: 36051 - DNA, 18 bp, Artificial Sequence
  Synthetic DNA
atattggtcacactatag

SEQ ID NO: 36052 - DNA, 18 bp, Artificial Sequence
  Synthetic DNA
atcgactacataatatag

SEQ ID NO: 36053 - DNA, 18 bp, Artificial Sequence
  Synthetic DNA
atctacgactcttttaag

SEQ ID NO: 36054 - DNA, 18 bp, Artificial Sequence
  Synthetic DNA
atctactacacacgattg

SEQ ID NO: 36055 - DNA, 18 bp, Artificial Sequence
  Synthetic DNA
atctaggattcacaaggg

SEQ ID NO: 36056 - DNA, 18 bp, Artificial Sequence
  Synthetic DNA
atctatggctcactgaag

SEQ ID NO: 36057 - DNA, 18 bp, Artificial Sequence
  Synthetic DNA
atcttggactgactatag

SEQ ID NO: 36058 - DNA, 18 bp, Artificial Sequence
  Synthetic DNA
atgaaagtttccctatag

SEQ ID NO: 36059 - DNA, 18 bp, Artificial Sequence
  Synthetic DNA
atgcacgattcactaaag

SEQ ID NO: 36060 - DNA, 18 bp, Artificial Sequence
  Synthetic DNA
atgtacaactcatatcag

SEQ ID NO: 36061 - DNA, 18 bp, Artificial Sequence
  Synthetic DNA
atgtacgtatcaccatgg

SEQ ID NO: 36062 - DNA, 18 bp, Artificial Sequence
  Synthetic DNA
atgtactattgattatag

SEQ ID NO: 36063 - DNA, 18 bp, Artificial Sequence
  Synthetic DNA
atgtgcgtctgactacag

SEQ ID NO: 36064 - DNA, 18 bp, Artificial Sequence
  Synthetic DNA
atgttagactcagtatag

SEQ ID NO: 36065 - DNA, 18 bp, Artificial Sequence
  Synthetic DNA
attaaccactcaatatag

SEQ ID NO: 36066 - DNA, 18 bp, Artificial Sequence
  Synthetic DNA
attaattacttactatag

SEQ ID NO: 36067 - DNA, 18 bp, Artificial Sequence
  Synthetic DNA
attcaagacttactcttg

SEQ ID NO: 36068 - DNA, 18 bp, Artificial Sequence
  Synthetic DNA
attcacgactcaatattg

SEQ ID NO: 36069 - DNA, 18 bp, Artificial Sequence
  Synthetic DNA
attggcgtttgttttttg

SEQ ID NO: 36070 - DNA, 18 bp, Artificial Sequence
  Synthetic DNA
atttacaactcacttcag

SEQ ID NO: 36071 - DNA, 18 bp, Artificial Sequence
  Synthetic DNA
atttacatctctctaaag

SEQ ID NO: 36072 - DNA, 18 bp, Artificial Sequence
  Synthetic DNA
atttaccacactctattg

SEQ ID NO: 36073 - DNA, 18 bp, Artificial Sequence
  Synthetic DNA
atttaccacgctctaaag

SEQ ID NO: 36074 - DNA, 18 bp, Artificial Sequence
  Synthetic DNA
atttacgactaaccaatg

SEQ ID NO: 36075 - DNA, 18 bp, Artificial Sequence
  Synthetic DNA
atttacgactaattattg

SEQ ID NO: 36076 - DNA, 18 bp, Artificial Sequence
  Synthetic DNA
atttacgactcactcaag

SEQ ID NO: 36077 - DNA, 18 bp, Artificial Sequence
  Synthetic DNA
atttacgagtcaaaactg

SEQ ID NO: 36078 - DNA, 18 bp, Artificial Sequence
  Synthetic DNA
atttacgagtcactaatg

SEQ ID NO: 36079 - DNA, 18 bp, Artificial Sequence
  Synthetic DNA
atttacgttaccctatag

SEQ ID NO: 36080 - DNA, 18 bp, Artificial Sequence
  Synthetic DNA
atttacttgtcactattg

SEQ ID NO: 36081 - DNA, 18 bp, Artificial Sequence
  Synthetic DNA
atttagttctcactatag

SEQ ID NO: 36082 - DNA, 18 bp, Artificial Sequence
  Synthetic DNA
atttatgactctctatag

SEQ ID NO: 36083 - DNA, 18 bp, Artificial Sequence
  Synthetic DNA
atttatgtctccctttag

SEQ ID NO: 36084 - DNA, 18 bp, Artificial Sequence
  Synthetic DNA
atttccgtctcaccatag

SEQ ID NO: 36085 - DNA, 18 bp, Artificial Sequence
  Synthetic DNA
atttccgttactctaaag

SEQ ID NO: 36086 - DNA, 18 bp, Artificial Sequence
  Synthetic DNA
atttcctactcactagag

SEQ ID NO: 36087 - DNA, 18 bp, Artificial Sequence
  Synthetic DNA
attttcgaaactctttag

SEQ ID NO: 36088 - DNA, 18 bp, Artificial Sequence
  Synthetic DNA
attttcgcctctctacag

SEQ ID NO: 36089 - DNA, 18 bp, Artificial Sequence
  Synthetic DNA
caaaaccatcctcaaaag

SEQ ID NO: 36090 - DNA, 18 bp, Artificial Sequence
  Synthetic DNA
caaaacgaacttcttcag

SEQ ID NO: 36091 - DNA, 18 bp, Artificial Sequence
  Synthetic DNA
caaaacgacatcctaaag

SEQ ID NO: 36092 - DNA, 18 bp, Artificial Sequence
  Synthetic DNA
caaaactaaattgtattg

SEQ ID NO: 36093 - DNA, 18 bp, Artificial Sequence
  Synthetic DNA
caaaactttccactatag

SEQ ID NO: 36094 - DNA, 18 bp, Artificial Sequence
  Synthetic DNA
caaaataatccactttag

SEQ ID NO: 36095 - DNA, 18 bp, Artificial Sequence
  Synthetic DNA
caaaatgactcactgttg

SEQ ID NO: 36096 - DNA, 18 bp, Artificial Sequence
  Synthetic DNA
caaaatgactccctaatg

SEQ ID NO: 36097 - DNA, 18 bp, Artificial Sequence
  Synthetic DNA
caaaatgcttcacaatag

SEQ ID NO: 36098 - DNA, 18 bp, Artificial Sequence
  Synthetic DNA
caaaatggctttatatag

SEQ ID NO: 36099 - DNA, 18 bp, Artificial Sequence
  Synthetic DNA
caaaattactcacattag

SEQ ID NO: 36100 - DNA, 18 bp, Artificial Sequence
  Synthetic DNA
caaaccgcctcaccaaag

SEQ ID NO: 36101 - DNA, 18 bp, Artificial Sequence
  Synthetic DNA
caaatcaacacacttatg

SEQ ID NO: 36102 - DNA, 18 bp, Artificial Sequence
  Synthetic DNA
caaatccactcactatgg

SEQ ID NO: 36103 - DNA, 18 bp, Artificial Sequence
  Synthetic DNA
caaatcgtccttattttg

SEQ ID NO: 36104 - DNA, 18 bp, Artificial Sequence
  Synthetic DNA
caacacaaataactccag

SEQ ID NO: 36105 - DNA, 18 bp, Artificial Sequence
  Synthetic DNA
caacacacctctctacag

SEQ ID NO: 36106 - DNA, 18 bp, Artificial Sequence
  Synthetic DNA
caacacgactcaaaattg

SEQ ID NO: 36107 - DNA, 18 bp, Artificial Sequence
  Synthetic DNA
caacacgattcacccttg

SEQ ID NO: 36108 - DNA, 18 bp, Artificial Sequence
  Synthetic DNA
caacactaatcactttag

SEQ ID NO: 36109 - DNA, 18 bp, Artificial Sequence
  Synthetic DNA
caagaacgctctctatag

SEQ ID NO: 36110 - DNA, 18 bp, Artificial Sequence
  Synthetic DNA
caagacaattcaatatag

SEQ ID NO: 36111 - DNA, 18 bp, Artificial Sequence
  Synthetic DNA
caagacgacttccattgg

SEQ ID NO: 36112 - DNA, 18 bp, Artificial Sequence
  Synthetic DNA
caagacgtctccatatag

SEQ ID NO: 36113 - DNA, 18 bp, Artificial Sequence
  Synthetic DNA
caataaaacacataatag

SEQ ID NO: 36114 - DNA, 18 bp, Artificial Sequence
  Synthetic DNA
caataaaattcactattg

SEQ ID NO: 36115 - DNA, 18 bp, Artificial Sequence
  Synthetic DNA
caataaacctcacaatcg

SEQ ID NO: 36116 - DNA, 18 bp, Artificial Sequence
  Synthetic DNA
caataaacttcacttgag

SEQ ID NO: 36117 - DNA, 18 bp, Artificial Sequence
  Synthetic DNA
caataagaccgtctttag

SEQ ID NO: 36118 - DNA, 18 bp, Artificial Sequence
  Synthetic DNA
caataagagactctatcg

SEQ ID NO: 36119 - DNA, 18 bp, Artificial Sequence
  Synthetic DNA
caataaggctcacttttg

SEQ ID NO: 36120 - DNA, 18 bp, Artificial Sequence
  Synthetic DNA
caataagtatctctcttg

SEQ ID NO: 36121 - DNA, 18 bp, Artificial Sequence
  Synthetic DNA
caataagtctcacaacag

SEQ ID NO: 36122 - DNA, 18 bp, Artificial Sequence
  Synthetic DNA
caataataccctcaatag

SEQ ID NO: 36123 - DNA, 18 bp, Artificial Sequence
  Synthetic DNA
caataatagtcacatgtg

SEQ ID NO: 36124 - DNA, 18 bp, Artificial Sequence
  Synthetic DNA
caataatattaactatag

SEQ ID NO: 36125 - DNA, 18 bp, Artificial Sequence
  Synthetic DNA
caatacaaatatcaaatg

SEQ ID NO: 36126 - DNA, 18 bp, Artificial Sequence
  Synthetic DNA
caatacaagtttctatag

SEQ ID NO: 36127 - DNA, 18 bp, Artificial Sequence
  Synthetic DNA
caatacaattcacactag

SEQ ID NO: 36128 - DNA, 18 bp, Artificial Sequence
  Synthetic DNA
caatacaattctttaaag

SEQ ID NO: 36129 - DNA, 18 bp, Artificial Sequence
  Synthetic DNA
caatacacctcacagtag

SEQ ID NO: 36130 - DNA, 18 bp, Artificial Sequence
  Synthetic DNA
caatacacgttaccatgg

SEQ ID NO: 36131 - DNA, 18 bp, Artificial Sequence
  Synthetic DNA
caatacagatcacaatag

SEQ ID NO: 36132 - DNA, 18 bp, Artificial Sequence
  Synthetic DNA
caataccacccacttccg

SEQ ID NO: 36133 - DNA, 18 bp, Artificial Sequence
  Synthetic DNA
caataccactagctatcg

SEQ ID NO: 36134 - DNA, 18 bp, Artificial Sequence
  Synthetic DNA
caatacgacatattagtg

SEQ ID NO: 36135 - DNA, 18 bp, Artificial Sequence
  Synthetic DNA
caatacgactcagctaaa

SEQ ID NO: 36136 - DNA, 18 bp, Artificial Sequence
  Synthetic DNA
caatacgactgtctaaaa

SEQ ID NO: 36137 - DNA, 18 bp, Artificial Sequence
  Synthetic DNA
caatacgacttcctcttg

SEQ ID NO: 36138 - DNA, 18 bp, Artificial Sequence
  Synthetic DNA
caatacgagcccatctag

SEQ ID NO: 36139 - DNA, 18 bp, Artificial Sequence
  Synthetic DNA
caatacgaggcgcaatag

SEQ ID NO: 36140 - DNA, 18 bp, Artificial Sequence
  Synthetic DNA
caatacgatacagtattg

SEQ ID NO: 36141 - DNA, 18 bp, Artificial Sequence
  Synthetic DNA
caatacgatccattattg

SEQ ID NO: 36142 - DNA, 18 bp, Artificial Sequence
  Synthetic DNA
caatacgcatcattacag

SEQ ID NO: 36143 - DNA, 18 bp, Artificial Sequence
  Synthetic DNA
caatacgcctctctaatg

SEQ ID NO: 36144 - DNA, 18 bp, Artificial Sequence
  Synthetic DNA
caatacgcctttatatag

SEQ ID NO: 36145 - DNA, 18 bp, Artificial Sequence
  Synthetic DNA
caatacggatctctaaag

SEQ ID NO: 36146 - DNA, 18 bp, Artificial Sequence
  Synthetic DNA
caatacgtatcaaaatag

SEQ ID NO: 36147 - DNA, 18 bp, Artificial Sequence
  Synthetic DNA
caatacgtctgattgcgg

SEQ ID NO: 36148 - DNA, 18 bp, Artificial Sequence
  Synthetic DNA
caatacgttacaatttgg

SEQ ID NO: 36149 - DNA, 18 bp, Artificial Sequence
  Synthetic DNA
caatacgtttccctgaag

SEQ ID NO: 36150 - DNA, 18 bp, Artificial Sequence
  Synthetic DNA
caatacgtttttttaaag

SEQ ID NO: 36151 - DNA, 18 bp, Artificial Sequence
  Synthetic DNA
caatactccacgcaaaag

SEQ ID NO: 36152 - DNA, 18 bp, Artificial Sequence
  Synthetic DNA
caataggaataacaccag

SEQ ID NO: 36153 - DNA, 18 bp, Artificial Sequence
  Synthetic DNA
caataggactcacttatg

SEQ ID NO: 36154 - DNA, 18 bp, Artificial Sequence
  Synthetic DNA
caataggattctatattg

SEQ ID NO: 36155 - DNA, 18 bp, Artificial Sequence
  Synthetic DNA
caatagggctaaatttag

SEQ ID NO: 36156 - DNA, 18 bp, Artificial Sequence
  Synthetic DNA
caataggtcgcactaaag

SEQ ID NO: 36157 - DNA, 18 bp, Artificial Sequence
  Synthetic DNA
caatagttatctctatag

SEQ ID NO: 36158 - DNA, 18 bp, Artificial Sequence
  Synthetic DNA
caatagttctctatacag

SEQ ID NO: 36159 - DNA, 18 bp, Artificial Sequence
  Synthetic DNA
caatatgacaaaatatag

SEQ ID NO: 36160 - DNA, 18 bp, Artificial Sequence
  Synthetic DNA
caatatgacacattttag

SEQ ID NO: 36161 - DNA, 18 bp, Artificial Sequence
  Synthetic DNA
caatatgacactctttag

SEQ ID NO: 36162 - DNA, 18 bp, Artificial Sequence
  Synthetic DNA
caatatgactcaaaatcg

SEQ ID NO: 36163 - DNA, 18 bp, Artificial Sequence
  Synthetic DNA
caatatgcaactctacag

SEQ ID NO: 36164 - DNA, 18 bp, Artificial Sequence
  Synthetic DNA
caatatggctccttaatg

SEQ ID NO: 36165 - DNA, 18 bp, Artificial Sequence
  Synthetic DNA
caatatgtctcgatagag

SEQ ID NO: 36166 - DNA, 18 bp, Artificial Sequence
  Synthetic DNA
caatatgttctactgatg

SEQ ID NO: 36167 - DNA, 18 bp, Artificial Sequence
  Synthetic DNA
caatattactcgcaatag

SEQ ID NO: 36168 - DNA, 18 bp, Artificial Sequence
  Synthetic DNA
caatcaaactatctatag

SEQ ID NO: 36169 - DNA, 18 bp, Artificial Sequence
  Synthetic DNA
caatcccccttatactag

SEQ ID NO: 36170 - DNA, 18 bp, Artificial Sequence
  Synthetic DNA
caatccgacgcacattag

SEQ ID NO: 36171 - DNA, 18 bp, Artificial Sequence
  Synthetic DNA
caatccgactctttttag

SEQ ID NO: 36172 - DNA, 18 bp, Artificial Sequence
  Synthetic DNA
caatccgtcttacaatag

SEQ ID NO: 36173 - DNA, 18 bp, Artificial Sequence
  Synthetic DNA
caatcctattcactcttg

SEQ ID NO: 36174 - DNA, 18 bp, Artificial Sequence
  Synthetic DNA
caatccttcacacgatag

SEQ ID NO: 36175 - DNA, 18 bp, Artificial Sequence
  Synthetic DNA
caatctcaccctctatag

SEQ ID NO: 36176 - DNA, 18 bp, Artificial Sequence
  Synthetic DNA
caatgatactccgtatag

SEQ ID NO: 36177 - DNA, 18 bp, Artificial Sequence
  Synthetic DNA
caatgggactcaatgtag

SEQ ID NO: 36178 - DNA, 18 bp, Artificial Sequence
  Synthetic DNA
caatgtaattcattatgg

SEQ ID NO: 36179 - DNA, 18 bp, Artificial Sequence
  Synthetic DNA
caatgtgcctcacttttg

SEQ ID NO: 36180 - DNA, 18 bp, Artificial Sequence
  Synthetic DNA
caattagactcacaaaag

SEQ ID NO: 36181 - DNA, 18 bp, Artificial Sequence
  Synthetic DNA
caattagactcagtttag

SEQ ID NO: 36182 - DNA, 18 bp, Artificial Sequence
  Synthetic DNA
caattcccctcagtatag

SEQ ID NO: 36183 - DNA, 18 bp, Artificial Sequence
  Synthetic DNA
caattcgaccaacaatag

SEQ ID NO: 36184 - DNA, 18 bp, Artificial Sequence
  Synthetic DNA
caattcgatccactaaag

SEQ ID NO: 36185 - DNA, 18 bp, Artificial Sequence
  Synthetic DNA
caattcgtatgaaaattg

SEQ ID NO: 36186 - DNA, 18 bp, Artificial Sequence
  Synthetic DNA
caatttaactcattacag

SEQ ID NO: 36187 - DNA, 18 bp, Artificial Sequence
  Synthetic DNA
caatttgactcaccacag

SEQ ID NO: 36188 - DNA, 18 bp, Artificial Sequence
  Synthetic DNA
caatttgactcattttgg

SEQ ID NO: 36189 - DNA, 18 bp, Artificial Sequence
  Synthetic DNA
cacaaagacacttttttg

SEQ ID NO: 36190 - DNA, 18 bp, Artificial Sequence
  Synthetic DNA
cacaaggacccattatag

SEQ ID NO: 36191 - DNA, 18 bp, Artificial Sequence
  Synthetic DNA
cactacaactcgtttaag

SEQ ID NO: 36192 - DNA, 18 bp, Artificial Sequence
  Synthetic DNA
cactacataactctatag

SEQ ID NO: 36193 - DNA, 18 bp, Artificial Sequence
  Synthetic DNA
cactacgaacctctttag

SEQ ID NO: 36194 - DNA, 18 bp, Artificial Sequence
  Synthetic DNA
cactatgattcaccatag

SEQ ID NO: 36195 - DNA, 18 bp, Artificial Sequence
  Synthetic DNA
cactgatactcactatag

SEQ ID NO: 36196 - DNA, 18 bp, Artificial Sequence
  Synthetic DNA
cacttcgtccgactcttg

SEQ ID NO: 36197 - DNA, 18 bp, Artificial Sequence
  Synthetic DNA
cagaaacaatcactatag

SEQ ID NO: 36198 - DNA, 18 bp, Artificial Sequence
  Synthetic DNA
cagagtaactctcaatag

SEQ ID NO: 36199 - DNA, 18 bp, Artificial Sequence
  Synthetic DNA
cagcacaacatactatag

SEQ ID NO: 36200 - DNA, 18 bp, Artificial Sequence
  Synthetic DNA
cagcacaacatagtgtag

SEQ ID NO: 36201 - DNA, 18 bp, Artificial Sequence
  Synthetic DNA
cagcacgtctcacagtag

SEQ ID NO: 36202 - DNA, 18 bp, Artificial Sequence
  Synthetic DNA
cagcatgaatttctatag

SEQ ID NO: 36203 - DNA, 18 bp, Artificial Sequence
  Synthetic DNA
cagcgggacacactatag

SEQ ID NO: 36204 - DNA, 18 bp, Artificial Sequence
  Synthetic DNA
cagctcgccaccttacag

SEQ ID NO: 36205 - DNA, 18 bp, Artificial Sequence
  Synthetic DNA
cagtaaagcacaataatg

SEQ ID NO: 36206 - DNA, 18 bp, Artificial Sequence
  Synthetic DNA
cagtacatttcgctatag

SEQ ID NO: 36207 - DNA, 18 bp, Artificial Sequence
  Synthetic DNA
cagtacctcacactgtag

SEQ ID NO: 36208 - DNA, 18 bp, Artificial Sequence
  Synthetic DNA
cagtacgtctgacaatgg

SEQ ID NO: 36209 - DNA, 18 bp, Artificial Sequence
  Synthetic DNA
cagtaggattctttatag

SEQ ID NO: 36210 - DNA, 18 bp, Artificial Sequence
  Synthetic DNA
cagtgcgagtcaatttag

SEQ ID NO: 36211 - DNA, 18 bp, Artificial Sequence
  Synthetic DNA
cagttcgacttaatatag

SEQ ID NO: 36212 - DNA, 18 bp, Artificial Sequence
  Synthetic DNA
cataaacacacgcgttag

SEQ ID NO: 36213 - DNA, 18 bp, Artificial Sequence
  Synthetic DNA
cataaggactaattatag

SEQ ID NO: 36214 - DNA, 18 bp, Artificial Sequence
  Synthetic DNA
catacagacttatattag

SEQ ID NO: 36215 - DNA, 18 bp, Artificial Sequence
  Synthetic DNA
catatcaacacactttag

SEQ ID NO: 36216 - DNA, 18 bp, Artificial Sequence
  Synthetic DNA
catcacgactctcaatag

SEQ ID NO: 36217 - DNA, 18 bp, Artificial Sequence
  Synthetic DNA
catgacaattcactatag

SEQ ID NO: 36218 - DNA, 18 bp, Artificial Sequence
  Synthetic DNA
cattaagaatcacactag

SEQ ID NO: 36219 - DNA, 18 bp, Artificial Sequence
  Synthetic DNA
cattaagactctctaaag

SEQ ID NO: 36220 - DNA, 18 bp, Artificial Sequence
  Synthetic DNA
cattaagcctcactagag

SEQ ID NO: 36221 - DNA, 18 bp, Artificial Sequence
  Synthetic DNA
cattaagtctttccacag

SEQ ID NO: 36222 - DNA, 18 bp, Artificial Sequence
  Synthetic DNA
cattaataccttctattg

SEQ ID NO: 36223 - DNA, 18 bp, Artificial Sequence
  Synthetic DNA
cattacaattcccggaag

SEQ ID NO: 36224 - DNA, 18 bp, Artificial Sequence
  Synthetic DNA
cattaccactatttattg

SEQ ID NO: 36225 - DNA, 18 bp, Artificial Sequence
  Synthetic DNA
cattacgactacctaaag

SEQ ID NO: 36226 - DNA, 18 bp, Artificial Sequence
  Synthetic DNA
cattacgacttgctttcg

SEQ ID NO: 36227 - DNA, 18 bp, Artificial Sequence
  Synthetic DNA
cattacgatactctacag

SEQ ID NO: 36228 - DNA, 18 bp, Artificial Sequence
  Synthetic DNA
cattacgatccactgtag

SEQ ID NO: 36229 - DNA, 18 bp, Artificial Sequence
  Synthetic DNA
cattacgcctctctttag

SEQ ID NO: 36230 - DNA, 18 bp, Artificial Sequence
  Synthetic DNA
cattacgtctaactgttg

SEQ ID NO: 36231 - DNA, 18 bp, Artificial Sequence
  Synthetic DNA
cattagttctcactaaag

SEQ ID NO: 36232 - DNA, 18 bp, Artificial Sequence
  Synthetic DNA
cattatgggcctctacag

SEQ ID NO: 36233 - DNA, 18 bp, Artificial Sequence
  Synthetic DNA
cattatgtctgactagtg

SEQ ID NO: 36234 - DNA, 18 bp, Artificial Sequence
  Synthetic DNA
cattccgagactctatag

SEQ ID NO: 36235 - DNA, 18 bp, Artificial Sequence
  Synthetic DNA
cattccgtctcacaatag

SEQ ID NO: 36236 - DNA, 18 bp, Artificial Sequence
  Synthetic DNA
cattctaactcattgttg

SEQ ID NO: 36237 - DNA, 18 bp, Artificial Sequence
  Synthetic DNA
cattgacgctcactatag

SEQ ID NO: 36238 - DNA, 18 bp, Artificial Sequence
  Synthetic DNA
catttcaactcacttcag

SEQ ID NO: 36239 - DNA, 18 bp, Artificial Sequence
  Synthetic DNA
catttcgacaaccttttg

SEQ ID NO: 36240 - DNA, 18 bp, Artificial Sequence
  Synthetic DNA
catttcgactatttctag

SEQ ID NO: 36241 - DNA, 18 bp, Artificial Sequence
  Synthetic DNA
catttcgactcgctatgg

SEQ ID NO: 36242 - DNA, 18 bp, Artificial Sequence
  Synthetic DNA
catttcgactttctcaag

SEQ ID NO: 36243 - DNA, 18 bp, Artificial Sequence
  Synthetic DNA
catttcgtatcacctatg

SEQ ID NO: 36244 - DNA, 18 bp, Artificial Sequence
  Synthetic DNA
catttcgtctcactttag

SEQ ID NO: 36245 - DNA, 18 bp, Artificial Sequence
  Synthetic DNA
ccaaacgattttcaattg

SEQ ID NO: 36246 - DNA, 18 bp, Artificial Sequence
  Synthetic DNA
ccaaacttctcactattg

SEQ ID NO: 36247 - DNA, 18 bp, Artificial Sequence
  Synthetic DNA
ccaaagaactctctttag

SEQ ID NO: 36248 - DNA, 18 bp, Artificial Sequence
  Synthetic DNA
ccaaccgactcactgctg

SEQ ID NO: 36249 - DNA, 18 bp, Artificial Sequence
  Synthetic DNA
ccataaggctcattatag

SEQ ID NO: 36250 - DNA, 18 bp, Artificial Sequence
  Synthetic DNA
ccataattctcaaattag

SEQ ID NO: 36251 - DNA, 18 bp, Artificial Sequence
  Synthetic DNA
ccatacgattcacaaaag

SEQ ID NO: 36252 - DNA, 18 bp, Artificial Sequence
  Synthetic DNA
ccatacgattcacttaag

SEQ ID NO: 36253 - DNA, 18 bp, Artificial Sequence
  Synthetic DNA
ccatacgattcataacag

SEQ ID NO: 36254 - DNA, 18 bp, Artificial Sequence
  Synthetic DNA
ccatactgcagtctctag

SEQ ID NO: 36255 - DNA, 18 bp, Artificial Sequence
  Synthetic DNA
ccataggactcacaacag

SEQ ID NO: 36256 - DNA, 18 bp, Artificial Sequence
  Synthetic DNA
ccataggagccaatatag

SEQ ID NO: 36257 - DNA, 18 bp, Artificial Sequence
  Synthetic DNA
ccatatgaatcacccgag

SEQ ID NO: 36258 - DNA, 18 bp, Artificial Sequence
  Synthetic DNA
ccatcctactcgatatcg

SEQ ID NO: 36259 - DNA, 18 bp, Artificial Sequence
  Synthetic DNA
ccatgcacaactctaatg

SEQ ID NO: 36260 - DNA, 18 bp, Artificial Sequence
  Synthetic DNA
ccatgccattaactattg

SEQ ID NO: 36261 - DNA, 18 bp, Artificial Sequence
  Synthetic DNA
ccatgcgacacactttag

SEQ ID NO: 36262 - DNA, 18 bp, Artificial Sequence
  Synthetic DNA
ccattagattcactatag

SEQ ID NO: 36263 - DNA, 18 bp, Artificial Sequence
  Synthetic DNA
ccattcaactcccaaaag

SEQ ID NO: 36264 - DNA, 18 bp, Artificial Sequence
  Synthetic DNA
ccattcgccgcactatag

SEQ ID NO: 36265 - DNA, 18 bp, Artificial Sequence
  Synthetic DNA
ccattggacatgcaatag

SEQ ID NO: 36266 - DNA, 18 bp, Artificial Sequence
  Synthetic DNA
ccctacgtcacacaatag

SEQ ID NO: 36267 - DNA, 18 bp, Artificial Sequence
  Synthetic DNA
cccttcgacacactatag

SEQ ID NO: 36268 - DNA, 18 bp, Artificial Sequence
  Synthetic DNA
ccgtaagtttcactatag

SEQ ID NO: 36269 - DNA, 18 bp, Artificial Sequence
  Synthetic DNA
ccgttctactccctaaag

SEQ ID NO: 36270 - DNA, 18 bp, Artificial Sequence
  Synthetic DNA
ccttaagacacaaaatag

SEQ ID NO: 36271 - DNA, 18 bp, Artificial Sequence
  Synthetic DNA
ccttacgattcactaaag

SEQ ID NO: 36272 - DNA, 18 bp, Artificial Sequence
  Synthetic DNA
cctttcgactcaaaatag

SEQ ID NO: 36273 - DNA, 18 bp, Artificial Sequence
  Synthetic DNA
cgaatggaatatacaaag

SEQ ID NO: 36274 - DNA, 18 bp, Artificial Sequence
  Synthetic DNA
cgacaccactgcctatag

SEQ ID NO: 36275 - DNA, 18 bp, Artificial Sequence
  Synthetic DNA
cgacactaatttccaaag

SEQ ID NO: 36276 - DNA, 18 bp, Artificial Sequence
  Synthetic DNA
cgataagcgttacaatag

SEQ ID NO: 36277 - DNA, 18 bp, Artificial Sequence
  Synthetic DNA
cgatacgacacaatttag

SEQ ID NO: 36278 - DNA, 18 bp, Artificial Sequence
  Synthetic DNA
cgatacgatccatataag

SEQ ID NO: 36279 - DNA, 18 bp, Artificial Sequence
  Synthetic DNA
cgatactagtcacaaaag

SEQ ID NO: 36280 - DNA, 18 bp, Artificial Sequence
  Synthetic DNA
cgatagaacttactatag

SEQ ID NO: 36281 - DNA, 18 bp, Artificial Sequence
  Synthetic DNA
cgatccaactcactcaag

SEQ ID NO: 36282 - DNA, 18 bp, Artificial Sequence
  Synthetic DNA
cgatgcgactcacttcag

SEQ ID NO: 36283 - DNA, 18 bp, Artificial Sequence
  Synthetic DNA
cgatgctagtcactatag

SEQ ID NO: 36284 - DNA, 18 bp, Artificial Sequence
  Synthetic DNA
cgattcacctcgttttag

SEQ ID NO: 36285 - DNA, 18 bp, Artificial Sequence
  Synthetic DNA
cggtacaacttactatag

SEQ ID NO: 36286 - DNA, 18 bp, Artificial Sequence
  Synthetic DNA
cgttacgactcattttag

SEQ ID NO: 36287 - DNA, 18 bp, Artificial Sequence
  Synthetic DNA
cgttgagtacctctttag

SEQ ID NO: 36288 - DNA, 18 bp, Artificial Sequence
  Synthetic DNA
ctaaacgacaaattttag

SEQ ID NO: 36289 - DNA, 18 bp, Artificial Sequence
  Synthetic DNA
ctaaaggactctctttag

SEQ ID NO: 36290 - DNA, 18 bp, Artificial Sequence
  Synthetic DNA
ctacacaactcagtatag

SEQ ID NO: 36291 - DNA, 18 bp, Artificial Sequence
  Synthetic DNA
ctacgagactgcaaatag

SEQ ID NO: 36292 - DNA, 18 bp, Artificial Sequence
  Synthetic DNA
ctagacttcacgctatag

SEQ ID NO: 36293 - DNA, 18 bp, Artificial Sequence
  Synthetic DNA
ctagaggtctaactatag

SEQ ID NO: 36294 - DNA, 18 bp, Artificial Sequence
  Synthetic DNA
ctagtcgattcattttag

SEQ ID NO: 36295 - DNA, 18 bp, Artificial Sequence
  Synthetic DNA
ctataagacacactaaag

SEQ ID NO: 36296 - DNA, 18 bp, Artificial Sequence
  Synthetic DNA
ctataagtatcacatttg

SEQ ID NO: 36297 - DNA, 18 bp, Artificial Sequence
  Synthetic DNA
ctatacaactgtatatcg

SEQ ID NO: 36298 - DNA, 18 bp, Artificial Sequence
  Synthetic DNA
ctatacctcttagtatag

SEQ ID NO: 36299 - DNA, 18 bp, Artificial Sequence
  Synthetic DNA
ctatacgacattcagttg

SEQ ID NO: 36300 - DNA, 18 bp, Artificial Sequence
  Synthetic DNA
ctatacgactcatcaatg

SEQ ID NO: 36301 - DNA, 18 bp, Artificial Sequence
  Synthetic DNA
ctatacgactttccttag

SEQ ID NO: 36302 - DNA, 18 bp, Artificial Sequence
  Synthetic DNA
ctatacgatacactaatg

SEQ ID NO: 36303 - DNA, 18 bp, Artificial Sequence
  Synthetic DNA
ctatacgattcaaaatag

SEQ ID NO: 36304 - DNA, 18 bp, Artificial Sequence
  Synthetic DNA
ctatacgattcatttttg

SEQ ID NO: 36305 - DNA, 18 bp, Artificial Sequence
  Synthetic DNA
ctatacgattctcattag

SEQ ID NO: 36306 - DNA, 18 bp, Artificial Sequence
  Synthetic DNA
ctatacgtcacggtcaag

SEQ ID NO: 36307 - DNA, 18 bp, Artificial Sequence
  Synthetic DNA
ctatacgtctgtataaag

SEQ ID NO: 36308 - DNA, 18 bp, Artificial Sequence
  Synthetic DNA
ctatactactaactgtag

SEQ ID NO: 36309 - DNA, 18 bp, Artificial Sequence
  Synthetic DNA
ctatactactgactgcag

SEQ ID NO: 36310 - DNA, 18 bp, Artificial Sequence
  Synthetic DNA
ctataggtctcactattg

SEQ ID NO: 36311 - DNA, 18 bp, Artificial Sequence
  Synthetic DNA
ctatatgaaccaacaaag

SEQ ID NO: 36312 - DNA, 18 bp, Artificial Sequence
  Synthetic DNA
ctatatgaatctttatcg

SEQ ID NO: 36313 - DNA, 18 bp, Artificial Sequence
  Synthetic DNA
ctatatgactctctatta

SEQ ID NO: 36314 - DNA, 18 bp, Artificial Sequence
  Synthetic DNA
ctatattacacattaatg

SEQ ID NO: 36315 - DNA, 18 bp, Artificial Sequence
  Synthetic DNA
ctatcaaaatcacttaag

SEQ ID NO: 36316 - DNA, 18 bp, Artificial Sequence
  Synthetic DNA
ctatcacattcaatattg

SEQ ID NO: 36317 - DNA, 18 bp, Artificial Sequence
  Synthetic DNA
ctatccgaaatactatag

SEQ ID NO: 36318 - DNA, 18 bp, Artificial Sequence
  Synthetic DNA
ctatccgagaccttatag

SEQ ID NO: 36319 - DNA, 18 bp, Artificial Sequence
  Synthetic DNA
ctattcgactaactaaag

SEQ ID NO: 36320 - DNA, 18 bp, Artificial Sequence
  Synthetic DNA
ctattcgactaactaagg

SEQ ID NO: 36321 - DNA, 18 bp, Artificial Sequence
  Synthetic DNA
ctattcgagcctctaaag

SEQ ID NO: 36322 - DNA, 18 bp, Artificial Sequence
  Synthetic DNA
ctattcgtctcactaaag

SEQ ID NO: 36323 - DNA, 18 bp, Artificial Sequence
  Synthetic DNA
ctattctacacacttaag

SEQ ID NO: 36324 - DNA, 18 bp, Artificial Sequence
  Synthetic DNA
ctcaacgattctatcaag

SEQ ID NO: 36325 - DNA, 18 bp, Artificial Sequence
  Synthetic DNA
ctctacgcctcaatatag

SEQ ID NO: 36326 - DNA, 18 bp, Artificial Sequence
  Synthetic DNA
ctctaggccttactatag

SEQ ID NO: 36327 - DNA, 18 bp, Artificial Sequence
  Synthetic DNA
ctcttagacttattatag

SEQ ID NO: 36328 - DNA, 18 bp, Artificial Sequence
  Synthetic DNA
ctgtactacacacaatag

SEQ ID NO: 36329 - DNA, 18 bp, Artificial Sequence
  Synthetic DNA
ctgtgcaactgtttaaag

SEQ ID NO: 36330 - DNA, 18 bp, Artificial Sequence
  Synthetic DNA
ctgttcgtttgactaaag

SEQ ID NO: 36331 - DNA, 18 bp, Artificial Sequence
  Synthetic DNA
ctttaccactctcataag

SEQ ID NO: 36332 - DNA, 18 bp, Artificial Sequence
  Synthetic DNA
ctttacgacacaccatag

SEQ ID NO: 36333 - DNA, 18 bp, Artificial Sequence
  Synthetic DNA
ctttacgagtaactattg

SEQ ID NO: 36334 - DNA, 18 bp, Artificial Sequence
  Synthetic DNA
ctttacgagtcgctttag

SEQ ID NO: 36335 - DNA, 18 bp, Artificial Sequence
  Synthetic DNA
ctttacgtcccactatag

SEQ ID NO: 36336 - DNA, 18 bp, Artificial Sequence
  Synthetic DNA
ctttacgtcttattatag

SEQ ID NO: 36337 - DNA, 18 bp, Artificial Sequence
  Synthetic DNA
ctttccgtcacacaatcg

SEQ ID NO: 36338 - DNA, 18 bp, Artificial Sequence
  Synthetic DNA
cttttccactcactctag

SEQ ID NO: 36339 - DNA, 18 bp, Artificial Sequence
  Synthetic DNA
cttttcgactcaccatag

SEQ ID NO: 36340 - DNA, 18 bp, Artificial Sequence
  Synthetic DNA
cttttcgtctcagtaaag

SEQ ID NO: 36341 - DNA, 18 bp, Artificial Sequence
  Synthetic DNA
gaaaacgactaattagag

SEQ ID NO: 36342 - DNA, 18 bp, Artificial Sequence
  Synthetic DNA
gaaaacgacttcctataa

SEQ ID NO: 36343 - DNA, 18 bp, Artificial Sequence
  Synthetic DNA
gaaaacgatcttctatag

SEQ ID NO: 36344 - DNA, 18 bp, Artificial Sequence
  Synthetic DNA
gaaaatgactctcaaaag

SEQ ID NO: 36345 - DNA, 18 bp, Artificial Sequence
  Synthetic DNA
gaaagctactcaatatag

SEQ ID NO: 36346 - DNA, 18 bp, Artificial Sequence
  Synthetic DNA
gaaatcgactaactaaag

SEQ ID NO: 36347 - DNA, 18 bp, Artificial Sequence
  Synthetic DNA
gaacaaaacttaccatag

SEQ ID NO: 36348 - DNA, 18 bp, Artificial Sequence
  Synthetic DNA
gaacacgtctcaccttag

SEQ ID NO: 36349 - DNA, 18 bp, Artificial Sequence
  Synthetic DNA
gaacatgactatacatag

SEQ ID NO: 36350 - DNA, 18 bp, Artificial Sequence
  Synthetic DNA
gaacgcaactcactatgg

SEQ ID NO: 36351 - DNA, 18 bp, Artificial Sequence
  Synthetic DNA
gaactcgactcactcttg

SEQ ID NO: 36352 - DNA, 18 bp, Artificial Sequence
  Synthetic DNA
gaagacgactttgtatag

SEQ ID NO: 36353 - DNA, 18 bp, Artificial Sequence
  Synthetic DNA
gaagatgactccctctag

SEQ ID NO: 36354 - DNA, 18 bp, Artificial Sequence
  Synthetic DNA
gaataagacattttattg

SEQ ID NO: 36355 - DNA, 18 bp, Artificial Sequence
  Synthetic DNA
gaataaggctcacttaag

SEQ ID NO: 36356 - DNA, 18 bp, Artificial Sequence
  Synthetic DNA
gaataagtctcacttttg

SEQ ID NO: 36357 - DNA, 18 bp, Artificial Sequence
  Synthetic DNA
gaatacgactcagccttg

SEQ ID NO: 36358 - DNA, 18 bp, Artificial Sequence
  Synthetic DNA
gaatacggtcaactatgg

SEQ ID NO: 36359 - DNA, 18 bp, Artificial Sequence
  Synthetic DNA
gaatacgtctcacttatg

SEQ ID NO: 36360 - DNA, 18 bp, Artificial Sequence
  Synthetic DNA
gaatactacagtctcaag

SEQ ID NO: 36361 - DNA, 18 bp, Artificial Sequence
  Synthetic DNA
gaatatagctaatatttg

SEQ ID NO: 36362 - DNA, 18 bp, Artificial Sequence
  Synthetic DNA
gaatatcacaaattattg

SEQ ID NO: 36363 - DNA, 18 bp, Artificial Sequence
  Synthetic DNA
gaatatgatatcctctag

SEQ ID NO: 36364 - DNA, 18 bp, Artificial Sequence
  Synthetic DNA
gaatatgtctaggaaaag

SEQ ID NO: 36365 - DNA, 18 bp, Artificial Sequence
  Synthetic DNA
gaatatgtctcgctcaag

SEQ ID NO: 36366 - DNA, 18 bp, Artificial Sequence
  Synthetic DNA
gaatattaatcagaatag

SEQ ID NO: 36367 - DNA, 18 bp, Artificial Sequence
  Synthetic DNA
gaatccgactaaatttag

SEQ ID NO: 36368 - DNA, 18 bp, Artificial Sequence
  Synthetic DNA
gaatcgcacacactttag

SEQ ID NO: 36369 - DNA, 18 bp, Artificial Sequence
  Synthetic DNA
gaatgcgactaacactag

SEQ ID NO: 36370 - DNA, 18 bp, Artificial Sequence
  Synthetic DNA
gaatgcgatccactagag

SEQ ID NO: 36371 - DNA, 18 bp, Artificial Sequence
  Synthetic DNA
gaatgctactcattaaag

SEQ ID NO: 36372 - DNA, 18 bp, Artificial Sequence
  Synthetic DNA
gaattcacctctctcttg

SEQ ID NO: 36373 - DNA, 18 bp, Artificial Sequence
  Synthetic DNA
gaattcgagtcaccatcg

SEQ ID NO: 36374 - DNA, 18 bp, Artificial Sequence
  Synthetic DNA
gaatttcactctccatag

SEQ ID NO: 36375 - DNA, 18 bp, Artificial Sequence
  Synthetic DNA
gacaacgactaaatttag

SEQ ID NO: 36376 - DNA, 18 bp, Artificial Sequence
  Synthetic DNA
gactacgccttactattg

SEQ ID NO: 36377 - DNA, 18 bp, Artificial Sequence
  Synthetic DNA
gactatgactgccaattg

SEQ ID NO: 36378 - DNA, 18 bp, Artificial Sequence
  Synthetic DNA
gactatgtctcactttag

SEQ ID NO: 36379 - DNA, 18 bp, Artificial Sequence
  Synthetic DNA
gactatgtctgagcatag

SEQ ID NO: 36380 - DNA, 18 bp, Artificial Sequence
  Synthetic DNA
gactccgtgtcactttgg

SEQ ID NO: 36381 - DNA, 18 bp, Artificial Sequence
  Synthetic DNA
gagcaacactctctatag

SEQ ID NO: 36382 - DNA, 18 bp, Artificial Sequence
  Synthetic DNA
gagtacgacaaagtaaag

SEQ ID NO: 36383 - DNA, 18 bp, Artificial Sequence
  Synthetic DNA
gagtactacgccctacag

SEQ ID NO: 36384 - DNA, 18 bp, Artificial Sequence
  Synthetic DNA
gagtatgtctcactattg

SEQ ID NO: 36385 - DNA, 18 bp, Artificial Sequence
  Synthetic DNA
gataatgaatcactatag

SEQ ID NO: 36386 - DNA, 18 bp, Artificial Sequence
  Synthetic DNA
gatctctactaagtatag

SEQ ID NO: 36387 - DNA, 18 bp, Artificial Sequence
  Synthetic DNA
gatgacgacagtcaatag

SEQ ID NO: 36388 - DNA, 18 bp, Artificial Sequence
  Synthetic DNA
gattaacacccactatgg

SEQ ID NO: 36389 - DNA, 18 bp, Artificial Sequence
  Synthetic DNA
gattacctctcactaaag

SEQ ID NO: 36390 - DNA, 18 bp, Artificial Sequence
  Synthetic DNA
gattacgactctcggttg

SEQ ID NO: 36391 - DNA, 18 bp, Artificial Sequence
  Synthetic DNA
gattacgtctcaccattg

SEQ ID NO: 36392 - DNA, 18 bp, Artificial Sequence
  Synthetic DNA
gattacttccaactttag

SEQ ID NO: 36393 - DNA, 18 bp, Artificial Sequence
  Synthetic DNA
gattattactcaccatag

SEQ ID NO: 36394 - DNA, 18 bp, Artificial Sequence
  Synthetic DNA
gattccaattttctatgg

SEQ ID NO: 36395 - DNA, 18 bp, Artificial Sequence
  Synthetic DNA
gatttccactctcaatag

SEQ ID NO: 36396 - DNA, 18 bp, Artificial Sequence
  Synthetic DNA
gatttctgagcactattg

SEQ ID NO: 36397 - DNA, 18 bp, Artificial Sequence
  Synthetic DNA
gcaaacgactaactctag

SEQ ID NO: 36398 - DNA, 18 bp, Artificial Sequence
  Synthetic DNA
gcacaagtcactctaaag

SEQ ID NO: 36399 - DNA, 18 bp, Artificial Sequence
  Synthetic DNA
gcacacgaatcacacatg

SEQ ID NO: 36400 - DNA, 18 bp, Artificial Sequence
  Synthetic DNA
gcatacaactcacaaaag

SEQ ID NO: 36401 - DNA, 18 bp, Artificial Sequence
  Synthetic DNA
gcatacgagtgactctag

SEQ ID NO: 36402 - DNA, 18 bp, Artificial Sequence
  Synthetic DNA
gcattcgacacacaaaag

SEQ ID NO: 36403 - DNA, 18 bp, Artificial Sequence
  Synthetic DNA
gcattcgactctctatgg

SEQ ID NO: 36404 - DNA, 18 bp, Artificial Sequence
  Synthetic DNA
gcattcgtcttactatag

SEQ ID NO: 36405 - DNA, 18 bp, Artificial Sequence
  Synthetic DNA
gcttacccctgcccatag

SEQ ID NO: 36406 - DNA, 18 bp, Artificial Sequence
  Synthetic DNA
ggattcgactcgctatcg

SEQ ID NO: 36407 - DNA, 18 bp, Artificial Sequence
  Synthetic DNA
ggttacaactcaaaactg

SEQ ID NO: 36408 - DNA, 18 bp, Artificial Sequence
  Synthetic DNA
gtaaaccacttactttag

SEQ ID NO: 36409 - DNA, 18 bp, Artificial Sequence
  Synthetic DNA
gtaaacgactccctatcg

SEQ ID NO: 36410 - DNA, 18 bp, Artificial Sequence
  Synthetic DNA
gtacatgtcttaatatag

SEQ ID NO: 36411 - DNA, 18 bp, Artificial Sequence
  Synthetic DNA
gtacgcgtttcactatag

SEQ ID NO: 36412 - DNA, 18 bp, Artificial Sequence
  Synthetic DNA
gtagacgcctccctttag

SEQ ID NO: 36413 - DNA, 18 bp, Artificial Sequence
  Synthetic DNA
gtagcctacactctttcg

SEQ ID NO: 36414 - DNA, 18 bp, Artificial Sequence
  Synthetic DNA
gtatacgccacacaaaag

SEQ ID NO: 36415 - DNA, 18 bp, Artificial Sequence
  Synthetic DNA
gtatacgtttaactattg

SEQ ID NO: 36416 - DNA, 18 bp, Artificial Sequence
  Synthetic DNA
gtatatgactcaccagtg

SEQ ID NO: 36417 - DNA, 18 bp, Artificial Sequence
  Synthetic DNA
gtatcagactaactatag

SEQ ID NO: 36418 - DNA, 18 bp, Artificial Sequence
  Synthetic DNA
gtattcgactctctccag

SEQ ID NO: 36419 - DNA, 18 bp, Artificial Sequence
  Synthetic DNA
gtcttcgattcactatag

SEQ ID NO: 36420 - DNA, 18 bp, Artificial Sequence
  Synthetic DNA
gtcttcgattctctatag

SEQ ID NO: 36421 - DNA, 18 bp, Artificial Sequence
  Synthetic DNA
gtgtacgactcacttgag

SEQ ID NO: 36422 - DNA, 18 bp, Artificial Sequence
  Synthetic DNA
gttaaagactcactaaag

SEQ ID NO: 36423 - DNA, 18 bp, Artificial Sequence
  Synthetic DNA
gttaacgtctcactatag

SEQ ID NO: 36424 - DNA, 18 bp, Artificial Sequence
  Synthetic DNA
gtttactattttctattg

SEQ ID NO: 36425 - DNA, 18 bp, Artificial Sequence
  Synthetic DNA
gttttagactcactattg

SEQ ID NO: 36426 - DNA, 18 bp, Artificial Sequence
  Synthetic DNA
gttttcatcgatcttaag

SEQ ID NO: 36427 - DNA, 18 bp, Artificial Sequence
  Synthetic DNA
taaaaagaatcaatttag

SEQ ID NO: 36428 - DNA, 18 bp, Artificial Sequence
  Synthetic DNA
taaaaagagacacaattg

SEQ ID NO: 36429 - DNA, 18 bp, Artificial Sequence
  Synthetic DNA
taaaaagtcacactgttg

SEQ ID NO: 36430 - DNA, 18 bp, Artificial Sequence
  Synthetic DNA
taaaaagtctcaagatag

SEQ ID NO: 36431 - DNA, 18 bp, Artificial Sequence
  Synthetic DNA
taaaaagtctcacgaatg

SEQ ID NO: 36432 - DNA, 18 bp, Artificial Sequence
  Synthetic DNA
taaaaagtctcgctaatg

SEQ ID NO: 36433 - DNA, 18 bp, Artificial Sequence
  Synthetic DNA
taaaaatacactctatag

SEQ ID NO: 36434 - DNA, 18 bp, Artificial Sequence
  Synthetic DNA
taaaaataccaagtatag

SEQ ID NO: 36435 - DNA, 18 bp, Artificial Sequence
  Synthetic DNA
taaaaatactcactactg

SEQ ID NO: 36436 - DNA, 18 bp, Artificial Sequence
  Synthetic DNA
taaaacaaatctcgatag

SEQ ID NO: 36437 - DNA, 18 bp, Artificial Sequence
  Synthetic DNA
taaaacaactctccttag

SEQ ID NO: 36438 - DNA, 18 bp, Artificial Sequence
  Synthetic DNA
taaaacaactctctcttg

SEQ ID NO: 36439 - DNA, 18 bp, Artificial Sequence
  Synthetic DNA
taaaacaatcctccatag

SEQ ID NO: 36440 - DNA, 18 bp, Artificial Sequence
  Synthetic DNA
taaaacaattctatatag

SEQ ID NO: 36441 - DNA, 18 bp, Artificial Sequence
  Synthetic DNA
taaaacagcatactctag

SEQ ID NO: 36442 - DNA, 18 bp, Artificial Sequence
  Synthetic DNA
taaaacagctctctaatg

SEQ ID NO: 36443 - DNA, 18 bp, Artificial Sequence
  Synthetic DNA
taaaacatatgactaaag

SEQ ID NO: 36444 - DNA, 18 bp, Artificial Sequence
  Synthetic DNA
taaaacatcaaccttaag

SEQ ID NO: 36445 - DNA, 18 bp, Artificial Sequence
  Synthetic DNA
taaaacatctcattacag

SEQ ID NO: 36446 - DNA, 18 bp, Artificial Sequence
  Synthetic DNA
taaaaccaattcctttgg

SEQ ID NO: 36447 - DNA, 18 bp, Artificial Sequence
  Synthetic DNA
taaaaccacccaccaaag

SEQ ID NO: 36448 - DNA, 18 bp, Artificial Sequence
  Synthetic DNA
taaaaccagttagtatag

SEQ ID NO: 36449 - DNA, 18 bp, Artificial Sequence
  Synthetic DNA
taaaaccattacccatag

SEQ ID NO: 36450 - DNA, 18 bp, Artificial Sequence
  Synthetic DNA
taaaaccgctcgctaatg

SEQ ID NO: 36451 - DNA, 18 bp, Artificial Sequence
  Synthetic DNA
taaaacctctcacatttg

SEQ ID NO: 36452 - DNA, 18 bp, Artificial Sequence
  Synthetic DNA
taaaacgaacctctacag

SEQ ID NO: 36453 - DNA, 18 bp, Artificial Sequence
  Synthetic DNA
taaaacgaatttatatcg

SEQ ID NO: 36454 - DNA, 18 bp, Artificial Sequence
  Synthetic DNA
taaaacgacaaaccatcg

SEQ ID NO: 36455 - DNA, 18 bp, Artificial Sequence
  Synthetic DNA
taaaacgacaatttaaag

SEQ ID NO: 36456 - DNA, 18 bp, Artificial Sequence
  Synthetic DNA
taaaacgacagtctacag

SEQ ID NO: 36457 - DNA, 18 bp, Artificial Sequence
  Synthetic DNA
taaaacgacattcaatgg

SEQ ID NO: 36458 - DNA, 18 bp, Artificial Sequence
  Synthetic DNA
taaaacgacattcatttg

SEQ ID NO: 36459 - DNA, 18 bp, Artificial Sequence
  Synthetic DNA
taaaacgacctacgaaag

SEQ ID NO: 36460 - DNA, 18 bp, Artificial Sequence
  Synthetic DNA
taaaacgactcacagagg

SEQ ID NO: 36461 - DNA, 18 bp, Artificial Sequence
  Synthetic DNA
taaaacgactcagctttg

SEQ ID NO: 36462 - DNA, 18 bp, Artificial Sequence
  Synthetic DNA
taaaacgactcatagaag

SEQ ID NO: 36463 - DNA, 18 bp, Artificial Sequence
  Synthetic DNA
taaaacgactcatatatg

SEQ ID NO: 36464 - DNA, 18 bp, Artificial Sequence
  Synthetic DNA
taaaacgactccaattag

SEQ ID NO: 36465 - DNA, 18 bp, Artificial Sequence
  Synthetic DNA
taaaacgactcccgttcg

SEQ ID NO: 36466 - DNA, 18 bp, Artificial Sequence
  Synthetic DNA
taaaacgactccgcgtag

SEQ ID NO: 36467 - DNA, 18 bp, Artificial Sequence
  Synthetic DNA
taaaacgactgtccacgg

SEQ ID NO: 36468 - DNA, 18 bp, Artificial Sequence
  Synthetic DNA
taaaacgacttaatcaag

SEQ ID NO: 36469 - DNA, 18 bp, Artificial Sequence
  Synthetic DNA
taaaacgactttttataa

SEQ ID NO: 36470 - DNA, 18 bp, Artificial Sequence
  Synthetic DNA
taaaacgatactctatgg

SEQ ID NO: 36471 - DNA, 18 bp, Artificial Sequence
  Synthetic DNA
taaaacgattaacatgag

SEQ ID NO: 36472 - DNA, 18 bp, Artificial Sequence
  Synthetic DNA
taaaacgatttacataag

SEQ ID NO: 36473 - DNA, 18 bp, Artificial Sequence
  Synthetic DNA
taaaacgattttatattg

SEQ ID NO: 36474 - DNA, 18 bp, Artificial Sequence
  Synthetic DNA
taaaacgcaaccctttag

SEQ ID NO: 36475 - DNA, 18 bp, Artificial Sequence
  Synthetic DNA
taaaacgcctcaatgtcg

SEQ ID NO: 36476 - DNA, 18 bp, Artificial Sequence
  Synthetic DNA
taaaacggctgttttaag

SEQ ID NO: 36477 - DNA, 18 bp, Artificial Sequence
  Synthetic DNA
taaaacgtagctctatag

SEQ ID NO: 36478 - DNA, 18 bp, Artificial Sequence
  Synthetic DNA
taaaacgtcaaaatttag

SEQ ID NO: 36479 - DNA, 18 bp, Artificial Sequence
  Synthetic DNA
taaaacgtcacaatgaag

SEQ ID NO: 36480 - DNA, 18 bp, Artificial Sequence
  Synthetic DNA
taaaacgtcacacagaag

SEQ ID NO: 36481 - DNA, 18 bp, Artificial Sequence
  Synthetic DNA
taaaacgtcacagtatcg

SEQ ID NO: 36482 - DNA, 18 bp, Artificial Sequence
  Synthetic DNA
taaaacgtcgctcaatag

SEQ ID NO: 36483 - DNA, 18 bp, Artificial Sequence
  Synthetic DNA
taaaacgtctctcaaaag

SEQ ID NO: 36484 - DNA, 18 bp, Artificial Sequence
  Synthetic DNA
taaaacgtctgagtaacg

SEQ ID NO: 36485 - DNA, 18 bp, Artificial Sequence
  Synthetic DNA
taaaacgtgtcattattg

SEQ ID NO: 36486 - DNA, 18 bp, Artificial Sequence
  Synthetic DNA
taaaacgtttccttatag

SEQ ID NO: 36487 - DNA, 18 bp, Artificial Sequence
  Synthetic DNA
taaaactacaatctaatg

SEQ ID NO: 36488 - DNA, 18 bp, Artificial Sequence
  Synthetic DNA
taaaactacacacccgag

SEQ ID NO: 36489 - DNA, 18 bp, Artificial Sequence
  Synthetic DNA
taaaactactatctaatg

SEQ ID NO: 36490 - DNA, 18 bp, Artificial Sequence
  Synthetic DNA
taaaactactctgaatag

SEQ ID NO: 36491 - DNA, 18 bp, Artificial Sequence
  Synthetic DNA
taaaactactgtctttag

SEQ ID NO: 36492 - DNA, 18 bp, Artificial Sequence
  Synthetic DNA
taaaactacttgcaataa

SEQ ID NO: 36493 - DNA, 18 bp, Artificial Sequence
  Synthetic DNA
taaaactagacactaaag

SEQ ID NO: 36494 - DNA, 18 bp, Artificial Sequence
  Synthetic DNA
taaaactagtcaccaaag

SEQ ID NO: 36495 - DNA, 18 bp, Artificial Sequence
  Synthetic DNA
taaaactattagcaatgg

SEQ ID NO: 36496 - DNA, 18 bp, Artificial Sequence
  Synthetic DNA
taaaacttctctcgacag

SEQ ID NO: 36497 - DNA, 18 bp, Artificial Sequence
  Synthetic DNA
taaaagcacctaaaatgg

SEQ ID NO: 36498 - DNA, 18 bp, Artificial Sequence
  Synthetic DNA
taaaagcacttgccaaag

SEQ ID NO: 36499 - DNA, 18 bp, Artificial Sequence
  Synthetic DNA
taaaaggacattctaaag

SEQ ID NO: 36500 - DNA, 18 bp, Artificial Sequence
  Synthetic DNA
taaaaggacgcacaattg

SEQ ID NO: 36501 - DNA, 18 bp, Artificial Sequence
  Synthetic DNA
taaaaggactaactgcag

SEQ ID NO: 36502 - DNA, 18 bp, Artificial Sequence
  Synthetic DNA
taaaagggcacaataatg

SEQ ID NO: 36503 - DNA, 18 bp, Artificial Sequence
  Synthetic DNA
taaaagggcactctatag

SEQ ID NO: 36504 - DNA, 18 bp, Artificial Sequence
  Synthetic DNA
taaaagggctatctatag

SEQ ID NO: 36505 - DNA, 18 bp, Artificial Sequence
  Synthetic DNA
taaaagtaaacacttatg

SEQ ID NO: 36506 - DNA, 18 bp, Artificial Sequence
  Synthetic DNA
taaaataacgcactaaag

SEQ ID NO: 36507 - DNA, 18 bp, Artificial Sequence
  Synthetic DNA
taaaataactctcaacag

SEQ ID NO: 36508 - DNA, 18 bp, Artificial Sequence
  Synthetic DNA
taaaataattacctctag

SEQ ID NO: 36509 - DNA, 18 bp, Artificial Sequence
  Synthetic DNA
taaaatatcttactaaag

SEQ ID NO: 36510 - DNA, 18 bp, Artificial Sequence
  Synthetic DNA
taaaatgaaactatatag

SEQ ID NO: 36511 - DNA, 18 bp, Artificial Sequence
  Synthetic DNA
taaaatgacacgattaag

SEQ ID NO: 36512 - DNA, 18 bp, Artificial Sequence
  Synthetic DNA
taaaatgacttacaatcg

SEQ ID NO: 36513 - DNA, 18 bp, Artificial Sequence
  Synthetic DNA
taaaatgatccactattg

SEQ ID NO: 36514 - DNA, 18 bp, Artificial Sequence
  Synthetic DNA
taaaatgcctcaaaaatg

SEQ ID NO: 36515 - DNA, 18 bp, Artificial Sequence
  Synthetic DNA
taaaatgcctcgttatag

SEQ ID NO: 36516 - DNA, 18 bp, Artificial Sequence
  Synthetic DNA
taaaattactaactattg

SEQ ID NO: 36517 - DNA, 18 bp, Artificial Sequence
  Synthetic DNA
taaaattactcactactg

SEQ ID NO: 36518 - DNA, 18 bp, Artificial Sequence
  Synthetic DNA
taaaattactccataaag

SEQ ID NO: 36519 - DNA, 18 bp, Artificial Sequence
  Synthetic DNA
taaaattactccatatct

SEQ ID NO: 36520 - DNA, 18 bp, Artificial Sequence
  Synthetic DNA
taaaattattcacaatag

SEQ ID NO: 36521 - DNA, 18 bp, Artificial Sequence
  Synthetic DNA
taaaattgctcaatttag

SEQ ID NO: 36522 - DNA, 18 bp, Artificial Sequence
  Synthetic DNA
taaacagtctcactaatg

SEQ ID NO: 36523 - DNA, 18 bp, Artificial Sequence
  Synthetic DNA
taaaccagctctccttag

SEQ ID NO: 36524 - DNA, 18 bp, Artificial Sequence
  Synthetic DNA
taaaccgaataacaatag

SEQ ID NO: 36525 - DNA, 18 bp, Artificial Sequence
  Synthetic DNA
taaaccgaataacctcag

SEQ ID NO: 36526 - DNA, 18 bp, Artificial Sequence
  Synthetic DNA
taaaccgacactctattg

SEQ ID NO: 36527 - DNA, 18 bp, Artificial Sequence
  Synthetic DNA
taaaccgaccttaagtag

SEQ ID NO: 36528 - DNA, 18 bp, Artificial Sequence
  Synthetic DNA
taaaccgactcgctactg

SEQ ID NO: 36529 - DNA, 18 bp, Artificial Sequence
  Synthetic DNA
taaaccgtcagattacag

SEQ ID NO: 36530 - DNA, 18 bp, Artificial Sequence
  Synthetic DNA
taaaccgtctctccatcg

SEQ ID NO: 36531 - DNA, 18 bp, Artificial Sequence
  Synthetic DNA
taaacctaaagactaaag

SEQ ID NO: 36532 - DNA, 18 bp, Artificial Sequence
  Synthetic DNA
taaacctactgactggag

SEQ ID NO: 36533 - DNA, 18 bp, Artificial Sequence
  Synthetic DNA
taaacggattatctatag

SEQ ID NO: 36534 - DNA, 18 bp, Artificial Sequence
  Synthetic DNA
taaagagccttatgggag

SEQ ID NO: 36535 - DNA, 18 bp, Artificial Sequence
  Synthetic DNA
taaagcaacccattatag

SEQ ID NO: 36536 - DNA, 18 bp, Artificial Sequence
  Synthetic DNA
taaagcctttcacaatag

SEQ ID NO: 36537 - DNA, 18 bp, Artificial Sequence
  Synthetic DNA
taaagcgaatccctaagg

SEQ ID NO: 36538 - DNA, 18 bp, Artificial Sequence
  Synthetic DNA
taaagcgaatctttctag

SEQ ID NO: 36539 - DNA, 18 bp, Artificial Sequence
  Synthetic DNA
taaagcgactccgaaaag

SEQ ID NO: 36540 - DNA, 18 bp, Artificial Sequence
  Synthetic DNA
taaagcgcatcattttag

SEQ ID NO: 36541 - DNA, 18 bp, Artificial Sequence
  Synthetic DNA
taaagctactctctaaag

SEQ ID NO: 36542 - DNA, 18 bp, Artificial Sequence
  Synthetic DNA
taaagctatttagattag

SEQ ID NO: 36543 - DNA, 18 bp, Artificial Sequence
  Synthetic DNA
taaagtaacccactattg

SEQ ID NO: 36544 - DNA, 18 bp, Artificial Sequence
  Synthetic DNA
taaagtacctcataattg

SEQ ID NO: 36545 - DNA, 18 bp, Artificial Sequence
  Synthetic DNA
taaagtgactaaccattg

SEQ ID NO: 36546 - DNA, 18 bp, Artificial Sequence
  Synthetic DNA
taaagtgactctcaaggg

SEQ ID NO: 36547 - DNA, 18 bp, Artificial Sequence
  Synthetic DNA
taaagtgtcttacattag

SEQ ID NO: 36548 - DNA, 18 bp, Artificial Sequence
  Synthetic DNA
taaagttactcattaaag

SEQ ID NO: 36549 - DNA, 18 bp, Artificial Sequence
  Synthetic DNA
taaataatctccctattg

SEQ ID NO: 36550 - DNA, 18 bp, Artificial Sequence
  Synthetic DNA
taaatagagtctctatag

SEQ ID NO: 36551 - DNA, 18 bp, Artificial Sequence
  Synthetic DNA
taaatagtctcactgtcg

SEQ ID NO: 36552 - DNA, 18 bp, Artificial Sequence
  Synthetic DNA
taaatagtcttactatag

SEQ ID NO: 36553 - DNA, 18 bp, Artificial Sequence
  Synthetic DNA
taaatcaactcaaaatag

SEQ ID NO: 36554 - DNA, 18 bp, Artificial Sequence
  Synthetic DNA
taaatcaatttaccatag

SEQ ID NO: 36555 - DNA, 18 bp, Artificial Sequence
  Synthetic DNA
taaatccattcccagttg

SEQ ID NO: 36556 - DNA, 18 bp, Artificial Sequence
  Synthetic DNA
taaatcgaaccacaatag

SEQ ID NO: 36557 - DNA, 18 bp, Artificial Sequence
  Synthetic DNA
taaatcgaagcactttag

SEQ ID NO: 36558 - DNA, 18 bp, Artificial Sequence
  Synthetic DNA
taaatcgaagtattaaag

SEQ ID NO: 36559 - DNA, 18 bp, Artificial Sequence
  Synthetic DNA
taaatcgaatgactattg

SEQ ID NO: 36560 - DNA, 18 bp, Artificial Sequence
  Synthetic DNA
taaatcgacagtctatag

SEQ ID NO: 36561 - DNA, 18 bp, Artificial Sequence
  Synthetic DNA
taaatcgactaattattg

SEQ ID NO: 36562 - DNA, 18 bp, Artificial Sequence
  Synthetic DNA
taaatcgactcacaagcg

SEQ ID NO: 36563 - DNA, 18 bp, Artificial Sequence
  Synthetic DNA
taaatcgactctcgatta

SEQ ID NO: 36564 - DNA, 18 bp, Artificial Sequence
  Synthetic DNA
taaatcgagtcacgagag

SEQ ID NO: 36565 - DNA, 18 bp, Artificial Sequence
  Synthetic DNA
taaatcgagtctgtatag

SEQ ID NO: 36566 - DNA, 18 bp, Artificial Sequence
  Synthetic DNA
taaatcgccactctagag

SEQ ID NO: 36567 - DNA, 18 bp, Artificial Sequence
  Synthetic DNA
taaatcgcctccatgtcg

SEQ ID NO: 36568 - DNA, 18 bp, Artificial Sequence
  Synthetic DNA
taaatcggctaaccgttg

SEQ ID NO: 36569 - DNA, 18 bp, Artificial Sequence
  Synthetic DNA
taaatcgtcactcagatg

SEQ ID NO: 36570 - DNA, 18 bp, Artificial Sequence
  Synthetic DNA
taaatcgtctatcttttg

SEQ ID NO: 36571 - DNA, 18 bp, Artificial Sequence
  Synthetic DNA
taaatcgtctcacttctg

SEQ ID NO: 36572 - DNA, 18 bp, Artificial Sequence
  Synthetic DNA
taaatcgtttcaccttag

SEQ ID NO: 36573 - DNA, 18 bp, Artificial Sequence
  Synthetic DNA
taaatctactaactacag

SEQ ID NO: 36574 - DNA, 18 bp, Artificial Sequence
  Synthetic DNA
taaatctactctcttttg

SEQ ID NO: 36575 - DNA, 18 bp, Artificial Sequence
  Synthetic DNA
taaatctattaactattg

SEQ ID NO: 36576 - DNA, 18 bp, Artificial Sequence
  Synthetic DNA
taaatgaactcactctag

SEQ ID NO: 36577 - DNA, 18 bp, Artificial Sequence
  Synthetic DNA
taaatggacccagtatag

SEQ ID NO: 36578 - DNA, 18 bp, Artificial Sequence
  Synthetic DNA
taaatggactctctgtag

SEQ ID NO: 36579 - DNA, 18 bp, Artificial Sequence
  Synthetic DNA
taaatggtcacaatttag

SEQ ID NO: 36580 - DNA, 18 bp, Artificial Sequence
  Synthetic DNA
taaattgactcctctgag

SEQ ID NO: 36581 - DNA, 18 bp, Artificial Sequence
  Synthetic DNA
taaattgactctcaattg

SEQ ID NO: 36582 - DNA, 18 bp, Artificial Sequence
  Synthetic DNA
taaattgactctttgtag

SEQ ID NO: 36583 - DNA, 18 bp, Artificial Sequence
  Synthetic DNA
taaattgattgacaaaag

SEQ ID NO: 36584 - DNA, 18 bp, Artificial Sequence
  Synthetic DNA
taacaaaacttactattg

SEQ ID NO: 36585 - DNA, 18 bp, Artificial Sequence
  Synthetic DNA
taacaaatccctaaattg

SEQ ID NO: 36586 - DNA, 18 bp, Artificial Sequence
  Synthetic DNA
taacaagacccatatttg

SEQ ID NO: 36587 - DNA, 18 bp, Artificial Sequence
  Synthetic DNA
taacaagattctctattg

SEQ ID NO: 36588 - DNA, 18 bp, Artificial Sequence
  Synthetic DNA
taacacaacccttgttag

SEQ ID NO: 36589 - DNA, 18 bp, Artificial Sequence
  Synthetic DNA
taacacaactatctcaag

SEQ ID NO: 36590 - DNA, 18 bp, Artificial Sequence
  Synthetic DNA
taacacaagacactattg

SEQ ID NO: 36591 - DNA, 18 bp, Artificial Sequence
  Synthetic DNA
taacacatttctctatcg

SEQ ID NO: 36592 - DNA, 18 bp, Artificial Sequence
  Synthetic DNA
taacaccacttattttag

SEQ ID NO: 36593 - DNA, 18 bp, Artificial Sequence
  Synthetic DNA
taacaccagtcacgacag

SEQ ID NO: 36594 - DNA, 18 bp, Artificial Sequence
  Synthetic DNA
taacacccttcactatgg

SEQ ID NO: 36595 - DNA, 18 bp, Artificial Sequence
  Synthetic DNA
taacacgaaacagattag

SEQ ID NO: 36596 - DNA, 18 bp, Artificial Sequence
  Synthetic DNA
taacacgaaattataaag

SEQ ID NO: 36597 - DNA, 18 bp, Artificial Sequence
  Synthetic DNA
taacacgaatgacaattg

SEQ ID NO: 36598 - DNA, 18 bp, Artificial Sequence
  Synthetic DNA
taacacgaatgacttgag

SEQ ID NO: 36599 - DNA, 18 bp, Artificial Sequence
  Synthetic DNA
taacacgacacacttctg

SEQ ID NO: 36600 - DNA, 18 bp, Artificial Sequence
  Synthetic DNA
taacacgaccctttatca

SEQ ID NO: 36601 - DNA, 18 bp, Artificial Sequence
  Synthetic DNA
taacacgactctcctcag

SEQ ID NO: 36602 - DNA, 18 bp, Artificial Sequence
  Synthetic DNA
taacacgactctccttcg

SEQ ID NO: 36603 - DNA, 18 bp, Artificial Sequence
  Synthetic DNA
taacacgagtagctttag

SEQ ID NO: 36604 - DNA, 18 bp, Artificial Sequence
  Synthetic DNA
taacacgagtcttaattg

SEQ ID NO: 36605 - DNA, 18 bp, Artificial Sequence
  Synthetic DNA
taacacgcaacactattg

SEQ ID NO: 36606 - DNA, 18 bp, Artificial Sequence
  Synthetic DNA
taacacgctccaatatag

SEQ ID NO: 36607 - DNA, 18 bp, Artificial Sequence
  Synthetic DNA
taacacgtcactacattg

SEQ ID NO: 36608 - DNA, 18 bp, Artificial Sequence
  Synthetic DNA
taacacgtcactcgttag

SEQ ID NO: 36609 - DNA, 18 bp, Artificial Sequence
  Synthetic DNA
taacacgtctcactcacg

SEQ ID NO: 36610 - DNA, 18 bp, Artificial Sequence
  Synthetic DNA
taacacgtctcagttaag

SEQ ID NO: 36611 - DNA, 18 bp, Artificial Sequence
  Synthetic DNA
taacacgttatagtatag

SEQ ID NO: 36612 - DNA, 18 bp, Artificial Sequence
  Synthetic DNA
taacacgtttcattaggg

SEQ ID NO: 36613 - DNA, 18 bp, Artificial Sequence
  Synthetic DNA
taacactagagactatag

SEQ ID NO: 36614 - DNA, 18 bp, Artificial Sequence
  Synthetic DNA
taacactagccataaaag

SEQ ID NO: 36615 - DNA, 18 bp, Artificial Sequence
  Synthetic DNA
taacactattcaatttcg

SEQ ID NO: 36616 - DNA, 18 bp, Artificial Sequence
  Synthetic DNA
taacactgcacgtcatag

SEQ ID NO: 36617 - DNA, 18 bp, Artificial Sequence
  Synthetic DNA
taacactgctaactaaag

SEQ ID NO: 36618 - DNA, 18 bp, Artificial Sequence
  Synthetic DNA
taacacttccgcctatag

SEQ ID NO: 36619 - DNA, 18 bp, Artificial Sequence
  Synthetic DNA
taacacttctcaatcttg

SEQ ID NO: 36620 - DNA, 18 bp, Artificial Sequence
  Synthetic DNA
taacacttctcattcaag

SEQ ID NO: 36621 - DNA, 18 bp, Artificial Sequence
  Synthetic DNA
taacacttctcgctaaag

SEQ ID NO: 36622 - DNA, 18 bp, Artificial Sequence
  Synthetic DNA
taacagggctcgctaaag

SEQ ID NO: 36623 - DNA, 18 bp, Artificial Sequence
  Synthetic DNA
taacataacccacaatag

SEQ ID NO: 36624 - DNA, 18 bp, Artificial Sequence
  Synthetic DNA
taacatgaatcacttacg

SEQ ID NO: 36625 - DNA, 18 bp, Artificial Sequence
  Synthetic DNA
taacatgtccggctatag

SEQ ID NO: 36626 - DNA, 18 bp, Artificial Sequence
  Synthetic DNA
taacatgtctctttagag

SEQ ID NO: 36627 - DNA, 18 bp, Artificial Sequence
  Synthetic DNA
taacccaactctctacag

SEQ ID NO: 36628 - DNA, 18 bp, Artificial Sequence
  Synthetic DNA
taacccagttttctatag

SEQ ID NO: 36629 - DNA, 18 bp, Artificial Sequence
  Synthetic DNA
taacccgaatgaatattg

SEQ ID NO: 36630 - DNA, 18 bp, Artificial Sequence
  Synthetic DNA
taacccgactctaacttg

SEQ ID NO: 36631 - DNA, 18 bp, Artificial Sequence
  Synthetic DNA
taacccgattcattgttg

SEQ ID NO: 36632 - DNA, 18 bp, Artificial Sequence
  Synthetic DNA
taacccgattccgtattg

SEQ ID NO: 36633 - DNA, 18 bp, Artificial Sequence
  Synthetic DNA
taacccggctctcaatag

SEQ ID NO: 36634 - DNA, 18 bp, Artificial Sequence
  Synthetic DNA
taacgcgacttacttgag

SEQ ID NO: 36635 - DNA, 18 bp, Artificial Sequence
  Synthetic DNA
taacgcgagacattatag

SEQ ID NO: 36636 - DNA, 18 bp, Artificial Sequence
  Synthetic DNA
taacgcgattctttaaag

SEQ ID NO: 36637 - DNA, 18 bp, Artificial Sequence
  Synthetic DNA
taacggtacatactaaag

SEQ ID NO: 36638 - DNA, 18 bp, Artificial Sequence
  Synthetic DNA
taacggttcacactttcg

SEQ ID NO: 36639 - DNA, 18 bp, Artificial Sequence
  Synthetic DNA
taacgtgacactcattag

SEQ ID NO: 36640 - DNA, 18 bp, Artificial Sequence
  Synthetic DNA
taactagacacgctacag

SEQ ID NO: 36641 - DNA, 18 bp, Artificial Sequence
  Synthetic DNA
taactagtctccctatgg

SEQ ID NO: 36642 - DNA, 18 bp, Artificial Sequence
  Synthetic DNA
taactataatctctatag

SEQ ID NO: 36643 - DNA, 18 bp, Artificial Sequence
  Synthetic DNA
taactcatcccactaacg

SEQ ID NO: 36644 - DNA, 18 bp, Artificial Sequence
  Synthetic DNA
taactccactctcttaag

SEQ ID NO: 36645 - DNA, 18 bp, Artificial Sequence
  Synthetic DNA
taactcgaccgacatagg

SEQ ID NO: 36646 - DNA, 18 bp, Artificial Sequence
  Synthetic DNA
taactcgactctctgatg

SEQ ID NO: 36647 - DNA, 18 bp, Artificial Sequence
  Synthetic DNA
taactcgactgactaatg

SEQ ID NO: 36648 - DNA, 18 bp, Artificial Sequence
  Synthetic DNA
taactcgacttacgatcg

SEQ ID NO: 36649 - DNA, 18 bp, Artificial Sequence
  Synthetic DNA
taactcgatacactaaag

SEQ ID NO: 36650 - DNA, 18 bp, Artificial Sequence
  Synthetic DNA
taactcgatacactatcg

SEQ ID NO: 36651 - DNA, 18 bp, Artificial Sequence
  Synthetic DNA
taactcgattatctatag

SEQ ID NO: 36652 - DNA, 18 bp, Artificial Sequence
  Synthetic DNA
taactcgattctctcttg

SEQ ID NO: 36653 - DNA, 18 bp, Artificial Sequence
  Synthetic DNA
taactcgcctcaccttag

SEQ ID NO: 36654 - DNA, 18 bp, Artificial Sequence
  Synthetic DNA
taactcgtcatacaaagg

SEQ ID NO: 36655 - DNA, 18 bp, Artificial Sequence
  Synthetic DNA
taactcgtctctatatag

SEQ ID NO: 36656 - DNA, 18 bp, Artificial Sequence
  Synthetic DNA
taactcgtctctcttcgg

SEQ ID NO: 36657 - DNA, 18 bp, Artificial Sequence
  Synthetic DNA
taactcgtttctcacaag

SEQ ID NO: 36658 - DNA, 18 bp, Artificial Sequence
  Synthetic DNA
taactgaactcattttag

SEQ ID NO: 36659 - DNA, 18 bp, Artificial Sequence
  Synthetic DNA
taactggactctttattg

SEQ ID NO: 36660 - DNA, 18 bp, Artificial Sequence
  Synthetic DNA
taacttgacacagtaaag

SEQ ID NO: 36661 - DNA, 18 bp, Artificial Sequence
  Synthetic DNA
taacttgactttctatag

SEQ ID NO: 36662 - DNA, 18 bp, Artificial Sequence
  Synthetic DNA
taactttactcaactttg

SEQ ID NO: 36663 - DNA, 18 bp, Artificial Sequence
  Synthetic DNA
taagaagacacgctattg

SEQ ID NO: 36664 - DNA, 18 bp, Artificial Sequence
  Synthetic DNA
taagacaacccgctacgg

SEQ ID NO: 36665 - DNA, 18 bp, Artificial Sequence
  Synthetic DNA
taagacatcttgttatgg

SEQ ID NO: 36666 - DNA, 18 bp, Artificial Sequence
  Synthetic DNA
taagacgacatacaaaag

SEQ ID NO: 36667 - DNA, 18 bp, Artificial Sequence
  Synthetic DNA
taagacgataaactgtag

SEQ ID NO: 36668 - DNA, 18 bp, Artificial Sequence
  Synthetic DNA
taagacgattcacatttg

SEQ ID NO: 36669 - DNA, 18 bp, Artificial Sequence
  Synthetic DNA
taagactccttattatag

SEQ ID NO: 36670 - DNA, 18 bp, Artificial Sequence
  Synthetic DNA
taagacttgttactatag

SEQ ID NO: 36671 - DNA, 18 bp, Artificial Sequence
  Synthetic DNA
taagagatctcactggag

SEQ ID NO: 36672 - DNA, 18 bp, Artificial Sequence
  Synthetic DNA
taagaggaaaaactatag

SEQ ID NO: 36673 - DNA, 18 bp, Artificial Sequence
  Synthetic DNA
taagataactcagtaatg

SEQ ID NO: 36674 - DNA, 18 bp, Artificial Sequence
  Synthetic DNA
taagatatctctcaattg

SEQ ID NO: 36675 - DNA, 18 bp, Artificial Sequence
  Synthetic DNA
taagatgtcacactttag

SEQ ID NO: 36676 - DNA, 18 bp, Artificial Sequence
  Synthetic DNA
taagattaccgactatag

SEQ ID NO: 36677 - DNA, 18 bp, Artificial Sequence
  Synthetic DNA
taagattactaagtacag

SEQ ID NO: 36678 - DNA, 18 bp, Artificial Sequence
  Synthetic DNA
taagcctaatgacaattg

SEQ ID NO: 36679 - DNA, 18 bp, Artificial Sequence
  Synthetic DNA
taaggaaactcaatatag

SEQ ID NO: 36680 - DNA, 18 bp, Artificial Sequence
  Synthetic DNA
taagtagacttattttag

SEQ ID NO: 36681 - DNA, 18 bp, Artificial Sequence
  Synthetic DNA
taagtcaactcacttgag

SEQ ID NO: 36682 - DNA, 18 bp, Artificial Sequence
  Synthetic DNA
taagtcagctctataccg

SEQ ID NO: 36683 - DNA, 18 bp, Artificial Sequence
  Synthetic DNA
taagtcatcactctatag

SEQ ID NO: 36684 - DNA, 18 bp, Artificial Sequence
  Synthetic DNA
taagtcgaggtatcatcg

SEQ ID NO: 36685 - DNA, 18 bp, Artificial Sequence
  Synthetic DNA
taagtcgattcgttatag

SEQ ID NO: 36686 - DNA, 18 bp, Artificial Sequence
  Synthetic DNA
taagtcgtttcacaatag

SEQ ID NO: 36687 - DNA, 18 bp, Artificial Sequence
  Synthetic DNA
taataaaaatcaataaag

SEQ ID NO: 36688 - DNA, 18 bp, Artificial Sequence
  Synthetic DNA
taataaaaatctaaatag

SEQ ID NO: 36689 - DNA, 18 bp, Artificial Sequence
  Synthetic DNA
taataaaaatctctaatg

SEQ ID NO: 36690 - DNA, 18 bp, Artificial Sequence
  Synthetic DNA
taataaaaccatccttag

SEQ ID NO: 36691 - DNA, 18 bp, Artificial Sequence
  Synthetic DNA
taataaaactctccattg

SEQ ID NO: 36692 - DNA, 18 bp, Artificial Sequence
  Synthetic DNA
taataaaactctctatta

SEQ ID NO: 36693 - DNA, 18 bp, Artificial Sequence
  Synthetic DNA
taataaatcttactacag

SEQ ID NO: 36694 - DNA, 18 bp, Artificial Sequence
  Synthetic DNA
taataaatttcacaaaag

SEQ ID NO: 36695 - DNA, 18 bp, Artificial Sequence
  Synthetic DNA
taataacacccccaattg

SEQ ID NO: 36696 - DNA, 18 bp, Artificial Sequence
  Synthetic DNA
taataaccctctctgttg

SEQ ID NO: 36697 - DNA, 18 bp, Artificial Sequence
  Synthetic DNA
taataaccttcaataatg

SEQ ID NO: 36698 - DNA, 18 bp, Artificial Sequence
  Synthetic DNA
taataactgtcaatttag

SEQ ID NO: 36699 - DNA, 18 bp, Artificial Sequence
  Synthetic DNA
taataagaaacccttaag

SEQ ID NO: 36700 - DNA, 18 bp, Artificial Sequence
  Synthetic DNA
taataagaatctcaaaag

SEQ ID NO: 36701 - DNA, 18 bp, Artificial Sequence
  Synthetic DNA
taataagacacacaaagg

SEQ ID NO: 36702 - DNA, 18 bp, Artificial Sequence
  Synthetic DNA
taataagacccgctaatg

SEQ ID NO: 36703 - DNA, 18 bp, Artificial Sequence
  Synthetic DNA
taataagacccgctagtg

SEQ ID NO: 36704 - DNA, 18 bp, Artificial Sequence
  Synthetic DNA
taataagacgcttttctg

SEQ ID NO: 36705 - DNA, 18 bp, Artificial Sequence
  Synthetic DNA
taataagactaacaactg

SEQ ID NO: 36706 - DNA, 18 bp, Artificial Sequence
  Synthetic DNA
taataagactataattag

SEQ ID NO: 36707 - DNA, 18 bp, Artificial Sequence
  Synthetic DNA
taataagactatttatgg

SEQ ID NO: 36708 - DNA, 18 bp, Artificial Sequence
  Synthetic DNA
taataagactcacaccgg

SEQ ID NO: 36709 - DNA, 18 bp, Artificial Sequence
  Synthetic DNA
taataagagagaataaag

SEQ ID NO: 36710 - DNA, 18 bp, Artificial Sequence
  Synthetic DNA
taataagagagtctatag

SEQ ID NO: 36711 - DNA, 18 bp, Artificial Sequence
  Synthetic DNA
taataagagagtttattg

SEQ ID NO: 36712 - DNA, 18 bp, Artificial Sequence
  Synthetic DNA
taataagagtgtctattg

SEQ ID NO: 36713 - DNA, 18 bp, Artificial Sequence
  Synthetic DNA
taataagccccattaatg

SEQ ID NO: 36714 - DNA, 18 bp, Artificial Sequence
  Synthetic DNA
taataagcctcacaaagg

SEQ ID NO: 36715 - DNA, 18 bp, Artificial Sequence
  Synthetic DNA
taataagcctcacacttg

SEQ ID NO: 36716 - DNA, 18 bp, Artificial Sequence
  Synthetic DNA
taataagcctctctaatg

SEQ ID NO: 36717 - DNA, 18 bp, Artificial Sequence
  Synthetic DNA
taataaggcactcaaaag

SEQ ID NO: 36718 - DNA, 18 bp, Artificial Sequence
  Synthetic DNA
taataaggctcaatcacg

SEQ ID NO: 36719 - DNA, 18 bp, Artificial Sequence
  Synthetic DNA
taataagggtgagtatag

SEQ ID NO: 36720 - DNA, 18 bp, Artificial Sequence
  Synthetic DNA
taataagtcactctctcg

SEQ ID NO: 36721 - DNA, 18 bp, Artificial Sequence
  Synthetic DNA
taataagtcactcttaag

SEQ ID NO: 36722 - DNA, 18 bp, Artificial Sequence
  Synthetic DNA
taataagtcagtcaaaag

SEQ ID NO: 36723 - DNA, 18 bp, Artificial Sequence
  Synthetic DNA
taataagtctccgtattg

SEQ ID NO: 36724 - DNA, 18 bp, Artificial Sequence
  Synthetic DNA
taataagtctctttacag

SEQ ID NO: 36725 - DNA, 18 bp, Artificial Sequence
  Synthetic DNA
taataagtctgacaatcg

SEQ ID NO: 36726 - DNA, 18 bp, Artificial Sequence
  Synthetic DNA
taataagtcttcctttag

SEQ ID NO: 36727 - DNA, 18 bp, Artificial Sequence
  Synthetic DNA
taataagtgccactttag

SEQ ID NO: 36728 - DNA, 18 bp, Artificial Sequence
  Synthetic DNA
taataagtgtcacatgtg

SEQ ID NO: 36729 - DNA, 18 bp, Artificial Sequence
  Synthetic DNA
taataagtgtctctataa

SEQ ID NO: 36730 - DNA, 18 bp, Artificial Sequence
  Synthetic DNA
taataagttccccttaag

SEQ ID NO: 36731 - DNA, 18 bp, Artificial Sequence
  Synthetic DNA
taataatacactctttag

SEQ ID NO: 36732 - DNA, 18 bp, Artificial Sequence
  Synthetic DNA
taataatacagaccattg

SEQ ID NO: 36733 - DNA, 18 bp, Artificial Sequence
  Synthetic DNA
taataataccatctttag

SEQ ID NO: 36734 - DNA, 18 bp, Artificial Sequence
  Synthetic DNA
taataatacccagtacag

SEQ ID NO: 36735 - DNA, 18 bp, Artificial Sequence
  Synthetic DNA
taataatactatctatgg

SEQ ID NO: 36736 - DNA, 18 bp, Artificial Sequence
  Synthetic DNA
taataatactcactgacg

SEQ ID NO: 36737 - DNA, 18 bp, Artificial Sequence
  Synthetic DNA
taataatactggcttgag

SEQ ID NO: 36738 - DNA, 18 bp, Artificial Sequence
  Synthetic DNA
taataatactttatatag

SEQ ID NO: 36739 - DNA, 18 bp, Artificial Sequence
  Synthetic DNA
taataatactttcattag

SEQ ID NO: 36740 - DNA, 18 bp, Artificial Sequence
  Synthetic DNA
taataatcttcgctatag

SEQ ID NO: 36741 - DNA, 18 bp, Artificial Sequence
  Synthetic DNA
taataattgtcacactag

SEQ ID NO: 36742 - DNA, 18 bp, Artificial Sequence
  Synthetic DNA
taataattttcaccttag

SEQ ID NO: 36743 - DNA, 18 bp, Artificial Sequence
  Synthetic DNA
taataattttcagtccag

SEQ ID NO: 36744 - DNA, 18 bp, Artificial Sequence
  Synthetic DNA
taatacaaaataatatag

SEQ ID NO: 36745 - DNA, 18 bp, Artificial Sequence
  Synthetic DNA
taatacaaatctttcaag

SEQ ID NO: 36746 - DNA, 18 bp, Artificial Sequence
  Synthetic DNA
taatacaaatgcctatcg

SEQ ID NO: 36747 - DNA, 18 bp, Artificial Sequence
  Synthetic DNA
taatacaacactctttcg

SEQ ID NO: 36748 - DNA, 18 bp, Artificial Sequence
  Synthetic DNA
taatacaaccaattattg

SEQ ID NO: 36749 - DNA, 18 bp, Artificial Sequence
  Synthetic DNA
taatacaacgccattcag

SEQ ID NO: 36750 - DNA, 18 bp, Artificial Sequence
  Synthetic DNA
taatacaactaacacaag

SEQ ID NO: 36751 - DNA, 18 bp, Artificial Sequence
  Synthetic DNA
taatacaactaattaatg

SEQ ID NO: 36752 - DNA, 18 bp, Artificial Sequence
  Synthetic DNA
taatacaactagaaacag

SEQ ID NO: 36753 - DNA, 18 bp, Artificial Sequence
  Synthetic DNA
taatacaactcaactgcg

SEQ ID NO: 36754 - DNA, 18 bp, Artificial Sequence
  Synthetic DNA
taatacaactctattaag

SEQ ID NO: 36755 - DNA, 18 bp, Artificial Sequence
  Synthetic DNA
taatacaagtaagtaaag

SEQ ID NO: 36756 - DNA, 18 bp, Artificial Sequence
  Synthetic DNA
taatacaagttacaacgg

SEQ ID NO: 36757 - DNA, 18 bp, Artificial Sequence
  Synthetic DNA
taatacaattcatgttag

SEQ ID NO: 36758 - DNA, 18 bp, Artificial Sequence
  Synthetic DNA
taatacacatcgctggag

SEQ ID NO: 36759 - DNA, 18 bp, Artificial Sequence
  Synthetic DNA
taatacagaccactgtag

SEQ ID NO: 36760 - DNA, 18 bp, Artificial Sequence
  Synthetic DNA
taatacagcactcaaaag

SEQ ID NO: 36761 - DNA, 18 bp, Artificial Sequence
  Synthetic DNA
taatacagctcacaaacg

SEQ ID NO: 36762 - DNA, 18 bp, Artificial Sequence
  Synthetic DNA
taatacagttcgcctttg

SEQ ID NO: 36763 - DNA, 18 bp, Artificial Sequence
  Synthetic DNA
taatacatatcaatattg

SEQ ID NO: 36764 - DNA, 18 bp, Artificial Sequence
  Synthetic DNA
taatacatatcactaata

SEQ ID NO: 36765 - DNA, 18 bp, Artificial Sequence
  Synthetic DNA
taatacatatcactttcg

SEQ ID NO: 36766 - DNA, 18 bp, Artificial Sequence
  Synthetic DNA
taatacatcacaccacag

SEQ ID NO: 36767 - DNA, 18 bp, Artificial Sequence
  Synthetic DNA
taatacatcacacttaag

SEQ ID NO: 36768 - DNA, 18 bp, Artificial Sequence
  Synthetic DNA
taatacatcgatctattg

SEQ ID NO: 36769 - DNA, 18 bp, Artificial Sequence
  Synthetic DNA
taatacatctcacctttg

SEQ ID NO: 36770 - DNA, 18 bp, Artificial Sequence
  Synthetic DNA
taatacatctctcaaacg

SEQ ID NO: 36771 - DNA, 18 bp, Artificial Sequence
  Synthetic DNA
taatacatctttctatta

SEQ ID NO: 36772 - DNA, 18 bp, Artificial Sequence
  Synthetic DNA
taatacattactctattg

SEQ ID NO: 36773 - DNA, 18 bp, Artificial Sequence
  Synthetic DNA
taataccacacgccattg

SEQ ID NO: 36774 - DNA, 18 bp, Artificial Sequence
  Synthetic DNA
taataccacagtctttag

SEQ ID NO: 36775 - DNA, 18 bp, Artificial Sequence
  Synthetic DNA
taataccactcatcgaag

SEQ ID NO: 36776 - DNA, 18 bp, Artificial Sequence
  Synthetic DNA
taataccatccataatag

SEQ ID NO: 36777 - DNA, 18 bp, Artificial Sequence
  Synthetic DNA
taataccattctttaaag

SEQ ID NO: 36778 - DNA, 18 bp, Artificial Sequence
  Synthetic DNA
taataccccatacaatag

SEQ ID NO: 36779 - DNA, 18 bp, Artificial Sequence
  Synthetic DNA
taatacctcatagtgtag

SEQ ID NO: 36780 - DNA, 18 bp, Artificial Sequence
  Synthetic DNA
taatacgaaactttctag

SEQ ID NO: 36781 - DNA, 18 bp, Artificial Sequence
  Synthetic DNA
taatacgaatacaaatag

SEQ ID NO: 36782 - DNA, 18 bp, Artificial Sequence
  Synthetic DNA
taatacgaatcaaaaatg

SEQ ID NO: 36783 - DNA, 18 bp, Artificial Sequence
  Synthetic DNA
taatacgaatgtctaagg

SEQ ID NO: 36784 - DNA, 18 bp, Artificial Sequence
  Synthetic DNA
taatacgacacatcaccg

SEQ ID NO: 36785 - DNA, 18 bp, Artificial Sequence
  Synthetic DNA
taatacgacacctattag

SEQ ID NO: 36786 - DNA, 18 bp, Artificial Sequence
  Synthetic DNA
taatacgacactctccgg

SEQ ID NO: 36787 - DNA, 18 bp, Artificial Sequence
  Synthetic DNA
taatacgacatacccttg

SEQ ID NO: 36788 - DNA, 18 bp, Artificial Sequence
  Synthetic DNA
taatacgaccctattaag

SEQ ID NO: 36789 - DNA, 18 bp, Artificial Sequence
  Synthetic DNA
taatacgaccctatttcg

SEQ ID NO: 36790 - DNA, 18 bp, Artificial Sequence
  Synthetic DNA
taatacgaccctctttta

SEQ ID NO: 36791 - DNA, 18 bp, Artificial Sequence
  Synthetic DNA
taatacgaccctgcggtg

SEQ ID NO: 36792 - DNA, 18 bp, Artificial Sequence
  Synthetic DNA
taatacgacctagtgaag

SEQ ID NO: 36793 - DNA, 18 bp, Artificial Sequence
  Synthetic DNA
taatacgactaaaggaag

SEQ ID NO: 36794 - DNA, 18 bp, Artificial Sequence
  Synthetic DNA
taatacgactctagactg

SEQ ID NO: 36795 - DNA, 18 bp, Artificial Sequence
  Synthetic DNA
taatacgactctattctg

SEQ ID NO: 36796 - DNA, 18 bp, Artificial Sequence
  Synthetic DNA
taatacgactctcttacc

SEQ ID NO: 36797 - DNA, 18 bp, Artificial Sequence
  Synthetic DNA
taatacgactctgtgatg

SEQ ID NO: 36798 - DNA, 18 bp, Artificial Sequence
  Synthetic DNA
taatacgactgtcttgtg

SEQ ID NO: 36799 - DNA, 18 bp, Artificial Sequence
  Synthetic DNA
taatacgagaaactcgtg

SEQ ID NO: 36800 - DNA, 18 bp, Artificial Sequence
  Synthetic DNA
taatacgagccttcttag

SEQ ID NO: 36801 - DNA, 18 bp, Artificial Sequence
  Synthetic DNA
taatacgagtcacagatg

SEQ ID NO: 36802 - DNA, 18 bp, Artificial Sequence
  Synthetic DNA
taatacgataaaccattg

SEQ ID NO: 36803 - DNA, 18 bp, Artificial Sequence
  Synthetic DNA
taatacgatatagttaag

SEQ ID NO: 36804 - DNA, 18 bp, Artificial Sequence
  Synthetic DNA
taatacgatgctgtattg

SEQ ID NO: 36805 - DNA, 18 bp, Artificial Sequence
  Synthetic DNA
taatacgattctcagaag

SEQ ID NO: 36806 - DNA, 18 bp, Artificial Sequence
  Synthetic DNA
taatacgattgacttacg

SEQ ID NO: 36807 - DNA, 18 bp, Artificial Sequence
  Synthetic DNA
taatacgcagccgtatag

SEQ ID NO: 36808 - DNA, 18 bp, Artificial Sequence
  Synthetic DNA
taatacgcatatcaacag

SEQ ID NO: 36809 - DNA, 18 bp, Artificial Sequence
  Synthetic DNA
taatacgcatcataattg

SEQ ID NO: 36810 - DNA, 18 bp, Artificial Sequence
  Synthetic DNA
taatacgccacagttttg

SEQ ID NO: 36811 - DNA, 18 bp, Artificial Sequence
  Synthetic DNA
taatacgccacatatttg

SEQ ID NO: 36812 - DNA, 18 bp, Artificial Sequence
  Synthetic DNA
taatacgccactcatttg

SEQ ID NO: 36813 - DNA, 18 bp, Artificial Sequence
  Synthetic DNA
taatacgccatactatta

SEQ ID NO: 36814 - DNA, 18 bp, Artificial Sequence
  Synthetic DNA
taatacgcctctaaaaag

SEQ ID NO: 36815 - DNA, 18 bp, Artificial Sequence
  Synthetic DNA
taatacgcctcttttttg

SEQ ID NO: 36816 - DNA, 18 bp, Artificial Sequence
  Synthetic DNA
taatacgctacagttaag

SEQ ID NO: 36817 - DNA, 18 bp, Artificial Sequence
  Synthetic DNA
taatacgcttcacagtgg

SEQ ID NO: 36818 - DNA, 18 bp, Artificial Sequence
  Synthetic DNA
taatacgcttcattaacg

SEQ ID NO: 36819 - DNA, 18 bp, Artificial Sequence
  Synthetic DNA
taatacgcttccctttcg

SEQ ID NO: 36820 - DNA, 18 bp, Artificial Sequence
  Synthetic DNA
taatacgcttctgaatag

SEQ ID NO: 36821 - DNA, 18 bp, Artificial Sequence
  Synthetic DNA
taatacggatcattttgg

SEQ ID NO: 36822 - DNA, 18 bp, Artificial Sequence
  Synthetic DNA
taatacggatctcttttg

SEQ ID NO: 36823 - DNA, 18 bp, Artificial Sequence
  Synthetic DNA
taatacggcagacttaag

SEQ ID NO: 36824 - DNA, 18 bp, Artificial Sequence
  Synthetic DNA
taatacggcattcaattg

SEQ ID NO: 36825 - DNA, 18 bp, Artificial Sequence
  Synthetic DNA
taatacggcccacaacgg

SEQ ID NO: 36826 - DNA, 18 bp, Artificial Sequence
  Synthetic DNA
taatacggccctcctcag

SEQ ID NO: 36827 - DNA, 18 bp, Artificial Sequence
  Synthetic DNA
taatacggctcacgccgg

SEQ ID NO: 36828 - DNA, 18 bp, Artificial Sequence
  Synthetic DNA
taatacggtaaactaatg

SEQ ID NO: 36829 - DNA, 18 bp, Artificial Sequence
  Synthetic DNA
taatacgtagctctgtag

SEQ ID NO: 36830 - DNA, 18 bp, Artificial Sequence
  Synthetic DNA
taatacgtataacctggg

SEQ ID NO: 36831 - DNA, 18 bp, Artificial Sequence
  Synthetic DNA
taatacgtataacttatg

SEQ ID NO: 36832 - DNA, 18 bp, Artificial Sequence
  Synthetic DNA
taatacgtatatcaacag

SEQ ID NO: 36833 - DNA, 18 bp, Artificial Sequence
  Synthetic DNA
taatacgtatcacgcttg

SEQ ID NO: 36834 - DNA, 18 bp, Artificial Sequence
  Synthetic DNA
taatacgtcaaactaacg

SEQ ID NO: 36835 - DNA, 18 bp, Artificial Sequence
  Synthetic DNA
taatacgtcacgttattg

SEQ ID NO: 36836 - DNA, 18 bp, Artificial Sequence
  Synthetic DNA
taatacgtcactccattg

SEQ ID NO: 36837 - DNA, 18 bp, Artificial Sequence
  Synthetic DNA
taatacgtcataatctag

SEQ ID NO: 36838 - DNA, 18 bp, Artificial Sequence
  Synthetic DNA
taatacgtcccacatttg

SEQ ID NO: 36839 - DNA, 18 bp, Artificial Sequence
  Synthetic DNA
taatacgtcccacttcgg

SEQ ID NO: 36840 - DNA, 18 bp, Artificial Sequence
  Synthetic DNA
taatacgtctaaatccag

SEQ ID NO: 36841 - DNA, 18 bp, Artificial Sequence
  Synthetic DNA
taatacgtctagcactag

SEQ ID NO: 36842 - DNA, 18 bp, Artificial Sequence
  Synthetic DNA
taatacgtctatccaaag

SEQ ID NO: 36843 - DNA, 18 bp, Artificial Sequence
  Synthetic DNA
taatacgtctatccattg

SEQ ID NO: 36844 - DNA, 18 bp, Artificial Sequence
  Synthetic DNA
taatacgtctcacacgtg

SEQ ID NO: 36845 - DNA, 18 bp, Artificial Sequence
  Synthetic DNA
taatacgtctgagcattg

SEQ ID NO: 36846 - DNA, 18 bp, Artificial Sequence
  Synthetic DNA
taatacgtctgcctaatg

SEQ ID NO: 36847 - DNA, 18 bp, Artificial Sequence
  Synthetic DNA
taatacgtcttaaggtag

SEQ ID NO: 36848 - DNA, 18 bp, Artificial Sequence
  Synthetic DNA
taatacgtcttcataaag

SEQ ID NO: 36849 - DNA, 18 bp, Artificial Sequence
  Synthetic DNA
taatacgtgaccctaaag

SEQ ID NO: 36850 - DNA, 18 bp, Artificial Sequence
  Synthetic DNA
taatacgtgcgactaaag

SEQ ID NO: 36851 - DNA, 18 bp, Artificial Sequence
  Synthetic DNA
taatacgtgtatttatag

SEQ ID NO: 36852 - DNA, 18 bp, Artificial Sequence
  Synthetic DNA
taatacgtgttgccaaag

SEQ ID NO: 36853 - DNA, 18 bp, Artificial Sequence
  Synthetic DNA
taatacgttaccagtaag

SEQ ID NO: 36854 - DNA, 18 bp, Artificial Sequence
  Synthetic DNA
taatacgttatacaatag

SEQ ID NO: 36855 - DNA, 18 bp, Artificial Sequence
  Synthetic DNA
taatacgttccacctttg

SEQ ID NO: 36856 - DNA, 18 bp, Artificial Sequence
  Synthetic DNA
taatacgttttaacatag

SEQ ID NO: 36857 - DNA, 18 bp, Artificial Sequence
  Synthetic DNA
taatactaaaatctatag

SEQ ID NO: 36858 - DNA, 18 bp, Artificial Sequence
  Synthetic DNA
taatactaaagatcattg

SEQ ID NO: 36859 - DNA, 18 bp, Artificial Sequence
  Synthetic DNA
taatactacaacctatgg

SEQ ID NO: 36860 - DNA, 18 bp, Artificial Sequence
  Synthetic DNA
taatactacacacaagcg

SEQ ID NO: 36861 - DNA, 18 bp, Artificial Sequence
  Synthetic DNA
taatactacacacttcgg

SEQ ID NO: 36862 - DNA, 18 bp, Artificial Sequence
  Synthetic DNA
taatactacacatttaag

SEQ ID NO: 36863 - DNA, 18 bp, Artificial Sequence
  Synthetic DNA
taatactacacgcaattg

SEQ ID NO: 36864 - DNA, 18 bp, Artificial Sequence
  Synthetic DNA
taatactacactcttaag

SEQ ID NO: 36865 - DNA, 18 bp, Artificial Sequence
  Synthetic DNA
taatactaccgtttatag

SEQ ID NO: 36866 - DNA, 18 bp, Artificial Sequence
  Synthetic DNA
taatactacctactttgg

SEQ ID NO: 36867 - DNA, 18 bp, Artificial Sequence
  Synthetic DNA
taatactacgcttcatag

SEQ ID NO: 36868 - DNA, 18 bp, Artificial Sequence
  Synthetic DNA
taatactactatgtaaag

SEQ ID NO: 36869 - DNA, 18 bp, Artificial Sequence
  Synthetic DNA
taatactactccgttcag

SEQ ID NO: 36870 - DNA, 18 bp, Artificial Sequence
  Synthetic DNA
taatactactgagaattg

SEQ ID NO: 36871 - DNA, 18 bp, Artificial Sequence
  Synthetic DNA
taatactattatctattg

SEQ ID NO: 36872 - DNA, 18 bp, Artificial Sequence
  Synthetic DNA
taatactattctctcctg

SEQ ID NO: 36873 - DNA, 18 bp, Artificial Sequence
  Synthetic DNA
taatactattgaattatg

SEQ ID NO: 36874 - DNA, 18 bp, Artificial Sequence
  Synthetic DNA
taatactccgaattatcg

SEQ ID NO: 36875 - DNA, 18 bp, Artificial Sequence
  Synthetic DNA
taatactcgtgactatcg

SEQ ID NO: 36876 - DNA, 18 bp, Artificial Sequence
  Synthetic DNA
taatactgattactttag

SEQ ID NO: 36877 - DNA, 18 bp, Artificial Sequence
  Synthetic DNA
taatactgcgcactcaag

SEQ ID NO: 36878 - DNA, 18 bp, Artificial Sequence
  Synthetic DNA
taatactgcgctaaacag

SEQ ID NO: 36879 - DNA, 18 bp, Artificial Sequence
  Synthetic DNA
taatactggtcactaatg

SEQ ID NO: 36880 - DNA, 18 bp, Artificial Sequence
  Synthetic DNA
taatactgtttacttaag

SEQ ID NO: 36881 - DNA, 18 bp, Artificial Sequence
  Synthetic DNA
taatacttcatattatag

SEQ ID NO: 36882 - DNA, 18 bp, Artificial Sequence
  Synthetic DNA
taatacttctaacattag

SEQ ID NO: 36883 - DNA, 18 bp, Artificial Sequence
  Synthetic DNA
taatacttctcgatattg

SEQ ID NO: 36884 - DNA, 18 bp, Artificial Sequence
  Synthetic DNA
taatacttctcttaatag

SEQ ID NO: 36885 - DNA, 18 bp, Artificial Sequence
  Synthetic DNA
taatacttcttaccattg

SEQ ID NO: 36886 - DNA, 18 bp, Artificial Sequence
  Synthetic DNA
taatacttcttactctcg

SEQ ID NO: 36887 - DNA, 18 bp, Artificial Sequence
  Synthetic DNA
taatacttggcactttag

SEQ ID NO: 36888 - DNA, 18 bp, Artificial Sequence
  Synthetic DNA
taatacttgtcactttcg

SEQ ID NO: 36889 - DNA, 18 bp, Artificial Sequence
  Synthetic DNA
taatacttgtctctagcg

SEQ ID NO: 36890 - DNA, 18 bp, Artificial Sequence
  Synthetic DNA
taatactttccaattgag

SEQ ID NO: 36891 - DNA, 18 bp, Artificial Sequence
  Synthetic DNA
taatagaactctttgttg

SEQ ID NO: 36892 - DNA, 18 bp, Artificial Sequence
  Synthetic DNA
taatagaacttacaacag

SEQ ID NO: 36893 - DNA, 18 bp, Artificial Sequence
  Synthetic DNA
taatagaagacttaattg

SEQ ID NO: 36894 - DNA, 18 bp, Artificial Sequence
  Synthetic DNA
taatagacctctctttag

SEQ ID NO: 36895 - DNA, 18 bp, Artificial Sequence
  Synthetic DNA
taatagcataaaataaag

SEQ ID NO: 36896 - DNA, 18 bp, Artificial Sequence
  Synthetic DNA
taataggaatctcctcag

SEQ ID NO: 36897 - DNA, 18 bp, Artificial Sequence
  Synthetic DNA
taataggaatgacgaaag

SEQ ID NO: 36898 - DNA, 18 bp, Artificial Sequence
  Synthetic DNA
taataggacagtctacag

SEQ ID NO: 36899 - DNA, 18 bp, Artificial Sequence
  Synthetic DNA
taataggactcacatatg

SEQ ID NO: 36900 - DNA, 18 bp, Artificial Sequence
  Synthetic DNA
taataggactcccttacg

SEQ ID NO: 36901 - DNA, 18 bp, Artificial Sequence
  Synthetic DNA
taataggactttctaatg

SEQ ID NO: 36902 - DNA, 18 bp, Artificial Sequence
  Synthetic DNA
taataggccacactcaag

SEQ ID NO: 36903 - DNA, 18 bp, Artificial Sequence
  Synthetic DNA
taataggcccctctattg

SEQ ID NO: 36904 - DNA, 18 bp, Artificial Sequence
  Synthetic DNA
taataggtatcacttaag

SEQ ID NO: 36905 - DNA, 18 bp, Artificial Sequence
  Synthetic DNA
taataggtctaataatcg

SEQ ID NO: 36906 - DNA, 18 bp, Artificial Sequence
  Synthetic DNA
taataggtctcaccttcg

SEQ ID NO: 36907 - DNA, 18 bp, Artificial Sequence
  Synthetic DNA
taataggtgtcacttcag

SEQ ID NO: 36908 - DNA, 18 bp, Artificial Sequence
  Synthetic DNA
taataggttaaactatag

SEQ ID NO: 36909 - DNA, 18 bp, Artificial Sequence
  Synthetic DNA
taatagtagtcacttctg

SEQ ID NO: 36910 - DNA, 18 bp, Artificial Sequence
  Synthetic DNA
taatataaatcactttcg

SEQ ID NO: 36911 - DNA, 18 bp, Artificial Sequence
  Synthetic DNA
taatataacacaacatag

SEQ ID NO: 36912 - DNA, 18 bp, Artificial Sequence
  Synthetic DNA
taatataacactatatag

SEQ ID NO: 36913 - DNA, 18 bp, Artificial Sequence
  Synthetic DNA
taatataactcaatgaag

SEQ ID NO: 36914 - DNA, 18 bp, Artificial Sequence
  Synthetic DNA
taatataactcactgatg

SEQ ID NO: 36915 - DNA, 18 bp, Artificial Sequence
  Synthetic DNA
taatataactcacttacg

SEQ ID NO: 36916 - DNA, 18 bp, Artificial Sequence
  Synthetic DNA
taatataactcattactg

SEQ ID NO: 36917 - DNA, 18 bp, Artificial Sequence
  Synthetic DNA
taatataactctctaagg

SEQ ID NO: 36918 - DNA, 18 bp, Artificial Sequence
  Synthetic DNA
taatataactgtctattg

SEQ ID NO: 36919 - DNA, 18 bp, Artificial Sequence
  Synthetic DNA
taatataacttaattagg

SEQ ID NO: 36920 - DNA, 18 bp, Artificial Sequence
  Synthetic DNA
taatatatcacaccattg

SEQ ID NO: 36921 - DNA, 18 bp, Artificial Sequence
  Synthetic DNA
taatatatcccattaaag

SEQ ID NO: 36922 - DNA, 18 bp, Artificial Sequence
  Synthetic DNA
taatatatcgctctattg

SEQ ID NO: 36923 - DNA, 18 bp, Artificial Sequence
  Synthetic DNA
taatatcacccacaattg

SEQ ID NO: 36924 - DNA, 18 bp, Artificial Sequence
  Synthetic DNA
taatatcacttcttatag

SEQ ID NO: 36925 - DNA, 18 bp, Artificial Sequence
  Synthetic DNA
taatatctcacccaagag

SEQ ID NO: 36926 - DNA, 18 bp, Artificial Sequence
  Synthetic DNA
taatatctctccctatcg

SEQ ID NO: 36927 - DNA, 18 bp, Artificial Sequence
  Synthetic DNA
taatatgaatgtatatag

SEQ ID NO: 36928 - DNA, 18 bp, Artificial Sequence
  Synthetic DNA
taatatgacaaaccaaag

SEQ ID NO: 36929 - DNA, 18 bp, Artificial Sequence
  Synthetic DNA
taatatgacacttcatag

SEQ ID NO: 36930 - DNA, 18 bp, Artificial Sequence
  Synthetic DNA
taatatgacatacctaag

SEQ ID NO: 36931 - DNA, 18 bp, Artificial Sequence
  Synthetic DNA
taatatgacccaatactg

SEQ ID NO: 36932 - DNA, 18 bp, Artificial Sequence
  Synthetic DNA
taatatgacgccatattg

SEQ ID NO: 36933 - DNA, 18 bp, Artificial Sequence
  Synthetic DNA
taatatgactaaatttgg

SEQ ID NO: 36934 - DNA, 18 bp, Artificial Sequence
  Synthetic DNA
taatatgactaactcgtg

SEQ ID NO: 36935 - DNA, 18 bp, Artificial Sequence
  Synthetic DNA
taatatgactcatataag

SEQ ID NO: 36936 - DNA, 18 bp, Artificial Sequence
  Synthetic DNA
taatatgactctacaatg

SEQ ID NO: 36937 - DNA, 18 bp, Artificial Sequence
  Synthetic DNA
taatatgactctattcag

SEQ ID NO: 36938 - DNA, 18 bp, Artificial Sequence
  Synthetic DNA
taatatgagcctctattg

SEQ ID NO: 36939 - DNA, 18 bp, Artificial Sequence
  Synthetic DNA
taatatgagtctctaatg

SEQ ID NO: 36940 - DNA, 18 bp, Artificial Sequence
  Synthetic DNA
taatatgagttaccttcg

SEQ ID NO: 36941 - DNA, 18 bp, Artificial Sequence
  Synthetic DNA
taatatgatatactatgg

SEQ ID NO: 36942 - DNA, 18 bp, Artificial Sequence
  Synthetic DNA
taatatgattatcttaag

SEQ ID NO: 36943 - DNA, 18 bp, Artificial Sequence
  Synthetic DNA
taatatgattcaccttgg

SEQ ID NO: 36944 - DNA, 18 bp, Artificial Sequence
  Synthetic DNA
taatatgattcactcgtg

SEQ ID NO: 36945 - DNA, 18 bp, Artificial Sequence
  Synthetic DNA
taatatgattggatacag

SEQ ID NO: 36946 - DNA, 18 bp, Artificial Sequence
  Synthetic DNA
taatatgcgttcctatag

SEQ ID NO: 36947 - DNA, 18 bp, Artificial Sequence
  Synthetic DNA
taatatggcactctagag

SEQ ID NO: 36948 - DNA, 18 bp, Artificial Sequence
  Synthetic DNA
taatatggcactcttttg

SEQ ID NO: 36949 - DNA, 18 bp, Artificial Sequence
  Synthetic DNA
taatatggctcaaaaatg

SEQ ID NO: 36950 - DNA, 18 bp, Artificial Sequence
  Synthetic DNA
taatatggctcatattag

SEQ ID NO: 36951 - DNA, 18 bp, Artificial Sequence
  Synthetic DNA
taatatggtccaccattg

SEQ ID NO: 36952 - DNA, 18 bp, Artificial Sequence
  Synthetic DNA
taatatgtataactgtag

SEQ ID NO: 36953 - DNA, 18 bp, Artificial Sequence
  Synthetic DNA
taatatgtctcaataaac

SEQ ID NO: 36954 - DNA, 18 bp, Artificial Sequence
  Synthetic DNA
taatatgtctcgcaaaag

SEQ ID NO: 36955 - DNA, 18 bp, Artificial Sequence
  Synthetic DNA
taatatgtttaacgcttg

SEQ ID NO: 36956 - DNA, 18 bp, Artificial Sequence
  Synthetic DNA
taatattactcaacatcg

SEQ ID NO: 36957 - DNA, 18 bp, Artificial Sequence
  Synthetic DNA
taatattactcatgacag

SEQ ID NO: 36958 - DNA, 18 bp, Artificial Sequence
  Synthetic DNA
taatattagtcctattag

SEQ ID NO: 36959 - DNA, 18 bp, Artificial Sequence
  Synthetic DNA
taatattattccctaaag

SEQ ID NO: 36960 - DNA, 18 bp, Artificial Sequence
  Synthetic DNA
taatattgctcacaatgg

SEQ ID NO: 36961 - DNA, 18 bp, Artificial Sequence
  Synthetic DNA
taatatttctcacttatg

SEQ ID NO: 36962 - DNA, 18 bp, Artificial Sequence
  Synthetic DNA
taatatttctcattagag

SEQ ID NO: 36963 - DNA, 18 bp, Artificial Sequence
  Synthetic DNA
taatatttgtcactttag

SEQ ID NO: 36964 - DNA, 18 bp, Artificial Sequence
  Synthetic DNA
taatcagacccacagtcg

SEQ ID NO: 36965 - DNA, 18 bp, Artificial Sequence
  Synthetic DNA
taatcagacccactgtcg

SEQ ID NO: 36966 - DNA, 18 bp, Artificial Sequence
  Synthetic DNA
taatcagccgcacaattg

SEQ ID NO: 36967 - DNA, 18 bp, Artificial Sequence
  Synthetic DNA
taatcagtcactctatag

SEQ ID NO: 36968 - DNA, 18 bp, Artificial Sequence
  Synthetic DNA
taatcagtccttccatag

SEQ ID NO: 36969 - DNA, 18 bp, Artificial Sequence
  Synthetic DNA
taatccaacatacgactg

SEQ ID NO: 36970 - DNA, 18 bp, Artificial Sequence
  Synthetic DNA
taatccaactgcccatag

SEQ ID NO: 36971 - DNA, 18 bp, Artificial Sequence
  Synthetic DNA
taatccagctcagtttag

SEQ ID NO: 36972 - DNA, 18 bp, Artificial Sequence
  Synthetic DNA
taatcccattcgttatag

SEQ ID NO: 36973 - DNA, 18 bp, Artificial Sequence
  Synthetic DNA
taatcccgctcaatctag

SEQ ID NO: 36974 - DNA, 18 bp, Artificial Sequence
  Synthetic DNA
taatccctctacctattg

SEQ ID NO: 36975 - DNA, 18 bp, Artificial Sequence
  Synthetic DNA
taatccctctctcataag

SEQ ID NO: 36976 - DNA, 18 bp, Artificial Sequence
  Synthetic DNA
taatccgaaattcaatag

SEQ ID NO: 36977 - DNA, 18 bp, Artificial Sequence
  Synthetic DNA
taatccgaactactttag

SEQ ID NO: 36978 - DNA, 18 bp, Artificial Sequence
  Synthetic DNA
taatccgactaagttcag

SEQ ID NO: 36979 - DNA, 18 bp, Artificial Sequence
  Synthetic DNA
taatccgactcaaaaatg

SEQ ID NO: 36980 - DNA, 18 bp, Artificial Sequence
  Synthetic DNA
taatccgactttctttcg

SEQ ID NO: 36981 - DNA, 18 bp, Artificial Sequence
  Synthetic DNA
taatccggatttctctcg

SEQ ID NO: 36982 - DNA, 18 bp, Artificial Sequence
  Synthetic DNA
taatccggttaggtgtag

SEQ ID NO: 36983 - DNA, 18 bp, Artificial Sequence
  Synthetic DNA
taatccgtcacagtaaag

SEQ ID NO: 36984 - DNA, 18 bp, Artificial Sequence
  Synthetic DNA
taatccgtctcaacattg

SEQ ID NO: 36985 - DNA, 18 bp, Artificial Sequence
  Synthetic DNA
taatccgtctcatatcag

SEQ ID NO: 36986 - DNA, 18 bp, Artificial Sequence
  Synthetic DNA
taatccgtctccctgtcg

SEQ ID NO: 36987 - DNA, 18 bp, Artificial Sequence
  Synthetic DNA
taatccgtctcgttaacg

SEQ ID NO: 36988 - DNA, 18 bp, Artificial Sequence
  Synthetic DNA
taatccgttacactgaag

SEQ ID NO: 36989 - DNA, 18 bp, Artificial Sequence
  Synthetic DNA
taatcctaataactatgg

SEQ ID NO: 36990 - DNA, 18 bp, Artificial Sequence
  Synthetic DNA
taatcctatgcacattag

SEQ ID NO: 36991 - DNA, 18 bp, Artificial Sequence
  Synthetic DNA
taatccttcacaaaaaag

SEQ ID NO: 36992 - DNA, 18 bp, Artificial Sequence
  Synthetic DNA
taatccttcatactttag

SEQ ID NO: 36993 - DNA, 18 bp, Artificial Sequence
  Synthetic DNA
taatccttctcacttttg

SEQ ID NO: 36994 - DNA, 18 bp, Artificial Sequence
  Synthetic DNA
taatccttttcactaaag

SEQ ID NO: 36995 - DNA, 18 bp, Artificial Sequence
  Synthetic DNA
taatcgaaatcactattg

SEQ ID NO: 36996 - DNA, 18 bp, Artificial Sequence
  Synthetic DNA
taatcgaacacaaattag

SEQ ID NO: 36997 - DNA, 18 bp, Artificial Sequence
  Synthetic DNA
taatcggacggagtaatg

SEQ ID NO: 36998 - DNA, 18 bp, Artificial Sequence
  Synthetic DNA
taatcggcttctctatag

SEQ ID NO: 36999 - DNA, 18 bp, Artificial Sequence
  Synthetic DNA
taatcgtactctttatag

SEQ ID NO: 37000 - DNA, 18 bp, Artificial Sequence
  Synthetic DNA
taatcgtgcgaacaaatg

SEQ ID NO: 37001 - DNA, 18 bp, Artificial Sequence
  Synthetic DNA
taatctgaataaccatag

SEQ ID NO: 37002 - DNA, 18 bp, Artificial Sequence
  Synthetic DNA
taatctgactctatgttg

SEQ ID NO: 37003 - DNA, 18 bp, Artificial Sequence
  Synthetic DNA
taatctgactctcaattg

SEQ ID NO: 37004 - DNA, 18 bp, Artificial Sequence
  Synthetic DNA
taatctgtgacatagtag

SEQ ID NO: 37005 - DNA, 18 bp, Artificial Sequence
  Synthetic DNA
taatgaatctctttatag

SEQ ID NO: 37006 - DNA, 18 bp, Artificial Sequence
  Synthetic DNA
taatgacattctctatag

SEQ ID NO: 37007 - DNA, 18 bp, Artificial Sequence
  Synthetic DNA
taatgagacacgctattg

SEQ ID NO: 37008 - DNA, 18 bp, Artificial Sequence
  Synthetic DNA
taatgagattgagtatgg

SEQ ID NO: 37009 - DNA, 18 bp, Artificial Sequence
  Synthetic DNA
taatgagcatcactatcg

SEQ ID NO: 37010 - DNA, 18 bp, Artificial Sequence
  Synthetic DNA
taatgaggttcaatattg

SEQ ID NO: 37011 - DNA, 18 bp, Artificial Sequence
  Synthetic DNA
taatgagtcatactttag

SEQ ID NO: 37012 - DNA, 18 bp, Artificial Sequence
  Synthetic DNA
taatgcaactctctgaag

SEQ ID NO: 37013 - DNA, 18 bp, Artificial Sequence
  Synthetic DNA
taatgcaattcattattg

SEQ ID NO: 37014 - DNA, 18 bp, Artificial Sequence
  Synthetic DNA
taatgcataacactatag

SEQ ID NO: 37015 - DNA, 18 bp, Artificial Sequence
  Synthetic DNA
taatgcatctcacttatg

SEQ ID NO: 37016 - DNA, 18 bp, Artificial Sequence
  Synthetic DNA
taatgcatctccttatag

SEQ ID NO: 37017 - DNA, 18 bp, Artificial Sequence
  Synthetic DNA
taatgccgctcgcataag

SEQ ID NO: 37018 - DNA, 18 bp, Artificial Sequence
  Synthetic DNA
taatgcgaatcaattttg

SEQ ID NO: 37019 - DNA, 18 bp, Artificial Sequence
  Synthetic DNA
taatgcgaatctcaaaag

SEQ ID NO: 37020 - DNA, 18 bp, Artificial Sequence
  Synthetic DNA
taatgcgaccccctagtg

SEQ ID NO: 37021 - DNA, 18 bp, Artificial Sequence
  Synthetic DNA
taatgcgactcccaaatg

SEQ ID NO: 37022 - DNA, 18 bp, Artificial Sequence
  Synthetic DNA
taatgcgatatactttag

SEQ ID NO: 37023 - DNA, 18 bp, Artificial Sequence
  Synthetic DNA
taatgcgattagataatg

SEQ ID NO: 37024 - DNA, 18 bp, Artificial Sequence
  Synthetic DNA
taatgcgatttagtctag

SEQ ID NO: 37025 - DNA, 18 bp, Artificial Sequence
  Synthetic DNA
taatgcgcctaacttgag

SEQ ID NO: 37026 - DNA, 18 bp, Artificial Sequence
  Synthetic DNA
taatgcgccttattagag

SEQ ID NO: 37027 - DNA, 18 bp, Artificial Sequence
  Synthetic DNA
taatgcgcttcactacac

SEQ ID NO: 37028 - DNA, 18 bp, Artificial Sequence
  Synthetic DNA
taatgcggctatctattg

SEQ ID NO: 37029 - DNA, 18 bp, Artificial Sequence
  Synthetic DNA
taatgcggttcagaattg

SEQ ID NO: 37030 - DNA, 18 bp, Artificial Sequence
  Synthetic DNA
taatgcgtataaataaag

SEQ ID NO: 37031 - DNA, 18 bp, Artificial Sequence
  Synthetic DNA
taatgcgtatttctaaag

SEQ ID NO: 37032 - DNA, 18 bp, Artificial Sequence
  Synthetic DNA
taatgcgtctcactcatg

SEQ ID NO: 37033 - DNA, 18 bp, Artificial Sequence
  Synthetic DNA
taatgcgtttctcaataa

SEQ ID NO: 37034 - DNA, 18 bp, Artificial Sequence
  Synthetic DNA
taatgctacagactatcg

SEQ ID NO: 37035 - DNA, 18 bp, Artificial Sequence
  Synthetic DNA
taatgctactctcaggag

SEQ ID NO: 37036 - DNA, 18 bp, Artificial Sequence
  Synthetic DNA
taatgctattcagtctag

SEQ ID NO: 37037 - DNA, 18 bp, Artificial Sequence
  Synthetic DNA
taatgctcgtcactttcg

SEQ ID NO: 37038 - DNA, 18 bp, Artificial Sequence
  Synthetic DNA
taatgctgccctctctag

SEQ ID NO: 37039 - DNA, 18 bp, Artificial Sequence
  Synthetic DNA
taatgcttttaacaatcg

SEQ ID NO: 37040 - DNA, 18 bp, Artificial Sequence
  Synthetic DNA
taatgggactcacgaatg

SEQ ID NO: 37041 - DNA, 18 bp, Artificial Sequence
  Synthetic DNA
taatgggattcaataaag

SEQ ID NO: 37042 - DNA, 18 bp, Artificial Sequence
  Synthetic DNA
taatgggccttactctag

SEQ ID NO: 37043 - DNA, 18 bp, Artificial Sequence
  Synthetic DNA
taatggtactcgcttcag

SEQ ID NO: 37044 - DNA, 18 bp, Artificial Sequence
  Synthetic DNA
taatgtgaatcacttaag

SEQ ID NO: 37045 - DNA, 18 bp, Artificial Sequence
  Synthetic DNA
taatgtgacacactgcag

SEQ ID NO: 37046 - DNA, 18 bp, Artificial Sequence
  Synthetic DNA
taatgtgacatagaactg

SEQ ID NO: 37047 - DNA, 18 bp, Artificial Sequence
  Synthetic DNA
taatgtgaccaataacag

SEQ ID NO: 37048 - DNA, 18 bp, Artificial Sequence
  Synthetic DNA
taatgtgacctcgtcacg

SEQ ID NO: 37049 - DNA, 18 bp, Artificial Sequence
  Synthetic DNA
taatgttaactaccatag

SEQ ID NO: 37050 - DNA, 18 bp, Artificial Sequence
  Synthetic DNA
taatgttactctctattg

SEQ ID NO: 37051 - DNA, 18 bp, Artificial Sequence
  Synthetic DNA
taatgtttcacaccatag

SEQ ID NO: 37052 - DNA, 18 bp, Artificial Sequence
  Synthetic DNA
taatgtttcttacaatag

SEQ ID NO: 37053 - DNA, 18 bp, Artificial Sequence
  Synthetic DNA
taattaaaaaccctattg

SEQ ID NO: 37054 - DNA, 18 bp, Artificial Sequence
  Synthetic DNA
taattaatctcactatcg

SEQ ID NO: 37055 - DNA, 18 bp, Artificial Sequence
  Synthetic DNA
taattacactcattattg

SEQ ID NO: 37056 - DNA, 18 bp, Artificial Sequence
  Synthetic DNA
taattagacataccttag

SEQ ID NO: 37057 - DNA, 18 bp, Artificial Sequence
  Synthetic DNA
taattagactcattttgg

SEQ ID NO: 37058 - DNA, 18 bp, Artificial Sequence
  Synthetic DNA
taattagattaaataaag

SEQ ID NO: 37059 - DNA, 18 bp, Artificial Sequence
  Synthetic DNA
taattagcctcgttaaag

SEQ ID NO: 37060 - DNA, 18 bp, Artificial Sequence
  Synthetic DNA
taattaggctcttaatag

SEQ ID NO: 37061 - DNA, 18 bp, Artificial Sequence
  Synthetic DNA
taattagtcacattatag

SEQ ID NO: 37062 - DNA, 18 bp, Artificial Sequence
  Synthetic DNA
taattagtcacattctag

SEQ ID NO: 37063 - DNA, 18 bp, Artificial Sequence
  Synthetic DNA
taattagtctctatattg

SEQ ID NO: 37064 - DNA, 18 bp, Artificial Sequence
  Synthetic DNA
taattataacatatatgg

SEQ ID NO: 37065 - DNA, 18 bp, Artificial Sequence
  Synthetic DNA
taattcaacactatatag

SEQ ID NO: 37066 - DNA, 18 bp, Artificial Sequence
  Synthetic DNA
taattcaacactctataa

SEQ ID NO: 37067 - DNA, 18 bp, Artificial Sequence
  Synthetic DNA
taattcaacatagtttag

SEQ ID NO: 37068 - DNA, 18 bp, Artificial Sequence
  Synthetic DNA
taattcaactcacattgg

SEQ ID NO: 37069 - DNA, 18 bp, Artificial Sequence
  Synthetic DNA
taattcaactcaccttcg

SEQ ID NO: 37070 - DNA, 18 bp, Artificial Sequence
  Synthetic DNA
taattcaacttaatatcg

SEQ ID NO: 37071 - DNA, 18 bp, Artificial Sequence
  Synthetic DNA
taattcaacttatatcag

SEQ ID NO: 37072 - DNA, 18 bp, Artificial Sequence
  Synthetic DNA
taattcatatcaatgtag

SEQ ID NO: 37073 - DNA, 18 bp, Artificial Sequence
  Synthetic DNA
taattcatcacagtatag

SEQ ID NO: 37074 - DNA, 18 bp, Artificial Sequence
  Synthetic DNA
taattcatcatactgttg

SEQ ID NO: 37075 - DNA, 18 bp, Artificial Sequence
  Synthetic DNA
taattcatctgtcaatcg

SEQ ID NO: 37076 - DNA, 18 bp, Artificial Sequence
  Synthetic DNA
taattcatgtcattttag

SEQ ID NO: 37077 - DNA, 18 bp, Artificial Sequence
  Synthetic DNA
taattccaaccattatag

SEQ ID NO: 37078 - DNA, 18 bp, Artificial Sequence
  Synthetic DNA
taattccaatcactgcag

SEQ ID NO: 37079 - DNA, 18 bp, Artificial Sequence
  Synthetic DNA
taattccacactgtaatg

SEQ ID NO: 37080 - DNA, 18 bp, Artificial Sequence
  Synthetic DNA
taattccacccaccacag

SEQ ID NO: 37081 - DNA, 18 bp, Artificial Sequence
  Synthetic DNA
taattccactctcttatg

SEQ ID NO: 37082 - DNA, 18 bp, Artificial Sequence
  Synthetic DNA
taattccgtactcaatcg

SEQ ID NO: 37083 - DNA, 18 bp, Artificial Sequence
  Synthetic DNA
taattcctcacactgtag

SEQ ID NO: 37084 - DNA, 18 bp, Artificial Sequence
  Synthetic DNA
taattcgaaacaataaag

SEQ ID NO: 37085 - DNA, 18 bp, Artificial Sequence
  Synthetic DNA
taattcgaaccacgattg

SEQ ID NO: 37086 - DNA, 18 bp, Artificial Sequence
  Synthetic DNA
taattcgaatcgcaatgg

SEQ ID NO: 37087 - DNA, 18 bp, Artificial Sequence
  Synthetic DNA
taattcgacaaagtttag

SEQ ID NO: 37088 - DNA, 18 bp, Artificial Sequence
  Synthetic DNA
taattcgacagacatgag

SEQ ID NO: 37089 - DNA, 18 bp, Artificial Sequence
  Synthetic DNA
taattcgaccaacaaaag

SEQ ID NO: 37090 - DNA, 18 bp, Artificial Sequence
  Synthetic DNA
taattcgactcaaattcg

SEQ ID NO: 37091 - DNA, 18 bp, Artificial Sequence
  Synthetic DNA
taattcgactcacgtgcg

SEQ ID NO: 37092 - DNA, 18 bp, Artificial Sequence
  Synthetic DNA
taattcgactcatacttg

SEQ ID NO: 37093 - DNA, 18 bp, Artificial Sequence
  Synthetic DNA
taattcgacttgccttag

SEQ ID NO: 37094 - DNA, 18 bp, Artificial Sequence
  Synthetic DNA
taattcgagtctcataag

SEQ ID NO: 37095 - DNA, 18 bp, Artificial Sequence
  Synthetic DNA
taattcgatactctatgg

SEQ ID NO: 37096 - DNA, 18 bp, Artificial Sequence
  Synthetic DNA
taattcgattcctgatag

SEQ ID NO: 37097 - DNA, 18 bp, Artificial Sequence
  Synthetic DNA
taattcgattctgtatcg

SEQ ID NO: 37098 - DNA, 18 bp, Artificial Sequence
  Synthetic DNA
taattcgcatccctaaag

SEQ ID NO: 37099 - DNA, 18 bp, Artificial Sequence
  Synthetic DNA
taattcgcctaacttttg

SEQ ID NO: 37100 - DNA, 18 bp, Artificial Sequence
  Synthetic DNA
taattcgctccactacag

SEQ ID NO: 37101 - DNA, 18 bp, Artificial Sequence
  Synthetic DNA
taattcggatcacattag

SEQ ID NO: 37102 - DNA, 18 bp, Artificial Sequence
  Synthetic DNA
taattcggcgcactaagg

SEQ ID NO: 37103 - DNA, 18 bp, Artificial Sequence
  Synthetic DNA
taattcggttcagcatag

SEQ ID NO: 37104 - DNA, 18 bp, Artificial Sequence
  Synthetic DNA
taattcgtatccatattg

SEQ ID NO: 37105 - DNA, 18 bp, Artificial Sequence
  Synthetic DNA
taattcgtctaatgatag

SEQ ID NO: 37106 - DNA, 18 bp, Artificial Sequence
  Synthetic DNA
taattcgtctcataatcg

SEQ ID NO: 37107 - DNA, 18 bp, Artificial Sequence
  Synthetic DNA
taattcgtctctccatcg

SEQ ID NO: 37108 - DNA, 18 bp, Artificial Sequence
  Synthetic DNA
taattcgtctgaacatag

SEQ ID NO: 37109 - DNA, 18 bp, Artificial Sequence
  Synthetic DNA
taattcgtcttactagtg

SEQ ID NO: 37110 - DNA, 18 bp, Artificial Sequence
  Synthetic DNA
taattcgttccaatgtag

SEQ ID NO: 37111 - DNA, 18 bp, Artificial Sequence
  Synthetic DNA
taattcgtttcattaaag

SEQ ID NO: 37112 - DNA, 18 bp, Artificial Sequence
  Synthetic DNA
taattcgtttcattattg

SEQ ID NO: 37113 - DNA, 18 bp, Artificial Sequence
  Synthetic DNA
taattctacacactcaag

SEQ ID NO: 37114 - DNA, 18 bp, Artificial Sequence
  Synthetic DNA
taattctacacatagtag

SEQ ID NO: 37115 - DNA, 18 bp, Artificial Sequence
  Synthetic DNA
taattctactaaatagcg

SEQ ID NO: 37116 - DNA, 18 bp, Artificial Sequence
  Synthetic DNA
taattctactatcaatcg

SEQ ID NO: 37117 - DNA, 18 bp, Artificial Sequence
  Synthetic DNA
taattctactcagattag

SEQ ID NO: 37118 - DNA, 18 bp, Artificial Sequence
  Synthetic DNA
taattctactcagtagtg

SEQ ID NO: 37119 - DNA, 18 bp, Artificial Sequence
  Synthetic DNA
taattctactcgcttttg

SEQ ID NO: 37120 - DNA, 18 bp, Artificial Sequence
  Synthetic DNA
taattctactctgtaatg

SEQ ID NO: 37121 - DNA, 18 bp, Artificial Sequence
  Synthetic DNA
taattctactgccaatag

SEQ ID NO: 37122 - DNA, 18 bp, Artificial Sequence
  Synthetic DNA
taattctacttgttacag

SEQ ID NO: 37123 - DNA, 18 bp, Artificial Sequence
  Synthetic DNA
taattctactttctaaag

SEQ ID NO: 37124 - DNA, 18 bp, Artificial Sequence
  Synthetic DNA
taattctatctacactag

SEQ ID NO: 37125 - DNA, 18 bp, Artificial Sequence
  Synthetic DNA
taattctcctcatttgag

SEQ ID NO: 37126 - DNA, 18 bp, Artificial Sequence
  Synthetic DNA
taattcttcgcattatag

SEQ ID NO: 37127 - DNA, 18 bp, Artificial Sequence
  Synthetic DNA
taattcttctcaccaaag

SEQ ID NO: 37128 - DNA, 18 bp, Artificial Sequence
  Synthetic DNA
taattcttctcataatag

SEQ ID NO: 37129 - DNA, 18 bp, Artificial Sequence
  Synthetic DNA
taattcttctcgctaaag

SEQ ID NO: 37130 - DNA, 18 bp, Artificial Sequence
  Synthetic DNA
taattcttctctaaattg

SEQ ID NO: 37131 - DNA, 18 bp, Artificial Sequence
  Synthetic DNA
taattcttctctcattag

SEQ ID NO: 37132 - DNA, 18 bp, Artificial Sequence
  Synthetic DNA
taattgagctctctatag

SEQ ID NO: 37133 - DNA, 18 bp, Artificial Sequence
  Synthetic DNA
taattgatatcttcaagg

SEQ ID NO: 37134 - DNA, 18 bp, Artificial Sequence
  Synthetic DNA
taattgatctcactagta

SEQ ID NO: 37135 - DNA, 18 bp, Artificial Sequence
  Synthetic DNA
taattgcacttacttatg

SEQ ID NO: 37136 - DNA, 18 bp, Artificial Sequence
  Synthetic DNA
taattggacacacaaaag

SEQ ID NO: 37137 - DNA, 18 bp, Artificial Sequence
  Synthetic DNA
taattggaccctcattag

SEQ ID NO: 37138 - DNA, 18 bp, Artificial Sequence
  Synthetic DNA
taattggattcactaagg

SEQ ID NO: 37139 - DNA, 18 bp, Artificial Sequence
  Synthetic DNA
taattggccgcgctcttg

SEQ ID NO: 37140 - DNA, 18 bp, Artificial Sequence
  Synthetic DNA
taattgggctctcaatag

SEQ ID NO: 37141 - DNA, 18 bp, Artificial Sequence
  Synthetic DNA
taattgggctctcttttg

SEQ ID NO: 37142 - DNA, 18 bp, Artificial Sequence
  Synthetic DNA
taattggtataactatcg

SEQ ID NO: 37143 - DNA, 18 bp, Artificial Sequence
  Synthetic DNA
taattggtctaacaattg

SEQ ID NO: 37144 - DNA, 18 bp, Artificial Sequence
  Synthetic DNA
taattggtctcactctgg

SEQ ID NO: 37145 - DNA, 18 bp, Artificial Sequence
  Synthetic DNA
taatttatttcacaatag

SEQ ID NO: 37146 - DNA, 18 bp, Artificial Sequence
  Synthetic DNA
taatttcaaacactatag

SEQ ID NO: 37147 - DNA, 18 bp, Artificial Sequence
  Synthetic DNA
taatttctctcactaaag

SEQ ID NO: 37148 - DNA, 18 bp, Artificial Sequence
  Synthetic DNA
taatttgaatcagtatcg

SEQ ID NO: 37149 - DNA, 18 bp, Artificial Sequence
  Synthetic DNA
taatttgacagactattg

SEQ ID NO: 37150 - DNA, 18 bp, Artificial Sequence
  Synthetic DNA
taatttgacccgcattcg

SEQ ID NO: 37151 - DNA, 18 bp, Artificial Sequence
  Synthetic DNA
taatttgactaaatgtag

SEQ ID NO: 37152 - DNA, 18 bp, Artificial Sequence
  Synthetic DNA
taatttgactagttgtag

SEQ ID NO: 37153 - DNA, 18 bp, Artificial Sequence
  Synthetic DNA
taatttgactatagattg

SEQ ID NO: 37154 - DNA, 18 bp, Artificial Sequence
  Synthetic DNA
taatttgactcattgttg

SEQ ID NO: 37155 - DNA, 18 bp, Artificial Sequence
  Synthetic DNA
taatttgactccctcttg

SEQ ID NO: 37156 - DNA, 18 bp, Artificial Sequence
  Synthetic DNA
taatttgactcctaatag

SEQ ID NO: 37157 - DNA, 18 bp, Artificial Sequence
  Synthetic DNA
taatttgactcggtattg

SEQ ID NO: 37158 - DNA, 18 bp, Artificial Sequence
  Synthetic DNA
taatttgactttctatcg

SEQ ID NO: 37159 - DNA, 18 bp, Artificial Sequence
  Synthetic DNA
taatttgagtttatatag

SEQ ID NO: 37160 - DNA, 18 bp, Artificial Sequence
  Synthetic DNA
taatttgattctctctag

SEQ ID NO: 37161 - DNA, 18 bp, Artificial Sequence
  Synthetic DNA
taatttgcctcactgttg

SEQ ID NO: 37162 - DNA, 18 bp, Artificial Sequence
  Synthetic DNA
taatttgcctcattttag

SEQ ID NO: 37163 - DNA, 18 bp, Artificial Sequence
  Synthetic DNA
taatttgtcggactattg

SEQ ID NO: 37164 - DNA, 18 bp, Artificial Sequence
  Synthetic DNA
taatttgtctagctatag

SEQ ID NO: 37165 - DNA, 18 bp, Artificial Sequence
  Synthetic DNA
taatttgtctcaaaaaag

SEQ ID NO: 37166 - DNA, 18 bp, Artificial Sequence
  Synthetic DNA
taattttactctctataa

SEQ ID NO: 37167 - DNA, 18 bp, Artificial Sequence
  Synthetic DNA
taattttactttctaaag

SEQ ID NO: 37168 - DNA, 18 bp, Artificial Sequence
  Synthetic DNA
taatttttctacccatag

SEQ ID NO: 37169 - DNA, 18 bp, Artificial Sequence
  Synthetic DNA
tacaaactttcactatag

SEQ ID NO: 37170 - DNA, 18 bp, Artificial Sequence
  Synthetic DNA
tacaaagactcacaattg

SEQ ID NO: 37171 - DNA, 18 bp, Artificial Sequence
  Synthetic DNA
tacaaagtctccctatcg

SEQ ID NO: 37172 - DNA, 18 bp, Artificial Sequence
  Synthetic DNA
tacaacaacacactaaag

SEQ ID NO: 37173 - DNA, 18 bp, Artificial Sequence
  Synthetic DNA
tacaacaacattctttag

SEQ ID NO: 37174 - DNA, 18 bp, Artificial Sequence
  Synthetic DNA
tacaacgaatcataatag

SEQ ID NO: 37175 - DNA, 18 bp, Artificial Sequence
  Synthetic DNA
tacaacgacaatctctag

SEQ ID NO: 37176 - DNA, 18 bp, Artificial Sequence
  Synthetic DNA
tacaacggttcactaaag

SEQ ID NO: 37177 - DNA, 18 bp, Artificial Sequence
  Synthetic DNA
tacaacttctctctatag

SEQ ID NO: 37178 - DNA, 18 bp, Artificial Sequence
  Synthetic DNA
tacaaggattcacaaaag

SEQ ID NO: 37179 - DNA, 18 bp, Artificial Sequence
  Synthetic DNA
tacaaggtctaattttag

SEQ ID NO: 37180 - DNA, 18 bp, Artificial Sequence
  Synthetic DNA
tacaataactcacaatcg

SEQ ID NO: 37181 - DNA, 18 bp, Artificial Sequence
  Synthetic DNA
tacaatgtgtcacaatag

SEQ ID NO: 37182 - DNA, 18 bp, Artificial Sequence
  Synthetic DNA
tacaattattcgctatag

SEQ ID NO: 37183 - DNA, 18 bp, Artificial Sequence
  Synthetic DNA
tacaatttctgactgtag

SEQ ID NO: 37184 - DNA, 18 bp, Artificial Sequence
  Synthetic DNA
tacacccacccactattg

SEQ ID NO: 37185 - DNA, 18 bp, Artificial Sequence
  Synthetic DNA
tacaccggctcacaatag

SEQ ID NO: 37186 - DNA, 18 bp, Artificial Sequence
  Synthetic DNA
tacacctagtcactattg

SEQ ID NO: 37187 - DNA, 18 bp, Artificial Sequence
  Synthetic DNA
tacactgactcactggag

SEQ ID NO: 37188 - DNA, 18 bp, Artificial Sequence
  Synthetic DNA
tacagcggttcactatag

SEQ ID NO: 37189 - DNA, 18 bp, Artificial Sequence
  Synthetic DNA
tacagcttttcgccatag

SEQ ID NO: 37190 - DNA, 18 bp, Artificial Sequence
  Synthetic DNA
tacatcgaattactatag

SEQ ID NO: 37191 - DNA, 18 bp, Artificial Sequence
  Synthetic DNA
tacatcgactatattcag

SEQ ID NO: 37192 - DNA, 18 bp, Artificial Sequence
  Synthetic DNA
tacatcgactcactgtcg

SEQ ID NO: 37193 - DNA, 18 bp, Artificial Sequence
  Synthetic DNA
tacatcgactcagtattg

SEQ ID NO: 37194 - DNA, 18 bp, Artificial Sequence
  Synthetic DNA
tacatggtctctatatag

SEQ ID NO: 37195 - DNA, 18 bp, Artificial Sequence
  Synthetic DNA
taccacaattcaccttag

SEQ ID NO: 37196 - DNA, 18 bp, Artificial Sequence
  Synthetic DNA
taccacatcttactatag

SEQ ID NO: 37197 - DNA, 18 bp, Artificial Sequence
  Synthetic DNA
taccacctctcaatagag

SEQ ID NO: 37198 - DNA, 18 bp, Artificial Sequence
  Synthetic DNA
taccgccacaggctatag

SEQ ID NO: 37199 - DNA, 18 bp, Artificial Sequence
  Synthetic DNA
tacctagactcactagtg

SEQ ID NO: 37200 - DNA, 18 bp, Artificial Sequence
  Synthetic DNA
tacctcgactcattgttg

SEQ ID NO: 37201 - DNA, 18 bp, Artificial Sequence
  Synthetic DNA
tacctcgtcataatatag

SEQ ID NO: 37202 - DNA, 18 bp, Artificial Sequence
  Synthetic DNA
tacgacgtctatctaacg

SEQ ID NO: 37203 - DNA, 18 bp, Artificial Sequence
  Synthetic DNA
tacgatttctcactaaag

SEQ ID NO: 37204 - DNA, 18 bp, Artificial Sequence
  Synthetic DNA
tacgtccttagcctaaag

SEQ ID NO: 37205 - DNA, 18 bp, Artificial Sequence
  Synthetic DNA
tactaaaactcaccattg

SEQ ID NO: 37206 - DNA, 18 bp, Artificial Sequence
  Synthetic DNA
tactaaatcactttatag

SEQ ID NO: 37207 - DNA, 18 bp, Artificial Sequence
  Synthetic DNA
tactaagacatgctatag

SEQ ID NO: 37208 - DNA, 18 bp, Artificial Sequence
  Synthetic DNA
tactaagccccactatcg

SEQ ID NO: 37209 - DNA, 18 bp, Artificial Sequence
  Synthetic DNA
tactaaggataactaaag

SEQ ID NO: 37210 - DNA, 18 bp, Artificial Sequence
  Synthetic DNA
tactaataccaactttag

SEQ ID NO: 37211 - DNA, 18 bp, Artificial Sequence
  Synthetic DNA
tactacaactcacagaag

SEQ ID NO: 37212 - DNA, 18 bp, Artificial Sequence
  Synthetic DNA
tactacaacttactgctg

SEQ ID NO: 37213 - DNA, 18 bp, Artificial Sequence
  Synthetic DNA
tactacaacttactttcg

SEQ ID NO: 37214 - DNA, 18 bp, Artificial Sequence
  Synthetic DNA
tactacacctctcttgag

SEQ ID NO: 37215 - DNA, 18 bp, Artificial Sequence
  Synthetic DNA
tactacatcatattattg

SEQ ID NO: 37216 - DNA, 18 bp, Artificial Sequence
  Synthetic DNA
tactaccaataactaaag

SEQ ID NO: 37217 - DNA, 18 bp, Artificial Sequence
  Synthetic DNA
tactaccactcacttatg

SEQ ID NO: 37218 - DNA, 18 bp, Artificial Sequence
  Synthetic DNA
tactaccattcaacaaag

SEQ ID NO: 37219 - DNA, 18 bp, Artificial Sequence
  Synthetic DNA
tactacgaaaacatctgg

SEQ ID NO: 37220 - DNA, 18 bp, Artificial Sequence
  Synthetic DNA
tactacgaatcaaaagag

SEQ ID NO: 37221 - DNA, 18 bp, Artificial Sequence
  Synthetic DNA
tactacgacaaataatag

SEQ ID NO: 37222 - DNA, 18 bp, Artificial Sequence
  Synthetic DNA
tactacgacccattagtg

SEQ ID NO: 37223 - DNA, 18 bp, Artificial Sequence
  Synthetic DNA
tactacgacgtattaaag

SEQ ID NO: 37224 - DNA, 18 bp, Artificial Sequence
  Synthetic DNA
tactacgactgaccactg

SEQ ID NO: 37225 - DNA, 18 bp, Artificial Sequence
  Synthetic DNA
tactacgactgatcattg

SEQ ID NO: 37226 - DNA, 18 bp, Artificial Sequence
  Synthetic DNA
tactacgacttgtaatag

SEQ ID NO: 37227 - DNA, 18 bp, Artificial Sequence
  Synthetic DNA
tactacgctccactttag

SEQ ID NO: 37228 - DNA, 18 bp, Artificial Sequence
  Synthetic DNA
tactacggctctctaagg

SEQ ID NO: 37229 - DNA, 18 bp, Artificial Sequence
  Synthetic DNA
tactacgtatcactcttg

SEQ ID NO: 37230 - DNA, 18 bp, Artificial Sequence
  Synthetic DNA
tactacgtcactcgttag

SEQ ID NO: 37231 - DNA, 18 bp, Artificial Sequence
  Synthetic DNA
tactacgtcagtctatag

SEQ ID NO: 37232 - DNA, 18 bp, Artificial Sequence
  Synthetic DNA
tactacgtttgaccatag

SEQ ID NO: 37233 - DNA, 18 bp, Artificial Sequence
  Synthetic DNA
tactactacacgcattgg

SEQ ID NO: 37234 - DNA, 18 bp, Artificial Sequence
  Synthetic DNA
tactactataaactatag

SEQ ID NO: 37235 - DNA, 18 bp, Artificial Sequence
  Synthetic DNA
tactaggactcgctacgg

SEQ ID NO: 37236 - DNA, 18 bp, Artificial Sequence
  Synthetic DNA
tactagggatcacattag

SEQ ID NO: 37237 - DNA, 18 bp, Artificial Sequence
  Synthetic DNA
tactataaccccctttgg

SEQ ID NO: 37238 - DNA, 18 bp, Artificial Sequence
  Synthetic DNA
tactataagtctctatag

SEQ ID NO: 37239 - DNA, 18 bp, Artificial Sequence
  Synthetic DNA
tactatcactcacgaaag

SEQ ID NO: 37240 - DNA, 18 bp, Artificial Sequence
  Synthetic DNA
tactatgactcaacattg

SEQ ID NO: 37241 - DNA, 18 bp, Artificial Sequence
  Synthetic DNA
tactatgcctcgccactg

SEQ ID NO: 37242 - DNA, 18 bp, Artificial Sequence
  Synthetic DNA
tactatggctcatcaagg

SEQ ID NO: 37243 - DNA, 18 bp, Artificial Sequence
  Synthetic DNA
tactcagactctctttag

SEQ ID NO: 37244 - DNA, 18 bp, Artificial Sequence
  Synthetic DNA
tactctcactcccaatag

SEQ ID NO: 37245 - DNA, 18 bp, Artificial Sequence
  Synthetic DNA
tactctgtctctctattg

SEQ ID NO: 37246 - DNA, 18 bp, Artificial Sequence
  Synthetic DNA
tactgcgaatcacaacag

SEQ ID NO: 37247 - DNA, 18 bp, Artificial Sequence
  Synthetic DNA
tactgcgactcaatatca

SEQ ID NO: 37248 - DNA, 18 bp, Artificial Sequence
  Synthetic DNA
tactgcgcctcaattttg

SEQ ID NO: 37249 - DNA, 18 bp, Artificial Sequence
  Synthetic DNA
tactgcgtctctcaaaag

SEQ ID NO: 37250 - DNA, 18 bp, Artificial Sequence
  Synthetic DNA
tacttagactcactaatg

SEQ ID NO: 37251 - DNA, 18 bp, Artificial Sequence
  Synthetic DNA
tacttcatctcaatgtag

SEQ ID NO: 37252 - DNA, 18 bp, Artificial Sequence
  Synthetic DNA
tacttccactctctatcg

SEQ ID NO: 37253 - DNA, 18 bp, Artificial Sequence
  Synthetic DNA
tacttcctctcaggatag

SEQ ID NO: 37254 - DNA, 18 bp, Artificial Sequence
  Synthetic DNA
tacttcgacacccgtttg

SEQ ID NO: 37255 - DNA, 18 bp, Artificial Sequence
  Synthetic DNA
tacttcgaccgactattg

SEQ ID NO: 37256 - DNA, 18 bp, Artificial Sequence
  Synthetic DNA
tacttcgactatcaagtg

SEQ ID NO: 37257 - DNA, 18 bp, Artificial Sequence
  Synthetic DNA
tacttcgactctctgaag

SEQ ID NO: 37258 - DNA, 18 bp, Artificial Sequence
  Synthetic DNA
tacttcgtttcattatag

SEQ ID NO: 37259 - DNA, 18 bp, Artificial Sequence
  Synthetic DNA
tacttctattttctattg

SEQ ID NO: 37260 - DNA, 18 bp, Artificial Sequence
  Synthetic DNA
tacttgggttaattcaag

SEQ ID NO: 37261 - DNA, 18 bp, Artificial Sequence
  Synthetic DNA
tacttggtctcaccatag

SEQ ID NO: 37262 - DNA, 18 bp, Artificial Sequence
  Synthetic DNA
tactttaacttactttag

SEQ ID NO: 37263 - DNA, 18 bp, Artificial Sequence
  Synthetic DNA
tactttgactcaaaatag

SEQ ID NO: 37264 - DNA, 18 bp, Artificial Sequence
  Synthetic DNA
tactttgactgactaaag

SEQ ID NO: 37265 - DNA, 18 bp, Artificial Sequence
  Synthetic DNA
tagaaagattcactaatg

SEQ ID NO: 37266 - DNA, 18 bp, Artificial Sequence
  Synthetic DNA
tagaacatatcactacag

SEQ ID NO: 37267 - DNA, 18 bp, Artificial Sequence
  Synthetic DNA
tagaacgaatcgcaatag

SEQ ID NO: 37268 - DNA, 18 bp, Artificial Sequence
  Synthetic DNA
tagaacgacttgccatag

SEQ ID NO: 37269 - DNA, 18 bp, Artificial Sequence
  Synthetic DNA
tagaacgagtcaataacg

SEQ ID NO: 37270 - DNA, 18 bp, Artificial Sequence
  Synthetic DNA
tagaacgatccactcttg

SEQ ID NO: 37271 - DNA, 18 bp, Artificial Sequence
  Synthetic DNA
tagaacgccttactgacg

SEQ ID NO: 37272 - DNA, 18 bp, Artificial Sequence
  Synthetic DNA
tagaacggcactcttcag

SEQ ID NO: 37273 - DNA, 18 bp, Artificial Sequence
  Synthetic DNA
tagaacgtcaccctattg

SEQ ID NO: 37274 - DNA, 18 bp, Artificial Sequence
  Synthetic DNA
tagaacgtctcacaacag

SEQ ID NO: 37275 - DNA, 18 bp, Artificial Sequence
  Synthetic DNA
tagaacgtcttactctag

SEQ ID NO: 37276 - DNA, 18 bp, Artificial Sequence
  Synthetic DNA
tagaacgtcttagtatag

SEQ ID NO: 37277 - DNA, 18 bp, Artificial Sequence
  Synthetic DNA
tagaaggattcactacag

SEQ ID NO: 37278 - DNA, 18 bp, Artificial Sequence
  Synthetic DNA
tagaccgactaaccatag

SEQ ID NO: 37279 - DNA, 18 bp, Artificial Sequence
  Synthetic DNA
tagaccgacttaatatag

SEQ ID NO: 37280 - DNA, 18 bp, Artificial Sequence
  Synthetic DNA
tagatcaccgaactattg

SEQ ID NO: 37281 - DNA, 18 bp, Artificial Sequence
  Synthetic DNA
tagatccactcacaatgg

SEQ ID NO: 37282 - DNA, 18 bp, Artificial Sequence
  Synthetic DNA
tagatcgactcagtcaag

SEQ ID NO: 37283 - DNA, 18 bp, Artificial Sequence
  Synthetic DNA
tagatcgattcacctatg

SEQ ID NO: 37284 - DNA, 18 bp, Artificial Sequence
  Synthetic DNA
tagatcgcctccctatgg

SEQ ID NO: 37285 - DNA, 18 bp, Artificial Sequence
  Synthetic DNA
tagatggaatcactacag

SEQ ID NO: 37286 - DNA, 18 bp, Artificial Sequence
  Synthetic DNA
tagattgattaactaaag

SEQ ID NO: 37287 - DNA, 18 bp, Artificial Sequence
  Synthetic DNA
tagattgcctcactattg

SEQ ID NO: 37288 - DNA, 18 bp, Artificial Sequence
  Synthetic DNA
tagcaattctcaatattg

SEQ ID NO: 37289 - DNA, 18 bp, Artificial Sequence
  Synthetic DNA
tagcaccaatcatactag

SEQ ID NO: 37290 - DNA, 18 bp, Artificial Sequence
  Synthetic DNA
tagcaccacaaaataacg

SEQ ID NO: 37291 - DNA, 18 bp, Artificial Sequence
  Synthetic DNA
tagcaggactcagtgtag

SEQ ID NO: 37292 - DNA, 18 bp, Artificial Sequence
  Synthetic DNA
tagctagattctctatgg

SEQ ID NO: 37293 - DNA, 18 bp, Artificial Sequence
  Synthetic DNA
taggacaactaaccttgg

SEQ ID NO: 37294 - DNA, 18 bp, Artificial Sequence
  Synthetic DNA
taggaccactcacaattg

SEQ ID NO: 37295 - DNA, 18 bp, Artificial Sequence
  Synthetic DNA
taggacctctcgatatag

SEQ ID NO: 37296 - DNA, 18 bp, Artificial Sequence
  Synthetic DNA
taggacgaatcattattg

SEQ ID NO: 37297 - DNA, 18 bp, Artificial Sequence
  Synthetic DNA
taggacgaccctctttgg

SEQ ID NO: 37298 - DNA, 18 bp, Artificial Sequence
  Synthetic DNA
taggacgtcataccttag

SEQ ID NO: 37299 - DNA, 18 bp, Artificial Sequence
  Synthetic DNA
tagtaaaccctactatgg

SEQ ID NO: 37300 - DNA, 18 bp, Artificial Sequence
  Synthetic DNA
tagtaagactcgatacag

SEQ ID NO: 37301 - DNA, 18 bp, Artificial Sequence
  Synthetic DNA
tagtaagattcaccattg

SEQ ID NO: 37302 - DNA, 18 bp, Artificial Sequence
  Synthetic DNA
tagtaaggatatcaattg

SEQ ID NO: 37303 - DNA, 18 bp, Artificial Sequence
  Synthetic DNA
tagtaattctcactacag

SEQ ID NO: 37304 - DNA, 18 bp, Artificial Sequence
  Synthetic DNA
tagtacaactcgctactg

SEQ ID NO: 37305 - DNA, 18 bp, Artificial Sequence
  Synthetic DNA
tagtacaagtcagtaacg

SEQ ID NO: 37306 - DNA, 18 bp, Artificial Sequence
  Synthetic DNA
tagtacaattcttcatag

SEQ ID NO: 37307 - DNA, 18 bp, Artificial Sequence
  Synthetic DNA
tagtacgaatctaaatag

SEQ ID NO: 37308 - DNA, 18 bp, Artificial Sequence
  Synthetic DNA
tagtacgactctcaatta

SEQ ID NO: 37309 - DNA, 18 bp, Artificial Sequence
  Synthetic DNA
tagtacgagactcttatg

SEQ ID NO: 37310 - DNA, 18 bp, Artificial Sequence
  Synthetic DNA
tagtacgagctacaaaag

SEQ ID NO: 37311 - DNA, 18 bp, Artificial Sequence
  Synthetic DNA
tagtacgataaactttag

SEQ ID NO: 37312 - DNA, 18 bp, Artificial Sequence
  Synthetic DNA
tagtacgattcacaaacg

SEQ ID NO: 37313 - DNA, 18 bp, Artificial Sequence
  Synthetic DNA
tagtacgattccccatgg

SEQ ID NO: 37314 - DNA, 18 bp, Artificial Sequence
  Synthetic DNA
tagtacgattctatttag

SEQ ID NO: 37315 - DNA, 18 bp, Artificial Sequence
  Synthetic DNA
tagtacgattctccttag

SEQ ID NO: 37316 - DNA, 18 bp, Artificial Sequence
  Synthetic DNA
tagtacgccacactctgg

SEQ ID NO: 37317 - DNA, 18 bp, Artificial Sequence
  Synthetic DNA
tagtacgccactccatag

SEQ ID NO: 37318 - DNA, 18 bp, Artificial Sequence
  Synthetic DNA
tagtacgcctaacaaaag

SEQ ID NO: 37319 - DNA, 18 bp, Artificial Sequence
  Synthetic DNA
tagtacgtatattgatag

SEQ ID NO: 37320 - DNA, 18 bp, Artificial Sequence
  Synthetic DNA
tagtacgtcaaactttgg

SEQ ID NO: 37321 - DNA, 18 bp, Artificial Sequence
  Synthetic DNA
tagtacgtcttataatcg

SEQ ID NO: 37322 - DNA, 18 bp, Artificial Sequence
  Synthetic DNA
tagtactaatatatatag

SEQ ID NO: 37323 - DNA, 18 bp, Artificial Sequence
  Synthetic DNA
tagtactactcaaaaagg

SEQ ID NO: 37324 - DNA, 18 bp, Artificial Sequence
  Synthetic DNA
tagtactacttgctctag

SEQ ID NO: 37325 - DNA, 18 bp, Artificial Sequence
  Synthetic DNA
tagtactactttctttag

SEQ ID NO: 37326 - DNA, 18 bp, Artificial Sequence
  Synthetic DNA
tagtactatacacttaag

SEQ ID NO: 37327 - DNA, 18 bp, Artificial Sequence
  Synthetic DNA
tagtactgctcactaccg

SEQ ID NO: 37328 - DNA, 18 bp, Artificial Sequence
  Synthetic DNA
tagtaggactcctatgag

SEQ ID NO: 37329 - DNA, 18 bp, Artificial Sequence
  Synthetic DNA
tagtaggtctcaaaatag

SEQ ID NO: 37330 - DNA, 18 bp, Artificial Sequence
  Synthetic DNA
tagtagtacactatatag

SEQ ID NO: 37331 - DNA, 18 bp, Artificial Sequence
  Synthetic DNA
tagtagtgtttattatag

SEQ ID NO: 37332 - DNA, 18 bp, Artificial Sequence
  Synthetic DNA
tagtatgaatcactccag

SEQ ID NO: 37333 - DNA, 18 bp, Artificial Sequence
  Synthetic DNA
tagtatgacacccataag

SEQ ID NO: 37334 - DNA, 18 bp, Artificial Sequence
  Synthetic DNA
tagtatggctcataaacg

SEQ ID NO: 37335 - DNA, 18 bp, Artificial Sequence
  Synthetic DNA
tagtatgtctttacatag

SEQ ID NO: 37336 - DNA, 18 bp, Artificial Sequence
  Synthetic DNA
tagtatttctctctcttg

SEQ ID NO: 37337 - DNA, 18 bp, Artificial Sequence
  Synthetic DNA
tagtcagactcaccctag

SEQ ID NO: 37338 - DNA, 18 bp, Artificial Sequence
  Synthetic DNA
tagtcatactcactcaag

SEQ ID NO: 37339 - DNA, 18 bp, Artificial Sequence
  Synthetic DNA
tagtcatacttacaatag

SEQ ID NO: 37340 - DNA, 18 bp, Artificial Sequence
  Synthetic DNA
tagtccaacgcccaaaag

SEQ ID NO: 37341 - DNA, 18 bp, Artificial Sequence
  Synthetic DNA
tagtccatctcacactag

SEQ ID NO: 37342 - DNA, 18 bp, Artificial Sequence
  Synthetic DNA
tagtccgattatccatag

SEQ ID NO: 37343 - DNA, 18 bp, Artificial Sequence
  Synthetic DNA
tagtccgttactctatag

SEQ ID NO: 37344 - DNA, 18 bp, Artificial Sequence
  Synthetic DNA
tagtgaaactaaccatag

SEQ ID NO: 37345 - DNA, 18 bp, Artificial Sequence
  Synthetic DNA
tagtgccactctcaacgg

SEQ ID NO: 37346 - DNA, 18 bp, Artificial Sequence
  Synthetic DNA
tagtgccgatcactaaag

SEQ ID NO: 37347 - DNA, 18 bp, Artificial Sequence
  Synthetic DNA
tagttcaacacgataaag

SEQ ID NO: 37348 - DNA, 18 bp, Artificial Sequence
  Synthetic DNA
tagttcattactctattg

SEQ ID NO: 37349 - DNA, 18 bp, Artificial Sequence
  Synthetic DNA
tagttcgacacctcacag

SEQ ID NO: 37350 - DNA, 18 bp, Artificial Sequence
  Synthetic DNA
tagttcgacactctaacg

SEQ ID NO: 37351 - DNA, 18 bp, Artificial Sequence
  Synthetic DNA
tagttcgacgcacttttg

SEQ ID NO: 37352 - DNA, 18 bp, Artificial Sequence
  Synthetic DNA
tagttcgactcacccaag

SEQ ID NO: 37353 - DNA, 18 bp, Artificial Sequence
  Synthetic DNA
tagttcgacttagtttag

SEQ ID NO: 37354 - DNA, 18 bp, Artificial Sequence
  Synthetic DNA
tagttcgactttgtttag

SEQ ID NO: 37355 - DNA, 18 bp, Artificial Sequence
  Synthetic DNA
tagttcgtactactatag

SEQ ID NO: 37356 - DNA, 18 bp, Artificial Sequence
  Synthetic DNA
tagttctactaacaatag

SEQ ID NO: 37357 - DNA, 18 bp, Artificial Sequence
  Synthetic DNA
tagttctactcgctttag

SEQ ID NO: 37358 - DNA, 18 bp, Artificial Sequence
  Synthetic DNA
tagttcttctaactcttg

SEQ ID NO: 37359 - DNA, 18 bp, Artificial Sequence
  Synthetic DNA
tagttggacacctttaag

SEQ ID NO: 37360 - DNA, 18 bp, Artificial Sequence
  Synthetic DNA
tagttggacccgctgtag

SEQ ID NO: 37361 - DNA, 18 bp, Artificial Sequence
  Synthetic DNA
tagttggactcagtgtag

SEQ ID NO: 37362 - DNA, 18 bp, Artificial Sequence
  Synthetic DNA
tagttggattcacaatag

SEQ ID NO: 37363 - DNA, 18 bp, Artificial Sequence
  Synthetic DNA
tagtttgactcaatatcg

SEQ ID NO: 37364 - DNA, 18 bp, Artificial Sequence
  Synthetic DNA
tataaagacactcatttg

SEQ ID NO: 37365 - DNA, 18 bp, Artificial Sequence
  Synthetic DNA
tataaagattcactaaag

SEQ ID NO: 37366 - DNA, 18 bp, Artificial Sequence
  Synthetic DNA
tataaagcataactttag

SEQ ID NO: 37367 - DNA, 18 bp, Artificial Sequence
  Synthetic DNA
tataaagtgtcactatcg

SEQ ID NO: 37368 - DNA, 18 bp, Artificial Sequence
  Synthetic DNA
tataaagttttaatatag

SEQ ID NO: 37369 - DNA, 18 bp, Artificial Sequence
  Synthetic DNA
tataacaacatacaattg

SEQ ID NO: 37370 - DNA, 18 bp, Artificial Sequence
  Synthetic DNA
tataacaacgatctgtag

SEQ ID NO: 37371 - DNA, 18 bp, Artificial Sequence
  Synthetic DNA
tataacaatacattatag

SEQ ID NO: 37372 - DNA, 18 bp, Artificial Sequence
  Synthetic DNA
tataacagctcacattag

SEQ ID NO: 37373 - DNA, 18 bp, Artificial Sequence
  Synthetic DNA
tataacatcaaactcaag

SEQ ID NO: 37374 - DNA, 18 bp, Artificial Sequence
  Synthetic DNA
tataacatctaactgtag

SEQ ID NO: 37375 - DNA, 18 bp, Artificial Sequence
  Synthetic DNA
tataacatctaatttttg

SEQ ID NO: 37376 - DNA, 18 bp, Artificial Sequence
  Synthetic DNA
tataaccaatatctaaag

SEQ ID NO: 37377 - DNA, 18 bp, Artificial Sequence
  Synthetic DNA
tataaccaatcattaaag

SEQ ID NO: 37378 - DNA, 18 bp, Artificial Sequence
  Synthetic DNA
tataaccactctttcttg

SEQ ID NO: 37379 - DNA, 18 bp, Artificial Sequence
  Synthetic DNA
tataaccatacagtatag

SEQ ID NO: 37380 - DNA, 18 bp, Artificial Sequence
  Synthetic DNA
tataaccgatcacggtag

SEQ ID NO: 37381 - DNA, 18 bp, Artificial Sequence
  Synthetic DNA
tataacctctaactatag

SEQ ID NO: 37382 - DNA, 18 bp, Artificial Sequence
  Synthetic DNA
tataacgaatctcaggtg

SEQ ID NO: 37383 - DNA, 18 bp, Artificial Sequence
  Synthetic DNA
tataacgacactctatcg

SEQ ID NO: 37384 - DNA, 18 bp, Artificial Sequence
  Synthetic DNA
tataacgacatactattg

SEQ ID NO: 37385 - DNA, 18 bp, Artificial Sequence
  Synthetic DNA
tataacgactcactctga

SEQ ID NO: 37386 - DNA, 18 bp, Artificial Sequence
  Synthetic DNA
tataacgacttactaaaa

SEQ ID NO: 37387 - DNA, 18 bp, Artificial Sequence
  Synthetic DNA
tataacgagtcactcgag

SEQ ID NO: 37388 - DNA, 18 bp, Artificial Sequence
  Synthetic DNA
tataacgatacattaaag

SEQ ID NO: 37389 - DNA, 18 bp, Artificial Sequence
  Synthetic DNA
tataacgattcactgttg

SEQ ID NO: 37390 - DNA, 18 bp, Artificial Sequence
  Synthetic DNA
tataacgccgctctatag

SEQ ID NO: 37391 - DNA, 18 bp, Artificial Sequence
  Synthetic DNA
tataacgcctaacaaaag

SEQ ID NO: 37392 - DNA, 18 bp, Artificial Sequence
  Synthetic DNA
tataacgcctaattagag

SEQ ID NO: 37393 - DNA, 18 bp, Artificial Sequence
  Synthetic DNA
tataacggatcaccattg

SEQ ID NO: 37394 - DNA, 18 bp, Artificial Sequence
  Synthetic DNA
tataacggctcacgaaag

SEQ ID NO: 37395 - DNA, 18 bp, Artificial Sequence
  Synthetic DNA
tataacggctcattattg

SEQ ID NO: 37396 - DNA, 18 bp, Artificial Sequence
  Synthetic DNA
tataacgtctctcaatag

SEQ ID NO: 37397 - DNA, 18 bp, Artificial Sequence
  Synthetic DNA
tataacgtttcagtacag

SEQ ID NO: 37398 - DNA, 18 bp, Artificial Sequence
  Synthetic DNA
tataactacacgctatcg

SEQ ID NO: 37399 - DNA, 18 bp, Artificial Sequence
  Synthetic DNA
tataactattcacactgg

SEQ ID NO: 37400 - DNA, 18 bp, Artificial Sequence
  Synthetic DNA
tataactccacgtaactg

SEQ ID NO: 37401 - DNA, 18 bp, Artificial Sequence
  Synthetic DNA
tataaggactaactaaag

SEQ ID NO: 37402 - DNA, 18 bp, Artificial Sequence
  Synthetic DNA
tataatgaatcacgacag

SEQ ID NO: 37403 - DNA, 18 bp, Artificial Sequence
  Synthetic DNA
tataatgactcactatca

SEQ ID NO: 37404 - DNA, 18 bp, Artificial Sequence
  Synthetic DNA
tataatgatttattctag

SEQ ID NO: 37405 - DNA, 18 bp, Artificial Sequence
  Synthetic DNA
tataccaactctctaaag

SEQ ID NO: 37406 - DNA, 18 bp, Artificial Sequence
  Synthetic DNA
tatacccggtcacaaaag

SEQ ID NO: 37407 - DNA, 18 bp, Artificial Sequence
  Synthetic DNA
tataccgacagatattag

SEQ ID NO: 37408 - DNA, 18 bp, Artificial Sequence
  Synthetic DNA
tataccgactcacttttg

SEQ ID NO: 37409 - DNA, 18 bp, Artificial Sequence
  Synthetic DNA
tatactatcttactatag

SEQ ID NO: 37410 - DNA, 18 bp, Artificial Sequence
  Synthetic DNA
tatactgactctttacag

SEQ ID NO: 37411 - DNA, 18 bp, Artificial Sequence
  Synthetic DNA
tatagcgactaactgtag

SEQ ID NO: 37412 - DNA, 18 bp, Artificial Sequence
  Synthetic DNA
tatagcgattcaccatag

SEQ ID NO: 37413 - DNA, 18 bp, Artificial Sequence
  Synthetic DNA
tatagctacccactatag

SEQ ID NO: 37414 - DNA, 18 bp, Artificial Sequence
  Synthetic DNA
tatagctactcatcatag

SEQ ID NO: 37415 - DNA, 18 bp, Artificial Sequence
  Synthetic DNA
tatagtgtcttgctcttg

SEQ ID NO: 37416 - DNA, 18 bp, Artificial Sequence
  Synthetic DNA
tatatagtctctcaatag

SEQ ID NO: 37417 - DNA, 18 bp, Artificial Sequence
  Synthetic DNA
tatatcaactggccatag

SEQ ID NO: 37418 - DNA, 18 bp, Artificial Sequence
  Synthetic DNA
tatatccactcactaaag

SEQ ID NO: 37419 - DNA, 18 bp, Artificial Sequence
  Synthetic DNA
tatatcgacttactcaag

SEQ ID NO: 37420 - DNA, 18 bp, Artificial Sequence
  Synthetic DNA
tatatcgagtccctattg

SEQ ID NO: 37421 - DNA, 18 bp, Artificial Sequence
  Synthetic DNA
tatatcgatgcactatag

SEQ ID NO: 37422 - DNA, 18 bp, Artificial Sequence
  Synthetic DNA
tatatcggctcactttag

SEQ ID NO: 37423 - DNA, 18 bp, Artificial Sequence
  Synthetic DNA
tatatcggctcattatag

SEQ ID NO: 37424 - DNA, 18 bp, Artificial Sequence
  Synthetic DNA
tatatcggctctaactag

SEQ ID NO: 37425 - DNA, 18 bp, Artificial Sequence
  Synthetic DNA
tatatcggttcatttttg

SEQ ID NO: 37426 - DNA, 18 bp, Artificial Sequence
  Synthetic DNA
tatatcttatcattacgg

SEQ ID NO: 37427 - DNA, 18 bp, Artificial Sequence
  Synthetic DNA
tatatcttctcaatatag

SEQ ID NO: 37428 - DNA, 18 bp, Artificial Sequence
  Synthetic DNA
tatattgaatcagcttag

SEQ ID NO: 37429 - DNA, 18 bp, Artificial Sequence
  Synthetic DNA
tatcaagcctcagtgttg

SEQ ID NO: 37430 - DNA, 18 bp, Artificial Sequence
  Synthetic DNA
tatcaatactcacaatag

SEQ ID NO: 37431 - DNA, 18 bp, Artificial Sequence
  Synthetic DNA
tatcacaacccactatcg

SEQ ID NO: 37432 - DNA, 18 bp, Artificial Sequence
  Synthetic DNA
tatcacaacttacttttg

SEQ ID NO: 37433 - DNA, 18 bp, Artificial Sequence
  Synthetic DNA
tatcacatgtcacttttg

SEQ ID NO: 37434 - DNA, 18 bp, Artificial Sequence
  Synthetic DNA
tatcaccactcgcaatag

SEQ ID NO: 37435 - DNA, 18 bp, Artificial Sequence
  Synthetic DNA
tatcaccattcactatcg

SEQ ID NO: 37436 - DNA, 18 bp, Artificial Sequence
  Synthetic DNA
tatcacgacaccctattg

SEQ ID NO: 37437 - DNA, 18 bp, Artificial Sequence
  Synthetic DNA
tatcacgatttattaaag

SEQ ID NO: 37438 - DNA, 18 bp, Artificial Sequence
  Synthetic DNA
tatcacgccacacttagg

SEQ ID NO: 37439 - DNA, 18 bp, Artificial Sequence
  Synthetic DNA
tatcacgtatgactttag

SEQ ID NO: 37440 - DNA, 18 bp, Artificial Sequence
  Synthetic DNA
tatcacgtctaaaattag

SEQ ID NO: 37441 - DNA, 18 bp, Artificial Sequence
  Synthetic DNA
tatcacgtctctcaatcg

SEQ ID NO: 37442 - DNA, 18 bp, Artificial Sequence
  Synthetic DNA
tatcacgtctgactatcg

SEQ ID NO: 37443 - DNA, 18 bp, Artificial Sequence
  Synthetic DNA
tatcactattcaacatgg

SEQ ID NO: 37444 - DNA, 18 bp, Artificial Sequence
  Synthetic DNA
tatcactcctcaccatag

SEQ ID NO: 37445 - DNA, 18 bp, Artificial Sequence
  Synthetic DNA
tatcatgactatcaatag

SEQ ID NO: 37446 - DNA, 18 bp, Artificial Sequence
  Synthetic DNA
tatcatgtctcactatcg

SEQ ID NO: 37447 - DNA, 18 bp, Artificial Sequence
  Synthetic DNA
tatcgagactaactatag

SEQ ID NO: 37448 - DNA, 18 bp, Artificial Sequence
  Synthetic DNA
tatctagacaaactatcg

SEQ ID NO: 37449 - DNA, 18 bp, Artificial Sequence
  Synthetic DNA
tatctcagctcacaatag

SEQ ID NO: 37450 - DNA, 18 bp, Artificial Sequence
  Synthetic DNA
tatctcagctcagaatag

SEQ ID NO: 37451 - DNA, 18 bp, Artificial Sequence
  Synthetic DNA
tatctccgcacactatag

SEQ ID NO: 37452 - DNA, 18 bp, Artificial Sequence
  Synthetic DNA
tatctcgaatctatatag

SEQ ID NO: 37453 - DNA, 18 bp, Artificial Sequence
  Synthetic DNA
tatctcgactctctactg

SEQ ID NO: 37454 - DNA, 18 bp, Artificial Sequence
  Synthetic DNA
tatctcgtctcagtatcg

SEQ ID NO: 37455 - DNA, 18 bp, Artificial Sequence
  Synthetic DNA
tatctgcaatcactatag

SEQ ID NO: 37456 - DNA, 18 bp, Artificial Sequence
  Synthetic DNA
tatcttgactcgcaattg

SEQ ID NO: 37457 - DNA, 18 bp, Artificial Sequence
  Synthetic DNA
tatcttgtctcacaattg

SEQ ID NO: 37458 - DNA, 18 bp, Artificial Sequence
  Synthetic DNA
tatgaagactctcttttg

SEQ ID NO: 37459 - DNA, 18 bp, Artificial Sequence
  Synthetic DNA
tatgacgactcgaaatag

SEQ ID NO: 37460 - DNA, 18 bp, Artificial Sequence
  Synthetic DNA
tatgacgcatcacaatag

SEQ ID NO: 37461 - DNA, 18 bp, Artificial Sequence
  Synthetic DNA
tatgacgtctccctacag

SEQ ID NO: 37462 - DNA, 18 bp, Artificial Sequence
  Synthetic DNA
tatgacgtctgactaaag

SEQ ID NO: 37463 - DNA, 18 bp, Artificial Sequence
  Synthetic DNA
tatgaggactccctatgg

SEQ ID NO: 37464 - DNA, 18 bp, Artificial Sequence
  Synthetic DNA
tatgatgtcacgtaatag

SEQ ID NO: 37465 - DNA, 18 bp, Artificial Sequence
  Synthetic DNA
tatggcatctcacaatgg

SEQ ID NO: 37466 - DNA, 18 bp, Artificial Sequence
  Synthetic DNA
tatgtcaacacacgtttg

SEQ ID NO: 37467 - DNA, 18 bp, Artificial Sequence
  Synthetic DNA
tattaaatctcactaaag

SEQ ID NO: 37468 - DNA, 18 bp, Artificial Sequence
  Synthetic DNA
tattaaatctcactaatg

SEQ ID NO: 37469 - DNA, 18 bp, Artificial Sequence
  Synthetic DNA
tattaacattcaccttag

SEQ ID NO: 37470 - DNA, 18 bp, Artificial Sequence
  Synthetic DNA
tattaacgcacactaaag

SEQ ID NO: 37471 - DNA, 18 bp, Artificial Sequence
  Synthetic DNA
tattaactctcactaaag

SEQ ID NO: 37472 - DNA, 18 bp, Artificial Sequence
  Synthetic DNA
tattaagaatcgcaatag

SEQ ID NO: 37473 - DNA, 18 bp, Artificial Sequence
  Synthetic DNA
tattaagactcactacct

SEQ ID NO: 37474 - DNA, 18 bp, Artificial Sequence
  Synthetic DNA
tattaagactgaatttag

SEQ ID NO: 37475 - DNA, 18 bp, Artificial Sequence
  Synthetic DNA
tattaaggcacactcaag

SEQ ID NO: 37476 - DNA, 18 bp, Artificial Sequence
  Synthetic DNA
tattaaggctttttatag

SEQ ID NO: 37477 - DNA, 18 bp, Artificial Sequence
  Synthetic DNA
tattaagtcacgccaaag

SEQ ID NO: 37478 - DNA, 18 bp, Artificial Sequence
  Synthetic DNA
tattaagtcttaataaag

SEQ ID NO: 37479 - DNA, 18 bp, Artificial Sequence
  Synthetic DNA
tattaagtctttctatag

SEQ ID NO: 37480 - DNA, 18 bp, Artificial Sequence
  Synthetic DNA
tattaagttagactgtag

SEQ ID NO: 37481 - DNA, 18 bp, Artificial Sequence
  Synthetic DNA
tattaagtttctttatag

SEQ ID NO: 37482 - DNA, 18 bp, Artificial Sequence
  Synthetic DNA
tattaatacatactatag

SEQ ID NO: 37483 - DNA, 18 bp, Artificial Sequence
  Synthetic DNA
tattaatacccacaatag

SEQ ID NO: 37484 - DNA, 18 bp, Artificial Sequence
  Synthetic DNA
tattaatactcaatgtcg

SEQ ID NO: 37485 - DNA, 18 bp, Artificial Sequence
  Synthetic DNA
tattaatactccctattg

SEQ ID NO: 37486 - DNA, 18 bp, Artificial Sequence
  Synthetic DNA
tattaatcctcactaaag

SEQ ID NO: 37487 - DNA, 18 bp, Artificial Sequence
  Synthetic DNA
tattaattctgactatag

SEQ ID NO: 37488 - DNA, 18 bp, Artificial Sequence
  Synthetic DNA
tattacaacacactcttg

SEQ ID NO: 37489 - DNA, 18 bp, Artificial Sequence
  Synthetic DNA
tattacaacacagattag

SEQ ID NO: 37490 - DNA, 18 bp, Artificial Sequence
  Synthetic DNA
tattacaactaaatatgg

SEQ ID NO: 37491 - DNA, 18 bp, Artificial Sequence
  Synthetic DNA
tattacaactagcatctg

SEQ ID NO: 37492 - DNA, 18 bp, Artificial Sequence
  Synthetic DNA
tattacaagtcactctcg

SEQ ID NO: 37493 - DNA, 18 bp, Artificial Sequence
  Synthetic DNA
tattacaattctctatgg

SEQ ID NO: 37494 - DNA, 18 bp, Artificial Sequence
  Synthetic DNA
tattacacctctaaatag

SEQ ID NO: 37495 - DNA, 18 bp, Artificial Sequence
  Synthetic DNA
tattacagattccaatag

SEQ ID NO: 37496 - DNA, 18 bp, Artificial Sequence
  Synthetic DNA
tattacagttcattatag

SEQ ID NO: 37497 - DNA, 18 bp, Artificial Sequence
  Synthetic DNA
tattacatcactccatag

SEQ ID NO: 37498 - DNA, 18 bp, Artificial Sequence
  Synthetic DNA
tattacatcgccccaaag

SEQ ID NO: 37499 - DNA, 18 bp, Artificial Sequence
  Synthetic DNA
tattacatctcacctttg

SEQ ID NO: 37500 - DNA, 18 bp, Artificial Sequence
  Synthetic DNA
tattacatctcacgatgg

SEQ ID NO: 37501 - DNA, 18 bp, Artificial Sequence
  Synthetic DNA
tattacatcttattatag

SEQ ID NO: 37502 - DNA, 18 bp, Artificial Sequence
  Synthetic DNA
tattaccacacattgctg

SEQ ID NO: 37503 - DNA, 18 bp, Artificial Sequence
  Synthetic DNA
tattaccactaacttaag

SEQ ID NO: 37504 - DNA, 18 bp, Artificial Sequence
  Synthetic DNA
tattaccactcactgggg

SEQ ID NO: 37505 - DNA, 18 bp, Artificial Sequence
  Synthetic DNA
tattaccactcagttgag

SEQ ID NO: 37506 - DNA, 18 bp, Artificial Sequence
  Synthetic DNA
tattaccatacacaatcg

SEQ ID NO: 37507 - DNA, 18 bp, Artificial Sequence
  Synthetic DNA
tattacccctaaatatag

SEQ ID NO: 37508 - DNA, 18 bp, Artificial Sequence
  Synthetic DNA
tattacctcaaattatag

SEQ ID NO: 37509 - DNA, 18 bp, Artificial Sequence
  Synthetic DNA
tattacgaacctttatag

SEQ ID NO: 37510 - DNA, 18 bp, Artificial Sequence
  Synthetic DNA
tattacgaataacaaaag

SEQ ID NO: 37511 - DNA, 18 bp, Artificial Sequence
  Synthetic DNA
tattacgaatcattttaa

SEQ ID NO: 37512 - DNA, 18 bp, Artificial Sequence
  Synthetic DNA
tattacgacaaagaatag

SEQ ID NO: 37513 - DNA, 18 bp, Artificial Sequence
  Synthetic DNA
tattacgacacaatgcag

SEQ ID NO: 37514 - DNA, 18 bp, Artificial Sequence
  Synthetic DNA
tattacgacacctaatag

SEQ ID NO: 37515 - DNA, 18 bp, Artificial Sequence
  Synthetic DNA
tattacgaccaactttgg

SEQ ID NO: 37516 - DNA, 18 bp, Artificial Sequence
  Synthetic DNA
tattacgactaaagaaag

SEQ ID NO: 37517 - DNA, 18 bp, Artificial Sequence
  Synthetic DNA
tattacgactcacatacg

SEQ ID NO: 37518 - DNA, 18 bp, Artificial Sequence
  Synthetic DNA
tattacgactcacggatg

SEQ ID NO: 37519 - DNA, 18 bp, Artificial Sequence
  Synthetic DNA
tattacgactcatctaag

SEQ ID NO: 37520 - DNA, 18 bp, Artificial Sequence
  Synthetic DNA
tattacgactccctttta

SEQ ID NO: 37521 - DNA, 18 bp, Artificial Sequence
  Synthetic DNA
tattacgactctctttta

SEQ ID NO: 37522 - DNA, 18 bp, Artificial Sequence
  Synthetic DNA
tattacgactctgactag

SEQ ID NO: 37523 - DNA, 18 bp, Artificial Sequence
  Synthetic DNA
tattacgactgatttttg

SEQ ID NO: 37524 - DNA, 18 bp, Artificial Sequence
  Synthetic DNA
tattacgactggatgaag

SEQ ID NO: 37525 - DNA, 18 bp, Artificial Sequence
  Synthetic DNA
tattacgactttattttg

SEQ ID NO: 37526 - DNA, 18 bp, Artificial Sequence
  Synthetic DNA
tattacgactttccacag

SEQ ID NO: 37527 - DNA, 18 bp, Artificial Sequence
  Synthetic DNA
tattacgagacattttag

SEQ ID NO: 37528 - DNA, 18 bp, Artificial Sequence
  Synthetic DNA
tattacgagtaagaatag

SEQ ID NO: 37529 - DNA, 18 bp, Artificial Sequence
  Synthetic DNA
tattacgagtgttaattg

SEQ ID NO: 37530 - DNA, 18 bp, Artificial Sequence
  Synthetic DNA
tattacgattatcaaatg

SEQ ID NO: 37531 - DNA, 18 bp, Artificial Sequence
  Synthetic DNA
tattacgattcaaaattg

SEQ ID NO: 37532 - DNA, 18 bp, Artificial Sequence
  Synthetic DNA
tattacgattcaccgtcg

SEQ ID NO: 37533 - DNA, 18 bp, Artificial Sequence
  Synthetic DNA
tattacgattcatcaaag

SEQ ID NO: 37534 - DNA, 18 bp, Artificial Sequence
  Synthetic DNA
tattacgcatctctttag

SEQ ID NO: 37535 - DNA, 18 bp, Artificial Sequence
  Synthetic DNA
tattacgcctacctaatg

SEQ ID NO: 37536 - DNA, 18 bp, Artificial Sequence
  Synthetic DNA
tattacgcctcaatagtg

SEQ ID NO: 37537 - DNA, 18 bp, Artificial Sequence
  Synthetic DNA
tattacgcctctctctcg

SEQ ID NO: 37538 - DNA, 18 bp, Artificial Sequence
  Synthetic DNA
tattacgcctctttgtag

SEQ ID NO: 37539 - DNA, 18 bp, Artificial Sequence
  Synthetic DNA
tattacggaccatttttg

SEQ ID NO: 37540 - DNA, 18 bp, Artificial Sequence
  Synthetic DNA
tattacggcataatacag

SEQ ID NO: 37541 - DNA, 18 bp, Artificial Sequence
  Synthetic DNA
tattacggctctcactag

SEQ ID NO: 37542 - DNA, 18 bp, Artificial Sequence
  Synthetic DNA
tattacggcttacaattg

SEQ ID NO: 37543 - DNA, 18 bp, Artificial Sequence
  Synthetic DNA
tattacggtacacaaatg

SEQ ID NO: 37544 - DNA, 18 bp, Artificial Sequence
  Synthetic DNA
tattacggttctccatag

SEQ ID NO: 37545 - DNA, 18 bp, Artificial Sequence
  Synthetic DNA
tattacgtcatactaatg

SEQ ID NO: 37546 - DNA, 18 bp, Artificial Sequence
  Synthetic DNA
tattacgtccctcctttg

SEQ ID NO: 37547 - DNA, 18 bp, Artificial Sequence
  Synthetic DNA
tattacgtcttcctaatg

SEQ ID NO: 37548 - DNA, 18 bp, Artificial Sequence
  Synthetic DNA
tattacgtctttcagtgg

SEQ ID NO: 37549 - DNA, 18 bp, Artificial Sequence
  Synthetic DNA
tattacgtttcaatttag

SEQ ID NO: 37550 - DNA, 18 bp, Artificial Sequence
  Synthetic DNA
tattacgtttcccaaatg

SEQ ID NO: 37551 - DNA, 18 bp, Artificial Sequence
  Synthetic DNA
tattactaaccattatag

SEQ ID NO: 37552 - DNA, 18 bp, Artificial Sequence
  Synthetic DNA
tattactacacaatatcg

SEQ ID NO: 37553 - DNA, 18 bp, Artificial Sequence
  Synthetic DNA
tattactacacgctttag

SEQ ID NO: 37554 - DNA, 18 bp, Artificial Sequence
  Synthetic DNA
tattactacccatgattg

SEQ ID NO: 37555 - DNA, 18 bp, Artificial Sequence
  Synthetic DNA
tattactatactgtatag

SEQ ID NO: 37556 - DNA, 18 bp, Artificial Sequence
  Synthetic DNA
tattactcctcagcatag

SEQ ID NO: 37557 - DNA, 18 bp, Artificial Sequence
  Synthetic DNA
tattactgctaacaatag

SEQ ID NO: 37558 - DNA, 18 bp, Artificial Sequence
  Synthetic DNA
tattactgctaagtttag

SEQ ID NO: 37559 - DNA, 18 bp, Artificial Sequence
  Synthetic DNA
tattacttctatctatag

SEQ ID NO: 37560 - DNA, 18 bp, Artificial Sequence
  Synthetic DNA
tattacttctcactaagg

SEQ ID NO: 37561 - DNA, 18 bp, Artificial Sequence
  Synthetic DNA
tattacttctcagactag

SEQ ID NO: 37562 - DNA, 18 bp, Artificial Sequence
  Synthetic DNA
tattacttcttaacatag

SEQ ID NO: 37563 - DNA, 18 bp, Artificial Sequence
  Synthetic DNA
tattactttttaccatag

SEQ ID NO: 37564 - DNA, 18 bp, Artificial Sequence
  Synthetic DNA
tattagatctcactttag

SEQ ID NO: 37565 - DNA, 18 bp, Artificial Sequence
  Synthetic DNA
tattagcacttattatag

SEQ ID NO: 37566 - DNA, 18 bp, Artificial Sequence
  Synthetic DNA
tattaggaccaataagag

SEQ ID NO: 37567 - DNA, 18 bp, Artificial Sequence
  Synthetic DNA
tattaggactcattgttg

SEQ ID NO: 37568 - DNA, 18 bp, Artificial Sequence
  Synthetic DNA
tattaggagttcctatag

SEQ ID NO: 37569 - DNA, 18 bp, Artificial Sequence
  Synthetic DNA
tattaggatttacagtag

SEQ ID NO: 37570 - DNA, 18 bp, Artificial Sequence
  Synthetic DNA
tattaggtttctctatag

SEQ ID NO: 37571 - DNA, 18 bp, Artificial Sequence
  Synthetic DNA
tattagtactccctactg

SEQ ID NO: 37572 - DNA, 18 bp, Artificial Sequence
  Synthetic DNA
tattagtattccctttag

SEQ ID NO: 37573 - DNA, 18 bp, Artificial Sequence
  Synthetic DNA
tattatgaacctctatcg

SEQ ID NO: 37574 - DNA, 18 bp, Artificial Sequence
  Synthetic DNA
tattatgacagaatttag

SEQ ID NO: 37575 - DNA, 18 bp, Artificial Sequence
  Synthetic DNA
tattatgacggtgtagag

SEQ ID NO: 37576 - DNA, 18 bp, Artificial Sequence
  Synthetic DNA
tattatgactcatgaaag

SEQ ID NO: 37577 - DNA, 18 bp, Artificial Sequence
  Synthetic DNA
tattatgactctctgtgg

SEQ ID NO: 37578 - DNA, 18 bp, Artificial Sequence
  Synthetic DNA
tattatgtctccatttag

SEQ ID NO: 37579 - DNA, 18 bp, Artificial Sequence
  Synthetic DNA
tattatgtctcttattag

SEQ ID NO: 37580 - DNA, 18 bp, Artificial Sequence
  Synthetic DNA
tattatgtttcacaatcg

SEQ ID NO: 37581 - DNA, 18 bp, Artificial Sequence
  Synthetic DNA
tattattaatcactctag

SEQ ID NO: 37582 - DNA, 18 bp, Artificial Sequence
  Synthetic DNA
tattattactcaacatcg

SEQ ID NO: 37583 - DNA, 18 bp, Artificial Sequence
  Synthetic DNA
tattattactcacttcgg

SEQ ID NO: 37584 - DNA, 18 bp, Artificial Sequence
  Synthetic DNA
tattattactctatattg

SEQ ID NO: 37585 - DNA, 18 bp, Artificial Sequence
  Synthetic DNA
tattcagactcactatta

SEQ ID NO: 37586 - DNA, 18 bp, Artificial Sequence
  Synthetic DNA
tattccaatgcagtattg

SEQ ID NO: 37587 - DNA, 18 bp, Artificial Sequence
  Synthetic DNA
tattccgaatcaatattg

SEQ ID NO: 37588 - DNA, 18 bp, Artificial Sequence
  Synthetic DNA
tattccgacacaatatcg

SEQ ID NO: 37589 - DNA, 18 bp, Artificial Sequence
  Synthetic DNA
tattccgacccaaaatag

SEQ ID NO: 37590 - DNA, 18 bp, Artificial Sequence
  Synthetic DNA
tattccgactcacataag

SEQ ID NO: 37591 - DNA, 18 bp, Artificial Sequence
  Synthetic DNA
tattccgagatactgtag

SEQ ID NO: 37592 - DNA, 18 bp, Artificial Sequence
  Synthetic DNA
tattccgatacaattaag

SEQ ID NO: 37593 - DNA, 18 bp, Artificial Sequence
  Synthetic DNA
tattccgtctacctgtag

SEQ ID NO: 37594 - DNA, 18 bp, Artificial Sequence
  Synthetic DNA
tattcctacccatttctg

SEQ ID NO: 37595 - DNA, 18 bp, Artificial Sequence
  Synthetic DNA
tattcctactcccacatg

SEQ ID NO: 37596 - DNA, 18 bp, Artificial Sequence
  Synthetic DNA
tattccttctagtctttg

SEQ ID NO: 37597 - DNA, 18 bp, Artificial Sequence
  Synthetic DNA
tattccttctcattaaag

SEQ ID NO: 37598 - DNA, 18 bp, Artificial Sequence
  Synthetic DNA
tattccttttcagtattg

SEQ ID NO: 37599 - DNA, 18 bp, Artificial Sequence
  Synthetic DNA
tattcgaactgtctactg

SEQ ID NO: 37600 - DNA, 18 bp, Artificial Sequence
  Synthetic DNA
tattcgaattcactctag

SEQ ID NO: 37601 - DNA, 18 bp, Artificial Sequence
  Synthetic DNA
tattctcactcacgatag

SEQ ID NO: 37602 - DNA, 18 bp, Artificial Sequence
  Synthetic DNA
tattctgatactctatag

SEQ ID NO: 37603 - DNA, 18 bp, Artificial Sequence
  Synthetic DNA
tattctgcctgactatag

SEQ ID NO: 37604 - DNA, 18 bp, Artificial Sequence
  Synthetic DNA
tattgaaacagattctgg

SEQ ID NO: 37605 - DNA, 18 bp, Artificial Sequence
  Synthetic DNA
tattgagaaaaactaatg

SEQ ID NO: 37606 - DNA, 18 bp, Artificial Sequence
  Synthetic DNA
tattgagactcacttttg

SEQ ID NO: 37607 - DNA, 18 bp, Artificial Sequence
  Synthetic DNA
tattgcaacacactattg

SEQ ID NO: 37608 - DNA, 18 bp, Artificial Sequence
  Synthetic DNA
tattgccactcactagtg

SEQ ID NO: 37609 - DNA, 18 bp, Artificial Sequence
  Synthetic DNA
tattgccactcacttttg

SEQ ID NO: 37610 - DNA, 18 bp, Artificial Sequence
  Synthetic DNA
tattgccactctctatcg

SEQ ID NO: 37611 - DNA, 18 bp, Artificial Sequence
  Synthetic DNA
tattgcgaatcacagtgg

SEQ ID NO: 37612 - DNA, 18 bp, Artificial Sequence
  Synthetic DNA
tattgcgacacactcatg

SEQ ID NO: 37613 - DNA, 18 bp, Artificial Sequence
  Synthetic DNA
tattgcgactcacttttt

SEQ ID NO: 37614 - DNA, 18 bp, Artificial Sequence
  Synthetic DNA
tattgcgactcgccttcg

SEQ ID NO: 37615 - DNA, 18 bp, Artificial Sequence
  Synthetic DNA
tattgcgcctcaataatg

SEQ ID NO: 37616 - DNA, 18 bp, Artificial Sequence
  Synthetic DNA
tattgctactcaataaag

SEQ ID NO: 37617 - DNA, 18 bp, Artificial Sequence
  Synthetic DNA
tattgctactcacttttg

SEQ ID NO: 37618 - DNA, 18 bp, Artificial Sequence
  Synthetic DNA
tattgctagtcacattag

SEQ ID NO: 37619 - DNA, 18 bp, Artificial Sequence
  Synthetic DNA
tattgctcaatactaaag

SEQ ID NO: 37620 - DNA, 18 bp, Artificial Sequence
  Synthetic DNA
tattgtctctctctatag

SEQ ID NO: 37621 - DNA, 18 bp, Artificial Sequence
  Synthetic DNA
tattgtgacgcaatatag

SEQ ID NO: 37622 - DNA, 18 bp, Artificial Sequence
  Synthetic DNA
tatttaatcttacaagtg

SEQ ID NO: 37623 - DNA, 18 bp, Artificial Sequence
  Synthetic DNA
tatttataattcatattg

SEQ ID NO: 37624 - DNA, 18 bp, Artificial Sequence
  Synthetic DNA
tatttcaactctcaattg

SEQ ID NO: 37625 - DNA, 18 bp, Artificial Sequence
  Synthetic DNA
tatttcaattaattatag

SEQ ID NO: 37626 - DNA, 18 bp, Artificial Sequence
  Synthetic DNA
tatttcaccccactacag

SEQ ID NO: 37627 - DNA, 18 bp, Artificial Sequence
  Synthetic DNA
tatttcacctcactttag

SEQ ID NO: 37628 - DNA, 18 bp, Artificial Sequence
  Synthetic DNA
tatttcagccaactatcg

SEQ ID NO: 37629 - DNA, 18 bp, Artificial Sequence
  Synthetic DNA
tatttcagcttacatgcg

SEQ ID NO: 37630 - DNA, 18 bp, Artificial Sequence
  Synthetic DNA
tatttccaatgcctattg

SEQ ID NO: 37631 - DNA, 18 bp, Artificial Sequence
  Synthetic DNA
tatttccaccgtctctag

SEQ ID NO: 37632 - DNA, 18 bp, Artificial Sequence
  Synthetic DNA
tatttcgacacattatcg

SEQ ID NO: 37633 - DNA, 18 bp, Artificial Sequence
  Synthetic DNA
tatttcgacactcaataa

SEQ ID NO: 37634 - DNA, 18 bp, Artificial Sequence
  Synthetic DNA
tatttcgacagtatatag

SEQ ID NO: 37635 - DNA, 18 bp, Artificial Sequence
  Synthetic DNA
tatttcgacccgttatag

SEQ ID NO: 37636 - DNA, 18 bp, Artificial Sequence
  Synthetic DNA
tatttcgaccctttaaag

SEQ ID NO: 37637 - DNA, 18 bp, Artificial Sequence
  Synthetic DNA
tatttcgacgcatcatag

SEQ ID NO: 37638 - DNA, 18 bp, Artificial Sequence
  Synthetic DNA
tatttcgactcaagatgg

SEQ ID NO: 37639 - DNA, 18 bp, Artificial Sequence
  Synthetic DNA
tatttcgactgacaaaag

SEQ ID NO: 37640 - DNA, 18 bp, Artificial Sequence
  Synthetic DNA
tatttcgacttaacatag

SEQ ID NO: 37641 - DNA, 18 bp, Artificial Sequence
  Synthetic DNA
tatttcgacttagtattg

SEQ ID NO: 37642 - DNA, 18 bp, Artificial Sequence
  Synthetic DNA
tatttcgagtcaaaaccg

SEQ ID NO: 37643 - DNA, 18 bp, Artificial Sequence
  Synthetic DNA
tatttcggctcggtttag

SEQ ID NO: 37644 - DNA, 18 bp, Artificial Sequence
  Synthetic DNA
tatttcgtatcactcagg

SEQ ID NO: 37645 - DNA, 18 bp, Artificial Sequence
  Synthetic DNA
tatttcgtcaccatatag

SEQ ID NO: 37646 - DNA, 18 bp, Artificial Sequence
  Synthetic DNA
tatttcgtctcactgttg

SEQ ID NO: 37647 - DNA, 18 bp, Artificial Sequence
  Synthetic DNA
tatttcgtctctccatag

SEQ ID NO: 37648 - DNA, 18 bp, Artificial Sequence
  Synthetic DNA
tatttcgtctttaactag

SEQ ID NO: 37649 - DNA, 18 bp, Artificial Sequence
  Synthetic DNA
tatttcgtgcaactatcg

SEQ ID NO: 37650 - DNA, 18 bp, Artificial Sequence
  Synthetic DNA
tatttcgttgcaatattg

SEQ ID NO: 37651 - DNA, 18 bp, Artificial Sequence
  Synthetic DNA
tatttcgtttgattatag

SEQ ID NO: 37652 - DNA, 18 bp, Artificial Sequence
  Synthetic DNA
tatttctactcatttgag

SEQ ID NO: 37653 - DNA, 18 bp, Artificial Sequence
  Synthetic DNA
tatttctccgaattattg

SEQ ID NO: 37654 - DNA, 18 bp, Artificial Sequence
  Synthetic DNA
tatttctcctcacattag

SEQ ID NO: 37655 - DNA, 18 bp, Artificial Sequence
  Synthetic DNA
tatttctcctcacctttg

SEQ ID NO: 37656 - DNA, 18 bp, Artificial Sequence
  Synthetic DNA
tatttggactcacattag

SEQ ID NO: 37657 - DNA, 18 bp, Artificial Sequence
  Synthetic DNA
tattttgactcactgttg

SEQ ID NO: 37658 - DNA, 18 bp, Artificial Sequence
  Synthetic DNA
tattttgagtcattctag

SEQ ID NO: 37659 - DNA, 18 bp, Artificial Sequence
  Synthetic DNA
tattttgtctcactactg

SEQ ID NO: 37660 - DNA, 18 bp, Artificial Sequence
  Synthetic DNA
tatttttacacattatag

SEQ ID NO: 37661 - DNA, 18 bp, Artificial Sequence
  Synthetic DNA
tattttttctcacatttg

SEQ ID NO: 37662 - DNA, 18 bp, Artificial Sequence
  Synthetic DNA
tcaaaaaactcactttag

SEQ ID NO: 37663 - DNA, 18 bp, Artificial Sequence
  Synthetic DNA
tcaaaagactcatcctag

SEQ ID NO: 37664 - DNA, 18 bp, Artificial Sequence
  Synthetic DNA
tcaaacaaaacactctag

SEQ ID NO: 37665 - DNA, 18 bp, Artificial Sequence
  Synthetic DNA
tcaaacgaataacaatag

SEQ ID NO: 37666 - DNA, 18 bp, Artificial Sequence
  Synthetic DNA
tcaaacgattccccttag

SEQ ID NO: 37667 - DNA, 18 bp, Artificial Sequence
  Synthetic DNA
tcaaacggctgagaatag

SEQ ID NO: 37668 - DNA, 18 bp, Artificial Sequence
  Synthetic DNA
tcaaacgtcttacaaaag

SEQ ID NO: 37669 - DNA, 18 bp, Artificial Sequence
  Synthetic DNA
tcaaactacccacattag

SEQ ID NO: 37670 - DNA, 18 bp, Artificial Sequence
  Synthetic DNA
tcaaacttctctctgtag

SEQ ID NO: 37671 - DNA, 18 bp, Artificial Sequence
  Synthetic DNA
tcaaaggcccttctatag

SEQ ID NO: 37672 - DNA, 18 bp, Artificial Sequence
  Synthetic DNA
tcaaatctcaaactatag

SEQ ID NO: 37673 - DNA, 18 bp, Artificial Sequence
  Synthetic DNA
tcaaatgacagactaaag

SEQ ID NO: 37674 - DNA, 18 bp, Artificial Sequence
  Synthetic DNA
tcaaatgtttcattatag

SEQ ID NO: 37675 - DNA, 18 bp, Artificial Sequence
  Synthetic DNA
tcaagcgactctcagtgg

SEQ ID NO: 37676 - DNA, 18 bp, Artificial Sequence
  Synthetic DNA
tcaagcggctcacttttg

SEQ ID NO: 37677 - DNA, 18 bp, Artificial Sequence
  Synthetic DNA
tcaatcagctcactcttg

SEQ ID NO: 37678 - DNA, 18 bp, Artificial Sequence
  Synthetic DNA
tcaatcctctaaccattg

SEQ ID NO: 37679 - DNA, 18 bp, Artificial Sequence
  Synthetic DNA
tcaatcgggacactaggg

SEQ ID NO: 37680 - DNA, 18 bp, Artificial Sequence
  Synthetic DNA
tcaatgtcctcacaatag

SEQ ID NO: 37681 - DNA, 18 bp, Artificial Sequence
  Synthetic DNA
tcaattgacacactatag

SEQ ID NO: 37682 - DNA, 18 bp, Artificial Sequence
  Synthetic DNA
tcacaactcacactatag

SEQ ID NO: 37683 - DNA, 18 bp, Artificial Sequence
  Synthetic DNA
tcacacgtctcacttaag

SEQ ID NO: 37684 - DNA, 18 bp, Artificial Sequence
  Synthetic DNA
tcaccaaacccactatag

SEQ ID NO: 37685 - DNA, 18 bp, Artificial Sequence
  Synthetic DNA
tcacccgtcaacctattg

SEQ ID NO: 37686 - DNA, 18 bp, Artificial Sequence
  Synthetic DNA
tcacctgtatcaatatag

SEQ ID NO: 37687 - DNA, 18 bp, Artificial Sequence
  Synthetic DNA
tcactcgtcctactatag

SEQ ID NO: 37688 - DNA, 18 bp, Artificial Sequence
  Synthetic DNA
tcactcgtctctatatcg

SEQ ID NO: 37689 - DNA, 18 bp, Artificial Sequence
  Synthetic DNA
tcactctactcatttcag

SEQ ID NO: 37690 - DNA, 18 bp, Artificial Sequence
  Synthetic DNA
tcagacaactcacttaag

SEQ ID NO: 37691 - DNA, 18 bp, Artificial Sequence
  Synthetic DNA
tcagacgagacactaaag

SEQ ID NO: 37692 - DNA, 18 bp, Artificial Sequence
  Synthetic DNA
tcagtagactcataatag

SEQ ID NO: 37693 - DNA, 18 bp, Artificial Sequence
  Synthetic DNA
tcataaaattaacttttg

SEQ ID NO: 37694 - DNA, 18 bp, Artificial Sequence
  Synthetic DNA
tcataacactctctaaag

SEQ ID NO: 37695 - DNA, 18 bp, Artificial Sequence
  Synthetic DNA
tcataagacccacaacag

SEQ ID NO: 37696 - DNA, 18 bp, Artificial Sequence
  Synthetic DNA
tcataagactaaaaatag

SEQ ID NO: 37697 - DNA, 18 bp, Artificial Sequence
  Synthetic DNA
tcatacaacattctaatg

SEQ ID NO: 37698 - DNA, 18 bp, Artificial Sequence
  Synthetic DNA
tcatacaacttaaaatag

SEQ ID NO: 37699 - DNA, 18 bp, Artificial Sequence
  Synthetic DNA
tcatacagcacactaaag

SEQ ID NO: 37700 - DNA, 18 bp, Artificial Sequence
  Synthetic DNA
tcatacgacaaacttttg

SEQ ID NO: 37701 - DNA, 18 bp, Artificial Sequence
  Synthetic DNA
tcatacgacacaacattg

SEQ ID NO: 37702 - DNA, 18 bp, Artificial Sequence
  Synthetic DNA
tcatacgacagactttcg

SEQ ID NO: 37703 - DNA, 18 bp, Artificial Sequence
  Synthetic DNA
tcatacgacatactctgg

SEQ ID NO: 37704 - DNA, 18 bp, Artificial Sequence
  Synthetic DNA
tcatacgaccctatctag

SEQ ID NO: 37705 - DNA, 18 bp, Artificial Sequence
  Synthetic DNA
tcatacgacgcacttgtg

SEQ ID NO: 37706 - DNA, 18 bp, Artificial Sequence
  Synthetic DNA
tcatacgactaacataag

SEQ ID NO: 37707 - DNA, 18 bp, Artificial Sequence
  Synthetic DNA
tcatacgattcatcattg

SEQ ID NO: 37708 - DNA, 18 bp, Artificial Sequence
  Synthetic DNA
tcatacgattccctctgg

SEQ ID NO: 37709 - DNA, 18 bp, Artificial Sequence
  Synthetic DNA
tcatacgcttcactaatg

SEQ ID NO: 37710 - DNA, 18 bp, Artificial Sequence
  Synthetic DNA
tcatacgcttcgcaatag

SEQ ID NO: 37711 - DNA, 18 bp, Artificial Sequence
  Synthetic DNA
tcatacggctcttaatag

SEQ ID NO: 37712 - DNA, 18 bp, Artificial Sequence
  Synthetic DNA
tcatacggctttccatag

SEQ ID NO: 37713 - DNA, 18 bp, Artificial Sequence
  Synthetic DNA
tcatacgtcccaataaag

SEQ ID NO: 37714 - DNA, 18 bp, Artificial Sequence
  Synthetic DNA
tcatacgtcctattatag

SEQ ID NO: 37715 - DNA, 18 bp, Artificial Sequence
  Synthetic DNA
tcatacgtctatatattg

SEQ ID NO: 37716 - DNA, 18 bp, Artificial Sequence
  Synthetic DNA
tcatacgtctctcctcag

SEQ ID NO: 37717 - DNA, 18 bp, Artificial Sequence
  Synthetic DNA
tcatacgtctctctgtgg

SEQ ID NO: 37718 - DNA, 18 bp, Artificial Sequence
  Synthetic DNA
tcatacgtttctctttgg

SEQ ID NO: 37719 - DNA, 18 bp, Artificial Sequence
  Synthetic DNA
tcatactactacctattg

SEQ ID NO: 37720 - DNA, 18 bp, Artificial Sequence
  Synthetic DNA
tcatactagacttttcag

SEQ ID NO: 37721 - DNA, 18 bp, Artificial Sequence
  Synthetic DNA
tcatactattaattatag

SEQ ID NO: 37722 - DNA, 18 bp, Artificial Sequence
  Synthetic DNA
tcatacttttaactttag

SEQ ID NO: 37723 - DNA, 18 bp, Artificial Sequence
  Synthetic DNA
tcataggactccttacag

SEQ ID NO: 37724 - DNA, 18 bp, Artificial Sequence
  Synthetic DNA
tcataggtcaaattatag

SEQ ID NO: 37725 - DNA, 18 bp, Artificial Sequence
  Synthetic DNA
tcataggtctcacaggag

SEQ ID NO: 37726 - DNA, 18 bp, Artificial Sequence
  Synthetic DNA
tcatataactcacaaaag

SEQ ID NO: 37727 - DNA, 18 bp, Artificial Sequence
  Synthetic DNA
tcatatgactaacaaaag

SEQ ID NO: 37728 - DNA, 18 bp, Artificial Sequence
  Synthetic DNA
tcatatgactacctgcag

SEQ ID NO: 37729 - DNA, 18 bp, Artificial Sequence
  Synthetic DNA
tcatatgactcccttgag

SEQ ID NO: 37730 - DNA, 18 bp, Artificial Sequence
  Synthetic DNA
tcatatgagcctctttag

SEQ ID NO: 37731 - DNA, 18 bp, Artificial Sequence
  Synthetic DNA
tcatatgtctaactttag

SEQ ID NO: 37732 - DNA, 18 bp, Artificial Sequence
  Synthetic DNA
tcatccaggcaactaaag

SEQ ID NO: 37733 - DNA, 18 bp, Artificial Sequence
  Synthetic DNA
tcatccctccgtctatag

SEQ ID NO: 37734 - DNA, 18 bp, Artificial Sequence
  Synthetic DNA
tcatccctctagctattg

SEQ ID NO: 37735 - DNA, 18 bp, Artificial Sequence
  Synthetic DNA
tcatccgatttacttatg

SEQ ID NO: 37736 - DNA, 18 bp, Artificial Sequence
  Synthetic DNA
tcatcggagtcaatattg

SEQ ID NO: 37737 - DNA, 18 bp, Artificial Sequence
  Synthetic DNA
tcatctctctcacttccg

SEQ ID NO: 37738 - DNA, 18 bp, Artificial Sequence
  Synthetic DNA
tcatcttacaaactatag

SEQ ID NO: 37739 - DNA, 18 bp, Artificial Sequence
  Synthetic DNA
tcatgcagctcccaatag

SEQ ID NO: 37740 - DNA, 18 bp, Artificial Sequence
  Synthetic DNA
tcatgcgaattactttag

SEQ ID NO: 37741 - DNA, 18 bp, Artificial Sequence
  Synthetic DNA
tcatgcgactcatcaaag

SEQ ID NO: 37742 - DNA, 18 bp, Artificial Sequence
  Synthetic DNA
tcatgcgccttacaatag

SEQ ID NO: 37743 - DNA, 18 bp, Artificial Sequence
  Synthetic DNA
tcatgcggctcacaataa

SEQ ID NO: 37744 - DNA, 18 bp, Artificial Sequence
  Synthetic DNA
tcatgggcctcagtatag

SEQ ID NO: 37745 - DNA, 18 bp, Artificial Sequence
  Synthetic DNA
tcatgtgtctcactctcg

SEQ ID NO: 37746 - DNA, 18 bp, Artificial Sequence
  Synthetic DNA
tcattatatacgccatag

SEQ ID NO: 37747 - DNA, 18 bp, Artificial Sequence
  Synthetic DNA
tcattcaactcaatgtag

SEQ ID NO: 37748 - DNA, 18 bp, Artificial Sequence
  Synthetic DNA
tcattcgaatccttaagg

SEQ ID NO: 37749 - DNA, 18 bp, Artificial Sequence
  Synthetic DNA
tcattcgacacacaaaag

SEQ ID NO: 37750 - DNA, 18 bp, Artificial Sequence
  Synthetic DNA
tcattcgactcataattg

SEQ ID NO: 37751 - DNA, 18 bp, Artificial Sequence
  Synthetic DNA
tcattcgactcattaagg

SEQ ID NO: 37752 - DNA, 18 bp, Artificial Sequence
  Synthetic DNA
tcattcgagacactttcg

SEQ ID NO: 37753 - DNA, 18 bp, Artificial Sequence
  Synthetic DNA
tcattcgcatcacaatag

SEQ ID NO: 37754 - DNA, 18 bp, Artificial Sequence
  Synthetic DNA
tcattcgcctcatattag

SEQ ID NO: 37755 - DNA, 18 bp, Artificial Sequence
  Synthetic DNA
tcattcgcttcacttatg

SEQ ID NO: 37756 - DNA, 18 bp, Artificial Sequence
  Synthetic DNA
tcattcggcacactttag

SEQ ID NO: 37757 - DNA, 18 bp, Artificial Sequence
  Synthetic DNA
tcattcggctcacttaag

SEQ ID NO: 37758 - DNA, 18 bp, Artificial Sequence
  Synthetic DNA
tcattcgtatcacaattg

SEQ ID NO: 37759 - DNA, 18 bp, Artificial Sequence
  Synthetic DNA
tcattcgtcacacaatag

SEQ ID NO: 37760 - DNA, 18 bp, Artificial Sequence
  Synthetic DNA
tcattctactaagtaaag

SEQ ID NO: 37761 - DNA, 18 bp, Artificial Sequence
  Synthetic DNA
tcattggactcactactg

SEQ ID NO: 37762 - DNA, 18 bp, Artificial Sequence
  Synthetic DNA
tcattggtctaactactg

SEQ ID NO: 37763 - DNA, 18 bp, Artificial Sequence
  Synthetic DNA
tcatttgactgaatatag

SEQ ID NO: 37764 - DNA, 18 bp, Artificial Sequence
  Synthetic DNA
tcccacacctcaatattg

SEQ ID NO: 37765 - DNA, 18 bp, Artificial Sequence
  Synthetic DNA
tcctaaaacttagtactg

SEQ ID NO: 37766 - DNA, 18 bp, Artificial Sequence
  Synthetic DNA
tcctaccactcaatattg

SEQ ID NO: 37767 - DNA, 18 bp, Artificial Sequence
  Synthetic DNA
tcctacgactctcttaag

SEQ ID NO: 37768 - DNA, 18 bp, Artificial Sequence
  Synthetic DNA
tcctacgatacaccttag

SEQ ID NO: 37769 - DNA, 18 bp, Artificial Sequence
  Synthetic DNA
tcctacgattaactaaag

SEQ ID NO: 37770 - DNA, 18 bp, Artificial Sequence
  Synthetic DNA
tccttcggctgtctatag

SEQ ID NO: 37771 - DNA, 18 bp, Artificial Sequence
  Synthetic DNA
tcgaacgacattttatag

SEQ ID NO: 37772 - DNA, 18 bp, Artificial Sequence
  Synthetic DNA
tcgagctactcacaatag

SEQ ID NO: 37773 - DNA, 18 bp, Artificial Sequence
  Synthetic DNA
tcgcccgaatcagtaaag

SEQ ID NO: 37774 - DNA, 18 bp, Artificial Sequence
  Synthetic DNA
tcgctcgtatctctatgg

SEQ ID NO: 37775 - DNA, 18 bp, Artificial Sequence
  Synthetic DNA
tcgtacttccatctaatg

SEQ ID NO: 37776 - DNA, 18 bp, Artificial Sequence
  Synthetic DNA
tcgtaggactgaccatag

SEQ ID NO: 37777 - DNA, 18 bp, Artificial Sequence
  Synthetic DNA
tcgttcgtattattattg

SEQ ID NO: 37778 - DNA, 18 bp, Artificial Sequence
  Synthetic DNA
tcgttctactctctatag

SEQ ID NO: 37779 - DNA, 18 bp, Artificial Sequence
  Synthetic DNA
tctaacgactcacacttg

SEQ ID NO: 37780 - DNA, 18 bp, Artificial Sequence
  Synthetic DNA
tctaacgactcacttttg

SEQ ID NO: 37781 - DNA, 18 bp, Artificial Sequence
  Synthetic DNA
tctaacgacttaatatcg

SEQ ID NO: 37782 - DNA, 18 bp, Artificial Sequence
  Synthetic DNA
tctaacgcatcactttag

SEQ ID NO: 37783 - DNA, 18 bp, Artificial Sequence
  Synthetic DNA
tctaacgtctcactttag

SEQ ID NO: 37784 - DNA, 18 bp, Artificial Sequence
  Synthetic DNA
tctaacgtctctatctag

SEQ ID NO: 37785 - DNA, 18 bp, Artificial Sequence
  Synthetic DNA
tctaactactgacttaag

SEQ ID NO: 37786 - DNA, 18 bp, Artificial Sequence
  Synthetic DNA
tctaatgattctctctag

SEQ ID NO: 37787 - DNA, 18 bp, Artificial Sequence
  Synthetic DNA
tctacctcctcatcatag

SEQ ID NO: 37788 - DNA, 18 bp, Artificial Sequence
  Synthetic DNA
tctatctactctctatag

SEQ ID NO: 37789 - DNA, 18 bp, Artificial Sequence
  Synthetic DNA
tctcaagactcactacag

SEQ ID NO: 37790 - DNA, 18 bp, Artificial Sequence
  Synthetic DNA
tctcacgaactattatag

SEQ ID NO: 37791 - DNA, 18 bp, Artificial Sequence
  Synthetic DNA
tctcacgactcactgcag

SEQ ID NO: 37792 - DNA, 18 bp, Artificial Sequence
  Synthetic DNA
tctcacgactcataatcg

SEQ ID NO: 37793 - DNA, 18 bp, Artificial Sequence
  Synthetic DNA
tctcacgactttcaacag

SEQ ID NO: 37794 - DNA, 18 bp, Artificial Sequence
  Synthetic DNA
tctcacggctcaatatag

SEQ ID NO: 37795 - DNA, 18 bp, Artificial Sequence
  Synthetic DNA
tctcaggtctctctaaag

SEQ ID NO: 37796 - DNA, 18 bp, Artificial Sequence
  Synthetic DNA
tcttaaaacccactaatg

SEQ ID NO: 37797 - DNA, 18 bp, Artificial Sequence
  Synthetic DNA
tcttaagagtttctatag

SEQ ID NO: 37798 - DNA, 18 bp, Artificial Sequence
  Synthetic DNA
tcttaatactcaccatag

SEQ ID NO: 37799 - DNA, 18 bp, Artificial Sequence
  Synthetic DNA
tcttacaacttacaaaag

SEQ ID NO: 37800 - DNA, 18 bp, Artificial Sequence
  Synthetic DNA
tcttacaagacactatag

SEQ ID NO: 37801 - DNA, 18 bp, Artificial Sequence
  Synthetic DNA
tcttacatctcataatag

SEQ ID NO: 37802 - DNA, 18 bp, Artificial Sequence
  Synthetic DNA
tcttaccaataagcatag

SEQ ID NO: 37803 - DNA, 18 bp, Artificial Sequence
  Synthetic DNA
tcttacgaatatcaatag

SEQ ID NO: 37804 - DNA, 18 bp, Artificial Sequence
  Synthetic DNA
tcttacgacaatctttag

SEQ ID NO: 37805 - DNA, 18 bp, Artificial Sequence
  Synthetic DNA
tcttacgacacactcttg

SEQ ID NO: 37806 - DNA, 18 bp, Artificial Sequence
  Synthetic DNA
tcttacgactcaaaatcg

SEQ ID NO: 37807 - DNA, 18 bp, Artificial Sequence
  Synthetic DNA
tcttacgactcgcttaag

SEQ ID NO: 37808 - DNA, 18 bp, Artificial Sequence
  Synthetic DNA
tcttacgagataatatag

SEQ ID NO: 37809 - DNA, 18 bp, Artificial Sequence
  Synthetic DNA
tcttacgagtctcttttg

SEQ ID NO: 37810 - DNA, 18 bp, Artificial Sequence
  Synthetic DNA
tcttacgataaactttcg

SEQ ID NO: 37811 - DNA, 18 bp, Artificial Sequence
  Synthetic DNA
tcttacgatgctctatag

SEQ ID NO: 37812 - DNA, 18 bp, Artificial Sequence
  Synthetic DNA
tcttacgtcgcactttag

SEQ ID NO: 37813 - DNA, 18 bp, Artificial Sequence
  Synthetic DNA
tcttaggactcactttcg

SEQ ID NO: 37814 - DNA, 18 bp, Artificial Sequence
  Synthetic DNA
tcttatgactaacaatag

SEQ ID NO: 37815 - DNA, 18 bp, Artificial Sequence
  Synthetic DNA
tcttatgtcactctttag

SEQ ID NO: 37816 - DNA, 18 bp, Artificial Sequence
  Synthetic DNA
tcttattacacactttag

SEQ ID NO: 37817 - DNA, 18 bp, Artificial Sequence
  Synthetic DNA
tcttccgactctctacag

SEQ ID NO: 37818 - DNA, 18 bp, Artificial Sequence
  Synthetic DNA
tcttgcaactcagtcttg

SEQ ID NO: 37819 - DNA, 18 bp, Artificial Sequence
  Synthetic DNA
tctttagtctccctatag

SEQ ID NO: 37820 - DNA, 18 bp, Artificial Sequence
  Synthetic DNA
tctttatactcactatag

SEQ ID NO: 37821 - DNA, 18 bp, Artificial Sequence
  Synthetic DNA
tctttatacttacttaag

SEQ ID NO: 37822 - DNA, 18 bp, Artificial Sequence
  Synthetic DNA
tctttcgacaaaccatag

SEQ ID NO: 37823 - DNA, 18 bp, Artificial Sequence
  Synthetic DNA
tctttcgactaaccattg

SEQ ID NO: 37824 - DNA, 18 bp, Artificial Sequence
  Synthetic DNA
tctttcttctcactatag

SEQ ID NO: 37825 - DNA, 18 bp, Artificial Sequence
  Synthetic DNA
tgaaacaatacgcgttag

SEQ ID NO: 37826 - DNA, 18 bp, Artificial Sequence
  Synthetic DNA
tgaaacaatgcactaaag

SEQ ID NO: 37827 - DNA, 18 bp, Artificial Sequence
  Synthetic DNA
tgaaacaccgccctttcg

SEQ ID NO: 37828 - DNA, 18 bp, Artificial Sequence
  Synthetic DNA
tgaaacctctctctatag

SEQ ID NO: 37829 - DNA, 18 bp, Artificial Sequence
  Synthetic DNA
tgaaacgaatatccatag

SEQ ID NO: 37830 - DNA, 18 bp, Artificial Sequence
  Synthetic DNA
tgaaacgaatcacgaatg

SEQ ID NO: 37831 - DNA, 18 bp, Artificial Sequence
  Synthetic DNA
tgaaacgaattcctaaag

SEQ ID NO: 37832 - DNA, 18 bp, Artificial Sequence
  Synthetic DNA
tgaaacgacacttcattg

SEQ ID NO: 37833 - DNA, 18 bp, Artificial Sequence
  Synthetic DNA
tgaaacgattctatatag

SEQ ID NO: 37834 - DNA, 18 bp, Artificial Sequence
  Synthetic DNA
tgaaacgtatcactgtag

SEQ ID NO: 37835 - DNA, 18 bp, Artificial Sequence
  Synthetic DNA
tgaaacgtatgattgtag

SEQ ID NO: 37836 - DNA, 18 bp, Artificial Sequence
  Synthetic DNA
tgaaacgtcacccaaacg

SEQ ID NO: 37837 - DNA, 18 bp, Artificial Sequence
  Synthetic DNA
tgaaaggaataaattacg

SEQ ID NO: 37838 - DNA, 18 bp, Artificial Sequence
  Synthetic DNA
tgaaatgacttactgttg

SEQ ID NO: 37839 - DNA, 18 bp, Artificial Sequence
  Synthetic DNA
tgaaccgacgctctatag

SEQ ID NO: 37840 - DNA, 18 bp, Artificial Sequence
  Synthetic DNA
tgaatcgagtcccttaag

SEQ ID NO: 37841 - DNA, 18 bp, Artificial Sequence
  Synthetic DNA
tgaatctagtctcattag

SEQ ID NO: 37842 - DNA, 18 bp, Artificial Sequence
  Synthetic DNA
tgaatttacacactaaag

SEQ ID NO: 37843 - DNA, 18 bp, Artificial Sequence
  Synthetic DNA
tgacaagacccacattag

SEQ ID NO: 37844 - DNA, 18 bp, Artificial Sequence
  Synthetic DNA
tgacacgactcacaactg

SEQ ID NO: 37845 - DNA, 18 bp, Artificial Sequence
  Synthetic DNA
tgacacgactcaccatga

SEQ ID NO: 37846 - DNA, 18 bp, Artificial Sequence
  Synthetic DNA
tgacacgactctttaaag

SEQ ID NO: 37847 - DNA, 18 bp, Artificial Sequence
  Synthetic DNA
tgacacgtcttcctgtag

SEQ ID NO: 37848 - DNA, 18 bp, Artificial Sequence
  Synthetic DNA
tgacatgactcaccttag

SEQ ID NO: 37849 - DNA, 18 bp, Artificial Sequence
  Synthetic DNA
tgagaagacaaactgtag

SEQ ID NO: 37850 - DNA, 18 bp, Artificial Sequence
  Synthetic DNA
tgagacatctctctatag

SEQ ID NO: 37851 - DNA, 18 bp, Artificial Sequence
  Synthetic DNA
tgagagaaatcactattg

SEQ ID NO: 37852 - DNA, 18 bp, Artificial Sequence
  Synthetic DNA
tgagaggtctcactttag

SEQ ID NO: 37853 - DNA, 18 bp, Artificial Sequence
  Synthetic DNA
tgataaaactcgcattag

SEQ ID NO: 37854 - DNA, 18 bp, Artificial Sequence
  Synthetic DNA
tgataagaatcatcatag

SEQ ID NO: 37855 - DNA, 18 bp, Artificial Sequence
  Synthetic DNA
tgataagactctttgaag

SEQ ID NO: 37856 - DNA, 18 bp, Artificial Sequence
  Synthetic DNA
tgataagtttccctatag

SEQ ID NO: 37857 - DNA, 18 bp, Artificial Sequence
  Synthetic DNA
tgataatactctctctag

SEQ ID NO: 37858 - DNA, 18 bp, Artificial Sequence
  Synthetic DNA
tgataatacttacaatcg

SEQ ID NO: 37859 - DNA, 18 bp, Artificial Sequence
  Synthetic DNA
tgataatattctctatag

SEQ ID NO: 37860 - DNA, 18 bp, Artificial Sequence
  Synthetic DNA
tgatacaacgcgctgacg

SEQ ID NO: 37861 - DNA, 18 bp, Artificial Sequence
  Synthetic DNA
tgatacctctgactgctg

SEQ ID NO: 37862 - DNA, 18 bp, Artificial Sequence
  Synthetic DNA
tgatacgaatgagtttag

SEQ ID NO: 37863 - DNA, 18 bp, Artificial Sequence
  Synthetic DNA
tgatacgactcaattacg

SEQ ID NO: 37864 - DNA, 18 bp, Artificial Sequence
  Synthetic DNA
tgatacgcatcattaaag

SEQ ID NO: 37865 - DNA, 18 bp, Artificial Sequence
  Synthetic DNA
tgatacggctcagtttgg

SEQ ID NO: 37866 - DNA, 18 bp, Artificial Sequence
  Synthetic DNA
tgatacgtctaactcatg

SEQ ID NO: 37867 - DNA, 18 bp, Artificial Sequence
  Synthetic DNA
tgatacgtctctctactg

SEQ ID NO: 37868 - DNA, 18 bp, Artificial Sequence
  Synthetic DNA
tgatacgtctgggaatag

SEQ ID NO: 37869 - DNA, 18 bp, Artificial Sequence
  Synthetic DNA
tgatactacaccctcttg

SEQ ID NO: 37870 - DNA, 18 bp, Artificial Sequence
  Synthetic DNA
tgatactacactctttag

SEQ ID NO: 37871 - DNA, 18 bp, Artificial Sequence
  Synthetic DNA
tgatactacatactctag

SEQ ID NO: 37872 - DNA, 18 bp, Artificial Sequence
  Synthetic DNA
tgatacttatatgtttag

SEQ ID NO: 37873 - DNA, 18 bp, Artificial Sequence
  Synthetic DNA
tgatacttcccactcaag

SEQ ID NO: 37874 - DNA, 18 bp, Artificial Sequence
  Synthetic DNA
tgataggtttctctttcg

SEQ ID NO: 37875 - DNA, 18 bp, Artificial Sequence
  Synthetic DNA
tgatataattcaatgtag

SEQ ID NO: 37876 - DNA, 18 bp, Artificial Sequence
  Synthetic DNA
tgatataccactctatag

SEQ ID NO: 37877 - DNA, 18 bp, Artificial Sequence
  Synthetic DNA
tgatatacctcactacag

SEQ ID NO: 37878 - DNA, 18 bp, Artificial Sequence
  Synthetic DNA
tgatatatcacactacag

SEQ ID NO: 37879 - DNA, 18 bp, Artificial Sequence
  Synthetic DNA
tgatatcgctcgctatag

SEQ ID NO: 37880 - DNA, 18 bp, Artificial Sequence
  Synthetic DNA
tgatatggctacctatag

SEQ ID NO: 37881 - DNA, 18 bp, Artificial Sequence
  Synthetic DNA
tgatcagcatcactattg

SEQ ID NO: 37882 - DNA, 18 bp, Artificial Sequence
  Synthetic DNA
tgatccatctcacactag

SEQ ID NO: 37883 - DNA, 18 bp, Artificial Sequence
  Synthetic DNA
tgatccgacccactaacg

SEQ ID NO: 37884 - DNA, 18 bp, Artificial Sequence
  Synthetic DNA
tgatccgtcccaatattg

SEQ ID NO: 37885 - DNA, 18 bp, Artificial Sequence
  Synthetic DNA
tgatccttgtcactatag

SEQ ID NO: 37886 - DNA, 18 bp, Artificial Sequence
  Synthetic DNA
tgatgactctcacagtag

SEQ ID NO: 37887 - DNA, 18 bp, Artificial Sequence
  Synthetic DNA
tgatgcccatcattatag

SEQ ID NO: 37888 - DNA, 18 bp, Artificial Sequence
  Synthetic DNA
tgatgcgactcaattaag

SEQ ID NO: 37889 - DNA, 18 bp, Artificial Sequence
  Synthetic DNA
tgatgcgactgtctgtag

SEQ ID NO: 37890 - DNA, 18 bp, Artificial Sequence
  Synthetic DNA
tgatgctactaaccaaag

SEQ ID NO: 37891 - DNA, 18 bp, Artificial Sequence
  Synthetic DNA
tgatgctacttactgttg

SEQ ID NO: 37892 - DNA, 18 bp, Artificial Sequence
  Synthetic DNA
tgatgggactcataatag

SEQ ID NO: 37893 - DNA, 18 bp, Artificial Sequence
  Synthetic DNA
tgatgtgactaactactg

SEQ ID NO: 37894 - DNA, 18 bp, Artificial Sequence
  Synthetic DNA
tgattcaacaaactttcg

SEQ ID NO: 37895 - DNA, 18 bp, Artificial Sequence
  Synthetic DNA
tgattccacatacaatag

SEQ ID NO: 37896 - DNA, 18 bp, Artificial Sequence
  Synthetic DNA
tgattccgcgctctatcg

SEQ ID NO: 37897 - DNA, 18 bp, Artificial Sequence
  Synthetic DNA
tgattcgaatatatatag

SEQ ID NO: 37898 - DNA, 18 bp, Artificial Sequence
  Synthetic DNA
tgattcgaatgtcaatag

SEQ ID NO: 37899 - DNA, 18 bp, Artificial Sequence
  Synthetic DNA
tgattcgacacacttcag

SEQ ID NO: 37900 - DNA, 18 bp, Artificial Sequence
  Synthetic DNA
tgattcgacccacttatg

SEQ ID NO: 37901 - DNA, 18 bp, Artificial Sequence
  Synthetic DNA
tgattcgacgcactgcag

SEQ ID NO: 37902 - DNA, 18 bp, Artificial Sequence
  Synthetic DNA
tgattcgatttagtatcg

SEQ ID NO: 37903 - DNA, 18 bp, Artificial Sequence
  Synthetic DNA
tgattcgcccacctctgg

SEQ ID NO: 37904 - DNA, 18 bp, Artificial Sequence
  Synthetic DNA
tgattcgcttcactcaag

SEQ ID NO: 37905 - DNA, 18 bp, Artificial Sequence
  Synthetic DNA
tgattgtacaccctatag

SEQ ID NO: 37906 - DNA, 18 bp, Artificial Sequence
  Synthetic DNA
tgatttgattctttcatg

SEQ ID NO: 37907 - DNA, 18 bp, Artificial Sequence
  Synthetic DNA
tgcaacatcccacaatag

SEQ ID NO: 37908 - DNA, 18 bp, Artificial Sequence
  Synthetic DNA
tgcaaggactcattatag

SEQ ID NO: 37909 - DNA, 18 bp, Artificial Sequence
  Synthetic DNA
tgcatataatcactattg

SEQ ID NO: 37910 - DNA, 18 bp, Artificial Sequence
  Synthetic DNA
tgcatcgactcatattag

SEQ ID NO: 37911 - DNA, 18 bp, Artificial Sequence
  Synthetic DNA
tgctaacaaaaactattg

SEQ ID NO: 37912 - DNA, 18 bp, Artificial Sequence
  Synthetic DNA
tgctacgacctaaaatag

SEQ ID NO: 37913 - DNA, 18 bp, Artificial Sequence
  Synthetic DNA
tgctacgactgattaaag

SEQ ID NO: 37914 - DNA, 18 bp, Artificial Sequence
  Synthetic DNA
tgctacgtcaaactattg

SEQ ID NO: 37915 - DNA, 18 bp, Artificial Sequence
  Synthetic DNA
tgctacgtctaactgtgg

SEQ ID NO: 37916 - DNA, 18 bp, Artificial Sequence
  Synthetic DNA
tgctaggactctctacag

SEQ ID NO: 37917 - DNA, 18 bp, Artificial Sequence
  Synthetic DNA
tgctctgactgaccatag

SEQ ID NO: 37918 - DNA, 18 bp, Artificial Sequence
  Synthetic DNA
tgctgcgactcattttag

SEQ ID NO: 37919 - DNA, 18 bp, Artificial Sequence
  Synthetic DNA
tgctttgactcactgtag

SEQ ID NO: 37920 - DNA, 18 bp, Artificial Sequence
  Synthetic DNA
tggaacgactctcaatag

SEQ ID NO: 37921 - DNA, 18 bp, Artificial Sequence
  Synthetic DNA
tggcacaactcagtaatg

SEQ ID NO: 37922 - DNA, 18 bp, Artificial Sequence
  Synthetic DNA
tggtaacactcactttag

SEQ ID NO: 37923 - DNA, 18 bp, Artificial Sequence
  Synthetic DNA
tggtacgacactctaaag

SEQ ID NO: 37924 - DNA, 18 bp, Artificial Sequence
  Synthetic DNA
tggtatgacattcttttg

SEQ ID NO: 37925 - DNA, 18 bp, Artificial Sequence
  Synthetic DNA
tggtatgactctctattg

SEQ ID NO: 37926 - DNA, 18 bp, Artificial Sequence
  Synthetic DNA
tggtgcatgtaacaaaag

SEQ ID NO: 37927 - DNA, 18 bp, Artificial Sequence
  Synthetic DNA
tggtgcgccacactaaag

SEQ ID NO: 37928 - DNA, 18 bp, Artificial Sequence
  Synthetic DNA
tgtaacgactatctttag

SEQ ID NO: 37929 - DNA, 18 bp, Artificial Sequence
  Synthetic DNA
tgtaacgtctcactatat

SEQ ID NO: 37930 - DNA, 18 bp, Artificial Sequence
  Synthetic DNA
tgtacgcactcactatag

SEQ ID NO: 37931 - DNA, 18 bp, Artificial Sequence
  Synthetic DNA
tgtatctaatcagtatag

SEQ ID NO: 37932 - DNA, 18 bp, Artificial Sequence
  Synthetic DNA
tgtcacaactctctcaag

SEQ ID NO: 37933 - DNA, 18 bp, Artificial Sequence
  Synthetic DNA
tgtcacgacttcctatag

SEQ ID NO: 37934 - DNA, 18 bp, Artificial Sequence
  Synthetic DNA
tgttaagaatatctatag

SEQ ID NO: 37935 - DNA, 18 bp, Artificial Sequence
  Synthetic DNA
tgttaagacccacgatag

SEQ ID NO: 37936 - DNA, 18 bp, Artificial Sequence
  Synthetic DNA
tgttaagagtcattctag

SEQ ID NO: 37937 - DNA, 18 bp, Artificial Sequence
  Synthetic DNA
tgttaagatccactatag

SEQ ID NO: 37938 - DNA, 18 bp, Artificial Sequence
  Synthetic DNA
tgttacaacatactatag

SEQ ID NO: 37939 - DNA, 18 bp, Artificial Sequence
  Synthetic DNA
tgttacaactctctgaag

SEQ ID NO: 37940 - DNA, 18 bp, Artificial Sequence
  Synthetic DNA
tgttacgccttacataag

SEQ ID NO: 37941 - DNA, 18 bp, Artificial Sequence
  Synthetic DNA
tgttacggcttactgttg

SEQ ID NO: 37942 - DNA, 18 bp, Artificial Sequence
  Synthetic DNA
tgttacgtctgacttttg

SEQ ID NO: 37943 - DNA, 18 bp, Artificial Sequence
  Synthetic DNA
tgttacttcaggctactg

SEQ ID NO: 37944 - DNA, 18 bp, Artificial Sequence
  Synthetic DNA
tgttataactctcaatgg

SEQ ID NO: 37945 - DNA, 18 bp, Artificial Sequence
  Synthetic DNA
tgttatgactttatttag

SEQ ID NO: 37946 - DNA, 18 bp, Artificial Sequence
  Synthetic DNA
tgttatgtctccgtttag

SEQ ID NO: 37947 - DNA, 18 bp, Artificial Sequence
  Synthetic DNA
tgttatgtgttattatcg

SEQ ID NO: 37948 - DNA, 18 bp, Artificial Sequence
  Synthetic DNA
tgttccggcccactatcg

SEQ ID NO: 37949 - DNA, 18 bp, Artificial Sequence
  Synthetic DNA
tgttctgtctcactatcg

SEQ ID NO: 37950 - DNA, 18 bp, Artificial Sequence
  Synthetic DNA
tgttctgtttcagtaaag

SEQ ID NO: 37951 - DNA, 18 bp, Artificial Sequence
  Synthetic DNA
tgttgcgactcactcttg

SEQ ID NO: 37952 - DNA, 18 bp, Artificial Sequence
  Synthetic DNA
tgttgtaacacacattag

SEQ ID NO: 37953 - DNA, 18 bp, Artificial Sequence
  Synthetic DNA
tgtttacaataacacaag

SEQ ID NO: 37954 - DNA, 18 bp, Artificial Sequence
  Synthetic DNA
tgtttagacccattctag

SEQ ID NO: 37955 - DNA, 18 bp, Artificial Sequence
  Synthetic DNA
tgtttagtttcactttag

SEQ ID NO: 37956 - DNA, 18 bp, Artificial Sequence
  Synthetic DNA
tgtttcgactctcttaag

SEQ ID NO: 37957 - DNA, 18 bp, Artificial Sequence
  Synthetic DNA
tgtttctattcactatag

SEQ ID NO: 37958 - DNA, 18 bp, Artificial Sequence
  Synthetic DNA
tgtttcttcgcactatag

SEQ ID NO: 37959 - DNA, 18 bp, Artificial Sequence
  Synthetic DNA
tgttttgactcattatag

SEQ ID NO: 37960 - DNA, 18 bp, Artificial Sequence
  Synthetic DNA
ttaaaaaacacactttag

SEQ ID NO: 37961 - DNA, 18 bp, Artificial Sequence
  Synthetic DNA
ttaaaagaattactgtag

SEQ ID NO: 37962 - DNA, 18 bp, Artificial Sequence
  Synthetic DNA
ttaaaagcctcactattg

SEQ ID NO: 37963 - DNA, 18 bp, Artificial Sequence
  Synthetic DNA
ttaaaagtctctctaaag

SEQ ID NO: 37964 - DNA, 18 bp, Artificial Sequence
  Synthetic DNA
ttaaaagtctctctatag

SEQ ID NO: 37965 - DNA, 18 bp, Artificial Sequence
  Synthetic DNA
ttaaacaacacaccattg

SEQ ID NO: 37966 - DNA, 18 bp, Artificial Sequence
  Synthetic DNA
ttaaacaactcactcttg

SEQ ID NO: 37967 - DNA, 18 bp, Artificial Sequence
  Synthetic DNA
ttaaacaactctggttag

SEQ ID NO: 37968 - DNA, 18 bp, Artificial Sequence
  Synthetic DNA
ttaaaccacttaaaatag

SEQ ID NO: 37969 - DNA, 18 bp, Artificial Sequence
  Synthetic DNA
ttaaacgacccggcatag

SEQ ID NO: 37970 - DNA, 18 bp, Artificial Sequence
  Synthetic DNA
ttaaacgactatctatcg

SEQ ID NO: 37971 - DNA, 18 bp, Artificial Sequence
  Synthetic DNA
ttaaacgactcaaaacag

SEQ ID NO: 37972 - DNA, 18 bp, Artificial Sequence
  Synthetic DNA
ttaaacgactcataaatg

SEQ ID NO: 37973 - DNA, 18 bp, Artificial Sequence
  Synthetic DNA
ttaaacgactcattagtg

SEQ ID NO: 37974 - DNA, 18 bp, Artificial Sequence
  Synthetic DNA
ttaaacgactctatctag

SEQ ID NO: 37975 - DNA, 18 bp, Artificial Sequence
  Synthetic DNA
ttaaacgactctctttgg

SEQ ID NO: 37976 - DNA, 18 bp, Artificial Sequence
  Synthetic DNA
ttaaacgacttgctgtag

SEQ ID NO: 37977 - DNA, 18 bp, Artificial Sequence
  Synthetic DNA
ttaaacgccatacagttg

SEQ ID NO: 37978 - DNA, 18 bp, Artificial Sequence
  Synthetic DNA
ttaaacgcctaactcgag

SEQ ID NO: 37979 - DNA, 18 bp, Artificial Sequence
  Synthetic DNA
ttaaacgcctcaaaatag

SEQ ID NO: 37980 - DNA, 18 bp, Artificial Sequence
  Synthetic DNA
ttaaacgcgtcactaaag

SEQ ID NO: 37981 - DNA, 18 bp, Artificial Sequence
  Synthetic DNA
ttaaacggcttactttag

SEQ ID NO: 37982 - DNA, 18 bp, Artificial Sequence
  Synthetic DNA
ttaaacgtatcaatatag

SEQ ID NO: 37983 - DNA, 18 bp, Artificial Sequence
  Synthetic DNA
ttaaacgtatcacaaatg

SEQ ID NO: 37984 - DNA, 18 bp, Artificial Sequence
  Synthetic DNA
ttaaacgtcacactaatg

SEQ ID NO: 37985 - DNA, 18 bp, Artificial Sequence
  Synthetic DNA
ttaaacgtctcacaatcg

SEQ ID NO: 37986 - DNA, 18 bp, Artificial Sequence
  Synthetic DNA
ttaaacgtgtaacaatag

SEQ ID NO: 37987 - DNA, 18 bp, Artificial Sequence
  Synthetic DNA
ttaaacgttgcactatgg

SEQ ID NO: 37988 - DNA, 18 bp, Artificial Sequence
  Synthetic DNA
ttaaactacaccctctag

SEQ ID NO: 37989 - DNA, 18 bp, Artificial Sequence
  Synthetic DNA
ttaaactacccatgttag

SEQ ID NO: 37990 - DNA, 18 bp, Artificial Sequence
  Synthetic DNA
ttaaactactaaaaacag

SEQ ID NO: 37991 - DNA, 18 bp, Artificial Sequence
  Synthetic DNA
ttaaactatacacttttg

SEQ ID NO: 37992 - DNA, 18 bp, Artificial Sequence
  Synthetic DNA
ttaaactatttactaaag

SEQ ID NO: 37993 - DNA, 18 bp, Artificial Sequence
  Synthetic DNA
ttaaacttacatctatag

SEQ ID NO: 37994 - DNA, 18 bp, Artificial Sequence
  Synthetic DNA
ttaaaggactctccaaag

SEQ ID NO: 37995 - DNA, 18 bp, Artificial Sequence
  Synthetic DNA
ttaaaggattcaattgag

SEQ ID NO: 37996 - DNA, 18 bp, Artificial Sequence
  Synthetic DNA
ttaaataaatgactttag

SEQ ID NO: 37997 - DNA, 18 bp, Artificial Sequence
  Synthetic DNA
ttaaatgactaactttag

SEQ ID NO: 37998 - DNA, 18 bp, Artificial Sequence
  Synthetic DNA
ttaaatgactcagttgag

SEQ ID NO: 37999 - DNA, 18 bp, Artificial Sequence
  Synthetic DNA
ttaaatgactctctaatg

SEQ ID NO: 38000 - DNA, 18 bp, Artificial Sequence
  Synthetic DNA
ttaaatgattcataatag

SEQ ID NO: 38001 - DNA, 18 bp, Artificial Sequence
  Synthetic DNA
ttaacaaactctctaatg

SEQ ID NO: 38002 - DNA, 18 bp, Artificial Sequence
  Synthetic DNA
ttaaccgactcacagttg

SEQ ID NO: 38003 - DNA, 18 bp, Artificial Sequence
  Synthetic DNA
ttaagcaagtcacatctg

SEQ ID NO: 38004 - DNA, 18 bp, Artificial Sequence
  Synthetic DNA
ttaagcgacgcattttag

SEQ ID NO: 38005 - DNA, 18 bp, Artificial Sequence
  Synthetic DNA
ttaagcgagtctctatag

SEQ ID NO: 38006 - DNA, 18 bp, Artificial Sequence
  Synthetic DNA
ttaagcggcttactagag

SEQ ID NO: 38007 - DNA, 18 bp, Artificial Sequence
  Synthetic DNA
ttaagcgtctcactaaag

SEQ ID NO: 38008 - DNA, 18 bp, Artificial Sequence
  Synthetic DNA
ttaatacactcagtattg

SEQ ID NO: 38009 - DNA, 18 bp, Artificial Sequence
  Synthetic DNA
ttaatccactcacgatag

SEQ ID NO: 38010 - DNA, 18 bp, Artificial Sequence
  Synthetic DNA
ttaatcgacatacactcg

SEQ ID NO: 38011 - DNA, 18 bp, Artificial Sequence
  Synthetic DNA
ttaatcgactcacttgtg

SEQ ID NO: 38012 - DNA, 18 bp, Artificial Sequence
  Synthetic DNA
ttaatcgactgactatcg

SEQ ID NO: 38013 - DNA, 18 bp, Artificial Sequence
  Synthetic DNA
ttaattgaaccactatag

SEQ ID NO: 38014 - DNA, 18 bp, Artificial Sequence
  Synthetic DNA
ttacacaagtcactatgg

SEQ ID NO: 38015 - DNA, 18 bp, Artificial Sequence
  Synthetic DNA
ttacaccacaaactacag

SEQ ID NO: 38016 - DNA, 18 bp, Artificial Sequence
  Synthetic DNA
ttacacgaaacactattg

SEQ ID NO: 38017 - DNA, 18 bp, Artificial Sequence
  Synthetic DNA
ttacacgaatcacaacag

SEQ ID NO: 38018 - DNA, 18 bp, Artificial Sequence
  Synthetic DNA
ttacacgattctcttttg

SEQ ID NO: 38019 - DNA, 18 bp, Artificial Sequence
  Synthetic DNA
ttacacggctttctatag

SEQ ID NO: 38020 - DNA, 18 bp, Artificial Sequence
  Synthetic DNA
ttacacgtctttctatag

SEQ ID NO: 38021 - DNA, 18 bp, Artificial Sequence
  Synthetic DNA
ttacacgttacactatag

SEQ ID NO: 38022 - DNA, 18 bp, Artificial Sequence
  Synthetic DNA
ttacacttctccccatag

SEQ ID NO: 38023 - DNA, 18 bp, Artificial Sequence
  Synthetic DNA
ttacacttgtcactatgg

SEQ ID NO: 38024 - DNA, 18 bp, Artificial Sequence
  Synthetic DNA
ttacatgtgcatcttcag

SEQ ID NO: 38025 - DNA, 18 bp, Artificial Sequence
  Synthetic DNA
ttacctgacttgcttctg

SEQ ID NO: 38026 - DNA, 18 bp, Artificial Sequence
  Synthetic DNA
ttactatactcatcacag

SEQ ID NO: 38027 - DNA, 18 bp, Artificial Sequence
  Synthetic DNA
ttactcatcacaatatag

SEQ ID NO: 38028 - DNA, 18 bp, Artificial Sequence
  Synthetic DNA
ttactcgacgcattatag

SEQ ID NO: 38029 - DNA, 18 bp, Artificial Sequence
  Synthetic DNA
ttactcgattcacttcag

SEQ ID NO: 38030 - DNA, 18 bp, Artificial Sequence
  Synthetic DNA
ttactcgcctgtctatag

SEQ ID NO: 38031 - DNA, 18 bp, Artificial Sequence
  Synthetic DNA
ttagaagacacactaaag

SEQ ID NO: 38032 - DNA, 18 bp, Artificial Sequence
  Synthetic DNA
ttagaagaccaagcaaag

SEQ ID NO: 38033 - DNA, 18 bp, Artificial Sequence
  Synthetic DNA
ttagacaagtactctaag

SEQ ID NO: 38034 - DNA, 18 bp, Artificial Sequence
  Synthetic DNA
ttagacgacacattaaag

SEQ ID NO: 38035 - DNA, 18 bp, Artificial Sequence
  Synthetic DNA
ttagacgactctctcaag

SEQ ID NO: 38036 - DNA, 18 bp, Artificial Sequence
  Synthetic DNA
ttagactatactctctgg

SEQ ID NO: 38037 - DNA, 18 bp, Artificial Sequence
  Synthetic DNA
ttagacttatctctatag

SEQ ID NO: 38038 - DNA, 18 bp, Artificial Sequence
  Synthetic DNA
ttagatgactctcctgtg

SEQ ID NO: 38039 - DNA, 18 bp, Artificial Sequence
  Synthetic DNA
ttagtggacccacaacag

SEQ ID NO: 38040 - DNA, 18 bp, Artificial Sequence
  Synthetic DNA
ttataacattcataacag

SEQ ID NO: 38041 - DNA, 18 bp, Artificial Sequence
  Synthetic DNA
ttataagaatcacaatcg

SEQ ID NO: 38042 - DNA, 18 bp, Artificial Sequence
  Synthetic DNA
ttataagacccaatttag

SEQ ID NO: 38043 - DNA, 18 bp, Artificial Sequence
  Synthetic DNA
ttataagacccactaacg

SEQ ID NO: 38044 - DNA, 18 bp, Artificial Sequence
  Synthetic DNA
ttataagacctacaatag

SEQ ID NO: 38045 - DNA, 18 bp, Artificial Sequence
  Synthetic DNA
ttataagactatctattg

SEQ ID NO: 38046 - DNA, 18 bp, Artificial Sequence
  Synthetic DNA
ttataagactcggtaaag

SEQ ID NO: 38047 - DNA, 18 bp, Artificial Sequence
  Synthetic DNA
ttataagactggctgatg

SEQ ID NO: 38048 - DNA, 18 bp, Artificial Sequence
  Synthetic DNA
ttataagactttcaatgg

SEQ ID NO: 38049 - DNA, 18 bp, Artificial Sequence
  Synthetic DNA
ttataagattcccaattg

SEQ ID NO: 38050 - DNA, 18 bp, Artificial Sequence
  Synthetic DNA
ttataagattctgtatcg

SEQ ID NO: 38051 - DNA, 18 bp, Artificial Sequence
  Synthetic DNA
ttataagcattactatag

SEQ ID NO: 38052 - DNA, 18 bp, Artificial Sequence
  Synthetic DNA
ttataagcctcaaaatag

SEQ ID NO: 38053 - DNA, 18 bp, Artificial Sequence
  Synthetic DNA
ttataaggcttactaaag

SEQ ID NO: 38054 - DNA, 18 bp, Artificial Sequence
  Synthetic DNA
ttataagtcttcttacgg

SEQ ID NO: 38055 - DNA, 18 bp, Artificial Sequence
  Synthetic DNA
ttataagtgtctacaaag

SEQ ID NO: 38056 - DNA, 18 bp, Artificial Sequence
  Synthetic DNA
ttataatacaccctaagg

SEQ ID NO: 38057 - DNA, 18 bp, Artificial Sequence
  Synthetic DNA
ttataatgctcactaaag

SEQ ID NO: 38058 - DNA, 18 bp, Artificial Sequence
  Synthetic DNA
ttataattctaactcaag

SEQ ID NO: 38059 - DNA, 18 bp, Artificial Sequence
  Synthetic DNA
ttatacaaatcactattc

SEQ ID NO: 38060 - DNA, 18 bp, Artificial Sequence
  Synthetic DNA
ttatacaaatctatacag

SEQ ID NO: 38061 - DNA, 18 bp, Artificial Sequence
  Synthetic DNA
ttatacaacacacttcag

SEQ ID NO: 38062 - DNA, 18 bp, Artificial Sequence
  Synthetic DNA
ttatacaacacagtaaag

SEQ ID NO: 38063 - DNA, 18 bp, Artificial Sequence
  Synthetic DNA
ttatacaacacatttaag

SEQ ID NO: 38064 - DNA, 18 bp, Artificial Sequence
  Synthetic DNA
ttatacaacatactttag

SEQ ID NO: 38065 - DNA, 18 bp, Artificial Sequence
  Synthetic DNA
ttatacaacatgcaattg

SEQ ID NO: 38066 - DNA, 18 bp, Artificial Sequence
  Synthetic DNA
ttatacaactcacagtcg

SEQ ID NO: 38067 - DNA, 18 bp, Artificial Sequence
  Synthetic DNA
ttatacaactcactacct

SEQ ID NO: 38068 - DNA, 18 bp, Artificial Sequence
  Synthetic DNA
ttatacaactcattgaag

SEQ ID NO: 38069 - DNA, 18 bp, Artificial Sequence
  Synthetic DNA
ttatacaactctgtaaag

SEQ ID NO: 38070 - DNA, 18 bp, Artificial Sequence
  Synthetic DNA
ttatacaacttccttttg

SEQ ID NO: 38071 - DNA, 18 bp, Artificial Sequence
  Synthetic DNA
ttatacaagtctctaaag

SEQ ID NO: 38072 - DNA, 18 bp, Artificial Sequence
  Synthetic DNA
ttatacaattctttatag

SEQ ID NO: 38073 - DNA, 18 bp, Artificial Sequence
  Synthetic DNA
ttatacaattttatattg

SEQ ID NO: 38074 - DNA, 18 bp, Artificial Sequence
  Synthetic DNA
ttatacacatcaatatag

SEQ ID NO: 38075 - DNA, 18 bp, Artificial Sequence
  Synthetic DNA
ttatacagctcaaaaagg

SEQ ID NO: 38076 - DNA, 18 bp, Artificial Sequence
  Synthetic DNA
ttatacatctcaccatgg

SEQ ID NO: 38077 - DNA, 18 bp, Artificial Sequence
  Synthetic DNA
ttatacatctctctacag

SEQ ID NO: 38078 - DNA, 18 bp, Artificial Sequence
  Synthetic DNA
ttatacattacaatatag

SEQ ID NO: 38079 - DNA, 18 bp, Artificial Sequence
  Synthetic DNA
ttataccacaaacaatcg

SEQ ID NO: 38080 - DNA, 18 bp, Artificial Sequence
  Synthetic DNA
ttataccacttagaacag

SEQ ID NO: 38081 - DNA, 18 bp, Artificial Sequence
  Synthetic DNA
ttataccagttactttag

SEQ ID NO: 38082 - DNA, 18 bp, Artificial Sequence
  Synthetic DNA
ttatacccctctctattg

SEQ ID NO: 38083 - DNA, 18 bp, Artificial Sequence
  Synthetic DNA
ttatacccttaactgcag

SEQ ID NO: 38084 - DNA, 18 bp, Artificial Sequence
  Synthetic DNA
ttataccgcccattatgg

SEQ ID NO: 38085 - DNA, 18 bp, Artificial Sequence
  Synthetic DNA
ttatacctcttacattag

SEQ ID NO: 38086 - DNA, 18 bp, Artificial Sequence
  Synthetic DNA
ttatacctctttctacag

SEQ ID NO: 38087 - DNA, 18 bp, Artificial Sequence
  Synthetic DNA
ttatacgaataacttgtg

SEQ ID NO: 38088 - DNA, 18 bp, Artificial Sequence
  Synthetic DNA
ttatacgaatccacaaag

SEQ ID NO: 38089 - DNA, 18 bp, Artificial Sequence
  Synthetic DNA
ttatacgaatctatgtag

SEQ ID NO: 38090 - DNA, 18 bp, Artificial Sequence
  Synthetic DNA
ttatacgacacaacagcg

SEQ ID NO: 38091 - DNA, 18 bp, Artificial Sequence
  Synthetic DNA
ttatacgacagaatcaag

SEQ ID NO: 38092 - DNA, 18 bp, Artificial Sequence
  Synthetic DNA
ttatacgaccctcatcgg

SEQ ID NO: 38093 - DNA, 18 bp, Artificial Sequence
  Synthetic DNA
ttatacgaccctcgtgtg

SEQ ID NO: 38094 - DNA, 18 bp, Artificial Sequence
  Synthetic DNA
ttatacgaccctttatcg

SEQ ID NO: 38095 - DNA, 18 bp, Artificial Sequence
  Synthetic DNA
ttatacgactcaaccttg

SEQ ID NO: 38096 - DNA, 18 bp, Artificial Sequence
  Synthetic DNA
ttatacgactcacttaga

SEQ ID NO: 38097 - DNA, 18 bp, Artificial Sequence
  Synthetic DNA
ttatacgactcagcaagg

SEQ ID NO: 38098 - DNA, 18 bp, Artificial Sequence
  Synthetic DNA
ttatacgactccttctgg

SEQ ID NO: 38099 - DNA, 18 bp, Artificial Sequence
  Synthetic DNA
ttatacgactcgcttctg

SEQ ID NO: 38100 - DNA, 18 bp, Artificial Sequence
  Synthetic DNA
ttatacgactctatcttg

SEQ ID NO: 38101 - DNA, 18 bp, Artificial Sequence
  Synthetic DNA
ttatacgacttgatattg

SEQ ID NO: 38102 - DNA, 18 bp, Artificial Sequence
  Synthetic DNA
ttatacgacttgttacag

SEQ ID NO: 38103 - DNA, 18 bp, Artificial Sequence
  Synthetic DNA
ttatacgactttatagtg

SEQ ID NO: 38104 - DNA, 18 bp, Artificial Sequence
  Synthetic DNA
ttatacgactttatttag

SEQ ID NO: 38105 - DNA, 18 bp, Artificial Sequence
  Synthetic DNA
ttatacgagtaactaagg

SEQ ID NO: 38106 - DNA, 18 bp, Artificial Sequence
  Synthetic DNA
ttatacgagtcattgcag

SEQ ID NO: 38107 - DNA, 18 bp, Artificial Sequence
  Synthetic DNA
ttatacgagtcgcaatcg

SEQ ID NO: 38108 - DNA, 18 bp, Artificial Sequence
  Synthetic DNA
ttatacgatacagtactg

SEQ ID NO: 38109 - DNA, 18 bp, Artificial Sequence
  Synthetic DNA
ttatacgattcacatttg

SEQ ID NO: 38110 - DNA, 18 bp, Artificial Sequence
  Synthetic DNA
ttatacgattcagttatg

SEQ ID NO: 38111 - DNA, 18 bp, Artificial Sequence
  Synthetic DNA
ttatacgatttactaccg

SEQ ID NO: 38112 - DNA, 18 bp, Artificial Sequence
  Synthetic DNA
ttatacgattttctattg

SEQ ID NO: 38113 - DNA, 18 bp, Artificial Sequence
  Synthetic DNA
ttatacgcataactgttg

SEQ ID NO: 38114 - DNA, 18 bp, Artificial Sequence
  Synthetic DNA
ttatacgccacaaaatag

SEQ ID NO: 38115 - DNA, 18 bp, Artificial Sequence
  Synthetic DNA
ttatacgccacactgtcg

SEQ ID NO: 38116 - DNA, 18 bp, Artificial Sequence
  Synthetic DNA
ttatacgcctccatctag

SEQ ID NO: 38117 - DNA, 18 bp, Artificial Sequence
  Synthetic DNA
ttatacgctttactctag

SEQ ID NO: 38118 - DNA, 18 bp, Artificial Sequence
  Synthetic DNA
ttatacgtatcactaagg

SEQ ID NO: 38119 - DNA, 18 bp, Artificial Sequence
  Synthetic DNA
ttatacgtattaattaag

SEQ ID NO: 38120 - DNA, 18 bp, Artificial Sequence
  Synthetic DNA
ttatacgtattactgtag

SEQ ID NO: 38121 - DNA, 18 bp, Artificial Sequence
  Synthetic DNA
ttatacgtcacttttttg

SEQ ID NO: 38122 - DNA, 18 bp, Artificial Sequence
  Synthetic DNA
ttatacgtcccacaataa

SEQ ID NO: 38123 - DNA, 18 bp, Artificial Sequence
  Synthetic DNA
ttatacgtctcacatgcg

SEQ ID NO: 38124 - DNA, 18 bp, Artificial Sequence
  Synthetic DNA
ttatacgtctctcaatgg

SEQ ID NO: 38125 - DNA, 18 bp, Artificial Sequence
  Synthetic DNA
ttatacgtctctttataa

SEQ ID NO: 38126 - DNA, 18 bp, Artificial Sequence
  Synthetic DNA
ttatacgtgccaccatag

SEQ ID NO: 38127 - DNA, 18 bp, Artificial Sequence
  Synthetic DNA
ttatacgtgttacatatg

SEQ ID NO: 38128 - DNA, 18 bp, Artificial Sequence
  Synthetic DNA
ttatacgtttcagttgag

SEQ ID NO: 38129 - DNA, 18 bp, Artificial Sequence
  Synthetic DNA
ttatacgttttcttatag

SEQ ID NO: 38130 - DNA, 18 bp, Artificial Sequence
  Synthetic DNA
ttatacgtttttcttttg

SEQ ID NO: 38131 - DNA, 18 bp, Artificial Sequence
  Synthetic DNA
ttatactaataattttag

SEQ ID NO: 38132 - DNA, 18 bp, Artificial Sequence
  Synthetic DNA
ttatactaatatctaaag

SEQ ID NO: 38133 - DNA, 18 bp, Artificial Sequence
  Synthetic DNA
ttatactaatcaattgag

SEQ ID NO: 38134 - DNA, 18 bp, Artificial Sequence
  Synthetic DNA
ttatactacacaccttag

SEQ ID NO: 38135 - DNA, 18 bp, Artificial Sequence
  Synthetic DNA
ttatactacccacattag

SEQ ID NO: 38136 - DNA, 18 bp, Artificial Sequence
  Synthetic DNA
ttatactactaaaaatgg

SEQ ID NO: 38137 - DNA, 18 bp, Artificial Sequence
  Synthetic DNA
ttatactactcacttccg

SEQ ID NO: 38138 - DNA, 18 bp, Artificial Sequence
  Synthetic DNA
ttatactactctcgaagg

SEQ ID NO: 38139 - DNA, 18 bp, Artificial Sequence
  Synthetic DNA
ttatactatacactcaag

SEQ ID NO: 38140 - DNA, 18 bp, Artificial Sequence
  Synthetic DNA
ttatactatcctatatag

SEQ ID NO: 38141 - DNA, 18 bp, Artificial Sequence
  Synthetic DNA
ttatactattcatttttg

SEQ ID NO: 38142 - DNA, 18 bp, Artificial Sequence
  Synthetic DNA
ttatactcctttctattg

SEQ ID NO: 38143 - DNA, 18 bp, Artificial Sequence
  Synthetic DNA
ttatactgacccctaaag

SEQ ID NO: 38144 - DNA, 18 bp, Artificial Sequence
  Synthetic DNA
ttatactgctcaaaatag

SEQ ID NO: 38145 - DNA, 18 bp, Artificial Sequence
  Synthetic DNA
ttatacttctaactatac

SEQ ID NO: 38146 - DNA, 18 bp, Artificial Sequence
  Synthetic DNA
ttataggacacagtttag

SEQ ID NO: 38147 - DNA, 18 bp, Artificial Sequence
  Synthetic DNA
ttataggacacattaaag

SEQ ID NO: 38148 - DNA, 18 bp, Artificial Sequence
  Synthetic DNA
ttataggactcagtactg

SEQ ID NO: 38149 - DNA, 18 bp, Artificial Sequence
  Synthetic DNA
ttataggactctccacag

SEQ ID NO: 38150 - DNA, 18 bp, Artificial Sequence
  Synthetic DNA
ttataggacttacgccag

SEQ ID NO: 38151 - DNA, 18 bp, Artificial Sequence
  Synthetic DNA
ttataggagatactatag

SEQ ID NO: 38152 - DNA, 18 bp, Artificial Sequence
  Synthetic DNA
ttataggattttatatag

SEQ ID NO: 38153 - DNA, 18 bp, Artificial Sequence
  Synthetic DNA
ttataggattttttcgag

SEQ ID NO: 38154 - DNA, 18 bp, Artificial Sequence
  Synthetic DNA
ttataggcatcccttctg

SEQ ID NO: 38155 - DNA, 18 bp, Artificial Sequence
  Synthetic DNA
ttatagggcccgttattg

SEQ ID NO: 38156 - DNA, 18 bp, Artificial Sequence
  Synthetic DNA
ttataggtctcactcttg

SEQ ID NO: 38157 - DNA, 18 bp, Artificial Sequence
  Synthetic DNA
ttataggtctcgccaaag

SEQ ID NO: 38158 - DNA, 18 bp, Artificial Sequence
  Synthetic DNA
ttataggtttcataaatg

SEQ ID NO: 38159 - DNA, 18 bp, Artificial Sequence
  Synthetic DNA
ttatagtactcacaatcg

SEQ ID NO: 38160 - DNA, 18 bp, Artificial Sequence
  Synthetic DNA
ttatagtactcaccttgg

SEQ ID NO: 38161 - DNA, 18 bp, Artificial Sequence
  Synthetic DNA
ttatataactcaacatag

SEQ ID NO: 38162 - DNA, 18 bp, Artificial Sequence
  Synthetic DNA
ttatataactctcaatcg

SEQ ID NO: 38163 - DNA, 18 bp, Artificial Sequence
  Synthetic DNA
ttatataactctcgattg

SEQ ID NO: 38164 - DNA, 18 bp, Artificial Sequence
  Synthetic DNA
ttatataagtctctgaag

SEQ ID NO: 38165 - DNA, 18 bp, Artificial Sequence
  Synthetic DNA
ttatatatctcactttag

SEQ ID NO: 38166 - DNA, 18 bp, Artificial Sequence
  Synthetic DNA
ttatatcactatctatcg

SEQ ID NO: 38167 - DNA, 18 bp, Artificial Sequence
  Synthetic DNA
ttatatcagacacataag

SEQ ID NO: 38168 - DNA, 18 bp, Artificial Sequence
  Synthetic DNA
ttatatctctcactgcag

SEQ ID NO: 38169 - DNA, 18 bp, Artificial Sequence
  Synthetic DNA
ttatatgacagacgagag

SEQ ID NO: 38170 - DNA, 18 bp, Artificial Sequence
  Synthetic DNA
ttatatgacatagtatag

SEQ ID NO: 38171 - DNA, 18 bp, Artificial Sequence
  Synthetic DNA
ttatatgaccgagtatag

SEQ ID NO: 38172 - DNA, 18 bp, Artificial Sequence
  Synthetic DNA
ttatatgactcaagttag

SEQ ID NO: 38173 - DNA, 18 bp, Artificial Sequence
  Synthetic DNA
ttatatgactccttattg

SEQ ID NO: 38174 - DNA, 18 bp, Artificial Sequence
  Synthetic DNA
ttatatgactcgtcatag

SEQ ID NO: 38175 - DNA, 18 bp, Artificial Sequence
  Synthetic DNA
ttatatgatatacaattg

SEQ ID NO: 38176 - DNA, 18 bp, Artificial Sequence
  Synthetic DNA
ttatatgcatctaaacag

SEQ ID NO: 38177 - DNA, 18 bp, Artificial Sequence
  Synthetic DNA
ttatatgggcctcttgag

SEQ ID NO: 38178 - DNA, 18 bp, Artificial Sequence
  Synthetic DNA
ttatattacacactttcg

SEQ ID NO: 38179 - DNA, 18 bp, Artificial Sequence
  Synthetic DNA
ttatattactttctttag

SEQ ID NO: 38180 - DNA, 18 bp, Artificial Sequence
  Synthetic DNA
ttatatttgtaaccatag

SEQ ID NO: 38181 - DNA, 18 bp, Artificial Sequence
  Synthetic DNA
ttatcagacccaagcaag

SEQ ID NO: 38182 - DNA, 18 bp, Artificial Sequence
  Synthetic DNA
ttatcagacccactgtgg

SEQ ID NO: 38183 - DNA, 18 bp, Artificial Sequence
  Synthetic DNA
ttatcagacgcattatag

SEQ ID NO: 38184 - DNA, 18 bp, Artificial Sequence
  Synthetic DNA
ttatcagtcttacaatag

SEQ ID NO: 38185 - DNA, 18 bp, Artificial Sequence
  Synthetic DNA
ttatccgaattaaaatag

SEQ ID NO: 38186 - DNA, 18 bp, Artificial Sequence
  Synthetic DNA
ttatccgacactctattg

SEQ ID NO: 38187 - DNA, 18 bp, Artificial Sequence
  Synthetic DNA
ttatccgactctcttaag

SEQ ID NO: 38188 - DNA, 18 bp, Artificial Sequence
  Synthetic DNA
ttatccgattggcttttg

SEQ ID NO: 38189 - DNA, 18 bp, Artificial Sequence
  Synthetic DNA
ttatccgcctcactaccg

SEQ ID NO: 38190 - DNA, 18 bp, Artificial Sequence
  Synthetic DNA
ttatccgtctctcaaaag

SEQ ID NO: 38191 - DNA, 18 bp, Artificial Sequence
  Synthetic DNA
ttatcctacagacaatag

SEQ ID NO: 38192 - DNA, 18 bp, Artificial Sequence
  Synthetic DNA
ttatccttctcacaatag

SEQ ID NO: 38193 - DNA, 18 bp, Artificial Sequence
  Synthetic DNA
ttatccttctttctatag

SEQ ID NO: 38194 - DNA, 18 bp, Artificial Sequence
  Synthetic DNA
ttatctgatgcccttttg

SEQ ID NO: 38195 - DNA, 18 bp, Artificial Sequence
  Synthetic DNA
ttatctgtatcaccatag

SEQ ID NO: 38196 - DNA, 18 bp, Artificial Sequence
  Synthetic DNA
ttatctgtctaactatag

SEQ ID NO: 38197 - DNA, 18 bp, Artificial Sequence
  Synthetic DNA
ttatgacactcacaaaag

SEQ ID NO: 38198 - DNA, 18 bp, Artificial Sequence
  Synthetic DNA
ttatgagactcataatag

SEQ ID NO: 38199 - DNA, 18 bp, Artificial Sequence
  Synthetic DNA
ttatgaggcacacttcag

SEQ ID NO: 38200 - DNA, 18 bp, Artificial Sequence
  Synthetic DNA
ttatgagtctcacaacag

SEQ ID NO: 38201 - DNA, 18 bp, Artificial Sequence
  Synthetic DNA
ttatgcgactcacttacg

SEQ ID NO: 38202 - DNA, 18 bp, Artificial Sequence
  Synthetic DNA
ttatgcgactctattacg

SEQ ID NO: 38203 - DNA, 18 bp, Artificial Sequence
  Synthetic DNA
ttatgcgtctcccatttg

SEQ ID NO: 38204 - DNA, 18 bp, Artificial Sequence
  Synthetic DNA
ttatgcgtctcgctgttg

SEQ ID NO: 38205 - DNA, 18 bp, Artificial Sequence
  Synthetic DNA
ttatgcgtgttacgttag

SEQ ID NO: 38206 - DNA, 18 bp, Artificial Sequence
  Synthetic DNA
ttatgtggcttagtatag

SEQ ID NO: 38207 - DNA, 18 bp, Artificial Sequence
  Synthetic DNA
ttattaatctcaccatag

SEQ ID NO: 38208 - DNA, 18 bp, Artificial Sequence
  Synthetic DNA
ttattagacaccttattg

SEQ ID NO: 38209 - DNA, 18 bp, Artificial Sequence
  Synthetic DNA
ttattagactctctacag

SEQ ID NO: 38210 - DNA, 18 bp, Artificial Sequence
  Synthetic DNA
ttattcaacgcactctag

SEQ ID NO: 38211 - DNA, 18 bp, Artificial Sequence
  Synthetic DNA
ttattcaacggactctag

SEQ ID NO: 38212 - DNA, 18 bp, Artificial Sequence
  Synthetic DNA
ttattcaactcactaacg

SEQ ID NO: 38213 - DNA, 18 bp, Artificial Sequence
  Synthetic DNA
ttattcaactcgctttag

SEQ ID NO: 38214 - DNA, 18 bp, Artificial Sequence
  Synthetic DNA
ttattcaacttagtgtag

SEQ ID NO: 38215 - DNA, 18 bp, Artificial Sequence
  Synthetic DNA
ttattcatcacactttag

SEQ ID NO: 38216 - DNA, 18 bp, Artificial Sequence
  Synthetic DNA
ttattcatttaactattg

SEQ ID NO: 38217 - DNA, 18 bp, Artificial Sequence
  Synthetic DNA
ttattcccctgtctattg

SEQ ID NO: 38218 - DNA, 18 bp, Artificial Sequence
  Synthetic DNA
ttattcgacacactcttg

SEQ ID NO: 38219 - DNA, 18 bp, Artificial Sequence
  Synthetic DNA
ttattcgactcattactg

SEQ ID NO: 38220 - DNA, 18 bp, Artificial Sequence
  Synthetic DNA
ttattcgactcgcgattg

SEQ ID NO: 38221 - DNA, 18 bp, Artificial Sequence
  Synthetic DNA
ttattcgactcgttgtag

SEQ ID NO: 38222 - DNA, 18 bp, Artificial Sequence
  Synthetic DNA
ttattcgccagtcaatag

SEQ ID NO: 38223 - DNA, 18 bp, Artificial Sequence
  Synthetic DNA
ttattcgcctcaatatcg

SEQ ID NO: 38224 - DNA, 18 bp, Artificial Sequence
  Synthetic DNA
ttattcgtatcagattag

SEQ ID NO: 38225 - DNA, 18 bp, Artificial Sequence
  Synthetic DNA
ttattcgtcttagaaaag

SEQ ID NO: 38226 - DNA, 18 bp, Artificial Sequence
  Synthetic DNA
ttattcgtttcagtacgg

SEQ ID NO: 38227 - DNA, 18 bp, Artificial Sequence
  Synthetic DNA
ttattctacccatttttg

SEQ ID NO: 38228 - DNA, 18 bp, Artificial Sequence
  Synthetic DNA
ttattctactctaacaag

SEQ ID NO: 38229 - DNA, 18 bp, Artificial Sequence
  Synthetic DNA
ttattctatacactatag

SEQ ID NO: 38230 - DNA, 18 bp, Artificial Sequence
  Synthetic DNA
ttattcttatttctcatg

SEQ ID NO: 38231 - DNA, 18 bp, Artificial Sequence
  Synthetic DNA
ttattcttctctctacag

SEQ ID NO: 38232 - DNA, 18 bp, Artificial Sequence
  Synthetic DNA
ttattggaatctttttag

SEQ ID NO: 38233 - DNA, 18 bp, Artificial Sequence
  Synthetic DNA
ttattgtgctcactaacg

SEQ ID NO: 38234 - DNA, 18 bp, Artificial Sequence
  Synthetic DNA
ttatttgactcaatagag

SEQ ID NO: 38235 - DNA, 18 bp, Artificial Sequence
  Synthetic DNA
ttatttgattcgctatag

SEQ ID NO: 38236 - DNA, 18 bp, Artificial Sequence
  Synthetic DNA
ttcaacgacacactatgg

SEQ ID NO: 38237 - DNA, 18 bp, Artificial Sequence
  Synthetic DNA
ttcaacgactctgttgag

SEQ ID NO: 38238 - DNA, 18 bp, Artificial Sequence
  Synthetic DNA
ttcaacgtcgtactagag

SEQ ID NO: 38239 - DNA, 18 bp, Artificial Sequence
  Synthetic DNA
ttcaactagccattatag

SEQ ID NO: 38240 - DNA, 18 bp, Artificial Sequence
  Synthetic DNA
ttcaacttctcaatatcg

SEQ ID NO: 38241 - DNA, 18 bp, Artificial Sequence
  Synthetic DNA
ttcaaggtcttactacag

SEQ ID NO: 38242 - DNA, 18 bp, Artificial Sequence
  Synthetic DNA
ttcatctacccactttag

SEQ ID NO: 38243 - DNA, 18 bp, Artificial Sequence
  Synthetic DNA
ttccacgactcactaatg

SEQ ID NO: 38244 - DNA, 18 bp, Artificial Sequence
  Synthetic DNA
ttcctcgactatcttttg

SEQ ID NO: 38245 - DNA, 18 bp, Artificial Sequence
  Synthetic DNA
ttctaaaactcactactg

SEQ ID NO: 38246 - DNA, 18 bp, Artificial Sequence
  Synthetic DNA
ttctacaaattattatag

SEQ ID NO: 38247 - DNA, 18 bp, Artificial Sequence
  Synthetic DNA
ttctacacataactcgag

SEQ ID NO: 38248 - DNA, 18 bp, Artificial Sequence
  Synthetic DNA
ttctaccaatctctttag

SEQ ID NO: 38249 - DNA, 18 bp, Artificial Sequence
  Synthetic DNA
ttctacgaccctcattag

SEQ ID NO: 38250 - DNA, 18 bp, Artificial Sequence
  Synthetic DNA
ttctacgactgcctagag

SEQ ID NO: 38251 - DNA, 18 bp, Artificial Sequence
  Synthetic DNA
ttctacgagtctccatag

SEQ ID NO: 38252 - DNA, 18 bp, Artificial Sequence
  Synthetic DNA
ttctacgatctactatgg

SEQ ID NO: 38253 - DNA, 18 bp, Artificial Sequence
  Synthetic DNA
ttctacgtctccttattg

SEQ ID NO: 38254 - DNA, 18 bp, Artificial Sequence
  Synthetic DNA
ttctacgtgatactaaag

SEQ ID NO: 38255 - DNA, 18 bp, Artificial Sequence
  Synthetic DNA
ttctatgacacacaatag

SEQ ID NO: 38256 - DNA, 18 bp, Artificial Sequence
  Synthetic DNA
ttctatttctcaatattg

SEQ ID NO: 38257 - DNA, 18 bp, Artificial Sequence
  Synthetic DNA
ttctctaactcaatctag

SEQ ID NO: 38258 - DNA, 18 bp, Artificial Sequence
  Synthetic DNA
ttctgccacagtctactg

SEQ ID NO: 38259 - DNA, 18 bp, Artificial Sequence
  Synthetic DNA
ttcttaatctcatataag

SEQ ID NO: 38260 - DNA, 18 bp, Artificial Sequence
  Synthetic DNA
ttcttcaacttacttttg

SEQ ID NO: 38261 - DNA, 18 bp, Artificial Sequence
  Synthetic DNA
ttcttccacctcaaattg

SEQ ID NO: 38262 - DNA, 18 bp, Artificial Sequence
  Synthetic DNA
ttcttcctctcactattg

SEQ ID NO: 38263 - DNA, 18 bp, Artificial Sequence
  Synthetic DNA
ttcttcgactctctattg

SEQ ID NO: 38264 - DNA, 18 bp, Artificial Sequence
  Synthetic DNA
ttcttcgactgactttcg

SEQ ID NO: 38265 - DNA, 18 bp, Artificial Sequence
  Synthetic DNA
ttcttcgtctctttctag

SEQ ID NO: 38266 - DNA, 18 bp, Artificial Sequence
  Synthetic DNA
ttcttgaactcactgttg

SEQ ID NO: 38267 - DNA, 18 bp, Artificial Sequence
  Synthetic DNA
ttctttgacccactaaag

SEQ ID NO: 38268 - DNA, 18 bp, Artificial Sequence
  Synthetic DNA
ttctttgacgcacaattg

SEQ ID NO: 38269 - DNA, 18 bp, Artificial Sequence
  Synthetic DNA
ttgaacaaccgacaatag

SEQ ID NO: 38270 - DNA, 18 bp, Artificial Sequence
  Synthetic DNA
ttgaaccactcactttag

SEQ ID NO: 38271 - DNA, 18 bp, Artificial Sequence
  Synthetic DNA
ttgaaccactctcaattg

SEQ ID NO: 38272 - DNA, 18 bp, Artificial Sequence
  Synthetic DNA
ttgaacgactcaatctag

SEQ ID NO: 38273 - DNA, 18 bp, Artificial Sequence
  Synthetic DNA
ttgaactcatcactatag

SEQ ID NO: 38274 - DNA, 18 bp, Artificial Sequence
  Synthetic DNA
ttgattgtcttactatag

SEQ ID NO: 38275 - DNA, 18 bp, Artificial Sequence
  Synthetic DNA
ttgcacaagtcaacatag

SEQ ID NO: 38276 - DNA, 18 bp, Artificial Sequence
  Synthetic DNA
ttgcacgtcttattatag

SEQ ID NO: 38277 - DNA, 18 bp, Artificial Sequence
  Synthetic DNA
ttgctcaactgactaaag

SEQ ID NO: 38278 - DNA, 18 bp, Artificial Sequence
  Synthetic DNA
ttgctcgactctctacag

SEQ ID NO: 38279 - DNA, 18 bp, Artificial Sequence
  Synthetic DNA
ttgtacaaatcacccttg

SEQ ID NO: 38280 - DNA, 18 bp, Artificial Sequence
  Synthetic DNA
ttgtacaactccccatag

SEQ ID NO: 38281 - DNA, 18 bp, Artificial Sequence
  Synthetic DNA
ttgtacctctcccaatag

SEQ ID NO: 38282 - DNA, 18 bp, Artificial Sequence
  Synthetic DNA
ttgtacgaccctctaaag

SEQ ID NO: 38283 - DNA, 18 bp, Artificial Sequence
  Synthetic DNA
ttgtacggcaatctaaag

SEQ ID NO: 38284 - DNA, 18 bp, Artificial Sequence
  Synthetic DNA
ttgtacgtatgattatag

SEQ ID NO: 38285 - DNA, 18 bp, Artificial Sequence
  Synthetic DNA
ttgtacgtcacaccattg

SEQ ID NO: 38286 - DNA, 18 bp, Artificial Sequence
  Synthetic DNA
ttgtacgtctaagtatag

SEQ ID NO: 38287 - DNA, 18 bp, Artificial Sequence
  Synthetic DNA
ttgtaggattcagtaaag

SEQ ID NO: 38288 - DNA, 18 bp, Artificial Sequence
  Synthetic DNA
ttgtatgtctcaagtgtg

SEQ ID NO: 38289 - DNA, 18 bp, Artificial Sequence
  Synthetic DNA
ttgtgcgactaactctag

SEQ ID NO: 38290 - DNA, 18 bp, Artificial Sequence
  Synthetic DNA
ttgtgggaatcaatatag

SEQ ID NO: 38291 - DNA, 18 bp, Artificial Sequence
  Synthetic DNA
ttgttagagacacttttg

SEQ ID NO: 38292 - DNA, 18 bp, Artificial Sequence
  Synthetic DNA
ttgttcaaagctctacag

SEQ ID NO: 38293 - DNA, 18 bp, Artificial Sequence
  Synthetic DNA
ttgttcgaatcacaacag

SEQ ID NO: 38294 - DNA, 18 bp, Artificial Sequence
  Synthetic DNA
tttaaagactcacttaag

SEQ ID NO: 38295 - DNA, 18 bp, Artificial Sequence
  Synthetic DNA
tttaaagactcagaatag

SEQ ID NO: 38296 - DNA, 18 bp, Artificial Sequence
  Synthetic DNA
tttaacatcacactatag

SEQ ID NO: 38297 - DNA, 18 bp, Artificial Sequence
  Synthetic DNA
tttaaccattcactatcg

SEQ ID NO: 38298 - DNA, 18 bp, Artificial Sequence
  Synthetic DNA
tttaacgaatcactatcg

SEQ ID NO: 38299 - DNA, 18 bp, Artificial Sequence
  Synthetic DNA
tttaacgacaaaccattg

SEQ ID NO: 38300 - DNA, 18 bp, Artificial Sequence
  Synthetic DNA
tttaacgactcaccctag

SEQ ID NO: 38301 - DNA, 18 bp, Artificial Sequence
  Synthetic DNA
tttaacgactctcaaaag

SEQ ID NO: 38302 - DNA, 18 bp, Artificial Sequence
  Synthetic DNA
tttaacgaggcaatatcg

SEQ ID NO: 38303 - DNA, 18 bp, Artificial Sequence
  Synthetic DNA
tttaacgtttcactctag

SEQ ID NO: 38304 - DNA, 18 bp, Artificial Sequence
  Synthetic DNA
tttaactactccttaatg

SEQ ID NO: 38305 - DNA, 18 bp, Artificial Sequence
  Synthetic DNA
tttacccactgcctagcg

SEQ ID NO: 38306 - DNA, 18 bp, Artificial Sequence
  Synthetic DNA
tttaccgcctcagtatag

SEQ ID NO: 38307 - DNA, 18 bp, Artificial Sequence
  Synthetic DNA
tttactgactatgtttag

SEQ ID NO: 38308 - DNA, 18 bp, Artificial Sequence
  Synthetic DNA
tttagcgactgactatag

SEQ ID NO: 38309 - DNA, 18 bp, Artificial Sequence
  Synthetic DNA
tttatcgcctttaaaaag

SEQ ID NO: 38310 - DNA, 18 bp, Artificial Sequence
  Synthetic DNA
tttatcgtctccctatgg

SEQ ID NO: 38311 - DNA, 18 bp, Artificial Sequence
  Synthetic DNA
tttcaatactctccattg

SEQ ID NO: 38312 - DNA, 18 bp, Artificial Sequence
  Synthetic DNA
tttcatgacggactttag

SEQ ID NO: 38313 - DNA, 18 bp, Artificial Sequence
  Synthetic DNA
tttctcgactgaatattg

SEQ ID NO: 38314 - DNA, 18 bp, Artificial Sequence
  Synthetic DNA
tttctggactaacaatag

SEQ ID NO: 38315 - DNA, 18 bp, Artificial Sequence
  Synthetic DNA
tttgacgcctcactgtag

SEQ ID NO: 38316 - DNA, 18 bp, Artificial Sequence
  Synthetic DNA
ttttaagacgctttattg

SEQ ID NO: 38317 - DNA, 18 bp, Artificial Sequence
  Synthetic DNA
ttttaagactaactcttg

SEQ ID NO: 38318 - DNA, 18 bp, Artificial Sequence
  Synthetic DNA
ttttaagactcactaggg

SEQ ID NO: 38319 - DNA, 18 bp, Artificial Sequence
  Synthetic DNA
ttttaagattcacaattg

SEQ ID NO: 38320 - DNA, 18 bp, Artificial Sequence
  Synthetic DNA
ttttaatactctttctag

SEQ ID NO: 38321 - DNA, 18 bp, Artificial Sequence
  Synthetic DNA
ttttaatagtccctagag

SEQ ID NO: 38322 - DNA, 18 bp, Artificial Sequence
  Synthetic DNA
ttttaatagtccctagat

SEQ ID NO: 38323 - DNA, 18 bp, Artificial Sequence
  Synthetic DNA
ttttacaaattacgaaag

SEQ ID NO: 38324 - DNA, 18 bp, Artificial Sequence
  Synthetic DNA
ttttacatattactctag

SEQ ID NO: 38325 - DNA, 18 bp, Artificial Sequence
  Synthetic DNA
ttttacctcttactatag

SEQ ID NO: 38326 - DNA, 18 bp, Artificial Sequence
  Synthetic DNA
ttttacgactcatttaag

SEQ ID NO: 38327 - DNA, 18 bp, Artificial Sequence
  Synthetic DNA
ttttacgacttaatttag

SEQ ID NO: 38328 - DNA, 18 bp, Artificial Sequence
  Synthetic DNA
ttttacgagactttataa

SEQ ID NO: 38329 - DNA, 18 bp, Artificial Sequence
  Synthetic DNA
ttttacgatacattaaag

SEQ ID NO: 38330 - DNA, 18 bp, Artificial Sequence
  Synthetic DNA
ttttacgatccactattg

SEQ ID NO: 38331 - DNA, 18 bp, Artificial Sequence
  Synthetic DNA
ttttacgattgattaatg

SEQ ID NO: 38332 - DNA, 18 bp, Artificial Sequence
  Synthetic DNA
ttttacgccacactacag

SEQ ID NO: 38333 - DNA, 18 bp, Artificial Sequence
  Synthetic DNA
ttttacgcctaactattg

SEQ ID NO: 38334 - DNA, 18 bp, Artificial Sequence
  Synthetic DNA
ttttacgcgtctctatag

SEQ ID NO: 38335 - DNA, 18 bp, Artificial Sequence
  Synthetic DNA
ttttacggctgagcaaag

SEQ ID NO: 38336 - DNA, 18 bp, Artificial Sequence
  Synthetic DNA
ttttacggctttcgatag

SEQ ID NO: 38337 - DNA, 18 bp, Artificial Sequence
  Synthetic DNA
ttttacgtctctgtattg

SEQ ID NO: 38338 - DNA, 18 bp, Artificial Sequence
  Synthetic DNA
ttttacgtctgaccatag

SEQ ID NO: 38339 - DNA, 18 bp, Artificial Sequence
  Synthetic DNA
ttttacgtcttaaattag

SEQ ID NO: 38340 - DNA, 18 bp, Artificial Sequence
  Synthetic DNA
ttttactaatcgctatag

SEQ ID NO: 38341 - DNA, 18 bp, Artificial Sequence
  Synthetic DNA
ttttactactcttaatag

SEQ ID NO: 38342 - DNA, 18 bp, Artificial Sequence
  Synthetic DNA
ttttactccagacaatag

SEQ ID NO: 38343 - DNA, 18 bp, Artificial Sequence
  Synthetic DNA
ttttactcgtccatatag

SEQ ID NO: 38344 - DNA, 18 bp, Artificial Sequence
  Synthetic DNA
ttttacttttcatggttg

SEQ ID NO: 38345 - DNA, 18 bp, Artificial Sequence
  Synthetic DNA
ttttaggtcacgttattg

SEQ ID NO: 38346 - DNA, 18 bp, Artificial Sequence
  Synthetic DNA
ttttaggtgttacaatag

SEQ ID NO: 38347 - DNA, 18 bp, Artificial Sequence
  Synthetic DNA
ttttataactcgctatag

SEQ ID NO: 38348 - DNA, 18 bp, Artificial Sequence
  Synthetic DNA
ttttatacctgtctaccg

SEQ ID NO: 38349 - DNA, 18 bp, Artificial Sequence
  Synthetic DNA
ttttatgcccaaatatag

SEQ ID NO: 38350 - DNA, 18 bp, Artificial Sequence
  Synthetic DNA
ttttatttaacactatag

SEQ ID NO: 38351 - DNA, 18 bp, Artificial Sequence
  Synthetic DNA
ttttccaacttaatttag

SEQ ID NO: 38352 - DNA, 18 bp, Artificial Sequence
  Synthetic DNA
ttttccatcttactatag

SEQ ID NO: 38353 - DNA, 18 bp, Artificial Sequence
  Synthetic DNA
ttttccgacgcattatag

SEQ ID NO: 38354 - DNA, 18 bp, Artificial Sequence
  Synthetic DNA
ttttccgactcaatttag

SEQ ID NO: 38355 - DNA, 18 bp, Artificial Sequence
  Synthetic DNA
ttttccgactcactgtcg

SEQ ID NO: 38356 - DNA, 18 bp, Artificial Sequence
  Synthetic DNA
ttttccgactgtctacag

SEQ ID NO: 38357 - DNA, 18 bp, Artificial Sequence
  Synthetic DNA
ttttccggcaatctatag

SEQ ID NO: 38358 - DNA, 18 bp, Artificial Sequence
  Synthetic DNA
ttttccgtctcactacag

SEQ ID NO: 38359 - DNA, 18 bp, Artificial Sequence
  Synthetic DNA
ttttccgtgccacaatag

SEQ ID NO: 38360 - DNA, 18 bp, Artificial Sequence
  Synthetic DNA
ttttctgactcgttctag

SEQ ID NO: 38361 - DNA, 18 bp, Artificial Sequence
  Synthetic DNA
ttttgcgaatcaatatag

SEQ ID NO: 38362 - DNA, 18 bp, Artificial Sequence
  Synthetic DNA
ttttgcgactacctatag

SEQ ID NO: 38363 - DNA, 18 bp, Artificial Sequence
  Synthetic DNA
ttttgcgagtcactttag

SEQ ID NO: 38364 - DNA, 18 bp, Artificial Sequence
  Synthetic DNA
ttttgcgattcacgcaag

SEQ ID NO: 38365 - DNA, 18 bp, Artificial Sequence
  Synthetic DNA
ttttgctgctcactatag

SEQ ID NO: 38366 - DNA, 18 bp, Artificial Sequence
  Synthetic DNA
ttttggatctcagtcacg

SEQ ID NO: 38367 - DNA, 18 bp, Artificial Sequence
  Synthetic DNA
tttttcgacttactatcg

SEQ ID NO: 38368 - DNA, 18 bp, Artificial Sequence
  Synthetic DNA
tttttcgattcaatatag

SEQ ID NO: 38369 - DNA, 18 bp, Artificial Sequence
  Synthetic DNA
tttttcgattcacaattg

SEQ ID NO: 38370 - DNA, 18 bp, Artificial Sequence
  Synthetic DNA
tttttcggctccctaaag

SEQ ID NO: 38371 - DNA, 18 bp, Artificial Sequence
  Synthetic DNA
tttttcgtttcaattaag

SEQ ID NO: 38372 - DNA, 18 bp, Artificial Sequence
  Synthetic DNA
tttttctacttcttaaag

SEQ ID NO: 38373 - DNA, 18 bp, Artificial Sequence
  Synthetic DNA
tttttgctcccaataatg

SEQ ID NO: 38374 - DNA, 18 bp, Artificial Sequence
  Synthetic DNA
tttttggatttcaaatag

SEQ ID NO: 38375 - DNA, 18 bp, Artificial Sequence
  Synthetic DNA
tattttgtctcactaatg

SEQ ID NO: 38376 - DNA, 18 bp, Artificial Sequence
  Synthetic DNA
tgtcacgtctcactttag

SEQ ID NO: 38377 - DNA, 18 bp, Artificial Sequence
  Synthetic DNA
tatagcgactaccaatcg

SEQ ID NO: 38378 - DNA, 18 bp, Artificial Sequence
  Synthetic DNA
taatttgacacgctattg

SEQ ID NO: 38379 - DNA, 18 bp, Artificial Sequence
  Synthetic DNA
caatcggactcaccattg

SEQ ID NO: 38380 - DNA, 18 bp, Artificial Sequence
  Synthetic DNA
tacagcgcctcaccttag

SEQ ID NO: 38381 - DNA, 18 bp, Artificial Sequence
  Synthetic DNA
attttcgcatcactacag

SEQ ID NO: 38382 - DNA, 18 bp, Artificial Sequence
  Synthetic DNA
tataacaactcgctattg

SEQ ID NO: 38383 - DNA, 18 bp, Artificial Sequence
  Synthetic DNA
tctaatgaatcgctatag

SEQ ID NO: 38384 - DNA, 18 bp, Artificial Sequence
  Synthetic DNA
tgttacgactcgaattag

SEQ ID NO: 38385 - DNA, 18 bp, Artificial Sequence
  Synthetic DNA
ttactctactccctatag

SEQ ID NO: 38386 - DNA, 18 bp, Artificial Sequence
  Synthetic DNA
tattacgactctggtcag

SEQ ID NO: 38387 - DNA, 18 bp, Artificial Sequence
  Synthetic DNA
gaattagtcgcgctatag

SEQ ID NO: 38388 - DNA, 18 bp, Artificial Sequence
  Synthetic DNA
ttatccgagtcacattag

SEQ ID NO: 38389 - DNA, 18 bp, Artificial Sequence
  Synthetic DNA
atctattgcacacttaag

SEQ ID NO: 38390 - DNA, 18 bp, Artificial Sequence
  Synthetic DNA
tagttcgagtcaccaaag

SEQ ID NO: 38391 - DNA, 18 bp, Artificial Sequence
  Synthetic DNA
tattggtgctccctgtcg

SEQ ID NO: 38392 - DNA, 18 bp, Artificial Sequence
  Synthetic DNA
tatttggtctctctatag

SEQ ID NO: 38393 - DNA, 18 bp, Artificial Sequence
  Synthetic DNA
taaatagacttactttag

SEQ ID NO: 38394 - DNA, 18 bp, Artificial Sequence
  Synthetic DNA
caaaatgactcagtaaag

SEQ ID NO: 38395 - DNA, 18 bp, Artificial Sequence
  Synthetic DNA
taatacaactcttaattg

SEQ ID NO: 38396 - DNA, 18 bp, Artificial Sequence
  Synthetic DNA
taatccgcgtcactttgg

SEQ ID NO: 38397 - DNA, 18 bp, Artificial Sequence
  Synthetic DNA
tacaatgtctcaatatag

SEQ ID NO: 38398 - DNA, 18 bp, Artificial Sequence
  Synthetic DNA
ttttgagactcactaaag

SEQ ID NO: 38399 - DNA, 18 bp, Artificial Sequence
  Synthetic DNA
tgttaagactcactaatg

SEQ ID NO: 38400 - DNA, 18 bp, Artificial Sequence
  Synthetic DNA
ttaatcgtctcactattg

SEQ ID NO: 38401 - DNA, 18 bp, Artificial Sequence
  Synthetic DNA
tgatacgtgttactaaag

SEQ ID NO: 38402 - DNA, 18 bp, Artificial Sequence
  Synthetic DNA
ttaatagactcactcaag

SEQ ID NO: 38403 - DNA, 18 bp, Artificial Sequence
  Synthetic DNA
cgattcgactcgctattg

SEQ ID NO: 38404 - DNA, 18 bp, Artificial Sequence
  Synthetic DNA
ttaaacgtgtcccattag

SEQ ID NO: 38405 - DNA, 18 bp, Artificial Sequence
  Synthetic DNA
atttagaactcactacag

SEQ ID NO: 38406 - DNA, 18 bp, Artificial Sequence
  Synthetic DNA
taactcgcatcgctttag

SEQ ID NO: 38407 - DNA, 18 bp, Artificial Sequence
  Synthetic DNA
tagaacgccatactatag

SEQ ID NO: 38408 - DNA, 18 bp, Artificial Sequence
  Synthetic DNA
tataacgactctcttttg

SEQ ID NO: 38409 - DNA, 18 bp, Artificial Sequence
  Synthetic DNA
tgttacgaaactctatag

SEQ ID NO: 38410 - DNA, 18 bp, Artificial Sequence
  Synthetic DNA
ttttaggactcacttttg

SEQ ID NO: 38411 - DNA, 18 bp, Artificial Sequence
  Synthetic DNA
ttaaaagactcacctaag

SEQ ID NO: 38412 - DNA, 18 bp, Artificial Sequence
  Synthetic DNA
taatacggcattctttcg

SEQ ID NO: 38413 - DNA, 18 bp, Artificial Sequence
  Synthetic DNA
tttaacgaatcactttag

SEQ ID NO: 38414 - DNA, 18 bp, Artificial Sequence
  Synthetic DNA
gatttggactcgctatcg

SEQ ID NO: 38415 - DNA, 18 bp, Artificial Sequence
  Synthetic DNA
tatagcgagtcaatttag

SEQ ID NO: 38416 - DNA, 18 bp, Artificial Sequence
  Synthetic DNA
tattacaactcatcgtag

SEQ ID NO: 38417 - DNA, 18 bp, Artificial Sequence
  Synthetic DNA
ttttactactcacaaaag

SEQ ID NO: 38418 - DNA, 18 bp, Artificial Sequence
  Synthetic DNA
tattacacttctctatag

SEQ ID NO: 38419 - DNA, 18 bp, Artificial Sequence
  Synthetic DNA
ttattcgactcacatcag

SEQ ID NO: 38420 - DNA, 18 bp, Artificial Sequence
  Synthetic DNA
taatatttgtcactttcg

SEQ ID NO: 38421 - DNA, 18 bp, Artificial Sequence
  Synthetic DNA
tatagcgtctcactaaag

SEQ ID NO: 38422 - DNA, 18 bp, Artificial Sequence
  Synthetic DNA
taatggaactgactaaag

SEQ ID NO: 38423 - DNA, 18 bp, Artificial Sequence
  Synthetic DNA
aaaatcgactcaatcttg

SEQ ID NO: 38424 - DNA, 18 bp, Artificial Sequence
  Synthetic DNA
ataaccgacgctctttag

SEQ ID NO: 38425 - DNA, 18 bp, Artificial Sequence
  Synthetic DNA
ctaatcggctcactatcg

SEQ ID NO: 38426 - DNA, 18 bp, Artificial Sequence
  Synthetic DNA
gaattcgacaccctcatg

SEQ ID NO: 38427 - DNA, 18 bp, Artificial Sequence
  Synthetic DNA
gataaggactttctaagg

SEQ ID NO: 38428 - DNA, 18 bp, Artificial Sequence
  Synthetic DNA
taaaactacaaactctcg

SEQ ID NO: 38429 - DNA, 18 bp, Artificial Sequence
  Synthetic DNA
taaaactatttgctatag

SEQ ID NO: 38430 - DNA, 18 bp, Artificial Sequence
  Synthetic DNA
taataagtcaaaccattg

SEQ ID NO: 38431 - DNA, 18 bp, Artificial Sequence
  Synthetic DNA
taataccaatctcaatgg

SEQ ID NO: 38432 - DNA, 18 bp, Artificial Sequence
  Synthetic DNA
taatacgaacgcctattg

SEQ ID NO: 38433 - DNA, 18 bp, Artificial Sequence
  Synthetic DNA
taatacttctgctgattg

SEQ ID NO: 38434 - DNA, 18 bp, Artificial Sequence
  Synthetic DNA
taattatactcaatgcag

SEQ ID NO: 38435 - DNA, 18 bp, Artificial Sequence
  Synthetic DNA
taattcaattctccagtg

SEQ ID NO: 38436 - DNA, 18 bp, Artificial Sequence
  Synthetic DNA
tacattgattcacgatgg

SEQ ID NO: 38437 - DNA, 18 bp, Artificial Sequence
  Synthetic DNA
tacgacgactcaccaatg

SEQ ID NO: 38438 - DNA, 18 bp, Artificial Sequence
  Synthetic DNA
tactaaggcgctctatag

SEQ ID NO: 38439 - DNA, 18 bp, Artificial Sequence
  Synthetic DNA
tactgcgaatctaaatag

SEQ ID NO: 38440 - DNA, 18 bp, Artificial Sequence
  Synthetic DNA
tagtacaactcacatcag

SEQ ID NO: 38441 - DNA, 18 bp, Artificial Sequence
  Synthetic DNA
tagttcacttcacattag

SEQ ID NO: 38442 - DNA, 18 bp, Artificial Sequence
  Synthetic DNA
tatcgcgacacgctctcg

SEQ ID NO: 38443 - DNA, 18 bp, Artificial Sequence
  Synthetic DNA
tattacatctgactctag

SEQ ID NO: 38444 - DNA, 18 bp, Artificial Sequence
  Synthetic DNA
tattacgacccgcaattg

SEQ ID NO: 38445 - DNA, 18 bp, Artificial Sequence
  Synthetic DNA
tattacgtattacactag

SEQ ID NO: 38446 - DNA, 18 bp, Artificial Sequence
  Synthetic DNA
tgatacgaatcgcttctg

SEQ ID NO: 38447 - DNA, 18 bp, Artificial Sequence
  Synthetic DNA
tgatgcctctcatattag

SEQ ID NO: 38448 - DNA, 18 bp, Artificial Sequence
  Synthetic DNA
tgcttcgacacactatgg

SEQ ID NO: 38449 - DNA, 18 bp, Artificial Sequence
  Synthetic DNA
ttatcacacacacaatag

SEQ ID NO: 38450 - DNA, 18 bp, Artificial Sequence
  Synthetic DNA
ttattagactcaccatcg

SEQ ID NO: 38451 - DNA, 18 bp, Artificial Sequence
  Synthetic DNA
ttattcgtctcgctattg

SEQ ID NO: 38452 - DNA, 18 bp, Artificial Sequence
  Synthetic DNA
taaaacgaacctctaaag

SEQ ID NO: 38453 - DNA, 18 bp, Artificial Sequence
  Synthetic DNA
tattgcgcctcaccattg

SEQ ID NO: 38454 - DNA, 18 bp, Artificial Sequence
  Synthetic DNA
tgatactactctctaacg

SEQ ID NO: 38455 - DNA, 18 bp, Artificial Sequence
  Synthetic DNA
atattcgtctcactacag

SEQ ID NO: 38456 - DNA, 18 bp, Artificial Sequence
  Synthetic DNA
tagtacgtcttgctaaag

SEQ ID NO: 38457 - DNA, 18 bp, Artificial Sequence
  Synthetic DNA
ttttacgacgcccaactg

SEQ ID NO: 38458 - DNA, 18 bp, Artificial Sequence
  Synthetic DNA
tatttcgtctcgctcaag

SEQ ID NO: 38459 - DNA, 18 bp, Artificial Sequence
  Synthetic DNA
taatacgttctactactg

SEQ ID NO: 38460 - DNA, 18 bp, Artificial Sequence
  Synthetic DNA
taaatctcctcgcttaag

SEQ ID NO: 38461 - DNA, 18 bp, Artificial Sequence
  Synthetic DNA
taattggcctcacttttg

SEQ ID NO: 38462 - DNA, 18 bp, Artificial Sequence
  Synthetic DNA
ttaagcgactcacttaag

SEQ ID NO: 38463 - DNA, 18 bp, Artificial Sequence
  Synthetic DNA
ttatgagattcatgattg

SEQ ID NO: 38464 - DNA, 18 bp, Artificial Sequence
  Synthetic DNA
ttaatcgtctcactttag

SEQ ID NO: 38465 - DNA, 18 bp, Artificial Sequence
  Synthetic DNA
tgatacctgcctcttttg

SEQ ID NO: 38466 - DNA, 18 bp, Artificial Sequence
  Synthetic DNA
aaaagcgacacacttttg

SEQ ID NO: 38467 - DNA, 18 bp, Artificial Sequence
  Synthetic DNA
ctaccagactcgctattg

SEQ ID NO: 38468 - DNA, 18 bp, Artificial Sequence
  Synthetic DNA
taatagatctcgctattg

SEQ ID NO: 38469 - DNA, 18 bp, Artificial Sequence
  Synthetic DNA
tataagaactcactaaag

SEQ ID NO: 38470 - DNA, 18 bp, Artificial Sequence
  Synthetic DNA
ttattagactcacgttag

SEQ ID NO: 38471 - DNA, 18 bp, Artificial Sequence
  Synthetic DNA
acatacctatcactttag

SEQ ID NO: 38472 - DNA, 18 bp, Artificial Sequence
  Synthetic DNA
caattcaactcactcaag

SEQ ID NO: 38473 - DNA, 18 bp, Artificial Sequence
  Synthetic DNA
taatttgactcactgatg

SEQ ID NO: 38474 - DNA, 18 bp, Artificial Sequence
  Synthetic DNA
ttaaacgttttactatag

SEQ ID NO: 38475 - DNA, 18 bp, Artificial Sequence
  Synthetic DNA
ttattcgactcacttccg

SEQ ID NO: 38476 - DNA, 18 bp, Artificial Sequence
  Synthetic DNA
ttgaaagactcaccattg

SEQ ID NO: 38477 - DNA, 18 bp, Artificial Sequence
  Synthetic DNA
ttgaacgactcgctattg

SEQ ID NO: 38478 - DNA, 18 bp, Artificial Sequence
  Synthetic DNA
tttattgactcactatag

SEQ ID NO: 38479 - DNA, 18 bp, Artificial Sequence
  Synthetic DNA
tttttcggctcactagag

SEQ ID NO: 38480 - DNA, 18 bp, Artificial Sequence
  Synthetic DNA
aaaaacaaatcattatag

SEQ ID NO: 38481 - DNA, 18 bp, Artificial Sequence
  Synthetic DNA
aaacacaaaacactatag

SEQ ID NO: 38482 - DNA, 18 bp, Artificial Sequence
  Synthetic DNA
aaataagaatcactaatg

SEQ ID NO: 38483 - DNA, 18 bp, Artificial Sequence
  Synthetic DNA
aaataatactcactcaag

SEQ ID NO: 38484 - DNA, 18 bp, Artificial Sequence
  Synthetic DNA
aaatacaacacacattag

SEQ ID NO: 38485 - DNA, 18 bp, Artificial Sequence
  Synthetic DNA
aaatacgacgctccacag

SEQ ID NO: 38486 - DNA, 18 bp, Artificial Sequence
  Synthetic DNA
aaatacgacttagtgtcg

SEQ ID NO: 38487 - DNA, 18 bp, Artificial Sequence
  Synthetic DNA
aaatacgtcaaactgtag

SEQ ID NO: 38488 - DNA, 18 bp, Artificial Sequence
  Synthetic DNA
aaatacgtctatctaaag

SEQ ID NO: 38489 - DNA, 18 bp, Artificial Sequence
  Synthetic DNA
aaatatgtctcactaatg

SEQ ID NO: 38490 - DNA, 18 bp, Artificial Sequence
  Synthetic DNA
aaatatgtctcgctgatg

SEQ ID NO: 38491 - DNA, 18 bp, Artificial Sequence
  Synthetic DNA
aaatatgttttaatattg

SEQ ID NO: 38492 - DNA, 18 bp, Artificial Sequence
  Synthetic DNA
aaatccgcatctgtaaag

SEQ ID NO: 38493 - DNA, 18 bp, Artificial Sequence
  Synthetic DNA
aaatgcgcctcaccaatg

SEQ ID NO: 38494 - DNA, 18 bp, Artificial Sequence
  Synthetic DNA
aaatggaattccctacag

SEQ ID NO: 38495 - DNA, 18 bp, Artificial Sequence
  Synthetic DNA
aaattagtcactcgatgg

SEQ ID NO: 38496 - DNA, 18 bp, Artificial Sequence
  Synthetic DNA
aaattcgcatcaatatag

SEQ ID NO: 38497 - DNA, 18 bp, Artificial Sequence
  Synthetic DNA
aaattttactcggtatag

SEQ ID NO: 38498 - DNA, 18 bp, Artificial Sequence
  Synthetic DNA
aactctgactccctatag

SEQ ID NO: 38499 - DNA, 18 bp, Artificial Sequence
  Synthetic DNA
aagatcgactcactaaag

SEQ ID NO: 38500 - DNA, 18 bp, Artificial Sequence
  Synthetic DNA
aagtatgtctcactttag

SEQ ID NO: 38501 - DNA, 18 bp, Artificial Sequence
  Synthetic DNA
aatcacctctctctttag

SEQ ID NO: 38502 - DNA, 18 bp, Artificial Sequence
  Synthetic DNA
aatgacgacgctctattg

SEQ ID NO: 38503 - DNA, 18 bp, Artificial Sequence
  Synthetic DNA
aattccgatacactaaag

SEQ ID NO: 38504 - DNA, 18 bp, Artificial Sequence
  Synthetic DNA
aatttcgaataacaatag

SEQ ID NO: 38505 - DNA, 18 bp, Artificial Sequence
  Synthetic DNA
acatacgattctctattg

SEQ ID NO: 38506 - DNA, 18 bp, Artificial Sequence
  Synthetic DNA
acatccgacacacataag

SEQ ID NO: 38507 - DNA, 18 bp, Artificial Sequence
  Synthetic DNA
acttatgacaggctatcg

SEQ ID NO: 38508 - DNA, 18 bp, Artificial Sequence
  Synthetic DNA
agatacagcagtctaatg

SEQ ID NO: 38509 - DNA, 18 bp, Artificial Sequence
  Synthetic DNA
agtgacgactcacaatag

SEQ ID NO: 38510 - DNA, 18 bp, Artificial Sequence
  Synthetic DNA
agttaggactctctttag

SEQ ID NO: 38511 - DNA, 18 bp, Artificial Sequence
  Synthetic DNA
ataaacgactatcgtttg

SEQ ID NO: 38512 - DNA, 18 bp, Artificial Sequence
  Synthetic DNA
atataagactccgaatag

SEQ ID NO: 38513 - DNA, 18 bp, Artificial Sequence
  Synthetic DNA
atatacgactctcttatg

SEQ ID NO: 38514 - DNA, 18 bp, Artificial Sequence
  Synthetic DNA
atatacgattcagtaaag

SEQ ID NO: 38515 - DNA, 18 bp, Artificial Sequence
  Synthetic DNA
atatacgattctctctag

SEQ ID NO: 38516 - DNA, 18 bp, Artificial Sequence
  Synthetic DNA
atatacgcccaacaatag

SEQ ID NO: 38517 - DNA, 18 bp, Artificial Sequence
  Synthetic DNA
atatacggctcgctgttg

SEQ ID NO: 38518 - DNA, 18 bp, Artificial Sequence
  Synthetic DNA
atataggatacactatag

SEQ ID NO: 38519 - DNA, 18 bp, Artificial Sequence
  Synthetic DNA
atatatgacacgatatag

SEQ ID NO: 38520 - DNA, 18 bp, Artificial Sequence
  Synthetic DNA
atatcggcctcactatag

SEQ ID NO: 38521 - DNA, 18 bp, Artificial Sequence
  Synthetic DNA
atatgagactgccaatag

SEQ ID NO: 38522 - DNA, 18 bp, Artificial Sequence
  Synthetic DNA
atctacgacttacaaaag

SEQ ID NO: 38523 - DNA, 18 bp, Artificial Sequence
  Synthetic DNA
attaacgtccggctatag

SEQ ID NO: 38524 - DNA, 18 bp, Artificial Sequence
  Synthetic DNA
attaactagtccctatcg

SEQ ID NO: 38525 - DNA, 18 bp, Artificial Sequence
  Synthetic DNA
attcacgtctcactatag

SEQ ID NO: 38526 - DNA, 18 bp, Artificial Sequence
  Synthetic DNA
caaaacaactcacttaag

SEQ ID NO: 38527 - DNA, 18 bp, Artificial Sequence
  Synthetic DNA
caaaacgactcacttaaa

SEQ ID NO: 38528 - DNA, 18 bp, Artificial Sequence
  Synthetic DNA
caaatcgattctatatag

SEQ ID NO: 38529 - DNA, 18 bp, Artificial Sequence
  Synthetic DNA
caacacgtctaactttag

SEQ ID NO: 38530 - DNA, 18 bp, Artificial Sequence
  Synthetic DNA
caatacgaccccctctgg

SEQ ID NO: 38531 - DNA, 18 bp, Artificial Sequence
  Synthetic DNA
caatactaagcactttag

SEQ ID NO: 38532 - DNA, 18 bp, Artificial Sequence
  Synthetic DNA
caatactatttactattg

SEQ ID NO: 38533 - DNA, 18 bp, Artificial Sequence
  Synthetic DNA
caatagatctcactctag

SEQ ID NO: 38534 - DNA, 18 bp, Artificial Sequence
  Synthetic DNA
caatccttctctcaaaag

SEQ ID NO: 38535 - DNA, 18 bp, Artificial Sequence
  Synthetic DNA
caatctgactctcaaaag

SEQ ID NO: 38536 - DNA, 18 bp, Artificial Sequence
  Synthetic DNA
caattggaatctctatag

SEQ ID NO: 38537 - DNA, 18 bp, Artificial Sequence
  Synthetic DNA
cagaacgacttcctacag

SEQ ID NO: 38538 - DNA, 18 bp, Artificial Sequence
  Synthetic DNA
cagagagactcactatag

SEQ ID NO: 38539 - DNA, 18 bp, Artificial Sequence
  Synthetic DNA
cattgctattcactatag

SEQ ID NO: 38540 - DNA, 18 bp, Artificial Sequence
  Synthetic DNA
ccttacaattcacaatag

SEQ ID NO: 38541 - DNA, 18 bp, Artificial Sequence
  Synthetic DNA
ctattcgccgcactatcg

SEQ ID NO: 38542 - DNA, 18 bp, Artificial Sequence
  Synthetic DNA
ctattcggctcactatcg

SEQ ID NO: 38543 - DNA, 18 bp, Artificial Sequence
  Synthetic DNA
ctctacggcacgctatag

SEQ ID NO: 38544 - DNA, 18 bp, Artificial Sequence
  Synthetic DNA
ctttacgaattaaaattg

SEQ ID NO: 38545 - DNA, 18 bp, Artificial Sequence
  Synthetic DNA
ctttacgtatcagtatag

SEQ ID NO: 38546 - DNA, 18 bp, Artificial Sequence
  Synthetic DNA
gaaaacgagtttccattg

SEQ ID NO: 38547 - DNA, 18 bp, Artificial Sequence
  Synthetic DNA
gaataccattcacaaatg

SEQ ID NO: 38548 - DNA, 18 bp, Artificial Sequence
  Synthetic DNA
gaatacgaatcacgtaag

SEQ ID NO: 38549 - DNA, 18 bp, Artificial Sequence
  Synthetic DNA
gaattcgatacattatag

SEQ ID NO: 38550 - DNA, 18 bp, Artificial Sequence
  Synthetic DNA
gaatttgaacttctatag

SEQ ID NO: 38551 - DNA, 18 bp, Artificial Sequence
  Synthetic DNA
gaatttgattcgacatag

SEQ ID NO: 38552 - DNA, 18 bp, Artificial Sequence
  Synthetic DNA
gattacgactctcgtttg

SEQ ID NO: 38553 - DNA, 18 bp, Artificial Sequence
  Synthetic DNA
ggtaacgacccagtaaag

SEQ ID NO: 38554 - DNA, 18 bp, Artificial Sequence
  Synthetic DNA
gtatactacactcaattg

SEQ ID NO: 38555 - DNA, 18 bp, Artificial Sequence
  Synthetic DNA
gtattcgtctatctattg

SEQ ID NO: 38556 - DNA, 18 bp, Artificial Sequence
  Synthetic DNA
gtttccgtcattctatag

SEQ ID NO: 38557 - DNA, 18 bp, Artificial Sequence
  Synthetic DNA
taaaacaattctctacag

SEQ ID NO: 38558 - DNA, 18 bp, Artificial Sequence
  Synthetic DNA
taaaacgaatctacttag

SEQ ID NO: 38559 - DNA, 18 bp, Artificial Sequence
  Synthetic DNA
taaaatgactcaacttgg

SEQ ID NO: 38560 - DNA, 18 bp, Artificial Sequence
  Synthetic DNA
taaaatgtctcaccttag

SEQ ID NO: 38561 - DNA, 18 bp, Artificial Sequence
  Synthetic DNA
taaaatgtctgagtaaag

SEQ ID NO: 38562 - DNA, 18 bp, Artificial Sequence
  Synthetic DNA
taaaccatcacactatcg

SEQ ID NO: 38563 - DNA, 18 bp, Artificial Sequence
  Synthetic DNA
taaaccgtctcactaatg

SEQ ID NO: 38564 - DNA, 18 bp, Artificial Sequence
  Synthetic DNA
taaagcgactctcttttg

SEQ ID NO: 38565 - DNA, 18 bp, Artificial Sequence
  Synthetic DNA
taaatcgacagaccatag

SEQ ID NO: 38566 - DNA, 18 bp, Artificial Sequence
  Synthetic DNA
taaatcgtctcccgttag

SEQ ID NO: 38567 - DNA, 18 bp, Artificial Sequence
  Synthetic DNA
taacaaggaaagctattg

SEQ ID NO: 38568 - DNA, 18 bp, Artificial Sequence
  Synthetic DNA
taacaaggctcactaggg

SEQ ID NO: 38569 - DNA, 18 bp, Artificial Sequence
  Synthetic DNA
taacaagtctcacataag

SEQ ID NO: 38570 - DNA, 18 bp, Artificial Sequence
  Synthetic DNA
taacacaattcattagag

SEQ ID NO: 38571 - DNA, 18 bp, Artificial Sequence
  Synthetic DNA
taacacgacttttcttag

SEQ ID NO: 38572 - DNA, 18 bp, Artificial Sequence
  Synthetic DNA
taacacgattccccagag

SEQ ID NO: 38573 - DNA, 18 bp, Artificial Sequence
  Synthetic DNA
taacacgtctctcaagcg

SEQ ID NO: 38574 - DNA, 18 bp, Artificial Sequence
  Synthetic DNA
taaggcccctaactatag

SEQ ID NO: 38575 - DNA, 18 bp, Artificial Sequence
  Synthetic DNA
taataacacttactaatg

SEQ ID NO: 38576 - DNA, 18 bp, Artificial Sequence
  Synthetic DNA
taataagaattattaaag

SEQ ID NO: 38577 - DNA, 18 bp, Artificial Sequence
  Synthetic DNA
taataagtctcatcatcg

SEQ ID NO: 38578 - DNA, 18 bp, Artificial Sequence
  Synthetic DNA
taataattctctatattg

SEQ ID NO: 38579 - DNA, 18 bp, Artificial Sequence
  Synthetic DNA
taatacaattctatttcg

SEQ ID NO: 38580 - DNA, 18 bp, Artificial Sequence
  Synthetic DNA
taataccaataagtctag

SEQ ID NO: 38581 - DNA, 18 bp, Artificial Sequence
  Synthetic DNA
taataccactcttgttag

SEQ ID NO: 38582 - DNA, 18 bp, Artificial Sequence
  Synthetic DNA
taatacgacttccactcg

SEQ ID NO: 38583 - DNA, 18 bp, Artificial Sequence
  Synthetic DNA
taatacgacttttcaaag

SEQ ID NO: 38584 - DNA, 18 bp, Artificial Sequence
  Synthetic DNA
taatacgattctggctag

SEQ ID NO: 38585 - DNA, 18 bp, Artificial Sequence
  Synthetic DNA
taatacgcatctaaatag

SEQ ID NO: 38586 - DNA, 18 bp, Artificial Sequence
  Synthetic DNA
taatacgtaacattcaag

SEQ ID NO: 38587 - DNA, 18 bp, Artificial Sequence
  Synthetic DNA
taatacgtctcacaccgg

SEQ ID NO: 38588 - DNA, 18 bp, Artificial Sequence
  Synthetic DNA
taatactacactttcatg

SEQ ID NO: 38589 - DNA, 18 bp, Artificial Sequence
  Synthetic DNA
taatactattatgagtcg

SEQ ID NO: 38590 - DNA, 18 bp, Artificial Sequence
  Synthetic DNA
taatagaaccctcactag

SEQ ID NO: 38591 - DNA, 18 bp, Artificial Sequence
  Synthetic DNA
taataggataccctaaag

SEQ ID NO: 38592 - DNA, 18 bp, Artificial Sequence
  Synthetic DNA
taatatcacttaagatag

SEQ ID NO: 38593 - DNA, 18 bp, Artificial Sequence
  Synthetic DNA
taatatgcctttatattg

SEQ ID NO: 38594 - DNA, 18 bp, Artificial Sequence
  Synthetic DNA
taatatggacgacataag

SEQ ID NO: 38595 - DNA, 18 bp, Artificial Sequence
  Synthetic DNA
taatccgaccaccaatag

SEQ ID NO: 38596 - DNA, 18 bp, Artificial Sequence
  Synthetic DNA
taatccgagcccgtaaag

SEQ ID NO: 38597 - DNA, 18 bp, Artificial Sequence
  Synthetic DNA
taatcctcctaaatatag

SEQ ID NO: 38598 - DNA, 18 bp, Artificial Sequence
  Synthetic DNA
taatgagtccggctatag

SEQ ID NO: 38599 - DNA, 18 bp, Artificial Sequence
  Synthetic DNA
taattagacacgctattg

SEQ ID NO: 38600 - DNA, 18 bp, Artificial Sequence
  Synthetic DNA
taattagatacactattg

SEQ ID NO: 38601 - DNA, 18 bp, Artificial Sequence
  Synthetic DNA
taattcaattcactagtg

SEQ ID NO: 38602 - DNA, 18 bp, Artificial Sequence
  Synthetic DNA
taattcgactttttaagg

SEQ ID NO: 38603 - DNA, 18 bp, Artificial Sequence
  Synthetic DNA
taattgaaaataactcag

SEQ ID NO: 38604 - DNA, 18 bp, Artificial Sequence
  Synthetic DNA
taatttaatttactactg

SEQ ID NO: 38605 - DNA, 18 bp, Artificial Sequence
  Synthetic DNA
taatttgtctcacattgg

SEQ ID NO: 38606 - DNA, 18 bp, Artificial Sequence
  Synthetic DNA
tacaaatattcactatag

SEQ ID NO: 38607 - DNA, 18 bp, Artificial Sequence
  Synthetic DNA
tacaacgactcaatttcg

SEQ ID NO: 38608 - DNA, 18 bp, Artificial Sequence
  Synthetic DNA
tacaatgattcattatcg

SEQ ID NO: 38609 - DNA, 18 bp, Artificial Sequence
  Synthetic DNA
tacaattacttcctaatg

SEQ ID NO: 38610 - DNA, 18 bp, Artificial Sequence
  Synthetic DNA
tactccgaatcacttaag

SEQ ID NO: 38611 - DNA, 18 bp, Artificial Sequence
  Synthetic DNA
tactgcgaacccaacaag

SEQ ID NO: 38612 - DNA, 18 bp, Artificial Sequence
  Synthetic DNA
tactgtgacatactattg

SEQ ID NO: 38613 - DNA, 18 bp, Artificial Sequence
  Synthetic DNA
tacttcaattaactgtgg

SEQ ID NO: 38614 - DNA, 18 bp, Artificial Sequence
  Synthetic DNA
tacttctactcgctatcg

SEQ ID NO: 38615 - DNA, 18 bp, Artificial Sequence
  Synthetic DNA
tagcacgactttttaaag

SEQ ID NO: 38616 - DNA, 18 bp, Artificial Sequence
  Synthetic DNA
tagcataaatctatttag

SEQ ID NO: 38617 - DNA, 18 bp, Artificial Sequence
  Synthetic DNA
taggagatttcactatag

SEQ ID NO: 38618 - DNA, 18 bp, Artificial Sequence
  Synthetic DNA
tagtaagttgaattatag

SEQ ID NO: 38619 - DNA, 18 bp, Artificial Sequence
  Synthetic DNA
tagtacgcgtaagtttag

SEQ ID NO: 38620 - DNA, 18 bp, Artificial Sequence
  Synthetic DNA
tagttagactaactaaag

SEQ ID NO: 38621 - DNA, 18 bp, Artificial Sequence
  Synthetic DNA
tataacggctcacagaag

SEQ ID NO: 38622 - DNA, 18 bp, Artificial Sequence
  Synthetic DNA
tataaggactcgctattg

SEQ ID NO: 38623 - DNA, 18 bp, Artificial Sequence
  Synthetic DNA
tataatgtccgactatag

SEQ ID NO: 38624 - DNA, 18 bp, Artificial Sequence
  Synthetic DNA
tataccaatcctttaaag

SEQ ID NO: 38625 - DNA, 18 bp, Artificial Sequence
  Synthetic DNA
tatatccacacattatag

SEQ ID NO: 38626 - DNA, 18 bp, Artificial Sequence
  Synthetic DNA
tatatcctttctctatag

SEQ ID NO: 38627 - DNA, 18 bp, Artificial Sequence
  Synthetic DNA
tatcttgacacattatag

SEQ ID NO: 38628 - DNA, 18 bp, Artificial Sequence
  Synthetic DNA
tatgacgtatcactttag

SEQ ID NO: 38629 - DNA, 18 bp, Artificial Sequence
  Synthetic DNA
tatgtatactcactatag

SEQ ID NO: 38630 - DNA, 18 bp, Artificial Sequence
  Synthetic DNA
tatgtcgaatctattaag

SEQ ID NO: 38631 - DNA, 18 bp, Artificial Sequence
  Synthetic DNA
tattaatacttggtatag

SEQ ID NO: 38632 - DNA, 18 bp, Artificial Sequence
  Synthetic DNA
tattaccacccactcttg

SEQ ID NO: 38633 - DNA, 18 bp, Artificial Sequence
  Synthetic DNA
tattacgactcaatcatg

SEQ ID NO: 38634 - DNA, 18 bp, Artificial Sequence
  Synthetic DNA
tattacgactcactcata

SEQ ID NO: 38635 - DNA, 18 bp, Artificial Sequence
  Synthetic DNA
tattacgattctctactg

SEQ ID NO: 38636 - DNA, 18 bp, Artificial Sequence
  Synthetic DNA
tattacgcccaattacag

SEQ ID NO: 38637 - DNA, 18 bp, Artificial Sequence
  Synthetic DNA
tattacgcctctcgatcg

SEQ ID NO: 38638 - DNA, 18 bp, Artificial Sequence
  Synthetic DNA
tattactgctcttaacag

SEQ ID NO: 38639 - DNA, 18 bp, Artificial Sequence
  Synthetic DNA
tattataactctgtaaag

SEQ ID NO: 38640 - DNA, 18 bp, Artificial Sequence
  Synthetic DNA
tattatgagtctctattg

SEQ ID NO: 38641 - DNA, 18 bp, Artificial Sequence
  Synthetic DNA
tattccatcttactacag

SEQ ID NO: 38642 - DNA, 18 bp, Artificial Sequence
  Synthetic DNA
tattgtgactcacttttg

SEQ ID NO: 38643 - DNA, 18 bp, Artificial Sequence
  Synthetic DNA
tatttcaaaacactatag

SEQ ID NO: 38644 - DNA, 18 bp, Artificial Sequence
  Synthetic DNA
tatttcaatacactatag

SEQ ID NO: 38645 - DNA, 18 bp, Artificial Sequence
  Synthetic DNA
tatttcctcccactatag

SEQ ID NO: 38646 - DNA, 18 bp, Artificial Sequence
  Synthetic DNA
tatttcgactatttatcg

SEQ ID NO: 38647 - DNA, 18 bp, Artificial Sequence
  Synthetic DNA
tatttcgattcacagtag

SEQ ID NO: 38648 - DNA, 18 bp, Artificial Sequence
  Synthetic DNA
tatttctcaccattattg

SEQ ID NO: 38649 - DNA, 18 bp, Artificial Sequence
  Synthetic DNA
tcaaactacccactaaag

SEQ ID NO: 38650 - DNA, 18 bp, Artificial Sequence
  Synthetic DNA
tcaatcaacttactatag

SEQ ID NO: 38651 - DNA, 18 bp, Artificial Sequence
  Synthetic DNA
tcaatcgacacactgtag

SEQ ID NO: 38652 - DNA, 18 bp, Artificial Sequence
  Synthetic DNA
tcaatcggctccttatag

SEQ ID NO: 38653 - DNA, 18 bp, Artificial Sequence
  Synthetic DNA
tcagacgtctttttatag

SEQ ID NO: 38654 - DNA, 18 bp, Artificial Sequence
  Synthetic DNA
tcatacgaatcacagcag

SEQ ID NO: 38655 - DNA, 18 bp, Artificial Sequence
  Synthetic DNA
tcatccgacacactttcg

SEQ ID NO: 38656 - DNA, 18 bp, Artificial Sequence
  Synthetic DNA
tcatgcaactcgttacag

SEQ ID NO: 38657 - DNA, 18 bp, Artificial Sequence
  Synthetic DNA
tcattcttctcactaaag

SEQ ID NO: 38658 - DNA, 18 bp, Artificial Sequence
  Synthetic DNA
tcctatcattttctatag

SEQ ID NO: 38659 - DNA, 18 bp, Artificial Sequence
  Synthetic DNA
tctgtcaactcactacag

SEQ ID NO: 38660 - DNA, 18 bp, Artificial Sequence
  Synthetic DNA
tcttacatctcactacag

SEQ ID NO: 38661 - DNA, 18 bp, Artificial Sequence
  Synthetic DNA
tgactcgacactctatag

SEQ ID NO: 38662 - DNA, 18 bp, Artificial Sequence
  Synthetic DNA
tgatacaactcattactg

SEQ ID NO: 38663 - DNA, 18 bp, Artificial Sequence
  Synthetic DNA
tgatacggttcgcttttg

SEQ ID NO: 38664 - DNA, 18 bp, Artificial Sequence
  Synthetic DNA
tgatacgtcacacttttg

SEQ ID NO: 38665 - DNA, 18 bp, Artificial Sequence
  Synthetic DNA
tgattcgactcacatttg

SEQ ID NO: 38666 - DNA, 18 bp, Artificial Sequence
  Synthetic DNA
tgattcgccactcaactg

SEQ ID NO: 38667 - DNA, 18 bp, Artificial Sequence
  Synthetic DNA
tgctacagttcactatag

SEQ ID NO: 38668 - DNA, 18 bp, Artificial Sequence
  Synthetic DNA
tggtatgtctcaaaatag

SEQ ID NO: 38669 - DNA, 18 bp, Artificial Sequence
  Synthetic DNA
tggttggtctcactatag

SEQ ID NO: 38670 - DNA, 18 bp, Artificial Sequence
  Synthetic DNA
tgttacaaggcactatgg

SEQ ID NO: 38671 - DNA, 18 bp, Artificial Sequence
  Synthetic DNA
tgttacgaatcaaaattg

SEQ ID NO: 38672 - DNA, 18 bp, Artificial Sequence
  Synthetic DNA
tgttacgactatcaatag

SEQ ID NO: 38673 - DNA, 18 bp, Artificial Sequence
  Synthetic DNA
tgtttcaacacactacag

SEQ ID NO: 38674 - DNA, 18 bp, Artificial Sequence
  Synthetic DNA
tgtttcgcctcactgtag

SEQ ID NO: 38675 - DNA, 18 bp, Artificial Sequence
  Synthetic DNA
ttaaacgactcactcatg

SEQ ID NO: 38676 - DNA, 18 bp, Artificial Sequence
  Synthetic DNA
ttaaacgactcgctactg

SEQ ID NO: 38677 - DNA, 18 bp, Artificial Sequence
  Synthetic DNA
ttacaagacttactaaag

SEQ ID NO: 38678 - DNA, 18 bp, Artificial Sequence
  Synthetic DNA
ttacacgattcacattag

SEQ ID NO: 38679 - DNA, 18 bp, Artificial Sequence
  Synthetic DNA
ttacactagtcattaaag

SEQ ID NO: 38680 - DNA, 18 bp, Artificial Sequence
  Synthetic DNA
ttactcgactcactttcg

SEQ ID NO: 38681 - DNA, 18 bp, Artificial Sequence
  Synthetic DNA
ttagacgtcactatatag

SEQ ID NO: 38682 - DNA, 18 bp, Artificial Sequence
  Synthetic DNA
ttataagtctctcaatag

SEQ ID NO: 38683 - DNA, 18 bp, Artificial Sequence
  Synthetic DNA
ttatacgactcttttatg

SEQ ID NO: 38684 - DNA, 18 bp, Artificial Sequence
  Synthetic DNA
ttatacgtcagactattg

SEQ ID NO: 38685 - DNA, 18 bp, Artificial Sequence
  Synthetic DNA
ttatactaataatacttg

SEQ ID NO: 38686 - DNA, 18 bp, Artificial Sequence
  Synthetic DNA
ttatatgcattactctag

SEQ ID NO: 38687 - DNA, 18 bp, Artificial Sequence
  Synthetic DNA
ttatatgtctcacgattg

SEQ ID NO: 38688 - DNA, 18 bp, Artificial Sequence
  Synthetic DNA
ttatattaatcaattaag

SEQ ID NO: 38689 - DNA, 18 bp, Artificial Sequence
  Synthetic DNA
ttatcaaactcgctatag

SEQ ID NO: 38690 - DNA, 18 bp, Artificial Sequence
  Synthetic DNA
ttatgagactcacatacg

SEQ ID NO: 38691 - DNA, 18 bp, Artificial Sequence
  Synthetic DNA
ttatgcaaaacacaatag

SEQ ID NO: 38692 - DNA, 18 bp, Artificial Sequence
  Synthetic DNA
ttatgcgtctctgtattg

SEQ ID NO: 38693 - DNA, 18 bp, Artificial Sequence
  Synthetic DNA
ttattacactcaccatag

SEQ ID NO: 38694 - DNA, 18 bp, Artificial Sequence
  Synthetic DNA
ttattcagctctctaaag

SEQ ID NO: 38695 - DNA, 18 bp, Artificial Sequence
  Synthetic DNA
ttattcgactgctgctag

SEQ ID NO: 38696 - DNA, 18 bp, Artificial Sequence
  Synthetic DNA
ttattcgagatgttagag

SEQ ID NO: 38697 - DNA, 18 bp, Artificial Sequence
  Synthetic DNA
ttattcgtctcactactg

SEQ ID NO: 38698 - DNA, 18 bp, Artificial Sequence
  Synthetic DNA
ttattcgtttaactctag

SEQ ID NO: 38699 - DNA, 18 bp, Artificial Sequence
  Synthetic DNA
ttattctactcacaaaag

SEQ ID NO: 38700 - DNA, 18 bp, Artificial Sequence
  Synthetic DNA
ttatttcacacgctatag

SEQ ID NO: 38701 - DNA, 18 bp, Artificial Sequence
  Synthetic DNA
ttcaaatactaactattg

SEQ ID NO: 38702 - DNA, 18 bp, Artificial Sequence
  Synthetic DNA
ttctaataattactattg

SEQ ID NO: 38703 - DNA, 18 bp, Artificial Sequence
  Synthetic DNA
ttctacggcttattcatg

SEQ ID NO: 38704 - DNA, 18 bp, Artificial Sequence
  Synthetic DNA
ttctccgtcccactattg

SEQ ID NO: 38705 - DNA, 18 bp, Artificial Sequence
  Synthetic DNA
ttctctgaatctttatag

SEQ ID NO: 38706 - DNA, 18 bp, Artificial Sequence
  Synthetic DNA
ttgaacgcctaagtatag

SEQ ID NO: 38707 - DNA, 18 bp, Artificial Sequence
  Synthetic DNA
ttgaaggactcattatag

SEQ ID NO: 38708 - DNA, 18 bp, Artificial Sequence
  Synthetic DNA
ttgtcggtcttactattg

SEQ ID NO: 38709 - DNA, 18 bp, Artificial Sequence
  Synthetic DNA
tttcacgagtcacgatag

SEQ ID NO: 38710 - DNA, 18 bp, Artificial Sequence
  Synthetic DNA
ttttaccactctccttag

SEQ ID NO: 38711 - DNA, 18 bp, Artificial Sequence
  Synthetic DNA
ttttacgtctcgctagag

SEQ ID NO: 38712 - DNA, 18 bp, Artificial Sequence
  Synthetic DNA
ttttactactcgcaatag

SEQ ID NO: 38713 - DNA, 18 bp, Artificial Sequence
  Synthetic DNA
ttttatcactgactattg

SEQ ID NO: 38714 - DNA, 18 bp, Artificial Sequence
  Synthetic DNA
ttttatgaatcattaaag

SEQ ID NO: 38715 - DNA, 18 bp, Artificial Sequence
  Synthetic DNA
ttttccgcatcactatag

SEQ ID NO: 38716 - DNA, 18 bp, Artificial Sequence
  Synthetic DNA
ttttgagattcccttatg

SEQ ID NO: 38717 - DNA, 18 bp, Artificial Sequence
  Synthetic DNA
ttttgccgctctctatag

SEQ ID NO: 38718 - DNA, 18 bp, Artificial Sequence
  Synthetic DNA
tttttcgattcactaaag

SEQ ID NO: 38719 - DNA, 18 bp, Artificial Sequence
  Synthetic DNA
tttttcgcctcactacag

SEQ ID NO: 38720 - DNA, 18 bp, Artificial Sequence
  Synthetic DNA
tttttcgtctcactatcg

SEQ ID NO: 38721 - DNA, 18 bp, Artificial Sequence
  Synthetic DNA
taataagactatcattag

SEQ ID NO: 38722 - DNA, 18 bp, Artificial Sequence
  Synthetic DNA
tattaagcatcaccagag

SEQ ID NO: 38723 - DNA, 18 bp, Artificial Sequence
  Synthetic DNA
ttatacgtgtcaccattg

SEQ ID NO: 38724 - DNA, 18 bp, Artificial Sequence
  Synthetic DNA
tgatataattcactatgg

SEQ ID NO: 38725 - DNA, 18 bp, Artificial Sequence
  Synthetic DNA
ttacgcgactcacttaag

SEQ ID NO: 38726 - DNA, 18 bp, Artificial Sequence
  Synthetic DNA
tattaccatttactgtag

SEQ ID NO: 38727 - DNA, 18 bp, Artificial Sequence
  Synthetic DNA
atgtacgacactctatag

SEQ ID NO: 38728 - DNA, 18 bp, Artificial Sequence
  Synthetic DNA
ttatctgactcacttttg

SEQ ID NO: 38729 - DNA, 18 bp, Artificial Sequence
  Synthetic DNA
tattccgcctcactaatg

SEQ ID NO: 38730 - DNA, 18 bp, Artificial Sequence
  Synthetic DNA
tattctaactcactgtgg

SEQ ID NO: 38731 - DNA, 18 bp, Artificial Sequence
  Synthetic DNA
ttaatcgactcagtttag

SEQ ID NO: 38732 - DNA, 18 bp, Artificial Sequence
  Synthetic DNA
aaatttgactttcaatag

SEQ ID NO: 38733 - DNA, 18 bp, Artificial Sequence
  Synthetic DNA
aattacgaaacactagag

SEQ ID NO: 38734 - DNA, 18 bp, Artificial Sequence
  Synthetic DNA
acatacgaatttgtagag

SEQ ID NO: 38735 - DNA, 18 bp, Artificial Sequence
  Synthetic DNA
acattcgactcactttgg

SEQ ID NO: 38736 - DNA, 18 bp, Artificial Sequence
  Synthetic DNA
agaaaagaatcaatatag

SEQ ID NO: 38737 - DNA, 18 bp, Artificial Sequence
  Synthetic DNA
atatacgacttacatttg

SEQ ID NO: 38738 - DNA, 18 bp, Artificial Sequence
  Synthetic DNA
atattcgactcaccatcg

SEQ ID NO: 38739 - DNA, 18 bp, Artificial Sequence
  Synthetic DNA
ctatgcggatcattatag

SEQ ID NO: 38740 - DNA, 18 bp, Artificial Sequence
  Synthetic DNA
taacacggcacgcaatag

SEQ ID NO: 38741 - DNA, 18 bp, Artificial Sequence
  Synthetic DNA
taataaaactcacgaatg

SEQ ID NO: 38742 - DNA, 18 bp, Artificial Sequence
  Synthetic DNA
taataccctccacaaatg

SEQ ID NO: 38743 - DNA, 18 bp, Artificial Sequence
  Synthetic DNA
taatacgacatccaacag

SEQ ID NO: 38744 - DNA, 18 bp, Artificial Sequence
  Synthetic DNA
taatacgagcctctaatg

SEQ ID NO: 38745 - DNA, 18 bp, Artificial Sequence
  Synthetic DNA
taatccgactcagttgtg

SEQ ID NO: 38746 - DNA, 18 bp, Artificial Sequence
  Synthetic DNA
tacctcgactaactattg

SEQ ID NO: 38747 - DNA, 18 bp, Artificial Sequence
  Synthetic DNA
tagtactagtcagataag

SEQ ID NO: 38748 - DNA, 18 bp, Artificial Sequence
  Synthetic DNA
tagtgcgtcacactttag

SEQ ID NO: 38749 - DNA, 18 bp, Artificial Sequence
  Synthetic DNA
tattagaactcactagtg

SEQ ID NO: 38750 - DNA, 18 bp, Artificial Sequence
  Synthetic DNA
tcaacctactcacttttg

SEQ ID NO: 38751 - DNA, 18 bp, Artificial Sequence
  Synthetic DNA
tcacacctctcactattg

SEQ ID NO: 38752 - DNA, 18 bp, Artificial Sequence
  Synthetic DNA
tcatacgaataactcttg

SEQ ID NO: 38753 - DNA, 18 bp, Artificial Sequence
  Synthetic DNA
tcatacgtcttacattag

SEQ ID NO: 38754 - DNA, 18 bp, Artificial Sequence
  Synthetic DNA
tgatgtaactcactaaag

SEQ ID NO: 38755 - DNA, 18 bp, Artificial Sequence
  Synthetic DNA
tgattcaacgcaatatag

SEQ ID NO: 38756 - DNA, 18 bp, Artificial Sequence
  Synthetic DNA
ttaaaggactcacatttg

SEQ ID NO: 38757 - DNA, 18 bp, Artificial Sequence
  Synthetic DNA
ttaaaggtgtgactatag

SEQ ID NO: 38758 - DNA, 18 bp, Artificial Sequence
  Synthetic DNA
ttaaatgactcccaatag

SEQ ID NO: 38759 - DNA, 18 bp, Artificial Sequence
  Synthetic DNA
ttatacatctttctattg

SEQ ID NO: 38760 - DNA, 18 bp, Artificial Sequence
  Synthetic DNA
ttataccttattctttag

SEQ ID NO: 38761 - DNA, 18 bp, Artificial Sequence
  Synthetic DNA
ttatacgccaggctatag

SEQ ID NO: 38762 - DNA, 18 bp, Artificial Sequence
  Synthetic DNA
ttatacgtctcaccaatg

SEQ ID NO: 38763 - DNA, 18 bp, Artificial Sequence
  Synthetic DNA
ttattcgactcgctaatg

SEQ ID NO: 38764 - DNA, 18 bp, Artificial Sequence
  Synthetic DNA
ttatttggctcacactag

SEQ ID NO: 38765 - DNA, 18 bp, Artificial Sequence
  Synthetic DNA
tttttcgactcactcaag

SEQ ID NO: 38766 - DNA, 18 bp, Artificial Sequence
  Synthetic DNA
tcatacaactcgatttag

SEQ ID NO: 38767 - DNA, 18 bp, Artificial Sequence
  Synthetic DNA
atttatagctcactattg

SEQ ID NO: 38768 - DNA, 18 bp, Artificial Sequence
  Synthetic DNA
caaatagactcactaaag

SEQ ID NO: 38769 - DNA, 18 bp, Artificial Sequence
  Synthetic DNA
taatacaatgttctaaag

SEQ ID NO: 38770 - DNA, 18 bp, Artificial Sequence
  Synthetic DNA
taatacgaccatctcttg

SEQ ID NO: 38771 - DNA, 18 bp, Artificial Sequence
  Synthetic DNA
taatagaactcttaatag

SEQ ID NO: 38772 - DNA, 18 bp, Artificial Sequence
  Synthetic DNA
taatagcacttaaaaaag

SEQ ID NO: 38773 - DNA, 18 bp, Artificial Sequence
  Synthetic DNA
taattcgtgtcattacag

SEQ ID NO: 38774 - DNA, 18 bp, Artificial Sequence
  Synthetic DNA
tattacgtttcaccaaag

SEQ ID NO: 38775 - DNA, 18 bp, Artificial Sequence
  Synthetic DNA
tgatagggctaactaaag

SEQ ID NO: 38776 - DNA, 18 bp, Artificial Sequence
  Synthetic DNA
tgttgcgtctcactaaag

SEQ ID NO: 38777 - DNA, 18 bp, Artificial Sequence
  Synthetic DNA
ttaaacgactcgctgttg

SEQ ID NO: 38778 - DNA, 18 bp, Artificial Sequence
  Synthetic DNA
ttttacgtctcactaatg

SEQ ID NO: 38779 - DNA, 18 bp, Artificial Sequence
  Synthetic DNA
taaaacgcatctctacag

SEQ ID NO: 38780 - DNA, 18 bp, Artificial Sequence
  Synthetic DNA
taatcaaactcacttcag

SEQ ID NO: 38781 - DNA, 18 bp, Artificial Sequence
  Synthetic DNA
agatcggactcactgtag

SEQ ID NO: 38782 - DNA, 18 bp, Artificial Sequence
  Synthetic DNA
tgataattctctttatag

SEQ ID NO: 38783 - DNA, 18 bp, Artificial Sequence
  Synthetic DNA
taaaacgtctctctggag

SEQ ID NO: 38784 - DNA, 18 bp, Artificial Sequence
  Synthetic DNA
tttaacgtctcgctatag

SEQ ID NO: 38785 - DNA, 18 bp, Artificial Sequence
  Synthetic DNA
atttacgactcacactag

SEQ ID NO: 38786 - DNA, 18 bp, Artificial Sequence
  Synthetic DNA
taattcggcacgatattg

SEQ ID NO: 38787 - DNA, 18 bp, Artificial Sequence
  Synthetic DNA
taattcgtcttcctttag

SEQ ID NO: 38788 - DNA, 18 bp, Artificial Sequence
  Synthetic DNA
tttttcgactcactaatg

SEQ ID NO: 38789 - DNA, 18 bp, Artificial Sequence
  Synthetic DNA
taattcgagtcacagatg

SEQ ID NO: 38790 - DNA, 18 bp, Artificial Sequence
  Synthetic DNA
agatatgtttcactaaag

SEQ ID NO: 38791 - DNA, 18 bp, Artificial Sequence
  Synthetic DNA
atattttactctccaaag

SEQ ID NO: 38792 - DNA, 18 bp, Artificial Sequence
  Synthetic DNA
atgtacggctaacacctg

SEQ ID NO: 38793 - DNA, 18 bp, Artificial Sequence
  Synthetic DNA
taacatgaaccactaatg

SEQ ID NO: 38794 - DNA, 18 bp, Artificial Sequence
  Synthetic DNA
taaggcgatacactaaag

SEQ ID NO: 38795 - DNA, 18 bp, Artificial Sequence
  Synthetic DNA
aaaaaggacacaccacag

SEQ ID NO: 38796 - DNA, 18 bp, Artificial Sequence
  Synthetic DNA
aatttcgtcttaatcctg

SEQ ID NO: 38797 - DNA, 18 bp, Artificial Sequence
  Synthetic DNA
atatactacgcatcactg

SEQ ID NO: 38798 - DNA, 18 bp, Artificial Sequence
  Synthetic DNA
ctaaacgactctctaaag

SEQ ID NO: 38799 - DNA, 18 bp, Artificial Sequence
  Synthetic DNA
gtatacgtctcacttttg

SEQ ID NO: 38800 - DNA, 18 bp, Artificial Sequence
  Synthetic DNA
taagtcgatccacaatag

SEQ ID NO: 38801 - DNA, 18 bp, Artificial Sequence
  Synthetic DNA
taatacacttcacagatg

SEQ ID NO: 38802 - DNA, 18 bp, Artificial Sequence
  Synthetic DNA
taatcttagccaccatag

SEQ ID NO: 38803 - DNA, 18 bp, Artificial Sequence
  Synthetic DNA
taatgtgactcaactaag

SEQ ID NO: 38804 - DNA, 18 bp, Artificial Sequence
  Synthetic DNA
tacctgtacttactctag

SEQ ID NO: 38805 - DNA, 18 bp, Artificial Sequence
  Synthetic DNA
tagtacgtttcacttaag

SEQ ID NO: 38806 - DNA, 18 bp, Artificial Sequence
  Synthetic DNA
tattacctttcataattg

SEQ ID NO: 38807 - DNA, 18 bp, Artificial Sequence
  Synthetic DNA
tattgtgactctatacag

SEQ ID NO: 38808 - DNA, 18 bp, Artificial Sequence
  Synthetic DNA
tatttcgtcaatctaaag

SEQ ID NO: 38809 - DNA, 18 bp, Artificial Sequence
  Synthetic DNA
tcctgtgactcatactag

SEQ ID NO: 38810 - DNA, 18 bp, Artificial Sequence
  Synthetic DNA
tcgtacgacacaccattg

SEQ ID NO: 38811 - DNA, 18 bp, Artificial Sequence
  Synthetic DNA
tcttagtactcacataag

SEQ ID NO: 38812 - DNA, 18 bp, Artificial Sequence
  Synthetic DNA
ttaaagaactcactaaag

SEQ ID NO: 38813 - DNA, 18 bp, Artificial Sequence
  Synthetic DNA
ttaagcgactcgctttag

SEQ ID NO: 38814 - DNA, 18 bp, Artificial Sequence
  Synthetic DNA
ttacacgatccacgatag

SEQ ID NO: 38815 - DNA, 18 bp, Artificial Sequence
  Synthetic DNA
ttataagtatcactattg

SEQ ID NO: 38816 - DNA, 18 bp, Artificial Sequence
  Synthetic DNA
ttatacttctaactagag

SEQ ID NO: 38817 - DNA, 18 bp, Artificial Sequence
  Synthetic DNA
ttattggactcacttaag

SEQ ID NO: 38818 - DNA, 18 bp, Artificial Sequence
  Synthetic DNA
ttatttgggccactattg

SEQ ID NO: 38819 - DNA, 18 bp, Artificial Sequence
  Synthetic DNA
tttatagtctcactgaag

SEQ ID NO: 38820 - DNA, 18 bp, Artificial Sequence
  Synthetic DNA
aaaaacctcaccctaagg

SEQ ID NO: 38821 - DNA, 18 bp, Artificial Sequence
  Synthetic DNA
aaaaacgagtcactaatg

SEQ ID NO: 38822 - DNA, 18 bp, Artificial Sequence
  Synthetic DNA
aaaaactactcaccgtag

SEQ ID NO: 38823 - DNA, 18 bp, Artificial Sequence
  Synthetic DNA
aaacacgactaacgattg

SEQ ID NO: 38824 - DNA, 18 bp, Artificial Sequence
  Synthetic DNA
aaacattattcactattg

SEQ ID NO: 38825 - DNA, 18 bp, Artificial Sequence
  Synthetic DNA
aaacctgcctcactagag

SEQ ID NO: 38826 - DNA, 18 bp, Artificial Sequence
  Synthetic DNA
aaactcatctcactatag

SEQ ID NO: 38827 - DNA, 18 bp, Artificial Sequence
  Synthetic DNA
aaatacaattcacaacag

SEQ ID NO: 38828 - DNA, 18 bp, Artificial Sequence
  Synthetic DNA
aaatacctctagctacag

SEQ ID NO: 38829 - DNA, 18 bp, Artificial Sequence
  Synthetic DNA
aaatacgatacaaagttg

SEQ ID NO: 38830 - DNA, 18 bp, Artificial Sequence
  Synthetic DNA
aaatactactctctactg

SEQ ID NO: 38831 - DNA, 18 bp, Artificial Sequence
  Synthetic DNA
aaatactagtgcttatag

SEQ ID NO: 38832 - DNA, 18 bp, Artificial Sequence
  Synthetic DNA
aaatactatcttcaatag

SEQ ID NO: 38833 - DNA, 18 bp, Artificial Sequence
  Synthetic DNA
aaatagatgtcaatttcg

SEQ ID NO: 38834 - DNA, 18 bp, Artificial Sequence
  Synthetic DNA
aaatagcactaactctcg

SEQ ID NO: 38835 - DNA, 18 bp, Artificial Sequence
  Synthetic DNA
aaatatgacccacttcag

SEQ ID NO: 38836 - DNA, 18 bp, Artificial Sequence
  Synthetic DNA
aaatatgtcactccacag

SEQ ID NO: 38837 - DNA, 18 bp, Artificial Sequence
  Synthetic DNA
aaatatgtttttcaatgg

SEQ ID NO: 38838 - DNA, 18 bp, Artificial Sequence
  Synthetic DNA
aaatccttcacactatcg

SEQ ID NO: 38839 - DNA, 18 bp, Artificial Sequence
  Synthetic DNA
aaatgccattctatctag

SEQ ID NO: 38840 - DNA, 18 bp, Artificial Sequence
  Synthetic DNA
aaattcgagacccaatcg

SEQ ID NO: 38841 - DNA, 18 bp, Artificial Sequence
  Synthetic DNA
aaatttgagtctatatag

SEQ ID NO: 38842 - DNA, 18 bp, Artificial Sequence
  Synthetic DNA
aacggcgtcttaccaaag

SEQ ID NO: 38843 - DNA, 18 bp, Artificial Sequence
  Synthetic DNA
aacttccactcatttacg

SEQ ID NO: 38844 - DNA, 18 bp, Artificial Sequence
  Synthetic DNA
aagtatgactctctacag

SEQ ID NO: 38845 - DNA, 18 bp, Artificial Sequence
  Synthetic DNA
aagttcacctctctacag

SEQ ID NO: 38846 - DNA, 18 bp, Artificial Sequence
  Synthetic DNA
aatagcgacatactattg

SEQ ID NO: 38847 - DNA, 18 bp, Artificial Sequence
  Synthetic DNA
aataggcactcactaaag

SEQ ID NO: 38848 - DNA, 18 bp, Artificial Sequence
  Synthetic DNA
aatatggacacaatatag

SEQ ID NO: 38849 - DNA, 18 bp, Artificial Sequence
  Synthetic DNA
aattacgactagctattg

SEQ ID NO: 38850 - DNA, 18 bp, Artificial Sequence
  Synthetic DNA
aattacgagacacaaaag

SEQ ID NO: 38851 - DNA, 18 bp, Artificial Sequence
  Synthetic DNA
aattacgcctcgctaaag

SEQ ID NO: 38852 - DNA, 18 bp, Artificial Sequence
  Synthetic DNA
aattacgtcttaccgtag

SEQ ID NO: 38853 - DNA, 18 bp, Artificial Sequence
  Synthetic DNA
aattacttcccacttttg

SEQ ID NO: 38854 - DNA, 18 bp, Artificial Sequence
  Synthetic DNA
aattatgacttactttag

SEQ ID NO: 38855 - DNA, 18 bp, Artificial Sequence
  Synthetic DNA
aattattcctcactattg

SEQ ID NO: 38856 - DNA, 18 bp, Artificial Sequence
  Synthetic DNA
aattccgacgcacattag

SEQ ID NO: 38857 - DNA, 18 bp, Artificial Sequence
  Synthetic DNA
aatttcgaattaatatag

SEQ ID NO: 38858 - DNA, 18 bp, Artificial Sequence
  Synthetic DNA
acaaacgattcactaaaa

SEQ ID NO: 38859 - DNA, 18 bp, Artificial Sequence
  Synthetic DNA
acaaccgcctaactatag

SEQ ID NO: 38860 - DNA, 18 bp, Artificial Sequence
  Synthetic DNA
acacaagattctatatag

SEQ ID NO: 38861 - DNA, 18 bp, Artificial Sequence
  Synthetic DNA
acactccactcatcaaag

SEQ ID NO: 38862 - DNA, 18 bp, Artificial Sequence
  Synthetic DNA
acatatttctaactttag

SEQ ID NO: 38863 - DNA, 18 bp, Artificial Sequence
  Synthetic DNA
acctacttctaactatag

SEQ ID NO: 38864 - DNA, 18 bp, Artificial Sequence
  Synthetic DNA
acttaagactcaccaaag

SEQ ID NO: 38865 - DNA, 18 bp, Artificial Sequence
  Synthetic DNA
actttcgtctcactattg

SEQ ID NO: 38866 - DNA, 18 bp, Artificial Sequence
  Synthetic DNA
agaaacatctcactatag

SEQ ID NO: 38867 - DNA, 18 bp, Artificial Sequence
  Synthetic DNA
agagatgactcacttgag

SEQ ID NO: 38868 - DNA, 18 bp, Artificial Sequence
  Synthetic DNA
agatacggctaactattg

SEQ ID NO: 38869 - DNA, 18 bp, Artificial Sequence
  Synthetic DNA
agtaccgattctctatag

SEQ ID NO: 38870 - DNA, 18 bp, Artificial Sequence
  Synthetic DNA
agtttcgactaactattg

SEQ ID NO: 38871 - DNA, 18 bp, Artificial Sequence
  Synthetic DNA
ataaaggcctaactaaag

SEQ ID NO: 38872 - DNA, 18 bp, Artificial Sequence
  Synthetic DNA
ataagctacacactttag

SEQ ID NO: 38873 - DNA, 18 bp, Artificial Sequence
  Synthetic DNA
ataatcgtcgccctttag

SEQ ID NO: 38874 - DNA, 18 bp, Artificial Sequence
  Synthetic DNA
atatacgactaaccgttg

SEQ ID NO: 38875 - DNA, 18 bp, Artificial Sequence
  Synthetic DNA
atatacgactttctaaag

SEQ ID NO: 38876 - DNA, 18 bp, Artificial Sequence
  Synthetic DNA
atatgctactaactaatg

SEQ ID NO: 38877 - DNA, 18 bp, Artificial Sequence
  Synthetic DNA
atattcaactcgctatag

SEQ ID NO: 38878 - DNA, 18 bp, Artificial Sequence
  Synthetic DNA
atattctactcacattag

SEQ ID NO: 38879 - DNA, 18 bp, Artificial Sequence
  Synthetic DNA
atgatggatagaataatg

SEQ ID NO: 38880 - DNA, 18 bp, Artificial Sequence
  Synthetic DNA
atgttccactcactattg

SEQ ID NO: 38881 - DNA, 18 bp, Artificial Sequence
  Synthetic DNA
atttgcgactcagtaaag

SEQ ID NO: 38882 - DNA, 18 bp, Artificial Sequence
  Synthetic DNA
caaaattacacataatag

SEQ ID NO: 38883 - DNA, 18 bp, Artificial Sequence
  Synthetic DNA
caacacgattcagtattg

SEQ ID NO: 38884 - DNA, 18 bp, Artificial Sequence
  Synthetic DNA
caataagactaaccacag

SEQ ID NO: 38885 - DNA, 18 bp, Artificial Sequence
  Synthetic DNA
caatacactacacaatag

SEQ ID NO: 38886 - DNA, 18 bp, Artificial Sequence
  Synthetic DNA
caatacgatagactaaag

SEQ ID NO: 38887 - DNA, 18 bp, Artificial Sequence
  Synthetic DNA
caatacgatatattatag

SEQ ID NO: 38888 - DNA, 18 bp, Artificial Sequence
  Synthetic DNA
caatgcttgctactatag

SEQ ID NO: 38889 - DNA, 18 bp, Artificial Sequence
  Synthetic DNA
cagaaagactcattgtag

SEQ ID NO: 38890 - DNA, 18 bp, Artificial Sequence
  Synthetic DNA
cattaccttgtacaatgg

SEQ ID NO: 38891 - DNA, 18 bp, Artificial Sequence
  Synthetic DNA
cattacgtctcattgttg

SEQ ID NO: 38892 - DNA, 18 bp, Artificial Sequence
  Synthetic DNA
cattatgactcttcaaag

SEQ ID NO: 38893 - DNA, 18 bp, Artificial Sequence
  Synthetic DNA
ccacacaactctctaaag

SEQ ID NO: 38894 - DNA, 18 bp, Artificial Sequence
  Synthetic DNA
ccattcaactcattacag

SEQ ID NO: 38895 - DNA, 18 bp, Artificial Sequence
  Synthetic DNA
cccaaatactcaccacag

SEQ ID NO: 38896 - DNA, 18 bp, Artificial Sequence
  Synthetic DNA
ctaaacgcctcacgttag

SEQ ID NO: 38897 - DNA, 18 bp, Artificial Sequence
  Synthetic DNA
ctacacgactatttagag

SEQ ID NO: 38898 - DNA, 18 bp, Artificial Sequence
  Synthetic DNA
ctagatgacccactaaag

SEQ ID NO: 38899 - DNA, 18 bp, Artificial Sequence
  Synthetic DNA
ctatacgacactctatcg

SEQ ID NO: 38900 - DNA, 18 bp, Artificial Sequence
  Synthetic DNA
ctatacggctcagcatag

SEQ ID NO: 38901 - DNA, 18 bp, Artificial Sequence
  Synthetic DNA
ctatctaactcacttcag

SEQ ID NO: 38902 - DNA, 18 bp, Artificial Sequence
  Synthetic DNA
ctatgctacacactatag

SEQ ID NO: 38903 - DNA, 18 bp, Artificial Sequence
  Synthetic DNA
ctatgcttctctgtgtag

SEQ ID NO: 38904 - DNA, 18 bp, Artificial Sequence
  Synthetic DNA
cttggcgactaactactg

SEQ ID NO: 38905 - DNA, 18 bp, Artificial Sequence
  Synthetic DNA
gaaagcgacttgatatag

SEQ ID NO: 38906 - DNA, 18 bp, Artificial Sequence
  Synthetic DNA
gaactcgagtcacggtag

SEQ ID NO: 38907 - DNA, 18 bp, Artificial Sequence
  Synthetic DNA
gaatattatccgctatag

SEQ ID NO: 38908 - DNA, 18 bp, Artificial Sequence
  Synthetic DNA
gaattcgccactttgtag

SEQ ID NO: 38909 - DNA, 18 bp, Artificial Sequence
  Synthetic DNA
gattaagtttcgctaacg

SEQ ID NO: 38910 - DNA, 18 bp, Artificial Sequence
  Synthetic DNA
gattacgtcaccctttag

SEQ ID NO: 38911 - DNA, 18 bp, Artificial Sequence
  Synthetic DNA
ggatatgactctatattg

SEQ ID NO: 38912 - DNA, 18 bp, Artificial Sequence
  Synthetic DNA
taaaaagattttctattg

SEQ ID NO: 38913 - DNA, 18 bp, Artificial Sequence
  Synthetic DNA
taaaacctctgacaaaag

SEQ ID NO: 38914 - DNA, 18 bp, Artificial Sequence
  Synthetic DNA
taaaacgatatacaatag

SEQ ID NO: 38915 - DNA, 18 bp, Artificial Sequence
  Synthetic DNA
taaaacgattcacaaccg

SEQ ID NO: 38916 - DNA, 18 bp, Artificial Sequence
  Synthetic DNA
taaaacgtcacacactag

SEQ ID NO: 38917 - DNA, 18 bp, Artificial Sequence
  Synthetic DNA
taaaacgtttcactttcg

SEQ ID NO: 38918 - DNA, 18 bp, Artificial Sequence
  Synthetic DNA
taaaactactcagcattg

SEQ ID NO: 38919 - DNA, 18 bp, Artificial Sequence
  Synthetic DNA
taaaaggaagtactttag

SEQ ID NO: 38920 - DNA, 18 bp, Artificial Sequence
  Synthetic DNA
taaaaggacacaaaatag

SEQ ID NO: 38921 - DNA, 18 bp, Artificial Sequence
  Synthetic DNA
taaaatgaagcagtttag

SEQ ID NO: 38922 - DNA, 18 bp, Artificial Sequence
  Synthetic DNA
taaaatgtcttactattg

SEQ ID NO: 38923 - DNA, 18 bp, Artificial Sequence
  Synthetic DNA
taaaatgtttaaatgtag

SEQ ID NO: 38924 - DNA, 18 bp, Artificial Sequence
  Synthetic DNA
taaaattcctcatttttg

SEQ ID NO: 38925 - DNA, 18 bp, Artificial Sequence
  Synthetic DNA
taaaccttctaacttttg

SEQ ID NO: 38926 - DNA, 18 bp, Artificial Sequence
  Synthetic DNA
taaagagactgactattg

SEQ ID NO: 38927 - DNA, 18 bp, Artificial Sequence
  Synthetic DNA
taaatgtactgaatattg

SEQ ID NO: 38928 - DNA, 18 bp, Artificial Sequence
  Synthetic DNA
taaattgactcacactag

SEQ ID NO: 38929 - DNA, 18 bp, Artificial Sequence
  Synthetic DNA
taacaatactagcaaaag

SEQ ID NO: 38930 - DNA, 18 bp, Artificial Sequence
  Synthetic DNA
taacacgcttctctacag

SEQ ID NO: 38931 - DNA, 18 bp, Artificial Sequence
  Synthetic DNA
taacactactctccaaag

SEQ ID NO: 38932 - DNA, 18 bp, Artificial Sequence
  Synthetic DNA
taacactatttcctacag

SEQ ID NO: 38933 - DNA, 18 bp, Artificial Sequence
  Synthetic DNA
taacgcgactctttttag

SEQ ID NO: 38934 - DNA, 18 bp, Artificial Sequence
  Synthetic DNA
taataaaactccctcgag

SEQ ID NO: 38935 - DNA, 18 bp, Artificial Sequence
  Synthetic DNA
taatacatctcttttttg

SEQ ID NO: 38936 - DNA, 18 bp, Artificial Sequence
  Synthetic DNA
taataccactgtctaatg

SEQ ID NO: 38937 - DNA, 18 bp, Artificial Sequence
  Synthetic DNA
taataccgctacgtttcg

SEQ ID NO: 38938 - DNA, 18 bp, Artificial Sequence
  Synthetic DNA
taatacctcttacaattg

SEQ ID NO: 38939 - DNA, 18 bp, Artificial Sequence
  Synthetic DNA
taatacgaatgccttttg

SEQ ID NO: 38940 - DNA, 18 bp, Artificial Sequence
  Synthetic DNA
taatacgagactgcatag

SEQ ID NO: 38941 - DNA, 18 bp, Artificial Sequence
  Synthetic DNA
taatacgataccataaag

SEQ ID NO: 38942 - DNA, 18 bp, Artificial Sequence
  Synthetic DNA
taatacgatagccaattg

SEQ ID NO: 38943 - DNA, 18 bp, Artificial Sequence
  Synthetic DNA
taatacgatagtccgaag

SEQ ID NO: 38944 - DNA, 18 bp, Artificial Sequence
  Synthetic DNA
taatacggcagacatttg

SEQ ID NO: 38945 - DNA, 18 bp, Artificial Sequence
  Synthetic DNA
taatacggctacgtttag

SEQ ID NO: 38946 - DNA, 18 bp, Artificial Sequence
  Synthetic DNA
taatacttcctagtaatg

SEQ ID NO: 38947 - DNA, 18 bp, Artificial Sequence
  Synthetic DNA
taatatatctcaagattg

SEQ ID NO: 38948 - DNA, 18 bp, Artificial Sequence
  Synthetic DNA
taatatgacacaagacag

SEQ ID NO: 38949 - DNA, 18 bp, Artificial Sequence
  Synthetic DNA
taatatgactaataatgg

SEQ ID NO: 38950 - DNA, 18 bp, Artificial Sequence
  Synthetic DNA
taatatgactcagttatg

SEQ ID NO: 38951 - DNA, 18 bp, Artificial Sequence
  Synthetic DNA
taatattacacagtaaag

SEQ ID NO: 38952 - DNA, 18 bp, Artificial Sequence
  Synthetic DNA
taatattactaaaaatag

SEQ ID NO: 38953 - DNA, 18 bp, Artificial Sequence
  Synthetic DNA
taatcagactcacataag

SEQ ID NO: 38954 - DNA, 18 bp, Artificial Sequence
  Synthetic DNA
taatccgactctgaattg

SEQ ID NO: 38955 - DNA, 18 bp, Artificial Sequence
  Synthetic DNA
taatccgccataccgtcg

SEQ ID NO: 38956 - DNA, 18 bp, Artificial Sequence
  Synthetic DNA
taatccgtccctctatcg

SEQ ID NO: 38957 - DNA, 18 bp, Artificial Sequence
  Synthetic DNA
taatcgaagacactatgg

SEQ ID NO: 38958 - DNA, 18 bp, Artificial Sequence
  Synthetic DNA
taatgaaactaacaatag

SEQ ID NO: 38959 - DNA, 18 bp, Artificial Sequence
  Synthetic DNA
taatgagaatcattagag

SEQ ID NO: 38960 - DNA, 18 bp, Artificial Sequence
  Synthetic DNA
taatgcaacacagtattg

SEQ ID NO: 38961 - DNA, 18 bp, Artificial Sequence
  Synthetic DNA
taatgcgacccagaacgg

SEQ ID NO: 38962 - DNA, 18 bp, Artificial Sequence
  Synthetic DNA
taattaaattaactatag

SEQ ID NO: 38963 - DNA, 18 bp, Artificial Sequence
  Synthetic DNA
taattagactcgttattg

SEQ ID NO: 38964 - DNA, 18 bp, Artificial Sequence
  Synthetic DNA
taattagacttaatttag

SEQ ID NO: 38965 - DNA, 18 bp, Artificial Sequence
  Synthetic DNA
taattcaccttactattg

SEQ ID NO: 38966 - DNA, 18 bp, Artificial Sequence
  Synthetic DNA
taattcgaccctctttcg

SEQ ID NO: 38967 - DNA, 18 bp, Artificial Sequence
  Synthetic DNA
taattcgactcgcgctcg

SEQ ID NO: 38968 - DNA, 18 bp, Artificial Sequence
  Synthetic DNA
taattcgagtcctaatag

SEQ ID NO: 38969 - DNA, 18 bp, Artificial Sequence
  Synthetic DNA
taattcgtcagatttgag

SEQ ID NO: 38970 - DNA, 18 bp, Artificial Sequence
  Synthetic DNA
taattcgtctcgataaag

SEQ ID NO: 38971 - DNA, 18 bp, Artificial Sequence
  Synthetic DNA
taattctcctcactactg

SEQ ID NO: 38972 - DNA, 18 bp, Artificial Sequence
  Synthetic DNA
taattttacccactctag

SEQ ID NO: 38973 - DNA, 18 bp, Artificial Sequence
  Synthetic DNA
tacaacaaatcaacatag

SEQ ID NO: 38974 - DNA, 18 bp, Artificial Sequence
  Synthetic DNA
tacaacgccttacattag

SEQ ID NO: 38975 - DNA, 18 bp, Artificial Sequence
  Synthetic DNA
tacaaggtctccctatag

SEQ ID NO: 38976 - DNA, 18 bp, Artificial Sequence
  Synthetic DNA
tacacagactcagtatag

SEQ ID NO: 38977 - DNA, 18 bp, Artificial Sequence
  Synthetic DNA
tacagcgccacataattg

SEQ ID NO: 38978 - DNA, 18 bp, Artificial Sequence
  Synthetic DNA
taccacggctgccttccg

SEQ ID NO: 38979 - DNA, 18 bp, Artificial Sequence
  Synthetic DNA
tactacatctcaccaaag

SEQ ID NO: 38980 - DNA, 18 bp, Artificial Sequence
  Synthetic DNA
tactacgattaatcatcg

SEQ ID NO: 38981 - DNA, 18 bp, Artificial Sequence
  Synthetic DNA
tactactacttcatatag

SEQ ID NO: 38982 - DNA, 18 bp, Artificial Sequence
  Synthetic DNA
tactgcgactcacttagg

SEQ ID NO: 38983 - DNA, 18 bp, Artificial Sequence
  Synthetic DNA
tactttgactcactccag

SEQ ID NO: 38984 - DNA, 18 bp, Artificial Sequence
  Synthetic DNA
tagaaagtgtcaccattg

SEQ ID NO: 38985 - DNA, 18 bp, Artificial Sequence
  Synthetic DNA
tagaacgactcgatgtag

SEQ ID NO: 38986 - DNA, 18 bp, Artificial Sequence
  Synthetic DNA
tagaacgtctctctgggg

SEQ ID NO: 38987 - DNA, 18 bp, Artificial Sequence
  Synthetic DNA
tagagtgactcagtttgg

SEQ ID NO: 38988 - DNA, 18 bp, Artificial Sequence
  Synthetic DNA
taggcctattcaattttg

SEQ ID NO: 38989 - DNA, 18 bp, Artificial Sequence
  Synthetic DNA
tagtacatcacacgatag

SEQ ID NO: 38990 - DNA, 18 bp, Artificial Sequence
  Synthetic DNA
tagtacgactcaaataag

SEQ ID NO: 38991 - DNA, 18 bp, Artificial Sequence
  Synthetic DNA
tagtacgtataactgacg

SEQ ID NO: 38992 - DNA, 18 bp, Artificial Sequence
  Synthetic DNA
tagtacgtgacactttag

SEQ ID NO: 38993 - DNA, 18 bp, Artificial Sequence
  Synthetic DNA
tataaccagtctcaatag

SEQ ID NO: 38994 - DNA, 18 bp, Artificial Sequence
  Synthetic DNA
tataacggcacaatctag

SEQ ID NO: 38995 - DNA, 18 bp, Artificial Sequence
  Synthetic DNA
tataccgcctaactatgg

SEQ ID NO: 38996 - DNA, 18 bp, Artificial Sequence
  Synthetic DNA
tatatcataccactgtcg

SEQ ID NO: 38997 - DNA, 18 bp, Artificial Sequence
  Synthetic DNA
tatcacgatacaatatgg

SEQ ID NO: 38998 - DNA, 18 bp, Artificial Sequence
  Synthetic DNA
tatcacgtgtcagtatag

SEQ ID NO: 38999 - DNA, 18 bp, Artificial Sequence
  Synthetic DNA
tatgaccattctctatag

SEQ ID NO: 39000 - DNA, 18 bp, Artificial Sequence
  Synthetic DNA
tattaatagtcacgttag

SEQ ID NO: 39001 - DNA, 18 bp, Artificial Sequence
  Synthetic DNA
tattacaacttactaacg

SEQ ID NO: 39002 - DNA, 18 bp, Artificial Sequence
  Synthetic DNA
tattacgctaccccatag

SEQ ID NO: 39003 - DNA, 18 bp, Artificial Sequence
  Synthetic DNA
tattactaccgactttag

SEQ ID NO: 39004 - DNA, 18 bp, Artificial Sequence
  Synthetic DNA
tattacttatcattcaag

SEQ ID NO: 39005 - DNA, 18 bp, Artificial Sequence
  Synthetic DNA
tattcggactcgctattg

SEQ ID NO: 39006 - DNA, 18 bp, Artificial Sequence
  Synthetic DNA
tattgcggctcactgcag

SEQ ID NO: 39007 - DNA, 18 bp, Artificial Sequence
  Synthetic DNA
tattgcgtcactctatag

SEQ ID NO: 39008 - DNA, 18 bp, Artificial Sequence
  Synthetic DNA
tatttagacctactattg

SEQ ID NO: 39009 - DNA, 18 bp, Artificial Sequence
  Synthetic DNA
tatttccactgacaatag

SEQ ID NO: 39010 - DNA, 18 bp, Artificial Sequence
  Synthetic DNA
tatttcgaatcgatatag

SEQ ID NO: 39011 - DNA, 18 bp, Artificial Sequence
  Synthetic DNA
tatttcgagccaccttag

SEQ ID NO: 39012 - DNA, 18 bp, Artificial Sequence
  Synthetic DNA
tatttcgattgataattg

SEQ ID NO: 39013 - DNA, 18 bp, Artificial Sequence
  Synthetic DNA
tatttctacacataacag

SEQ ID NO: 39014 - DNA, 18 bp, Artificial Sequence
  Synthetic DNA
tcaaacgtctcaatattg

SEQ ID NO: 39015 - DNA, 18 bp, Artificial Sequence
  Synthetic DNA
tcaaactactcacaattg

SEQ ID NO: 39016 - DNA, 18 bp, Artificial Sequence
  Synthetic DNA
tcaaaggtttcactatag

SEQ ID NO: 39017 - DNA, 18 bp, Artificial Sequence
  Synthetic DNA
tcaaatgagtcattatag

SEQ ID NO: 39018 - DNA, 18 bp, Artificial Sequence
  Synthetic DNA
tcaaatgattaactagag

SEQ ID NO: 39019 - DNA, 18 bp, Artificial Sequence
  Synthetic DNA
tcaagtgactcacaaaag

SEQ ID NO: 39020 - DNA, 18 bp, Artificial Sequence
  Synthetic DNA
tcaatctattcaccaaag

SEQ ID NO: 39021 - DNA, 18 bp, Artificial Sequence
  Synthetic DNA
tcaatggacacactttag

SEQ ID NO: 39022 - DNA, 18 bp, Artificial Sequence
  Synthetic DNA
tcataagactagtttatg

SEQ ID NO: 39023 - DNA, 18 bp, Artificial Sequence
  Synthetic DNA
tcataaggcacttcgaag

SEQ ID NO: 39024 - DNA, 18 bp, Artificial Sequence
  Synthetic DNA
tcataattctaactattg

SEQ ID NO: 39025 - DNA, 18 bp, Artificial Sequence
  Synthetic DNA
tcgaacgtatcactatag

SEQ ID NO: 39026 - DNA, 18 bp, Artificial Sequence
  Synthetic DNA
tcgtatcactaacaatag

SEQ ID NO: 39027 - DNA, 18 bp, Artificial Sequence
  Synthetic DNA
tctaacggctctctaaag

SEQ ID NO: 39028 - DNA, 18 bp, Artificial Sequence
  Synthetic DNA
tctttcgtctctctatag

SEQ ID NO: 39029 - DNA, 18 bp, Artificial Sequence
  Synthetic DNA
tgaaacgacccacactag

SEQ ID NO: 39030 - DNA, 18 bp, Artificial Sequence
  Synthetic DNA
tgaattgtctcactaaag

SEQ ID NO: 39031 - DNA, 18 bp, Artificial Sequence
  Synthetic DNA
tgataccaatcataattg

SEQ ID NO: 39032 - DNA, 18 bp, Artificial Sequence
  Synthetic DNA
tgatacgtccgacttaag

SEQ ID NO: 39033 - DNA, 18 bp, Artificial Sequence
  Synthetic DNA
tgatataactcattatcg

SEQ ID NO: 39034 - DNA, 18 bp, Artificial Sequence
  Synthetic DNA
tgatataattcacattag

SEQ ID NO: 39035 - DNA, 18 bp, Artificial Sequence
  Synthetic DNA
tgatatctcaaattatag

SEQ ID NO: 39036 - DNA, 18 bp, Artificial Sequence
  Synthetic DNA
tgatatgactctcaattg

SEQ ID NO: 39037 - DNA, 18 bp, Artificial Sequence
  Synthetic DNA
tgattcgagtcaccgaag

SEQ ID NO: 39038 - DNA, 18 bp, Artificial Sequence
  Synthetic DNA
tgttattattatcagtag

SEQ ID NO: 39039 - DNA, 18 bp, Artificial Sequence
  Synthetic DNA
ttaaacgcattattatag

SEQ ID NO: 39040 - DNA, 18 bp, Artificial Sequence
  Synthetic DNA
ttaaatgacaaattctag

SEQ ID NO: 39041 - DNA, 18 bp, Artificial Sequence
  Synthetic DNA
ttaaccgactcattattg

SEQ ID NO: 39042 - DNA, 18 bp, Artificial Sequence
  Synthetic DNA
ttaatagtctcactcatg

SEQ ID NO: 39043 - DNA, 18 bp, Artificial Sequence
  Synthetic DNA
ttaatcgattaactttcg

SEQ ID NO: 39044 - DNA, 18 bp, Artificial Sequence
  Synthetic DNA
ttaattgattctctattg

SEQ ID NO: 39045 - DNA, 18 bp, Artificial Sequence
  Synthetic DNA
ttacacatttcattaaag

SEQ ID NO: 39046 - DNA, 18 bp, Artificial Sequence
  Synthetic DNA
ttacacgagtctcaatag

SEQ ID NO: 39047 - DNA, 18 bp, Artificial Sequence
  Synthetic DNA
ttacacgtatttctattg

SEQ ID NO: 39048 - DNA, 18 bp, Artificial Sequence
  Synthetic DNA
ttacaggaccctctatcg

SEQ ID NO: 39049 - DNA, 18 bp, Artificial Sequence
  Synthetic DNA
ttacaggatccactcaag

SEQ ID NO: 39050 - DNA, 18 bp, Artificial Sequence
  Synthetic DNA
ttacgcgattcaatatag

SEQ ID NO: 39051 - DNA, 18 bp, Artificial Sequence
  Synthetic DNA
ttactctagttatcttag

SEQ ID NO: 39052 - DNA, 18 bp, Artificial Sequence
  Synthetic DNA
ttagaccgctaaaaatag

SEQ ID NO: 39053 - DNA, 18 bp, Artificial Sequence
  Synthetic DNA
ttagacggcagactttag

SEQ ID NO: 39054 - DNA, 18 bp, Artificial Sequence
  Synthetic DNA
ttagattactcacaatag

SEQ ID NO: 39055 - DNA, 18 bp, Artificial Sequence
  Synthetic DNA
ttataaaactcactgaag

SEQ ID NO: 39056 - DNA, 18 bp, Artificial Sequence
  Synthetic DNA
ttataagtaacacaatag

SEQ ID NO: 39057 - DNA, 18 bp, Artificial Sequence
  Synthetic DNA
ttataagtttccctatag

SEQ ID NO: 39058 - DNA, 18 bp, Artificial Sequence
  Synthetic DNA
ttataatactcgctattg

SEQ ID NO: 39059 - DNA, 18 bp, Artificial Sequence
  Synthetic DNA
ttataatactgtctatag

SEQ ID NO: 39060 - DNA, 18 bp, Artificial Sequence
  Synthetic DNA
ttatacagcacacattag

SEQ ID NO: 39061 - DNA, 18 bp, Artificial Sequence
  Synthetic DNA
ttataccaattatcatag

SEQ ID NO: 39062 - DNA, 18 bp, Artificial Sequence
  Synthetic DNA
ttataccattgtcaatag

SEQ ID NO: 39063 - DNA, 18 bp, Artificial Sequence
  Synthetic DNA
ttatacgacacaccacgg

SEQ ID NO: 39064 - DNA, 18 bp, Artificial Sequence
  Synthetic DNA
ttatacgacgctcaaaag

SEQ ID NO: 39065 - DNA, 18 bp, Artificial Sequence
  Synthetic DNA
ttatacggaacactatcg

SEQ ID NO: 39066 - DNA, 18 bp, Artificial Sequence
  Synthetic DNA
ttatacggttacccatag

SEQ ID NO: 39067 - DNA, 18 bp, Artificial Sequence
  Synthetic DNA
ttatacgtactagtatag

SEQ ID NO: 39068 - DNA, 18 bp, Artificial Sequence
  Synthetic DNA
ttatacgtctcgctgaag

SEQ ID NO: 39069 - DNA, 18 bp, Artificial Sequence
  Synthetic DNA
ttatactactaacaatgg

SEQ ID NO: 39070 - DNA, 18 bp, Artificial Sequence
  Synthetic DNA
ttatactattctactttg

SEQ ID NO: 39071 - DNA, 18 bp, Artificial Sequence
  Synthetic DNA
ttatagctctcagtatag

SEQ ID NO: 39072 - DNA, 18 bp, Artificial Sequence
  Synthetic DNA
ttatagttctctctattg

SEQ ID NO: 39073 - DNA, 18 bp, Artificial Sequence
  Synthetic DNA
ttatataactctattttg

SEQ ID NO: 39074 - DNA, 18 bp, Artificial Sequence
  Synthetic DNA
ttatcccaatctcgacag

SEQ ID NO: 39075 - DNA, 18 bp, Artificial Sequence
  Synthetic DNA
ttatcgaaatctctatag

SEQ ID NO: 39076 - DNA, 18 bp, Artificial Sequence
  Synthetic DNA
ttatgacactcgaaatag

SEQ ID NO: 39077 - DNA, 18 bp, Artificial Sequence
  Synthetic DNA
ttatgcaactcgctaaag

SEQ ID NO: 39078 - DNA, 18 bp, Artificial Sequence
  Synthetic DNA
ttatgcatcacactatag

SEQ ID NO: 39079 - DNA, 18 bp, Artificial Sequence
  Synthetic DNA
ttatgcgacaatacattg

SEQ ID NO: 39080 - DNA, 18 bp, Artificial Sequence
  Synthetic DNA
ttattccattgactatag

SEQ ID NO: 39081 - DNA, 18 bp, Artificial Sequence
  Synthetic DNA
ttattcgattaactaatg

SEQ ID NO: 39082 - DNA, 18 bp, Artificial Sequence
  Synthetic DNA
ttattcgtttgactatcg

SEQ ID NO: 39083 - DNA, 18 bp, Artificial Sequence
  Synthetic DNA
ttattctaatcgcaaaag

SEQ ID NO: 39084 - DNA, 18 bp, Artificial Sequence
  Synthetic DNA
ttcaataacccattaaag

SEQ ID NO: 39085 - DNA, 18 bp, Artificial Sequence
  Synthetic DNA
ttcgaccactcacgtgtg

SEQ ID NO: 39086 - DNA, 18 bp, Artificial Sequence
  Synthetic DNA
ttctatgagacactacag

SEQ ID NO: 39087 - DNA, 18 bp, Artificial Sequence
  Synthetic DNA
ttctatgtctcacttttg

SEQ ID NO: 39088 - DNA, 18 bp, Artificial Sequence
  Synthetic DNA
ttgaacggcgcacttctg

SEQ ID NO: 39089 - DNA, 18 bp, Artificial Sequence
  Synthetic DNA
ttgaatgactcacaatag

SEQ ID NO: 39090 - DNA, 18 bp, Artificial Sequence
  Synthetic DNA
ttgtacgacacaatgtag

SEQ ID NO: 39091 - DNA, 18 bp, Artificial Sequence
  Synthetic DNA
ttgttcaacacactttag

SEQ ID NO: 39092 - DNA, 18 bp, Artificial Sequence
  Synthetic DNA
ttgttctagtcacttagg

SEQ ID NO: 39093 - DNA, 18 bp, Artificial Sequence
  Synthetic DNA
tttaacaactcacaaaag

SEQ ID NO: 39094 - DNA, 18 bp, Artificial Sequence
  Synthetic DNA
tttaacggttcactatag

SEQ ID NO: 39095 - DNA, 18 bp, Artificial Sequence
  Synthetic DNA
tttaatgactcactgtag

SEQ ID NO: 39096 - DNA, 18 bp, Artificial Sequence
  Synthetic DNA
ttttaagactcacagtag

SEQ ID NO: 39097 - DNA, 18 bp, Artificial Sequence
  Synthetic DNA
ttttacgtctcacaaatg

SEQ ID NO: 39098 - DNA, 18 bp, Artificial Sequence
  Synthetic DNA
ttttaggattcagatccg

SEQ ID NO: 39099 - DNA, 18 bp, Artificial Sequence
  Synthetic DNA
tttttggactcacttttg

SEQ ID NO: 39100 - DNA, 18 bp, Artificial Sequence
  Synthetic DNA
aaaaaagaaacattaaag

SEQ ID NO: 39101 - DNA, 18 bp, Artificial Sequence
  Synthetic DNA
aaaaaagactaactaaag

SEQ ID NO: 39102 - DNA, 18 bp, Artificial Sequence
  Synthetic DNA
aaaaaagacttgctaaag

SEQ ID NO: 39103 - DNA, 18 bp, Artificial Sequence
  Synthetic DNA
aaaaaagactttcaatag

SEQ ID NO: 39104 - DNA, 18 bp, Artificial Sequence
  Synthetic DNA
aaaaaagtctcactctag

SEQ ID NO: 39105 - DNA, 18 bp, Artificial Sequence
  Synthetic DNA
aaaaacaaatcatataag

SEQ ID NO: 39106 - DNA, 18 bp, Artificial Sequence
  Synthetic DNA
aaaaacaacaggcaatag

SEQ ID NO: 39107 - DNA, 18 bp, Artificial Sequence
  Synthetic DNA
aaaaacatcacgctaaag

SEQ ID NO: 39108 - DNA, 18 bp, Artificial Sequence
  Synthetic DNA
aaaaaccactcgttatag

SEQ ID NO: 39109 - DNA, 18 bp, Artificial Sequence
  Synthetic DNA
aaaaaccactcttttaag

SEQ ID NO: 39110 - DNA, 18 bp, Artificial Sequence
  Synthetic DNA
aaaaacgaatcacacaca

SEQ ID NO: 39111 - DNA, 18 bp, Artificial Sequence
  Synthetic DNA
aaaaacgacacaataaag

SEQ ID NO: 39112 - DNA, 18 bp, Artificial Sequence
  Synthetic DNA
aaaaacgacacattgtag

SEQ ID NO: 39113 - DNA, 18 bp, Artificial Sequence
  Synthetic DNA
aaaaacgacaccataagg

SEQ ID NO: 39114 - DNA, 18 bp, Artificial Sequence
  Synthetic DNA
aaaaacgactaacagtcg

SEQ ID NO: 39115 - DNA, 18 bp, Artificial Sequence
  Synthetic DNA
aaaaacgactcacataag

SEQ ID NO: 39116 - DNA, 18 bp, Artificial Sequence
  Synthetic DNA
aaaaacgactcatatatg

SEQ ID NO: 39117 - DNA, 18 bp, Artificial Sequence
  Synthetic DNA
aaaaacgactcctaatag

SEQ ID NO: 39118 - DNA, 18 bp, Artificial Sequence
  Synthetic DNA
aaaaacgactctcaactg

SEQ ID NO: 39119 - DNA, 18 bp, Artificial Sequence
  Synthetic DNA
aaaaacgacttcctttag

SEQ ID NO: 39120 - DNA, 18 bp, Artificial Sequence
  Synthetic DNA
aaaaacgagtctttagag

SEQ ID NO: 39121 - DNA, 18 bp, Artificial Sequence
  Synthetic DNA
aaaaacgatccgcttcag

SEQ ID NO: 39122 - DNA, 18 bp, Artificial Sequence
  Synthetic DNA
aaaaacgcgtctcaatag

SEQ ID NO: 39123 - DNA, 18 bp, Artificial Sequence
  Synthetic DNA
aaaaacggtttactctcg

SEQ ID NO: 39124 - DNA, 18 bp, Artificial Sequence
  Synthetic DNA
aaaaacgtatctcttcag

SEQ ID NO: 39125 - DNA, 18 bp, Artificial Sequence
  Synthetic DNA
aaaaacgtgtgactatag

SEQ ID NO: 39126 - DNA, 18 bp, Artificial Sequence
  Synthetic DNA
aaaaacgtttcaatattg

SEQ ID NO: 39127 - DNA, 18 bp, Artificial Sequence
  Synthetic DNA
aaaaacttctcactatgg

SEQ ID NO: 39128 - DNA, 18 bp, Artificial Sequence
  Synthetic DNA
aaaaaggaacccctattg

SEQ ID NO: 39129 - DNA, 18 bp, Artificial Sequence
  Synthetic DNA
aaaaaggacacactacag

SEQ ID NO: 39130 - DNA, 18 bp, Artificial Sequence
  Synthetic DNA
aaaaaggactcattatcg

SEQ ID NO: 39131 - DNA, 18 bp, Artificial Sequence
  Synthetic DNA
aaaaaggactcgctagag

SEQ ID NO: 39132 - DNA, 18 bp, Artificial Sequence
  Synthetic DNA
aaaaaggactcggaatcg

SEQ ID NO: 39133 - DNA, 18 bp, Artificial Sequence
  Synthetic DNA
aaaaaggatacactatag

SEQ ID NO: 39134 - DNA, 18 bp, Artificial Sequence
  Synthetic DNA
aaaaagtaccgcatatgg

SEQ ID NO: 39135 - DNA, 18 bp, Artificial Sequence
  Synthetic DNA
aaaaatatctcacttcag

SEQ ID NO: 39136 - DNA, 18 bp, Artificial Sequence
  Synthetic DNA
aaaaatcactcttaatag

SEQ ID NO: 39137 - DNA, 18 bp, Artificial Sequence
  Synthetic DNA
aaaaatctcacttaatag

SEQ ID NO: 39138 - DNA, 18 bp, Artificial Sequence
  Synthetic DNA
aaaaatgactaaatatag

SEQ ID NO: 39139 - DNA, 18 bp, Artificial Sequence
  Synthetic DNA
aaaaatgattcactctag

SEQ ID NO: 39140 - DNA, 18 bp, Artificial Sequence
  Synthetic DNA
aaaaattactccctttcg

SEQ ID NO: 39141 - DNA, 18 bp, Artificial Sequence
  Synthetic DNA
aaaacagactgactatag

SEQ ID NO: 39142 - DNA, 18 bp, Artificial Sequence
  Synthetic DNA
aaaaccaactcaatatag

SEQ ID NO: 39143 - DNA, 18 bp, Artificial Sequence
  Synthetic DNA
aaaaccgtcccactaatg

SEQ ID NO: 39144 - DNA, 18 bp, Artificial Sequence
  Synthetic DNA
aaaagcgactccttattg

SEQ ID NO: 39145 - DNA, 18 bp, Artificial Sequence
  Synthetic DNA
aaaagcgcttttcattag

SEQ ID NO: 39146 - DNA, 18 bp, Artificial Sequence
  Synthetic DNA
aaaagttactctctagag

SEQ ID NO: 39147 - DNA, 18 bp, Artificial Sequence
  Synthetic DNA
aaaatccactcaataaag

SEQ ID NO: 39148 - DNA, 18 bp, Artificial Sequence
  Synthetic DNA
aaaatcgactgtcgatag

SEQ ID NO: 39149 - DNA, 18 bp, Artificial Sequence
  Synthetic DNA
aaaatcgagactccatag

SEQ ID NO: 39150 - DNA, 18 bp, Artificial Sequence
  Synthetic DNA
aaaatcgagtcctttcag

SEQ ID NO: 39151 - DNA, 18 bp, Artificial Sequence
  Synthetic DNA
aaaatcgcctgttaatag

SEQ ID NO: 39152 - DNA, 18 bp, Artificial Sequence
  Synthetic DNA
aaaatcggctcactaatg

SEQ ID NO: 39153 - DNA, 18 bp, Artificial Sequence
  Synthetic DNA
aaaatggactcagtatag

SEQ ID NO: 39154 - DNA, 18 bp, Artificial Sequence
  Synthetic DNA
aaaattaactcactatcg

SEQ ID NO: 39155 - DNA, 18 bp, Artificial Sequence
  Synthetic DNA
aaacacaattcacaatag

SEQ ID NO: 39156 - DNA, 18 bp, Artificial Sequence
  Synthetic DNA
aaacacatcacactatag

SEQ ID NO: 39157 - DNA, 18 bp, Artificial Sequence
  Synthetic DNA
aaacacgtaactcaacag

SEQ ID NO: 39158 - DNA, 18 bp, Artificial Sequence
  Synthetic DNA
aaacacgttataatatag

SEQ ID NO: 39159 - DNA, 18 bp, Artificial Sequence
  Synthetic DNA
aaacagtataccatgcag

SEQ ID NO: 39160 - DNA, 18 bp, Artificial Sequence
  Synthetic DNA
aaacatgatacacattag

SEQ ID NO: 39161 - DNA, 18 bp, Artificial Sequence
  Synthetic DNA
aaacatgcatcacaatgg

SEQ ID NO: 39162 - DNA, 18 bp, Artificial Sequence
  Synthetic DNA
aaacgtgaatcactgtag

SEQ ID NO: 39163 - DNA, 18 bp, Artificial Sequence
  Synthetic DNA
aaactcgactgtgcatag

SEQ ID NO: 39164 - DNA, 18 bp, Artificial Sequence
  Synthetic DNA
aaactcttctcactatag

SEQ ID NO: 39165 - DNA, 18 bp, Artificial Sequence
  Synthetic DNA
aaactggtctctctctag

SEQ ID NO: 39166 - DNA, 18 bp, Artificial Sequence
  Synthetic DNA
aaactggtgtaattttag

SEQ ID NO: 39167 - DNA, 18 bp, Artificial Sequence
  Synthetic DNA
aaacttaactcaatatcg

SEQ ID NO: 39168 - DNA, 18 bp, Artificial Sequence
  Synthetic DNA
aaacttgtcacaataatg

SEQ ID NO: 39169 - DNA, 18 bp, Artificial Sequence
  Synthetic DNA
aaagaaccctatctatag

SEQ ID NO: 39170 - DNA, 18 bp, Artificial Sequence
  Synthetic DNA
aaagaagactctcgatag

SEQ ID NO: 39171 - DNA, 18 bp, Artificial Sequence
  Synthetic DNA
aaagaagattcactatcg

SEQ ID NO: 39172 - DNA, 18 bp, Artificial Sequence
  Synthetic DNA
aaagaatagtcactatag

SEQ ID NO: 39173 - DNA, 18 bp, Artificial Sequence
  Synthetic DNA
aaagacatctcaatatag

SEQ ID NO: 39174 - DNA, 18 bp, Artificial Sequence
  Synthetic DNA
aaagaccacaatctctag

SEQ ID NO: 39175 - DNA, 18 bp, Artificial Sequence
  Synthetic DNA
aaagacgaataactaatg

SEQ ID NO: 39176 - DNA, 18 bp, Artificial Sequence
  Synthetic DNA
aaagactatagactatag

SEQ ID NO: 39177 - DNA, 18 bp, Artificial Sequence
  Synthetic DNA
aaaggctactcactacag

SEQ ID NO: 39178 - DNA, 18 bp, Artificial Sequence
  Synthetic DNA
aaagtcttataactttag

SEQ ID NO: 39179 - DNA, 18 bp, Artificial Sequence
  Synthetic DNA
aaataaaaatcacactag

SEQ ID NO: 39180 - DNA, 18 bp, Artificial Sequence
  Synthetic DNA
aaataaaactctctttag

SEQ ID NO: 39181 - DNA, 18 bp, Artificial Sequence
  Synthetic DNA
aaataaagtactctatag

SEQ ID NO: 39182 - DNA, 18 bp, Artificial Sequence
  Synthetic DNA
aaataagaatcaatgatg

SEQ ID NO: 39183 - DNA, 18 bp, Artificial Sequence
  Synthetic DNA
aaataagactaaataatg

SEQ ID NO: 39184 - DNA, 18 bp, Artificial Sequence
  Synthetic DNA
aaataagactccaaaatg

SEQ ID NO: 39185 - DNA, 18 bp, Artificial Sequence
  Synthetic DNA
aaataagactctcaacag

SEQ ID NO: 39186 - DNA, 18 bp, Artificial Sequence
  Synthetic DNA
aaataagatccactagag

SEQ ID NO: 39187 - DNA, 18 bp, Artificial Sequence
  Synthetic DNA
aaataagattcacttcag

SEQ ID NO: 39188 - DNA, 18 bp, Artificial Sequence
  Synthetic DNA
aaataagcttctgtatag

SEQ ID NO: 39189 - DNA, 18 bp, Artificial Sequence
  Synthetic DNA
aaataaggctgactaaag

SEQ ID NO: 39190 - DNA, 18 bp, Artificial Sequence
  Synthetic DNA
aaataagtatcactccag

SEQ ID NO: 39191 - DNA, 18 bp, Artificial Sequence
  Synthetic DNA
aaataagtctcaatatcg

SEQ ID NO: 39192 - DNA, 18 bp, Artificial Sequence
  Synthetic DNA
aaataagtctcacaatcg

SEQ ID NO: 39193 - DNA, 18 bp, Artificial Sequence
  Synthetic DNA
aaataatactctctcatg

SEQ ID NO: 39194 - DNA, 18 bp, Artificial Sequence
  Synthetic DNA
aaatacaaaacacaatag

SEQ ID NO: 39195 - DNA, 18 bp, Artificial Sequence
  Synthetic DNA
aaatacaactacctattg

SEQ ID NO: 39196 - DNA, 18 bp, Artificial Sequence
  Synthetic DNA
aaatacaactctctaatg

SEQ ID NO: 39197 - DNA, 18 bp, Artificial Sequence
  Synthetic DNA
aaatacaagtgataatag

SEQ ID NO: 39198 - DNA, 18 bp, Artificial Sequence
  Synthetic DNA
aaatacagctatctatag

SEQ ID NO: 39199 - DNA, 18 bp, Artificial Sequence
  Synthetic DNA
aaatacatcaccctatcg

SEQ ID NO: 39200 - DNA, 18 bp, Artificial Sequence
  Synthetic DNA
aaataccacacaatacag

SEQ ID NO: 39201 - DNA, 18 bp, Artificial Sequence
  Synthetic DNA
aaataccacttacttttg

SEQ ID NO: 39202 - DNA, 18 bp, Artificial Sequence
  Synthetic DNA
aaataccctactcattag

SEQ ID NO: 39203 - DNA, 18 bp, Artificial Sequence
  Synthetic DNA
aaatacctcagtctctag

SEQ ID NO: 39204 - DNA, 18 bp, Artificial Sequence
  Synthetic DNA
aaatacctcttaccatag

SEQ ID NO: 39205 - DNA, 18 bp, Artificial Sequence
  Synthetic DNA
aaatacgaagcacaattg

SEQ ID NO: 39206 - DNA, 18 bp, Artificial Sequence
  Synthetic DNA
aaatacgaatatctgtag

SEQ ID NO: 39207 - DNA, 18 bp, Artificial Sequence
  Synthetic DNA
aaatacgaattactcaag

SEQ ID NO: 39208 - DNA, 18 bp, Artificial Sequence
  Synthetic DNA
aaatacgacaccttacag

SEQ ID NO: 39209 - DNA, 18 bp, Artificial Sequence
  Synthetic DNA
aaatacgacactcaatgg

SEQ ID NO: 39210 - DNA, 18 bp, Artificial Sequence
  Synthetic DNA
aaatacgaccctcgattg

SEQ ID NO: 39211 - DNA, 18 bp, Artificial Sequence
  Synthetic DNA
aaatacgactcaaaaatg

SEQ ID NO: 39212 - DNA, 18 bp, Artificial Sequence
  Synthetic DNA
aaatacgactcctttaag

SEQ ID NO: 39213 - DNA, 18 bp, Artificial Sequence
  Synthetic DNA
aaatacgactgactcatg

SEQ ID NO: 39214 - DNA, 18 bp, Artificial Sequence
  Synthetic DNA
aaatacgactgattgttg

SEQ ID NO: 39215 - DNA, 18 bp, Artificial Sequence
  Synthetic DNA
aaatacgactgtgtaaag

SEQ ID NO: 39216 - DNA, 18 bp, Artificial Sequence
  Synthetic DNA
aaatacgacttttttcag

SEQ ID NO: 39217 - DNA, 18 bp, Artificial Sequence
  Synthetic DNA
aaatacgagtctttgtag

SEQ ID NO: 39218 - DNA, 18 bp, Artificial Sequence
  Synthetic DNA
aaatacgatcctataaag

SEQ ID NO: 39219 - DNA, 18 bp, Artificial Sequence
  Synthetic DNA
aaatacgattatctttag

SEQ ID NO: 39220 - DNA, 18 bp, Artificial Sequence
  Synthetic DNA
aaatacgcatatgagtag

SEQ ID NO: 39221 - DNA, 18 bp, Artificial Sequence
  Synthetic DNA
aaatacgcctcaaagaag

SEQ ID NO: 39222 - DNA, 18 bp, Artificial Sequence
  Synthetic DNA
aaatacgccttatcatag

SEQ ID NO: 39223 - DNA, 18 bp, Artificial Sequence
  Synthetic DNA
aaatacgccttatctaag

SEQ ID NO: 39224 - DNA, 18 bp, Artificial Sequence
  Synthetic DNA
aaatacgtcaaacaaatg

SEQ ID NO: 39225 - DNA, 18 bp, Artificial Sequence
  Synthetic DNA
aaatacgtctttttattg

SEQ ID NO: 39226 - DNA, 18 bp, Artificial Sequence
  Synthetic DNA
aaatacgtgtaactattg

SEQ ID NO: 39227 - DNA, 18 bp, Artificial Sequence
  Synthetic DNA
aaatacgtgtagctattg

SEQ ID NO: 39228 - DNA, 18 bp, Artificial Sequence
  Synthetic DNA
aaatactacagagtatag

SEQ ID NO: 39229 - DNA, 18 bp, Artificial Sequence
  Synthetic DNA
aaatactactaacttttg

SEQ ID NO: 39230 - DNA, 18 bp, Artificial Sequence
  Synthetic DNA
aaatacttcaaactttag

SEQ ID NO: 39231 - DNA, 18 bp, Artificial Sequence
  Synthetic DNA
aaatacttcgctctttag

SEQ ID NO: 39232 - DNA, 18 bp, Artificial Sequence
  Synthetic DNA
aaataggacccaataaag

SEQ ID NO: 39233 - DNA, 18 bp, Artificial Sequence
  Synthetic DNA
aaataggccacattgtag

SEQ ID NO: 39234 - DNA, 18 bp, Artificial Sequence
  Synthetic DNA
aaatagggctttatttgg

SEQ ID NO: 39235 - DNA, 18 bp, Artificial Sequence
  Synthetic DNA
aaataggtctcaccattg

SEQ ID NO: 39236 - DNA, 18 bp, Artificial Sequence
  Synthetic DNA
aaatataacttaagattg

SEQ ID NO: 39237 - DNA, 18 bp, Artificial Sequence
  Synthetic DNA
aaatataatacgcttttg

SEQ ID NO: 39238 - DNA, 18 bp, Artificial Sequence
  Synthetic DNA
aaatatgagtttatattg

SEQ ID NO: 39239 - DNA, 18 bp, Artificial Sequence
  Synthetic DNA
aaatatgattctgtatag

SEQ ID NO: 39240 - DNA, 18 bp, Artificial Sequence
  Synthetic DNA
aaatatgcatcaccagtg

SEQ ID NO: 39241 - DNA, 18 bp, Artificial Sequence
  Synthetic DNA
aaatatgccacatactag

SEQ ID NO: 39242 - DNA, 18 bp, Artificial Sequence
  Synthetic DNA
aaatatgtatttctatag

SEQ ID NO: 39243 - DNA, 18 bp, Artificial Sequence
  Synthetic DNA
aaatatgtttccctatag

SEQ ID NO: 39244 - DNA, 18 bp, Artificial Sequence
  Synthetic DNA
aaatattactctctgtag

SEQ ID NO: 39245 - DNA, 18 bp, Artificial Sequence
  Synthetic DNA
aaatcaaactcactgtag

SEQ ID NO: 39246 - DNA, 18 bp, Artificial Sequence
  Synthetic DNA
aaatcacgctcacttaag

SEQ ID NO: 39247 - DNA, 18 bp, Artificial Sequence
  Synthetic DNA
aaatccaacacactaacg

SEQ ID NO: 39248 - DNA, 18 bp, Artificial Sequence
  Synthetic DNA
aaatccaactgtcagtag

SEQ ID NO: 39249 - DNA, 18 bp, Artificial Sequence
  Synthetic DNA
aaatccacccctaaaatg

SEQ ID NO: 39250 - DNA, 18 bp, Artificial Sequence
  Synthetic DNA
aaatccgacacccaatag

SEQ ID NO: 39251 - DNA, 18 bp, Artificial Sequence
  Synthetic DNA
aaatccgactccttttag

SEQ ID NO: 39252 - DNA, 18 bp, Artificial Sequence
  Synthetic DNA
aaatccgatactctatag

SEQ ID NO: 39253 - DNA, 18 bp, Artificial Sequence
  Synthetic DNA
aaatccgatttatcatag

SEQ ID NO: 39254 - DNA, 18 bp, Artificial Sequence
  Synthetic DNA
aaatccggttctctaaag

SEQ ID NO: 39255 - DNA, 18 bp, Artificial Sequence
  Synthetic DNA
aaatcctacacagttatg

SEQ ID NO: 39256 - DNA, 18 bp, Artificial Sequence
  Synthetic DNA
aaatcctactcacagttg

SEQ ID NO: 39257 - DNA, 18 bp, Artificial Sequence
  Synthetic DNA
aaatcgttgtcactatag

SEQ ID NO: 39258 - DNA, 18 bp, Artificial Sequence
  Synthetic DNA
aaatctgaatcaaggtag

SEQ ID NO: 39259 - DNA, 18 bp, Artificial Sequence
  Synthetic DNA
aaatgagactcataatag

SEQ ID NO: 39260 - DNA, 18 bp, Artificial Sequence
  Synthetic DNA
aaatgcaactatctatag

SEQ ID NO: 39261 - DNA, 18 bp, Artificial Sequence
  Synthetic DNA
aaatgccacactcttaag

SEQ ID NO: 39262 - DNA, 18 bp, Artificial Sequence
  Synthetic DNA
aaatgccactctctttag

SEQ ID NO: 39263 - DNA, 18 bp, Artificial Sequence
  Synthetic DNA
aaatgccattaaaaatag

SEQ ID NO: 39264 - DNA, 18 bp, Artificial Sequence
  Synthetic DNA
aaatgcgacacactcaag

SEQ ID NO: 39265 - DNA, 18 bp, Artificial Sequence
  Synthetic DNA
aaatgcgactgaagatag

SEQ ID NO: 39266 - DNA, 18 bp, Artificial Sequence
  Synthetic DNA
aaatgcggctcagagtag

SEQ ID NO: 39267 - DNA, 18 bp, Artificial Sequence
  Synthetic DNA
aaatgcgtctctctttgg

SEQ ID NO: 39268 - DNA, 18 bp, Artificial Sequence
  Synthetic DNA
aaatgctaatcactaaag

SEQ ID NO: 39269 - DNA, 18 bp, Artificial Sequence
  Synthetic DNA
aaatgtaaatctcttaag

SEQ ID NO: 39270 - DNA, 18 bp, Artificial Sequence
  Synthetic DNA
aaatgtgacactcatttg

SEQ ID NO: 39271 - DNA, 18 bp, Artificial Sequence
  Synthetic DNA
aaatgtttctctctatag

SEQ ID NO: 39272 - DNA, 18 bp, Artificial Sequence
  Synthetic DNA
aaatgtttctttttttag

SEQ ID NO: 39273 - DNA, 18 bp, Artificial Sequence
  Synthetic DNA
aaattaaaattactttag

SEQ ID NO: 39274 - DNA, 18 bp, Artificial Sequence
  Synthetic DNA
aaattagactgcctattg

SEQ ID NO: 39275 - DNA, 18 bp, Artificial Sequence
  Synthetic DNA
aaattagactgtctttag

SEQ ID NO: 39276 - DNA, 18 bp, Artificial Sequence
  Synthetic DNA
aaattagtcttattattg

SEQ ID NO: 39277 - DNA, 18 bp, Artificial Sequence
  Synthetic DNA
aaattcaacgcacacaag

SEQ ID NO: 39278 - DNA, 18 bp, Artificial Sequence
  Synthetic DNA
aaattcaactcactactg

SEQ ID NO: 39279 - DNA, 18 bp, Artificial Sequence
  Synthetic DNA
aaattcaactcacttgag

SEQ ID NO: 39280 - DNA, 18 bp, Artificial Sequence
  Synthetic DNA
aaattccactcactcttg

SEQ ID NO: 39281 - DNA, 18 bp, Artificial Sequence
  Synthetic DNA
aaattccactcgcttaag

SEQ ID NO: 39282 - DNA, 18 bp, Artificial Sequence
  Synthetic DNA
aaattccatccactaaag

SEQ ID NO: 39283 - DNA, 18 bp, Artificial Sequence
  Synthetic DNA
aaattcgaaactctaaag

SEQ ID NO: 39284 - DNA, 18 bp, Artificial Sequence
  Synthetic DNA
aaattcgaatcctcatag

SEQ ID NO: 39285 - DNA, 18 bp, Artificial Sequence
  Synthetic DNA
aaattcgacccactgaag

SEQ ID NO: 39286 - DNA, 18 bp, Artificial Sequence
  Synthetic DNA
aaattcgacggaatatag

SEQ ID NO: 39287 - DNA, 18 bp, Artificial Sequence
  Synthetic DNA
aaattcgactaataatag

SEQ ID NO: 39288 - DNA, 18 bp, Artificial Sequence
  Synthetic DNA
aaattcgactatctgttg

SEQ ID NO: 39289 - DNA, 18 bp, Artificial Sequence
  Synthetic DNA
aaattcgactctcactag

SEQ ID NO: 39290 - DNA, 18 bp, Artificial Sequence
  Synthetic DNA
aaattcgactctcttaag

SEQ ID NO: 39291 - DNA, 18 bp, Artificial Sequence
  Synthetic DNA
aaattcgacttaacatag

SEQ ID NO: 39292 - DNA, 18 bp, Artificial Sequence
  Synthetic DNA
aaattcgagtctctagag

SEQ ID NO: 39293 - DNA, 18 bp, Artificial Sequence
  Synthetic DNA
aaattcgattgacataag

SEQ ID NO: 39294 - DNA, 18 bp, Artificial Sequence
  Synthetic DNA
aaattcgcctcactgtgg

SEQ ID NO: 39295 - DNA, 18 bp, Artificial Sequence
  Synthetic DNA
aaattcggcacacattag

SEQ ID NO: 39296 - DNA, 18 bp, Artificial Sequence
  Synthetic DNA
aaattcggctctcaacag

SEQ ID NO: 39297 - DNA, 18 bp, Artificial Sequence
  Synthetic DNA
aaattcggctgaatatag

SEQ ID NO: 39298 - DNA, 18 bp, Artificial Sequence
  Synthetic DNA
aaattcggcttacattag

SEQ ID NO: 39299 - DNA, 18 bp, Artificial Sequence
  Synthetic DNA
aaattcgtctcacaaagg

SEQ ID NO: 39300 - DNA, 18 bp, Artificial Sequence
  Synthetic DNA
aaattcgtttttatatag

SEQ ID NO: 39301 - DNA, 18 bp, Artificial Sequence
  Synthetic DNA
aaattctaattactattg

SEQ ID NO: 39302 - DNA, 18 bp, Artificial Sequence
  Synthetic DNA
aaattctacaaacttaag

SEQ ID NO: 39303 - DNA, 18 bp, Artificial Sequence
  Synthetic DNA
aaattctacacactacag

SEQ ID NO: 39304 - DNA, 18 bp, Artificial Sequence
  Synthetic DNA
aaattctactcccattag

SEQ ID NO: 39305 - DNA, 18 bp, Artificial Sequence
  Synthetic DNA
aaattctactcgttatag

SEQ ID NO: 39306 - DNA, 18 bp, Artificial Sequence
  Synthetic DNA
aaattctactgaccactg

SEQ ID NO: 39307 - DNA, 18 bp, Artificial Sequence
  Synthetic DNA
aaattctattaattatgg

SEQ ID NO: 39308 - DNA, 18 bp, Artificial Sequence
  Synthetic DNA
aaattcttcccactatag

SEQ ID NO: 39309 - DNA, 18 bp, Artificial Sequence
  Synthetic DNA
aaattcttgacaccatag

SEQ ID NO: 39310 - DNA, 18 bp, Artificial Sequence
  Synthetic DNA
aaatttaacacccactag

SEQ ID NO: 39311 - DNA, 18 bp, Artificial Sequence
  Synthetic DNA
aaatttatctcactatag

SEQ ID NO: 39312 - DNA, 18 bp, Artificial Sequence
  Synthetic DNA
aaatttgaatctaaatag

SEQ ID NO: 39313 - DNA, 18 bp, Artificial Sequence
  Synthetic DNA
aaatttgacactctatag

SEQ ID NO: 39314 - DNA, 18 bp, Artificial Sequence
  Synthetic DNA
aaatttgactcaacatag

SEQ ID NO: 39315 - DNA, 18 bp, Artificial Sequence
  Synthetic DNA
aaatttgagccactaacg

SEQ ID NO: 39316 - DNA, 18 bp, Artificial Sequence
  Synthetic DNA
aaattttacacactatgg

SEQ ID NO: 39317 - DNA, 18 bp, Artificial Sequence
  Synthetic DNA
aaattttttgcactgttg

SEQ ID NO: 39318 - DNA, 18 bp, Artificial Sequence
  Synthetic DNA
aacaacgactctccatag

SEQ ID NO: 39319 - DNA, 18 bp, Artificial Sequence
  Synthetic DNA
aacaactactaactttgg

SEQ ID NO: 39320 - DNA, 18 bp, Artificial Sequence
  Synthetic DNA
aacatcgactctgaatag

SEQ ID NO: 39321 - DNA, 18 bp, Artificial Sequence
  Synthetic DNA
aaccgctactcattttag

SEQ ID NO: 39322 - DNA, 18 bp, Artificial Sequence
  Synthetic DNA
aacgatgactaactatag

SEQ ID NO: 39323 - DNA, 18 bp, Artificial Sequence
  Synthetic DNA
aactaaaactcactatcg

SEQ ID NO: 39324 - DNA, 18 bp, Artificial Sequence
  Synthetic DNA
aactaagacacaccatag

SEQ ID NO: 39325 - DNA, 18 bp, Artificial Sequence
  Synthetic DNA
aactacctttcactatag

SEQ ID NO: 39326 - DNA, 18 bp, Artificial Sequence
  Synthetic DNA
aactacgtccctctaaag

SEQ ID NO: 39327 - DNA, 18 bp, Artificial Sequence
  Synthetic DNA
aactaggacacattattg

SEQ ID NO: 39328 - DNA, 18 bp, Artificial Sequence
  Synthetic DNA
aactaggacttaatttcg

SEQ ID NO: 39329 - DNA, 18 bp, Artificial Sequence
  Synthetic DNA
aactatgacttactttag

SEQ ID NO: 39330 - DNA, 18 bp, Artificial Sequence
  Synthetic DNA
aactattactaactatag

SEQ ID NO: 39331 - DNA, 18 bp, Artificial Sequence
  Synthetic DNA
aactccgaatctctaaag

SEQ ID NO: 39332 - DNA, 18 bp, Artificial Sequence
  Synthetic DNA
aactcgaaatctctccag

SEQ ID NO: 39333 - DNA, 18 bp, Artificial Sequence
  Synthetic DNA
aacttaaactcgatatag

SEQ ID NO: 39334 - DNA, 18 bp, Artificial Sequence
  Synthetic DNA
aacttcgtctcactatgg

SEQ ID NO: 39335 - DNA, 18 bp, Artificial Sequence
  Synthetic DNA
aagaaccaacctctactg

SEQ ID NO: 39336 - DNA, 18 bp, Artificial Sequence
  Synthetic DNA
aagaacgactcactaagg

SEQ ID NO: 39337 - DNA, 18 bp, Artificial Sequence
  Synthetic DNA
aagaactactcactattg

SEQ ID NO: 39338 - DNA, 18 bp, Artificial Sequence
  Synthetic DNA
aagatcgactcactctag

SEQ ID NO: 39339 - DNA, 18 bp, Artificial Sequence
  Synthetic DNA
aagcaagactcattaaag

SEQ ID NO: 39340 - DNA, 18 bp, Artificial Sequence
  Synthetic DNA
aagcacgactcaggttag

SEQ ID NO: 39341 - DNA, 18 bp, Artificial Sequence
  Synthetic DNA
aagcacgcgatactatag

SEQ ID NO: 39342 - DNA, 18 bp, Artificial Sequence
  Synthetic DNA
aagtaagactctctttag

SEQ ID NO: 39343 - DNA, 18 bp, Artificial Sequence
  Synthetic DNA
aagtacaactctccatag

SEQ ID NO: 39344 - DNA, 18 bp, Artificial Sequence
  Synthetic DNA
aagtacgacttacattag

SEQ ID NO: 39345 - DNA, 18 bp, Artificial Sequence
  Synthetic DNA
aagtacgattctctctag

SEQ ID NO: 39346 - DNA, 18 bp, Artificial Sequence
  Synthetic DNA
aagtacgccaaactctag

SEQ ID NO: 39347 - DNA, 18 bp, Artificial Sequence
  Synthetic DNA
aagtacgcgtccctatag

SEQ ID NO: 39348 - DNA, 18 bp, Artificial Sequence
  Synthetic DNA
aagtacgtttcactttag

SEQ ID NO: 39349 - DNA, 18 bp, Artificial Sequence
  Synthetic DNA
aagtactacttactattg

SEQ ID NO: 39350 - DNA, 18 bp, Artificial Sequence
  Synthetic DNA
aagtactcctaactaaag

SEQ ID NO: 39351 - DNA, 18 bp, Artificial Sequence
  Synthetic DNA
aagtcctatccagtatag

SEQ ID NO: 39352 - DNA, 18 bp, Artificial Sequence
  Synthetic DNA
aagtctgactcaatctag

SEQ ID NO: 39353 - DNA, 18 bp, Artificial Sequence
  Synthetic DNA
aagtgcaacccagttaag

SEQ ID NO: 39354 - DNA, 18 bp, Artificial Sequence
  Synthetic DNA
aagttcgaatcactatcg

SEQ ID NO: 39355 - DNA, 18 bp, Artificial Sequence
  Synthetic DNA
aagttcgaattggtaatg

SEQ ID NO: 39356 - DNA, 18 bp, Artificial Sequence
  Synthetic DNA
aagttcgtcaaacattgg

SEQ ID NO: 39357 - DNA, 18 bp, Artificial Sequence
  Synthetic DNA
aataaagacactctatag

SEQ ID NO: 39358 - DNA, 18 bp, Artificial Sequence
  Synthetic DNA
aataaagactaatttaag

SEQ ID NO: 39359 - DNA, 18 bp, Artificial Sequence
  Synthetic DNA
aataaagactcagcatag

SEQ ID NO: 39360 - DNA, 18 bp, Artificial Sequence
  Synthetic DNA
aataaagattcactgcag

SEQ ID NO: 39361 - DNA, 18 bp, Artificial Sequence
  Synthetic DNA
aataacgactgactcttg

SEQ ID NO: 39362 - DNA, 18 bp, Artificial Sequence
  Synthetic DNA
aataacgagcaactacag

SEQ ID NO: 39363 - DNA, 18 bp, Artificial Sequence
  Synthetic DNA
aataaggactcacttttg

SEQ ID NO: 39364 - DNA, 18 bp, Artificial Sequence
  Synthetic DNA
aataccgaaacactatag

SEQ ID NO: 39365 - DNA, 18 bp, Artificial Sequence
  Synthetic DNA
aatactgacacaaattgg

SEQ ID NO: 39366 - DNA, 18 bp, Artificial Sequence
  Synthetic DNA
aatagcgacacactatgg

SEQ ID NO: 39367 - DNA, 18 bp, Artificial Sequence
  Synthetic DNA
aatagcgactctctatag

SEQ ID NO: 39368 - DNA, 18 bp, Artificial Sequence
  Synthetic DNA
aatatcaacacattatag

SEQ ID NO: 39369 - DNA, 18 bp, Artificial Sequence
  Synthetic DNA
aatatcgtctcactacgg

SEQ ID NO: 39370 - DNA, 18 bp, Artificial Sequence
  Synthetic DNA
aatattgacccacaatag

SEQ ID NO: 39371 - DNA, 18 bp, Artificial Sequence
  Synthetic DNA
aatctcatccgaaactag

SEQ ID NO: 39372 - DNA, 18 bp, Artificial Sequence
  Synthetic DNA
aatgacgtctctctatag

SEQ ID NO: 39373 - DNA, 18 bp, Artificial Sequence
  Synthetic DNA
aatgatcactctctaaag

SEQ ID NO: 39374 - DNA, 18 bp, Artificial Sequence
  Synthetic DNA
aatgccgatccactaagg

SEQ ID NO: 39375 - DNA, 18 bp, Artificial Sequence
  Synthetic DNA
aattaagacactcagcag

SEQ ID NO: 39376 - DNA, 18 bp, Artificial Sequence
  Synthetic DNA
aattaagacttgctacag

SEQ ID NO: 39377 - DNA, 18 bp, Artificial Sequence
  Synthetic DNA
aattaagattcaaaattg

SEQ ID NO: 39378 - DNA, 18 bp, Artificial Sequence
  Synthetic DNA
aattaatactctgtatag

SEQ ID NO: 39379 - DNA, 18 bp, Artificial Sequence
  Synthetic DNA
aattacaacaaacttttg

SEQ ID NO: 39380 - DNA, 18 bp, Artificial Sequence
  Synthetic DNA
aattacaatacactatag

SEQ ID NO: 39381 - DNA, 18 bp, Artificial Sequence
  Synthetic DNA
aattacaatttacaacag

SEQ ID NO: 39382 - DNA, 18 bp, Artificial Sequence
  Synthetic DNA
aattacgacggactagag

SEQ ID NO: 39383 - DNA, 18 bp, Artificial Sequence
  Synthetic DNA
aattacgactctcttatg

SEQ ID NO: 39384 - DNA, 18 bp, Artificial Sequence
  Synthetic DNA
aattacgccaaagcacag

SEQ ID NO: 39385 - DNA, 18 bp, Artificial Sequence
  Synthetic DNA
aattacgcctcattattg

SEQ ID NO: 39386 - DNA, 18 bp, Artificial Sequence
  Synthetic DNA
aattacggttctttattg

SEQ ID NO: 39387 - DNA, 18 bp, Artificial Sequence
  Synthetic DNA
aattacgtaccacttaag

SEQ ID NO: 39388 - DNA, 18 bp, Artificial Sequence
  Synthetic DNA
aattacgtccctctaagg

SEQ ID NO: 39389 - DNA, 18 bp, Artificial Sequence
  Synthetic DNA
aattacgtctcacaacag

SEQ ID NO: 39390 - DNA, 18 bp, Artificial Sequence
  Synthetic DNA
aattacgtctgactctag

SEQ ID NO: 39391 - DNA, 18 bp, Artificial Sequence
  Synthetic DNA
aattactgctaactattg

SEQ ID NO: 39392 - DNA, 18 bp, Artificial Sequence
  Synthetic DNA
aattacttctctctaaag

SEQ ID NO: 39393 - DNA, 18 bp, Artificial Sequence
  Synthetic DNA
aattagaacacactctag

SEQ ID NO: 39394 - DNA, 18 bp, Artificial Sequence
  Synthetic DNA
aattagcacttccaaaag

SEQ ID NO: 39395 - DNA, 18 bp, Artificial Sequence
  Synthetic DNA
aattaggactatcttatg

SEQ ID NO: 39396 - DNA, 18 bp, Artificial Sequence
  Synthetic DNA
aattaggatcaactatag

SEQ ID NO: 39397 - DNA, 18 bp, Artificial Sequence
  Synthetic DNA
aattaggatttattatag

SEQ ID NO: 39398 - DNA, 18 bp, Artificial Sequence
  Synthetic DNA
aattaggtctcactaaag

SEQ ID NO: 39399 - DNA, 18 bp, Artificial Sequence
  Synthetic DNA
aattatgatttattatcg

SEQ ID NO: 39400 - DNA, 18 bp, Artificial Sequence
  Synthetic DNA
aattatgtctctgaatag

SEQ ID NO: 39401 - DNA, 18 bp, Artificial Sequence
  Synthetic DNA
aattattactcacaatag

SEQ ID NO: 39402 - DNA, 18 bp, Artificial Sequence
  Synthetic DNA
aattattgctcagactag

SEQ ID NO: 39403 - DNA, 18 bp, Artificial Sequence
  Synthetic DNA
aattcagacttacaaaag

SEQ ID NO: 39404 - DNA, 18 bp, Artificial Sequence
  Synthetic DNA
aattccaaccctctatgg

SEQ ID NO: 39405 - DNA, 18 bp, Artificial Sequence
  Synthetic DNA
aattccgacacccgatag

SEQ ID NO: 39406 - DNA, 18 bp, Artificial Sequence
  Synthetic DNA
aattccgatacaatatag

SEQ ID NO: 39407 - DNA, 18 bp, Artificial Sequence
  Synthetic DNA
aattccgcctcagaaaag

SEQ ID NO: 39408 - DNA, 18 bp, Artificial Sequence
  Synthetic DNA
aattccgtatcattaaag

SEQ ID NO: 39409 - DNA, 18 bp, Artificial Sequence
  Synthetic DNA
aattctaacccagtatag

SEQ ID NO: 39410 - DNA, 18 bp, Artificial Sequence
  Synthetic DNA
aattgccagtccctatag

SEQ ID NO: 39411 - DNA, 18 bp, Artificial Sequence
  Synthetic DNA
aattgcgtctcacaattg

SEQ ID NO: 39412 - DNA, 18 bp, Artificial Sequence
  Synthetic DNA
aattgctacttattttag

SEQ ID NO: 39413 - DNA, 18 bp, Artificial Sequence
  Synthetic DNA
aattgtgactcactatcg

SEQ ID NO: 39414 - DNA, 18 bp, Artificial Sequence
  Synthetic DNA
aatttagactatctattg

SEQ ID NO: 39415 - DNA, 18 bp, Artificial Sequence
  Synthetic DNA
aatttcaacgcattattg

SEQ ID NO: 39416 - DNA, 18 bp, Artificial Sequence
  Synthetic DNA
aatttcgactcacatgtg

SEQ ID NO: 39417 - DNA, 18 bp, Artificial Sequence
  Synthetic DNA
aatttcgactcactactg

SEQ ID NO: 39418 - DNA, 18 bp, Artificial Sequence
  Synthetic DNA
aatttcgactctttttag

SEQ ID NO: 39419 - DNA, 18 bp, Artificial Sequence
  Synthetic DNA
aatttcgtcactctatgg

SEQ ID NO: 39420 - DNA, 18 bp, Artificial Sequence
  Synthetic DNA
aattttgacacaatacag

SEQ ID NO: 39421 - DNA, 18 bp, Artificial Sequence
  Synthetic DNA
aattttgacccactatag

SEQ ID NO: 39422 - DNA, 18 bp, Artificial Sequence
  Synthetic DNA
aattttgtgtaactattg

SEQ ID NO: 39423 - DNA, 18 bp, Artificial Sequence
  Synthetic DNA
aatttttaatcacattag

SEQ ID NO: 39424 - DNA, 18 bp, Artificial Sequence
  Synthetic DNA
aatttttactcactatag

SEQ ID NO: 39425 - DNA, 18 bp, Artificial Sequence
  Synthetic DNA
aattttttcccaatatag

SEQ ID NO: 39426 - DNA, 18 bp, Artificial Sequence
  Synthetic DNA
acaaaagactcactaaag

SEQ ID NO: 39427 - DNA, 18 bp, Artificial Sequence
  Synthetic DNA
acaaacgaatgtctatag

SEQ ID NO: 39428 - DNA, 18 bp, Artificial Sequence
  Synthetic DNA
acaaacgacacacagtag

SEQ ID NO: 39429 - DNA, 18 bp, Artificial Sequence
  Synthetic DNA
acaaacgattcattatgg

SEQ ID NO: 39430 - DNA, 18 bp, Artificial Sequence
  Synthetic DNA
acaaacgccttacaaaag

SEQ ID NO: 39431 - DNA, 18 bp, Artificial Sequence
  Synthetic DNA
acaaatgacccacagtag

SEQ ID NO: 39432 - DNA, 18 bp, Artificial Sequence
  Synthetic DNA
acaaatgactctctatag

SEQ ID NO: 39433 - DNA, 18 bp, Artificial Sequence
  Synthetic DNA
acaattgacaaacgatag

SEQ ID NO: 39434 - DNA, 18 bp, Artificial Sequence
  Synthetic DNA
acacaagtttcattatag

SEQ ID NO: 39435 - DNA, 18 bp, Artificial Sequence
  Synthetic DNA
acatacgaatacatgaag

SEQ ID NO: 39436 - DNA, 18 bp, Artificial Sequence
  Synthetic DNA
acatacgactccctcttg

SEQ ID NO: 39437 - DNA, 18 bp, Artificial Sequence
  Synthetic DNA
acatacgactctttattg

SEQ ID NO: 39438 - DNA, 18 bp, Artificial Sequence
  Synthetic DNA
acatacgcttaactatag

SEQ ID NO: 39439 - DNA, 18 bp, Artificial Sequence
  Synthetic DNA
acatacggctcactttgg

SEQ ID NO: 39440 - DNA, 18 bp, Artificial Sequence
  Synthetic DNA
acatacgtcttgctatgg

SEQ ID NO: 39441 - DNA, 18 bp, Artificial Sequence
  Synthetic DNA
acatactactcactaagg

SEQ ID NO: 39442 - DNA, 18 bp, Artificial Sequence
  Synthetic DNA
acataggacacactattg

SEQ ID NO: 39443 - DNA, 18 bp, Artificial Sequence
  Synthetic DNA
acatatgagacaataccg

SEQ ID NO: 39444 - DNA, 18 bp, Artificial Sequence
  Synthetic DNA
acatatgagtcattatag

SEQ ID NO: 39445 - DNA, 18 bp, Artificial Sequence
  Synthetic DNA
acattcaatataccatag

SEQ ID NO: 39446 - DNA, 18 bp, Artificial Sequence
  Synthetic DNA
acattctactcacttttg

SEQ ID NO: 39447 - DNA, 18 bp, Artificial Sequence
  Synthetic DNA
accatagatccactatag

SEQ ID NO: 39448 - DNA, 18 bp, Artificial Sequence
  Synthetic DNA
acctaagacaaacttttg

SEQ ID NO: 39449 - DNA, 18 bp, Artificial Sequence
  Synthetic DNA
acctatgactcactatcg

SEQ ID NO: 39450 - DNA, 18 bp, Artificial Sequence
  Synthetic DNA
accttcgaccctctgtag

SEQ ID NO: 39451 - DNA, 18 bp, Artificial Sequence
  Synthetic DNA
accttcggctcacacaag

SEQ ID NO: 39452 - DNA, 18 bp, Artificial Sequence
  Synthetic DNA
actaaagttcaactatag

SEQ ID NO: 39453 - DNA, 18 bp, Artificial Sequence
  Synthetic DNA
actaacgatttactaaag

SEQ ID NO: 39454 - DNA, 18 bp, Artificial Sequence
  Synthetic DNA
acttacgacatactttcg

SEQ ID NO: 39455 - DNA, 18 bp, Artificial Sequence
  Synthetic DNA
acttataagaaacaaagg

SEQ ID NO: 39456 - DNA, 18 bp, Artificial Sequence
  Synthetic DNA
acttatgacatactacgg

SEQ ID NO: 39457 - DNA, 18 bp, Artificial Sequence
  Synthetic DNA
acttttgactcagcgaag

SEQ ID NO: 39458 - DNA, 18 bp, Artificial Sequence
  Synthetic DNA
agaaacgactgactttag

SEQ ID NO: 39459 - DNA, 18 bp, Artificial Sequence
  Synthetic DNA
agaagtgattcaccattg

SEQ ID NO: 39460 - DNA, 18 bp, Artificial Sequence
  Synthetic DNA
agaatagacacactttag

SEQ ID NO: 39461 - DNA, 18 bp, Artificial Sequence
  Synthetic DNA
agaatcgaatcactttgg

SEQ ID NO: 39462 - DNA, 18 bp, Artificial Sequence
  Synthetic DNA
agaatcgactcatcatcg

SEQ ID NO: 39463 - DNA, 18 bp, Artificial Sequence
  Synthetic DNA
agacaagcctcaatatag

SEQ ID NO: 39464 - DNA, 18 bp, Artificial Sequence
  Synthetic DNA
agacgggactatctttag

SEQ ID NO: 39465 - DNA, 18 bp, Artificial Sequence
  Synthetic DNA
agacttgactcactatag

SEQ ID NO: 39466 - DNA, 18 bp, Artificial Sequence
  Synthetic DNA
agatacaaatctctttcg

SEQ ID NO: 39467 - DNA, 18 bp, Artificial Sequence
  Synthetic DNA
agatacctcactctatag

SEQ ID NO: 39468 - DNA, 18 bp, Artificial Sequence
  Synthetic DNA
agatacgacttagtttgg

SEQ ID NO: 39469 - DNA, 18 bp, Artificial Sequence
  Synthetic DNA
agatacgtcacagtattg

SEQ ID NO: 39470 - DNA, 18 bp, Artificial Sequence
  Synthetic DNA
agatacgtgtcaatatgg

SEQ ID NO: 39471 - DNA, 18 bp, Artificial Sequence
  Synthetic DNA
agatatgaatcacaatag

SEQ ID NO: 39472 - DNA, 18 bp, Artificial Sequence
  Synthetic DNA
agatatgacccaatattg

SEQ ID NO: 39473 - DNA, 18 bp, Artificial Sequence
  Synthetic DNA
agatattactcaatatag

SEQ ID NO: 39474 - DNA, 18 bp, Artificial Sequence
  Synthetic DNA
agatgcgtttcagtaaag

SEQ ID NO: 39475 - DNA, 18 bp, Artificial Sequence
  Synthetic DNA
agattcgagtctctatag

SEQ ID NO: 39476 - DNA, 18 bp, Artificial Sequence
  Synthetic DNA
agcttcgattcaatatag

SEQ ID NO: 39477 - DNA, 18 bp, Artificial Sequence
  Synthetic DNA
agtagctactaactatag

SEQ ID NO: 39478 - DNA, 18 bp, Artificial Sequence
  Synthetic DNA
agtcaagtctcacaatag

SEQ ID NO: 39479 - DNA, 18 bp, Artificial Sequence
  Synthetic DNA
agtcgcgactcaatatag

SEQ ID NO: 39480 - DNA, 18 bp, Artificial Sequence
  Synthetic DNA
agtgaacactcactgtca

SEQ ID NO: 39481 - DNA, 18 bp, Artificial Sequence
  Synthetic DNA
agtgacgacacactgaag

SEQ ID NO: 39482 - DNA, 18 bp, Artificial Sequence
  Synthetic DNA
agtgacgacccacaattg

SEQ ID NO: 39483 - DNA, 18 bp, Artificial Sequence
  Synthetic DNA
agttaagacacaccacag

SEQ ID NO: 39484 - DNA, 18 bp, Artificial Sequence
  Synthetic DNA
agttacaattaaccatag

SEQ ID NO: 39485 - DNA, 18 bp, Artificial Sequence
  Synthetic DNA
agttaggacacattatag

SEQ ID NO: 39486 - DNA, 18 bp, Artificial Sequence
  Synthetic DNA
agttatggctcagtattg

SEQ ID NO: 39487 - DNA, 18 bp, Artificial Sequence
  Synthetic DNA
agttccccatcactatag

SEQ ID NO: 39488 - DNA, 18 bp, Artificial Sequence
  Synthetic DNA
ataaacatcatactatag

SEQ ID NO: 39489 - DNA, 18 bp, Artificial Sequence
  Synthetic DNA
ataaacgaatcactttag

SEQ ID NO: 39490 - DNA, 18 bp, Artificial Sequence
  Synthetic DNA
ataaacgactcctattag

SEQ ID NO: 39491 - DNA, 18 bp, Artificial Sequence
  Synthetic DNA
ataaacgacttactataa

SEQ ID NO: 39492 - DNA, 18 bp, Artificial Sequence
  Synthetic DNA
ataaacgattcaatatag

SEQ ID NO: 39493 - DNA, 18 bp, Artificial Sequence
  Synthetic DNA
ataaacgatttactaaag

SEQ ID NO: 39494 - DNA, 18 bp, Artificial Sequence
  Synthetic DNA
ataaacggcttacaattg

SEQ ID NO: 39495 - DNA, 18 bp, Artificial Sequence
  Synthetic DNA
ataaacgtgtcacaattg

SEQ ID NO: 39496 - DNA, 18 bp, Artificial Sequence
  Synthetic DNA
ataaacgtttccctactg

SEQ ID NO: 39497 - DNA, 18 bp, Artificial Sequence
  Synthetic DNA
ataaaggtaacactatag

SEQ ID NO: 39498 - DNA, 18 bp, Artificial Sequence
  Synthetic DNA
ataaatgaatcactcatg

SEQ ID NO: 39499 - DNA, 18 bp, Artificial Sequence
  Synthetic DNA
ataaccgactcgttttag

SEQ ID NO: 39500 - DNA, 18 bp, Artificial Sequence
  Synthetic DNA
ataaccgattcactatag

SEQ ID NO: 39501 - DNA, 18 bp, Artificial Sequence
  Synthetic DNA
ataacctactcactatag

SEQ ID NO: 39502 - DNA, 18 bp, Artificial Sequence
  Synthetic DNA
ataacctcctttctatag

SEQ ID NO: 39503 - DNA, 18 bp, Artificial Sequence
  Synthetic DNA
ataagagactgtctattg

SEQ ID NO: 39504 - DNA, 18 bp, Artificial Sequence
  Synthetic DNA
ataagcggctcaatttag

SEQ ID NO: 39505 - DNA, 18 bp, Artificial Sequence
  Synthetic DNA
ataagctcttcactattg

SEQ ID NO: 39506 - DNA, 18 bp, Artificial Sequence
  Synthetic DNA
ataatcaaatcacggtag

SEQ ID NO: 39507 - DNA, 18 bp, Artificial Sequence
  Synthetic DNA
atacaagcctcacttttg

SEQ ID NO: 39508 - DNA, 18 bp, Artificial Sequence
  Synthetic DNA
atacacgaatctctatgg

SEQ ID NO: 39509 - DNA, 18 bp, Artificial Sequence
  Synthetic DNA
atacacgactcaaaactg

SEQ ID NO: 39510 - DNA, 18 bp, Artificial Sequence
  Synthetic DNA
atacacgattcactacag

SEQ ID NO: 39511 - DNA, 18 bp, Artificial Sequence
  Synthetic DNA
atacacggcacacgatag

SEQ ID NO: 39512 - DNA, 18 bp, Artificial Sequence
  Synthetic DNA
atacaggaatctctattg

SEQ ID NO: 39513 - DNA, 18 bp, Artificial Sequence
  Synthetic DNA
atacgctactctctaagg

SEQ ID NO: 39514 - DNA, 18 bp, Artificial Sequence
  Synthetic DNA
atactcgaaacaaaattg

SEQ ID NO: 39515 - DNA, 18 bp, Artificial Sequence
  Synthetic DNA
atactcgtatcactccgg

SEQ ID NO: 39516 - DNA, 18 bp, Artificial Sequence
  Synthetic DNA
atactctaataactatag

SEQ ID NO: 39517 - DNA, 18 bp, Artificial Sequence
  Synthetic DNA
atagctgactcacaatag

SEQ ID NO: 39518 - DNA, 18 bp, Artificial Sequence
  Synthetic DNA
atataaaactaaccatcg

SEQ ID NO: 39519 - DNA, 18 bp, Artificial Sequence
  Synthetic DNA
atataagacctgggagag

SEQ ID NO: 39520 - DNA, 18 bp, Artificial Sequence
  Synthetic DNA
atataagacgctccatag

SEQ ID NO: 39521 - DNA, 18 bp, Artificial Sequence
  Synthetic DNA
atataagactctatatag

SEQ ID NO: 39522 - DNA, 18 bp, Artificial Sequence
  Synthetic DNA
atataagatcgtctttag

SEQ ID NO: 39523 - DNA, 18 bp, Artificial Sequence
  Synthetic DNA
atataaggcgcacttttg

SEQ ID NO: 39524 - DNA, 18 bp, Artificial Sequence
  Synthetic DNA
atatacaacccagtattg

SEQ ID NO: 39525 - DNA, 18 bp, Artificial Sequence
  Synthetic DNA
atataccacagactatgg

SEQ ID NO: 39526 - DNA, 18 bp, Artificial Sequence
  Synthetic DNA
atataccactcacattag

SEQ ID NO: 39527 - DNA, 18 bp, Artificial Sequence
  Synthetic DNA
atataccactcgctaaag

SEQ ID NO: 39528 - DNA, 18 bp, Artificial Sequence
  Synthetic DNA
atatacccctaactatag

SEQ ID NO: 39529 - DNA, 18 bp, Artificial Sequence
  Synthetic DNA
atatacgaaattctttag

SEQ ID NO: 39530 - DNA, 18 bp, Artificial Sequence
  Synthetic DNA
atatacgaatatcaatag

SEQ ID NO: 39531 - DNA, 18 bp, Artificial Sequence
  Synthetic DNA
atatacgaattaccacag

SEQ ID NO: 39532 - DNA, 18 bp, Artificial Sequence
  Synthetic DNA
atatacgacacttaatag

SEQ ID NO: 39533 - DNA, 18 bp, Artificial Sequence
  Synthetic DNA
atatacgacccacaatgg

SEQ ID NO: 39534 - DNA, 18 bp, Artificial Sequence
  Synthetic DNA
atatacgactaacatcag

SEQ ID NO: 39535 - DNA, 18 bp, Artificial Sequence
  Synthetic DNA
atatacgactcgttacag

SEQ ID NO: 39536 - DNA, 18 bp, Artificial Sequence
  Synthetic DNA
atatacgataaataatag

SEQ ID NO: 39537 - DNA, 18 bp, Artificial Sequence
  Synthetic DNA
atatacgattcaccattg

SEQ ID NO: 39538 - DNA, 18 bp, Artificial Sequence
  Synthetic DNA
atatacgattctaaaaag

SEQ ID NO: 39539 - DNA, 18 bp, Artificial Sequence
  Synthetic DNA
atatacgcccaactatag

SEQ ID NO: 39540 - DNA, 18 bp, Artificial Sequence
  Synthetic DNA
atatacgtaccattttag

SEQ ID NO: 39541 - DNA, 18 bp, Artificial Sequence
  Synthetic DNA
atatacgtcattaaatag

SEQ ID NO: 39542 - DNA, 18 bp, Artificial Sequence
  Synthetic DNA
atatacgtctcataatag

SEQ ID NO: 39543 - DNA, 18 bp, Artificial Sequence
  Synthetic DNA
atatacgttattcaatag

SEQ ID NO: 39544 - DNA, 18 bp, Artificial Sequence
  Synthetic DNA
atatacgtttcgcaatag

SEQ ID NO: 39545 - DNA, 18 bp, Artificial Sequence
  Synthetic DNA
atatactacccaatatcg

SEQ ID NO: 39546 - DNA, 18 bp, Artificial Sequence
  Synthetic DNA
atatactactcaatttag

SEQ ID NO: 39547 - DNA, 18 bp, Artificial Sequence
  Synthetic DNA
atatacttacccctatag

SEQ ID NO: 39548 - DNA, 18 bp, Artificial Sequence
  Synthetic DNA
atatacttcggactctag

SEQ ID NO: 39549 - DNA, 18 bp, Artificial Sequence
  Synthetic DNA
atatacttctacttatag

SEQ ID NO: 39550 - DNA, 18 bp, Artificial Sequence
  Synthetic DNA
atatacttctcacgagtg

SEQ ID NO: 39551 - DNA, 18 bp, Artificial Sequence
  Synthetic DNA
atatagaactaattatag

SEQ ID NO: 39552 - DNA, 18 bp, Artificial Sequence
  Synthetic DNA
atataggtcccacaatag

SEQ ID NO: 39553 - DNA, 18 bp, Artificial Sequence
  Synthetic DNA
atataggtcccacagtag

SEQ ID NO: 39554 - DNA, 18 bp, Artificial Sequence
  Synthetic DNA
atatagttcgcacttttg

SEQ ID NO: 39555 - DNA, 18 bp, Artificial Sequence
  Synthetic DNA
atatataactctctattg

SEQ ID NO: 39556 - DNA, 18 bp, Artificial Sequence
  Synthetic DNA
atatatcactcattacag

SEQ ID NO: 39557 - DNA, 18 bp, Artificial Sequence
  Synthetic DNA
atatatgaatctctacag

SEQ ID NO: 39558 - DNA, 18 bp, Artificial Sequence
  Synthetic DNA
atatatgacataccagcg

SEQ ID NO: 39559 - DNA, 18 bp, Artificial Sequence
  Synthetic DNA
atatatgacccacattag

SEQ ID NO: 39560 - DNA, 18 bp, Artificial Sequence
  Synthetic DNA
atatatgactcatcagag

SEQ ID NO: 39561 - DNA, 18 bp, Artificial Sequence
  Synthetic DNA
atatatgacttacaatgg

SEQ ID NO: 39562 - DNA, 18 bp, Artificial Sequence
  Synthetic DNA
atatatgagtatctatag

SEQ ID NO: 39563 - DNA, 18 bp, Artificial Sequence
  Synthetic DNA
atatatgcctttctattg

SEQ ID NO: 39564 - DNA, 18 bp, Artificial Sequence
  Synthetic DNA
atatatggctaactatag

SEQ ID NO: 39565 - DNA, 18 bp, Artificial Sequence
  Synthetic DNA
atatatgtttgactatag

SEQ ID NO: 39566 - DNA, 18 bp, Artificial Sequence
  Synthetic DNA
atatccaattctcttatg

SEQ ID NO: 39567 - DNA, 18 bp, Artificial Sequence
  Synthetic DNA
atatccgactcactgttg

SEQ ID NO: 39568 - DNA, 18 bp, Artificial Sequence
  Synthetic DNA
atatccgtctccccatag

SEQ ID NO: 39569 - DNA, 18 bp, Artificial Sequence
  Synthetic DNA
atatccgtttcactatag

SEQ ID NO: 39570 - DNA, 18 bp, Artificial Sequence
  Synthetic DNA
atatcctacacattctag

SEQ ID NO: 39571 - DNA, 18 bp, Artificial Sequence
  Synthetic DNA
atatgaccctcactatag

SEQ ID NO: 39572 - DNA, 18 bp, Artificial Sequence
  Synthetic DNA
atatgagactcactattg

SEQ ID NO: 39573 - DNA, 18 bp, Artificial Sequence
  Synthetic DNA
atatgcagatcataatag

SEQ ID NO: 39574 - DNA, 18 bp, Artificial Sequence
  Synthetic DNA
atatgcgaccctctatag

SEQ ID NO: 39575 - DNA, 18 bp, Artificial Sequence
  Synthetic DNA
atatgcgattaactatag

SEQ ID NO: 39576 - DNA, 18 bp, Artificial Sequence
  Synthetic DNA
atatgcggatcactaaag

SEQ ID NO: 39577 - DNA, 18 bp, Artificial Sequence
  Synthetic DNA
atatgctaatcacaatag

SEQ ID NO: 39578 - DNA, 18 bp, Artificial Sequence
  Synthetic DNA
atatgctaatcactatcg

SEQ ID NO: 39579 - DNA, 18 bp, Artificial Sequence
  Synthetic DNA
atatgctgctcactttag

SEQ ID NO: 39580 - DNA, 18 bp, Artificial Sequence
  Synthetic DNA
atatgtgtgccactattg

SEQ ID NO: 39581 - DNA, 18 bp, Artificial Sequence
  Synthetic DNA
atattaaacacacattag

SEQ ID NO: 39582 - DNA, 18 bp, Artificial Sequence
  Synthetic DNA
atattagactctcgatag

SEQ ID NO: 39583 - DNA, 18 bp, Artificial Sequence
  Synthetic DNA
atattagacttttcatag

SEQ ID NO: 39584 - DNA, 18 bp, Artificial Sequence
  Synthetic DNA
atattatagtcactatag

SEQ ID NO: 39585 - DNA, 18 bp, Artificial Sequence
  Synthetic DNA
atattcaacactatgatg

SEQ ID NO: 39586 - DNA, 18 bp, Artificial Sequence
  Synthetic DNA
atattcgaacccctatag

SEQ ID NO: 39587 - DNA, 18 bp, Artificial Sequence
  Synthetic DNA
atattcgattatgtttag

SEQ ID NO: 39588 - DNA, 18 bp, Artificial Sequence
  Synthetic DNA
atattctactcgcaatag

SEQ ID NO: 39589 - DNA, 18 bp, Artificial Sequence
  Synthetic DNA
atatttgattcactattg

SEQ ID NO: 39590 - DNA, 18 bp, Artificial Sequence
  Synthetic DNA
atcctcggcttactacgg

SEQ ID NO: 39591 - DNA, 18 bp, Artificial Sequence
  Synthetic DNA
atctaatattcaccatag

SEQ ID NO: 39592 - DNA, 18 bp, Artificial Sequence
  Synthetic DNA
atctacaactcacattag

SEQ ID NO: 39593 - DNA, 18 bp, Artificial Sequence
  Synthetic DNA
atctaccaccatctatag

SEQ ID NO: 39594 - DNA, 18 bp, Artificial Sequence
  Synthetic DNA
atcttaaccttactattg

SEQ ID NO: 39595 - DNA, 18 bp, Artificial Sequence
  Synthetic DNA
atcttagactcaatattg

SEQ ID NO: 39596 - DNA, 18 bp, Artificial Sequence
  Synthetic DNA
atgcataaaacactatag

SEQ ID NO: 39597 - DNA, 18 bp, Artificial Sequence
  Synthetic DNA
atgtacaacttccaatag

SEQ ID NO: 39598 - DNA, 18 bp, Artificial Sequence
  Synthetic DNA
atgtacgacacactgtag

SEQ ID NO: 39599 - DNA, 18 bp, Artificial Sequence
  Synthetic DNA
atgtacgcgtcactattg

SEQ ID NO: 39600 - DNA, 18 bp, Artificial Sequence
  Synthetic DNA
atgtacgtcacacgatag

SEQ ID NO: 39601 - DNA, 18 bp, Artificial Sequence
  Synthetic DNA
atgttattctcaatattg

SEQ ID NO: 39602 - DNA, 18 bp, Artificial Sequence
  Synthetic DNA
atgttcgactcaccatag

SEQ ID NO: 39603 - DNA, 18 bp, Artificial Sequence
  Synthetic DNA
atgttcgtttctctaaag

SEQ ID NO: 39604 - DNA, 18 bp, Artificial Sequence
  Synthetic DNA
attaacaactcactttag

SEQ ID NO: 39605 - DNA, 18 bp, Artificial Sequence
  Synthetic DNA
attaacgaatcactatag

SEQ ID NO: 39606 - DNA, 18 bp, Artificial Sequence
  Synthetic DNA
attaacgtctcattgtag

SEQ ID NO: 39607 - DNA, 18 bp, Artificial Sequence
  Synthetic DNA
attaatgatttacatcag

SEQ ID NO: 39608 - DNA, 18 bp, Artificial Sequence
  Synthetic DNA
attaccggcttacaattg

SEQ ID NO: 39609 - DNA, 18 bp, Artificial Sequence
  Synthetic DNA
attatcgtctcccttttg

SEQ ID NO: 39610 - DNA, 18 bp, Artificial Sequence
  Synthetic DNA
attcacgacctacattag

SEQ ID NO: 39611 - DNA, 18 bp, Artificial Sequence
  Synthetic DNA
atttaagtcacaaaatag

SEQ ID NO: 39612 - DNA, 18 bp, Artificial Sequence
  Synthetic DNA
atttaataattgctatag

SEQ ID NO: 39613 - DNA, 18 bp, Artificial Sequence
  Synthetic DNA
atttaccagtctttatag

SEQ ID NO: 39614 - DNA, 18 bp, Artificial Sequence
  Synthetic DNA
atttaccattctcgatag

SEQ ID NO: 39615 - DNA, 18 bp, Artificial Sequence
  Synthetic DNA
atttacgactcgctattg

SEQ ID NO: 39616 - DNA, 18 bp, Artificial Sequence
  Synthetic DNA
atttacgactcttaatag

SEQ ID NO: 39617 - DNA, 18 bp, Artificial Sequence
  Synthetic DNA
atttacgtctcactattg

SEQ ID NO: 39618 - DNA, 18 bp, Artificial Sequence
  Synthetic DNA
atttactacttactttag

SEQ ID NO: 39619 - DNA, 18 bp, Artificial Sequence
  Synthetic DNA
atttataacactctatag

SEQ ID NO: 39620 - DNA, 18 bp, Artificial Sequence
  Synthetic DNA
atttatgtatcactattg

SEQ ID NO: 39621 - DNA, 18 bp, Artificial Sequence
  Synthetic DNA
atttcatactcactatag

SEQ ID NO: 39622 - DNA, 18 bp, Artificial Sequence
  Synthetic DNA
atttctgactcacttaag

SEQ ID NO: 39623 - DNA, 18 bp, Artificial Sequence
  Synthetic DNA
caaaaagactcatcttag

SEQ ID NO: 39624 - DNA, 18 bp, Artificial Sequence
  Synthetic DNA
caaaacacctcacagaag

SEQ ID NO: 39625 - DNA, 18 bp, Artificial Sequence
  Synthetic DNA
caaaaccattcactttag

SEQ ID NO: 39626 - DNA, 18 bp, Artificial Sequence
  Synthetic DNA
caaaacgaatctcgatag

SEQ ID NO: 39627 - DNA, 18 bp, Artificial Sequence
  Synthetic DNA
caaaacgactcttaattg

SEQ ID NO: 39628 - DNA, 18 bp, Artificial Sequence
  Synthetic DNA
caaaacgagtcacattag

SEQ ID NO: 39629 - DNA, 18 bp, Artificial Sequence
  Synthetic DNA
caaaacgattctcaattg

SEQ ID NO: 39630 - DNA, 18 bp, Artificial Sequence
  Synthetic DNA
caaaacgtataactatag

SEQ ID NO: 39631 - DNA, 18 bp, Artificial Sequence
  Synthetic DNA
caaaacgtcactttatcg

SEQ ID NO: 39632 - DNA, 18 bp, Artificial Sequence
  Synthetic DNA
caaaacgtctcccattag

SEQ ID NO: 39633 - DNA, 18 bp, Artificial Sequence
  Synthetic DNA
caaaactagggactactg

SEQ ID NO: 39634 - DNA, 18 bp, Artificial Sequence
  Synthetic DNA
caaaatgactactaatag

SEQ ID NO: 39635 - DNA, 18 bp, Artificial Sequence
  Synthetic DNA
caaaccgacacactttag

SEQ ID NO: 39636 - DNA, 18 bp, Artificial Sequence
  Synthetic DNA
caaagcgacgcacagtag

SEQ ID NO: 39637 - DNA, 18 bp, Artificial Sequence
  Synthetic DNA
caaagcgtctcaatatag

SEQ ID NO: 39638 - DNA, 18 bp, Artificial Sequence
  Synthetic DNA
caaagcgttacactattg

SEQ ID NO: 39639 - DNA, 18 bp, Artificial Sequence
  Synthetic DNA
caaataatttgaaagtag

SEQ ID NO: 39640 - DNA, 18 bp, Artificial Sequence
  Synthetic DNA
caaatagactcaatatag

SEQ ID NO: 39641 - DNA, 18 bp, Artificial Sequence
  Synthetic DNA
caaatccattctctattg

SEQ ID NO: 39642 - DNA, 18 bp, Artificial Sequence
  Synthetic DNA
caaatcgactttctctag

SEQ ID NO: 39643 - DNA, 18 bp, Artificial Sequence
  Synthetic DNA
caaatcggctcgctttag

SEQ ID NO: 39644 - DNA, 18 bp, Artificial Sequence
  Synthetic DNA
caaatgtactctatttag

SEQ ID NO: 39645 - DNA, 18 bp, Artificial Sequence
  Synthetic DNA
caacaagacacagtatag

SEQ ID NO: 39646 - DNA, 18 bp, Artificial Sequence
  Synthetic DNA
caacacgacacacaaaag

SEQ ID NO: 39647 - DNA, 18 bp, Artificial Sequence
  Synthetic DNA
caacacgacacattaaag

SEQ ID NO: 39648 - DNA, 18 bp, Artificial Sequence
  Synthetic DNA
caacacgacttaatattg

SEQ ID NO: 39649 - DNA, 18 bp, Artificial Sequence
  Synthetic DNA
caacacgattcaacatag

SEQ ID NO: 39650 - DNA, 18 bp, Artificial Sequence
  Synthetic DNA
caacacgtctcacgaaag

SEQ ID NO: 39651 - DNA, 18 bp, Artificial Sequence
  Synthetic DNA
caacactactcacttaag

SEQ ID NO: 39652 - DNA, 18 bp, Artificial Sequence
  Synthetic DNA
caacactactctctaaag

SEQ ID NO: 39653 - DNA, 18 bp, Artificial Sequence
  Synthetic DNA
caacactacttaatatag

SEQ ID NO: 39654 - DNA, 18 bp, Artificial Sequence
  Synthetic DNA
caacatgcctaagtttag

SEQ ID NO: 39655 - DNA, 18 bp, Artificial Sequence
  Synthetic DNA
caactcgactcacaattg

SEQ ID NO: 39656 - DNA, 18 bp, Artificial Sequence
  Synthetic DNA
caactctaatatcaatag

SEQ ID NO: 39657 - DNA, 18 bp, Artificial Sequence
  Synthetic DNA
caagaacactcattctag

SEQ ID NO: 39658 - DNA, 18 bp, Artificial Sequence
  Synthetic DNA
caagacgacttatttaag

SEQ ID NO: 39659 - DNA, 18 bp, Artificial Sequence
  Synthetic DNA
caagacggttcaccttag

SEQ ID NO: 39660 - DNA, 18 bp, Artificial Sequence
  Synthetic DNA
caagacgtatcactaaag

SEQ ID NO: 39661 - DNA, 18 bp, Artificial Sequence
  Synthetic DNA
caagacttctcaccgtcg

SEQ ID NO: 39662 - DNA, 18 bp, Artificial Sequence
  Synthetic DNA
caagatgacccgctatag

SEQ ID NO: 39663 - DNA, 18 bp, Artificial Sequence
  Synthetic DNA
caataaatcccacattag

SEQ ID NO: 39664 - DNA, 18 bp, Artificial Sequence
  Synthetic DNA
caataaatttcactatag

SEQ ID NO: 39665 - DNA, 18 bp, Artificial Sequence
  Synthetic DNA
caataacaatccctatag

SEQ ID NO: 39666 - DNA, 18 bp, Artificial Sequence
  Synthetic DNA
caataagaacaacaaatg

SEQ ID NO: 39667 - DNA, 18 bp, Artificial Sequence
  Synthetic DNA
caataagaatccttattg

SEQ ID NO: 39668 - DNA, 18 bp, Artificial Sequence
  Synthetic DNA
caataagactcaagaaag

SEQ ID NO: 39669 - DNA, 18 bp, Artificial Sequence
  Synthetic DNA
caataagactcacctgag

SEQ ID NO: 39670 - DNA, 18 bp, Artificial Sequence
  Synthetic DNA
caataagactggctattg

SEQ ID NO: 39671 - DNA, 18 bp, Artificial Sequence
  Synthetic DNA
caataagttatactttag

SEQ ID NO: 39672 - DNA, 18 bp, Artificial Sequence
  Synthetic DNA
caataagttcccctttgg

SEQ ID NO: 39673 - DNA, 18 bp, Artificial Sequence
  Synthetic DNA
caataatactcaatatcg

SEQ ID NO: 39674 - DNA, 18 bp, Artificial Sequence
  Synthetic DNA
caatacaaatacctttag

SEQ ID NO: 39675 - DNA, 18 bp, Artificial Sequence
  Synthetic DNA
caatacaacccagtacag

SEQ ID NO: 39676 - DNA, 18 bp, Artificial Sequence
  Synthetic DNA
caatacaactcacaaccg

SEQ ID NO: 39677 - DNA, 18 bp, Artificial Sequence
  Synthetic DNA
caatacaattccctacag

SEQ ID NO: 39678 - DNA, 18 bp, Artificial Sequence
  Synthetic DNA
caatacagttcattatag

SEQ ID NO: 39679 - DNA, 18 bp, Artificial Sequence
  Synthetic DNA
caatacatcactttatag

SEQ ID NO: 39680 - DNA, 18 bp, Artificial Sequence
  Synthetic DNA
caatacatcccagtacag

SEQ ID NO: 39681 - DNA, 18 bp, Artificial Sequence
  Synthetic DNA
caataccacacacttcag

SEQ ID NO: 39682 - DNA, 18 bp, Artificial Sequence
  Synthetic DNA
caataccactgacttgag

SEQ ID NO: 39683 - DNA, 18 bp, Artificial Sequence
  Synthetic DNA
caatacccctaactctag

SEQ ID NO: 39684 - DNA, 18 bp, Artificial Sequence
  Synthetic DNA
caataccgctctcttttg

SEQ ID NO: 39685 - DNA, 18 bp, Artificial Sequence
  Synthetic DNA
caatacctctcaccttag

SEQ ID NO: 39686 - DNA, 18 bp, Artificial Sequence
  Synthetic DNA
caatacgacactccaatg

SEQ ID NO: 39687 - DNA, 18 bp, Artificial Sequence
  Synthetic DNA
caatacgacatgctaaag

SEQ ID NO: 39688 - DNA, 18 bp, Artificial Sequence
  Synthetic DNA
caatacgacgcacaaggg

SEQ ID NO: 39689 - DNA, 18 bp, Artificial Sequence
  Synthetic DNA
caatacgactactaaagg

SEQ ID NO: 39690 - DNA, 18 bp, Artificial Sequence
  Synthetic DNA
caatacgactcttaattg

SEQ ID NO: 39691 - DNA, 18 bp, Artificial Sequence
  Synthetic DNA
caatacgactgtttaaag

SEQ ID NO: 39692 - DNA, 18 bp, Artificial Sequence
  Synthetic DNA
caatacgagtcacttacg

SEQ ID NO: 39693 - DNA, 18 bp, Artificial Sequence
  Synthetic DNA
caatacgattctcaaaag

SEQ ID NO: 39694 - DNA, 18 bp, Artificial Sequence
  Synthetic DNA
caatacgcatcaataaag

SEQ ID NO: 39695 - DNA, 18 bp, Artificial Sequence
  Synthetic DNA
caatacgcgaaactgtcg

SEQ ID NO: 39696 - DNA, 18 bp, Artificial Sequence
  Synthetic DNA
caatacgcttatctttag

SEQ ID NO: 39697 - DNA, 18 bp, Artificial Sequence
  Synthetic DNA
caatacgtcacaatatcg

SEQ ID NO: 39698 - DNA, 18 bp, Artificial Sequence
  Synthetic DNA
caatacgtcacacaattg

SEQ ID NO: 39699 - DNA, 18 bp, Artificial Sequence
  Synthetic DNA
caatacgtctctcaaacg

SEQ ID NO: 39700 - DNA, 18 bp, Artificial Sequence
  Synthetic DNA
caatacgtgcgtctatag

SEQ ID NO: 39701 - DNA, 18 bp, Artificial Sequence
  Synthetic DNA
caatactaatcggcacag

SEQ ID NO: 39702 - DNA, 18 bp, Artificial Sequence
  Synthetic DNA
caatactaatggctttag

SEQ ID NO: 39703 - DNA, 18 bp, Artificial Sequence
  Synthetic DNA
caatactactctatttag

SEQ ID NO: 39704 - DNA, 18 bp, Artificial Sequence
  Synthetic DNA
caatactatatacattgg

SEQ ID NO: 39705 - DNA, 18 bp, Artificial Sequence
  Synthetic DNA
caatactgctcaccaaag

SEQ ID NO: 39706 - DNA, 18 bp, Artificial Sequence
  Synthetic DNA
caatacttctctatatag

SEQ ID NO: 39707 - DNA, 18 bp, Artificial Sequence
  Synthetic DNA
caatagaaatcactattg

SEQ ID NO: 39708 - DNA, 18 bp, Artificial Sequence
  Synthetic DNA
caataggagtcgcaagtg

SEQ ID NO: 39709 - DNA, 18 bp, Artificial Sequence
  Synthetic DNA
caatagggcgcactctag

SEQ ID NO: 39710 - DNA, 18 bp, Artificial Sequence
  Synthetic DNA
caataggtcacgcattag

SEQ ID NO: 39711 - DNA, 18 bp, Artificial Sequence
  Synthetic DNA
caatatcaatcctttaag

SEQ ID NO: 39712 - DNA, 18 bp, Artificial Sequence
  Synthetic DNA
caatatgaaactccatag

SEQ ID NO: 39713 - DNA, 18 bp, Artificial Sequence
  Synthetic DNA
caatatgaatcacaattg

SEQ ID NO: 39714 - DNA, 18 bp, Artificial Sequence
  Synthetic DNA
caatatgacccacttaag

SEQ ID NO: 39715 - DNA, 18 bp, Artificial Sequence
  Synthetic DNA
caatatgatcaactcttg

SEQ ID NO: 39716 - DNA, 18 bp, Artificial Sequence
  Synthetic DNA
caatatgattcacctttg

SEQ ID NO: 39717 - DNA, 18 bp, Artificial Sequence
  Synthetic DNA
caatatggctcaatttag

SEQ ID NO: 39718 - DNA, 18 bp, Artificial Sequence
  Synthetic DNA
caatattagaaactatag

SEQ ID NO: 39719 - DNA, 18 bp, Artificial Sequence
  Synthetic DNA
caatatttttctctaaag

SEQ ID NO: 39720 - DNA, 18 bp, Artificial Sequence
  Synthetic DNA
caatcagtcacacaacag

SEQ ID NO: 39721 - DNA, 18 bp, Artificial Sequence
  Synthetic DNA
caatcatcctcaccaaag

SEQ ID NO: 39722 - DNA, 18 bp, Artificial Sequence
  Synthetic DNA
caatccatctcacttttg

SEQ ID NO: 39723 - DNA, 18 bp, Artificial Sequence
  Synthetic DNA
caatcccaattcatatag

SEQ ID NO: 39724 - DNA, 18 bp, Artificial Sequence
  Synthetic DNA
caatccgacacactctcg

SEQ ID NO: 39725 - DNA, 18 bp, Artificial Sequence
  Synthetic DNA
caatccgcctcactgaag

SEQ ID NO: 39726 - DNA, 18 bp, Artificial Sequence
  Synthetic DNA
caatcggagtccctaaag

SEQ ID NO: 39727 - DNA, 18 bp, Artificial Sequence
  Synthetic DNA
caatctgattccataatg

SEQ ID NO: 39728 - DNA, 18 bp, Artificial Sequence
  Synthetic DNA
caatcttccgcacaactg

SEQ ID NO: 39729 - DNA, 18 bp, Artificial Sequence
  Synthetic DNA
caatgcgactctctaagg

SEQ ID NO: 39730 - DNA, 18 bp, Artificial Sequence
  Synthetic DNA
caatgcgtcacacattag

SEQ ID NO: 39731 - DNA, 18 bp, Artificial Sequence
  Synthetic DNA
caatgtgacaccgtatag

SEQ ID NO: 39732 - DNA, 18 bp, Artificial Sequence
  Synthetic DNA
caatgtgactcactaatg

SEQ ID NO: 39733 - DNA, 18 bp, Artificial Sequence
  Synthetic DNA
caatgtgtcacactagtg

SEQ ID NO: 39734 - DNA, 18 bp, Artificial Sequence
  Synthetic DNA
caattaaacaaactatag

SEQ ID NO: 39735 - DNA, 18 bp, Artificial Sequence
  Synthetic DNA
caattagccccactatag

SEQ ID NO: 39736 - DNA, 18 bp, Artificial Sequence
  Synthetic DNA
caattatattcattatag

SEQ ID NO: 39737 - DNA, 18 bp, Artificial Sequence
  Synthetic DNA
caattccactaaattttg

SEQ ID NO: 39738 - DNA, 18 bp, Artificial Sequence
  Synthetic DNA
caattccactcagcatgg

SEQ ID NO: 39739 - DNA, 18 bp, Artificial Sequence
  Synthetic DNA
caattcctctcagtatag

SEQ ID NO: 39740 - DNA, 18 bp, Artificial Sequence
  Synthetic DNA
caattcgactaaacatag

SEQ ID NO: 39741 - DNA, 18 bp, Artificial Sequence
  Synthetic DNA
caattcgagtatccaaag

SEQ ID NO: 39742 - DNA, 18 bp, Artificial Sequence
  Synthetic DNA
caattcgtctcagtttag

SEQ ID NO: 39743 - DNA, 18 bp, Artificial Sequence
  Synthetic DNA
caattctacactataatg

SEQ ID NO: 39744 - DNA, 18 bp, Artificial Sequence
  Synthetic DNA
caattctcctcacttatg

SEQ ID NO: 39745 - DNA, 18 bp, Artificial Sequence
  Synthetic DNA
caattgaactcacaattg

SEQ ID NO: 39746 - DNA, 18 bp, Artificial Sequence
  Synthetic DNA
caattggaattaccatag

SEQ ID NO: 39747 - DNA, 18 bp, Artificial Sequence
  Synthetic DNA
caatttaactcacaaaag

SEQ ID NO: 39748 - DNA, 18 bp, Artificial Sequence
  Synthetic DNA
caatttaactcataatag

SEQ ID NO: 39749 - DNA, 18 bp, Artificial Sequence
  Synthetic DNA
caatttatctcacaattg

SEQ ID NO: 39750 - DNA, 18 bp, Artificial Sequence
  Synthetic DNA
caatttgactcacataag

SEQ ID NO: 39751 - DNA, 18 bp, Artificial Sequence
  Synthetic DNA
caatttgtattactatag

SEQ ID NO: 39752 - DNA, 18 bp, Artificial Sequence
  Synthetic DNA
caatttgtctatttgtag

SEQ ID NO: 39753 - DNA, 18 bp, Artificial Sequence
  Synthetic DNA
cacagcaacactttattg

SEQ ID NO: 39754 - DNA, 18 bp, Artificial Sequence
  Synthetic DNA
cactacaagtccctttag

SEQ ID NO: 39755 - DNA, 18 bp, Artificial Sequence
  Synthetic DNA
cactaccattcgctatag

SEQ ID NO: 39756 - DNA, 18 bp, Artificial Sequence
  Synthetic DNA
cactacgaattacaatag

SEQ ID NO: 39757 - DNA, 18 bp, Artificial Sequence
  Synthetic DNA
cactacgacacataattg

SEQ ID NO: 39758 - DNA, 18 bp, Artificial Sequence
  Synthetic DNA
cactacgacaccctttag

SEQ ID NO: 39759 - DNA, 18 bp, Artificial Sequence
  Synthetic DNA
cactatgactccctattg

SEQ ID NO: 39760 - DNA, 18 bp, Artificial Sequence
  Synthetic DNA
cactatttctcactaaag

SEQ ID NO: 39761 - DNA, 18 bp, Artificial Sequence
  Synthetic DNA
cactcccactctttattg

SEQ ID NO: 39762 - DNA, 18 bp, Artificial Sequence
  Synthetic DNA
cactttaactctgtctag

SEQ ID NO: 39763 - DNA, 18 bp, Artificial Sequence
  Synthetic DNA
cactttgtttctctacag

SEQ ID NO: 39764 - DNA, 18 bp, Artificial Sequence
  Synthetic DNA
cagaacgactcacttatg

SEQ ID NO: 39765 - DNA, 18 bp, Artificial Sequence
  Synthetic DNA
cagtacaattagccatag

SEQ ID NO: 39766 - DNA, 18 bp, Artificial Sequence
  Synthetic DNA
cagtaccagttactaaag

SEQ ID NO: 39767 - DNA, 18 bp, Artificial Sequence
  Synthetic DNA
cagtacgactctcttgag

SEQ ID NO: 39768 - DNA, 18 bp, Artificial Sequence
  Synthetic DNA
cagtacgtccatttatag

SEQ ID NO: 39769 - DNA, 18 bp, Artificial Sequence
  Synthetic DNA
cagtactactcattagag

SEQ ID NO: 39770 - DNA, 18 bp, Artificial Sequence
  Synthetic DNA
cagtactattttaaatag

SEQ ID NO: 39771 - DNA, 18 bp, Artificial Sequence
  Synthetic DNA
cagtgttactcactactg

SEQ ID NO: 39772 - DNA, 18 bp, Artificial Sequence
  Synthetic DNA
cagttcgactttctaaag

SEQ ID NO: 39773 - DNA, 18 bp, Artificial Sequence
  Synthetic DNA
cataacgacaagctagag

SEQ ID NO: 39774 - DNA, 18 bp, Artificial Sequence
  Synthetic DNA
cataacgagtcacttaag

SEQ ID NO: 39775 - DNA, 18 bp, Artificial Sequence
  Synthetic DNA
cataactactcaccttag

SEQ ID NO: 39776 - DNA, 18 bp, Artificial Sequence
  Synthetic DNA
catatcgactcactacag

SEQ ID NO: 39777 - DNA, 18 bp, Artificial Sequence
  Synthetic DNA
catatcgattctaaatag

SEQ ID NO: 39778 - DNA, 18 bp, Artificial Sequence
  Synthetic DNA
catatctagtccatattg

SEQ ID NO: 39779 - DNA, 18 bp, Artificial Sequence
  Synthetic DNA
catcacaactttttatgg

SEQ ID NO: 39780 - DNA, 18 bp, Artificial Sequence
  Synthetic DNA
catcacgtgtcactaaag

SEQ ID NO: 39781 - DNA, 18 bp, Artificial Sequence
  Synthetic DNA
catctcgactcactttag

SEQ ID NO: 39782 - DNA, 18 bp, Artificial Sequence
  Synthetic DNA
catcttgccgctcgatag

SEQ ID NO: 39783 - DNA, 18 bp, Artificial Sequence
  Synthetic DNA
catgcagacactctctag

SEQ ID NO: 39784 - DNA, 18 bp, Artificial Sequence
  Synthetic DNA
cattaaaactcaggttag

SEQ ID NO: 39785 - DNA, 18 bp, Artificial Sequence
  Synthetic DNA
cattaagaaccactattg

SEQ ID NO: 39786 - DNA, 18 bp, Artificial Sequence
  Synthetic DNA
cattaagaccccttacag

SEQ ID NO: 39787 - DNA, 18 bp, Artificial Sequence
  Synthetic DNA
cattaagactccttactg

SEQ ID NO: 39788 - DNA, 18 bp, Artificial Sequence
  Synthetic DNA
cattaagtctcgctacag

SEQ ID NO: 39789 - DNA, 18 bp, Artificial Sequence
  Synthetic DNA
cattacgactctatattg

SEQ ID NO: 39790 - DNA, 18 bp, Artificial Sequence
  Synthetic DNA
cattacgactctcgtttg

SEQ ID NO: 39791 - DNA, 18 bp, Artificial Sequence
  Synthetic DNA
cattacggtacactactg

SEQ ID NO: 39792 - DNA, 18 bp, Artificial Sequence
  Synthetic DNA
cattacgtcaccctatag

SEQ ID NO: 39793 - DNA, 18 bp, Artificial Sequence
  Synthetic DNA
cattacgtctccctatgg

SEQ ID NO: 39794 - DNA, 18 bp, Artificial Sequence
  Synthetic DNA
cattacgtgtcaaaatag

SEQ ID NO: 39795 - DNA, 18 bp, Artificial Sequence
  Synthetic DNA
cattactactctccatag

SEQ ID NO: 39796 - DNA, 18 bp, Artificial Sequence
  Synthetic DNA
cattaggaatccctatag

SEQ ID NO: 39797 - DNA, 18 bp, Artificial Sequence
  Synthetic DNA
cattagtattcactatgg

SEQ ID NO: 39798 - DNA, 18 bp, Artificial Sequence
  Synthetic DNA
cattatggctcgctatcg

SEQ ID NO: 39799 - DNA, 18 bp, Artificial Sequence
  Synthetic DNA
cattatgtattactattg

SEQ ID NO: 39800 - DNA, 18 bp, Artificial Sequence
  Synthetic DNA
cattccaatttactgttg

SEQ ID NO: 39801 - DNA, 18 bp, Artificial Sequence
  Synthetic DNA
cattcccactccctctag

SEQ ID NO: 39802 - DNA, 18 bp, Artificial Sequence
  Synthetic DNA
cattcctccacttaaatg

SEQ ID NO: 39803 - DNA, 18 bp, Artificial Sequence
  Synthetic DNA
cattgcgactaacaattg

SEQ ID NO: 39804 - DNA, 18 bp, Artificial Sequence
  Synthetic DNA
cattgcgactcacttatg

SEQ ID NO: 39805 - DNA, 18 bp, Artificial Sequence
  Synthetic DNA
catttcaaatcattaaag

SEQ ID NO: 39806 - DNA, 18 bp, Artificial Sequence
  Synthetic DNA
catttctacacacaatag

SEQ ID NO: 39807 - DNA, 18 bp, Artificial Sequence
  Synthetic DNA
ccaaaagactcactaacg

SEQ ID NO: 39808 - DNA, 18 bp, Artificial Sequence
  Synthetic DNA
ccagacgatgcactatag

SEQ ID NO: 39809 - DNA, 18 bp, Artificial Sequence
  Synthetic DNA
ccagactactaactttag

SEQ ID NO: 39810 - DNA, 18 bp, Artificial Sequence
  Synthetic DNA
ccatacccttcactttgg

SEQ ID NO: 39811 - DNA, 18 bp, Artificial Sequence
  Synthetic DNA
ccatacctctcactatcg

SEQ ID NO: 39812 - DNA, 18 bp, Artificial Sequence
  Synthetic DNA
ccatacgactctgtcaag

SEQ ID NO: 39813 - DNA, 18 bp, Artificial Sequence
  Synthetic DNA
ccatacgactcttttcag

SEQ ID NO: 39814 - DNA, 18 bp, Artificial Sequence
  Synthetic DNA
ccatacgatacactgtag

SEQ ID NO: 39815 - DNA, 18 bp, Artificial Sequence
  Synthetic DNA
ccatacgccccaccatag

SEQ ID NO: 39816 - DNA, 18 bp, Artificial Sequence
  Synthetic DNA
ccatattactgacaatag

SEQ ID NO: 39817 - DNA, 18 bp, Artificial Sequence
  Synthetic DNA
ccatccaaatcagaatag

SEQ ID NO: 39818 - DNA, 18 bp, Artificial Sequence
  Synthetic DNA
ccatccgactcatattag

SEQ ID NO: 39819 - DNA, 18 bp, Artificial Sequence
  Synthetic DNA
ccatcggtctcattatag

SEQ ID NO: 39820 - DNA, 18 bp, Artificial Sequence
  Synthetic DNA
ccattagactttctattg

SEQ ID NO: 39821 - DNA, 18 bp, Artificial Sequence
  Synthetic DNA
ccattcgagtcacatttg

SEQ ID NO: 39822 - DNA, 18 bp, Artificial Sequence
  Synthetic DNA
ccttacaaaattctatag

SEQ ID NO: 39823 - DNA, 18 bp, Artificial Sequence
  Synthetic DNA
ccttacaacttctttgag

SEQ ID NO: 39824 - DNA, 18 bp, Artificial Sequence
  Synthetic DNA
ccttacgactgactaaag

SEQ ID NO: 39825 - DNA, 18 bp, Artificial Sequence
  Synthetic DNA
cgaaacttctgactattg

SEQ ID NO: 39826 - DNA, 18 bp, Artificial Sequence
  Synthetic DNA
cgaatcgactcagtatag

SEQ ID NO: 39827 - DNA, 18 bp, Artificial Sequence
  Synthetic DNA
cgatacaaccaaaaatag

SEQ ID NO: 39828 - DNA, 18 bp, Artificial Sequence
  Synthetic DNA
cgatacccttcttcaaag

SEQ ID NO: 39829 - DNA, 18 bp, Artificial Sequence
  Synthetic DNA
cgatacgacgcgcaatag

SEQ ID NO: 39830 - DNA, 18 bp, Artificial Sequence
  Synthetic DNA
cgatacgactgcatatcg

SEQ ID NO: 39831 - DNA, 18 bp, Artificial Sequence
  Synthetic DNA
cgatacgagtcagtattg

SEQ ID NO: 39832 - DNA, 18 bp, Artificial Sequence
  Synthetic DNA
cgatacgtcacactacag

SEQ ID NO: 39833 - DNA, 18 bp, Artificial Sequence
  Synthetic DNA
cgataggacgcattttag

SEQ ID NO: 39834 - DNA, 18 bp, Artificial Sequence
  Synthetic DNA
cgattctcctcattatag

SEQ ID NO: 39835 - DNA, 18 bp, Artificial Sequence
  Synthetic DNA
cgctaccactcaaaatag

SEQ ID NO: 39836 - DNA, 18 bp, Artificial Sequence
  Synthetic DNA
cgctacccctcactatag

SEQ ID NO: 39837 - DNA, 18 bp, Artificial Sequence
  Synthetic DNA
cgtaactgttcagtcaag

SEQ ID NO: 39838 - DNA, 18 bp, Artificial Sequence
  Synthetic DNA
cgtaaggacaaactttag

SEQ ID NO: 39839 - DNA, 18 bp, Artificial Sequence
  Synthetic DNA
cgttacgattcactattg

SEQ ID NO: 39840 - DNA, 18 bp, Artificial Sequence
  Synthetic DNA
ctaaacataatagtgacg

SEQ ID NO: 39841 - DNA, 18 bp, Artificial Sequence
  Synthetic DNA
ctaaacatcttattatag

SEQ ID NO: 39842 - DNA, 18 bp, Artificial Sequence
  Synthetic DNA
ctaaacgaatcaatatgg

SEQ ID NO: 39843 - DNA, 18 bp, Artificial Sequence
  Synthetic DNA
ctaaacgactcaccacag

SEQ ID NO: 39844 - DNA, 18 bp, Artificial Sequence
  Synthetic DNA
ctaaacgcctcacaattg

SEQ ID NO: 39845 - DNA, 18 bp, Artificial Sequence
  Synthetic DNA
ctaatcgacaaaggatag

SEQ ID NO: 39846 - DNA, 18 bp, Artificial Sequence
  Synthetic DNA
ctaatcgactcacaatcg

SEQ ID NO: 39847 - DNA, 18 bp, Artificial Sequence
  Synthetic DNA
ctaatcgactcgctttag

SEQ ID NO: 39848 - DNA, 18 bp, Artificial Sequence
  Synthetic DNA
ctacacgactacctatag

SEQ ID NO: 39849 - DNA, 18 bp, Artificial Sequence
  Synthetic DNA
ctacacgcctcgctaacg

SEQ ID NO: 39850 - DNA, 18 bp, Artificial Sequence
  Synthetic DNA
ctataagagtttttatag

SEQ ID NO: 39851 - DNA, 18 bp, Artificial Sequence
  Synthetic DNA
ctataagtataactgctg

SEQ ID NO: 39852 - DNA, 18 bp, Artificial Sequence
  Synthetic DNA
ctatacaactcgctaaag

SEQ ID NO: 39853 - DNA, 18 bp, Artificial Sequence
  Synthetic DNA
ctatacaactctctatgg

SEQ ID NO: 39854 - DNA, 18 bp, Artificial Sequence
  Synthetic DNA
ctatacaattcactattg

SEQ ID NO: 39855 - DNA, 18 bp, Artificial Sequence
  Synthetic DNA
ctatacgacaccctattg

SEQ ID NO: 39856 - DNA, 18 bp, Artificial Sequence
  Synthetic DNA
ctatacgacgttataacg

SEQ ID NO: 39857 - DNA, 18 bp, Artificial Sequence
  Synthetic DNA
ctatacgactagctatcg

SEQ ID NO: 39858 - DNA, 18 bp, Artificial Sequence
  Synthetic DNA
ctatacgactcacatttg

SEQ ID NO: 39859 - DNA, 18 bp, Artificial Sequence
  Synthetic DNA
ctatacgagtaaccatag

SEQ ID NO: 39860 - DNA, 18 bp, Artificial Sequence
  Synthetic DNA
ctatacgattcatcttag

SEQ ID NO: 39861 - DNA, 18 bp, Artificial Sequence
  Synthetic DNA
ctatacgctttaacatcg

SEQ ID NO: 39862 - DNA, 18 bp, Artificial Sequence
  Synthetic DNA
ctatacgtcatacattag

SEQ ID NO: 39863 - DNA, 18 bp, Artificial Sequence
  Synthetic DNA
ctatacgtccaacgaaag

SEQ ID NO: 39864 - DNA, 18 bp, Artificial Sequence
  Synthetic DNA
ctatactacttactaaag

SEQ ID NO: 39865 - DNA, 18 bp, Artificial Sequence
  Synthetic DNA
ctatactccactcttttg

SEQ ID NO: 39866 - DNA, 18 bp, Artificial Sequence
  Synthetic DNA
ctatacttcttagtcttg

SEQ ID NO: 39867 - DNA, 18 bp, Artificial Sequence
  Synthetic DNA
ctatataagccactatag

SEQ ID NO: 39868 - DNA, 18 bp, Artificial Sequence
  Synthetic DNA
ctatatgattctctatag

SEQ ID NO: 39869 - DNA, 18 bp, Artificial Sequence
  Synthetic DNA
ctatatgtctaacttttg

SEQ ID NO: 39870 - DNA, 18 bp, Artificial Sequence
  Synthetic DNA
ctatattaatcactatag

SEQ ID NO: 39871 - DNA, 18 bp, Artificial Sequence
  Synthetic DNA
ctatgcaacagacaattg

SEQ ID NO: 39872 - DNA, 18 bp, Artificial Sequence
  Synthetic DNA
ctatgcgacccacaatag

SEQ ID NO: 39873 - DNA, 18 bp, Artificial Sequence
  Synthetic DNA
ctatgcgagtccgtattg

SEQ ID NO: 39874 - DNA, 18 bp, Artificial Sequence
  Synthetic DNA
ctattagacacacaatag

SEQ ID NO: 39875 - DNA, 18 bp, Artificial Sequence
  Synthetic DNA
ctattagatactctatag

SEQ ID NO: 39876 - DNA, 18 bp, Artificial Sequence
  Synthetic DNA
ctattcgacacactttag

SEQ ID NO: 39877 - DNA, 18 bp, Artificial Sequence
  Synthetic DNA
ctcaacctatcattttag

SEQ ID NO: 39878 - DNA, 18 bp, Artificial Sequence
  Synthetic DNA
ctcaacggctcactagtg

SEQ ID NO: 39879 - DNA, 18 bp, Artificial Sequence
  Synthetic DNA
ctccatgagtctccattg

SEQ ID NO: 39880 - DNA, 18 bp, Artificial Sequence
  Synthetic DNA
ctctaagactcacattag

SEQ ID NO: 39881 - DNA, 18 bp, Artificial Sequence
  Synthetic DNA
ctctacgtctcattatcg

SEQ ID NO: 39882 - DNA, 18 bp, Artificial Sequence
  Synthetic DNA
ctctatgacatgcaatag

SEQ ID NO: 39883 - DNA, 18 bp, Artificial Sequence
  Synthetic DNA
ctgatcgactcactattg

SEQ ID NO: 39884 - DNA, 18 bp, Artificial Sequence
  Synthetic DNA
ctggactactcacgtaag

SEQ ID NO: 39885 - DNA, 18 bp, Artificial Sequence
  Synthetic DNA
cttagggactcactatag

SEQ ID NO: 39886 - DNA, 18 bp, Artificial Sequence
  Synthetic DNA
cttatcgactctttatag

SEQ ID NO: 39887 - DNA, 18 bp, Artificial Sequence
  Synthetic DNA
cttatcgattctctgaag

SEQ ID NO: 39888 - DNA, 18 bp, Artificial Sequence
  Synthetic DNA
ctttaatactatcaatag

SEQ ID NO: 39889 - DNA, 18 bp, Artificial Sequence
  Synthetic DNA
ctttacaacaaactacag

SEQ ID NO: 39890 - DNA, 18 bp, Artificial Sequence
  Synthetic DNA
ctttacaactcaatatag

SEQ ID NO: 39891 - DNA, 18 bp, Artificial Sequence
  Synthetic DNA
ctttacgacattatatcg

SEQ ID NO: 39892 - DNA, 18 bp, Artificial Sequence
  Synthetic DNA
ctttacgactcacataag

SEQ ID NO: 39893 - DNA, 18 bp, Artificial Sequence
  Synthetic DNA
ctttacgagtcaatatcg

SEQ ID NO: 39894 - DNA, 18 bp, Artificial Sequence
  Synthetic DNA
ctttgcgacacaccatag

SEQ ID NO: 39895 - DNA, 18 bp, Artificial Sequence
  Synthetic DNA
cttttcgactaactatag

SEQ ID NO: 39896 - DNA, 18 bp, Artificial Sequence
  Synthetic DNA
cttttcgactcaggtaag

SEQ ID NO: 39897 - DNA, 18 bp, Artificial Sequence
  Synthetic DNA
gaaaaagactgactatcg

SEQ ID NO: 39898 - DNA, 18 bp, Artificial Sequence
  Synthetic DNA
gaaaaccacaatatatag

SEQ ID NO: 39899 - DNA, 18 bp, Artificial Sequence
  Synthetic DNA
gaaaaccagtcagcatag

SEQ ID NO: 39900 - DNA, 18 bp, Artificial Sequence
  Synthetic DNA
gaaaacgtctcacaattg

SEQ ID NO: 39901 - DNA, 18 bp, Artificial Sequence
  Synthetic DNA
gaaaagggcacgctatag

SEQ ID NO: 39902 - DNA, 18 bp, Artificial Sequence
  Synthetic DNA
gaaaccggttcactatag

SEQ ID NO: 39903 - DNA, 18 bp, Artificial Sequence
  Synthetic DNA
gaaacctacactgtatag

SEQ ID NO: 39904 - DNA, 18 bp, Artificial Sequence
  Synthetic DNA
gaaataaactcactatag

SEQ ID NO: 39905 - DNA, 18 bp, Artificial Sequence
  Synthetic DNA
gaaatcaactctgttaag

SEQ ID NO: 39906 - DNA, 18 bp, Artificial Sequence
  Synthetic DNA
gaaatctacttactatag

SEQ ID NO: 39907 - DNA, 18 bp, Artificial Sequence
  Synthetic DNA
gaacacgattcactctgg

SEQ ID NO: 39908 - DNA, 18 bp, Artificial Sequence
  Synthetic DNA
gaacataaccaactctag

SEQ ID NO: 39909 - DNA, 18 bp, Artificial Sequence
  Synthetic DNA
gaagataacacaccatgg

SEQ ID NO: 39910 - DNA, 18 bp, Artificial Sequence
  Synthetic DNA
gaataacacttacctaag

SEQ ID NO: 39911 - DNA, 18 bp, Artificial Sequence
  Synthetic DNA
gaatacaacgctctttcg

SEQ ID NO: 39912 - DNA, 18 bp, Artificial Sequence
  Synthetic DNA
gaatacaccgcacattag

SEQ ID NO: 39913 - DNA, 18 bp, Artificial Sequence
  Synthetic DNA
gaataccagtcgctattg

SEQ ID NO: 39914 - DNA, 18 bp, Artificial Sequence
  Synthetic DNA
gaatacgaaacaccttag

SEQ ID NO: 39915 - DNA, 18 bp, Artificial Sequence
  Synthetic DNA
gaatacgactatttaagg

SEQ ID NO: 39916 - DNA, 18 bp, Artificial Sequence
  Synthetic DNA
gaatacgactgacttatg

SEQ ID NO: 39917 - DNA, 18 bp, Artificial Sequence
  Synthetic DNA
gaatacgatcaattctcg

SEQ ID NO: 39918 - DNA, 18 bp, Artificial Sequence
  Synthetic DNA
gaatacgtcggaatttag

SEQ ID NO: 39919 - DNA, 18 bp, Artificial Sequence
  Synthetic DNA
gaatactacacaactttg

SEQ ID NO: 39920 - DNA, 18 bp, Artificial Sequence
  Synthetic DNA
gaataggaatcatttatg

SEQ ID NO: 39921 - DNA, 18 bp, Artificial Sequence
  Synthetic DNA
gaatatgattttcaatag

SEQ ID NO: 39922 - DNA, 18 bp, Artificial Sequence
  Synthetic DNA
gaatatttgtcactattg

SEQ ID NO: 39923 - DNA, 18 bp, Artificial Sequence
  Synthetic DNA
gaatccggttcagtatcg

SEQ ID NO: 39924 - DNA, 18 bp, Artificial Sequence
  Synthetic DNA
gaatcggacgctcttacg

SEQ ID NO: 39925 - DNA, 18 bp, Artificial Sequence
  Synthetic DNA
gaatgcgcctcaccatcg

SEQ ID NO: 39926 - DNA, 18 bp, Artificial Sequence
  Synthetic DNA
gaattagaataactatag

SEQ ID NO: 39927 - DNA, 18 bp, Artificial Sequence
  Synthetic DNA
gaattagactcacctcgg

SEQ ID NO: 39928 - DNA, 18 bp, Artificial Sequence
  Synthetic DNA
gaattagtctaactattg

SEQ ID NO: 39929 - DNA, 18 bp, Artificial Sequence
  Synthetic DNA
gaattcgaagtactattg

SEQ ID NO: 39930 - DNA, 18 bp, Artificial Sequence
  Synthetic DNA
gaattcgaatctctaaag

SEQ ID NO: 39931 - DNA, 18 bp, Artificial Sequence
  Synthetic DNA
gaattctactttttaaag

SEQ ID NO: 39932 - DNA, 18 bp, Artificial Sequence
  Synthetic DNA
gaattggactctttatag

SEQ ID NO: 39933 - DNA, 18 bp, Artificial Sequence
  Synthetic DNA
gacgacaacacagaattg

SEQ ID NO: 39934 - DNA, 18 bp, Artificial Sequence
  Synthetic DNA
gacgtagactcgacatag

SEQ ID NO: 39935 - DNA, 18 bp, Artificial Sequence
  Synthetic DNA
gactaagatactctttag

SEQ ID NO: 39936 - DNA, 18 bp, Artificial Sequence
  Synthetic DNA
gactaggtctgtctatag

SEQ ID NO: 39937 - DNA, 18 bp, Artificial Sequence
  Synthetic DNA
gacttcgactcataatag

SEQ ID NO: 39938 - DNA, 18 bp, Artificial Sequence
  Synthetic DNA
gagaactactcactaaag

SEQ ID NO: 39939 - DNA, 18 bp, Artificial Sequence
  Synthetic DNA
gagcacctctcacttagg

SEQ ID NO: 39940 - DNA, 18 bp, Artificial Sequence
  Synthetic DNA
gagtacacctcactaaag

SEQ ID NO: 39941 - DNA, 18 bp, Artificial Sequence
  Synthetic DNA
gagtacgtctcagtacag

SEQ ID NO: 39942 - DNA, 18 bp, Artificial Sequence
  Synthetic DNA
gagtgtgaatcactaaag

SEQ ID NO: 39943 - DNA, 18 bp, Artificial Sequence
  Synthetic DNA
gataaagactctcaatag

SEQ ID NO: 39944 - DNA, 18 bp, Artificial Sequence
  Synthetic DNA
gataaaggctcactatag

SEQ ID NO: 39945 - DNA, 18 bp, Artificial Sequence
  Synthetic DNA
gataatgagtcactatag

SEQ ID NO: 39946 - DNA, 18 bp, Artificial Sequence
  Synthetic DNA
gatatccactaactttag

SEQ ID NO: 39947 - DNA, 18 bp, Artificial Sequence
  Synthetic DNA
gatatcgaaacaatatag

SEQ ID NO: 39948 - DNA, 18 bp, Artificial Sequence
  Synthetic DNA
gatatcgtctcactatag

SEQ ID NO: 39949 - DNA, 18 bp, Artificial Sequence
  Synthetic DNA
gatcagtactcactatag

SEQ ID NO: 39950 - DNA, 18 bp, Artificial Sequence
  Synthetic DNA
gatcatcactaactatcg

SEQ ID NO: 39951 - DNA, 18 bp, Artificial Sequence
  Synthetic DNA
gattacaactcacattag

SEQ ID NO: 39952 - DNA, 18 bp, Artificial Sequence
  Synthetic DNA
gattaccatgcacaacag

SEQ ID NO: 39953 - DNA, 18 bp, Artificial Sequence
  Synthetic DNA
gattacgagttactcttg

SEQ ID NO: 39954 - DNA, 18 bp, Artificial Sequence
  Synthetic DNA
gattacgcctcacaaaag

SEQ ID NO: 39955 - DNA, 18 bp, Artificial Sequence
  Synthetic DNA
gattatgactaactatcg

SEQ ID NO: 39956 - DNA, 18 bp, Artificial Sequence
  Synthetic DNA
gattattactctttattg

SEQ ID NO: 39957 - DNA, 18 bp, Artificial Sequence
  Synthetic DNA
gattccgacacactttag

SEQ ID NO: 39958 - DNA, 18 bp, Artificial Sequence
  Synthetic DNA
gattgcgattctctattg

SEQ ID NO: 39959 - DNA, 18 bp, Artificial Sequence
  Synthetic DNA
gatttcgtttcactatag

SEQ ID NO: 39960 - DNA, 18 bp, Artificial Sequence
  Synthetic DNA
gcaaaccacacaatcaag

SEQ ID NO: 39961 - DNA, 18 bp, Artificial Sequence
  Synthetic DNA
gcaaccgactcattatag

SEQ ID NO: 39962 - DNA, 18 bp, Artificial Sequence
  Synthetic DNA
gcaattgcctcacgttag

SEQ ID NO: 39963 - DNA, 18 bp, Artificial Sequence
  Synthetic DNA
gcactcgactccttgtgg

SEQ ID NO: 39964 - DNA, 18 bp, Artificial Sequence
  Synthetic DNA
gcataccagtcacaacag

SEQ ID NO: 39965 - DNA, 18 bp, Artificial Sequence
  Synthetic DNA
gcataccatacactttag

SEQ ID NO: 39966 - DNA, 18 bp, Artificial Sequence
  Synthetic DNA
gcattcgtctctctatag

SEQ ID NO: 39967 - DNA, 18 bp, Artificial Sequence
  Synthetic DNA
gcttacgacaaactattg

SEQ ID NO: 39968 - DNA, 18 bp, Artificial Sequence
  Synthetic DNA
gcttacgattcgctgaag

SEQ ID NO: 39969 - DNA, 18 bp, Artificial Sequence
  Synthetic DNA
gcttgagactcactatag

SEQ ID NO: 39970 - DNA, 18 bp, Artificial Sequence
  Synthetic DNA
ggaaactcctcactaaag

SEQ ID NO: 39971 - DNA, 18 bp, Artificial Sequence
  Synthetic DNA
ggataatacacactatcg

SEQ ID NO: 39972 - DNA, 18 bp, Artificial Sequence
  Synthetic DNA
ggatacatcactgtatag

SEQ ID NO: 39973 - DNA, 18 bp, Artificial Sequence
  Synthetic DNA
ggatacccgtctctagag

SEQ ID NO: 39974 - DNA, 18 bp, Artificial Sequence
  Synthetic DNA
ggatacgtcagactatag

SEQ ID NO: 39975 - DNA, 18 bp, Artificial Sequence
  Synthetic DNA
ggatactacttacaattg

SEQ ID NO: 39976 - DNA, 18 bp, Artificial Sequence
  Synthetic DNA
ggatccgaataactacag

SEQ ID NO: 39977 - DNA, 18 bp, Artificial Sequence
  Synthetic DNA
ggctataacacacaattg

SEQ ID NO: 39978 - DNA, 18 bp, Artificial Sequence
  Synthetic DNA
gtaaacccctaacaatag

SEQ ID NO: 39979 - DNA, 18 bp, Artificial Sequence
  Synthetic DNA
gtaaacgactgaatattg

SEQ ID NO: 39980 - DNA, 18 bp, Artificial Sequence
  Synthetic DNA
gtaaacggccctctattg

SEQ ID NO: 39981 - DNA, 18 bp, Artificial Sequence
  Synthetic DNA
gtacagctattgttatag

SEQ ID NO: 39982 - DNA, 18 bp, Artificial Sequence
  Synthetic DNA
gtagaatactcaccatcg

SEQ ID NO: 39983 - DNA, 18 bp, Artificial Sequence
  Synthetic DNA
gtataagcctcactccag

SEQ ID NO: 39984 - DNA, 18 bp, Artificial Sequence
  Synthetic DNA
gtatacgagtcacatcag

SEQ ID NO: 39985 - DNA, 18 bp, Artificial Sequence
  Synthetic DNA
gtatactactctatatag

SEQ ID NO: 39986 - DNA, 18 bp, Artificial Sequence
  Synthetic DNA
gtatacttcgcactttag

SEQ ID NO: 39987 - DNA, 18 bp, Artificial Sequence
  Synthetic DNA
gtatataatacacttttg

SEQ ID NO: 39988 - DNA, 18 bp, Artificial Sequence
  Synthetic DNA
gtatatgacaaacaatag

SEQ ID NO: 39989 - DNA, 18 bp, Artificial Sequence
  Synthetic DNA
gtatatgacacactaatg

SEQ ID NO: 39990 - DNA, 18 bp, Artificial Sequence
  Synthetic DNA
gtatattacacagtatag

SEQ ID NO: 39991 - DNA, 18 bp, Artificial Sequence
  Synthetic DNA
gtatccgactcccaaaag

SEQ ID NO: 39992 - DNA, 18 bp, Artificial Sequence
  Synthetic DNA
gtatgcaactcacattag

SEQ ID NO: 39993 - DNA, 18 bp, Artificial Sequence
  Synthetic DNA
gtattcgaatcgctatag

SEQ ID NO: 39994 - DNA, 18 bp, Artificial Sequence
  Synthetic DNA
gtattcgaatgactatag

SEQ ID NO: 39995 - DNA, 18 bp, Artificial Sequence
  Synthetic DNA
gtattcggcctactatag

SEQ ID NO: 39996 - DNA, 18 bp, Artificial Sequence
  Synthetic DNA
gtattcttctctctatag

SEQ ID NO: 39997 - DNA, 18 bp, Artificial Sequence
  Synthetic DNA
gtctacgaccctttatag

SEQ ID NO: 39998 - DNA, 18 bp, Artificial Sequence
  Synthetic DNA
gtgacgtggtctctttag

SEQ ID NO: 39999 - DNA, 18 bp, Artificial Sequence
  Synthetic DNA
gtgtaagcctcactaaag

SEQ ID NO: 40000 - DNA, 18 bp, Artificial Sequence
  Synthetic DNA
gtgtacgattcaatatag

SEQ ID NO: 40001 - DNA, 18 bp, Artificial Sequence
  Synthetic DNA
gtgtaggactctctcaag

SEQ ID NO: 40002 - DNA, 18 bp, Artificial Sequence
  Synthetic DNA
gtgtatgtctcactatag

SEQ ID NO: 40003 - DNA, 18 bp, Artificial Sequence
  Synthetic DNA
gttgaagcctatcaagag

SEQ ID NO: 40004 - DNA, 18 bp, Artificial Sequence
  Synthetic DNA
gttgacgaatcgcaatag

SEQ ID NO: 40005 - DNA, 18 bp, Artificial Sequence
  Synthetic DNA
gtttacgaatcaacatag

SEQ ID NO: 40006 - DNA, 18 bp, Artificial Sequence
  Synthetic DNA
gttttagactcactatag

SEQ ID NO: 40007 - DNA, 18 bp, Artificial Sequence
  Synthetic DNA
gttttcgactctctttag

SEQ ID NO: 40008 - DNA, 18 bp, Artificial Sequence
  Synthetic DNA
taaaaaaaatcgctaaag

SEQ ID NO: 40009 - DNA, 18 bp, Artificial Sequence
  Synthetic DNA
taaaaacacattatatgg

SEQ ID NO: 40010 - DNA, 18 bp, Artificial Sequence
  Synthetic DNA
taaaaagaatcgctattg

SEQ ID NO: 40011 - DNA, 18 bp, Artificial Sequence
  Synthetic DNA
taaaaagaatgattatcg

SEQ ID NO: 40012 - DNA, 18 bp, Artificial Sequence
  Synthetic DNA
taaaaagacaaaaaatag

SEQ ID NO: 40013 - DNA, 18 bp, Artificial Sequence
  Synthetic DNA
taaaaagacataaaattg

SEQ ID NO: 40014 - DNA, 18 bp, Artificial Sequence
  Synthetic DNA
taaaaagaccaactatgg

SEQ ID NO: 40015 - DNA, 18 bp, Artificial Sequence
  Synthetic DNA
taaaaagactcatctcag

SEQ ID NO: 40016 - DNA, 18 bp, Artificial Sequence
  Synthetic DNA
taaaaagagtccctaatg

SEQ ID NO: 40017 - DNA, 18 bp, Artificial Sequence
  Synthetic DNA
taaaaagcctcatctatg

SEQ ID NO: 40018 - DNA, 18 bp, Artificial Sequence
  Synthetic DNA
taaaaagcctcgctctag

SEQ ID NO: 40019 - DNA, 18 bp, Artificial Sequence
  Synthetic DNA
taaaaagtatcactttcg

SEQ ID NO: 40020 - DNA, 18 bp, Artificial Sequence
  Synthetic DNA
taaaaagtctctaattag

SEQ ID NO: 40021 - DNA, 18 bp, Artificial Sequence
  Synthetic DNA
taaaaagtctctctttag

SEQ ID NO: 40022 - DNA, 18 bp, Artificial Sequence
  Synthetic DNA
taaaaagtcttactattg

SEQ ID NO: 40023 - DNA, 18 bp, Artificial Sequence
  Synthetic DNA
taaaacaactcacgtaag

SEQ ID NO: 40024 - DNA, 18 bp, Artificial Sequence
  Synthetic DNA
taaaacaactctatttag

SEQ ID NO: 40025 - DNA, 18 bp, Artificial Sequence
  Synthetic DNA
taaaacaactgacaattg

SEQ ID NO: 40026 - DNA, 18 bp, Artificial Sequence
  Synthetic DNA
taaaacaattcacaattg

SEQ ID NO: 40027 - DNA, 18 bp, Artificial Sequence
  Synthetic DNA
taaaacagctctgttttg

SEQ ID NO: 40028 - DNA, 18 bp, Artificial Sequence
  Synthetic DNA
taaaacatctcacccgag

SEQ ID NO: 40029 - DNA, 18 bp, Artificial Sequence
  Synthetic DNA
taaaaccaccctatattg

SEQ ID NO: 40030 - DNA, 18 bp, Artificial Sequence
  Synthetic DNA
taaaaccaccctcacaag

SEQ ID NO: 40031 - DNA, 18 bp, Artificial Sequence
  Synthetic DNA
taaaaccacgtaataaag

SEQ ID NO: 40032 - DNA, 18 bp, Artificial Sequence
  Synthetic DNA
taaaaccactaacaagcg

SEQ ID NO: 40033 - DNA, 18 bp, Artificial Sequence
  Synthetic DNA
taaaaccactcataatcg

SEQ ID NO: 40034 - DNA, 18 bp, Artificial Sequence
  Synthetic DNA
taaaacctttctctattg

SEQ ID NO: 40035 - DNA, 18 bp, Artificial Sequence
  Synthetic DNA
taaaacgaaacattaaag

SEQ ID NO: 40036 - DNA, 18 bp, Artificial Sequence
  Synthetic DNA
taaaacgaagaactattg

SEQ ID NO: 40037 - DNA, 18 bp, Artificial Sequence
  Synthetic DNA
taaaacgaattacattag

SEQ ID NO: 40038 - DNA, 18 bp, Artificial Sequence
  Synthetic DNA
taaaacgacaatcattag

SEQ ID NO: 40039 - DNA, 18 bp, Artificial Sequence
  Synthetic DNA
taaaacgacactttaaag

SEQ ID NO: 40040 - DNA, 18 bp, Artificial Sequence
  Synthetic DNA
taaaacgacatacttctg

SEQ ID NO: 40041 - DNA, 18 bp, Artificial Sequence
  Synthetic DNA
taaaacgacattcaatag

SEQ ID NO: 40042 - DNA, 18 bp, Artificial Sequence
  Synthetic DNA
taaaacgaccaactaggg

SEQ ID NO: 40043 - DNA, 18 bp, Artificial Sequence
  Synthetic DNA
taaaacgaccctctcttg

SEQ ID NO: 40044 - DNA, 18 bp, Artificial Sequence
  Synthetic DNA
taaaacgacgcagattag

SEQ ID NO: 40045 - DNA, 18 bp, Artificial Sequence
  Synthetic DNA
taaaacgacgctgtaccg

SEQ ID NO: 40046 - DNA, 18 bp, Artificial Sequence
  Synthetic DNA
taaaacgactatcctaag

SEQ ID NO: 40047 - DNA, 18 bp, Artificial Sequence
  Synthetic DNA
taaaacgactgcttctag

SEQ ID NO: 40048 - DNA, 18 bp, Artificial Sequence
  Synthetic DNA
taaaacgacttaacaaag

SEQ ID NO: 40049 - DNA, 18 bp, Artificial Sequence
  Synthetic DNA
taaaacgagatacttgag

SEQ ID NO: 40050 - DNA, 18 bp, Artificial Sequence
  Synthetic DNA
taaaacgagtaattctgg

SEQ ID NO: 40051 - DNA, 18 bp, Artificial Sequence
  Synthetic DNA
taaaacgatacattattg

SEQ ID NO: 40052 - DNA, 18 bp, Artificial Sequence
  Synthetic DNA
taaaacgattgactgaag

SEQ ID NO: 40053 - DNA, 18 bp, Artificial Sequence
  Synthetic DNA
taaaacgattgccgattg

SEQ ID NO: 40054 - DNA, 18 bp, Artificial Sequence
  Synthetic DNA
taaaacgcctaaatctag

SEQ ID NO: 40055 - DNA, 18 bp, Artificial Sequence
  Synthetic DNA
taaaacgcctctatctag

SEQ ID NO: 40056 - DNA, 18 bp, Artificial Sequence
  Synthetic DNA
taaaacggataactgtag

SEQ ID NO: 40057 - DNA, 18 bp, Artificial Sequence
  Synthetic DNA
taaaacggatcagtacag

SEQ ID NO: 40058 - DNA, 18 bp, Artificial Sequence
  Synthetic DNA
taaaacggctgattcaag

SEQ ID NO: 40059 - DNA, 18 bp, Artificial Sequence
  Synthetic DNA
taaaacgtatcgttatag

SEQ ID NO: 40060 - DNA, 18 bp, Artificial Sequence
  Synthetic DNA
taaaacgtatgactaaag

SEQ ID NO: 40061 - DNA, 18 bp, Artificial Sequence
  Synthetic DNA
taaaacgtcacaccccag

SEQ ID NO: 40062 - DNA, 18 bp, Artificial Sequence
  Synthetic DNA
taaaacgtcactccatcg

SEQ ID NO: 40063 - DNA, 18 bp, Artificial Sequence
  Synthetic DNA
taaaacgtccgactatgg

SEQ ID NO: 40064 - DNA, 18 bp, Artificial Sequence
  Synthetic DNA
taaaacgtctcgcttttg

SEQ ID NO: 40065 - DNA, 18 bp, Artificial Sequence
  Synthetic DNA
taaaacgtctctatctag

SEQ ID NO: 40066 - DNA, 18 bp, Artificial Sequence
  Synthetic DNA
taaaacgtctctccatgg

SEQ ID NO: 40067 - DNA, 18 bp, Artificial Sequence
  Synthetic DNA
taaaacgtctgactaatg

SEQ ID NO: 40068 - DNA, 18 bp, Artificial Sequence
  Synthetic DNA
taaaacgtcttattgtgg

SEQ ID NO: 40069 - DNA, 18 bp, Artificial Sequence
  Synthetic DNA
taaaacgtcttgctgtag

SEQ ID NO: 40070 - DNA, 18 bp, Artificial Sequence
  Synthetic DNA
taaaacgtgacacttaag

SEQ ID NO: 40071 - DNA, 18 bp, Artificial Sequence
  Synthetic DNA
taaaacgtgtcactaatg

SEQ ID NO: 40072 - DNA, 18 bp, Artificial Sequence
  Synthetic DNA
taaaacgttacactaaag

SEQ ID NO: 40073 - DNA, 18 bp, Artificial Sequence
  Synthetic DNA
taaaactacacattcaag

SEQ ID NO: 40074 - DNA, 18 bp, Artificial Sequence
  Synthetic DNA
taaaactacactttatag

SEQ ID NO: 40075 - DNA, 18 bp, Artificial Sequence
  Synthetic DNA
taaaactactaaaaaaag

SEQ ID NO: 40076 - DNA, 18 bp, Artificial Sequence
  Synthetic DNA
taaaactactcattgtcg

SEQ ID NO: 40077 - DNA, 18 bp, Artificial Sequence
  Synthetic DNA
taaaactactctccttag

SEQ ID NO: 40078 - DNA, 18 bp, Artificial Sequence
  Synthetic DNA
taaaactactctcgactg

SEQ ID NO: 40079 - DNA, 18 bp, Artificial Sequence
  Synthetic DNA
taaaactatacagtatgg

SEQ ID NO: 40080 - DNA, 18 bp, Artificial Sequence
  Synthetic DNA
taaaactattatctatcg

SEQ ID NO: 40081 - DNA, 18 bp, Artificial Sequence
  Synthetic DNA
taaaactcatcgctatag

SEQ ID NO: 40082 - DNA, 18 bp, Artificial Sequence
  Synthetic DNA
taaaactcctcacattag

SEQ ID NO: 40083 - DNA, 18 bp, Artificial Sequence
  Synthetic DNA
taaaactcctctctaaag

SEQ ID NO: 40084 - DNA, 18 bp, Artificial Sequence
  Synthetic DNA
taaaactgctcacatttg

SEQ ID NO: 40085 - DNA, 18 bp, Artificial Sequence
  Synthetic DNA
taaaactgttctcaaaag

SEQ ID NO: 40086 - DNA, 18 bp, Artificial Sequence
  Synthetic DNA
taaaacttatcactaatg

SEQ ID NO: 40087 - DNA, 18 bp, Artificial Sequence
  Synthetic DNA
taaaacttcacactacag

SEQ ID NO: 40088 - DNA, 18 bp, Artificial Sequence
  Synthetic DNA
taaaacttgccattaaag

SEQ ID NO: 40089 - DNA, 18 bp, Artificial Sequence
  Synthetic DNA
taaaacttttcactatcg

SEQ ID NO: 40090 - DNA, 18 bp, Artificial Sequence
  Synthetic DNA
taaaaggaataactgtag

SEQ ID NO: 40091 - DNA, 18 bp, Artificial Sequence
  Synthetic DNA
taaaaggaatcactttcg

SEQ ID NO: 40092 - DNA, 18 bp, Artificial Sequence
  Synthetic DNA
taaaaggactagcaatag

SEQ ID NO: 40093 - DNA, 18 bp, Artificial Sequence
  Synthetic DNA
taaaaggataccttgttg

SEQ ID NO: 40094 - DNA, 18 bp, Artificial Sequence
  Synthetic DNA
taaaaggattcaatgaag

SEQ ID NO: 40095 - DNA, 18 bp, Artificial Sequence
  Synthetic DNA
taaaagtaaacatcagag

SEQ ID NO: 40096 - DNA, 18 bp, Artificial Sequence
  Synthetic DNA
taaaataaatccctactg

SEQ ID NO: 40097 - DNA, 18 bp, Artificial Sequence
  Synthetic DNA
taaaatgaattactttag

SEQ ID NO: 40098 - DNA, 18 bp, Artificial Sequence
  Synthetic DNA
taaaatgactcgagaaag

SEQ ID NO: 40099 - DNA, 18 bp, Artificial Sequence
  Synthetic DNA
taaaatgactcgctgcag

SEQ ID NO: 40100 - DNA, 18 bp, Artificial Sequence
  Synthetic DNA
taaaatgacttacaaaag

SEQ ID NO: 40101 - DNA, 18 bp, Artificial Sequence
  Synthetic DNA
taaaatgactttctttcg

SEQ ID NO: 40102 - DNA, 18 bp, Artificial Sequence
  Synthetic DNA
taaaatgattaactttag

SEQ ID NO: 40103 - DNA, 18 bp, Artificial Sequence
  Synthetic DNA
taaaatgattccttatag

SEQ ID NO: 40104 - DNA, 18 bp, Artificial Sequence
  Synthetic DNA
taaaatgcaactcaatcg

SEQ ID NO: 40105 - DNA, 18 bp, Artificial Sequence
  Synthetic DNA
taaaatgtcataatattg

SEQ ID NO: 40106 - DNA, 18 bp, Artificial Sequence
  Synthetic DNA
taaaatgtctgattatag

SEQ ID NO: 40107 - DNA, 18 bp, Artificial Sequence
  Synthetic DNA
taaaatgtctgtctatag

SEQ ID NO: 40108 - DNA, 18 bp, Artificial Sequence
  Synthetic DNA
taaaattagtctctgaag

SEQ ID NO: 40109 - DNA, 18 bp, Artificial Sequence
  Synthetic DNA
taaaccaattcactttag

SEQ ID NO: 40110 - DNA, 18 bp, Artificial Sequence
  Synthetic DNA
taaaccgacgctctatcg

SEQ ID NO: 40111 - DNA, 18 bp, Artificial Sequence
  Synthetic DNA
taaaccgacttaatatgg

SEQ ID NO: 40112 - DNA, 18 bp, Artificial Sequence
  Synthetic DNA
taaaccgactttctattg

SEQ ID NO: 40113 - DNA, 18 bp, Artificial Sequence
  Synthetic DNA
taaaccgatatgttatag

SEQ ID NO: 40114 - DNA, 18 bp, Artificial Sequence
  Synthetic DNA
taaaccgcatcacaatag

SEQ ID NO: 40115 - DNA, 18 bp, Artificial Sequence
  Synthetic DNA
taaaccgccttgctatag

SEQ ID NO: 40116 - DNA, 18 bp, Artificial Sequence
  Synthetic DNA
taaaccggttcattttag

SEQ ID NO: 40117 - DNA, 18 bp, Artificial Sequence
  Synthetic DNA
taaaccgtcacactatgg

SEQ ID NO: 40118 - DNA, 18 bp, Artificial Sequence
  Synthetic DNA
taaacctacacagtacgg

SEQ ID NO: 40119 - DNA, 18 bp, Artificial Sequence
  Synthetic DNA
taaacctgcatacaaaag

SEQ ID NO: 40120 - DNA, 18 bp, Artificial Sequence
  Synthetic DNA
taaacgcactcactattg

SEQ ID NO: 40121 - DNA, 18 bp, Artificial Sequence
  Synthetic DNA
taaactgacttactttcg

SEQ ID NO: 40122 - DNA, 18 bp, Artificial Sequence
  Synthetic DNA
taaactgatactctttag

SEQ ID NO: 40123 - DNA, 18 bp, Artificial Sequence
  Synthetic DNA
taaactgattcccaattg

SEQ ID NO: 40124 - DNA, 18 bp, Artificial Sequence
  Synthetic DNA
taaactggcgcactttag

SEQ ID NO: 40125 - DNA, 18 bp, Artificial Sequence
  Synthetic DNA
taaagccaaaaactatag

SEQ ID NO: 40126 - DNA, 18 bp, Artificial Sequence
  Synthetic DNA
taaagccacacagtaaag

SEQ ID NO: 40127 - DNA, 18 bp, Artificial Sequence
  Synthetic DNA
taaagcctctccctatag

SEQ ID NO: 40128 - DNA, 18 bp, Artificial Sequence
  Synthetic DNA
taaagcgactaacagtag

SEQ ID NO: 40129 - DNA, 18 bp, Artificial Sequence
  Synthetic DNA
taaagcgactcccttttg

SEQ ID NO: 40130 - DNA, 18 bp, Artificial Sequence
  Synthetic DNA
taaagcggcacactttag

SEQ ID NO: 40131 - DNA, 18 bp, Artificial Sequence
  Synthetic DNA
taaagcggctcacgaaag

SEQ ID NO: 40132 - DNA, 18 bp, Artificial Sequence
  Synthetic DNA
taaagctacttactatgg

SEQ ID NO: 40133 - DNA, 18 bp, Artificial Sequence
  Synthetic DNA
taaagggacttacattag

SEQ ID NO: 40134 - DNA, 18 bp, Artificial Sequence
  Synthetic DNA
taaagggtatcactatag

SEQ ID NO: 40135 - DNA, 18 bp, Artificial Sequence
  Synthetic DNA
taaaggtacttactatag

SEQ ID NO: 40136 - DNA, 18 bp, Artificial Sequence
  Synthetic DNA
taaagtgactatctatag

SEQ ID NO: 40137 - DNA, 18 bp, Artificial Sequence
  Synthetic DNA
taaagtgactcaatagtg

SEQ ID NO: 40138 - DNA, 18 bp, Artificial Sequence
  Synthetic DNA
taaatagatataataacg

SEQ ID NO: 40139 - DNA, 18 bp, Artificial Sequence
  Synthetic DNA
taaatattttcactagag

SEQ ID NO: 40140 - DNA, 18 bp, Artificial Sequence
  Synthetic DNA
taaatcaactcataatag

SEQ ID NO: 40141 - DNA, 18 bp, Artificial Sequence
  Synthetic DNA
taaatcaattcccaattg

SEQ ID NO: 40142 - DNA, 18 bp, Artificial Sequence
  Synthetic DNA
taaatcatctctcaaaag

SEQ ID NO: 40143 - DNA, 18 bp, Artificial Sequence
  Synthetic DNA
taaatcgaataaaattag

SEQ ID NO: 40144 - DNA, 18 bp, Artificial Sequence
  Synthetic DNA
taaatcgaatgactttag

SEQ ID NO: 40145 - DNA, 18 bp, Artificial Sequence
  Synthetic DNA
taaatcgaccccctttag

SEQ ID NO: 40146 - DNA, 18 bp, Artificial Sequence
  Synthetic DNA
taaatcgactaattttag

SEQ ID NO: 40147 - DNA, 18 bp, Artificial Sequence
  Synthetic DNA
taaatcgactcactacta

SEQ ID NO: 40148 - DNA, 18 bp, Artificial Sequence
  Synthetic DNA
taaatcgactctattttg

SEQ ID NO: 40149 - DNA, 18 bp, Artificial Sequence
  Synthetic DNA
taaatcgatcgacaatag

SEQ ID NO: 40150 - DNA, 18 bp, Artificial Sequence
  Synthetic DNA
taaatcgattcaattaag

SEQ ID NO: 40151 - DNA, 18 bp, Artificial Sequence
  Synthetic DNA
taaatcgtctaactaatg

SEQ ID NO: 40152 - DNA, 18 bp, Artificial Sequence
  Synthetic DNA
taaatcgtcttactgttg

SEQ ID NO: 40153 - DNA, 18 bp, Artificial Sequence
  Synthetic DNA
taaatcgttaaacaatag

SEQ ID NO: 40154 - DNA, 18 bp, Artificial Sequence
  Synthetic DNA
taaatctacacacaatag

SEQ ID NO: 40155 - DNA, 18 bp, Artificial Sequence
  Synthetic DNA
taaatctatttaatttag

SEQ ID NO: 40156 - DNA, 18 bp, Artificial Sequence
  Synthetic DNA
taaatctatttactatag

SEQ ID NO: 40157 - DNA, 18 bp, Artificial Sequence
  Synthetic DNA
taaatggacattctatag

SEQ ID NO: 40158 - DNA, 18 bp, Artificial Sequence
  Synthetic DNA
taaatggactctcgatag

SEQ ID NO: 40159 - DNA, 18 bp, Artificial Sequence
  Synthetic DNA
taaatggacttactattg

SEQ ID NO: 40160 - DNA, 18 bp, Artificial Sequence
  Synthetic DNA
taaatggtgaaacggatg

SEQ ID NO: 40161 - DNA, 18 bp, Artificial Sequence
  Synthetic DNA
taaattgtctcactactg

SEQ ID NO: 40162 - DNA, 18 bp, Artificial Sequence
  Synthetic DNA
taaatttaatcactatag

SEQ ID NO: 40163 - DNA, 18 bp, Artificial Sequence
  Synthetic DNA
taaatttactgtttatag

SEQ ID NO: 40164 - DNA, 18 bp, Artificial Sequence
  Synthetic DNA
taacaaaatctaatatag

SEQ ID NO: 40165 - DNA, 18 bp, Artificial Sequence
  Synthetic DNA
taacaagactcgcttcag

SEQ ID NO: 40166 - DNA, 18 bp, Artificial Sequence
  Synthetic DNA
taacaagattctatatag

SEQ ID NO: 40167 - DNA, 18 bp, Artificial Sequence
  Synthetic DNA
taacaagatttactagtg

SEQ ID NO: 40168 - DNA, 18 bp, Artificial Sequence
  Synthetic DNA
taacaagtttcacataag

SEQ ID NO: 40169 - DNA, 18 bp, Artificial Sequence
  Synthetic DNA
taacaatattcactttag

SEQ ID NO: 40170 - DNA, 18 bp, Artificial Sequence
  Synthetic DNA
taacacaagttactttag

SEQ ID NO: 40171 - DNA, 18 bp, Artificial Sequence
  Synthetic DNA
taacacatgtcaaaattg

SEQ ID NO: 40172 - DNA, 18 bp, Artificial Sequence
  Synthetic DNA
taacaccacacacaagag

SEQ ID NO: 40173 - DNA, 18 bp, Artificial Sequence
  Synthetic DNA
taacaccattctctctag

SEQ ID NO: 40174 - DNA, 18 bp, Artificial Sequence
  Synthetic DNA
taacacctcttactaaag

SEQ ID NO: 40175 - DNA, 18 bp, Artificial Sequence
  Synthetic DNA
taacacctgtcattattg

SEQ ID NO: 40176 - DNA, 18 bp, Artificial Sequence
  Synthetic DNA
taacacgaagctctttag

SEQ ID NO: 40177 - DNA, 18 bp, Artificial Sequence
  Synthetic DNA
taacacgacacaaaaggg

SEQ ID NO: 40178 - DNA, 18 bp, Artificial Sequence
  Synthetic DNA
taacacgactatctaatg

SEQ ID NO: 40179 - DNA, 18 bp, Artificial Sequence
  Synthetic DNA
taacacgactcagttatg

SEQ ID NO: 40180 - DNA, 18 bp, Artificial Sequence
  Synthetic DNA
taacacgactcattgctg

SEQ ID NO: 40181 - DNA, 18 bp, Artificial Sequence
  Synthetic DNA
taacacgagtatctattg

SEQ ID NO: 40182 - DNA, 18 bp, Artificial Sequence
  Synthetic DNA
taacacgagtctatttgg

SEQ ID NO: 40183 - DNA, 18 bp, Artificial Sequence
  Synthetic DNA
taacacggataactttag

SEQ ID NO: 40184 - DNA, 18 bp, Artificial Sequence
  Synthetic DNA
taacacggcatataatag

SEQ ID NO: 40185 - DNA, 18 bp, Artificial Sequence
  Synthetic DNA
taacacgtatcattaaag

SEQ ID NO: 40186 - DNA, 18 bp, Artificial Sequence
  Synthetic DNA
taacacgtcaccgtatag

SEQ ID NO: 40187 - DNA, 18 bp, Artificial Sequence
  Synthetic DNA
taacacgtcgtaccatag

SEQ ID NO: 40188 - DNA, 18 bp, Artificial Sequence
  Synthetic DNA
taacacgtctaattttag

SEQ ID NO: 40189 - DNA, 18 bp, Artificial Sequence
  Synthetic DNA
taacactaatcattattg

SEQ ID NO: 40190 - DNA, 18 bp, Artificial Sequence
  Synthetic DNA
taacactaatgaatatag

SEQ ID NO: 40191 - DNA, 18 bp, Artificial Sequence
  Synthetic DNA
taacactaccttctatag

SEQ ID NO: 40192 - DNA, 18 bp, Artificial Sequence
  Synthetic DNA
taacactacgcattacag

SEQ ID NO: 40193 - DNA, 18 bp, Artificial Sequence
  Synthetic DNA
taacactaggcactattg

SEQ ID NO: 40194 - DNA, 18 bp, Artificial Sequence
  Synthetic DNA
taacaggactagcacaag

SEQ ID NO: 40195 - DNA, 18 bp, Artificial Sequence
  Synthetic DNA
taacaggactcacaactg

SEQ ID NO: 40196 - DNA, 18 bp, Artificial Sequence
  Synthetic DNA
taacaggactcagattag

SEQ ID NO: 40197 - DNA, 18 bp, Artificial Sequence
  Synthetic DNA
taacaggtctccctttag

SEQ ID NO: 40198 - DNA, 18 bp, Artificial Sequence
  Synthetic DNA
taacaggtcttgctatag

SEQ ID NO: 40199 - DNA, 18 bp, Artificial Sequence
  Synthetic DNA
taacatcattttcaaaag

SEQ ID NO: 40200 - DNA, 18 bp, Artificial Sequence
  Synthetic DNA
taacatgaataactatcg

SEQ ID NO: 40201 - DNA, 18 bp, Artificial Sequence
  Synthetic DNA
taacatgactttcatttg

SEQ ID NO: 40202 - DNA, 18 bp, Artificial Sequence
  Synthetic DNA
taacatgtatccctttag

SEQ ID NO: 40203 - DNA, 18 bp, Artificial Sequence
  Synthetic DNA
taacatgtcaacctatag

SEQ ID NO: 40204 - DNA, 18 bp, Artificial Sequence
  Synthetic DNA
taacatgtttctgcatag

SEQ ID NO: 40205 - DNA, 18 bp, Artificial Sequence
  Synthetic DNA
taacattcctctgcatag

SEQ ID NO: 40206 - DNA, 18 bp, Artificial Sequence
  Synthetic DNA
taacatttgtcacaatag

SEQ ID NO: 40207 - DNA, 18 bp, Artificial Sequence
  Synthetic DNA
taacccgtcaaactaaag

SEQ ID NO: 40208 - DNA, 18 bp, Artificial Sequence
  Synthetic DNA
taacccgtctgatttaag

SEQ ID NO: 40209 - DNA, 18 bp, Artificial Sequence
  Synthetic DNA
taacccttctctccatag

SEQ ID NO: 40210 - DNA, 18 bp, Artificial Sequence
  Synthetic DNA
taaccttaaacactattg

SEQ ID NO: 40211 - DNA, 18 bp, Artificial Sequence
  Synthetic DNA
taaccttactctatactg

SEQ ID NO: 40212 - DNA, 18 bp, Artificial Sequence
  Synthetic DNA
taacgcgacttattatgg

SEQ ID NO: 40213 - DNA, 18 bp, Artificial Sequence
  Synthetic DNA
taacgcgtatctctatag

SEQ ID NO: 40214 - DNA, 18 bp, Artificial Sequence
  Synthetic DNA
taactacacacactatgg

SEQ ID NO: 40215 - DNA, 18 bp, Artificial Sequence
  Synthetic DNA
taactatactctaagtag

SEQ ID NO: 40216 - DNA, 18 bp, Artificial Sequence
  Synthetic DNA
taactcaacccaccaaag

SEQ ID NO: 40217 - DNA, 18 bp, Artificial Sequence
  Synthetic DNA
taactcatttcagtatag

SEQ ID NO: 40218 - DNA, 18 bp, Artificial Sequence
  Synthetic DNA
taactccactttctattg

SEQ ID NO: 40219 - DNA, 18 bp, Artificial Sequence
  Synthetic DNA
taactcgactaattggag

SEQ ID NO: 40220 - DNA, 18 bp, Artificial Sequence
  Synthetic DNA
taactcgactttgtaccg

SEQ ID NO: 40221 - DNA, 18 bp, Artificial Sequence
  Synthetic DNA
taactcgatatactaccg

SEQ ID NO: 40222 - DNA, 18 bp, Artificial Sequence
  Synthetic DNA
taactctacactctagag

SEQ ID NO: 40223 - DNA, 18 bp, Artificial Sequence
  Synthetic DNA
taactggccgtactatag

SEQ ID NO: 40224 - DNA, 18 bp, Artificial Sequence
  Synthetic DNA
taactgtactcgtcatag

SEQ ID NO: 40225 - DNA, 18 bp, Artificial Sequence
  Synthetic DNA
taacttggctcaatgtag

SEQ ID NO: 40226 - DNA, 18 bp, Artificial Sequence
  Synthetic DNA
taacttgtcaaagcaaag

SEQ ID NO: 40227 - DNA, 18 bp, Artificial Sequence
  Synthetic DNA
taagaactttacctatag

SEQ ID NO: 40228 - DNA, 18 bp, Artificial Sequence
  Synthetic DNA
taagacagctcacttaag

SEQ ID NO: 40229 - DNA, 18 bp, Artificial Sequence
  Synthetic DNA
taagaccactctataagg

SEQ ID NO: 40230 - DNA, 18 bp, Artificial Sequence
  Synthetic DNA
taagaccattctctaaag

SEQ ID NO: 40231 - DNA, 18 bp, Artificial Sequence
  Synthetic DNA
taagacgaaacccgttag

SEQ ID NO: 40232 - DNA, 18 bp, Artificial Sequence
  Synthetic DNA
taagacgataacctatag

SEQ ID NO: 40233 - DNA, 18 bp, Artificial Sequence
  Synthetic DNA
taagacgattcatgtagg

SEQ ID NO: 40234 - DNA, 18 bp, Artificial Sequence
  Synthetic DNA
taagacgatttacattag

SEQ ID NO: 40235 - DNA, 18 bp, Artificial Sequence
  Synthetic DNA
taagacggatcattttag

SEQ ID NO: 40236 - DNA, 18 bp, Artificial Sequence
  Synthetic DNA
taagacggcactctattg

SEQ ID NO: 40237 - DNA, 18 bp, Artificial Sequence
  Synthetic DNA
taagacgtaacagttttg

SEQ ID NO: 40238 - DNA, 18 bp, Artificial Sequence
  Synthetic DNA
taagactatacacaaaag

SEQ ID NO: 40239 - DNA, 18 bp, Artificial Sequence
  Synthetic DNA
taagaggagtatctatag

SEQ ID NO: 40240 - DNA, 18 bp, Artificial Sequence
  Synthetic DNA
taagaggccaccctattg

SEQ ID NO: 40241 - DNA, 18 bp, Artificial Sequence
  Synthetic DNA
taagatcactcaatatcg

SEQ ID NO: 40242 - DNA, 18 bp, Artificial Sequence
  Synthetic DNA
taagatccctctgtgtag

SEQ ID NO: 40243 - DNA, 18 bp, Artificial Sequence
  Synthetic DNA
taagatgactctttatgg

SEQ ID NO: 40244 - DNA, 18 bp, Artificial Sequence
  Synthetic DNA
taagatgatacactaaag

SEQ ID NO: 40245 - DNA, 18 bp, Artificial Sequence
  Synthetic DNA
taagatgtctaattttag

SEQ ID NO: 40246 - DNA, 18 bp, Artificial Sequence
  Synthetic DNA
taagattcctcactctag

SEQ ID NO: 40247 - DNA, 18 bp, Artificial Sequence
  Synthetic DNA
taagcagacttactctag

SEQ ID NO: 40248 - DNA, 18 bp, Artificial Sequence
  Synthetic DNA
taagcggtctccctatag

SEQ ID NO: 40249 - DNA, 18 bp, Artificial Sequence
  Synthetic DNA
taaggtgcttcatactag

SEQ ID NO: 40250 - DNA, 18 bp, Artificial Sequence
  Synthetic DNA
taagtagcgtcaatgtag

SEQ ID NO: 40251 - DNA, 18 bp, Artificial Sequence
  Synthetic DNA
taagtcaacatactatag

SEQ ID NO: 40252 - DNA, 18 bp, Artificial Sequence
  Synthetic DNA
taagtcgattcagtaaag

SEQ ID NO: 40253 - DNA, 18 bp, Artificial Sequence
  Synthetic DNA
taagtcggcacaatatag

SEQ ID NO: 40254 - DNA, 18 bp, Artificial Sequence
  Synthetic DNA
taagtcgtctcacaaaag

SEQ ID NO: 40255 - DNA, 18 bp, Artificial Sequence
  Synthetic DNA
taagtcgtgtctctatag

SEQ ID NO: 40256 - DNA, 18 bp, Artificial Sequence
  Synthetic DNA
taagtctatgaactaatg

SEQ ID NO: 40257 - DNA, 18 bp, Artificial Sequence
  Synthetic DNA
taagttgacacactttag

SEQ ID NO: 40258 - DNA, 18 bp, Artificial Sequence
  Synthetic DNA
taagttgactaactattg

SEQ ID NO: 40259 - DNA, 18 bp, Artificial Sequence
  Synthetic DNA
taataaaacccacattag

SEQ ID NO: 40260 - DNA, 18 bp, Artificial Sequence
  Synthetic DNA
taataaacctcacttttg

SEQ ID NO: 40261 - DNA, 18 bp, Artificial Sequence
  Synthetic DNA
taataaatatcacttgag

SEQ ID NO: 40262 - DNA, 18 bp, Artificial Sequence
  Synthetic DNA
taataaatctatcaccag

SEQ ID NO: 40263 - DNA, 18 bp, Artificial Sequence
  Synthetic DNA
taataaatttcactattg

SEQ ID NO: 40264 - DNA, 18 bp, Artificial Sequence
  Synthetic DNA
taataacaatcacaacag

SEQ ID NO: 40265 - DNA, 18 bp, Artificial Sequence
  Synthetic DNA
taataacacatagaatag

SEQ ID NO: 40266 - DNA, 18 bp, Artificial Sequence
  Synthetic DNA
taataacacgcacaacag

SEQ ID NO: 40267 - DNA, 18 bp, Artificial Sequence
  Synthetic DNA
taataacactcacataag

SEQ ID NO: 40268 - DNA, 18 bp, Artificial Sequence
  Synthetic DNA
taataacagtcccgatag

SEQ ID NO: 40269 - DNA, 18 bp, Artificial Sequence
  Synthetic DNA
taataaccaactttatcg

SEQ ID NO: 40270 - DNA, 18 bp, Artificial Sequence
  Synthetic DNA
taataactccttctatag

SEQ ID NO: 40271 - DNA, 18 bp, Artificial Sequence
  Synthetic DNA
taataactctcacaatgg

SEQ ID NO: 40272 - DNA, 18 bp, Artificial Sequence
  Synthetic DNA
taataagaaaaaccatag

SEQ ID NO: 40273 - DNA, 18 bp, Artificial Sequence
  Synthetic DNA
taataagaaatactttag

SEQ ID NO: 40274 - DNA, 18 bp, Artificial Sequence
  Synthetic DNA
taataagaatatctttag

SEQ ID NO: 40275 - DNA, 18 bp, Artificial Sequence
  Synthetic DNA
taataagaatctatttag

SEQ ID NO: 40276 - DNA, 18 bp, Artificial Sequence
  Synthetic DNA
taataagaatctcctaag

SEQ ID NO: 40277 - DNA, 18 bp, Artificial Sequence
  Synthetic DNA
taataagaatctttaatg

SEQ ID NO: 40278 - DNA, 18 bp, Artificial Sequence
  Synthetic DNA
taataagaatttccacag

SEQ ID NO: 40279 - DNA, 18 bp, Artificial Sequence
  Synthetic DNA
taataagacagagtattg

SEQ ID NO: 40280 - DNA, 18 bp, Artificial Sequence
  Synthetic DNA
taataagacagcattaag

SEQ ID NO: 40281 - DNA, 18 bp, Artificial Sequence
  Synthetic DNA
taataagacattcaattg

SEQ ID NO: 40282 - DNA, 18 bp, Artificial Sequence
  Synthetic DNA
taataagactaacataag

SEQ ID NO: 40283 - DNA, 18 bp, Artificial Sequence
  Synthetic DNA
taataagactcagttatg

SEQ ID NO: 40284 - DNA, 18 bp, Artificial Sequence
  Synthetic DNA
taataagactcgattaag

SEQ ID NO: 40285 - DNA, 18 bp, Artificial Sequence
  Synthetic DNA
taataagactctatgaag

SEQ ID NO: 40286 - DNA, 18 bp, Artificial Sequence
  Synthetic DNA
taataagactctctacct

SEQ ID NO: 40287 - DNA, 18 bp, Artificial Sequence
  Synthetic DNA
taataagactgacataag

SEQ ID NO: 40288 - DNA, 18 bp, Artificial Sequence
  Synthetic DNA
taataagacttataagag

SEQ ID NO: 40289 - DNA, 18 bp, Artificial Sequence
  Synthetic DNA
taataagattaactcaag

SEQ ID NO: 40290 - DNA, 18 bp, Artificial Sequence
  Synthetic DNA
taataagattaacttttg

SEQ ID NO: 40291 - DNA, 18 bp, Artificial Sequence
  Synthetic DNA
taataagattcaagattg

SEQ ID NO: 40292 - DNA, 18 bp, Artificial Sequence
  Synthetic DNA
taataagccacgccatag

SEQ ID NO: 40293 - DNA, 18 bp, Artificial Sequence
  Synthetic DNA
taataagcctcagtaggg

SEQ ID NO: 40294 - DNA, 18 bp, Artificial Sequence
  Synthetic DNA
taataagcctttccatag

SEQ ID NO: 40295 - DNA, 18 bp, Artificial Sequence
  Synthetic DNA
taataaggattaatttag

SEQ ID NO: 40296 - DNA, 18 bp, Artificial Sequence
  Synthetic DNA
taataaggttcatcatgg

SEQ ID NO: 40297 - DNA, 18 bp, Artificial Sequence
  Synthetic DNA
taataagtaacactacag

SEQ ID NO: 40298 - DNA, 18 bp, Artificial Sequence
  Synthetic DNA
taataagtcaaactctag

SEQ ID NO: 40299 - DNA, 18 bp, Artificial Sequence
  Synthetic DNA
taataagtcccgctagag

SEQ ID NO: 40300 - DNA, 18 bp, Artificial Sequence
  Synthetic DNA
taataagtttcaccgtgg

SEQ ID NO: 40301 - DNA, 18 bp, Artificial Sequence
  Synthetic DNA
taataagtttgactcaag

SEQ ID NO: 40302 - DNA, 18 bp, Artificial Sequence
  Synthetic DNA
taataatacatactatgg

SEQ ID NO: 40303 - DNA, 18 bp, Artificial Sequence
  Synthetic DNA
taataatcctcagtttag

SEQ ID NO: 40304 - DNA, 18 bp, Artificial Sequence
  Synthetic DNA
taataatgctcactaatg

SEQ ID NO: 40305 - DNA, 18 bp, Artificial Sequence
  Synthetic DNA
taataattataacaatcg

SEQ ID NO: 40306 - DNA, 18 bp, Artificial Sequence
  Synthetic DNA
taataattatggcttttg

SEQ ID NO: 40307 - DNA, 18 bp, Artificial Sequence
  Synthetic DNA
taataattcttactaaag

SEQ ID NO: 40308 - DNA, 18 bp, Artificial Sequence
  Synthetic DNA
taataattcttactctag

SEQ ID NO: 40309 - DNA, 18 bp, Artificial Sequence
  Synthetic DNA
taatacaacacacatcag

SEQ ID NO: 40310 - DNA, 18 bp, Artificial Sequence
  Synthetic DNA
taatacaacacgttttag

SEQ ID NO: 40311 - DNA, 18 bp, Artificial Sequence
  Synthetic DNA
taatacaacactctcaag

SEQ ID NO: 40312 - DNA, 18 bp, Artificial Sequence
  Synthetic DNA
taatacaacatatttaag

SEQ ID NO: 40313 - DNA, 18 bp, Artificial Sequence
  Synthetic DNA
taatacaaccttcaatag

SEQ ID NO: 40314 - DNA, 18 bp, Artificial Sequence
  Synthetic DNA
taatacaaccttgtatag

SEQ ID NO: 40315 - DNA, 18 bp, Artificial Sequence
  Synthetic DNA
taatacaactaattacca

SEQ ID NO: 40316 - DNA, 18 bp, Artificial Sequence
  Synthetic DNA
taatacaactccctcatg

SEQ ID NO: 40317 - DNA, 18 bp, Artificial Sequence
  Synthetic DNA
taatacaacttagaaaag

SEQ ID NO: 40318 - DNA, 18 bp, Artificial Sequence
  Synthetic DNA
taatacaactttgcattg

SEQ ID NO: 40319 - DNA, 18 bp, Artificial Sequence
  Synthetic DNA
taatacaagtgacttaag

SEQ ID NO: 40320 - DNA, 18 bp, Artificial Sequence
  Synthetic DNA
taatacaatattctaccg

SEQ ID NO: 40321 - DNA, 18 bp, Artificial Sequence
  Synthetic DNA
taatacaattcggagatg

SEQ ID NO: 40322 - DNA, 18 bp, Artificial Sequence
  Synthetic DNA
taatacaattctctcttg

SEQ ID NO: 40323 - DNA, 18 bp, Artificial Sequence
  Synthetic DNA
taatacacaacactgtag

SEQ ID NO: 40324 - DNA, 18 bp, Artificial Sequence
  Synthetic DNA
taatacacatctcttttg

SEQ ID NO: 40325 - DNA, 18 bp, Artificial Sequence
  Synthetic DNA
taatacaccacaataaag

SEQ ID NO: 40326 - DNA, 18 bp, Artificial Sequence
  Synthetic DNA
taatacaccactcttttg

SEQ ID NO: 40327 - DNA, 18 bp, Artificial Sequence
  Synthetic DNA
taatacacttctatatag

SEQ ID NO: 40328 - DNA, 18 bp, Artificial Sequence
  Synthetic DNA
taatacagagccctaatg

SEQ ID NO: 40329 - DNA, 18 bp, Artificial Sequence
  Synthetic DNA
taatacagttcagttttg

SEQ ID NO: 40330 - DNA, 18 bp, Artificial Sequence
  Synthetic DNA
taatacatatcatttgag

SEQ ID NO: 40331 - DNA, 18 bp, Artificial Sequence
  Synthetic DNA
taatacatcacacttgcg

SEQ ID NO: 40332 - DNA, 18 bp, Artificial Sequence
  Synthetic DNA
taatacatcacatatgag

SEQ ID NO: 40333 - DNA, 18 bp, Artificial Sequence
  Synthetic DNA
taatacatcaccatgaag

SEQ ID NO: 40334 - DNA, 18 bp, Artificial Sequence
  Synthetic DNA
taatacatcactctacag

SEQ ID NO: 40335 - DNA, 18 bp, Artificial Sequence
  Synthetic DNA
taatacatcactctttgg

SEQ ID NO: 40336 - DNA, 18 bp, Artificial Sequence
  Synthetic DNA
taatacatctcgttctag

SEQ ID NO: 40337 - DNA, 18 bp, Artificial Sequence
  Synthetic DNA
taatacatcttactttcg

SEQ ID NO: 40338 - DNA, 18 bp, Artificial Sequence
  Synthetic DNA
taatacatgtcacttgag

SEQ ID NO: 40339 - DNA, 18 bp, Artificial Sequence
  Synthetic DNA
taatacattatattattg

SEQ ID NO: 40340 - DNA, 18 bp, Artificial Sequence
  Synthetic DNA
taatacatttaacaaaag

SEQ ID NO: 40341 - DNA, 18 bp, Artificial Sequence
  Synthetic DNA
taatacatttccctagag

SEQ ID NO: 40342 - DNA, 18 bp, Artificial Sequence
  Synthetic DNA
taatacattttactttgg

SEQ ID NO: 40343 - DNA, 18 bp, Artificial Sequence
  Synthetic DNA
taataccaaacaacgttg

SEQ ID NO: 40344 - DNA, 18 bp, Artificial Sequence
  Synthetic DNA
taataccaaataccatag

SEQ ID NO: 40345 - DNA, 18 bp, Artificial Sequence
  Synthetic DNA
taataccacaatcatcag

SEQ ID NO: 40346 - DNA, 18 bp, Artificial Sequence
  Synthetic DNA
taataccacacactgatg

SEQ ID NO: 40347 - DNA, 18 bp, Artificial Sequence
  Synthetic DNA
taataccacactcacaag

SEQ ID NO: 40348 - DNA, 18 bp, Artificial Sequence
  Synthetic DNA
taataccacattatatgg

SEQ ID NO: 40349 - DNA, 18 bp, Artificial Sequence
  Synthetic DNA
taataccacgtttttaag

SEQ ID NO: 40350 - DNA, 18 bp, Artificial Sequence
  Synthetic DNA
taataccactaattactg

SEQ ID NO: 40351 - DNA, 18 bp, Artificial Sequence
  Synthetic DNA
taataccactatcttagg

SEQ ID NO: 40352 - DNA, 18 bp, Artificial Sequence
  Synthetic DNA
taataccactcttttttg

SEQ ID NO: 40353 - DNA, 18 bp, Artificial Sequence
  Synthetic DNA
taataccactttaaatag

SEQ ID NO: 40354 - DNA, 18 bp, Artificial Sequence
  Synthetic DNA
taataccagtatatatag

SEQ ID NO: 40355 - DNA, 18 bp, Artificial Sequence
  Synthetic DNA
taataccagtctctttcg

SEQ ID NO: 40356 - DNA, 18 bp, Artificial Sequence
  Synthetic DNA
taataccatcctattgcg

SEQ ID NO: 40357 - DNA, 18 bp, Artificial Sequence
  Synthetic DNA
taataccattcaatggag

SEQ ID NO: 40358 - DNA, 18 bp, Artificial Sequence
  Synthetic DNA
taataccattcatttttg

SEQ ID NO: 40359 - DNA, 18 bp, Artificial Sequence
  Synthetic DNA
taataccatttattaaag

SEQ ID NO: 40360 - DNA, 18 bp, Artificial Sequence
  Synthetic DNA
taataccgaacactctag

SEQ ID NO: 40361 - DNA, 18 bp, Artificial Sequence
  Synthetic DNA
taataccgctctacattg

SEQ ID NO: 40362 - DNA, 18 bp, Artificial Sequence
  Synthetic DNA
taataccgctctcaatcg

SEQ ID NO: 40363 - DNA, 18 bp, Artificial Sequence
  Synthetic DNA
taatacctctatttatag

SEQ ID NO: 40364 - DNA, 18 bp, Artificial Sequence
  Synthetic DNA
taatacctctctctaccg

SEQ ID NO: 40365 - DNA, 18 bp, Artificial Sequence
  Synthetic DNA
taatacctgtctctttag

SEQ ID NO: 40366 - DNA, 18 bp, Artificial Sequence
  Synthetic DNA
taatacctttcatgatag

SEQ ID NO: 40367 - DNA, 18 bp, Artificial Sequence
  Synthetic DNA
taatacgaaaatgaatag

SEQ ID NO: 40368 - DNA, 18 bp, Artificial Sequence
  Synthetic DNA
taatacgaaacaaacaag

SEQ ID NO: 40369 - DNA, 18 bp, Artificial Sequence
  Synthetic DNA
taatacgaaactgtattg

SEQ ID NO: 40370 - DNA, 18 bp, Artificial Sequence
  Synthetic DNA
taatacgaagtattttag

SEQ ID NO: 40371 - DNA, 18 bp, Artificial Sequence
  Synthetic DNA
taatacgaatatatattg

SEQ ID NO: 40372 - DNA, 18 bp, Artificial Sequence
  Synthetic DNA
taatacgaatcccctttg

SEQ ID NO: 40373 - DNA, 18 bp, Artificial Sequence
  Synthetic DNA
taatacgaatccctcctg

SEQ ID NO: 40374 - DNA, 18 bp, Artificial Sequence
  Synthetic DNA
taatacgaatctgtaagg

SEQ ID NO: 40375 - DNA, 18 bp, Artificial Sequence
  Synthetic DNA
taatacgaattccattag

SEQ ID NO: 40376 - DNA, 18 bp, Artificial Sequence
  Synthetic DNA
taatacgacacaaattcg

SEQ ID NO: 40377 - DNA, 18 bp, Artificial Sequence
  Synthetic DNA
taatacgacacgaagttg

SEQ ID NO: 40378 - DNA, 18 bp, Artificial Sequence
  Synthetic DNA
taatacgacactaataag

SEQ ID NO: 40379 - DNA, 18 bp, Artificial Sequence
  Synthetic DNA
taatacgacactttgaag

SEQ ID NO: 40380 - DNA, 18 bp, Artificial Sequence
  Synthetic DNA
taatacgacagtccctag

SEQ ID NO: 40381 - DNA, 18 bp, Artificial Sequence
  Synthetic DNA
taatacgacatacacttg

SEQ ID NO: 40382 - DNA, 18 bp, Artificial Sequence
  Synthetic DNA
taatacgacatattcttg

SEQ ID NO: 40383 - DNA, 18 bp, Artificial Sequence
  Synthetic DNA
taatacgaccctagcttg

SEQ ID NO: 40384 - DNA, 18 bp, Artificial Sequence
  Synthetic DNA
taatacgactcttatatg

SEQ ID NO: 40385 - DNA, 18 bp, Artificial Sequence
  Synthetic DNA
taatacgactgacatagg

SEQ ID NO: 40386 - DNA, 18 bp, Artificial Sequence
  Synthetic DNA
taatacgacttgcctttg

SEQ ID NO: 40387 - DNA, 18 bp, Artificial Sequence
  Synthetic DNA
taatacgagacgtaaaag

SEQ ID NO: 40388 - DNA, 18 bp, Artificial Sequence
  Synthetic DNA
taatacgagtctaattag

SEQ ID NO: 40389 - DNA, 18 bp, Artificial Sequence
  Synthetic DNA
taatacgataaactttgg

SEQ ID NO: 40390 - DNA, 18 bp, Artificial Sequence
  Synthetic DNA
taatacgatacacttatg

SEQ ID NO: 40391 - DNA, 18 bp, Artificial Sequence
  Synthetic DNA
taatacgatatacttaag

SEQ ID NO: 40392 - DNA, 18 bp, Artificial Sequence
  Synthetic DNA
taatacgatattctatcg

SEQ ID NO: 40393 - DNA, 18 bp, Artificial Sequence
  Synthetic DNA
taatacgatccacgtgag

SEQ ID NO: 40394 - DNA, 18 bp, Artificial Sequence
  Synthetic DNA
taatacgattaattcaag

SEQ ID NO: 40395 - DNA, 18 bp, Artificial Sequence
  Synthetic DNA
taatacgattatataatg

SEQ ID NO: 40396 - DNA, 18 bp, Artificial Sequence
  Synthetic DNA
taatacgattcgatagtg

SEQ ID NO: 40397 - DNA, 18 bp, Artificial Sequence
  Synthetic DNA
taatacgattcgcccttg

SEQ ID NO: 40398 - DNA, 18 bp, Artificial Sequence
  Synthetic DNA
taatacgattctatgtgg

SEQ ID NO: 40399 - DNA, 18 bp, Artificial Sequence
  Synthetic DNA
taatacgattgtgtttgg

SEQ ID NO: 40400 - DNA, 18 bp, Artificial Sequence
  Synthetic DNA
taatacgccacatatcag

SEQ ID NO: 40401 - DNA, 18 bp, Artificial Sequence
  Synthetic DNA
taatacgccataccaaag

SEQ ID NO: 40402 - DNA, 18 bp, Artificial Sequence
  Synthetic DNA
taatacgcccaacattag

SEQ ID NO: 40403 - DNA, 18 bp, Artificial Sequence
  Synthetic DNA
taatacgccttattacgg

SEQ ID NO: 40404 - DNA, 18 bp, Artificial Sequence
  Synthetic DNA
taatacgcgacgtttttg

SEQ ID NO: 40405 - DNA, 18 bp, Artificial Sequence
  Synthetic DNA
taatacgctaaattgtag

SEQ ID NO: 40406 - DNA, 18 bp, Artificial Sequence
  Synthetic DNA
taatacgcttcaaaagag

SEQ ID NO: 40407 - DNA, 18 bp, Artificial Sequence
  Synthetic DNA
taatacgcttttctattg

SEQ ID NO: 40408 - DNA, 18 bp, Artificial Sequence
  Synthetic DNA
taatacggctcgcttatg

SEQ ID NO: 40409 - DNA, 18 bp, Artificial Sequence
  Synthetic DNA
taatacggcttcgcttag

SEQ ID NO: 40410 - DNA, 18 bp, Artificial Sequence
  Synthetic DNA
taatacggttcattagtg

SEQ ID NO: 40411 - DNA, 18 bp, Artificial Sequence
  Synthetic DNA
taatacggttctcgttgg

SEQ ID NO: 40412 - DNA, 18 bp, Artificial Sequence
  Synthetic DNA
taatacgtacaataatag

SEQ ID NO: 40413 - DNA, 18 bp, Artificial Sequence
  Synthetic DNA
taatacgtataaatatcg

SEQ ID NO: 40414 - DNA, 18 bp, Artificial Sequence
  Synthetic DNA
taatacgtatccatgttg

SEQ ID NO: 40415 - DNA, 18 bp, Artificial Sequence
  Synthetic DNA
taatacgtatcttaatag

SEQ ID NO: 40416 - DNA, 18 bp, Artificial Sequence
  Synthetic DNA
taatacgtattaatattg

SEQ ID NO: 40417 - DNA, 18 bp, Artificial Sequence
  Synthetic DNA
taatacgtcaatttatag

SEQ ID NO: 40418 - DNA, 18 bp, Artificial Sequence
  Synthetic DNA
taatacgtcacaattcag

SEQ ID NO: 40419 - DNA, 18 bp, Artificial Sequence
  Synthetic DNA
taatacgtcaccctgaag

SEQ ID NO: 40420 - DNA, 18 bp, Artificial Sequence
  Synthetic DNA
taatacgtcaccttctag

SEQ ID NO: 40421 - DNA, 18 bp, Artificial Sequence
  Synthetic DNA
taatacgtcactgtccag

SEQ ID NO: 40422 - DNA, 18 bp, Artificial Sequence
  Synthetic DNA
taatacgtctaaactcag

SEQ ID NO: 40423 - DNA, 18 bp, Artificial Sequence
  Synthetic DNA
taatacgtctaccaagag

SEQ ID NO: 40424 - DNA, 18 bp, Artificial Sequence
  Synthetic DNA
taatacgtctctataacg

SEQ ID NO: 40425 - DNA, 18 bp, Artificial Sequence
  Synthetic DNA
taatacgtctctcccaag

SEQ ID NO: 40426 - DNA, 18 bp, Artificial Sequence
  Synthetic DNA
taatacgtctctcctgag

SEQ ID NO: 40427 - DNA, 18 bp, Artificial Sequence
  Synthetic DNA
taatacgtctctcgaatg

SEQ ID NO: 40428 - DNA, 18 bp, Artificial Sequence
  Synthetic DNA
taatacgtctgttaattg

SEQ ID NO: 40429 - DNA, 18 bp, Artificial Sequence
  Synthetic DNA
taatacgtcttttcttag

SEQ ID NO: 40430 - DNA, 18 bp, Artificial Sequence
  Synthetic DNA
taatacgtgactatacag

SEQ ID NO: 40431 - DNA, 18 bp, Artificial Sequence
  Synthetic DNA
taatacgtgtcagtactg

SEQ ID NO: 40432 - DNA, 18 bp, Artificial Sequence
  Synthetic DNA
taatacgttactccaaag

SEQ ID NO: 40433 - DNA, 18 bp, Artificial Sequence
  Synthetic DNA
taatacgtttaacaattg

SEQ ID NO: 40434 - DNA, 18 bp, Artificial Sequence
  Synthetic DNA
taatacgtttcatcgtcg

SEQ ID NO: 40435 - DNA, 18 bp, Artificial Sequence
  Synthetic DNA
taatacgttttaatattg

SEQ ID NO: 40436 - DNA, 18 bp, Artificial Sequence
  Synthetic DNA
taatacgttttggttttg

SEQ ID NO: 40437 - DNA, 18 bp, Artificial Sequence
  Synthetic DNA
taatactaatctcaaaag

SEQ ID NO: 40438 - DNA, 18 bp, Artificial Sequence
  Synthetic DNA
taatactaatgatcatag

SEQ ID NO: 40439 - DNA, 18 bp, Artificial Sequence
  Synthetic DNA
taatactacaaactactg

SEQ ID NO: 40440 - DNA, 18 bp, Artificial Sequence
  Synthetic DNA
taatactacaaactcaag

SEQ ID NO: 40441 - DNA, 18 bp, Artificial Sequence
  Synthetic DNA
taatactacactgtagag

SEQ ID NO: 40442 - DNA, 18 bp, Artificial Sequence
  Synthetic DNA
taatactacactttacag

SEQ ID NO: 40443 - DNA, 18 bp, Artificial Sequence
  Synthetic DNA
taatactacagactgttg

SEQ ID NO: 40444 - DNA, 18 bp, Artificial Sequence
  Synthetic DNA
taatactacataacgtag

SEQ ID NO: 40445 - DNA, 18 bp, Artificial Sequence
  Synthetic DNA
taatactaccttctaaag

SEQ ID NO: 40446 - DNA, 18 bp, Artificial Sequence
  Synthetic DNA
taatactactcaatcatg

SEQ ID NO: 40447 - DNA, 18 bp, Artificial Sequence
  Synthetic DNA
taatactactcacatatg

SEQ ID NO: 40448 - DNA, 18 bp, Artificial Sequence
  Synthetic DNA
taatactactctattaag

SEQ ID NO: 40449 - DNA, 18 bp, Artificial Sequence
  Synthetic DNA
taatactactctcctctg

SEQ ID NO: 40450 - DNA, 18 bp, Artificial Sequence
  Synthetic DNA
taatactactttctcaag

SEQ ID NO: 40451 - DNA, 18 bp, Artificial Sequence
  Synthetic DNA
taatactagatattttag

SEQ ID NO: 40452 - DNA, 18 bp, Artificial Sequence
  Synthetic DNA
taatactagtcattaatg

SEQ ID NO: 40453 - DNA, 18 bp, Artificial Sequence
  Synthetic DNA
taatactagtccctaatg

SEQ ID NO: 40454 - DNA, 18 bp, Artificial Sequence
  Synthetic DNA
taatactatccaacattg

SEQ ID NO: 40455 - DNA, 18 bp, Artificial Sequence
  Synthetic DNA
taatactattcatcgtcg

SEQ ID NO: 40456 - DNA, 18 bp, Artificial Sequence
  Synthetic DNA
taatactattcgcaaaag

SEQ ID NO: 40457 - DNA, 18 bp, Artificial Sequence
  Synthetic DNA
taatactccataccactg

SEQ ID NO: 40458 - DNA, 18 bp, Artificial Sequence
  Synthetic DNA
taatactgcactccatag

SEQ ID NO: 40459 - DNA, 18 bp, Artificial Sequence
  Synthetic DNA
taatactgcctaatttag

SEQ ID NO: 40460 - DNA, 18 bp, Artificial Sequence
  Synthetic DNA
taatactgttcacttttg

SEQ ID NO: 40461 - DNA, 18 bp, Artificial Sequence
  Synthetic DNA
taatacttaaaactctag

SEQ ID NO: 40462 - DNA, 18 bp, Artificial Sequence
  Synthetic DNA
taatacttaacgctacag

SEQ ID NO: 40463 - DNA, 18 bp, Artificial Sequence
  Synthetic DNA
taatacttataactctag

SEQ ID NO: 40464 - DNA, 18 bp, Artificial Sequence
  Synthetic DNA
taatacttatcatcatag

SEQ ID NO: 40465 - DNA, 18 bp, Artificial Sequence
  Synthetic DNA
taatacttcatcctatag

SEQ ID NO: 40466 - DNA, 18 bp, Artificial Sequence
  Synthetic DNA
taatacttctatccgtag

SEQ ID NO: 40467 - DNA, 18 bp, Artificial Sequence
  Synthetic DNA
taatacttctctataaag

SEQ ID NO: 40468 - DNA, 18 bp, Artificial Sequence
  Synthetic DNA
taatacttctgacaattg

SEQ ID NO: 40469 - DNA, 18 bp, Artificial Sequence
  Synthetic DNA
taatacttcttatgatag

SEQ ID NO: 40470 - DNA, 18 bp, Artificial Sequence
  Synthetic DNA
taatactttttgctcttg

SEQ ID NO: 40471 - DNA, 18 bp, Artificial Sequence
  Synthetic DNA
taatagaattcaaaatag

SEQ ID NO: 40472 - DNA, 18 bp, Artificial Sequence
  Synthetic DNA
taatagacatcactattg

SEQ ID NO: 40473 - DNA, 18 bp, Artificial Sequence
  Synthetic DNA
taatagatcacacatgag

SEQ ID NO: 40474 - DNA, 18 bp, Artificial Sequence
  Synthetic DNA
taatagatcacgctttag

SEQ ID NO: 40475 - DNA, 18 bp, Artificial Sequence
  Synthetic DNA
taatagctctcacaaaag

SEQ ID NO: 40476 - DNA, 18 bp, Artificial Sequence
  Synthetic DNA
taataggaaagactattg

SEQ ID NO: 40477 - DNA, 18 bp, Artificial Sequence
  Synthetic DNA
taataggaatcaaaattg

SEQ ID NO: 40478 - DNA, 18 bp, Artificial Sequence
  Synthetic DNA
taataggaatctcaaatg

SEQ ID NO: 40479 - DNA, 18 bp, Artificial Sequence
  Synthetic DNA
taataggacacaccgaag

SEQ ID NO: 40480 - DNA, 18 bp, Artificial Sequence
  Synthetic DNA
taataggacatactgttg

SEQ ID NO: 40481 - DNA, 18 bp, Artificial Sequence
  Synthetic DNA
taataggacgaattacag

SEQ ID NO: 40482 - DNA, 18 bp, Artificial Sequence
  Synthetic DNA
taataggacgtagtaaag

SEQ ID NO: 40483 - DNA, 18 bp, Artificial Sequence
  Synthetic DNA
taataggactatttattg

SEQ ID NO: 40484 - DNA, 18 bp, Artificial Sequence
  Synthetic DNA
taataggactctaggttg

SEQ ID NO: 40485 - DNA, 18 bp, Artificial Sequence
  Synthetic DNA
taataggactctcctcaa

SEQ ID NO: 40486 - DNA, 18 bp, Artificial Sequence
  Synthetic DNA
taataggacttgctgttg

SEQ ID NO: 40487 - DNA, 18 bp, Artificial Sequence
  Synthetic DNA
taataggactttctagtg

SEQ ID NO: 40488 - DNA, 18 bp, Artificial Sequence
  Synthetic DNA
taataggataaactatgg

SEQ ID NO: 40489 - DNA, 18 bp, Artificial Sequence
  Synthetic DNA
taataggcatcttaatag

SEQ ID NO: 40490 - DNA, 18 bp, Artificial Sequence
  Synthetic DNA
taataggtaacagtatag

SEQ ID NO: 40491 - DNA, 18 bp, Artificial Sequence
  Synthetic DNA
taataggtattaagaaag

SEQ ID NO: 40492 - DNA, 18 bp, Artificial Sequence
  Synthetic DNA
taataggtctcaacacgg

SEQ ID NO: 40493 - DNA, 18 bp, Artificial Sequence
  Synthetic DNA
taataggtgtcatttttg

SEQ ID NO: 40494 - DNA, 18 bp, Artificial Sequence
  Synthetic DNA
taataggttgcgttatag

SEQ ID NO: 40495 - DNA, 18 bp, Artificial Sequence
  Synthetic DNA
taataggtttcactacga

SEQ ID NO: 40496 - DNA, 18 bp, Artificial Sequence
  Synthetic DNA
taatagttttcactatgg

SEQ ID NO: 40497 - DNA, 18 bp, Artificial Sequence
  Synthetic DNA
taatagttttctctaaag

SEQ ID NO: 40498 - DNA, 18 bp, Artificial Sequence
  Synthetic DNA
taatataaatcactagtg

SEQ ID NO: 40499 - DNA, 18 bp, Artificial Sequence
  Synthetic DNA
taatataaatctctaaag

SEQ ID NO: 40500 - DNA, 18 bp, Artificial Sequence
  Synthetic DNA
taatataaatctctaatg

SEQ ID NO: 40501 - DNA, 18 bp, Artificial Sequence
  Synthetic DNA
taatataacactgtatag

SEQ ID NO: 40502 - DNA, 18 bp, Artificial Sequence
  Synthetic DNA
taatataacggaccatcg

SEQ ID NO: 40503 - DNA, 18 bp, Artificial Sequence
  Synthetic DNA
taatataactcaaaaaag

SEQ ID NO: 40504 - DNA, 18 bp, Artificial Sequence
  Synthetic DNA
taatatatatagatttag

SEQ ID NO: 40505 - DNA, 18 bp, Artificial Sequence
  Synthetic DNA
taatatatctcaccattg

SEQ ID NO: 40506 - DNA, 18 bp, Artificial Sequence
  Synthetic DNA
taatatatcttagtagag

SEQ ID NO: 40507 - DNA, 18 bp, Artificial Sequence
  Synthetic DNA
taatatatttcgctatag

SEQ ID NO: 40508 - DNA, 18 bp, Artificial Sequence
  Synthetic DNA
taatatcactctatatgg

SEQ ID NO: 40509 - DNA, 18 bp, Artificial Sequence
  Synthetic DNA
taatatcactttcccatg

SEQ ID NO: 40510 - DNA, 18 bp, Artificial Sequence
  Synthetic DNA
taatatcatcaactacag

SEQ ID NO: 40511 - DNA, 18 bp, Artificial Sequence
  Synthetic DNA
taatatgaaacgctttag

SEQ ID NO: 40512 - DNA, 18 bp, Artificial Sequence
  Synthetic DNA
taatatgaatatctattg

SEQ ID NO: 40513 - DNA, 18 bp, Artificial Sequence
  Synthetic DNA
taatatgacccaatcaag

SEQ ID NO: 40514 - DNA, 18 bp, Artificial Sequence
  Synthetic DNA
taatatgactaacacaag

SEQ ID NO: 40515 - DNA, 18 bp, Artificial Sequence
  Synthetic DNA
taatatgactggcttcag

SEQ ID NO: 40516 - DNA, 18 bp, Artificial Sequence
  Synthetic DNA
taatatgacttaattaag

SEQ ID NO: 40517 - DNA, 18 bp, Artificial Sequence
  Synthetic DNA
taatatgactttatattg

SEQ ID NO: 40518 - DNA, 18 bp, Artificial Sequence
  Synthetic DNA
taatatgagccactgtgg

SEQ ID NO: 40519 - DNA, 18 bp, Artificial Sequence
  Synthetic DNA
taatatgatccaatctag

SEQ ID NO: 40520 - DNA, 18 bp, Artificial Sequence
  Synthetic DNA
taatatgcaacactaaag

SEQ ID NO: 40521 - DNA, 18 bp, Artificial Sequence
  Synthetic DNA
taatatgccaatcatttg

SEQ ID NO: 40522 - DNA, 18 bp, Artificial Sequence
  Synthetic DNA
taatatgccatagcatgg

SEQ ID NO: 40523 - DNA, 18 bp, Artificial Sequence
  Synthetic DNA
taatatggctaatattag

SEQ ID NO: 40524 - DNA, 18 bp, Artificial Sequence
  Synthetic DNA
taatatgggaccctatag

SEQ ID NO: 40525 - DNA, 18 bp, Artificial Sequence
  Synthetic DNA
taatatgtcactgtaaag

SEQ ID NO: 40526 - DNA, 18 bp, Artificial Sequence
  Synthetic DNA
taatatgtctaatcctag

SEQ ID NO: 40527 - DNA, 18 bp, Artificial Sequence
  Synthetic DNA
taatatgtctcgacattg

SEQ ID NO: 40528 - DNA, 18 bp, Artificial Sequence
  Synthetic DNA
taatatgtctctcctaag

SEQ ID NO: 40529 - DNA, 18 bp, Artificial Sequence
  Synthetic DNA
taatatgtctctcgattg

SEQ ID NO: 40530 - DNA, 18 bp, Artificial Sequence
  Synthetic DNA
taatatgtctgataatag

SEQ ID NO: 40531 - DNA, 18 bp, Artificial Sequence
  Synthetic DNA
taatatgtgacgctatag

SEQ ID NO: 40532 - DNA, 18 bp, Artificial Sequence
  Synthetic DNA
taatatgtttcaccattg

SEQ ID NO: 40533 - DNA, 18 bp, Artificial Sequence
  Synthetic DNA
taatatgtttttcaaaag

SEQ ID NO: 40534 - DNA, 18 bp, Artificial Sequence
  Synthetic DNA
taatatgtttttctatag

SEQ ID NO: 40535 - DNA, 18 bp, Artificial Sequence
  Synthetic DNA
taatattaaactcaacag

SEQ ID NO: 40536 - DNA, 18 bp, Artificial Sequence
  Synthetic DNA
taatattacaaactacag

SEQ ID NO: 40537 - DNA, 18 bp, Artificial Sequence
  Synthetic DNA
taatattacccactaagg

SEQ ID NO: 40538 - DNA, 18 bp, Artificial Sequence
  Synthetic DNA
taatattacctaacatag

SEQ ID NO: 40539 - DNA, 18 bp, Artificial Sequence
  Synthetic DNA
taatattacgcaattatg

SEQ ID NO: 40540 - DNA, 18 bp, Artificial Sequence
  Synthetic DNA
taatattattcacaactg

SEQ ID NO: 40541 - DNA, 18 bp, Artificial Sequence
  Synthetic DNA
taatattgtaatctatag

SEQ ID NO: 40542 - DNA, 18 bp, Artificial Sequence
  Synthetic DNA
taatattgtacaccatag

SEQ ID NO: 40543 - DNA, 18 bp, Artificial Sequence
  Synthetic DNA
taatatttatctctttag

SEQ ID NO: 40544 - DNA, 18 bp, Artificial Sequence
  Synthetic DNA
taatcagaacaactattg

SEQ ID NO: 40545 - DNA, 18 bp, Artificial Sequence
  Synthetic DNA
taatcagaataagctaag

SEQ ID NO: 40546 - DNA, 18 bp, Artificial Sequence
  Synthetic DNA
taatcagactattaatag

SEQ ID NO: 40547 - DNA, 18 bp, Artificial Sequence
  Synthetic DNA
taatcagactctctaccg

SEQ ID NO: 40548 - DNA, 18 bp, Artificial Sequence
  Synthetic DNA
taatcagactggtgaaag

SEQ ID NO: 40549 - DNA, 18 bp, Artificial Sequence
  Synthetic DNA
taatcagagtgtaagtag

SEQ ID NO: 40550 - DNA, 18 bp, Artificial Sequence
  Synthetic DNA
taatcagtatcaacattg

SEQ ID NO: 40551 - DNA, 18 bp, Artificial Sequence
  Synthetic DNA
taatcagtctaattacag

SEQ ID NO: 40552 - DNA, 18 bp, Artificial Sequence
  Synthetic DNA
taatcatattttctttag

SEQ ID NO: 40553 - DNA, 18 bp, Artificial Sequence
  Synthetic DNA
taatcatgatcactatag

SEQ ID NO: 40554 - DNA, 18 bp, Artificial Sequence
  Synthetic DNA
taatccaaatcgcaatag

SEQ ID NO: 40555 - DNA, 18 bp, Artificial Sequence
  Synthetic DNA
taatccaaatctctatgg

SEQ ID NO: 40556 - DNA, 18 bp, Artificial Sequence
  Synthetic DNA
taatccaactatctgtag

SEQ ID NO: 40557 - DNA, 18 bp, Artificial Sequence
  Synthetic DNA
taatccaattcattattg

SEQ ID NO: 40558 - DNA, 18 bp, Artificial Sequence
  Synthetic DNA
taatccacccaaccatcg

SEQ ID NO: 40559 - DNA, 18 bp, Artificial Sequence
  Synthetic DNA
taatccctatcaatttag

SEQ ID NO: 40560 - DNA, 18 bp, Artificial Sequence
  Synthetic DNA
taatccgaatctcttttg

SEQ ID NO: 40561 - DNA, 18 bp, Artificial Sequence
  Synthetic DNA
taatccgacactcagtag

SEQ ID NO: 40562 - DNA, 18 bp, Artificial Sequence
  Synthetic DNA
taatccgactcaaatttg

SEQ ID NO: 40563 - DNA, 18 bp, Artificial Sequence
  Synthetic DNA
taatccgactcagatttg

SEQ ID NO: 40564 - DNA, 18 bp, Artificial Sequence
  Synthetic DNA
taatccgactcgtcaatg

SEQ ID NO: 40565 - DNA, 18 bp, Artificial Sequence
  Synthetic DNA
taatccgccaccctttag

SEQ ID NO: 40566 - DNA, 18 bp, Artificial Sequence
  Synthetic DNA
taatccgcttctctattg

SEQ ID NO: 40567 - DNA, 18 bp, Artificial Sequence
  Synthetic DNA
taatccggataatgatag

SEQ ID NO: 40568 - DNA, 18 bp, Artificial Sequence
  Synthetic DNA
taatccggcgctttatag

SEQ ID NO: 40569 - DNA, 18 bp, Artificial Sequence
  Synthetic DNA
taatccggctaacactag

SEQ ID NO: 40570 - DNA, 18 bp, Artificial Sequence
  Synthetic DNA
taatccgggtaactacag

SEQ ID NO: 40571 - DNA, 18 bp, Artificial Sequence
  Synthetic DNA
taatccgtcccacaattg

SEQ ID NO: 40572 - DNA, 18 bp, Artificial Sequence
  Synthetic DNA
taatccgtcgttcataag

SEQ ID NO: 40573 - DNA, 18 bp, Artificial Sequence
  Synthetic DNA
taatccgtctcagttatg

SEQ ID NO: 40574 - DNA, 18 bp, Artificial Sequence
  Synthetic DNA
taatccgtctttatatgg

SEQ ID NO: 40575 - DNA, 18 bp, Artificial Sequence
  Synthetic DNA
taatccgtctttcaaaag

SEQ ID NO: 40576 - DNA, 18 bp, Artificial Sequence
  Synthetic DNA
taatcctaataactttag

SEQ ID NO: 40577 - DNA, 18 bp, Artificial Sequence
  Synthetic DNA
taatcctacaaactttag

SEQ ID NO: 40578 - DNA, 18 bp, Artificial Sequence
  Synthetic DNA
taatcctacactatatag

SEQ ID NO: 40579 - DNA, 18 bp, Artificial Sequence
  Synthetic DNA
taatcctacctacaatag

SEQ ID NO: 40580 - DNA, 18 bp, Artificial Sequence
  Synthetic DNA
taatcctacttgcgaagg

SEQ ID NO: 40581 - DNA, 18 bp, Artificial Sequence
  Synthetic DNA
taatcctactttctttag

SEQ ID NO: 40582 - DNA, 18 bp, Artificial Sequence
  Synthetic DNA
taatcgaattcgctaaag

SEQ ID NO: 40583 - DNA, 18 bp, Artificial Sequence
  Synthetic DNA
taatcgagctcactaaag

SEQ ID NO: 40584 - DNA, 18 bp, Artificial Sequence
  Synthetic DNA
taatcggactctcttttg

SEQ ID NO: 40585 - DNA, 18 bp, Artificial Sequence
  Synthetic DNA
taatcggactctgtaaag

SEQ ID NO: 40586 - DNA, 18 bp, Artificial Sequence
  Synthetic DNA
taatcggtctcacaacag

SEQ ID NO: 40587 - DNA, 18 bp, Artificial Sequence
  Synthetic DNA
taatctaactcgttttag

SEQ ID NO: 40588 - DNA, 18 bp, Artificial Sequence
  Synthetic DNA
taatctgacgtacaaaag

SEQ ID NO: 40589 - DNA, 18 bp, Artificial Sequence
  Synthetic DNA
taatctgactccttattg

SEQ ID NO: 40590 - DNA, 18 bp, Artificial Sequence
  Synthetic DNA
taatctgagtcggtatcg

SEQ ID NO: 40591 - DNA, 18 bp, Artificial Sequence
  Synthetic DNA
taatctggcccactttag

SEQ ID NO: 40592 - DNA, 18 bp, Artificial Sequence
  Synthetic DNA
taatctgtctctttatgg

SEQ ID NO: 40593 - DNA, 18 bp, Artificial Sequence
  Synthetic DNA
taatctttctctttatgg

SEQ ID NO: 40594 - DNA, 18 bp, Artificial Sequence
  Synthetic DNA
taatgaaactctctcttg

SEQ ID NO: 40595 - DNA, 18 bp, Artificial Sequence
  Synthetic DNA
taatgacatttacataag

SEQ ID NO: 40596 - DNA, 18 bp, Artificial Sequence
  Synthetic DNA
taatgactctctctaaag

SEQ ID NO: 40597 - DNA, 18 bp, Artificial Sequence
  Synthetic DNA
taatgagaatctttatag

SEQ ID NO: 40598 - DNA, 18 bp, Artificial Sequence
  Synthetic DNA
taatgatactctccatag

SEQ ID NO: 40599 - DNA, 18 bp, Artificial Sequence
  Synthetic DNA
taatgatacttactttag

SEQ ID NO: 40600 - DNA, 18 bp, Artificial Sequence
  Synthetic DNA
taatgatgctcactaaag

SEQ ID NO: 40601 - DNA, 18 bp, Artificial Sequence
  Synthetic DNA
taatgattctaactacag

SEQ ID NO: 40602 - DNA, 18 bp, Artificial Sequence
  Synthetic DNA
taatgcaactcacttggg

SEQ ID NO: 40603 - DNA, 18 bp, Artificial Sequence
  Synthetic DNA
taatgcaactcgttctag

SEQ ID NO: 40604 - DNA, 18 bp, Artificial Sequence
  Synthetic DNA
taatgcaattctatatag

SEQ ID NO: 40605 - DNA, 18 bp, Artificial Sequence
  Synthetic DNA
taatgcacctgaccatag

SEQ ID NO: 40606 - DNA, 18 bp, Artificial Sequence
  Synthetic DNA
taatgcagctaactaaag

SEQ ID NO: 40607 - DNA, 18 bp, Artificial Sequence
  Synthetic DNA
taatgcatattattattg

SEQ ID NO: 40608 - DNA, 18 bp, Artificial Sequence
  Synthetic DNA
taatgcatcatactatag

SEQ ID NO: 40609 - DNA, 18 bp, Artificial Sequence
  Synthetic DNA
taatgcatcctactctag

SEQ ID NO: 40610 - DNA, 18 bp, Artificial Sequence
  Synthetic DNA
taatgcatgtcattctag

SEQ ID NO: 40611 - DNA, 18 bp, Artificial Sequence
  Synthetic DNA
taatgccaatgtctaacg

SEQ ID NO: 40612 - DNA, 18 bp, Artificial Sequence
  Synthetic DNA
taatgccactatctaaag

SEQ ID NO: 40613 - DNA, 18 bp, Artificial Sequence
  Synthetic DNA
taatgcccctcattttgg

SEQ ID NO: 40614 - DNA, 18 bp, Artificial Sequence
  Synthetic DNA
taatgcctgtctcattag

SEQ ID NO: 40615 - DNA, 18 bp, Artificial Sequence
  Synthetic DNA
taatgcctttctctatag

SEQ ID NO: 40616 - DNA, 18 bp, Artificial Sequence
  Synthetic DNA
taatgcgaatctcttaag

SEQ ID NO: 40617 - DNA, 18 bp, Artificial Sequence
  Synthetic DNA
taatgcgacacagacaag

SEQ ID NO: 40618 - DNA, 18 bp, Artificial Sequence
  Synthetic DNA
taatgcgacactctgatg

SEQ ID NO: 40619 - DNA, 18 bp, Artificial Sequence
  Synthetic DNA
taatgcgacattctatgg

SEQ ID NO: 40620 - DNA, 18 bp, Artificial Sequence
  Synthetic DNA
taatgcgaccaaaaagag

SEQ ID NO: 40621 - DNA, 18 bp, Artificial Sequence
  Synthetic DNA
taatgcgaccacctattg

SEQ ID NO: 40622 - DNA, 18 bp, Artificial Sequence
  Synthetic DNA
taatgcgactcaacaatg

SEQ ID NO: 40623 - DNA, 18 bp, Artificial Sequence
  Synthetic DNA
taatgcgactctccccag

SEQ ID NO: 40624 - DNA, 18 bp, Artificial Sequence
  Synthetic DNA
taatgcgagactctgtag

SEQ ID NO: 40625 - DNA, 18 bp, Artificial Sequence
  Synthetic DNA
taatgcggataacaatcg

SEQ ID NO: 40626 - DNA, 18 bp, Artificial Sequence
  Synthetic DNA
taatgcggcttacttaag

SEQ ID NO: 40627 - DNA, 18 bp, Artificial Sequence
  Synthetic DNA
taatgcgtatcaatagag

SEQ ID NO: 40628 - DNA, 18 bp, Artificial Sequence
  Synthetic DNA
taatgcgtctcgcatcag

SEQ ID NO: 40629 - DNA, 18 bp, Artificial Sequence
  Synthetic DNA
taatgcgtcttaatttag

SEQ ID NO: 40630 - DNA, 18 bp, Artificial Sequence
  Synthetic DNA
taatgcgttactttatag

SEQ ID NO: 40631 - DNA, 18 bp, Artificial Sequence
  Synthetic DNA
taatgctacgcattattg

SEQ ID NO: 40632 - DNA, 18 bp, Artificial Sequence
  Synthetic DNA
taatgctgctcactgttg

SEQ ID NO: 40633 - DNA, 18 bp, Artificial Sequence
  Synthetic DNA
taatgcttctcaatagag

SEQ ID NO: 40634 - DNA, 18 bp, Artificial Sequence
  Synthetic DNA
taatgcttctgtctatcg

SEQ ID NO: 40635 - DNA, 18 bp, Artificial Sequence
  Synthetic DNA
taatgcttgtggatatag

SEQ ID NO: 40636 - DNA, 18 bp, Artificial Sequence
  Synthetic DNA
taatggcccccactctag

SEQ ID NO: 40637 - DNA, 18 bp, Artificial Sequence
  Synthetic DNA
taatgggacttattacag

SEQ ID NO: 40638 - DNA, 18 bp, Artificial Sequence
  Synthetic DNA
taatgggtttctctatag

SEQ ID NO: 40639 - DNA, 18 bp, Artificial Sequence
  Synthetic DNA
taatggtagtaactctag

SEQ ID NO: 40640 - DNA, 18 bp, Artificial Sequence
  Synthetic DNA
taatgtcaatctttattg

SEQ ID NO: 40641 - DNA, 18 bp, Artificial Sequence
  Synthetic DNA
taatgtgacacacttcag

SEQ ID NO: 40642 - DNA, 18 bp, Artificial Sequence
  Synthetic DNA
taatgtgactcgatattg

SEQ ID NO: 40643 - DNA, 18 bp, Artificial Sequence
  Synthetic DNA
taatgttactaacaaacg

SEQ ID NO: 40644 - DNA, 18 bp, Artificial Sequence
  Synthetic DNA
taatgttacttagtatgg

SEQ ID NO: 40645 - DNA, 18 bp, Artificial Sequence
  Synthetic DNA
taatgttacttttaccag

SEQ ID NO: 40646 - DNA, 18 bp, Artificial Sequence
  Synthetic DNA
taattaaaattattctag

SEQ ID NO: 40647 - DNA, 18 bp, Artificial Sequence
  Synthetic DNA
taattaaactcattagag

SEQ ID NO: 40648 - DNA, 18 bp, Artificial Sequence
  Synthetic DNA
taattaaactctcaattg

SEQ ID NO: 40649 - DNA, 18 bp, Artificial Sequence
  Synthetic DNA
taattaaatccactatag

SEQ ID NO: 40650 - DNA, 18 bp, Artificial Sequence
  Synthetic DNA
taattacactccctattg

SEQ ID NO: 40651 - DNA, 18 bp, Artificial Sequence
  Synthetic DNA
taattacatacactttag

SEQ ID NO: 40652 - DNA, 18 bp, Artificial Sequence
  Synthetic DNA
taattagaaacactgtag

SEQ ID NO: 40653 - DNA, 18 bp, Artificial Sequence
  Synthetic DNA
taattagaatctctattg

SEQ ID NO: 40654 - DNA, 18 bp, Artificial Sequence
  Synthetic DNA
taattagaatctgtatag

SEQ ID NO: 40655 - DNA, 18 bp, Artificial Sequence
  Synthetic DNA
taattagacaagttatag

SEQ ID NO: 40656 - DNA, 18 bp, Artificial Sequence
  Synthetic DNA
taattagacacaatatcg

SEQ ID NO: 40657 - DNA, 18 bp, Artificial Sequence
  Synthetic DNA
taattagacccataatag

SEQ ID NO: 40658 - DNA, 18 bp, Artificial Sequence
  Synthetic DNA
taattagagttactaaag

SEQ ID NO: 40659 - DNA, 18 bp, Artificial Sequence
  Synthetic DNA
taattagattccgtttag

SEQ ID NO: 40660 - DNA, 18 bp, Artificial Sequence
  Synthetic DNA
taattagcctctggcaag

SEQ ID NO: 40661 - DNA, 18 bp, Artificial Sequence
  Synthetic DNA
taattaggctcacttctg

SEQ ID NO: 40662 - DNA, 18 bp, Artificial Sequence
  Synthetic DNA
taattaggctcattattg

SEQ ID NO: 40663 - DNA, 18 bp, Artificial Sequence
  Synthetic DNA
taattagtcgtacgattg

SEQ ID NO: 40664 - DNA, 18 bp, Artificial Sequence
  Synthetic DNA
taattagtctgtataatg

SEQ ID NO: 40665 - DNA, 18 bp, Artificial Sequence
  Synthetic DNA
taattagtttcaatattg

SEQ ID NO: 40666 - DNA, 18 bp, Artificial Sequence
  Synthetic DNA
taattataatgaatatag

SEQ ID NO: 40667 - DNA, 18 bp, Artificial Sequence
  Synthetic DNA
taattatactcaatgatg

SEQ ID NO: 40668 - DNA, 18 bp, Artificial Sequence
  Synthetic DNA
taattatactctcttcag

SEQ ID NO: 40669 - DNA, 18 bp, Artificial Sequence
  Synthetic DNA
taattatactttctaaag

SEQ ID NO: 40670 - DNA, 18 bp, Artificial Sequence
  Synthetic DNA
taattatattctctcgag

SEQ ID NO: 40671 - DNA, 18 bp, Artificial Sequence
  Synthetic DNA
taattatatttactatag

SEQ ID NO: 40672 - DNA, 18 bp, Artificial Sequence
  Synthetic DNA
taattattcctactatag

SEQ ID NO: 40673 - DNA, 18 bp, Artificial Sequence
  Synthetic DNA
taattattctcagtatag

SEQ ID NO: 40674 - DNA, 18 bp, Artificial Sequence
  Synthetic DNA
taattcaacacattttag

SEQ ID NO: 40675 - DNA, 18 bp, Artificial Sequence
  Synthetic DNA
taattcaacacgccagag

SEQ ID NO: 40676 - DNA, 18 bp, Artificial Sequence
  Synthetic DNA
taattcaacatactaaag

SEQ ID NO: 40677 - DNA, 18 bp, Artificial Sequence
  Synthetic DNA
taattcaactaaagttag

SEQ ID NO: 40678 - DNA, 18 bp, Artificial Sequence
  Synthetic DNA
taattcaactaacatgag

SEQ ID NO: 40679 - DNA, 18 bp, Artificial Sequence
  Synthetic DNA
taattcaactcacacggg

SEQ ID NO: 40680 - DNA, 18 bp, Artificial Sequence
  Synthetic DNA
taattcaactcgatatcg

SEQ ID NO: 40681 - DNA, 18 bp, Artificial Sequence
  Synthetic DNA
taattcacctttctaaag

SEQ ID NO: 40682 - DNA, 18 bp, Artificial Sequence
  Synthetic DNA
taattcagtgatccaaag

SEQ ID NO: 40683 - DNA, 18 bp, Artificial Sequence
  Synthetic DNA
taattcatcgcactctag

SEQ ID NO: 40684 - DNA, 18 bp, Artificial Sequence
  Synthetic DNA
taattcatggcgctgagg

SEQ ID NO: 40685 - DNA, 18 bp, Artificial Sequence
  Synthetic DNA
taattccaatcagcatag

SEQ ID NO: 40686 - DNA, 18 bp, Artificial Sequence
  Synthetic DNA
taattccacactctgtag

SEQ ID NO: 40687 - DNA, 18 bp, Artificial Sequence
  Synthetic DNA
taattccagtaactattg

SEQ ID NO: 40688 - DNA, 18 bp, Artificial Sequence
  Synthetic DNA
taattccagtcacttatg

SEQ ID NO: 40689 - DNA, 18 bp, Artificial Sequence
  Synthetic DNA
taattcctatcactaaag

SEQ ID NO: 40690 - DNA, 18 bp, Artificial Sequence
  Synthetic DNA
taattcgaaaaactatgg

SEQ ID NO: 40691 - DNA, 18 bp, Artificial Sequence
  Synthetic DNA
taattcgaaatactttcg

SEQ ID NO: 40692 - DNA, 18 bp, Artificial Sequence
  Synthetic DNA
taattcgaacttaaaaag

SEQ ID NO: 40693 - DNA, 18 bp, Artificial Sequence
  Synthetic DNA
taattcgaatcattcaag

SEQ ID NO: 40694 - DNA, 18 bp, Artificial Sequence
  Synthetic DNA
taattcgacacggactag

SEQ ID NO: 40695 - DNA, 18 bp, Artificial Sequence
  Synthetic DNA
taattcgacatacaatcg

SEQ ID NO: 40696 - DNA, 18 bp, Artificial Sequence
  Synthetic DNA
taattcgactacttatcg

SEQ ID NO: 40697 - DNA, 18 bp, Artificial Sequence
  Synthetic DNA
taattcgactatcttacg

SEQ ID NO: 40698 - DNA, 18 bp, Artificial Sequence
  Synthetic DNA
taattcgactcatattgg

SEQ ID NO: 40699 - DNA, 18 bp, Artificial Sequence
  Synthetic DNA
taattcgactcatgtttg

SEQ ID NO: 40700 - DNA, 18 bp, Artificial Sequence
  Synthetic DNA
taattcgactcgcgaagg

SEQ ID NO: 40701 - DNA, 18 bp, Artificial Sequence
  Synthetic DNA
taattcgactcggatcag

SEQ ID NO: 40702 - DNA, 18 bp, Artificial Sequence
  Synthetic DNA
taattcgactctcacggg

SEQ ID NO: 40703 - DNA, 18 bp, Artificial Sequence
  Synthetic DNA
taattcgactctcttacg

SEQ ID NO: 40704 - DNA, 18 bp, Artificial Sequence
  Synthetic DNA
taattcgactcttattag

SEQ ID NO: 40705 - DNA, 18 bp, Artificial Sequence
  Synthetic DNA
taattcgactgacacttg

SEQ ID NO: 40706 - DNA, 18 bp, Artificial Sequence
  Synthetic DNA
taattcgacttccttaag

SEQ ID NO: 40707 - DNA, 18 bp, Artificial Sequence
  Synthetic DNA
taattcgactttctctcg

SEQ ID NO: 40708 - DNA, 18 bp, Artificial Sequence
  Synthetic DNA
taattcgatacagctttg

SEQ ID NO: 40709 - DNA, 18 bp, Artificial Sequence
  Synthetic DNA
taattcgattcacaactg

SEQ ID NO: 40710 - DNA, 18 bp, Artificial Sequence
  Synthetic DNA
taattcgattgtccttag

SEQ ID NO: 40711 - DNA, 18 bp, Artificial Sequence
  Synthetic DNA
taattcgcctgaaattag

SEQ ID NO: 40712 - DNA, 18 bp, Artificial Sequence
  Synthetic DNA
taattcgcgtcccttaag

SEQ ID NO: 40713 - DNA, 18 bp, Artificial Sequence
  Synthetic DNA
taattcgctatactattg

SEQ ID NO: 40714 - DNA, 18 bp, Artificial Sequence
  Synthetic DNA
taattcggatcacatttg

SEQ ID NO: 40715 - DNA, 18 bp, Artificial Sequence
  Synthetic DNA
taattcggctaattattg

SEQ ID NO: 40716 - DNA, 18 bp, Artificial Sequence
  Synthetic DNA
taattcgtaatactatag

SEQ ID NO: 40717 - DNA, 18 bp, Artificial Sequence
  Synthetic DNA
taattcgtatcaatattg

SEQ ID NO: 40718 - DNA, 18 bp, Artificial Sequence
  Synthetic DNA
taattcgtatcactgaag

SEQ ID NO: 40719 - DNA, 18 bp, Artificial Sequence
  Synthetic DNA
taattcgtcacatagaag

SEQ ID NO: 40720 - DNA, 18 bp, Artificial Sequence
  Synthetic DNA
taattcgtcactttatag

SEQ ID NO: 40721 - DNA, 18 bp, Artificial Sequence
  Synthetic DNA
taattcgtcagactaaag

SEQ ID NO: 40722 - DNA, 18 bp, Artificial Sequence
  Synthetic DNA
taattcgtcagattatcg

SEQ ID NO: 40723 - DNA, 18 bp, Artificial Sequence
  Synthetic DNA
taattcgtcgcactttcg

SEQ ID NO: 40724 - DNA, 18 bp, Artificial Sequence
  Synthetic DNA
taattcgtcgcattcaag

SEQ ID NO: 40725 - DNA, 18 bp, Artificial Sequence
  Synthetic DNA
taattcgtctagctgtag

SEQ ID NO: 40726 - DNA, 18 bp, Artificial Sequence
  Synthetic DNA
taattcgtctcaaatttg

SEQ ID NO: 40727 - DNA, 18 bp, Artificial Sequence
  Synthetic DNA
taattcgtctcacacttg

SEQ ID NO: 40728 - DNA, 18 bp, Artificial Sequence
  Synthetic DNA
taattcgtctcacttagg

SEQ ID NO: 40729 - DNA, 18 bp, Artificial Sequence
  Synthetic DNA
taattcgtctctctaagg

SEQ ID NO: 40730 - DNA, 18 bp, Artificial Sequence
  Synthetic DNA
taattcgtctttctactg

SEQ ID NO: 40731 - DNA, 18 bp, Artificial Sequence
  Synthetic DNA
taattcgtttcaatattg

SEQ ID NO: 40732 - DNA, 18 bp, Artificial Sequence
  Synthetic DNA
taattcgtttcagtaaag

SEQ ID NO: 40733 - DNA, 18 bp, Artificial Sequence
  Synthetic DNA
taattcgtttcatcatag

SEQ ID NO: 40734 - DNA, 18 bp, Artificial Sequence
  Synthetic DNA
taattctacacacaagtg

SEQ ID NO: 40735 - DNA, 18 bp, Artificial Sequence
  Synthetic DNA
taattctacatactaaag

SEQ ID NO: 40736 - DNA, 18 bp, Artificial Sequence
  Synthetic DNA
taattctaccctctaatg

SEQ ID NO: 40737 - DNA, 18 bp, Artificial Sequence
  Synthetic DNA
taattctactaataatag

SEQ ID NO: 40738 - DNA, 18 bp, Artificial Sequence
  Synthetic DNA
taattctattctacatgg

SEQ ID NO: 40739 - DNA, 18 bp, Artificial Sequence
  Synthetic DNA
taattctgcgcagtattg

SEQ ID NO: 40740 - DNA, 18 bp, Artificial Sequence
  Synthetic DNA
taattctgctatatctcg

SEQ ID NO: 40741 - DNA, 18 bp, Artificial Sequence
  Synthetic DNA
taattctgctcacctcag

SEQ ID NO: 40742 - DNA, 18 bp, Artificial Sequence
  Synthetic DNA
taattcttatcatggtag

SEQ ID NO: 40743 - DNA, 18 bp, Artificial Sequence
  Synthetic DNA
taattcttctcactactg

SEQ ID NO: 40744 - DNA, 18 bp, Artificial Sequence
  Synthetic DNA
taattcttctgacttaag

SEQ ID NO: 40745 - DNA, 18 bp, Artificial Sequence
  Synthetic DNA
taattcttctgtctatag

SEQ ID NO: 40746 - DNA, 18 bp, Artificial Sequence
  Synthetic DNA
taattcttttcataatag

SEQ ID NO: 40747 - DNA, 18 bp, Artificial Sequence
  Synthetic DNA
taattgctctctcaaaag

SEQ ID NO: 40748 - DNA, 18 bp, Artificial Sequence
  Synthetic DNA
taattggaatcattattg

SEQ ID NO: 40749 - DNA, 18 bp, Artificial Sequence
  Synthetic DNA
taattggaatttctatag

SEQ ID NO: 40750 - DNA, 18 bp, Artificial Sequence
  Synthetic DNA
taattggacacgtaaatg

SEQ ID NO: 40751 - DNA, 18 bp, Artificial Sequence
  Synthetic DNA
taattggacgaactaaag

SEQ ID NO: 40752 - DNA, 18 bp, Artificial Sequence
  Synthetic DNA
taattggacttatttttg

SEQ ID NO: 40753 - DNA, 18 bp, Artificial Sequence
  Synthetic DNA
taattggatacactctag

SEQ ID NO: 40754 - DNA, 18 bp, Artificial Sequence
  Synthetic DNA
taattggattctttattg

SEQ ID NO: 40755 - DNA, 18 bp, Artificial Sequence
  Synthetic DNA
taattggattttataaag

SEQ ID NO: 40756 - DNA, 18 bp, Artificial Sequence
  Synthetic DNA
taattggctacactacag

SEQ ID NO: 40757 - DNA, 18 bp, Artificial Sequence
  Synthetic DNA
taattgggcatactatag

SEQ ID NO: 40758 - DNA, 18 bp, Artificial Sequence
  Synthetic DNA
taattgggcgccccatcg

SEQ ID NO: 40759 - DNA, 18 bp, Artificial Sequence
  Synthetic DNA
taattggtataagtatag

SEQ ID NO: 40760 - DNA, 18 bp, Artificial Sequence
  Synthetic DNA
taattggtctcacatatg

SEQ ID NO: 40761 - DNA, 18 bp, Artificial Sequence
  Synthetic DNA
taattggtctcctgatag

SEQ ID NO: 40762 - DNA, 18 bp, Artificial Sequence
  Synthetic DNA
taattggtgtcactacag

SEQ ID NO: 40763 - DNA, 18 bp, Artificial Sequence
  Synthetic DNA
taattgtacactatttag

SEQ ID NO: 40764 - DNA, 18 bp, Artificial Sequence
  Synthetic DNA
taattgtgcacacaaagg

SEQ ID NO: 40765 - DNA, 18 bp, Artificial Sequence
  Synthetic DNA
taattgttcccactatcg

SEQ ID NO: 40766 - DNA, 18 bp, Artificial Sequence
  Synthetic DNA
taatttaactccttaaag

SEQ ID NO: 40767 - DNA, 18 bp, Artificial Sequence
  Synthetic DNA
taatttaactcgctaagg

SEQ ID NO: 40768 - DNA, 18 bp, Artificial Sequence
  Synthetic DNA
taatttcacacacgttag

SEQ ID NO: 40769 - DNA, 18 bp, Artificial Sequence
  Synthetic DNA
taatttcacttattctag

SEQ ID NO: 40770 - DNA, 18 bp, Artificial Sequence
  Synthetic DNA
taatttgactaactagtg

SEQ ID NO: 40771 - DNA, 18 bp, Artificial Sequence
  Synthetic DNA
taatttgagtctctaaag

SEQ ID NO: 40772 - DNA, 18 bp, Artificial Sequence
  Synthetic DNA
taatttgattaactttag

SEQ ID NO: 40773 - DNA, 18 bp, Artificial Sequence
  Synthetic DNA
taatttgtcagactatag

SEQ ID NO: 40774 - DNA, 18 bp, Artificial Sequence
  Synthetic DNA
taatttgtctaactcaag

SEQ ID NO: 40775 - DNA, 18 bp, Artificial Sequence
  Synthetic DNA
taatttgtctcacataag

SEQ ID NO: 40776 - DNA, 18 bp, Artificial Sequence
  Synthetic DNA
taatttgtctcactgcag

SEQ ID NO: 40777 - DNA, 18 bp, Artificial Sequence
  Synthetic DNA
taatttgtttcactgttg

SEQ ID NO: 40778 - DNA, 18 bp, Artificial Sequence
  Synthetic DNA
tacaaagagttactatcg

SEQ ID NO: 40779 - DNA, 18 bp, Artificial Sequence
  Synthetic DNA
tacaacaacacactttag

SEQ ID NO: 40780 - DNA, 18 bp, Artificial Sequence
  Synthetic DNA
tacaacaactcaatattg

SEQ ID NO: 40781 - DNA, 18 bp, Artificial Sequence
  Synthetic DNA
tacaacaactcataatag

SEQ ID NO: 40782 - DNA, 18 bp, Artificial Sequence
  Synthetic DNA
tacaacacctctctatag

SEQ ID NO: 40783 - DNA, 18 bp, Artificial Sequence
  Synthetic DNA
tacaaccaccccattaag

SEQ ID NO: 40784 - DNA, 18 bp, Artificial Sequence
  Synthetic DNA
tacaaccagtcactatcg

SEQ ID NO: 40785 - DNA, 18 bp, Artificial Sequence
  Synthetic DNA
tacaacgaatcactttgg

SEQ ID NO: 40786 - DNA, 18 bp, Artificial Sequence
  Synthetic DNA
tacaacgacacatcatag

SEQ ID NO: 40787 - DNA, 18 bp, Artificial Sequence
  Synthetic DNA
tacaacgactcatgtaag

SEQ ID NO: 40788 - DNA, 18 bp, Artificial Sequence
  Synthetic DNA
tacaacgacttaatattg

SEQ ID NO: 40789 - DNA, 18 bp, Artificial Sequence
  Synthetic DNA
tacaacgacttattatgg

SEQ ID NO: 40790 - DNA, 18 bp, Artificial Sequence
  Synthetic DNA
tacaacgattcaatatgg

SEQ ID NO: 40791 - DNA, 18 bp, Artificial Sequence
  Synthetic DNA
tacaacgcatcaccttag

SEQ ID NO: 40792 - DNA, 18 bp, Artificial Sequence
  Synthetic DNA
tacaacgccttattaatg

SEQ ID NO: 40793 - DNA, 18 bp, Artificial Sequence
  Synthetic DNA
tacaacgctccactatgg

SEQ ID NO: 40794 - DNA, 18 bp, Artificial Sequence
  Synthetic DNA
tacaacggcgcactattg

SEQ ID NO: 40795 - DNA, 18 bp, Artificial Sequence
  Synthetic DNA
tacaactactttctccag

SEQ ID NO: 40796 - DNA, 18 bp, Artificial Sequence
  Synthetic DNA
tacaagagttcactatgg

SEQ ID NO: 40797 - DNA, 18 bp, Artificial Sequence
  Synthetic DNA
tacaaggactgtctatag

SEQ ID NO: 40798 - DNA, 18 bp, Artificial Sequence
  Synthetic DNA
tacaatcactcacttttg

SEQ ID NO: 40799 - DNA, 18 bp, Artificial Sequence
  Synthetic DNA
tacacacactcacaatcg

SEQ ID NO: 40800 - DNA, 18 bp, Artificial Sequence
  Synthetic DNA
tacaccgattcagtttag

SEQ ID NO: 40801 - DNA, 18 bp, Artificial Sequence
  Synthetic DNA
tacaccgcctaacaatag

SEQ ID NO: 40802 - DNA, 18 bp, Artificial Sequence
  Synthetic DNA
tacagagtcttagtatag

SEQ ID NO: 40803 - DNA, 18 bp, Artificial Sequence
  Synthetic DNA
tacataggctctctatag

SEQ ID NO: 40804 - DNA, 18 bp, Artificial Sequence
  Synthetic DNA
tacatcgataaacaattg

SEQ ID NO: 40805 - DNA, 18 bp, Artificial Sequence
  Synthetic DNA
tacatcgtcccactatag

SEQ ID NO: 40806 - DNA, 18 bp, Artificial Sequence
  Synthetic DNA
tacatgtccactcaattg

SEQ ID NO: 40807 - DNA, 18 bp, Artificial Sequence
  Synthetic DNA
taccaaaactcactattg

SEQ ID NO: 40808 - DNA, 18 bp, Artificial Sequence
  Synthetic DNA
taccacacctaactatag

SEQ ID NO: 40809 - DNA, 18 bp, Artificial Sequence
  Synthetic DNA
taccacatctcacaatag

SEQ ID NO: 40810 - DNA, 18 bp, Artificial Sequence
  Synthetic DNA
taccacgactcatactag

SEQ ID NO: 40811 - DNA, 18 bp, Artificial Sequence
  Synthetic DNA
taccacgcctgacattag

SEQ ID NO: 40812 - DNA, 18 bp, Artificial Sequence
  Synthetic DNA
taccacgtcttactacag

SEQ ID NO: 40813 - DNA, 18 bp, Artificial Sequence
  Synthetic DNA
taccacgtttcactgtag

SEQ ID NO: 40814 - DNA, 18 bp, Artificial Sequence
  Synthetic DNA
taccactactctctgtag

SEQ ID NO: 40815 - DNA, 18 bp, Artificial Sequence
  Synthetic DNA
taccatgactgtctatag

SEQ ID NO: 40816 - DNA, 18 bp, Artificial Sequence
  Synthetic DNA
taccgcttcaaagtattg

SEQ ID NO: 40817 - DNA, 18 bp, Artificial Sequence
  Synthetic DNA
taccttgacacgctgaag

SEQ ID NO: 40818 - DNA, 18 bp, Artificial Sequence
  Synthetic DNA
tacgaccagtcgatgaag

SEQ ID NO: 40819 - DNA, 18 bp, Artificial Sequence
  Synthetic DNA
tacgactactctctctag

SEQ ID NO: 40820 - DNA, 18 bp, Artificial Sequence
  Synthetic DNA
tacggcgaatcgctatag

SEQ ID NO: 40821 - DNA, 18 bp, Artificial Sequence
  Synthetic DNA
tacggcgtcattcgatag

SEQ ID NO: 40822 - DNA, 18 bp, Artificial Sequence
  Synthetic DNA
tacgttgaccatctgcag

SEQ ID NO: 40823 - DNA, 18 bp, Artificial Sequence
  Synthetic DNA
tactaagactaacaaaag

SEQ ID NO: 40824 - DNA, 18 bp, Artificial Sequence
  Synthetic DNA
tactaagactctcttttg

SEQ ID NO: 40825 - DNA, 18 bp, Artificial Sequence
  Synthetic DNA
tactaagtcacactaaag

SEQ ID NO: 40826 - DNA, 18 bp, Artificial Sequence
  Synthetic DNA
tactaatacacactattg

SEQ ID NO: 40827 - DNA, 18 bp, Artificial Sequence
  Synthetic DNA
tactacaaatctctatcg

SEQ ID NO: 40828 - DNA, 18 bp, Artificial Sequence
  Synthetic DNA
tactacaacacattttag

SEQ ID NO: 40829 - DNA, 18 bp, Artificial Sequence
  Synthetic DNA
tactacaacgcaataaag

SEQ ID NO: 40830 - DNA, 18 bp, Artificial Sequence
  Synthetic DNA
tactacaactcacttatg

SEQ ID NO: 40831 - DNA, 18 bp, Artificial Sequence
  Synthetic DNA
tactacaactccttgtag

SEQ ID NO: 40832 - DNA, 18 bp, Artificial Sequence
  Synthetic DNA
tactacaactcgtagctg

SEQ ID NO: 40833 - DNA, 18 bp, Artificial Sequence
  Synthetic DNA
tactacaactctccatcg

SEQ ID NO: 40834 - DNA, 18 bp, Artificial Sequence
  Synthetic DNA
tactacatctcttcacag

SEQ ID NO: 40835 - DNA, 18 bp, Artificial Sequence
  Synthetic DNA
tactacatcttaaatttg

SEQ ID NO: 40836 - DNA, 18 bp, Artificial Sequence
  Synthetic DNA
tactacatctttcattag

SEQ ID NO: 40837 - DNA, 18 bp, Artificial Sequence
  Synthetic DNA
tactaccactatgtgtag

SEQ ID NO: 40838 - DNA, 18 bp, Artificial Sequence
  Synthetic DNA
tactaccagtctatatag

SEQ ID NO: 40839 - DNA, 18 bp, Artificial Sequence
  Synthetic DNA
tactacgaaaccagttag

SEQ ID NO: 40840 - DNA, 18 bp, Artificial Sequence
  Synthetic DNA
tactacgacaaacatttg

SEQ ID NO: 40841 - DNA, 18 bp, Artificial Sequence
  Synthetic DNA
tactacgacacattttcg

SEQ ID NO: 40842 - DNA, 18 bp, Artificial Sequence
  Synthetic DNA
tactacgactcattacct

SEQ ID NO: 40843 - DNA, 18 bp, Artificial Sequence
  Synthetic DNA
tactacgatttataatag

SEQ ID NO: 40844 - DNA, 18 bp, Artificial Sequence
  Synthetic DNA
tactacgcgtcacagtag

SEQ ID NO: 40845 - DNA, 18 bp, Artificial Sequence
  Synthetic DNA
tactacgtcgcgctgtag

SEQ ID NO: 40846 - DNA, 18 bp, Artificial Sequence
  Synthetic DNA
tactacgtctcccaaaag

SEQ ID NO: 40847 - DNA, 18 bp, Artificial Sequence
  Synthetic DNA
tactacgtttcaatgtag

SEQ ID NO: 40848 - DNA, 18 bp, Artificial Sequence
  Synthetic DNA
tactactactctatagag

SEQ ID NO: 40849 - DNA, 18 bp, Artificial Sequence
  Synthetic DNA
tactactactctcaattg

SEQ ID NO: 40850 - DNA, 18 bp, Artificial Sequence
  Synthetic DNA
tactactacttaacaaag

SEQ ID NO: 40851 - DNA, 18 bp, Artificial Sequence
  Synthetic DNA
tactactacttacaactg

SEQ ID NO: 40852 - DNA, 18 bp, Artificial Sequence
  Synthetic DNA
tactacttctaaggctag

SEQ ID NO: 40853 - DNA, 18 bp, Artificial Sequence
  Synthetic DNA
tactacttctcacagtag

SEQ ID NO: 40854 - DNA, 18 bp, Artificial Sequence
  Synthetic DNA
tactagcactcacactag

SEQ ID NO: 40855 - DNA, 18 bp, Artificial Sequence
  Synthetic DNA
tactaggactctccttag

SEQ ID NO: 40856 - DNA, 18 bp, Artificial Sequence
  Synthetic DNA
tactaggatttcctatgg

SEQ ID NO: 40857 - DNA, 18 bp, Artificial Sequence
  Synthetic DNA
tactataacaccctatag

SEQ ID NO: 40858 - DNA, 18 bp, Artificial Sequence
  Synthetic DNA
tactataactccatatag

SEQ ID NO: 40859 - DNA, 18 bp, Artificial Sequence
  Synthetic DNA
tactataattctttcaag

SEQ ID NO: 40860 - DNA, 18 bp, Artificial Sequence
  Synthetic DNA
tactatgaatgagcaaag

SEQ ID NO: 40861 - DNA, 18 bp, Artificial Sequence
  Synthetic DNA
tactatgcgtcacttaag

SEQ ID NO: 40862 - DNA, 18 bp, Artificial Sequence
  Synthetic DNA
tactatgtatctctatag

SEQ ID NO: 40863 - DNA, 18 bp, Artificial Sequence
  Synthetic DNA
tactatttctaattttag

SEQ ID NO: 40864 - DNA, 18 bp, Artificial Sequence
  Synthetic DNA
tactatttctcacaatag

SEQ ID NO: 40865 - DNA, 18 bp, Artificial Sequence
  Synthetic DNA
tactcctactcactgtcg

SEQ ID NO: 40866 - DNA, 18 bp, Artificial Sequence
  Synthetic DNA
tactcctactctctaaag

SEQ ID NO: 40867 - DNA, 18 bp, Artificial Sequence
  Synthetic DNA
tactctatcacactatag

SEQ ID NO: 40868 - DNA, 18 bp, Artificial Sequence
  Synthetic DNA
tactgagtctctccgtag

SEQ ID NO: 40869 - DNA, 18 bp, Artificial Sequence
  Synthetic DNA
tactgccactccattttg

SEQ ID NO: 40870 - DNA, 18 bp, Artificial Sequence
  Synthetic DNA
tactgtgacacattaaag

SEQ ID NO: 40871 - DNA, 18 bp, Artificial Sequence
  Synthetic DNA
tacttagactcaagttag

SEQ ID NO: 40872 - DNA, 18 bp, Artificial Sequence
  Synthetic DNA
tacttagactcgcaatag

SEQ ID NO: 40873 - DNA, 18 bp, Artificial Sequence
  Synthetic DNA
tacttcaaatctctatag

SEQ ID NO: 40874 - DNA, 18 bp, Artificial Sequence
  Synthetic DNA
tacttcaattcattatcg

SEQ ID NO: 40875 - DNA, 18 bp, Artificial Sequence
  Synthetic DNA
tacttcgacttccttaag

SEQ ID NO: 40876 - DNA, 18 bp, Artificial Sequence
  Synthetic DNA
tacttcgatctactatag

SEQ ID NO: 40877 - DNA, 18 bp, Artificial Sequence
  Synthetic DNA
tacttcgtgtctcaatag

SEQ ID NO: 40878 - DNA, 18 bp, Artificial Sequence
  Synthetic DNA
tacttctactcactttgg

SEQ ID NO: 40879 - DNA, 18 bp, Artificial Sequence
  Synthetic DNA
tacttcttctaactatag

SEQ ID NO: 40880 - DNA, 18 bp, Artificial Sequence
  Synthetic DNA
tactttgacagtctacag

SEQ ID NO: 40881 - DNA, 18 bp, Artificial Sequence
  Synthetic DNA
tagaaaaacacactatgg

SEQ ID NO: 40882 - DNA, 18 bp, Artificial Sequence
  Synthetic DNA
tagaaatcttcacaatcg

SEQ ID NO: 40883 - DNA, 18 bp, Artificial Sequence
  Synthetic DNA
tagaacaccactctattg

SEQ ID NO: 40884 - DNA, 18 bp, Artificial Sequence
  Synthetic DNA
tagaacgactcaatcaag

SEQ ID NO: 40885 - DNA, 18 bp, Artificial Sequence
  Synthetic DNA
tagaacgactgtctattg

SEQ ID NO: 40886 - DNA, 18 bp, Artificial Sequence
  Synthetic DNA
tagaacgacttacattag

SEQ ID NO: 40887 - DNA, 18 bp, Artificial Sequence
  Synthetic DNA
tagaacgatacagtgtag

SEQ ID NO: 40888 - DNA, 18 bp, Artificial Sequence
  Synthetic DNA
tagaacgattcatgttag

SEQ ID NO: 40889 - DNA, 18 bp, Artificial Sequence
  Synthetic DNA
tagaacgcattcttaccg

SEQ ID NO: 40890 - DNA, 18 bp, Artificial Sequence
  Synthetic DNA
tagaacggcttactattg

SEQ ID NO: 40891 - DNA, 18 bp, Artificial Sequence
  Synthetic DNA
tagaacgtctcacttatg

SEQ ID NO: 40892 - DNA, 18 bp, Artificial Sequence
  Synthetic DNA
tagaacgtcttaaaaatg

SEQ ID NO: 40893 - DNA, 18 bp, Artificial Sequence
  Synthetic DNA
tagaaggaatcacaatag

SEQ ID NO: 40894 - DNA, 18 bp, Artificial Sequence
  Synthetic DNA
tagaaggacacactctag

SEQ ID NO: 40895 - DNA, 18 bp, Artificial Sequence
  Synthetic DNA
tagaatcactacctagag

SEQ ID NO: 40896 - DNA, 18 bp, Artificial Sequence
  Synthetic DNA
tagaatgtcttactatag

SEQ ID NO: 40897 - DNA, 18 bp, Artificial Sequence
  Synthetic DNA
tagaattactaactttag

SEQ ID NO: 40898 - DNA, 18 bp, Artificial Sequence
  Synthetic DNA
tagaccgattaactctcg

SEQ ID NO: 40899 - DNA, 18 bp, Artificial Sequence
  Synthetic DNA
tagaccgccttactatag

SEQ ID NO: 40900 - DNA, 18 bp, Artificial Sequence
  Synthetic DNA
tagactgtctaaatatag

SEQ ID NO: 40901 - DNA, 18 bp, Artificial Sequence
  Synthetic DNA
tagatcgaattactttag

SEQ ID NO: 40902 - DNA, 18 bp, Artificial Sequence
  Synthetic DNA
tagatcgacgcagatatg

SEQ ID NO: 40903 - DNA, 18 bp, Artificial Sequence
  Synthetic DNA
tagatcgactaattagag

SEQ ID NO: 40904 - DNA, 18 bp, Artificial Sequence
  Synthetic DNA
tagatctatttaatatag

SEQ ID NO: 40905 - DNA, 18 bp, Artificial Sequence
  Synthetic DNA
tagatggcctctcaaaag

SEQ ID NO: 40906 - DNA, 18 bp, Artificial Sequence
  Synthetic DNA
tagcaagtctcactagag

SEQ ID NO: 40907 - DNA, 18 bp, Artificial Sequence
  Synthetic DNA
tagcacgactcatttttg

SEQ ID NO: 40908 - DNA, 18 bp, Artificial Sequence
  Synthetic DNA
tagcacgactccttattg

SEQ ID NO: 40909 - DNA, 18 bp, Artificial Sequence
  Synthetic DNA
tagcacgccacactttag

SEQ ID NO: 40910 - DNA, 18 bp, Artificial Sequence
  Synthetic DNA
tagcacggcaaaatattg

SEQ ID NO: 40911 - DNA, 18 bp, Artificial Sequence
  Synthetic DNA
tagcatgacacattatag

SEQ ID NO: 40912 - DNA, 18 bp, Artificial Sequence
  Synthetic DNA
tagcatgacataatatag

SEQ ID NO: 40913 - DNA, 18 bp, Artificial Sequence
  Synthetic DNA
tagcatgtgccacaatag

SEQ ID NO: 40914 - DNA, 18 bp, Artificial Sequence
  Synthetic DNA
taggacgaagctccatag

SEQ ID NO: 40915 - DNA, 18 bp, Artificial Sequence
  Synthetic DNA
taggacgtctcacacttg

SEQ ID NO: 40916 - DNA, 18 bp, Artificial Sequence
  Synthetic DNA
taggtcaaaacacattag

SEQ ID NO: 40917 - DNA, 18 bp, Artificial Sequence
  Synthetic DNA
taggtcctctcactatag

SEQ ID NO: 40918 - DNA, 18 bp, Artificial Sequence
  Synthetic DNA
tagtaaaactaacaatag

SEQ ID NO: 40919 - DNA, 18 bp, Artificial Sequence
  Synthetic DNA
tagtaaaactcaccaaag

SEQ ID NO: 40920 - DNA, 18 bp, Artificial Sequence
  Synthetic DNA
tagtaagaccttctatgg

SEQ ID NO: 40921 - DNA, 18 bp, Artificial Sequence
  Synthetic DNA
tagtaagactctctttcg

SEQ ID NO: 40922 - DNA, 18 bp, Artificial Sequence
  Synthetic DNA
tagtacaacacactagcg

SEQ ID NO: 40923 - DNA, 18 bp, Artificial Sequence
  Synthetic DNA
tagtacaattaactttcg

SEQ ID NO: 40924 - DNA, 18 bp, Artificial Sequence
  Synthetic DNA
tagtacaattcacttaag

SEQ ID NO: 40925 - DNA, 18 bp, Artificial Sequence
  Synthetic DNA
tagtacaattcactttcg

SEQ ID NO: 40926 - DNA, 18 bp, Artificial Sequence
  Synthetic DNA
tagtacaattcgctattg

SEQ ID NO: 40927 - DNA, 18 bp, Artificial Sequence
  Synthetic DNA
tagtacatatcactaatg

SEQ ID NO: 40928 - DNA, 18 bp, Artificial Sequence
  Synthetic DNA
tagtacatatcattacag

SEQ ID NO: 40929 - DNA, 18 bp, Artificial Sequence
  Synthetic DNA
tagtacatatctctcttg

SEQ ID NO: 40930 - DNA, 18 bp, Artificial Sequence
  Synthetic DNA
tagtacatcagtctatag

SEQ ID NO: 40931 - DNA, 18 bp, Artificial Sequence
  Synthetic DNA
tagtaccactcctaatag

SEQ ID NO: 40932 - DNA, 18 bp, Artificial Sequence
  Synthetic DNA
tagtaccactttctaaag

SEQ ID NO: 40933 - DNA, 18 bp, Artificial Sequence
  Synthetic DNA
tagtaccatacacaatag

SEQ ID NO: 40934 - DNA, 18 bp, Artificial Sequence
  Synthetic DNA
tagtacgaaacagtctag

SEQ ID NO: 40935 - DNA, 18 bp, Artificial Sequence
  Synthetic DNA
tagtacgaatcggaatag

SEQ ID NO: 40936 - DNA, 18 bp, Artificial Sequence
  Synthetic DNA
tagtacgacaaatttaag

SEQ ID NO: 40937 - DNA, 18 bp, Artificial Sequence
  Synthetic DNA
tagtacgactctccaatg

SEQ ID NO: 40938 - DNA, 18 bp, Artificial Sequence
  Synthetic DNA
tagtacgatcgactcatg

SEQ ID NO: 40939 - DNA, 18 bp, Artificial Sequence
  Synthetic DNA
tagtacggccatctattg

SEQ ID NO: 40940 - DNA, 18 bp, Artificial Sequence
  Synthetic DNA
tagtacgtcacgctattg

SEQ ID NO: 40941 - DNA, 18 bp, Artificial Sequence
  Synthetic DNA
tagtacgtctcaccactg

SEQ ID NO: 40942 - DNA, 18 bp, Artificial Sequence
  Synthetic DNA
tagtacgtctctcttgag

SEQ ID NO: 40943 - DNA, 18 bp, Artificial Sequence
  Synthetic DNA
tagtactactgatttttg

SEQ ID NO: 40944 - DNA, 18 bp, Artificial Sequence
  Synthetic DNA
tagtacttatcccagtag

SEQ ID NO: 40945 - DNA, 18 bp, Artificial Sequence
  Synthetic DNA
tagtacttctcaatagag

SEQ ID NO: 40946 - DNA, 18 bp, Artificial Sequence
  Synthetic DNA
tagtacttgtcgctatcg

SEQ ID NO: 40947 - DNA, 18 bp, Artificial Sequence
  Synthetic DNA
tagtaggattcactaggg

SEQ ID NO: 40948 - DNA, 18 bp, Artificial Sequence
  Synthetic DNA
tagtatatcatactattg

SEQ ID NO: 40949 - DNA, 18 bp, Artificial Sequence
  Synthetic DNA
tagtatgactcattgttg

SEQ ID NO: 40950 - DNA, 18 bp, Artificial Sequence
  Synthetic DNA
tagtatgctttaatatag

SEQ ID NO: 40951 - DNA, 18 bp, Artificial Sequence
  Synthetic DNA
tagtattactcaatacag

SEQ ID NO: 40952 - DNA, 18 bp, Artificial Sequence
  Synthetic DNA
tagtattacttataattg

SEQ ID NO: 40953 - DNA, 18 bp, Artificial Sequence
  Synthetic DNA
tagtattagatactattg

SEQ ID NO: 40954 - DNA, 18 bp, Artificial Sequence
  Synthetic DNA
tagtcagactaattttag

SEQ ID NO: 40955 - DNA, 18 bp, Artificial Sequence
  Synthetic DNA
tagtcatactcactaaag

SEQ ID NO: 40956 - DNA, 18 bp, Artificial Sequence
  Synthetic DNA
tagtccatctctctattg

SEQ ID NO: 40957 - DNA, 18 bp, Artificial Sequence
  Synthetic DNA
tagtccatgtcgctatag

SEQ ID NO: 40958 - DNA, 18 bp, Artificial Sequence
  Synthetic DNA
tagtccgtgccactattg

SEQ ID NO: 40959 - DNA, 18 bp, Artificial Sequence
  Synthetic DNA
tagtcggacacactattg

SEQ ID NO: 40960 - DNA, 18 bp, Artificial Sequence
  Synthetic DNA
tagtcggactcactgaag

SEQ ID NO: 40961 - DNA, 18 bp, Artificial Sequence
  Synthetic DNA
tagtctcactcactttcg

SEQ ID NO: 40962 - DNA, 18 bp, Artificial Sequence
  Synthetic DNA
tagtgagtttcactacag

SEQ ID NO: 40963 - DNA, 18 bp, Artificial Sequence
  Synthetic DNA
tagtgggacccacaagag

SEQ ID NO: 40964 - DNA, 18 bp, Artificial Sequence
  Synthetic DNA
tagttcaactcctttaag

SEQ ID NO: 40965 - DNA, 18 bp, Artificial Sequence
  Synthetic DNA
tagttcaactctcgaacg

SEQ ID NO: 40966 - DNA, 18 bp, Artificial Sequence
  Synthetic DNA
tagttcgaaactctatag

SEQ ID NO: 40967 - DNA, 18 bp, Artificial Sequence
  Synthetic DNA
tagttcgaaccactttag

SEQ ID NO: 40968 - DNA, 18 bp, Artificial Sequence
  Synthetic DNA
tagttcgaaccattatag

SEQ ID NO: 40969 - DNA, 18 bp, Artificial Sequence
  Synthetic DNA
tagttcgaataactgtag

SEQ ID NO: 40970 - DNA, 18 bp, Artificial Sequence
  Synthetic DNA
tagttcgaatttttatag

SEQ ID NO: 40971 - DNA, 18 bp, Artificial Sequence
  Synthetic DNA
tagttcgacaccgtaaag

SEQ ID NO: 40972 - DNA, 18 bp, Artificial Sequence
  Synthetic DNA
tagttcgacactcaattg

SEQ ID NO: 40973 - DNA, 18 bp, Artificial Sequence
  Synthetic DNA
tagttcgaccctctttag

SEQ ID NO: 40974 - DNA, 18 bp, Artificial Sequence
  Synthetic DNA
tagttcgactagcaatag

SEQ ID NO: 40975 - DNA, 18 bp, Artificial Sequence
  Synthetic DNA
tagttcgtctaacaagtg

SEQ ID NO: 40976 - DNA, 18 bp, Artificial Sequence
  Synthetic DNA
tagttctactcacaattg

SEQ ID NO: 40977 - DNA, 18 bp, Artificial Sequence
  Synthetic DNA
tagttctactcgctaaag

SEQ ID NO: 40978 - DNA, 18 bp, Artificial Sequence
  Synthetic DNA
tagttctacttattaaag

SEQ ID NO: 40979 - DNA, 18 bp, Artificial Sequence
  Synthetic DNA
tagttctagtccctaatg

SEQ ID NO: 40980 - DNA, 18 bp, Artificial Sequence
  Synthetic DNA
tagttctattcactacag

SEQ ID NO: 40981 - DNA, 18 bp, Artificial Sequence
  Synthetic DNA
tagttctattcattatag

SEQ ID NO: 40982 - DNA, 18 bp, Artificial Sequence
  Synthetic DNA
tagttctcttcatcttag

SEQ ID NO: 40983 - DNA, 18 bp, Artificial Sequence
  Synthetic DNA
tagttctgctgactggag

SEQ ID NO: 40984 - DNA, 18 bp, Artificial Sequence
  Synthetic DNA
tagttcttctcattttag

SEQ ID NO: 40985 - DNA, 18 bp, Artificial Sequence
  Synthetic DNA
tataaaaactccctaaag

SEQ ID NO: 40986 - DNA, 18 bp, Artificial Sequence
  Synthetic DNA
tataaacactcaacatag

SEQ ID NO: 40987 - DNA, 18 bp, Artificial Sequence
  Synthetic DNA
tataaagaatcactaaag

SEQ ID NO: 40988 - DNA, 18 bp, Artificial Sequence
  Synthetic DNA
tataaagactcacataag

SEQ ID NO: 40989 - DNA, 18 bp, Artificial Sequence
  Synthetic DNA
tataaagagtccctaatg

SEQ ID NO: 40990 - DNA, 18 bp, Artificial Sequence
  Synthetic DNA
tataaagcattactacag

SEQ ID NO: 40991 - DNA, 18 bp, Artificial Sequence
  Synthetic DNA
tataaatactgatcatag

SEQ ID NO: 40992 - DNA, 18 bp, Artificial Sequence
  Synthetic DNA
tataacaattcgcattag

SEQ ID NO: 40993 - DNA, 18 bp, Artificial Sequence
  Synthetic DNA
tataaccactcattttag

SEQ ID NO: 40994 - DNA, 18 bp, Artificial Sequence
  Synthetic DNA
tataaccactctctaaag

SEQ ID NO: 40995 - DNA, 18 bp, Artificial Sequence
  Synthetic DNA
tataacgacacacgttgg

SEQ ID NO: 40996 - DNA, 18 bp, Artificial Sequence
  Synthetic DNA
tataacgacacattttcg

SEQ ID NO: 40997 - DNA, 18 bp, Artificial Sequence
  Synthetic DNA
tataacgacactatatcg

SEQ ID NO: 40998 - DNA, 18 bp, Artificial Sequence
  Synthetic DNA
tataacgacatactaaag

SEQ ID NO: 40999 - DNA, 18 bp, Artificial Sequence
  Synthetic DNA
tataacgactctaatttg

SEQ ID NO: 41000 - DNA, 18 bp, Artificial Sequence
  Synthetic DNA
tataacgactgacaaagg

SEQ ID NO: 41001 - DNA, 18 bp, Artificial Sequence
  Synthetic DNA
tataacgacttcctaaag

SEQ ID NO: 41002 - DNA, 18 bp, Artificial Sequence
  Synthetic DNA
tataacgagaaactatag

SEQ ID NO: 41003 - DNA, 18 bp, Artificial Sequence
  Synthetic DNA
tataacgagattctttag

SEQ ID NO: 41004 - DNA, 18 bp, Artificial Sequence
  Synthetic DNA
tataacgagctactaatg

SEQ ID NO: 41005 - DNA, 18 bp, Artificial Sequence
  Synthetic DNA
tataacgagtcaccagag

SEQ ID NO: 41006 - DNA, 18 bp, Artificial Sequence
  Synthetic DNA
tataacgagtcaccctag

SEQ ID NO: 41007 - DNA, 18 bp, Artificial Sequence
  Synthetic DNA
tataacgatacactccag

SEQ ID NO: 41008 - DNA, 18 bp, Artificial Sequence
  Synthetic DNA
tataacgattccccacag

SEQ ID NO: 41009 - DNA, 18 bp, Artificial Sequence
  Synthetic DNA
tataacgcctaaaaattg

SEQ ID NO: 41010 - DNA, 18 bp, Artificial Sequence
  Synthetic DNA
tataacgcctcacttttg

SEQ ID NO: 41011 - DNA, 18 bp, Artificial Sequence
  Synthetic DNA
tataacggctcaatatcg

SEQ ID NO: 41012 - DNA, 18 bp, Artificial Sequence
  Synthetic DNA
tataacgtcacactcaag

SEQ ID NO: 41013 - DNA, 18 bp, Artificial Sequence
  Synthetic DNA
tataacgtcccaatatag

SEQ ID NO: 41014 - DNA, 18 bp, Artificial Sequence
  Synthetic DNA
tataacgtctctctcatg

SEQ ID NO: 41015 - DNA, 18 bp, Artificial Sequence
  Synthetic DNA
tataacgtgtccctatag

SEQ ID NO: 41016 - DNA, 18 bp, Artificial Sequence
  Synthetic DNA
tataactactccctcttg

SEQ ID NO: 41017 - DNA, 18 bp, Artificial Sequence
  Synthetic DNA
tataactactgactttag

SEQ ID NO: 41018 - DNA, 18 bp, Artificial Sequence
  Synthetic DNA
tataactattcacgatag

SEQ ID NO: 41019 - DNA, 18 bp, Artificial Sequence
  Synthetic DNA
tataacttttcaatattg

SEQ ID NO: 41020 - DNA, 18 bp, Artificial Sequence
  Synthetic DNA
tataaggactcaccaaag

SEQ ID NO: 41021 - DNA, 18 bp, Artificial Sequence
  Synthetic DNA
tataaggagacactacag

SEQ ID NO: 41022 - DNA, 18 bp, Artificial Sequence
  Synthetic DNA
tataaggattcaccattg

SEQ ID NO: 41023 - DNA, 18 bp, Artificial Sequence
  Synthetic DNA
tataataattctctttag

SEQ ID NO: 41024 - DNA, 18 bp, Artificial Sequence
  Synthetic DNA
tataatgactccctaccg

SEQ ID NO: 41025 - DNA, 18 bp, Artificial Sequence
  Synthetic DNA
tataatgtctcagaatag

SEQ ID NO: 41026 - DNA, 18 bp, Artificial Sequence
  Synthetic DNA
tataccgactcaacaaag

SEQ ID NO: 41027 - DNA, 18 bp, Artificial Sequence
  Synthetic DNA
tataccgtctaacttgtg

SEQ ID NO: 41028 - DNA, 18 bp, Artificial Sequence
  Synthetic DNA
tataccttcacactatag

SEQ ID NO: 41029 - DNA, 18 bp, Artificial Sequence
  Synthetic DNA
tatacgaactccctaaag

SEQ ID NO: 41030 - DNA, 18 bp, Artificial Sequence
  Synthetic DNA
tatactgatacattatag

SEQ ID NO: 41031 - DNA, 18 bp, Artificial Sequence
  Synthetic DNA
tatactgcctgactatag

SEQ ID NO: 41032 - DNA, 18 bp, Artificial Sequence
  Synthetic DNA
tatagcaattcactaaag

SEQ ID NO: 41033 - DNA, 18 bp, Artificial Sequence
  Synthetic DNA
tatagcgacactctatag

SEQ ID NO: 41034 - DNA, 18 bp, Artificial Sequence
  Synthetic DNA
tatagcgtctctctatag

SEQ ID NO: 41035 - DNA, 18 bp, Artificial Sequence
  Synthetic DNA
tatagcgtttcactatcg

SEQ ID NO: 41036 - DNA, 18 bp, Artificial Sequence
  Synthetic DNA
tatatagagactctattg

SEQ ID NO: 41037 - DNA, 18 bp, Artificial Sequence
  Synthetic DNA
tatatcatcacactatag

SEQ ID NO: 41038 - DNA, 18 bp, Artificial Sequence
  Synthetic DNA
tatatcgacaggctaaag

SEQ ID NO: 41039 - DNA, 18 bp, Artificial Sequence
  Synthetic DNA
tatatcgactaaatacag

SEQ ID NO: 41040 - DNA, 18 bp, Artificial Sequence
  Synthetic DNA
tatatcgactcgcttaag

SEQ ID NO: 41041 - DNA, 18 bp, Artificial Sequence
  Synthetic DNA
tatatcgccccagaaaag

SEQ ID NO: 41042 - DNA, 18 bp, Artificial Sequence
  Synthetic DNA
tatatcgtaacgctgtag

SEQ ID NO: 41043 - DNA, 18 bp, Artificial Sequence
  Synthetic DNA
tatatcgtcacactattg

SEQ ID NO: 41044 - DNA, 18 bp, Artificial Sequence
  Synthetic DNA
tatatctactcacttaag

SEQ ID NO: 41045 - DNA, 18 bp, Artificial Sequence
  Synthetic DNA
tatatcttcacactcttg

SEQ ID NO: 41046 - DNA, 18 bp, Artificial Sequence
  Synthetic DNA
tatatggacttcgaatag

SEQ ID NO: 41047 - DNA, 18 bp, Artificial Sequence
  Synthetic DNA
tatattgactcacttccg

SEQ ID NO: 41048 - DNA, 18 bp, Artificial Sequence
  Synthetic DNA
tatcaagccattctttag

SEQ ID NO: 41049 - DNA, 18 bp, Artificial Sequence
  Synthetic DNA
tatcacacctcacaatag

SEQ ID NO: 41050 - DNA, 18 bp, Artificial Sequence
  Synthetic DNA
tatcacgaatctatacag

SEQ ID NO: 41051 - DNA, 18 bp, Artificial Sequence
  Synthetic DNA
tatcacgacagtcttttg

SEQ ID NO: 41052 - DNA, 18 bp, Artificial Sequence
  Synthetic DNA
tatcacgactcaacttag

SEQ ID NO: 41053 - DNA, 18 bp, Artificial Sequence
  Synthetic DNA
tatcacgacttgctaaag

SEQ ID NO: 41054 - DNA, 18 bp, Artificial Sequence
  Synthetic DNA
tatcacgattcgatatag

SEQ ID NO: 41055 - DNA, 18 bp, Artificial Sequence
  Synthetic DNA
tatcacgccacccaatag

SEQ ID NO: 41056 - DNA, 18 bp, Artificial Sequence
  Synthetic DNA
tatcacggatctctattg

SEQ ID NO: 41057 - DNA, 18 bp, Artificial Sequence
  Synthetic DNA
tatcacggtacacgattg

SEQ ID NO: 41058 - DNA, 18 bp, Artificial Sequence
  Synthetic DNA
tatcacgtctacctatag

SEQ ID NO: 41059 - DNA, 18 bp, Artificial Sequence
  Synthetic DNA
tatcacgtctcacatatg

SEQ ID NO: 41060 - DNA, 18 bp, Artificial Sequence
  Synthetic DNA
tatcacgtctcactaatg

SEQ ID NO: 41061 - DNA, 18 bp, Artificial Sequence
  Synthetic DNA
tatcacgttacactaaag

SEQ ID NO: 41062 - DNA, 18 bp, Artificial Sequence
  Synthetic DNA
tatcaggtctcattatag

SEQ ID NO: 41063 - DNA, 18 bp, Artificial Sequence
  Synthetic DNA
tatcagttctctctatag

SEQ ID NO: 41064 - DNA, 18 bp, Artificial Sequence
  Synthetic DNA
tatcattactcactttag

SEQ ID NO: 41065 - DNA, 18 bp, Artificial Sequence
  Synthetic DNA
tatccccactcaccattg

SEQ ID NO: 41066 - DNA, 18 bp, Artificial Sequence
  Synthetic DNA
tatcgcgattcacggtag

SEQ ID NO: 41067 - DNA, 18 bp, Artificial Sequence
  Synthetic DNA
tatcgcgtctagcaatag

SEQ ID NO: 41068 - DNA, 18 bp, Artificial Sequence
  Synthetic DNA
tatctcagctcactaatg

SEQ ID NO: 41069 - DNA, 18 bp, Artificial Sequence
  Synthetic DNA
tatctcgacccactaaag

SEQ ID NO: 41070 - DNA, 18 bp, Artificial Sequence
  Synthetic DNA
tatctcgtctcacaaaag

SEQ ID NO: 41071 - DNA, 18 bp, Artificial Sequence
  Synthetic DNA
tatctcgtggcactatgg

SEQ ID NO: 41072 - DNA, 18 bp, Artificial Sequence
  Synthetic DNA
tatctctactcaccatag

SEQ ID NO: 41073 - DNA, 18 bp, Artificial Sequence
  Synthetic DNA
tatcttgtcatatagtag

SEQ ID NO: 41074 - DNA, 18 bp, Artificial Sequence
  Synthetic DNA
tatctttacttatttcag

SEQ ID NO: 41075 - DNA, 18 bp, Artificial Sequence
  Synthetic DNA
tatgaccgttcaccatag

SEQ ID NO: 41076 - DNA, 18 bp, Artificial Sequence
  Synthetic DNA
tatgacgaatctctaccg

SEQ ID NO: 41077 - DNA, 18 bp, Artificial Sequence
  Synthetic DNA
tatgacgaatctctcatg

SEQ ID NO: 41078 - DNA, 18 bp, Artificial Sequence
  Synthetic DNA
tatgacgacacgctttag

SEQ ID NO: 41079 - DNA, 18 bp, Artificial Sequence
  Synthetic DNA
tatgaggactcattaaag

SEQ ID NO: 41080 - DNA, 18 bp, Artificial Sequence
  Synthetic DNA
tatgatgagtcactaaag

SEQ ID NO: 41081 - DNA, 18 bp, Artificial Sequence
  Synthetic DNA
tatgccgactcaataagg

SEQ ID NO: 41082 - DNA, 18 bp, Artificial Sequence
  Synthetic DNA
tatgtcgactcaattttg

SEQ ID NO: 41083 - DNA, 18 bp, Artificial Sequence
  Synthetic DNA
tattaaaacacaattttg

SEQ ID NO: 41084 - DNA, 18 bp, Artificial Sequence
  Synthetic DNA
tattaaaacccgctatag

SEQ ID NO: 41085 - DNA, 18 bp, Artificial Sequence
  Synthetic DNA
tattaaaattcacagtag

SEQ ID NO: 41086 - DNA, 18 bp, Artificial Sequence
  Synthetic DNA
tattaacactaactatcg

SEQ ID NO: 41087 - DNA, 18 bp, Artificial Sequence
  Synthetic DNA
tattaacactaactgtag

SEQ ID NO: 41088 - DNA, 18 bp, Artificial Sequence
  Synthetic DNA
tattaacgcttgcaatag

SEQ ID NO: 41089 - DNA, 18 bp, Artificial Sequence
  Synthetic DNA
tattaagaatcattattg

SEQ ID NO: 41090 - DNA, 18 bp, Artificial Sequence
  Synthetic DNA
tattaagactcaaattag

SEQ ID NO: 41091 - DNA, 18 bp, Artificial Sequence
  Synthetic DNA
tattaagactccccatcg

SEQ ID NO: 41092 - DNA, 18 bp, Artificial Sequence
  Synthetic DNA
tattaagactctatattg

SEQ ID NO: 41093 - DNA, 18 bp, Artificial Sequence
  Synthetic DNA
tattaagactctctttgg

SEQ ID NO: 41094 - DNA, 18 bp, Artificial Sequence
  Synthetic DNA
tattaagatgcttcaaag

SEQ ID NO: 41095 - DNA, 18 bp, Artificial Sequence
  Synthetic DNA
tattaagcatcacaatgg

SEQ ID NO: 41096 - DNA, 18 bp, Artificial Sequence
  Synthetic DNA
tattaagccttacttttg

SEQ ID NO: 41097 - DNA, 18 bp, Artificial Sequence
  Synthetic DNA
tattaaggctcattctag

SEQ ID NO: 41098 - DNA, 18 bp, Artificial Sequence
  Synthetic DNA
tattaaggttcactctag

SEQ ID NO: 41099 - DNA, 18 bp, Artificial Sequence
  Synthetic DNA
tattaagtcgctctatag

SEQ ID NO: 41100 - DNA, 18 bp, Artificial Sequence
  Synthetic DNA
tattaagtcttatattgg

SEQ ID NO: 41101 - DNA, 18 bp, Artificial Sequence
  Synthetic DNA
tattacaaatcactgttg

SEQ ID NO: 41102 - DNA, 18 bp, Artificial Sequence
  Synthetic DNA
tattacaacactctaaag

SEQ ID NO: 41103 - DNA, 18 bp, Artificial Sequence
  Synthetic DNA
tattacaacccccaattg

SEQ ID NO: 41104 - DNA, 18 bp, Artificial Sequence
  Synthetic DNA
tattacaaccccctaacg

SEQ ID NO: 41105 - DNA, 18 bp, Artificial Sequence
  Synthetic DNA
tattacaactcacatagg

SEQ ID NO: 41106 - DNA, 18 bp, Artificial Sequence
  Synthetic DNA
tattacaactcccgagag

SEQ ID NO: 41107 - DNA, 18 bp, Artificial Sequence
  Synthetic DNA
tattacaactctctcgtg

SEQ ID NO: 41108 - DNA, 18 bp, Artificial Sequence
  Synthetic DNA
tattacaactgtctttcg

SEQ ID NO: 41109 - DNA, 18 bp, Artificial Sequence
  Synthetic DNA
tattacaactttatgtag

SEQ ID NO: 41110 - DNA, 18 bp, Artificial Sequence
  Synthetic DNA
tattacatatcactatcg

SEQ ID NO: 41111 - DNA, 18 bp, Artificial Sequence
  Synthetic DNA
tattacatcaaaattaag

SEQ ID NO: 41112 - DNA, 18 bp, Artificial Sequence
  Synthetic DNA
tattacatcactctaaag

SEQ ID NO: 41113 - DNA, 18 bp, Artificial Sequence
  Synthetic DNA
tattaccaatgattttcg

SEQ ID NO: 41114 - DNA, 18 bp, Artificial Sequence
  Synthetic DNA
tattaccacaaactttag

SEQ ID NO: 41115 - DNA, 18 bp, Artificial Sequence
  Synthetic DNA
tattaccacacactgtcg

SEQ ID NO: 41116 - DNA, 18 bp, Artificial Sequence
  Synthetic DNA
tattaccacccaatatgg

SEQ ID NO: 41117 - DNA, 18 bp, Artificial Sequence
  Synthetic DNA
tattaccactctcgtaag

SEQ ID NO: 41118 - DNA, 18 bp, Artificial Sequence
  Synthetic DNA
tattaccagttaaaccag

SEQ ID NO: 41119 - DNA, 18 bp, Artificial Sequence
  Synthetic DNA
tattaccccacaatgtag

SEQ ID NO: 41120 - DNA, 18 bp, Artificial Sequence
  Synthetic DNA
tattaccccacacgatag

SEQ ID NO: 41121 - DNA, 18 bp, Artificial Sequence
  Synthetic DNA
tattacgaaacattagag

SEQ ID NO: 41122 - DNA, 18 bp, Artificial Sequence
  Synthetic DNA
tattacgaaacccaatag

SEQ ID NO: 41123 - DNA, 18 bp, Artificial Sequence
  Synthetic DNA
tattacgaaaccctattg

SEQ ID NO: 41124 - DNA, 18 bp, Artificial Sequence
  Synthetic DNA
tattacgaaactctatgg

SEQ ID NO: 41125 - DNA, 18 bp, Artificial Sequence
  Synthetic DNA
tattacgaacaagtatag

SEQ ID NO: 41126 - DNA, 18 bp, Artificial Sequence
  Synthetic DNA
tattacgaataaataaag

SEQ ID NO: 41127 - DNA, 18 bp, Artificial Sequence
  Synthetic DNA
tattacgaatcaagatgg

SEQ ID NO: 41128 - DNA, 18 bp, Artificial Sequence
  Synthetic DNA
tattacgaatctatttag

SEQ ID NO: 41129 - DNA, 18 bp, Artificial Sequence
  Synthetic DNA
tattacgacacccattag

SEQ ID NO: 41130 - DNA, 18 bp, Artificial Sequence
  Synthetic DNA
tattacgacctacttcag

SEQ ID NO: 41131 - DNA, 18 bp, Artificial Sequence
  Synthetic DNA
tattacgacctgctacag

SEQ ID NO: 41132 - DNA, 18 bp, Artificial Sequence
  Synthetic DNA
tattacgactatacttag

SEQ ID NO: 41133 - DNA, 18 bp, Artificial Sequence
  Synthetic DNA
tattacgactctcataag

SEQ ID NO: 41134 - DNA, 18 bp, Artificial Sequence
  Synthetic DNA
tattacgacttgcaatcg

SEQ ID NO: 41135 - DNA, 18 bp, Artificial Sequence
  Synthetic DNA
tattacgacttgttattg

SEQ ID NO: 41136 - DNA, 18 bp, Artificial Sequence
  Synthetic DNA
tattacgaggtagtatgg

SEQ ID NO: 41137 - DNA, 18 bp, Artificial Sequence
  Synthetic DNA
tattacgagtcgcgtgtg

SEQ ID NO: 41138 - DNA, 18 bp, Artificial Sequence
  Synthetic DNA
tattacgattcaatgatg

SEQ ID NO: 41139 - DNA, 18 bp, Artificial Sequence
  Synthetic DNA
tattacgattcattaatg

SEQ ID NO: 41140 - DNA, 18 bp, Artificial Sequence
  Synthetic DNA
tattacgattcatttcag

SEQ ID NO: 41141 - DNA, 18 bp, Artificial Sequence
  Synthetic DNA
tattacgattccgataag

SEQ ID NO: 41142 - DNA, 18 bp, Artificial Sequence
  Synthetic DNA
tattacgattgcccatag

SEQ ID NO: 41143 - DNA, 18 bp, Artificial Sequence
  Synthetic DNA
tattacgccaaactgaag

SEQ ID NO: 41144 - DNA, 18 bp, Artificial Sequence
  Synthetic DNA
tattacgccacccaatcg

SEQ ID NO: 41145 - DNA, 18 bp, Artificial Sequence
  Synthetic DNA
tattacgccacgctaagg

SEQ ID NO: 41146 - DNA, 18 bp, Artificial Sequence
  Synthetic DNA
tattacgccccatttaag

SEQ ID NO: 41147 - DNA, 18 bp, Artificial Sequence
  Synthetic DNA
tattacgcctacctctag

SEQ ID NO: 41148 - DNA, 18 bp, Artificial Sequence
  Synthetic DNA
tattacgcctctcagtag

SEQ ID NO: 41149 - DNA, 18 bp, Artificial Sequence
  Synthetic DNA
tattacgcctggatttag

SEQ ID NO: 41150 - DNA, 18 bp, Artificial Sequence
  Synthetic DNA
tattacgcgtagctaagg

SEQ ID NO: 41151 - DNA, 18 bp, Artificial Sequence
  Synthetic DNA
tattacggctccattagg

SEQ ID NO: 41152 - DNA, 18 bp, Artificial Sequence
  Synthetic DNA
tattacgggcaactatag

SEQ ID NO: 41153 - DNA, 18 bp, Artificial Sequence
  Synthetic DNA
tattacgggccacaatag

SEQ ID NO: 41154 - DNA, 18 bp, Artificial Sequence
  Synthetic DNA
tattacgggcttcttaag

SEQ ID NO: 41155 - DNA, 18 bp, Artificial Sequence
  Synthetic DNA
tattacggttgactagag

SEQ ID NO: 41156 - DNA, 18 bp, Artificial Sequence
  Synthetic DNA
tattacgtatctttttcg

SEQ ID NO: 41157 - DNA, 18 bp, Artificial Sequence
  Synthetic DNA
tattacgtcaagcataag

SEQ ID NO: 41158 - DNA, 18 bp, Artificial Sequence
  Synthetic DNA
tattacgtccccctgaag

SEQ ID NO: 41159 - DNA, 18 bp, Artificial Sequence
  Synthetic DNA
tattacgtctcaccagtg

SEQ ID NO: 41160 - DNA, 18 bp, Artificial Sequence
  Synthetic DNA
tattacgtctcactgctg

SEQ ID NO: 41161 - DNA, 18 bp, Artificial Sequence
  Synthetic DNA
tattacgtctcacttacg

SEQ ID NO: 41162 - DNA, 18 bp, Artificial Sequence
  Synthetic DNA
tattacgtctccttattg

SEQ ID NO: 41163 - DNA, 18 bp, Artificial Sequence
  Synthetic DNA
tattacgttgcactcaag

SEQ ID NO: 41164 - DNA, 18 bp, Artificial Sequence
  Synthetic DNA
tattacgttgcgctatag

SEQ ID NO: 41165 - DNA, 18 bp, Artificial Sequence
  Synthetic DNA
tattacgtttcaccattg

SEQ ID NO: 41166 - DNA, 18 bp, Artificial Sequence
  Synthetic DNA
tattactaaccattttag

SEQ ID NO: 41167 - DNA, 18 bp, Artificial Sequence
  Synthetic DNA
tattactaagcattatcg

SEQ ID NO: 41168 - DNA, 18 bp, Artificial Sequence
  Synthetic DNA
tattactacataatcaag

SEQ ID NO: 41169 - DNA, 18 bp, Artificial Sequence
  Synthetic DNA
tattactacccaatattg

SEQ ID NO: 41170 - DNA, 18 bp, Artificial Sequence
  Synthetic DNA
tattactacgctatatag

SEQ ID NO: 41171 - DNA, 18 bp, Artificial Sequence
  Synthetic DNA
tattactactagcaaaag

SEQ ID NO: 41172 - DNA, 18 bp, Artificial Sequence
  Synthetic DNA
tattactactcatttgtg

SEQ ID NO: 41173 - DNA, 18 bp, Artificial Sequence
  Synthetic DNA
tattactactctcattag

SEQ ID NO: 41174 - DNA, 18 bp, Artificial Sequence
  Synthetic DNA
tattactactgattaaag

SEQ ID NO: 41175 - DNA, 18 bp, Artificial Sequence
  Synthetic DNA
tattactactggatactg

SEQ ID NO: 41176 - DNA, 18 bp, Artificial Sequence
  Synthetic DNA
tattactagtcacaaaag

SEQ ID NO: 41177 - DNA, 18 bp, Artificial Sequence
  Synthetic DNA
tattactccacaccgatg

SEQ ID NO: 41178 - DNA, 18 bp, Artificial Sequence
  Synthetic DNA
tattactccatactatag

SEQ ID NO: 41179 - DNA, 18 bp, Artificial Sequence
  Synthetic DNA
tattacttatatctatag

SEQ ID NO: 41180 - DNA, 18 bp, Artificial Sequence
  Synthetic DNA
tattacttctcagtagag

SEQ ID NO: 41181 - DNA, 18 bp, Artificial Sequence
  Synthetic DNA
tattagaactaattatgg

SEQ ID NO: 41182 - DNA, 18 bp, Artificial Sequence
  Synthetic DNA
tattagaactcactcaag

SEQ ID NO: 41183 - DNA, 18 bp, Artificial Sequence
  Synthetic DNA
tattaggaccctcaatgg

SEQ ID NO: 41184 - DNA, 18 bp, Artificial Sequence
  Synthetic DNA
tattaggactatctaaag

SEQ ID NO: 41185 - DNA, 18 bp, Artificial Sequence
  Synthetic DNA
tattaggactccttactg

SEQ ID NO: 41186 - DNA, 18 bp, Artificial Sequence
  Synthetic DNA
tattaggactgtctattg

SEQ ID NO: 41187 - DNA, 18 bp, Artificial Sequence
  Synthetic DNA
tattaggattcacgatgg

SEQ ID NO: 41188 - DNA, 18 bp, Artificial Sequence
  Synthetic DNA
tattaggattctccatcg

SEQ ID NO: 41189 - DNA, 18 bp, Artificial Sequence
  Synthetic DNA
tattaggcctcaaaaaag

SEQ ID NO: 41190 - DNA, 18 bp, Artificial Sequence
  Synthetic DNA
tattaggcctcacctaag

SEQ ID NO: 41191 - DNA, 18 bp, Artificial Sequence
  Synthetic DNA
tattaggtcacatattag

SEQ ID NO: 41192 - DNA, 18 bp, Artificial Sequence
  Synthetic DNA
tattataaatcaccattg

SEQ ID NO: 41193 - DNA, 18 bp, Artificial Sequence
  Synthetic DNA
tattataacgcactattg

SEQ ID NO: 41194 - DNA, 18 bp, Artificial Sequence
  Synthetic DNA
tattataactacctatag

SEQ ID NO: 41195 - DNA, 18 bp, Artificial Sequence
  Synthetic DNA
tattataactctccattg

SEQ ID NO: 41196 - DNA, 18 bp, Artificial Sequence
  Synthetic DNA
tattataactcttttttg

SEQ ID NO: 41197 - DNA, 18 bp, Artificial Sequence
  Synthetic DNA
tattataattcttcatgg

SEQ ID NO: 41198 - DNA, 18 bp, Artificial Sequence
  Synthetic DNA
tattatatttcactatag

SEQ ID NO: 41199 - DNA, 18 bp, Artificial Sequence
  Synthetic DNA
tattatcacacattgcag

SEQ ID NO: 41200 - DNA, 18 bp, Artificial Sequence
  Synthetic DNA
tattatccctcactattg

SEQ ID NO: 41201 - DNA, 18 bp, Artificial Sequence
  Synthetic DNA
tattatgaaaaactctgg

SEQ ID NO: 41202 - DNA, 18 bp, Artificial Sequence
  Synthetic DNA
tattatgaccgaccaaag

SEQ ID NO: 41203 - DNA, 18 bp, Artificial Sequence
  Synthetic DNA
tattatgacgcggtatag

SEQ ID NO: 41204 - DNA, 18 bp, Artificial Sequence
  Synthetic DNA
tattatgactatccaaag

SEQ ID NO: 41205 - DNA, 18 bp, Artificial Sequence
  Synthetic DNA
tattatgactttgttttg

SEQ ID NO: 41206 - DNA, 18 bp, Artificial Sequence
  Synthetic DNA
tattatgagtcaatcttg

SEQ ID NO: 41207 - DNA, 18 bp, Artificial Sequence
  Synthetic DNA
tattatgattcacatcag

SEQ ID NO: 41208 - DNA, 18 bp, Artificial Sequence
  Synthetic DNA
tattatggttcacaaaag

SEQ ID NO: 41209 - DNA, 18 bp, Artificial Sequence
  Synthetic DNA
tattatgtatcactattg

SEQ ID NO: 41210 - DNA, 18 bp, Artificial Sequence
  Synthetic DNA
tattatgtcacattttag

SEQ ID NO: 41211 - DNA, 18 bp, Artificial Sequence
  Synthetic DNA
tattatgtcattataaag

SEQ ID NO: 41212 - DNA, 18 bp, Artificial Sequence
  Synthetic DNA
tattatgtttccctctag

SEQ ID NO: 41213 - DNA, 18 bp, Artificial Sequence
  Synthetic DNA
tattattaaactctattg

SEQ ID NO: 41214 - DNA, 18 bp, Artificial Sequence
  Synthetic DNA
tattattaaatactatgg

SEQ ID NO: 41215 - DNA, 18 bp, Artificial Sequence
  Synthetic DNA
tattattgctaagtaaag

SEQ ID NO: 41216 - DNA, 18 bp, Artificial Sequence
  Synthetic DNA
tattcaaacactatatag

SEQ ID NO: 41217 - DNA, 18 bp, Artificial Sequence
  Synthetic DNA
tattcactcatactatag

SEQ ID NO: 41218 - DNA, 18 bp, Artificial Sequence
  Synthetic DNA
tattcagactcagatttg

SEQ ID NO: 41219 - DNA, 18 bp, Artificial Sequence
  Synthetic DNA
tattcaggctcacaattg

SEQ ID NO: 41220 - DNA, 18 bp, Artificial Sequence
  Synthetic DNA
tattcatacacactattg

SEQ ID NO: 41221 - DNA, 18 bp, Artificial Sequence
  Synthetic DNA
tattcatattcattctag

SEQ ID NO: 41222 - DNA, 18 bp, Artificial Sequence
  Synthetic DNA
tattccaacacgctctag

SEQ ID NO: 41223 - DNA, 18 bp, Artificial Sequence
  Synthetic DNA
tattccctctgcctatag

SEQ ID NO: 41224 - DNA, 18 bp, Artificial Sequence
  Synthetic DNA
tattccgaatgaatatag

SEQ ID NO: 41225 - DNA, 18 bp, Artificial Sequence
  Synthetic DNA
tattccgactcagttttg

SEQ ID NO: 41226 - DNA, 18 bp, Artificial Sequence
  Synthetic DNA
tattccgacttaaattag

SEQ ID NO: 41227 - DNA, 18 bp, Artificial Sequence
  Synthetic DNA
tattccgacttatttttg

SEQ ID NO: 41228 - DNA, 18 bp, Artificial Sequence
  Synthetic DNA
tattccgagtaactattg

SEQ ID NO: 41229 - DNA, 18 bp, Artificial Sequence
  Synthetic DNA
tattccggcacacagtgg

SEQ ID NO: 41230 - DNA, 18 bp, Artificial Sequence
  Synthetic DNA
tattcctggtttctatag

SEQ ID NO: 41231 - DNA, 18 bp, Artificial Sequence
  Synthetic DNA
tattccttcaccctaaag

SEQ ID NO: 41232 - DNA, 18 bp, Artificial Sequence
  Synthetic DNA
tattcggatacacaattg

SEQ ID NO: 41233 - DNA, 18 bp, Artificial Sequence
  Synthetic DNA
tattctgacacactgtag

SEQ ID NO: 41234 - DNA, 18 bp, Artificial Sequence
  Synthetic DNA
tattcttactcgctgtag

SEQ ID NO: 41235 - DNA, 18 bp, Artificial Sequence
  Synthetic DNA
tattctttctcactttag

SEQ ID NO: 41236 - DNA, 18 bp, Artificial Sequence
  Synthetic DNA
tattgagaatcgcaatgg

SEQ ID NO: 41237 - DNA, 18 bp, Artificial Sequence
  Synthetic DNA
tattgcgacatgctattg

SEQ ID NO: 41238 - DNA, 18 bp, Artificial Sequence
  Synthetic DNA
tattgcgactcatcaaag

SEQ ID NO: 41239 - DNA, 18 bp, Artificial Sequence
  Synthetic DNA
tattgcgactctcaatcg

SEQ ID NO: 41240 - DNA, 18 bp, Artificial Sequence
  Synthetic DNA
tattgcgactctttattg

SEQ ID NO: 41241 - DNA, 18 bp, Artificial Sequence
  Synthetic DNA
tattgcgatacagtatag

SEQ ID NO: 41242 - DNA, 18 bp, Artificial Sequence
  Synthetic DNA
tattgcgattcacactgg

SEQ ID NO: 41243 - DNA, 18 bp, Artificial Sequence
  Synthetic DNA
tattgcgattctctctgg

SEQ ID NO: 41244 - DNA, 18 bp, Artificial Sequence
  Synthetic DNA
tattgcgtattactatag

SEQ ID NO: 41245 - DNA, 18 bp, Artificial Sequence
  Synthetic DNA
tattgcgtcaccatatag

SEQ ID NO: 41246 - DNA, 18 bp, Artificial Sequence
  Synthetic DNA
tattgcgtctaaatattg

SEQ ID NO: 41247 - DNA, 18 bp, Artificial Sequence
  Synthetic DNA
tattgcgtttaactatag

SEQ ID NO: 41248 - DNA, 18 bp, Artificial Sequence
  Synthetic DNA
tattgctactatctctag

SEQ ID NO: 41249 - DNA, 18 bp, Artificial Sequence
  Synthetic DNA
tattgctactcactaatg

SEQ ID NO: 41250 - DNA, 18 bp, Artificial Sequence
  Synthetic DNA
tattgctgctaacaatag

SEQ ID NO: 41251 - DNA, 18 bp, Artificial Sequence
  Synthetic DNA
tattgggacttaccaaag

SEQ ID NO: 41252 - DNA, 18 bp, Artificial Sequence
  Synthetic DNA
tattgtgaaactcaatag

SEQ ID NO: 41253 - DNA, 18 bp, Artificial Sequence
  Synthetic DNA
tattgtgactttgtatag

SEQ ID NO: 41254 - DNA, 18 bp, Artificial Sequence
  Synthetic DNA
tatttaaacacactatag

SEQ ID NO: 41255 - DNA, 18 bp, Artificial Sequence
  Synthetic DNA
tatttagtcacgctttag

SEQ ID NO: 41256 - DNA, 18 bp, Artificial Sequence
  Synthetic DNA
tatttagtctcacttttg

SEQ ID NO: 41257 - DNA, 18 bp, Artificial Sequence
  Synthetic DNA
tatttagtttatctaccg

SEQ ID NO: 41258 - DNA, 18 bp, Artificial Sequence
  Synthetic DNA
tatttatacttactaaag

SEQ ID NO: 41259 - DNA, 18 bp, Artificial Sequence
  Synthetic DNA
tatttcaactcattactg

SEQ ID NO: 41260 - DNA, 18 bp, Artificial Sequence
  Synthetic DNA
tatttcaactttctattg

SEQ ID NO: 41261 - DNA, 18 bp, Artificial Sequence
  Synthetic DNA
tatttcaagtctccttag

SEQ ID NO: 41262 - DNA, 18 bp, Artificial Sequence
  Synthetic DNA
tatttcatctcactcatg

SEQ ID NO: 41263 - DNA, 18 bp, Artificial Sequence
  Synthetic DNA
tatttccactaaatatag

SEQ ID NO: 41264 - DNA, 18 bp, Artificial Sequence
  Synthetic DNA
tatttccactcacaatcg

SEQ ID NO: 41265 - DNA, 18 bp, Artificial Sequence
  Synthetic DNA
tatttccactctcattag

SEQ ID NO: 41266 - DNA, 18 bp, Artificial Sequence
  Synthetic DNA
tatttccagtcacaatag

SEQ ID NO: 41267 - DNA, 18 bp, Artificial Sequence
  Synthetic DNA
tatttcgaaccactgttg

SEQ ID NO: 41268 - DNA, 18 bp, Artificial Sequence
  Synthetic DNA
tatttcgaatcttcctag

SEQ ID NO: 41269 - DNA, 18 bp, Artificial Sequence
  Synthetic DNA
tatttcgacatcctttag

SEQ ID NO: 41270 - DNA, 18 bp, Artificial Sequence
  Synthetic DNA
tatttcgaccatctctag

SEQ ID NO: 41271 - DNA, 18 bp, Artificial Sequence
  Synthetic DNA
tatttcgacccacttcag

SEQ ID NO: 41272 - DNA, 18 bp, Artificial Sequence
  Synthetic DNA
tatttcgaccccctaaag

SEQ ID NO: 41273 - DNA, 18 bp, Artificial Sequence
  Synthetic DNA
tatttcgacctagtatag

SEQ ID NO: 41274 - DNA, 18 bp, Artificial Sequence
  Synthetic DNA
tatttcgactaactggag

SEQ ID NO: 41275 - DNA, 18 bp, Artificial Sequence
  Synthetic DNA
tatttcgactcgctccag

SEQ ID NO: 41276 - DNA, 18 bp, Artificial Sequence
  Synthetic DNA
tatttcgacttgttgtcg

SEQ ID NO: 41277 - DNA, 18 bp, Artificial Sequence
  Synthetic DNA
tatttcgatagacaatag

SEQ ID NO: 41278 - DNA, 18 bp, Artificial Sequence
  Synthetic DNA
tatttcgcctcacttcag

SEQ ID NO: 41279 - DNA, 18 bp, Artificial Sequence
  Synthetic DNA
tatttcggcccaccattg

SEQ ID NO: 41280 - DNA, 18 bp, Artificial Sequence
  Synthetic DNA
tatttcgtatcacttatg

SEQ ID NO: 41281 - DNA, 18 bp, Artificial Sequence
  Synthetic DNA
tatttcgtgtggctaagg

SEQ ID NO: 41282 - DNA, 18 bp, Artificial Sequence
  Synthetic DNA
tatttctacacattattg

SEQ ID NO: 41283 - DNA, 18 bp, Artificial Sequence
  Synthetic DNA
tatttctacactttatag

SEQ ID NO: 41284 - DNA, 18 bp, Artificial Sequence
  Synthetic DNA
tatttctactaactaagg

SEQ ID NO: 41285 - DNA, 18 bp, Artificial Sequence
  Synthetic DNA
tatttctactcacaacag

SEQ ID NO: 41286 - DNA, 18 bp, Artificial Sequence
  Synthetic DNA
tatttctactcaccatcg

SEQ ID NO: 41287 - DNA, 18 bp, Artificial Sequence
  Synthetic DNA
tatttctacttactctag

SEQ ID NO: 41288 - DNA, 18 bp, Artificial Sequence
  Synthetic DNA
tatttcttctcaaattag

SEQ ID NO: 41289 - DNA, 18 bp, Artificial Sequence
  Synthetic DNA
tatttcttttcaccattg

SEQ ID NO: 41290 - DNA, 18 bp, Artificial Sequence
  Synthetic DNA
tatttgcagtcactatag

SEQ ID NO: 41291 - DNA, 18 bp, Artificial Sequence
  Synthetic DNA
tatttggactcactgaag

SEQ ID NO: 41292 - DNA, 18 bp, Artificial Sequence
  Synthetic DNA
tattttctctcacaactg

SEQ ID NO: 41293 - DNA, 18 bp, Artificial Sequence
  Synthetic DNA
tattttgaataactatag

SEQ ID NO: 41294 - DNA, 18 bp, Artificial Sequence
  Synthetic DNA
tattttgaattactttag

SEQ ID NO: 41295 - DNA, 18 bp, Artificial Sequence
  Synthetic DNA
tattttgacccactaatg

SEQ ID NO: 41296 - DNA, 18 bp, Artificial Sequence
  Synthetic DNA
tattttgacccattaaag

SEQ ID NO: 41297 - DNA, 18 bp, Artificial Sequence
  Synthetic DNA
tattttgactcaaattgg

SEQ ID NO: 41298 - DNA, 18 bp, Artificial Sequence
  Synthetic DNA
tattttgatctactatag

SEQ ID NO: 41299 - DNA, 18 bp, Artificial Sequence
  Synthetic DNA
tattttgtcatacaatag

SEQ ID NO: 41300 - DNA, 18 bp, Artificial Sequence
  Synthetic DNA
tattttgtctctcttaag

SEQ ID NO: 41301 - DNA, 18 bp, Artificial Sequence
  Synthetic DNA
tatttttactaactatag

SEQ ID NO: 41302 - DNA, 18 bp, Artificial Sequence
  Synthetic DNA
tcaaacaattaaatatag

SEQ ID NO: 41303 - DNA, 18 bp, Artificial Sequence
  Synthetic DNA
tcaaacagatcactattg

SEQ ID NO: 41304 - DNA, 18 bp, Artificial Sequence
  Synthetic DNA
tcaaacgaaacactcttg

SEQ ID NO: 41305 - DNA, 18 bp, Artificial Sequence
  Synthetic DNA
tcaaacgactctcttcag

SEQ ID NO: 41306 - DNA, 18 bp, Artificial Sequence
  Synthetic DNA
tcaaacgactttctttcg

SEQ ID NO: 41307 - DNA, 18 bp, Artificial Sequence
  Synthetic DNA
tcaaacgagcttctacag

SEQ ID NO: 41308 - DNA, 18 bp, Artificial Sequence
  Synthetic DNA
tcaaacgattcactgaag

SEQ ID NO: 41309 - DNA, 18 bp, Artificial Sequence
  Synthetic DNA
tcaaacgccttgctttag

SEQ ID NO: 41310 - DNA, 18 bp, Artificial Sequence
  Synthetic DNA
tcaaacgtctaactgtag

SEQ ID NO: 41311 - DNA, 18 bp, Artificial Sequence
  Synthetic DNA
tcaaacgtctcaatacag

SEQ ID NO: 41312 - DNA, 18 bp, Artificial Sequence
  Synthetic DNA
tcaaactactcaaaatgg

SEQ ID NO: 41313 - DNA, 18 bp, Artificial Sequence
  Synthetic DNA
tcaaactactctctctag

SEQ ID NO: 41314 - DNA, 18 bp, Artificial Sequence
  Synthetic DNA
tcaaacttatctctatag

SEQ ID NO: 41315 - DNA, 18 bp, Artificial Sequence
  Synthetic DNA
tcaaccgattaacattag

SEQ ID NO: 41316 - DNA, 18 bp, Artificial Sequence
  Synthetic DNA
tcaaccttctcattagag

SEQ ID NO: 41317 - DNA, 18 bp, Artificial Sequence
  Synthetic DNA
tcaatcgaatcacaattg

SEQ ID NO: 41318 - DNA, 18 bp, Artificial Sequence
  Synthetic DNA
tcaatcgacaaccaatag

SEQ ID NO: 41319 - DNA, 18 bp, Artificial Sequence
  Synthetic DNA
tcaatcgtcacggtatag

SEQ ID NO: 41320 - DNA, 18 bp, Artificial Sequence
  Synthetic DNA
tcaattgtgtcactattg

SEQ ID NO: 41321 - DNA, 18 bp, Artificial Sequence
  Synthetic DNA
tcacacatctcatgatag

SEQ ID NO: 41322 - DNA, 18 bp, Artificial Sequence
  Synthetic DNA
tcacaccactcacgattg

SEQ ID NO: 41323 - DNA, 18 bp, Artificial Sequence
  Synthetic DNA
tcacacgatttactacag

SEQ ID NO: 41324 - DNA, 18 bp, Artificial Sequence
  Synthetic DNA
tcacacttcttactattg

SEQ ID NO: 41325 - DNA, 18 bp, Artificial Sequence
  Synthetic DNA
tcacaggtctatctatag

SEQ ID NO: 41326 - DNA, 18 bp, Artificial Sequence
  Synthetic DNA
tcacatgacgctttcgag

SEQ ID NO: 41327 - DNA, 18 bp, Artificial Sequence
  Synthetic DNA
tcactaacctaactttag

SEQ ID NO: 41328 - DNA, 18 bp, Artificial Sequence
  Synthetic DNA
tcactcgactaataattg

SEQ ID NO: 41329 - DNA, 18 bp, Artificial Sequence
  Synthetic DNA
tcagacatcagacaatgg

SEQ ID NO: 41330 - DNA, 18 bp, Artificial Sequence
  Synthetic DNA
tcagactactaattatag

SEQ ID NO: 41331 - DNA, 18 bp, Artificial Sequence
  Synthetic DNA
tcagactattcactaaag

SEQ ID NO: 41332 - DNA, 18 bp, Artificial Sequence
  Synthetic DNA
tcagccgaaacactttag

SEQ ID NO: 41333 - DNA, 18 bp, Artificial Sequence
  Synthetic DNA
tcagccgacttacactag

SEQ ID NO: 41334 - DNA, 18 bp, Artificial Sequence
  Synthetic DNA
tcagctgtctcactttag

SEQ ID NO: 41335 - DNA, 18 bp, Artificial Sequence
  Synthetic DNA
tcataaaacacattaaag

SEQ ID NO: 41336 - DNA, 18 bp, Artificial Sequence
  Synthetic DNA
tcataacaaaaagtttag

SEQ ID NO: 41337 - DNA, 18 bp, Artificial Sequence
  Synthetic DNA
tcataagaaacattttag

SEQ ID NO: 41338 - DNA, 18 bp, Artificial Sequence
  Synthetic DNA
tcataagacgctctctag

SEQ ID NO: 41339 - DNA, 18 bp, Artificial Sequence
  Synthetic DNA
tcataagtatcagtattg

SEQ ID NO: 41340 - DNA, 18 bp, Artificial Sequence
  Synthetic DNA
tcataagtcttactaaag

SEQ ID NO: 41341 - DNA, 18 bp, Artificial Sequence
  Synthetic DNA
tcataatactgactaaag

SEQ ID NO: 41342 - DNA, 18 bp, Artificial Sequence
  Synthetic DNA
tcatacaaatccctattg

SEQ ID NO: 41343 - DNA, 18 bp, Artificial Sequence
  Synthetic DNA
tcatacaaatctctaaag

SEQ ID NO: 41344 - DNA, 18 bp, Artificial Sequence
  Synthetic DNA
tcatacaacaaacttttg

SEQ ID NO: 41345 - DNA, 18 bp, Artificial Sequence
  Synthetic DNA
tcatacaacatactattg

SEQ ID NO: 41346 - DNA, 18 bp, Artificial Sequence
  Synthetic DNA
tcatacaaccaactattg

SEQ ID NO: 41347 - DNA, 18 bp, Artificial Sequence
  Synthetic DNA
tcatacaactcacatttg

SEQ ID NO: 41348 - DNA, 18 bp, Artificial Sequence
  Synthetic DNA
tcatacaactttcaatag

SEQ ID NO: 41349 - DNA, 18 bp, Artificial Sequence
  Synthetic DNA
tcatacatatctctattg

SEQ ID NO: 41350 - DNA, 18 bp, Artificial Sequence
  Synthetic DNA
tcataccaatctcaattg

SEQ ID NO: 41351 - DNA, 18 bp, Artificial Sequence
  Synthetic DNA
tcataccactatctacag

SEQ ID NO: 41352 - DNA, 18 bp, Artificial Sequence
  Synthetic DNA
tcataccactcataatgg

SEQ ID NO: 41353 - DNA, 18 bp, Artificial Sequence
  Synthetic DNA
tcatacccatctctatag

SEQ ID NO: 41354 - DNA, 18 bp, Artificial Sequence
  Synthetic DNA
tcatacgaaattctattg

SEQ ID NO: 41355 - DNA, 18 bp, Artificial Sequence
  Synthetic DNA
tcatacgacaaattattg

SEQ ID NO: 41356 - DNA, 18 bp, Artificial Sequence
  Synthetic DNA
tcatacgacactcttaag

SEQ ID NO: 41357 - DNA, 18 bp, Artificial Sequence
  Synthetic DNA
tcatacgacactcttttg

SEQ ID NO: 41358 - DNA, 18 bp, Artificial Sequence
  Synthetic DNA
tcatacgacattccctag

SEQ ID NO: 41359 - DNA, 18 bp, Artificial Sequence
  Synthetic DNA
tcatacgaccttctacag

SEQ ID NO: 41360 - DNA, 18 bp, Artificial Sequence
  Synthetic DNA
tcatacgacgatgtatag

SEQ ID NO: 41361 - DNA, 18 bp, Artificial Sequence
  Synthetic DNA
tcatacgactaacaagcg

SEQ ID NO: 41362 - DNA, 18 bp, Artificial Sequence
  Synthetic DNA
tcatacgactatcactag

SEQ ID NO: 41363 - DNA, 18 bp, Artificial Sequence
  Synthetic DNA
tcatacgactcatatttg

SEQ ID NO: 41364 - DNA, 18 bp, Artificial Sequence
  Synthetic DNA
tcatacgactctcaaacg

SEQ ID NO: 41365 - DNA, 18 bp, Artificial Sequence
  Synthetic DNA
tcatacgactgatactag

SEQ ID NO: 41366 - DNA, 18 bp, Artificial Sequence
  Synthetic DNA
tcatacgccaaacactgg

SEQ ID NO: 41367 - DNA, 18 bp, Artificial Sequence
  Synthetic DNA
tcatacgccaaactttag

SEQ ID NO: 41368 - DNA, 18 bp, Artificial Sequence
  Synthetic DNA
tcatacggctctacatag

SEQ ID NO: 41369 - DNA, 18 bp, Artificial Sequence
  Synthetic DNA
tcatacgtatcacattag

SEQ ID NO: 41370 - DNA, 18 bp, Artificial Sequence
  Synthetic DNA
tcatacgtcagacgatag

SEQ ID NO: 41371 - DNA, 18 bp, Artificial Sequence
  Synthetic DNA
tcatacgtcatcctaaag

SEQ ID NO: 41372 - DNA, 18 bp, Artificial Sequence
  Synthetic DNA
tcatacgtccctctattg

SEQ ID NO: 41373 - DNA, 18 bp, Artificial Sequence
  Synthetic DNA
tcatacgtctccccttag

SEQ ID NO: 41374 - DNA, 18 bp, Artificial Sequence
  Synthetic DNA
tcatacgtctgattacag

SEQ ID NO: 41375 - DNA, 18 bp, Artificial Sequence
  Synthetic DNA
tcatacgtgttacttaag

SEQ ID NO: 41376 - DNA, 18 bp, Artificial Sequence
  Synthetic DNA
tcatactaattacaatag

SEQ ID NO: 41377 - DNA, 18 bp, Artificial Sequence
  Synthetic DNA
tcatactactagcgatag

SEQ ID NO: 41378 - DNA, 18 bp, Artificial Sequence
  Synthetic DNA
tcatactactttgaatag

SEQ ID NO: 41379 - DNA, 18 bp, Artificial Sequence
  Synthetic DNA
tcatactattcacaaaag

SEQ ID NO: 41380 - DNA, 18 bp, Artificial Sequence
  Synthetic DNA
tcatacttatcgctttag

SEQ ID NO: 41381 - DNA, 18 bp, Artificial Sequence
  Synthetic DNA
tcatacttctacctagcg

SEQ ID NO: 41382 - DNA, 18 bp, Artificial Sequence
  Synthetic DNA
tcataggactcgcaagag

SEQ ID NO: 41383 - DNA, 18 bp, Artificial Sequence
  Synthetic DNA
tcatagtaatcacattag

SEQ ID NO: 41384 - DNA, 18 bp, Artificial Sequence
  Synthetic DNA
tcatataacactatatag

SEQ ID NO: 41385 - DNA, 18 bp, Artificial Sequence
  Synthetic DNA
tcatatactacactatag

SEQ ID NO: 41386 - DNA, 18 bp, Artificial Sequence
  Synthetic DNA
tcatatgaaactctcaag

SEQ ID NO: 41387 - DNA, 18 bp, Artificial Sequence
  Synthetic DNA
tcatatgacatattatag

SEQ ID NO: 41388 - DNA, 18 bp, Artificial Sequence
  Synthetic DNA
tcatatgacttacaattg

SEQ ID NO: 41389 - DNA, 18 bp, Artificial Sequence
  Synthetic DNA
tcatatgtccacctatag

SEQ ID NO: 41390 - DNA, 18 bp, Artificial Sequence
  Synthetic DNA
tcatatttctcgctatag

SEQ ID NO: 41391 - DNA, 18 bp, Artificial Sequence
  Synthetic DNA
tcatcaatcacactacag

SEQ ID NO: 41392 - DNA, 18 bp, Artificial Sequence
  Synthetic DNA
tcatccgaatttccatag

SEQ ID NO: 41393 - DNA, 18 bp, Artificial Sequence
  Synthetic DNA
tcatccgacccagtaatg

SEQ ID NO: 41394 - DNA, 18 bp, Artificial Sequence
  Synthetic DNA
tcatccgactttatattg

SEQ ID NO: 41395 - DNA, 18 bp, Artificial Sequence
  Synthetic DNA
tcatccgactttcttgag

SEQ ID NO: 41396 - DNA, 18 bp, Artificial Sequence
  Synthetic DNA
tcatccgaggctctaaag

SEQ ID NO: 41397 - DNA, 18 bp, Artificial Sequence
  Synthetic DNA
tcatccggctctcccaag

SEQ ID NO: 41398 - DNA, 18 bp, Artificial Sequence
  Synthetic DNA
tcatccgtcccaacatag

SEQ ID NO: 41399 - DNA, 18 bp, Artificial Sequence
  Synthetic DNA
tcatccttctcattaaag

SEQ ID NO: 41400 - DNA, 18 bp, Artificial Sequence
  Synthetic DNA
tcatgataatcactaatg

SEQ ID NO: 41401 - DNA, 18 bp, Artificial Sequence
  Synthetic DNA
tcatgcaaatcaccagcg

SEQ ID NO: 41402 - DNA, 18 bp, Artificial Sequence
  Synthetic DNA
tcatgccaatcactttag

SEQ ID NO: 41403 - DNA, 18 bp, Artificial Sequence
  Synthetic DNA
tcatgcgactctattttg

SEQ ID NO: 41404 - DNA, 18 bp, Artificial Sequence
  Synthetic DNA
tcatgcgacttaacttag

SEQ ID NO: 41405 - DNA, 18 bp, Artificial Sequence
  Synthetic DNA
tcatgcgtctcaatattg

SEQ ID NO: 41406 - DNA, 18 bp, Artificial Sequence
  Synthetic DNA
tcatgctactccttaaag

SEQ ID NO: 41407 - DNA, 18 bp, Artificial Sequence
  Synthetic DNA
tcatgtgtcgctctgtag

SEQ ID NO: 41408 - DNA, 18 bp, Artificial Sequence
  Synthetic DNA
tcattaatatctcaaaag

SEQ ID NO: 41409 - DNA, 18 bp, Artificial Sequence
  Synthetic DNA
tcattagcctcaggatag

SEQ ID NO: 41410 - DNA, 18 bp, Artificial Sequence
  Synthetic DNA
tcattagtattaacatag

SEQ ID NO: 41411 - DNA, 18 bp, Artificial Sequence
  Synthetic DNA
tcattcaactcattaaag

SEQ ID NO: 41412 - DNA, 18 bp, Artificial Sequence
  Synthetic DNA
tcattcatatcactatag

SEQ ID NO: 41413 - DNA, 18 bp, Artificial Sequence
  Synthetic DNA
tcattcatctcacaatag

SEQ ID NO: 41414 - DNA, 18 bp, Artificial Sequence
  Synthetic DNA
tcattcatctcactgtag

SEQ ID NO: 41415 - DNA, 18 bp, Artificial Sequence
  Synthetic DNA
tcattccacttactattg

SEQ ID NO: 41416 - DNA, 18 bp, Artificial Sequence
  Synthetic DNA
tcattcgacactcttttg

SEQ ID NO: 41417 - DNA, 18 bp, Artificial Sequence
  Synthetic DNA
tcattcgagtcagtttag

SEQ ID NO: 41418 - DNA, 18 bp, Artificial Sequence
  Synthetic DNA
tcattcgatccactaatg

SEQ ID NO: 41419 - DNA, 18 bp, Artificial Sequence
  Synthetic DNA
tcattcgatgcgccttag

SEQ ID NO: 41420 - DNA, 18 bp, Artificial Sequence
  Synthetic DNA
tcattcgtatgagtatag

SEQ ID NO: 41421 - DNA, 18 bp, Artificial Sequence
  Synthetic DNA
tcattcgtctcaatgtcg

SEQ ID NO: 41422 - DNA, 18 bp, Artificial Sequence
  Synthetic DNA
tcattctaatcacaaaag

SEQ ID NO: 41423 - DNA, 18 bp, Artificial Sequence
  Synthetic DNA
tcattctacacaaccacg

SEQ ID NO: 41424 - DNA, 18 bp, Artificial Sequence
  Synthetic DNA
tcattggactcacccaag

SEQ ID NO: 41425 - DNA, 18 bp, Artificial Sequence
  Synthetic DNA
tcatttgacagtcaatag

SEQ ID NO: 41426 - DNA, 18 bp, Artificial Sequence
  Synthetic DNA
tcattttacacattaaag

SEQ ID NO: 41427 - DNA, 18 bp, Artificial Sequence
  Synthetic DNA
tccaactactctcaattg

SEQ ID NO: 41428 - DNA, 18 bp, Artificial Sequence
  Synthetic DNA
tccaccgttcgactatgg

SEQ ID NO: 41429 - DNA, 18 bp, Artificial Sequence
  Synthetic DNA
tcctaagtcccactttag

SEQ ID NO: 41430 - DNA, 18 bp, Artificial Sequence
  Synthetic DNA
tcctaagtttcactagag

SEQ ID NO: 41431 - DNA, 18 bp, Artificial Sequence
  Synthetic DNA
tcctaatactcacttaag

SEQ ID NO: 41432 - DNA, 18 bp, Artificial Sequence
  Synthetic DNA
tcctacatcccactaaag

SEQ ID NO: 41433 - DNA, 18 bp, Artificial Sequence
  Synthetic DNA
tcctacgactccttattg

SEQ ID NO: 41434 - DNA, 18 bp, Artificial Sequence
  Synthetic DNA
tcctacttcacaatattg

SEQ ID NO: 41435 - DNA, 18 bp, Artificial Sequence
  Synthetic DNA
tcctatgtctcactacag

SEQ ID NO: 41436 - DNA, 18 bp, Artificial Sequence
  Synthetic DNA
tcctcagacaaattttag

SEQ ID NO: 41437 - DNA, 18 bp, Artificial Sequence
  Synthetic DNA
tcctccgattaaccattg

SEQ ID NO: 41438 - DNA, 18 bp, Artificial Sequence
  Synthetic DNA
tcctcctatacaatacag

SEQ ID NO: 41439 - DNA, 18 bp, Artificial Sequence
  Synthetic DNA
tccttccgttcagtattg

SEQ ID NO: 41440 - DNA, 18 bp, Artificial Sequence
  Synthetic DNA
tccttctcctcactaaag

SEQ ID NO: 41441 - DNA, 18 bp, Artificial Sequence
  Synthetic DNA
tcgaaatactcaatatgg

SEQ ID NO: 41442 - DNA, 18 bp, Artificial Sequence
  Synthetic DNA
tcgaacgtctctctatag

SEQ ID NO: 41443 - DNA, 18 bp, Artificial Sequence
  Synthetic DNA
tcgtacgattcataatag

SEQ ID NO: 41444 - DNA, 18 bp, Artificial Sequence
  Synthetic DNA
tcgttcgaccaactatag

SEQ ID NO: 41445 - DNA, 18 bp, Artificial Sequence
  Synthetic DNA
tcgttcgtctatctaaag

SEQ ID NO: 41446 - DNA, 18 bp, Artificial Sequence
  Synthetic DNA
tcgttcgtctctctattg

SEQ ID NO: 41447 - DNA, 18 bp, Artificial Sequence
  Synthetic DNA
tctaacgcctcactagag

SEQ ID NO: 41448 - DNA, 18 bp, Artificial Sequence
  Synthetic DNA
tctaacgtccctctatag

SEQ ID NO: 41449 - DNA, 18 bp, Artificial Sequence
  Synthetic DNA
tctaatgactcattgtcg

SEQ ID NO: 41450 - DNA, 18 bp, Artificial Sequence
  Synthetic DNA
tctagtaaaccactttag

SEQ ID NO: 41451 - DNA, 18 bp, Artificial Sequence
  Synthetic DNA
tctcacgattcactattg

SEQ ID NO: 41452 - DNA, 18 bp, Artificial Sequence
  Synthetic DNA
tctctcgacttcccatag

SEQ ID NO: 41453 - DNA, 18 bp, Artificial Sequence
  Synthetic DNA
tcttacgaaacacaatag

SEQ ID NO: 41454 - DNA, 18 bp, Artificial Sequence
  Synthetic DNA
tcttacgaaccactattg

SEQ ID NO: 41455 - DNA, 18 bp, Artificial Sequence
  Synthetic DNA
tcttacgacactcttttg

SEQ ID NO: 41456 - DNA, 18 bp, Artificial Sequence
  Synthetic DNA
tcttacgcatttcaattg

SEQ ID NO: 41457 - DNA, 18 bp, Artificial Sequence
  Synthetic DNA
tcttacgtctctcaagtg

SEQ ID NO: 41458 - DNA, 18 bp, Artificial Sequence
  Synthetic DNA
tcttactactcagcacag

SEQ ID NO: 41459 - DNA, 18 bp, Artificial Sequence
  Synthetic DNA
tcttactactgaatatag

SEQ ID NO: 41460 - DNA, 18 bp, Artificial Sequence
  Synthetic DNA
tcttactcctcaatttag

SEQ ID NO: 41461 - DNA, 18 bp, Artificial Sequence
  Synthetic DNA
tcttatgtctcactattg

SEQ ID NO: 41462 - DNA, 18 bp, Artificial Sequence
  Synthetic DNA
tcttgcgtctgtacatag

SEQ ID NO: 41463 - DNA, 18 bp, Artificial Sequence
  Synthetic DNA
tctttcattacattatag

SEQ ID NO: 41464 - DNA, 18 bp, Artificial Sequence
  Synthetic DNA
tctttcgaagctctaaag

SEQ ID NO: 41465 - DNA, 18 bp, Artificial Sequence
  Synthetic DNA
tctttcgacttagtaaag

SEQ ID NO: 41466 - DNA, 18 bp, Artificial Sequence
  Synthetic DNA
tctttcgtctctctaaag

SEQ ID NO: 41467 - DNA, 18 bp, Artificial Sequence
  Synthetic DNA
tcttttaacccactaacg

SEQ ID NO: 41468 - DNA, 18 bp, Artificial Sequence
  Synthetic DNA
tgaaaagtctcacaaaag

SEQ ID NO: 41469 - DNA, 18 bp, Artificial Sequence
  Synthetic DNA
tgaaaccactctctgtag

SEQ ID NO: 41470 - DNA, 18 bp, Artificial Sequence
  Synthetic DNA
tgaaacgacaagataaag

SEQ ID NO: 41471 - DNA, 18 bp, Artificial Sequence
  Synthetic DNA
tgaaacgacgcacactcg

SEQ ID NO: 41472 - DNA, 18 bp, Artificial Sequence
  Synthetic DNA
tgaaacgagtcacgttgg

SEQ ID NO: 41473 - DNA, 18 bp, Artificial Sequence
  Synthetic DNA
tgaaacgagtttccaaag

SEQ ID NO: 41474 - DNA, 18 bp, Artificial Sequence
  Synthetic DNA
tgaaacgatacactttag

SEQ ID NO: 41475 - DNA, 18 bp, Artificial Sequence
  Synthetic DNA
tgaaatgacttaccatag

SEQ ID NO: 41476 - DNA, 18 bp, Artificial Sequence
  Synthetic DNA
tgaaatgtctcactatgg

SEQ ID NO: 41477 - DNA, 18 bp, Artificial Sequence
  Synthetic DNA
tgaacccactctctattg

SEQ ID NO: 41478 - DNA, 18 bp, Artificial Sequence
  Synthetic DNA
tgaagcaattcattatag

SEQ ID NO: 41479 - DNA, 18 bp, Artificial Sequence
  Synthetic DNA
tgaagcgactcgctttag

SEQ ID NO: 41480 - DNA, 18 bp, Artificial Sequence
  Synthetic DNA
tgaatagaaacactagtg

SEQ ID NO: 41481 - DNA, 18 bp, Artificial Sequence
  Synthetic DNA
tgaatcgacacactgcag

SEQ ID NO: 41482 - DNA, 18 bp, Artificial Sequence
  Synthetic DNA
tgaatcggctcacaattg

SEQ ID NO: 41483 - DNA, 18 bp, Artificial Sequence
  Synthetic DNA
tgaatcgtcacactattg

SEQ ID NO: 41484 - DNA, 18 bp, Artificial Sequence
  Synthetic DNA
tgaatcttttcactaaag

SEQ ID NO: 41485 - DNA, 18 bp, Artificial Sequence
  Synthetic DNA
tgaatggtctcaaaatag

SEQ ID NO: 41486 - DNA, 18 bp, Artificial Sequence
  Synthetic DNA
tgaattgactcactctag

SEQ ID NO: 41487 - DNA, 18 bp, Artificial Sequence
  Synthetic DNA
tgacaagactcacaaaag

SEQ ID NO: 41488 - DNA, 18 bp, Artificial Sequence
  Synthetic DNA
tgacaagtcccactttag

SEQ ID NO: 41489 - DNA, 18 bp, Artificial Sequence
  Synthetic DNA
tgacacgactcacaccag

SEQ ID NO: 41490 - DNA, 18 bp, Artificial Sequence
  Synthetic DNA
tgacacgactctcttttg

SEQ ID NO: 41491 - DNA, 18 bp, Artificial Sequence
  Synthetic DNA
tgacacgcctgacaaaag

SEQ ID NO: 41492 - DNA, 18 bp, Artificial Sequence
  Synthetic DNA
tgacatgagtaactacag

SEQ ID NO: 41493 - DNA, 18 bp, Artificial Sequence
  Synthetic DNA
tgaccctactcactctag

SEQ ID NO: 41494 - DNA, 18 bp, Artificial Sequence
  Synthetic DNA
tgataaaacacactatgg

SEQ ID NO: 41495 - DNA, 18 bp, Artificial Sequence
  Synthetic DNA
tgataaggcttgatctgg

SEQ ID NO: 41496 - DNA, 18 bp, Artificial Sequence
  Synthetic DNA
tgataattctctctacag

SEQ ID NO: 41497 - DNA, 18 bp, Artificial Sequence
  Synthetic DNA
tgatacaaatcatattag

SEQ ID NO: 41498 - DNA, 18 bp, Artificial Sequence
  Synthetic DNA
tgatacaaatctttatag

SEQ ID NO: 41499 - DNA, 18 bp, Artificial Sequence
  Synthetic DNA
tgatacaacacattctag

SEQ ID NO: 41500 - DNA, 18 bp, Artificial Sequence
  Synthetic DNA
tgatacaactgtgtatag

SEQ ID NO: 41501 - DNA, 18 bp, Artificial Sequence
  Synthetic DNA
tgatacatttctgtatag

SEQ ID NO: 41502 - DNA, 18 bp, Artificial Sequence
  Synthetic DNA
tgataccacacattggtg

SEQ ID NO: 41503 - DNA, 18 bp, Artificial Sequence
  Synthetic DNA
tgataccacactctaaag

SEQ ID NO: 41504 - DNA, 18 bp, Artificial Sequence
  Synthetic DNA
tgataccatacacaatgg

SEQ ID NO: 41505 - DNA, 18 bp, Artificial Sequence
  Synthetic DNA
tgatacgaaaatcaatag

SEQ ID NO: 41506 - DNA, 18 bp, Artificial Sequence
  Synthetic DNA
tgatacgacagacaaatg

SEQ ID NO: 41507 - DNA, 18 bp, Artificial Sequence
  Synthetic DNA
tgatacgacagcgcgtag

SEQ ID NO: 41508 - DNA, 18 bp, Artificial Sequence
  Synthetic DNA
tgatacgacagtcaaaag

SEQ ID NO: 41509 - DNA, 18 bp, Artificial Sequence
  Synthetic DNA
tgatacgacataccggag

SEQ ID NO: 41510 - DNA, 18 bp, Artificial Sequence
  Synthetic DNA
tgatacgacatactaagg

SEQ ID NO: 41511 - DNA, 18 bp, Artificial Sequence
  Synthetic DNA
tgatacgactctataggg

SEQ ID NO: 41512 - DNA, 18 bp, Artificial Sequence
  Synthetic DNA
tgatacgataaactattg

SEQ ID NO: 41513 - DNA, 18 bp, Artificial Sequence
  Synthetic DNA
tgatacgccgcacaatgg

SEQ ID NO: 41514 - DNA, 18 bp, Artificial Sequence
  Synthetic DNA
tgatacgcctaattcaag

SEQ ID NO: 41515 - DNA, 18 bp, Artificial Sequence
  Synthetic DNA
tgatacggatcacttaag

SEQ ID NO: 41516 - DNA, 18 bp, Artificial Sequence
  Synthetic DNA
tgatacgtatcccaatag

SEQ ID NO: 41517 - DNA, 18 bp, Artificial Sequence
  Synthetic DNA
tgatacgtatctcttagg

SEQ ID NO: 41518 - DNA, 18 bp, Artificial Sequence
  Synthetic DNA
tgatacgtcacataattg

SEQ ID NO: 41519 - DNA, 18 bp, Artificial Sequence
  Synthetic DNA
tgatacgtcaccctaaag

SEQ ID NO: 41520 - DNA, 18 bp, Artificial Sequence
  Synthetic DNA
tgatacgtctcaaattag

SEQ ID NO: 41521 - DNA, 18 bp, Artificial Sequence
  Synthetic DNA
tgatacgtctcataattg

SEQ ID NO: 41522 - DNA, 18 bp, Artificial Sequence
  Synthetic DNA
tgatacgtctcgaattag

SEQ ID NO: 41523 - DNA, 18 bp, Artificial Sequence
  Synthetic DNA
tgatacgtgccacttttg

SEQ ID NO: 41524 - DNA, 18 bp, Artificial Sequence
  Synthetic DNA
tgatactaatcacaatcg

SEQ ID NO: 41525 - DNA, 18 bp, Artificial Sequence
  Synthetic DNA
tgatactactctttattg

SEQ ID NO: 41526 - DNA, 18 bp, Artificial Sequence
  Synthetic DNA
tgatacttcacactacag

SEQ ID NO: 41527 - DNA, 18 bp, Artificial Sequence
  Synthetic DNA
tgatacttctttcattag

SEQ ID NO: 41528 - DNA, 18 bp, Artificial Sequence
  Synthetic DNA
tgatacttctttctattg

SEQ ID NO: 41529 - DNA, 18 bp, Artificial Sequence
  Synthetic DNA
tgatacttttctctgcag

SEQ ID NO: 41530 - DNA, 18 bp, Artificial Sequence
  Synthetic DNA
tgatagctctttttaaag

SEQ ID NO: 41531 - DNA, 18 bp, Artificial Sequence
  Synthetic DNA
tgataggaattcttatag

SEQ ID NO: 41532 - DNA, 18 bp, Artificial Sequence
  Synthetic DNA
tgataggactatcttaag

SEQ ID NO: 41533 - DNA, 18 bp, Artificial Sequence
  Synthetic DNA
tgatagggcagactatag

SEQ ID NO: 41534 - DNA, 18 bp, Artificial Sequence
  Synthetic DNA
tgataggtctaattaaag

SEQ ID NO: 41535 - DNA, 18 bp, Artificial Sequence
  Synthetic DNA
tgataggtctcaatttag

SEQ ID NO: 41536 - DNA, 18 bp, Artificial Sequence
  Synthetic DNA
tgataggtgtcactacag

SEQ ID NO: 41537 - DNA, 18 bp, Artificial Sequence
  Synthetic DNA
tgatataatgtccttctg

SEQ ID NO: 41538 - DNA, 18 bp, Artificial Sequence
  Synthetic DNA
tgatatatcacagtatag

SEQ ID NO: 41539 - DNA, 18 bp, Artificial Sequence
  Synthetic DNA
tgatatcttatactatag

SEQ ID NO: 41540 - DNA, 18 bp, Artificial Sequence
  Synthetic DNA
tgatatgaatcaatacag

SEQ ID NO: 41541 - DNA, 18 bp, Artificial Sequence
  Synthetic DNA
tgatatgaatcaatttag

SEQ ID NO: 41542 - DNA, 18 bp, Artificial Sequence
  Synthetic DNA
tgatatgtctcttgatag

SEQ ID NO: 41543 - DNA, 18 bp, Artificial Sequence
  Synthetic DNA
tgatccaactccatagtg

SEQ ID NO: 41544 - DNA, 18 bp, Artificial Sequence
  Synthetic DNA
tgatcccactgtctttag

SEQ ID NO: 41545 - DNA, 18 bp, Artificial Sequence
  Synthetic DNA
tgatccgaatcattaatg

SEQ ID NO: 41546 - DNA, 18 bp, Artificial Sequence
  Synthetic DNA
tgatccgactctcttaag

SEQ ID NO: 41547 - DNA, 18 bp, Artificial Sequence
  Synthetic DNA
tgatcctattcgaaagag

SEQ ID NO: 41548 - DNA, 18 bp, Artificial Sequence
  Synthetic DNA
tgatcggacccacgctag

SEQ ID NO: 41549 - DNA, 18 bp, Artificial Sequence
  Synthetic DNA
tgatctttcacacaatcg

SEQ ID NO: 41550 - DNA, 18 bp, Artificial Sequence
  Synthetic DNA
tgatgagattcttaatag

SEQ ID NO: 41551 - DNA, 18 bp, Artificial Sequence
  Synthetic DNA
tgatgcgagtgatcttag

SEQ ID NO: 41552 - DNA, 18 bp, Artificial Sequence
  Synthetic DNA
tgatgcgagttattagtg

SEQ ID NO: 41553 - DNA, 18 bp, Artificial Sequence
  Synthetic DNA
tgatgcgtctcgctacag

SEQ ID NO: 41554 - DNA, 18 bp, Artificial Sequence
  Synthetic DNA
tgattactttcaatatag

SEQ ID NO: 41555 - DNA, 18 bp, Artificial Sequence
  Synthetic DNA
tgattagcctcacaattg

SEQ ID NO: 41556 - DNA, 18 bp, Artificial Sequence
  Synthetic DNA
tgattcatctcacttcag

SEQ ID NO: 41557 - DNA, 18 bp, Artificial Sequence
  Synthetic DNA
tgattcatctgactatag

SEQ ID NO: 41558 - DNA, 18 bp, Artificial Sequence
  Synthetic DNA
tgattcatcttaataaag

SEQ ID NO: 41559 - DNA, 18 bp, Artificial Sequence
  Synthetic DNA
tgattcgaatcacttttg

SEQ ID NO: 41560 - DNA, 18 bp, Artificial Sequence
  Synthetic DNA
tgattcgactcaatactg

SEQ ID NO: 41561 - DNA, 18 bp, Artificial Sequence
  Synthetic DNA
tgattcgactgacattag

SEQ ID NO: 41562 - DNA, 18 bp, Artificial Sequence
  Synthetic DNA
tgattcgagtacctaatg

SEQ ID NO: 41563 - DNA, 18 bp, Artificial Sequence
  Synthetic DNA
tgattcgtcgcaccaaag

SEQ ID NO: 41564 - DNA, 18 bp, Artificial Sequence
  Synthetic DNA
tgattggacactctcaag

SEQ ID NO: 41565 - DNA, 18 bp, Artificial Sequence
  Synthetic DNA
tgattggcctcatcctag

SEQ ID NO: 41566 - DNA, 18 bp, Artificial Sequence
  Synthetic DNA
tgattggtctctctttag

SEQ ID NO: 41567 - DNA, 18 bp, Artificial Sequence
  Synthetic DNA
tgatttactccactatag

SEQ ID NO: 41568 - DNA, 18 bp, Artificial Sequence
  Synthetic DNA
tgatttatctcactgtag

SEQ ID NO: 41569 - DNA, 18 bp, Artificial Sequence
  Synthetic DNA
tgcaacaaaacaaaatag

SEQ ID NO: 41570 - DNA, 18 bp, Artificial Sequence
  Synthetic DNA
tgcaactacatcctattg

SEQ ID NO: 41571 - DNA, 18 bp, Artificial Sequence
  Synthetic DNA
tgctacgaataacaacag

SEQ ID NO: 41572 - DNA, 18 bp, Artificial Sequence
  Synthetic DNA
tgctacgcttttctatag

SEQ ID NO: 41573 - DNA, 18 bp, Artificial Sequence
  Synthetic DNA
tgctacgtctctctacag

SEQ ID NO: 41574 - DNA, 18 bp, Artificial Sequence
  Synthetic DNA
tgctaggactcaataaag

SEQ ID NO: 41575 - DNA, 18 bp, Artificial Sequence
  Synthetic DNA
tgctccgacactcaatcg

SEQ ID NO: 41576 - DNA, 18 bp, Artificial Sequence
  Synthetic DNA
tgctccttcagacaatgg

SEQ ID NO: 41577 - DNA, 18 bp, Artificial Sequence
  Synthetic DNA
tgcttcgactcgttctag

SEQ ID NO: 41578 - DNA, 18 bp, Artificial Sequence
  Synthetic DNA
tggaaagactccctatag

SEQ ID NO: 41579 - DNA, 18 bp, Artificial Sequence
  Synthetic DNA
tggaacggcactatgtag

SEQ ID NO: 41580 - DNA, 18 bp, Artificial Sequence
  Synthetic DNA
tggagctactaactatag

SEQ ID NO: 41581 - DNA, 18 bp, Artificial Sequence
  Synthetic DNA
tgggagaactcattttag

SEQ ID NO: 41582 - DNA, 18 bp, Artificial Sequence
  Synthetic DNA
tggtacccctctatcttg

SEQ ID NO: 41583 - DNA, 18 bp, Artificial Sequence
  Synthetic DNA
tggtacgacacaatatcg

SEQ ID NO: 41584 - DNA, 18 bp, Artificial Sequence
  Synthetic DNA
tggtacgagtgaccatag

SEQ ID NO: 41585 - DNA, 18 bp, Artificial Sequence
  Synthetic DNA
tggtacgattcacaaaag

SEQ ID NO: 41586 - DNA, 18 bp, Artificial Sequence
  Synthetic DNA
tggtaggactcactactg

SEQ ID NO: 41587 - DNA, 18 bp, Artificial Sequence
  Synthetic DNA
tggtatgaaaggctatag

SEQ ID NO: 41588 - DNA, 18 bp, Artificial Sequence
  Synthetic DNA
tggttcgacacacttctg

SEQ ID NO: 41589 - DNA, 18 bp, Artificial Sequence
  Synthetic DNA
tgtaacgactcattatgg

SEQ ID NO: 41590 - DNA, 18 bp, Artificial Sequence
  Synthetic DNA
tgtaactacattctttag

SEQ ID NO: 41591 - DNA, 18 bp, Artificial Sequence
  Synthetic DNA
tgtaagttctcactgttg

SEQ ID NO: 41592 - DNA, 18 bp, Artificial Sequence
  Synthetic DNA
tgtaatgacttactttag

SEQ ID NO: 41593 - DNA, 18 bp, Artificial Sequence
  Synthetic DNA
tgtaccgtctttcaatag

SEQ ID NO: 41594 - DNA, 18 bp, Artificial Sequence
  Synthetic DNA
tgtatccacacacaatag

SEQ ID NO: 41595 - DNA, 18 bp, Artificial Sequence
  Synthetic DNA
tgtatccgctcactctag

SEQ ID NO: 41596 - DNA, 18 bp, Artificial Sequence
  Synthetic DNA
tgtatggcctcaaagtag

SEQ ID NO: 41597 - DNA, 18 bp, Artificial Sequence
  Synthetic DNA
tgtattgactcgctatcg

SEQ ID NO: 41598 - DNA, 18 bp, Artificial Sequence
  Synthetic DNA
tgtcacgactcgttgtaa

SEQ ID NO: 41599 - DNA, 18 bp, Artificial Sequence
  Synthetic DNA
tgtcacggtccataatag

SEQ ID NO: 41600 - DNA, 18 bp, Artificial Sequence
  Synthetic DNA
tgtctcccctaactatag

SEQ ID NO: 41601 - DNA, 18 bp, Artificial Sequence
  Synthetic DNA
tgtcttgtatcactatag

SEQ ID NO: 41602 - DNA, 18 bp, Artificial Sequence
  Synthetic DNA
tgtgtcgtctaattattg

SEQ ID NO: 41603 - DNA, 18 bp, Artificial Sequence
  Synthetic DNA
tgttaagacgcccttaag

SEQ ID NO: 41604 - DNA, 18 bp, Artificial Sequence
  Synthetic DNA
tgttacaactctcaatag

SEQ ID NO: 41605 - DNA, 18 bp, Artificial Sequence
  Synthetic DNA
tgttacaacttacaatag

SEQ ID NO: 41606 - DNA, 18 bp, Artificial Sequence
  Synthetic DNA
tgttaccaataactatag

SEQ ID NO: 41607 - DNA, 18 bp, Artificial Sequence
  Synthetic DNA
tgttacgaatcacttttg

SEQ ID NO: 41608 - DNA, 18 bp, Artificial Sequence
  Synthetic DNA
tgttacgacacacaaaag

SEQ ID NO: 41609 - DNA, 18 bp, Artificial Sequence
  Synthetic DNA
tgttacgactcctcatag

SEQ ID NO: 41610 - DNA, 18 bp, Artificial Sequence
  Synthetic DNA
tgttacgactgaatagag

SEQ ID NO: 41611 - DNA, 18 bp, Artificial Sequence
  Synthetic DNA
tgttacgcctctcaatag

SEQ ID NO: 41612 - DNA, 18 bp, Artificial Sequence
  Synthetic DNA
tgttacgtctcactccag

SEQ ID NO: 41613 - DNA, 18 bp, Artificial Sequence
  Synthetic DNA
tgttactacaatctatag

SEQ ID NO: 41614 - DNA, 18 bp, Artificial Sequence
  Synthetic DNA
tgttactactacctatag

SEQ ID NO: 41615 - DNA, 18 bp, Artificial Sequence
  Synthetic DNA
tgttactactcaatatcg

SEQ ID NO: 41616 - DNA, 18 bp, Artificial Sequence
  Synthetic DNA
tgttatgacacactttag

SEQ ID NO: 41617 - DNA, 18 bp, Artificial Sequence
  Synthetic DNA
tgttcagattagttatag

SEQ ID NO: 41618 - DNA, 18 bp, Artificial Sequence
  Synthetic DNA
tgttccgactctcaatag

SEQ ID NO: 41619 - DNA, 18 bp, Artificial Sequence
  Synthetic DNA
tgttgcaactcacaatag

SEQ ID NO: 41620 - DNA, 18 bp, Artificial Sequence
  Synthetic DNA
tgtttcaactcaatatag

SEQ ID NO: 41621 - DNA, 18 bp, Artificial Sequence
  Synthetic DNA
tgtttcatctcattatag

SEQ ID NO: 41622 - DNA, 18 bp, Artificial Sequence
  Synthetic DNA
tgtttcgtctcaccaacg

SEQ ID NO: 41623 - DNA, 18 bp, Artificial Sequence
  Synthetic DNA
tgttttgtctcaatatag

SEQ ID NO: 41624 - DNA, 18 bp, Artificial Sequence
  Synthetic DNA
ttaaaaagctctcatcag

SEQ ID NO: 41625 - DNA, 18 bp, Artificial Sequence
  Synthetic DNA
ttaaaagaatcattaatg

SEQ ID NO: 41626 - DNA, 18 bp, Artificial Sequence
  Synthetic DNA
ttaaaagactaatattag

SEQ ID NO: 41627 - DNA, 18 bp, Artificial Sequence
  Synthetic DNA
ttaaaaggctatctctag

SEQ ID NO: 41628 - DNA, 18 bp, Artificial Sequence
  Synthetic DNA
ttaaaaggctcaaaatgg

SEQ ID NO: 41629 - DNA, 18 bp, Artificial Sequence
  Synthetic DNA
ttaaacaactatcttttg

SEQ ID NO: 41630 - DNA, 18 bp, Artificial Sequence
  Synthetic DNA
ttaaacaagtcagtacag

SEQ ID NO: 41631 - DNA, 18 bp, Artificial Sequence
  Synthetic DNA
ttaaacgacactctactg

SEQ ID NO: 41632 - DNA, 18 bp, Artificial Sequence
  Synthetic DNA
ttaaacgacagtttatag

SEQ ID NO: 41633 - DNA, 18 bp, Artificial Sequence
  Synthetic DNA
ttaaacgaccaattatag

SEQ ID NO: 41634 - DNA, 18 bp, Artificial Sequence
  Synthetic DNA
ttaaacgacgtacttaag

SEQ ID NO: 41635 - DNA, 18 bp, Artificial Sequence
  Synthetic DNA
ttaaacgactcttactag

SEQ ID NO: 41636 - DNA, 18 bp, Artificial Sequence
  Synthetic DNA
ttaaacgagtctctacag

SEQ ID NO: 41637 - DNA, 18 bp, Artificial Sequence
  Synthetic DNA
ttaaacgtatatctgaag

SEQ ID NO: 41638 - DNA, 18 bp, Artificial Sequence
  Synthetic DNA
ttaaacgtatctatatag

SEQ ID NO: 41639 - DNA, 18 bp, Artificial Sequence
  Synthetic DNA
ttaaacgtctaaccaatg

SEQ ID NO: 41640 - DNA, 18 bp, Artificial Sequence
  Synthetic DNA
ttaaactactaaatatag

SEQ ID NO: 41641 - DNA, 18 bp, Artificial Sequence
  Synthetic DNA
ttaaactactcccaatag

SEQ ID NO: 41642 - DNA, 18 bp, Artificial Sequence
  Synthetic DNA
ttaaagcattcaataatg

SEQ ID NO: 41643 - DNA, 18 bp, Artificial Sequence
  Synthetic DNA
ttaaaggacacattttag

SEQ ID NO: 41644 - DNA, 18 bp, Artificial Sequence
  Synthetic DNA
ttaaaggattctctttag

SEQ ID NO: 41645 - DNA, 18 bp, Artificial Sequence
  Synthetic DNA
ttaaagtacactttatag

SEQ ID NO: 41646 - DNA, 18 bp, Artificial Sequence
  Synthetic DNA
ttaaatacatcactatag

SEQ ID NO: 41647 - DNA, 18 bp, Artificial Sequence
  Synthetic DNA
ttaaatcataaacgctag

SEQ ID NO: 41648 - DNA, 18 bp, Artificial Sequence
  Synthetic DNA
ttaaatgacttactaaag

SEQ ID NO: 41649 - DNA, 18 bp, Artificial Sequence
  Synthetic DNA
ttaaatgcctttcgatcg

SEQ ID NO: 41650 - DNA, 18 bp, Artificial Sequence
  Synthetic DNA
ttaaatgtcgctctatag

SEQ ID NO: 41651 - DNA, 18 bp, Artificial Sequence
  Synthetic DNA
ttaaatgtgtcactatag

SEQ ID NO: 41652 - DNA, 18 bp, Artificial Sequence
  Synthetic DNA
ttaaatgttgctctttag

SEQ ID NO: 41653 - DNA, 18 bp, Artificial Sequence
  Synthetic DNA
ttaaattactcactacag

SEQ ID NO: 41654 - DNA, 18 bp, Artificial Sequence
  Synthetic DNA
ttaaccaactcacttttg

SEQ ID NO: 41655 - DNA, 18 bp, Artificial Sequence
  Synthetic DNA
ttaaccgactcgtttcag

SEQ ID NO: 41656 - DNA, 18 bp, Artificial Sequence
  Synthetic DNA
ttaaccgactgaaaacag

SEQ ID NO: 41657 - DNA, 18 bp, Artificial Sequence
  Synthetic DNA
ttaaccgtatcacaatag

SEQ ID NO: 41658 - DNA, 18 bp, Artificial Sequence
  Synthetic DNA
ttaaccgtctcatcttag

SEQ ID NO: 41659 - DNA, 18 bp, Artificial Sequence
  Synthetic DNA
ttaactgacacgctagag

SEQ ID NO: 41660 - DNA, 18 bp, Artificial Sequence
  Synthetic DNA
ttaagagactcatcatag

SEQ ID NO: 41661 - DNA, 18 bp, Artificial Sequence
  Synthetic DNA
ttaagctactaactatcg

SEQ ID NO: 41662 - DNA, 18 bp, Artificial Sequence
  Synthetic DNA
ttaatagactcagtatag

SEQ ID NO: 41663 - DNA, 18 bp, Artificial Sequence
  Synthetic DNA
ttaatccactttctaaag

SEQ ID NO: 41664 - DNA, 18 bp, Artificial Sequence
  Synthetic DNA
ttaatccattcactatag

SEQ ID NO: 41665 - DNA, 18 bp, Artificial Sequence
  Synthetic DNA
ttaatcctcacagtaaag

SEQ ID NO: 41666 - DNA, 18 bp, Artificial Sequence
  Synthetic DNA
ttaatcgaccaactacag

SEQ ID NO: 41667 - DNA, 18 bp, Artificial Sequence
  Synthetic DNA
ttaatcgaccaattttag

SEQ ID NO: 41668 - DNA, 18 bp, Artificial Sequence
  Synthetic DNA
ttaatcgactcagtttgg

SEQ ID NO: 41669 - DNA, 18 bp, Artificial Sequence
  Synthetic DNA
ttaatcgtcactctttag

SEQ ID NO: 41670 - DNA, 18 bp, Artificial Sequence
  Synthetic DNA
ttaatcgtctcactagtg

SEQ ID NO: 41671 - DNA, 18 bp, Artificial Sequence
  Synthetic DNA
ttaatcgtctcactatgg

SEQ ID NO: 41672 - DNA, 18 bp, Artificial Sequence
  Synthetic DNA
ttaatctacacactatgg

SEQ ID NO: 41673 - DNA, 18 bp, Artificial Sequence
  Synthetic DNA
ttaatctactcactgatg

SEQ ID NO: 41674 - DNA, 18 bp, Artificial Sequence
  Synthetic DNA
ttaatctactcactgttg

SEQ ID NO: 41675 - DNA, 18 bp, Artificial Sequence
  Synthetic DNA
ttaatgcagtatctatag

SEQ ID NO: 41676 - DNA, 18 bp, Artificial Sequence
  Synthetic DNA
ttaattctctcaatataa

SEQ ID NO: 41677 - DNA, 18 bp, Artificial Sequence
  Synthetic DNA
ttaattgcgtcattattg

SEQ ID NO: 41678 - DNA, 18 bp, Artificial Sequence
  Synthetic DNA
ttaatttactcactatcg

SEQ ID NO: 41679 - DNA, 18 bp, Artificial Sequence
  Synthetic DNA
ttacaaatcacactttag

SEQ ID NO: 41680 - DNA, 18 bp, Artificial Sequence
  Synthetic DNA
ttacaagccgctttattg

SEQ ID NO: 41681 - DNA, 18 bp, Artificial Sequence
  Synthetic DNA
ttacaagtctctgaatag

SEQ ID NO: 41682 - DNA, 18 bp, Artificial Sequence
  Synthetic DNA
ttacaattctgactatag

SEQ ID NO: 41683 - DNA, 18 bp, Artificial Sequence
  Synthetic DNA
ttacacaactggatcctg

SEQ ID NO: 41684 - DNA, 18 bp, Artificial Sequence
  Synthetic DNA
ttacacgagtcacaaatg

SEQ ID NO: 41685 - DNA, 18 bp, Artificial Sequence
  Synthetic DNA
ttacacgtctaattattg

SEQ ID NO: 41686 - DNA, 18 bp, Artificial Sequence
  Synthetic DNA
ttacacgtctcaatgtag

SEQ ID NO: 41687 - DNA, 18 bp, Artificial Sequence
  Synthetic DNA
ttacacgtctcacccctg

SEQ ID NO: 41688 - DNA, 18 bp, Artificial Sequence
  Synthetic DNA
ttacacgtttcactctag

SEQ ID NO: 41689 - DNA, 18 bp, Artificial Sequence
  Synthetic DNA
ttacactactcattatcg

SEQ ID NO: 41690 - DNA, 18 bp, Artificial Sequence
  Synthetic DNA
ttacactccttactttag

SEQ ID NO: 41691 - DNA, 18 bp, Artificial Sequence
  Synthetic DNA
ttacataatttactattg

SEQ ID NO: 41692 - DNA, 18 bp, Artificial Sequence
  Synthetic DNA
ttacatcacttactattg

SEQ ID NO: 41693 - DNA, 18 bp, Artificial Sequence
  Synthetic DNA
ttacatgactcatattag

SEQ ID NO: 41694 - DNA, 18 bp, Artificial Sequence
  Synthetic DNA
ttacatgactcgcttaag

SEQ ID NO: 41695 - DNA, 18 bp, Artificial Sequence
  Synthetic DNA
ttacattactcactgtcg

SEQ ID NO: 41696 - DNA, 18 bp, Artificial Sequence
  Synthetic DNA
ttacccgactcactaccg

SEQ ID NO: 41697 - DNA, 18 bp, Artificial Sequence
  Synthetic DNA
ttacctgtttgactatag

SEQ ID NO: 41698 - DNA, 18 bp, Artificial Sequence
  Synthetic DNA
ttacgcgaatcactaaag

SEQ ID NO: 41699 - DNA, 18 bp, Artificial Sequence
  Synthetic DNA
ttactcgaataactattg

SEQ ID NO: 41700 - DNA, 18 bp, Artificial Sequence
  Synthetic DNA
ttactcgaccgacactag

SEQ ID NO: 41701 - DNA, 18 bp, Artificial Sequence
  Synthetic DNA
ttactcgactcaatacag

SEQ ID NO: 41702 - DNA, 18 bp, Artificial Sequence
  Synthetic DNA
ttactcgactcactttgg

SEQ ID NO: 41703 - DNA, 18 bp, Artificial Sequence
  Synthetic DNA
ttactcgactctcaatag

SEQ ID NO: 41704 - DNA, 18 bp, Artificial Sequence
  Synthetic DNA
ttactcgagttgccctag

SEQ ID NO: 41705 - DNA, 18 bp, Artificial Sequence
  Synthetic DNA
ttactctagccacaatag

SEQ ID NO: 41706 - DNA, 18 bp, Artificial Sequence
  Synthetic DNA
ttactctgatcgctatag

SEQ ID NO: 41707 - DNA, 18 bp, Artificial Sequence
  Synthetic DNA
ttacttgagtcactatgg

SEQ ID NO: 41708 - DNA, 18 bp, Artificial Sequence
  Synthetic DNA
ttacttgattcaagatag

SEQ ID NO: 41709 - DNA, 18 bp, Artificial Sequence
  Synthetic DNA
ttagaagtcagtctaatg

SEQ ID NO: 41710 - DNA, 18 bp, Artificial Sequence
  Synthetic DNA
ttagacgacatacctttg

SEQ ID NO: 41711 - DNA, 18 bp, Artificial Sequence
  Synthetic DNA
ttagacgacccattttag

SEQ ID NO: 41712 - DNA, 18 bp, Artificial Sequence
  Synthetic DNA
ttagacgatgaactaatg

SEQ ID NO: 41713 - DNA, 18 bp, Artificial Sequence
  Synthetic DNA
ttagacgcacaactatag

SEQ ID NO: 41714 - DNA, 18 bp, Artificial Sequence
  Synthetic DNA
ttagacgccattcagtcg

SEQ ID NO: 41715 - DNA, 18 bp, Artificial Sequence
  Synthetic DNA
ttagacgcctcacattag

SEQ ID NO: 41716 - DNA, 18 bp, Artificial Sequence
  Synthetic DNA
ttagacggctcaatattg

SEQ ID NO: 41717 - DNA, 18 bp, Artificial Sequence
  Synthetic DNA
ttagacttctaaatatag

SEQ ID NO: 41718 - DNA, 18 bp, Artificial Sequence
  Synthetic DNA
ttagccgacgtactatag

SEQ ID NO: 41719 - DNA, 18 bp, Artificial Sequence
  Synthetic DNA
ttagccgactctccaaag

SEQ ID NO: 41720 - DNA, 18 bp, Artificial Sequence
  Synthetic DNA
ttaggagtctcaaaatag

SEQ ID NO: 41721 - DNA, 18 bp, Artificial Sequence
  Synthetic DNA
ttagtcgtcacaatacag

SEQ ID NO: 41722 - DNA, 18 bp, Artificial Sequence
  Synthetic DNA
ttagtgcactcactatag

SEQ ID NO: 41723 - DNA, 18 bp, Artificial Sequence
  Synthetic DNA
ttataaaaatcctttacg

SEQ ID NO: 41724 - DNA, 18 bp, Artificial Sequence
  Synthetic DNA
ttataaaactatatattg

SEQ ID NO: 41725 - DNA, 18 bp, Artificial Sequence
  Synthetic DNA
ttataaaactctctagag

SEQ ID NO: 41726 - DNA, 18 bp, Artificial Sequence
  Synthetic DNA
ttataacagtcactaatg

SEQ ID NO: 41727 - DNA, 18 bp, Artificial Sequence
  Synthetic DNA
ttataagacacaaactag

SEQ ID NO: 41728 - DNA, 18 bp, Artificial Sequence
  Synthetic DNA
ttataagacactctactg

SEQ ID NO: 41729 - DNA, 18 bp, Artificial Sequence
  Synthetic DNA
ttataagaccttttatcg

SEQ ID NO: 41730 - DNA, 18 bp, Artificial Sequence
  Synthetic DNA
ttataagactaacgaatg

SEQ ID NO: 41731 - DNA, 18 bp, Artificial Sequence
  Synthetic DNA
ttataagactcaacttag

SEQ ID NO: 41732 - DNA, 18 bp, Artificial Sequence
  Synthetic DNA
ttataagacttacgtcag

SEQ ID NO: 41733 - DNA, 18 bp, Artificial Sequence
  Synthetic DNA
ttataagactttatatag

SEQ ID NO: 41734 - DNA, 18 bp, Artificial Sequence
  Synthetic DNA
ttataagccacacaatag

SEQ ID NO: 41735 - DNA, 18 bp, Artificial Sequence
  Synthetic DNA
ttataagtcccactctag

SEQ ID NO: 41736 - DNA, 18 bp, Artificial Sequence
  Synthetic DNA
ttataagtctcaatatgg

SEQ ID NO: 41737 - DNA, 18 bp, Artificial Sequence
  Synthetic DNA
ttataagtctcgctattg

SEQ ID NO: 41738 - DNA, 18 bp, Artificial Sequence
  Synthetic DNA
ttataagtctcgctcaag

SEQ ID NO: 41739 - DNA, 18 bp, Artificial Sequence
  Synthetic DNA
ttataagtctcttacttg

SEQ ID NO: 41740 - DNA, 18 bp, Artificial Sequence
  Synthetic DNA
ttataatacacacattag

SEQ ID NO: 41741 - DNA, 18 bp, Artificial Sequence
  Synthetic DNA
ttataattgtcaatatag

SEQ ID NO: 41742 - DNA, 18 bp, Artificial Sequence
  Synthetic DNA
ttataatttagacaatag

SEQ ID NO: 41743 - DNA, 18 bp, Artificial Sequence
  Synthetic DNA
ttatacaaaatcttttag

SEQ ID NO: 41744 - DNA, 18 bp, Artificial Sequence
  Synthetic DNA
ttatacaaatatcattag

SEQ ID NO: 41745 - DNA, 18 bp, Artificial Sequence
  Synthetic DNA
ttatacaacacaccaaag

SEQ ID NO: 41746 - DNA, 18 bp, Artificial Sequence
  Synthetic DNA
ttatacaacacttttaag

SEQ ID NO: 41747 - DNA, 18 bp, Artificial Sequence
  Synthetic DNA
ttatacaactctaatcag

SEQ ID NO: 41748 - DNA, 18 bp, Artificial Sequence
  Synthetic DNA
ttatacaattaactaaag

SEQ ID NO: 41749 - DNA, 18 bp, Artificial Sequence
  Synthetic DNA
ttatacaattcaccgtag

SEQ ID NO: 41750 - DNA, 18 bp, Artificial Sequence
  Synthetic DNA
ttatacaatttcaaatcg

SEQ ID NO: 41751 - DNA, 18 bp, Artificial Sequence
  Synthetic DNA
ttatacaccatttaagtg

SEQ ID NO: 41752 - DNA, 18 bp, Artificial Sequence
  Synthetic DNA
ttatacatcgctatttag

SEQ ID NO: 41753 - DNA, 18 bp, Artificial Sequence
  Synthetic DNA
ttatacatctcactactg

SEQ ID NO: 41754 - DNA, 18 bp, Artificial Sequence
  Synthetic DNA
ttatacatctctctttag

SEQ ID NO: 41755 - DNA, 18 bp, Artificial Sequence
  Synthetic DNA
ttatacatcttacaatag

SEQ ID NO: 41756 - DNA, 18 bp, Artificial Sequence
  Synthetic DNA
ttataccaagcaccatag

SEQ ID NO: 41757 - DNA, 18 bp, Artificial Sequence
  Synthetic DNA
ttataccacaaactgttg

SEQ ID NO: 41758 - DNA, 18 bp, Artificial Sequence
  Synthetic DNA
ttataccaccgcccatag

SEQ ID NO: 41759 - DNA, 18 bp, Artificial Sequence
  Synthetic DNA
ttataccactcagtgaag

SEQ ID NO: 41760 - DNA, 18 bp, Artificial Sequence
  Synthetic DNA
ttataccactcctcatag

SEQ ID NO: 41761 - DNA, 18 bp, Artificial Sequence
  Synthetic DNA
ttataccacttacactag

SEQ ID NO: 41762 - DNA, 18 bp, Artificial Sequence
  Synthetic DNA
ttataccgctccacgtgg

SEQ ID NO: 41763 - DNA, 18 bp, Artificial Sequence
  Synthetic DNA
ttatacctctcaatattg

SEQ ID NO: 41764 - DNA, 18 bp, Artificial Sequence
  Synthetic DNA
ttatacctttcactttag

SEQ ID NO: 41765 - DNA, 18 bp, Artificial Sequence
  Synthetic DNA
ttatacgaatgatattag

SEQ ID NO: 41766 - DNA, 18 bp, Artificial Sequence
  Synthetic DNA
ttatacgaattcatcgtg

SEQ ID NO: 41767 - DNA, 18 bp, Artificial Sequence
  Synthetic DNA
ttatacgacaaaaaaatg

SEQ ID NO: 41768 - DNA, 18 bp, Artificial Sequence
  Synthetic DNA
ttatacgacaattctttg

SEQ ID NO: 41769 - DNA, 18 bp, Artificial Sequence
  Synthetic DNA
ttatacgacacaatttgg

SEQ ID NO: 41770 - DNA, 18 bp, Artificial Sequence
  Synthetic DNA
ttatacgacactcagaag

SEQ ID NO: 41771 - DNA, 18 bp, Artificial Sequence
  Synthetic DNA
ttatacgacactgaatag

SEQ ID NO: 41772 - DNA, 18 bp, Artificial Sequence
  Synthetic DNA
ttatacgactctcgactg

SEQ ID NO: 41773 - DNA, 18 bp, Artificial Sequence
  Synthetic DNA
ttatacgactgtcttcag

SEQ ID NO: 41774 - DNA, 18 bp, Artificial Sequence
  Synthetic DNA
ttatacgacttgttattg

SEQ ID NO: 41775 - DNA, 18 bp, Artificial Sequence
  Synthetic DNA
ttatacgaggcacttttg

SEQ ID NO: 41776 - DNA, 18 bp, Artificial Sequence
  Synthetic DNA
ttatacgatacagattag

SEQ ID NO: 41777 - DNA, 18 bp, Artificial Sequence
  Synthetic DNA
ttatacgatataatactg

SEQ ID NO: 41778 - DNA, 18 bp, Artificial Sequence
  Synthetic DNA
ttatacgattaattaatg

SEQ ID NO: 41779 - DNA, 18 bp, Artificial Sequence
  Synthetic DNA
ttatacgattagcaatag

SEQ ID NO: 41780 - DNA, 18 bp, Artificial Sequence
  Synthetic DNA
ttatacgattcaaaatgg

SEQ ID NO: 41781 - DNA, 18 bp, Artificial Sequence
  Synthetic DNA
ttatacgattttctaaag

SEQ ID NO: 41782 - DNA, 18 bp, Artificial Sequence
  Synthetic DNA
ttatacgcaccattacag

SEQ ID NO: 41783 - DNA, 18 bp, Artificial Sequence
  Synthetic DNA
ttatacgcagcactactg

SEQ ID NO: 41784 - DNA, 18 bp, Artificial Sequence
  Synthetic DNA
ttatacgccacacatctg

SEQ ID NO: 41785 - DNA, 18 bp, Artificial Sequence
  Synthetic DNA
ttatacgcccaagtatag

SEQ ID NO: 41786 - DNA, 18 bp, Artificial Sequence
  Synthetic DNA
ttatacgcctcaccttgg

SEQ ID NO: 41787 - DNA, 18 bp, Artificial Sequence
  Synthetic DNA
ttatacgcgtcataagtg

SEQ ID NO: 41788 - DNA, 18 bp, Artificial Sequence
  Synthetic DNA
ttatacgctacattatag

SEQ ID NO: 41789 - DNA, 18 bp, Artificial Sequence
  Synthetic DNA
ttatacggatcactcaag

SEQ ID NO: 41790 - DNA, 18 bp, Artificial Sequence
  Synthetic DNA
ttatacggatttttatag

SEQ ID NO: 41791 - DNA, 18 bp, Artificial Sequence
  Synthetic DNA
ttatacggcacacaattg

SEQ ID NO: 41792 - DNA, 18 bp, Artificial Sequence
  Synthetic DNA
ttatacggctctaaatag

SEQ ID NO: 41793 - DNA, 18 bp, Artificial Sequence
  Synthetic DNA
ttatacgtatcatcattg

SEQ ID NO: 41794 - DNA, 18 bp, Artificial Sequence
  Synthetic DNA
ttatacgtatctatatag

SEQ ID NO: 41795 - DNA, 18 bp, Artificial Sequence
  Synthetic DNA
ttatacgtatgtctaaag

SEQ ID NO: 41796 - DNA, 18 bp, Artificial Sequence
  Synthetic DNA
ttatacgtcaatttatag

SEQ ID NO: 41797 - DNA, 18 bp, Artificial Sequence
  Synthetic DNA
ttatacgtcagacttttg

SEQ ID NO: 41798 - DNA, 18 bp, Artificial Sequence
  Synthetic DNA
ttatacgtccatttaaag

SEQ ID NO: 41799 - DNA, 18 bp, Artificial Sequence
  Synthetic DNA
ttatacgtctaatactag

SEQ ID NO: 41800 - DNA, 18 bp, Artificial Sequence
  Synthetic DNA
ttatacgtctatttgtag

SEQ ID NO: 41801 - DNA, 18 bp, Artificial Sequence
  Synthetic DNA
ttatacgtctcacattcg

SEQ ID NO: 41802 - DNA, 18 bp, Artificial Sequence
  Synthetic DNA
ttatacgtctcaccgagg

SEQ ID NO: 41803 - DNA, 18 bp, Artificial Sequence
  Synthetic DNA
ttatacgtctcagaaccg

SEQ ID NO: 41804 - DNA, 18 bp, Artificial Sequence
  Synthetic DNA
ttatacgtctctaaagag

SEQ ID NO: 41805 - DNA, 18 bp, Artificial Sequence
  Synthetic DNA
ttatacgtctctgttctg

SEQ ID NO: 41806 - DNA, 18 bp, Artificial Sequence
  Synthetic DNA
ttatacgtctgtatttcg

SEQ ID NO: 41807 - DNA, 18 bp, Artificial Sequence
  Synthetic DNA
ttatacgtcttaataaag

SEQ ID NO: 41808 - DNA, 18 bp, Artificial Sequence
  Synthetic DNA
ttatacgttccacagaag

SEQ ID NO: 41809 - DNA, 18 bp, Artificial Sequence
  Synthetic DNA
ttatactaatcgatttag

SEQ ID NO: 41810 - DNA, 18 bp, Artificial Sequence
  Synthetic DNA
ttatactacacattaaag

SEQ ID NO: 41811 - DNA, 18 bp, Artificial Sequence
  Synthetic DNA
ttatactacacattagag

SEQ ID NO: 41812 - DNA, 18 bp, Artificial Sequence
  Synthetic DNA
ttatactacacctttaag

SEQ ID NO: 41813 - DNA, 18 bp, Artificial Sequence
  Synthetic DNA
ttatactacgcataattg

SEQ ID NO: 41814 - DNA, 18 bp, Artificial Sequence
  Synthetic DNA
ttatactactcaatagcg

SEQ ID NO: 41815 - DNA, 18 bp, Artificial Sequence
  Synthetic DNA
ttatactactcagtcttg

SEQ ID NO: 41816 - DNA, 18 bp, Artificial Sequence
  Synthetic DNA
ttatactactctatattg

SEQ ID NO: 41817 - DNA, 18 bp, Artificial Sequence
  Synthetic DNA
ttatactagtcgctattg

SEQ ID NO: 41818 - DNA, 18 bp, Artificial Sequence
  Synthetic DNA
ttatactagtctctttag

SEQ ID NO: 41819 - DNA, 18 bp, Artificial Sequence
  Synthetic DNA
ttatactattcaccctag

SEQ ID NO: 41820 - DNA, 18 bp, Artificial Sequence
  Synthetic DNA
ttatactatttactacag

SEQ ID NO: 41821 - DNA, 18 bp, Artificial Sequence
  Synthetic DNA
ttatactcctcaccacag

SEQ ID NO: 41822 - DNA, 18 bp, Artificial Sequence
  Synthetic DNA
ttatactgatcacaaatg

SEQ ID NO: 41823 - DNA, 18 bp, Artificial Sequence
  Synthetic DNA
ttatactgcttaatatag

SEQ ID NO: 41824 - DNA, 18 bp, Artificial Sequence
  Synthetic DNA
ttatacttctcacatcag

SEQ ID NO: 41825 - DNA, 18 bp, Artificial Sequence
  Synthetic DNA
ttatacttctcattttag

SEQ ID NO: 41826 - DNA, 18 bp, Artificial Sequence
  Synthetic DNA
ttatacttctgacaattg

SEQ ID NO: 41827 - DNA, 18 bp, Artificial Sequence
  Synthetic DNA
ttatacttttctttatag

SEQ ID NO: 41828 - DNA, 18 bp, Artificial Sequence
  Synthetic DNA
ttatagaactcattgaag

SEQ ID NO: 41829 - DNA, 18 bp, Artificial Sequence
  Synthetic DNA
ttataggaattaatttag

SEQ ID NO: 41830 - DNA, 18 bp, Artificial Sequence
  Synthetic DNA
ttataggacaaactacag

SEQ ID NO: 41831 - DNA, 18 bp, Artificial Sequence
  Synthetic DNA
ttataggacaagatattg

SEQ ID NO: 41832 - DNA, 18 bp, Artificial Sequence
  Synthetic DNA
ttataggacaggagatag

SEQ ID NO: 41833 - DNA, 18 bp, Artificial Sequence
  Synthetic DNA
ttataggagtttctatag

SEQ ID NO: 41834 - DNA, 18 bp, Artificial Sequence
  Synthetic DNA
ttataggtcttactccag

SEQ ID NO: 41835 - DNA, 18 bp, Artificial Sequence
  Synthetic DNA
ttataggttataatatag

SEQ ID NO: 41836 - DNA, 18 bp, Artificial Sequence
  Synthetic DNA
ttatagtacctactattg

SEQ ID NO: 41837 - DNA, 18 bp, Artificial Sequence
  Synthetic DNA
ttatagtactctctagtg

SEQ ID NO: 41838 - DNA, 18 bp, Artificial Sequence
  Synthetic DNA
ttatagttctcatgatag

SEQ ID NO: 41839 - DNA, 18 bp, Artificial Sequence
  Synthetic DNA
ttatataactcccttaag

SEQ ID NO: 41840 - DNA, 18 bp, Artificial Sequence
  Synthetic DNA
ttatataattaagaacag

SEQ ID NO: 41841 - DNA, 18 bp, Artificial Sequence
  Synthetic DNA
ttatatcacacactaaag

SEQ ID NO: 41842 - DNA, 18 bp, Artificial Sequence
  Synthetic DNA
ttatatcactcaatcaag

SEQ ID NO: 41843 - DNA, 18 bp, Artificial Sequence
  Synthetic DNA
ttatatctctgattatag

SEQ ID NO: 41844 - DNA, 18 bp, Artificial Sequence
  Synthetic DNA
ttatatgacacactcttg

SEQ ID NO: 41845 - DNA, 18 bp, Artificial Sequence
  Synthetic DNA
ttatatgacagaccattg

SEQ ID NO: 41846 - DNA, 18 bp, Artificial Sequence
  Synthetic DNA
ttatatgaccatctatag

SEQ ID NO: 41847 - DNA, 18 bp, Artificial Sequence
  Synthetic DNA
ttatatgacctacaatag

SEQ ID NO: 41848 - DNA, 18 bp, Artificial Sequence
  Synthetic DNA
ttatatgactccttttag

SEQ ID NO: 41849 - DNA, 18 bp, Artificial Sequence
  Synthetic DNA
ttatatgactctctgtgg

SEQ ID NO: 41850 - DNA, 18 bp, Artificial Sequence
  Synthetic DNA
ttatatgactttctttgg

SEQ ID NO: 41851 - DNA, 18 bp, Artificial Sequence
  Synthetic DNA
ttatatgatagaccattg

SEQ ID NO: 41852 - DNA, 18 bp, Artificial Sequence
  Synthetic DNA
ttatatgccactctagag

SEQ ID NO: 41853 - DNA, 18 bp, Artificial Sequence
  Synthetic DNA
ttatatgccccactttag

SEQ ID NO: 41854 - DNA, 18 bp, Artificial Sequence
  Synthetic DNA
ttatatgcctcacaacag

SEQ ID NO: 41855 - DNA, 18 bp, Artificial Sequence
  Synthetic DNA
ttatatgtcttccaatag

SEQ ID NO: 41856 - DNA, 18 bp, Artificial Sequence
  Synthetic DNA
ttatatgtttatatatag

SEQ ID NO: 41857 - DNA, 18 bp, Artificial Sequence
  Synthetic DNA
ttatattactcatcttag

SEQ ID NO: 41858 - DNA, 18 bp, Artificial Sequence
  Synthetic DNA
ttatcaacctgattaaag

SEQ ID NO: 41859 - DNA, 18 bp, Artificial Sequence
  Synthetic DNA
ttatcagactcaccatcg

SEQ ID NO: 41860 - DNA, 18 bp, Artificial Sequence
  Synthetic DNA
ttatcagactcactcttg

SEQ ID NO: 41861 - DNA, 18 bp, Artificial Sequence
  Synthetic DNA
ttatcagtcttaccatcg

SEQ ID NO: 41862 - DNA, 18 bp, Artificial Sequence
  Synthetic DNA
ttatccaactccctgtag

SEQ ID NO: 41863 - DNA, 18 bp, Artificial Sequence
  Synthetic DNA
ttatcccactctcaaatg

SEQ ID NO: 41864 - DNA, 18 bp, Artificial Sequence
  Synthetic DNA
ttatccgacagcctatag

SEQ ID NO: 41865 - DNA, 18 bp, Artificial Sequence
  Synthetic DNA
ttatccgactcacaagtg

SEQ ID NO: 41866 - DNA, 18 bp, Artificial Sequence
  Synthetic DNA
ttatccgtcccattcaag

SEQ ID NO: 41867 - DNA, 18 bp, Artificial Sequence
  Synthetic DNA
ttatcggcctcactatgg

SEQ ID NO: 41868 - DNA, 18 bp, Artificial Sequence
  Synthetic DNA
ttatgcatctaagtatag

SEQ ID NO: 41869 - DNA, 18 bp, Artificial Sequence
  Synthetic DNA
ttatgcatcttcctatag

SEQ ID NO: 41870 - DNA, 18 bp, Artificial Sequence
  Synthetic DNA
ttatgccactgttataag

SEQ ID NO: 41871 - DNA, 18 bp, Artificial Sequence
  Synthetic DNA
ttatgcgaccacttatag

SEQ ID NO: 41872 - DNA, 18 bp, Artificial Sequence
  Synthetic DNA
ttatgcgactctttctag

SEQ ID NO: 41873 - DNA, 18 bp, Artificial Sequence
  Synthetic DNA
ttatgcgagtctctttag

SEQ ID NO: 41874 - DNA, 18 bp, Artificial Sequence
  Synthetic DNA
ttatgcgattcactaacg

SEQ ID NO: 41875 - DNA, 18 bp, Artificial Sequence
  Synthetic DNA
ttatgcgatttactaatg

SEQ ID NO: 41876 - DNA, 18 bp, Artificial Sequence
  Synthetic DNA
ttatgcggctcactaagg

SEQ ID NO: 41877 - DNA, 18 bp, Artificial Sequence
  Synthetic DNA
ttatgcggctcattttag

SEQ ID NO: 41878 - DNA, 18 bp, Artificial Sequence
  Synthetic DNA
ttatgcgtcacactttag

SEQ ID NO: 41879 - DNA, 18 bp, Artificial Sequence
  Synthetic DNA
ttatgcgtctgaccatag

SEQ ID NO: 41880 - DNA, 18 bp, Artificial Sequence
  Synthetic DNA
ttatgcgtgtcacttcgg

SEQ ID NO: 41881 - DNA, 18 bp, Artificial Sequence
  Synthetic DNA
ttatgctactcagtgtag

SEQ ID NO: 41882 - DNA, 18 bp, Artificial Sequence
  Synthetic DNA
ttatgctacttactatcg

SEQ ID NO: 41883 - DNA, 18 bp, Artificial Sequence
  Synthetic DNA
ttatgctactttatatag

SEQ ID NO: 41884 - DNA, 18 bp, Artificial Sequence
  Synthetic DNA
ttatgggattcaatttag

SEQ ID NO: 41885 - DNA, 18 bp, Artificial Sequence
  Synthetic DNA
ttatgtgaattataacgg

SEQ ID NO: 41886 - DNA, 18 bp, Artificial Sequence
  Synthetic DNA
ttatgtgatctactattg

SEQ ID NO: 41887 - DNA, 18 bp, Artificial Sequence
  Synthetic DNA
ttatgttactcatgatag

SEQ ID NO: 41888 - DNA, 18 bp, Artificial Sequence
  Synthetic DNA
ttattaaactcacattag

SEQ ID NO: 41889 - DNA, 18 bp, Artificial Sequence
  Synthetic DNA
ttattaaacttactatag

SEQ ID NO: 41890 - DNA, 18 bp, Artificial Sequence
  Synthetic DNA
ttattacaatcactatcg

SEQ ID NO: 41891 - DNA, 18 bp, Artificial Sequence
  Synthetic DNA
ttattagacacactaaag

SEQ ID NO: 41892 - DNA, 18 bp, Artificial Sequence
  Synthetic DNA
ttattagacagacgatag

SEQ ID NO: 41893 - DNA, 18 bp, Artificial Sequence
  Synthetic DNA
ttattagatactctgtag

SEQ ID NO: 41894 - DNA, 18 bp, Artificial Sequence
  Synthetic DNA
ttattagtctcaacatag

SEQ ID NO: 41895 - DNA, 18 bp, Artificial Sequence
  Synthetic DNA
ttattagtctccctaaag

SEQ ID NO: 41896 - DNA, 18 bp, Artificial Sequence
  Synthetic DNA
ttattagtttcacaacag

SEQ ID NO: 41897 - DNA, 18 bp, Artificial Sequence
  Synthetic DNA
ttattatactcatataag

SEQ ID NO: 41898 - DNA, 18 bp, Artificial Sequence
  Synthetic DNA
ttattcaacatgctatag

SEQ ID NO: 41899 - DNA, 18 bp, Artificial Sequence
  Synthetic DNA
ttattcaactcacctaag

SEQ ID NO: 41900 - DNA, 18 bp, Artificial Sequence
  Synthetic DNA
ttattcatctcgcaatag

SEQ ID NO: 41901 - DNA, 18 bp, Artificial Sequence
  Synthetic DNA
ttattcatctcgctacag

SEQ ID NO: 41902 - DNA, 18 bp, Artificial Sequence
  Synthetic DNA
ttattccaatcacttctg

SEQ ID NO: 41903 - DNA, 18 bp, Artificial Sequence
  Synthetic DNA
ttattcgaaaaattacag

SEQ ID NO: 41904 - DNA, 18 bp, Artificial Sequence
  Synthetic DNA
ttattcgaatcacaacag

SEQ ID NO: 41905 - DNA, 18 bp, Artificial Sequence
  Synthetic DNA
ttattcgacaaacagcag

SEQ ID NO: 41906 - DNA, 18 bp, Artificial Sequence
  Synthetic DNA
ttattcgacacattattg

SEQ ID NO: 41907 - DNA, 18 bp, Artificial Sequence
  Synthetic DNA
ttattcgacagaccaaag

SEQ ID NO: 41908 - DNA, 18 bp, Artificial Sequence
  Synthetic DNA
ttattcgacgcaattcag

SEQ ID NO: 41909 - DNA, 18 bp, Artificial Sequence
  Synthetic DNA
ttattcgactcataacag

SEQ ID NO: 41910 - DNA, 18 bp, Artificial Sequence
  Synthetic DNA
ttattcgactctgtattg

SEQ ID NO: 41911 - DNA, 18 bp, Artificial Sequence
  Synthetic DNA
ttattcgactttctctag

SEQ ID NO: 41912 - DNA, 18 bp, Artificial Sequence
  Synthetic DNA
ttattcgagtcgctttag

SEQ ID NO: 41913 - DNA, 18 bp, Artificial Sequence
  Synthetic DNA
ttattcgcctagctattg

SEQ ID NO: 41914 - DNA, 18 bp, Artificial Sequence
  Synthetic DNA
ttattcgcgaatctatag

SEQ ID NO: 41915 - DNA, 18 bp, Artificial Sequence
  Synthetic DNA
ttattcgctttactaaag

SEQ ID NO: 41916 - DNA, 18 bp, Artificial Sequence
  Synthetic DNA
ttattcggctcaccttag

SEQ ID NO: 41917 - DNA, 18 bp, Artificial Sequence
  Synthetic DNA
ttattcggttctctttag

SEQ ID NO: 41918 - DNA, 18 bp, Artificial Sequence
  Synthetic DNA
ttattcgtcaaacttaag

SEQ ID NO: 41919 - DNA, 18 bp, Artificial Sequence
  Synthetic DNA
ttattcgtcacactaatg

SEQ ID NO: 41920 - DNA, 18 bp, Artificial Sequence
  Synthetic DNA
ttattcgtctcactttgg

SEQ ID NO: 41921 - DNA, 18 bp, Artificial Sequence
  Synthetic DNA
ttattcgtctcgccatag

SEQ ID NO: 41922 - DNA, 18 bp, Artificial Sequence
  Synthetic DNA
ttattcgtcttattatag

SEQ ID NO: 41923 - DNA, 18 bp, Artificial Sequence
  Synthetic DNA
ttattctactctctacag

SEQ ID NO: 41924 - DNA, 18 bp, Artificial Sequence
  Synthetic DNA
ttattctacttacacatg

SEQ ID NO: 41925 - DNA, 18 bp, Artificial Sequence
  Synthetic DNA
ttattctatgctctatag

SEQ ID NO: 41926 - DNA, 18 bp, Artificial Sequence
  Synthetic DNA
ttattctattccctattg

SEQ ID NO: 41927 - DNA, 18 bp, Artificial Sequence
  Synthetic DNA
ttattctcatagctttag

SEQ ID NO: 41928 - DNA, 18 bp, Artificial Sequence
  Synthetic DNA
ttattgaagttactatag

SEQ ID NO: 41929 - DNA, 18 bp, Artificial Sequence
  Synthetic DNA
ttattgaattttctatag

SEQ ID NO: 41930 - DNA, 18 bp, Artificial Sequence
  Synthetic DNA
ttattgcaaccacttaag

SEQ ID NO: 41931 - DNA, 18 bp, Artificial Sequence
  Synthetic DNA
ttattggaaccactatag

SEQ ID NO: 41932 - DNA, 18 bp, Artificial Sequence
  Synthetic DNA
ttattggaccaaatcatg

SEQ ID NO: 41933 - DNA, 18 bp, Artificial Sequence
  Synthetic DNA
ttattggtctcactattg

SEQ ID NO: 41934 - DNA, 18 bp, Artificial Sequence
  Synthetic DNA
ttatttcccacgctatag

SEQ ID NO: 41935 - DNA, 18 bp, Artificial Sequence
  Synthetic DNA
ttatttgactctcttttg

SEQ ID NO: 41936 - DNA, 18 bp, Artificial Sequence
  Synthetic DNA
ttatttgagaaactatag

SEQ ID NO: 41937 - DNA, 18 bp, Artificial Sequence
  Synthetic DNA
ttatttgattcacaatag

SEQ ID NO: 41938 - DNA, 18 bp, Artificial Sequence
  Synthetic DNA
ttatttgtcacacttaag

SEQ ID NO: 41939 - DNA, 18 bp, Artificial Sequence
  Synthetic DNA
ttatttgtctcactacag

SEQ ID NO: 41940 - DNA, 18 bp, Artificial Sequence
  Synthetic DNA
ttattttactctctaagg

SEQ ID NO: 41941 - DNA, 18 bp, Artificial Sequence
  Synthetic DNA
ttattttacttactatag

SEQ ID NO: 41942 - DNA, 18 bp, Artificial Sequence
  Synthetic DNA
ttcaaagaatcactttag

SEQ ID NO: 41943 - DNA, 18 bp, Artificial Sequence
  Synthetic DNA
ttcaaagtatcagtatag

SEQ ID NO: 41944 - DNA, 18 bp, Artificial Sequence
  Synthetic DNA
ttcaaagtctgactatag

SEQ ID NO: 41945 - DNA, 18 bp, Artificial Sequence
  Synthetic DNA
ttcaaccatgcactattg

SEQ ID NO: 41946 - DNA, 18 bp, Artificial Sequence
  Synthetic DNA
ttcagcgcttagctaaag

SEQ ID NO: 41947 - DNA, 18 bp, Artificial Sequence
  Synthetic DNA
ttccaccacacactctag

SEQ ID NO: 41948 - DNA, 18 bp, Artificial Sequence
  Synthetic DNA
ttccatgaatatctatag

SEQ ID NO: 41949 - DNA, 18 bp, Artificial Sequence
  Synthetic DNA
ttccttcattcaccatag

SEQ ID NO: 41950 - DNA, 18 bp, Artificial Sequence
  Synthetic DNA
ttcgtcaactcactttag

SEQ ID NO: 41951 - DNA, 18 bp, Artificial Sequence
  Synthetic DNA
ttctaagagtgactaaag

SEQ ID NO: 41952 - DNA, 18 bp, Artificial Sequence
  Synthetic DNA
ttctaagatttactattg

SEQ ID NO: 41953 - DNA, 18 bp, Artificial Sequence
  Synthetic DNA
ttctacaaatctctattg

SEQ ID NO: 41954 - DNA, 18 bp, Artificial Sequence
  Synthetic DNA
ttctacaacacactactg

SEQ ID NO: 41955 - DNA, 18 bp, Artificial Sequence
  Synthetic DNA
ttctacgaatacctcaag

SEQ ID NO: 41956 - DNA, 18 bp, Artificial Sequence
  Synthetic DNA
ttctacgacagaaaacag

SEQ ID NO: 41957 - DNA, 18 bp, Artificial Sequence
  Synthetic DNA
ttctacgactaactgttg

SEQ ID NO: 41958 - DNA, 18 bp, Artificial Sequence
  Synthetic DNA
ttctacgactgacttttg

SEQ ID NO: 41959 - DNA, 18 bp, Artificial Sequence
  Synthetic DNA
ttctacgatacacatacg

SEQ ID NO: 41960 - DNA, 18 bp, Artificial Sequence
  Synthetic DNA
ttctacgtataactattg

SEQ ID NO: 41961 - DNA, 18 bp, Artificial Sequence
  Synthetic DNA
ttctacgtcacactttag

SEQ ID NO: 41962 - DNA, 18 bp, Artificial Sequence
  Synthetic DNA
ttctacgtccgactatag

SEQ ID NO: 41963 - DNA, 18 bp, Artificial Sequence
  Synthetic DNA
ttctacgtctatctatag

SEQ ID NO: 41964 - DNA, 18 bp, Artificial Sequence
  Synthetic DNA
ttctactacataaaattg

SEQ ID NO: 41965 - DNA, 18 bp, Artificial Sequence
  Synthetic DNA
ttctatgaaacaccatcg

SEQ ID NO: 41966 - DNA, 18 bp, Artificial Sequence
  Synthetic DNA
ttctatgacatacaattg

SEQ ID NO: 41967 - DNA, 18 bp, Artificial Sequence
  Synthetic DNA
ttctccatgccaacatag

SEQ ID NO: 41968 - DNA, 18 bp, Artificial Sequence
  Synthetic DNA
ttctcgtactcactattg

SEQ ID NO: 41969 - DNA, 18 bp, Artificial Sequence
  Synthetic DNA
ttctgcgtttcattatag

SEQ ID NO: 41970 - DNA, 18 bp, Artificial Sequence
  Synthetic DNA
ttcttagaatcaatatag

SEQ ID NO: 41971 - DNA, 18 bp, Artificial Sequence
  Synthetic DNA
ttcttagaatcactaaag

SEQ ID NO: 41972 - DNA, 18 bp, Artificial Sequence
  Synthetic DNA
ttcttcgcatcactatcg

SEQ ID NO: 41973 - DNA, 18 bp, Artificial Sequence
  Synthetic DNA
ttcttggtctcactctag

SEQ ID NO: 41974 - DNA, 18 bp, Artificial Sequence
  Synthetic DNA
ttctttgtaactctatag

SEQ ID NO: 41975 - DNA, 18 bp, Artificial Sequence
  Synthetic DNA
ttgaacaacttattatag

SEQ ID NO: 41976 - DNA, 18 bp, Artificial Sequence
  Synthetic DNA
ttgaacgaacgactattg

SEQ ID NO: 41977 - DNA, 18 bp, Artificial Sequence
  Synthetic DNA
ttgaacgacccaattttg

SEQ ID NO: 41978 - DNA, 18 bp, Artificial Sequence
  Synthetic DNA
ttgaacgcctcacgatag

SEQ ID NO: 41979 - DNA, 18 bp, Artificial Sequence
  Synthetic DNA
ttgaacgtctctctatcg

SEQ ID NO: 41980 - DNA, 18 bp, Artificial Sequence
  Synthetic DNA
ttgatcgattttcaatag

SEQ ID NO: 41981 - DNA, 18 bp, Artificial Sequence
  Synthetic DNA
ttgcacgtctaacgtcag

SEQ ID NO: 41982 - DNA, 18 bp, Artificial Sequence
  Synthetic DNA
ttggacaatcctcaactg

SEQ ID NO: 41983 - DNA, 18 bp, Artificial Sequence
  Synthetic DNA
ttgtaaacctcactttag

SEQ ID NO: 41984 - DNA, 18 bp, Artificial Sequence
  Synthetic DNA
ttgtaagtcataatatag

SEQ ID NO: 41985 - DNA, 18 bp, Artificial Sequence
  Synthetic DNA
ttgtacaacacactaagg

SEQ ID NO: 41986 - DNA, 18 bp, Artificial Sequence
  Synthetic DNA
ttgtacgacctctaatgg

SEQ ID NO: 41987 - DNA, 18 bp, Artificial Sequence
  Synthetic DNA
ttgtacgagtcaccttcg

SEQ ID NO: 41988 - DNA, 18 bp, Artificial Sequence
  Synthetic DNA
ttgtacgattcacataag

SEQ ID NO: 41989 - DNA, 18 bp, Artificial Sequence
  Synthetic DNA
ttgtacgcctctctctag

SEQ ID NO: 41990 - DNA, 18 bp, Artificial Sequence
  Synthetic DNA
ttgtacgtctaaattaag

SEQ ID NO: 41991 - DNA, 18 bp, Artificial Sequence
  Synthetic DNA
ttgtacgtgttcccaatg

SEQ ID NO: 41992 - DNA, 18 bp, Artificial Sequence
  Synthetic DNA
ttgtactgctctctttag

SEQ ID NO: 41993 - DNA, 18 bp, Artificial Sequence
  Synthetic DNA
ttgtaggacgcactacgg

SEQ ID NO: 41994 - DNA, 18 bp, Artificial Sequence
  Synthetic DNA
ttgtatatctcactatag

SEQ ID NO: 41995 - DNA, 18 bp, Artificial Sequence
  Synthetic DNA
ttgtatgacacatcattg

SEQ ID NO: 41996 - DNA, 18 bp, Artificial Sequence
  Synthetic DNA
ttgtatgactctcaatag

SEQ ID NO: 41997 - DNA, 18 bp, Artificial Sequence
  Synthetic DNA
ttgtcccattcactaaag

SEQ ID NO: 41998 - DNA, 18 bp, Artificial Sequence
  Synthetic DNA
ttgtgcgaatcacgctag

SEQ ID NO: 41999 - DNA, 18 bp, Artificial Sequence
  Synthetic DNA
ttgttctatccactttcg

SEQ ID NO: 42000 - DNA, 18 bp, Artificial Sequence
  Synthetic DNA
ttgtttgactctttttag

SEQ ID NO: 42001 - DNA, 18 bp, Artificial Sequence
  Synthetic DNA
tttaaagacccacatatg

SEQ ID NO: 42002 - DNA, 18 bp, Artificial Sequence
  Synthetic DNA
tttaaccattctccttag

SEQ ID NO: 42003 - DNA, 18 bp, Artificial Sequence
  Synthetic DNA
tttaacgactccacaaag

SEQ ID NO: 42004 - DNA, 18 bp, Artificial Sequence
  Synthetic DNA
tttaacgacttagtttag

SEQ ID NO: 42005 - DNA, 18 bp, Artificial Sequence
  Synthetic DNA
tttaacgagttactatcg

SEQ ID NO: 42006 - DNA, 18 bp, Artificial Sequence
  Synthetic DNA
tttaacgatacattaaag

SEQ ID NO: 42007 - DNA, 18 bp, Artificial Sequence
  Synthetic DNA
tttaacgattaaccatcg

SEQ ID NO: 42008 - DNA, 18 bp, Artificial Sequence
  Synthetic DNA
tttaacgtctcacgttag

SEQ ID NO: 42009 - DNA, 18 bp, Artificial Sequence
  Synthetic DNA
tttaacgtctcgcaattg

SEQ ID NO: 42010 - DNA, 18 bp, Artificial Sequence
  Synthetic DNA
tttacatactgactatag

SEQ ID NO: 42011 - DNA, 18 bp, Artificial Sequence
  Synthetic DNA
tttaccaactcactttag

SEQ ID NO: 42012 - DNA, 18 bp, Artificial Sequence
  Synthetic DNA
tttaccgcctatctaaag

SEQ ID NO: 42013 - DNA, 18 bp, Artificial Sequence
  Synthetic DNA
tttaccgtctaactatcg

SEQ ID NO: 42014 - DNA, 18 bp, Artificial Sequence
  Synthetic DNA
tttaccgtctctctaatg

SEQ ID NO: 42015 - DNA, 18 bp, Artificial Sequence
  Synthetic DNA
tttagcaactcagtattg

SEQ ID NO: 42016 - DNA, 18 bp, Artificial Sequence
  Synthetic DNA
tttatatacttgctatag

SEQ ID NO: 42017 - DNA, 18 bp, Artificial Sequence
  Synthetic DNA
tttatcaaatcacaatag

SEQ ID NO: 42018 - DNA, 18 bp, Artificial Sequence
  Synthetic DNA
tttatcgacttaatatag

SEQ ID NO: 42019 - DNA, 18 bp, Artificial Sequence
  Synthetic DNA
tttatcggctctctatag

SEQ ID NO: 42020 - DNA, 18 bp, Artificial Sequence
  Synthetic DNA
tttatcgtcgctatatag

SEQ ID NO: 42021 - DNA, 18 bp, Artificial Sequence
  Synthetic DNA
tttatggactgtctattg

SEQ ID NO: 42022 - DNA, 18 bp, Artificial Sequence
  Synthetic DNA
tttcaacaatcattacgg

SEQ ID NO: 42023 - DNA, 18 bp, Artificial Sequence
  Synthetic DNA
tttcacgactaactaaag

SEQ ID NO: 42024 - DNA, 18 bp, Artificial Sequence
  Synthetic DNA
tttcacttctcacttgag

SEQ ID NO: 42025 - DNA, 18 bp, Artificial Sequence
  Synthetic DNA
tttcatatcctactctag

SEQ ID NO: 42026 - DNA, 18 bp, Artificial Sequence
  Synthetic DNA
tttcgctactcactatag

SEQ ID NO: 42027 - DNA, 18 bp, Artificial Sequence
  Synthetic DNA
tttctggactcactatag

SEQ ID NO: 42028 - DNA, 18 bp, Artificial Sequence
  Synthetic DNA
tttgacatctcaataaag

SEQ ID NO: 42029 - DNA, 18 bp, Artificial Sequence
  Synthetic DNA
tttgaccattcactctag

SEQ ID NO: 42030 - DNA, 18 bp, Artificial Sequence
  Synthetic DNA
tttgattactctctatag

SEQ ID NO: 42031 - DNA, 18 bp, Artificial Sequence
  Synthetic DNA
tttgcttaagctcaatag

SEQ ID NO: 42032 - DNA, 18 bp, Artificial Sequence
  Synthetic DNA
tttgttgacacactatcg

SEQ ID NO: 42033 - DNA, 18 bp, Artificial Sequence
  Synthetic DNA
ttttaaaagtctatatgg

SEQ ID NO: 42034 - DNA, 18 bp, Artificial Sequence
  Synthetic DNA
ttttaacgctcactatag

SEQ ID NO: 42035 - DNA, 18 bp, Artificial Sequence
  Synthetic DNA
ttttaagacataccatag

SEQ ID NO: 42036 - DNA, 18 bp, Artificial Sequence
  Synthetic DNA
ttttaagactcaaaatag

SEQ ID NO: 42037 - DNA, 18 bp, Artificial Sequence
  Synthetic DNA
ttttaagattcattctgg

SEQ ID NO: 42038 - DNA, 18 bp, Artificial Sequence
  Synthetic DNA
ttttaagtctaacaatag

SEQ ID NO: 42039 - DNA, 18 bp, Artificial Sequence
  Synthetic DNA
ttttaagtctcaatatag

SEQ ID NO: 42040 - DNA, 18 bp, Artificial Sequence
  Synthetic DNA
ttttaatgatcaatatag

SEQ ID NO: 42041 - DNA, 18 bp, Artificial Sequence
  Synthetic DNA
ttttacaattaacaatag

SEQ ID NO: 42042 - DNA, 18 bp, Artificial Sequence
  Synthetic DNA
ttttacattacactatag

SEQ ID NO: 42043 - DNA, 18 bp, Artificial Sequence
  Synthetic DNA
ttttacctcgcattattg

SEQ ID NO: 42044 - DNA, 18 bp, Artificial Sequence
  Synthetic DNA
ttttacgaataactttcg

SEQ ID NO: 42045 - DNA, 18 bp, Artificial Sequence
  Synthetic DNA
ttttacgaattactaacg

SEQ ID NO: 42046 - DNA, 18 bp, Artificial Sequence
  Synthetic DNA
ttttacgacaaataacag

SEQ ID NO: 42047 - DNA, 18 bp, Artificial Sequence
  Synthetic DNA
ttttacgacacacaattg

SEQ ID NO: 42048 - DNA, 18 bp, Artificial Sequence
  Synthetic DNA
ttttacgacactctgtag

SEQ ID NO: 42049 - DNA, 18 bp, Artificial Sequence
  Synthetic DNA
ttttacgacatactgttg

SEQ ID NO: 42050 - DNA, 18 bp, Artificial Sequence
  Synthetic DNA
ttttacgactcaatcaag

SEQ ID NO: 42051 - DNA, 18 bp, Artificial Sequence
  Synthetic DNA
ttttacgactcagtcttg

SEQ ID NO: 42052 - DNA, 18 bp, Artificial Sequence
  Synthetic DNA
ttttacgactcattgtcg

SEQ ID NO: 42053 - DNA, 18 bp, Artificial Sequence
  Synthetic DNA
ttttacggataactatag

SEQ ID NO: 42054 - DNA, 18 bp, Artificial Sequence
  Synthetic DNA
ttttacggctccgttaag

SEQ ID NO: 42055 - DNA, 18 bp, Artificial Sequence
  Synthetic DNA
ttttacgtacctctttag

SEQ ID NO: 42056 - DNA, 18 bp, Artificial Sequence
  Synthetic DNA
ttttacgtcacacaaaag

SEQ ID NO: 42057 - DNA, 18 bp, Artificial Sequence
  Synthetic DNA
ttttacgtctagctagag

SEQ ID NO: 42058 - DNA, 18 bp, Artificial Sequence
  Synthetic DNA
ttttacgtctcacaacag

SEQ ID NO: 42059 - DNA, 18 bp, Artificial Sequence
  Synthetic DNA
ttttacgtctcactatta

SEQ ID NO: 42060 - DNA, 18 bp, Artificial Sequence
  Synthetic DNA
ttttacgtctcgacaaag

SEQ ID NO: 42061 - DNA, 18 bp, Artificial Sequence
  Synthetic DNA
ttttacgtgtaacattgg

SEQ ID NO: 42062 - DNA, 18 bp, Artificial Sequence
  Synthetic DNA
ttttacgtttcacgatag

SEQ ID NO: 42063 - DNA, 18 bp, Artificial Sequence
  Synthetic DNA
ttttactaataacatcag

SEQ ID NO: 42064 - DNA, 18 bp, Artificial Sequence
  Synthetic DNA
ttttactatcaactatag

SEQ ID NO: 42065 - DNA, 18 bp, Artificial Sequence
  Synthetic DNA
ttttacttcttactctag

SEQ ID NO: 42066 - DNA, 18 bp, Artificial Sequence
  Synthetic DNA
ttttaggactcactagcg

SEQ ID NO: 42067 - DNA, 18 bp, Artificial Sequence
  Synthetic DNA
ttttatgagtcacttaag

SEQ ID NO: 42068 - DNA, 18 bp, Artificial Sequence
  Synthetic DNA
ttttccgaatctctgtag

SEQ ID NO: 42069 - DNA, 18 bp, Artificial Sequence
  Synthetic DNA
ttttccgtctcactattg

SEQ ID NO: 42070 - DNA, 18 bp, Artificial Sequence
  Synthetic DNA
ttttcctactcactgtag

SEQ ID NO: 42071 - DNA, 18 bp, Artificial Sequence
  Synthetic DNA
ttttcggactctcaacag

SEQ ID NO: 42072 - DNA, 18 bp, Artificial Sequence
  Synthetic DNA
ttttctaactatatatag

SEQ ID NO: 42073 - DNA, 18 bp, Artificial Sequence
  Synthetic DNA
ttttctgattcactatag

SEQ ID NO: 42074 - DNA, 18 bp, Artificial Sequence
  Synthetic DNA
ttttcttataaactttag

SEQ ID NO: 42075 - DNA, 18 bp, Artificial Sequence
  Synthetic DNA
ttttgcgacccaaaatag

SEQ ID NO: 42076 - DNA, 18 bp, Artificial Sequence
  Synthetic DNA
ttttgcgactcaatttag

SEQ ID NO: 42077 - DNA, 18 bp, Artificial Sequence
  Synthetic DNA
ttttgcgactctctgtag

SEQ ID NO: 42078 - DNA, 18 bp, Artificial Sequence
  Synthetic DNA
ttttgttactctctatag

SEQ ID NO: 42079 - DNA, 18 bp, Artificial Sequence
  Synthetic DNA
tttttaatttcactaaag

SEQ ID NO: 42080 - DNA, 18 bp, Artificial Sequence
  Synthetic DNA
tttttcaactcagtatag

SEQ ID NO: 42081 - DNA, 18 bp, Artificial Sequence
  Synthetic DNA
tttttcaactctcaaatg

SEQ ID NO: 42082 - DNA, 18 bp, Artificial Sequence
  Synthetic DNA
tttttcaattcactcgag

SEQ ID NO: 42083 - DNA, 18 bp, Artificial Sequence
  Synthetic DNA
tttttccactccatttag

SEQ ID NO: 42084 - DNA, 18 bp, Artificial Sequence
  Synthetic DNA
tttttcgaaacactaaag

SEQ ID NO: 42085 - DNA, 18 bp, Artificial Sequence
  Synthetic DNA
tttttcgactaagtacag

SEQ ID NO: 42086 - DNA, 18 bp, Artificial Sequence
  Synthetic DNA
tttttcgagtcagtattg

SEQ ID NO: 42087 - DNA, 18 bp, Artificial Sequence
  Synthetic DNA
tttttcggttctctatag

SEQ ID NO: 42088 - DNA, 18 bp, Artificial Sequence
  Synthetic DNA
tttttcgtctaaaaatag

SEQ ID NO: 42089 - DNA, 18 bp, Artificial Sequence
  Synthetic DNA
tagtactcttaaccaacg

SEQ ID NO: 42090 - DNA, 18 bp, Artificial Sequence
  Synthetic DNA
tatagcgaatcactttag

SEQ ID NO: 42091 - DNA, 18 bp, Artificial Sequence
  Synthetic DNA
taaatgaactcaccatag

SEQ ID NO: 42092 - DNA, 18 bp, Artificial Sequence
  Synthetic DNA
ttaaatgactcactctgg

SEQ ID NO: 42093 - DNA, 18 bp, Artificial Sequence
  Synthetic DNA
atatgcgactcacttaag

SEQ ID NO: 42094 - DNA, 18 bp, Artificial Sequence
  Synthetic DNA
caataagactcgctaatg

SEQ ID NO: 42095 - DNA, 18 bp, Artificial Sequence
  Synthetic DNA
tgaattgtttcactattg

SEQ ID NO: 42096 - DNA, 18 bp, Artificial Sequence
  Synthetic DNA
ttatccgtctcaccaaag

SEQ ID NO: 42097 - DNA, 18 bp, Artificial Sequence
  Synthetic DNA
aatttcaactcactattg

SEQ ID NO: 42098 - DNA, 18 bp, Artificial Sequence
  Synthetic DNA
tatagcgattcactacag

SEQ ID NO: 42099 - DNA, 18 bp, Artificial Sequence
  Synthetic DNA
tatacagactcgctatag

SEQ ID NO: 42100 - DNA, 18 bp, Artificial Sequence
  Synthetic DNA
tatcgcgacacactttag

SEQ ID NO: 42101 - DNA, 18 bp, Artificial Sequence
  Synthetic DNA
caaagcgtctcactttag

SEQ ID NO: 42102 - DNA, 18 bp, Artificial Sequence
  Synthetic DNA
tagtgcgttttactatag

SEQ ID NO: 42103 - DNA, 18 bp, Artificial Sequence
  Synthetic DNA
tatatcaactcactattg

SEQ ID NO: 42104 - DNA, 18 bp, Artificial Sequence
  Synthetic DNA
aaagacgaatatatatag

SEQ ID NO: 42105 - DNA, 18 bp, Artificial Sequence
  Synthetic DNA
agaatcgccagtctaaag

SEQ ID NO: 42106 - DNA, 18 bp, Artificial Sequence
  Synthetic DNA
atatacgactcgctaccg

SEQ ID NO: 42107 - DNA, 18 bp, Artificial Sequence
  Synthetic DNA
caatagaactctctaagg

SEQ ID NO: 42108 - DNA, 18 bp, Artificial Sequence
  Synthetic DNA
ccataagacacgctatag

SEQ ID NO: 42109 - DNA, 18 bp, Artificial Sequence
  Synthetic DNA
ccatatgactcataatag

SEQ ID NO: 42110 - DNA, 18 bp, Artificial Sequence
  Synthetic DNA
taaaacaagtctctatcg

SEQ ID NO: 42111 - DNA, 18 bp, Artificial Sequence
  Synthetic DNA
taaagcgaatcatcatag

SEQ ID NO: 42112 - DNA, 18 bp, Artificial Sequence
  Synthetic DNA
taactaatctctgtatag

SEQ ID NO: 42113 - DNA, 18 bp, Artificial Sequence
  Synthetic DNA
taataacgcacactaaag

SEQ ID NO: 42114 - DNA, 18 bp, Artificial Sequence
  Synthetic DNA
taatacgatccttaagtg

SEQ ID NO: 42115 - DNA, 18 bp, Artificial Sequence
  Synthetic DNA
taatgtgccttactgtcg

SEQ ID NO: 42116 - DNA, 18 bp, Artificial Sequence
  Synthetic DNA
taattcgacatagtttag

SEQ ID NO: 42117 - DNA, 18 bp, Artificial Sequence
  Synthetic DNA
taattctacccattattg

SEQ ID NO: 42118 - DNA, 18 bp, Artificial Sequence
  Synthetic DNA
tacatctactcaatatag

SEQ ID NO: 42119 - DNA, 18 bp, Artificial Sequence
  Synthetic DNA
tataaagactcattatgg

SEQ ID NO: 42120 - DNA, 18 bp, Artificial Sequence
  Synthetic DNA
tatataaactcactttag

SEQ ID NO: 42121 - DNA, 18 bp, Artificial Sequence
  Synthetic DNA
tattccgacacactaatg

SEQ ID NO: 42122 - DNA, 18 bp, Artificial Sequence
  Synthetic DNA
tcatacgacttacacgtg

SEQ ID NO: 42123 - DNA, 18 bp, Artificial Sequence
  Synthetic DNA
tgaagcgatcctctatag

SEQ ID NO: 42124 - DNA, 18 bp, Artificial Sequence
  Synthetic DNA
ttaaacagctctcgacag

SEQ ID NO: 42125 - DNA, 18 bp, Artificial Sequence
  Synthetic DNA
ttagacgtctcacaaaag

SEQ ID NO: 42126 - DNA, 18 bp, Artificial Sequence
  Synthetic DNA
ttataactctcactattg

SEQ ID NO: 42127 - DNA, 18 bp, Artificial Sequence
  Synthetic DNA
ttattccaatcaccatag

SEQ ID NO: 42128 - DNA, 18 bp, Artificial Sequence
  Synthetic DNA
ttattggtgtgactctag

SEQ ID NO: 42129 - DNA, 18 bp, Artificial Sequence
  Synthetic DNA
ttctacgtgccattatag

SEQ ID NO: 42130 - DNA, 18 bp, Artificial Sequence
  Synthetic DNA
ttgttagtctcattaaag

SEQ ID NO: 42131 - DNA, 18 bp, Artificial Sequence
  Synthetic DNA
taattggactcaccgctg

SEQ ID NO: 42132 - DNA, 18 bp, Artificial Sequence
  Synthetic DNA
tattacgtttcactaatg

SEQ ID NO: 42133 - DNA, 18 bp, Artificial Sequence
  Synthetic DNA
ttaaacgactaacaattg

SEQ ID NO: 42134 - DNA, 18 bp, Artificial Sequence
  Synthetic DNA
tttttcgactgtctttag

SEQ ID NO: 42135 - DNA, 18 bp, Artificial Sequence
  Synthetic DNA
ttaagcaactcactgtag

SEQ ID NO: 42136 - DNA, 18 bp, Artificial Sequence
  Synthetic DNA
taaatagactcactaatg

SEQ ID NO: 42137 - DNA, 18 bp, Artificial Sequence
  Synthetic DNA
aatttggactcactttag

SEQ ID NO: 42138 - DNA, 18 bp, Artificial Sequence
  Synthetic DNA
taacacgactcgcgaatg

SEQ ID NO: 42139 - DNA, 18 bp, Artificial Sequence
  Synthetic DNA
taatacacttctctagag

SEQ ID NO: 42140 - DNA, 18 bp, Artificial Sequence
  Synthetic DNA
tataaaaactcgctatag

SEQ ID NO: 42141 - DNA, 18 bp, Artificial Sequence
  Synthetic DNA
ttatactcccggctatag

SEQ ID NO: 42142 - DNA, 18 bp, Artificial Sequence
  Synthetic DNA
ttatcagaatctccatag

SEQ ID NO: 42143 - DNA, 18 bp, Artificial Sequence
  Synthetic DNA
aaaaaagactcacgttag

SEQ ID NO: 42144 - DNA, 18 bp, Artificial Sequence
  Synthetic DNA
aaaaacgactttctctag

SEQ ID NO: 42145 - DNA, 18 bp, Artificial Sequence
  Synthetic DNA
aaaatagactcactatgg

SEQ ID NO: 42146 - DNA, 18 bp, Artificial Sequence
  Synthetic DNA
aaacccggctcactaaag

SEQ ID NO: 42147 - DNA, 18 bp, Artificial Sequence
  Synthetic DNA
aaataagacacaccttag

SEQ ID NO: 42148 - DNA, 18 bp, Artificial Sequence
  Synthetic DNA
aaataaggctctctattg

SEQ ID NO: 42149 - DNA, 18 bp, Artificial Sequence
  Synthetic DNA
aaatacaacacacaaaag

SEQ ID NO: 42150 - DNA, 18 bp, Artificial Sequence
  Synthetic DNA
aaataccaacagacatag

SEQ ID NO: 42151 - DNA, 18 bp, Artificial Sequence
  Synthetic DNA
aaatacctatatttatag

SEQ ID NO: 42152 - DNA, 18 bp, Artificial Sequence
  Synthetic DNA
aaataggactcgctgcag

SEQ ID NO: 42153 - DNA, 18 bp, Artificial Sequence
  Synthetic DNA
aaatccggcatactactg

SEQ ID NO: 42154 - DNA, 18 bp, Artificial Sequence
  Synthetic DNA
aaatgcgacaccggttag

SEQ ID NO: 42155 - DNA, 18 bp, Artificial Sequence
  Synthetic DNA
aaattcaatccactatgg

SEQ ID NO: 42156 - DNA, 18 bp, Artificial Sequence
  Synthetic DNA
aaattcgactcttttaag

SEQ ID NO: 42157 - DNA, 18 bp, Artificial Sequence
  Synthetic DNA
aaattcgactgactcttg

SEQ ID NO: 42158 - DNA, 18 bp, Artificial Sequence
  Synthetic DNA
aaattcgagtcagtattg

SEQ ID NO: 42159 - DNA, 18 bp, Artificial Sequence
  Synthetic DNA
aaattcgatacactaaag

SEQ ID NO: 42160 - DNA, 18 bp, Artificial Sequence
  Synthetic DNA
aaattcgattcatgatag

SEQ ID NO: 42161 - DNA, 18 bp, Artificial Sequence
  Synthetic DNA
aacgacaactctctaaag

SEQ ID NO: 42162 - DNA, 18 bp, Artificial Sequence
  Synthetic DNA
aagtacaactcattattg

SEQ ID NO: 42163 - DNA, 18 bp, Artificial Sequence
  Synthetic DNA
aagtacgatccactaaag

SEQ ID NO: 42164 - DNA, 18 bp, Artificial Sequence
  Synthetic DNA
aagtactactaactcatg

SEQ ID NO: 42165 - DNA, 18 bp, Artificial Sequence
  Synthetic DNA
aagttcgactcacgaaag

SEQ ID NO: 42166 - DNA, 18 bp, Artificial Sequence
  Synthetic DNA
aatatcaacgcacttttg

SEQ ID NO: 42167 - DNA, 18 bp, Artificial Sequence
  Synthetic DNA
aattaccattccccattg

SEQ ID NO: 42168 - DNA, 18 bp, Artificial Sequence
  Synthetic DNA
aattacgacacagtttag

SEQ ID NO: 42169 - DNA, 18 bp, Artificial Sequence
  Synthetic DNA
aattacgactatctcaag

SEQ ID NO: 42170 - DNA, 18 bp, Artificial Sequence
  Synthetic DNA
aattaggaaccagtaaag

SEQ ID NO: 42171 - DNA, 18 bp, Artificial Sequence
  Synthetic DNA
aattatgacgcacaattg

SEQ ID NO: 42172 - DNA, 18 bp, Artificial Sequence
  Synthetic DNA
aatttcgacgcactttag

SEQ ID NO: 42173 - DNA, 18 bp, Artificial Sequence
  Synthetic DNA
acatacaactcattaaag

SEQ ID NO: 42174 - DNA, 18 bp, Artificial Sequence
  Synthetic DNA
acatacgccactctatag

SEQ ID NO: 42175 - DNA, 18 bp, Artificial Sequence
  Synthetic DNA
acatacgtctcattaaag

SEQ ID NO: 42176 - DNA, 18 bp, Artificial Sequence
  Synthetic DNA
acccacgacttactttcg

SEQ ID NO: 42177 - DNA, 18 bp, Artificial Sequence
  Synthetic DNA
acttacgacacttaatag

SEQ ID NO: 42178 - DNA, 18 bp, Artificial Sequence
  Synthetic DNA
agacgagatacactatag

SEQ ID NO: 42179 - DNA, 18 bp, Artificial Sequence
  Synthetic DNA
ataaacgtcactatacag

SEQ ID NO: 42180 - DNA, 18 bp, Artificial Sequence
  Synthetic DNA
atagacttatcattatag

SEQ ID NO: 42181 - DNA, 18 bp, Artificial Sequence
  Synthetic DNA
atataagactcactccag

SEQ ID NO: 42182 - DNA, 18 bp, Artificial Sequence
  Synthetic DNA
atatacatatcactatag

SEQ ID NO: 42183 - DNA, 18 bp, Artificial Sequence
  Synthetic DNA
atatacattgcactatag

SEQ ID NO: 42184 - DNA, 18 bp, Artificial Sequence
  Synthetic DNA
atataggactcgcattag

SEQ ID NO: 42185 - DNA, 18 bp, Artificial Sequence
  Synthetic DNA
atatcagattcactttag

SEQ ID NO: 42186 - DNA, 18 bp, Artificial Sequence
  Synthetic DNA
atatccattatactacag

SEQ ID NO: 42187 - DNA, 18 bp, Artificial Sequence
  Synthetic DNA
atatgcacctcactatag

SEQ ID NO: 42188 - DNA, 18 bp, Artificial Sequence
  Synthetic DNA
atcttcgaatcagtatag

SEQ ID NO: 42189 - DNA, 18 bp, Artificial Sequence
  Synthetic DNA
caaaaagactcaccaaag

SEQ ID NO: 42190 - DNA, 18 bp, Artificial Sequence
  Synthetic DNA
caaaaagacttcttatag

SEQ ID NO: 42191 - DNA, 18 bp, Artificial Sequence
  Synthetic DNA
caatacatatcaatatag

SEQ ID NO: 42192 - DNA, 18 bp, Artificial Sequence
  Synthetic DNA
caataccactcgcagtag

SEQ ID NO: 42193 - DNA, 18 bp, Artificial Sequence
  Synthetic DNA
caatacggctaattaatg

SEQ ID NO: 42194 - DNA, 18 bp, Artificial Sequence
  Synthetic DNA
caatactaaacacatcag

SEQ ID NO: 42195 - DNA, 18 bp, Artificial Sequence
  Synthetic DNA
caataggagtcactcaag

SEQ ID NO: 42196 - DNA, 18 bp, Artificial Sequence
  Synthetic DNA
caataggtctctttatcg

SEQ ID NO: 42197 - DNA, 18 bp, Artificial Sequence
  Synthetic DNA
caatgcgactgaccaatg

SEQ ID NO: 42198 - DNA, 18 bp, Artificial Sequence
  Synthetic DNA
caattgcattcactaaag

SEQ ID NO: 42199 - DNA, 18 bp, Artificial Sequence
  Synthetic DNA
cactagcagttacattag

SEQ ID NO: 42200 - DNA, 18 bp, Artificial Sequence
  Synthetic DNA
cagcacgactaaacttag

SEQ ID NO: 42201 - DNA, 18 bp, Artificial Sequence
  Synthetic DNA
cataaggacttactttag

SEQ ID NO: 42202 - DNA, 18 bp, Artificial Sequence
  Synthetic DNA
cattacaactagctatcg

SEQ ID NO: 42203 - DNA, 18 bp, Artificial Sequence
  Synthetic DNA
cattatttctccctaaag

SEQ ID NO: 42204 - DNA, 18 bp, Artificial Sequence
  Synthetic DNA
cattcgaaattgcatttg

SEQ ID NO: 42205 - DNA, 18 bp, Artificial Sequence
  Synthetic DNA
cattttcacaatctattg

SEQ ID NO: 42206 - DNA, 18 bp, Artificial Sequence
  Synthetic DNA
ccatataactctctatag

SEQ ID NO: 42207 - DNA, 18 bp, Artificial Sequence
  Synthetic DNA
cgaaatgattaactccag

SEQ ID NO: 42208 - DNA, 18 bp, Artificial Sequence
  Synthetic DNA
ctatacgtctatcttttg

SEQ ID NO: 42209 - DNA, 18 bp, Artificial Sequence
  Synthetic DNA
ctctacgccttactaatg

SEQ ID NO: 42210 - DNA, 18 bp, Artificial Sequence
  Synthetic DNA
ctctatgtctatttatag

SEQ ID NO: 42211 - DNA, 18 bp, Artificial Sequence
  Synthetic DNA
ctgtaccaatcactttag

SEQ ID NO: 42212 - DNA, 18 bp, Artificial Sequence
  Synthetic DNA
gaacgcttctcacaatag

SEQ ID NO: 42213 - DNA, 18 bp, Artificial Sequence
  Synthetic DNA
gaatacaataccctattg

SEQ ID NO: 42214 - DNA, 18 bp, Artificial Sequence
  Synthetic DNA
gaatacgattttctaaag

SEQ ID NO: 42215 - DNA, 18 bp, Artificial Sequence
  Synthetic DNA
gaatacgtctggcataag

SEQ ID NO: 42216 - DNA, 18 bp, Artificial Sequence
  Synthetic DNA
gaatattattcaagatag

SEQ ID NO: 42217 - DNA, 18 bp, Artificial Sequence
  Synthetic DNA
gagaacatttcactatag

SEQ ID NO: 42218 - DNA, 18 bp, Artificial Sequence
  Synthetic DNA
gattacggcccaccatag

SEQ ID NO: 42219 - DNA, 18 bp, Artificial Sequence
  Synthetic DNA
ggacaagtctcaccacag

SEQ ID NO: 42220 - DNA, 18 bp, Artificial Sequence
  Synthetic DNA
gtcaaagcctctctaaag

SEQ ID NO: 42221 - DNA, 18 bp, Artificial Sequence
  Synthetic DNA
gttaacgacacacaattg

SEQ ID NO: 42222 - DNA, 18 bp, Artificial Sequence
  Synthetic DNA
taaaacaaatcaataaag

SEQ ID NO: 42223 - DNA, 18 bp, Artificial Sequence
  Synthetic DNA
taaaacgacaccctttcg

SEQ ID NO: 42224 - DNA, 18 bp, Artificial Sequence
  Synthetic DNA
taaaacgagacttaatag

SEQ ID NO: 42225 - DNA, 18 bp, Artificial Sequence
  Synthetic DNA
taaaacgaggcactgcag

SEQ ID NO: 42226 - DNA, 18 bp, Artificial Sequence
  Synthetic DNA
taaaacgtcacattaaag

SEQ ID NO: 42227 - DNA, 18 bp, Artificial Sequence
  Synthetic DNA
taaaaggacaaacgaaag

SEQ ID NO: 42228 - DNA, 18 bp, Artificial Sequence
  Synthetic DNA
taaagccactcagtattg

SEQ ID NO: 42229 - DNA, 18 bp, Artificial Sequence
  Synthetic DNA
taaatctattccctatag

SEQ ID NO: 42230 - DNA, 18 bp, Artificial Sequence
  Synthetic DNA
taacacgtctcccttaag

SEQ ID NO: 42231 - DNA, 18 bp, Artificial Sequence
  Synthetic DNA
taacaggactcaaactag

SEQ ID NO: 42232 - DNA, 18 bp, Artificial Sequence
  Synthetic DNA
taacaggactcacttggg

SEQ ID NO: 42233 - DNA, 18 bp, Artificial Sequence
  Synthetic DNA
taacatgtcacacaacag

SEQ ID NO: 42234 - DNA, 18 bp, Artificial Sequence
  Synthetic DNA
taacattattatgggctg

SEQ ID NO: 42235 - DNA, 18 bp, Artificial Sequence
  Synthetic DNA
taacgcgttccagtatgg

SEQ ID NO: 42236 - DNA, 18 bp, Artificial Sequence
  Synthetic DNA
taacgctacccaatatcg

SEQ ID NO: 42237 - DNA, 18 bp, Artificial Sequence
  Synthetic DNA
taactaatctcactatag

SEQ ID NO: 42238 - DNA, 18 bp, Artificial Sequence
  Synthetic DNA
taactcaattctctatag

SEQ ID NO: 42239 - DNA, 18 bp, Artificial Sequence
  Synthetic DNA
taagacgactgtcaatgg

SEQ ID NO: 42240 - DNA, 18 bp, Artificial Sequence
  Synthetic DNA
taagacgattctaaatcg

SEQ ID NO: 42241 - DNA, 18 bp, Artificial Sequence
  Synthetic DNA
taagacgattgcgtttag

SEQ ID NO: 42242 - DNA, 18 bp, Artificial Sequence
  Synthetic DNA
taagacgtcacattattg

SEQ ID NO: 42243 - DNA, 18 bp, Artificial Sequence
  Synthetic DNA
taagtcgaatcgatattg

SEQ ID NO: 42244 - DNA, 18 bp, Artificial Sequence
  Synthetic DNA
taataagttactctattg

SEQ ID NO: 42245 - DNA, 18 bp, Artificial Sequence
  Synthetic DNA
taatacaaatcttttaag

SEQ ID NO: 42246 - DNA, 18 bp, Artificial Sequence
  Synthetic DNA
taatacaactgtacatag

SEQ ID NO: 42247 - DNA, 18 bp, Artificial Sequence
  Synthetic DNA
taatacagcttgcaatag

SEQ ID NO: 42248 - DNA, 18 bp, Artificial Sequence
  Synthetic DNA
taataccactaacgaatg

SEQ ID NO: 42249 - DNA, 18 bp, Artificial Sequence
  Synthetic DNA
taatacgactcccgcagg

SEQ ID NO: 42250 - DNA, 18 bp, Artificial Sequence
  Synthetic DNA
taatacgattatcattag

SEQ ID NO: 42251 - DNA, 18 bp, Artificial Sequence
  Synthetic DNA
taatacgcctcacctatg

SEQ ID NO: 42252 - DNA, 18 bp, Artificial Sequence
  Synthetic DNA
taatacgtcaatctaagg

SEQ ID NO: 42253 - DNA, 18 bp, Artificial Sequence
  Synthetic DNA
taatacgtctcatcacgg

SEQ ID NO: 42254 - DNA, 18 bp, Artificial Sequence
  Synthetic DNA
taatacgttttaaattag

SEQ ID NO: 42255 - DNA, 18 bp, Artificial Sequence
  Synthetic DNA
taatactatacagtaaag

SEQ ID NO: 42256 - DNA, 18 bp, Artificial Sequence
  Synthetic DNA
taatatcacctacaatag

SEQ ID NO: 42257 - DNA, 18 bp, Artificial Sequence
  Synthetic DNA
taatatcactcagactag

SEQ ID NO: 42258 - DNA, 18 bp, Artificial Sequence
  Synthetic DNA
taatatctctcaaaatag

SEQ ID NO: 42259 - DNA, 18 bp, Artificial Sequence
  Synthetic DNA
taatattaaacaccatag

SEQ ID NO: 42260 - DNA, 18 bp, Artificial Sequence
  Synthetic DNA
taatccgtttcagtaatg

SEQ ID NO: 42261 - DNA, 18 bp, Artificial Sequence
  Synthetic DNA
taatcctccacatttaag

SEQ ID NO: 42262 - DNA, 18 bp, Artificial Sequence
  Synthetic DNA
taatccttctaataatag

SEQ ID NO: 42263 - DNA, 18 bp, Artificial Sequence
  Synthetic DNA
taatccttctttctattg

SEQ ID NO: 42264 - DNA, 18 bp, Artificial Sequence
  Synthetic DNA
taatcgatctatctattg

SEQ ID NO: 42265 - DNA, 18 bp, Artificial Sequence
  Synthetic DNA
taatgagacccatcatag

SEQ ID NO: 42266 - DNA, 18 bp, Artificial Sequence
  Synthetic DNA
taatgggatgcacgattg

SEQ ID NO: 42267 - DNA, 18 bp, Artificial Sequence
  Synthetic DNA
taatgtaacacactttag

SEQ ID NO: 42268 - DNA, 18 bp, Artificial Sequence
  Synthetic DNA
taatgtgtcttactgtag

SEQ ID NO: 42269 - DNA, 18 bp, Artificial Sequence
  Synthetic DNA
taattagtgtaactttag

SEQ ID NO: 42270 - DNA, 18 bp, Artificial Sequence
  Synthetic DNA
taattcaactctctgaag

SEQ ID NO: 42271 - DNA, 18 bp, Artificial Sequence
  Synthetic DNA
taattccacacacaattg

SEQ ID NO: 42272 - DNA, 18 bp, Artificial Sequence
  Synthetic DNA
taattcgacttaccccag

SEQ ID NO: 42273 - DNA, 18 bp, Artificial Sequence
  Synthetic DNA
taattcgcaacactatcg

SEQ ID NO: 42274 - DNA, 18 bp, Artificial Sequence
  Synthetic DNA
taattcttgtgtcttaag

SEQ ID NO: 42275 - DNA, 18 bp, Artificial Sequence
  Synthetic DNA
taattggactctatagcg

SEQ ID NO: 42276 - DNA, 18 bp, Artificial Sequence
  Synthetic DNA
taatttgattcgctcaag

SEQ ID NO: 42277 - DNA, 18 bp, Artificial Sequence
  Synthetic DNA
tacaggcactcacttaag

SEQ ID NO: 42278 - DNA, 18 bp, Artificial Sequence
  Synthetic DNA
tacatcgattcactactg

SEQ ID NO: 42279 - DNA, 18 bp, Artificial Sequence
  Synthetic DNA
tacgaacaccctgtatag

SEQ ID NO: 42280 - DNA, 18 bp, Artificial Sequence
  Synthetic DNA
tacgccgactttctaatg

SEQ ID NO: 42281 - DNA, 18 bp, Artificial Sequence
  Synthetic DNA
tactacaactcgcaatta

SEQ ID NO: 42282 - DNA, 18 bp, Artificial Sequence
  Synthetic DNA
tactaccacttaccacag

SEQ ID NO: 42283 - DNA, 18 bp, Artificial Sequence
  Synthetic DNA
tactacggctcgccattg

SEQ ID NO: 42284 - DNA, 18 bp, Artificial Sequence
  Synthetic DNA
tactatggctttctatag

SEQ ID NO: 42285 - DNA, 18 bp, Artificial Sequence
  Synthetic DNA
tactccgaccaacaaatg

SEQ ID NO: 42286 - DNA, 18 bp, Artificial Sequence
  Synthetic DNA
tacttgggctcactctag

SEQ ID NO: 42287 - DNA, 18 bp, Artificial Sequence
  Synthetic DNA
tagaacaacttaccacgg

SEQ ID NO: 42288 - DNA, 18 bp, Artificial Sequence
  Synthetic DNA
tagaacggctctctgtcg

SEQ ID NO: 42289 - DNA, 18 bp, Artificial Sequence
  Synthetic DNA
tagagggaatctctaaag

SEQ ID NO: 42290 - DNA, 18 bp, Artificial Sequence
  Synthetic DNA
tagctcggatcacaaaag

SEQ ID NO: 42291 - DNA, 18 bp, Artificial Sequence
  Synthetic DNA
tagtacggctctatatcg

SEQ ID NO: 42292 - DNA, 18 bp, Artificial Sequence
  Synthetic DNA
tagtagcactaactattg

SEQ ID NO: 42293 - DNA, 18 bp, Artificial Sequence
  Synthetic DNA
tagttcgattttcttttg

SEQ ID NO: 42294 - DNA, 18 bp, Artificial Sequence
  Synthetic DNA
tagttcgcctctctattg

SEQ ID NO: 42295 - DNA, 18 bp, Artificial Sequence
  Synthetic DNA
tagttcgtctcaccaaag

SEQ ID NO: 42296 - DNA, 18 bp, Artificial Sequence
  Synthetic DNA
tagttctaattatcatag

SEQ ID NO: 42297 - DNA, 18 bp, Artificial Sequence
  Synthetic DNA
tagttgatctgcatatag

SEQ ID NO: 42298 - DNA, 18 bp, Artificial Sequence
  Synthetic DNA
tataaatacctatgaaag

SEQ ID NO: 42299 - DNA, 18 bp, Artificial Sequence
  Synthetic DNA
tataacgaataacacttg

SEQ ID NO: 42300 - DNA, 18 bp, Artificial Sequence
  Synthetic DNA
tataactaatcacataag

SEQ ID NO: 42301 - DNA, 18 bp, Artificial Sequence
  Synthetic DNA
tataacttttcacaggag

SEQ ID NO: 42302 - DNA, 18 bp, Artificial Sequence
  Synthetic DNA
tataaggcctctctaaag

SEQ ID NO: 42303 - DNA, 18 bp, Artificial Sequence
  Synthetic DNA
tataaggtctcattaatg

SEQ ID NO: 42304 - DNA, 18 bp, Artificial Sequence
  Synthetic DNA
tatagcctgccactaaag

SEQ ID NO: 42305 - DNA, 18 bp, Artificial Sequence
  Synthetic DNA
tatattgactcactaatg

SEQ ID NO: 42306 - DNA, 18 bp, Artificial Sequence
  Synthetic DNA
tatattgatccactatgg

SEQ ID NO: 42307 - DNA, 18 bp, Artificial Sequence
  Synthetic DNA
tatcacgtctaccaacag

SEQ ID NO: 42308 - DNA, 18 bp, Artificial Sequence
  Synthetic DNA
tatcaggactctctattg

SEQ ID NO: 42309 - DNA, 18 bp, Artificial Sequence
  Synthetic DNA
tattaagacacattttag

SEQ ID NO: 42310 - DNA, 18 bp, Artificial Sequence
  Synthetic DNA
tattaccacttacttaag

SEQ ID NO: 42311 - DNA, 18 bp, Artificial Sequence
  Synthetic DNA
tattacggcaacttatag

SEQ ID NO: 42312 - DNA, 18 bp, Artificial Sequence
  Synthetic DNA
tattactattcagcaaag

SEQ ID NO: 42313 - DNA, 18 bp, Artificial Sequence
  Synthetic DNA
tattacttctcactgcag

SEQ ID NO: 42314 - DNA, 18 bp, Artificial Sequence
  Synthetic DNA
tattagaactcaatttag

SEQ ID NO: 42315 - DNA, 18 bp, Artificial Sequence
  Synthetic DNA
tattatgaatctccatag

SEQ ID NO: 42316 - DNA, 18 bp, Artificial Sequence
  Synthetic DNA
tattatgtttcattaatg

SEQ ID NO: 42317 - DNA, 18 bp, Artificial Sequence
  Synthetic DNA
tatttagactcaataaag

SEQ ID NO: 42318 - DNA, 18 bp, Artificial Sequence
  Synthetic DNA
tatttcgactaacattag

SEQ ID NO: 42319 - DNA, 18 bp, Artificial Sequence
  Synthetic DNA
tatttcgactcacatcag

SEQ ID NO: 42320 - DNA, 18 bp, Artificial Sequence
  Synthetic DNA
tattttgactcactacgg

SEQ ID NO: 42321 - DNA, 18 bp, Artificial Sequence
  Synthetic DNA
tatttttacacactatag

SEQ ID NO: 42322 - DNA, 18 bp, Artificial Sequence
  Synthetic DNA
tcacacggctcgctattg

SEQ ID NO: 42323 - DNA, 18 bp, Artificial Sequence
  Synthetic DNA
tcagagaacacactaagg

SEQ ID NO: 42324 - DNA, 18 bp, Artificial Sequence
  Synthetic DNA
tcagatgacttactttag

SEQ ID NO: 42325 - DNA, 18 bp, Artificial Sequence
  Synthetic DNA
tcatacgactcataaccg

SEQ ID NO: 42326 - DNA, 18 bp, Artificial Sequence
  Synthetic DNA
tcatacgcgttccaaatg

SEQ ID NO: 42327 - DNA, 18 bp, Artificial Sequence
  Synthetic DNA
tcatacgtcccacaatgg

SEQ ID NO: 42328 - DNA, 18 bp, Artificial Sequence
  Synthetic DNA
tcatgcgtctctcaattg

SEQ ID NO: 42329 - DNA, 18 bp, Artificial Sequence
  Synthetic DNA
tcatgggatactttttag

SEQ ID NO: 42330 - DNA, 18 bp, Artificial Sequence
  Synthetic DNA
tcattagacagattatcg

SEQ ID NO: 42331 - DNA, 18 bp, Artificial Sequence
  Synthetic DNA
tcattctactaaatatag

SEQ ID NO: 42332 - DNA, 18 bp, Artificial Sequence
  Synthetic DNA
tctgaagactagctctag

SEQ ID NO: 42333 - DNA, 18 bp, Artificial Sequence
  Synthetic DNA
tctgaatcctcactatag

SEQ ID NO: 42334 - DNA, 18 bp, Artificial Sequence
  Synthetic DNA
tcttacttcccactaaag

SEQ ID NO: 42335 - DNA, 18 bp, Artificial Sequence
  Synthetic DNA
tgaaacgtaacgttatcg

SEQ ID NO: 42336 - DNA, 18 bp, Artificial Sequence
  Synthetic DNA
tgaccagacacttaatag

SEQ ID NO: 42337 - DNA, 18 bp, Artificial Sequence
  Synthetic DNA
tgatacgtataactgcag

SEQ ID NO: 42338 - DNA, 18 bp, Artificial Sequence
  Synthetic DNA
tgatataactcactgttg

SEQ ID NO: 42339 - DNA, 18 bp, Artificial Sequence
  Synthetic DNA
tgatatgattgaatttag

SEQ ID NO: 42340 - DNA, 18 bp, Artificial Sequence
  Synthetic DNA
tgcaaaaacgcataacag

SEQ ID NO: 42341 - DNA, 18 bp, Artificial Sequence
  Synthetic DNA
tgctactagtcacaatag

SEQ ID NO: 42342 - DNA, 18 bp, Artificial Sequence
  Synthetic DNA
tggttcgactctatcagg

SEQ ID NO: 42343 - DNA, 18 bp, Artificial Sequence
  Synthetic DNA
tgttacgcctagctatag

SEQ ID NO: 42344 - DNA, 18 bp, Artificial Sequence
  Synthetic DNA
tgttacgtatcaccttag

SEQ ID NO: 42345 - DNA, 18 bp, Artificial Sequence
  Synthetic DNA
tgttacgtatcactacag

SEQ ID NO: 42346 - DNA, 18 bp, Artificial Sequence
  Synthetic DNA
ttaaacaactcgctatcg

SEQ ID NO: 42347 - DNA, 18 bp, Artificial Sequence
  Synthetic DNA
ttaaataactcattattg

SEQ ID NO: 42348 - DNA, 18 bp, Artificial Sequence
  Synthetic DNA
ttaaatctctaacactag

SEQ ID NO: 42349 - DNA, 18 bp, Artificial Sequence
  Synthetic DNA
ttacacgtcattgtatag

SEQ ID NO: 42350 - DNA, 18 bp, Artificial Sequence
  Synthetic DNA
ttacccgacttgctctgg

SEQ ID NO: 42351 - DNA, 18 bp, Artificial Sequence
  Synthetic DNA
ttagacaactcgaaatag

SEQ ID NO: 42352 - DNA, 18 bp, Artificial Sequence
  Synthetic DNA
ttagacgtcaaacaatag

SEQ ID NO: 42353 - DNA, 18 bp, Artificial Sequence
  Synthetic DNA
ttataagactccacttag

SEQ ID NO: 42354 - DNA, 18 bp, Artificial Sequence
  Synthetic DNA
ttatacgacatgctaaag

SEQ ID NO: 42355 - DNA, 18 bp, Artificial Sequence
  Synthetic DNA
ttatacgtcccagtatcg

SEQ ID NO: 42356 - DNA, 18 bp, Artificial Sequence
  Synthetic DNA
ttatactattcacataag

SEQ ID NO: 42357 - DNA, 18 bp, Artificial Sequence
  Synthetic DNA
ttatactccccacaatag

SEQ ID NO: 42358 - DNA, 18 bp, Artificial Sequence
  Synthetic DNA
ttataggattcatttttg

SEQ ID NO: 42359 - DNA, 18 bp, Artificial Sequence
  Synthetic DNA
ttatccggctaattctag

SEQ ID NO: 42360 - DNA, 18 bp, Artificial Sequence
  Synthetic DNA
ttatgcgcctcactctcg

SEQ ID NO: 42361 - DNA, 18 bp, Artificial Sequence
  Synthetic DNA
ttattcgtctcttgaaag

SEQ ID NO: 42362 - DNA, 18 bp, Artificial Sequence
  Synthetic DNA
ttattggactcgctattg

SEQ ID NO: 42363 - DNA, 18 bp, Artificial Sequence
  Synthetic DNA
ttattgtgctcattatag

SEQ ID NO: 42364 - DNA, 18 bp, Artificial Sequence
  Synthetic DNA
ttcaacgacccggtttag

SEQ ID NO: 42365 - DNA, 18 bp, Artificial Sequence
  Synthetic DNA
ttcgacgacacacgatag

SEQ ID NO: 42366 - DNA, 18 bp, Artificial Sequence
  Synthetic DNA
ttctacgaatccctgtag

SEQ ID NO: 42367 - DNA, 18 bp, Artificial Sequence
  Synthetic DNA
ttctacgcctctcaatag

SEQ ID NO: 42368 - DNA, 18 bp, Artificial Sequence
  Synthetic DNA
ttgttctactaactatag

SEQ ID NO: 42369 - DNA, 18 bp, Artificial Sequence
  Synthetic DNA
tttaacgagtcacaaaag

SEQ ID NO: 42370 - DNA, 18 bp, Artificial Sequence
  Synthetic DNA
tttagggactcactatag

SEQ ID NO: 42371 - DNA, 18 bp, Artificial Sequence
  Synthetic DNA
ttttacgcccctccttag

SEQ ID NO: 42372 - DNA, 18 bp, Artificial Sequence
  Synthetic DNA
ttttacgtcaacctatag

SEQ ID NO: 42373 - DNA, 18 bp, Artificial Sequence
  Synthetic DNA
ttttacgtctcagtaaag

SEQ ID NO: 42374 - DNA, 18 bp, Artificial Sequence
  Synthetic DNA
ttttacgtctcagtattg

SEQ ID NO: 42375 - DNA, 18 bp, Artificial Sequence
  Synthetic DNA
ttttacgtttcactttag

SEQ ID NO: 42376 - DNA, 18 bp, Artificial Sequence
  Synthetic DNA
ttttactactcccgaaag

SEQ ID NO: 42377 - DNA, 18 bp, Artificial Sequence
  Synthetic DNA
ttttactatacagtatag

SEQ ID NO: 42378 - DNA, 18 bp, Artificial Sequence
  Synthetic DNA
ttttaggtctcactatcg

SEQ ID NO: 42379 - DNA, 18 bp, Artificial Sequence
  Synthetic DNA
ttttatgactctctttcg

SEQ ID NO: 42380 - DNA, 18 bp, Artificial Sequence
  Synthetic DNA
ttttatggctcacttaag

SEQ ID NO: 42381 - DNA, 18 bp, Artificial Sequence
  Synthetic DNA
tttttagacacaatattg

SEQ ID NO: 42382 - DNA, 18 bp, Artificial Sequence
  Synthetic DNA
tttttcgacacactagag

SEQ ID NO: 42383 - DNA, 18 bp, Artificial Sequence
  Synthetic DNA
aaatactaatcactttcg

SEQ ID NO: 42384 - DNA, 18 bp, Artificial Sequence
  Synthetic DNA
aaatgcatctcacaatag

SEQ ID NO: 42385 - DNA, 18 bp, Artificial Sequence
  Synthetic DNA
aactacgacttaaaatag

SEQ ID NO: 42386 - DNA, 18 bp, Artificial Sequence
  Synthetic DNA
actttcgactcactgtag

SEQ ID NO: 42387 - DNA, 18 bp, Artificial Sequence
  Synthetic DNA
agatatgtctcattttag

SEQ ID NO: 42388 - DNA, 18 bp, Artificial Sequence
  Synthetic DNA
agttacgtctcaatatag

SEQ ID NO: 42389 - DNA, 18 bp, Artificial Sequence
  Synthetic DNA
caattcaattcactctag

SEQ ID NO: 42390 - DNA, 18 bp, Artificial Sequence
  Synthetic DNA
taaaacaactcaccaatg

SEQ ID NO: 42391 - DNA, 18 bp, Artificial Sequence
  Synthetic DNA
taacacgtctcattaagg

SEQ ID NO: 42392 - DNA, 18 bp, Artificial Sequence
  Synthetic DNA
taacaggtcacaccatgg

SEQ ID NO: 42393 - DNA, 18 bp, Artificial Sequence
  Synthetic DNA
taatacgaatctattaag

SEQ ID NO: 42394 - DNA, 18 bp, Artificial Sequence
  Synthetic DNA
taatatagctcacactag

SEQ ID NO: 42395 - DNA, 18 bp, Artificial Sequence
  Synthetic DNA
taatatgccttactttcg

SEQ ID NO: 42396 - DNA, 18 bp, Artificial Sequence
  Synthetic DNA
taattagattctcattag

SEQ ID NO: 42397 - DNA, 18 bp, Artificial Sequence
  Synthetic DNA
tagttcgagtctgtctag

SEQ ID NO: 42398 - DNA, 18 bp, Artificial Sequence
  Synthetic DNA
tataacgaaaaactatag

SEQ ID NO: 42399 - DNA, 18 bp, Artificial Sequence
  Synthetic DNA
tataactactcacttaag

SEQ ID NO: 42400 - DNA, 18 bp, Artificial Sequence
  Synthetic DNA
tatatcgtctcatttaag

SEQ ID NO: 42401 - DNA, 18 bp, Artificial Sequence
  Synthetic DNA
tattacgagtcagaattg

SEQ ID NO: 42402 - DNA, 18 bp, Artificial Sequence
  Synthetic DNA
tattactactctatttag

SEQ ID NO: 42403 - DNA, 18 bp, Artificial Sequence
  Synthetic DNA
tcataagattcacaattg

SEQ ID NO: 42404 - DNA, 18 bp, Artificial Sequence
  Synthetic DNA
tcatatgagtcgttttag

SEQ ID NO: 42405 - DNA, 18 bp, Artificial Sequence
  Synthetic DNA
tgataggagtgaatacag

SEQ ID NO: 42406 - DNA, 18 bp, Artificial Sequence
  Synthetic DNA
tgccacagctcacaaaag

SEQ ID NO: 42407 - DNA, 18 bp, Artificial Sequence
  Synthetic DNA
ttacaaaactcagattcg

SEQ ID NO: 42408 - DNA, 18 bp, Artificial Sequence
  Synthetic DNA
ttatacaactctctagcg

SEQ ID NO: 42409 - DNA, 18 bp, Artificial Sequence
  Synthetic DNA
ttatacgtctcagattag

SEQ ID NO: 42410 - DNA, 18 bp, Artificial Sequence
  Synthetic DNA
ttatataactcactaatg

SEQ ID NO: 42411 - DNA, 18 bp, Artificial Sequence
  Synthetic DNA
ttatatgtctcacaattg

SEQ ID NO: 42412 - DNA, 18 bp, Artificial Sequence
  Synthetic DNA
ttatgcgtttcacgatag

SEQ ID NO: 42413 - DNA, 18 bp, Artificial Sequence
  Synthetic DNA
ttgatcgacacgctattg

SEQ ID NO: 42414 - DNA, 18 bp, Artificial Sequence
  Synthetic DNA
ttgtacctatgactatag

SEQ ID NO: 42415 - DNA, 18 bp, Artificial Sequence
  Synthetic DNA
tttcatgtcactctattg

SEQ ID NO: 42416 - DNA, 18 bp, Artificial Sequence
  Synthetic DNA
tttctcgacacacgaaag

SEQ ID NO: 42417 - DNA, 18 bp, Artificial Sequence
  Synthetic DNA
ttaaaagactcactaatg

SEQ ID NO: 42418 - DNA, 18 bp, Artificial Sequence
  Synthetic DNA
aaacaccaattactatag

SEQ ID NO: 42419 - DNA, 18 bp, Artificial Sequence
  Synthetic DNA
aaatacgtcttagtttag

SEQ ID NO: 42420 - DNA, 18 bp, Artificial Sequence
  Synthetic DNA
atttaggactctctatag

SEQ ID NO: 42421 - DNA, 18 bp, Artificial Sequence
  Synthetic DNA
taaaactacacagtattg

SEQ ID NO: 42422 - DNA, 18 bp, Artificial Sequence
  Synthetic DNA
taagtcgaattagtttag

SEQ ID NO: 42423 - DNA, 18 bp, Artificial Sequence
  Synthetic DNA
tattacgtcacgcaatag

SEQ ID NO: 42424 - DNA, 18 bp, Artificial Sequence
  Synthetic DNA
ttaaacggatcactatcg

SEQ ID NO: 42425 - DNA, 18 bp, Artificial Sequence
  Synthetic DNA
tatttcgactcgcttaag

SEQ ID NO: 42426 - DNA, 18 bp, Artificial Sequence
  Synthetic DNA
taattgtgctcactaaag

SEQ ID NO: 42427 - DNA, 18 bp, Artificial Sequence
  Synthetic DNA
tgatgtgtctcacaatag

SEQ ID NO: 42428 - DNA, 18 bp, Artificial Sequence
  Synthetic DNA
ttattcgcctcacttaag

SEQ ID NO: 42429 - DNA, 18 bp, Artificial Sequence
  Synthetic DNA
agatatgacacactaaag

SEQ ID NO: 42430 - DNA, 18 bp, Artificial Sequence
  Synthetic DNA
tagaccgacttactaaag

SEQ ID NO: 42431 - DNA, 18 bp, Artificial Sequence
  Synthetic DNA
tagtacgtctccattttg

SEQ ID NO: 42432 - DNA, 18 bp, Artificial Sequence
  Synthetic DNA
gtttttgactaattaatg

SEQ ID NO: 42433 - DNA, 18 bp, Artificial Sequence
  Synthetic DNA
taatccggctcaccaatg

SEQ ID NO: 42434 - DNA, 18 bp, Artificial Sequence
  Synthetic DNA
tactacaaccgaccattg

SEQ ID NO: 42435 - DNA, 18 bp, Artificial Sequence
  Synthetic DNA
ttacgcgtctcactattg

SEQ ID NO: 42436 - DNA, 18 bp, Artificial Sequence
  Synthetic DNA
aaaatcggcacattttag

SEQ ID NO: 42437 - DNA, 18 bp, Artificial Sequence
  Synthetic DNA
aaatacgacacgccaaag

SEQ ID NO: 42438 - DNA, 18 bp, Artificial Sequence
  Synthetic DNA
aaatacgattagctaaag

SEQ ID NO: 42439 - DNA, 18 bp, Artificial Sequence
  Synthetic DNA
aaattcaactatatgtag

SEQ ID NO: 42440 - DNA, 18 bp, Artificial Sequence
  Synthetic DNA
aattactgctcaccaaag

SEQ ID NO: 42441 - DNA, 18 bp, Artificial Sequence
  Synthetic DNA
acattcgtctttctatag

SEQ ID NO: 42442 - DNA, 18 bp, Artificial Sequence
  Synthetic DNA
atttgcgtctcactatag

SEQ ID NO: 42443 - DNA, 18 bp, Artificial Sequence
  Synthetic DNA
caaaacgtgccataatgg

SEQ ID NO: 42444 - DNA, 18 bp, Artificial Sequence
  Synthetic DNA
caaaactattttgagtcg

SEQ ID NO: 42445 - DNA, 18 bp, Artificial Sequence
  Synthetic DNA
caattggacacgctatag

SEQ ID NO: 42446 - DNA, 18 bp, Artificial Sequence
  Synthetic DNA
ccactcgactccctatag

SEQ ID NO: 42447 - DNA, 18 bp, Artificial Sequence
  Synthetic DNA
ctatacaactcagtattg

SEQ ID NO: 42448 - DNA, 18 bp, Artificial Sequence
  Synthetic DNA
taaaacaagttcctatcg

SEQ ID NO: 42449 - DNA, 18 bp, Artificial Sequence
  Synthetic DNA
taaaacgtatcatttttg

SEQ ID NO: 42450 - DNA, 18 bp, Artificial Sequence
  Synthetic DNA
taactcaattcattatag

SEQ ID NO: 42451 - DNA, 18 bp, Artificial Sequence
  Synthetic DNA
taatatgttacactgtag

SEQ ID NO: 42452 - DNA, 18 bp, Artificial Sequence
  Synthetic DNA
taattcggatcttcttgg

SEQ ID NO: 42453 - DNA, 18 bp, Artificial Sequence
  Synthetic DNA
tactgcgtcagactatag

SEQ ID NO: 42454 - DNA, 18 bp, Artificial Sequence
  Synthetic DNA
tagtttgactcattaaag

SEQ ID NO: 42455 - DNA, 18 bp, Artificial Sequence
  Synthetic DNA
tatacctgcacacaaatg

SEQ ID NO: 42456 - DNA, 18 bp, Artificial Sequence
  Synthetic DNA
tatgacgaatcaccaacg

SEQ ID NO: 42457 - DNA, 18 bp, Artificial Sequence
  Synthetic DNA
tcatacgaccaacagtag

SEQ ID NO: 42458 - DNA, 18 bp, Artificial Sequence
  Synthetic DNA
tccacctactcaccatag

SEQ ID NO: 42459 - DNA, 18 bp, Artificial Sequence
  Synthetic DNA
tcttactactcactccag

SEQ ID NO: 42460 - DNA, 18 bp, Artificial Sequence
  Synthetic DNA
tgttactatacacaatag

SEQ ID NO: 42461 - DNA, 18 bp, Artificial Sequence
  Synthetic DNA
ttacacgactcatggcag

SEQ ID NO: 42462 - DNA, 18 bp, Artificial Sequence
  Synthetic DNA
ttagacgaatctccatag

SEQ ID NO: 42463 - DNA, 18 bp, Artificial Sequence
  Synthetic DNA
ttatgcatttcattatag

SEQ ID NO: 42464 - DNA, 18 bp, Artificial Sequence
  Synthetic DNA
ttattcgacagactaaag

SEQ ID NO: 42465 - DNA, 18 bp, Artificial Sequence
  Synthetic DNA
ttgcacgactctctacag

SEQ ID NO: 42466 - DNA, 18 bp, Artificial Sequence
  Synthetic DNA
aaaaacctccctttatag

SEQ ID NO: 42467 - DNA, 18 bp, Artificial Sequence
  Synthetic DNA
aaaaacgagtcacttttg

SEQ ID NO: 42468 - DNA, 18 bp, Artificial Sequence
  Synthetic DNA
aaaaacttctcccaattg

SEQ ID NO: 42469 - DNA, 18 bp, Artificial Sequence
  Synthetic DNA
aaaaattaatcactatag

SEQ ID NO: 42470 - DNA, 18 bp, Artificial Sequence
  Synthetic DNA
aaacacgactccgtttag

SEQ ID NO: 42471 - DNA, 18 bp, Artificial Sequence
  Synthetic DNA
aaataaaaatctctttag

SEQ ID NO: 42472 - DNA, 18 bp, Artificial Sequence
  Synthetic DNA
aaataagagtcgcaatag

SEQ ID NO: 42473 - DNA, 18 bp, Artificial Sequence
  Synthetic DNA
aaataagtctcactgttg

SEQ ID NO: 42474 - DNA, 18 bp, Artificial Sequence
  Synthetic DNA
aaatacgacactctcaag

SEQ ID NO: 42475 - DNA, 18 bp, Artificial Sequence
  Synthetic DNA
aaatacgacagccgaatg

SEQ ID NO: 42476 - DNA, 18 bp, Artificial Sequence
  Synthetic DNA
aaatacgtatttctctag

SEQ ID NO: 42477 - DNA, 18 bp, Artificial Sequence
  Synthetic DNA
aaatacgtctctcaattg

SEQ ID NO: 42478 - DNA, 18 bp, Artificial Sequence
  Synthetic DNA
aaataggtctcattgaag

SEQ ID NO: 42479 - DNA, 18 bp, Artificial Sequence
  Synthetic DNA
aaatatgactccccctgg

SEQ ID NO: 42480 - DNA, 18 bp, Artificial Sequence
  Synthetic DNA
aaatccgagtcaataaag

SEQ ID NO: 42481 - DNA, 18 bp, Artificial Sequence
  Synthetic DNA
aaatgcgactcaataatg

SEQ ID NO: 42482 - DNA, 18 bp, Artificial Sequence
  Synthetic DNA
aaatgcgactctcttcag

SEQ ID NO: 42483 - DNA, 18 bp, Artificial Sequence
  Synthetic DNA
aaattagactctctacag

SEQ ID NO: 42484 - DNA, 18 bp, Artificial Sequence
  Synthetic DNA
aaattagatacaatattg

SEQ ID NO: 42485 - DNA, 18 bp, Artificial Sequence
  Synthetic DNA
aaattcgagtctatgtag

SEQ ID NO: 42486 - DNA, 18 bp, Artificial Sequence
  Synthetic DNA
aaatttgactccgtatag

SEQ ID NO: 42487 - DNA, 18 bp, Artificial Sequence
  Synthetic DNA
aacttagtctcaatatag

SEQ ID NO: 42488 - DNA, 18 bp, Artificial Sequence
  Synthetic DNA
aagaacttctcggaattg

SEQ ID NO: 42489 - DNA, 18 bp, Artificial Sequence
  Synthetic DNA
aagtacgactctcaaaag

SEQ ID NO: 42490 - DNA, 18 bp, Artificial Sequence
  Synthetic DNA
aagttcgacacatatacg

SEQ ID NO: 42491 - DNA, 18 bp, Artificial Sequence
  Synthetic DNA
aatagcgactcacaaaag

SEQ ID NO: 42492 - DNA, 18 bp, Artificial Sequence
  Synthetic DNA
aattacgactctcgattg

SEQ ID NO: 42493 - DNA, 18 bp, Artificial Sequence
  Synthetic DNA
aattacgacttaaaactg

SEQ ID NO: 42494 - DNA, 18 bp, Artificial Sequence
  Synthetic DNA
aattacgagtccatttag

SEQ ID NO: 42495 - DNA, 18 bp, Artificial Sequence
  Synthetic DNA
aattacggatcacaatag

SEQ ID NO: 42496 - DNA, 18 bp, Artificial Sequence
  Synthetic DNA
aattacgtctaacaatag

SEQ ID NO: 42497 - DNA, 18 bp, Artificial Sequence
  Synthetic DNA
aattacgtctcacaatcg

SEQ ID NO: 42498 - DNA, 18 bp, Artificial Sequence
  Synthetic DNA
acagaggaaatacaatag

SEQ ID NO: 42499 - DNA, 18 bp, Artificial Sequence
  Synthetic DNA
acatacgacactctttcg

SEQ ID NO: 42500 - DNA, 18 bp, Artificial Sequence
  Synthetic DNA
acatatgagtctctttag

SEQ ID NO: 42501 - DNA, 18 bp, Artificial Sequence
  Synthetic DNA
acatcctattcactatag

SEQ ID NO: 42502 - DNA, 18 bp, Artificial Sequence
  Synthetic DNA
acattcgtctcacaatag

SEQ ID NO: 42503 - DNA, 18 bp, Artificial Sequence
  Synthetic DNA
acctacgactaactttcg

SEQ ID NO: 42504 - DNA, 18 bp, Artificial Sequence
  Synthetic DNA
acttacgactttataaag

SEQ ID NO: 42505 - DNA, 18 bp, Artificial Sequence
  Synthetic DNA
actttcgtcttactattg

SEQ ID NO: 42506 - DNA, 18 bp, Artificial Sequence
  Synthetic DNA
agatacgcgacaccattg

SEQ ID NO: 42507 - DNA, 18 bp, Artificial Sequence
  Synthetic DNA
agataggactcattattg

SEQ ID NO: 42508 - DNA, 18 bp, Artificial Sequence
  Synthetic DNA
agattcgcttcacagtag

SEQ ID NO: 42509 - DNA, 18 bp, Artificial Sequence
  Synthetic DNA
agcctcgactcactatag

SEQ ID NO: 42510 - DNA, 18 bp, Artificial Sequence
  Synthetic DNA
atagacatctcactatag

SEQ ID NO: 42511 - DNA, 18 bp, Artificial Sequence
  Synthetic DNA
atatacaactctcttttg

SEQ ID NO: 42512 - DNA, 18 bp, Artificial Sequence
  Synthetic DNA
atatacaattgcctatag

SEQ ID NO: 42513 - DNA, 18 bp, Artificial Sequence
  Synthetic DNA
atatacgagtcacttcag

SEQ ID NO: 42514 - DNA, 18 bp, Artificial Sequence
  Synthetic DNA
atatactactctattttg

SEQ ID NO: 42515 - DNA, 18 bp, Artificial Sequence
  Synthetic DNA
atatactactctcagccg

SEQ ID NO: 42516 - DNA, 18 bp, Artificial Sequence
  Synthetic DNA
atatattcttcagtaaag

SEQ ID NO: 42517 - DNA, 18 bp, Artificial Sequence
  Synthetic DNA
atctacctttcagtttag

SEQ ID NO: 42518 - DNA, 18 bp, Artificial Sequence
  Synthetic DNA
atgaacgacttacaattg

SEQ ID NO: 42519 - DNA, 18 bp, Artificial Sequence
  Synthetic DNA
atttacgactcacttttg

SEQ ID NO: 42520 - DNA, 18 bp, Artificial Sequence
  Synthetic DNA
atttacgactcggtatcg

SEQ ID NO: 42521 - DNA, 18 bp, Artificial Sequence
  Synthetic DNA
atttactgcttactatag

SEQ ID NO: 42522 - DNA, 18 bp, Artificial Sequence
  Synthetic DNA
caactcaaaacactatag

SEQ ID NO: 42523 - DNA, 18 bp, Artificial Sequence
  Synthetic DNA
caactcgaatcccagttg

SEQ ID NO: 42524 - DNA, 18 bp, Artificial Sequence
  Synthetic DNA
caagatcacttactatag

SEQ ID NO: 42525 - DNA, 18 bp, Artificial Sequence
  Synthetic DNA
caatacaaccatccatag

SEQ ID NO: 42526 - DNA, 18 bp, Artificial Sequence
  Synthetic DNA
caatacacctcaaaatgg

SEQ ID NO: 42527 - DNA, 18 bp, Artificial Sequence
  Synthetic DNA
caatacagctcataatag

SEQ ID NO: 42528 - DNA, 18 bp, Artificial Sequence
  Synthetic DNA
caatacgactcttgatcg

SEQ ID NO: 42529 - DNA, 18 bp, Artificial Sequence
  Synthetic DNA
caatacgattcacatttg

SEQ ID NO: 42530 - DNA, 18 bp, Artificial Sequence
  Synthetic DNA
caatacgcctcaccgaag

SEQ ID NO: 42531 - DNA, 18 bp, Artificial Sequence
  Synthetic DNA
caatacgtataactacag

SEQ ID NO: 42532 - DNA, 18 bp, Artificial Sequence
  Synthetic DNA
caatacgtgtagcaattg

SEQ ID NO: 42533 - DNA, 18 bp, Artificial Sequence
  Synthetic DNA
caatccgtcatacatctg

SEQ ID NO: 42534 - DNA, 18 bp, Artificial Sequence
  Synthetic DNA
caatcctagtctctatag

SEQ ID NO: 42535 - DNA, 18 bp, Artificial Sequence
  Synthetic DNA
caattcaactgacttaag

SEQ ID NO: 42536 - DNA, 18 bp, Artificial Sequence
  Synthetic DNA
cacaccgagtcactattg

SEQ ID NO: 42537 - DNA, 18 bp, Artificial Sequence
  Synthetic DNA
cacctcgactctctgtag

SEQ ID NO: 42538 - DNA, 18 bp, Artificial Sequence
  Synthetic DNA
cactaccactctttttag

SEQ ID NO: 42539 - DNA, 18 bp, Artificial Sequence
  Synthetic DNA
cactacggctctctacag

SEQ ID NO: 42540 - DNA, 18 bp, Artificial Sequence
  Synthetic DNA
cactacttctcactttag

SEQ ID NO: 42541 - DNA, 18 bp, Artificial Sequence
  Synthetic DNA
cagaactacacactagag

SEQ ID NO: 42542 - DNA, 18 bp, Artificial Sequence
  Synthetic DNA
cattacaactctctgtag

SEQ ID NO: 42543 - DNA, 18 bp, Artificial Sequence
  Synthetic DNA
cattattatttacttttg

SEQ ID NO: 42544 - DNA, 18 bp, Artificial Sequence
  Synthetic DNA
catttcgtctctatatag

SEQ ID NO: 42545 - DNA, 18 bp, Artificial Sequence
  Synthetic DNA
ccatgcgactcacactgg

SEQ ID NO: 42546 - DNA, 18 bp, Artificial Sequence
  Synthetic DNA
ccgtaccactcacaatgg

SEQ ID NO: 42547 - DNA, 18 bp, Artificial Sequence
  Synthetic DNA
cgacacctcactcaatag

SEQ ID NO: 42548 - DNA, 18 bp, Artificial Sequence
  Synthetic DNA
cgatactaaacactttag

SEQ ID NO: 42549 - DNA, 18 bp, Artificial Sequence
  Synthetic DNA
cgatactagacactttcg

SEQ ID NO: 42550 - DNA, 18 bp, Artificial Sequence
  Synthetic DNA
cgttacgactcagttaag

SEQ ID NO: 42551 - DNA, 18 bp, Artificial Sequence
  Synthetic DNA
ctacacgacgcactatgg

SEQ ID NO: 42552 - DNA, 18 bp, Artificial Sequence
  Synthetic DNA
ctatacatctcaccatag

SEQ ID NO: 42553 - DNA, 18 bp, Artificial Sequence
  Synthetic DNA
ctatacgcctcgctaacg

SEQ ID NO: 42554 - DNA, 18 bp, Artificial Sequence
  Synthetic DNA
ctatactactcaattcag

SEQ ID NO: 42555 - DNA, 18 bp, Artificial Sequence
  Synthetic DNA
gaatatgatacactttag

SEQ ID NO: 42556 - DNA, 18 bp, Artificial Sequence
  Synthetic DNA
gagtactcatctctatcg

SEQ ID NO: 42557 - DNA, 18 bp, Artificial Sequence
  Synthetic DNA
gcatacgactctattaag

SEQ ID NO: 42558 - DNA, 18 bp, Artificial Sequence
  Synthetic DNA
ggttacgaatcaatatag

SEQ ID NO: 42559 - DNA, 18 bp, Artificial Sequence
  Synthetic DNA
gtatacgactgactgttg

SEQ ID NO: 42560 - DNA, 18 bp, Artificial Sequence
  Synthetic DNA
taaaaaaactatctatag

SEQ ID NO: 42561 - DNA, 18 bp, Artificial Sequence
  Synthetic DNA
taaaacacctttctcatg

SEQ ID NO: 42562 - DNA, 18 bp, Artificial Sequence
  Synthetic DNA
taaaaccacaagcatttg

SEQ ID NO: 42563 - DNA, 18 bp, Artificial Sequence
  Synthetic DNA
taaaaccagttactacag

SEQ ID NO: 42564 - DNA, 18 bp, Artificial Sequence
  Synthetic DNA
taaaaccatcccctttag

SEQ ID NO: 42565 - DNA, 18 bp, Artificial Sequence
  Synthetic DNA
taaaacccctaactagag

SEQ ID NO: 42566 - DNA, 18 bp, Artificial Sequence
  Synthetic DNA
taaaacctatcactactg

SEQ ID NO: 42567 - DNA, 18 bp, Artificial Sequence
  Synthetic DNA
taaaacttatcaatatag

SEQ ID NO: 42568 - DNA, 18 bp, Artificial Sequence
  Synthetic DNA
taaaacttctaaatatag

SEQ ID NO: 42569 - DNA, 18 bp, Artificial Sequence
  Synthetic DNA
taaaatgcctcaccaaag

SEQ ID NO: 42570 - DNA, 18 bp, Artificial Sequence
  Synthetic DNA
taaaccgacgctctatgg

SEQ ID NO: 42571 - DNA, 18 bp, Artificial Sequence
  Synthetic DNA
taaatggagtctctatag

SEQ ID NO: 42572 - DNA, 18 bp, Artificial Sequence
  Synthetic DNA
taaattgactcccgatag

SEQ ID NO: 42573 - DNA, 18 bp, Artificial Sequence
  Synthetic DNA
taacaccactctcattag

SEQ ID NO: 42574 - DNA, 18 bp, Artificial Sequence
  Synthetic DNA
taacacccttcactattg

SEQ ID NO: 42575 - DNA, 18 bp, Artificial Sequence
  Synthetic DNA
taacacgtatcattactg

SEQ ID NO: 42576 - DNA, 18 bp, Artificial Sequence
  Synthetic DNA
taacccgactcgttattg

SEQ ID NO: 42577 - DNA, 18 bp, Artificial Sequence
  Synthetic DNA
taagaatactccctgtcg

SEQ ID NO: 42578 - DNA, 18 bp, Artificial Sequence
  Synthetic DNA
taagtccagtctctttag

SEQ ID NO: 42579 - DNA, 18 bp, Artificial Sequence
  Synthetic DNA
taataaaacttgcaatag

SEQ ID NO: 42580 - DNA, 18 bp, Artificial Sequence
  Synthetic DNA
taataaatctcaaaatcg

SEQ ID NO: 42581 - DNA, 18 bp, Artificial Sequence
  Synthetic DNA
taataagacacgcaaatg

SEQ ID NO: 42582 - DNA, 18 bp, Artificial Sequence
  Synthetic DNA
taataagtctagcaatag

SEQ ID NO: 42583 - DNA, 18 bp, Artificial Sequence
  Synthetic DNA
taataagtttcaataaag

SEQ ID NO: 42584 - DNA, 18 bp, Artificial Sequence
  Synthetic DNA
taatacaagttacattag

SEQ ID NO: 42585 - DNA, 18 bp, Artificial Sequence
  Synthetic DNA
taataccagcgacattag

SEQ ID NO: 42586 - DNA, 18 bp, Artificial Sequence
  Synthetic DNA
taatacgacattgattcg

SEQ ID NO: 42587 - DNA, 18 bp, Artificial Sequence
  Synthetic DNA
taatacgactaggactag

SEQ ID NO: 42588 - DNA, 18 bp, Artificial Sequence
  Synthetic DNA
taatacgatagacaaaag

SEQ ID NO: 42589 - DNA, 18 bp, Artificial Sequence
  Synthetic DNA
taatacggttcacgaatg

SEQ ID NO: 42590 - DNA, 18 bp, Artificial Sequence
  Synthetic DNA
taatacgtccatacagag

SEQ ID NO: 42591 - DNA, 18 bp, Artificial Sequence
  Synthetic DNA
taatacgtcctattttag

SEQ ID NO: 42592 - DNA, 18 bp, Artificial Sequence
  Synthetic DNA
taatactacacatagttg

SEQ ID NO: 42593 - DNA, 18 bp, Artificial Sequence
  Synthetic DNA
taatactactctcacgag

SEQ ID NO: 42594 - DNA, 18 bp, Artificial Sequence
  Synthetic DNA
taatactattcccaaaag

SEQ ID NO: 42595 - DNA, 18 bp, Artificial Sequence
  Synthetic DNA
taatactcatcacaatcg

SEQ ID NO: 42596 - DNA, 18 bp, Artificial Sequence
  Synthetic DNA
taatactgattgctagcg

SEQ ID NO: 42597 - DNA, 18 bp, Artificial Sequence
  Synthetic DNA
taatacttctaacttttg

SEQ ID NO: 42598 - DNA, 18 bp, Artificial Sequence
  Synthetic DNA
taatacttctgccattag

SEQ ID NO: 42599 - DNA, 18 bp, Artificial Sequence
  Synthetic DNA
taatataacaaacaatgg

SEQ ID NO: 42600 - DNA, 18 bp, Artificial Sequence
  Synthetic DNA
taatatgagtccccattg

SEQ ID NO: 42601 - DNA, 18 bp, Artificial Sequence
  Synthetic DNA
taatattactcaatttcg

SEQ ID NO: 42602 - DNA, 18 bp, Artificial Sequence
  Synthetic DNA
taatattagtcattattg

SEQ ID NO: 42603 - DNA, 18 bp, Artificial Sequence
  Synthetic DNA
taatattttttattgaag

SEQ ID NO: 42604 - DNA, 18 bp, Artificial Sequence
  Synthetic DNA
taatccaacattcaatag

SEQ ID NO: 42605 - DNA, 18 bp, Artificial Sequence
  Synthetic DNA
taatcccactgcttctag

SEQ ID NO: 42606 - DNA, 18 bp, Artificial Sequence
  Synthetic DNA
taatccgaatcccatttg

SEQ ID NO: 42607 - DNA, 18 bp, Artificial Sequence
  Synthetic DNA
taatccgcaccactatcg

SEQ ID NO: 42608 - DNA, 18 bp, Artificial Sequence
  Synthetic DNA
taatcctagccccactag

SEQ ID NO: 42609 - DNA, 18 bp, Artificial Sequence
  Synthetic DNA
taatgagacacgctaatg

SEQ ID NO: 42610 - DNA, 18 bp, Artificial Sequence
  Synthetic DNA
taatgagactcactttta

SEQ ID NO: 42611 - DNA, 18 bp, Artificial Sequence
  Synthetic DNA
taatgagtgtcacagtag

SEQ ID NO: 42612 - DNA, 18 bp, Artificial Sequence
  Synthetic DNA
taatgggatttactaaag

SEQ ID NO: 42613 - DNA, 18 bp, Artificial Sequence
  Synthetic DNA
taatgtgagtcttaatag

SEQ ID NO: 42614 - DNA, 18 bp, Artificial Sequence
  Synthetic DNA
taattatgctcattttag

SEQ ID NO: 42615 - DNA, 18 bp, Artificial Sequence
  Synthetic DNA
taattcacctatctatag

SEQ ID NO: 42616 - DNA, 18 bp, Artificial Sequence
  Synthetic DNA
taattcatcactctaaag

SEQ ID NO: 42617 - DNA, 18 bp, Artificial Sequence
  Synthetic DNA
taattcgacagcttgtag

SEQ ID NO: 42618 - DNA, 18 bp, Artificial Sequence
  Synthetic DNA
taattcgacgctcttttg

SEQ ID NO: 42619 - DNA, 18 bp, Artificial Sequence
  Synthetic DNA
taattcgactgatttaag

SEQ ID NO: 42620 - DNA, 18 bp, Artificial Sequence
  Synthetic DNA
taattcgcttaactagtg

SEQ ID NO: 42621 - DNA, 18 bp, Artificial Sequence
  Synthetic DNA
taattcgtatctatatag

SEQ ID NO: 42622 - DNA, 18 bp, Artificial Sequence
  Synthetic DNA
taattcgtcactcaatcg

SEQ ID NO: 42623 - DNA, 18 bp, Artificial Sequence
  Synthetic DNA
taattcgtcatactaaag

SEQ ID NO: 42624 - DNA, 18 bp, Artificial Sequence
  Synthetic DNA
taattcgtcgcttaatcg

SEQ ID NO: 42625 - DNA, 18 bp, Artificial Sequence
  Synthetic DNA
taattcgtgtaactctag

SEQ ID NO: 42626 - DNA, 18 bp, Artificial Sequence
  Synthetic DNA
taatttgtgttactacag

SEQ ID NO: 42627 - DNA, 18 bp, Artificial Sequence
  Synthetic DNA
tacaatggctctatatag

SEQ ID NO: 42628 - DNA, 18 bp, Artificial Sequence
  Synthetic DNA
tacatccactctttatag

SEQ ID NO: 42629 - DNA, 18 bp, Artificial Sequence
  Synthetic DNA
taccaagactaaatatag

SEQ ID NO: 42630 - DNA, 18 bp, Artificial Sequence
  Synthetic DNA
tacgacgcctcattaaag

SEQ ID NO: 42631 - DNA, 18 bp, Artificial Sequence
  Synthetic DNA
tactaatactaataatag

SEQ ID NO: 42632 - DNA, 18 bp, Artificial Sequence
  Synthetic DNA
tactacgacaaagactag

SEQ ID NO: 42633 - DNA, 18 bp, Artificial Sequence
  Synthetic DNA
tactccgatctactatag

SEQ ID NO: 42634 - DNA, 18 bp, Artificial Sequence
  Synthetic DNA
tactcctatacaatatag

SEQ ID NO: 42635 - DNA, 18 bp, Artificial Sequence
  Synthetic DNA
tacttatacttactattg

SEQ ID NO: 42636 - DNA, 18 bp, Artificial Sequence
  Synthetic DNA
tacttcgactacctttag

SEQ ID NO: 42637 - DNA, 18 bp, Artificial Sequence
  Synthetic DNA
tacttctactcataatag

SEQ ID NO: 42638 - DNA, 18 bp, Artificial Sequence
  Synthetic DNA
tagcacgacaaatcttag

SEQ ID NO: 42639 - DNA, 18 bp, Artificial Sequence
  Synthetic DNA
taggacgactctctttcg

SEQ ID NO: 42640 - DNA, 18 bp, Artificial Sequence
  Synthetic DNA
tataaaggatcactagag

SEQ ID NO: 42641 - DNA, 18 bp, Artificial Sequence
  Synthetic DNA
tataacggcgctctatag

SEQ ID NO: 42642 - DNA, 18 bp, Artificial Sequence
  Synthetic DNA
tataacggctcacacaag

SEQ ID NO: 42643 - DNA, 18 bp, Artificial Sequence
  Synthetic DNA
tataacgtcttacttttg

SEQ ID NO: 42644 - DNA, 18 bp, Artificial Sequence
  Synthetic DNA
tataatgctccacgatag

SEQ ID NO: 42645 - DNA, 18 bp, Artificial Sequence
  Synthetic DNA
tataccgtctgtttatag

SEQ ID NO: 42646 - DNA, 18 bp, Artificial Sequence
  Synthetic DNA
tatacctgctcactaaag

SEQ ID NO: 42647 - DNA, 18 bp, Artificial Sequence
  Synthetic DNA
tatcacgacggattaaag

SEQ ID NO: 42648 - DNA, 18 bp, Artificial Sequence
  Synthetic DNA
tatcccggcaaaatgtag

SEQ ID NO: 42649 - DNA, 18 bp, Artificial Sequence
  Synthetic DNA
tatctcgactcaatttag

SEQ ID NO: 42650 - DNA, 18 bp, Artificial Sequence
  Synthetic DNA
tatgacgactcaattttg

SEQ ID NO: 42651 - DNA, 18 bp, Artificial Sequence
  Synthetic DNA
tatgactactatttatag

SEQ ID NO: 42652 - DNA, 18 bp, Artificial Sequence
  Synthetic DNA
tattaacacttactatgg

SEQ ID NO: 42653 - DNA, 18 bp, Artificial Sequence
  Synthetic DNA
tattaacattaagtctag

SEQ ID NO: 42654 - DNA, 18 bp, Artificial Sequence
  Synthetic DNA
tattaagcctcttcctag

SEQ ID NO: 42655 - DNA, 18 bp, Artificial Sequence
  Synthetic DNA
tattacctttcactctag

SEQ ID NO: 42656 - DNA, 18 bp, Artificial Sequence
  Synthetic DNA
tattacgactcaaacttg

SEQ ID NO: 42657 - DNA, 18 bp, Artificial Sequence
  Synthetic DNA
tattacgagcccataaag

SEQ ID NO: 42658 - DNA, 18 bp, Artificial Sequence
  Synthetic DNA
tattacgtcccaccatcg

SEQ ID NO: 42659 - DNA, 18 bp, Artificial Sequence
  Synthetic DNA
tattactaatcacttaag

SEQ ID NO: 42660 - DNA, 18 bp, Artificial Sequence
  Synthetic DNA
tattactactcacctaag

SEQ ID NO: 42661 - DNA, 18 bp, Artificial Sequence
  Synthetic DNA
tattactactctctaatg

SEQ ID NO: 42662 - DNA, 18 bp, Artificial Sequence
  Synthetic DNA
tattactactctttttag

SEQ ID NO: 42663 - DNA, 18 bp, Artificial Sequence
  Synthetic DNA
tattagaactcgctctag

SEQ ID NO: 42664 - DNA, 18 bp, Artificial Sequence
  Synthetic DNA
tattaggactcgctttgg

SEQ ID NO: 42665 - DNA, 18 bp, Artificial Sequence
  Synthetic DNA
tattaggattcccattag

SEQ ID NO: 42666 - DNA, 18 bp, Artificial Sequence
  Synthetic DNA
tattatcaatctttatag

SEQ ID NO: 42667 - DNA, 18 bp, Artificial Sequence
  Synthetic DNA
tattatctctcgctattg

SEQ ID NO: 42668 - DNA, 18 bp, Artificial Sequence
  Synthetic DNA
tattatgactcaattttg

SEQ ID NO: 42669 - DNA, 18 bp, Artificial Sequence
  Synthetic DNA
tattattaactactatag

SEQ ID NO: 42670 - DNA, 18 bp, Artificial Sequence
  Synthetic DNA
tatttagactctacatgg

SEQ ID NO: 42671 - DNA, 18 bp, Artificial Sequence
  Synthetic DNA
tcaagtgactcacaatag

SEQ ID NO: 42672 - DNA, 18 bp, Artificial Sequence
  Synthetic DNA
tcacacgttttagaatag

SEQ ID NO: 42673 - DNA, 18 bp, Artificial Sequence
  Synthetic DNA
tcagtcgtctcactaacg

SEQ ID NO: 42674 - DNA, 18 bp, Artificial Sequence
  Synthetic DNA
tcataacacttatcaaag

SEQ ID NO: 42675 - DNA, 18 bp, Artificial Sequence
  Synthetic DNA
tcataaggctcactctgg

SEQ ID NO: 42676 - DNA, 18 bp, Artificial Sequence
  Synthetic DNA
tcatacgactaatttttg

SEQ ID NO: 42677 - DNA, 18 bp, Artificial Sequence
  Synthetic DNA
tcatacgagtctttattg

SEQ ID NO: 42678 - DNA, 18 bp, Artificial Sequence
  Synthetic DNA
tcatacgcgtcacaaaag

SEQ ID NO: 42679 - DNA, 18 bp, Artificial Sequence
  Synthetic DNA
tcatactactagctaaag

SEQ ID NO: 42680 - DNA, 18 bp, Artificial Sequence
  Synthetic DNA
tcatacttctcaaaattg

SEQ ID NO: 42681 - DNA, 18 bp, Artificial Sequence
  Synthetic DNA
tcatatgtcccgctatag

SEQ ID NO: 42682 - DNA, 18 bp, Artificial Sequence
  Synthetic DNA
tcatattactatctaatg

SEQ ID NO: 42683 - DNA, 18 bp, Artificial Sequence
  Synthetic DNA
tcatgcgactcacttagg

SEQ ID NO: 42684 - DNA, 18 bp, Artificial Sequence
  Synthetic DNA
tcattagcctcactaaag

SEQ ID NO: 42685 - DNA, 18 bp, Artificial Sequence
  Synthetic DNA
tcattcgacgctctatgg

SEQ ID NO: 42686 - DNA, 18 bp, Artificial Sequence
  Synthetic DNA
tcgaattaccctttatag

SEQ ID NO: 42687 - DNA, 18 bp, Artificial Sequence
  Synthetic DNA
tctagcgactaaaaatag

SEQ ID NO: 42688 - DNA, 18 bp, Artificial Sequence
  Synthetic DNA
tctgataacttactatag

SEQ ID NO: 42689 - DNA, 18 bp, Artificial Sequence
  Synthetic DNA
tcttaccactcgcactag

SEQ ID NO: 42690 - DNA, 18 bp, Artificial Sequence
  Synthetic DNA
tcttacgtatcactagag

SEQ ID NO: 42691 - DNA, 18 bp, Artificial Sequence
  Synthetic DNA
tgataccagtcatcaatg

SEQ ID NO: 42692 - DNA, 18 bp, Artificial Sequence
  Synthetic DNA
tgatacgacggtctgtgg

SEQ ID NO: 42693 - DNA, 18 bp, Artificial Sequence
  Synthetic DNA
tgatacgtctttctttag

SEQ ID NO: 42694 - DNA, 18 bp, Artificial Sequence
  Synthetic DNA
tgatagtagtctccaaag

SEQ ID NO: 42695 - DNA, 18 bp, Artificial Sequence
  Synthetic DNA
tgatatgactcagtaacg

SEQ ID NO: 42696 - DNA, 18 bp, Artificial Sequence
  Synthetic DNA
tgatgggactttctaaag

SEQ ID NO: 42697 - DNA, 18 bp, Artificial Sequence
  Synthetic DNA
tgattacactcacaatag

SEQ ID NO: 42698 - DNA, 18 bp, Artificial Sequence
  Synthetic DNA
tgattcgtctcattaaag

SEQ ID NO: 42699 - DNA, 18 bp, Artificial Sequence
  Synthetic DNA
tgattggattcactacag

SEQ ID NO: 42700 - DNA, 18 bp, Artificial Sequence
  Synthetic DNA
tgctaggagtcataatag

SEQ ID NO: 42701 - DNA, 18 bp, Artificial Sequence
  Synthetic DNA
tggtaccactcactgttg

SEQ ID NO: 42702 - DNA, 18 bp, Artificial Sequence
  Synthetic DNA
tggtacgattgactatgg

SEQ ID NO: 42703 - DNA, 18 bp, Artificial Sequence
  Synthetic DNA
tgttacgactgacaaatg

SEQ ID NO: 42704 - DNA, 18 bp, Artificial Sequence
  Synthetic DNA
ttaaaaaacttactatag

SEQ ID NO: 42705 - DNA, 18 bp, Artificial Sequence
  Synthetic DNA
ttaaacgattctgtatag

SEQ ID NO: 42706 - DNA, 18 bp, Artificial Sequence
  Synthetic DNA
ttaaacgtctagctttag

SEQ ID NO: 42707 - DNA, 18 bp, Artificial Sequence
  Synthetic DNA
ttaaccaactctctactg

SEQ ID NO: 42708 - DNA, 18 bp, Artificial Sequence
  Synthetic DNA
ttaatccgctcactattg

SEQ ID NO: 42709 - DNA, 18 bp, Artificial Sequence
  Synthetic DNA
ttaatcgattcgctaatg

SEQ ID NO: 42710 - DNA, 18 bp, Artificial Sequence
  Synthetic DNA
ttacacgacacacacgtg

SEQ ID NO: 42711 - DNA, 18 bp, Artificial Sequence
  Synthetic DNA
ttacacgaccgactacag

SEQ ID NO: 42712 - DNA, 18 bp, Artificial Sequence
  Synthetic DNA
ttacccgactgacttttg

SEQ ID NO: 42713 - DNA, 18 bp, Artificial Sequence
  Synthetic DNA
ttactcgaatcactgcag

SEQ ID NO: 42714 - DNA, 18 bp, Artificial Sequence
  Synthetic DNA
ttagtcgattaacttttg

SEQ ID NO: 42715 - DNA, 18 bp, Artificial Sequence
  Synthetic DNA
ttataagacgcgctaaag

SEQ ID NO: 42716 - DNA, 18 bp, Artificial Sequence
  Synthetic DNA
ttataagttacactatag

SEQ ID NO: 42717 - DNA, 18 bp, Artificial Sequence
  Synthetic DNA
ttataattctctctatag

SEQ ID NO: 42718 - DNA, 18 bp, Artificial Sequence
  Synthetic DNA
ttatacaactaaccctag

SEQ ID NO: 42719 - DNA, 18 bp, Artificial Sequence
  Synthetic DNA
ttatacaactttctatcg

SEQ ID NO: 42720 - DNA, 18 bp, Artificial Sequence
  Synthetic DNA
ttatacaactttcttatg

SEQ ID NO: 42721 - DNA, 18 bp, Artificial Sequence
  Synthetic DNA
ttatacaattaaatatag

SEQ ID NO: 42722 - DNA, 18 bp, Artificial Sequence
  Synthetic DNA
ttataccagccaccatag

SEQ ID NO: 42723 - DNA, 18 bp, Artificial Sequence
  Synthetic DNA
ttatacgaacttctcttg

SEQ ID NO: 42724 - DNA, 18 bp, Artificial Sequence
  Synthetic DNA
ttatacgacgcgctaagg

SEQ ID NO: 42725 - DNA, 18 bp, Artificial Sequence
  Synthetic DNA
ttatacgactctttgaag

SEQ ID NO: 42726 - DNA, 18 bp, Artificial Sequence
  Synthetic DNA
ttatacgtcatacgagag

SEQ ID NO: 42727 - DNA, 18 bp, Artificial Sequence
  Synthetic DNA
ttatacgtcttcctattg

SEQ ID NO: 42728 - DNA, 18 bp, Artificial Sequence
  Synthetic DNA
ttatacgtgacactgttg

SEQ ID NO: 42729 - DNA, 18 bp, Artificial Sequence
  Synthetic DNA
ttatactaagccctatag

SEQ ID NO: 42730 - DNA, 18 bp, Artificial Sequence
  Synthetic DNA
ttatactaatcactgggg

SEQ ID NO: 42731 - DNA, 18 bp, Artificial Sequence
  Synthetic DNA
ttatacttctcactagtg

SEQ ID NO: 42732 - DNA, 18 bp, Artificial Sequence
  Synthetic DNA
ttatacttttaacaatag

SEQ ID NO: 42733 - DNA, 18 bp, Artificial Sequence
  Synthetic DNA
ttatatgactaactggag

SEQ ID NO: 42734 - DNA, 18 bp, Artificial Sequence
  Synthetic DNA
ttatatgacttatcaaag

SEQ ID NO: 42735 - DNA, 18 bp, Artificial Sequence
  Synthetic DNA
ttatatgatactctatag

SEQ ID NO: 42736 - DNA, 18 bp, Artificial Sequence
  Synthetic DNA
ttatattattcaccatag

SEQ ID NO: 42737 - DNA, 18 bp, Artificial Sequence
  Synthetic DNA
ttatcttactcactttag

SEQ ID NO: 42738 - DNA, 18 bp, Artificial Sequence
  Synthetic DNA
ttattaaactctctatag

SEQ ID NO: 42739 - DNA, 18 bp, Artificial Sequence
  Synthetic DNA
ttattcaccactcttcag

SEQ ID NO: 42740 - DNA, 18 bp, Artificial Sequence
  Synthetic DNA
ttattcccctaacgatcg

SEQ ID NO: 42741 - DNA, 18 bp, Artificial Sequence
  Synthetic DNA
ttattcgacacataatag

SEQ ID NO: 42742 - DNA, 18 bp, Artificial Sequence
  Synthetic DNA
ttattcgactcagcattg

SEQ ID NO: 42743 - DNA, 18 bp, Artificial Sequence
  Synthetic DNA
ttattcgactcccaatgg

SEQ ID NO: 42744 - DNA, 18 bp, Artificial Sequence
  Synthetic DNA
ttattcgtattgctatag

SEQ ID NO: 42745 - DNA, 18 bp, Artificial Sequence
  Synthetic DNA
ttattggattcactaaag

SEQ ID NO: 42746 - DNA, 18 bp, Artificial Sequence
  Synthetic DNA
ttctaagtataactatag

SEQ ID NO: 42747 - DNA, 18 bp, Artificial Sequence
  Synthetic DNA
ttctactacactttacag

SEQ ID NO: 42748 - DNA, 18 bp, Artificial Sequence
  Synthetic DNA
ttctccgactcattacag

SEQ ID NO: 42749 - DNA, 18 bp, Artificial Sequence
  Synthetic DNA
ttgaacggctctctttag

SEQ ID NO: 42750 - DNA, 18 bp, Artificial Sequence
  Synthetic DNA
ttgtaccaatcacaatag

SEQ ID NO: 42751 - DNA, 18 bp, Artificial Sequence
  Synthetic DNA
tttcaggacttgctttaa

SEQ ID NO: 42752 - DNA, 18 bp, Artificial Sequence
  Synthetic DNA
ttttaacacactcaaagg

SEQ ID NO: 42753 - DNA, 18 bp, Artificial Sequence
  Synthetic DNA
ttttacaaagcaatattg

SEQ ID NO: 42754 - DNA, 18 bp, Artificial Sequence
  Synthetic DNA
ttttacgaatcattattg

SEQ ID NO: 42755 - DNA, 18 bp, Artificial Sequence
  Synthetic DNA
ttttactactcaatttag

SEQ ID NO: 42756 - DNA, 18 bp, Artificial Sequence
  Synthetic DNA
tttttcgacatattatag

SEQ ID NO: 42757 - DNA, 18 bp, Artificial Sequence
  Synthetic DNA
tttttcggctcactaaag

SEQ ID NO: 42758 - DNA, 18 bp, Artificial Sequence
  Synthetic DNA
aaaaaagtcttactttgg

SEQ ID NO: 42759 - DNA, 18 bp, Artificial Sequence
  Synthetic DNA
aaaaacaaatcgctattg

SEQ ID NO: 42760 - DNA, 18 bp, Artificial Sequence
  Synthetic DNA
aaaaacaactccctaaag

SEQ ID NO: 42761 - DNA, 18 bp, Artificial Sequence
  Synthetic DNA
aaaaacaactgcgtgtag

SEQ ID NO: 42762 - DNA, 18 bp, Artificial Sequence
  Synthetic DNA
aaaaacatatcactaaag

SEQ ID NO: 42763 - DNA, 18 bp, Artificial Sequence
  Synthetic DNA
aaaaacatctgactatag

SEQ ID NO: 42764 - DNA, 18 bp, Artificial Sequence
  Synthetic DNA
aaaaaccattcactacag

SEQ ID NO: 42765 - DNA, 18 bp, Artificial Sequence
  Synthetic DNA
aaaaaccattctctcttg

SEQ ID NO: 42766 - DNA, 18 bp, Artificial Sequence
  Synthetic DNA
aaaaacgacggtctatag

SEQ ID NO: 42767 - DNA, 18 bp, Artificial Sequence
  Synthetic DNA
aaaaacgactaagcattg

SEQ ID NO: 42768 - DNA, 18 bp, Artificial Sequence
  Synthetic DNA
aaaaacgactcacacttg

SEQ ID NO: 42769 - DNA, 18 bp, Artificial Sequence
  Synthetic DNA
aaaaacgactcataattg

SEQ ID NO: 42770 - DNA, 18 bp, Artificial Sequence
  Synthetic DNA
aaaaacgactctcataag

SEQ ID NO: 42771 - DNA, 18 bp, Artificial Sequence
  Synthetic DNA
aaaaacgattgactaggg

SEQ ID NO: 42772 - DNA, 18 bp, Artificial Sequence
  Synthetic DNA
aaaaacgatttacaacag

SEQ ID NO: 42773 - DNA, 18 bp, Artificial Sequence
  Synthetic DNA
aaaaacgcctttctattg

SEQ ID NO: 42774 - DNA, 18 bp, Artificial Sequence
  Synthetic DNA
aaaaacggctcattattg

SEQ ID NO: 42775 - DNA, 18 bp, Artificial Sequence
  Synthetic DNA
aaaaacgtatcaacatag

SEQ ID NO: 42776 - DNA, 18 bp, Artificial Sequence
  Synthetic DNA
aaaaacgtcacacaattg

SEQ ID NO: 42777 - DNA, 18 bp, Artificial Sequence
  Synthetic DNA
aaaaacgtcacattgtag

SEQ ID NO: 42778 - DNA, 18 bp, Artificial Sequence
  Synthetic DNA
aaaaacgtctcatagtag

SEQ ID NO: 42779 - DNA, 18 bp, Artificial Sequence
  Synthetic DNA
aaaaactttactacatag

SEQ ID NO: 42780 - DNA, 18 bp, Artificial Sequence
  Synthetic DNA
aaaaaggtcttactacag

SEQ ID NO: 42781 - DNA, 18 bp, Artificial Sequence
  Synthetic DNA
aaaaaggtgatactatag

SEQ ID NO: 42782 - DNA, 18 bp, Artificial Sequence
  Synthetic DNA
aaaaatgacacatagtcg

SEQ ID NO: 42783 - DNA, 18 bp, Artificial Sequence
  Synthetic DNA
aaaaatttttcactctag

SEQ ID NO: 42784 - DNA, 18 bp, Artificial Sequence
  Synthetic DNA
aaaacagactcgcgatag

SEQ ID NO: 42785 - DNA, 18 bp, Artificial Sequence
  Synthetic DNA
aaaaccgattcactagag

SEQ ID NO: 42786 - DNA, 18 bp, Artificial Sequence
  Synthetic DNA
aaaaccgtctctctaatg

SEQ ID NO: 42787 - DNA, 18 bp, Artificial Sequence
  Synthetic DNA
aaaagcgaaattcgttag

SEQ ID NO: 42788 - DNA, 18 bp, Artificial Sequence
  Synthetic DNA
aaaagcgacacactaaag

SEQ ID NO: 42789 - DNA, 18 bp, Artificial Sequence
  Synthetic DNA
aaaagcgactgactattg

SEQ ID NO: 42790 - DNA, 18 bp, Artificial Sequence
  Synthetic DNA
aaaatcatctcactatag

SEQ ID NO: 42791 - DNA, 18 bp, Artificial Sequence
  Synthetic DNA
aaaatccattcactattg

SEQ ID NO: 42792 - DNA, 18 bp, Artificial Sequence
  Synthetic DNA
aaaatcggctaattctag

SEQ ID NO: 42793 - DNA, 18 bp, Artificial Sequence
  Synthetic DNA
aaaatcgtttcactaacg

SEQ ID NO: 42794 - DNA, 18 bp, Artificial Sequence
  Synthetic DNA
aaacacaagtcattatag

SEQ ID NO: 42795 - DNA, 18 bp, Artificial Sequence
  Synthetic DNA
aaacacgagtccaaattg

SEQ ID NO: 42796 - DNA, 18 bp, Artificial Sequence
  Synthetic DNA
aaacacgatgcttctttg

SEQ ID NO: 42797 - DNA, 18 bp, Artificial Sequence
  Synthetic DNA
aaacacgcttccgttgtg

SEQ ID NO: 42798 - DNA, 18 bp, Artificial Sequence
  Synthetic DNA
aaacacgtctgagtatcg

SEQ ID NO: 42799 - DNA, 18 bp, Artificial Sequence
  Synthetic DNA
aaacacgttccattatag

SEQ ID NO: 42800 - DNA, 18 bp, Artificial Sequence
  Synthetic DNA
aaacactactcattaaag

SEQ ID NO: 42801 - DNA, 18 bp, Artificial Sequence
  Synthetic DNA
aaacactcctccctgaag

SEQ ID NO: 42802 - DNA, 18 bp, Artificial Sequence
  Synthetic DNA
aaacatgactatctattg

SEQ ID NO: 42803 - DNA, 18 bp, Artificial Sequence
  Synthetic DNA
aaacatgactcacaattg

SEQ ID NO: 42804 - DNA, 18 bp, Artificial Sequence
  Synthetic DNA
aaacccttttcagtatcg

SEQ ID NO: 42805 - DNA, 18 bp, Artificial Sequence
  Synthetic DNA
aaacgcaattcactaaag

SEQ ID NO: 42806 - DNA, 18 bp, Artificial Sequence
  Synthetic DNA
aaacgctactctcttaag

SEQ ID NO: 42807 - DNA, 18 bp, Artificial Sequence
  Synthetic DNA
aaactcaacttaatatag

SEQ ID NO: 42808 - DNA, 18 bp, Artificial Sequence
  Synthetic DNA
aaactcgaaacacagtag

SEQ ID NO: 42809 - DNA, 18 bp, Artificial Sequence
  Synthetic DNA
aaactcggctatataaag

SEQ ID NO: 42810 - DNA, 18 bp, Artificial Sequence
  Synthetic DNA
aaactctactcacaaatg

SEQ ID NO: 42811 - DNA, 18 bp, Artificial Sequence
  Synthetic DNA
aaactggacacatgttag

SEQ ID NO: 42812 - DNA, 18 bp, Artificial Sequence
  Synthetic DNA
aaacttgattatctatag

SEQ ID NO: 42813 - DNA, 18 bp, Artificial Sequence
  Synthetic DNA
aaagaccacacattatag

SEQ ID NO: 42814 - DNA, 18 bp, Artificial Sequence
  Synthetic DNA
aaagaccagtcaaaatag

SEQ ID NO: 42815 - DNA, 18 bp, Artificial Sequence
  Synthetic DNA
aaagacgtcaaactatgg

SEQ ID NO: 42816 - DNA, 18 bp, Artificial Sequence
  Synthetic DNA
aaagactactcaatgtag

SEQ ID NO: 42817 - DNA, 18 bp, Artificial Sequence
  Synthetic DNA
aaagataactcactgaag

SEQ ID NO: 42818 - DNA, 18 bp, Artificial Sequence
  Synthetic DNA
aaagatcactcacttcag

SEQ ID NO: 42819 - DNA, 18 bp, Artificial Sequence
  Synthetic DNA
aaagatgatttacgatag

SEQ ID NO: 42820 - DNA, 18 bp, Artificial Sequence
  Synthetic DNA
aaagattaatcaatgcag

SEQ ID NO: 42821 - DNA, 18 bp, Artificial Sequence
  Synthetic DNA
aaaggctatacacagtag

SEQ ID NO: 42822 - DNA, 18 bp, Artificial Sequence
  Synthetic DNA
aaagtcatctctccattg

SEQ ID NO: 42823 - DNA, 18 bp, Artificial Sequence
  Synthetic DNA
aaagtcgtttgaaatttg

SEQ ID NO: 42824 - DNA, 18 bp, Artificial Sequence
  Synthetic DNA
aaataaaacacacttcag

SEQ ID NO: 42825 - DNA, 18 bp, Artificial Sequence
  Synthetic DNA
aaataactctcaccaacg

SEQ ID NO: 42826 - DNA, 18 bp, Artificial Sequence
  Synthetic DNA
aaataagacatactaatg

SEQ ID NO: 42827 - DNA, 18 bp, Artificial Sequence
  Synthetic DNA
aaataagagacactacag

SEQ ID NO: 42828 - DNA, 18 bp, Artificial Sequence
  Synthetic DNA
aaataagccttgctgtag

SEQ ID NO: 42829 - DNA, 18 bp, Artificial Sequence
  Synthetic DNA
aaataagtcatactattg

SEQ ID NO: 42830 - DNA, 18 bp, Artificial Sequence
  Synthetic DNA
aaataattatcactatgg

SEQ ID NO: 42831 - DNA, 18 bp, Artificial Sequence
  Synthetic DNA
aaatacaaaaatctttag

SEQ ID NO: 42832 - DNA, 18 bp, Artificial Sequence
  Synthetic DNA
aaatacaaatcacaattg

SEQ ID NO: 42833 - DNA, 18 bp, Artificial Sequence
  Synthetic DNA
aaatacaactaacttttg

SEQ ID NO: 42834 - DNA, 18 bp, Artificial Sequence
  Synthetic DNA
aaatacaactcagatcag

SEQ ID NO: 42835 - DNA, 18 bp, Artificial Sequence
  Synthetic DNA
aaatacaatgcgccatag

SEQ ID NO: 42836 - DNA, 18 bp, Artificial Sequence
  Synthetic DNA
aaatacaattcacaattg

SEQ ID NO: 42837 - DNA, 18 bp, Artificial Sequence
  Synthetic DNA
aaatacaattctcaagag

SEQ ID NO: 42838 - DNA, 18 bp, Artificial Sequence
  Synthetic DNA
aaatacagttcagtacag

SEQ ID NO: 42839 - DNA, 18 bp, Artificial Sequence
  Synthetic DNA
aaatacatctcacgctag

SEQ ID NO: 42840 - DNA, 18 bp, Artificial Sequence
  Synthetic DNA
aaataccaatccctttag

SEQ ID NO: 42841 - DNA, 18 bp, Artificial Sequence
  Synthetic DNA
aaataccactcattcaag

SEQ ID NO: 42842 - DNA, 18 bp, Artificial Sequence
  Synthetic DNA
aaataccactcatttaag

SEQ ID NO: 42843 - DNA, 18 bp, Artificial Sequence
  Synthetic DNA
aaataccactccaaatag

SEQ ID NO: 42844 - DNA, 18 bp, Artificial Sequence
  Synthetic DNA
aaataccattcacgttag

SEQ ID NO: 42845 - DNA, 18 bp, Artificial Sequence
  Synthetic DNA
aaataccgctcactaacg

SEQ ID NO: 42846 - DNA, 18 bp, Artificial Sequence
  Synthetic DNA
aaataccgctggttagcg

SEQ ID NO: 42847 - DNA, 18 bp, Artificial Sequence
  Synthetic DNA
aaatacctcaccctaatg

SEQ ID NO: 42848 - DNA, 18 bp, Artificial Sequence
  Synthetic DNA
aaatacctcaccctatag

SEQ ID NO: 42849 - DNA, 18 bp, Artificial Sequence
  Synthetic DNA
aaatacctctctctattg

SEQ ID NO: 42850 - DNA, 18 bp, Artificial Sequence
  Synthetic DNA
aaataccttacactatag

SEQ ID NO: 42851 - DNA, 18 bp, Artificial Sequence
  Synthetic DNA
aaatacgaaatacaatcg

SEQ ID NO: 42852 - DNA, 18 bp, Artificial Sequence
  Synthetic DNA
aaatacgacaacctatgg

SEQ ID NO: 42853 - DNA, 18 bp, Artificial Sequence
  Synthetic DNA
aaatacgacacacttgtg

SEQ ID NO: 42854 - DNA, 18 bp, Artificial Sequence
  Synthetic DNA
aaatacgacattcatttg

SEQ ID NO: 42855 - DNA, 18 bp, Artificial Sequence
  Synthetic DNA
aaatacgactaataatcg

SEQ ID NO: 42856 - DNA, 18 bp, Artificial Sequence
  Synthetic DNA
aaatacgactcattgatg

SEQ ID NO: 42857 - DNA, 18 bp, Artificial Sequence
  Synthetic DNA
aaatacgactctaccaag

SEQ ID NO: 42858 - DNA, 18 bp, Artificial Sequence
  Synthetic DNA
aaatacgactctgttaag

SEQ ID NO: 42859 - DNA, 18 bp, Artificial Sequence
  Synthetic DNA
aaatacgactgactgctg

SEQ ID NO: 42860 - DNA, 18 bp, Artificial Sequence
  Synthetic DNA
aaatacgactgcaattag

SEQ ID NO: 42861 - DNA, 18 bp, Artificial Sequence
  Synthetic DNA
aaatacgatgcacaacag

SEQ ID NO: 42862 - DNA, 18 bp, Artificial Sequence
  Synthetic DNA
aaatacgatggactgtag

SEQ ID NO: 42863 - DNA, 18 bp, Artificial Sequence
  Synthetic DNA
aaatacgatggatttttg

SEQ ID NO: 42864 - DNA, 18 bp, Artificial Sequence
  Synthetic DNA
aaatacgccaaaccatag

SEQ ID NO: 42865 - DNA, 18 bp, Artificial Sequence
  Synthetic DNA
aaatacgcttcacttaag

SEQ ID NO: 42866 - DNA, 18 bp, Artificial Sequence
  Synthetic DNA
aaatacggctcaatgcag

SEQ ID NO: 42867 - DNA, 18 bp, Artificial Sequence
  Synthetic DNA
aaatacggctcgctcttg

SEQ ID NO: 42868 - DNA, 18 bp, Artificial Sequence
  Synthetic DNA
aaatacgtcacattgtcg

SEQ ID NO: 42869 - DNA, 18 bp, Artificial Sequence
  Synthetic DNA
aaatacgtcccacttgtg

SEQ ID NO: 42870 - DNA, 18 bp, Artificial Sequence
  Synthetic DNA
aaatacgtcggactaatg

SEQ ID NO: 42871 - DNA, 18 bp, Artificial Sequence
  Synthetic DNA
aaatacgtctaaatattg

SEQ ID NO: 42872 - DNA, 18 bp, Artificial Sequence
  Synthetic DNA
aaatacgtctcatactag

SEQ ID NO: 42873 - DNA, 18 bp, Artificial Sequence
  Synthetic DNA
aaatacgtctcattgtgg

SEQ ID NO: 42874 - DNA, 18 bp, Artificial Sequence
  Synthetic DNA
aaatacgtctcgatagag

SEQ ID NO: 42875 - DNA, 18 bp, Artificial Sequence
  Synthetic DNA
aaatacgtgtatttatag

SEQ ID NO: 42876 - DNA, 18 bp, Artificial Sequence
  Synthetic DNA
aaatacgtttaactaaag

SEQ ID NO: 42877 - DNA, 18 bp, Artificial Sequence
  Synthetic DNA
aaatacgtttctcctaag

SEQ ID NO: 42878 - DNA, 18 bp, Artificial Sequence
  Synthetic DNA
aaatactaaacaccatag

SEQ ID NO: 42879 - DNA, 18 bp, Artificial Sequence
  Synthetic DNA
aaatactaagcacagaag

SEQ ID NO: 42880 - DNA, 18 bp, Artificial Sequence
  Synthetic DNA
aaatactaattaccatag

SEQ ID NO: 42881 - DNA, 18 bp, Artificial Sequence
  Synthetic DNA
aaatactactatcaatag

SEQ ID NO: 42882 - DNA, 18 bp, Artificial Sequence
  Synthetic DNA
aaatactactccccatcg

SEQ ID NO: 42883 - DNA, 18 bp, Artificial Sequence
  Synthetic DNA
aaatactactcgcgttag

SEQ ID NO: 42884 - DNA, 18 bp, Artificial Sequence
  Synthetic DNA
aaatactactcgttcatg

SEQ ID NO: 42885 - DNA, 18 bp, Artificial Sequence
  Synthetic DNA
aaatactactttctacag

SEQ ID NO: 42886 - DNA, 18 bp, Artificial Sequence
  Synthetic DNA
aaatactagtcgttttag

SEQ ID NO: 42887 - DNA, 18 bp, Artificial Sequence
  Synthetic DNA
aaatactatacactatgg

SEQ ID NO: 42888 - DNA, 18 bp, Artificial Sequence
  Synthetic DNA
aaatactatccagaatag

SEQ ID NO: 42889 - DNA, 18 bp, Artificial Sequence
  Synthetic DNA
aaatactattctctatcg

SEQ ID NO: 42890 - DNA, 18 bp, Artificial Sequence
  Synthetic DNA
aaatactatttcctatag

SEQ ID NO: 42891 - DNA, 18 bp, Artificial Sequence
  Synthetic DNA
aaatacttttcagtatag

SEQ ID NO: 42892 - DNA, 18 bp, Artificial Sequence
  Synthetic DNA
aaatagaatactctatag

SEQ ID NO: 42893 - DNA, 18 bp, Artificial Sequence
  Synthetic DNA
aaataggacatcctacag

SEQ ID NO: 42894 - DNA, 18 bp, Artificial Sequence
  Synthetic DNA
aaataggagtcacgaatg

SEQ ID NO: 42895 - DNA, 18 bp, Artificial Sequence
  Synthetic DNA
aaatagggctctctatgg

SEQ ID NO: 42896 - DNA, 18 bp, Artificial Sequence
  Synthetic DNA
aaataggtggttctattg

SEQ ID NO: 42897 - DNA, 18 bp, Artificial Sequence
  Synthetic DNA
aaatataacactctatag

SEQ ID NO: 42898 - DNA, 18 bp, Artificial Sequence
  Synthetic DNA
aaatataacatagtatag

SEQ ID NO: 42899 - DNA, 18 bp, Artificial Sequence
  Synthetic DNA
aaatataactaactacag

SEQ ID NO: 42900 - DNA, 18 bp, Artificial Sequence
  Synthetic DNA
aaatataatccactatag

SEQ ID NO: 42901 - DNA, 18 bp, Artificial Sequence
  Synthetic DNA
aaatatatcttcctaatg

SEQ ID NO: 42902 - DNA, 18 bp, Artificial Sequence
  Synthetic DNA
aaatatgacacactttcg

SEQ ID NO: 42903 - DNA, 18 bp, Artificial Sequence
  Synthetic DNA
aaatatgactaagtatcg

SEQ ID NO: 42904 - DNA, 18 bp, Artificial Sequence
  Synthetic DNA
aaatatgactcaaataag

SEQ ID NO: 42905 - DNA, 18 bp, Artificial Sequence
  Synthetic DNA
aaatatgacttacaatcg

SEQ ID NO: 42906 - DNA, 18 bp, Artificial Sequence
  Synthetic DNA
aaatatgatatactatag

SEQ ID NO: 42907 - DNA, 18 bp, Artificial Sequence
  Synthetic DNA
aaatatgtccgactaaag

SEQ ID NO: 42908 - DNA, 18 bp, Artificial Sequence
  Synthetic DNA
aaatatgtcgctctatag

SEQ ID NO: 42909 - DNA, 18 bp, Artificial Sequence
  Synthetic DNA
aaatatgtttcattaaag

SEQ ID NO: 42910 - DNA, 18 bp, Artificial Sequence
  Synthetic DNA
aaatattactcacgctgg

SEQ ID NO: 42911 - DNA, 18 bp, Artificial Sequence
  Synthetic DNA
aaatcaaacacgcaaaag

SEQ ID NO: 42912 - DNA, 18 bp, Artificial Sequence
  Synthetic DNA
aaatccgaatcactaccg

SEQ ID NO: 42913 - DNA, 18 bp, Artificial Sequence
  Synthetic DNA
aaatccgactcagttttg

SEQ ID NO: 42914 - DNA, 18 bp, Artificial Sequence
  Synthetic DNA
aaatccgactcgctaatg

SEQ ID NO: 42915 - DNA, 18 bp, Artificial Sequence
  Synthetic DNA
aaatccgagccactaaag

SEQ ID NO: 42916 - DNA, 18 bp, Artificial Sequence
  Synthetic DNA
aaatccgagtccctaagg

SEQ ID NO: 42917 - DNA, 18 bp, Artificial Sequence
  Synthetic DNA
aaatccgcctcagcttag

SEQ ID NO: 42918 - DNA, 18 bp, Artificial Sequence
  Synthetic DNA
aaatccgcttcactatgg

SEQ ID NO: 42919 - DNA, 18 bp, Artificial Sequence
  Synthetic DNA
aaatccgcttcacttaag

SEQ ID NO: 42920 - DNA, 18 bp, Artificial Sequence
  Synthetic DNA
aaatctgactcaacatag

SEQ ID NO: 42921 - DNA, 18 bp, Artificial Sequence
  Synthetic DNA
aaatctgactcaccctag

SEQ ID NO: 42922 - DNA, 18 bp, Artificial Sequence
  Synthetic DNA
aaatgccagtcagtctag

SEQ ID NO: 42923 - DNA, 18 bp, Artificial Sequence
  Synthetic DNA
aaatgcgaatcataatgg

SEQ ID NO: 42924 - DNA, 18 bp, Artificial Sequence
  Synthetic DNA
aaatgcgactcccaatgg

SEQ ID NO: 42925 - DNA, 18 bp, Artificial Sequence
  Synthetic DNA
aaatgcgactctctaatg

SEQ ID NO: 42926 - DNA, 18 bp, Artificial Sequence
  Synthetic DNA
aaatgcgactctttgtag

SEQ ID NO: 42927 - DNA, 18 bp, Artificial Sequence
  Synthetic DNA
aaatgcgacttctactag

SEQ ID NO: 42928 - DNA, 18 bp, Artificial Sequence
  Synthetic DNA
aaatgctacactctttag

SEQ ID NO: 42929 - DNA, 18 bp, Artificial Sequence
  Synthetic DNA
aaatgctactcccttcag

SEQ ID NO: 42930 - DNA, 18 bp, Artificial Sequence
  Synthetic DNA
aaatgggattcacccaag

SEQ ID NO: 42931 - DNA, 18 bp, Artificial Sequence
  Synthetic DNA
aaatgtgaaacactgccg

SEQ ID NO: 42932 - DNA, 18 bp, Artificial Sequence
  Synthetic DNA
aaatgtgccacaatctag

SEQ ID NO: 42933 - DNA, 18 bp, Artificial Sequence
  Synthetic DNA
aaattaatctcactattg

SEQ ID NO: 42934 - DNA, 18 bp, Artificial Sequence
  Synthetic DNA
aaattacacactatatag

SEQ ID NO: 42935 - DNA, 18 bp, Artificial Sequence
  Synthetic DNA
aaattagaatccgtatag

SEQ ID NO: 42936 - DNA, 18 bp, Artificial Sequence
  Synthetic DNA
aaattagactcacaaaag

SEQ ID NO: 42937 - DNA, 18 bp, Artificial Sequence
  Synthetic DNA
aaattagactcagcatag

SEQ ID NO: 42938 - DNA, 18 bp, Artificial Sequence
  Synthetic DNA
aaattagactccctaaag

SEQ ID NO: 42939 - DNA, 18 bp, Artificial Sequence
  Synthetic DNA
aaattagactttctacag

SEQ ID NO: 42940 - DNA, 18 bp, Artificial Sequence
  Synthetic DNA
aaattcaaatcatcaaag

SEQ ID NO: 42941 - DNA, 18 bp, Artificial Sequence
  Synthetic DNA
aaattcaacactattgag

SEQ ID NO: 42942 - DNA, 18 bp, Artificial Sequence
  Synthetic DNA
aaattcaacccattctag

SEQ ID NO: 42943 - DNA, 18 bp, Artificial Sequence
  Synthetic DNA
aaattcaactcattaaag

SEQ ID NO: 42944 - DNA, 18 bp, Artificial Sequence
  Synthetic DNA
aaattcaactcattattg

SEQ ID NO: 42945 - DNA, 18 bp, Artificial Sequence
  Synthetic DNA
aaattcacctctctaaag

SEQ ID NO: 42946 - DNA, 18 bp, Artificial Sequence
  Synthetic DNA
aaattcatctctctctag

SEQ ID NO: 42947 - DNA, 18 bp, Artificial Sequence
  Synthetic DNA
aaattccagtcattactg

SEQ ID NO: 42948 - DNA, 18 bp, Artificial Sequence
  Synthetic DNA
aaattcctctctctaaag

SEQ ID NO: 42949 - DNA, 18 bp, Artificial Sequence
  Synthetic DNA
aaattcgaatctctacag

SEQ ID NO: 42950 - DNA, 18 bp, Artificial Sequence
  Synthetic DNA
aaattcgacaaacaatcg

SEQ ID NO: 42951 - DNA, 18 bp, Artificial Sequence
  Synthetic DNA
aaattcgacactttcatg

SEQ ID NO: 42952 - DNA, 18 bp, Artificial Sequence
  Synthetic DNA
aaattcgacatactttag

SEQ ID NO: 42953 - DNA, 18 bp, Artificial Sequence
  Synthetic DNA
aaattcgactcatttcag

SEQ ID NO: 42954 - DNA, 18 bp, Artificial Sequence
  Synthetic DNA
aaattcgagtcaataaag

SEQ ID NO: 42955 - DNA, 18 bp, Artificial Sequence
  Synthetic DNA
aaattcgattaagtctag

SEQ ID NO: 42956 - DNA, 18 bp, Artificial Sequence
  Synthetic DNA
aaattcgatttaccttag

SEQ ID NO: 42957 - DNA, 18 bp, Artificial Sequence
  Synthetic DNA
aaattcggatgtctatag

SEQ ID NO: 42958 - DNA, 18 bp, Artificial Sequence
  Synthetic DNA
aaattcgtctcacaagag

SEQ ID NO: 42959 - DNA, 18 bp, Artificial Sequence
  Synthetic DNA
aaattcgttcaacttgag

SEQ ID NO: 42960 - DNA, 18 bp, Artificial Sequence
  Synthetic DNA
aaattctactcacttaag

SEQ ID NO: 42961 - DNA, 18 bp, Artificial Sequence
  Synthetic DNA
aaattcttcaaactttag

SEQ ID NO: 42962 - DNA, 18 bp, Artificial Sequence
  Synthetic DNA
aaattggaaccactacag

SEQ ID NO: 42963 - DNA, 18 bp, Artificial Sequence
  Synthetic DNA
aaattggacatacaatag

SEQ ID NO: 42964 - DNA, 18 bp, Artificial Sequence
  Synthetic DNA
aaattggactcatttaag

SEQ ID NO: 42965 - DNA, 18 bp, Artificial Sequence
  Synthetic DNA
aaattggactctctattg

SEQ ID NO: 42966 - DNA, 18 bp, Artificial Sequence
  Synthetic DNA
aaattttactcaatatag

SEQ ID NO: 42967 - DNA, 18 bp, Artificial Sequence
  Synthetic DNA
aacaacacctctctatag

SEQ ID NO: 42968 - DNA, 18 bp, Artificial Sequence
  Synthetic DNA
aacaacgacaaactatag

SEQ ID NO: 42969 - DNA, 18 bp, Artificial Sequence
  Synthetic DNA
aacaacgatttacttttg

SEQ ID NO: 42970 - DNA, 18 bp, Artificial Sequence
  Synthetic DNA
aacaacgatttattatag

SEQ ID NO: 42971 - DNA, 18 bp, Artificial Sequence
  Synthetic DNA
aacaattactcacttttg

SEQ ID NO: 42972 - DNA, 18 bp, Artificial Sequence
  Synthetic DNA
aaccaccacacactatgg

SEQ ID NO: 42973 - DNA, 18 bp, Artificial Sequence
  Synthetic DNA
aaccacgtctgactatag

SEQ ID NO: 42974 - DNA, 18 bp, Artificial Sequence
  Synthetic DNA
aaccactactcacttaag

SEQ ID NO: 42975 - DNA, 18 bp, Artificial Sequence
  Synthetic DNA
aacctagcctcactatag

SEQ ID NO: 42976 - DNA, 18 bp, Artificial Sequence
  Synthetic DNA
aacgacaattcactgtag

SEQ ID NO: 42977 - DNA, 18 bp, Artificial Sequence
  Synthetic DNA
aactaagactcaatatcg

SEQ ID NO: 42978 - DNA, 18 bp, Artificial Sequence
  Synthetic DNA
aactacaacacaccattg

SEQ ID NO: 42979 - DNA, 18 bp, Artificial Sequence
  Synthetic DNA
aactacaattcactacag

SEQ ID NO: 42980 - DNA, 18 bp, Artificial Sequence
  Synthetic DNA
aactaccactcagaaaag

SEQ ID NO: 42981 - DNA, 18 bp, Artificial Sequence
  Synthetic DNA
aactacccgtctctaaag

SEQ ID NO: 42982 - DNA, 18 bp, Artificial Sequence
  Synthetic DNA
aactacctcccaacctag

SEQ ID NO: 42983 - DNA, 18 bp, Artificial Sequence
  Synthetic DNA
aactacgaagaacttttg

SEQ ID NO: 42984 - DNA, 18 bp, Artificial Sequence
  Synthetic DNA
aactacgactatttatag

SEQ ID NO: 42985 - DNA, 18 bp, Artificial Sequence
  Synthetic DNA
aactacgactctataaag

SEQ ID NO: 42986 - DNA, 18 bp, Artificial Sequence
  Synthetic DNA
aactacgcatctcaacgg

SEQ ID NO: 42987 - DNA, 18 bp, Artificial Sequence
  Synthetic DNA
aactacggctcacttttg

SEQ ID NO: 42988 - DNA, 18 bp, Artificial Sequence
  Synthetic DNA
aactacgtcacactagag

SEQ ID NO: 42989 - DNA, 18 bp, Artificial Sequence
  Synthetic DNA
aactatgacacactagag

SEQ ID NO: 42990 - DNA, 18 bp, Artificial Sequence
  Synthetic DNA
aactatgacttacaaaag

SEQ ID NO: 42991 - DNA, 18 bp, Artificial Sequence
  Synthetic DNA
aactccgtctcacttcag

SEQ ID NO: 42992 - DNA, 18 bp, Artificial Sequence
  Synthetic DNA
aactcctacgctttattg

SEQ ID NO: 42993 - DNA, 18 bp, Artificial Sequence
  Synthetic DNA
aactgcggctcaacaaag

SEQ ID NO: 42994 - DNA, 18 bp, Artificial Sequence
  Synthetic DNA
aactgcgtctgaatattg

SEQ ID NO: 42995 - DNA, 18 bp, Artificial Sequence
  Synthetic DNA
aacttccactcacttgtg

SEQ ID NO: 42996 - DNA, 18 bp, Artificial Sequence
  Synthetic DNA
aacttcgattcattatag

SEQ ID NO: 42997 - DNA, 18 bp, Artificial Sequence
  Synthetic DNA
aacttcgtcaaactatag

SEQ ID NO: 42998 - DNA, 18 bp, Artificial Sequence
  Synthetic DNA
aacttcgtctgacaatag

SEQ ID NO: 42999 - DNA, 18 bp, Artificial Sequence
  Synthetic DNA
aagcaaatctcactttag

SEQ ID NO: 43000 - DNA, 18 bp, Artificial Sequence
  Synthetic DNA
aagcactactgactatag

SEQ ID NO: 43001 - DNA, 18 bp, Artificial Sequence
  Synthetic DNA
aaggacgtatcacaattg

SEQ ID NO: 43002 - DNA, 18 bp, Artificial Sequence
  Synthetic DNA
aagtacaactcaataaag

SEQ ID NO: 43003 - DNA, 18 bp, Artificial Sequence
  Synthetic DNA
aagtacaactcacttcgg

SEQ ID NO: 43004 - DNA, 18 bp, Artificial Sequence
  Synthetic DNA
aagtacaactctcaaaag

SEQ ID NO: 43005 - DNA, 18 bp, Artificial Sequence
  Synthetic DNA
aagtacaagtaaccacgg

SEQ ID NO: 43006 - DNA, 18 bp, Artificial Sequence
  Synthetic DNA
aagtaccaattactatag

SEQ ID NO: 43007 - DNA, 18 bp, Artificial Sequence
  Synthetic DNA
aagtaccacctaaagtag

SEQ ID NO: 43008 - DNA, 18 bp, Artificial Sequence
  Synthetic DNA
aagtaccactaactttag

SEQ ID NO: 43009 - DNA, 18 bp, Artificial Sequence
  Synthetic DNA
aagtacgactgagtacag

SEQ ID NO: 43010 - DNA, 18 bp, Artificial Sequence
  Synthetic DNA
aagtacggcttagcattg

SEQ ID NO: 43011 - DNA, 18 bp, Artificial Sequence
  Synthetic DNA
aagtataattcactattg

SEQ ID NO: 43012 - DNA, 18 bp, Artificial Sequence
  Synthetic DNA
aagtatgtttcattatag

SEQ ID NO: 43013 - DNA, 18 bp, Artificial Sequence
  Synthetic DNA
aagtcatactctttatag

SEQ ID NO: 43014 - DNA, 18 bp, Artificial Sequence
  Synthetic DNA
aagtctctctcactatag

SEQ ID NO: 43015 - DNA, 18 bp, Artificial Sequence
  Synthetic DNA
aagttcgactcaccaaag

SEQ ID NO: 43016 - DNA, 18 bp, Artificial Sequence
  Synthetic DNA
aagttcgccacactttag

SEQ ID NO: 43017 - DNA, 18 bp, Artificial Sequence
  Synthetic DNA
aataacacctcactatag

SEQ ID NO: 43018 - DNA, 18 bp, Artificial Sequence
  Synthetic DNA
aataacgaatccctctag

SEQ ID NO: 43019 - DNA, 18 bp, Artificial Sequence
  Synthetic DNA
aataacgactagctatag

SEQ ID NO: 43020 - DNA, 18 bp, Artificial Sequence
  Synthetic DNA
aataacgactcactttgg

SEQ ID NO: 43021 - DNA, 18 bp, Artificial Sequence
  Synthetic DNA
aataccgtctcagtatag

SEQ ID NO: 43022 - DNA, 18 bp, Artificial Sequence
  Synthetic DNA
aatatatacttatatgag

SEQ ID NO: 43023 - DNA, 18 bp, Artificial Sequence
  Synthetic DNA
aatatcgactctttacag

SEQ ID NO: 43024 - DNA, 18 bp, Artificial Sequence
  Synthetic DNA
aatatcgatcctctatag

SEQ ID NO: 43025 - DNA, 18 bp, Artificial Sequence
  Synthetic DNA
aatatcgtctgtcaatag

SEQ ID NO: 43026 - DNA, 18 bp, Artificial Sequence
  Synthetic DNA
aatcacaaccaactcttg

SEQ ID NO: 43027 - DNA, 18 bp, Artificial Sequence
  Synthetic DNA
aatcacgattctcttttg

SEQ ID NO: 43028 - DNA, 18 bp, Artificial Sequence
  Synthetic DNA
aatcactaatcactttag

SEQ ID NO: 43029 - DNA, 18 bp, Artificial Sequence
  Synthetic DNA
aatcattagtccttattg

SEQ ID NO: 43030 - DNA, 18 bp, Artificial Sequence
  Synthetic DNA
aatctagacccacaacag

SEQ ID NO: 43031 - DNA, 18 bp, Artificial Sequence
  Synthetic DNA
aatctagactctcaattg

SEQ ID NO: 43032 - DNA, 18 bp, Artificial Sequence
  Synthetic DNA
aatctcctcacagttcag

SEQ ID NO: 43033 - DNA, 18 bp, Artificial Sequence
  Synthetic DNA
aatgacgacttgacaatg

SEQ ID NO: 43034 - DNA, 18 bp, Artificial Sequence
  Synthetic DNA
aatgacgtatatatatag

SEQ ID NO: 43035 - DNA, 18 bp, Artificial Sequence
  Synthetic DNA
aatgacgtctcactgttg

SEQ ID NO: 43036 - DNA, 18 bp, Artificial Sequence
  Synthetic DNA
aatgtctacaaactatag

SEQ ID NO: 43037 - DNA, 18 bp, Artificial Sequence
  Synthetic DNA
aattaagacacataaaag

SEQ ID NO: 43038 - DNA, 18 bp, Artificial Sequence
  Synthetic DNA
aattaagataaacttaag

SEQ ID NO: 43039 - DNA, 18 bp, Artificial Sequence
  Synthetic DNA
aattaatattccttttag

SEQ ID NO: 43040 - DNA, 18 bp, Artificial Sequence
  Synthetic DNA
aattacaaataactatag

SEQ ID NO: 43041 - DNA, 18 bp, Artificial Sequence
  Synthetic DNA
aattacaacactctatag

SEQ ID NO: 43042 - DNA, 18 bp, Artificial Sequence
  Synthetic DNA
aattacaactctgtaaag

SEQ ID NO: 43043 - DNA, 18 bp, Artificial Sequence
  Synthetic DNA
aattacaactgtctttag

SEQ ID NO: 43044 - DNA, 18 bp, Artificial Sequence
  Synthetic DNA
aattacaactttctatag

SEQ ID NO: 43045 - DNA, 18 bp, Artificial Sequence
  Synthetic DNA
aattacaattcacaatcg

SEQ ID NO: 43046 - DNA, 18 bp, Artificial Sequence
  Synthetic DNA
aattacatctcacaatcg

SEQ ID NO: 43047 - DNA, 18 bp, Artificial Sequence
  Synthetic DNA
aattaccactagatatag

SEQ ID NO: 43048 - DNA, 18 bp, Artificial Sequence
  Synthetic DNA
aattaccttaaaatatag

SEQ ID NO: 43049 - DNA, 18 bp, Artificial Sequence
  Synthetic DNA
aattacgaattttacaag

SEQ ID NO: 43050 - DNA, 18 bp, Artificial Sequence
  Synthetic DNA
aattacgacaagcaataa

SEQ ID NO: 43051 - DNA, 18 bp, Artificial Sequence
  Synthetic DNA
aattacgacccagtctgg

SEQ ID NO: 43052 - DNA, 18 bp, Artificial Sequence
  Synthetic DNA
aattacgactcacttacg

SEQ ID NO: 43053 - DNA, 18 bp, Artificial Sequence
  Synthetic DNA
aattacgactctcaatcg

SEQ ID NO: 43054 - DNA, 18 bp, Artificial Sequence
  Synthetic DNA
aattacgactctctaacg

SEQ ID NO: 43055 - DNA, 18 bp, Artificial Sequence
  Synthetic DNA
aattacgattcaccaatg

SEQ ID NO: 43056 - DNA, 18 bp, Artificial Sequence
  Synthetic DNA
aattacgatttactatgg

SEQ ID NO: 43057 - DNA, 18 bp, Artificial Sequence
  Synthetic DNA
aattacgtatctcttaag

SEQ ID NO: 43058 - DNA, 18 bp, Artificial Sequence
  Synthetic DNA
aattacgtcccatttttg

SEQ ID NO: 43059 - DNA, 18 bp, Artificial Sequence
  Synthetic DNA
aattacgtctccctaaag

SEQ ID NO: 43060 - DNA, 18 bp, Artificial Sequence
  Synthetic DNA
aattacgtctccctaatg

SEQ ID NO: 43061 - DNA, 18 bp, Artificial Sequence
  Synthetic DNA
aattacgtctccctattg

SEQ ID NO: 43062 - DNA, 18 bp, Artificial Sequence
  Synthetic DNA
aattacgtctccgtaaag

SEQ ID NO: 43063 - DNA, 18 bp, Artificial Sequence
  Synthetic DNA
aattactaataactttag

SEQ ID NO: 43064 - DNA, 18 bp, Artificial Sequence
  Synthetic DNA
aattactactcattattg

SEQ ID NO: 43065 - DNA, 18 bp, Artificial Sequence
  Synthetic DNA
aattactatacactatag

SEQ ID NO: 43066 - DNA, 18 bp, Artificial Sequence
  Synthetic DNA
aattagcacttactatag

SEQ ID NO: 43067 - DNA, 18 bp, Artificial Sequence
  Synthetic DNA
aattaggactcactcgag

SEQ ID NO: 43068 - DNA, 18 bp, Artificial Sequence
  Synthetic DNA
aattagtccaccttattg

SEQ ID NO: 43069 - DNA, 18 bp, Artificial Sequence
  Synthetic DNA
aattataactatctatag

SEQ ID NO: 43070 - DNA, 18 bp, Artificial Sequence
  Synthetic DNA
aattatgactcagtatcg

SEQ ID NO: 43071 - DNA, 18 bp, Artificial Sequence
  Synthetic DNA
aattatgtcataatatag

SEQ ID NO: 43072 - DNA, 18 bp, Artificial Sequence
  Synthetic DNA
aattatgtctcattaaag

SEQ ID NO: 43073 - DNA, 18 bp, Artificial Sequence
  Synthetic DNA
aattattaccaaccatag

SEQ ID NO: 43074 - DNA, 18 bp, Artificial Sequence
  Synthetic DNA
aattccaaatcactttag

SEQ ID NO: 43075 - DNA, 18 bp, Artificial Sequence
  Synthetic DNA
aattccaaccctcaatag

SEQ ID NO: 43076 - DNA, 18 bp, Artificial Sequence
  Synthetic DNA
aattccgtctcgatgtag

SEQ ID NO: 43077 - DNA, 18 bp, Artificial Sequence
  Synthetic DNA
aattcctcttcgcgatag

SEQ ID NO: 43078 - DNA, 18 bp, Artificial Sequence
  Synthetic DNA
aattcggactaactatag

SEQ ID NO: 43079 - DNA, 18 bp, Artificial Sequence
  Synthetic DNA
aattcggactcactaaag

SEQ ID NO: 43080 - DNA, 18 bp, Artificial Sequence
  Synthetic DNA
aattgagtctcactgttg

SEQ ID NO: 43081 - DNA, 18 bp, Artificial Sequence
  Synthetic DNA
aattgcaaatcactttag

SEQ ID NO: 43082 - DNA, 18 bp, Artificial Sequence
  Synthetic DNA
aattgcaacacactttag

SEQ ID NO: 43083 - DNA, 18 bp, Artificial Sequence
  Synthetic DNA
aattgcaacttattatcg

SEQ ID NO: 43084 - DNA, 18 bp, Artificial Sequence
  Synthetic DNA
aattgcgaaccgcaatag

SEQ ID NO: 43085 - DNA, 18 bp, Artificial Sequence
  Synthetic DNA
aattgcgacccactttcg

SEQ ID NO: 43086 - DNA, 18 bp, Artificial Sequence
  Synthetic DNA
aatttatacacactttag

SEQ ID NO: 43087 - DNA, 18 bp, Artificial Sequence
  Synthetic DNA
aatttcaactcattttag

SEQ ID NO: 43088 - DNA, 18 bp, Artificial Sequence
  Synthetic DNA
aatttcaactttatatag

SEQ ID NO: 43089 - DNA, 18 bp, Artificial Sequence
  Synthetic DNA
aatttcaattcgaaaaag

SEQ ID NO: 43090 - DNA, 18 bp, Artificial Sequence
  Synthetic DNA
aatttccacaaactgcag

SEQ ID NO: 43091 - DNA, 18 bp, Artificial Sequence
  Synthetic DNA
aatttcgactaactaaag

SEQ ID NO: 43092 - DNA, 18 bp, Artificial Sequence
  Synthetic DNA
aatttcgtctcactatcg

SEQ ID NO: 43093 - DNA, 18 bp, Artificial Sequence
  Synthetic DNA
aattttgactcagggtag

SEQ ID NO: 43094 - DNA, 18 bp, Artificial Sequence
  Synthetic DNA
acaaacgcatcacagatg

SEQ ID NO: 43095 - DNA, 18 bp, Artificial Sequence
  Synthetic DNA
acaaacgcctttcaatag

SEQ ID NO: 43096 - DNA, 18 bp, Artificial Sequence
  Synthetic DNA
acaactgaatcatttaag

SEQ ID NO: 43097 - DNA, 18 bp, Artificial Sequence
  Synthetic DNA
acacacgtatcactacag

SEQ ID NO: 43098 - DNA, 18 bp, Artificial Sequence
  Synthetic DNA
acactcgaatcattaaag

SEQ ID NO: 43099 - DNA, 18 bp, Artificial Sequence
  Synthetic DNA
acactcgactctttcttg

SEQ ID NO: 43100 - DNA, 18 bp, Artificial Sequence
  Synthetic DNA
acactcggctcaatatag

SEQ ID NO: 43101 - DNA, 18 bp, Artificial Sequence
  Synthetic DNA
acagacgaataattatgg

SEQ ID NO: 43102 - DNA, 18 bp, Artificial Sequence
  Synthetic DNA
acataaaatttactatag

SEQ ID NO: 43103 - DNA, 18 bp, Artificial Sequence
  Synthetic DNA
acataacagtccctatag

SEQ ID NO: 43104 - DNA, 18 bp, Artificial Sequence
  Synthetic DNA
acataagacaaaatatag

SEQ ID NO: 43105 - DNA, 18 bp, Artificial Sequence
  Synthetic DNA
acataagacgctctatag

SEQ ID NO: 43106 - DNA, 18 bp, Artificial Sequence
  Synthetic DNA
acataagtcacacagtag

SEQ ID NO: 43107 - DNA, 18 bp, Artificial Sequence
  Synthetic DNA
acatacgaacctcttttg

SEQ ID NO: 43108 - DNA, 18 bp, Artificial Sequence
  Synthetic DNA
acatacgaatctcaatag

SEQ ID NO: 43109 - DNA, 18 bp, Artificial Sequence
  Synthetic DNA
acatacgacaaacaatag

SEQ ID NO: 43110 - DNA, 18 bp, Artificial Sequence
  Synthetic DNA
acatacgagtctctatcg

SEQ ID NO: 43111 - DNA, 18 bp, Artificial Sequence
  Synthetic DNA
acatacgatccactaagg

SEQ ID NO: 43112 - DNA, 18 bp, Artificial Sequence
  Synthetic DNA
acatacgccactatcaag

SEQ ID NO: 43113 - DNA, 18 bp, Artificial Sequence
  Synthetic DNA
acatacgtctaaaaatag

SEQ ID NO: 43114 - DNA, 18 bp, Artificial Sequence
  Synthetic DNA
acatacgtctcataatag

SEQ ID NO: 43115 - DNA, 18 bp, Artificial Sequence
  Synthetic DNA
acatactactcactcgag

SEQ ID NO: 43116 - DNA, 18 bp, Artificial Sequence
  Synthetic DNA
acatactgcttactatag

SEQ ID NO: 43117 - DNA, 18 bp, Artificial Sequence
  Synthetic DNA
acatagcactcattatag

SEQ ID NO: 43118 - DNA, 18 bp, Artificial Sequence
  Synthetic DNA
acatatgaatcaatatcg

SEQ ID NO: 43119 - DNA, 18 bp, Artificial Sequence
  Synthetic DNA
acatatgactcattcagg

SEQ ID NO: 43120 - DNA, 18 bp, Artificial Sequence
  Synthetic DNA
acatatgactcgctacag

SEQ ID NO: 43121 - DNA, 18 bp, Artificial Sequence
  Synthetic DNA
acatatgagtccttctag

SEQ ID NO: 43122 - DNA, 18 bp, Artificial Sequence
  Synthetic DNA
acatatgtctcactgtag

SEQ ID NO: 43123 - DNA, 18 bp, Artificial Sequence
  Synthetic DNA
acatcaggctcactatag

SEQ ID NO: 43124 - DNA, 18 bp, Artificial Sequence
  Synthetic DNA
acatccatctcaataaag

SEQ ID NO: 43125 - DNA, 18 bp, Artificial Sequence
  Synthetic DNA
acatccgacttgctatag

SEQ ID NO: 43126 - DNA, 18 bp, Artificial Sequence
  Synthetic DNA
acatgagactctctactg

SEQ ID NO: 43127 - DNA, 18 bp, Artificial Sequence
  Synthetic DNA
acatgcgattcactctag

SEQ ID NO: 43128 - DNA, 18 bp, Artificial Sequence
  Synthetic DNA
acattaggctcactatag

SEQ ID NO: 43129 - DNA, 18 bp, Artificial Sequence
  Synthetic DNA
acattcaactctctatag

SEQ ID NO: 43130 - DNA, 18 bp, Artificial Sequence
  Synthetic DNA
acattcgacatactatag

SEQ ID NO: 43131 - DNA, 18 bp, Artificial Sequence
  Synthetic DNA
acattcgactccctttag

SEQ ID NO: 43132 - DNA, 18 bp, Artificial Sequence
  Synthetic DNA
acattcgtgtcagtatag

SEQ ID NO: 43133 - DNA, 18 bp, Artificial Sequence
  Synthetic DNA
accaaccactcatcatag

SEQ ID NO: 43134 - DNA, 18 bp, Artificial Sequence
  Synthetic DNA
acccacgaatcattcaag

SEQ ID NO: 43135 - DNA, 18 bp, Artificial Sequence
  Synthetic DNA
acctacgacccactattg

SEQ ID NO: 43136 - DNA, 18 bp, Artificial Sequence
  Synthetic DNA
acgatagaatctcaacag

SEQ ID NO: 43137 - DNA, 18 bp, Artificial Sequence
  Synthetic DNA
acgcacacctcaatatag

SEQ ID NO: 43138 - DNA, 18 bp, Artificial Sequence
  Synthetic DNA
acgtaccacactcaattg

SEQ ID NO: 43139 - DNA, 18 bp, Artificial Sequence
  Synthetic DNA
acgtacgactaagcattg

SEQ ID NO: 43140 - DNA, 18 bp, Artificial Sequence
  Synthetic DNA
acgtttgtcactcaatag

SEQ ID NO: 43141 - DNA, 18 bp, Artificial Sequence
  Synthetic DNA
acttaattctcacaatag

SEQ ID NO: 43142 - DNA, 18 bp, Artificial Sequence
  Synthetic DNA
acttacgtatcaaaattg

SEQ ID NO: 43143 - DNA, 18 bp, Artificial Sequence
  Synthetic DNA
acttactacttactatag

SEQ ID NO: 43144 - DNA, 18 bp, Artificial Sequence
  Synthetic DNA
acttagaactcagtatag

SEQ ID NO: 43145 - DNA, 18 bp, Artificial Sequence
  Synthetic DNA
acttaggactcaatatag

SEQ ID NO: 43146 - DNA, 18 bp, Artificial Sequence
  Synthetic DNA
acttagtacactctatag

SEQ ID NO: 43147 - DNA, 18 bp, Artificial Sequence
  Synthetic DNA
acttatgagtaactaaag

SEQ ID NO: 43148 - DNA, 18 bp, Artificial Sequence
  Synthetic DNA
actttcgtttcattaatg

SEQ ID NO: 43149 - DNA, 18 bp, Artificial Sequence
  Synthetic DNA
agaaacgacacgctgttg

SEQ ID NO: 43150 - DNA, 18 bp, Artificial Sequence
  Synthetic DNA
agaaacgacacttaatag

SEQ ID NO: 43151 - DNA, 18 bp, Artificial Sequence
  Synthetic DNA
agaaacgactctatatag

SEQ ID NO: 43152 - DNA, 18 bp, Artificial Sequence
  Synthetic DNA
agaaacgactttctattg

SEQ ID NO: 43153 - DNA, 18 bp, Artificial Sequence
  Synthetic DNA
agaaccgactctctgtag

SEQ ID NO: 43154 - DNA, 18 bp, Artificial Sequence
  Synthetic DNA
agacaagtcacactttag

SEQ ID NO: 43155 - DNA, 18 bp, Artificial Sequence
  Synthetic DNA
agataagactaactaatg

SEQ ID NO: 43156 - DNA, 18 bp, Artificial Sequence
  Synthetic DNA
agataagactcacattag

SEQ ID NO: 43157 - DNA, 18 bp, Artificial Sequence
  Synthetic DNA
agataagtctctatatag

SEQ ID NO: 43158 - DNA, 18 bp, Artificial Sequence
  Synthetic DNA
agatacaacgctcttatg

SEQ ID NO: 43159 - DNA, 18 bp, Artificial Sequence
  Synthetic DNA
agatacaactcgatatag

SEQ ID NO: 43160 - DNA, 18 bp, Artificial Sequence
  Synthetic DNA
agatacgaattactaaag

SEQ ID NO: 43161 - DNA, 18 bp, Artificial Sequence
  Synthetic DNA
agatacgattgtctttag

SEQ ID NO: 43162 - DNA, 18 bp, Artificial Sequence
  Synthetic DNA
agatacggctgtctatag

SEQ ID NO: 43163 - DNA, 18 bp, Artificial Sequence
  Synthetic DNA
agatacgtcagattttag

SEQ ID NO: 43164 - DNA, 18 bp, Artificial Sequence
  Synthetic DNA
agataggaatcactaaag

SEQ ID NO: 43165 - DNA, 18 bp, Artificial Sequence
  Synthetic DNA
agataggatttactatag

SEQ ID NO: 43166 - DNA, 18 bp, Artificial Sequence
  Synthetic DNA
agatataactaagtttag

SEQ ID NO: 43167 - DNA, 18 bp, Artificial Sequence
  Synthetic DNA
agatatgaaaccctacag

SEQ ID NO: 43168 - DNA, 18 bp, Artificial Sequence
  Synthetic DNA
agatccgaatcccaatcg

SEQ ID NO: 43169 - DNA, 18 bp, Artificial Sequence
  Synthetic DNA
agatctggctcactattg

SEQ ID NO: 43170 - DNA, 18 bp, Artificial Sequence
  Synthetic DNA
agatgcgagtcattatag

SEQ ID NO: 43171 - DNA, 18 bp, Artificial Sequence
  Synthetic DNA
agattagacaccttatag

SEQ ID NO: 43172 - DNA, 18 bp, Artificial Sequence
  Synthetic DNA
agattcaattctctatag

SEQ ID NO: 43173 - DNA, 18 bp, Artificial Sequence
  Synthetic DNA
agattcgactcaccatcg

SEQ ID NO: 43174 - DNA, 18 bp, Artificial Sequence
  Synthetic DNA
agattcgactcgctaccg

SEQ ID NO: 43175 - DNA, 18 bp, Artificial Sequence
  Synthetic DNA
agattcgagtcactaaag

SEQ ID NO: 43176 - DNA, 18 bp, Artificial Sequence
  Synthetic DNA
agattcgcctcaatacag

SEQ ID NO: 43177 - DNA, 18 bp, Artificial Sequence
  Synthetic DNA
agatttgattcacctaag

SEQ ID NO: 43178 - DNA, 18 bp, Artificial Sequence
  Synthetic DNA
agcaaagtattacccttg

SEQ ID NO: 43179 - DNA, 18 bp, Artificial Sequence
  Synthetic DNA
agcattgactaactattg

SEQ ID NO: 43180 - DNA, 18 bp, Artificial Sequence
  Synthetic DNA
agctacgactcccaatag

SEQ ID NO: 43181 - DNA, 18 bp, Artificial Sequence
  Synthetic DNA
aggtacgtctctcgctag

SEQ ID NO: 43182 - DNA, 18 bp, Artificial Sequence
  Synthetic DNA
aggtttgcttcactatag

SEQ ID NO: 43183 - DNA, 18 bp, Artificial Sequence
  Synthetic DNA
agtaacgattcactaaag

SEQ ID NO: 43184 - DNA, 18 bp, Artificial Sequence
  Synthetic DNA
agttaaaactcactatag

SEQ ID NO: 43185 - DNA, 18 bp, Artificial Sequence
  Synthetic DNA
agttacaactcgtattag

SEQ ID NO: 43186 - DNA, 18 bp, Artificial Sequence
  Synthetic DNA
agttacgaaagactatag

SEQ ID NO: 43187 - DNA, 18 bp, Artificial Sequence
  Synthetic DNA
agttacgcctttcagtag

SEQ ID NO: 43188 - DNA, 18 bp, Artificial Sequence
  Synthetic DNA
agttacgcgtcatcagtg

SEQ ID NO: 43189 - DNA, 18 bp, Artificial Sequence
  Synthetic DNA
agttaggactctctatag

SEQ ID NO: 43190 - DNA, 18 bp, Artificial Sequence
  Synthetic DNA
ataaaatattctcatagg

SEQ ID NO: 43191 - DNA, 18 bp, Artificial Sequence
  Synthetic DNA
ataaacaattaattattg

SEQ ID NO: 43192 - DNA, 18 bp, Artificial Sequence
  Synthetic DNA
ataaacgacactctagag

SEQ ID NO: 43193 - DNA, 18 bp, Artificial Sequence
  Synthetic DNA
ataaacgactaactaaag

SEQ ID NO: 43194 - DNA, 18 bp, Artificial Sequence
  Synthetic DNA
ataaacgactcagagaag

SEQ ID NO: 43195 - DNA, 18 bp, Artificial Sequence
  Synthetic DNA
ataaacgactcgttatag

SEQ ID NO: 43196 - DNA, 18 bp, Artificial Sequence
  Synthetic DNA
ataaacgactctctattg

SEQ ID NO: 43197 - DNA, 18 bp, Artificial Sequence
  Synthetic DNA
ataaacgactctctcttg

SEQ ID NO: 43198 - DNA, 18 bp, Artificial Sequence
  Synthetic DNA
ataaacgacttattatag

SEQ ID NO: 43199 - DNA, 18 bp, Artificial Sequence
  Synthetic DNA
ataaacgattcaatacag

SEQ ID NO: 43200 - DNA, 18 bp, Artificial Sequence
  Synthetic DNA
ataaacggatcactctag

SEQ ID NO: 43201 - DNA, 18 bp, Artificial Sequence
  Synthetic DNA
ataaactactcattatag

SEQ ID NO: 43202 - DNA, 18 bp, Artificial Sequence
  Synthetic DNA
ataaatgactggttaaag

SEQ ID NO: 43203 - DNA, 18 bp, Artificial Sequence
  Synthetic DNA
ataaattactcattatag

SEQ ID NO: 43204 - DNA, 18 bp, Artificial Sequence
  Synthetic DNA
ataaccgactcacattag

SEQ ID NO: 43205 - DNA, 18 bp, Artificial Sequence
  Synthetic DNA
ataagcgactcactttag

SEQ ID NO: 43206 - DNA, 18 bp, Artificial Sequence
  Synthetic DNA
ataagcgactcattctag

SEQ ID NO: 43207 - DNA, 18 bp, Artificial Sequence
  Synthetic DNA
ataagcgacttacttaag

SEQ ID NO: 43208 - DNA, 18 bp, Artificial Sequence
  Synthetic DNA
ataagcgtcacactctag

SEQ ID NO: 43209 - DNA, 18 bp, Artificial Sequence
  Synthetic DNA
ataatagactcactattg

SEQ ID NO: 43210 - DNA, 18 bp, Artificial Sequence
  Synthetic DNA
ataatcaacactctattg

SEQ ID NO: 43211 - DNA, 18 bp, Artificial Sequence
  Synthetic DNA
ataatcgaatcactcttg

SEQ ID NO: 43212 - DNA, 18 bp, Artificial Sequence
  Synthetic DNA
ataatcgactcaccaaag

SEQ ID NO: 43213 - DNA, 18 bp, Artificial Sequence
  Synthetic DNA
ataatcgacttaccattg

SEQ ID NO: 43214 - DNA, 18 bp, Artificial Sequence
  Synthetic DNA
ataatcgagtcactacag

SEQ ID NO: 43215 - DNA, 18 bp, Artificial Sequence
  Synthetic DNA
ataatcgtctcactttcg

SEQ ID NO: 43216 - DNA, 18 bp, Artificial Sequence
  Synthetic DNA
ataatctcctgactatag

SEQ ID NO: 43217 - DNA, 18 bp, Artificial Sequence
  Synthetic DNA
ataattgaccctctatag

SEQ ID NO: 43218 - DNA, 18 bp, Artificial Sequence
  Synthetic DNA
atacacaagacattatag

SEQ ID NO: 43219 - DNA, 18 bp, Artificial Sequence
  Synthetic DNA
atacacaagtgtctaaag

SEQ ID NO: 43220 - DNA, 18 bp, Artificial Sequence
  Synthetic DNA
atacacgaaatactatag

SEQ ID NO: 43221 - DNA, 18 bp, Artificial Sequence
  Synthetic DNA
atacacgaattactattg

SEQ ID NO: 43222 - DNA, 18 bp, Artificial Sequence
  Synthetic DNA
atacacgacactatatag

SEQ ID NO: 43223 - DNA, 18 bp, Artificial Sequence
  Synthetic DNA
atacacgacgctctatag

SEQ ID NO: 43224 - DNA, 18 bp, Artificial Sequence
  Synthetic DNA
atacacgactaccatcag

SEQ ID NO: 43225 - DNA, 18 bp, Artificial Sequence
  Synthetic DNA
atacacgagacaccatag

SEQ ID NO: 43226 - DNA, 18 bp, Artificial Sequence
  Synthetic DNA
atacacgattaactaaag

SEQ ID NO: 43227 - DNA, 18 bp, Artificial Sequence
  Synthetic DNA
atacacgtctaacattag

SEQ ID NO: 43228 - DNA, 18 bp, Artificial Sequence
  Synthetic DNA
atacacgtctcatttttg

SEQ ID NO: 43229 - DNA, 18 bp, Artificial Sequence
  Synthetic DNA
atacatgactctctattg

SEQ ID NO: 43230 - DNA, 18 bp, Artificial Sequence
  Synthetic DNA
atactccactcactatag

SEQ ID NO: 43231 - DNA, 18 bp, Artificial Sequence
  Synthetic DNA
atactcgactctctattg

SEQ ID NO: 43232 - DNA, 18 bp, Artificial Sequence
  Synthetic DNA
atagacgtctatcagtag

SEQ ID NO: 43233 - DNA, 18 bp, Artificial Sequence
  Synthetic DNA
atagtcgaatcactttag

SEQ ID NO: 43234 - DNA, 18 bp, Artificial Sequence
  Synthetic DNA
atataaaactcaataaag

SEQ ID NO: 43235 - DNA, 18 bp, Artificial Sequence
  Synthetic DNA
atataacactcactattg

SEQ ID NO: 43236 - DNA, 18 bp, Artificial Sequence
  Synthetic DNA
atataagaaacactatcg

SEQ ID NO: 43237 - DNA, 18 bp, Artificial Sequence
  Synthetic DNA
atataagaatcactaatg

SEQ ID NO: 43238 - DNA, 18 bp, Artificial Sequence
  Synthetic DNA
atataagaatctctatag

SEQ ID NO: 43239 - DNA, 18 bp, Artificial Sequence
  Synthetic DNA
atataagacatactgtag

SEQ ID NO: 43240 - DNA, 18 bp, Artificial Sequence
  Synthetic DNA
atataagtcactccaatg

SEQ ID NO: 43241 - DNA, 18 bp, Artificial Sequence
  Synthetic DNA
atatacaactcactactg

SEQ ID NO: 43242 - DNA, 18 bp, Artificial Sequence
  Synthetic DNA
atatacaacttgccaaag

SEQ ID NO: 43243 - DNA, 18 bp, Artificial Sequence
  Synthetic DNA
atatacaattcactaaag

SEQ ID NO: 43244 - DNA, 18 bp, Artificial Sequence
  Synthetic DNA
atatacattaattttaag

SEQ ID NO: 43245 - DNA, 18 bp, Artificial Sequence
  Synthetic DNA
atataccactcattcaag

SEQ ID NO: 43246 - DNA, 18 bp, Artificial Sequence
  Synthetic DNA
atatacgaatctctattg

SEQ ID NO: 43247 - DNA, 18 bp, Artificial Sequence
  Synthetic DNA
atatacgacccaatgaag

SEQ ID NO: 43248 - DNA, 18 bp, Artificial Sequence
  Synthetic DNA
atatacgactatttattg

SEQ ID NO: 43249 - DNA, 18 bp, Artificial Sequence
  Synthetic DNA
atatacgactcaacattg

SEQ ID NO: 43250 - DNA, 18 bp, Artificial Sequence
  Synthetic DNA
atatacgactcaacctag

SEQ ID NO: 43251 - DNA, 18 bp, Artificial Sequence
  Synthetic DNA
atatacgactcacctttg

SEQ ID NO: 43252 - DNA, 18 bp, Artificial Sequence
  Synthetic DNA
atatacgactctttattg

SEQ ID NO: 43253 - DNA, 18 bp, Artificial Sequence
  Synthetic DNA
atatacgacttactactg

SEQ ID NO: 43254 - DNA, 18 bp, Artificial Sequence
  Synthetic DNA
atatacgattcccttttg

SEQ ID NO: 43255 - DNA, 18 bp, Artificial Sequence
  Synthetic DNA
atatacgccacattatag

SEQ ID NO: 43256 - DNA, 18 bp, Artificial Sequence
  Synthetic DNA
atatacgccactttatag

SEQ ID NO: 43257 - DNA, 18 bp, Artificial Sequence
  Synthetic DNA
atatacgccctcctttag

SEQ ID NO: 43258 - DNA, 18 bp, Artificial Sequence
  Synthetic DNA
atatacgcctcgctacag

SEQ ID NO: 43259 - DNA, 18 bp, Artificial Sequence
  Synthetic DNA
atatacgcctgaatactg

SEQ ID NO: 43260 - DNA, 18 bp, Artificial Sequence
  Synthetic DNA
atatacgccttccaattg

SEQ ID NO: 43261 - DNA, 18 bp, Artificial Sequence
  Synthetic DNA
atatacgcgtggttgaag

SEQ ID NO: 43262 - DNA, 18 bp, Artificial Sequence
  Synthetic DNA
atatacgtcgccctatag

SEQ ID NO: 43263 - DNA, 18 bp, Artificial Sequence
  Synthetic DNA
atatacgtctctccatgg

SEQ ID NO: 43264 - DNA, 18 bp, Artificial Sequence
  Synthetic DNA
atatactaatccctattg

SEQ ID NO: 43265 - DNA, 18 bp, Artificial Sequence
  Synthetic DNA
atatactacacataatag

SEQ ID NO: 43266 - DNA, 18 bp, Artificial Sequence
  Synthetic DNA
atatactactcatgctcg

SEQ ID NO: 43267 - DNA, 18 bp, Artificial Sequence
  Synthetic DNA
atatactattcagttcag

SEQ ID NO: 43268 - DNA, 18 bp, Artificial Sequence
  Synthetic DNA
atatacttcttactatag

SEQ ID NO: 43269 - DNA, 18 bp, Artificial Sequence
  Synthetic DNA
atatacttttgactatag

SEQ ID NO: 43270 - DNA, 18 bp, Artificial Sequence
  Synthetic DNA
atatagaagtcactaatg

SEQ ID NO: 43271 - DNA, 18 bp, Artificial Sequence
  Synthetic DNA
atataggactcaccatcg

SEQ ID NO: 43272 - DNA, 18 bp, Artificial Sequence
  Synthetic DNA
atataggactctctattg

SEQ ID NO: 43273 - DNA, 18 bp, Artificial Sequence
  Synthetic DNA
atataggtctcactaagg

SEQ ID NO: 43274 - DNA, 18 bp, Artificial Sequence
  Synthetic DNA
atatagtactcacaatag

SEQ ID NO: 43275 - DNA, 18 bp, Artificial Sequence
  Synthetic DNA
atatataacttactttag

SEQ ID NO: 43276 - DNA, 18 bp, Artificial Sequence
  Synthetic DNA
atatatgactctctacag

SEQ ID NO: 43277 - DNA, 18 bp, Artificial Sequence
  Synthetic DNA
atatatgactcttaattg

SEQ ID NO: 43278 - DNA, 18 bp, Artificial Sequence
  Synthetic DNA
atatatgattaactaaag

SEQ ID NO: 43279 - DNA, 18 bp, Artificial Sequence
  Synthetic DNA
atatattacacagtatag

SEQ ID NO: 43280 - DNA, 18 bp, Artificial Sequence
  Synthetic DNA
atatattactcaataaag

SEQ ID NO: 43281 - DNA, 18 bp, Artificial Sequence
  Synthetic DNA
atatccaattcacaatag

SEQ ID NO: 43282 - DNA, 18 bp, Artificial Sequence
  Synthetic DNA
atatccgactttcaatag

SEQ ID NO: 43283 - DNA, 18 bp, Artificial Sequence
  Synthetic DNA
atatcggactcacaatgg

SEQ ID NO: 43284 - DNA, 18 bp, Artificial Sequence
  Synthetic DNA
atatctatctcactattg

SEQ ID NO: 43285 - DNA, 18 bp, Artificial Sequence
  Synthetic DNA
atatgatactcactatag

SEQ ID NO: 43286 - DNA, 18 bp, Artificial Sequence
  Synthetic DNA
atatgcgactcaataaag

SEQ ID NO: 43287 - DNA, 18 bp, Artificial Sequence
  Synthetic DNA
atatgcgccaaactatag

SEQ ID NO: 43288 - DNA, 18 bp, Artificial Sequence
  Synthetic DNA
atatgcgtatctctcgag

SEQ ID NO: 43289 - DNA, 18 bp, Artificial Sequence
  Synthetic DNA
atatgcgtttgactttag

SEQ ID NO: 43290 - DNA, 18 bp, Artificial Sequence
  Synthetic DNA
atatgctacattatatag

SEQ ID NO: 43291 - DNA, 18 bp, Artificial Sequence
  Synthetic DNA
atattagaatctctaaag

SEQ ID NO: 43292 - DNA, 18 bp, Artificial Sequence
  Synthetic DNA
atattagactttccttag

SEQ ID NO: 43293 - DNA, 18 bp, Artificial Sequence
  Synthetic DNA
atattataatcagtatag

SEQ ID NO: 43294 - DNA, 18 bp, Artificial Sequence
  Synthetic DNA
atattcaacacacttgag

SEQ ID NO: 43295 - DNA, 18 bp, Artificial Sequence
  Synthetic DNA
atattcaactcactctag

SEQ ID NO: 43296 - DNA, 18 bp, Artificial Sequence
  Synthetic DNA
atattcaattctgtatag

SEQ ID NO: 43297 - DNA, 18 bp, Artificial Sequence
  Synthetic DNA
atattccaattactatcg

SEQ ID NO: 43298 - DNA, 18 bp, Artificial Sequence
  Synthetic DNA
atattcgacccacttaag

SEQ ID NO: 43299 - DNA, 18 bp, Artificial Sequence
  Synthetic DNA
atattcgacgcacaattg

SEQ ID NO: 43300 - DNA, 18 bp, Artificial Sequence
  Synthetic DNA
atattcgactgtctatag

SEQ ID NO: 43301 - DNA, 18 bp, Artificial Sequence
  Synthetic DNA
atattctactcactaatg

SEQ ID NO: 43302 - DNA, 18 bp, Artificial Sequence
  Synthetic DNA
atattctactccctctag

SEQ ID NO: 43303 - DNA, 18 bp, Artificial Sequence
  Synthetic DNA
atattcttgtagctattg

SEQ ID NO: 43304 - DNA, 18 bp, Artificial Sequence
  Synthetic DNA
atattggactaagtttag

SEQ ID NO: 43305 - DNA, 18 bp, Artificial Sequence
  Synthetic DNA
atatttatctcaatatag

SEQ ID NO: 43306 - DNA, 18 bp, Artificial Sequence
  Synthetic DNA
atcaacgcctcacaatag

SEQ ID NO: 43307 - DNA, 18 bp, Artificial Sequence
  Synthetic DNA
atccattactctttatag

SEQ ID NO: 43308 - DNA, 18 bp, Artificial Sequence
  Synthetic DNA
atcctcgtcttactctag

SEQ ID NO: 43309 - DNA, 18 bp, Artificial Sequence
  Synthetic DNA
atccttgacactccctag

SEQ ID NO: 43310 - DNA, 18 bp, Artificial Sequence
  Synthetic DNA
atcgaattctcattaaag

SEQ ID NO: 43311 - DNA, 18 bp, Artificial Sequence
  Synthetic DNA
atctacgaatgactatag

SEQ ID NO: 43312 - DNA, 18 bp, Artificial Sequence
  Synthetic DNA
atctacggctagataacg

SEQ ID NO: 43313 - DNA, 18 bp, Artificial Sequence
  Synthetic DNA
atctactattcactatag

SEQ ID NO: 43314 - DNA, 18 bp, Artificial Sequence
  Synthetic DNA
atctttaaatcactatag

SEQ ID NO: 43315 - DNA, 18 bp, Artificial Sequence
  Synthetic DNA
atgaaccgctcactatag

SEQ ID NO: 43316 - DNA, 18 bp, Artificial Sequence
  Synthetic DNA
atgaacgactcaatatag

SEQ ID NO: 43317 - DNA, 18 bp, Artificial Sequence
  Synthetic DNA
atgaacgattcactattg

SEQ ID NO: 43318 - DNA, 18 bp, Artificial Sequence
  Synthetic DNA
atgaacgcaattctatag

SEQ ID NO: 43319 - DNA, 18 bp, Artificial Sequence
  Synthetic DNA
atgatcgatccactgttg

SEQ ID NO: 43320 - DNA, 18 bp, Artificial Sequence
  Synthetic DNA
atgcacaacacactattg

SEQ ID NO: 43321 - DNA, 18 bp, Artificial Sequence
  Synthetic DNA
atgcacgactctcaatag

SEQ ID NO: 43322 - DNA, 18 bp, Artificial Sequence
  Synthetic DNA
atgtaagacatactaaag

SEQ ID NO: 43323 - DNA, 18 bp, Artificial Sequence
  Synthetic DNA
atgtacgaccaacaactg

SEQ ID NO: 43324 - DNA, 18 bp, Artificial Sequence
  Synthetic DNA
atgtattactcactattg

SEQ ID NO: 43325 - DNA, 18 bp, Artificial Sequence
  Synthetic DNA
atgtcctacgctcaatag

SEQ ID NO: 43326 - DNA, 18 bp, Artificial Sequence
  Synthetic DNA
attaaagattgaacatag

SEQ ID NO: 43327 - DNA, 18 bp, Artificial Sequence
  Synthetic DNA
attaaagtctctctatag

SEQ ID NO: 43328 - DNA, 18 bp, Artificial Sequence
  Synthetic DNA
attaacgactctttaatg

SEQ ID NO: 43329 - DNA, 18 bp, Artificial Sequence
  Synthetic DNA
attcacgagccactattg

SEQ ID NO: 43330 - DNA, 18 bp, Artificial Sequence
  Synthetic DNA
attcacgttgcacaatag

SEQ ID NO: 43331 - DNA, 18 bp, Artificial Sequence
  Synthetic DNA
attcagaactcactttag

SEQ ID NO: 43332 - DNA, 18 bp, Artificial Sequence
  Synthetic DNA
attgacttctctctattg

SEQ ID NO: 43333 - DNA, 18 bp, Artificial Sequence
  Synthetic DNA
atttaagacttattattg

SEQ ID NO: 43334 - DNA, 18 bp, Artificial Sequence
  Synthetic DNA
atttacaacccactcaag

SEQ ID NO: 43335 - DNA, 18 bp, Artificial Sequence
  Synthetic DNA
atttacatttcgcatttg

SEQ ID NO: 43336 - DNA, 18 bp, Artificial Sequence
  Synthetic DNA
atttacgaaccacaattg

SEQ ID NO: 43337 - DNA, 18 bp, Artificial Sequence
  Synthetic DNA
atttacgacaaactaaag

SEQ ID NO: 43338 - DNA, 18 bp, Artificial Sequence
  Synthetic DNA
atttacgactcaccgtag

SEQ ID NO: 43339 - DNA, 18 bp, Artificial Sequence
  Synthetic DNA
atttacgacttacgatag

SEQ ID NO: 43340 - DNA, 18 bp, Artificial Sequence
  Synthetic DNA
atttacgagacaccaacg

SEQ ID NO: 43341 - DNA, 18 bp, Artificial Sequence
  Synthetic DNA
atttacgagccacaattg

SEQ ID NO: 43342 - DNA, 18 bp, Artificial Sequence
  Synthetic DNA
atttacgatatactttag

SEQ ID NO: 43343 - DNA, 18 bp, Artificial Sequence
  Synthetic DNA
atttactaatcacttttg

SEQ ID NO: 43344 - DNA, 18 bp, Artificial Sequence
  Synthetic DNA
atttagtactcactatag

SEQ ID NO: 43345 - DNA, 18 bp, Artificial Sequence
  Synthetic DNA
atttatgacatactatag

SEQ ID NO: 43346 - DNA, 18 bp, Artificial Sequence
  Synthetic DNA
atttgcgcctcactaaag

SEQ ID NO: 43347 - DNA, 18 bp, Artificial Sequence
  Synthetic DNA
atttgcggcccaatatag

SEQ ID NO: 43348 - DNA, 18 bp, Artificial Sequence
  Synthetic DNA
attttcgaatctctatag

SEQ ID NO: 43349 - DNA, 18 bp, Artificial Sequence
  Synthetic DNA
attttcgacacacataag

SEQ ID NO: 43350 - DNA, 18 bp, Artificial Sequence
  Synthetic DNA
attttcgagtcactttag

SEQ ID NO: 43351 - DNA, 18 bp, Artificial Sequence
  Synthetic DNA
atttttgactccccatag

SEQ ID NO: 43352 - DNA, 18 bp, Artificial Sequence
  Synthetic DNA
caaaaagactccccattg

SEQ ID NO: 43353 - DNA, 18 bp, Artificial Sequence
  Synthetic DNA
caaaaagattcacaatag

SEQ ID NO: 43354 - DNA, 18 bp, Artificial Sequence
  Synthetic DNA
caaaaagcgtcaatatag

SEQ ID NO: 43355 - DNA, 18 bp, Artificial Sequence
  Synthetic DNA
caaaaatacttacaatag

SEQ ID NO: 43356 - DNA, 18 bp, Artificial Sequence
  Synthetic DNA
caaaacaacaccctatag

SEQ ID NO: 43357 - DNA, 18 bp, Artificial Sequence
  Synthetic DNA
caaaacaacactctaaag

SEQ ID NO: 43358 - DNA, 18 bp, Artificial Sequence
  Synthetic DNA
caaaaccattctttaaag

SEQ ID NO: 43359 - DNA, 18 bp, Artificial Sequence
  Synthetic DNA
caaaacgacagacaaatg

SEQ ID NO: 43360 - DNA, 18 bp, Artificial Sequence
  Synthetic DNA
caaaacgactatctgctg

SEQ ID NO: 43361 - DNA, 18 bp, Artificial Sequence
  Synthetic DNA
caaaacgactccattaag

SEQ ID NO: 43362 - DNA, 18 bp, Artificial Sequence
  Synthetic DNA
caaaacgactcgcactag

SEQ ID NO: 43363 - DNA, 18 bp, Artificial Sequence
  Synthetic DNA
caaaacgcttcattgttg

SEQ ID NO: 43364 - DNA, 18 bp, Artificial Sequence
  Synthetic DNA
caaaactaatcaccgtag

SEQ ID NO: 43365 - DNA, 18 bp, Artificial Sequence
  Synthetic DNA
caaaactattctcacaag

SEQ ID NO: 43366 - DNA, 18 bp, Artificial Sequence
  Synthetic DNA
caaaatgacactctattg

SEQ ID NO: 43367 - DNA, 18 bp, Artificial Sequence
  Synthetic DNA
caaaatgattcacaatag

SEQ ID NO: 43368 - DNA, 18 bp, Artificial Sequence
  Synthetic DNA
caaaatgtttcactatag

SEQ ID NO: 43369 - DNA, 18 bp, Artificial Sequence
  Synthetic DNA
caaatattctcactaaag

SEQ ID NO: 43370 - DNA, 18 bp, Artificial Sequence
  Synthetic DNA
caaatcgactcacactag

SEQ ID NO: 43371 - DNA, 18 bp, Artificial Sequence
  Synthetic DNA
caaatcgtttaactaaag

SEQ ID NO: 43372 - DNA, 18 bp, Artificial Sequence
  Synthetic DNA
caaatctaataaatatag

SEQ ID NO: 43373 - DNA, 18 bp, Artificial Sequence
  Synthetic DNA
caacacgactctctcaag

SEQ ID NO: 43374 - DNA, 18 bp, Artificial Sequence
  Synthetic DNA
caacccgaatttctttag

SEQ ID NO: 43375 - DNA, 18 bp, Artificial Sequence
  Synthetic DNA
caacccgactcaagatag

SEQ ID NO: 43376 - DNA, 18 bp, Artificial Sequence
  Synthetic DNA
caacccgactcacaattg

SEQ ID NO: 43377 - DNA, 18 bp, Artificial Sequence
  Synthetic DNA
caacggtactcaatatcg

SEQ ID NO: 43378 - DNA, 18 bp, Artificial Sequence
  Synthetic DNA
caagaatactctctaaag

SEQ ID NO: 43379 - DNA, 18 bp, Artificial Sequence
  Synthetic DNA
caagacatctctctattg

SEQ ID NO: 43380 - DNA, 18 bp, Artificial Sequence
  Synthetic DNA
caagacgactagctttag

SEQ ID NO: 43381 - DNA, 18 bp, Artificial Sequence
  Synthetic DNA
caagactagaaactatcg

SEQ ID NO: 43382 - DNA, 18 bp, Artificial Sequence
  Synthetic DNA
caataagactctctcacg

SEQ ID NO: 43383 - DNA, 18 bp, Artificial Sequence
  Synthetic DNA
caataagacttcattttg

SEQ ID NO: 43384 - DNA, 18 bp, Artificial Sequence
  Synthetic DNA
caataagattcactcttg

SEQ ID NO: 43385 - DNA, 18 bp, Artificial Sequence
  Synthetic DNA
caataagtctaattaaag

SEQ ID NO: 43386 - DNA, 18 bp, Artificial Sequence
  Synthetic DNA
caataatacttacatctg

SEQ ID NO: 43387 - DNA, 18 bp, Artificial Sequence
  Synthetic DNA
caatacaacaaactatgg

SEQ ID NO: 43388 - DNA, 18 bp, Artificial Sequence
  Synthetic DNA
caatacaatacattattg

SEQ ID NO: 43389 - DNA, 18 bp, Artificial Sequence
  Synthetic DNA
caatacaattctctacag

SEQ ID NO: 43390 - DNA, 18 bp, Artificial Sequence
  Synthetic DNA
caatacatagcagtattg

SEQ ID NO: 43391 - DNA, 18 bp, Artificial Sequence
  Synthetic DNA
caatacatcagattttag

SEQ ID NO: 43392 - DNA, 18 bp, Artificial Sequence
  Synthetic DNA
caataccacttcctatgg

SEQ ID NO: 43393 - DNA, 18 bp, Artificial Sequence
  Synthetic DNA
caataccattcacaactg

SEQ ID NO: 43394 - DNA, 18 bp, Artificial Sequence
  Synthetic DNA
caataccattcagtacag

SEQ ID NO: 43395 - DNA, 18 bp, Artificial Sequence
  Synthetic DNA
caatacccctcacaaacg

SEQ ID NO: 43396 - DNA, 18 bp, Artificial Sequence
  Synthetic DNA
caataccccttattatcg

SEQ ID NO: 43397 - DNA, 18 bp, Artificial Sequence
  Synthetic DNA
caatacgaaacaccaatg

SEQ ID NO: 43398 - DNA, 18 bp, Artificial Sequence
  Synthetic DNA
caatacgaatctctaatg

SEQ ID NO: 43399 - DNA, 18 bp, Artificial Sequence
  Synthetic DNA
caatacgactcctttcag

SEQ ID NO: 43400 - DNA, 18 bp, Artificial Sequence
  Synthetic DNA
caatacgactctcctatg

SEQ ID NO: 43401 - DNA, 18 bp, Artificial Sequence
  Synthetic DNA
caatacgactgaatagtg

SEQ ID NO: 43402 - DNA, 18 bp, Artificial Sequence
  Synthetic DNA
caatacgactgaattttg

SEQ ID NO: 43403 - DNA, 18 bp, Artificial Sequence
  Synthetic DNA
caatacgagatacttacg

SEQ ID NO: 43404 - DNA, 18 bp, Artificial Sequence
  Synthetic DNA
caatacgatattatacag

SEQ ID NO: 43405 - DNA, 18 bp, Artificial Sequence
  Synthetic DNA
caatacgattaactaatg

SEQ ID NO: 43406 - DNA, 18 bp, Artificial Sequence
  Synthetic DNA
caatacgattcacttata

SEQ ID NO: 43407 - DNA, 18 bp, Artificial Sequence
  Synthetic DNA
caatacgattcgtacctg

SEQ ID NO: 43408 - DNA, 18 bp, Artificial Sequence
  Synthetic DNA
caatacgcatcactgtcg

SEQ ID NO: 43409 - DNA, 18 bp, Artificial Sequence
  Synthetic DNA
caatacgccaccctttcg

SEQ ID NO: 43410 - DNA, 18 bp, Artificial Sequence
  Synthetic DNA
caatacgccactataatg

SEQ ID NO: 43411 - DNA, 18 bp, Artificial Sequence
  Synthetic DNA
caatacgcctccataaag

SEQ ID NO: 43412 - DNA, 18 bp, Artificial Sequence
  Synthetic DNA
caatacgtcctactaaag

SEQ ID NO: 43413 - DNA, 18 bp, Artificial Sequence
  Synthetic DNA
caatacgtctctctggag

SEQ ID NO: 43414 - DNA, 18 bp, Artificial Sequence
  Synthetic DNA
caatacgttactctatag

SEQ ID NO: 43415 - DNA, 18 bp, Artificial Sequence
  Synthetic DNA
caatactaatctctaaag

SEQ ID NO: 43416 - DNA, 18 bp, Artificial Sequence
  Synthetic DNA
caatactacaaacaaaag

SEQ ID NO: 43417 - DNA, 18 bp, Artificial Sequence
  Synthetic DNA
caatactacactctttag

SEQ ID NO: 43418 - DNA, 18 bp, Artificial Sequence
  Synthetic DNA
caatactactcccaattg

SEQ ID NO: 43419 - DNA, 18 bp, Artificial Sequence
  Synthetic DNA
caatactcctatattttg

SEQ ID NO: 43420 - DNA, 18 bp, Artificial Sequence
  Synthetic DNA
caatactctccattatag

SEQ ID NO: 43421 - DNA, 18 bp, Artificial Sequence
  Synthetic DNA
caatacttctcacgaaag

SEQ ID NO: 43422 - DNA, 18 bp, Artificial Sequence
  Synthetic DNA
caatagaagttactttgg

SEQ ID NO: 43423 - DNA, 18 bp, Artificial Sequence
  Synthetic DNA
caatagttctcactttag

SEQ ID NO: 43424 - DNA, 18 bp, Artificial Sequence
  Synthetic DNA
caatatcaccgactatag

SEQ ID NO: 43425 - DNA, 18 bp, Artificial Sequence
  Synthetic DNA
caatatgactaacattag

SEQ ID NO: 43426 - DNA, 18 bp, Artificial Sequence
  Synthetic DNA
caatatgactatgaatag

SEQ ID NO: 43427 - DNA, 18 bp, Artificial Sequence
  Synthetic DNA
caatatgactctttttag

SEQ ID NO: 43428 - DNA, 18 bp, Artificial Sequence
  Synthetic DNA
caatatgtcacaatccag

SEQ ID NO: 43429 - DNA, 18 bp, Artificial Sequence
  Synthetic DNA
caatatgtttccctatag

SEQ ID NO: 43430 - DNA, 18 bp, Artificial Sequence
  Synthetic DNA
caatcagattcactattg

SEQ ID NO: 43431 - DNA, 18 bp, Artificial Sequence
  Synthetic DNA
caatcagtcacattttag

SEQ ID NO: 43432 - DNA, 18 bp, Artificial Sequence
  Synthetic DNA
caatccaactcccaaaag

SEQ ID NO: 43433 - DNA, 18 bp, Artificial Sequence
  Synthetic DNA
caatccgaataacaatgg

SEQ ID NO: 43434 - DNA, 18 bp, Artificial Sequence
  Synthetic DNA
caatccgactcacttacg

SEQ ID NO: 43435 - DNA, 18 bp, Artificial Sequence
  Synthetic DNA
caatccgactcgtaaatg

SEQ ID NO: 43436 - DNA, 18 bp, Artificial Sequence
  Synthetic DNA
caatccgattcacttacg

SEQ ID NO: 43437 - DNA, 18 bp, Artificial Sequence
  Synthetic DNA
caatcggacacacgatag

SEQ ID NO: 43438 - DNA, 18 bp, Artificial Sequence
  Synthetic DNA
caatgagtcatgcttttg

SEQ ID NO: 43439 - DNA, 18 bp, Artificial Sequence
  Synthetic DNA
caatgcaacacacaatag

SEQ ID NO: 43440 - DNA, 18 bp, Artificial Sequence
  Synthetic DNA
caatgcacgtcactttag

SEQ ID NO: 43441 - DNA, 18 bp, Artificial Sequence
  Synthetic DNA
caatgcgtctgattagag

SEQ ID NO: 43442 - DNA, 18 bp, Artificial Sequence
  Synthetic DNA
caatgcttctctttttag

SEQ ID NO: 43443 - DNA, 18 bp, Artificial Sequence
  Synthetic DNA
caatgggaatctctaacg

SEQ ID NO: 43444 - DNA, 18 bp, Artificial Sequence
  Synthetic DNA
caattaatctcacgatag

SEQ ID NO: 43445 - DNA, 18 bp, Artificial Sequence
  Synthetic DNA
caattacactcactacag

SEQ ID NO: 43446 - DNA, 18 bp, Artificial Sequence
  Synthetic DNA
caattagactttcaaatg

SEQ ID NO: 43447 - DNA, 18 bp, Artificial Sequence
  Synthetic DNA
caattccacacaccatag

SEQ ID NO: 43448 - DNA, 18 bp, Artificial Sequence
  Synthetic DNA
caattcgaatctccattg

SEQ ID NO: 43449 - DNA, 18 bp, Artificial Sequence
  Synthetic DNA
caattcgaatcttaaaag

SEQ ID NO: 43450 - DNA, 18 bp, Artificial Sequence
  Synthetic DNA
caattcgtataaataatg

SEQ ID NO: 43451 - DNA, 18 bp, Artificial Sequence
  Synthetic DNA
caattcgtcccactaaag

SEQ ID NO: 43452 - DNA, 18 bp, Artificial Sequence
  Synthetic DNA
caattcttcttactatag

SEQ ID NO: 43453 - DNA, 18 bp, Artificial Sequence
  Synthetic DNA
caatttgacattccaaag

SEQ ID NO: 43454 - DNA, 18 bp, Artificial Sequence
  Synthetic DNA
caatttttctatctatag

SEQ ID NO: 43455 - DNA, 18 bp, Artificial Sequence
  Synthetic DNA
cacaccgattctctatag

SEQ ID NO: 43456 - DNA, 18 bp, Artificial Sequence
  Synthetic DNA
cacaccttctatcaagag

SEQ ID NO: 43457 - DNA, 18 bp, Artificial Sequence
  Synthetic DNA
cacatccaatcgttatag

SEQ ID NO: 43458 - DNA, 18 bp, Artificial Sequence
  Synthetic DNA
caccacgaatcactttag

SEQ ID NO: 43459 - DNA, 18 bp, Artificial Sequence
  Synthetic DNA
cacgaccactcaatatag

SEQ ID NO: 43460 - DNA, 18 bp, Artificial Sequence
  Synthetic DNA
cactaccacccacatttg

SEQ ID NO: 43461 - DNA, 18 bp, Artificial Sequence
  Synthetic DNA
cactaccactcacttcag

SEQ ID NO: 43462 - DNA, 18 bp, Artificial Sequence
  Synthetic DNA
cactaccactcattattg

SEQ ID NO: 43463 - DNA, 18 bp, Artificial Sequence
  Synthetic DNA
cactacgacctactattg

SEQ ID NO: 43464 - DNA, 18 bp, Artificial Sequence
  Synthetic DNA
cactacgtgtcgctatag

SEQ ID NO: 43465 - DNA, 18 bp, Artificial Sequence
  Synthetic DNA
cactacttatatctatgg

SEQ ID NO: 43466 - DNA, 18 bp, Artificial Sequence
  Synthetic DNA
cactacttcacattatag

SEQ ID NO: 43467 - DNA, 18 bp, Artificial Sequence
  Synthetic DNA
cactatgattcacacaag

SEQ ID NO: 43468 - DNA, 18 bp, Artificial Sequence
  Synthetic DNA
cactattcctcaataaag

SEQ ID NO: 43469 - DNA, 18 bp, Artificial Sequence
  Synthetic DNA
cactgcgaatctctatag

SEQ ID NO: 43470 - DNA, 18 bp, Artificial Sequence
  Synthetic DNA
cacttccaccatttatag

SEQ ID NO: 43471 - DNA, 18 bp, Artificial Sequence
  Synthetic DNA
cactttgaatatcgatag

SEQ ID NO: 43472 - DNA, 18 bp, Artificial Sequence
  Synthetic DNA
cagaaattgtcacttctg

SEQ ID NO: 43473 - DNA, 18 bp, Artificial Sequence
  Synthetic DNA
cagatcgtctcactatag

SEQ ID NO: 43474 - DNA, 18 bp, Artificial Sequence
  Synthetic DNA
cagcaccgcacaataaag

SEQ ID NO: 43475 - DNA, 18 bp, Artificial Sequence
  Synthetic DNA
cagtacgaataacaatag

SEQ ID NO: 43476 - DNA, 18 bp, Artificial Sequence
  Synthetic DNA
cagtacgagtcaataaag

SEQ ID NO: 43477 - DNA, 18 bp, Artificial Sequence
  Synthetic DNA
cagtacgagttgataaag

SEQ ID NO: 43478 - DNA, 18 bp, Artificial Sequence
  Synthetic DNA
cagtagtaatctattaag

SEQ ID NO: 43479 - DNA, 18 bp, Artificial Sequence
  Synthetic DNA
cagtatgacacatacaag

SEQ ID NO: 43480 - DNA, 18 bp, Artificial Sequence
  Synthetic DNA
cagtgcgactcaatttag

SEQ ID NO: 43481 - DNA, 18 bp, Artificial Sequence
  Synthetic DNA
cagtgtgactcactctag

SEQ ID NO: 43482 - DNA, 18 bp, Artificial Sequence
  Synthetic DNA
cagtttgacccaatatag

SEQ ID NO: 43483 - DNA, 18 bp, Artificial Sequence
  Synthetic DNA
cataacgacgcaccatag

SEQ ID NO: 43484 - DNA, 18 bp, Artificial Sequence
  Synthetic DNA
cataacgactttctaagg

SEQ ID NO: 43485 - DNA, 18 bp, Artificial Sequence
  Synthetic DNA
cataacggcacactatcg

SEQ ID NO: 43486 - DNA, 18 bp, Artificial Sequence
  Synthetic DNA
cataacgtttaacattag

SEQ ID NO: 43487 - DNA, 18 bp, Artificial Sequence
  Synthetic DNA
cataatgacactctaaag

SEQ ID NO: 43488 - DNA, 18 bp, Artificial Sequence
  Synthetic DNA
catatcgagcctatatcg

SEQ ID NO: 43489 - DNA, 18 bp, Artificial Sequence
  Synthetic DNA
catattgagtcactcaag

SEQ ID NO: 43490 - DNA, 18 bp, Artificial Sequence
  Synthetic DNA
catcacaattcacaatag

SEQ ID NO: 43491 - DNA, 18 bp, Artificial Sequence
  Synthetic DNA
catcacggctcataaagg

SEQ ID NO: 43492 - DNA, 18 bp, Artificial Sequence
  Synthetic DNA
catcttgactcaatagtg

SEQ ID NO: 43493 - DNA, 18 bp, Artificial Sequence
  Synthetic DNA
cattaaaactcactttag

SEQ ID NO: 43494 - DNA, 18 bp, Artificial Sequence
  Synthetic DNA
cattaagcctcactttag

SEQ ID NO: 43495 - DNA, 18 bp, Artificial Sequence
  Synthetic DNA
cattaaggcttcctttag

SEQ ID NO: 43496 - DNA, 18 bp, Artificial Sequence
  Synthetic DNA
cattacaacttagtctag

SEQ ID NO: 43497 - DNA, 18 bp, Artificial Sequence
  Synthetic DNA
cattacacccctcaatcg

SEQ ID NO: 43498 - DNA, 18 bp, Artificial Sequence
  Synthetic DNA
cattacatctgtcaatag

SEQ ID NO: 43499 - DNA, 18 bp, Artificial Sequence
  Synthetic DNA
cattaccacccactttag

SEQ ID NO: 43500 - DNA, 18 bp, Artificial Sequence
  Synthetic DNA
cattacgaatccctagag

SEQ ID NO: 43501 - DNA, 18 bp, Artificial Sequence
  Synthetic DNA
cattacgacccaatattg

SEQ ID NO: 43502 - DNA, 18 bp, Artificial Sequence
  Synthetic DNA
cattacgacccgcttcag

SEQ ID NO: 43503 - DNA, 18 bp, Artificial Sequence
  Synthetic DNA
cattacgatgcactttag

SEQ ID NO: 43504 - DNA, 18 bp, Artificial Sequence
  Synthetic DNA
cattacggattactatag

SEQ ID NO: 43505 - DNA, 18 bp, Artificial Sequence
  Synthetic DNA
cattacgtcactctaaag

SEQ ID NO: 43506 - DNA, 18 bp, Artificial Sequence
  Synthetic DNA
cattacgtcccactagag

SEQ ID NO: 43507 - DNA, 18 bp, Artificial Sequence
  Synthetic DNA
cattacgtgtctctaatg

SEQ ID NO: 43508 - DNA, 18 bp, Artificial Sequence
  Synthetic DNA
cattactaatctcaatag

SEQ ID NO: 43509 - DNA, 18 bp, Artificial Sequence
  Synthetic DNA
cattactcctcatttcag

SEQ ID NO: 43510 - DNA, 18 bp, Artificial Sequence
  Synthetic DNA
cattatgactcacaatcg

SEQ ID NO: 43511 - DNA, 18 bp, Artificial Sequence
  Synthetic DNA
cattatgactcagtattg

SEQ ID NO: 43512 - DNA, 18 bp, Artificial Sequence
  Synthetic DNA
cattatgattcaccgttg

SEQ ID NO: 43513 - DNA, 18 bp, Artificial Sequence
  Synthetic DNA
cattatgattcgctttag

SEQ ID NO: 43514 - DNA, 18 bp, Artificial Sequence
  Synthetic DNA
catttagactcactttag

SEQ ID NO: 43515 - DNA, 18 bp, Artificial Sequence
  Synthetic DNA
catttcgacaaatcatag

SEQ ID NO: 43516 - DNA, 18 bp, Artificial Sequence
  Synthetic DNA
catttcgacatactattg

SEQ ID NO: 43517 - DNA, 18 bp, Artificial Sequence
  Synthetic DNA
catttcgactcactaagg

SEQ ID NO: 43518 - DNA, 18 bp, Artificial Sequence
  Synthetic DNA
catttcgcttcaacttgg

SEQ ID NO: 43519 - DNA, 18 bp, Artificial Sequence
  Synthetic DNA
cattttgacccactaatg

SEQ ID NO: 43520 - DNA, 18 bp, Artificial Sequence
  Synthetic DNA
ccaaactacacactatag

SEQ ID NO: 43521 - DNA, 18 bp, Artificial Sequence
  Synthetic DNA
ccataagtgccacaacgg

SEQ ID NO: 43522 - DNA, 18 bp, Artificial Sequence
  Synthetic DNA
ccatacaacttagtaaag

SEQ ID NO: 43523 - DNA, 18 bp, Artificial Sequence
  Synthetic DNA
ccatacaccatactatag

SEQ ID NO: 43524 - DNA, 18 bp, Artificial Sequence
  Synthetic DNA
ccatacgactcacatatg

SEQ ID NO: 43525 - DNA, 18 bp, Artificial Sequence
  Synthetic DNA
ccatacgactgtcactag

SEQ ID NO: 43526 - DNA, 18 bp, Artificial Sequence
  Synthetic DNA
ccatacgattcactaatg

SEQ ID NO: 43527 - DNA, 18 bp, Artificial Sequence
  Synthetic DNA
ccatacgatttacgatag

SEQ ID NO: 43528 - DNA, 18 bp, Artificial Sequence
  Synthetic DNA
ccatacggctaaatttag

SEQ ID NO: 43529 - DNA, 18 bp, Artificial Sequence
  Synthetic DNA
ccatactactctctttag

SEQ ID NO: 43530 - DNA, 18 bp, Artificial Sequence
  Synthetic DNA
ccatgccattcacaacag

SEQ ID NO: 43531 - DNA, 18 bp, Artificial Sequence
  Synthetic DNA
cctaaagaatcactatag

SEQ ID NO: 43532 - DNA, 18 bp, Artificial Sequence
  Synthetic DNA
cctcatgacttactatag

SEQ ID NO: 43533 - DNA, 18 bp, Artificial Sequence
  Synthetic DNA
ccttacgacttgctatag

SEQ ID NO: 43534 - DNA, 18 bp, Artificial Sequence
  Synthetic DNA
cgaaaagattctttatag

SEQ ID NO: 43535 - DNA, 18 bp, Artificial Sequence
  Synthetic DNA
cgaaacgactccctattg

SEQ ID NO: 43536 - DNA, 18 bp, Artificial Sequence
  Synthetic DNA
cgaaacgactctctactg

SEQ ID NO: 43537 - DNA, 18 bp, Artificial Sequence
  Synthetic DNA
cgaaacgatacactacag

SEQ ID NO: 43538 - DNA, 18 bp, Artificial Sequence
  Synthetic DNA
cgaaaggactcactaatg

SEQ ID NO: 43539 - DNA, 18 bp, Artificial Sequence
  Synthetic DNA
cgatccaactcacttgtg

SEQ ID NO: 43540 - DNA, 18 bp, Artificial Sequence
  Synthetic DNA
cgatctgacccactaaag

SEQ ID NO: 43541 - DNA, 18 bp, Artificial Sequence
  Synthetic DNA
cgattcgactctcaaaag

SEQ ID NO: 43542 - DNA, 18 bp, Artificial Sequence
  Synthetic DNA
cgcaacgacacccaattg

SEQ ID NO: 43543 - DNA, 18 bp, Artificial Sequence
  Synthetic DNA
cggttcgtctctcaatcg

SEQ ID NO: 43544 - DNA, 18 bp, Artificial Sequence
  Synthetic DNA
cggttcgtctctctttag

SEQ ID NO: 43545 - DNA, 18 bp, Artificial Sequence
  Synthetic DNA
cgtaacgactcatttttg

SEQ ID NO: 43546 - DNA, 18 bp, Artificial Sequence
  Synthetic DNA
cgttacatctcactgttg

SEQ ID NO: 43547 - DNA, 18 bp, Artificial Sequence
  Synthetic DNA
cgttagaacacataatag

SEQ ID NO: 43548 - DNA, 18 bp, Artificial Sequence
  Synthetic DNA
ctaaaccacacacttgag

SEQ ID NO: 43549 - DNA, 18 bp, Artificial Sequence
  Synthetic DNA
ctaaaccacatcggctag

SEQ ID NO: 43550 - DNA, 18 bp, Artificial Sequence
  Synthetic DNA
ctaaacgactgactttag

SEQ ID NO: 43551 - DNA, 18 bp, Artificial Sequence
  Synthetic DNA
ctaaacgtctcactatgg

SEQ ID NO: 43552 - DNA, 18 bp, Artificial Sequence
  Synthetic DNA
ctaatctacacactatgg

SEQ ID NO: 43553 - DNA, 18 bp, Artificial Sequence
  Synthetic DNA
ctaatctacacactttag

SEQ ID NO: 43554 - DNA, 18 bp, Artificial Sequence
  Synthetic DNA
ctaatgcacttattatag

SEQ ID NO: 43555 - DNA, 18 bp, Artificial Sequence
  Synthetic DNA
ctacacgattcacaatag

SEQ ID NO: 43556 - DNA, 18 bp, Artificial Sequence
  Synthetic DNA
ctacacgatttactaacg

SEQ ID NO: 43557 - DNA, 18 bp, Artificial Sequence
  Synthetic DNA
ctacactactcaatacag

SEQ ID NO: 43558 - DNA, 18 bp, Artificial Sequence
  Synthetic DNA
ctagacgactatccactg

SEQ ID NO: 43559 - DNA, 18 bp, Artificial Sequence
  Synthetic DNA
ctataaaactcacagtgg

SEQ ID NO: 43560 - DNA, 18 bp, Artificial Sequence
  Synthetic DNA
ctataacactcactaatg

SEQ ID NO: 43561 - DNA, 18 bp, Artificial Sequence
  Synthetic DNA
ctataagagtcactaaag

SEQ ID NO: 43562 - DNA, 18 bp, Artificial Sequence
  Synthetic DNA
ctatacaaatgactatag

SEQ ID NO: 43563 - DNA, 18 bp, Artificial Sequence
  Synthetic DNA
ctatacaactcactgtgg

SEQ ID NO: 43564 - DNA, 18 bp, Artificial Sequence
  Synthetic DNA
ctatacgaatctgtattg

SEQ ID NO: 43565 - DNA, 18 bp, Artificial Sequence
  Synthetic DNA
ctatacgaccctatacag

SEQ ID NO: 43566 - DNA, 18 bp, Artificial Sequence
  Synthetic DNA
ctatacgactgcctaacg

SEQ ID NO: 43567 - DNA, 18 bp, Artificial Sequence
  Synthetic DNA
ctatacgagtctctacag

SEQ ID NO: 43568 - DNA, 18 bp, Artificial Sequence
  Synthetic DNA
ctatacgtctacctatag

SEQ ID NO: 43569 - DNA, 18 bp, Artificial Sequence
  Synthetic DNA
ctatacgtctcataacag

SEQ ID NO: 43570 - DNA, 18 bp, Artificial Sequence
  Synthetic DNA
ctatactcctcacttttg

SEQ ID NO: 43571 - DNA, 18 bp, Artificial Sequence
  Synthetic DNA
ctatctgactaaataatg

SEQ ID NO: 43572 - DNA, 18 bp, Artificial Sequence
  Synthetic DNA
ctatgagtgtggcaatag

SEQ ID NO: 43573 - DNA, 18 bp, Artificial Sequence
  Synthetic DNA
ctatgcgatccactatag

SEQ ID NO: 43574 - DNA, 18 bp, Artificial Sequence
  Synthetic DNA
ctattcatccctcgatag

SEQ ID NO: 43575 - DNA, 18 bp, Artificial Sequence
  Synthetic DNA
ctattcgactcgctaaag

SEQ ID NO: 43576 - DNA, 18 bp, Artificial Sequence
  Synthetic DNA
ctcaaatactctctagag

SEQ ID NO: 43577 - DNA, 18 bp, Artificial Sequence
  Synthetic DNA
ctcaacgacccactaaag

SEQ ID NO: 43578 - DNA, 18 bp, Artificial Sequence
  Synthetic DNA
ctctacgactgactatgg

SEQ ID NO: 43579 - DNA, 18 bp, Artificial Sequence
  Synthetic DNA
ctctacgtctcacttcag

SEQ ID NO: 43580 - DNA, 18 bp, Artificial Sequence
  Synthetic DNA
ctctatgactctctgttg

SEQ ID NO: 43581 - DNA, 18 bp, Artificial Sequence
  Synthetic DNA
ctctctgactctcaaaag

SEQ ID NO: 43582 - DNA, 18 bp, Artificial Sequence
  Synthetic DNA
ctcttagactaagcaaag

SEQ ID NO: 43583 - DNA, 18 bp, Artificial Sequence
  Synthetic DNA
ctgtacgtcgcactatcg

SEQ ID NO: 43584 - DNA, 18 bp, Artificial Sequence
  Synthetic DNA
ctgtactacttacattag

SEQ ID NO: 43585 - DNA, 18 bp, Artificial Sequence
  Synthetic DNA
ctgttcgaatctctatag

SEQ ID NO: 43586 - DNA, 18 bp, Artificial Sequence
  Synthetic DNA
ctgttcgactcacaaaag

SEQ ID NO: 43587 - DNA, 18 bp, Artificial Sequence
  Synthetic DNA
cttaacaactcattatag

SEQ ID NO: 43588 - DNA, 18 bp, Artificial Sequence
  Synthetic DNA
cttaacaacttactattg

SEQ ID NO: 43589 - DNA, 18 bp, Artificial Sequence
  Synthetic DNA
cttaatcactaacaaaag

SEQ ID NO: 43590 - DNA, 18 bp, Artificial Sequence
  Synthetic DNA
cttctctactaattaaag

SEQ ID NO: 43591 - DNA, 18 bp, Artificial Sequence
  Synthetic DNA
ctttaatttccacaattg

SEQ ID NO: 43592 - DNA, 18 bp, Artificial Sequence
  Synthetic DNA
ctttacgaatcactaaag

SEQ ID NO: 43593 - DNA, 18 bp, Artificial Sequence
  Synthetic DNA
ctttacgagcgacttgag

SEQ ID NO: 43594 - DNA, 18 bp, Artificial Sequence
  Synthetic DNA
ctttacgataaactatag

SEQ ID NO: 43595 - DNA, 18 bp, Artificial Sequence
  Synthetic DNA
ctttgcgactctgtatag

SEQ ID NO: 43596 - DNA, 18 bp, Artificial Sequence
  Synthetic DNA
gaaaacgtcacaccatag

SEQ ID NO: 43597 - DNA, 18 bp, Artificial Sequence
  Synthetic DNA
gaaaaggactccaatcag

SEQ ID NO: 43598 - DNA, 18 bp, Artificial Sequence
  Synthetic DNA
gaaaccgacgctctattg

SEQ ID NO: 43599 - DNA, 18 bp, Artificial Sequence
  Synthetic DNA
gaaagatacacggcttag

SEQ ID NO: 43600 - DNA, 18 bp, Artificial Sequence
  Synthetic DNA
gaaatagattcaatatag

SEQ ID NO: 43601 - DNA, 18 bp, Artificial Sequence
  Synthetic DNA
gaaatccacttactttcg

SEQ ID NO: 43602 - DNA, 18 bp, Artificial Sequence
  Synthetic DNA
gaaatggaatctttactg

SEQ ID NO: 43603 - DNA, 18 bp, Artificial Sequence
  Synthetic DNA
gaaattgacttactacag

SEQ ID NO: 43604 - DNA, 18 bp, Artificial Sequence
  Synthetic DNA
gaacataactaacaactg

SEQ ID NO: 43605 - DNA, 18 bp, Artificial Sequence
  Synthetic DNA
gaactcgacttactaacg

SEQ ID NO: 43606 - DNA, 18 bp, Artificial Sequence
  Synthetic DNA
gaagtctacttaccatag

SEQ ID NO: 43607 - DNA, 18 bp, Artificial Sequence
  Synthetic DNA
gaataaaccatgcaatag

SEQ ID NO: 43608 - DNA, 18 bp, Artificial Sequence
  Synthetic DNA
gaataagactaatcttag

SEQ ID NO: 43609 - DNA, 18 bp, Artificial Sequence
  Synthetic DNA
gaataagactcagaacag

SEQ ID NO: 43610 - DNA, 18 bp, Artificial Sequence
  Synthetic DNA
gaataatactgccaaaag

SEQ ID NO: 43611 - DNA, 18 bp, Artificial Sequence
  Synthetic DNA
gaataattgaaactatag

SEQ ID NO: 43612 - DNA, 18 bp, Artificial Sequence
  Synthetic DNA
gaatacaacatattgtag

SEQ ID NO: 43613 - DNA, 18 bp, Artificial Sequence
  Synthetic DNA
gaatacaactaatatatg

SEQ ID NO: 43614 - DNA, 18 bp, Artificial Sequence
  Synthetic DNA
gaatacaactcaagttag

SEQ ID NO: 43615 - DNA, 18 bp, Artificial Sequence
  Synthetic DNA
gaatacaagttagtgtag

SEQ ID NO: 43616 - DNA, 18 bp, Artificial Sequence
  Synthetic DNA
gaatacacctctttacag

SEQ ID NO: 43617 - DNA, 18 bp, Artificial Sequence
  Synthetic DNA
gaataccacacattttag

SEQ ID NO: 43618 - DNA, 18 bp, Artificial Sequence
  Synthetic DNA
gaatacgaaaatctaaag

SEQ ID NO: 43619 - DNA, 18 bp, Artificial Sequence
  Synthetic DNA
gaatacgacactaagtag

SEQ ID NO: 43620 - DNA, 18 bp, Artificial Sequence
  Synthetic DNA
gaatacgccccactcttg

SEQ ID NO: 43621 - DNA, 18 bp, Artificial Sequence
  Synthetic DNA
gaatacgtatcactactg

SEQ ID NO: 43622 - DNA, 18 bp, Artificial Sequence
  Synthetic DNA
gaatacgtcaaattatag

SEQ ID NO: 43623 - DNA, 18 bp, Artificial Sequence
  Synthetic DNA
gaatacgtcacacggaag

SEQ ID NO: 43624 - DNA, 18 bp, Artificial Sequence
  Synthetic DNA
gaatactattatcttaag

SEQ ID NO: 43625 - DNA, 18 bp, Artificial Sequence
  Synthetic DNA
gaatataacactatttag

SEQ ID NO: 43626 - DNA, 18 bp, Artificial Sequence
  Synthetic DNA
gaatataacactctattg

SEQ ID NO: 43627 - DNA, 18 bp, Artificial Sequence
  Synthetic DNA
gaatatcactcactcttg

SEQ ID NO: 43628 - DNA, 18 bp, Artificial Sequence
  Synthetic DNA
gaatatgactctccctag

SEQ ID NO: 43629 - DNA, 18 bp, Artificial Sequence
  Synthetic DNA
gaatattacccaataacg

SEQ ID NO: 43630 - DNA, 18 bp, Artificial Sequence
  Synthetic DNA
gaatattcctcattatag

SEQ ID NO: 43631 - DNA, 18 bp, Artificial Sequence
  Synthetic DNA
gaatccgtctcactaacg

SEQ ID NO: 43632 - DNA, 18 bp, Artificial Sequence
  Synthetic DNA
gaatccgtctctcatatg

SEQ ID NO: 43633 - DNA, 18 bp, Artificial Sequence
  Synthetic DNA
gaatcttactatctctag

SEQ ID NO: 43634 - DNA, 18 bp, Artificial Sequence
  Synthetic DNA
gaatgccatttacgacag

SEQ ID NO: 43635 - DNA, 18 bp, Artificial Sequence
  Synthetic DNA
gaatgcgactctccaaag

SEQ ID NO: 43636 - DNA, 18 bp, Artificial Sequence
  Synthetic DNA
gaattcgatacaaaatag

SEQ ID NO: 43637 - DNA, 18 bp, Artificial Sequence
  Synthetic DNA
gaattcgcctctcattag

SEQ ID NO: 43638 - DNA, 18 bp, Artificial Sequence
  Synthetic DNA
gaattgaactcggtatag

SEQ ID NO: 43639 - DNA, 18 bp, Artificial Sequence
  Synthetic DNA
gacaccgactcacaattg

SEQ ID NO: 43640 - DNA, 18 bp, Artificial Sequence
  Synthetic DNA
gactacgaatagctatag

SEQ ID NO: 43641 - DNA, 18 bp, Artificial Sequence
  Synthetic DNA
gactagtactcactaaag

SEQ ID NO: 43642 - DNA, 18 bp, Artificial Sequence
  Synthetic DNA
gactatggctctcaatag

SEQ ID NO: 43643 - DNA, 18 bp, Artificial Sequence
  Synthetic DNA
gagcatgagtctcgatcg

SEQ ID NO: 43644 - DNA, 18 bp, Artificial Sequence
  Synthetic DNA
gataatgaccctctatag

SEQ ID NO: 43645 - DNA, 18 bp, Artificial Sequence
  Synthetic DNA
gatgtggacactctatag

SEQ ID NO: 43646 - DNA, 18 bp, Artificial Sequence
  Synthetic DNA
gattaagagactctatag

SEQ ID NO: 43647 - DNA, 18 bp, Artificial Sequence
  Synthetic DNA
gattaagcctctctttag

SEQ ID NO: 43648 - DNA, 18 bp, Artificial Sequence
  Synthetic DNA
gattacgaatcacatatg

SEQ ID NO: 43649 - DNA, 18 bp, Artificial Sequence
  Synthetic DNA
gattacgacgcacaattg

SEQ ID NO: 43650 - DNA, 18 bp, Artificial Sequence
  Synthetic DNA
gattacggctaactcaag

SEQ ID NO: 43651 - DNA, 18 bp, Artificial Sequence
  Synthetic DNA
gattactacacaatatag

SEQ ID NO: 43652 - DNA, 18 bp, Artificial Sequence
  Synthetic DNA
gattactactagctattg

SEQ ID NO: 43653 - DNA, 18 bp, Artificial Sequence
  Synthetic DNA
gattacttcactctatag

SEQ ID NO: 43654 - DNA, 18 bp, Artificial Sequence
  Synthetic DNA
gattacttcccacaaaag

SEQ ID NO: 43655 - DNA, 18 bp, Artificial Sequence
  Synthetic DNA
gattaggtcttactttag

SEQ ID NO: 43656 - DNA, 18 bp, Artificial Sequence
  Synthetic DNA
gattatgacttaattaag

SEQ ID NO: 43657 - DNA, 18 bp, Artificial Sequence
  Synthetic DNA
gattccgacttgctaaag

SEQ ID NO: 43658 - DNA, 18 bp, Artificial Sequence
  Synthetic DNA
gattgcggctcactaaag

SEQ ID NO: 43659 - DNA, 18 bp, Artificial Sequence
  Synthetic DNA
gatttcgtctcattatag

SEQ ID NO: 43660 - DNA, 18 bp, Artificial Sequence
  Synthetic DNA
gcaatgcacttctattag

SEQ ID NO: 43661 - DNA, 18 bp, Artificial Sequence
  Synthetic DNA
gcataagtctttataaag

SEQ ID NO: 43662 - DNA, 18 bp, Artificial Sequence
  Synthetic DNA
gcatacaacttacttagg

SEQ ID NO: 43663 - DNA, 18 bp, Artificial Sequence
  Synthetic DNA
gcatacatctcactaaag

SEQ ID NO: 43664 - DNA, 18 bp, Artificial Sequence
  Synthetic DNA
gcatacgacaaccaattt

SEQ ID NO: 43665 - DNA, 18 bp, Artificial Sequence
  Synthetic DNA
gcatacgcctcactcatg

SEQ ID NO: 43666 - DNA, 18 bp, Artificial Sequence
  Synthetic DNA
gcatacgtcacttaaaag

SEQ ID NO: 43667 - DNA, 18 bp, Artificial Sequence
  Synthetic DNA
gcatacgttatagtttag

SEQ ID NO: 43668 - DNA, 18 bp, Artificial Sequence
  Synthetic DNA
gcatactacttattatag

SEQ ID NO: 43669 - DNA, 18 bp, Artificial Sequence
  Synthetic DNA
gcatataactctttatag

SEQ ID NO: 43670 - DNA, 18 bp, Artificial Sequence
  Synthetic DNA
gcatgtgactgacgattg

SEQ ID NO: 43671 - DNA, 18 bp, Artificial Sequence
  Synthetic DNA
gcttacgacactctatag

SEQ ID NO: 43672 - DNA, 18 bp, Artificial Sequence
  Synthetic DNA
ggaaacaacccactattg

SEQ ID NO: 43673 - DNA, 18 bp, Artificial Sequence
  Synthetic DNA
ggatacgacatactattg

SEQ ID NO: 43674 - DNA, 18 bp, Artificial Sequence
  Synthetic DNA
ggatacgattctccattg

SEQ ID NO: 43675 - DNA, 18 bp, Artificial Sequence
  Synthetic DNA
ggatacgtctgccaatcg

SEQ ID NO: 43676 - DNA, 18 bp, Artificial Sequence
  Synthetic DNA
ggatgcacctctctaaag

SEQ ID NO: 43677 - DNA, 18 bp, Artificial Sequence
  Synthetic DNA
gtaaacgactctttcttg

SEQ ID NO: 43678 - DNA, 18 bp, Artificial Sequence
  Synthetic DNA
gtaaacgccatactatag

SEQ ID NO: 43679 - DNA, 18 bp, Artificial Sequence
  Synthetic DNA
gtaattgattcactatag

SEQ ID NO: 43680 - DNA, 18 bp, Artificial Sequence
  Synthetic DNA
gtactcgagtcattattg

SEQ ID NO: 43681 - DNA, 18 bp, Artificial Sequence
  Synthetic DNA
gtatacaccaaactatag

SEQ ID NO: 43682 - DNA, 18 bp, Artificial Sequence
  Synthetic DNA
gtatacgtatcaccatag

SEQ ID NO: 43683 - DNA, 18 bp, Artificial Sequence
  Synthetic DNA
gtatactaatcactttag

SEQ ID NO: 43684 - DNA, 18 bp, Artificial Sequence
  Synthetic DNA
gtatacttctcactattg

SEQ ID NO: 43685 - DNA, 18 bp, Artificial Sequence
  Synthetic DNA
gtatacttcttactaaag

SEQ ID NO: 43686 - DNA, 18 bp, Artificial Sequence
  Synthetic DNA
gtataggcatcactttag

SEQ ID NO: 43687 - DNA, 18 bp, Artificial Sequence
  Synthetic DNA
gtatatgattcactatcg

SEQ ID NO: 43688 - DNA, 18 bp, Artificial Sequence
  Synthetic DNA
gtatccagctcactatag

SEQ ID NO: 43689 - DNA, 18 bp, Artificial Sequence
  Synthetic DNA
gtatgcgactcatcatgg

SEQ ID NO: 43690 - DNA, 18 bp, Artificial Sequence
  Synthetic DNA
gtctacgactcactaacg

SEQ ID NO: 43691 - DNA, 18 bp, Artificial Sequence
  Synthetic DNA
gtgtacgacccattaaag

SEQ ID NO: 43692 - DNA, 18 bp, Artificial Sequence
  Synthetic DNA
gtgttcgcctcactattg

SEQ ID NO: 43693 - DNA, 18 bp, Artificial Sequence
  Synthetic DNA
gtttgcgacttactatag

SEQ ID NO: 43694 - DNA, 18 bp, Artificial Sequence
  Synthetic DNA
gttttcgattcactattg

SEQ ID NO: 43695 - DNA, 18 bp, Artificial Sequence
  Synthetic DNA
taaaaacacgatgtgtcg

SEQ ID NO: 43696 - DNA, 18 bp, Artificial Sequence
  Synthetic DNA
taaaaacatttactatcg

SEQ ID NO: 43697 - DNA, 18 bp, Artificial Sequence
  Synthetic DNA
taaaaagaatctctatcg

SEQ ID NO: 43698 - DNA, 18 bp, Artificial Sequence
  Synthetic DNA
taaaaagacatgctgtag

SEQ ID NO: 43699 - DNA, 18 bp, Artificial Sequence
  Synthetic DNA
taaaaagacattctaaag

SEQ ID NO: 43700 - DNA, 18 bp, Artificial Sequence
  Synthetic DNA
taaaaagactaacacaag

SEQ ID NO: 43701 - DNA, 18 bp, Artificial Sequence
  Synthetic DNA
taaaaagactaccaatag

SEQ ID NO: 43702 - DNA, 18 bp, Artificial Sequence
  Synthetic DNA
taaaaagactagccatag

SEQ ID NO: 43703 - DNA, 18 bp, Artificial Sequence
  Synthetic DNA
taaaaagactggctacag

SEQ ID NO: 43704 - DNA, 18 bp, Artificial Sequence
  Synthetic DNA
taaaaagactttttttcg

SEQ ID NO: 43705 - DNA, 18 bp, Artificial Sequence
  Synthetic DNA
taaaaagagttatgacag

SEQ ID NO: 43706 - DNA, 18 bp, Artificial Sequence
  Synthetic DNA
taaaaagattctcctaag

SEQ ID NO: 43707 - DNA, 18 bp, Artificial Sequence
  Synthetic DNA
taaaaagtctcgcaatgg

SEQ ID NO: 43708 - DNA, 18 bp, Artificial Sequence
  Synthetic DNA
taaaaagttccaaagtag

SEQ ID NO: 43709 - DNA, 18 bp, Artificial Sequence
  Synthetic DNA
taaaacaacccaaaattg

SEQ ID NO: 43710 - DNA, 18 bp, Artificial Sequence
  Synthetic DNA
taaaacaaccccctattg

SEQ ID NO: 43711 - DNA, 18 bp, Artificial Sequence
  Synthetic DNA
taaaacaactaattaagg

SEQ ID NO: 43712 - DNA, 18 bp, Artificial Sequence
  Synthetic DNA
taaaacaactcagcttag

SEQ ID NO: 43713 - DNA, 18 bp, Artificial Sequence
  Synthetic DNA
taaaacaagtaactacag

SEQ ID NO: 43714 - DNA, 18 bp, Artificial Sequence
  Synthetic DNA
taaaacaagtcaatttag

SEQ ID NO: 43715 - DNA, 18 bp, Artificial Sequence
  Synthetic DNA
taaaacacctcacactag

SEQ ID NO: 43716 - DNA, 18 bp, Artificial Sequence
  Synthetic DNA
taaaacatcattcaaaag

SEQ ID NO: 43717 - DNA, 18 bp, Artificial Sequence
  Synthetic DNA
taaaacatcattccatag

SEQ ID NO: 43718 - DNA, 18 bp, Artificial Sequence
  Synthetic DNA
taaaacatctcacgattg

SEQ ID NO: 43719 - DNA, 18 bp, Artificial Sequence
  Synthetic DNA
taaaaccacgagcaagag

SEQ ID NO: 43720 - DNA, 18 bp, Artificial Sequence
  Synthetic DNA
taaaaccactcacttctg

SEQ ID NO: 43721 - DNA, 18 bp, Artificial Sequence
  Synthetic DNA
taaaaccactcatcttag

SEQ ID NO: 43722 - DNA, 18 bp, Artificial Sequence
  Synthetic DNA
taaaaccacttaattttg

SEQ ID NO: 43723 - DNA, 18 bp, Artificial Sequence
  Synthetic DNA
taaaaccatcgtcgatag

SEQ ID NO: 43724 - DNA, 18 bp, Artificial Sequence
  Synthetic DNA
taaaacccctaactattg

SEQ ID NO: 43725 - DNA, 18 bp, Artificial Sequence
  Synthetic DNA
taaaaccgctcagtactg

SEQ ID NO: 43726 - DNA, 18 bp, Artificial Sequence
  Synthetic DNA
taaaacctcccaattaag

SEQ ID NO: 43727 - DNA, 18 bp, Artificial Sequence
  Synthetic DNA
taaaacctctcactgaag

SEQ ID NO: 43728 - DNA, 18 bp, Artificial Sequence
  Synthetic DNA
taaaacgaaacacaccag

SEQ ID NO: 43729 - DNA, 18 bp, Artificial Sequence
  Synthetic DNA
taaaacgaaacattcatg

SEQ ID NO: 43730 - DNA, 18 bp, Artificial Sequence
  Synthetic DNA
taaaacgaattactttgg

SEQ ID NO: 43731 - DNA, 18 bp, Artificial Sequence
  Synthetic DNA
taaaacgacaatacatag

SEQ ID NO: 43732 - DNA, 18 bp, Artificial Sequence
  Synthetic DNA
taaaacgacatattctag

SEQ ID NO: 43733 - DNA, 18 bp, Artificial Sequence
  Synthetic DNA
taaaacgacatccaattg

SEQ ID NO: 43734 - DNA, 18 bp, Artificial Sequence
  Synthetic DNA
taaaacgacccaacttag

SEQ ID NO: 43735 - DNA, 18 bp, Artificial Sequence
  Synthetic DNA
taaaacgacctagtctcg

SEQ ID NO: 43736 - DNA, 18 bp, Artificial Sequence
  Synthetic DNA
taaaacgacctattttag

SEQ ID NO: 43737 - DNA, 18 bp, Artificial Sequence
  Synthetic DNA
taaaacgacgcaatctcg

SEQ ID NO: 43738 - DNA, 18 bp, Artificial Sequence
  Synthetic DNA
taaaacgacgctctaccg

SEQ ID NO: 43739 - DNA, 18 bp, Artificial Sequence
  Synthetic DNA
taaaacgactaagttttg

SEQ ID NO: 43740 - DNA, 18 bp, Artificial Sequence
  Synthetic DNA
taaaacgactgaccaatg

SEQ ID NO: 43741 - DNA, 18 bp, Artificial Sequence
  Synthetic DNA
taaaacgacttataaaag

SEQ ID NO: 43742 - DNA, 18 bp, Artificial Sequence
  Synthetic DNA
taaaacgactttttacag

SEQ ID NO: 43743 - DNA, 18 bp, Artificial Sequence
  Synthetic DNA
taaaacgagacactcatg

SEQ ID NO: 43744 - DNA, 18 bp, Artificial Sequence
  Synthetic DNA
taaaacgagtttttatag

SEQ ID NO: 43745 - DNA, 18 bp, Artificial Sequence
  Synthetic DNA
taaaacgattcaattttg

SEQ ID NO: 43746 - DNA, 18 bp, Artificial Sequence
  Synthetic DNA
taaaacgattcagcttag

SEQ ID NO: 43747 - DNA, 18 bp, Artificial Sequence
  Synthetic DNA
taaaacgattcattgttg

SEQ ID NO: 43748 - DNA, 18 bp, Artificial Sequence
  Synthetic DNA
taaaacgattttgaatag

SEQ ID NO: 43749 - DNA, 18 bp, Artificial Sequence
  Synthetic DNA
taaaacggaagactgtag

SEQ ID NO: 43750 - DNA, 18 bp, Artificial Sequence
  Synthetic DNA
taaaacggcaaaatgttg

SEQ ID NO: 43751 - DNA, 18 bp, Artificial Sequence
  Synthetic DNA
taaaacggcacagtacag

SEQ ID NO: 43752 - DNA, 18 bp, Artificial Sequence
  Synthetic DNA
taaaacggcagtctatag

SEQ ID NO: 43753 - DNA, 18 bp, Artificial Sequence
  Synthetic DNA
taaaacggctcccaaacg

SEQ ID NO: 43754 - DNA, 18 bp, Artificial Sequence
  Synthetic DNA
taaaacgtatccttatag

SEQ ID NO: 43755 - DNA, 18 bp, Artificial Sequence
  Synthetic DNA
taaaacgtctatttattg

SEQ ID NO: 43756 - DNA, 18 bp, Artificial Sequence
  Synthetic DNA
taaaacgtctcacagcag

SEQ ID NO: 43757 - DNA, 18 bp, Artificial Sequence
  Synthetic DNA
taaaacgtctccataacg

SEQ ID NO: 43758 - DNA, 18 bp, Artificial Sequence
  Synthetic DNA
taaaacgtctctctaggg

SEQ ID NO: 43759 - DNA, 18 bp, Artificial Sequence
  Synthetic DNA
taaaacgtctctctgctg

SEQ ID NO: 43760 - DNA, 18 bp, Artificial Sequence
  Synthetic DNA
taaaacgtctctttgaag

SEQ ID NO: 43761 - DNA, 18 bp, Artificial Sequence
  Synthetic DNA
taaaacgtctgtctgagg

SEQ ID NO: 43762 - DNA, 18 bp, Artificial Sequence
  Synthetic DNA
taaaacgtctgtgtttag

SEQ ID NO: 43763 - DNA, 18 bp, Artificial Sequence
  Synthetic DNA
taaaacgtcttaccattg

SEQ ID NO: 43764 - DNA, 18 bp, Artificial Sequence
  Synthetic DNA
taaaacgtcttaccgcag

SEQ ID NO: 43765 - DNA, 18 bp, Artificial Sequence
  Synthetic DNA
taaaacgtcttcctacag

SEQ ID NO: 43766 - DNA, 18 bp, Artificial Sequence
  Synthetic DNA
taaaacgtcttgctaaag

SEQ ID NO: 43767 - DNA, 18 bp, Artificial Sequence
  Synthetic DNA
taaaactaaaccttttag

SEQ ID NO: 43768 - DNA, 18 bp, Artificial Sequence
  Synthetic DNA
taaaactaatcactgcag

SEQ ID NO: 43769 - DNA, 18 bp, Artificial Sequence
  Synthetic DNA
taaaactacactctacag

SEQ ID NO: 43770 - DNA, 18 bp, Artificial Sequence
  Synthetic DNA
taaaactactaacgatgg

SEQ ID NO: 43771 - DNA, 18 bp, Artificial Sequence
  Synthetic DNA
taaaactactcatttcag

SEQ ID NO: 43772 - DNA, 18 bp, Artificial Sequence
  Synthetic DNA
taaaactattcacttgag

SEQ ID NO: 43773 - DNA, 18 bp, Artificial Sequence
  Synthetic DNA
taaaactattccctatgg

SEQ ID NO: 43774 - DNA, 18 bp, Artificial Sequence
  Synthetic DNA
taaaagaacactcataag

SEQ ID NO: 43775 - DNA, 18 bp, Artificial Sequence
  Synthetic DNA
taaaagcactcacttcag

SEQ ID NO: 43776 - DNA, 18 bp, Artificial Sequence
  Synthetic DNA
taaaagcacttatctaag

SEQ ID NO: 43777 - DNA, 18 bp, Artificial Sequence
  Synthetic DNA
taaaaggaaacacaatag

SEQ ID NO: 43778 - DNA, 18 bp, Artificial Sequence
  Synthetic DNA
taaaaggaaccaacatag

SEQ ID NO: 43779 - DNA, 18 bp, Artificial Sequence
  Synthetic DNA
taaaaggaagcactttag

SEQ ID NO: 43780 - DNA, 18 bp, Artificial Sequence
  Synthetic DNA
taaaaggaatcataacag

SEQ ID NO: 43781 - DNA, 18 bp, Artificial Sequence
  Synthetic DNA
taaaaggaatttatttag

SEQ ID NO: 43782 - DNA, 18 bp, Artificial Sequence
  Synthetic DNA
taaaaggactacttatag

SEQ ID NO: 43783 - DNA, 18 bp, Artificial Sequence
  Synthetic DNA
taaaaggactcgttatcg

SEQ ID NO: 43784 - DNA, 18 bp, Artificial Sequence
  Synthetic DNA
taaaaggactctctagtg

SEQ ID NO: 43785 - DNA, 18 bp, Artificial Sequence
  Synthetic DNA
taaaaggattcactaacg

SEQ ID NO: 43786 - DNA, 18 bp, Artificial Sequence
  Synthetic DNA
taaaaggtttcacgatgg

SEQ ID NO: 43787 - DNA, 18 bp, Artificial Sequence
  Synthetic DNA
taaaagttctcactcgag

SEQ ID NO: 43788 - DNA, 18 bp, Artificial Sequence
  Synthetic DNA
taaaatcacacataatag

SEQ ID NO: 43789 - DNA, 18 bp, Artificial Sequence
  Synthetic DNA
taaaatctctcacagttg

SEQ ID NO: 43790 - DNA, 18 bp, Artificial Sequence
  Synthetic DNA
taaaatgaatctttatag

SEQ ID NO: 43791 - DNA, 18 bp, Artificial Sequence
  Synthetic DNA
taaaatgactcacaaccg

SEQ ID NO: 43792 - DNA, 18 bp, Artificial Sequence
  Synthetic DNA
taaaatgacttaaatcag

SEQ ID NO: 43793 - DNA, 18 bp, Artificial Sequence
  Synthetic DNA
taaaatgagtaacgatag

SEQ ID NO: 43794 - DNA, 18 bp, Artificial Sequence
  Synthetic DNA
taaaatgataaactatag

SEQ ID NO: 43795 - DNA, 18 bp, Artificial Sequence
  Synthetic DNA
taaaatgatacactgttg

SEQ ID NO: 43796 - DNA, 18 bp, Artificial Sequence
  Synthetic DNA
taaaatgattcaaaatag

SEQ ID NO: 43797 - DNA, 18 bp, Artificial Sequence
  Synthetic DNA
taaaatgcctcaaaatag

SEQ ID NO: 43798 - DNA, 18 bp, Artificial Sequence
  Synthetic DNA
taaaatgtatacctaaag

SEQ ID NO: 43799 - DNA, 18 bp, Artificial Sequence
  Synthetic DNA
taaaatgtatatctatag

SEQ ID NO: 43800 - DNA, 18 bp, Artificial Sequence
  Synthetic DNA
taaaatgtcactctaatg

SEQ ID NO: 43801 - DNA, 18 bp, Artificial Sequence
  Synthetic DNA
taaaattaaccactatag

SEQ ID NO: 43802 - DNA, 18 bp, Artificial Sequence
  Synthetic DNA
taaaattacacgctatag

SEQ ID NO: 43803 - DNA, 18 bp, Artificial Sequence
  Synthetic DNA
taaaattactctctagag

SEQ ID NO: 43804 - DNA, 18 bp, Artificial Sequence
  Synthetic DNA
taaaattcccctatatag

SEQ ID NO: 43805 - DNA, 18 bp, Artificial Sequence
  Synthetic DNA
taaaatttctcacagtag

SEQ ID NO: 43806 - DNA, 18 bp, Artificial Sequence
  Synthetic DNA
taaacattcaaactatag

SEQ ID NO: 43807 - DNA, 18 bp, Artificial Sequence
  Synthetic DNA
taaaccaactcattgttg

SEQ ID NO: 43808 - DNA, 18 bp, Artificial Sequence
  Synthetic DNA
taaaccgacgctctattg

SEQ ID NO: 43809 - DNA, 18 bp, Artificial Sequence
  Synthetic DNA
taaaccgactccttaaag

SEQ ID NO: 43810 - DNA, 18 bp, Artificial Sequence
  Synthetic DNA
taaaccgagtcactttcg

SEQ ID NO: 43811 - DNA, 18 bp, Artificial Sequence
  Synthetic DNA
taaaccgtctgaccattg

SEQ ID NO: 43812 - DNA, 18 bp, Artificial Sequence
  Synthetic DNA
taaacctacttaccacag

SEQ ID NO: 43813 - DNA, 18 bp, Artificial Sequence
  Synthetic DNA
taaacgaactctctatag

SEQ ID NO: 43814 - DNA, 18 bp, Artificial Sequence
  Synthetic DNA
taaactgacagactttag

SEQ ID NO: 43815 - DNA, 18 bp, Artificial Sequence
  Synthetic DNA
taaactgactctcttaag

SEQ ID NO: 43816 - DNA, 18 bp, Artificial Sequence
  Synthetic DNA
taaagactctaactaaag

SEQ ID NO: 43817 - DNA, 18 bp, Artificial Sequence
  Synthetic DNA
taaagccactcgctacag

SEQ ID NO: 43818 - DNA, 18 bp, Artificial Sequence
  Synthetic DNA
taaagccactctttattg

SEQ ID NO: 43819 - DNA, 18 bp, Artificial Sequence
  Synthetic DNA
taaagcgaatcgctttag

SEQ ID NO: 43820 - DNA, 18 bp, Artificial Sequence
  Synthetic DNA
taaagcgactagcgtttg

SEQ ID NO: 43821 - DNA, 18 bp, Artificial Sequence
  Synthetic DNA
taaagcgactcacttatg

SEQ ID NO: 43822 - DNA, 18 bp, Artificial Sequence
  Synthetic DNA
taaagcgattctagatag

SEQ ID NO: 43823 - DNA, 18 bp, Artificial Sequence
  Synthetic DNA
taaagcgtcacacgatag

SEQ ID NO: 43824 - DNA, 18 bp, Artificial Sequence
  Synthetic DNA
taaagcgtcacacttttg

SEQ ID NO: 43825 - DNA, 18 bp, Artificial Sequence
  Synthetic DNA
taaagcgtccaactatgg

SEQ ID NO: 43826 - DNA, 18 bp, Artificial Sequence
  Synthetic DNA
taaagctgctcactattg

SEQ ID NO: 43827 - DNA, 18 bp, Artificial Sequence
  Synthetic DNA
taaataaactcacactag

SEQ ID NO: 43828 - DNA, 18 bp, Artificial Sequence
  Synthetic DNA
taaataaagtcacttaag

SEQ ID NO: 43829 - DNA, 18 bp, Artificial Sequence
  Synthetic DNA
taaatagcctcactatcg

SEQ ID NO: 43830 - DNA, 18 bp, Artificial Sequence
  Synthetic DNA
taaatatacgctctttag

SEQ ID NO: 43831 - DNA, 18 bp, Artificial Sequence
  Synthetic DNA
taaatatcctctccacag

SEQ ID NO: 43832 - DNA, 18 bp, Artificial Sequence
  Synthetic DNA
taaatcaactctagatcg

SEQ ID NO: 43833 - DNA, 18 bp, Artificial Sequence
  Synthetic DNA
taaatcaactctatacag

SEQ ID NO: 43834 - DNA, 18 bp, Artificial Sequence
  Synthetic DNA
taaatcaactctctgccg

SEQ ID NO: 43835 - DNA, 18 bp, Artificial Sequence
  Synthetic DNA
taaatcacataactatcg

SEQ ID NO: 43836 - DNA, 18 bp, Artificial Sequence
  Synthetic DNA
taaatccactgtctatag

SEQ ID NO: 43837 - DNA, 18 bp, Artificial Sequence
  Synthetic DNA
taaatccactttcatttg

SEQ ID NO: 43838 - DNA, 18 bp, Artificial Sequence
  Synthetic DNA
taaatcctctcgataaag

SEQ ID NO: 43839 - DNA, 18 bp, Artificial Sequence
  Synthetic DNA
taaatcgaaccgctaaag

SEQ ID NO: 43840 - DNA, 18 bp, Artificial Sequence
  Synthetic DNA
taaatcgacaatcttttg

SEQ ID NO: 43841 - DNA, 18 bp, Artificial Sequence
  Synthetic DNA
taaatcgacagtctaaag

SEQ ID NO: 43842 - DNA, 18 bp, Artificial Sequence
  Synthetic DNA
taaatcgactaccgaaag

SEQ ID NO: 43843 - DNA, 18 bp, Artificial Sequence
  Synthetic DNA
taaatcgactcagaaatg

SEQ ID NO: 43844 - DNA, 18 bp, Artificial Sequence
  Synthetic DNA
taaatcgactcgataaag

SEQ ID NO: 43845 - DNA, 18 bp, Artificial Sequence
  Synthetic DNA
taaatcgactcgcttatg

SEQ ID NO: 43846 - DNA, 18 bp, Artificial Sequence
  Synthetic DNA
taaatcgatacactaaaa

SEQ ID NO: 43847 - DNA, 18 bp, Artificial Sequence
  Synthetic DNA
taaatcgattgattatag

SEQ ID NO: 43848 - DNA, 18 bp, Artificial Sequence
  Synthetic DNA
taaatcgcctaactctag

SEQ ID NO: 43849 - DNA, 18 bp, Artificial Sequence
  Synthetic DNA
taaatcgcctatatatag

SEQ ID NO: 43850 - DNA, 18 bp, Artificial Sequence
  Synthetic DNA
taaatcgcttcactttag

SEQ ID NO: 43851 - DNA, 18 bp, Artificial Sequence
  Synthetic DNA
taaatcggcttattatag

SEQ ID NO: 43852 - DNA, 18 bp, Artificial Sequence
  Synthetic DNA
taaatcgtattatttgag

SEQ ID NO: 43853 - DNA, 18 bp, Artificial Sequence
  Synthetic DNA
taaatcgtcccaatatag

SEQ ID NO: 43854 - DNA, 18 bp, Artificial Sequence
  Synthetic DNA
taaatcgtcgtaatattg

SEQ ID NO: 43855 - DNA, 18 bp, Artificial Sequence
  Synthetic DNA
taaatcgtctaacttcag

SEQ ID NO: 43856 - DNA, 18 bp, Artificial Sequence
  Synthetic DNA
taaatcgtctcgcatcag

SEQ ID NO: 43857 - DNA, 18 bp, Artificial Sequence
  Synthetic DNA
taaatcgtgatcccctag

SEQ ID NO: 43858 - DNA, 18 bp, Artificial Sequence
  Synthetic DNA
taaatctacaaactatcg

SEQ ID NO: 43859 - DNA, 18 bp, Artificial Sequence
  Synthetic DNA
taaatctactcaattagg

SEQ ID NO: 43860 - DNA, 18 bp, Artificial Sequence
  Synthetic DNA
taaatctagacacaatag

SEQ ID NO: 43861 - DNA, 18 bp, Artificial Sequence
  Synthetic DNA
taaatcttgtcacttttg

SEQ ID NO: 43862 - DNA, 18 bp, Artificial Sequence
  Synthetic DNA
taaatggtctcactattg

SEQ ID NO: 43863 - DNA, 18 bp, Artificial Sequence
  Synthetic DNA
taaattaactccctttag

SEQ ID NO: 43864 - DNA, 18 bp, Artificial Sequence
  Synthetic DNA
taaattaactctctataa

SEQ ID NO: 43865 - DNA, 18 bp, Artificial Sequence
  Synthetic DNA
taaattcattaactatag

SEQ ID NO: 43866 - DNA, 18 bp, Artificial Sequence
  Synthetic DNA
taaattgactcacatatg

SEQ ID NO: 43867 - DNA, 18 bp, Artificial Sequence
  Synthetic DNA
taaattgactggctttag

SEQ ID NO: 43868 - DNA, 18 bp, Artificial Sequence
  Synthetic DNA
taaatttactcactctag

SEQ ID NO: 43869 - DNA, 18 bp, Artificial Sequence
  Synthetic DNA
taacaaatttcacgatag

SEQ ID NO: 43870 - DNA, 18 bp, Artificial Sequence
  Synthetic DNA
taacaagaaacactttcg

SEQ ID NO: 43871 - DNA, 18 bp, Artificial Sequence
  Synthetic DNA
taacaagatttgtattag

SEQ ID NO: 43872 - DNA, 18 bp, Artificial Sequence
  Synthetic DNA
taacaaggctcactaatg

SEQ ID NO: 43873 - DNA, 18 bp, Artificial Sequence
  Synthetic DNA
taacaattcacacaagag

SEQ ID NO: 43874 - DNA, 18 bp, Artificial Sequence
  Synthetic DNA
taacaattcctactatgg

SEQ ID NO: 43875 - DNA, 18 bp, Artificial Sequence
  Synthetic DNA
taacacactgcactatag

SEQ ID NO: 43876 - DNA, 18 bp, Artificial Sequence
  Synthetic DNA
taacacacttcacaatcg

SEQ ID NO: 43877 - DNA, 18 bp, Artificial Sequence
  Synthetic DNA
taacacagctctctgtag

SEQ ID NO: 43878 - DNA, 18 bp, Artificial Sequence
  Synthetic DNA
taacacagcttaccatgg

SEQ ID NO: 43879 - DNA, 18 bp, Artificial Sequence
  Synthetic DNA
taacacatctctctaaag

SEQ ID NO: 43880 - DNA, 18 bp, Artificial Sequence
  Synthetic DNA
taacaccatacacaatag

SEQ ID NO: 43881 - DNA, 18 bp, Artificial Sequence
  Synthetic DNA
taacaccatatactaaag

SEQ ID NO: 43882 - DNA, 18 bp, Artificial Sequence
  Synthetic DNA
taacaccctctactatag

SEQ ID NO: 43883 - DNA, 18 bp, Artificial Sequence
  Synthetic DNA
taacacgaataacattag

SEQ ID NO: 43884 - DNA, 18 bp, Artificial Sequence
  Synthetic DNA
taacacgaattactaccg

SEQ ID NO: 43885 - DNA, 18 bp, Artificial Sequence
  Synthetic DNA
taacacgacacaataatg

SEQ ID NO: 43886 - DNA, 18 bp, Artificial Sequence
  Synthetic DNA
taacacgacccaccaacg

SEQ ID NO: 43887 - DNA, 18 bp, Artificial Sequence
  Synthetic DNA
taacacgactatttttag

SEQ ID NO: 43888 - DNA, 18 bp, Artificial Sequence
  Synthetic DNA
taacacgactctatcttg

SEQ ID NO: 43889 - DNA, 18 bp, Artificial Sequence
  Synthetic DNA
taacacgagtcaaaaaag

SEQ ID NO: 43890 - DNA, 18 bp, Artificial Sequence
  Synthetic DNA
taacacgagtctgttcag

SEQ ID NO: 43891 - DNA, 18 bp, Artificial Sequence
  Synthetic DNA
taacacgatcggctatag

SEQ ID NO: 43892 - DNA, 18 bp, Artificial Sequence
  Synthetic DNA
taacacgattcacagatg

SEQ ID NO: 43893 - DNA, 18 bp, Artificial Sequence
  Synthetic DNA
taacacgattccccatgg

SEQ ID NO: 43894 - DNA, 18 bp, Artificial Sequence
  Synthetic DNA
taacacgccacgcttatg

SEQ ID NO: 43895 - DNA, 18 bp, Artificial Sequence
  Synthetic DNA
taacacgcctcataacag

SEQ ID NO: 43896 - DNA, 18 bp, Artificial Sequence
  Synthetic DNA
taacacggctcactcagg

SEQ ID NO: 43897 - DNA, 18 bp, Artificial Sequence
  Synthetic DNA
taacacggcttacttaag

SEQ ID NO: 43898 - DNA, 18 bp, Artificial Sequence
  Synthetic DNA
taacacggttgacgatag

SEQ ID NO: 43899 - DNA, 18 bp, Artificial Sequence
  Synthetic DNA
taacacgtctatatatag

SEQ ID NO: 43900 - DNA, 18 bp, Artificial Sequence
  Synthetic DNA
taacacgtctcaacatgg

SEQ ID NO: 43901 - DNA, 18 bp, Artificial Sequence
  Synthetic DNA
taacactaaacactaaag

SEQ ID NO: 43902 - DNA, 18 bp, Artificial Sequence
  Synthetic DNA
taacactacctaccatag

SEQ ID NO: 43903 - DNA, 18 bp, Artificial Sequence
  Synthetic DNA
taacactactaacaattg

SEQ ID NO: 43904 - DNA, 18 bp, Artificial Sequence
  Synthetic DNA
taacactactttctctag

SEQ ID NO: 43905 - DNA, 18 bp, Artificial Sequence
  Synthetic DNA
taacactattcaccattg

SEQ ID NO: 43906 - DNA, 18 bp, Artificial Sequence
  Synthetic DNA
taacactattcataattg

SEQ ID NO: 43907 - DNA, 18 bp, Artificial Sequence
  Synthetic DNA
taacactccactctatag

SEQ ID NO: 43908 - DNA, 18 bp, Artificial Sequence
  Synthetic DNA
taacactcctcgtttcag

SEQ ID NO: 43909 - DNA, 18 bp, Artificial Sequence
  Synthetic DNA
taacacttctctctgaag

SEQ ID NO: 43910 - DNA, 18 bp, Artificial Sequence
  Synthetic DNA
taacacttgacactatag

SEQ ID NO: 43911 - DNA, 18 bp, Artificial Sequence
  Synthetic DNA
taacactttgcacaaaag

SEQ ID NO: 43912 - DNA, 18 bp, Artificial Sequence
  Synthetic DNA
taacaggaattcctttag

SEQ ID NO: 43913 - DNA, 18 bp, Artificial Sequence
  Synthetic DNA
taacaggactaaataaag

SEQ ID NO: 43914 - DNA, 18 bp, Artificial Sequence
  Synthetic DNA
taacaggactcttaattg

SEQ ID NO: 43915 - DNA, 18 bp, Artificial Sequence
  Synthetic DNA
taacaggctttacgatag

SEQ ID NO: 43916 - DNA, 18 bp, Artificial Sequence
  Synthetic DNA
taacaggtctcaatcaag

SEQ ID NO: 43917 - DNA, 18 bp, Artificial Sequence
  Synthetic DNA
taacagtacatacgatag

SEQ ID NO: 43918 - DNA, 18 bp, Artificial Sequence
  Synthetic DNA
taacagtacttactaaag

SEQ ID NO: 43919 - DNA, 18 bp, Artificial Sequence
  Synthetic DNA
taacatatatcattatag

SEQ ID NO: 43920 - DNA, 18 bp, Artificial Sequence
  Synthetic DNA
taacatcactgactttcg

SEQ ID NO: 43921 - DNA, 18 bp, Artificial Sequence
  Synthetic DNA
taacatgacccactgaag

SEQ ID NO: 43922 - DNA, 18 bp, Artificial Sequence
  Synthetic DNA
taacatgactaacttaag

SEQ ID NO: 43923 - DNA, 18 bp, Artificial Sequence
  Synthetic DNA
taacatgactcccaacag

SEQ ID NO: 43924 - DNA, 18 bp, Artificial Sequence
  Synthetic DNA
taacatgactttctacag

SEQ ID NO: 43925 - DNA, 18 bp, Artificial Sequence
  Synthetic DNA
taacatgatacagtatag

SEQ ID NO: 43926 - DNA, 18 bp, Artificial Sequence
  Synthetic DNA
taacatgattctctacag

SEQ ID NO: 43927 - DNA, 18 bp, Artificial Sequence
  Synthetic DNA
taacatgcctcactactg

SEQ ID NO: 43928 - DNA, 18 bp, Artificial Sequence
  Synthetic DNA
taacattactcattttag

SEQ ID NO: 43929 - DNA, 18 bp, Artificial Sequence
  Synthetic DNA
taacattccttactatag

SEQ ID NO: 43930 - DNA, 18 bp, Artificial Sequence
  Synthetic DNA
taacccgacaatatatag

SEQ ID NO: 43931 - DNA, 18 bp, Artificial Sequence
  Synthetic DNA
taacccgacaccttaaag

SEQ ID NO: 43932 - DNA, 18 bp, Artificial Sequence
  Synthetic DNA
taacccgactatcaatag

SEQ ID NO: 43933 - DNA, 18 bp, Artificial Sequence
  Synthetic DNA
taacccgacttacttttg

SEQ ID NO: 43934 - DNA, 18 bp, Artificial Sequence
  Synthetic DNA
taacccggctgaccatag

SEQ ID NO: 43935 - DNA, 18 bp, Artificial Sequence
  Synthetic DNA
taaccctacaaacttttg

SEQ ID NO: 43936 - DNA, 18 bp, Artificial Sequence
  Synthetic DNA
taacctgttcgcctatag

SEQ ID NO: 43937 - DNA, 18 bp, Artificial Sequence
  Synthetic DNA
taacgattctcaatcttg

SEQ ID NO: 43938 - DNA, 18 bp, Artificial Sequence
  Synthetic DNA
taacgcaactatctttag

SEQ ID NO: 43939 - DNA, 18 bp, Artificial Sequence
  Synthetic DNA
taacgcaactctctaagg

SEQ ID NO: 43940 - DNA, 18 bp, Artificial Sequence
  Synthetic DNA
taacgcgtctaattatag

SEQ ID NO: 43941 - DNA, 18 bp, Artificial Sequence
  Synthetic DNA
taactcaacttactctag

SEQ ID NO: 43942 - DNA, 18 bp, Artificial Sequence
  Synthetic DNA
taactcaatcctcaaaag

SEQ ID NO: 43943 - DNA, 18 bp, Artificial Sequence
  Synthetic DNA
taactcaatttactatag

SEQ ID NO: 43944 - DNA, 18 bp, Artificial Sequence
  Synthetic DNA
taactccactcactaatg

SEQ ID NO: 43945 - DNA, 18 bp, Artificial Sequence
  Synthetic DNA
taactccacttacaatag

SEQ ID NO: 43946 - DNA, 18 bp, Artificial Sequence
  Synthetic DNA
taactcccctctcaatag

SEQ ID NO: 43947 - DNA, 18 bp, Artificial Sequence
  Synthetic DNA
taactcgacacaaattag

SEQ ID NO: 43948 - DNA, 18 bp, Artificial Sequence
  Synthetic DNA
taactcgacatacttcag

SEQ ID NO: 43949 - DNA, 18 bp, Artificial Sequence
  Synthetic DNA
taactcgaccctttatag

SEQ ID NO: 43950 - DNA, 18 bp, Artificial Sequence
  Synthetic DNA
taactcgactagttacgg

SEQ ID NO: 43951 - DNA, 18 bp, Artificial Sequence
  Synthetic DNA
taactctactcacaacag

SEQ ID NO: 43952 - DNA, 18 bp, Artificial Sequence
  Synthetic DNA
taactggtctcactttag

SEQ ID NO: 43953 - DNA, 18 bp, Artificial Sequence
  Synthetic DNA
taacttcttacactttag

SEQ ID NO: 43954 - DNA, 18 bp, Artificial Sequence
  Synthetic DNA
taacttgaatcactctag

SEQ ID NO: 43955 - DNA, 18 bp, Artificial Sequence
  Synthetic DNA
taacttgaattcgtacag

SEQ ID NO: 43956 - DNA, 18 bp, Artificial Sequence
  Synthetic DNA
taacttgactatctatag

SEQ ID NO: 43957 - DNA, 18 bp, Artificial Sequence
  Synthetic DNA
taacttgagtcactaaag

SEQ ID NO: 43958 - DNA, 18 bp, Artificial Sequence
  Synthetic DNA
taacttgtatccctatag

SEQ ID NO: 43959 - DNA, 18 bp, Artificial Sequence
  Synthetic DNA
taagaaaaaacactattg

SEQ ID NO: 43960 - DNA, 18 bp, Artificial Sequence
  Synthetic DNA
taagaaaactcactcttg

SEQ ID NO: 43961 - DNA, 18 bp, Artificial Sequence
  Synthetic DNA
taagaagacggaatattg

SEQ ID NO: 43962 - DNA, 18 bp, Artificial Sequence
  Synthetic DNA
taagaagattctctattg

SEQ ID NO: 43963 - DNA, 18 bp, Artificial Sequence
  Synthetic DNA
taagaagtcagactattg

SEQ ID NO: 43964 - DNA, 18 bp, Artificial Sequence
  Synthetic DNA
taagacagctcactgttg

SEQ ID NO: 43965 - DNA, 18 bp, Artificial Sequence
  Synthetic DNA
taagaccacttgctattg

SEQ ID NO: 43966 - DNA, 18 bp, Artificial Sequence
  Synthetic DNA
taagacctctcaagatag

SEQ ID NO: 43967 - DNA, 18 bp, Artificial Sequence
  Synthetic DNA
taagacctcttaatatag

SEQ ID NO: 43968 - DNA, 18 bp, Artificial Sequence
  Synthetic DNA
taagacgacatcctattg

SEQ ID NO: 43969 - DNA, 18 bp, Artificial Sequence
  Synthetic DNA
taagacgaccctctagtg

SEQ ID NO: 43970 - DNA, 18 bp, Artificial Sequence
  Synthetic DNA
taagacgacctacactag

SEQ ID NO: 43971 - DNA, 18 bp, Artificial Sequence
  Synthetic DNA
taagacgactatatctag

SEQ ID NO: 43972 - DNA, 18 bp, Artificial Sequence
  Synthetic DNA
taagacgacttagactag

SEQ ID NO: 43973 - DNA, 18 bp, Artificial Sequence
  Synthetic DNA
taagacgtattttgatag

SEQ ID NO: 43974 - DNA, 18 bp, Artificial Sequence
  Synthetic DNA
taagacgtctcattgaag

SEQ ID NO: 43975 - DNA, 18 bp, Artificial Sequence
  Synthetic DNA
taagacgtctcattgttg

SEQ ID NO: 43976 - DNA, 18 bp, Artificial Sequence
  Synthetic DNA
taagacgtctcggaatag

SEQ ID NO: 43977 - DNA, 18 bp, Artificial Sequence
  Synthetic DNA
taagacgtcttattttag

SEQ ID NO: 43978 - DNA, 18 bp, Artificial Sequence
  Synthetic DNA
taagactcctcagtttag

SEQ ID NO: 43979 - DNA, 18 bp, Artificial Sequence
  Synthetic DNA
taagacttatcactgagg

SEQ ID NO: 43980 - DNA, 18 bp, Artificial Sequence
  Synthetic DNA
taagataactccctgctg

SEQ ID NO: 43981 - DNA, 18 bp, Artificial Sequence
  Synthetic DNA
taagatgacacaaaatag

SEQ ID NO: 43982 - DNA, 18 bp, Artificial Sequence
  Synthetic DNA
taagatgactaacattag

SEQ ID NO: 43983 - DNA, 18 bp, Artificial Sequence
  Synthetic DNA
taagatgactctgtccag

SEQ ID NO: 43984 - DNA, 18 bp, Artificial Sequence
  Synthetic DNA
taagccgaatctcttgag

SEQ ID NO: 43985 - DNA, 18 bp, Artificial Sequence
  Synthetic DNA
taagccgactcccactag

SEQ ID NO: 43986 - DNA, 18 bp, Artificial Sequence
  Synthetic DNA
taaggaaactcccagtag

SEQ ID NO: 43987 - DNA, 18 bp, Artificial Sequence
  Synthetic DNA
taaggcaacaaacaatag

SEQ ID NO: 43988 - DNA, 18 bp, Artificial Sequence
  Synthetic DNA
taaggcgactcacttctg

SEQ ID NO: 43989 - DNA, 18 bp, Artificial Sequence
  Synthetic DNA
taaggctactctcaatag

SEQ ID NO: 43990 - DNA, 18 bp, Artificial Sequence
  Synthetic DNA
taaggtgatactctatag

SEQ ID NO: 43991 - DNA, 18 bp, Artificial Sequence
  Synthetic DNA
taagtcgaaacacaatag

SEQ ID NO: 43992 - DNA, 18 bp, Artificial Sequence
  Synthetic DNA
taagtcgacttacttaag

SEQ ID NO: 43993 - DNA, 18 bp, Artificial Sequence
  Synthetic DNA
taagtcgacttattgtag

SEQ ID NO: 43994 - DNA, 18 bp, Artificial Sequence
  Synthetic DNA
taagtctaaattcaacag

SEQ ID NO: 43995 - DNA, 18 bp, Artificial Sequence
  Synthetic DNA
taagttgagcaattatag

SEQ ID NO: 43996 - DNA, 18 bp, Artificial Sequence
  Synthetic DNA
taataaaacacactccag

SEQ ID NO: 43997 - DNA, 18 bp, Artificial Sequence
  Synthetic DNA
taataaaactatcgattg

SEQ ID NO: 43998 - DNA, 18 bp, Artificial Sequence
  Synthetic DNA
taataaaactcaattcag

SEQ ID NO: 43999 - DNA, 18 bp, Artificial Sequence
  Synthetic DNA
taataaaactcactcagg

SEQ ID NO: 44000 - DNA, 18 bp, Artificial Sequence
  Synthetic DNA
taataaaacttgttattg

SEQ ID NO: 44001 - DNA, 18 bp, Artificial Sequence
  Synthetic DNA
taataaaattcacatagg

SEQ ID NO: 44002 - DNA, 18 bp, Artificial Sequence
  Synthetic DNA
taataaaccaccctatag

SEQ ID NO: 44003 - DNA, 18 bp, Artificial Sequence
  Synthetic DNA
taataaacccatctatag

SEQ ID NO: 44004 - DNA, 18 bp, Artificial Sequence
  Synthetic DNA
taataaatataactttag

SEQ ID NO: 44005 - DNA, 18 bp, Artificial Sequence
  Synthetic DNA
taataaatctcacttgcg

SEQ ID NO: 44006 - DNA, 18 bp, Artificial Sequence
  Synthetic DNA
taataacactaacgattg

SEQ ID NO: 44007 - DNA, 18 bp, Artificial Sequence
  Synthetic DNA
taataacactctaattgg

SEQ ID NO: 44008 - DNA, 18 bp, Artificial Sequence
  Synthetic DNA
taataaccctatctaaag

SEQ ID NO: 44009 - DNA, 18 bp, Artificial Sequence
  Synthetic DNA
taataactcatatgatag

SEQ ID NO: 44010 - DNA, 18 bp, Artificial Sequence
  Synthetic DNA
taataagacacatttttg

SEQ ID NO: 44011 - DNA, 18 bp, Artificial Sequence
  Synthetic DNA
taataagacgtactagtg

SEQ ID NO: 44012 - DNA, 18 bp, Artificial Sequence
  Synthetic DNA
taataagactagtttcag

SEQ ID NO: 44013 - DNA, 18 bp, Artificial Sequence
  Synthetic DNA
taataagactcacatggg

SEQ ID NO: 44014 - DNA, 18 bp, Artificial Sequence
  Synthetic DNA
taataagactcacctggt

SEQ ID NO: 44015 - DNA, 18 bp, Artificial Sequence
  Synthetic DNA
taataagactcatccttg

SEQ ID NO: 44016 - DNA, 18 bp, Artificial Sequence
  Synthetic DNA
taataagactcccttatg

SEQ ID NO: 44017 - DNA, 18 bp, Artificial Sequence
  Synthetic DNA
taataagactctattttg

SEQ ID NO: 44018 - DNA, 18 bp, Artificial Sequence
  Synthetic DNA
taataagacttctcaatg

SEQ ID NO: 44019 - DNA, 18 bp, Artificial Sequence
  Synthetic DNA
taataagactttcaattg

SEQ ID NO: 44020 - DNA, 18 bp, Artificial Sequence
  Synthetic DNA
taataagagtgacggtag

SEQ ID NO: 44021 - DNA, 18 bp, Artificial Sequence
  Synthetic DNA
taataagagttattattg

SEQ ID NO: 44022 - DNA, 18 bp, Artificial Sequence
  Synthetic DNA
taataagatacaccattg

SEQ ID NO: 44023 - DNA, 18 bp, Artificial Sequence
  Synthetic DNA
taataagatgcatcatag

SEQ ID NO: 44024 - DNA, 18 bp, Artificial Sequence
  Synthetic DNA
taataagattaaatatca

SEQ ID NO: 44025 - DNA, 18 bp, Artificial Sequence
  Synthetic DNA
taataagattcccactag

SEQ ID NO: 44026 - DNA, 18 bp, Artificial Sequence
  Synthetic DNA
taataagccaccttatgg

SEQ ID NO: 44027 - DNA, 18 bp, Artificial Sequence
  Synthetic DNA
taataagcctctcaatcg

SEQ ID NO: 44028 - DNA, 18 bp, Artificial Sequence
  Synthetic DNA
taataaggcacacttaag

SEQ ID NO: 44029 - DNA, 18 bp, Artificial Sequence
  Synthetic DNA
taataaggccgactaaag

SEQ ID NO: 44030 - DNA, 18 bp, Artificial Sequence
  Synthetic DNA
taataagtatctttatag

SEQ ID NO: 44031 - DNA, 18 bp, Artificial Sequence
  Synthetic DNA
taataagtctcattgtcg

SEQ ID NO: 44032 - DNA, 18 bp, Artificial Sequence
  Synthetic DNA
taataagtctctcaaaag

SEQ ID NO: 44033 - DNA, 18 bp, Artificial Sequence
  Synthetic DNA
taataagttactctatag

SEQ ID NO: 44034 - DNA, 18 bp, Artificial Sequence
  Synthetic DNA
taataagttttagtatag

SEQ ID NO: 44035 - DNA, 18 bp, Artificial Sequence
  Synthetic DNA
taataataaacaccatag

SEQ ID NO: 44036 - DNA, 18 bp, Artificial Sequence
  Synthetic DNA
taataataaacccttttg

SEQ ID NO: 44037 - DNA, 18 bp, Artificial Sequence
  Synthetic DNA
taataataccatctatcg

SEQ ID NO: 44038 - DNA, 18 bp, Artificial Sequence
  Synthetic DNA
taataatacgtaatatag

SEQ ID NO: 44039 - DNA, 18 bp, Artificial Sequence
  Synthetic DNA
taataatattgtctatag

SEQ ID NO: 44040 - DNA, 18 bp, Artificial Sequence
  Synthetic DNA
taataatatttactccag

SEQ ID NO: 44041 - DNA, 18 bp, Artificial Sequence
  Synthetic DNA
taataatccacatcatag

SEQ ID NO: 44042 - DNA, 18 bp, Artificial Sequence
  Synthetic DNA
taataatgcgtgccagag

SEQ ID NO: 44043 - DNA, 18 bp, Artificial Sequence
  Synthetic DNA
taataattttgtgttttg

SEQ ID NO: 44044 - DNA, 18 bp, Artificial Sequence
  Synthetic DNA
taatacaaatcaattaag

SEQ ID NO: 44045 - DNA, 18 bp, Artificial Sequence
  Synthetic DNA
taatacaaatcacacgtg

SEQ ID NO: 44046 - DNA, 18 bp, Artificial Sequence
  Synthetic DNA
taatacaaatcattaatg

SEQ ID NO: 44047 - DNA, 18 bp, Artificial Sequence
  Synthetic DNA
taatacaaatctaaacag

SEQ ID NO: 44048 - DNA, 18 bp, Artificial Sequence
  Synthetic DNA
taatacaacaaacaacag

SEQ ID NO: 44049 - DNA, 18 bp, Artificial Sequence
  Synthetic DNA
taatacaacactatagag

SEQ ID NO: 44050 - DNA, 18 bp, Artificial Sequence
  Synthetic DNA
taatacaacactgtattg

SEQ ID NO: 44051 - DNA, 18 bp, Artificial Sequence
  Synthetic DNA
taatacaacagacaaaag

SEQ ID NO: 44052 - DNA, 18 bp, Artificial Sequence
  Synthetic DNA
taatacaacagtctctgg

SEQ ID NO: 44053 - DNA, 18 bp, Artificial Sequence
  Synthetic DNA
taatacaacccacgtttg

SEQ ID NO: 44054 - DNA, 18 bp, Artificial Sequence
  Synthetic DNA
taatacaactatctgtcg

SEQ ID NO: 44055 - DNA, 18 bp, Artificial Sequence
  Synthetic DNA
taatacaactccctcctg

SEQ ID NO: 44056 - DNA, 18 bp, Artificial Sequence
  Synthetic DNA
taatacaactctttttcg

SEQ ID NO: 44057 - DNA, 18 bp, Artificial Sequence
  Synthetic DNA
taatacaactggctttgg

SEQ ID NO: 44058 - DNA, 18 bp, Artificial Sequence
  Synthetic DNA
taatacaactgtgtgtag

SEQ ID NO: 44059 - DNA, 18 bp, Artificial Sequence
  Synthetic DNA
taatacaacttaaaattg

SEQ ID NO: 44060 - DNA, 18 bp, Artificial Sequence
  Synthetic DNA
taatacaacttagtgttg

SEQ ID NO: 44061 - DNA, 18 bp, Artificial Sequence
  Synthetic DNA
taatacaactttaattag

SEQ ID NO: 44062 - DNA, 18 bp, Artificial Sequence
  Synthetic DNA
taatacaatacgtttgag

SEQ ID NO: 44063 - DNA, 18 bp, Artificial Sequence
  Synthetic DNA
taatacaatgcaaaatcg

SEQ ID NO: 44064 - DNA, 18 bp, Artificial Sequence
  Synthetic DNA
taatacaattcaataacg

SEQ ID NO: 44065 - DNA, 18 bp, Artificial Sequence
  Synthetic DNA
taatacaattccatatgg

SEQ ID NO: 44066 - DNA, 18 bp, Artificial Sequence
  Synthetic DNA
taatacacatcatgatag

SEQ ID NO: 44067 - DNA, 18 bp, Artificial Sequence
  Synthetic DNA
taatacactaaacttatg

SEQ ID NO: 44068 - DNA, 18 bp, Artificial Sequence
  Synthetic DNA
taatacagcttattttcg

SEQ ID NO: 44069 - DNA, 18 bp, Artificial Sequence
  Synthetic DNA
taatacatatcagcatag

SEQ ID NO: 44070 - DNA, 18 bp, Artificial Sequence
  Synthetic DNA
taatacatcacaatttag

SEQ ID NO: 44071 - DNA, 18 bp, Artificial Sequence
  Synthetic DNA
taatacatcatcctcaag

SEQ ID NO: 44072 - DNA, 18 bp, Artificial Sequence
  Synthetic DNA
taatacatcatgctatag

SEQ ID NO: 44073 - DNA, 18 bp, Artificial Sequence
  Synthetic DNA
taatacatccccctaaag

SEQ ID NO: 44074 - DNA, 18 bp, Artificial Sequence
  Synthetic DNA
taatacatccctcaacag

SEQ ID NO: 44075 - DNA, 18 bp, Artificial Sequence
  Synthetic DNA
taatacatcctaatacag

SEQ ID NO: 44076 - DNA, 18 bp, Artificial Sequence
  Synthetic DNA
taatacatcttaaaaacg

SEQ ID NO: 44077 - DNA, 18 bp, Artificial Sequence
  Synthetic DNA
taatacatgtctccatag

SEQ ID NO: 44078 - DNA, 18 bp, Artificial Sequence
  Synthetic DNA
taatacatttcgggacag

SEQ ID NO: 44079 - DNA, 18 bp, Artificial Sequence
  Synthetic DNA
taatacatttctctataa

SEQ ID NO: 44080 - DNA, 18 bp, Artificial Sequence
  Synthetic DNA
taataccaacatctatag

SEQ ID NO: 44081 - DNA, 18 bp, Artificial Sequence
  Synthetic DNA
taataccaaccacaattg

SEQ ID NO: 44082 - DNA, 18 bp, Artificial Sequence
  Synthetic DNA
taataccaatttttctag

SEQ ID NO: 44083 - DNA, 18 bp, Artificial Sequence
  Synthetic DNA
taataccacacgcaattg

SEQ ID NO: 44084 - DNA, 18 bp, Artificial Sequence
  Synthetic DNA
taataccacactatttag

SEQ ID NO: 44085 - DNA, 18 bp, Artificial Sequence
  Synthetic DNA
taataccacactcaaaag

SEQ ID NO: 44086 - DNA, 18 bp, Artificial Sequence
  Synthetic DNA
taataccacactgtttag

SEQ ID NO: 44087 - DNA, 18 bp, Artificial Sequence
  Synthetic DNA
taataccacccacctttg

SEQ ID NO: 44088 - DNA, 18 bp, Artificial Sequence
  Synthetic DNA
taataccaccctacatag

SEQ ID NO: 44089 - DNA, 18 bp, Artificial Sequence
  Synthetic DNA
taataccactaaatcttg

SEQ ID NO: 44090 - DNA, 18 bp, Artificial Sequence
  Synthetic DNA
taataccactaactgctg

SEQ ID NO: 44091 - DNA, 18 bp, Artificial Sequence
  Synthetic DNA
taataccacttacaggag

SEQ ID NO: 44092 - DNA, 18 bp, Artificial Sequence
  Synthetic DNA
taataccacttcctttcg

SEQ ID NO: 44093 - DNA, 18 bp, Artificial Sequence
  Synthetic DNA
taataccagacttttaag

SEQ ID NO: 44094 - DNA, 18 bp, Artificial Sequence
  Synthetic DNA
taataccattctccaacg

SEQ ID NO: 44095 - DNA, 18 bp, Artificial Sequence
  Synthetic DNA
taatacccttaaatatag

SEQ ID NO: 44096 - DNA, 18 bp, Artificial Sequence
  Synthetic DNA
taataccgcacacaaaag

SEQ ID NO: 44097 - DNA, 18 bp, Artificial Sequence
  Synthetic DNA
taataccgccgactttgg

SEQ ID NO: 44098 - DNA, 18 bp, Artificial Sequence
  Synthetic DNA
taatacctaccacaatag

SEQ ID NO: 44099 - DNA, 18 bp, Artificial Sequence
  Synthetic DNA
taatacctctctttgtag

SEQ ID NO: 44100 - DNA, 18 bp, Artificial Sequence
  Synthetic DNA
taatacctttcacctgag

SEQ ID NO: 44101 - DNA, 18 bp, Artificial Sequence
  Synthetic DNA
taatacgaaagactaatg

SEQ ID NO: 44102 - DNA, 18 bp, Artificial Sequence
  Synthetic DNA
taatacgaacttctattg

SEQ ID NO: 44103 - DNA, 18 bp, Artificial Sequence
  Synthetic DNA
taatacgaatcccaaatg

SEQ ID NO: 44104 - DNA, 18 bp, Artificial Sequence
  Synthetic DNA
taatacgaatcttccttg

SEQ ID NO: 44105 - DNA, 18 bp, Artificial Sequence
  Synthetic DNA
taatacgaattagagtag

SEQ ID NO: 44106 - DNA, 18 bp, Artificial Sequence
  Synthetic DNA
taatacgaattagcacag

SEQ ID NO: 44107 - DNA, 18 bp, Artificial Sequence
  Synthetic DNA
taatacgaattatactag

SEQ ID NO: 44108 - DNA, 18 bp, Artificial Sequence
  Synthetic DNA
taatacgacaaacagttg

SEQ ID NO: 44109 - DNA, 18 bp, Artificial Sequence
  Synthetic DNA
taatacgacaaacttagg

SEQ ID NO: 44110 - DNA, 18 bp, Artificial Sequence
  Synthetic DNA
taatacgacaattacaag

SEQ ID NO: 44111 - DNA, 18 bp, Artificial Sequence
  Synthetic DNA
taatacgacagccttaag

SEQ ID NO: 44112 - DNA, 18 bp, Artificial Sequence
  Synthetic DNA
taatacgacatatcacgg

SEQ ID NO: 44113 - DNA, 18 bp, Artificial Sequence
  Synthetic DNA
taatacgacccaaatcag

SEQ ID NO: 44114 - DNA, 18 bp, Artificial Sequence
  Synthetic DNA
taatacgaccctaaaacg

SEQ ID NO: 44115 - DNA, 18 bp, Artificial Sequence
  Synthetic DNA
taatacgacgaatttttg

SEQ ID NO: 44116 - DNA, 18 bp, Artificial Sequence
  Synthetic DNA
taatacgacgtttaatcg

SEQ ID NO: 44117 - DNA, 18 bp, Artificial Sequence
  Synthetic DNA
taatacgactactaagag

SEQ ID NO: 44118 - DNA, 18 bp, Artificial Sequence
  Synthetic DNA
taatacgactcgtcttcg

SEQ ID NO: 44119 - DNA, 18 bp, Artificial Sequence
  Synthetic DNA
taatacgactttgtcaag

SEQ ID NO: 44120 - DNA, 18 bp, Artificial Sequence
  Synthetic DNA
taatacgagtaattaatg

SEQ ID NO: 44121 - DNA, 18 bp, Artificial Sequence
  Synthetic DNA
taatacgataaactaacg

SEQ ID NO: 44122 - DNA, 18 bp, Artificial Sequence
  Synthetic DNA
taatacgatactatgaag

SEQ ID NO: 44123 - DNA, 18 bp, Artificial Sequence
  Synthetic DNA
taatacgatcaaaaatag

SEQ ID NO: 44124 - DNA, 18 bp, Artificial Sequence
  Synthetic DNA
taatacgatcctccatgg

SEQ ID NO: 44125 - DNA, 18 bp, Artificial Sequence
  Synthetic DNA
taatacgattaaccactg

SEQ ID NO: 44126 - DNA, 18 bp, Artificial Sequence
  Synthetic DNA
taatacgattcatacttg

SEQ ID NO: 44127 - DNA, 18 bp, Artificial Sequence
  Synthetic DNA
taatacgattccccacgg

SEQ ID NO: 44128 - DNA, 18 bp, Artificial Sequence
  Synthetic DNA
taatacgattcgtaatgg

SEQ ID NO: 44129 - DNA, 18 bp, Artificial Sequence
  Synthetic DNA
taatacgcacaacattag

SEQ ID NO: 44130 - DNA, 18 bp, Artificial Sequence
  Synthetic DNA
taatacgcaccaatatgg

SEQ ID NO: 44131 - DNA, 18 bp, Artificial Sequence
  Synthetic DNA
taatacgccgctctaatg

SEQ ID NO: 44132 - DNA, 18 bp, Artificial Sequence
  Synthetic DNA
taatacgcctctcccttg

SEQ ID NO: 44133 - DNA, 18 bp, Artificial Sequence
  Synthetic DNA
taatacgcttctcaattg

SEQ ID NO: 44134 - DNA, 18 bp, Artificial Sequence
  Synthetic DNA
taatacgctttattttag

SEQ ID NO: 44135 - DNA, 18 bp, Artificial Sequence
  Synthetic DNA
taatacggacacgaatag

SEQ ID NO: 44136 - DNA, 18 bp, Artificial Sequence
  Synthetic DNA
taatacggctaactgagg

SEQ ID NO: 44137 - DNA, 18 bp, Artificial Sequence
  Synthetic DNA
taatacggcttacttagg

SEQ ID NO: 44138 - DNA, 18 bp, Artificial Sequence
  Synthetic DNA
taatacggcttagaatcg

SEQ ID NO: 44139 - DNA, 18 bp, Artificial Sequence
  Synthetic DNA
taatacggtttgttaaag

SEQ ID NO: 44140 - DNA, 18 bp, Artificial Sequence
  Synthetic DNA
taatacgtaaaactttag

SEQ ID NO: 44141 - DNA, 18 bp, Artificial Sequence
  Synthetic DNA
taatacgtatcaatgttg

SEQ ID NO: 44142 - DNA, 18 bp, Artificial Sequence
  Synthetic DNA
taatacgtatctcaatgg

SEQ ID NO: 44143 - DNA, 18 bp, Artificial Sequence
  Synthetic DNA
taatacgtcaaaatatgg

SEQ ID NO: 44144 - DNA, 18 bp, Artificial Sequence
  Synthetic DNA
taatacgtcaccctagcg

SEQ ID NO: 44145 - DNA, 18 bp, Artificial Sequence
  Synthetic DNA
taatacgtcccaaaaaag

SEQ ID NO: 44146 - DNA, 18 bp, Artificial Sequence
  Synthetic DNA
taatacgtcccatttatg

SEQ ID NO: 44147 - DNA, 18 bp, Artificial Sequence
  Synthetic DNA
taatacgtccctctaccg

SEQ ID NO: 44148 - DNA, 18 bp, Artificial Sequence
  Synthetic DNA
taatacgtctaatttaag

SEQ ID NO: 44149 - DNA, 18 bp, Artificial Sequence
  Synthetic DNA
taatacgtctatctgaag

SEQ ID NO: 44150 - DNA, 18 bp, Artificial Sequence
  Synthetic DNA
taatacgtctgtatctag

SEQ ID NO: 44151 - DNA, 18 bp, Artificial Sequence
  Synthetic DNA
taatacgtcttgctactg

SEQ ID NO: 44152 - DNA, 18 bp, Artificial Sequence
  Synthetic DNA
taatacgtctttcattgg

SEQ ID NO: 44153 - DNA, 18 bp, Artificial Sequence
  Synthetic DNA
taatacgtgccactgaag

SEQ ID NO: 44154 - DNA, 18 bp, Artificial Sequence
  Synthetic DNA
taatacgtgccattagag

SEQ ID NO: 44155 - DNA, 18 bp, Artificial Sequence
  Synthetic DNA
taatacgtgtaacattag

SEQ ID NO: 44156 - DNA, 18 bp, Artificial Sequence
  Synthetic DNA
taatacgttacattattg

SEQ ID NO: 44157 - DNA, 18 bp, Artificial Sequence
  Synthetic DNA
taatacgttccaataatg

SEQ ID NO: 44158 - DNA, 18 bp, Artificial Sequence
  Synthetic DNA
taatacgttcccctatcg

SEQ ID NO: 44159 - DNA, 18 bp, Artificial Sequence
  Synthetic DNA
taatacgtttcccaattg

SEQ ID NO: 44160 - DNA, 18 bp, Artificial Sequence
  Synthetic DNA
taatacgtttcgatttag

SEQ ID NO: 44161 - DNA, 18 bp, Artificial Sequence
  Synthetic DNA
taatacgttttactaatg

SEQ ID NO: 44162 - DNA, 18 bp, Artificial Sequence
  Synthetic DNA
taatactaaacattacag

SEQ ID NO: 44163 - DNA, 18 bp, Artificial Sequence
  Synthetic DNA
taatactaacatctatag

SEQ ID NO: 44164 - DNA, 18 bp, Artificial Sequence
  Synthetic DNA
taatactaatctcttatg

SEQ ID NO: 44165 - DNA, 18 bp, Artificial Sequence
  Synthetic DNA
taatactacaaaccaaag

SEQ ID NO: 44166 - DNA, 18 bp, Artificial Sequence
  Synthetic DNA
taatactacagacgatgg

SEQ ID NO: 44167 - DNA, 18 bp, Artificial Sequence
  Synthetic DNA
taatactaccctctccag

SEQ ID NO: 44168 - DNA, 18 bp, Artificial Sequence
  Synthetic DNA
taatactactaccaacag

SEQ ID NO: 44169 - DNA, 18 bp, Artificial Sequence
  Synthetic DNA
taatactactatttaagg

SEQ ID NO: 44170 - DNA, 18 bp, Artificial Sequence
  Synthetic DNA
taatactactccaattag

SEQ ID NO: 44171 - DNA, 18 bp, Artificial Sequence
  Synthetic DNA
taatactactcgcttatg

SEQ ID NO: 44172 - DNA, 18 bp, Artificial Sequence
  Synthetic DNA
taatactactgtttattg

SEQ ID NO: 44173 - DNA, 18 bp, Artificial Sequence
  Synthetic DNA
taatactacttagttttg

SEQ ID NO: 44174 - DNA, 18 bp, Artificial Sequence
  Synthetic DNA
taatactactttatctag

SEQ ID NO: 44175 - DNA, 18 bp, Artificial Sequence
  Synthetic DNA
taatactataagccacag

SEQ ID NO: 44176 - DNA, 18 bp, Artificial Sequence
  Synthetic DNA
taatactatacagtggtg

SEQ ID NO: 44177 - DNA, 18 bp, Artificial Sequence
  Synthetic DNA
taatactattcaatctcg

SEQ ID NO: 44178 - DNA, 18 bp, Artificial Sequence
  Synthetic DNA
taatactattctgtaaag

SEQ ID NO: 44179 - DNA, 18 bp, Artificial Sequence
  Synthetic DNA
taatactccacgctaaag

SEQ ID NO: 44180 - DNA, 18 bp, Artificial Sequence
  Synthetic DNA
taatactcctcagatcag

SEQ ID NO: 44181 - DNA, 18 bp, Artificial Sequence
  Synthetic DNA
taatactcctctctactg

SEQ ID NO: 44182 - DNA, 18 bp, Artificial Sequence
  Synthetic DNA
taatactgctcatcaaag

SEQ ID NO: 44183 - DNA, 18 bp, Artificial Sequence
  Synthetic DNA
taatacttatcacccaag

SEQ ID NO: 44184 - DNA, 18 bp, Artificial Sequence
  Synthetic DNA
taatacttatgtctattg

SEQ ID NO: 44185 - DNA, 18 bp, Artificial Sequence
  Synthetic DNA
taatacttcaaaataaag

SEQ ID NO: 44186 - DNA, 18 bp, Artificial Sequence
  Synthetic DNA
taatacttcacacaatcg

SEQ ID NO: 44187 - DNA, 18 bp, Artificial Sequence
  Synthetic DNA
taatacttcactctatcg

SEQ ID NO: 44188 - DNA, 18 bp, Artificial Sequence
  Synthetic DNA
taatacttcctaatatag

SEQ ID NO: 44189 - DNA, 18 bp, Artificial Sequence
  Synthetic DNA
taatacttctcacgctgg

SEQ ID NO: 44190 - DNA, 18 bp, Artificial Sequence
  Synthetic DNA
taatacttctcttttaag

SEQ ID NO: 44191 - DNA, 18 bp, Artificial Sequence
  Synthetic DNA
taatacttctgttcatag

SEQ ID NO: 44192 - DNA, 18 bp, Artificial Sequence
  Synthetic DNA
taatacttcttactaatg

SEQ ID NO: 44193 - DNA, 18 bp, Artificial Sequence
  Synthetic DNA
taatacttctttctacag

SEQ ID NO: 44194 - DNA, 18 bp, Artificial Sequence
  Synthetic DNA
taatactttacacttaag

SEQ ID NO: 44195 - DNA, 18 bp, Artificial Sequence
  Synthetic DNA
taatacttttcatcacag

SEQ ID NO: 44196 - DNA, 18 bp, Artificial Sequence
  Synthetic DNA
taatacttttttctctag

SEQ ID NO: 44197 - DNA, 18 bp, Artificial Sequence
  Synthetic DNA
taatagaaattacgaaag

SEQ ID NO: 44198 - DNA, 18 bp, Artificial Sequence
  Synthetic DNA
taatagaactcccttttg

SEQ ID NO: 44199 - DNA, 18 bp, Artificial Sequence
  Synthetic DNA
taatagaacttaaaaaag

SEQ ID NO: 44200 - DNA, 18 bp, Artificial Sequence
  Synthetic DNA
taatagaacttactaccg

SEQ ID NO: 44201 - DNA, 18 bp, Artificial Sequence
  Synthetic DNA
taatagaaggaattatag

SEQ ID NO: 44202 - DNA, 18 bp, Artificial Sequence
  Synthetic DNA
taatagatctaaccatag

SEQ ID NO: 44203 - DNA, 18 bp, Artificial Sequence
  Synthetic DNA
taatagatctcagtttag

SEQ ID NO: 44204 - DNA, 18 bp, Artificial Sequence
  Synthetic DNA
taatagcaatctttatcg

SEQ ID NO: 44205 - DNA, 18 bp, Artificial Sequence
  Synthetic DNA
taatagcccaattcatag

SEQ ID NO: 44206 - DNA, 18 bp, Artificial Sequence
  Synthetic DNA
taatagctttctctattg

SEQ ID NO: 44207 - DNA, 18 bp, Artificial Sequence
  Synthetic DNA
taataggaatcaatctcg

SEQ ID NO: 44208 - DNA, 18 bp, Artificial Sequence
  Synthetic DNA
taataggaatcacacttg

SEQ ID NO: 44209 - DNA, 18 bp, Artificial Sequence
  Synthetic DNA
taataggactatatgtag

SEQ ID NO: 44210 - DNA, 18 bp, Artificial Sequence
  Synthetic DNA
taataggactcatagcag

SEQ ID NO: 44211 - DNA, 18 bp, Artificial Sequence
  Synthetic DNA
taataggacttaccgaag

SEQ ID NO: 44212 - DNA, 18 bp, Artificial Sequence
  Synthetic DNA
taataggatctaattaag

SEQ ID NO: 44213 - DNA, 18 bp, Artificial Sequence
  Synthetic DNA
taataggattcgctgggg

SEQ ID NO: 44214 - DNA, 18 bp, Artificial Sequence
  Synthetic DNA
taataggattgacaatcg

SEQ ID NO: 44215 - DNA, 18 bp, Artificial Sequence
  Synthetic DNA
taatagggcatacattag

SEQ ID NO: 44216 - DNA, 18 bp, Artificial Sequence
  Synthetic DNA
taataggtcaaaagttag

SEQ ID NO: 44217 - DNA, 18 bp, Artificial Sequence
  Synthetic DNA
taataggtcacagtatcg

SEQ ID NO: 44218 - DNA, 18 bp, Artificial Sequence
  Synthetic DNA
taataggtctaatattag

SEQ ID NO: 44219 - DNA, 18 bp, Artificial Sequence
  Synthetic DNA
taataggtttcactacgg

SEQ ID NO: 44220 - DNA, 18 bp, Artificial Sequence
  Synthetic DNA
taatagtaatcacactag

SEQ ID NO: 44221 - DNA, 18 bp, Artificial Sequence
  Synthetic DNA
taatagtaatctccatag

SEQ ID NO: 44222 - DNA, 18 bp, Artificial Sequence
  Synthetic DNA
taatagtactcattccag

SEQ ID NO: 44223 - DNA, 18 bp, Artificial Sequence
  Synthetic DNA
taatagtagtaactaaag

SEQ ID NO: 44224 - DNA, 18 bp, Artificial Sequence
  Synthetic DNA
taatagtccactctatag

SEQ ID NO: 44225 - DNA, 18 bp, Artificial Sequence
  Synthetic DNA
taatagttcaaactgtag

SEQ ID NO: 44226 - DNA, 18 bp, Artificial Sequence
  Synthetic DNA
taatagttgtcactaaag

SEQ ID NO: 44227 - DNA, 18 bp, Artificial Sequence
  Synthetic DNA
taatagttttcacaatag

SEQ ID NO: 44228 - DNA, 18 bp, Artificial Sequence
  Synthetic DNA
taatataaatcacaattg

SEQ ID NO: 44229 - DNA, 18 bp, Artificial Sequence
  Synthetic DNA
taatataaatctttacag

SEQ ID NO: 44230 - DNA, 18 bp, Artificial Sequence
  Synthetic DNA
taatataactctatctag

SEQ ID NO: 44231 - DNA, 18 bp, Artificial Sequence
  Synthetic DNA
taatataactctcaaaag

SEQ ID NO: 44232 - DNA, 18 bp, Artificial Sequence
  Synthetic DNA
taatatatttcaccagag

SEQ ID NO: 44233 - DNA, 18 bp, Artificial Sequence
  Synthetic DNA
taatatcacgtactattg

SEQ ID NO: 44234 - DNA, 18 bp, Artificial Sequence
  Synthetic DNA
taatatcactccatctag

SEQ ID NO: 44235 - DNA, 18 bp, Artificial Sequence
  Synthetic DNA
taatatcattcgtgtaag

SEQ ID NO: 44236 - DNA, 18 bp, Artificial Sequence
  Synthetic DNA
taatatcccccatgttag

SEQ ID NO: 44237 - DNA, 18 bp, Artificial Sequence
  Synthetic DNA
taatatccgtcactatgg

SEQ ID NO: 44238 - DNA, 18 bp, Artificial Sequence
  Synthetic DNA
taatatctaacactatag

SEQ ID NO: 44239 - DNA, 18 bp, Artificial Sequence
  Synthetic DNA
taatatctcacatttaag

SEQ ID NO: 44240 - DNA, 18 bp, Artificial Sequence
  Synthetic DNA
taatatctcttactaaag

SEQ ID NO: 44241 - DNA, 18 bp, Artificial Sequence
  Synthetic DNA
taatatgaaacaatatcg

SEQ ID NO: 44242 - DNA, 18 bp, Artificial Sequence
  Synthetic DNA
taatatgaaaccatattg

SEQ ID NO: 44243 - DNA, 18 bp, Artificial Sequence
  Synthetic DNA
taatatgaatctctaagg

SEQ ID NO: 44244 - DNA, 18 bp, Artificial Sequence
  Synthetic DNA
taatatgacacgttacag

SEQ ID NO: 44245 - DNA, 18 bp, Artificial Sequence
  Synthetic DNA
taatatgacactctttgg

SEQ ID NO: 44246 - DNA, 18 bp, Artificial Sequence
  Synthetic DNA
taatatgacataattttg

SEQ ID NO: 44247 - DNA, 18 bp, Artificial Sequence
  Synthetic DNA
taatatgacatacttttg

SEQ ID NO: 44248 - DNA, 18 bp, Artificial Sequence
  Synthetic DNA
taatatgaccatcaatag

SEQ ID NO: 44249 - DNA, 18 bp, Artificial Sequence
  Synthetic DNA
taatatgacccacctgag

SEQ ID NO: 44250 - DNA, 18 bp, Artificial Sequence
  Synthetic DNA
taatatgactatcactcg

SEQ ID NO: 44251 - DNA, 18 bp, Artificial Sequence
  Synthetic DNA
taatatgactctaactag

SEQ ID NO: 44252 - DNA, 18 bp, Artificial Sequence
  Synthetic DNA
taatatgacttgccacag

SEQ ID NO: 44253 - DNA, 18 bp, Artificial Sequence
  Synthetic DNA
taatatgagtatctattg

SEQ ID NO: 44254 - DNA, 18 bp, Artificial Sequence
  Synthetic DNA
taatatgattcgttaatg

SEQ ID NO: 44255 - DNA, 18 bp, Artificial Sequence
  Synthetic DNA
taatatgattctatagag

SEQ ID NO: 44256 - DNA, 18 bp, Artificial Sequence
  Synthetic DNA
taatatgatttactctaa

SEQ ID NO: 44257 - DNA, 18 bp, Artificial Sequence
  Synthetic DNA
taatatgccacagtttag

SEQ ID NO: 44258 - DNA, 18 bp, Artificial Sequence
  Synthetic DNA
taatatgcttcttttaag

SEQ ID NO: 44259 - DNA, 18 bp, Artificial Sequence
  Synthetic DNA
taatatggctgattaaag

SEQ ID NO: 44260 - DNA, 18 bp, Artificial Sequence
  Synthetic DNA
taatatggctggcattag

SEQ ID NO: 44261 - DNA, 18 bp, Artificial Sequence
  Synthetic DNA
taatatgtccagttattg

SEQ ID NO: 44262 - DNA, 18 bp, Artificial Sequence
  Synthetic DNA
taatatgtccctctaacg

SEQ ID NO: 44263 - DNA, 18 bp, Artificial Sequence
  Synthetic DNA
taatatgtcgtactatgg

SEQ ID NO: 44264 - DNA, 18 bp, Artificial Sequence
  Synthetic DNA
taatatgtctcacaaggg

SEQ ID NO: 44265 - DNA, 18 bp, Artificial Sequence
  Synthetic DNA
taatatgtctccgtacag

SEQ ID NO: 44266 - DNA, 18 bp, Artificial Sequence
  Synthetic DNA
taatatgtctggctaagg

SEQ ID NO: 44267 - DNA, 18 bp, Artificial Sequence
  Synthetic DNA
taatatgtgtcattctag

SEQ ID NO: 44268 - DNA, 18 bp, Artificial Sequence
  Synthetic DNA
taatatgtttatcaatag

SEQ ID NO: 44269 - DNA, 18 bp, Artificial Sequence
  Synthetic DNA
taatattacccactctgg

SEQ ID NO: 44270 - DNA, 18 bp, Artificial Sequence
  Synthetic DNA
taatattactaaattatg

SEQ ID NO: 44271 - DNA, 18 bp, Artificial Sequence
  Synthetic DNA
taatattactaacttacg

SEQ ID NO: 44272 - DNA, 18 bp, Artificial Sequence
  Synthetic DNA
taatattactccttaatg

SEQ ID NO: 44273 - DNA, 18 bp, Artificial Sequence
  Synthetic DNA
taatattactgtctaaag

SEQ ID NO: 44274 - DNA, 18 bp, Artificial Sequence
  Synthetic DNA
taatattactttctcctg

SEQ ID NO: 44275 - DNA, 18 bp, Artificial Sequence
  Synthetic DNA
taatattagctactagtg

SEQ ID NO: 44276 - DNA, 18 bp, Artificial Sequence
  Synthetic DNA
taatattattcagttgag

SEQ ID NO: 44277 - DNA, 18 bp, Artificial Sequence
  Synthetic DNA
taatattcctcaatttag

SEQ ID NO: 44278 - DNA, 18 bp, Artificial Sequence
  Synthetic DNA
taatattgctcactactg

SEQ ID NO: 44279 - DNA, 18 bp, Artificial Sequence
  Synthetic DNA
taatattgctccctaaag

SEQ ID NO: 44280 - DNA, 18 bp, Artificial Sequence
  Synthetic DNA
taatatttatcaccttgg

SEQ ID NO: 44281 - DNA, 18 bp, Artificial Sequence
  Synthetic DNA
taatatttcttataatcg

SEQ ID NO: 44282 - DNA, 18 bp, Artificial Sequence
  Synthetic DNA
taatatttttcccttaag

SEQ ID NO: 44283 - DNA, 18 bp, Artificial Sequence
  Synthetic DNA
taatcaaaccaaatatag

SEQ ID NO: 44284 - DNA, 18 bp, Artificial Sequence
  Synthetic DNA
taatcagaacctccgtag

SEQ ID NO: 44285 - DNA, 18 bp, Artificial Sequence
  Synthetic DNA
taatcagacactcttgcg

SEQ ID NO: 44286 - DNA, 18 bp, Artificial Sequence
  Synthetic DNA
taatcagagtctccatag

SEQ ID NO: 44287 - DNA, 18 bp, Artificial Sequence
  Synthetic DNA
taatcagtctcaccattg

SEQ ID NO: 44288 - DNA, 18 bp, Artificial Sequence
  Synthetic DNA
taatcatactaacaacgg

SEQ ID NO: 44289 - DNA, 18 bp, Artificial Sequence
  Synthetic DNA
taatcatactaattatag

SEQ ID NO: 44290 - DNA, 18 bp, Artificial Sequence
  Synthetic DNA
taatccaaatccatatag

SEQ ID NO: 44291 - DNA, 18 bp, Artificial Sequence
  Synthetic DNA
taatccaattctctaatg

SEQ ID NO: 44292 - DNA, 18 bp, Artificial Sequence
  Synthetic DNA
taatccacactactttgg

SEQ ID NO: 44293 - DNA, 18 bp, Artificial Sequence
  Synthetic DNA
taatccattcccctattg

SEQ ID NO: 44294 - DNA, 18 bp, Artificial Sequence
  Synthetic DNA
taatcccacctactattg

SEQ ID NO: 44295 - DNA, 18 bp, Artificial Sequence
  Synthetic DNA
taatcccacttgatatag

SEQ ID NO: 44296 - DNA, 18 bp, Artificial Sequence
  Synthetic DNA
taatcccggtcaacatag

SEQ ID NO: 44297 - DNA, 18 bp, Artificial Sequence
  Synthetic DNA
taatccctcttagtatag

SEQ ID NO: 44298 - DNA, 18 bp, Artificial Sequence
  Synthetic DNA
taatccgaattaccaaag

SEQ ID NO: 44299 - DNA, 18 bp, Artificial Sequence
  Synthetic DNA
taatccgacatactaggg

SEQ ID NO: 44300 - DNA, 18 bp, Artificial Sequence
  Synthetic DNA
taatccgactcacatcgg

SEQ ID NO: 44301 - DNA, 18 bp, Artificial Sequence
  Synthetic DNA
taatccgactcgttaacg

SEQ ID NO: 44302 - DNA, 18 bp, Artificial Sequence
  Synthetic DNA
taatccgactctatttcg

SEQ ID NO: 44303 - DNA, 18 bp, Artificial Sequence
  Synthetic DNA
taatccgataaacagtag

SEQ ID NO: 44304 - DNA, 18 bp, Artificial Sequence
  Synthetic DNA
taatccgatagcctgtag

SEQ ID NO: 44305 - DNA, 18 bp, Artificial Sequence
  Synthetic DNA
taatccgattgtctctag

SEQ ID NO: 44306 - DNA, 18 bp, Artificial Sequence
  Synthetic DNA
taatccggcaatctatgg

SEQ ID NO: 44307 - DNA, 18 bp, Artificial Sequence
  Synthetic DNA
taatccggctcaataatg

SEQ ID NO: 44308 - DNA, 18 bp, Artificial Sequence
  Synthetic DNA
taatccgtcgaaatatag

SEQ ID NO: 44309 - DNA, 18 bp, Artificial Sequence
  Synthetic DNA
taatccgtctcgctcatg

SEQ ID NO: 44310 - DNA, 18 bp, Artificial Sequence
  Synthetic DNA
taatcctaatctctattg

SEQ ID NO: 44311 - DNA, 18 bp, Artificial Sequence
  Synthetic DNA
taatcctacactcaatag

SEQ ID NO: 44312 - DNA, 18 bp, Artificial Sequence
  Synthetic DNA
taatcctactaggtatag

SEQ ID NO: 44313 - DNA, 18 bp, Artificial Sequence
  Synthetic DNA
taatcctactcagcttag

SEQ ID NO: 44314 - DNA, 18 bp, Artificial Sequence
  Synthetic DNA
taatcctactctaaatag

SEQ ID NO: 44315 - DNA, 18 bp, Artificial Sequence
  Synthetic DNA
taatcctgctcgctaaag

SEQ ID NO: 44316 - DNA, 18 bp, Artificial Sequence
  Synthetic DNA
taatccttttctctatag

SEQ ID NO: 44317 - DNA, 18 bp, Artificial Sequence
  Synthetic DNA
taatcgtacttattacag

SEQ ID NO: 44318 - DNA, 18 bp, Artificial Sequence
  Synthetic DNA
taatctatctcactatcg

SEQ ID NO: 44319 - DNA, 18 bp, Artificial Sequence
  Synthetic DNA
taatctgaattactattg

SEQ ID NO: 44320 - DNA, 18 bp, Artificial Sequence
  Synthetic DNA
taatctgaattcctatag

SEQ ID NO: 44321 - DNA, 18 bp, Artificial Sequence
  Synthetic DNA
taatctgacagactaaag

SEQ ID NO: 44322 - DNA, 18 bp, Artificial Sequence
  Synthetic DNA
taatctgactctctaacg

SEQ ID NO: 44323 - DNA, 18 bp, Artificial Sequence
  Synthetic DNA
taatctgactgcctttcg

SEQ ID NO: 44324 - DNA, 18 bp, Artificial Sequence
  Synthetic DNA
taatctgtcacactatcg

SEQ ID NO: 44325 - DNA, 18 bp, Artificial Sequence
  Synthetic DNA
taatctgtctctttatag

SEQ ID NO: 44326 - DNA, 18 bp, Artificial Sequence
  Synthetic DNA
taatcttactcactacgg

SEQ ID NO: 44327 - DNA, 18 bp, Artificial Sequence
  Synthetic DNA
taatgaaactcagctttg

SEQ ID NO: 44328 - DNA, 18 bp, Artificial Sequence
  Synthetic DNA
taatgagacttccaatgg

SEQ ID NO: 44329 - DNA, 18 bp, Artificial Sequence
  Synthetic DNA
taatgagagtaacaatag

SEQ ID NO: 44330 - DNA, 18 bp, Artificial Sequence
  Synthetic DNA
taatgagcctcatattag

SEQ ID NO: 44331 - DNA, 18 bp, Artificial Sequence
  Synthetic DNA
taatgagtatcactattg

SEQ ID NO: 44332 - DNA, 18 bp, Artificial Sequence
  Synthetic DNA
taatgagtcacattatgg

SEQ ID NO: 44333 - DNA, 18 bp, Artificial Sequence
  Synthetic DNA
taatgcaaatcggtatag

SEQ ID NO: 44334 - DNA, 18 bp, Artificial Sequence
  Synthetic DNA
taatgcaacagtttacag

SEQ ID NO: 44335 - DNA, 18 bp, Artificial Sequence
  Synthetic DNA
taatgcaactagcactag

SEQ ID NO: 44336 - DNA, 18 bp, Artificial Sequence
  Synthetic DNA
taatgcaactcccaatcg

SEQ ID NO: 44337 - DNA, 18 bp, Artificial Sequence
  Synthetic DNA
taatgcacgtgattatag

SEQ ID NO: 44338 - DNA, 18 bp, Artificial Sequence
  Synthetic DNA
taatgcagccctatattg

SEQ ID NO: 44339 - DNA, 18 bp, Artificial Sequence
  Synthetic DNA
taatgcatctcaatcttg

SEQ ID NO: 44340 - DNA, 18 bp, Artificial Sequence
  Synthetic DNA
taatgcatctctttatag

SEQ ID NO: 44341 - DNA, 18 bp, Artificial Sequence
  Synthetic DNA
taatgccaatcagtacag

SEQ ID NO: 44342 - DNA, 18 bp, Artificial Sequence
  Synthetic DNA
taatgccacacacttatg

SEQ ID NO: 44343 - DNA, 18 bp, Artificial Sequence
  Synthetic DNA
taatgccattcacttttg

SEQ ID NO: 44344 - DNA, 18 bp, Artificial Sequence
  Synthetic DNA
taatgcccctcacttttg

SEQ ID NO: 44345 - DNA, 18 bp, Artificial Sequence
  Synthetic DNA
taatgcctccctctaatg

SEQ ID NO: 44346 - DNA, 18 bp, Artificial Sequence
  Synthetic DNA
taatgcgaatcaatcttg

SEQ ID NO: 44347 - DNA, 18 bp, Artificial Sequence
  Synthetic DNA
taatgcgaatctcatatg

SEQ ID NO: 44348 - DNA, 18 bp, Artificial Sequence
  Synthetic DNA
taatgcgacacaaaattg

SEQ ID NO: 44349 - DNA, 18 bp, Artificial Sequence
  Synthetic DNA
taatgcgactatctcaag

SEQ ID NO: 44350 - DNA, 18 bp, Artificial Sequence
  Synthetic DNA
taatgcgactcgcaactg

SEQ ID NO: 44351 - DNA, 18 bp, Artificial Sequence
  Synthetic DNA
taatgcgactcggcacag

SEQ ID NO: 44352 - DNA, 18 bp, Artificial Sequence
  Synthetic DNA
taatgcgactggttattg

SEQ ID NO: 44353 - DNA, 18 bp, Artificial Sequence
  Synthetic DNA
taatgcgattatctatcg

SEQ ID NO: 44354 - DNA, 18 bp, Artificial Sequence
  Synthetic DNA
taatgcgattcgttttag

SEQ ID NO: 44355 - DNA, 18 bp, Artificial Sequence
  Synthetic DNA
taatgcgcatcactgttg

SEQ ID NO: 44356 - DNA, 18 bp, Artificial Sequence
  Synthetic DNA
taatgcggcacgtaatag

SEQ ID NO: 44357 - DNA, 18 bp, Artificial Sequence
  Synthetic DNA
taatgcgtaacacaatag

SEQ ID NO: 44358 - DNA, 18 bp, Artificial Sequence
  Synthetic DNA
taatgcgtcacacaggcg

SEQ ID NO: 44359 - DNA, 18 bp, Artificial Sequence
  Synthetic DNA
taatgcgtcattgatttg

SEQ ID NO: 44360 - DNA, 18 bp, Artificial Sequence
  Synthetic DNA
taatgcgtccttctatgg

SEQ ID NO: 44361 - DNA, 18 bp, Artificial Sequence
  Synthetic DNA
taatgcgtcgcacatcag

SEQ ID NO: 44362 - DNA, 18 bp, Artificial Sequence
  Synthetic DNA
taatgcgtctaaacatgg

SEQ ID NO: 44363 - DNA, 18 bp, Artificial Sequence
  Synthetic DNA
taatgcgtctcacagtcg

SEQ ID NO: 44364 - DNA, 18 bp, Artificial Sequence
  Synthetic DNA
taatgcgttacagtatag

SEQ ID NO: 44365 - DNA, 18 bp, Artificial Sequence
  Synthetic DNA
taatgcgttgaactatag

SEQ ID NO: 44366 - DNA, 18 bp, Artificial Sequence
  Synthetic DNA
taatgcgtttcaattaag

SEQ ID NO: 44367 - DNA, 18 bp, Artificial Sequence
  Synthetic DNA
taatgcgttttagcatag

SEQ ID NO: 44368 - DNA, 18 bp, Artificial Sequence
  Synthetic DNA
taatgctactctaactag

SEQ ID NO: 44369 - DNA, 18 bp, Artificial Sequence
  Synthetic DNA
taatggctcttactatag

SEQ ID NO: 44370 - DNA, 18 bp, Artificial Sequence
  Synthetic DNA
taatgggacacaataaag

SEQ ID NO: 44371 - DNA, 18 bp, Artificial Sequence
  Synthetic DNA
taatgggagacactttag

SEQ ID NO: 44372 - DNA, 18 bp, Artificial Sequence
  Synthetic DNA
taatgggtatcattatag

SEQ ID NO: 44373 - DNA, 18 bp, Artificial Sequence
  Synthetic DNA
taatgtgttacactttag

SEQ ID NO: 44374 - DNA, 18 bp, Artificial Sequence
  Synthetic DNA
taatgtgtttcactattg

SEQ ID NO: 44375 - DNA, 18 bp, Artificial Sequence
  Synthetic DNA
taatgttacaacctatag

SEQ ID NO: 44376 - DNA, 18 bp, Artificial Sequence
  Synthetic DNA
taattaaacccaccaacg

SEQ ID NO: 44377 - DNA, 18 bp, Artificial Sequence
  Synthetic DNA
taattaaagtcactgaag

SEQ ID NO: 44378 - DNA, 18 bp, Artificial Sequence
  Synthetic DNA
taattaatcttacaattg

SEQ ID NO: 44379 - DNA, 18 bp, Artificial Sequence
  Synthetic DNA
taattaatttcgctatag

SEQ ID NO: 44380 - DNA, 18 bp, Artificial Sequence
  Synthetic DNA
taattacaaacactatag

SEQ ID NO: 44381 - DNA, 18 bp, Artificial Sequence
  Synthetic DNA
taattactctaactattg

SEQ ID NO: 44382 - DNA, 18 bp, Artificial Sequence
  Synthetic DNA
taattactgtcaatacag

SEQ ID NO: 44383 - DNA, 18 bp, Artificial Sequence
  Synthetic DNA
taattagacaaacattag

SEQ ID NO: 44384 - DNA, 18 bp, Artificial Sequence
  Synthetic DNA
taattagacccatcaatg

SEQ ID NO: 44385 - DNA, 18 bp, Artificial Sequence
  Synthetic DNA
taattagccacaataaag

SEQ ID NO: 44386 - DNA, 18 bp, Artificial Sequence
  Synthetic DNA
taattagccacactatcg

SEQ ID NO: 44387 - DNA, 18 bp, Artificial Sequence
  Synthetic DNA
taattagcctcgccaatg

SEQ ID NO: 44388 - DNA, 18 bp, Artificial Sequence
  Synthetic DNA
taattagtcacgctattg

SEQ ID NO: 44389 - DNA, 18 bp, Artificial Sequence
  Synthetic DNA
taattagtttcattatag

SEQ ID NO: 44390 - DNA, 18 bp, Artificial Sequence
  Synthetic DNA
taattatacacactatgg

SEQ ID NO: 44391 - DNA, 18 bp, Artificial Sequence
  Synthetic DNA
taattatactcgcaaaag

SEQ ID NO: 44392 - DNA, 18 bp, Artificial Sequence
  Synthetic DNA
taattatacttaatatag

SEQ ID NO: 44393 - DNA, 18 bp, Artificial Sequence
  Synthetic DNA
taattatactttctatag

SEQ ID NO: 44394 - DNA, 18 bp, Artificial Sequence
  Synthetic DNA
taattatattcacagtag

SEQ ID NO: 44395 - DNA, 18 bp, Artificial Sequence
  Synthetic DNA
taattcaaaacaattttg

SEQ ID NO: 44396 - DNA, 18 bp, Artificial Sequence
  Synthetic DNA
taattcaaattattatag

SEQ ID NO: 44397 - DNA, 18 bp, Artificial Sequence
  Synthetic DNA
taattcaacccacttgag

SEQ ID NO: 44398 - DNA, 18 bp, Artificial Sequence
  Synthetic DNA
taattcaactaactagtg

SEQ ID NO: 44399 - DNA, 18 bp, Artificial Sequence
  Synthetic DNA
taattcaactacccatcg

SEQ ID NO: 44400 - DNA, 18 bp, Artificial Sequence
  Synthetic DNA
taattcaactcaattcag

SEQ ID NO: 44401 - DNA, 18 bp, Artificial Sequence
  Synthetic DNA
taattcaactctcaacag

SEQ ID NO: 44402 - DNA, 18 bp, Artificial Sequence
  Synthetic DNA
taattcaactctctcgcg

SEQ ID NO: 44403 - DNA, 18 bp, Artificial Sequence
  Synthetic DNA
taattcaattcactgaag

SEQ ID NO: 44404 - DNA, 18 bp, Artificial Sequence
  Synthetic DNA
taattcatctaacacatg

SEQ ID NO: 44405 - DNA, 18 bp, Artificial Sequence
  Synthetic DNA
taattcatctcaccttag

SEQ ID NO: 44406 - DNA, 18 bp, Artificial Sequence
  Synthetic DNA
taattccaaccactattg

SEQ ID NO: 44407 - DNA, 18 bp, Artificial Sequence
  Synthetic DNA
taattccaagcacaacag

SEQ ID NO: 44408 - DNA, 18 bp, Artificial Sequence
  Synthetic DNA
taattccaataattgtgg

SEQ ID NO: 44409 - DNA, 18 bp, Artificial Sequence
  Synthetic DNA
taattccaatttttttag

SEQ ID NO: 44410 - DNA, 18 bp, Artificial Sequence
  Synthetic DNA
taattccacaatctagag

SEQ ID NO: 44411 - DNA, 18 bp, Artificial Sequence
  Synthetic DNA
taattccactgactactg

SEQ ID NO: 44412 - DNA, 18 bp, Artificial Sequence
  Synthetic DNA
taattccacttattaaag

SEQ ID NO: 44413 - DNA, 18 bp, Artificial Sequence
  Synthetic DNA
taattccagtttctattg

SEQ ID NO: 44414 - DNA, 18 bp, Artificial Sequence
  Synthetic DNA
taattccattaaatatag

SEQ ID NO: 44415 - DNA, 18 bp, Artificial Sequence
  Synthetic DNA
taattcccttcgctaaag

SEQ ID NO: 44416 - DNA, 18 bp, Artificial Sequence
  Synthetic DNA
taattccgcccgctattg

SEQ ID NO: 44417 - DNA, 18 bp, Artificial Sequence
  Synthetic DNA
taattcctctctctattg

SEQ ID NO: 44418 - DNA, 18 bp, Artificial Sequence
  Synthetic DNA
taattcctgacactgtgg

SEQ ID NO: 44419 - DNA, 18 bp, Artificial Sequence
  Synthetic DNA
taattcctttctctatag

SEQ ID NO: 44420 - DNA, 18 bp, Artificial Sequence
  Synthetic DNA
taattcgaaacgtaactg

SEQ ID NO: 44421 - DNA, 18 bp, Artificial Sequence
  Synthetic DNA
taattcgaaaggcttaag

SEQ ID NO: 44422 - DNA, 18 bp, Artificial Sequence
  Synthetic DNA
taattcgaatcattcttg

SEQ ID NO: 44423 - DNA, 18 bp, Artificial Sequence
  Synthetic DNA
taattcgaatcccaaaag

SEQ ID NO: 44424 - DNA, 18 bp, Artificial Sequence
  Synthetic DNA
taattcgaatctcagatg

SEQ ID NO: 44425 - DNA, 18 bp, Artificial Sequence
  Synthetic DNA
taattcgacacggtaaag

SEQ ID NO: 44426 - DNA, 18 bp, Artificial Sequence
  Synthetic DNA
taattcgacacgtcttag

SEQ ID NO: 44427 - DNA, 18 bp, Artificial Sequence
  Synthetic DNA
taattcgacacttttttg

SEQ ID NO: 44428 - DNA, 18 bp, Artificial Sequence
  Synthetic DNA
taattcgacgcaacactg

SEQ ID NO: 44429 - DNA, 18 bp, Artificial Sequence
  Synthetic DNA
taattcgactaaggaaag

SEQ ID NO: 44430 - DNA, 18 bp, Artificial Sequence
  Synthetic DNA
taattcgactaattggag

SEQ ID NO: 44431 - DNA, 18 bp, Artificial Sequence
  Synthetic DNA
taattcgactaccaaccg

SEQ ID NO: 44432 - DNA, 18 bp, Artificial Sequence
  Synthetic DNA
taattcgactagcaacag

SEQ ID NO: 44433 - DNA, 18 bp, Artificial Sequence
  Synthetic DNA
taattcgactcctatttg

SEQ ID NO: 44434 - DNA, 18 bp, Artificial Sequence
  Synthetic DNA
taattcgactgaagctag

SEQ ID NO: 44435 - DNA, 18 bp, Artificial Sequence
  Synthetic DNA
taattcgacttccaaatg

SEQ ID NO: 44436 - DNA, 18 bp, Artificial Sequence
  Synthetic DNA
taattcgactttcgagag

SEQ ID NO: 44437 - DNA, 18 bp, Artificial Sequence
  Synthetic DNA
taattcgactttctacgg

SEQ ID NO: 44438 - DNA, 18 bp, Artificial Sequence
  Synthetic DNA
taattcgagaaactacag

SEQ ID NO: 44439 - DNA, 18 bp, Artificial Sequence
  Synthetic DNA
taattcgagtttttatag

SEQ ID NO: 44440 - DNA, 18 bp, Artificial Sequence
  Synthetic DNA
taattcgatccgattcag

SEQ ID NO: 44441 - DNA, 18 bp, Artificial Sequence
  Synthetic DNA
taattcgatgcattatcg

SEQ ID NO: 44442 - DNA, 18 bp, Artificial Sequence
  Synthetic DNA
taattcgattcacaaggg

SEQ ID NO: 44443 - DNA, 18 bp, Artificial Sequence
  Synthetic DNA
taattcgattcataattg

SEQ ID NO: 44444 - DNA, 18 bp, Artificial Sequence
  Synthetic DNA
taattcgatttacacttg

SEQ ID NO: 44445 - DNA, 18 bp, Artificial Sequence
  Synthetic DNA
taattcgcctcctattag

SEQ ID NO: 44446 - DNA, 18 bp, Artificial Sequence
  Synthetic DNA
taattcgcctctatatcg

SEQ ID NO: 44447 - DNA, 18 bp, Artificial Sequence
  Synthetic DNA
taattcgcctgttgaaag

SEQ ID NO: 44448 - DNA, 18 bp, Artificial Sequence
  Synthetic DNA
taattcggatcacaaaag

SEQ ID NO: 44449 - DNA, 18 bp, Artificial Sequence
  Synthetic DNA
taattcggcacgctttag

SEQ ID NO: 44450 - DNA, 18 bp, Artificial Sequence
  Synthetic DNA
taattcggcactcaaaag

SEQ ID NO: 44451 - DNA, 18 bp, Artificial Sequence
  Synthetic DNA
taattcggctccttttag

SEQ ID NO: 44452 - DNA, 18 bp, Artificial Sequence
  Synthetic DNA
taattcggcttagttacg

SEQ ID NO: 44453 - DNA, 18 bp, Artificial Sequence
  Synthetic DNA
taattcgtaaccctttag

SEQ ID NO: 44454 - DNA, 18 bp, Artificial Sequence
  Synthetic DNA
taattcgtcagaaaattg

SEQ ID NO: 44455 - DNA, 18 bp, Artificial Sequence
  Synthetic DNA
taattcgtctagctgttg

SEQ ID NO: 44456 - DNA, 18 bp, Artificial Sequence
  Synthetic DNA
taattcgtctcaacattg

SEQ ID NO: 44457 - DNA, 18 bp, Artificial Sequence
  Synthetic DNA
taattcgtctcacaactg

SEQ ID NO: 44458 - DNA, 18 bp, Artificial Sequence
  Synthetic DNA
taattcgtctgaccaacg

SEQ ID NO: 44459 - DNA, 18 bp, Artificial Sequence
  Synthetic DNA
taattcgtcttacttacg

SEQ ID NO: 44460 - DNA, 18 bp, Artificial Sequence
  Synthetic DNA
taattcgtcttgctgtag

SEQ ID NO: 44461 - DNA, 18 bp, Artificial Sequence
  Synthetic DNA
taattcgtttaactaccg

SEQ ID NO: 44462 - DNA, 18 bp, Artificial Sequence
  Synthetic DNA
taattctaaacaataatg

SEQ ID NO: 44463 - DNA, 18 bp, Artificial Sequence
  Synthetic DNA
taattctacaaaatttag

SEQ ID NO: 44464 - DNA, 18 bp, Artificial Sequence
  Synthetic DNA
taattctacaaactaatg

SEQ ID NO: 44465 - DNA, 18 bp, Artificial Sequence
  Synthetic DNA
taattctaccatctatcg

SEQ ID NO: 44466 - DNA, 18 bp, Artificial Sequence
  Synthetic DNA
taattctacgctcattag

SEQ ID NO: 44467 - DNA, 18 bp, Artificial Sequence
  Synthetic DNA
taattctactcacctttg

SEQ ID NO: 44468 - DNA, 18 bp, Artificial Sequence
  Synthetic DNA
taattctactcatttttg

SEQ ID NO: 44469 - DNA, 18 bp, Artificial Sequence
  Synthetic DNA
taattctactctatattg

SEQ ID NO: 44470 - DNA, 18 bp, Artificial Sequence
  Synthetic DNA
taattctatacacacttg

SEQ ID NO: 44471 - DNA, 18 bp, Artificial Sequence
  Synthetic DNA
taattctcctccctttag

SEQ ID NO: 44472 - DNA, 18 bp, Artificial Sequence
  Synthetic DNA
taattctccttactaaag

SEQ ID NO: 44473 - DNA, 18 bp, Artificial Sequence
  Synthetic DNA
taattctcttcaacatag

SEQ ID NO: 44474 - DNA, 18 bp, Artificial Sequence
  Synthetic DNA
taattctgcaaactatag

SEQ ID NO: 44475 - DNA, 18 bp, Artificial Sequence
  Synthetic DNA
taattctgctctctattg

SEQ ID NO: 44476 - DNA, 18 bp, Artificial Sequence
  Synthetic DNA
taattcttaaaactcaag

SEQ ID NO: 44477 - DNA, 18 bp, Artificial Sequence
  Synthetic DNA
taattcttatatctttag

SEQ ID NO: 44478 - DNA, 18 bp, Artificial Sequence
  Synthetic DNA
taattcttctcattatgg

SEQ ID NO: 44479 - DNA, 18 bp, Artificial Sequence
  Synthetic DNA
taattcttgtctcttgcg

SEQ ID NO: 44480 - DNA, 18 bp, Artificial Sequence
  Synthetic DNA
taattgaactaaatatag

SEQ ID NO: 44481 - DNA, 18 bp, Artificial Sequence
  Synthetic DNA
taattgaactaactttag

SEQ ID NO: 44482 - DNA, 18 bp, Artificial Sequence
  Synthetic DNA
taattgcacacacaaaag

SEQ ID NO: 44483 - DNA, 18 bp, Artificial Sequence
  Synthetic DNA
taattgcactcacaaatg

SEQ ID NO: 44484 - DNA, 18 bp, Artificial Sequence
  Synthetic DNA
taattgcagtagctttag

SEQ ID NO: 44485 - DNA, 18 bp, Artificial Sequence
  Synthetic DNA
taattggaaccattatag

SEQ ID NO: 44486 - DNA, 18 bp, Artificial Sequence
  Synthetic DNA
taattggactaactctcg

SEQ ID NO: 44487 - DNA, 18 bp, Artificial Sequence
  Synthetic DNA
taattggactaacttcag

SEQ ID NO: 44488 - DNA, 18 bp, Artificial Sequence
  Synthetic DNA
taattggactatttatag

SEQ ID NO: 44489 - DNA, 18 bp, Artificial Sequence
  Synthetic DNA
taattggagtcccagtag

SEQ ID NO: 44490 - DNA, 18 bp, Artificial Sequence
  Synthetic DNA
taattggattcaataacg

SEQ ID NO: 44491 - DNA, 18 bp, Artificial Sequence
  Synthetic DNA
taattggtcacactattg

SEQ ID NO: 44492 - DNA, 18 bp, Artificial Sequence
  Synthetic DNA
taattggtctcaatctag

SEQ ID NO: 44493 - DNA, 18 bp, Artificial Sequence
  Synthetic DNA
taattgtactcataatcg

SEQ ID NO: 44494 - DNA, 18 bp, Artificial Sequence
  Synthetic DNA
taattgttctcactatcg

SEQ ID NO: 44495 - DNA, 18 bp, Artificial Sequence
  Synthetic DNA
taatttaaatcagaagag

SEQ ID NO: 44496 - DNA, 18 bp, Artificial Sequence
  Synthetic DNA
taatttaacacactaaag

SEQ ID NO: 44497 - DNA, 18 bp, Artificial Sequence
  Synthetic DNA
taatttaacaccccgaag

SEQ ID NO: 44498 - DNA, 18 bp, Artificial Sequence
  Synthetic DNA
taatttaacgctcgatag

SEQ ID NO: 44499 - DNA, 18 bp, Artificial Sequence
  Synthetic DNA
taatttaactcagtattg

SEQ ID NO: 44500 - DNA, 18 bp, Artificial Sequence
  Synthetic DNA
taatttaactctgcattg

SEQ ID NO: 44501 - DNA, 18 bp, Artificial Sequence
  Synthetic DNA
taatttaccacactatcg

SEQ ID NO: 44502 - DNA, 18 bp, Artificial Sequence
  Synthetic DNA
taatttatgacactaaag

SEQ ID NO: 44503 - DNA, 18 bp, Artificial Sequence
  Synthetic DNA
taatttcattcacaataa

SEQ ID NO: 44504 - DNA, 18 bp, Artificial Sequence
  Synthetic DNA
taatttctctaatgatag

SEQ ID NO: 44505 - DNA, 18 bp, Artificial Sequence
  Synthetic DNA
taatttgacctagtgtag

SEQ ID NO: 44506 - DNA, 18 bp, Artificial Sequence
  Synthetic DNA
taatttgactcataacag

SEQ ID NO: 44507 - DNA, 18 bp, Artificial Sequence
  Synthetic DNA
taatttgaggaactatag

SEQ ID NO: 44508 - DNA, 18 bp, Artificial Sequence
  Synthetic DNA
taatttggcccaccatag

SEQ ID NO: 44509 - DNA, 18 bp, Artificial Sequence
  Synthetic DNA
taatttggctccctaaag

SEQ ID NO: 44510 - DNA, 18 bp, Artificial Sequence
  Synthetic DNA
taatttgtctaactaaag

SEQ ID NO: 44511 - DNA, 18 bp, Artificial Sequence
  Synthetic DNA
taatttgtctctgttaag

SEQ ID NO: 44512 - DNA, 18 bp, Artificial Sequence
  Synthetic DNA
taatttgtgtgcgtctag

SEQ ID NO: 44513 - DNA, 18 bp, Artificial Sequence
  Synthetic DNA
taattttaatctctatag

SEQ ID NO: 44514 - DNA, 18 bp, Artificial Sequence
  Synthetic DNA
taattttactcaaaatag

SEQ ID NO: 44515 - DNA, 18 bp, Artificial Sequence
  Synthetic DNA
taattttactcactcatg

SEQ ID NO: 44516 - DNA, 18 bp, Artificial Sequence
  Synthetic DNA
taattttactcactgttg

SEQ ID NO: 44517 - DNA, 18 bp, Artificial Sequence
  Synthetic DNA
tacaaagacaaaccatag

SEQ ID NO: 44518 - DNA, 18 bp, Artificial Sequence
  Synthetic DNA
tacaaagagtcactttag

SEQ ID NO: 44519 - DNA, 18 bp, Artificial Sequence
  Synthetic DNA
tacaaagtttcactgtag

SEQ ID NO: 44520 - DNA, 18 bp, Artificial Sequence
  Synthetic DNA
tacaaatatacactctag

SEQ ID NO: 44521 - DNA, 18 bp, Artificial Sequence
  Synthetic DNA
tacaacaattcactagag

SEQ ID NO: 44522 - DNA, 18 bp, Artificial Sequence
  Synthetic DNA
tacaacaattctctatag

SEQ ID NO: 44523 - DNA, 18 bp, Artificial Sequence
  Synthetic DNA
tacaaccactggcttatg

SEQ ID NO: 44524 - DNA, 18 bp, Artificial Sequence
  Synthetic DNA
tacaacgaatcacattag

SEQ ID NO: 44525 - DNA, 18 bp, Artificial Sequence
  Synthetic DNA
tacaacgaatctcaattg

SEQ ID NO: 44526 - DNA, 18 bp, Artificial Sequence
  Synthetic DNA
tacaacgactcacaagtg

SEQ ID NO: 44527 - DNA, 18 bp, Artificial Sequence
  Synthetic DNA
tacaacgagacacaatag

SEQ ID NO: 44528 - DNA, 18 bp, Artificial Sequence
  Synthetic DNA
tacaacgattcgctaatg

SEQ ID NO: 44529 - DNA, 18 bp, Artificial Sequence
  Synthetic DNA
tacaacggctatttatcg

SEQ ID NO: 44530 - DNA, 18 bp, Artificial Sequence
  Synthetic DNA
tacaacgtctcacgaaag

SEQ ID NO: 44531 - DNA, 18 bp, Artificial Sequence
  Synthetic DNA
tacaacgtctcactctaa

SEQ ID NO: 44532 - DNA, 18 bp, Artificial Sequence
  Synthetic DNA
tacaacgtctcccaatcg

SEQ ID NO: 44533 - DNA, 18 bp, Artificial Sequence
  Synthetic DNA
tacaactactggcagtag

SEQ ID NO: 44534 - DNA, 18 bp, Artificial Sequence
  Synthetic DNA
tacaactattcgcttaag

SEQ ID NO: 44535 - DNA, 18 bp, Artificial Sequence
  Synthetic DNA
tacaagtacacactatag

SEQ ID NO: 44536 - DNA, 18 bp, Artificial Sequence
  Synthetic DNA
tacaatgactctctttag

SEQ ID NO: 44537 - DNA, 18 bp, Artificial Sequence
  Synthetic DNA
tacaatgtctcccgatag

SEQ ID NO: 44538 - DNA, 18 bp, Artificial Sequence
  Synthetic DNA
tacagcgtctcaaaatag

SEQ ID NO: 44539 - DNA, 18 bp, Artificial Sequence
  Synthetic DNA
tacatcaactcactttag

SEQ ID NO: 44540 - DNA, 18 bp, Artificial Sequence
  Synthetic DNA
tacatcgagtcacttaag

SEQ ID NO: 44541 - DNA, 18 bp, Artificial Sequence
  Synthetic DNA
tacatcgtcacactgtag

SEQ ID NO: 44542 - DNA, 18 bp, Artificial Sequence
  Synthetic DNA
tacatgaaattactatag

SEQ ID NO: 44543 - DNA, 18 bp, Artificial Sequence
  Synthetic DNA
tacattgactgattatag

SEQ ID NO: 44544 - DNA, 18 bp, Artificial Sequence
  Synthetic DNA
taccaagactcgcattag

SEQ ID NO: 44545 - DNA, 18 bp, Artificial Sequence
  Synthetic DNA
taccacaagttactaagg

SEQ ID NO: 44546 - DNA, 18 bp, Artificial Sequence
  Synthetic DNA
taccacgacgctctatgg

SEQ ID NO: 44547 - DNA, 18 bp, Artificial Sequence
  Synthetic DNA
taccaggattaacccttg

SEQ ID NO: 44548 - DNA, 18 bp, Artificial Sequence
  Synthetic DNA
taccatcactcattaaag

SEQ ID NO: 44549 - DNA, 18 bp, Artificial Sequence
  Synthetic DNA
taccatgacgaactataa

SEQ ID NO: 44550 - DNA, 18 bp, Artificial Sequence
  Synthetic DNA
tacccaggaacactatag

SEQ ID NO: 44551 - DNA, 18 bp, Artificial Sequence
  Synthetic DNA
taccgcgtttcgctaacg

SEQ ID NO: 44552 - DNA, 18 bp, Artificial Sequence
  Synthetic DNA
tacctccactcactattg

SEQ ID NO: 44553 - DNA, 18 bp, Artificial Sequence
  Synthetic DNA
tacctcggctcgttatag

SEQ ID NO: 44554 - DNA, 18 bp, Artificial Sequence
  Synthetic DNA
tacgacaactaagaattg

SEQ ID NO: 44555 - DNA, 18 bp, Artificial Sequence
  Synthetic DNA
tacgacgatagactctag

SEQ ID NO: 44556 - DNA, 18 bp, Artificial Sequence
  Synthetic DNA
tacgacgcatccctatag

SEQ ID NO: 44557 - DNA, 18 bp, Artificial Sequence
  Synthetic DNA
tacgaggagtcattttag

SEQ ID NO: 44558 - DNA, 18 bp, Artificial Sequence
  Synthetic DNA
tacgagtacttacttcag

SEQ ID NO: 44559 - DNA, 18 bp, Artificial Sequence
  Synthetic DNA
tacgtcaactcttaaatg

SEQ ID NO: 44560 - DNA, 18 bp, Artificial Sequence
  Synthetic DNA
tacgtcgattcactaaag

SEQ ID NO: 44561 - DNA, 18 bp, Artificial Sequence
  Synthetic DNA
tactaaaacgttttatag

SEQ ID NO: 44562 - DNA, 18 bp, Artificial Sequence
  Synthetic DNA
tactaaaactctcactcg

SEQ ID NO: 44563 - DNA, 18 bp, Artificial Sequence
  Synthetic DNA
tactaagaaactcattag

SEQ ID NO: 44564 - DNA, 18 bp, Artificial Sequence
  Synthetic DNA
tactaagattcattttag

SEQ ID NO: 44565 - DNA, 18 bp, Artificial Sequence
  Synthetic DNA
tactaagtttcacaatag

SEQ ID NO: 44566 - DNA, 18 bp, Artificial Sequence
  Synthetic DNA
tactacaactacatatag

SEQ ID NO: 44567 - DNA, 18 bp, Artificial Sequence
  Synthetic DNA
tactacaactagaaaaag

SEQ ID NO: 44568 - DNA, 18 bp, Artificial Sequence
  Synthetic DNA
tactacaactcgcataag

SEQ ID NO: 44569 - DNA, 18 bp, Artificial Sequence
  Synthetic DNA
tactacaattcaccaaag

SEQ ID NO: 44570 - DNA, 18 bp, Artificial Sequence
  Synthetic DNA
tactaccattaacaaaag

SEQ ID NO: 44571 - DNA, 18 bp, Artificial Sequence
  Synthetic DNA
tactacgaaacgttatag

SEQ ID NO: 44572 - DNA, 18 bp, Artificial Sequence
  Synthetic DNA
tactacgaatctctaagg

SEQ ID NO: 44573 - DNA, 18 bp, Artificial Sequence
  Synthetic DNA
tactacgacttattaacg

SEQ ID NO: 44574 - DNA, 18 bp, Artificial Sequence
  Synthetic DNA
tactacgagcctatacag

SEQ ID NO: 44575 - DNA, 18 bp, Artificial Sequence
  Synthetic DNA
tactacgatcgactattg

SEQ ID NO: 44576 - DNA, 18 bp, Artificial Sequence
  Synthetic DNA
tactacgattaaccattg

SEQ ID NO: 44577 - DNA, 18 bp, Artificial Sequence
  Synthetic DNA
tactacgattcacctaag

SEQ ID NO: 44578 - DNA, 18 bp, Artificial Sequence
  Synthetic DNA
tactacgattctcttcag

SEQ ID NO: 44579 - DNA, 18 bp, Artificial Sequence
  Synthetic DNA
tactacgctttacattag

SEQ ID NO: 44580 - DNA, 18 bp, Artificial Sequence
  Synthetic DNA
tactacggcttacagtag

SEQ ID NO: 44581 - DNA, 18 bp, Artificial Sequence
  Synthetic DNA
tactacggtaaactatag

SEQ ID NO: 44582 - DNA, 18 bp, Artificial Sequence
  Synthetic DNA
tactacgtcactctaaag

SEQ ID NO: 44583 - DNA, 18 bp, Artificial Sequence
  Synthetic DNA
tactacgtcatagtaaag

SEQ ID NO: 44584 - DNA, 18 bp, Artificial Sequence
  Synthetic DNA
tactacgtctccttgtag

SEQ ID NO: 44585 - DNA, 18 bp, Artificial Sequence
  Synthetic DNA
tactacgtctgacaaaag

SEQ ID NO: 44586 - DNA, 18 bp, Artificial Sequence
  Synthetic DNA
tactacgtcttaccaagg

SEQ ID NO: 44587 - DNA, 18 bp, Artificial Sequence
  Synthetic DNA
tactacgtcttattcccg

SEQ ID NO: 44588 - DNA, 18 bp, Artificial Sequence
  Synthetic DNA
tactacgtggcactctag

SEQ ID NO: 44589 - DNA, 18 bp, Artificial Sequence
  Synthetic DNA
tactacgtgtcactgaag

SEQ ID NO: 44590 - DNA, 18 bp, Artificial Sequence
  Synthetic DNA
tactacgtgtcccaatcg

SEQ ID NO: 44591 - DNA, 18 bp, Artificial Sequence
  Synthetic DNA
tactacgtttcacaactg

SEQ ID NO: 44592 - DNA, 18 bp, Artificial Sequence
  Synthetic DNA
tactactattaacttaag

SEQ ID NO: 44593 - DNA, 18 bp, Artificial Sequence
  Synthetic DNA
tactactttcctcgctag

SEQ ID NO: 44594 - DNA, 18 bp, Artificial Sequence
  Synthetic DNA
tactaggaatcacttttg

SEQ ID NO: 44595 - DNA, 18 bp, Artificial Sequence
  Synthetic DNA
tactagggctggcaatag

SEQ ID NO: 44596 - DNA, 18 bp, Artificial Sequence
  Synthetic DNA
tactatgagtcacttttg

SEQ ID NO: 44597 - DNA, 18 bp, Artificial Sequence
  Synthetic DNA
tactatggctcaccaaag

SEQ ID NO: 44598 - DNA, 18 bp, Artificial Sequence
  Synthetic DNA
tactatgtcagactatag

SEQ ID NO: 44599 - DNA, 18 bp, Artificial Sequence
  Synthetic DNA
tactattactcctttcag

SEQ ID NO: 44600 - DNA, 18 bp, Artificial Sequence
  Synthetic DNA
tactatttctaactcaag

SEQ ID NO: 44601 - DNA, 18 bp, Artificial Sequence
  Synthetic DNA
tactcagaatcactgacg

SEQ ID NO: 44602 - DNA, 18 bp, Artificial Sequence
  Synthetic DNA
tactcagactctcataag

SEQ ID NO: 44603 - DNA, 18 bp, Artificial Sequence
  Synthetic DNA
tactcatacacactttag

SEQ ID NO: 44604 - DNA, 18 bp, Artificial Sequence
  Synthetic DNA
tactcatactcaataacg

SEQ ID NO: 44605 - DNA, 18 bp, Artificial Sequence
  Synthetic DNA
tactccagctaatgatag

SEQ ID NO: 44606 - DNA, 18 bp, Artificial Sequence
  Synthetic DNA
tactcccacagactatag

SEQ ID NO: 44607 - DNA, 18 bp, Artificial Sequence
  Synthetic DNA
tactccgacaatctatag

SEQ ID NO: 44608 - DNA, 18 bp, Artificial Sequence
  Synthetic DNA
tactccgactctcaattg

SEQ ID NO: 44609 - DNA, 18 bp, Artificial Sequence
  Synthetic DNA
tactctgactcactaatg

SEQ ID NO: 44610 - DNA, 18 bp, Artificial Sequence
  Synthetic DNA
tactgagactgactttgg

SEQ ID NO: 44611 - DNA, 18 bp, Artificial Sequence
  Synthetic DNA
tactgagtctcgctaaag

SEQ ID NO: 44612 - DNA, 18 bp, Artificial Sequence
  Synthetic DNA
tactgcatcacgagatcg

SEQ ID NO: 44613 - DNA, 18 bp, Artificial Sequence
  Synthetic DNA
tactgcattacacaatag

SEQ ID NO: 44614 - DNA, 18 bp, Artificial Sequence
  Synthetic DNA
tactgcgacactcaatag

SEQ ID NO: 44615 - DNA, 18 bp, Artificial Sequence
  Synthetic DNA
tactgcgactcttgatag

SEQ ID NO: 44616 - DNA, 18 bp, Artificial Sequence
  Synthetic DNA
tactgcgactttctatcg

SEQ ID NO: 44617 - DNA, 18 bp, Artificial Sequence
  Synthetic DNA
tactgctacacactttag

SEQ ID NO: 44618 - DNA, 18 bp, Artificial Sequence
  Synthetic DNA
tactgctacagcatatgg

SEQ ID NO: 44619 - DNA, 18 bp, Artificial Sequence
  Synthetic DNA
tactgtgaatcacttaag

SEQ ID NO: 44620 - DNA, 18 bp, Artificial Sequence
  Synthetic DNA
tacttagcctaactatag

SEQ ID NO: 44621 - DNA, 18 bp, Artificial Sequence
  Synthetic DNA
tacttatattacctaatg

SEQ ID NO: 44622 - DNA, 18 bp, Artificial Sequence
  Synthetic DNA
tacttcgaatcaataatg

SEQ ID NO: 44623 - DNA, 18 bp, Artificial Sequence
  Synthetic DNA
tacttcgacaaataatag

SEQ ID NO: 44624 - DNA, 18 bp, Artificial Sequence
  Synthetic DNA
tacttcgattgtctatag

SEQ ID NO: 44625 - DNA, 18 bp, Artificial Sequence
  Synthetic DNA
tacttcgatttaatgaag

SEQ ID NO: 44626 - DNA, 18 bp, Artificial Sequence
  Synthetic DNA
tacttcgcatctctctag

SEQ ID NO: 44627 - DNA, 18 bp, Artificial Sequence
  Synthetic DNA
tacttcggcacagcatag

SEQ ID NO: 44628 - DNA, 18 bp, Artificial Sequence
  Synthetic DNA
tacttcgtcagacaagag

SEQ ID NO: 44629 - DNA, 18 bp, Artificial Sequence
  Synthetic DNA
tacttcgtctcagaatag

SEQ ID NO: 44630 - DNA, 18 bp, Artificial Sequence
  Synthetic DNA
tacttctacacacataag

SEQ ID NO: 44631 - DNA, 18 bp, Artificial Sequence
  Synthetic DNA
tacttctactccttgagg

SEQ ID NO: 44632 - DNA, 18 bp, Artificial Sequence
  Synthetic DNA
tacttcttatcacttgag

SEQ ID NO: 44633 - DNA, 18 bp, Artificial Sequence
  Synthetic DNA
tactttgaatgactcttg

SEQ ID NO: 44634 - DNA, 18 bp, Artificial Sequence
  Synthetic DNA
tactttggctcactatcg

SEQ ID NO: 44635 - DNA, 18 bp, Artificial Sequence
  Synthetic DNA
tactttgtcacaccatag

SEQ ID NO: 44636 - DNA, 18 bp, Artificial Sequence
  Synthetic DNA
tactttgtctcactacag

SEQ ID NO: 44637 - DNA, 18 bp, Artificial Sequence
  Synthetic DNA
tagaaagacgcactaaag

SEQ ID NO: 44638 - DNA, 18 bp, Artificial Sequence
  Synthetic DNA
tagaaagtttcattgtag

SEQ ID NO: 44639 - DNA, 18 bp, Artificial Sequence
  Synthetic DNA
tagaacaacacactgagg

SEQ ID NO: 44640 - DNA, 18 bp, Artificial Sequence
  Synthetic DNA
tagaacgaatcattttag

SEQ ID NO: 44641 - DNA, 18 bp, Artificial Sequence
  Synthetic DNA
tagaacgacacacccttg

SEQ ID NO: 44642 - DNA, 18 bp, Artificial Sequence
  Synthetic DNA
tagaacgacagactaaag

SEQ ID NO: 44643 - DNA, 18 bp, Artificial Sequence
  Synthetic DNA
tagaacgactctccattg

SEQ ID NO: 44644 - DNA, 18 bp, Artificial Sequence
  Synthetic DNA
tagaacgagtctcttgag

SEQ ID NO: 44645 - DNA, 18 bp, Artificial Sequence
  Synthetic DNA
tagaacgtgtctctaaag

SEQ ID NO: 44646 - DNA, 18 bp, Artificial Sequence
  Synthetic DNA
tagactgacttactttcg

SEQ ID NO: 44647 - DNA, 18 bp, Artificial Sequence
  Synthetic DNA
tagagcgaattccaattg

SEQ ID NO: 44648 - DNA, 18 bp, Artificial Sequence
  Synthetic DNA
tagatagacctactattg

SEQ ID NO: 44649 - DNA, 18 bp, Artificial Sequence
  Synthetic DNA
tagatccactcactttag

SEQ ID NO: 44650 - DNA, 18 bp, Artificial Sequence
  Synthetic DNA
tagatcgacacattatag

SEQ ID NO: 44651 - DNA, 18 bp, Artificial Sequence
  Synthetic DNA
tagatcgtctcaatatag

SEQ ID NO: 44652 - DNA, 18 bp, Artificial Sequence
  Synthetic DNA
tagatcttctcactatag

SEQ ID NO: 44653 - DNA, 18 bp, Artificial Sequence
  Synthetic DNA
tagcacaactcacataag

SEQ ID NO: 44654 - DNA, 18 bp, Artificial Sequence
  Synthetic DNA
tagcacgtcttaatttag

SEQ ID NO: 44655 - DNA, 18 bp, Artificial Sequence
  Synthetic DNA
tagcacttcaaacgatag

SEQ ID NO: 44656 - DNA, 18 bp, Artificial Sequence
  Synthetic DNA
tagcagaactcactatgg

SEQ ID NO: 44657 - DNA, 18 bp, Artificial Sequence
  Synthetic DNA
tagcatgacccactaaag

SEQ ID NO: 44658 - DNA, 18 bp, Artificial Sequence
  Synthetic DNA
tagcccgactaaccatag

SEQ ID NO: 44659 - DNA, 18 bp, Artificial Sequence
  Synthetic DNA
tagcgcgactcacttaag

SEQ ID NO: 44660 - DNA, 18 bp, Artificial Sequence
  Synthetic DNA
tagctccacgaaatgtag

SEQ ID NO: 44661 - DNA, 18 bp, Artificial Sequence
  Synthetic DNA
tagctcctcgaactaaag

SEQ ID NO: 44662 - DNA, 18 bp, Artificial Sequence
  Synthetic DNA
tagctcgacacattatgg

SEQ ID NO: 44663 - DNA, 18 bp, Artificial Sequence
  Synthetic DNA
tagctctacacactctag

SEQ ID NO: 44664 - DNA, 18 bp, Artificial Sequence
  Synthetic DNA
taggacgaaccattgtag

SEQ ID NO: 44665 - DNA, 18 bp, Artificial Sequence
  Synthetic DNA
tagtaacacataatatag

SEQ ID NO: 44666 - DNA, 18 bp, Artificial Sequence
  Synthetic DNA
tagtaagaattaatatag

SEQ ID NO: 44667 - DNA, 18 bp, Artificial Sequence
  Synthetic DNA
tagtaagactaactcatg

SEQ ID NO: 44668 - DNA, 18 bp, Artificial Sequence
  Synthetic DNA
tagtaagactatctatcg

SEQ ID NO: 44669 - DNA, 18 bp, Artificial Sequence
  Synthetic DNA
tagtaaggcacactcggg

SEQ ID NO: 44670 - DNA, 18 bp, Artificial Sequence
  Synthetic DNA
tagtaagtctaattagag

SEQ ID NO: 44671 - DNA, 18 bp, Artificial Sequence
  Synthetic DNA
tagtaataaccaaactag

SEQ ID NO: 44672 - DNA, 18 bp, Artificial Sequence
  Synthetic DNA
tagtaatactaactaaag

SEQ ID NO: 44673 - DNA, 18 bp, Artificial Sequence
  Synthetic DNA
tagtacaactcccattag

SEQ ID NO: 44674 - DNA, 18 bp, Artificial Sequence
  Synthetic DNA
tagtacaactctgtctag

SEQ ID NO: 44675 - DNA, 18 bp, Artificial Sequence
  Synthetic DNA
tagtacacctcagcaaag

SEQ ID NO: 44676 - DNA, 18 bp, Artificial Sequence
  Synthetic DNA
tagtacatgtcacttaag

SEQ ID NO: 44677 - DNA, 18 bp, Artificial Sequence
  Synthetic DNA
tagtaccacatccaatag

SEQ ID NO: 44678 - DNA, 18 bp, Artificial Sequence
  Synthetic DNA
tagtaccactcaaatagg

SEQ ID NO: 44679 - DNA, 18 bp, Artificial Sequence
  Synthetic DNA
tagtaccacttgcaatag

SEQ ID NO: 44680 - DNA, 18 bp, Artificial Sequence
  Synthetic DNA
tagtacgactacatttcg

SEQ ID NO: 44681 - DNA, 18 bp, Artificial Sequence
  Synthetic DNA
tagtacgactcgcgaacg

SEQ ID NO: 44682 - DNA, 18 bp, Artificial Sequence
  Synthetic DNA
tagtacgatacactaatg

SEQ ID NO: 44683 - DNA, 18 bp, Artificial Sequence
  Synthetic DNA
tagtacgatgctaaatag

SEQ ID NO: 44684 - DNA, 18 bp, Artificial Sequence
  Synthetic DNA
tagtacgccacatctttg

SEQ ID NO: 44685 - DNA, 18 bp, Artificial Sequence
  Synthetic DNA
tagtacgccatactatgg

SEQ ID NO: 44686 - DNA, 18 bp, Artificial Sequence
  Synthetic DNA
tagtacgccccaccatcg

SEQ ID NO: 44687 - DNA, 18 bp, Artificial Sequence
  Synthetic DNA
tagtacgcctcaattttg

SEQ ID NO: 44688 - DNA, 18 bp, Artificial Sequence
  Synthetic DNA
tagtacggctcgaattag

SEQ ID NO: 44689 - DNA, 18 bp, Artificial Sequence
  Synthetic DNA
tagtacggtaaccttttg

SEQ ID NO: 44690 - DNA, 18 bp, Artificial Sequence
  Synthetic DNA
tagtacgtctcagaattg

SEQ ID NO: 44691 - DNA, 18 bp, Artificial Sequence
  Synthetic DNA
tagtacgtctctgtattg

SEQ ID NO: 44692 - DNA, 18 bp, Artificial Sequence
  Synthetic DNA
tagtacgtgtctaaatag

SEQ ID NO: 44693 - DNA, 18 bp, Artificial Sequence
  Synthetic DNA
tagtacgtttcagtatcg

SEQ ID NO: 44694 - DNA, 18 bp, Artificial Sequence
  Synthetic DNA
tagtactacacagtaaag

SEQ ID NO: 44695 - DNA, 18 bp, Artificial Sequence
  Synthetic DNA
tagtactcctcacataag

SEQ ID NO: 44696 - DNA, 18 bp, Artificial Sequence
  Synthetic DNA
tagtacttctctctaaag

SEQ ID NO: 44697 - DNA, 18 bp, Artificial Sequence
  Synthetic DNA
tagtagtactcaaaatag

SEQ ID NO: 44698 - DNA, 18 bp, Artificial Sequence
  Synthetic DNA
tagtataacaatctatcg

SEQ ID NO: 44699 - DNA, 18 bp, Artificial Sequence
  Synthetic DNA
tagtataactcactagtg

SEQ ID NO: 44700 - DNA, 18 bp, Artificial Sequence
  Synthetic DNA
tagtatcacacattaaag

SEQ ID NO: 44701 - DNA, 18 bp, Artificial Sequence
  Synthetic DNA
tagtatgactccatttag

SEQ ID NO: 44702 - DNA, 18 bp, Artificial Sequence
  Synthetic DNA
tagtatgactctcttcag

SEQ ID NO: 44703 - DNA, 18 bp, Artificial Sequence
  Synthetic DNA
tagtatgattcaccaaag

SEQ ID NO: 44704 - DNA, 18 bp, Artificial Sequence
  Synthetic DNA
tagtatgccacattattg

SEQ ID NO: 44705 - DNA, 18 bp, Artificial Sequence
  Synthetic DNA
tagtatgccatactaacg

SEQ ID NO: 44706 - DNA, 18 bp, Artificial Sequence
  Synthetic DNA
tagtcagactcactaagg

SEQ ID NO: 44707 - DNA, 18 bp, Artificial Sequence
  Synthetic DNA
tagtcagagtcgcttttg

SEQ ID NO: 44708 - DNA, 18 bp, Artificial Sequence
  Synthetic DNA
tagtcataatttctaaag

SEQ ID NO: 44709 - DNA, 18 bp, Artificial Sequence
  Synthetic DNA
tagtccgactcaattatg

SEQ ID NO: 44710 - DNA, 18 bp, Artificial Sequence
  Synthetic DNA
tagtccgattgataatag

SEQ ID NO: 44711 - DNA, 18 bp, Artificial Sequence
  Synthetic DNA
tagtccgcttagctatcg

SEQ ID NO: 44712 - DNA, 18 bp, Artificial Sequence
  Synthetic DNA
tagtgcctctatctatag

SEQ ID NO: 44713 - DNA, 18 bp, Artificial Sequence
  Synthetic DNA
tagtgcgaatcaataaag

SEQ ID NO: 44714 - DNA, 18 bp, Artificial Sequence
  Synthetic DNA
tagtgcgactttcaatag

SEQ ID NO: 44715 - DNA, 18 bp, Artificial Sequence
  Synthetic DNA
tagtgcgagtaacaagag

SEQ ID NO: 44716 - DNA, 18 bp, Artificial Sequence
  Synthetic DNA
tagtgcgcgtccctatag

SEQ ID NO: 44717 - DNA, 18 bp, Artificial Sequence
  Synthetic DNA
tagttagactcacattag

SEQ ID NO: 44718 - DNA, 18 bp, Artificial Sequence
  Synthetic DNA
tagttagactctaaacag

SEQ ID NO: 44719 - DNA, 18 bp, Artificial Sequence
  Synthetic DNA
tagttcaactcgctaaag

SEQ ID NO: 44720 - DNA, 18 bp, Artificial Sequence
  Synthetic DNA
tagttccactttcggtcg

SEQ ID NO: 44721 - DNA, 18 bp, Artificial Sequence
  Synthetic DNA
tagttcgaatcagtaatg

SEQ ID NO: 44722 - DNA, 18 bp, Artificial Sequence
  Synthetic DNA
tagttcgactcaattttg

SEQ ID NO: 44723 - DNA, 18 bp, Artificial Sequence
  Synthetic DNA
tagttcgagacatttaag

SEQ ID NO: 44724 - DNA, 18 bp, Artificial Sequence
  Synthetic DNA
tagttcgcttcattgaag

SEQ ID NO: 44725 - DNA, 18 bp, Artificial Sequence
  Synthetic DNA
tagttcgtaccactaaag

SEQ ID NO: 44726 - DNA, 18 bp, Artificial Sequence
  Synthetic DNA
tagttcgtctcccttttg

SEQ ID NO: 44727 - DNA, 18 bp, Artificial Sequence
  Synthetic DNA
tagttcgtgtctcaatag

SEQ ID NO: 44728 - DNA, 18 bp, Artificial Sequence
  Synthetic DNA
tagttctactaactatcg

SEQ ID NO: 44729 - DNA, 18 bp, Artificial Sequence
  Synthetic DNA
tagttctactttcttttg

SEQ ID NO: 44730 - DNA, 18 bp, Artificial Sequence
  Synthetic DNA
tagttggtctatctatag

SEQ ID NO: 44731 - DNA, 18 bp, Artificial Sequence
  Synthetic DNA
tagttggtcttactaaag

SEQ ID NO: 44732 - DNA, 18 bp, Artificial Sequence
  Synthetic DNA
tagttgtactcgctatag

SEQ ID NO: 44733 - DNA, 18 bp, Artificial Sequence
  Synthetic DNA
tagtttaactcgctatag

SEQ ID NO: 44734 - DNA, 18 bp, Artificial Sequence
  Synthetic DNA
tagtttgacatactatag

SEQ ID NO: 44735 - DNA, 18 bp, Artificial Sequence
  Synthetic DNA
tagtttgactcatttcag

SEQ ID NO: 44736 - DNA, 18 bp, Artificial Sequence
  Synthetic DNA
tagtttggctcagtatgg

SEQ ID NO: 44737 - DNA, 18 bp, Artificial Sequence
  Synthetic DNA
tagttttaccgattaaag

SEQ ID NO: 44738 - DNA, 18 bp, Artificial Sequence
  Synthetic DNA
tagttttactcacttacg

SEQ ID NO: 44739 - DNA, 18 bp, Artificial Sequence
  Synthetic DNA
tataaagattcattagtg

SEQ ID NO: 44740 - DNA, 18 bp, Artificial Sequence
  Synthetic DNA
tataaagtatcactattg

SEQ ID NO: 44741 - DNA, 18 bp, Artificial Sequence
  Synthetic DNA
tataacaaattactatag

SEQ ID NO: 44742 - DNA, 18 bp, Artificial Sequence
  Synthetic DNA
tataaccagtccttatag

SEQ ID NO: 44743 - DNA, 18 bp, Artificial Sequence
  Synthetic DNA
tataacctcacacattag

SEQ ID NO: 44744 - DNA, 18 bp, Artificial Sequence
  Synthetic DNA
tataacgaaacactgtag

SEQ ID NO: 44745 - DNA, 18 bp, Artificial Sequence
  Synthetic DNA
tataacgaatcgcagtag

SEQ ID NO: 44746 - DNA, 18 bp, Artificial Sequence
  Synthetic DNA
tataacgacacgctaaag

SEQ ID NO: 44747 - DNA, 18 bp, Artificial Sequence
  Synthetic DNA
tataacgactacctagtg

SEQ ID NO: 44748 - DNA, 18 bp, Artificial Sequence
  Synthetic DNA
tataacgactaccttaag

SEQ ID NO: 44749 - DNA, 18 bp, Artificial Sequence
  Synthetic DNA
tataacgactcccattcg

SEQ ID NO: 44750 - DNA, 18 bp, Artificial Sequence
  Synthetic DNA
tataacgactcccggtag

SEQ ID NO: 44751 - DNA, 18 bp, Artificial Sequence
  Synthetic DNA
tataacgactcgccattg

SEQ ID NO: 44752 - DNA, 18 bp, Artificial Sequence
  Synthetic DNA
tataacgactttctttcg

SEQ ID NO: 44753 - DNA, 18 bp, Artificial Sequence
  Synthetic DNA
tataacgagtaagtaaag

SEQ ID NO: 44754 - DNA, 18 bp, Artificial Sequence
  Synthetic DNA
tataacgatacgctatag

SEQ ID NO: 44755 - DNA, 18 bp, Artificial Sequence
  Synthetic DNA
tataacgattaacaaaag

SEQ ID NO: 44756 - DNA, 18 bp, Artificial Sequence
  Synthetic DNA
tataacgattgtcaatag

SEQ ID NO: 44757 - DNA, 18 bp, Artificial Sequence
  Synthetic DNA
tataacgatttactacag

SEQ ID NO: 44758 - DNA, 18 bp, Artificial Sequence
  Synthetic DNA
tataacgccactttatag

SEQ ID NO: 44759 - DNA, 18 bp, Artificial Sequence
  Synthetic DNA
tataacgcctcagtttag

SEQ ID NO: 44760 - DNA, 18 bp, Artificial Sequence
  Synthetic DNA
tataacggctatctatag

SEQ ID NO: 44761 - DNA, 18 bp, Artificial Sequence
  Synthetic DNA
tataacggctcacttcgg

SEQ ID NO: 44762 - DNA, 18 bp, Artificial Sequence
  Synthetic DNA
tataacggctctcatttg

SEQ ID NO: 44763 - DNA, 18 bp, Artificial Sequence
  Synthetic DNA
tataacgtcacaatatag

SEQ ID NO: 44764 - DNA, 18 bp, Artificial Sequence
  Synthetic DNA
tataacgtcacacactag

SEQ ID NO: 44765 - DNA, 18 bp, Artificial Sequence
  Synthetic DNA
tataacgtcacataatag

SEQ ID NO: 44766 - DNA, 18 bp, Artificial Sequence
  Synthetic DNA
tataacgtctaacatttg

SEQ ID NO: 44767 - DNA, 18 bp, Artificial Sequence
  Synthetic DNA
tataacgtctaaccatag

SEQ ID NO: 44768 - DNA, 18 bp, Artificial Sequence
  Synthetic DNA
tataacgtctcatcatag

SEQ ID NO: 44769 - DNA, 18 bp, Artificial Sequence
  Synthetic DNA
tataacgtctcttccttg

SEQ ID NO: 44770 - DNA, 18 bp, Artificial Sequence
  Synthetic DNA
tataacgtgtgacgatag

SEQ ID NO: 44771 - DNA, 18 bp, Artificial Sequence
  Synthetic DNA
tataacgtgttactatag

SEQ ID NO: 44772 - DNA, 18 bp, Artificial Sequence
  Synthetic DNA
tataacgtttcgcaaaag

SEQ ID NO: 44773 - DNA, 18 bp, Artificial Sequence
  Synthetic DNA
tataactaccctcactag

SEQ ID NO: 44774 - DNA, 18 bp, Artificial Sequence
  Synthetic DNA
tataactactcccctttg

SEQ ID NO: 44775 - DNA, 18 bp, Artificial Sequence
  Synthetic DNA
tataactacttgcaatag

SEQ ID NO: 44776 - DNA, 18 bp, Artificial Sequence
  Synthetic DNA
tataactccttacaatag

SEQ ID NO: 44777 - DNA, 18 bp, Artificial Sequence
  Synthetic DNA
tataactgctctcaatag

SEQ ID NO: 44778 - DNA, 18 bp, Artificial Sequence
  Synthetic DNA
tataacttatcaaagtag

SEQ ID NO: 44779 - DNA, 18 bp, Artificial Sequence
  Synthetic DNA
tataacttcacacaatag

SEQ ID NO: 44780 - DNA, 18 bp, Artificial Sequence
  Synthetic DNA
tataagaaattactatag

SEQ ID NO: 44781 - DNA, 18 bp, Artificial Sequence
  Synthetic DNA
tataaggacacactctgg

SEQ ID NO: 44782 - DNA, 18 bp, Artificial Sequence
  Synthetic DNA
tataaggactcattcttg

SEQ ID NO: 44783 - DNA, 18 bp, Artificial Sequence
  Synthetic DNA
tataaggattcactgttg

SEQ ID NO: 44784 - DNA, 18 bp, Artificial Sequence
  Synthetic DNA
tataagtagactcaatag

SEQ ID NO: 44785 - DNA, 18 bp, Artificial Sequence
  Synthetic DNA
tataatatctcgctattg

SEQ ID NO: 44786 - DNA, 18 bp, Artificial Sequence
  Synthetic DNA
tataatcactcacaagag

SEQ ID NO: 44787 - DNA, 18 bp, Artificial Sequence
  Synthetic DNA
tataatgacactatttgg

SEQ ID NO: 44788 - DNA, 18 bp, Artificial Sequence
  Synthetic DNA
tataatgactcaatgtag

SEQ ID NO: 44789 - DNA, 18 bp, Artificial Sequence
  Synthetic DNA
tataatgactcacttcag

SEQ ID NO: 44790 - DNA, 18 bp, Artificial Sequence
  Synthetic DNA
tataatttcacactatag

SEQ ID NO: 44791 - DNA, 18 bp, Artificial Sequence
  Synthetic DNA
tataatttctcacaattg

SEQ ID NO: 44792 - DNA, 18 bp, Artificial Sequence
  Synthetic DNA
tataccacttaacttaag

SEQ ID NO: 44793 - DNA, 18 bp, Artificial Sequence
  Synthetic DNA
tataccgacatgctctag

SEQ ID NO: 44794 - DNA, 18 bp, Artificial Sequence
  Synthetic DNA
tataccgactctctaaag

SEQ ID NO: 44795 - DNA, 18 bp, Artificial Sequence
  Synthetic DNA
tataccgtcttactgcag

SEQ ID NO: 44796 - DNA, 18 bp, Artificial Sequence
  Synthetic DNA
tatacgttctcaatttag

SEQ ID NO: 44797 - DNA, 18 bp, Artificial Sequence
  Synthetic DNA
tatagagtctctctttgg

SEQ ID NO: 44798 - DNA, 18 bp, Artificial Sequence
  Synthetic DNA
tatagatactcacattag

SEQ ID NO: 44799 - DNA, 18 bp, Artificial Sequence
  Synthetic DNA
tatagcgaatcactcgag

SEQ ID NO: 44800 - DNA, 18 bp, Artificial Sequence
  Synthetic DNA
tatagcgacttgccatag

SEQ ID NO: 44801 - DNA, 18 bp, Artificial Sequence
  Synthetic DNA
tatagcgttccactatag

SEQ ID NO: 44802 - DNA, 18 bp, Artificial Sequence
  Synthetic DNA
tatatcaactcactagag

SEQ ID NO: 44803 - DNA, 18 bp, Artificial Sequence
  Synthetic DNA
tatatcatatcaaaatag

SEQ ID NO: 44804 - DNA, 18 bp, Artificial Sequence
  Synthetic DNA
tatatccacccattctag

SEQ ID NO: 44805 - DNA, 18 bp, Artificial Sequence
  Synthetic DNA
tatatcgacgcacttttg

SEQ ID NO: 44806 - DNA, 18 bp, Artificial Sequence
  Synthetic DNA
tatatcgtgtcgggattg

SEQ ID NO: 44807 - DNA, 18 bp, Artificial Sequence
  Synthetic DNA
tatatctaccaactacag

SEQ ID NO: 44808 - DNA, 18 bp, Artificial Sequence
  Synthetic DNA
tatattgattcactaaag

SEQ ID NO: 44809 - DNA, 18 bp, Artificial Sequence
  Synthetic DNA
tatattgtctctctatag

SEQ ID NO: 44810 - DNA, 18 bp, Artificial Sequence
  Synthetic DNA
tatcaattctgcctatcg

SEQ ID NO: 44811 - DNA, 18 bp, Artificial Sequence
  Synthetic DNA
tatcacgaaacagtggtg

SEQ ID NO: 44812 - DNA, 18 bp, Artificial Sequence
  Synthetic DNA
tatcacgactgaaaattg

SEQ ID NO: 44813 - DNA, 18 bp, Artificial Sequence
  Synthetic DNA
tatcacgcctcaatatcg

SEQ ID NO: 44814 - DNA, 18 bp, Artificial Sequence
  Synthetic DNA
tatcacggctcactgcag

SEQ ID NO: 44815 - DNA, 18 bp, Artificial Sequence
  Synthetic DNA
tatcacggctctcgcttg

SEQ ID NO: 44816 - DNA, 18 bp, Artificial Sequence
  Synthetic DNA
tatcacgtcttatcatag

SEQ ID NO: 44817 - DNA, 18 bp, Artificial Sequence
  Synthetic DNA
tatcatcattcactaaag

SEQ ID NO: 44818 - DNA, 18 bp, Artificial Sequence
  Synthetic DNA
tatcatgaaaaactatgg

SEQ ID NO: 44819 - DNA, 18 bp, Artificial Sequence
  Synthetic DNA
tatcatgactcattgttg

SEQ ID NO: 44820 - DNA, 18 bp, Artificial Sequence
  Synthetic DNA
tatcattgcttactatag

SEQ ID NO: 44821 - DNA, 18 bp, Artificial Sequence
  Synthetic DNA
tatcccaagtcactttag

SEQ ID NO: 44822 - DNA, 18 bp, Artificial Sequence
  Synthetic DNA
tatcccgactcacaatcg

SEQ ID NO: 44823 - DNA, 18 bp, Artificial Sequence
  Synthetic DNA
tatcctatgtccctttag

SEQ ID NO: 44824 - DNA, 18 bp, Artificial Sequence
  Synthetic DNA
tatcgcgacatactatag

SEQ ID NO: 44825 - DNA, 18 bp, Artificial Sequence
  Synthetic DNA
tatcggtagacacaattg

SEQ ID NO: 44826 - DNA, 18 bp, Artificial Sequence
  Synthetic DNA
tatctatactcaatattg

SEQ ID NO: 44827 - DNA, 18 bp, Artificial Sequence
  Synthetic DNA
tatctcatctcactatag

SEQ ID NO: 44828 - DNA, 18 bp, Artificial Sequence
  Synthetic DNA
tatctcgccccactattg

SEQ ID NO: 44829 - DNA, 18 bp, Artificial Sequence
  Synthetic DNA
tatctggattcactttgg

SEQ ID NO: 44830 - DNA, 18 bp, Artificial Sequence
  Synthetic DNA
tatgaagactcgctacag

SEQ ID NO: 44831 - DNA, 18 bp, Artificial Sequence
  Synthetic DNA
tatgacgactcacagaag

SEQ ID NO: 44832 - DNA, 18 bp, Artificial Sequence
  Synthetic DNA
tatgacgactctcttgag

SEQ ID NO: 44833 - DNA, 18 bp, Artificial Sequence
  Synthetic DNA
tatgacgtcaatcaaaag

SEQ ID NO: 44834 - DNA, 18 bp, Artificial Sequence
  Synthetic DNA
tatgactaccctctattg

SEQ ID NO: 44835 - DNA, 18 bp, Artificial Sequence
  Synthetic DNA
tatgatgacaaattatag

SEQ ID NO: 44836 - DNA, 18 bp, Artificial Sequence
  Synthetic DNA
tatgatgattctctagag

SEQ ID NO: 44837 - DNA, 18 bp, Artificial Sequence
  Synthetic DNA
tatgccgtttgccttaag

SEQ ID NO: 44838 - DNA, 18 bp, Artificial Sequence
  Synthetic DNA
tatggttaatcactatgg

SEQ ID NO: 44839 - DNA, 18 bp, Artificial Sequence
  Synthetic DNA
tatgtcaactcactttag

SEQ ID NO: 44840 - DNA, 18 bp, Artificial Sequence
  Synthetic DNA
tattaaaacacacgaatg

SEQ ID NO: 44841 - DNA, 18 bp, Artificial Sequence
  Synthetic DNA
tattaaaactctctttag

SEQ ID NO: 44842 - DNA, 18 bp, Artificial Sequence
  Synthetic DNA
tattaacactcttagtcg

SEQ ID NO: 44843 - DNA, 18 bp, Artificial Sequence
  Synthetic DNA
tattaagaatcattttag

SEQ ID NO: 44844 - DNA, 18 bp, Artificial Sequence
  Synthetic DNA
tattaagaggtactctag

SEQ ID NO: 44845 - DNA, 18 bp, Artificial Sequence
  Synthetic DNA
tattaagagtaattattg

SEQ ID NO: 44846 - DNA, 18 bp, Artificial Sequence
  Synthetic DNA
tattaagatacacaatag

SEQ ID NO: 44847 - DNA, 18 bp, Artificial Sequence
  Synthetic DNA
tattaagattcacttcag

SEQ ID NO: 44848 - DNA, 18 bp, Artificial Sequence
  Synthetic DNA
tattaagattttatatag

SEQ ID NO: 44849 - DNA, 18 bp, Artificial Sequence
  Synthetic DNA
tattaaggcacacagaag

SEQ ID NO: 44850 - DNA, 18 bp, Artificial Sequence
  Synthetic DNA
tattaagtatctctgatg

SEQ ID NO: 44851 - DNA, 18 bp, Artificial Sequence
  Synthetic DNA
tattaagtcccactacag

SEQ ID NO: 44852 - DNA, 18 bp, Artificial Sequence
  Synthetic DNA
tattaatcctcaataaag

SEQ ID NO: 44853 - DNA, 18 bp, Artificial Sequence
  Synthetic DNA
tattaatgcccactatag

SEQ ID NO: 44854 - DNA, 18 bp, Artificial Sequence
  Synthetic DNA
tattacaacaccccatag

SEQ ID NO: 44855 - DNA, 18 bp, Artificial Sequence
  Synthetic DNA
tattacaacattcaatag

SEQ ID NO: 44856 - DNA, 18 bp, Artificial Sequence
  Synthetic DNA
tattacaactcgctactg

SEQ ID NO: 44857 - DNA, 18 bp, Artificial Sequence
  Synthetic DNA
tattacaactctcataag

SEQ ID NO: 44858 - DNA, 18 bp, Artificial Sequence
  Synthetic DNA
tattacaacttacattag

SEQ ID NO: 44859 - DNA, 18 bp, Artificial Sequence
  Synthetic DNA
tattacaacttactttcg

SEQ ID NO: 44860 - DNA, 18 bp, Artificial Sequence
  Synthetic DNA
tattacaatacattatcg

SEQ ID NO: 44861 - DNA, 18 bp, Artificial Sequence
  Synthetic DNA
tattacaattcaaaatag

SEQ ID NO: 44862 - DNA, 18 bp, Artificial Sequence
  Synthetic DNA
tattacacgtcactaccg

SEQ ID NO: 44863 - DNA, 18 bp, Artificial Sequence
  Synthetic DNA
tattacagatcactactg

SEQ ID NO: 44864 - DNA, 18 bp, Artificial Sequence
  Synthetic DNA
tattacatattaatatag

SEQ ID NO: 44865 - DNA, 18 bp, Artificial Sequence
  Synthetic DNA
tattacatattactatag

SEQ ID NO: 44866 - DNA, 18 bp, Artificial Sequence
  Synthetic DNA
tattacatgtcactttag

SEQ ID NO: 44867 - DNA, 18 bp, Artificial Sequence
  Synthetic DNA
tattaccaaacactattg

SEQ ID NO: 44868 - DNA, 18 bp, Artificial Sequence
  Synthetic DNA
tattaccaaactctatag

SEQ ID NO: 44869 - DNA, 18 bp, Artificial Sequence
  Synthetic DNA
tattaccacccactttcg

SEQ ID NO: 44870 - DNA, 18 bp, Artificial Sequence
  Synthetic DNA
tattaccaccgaatattg

SEQ ID NO: 44871 - DNA, 18 bp, Artificial Sequence
  Synthetic DNA
tattacctctcaatgtag

SEQ ID NO: 44872 - DNA, 18 bp, Artificial Sequence
  Synthetic DNA
tattacgaaatactgtcg

SEQ ID NO: 44873 - DNA, 18 bp, Artificial Sequence
  Synthetic DNA
tattacgaataactttgg

SEQ ID NO: 44874 - DNA, 18 bp, Artificial Sequence
  Synthetic DNA
tattacgaatagcaagtg

SEQ ID NO: 44875 - DNA, 18 bp, Artificial Sequence
  Synthetic DNA
tattacgaatccctaatg

SEQ ID NO: 44876 - DNA, 18 bp, Artificial Sequence
  Synthetic DNA
tattacgaatcgaaattg

SEQ ID NO: 44877 - DNA, 18 bp, Artificial Sequence
  Synthetic DNA
tattacgacaatttatcg

SEQ ID NO: 44878 - DNA, 18 bp, Artificial Sequence
  Synthetic DNA
tattacgacacaaattag

SEQ ID NO: 44879 - DNA, 18 bp, Artificial Sequence
  Synthetic DNA
tattacgacacagcaaag

SEQ ID NO: 44880 - DNA, 18 bp, Artificial Sequence
  Synthetic DNA
tattacgacatacttaag

SEQ ID NO: 44881 - DNA, 18 bp, Artificial Sequence
  Synthetic DNA
tattacgacccacaggtg

SEQ ID NO: 44882 - DNA, 18 bp, Artificial Sequence
  Synthetic DNA
tattacgactaacaaagg

SEQ ID NO: 44883 - DNA, 18 bp, Artificial Sequence
  Synthetic DNA
tattacgactcaacacgg

SEQ ID NO: 44884 - DNA, 18 bp, Artificial Sequence
  Synthetic DNA
tattacgactctaaataa

SEQ ID NO: 44885 - DNA, 18 bp, Artificial Sequence
  Synthetic DNA
tattacgactctttgacg

SEQ ID NO: 44886 - DNA, 18 bp, Artificial Sequence
  Synthetic DNA
tattacgactttttttag

SEQ ID NO: 44887 - DNA, 18 bp, Artificial Sequence
  Synthetic DNA
tattacgagattctatag

SEQ ID NO: 44888 - DNA, 18 bp, Artificial Sequence
  Synthetic DNA
tattacgaggcattattg

SEQ ID NO: 44889 - DNA, 18 bp, Artificial Sequence
  Synthetic DNA
tattacgagtcaattaag

SEQ ID NO: 44890 - DNA, 18 bp, Artificial Sequence
  Synthetic DNA
tattacgagtctatattg

SEQ ID NO: 44891 - DNA, 18 bp, Artificial Sequence
  Synthetic DNA
tattacgatactccaaag

SEQ ID NO: 44892 - DNA, 18 bp, Artificial Sequence
  Synthetic DNA
tattacgatccacaattg

SEQ ID NO: 44893 - DNA, 18 bp, Artificial Sequence
  Synthetic DNA
tattacgatccatttttg

SEQ ID NO: 44894 - DNA, 18 bp, Artificial Sequence
  Synthetic DNA
tattacgattagctattg

SEQ ID NO: 44895 - DNA, 18 bp, Artificial Sequence
  Synthetic DNA
tattacgattcacgtgag

SEQ ID NO: 44896 - DNA, 18 bp, Artificial Sequence
  Synthetic DNA
tattacgccactcgatag

SEQ ID NO: 44897 - DNA, 18 bp, Artificial Sequence
  Synthetic DNA
tattacgccagattatgg

SEQ ID NO: 44898 - DNA, 18 bp, Artificial Sequence
  Synthetic DNA
tattacgccatattatag

SEQ ID NO: 44899 - DNA, 18 bp, Artificial Sequence
  Synthetic DNA
tattacgcgcaagtatag

SEQ ID NO: 44900 - DNA, 18 bp, Artificial Sequence
  Synthetic DNA
tattacgctgttctttag

SEQ ID NO: 44901 - DNA, 18 bp, Artificial Sequence
  Synthetic DNA
tattacggcaccctgatg

SEQ ID NO: 44902 - DNA, 18 bp, Artificial Sequence
  Synthetic DNA
tattacggccaatttaag

SEQ ID NO: 44903 - DNA, 18 bp, Artificial Sequence
  Synthetic DNA
tattacggtagactattg

SEQ ID NO: 44904 - DNA, 18 bp, Artificial Sequence
  Synthetic DNA
tattacgtatcagtcccg

SEQ ID NO: 44905 - DNA, 18 bp, Artificial Sequence
  Synthetic DNA
tattacgtcccattactg

SEQ ID NO: 44906 - DNA, 18 bp, Artificial Sequence
  Synthetic DNA
tattacgtctaattattg

SEQ ID NO: 44907 - DNA, 18 bp, Artificial Sequence
  Synthetic DNA
tattacgtcttagtattg

SEQ ID NO: 44908 - DNA, 18 bp, Artificial Sequence
  Synthetic DNA
tattacgtgtcatctcag

SEQ ID NO: 44909 - DNA, 18 bp, Artificial Sequence
  Synthetic DNA
tattacgttatacaatag

SEQ ID NO: 44910 - DNA, 18 bp, Artificial Sequence
  Synthetic DNA
tattacgtttctcattag

SEQ ID NO: 44911 - DNA, 18 bp, Artificial Sequence
  Synthetic DNA
tattacgtttctctattg

SEQ ID NO: 44912 - DNA, 18 bp, Artificial Sequence
  Synthetic DNA
tattacgtttttctccag

SEQ ID NO: 44913 - DNA, 18 bp, Artificial Sequence
  Synthetic DNA
tattacgtttttctttag

SEQ ID NO: 44914 - DNA, 18 bp, Artificial Sequence
  Synthetic DNA
tattactaatcaccgaag

SEQ ID NO: 44915 - DNA, 18 bp, Artificial Sequence
  Synthetic DNA
tattactaatcataatgg

SEQ ID NO: 44916 - DNA, 18 bp, Artificial Sequence
  Synthetic DNA
tattactacaacgtattg

SEQ ID NO: 44917 - DNA, 18 bp, Artificial Sequence
  Synthetic DNA
tattactacacattatcg

SEQ ID NO: 44918 - DNA, 18 bp, Artificial Sequence
  Synthetic DNA
tattactacactgcagag

SEQ ID NO: 44919 - DNA, 18 bp, Artificial Sequence
  Synthetic DNA
tattactaccaactttcg

SEQ ID NO: 44920 - DNA, 18 bp, Artificial Sequence
  Synthetic DNA
tattactaccctttaatg

SEQ ID NO: 44921 - DNA, 18 bp, Artificial Sequence
  Synthetic DNA
tattactactagtcatag

SEQ ID NO: 44922 - DNA, 18 bp, Artificial Sequence
  Synthetic DNA
tattactactctcctcag

SEQ ID NO: 44923 - DNA, 18 bp, Artificial Sequence
  Synthetic DNA
tattactatactgaatgg

SEQ ID NO: 44924 - DNA, 18 bp, Artificial Sequence
  Synthetic DNA
tattactatccactgaag

SEQ ID NO: 44925 - DNA, 18 bp, Artificial Sequence
  Synthetic DNA
tattactattctcgatag

SEQ ID NO: 44926 - DNA, 18 bp, Artificial Sequence
  Synthetic DNA
tattactatttttaattg

SEQ ID NO: 44927 - DNA, 18 bp, Artificial Sequence
  Synthetic DNA
tattactgctatttatag

SEQ ID NO: 44928 - DNA, 18 bp, Artificial Sequence
  Synthetic DNA
tattacttctcactgtgg

SEQ ID NO: 44929 - DNA, 18 bp, Artificial Sequence
  Synthetic DNA
tattacttgtcacaatag

SEQ ID NO: 44930 - DNA, 18 bp, Artificial Sequence
  Synthetic DNA
tattagaactctcttacg

SEQ ID NO: 44931 - DNA, 18 bp, Artificial Sequence
  Synthetic DNA
tattaggaatcagaatag

SEQ ID NO: 44932 - DNA, 18 bp, Artificial Sequence
  Synthetic DNA
tattaggaatcctattag

SEQ ID NO: 44933 - DNA, 18 bp, Artificial Sequence
  Synthetic DNA
tattaggacctaacctcg

SEQ ID NO: 44934 - DNA, 18 bp, Artificial Sequence
  Synthetic DNA
tattaggattctcaattg

SEQ ID NO: 44935 - DNA, 18 bp, Artificial Sequence
  Synthetic DNA
tattaggcctcggcacag

SEQ ID NO: 44936 - DNA, 18 bp, Artificial Sequence
  Synthetic DNA
tattagggcactccaaag

SEQ ID NO: 44937 - DNA, 18 bp, Artificial Sequence
  Synthetic DNA
tattagtactacctaaag

SEQ ID NO: 44938 - DNA, 18 bp, Artificial Sequence
  Synthetic DNA
tattataacccactacag

SEQ ID NO: 44939 - DNA, 18 bp, Artificial Sequence
  Synthetic DNA
tattatcccattcttaag

SEQ ID NO: 44940 - DNA, 18 bp, Artificial Sequence
  Synthetic DNA
tattatgaatcactaagg

SEQ ID NO: 44941 - DNA, 18 bp, Artificial Sequence
  Synthetic DNA
tattatgaatttctatag

SEQ ID NO: 44942 - DNA, 18 bp, Artificial Sequence
  Synthetic DNA
tattatgacactctattg

SEQ ID NO: 44943 - DNA, 18 bp, Artificial Sequence
  Synthetic DNA
tattatgactaaatattg

SEQ ID NO: 44944 - DNA, 18 bp, Artificial Sequence
  Synthetic DNA
tattatgactaattatcg

SEQ ID NO: 44945 - DNA, 18 bp, Artificial Sequence
  Synthetic DNA
tattatgactatcaatag

SEQ ID NO: 44946 - DNA, 18 bp, Artificial Sequence
  Synthetic DNA
tattatgactctttttag

SEQ ID NO: 44947 - DNA, 18 bp, Artificial Sequence
  Synthetic DNA
tattatgactgacttaag

SEQ ID NO: 44948 - DNA, 18 bp, Artificial Sequence
  Synthetic DNA
tattatgattaactcaag

SEQ ID NO: 44949 - DNA, 18 bp, Artificial Sequence
  Synthetic DNA
tattatgattcacttcag

SEQ ID NO: 44950 - DNA, 18 bp, Artificial Sequence
  Synthetic DNA
tattatgattcactttgg

SEQ ID NO: 44951 - DNA, 18 bp, Artificial Sequence
  Synthetic DNA
tattatgattcattgtag

SEQ ID NO: 44952 - DNA, 18 bp, Artificial Sequence
  Synthetic DNA
tattatgcaccactttag

SEQ ID NO: 44953 - DNA, 18 bp, Artificial Sequence
  Synthetic DNA
tattatgtattatcatag

SEQ ID NO: 44954 - DNA, 18 bp, Artificial Sequence
  Synthetic DNA
tattatgtctttctttag

SEQ ID NO: 44955 - DNA, 18 bp, Artificial Sequence
  Synthetic DNA
tattattacatgctccag

SEQ ID NO: 44956 - DNA, 18 bp, Artificial Sequence
  Synthetic DNA
tattatttctcactctag

SEQ ID NO: 44957 - DNA, 18 bp, Artificial Sequence
  Synthetic DNA
tattatttttcagtattg

SEQ ID NO: 44958 - DNA, 18 bp, Artificial Sequence
  Synthetic DNA
tattcagtcacactattg

SEQ ID NO: 44959 - DNA, 18 bp, Artificial Sequence
  Synthetic DNA
tattccaagacactttag

SEQ ID NO: 44960 - DNA, 18 bp, Artificial Sequence
  Synthetic DNA
tattccgaatcacattcg

SEQ ID NO: 44961 - DNA, 18 bp, Artificial Sequence
  Synthetic DNA
tattccgacaccctgaag

SEQ ID NO: 44962 - DNA, 18 bp, Artificial Sequence
  Synthetic DNA
tattccgacattctcttg

SEQ ID NO: 44963 - DNA, 18 bp, Artificial Sequence
  Synthetic DNA
tattccgactctttgtag

SEQ ID NO: 44964 - DNA, 18 bp, Artificial Sequence
  Synthetic DNA
tattccgagtgattatag

SEQ ID NO: 44965 - DNA, 18 bp, Artificial Sequence
  Synthetic DNA
tattccgcgccactctag

SEQ ID NO: 44966 - DNA, 18 bp, Artificial Sequence
  Synthetic DNA
tattcctaacaactttag

SEQ ID NO: 44967 - DNA, 18 bp, Artificial Sequence
  Synthetic DNA
tattcctactcagtacag

SEQ ID NO: 44968 - DNA, 18 bp, Artificial Sequence
  Synthetic DNA
tattcctattaacttttg

SEQ ID NO: 44969 - DNA, 18 bp, Artificial Sequence
  Synthetic DNA
tattctcactcattttag

SEQ ID NO: 44970 - DNA, 18 bp, Artificial Sequence
  Synthetic DNA
tattctgactcgatttag

SEQ ID NO: 44971 - DNA, 18 bp, Artificial Sequence
  Synthetic DNA
tattctgccttatcatag

SEQ ID NO: 44972 - DNA, 18 bp, Artificial Sequence
  Synthetic DNA
tattctggctcattatag

SEQ ID NO: 44973 - DNA, 18 bp, Artificial Sequence
  Synthetic DNA
tattgacactctccatag

SEQ ID NO: 44974 - DNA, 18 bp, Artificial Sequence
  Synthetic DNA
tattgagactcacaaaag

SEQ ID NO: 44975 - DNA, 18 bp, Artificial Sequence
  Synthetic DNA
tattgattctcaccgtag

SEQ ID NO: 44976 - DNA, 18 bp, Artificial Sequence
  Synthetic DNA
tattgcaacacacaatag

SEQ ID NO: 44977 - DNA, 18 bp, Artificial Sequence
  Synthetic DNA
tattgcgacactttgagg

SEQ ID NO: 44978 - DNA, 18 bp, Artificial Sequence
  Synthetic DNA
tattgcgcctcaataaag

SEQ ID NO: 44979 - DNA, 18 bp, Artificial Sequence
  Synthetic DNA
tattgcgcttcgccctag

SEQ ID NO: 44980 - DNA, 18 bp, Artificial Sequence
  Synthetic DNA
tattgcgtctcaaatttg

SEQ ID NO: 44981 - DNA, 18 bp, Artificial Sequence
  Synthetic DNA
tattgcgtctctctattg

SEQ ID NO: 44982 - DNA, 18 bp, Artificial Sequence
  Synthetic DNA
tattgctactgcctattg

SEQ ID NO: 44983 - DNA, 18 bp, Artificial Sequence
  Synthetic DNA
tattgtgactctctcaag

SEQ ID NO: 44984 - DNA, 18 bp, Artificial Sequence
  Synthetic DNA
tattgtgactggttttag

SEQ ID NO: 44985 - DNA, 18 bp, Artificial Sequence
  Synthetic DNA
tattgtgccacactacgg

SEQ ID NO: 44986 - DNA, 18 bp, Artificial Sequence
  Synthetic DNA
tatttaaactcactgtgg

SEQ ID NO: 44987 - DNA, 18 bp, Artificial Sequence
  Synthetic DNA
tatttaatttctcaatag

SEQ ID NO: 44988 - DNA, 18 bp, Artificial Sequence
  Synthetic DNA
tatttagatcctcatttg

SEQ ID NO: 44989 - DNA, 18 bp, Artificial Sequence
  Synthetic DNA
tatttagtatcgctatcg

SEQ ID NO: 44990 - DNA, 18 bp, Artificial Sequence
  Synthetic DNA
tatttagtctctttatag

SEQ ID NO: 44991 - DNA, 18 bp, Artificial Sequence
  Synthetic DNA
tatttagtgtcactatag

SEQ ID NO: 44992 - DNA, 18 bp, Artificial Sequence
  Synthetic DNA
tatttcaaatcaattttg

SEQ ID NO: 44993 - DNA, 18 bp, Artificial Sequence
  Synthetic DNA
tatttcaaatcactttag

SEQ ID NO: 44994 - DNA, 18 bp, Artificial Sequence
  Synthetic DNA
tatttcaactcaccattg

SEQ ID NO: 44995 - DNA, 18 bp, Artificial Sequence
  Synthetic DNA
tatttcaactctctttag

SEQ ID NO: 44996 - DNA, 18 bp, Artificial Sequence
  Synthetic DNA
tatttccaaccctatttg

SEQ ID NO: 44997 - DNA, 18 bp, Artificial Sequence
  Synthetic DNA
tatttccactacctaaag

SEQ ID NO: 44998 - DNA, 18 bp, Artificial Sequence
  Synthetic DNA
tatttccactcaccaaag

SEQ ID NO: 44999 - DNA, 18 bp, Artificial Sequence
  Synthetic DNA
tatttccactcatcatcg

SEQ ID NO: 45000 - DNA, 18 bp, Artificial Sequence
  Synthetic DNA
tatttccactcgcaaaag

SEQ ID NO: 45001 - DNA, 18 bp, Artificial Sequence
  Synthetic DNA
tatttcgaaaaattatag

SEQ ID NO: 45002 - DNA, 18 bp, Artificial Sequence
  Synthetic DNA
tatttcgaatcacaatgg

SEQ ID NO: 45003 - DNA, 18 bp, Artificial Sequence
  Synthetic DNA
tatttcgaatcaccttag

SEQ ID NO: 45004 - DNA, 18 bp, Artificial Sequence
  Synthetic DNA
tatttcgaatccctttag

SEQ ID NO: 45005 - DNA, 18 bp, Artificial Sequence
  Synthetic DNA
tatttcgacacaataatg

SEQ ID NO: 45006 - DNA, 18 bp, Artificial Sequence
  Synthetic DNA
tatttcgacacacaattg

SEQ ID NO: 45007 - DNA, 18 bp, Artificial Sequence
  Synthetic DNA
tatttcgacctacttgag

SEQ ID NO: 45008 - DNA, 18 bp, Artificial Sequence
  Synthetic DNA
tatttcgagtcactaagg

SEQ ID NO: 45009 - DNA, 18 bp, Artificial Sequence
  Synthetic DNA
tatttcgattcaccgaag

SEQ ID NO: 45010 - DNA, 18 bp, Artificial Sequence
  Synthetic DNA
tatttcggctctcttaag

SEQ ID NO: 45011 - DNA, 18 bp, Artificial Sequence
  Synthetic DNA
tatttcgtcccattgaag

SEQ ID NO: 45012 - DNA, 18 bp, Artificial Sequence
  Synthetic DNA
tatttcgtgtcactctag

SEQ ID NO: 45013 - DNA, 18 bp, Artificial Sequence
  Synthetic DNA
tatttcgtttctattaag

SEQ ID NO: 45014 - DNA, 18 bp, Artificial Sequence
  Synthetic DNA
tatttctaatcgcttaag

SEQ ID NO: 45015 - DNA, 18 bp, Artificial Sequence
  Synthetic DNA
tatttctacacactattg

SEQ ID NO: 45016 - DNA, 18 bp, Artificial Sequence
  Synthetic DNA
tatttctactcacaatcg

SEQ ID NO: 45017 - DNA, 18 bp, Artificial Sequence
  Synthetic DNA
tatttctactcacaatgg

SEQ ID NO: 45018 - DNA, 18 bp, Artificial Sequence
  Synthetic DNA
tatttctagtctctattg

SEQ ID NO: 45019 - DNA, 18 bp, Artificial Sequence
  Synthetic DNA
tatttctattcagtgtgg

SEQ ID NO: 45020 - DNA, 18 bp, Artificial Sequence
  Synthetic DNA
tatttctcttttcaatag

SEQ ID NO: 45021 - DNA, 18 bp, Artificial Sequence
  Synthetic DNA
tatttctgctctcaatag

SEQ ID NO: 45022 - DNA, 18 bp, Artificial Sequence
  Synthetic DNA
tatttcttattactgtag

SEQ ID NO: 45023 - DNA, 18 bp, Artificial Sequence
  Synthetic DNA
tatttctttttactatcg

SEQ ID NO: 45024 - DNA, 18 bp, Artificial Sequence
  Synthetic DNA
tatttggacccattattg

SEQ ID NO: 45025 - DNA, 18 bp, Artificial Sequence
  Synthetic DNA
tatttggtctcactattg

SEQ ID NO: 45026 - DNA, 18 bp, Artificial Sequence
  Synthetic DNA
tatttgtactcagtatag

SEQ ID NO: 45027 - DNA, 18 bp, Artificial Sequence
  Synthetic DNA
tattttaaatcacgacag

SEQ ID NO: 45028 - DNA, 18 bp, Artificial Sequence
  Synthetic DNA
tattttcactcactaaag

SEQ ID NO: 45029 - DNA, 18 bp, Artificial Sequence
  Synthetic DNA
tattttgtctcactttcg

SEQ ID NO: 45030 - DNA, 18 bp, Artificial Sequence
  Synthetic DNA
tattttgtctcatcacag

SEQ ID NO: 45031 - DNA, 18 bp, Artificial Sequence
  Synthetic DNA
tatttttactcactaaag

SEQ ID NO: 45032 - DNA, 18 bp, Artificial Sequence
  Synthetic DNA
tcaaacatctctactaag

SEQ ID NO: 45033 - DNA, 18 bp, Artificial Sequence
  Synthetic DNA
tcaaacatctgactattg

SEQ ID NO: 45034 - DNA, 18 bp, Artificial Sequence
  Synthetic DNA
tcaaacgacttacattag

SEQ ID NO: 45035 - DNA, 18 bp, Artificial Sequence
  Synthetic DNA
tcaaacgatactccatag

SEQ ID NO: 45036 - DNA, 18 bp, Artificial Sequence
  Synthetic DNA
tcaaacgattagcttaag

SEQ ID NO: 45037 - DNA, 18 bp, Artificial Sequence
  Synthetic DNA
tcaaacgtaataataaag

SEQ ID NO: 45038 - DNA, 18 bp, Artificial Sequence
  Synthetic DNA
tcaaatgaatacctatag

SEQ ID NO: 45039 - DNA, 18 bp, Artificial Sequence
  Synthetic DNA
tcaaattacaaacttttg

SEQ ID NO: 45040 - DNA, 18 bp, Artificial Sequence
  Synthetic DNA
tcaacagactcactatcg

SEQ ID NO: 45041 - DNA, 18 bp, Artificial Sequence
  Synthetic DNA
tcaaccgactctcaatag

SEQ ID NO: 45042 - DNA, 18 bp, Artificial Sequence
  Synthetic DNA
tcaacctactcactattg

SEQ ID NO: 45043 - DNA, 18 bp, Artificial Sequence
  Synthetic DNA
tcaacctagacactacag

SEQ ID NO: 45044 - DNA, 18 bp, Artificial Sequence
  Synthetic DNA
tcaatagactcagtatag

SEQ ID NO: 45045 - DNA, 18 bp, Artificial Sequence
  Synthetic DNA
tcaatatactcactctgg

SEQ ID NO: 45046 - DNA, 18 bp, Artificial Sequence
  Synthetic DNA
tcaatcgactcgatatag

SEQ ID NO: 45047 - DNA, 18 bp, Artificial Sequence
  Synthetic DNA
tcaatcgactttctaaag

SEQ ID NO: 45048 - DNA, 18 bp, Artificial Sequence
  Synthetic DNA
tcaatcgtctttctatag

SEQ ID NO: 45049 - DNA, 18 bp, Artificial Sequence
  Synthetic DNA
tcaattgacacacctagg

SEQ ID NO: 45050 - DNA, 18 bp, Artificial Sequence
  Synthetic DNA
tcaattgacactatatag

SEQ ID NO: 45051 - DNA, 18 bp, Artificial Sequence
  Synthetic DNA
tcaattgactcacaaaag

SEQ ID NO: 45052 - DNA, 18 bp, Artificial Sequence
  Synthetic DNA
tcacaagaatcaataaag

SEQ ID NO: 45053 - DNA, 18 bp, Artificial Sequence
  Synthetic DNA
tcacaccattcactatcg

SEQ ID NO: 45054 - DNA, 18 bp, Artificial Sequence
  Synthetic DNA
tcacacgactcacatttg

SEQ ID NO: 45055 - DNA, 18 bp, Artificial Sequence
  Synthetic DNA
tcacacgtttcatcaaag

SEQ ID NO: 45056 - DNA, 18 bp, Artificial Sequence
  Synthetic DNA
tcacactactcaataaag

SEQ ID NO: 45057 - DNA, 18 bp, Artificial Sequence
  Synthetic DNA
tcacactactcactgtcg

SEQ ID NO: 45058 - DNA, 18 bp, Artificial Sequence
  Synthetic DNA
tcacaggattctctatag

SEQ ID NO: 45059 - DNA, 18 bp, Artificial Sequence
  Synthetic DNA
tcacatcactcactttag

SEQ ID NO: 45060 - DNA, 18 bp, Artificial Sequence
  Synthetic DNA
tcacgcgactctctatgg

SEQ ID NO: 45061 - DNA, 18 bp, Artificial Sequence
  Synthetic DNA
tcactcgacacaacagag

SEQ ID NO: 45062 - DNA, 18 bp, Artificial Sequence
  Synthetic DNA
tcactcgtctcacaacag

SEQ ID NO: 45063 - DNA, 18 bp, Artificial Sequence
  Synthetic DNA
tcactctactctctatcg

SEQ ID NO: 45064 - DNA, 18 bp, Artificial Sequence
  Synthetic DNA
tcactttatacactttag

SEQ ID NO: 45065 - DNA, 18 bp, Artificial Sequence
  Synthetic DNA
tcagaagagtttctatag

SEQ ID NO: 45066 - DNA, 18 bp, Artificial Sequence
  Synthetic DNA
tcagacaactcatagaag

SEQ ID NO: 45067 - DNA, 18 bp, Artificial Sequence
  Synthetic DNA
tcagacgtctccctacag

SEQ ID NO: 45068 - DNA, 18 bp, Artificial Sequence
  Synthetic DNA
tcagactatttactattg

SEQ ID NO: 45069 - DNA, 18 bp, Artificial Sequence
  Synthetic DNA
tcagatgactctcacttg

SEQ ID NO: 45070 - DNA, 18 bp, Artificial Sequence
  Synthetic DNA
tcagattaatcacttgag

SEQ ID NO: 45071 - DNA, 18 bp, Artificial Sequence
  Synthetic DNA
tcagcagtatgactaaag

SEQ ID NO: 45072 - DNA, 18 bp, Artificial Sequence
  Synthetic DNA
tcagcctacactctatag

SEQ ID NO: 45073 - DNA, 18 bp, Artificial Sequence
  Synthetic DNA
tcataaaacttactttag

SEQ ID NO: 45074 - DNA, 18 bp, Artificial Sequence
  Synthetic DNA
tcataaatctcacattag

SEQ ID NO: 45075 - DNA, 18 bp, Artificial Sequence
  Synthetic DNA
tcataagaatctcaatag

SEQ ID NO: 45076 - DNA, 18 bp, Artificial Sequence
  Synthetic DNA
tcataagactcacgtttg

SEQ ID NO: 45077 - DNA, 18 bp, Artificial Sequence
  Synthetic DNA
tcataagactcgggatag

SEQ ID NO: 45078 - DNA, 18 bp, Artificial Sequence
  Synthetic DNA
tcatacaacgcacaaaag

SEQ ID NO: 45079 - DNA, 18 bp, Artificial Sequence
  Synthetic DNA
tcatacaactcgttactg

SEQ ID NO: 45080 - DNA, 18 bp, Artificial Sequence
  Synthetic DNA
tcatacaattcacaaaag

SEQ ID NO: 45081 - DNA, 18 bp, Artificial Sequence
  Synthetic DNA
tcatacagctgataatag

SEQ ID NO: 45082 - DNA, 18 bp, Artificial Sequence
  Synthetic DNA
tcatacatttgtctaatg

SEQ ID NO: 45083 - DNA, 18 bp, Artificial Sequence
  Synthetic DNA
tcatacattttacaatag

SEQ ID NO: 45084 - DNA, 18 bp, Artificial Sequence
  Synthetic DNA
tcatacattttactatgg

SEQ ID NO: 45085 - DNA, 18 bp, Artificial Sequence
  Synthetic DNA
tcataccagccactaaag

SEQ ID NO: 45086 - DNA, 18 bp, Artificial Sequence
  Synthetic DNA
tcataccatccactaatg

SEQ ID NO: 45087 - DNA, 18 bp, Artificial Sequence
  Synthetic DNA
tcataccgttcactagag

SEQ ID NO: 45088 - DNA, 18 bp, Artificial Sequence
  Synthetic DNA
tcatacgaataattaaag

SEQ ID NO: 45089 - DNA, 18 bp, Artificial Sequence
  Synthetic DNA
tcatacgacacccttgag

SEQ ID NO: 45090 - DNA, 18 bp, Artificial Sequence
  Synthetic DNA
tcatacgactatctaccg

SEQ ID NO: 45091 - DNA, 18 bp, Artificial Sequence
  Synthetic DNA
tcatacgactctcaactg

SEQ ID NO: 45092 - DNA, 18 bp, Artificial Sequence
  Synthetic DNA
tcatacgactctcttagg

SEQ ID NO: 45093 - DNA, 18 bp, Artificial Sequence
  Synthetic DNA
tcatacgactgagtaagg

SEQ ID NO: 45094 - DNA, 18 bp, Artificial Sequence
  Synthetic DNA
tcatacgacttcttaatg

SEQ ID NO: 45095 - DNA, 18 bp, Artificial Sequence
  Synthetic DNA
tcatacgagtcattttgg

SEQ ID NO: 45096 - DNA, 18 bp, Artificial Sequence
  Synthetic DNA
tcatacgatacattatcg

SEQ ID NO: 45097 - DNA, 18 bp, Artificial Sequence
  Synthetic DNA
tcatacgattcaattgag

SEQ ID NO: 45098 - DNA, 18 bp, Artificial Sequence
  Synthetic DNA
tcatacgattctcaaaag

SEQ ID NO: 45099 - DNA, 18 bp, Artificial Sequence
  Synthetic DNA
tcatacgattctcgctag

SEQ ID NO: 45100 - DNA, 18 bp, Artificial Sequence
  Synthetic DNA
tcatacgcattactctag

SEQ ID NO: 45101 - DNA, 18 bp, Artificial Sequence
  Synthetic DNA
tcatacgcctcgttttgg

SEQ ID NO: 45102 - DNA, 18 bp, Artificial Sequence
  Synthetic DNA
tcatacggcaccctatgg

SEQ ID NO: 45103 - DNA, 18 bp, Artificial Sequence
  Synthetic DNA
tcatacggcttacccttg

SEQ ID NO: 45104 - DNA, 18 bp, Artificial Sequence
  Synthetic DNA
tcatacggttctttaaag

SEQ ID NO: 45105 - DNA, 18 bp, Artificial Sequence
  Synthetic DNA
tcatacgtataactatgg

SEQ ID NO: 45106 - DNA, 18 bp, Artificial Sequence
  Synthetic DNA
tcatacgtatgaatatag

SEQ ID NO: 45107 - DNA, 18 bp, Artificial Sequence
  Synthetic DNA
tcatacgttacacaaatg

SEQ ID NO: 45108 - DNA, 18 bp, Artificial Sequence
  Synthetic DNA
tcatacgtttctgtaatg

SEQ ID NO: 45109 - DNA, 18 bp, Artificial Sequence
  Synthetic DNA
tcatactaatcaccttcg

SEQ ID NO: 45110 - DNA, 18 bp, Artificial Sequence
  Synthetic DNA
tcatactacaatcttacg

SEQ ID NO: 45111 - DNA, 18 bp, Artificial Sequence
  Synthetic DNA
tcatactactttgtatag

SEQ ID NO: 45112 - DNA, 18 bp, Artificial Sequence
  Synthetic DNA
tcatactatatacagtag

SEQ ID NO: 45113 - DNA, 18 bp, Artificial Sequence
  Synthetic DNA
tcatacttctctcgaaag

SEQ ID NO: 45114 - DNA, 18 bp, Artificial Sequence
  Synthetic DNA
tcatacttctgactatgg

SEQ ID NO: 45115 - DNA, 18 bp, Artificial Sequence
  Synthetic DNA
tcatacttttcactgaag

SEQ ID NO: 45116 - DNA, 18 bp, Artificial Sequence
  Synthetic DNA
tcatagctctaactctag

SEQ ID NO: 45117 - DNA, 18 bp, Artificial Sequence
  Synthetic DNA
tcataggtcacactctag

SEQ ID NO: 45118 - DNA, 18 bp, Artificial Sequence
  Synthetic DNA
tcatataacccactttag

SEQ ID NO: 45119 - DNA, 18 bp, Artificial Sequence
  Synthetic DNA
tcatatcactcagttaag

SEQ ID NO: 45120 - DNA, 18 bp, Artificial Sequence
  Synthetic DNA
tcatatcattcaattgag

SEQ ID NO: 45121 - DNA, 18 bp, Artificial Sequence
  Synthetic DNA
tcatatgacaacctatag

SEQ ID NO: 45122 - DNA, 18 bp, Artificial Sequence
  Synthetic DNA
tcatatgacagacaattg

SEQ ID NO: 45123 - DNA, 18 bp, Artificial Sequence
  Synthetic DNA
tcatatgacccaaaatcg

SEQ ID NO: 45124 - DNA, 18 bp, Artificial Sequence
  Synthetic DNA
tcatatggctcattaaag

SEQ ID NO: 45125 - DNA, 18 bp, Artificial Sequence
  Synthetic DNA
tcatatgtcacacttttg

SEQ ID NO: 45126 - DNA, 18 bp, Artificial Sequence
  Synthetic DNA
tcatattactcacaagag

SEQ ID NO: 45127 - DNA, 18 bp, Artificial Sequence
  Synthetic DNA
tcatatttttagtaatag

SEQ ID NO: 45128 - DNA, 18 bp, Artificial Sequence
  Synthetic DNA
tcatcaaacacacaatag

SEQ ID NO: 45129 - DNA, 18 bp, Artificial Sequence
  Synthetic DNA
tcatcaaacacactatag

SEQ ID NO: 45130 - DNA, 18 bp, Artificial Sequence
  Synthetic DNA
tcatcaaactcgccagcg

SEQ ID NO: 45131 - DNA, 18 bp, Artificial Sequence
  Synthetic DNA
tcatcagattgactatag

SEQ ID NO: 45132 - DNA, 18 bp, Artificial Sequence
  Synthetic DNA
tcatccaaatcactttag

SEQ ID NO: 45133 - DNA, 18 bp, Artificial Sequence
  Synthetic DNA
tcatccaacatactatag

SEQ ID NO: 45134 - DNA, 18 bp, Artificial Sequence
  Synthetic DNA
tcatccatctgagaattg

SEQ ID NO: 45135 - DNA, 18 bp, Artificial Sequence
  Synthetic DNA
tcatcccattcacaatcg

SEQ ID NO: 45136 - DNA, 18 bp, Artificial Sequence
  Synthetic DNA
tcatccgactcacataag

SEQ ID NO: 45137 - DNA, 18 bp, Artificial Sequence
  Synthetic DNA
tcatccgactgagaatag

SEQ ID NO: 45138 - DNA, 18 bp, Artificial Sequence
  Synthetic DNA
tcatcctaatcacaattg

SEQ ID NO: 45139 - DNA, 18 bp, Artificial Sequence
  Synthetic DNA
tcatcctacacactccag

SEQ ID NO: 45140 - DNA, 18 bp, Artificial Sequence
  Synthetic DNA
tcatgaaactcattttag

SEQ ID NO: 45141 - DNA, 18 bp, Artificial Sequence
  Synthetic DNA
tcatgactctcacaacag

SEQ ID NO: 45142 - DNA, 18 bp, Artificial Sequence
  Synthetic DNA
tcatgagactatatattg

SEQ ID NO: 45143 - DNA, 18 bp, Artificial Sequence
  Synthetic DNA
tcatgcaactcacattag

SEQ ID NO: 45144 - DNA, 18 bp, Artificial Sequence
  Synthetic DNA
tcatgcgacttaccacag

SEQ ID NO: 45145 - DNA, 18 bp, Artificial Sequence
  Synthetic DNA
tcatgcgacttactgttg

SEQ ID NO: 45146 - DNA, 18 bp, Artificial Sequence
  Synthetic DNA
tcatgctcatcaatatag

SEQ ID NO: 45147 - DNA, 18 bp, Artificial Sequence
  Synthetic DNA
tcatgctgctccatatcg

SEQ ID NO: 45148 - DNA, 18 bp, Artificial Sequence
  Synthetic DNA
tcattaggccgactttag

SEQ ID NO: 45149 - DNA, 18 bp, Artificial Sequence
  Synthetic DNA
tcattcatctcactactg

SEQ ID NO: 45150 - DNA, 18 bp, Artificial Sequence
  Synthetic DNA
tcattccactcagtatcg

SEQ ID NO: 45151 - DNA, 18 bp, Artificial Sequence
  Synthetic DNA
tcattccacttagtatag

SEQ ID NO: 45152 - DNA, 18 bp, Artificial Sequence
  Synthetic DNA
tcattccgctcattatag

SEQ ID NO: 45153 - DNA, 18 bp, Artificial Sequence
  Synthetic DNA
tcattcgacatacaatag

SEQ ID NO: 45154 - DNA, 18 bp, Artificial Sequence
  Synthetic DNA
tcattcgacctactttag

SEQ ID NO: 45155 - DNA, 18 bp, Artificial Sequence
  Synthetic DNA
tcattcgattcaccaatg

SEQ ID NO: 45156 - DNA, 18 bp, Artificial Sequence
  Synthetic DNA
tcattcgattccctaccg

SEQ ID NO: 45157 - DNA, 18 bp, Artificial Sequence
  Synthetic DNA
tcattcgattctcaattg

SEQ ID NO: 45158 - DNA, 18 bp, Artificial Sequence
  Synthetic DNA
tcattcgatttactctag

SEQ ID NO: 45159 - DNA, 18 bp, Artificial Sequence
  Synthetic DNA
tcattcggaccactattg

SEQ ID NO: 45160 - DNA, 18 bp, Artificial Sequence
  Synthetic DNA
tcattcggcttactttcg

SEQ ID NO: 45161 - DNA, 18 bp, Artificial Sequence
  Synthetic DNA
tcattctactcacttcag

SEQ ID NO: 45162 - DNA, 18 bp, Artificial Sequence
  Synthetic DNA
tcattctactcatattag

SEQ ID NO: 45163 - DNA, 18 bp, Artificial Sequence
  Synthetic DNA
tcattggaatcattaaag

SEQ ID NO: 45164 - DNA, 18 bp, Artificial Sequence
  Synthetic DNA
tcatttgaccctctatag

SEQ ID NO: 45165 - DNA, 18 bp, Artificial Sequence
  Synthetic DNA
tcatttgactcacttaag

SEQ ID NO: 45166 - DNA, 18 bp, Artificial Sequence
  Synthetic DNA
tcatttgtattactatag

SEQ ID NO: 45167 - DNA, 18 bp, Artificial Sequence
  Synthetic DNA
tcatttgtctcgttttcg

SEQ ID NO: 45168 - DNA, 18 bp, Artificial Sequence
  Synthetic DNA
tccaacgtgtcactatag

SEQ ID NO: 45169 - DNA, 18 bp, Artificial Sequence
  Synthetic DNA
tcctaagactcacttttg

SEQ ID NO: 45170 - DNA, 18 bp, Artificial Sequence
  Synthetic DNA
tcctacgtctcacccaag

SEQ ID NO: 45171 - DNA, 18 bp, Artificial Sequence
  Synthetic DNA
tcctactactctttgtag

SEQ ID NO: 45172 - DNA, 18 bp, Artificial Sequence
  Synthetic DNA
tcctagcactaactatgg

SEQ ID NO: 45173 - DNA, 18 bp, Artificial Sequence
  Synthetic DNA
tcctatggctgactttag

SEQ ID NO: 45174 - DNA, 18 bp, Artificial Sequence
  Synthetic DNA
tccttcaaatcactattg

SEQ ID NO: 45175 - DNA, 18 bp, Artificial Sequence
  Synthetic DNA
tccttccgctgtatatag

SEQ ID NO: 45176 - DNA, 18 bp, Artificial Sequence
  Synthetic DNA
tccttcgattcactctag

SEQ ID NO: 45177 - DNA, 18 bp, Artificial Sequence
  Synthetic DNA
tcgaacgactctcggcag

SEQ ID NO: 45178 - DNA, 18 bp, Artificial Sequence
  Synthetic DNA
tcgcactacacagtatag

SEQ ID NO: 45179 - DNA, 18 bp, Artificial Sequence
  Synthetic DNA
tcgtaagtctcgctatgg

SEQ ID NO: 45180 - DNA, 18 bp, Artificial Sequence
  Synthetic DNA
tcgtacaacacactacag

SEQ ID NO: 45181 - DNA, 18 bp, Artificial Sequence
  Synthetic DNA
tcgtacagctcacaatag

SEQ ID NO: 45182 - DNA, 18 bp, Artificial Sequence
  Synthetic DNA
tcgtacatctcactgtag

SEQ ID NO: 45183 - DNA, 18 bp, Artificial Sequence
  Synthetic DNA
tcgttctactcacagtag

SEQ ID NO: 45184 - DNA, 18 bp, Artificial Sequence
  Synthetic DNA
tcgtttaactccctattg

SEQ ID NO: 45185 - DNA, 18 bp, Artificial Sequence
  Synthetic DNA
tctaacgccttcatattg

SEQ ID NO: 45186 - DNA, 18 bp, Artificial Sequence
  Synthetic DNA
tctaactacttagtagag

SEQ ID NO: 45187 - DNA, 18 bp, Artificial Sequence
  Synthetic DNA
tctaataaccccctttag

SEQ ID NO: 45188 - DNA, 18 bp, Artificial Sequence
  Synthetic DNA
tctaccgactcaatatag

SEQ ID NO: 45189 - DNA, 18 bp, Artificial Sequence
  Synthetic DNA
tctaccgactcacaatag

SEQ ID NO: 45190 - DNA, 18 bp, Artificial Sequence
  Synthetic DNA
tctattgtctcactatag

SEQ ID NO: 45191 - DNA, 18 bp, Artificial Sequence
  Synthetic DNA
tctcaagactctgcattg

SEQ ID NO: 45192 - DNA, 18 bp, Artificial Sequence
  Synthetic DNA
tctctccactcattaaag

SEQ ID NO: 45193 - DNA, 18 bp, Artificial Sequence
  Synthetic DNA
tcttaactttctccatag

SEQ ID NO: 45194 - DNA, 18 bp, Artificial Sequence
  Synthetic DNA
tcttaagactcgctatgg

SEQ ID NO: 45195 - DNA, 18 bp, Artificial Sequence
  Synthetic DNA
tcttaccactccctttag

SEQ ID NO: 45196 - DNA, 18 bp, Artificial Sequence
  Synthetic DNA
tcttacctctctttttag

SEQ ID NO: 45197 - DNA, 18 bp, Artificial Sequence
  Synthetic DNA
tcttacgaaacagtattg

SEQ ID NO: 45198 - DNA, 18 bp, Artificial Sequence
  Synthetic DNA
tcttacgacggaacctag

SEQ ID NO: 45199 - DNA, 18 bp, Artificial Sequence
  Synthetic DNA
tcttacgactaaaactag

SEQ ID NO: 45200 - DNA, 18 bp, Artificial Sequence
  Synthetic DNA
tcttacgactgacaaaag

SEQ ID NO: 45201 - DNA, 18 bp, Artificial Sequence
  Synthetic DNA
tcttacgcctcacaacgg

SEQ ID NO: 45202 - DNA, 18 bp, Artificial Sequence
  Synthetic DNA
tcttacgtcaggctacag

SEQ ID NO: 45203 - DNA, 18 bp, Artificial Sequence
  Synthetic DNA
tcttacgtctaattattg

SEQ ID NO: 45204 - DNA, 18 bp, Artificial Sequence
  Synthetic DNA
tcttactattgacattag

SEQ ID NO: 45205 - DNA, 18 bp, Artificial Sequence
  Synthetic DNA
tcttaggactaagtattg

SEQ ID NO: 45206 - DNA, 18 bp, Artificial Sequence
  Synthetic DNA
tcttaggattcaatatag

SEQ ID NO: 45207 - DNA, 18 bp, Artificial Sequence
  Synthetic DNA
tcttatgacgaacaattg

SEQ ID NO: 45208 - DNA, 18 bp, Artificial Sequence
  Synthetic DNA
tcttatgactcaacatag

SEQ ID NO: 45209 - DNA, 18 bp, Artificial Sequence
  Synthetic DNA
tcttatgactctctaacg

SEQ ID NO: 45210 - DNA, 18 bp, Artificial Sequence
  Synthetic DNA
tcttattactgactgttg

SEQ ID NO: 45211 - DNA, 18 bp, Artificial Sequence
  Synthetic DNA
tcttcccagtcacctttg

SEQ ID NO: 45212 - DNA, 18 bp, Artificial Sequence
  Synthetic DNA
tcttgcgacagattgtag

SEQ ID NO: 45213 - DNA, 18 bp, Artificial Sequence
  Synthetic DNA
tctttcgtctcactaaag

SEQ ID NO: 45214 - DNA, 18 bp, Artificial Sequence
  Synthetic DNA
tctttggactcactctag

SEQ ID NO: 45215 - DNA, 18 bp, Artificial Sequence
  Synthetic DNA
tctttttacactgattag

SEQ ID NO: 45216 - DNA, 18 bp, Artificial Sequence
  Synthetic DNA
tgaaaagacactctattg

SEQ ID NO: 45217 - DNA, 18 bp, Artificial Sequence
  Synthetic DNA
tgaaaccattctttctag

SEQ ID NO: 45218 - DNA, 18 bp, Artificial Sequence
  Synthetic DNA
tgaaacgaaatcaaatag

SEQ ID NO: 45219 - DNA, 18 bp, Artificial Sequence
  Synthetic DNA
tgaaacgaattactctag

SEQ ID NO: 45220 - DNA, 18 bp, Artificial Sequence
  Synthetic DNA
tgaaacgacacttcttag

SEQ ID NO: 45221 - DNA, 18 bp, Artificial Sequence
  Synthetic DNA
tgaaacgacatactgatg

SEQ ID NO: 45222 - DNA, 18 bp, Artificial Sequence
  Synthetic DNA
tgaaacgacccacattag

SEQ ID NO: 45223 - DNA, 18 bp, Artificial Sequence
  Synthetic DNA
tgaaacgacgcagtaaag

SEQ ID NO: 45224 - DNA, 18 bp, Artificial Sequence
  Synthetic DNA
tgaaacgattctctttcg

SEQ ID NO: 45225 - DNA, 18 bp, Artificial Sequence
  Synthetic DNA
tgaaacggcttattaatg

SEQ ID NO: 45226 - DNA, 18 bp, Artificial Sequence
  Synthetic DNA
tgaaacgtcacactatcg

SEQ ID NO: 45227 - DNA, 18 bp, Artificial Sequence
  Synthetic DNA
tgaaactacccgcttcag

SEQ ID NO: 45228 - DNA, 18 bp, Artificial Sequence
  Synthetic DNA
tgaaaggactcacaattg

SEQ ID NO: 45229 - DNA, 18 bp, Artificial Sequence
  Synthetic DNA
tgaaatgtgtcaatatag

SEQ ID NO: 45230 - DNA, 18 bp, Artificial Sequence
  Synthetic DNA
tgaactgatacactatag

SEQ ID NO: 45231 - DNA, 18 bp, Artificial Sequence
  Synthetic DNA
tgaagtgacttacagtag

SEQ ID NO: 45232 - DNA, 18 bp, Artificial Sequence
  Synthetic DNA
tgaataatctctcttttg

SEQ ID NO: 45233 - DNA, 18 bp, Artificial Sequence
  Synthetic DNA
tgaatcgactcactaacg

SEQ ID NO: 45234 - DNA, 18 bp, Artificial Sequence
  Synthetic DNA
tgaatcgactcactaatg

SEQ ID NO: 45235 - DNA, 18 bp, Artificial Sequence
  Synthetic DNA
tgacaatacacagtatag

SEQ ID NO: 45236 - DNA, 18 bp, Artificial Sequence
  Synthetic DNA
tgacaccattcaccatag

SEQ ID NO: 45237 - DNA, 18 bp, Artificial Sequence
  Synthetic DNA
tgacacgactcataatcg

SEQ ID NO: 45238 - DNA, 18 bp, Artificial Sequence
  Synthetic DNA
tgacacgccacaatcttg

SEQ ID NO: 45239 - DNA, 18 bp, Artificial Sequence
  Synthetic DNA
tgacgcgtcacgcgctag

SEQ ID NO: 45240 - DNA, 18 bp, Artificial Sequence
  Synthetic DNA
tgactagacccactgtag

SEQ ID NO: 45241 - DNA, 18 bp, Artificial Sequence
  Synthetic DNA
tgacttgacagactatag

SEQ ID NO: 45242 - DNA, 18 bp, Artificial Sequence
  Synthetic DNA
tgagacgtcgagatatag

SEQ ID NO: 45243 - DNA, 18 bp, Artificial Sequence
  Synthetic DNA
tgagccgactcagagtag

SEQ ID NO: 45244 - DNA, 18 bp, Artificial Sequence
  Synthetic DNA
tgagtagactccctattg

SEQ ID NO: 45245 - DNA, 18 bp, Artificial Sequence
  Synthetic DNA
tgagtcaacacactatgg

SEQ ID NO: 45246 - DNA, 18 bp, Artificial Sequence
  Synthetic DNA
tgataaacctcattatag

SEQ ID NO: 45247 - DNA, 18 bp, Artificial Sequence
  Synthetic DNA
tgataacaatcattctag

SEQ ID NO: 45248 - DNA, 18 bp, Artificial Sequence
  Synthetic DNA
tgataagaatcacttctg

SEQ ID NO: 45249 - DNA, 18 bp, Artificial Sequence
  Synthetic DNA
tgataagtctcacgatgg

SEQ ID NO: 45250 - DNA, 18 bp, Artificial Sequence
  Synthetic DNA
tgataatcataccgatag

SEQ ID NO: 45251 - DNA, 18 bp, Artificial Sequence
  Synthetic DNA
tgatacaaaacactattg

SEQ ID NO: 45252 - DNA, 18 bp, Artificial Sequence
  Synthetic DNA
tgatacaaatcgctttag

SEQ ID NO: 45253 - DNA, 18 bp, Artificial Sequence
  Synthetic DNA
tgatacaacagactaaag

SEQ ID NO: 45254 - DNA, 18 bp, Artificial Sequence
  Synthetic DNA
tgatacaacattctacgg

SEQ ID NO: 45255 - DNA, 18 bp, Artificial Sequence
  Synthetic DNA
tgatacaattcacaattg

SEQ ID NO: 45256 - DNA, 18 bp, Artificial Sequence
  Synthetic DNA
tgatacaattctttattg

SEQ ID NO: 45257 - DNA, 18 bp, Artificial Sequence
  Synthetic DNA
tgatacagctctctaaag

SEQ ID NO: 45258 - DNA, 18 bp, Artificial Sequence
  Synthetic DNA
tgatacgaaatacaatag

SEQ ID NO: 45259 - DNA, 18 bp, Artificial Sequence
  Synthetic DNA
tgatacgacaaacgaagg

SEQ ID NO: 45260 - DNA, 18 bp, Artificial Sequence
  Synthetic DNA
tgatacgactgtcattag

SEQ ID NO: 45261 - DNA, 18 bp, Artificial Sequence
  Synthetic DNA
tgatacgagactcgatag

SEQ ID NO: 45262 - DNA, 18 bp, Artificial Sequence
  Synthetic DNA
tgatacgagtaacattag

SEQ ID NO: 45263 - DNA, 18 bp, Artificial Sequence
  Synthetic DNA
tgatacgattcatagtag

SEQ ID NO: 45264 - DNA, 18 bp, Artificial Sequence
  Synthetic DNA
tgatacgctccacaatag

SEQ ID NO: 45265 - DNA, 18 bp, Artificial Sequence
  Synthetic DNA
tgatacggtgcagtattg

SEQ ID NO: 45266 - DNA, 18 bp, Artificial Sequence
  Synthetic DNA
tgatacggttcaatccag

SEQ ID NO: 45267 - DNA, 18 bp, Artificial Sequence
  Synthetic DNA
tgatacgtctcaattcgg

SEQ ID NO: 45268 - DNA, 18 bp, Artificial Sequence
  Synthetic DNA
tgatacgtctctcaaggg

SEQ ID NO: 45269 - DNA, 18 bp, Artificial Sequence
  Synthetic DNA
tgatactactcccaatgg

SEQ ID NO: 45270 - DNA, 18 bp, Artificial Sequence
  Synthetic DNA
tgatacttctccgactag

SEQ ID NO: 45271 - DNA, 18 bp, Artificial Sequence
  Synthetic DNA
tgataggactcaatttcg

SEQ ID NO: 45272 - DNA, 18 bp, Artificial Sequence
  Synthetic DNA
tgataggccacactattg

SEQ ID NO: 45273 - DNA, 18 bp, Artificial Sequence
  Synthetic DNA
tgatataaatctctttag

SEQ ID NO: 45274 - DNA, 18 bp, Artificial Sequence
  Synthetic DNA
tgatataactcactttcg

SEQ ID NO: 45275 - DNA, 18 bp, Artificial Sequence
  Synthetic DNA
tgatataacttacaacag

SEQ ID NO: 45276 - DNA, 18 bp, Artificial Sequence
  Synthetic DNA
tgatatacatcacaatag

SEQ ID NO: 45277 - DNA, 18 bp, Artificial Sequence
  Synthetic DNA
tgatatcaccctctagag

SEQ ID NO: 45278 - DNA, 18 bp, Artificial Sequence
  Synthetic DNA
tgatatgaaaaactaaag

SEQ ID NO: 45279 - DNA, 18 bp, Artificial Sequence
  Synthetic DNA
tgatatgaatctctctag

SEQ ID NO: 45280 - DNA, 18 bp, Artificial Sequence
  Synthetic DNA
tgatatgaccccttatag

SEQ ID NO: 45281 - DNA, 18 bp, Artificial Sequence
  Synthetic DNA
tgatatgaccctctttag

SEQ ID NO: 45282 - DNA, 18 bp, Artificial Sequence
  Synthetic DNA
tgatatgactctctactg

SEQ ID NO: 45283 - DNA, 18 bp, Artificial Sequence
  Synthetic DNA
tgatatgattcaatttag

SEQ ID NO: 45284 - DNA, 18 bp, Artificial Sequence
  Synthetic DNA
tgatatggccctcaatag

SEQ ID NO: 45285 - DNA, 18 bp, Artificial Sequence
  Synthetic DNA
tgatatgtctcatttaag

SEQ ID NO: 45286 - DNA, 18 bp, Artificial Sequence
  Synthetic DNA
tgatccgacctactctag

SEQ ID NO: 45287 - DNA, 18 bp, Artificial Sequence
  Synthetic DNA
tgatccgatgcagtttag

SEQ ID NO: 45288 - DNA, 18 bp, Artificial Sequence
  Synthetic DNA
tgatccgtctaattatag

SEQ ID NO: 45289 - DNA, 18 bp, Artificial Sequence
  Synthetic DNA
tgatctaacaccttatag

SEQ ID NO: 45290 - DNA, 18 bp, Artificial Sequence
  Synthetic DNA
tgatgcaaatccctatag

SEQ ID NO: 45291 - DNA, 18 bp, Artificial Sequence
  Synthetic DNA
tgatgcgaatcaataaaa

SEQ ID NO: 45292 - DNA, 18 bp, Artificial Sequence
  Synthetic DNA
tgatgcgactaatggtag

SEQ ID NO: 45293 - DNA, 18 bp, Artificial Sequence
  Synthetic DNA
tgatgcgattcacaatcg

SEQ ID NO: 45294 - DNA, 18 bp, Artificial Sequence
  Synthetic DNA
tgatgcgcgtcactaagg

SEQ ID NO: 45295 - DNA, 18 bp, Artificial Sequence
  Synthetic DNA
tgatgctactcagcatag

SEQ ID NO: 45296 - DNA, 18 bp, Artificial Sequence
  Synthetic DNA
tgattagagtcactttag

SEQ ID NO: 45297 - DNA, 18 bp, Artificial Sequence
  Synthetic DNA
tgattatactcaattcag

SEQ ID NO: 45298 - DNA, 18 bp, Artificial Sequence
  Synthetic DNA
tgattcaaatcacagcag

SEQ ID NO: 45299 - DNA, 18 bp, Artificial Sequence
  Synthetic DNA
tgattcaaatcattattg

SEQ ID NO: 45300 - DNA, 18 bp, Artificial Sequence
  Synthetic DNA
tgattcacctcacattag

SEQ ID NO: 45301 - DNA, 18 bp, Artificial Sequence
  Synthetic DNA
tgattccactaacaatag

SEQ ID NO: 45302 - DNA, 18 bp, Artificial Sequence
  Synthetic DNA
tgattcgactcaccatga

SEQ ID NO: 45303 - DNA, 18 bp, Artificial Sequence
  Synthetic DNA
tgattcgactgaagaaag

SEQ ID NO: 45304 - DNA, 18 bp, Artificial Sequence
  Synthetic DNA
tgattcgacttatgctag

SEQ ID NO: 45305 - DNA, 18 bp, Artificial Sequence
  Synthetic DNA
tgattcgactttctaagg

SEQ ID NO: 45306 - DNA, 18 bp, Artificial Sequence
  Synthetic DNA
tgattcgccactctatag

SEQ ID NO: 45307 - DNA, 18 bp, Artificial Sequence
  Synthetic DNA
tgattcggatcacattgg

SEQ ID NO: 45308 - DNA, 18 bp, Artificial Sequence
  Synthetic DNA
tgattcggctctctaggg

SEQ ID NO: 45309 - DNA, 18 bp, Artificial Sequence
  Synthetic DNA
tgattcgtgataatagag

SEQ ID NO: 45310 - DNA, 18 bp, Artificial Sequence
  Synthetic DNA
tgattcgtgtcattatcg

SEQ ID NO: 45311 - DNA, 18 bp, Artificial Sequence
  Synthetic DNA
tgattcgttttattatag

SEQ ID NO: 45312 - DNA, 18 bp, Artificial Sequence
  Synthetic DNA
tgattctacacaatatag

SEQ ID NO: 45313 - DNA, 18 bp, Artificial Sequence
  Synthetic DNA
tgattcttcgcactaaag

SEQ ID NO: 45314 - DNA, 18 bp, Artificial Sequence
  Synthetic DNA
tgattcttctctctaaag

SEQ ID NO: 45315 - DNA, 18 bp, Artificial Sequence
  Synthetic DNA
tgatttgactcagtccag

SEQ ID NO: 45316 - DNA, 18 bp, Artificial Sequence
  Synthetic DNA
tgcaacaactcactaaag

SEQ ID NO: 45317 - DNA, 18 bp, Artificial Sequence
  Synthetic DNA
tgcaacgactttctatag

SEQ ID NO: 45318 - DNA, 18 bp, Artificial Sequence
  Synthetic DNA
tgcaatgacttacacatg

SEQ ID NO: 45319 - DNA, 18 bp, Artificial Sequence
  Synthetic DNA
tgcaccgactctctatag

SEQ ID NO: 45320 - DNA, 18 bp, Artificial Sequence
  Synthetic DNA
tgcagcgtatcaccaaag

SEQ ID NO: 45321 - DNA, 18 bp, Artificial Sequence
  Synthetic DNA
tgccacaactcaccatag

SEQ ID NO: 45322 - DNA, 18 bp, Artificial Sequence
  Synthetic DNA
tgccatgcctcactctag

SEQ ID NO: 45323 - DNA, 18 bp, Artificial Sequence
  Synthetic DNA
tgccgcgactcactaaag

SEQ ID NO: 45324 - DNA, 18 bp, Artificial Sequence
  Synthetic DNA
tgctaagtctcactattg

SEQ ID NO: 45325 - DNA, 18 bp, Artificial Sequence
  Synthetic DNA
tgctacaaataactatag

SEQ ID NO: 45326 - DNA, 18 bp, Artificial Sequence
  Synthetic DNA
tgctaccacaatccatag

SEQ ID NO: 45327 - DNA, 18 bp, Artificial Sequence
  Synthetic DNA
tgctacgaatgactcatg

SEQ ID NO: 45328 - DNA, 18 bp, Artificial Sequence
  Synthetic DNA
tgctacgacttaagatcg

SEQ ID NO: 45329 - DNA, 18 bp, Artificial Sequence
  Synthetic DNA
tgctacgacttattttag

SEQ ID NO: 45330 - DNA, 18 bp, Artificial Sequence
  Synthetic DNA
tgctacgcgttacaattg

SEQ ID NO: 45331 - DNA, 18 bp, Artificial Sequence
  Synthetic DNA
tggaacgactcccaatag

SEQ ID NO: 45332 - DNA, 18 bp, Artificial Sequence
  Synthetic DNA
tggaactaattactatgg

SEQ ID NO: 45333 - DNA, 18 bp, Artificial Sequence
  Synthetic DNA
tggaatgactctctatag

SEQ ID NO: 45334 - DNA, 18 bp, Artificial Sequence
  Synthetic DNA
tggatctattccctcttg

SEQ ID NO: 45335 - DNA, 18 bp, Artificial Sequence
  Synthetic DNA
tggcacgactcacaattg

SEQ ID NO: 45336 - DNA, 18 bp, Artificial Sequence
  Synthetic DNA
tggcacgactcactagtg

SEQ ID NO: 45337 - DNA, 18 bp, Artificial Sequence
  Synthetic DNA
tggcacgagtgtcttaag

SEQ ID NO: 45338 - DNA, 18 bp, Artificial Sequence
  Synthetic DNA
tggcacggctaatcatag

SEQ ID NO: 45339 - DNA, 18 bp, Artificial Sequence
  Synthetic DNA
tggcaggaatcactaaag

SEQ ID NO: 45340 - DNA, 18 bp, Artificial Sequence
  Synthetic DNA
tggcgcgactcacactag

SEQ ID NO: 45341 - DNA, 18 bp, Artificial Sequence
  Synthetic DNA
tgggaccactcactgtag

SEQ ID NO: 45342 - DNA, 18 bp, Artificial Sequence
  Synthetic DNA
tggtacaactccctttag

SEQ ID NO: 45343 - DNA, 18 bp, Artificial Sequence
  Synthetic DNA
tggtacaactctttttag

SEQ ID NO: 45344 - DNA, 18 bp, Artificial Sequence
  Synthetic DNA
tggtacgactagctattg

SEQ ID NO: 45345 - DNA, 18 bp, Artificial Sequence
  Synthetic DNA
tggtacgactccctaatg

SEQ ID NO: 45346 - DNA, 18 bp, Artificial Sequence
  Synthetic DNA
tggtacgagtctctgtag

SEQ ID NO: 45347 - DNA, 18 bp, Artificial Sequence
  Synthetic DNA
tggtacgtctcgccatag

SEQ ID NO: 45348 - DNA, 18 bp, Artificial Sequence
  Synthetic DNA
tggtccgactcaatacag

SEQ ID NO: 45349 - DNA, 18 bp, Artificial Sequence
  Synthetic DNA
tggtccggcacacaggag

SEQ ID NO: 45350 - DNA, 18 bp, Artificial Sequence
  Synthetic DNA
tggttcgacctactacag

SEQ ID NO: 45351 - DNA, 18 bp, Artificial Sequence
  Synthetic DNA
tggttcgattcacccaag

SEQ ID NO: 45352 - DNA, 18 bp, Artificial Sequence
  Synthetic DNA
tgtaaagactcactaaag

SEQ ID NO: 45353 - DNA, 18 bp, Artificial Sequence
  Synthetic DNA
tgtaaagactctctatag

SEQ ID NO: 45354 - DNA, 18 bp, Artificial Sequence
  Synthetic DNA
tgtaaccacttactacag

SEQ ID NO: 45355 - DNA, 18 bp, Artificial Sequence
  Synthetic DNA
tgtaacgacttaatcaag

SEQ ID NO: 45356 - DNA, 18 bp, Artificial Sequence
  Synthetic DNA
tgtaacgcgtaagaaatg

SEQ ID NO: 45357 - DNA, 18 bp, Artificial Sequence
  Synthetic DNA
tgtaacggctcattattg

SEQ ID NO: 45358 - DNA, 18 bp, Artificial Sequence
  Synthetic DNA
tgtaacgtctcgctatag

SEQ ID NO: 45359 - DNA, 18 bp, Artificial Sequence
  Synthetic DNA
tgtaatgacaaactatag

SEQ ID NO: 45360 - DNA, 18 bp, Artificial Sequence
  Synthetic DNA
tgtcatgacttactatag

SEQ ID NO: 45361 - DNA, 18 bp, Artificial Sequence
  Synthetic DNA
tgtgacgtcccatcattg

SEQ ID NO: 45362 - DNA, 18 bp, Artificial Sequence
  Synthetic DNA
tgtgatgtctcactatag

SEQ ID NO: 45363 - DNA, 18 bp, Artificial Sequence
  Synthetic DNA
tgttaagcctatctattg

SEQ ID NO: 45364 - DNA, 18 bp, Artificial Sequence
  Synthetic DNA
tgttaagtatcagtgtag

SEQ ID NO: 45365 - DNA, 18 bp, Artificial Sequence
  Synthetic DNA
tgttacatttcaccaaag

SEQ ID NO: 45366 - DNA, 18 bp, Artificial Sequence
  Synthetic DNA
tgttacatttgactatag

SEQ ID NO: 45367 - DNA, 18 bp, Artificial Sequence
  Synthetic DNA
tgttaccacgtgctctag

SEQ ID NO: 45368 - DNA, 18 bp, Artificial Sequence
  Synthetic DNA
tgttacgaaccccttttg

SEQ ID NO: 45369 - DNA, 18 bp, Artificial Sequence
  Synthetic DNA
tgttacgaatgaccaaag

SEQ ID NO: 45370 - DNA, 18 bp, Artificial Sequence
  Synthetic DNA
tgttacgactcagttagg

SEQ ID NO: 45371 - DNA, 18 bp, Artificial Sequence
  Synthetic DNA
tgttacgactcgctaatg

SEQ ID NO: 45372 - DNA, 18 bp, Artificial Sequence
  Synthetic DNA
tgttacggcccactatcg

SEQ ID NO: 45373 - DNA, 18 bp, Artificial Sequence
  Synthetic DNA
tgttacggctcattctgg

SEQ ID NO: 45374 - DNA, 18 bp, Artificial Sequence
  Synthetic DNA
tgttacgtcacacaatag

SEQ ID NO: 45375 - DNA, 18 bp, Artificial Sequence
  Synthetic DNA
tgttacgtgtctttaaag

SEQ ID NO: 45376 - DNA, 18 bp, Artificial Sequence
  Synthetic DNA
tgttacgtttcattatag

SEQ ID NO: 45377 - DNA, 18 bp, Artificial Sequence
  Synthetic DNA
tgttagttctctcgatag

SEQ ID NO: 45378 - DNA, 18 bp, Artificial Sequence
  Synthetic DNA
tgttataactttgtattg

SEQ ID NO: 45379 - DNA, 18 bp, Artificial Sequence
  Synthetic DNA
tgttcctactcattttag

SEQ ID NO: 45380 - DNA, 18 bp, Artificial Sequence
  Synthetic DNA
tgttctgattcactatag

SEQ ID NO: 45381 - DNA, 18 bp, Artificial Sequence
  Synthetic DNA
tgttgcgactcactaaaa

SEQ ID NO: 45382 - DNA, 18 bp, Artificial Sequence
  Synthetic DNA
tgtttagattcactataa

SEQ ID NO: 45383 - DNA, 18 bp, Artificial Sequence
  Synthetic DNA
tgtttagtgtcaccatag

SEQ ID NO: 45384 - DNA, 18 bp, Artificial Sequence
  Synthetic DNA
tgtttccactcaatatag

SEQ ID NO: 45385 - DNA, 18 bp, Artificial Sequence
  Synthetic DNA
ttaaaagactcactactg

SEQ ID NO: 45386 - DNA, 18 bp, Artificial Sequence
  Synthetic DNA
ttaaaagactcgcaatag

SEQ ID NO: 45387 - DNA, 18 bp, Artificial Sequence
  Synthetic DNA
ttaaaagacttacagtcg

SEQ ID NO: 45388 - DNA, 18 bp, Artificial Sequence
  Synthetic DNA
ttaaacaaccatctttag

SEQ ID NO: 45389 - DNA, 18 bp, Artificial Sequence
  Synthetic DNA
ttaaacaactaactattg

SEQ ID NO: 45390 - DNA, 18 bp, Artificial Sequence
  Synthetic DNA
ttaaacaacttaaatcag

SEQ ID NO: 45391 - DNA, 18 bp, Artificial Sequence
  Synthetic DNA
ttaaacaagaaatcttag

SEQ ID NO: 45392 - DNA, 18 bp, Artificial Sequence
  Synthetic DNA
ttaaacaattcccttaag

SEQ ID NO: 45393 - DNA, 18 bp, Artificial Sequence
  Synthetic DNA
ttaaaccacctactaatg

SEQ ID NO: 45394 - DNA, 18 bp, Artificial Sequence
  Synthetic DNA
ttaaacgacatattactg

SEQ ID NO: 45395 - DNA, 18 bp, Artificial Sequence
  Synthetic DNA
ttaaacgacccacttaag

SEQ ID NO: 45396 - DNA, 18 bp, Artificial Sequence
  Synthetic DNA
ttaaacgactgtctatcg

SEQ ID NO: 45397 - DNA, 18 bp, Artificial Sequence
  Synthetic DNA
ttaaacgacttaatattg

SEQ ID NO: 45398 - DNA, 18 bp, Artificial Sequence
  Synthetic DNA
ttaaacgacttacattgg

SEQ ID NO: 45399 - DNA, 18 bp, Artificial Sequence
  Synthetic DNA
ttaaacgacttaccgtag

SEQ ID NO: 45400 - DNA, 18 bp, Artificial Sequence
  Synthetic DNA
ttaaacgacttactgatg

SEQ ID NO: 45401 - DNA, 18 bp, Artificial Sequence
  Synthetic DNA
ttaaacgagcaaagatag

SEQ ID NO: 45402 - DNA, 18 bp, Artificial Sequence
  Synthetic DNA
ttaaacgagtacctatag

SEQ ID NO: 45403 - DNA, 18 bp, Artificial Sequence
  Synthetic DNA
ttaaacgataaattatag

SEQ ID NO: 45404 - DNA, 18 bp, Artificial Sequence
  Synthetic DNA
ttaaacgataccatatag

SEQ ID NO: 45405 - DNA, 18 bp, Artificial Sequence
  Synthetic DNA
ttaaacgatatacttttg

SEQ ID NO: 45406 - DNA, 18 bp, Artificial Sequence
  Synthetic DNA
ttaaacgattcacactag

SEQ ID NO: 45407 - DNA, 18 bp, Artificial Sequence
  Synthetic DNA
ttaaacgatttacctttg

SEQ ID NO: 45408 - DNA, 18 bp, Artificial Sequence
  Synthetic DNA
ttaaacgcctctttatag

SEQ ID NO: 45409 - DNA, 18 bp, Artificial Sequence
  Synthetic DNA
ttaaacggcacattcttg

SEQ ID NO: 45410 - DNA, 18 bp, Artificial Sequence
  Synthetic DNA
ttaaacgggtaactatag

SEQ ID NO: 45411 - DNA, 18 bp, Artificial Sequence
  Synthetic DNA
ttaaacggtactatatag

SEQ ID NO: 45412 - DNA, 18 bp, Artificial Sequence
  Synthetic DNA
ttaaacgtctcaataagg

SEQ ID NO: 45413 - DNA, 18 bp, Artificial Sequence
  Synthetic DNA
ttaaacgtctcgatggag

SEQ ID NO: 45414 - DNA, 18 bp, Artificial Sequence
  Synthetic DNA
ttaaacgtgtctatatag

SEQ ID NO: 45415 - DNA, 18 bp, Artificial Sequence
  Synthetic DNA
ttaaacgttttacaattg

SEQ ID NO: 45416 - DNA, 18 bp, Artificial Sequence
  Synthetic DNA
ttaaacgttttactacag

SEQ ID NO: 45417 - DNA, 18 bp, Artificial Sequence
  Synthetic DNA
ttaaactagtcactagtg

SEQ ID NO: 45418 - DNA, 18 bp, Artificial Sequence
  Synthetic DNA
ttaaactagtcattagag

SEQ ID NO: 45419 - DNA, 18 bp, Artificial Sequence
  Synthetic DNA
ttaaactagtccctatag

SEQ ID NO: 45420 - DNA, 18 bp, Artificial Sequence
  Synthetic DNA
ttaaacttctgacaaatg

SEQ ID NO: 45421 - DNA, 18 bp, Artificial Sequence
  Synthetic DNA
ttaaacttctgactattg

SEQ ID NO: 45422 - DNA, 18 bp, Artificial Sequence
  Synthetic DNA
ttaaaggatacactatag

SEQ ID NO: 45423 - DNA, 18 bp, Artificial Sequence
  Synthetic DNA
ttaaatgaatctctaaag

SEQ ID NO: 45424 - DNA, 18 bp, Artificial Sequence
  Synthetic DNA
ttaaatgacacaatagag

SEQ ID NO: 45425 - DNA, 18 bp, Artificial Sequence
  Synthetic DNA
ttaaatgactaactcaag

SEQ ID NO: 45426 - DNA, 18 bp, Artificial Sequence
  Synthetic DNA
ttaaatgactgattactg

SEQ ID NO: 45427 - DNA, 18 bp, Artificial Sequence
  Synthetic DNA
ttaaatgatttactttag

SEQ ID NO: 45428 - DNA, 18 bp, Artificial Sequence
  Synthetic DNA
ttaaatggctcactttag

SEQ ID NO: 45429 - DNA, 18 bp, Artificial Sequence
  Synthetic DNA
ttaaatgtcacactaaag

SEQ ID NO: 45430 - DNA, 18 bp, Artificial Sequence
  Synthetic DNA
ttaaatgtctctcttttg

SEQ ID NO: 45431 - DNA, 18 bp, Artificial Sequence
  Synthetic DNA
ttaaccgagtctctatag

SEQ ID NO: 45432 - DNA, 18 bp, Artificial Sequence
  Synthetic DNA
ttaaccgcatcacagtag

SEQ ID NO: 45433 - DNA, 18 bp, Artificial Sequence
  Synthetic DNA
ttaaccgtcaaactaaag

SEQ ID NO: 45434 - DNA, 18 bp, Artificial Sequence
  Synthetic DNA
ttaactgagtcacatttg

SEQ ID NO: 45435 - DNA, 18 bp, Artificial Sequence
  Synthetic DNA
ttaacttaatcacttaag

SEQ ID NO: 45436 - DNA, 18 bp, Artificial Sequence
  Synthetic DNA
ttaagcgacacatcatag

SEQ ID NO: 45437 - DNA, 18 bp, Artificial Sequence
  Synthetic DNA
ttaagcgactctcaattg

SEQ ID NO: 45438 - DNA, 18 bp, Artificial Sequence
  Synthetic DNA
ttaagcgattctctttag

SEQ ID NO: 45439 - DNA, 18 bp, Artificial Sequence
  Synthetic DNA
ttaagcgcctaataatag

SEQ ID NO: 45440 - DNA, 18 bp, Artificial Sequence
  Synthetic DNA
ttaagctactcactttag

SEQ ID NO: 45441 - DNA, 18 bp, Artificial Sequence
  Synthetic DNA
ttaatagtctcactttag

SEQ ID NO: 45442 - DNA, 18 bp, Artificial Sequence
  Synthetic DNA
ttaatcaactcattaaag

SEQ ID NO: 45443 - DNA, 18 bp, Artificial Sequence
  Synthetic DNA
ttaatccactctctaaag

SEQ ID NO: 45444 - DNA, 18 bp, Artificial Sequence
  Synthetic DNA
ttaatcgacacactgttg

SEQ ID NO: 45445 - DNA, 18 bp, Artificial Sequence
  Synthetic DNA
ttaatcgacccactaaag

SEQ ID NO: 45446 - DNA, 18 bp, Artificial Sequence
  Synthetic DNA
ttaatcgacccactttag

SEQ ID NO: 45447 - DNA, 18 bp, Artificial Sequence
  Synthetic DNA
ttaatcgactcgctaaag

SEQ ID NO: 45448 - DNA, 18 bp, Artificial Sequence
  Synthetic DNA
ttaatcggctcacaatag

SEQ ID NO: 45449 - DNA, 18 bp, Artificial Sequence
  Synthetic DNA
ttaatcgtcgcactaaag

SEQ ID NO: 45450 - DNA, 18 bp, Artificial Sequence
  Synthetic DNA
ttaatcgtttcagtatag

SEQ ID NO: 45451 - DNA, 18 bp, Artificial Sequence
  Synthetic DNA
ttaatcgttttccaatcg

SEQ ID NO: 45452 - DNA, 18 bp, Artificial Sequence
  Synthetic DNA
ttaatctacacactttag

SEQ ID NO: 45453 - DNA, 18 bp, Artificial Sequence
  Synthetic DNA
ttaatggactcacttttg

SEQ ID NO: 45454 - DNA, 18 bp, Artificial Sequence
  Synthetic DNA
ttaatggactgactattg

SEQ ID NO: 45455 - DNA, 18 bp, Artificial Sequence
  Synthetic DNA
ttaattgattcattatag

SEQ ID NO: 45456 - DNA, 18 bp, Artificial Sequence
  Synthetic DNA
ttacaagactcattgcag

SEQ ID NO: 45457 - DNA, 18 bp, Artificial Sequence
  Synthetic DNA
ttacacaaatcattatag

SEQ ID NO: 45458 - DNA, 18 bp, Artificial Sequence
  Synthetic DNA
ttacacaacactctatgg

SEQ ID NO: 45459 - DNA, 18 bp, Artificial Sequence
  Synthetic DNA
ttacacccctaactatag

SEQ ID NO: 45460 - DNA, 18 bp, Artificial Sequence
  Synthetic DNA
ttacacgaaccaattttg

SEQ ID NO: 45461 - DNA, 18 bp, Artificial Sequence
  Synthetic DNA
ttacacgaatcataatag

SEQ ID NO: 45462 - DNA, 18 bp, Artificial Sequence
  Synthetic DNA
ttacacgagtcaatttag

SEQ ID NO: 45463 - DNA, 18 bp, Artificial Sequence
  Synthetic DNA
ttacacgtctcgataatg

SEQ ID NO: 45464 - DNA, 18 bp, Artificial Sequence
  Synthetic DNA
ttacacgtctctctacag

SEQ ID NO: 45465 - DNA, 18 bp, Artificial Sequence
  Synthetic DNA
ttacacgtttgactgtag

SEQ ID NO: 45466 - DNA, 18 bp, Artificial Sequence
  Synthetic DNA
ttacactactatcaatgg

SEQ ID NO: 45467 - DNA, 18 bp, Artificial Sequence
  Synthetic DNA
ttacactagaccatatcg

SEQ ID NO: 45468 - DNA, 18 bp, Artificial Sequence
  Synthetic DNA
ttacagaagtcacactag

SEQ ID NO: 45469 - DNA, 18 bp, Artificial Sequence
  Synthetic DNA
ttacaggactcacttaag

SEQ ID NO: 45470 - DNA, 18 bp, Artificial Sequence
  Synthetic DNA
ttacaggactcgctttag

SEQ ID NO: 45471 - DNA, 18 bp, Artificial Sequence
  Synthetic DNA
ttacatgcctcacttttg

SEQ ID NO: 45472 - DNA, 18 bp, Artificial Sequence
  Synthetic DNA
ttacattaacccctattg

SEQ ID NO: 45473 - DNA, 18 bp, Artificial Sequence
  Synthetic DNA
ttaccccactcactactg

SEQ ID NO: 45474 - DNA, 18 bp, Artificial Sequence
  Synthetic DNA
ttacccgactaaatatag

SEQ ID NO: 45475 - DNA, 18 bp, Artificial Sequence
  Synthetic DNA
ttacgagtctaacaattg

SEQ ID NO: 45476 - DNA, 18 bp, Artificial Sequence
  Synthetic DNA
ttacgcgactaacaaaag

SEQ ID NO: 45477 - DNA, 18 bp, Artificial Sequence
  Synthetic DNA
ttacgcgactaactatcg

SEQ ID NO: 45478 - DNA, 18 bp, Artificial Sequence
  Synthetic DNA
ttacgcgactttctcaag

SEQ ID NO: 45479 - DNA, 18 bp, Artificial Sequence
  Synthetic DNA
ttacgtggctctgttatg

SEQ ID NO: 45480 - DNA, 18 bp, Artificial Sequence
  Synthetic DNA
ttactcgacacattttcg

SEQ ID NO: 45481 - DNA, 18 bp, Artificial Sequence
  Synthetic DNA
ttactcggctccttttag

SEQ ID NO: 45482 - DNA, 18 bp, Artificial Sequence
  Synthetic DNA
ttactcgtctctctatag

SEQ ID NO: 45483 - DNA, 18 bp, Artificial Sequence
  Synthetic DNA
ttactcgtctgactaaag

SEQ ID NO: 45484 - DNA, 18 bp, Artificial Sequence
  Synthetic DNA
ttactctaatcacacgag

SEQ ID NO: 45485 - DNA, 18 bp, Artificial Sequence
  Synthetic DNA
ttactctgctcaatcaag

SEQ ID NO: 45486 - DNA, 18 bp, Artificial Sequence
  Synthetic DNA
ttagaccacttactatcg

SEQ ID NO: 45487 - DNA, 18 bp, Artificial Sequence
  Synthetic DNA
ttagacgacacactaccg

SEQ ID NO: 45488 - DNA, 18 bp, Artificial Sequence
  Synthetic DNA
ttagacgactatctattg

SEQ ID NO: 45489 - DNA, 18 bp, Artificial Sequence
  Synthetic DNA
ttagacgattctatattg

SEQ ID NO: 45490 - DNA, 18 bp, Artificial Sequence
  Synthetic DNA
ttagacgtctttatacag

SEQ ID NO: 45491 - DNA, 18 bp, Artificial Sequence
  Synthetic DNA
ttagatgactcacttttg

SEQ ID NO: 45492 - DNA, 18 bp, Artificial Sequence
  Synthetic DNA
ttagccgactctctatcg

SEQ ID NO: 45493 - DNA, 18 bp, Artificial Sequence
  Synthetic DNA
ttagccgtctcactaaag

SEQ ID NO: 45494 - DNA, 18 bp, Artificial Sequence
  Synthetic DNA
ttagtccgctcaccgtag

SEQ ID NO: 45495 - DNA, 18 bp, Artificial Sequence
  Synthetic DNA
ttataaaaccctttatag

SEQ ID NO: 45496 - DNA, 18 bp, Artificial Sequence
  Synthetic DNA
ttataaaactaacgaaag

SEQ ID NO: 45497 - DNA, 18 bp, Artificial Sequence
  Synthetic DNA
ttataaaactcgccttag

SEQ ID NO: 45498 - DNA, 18 bp, Artificial Sequence
  Synthetic DNA
ttataaagttcactccag

SEQ ID NO: 45499 - DNA, 18 bp, Artificial Sequence
  Synthetic DNA
ttataagaagctctttcg

SEQ ID NO: 45500 - DNA, 18 bp, Artificial Sequence
  Synthetic DNA
ttataagacccaagatag

SEQ ID NO: 45501 - DNA, 18 bp, Artificial Sequence
  Synthetic DNA
ttataagacctactaaag

SEQ ID NO: 45502 - DNA, 18 bp, Artificial Sequence
  Synthetic DNA
ttataagactaacttaag

SEQ ID NO: 45503 - DNA, 18 bp, Artificial Sequence
  Synthetic DNA
ttataagactccctgaag

SEQ ID NO: 45504 - DNA, 18 bp, Artificial Sequence
  Synthetic DNA
ttataagattccttttag

SEQ ID NO: 45505 - DNA, 18 bp, Artificial Sequence
  Synthetic DNA
ttataatacgcgctatag

SEQ ID NO: 45506 - DNA, 18 bp, Artificial Sequence
  Synthetic DNA
ttataattcaccattaag

SEQ ID NO: 45507 - DNA, 18 bp, Artificial Sequence
  Synthetic DNA
ttatacaacacactgccg

SEQ ID NO: 45508 - DNA, 18 bp, Artificial Sequence
  Synthetic DNA
ttatacaacactctctag

SEQ ID NO: 45509 - DNA, 18 bp, Artificial Sequence
  Synthetic DNA
ttatacaacatccatttg

SEQ ID NO: 45510 - DNA, 18 bp, Artificial Sequence
  Synthetic DNA
ttatacaaccctcaatag

SEQ ID NO: 45511 - DNA, 18 bp, Artificial Sequence
  Synthetic DNA
ttatacaactaattcgtg

SEQ ID NO: 45512 - DNA, 18 bp, Artificial Sequence
  Synthetic DNA
ttatacaactcacaccag

SEQ ID NO: 45513 - DNA, 18 bp, Artificial Sequence
  Synthetic DNA
ttatacaactcacatatg

SEQ ID NO: 45514 - DNA, 18 bp, Artificial Sequence
  Synthetic DNA
ttatacaactcgatattg

SEQ ID NO: 45515 - DNA, 18 bp, Artificial Sequence
  Synthetic DNA
ttatacaactgataagtg

SEQ ID NO: 45516 - DNA, 18 bp, Artificial Sequence
  Synthetic DNA
ttatacaatcgtccatag

SEQ ID NO: 45517 - DNA, 18 bp, Artificial Sequence
  Synthetic DNA
ttatacaattaactattg

SEQ ID NO: 45518 - DNA, 18 bp, Artificial Sequence
  Synthetic DNA
ttatacacctaacttaag

SEQ ID NO: 45519 - DNA, 18 bp, Artificial Sequence
  Synthetic DNA
ttatacatcaaacaatag

SEQ ID NO: 45520 - DNA, 18 bp, Artificial Sequence
  Synthetic DNA
ttatacatctcacaaacg

SEQ ID NO: 45521 - DNA, 18 bp, Artificial Sequence
  Synthetic DNA
ttatacatctgacttcag

SEQ ID NO: 45522 - DNA, 18 bp, Artificial Sequence
  Synthetic DNA
ttataccactaacttatg

SEQ ID NO: 45523 - DNA, 18 bp, Artificial Sequence
  Synthetic DNA
ttataccactagcgttag

SEQ ID NO: 45524 - DNA, 18 bp, Artificial Sequence
  Synthetic DNA
ttataccactctcttttg

SEQ ID NO: 45525 - DNA, 18 bp, Artificial Sequence
  Synthetic DNA
ttataccactttatatag

SEQ ID NO: 45526 - DNA, 18 bp, Artificial Sequence
  Synthetic DNA
ttataccactttccacag

SEQ ID NO: 45527 - DNA, 18 bp, Artificial Sequence
  Synthetic DNA
ttataccactttctttag

SEQ ID NO: 45528 - DNA, 18 bp, Artificial Sequence
  Synthetic DNA
ttataccagtaactctag

SEQ ID NO: 45529 - DNA, 18 bp, Artificial Sequence
  Synthetic DNA
ttataccattcaacatag

SEQ ID NO: 45530 - DNA, 18 bp, Artificial Sequence
  Synthetic DNA
ttataccattcacaatgg

SEQ ID NO: 45531 - DNA, 18 bp, Artificial Sequence
  Synthetic DNA
ttatacccatctatgtgg

SEQ ID NO: 45532 - DNA, 18 bp, Artificial Sequence
  Synthetic DNA
ttatacctcgcatccttg

SEQ ID NO: 45533 - DNA, 18 bp, Artificial Sequence
  Synthetic DNA
ttatacctctcaataaag

SEQ ID NO: 45534 - DNA, 18 bp, Artificial Sequence
  Synthetic DNA
ttatacctctcacactag

SEQ ID NO: 45535 - DNA, 18 bp, Artificial Sequence
  Synthetic DNA
ttatacgaaatacgttag

SEQ ID NO: 45536 - DNA, 18 bp, Artificial Sequence
  Synthetic DNA
ttatacgaatcatttttg

SEQ ID NO: 45537 - DNA, 18 bp, Artificial Sequence
  Synthetic DNA
ttatacgaatctcacttg

SEQ ID NO: 45538 - DNA, 18 bp, Artificial Sequence
  Synthetic DNA
ttatacgaattactagtg

SEQ ID NO: 45539 - DNA, 18 bp, Artificial Sequence
  Synthetic DNA
ttatacgaatttctgtag

SEQ ID NO: 45540 - DNA, 18 bp, Artificial Sequence
  Synthetic DNA
ttatacgacaaccaagag

SEQ ID NO: 45541 - DNA, 18 bp, Artificial Sequence
  Synthetic DNA
ttatacgacaatctgcag

SEQ ID NO: 45542 - DNA, 18 bp, Artificial Sequence
  Synthetic DNA
ttatacgacagagtacag

SEQ ID NO: 45543 - DNA, 18 bp, Artificial Sequence
  Synthetic DNA
ttatacgacgatcaacgg

SEQ ID NO: 45544 - DNA, 18 bp, Artificial Sequence
  Synthetic DNA
ttatacgactccaaaatg

SEQ ID NO: 45545 - DNA, 18 bp, Artificial Sequence
  Synthetic DNA
ttatacgactcctaatcg

SEQ ID NO: 45546 - DNA, 18 bp, Artificial Sequence
  Synthetic DNA
ttatacgactctgtggag

SEQ ID NO: 45547 - DNA, 18 bp, Artificial Sequence
  Synthetic DNA
ttatacgactgaccaatg

SEQ ID NO: 45548 - DNA, 18 bp, Artificial Sequence
  Synthetic DNA
ttatacgagtcattaatg

SEQ ID NO: 45549 - DNA, 18 bp, Artificial Sequence
  Synthetic DNA
ttatacgatacagtatgg

SEQ ID NO: 45550 - DNA, 18 bp, Artificial Sequence
  Synthetic DNA
ttatacgattctttttcg

SEQ ID NO: 45551 - DNA, 18 bp, Artificial Sequence
  Synthetic DNA
ttatacgccacactgttg

SEQ ID NO: 45552 - DNA, 18 bp, Artificial Sequence
  Synthetic DNA
ttatacggatctcttttg

SEQ ID NO: 45553 - DNA, 18 bp, Artificial Sequence
  Synthetic DNA
ttatacggcacactttgg

SEQ ID NO: 45554 - DNA, 18 bp, Artificial Sequence
  Synthetic DNA
ttatacgggataaattag

SEQ ID NO: 45555 - DNA, 18 bp, Artificial Sequence
  Synthetic DNA
ttatacggtccatcattg

SEQ ID NO: 45556 - DNA, 18 bp, Artificial Sequence
  Synthetic DNA
ttatacgtacatctatag

SEQ ID NO: 45557 - DNA, 18 bp, Artificial Sequence
  Synthetic DNA
ttatacgtcactatttag

SEQ ID NO: 45558 - DNA, 18 bp, Artificial Sequence
  Synthetic DNA
ttatacgtcattttatag

SEQ ID NO: 45559 - DNA, 18 bp, Artificial Sequence
  Synthetic DNA
ttatacgtcccgctaaag

SEQ ID NO: 45560 - DNA, 18 bp, Artificial Sequence
  Synthetic DNA
ttatacgtcttcctacag

SEQ ID NO: 45561 - DNA, 18 bp, Artificial Sequence
  Synthetic DNA
ttatacgtcttggttttg

SEQ ID NO: 45562 - DNA, 18 bp, Artificial Sequence
  Synthetic DNA
ttatacgtgtcattctag

SEQ ID NO: 45563 - DNA, 18 bp, Artificial Sequence
  Synthetic DNA
ttatacgttccagtatag

SEQ ID NO: 45564 - DNA, 18 bp, Artificial Sequence
  Synthetic DNA
ttatacgttgattaatag

SEQ ID NO: 45565 - DNA, 18 bp, Artificial Sequence
  Synthetic DNA
ttatactaaacaccttag

SEQ ID NO: 45566 - DNA, 18 bp, Artificial Sequence
  Synthetic DNA
ttatactaatcaatatgg

SEQ ID NO: 45567 - DNA, 18 bp, Artificial Sequence
  Synthetic DNA
ttatactacaaaactcag

SEQ ID NO: 45568 - DNA, 18 bp, Artificial Sequence
  Synthetic DNA
ttatactacccacgttcg

SEQ ID NO: 45569 - DNA, 18 bp, Artificial Sequence
  Synthetic DNA
ttatactacgcaacattg

SEQ ID NO: 45570 - DNA, 18 bp, Artificial Sequence
  Synthetic DNA
ttatactaggcactaaag

SEQ ID NO: 45571 - DNA, 18 bp, Artificial Sequence
  Synthetic DNA
ttatactccttaccgtag

SEQ ID NO: 45572 - DNA, 18 bp, Artificial Sequence
  Synthetic DNA
ttatacttatcactatcg

SEQ ID NO: 45573 - DNA, 18 bp, Artificial Sequence
  Synthetic DNA
ttatacttctcaccattg

SEQ ID NO: 45574 - DNA, 18 bp, Artificial Sequence
  Synthetic DNA
ttatagaactgaataggg

SEQ ID NO: 45575 - DNA, 18 bp, Artificial Sequence
  Synthetic DNA
ttataggacattatacag

SEQ ID NO: 45576 - DNA, 18 bp, Artificial Sequence
  Synthetic DNA
ttataggacccattattg

SEQ ID NO: 45577 - DNA, 18 bp, Artificial Sequence
  Synthetic DNA
ttataggattcacagttg

SEQ ID NO: 45578 - DNA, 18 bp, Artificial Sequence
  Synthetic DNA
ttataggattctcaatag

SEQ ID NO: 45579 - DNA, 18 bp, Artificial Sequence
  Synthetic DNA
ttatagggatctcgaaag

SEQ ID NO: 45580 - DNA, 18 bp, Artificial Sequence
  Synthetic DNA
ttatagttttcactgtag

SEQ ID NO: 45581 - DNA, 18 bp, Artificial Sequence
  Synthetic DNA
ttatataacccattatag

SEQ ID NO: 45582 - DNA, 18 bp, Artificial Sequence
  Synthetic DNA
ttatataacgcattatag

SEQ ID NO: 45583 - DNA, 18 bp, Artificial Sequence
  Synthetic DNA
ttatataactctctagtg

SEQ ID NO: 45584 - DNA, 18 bp, Artificial Sequence
  Synthetic DNA
ttatatcactcacaaaag

SEQ ID NO: 45585 - DNA, 18 bp, Artificial Sequence
  Synthetic DNA
ttatatcactcgcaatag

SEQ ID NO: 45586 - DNA, 18 bp, Artificial Sequence
  Synthetic DNA
ttatatcccacacattag

SEQ ID NO: 45587 - DNA, 18 bp, Artificial Sequence
  Synthetic DNA
ttatatgaatcaatcaag

SEQ ID NO: 45588 - DNA, 18 bp, Artificial Sequence
  Synthetic DNA
ttatatgagccattattg

SEQ ID NO: 45589 - DNA, 18 bp, Artificial Sequence
  Synthetic DNA
ttatatgagtcactttcg

SEQ ID NO: 45590 - DNA, 18 bp, Artificial Sequence
  Synthetic DNA
ttatatgatactctattg

SEQ ID NO: 45591 - DNA, 18 bp, Artificial Sequence
  Synthetic DNA
ttatatgcctcactaacg

SEQ ID NO: 45592 - DNA, 18 bp, Artificial Sequence
  Synthetic DNA
ttatatgcctctaattag

SEQ ID NO: 45593 - DNA, 18 bp, Artificial Sequence
  Synthetic DNA
ttatatggcgcattgtag

SEQ ID NO: 45594 - DNA, 18 bp, Artificial Sequence
  Synthetic DNA
ttatatgtctatctatag

SEQ ID NO: 45595 - DNA, 18 bp, Artificial Sequence
  Synthetic DNA
ttatatgtctctctgaag

SEQ ID NO: 45596 - DNA, 18 bp, Artificial Sequence
  Synthetic DNA
ttatatgtctctgtttag

SEQ ID NO: 45597 - DNA, 18 bp, Artificial Sequence
  Synthetic DNA
ttatatgtctgactaaag

SEQ ID NO: 45598 - DNA, 18 bp, Artificial Sequence
  Synthetic DNA
ttatatgtctggctaaag

SEQ ID NO: 45599 - DNA, 18 bp, Artificial Sequence
  Synthetic DNA
ttatatgtcttactatgg

SEQ ID NO: 45600 - DNA, 18 bp, Artificial Sequence
  Synthetic DNA
ttatattacccactacag

SEQ ID NO: 45601 - DNA, 18 bp, Artificial Sequence
  Synthetic DNA
ttatattattcgctatag

SEQ ID NO: 45602 - DNA, 18 bp, Artificial Sequence
  Synthetic DNA
ttatatttatcactatag

SEQ ID NO: 45603 - DNA, 18 bp, Artificial Sequence
  Synthetic DNA
ttatcactctcactatag

SEQ ID NO: 45604 - DNA, 18 bp, Artificial Sequence
  Synthetic DNA
ttatcagaatgactttag

SEQ ID NO: 45605 - DNA, 18 bp, Artificial Sequence
  Synthetic DNA
ttatcagactaacttttg

SEQ ID NO: 45606 - DNA, 18 bp, Artificial Sequence
  Synthetic DNA
ttatcagactcactctgg

SEQ ID NO: 45607 - DNA, 18 bp, Artificial Sequence
  Synthetic DNA
ttatcagactcgttatag

SEQ ID NO: 45608 - DNA, 18 bp, Artificial Sequence
  Synthetic DNA
ttatcagactgactagcg

SEQ ID NO: 45609 - DNA, 18 bp, Artificial Sequence
  Synthetic DNA
ttatccaaatctgcatag

SEQ ID NO: 45610 - DNA, 18 bp, Artificial Sequence
  Synthetic DNA
ttatccaactcaatattg

SEQ ID NO: 45611 - DNA, 18 bp, Artificial Sequence
  Synthetic DNA
ttatccaactctctaaag

SEQ ID NO: 45612 - DNA, 18 bp, Artificial Sequence
  Synthetic DNA
ttatccaactcttcatag

SEQ ID NO: 45613 - DNA, 18 bp, Artificial Sequence
  Synthetic DNA
ttatccatctcacttaag

SEQ ID NO: 45614 - DNA, 18 bp, Artificial Sequence
  Synthetic DNA
ttatcccactcattgtag

SEQ ID NO: 45615 - DNA, 18 bp, Artificial Sequence
  Synthetic DNA
ttatcccattcactgtag

SEQ ID NO: 45616 - DNA, 18 bp, Artificial Sequence
  Synthetic DNA
ttatccgaaggcatatag

SEQ ID NO: 45617 - DNA, 18 bp, Artificial Sequence
  Synthetic DNA
ttatccgacattttctag

SEQ ID NO: 45618 - DNA, 18 bp, Artificial Sequence
  Synthetic DNA
ttatccgaccaactttag

SEQ ID NO: 45619 - DNA, 18 bp, Artificial Sequence
  Synthetic DNA
ttatccgactcgctgcag

SEQ ID NO: 45620 - DNA, 18 bp, Artificial Sequence
  Synthetic DNA
ttatccgacttcttattg

SEQ ID NO: 45621 - DNA, 18 bp, Artificial Sequence
  Synthetic DNA
ttatccgagccacctaag

SEQ ID NO: 45622 - DNA, 18 bp, Artificial Sequence
  Synthetic DNA
ttatccgcttcactatgg

SEQ ID NO: 45623 - DNA, 18 bp, Artificial Sequence
  Synthetic DNA
ttatccgtctcaaaatcg

SEQ ID NO: 45624 - DNA, 18 bp, Artificial Sequence
  Synthetic DNA
ttatccgtctcacttacg

SEQ ID NO: 45625 - DNA, 18 bp, Artificial Sequence
  Synthetic DNA
ttatccgtttctctcctg

SEQ ID NO: 45626 - DNA, 18 bp, Artificial Sequence
  Synthetic DNA
ttatcctactcgctaaag

SEQ ID NO: 45627 - DNA, 18 bp, Artificial Sequence
  Synthetic DNA
ttatcctactctcagtgg

SEQ ID NO: 45628 - DNA, 18 bp, Artificial Sequence
  Synthetic DNA
ttatcctacttaccattg

SEQ ID NO: 45629 - DNA, 18 bp, Artificial Sequence
  Synthetic DNA
ttatcgaactctctatag

SEQ ID NO: 45630 - DNA, 18 bp, Artificial Sequence
  Synthetic DNA
ttatctgactgactagcg

SEQ ID NO: 45631 - DNA, 18 bp, Artificial Sequence
  Synthetic DNA
ttatgcaattcaccatag

SEQ ID NO: 45632 - DNA, 18 bp, Artificial Sequence
  Synthetic DNA
ttatgcacctcattaaag

SEQ ID NO: 45633 - DNA, 18 bp, Artificial Sequence
  Synthetic DNA
ttatgcacctcatttatg

SEQ ID NO: 45634 - DNA, 18 bp, Artificial Sequence
  Synthetic DNA
ttatgcatctcaccatcg

SEQ ID NO: 45635 - DNA, 18 bp, Artificial Sequence
  Synthetic DNA
ttatgcgaataaccaatg

SEQ ID NO: 45636 - DNA, 18 bp, Artificial Sequence
  Synthetic DNA
ttatgcgaatctcttcag

SEQ ID NO: 45637 - DNA, 18 bp, Artificial Sequence
  Synthetic DNA
ttatgcgacacgatttag

SEQ ID NO: 45638 - DNA, 18 bp, Artificial Sequence
  Synthetic DNA
ttatgcgactctctagtg

SEQ ID NO: 45639 - DNA, 18 bp, Artificial Sequence
  Synthetic DNA
ttatgcgactttataatg

SEQ ID NO: 45640 - DNA, 18 bp, Artificial Sequence
  Synthetic DNA
ttatgcgattcgctctag

SEQ ID NO: 45641 - DNA, 18 bp, Artificial Sequence
  Synthetic DNA
ttatgcgccacacccctg

SEQ ID NO: 45642 - DNA, 18 bp, Artificial Sequence
  Synthetic DNA
ttatgcgcctcagtatta

SEQ ID NO: 45643 - DNA, 18 bp, Artificial Sequence
  Synthetic DNA
ttatgcggtacactatcg

SEQ ID NO: 45644 - DNA, 18 bp, Artificial Sequence
  Synthetic DNA
ttatgcgtatccctatag

SEQ ID NO: 45645 - DNA, 18 bp, Artificial Sequence
  Synthetic DNA
ttatgcgtctcacaatgg

SEQ ID NO: 45646 - DNA, 18 bp, Artificial Sequence
  Synthetic DNA
ttatgctaatgtctgtag

SEQ ID NO: 45647 - DNA, 18 bp, Artificial Sequence
  Synthetic DNA
ttatgctacaccctttag

SEQ ID NO: 45648 - DNA, 18 bp, Artificial Sequence
  Synthetic DNA
ttatgctactaactattg

SEQ ID NO: 45649 - DNA, 18 bp, Artificial Sequence
  Synthetic DNA
ttatgctactcgctttag

SEQ ID NO: 45650 - DNA, 18 bp, Artificial Sequence
  Synthetic DNA
ttatggaaatcactattg

SEQ ID NO: 45651 - DNA, 18 bp, Artificial Sequence
  Synthetic DNA
ttatgggaggcgttattg

SEQ ID NO: 45652 - DNA, 18 bp, Artificial Sequence
  Synthetic DNA
ttatggtacattctaaag

SEQ ID NO: 45653 - DNA, 18 bp, Artificial Sequence
  Synthetic DNA
ttatgtgacattcaattg

SEQ ID NO: 45654 - DNA, 18 bp, Artificial Sequence
  Synthetic DNA
ttatgtgactcacaacag

SEQ ID NO: 45655 - DNA, 18 bp, Artificial Sequence
  Synthetic DNA
ttatgtgactctataaag

SEQ ID NO: 45656 - DNA, 18 bp, Artificial Sequence
  Synthetic DNA
ttatgtgtctaactctcg

SEQ ID NO: 45657 - DNA, 18 bp, Artificial Sequence
  Synthetic DNA
ttatgttaaacaatctcg

SEQ ID NO: 45658 - DNA, 18 bp, Artificial Sequence
  Synthetic DNA
ttattaagcacacatttg

SEQ ID NO: 45659 - DNA, 18 bp, Artificial Sequence
  Synthetic DNA
ttattagaatcaatttag

SEQ ID NO: 45660 - DNA, 18 bp, Artificial Sequence
  Synthetic DNA
ttattagacacgccgtag

SEQ ID NO: 45661 - DNA, 18 bp, Artificial Sequence
  Synthetic DNA
ttattagactccctaaag

SEQ ID NO: 45662 - DNA, 18 bp, Artificial Sequence
  Synthetic DNA
ttattagattcaatacag

SEQ ID NO: 45663 - DNA, 18 bp, Artificial Sequence
  Synthetic DNA
ttattagccttactaaag

SEQ ID NO: 45664 - DNA, 18 bp, Artificial Sequence
  Synthetic DNA
ttattaggattactaaag

SEQ ID NO: 45665 - DNA, 18 bp, Artificial Sequence
  Synthetic DNA
ttattagtcattcaatag

SEQ ID NO: 45666 - DNA, 18 bp, Artificial Sequence
  Synthetic DNA
ttattagtccaacttagg

SEQ ID NO: 45667 - DNA, 18 bp, Artificial Sequence
  Synthetic DNA
ttattatactgactactg

SEQ ID NO: 45668 - DNA, 18 bp, Artificial Sequence
  Synthetic DNA
ttattcaacgcgctagag

SEQ ID NO: 45669 - DNA, 18 bp, Artificial Sequence
  Synthetic DNA
ttattcaactctcctaag

SEQ ID NO: 45670 - DNA, 18 bp, Artificial Sequence
  Synthetic DNA
ttattcaacttactttcg

SEQ ID NO: 45671 - DNA, 18 bp, Artificial Sequence
  Synthetic DNA
ttattcaattttccctag

SEQ ID NO: 45672 - DNA, 18 bp, Artificial Sequence
  Synthetic DNA
ttattcatctcgctatag

SEQ ID NO: 45673 - DNA, 18 bp, Artificial Sequence
  Synthetic DNA
ttattccacccaatattg

SEQ ID NO: 45674 - DNA, 18 bp, Artificial Sequence
  Synthetic DNA
ttattccactatctttag

SEQ ID NO: 45675 - DNA, 18 bp, Artificial Sequence
  Synthetic DNA
ttattccactcaccatgg

SEQ ID NO: 45676 - DNA, 18 bp, Artificial Sequence
  Synthetic DNA
ttattccactcatttaag

SEQ ID NO: 45677 - DNA, 18 bp, Artificial Sequence
  Synthetic DNA
ttattccacttacgatag

SEQ ID NO: 45678 - DNA, 18 bp, Artificial Sequence
  Synthetic DNA
ttattccgttcacaatag

SEQ ID NO: 45679 - DNA, 18 bp, Artificial Sequence
  Synthetic DNA
ttattcctctaactatag

SEQ ID NO: 45680 - DNA, 18 bp, Artificial Sequence
  Synthetic DNA
ttattcgaaatacgatag

SEQ ID NO: 45681 - DNA, 18 bp, Artificial Sequence
  Synthetic DNA
ttattcgaaatactatgg

SEQ ID NO: 45682 - DNA, 18 bp, Artificial Sequence
  Synthetic DNA
ttattcgaatcacttagg

SEQ ID NO: 45683 - DNA, 18 bp, Artificial Sequence
  Synthetic DNA
ttattcgaatcattcgag

SEQ ID NO: 45684 - DNA, 18 bp, Artificial Sequence
  Synthetic DNA
ttattcgacacacaagtg

SEQ ID NO: 45685 - DNA, 18 bp, Artificial Sequence
  Synthetic DNA
ttattcgacccattatcg

SEQ ID NO: 45686 - DNA, 18 bp, Artificial Sequence
  Synthetic DNA
ttattcgacgctctttag

SEQ ID NO: 45687 - DNA, 18 bp, Artificial Sequence
  Synthetic DNA
ttattcgactcaacctag

SEQ ID NO: 45688 - DNA, 18 bp, Artificial Sequence
  Synthetic DNA
ttattcgactcatctctg

SEQ ID NO: 45689 - DNA, 18 bp, Artificial Sequence
  Synthetic DNA
ttattcgactccacatag

SEQ ID NO: 45690 - DNA, 18 bp, Artificial Sequence
  Synthetic DNA
ttattcgactcccaacag

SEQ ID NO: 45691 - DNA, 18 bp, Artificial Sequence
  Synthetic DNA
ttattcgactctataacg

SEQ ID NO: 45692 - DNA, 18 bp, Artificial Sequence
  Synthetic DNA
ttattcgactgtctaatg

SEQ ID NO: 45693 - DNA, 18 bp, Artificial Sequence
  Synthetic DNA
ttattcgagtcacaacag

SEQ ID NO: 45694 - DNA, 18 bp, Artificial Sequence
  Synthetic DNA
ttattcgagtcccaacgg

SEQ ID NO: 45695 - DNA, 18 bp, Artificial Sequence
  Synthetic DNA
ttattcgcctccctgtag

SEQ ID NO: 45696 - DNA, 18 bp, Artificial Sequence
  Synthetic DNA
ttattcgccttactaaag

SEQ ID NO: 45697 - DNA, 18 bp, Artificial Sequence
  Synthetic DNA
ttattcggcttactattg

SEQ ID NO: 45698 - DNA, 18 bp, Artificial Sequence
  Synthetic DNA
ttattcgtcacactcaag

SEQ ID NO: 45699 - DNA, 18 bp, Artificial Sequence
  Synthetic DNA
ttattcgtcactctaaag

SEQ ID NO: 45700 - DNA, 18 bp, Artificial Sequence
  Synthetic DNA
ttattcgtcccgatttcg

SEQ ID NO: 45701 - DNA, 18 bp, Artificial Sequence
  Synthetic DNA
ttattcgtcctactatcg

SEQ ID NO: 45702 - DNA, 18 bp, Artificial Sequence
  Synthetic DNA
ttattcgtctatctgtag

SEQ ID NO: 45703 - DNA, 18 bp, Artificial Sequence
  Synthetic DNA
ttattcgtctcagtaaag

SEQ ID NO: 45704 - DNA, 18 bp, Artificial Sequence
  Synthetic DNA
ttattcgtctctttattg

SEQ ID NO: 45705 - DNA, 18 bp, Artificial Sequence
  Synthetic DNA
ttattcgtgtctctatag

SEQ ID NO: 45706 - DNA, 18 bp, Artificial Sequence
  Synthetic DNA
ttattcgtgttaaaatag

SEQ ID NO: 45707 - DNA, 18 bp, Artificial Sequence
  Synthetic DNA
ttattctatatactttag

SEQ ID NO: 45708 - DNA, 18 bp, Artificial Sequence
  Synthetic DNA
ttattcttcttagtatag

SEQ ID NO: 45709 - DNA, 18 bp, Artificial Sequence
  Synthetic DNA
ttattgaactctctatcg

SEQ ID NO: 45710 - DNA, 18 bp, Artificial Sequence
  Synthetic DNA
ttattggactaaaattag

SEQ ID NO: 45711 - DNA, 18 bp, Artificial Sequence
  Synthetic DNA
ttattggactaatcaaag

SEQ ID NO: 45712 - DNA, 18 bp, Artificial Sequence
  Synthetic DNA
ttattggacttcctaaag

SEQ ID NO: 45713 - DNA, 18 bp, Artificial Sequence
  Synthetic DNA
ttattggtctcaccattg

SEQ ID NO: 45714 - DNA, 18 bp, Artificial Sequence
  Synthetic DNA
ttatttaaatcacaatag

SEQ ID NO: 45715 - DNA, 18 bp, Artificial Sequence
  Synthetic DNA
ttatttatatcactagag

SEQ ID NO: 45716 - DNA, 18 bp, Artificial Sequence
  Synthetic DNA
ttatttgacacattattg

SEQ ID NO: 45717 - DNA, 18 bp, Artificial Sequence
  Synthetic DNA
ttatttgacacattttag

SEQ ID NO: 45718 - DNA, 18 bp, Artificial Sequence
  Synthetic DNA
ttatttgactcaacatag

SEQ ID NO: 45719 - DNA, 18 bp, Artificial Sequence
  Synthetic DNA
ttatttgactcatatcag

SEQ ID NO: 45720 - DNA, 18 bp, Artificial Sequence
  Synthetic DNA
ttatttgcctcactaatg

SEQ ID NO: 45721 - DNA, 18 bp, Artificial Sequence
  Synthetic DNA
ttatttgtcttcctatag

SEQ ID NO: 45722 - DNA, 18 bp, Artificial Sequence
  Synthetic DNA
ttattttaatcactaaag

SEQ ID NO: 45723 - DNA, 18 bp, Artificial Sequence
  Synthetic DNA
ttattttgctcactccag

SEQ ID NO: 45724 - DNA, 18 bp, Artificial Sequence
  Synthetic DNA
ttcaacgaatttctaaag

SEQ ID NO: 45725 - DNA, 18 bp, Artificial Sequence
  Synthetic DNA
ttcaacgactatctatcg

SEQ ID NO: 45726 - DNA, 18 bp, Artificial Sequence
  Synthetic DNA
ttcaacgcctcactaaag

SEQ ID NO: 45727 - DNA, 18 bp, Artificial Sequence
  Synthetic DNA
ttcaacgtcaatctatag

SEQ ID NO: 45728 - DNA, 18 bp, Artificial Sequence
  Synthetic DNA
ttcaacgtctcgccagag

SEQ ID NO: 45729 - DNA, 18 bp, Artificial Sequence
  Synthetic DNA
ttcaatgaattactatag

SEQ ID NO: 45730 - DNA, 18 bp, Artificial Sequence
  Synthetic DNA
ttcaatgactctctatag

SEQ ID NO: 45731 - DNA, 18 bp, Artificial Sequence
  Synthetic DNA
ttcaatggttaaatatgg

SEQ ID NO: 45732 - DNA, 18 bp, Artificial Sequence
  Synthetic DNA
ttcatcgaagcactctag

SEQ ID NO: 45733 - DNA, 18 bp, Artificial Sequence
  Synthetic DNA
ttccatttcactctatcg

SEQ ID NO: 45734 - DNA, 18 bp, Artificial Sequence
  Synthetic DNA
ttcctggacttactctag

SEQ ID NO: 45735 - DNA, 18 bp, Artificial Sequence
  Synthetic DNA
ttcgacgactcattagag

SEQ ID NO: 45736 - DNA, 18 bp, Artificial Sequence
  Synthetic DNA
ttctacaacccattttag

SEQ ID NO: 45737 - DNA, 18 bp, Artificial Sequence
  Synthetic DNA
ttctacacctcactagcg

SEQ ID NO: 45738 - DNA, 18 bp, Artificial Sequence
  Synthetic DNA
ttctacctctcacattag

SEQ ID NO: 45739 - DNA, 18 bp, Artificial Sequence
  Synthetic DNA
ttctacgaatcactaacg

SEQ ID NO: 45740 - DNA, 18 bp, Artificial Sequence
  Synthetic DNA
ttctacgactctccacag

SEQ ID NO: 45741 - DNA, 18 bp, Artificial Sequence
  Synthetic DNA
ttctacgacttacttttg

SEQ ID NO: 45742 - DNA, 18 bp, Artificial Sequence
  Synthetic DNA
ttctacgagctactatag

SEQ ID NO: 45743 - DNA, 18 bp, Artificial Sequence
  Synthetic DNA
ttctacgattcacttatg

SEQ ID NO: 45744 - DNA, 18 bp, Artificial Sequence
  Synthetic DNA
ttctacgattcgcaatag

SEQ ID NO: 45745 - DNA, 18 bp, Artificial Sequence
  Synthetic DNA
ttctacgattctcaatag

SEQ ID NO: 45746 - DNA, 18 bp, Artificial Sequence
  Synthetic DNA
ttctacgtttcacttttg

SEQ ID NO: 45747 - DNA, 18 bp, Artificial Sequence
  Synthetic DNA
ttctactgcgcactaaag

SEQ ID NO: 45748 - DNA, 18 bp, Artificial Sequence
  Synthetic DNA
ttctagcacacacagtcg

SEQ ID NO: 45749 - DNA, 18 bp, Artificial Sequence
  Synthetic DNA
ttctaggtctcactacag

SEQ ID NO: 45750 - DNA, 18 bp, Artificial Sequence
  Synthetic DNA
ttctataactcgtgatag

SEQ ID NO: 45751 - DNA, 18 bp, Artificial Sequence
  Synthetic DNA
ttctatgactaactagtg

SEQ ID NO: 45752 - DNA, 18 bp, Artificial Sequence
  Synthetic DNA
ttctccatctcgctatag

SEQ ID NO: 45753 - DNA, 18 bp, Artificial Sequence
  Synthetic DNA
ttctccgactcactgctg

SEQ ID NO: 45754 - DNA, 18 bp, Artificial Sequence
  Synthetic DNA
ttcttagatatactatag

SEQ ID NO: 45755 - DNA, 18 bp, Artificial Sequence
  Synthetic DNA
ttcttcgactcattatcg

SEQ ID NO: 45756 - DNA, 18 bp, Artificial Sequence
  Synthetic DNA
ttcttcgactctcttatg

SEQ ID NO: 45757 - DNA, 18 bp, Artificial Sequence
  Synthetic DNA
ttctttgactaactatag

SEQ ID NO: 45758 - DNA, 18 bp, Artificial Sequence
  Synthetic DNA
ttgaacgtcatcctatag

SEQ ID NO: 45759 - DNA, 18 bp, Artificial Sequence
  Synthetic DNA
ttgaacgtttcttagtag

SEQ ID NO: 45760 - DNA, 18 bp, Artificial Sequence
  Synthetic DNA
ttgagtgtctcaagacag

SEQ ID NO: 45761 - DNA, 18 bp, Artificial Sequence
  Synthetic DNA
ttgatcgactcacaattg

SEQ ID NO: 45762 - DNA, 18 bp, Artificial Sequence
  Synthetic DNA
ttgcacccctcactttag

SEQ ID NO: 45763 - DNA, 18 bp, Artificial Sequence
  Synthetic DNA
ttgcacgactaactttag

SEQ ID NO: 45764 - DNA, 18 bp, Artificial Sequence
  Synthetic DNA
ttgcacgactaagaatag

SEQ ID NO: 45765 - DNA, 18 bp, Artificial Sequence
  Synthetic DNA
ttgcacgactcgcttaag

SEQ ID NO: 45766 - DNA, 18 bp, Artificial Sequence
  Synthetic DNA
ttggcctactcattaagg

SEQ ID NO: 45767 - DNA, 18 bp, Artificial Sequence
  Synthetic DNA
ttgtaagactcactaagg

SEQ ID NO: 45768 - DNA, 18 bp, Artificial Sequence
  Synthetic DNA
ttgtaagactcattattg

SEQ ID NO: 45769 - DNA, 18 bp, Artificial Sequence
  Synthetic DNA
ttgtaaggctctctaaag

SEQ ID NO: 45770 - DNA, 18 bp, Artificial Sequence
  Synthetic DNA
ttgtaccactcggtaaag

SEQ ID NO: 45771 - DNA, 18 bp, Artificial Sequence
  Synthetic DNA
ttgtacgacacttcatag

SEQ ID NO: 45772 - DNA, 18 bp, Artificial Sequence
  Synthetic DNA
ttgtacgacgcactgaag

SEQ ID NO: 45773 - DNA, 18 bp, Artificial Sequence
  Synthetic DNA
ttgtacgactttctttag

SEQ ID NO: 45774 - DNA, 18 bp, Artificial Sequence
  Synthetic DNA
ttgtacgattctcttaag

SEQ ID NO: 45775 - DNA, 18 bp, Artificial Sequence
  Synthetic DNA
ttgtacgccactcgatag

SEQ ID NO: 45776 - DNA, 18 bp, Artificial Sequence
  Synthetic DNA
ttgtacgccttacactag

SEQ ID NO: 45777 - DNA, 18 bp, Artificial Sequence
  Synthetic DNA
ttgtacgtatcatattag

SEQ ID NO: 45778 - DNA, 18 bp, Artificial Sequence
  Synthetic DNA
ttgtacgtcatacaatag

SEQ ID NO: 45779 - DNA, 18 bp, Artificial Sequence
  Synthetic DNA
ttgtacgtctcaacgaag

SEQ ID NO: 45780 - DNA, 18 bp, Artificial Sequence
  Synthetic DNA
ttgtacgtctctcatttg

SEQ ID NO: 45781 - DNA, 18 bp, Artificial Sequence
  Synthetic DNA
ttgtacgtttatctatag

SEQ ID NO: 45782 - DNA, 18 bp, Artificial Sequence
  Synthetic DNA
ttgtactaatcattacag

SEQ ID NO: 45783 - DNA, 18 bp, Artificial Sequence
  Synthetic DNA
ttgtactacacacattag

SEQ ID NO: 45784 - DNA, 18 bp, Artificial Sequence
  Synthetic DNA
ttgtaggaatatacatcg

SEQ ID NO: 45785 - DNA, 18 bp, Artificial Sequence
  Synthetic DNA
ttgtataaatcgctaatg

SEQ ID NO: 45786 - DNA, 18 bp, Artificial Sequence
  Synthetic DNA
ttgtatcacatactatag

SEQ ID NO: 45787 - DNA, 18 bp, Artificial Sequence
  Synthetic DNA
ttgtatgactatctttag

SEQ ID NO: 45788 - DNA, 18 bp, Artificial Sequence
  Synthetic DNA
ttgtatgacttactttag

SEQ ID NO: 45789 - DNA, 18 bp, Artificial Sequence
  Synthetic DNA
ttgtatgtgtcacgttag

SEQ ID NO: 45790 - DNA, 18 bp, Artificial Sequence
  Synthetic DNA
ttgtattattctctaaag

SEQ ID NO: 45791 - DNA, 18 bp, Artificial Sequence
  Synthetic DNA
ttgttagactctcaagtg

SEQ ID NO: 45792 - DNA, 18 bp, Artificial Sequence
  Synthetic DNA
ttgttagagtcactatag

SEQ ID NO: 45793 - DNA, 18 bp, Artificial Sequence
  Synthetic DNA
ttgttagtaactctatag

SEQ ID NO: 45794 - DNA, 18 bp, Artificial Sequence
  Synthetic DNA
ttgttcgacttattatag

SEQ ID NO: 45795 - DNA, 18 bp, Artificial Sequence
  Synthetic DNA
ttgttcggttgtatatag

SEQ ID NO: 45796 - DNA, 18 bp, Artificial Sequence
  Synthetic DNA
ttgttcgtctccctatgg

SEQ ID NO: 45797 - DNA, 18 bp, Artificial Sequence
  Synthetic DNA
ttgttctactctgtttag

SEQ ID NO: 45798 - DNA, 18 bp, Artificial Sequence
  Synthetic DNA
tttaacgaatatctatag

SEQ ID NO: 45799 - DNA, 18 bp, Artificial Sequence
  Synthetic DNA
tttaacgacatattatag

SEQ ID NO: 45800 - DNA, 18 bp, Artificial Sequence
  Synthetic DNA
tttaacgattcagtaaag

SEQ ID NO: 45801 - DNA, 18 bp, Artificial Sequence
  Synthetic DNA
tttaacgtcacactaaag

SEQ ID NO: 45802 - DNA, 18 bp, Artificial Sequence
  Synthetic DNA
tttaacgttccactatag

SEQ ID NO: 45803 - DNA, 18 bp, Artificial Sequence
  Synthetic DNA
tttaaggacttacattag

SEQ ID NO: 45804 - DNA, 18 bp, Artificial Sequence
  Synthetic DNA
tttaccgattaactacgg

SEQ ID NO: 45805 - DNA, 18 bp, Artificial Sequence
  Synthetic DNA
tttatccactcattatag

SEQ ID NO: 45806 - DNA, 18 bp, Artificial Sequence
  Synthetic DNA
tttatcgactctctattg

SEQ ID NO: 45807 - DNA, 18 bp, Artificial Sequence
  Synthetic DNA
tttcacaactcaccatag

SEQ ID NO: 45808 - DNA, 18 bp, Artificial Sequence
  Synthetic DNA
tttcacgactcacaatgg

SEQ ID NO: 45809 - DNA, 18 bp, Artificial Sequence
  Synthetic DNA
tttcacgacttactatcg

SEQ ID NO: 45810 - DNA, 18 bp, Artificial Sequence
  Synthetic DNA
tttcacgagtctctttag

SEQ ID NO: 45811 - DNA, 18 bp, Artificial Sequence
  Synthetic DNA
tttcgcaacagactatgg

SEQ ID NO: 45812 - DNA, 18 bp, Artificial Sequence
  Synthetic DNA
tttcgcgactctttattg

SEQ ID NO: 45813 - DNA, 18 bp, Artificial Sequence
  Synthetic DNA
tttcgcggctttctatag

SEQ ID NO: 45814 - DNA, 18 bp, Artificial Sequence
  Synthetic DNA
tttgacgagtcactcaag

SEQ ID NO: 45815 - DNA, 18 bp, Artificial Sequence
  Synthetic DNA
tttgtagattcactatag

SEQ ID NO: 45816 - DNA, 18 bp, Artificial Sequence
  Synthetic DNA
ttttaaaacgcacttaag

SEQ ID NO: 45817 - DNA, 18 bp, Artificial Sequence
  Synthetic DNA
ttttaagactaacgttag

SEQ ID NO: 45818 - DNA, 18 bp, Artificial Sequence
  Synthetic DNA
ttttaagactcttttttg

SEQ ID NO: 45819 - DNA, 18 bp, Artificial Sequence
  Synthetic DNA
ttttaagacttgctttag

SEQ ID NO: 45820 - DNA, 18 bp, Artificial Sequence
  Synthetic DNA
ttttaagtcgtactatag

SEQ ID NO: 45821 - DNA, 18 bp, Artificial Sequence
  Synthetic DNA
ttttaagtttgtcaaaag

SEQ ID NO: 45822 - DNA, 18 bp, Artificial Sequence
  Synthetic DNA
ttttacaactaacttaag

SEQ ID NO: 45823 - DNA, 18 bp, Artificial Sequence
  Synthetic DNA
ttttacaactccgaatcg

SEQ ID NO: 45824 - DNA, 18 bp, Artificial Sequence
  Synthetic DNA
ttttacaactctctctag

SEQ ID NO: 45825 - DNA, 18 bp, Artificial Sequence
  Synthetic DNA
ttttacaatacactatag

SEQ ID NO: 45826 - DNA, 18 bp, Artificial Sequence
  Synthetic DNA
ttttacaattaactatag

SEQ ID NO: 45827 - DNA, 18 bp, Artificial Sequence
  Synthetic DNA
ttttacaattcaccatag

SEQ ID NO: 45828 - DNA, 18 bp, Artificial Sequence
  Synthetic DNA
ttttacatattactaacg

SEQ ID NO: 45829 - DNA, 18 bp, Artificial Sequence
  Synthetic DNA
ttttacatttaactatcg

SEQ ID NO: 45830 - DNA, 18 bp, Artificial Sequence
  Synthetic DNA
ttttaccccacactattg

SEQ ID NO: 45831 - DNA, 18 bp, Artificial Sequence
  Synthetic DNA
ttttacctcttacaatag

SEQ ID NO: 45832 - DNA, 18 bp, Artificial Sequence
  Synthetic DNA
ttttacgaaattcattag

SEQ ID NO: 45833 - DNA, 18 bp, Artificial Sequence
  Synthetic DNA
ttttacgaataactattg

SEQ ID NO: 45834 - DNA, 18 bp, Artificial Sequence
  Synthetic DNA
ttttacgaattacttctg

SEQ ID NO: 45835 - DNA, 18 bp, Artificial Sequence
  Synthetic DNA
ttttacgacaccctacag

SEQ ID NO: 45836 - DNA, 18 bp, Artificial Sequence
  Synthetic DNA
ttttacgacccacaacag

SEQ ID NO: 45837 - DNA, 18 bp, Artificial Sequence
  Synthetic DNA
ttttacgactatctaaag

SEQ ID NO: 45838 - DNA, 18 bp, Artificial Sequence
  Synthetic DNA
ttttacgactatgtgttg

SEQ ID NO: 45839 - DNA, 18 bp, Artificial Sequence
  Synthetic DNA
ttttacgactcataattg

SEQ ID NO: 45840 - DNA, 18 bp, Artificial Sequence
  Synthetic DNA
ttttacgactctccgttg

SEQ ID NO: 45841 - DNA, 18 bp, Artificial Sequence
  Synthetic DNA
ttttacgactggttatgg

SEQ ID NO: 45842 - DNA, 18 bp, Artificial Sequence
  Synthetic DNA
ttttacgacttaataaag

SEQ ID NO: 45843 - DNA, 18 bp, Artificial Sequence
  Synthetic DNA
ttttacggctcacgacag

SEQ ID NO: 45844 - DNA, 18 bp, Artificial Sequence
  Synthetic DNA
ttttacgtatcacttttg

SEQ ID NO: 45845 - DNA, 18 bp, Artificial Sequence
  Synthetic DNA
ttttacgtcacactatcg

SEQ ID NO: 45846 - DNA, 18 bp, Artificial Sequence
  Synthetic DNA
ttttacgtccaactaaag

SEQ ID NO: 45847 - DNA, 18 bp, Artificial Sequence
  Synthetic DNA
ttttacgtctaaacgtag

SEQ ID NO: 45848 - DNA, 18 bp, Artificial Sequence
  Synthetic DNA
ttttacgtctcaatttag

SEQ ID NO: 45849 - DNA, 18 bp, Artificial Sequence
  Synthetic DNA
ttttactacatactttag

SEQ ID NO: 45850 - DNA, 18 bp, Artificial Sequence
  Synthetic DNA
ttttactacccactaaag

SEQ ID NO: 45851 - DNA, 18 bp, Artificial Sequence
  Synthetic DNA
ttttactactgactacag

SEQ ID NO: 45852 - DNA, 18 bp, Artificial Sequence
  Synthetic DNA
ttttactgctctcaatag

SEQ ID NO: 45853 - DNA, 18 bp, Artificial Sequence
  Synthetic DNA
ttttactttttcatatag

SEQ ID NO: 45854 - DNA, 18 bp, Artificial Sequence
  Synthetic DNA
ttttagaactcaccttag

SEQ ID NO: 45855 - DNA, 18 bp, Artificial Sequence
  Synthetic DNA
ttttagaactcactattg

SEQ ID NO: 45856 - DNA, 18 bp, Artificial Sequence
  Synthetic DNA
ttttaggacaatatatag

SEQ ID NO: 45857 - DNA, 18 bp, Artificial Sequence
  Synthetic DNA
ttttaggactcactgtgg

SEQ ID NO: 45858 - DNA, 18 bp, Artificial Sequence
  Synthetic DNA
ttttaggattcactttag

SEQ ID NO: 45859 - DNA, 18 bp, Artificial Sequence
  Synthetic DNA
ttttataaaacaatgtag

SEQ ID NO: 45860 - DNA, 18 bp, Artificial Sequence
  Synthetic DNA
ttttatctctcaaatatg

SEQ ID NO: 45861 - DNA, 18 bp, Artificial Sequence
  Synthetic DNA
ttttatgaatcgctatag

SEQ ID NO: 45862 - DNA, 18 bp, Artificial Sequence
  Synthetic DNA
ttttatgacaccatatag

SEQ ID NO: 45863 - DNA, 18 bp, Artificial Sequence
  Synthetic DNA
ttttatgacatataattg

SEQ ID NO: 45864 - DNA, 18 bp, Artificial Sequence
  Synthetic DNA
ttttatgactgttaatag

SEQ ID NO: 45865 - DNA, 18 bp, Artificial Sequence
  Synthetic DNA
ttttatgacttactaaag

SEQ ID NO: 45866 - DNA, 18 bp, Artificial Sequence
  Synthetic DNA
ttttatgacttattattg

SEQ ID NO: 45867 - DNA, 18 bp, Artificial Sequence
  Synthetic DNA
ttttatgactttatagag

SEQ ID NO: 45868 - DNA, 18 bp, Artificial Sequence
  Synthetic DNA
ttttatgattcacttacg

SEQ ID NO: 45869 - DNA, 18 bp, Artificial Sequence
  Synthetic DNA
ttttatgattcattattg

SEQ ID NO: 45870 - DNA, 18 bp, Artificial Sequence
  Synthetic DNA
ttttatggcacactatag

SEQ ID NO: 45871 - DNA, 18 bp, Artificial Sequence
  Synthetic DNA
ttttatgtatcactatag

SEQ ID NO: 45872 - DNA, 18 bp, Artificial Sequence
  Synthetic DNA
ttttatgtcactctttag

SEQ ID NO: 45873 - DNA, 18 bp, Artificial Sequence
  Synthetic DNA
ttttatgtccctccattg

SEQ ID NO: 45874 - DNA, 18 bp, Artificial Sequence
  Synthetic DNA
ttttccgacacaatatag

SEQ ID NO: 45875 - DNA, 18 bp, Artificial Sequence
  Synthetic DNA
ttttccgactaaatattg

SEQ ID NO: 45876 - DNA, 18 bp, Artificial Sequence
  Synthetic DNA
ttttccgtttcactattg

SEQ ID NO: 45877 - DNA, 18 bp, Artificial Sequence
  Synthetic DNA
ttttgccaatcactatag

SEQ ID NO: 45878 - DNA, 18 bp, Artificial Sequence
  Synthetic DNA
ttttgcgcctcactaaag

SEQ ID NO: 45879 - DNA, 18 bp, Artificial Sequence
  Synthetic DNA
ttttgcgtctcactttag

SEQ ID NO: 45880 - DNA, 18 bp, Artificial Sequence
  Synthetic DNA
ttttgctacacactatag

SEQ ID NO: 45881 - DNA, 18 bp, Artificial Sequence
  Synthetic DNA
ttttgggaccatctagcg

SEQ ID NO: 45882 - DNA, 18 bp, Artificial Sequence
  Synthetic DNA
tttttatactctgtttag

SEQ ID NO: 45883 - DNA, 18 bp, Artificial Sequence
  Synthetic DNA
tttttcaacttattttag

SEQ ID NO: 45884 - DNA, 18 bp, Artificial Sequence
  Synthetic DNA
tttttcatctcacaatag

SEQ ID NO: 45885 - DNA, 18 bp, Artificial Sequence
  Synthetic DNA
tttttcgaaacactatag

SEQ ID NO: 45886 - DNA, 18 bp, Artificial Sequence
  Synthetic DNA
tttttcgacacaatgaag

SEQ ID NO: 45887 - DNA, 18 bp, Artificial Sequence
  Synthetic DNA
tttttcgacacataaaag

SEQ ID NO: 45888 - DNA, 18 bp, Artificial Sequence
  Synthetic DNA
tttttcgactaactgtcg

SEQ ID NO: 45889 - DNA, 18 bp, Artificial Sequence
  Synthetic DNA
tttttcgactcactaagg

SEQ ID NO: 45890 - DNA, 18 bp, Artificial Sequence
  Synthetic DNA
tttttcgactcactttcg

SEQ ID NO: 45891 - DNA, 18 bp, Artificial Sequence
  Synthetic DNA
tttttctaatcactaaag

SEQ ID NO: 45892 - DNA, 18 bp, Artificial Sequence
  Synthetic DNA
tttttgtattcactatag

SEQ ID NO: 45893 - DNA, 18 bp, Artificial Sequence
  Synthetic DNA
ttttttgtctcactaaag

SEQ ID NO: 45894 - DNA, 18 bp, Artificial Sequence
  Synthetic DNA
ctttacgtctcactattg

SEQ ID NO: 45895 - DNA, 18 bp, Artificial Sequence
  Synthetic DNA
tatgtagccccaccaaag

SEQ ID NO: 45896 - DNA, 18 bp, Artificial Sequence
  Synthetic DNA
aaatccgacactctattg

SEQ ID NO: 45897 - DNA, 18 bp, Artificial Sequence
  Synthetic DNA
cattaaaactcactaaag

SEQ ID NO: 45898 - DNA, 18 bp, Artificial Sequence
  Synthetic DNA
taaagagcatcactatag

SEQ ID NO: 45899 - DNA, 18 bp, Artificial Sequence
  Synthetic DNA
tagaacatctctttatag

SEQ ID NO: 45900 - DNA, 18 bp, Artificial Sequence
  Synthetic DNA
tatcacgactaacctttg

SEQ ID NO: 45901 - DNA, 18 bp, Artificial Sequence
  Synthetic DNA
aaataatacaaacaatag

SEQ ID NO: 45902 - DNA, 18 bp, Artificial Sequence
  Synthetic DNA
aaatatgacattttatag

SEQ ID NO: 45903 - DNA, 18 bp, Artificial Sequence
  Synthetic DNA
aagatcgactcactatcg

SEQ ID NO: 45904 - DNA, 18 bp, Artificial Sequence
  Synthetic DNA
acatgcgactcaataaag

SEQ ID NO: 45905 - DNA, 18 bp, Artificial Sequence
  Synthetic DNA
agaaacgactaactctag

SEQ ID NO: 45906 - DNA, 18 bp, Artificial Sequence
  Synthetic DNA
atatacgacaaactattg

SEQ ID NO: 45907 - DNA, 18 bp, Artificial Sequence
  Synthetic DNA
atatccgacacaatttag

SEQ ID NO: 45908 - DNA, 18 bp, Artificial Sequence
  Synthetic DNA
atattcgactggctgtag

SEQ ID NO: 45909 - DNA, 18 bp, Artificial Sequence
  Synthetic DNA
atttacaacacacgattg

SEQ ID NO: 45910 - DNA, 18 bp, Artificial Sequence
  Synthetic DNA
taatatgtattcctatag

SEQ ID NO: 45911 - DNA, 18 bp, Artificial Sequence
  Synthetic DNA
taatatgtctctttactg

SEQ ID NO: 45912 - DNA, 18 bp, Artificial Sequence
  Synthetic DNA
taatccaactgtttatag

SEQ ID NO: 45913 - DNA, 18 bp, Artificial Sequence
  Synthetic DNA
taatccgtctaactaatg

SEQ ID NO: 45914 - DNA, 18 bp, Artificial Sequence
  Synthetic DNA
taatgccactgacttttg

SEQ ID NO: 45915 - DNA, 18 bp, Artificial Sequence
  Synthetic DNA
taattcttctcattagag

SEQ ID NO: 45916 - DNA, 18 bp, Artificial Sequence
  Synthetic DNA
tactaagtctccctttag

SEQ ID NO: 45917 - DNA, 18 bp, Artificial Sequence
  Synthetic DNA
tactatgacatactatgg

SEQ ID NO: 45918 - DNA, 18 bp, Artificial Sequence
  Synthetic DNA
tataacgactattaattg

SEQ ID NO: 45919 - DNA, 18 bp, Artificial Sequence
  Synthetic DNA
tattacttgtcccaatag

SEQ ID NO: 45920 - DNA, 18 bp, Artificial Sequence
  Synthetic DNA
tatttaaacacactctag

SEQ ID NO: 45921 - DNA, 18 bp, Artificial Sequence
  Synthetic DNA
tatttcgacgcattttag

SEQ ID NO: 45922 - DNA, 18 bp, Artificial Sequence
  Synthetic DNA
tctaacgactcacaacag

SEQ ID NO: 45923 - DNA, 18 bp, Artificial Sequence
  Synthetic DNA
tgaaacaacactcaaaag

SEQ ID NO: 45924 - DNA, 18 bp, Artificial Sequence
  Synthetic DNA
tgttacgcctctctagag

SEQ ID NO: 45925 - DNA, 18 bp, Artificial Sequence
  Synthetic DNA
ttatacgacgcacatttg

SEQ ID NO: 45926 - DNA, 18 bp, Artificial Sequence
  Synthetic DNA
ttttagcacccgccatag

SEQ ID NO: 45927 - DNA, 18 bp, Artificial Sequence
  Synthetic DNA
taaaactactgactagtg

SEQ ID NO: 45928 - DNA, 18 bp, Artificial Sequence
  Synthetic DNA
tcataggactcaatgaag

SEQ ID NO: 45929 - DNA, 18 bp, Artificial Sequence
  Synthetic DNA
tgaaataactcactatgg

SEQ ID NO: 45930 - DNA, 18 bp, Artificial Sequence
  Synthetic DNA
ttatacagctcactactg

SEQ ID NO: 45931 - DNA, 18 bp, Artificial Sequence
  Synthetic DNA
aaaaacatcccactagag

SEQ ID NO: 45932 - DNA, 18 bp, Artificial Sequence
  Synthetic DNA
aaaaatgactcaccttag

SEQ ID NO: 45933 - DNA, 18 bp, Artificial Sequence
  Synthetic DNA
aaataaccctcactgaag

SEQ ID NO: 45934 - DNA, 18 bp, Artificial Sequence
  Synthetic DNA
aaataagaagaaatatag

SEQ ID NO: 45935 - DNA, 18 bp, Artificial Sequence
  Synthetic DNA
aaataagacaatctattg

SEQ ID NO: 45936 - DNA, 18 bp, Artificial Sequence
  Synthetic DNA
aaataagtatcccaatag

SEQ ID NO: 45937 - DNA, 18 bp, Artificial Sequence
  Synthetic DNA
aaataatacactttatag

SEQ ID NO: 45938 - DNA, 18 bp, Artificial Sequence
  Synthetic DNA
aaatacaattaaccatag

SEQ ID NO: 45939 - DNA, 18 bp, Artificial Sequence
  Synthetic DNA
aaatacaatttatcaaag

SEQ ID NO: 45940 - DNA, 18 bp, Artificial Sequence
  Synthetic DNA
aaatacagcttccttttg

SEQ ID NO: 45941 - DNA, 18 bp, Artificial Sequence
  Synthetic DNA
aaatacttatcaatagag

SEQ ID NO: 45942 - DNA, 18 bp, Artificial Sequence
  Synthetic DNA
aaataggcttcacactag

SEQ ID NO: 45943 - DNA, 18 bp, Artificial Sequence
  Synthetic DNA
aaatcatacttacaatag

SEQ ID NO: 45944 - DNA, 18 bp, Artificial Sequence
  Synthetic DNA
aaatccaactcacaaaag

SEQ ID NO: 45945 - DNA, 18 bp, Artificial Sequence
  Synthetic DNA
aaatgatactcacttcag

SEQ ID NO: 45946 - DNA, 18 bp, Artificial Sequence
  Synthetic DNA
aaatgctattcactattg

SEQ ID NO: 45947 - DNA, 18 bp, Artificial Sequence
  Synthetic DNA
aaattagactcacttaag

SEQ ID NO: 45948 - DNA, 18 bp, Artificial Sequence
  Synthetic DNA
aaattcgactgaatattg

SEQ ID NO: 45949 - DNA, 18 bp, Artificial Sequence
  Synthetic DNA
aacaactacagactatag

SEQ ID NO: 45950 - DNA, 18 bp, Artificial Sequence
  Synthetic DNA
aactaagaatccctatag

SEQ ID NO: 45951 - DNA, 18 bp, Artificial Sequence
  Synthetic DNA
aactccgactcaatacag

SEQ ID NO: 45952 - DNA, 18 bp, Artificial Sequence
  Synthetic DNA
aagaacgaatgactaaag

SEQ ID NO: 45953 - DNA, 18 bp, Artificial Sequence
  Synthetic DNA
aagtagtactcagtatag

SEQ ID NO: 45954 - DNA, 18 bp, Artificial Sequence
  Synthetic DNA
aagtatgaattcctatag

SEQ ID NO: 45955 - DNA, 18 bp, Artificial Sequence
  Synthetic DNA
aagttcaactccctatag

SEQ ID NO: 45956 - DNA, 18 bp, Artificial Sequence
  Synthetic DNA
aatcacgaatcaccactg

SEQ ID NO: 45957 - DNA, 18 bp, Artificial Sequence
  Synthetic DNA
aattacgactgtttatag

SEQ ID NO: 45958 - DNA, 18 bp, Artificial Sequence
  Synthetic DNA
aattacgtttctatttag

SEQ ID NO: 45959 - DNA, 18 bp, Artificial Sequence
  Synthetic DNA
aattactagtctctatag

SEQ ID NO: 45960 - DNA, 18 bp, Artificial Sequence
  Synthetic DNA
aattactgatctctattg

SEQ ID NO: 45961 - DNA, 18 bp, Artificial Sequence
  Synthetic DNA
aattccgacacacttatg

SEQ ID NO: 45962 - DNA, 18 bp, Artificial Sequence
  Synthetic DNA
acataagacccactttag

SEQ ID NO: 45963 - DNA, 18 bp, Artificial Sequence
  Synthetic DNA
acatccctcccactgtag

SEQ ID NO: 45964 - DNA, 18 bp, Artificial Sequence
  Synthetic DNA
agatacgattaatatttg

SEQ ID NO: 45965 - DNA, 18 bp, Artificial Sequence
  Synthetic DNA
agattaggatctctatag

SEQ ID NO: 45966 - DNA, 18 bp, Artificial Sequence
  Synthetic DNA
aggaacgactcgctatag

SEQ ID NO: 45967 - DNA, 18 bp, Artificial Sequence
  Synthetic DNA
ataaacgacttaatagag

SEQ ID NO: 45968 - DNA, 18 bp, Artificial Sequence
  Synthetic DNA
ataaacgtcgcgctatag

SEQ ID NO: 45969 - DNA, 18 bp, Artificial Sequence
  Synthetic DNA
atataaaacttattttag

SEQ ID NO: 45970 - DNA, 18 bp, Artificial Sequence
  Synthetic DNA
atatacaaatcaatctag

SEQ ID NO: 45971 - DNA, 18 bp, Artificial Sequence
  Synthetic DNA
atataggactcacttaag

SEQ ID NO: 45972 - DNA, 18 bp, Artificial Sequence
  Synthetic DNA
atatgccagacacaagag

SEQ ID NO: 45973 - DNA, 18 bp, Artificial Sequence
  Synthetic DNA
atattcatgccactattg

SEQ ID NO: 45974 - DNA, 18 bp, Artificial Sequence
  Synthetic DNA
atattcgactcacactag

SEQ ID NO: 45975 - DNA, 18 bp, Artificial Sequence
  Synthetic DNA
atctaggtctctctatag

SEQ ID NO: 45976 - DNA, 18 bp, Artificial Sequence
  Synthetic DNA
atttaccacatactatag

SEQ ID NO: 45977 - DNA, 18 bp, Artificial Sequence
  Synthetic DNA
atttccggctcactatag

SEQ ID NO: 45978 - DNA, 18 bp, Artificial Sequence
  Synthetic DNA
caaaacgccacactaaag

SEQ ID NO: 45979 - DNA, 18 bp, Artificial Sequence
  Synthetic DNA
caaaattactaactttgg

SEQ ID NO: 45980 - DNA, 18 bp, Artificial Sequence
  Synthetic DNA
caacacgtgtcacaaacg

SEQ ID NO: 45981 - DNA, 18 bp, Artificial Sequence
  Synthetic DNA
caataccacttaatattg

SEQ ID NO: 45982 - DNA, 18 bp, Artificial Sequence
  Synthetic DNA
caatacctttcacattag

SEQ ID NO: 45983 - DNA, 18 bp, Artificial Sequence
  Synthetic DNA
caatatgaagaacatttg

SEQ ID NO: 45984 - DNA, 18 bp, Artificial Sequence
  Synthetic DNA
caatcagatcccatatag

SEQ ID NO: 45985 - DNA, 18 bp, Artificial Sequence
  Synthetic DNA
caatccgactacctattg

SEQ ID NO: 45986 - DNA, 18 bp, Artificial Sequence
  Synthetic DNA
cacttcgactgtctatag

SEQ ID NO: 45987 - DNA, 18 bp, Artificial Sequence
  Synthetic DNA
cagtacaaatcactattg

SEQ ID NO: 45988 - DNA, 18 bp, Artificial Sequence
  Synthetic DNA
cagttcgcttcaatgtag

SEQ ID NO: 45989 - DNA, 18 bp, Artificial Sequence
  Synthetic DNA
catagcgtttcactgtag

SEQ ID NO: 45990 - DNA, 18 bp, Artificial Sequence
  Synthetic DNA
cattaagaatcacaaaag

SEQ ID NO: 45991 - DNA, 18 bp, Artificial Sequence
  Synthetic DNA
cattacgacacaatatcg

SEQ ID NO: 45992 - DNA, 18 bp, Artificial Sequence
  Synthetic DNA
cattacgtctcactaacg

SEQ ID NO: 45993 - DNA, 18 bp, Artificial Sequence
  Synthetic DNA
ccataagactcaatttgg

SEQ ID NO: 45994 - DNA, 18 bp, Artificial Sequence
  Synthetic DNA
ccatgcgactctcaatag

SEQ ID NO: 45995 - DNA, 18 bp, Artificial Sequence
  Synthetic DNA
ccgtaggattcactatag

SEQ ID NO: 45996 - DNA, 18 bp, Artificial Sequence
  Synthetic DNA
ccttaggactcactagag

SEQ ID NO: 45997 - DNA, 18 bp, Artificial Sequence
  Synthetic DNA
cgatatgactcgctattg

SEQ ID NO: 45998 - DNA, 18 bp, Artificial Sequence
  Synthetic DNA
ctatacgtctcattaaag

SEQ ID NO: 45999 - DNA, 18 bp, Artificial Sequence
  Synthetic DNA
ctatatgtctcaccaaag

SEQ ID NO: 46000 - DNA, 18 bp, Artificial Sequence
  Synthetic DNA
gaataggacctactaaag

SEQ ID NO: 46001 - DNA, 18 bp, Artificial Sequence
  Synthetic DNA
gaataggactctcattag

SEQ ID NO: 46002 - DNA, 18 bp, Artificial Sequence
  Synthetic DNA
gattactgcacactgtag

SEQ ID NO: 46003 - DNA, 18 bp, Artificial Sequence
  Synthetic DNA
gcatatgtcttactatag

SEQ ID NO: 46004 - DNA, 18 bp, Artificial Sequence
  Synthetic DNA
ggttacgaattcctaaag

SEQ ID NO: 46005 - DNA, 18 bp, Artificial Sequence
  Synthetic DNA
gtaaacgcctcactaatg

SEQ ID NO: 46006 - DNA, 18 bp, Artificial Sequence
  Synthetic DNA
gtttacgactcactcttg

SEQ ID NO: 46007 - DNA, 18 bp, Artificial Sequence
  Synthetic DNA
taaaaagtctaactttag

SEQ ID NO: 46008 - DNA, 18 bp, Artificial Sequence
  Synthetic DNA
taaaacgaatctccattg

SEQ ID NO: 46009 - DNA, 18 bp, Artificial Sequence
  Synthetic DNA
taaaacgactaatagtag

SEQ ID NO: 46010 - DNA, 18 bp, Artificial Sequence
  Synthetic DNA
taaaacgagttactaacg

SEQ ID NO: 46011 - DNA, 18 bp, Artificial Sequence
  Synthetic DNA
taaaacgcttccctattg

SEQ ID NO: 46012 - DNA, 18 bp, Artificial Sequence
  Synthetic DNA
taaaacgtcactctattg

SEQ ID NO: 46013 - DNA, 18 bp, Artificial Sequence
  Synthetic DNA
taaaacgtcatacaatag

SEQ ID NO: 46014 - DNA, 18 bp, Artificial Sequence
  Synthetic DNA
taaaactactaactcttg

SEQ ID NO: 46015 - DNA, 18 bp, Artificial Sequence
  Synthetic DNA
taaaactcataactgatg

SEQ ID NO: 46016 - DNA, 18 bp, Artificial Sequence
  Synthetic DNA
taaaagcactcattttag

SEQ ID NO: 46017 - DNA, 18 bp, Artificial Sequence
  Synthetic DNA
taaaagttttcattaccg

SEQ ID NO: 46018 - DNA, 18 bp, Artificial Sequence
  Synthetic DNA
taaaatgactttcaatag

SEQ ID NO: 46019 - DNA, 18 bp, Artificial Sequence
  Synthetic DNA
taaaatggcacaccatag

SEQ ID NO: 46020 - DNA, 18 bp, Artificial Sequence
  Synthetic DNA
taaaccaactcatgatag

SEQ ID NO: 46021 - DNA, 18 bp, Artificial Sequence
  Synthetic DNA
taaaccgactcaaactag

SEQ ID NO: 46022 - DNA, 18 bp, Artificial Sequence
  Synthetic DNA
taaaccggcttactattg

SEQ ID NO: 46023 - DNA, 18 bp, Artificial Sequence
  Synthetic DNA
taaactgcgacacactag

SEQ ID NO: 46024 - DNA, 18 bp, Artificial Sequence
  Synthetic DNA
taaatcaactcactcaag

SEQ ID NO: 46025 - DNA, 18 bp, Artificial Sequence
  Synthetic DNA
taaatcgactcgctaatg

SEQ ID NO: 46026 - DNA, 18 bp, Artificial Sequence
  Synthetic DNA
taaatcgactttctttag

SEQ ID NO: 46027 - DNA, 18 bp, Artificial Sequence
  Synthetic DNA
taaatctacttacaaatg

SEQ ID NO: 46028 - DNA, 18 bp, Artificial Sequence
  Synthetic DNA
taaatctacttactcatg

SEQ ID NO: 46029 - DNA, 18 bp, Artificial Sequence
  Synthetic DNA
taacaatagcgactatag

SEQ ID NO: 46030 - DNA, 18 bp, Artificial Sequence
  Synthetic DNA
taacacgtaacacattag

SEQ ID NO: 46031 - DNA, 18 bp, Artificial Sequence
  Synthetic DNA
taacacgtctcaaaaaag

SEQ ID NO: 46032 - DNA, 18 bp, Artificial Sequence
  Synthetic DNA
taactcgtctcacaagag

SEQ ID NO: 46033 - DNA, 18 bp, Artificial Sequence
  Synthetic DNA
taagccgtcacaaaatag

SEQ ID NO: 46034 - DNA, 18 bp, Artificial Sequence
  Synthetic DNA
taaggcgactctcataag

SEQ ID NO: 46035 - DNA, 18 bp, Artificial Sequence
  Synthetic DNA
taataaaaaataatgtag

SEQ ID NO: 46036 - DNA, 18 bp, Artificial Sequence
  Synthetic DNA
taataagtctcccactag

SEQ ID NO: 46037 - DNA, 18 bp, Artificial Sequence
  Synthetic DNA
taataattatcacaaccg

SEQ ID NO: 46038 - DNA, 18 bp, Artificial Sequence
  Synthetic DNA
taatacaactatccatgg

SEQ ID NO: 46039 - DNA, 18 bp, Artificial Sequence
  Synthetic DNA
taatacatctcgctaatg

SEQ ID NO: 46040 - DNA, 18 bp, Artificial Sequence
  Synthetic DNA
taatacatctctcttacg

SEQ ID NO: 46041 - DNA, 18 bp, Artificial Sequence
  Synthetic DNA
taatacctatcacaattg

SEQ ID NO: 46042 - DNA, 18 bp, Artificial Sequence
  Synthetic DNA
taatacgacatgcaaaag

SEQ ID NO: 46043 - DNA, 18 bp, Artificial Sequence
  Synthetic DNA
taatacgagttataagag

SEQ ID NO: 46044 - DNA, 18 bp, Artificial Sequence
  Synthetic DNA
taatacgcaaaactttag

SEQ ID NO: 46045 - DNA, 18 bp, Artificial Sequence
  Synthetic DNA
taatacgcatccagttag

SEQ ID NO: 46046 - DNA, 18 bp, Artificial Sequence
  Synthetic DNA
taatacgccgcgcttttg

SEQ ID NO: 46047 - DNA, 18 bp, Artificial Sequence
  Synthetic DNA
taatacgtaaaactattg

SEQ ID NO: 46048 - DNA, 18 bp, Artificial Sequence
  Synthetic DNA
taatacgtgtcctttaag

SEQ ID NO: 46049 - DNA, 18 bp, Artificial Sequence
  Synthetic DNA
taatactacacaccctcg

SEQ ID NO: 46050 - DNA, 18 bp, Artificial Sequence
  Synthetic DNA
taatactacacgcatctg

SEQ ID NO: 46051 - DNA, 18 bp, Artificial Sequence
  Synthetic DNA
taatacttttcgctttcg

SEQ ID NO: 46052 - DNA, 18 bp, Artificial Sequence
  Synthetic DNA
taatagcactctcaaaag

SEQ ID NO: 46053 - DNA, 18 bp, Artificial Sequence
  Synthetic DNA
taataggactcaaattcg

SEQ ID NO: 46054 - DNA, 18 bp, Artificial Sequence
  Synthetic DNA
taataggggtaaccatag

SEQ ID NO: 46055 - DNA, 18 bp, Artificial Sequence
  Synthetic DNA
taatagtgcccactatcg

SEQ ID NO: 46056 - DNA, 18 bp, Artificial Sequence
  Synthetic DNA
taatatatctcgctaaag

SEQ ID NO: 46057 - DNA, 18 bp, Artificial Sequence
  Synthetic DNA
taatatgtccgagtatag

SEQ ID NO: 46058 - DNA, 18 bp, Artificial Sequence
  Synthetic DNA
taatcccattcattaaag

SEQ ID NO: 46059 - DNA, 18 bp, Artificial Sequence
  Synthetic DNA
taatccggctcccgctcg

SEQ ID NO: 46060 - DNA, 18 bp, Artificial Sequence
  Synthetic DNA
taatccgtgtcactagtg

SEQ ID NO: 46061 - DNA, 18 bp, Artificial Sequence
  Synthetic DNA
taatctcgctcgctatag

SEQ ID NO: 46062 - DNA, 18 bp, Artificial Sequence
  Synthetic DNA
taatgctactctcgttag

SEQ ID NO: 46063 - DNA, 18 bp, Artificial Sequence
  Synthetic DNA
taatgtaattaatattag

SEQ ID NO: 46064 - DNA, 18 bp, Artificial Sequence
  Synthetic DNA
taatgtttctctatatag

SEQ ID NO: 46065 - DNA, 18 bp, Artificial Sequence
  Synthetic DNA
taattagacagtctatag

SEQ ID NO: 46066 - DNA, 18 bp, Artificial Sequence
  Synthetic DNA
taattcgattcatgattg

SEQ ID NO: 46067 - DNA, 18 bp, Artificial Sequence
  Synthetic DNA
taattcgattcgcattag

SEQ ID NO: 46068 - DNA, 18 bp, Artificial Sequence
  Synthetic DNA
taattcgtcacaccattg

SEQ ID NO: 46069 - DNA, 18 bp, Artificial Sequence
  Synthetic DNA
taattcgtccgattacag

SEQ ID NO: 46070 - DNA, 18 bp, Artificial Sequence
  Synthetic DNA
taattcgtctcacaaacg

SEQ ID NO: 46071 - DNA, 18 bp, Artificial Sequence
  Synthetic DNA
taattctaatcgcaatag

SEQ ID NO: 46072 - DNA, 18 bp, Artificial Sequence
  Synthetic DNA
taatttgagtcgcagttg

SEQ ID NO: 46073 - DNA, 18 bp, Artificial Sequence
  Synthetic DNA
taatttgtcatactatcg

SEQ ID NO: 46074 - DNA, 18 bp, Artificial Sequence
  Synthetic DNA
taatttgtttaactatag

SEQ ID NO: 46075 - DNA, 18 bp, Artificial Sequence
  Synthetic DNA
taatttgtttgaccatag

SEQ ID NO: 46076 - DNA, 18 bp, Artificial Sequence
  Synthetic DNA
taccgcttctcacataag

SEQ ID NO: 46077 - DNA, 18 bp, Artificial Sequence
  Synthetic DNA
tacgaggtttcactgttg

SEQ ID NO: 46078 - DNA, 18 bp, Artificial Sequence
  Synthetic DNA
tactaatactcattattg

SEQ ID NO: 46079 - DNA, 18 bp, Artificial Sequence
  Synthetic DNA
tactaggagtaactattg

SEQ ID NO: 46080 - DNA, 18 bp, Artificial Sequence
  Synthetic DNA
tactaggagtcattgtag

SEQ ID NO: 46081 - DNA, 18 bp, Artificial Sequence
  Synthetic DNA
tactatgaatcataatag

SEQ ID NO: 46082 - DNA, 18 bp, Artificial Sequence
  Synthetic DNA
tactattacactctttag

SEQ ID NO: 46083 - DNA, 18 bp, Artificial Sequence
  Synthetic DNA
tactatttctttcaatag

SEQ ID NO: 46084 - DNA, 18 bp, Artificial Sequence
  Synthetic DNA
tacttcacaacactatgg

SEQ ID NO: 46085 - DNA, 18 bp, Artificial Sequence
  Synthetic DNA
tacttctattccctattg

SEQ ID NO: 46086 - DNA, 18 bp, Artificial Sequence
  Synthetic DNA
tagaacaatttataattg

SEQ ID NO: 46087 - DNA, 18 bp, Artificial Sequence
  Synthetic DNA
tagaacgcctcacttatg

SEQ ID NO: 46088 - DNA, 18 bp, Artificial Sequence
  Synthetic DNA
taggctcactcactatag

SEQ ID NO: 46089 - DNA, 18 bp, Artificial Sequence
  Synthetic DNA
tagtacaactttctttag

SEQ ID NO: 46090 - DNA, 18 bp, Artificial Sequence
  Synthetic DNA
tagtacgaataacattag

SEQ ID NO: 46091 - DNA, 18 bp, Artificial Sequence
  Synthetic DNA
tagtacgtcttcttatag

SEQ ID NO: 46092 - DNA, 18 bp, Artificial Sequence
  Synthetic DNA
tagtactactttatatag

SEQ ID NO: 46093 - DNA, 18 bp, Artificial Sequence
  Synthetic DNA
tagtactcgtaactatag

SEQ ID NO: 46094 - DNA, 18 bp, Artificial Sequence
  Synthetic DNA
tagtactgctcattattg

SEQ ID NO: 46095 - DNA, 18 bp, Artificial Sequence
  Synthetic DNA
tagtagcacacgataaag

SEQ ID NO: 46096 - DNA, 18 bp, Artificial Sequence
  Synthetic DNA
tagtccgtctatctattg

SEQ ID NO: 46097 - DNA, 18 bp, Artificial Sequence
  Synthetic DNA
tataaagactcacggtag

SEQ ID NO: 46098 - DNA, 18 bp, Artificial Sequence
  Synthetic DNA
tataacgactcctaatag

SEQ ID NO: 46099 - DNA, 18 bp, Artificial Sequence
  Synthetic DNA
tataacgcatcactaaag

SEQ ID NO: 46100 - DNA, 18 bp, Artificial Sequence
  Synthetic DNA
tataatgactcactcacg

SEQ ID NO: 46101 - DNA, 18 bp, Artificial Sequence
  Synthetic DNA
tatatcgattcaatacag

SEQ ID NO: 46102 - DNA, 18 bp, Artificial Sequence
  Synthetic DNA
tatatcgcctcactttag

SEQ ID NO: 46103 - DNA, 18 bp, Artificial Sequence
  Synthetic DNA
tatcacgacttacagtcg

SEQ ID NO: 46104 - DNA, 18 bp, Artificial Sequence
  Synthetic DNA
tatcacgtttcgttatcg

SEQ ID NO: 46105 - DNA, 18 bp, Artificial Sequence
  Synthetic DNA
tatcagttcatactatag

SEQ ID NO: 46106 - DNA, 18 bp, Artificial Sequence
  Synthetic DNA
tatgactaatcactatcg

SEQ ID NO: 46107 - DNA, 18 bp, Artificial Sequence
  Synthetic DNA
tattaaaattaaccaatg

SEQ ID NO: 46108 - DNA, 18 bp, Artificial Sequence
  Synthetic DNA
tattaatactcaattttg

SEQ ID NO: 46109 - DNA, 18 bp, Artificial Sequence
  Synthetic DNA
tattaccgctctgtatag

SEQ ID NO: 46110 - DNA, 18 bp, Artificial Sequence
  Synthetic DNA
tattaccttactcaacag

SEQ ID NO: 46111 - DNA, 18 bp, Artificial Sequence
  Synthetic DNA
tattacggcttacaccag

SEQ ID NO: 46112 - DNA, 18 bp, Artificial Sequence
  Synthetic DNA
tattacttctcaatccag

SEQ ID NO: 46113 - DNA, 18 bp, Artificial Sequence
  Synthetic DNA
tattacttctctcttttg

SEQ ID NO: 46114 - DNA, 18 bp, Artificial Sequence
  Synthetic DNA
tattagcacttacatttg

SEQ ID NO: 46115 - DNA, 18 bp, Artificial Sequence
  Synthetic DNA
tattatgtcttacaatag

SEQ ID NO: 46116 - DNA, 18 bp, Artificial Sequence
  Synthetic DNA
tatttcgattcactaatg

SEQ ID NO: 46117 - DNA, 18 bp, Artificial Sequence
  Synthetic DNA
tatttgaactcactttag

SEQ ID NO: 46118 - DNA, 18 bp, Artificial Sequence
  Synthetic DNA
tcaaacgacacagtgctg

SEQ ID NO: 46119 - DNA, 18 bp, Artificial Sequence
  Synthetic DNA
tcacaaaactctctattg

SEQ ID NO: 46120 - DNA, 18 bp, Artificial Sequence
  Synthetic DNA
tcacaccactcacaacag

SEQ ID NO: 46121 - DNA, 18 bp, Artificial Sequence
  Synthetic DNA
tcataagactcacactgg

SEQ ID NO: 46122 - DNA, 18 bp, Artificial Sequence
  Synthetic DNA
tcataagtatcactgttg

SEQ ID NO: 46123 - DNA, 18 bp, Artificial Sequence
  Synthetic DNA
tcataccgctcacgctag

SEQ ID NO: 46124 - DNA, 18 bp, Artificial Sequence
  Synthetic DNA
tcatacgtcacgcaatag

SEQ ID NO: 46125 - DNA, 18 bp, Artificial Sequence
  Synthetic DNA
tcatacgtctcccaaaag

SEQ ID NO: 46126 - DNA, 18 bp, Artificial Sequence
  Synthetic DNA
tcatacgtctggagatag

SEQ ID NO: 46127 - DNA, 18 bp, Artificial Sequence
  Synthetic DNA
tcatacttgtctctctag

SEQ ID NO: 46128 - DNA, 18 bp, Artificial Sequence
  Synthetic DNA
tcatatcaaataatatag

SEQ ID NO: 46129 - DNA, 18 bp, Artificial Sequence
  Synthetic DNA
tcatatgacagacactag

SEQ ID NO: 46130 - DNA, 18 bp, Artificial Sequence
  Synthetic DNA
tcatccgactccttttag

SEQ ID NO: 46131 - DNA, 18 bp, Artificial Sequence
  Synthetic DNA
tcattaaattaaatatag

SEQ ID NO: 46132 - DNA, 18 bp, Artificial Sequence
  Synthetic DNA
tcattcaactatctaaag

SEQ ID NO: 46133 - DNA, 18 bp, Artificial Sequence
  Synthetic DNA
tcatttgacacactacag

SEQ ID NO: 46134 - DNA, 18 bp, Artificial Sequence
  Synthetic DNA
tcccactactcacataag

SEQ ID NO: 46135 - DNA, 18 bp, Artificial Sequence
  Synthetic DNA
tcgtatgattcaccagag

SEQ ID NO: 46136 - DNA, 18 bp, Artificial Sequence
  Synthetic DNA
tcttacgactgacctatg

SEQ ID NO: 46137 - DNA, 18 bp, Artificial Sequence
  Synthetic DNA
tcttacgcctcacaaaag

SEQ ID NO: 46138 - DNA, 18 bp, Artificial Sequence
  Synthetic DNA
tcttacggtacactatag

SEQ ID NO: 46139 - DNA, 18 bp, Artificial Sequence
  Synthetic DNA
tgaaccgactcactaatg

SEQ ID NO: 46140 - DNA, 18 bp, Artificial Sequence
  Synthetic DNA
tgatagatgttactatag

SEQ ID NO: 46141 - DNA, 18 bp, Artificial Sequence
  Synthetic DNA
tgatcctgatctatattg

SEQ ID NO: 46142 - DNA, 18 bp, Artificial Sequence
  Synthetic DNA
tggtacaaatcactattg

SEQ ID NO: 46143 - DNA, 18 bp, Artificial Sequence
  Synthetic DNA
tgtcacgtctcactttcg

SEQ ID NO: 46144 - DNA, 18 bp, Artificial Sequence
  Synthetic DNA
tgtgacgcatcactgtag

SEQ ID NO: 46145 - DNA, 18 bp, Artificial Sequence
  Synthetic DNA
tgttatgcctcagtatag

SEQ ID NO: 46146 - DNA, 18 bp, Artificial Sequence
  Synthetic DNA
tgttccgagtcactacag

SEQ ID NO: 46147 - DNA, 18 bp, Artificial Sequence
  Synthetic DNA
tgtttcctctcacttacg

SEQ ID NO: 46148 - DNA, 18 bp, Artificial Sequence
  Synthetic DNA
ttaaacaattgaatatcg

SEQ ID NO: 46149 - DNA, 18 bp, Artificial Sequence
  Synthetic DNA
ttaaacgattcacaattg

SEQ ID NO: 46150 - DNA, 18 bp, Artificial Sequence
  Synthetic DNA
ttacacgactaaatatcg

SEQ ID NO: 46151 - DNA, 18 bp, Artificial Sequence
  Synthetic DNA
ttacactactctatatag

SEQ ID NO: 46152 - DNA, 18 bp, Artificial Sequence
  Synthetic DNA
ttaccatacaccctatag

SEQ ID NO: 46153 - DNA, 18 bp, Artificial Sequence
  Synthetic DNA
ttactcgcctcagtttag

SEQ ID NO: 46154 - DNA, 18 bp, Artificial Sequence
  Synthetic DNA
ttagatgactcacaattg

SEQ ID NO: 46155 - DNA, 18 bp, Artificial Sequence
  Synthetic DNA
ttataagacactctatgg

SEQ ID NO: 46156 - DNA, 18 bp, Artificial Sequence
  Synthetic DNA
ttataaggcaccctattg

SEQ ID NO: 46157 - DNA, 18 bp, Artificial Sequence
  Synthetic DNA
ttatacaactgtctaatg

SEQ ID NO: 46158 - DNA, 18 bp, Artificial Sequence
  Synthetic DNA
ttataccaatcgctttag

SEQ ID NO: 46159 - DNA, 18 bp, Artificial Sequence
  Synthetic DNA
ttataccacccacttttg

SEQ ID NO: 46160 - DNA, 18 bp, Artificial Sequence
  Synthetic DNA
ttataccactgtccatag

SEQ ID NO: 46161 - DNA, 18 bp, Artificial Sequence
  Synthetic DNA
ttatacgacagactcaag

SEQ ID NO: 46162 - DNA, 18 bp, Artificial Sequence
  Synthetic DNA
ttatacgaccctcattag

SEQ ID NO: 46163 - DNA, 18 bp, Artificial Sequence
  Synthetic DNA
ttatacgagtaactatca

SEQ ID NO: 46164 - DNA, 18 bp, Artificial Sequence
  Synthetic DNA
ttatacgttttacttcag

SEQ ID NO: 46165 - DNA, 18 bp, Artificial Sequence
  Synthetic DNA
ttataggtctcaatattg

SEQ ID NO: 46166 - DNA, 18 bp, Artificial Sequence
  Synthetic DNA
ttataggtctttctaaag

SEQ ID NO: 46167 - DNA, 18 bp, Artificial Sequence
  Synthetic DNA
ttatataactcattatcg

SEQ ID NO: 46168 - DNA, 18 bp, Artificial Sequence
  Synthetic DNA
ttatatggcttacaatag

SEQ ID NO: 46169 - DNA, 18 bp, Artificial Sequence
  Synthetic DNA
ttatccaactatctatag

SEQ ID NO: 46170 - DNA, 18 bp, Artificial Sequence
  Synthetic DNA
ttatccgaattactagag

SEQ ID NO: 46171 - DNA, 18 bp, Artificial Sequence
  Synthetic DNA
ttatccgattcactcaag

SEQ ID NO: 46172 - DNA, 18 bp, Artificial Sequence
  Synthetic DNA
ttatccgtctttctatag

SEQ ID NO: 46173 - DNA, 18 bp, Artificial Sequence
  Synthetic DNA
ttatgcgacttgctaaag

SEQ ID NO: 46174 - DNA, 18 bp, Artificial Sequence
  Synthetic DNA
ttatgcgatacaccatag

SEQ ID NO: 46175 - DNA, 18 bp, Artificial Sequence
  Synthetic DNA
ttatgcgcctcagaatag

SEQ ID NO: 46176 - DNA, 18 bp, Artificial Sequence
  Synthetic DNA
ttatgtgacacactaaag

SEQ ID NO: 46177 - DNA, 18 bp, Artificial Sequence
  Synthetic DNA
ttattcaagtcacaattg

SEQ ID NO: 46178 - DNA, 18 bp, Artificial Sequence
  Synthetic DNA
ttattcccgacactgtag

SEQ ID NO: 46179 - DNA, 18 bp, Artificial Sequence
  Synthetic DNA
ttattcgcactattatag

SEQ ID NO: 46180 - DNA, 18 bp, Artificial Sequence
  Synthetic DNA
ttattcgtctcgatatag

SEQ ID NO: 46181 - DNA, 18 bp, Artificial Sequence
  Synthetic DNA
ttattctactttctaaag

SEQ ID NO: 46182 - DNA, 18 bp, Artificial Sequence
  Synthetic DNA
ttattggactctttttag

SEQ ID NO: 46183 - DNA, 18 bp, Artificial Sequence
  Synthetic DNA
ttatttgagttacaatag

SEQ ID NO: 46184 - DNA, 18 bp, Artificial Sequence
  Synthetic DNA
ttcaatgactcactttag

SEQ ID NO: 46185 - DNA, 18 bp, Artificial Sequence
  Synthetic DNA
ttcatcgtctcacaatag

SEQ ID NO: 46186 - DNA, 18 bp, Artificial Sequence
  Synthetic DNA
ttcatcgtttctttaaag

SEQ ID NO: 46187 - DNA, 18 bp, Artificial Sequence
  Synthetic DNA
ttctaagagccactatag

SEQ ID NO: 46188 - DNA, 18 bp, Artificial Sequence
  Synthetic DNA
ttcttcgcatcgctgttg

SEQ ID NO: 46189 - DNA, 18 bp, Artificial Sequence
  Synthetic DNA
ttgcacgcctctccattg

SEQ ID NO: 46190 - DNA, 18 bp, Artificial Sequence
  Synthetic DNA
ttgtacatcatagtatag

SEQ ID NO: 46191 - DNA, 18 bp, Artificial Sequence
  Synthetic DNA
ttgtacggctcaatttag

SEQ ID NO: 46192 - DNA, 18 bp, Artificial Sequence
  Synthetic DNA
ttgtacgtcttaccaaag

SEQ ID NO: 46193 - DNA, 18 bp, Artificial Sequence
  Synthetic DNA
ttgtactattcactattg

SEQ ID NO: 46194 - DNA, 18 bp, Artificial Sequence
  Synthetic DNA
tttaacgagacactattg

SEQ ID NO: 46195 - DNA, 18 bp, Artificial Sequence
  Synthetic DNA
tttagcgactcacaagag

SEQ ID NO: 46196 - DNA, 18 bp, Artificial Sequence
  Synthetic DNA
ttttaagaaacacttttg

SEQ ID NO: 46197 - DNA, 18 bp, Artificial Sequence
  Synthetic DNA
ttttaagggttaccaatg

SEQ ID NO: 46198 - DNA, 18 bp, Artificial Sequence
  Synthetic DNA
ttttacctcacactctag

SEQ ID NO: 46199 - DNA, 18 bp, Artificial Sequence
  Synthetic DNA
ttttacgactcacacttg

SEQ ID NO: 46200 - DNA, 18 bp, Artificial Sequence
  Synthetic DNA
ttttacgagtcacataag

SEQ ID NO: 46201 - DNA, 18 bp, Artificial Sequence
  Synthetic DNA
ttttactattcagtatag

SEQ ID NO: 46202 - DNA, 18 bp, Artificial Sequence
  Synthetic DNA
cttttcgactcactttag

SEQ ID NO: 46203 - DNA, 18 bp, Artificial Sequence
  Synthetic DNA
aatttagactcactacag

SEQ ID NO: 46204 - DNA, 18 bp, Artificial Sequence
  Synthetic DNA
atattagactcaccatag

SEQ ID NO: 46205 - DNA, 18 bp, Artificial Sequence
  Synthetic DNA
atgtccgaatcactctag

SEQ ID NO: 46206 - DNA, 18 bp, Artificial Sequence
  Synthetic DNA
aaaaacggctctctaaag

SEQ ID NO: 46207 - DNA, 18 bp, Artificial Sequence
  Synthetic DNA
aaattcgactcgccattg

SEQ ID NO: 46208 - DNA, 18 bp, Artificial Sequence
  Synthetic DNA
aaattctactcagaattg

SEQ ID NO: 46209 - DNA, 18 bp, Artificial Sequence
  Synthetic DNA
atataagacacactccgg

SEQ ID NO: 46210 - DNA, 18 bp, Artificial Sequence
  Synthetic DNA
caaatcgactctctaaag

SEQ ID NO: 46211 - DNA, 18 bp, Artificial Sequence
  Synthetic DNA
cattccgattccctattg

SEQ ID NO: 46212 - DNA, 18 bp, Artificial Sequence
  Synthetic DNA
ctattcgactcgctattg

SEQ ID NO: 46213 - DNA, 18 bp, Artificial Sequence
  Synthetic DNA
gaatactaatagcttatg

SEQ ID NO: 46214 - DNA, 18 bp, Artificial Sequence
  Synthetic DNA
gttctcgactcgctattg

SEQ ID NO: 46215 - DNA, 18 bp, Artificial Sequence
  Synthetic DNA
taaagagagtcaaagctg

SEQ ID NO: 46216 - DNA, 18 bp, Artificial Sequence
  Synthetic DNA
taaattgactctctgcag

SEQ ID NO: 46217 - DNA, 18 bp, Artificial Sequence
  Synthetic DNA
taactcatttctctttcg

SEQ ID NO: 46218 - DNA, 18 bp, Artificial Sequence
  Synthetic DNA
taatgcgacagtccagag

SEQ ID NO: 46219 - DNA, 18 bp, Artificial Sequence
  Synthetic DNA
taattcgtgtatctaagg

SEQ ID NO: 46220 - DNA, 18 bp, Artificial Sequence
  Synthetic DNA
tacaatgacaatctttag

SEQ ID NO: 46221 - DNA, 18 bp, Artificial Sequence
  Synthetic DNA
tagtcctaagcactatag

SEQ ID NO: 46222 - DNA, 18 bp, Artificial Sequence
  Synthetic DNA
tataacgactcccttgag

SEQ ID NO: 46223 - DNA, 18 bp, Artificial Sequence
  Synthetic DNA
tatagcgactcttgatag

SEQ ID NO: 46224 - DNA, 18 bp, Artificial Sequence
  Synthetic DNA
tatcaaggctcaccatag

SEQ ID NO: 46225 - DNA, 18 bp, Artificial Sequence
  Synthetic DNA
tattaagacaatctatag

SEQ ID NO: 46226 - DNA, 18 bp, Artificial Sequence
  Synthetic DNA
tattatgtcatacatcag

SEQ ID NO: 46227 - DNA, 18 bp, Artificial Sequence
  Synthetic DNA
tcttacgcctcgctttcg

SEQ ID NO: 46228 - DNA, 18 bp, Artificial Sequence
  Synthetic DNA
ttattcgtcacaccatag

SEQ ID NO: 46229 - DNA, 18 bp, Artificial Sequence
  Synthetic DNA
ttctacgaatctctattg

SEQ ID NO: 46230 - DNA, 18 bp, Artificial Sequence
  Synthetic DNA
tttagcgactcactttag

SEQ ID NO: 46231 - DNA, 18 bp, Artificial Sequence
  Synthetic DNA
tttttcgattcacaatag

SEQ ID NO: 46232 - DNA, 18 bp, Artificial Sequence
  Synthetic DNA
ataagcgactcactaaag

SEQ ID NO: 46233 - DNA, 18 bp, Artificial Sequence
  Synthetic DNA
taatactactctcaaatg

SEQ ID NO: 46234 - DNA, 18 bp, Artificial Sequence
  Synthetic DNA
taatttgactatctttag

SEQ ID NO: 46235 - DNA, 18 bp, Artificial Sequence
  Synthetic DNA
ttgtacaactcgctatcg

SEQ ID NO: 46236 - DNA, 18 bp, Artificial Sequence
  Synthetic DNA
tatttaaactcactaaag

SEQ ID NO: 46237 - DNA, 18 bp, Artificial Sequence
  Synthetic DNA
caataatactcattaatg

SEQ ID NO: 46238 - DNA, 18 bp, Artificial Sequence
  Synthetic DNA
aacatcttatcactttcg

SEQ ID NO: 46239 - DNA, 18 bp, Artificial Sequence
  Synthetic DNA
aattatctctcaatatag

SEQ ID NO: 46240 - DNA, 18 bp, Artificial Sequence
  Synthetic DNA
acaaacgtcttaatgaag

SEQ ID NO: 46241 - DNA, 18 bp, Artificial Sequence
  Synthetic DNA
atatacgaattattatag

SEQ ID NO: 46242 - DNA, 18 bp, Artificial Sequence
  Synthetic DNA
atatacgattcaataaag

SEQ ID NO: 46243 - DNA, 18 bp, Artificial Sequence
  Synthetic DNA
caaaaagtcatactaaag

SEQ ID NO: 46244 - DNA, 18 bp, Artificial Sequence
  Synthetic DNA
taaaacgattcagattag

SEQ ID NO: 46245 - DNA, 18 bp, Artificial Sequence
  Synthetic DNA
taataagtctaattattg

SEQ ID NO: 46246 - DNA, 18 bp, Artificial Sequence
  Synthetic DNA
taatacatctcatttttg

SEQ ID NO: 46247 - DNA, 18 bp, Artificial Sequence
  Synthetic DNA
taattgcactcacctttg

SEQ ID NO: 46248 - DNA, 18 bp, Artificial Sequence
  Synthetic DNA
tacatggactcaaggttg

SEQ ID NO: 46249 - DNA, 18 bp, Artificial Sequence
  Synthetic DNA
tattacgtctcactgatg

SEQ ID NO: 46250 - DNA, 18 bp, Artificial Sequence
  Synthetic DNA
tattgttacacactatag

SEQ ID NO: 46251 - DNA, 18 bp, Artificial Sequence
  Synthetic DNA
tcttataacttactatag

SEQ ID NO: 46252 - DNA, 18 bp, Artificial Sequence
  Synthetic DNA
tctttcatctcaatatag

SEQ ID NO: 46253 - DNA, 18 bp, Artificial Sequence
  Synthetic DNA
ttacacgagatactatag

SEQ ID NO: 46254 - DNA, 18 bp, Artificial Sequence
  Synthetic DNA
ttataccattctcaaaag

SEQ ID NO: 46255 - DNA, 18 bp, Artificial Sequence
  Synthetic DNA
ttatacttctcaataatg

SEQ ID NO: 46256 - DNA, 18 bp, Artificial Sequence
  Synthetic DNA
ttatgtgactcagtctgg

SEQ ID NO: 46257 - DNA, 18 bp, Artificial Sequence
  Synthetic DNA
tttaaaaagtcactatag

SEQ ID NO: 46258 - DNA, 18 bp, Artificial Sequence
  Synthetic DNA
ttttgcaacacactattg

SEQ ID NO: 46259 - DNA, 18 bp, Artificial Sequence
  Synthetic DNA
aaaaacgacataatatag

SEQ ID NO: 46260 - DNA, 18 bp, Artificial Sequence
  Synthetic DNA
aaaatacactcattttag

SEQ ID NO: 46261 - DNA, 18 bp, Artificial Sequence
  Synthetic DNA
aaacacgtttcgctattg

SEQ ID NO: 46262 - DNA, 18 bp, Artificial Sequence
  Synthetic DNA
aaatacgaatccctttcg

SEQ ID NO: 46263 - DNA, 18 bp, Artificial Sequence
  Synthetic DNA
aaatacgtcacacttttg

SEQ ID NO: 46264 - DNA, 18 bp, Artificial Sequence
  Synthetic DNA
aaatgcgaaaaactttag

SEQ ID NO: 46265 - DNA, 18 bp, Artificial Sequence
  Synthetic DNA
aaattcaactcataatag

SEQ ID NO: 46266 - DNA, 18 bp, Artificial Sequence
  Synthetic DNA
aaattcgacactgaaaag

SEQ ID NO: 46267 - DNA, 18 bp, Artificial Sequence
  Synthetic DNA
aaattctattcactacag

SEQ ID NO: 46268 - DNA, 18 bp, Artificial Sequence
  Synthetic DNA
aaatttgcatcattattg

SEQ ID NO: 46269 - DNA, 18 bp, Artificial Sequence
  Synthetic DNA
aaatttgttacacttaag

SEQ ID NO: 46270 - DNA, 18 bp, Artificial Sequence
  Synthetic DNA
aacaaagactttctattg

SEQ ID NO: 46271 - DNA, 18 bp, Artificial Sequence
  Synthetic DNA
aacgacgacacgtttaag

SEQ ID NO: 46272 - DNA, 18 bp, Artificial Sequence
  Synthetic DNA
aactaagactcactgaag

SEQ ID NO: 46273 - DNA, 18 bp, Artificial Sequence
  Synthetic DNA
aactacaactccctgtag

SEQ ID NO: 46274 - DNA, 18 bp, Artificial Sequence
  Synthetic DNA
aagggtgtcttacatttg

SEQ ID NO: 46275 - DNA, 18 bp, Artificial Sequence
  Synthetic DNA
aagtacgtcgcacgatag

SEQ ID NO: 46276 - DNA, 18 bp, Artificial Sequence
  Synthetic DNA
aataccgagtccctatag

SEQ ID NO: 46277 - DNA, 18 bp, Artificial Sequence
  Synthetic DNA
aattaatactcagtttag

SEQ ID NO: 46278 - DNA, 18 bp, Artificial Sequence
  Synthetic DNA
aattaccactatctgttg

SEQ ID NO: 46279 - DNA, 18 bp, Artificial Sequence
  Synthetic DNA
aatttcagctcaatattg

SEQ ID NO: 46280 - DNA, 18 bp, Artificial Sequence
  Synthetic DNA
aatttcgacacaccatag

SEQ ID NO: 46281 - DNA, 18 bp, Artificial Sequence
  Synthetic DNA
aattttgtcccactatag

SEQ ID NO: 46282 - DNA, 18 bp, Artificial Sequence
  Synthetic DNA
acattccactctctatag

SEQ ID NO: 46283 - DNA, 18 bp, Artificial Sequence
  Synthetic DNA
acgtatgacactctaaag

SEQ ID NO: 46284 - DNA, 18 bp, Artificial Sequence
  Synthetic DNA
acttacttctaactccag

SEQ ID NO: 46285 - DNA, 18 bp, Artificial Sequence
  Synthetic DNA
acttttgagtcagttttg

SEQ ID NO: 46286 - DNA, 18 bp, Artificial Sequence
  Synthetic DNA
ataaacgacttactccag

SEQ ID NO: 46287 - DNA, 18 bp, Artificial Sequence
  Synthetic DNA
atatacgaatcgctaaag

SEQ ID NO: 46288 - DNA, 18 bp, Artificial Sequence
  Synthetic DNA
atatacgattcaccttag

SEQ ID NO: 46289 - DNA, 18 bp, Artificial Sequence
  Synthetic DNA
atataggactcacagtag

SEQ ID NO: 46290 - DNA, 18 bp, Artificial Sequence
  Synthetic DNA
atatatgtctctataaag

SEQ ID NO: 46291 - DNA, 18 bp, Artificial Sequence
  Synthetic DNA
atattcgacccactattg

SEQ ID NO: 46292 - DNA, 18 bp, Artificial Sequence
  Synthetic DNA
atcaacggttcgatatag

SEQ ID NO: 46293 - DNA, 18 bp, Artificial Sequence
  Synthetic DNA
atgtatgactcgttctag

SEQ ID NO: 46294 - DNA, 18 bp, Artificial Sequence
  Synthetic DNA
atttactaatcatttttg

SEQ ID NO: 46295 - DNA, 18 bp, Artificial Sequence
  Synthetic DNA
caaaacaaaacactatag

SEQ ID NO: 46296 - DNA, 18 bp, Artificial Sequence
  Synthetic DNA
caaaccggctcaccatag

SEQ ID NO: 46297 - DNA, 18 bp, Artificial Sequence
  Synthetic DNA
caacacgattcacactag

SEQ ID NO: 46298 - DNA, 18 bp, Artificial Sequence
  Synthetic DNA
caacaggtttcacttatg

SEQ ID NO: 46299 - DNA, 18 bp, Artificial Sequence
  Synthetic DNA
caactcgactcacattag

SEQ ID NO: 46300 - DNA, 18 bp, Artificial Sequence
  Synthetic DNA
caatacaacgcaccattg

SEQ ID NO: 46301 - DNA, 18 bp, Artificial Sequence
  Synthetic DNA
caatacaattcacaattg

SEQ ID NO: 46302 - DNA, 18 bp, Artificial Sequence
  Synthetic DNA
caatacgacaccgataag

SEQ ID NO: 46303 - DNA, 18 bp, Artificial Sequence
  Synthetic DNA
caatactattctctgtag

SEQ ID NO: 46304 - DNA, 18 bp, Artificial Sequence
  Synthetic DNA
caatgcaacacactaaag

SEQ ID NO: 46305 - DNA, 18 bp, Artificial Sequence
  Synthetic DNA
caatgcaactctttttag

SEQ ID NO: 46306 - DNA, 18 bp, Artificial Sequence
  Synthetic DNA
caattcgcctcacattag

SEQ ID NO: 46307 - DNA, 18 bp, Artificial Sequence
  Synthetic DNA
cagtacgtcttacaatag

SEQ ID NO: 46308 - DNA, 18 bp, Artificial Sequence
  Synthetic DNA
cattacgacgcaatatgg

SEQ ID NO: 46309 - DNA, 18 bp, Artificial Sequence
  Synthetic DNA
ctatactcctcaatattg

SEQ ID NO: 46310 - DNA, 18 bp, Artificial Sequence
  Synthetic DNA
ctatgcgacttacaatag

SEQ ID NO: 46311 - DNA, 18 bp, Artificial Sequence
  Synthetic DNA
ctctacgcctcaatatgg

SEQ ID NO: 46312 - DNA, 18 bp, Artificial Sequence
  Synthetic DNA
ctgtaggactcgctatag

SEQ ID NO: 46313 - DNA, 18 bp, Artificial Sequence
  Synthetic DNA
ctttaccacttagtatag

SEQ ID NO: 46314 - DNA, 18 bp, Artificial Sequence
  Synthetic DNA
gaacacatctcacattag

SEQ ID NO: 46315 - DNA, 18 bp, Artificial Sequence
  Synthetic DNA
gaataggactcagtagtg

SEQ ID NO: 46316 - DNA, 18 bp, Artificial Sequence
  Synthetic DNA
gaatccatctcactagag

SEQ ID NO: 46317 - DNA, 18 bp, Artificial Sequence
  Synthetic DNA
gataactactcacctaag

SEQ ID NO: 46318 - DNA, 18 bp, Artificial Sequence
  Synthetic DNA
gtaaacgactatctatag

SEQ ID NO: 46319 - DNA, 18 bp, Artificial Sequence
  Synthetic DNA
gtattcgactgtgtatag

SEQ ID NO: 46320 - DNA, 18 bp, Artificial Sequence
  Synthetic DNA
taaaaagtcggactacag

SEQ ID NO: 46321 - DNA, 18 bp, Artificial Sequence
  Synthetic DNA
taaaacaaatcattattg

SEQ ID NO: 46322 - DNA, 18 bp, Artificial Sequence
  Synthetic DNA
taaaacatgacactatcg

SEQ ID NO: 46323 - DNA, 18 bp, Artificial Sequence
  Synthetic DNA
taaaaccacccactaatg

SEQ ID NO: 46324 - DNA, 18 bp, Artificial Sequence
  Synthetic DNA
taaaacgattctcaaatg

SEQ ID NO: 46325 - DNA, 18 bp, Artificial Sequence
  Synthetic DNA
taaaactaatgattttag

SEQ ID NO: 46326 - DNA, 18 bp, Artificial Sequence
  Synthetic DNA
taaaactactccctttgg

SEQ ID NO: 46327 - DNA, 18 bp, Artificial Sequence
  Synthetic DNA
taaaactattctcactag

SEQ ID NO: 46328 - DNA, 18 bp, Artificial Sequence
  Synthetic DNA
taaaagcatagattattg

SEQ ID NO: 46329 - DNA, 18 bp, Artificial Sequence
  Synthetic DNA
taaaaggattctctttag

SEQ ID NO: 46330 - DNA, 18 bp, Artificial Sequence
  Synthetic DNA
taaaattattcactatgg

SEQ ID NO: 46331 - DNA, 18 bp, Artificial Sequence
  Synthetic DNA
taaaccgacccacggtag

SEQ ID NO: 46332 - DNA, 18 bp, Artificial Sequence
  Synthetic DNA
taaaccgtgtcactatgg

SEQ ID NO: 46333 - DNA, 18 bp, Artificial Sequence
  Synthetic DNA
taaacctactccccaaag

SEQ ID NO: 46334 - DNA, 18 bp, Artificial Sequence
  Synthetic DNA
taaagcaactccctattg

SEQ ID NO: 46335 - DNA, 18 bp, Artificial Sequence
  Synthetic DNA
taaagcgaatcccaatgg

SEQ ID NO: 46336 - DNA, 18 bp, Artificial Sequence
  Synthetic DNA
taaagcgagtaaacctag

SEQ ID NO: 46337 - DNA, 18 bp, Artificial Sequence
  Synthetic DNA
taaagggactcgccatag

SEQ ID NO: 46338 - DNA, 18 bp, Artificial Sequence
  Synthetic DNA
taaatcgactaacaactg

SEQ ID NO: 46339 - DNA, 18 bp, Artificial Sequence
  Synthetic DNA
taaatggactcactgacg

SEQ ID NO: 46340 - DNA, 18 bp, Artificial Sequence
  Synthetic DNA
taacaagactcccgattg

SEQ ID NO: 46341 - DNA, 18 bp, Artificial Sequence
  Synthetic DNA
taacaagcatcacaatag

SEQ ID NO: 46342 - DNA, 18 bp, Artificial Sequence
  Synthetic DNA
taacacacatcacttttg

SEQ ID NO: 46343 - DNA, 18 bp, Artificial Sequence
  Synthetic DNA
taacacaccccacttttg

SEQ ID NO: 46344 - DNA, 18 bp, Artificial Sequence
  Synthetic DNA
taacacgatacccaatag

SEQ ID NO: 46345 - DNA, 18 bp, Artificial Sequence
  Synthetic DNA
taacatacattctatttg

SEQ ID NO: 46346 - DNA, 18 bp, Artificial Sequence
  Synthetic DNA
taacgcgacttcctaaag

SEQ ID NO: 46347 - DNA, 18 bp, Artificial Sequence
  Synthetic DNA
taagactactttctttag

SEQ ID NO: 46348 - DNA, 18 bp, Artificial Sequence
  Synthetic DNA
taataaatctcatcatag

SEQ ID NO: 46349 - DNA, 18 bp, Artificial Sequence
  Synthetic DNA
taataagattctcaatcg

SEQ ID NO: 46350 - DNA, 18 bp, Artificial Sequence
  Synthetic DNA
taataagtatcaccgcag

SEQ ID NO: 46351 - DNA, 18 bp, Artificial Sequence
  Synthetic DNA
taatacaactccataacg

SEQ ID NO: 46352 - DNA, 18 bp, Artificial Sequence
  Synthetic DNA
taatacaatactcactcg

SEQ ID NO: 46353 - DNA, 18 bp, Artificial Sequence
  Synthetic DNA
taatacactttgctatag

SEQ ID NO: 46354 - DNA, 18 bp, Artificial Sequence
  Synthetic DNA
taatacagcacattaaag

SEQ ID NO: 46355 - DNA, 18 bp, Artificial Sequence
  Synthetic DNA
taatacatcgctatattg

SEQ ID NO: 46356 - DNA, 18 bp, Artificial Sequence
  Synthetic DNA
taataccactgcttaaag

SEQ ID NO: 46357 - DNA, 18 bp, Artificial Sequence
  Synthetic DNA
taatacctgtgtctctag

SEQ ID NO: 46358 - DNA, 18 bp, Artificial Sequence
  Synthetic DNA
taatacgaatttttaaag

SEQ ID NO: 46359 - DNA, 18 bp, Artificial Sequence
  Synthetic DNA
taatacgacttccataag

SEQ ID NO: 46360 - DNA, 18 bp, Artificial Sequence
  Synthetic DNA
taatacgccaccattgag

SEQ ID NO: 46361 - DNA, 18 bp, Artificial Sequence
  Synthetic DNA
taatacgcctcattcatg

SEQ ID NO: 46362 - DNA, 18 bp, Artificial Sequence
  Synthetic DNA
taatacgcctttcttaag

SEQ ID NO: 46363 - DNA, 18 bp, Artificial Sequence
  Synthetic DNA
taatacgcttcagttaag

SEQ ID NO: 46364 - DNA, 18 bp, Artificial Sequence
  Synthetic DNA
taatacgcttgagacttg

SEQ ID NO: 46365 - DNA, 18 bp, Artificial Sequence
  Synthetic DNA
taatacggctctattcag

SEQ ID NO: 46366 - DNA, 18 bp, Artificial Sequence
  Synthetic DNA
taatacggctgtatatgg

SEQ ID NO: 46367 - DNA, 18 bp, Artificial Sequence
  Synthetic DNA
taatacgtttaaatttag

SEQ ID NO: 46368 - DNA, 18 bp, Artificial Sequence
  Synthetic DNA
taatactacactttttag

SEQ ID NO: 46369 - DNA, 18 bp, Artificial Sequence
  Synthetic DNA
taatactactcagttatg

SEQ ID NO: 46370 - DNA, 18 bp, Artificial Sequence
  Synthetic DNA
taatactattctctttcg

SEQ ID NO: 46371 - DNA, 18 bp, Artificial Sequence
  Synthetic DNA
taatacttttcttcatag

SEQ ID NO: 46372 - DNA, 18 bp, Artificial Sequence
  Synthetic DNA
taatatgactctgtttgg

SEQ ID NO: 46373 - DNA, 18 bp, Artificial Sequence
  Synthetic DNA
taatatgagactctattg

SEQ ID NO: 46374 - DNA, 18 bp, Artificial Sequence
  Synthetic DNA
taatccgaaacaatttag

SEQ ID NO: 46375 - DNA, 18 bp, Artificial Sequence
  Synthetic DNA
taatccgaccgacttgag

SEQ ID NO: 46376 - DNA, 18 bp, Artificial Sequence
  Synthetic DNA
taatccgccccggtgtag

SEQ ID NO: 46377 - DNA, 18 bp, Artificial Sequence
  Synthetic DNA
taatccgtcacattctag

SEQ ID NO: 46378 - DNA, 18 bp, Artificial Sequence
  Synthetic DNA
taatctgactcatcaatg

SEQ ID NO: 46379 - DNA, 18 bp, Artificial Sequence
  Synthetic DNA
taatctgtgtctctgaag

SEQ ID NO: 46380 - DNA, 18 bp, Artificial Sequence
  Synthetic DNA
taatgcgtctcacctatg

SEQ ID NO: 46381 - DNA, 18 bp, Artificial Sequence
  Synthetic DNA
taatgctactcaattcag

SEQ ID NO: 46382 - DNA, 18 bp, Artificial Sequence
  Synthetic DNA
taattaatctcacaatag

SEQ ID NO: 46383 - DNA, 18 bp, Artificial Sequence
  Synthetic DNA
taattagattctccattg

SEQ ID NO: 46384 - DNA, 18 bp, Artificial Sequence
  Synthetic DNA
taattagtcacacttttg

SEQ ID NO: 46385 - DNA, 18 bp, Artificial Sequence
  Synthetic DNA
taattatactcagaatag

SEQ ID NO: 46386 - DNA, 18 bp, Artificial Sequence
  Synthetic DNA
taattatattcagtatag

SEQ ID NO: 46387 - DNA, 18 bp, Artificial Sequence
  Synthetic DNA
taattcaactaattttag

SEQ ID NO: 46388 - DNA, 18 bp, Artificial Sequence
  Synthetic DNA
taattcaactcacacaag

SEQ ID NO: 46389 - DNA, 18 bp, Artificial Sequence
  Synthetic DNA
taattcaactgtattgag

SEQ ID NO: 46390 - DNA, 18 bp, Artificial Sequence
  Synthetic DNA
taattccactcacctaag

SEQ ID NO: 46391 - DNA, 18 bp, Artificial Sequence
  Synthetic DNA
taattcgattaacttgag

SEQ ID NO: 46392 - DNA, 18 bp, Artificial Sequence
  Synthetic DNA
taattcgattctcctcag

SEQ ID NO: 46393 - DNA, 18 bp, Artificial Sequence
  Synthetic DNA
taattcgccttattaaag

SEQ ID NO: 46394 - DNA, 18 bp, Artificial Sequence
  Synthetic DNA
taattcggcactcttttg

SEQ ID NO: 46395 - DNA, 18 bp, Artificial Sequence
  Synthetic DNA
taattcgtctatctagag

SEQ ID NO: 46396 - DNA, 18 bp, Artificial Sequence
  Synthetic DNA
taattctacgctcaatag

SEQ ID NO: 46397 - DNA, 18 bp, Artificial Sequence
  Synthetic DNA
taattcttctcactttcg

SEQ ID NO: 46398 - DNA, 18 bp, Artificial Sequence
  Synthetic DNA
taattggtcttgctgtag

SEQ ID NO: 46399 - DNA, 18 bp, Artificial Sequence
  Synthetic DNA
taatttcgcgcacgaacg

SEQ ID NO: 46400 - DNA, 18 bp, Artificial Sequence
  Synthetic DNA
tacaacgactcaaaattg

SEQ ID NO: 46401 - DNA, 18 bp, Artificial Sequence
  Synthetic DNA
tacaacttcacaatatag

SEQ ID NO: 46402 - DNA, 18 bp, Artificial Sequence
  Synthetic DNA
tacatcgactcactgaag

SEQ ID NO: 46403 - DNA, 18 bp, Artificial Sequence
  Synthetic DNA
taccacgatacaatatag

SEQ ID NO: 46404 - DNA, 18 bp, Artificial Sequence
  Synthetic DNA
tactaagacacattaaag

SEQ ID NO: 46405 - DNA, 18 bp, Artificial Sequence
  Synthetic DNA
tactacaagcggctagag

SEQ ID NO: 46406 - DNA, 18 bp, Artificial Sequence
  Synthetic DNA
tactacgacaccttattg

SEQ ID NO: 46407 - DNA, 18 bp, Artificial Sequence
  Synthetic DNA
tactacgaccatttatag

SEQ ID NO: 46408 - DNA, 18 bp, Artificial Sequence
  Synthetic DNA
tactacgcatctctttag

SEQ ID NO: 46409 - DNA, 18 bp, Artificial Sequence
  Synthetic DNA
tactgcaactcagttttg

SEQ ID NO: 46410 - DNA, 18 bp, Artificial Sequence
  Synthetic DNA
tacttcaactcataatag

SEQ ID NO: 46411 - DNA, 18 bp, Artificial Sequence
  Synthetic DNA
tagtaagaaacagtatcg

SEQ ID NO: 46412 - DNA, 18 bp, Artificial Sequence
  Synthetic DNA
tagtacgattctctaatg

SEQ ID NO: 46413 - DNA, 18 bp, Artificial Sequence
  Synthetic DNA
tagtacgtctaaccaaag

SEQ ID NO: 46414 - DNA, 18 bp, Artificial Sequence
  Synthetic DNA
tagtacgtctcacatttg

SEQ ID NO: 46415 - DNA, 18 bp, Artificial Sequence
  Synthetic DNA
tagtacttctgactattg

SEQ ID NO: 46416 - DNA, 18 bp, Artificial Sequence
  Synthetic DNA
tagtataactgtctatcg

SEQ ID NO: 46417 - DNA, 18 bp, Artificial Sequence
  Synthetic DNA
tagtgcgacttacttcag

SEQ ID NO: 46418 - DNA, 18 bp, Artificial Sequence
  Synthetic DNA
tataacgactcaatccag

SEQ ID NO: 46419 - DNA, 18 bp, Artificial Sequence
  Synthetic DNA
tataacgtctcactaatg

SEQ ID NO: 46420 - DNA, 18 bp, Artificial Sequence
  Synthetic DNA
tatatctcattacttaag

SEQ ID NO: 46421 - DNA, 18 bp, Artificial Sequence
  Synthetic DNA
tatcacctctcactattg

SEQ ID NO: 46422 - DNA, 18 bp, Artificial Sequence
  Synthetic DNA
tatcacgaccgactacag

SEQ ID NO: 46423 - DNA, 18 bp, Artificial Sequence
  Synthetic DNA
tatcatagctaactatgg

SEQ ID NO: 46424 - DNA, 18 bp, Artificial Sequence
  Synthetic DNA
tatcatgattcactatgg

SEQ ID NO: 46425 - DNA, 18 bp, Artificial Sequence
  Synthetic DNA
tatgtcgtcttactgtag

SEQ ID NO: 46426 - DNA, 18 bp, Artificial Sequence
  Synthetic DNA
tattaagtctcatcatag

SEQ ID NO: 46427 - DNA, 18 bp, Artificial Sequence
  Synthetic DNA
tattacgaaggactaatg

SEQ ID NO: 46428 - DNA, 18 bp, Artificial Sequence
  Synthetic DNA
tattacgactcccgtaag

SEQ ID NO: 46429 - DNA, 18 bp, Artificial Sequence
  Synthetic DNA
tattacgcttctctactg

SEQ ID NO: 46430 - DNA, 18 bp, Artificial Sequence
  Synthetic DNA
tattactttttactacag

SEQ ID NO: 46431 - DNA, 18 bp, Artificial Sequence
  Synthetic DNA
tattatgactctcatttg

SEQ ID NO: 46432 - DNA, 18 bp, Artificial Sequence
  Synthetic DNA
tattatgactttctattg

SEQ ID NO: 46433 - DNA, 18 bp, Artificial Sequence
  Synthetic DNA
tattatgattcgatgtag

SEQ ID NO: 46434 - DNA, 18 bp, Artificial Sequence
  Synthetic DNA
tattccgtatcacttcag

SEQ ID NO: 46435 - DNA, 18 bp, Artificial Sequence
  Synthetic DNA
tattgcgaggcactgaag

SEQ ID NO: 46436 - DNA, 18 bp, Artificial Sequence
  Synthetic DNA
tattgcgagtttctatag

SEQ ID NO: 46437 - DNA, 18 bp, Artificial Sequence
  Synthetic DNA
tattgcgcctaacttaag

SEQ ID NO: 46438 - DNA, 18 bp, Artificial Sequence
  Synthetic DNA
tatttccactcacttttg

SEQ ID NO: 46439 - DNA, 18 bp, Artificial Sequence
  Synthetic DNA
tatttcctccctcaaaag

SEQ ID NO: 46440 - DNA, 18 bp, Artificial Sequence
  Synthetic DNA
tatttcgacattcaagtg

SEQ ID NO: 46441 - DNA, 18 bp, Artificial Sequence
  Synthetic DNA
tatttcgatatacaatag

SEQ ID NO: 46442 - DNA, 18 bp, Artificial Sequence
  Synthetic DNA
tatttcgattcccattag

SEQ ID NO: 46443 - DNA, 18 bp, Artificial Sequence
  Synthetic DNA
tatttcgattttctatag

SEQ ID NO: 46444 - DNA, 18 bp, Artificial Sequence
  Synthetic DNA
tatttggactttcaatag

SEQ ID NO: 46445 - DNA, 18 bp, Artificial Sequence
  Synthetic DNA
tcaaacgtcttacactag

SEQ ID NO: 46446 - DNA, 18 bp, Artificial Sequence
  Synthetic DNA
tcacaccactcacactag

SEQ ID NO: 46447 - DNA, 18 bp, Artificial Sequence
  Synthetic DNA
tcacacgtctaacagtag

SEQ ID NO: 46448 - DNA, 18 bp, Artificial Sequence
  Synthetic DNA
tcatacgacattcaatgg

SEQ ID NO: 46449 - DNA, 18 bp, Artificial Sequence
  Synthetic DNA
tcataggactctcttcag

SEQ ID NO: 46450 - DNA, 18 bp, Artificial Sequence
  Synthetic DNA
tcatatgaaacgttacag

SEQ ID NO: 46451 - DNA, 18 bp, Artificial Sequence
  Synthetic DNA
tcattcggctcattattg

SEQ ID NO: 46452 - DNA, 18 bp, Artificial Sequence
  Synthetic DNA
tcgtacgacccggtctag

SEQ ID NO: 46453 - DNA, 18 bp, Artificial Sequence
  Synthetic DNA
tcgttcgtctccccgtcg

SEQ ID NO: 46454 - DNA, 18 bp, Artificial Sequence
  Synthetic DNA
tctaacgactatctatag

SEQ ID NO: 46455 - DNA, 18 bp, Artificial Sequence
  Synthetic DNA
tgaaacatgtcgctaatg

SEQ ID NO: 46456 - DNA, 18 bp, Artificial Sequence
  Synthetic DNA
tgaaaccacagtctatag

SEQ ID NO: 46457 - DNA, 18 bp, Artificial Sequence
  Synthetic DNA
tgaatcgactcatagttg

SEQ ID NO: 46458 - DNA, 18 bp, Artificial Sequence
  Synthetic DNA
tgacacaccccaatatag

SEQ ID NO: 46459 - DNA, 18 bp, Artificial Sequence
  Synthetic DNA
tgacacgacttattattg

SEQ ID NO: 46460 - DNA, 18 bp, Artificial Sequence
  Synthetic DNA
tgataagtgtaactaatg

SEQ ID NO: 46461 - DNA, 18 bp, Artificial Sequence
  Synthetic DNA
tgatacgactttgttcag

SEQ ID NO: 46462 - DNA, 18 bp, Artificial Sequence
  Synthetic DNA
tgatacgtcttacgttgg

SEQ ID NO: 46463 - DNA, 18 bp, Artificial Sequence
  Synthetic DNA
tgatactaacctcttttg

SEQ ID NO: 46464 - DNA, 18 bp, Artificial Sequence
  Synthetic DNA
tgatatcacttactaaag

SEQ ID NO: 46465 - DNA, 18 bp, Artificial Sequence
  Synthetic DNA
tgatccgaatgtctatag

SEQ ID NO: 46466 - DNA, 18 bp, Artificial Sequence
  Synthetic DNA
tgatctctctcactatag

SEQ ID NO: 46467 - DNA, 18 bp, Artificial Sequence
  Synthetic DNA
tgttaggcctcgatatag

SEQ ID NO: 46468 - DNA, 18 bp, Artificial Sequence
  Synthetic DNA
ttaaaagtctcactgaag

SEQ ID NO: 46469 - DNA, 18 bp, Artificial Sequence
  Synthetic DNA
ttaaacctttgcctatag

SEQ ID NO: 46470 - DNA, 18 bp, Artificial Sequence
  Synthetic DNA
ttaaacgactcacataag

SEQ ID NO: 46471 - DNA, 18 bp, Artificial Sequence
  Synthetic DNA
ttaaattactcactattg

SEQ ID NO: 46472 - DNA, 18 bp, Artificial Sequence
  Synthetic DNA
ttacacatttcataattg

SEQ ID NO: 46473 - DNA, 18 bp, Artificial Sequence
  Synthetic DNA
ttacacggctctcaaaag

SEQ ID NO: 46474 - DNA, 18 bp, Artificial Sequence
  Synthetic DNA
ttacactacttactaaag

SEQ ID NO: 46475 - DNA, 18 bp, Artificial Sequence
  Synthetic DNA
ttacataactcactaaag

SEQ ID NO: 46476 - DNA, 18 bp, Artificial Sequence
  Synthetic DNA
ttactccactttctattg

SEQ ID NO: 46477 - DNA, 18 bp, Artificial Sequence
  Synthetic DNA
ttagacaaatcactttag

SEQ ID NO: 46478 - DNA, 18 bp, Artificial Sequence
  Synthetic DNA
ttataaaacagattgtag

SEQ ID NO: 46479 - DNA, 18 bp, Artificial Sequence
  Synthetic DNA
ttataaaactcgatttag

SEQ ID NO: 46480 - DNA, 18 bp, Artificial Sequence
  Synthetic DNA
ttataaacttgtgtacct

SEQ ID NO: 46481 - DNA, 18 bp, Artificial Sequence
  Synthetic DNA
ttataagtcacggtatag

SEQ ID NO: 46482 - DNA, 18 bp, Artificial Sequence
  Synthetic DNA
ttataagtctccctaaag

SEQ ID NO: 46483 - DNA, 18 bp, Artificial Sequence
  Synthetic DNA
ttatacaactcaatgcag

SEQ ID NO: 46484 - DNA, 18 bp, Artificial Sequence
  Synthetic DNA
ttatacaactgacttttg

SEQ ID NO: 46485 - DNA, 18 bp, Artificial Sequence
  Synthetic DNA
ttatacagctcactaccg

SEQ ID NO: 46486 - DNA, 18 bp, Artificial Sequence
  Synthetic DNA
ttatacatctttcaatag

SEQ ID NO: 46487 - DNA, 18 bp, Artificial Sequence
  Synthetic DNA
ttatacctatcattatag

SEQ ID NO: 46488 - DNA, 18 bp, Artificial Sequence
  Synthetic DNA
ttatacgatactcaagag

SEQ ID NO: 46489 - DNA, 18 bp, Artificial Sequence
  Synthetic DNA
ttatacgtctctgtattg

SEQ ID NO: 46490 - DNA, 18 bp, Artificial Sequence
  Synthetic DNA
ttatacgtctctttttag

SEQ ID NO: 46491 - DNA, 18 bp, Artificial Sequence
  Synthetic DNA
ttatacgtgtcaatttag

SEQ ID NO: 46492 - DNA, 18 bp, Artificial Sequence
  Synthetic DNA
ttatactactctcaattg

SEQ ID NO: 46493 - DNA, 18 bp, Artificial Sequence
  Synthetic DNA
ttatatgcctcataatag

SEQ ID NO: 46494 - DNA, 18 bp, Artificial Sequence
  Synthetic DNA
ttatgcgacatacaaaag

SEQ ID NO: 46495 - DNA, 18 bp, Artificial Sequence
  Synthetic DNA
ttatgcgaccctctattg

SEQ ID NO: 46496 - DNA, 18 bp, Artificial Sequence
  Synthetic DNA
ttattagacaccccacag

SEQ ID NO: 46497 - DNA, 18 bp, Artificial Sequence
  Synthetic DNA
ttattcgattctttttag

SEQ ID NO: 46498 - DNA, 18 bp, Artificial Sequence
  Synthetic DNA
ttatttggctcccaatag

SEQ ID NO: 46499 - DNA, 18 bp, Artificial Sequence
  Synthetic DNA
ttctacgactgtatatag

SEQ ID NO: 46500 - DNA, 18 bp, Artificial Sequence
  Synthetic DNA
ttctgcgaaccacttaag

SEQ ID NO: 46501 - DNA, 18 bp, Artificial Sequence
  Synthetic DNA
ttgtcagattcacgatag

SEQ ID NO: 46502 - DNA, 18 bp, Artificial Sequence
  Synthetic DNA
ttgtccgattctctatag

SEQ ID NO: 46503 - DNA, 18 bp, Artificial Sequence
  Synthetic DNA
ttgtgctattcacaatag

SEQ ID NO: 46504 - DNA, 18 bp, Artificial Sequence
  Synthetic DNA
tttaaagattctctttag

SEQ ID NO: 46505 - DNA, 18 bp, Artificial Sequence
  Synthetic DNA
tttaaagtctctctacag

SEQ ID NO: 46506 - DNA, 18 bp, Artificial Sequence
  Synthetic DNA
tttaatgactgactatag

SEQ ID NO: 46507 - DNA, 18 bp, Artificial Sequence
  Synthetic DNA
ttttacgactgaattttg

SEQ ID NO: 46508 - DNA, 18 bp, Artificial Sequence
  Synthetic DNA
ttttacgattcacttcag

SEQ ID NO: 46509 - DNA, 18 bp, Artificial Sequence
  Synthetic DNA
ttttacggttcgctatag

SEQ ID NO: 46510 - DNA, 18 bp, Artificial Sequence
  Synthetic DNA
ttttacgtcctacgattg

SEQ ID NO: 46511 - DNA, 18 bp, Artificial Sequence
  Synthetic DNA
ttttactactgattccag

SEQ ID NO: 46512 - DNA, 18 bp, Artificial Sequence
  Synthetic DNA
ttttacttctcacattgg

SEQ ID NO: 46513 - DNA, 18 bp, Artificial Sequence
  Synthetic DNA
ttttacttgacactctag

SEQ ID NO: 46514 - DNA, 18 bp, Artificial Sequence
  Synthetic DNA
ttttccgagcaactatag

SEQ ID NO: 46515 - DNA, 18 bp, Artificial Sequence
  Synthetic DNA
tttttagagtcacgatag

SEQ ID NO: 46516 - DNA, 18 bp, Artificial Sequence
  Synthetic DNA
aaaaaacactcacaatag

SEQ ID NO: 46517 - DNA, 18 bp, Artificial Sequence
  Synthetic DNA
aaaaaatacttcctttag

SEQ ID NO: 46518 - DNA, 18 bp, Artificial Sequence
  Synthetic DNA
aaaaacgacaaaatatag

SEQ ID NO: 46519 - DNA, 18 bp, Artificial Sequence
  Synthetic DNA
aaaaacgactccgtctcg

SEQ ID NO: 46520 - DNA, 18 bp, Artificial Sequence
  Synthetic DNA
aaaaacgactctcttttg

SEQ ID NO: 46521 - DNA, 18 bp, Artificial Sequence
  Synthetic DNA
aaaaacgacttgctatcg

SEQ ID NO: 46522 - DNA, 18 bp, Artificial Sequence
  Synthetic DNA
aaaaacgatccagtacag

SEQ ID NO: 46523 - DNA, 18 bp, Artificial Sequence
  Synthetic DNA
aaaaacgatccattctag

SEQ ID NO: 46524 - DNA, 18 bp, Artificial Sequence
  Synthetic DNA
aaaaacggctcgttttag

SEQ ID NO: 46525 - DNA, 18 bp, Artificial Sequence
  Synthetic DNA
aaaaacgggttacaatag

SEQ ID NO: 46526 - DNA, 18 bp, Artificial Sequence
  Synthetic DNA
aaaaacgtcactgtaaag

SEQ ID NO: 46527 - DNA, 18 bp, Artificial Sequence
  Synthetic DNA
aaaaacgtctttctctcg

SEQ ID NO: 46528 - DNA, 18 bp, Artificial Sequence
  Synthetic DNA
aaaaactactaactatcg

SEQ ID NO: 46529 - DNA, 18 bp, Artificial Sequence
  Synthetic DNA
aaaaactatagatcatag

SEQ ID NO: 46530 - DNA, 18 bp, Artificial Sequence
  Synthetic DNA
aaaaactctttactaaag

SEQ ID NO: 46531 - DNA, 18 bp, Artificial Sequence
  Synthetic DNA
aaaaacttccctcaatag

SEQ ID NO: 46532 - DNA, 18 bp, Artificial Sequence
  Synthetic DNA
aaaaaggagtaacaaaag

SEQ ID NO: 46533 - DNA, 18 bp, Artificial Sequence
  Synthetic DNA
aaaaaggattaactattg

SEQ ID NO: 46534 - DNA, 18 bp, Artificial Sequence
  Synthetic DNA
aaaaatcacatataatgg

SEQ ID NO: 46535 - DNA, 18 bp, Artificial Sequence
  Synthetic DNA
aaaaatgaatcactcaag

SEQ ID NO: 46536 - DNA, 18 bp, Artificial Sequence
  Synthetic DNA
aaaaatgtctctcgttag

SEQ ID NO: 46537 - DNA, 18 bp, Artificial Sequence
  Synthetic DNA
aaaacagtccaactatag

SEQ ID NO: 46538 - DNA, 18 bp, Artificial Sequence
  Synthetic DNA
aaaaccgacacaatatag

SEQ ID NO: 46539 - DNA, 18 bp, Artificial Sequence
  Synthetic DNA
aaaaccgcctctcttttg

SEQ ID NO: 46540 - DNA, 18 bp, Artificial Sequence
  Synthetic DNA
aaaacctgctcacagaag

SEQ ID NO: 46541 - DNA, 18 bp, Artificial Sequence
  Synthetic DNA
aaaacctttacactatag

SEQ ID NO: 46542 - DNA, 18 bp, Artificial Sequence
  Synthetic DNA
aaaagggactcacaattg

SEQ ID NO: 46543 - DNA, 18 bp, Artificial Sequence
  Synthetic DNA
aaaagtgaatcattatag

SEQ ID NO: 46544 - DNA, 18 bp, Artificial Sequence
  Synthetic DNA
aaaagtgactcagcattg

SEQ ID NO: 46545 - DNA, 18 bp, Artificial Sequence
  Synthetic DNA
aaaatagattcactcttg

SEQ ID NO: 46546 - DNA, 18 bp, Artificial Sequence
  Synthetic DNA
aaaatatacttactagag

SEQ ID NO: 46547 - DNA, 18 bp, Artificial Sequence
  Synthetic DNA
aaaatccaatctttatgg

SEQ ID NO: 46548 - DNA, 18 bp, Artificial Sequence
  Synthetic DNA
aaaatcgacatactacag

SEQ ID NO: 46549 - DNA, 18 bp, Artificial Sequence
  Synthetic DNA
aaaatcgactcacaagag

SEQ ID NO: 46550 - DNA, 18 bp, Artificial Sequence
  Synthetic DNA
aaaatcgactgactaatg

SEQ ID NO: 46551 - DNA, 18 bp, Artificial Sequence
  Synthetic DNA
aaaatcgtatcactacag

SEQ ID NO: 46552 - DNA, 18 bp, Artificial Sequence
  Synthetic DNA
aaacaacactcactattg

SEQ ID NO: 46553 - DNA, 18 bp, Artificial Sequence
  Synthetic DNA
aaacaagaatctctatag

SEQ ID NO: 46554 - DNA, 18 bp, Artificial Sequence
  Synthetic DNA
aaacaatacaaataaaag

SEQ ID NO: 46555 - DNA, 18 bp, Artificial Sequence
  Synthetic DNA
aaacaccaatcaagaaag

SEQ ID NO: 46556 - DNA, 18 bp, Artificial Sequence
  Synthetic DNA
aaacaccacatactaaag

SEQ ID NO: 46557 - DNA, 18 bp, Artificial Sequence
  Synthetic DNA
aaacaccactcatcattg

SEQ ID NO: 46558 - DNA, 18 bp, Artificial Sequence
  Synthetic DNA
aaacaccagttcctatag

SEQ ID NO: 46559 - DNA, 18 bp, Artificial Sequence
  Synthetic DNA
aaacacgacactttatag

SEQ ID NO: 46560 - DNA, 18 bp, Artificial Sequence
  Synthetic DNA
aaacacgacccgttatag

SEQ ID NO: 46561 - DNA, 18 bp, Artificial Sequence
  Synthetic DNA
aaacacgacttacattag

SEQ ID NO: 46562 - DNA, 18 bp, Artificial Sequence
  Synthetic DNA
aaacacgagtagttatag

SEQ ID NO: 46563 - DNA, 18 bp, Artificial Sequence
  Synthetic DNA
aaacacgatttgctatag

SEQ ID NO: 46564 - DNA, 18 bp, Artificial Sequence
  Synthetic DNA
aaacaggacttactattg

SEQ ID NO: 46565 - DNA, 18 bp, Artificial Sequence
  Synthetic DNA
aaacaggatacacaatgg

SEQ ID NO: 46566 - DNA, 18 bp, Artificial Sequence
  Synthetic DNA
aaaccatatacccaaaag

SEQ ID NO: 46567 - DNA, 18 bp, Artificial Sequence
  Synthetic DNA
aaacccgacacaatttag

SEQ ID NO: 46568 - DNA, 18 bp, Artificial Sequence
  Synthetic DNA
aaacgctactgactttag

SEQ ID NO: 46569 - DNA, 18 bp, Artificial Sequence
  Synthetic DNA
aaactcgactcataatgg

SEQ ID NO: 46570 - DNA, 18 bp, Artificial Sequence
  Synthetic DNA
aaactcgactctcaatag

SEQ ID NO: 46571 - DNA, 18 bp, Artificial Sequence
  Synthetic DNA
aaactggacttaatttag

SEQ ID NO: 46572 - DNA, 18 bp, Artificial Sequence
  Synthetic DNA
aaagaccacccatagtag

SEQ ID NO: 46573 - DNA, 18 bp, Artificial Sequence
  Synthetic DNA
aaagacctttcacaatag

SEQ ID NO: 46574 - DNA, 18 bp, Artificial Sequence
  Synthetic DNA
aaagacgactatctaaag

SEQ ID NO: 46575 - DNA, 18 bp, Artificial Sequence
  Synthetic DNA
aaagacgttacacgatag

SEQ ID NO: 46576 - DNA, 18 bp, Artificial Sequence
  Synthetic DNA
aaagatgattcaatacag

SEQ ID NO: 46577 - DNA, 18 bp, Artificial Sequence
  Synthetic DNA
aaagatgattcactacag

SEQ ID NO: 46578 - DNA, 18 bp, Artificial Sequence
  Synthetic DNA
aaagattactgacaatag

SEQ ID NO: 46579 - DNA, 18 bp, Artificial Sequence
  Synthetic DNA
aaagccgactcaattttg

SEQ ID NO: 46580 - DNA, 18 bp, Artificial Sequence
  Synthetic DNA
aaagtctactcacgatag

SEQ ID NO: 46581 - DNA, 18 bp, Artificial Sequence
  Synthetic DNA
aaataaaactctttatag

SEQ ID NO: 46582 - DNA, 18 bp, Artificial Sequence
  Synthetic DNA
aaataacacttacaatag

SEQ ID NO: 46583 - DNA, 18 bp, Artificial Sequence
  Synthetic DNA
aaataacagtcaaattag

SEQ ID NO: 46584 - DNA, 18 bp, Artificial Sequence
  Synthetic DNA
aaataacagttactaaag

SEQ ID NO: 46585 - DNA, 18 bp, Artificial Sequence
  Synthetic DNA
aaataactatcacaatgg

SEQ ID NO: 46586 - DNA, 18 bp, Artificial Sequence
  Synthetic DNA
aaataagacacattattg

SEQ ID NO: 46587 - DNA, 18 bp, Artificial Sequence
  Synthetic DNA
aaataagacatactattg

SEQ ID NO: 46588 - DNA, 18 bp, Artificial Sequence
  Synthetic DNA
aaataagactaatattag

SEQ ID NO: 46589 - DNA, 18 bp, Artificial Sequence
  Synthetic DNA
aaataagactcacattcg

SEQ ID NO: 46590 - DNA, 18 bp, Artificial Sequence
  Synthetic DNA
aaataagactctcatcag

SEQ ID NO: 46591 - DNA, 18 bp, Artificial Sequence
  Synthetic DNA
aaataagcatcactacgg

SEQ ID NO: 46592 - DNA, 18 bp, Artificial Sequence
  Synthetic DNA
aaataagccacagtatag

SEQ ID NO: 46593 - DNA, 18 bp, Artificial Sequence
  Synthetic DNA
aaataagccttactattg

SEQ ID NO: 46594 - DNA, 18 bp, Artificial Sequence
  Synthetic DNA
aaataaggcccactttag

SEQ ID NO: 46595 - DNA, 18 bp, Artificial Sequence
  Synthetic DNA
aaataagtcactccatag

SEQ ID NO: 46596 - DNA, 18 bp, Artificial Sequence
  Synthetic DNA
aaataatacttattatag

SEQ ID NO: 46597 - DNA, 18 bp, Artificial Sequence
  Synthetic DNA
aaataatgttcaatatag

SEQ ID NO: 46598 - DNA, 18 bp, Artificial Sequence
  Synthetic DNA
aaataattctcacaatcg

SEQ ID NO: 46599 - DNA, 18 bp, Artificial Sequence
  Synthetic DNA
aaataattgtcaccatag

SEQ ID NO: 46600 - DNA, 18 bp, Artificial Sequence
  Synthetic DNA
aaatacaaaactcaaacg

SEQ ID NO: 46601 - DNA, 18 bp, Artificial Sequence
  Synthetic DNA
aaatacaaatcaccttag

SEQ ID NO: 46602 - DNA, 18 bp, Artificial Sequence
  Synthetic DNA
aaatacaaatcacgaaag

SEQ ID NO: 46603 - DNA, 18 bp, Artificial Sequence
  Synthetic DNA
aaatacaacactctaaag

SEQ ID NO: 46604 - DNA, 18 bp, Artificial Sequence
  Synthetic DNA
aaatacaacactgtatag

SEQ ID NO: 46605 - DNA, 18 bp, Artificial Sequence
  Synthetic DNA
aaatacaagtcattaaag

SEQ ID NO: 46606 - DNA, 18 bp, Artificial Sequence
  Synthetic DNA
aaatacaatcccctatag

SEQ ID NO: 46607 - DNA, 18 bp, Artificial Sequence
  Synthetic DNA
aaatacaattcaggatag

SEQ ID NO: 46608 - DNA, 18 bp, Artificial Sequence
  Synthetic DNA
aaatacaattgatttgag

SEQ ID NO: 46609 - DNA, 18 bp, Artificial Sequence
  Synthetic DNA
aaatacacttcattttag

SEQ ID NO: 46610 - DNA, 18 bp, Artificial Sequence
  Synthetic DNA
aaatacatatcattatcg

SEQ ID NO: 46611 - DNA, 18 bp, Artificial Sequence
  Synthetic DNA
aaatacatcttgctaaag

SEQ ID NO: 46612 - DNA, 18 bp, Artificial Sequence
  Synthetic DNA
aaataccaaccactatcg

SEQ ID NO: 46613 - DNA, 18 bp, Artificial Sequence
  Synthetic DNA
aaataccaagcacaattg

SEQ ID NO: 46614 - DNA, 18 bp, Artificial Sequence
  Synthetic DNA
aaataccacacagtttag

SEQ ID NO: 46615 - DNA, 18 bp, Artificial Sequence
  Synthetic DNA
aaataccacagtatatgg

SEQ ID NO: 46616 - DNA, 18 bp, Artificial Sequence
  Synthetic DNA
aaataccactcacttatg

SEQ ID NO: 46617 - DNA, 18 bp, Artificial Sequence
  Synthetic DNA
aaataccactctccttag

SEQ ID NO: 46618 - DNA, 18 bp, Artificial Sequence
  Synthetic DNA
aaatacccctcacctttg

SEQ ID NO: 46619 - DNA, 18 bp, Artificial Sequence
  Synthetic DNA
aaatacctctaactaaag

SEQ ID NO: 46620 - DNA, 18 bp, Artificial Sequence
  Synthetic DNA
aaataccttatactatag

SEQ ID NO: 46621 - DNA, 18 bp, Artificial Sequence
  Synthetic DNA
aaatacgaaaagatatcg

SEQ ID NO: 46622 - DNA, 18 bp, Artificial Sequence
  Synthetic DNA
aaatacgaaatactttag

SEQ ID NO: 46623 - DNA, 18 bp, Artificial Sequence
  Synthetic DNA
aaatacgaaccactgaag

SEQ ID NO: 46624 - DNA, 18 bp, Artificial Sequence
  Synthetic DNA
aaatacgaataaagatag

SEQ ID NO: 46625 - DNA, 18 bp, Artificial Sequence
  Synthetic DNA
aaatacgaattaaataag

SEQ ID NO: 46626 - DNA, 18 bp, Artificial Sequence
  Synthetic DNA
aaatacgacaaacgtaag

SEQ ID NO: 46627 - DNA, 18 bp, Artificial Sequence
  Synthetic DNA
aaatacgacaggctatcg

SEQ ID NO: 46628 - DNA, 18 bp, Artificial Sequence
  Synthetic DNA
aaatacgaccgtctctag

SEQ ID NO: 46629 - DNA, 18 bp, Artificial Sequence
  Synthetic DNA
aaatacgactcctctcag

SEQ ID NO: 46630 - DNA, 18 bp, Artificial Sequence
  Synthetic DNA
aaatacgactcgtttaag

SEQ ID NO: 46631 - DNA, 18 bp, Artificial Sequence
  Synthetic DNA
aaatacgacttgcattag

SEQ ID NO: 46632 - DNA, 18 bp, Artificial Sequence
  Synthetic DNA
aaatacgagtctaaatag

SEQ ID NO: 46633 - DNA, 18 bp, Artificial Sequence
  Synthetic DNA
aaatacgatacacttaag

SEQ ID NO: 46634 - DNA, 18 bp, Artificial Sequence
  Synthetic DNA
aaatacgatcaaatctag

SEQ ID NO: 46635 - DNA, 18 bp, Artificial Sequence
  Synthetic DNA
aaatacgatttacaaagg

SEQ ID NO: 46636 - DNA, 18 bp, Artificial Sequence
  Synthetic DNA
aaatacgatttactcgcg

SEQ ID NO: 46637 - DNA, 18 bp, Artificial Sequence
  Synthetic DNA
aaatacgcctacttatag

SEQ ID NO: 46638 - DNA, 18 bp, Artificial Sequence
  Synthetic DNA
aaatacgcctcacagaag

SEQ ID NO: 46639 - DNA, 18 bp, Artificial Sequence
  Synthetic DNA
aaatacgcctcatagtag

SEQ ID NO: 46640 - DNA, 18 bp, Artificial Sequence
  Synthetic DNA
aaatacggatcacaacag

SEQ ID NO: 46641 - DNA, 18 bp, Artificial Sequence
  Synthetic DNA
aaatacggctcaattttg

SEQ ID NO: 46642 - DNA, 18 bp, Artificial Sequence
  Synthetic DNA
aaatacgtcacactaacg

SEQ ID NO: 46643 - DNA, 18 bp, Artificial Sequence
  Synthetic DNA
aaatacgtcataagacgg

SEQ ID NO: 46644 - DNA, 18 bp, Artificial Sequence
  Synthetic DNA
aaatacgttacacttcag

SEQ ID NO: 46645 - DNA, 18 bp, Artificial Sequence
  Synthetic DNA
aaatacgtttcaacatag

SEQ ID NO: 46646 - DNA, 18 bp, Artificial Sequence
  Synthetic DNA
aaatactacactcttaag

SEQ ID NO: 46647 - DNA, 18 bp, Artificial Sequence
  Synthetic DNA
aaatactactcaaactag

SEQ ID NO: 46648 - DNA, 18 bp, Artificial Sequence
  Synthetic DNA
aaatactactctgcatag

SEQ ID NO: 46649 - DNA, 18 bp, Artificial Sequence
  Synthetic DNA
aaatactacttaatacag

SEQ ID NO: 46650 - DNA, 18 bp, Artificial Sequence
  Synthetic DNA
aaatactagtcatttcag

SEQ ID NO: 46651 - DNA, 18 bp, Artificial Sequence
  Synthetic DNA
aaatactattggaaatag

SEQ ID NO: 46652 - DNA, 18 bp, Artificial Sequence
  Synthetic DNA
aaatactcctctttgtcg

SEQ ID NO: 46653 - DNA, 18 bp, Artificial Sequence
  Synthetic DNA
aaatacttctacctatag

SEQ ID NO: 46654 - DNA, 18 bp, Artificial Sequence
  Synthetic DNA
aaatacttctcaggtaag

SEQ ID NO: 46655 - DNA, 18 bp, Artificial Sequence
  Synthetic DNA
aaatacttcttgctatag

SEQ ID NO: 46656 - DNA, 18 bp, Artificial Sequence
  Synthetic DNA
aaatagcacgcacttcag

SEQ ID NO: 46657 - DNA, 18 bp, Artificial Sequence
  Synthetic DNA
aaataggactcaattaag

SEQ ID NO: 46658 - DNA, 18 bp, Artificial Sequence
  Synthetic DNA
aaataggacttacaattg

SEQ ID NO: 46659 - DNA, 18 bp, Artificial Sequence
  Synthetic DNA
aaataggattcacattgg

SEQ ID NO: 46660 - DNA, 18 bp, Artificial Sequence
  Synthetic DNA
aaataggcctcacttatg

SEQ ID NO: 46661 - DNA, 18 bp, Artificial Sequence
  Synthetic DNA
aaataggctttactattg

SEQ ID NO: 46662 - DNA, 18 bp, Artificial Sequence
  Synthetic DNA
aaatagggttcacaatag

SEQ ID NO: 46663 - DNA, 18 bp, Artificial Sequence
  Synthetic DNA
aaataggtatctcaatag

SEQ ID NO: 46664 - DNA, 18 bp, Artificial Sequence
  Synthetic DNA
aaataggtcacaatacag

SEQ ID NO: 46665 - DNA, 18 bp, Artificial Sequence
  Synthetic DNA
aaataggtctctagttag

SEQ ID NO: 46666 - DNA, 18 bp, Artificial Sequence
  Synthetic DNA
aaatatactacactattg

SEQ ID NO: 46667 - DNA, 18 bp, Artificial Sequence
  Synthetic DNA
aaatatatctctccatag

SEQ ID NO: 46668 - DNA, 18 bp, Artificial Sequence
  Synthetic DNA
aaatatatctgacaatag

SEQ ID NO: 46669 - DNA, 18 bp, Artificial Sequence
  Synthetic DNA
aaatatgaatcacaaatg

SEQ ID NO: 46670 - DNA, 18 bp, Artificial Sequence
  Synthetic DNA
aaatatgaatttctatag

SEQ ID NO: 46671 - DNA, 18 bp, Artificial Sequence
  Synthetic DNA
aaatatgacacacttgtg

SEQ ID NO: 46672 - DNA, 18 bp, Artificial Sequence
  Synthetic DNA
aaatatgactgtctattg

SEQ ID NO: 46673 - DNA, 18 bp, Artificial Sequence
  Synthetic DNA
aaatatgccccacgatgg

SEQ ID NO: 46674 - DNA, 18 bp, Artificial Sequence
  Synthetic DNA
aaatatgtctcaaatttg

SEQ ID NO: 46675 - DNA, 18 bp, Artificial Sequence
  Synthetic DNA
aaatatgtctttctattg

SEQ ID NO: 46676 - DNA, 18 bp, Artificial Sequence
  Synthetic DNA
aaatatttcacgctgtag

SEQ ID NO: 46677 - DNA, 18 bp, Artificial Sequence
  Synthetic DNA
aaatcagacttactttag

SEQ ID NO: 46678 - DNA, 18 bp, Artificial Sequence
  Synthetic DNA
aaatccaacacactttag

SEQ ID NO: 46679 - DNA, 18 bp, Artificial Sequence
  Synthetic DNA
aaatccgacagactactg

SEQ ID NO: 46680 - DNA, 18 bp, Artificial Sequence
  Synthetic DNA
aaatccgacatccaaaag

SEQ ID NO: 46681 - DNA, 18 bp, Artificial Sequence
  Synthetic DNA
aaatccgactaaatcaag

SEQ ID NO: 46682 - DNA, 18 bp, Artificial Sequence
  Synthetic DNA
aaatccgactcattctgg

SEQ ID NO: 46683 - DNA, 18 bp, Artificial Sequence
  Synthetic DNA
aaatccgagtcgctctag

SEQ ID NO: 46684 - DNA, 18 bp, Artificial Sequence
  Synthetic DNA
aaatccgcagcagtttag

SEQ ID NO: 46685 - DNA, 18 bp, Artificial Sequence
  Synthetic DNA
aaatcctactcactaatg

SEQ ID NO: 46686 - DNA, 18 bp, Artificial Sequence
  Synthetic DNA
aaatctttctcagtttag

SEQ ID NO: 46687 - DNA, 18 bp, Artificial Sequence
  Synthetic DNA
aaatgagacacgatttag

SEQ ID NO: 46688 - DNA, 18 bp, Artificial Sequence
  Synthetic DNA
aaatgagtctctcaatag

SEQ ID NO: 46689 - DNA, 18 bp, Artificial Sequence
  Synthetic DNA
aaatgcgactcgcatttg

SEQ ID NO: 46690 - DNA, 18 bp, Artificial Sequence
  Synthetic DNA
aaatgcgattcattttag

SEQ ID NO: 46691 - DNA, 18 bp, Artificial Sequence
  Synthetic DNA
aaatgcgattctgttaag

SEQ ID NO: 46692 - DNA, 18 bp, Artificial Sequence
  Synthetic DNA
aaatgcggctcactcatg

SEQ ID NO: 46693 - DNA, 18 bp, Artificial Sequence
  Synthetic DNA
aaatgcgtgtcattatag

SEQ ID NO: 46694 - DNA, 18 bp, Artificial Sequence
  Synthetic DNA
aaatggtacacactatag

SEQ ID NO: 46695 - DNA, 18 bp, Artificial Sequence
  Synthetic DNA
aaatgttaatcactatag

SEQ ID NO: 46696 - DNA, 18 bp, Artificial Sequence
  Synthetic DNA
aaattaaattcacttttg

SEQ ID NO: 46697 - DNA, 18 bp, Artificial Sequence
  Synthetic DNA
aaattagacactcttaag

SEQ ID NO: 46698 - DNA, 18 bp, Artificial Sequence
  Synthetic DNA
aaattagcctaaatacag

SEQ ID NO: 46699 - DNA, 18 bp, Artificial Sequence
  Synthetic DNA
aaattagtcctaatatag

SEQ ID NO: 46700 - DNA, 18 bp, Artificial Sequence
  Synthetic DNA
aaattagtctcaaaatag

SEQ ID NO: 46701 - DNA, 18 bp, Artificial Sequence
  Synthetic DNA
aaattagtctgacgatag

SEQ ID NO: 46702 - DNA, 18 bp, Artificial Sequence
  Synthetic DNA
aaattatactttcaattg

SEQ ID NO: 46703 - DNA, 18 bp, Artificial Sequence
  Synthetic DNA
aaattattctcactctag

SEQ ID NO: 46704 - DNA, 18 bp, Artificial Sequence
  Synthetic DNA
aaattcaacactccatag

SEQ ID NO: 46705 - DNA, 18 bp, Artificial Sequence
  Synthetic DNA
aaattcaattaactatag

SEQ ID NO: 46706 - DNA, 18 bp, Artificial Sequence
  Synthetic DNA
aaattcatctcggcattg

SEQ ID NO: 46707 - DNA, 18 bp, Artificial Sequence
  Synthetic DNA
aaattccactcccattag

SEQ ID NO: 46708 - DNA, 18 bp, Artificial Sequence
  Synthetic DNA
aaattcgacaaaatagcg

SEQ ID NO: 46709 - DNA, 18 bp, Artificial Sequence
  Synthetic DNA
aaattcgacacaattaag

SEQ ID NO: 46710 - DNA, 18 bp, Artificial Sequence
  Synthetic DNA
aaattcgacacattaaag

SEQ ID NO: 46711 - DNA, 18 bp, Artificial Sequence
  Synthetic DNA
aaattcgacgcgaaatag

SEQ ID NO: 46712 - DNA, 18 bp, Artificial Sequence
  Synthetic DNA
aaattcgacgctctgtag

SEQ ID NO: 46713 - DNA, 18 bp, Artificial Sequence
  Synthetic DNA
aaattcgactcagaagtg

SEQ ID NO: 46714 - DNA, 18 bp, Artificial Sequence
  Synthetic DNA
aaattcgactcggtaaag

SEQ ID NO: 46715 - DNA, 18 bp, Artificial Sequence
  Synthetic DNA
aaattcgactctctaacg

SEQ ID NO: 46716 - DNA, 18 bp, Artificial Sequence
  Synthetic DNA
aaattcgactgtctatcg

SEQ ID NO: 46717 - DNA, 18 bp, Artificial Sequence
  Synthetic DNA
aaattcgactttccaaag

SEQ ID NO: 46718 - DNA, 18 bp, Artificial Sequence
  Synthetic DNA
aaattcgagacactaaag

SEQ ID NO: 46719 - DNA, 18 bp, Artificial Sequence
  Synthetic DNA
aaattcgcctccctaaag

SEQ ID NO: 46720 - DNA, 18 bp, Artificial Sequence
  Synthetic DNA
aaattcgcttcactctag

SEQ ID NO: 46721 - DNA, 18 bp, Artificial Sequence
  Synthetic DNA
aaattcggcatactatag

SEQ ID NO: 46722 - DNA, 18 bp, Artificial Sequence
  Synthetic DNA
aaattcgggacgttcttg

SEQ ID NO: 46723 - DNA, 18 bp, Artificial Sequence
  Synthetic DNA
aaattcgtaatattatag

SEQ ID NO: 46724 - DNA, 18 bp, Artificial Sequence
  Synthetic DNA
aaattcgtcactcgatag

SEQ ID NO: 46725 - DNA, 18 bp, Artificial Sequence
  Synthetic DNA
aaattcgtcctacaatag

SEQ ID NO: 46726 - DNA, 18 bp, Artificial Sequence
  Synthetic DNA
aaattctactcacccttg

SEQ ID NO: 46727 - DNA, 18 bp, Artificial Sequence
  Synthetic DNA
aaattctactcacttgag

SEQ ID NO: 46728 - DNA, 18 bp, Artificial Sequence
  Synthetic DNA
aaattcttcacactatag

SEQ ID NO: 46729 - DNA, 18 bp, Artificial Sequence
  Synthetic DNA
aaattcttcacactgtag

SEQ ID NO: 46730 - DNA, 18 bp, Artificial Sequence
  Synthetic DNA
aaattgacttcactatag

SEQ ID NO: 46731 - DNA, 18 bp, Artificial Sequence
  Synthetic DNA
aaattgatttcaaaaaag

SEQ ID NO: 46732 - DNA, 18 bp, Artificial Sequence
  Synthetic DNA
aaattggacaccctatag

SEQ ID NO: 46733 - DNA, 18 bp, Artificial Sequence
  Synthetic DNA
aaattggactttatatag

SEQ ID NO: 46734 - DNA, 18 bp, Artificial Sequence
  Synthetic DNA
aaattgtactcactattg

SEQ ID NO: 46735 - DNA, 18 bp, Artificial Sequence
  Synthetic DNA
aaatttaaaacaaaagag

SEQ ID NO: 46736 - DNA, 18 bp, Artificial Sequence
  Synthetic DNA
aaatttgactcagtttag

SEQ ID NO: 46737 - DNA, 18 bp, Artificial Sequence
  Synthetic DNA
aaatttgactccctgtag

SEQ ID NO: 46738 - DNA, 18 bp, Artificial Sequence
  Synthetic DNA
aacaacgacaaagtatag

SEQ ID NO: 46739 - DNA, 18 bp, Artificial Sequence
  Synthetic DNA
aacaacgcctcacctgag

SEQ ID NO: 46740 - DNA, 18 bp, Artificial Sequence
  Synthetic DNA
aacaacgtctcaccagag

SEQ ID NO: 46741 - DNA, 18 bp, Artificial Sequence
  Synthetic DNA
aacaacgtctctttatag

SEQ ID NO: 46742 - DNA, 18 bp, Artificial Sequence
  Synthetic DNA
aacaactagttaaattag

SEQ ID NO: 46743 - DNA, 18 bp, Artificial Sequence
  Synthetic DNA
aacaaggactgcctatcg

SEQ ID NO: 46744 - DNA, 18 bp, Artificial Sequence
  Synthetic DNA
aacaatgactaactatag

SEQ ID NO: 46745 - DNA, 18 bp, Artificial Sequence
  Synthetic DNA
aaccaagatatgctagag

SEQ ID NO: 46746 - DNA, 18 bp, Artificial Sequence
  Synthetic DNA
aaccacgagacactttag

SEQ ID NO: 46747 - DNA, 18 bp, Artificial Sequence
  Synthetic DNA
aaccacgattcactaacg

SEQ ID NO: 46748 - DNA, 18 bp, Artificial Sequence
  Synthetic DNA
aactacatgtcattatag

SEQ ID NO: 46749 - DNA, 18 bp, Artificial Sequence
  Synthetic DNA
aactaccactgattattg

SEQ ID NO: 46750 - DNA, 18 bp, Artificial Sequence
  Synthetic DNA
aactacgaatcattacag

SEQ ID NO: 46751 - DNA, 18 bp, Artificial Sequence
  Synthetic DNA
aactacgacatacttttg

SEQ ID NO: 46752 - DNA, 18 bp, Artificial Sequence
  Synthetic DNA
aactacgacatgctatag

SEQ ID NO: 46753 - DNA, 18 bp, Artificial Sequence
  Synthetic DNA
aactacgacttgctaaag

SEQ ID NO: 46754 - DNA, 18 bp, Artificial Sequence
  Synthetic DNA
aactacgatttactaaag

SEQ ID NO: 46755 - DNA, 18 bp, Artificial Sequence
  Synthetic DNA
aactacgccttcatttag

SEQ ID NO: 46756 - DNA, 18 bp, Artificial Sequence
  Synthetic DNA
aactatgattgcctataa

SEQ ID NO: 46757 - DNA, 18 bp, Artificial Sequence
  Synthetic DNA
aactctgactcactattg

SEQ ID NO: 46758 - DNA, 18 bp, Artificial Sequence
  Synthetic DNA
aactgcgactcacataag

SEQ ID NO: 46759 - DNA, 18 bp, Artificial Sequence
  Synthetic DNA
aactgcgtctcactttag

SEQ ID NO: 46760 - DNA, 18 bp, Artificial Sequence
  Synthetic DNA
aacttcgacaaactatag

SEQ ID NO: 46761 - DNA, 18 bp, Artificial Sequence
  Synthetic DNA
aacttcgacacagttttg

SEQ ID NO: 46762 - DNA, 18 bp, Artificial Sequence
  Synthetic DNA
aacttcgactcaataaag

SEQ ID NO: 46763 - DNA, 18 bp, Artificial Sequence
  Synthetic DNA
aacttcgagtgactatag

SEQ ID NO: 46764 - DNA, 18 bp, Artificial Sequence
  Synthetic DNA
aacttcgcctcactttag

SEQ ID NO: 46765 - DNA, 18 bp, Artificial Sequence
  Synthetic DNA
aactttgacttactatag

SEQ ID NO: 46766 - DNA, 18 bp, Artificial Sequence
  Synthetic DNA
aagaaagaatcactaaag

SEQ ID NO: 46767 - DNA, 18 bp, Artificial Sequence
  Synthetic DNA
aagaaagcctcactaaag

SEQ ID NO: 46768 - DNA, 18 bp, Artificial Sequence
  Synthetic DNA
aagaaccagtcgcaatag

SEQ ID NO: 46769 - DNA, 18 bp, Artificial Sequence
  Synthetic DNA
aagaacgatgcacaacag

SEQ ID NO: 46770 - DNA, 18 bp, Artificial Sequence
  Synthetic DNA
aagatcgaatcactaccg

SEQ ID NO: 46771 - DNA, 18 bp, Artificial Sequence
  Synthetic DNA
aagatcgtctcactagag

SEQ ID NO: 46772 - DNA, 18 bp, Artificial Sequence
  Synthetic DNA
aagcacaactctgttttg

SEQ ID NO: 46773 - DNA, 18 bp, Artificial Sequence
  Synthetic DNA
aagcacaccacaatacag

SEQ ID NO: 46774 - DNA, 18 bp, Artificial Sequence
  Synthetic DNA
aagtacaactctatatag

SEQ ID NO: 46775 - DNA, 18 bp, Artificial Sequence
  Synthetic DNA
aagtacatctcatttttg

SEQ ID NO: 46776 - DNA, 18 bp, Artificial Sequence
  Synthetic DNA
aagtacgaataactacag

SEQ ID NO: 46777 - DNA, 18 bp, Artificial Sequence
  Synthetic DNA
aagtacgacccactactg

SEQ ID NO: 46778 - DNA, 18 bp, Artificial Sequence
  Synthetic DNA
aagtacgacctacaatag

SEQ ID NO: 46779 - DNA, 18 bp, Artificial Sequence
  Synthetic DNA
aagtacggctaacaatgg

SEQ ID NO: 46780 - DNA, 18 bp, Artificial Sequence
  Synthetic DNA
aagtacgtctcaccttag

SEQ ID NO: 46781 - DNA, 18 bp, Artificial Sequence
  Synthetic DNA
aagtaggactcgatatag

SEQ ID NO: 46782 - DNA, 18 bp, Artificial Sequence
  Synthetic DNA
aagtatgtctaactatag

SEQ ID NO: 46783 - DNA, 18 bp, Artificial Sequence
  Synthetic DNA
aagtgcgactcaatgatg

SEQ ID NO: 46784 - DNA, 18 bp, Artificial Sequence
  Synthetic DNA
aagttagattaacaattg

SEQ ID NO: 46785 - DNA, 18 bp, Artificial Sequence
  Synthetic DNA
aagttcgactccttttag

SEQ ID NO: 46786 - DNA, 18 bp, Artificial Sequence
  Synthetic DNA
aataacaactcaatactg

SEQ ID NO: 46787 - DNA, 18 bp, Artificial Sequence
  Synthetic DNA
aataacaactcactaaag

SEQ ID NO: 46788 - DNA, 18 bp, Artificial Sequence
  Synthetic DNA
aataaccacatacattag

SEQ ID NO: 46789 - DNA, 18 bp, Artificial Sequence
  Synthetic DNA
aataacctttccctacag

SEQ ID NO: 46790 - DNA, 18 bp, Artificial Sequence
  Synthetic DNA
aataacgacacacaaaag

SEQ ID NO: 46791 - DNA, 18 bp, Artificial Sequence
  Synthetic DNA
aataacgacccactattg

SEQ ID NO: 46792 - DNA, 18 bp, Artificial Sequence
  Synthetic DNA
aataacgtcactctgtag

SEQ ID NO: 46793 - DNA, 18 bp, Artificial Sequence
  Synthetic DNA
aataacgtctatctagtc

SEQ ID NO: 46794 - DNA, 18 bp, Artificial Sequence
  Synthetic DNA
aataacgtctcacaatag

SEQ ID NO: 46795 - DNA, 18 bp, Artificial Sequence
  Synthetic DNA
aataacgtctcattatag

SEQ ID NO: 46796 - DNA, 18 bp, Artificial Sequence
  Synthetic DNA
aataactaatcacagttg

SEQ ID NO: 46797 - DNA, 18 bp, Artificial Sequence
  Synthetic DNA
aataactagacaatatag

SEQ ID NO: 46798 - DNA, 18 bp, Artificial Sequence
  Synthetic DNA
aataatgtctcacattag

SEQ ID NO: 46799 - DNA, 18 bp, Artificial Sequence
  Synthetic DNA
aataccaactaaccgtag

SEQ ID NO: 46800 - DNA, 18 bp, Artificial Sequence
  Synthetic DNA
aatagcgactaactatag

SEQ ID NO: 46801 - DNA, 18 bp, Artificial Sequence
  Synthetic DNA
aatatagaatctctttgg

SEQ ID NO: 46802 - DNA, 18 bp, Artificial Sequence
  Synthetic DNA
aatatctacttattaatg

SEQ ID NO: 46803 - DNA, 18 bp, Artificial Sequence
  Synthetic DNA
aatcaagactcactaaag

SEQ ID NO: 46804 - DNA, 18 bp, Artificial Sequence
  Synthetic DNA
aatcaagattatctgtag

SEQ ID NO: 46805 - DNA, 18 bp, Artificial Sequence
  Synthetic DNA
aatcacaattcactctag

SEQ ID NO: 46806 - DNA, 18 bp, Artificial Sequence
  Synthetic DNA
aatcacgattccctatcg

SEQ ID NO: 46807 - DNA, 18 bp, Artificial Sequence
  Synthetic DNA
aatcacgtcacactatcg

SEQ ID NO: 46808 - DNA, 18 bp, Artificial Sequence
  Synthetic DNA
aatcactttagtccatag

SEQ ID NO: 46809 - DNA, 18 bp, Artificial Sequence
  Synthetic DNA
aatcaggacaaactttag

SEQ ID NO: 46810 - DNA, 18 bp, Artificial Sequence
  Synthetic DNA
aatcatgaccaactatag

SEQ ID NO: 46811 - DNA, 18 bp, Artificial Sequence
  Synthetic DNA
aatctcaactcactatag

SEQ ID NO: 46812 - DNA, 18 bp, Artificial Sequence
  Synthetic DNA
aatgacgaaccactttag

SEQ ID NO: 46813 - DNA, 18 bp, Artificial Sequence
  Synthetic DNA
aattaacaattactaaag

SEQ ID NO: 46814 - DNA, 18 bp, Artificial Sequence
  Synthetic DNA
aattaagactcgcaatgg

SEQ ID NO: 46815 - DNA, 18 bp, Artificial Sequence
  Synthetic DNA
aattaagcctcaatactg

SEQ ID NO: 46816 - DNA, 18 bp, Artificial Sequence
  Synthetic DNA
aattaaggctcactctag

SEQ ID NO: 46817 - DNA, 18 bp, Artificial Sequence
  Synthetic DNA
aattaattctcattatcg

SEQ ID NO: 46818 - DNA, 18 bp, Artificial Sequence
  Synthetic DNA
aattacaacttactaacg

SEQ ID NO: 46819 - DNA, 18 bp, Artificial Sequence
  Synthetic DNA
aattacaattcactacag

SEQ ID NO: 46820 - DNA, 18 bp, Artificial Sequence
  Synthetic DNA
aattacacctcactctag

SEQ ID NO: 46821 - DNA, 18 bp, Artificial Sequence
  Synthetic DNA
aattacatctcacgtttg

SEQ ID NO: 46822 - DNA, 18 bp, Artificial Sequence
  Synthetic DNA
aattaccacacaccatag

SEQ ID NO: 46823 - DNA, 18 bp, Artificial Sequence
  Synthetic DNA
aattaccactaacagaag

SEQ ID NO: 46824 - DNA, 18 bp, Artificial Sequence
  Synthetic DNA
aattacgaataacaatag

SEQ ID NO: 46825 - DNA, 18 bp, Artificial Sequence
  Synthetic DNA
aattacgacacccgattg

SEQ ID NO: 46826 - DNA, 18 bp, Artificial Sequence
  Synthetic DNA
aattacgacatacacttg

SEQ ID NO: 46827 - DNA, 18 bp, Artificial Sequence
  Synthetic DNA
aattacgaccccctatgg

SEQ ID NO: 46828 - DNA, 18 bp, Artificial Sequence
  Synthetic DNA
aattacgactcacgtttg

SEQ ID NO: 46829 - DNA, 18 bp, Artificial Sequence
  Synthetic DNA
aattacgactcactgctg

SEQ ID NO: 46830 - DNA, 18 bp, Artificial Sequence
  Synthetic DNA
aattacgactcattcaag

SEQ ID NO: 46831 - DNA, 18 bp, Artificial Sequence
  Synthetic DNA
aattacgactcccaaatg

SEQ ID NO: 46832 - DNA, 18 bp, Artificial Sequence
  Synthetic DNA
aattacgagtttctttgg

SEQ ID NO: 46833 - DNA, 18 bp, Artificial Sequence
  Synthetic DNA
aattacgatatactatag

SEQ ID NO: 46834 - DNA, 18 bp, Artificial Sequence
  Synthetic DNA
aattacgattaacacttg

SEQ ID NO: 46835 - DNA, 18 bp, Artificial Sequence
  Synthetic DNA
aattacgattcaatttag

SEQ ID NO: 46836 - DNA, 18 bp, Artificial Sequence
  Synthetic DNA
aattacggctcaatctag

SEQ ID NO: 46837 - DNA, 18 bp, Artificial Sequence
  Synthetic DNA
aattacggctcaatttag

SEQ ID NO: 46838 - DNA, 18 bp, Artificial Sequence
  Synthetic DNA
aattacggctccctttgg

SEQ ID NO: 46839 - DNA, 18 bp, Artificial Sequence
  Synthetic DNA
aattacgggattctatag

SEQ ID NO: 46840 - DNA, 18 bp, Artificial Sequence
  Synthetic DNA
aattacgtatccattcag

SEQ ID NO: 46841 - DNA, 18 bp, Artificial Sequence
  Synthetic DNA
aattacgtctcaatattg

SEQ ID NO: 46842 - DNA, 18 bp, Artificial Sequence
  Synthetic DNA
aattacgtcttactttcg

SEQ ID NO: 46843 - DNA, 18 bp, Artificial Sequence
  Synthetic DNA
aattacgtcttattatag

SEQ ID NO: 46844 - DNA, 18 bp, Artificial Sequence
  Synthetic DNA
aattacgtttctctctag

SEQ ID NO: 46845 - DNA, 18 bp, Artificial Sequence
  Synthetic DNA
aattactacaaactatag

SEQ ID NO: 46846 - DNA, 18 bp, Artificial Sequence
  Synthetic DNA
aattactacaatcatttg

SEQ ID NO: 46847 - DNA, 18 bp, Artificial Sequence
  Synthetic DNA
aattaggacaatctatag

SEQ ID NO: 46848 - DNA, 18 bp, Artificial Sequence
  Synthetic DNA
aattataatttacaatag

SEQ ID NO: 46849 - DNA, 18 bp, Artificial Sequence
  Synthetic DNA
aattatagcacactatag

SEQ ID NO: 46850 - DNA, 18 bp, Artificial Sequence
  Synthetic DNA
aattatgacccactttag

SEQ ID NO: 46851 - DNA, 18 bp, Artificial Sequence
  Synthetic DNA
aattattactctatactg

SEQ ID NO: 46852 - DNA, 18 bp, Artificial Sequence
  Synthetic DNA
aattattagtcactatag

SEQ ID NO: 46853 - DNA, 18 bp, Artificial Sequence
  Synthetic DNA
aattccaactatctatag

SEQ ID NO: 46854 - DNA, 18 bp, Artificial Sequence
  Synthetic DNA
aattccgacccattatag

SEQ ID NO: 46855 - DNA, 18 bp, Artificial Sequence
  Synthetic DNA
aattccgactcttttttg

SEQ ID NO: 46856 - DNA, 18 bp, Artificial Sequence
  Synthetic DNA
aattccgtcccactatag

SEQ ID NO: 46857 - DNA, 18 bp, Artificial Sequence
  Synthetic DNA
aattgagaatctctatag

SEQ ID NO: 46858 - DNA, 18 bp, Artificial Sequence
  Synthetic DNA
aattgcaactcactaaag

SEQ ID NO: 46859 - DNA, 18 bp, Artificial Sequence
  Synthetic DNA
aattgcgactgcatatag

SEQ ID NO: 46860 - DNA, 18 bp, Artificial Sequence
  Synthetic DNA
aattgcgtctcactatcg

SEQ ID NO: 46861 - DNA, 18 bp, Artificial Sequence
  Synthetic DNA
aattgctattcactaaag

SEQ ID NO: 46862 - DNA, 18 bp, Artificial Sequence
  Synthetic DNA
aattgtgactcgctatag

SEQ ID NO: 46863 - DNA, 18 bp, Artificial Sequence
  Synthetic DNA
aatttagaatcactattg

SEQ ID NO: 46864 - DNA, 18 bp, Artificial Sequence
  Synthetic DNA
aatttcaactcataacag

SEQ ID NO: 46865 - DNA, 18 bp, Artificial Sequence
  Synthetic DNA
aatttcgacaacctaaag

SEQ ID NO: 46866 - DNA, 18 bp, Artificial Sequence
  Synthetic DNA
aatttcgactcataatag

SEQ ID NO: 46867 - DNA, 18 bp, Artificial Sequence
  Synthetic DNA
aatttcgactcccattag

SEQ ID NO: 46868 - DNA, 18 bp, Artificial Sequence
  Synthetic DNA
aatttcgactcgctttag

SEQ ID NO: 46869 - DNA, 18 bp, Artificial Sequence
  Synthetic DNA
aatttcgagtcactctag

SEQ ID NO: 46870 - DNA, 18 bp, Artificial Sequence
  Synthetic DNA
aatttctactcactctgg

SEQ ID NO: 46871 - DNA, 18 bp, Artificial Sequence
  Synthetic DNA
aatttcttatcactatag

SEQ ID NO: 46872 - DNA, 18 bp, Artificial Sequence
  Synthetic DNA
aatttcttatcttaagag

SEQ ID NO: 46873 - DNA, 18 bp, Artificial Sequence
  Synthetic DNA
aatttgcacacattattg

SEQ ID NO: 46874 - DNA, 18 bp, Artificial Sequence
  Synthetic DNA
aatttggaactacaaaag

SEQ ID NO: 46875 - DNA, 18 bp, Artificial Sequence
  Synthetic DNA
aattttgactttcaatag

SEQ ID NO: 46876 - DNA, 18 bp, Artificial Sequence
  Synthetic DNA
acaaacgcatctctatag

SEQ ID NO: 46877 - DNA, 18 bp, Artificial Sequence
  Synthetic DNA
acaaacttctcactatgg

SEQ ID NO: 46878 - DNA, 18 bp, Artificial Sequence
  Synthetic DNA
acaaaggaccaaccatgg

SEQ ID NO: 46879 - DNA, 18 bp, Artificial Sequence
  Synthetic DNA
acacacatctatctatag

SEQ ID NO: 46880 - DNA, 18 bp, Artificial Sequence
  Synthetic DNA
acactctactcagtgttg

SEQ ID NO: 46881 - DNA, 18 bp, Artificial Sequence
  Synthetic DNA
acagctgaaccactatag

SEQ ID NO: 46882 - DNA, 18 bp, Artificial Sequence
  Synthetic DNA
acataagagtctcattcg

SEQ ID NO: 46883 - DNA, 18 bp, Artificial Sequence
  Synthetic DNA
acataagattcacaatag

SEQ ID NO: 46884 - DNA, 18 bp, Artificial Sequence
  Synthetic DNA
acataaggcttactatag

SEQ ID NO: 46885 - DNA, 18 bp, Artificial Sequence
  Synthetic DNA
acatacatctcactttag

SEQ ID NO: 46886 - DNA, 18 bp, Artificial Sequence
  Synthetic DNA
acatacatctgactatag

SEQ ID NO: 46887 - DNA, 18 bp, Artificial Sequence
  Synthetic DNA
acatacatttcacaatag

SEQ ID NO: 46888 - DNA, 18 bp, Artificial Sequence
  Synthetic DNA
acataccactcactaatg

SEQ ID NO: 46889 - DNA, 18 bp, Artificial Sequence
  Synthetic DNA
acataccgttcacttttg

SEQ ID NO: 46890 - DNA, 18 bp, Artificial Sequence
  Synthetic DNA
acatacgacaatcaaatg

SEQ ID NO: 46891 - DNA, 18 bp, Artificial Sequence
  Synthetic DNA
acatacgacacacctttg

SEQ ID NO: 46892 - DNA, 18 bp, Artificial Sequence
  Synthetic DNA
acatacgacacactgaag

SEQ ID NO: 46893 - DNA, 18 bp, Artificial Sequence
  Synthetic DNA
acatacgactcaataacg

SEQ ID NO: 46894 - DNA, 18 bp, Artificial Sequence
  Synthetic DNA
acatacgattcaataccg

SEQ ID NO: 46895 - DNA, 18 bp, Artificial Sequence
  Synthetic DNA
acatacgtgtcacaatag

SEQ ID NO: 46896 - DNA, 18 bp, Artificial Sequence
  Synthetic DNA
acatactaatctccatag

SEQ ID NO: 46897 - DNA, 18 bp, Artificial Sequence
  Synthetic DNA
acatactgctcactttag

SEQ ID NO: 46898 - DNA, 18 bp, Artificial Sequence
  Synthetic DNA
acatacttctctcattag

SEQ ID NO: 46899 - DNA, 18 bp, Artificial Sequence
  Synthetic DNA
acatattacgctctacag

SEQ ID NO: 46900 - DNA, 18 bp, Artificial Sequence
  Synthetic DNA
acatcctacataccaaag

SEQ ID NO: 46901 - DNA, 18 bp, Artificial Sequence
  Synthetic DNA
acatccttctctctatag

SEQ ID NO: 46902 - DNA, 18 bp, Artificial Sequence
  Synthetic DNA
acattcgagtcacatcag

SEQ ID NO: 46903 - DNA, 18 bp, Artificial Sequence
  Synthetic DNA
acattcggattacattag

SEQ ID NO: 46904 - DNA, 18 bp, Artificial Sequence
  Synthetic DNA
acattctactctcaatag

SEQ ID NO: 46905 - DNA, 18 bp, Artificial Sequence
  Synthetic DNA
acccgcgacacactgatg

SEQ ID NO: 46906 - DNA, 18 bp, Artificial Sequence
  Synthetic DNA
acctacgactccacatag

SEQ ID NO: 46907 - DNA, 18 bp, Artificial Sequence
  Synthetic DNA
acctacgacttactattg

SEQ ID NO: 46908 - DNA, 18 bp, Artificial Sequence
  Synthetic DNA
acgcgcgactgacttaag

SEQ ID NO: 46909 - DNA, 18 bp, Artificial Sequence
  Synthetic DNA
acgggcgtgtcacaatag

SEQ ID NO: 46910 - DNA, 18 bp, Artificial Sequence
  Synthetic DNA
acgtaccgttcaaaatag

SEQ ID NO: 46911 - DNA, 18 bp, Artificial Sequence
  Synthetic DNA
actaacgaaacactatag

SEQ ID NO: 46912 - DNA, 18 bp, Artificial Sequence
  Synthetic DNA
acttacgattcagaatag

SEQ ID NO: 46913 - DNA, 18 bp, Artificial Sequence
  Synthetic DNA
actttcctcacattttag

SEQ ID NO: 46914 - DNA, 18 bp, Artificial Sequence
  Synthetic DNA
agaaacgactaattatag

SEQ ID NO: 46915 - DNA, 18 bp, Artificial Sequence
  Synthetic DNA
agaaacgattcacaattg

SEQ ID NO: 46916 - DNA, 18 bp, Artificial Sequence
  Synthetic DNA
agaaacggctcaatacag

SEQ ID NO: 46917 - DNA, 18 bp, Artificial Sequence
  Synthetic DNA
agaaacggctctaaaacg

SEQ ID NO: 46918 - DNA, 18 bp, Artificial Sequence
  Synthetic DNA
agaaacgtctcacatcgg

SEQ ID NO: 46919 - DNA, 18 bp, Artificial Sequence
  Synthetic DNA
agaaccgattcactttag

SEQ ID NO: 46920 - DNA, 18 bp, Artificial Sequence
  Synthetic DNA
agaagcgcctctctagtg

SEQ ID NO: 46921 - DNA, 18 bp, Artificial Sequence
  Synthetic DNA
agaatcgattcactaaag

SEQ ID NO: 46922 - DNA, 18 bp, Artificial Sequence
  Synthetic DNA
agagaagattcactatag

SEQ ID NO: 46923 - DNA, 18 bp, Artificial Sequence
  Synthetic DNA
agagaagtatcactttag

SEQ ID NO: 46924 - DNA, 18 bp, Artificial Sequence
  Synthetic DNA
agagacggctcaataaag

SEQ ID NO: 46925 - DNA, 18 bp, Artificial Sequence
  Synthetic DNA
agatacaacaaataatag

SEQ ID NO: 46926 - DNA, 18 bp, Artificial Sequence
  Synthetic DNA
agatacatcaaactaaag

SEQ ID NO: 46927 - DNA, 18 bp, Artificial Sequence
  Synthetic DNA
agatactactctctattg

SEQ ID NO: 46928 - DNA, 18 bp, Artificial Sequence
  Synthetic DNA
agatacttctttctatag

SEQ ID NO: 46929 - DNA, 18 bp, Artificial Sequence
  Synthetic DNA
agataggcctaataatag

SEQ ID NO: 46930 - DNA, 18 bp, Artificial Sequence
  Synthetic DNA
agatatgcctcaattaag

SEQ ID NO: 46931 - DNA, 18 bp, Artificial Sequence
  Synthetic DNA
agatatttctcacttcta

SEQ ID NO: 46932 - DNA, 18 bp, Artificial Sequence
  Synthetic DNA
agattcgtctcattctag

SEQ ID NO: 46933 - DNA, 18 bp, Artificial Sequence
  Synthetic DNA
agattgcactcactaaag

SEQ ID NO: 46934 - DNA, 18 bp, Artificial Sequence
  Synthetic DNA
agattggactctctatag

SEQ ID NO: 46935 - DNA, 18 bp, Artificial Sequence
  Synthetic DNA
agcaacgactctcactag

SEQ ID NO: 46936 - DNA, 18 bp, Artificial Sequence
  Synthetic DNA
agctacgtttcactaaag

SEQ ID NO: 46937 - DNA, 18 bp, Artificial Sequence
  Synthetic DNA
agctatgtatctctattg

SEQ ID NO: 46938 - DNA, 18 bp, Artificial Sequence
  Synthetic DNA
aggtacgactcataatcg

SEQ ID NO: 46939 - DNA, 18 bp, Artificial Sequence
  Synthetic DNA
aggtacgactctttttag

SEQ ID NO: 46940 - DNA, 18 bp, Artificial Sequence
  Synthetic DNA
aggtacgccacactctag

SEQ ID NO: 46941 - DNA, 18 bp, Artificial Sequence
  Synthetic DNA
aggtactacccactatag

SEQ ID NO: 46942 - DNA, 18 bp, Artificial Sequence
  Synthetic DNA
aggtactactcactacag

SEQ ID NO: 46943 - DNA, 18 bp, Artificial Sequence
  Synthetic DNA
aggtagcactctcaattg

SEQ ID NO: 46944 - DNA, 18 bp, Artificial Sequence
  Synthetic DNA
aggtattaccctgtatag

SEQ ID NO: 46945 - DNA, 18 bp, Artificial Sequence
  Synthetic DNA
agttacaactctccatgg

SEQ ID NO: 46946 - DNA, 18 bp, Artificial Sequence
  Synthetic DNA
agttacgaataactaaag

SEQ ID NO: 46947 - DNA, 18 bp, Artificial Sequence
  Synthetic DNA
ataaaagtctcactacag

SEQ ID NO: 46948 - DNA, 18 bp, Artificial Sequence
  Synthetic DNA
ataaacaactctatagag

SEQ ID NO: 46949 - DNA, 18 bp, Artificial Sequence
  Synthetic DNA
ataaacgactcaccagtg

SEQ ID NO: 46950 - DNA, 18 bp, Artificial Sequence
  Synthetic DNA
ataaacgagtcactgtag

SEQ ID NO: 46951 - DNA, 18 bp, Artificial Sequence
  Synthetic DNA
ataaacgtctgactatag

SEQ ID NO: 46952 - DNA, 18 bp, Artificial Sequence
  Synthetic DNA
ataaaggtcacactaatg

SEQ ID NO: 46953 - DNA, 18 bp, Artificial Sequence
  Synthetic DNA
ataaatcccttaaaatag

SEQ ID NO: 46954 - DNA, 18 bp, Artificial Sequence
  Synthetic DNA
ataacccactttttataa

SEQ ID NO: 46955 - DNA, 18 bp, Artificial Sequence
  Synthetic DNA
ataatattcaccatttag

SEQ ID NO: 46956 - DNA, 18 bp, Artificial Sequence
  Synthetic DNA
ataatcatctcacttatg

SEQ ID NO: 46957 - DNA, 18 bp, Artificial Sequence
  Synthetic DNA
ataatcgactctctatag

SEQ ID NO: 46958 - DNA, 18 bp, Artificial Sequence
  Synthetic DNA
ataatcttttcagtattg

SEQ ID NO: 46959 - DNA, 18 bp, Artificial Sequence
  Synthetic DNA
ataatggtttaactagag

SEQ ID NO: 46960 - DNA, 18 bp, Artificial Sequence
  Synthetic DNA
atacatgactcactaaag

SEQ ID NO: 46961 - DNA, 18 bp, Artificial Sequence
  Synthetic DNA
atacatgactcactgaag

SEQ ID NO: 46962 - DNA, 18 bp, Artificial Sequence
  Synthetic DNA
atactcgagatactatag

SEQ ID NO: 46963 - DNA, 18 bp, Artificial Sequence
  Synthetic DNA
atagaggaatccctatag

SEQ ID NO: 46964 - DNA, 18 bp, Artificial Sequence
  Synthetic DNA
atagtcatctcagaatag

SEQ ID NO: 46965 - DNA, 18 bp, Artificial Sequence
  Synthetic DNA
atagtcgcctttctacgg

SEQ ID NO: 46966 - DNA, 18 bp, Artificial Sequence
  Synthetic DNA
atagtcgctacactaacg

SEQ ID NO: 46967 - DNA, 18 bp, Artificial Sequence
  Synthetic DNA
atataacactcactttag

SEQ ID NO: 46968 - DNA, 18 bp, Artificial Sequence
  Synthetic DNA
atataagactcaatattg

SEQ ID NO: 46969 - DNA, 18 bp, Artificial Sequence
  Synthetic DNA
atataaggttcattatcg

SEQ ID NO: 46970 - DNA, 18 bp, Artificial Sequence
  Synthetic DNA
atataagtcaaactatag

SEQ ID NO: 46971 - DNA, 18 bp, Artificial Sequence
  Synthetic DNA
atataagtctcacaatag

SEQ ID NO: 46972 - DNA, 18 bp, Artificial Sequence
  Synthetic DNA
atataatactaaattttg

SEQ ID NO: 46973 - DNA, 18 bp, Artificial Sequence
  Synthetic DNA
atatacaaaatacaatag

SEQ ID NO: 46974 - DNA, 18 bp, Artificial Sequence
  Synthetic DNA
atatacaaatcactgttg

SEQ ID NO: 46975 - DNA, 18 bp, Artificial Sequence
  Synthetic DNA
atatacaacatgcatcag

SEQ ID NO: 46976 - DNA, 18 bp, Artificial Sequence
  Synthetic DNA
atatacaactcacgattg

SEQ ID NO: 46977 - DNA, 18 bp, Artificial Sequence
  Synthetic DNA
atatacaactctctagag

SEQ ID NO: 46978 - DNA, 18 bp, Artificial Sequence
  Synthetic DNA
atatacagttcacgcgag

SEQ ID NO: 46979 - DNA, 18 bp, Artificial Sequence
  Synthetic DNA
atatacatatcaattaag

SEQ ID NO: 46980 - DNA, 18 bp, Artificial Sequence
  Synthetic DNA
atatacatctaactatag

SEQ ID NO: 46981 - DNA, 18 bp, Artificial Sequence
  Synthetic DNA
atataccactcattctgg

SEQ ID NO: 46982 - DNA, 18 bp, Artificial Sequence
  Synthetic DNA
atataccactctctacag

SEQ ID NO: 46983 - DNA, 18 bp, Artificial Sequence
  Synthetic DNA
atataccacttactgtag

SEQ ID NO: 46984 - DNA, 18 bp, Artificial Sequence
  Synthetic DNA
atatacctctctttatag

SEQ ID NO: 46985 - DNA, 18 bp, Artificial Sequence
  Synthetic DNA
atatacgaaagactaacg

SEQ ID NO: 46986 - DNA, 18 bp, Artificial Sequence
  Synthetic DNA
atatacgaattactttag

SEQ ID NO: 46987 - DNA, 18 bp, Artificial Sequence
  Synthetic DNA
atatacgacataatatcg

SEQ ID NO: 46988 - DNA, 18 bp, Artificial Sequence
  Synthetic DNA
atatacgacatactattg

SEQ ID NO: 46989 - DNA, 18 bp, Artificial Sequence
  Synthetic DNA
atatacgacctacaaatg

SEQ ID NO: 46990 - DNA, 18 bp, Artificial Sequence
  Synthetic DNA
atatacgactcagttttg

SEQ ID NO: 46991 - DNA, 18 bp, Artificial Sequence
  Synthetic DNA
atatacgactcatattag

SEQ ID NO: 46992 - DNA, 18 bp, Artificial Sequence
  Synthetic DNA
atatacgactcatcattg

SEQ ID NO: 46993 - DNA, 18 bp, Artificial Sequence
  Synthetic DNA
atatacgattcacactag

SEQ ID NO: 46994 - DNA, 18 bp, Artificial Sequence
  Synthetic DNA
atatacgccatacatttg

SEQ ID NO: 46995 - DNA, 18 bp, Artificial Sequence
  Synthetic DNA
atatacgcccccctatag

SEQ ID NO: 46996 - DNA, 18 bp, Artificial Sequence
  Synthetic DNA
atatacgcctcattatgg

SEQ ID NO: 46997 - DNA, 18 bp, Artificial Sequence
  Synthetic DNA
atatacggctcggtaaag

SEQ ID NO: 46998 - DNA, 18 bp, Artificial Sequence
  Synthetic DNA
atatacgtatcataatag

SEQ ID NO: 46999 - DNA, 18 bp, Artificial Sequence
  Synthetic DNA
atatacgtcacactgcag

SEQ ID NO: 47000 - DNA, 18 bp, Artificial Sequence
  Synthetic DNA
atatacgtctccttatag

SEQ ID NO: 47001 - DNA, 18 bp, Artificial Sequence
  Synthetic DNA
atatacgtctcgccatag

SEQ ID NO: 47002 - DNA, 18 bp, Artificial Sequence
  Synthetic DNA
atatacgtcttaccatag

SEQ ID NO: 47003 - DNA, 18 bp, Artificial Sequence
  Synthetic DNA
atatacgtgacacaattg

SEQ ID NO: 47004 - DNA, 18 bp, Artificial Sequence
  Synthetic DNA
atatactacaaagattag

SEQ ID NO: 47005 - DNA, 18 bp, Artificial Sequence
  Synthetic DNA
atatactacccacaatag

SEQ ID NO: 47006 - DNA, 18 bp, Artificial Sequence
  Synthetic DNA
atatactactgattcaag

SEQ ID NO: 47007 - DNA, 18 bp, Artificial Sequence
  Synthetic DNA
atatactatgcatcatag

SEQ ID NO: 47008 - DNA, 18 bp, Artificial Sequence
  Synthetic DNA
atatacttcttgccttag

SEQ ID NO: 47009 - DNA, 18 bp, Artificial Sequence
  Synthetic DNA
atatagaactcacaatag

SEQ ID NO: 47010 - DNA, 18 bp, Artificial Sequence
  Synthetic DNA
atataggactcgcaatag

SEQ ID NO: 47011 - DNA, 18 bp, Artificial Sequence
  Synthetic DNA
atataggccttactttag

SEQ ID NO: 47012 - DNA, 18 bp, Artificial Sequence
  Synthetic DNA
atataggtcacgaaatag

SEQ ID NO: 47013 - DNA, 18 bp, Artificial Sequence
  Synthetic DNA
atatatgaacgtctattg

SEQ ID NO: 47014 - DNA, 18 bp, Artificial Sequence
  Synthetic DNA
atatatgaatcactgtag

SEQ ID NO: 47015 - DNA, 18 bp, Artificial Sequence
  Synthetic DNA
atatatgtctcactcaag

SEQ ID NO: 47016 - DNA, 18 bp, Artificial Sequence
  Synthetic DNA
atatatgtctttgtatag

SEQ ID NO: 47017 - DNA, 18 bp, Artificial Sequence
  Synthetic DNA
atatattattcacaatag

SEQ ID NO: 47018 - DNA, 18 bp, Artificial Sequence
  Synthetic DNA
atatatttctcacaattg

SEQ ID NO: 47019 - DNA, 18 bp, Artificial Sequence
  Synthetic DNA
atatcagacatactattg

SEQ ID NO: 47020 - DNA, 18 bp, Artificial Sequence
  Synthetic DNA
atatcagtcacactatag

SEQ ID NO: 47021 - DNA, 18 bp, Artificial Sequence
  Synthetic DNA
atatccgacacactctgg

SEQ ID NO: 47022 - DNA, 18 bp, Artificial Sequence
  Synthetic DNA
atatcctactctctatag

SEQ ID NO: 47023 - DNA, 18 bp, Artificial Sequence
  Synthetic DNA
atatctcactcactatag

SEQ ID NO: 47024 - DNA, 18 bp, Artificial Sequence
  Synthetic DNA
atatgccactatctatag

SEQ ID NO: 47025 - DNA, 18 bp, Artificial Sequence
  Synthetic DNA
atatgcgaatcaaattag

SEQ ID NO: 47026 - DNA, 18 bp, Artificial Sequence
  Synthetic DNA
atatgcgacacactattg

SEQ ID NO: 47027 - DNA, 18 bp, Artificial Sequence
  Synthetic DNA
atatgcgacccactgttg

SEQ ID NO: 47028 - DNA, 18 bp, Artificial Sequence
  Synthetic DNA
atatgcgactaacactag

SEQ ID NO: 47029 - DNA, 18 bp, Artificial Sequence
  Synthetic DNA
atatgcgactcgttatag

SEQ ID NO: 47030 - DNA, 18 bp, Artificial Sequence
  Synthetic DNA
atatgcgagtcaatatag

SEQ ID NO: 47031 - DNA, 18 bp, Artificial Sequence
  Synthetic DNA
atatgcgtaccaccatcg

SEQ ID NO: 47032 - DNA, 18 bp, Artificial Sequence
  Synthetic DNA
atatgcgtctcagtatag

SEQ ID NO: 47033 - DNA, 18 bp, Artificial Sequence
  Synthetic DNA
atattagactctctttag

SEQ ID NO: 47034 - DNA, 18 bp, Artificial Sequence
  Synthetic DNA
atattcatctctctattg

SEQ ID NO: 47035 - DNA, 18 bp, Artificial Sequence
  Synthetic DNA
atattcctgtccttacag

SEQ ID NO: 47036 - DNA, 18 bp, Artificial Sequence
  Synthetic DNA
atattcgaaacactctag

SEQ ID NO: 47037 - DNA, 18 bp, Artificial Sequence
  Synthetic DNA
atattcgaaatacagtag

SEQ ID NO: 47038 - DNA, 18 bp, Artificial Sequence
  Synthetic DNA
atattcgactcacttctg

SEQ ID NO: 47039 - DNA, 18 bp, Artificial Sequence
  Synthetic DNA
atattcgagtgtctatag

SEQ ID NO: 47040 - DNA, 18 bp, Artificial Sequence
  Synthetic DNA
atattcgatatacttttg

SEQ ID NO: 47041 - DNA, 18 bp, Artificial Sequence
  Synthetic DNA
atattcgtcaaactaagg

SEQ ID NO: 47042 - DNA, 18 bp, Artificial Sequence
  Synthetic DNA
atattctactcacgatag

SEQ ID NO: 47043 - DNA, 18 bp, Artificial Sequence
  Synthetic DNA
atattctcctcactgaag

SEQ ID NO: 47044 - DNA, 18 bp, Artificial Sequence
  Synthetic DNA
atattcttcacaatatag

SEQ ID NO: 47045 - DNA, 18 bp, Artificial Sequence
  Synthetic DNA
atattcttcacactattg

SEQ ID NO: 47046 - DNA, 18 bp, Artificial Sequence
  Synthetic DNA
atattggacacacgatag

SEQ ID NO: 47047 - DNA, 18 bp, Artificial Sequence
  Synthetic DNA
atatttaactcactattg

SEQ ID NO: 47048 - DNA, 18 bp, Artificial Sequence
  Synthetic DNA
atcagcgattcttttttg

SEQ ID NO: 47049 - DNA, 18 bp, Artificial Sequence
  Synthetic DNA
atccacgaatcactttag

SEQ ID NO: 47050 - DNA, 18 bp, Artificial Sequence
  Synthetic DNA
atccaggactcgctatag

SEQ ID NO: 47051 - DNA, 18 bp, Artificial Sequence
  Synthetic DNA
atctacgaattactttcg

SEQ ID NO: 47052 - DNA, 18 bp, Artificial Sequence
  Synthetic DNA
atctacgacccaccatag

SEQ ID NO: 47053 - DNA, 18 bp, Artificial Sequence
  Synthetic DNA
atctacgacgctctatcg

SEQ ID NO: 47054 - DNA, 18 bp, Artificial Sequence
  Synthetic DNA
atctacgattctatttag

SEQ ID NO: 47055 - DNA, 18 bp, Artificial Sequence
  Synthetic DNA
atctatgtctcaaaatag

SEQ ID NO: 47056 - DNA, 18 bp, Artificial Sequence
  Synthetic DNA
atctatgtctcacgacag

SEQ ID NO: 47057 - DNA, 18 bp, Artificial Sequence
  Synthetic DNA
atctctgactaactatag

SEQ ID NO: 47058 - DNA, 18 bp, Artificial Sequence
  Synthetic DNA
atctgaaactcaccaaag

SEQ ID NO: 47059 - DNA, 18 bp, Artificial Sequence
  Synthetic DNA
atcttggacttactattg

SEQ ID NO: 47060 - DNA, 18 bp, Artificial Sequence
  Synthetic DNA
atgaacatgccccaatag

SEQ ID NO: 47061 - DNA, 18 bp, Artificial Sequence
  Synthetic DNA
atgacctactccccatag

SEQ ID NO: 47062 - DNA, 18 bp, Artificial Sequence
  Synthetic DNA
atgatcgacttgaaaaag

SEQ ID NO: 47063 - DNA, 18 bp, Artificial Sequence
  Synthetic DNA
atgcaagacacttaacag

SEQ ID NO: 47064 - DNA, 18 bp, Artificial Sequence
  Synthetic DNA
atgcacaactcaccatag

SEQ ID NO: 47065 - DNA, 18 bp, Artificial Sequence
  Synthetic DNA
atggataactcatcagag

SEQ ID NO: 47066 - DNA, 18 bp, Artificial Sequence
  Synthetic DNA
atgtaagacatactttag

SEQ ID NO: 47067 - DNA, 18 bp, Artificial Sequence
  Synthetic DNA
atgtacgtcaccccatag

SEQ ID NO: 47068 - DNA, 18 bp, Artificial Sequence
  Synthetic DNA
atgtatgactcattatag

SEQ ID NO: 47069 - DNA, 18 bp, Artificial Sequence
  Synthetic DNA
atgtatggctcacaacag

SEQ ID NO: 47070 - DNA, 18 bp, Artificial Sequence
  Synthetic DNA
atgtatttctcactttag

SEQ ID NO: 47071 - DNA, 18 bp, Artificial Sequence
  Synthetic DNA
atgtccgtgtcactaaag

SEQ ID NO: 47072 - DNA, 18 bp, Artificial Sequence
  Synthetic DNA
atgttctacacactatag

SEQ ID NO: 47073 - DNA, 18 bp, Artificial Sequence
  Synthetic DNA
atgttctaccaacagtag

SEQ ID NO: 47074 - DNA, 18 bp, Artificial Sequence
  Synthetic DNA
attaacgaatcgctattg

SEQ ID NO: 47075 - DNA, 18 bp, Artificial Sequence
  Synthetic DNA
attaacgatatacttaag

SEQ ID NO: 47076 - DNA, 18 bp, Artificial Sequence
  Synthetic DNA
attaactaaacactcagg

SEQ ID NO: 47077 - DNA, 18 bp, Artificial Sequence
  Synthetic DNA
attctcggctcactttag

SEQ ID NO: 47078 - DNA, 18 bp, Artificial Sequence
  Synthetic DNA
atttaattcacactatgg

SEQ ID NO: 47079 - DNA, 18 bp, Artificial Sequence
  Synthetic DNA
atttacaaccaacaatag

SEQ ID NO: 47080 - DNA, 18 bp, Artificial Sequence
  Synthetic DNA
atttacaagtcacatttg

SEQ ID NO: 47081 - DNA, 18 bp, Artificial Sequence
  Synthetic DNA
atttacgaaacactaacg

SEQ ID NO: 47082 - DNA, 18 bp, Artificial Sequence
  Synthetic DNA
atttacgaatcactactg

SEQ ID NO: 47083 - DNA, 18 bp, Artificial Sequence
  Synthetic DNA
atttacgactcactttgg

SEQ ID NO: 47084 - DNA, 18 bp, Artificial Sequence
  Synthetic DNA
atttacgactcgctaaag

SEQ ID NO: 47085 - DNA, 18 bp, Artificial Sequence
  Synthetic DNA
atttacgactctgtatag

SEQ ID NO: 47086 - DNA, 18 bp, Artificial Sequence
  Synthetic DNA
atttacgacttacaaaag

SEQ ID NO: 47087 - DNA, 18 bp, Artificial Sequence
  Synthetic DNA
atttacgtcagcctatag

SEQ ID NO: 47088 - DNA, 18 bp, Artificial Sequence
  Synthetic DNA
atttacgtctcactcgag

SEQ ID NO: 47089 - DNA, 18 bp, Artificial Sequence
  Synthetic DNA
atttactactctctaagg

SEQ ID NO: 47090 - DNA, 18 bp, Artificial Sequence
  Synthetic DNA
atttaggagtctctattg

SEQ ID NO: 47091 - DNA, 18 bp, Artificial Sequence
  Synthetic DNA
atttaggagtgactatag

SEQ ID NO: 47092 - DNA, 18 bp, Artificial Sequence
  Synthetic DNA
atttatgactcactagag

SEQ ID NO: 47093 - DNA, 18 bp, Artificial Sequence
  Synthetic DNA
atttgcgactctccttag

SEQ ID NO: 47094 - DNA, 18 bp, Artificial Sequence
  Synthetic DNA
attttcgaatcactacag

SEQ ID NO: 47095 - DNA, 18 bp, Artificial Sequence
  Synthetic DNA
attttcggcactccattg

SEQ ID NO: 47096 - DNA, 18 bp, Artificial Sequence
  Synthetic DNA
attttcgtctcactttag

SEQ ID NO: 47097 - DNA, 18 bp, Artificial Sequence
  Synthetic DNA
attttcgtctcattatag

SEQ ID NO: 47098 - DNA, 18 bp, Artificial Sequence
  Synthetic DNA
atttttgattttctcaag

SEQ ID NO: 47099 - DNA, 18 bp, Artificial Sequence
  Synthetic DNA
caaaaagaatcaccatag

SEQ ID NO: 47100 - DNA, 18 bp, Artificial Sequence
  Synthetic DNA
caaaacgaaacaccctag

SEQ ID NO: 47101 - DNA, 18 bp, Artificial Sequence
  Synthetic DNA
caaaacgaatgacgatag

SEQ ID NO: 47102 - DNA, 18 bp, Artificial Sequence
  Synthetic DNA
caaaacgactcaccaatg

SEQ ID NO: 47103 - DNA, 18 bp, Artificial Sequence
  Synthetic DNA
caaaacgactcattttcg

SEQ ID NO: 47104 - DNA, 18 bp, Artificial Sequence
  Synthetic DNA
caaaacgactctgtaatg

SEQ ID NO: 47105 - DNA, 18 bp, Artificial Sequence
  Synthetic DNA
caaaacggtactcaaaag

SEQ ID NO: 47106 - DNA, 18 bp, Artificial Sequence
  Synthetic DNA
caaaacgtctagctatag

SEQ ID NO: 47107 - DNA, 18 bp, Artificial Sequence
  Synthetic DNA
caaaacgtctcacatttg

SEQ ID NO: 47108 - DNA, 18 bp, Artificial Sequence
  Synthetic DNA
caaaacgtttcaatatag

SEQ ID NO: 47109 - DNA, 18 bp, Artificial Sequence
  Synthetic DNA
caaaactcctcgctaatg

SEQ ID NO: 47110 - DNA, 18 bp, Artificial Sequence
  Synthetic DNA
caaaagatcttgctatag

SEQ ID NO: 47111 - DNA, 18 bp, Artificial Sequence
  Synthetic DNA
caaaaggactccttatag

SEQ ID NO: 47112 - DNA, 18 bp, Artificial Sequence
  Synthetic DNA
caaaaggattcactatcg

SEQ ID NO: 47113 - DNA, 18 bp, Artificial Sequence
  Synthetic DNA
caaaatgactcacaatgg

SEQ ID NO: 47114 - DNA, 18 bp, Artificial Sequence
  Synthetic DNA
caaaatgactctcgttag

SEQ ID NO: 47115 - DNA, 18 bp, Artificial Sequence
  Synthetic DNA
caaaccgaactactatag

SEQ ID NO: 47116 - DNA, 18 bp, Artificial Sequence
  Synthetic DNA
caaacctattcgctttag

SEQ ID NO: 47117 - DNA, 18 bp, Artificial Sequence
  Synthetic DNA
caaatcagcacactaaag

SEQ ID NO: 47118 - DNA, 18 bp, Artificial Sequence
  Synthetic DNA
caaatcatcacactatag

SEQ ID NO: 47119 - DNA, 18 bp, Artificial Sequence
  Synthetic DNA
caaatccccttacagttg

SEQ ID NO: 47120 - DNA, 18 bp, Artificial Sequence
  Synthetic DNA
caaatcgactccttttag

SEQ ID NO: 47121 - DNA, 18 bp, Artificial Sequence
  Synthetic DNA
caaatcgactcgctaaag

SEQ ID NO: 47122 - DNA, 18 bp, Artificial Sequence
  Synthetic DNA
caaatcgactttttatag

SEQ ID NO: 47123 - DNA, 18 bp, Artificial Sequence
  Synthetic DNA
caaatcgattcaattttg

SEQ ID NO: 47124 - DNA, 18 bp, Artificial Sequence
  Synthetic DNA
caaatctccatactcaag

SEQ ID NO: 47125 - DNA, 18 bp, Artificial Sequence
  Synthetic DNA
caaattgactcacaattg

SEQ ID NO: 47126 - DNA, 18 bp, Artificial Sequence
  Synthetic DNA
caacaacacactctatag

SEQ ID NO: 47127 - DNA, 18 bp, Artificial Sequence
  Synthetic DNA
caacacatctcactattg

SEQ ID NO: 47128 - DNA, 18 bp, Artificial Sequence
  Synthetic DNA
caacaccaacaactctag

SEQ ID NO: 47129 - DNA, 18 bp, Artificial Sequence
  Synthetic DNA
caacacgtcacaccaacg

SEQ ID NO: 47130 - DNA, 18 bp, Artificial Sequence
  Synthetic DNA
caacacgtctcattgtag

SEQ ID NO: 47131 - DNA, 18 bp, Artificial Sequence
  Synthetic DNA
caacacgtgtcacaatag

SEQ ID NO: 47132 - DNA, 18 bp, Artificial Sequence
  Synthetic DNA
caacaggatcctatattg

SEQ ID NO: 47133 - DNA, 18 bp, Artificial Sequence
  Synthetic DNA
caactcgactcttattcg

SEQ ID NO: 47134 - DNA, 18 bp, Artificial Sequence
  Synthetic DNA
caagacgttcctctatag

SEQ ID NO: 47135 - DNA, 18 bp, Artificial Sequence
  Synthetic DNA
caagaggaatagttaaag

SEQ ID NO: 47136 - DNA, 18 bp, Artificial Sequence
  Synthetic DNA
caagctgtctcactatag

SEQ ID NO: 47137 - DNA, 18 bp, Artificial Sequence
  Synthetic DNA
caataaaacttactttag

SEQ ID NO: 47138 - DNA, 18 bp, Artificial Sequence
  Synthetic DNA
caataaagctcacattag

SEQ ID NO: 47139 - DNA, 18 bp, Artificial Sequence
  Synthetic DNA
caataagaatcacagttg

SEQ ID NO: 47140 - DNA, 18 bp, Artificial Sequence
  Synthetic DNA
caataagaccctcgatag

SEQ ID NO: 47141 - DNA, 18 bp, Artificial Sequence
  Synthetic DNA
caatacaactcgcaaccg

SEQ ID NO: 47142 - DNA, 18 bp, Artificial Sequence
  Synthetic DNA
caatacacccaactacag

SEQ ID NO: 47143 - DNA, 18 bp, Artificial Sequence
  Synthetic DNA
caatacacctcaccatcg

SEQ ID NO: 47144 - DNA, 18 bp, Artificial Sequence
  Synthetic DNA
caataccagacgctatcg

SEQ ID NO: 47145 - DNA, 18 bp, Artificial Sequence
  Synthetic DNA
caatacgacacccattag

SEQ ID NO: 47146 - DNA, 18 bp, Artificial Sequence
  Synthetic DNA
caatacgacataccaaag

SEQ ID NO: 47147 - DNA, 18 bp, Artificial Sequence
  Synthetic DNA
caatacgacatacttttg

SEQ ID NO: 47148 - DNA, 18 bp, Artificial Sequence
  Synthetic DNA
caatacgactcatattgg

SEQ ID NO: 47149 - DNA, 18 bp, Artificial Sequence
  Synthetic DNA
caatacgacttataaaag

SEQ ID NO: 47150 - DNA, 18 bp, Artificial Sequence
  Synthetic DNA
caatacgagtgacattag

SEQ ID NO: 47151 - DNA, 18 bp, Artificial Sequence
  Synthetic DNA
caatacgattctttttag

SEQ ID NO: 47152 - DNA, 18 bp, Artificial Sequence
  Synthetic DNA
caatacgccactcttaag

SEQ ID NO: 47153 - DNA, 18 bp, Artificial Sequence
  Synthetic DNA
caatacgccccacactag

SEQ ID NO: 47154 - DNA, 18 bp, Artificial Sequence
  Synthetic DNA
caatacgtattacaatag

SEQ ID NO: 47155 - DNA, 18 bp, Artificial Sequence
  Synthetic DNA
caatacgtctaccttaag

SEQ ID NO: 47156 - DNA, 18 bp, Artificial Sequence
  Synthetic DNA
caatacgtctgggtatag

SEQ ID NO: 47157 - DNA, 18 bp, Artificial Sequence
  Synthetic DNA
caatacgtctgtctaaag

SEQ ID NO: 47158 - DNA, 18 bp, Artificial Sequence
  Synthetic DNA
caatacgtttcacaaaag

SEQ ID NO: 47159 - DNA, 18 bp, Artificial Sequence
  Synthetic DNA
caatactacaaacactag

SEQ ID NO: 47160 - DNA, 18 bp, Artificial Sequence
  Synthetic DNA
caatactactcacttatg

SEQ ID NO: 47161 - DNA, 18 bp, Artificial Sequence
  Synthetic DNA
caatactactttttatag

SEQ ID NO: 47162 - DNA, 18 bp, Artificial Sequence
  Synthetic DNA
caatactgctcaagaatg

SEQ ID NO: 47163 - DNA, 18 bp, Artificial Sequence
  Synthetic DNA
caataggactcactcatg

SEQ ID NO: 47164 - DNA, 18 bp, Artificial Sequence
  Synthetic DNA
caataggatctactaatg

SEQ ID NO: 47165 - DNA, 18 bp, Artificial Sequence
  Synthetic DNA
caatataacccatcttag

SEQ ID NO: 47166 - DNA, 18 bp, Artificial Sequence
  Synthetic DNA
caatataactcaaaatag

SEQ ID NO: 47167 - DNA, 18 bp, Artificial Sequence
  Synthetic DNA
caatatgagtctccaaag

SEQ ID NO: 47168 - DNA, 18 bp, Artificial Sequence
  Synthetic DNA
caatatgattcagaatag

SEQ ID NO: 47169 - DNA, 18 bp, Artificial Sequence
  Synthetic DNA
caatatgccagtatatag

SEQ ID NO: 47170 - DNA, 18 bp, Artificial Sequence
  Synthetic DNA
caatatgccccaatatag

SEQ ID NO: 47171 - DNA, 18 bp, Artificial Sequence
  Synthetic DNA
caatatgccgcactattg

SEQ ID NO: 47172 - DNA, 18 bp, Artificial Sequence
  Synthetic DNA
caatatggctcacattag

SEQ ID NO: 47173 - DNA, 18 bp, Artificial Sequence
  Synthetic DNA
caatccgtgtcactagag

SEQ ID NO: 47174 - DNA, 18 bp, Artificial Sequence
  Synthetic DNA
caatccttcttgcaatag

SEQ ID NO: 47175 - DNA, 18 bp, Artificial Sequence
  Synthetic DNA
caatctgtctcatctttg

SEQ ID NO: 47176 - DNA, 18 bp, Artificial Sequence
  Synthetic DNA
caatgccactcacaacgg

SEQ ID NO: 47177 - DNA, 18 bp, Artificial Sequence
  Synthetic DNA
caatgcggtttactatag

SEQ ID NO: 47178 - DNA, 18 bp, Artificial Sequence
  Synthetic DNA
caatgcgttgcagtatag

SEQ ID NO: 47179 - DNA, 18 bp, Artificial Sequence
  Synthetic DNA
caatgctaatcacgaaag

SEQ ID NO: 47180 - DNA, 18 bp, Artificial Sequence
  Synthetic DNA
caatgctactcactccag

SEQ ID NO: 47181 - DNA, 18 bp, Artificial Sequence
  Synthetic DNA
caatgcttctcacatctg

SEQ ID NO: 47182 - DNA, 18 bp, Artificial Sequence
  Synthetic DNA
caatgggatactctatag

SEQ ID NO: 47183 - DNA, 18 bp, Artificial Sequence
  Synthetic DNA
caattagactctctattg

SEQ ID NO: 47184 - DNA, 18 bp, Artificial Sequence
  Synthetic DNA
caattagtctcgtaatag

SEQ ID NO: 47185 - DNA, 18 bp, Artificial Sequence
  Synthetic DNA
caattcgaatcccaattg

SEQ ID NO: 47186 - DNA, 18 bp, Artificial Sequence
  Synthetic DNA
caattcgacactttacag

SEQ ID NO: 47187 - DNA, 18 bp, Artificial Sequence
  Synthetic DNA
caattcgactaattacag

SEQ ID NO: 47188 - DNA, 18 bp, Artificial Sequence
  Synthetic DNA
caattcgactgaccaaag

SEQ ID NO: 47189 - DNA, 18 bp, Artificial Sequence
  Synthetic DNA
caattcgactttctaaag

SEQ ID NO: 47190 - DNA, 18 bp, Artificial Sequence
  Synthetic DNA
caattcgatacactgttg

SEQ ID NO: 47191 - DNA, 18 bp, Artificial Sequence
  Synthetic DNA
caattcgtatcaataaag

SEQ ID NO: 47192 - DNA, 18 bp, Artificial Sequence
  Synthetic DNA
caattcgtcccacttccg

SEQ ID NO: 47193 - DNA, 18 bp, Artificial Sequence
  Synthetic DNA
caattcgtttcacactag

SEQ ID NO: 47194 - DNA, 18 bp, Artificial Sequence
  Synthetic DNA
caattcgtttctctattg

SEQ ID NO: 47195 - DNA, 18 bp, Artificial Sequence
  Synthetic DNA
caattctaatcgcattag

SEQ ID NO: 47196 - DNA, 18 bp, Artificial Sequence
  Synthetic DNA
caattcttcgctctatag

SEQ ID NO: 47197 - DNA, 18 bp, Artificial Sequence
  Synthetic DNA
caatttgagtgaccatag

SEQ ID NO: 47198 - DNA, 18 bp, Artificial Sequence
  Synthetic DNA
caatttgatgtactatag

SEQ ID NO: 47199 - DNA, 18 bp, Artificial Sequence
  Synthetic DNA
caatttggctcacatgag

SEQ ID NO: 47200 - DNA, 18 bp, Artificial Sequence
  Synthetic DNA
caatttttctcactatag

SEQ ID NO: 47201 - DNA, 18 bp, Artificial Sequence
  Synthetic DNA
cacaacgactcaacaacg

SEQ ID NO: 47202 - DNA, 18 bp, Artificial Sequence
  Synthetic DNA
cacaccgactcactttag

SEQ ID NO: 47203 - DNA, 18 bp, Artificial Sequence
  Synthetic DNA
cactacaacccacttaag

SEQ ID NO: 47204 - DNA, 18 bp, Artificial Sequence
  Synthetic DNA
cactacatgtcactacag

SEQ ID NO: 47205 - DNA, 18 bp, Artificial Sequence
  Synthetic DNA
cactacattccactatag

SEQ ID NO: 47206 - DNA, 18 bp, Artificial Sequence
  Synthetic DNA
cactaccactgacttttg

SEQ ID NO: 47207 - DNA, 18 bp, Artificial Sequence
  Synthetic DNA
cactacgtttgagagttg

SEQ ID NO: 47208 - DNA, 18 bp, Artificial Sequence
  Synthetic DNA
cactactacacactaaag

SEQ ID NO: 47209 - DNA, 18 bp, Artificial Sequence
  Synthetic DNA
cactactacccatactgg

SEQ ID NO: 47210 - DNA, 18 bp, Artificial Sequence
  Synthetic DNA
cactattactcgctaacg

SEQ ID NO: 47211 - DNA, 18 bp, Artificial Sequence
  Synthetic DNA
cactccgacttcttacag

SEQ ID NO: 47212 - DNA, 18 bp, Artificial Sequence
  Synthetic DNA
cactccgattaacgttag

SEQ ID NO: 47213 - DNA, 18 bp, Artificial Sequence
  Synthetic DNA
cactgtgattcactcgag

SEQ ID NO: 47214 - DNA, 18 bp, Artificial Sequence
  Synthetic DNA
cacttcgacacactttag

SEQ ID NO: 47215 - DNA, 18 bp, Artificial Sequence
  Synthetic DNA
cacttcgaccaactatag

SEQ ID NO: 47216 - DNA, 18 bp, Artificial Sequence
  Synthetic DNA
cacttcggctcattatcg

SEQ ID NO: 47217 - DNA, 18 bp, Artificial Sequence
  Synthetic DNA
cagcacgactcattacgg

SEQ ID NO: 47218 - DNA, 18 bp, Artificial Sequence
  Synthetic DNA
cagcatgactcacaatag

SEQ ID NO: 47219 - DNA, 18 bp, Artificial Sequence
  Synthetic DNA
caggtcgattctactatg

SEQ ID NO: 47220 - DNA, 18 bp, Artificial Sequence
  Synthetic DNA
cagtaagactcgctctag

SEQ ID NO: 47221 - DNA, 18 bp, Artificial Sequence
  Synthetic DNA
cagtaagattaaatattg

SEQ ID NO: 47222 - DNA, 18 bp, Artificial Sequence
  Synthetic DNA
cagtacatttcaaaatag

SEQ ID NO: 47223 - DNA, 18 bp, Artificial Sequence
  Synthetic DNA
cagtacgaggcgcaattg

SEQ ID NO: 47224 - DNA, 18 bp, Artificial Sequence
  Synthetic DNA
cagtacgcttcactatcg

SEQ ID NO: 47225 - DNA, 18 bp, Artificial Sequence
  Synthetic DNA
cagtacgtctcccaatag

SEQ ID NO: 47226 - DNA, 18 bp, Artificial Sequence
  Synthetic DNA
cagtactagtcgctctag

SEQ ID NO: 47227 - DNA, 18 bp, Artificial Sequence
  Synthetic DNA
cagtactgctcattacag

SEQ ID NO: 47228 - DNA, 18 bp, Artificial Sequence
  Synthetic DNA
cagtatgctactctgtag

SEQ ID NO: 47229 - DNA, 18 bp, Artificial Sequence
  Synthetic DNA
cagtcaaactcattatag

SEQ ID NO: 47230 - DNA, 18 bp, Artificial Sequence
  Synthetic DNA
cagtccgatacatcttag

SEQ ID NO: 47231 - DNA, 18 bp, Artificial Sequence
  Synthetic DNA
cagtgctaccccgcatgg

SEQ ID NO: 47232 - DNA, 18 bp, Artificial Sequence
  Synthetic DNA
cataaatactcattaatg

SEQ ID NO: 47233 - DNA, 18 bp, Artificial Sequence
  Synthetic DNA
cataacaacgaacaatag

SEQ ID NO: 47234 - DNA, 18 bp, Artificial Sequence
  Synthetic DNA
cataacaactcatttttg

SEQ ID NO: 47235 - DNA, 18 bp, Artificial Sequence
  Synthetic DNA
cataacctcacccttttg

SEQ ID NO: 47236 - DNA, 18 bp, Artificial Sequence
  Synthetic DNA
cataacgaatcacaaaag

SEQ ID NO: 47237 - DNA, 18 bp, Artificial Sequence
  Synthetic DNA
cataacgaatctttttag

SEQ ID NO: 47238 - DNA, 18 bp, Artificial Sequence
  Synthetic DNA
cataacgactctctaatg

SEQ ID NO: 47239 - DNA, 18 bp, Artificial Sequence
  Synthetic DNA
cataactactcatcatag

SEQ ID NO: 47240 - DNA, 18 bp, Artificial Sequence
  Synthetic DNA
cataactactgactatag

SEQ ID NO: 47241 - DNA, 18 bp, Artificial Sequence
  Synthetic DNA
cataatgacacacaatcg

SEQ ID NO: 47242 - DNA, 18 bp, Artificial Sequence
  Synthetic DNA
cataatgattcccgatag

SEQ ID NO: 47243 - DNA, 18 bp, Artificial Sequence
  Synthetic DNA
cataatgtttcactttag

SEQ ID NO: 47244 - DNA, 18 bp, Artificial Sequence
  Synthetic DNA
catagcgattcactttag

SEQ ID NO: 47245 - DNA, 18 bp, Artificial Sequence
  Synthetic DNA
catatagactaactacag

SEQ ID NO: 47246 - DNA, 18 bp, Artificial Sequence
  Synthetic DNA
catatagactctctctag

SEQ ID NO: 47247 - DNA, 18 bp, Artificial Sequence
  Synthetic DNA
catcacacttcaatatag

SEQ ID NO: 47248 - DNA, 18 bp, Artificial Sequence
  Synthetic DNA
catcacgactcactcttg

SEQ ID NO: 47249 - DNA, 18 bp, Artificial Sequence
  Synthetic DNA
catcacgtctcactattg

SEQ ID NO: 47250 - DNA, 18 bp, Artificial Sequence
  Synthetic DNA
catcactgatcattatag

SEQ ID NO: 47251 - DNA, 18 bp, Artificial Sequence
  Synthetic DNA
catcccgacaacctctag

SEQ ID NO: 47252 - DNA, 18 bp, Artificial Sequence
  Synthetic DNA
catctctacacaatatag

SEQ ID NO: 47253 - DNA, 18 bp, Artificial Sequence
  Synthetic DNA
catgacgaatcacttttg

SEQ ID NO: 47254 - DNA, 18 bp, Artificial Sequence
  Synthetic DNA
catgacgactcatcatag

SEQ ID NO: 47255 - DNA, 18 bp, Artificial Sequence
  Synthetic DNA
catgacgtctaactatag

SEQ ID NO: 47256 - DNA, 18 bp, Artificial Sequence
  Synthetic DNA
catgccgtctcgtatttg

SEQ ID NO: 47257 - DNA, 18 bp, Artificial Sequence
  Synthetic DNA
cattaaggatcactaaag

SEQ ID NO: 47258 - DNA, 18 bp, Artificial Sequence
  Synthetic DNA
cattaagtcacattatag

SEQ ID NO: 47259 - DNA, 18 bp, Artificial Sequence
  Synthetic DNA
cattaatactaactattg

SEQ ID NO: 47260 - DNA, 18 bp, Artificial Sequence
  Synthetic DNA
cattacaacacattacag

SEQ ID NO: 47261 - DNA, 18 bp, Artificial Sequence
  Synthetic DNA
cattacaactcatcatcg

SEQ ID NO: 47262 - DNA, 18 bp, Artificial Sequence
  Synthetic DNA
cattacagctcacaaaag

SEQ ID NO: 47263 - DNA, 18 bp, Artificial Sequence
  Synthetic DNA
cattacagcttaatttag

SEQ ID NO: 47264 - DNA, 18 bp, Artificial Sequence
  Synthetic DNA
cattacatatcactaaag

SEQ ID NO: 47265 - DNA, 18 bp, Artificial Sequence
  Synthetic DNA
cattaccactctatctag

SEQ ID NO: 47266 - DNA, 18 bp, Artificial Sequence
  Synthetic DNA
cattacccaccactatag

SEQ ID NO: 47267 - DNA, 18 bp, Artificial Sequence
  Synthetic DNA
cattacgaatctctattg

SEQ ID NO: 47268 - DNA, 18 bp, Artificial Sequence
  Synthetic DNA
cattacgactaatatatg

SEQ ID NO: 47269 - DNA, 18 bp, Artificial Sequence
  Synthetic DNA
cattacgactcactgggg

SEQ ID NO: 47270 - DNA, 18 bp, Artificial Sequence
  Synthetic DNA
cattacgtttcaaaatag

SEQ ID NO: 47271 - DNA, 18 bp, Artificial Sequence
  Synthetic DNA
cattactactcactcctg

SEQ ID NO: 47272 - DNA, 18 bp, Artificial Sequence
  Synthetic DNA
cattacttctcagtatag

SEQ ID NO: 47273 - DNA, 18 bp, Artificial Sequence
  Synthetic DNA
cattaggtctcactcaag

SEQ ID NO: 47274 - DNA, 18 bp, Artificial Sequence
  Synthetic DNA
cattatgactcacagtag

SEQ ID NO: 47275 - DNA, 18 bp, Artificial Sequence
  Synthetic DNA
cattattactcaataaag

SEQ ID NO: 47276 - DNA, 18 bp, Artificial Sequence
  Synthetic DNA
cattccgacactctatag

SEQ ID NO: 47277 - DNA, 18 bp, Artificial Sequence
  Synthetic DNA
cattgctacactctatag

SEQ ID NO: 47278 - DNA, 18 bp, Artificial Sequence
  Synthetic DNA
catttcgcctctctatag

SEQ ID NO: 47279 - DNA, 18 bp, Artificial Sequence
  Synthetic DNA
catttcggcagattatag

SEQ ID NO: 47280 - DNA, 18 bp, Artificial Sequence
  Synthetic DNA
catttcggctcactacag

SEQ ID NO: 47281 - DNA, 18 bp, Artificial Sequence
  Synthetic DNA
catttcgtctcacaagag

SEQ ID NO: 47282 - DNA, 18 bp, Artificial Sequence
  Synthetic DNA
catttcgtttccctagag

SEQ ID NO: 47283 - DNA, 18 bp, Artificial Sequence
  Synthetic DNA
catttcgtttccctgtag

SEQ ID NO: 47284 - DNA, 18 bp, Artificial Sequence
  Synthetic DNA
ccaaacgacgcgctatgg

SEQ ID NO: 47285 - DNA, 18 bp, Artificial Sequence
  Synthetic DNA
ccaaacgacgctctaaag

SEQ ID NO: 47286 - DNA, 18 bp, Artificial Sequence
  Synthetic DNA
ccaaacgactcagtttag

SEQ ID NO: 47287 - DNA, 18 bp, Artificial Sequence
  Synthetic DNA
ccacacgactctcgatag

SEQ ID NO: 47288 - DNA, 18 bp, Artificial Sequence
  Synthetic DNA
ccacacgccacactatag

SEQ ID NO: 47289 - DNA, 18 bp, Artificial Sequence
  Synthetic DNA
ccacagttctcactattg

SEQ ID NO: 47290 - DNA, 18 bp, Artificial Sequence
  Synthetic DNA
ccagacgactcgttatcg

SEQ ID NO: 47291 - DNA, 18 bp, Artificial Sequence
  Synthetic DNA
ccatacgactcacagcag

SEQ ID NO: 47292 - DNA, 18 bp, Artificial Sequence
  Synthetic DNA
ccatacgtcccacaatgg

SEQ ID NO: 47293 - DNA, 18 bp, Artificial Sequence
  Synthetic DNA
ccataggaattataatag

SEQ ID NO: 47294 - DNA, 18 bp, Artificial Sequence
  Synthetic DNA
ccattagactcattatgg

SEQ ID NO: 47295 - DNA, 18 bp, Artificial Sequence
  Synthetic DNA
ccattggactaactattg

SEQ ID NO: 47296 - DNA, 18 bp, Artificial Sequence
  Synthetic DNA
ccgcaggtctcactatgg

SEQ ID NO: 47297 - DNA, 18 bp, Artificial Sequence
  Synthetic DNA
cctaacgaatgacaatag

SEQ ID NO: 47298 - DNA, 18 bp, Artificial Sequence
  Synthetic DNA
cctaacgattcactatag

SEQ ID NO: 47299 - DNA, 18 bp, Artificial Sequence
  Synthetic DNA
cctaccgactcgctattg

SEQ ID NO: 47300 - DNA, 18 bp, Artificial Sequence
  Synthetic DNA
ccttctgtcttaaaattg

SEQ ID NO: 47301 - DNA, 18 bp, Artificial Sequence
  Synthetic DNA
ccttgcgtctctcactag

SEQ ID NO: 47302 - DNA, 18 bp, Artificial Sequence
  Synthetic DNA
cgaaacgaatcagcgaag

SEQ ID NO: 47303 - DNA, 18 bp, Artificial Sequence
  Synthetic DNA
cgaaacgactaacttacg

SEQ ID NO: 47304 - DNA, 18 bp, Artificial Sequence
  Synthetic DNA
cgaaacgacttactttag

SEQ ID NO: 47305 - DNA, 18 bp, Artificial Sequence
  Synthetic DNA
cgaatcgcctcactatag

SEQ ID NO: 47306 - DNA, 18 bp, Artificial Sequence
  Synthetic DNA
cgatacgaattactatcg

SEQ ID NO: 47307 - DNA, 18 bp, Artificial Sequence
  Synthetic DNA
cgatacgaattcctatag

SEQ ID NO: 47308 - DNA, 18 bp, Artificial Sequence
  Synthetic DNA
cgatacgattgactctag

SEQ ID NO: 47309 - DNA, 18 bp, Artificial Sequence
  Synthetic DNA
cgatacggctcactcaag

SEQ ID NO: 47310 - DNA, 18 bp, Artificial Sequence
  Synthetic DNA
cgatacgtataagtatag

SEQ ID NO: 47311 - DNA, 18 bp, Artificial Sequence
  Synthetic DNA
cgataggactctccatag

SEQ ID NO: 47312 - DNA, 18 bp, Artificial Sequence
  Synthetic DNA
cgatgcttctcaatgtag

SEQ ID NO: 47313 - DNA, 18 bp, Artificial Sequence
  Synthetic DNA
cgattcgactttcaatag

SEQ ID NO: 47314 - DNA, 18 bp, Artificial Sequence
  Synthetic DNA
cgctatcgcatactatag

SEQ ID NO: 47315 - DNA, 18 bp, Artificial Sequence
  Synthetic DNA
cggtacacctcattatag

SEQ ID NO: 47316 - DNA, 18 bp, Artificial Sequence
  Synthetic DNA
cggtacgactcaatactg

SEQ ID NO: 47317 - DNA, 18 bp, Artificial Sequence
  Synthetic DNA
cggttcgtatcattttag

SEQ ID NO: 47318 - DNA, 18 bp, Artificial Sequence
  Synthetic DNA
cgtaacgactctctatag

SEQ ID NO: 47319 - DNA, 18 bp, Artificial Sequence
  Synthetic DNA
ctaaaagaatctcctaag

SEQ ID NO: 47320 - DNA, 18 bp, Artificial Sequence
  Synthetic DNA
ctaaacgaacctctatag

SEQ ID NO: 47321 - DNA, 18 bp, Artificial Sequence
  Synthetic DNA
ctaaacgactttccaaag

SEQ ID NO: 47322 - DNA, 18 bp, Artificial Sequence
  Synthetic DNA
ctaaacgtccaattagtg

SEQ ID NO: 47323 - DNA, 18 bp, Artificial Sequence
  Synthetic DNA
ctaaatctcggaattgag

SEQ ID NO: 47324 - DNA, 18 bp, Artificial Sequence
  Synthetic DNA
ctaaccgacccactatag

SEQ ID NO: 47325 - DNA, 18 bp, Artificial Sequence
  Synthetic DNA
ctaatcgacttactaaag

SEQ ID NO: 47326 - DNA, 18 bp, Artificial Sequence
  Synthetic DNA
ctacaagtcaaacaatag

SEQ ID NO: 47327 - DNA, 18 bp, Artificial Sequence
  Synthetic DNA
ctacacggcacactatag

SEQ ID NO: 47328 - DNA, 18 bp, Artificial Sequence
  Synthetic DNA
ctacttgacttaccctag

SEQ ID NO: 47329 - DNA, 18 bp, Artificial Sequence
  Synthetic DNA
ctagatcactcaaattcg

SEQ ID NO: 47330 - DNA, 18 bp, Artificial Sequence
  Synthetic DNA
ctataaaacatactattg

SEQ ID NO: 47331 - DNA, 18 bp, Artificial Sequence
  Synthetic DNA
ctataagactcactaatg

SEQ ID NO: 47332 - DNA, 18 bp, Artificial Sequence
  Synthetic DNA
ctataagtgtacgtatag

SEQ ID NO: 47333 - DNA, 18 bp, Artificial Sequence
  Synthetic DNA
ctatacaactctctttag

SEQ ID NO: 47334 - DNA, 18 bp, Artificial Sequence
  Synthetic DNA
ctatacaagtctctttag

SEQ ID NO: 47335 - DNA, 18 bp, Artificial Sequence
  Synthetic DNA
ctatacaatactctacag

SEQ ID NO: 47336 - DNA, 18 bp, Artificial Sequence
  Synthetic DNA
ctataccactaactttag

SEQ ID NO: 47337 - DNA, 18 bp, Artificial Sequence
  Synthetic DNA
ctatacgaagcactgtag

SEQ ID NO: 47338 - DNA, 18 bp, Artificial Sequence
  Synthetic DNA
ctatacgaatctagactg

SEQ ID NO: 47339 - DNA, 18 bp, Artificial Sequence
  Synthetic DNA
ctatacgactcatactgg

SEQ ID NO: 47340 - DNA, 18 bp, Artificial Sequence
  Synthetic DNA
ctatacgccactctatag

SEQ ID NO: 47341 - DNA, 18 bp, Artificial Sequence
  Synthetic DNA
ctatacggcccactttag

SEQ ID NO: 47342 - DNA, 18 bp, Artificial Sequence
  Synthetic DNA
ctatacggcgcactttag

SEQ ID NO: 47343 - DNA, 18 bp, Artificial Sequence
  Synthetic DNA
ctatacggctcattattg

SEQ ID NO: 47344 - DNA, 18 bp, Artificial Sequence
  Synthetic DNA
ctatacgtcactgtatag

SEQ ID NO: 47345 - DNA, 18 bp, Artificial Sequence
  Synthetic DNA
ctatacgtctccctctag

SEQ ID NO: 47346 - DNA, 18 bp, Artificial Sequence
  Synthetic DNA
ctatacgtttctctatag

SEQ ID NO: 47347 - DNA, 18 bp, Artificial Sequence
  Synthetic DNA
ctatactactctctaatg

SEQ ID NO: 47348 - DNA, 18 bp, Artificial Sequence
  Synthetic DNA
ctatacttcacattaaag

SEQ ID NO: 47349 - DNA, 18 bp, Artificial Sequence
  Synthetic DNA
ctatagagctcactatag

SEQ ID NO: 47350 - DNA, 18 bp, Artificial Sequence
  Synthetic DNA
ctataggtctagctatag

SEQ ID NO: 47351 - DNA, 18 bp, Artificial Sequence
  Synthetic DNA
ctataggtctcacaattg

SEQ ID NO: 47352 - DNA, 18 bp, Artificial Sequence
  Synthetic DNA
ctatatgacaatctatag

SEQ ID NO: 47353 - DNA, 18 bp, Artificial Sequence
  Synthetic DNA
ctatattatttataatag

SEQ ID NO: 47354 - DNA, 18 bp, Artificial Sequence
  Synthetic DNA
ctatccgaataactttcg

SEQ ID NO: 47355 - DNA, 18 bp, Artificial Sequence
  Synthetic DNA
ctatgagacttactaaag

SEQ ID NO: 47356 - DNA, 18 bp, Artificial Sequence
  Synthetic DNA
ctatgccactcactttag

SEQ ID NO: 47357 - DNA, 18 bp, Artificial Sequence
  Synthetic DNA
ctatgctaatcactatag

SEQ ID NO: 47358 - DNA, 18 bp, Artificial Sequence
  Synthetic DNA
ctattccacacgttatgg

SEQ ID NO: 47359 - DNA, 18 bp, Artificial Sequence
  Synthetic DNA
ctattctactctcgatag

SEQ ID NO: 47360 - DNA, 18 bp, Artificial Sequence
  Synthetic DNA
ctatttgactcactctag

SEQ ID NO: 47361 - DNA, 18 bp, Artificial Sequence
  Synthetic DNA
ctctaagtcttacaacag

SEQ ID NO: 47362 - DNA, 18 bp, Artificial Sequence
  Synthetic DNA
ctctaatattaactcaag

SEQ ID NO: 47363 - DNA, 18 bp, Artificial Sequence
  Synthetic DNA
ctctacgactcgatatag

SEQ ID NO: 47364 - DNA, 18 bp, Artificial Sequence
  Synthetic DNA
ctctacgactctcaacag

SEQ ID NO: 47365 - DNA, 18 bp, Artificial Sequence
  Synthetic DNA
ctgaacgactagcttaag

SEQ ID NO: 47366 - DNA, 18 bp, Artificial Sequence
  Synthetic DNA
ctgcaggaatcactatcg

SEQ ID NO: 47367 - DNA, 18 bp, Artificial Sequence
  Synthetic DNA
ctgtaagactctcaatag

SEQ ID NO: 47368 - DNA, 18 bp, Artificial Sequence
  Synthetic DNA
ctgtacgacaatcattag

SEQ ID NO: 47369 - DNA, 18 bp, Artificial Sequence
  Synthetic DNA
ctgtacgacgcccaacag

SEQ ID NO: 47370 - DNA, 18 bp, Artificial Sequence
  Synthetic DNA
ctgtacgagaaactgtag

SEQ ID NO: 47371 - DNA, 18 bp, Artificial Sequence
  Synthetic DNA
ctgtacgtatcactatag

SEQ ID NO: 47372 - DNA, 18 bp, Artificial Sequence
  Synthetic DNA
ctgtatgactcactctag

SEQ ID NO: 47373 - DNA, 18 bp, Artificial Sequence
  Synthetic DNA
cttaacctttcaatatag

SEQ ID NO: 47374 - DNA, 18 bp, Artificial Sequence
  Synthetic DNA
cttaacgtctgtgtaaag

SEQ ID NO: 47375 - DNA, 18 bp, Artificial Sequence
  Synthetic DNA
cttagcgactcactatag

SEQ ID NO: 47376 - DNA, 18 bp, Artificial Sequence
  Synthetic DNA
cttatctacacactttag

SEQ ID NO: 47377 - DNA, 18 bp, Artificial Sequence
  Synthetic DNA
ctttacgacttcctagag

SEQ ID NO: 47378 - DNA, 18 bp, Artificial Sequence
  Synthetic DNA
ctttacgttttaacatag

SEQ ID NO: 47379 - DNA, 18 bp, Artificial Sequence
  Synthetic DNA
ctttccgtctcactattg

SEQ ID NO: 47380 - DNA, 18 bp, Artificial Sequence
  Synthetic DNA
gaaaacgactaaatacag

SEQ ID NO: 47381 - DNA, 18 bp, Artificial Sequence
  Synthetic DNA
gaaaacgactctctaacg

SEQ ID NO: 47382 - DNA, 18 bp, Artificial Sequence
  Synthetic DNA
gaaatcaatttgctttag

SEQ ID NO: 47383 - DNA, 18 bp, Artificial Sequence
  Synthetic DNA
gaaatcgtatcacaattg

SEQ ID NO: 47384 - DNA, 18 bp, Artificial Sequence
  Synthetic DNA
gaacactatacactagag

SEQ ID NO: 47385 - DNA, 18 bp, Artificial Sequence
  Synthetic DNA
gaacacttctctctcaag

SEQ ID NO: 47386 - DNA, 18 bp, Artificial Sequence
  Synthetic DNA
gaacatgacaaactaaag

SEQ ID NO: 47387 - DNA, 18 bp, Artificial Sequence
  Synthetic DNA
gaacatgagtctcaatag

SEQ ID NO: 47388 - DNA, 18 bp, Artificial Sequence
  Synthetic DNA
gaacccgactcacgtttg

SEQ ID NO: 47389 - DNA, 18 bp, Artificial Sequence
  Synthetic DNA
gaagacgaatccctattg

SEQ ID NO: 47390 - DNA, 18 bp, Artificial Sequence
  Synthetic DNA
gaagacgtctcgctatgg

SEQ ID NO: 47391 - DNA, 18 bp, Artificial Sequence
  Synthetic DNA
gaataagacacacttttg

SEQ ID NO: 47392 - DNA, 18 bp, Artificial Sequence
  Synthetic DNA
gaataaggctctctagtg

SEQ ID NO: 47393 - DNA, 18 bp, Artificial Sequence
  Synthetic DNA
gaatacgaatcaattttg

SEQ ID NO: 47394 - DNA, 18 bp, Artificial Sequence
  Synthetic DNA
gaatacgacccccactag

SEQ ID NO: 47395 - DNA, 18 bp, Artificial Sequence
  Synthetic DNA
gaatactactctcttatg

SEQ ID NO: 47396 - DNA, 18 bp, Artificial Sequence
  Synthetic DNA
gaatacttctaattaaag

SEQ ID NO: 47397 - DNA, 18 bp, Artificial Sequence
  Synthetic DNA
gaatacttctcactactg

SEQ ID NO: 47398 - DNA, 18 bp, Artificial Sequence
  Synthetic DNA
gaataggtctcaataaag

SEQ ID NO: 47399 - DNA, 18 bp, Artificial Sequence
  Synthetic DNA
gaatatataagacatttg

SEQ ID NO: 47400 - DNA, 18 bp, Artificial Sequence
  Synthetic DNA
gaatatcacttactttag

SEQ ID NO: 47401 - DNA, 18 bp, Artificial Sequence
  Synthetic DNA
gaatatggttgactacag

SEQ ID NO: 47402 - DNA, 18 bp, Artificial Sequence
  Synthetic DNA
gaatattatccactatag

SEQ ID NO: 47403 - DNA, 18 bp, Artificial Sequence
  Synthetic DNA
gaatccgaattacaattg

SEQ ID NO: 47404 - DNA, 18 bp, Artificial Sequence
  Synthetic DNA
gaatccgactcctcatag

SEQ ID NO: 47405 - DNA, 18 bp, Artificial Sequence
  Synthetic DNA
gaatccgtccaactatag

SEQ ID NO: 47406 - DNA, 18 bp, Artificial Sequence
  Synthetic DNA
gaatcctacttactaaag

SEQ ID NO: 47407 - DNA, 18 bp, Artificial Sequence
  Synthetic DNA
gaatgcgtctcaaaatag

SEQ ID NO: 47408 - DNA, 18 bp, Artificial Sequence
  Synthetic DNA
gaattcaactaacattag

SEQ ID NO: 47409 - DNA, 18 bp, Artificial Sequence
  Synthetic DNA
gaattcaactcacaatcg

SEQ ID NO: 47410 - DNA, 18 bp, Artificial Sequence
  Synthetic DNA
gaattcgacaacttattg

SEQ ID NO: 47411 - DNA, 18 bp, Artificial Sequence
  Synthetic DNA
gaattcgtctaactaatg

SEQ ID NO: 47412 - DNA, 18 bp, Artificial Sequence
  Synthetic DNA
gaattctacccgctatag

SEQ ID NO: 47413 - DNA, 18 bp, Artificial Sequence
  Synthetic DNA
gaattgtactcactacag

SEQ ID NO: 47414 - DNA, 18 bp, Artificial Sequence
  Synthetic DNA
gaatttgactctctatgg

SEQ ID NO: 47415 - DNA, 18 bp, Artificial Sequence
  Synthetic DNA
gaattttatccactttag

SEQ ID NO: 47416 - DNA, 18 bp, Artificial Sequence
  Synthetic DNA
gacaacgagttactatag

SEQ ID NO: 47417 - DNA, 18 bp, Artificial Sequence
  Synthetic DNA
gactacgacactatacag

SEQ ID NO: 47418 - DNA, 18 bp, Artificial Sequence
  Synthetic DNA
gactacgaccccctctag

SEQ ID NO: 47419 - DNA, 18 bp, Artificial Sequence
  Synthetic DNA
gactacgagtctatgtag

SEQ ID NO: 47420 - DNA, 18 bp, Artificial Sequence
  Synthetic DNA
gactccgagtccagatgg

SEQ ID NO: 47421 - DNA, 18 bp, Artificial Sequence
  Synthetic DNA
gacttaatatcgccttag

SEQ ID NO: 47422 - DNA, 18 bp, Artificial Sequence
  Synthetic DNA
gacttcaactaggtatag

SEQ ID NO: 47423 - DNA, 18 bp, Artificial Sequence
  Synthetic DNA
gacttcttcccttaatag

SEQ ID NO: 47424 - DNA, 18 bp, Artificial Sequence
  Synthetic DNA
gagaacgattcactttag

SEQ ID NO: 47425 - DNA, 18 bp, Artificial Sequence
  Synthetic DNA
gaggatgactcactgaag

SEQ ID NO: 47426 - DNA, 18 bp, Artificial Sequence
  Synthetic DNA
gagtaagtctcattatag

SEQ ID NO: 47427 - DNA, 18 bp, Artificial Sequence
  Synthetic DNA
gagtaggactcataattg

SEQ ID NO: 47428 - DNA, 18 bp, Artificial Sequence
  Synthetic DNA
gataacgacgaactattg

SEQ ID NO: 47429 - DNA, 18 bp, Artificial Sequence
  Synthetic DNA
gataacggcttactatag

SEQ ID NO: 47430 - DNA, 18 bp, Artificial Sequence
  Synthetic DNA
gataacgtcccagtattg

SEQ ID NO: 47431 - DNA, 18 bp, Artificial Sequence
  Synthetic DNA
gatcacgacttactatgg

SEQ ID NO: 47432 - DNA, 18 bp, Artificial Sequence
  Synthetic DNA
gatcactacacatttcag

SEQ ID NO: 47433 - DNA, 18 bp, Artificial Sequence
  Synthetic DNA
gattacgaatcataaaag

SEQ ID NO: 47434 - DNA, 18 bp, Artificial Sequence
  Synthetic DNA
gattacgattcattagag

SEQ ID NO: 47435 - DNA, 18 bp, Artificial Sequence
  Synthetic DNA
gattacgttttactattg

SEQ ID NO: 47436 - DNA, 18 bp, Artificial Sequence
  Synthetic DNA
gattagtactgactatag

SEQ ID NO: 47437 - DNA, 18 bp, Artificial Sequence
  Synthetic DNA
gattataaattactatag

SEQ ID NO: 47438 - DNA, 18 bp, Artificial Sequence
  Synthetic DNA
gattgagattctgagtag

SEQ ID NO: 47439 - DNA, 18 bp, Artificial Sequence
  Synthetic DNA
gattgcgacggtcttttg

SEQ ID NO: 47440 - DNA, 18 bp, Artificial Sequence
  Synthetic DNA
gatttcgaatctctatag

SEQ ID NO: 47441 - DNA, 18 bp, Artificial Sequence
  Synthetic DNA
gatttcggctcactaaag

SEQ ID NO: 47442 - DNA, 18 bp, Artificial Sequence
  Synthetic DNA
gatttcgtctctctattg

SEQ ID NO: 47443 - DNA, 18 bp, Artificial Sequence
  Synthetic DNA
gcaaacgattctatgtag

SEQ ID NO: 47444 - DNA, 18 bp, Artificial Sequence
  Synthetic DNA
gcactcgacagactatag

SEQ ID NO: 47445 - DNA, 18 bp, Artificial Sequence
  Synthetic DNA
gcagttgcatcactattg

SEQ ID NO: 47446 - DNA, 18 bp, Artificial Sequence
  Synthetic DNA
gcatactattcaatatag

SEQ ID NO: 47447 - DNA, 18 bp, Artificial Sequence
  Synthetic DNA
gcattcgactgacttaag

SEQ ID NO: 47448 - DNA, 18 bp, Artificial Sequence
  Synthetic DNA
gcatttgaagctctatgg

SEQ ID NO: 47449 - DNA, 18 bp, Artificial Sequence
  Synthetic DNA
gcttatgtaccactatag

SEQ ID NO: 47450 - DNA, 18 bp, Artificial Sequence
  Synthetic DNA
gcttgctactctctatag

SEQ ID NO: 47451 - DNA, 18 bp, Artificial Sequence
  Synthetic DNA
gctttccccttactttag

SEQ ID NO: 47452 - DNA, 18 bp, Artificial Sequence
  Synthetic DNA
ggaaacgactcataatag

SEQ ID NO: 47453 - DNA, 18 bp, Artificial Sequence
  Synthetic DNA
ggaggcgactcactattg

SEQ ID NO: 47454 - DNA, 18 bp, Artificial Sequence
  Synthetic DNA
ggattaacctcactatag

SEQ ID NO: 47455 - DNA, 18 bp, Artificial Sequence
  Synthetic DNA
ggctagaactcaccctag

SEQ ID NO: 47456 - DNA, 18 bp, Artificial Sequence
  Synthetic DNA
ggttgcgactcttcttgg

SEQ ID NO: 47457 - DNA, 18 bp, Artificial Sequence
  Synthetic DNA
gtaaacaattgactatag

SEQ ID NO: 47458 - DNA, 18 bp, Artificial Sequence
  Synthetic DNA
gtaaacgattcactaaag

SEQ ID NO: 47459 - DNA, 18 bp, Artificial Sequence
  Synthetic DNA
gtagatgactttctatgg

SEQ ID NO: 47460 - DNA, 18 bp, Artificial Sequence
  Synthetic DNA
gtataaaacgtactaaag

SEQ ID NO: 47461 - DNA, 18 bp, Artificial Sequence
  Synthetic DNA
gtataagtcacataagag

SEQ ID NO: 47462 - DNA, 18 bp, Artificial Sequence
  Synthetic DNA
gtatacgactctctgtcg

SEQ ID NO: 47463 - DNA, 18 bp, Artificial Sequence
  Synthetic DNA
gtatatgactctaaatag

SEQ ID NO: 47464 - DNA, 18 bp, Artificial Sequence
  Synthetic DNA
gtatatttctcacaatag

SEQ ID NO: 47465 - DNA, 18 bp, Artificial Sequence
  Synthetic DNA
gtatcagactatatatag

SEQ ID NO: 47466 - DNA, 18 bp, Artificial Sequence
  Synthetic DNA
gtatccgatgcactatag

SEQ ID NO: 47467 - DNA, 18 bp, Artificial Sequence
  Synthetic DNA
gtatgcgcttcacagttg

SEQ ID NO: 47468 - DNA, 18 bp, Artificial Sequence
  Synthetic DNA
gtattagactctcttaag

SEQ ID NO: 47469 - DNA, 18 bp, Artificial Sequence
  Synthetic DNA
gtattcgactttctatag

SEQ ID NO: 47470 - DNA, 18 bp, Artificial Sequence
  Synthetic DNA
gtctaccactctataaag

SEQ ID NO: 47471 - DNA, 18 bp, Artificial Sequence
  Synthetic DNA
gtgaacgtctaactctag

SEQ ID NO: 47472 - DNA, 18 bp, Artificial Sequence
  Synthetic DNA
gtgtactacacaatattg

SEQ ID NO: 47473 - DNA, 18 bp, Artificial Sequence
  Synthetic DNA
gtttaattctcacagacg

SEQ ID NO: 47474 - DNA, 18 bp, Artificial Sequence
  Synthetic DNA
gtttacgaaacaaattag

SEQ ID NO: 47475 - DNA, 18 bp, Artificial Sequence
  Synthetic DNA
gttttcaactaactctcg

SEQ ID NO: 47476 - DNA, 18 bp, Artificial Sequence
  Synthetic DNA
taaaaaatctatctatag

SEQ ID NO: 47477 - DNA, 18 bp, Artificial Sequence
  Synthetic DNA
taaaaacactcattatcg

SEQ ID NO: 47478 - DNA, 18 bp, Artificial Sequence
  Synthetic DNA
taaaaacagcccctagtg

SEQ ID NO: 47479 - DNA, 18 bp, Artificial Sequence
  Synthetic DNA
taaaaagaatcaccatgg

SEQ ID NO: 47480 - DNA, 18 bp, Artificial Sequence
  Synthetic DNA
taaaaagaatgacagtag

SEQ ID NO: 47481 - DNA, 18 bp, Artificial Sequence
  Synthetic DNA
taaaaagacacgctcatg

SEQ ID NO: 47482 - DNA, 18 bp, Artificial Sequence
  Synthetic DNA
taaaaagatcccataaag

SEQ ID NO: 47483 - DNA, 18 bp, Artificial Sequence
  Synthetic DNA
taaaaagatttctactag

SEQ ID NO: 47484 - DNA, 18 bp, Artificial Sequence
  Synthetic DNA
taaaaagccatactaaag

SEQ ID NO: 47485 - DNA, 18 bp, Artificial Sequence
  Synthetic DNA
taaaaagcctcaccattg

SEQ ID NO: 47486 - DNA, 18 bp, Artificial Sequence
  Synthetic DNA
taaaaagtcacactttcg

SEQ ID NO: 47487 - DNA, 18 bp, Artificial Sequence
  Synthetic DNA
taaaaagtcctcttattg

SEQ ID NO: 47488 - DNA, 18 bp, Artificial Sequence
  Synthetic DNA
taaaaagtctcacccttg

SEQ ID NO: 47489 - DNA, 18 bp, Artificial Sequence
  Synthetic DNA
taaaaagtctcattttcg

SEQ ID NO: 47490 - DNA, 18 bp, Artificial Sequence
  Synthetic DNA
taaaaagtctcgccatag

SEQ ID NO: 47491 - DNA, 18 bp, Artificial Sequence
  Synthetic DNA
taaaaagtctgtttgttg

SEQ ID NO: 47492 - DNA, 18 bp, Artificial Sequence
  Synthetic DNA
taaaaagtgaccctttcg

SEQ ID NO: 47493 - DNA, 18 bp, Artificial Sequence
  Synthetic DNA
taaaaagtttcaccaagg

SEQ ID NO: 47494 - DNA, 18 bp, Artificial Sequence
  Synthetic DNA
taaaaatacacgatatag

SEQ ID NO: 47495 - DNA, 18 bp, Artificial Sequence
  Synthetic DNA
taaaaatacactctacag

SEQ ID NO: 47496 - DNA, 18 bp, Artificial Sequence
  Synthetic DNA
taaaaatattctctatag

SEQ ID NO: 47497 - DNA, 18 bp, Artificial Sequence
  Synthetic DNA
taaaacaacacatagtag

SEQ ID NO: 47498 - DNA, 18 bp, Artificial Sequence
  Synthetic DNA
taaaacaactaacttatg

SEQ ID NO: 47499 - DNA, 18 bp, Artificial Sequence
  Synthetic DNA
taaaacaactcaaaagag

SEQ ID NO: 47500 - DNA, 18 bp, Artificial Sequence
  Synthetic DNA
taaaacaactcaaatttg

SEQ ID NO: 47501 - DNA, 18 bp, Artificial Sequence
  Synthetic DNA
taaaacaactccataaag

SEQ ID NO: 47502 - DNA, 18 bp, Artificial Sequence
  Synthetic DNA
taaaacaactcgcaaaag

SEQ ID NO: 47503 - DNA, 18 bp, Artificial Sequence
  Synthetic DNA
taaaacaactgatttatg

SEQ ID NO: 47504 - DNA, 18 bp, Artificial Sequence
  Synthetic DNA
taaaacaagacattaaag

SEQ ID NO: 47505 - DNA, 18 bp, Artificial Sequence
  Synthetic DNA
taaaacaatccgtatgag

SEQ ID NO: 47506 - DNA, 18 bp, Artificial Sequence
  Synthetic DNA
taaaacaattctctctag

SEQ ID NO: 47507 - DNA, 18 bp, Artificial Sequence
  Synthetic DNA
taaaacatctcaccaaag

SEQ ID NO: 47508 - DNA, 18 bp, Artificial Sequence
  Synthetic DNA
taaaacatctctctgtag

SEQ ID NO: 47509 - DNA, 18 bp, Artificial Sequence
  Synthetic DNA
taaaaccaatctcaatag

SEQ ID NO: 47510 - DNA, 18 bp, Artificial Sequence
  Synthetic DNA
taaaaccacccacattag

SEQ ID NO: 47511 - DNA, 18 bp, Artificial Sequence
  Synthetic DNA
taaaaccactgaatattg

SEQ ID NO: 47512 - DNA, 18 bp, Artificial Sequence
  Synthetic DNA
taaaaccactttctaaag

SEQ ID NO: 47513 - DNA, 18 bp, Artificial Sequence
  Synthetic DNA
taaaaccagtaattattg

SEQ ID NO: 47514 - DNA, 18 bp, Artificial Sequence
  Synthetic DNA
taaaaccattctaattag

SEQ ID NO: 47515 - DNA, 18 bp, Artificial Sequence
  Synthetic DNA
taaaaccattgtctaaag

SEQ ID NO: 47516 - DNA, 18 bp, Artificial Sequence
  Synthetic DNA
taaaacccctgtctacag

SEQ ID NO: 47517 - DNA, 18 bp, Artificial Sequence
  Synthetic DNA
taaaaccccttgttatag

SEQ ID NO: 47518 - DNA, 18 bp, Artificial Sequence
  Synthetic DNA
taaaacctcacactgtag

SEQ ID NO: 47519 - DNA, 18 bp, Artificial Sequence
  Synthetic DNA
taaaacctctcctaaatg

SEQ ID NO: 47520 - DNA, 18 bp, Artificial Sequence
  Synthetic DNA
taaaacgaaaaagtattg

SEQ ID NO: 47521 - DNA, 18 bp, Artificial Sequence
  Synthetic DNA
taaaacgaaacgctaaag

SEQ ID NO: 47522 - DNA, 18 bp, Artificial Sequence
  Synthetic DNA
taaaacgaatatctacag

SEQ ID NO: 47523 - DNA, 18 bp, Artificial Sequence
  Synthetic DNA
taaaacgaatcactcatg

SEQ ID NO: 47524 - DNA, 18 bp, Artificial Sequence
  Synthetic DNA
taaaacgaatcccagtag

SEQ ID NO: 47525 - DNA, 18 bp, Artificial Sequence
  Synthetic DNA
taaaacgaatcgcattgg

SEQ ID NO: 47526 - DNA, 18 bp, Artificial Sequence
  Synthetic DNA
taaaacgacaatctaatg

SEQ ID NO: 47527 - DNA, 18 bp, Artificial Sequence
  Synthetic DNA
taaaacgacactgtctag

SEQ ID NO: 47528 - DNA, 18 bp, Artificial Sequence
  Synthetic DNA
taaaacgacagacattag

SEQ ID NO: 47529 - DNA, 18 bp, Artificial Sequence
  Synthetic DNA
taaaacgacatacagtgg

SEQ ID NO: 47530 - DNA, 18 bp, Artificial Sequence
  Synthetic DNA
taaaacgaccctattcag

SEQ ID NO: 47531 - DNA, 18 bp, Artificial Sequence
  Synthetic DNA
taaaacgacctccaaaag

SEQ ID NO: 47532 - DNA, 18 bp, Artificial Sequence
  Synthetic DNA
taaaacgactcaaaaatg

SEQ ID NO: 47533 - DNA, 18 bp, Artificial Sequence
  Synthetic DNA
taaaacgactcgttgttg

SEQ ID NO: 47534 - DNA, 18 bp, Artificial Sequence
  Synthetic DNA
taaaacgactgcacattg

SEQ ID NO: 47535 - DNA, 18 bp, Artificial Sequence
  Synthetic DNA
taaaacgactttcagtcg

SEQ ID NO: 47536 - DNA, 18 bp, Artificial Sequence
  Synthetic DNA
taaaacgagtaactgcag

SEQ ID NO: 47537 - DNA, 18 bp, Artificial Sequence
  Synthetic DNA
taaaacgagtgaaaatag

SEQ ID NO: 47538 - DNA, 18 bp, Artificial Sequence
  Synthetic DNA
taaaacgatctaatatag

SEQ ID NO: 47539 - DNA, 18 bp, Artificial Sequence
  Synthetic DNA
taaaacgattcacttctg

SEQ ID NO: 47540 - DNA, 18 bp, Artificial Sequence
  Synthetic DNA
taaaacgcatctctagag

SEQ ID NO: 47541 - DNA, 18 bp, Artificial Sequence
  Synthetic DNA
taaaacgccaaaatatag

SEQ ID NO: 47542 - DNA, 18 bp, Artificial Sequence
  Synthetic DNA
taaaacgcccctctacgg

SEQ ID NO: 47543 - DNA, 18 bp, Artificial Sequence
  Synthetic DNA
taaaacgcctcattagtg

SEQ ID NO: 47544 - DNA, 18 bp, Artificial Sequence
  Synthetic DNA
taaaacgccttccttaag

SEQ ID NO: 47545 - DNA, 18 bp, Artificial Sequence
  Synthetic DNA
taaaacggctacttatag

SEQ ID NO: 47546 - DNA, 18 bp, Artificial Sequence
  Synthetic DNA
taaaacggctatcttttg

SEQ ID NO: 47547 - DNA, 18 bp, Artificial Sequence
  Synthetic DNA
taaaacggcttattttag

SEQ ID NO: 47548 - DNA, 18 bp, Artificial Sequence
  Synthetic DNA
taaaacgtctaacaattg

SEQ ID NO: 47549 - DNA, 18 bp, Artificial Sequence
  Synthetic DNA
taaaacgtctcgcattag

SEQ ID NO: 47550 - DNA, 18 bp, Artificial Sequence
  Synthetic DNA
taaaacgtctcttactag

SEQ ID NO: 47551 - DNA, 18 bp, Artificial Sequence
  Synthetic DNA
taaaacgtctctttatgg

SEQ ID NO: 47552 - DNA, 18 bp, Artificial Sequence
  Synthetic DNA
taaaacgtgccattatag

SEQ ID NO: 47553 - DNA, 18 bp, Artificial Sequence
  Synthetic DNA
taaaacgtttagcttgtg

SEQ ID NO: 47554 - DNA, 18 bp, Artificial Sequence
  Synthetic DNA
taaaacgtttgtctctag

SEQ ID NO: 47555 - DNA, 18 bp, Artificial Sequence
  Synthetic DNA
taaaactacatacaatag

SEQ ID NO: 47556 - DNA, 18 bp, Artificial Sequence
  Synthetic DNA
taaaactacatcatcaag

SEQ ID NO: 47557 - DNA, 18 bp, Artificial Sequence
  Synthetic DNA
taaaactactatctaaag

SEQ ID NO: 47558 - DNA, 18 bp, Artificial Sequence
  Synthetic DNA
taaaactactcacatatg

SEQ ID NO: 47559 - DNA, 18 bp, Artificial Sequence
  Synthetic DNA
taaaactattcatgttcg

SEQ ID NO: 47560 - DNA, 18 bp, Artificial Sequence
  Synthetic DNA
taaaactcctcacagtag

SEQ ID NO: 47561 - DNA, 18 bp, Artificial Sequence
  Synthetic DNA
taaaactgcattctattg

SEQ ID NO: 47562 - DNA, 18 bp, Artificial Sequence
  Synthetic DNA
taaaacttctaactctag

SEQ ID NO: 47563 - DNA, 18 bp, Artificial Sequence
  Synthetic DNA
taaaacttctcgctagag

SEQ ID NO: 47564 - DNA, 18 bp, Artificial Sequence
  Synthetic DNA
taaaacttctctatatag

SEQ ID NO: 47565 - DNA, 18 bp, Artificial Sequence
  Synthetic DNA
taaaagaactcaacatag

SEQ ID NO: 47566 - DNA, 18 bp, Artificial Sequence
  Synthetic DNA
taaaagaactcaataagg

SEQ ID NO: 47567 - DNA, 18 bp, Artificial Sequence
  Synthetic DNA
taaaagcacatattaccg

SEQ ID NO: 47568 - DNA, 18 bp, Artificial Sequence
  Synthetic DNA
taaaaggactcatttcag

SEQ ID NO: 47569 - DNA, 18 bp, Artificial Sequence
  Synthetic DNA
taaaaggattccctcacg

SEQ ID NO: 47570 - DNA, 18 bp, Artificial Sequence
  Synthetic DNA
taaaaggcctcacaagag

SEQ ID NO: 47571 - DNA, 18 bp, Artificial Sequence
  Synthetic DNA
taaaagggttcattatag

SEQ ID NO: 47572 - DNA, 18 bp, Artificial Sequence
  Synthetic DNA
taaaaggtcttagttcag

SEQ ID NO: 47573 - DNA, 18 bp, Artificial Sequence
  Synthetic DNA
taaaagttatcacgatag

SEQ ID NO: 47574 - DNA, 18 bp, Artificial Sequence
  Synthetic DNA
taaaataactcactcttg

SEQ ID NO: 47575 - DNA, 18 bp, Artificial Sequence
  Synthetic DNA
taaaataactccctatcg

SEQ ID NO: 47576 - DNA, 18 bp, Artificial Sequence
  Synthetic DNA
taaaatatctggctagag

SEQ ID NO: 47577 - DNA, 18 bp, Artificial Sequence
  Synthetic DNA
taaaatcacttagttcag

SEQ ID NO: 47578 - DNA, 18 bp, Artificial Sequence
  Synthetic DNA
taaaatcagtctcaaaag

SEQ ID NO: 47579 - DNA, 18 bp, Artificial Sequence
  Synthetic DNA
taaaatcatttaagattg

SEQ ID NO: 47580 - DNA, 18 bp, Artificial Sequence
  Synthetic DNA
taaaatctcacactatag

SEQ ID NO: 47581 - DNA, 18 bp, Artificial Sequence
  Synthetic DNA
taaaatgaaccacaatag

SEQ ID NO: 47582 - DNA, 18 bp, Artificial Sequence
  Synthetic DNA
taaaatgacacaccgtag

SEQ ID NO: 47583 - DNA, 18 bp, Artificial Sequence
  Synthetic DNA
taaaatgacacgcaatag

SEQ ID NO: 47584 - DNA, 18 bp, Artificial Sequence
  Synthetic DNA
taaaatgaccctctttag

SEQ ID NO: 47585 - DNA, 18 bp, Artificial Sequence
  Synthetic DNA
taaaatgactctccaatg

SEQ ID NO: 47586 - DNA, 18 bp, Artificial Sequence
  Synthetic DNA
taaaatgactgcctaaag

SEQ ID NO: 47587 - DNA, 18 bp, Artificial Sequence
  Synthetic DNA
taaaatgagccacaatag

SEQ ID NO: 47588 - DNA, 18 bp, Artificial Sequence
  Synthetic DNA
taaaatgagtgactgaag

SEQ ID NO: 47589 - DNA, 18 bp, Artificial Sequence
  Synthetic DNA
taaaatgataaagtaaag

SEQ ID NO: 47590 - DNA, 18 bp, Artificial Sequence
  Synthetic DNA
taaaatgattcaatctag

SEQ ID NO: 47591 - DNA, 18 bp, Artificial Sequence
  Synthetic DNA
taaaatgattgactttag

SEQ ID NO: 47592 - DNA, 18 bp, Artificial Sequence
  Synthetic DNA
taaaatgtatgactatcg

SEQ ID NO: 47593 - DNA, 18 bp, Artificial Sequence
  Synthetic DNA
taaaatgtttctgtgtag

SEQ ID NO: 47594 - DNA, 18 bp, Artificial Sequence
  Synthetic DNA
taaaattatacaatatag

SEQ ID NO: 47595 - DNA, 18 bp, Artificial Sequence
  Synthetic DNA
taaaattattcactttag

SEQ ID NO: 47596 - DNA, 18 bp, Artificial Sequence
  Synthetic DNA
taaacaatctcaccatag

SEQ ID NO: 47597 - DNA, 18 bp, Artificial Sequence
  Synthetic DNA
taaacagactcattattg

SEQ ID NO: 47598 - DNA, 18 bp, Artificial Sequence
  Synthetic DNA
taaacagattcactgtag

SEQ ID NO: 47599 - DNA, 18 bp, Artificial Sequence
  Synthetic DNA
taaacagtctcactattg

SEQ ID NO: 47600 - DNA, 18 bp, Artificial Sequence
  Synthetic DNA
taaacatactctctatcg

SEQ ID NO: 47601 - DNA, 18 bp, Artificial Sequence
  Synthetic DNA
taaaccgaatcacaatcg

SEQ ID NO: 47602 - DNA, 18 bp, Artificial Sequence
  Synthetic DNA
taaaccgactcaattcag

SEQ ID NO: 47603 - DNA, 18 bp, Artificial Sequence
  Synthetic DNA
taaaccgatacacaatcg

SEQ ID NO: 47604 - DNA, 18 bp, Artificial Sequence
  Synthetic DNA
taaaccgtctctcagctg

SEQ ID NO: 47605 - DNA, 18 bp, Artificial Sequence
  Synthetic DNA
taaacctaccaacaatag

SEQ ID NO: 47606 - DNA, 18 bp, Artificial Sequence
  Synthetic DNA
taaacggaattactatag

SEQ ID NO: 47607 - DNA, 18 bp, Artificial Sequence
  Synthetic DNA
taaacggtctcacaaaag

SEQ ID NO: 47608 - DNA, 18 bp, Artificial Sequence
  Synthetic DNA
taaactgactcacagtag

SEQ ID NO: 47609 - DNA, 18 bp, Artificial Sequence
  Synthetic DNA
taaactgactcggaaaag

SEQ ID NO: 47610 - DNA, 18 bp, Artificial Sequence
  Synthetic DNA
taaactgactctatatag

SEQ ID NO: 47611 - DNA, 18 bp, Artificial Sequence
  Synthetic DNA
taaactgactctcaatag

SEQ ID NO: 47612 - DNA, 18 bp, Artificial Sequence
  Synthetic DNA
taaagagactctctgtag

SEQ ID NO: 47613 - DNA, 18 bp, Artificial Sequence
  Synthetic DNA
taaagagcctctctaaag

SEQ ID NO: 47614 - DNA, 18 bp, Artificial Sequence
  Synthetic DNA
taaagagtttcgctatag

SEQ ID NO: 47615 - DNA, 18 bp, Artificial Sequence
  Synthetic DNA
taaagatactaactatag

SEQ ID NO: 47616 - DNA, 18 bp, Artificial Sequence
  Synthetic DNA
taaagcaaaacactatag

SEQ ID NO: 47617 - DNA, 18 bp, Artificial Sequence
  Synthetic DNA
taaagcaagtcaccattg

SEQ ID NO: 47618 - DNA, 18 bp, Artificial Sequence
  Synthetic DNA
taaagcatttcacgatag

SEQ ID NO: 47619 - DNA, 18 bp, Artificial Sequence
  Synthetic DNA
taaagcgactccccacag

SEQ ID NO: 47620 - DNA, 18 bp, Artificial Sequence
  Synthetic DNA
taaagcgattcactgtcg

SEQ ID NO: 47621 - DNA, 18 bp, Artificial Sequence
  Synthetic DNA
taaagcgatttactaacg

SEQ ID NO: 47622 - DNA, 18 bp, Artificial Sequence
  Synthetic DNA
taaagcgtcaaactttag

SEQ ID NO: 47623 - DNA, 18 bp, Artificial Sequence
  Synthetic DNA
taaagcgtctaactattg

SEQ ID NO: 47624 - DNA, 18 bp, Artificial Sequence
  Synthetic DNA
taaagctacataccatcg

SEQ ID NO: 47625 - DNA, 18 bp, Artificial Sequence
  Synthetic DNA
taaagctacttgttagag

SEQ ID NO: 47626 - DNA, 18 bp, Artificial Sequence
  Synthetic DNA
taaagctgatctattttg

SEQ ID NO: 47627 - DNA, 18 bp, Artificial Sequence
  Synthetic DNA
taaagggactcataatag

SEQ ID NO: 47628 - DNA, 18 bp, Artificial Sequence
  Synthetic DNA
taaaggggatcactatag

SEQ ID NO: 47629 - DNA, 18 bp, Artificial Sequence
  Synthetic DNA
taaagggtttatgtttag

SEQ ID NO: 47630 - DNA, 18 bp, Artificial Sequence
  Synthetic DNA
taaaggtactcactattg

SEQ ID NO: 47631 - DNA, 18 bp, Artificial Sequence
  Synthetic DNA
taaagtgacttacggttg

SEQ ID NO: 47632 - DNA, 18 bp, Artificial Sequence
  Synthetic DNA
taaagtgagatacaaaag

SEQ ID NO: 47633 - DNA, 18 bp, Artificial Sequence
  Synthetic DNA
taaagtgagttactatag

SEQ ID NO: 47634 - DNA, 18 bp, Artificial Sequence
  Synthetic DNA
taaataaactaaatttcg

SEQ ID NO: 47635 - DNA, 18 bp, Artificial Sequence
  Synthetic DNA
taaatagactgtatttag

SEQ ID NO: 47636 - DNA, 18 bp, Artificial Sequence
  Synthetic DNA
taaatagagtcacattag

SEQ ID NO: 47637 - DNA, 18 bp, Artificial Sequence
  Synthetic DNA
taaatagatgcactaaag

SEQ ID NO: 47638 - DNA, 18 bp, Artificial Sequence
  Synthetic DNA
taaatagattaactatag

SEQ ID NO: 47639 - DNA, 18 bp, Artificial Sequence
  Synthetic DNA
taaatagtatcactatag

SEQ ID NO: 47640 - DNA, 18 bp, Artificial Sequence
  Synthetic DNA
taaatataatttctatag

SEQ ID NO: 47641 - DNA, 18 bp, Artificial Sequence
  Synthetic DNA
taaatcaaatcacaatag

SEQ ID NO: 47642 - DNA, 18 bp, Artificial Sequence
  Synthetic DNA
taaatcaacttagtatag

SEQ ID NO: 47643 - DNA, 18 bp, Artificial Sequence
  Synthetic DNA
taaatcagctcattatag

SEQ ID NO: 47644 - DNA, 18 bp, Artificial Sequence
  Synthetic DNA
taaatccaatctctgtag

SEQ ID NO: 47645 - DNA, 18 bp, Artificial Sequence
  Synthetic DNA
taaatcgaaacacaatag

SEQ ID NO: 47646 - DNA, 18 bp, Artificial Sequence
  Synthetic DNA
taaatcgaaacagttttg

SEQ ID NO: 47647 - DNA, 18 bp, Artificial Sequence
  Synthetic DNA
taaatcgacacaaaatag

SEQ ID NO: 47648 - DNA, 18 bp, Artificial Sequence
  Synthetic DNA
taaatcgacacaatctag

SEQ ID NO: 47649 - DNA, 18 bp, Artificial Sequence
  Synthetic DNA
taaatcgaccaacttttg

SEQ ID NO: 47650 - DNA, 18 bp, Artificial Sequence
  Synthetic DNA
taaatcgacccattttgg

SEQ ID NO: 47651 - DNA, 18 bp, Artificial Sequence
  Synthetic DNA
taaatcgactattttttg

SEQ ID NO: 47652 - DNA, 18 bp, Artificial Sequence
  Synthetic DNA
taaatcgactcatagttg

SEQ ID NO: 47653 - DNA, 18 bp, Artificial Sequence
  Synthetic DNA
taaatcgactctccatcg

SEQ ID NO: 47654 - DNA, 18 bp, Artificial Sequence
  Synthetic DNA
taaatcgactctctcaag

SEQ ID NO: 47655 - DNA, 18 bp, Artificial Sequence
  Synthetic DNA
taaatcgactgacaacag

SEQ ID NO: 47656 - DNA, 18 bp, Artificial Sequence
  Synthetic DNA
taaatcgagccgctttag

SEQ ID NO: 47657 - DNA, 18 bp, Artificial Sequence
  Synthetic DNA
taaatcgatatactatag

SEQ ID NO: 47658 - DNA, 18 bp, Artificial Sequence
  Synthetic DNA
taaatcgattcaccattg

SEQ ID NO: 47659 - DNA, 18 bp, Artificial Sequence
  Synthetic DNA
taaatcgattcataaaag

SEQ ID NO: 47660 - DNA, 18 bp, Artificial Sequence
  Synthetic DNA
taaatcgattctccatag

SEQ ID NO: 47661 - DNA, 18 bp, Artificial Sequence
  Synthetic DNA
taaatcgggccactttag

SEQ ID NO: 47662 - DNA, 18 bp, Artificial Sequence
  Synthetic DNA
taaatcgtctcacagttg

SEQ ID NO: 47663 - DNA, 18 bp, Artificial Sequence
  Synthetic DNA
taaatcgtctcactaacg

SEQ ID NO: 47664 - DNA, 18 bp, Artificial Sequence
  Synthetic DNA
taaatctacacgttatag

SEQ ID NO: 47665 - DNA, 18 bp, Artificial Sequence
  Synthetic DNA
taaatctactctctaaag

SEQ ID NO: 47666 - DNA, 18 bp, Artificial Sequence
  Synthetic DNA
taaatggaataactatag

SEQ ID NO: 47667 - DNA, 18 bp, Artificial Sequence
  Synthetic DNA
taaatggaatcactgcag

SEQ ID NO: 47668 - DNA, 18 bp, Artificial Sequence
  Synthetic DNA
taaatggacctactatag

SEQ ID NO: 47669 - DNA, 18 bp, Artificial Sequence
  Synthetic DNA
taaatgtattgacaatag

SEQ ID NO: 47670 - DNA, 18 bp, Artificial Sequence
  Synthetic DNA
taaattcactttctattg

SEQ ID NO: 47671 - DNA, 18 bp, Artificial Sequence
  Synthetic DNA
taaattgtctaactttag

SEQ ID NO: 47672 - DNA, 18 bp, Artificial Sequence
  Synthetic DNA
taaatttactcactttag

SEQ ID NO: 47673 - DNA, 18 bp, Artificial Sequence
  Synthetic DNA
taaattttcacaatgtag

SEQ ID NO: 47674 - DNA, 18 bp, Artificial Sequence
  Synthetic DNA
taacaaacgtgactatcg

SEQ ID NO: 47675 - DNA, 18 bp, Artificial Sequence
  Synthetic DNA
taacaacatttattaatg

SEQ ID NO: 47676 - DNA, 18 bp, Artificial Sequence
  Synthetic DNA
taacaaccctcacttttg

SEQ ID NO: 47677 - DNA, 18 bp, Artificial Sequence
  Synthetic DNA
taacaactcacactatag

SEQ ID NO: 47678 - DNA, 18 bp, Artificial Sequence
  Synthetic DNA
taacaagaatcacattag

SEQ ID NO: 47679 - DNA, 18 bp, Artificial Sequence
  Synthetic DNA
taacaagacacactcgtg

SEQ ID NO: 47680 - DNA, 18 bp, Artificial Sequence
  Synthetic DNA
taacaagacacgtgatag

SEQ ID NO: 47681 - DNA, 18 bp, Artificial Sequence
  Synthetic DNA
taacaagatccgttatag

SEQ ID NO: 47682 - DNA, 18 bp, Artificial Sequence
  Synthetic DNA
taacaagtctcacaattg

SEQ ID NO: 47683 - DNA, 18 bp, Artificial Sequence
  Synthetic DNA
taacaagtctcacgctag

SEQ ID NO: 47684 - DNA, 18 bp, Artificial Sequence
  Synthetic DNA
taacacaacacagattcg

SEQ ID NO: 47685 - DNA, 18 bp, Artificial Sequence
  Synthetic DNA
taacacaatttaataaag

SEQ ID NO: 47686 - DNA, 18 bp, Artificial Sequence
  Synthetic DNA
taacacactttcctatag

SEQ ID NO: 47687 - DNA, 18 bp, Artificial Sequence
  Synthetic DNA
taacacaggtcactctag

SEQ ID NO: 47688 - DNA, 18 bp, Artificial Sequence
  Synthetic DNA
taacacatctcaattttg

SEQ ID NO: 47689 - DNA, 18 bp, Artificial Sequence
  Synthetic DNA
taacaccactaacattgg

SEQ ID NO: 47690 - DNA, 18 bp, Artificial Sequence
  Synthetic DNA
taacaccactgtttacag

SEQ ID NO: 47691 - DNA, 18 bp, Artificial Sequence
  Synthetic DNA
taacacctcccacttaag

SEQ ID NO: 47692 - DNA, 18 bp, Artificial Sequence
  Synthetic DNA
taacacctctcacaattg

SEQ ID NO: 47693 - DNA, 18 bp, Artificial Sequence
  Synthetic DNA
taacacgaatctatttag

SEQ ID NO: 47694 - DNA, 18 bp, Artificial Sequence
  Synthetic DNA
taacacgacacaatcttg

SEQ ID NO: 47695 - DNA, 18 bp, Artificial Sequence
  Synthetic DNA
taacacgacagattattg

SEQ ID NO: 47696 - DNA, 18 bp, Artificial Sequence
  Synthetic DNA
taacacgaccgaatttag

SEQ ID NO: 47697 - DNA, 18 bp, Artificial Sequence
  Synthetic DNA
taacacgacgttttatag

SEQ ID NO: 47698 - DNA, 18 bp, Artificial Sequence
  Synthetic DNA
taacacgactaaataccg

SEQ ID NO: 47699 - DNA, 18 bp, Artificial Sequence
  Synthetic DNA
taacacgactacccttag

SEQ ID NO: 47700 - DNA, 18 bp, Artificial Sequence
  Synthetic DNA
taacacgattaacactag

SEQ ID NO: 47701 - DNA, 18 bp, Artificial Sequence
  Synthetic DNA
taacacgtacctttaaag

SEQ ID NO: 47702 - DNA, 18 bp, Artificial Sequence
  Synthetic DNA
taacacgtcccggtatag

SEQ ID NO: 47703 - DNA, 18 bp, Artificial Sequence
  Synthetic DNA
taacacgtttcactaagg

SEQ ID NO: 47704 - DNA, 18 bp, Artificial Sequence
  Synthetic DNA
taacactactgagttaag

SEQ ID NO: 47705 - DNA, 18 bp, Artificial Sequence
  Synthetic DNA
taacactacttataatcg

SEQ ID NO: 47706 - DNA, 18 bp, Artificial Sequence
  Synthetic DNA
taacactcgactctattg

SEQ ID NO: 47707 - DNA, 18 bp, Artificial Sequence
  Synthetic DNA
taacacttcacgctattg

SEQ ID NO: 47708 - DNA, 18 bp, Artificial Sequence
  Synthetic DNA
taacacttctcaccaaag

SEQ ID NO: 47709 - DNA, 18 bp, Artificial Sequence
  Synthetic DNA
taacacttcttgatatag

SEQ ID NO: 47710 - DNA, 18 bp, Artificial Sequence
  Synthetic DNA
taacaggaataattatag

SEQ ID NO: 47711 - DNA, 18 bp, Artificial Sequence
  Synthetic DNA
taacaggattcaccctag

SEQ ID NO: 47712 - DNA, 18 bp, Artificial Sequence
  Synthetic DNA
taacaggtcatactatag

SEQ ID NO: 47713 - DNA, 18 bp, Artificial Sequence
  Synthetic DNA
taacataactaactctcg

SEQ ID NO: 47714 - DNA, 18 bp, Artificial Sequence
  Synthetic DNA
taacatgcatatctatag

SEQ ID NO: 47715 - DNA, 18 bp, Artificial Sequence
  Synthetic DNA
taacatgcctcaccattg

SEQ ID NO: 47716 - DNA, 18 bp, Artificial Sequence
  Synthetic DNA
taacatgcctgactggag

SEQ ID NO: 47717 - DNA, 18 bp, Artificial Sequence
  Synthetic DNA
taacatggcttacaatag

SEQ ID NO: 47718 - DNA, 18 bp, Artificial Sequence
  Synthetic DNA
taacattactcactaatg

SEQ ID NO: 47719 - DNA, 18 bp, Artificial Sequence
  Synthetic DNA
taaccagtttgcctatag

SEQ ID NO: 47720 - DNA, 18 bp, Artificial Sequence
  Synthetic DNA
taacccgagtctatgtgg

SEQ ID NO: 47721 - DNA, 18 bp, Artificial Sequence
  Synthetic DNA
taacccgtctatctatag

SEQ ID NO: 47722 - DNA, 18 bp, Artificial Sequence
  Synthetic DNA
taaccctacactctaaag

SEQ ID NO: 47723 - DNA, 18 bp, Artificial Sequence
  Synthetic DNA
taaccggtctcacgatag

SEQ ID NO: 47724 - DNA, 18 bp, Artificial Sequence
  Synthetic DNA
taacgagtctctccattg

SEQ ID NO: 47725 - DNA, 18 bp, Artificial Sequence
  Synthetic DNA
taacgcgactcaattatg

SEQ ID NO: 47726 - DNA, 18 bp, Artificial Sequence
  Synthetic DNA
taacgcttctaactatag

SEQ ID NO: 47727 - DNA, 18 bp, Artificial Sequence
  Synthetic DNA
taacgttactcgatattg

SEQ ID NO: 47728 - DNA, 18 bp, Artificial Sequence
  Synthetic DNA
taactcaacgcactatgg

SEQ ID NO: 47729 - DNA, 18 bp, Artificial Sequence
  Synthetic DNA
taactcgactaagtcttg

SEQ ID NO: 47730 - DNA, 18 bp, Artificial Sequence
  Synthetic DNA
taactcgactgattatgg

SEQ ID NO: 47731 - DNA, 18 bp, Artificial Sequence
  Synthetic DNA
taactcgcttgacttaag

SEQ ID NO: 47732 - DNA, 18 bp, Artificial Sequence
  Synthetic DNA
taactcgggtaactctag

SEQ ID NO: 47733 - DNA, 18 bp, Artificial Sequence
  Synthetic DNA
taactcgtcttacttcag

SEQ ID NO: 47734 - DNA, 18 bp, Artificial Sequence
  Synthetic DNA
taactctacttcctttgg

SEQ ID NO: 47735 - DNA, 18 bp, Artificial Sequence
  Synthetic DNA
taactctcttctctatag

SEQ ID NO: 47736 - DNA, 18 bp, Artificial Sequence
  Synthetic DNA
taacttgactctctgtag

SEQ ID NO: 47737 - DNA, 18 bp, Artificial Sequence
  Synthetic DNA
taacttgattgtttatag

SEQ ID NO: 47738 - DNA, 18 bp, Artificial Sequence
  Synthetic DNA
taacttggcgaactttag

SEQ ID NO: 47739 - DNA, 18 bp, Artificial Sequence
  Synthetic DNA
taacttgtcttgtttttg

SEQ ID NO: 47740 - DNA, 18 bp, Artificial Sequence
  Synthetic DNA
taagaaaacttgctatag

SEQ ID NO: 47741 - DNA, 18 bp, Artificial Sequence
  Synthetic DNA
taagaacatgcaatctag

SEQ ID NO: 47742 - DNA, 18 bp, Artificial Sequence
  Synthetic DNA
taagaacgcaaatctaag

SEQ ID NO: 47743 - DNA, 18 bp, Artificial Sequence
  Synthetic DNA
taagaagtcttacaatag

SEQ ID NO: 47744 - DNA, 18 bp, Artificial Sequence
  Synthetic DNA
taagacaattcaatattg

SEQ ID NO: 47745 - DNA, 18 bp, Artificial Sequence
  Synthetic DNA
taagacatatcgtaatag

SEQ ID NO: 47746 - DNA, 18 bp, Artificial Sequence
  Synthetic DNA
taagacctgacactaatg

SEQ ID NO: 47747 - DNA, 18 bp, Artificial Sequence
  Synthetic DNA
taagacgaatatctaaag

SEQ ID NO: 47748 - DNA, 18 bp, Artificial Sequence
  Synthetic DNA
taagacgactaatattag

SEQ ID NO: 47749 - DNA, 18 bp, Artificial Sequence
  Synthetic DNA
taagacgactcatataag

SEQ ID NO: 47750 - DNA, 18 bp, Artificial Sequence
  Synthetic DNA
taagacgactctatttcg

SEQ ID NO: 47751 - DNA, 18 bp, Artificial Sequence
  Synthetic DNA
taagacgattcgcattag

SEQ ID NO: 47752 - DNA, 18 bp, Artificial Sequence
  Synthetic DNA
taagacgattgggcatag

SEQ ID NO: 47753 - DNA, 18 bp, Artificial Sequence
  Synthetic DNA
taagacgcctcccattag

SEQ ID NO: 47754 - DNA, 18 bp, Artificial Sequence
  Synthetic DNA
taagacggctctcaattg

SEQ ID NO: 47755 - DNA, 18 bp, Artificial Sequence
  Synthetic DNA
taagactaaccactattg

SEQ ID NO: 47756 - DNA, 18 bp, Artificial Sequence
  Synthetic DNA
taagactcctcgctcttg

SEQ ID NO: 47757 - DNA, 18 bp, Artificial Sequence
  Synthetic DNA
taagactgctcccaaacg

SEQ ID NO: 47758 - DNA, 18 bp, Artificial Sequence
  Synthetic DNA
taagaggaatcattatcg

SEQ ID NO: 47759 - DNA, 18 bp, Artificial Sequence
  Synthetic DNA
taagaggagtctctaaag

SEQ ID NO: 47760 - DNA, 18 bp, Artificial Sequence
  Synthetic DNA
taagatgactcacaaatg

SEQ ID NO: 47761 - DNA, 18 bp, Artificial Sequence
  Synthetic DNA
taagatgatccacgatag

SEQ ID NO: 47762 - DNA, 18 bp, Artificial Sequence
  Synthetic DNA
taagatgtctctatgtag

SEQ ID NO: 47763 - DNA, 18 bp, Artificial Sequence
  Synthetic DNA
taagccataacacttaag

SEQ ID NO: 47764 - DNA, 18 bp, Artificial Sequence
  Synthetic DNA
taagccgactaacaacgg

SEQ ID NO: 47765 - DNA, 18 bp, Artificial Sequence
  Synthetic DNA
taagccgactctctaccg

SEQ ID NO: 47766 - DNA, 18 bp, Artificial Sequence
  Synthetic DNA
taagtagagtcactccag

SEQ ID NO: 47767 - DNA, 18 bp, Artificial Sequence
  Synthetic DNA
taagtagcccaactatag

SEQ ID NO: 47768 - DNA, 18 bp, Artificial Sequence
  Synthetic DNA
taagtcatatcattatag

SEQ ID NO: 47769 - DNA, 18 bp, Artificial Sequence
  Synthetic DNA
taagtccgcgcactttag

SEQ ID NO: 47770 - DNA, 18 bp, Artificial Sequence
  Synthetic DNA
taagtcgaactactaaag

SEQ ID NO: 47771 - DNA, 18 bp, Artificial Sequence
  Synthetic DNA
taagtcggccctccatag

SEQ ID NO: 47772 - DNA, 18 bp, Artificial Sequence
  Synthetic DNA
taagtcgtgtaatattag

SEQ ID NO: 47773 - DNA, 18 bp, Artificial Sequence
  Synthetic DNA
taagtctaatcacttaag

SEQ ID NO: 47774 - DNA, 18 bp, Artificial Sequence
  Synthetic DNA
taagttgaaacactatag

SEQ ID NO: 47775 - DNA, 18 bp, Artificial Sequence
  Synthetic DNA
taagttgactcactctgg

SEQ ID NO: 47776 - DNA, 18 bp, Artificial Sequence
  Synthetic DNA
taataaaacccactttcg

SEQ ID NO: 47777 - DNA, 18 bp, Artificial Sequence
  Synthetic DNA
taataaaattcgcacttg

SEQ ID NO: 47778 - DNA, 18 bp, Artificial Sequence
  Synthetic DNA
taataaacctcaatagag

SEQ ID NO: 47779 - DNA, 18 bp, Artificial Sequence
  Synthetic DNA
taataaatctttcaatag

SEQ ID NO: 47780 - DNA, 18 bp, Artificial Sequence
  Synthetic DNA
taataacatatattctag

SEQ ID NO: 47781 - DNA, 18 bp, Artificial Sequence
  Synthetic DNA
taataacattctctattg

SEQ ID NO: 47782 - DNA, 18 bp, Artificial Sequence
  Synthetic DNA
taataagacacacccaag

SEQ ID NO: 47783 - DNA, 18 bp, Artificial Sequence
  Synthetic DNA
taataagacacccacaag

SEQ ID NO: 47784 - DNA, 18 bp, Artificial Sequence
  Synthetic DNA
taataagacccacgctcg

SEQ ID NO: 47785 - DNA, 18 bp, Artificial Sequence
  Synthetic DNA
taataagaccgtctttag

SEQ ID NO: 47786 - DNA, 18 bp, Artificial Sequence
  Synthetic DNA
taataagactcatttctg

SEQ ID NO: 47787 - DNA, 18 bp, Artificial Sequence
  Synthetic DNA
taataagacttacgttcg

SEQ ID NO: 47788 - DNA, 18 bp, Artificial Sequence
  Synthetic DNA
taataagatattgtatag

SEQ ID NO: 47789 - DNA, 18 bp, Artificial Sequence
  Synthetic DNA
taataagattcaatcacg

SEQ ID NO: 47790 - DNA, 18 bp, Artificial Sequence
  Synthetic DNA
taataagattcacatttg

SEQ ID NO: 47791 - DNA, 18 bp, Artificial Sequence
  Synthetic DNA
taataagcctggctttag

SEQ ID NO: 47792 - DNA, 18 bp, Artificial Sequence
  Synthetic DNA
taataagccttccaattg

SEQ ID NO: 47793 - DNA, 18 bp, Artificial Sequence
  Synthetic DNA
taataaggaacagcatag

SEQ ID NO: 47794 - DNA, 18 bp, Artificial Sequence
  Synthetic DNA
taataagtccttctattg

SEQ ID NO: 47795 - DNA, 18 bp, Artificial Sequence
  Synthetic DNA
taataagtctatatttcg

SEQ ID NO: 47796 - DNA, 18 bp, Artificial Sequence
  Synthetic DNA
taataagtctcccgtaag

SEQ ID NO: 47797 - DNA, 18 bp, Artificial Sequence
  Synthetic DNA
taataagtctgaatgttg

SEQ ID NO: 47798 - DNA, 18 bp, Artificial Sequence
  Synthetic DNA
taataagtctggcaatag

SEQ ID NO: 47799 - DNA, 18 bp, Artificial Sequence
  Synthetic DNA
taataagtttcacagtag

SEQ ID NO: 47800 - DNA, 18 bp, Artificial Sequence
  Synthetic DNA
taataataattactctcg

SEQ ID NO: 47801 - DNA, 18 bp, Artificial Sequence
  Synthetic DNA
taataataattataatag

SEQ ID NO: 47802 - DNA, 18 bp, Artificial Sequence
  Synthetic DNA
taataatacacgatatag

SEQ ID NO: 47803 - DNA, 18 bp, Artificial Sequence
  Synthetic DNA
taataatacccacattag

SEQ ID NO: 47804 - DNA, 18 bp, Artificial Sequence
  Synthetic DNA
taataatactcattaacg

SEQ ID NO: 47805 - DNA, 18 bp, Artificial Sequence
  Synthetic DNA
taataatactcttaacag

SEQ ID NO: 47806 - DNA, 18 bp, Artificial Sequence
  Synthetic DNA
taataatacttaccacag

SEQ ID NO: 47807 - DNA, 18 bp, Artificial Sequence
  Synthetic DNA
taataatattacctaccg

SEQ ID NO: 47808 - DNA, 18 bp, Artificial Sequence
  Synthetic DNA
taataatatttattgtag

SEQ ID NO: 47809 - DNA, 18 bp, Artificial Sequence
  Synthetic DNA
taataatgctccctttag

SEQ ID NO: 47810 - DNA, 18 bp, Artificial Sequence
  Synthetic DNA
taataattaacacttttg

SEQ ID NO: 47811 - DNA, 18 bp, Artificial Sequence
  Synthetic DNA
taataattatctttttag

SEQ ID NO: 47812 - DNA, 18 bp, Artificial Sequence
  Synthetic DNA
taataattctcactaagg

SEQ ID NO: 47813 - DNA, 18 bp, Artificial Sequence
  Synthetic DNA
taatacaaaactctctag

SEQ ID NO: 47814 - DNA, 18 bp, Artificial Sequence
  Synthetic DNA
taatacaaatcaccaacg

SEQ ID NO: 47815 - DNA, 18 bp, Artificial Sequence
  Synthetic DNA
taatacaaatcattactg

SEQ ID NO: 47816 - DNA, 18 bp, Artificial Sequence
  Synthetic DNA
taatacaaattactaatg

SEQ ID NO: 47817 - DNA, 18 bp, Artificial Sequence
  Synthetic DNA
taatacaacactccatgg

SEQ ID NO: 47818 - DNA, 18 bp, Artificial Sequence
  Synthetic DNA
taatacaacactttaaag

SEQ ID NO: 47819 - DNA, 18 bp, Artificial Sequence
  Synthetic DNA
taatacaaccaacttatg

SEQ ID NO: 47820 - DNA, 18 bp, Artificial Sequence
  Synthetic DNA
taatacaacccaccgttg

SEQ ID NO: 47821 - DNA, 18 bp, Artificial Sequence
  Synthetic DNA
taatacaactccccaatg

SEQ ID NO: 47822 - DNA, 18 bp, Artificial Sequence
  Synthetic DNA
taatacaactctatctgg

SEQ ID NO: 47823 - DNA, 18 bp, Artificial Sequence
  Synthetic DNA
taatacaactctctcgtg

SEQ ID NO: 47824 - DNA, 18 bp, Artificial Sequence
  Synthetic DNA
taatacaactcttcattg

SEQ ID NO: 47825 - DNA, 18 bp, Artificial Sequence
  Synthetic DNA
taatacaacttattactg

SEQ ID NO: 47826 - DNA, 18 bp, Artificial Sequence
  Synthetic DNA
taatacaaggcgcattcg

SEQ ID NO: 47827 - DNA, 18 bp, Artificial Sequence
  Synthetic DNA
taatacaagtcaccaatg

SEQ ID NO: 47828 - DNA, 18 bp, Artificial Sequence
  Synthetic DNA
taatacaatgccctagag

SEQ ID NO: 47829 - DNA, 18 bp, Artificial Sequence
  Synthetic DNA
taatacaatttaatacag

SEQ ID NO: 47830 - DNA, 18 bp, Artificial Sequence
  Synthetic DNA
taatacaatttattaaag

SEQ ID NO: 47831 - DNA, 18 bp, Artificial Sequence
  Synthetic DNA
taatacaccacactctcg

SEQ ID NO: 47832 - DNA, 18 bp, Artificial Sequence
  Synthetic DNA
taatacactcccaaatag

SEQ ID NO: 47833 - DNA, 18 bp, Artificial Sequence
  Synthetic DNA
taatacacttctctctag

SEQ ID NO: 47834 - DNA, 18 bp, Artificial Sequence
  Synthetic DNA
taatacagctaaagatag

SEQ ID NO: 47835 - DNA, 18 bp, Artificial Sequence
  Synthetic DNA
taatacagctcacagaag

SEQ ID NO: 47836 - DNA, 18 bp, Artificial Sequence
  Synthetic DNA
taatacatacaactatag

SEQ ID NO: 47837 - DNA, 18 bp, Artificial Sequence
  Synthetic DNA
taatacatcactatagtg

SEQ ID NO: 47838 - DNA, 18 bp, Artificial Sequence
  Synthetic DNA
taatacatcactctaatg

SEQ ID NO: 47839 - DNA, 18 bp, Artificial Sequence
  Synthetic DNA
taatacatcagacccttg

SEQ ID NO: 47840 - DNA, 18 bp, Artificial Sequence
  Synthetic DNA
taatacatcatactaaag

SEQ ID NO: 47841 - DNA, 18 bp, Artificial Sequence
  Synthetic DNA
taatacatcatactaatg

SEQ ID NO: 47842 - DNA, 18 bp, Artificial Sequence
  Synthetic DNA
taatacatcccaatattg

SEQ ID NO: 47843 - DNA, 18 bp, Artificial Sequence
  Synthetic DNA
taatacatctaactcttg

SEQ ID NO: 47844 - DNA, 18 bp, Artificial Sequence
  Synthetic DNA
taatacatctatctttag

SEQ ID NO: 47845 - DNA, 18 bp, Artificial Sequence
  Synthetic DNA
taatacatctttttaaag

SEQ ID NO: 47846 - DNA, 18 bp, Artificial Sequence
  Synthetic DNA
taatacattatgctatag

SEQ ID NO: 47847 - DNA, 18 bp, Artificial Sequence
  Synthetic DNA
taatacatttaattatgg

SEQ ID NO: 47848 - DNA, 18 bp, Artificial Sequence
  Synthetic DNA
taataccaaacagtaacg

SEQ ID NO: 47849 - DNA, 18 bp, Artificial Sequence
  Synthetic DNA
taataccaataacaagag

SEQ ID NO: 47850 - DNA, 18 bp, Artificial Sequence
  Synthetic DNA
taataccacacaaactag

SEQ ID NO: 47851 - DNA, 18 bp, Artificial Sequence
  Synthetic DNA
taataccacgtagaatcg

SEQ ID NO: 47852 - DNA, 18 bp, Artificial Sequence
  Synthetic DNA
taataccacttactcatg

SEQ ID NO: 47853 - DNA, 18 bp, Artificial Sequence
  Synthetic DNA
taataccagccgccaaag

SEQ ID NO: 47854 - DNA, 18 bp, Artificial Sequence
  Synthetic DNA
taataccatccgcttaag

SEQ ID NO: 47855 - DNA, 18 bp, Artificial Sequence
  Synthetic DNA
taataccattatctaaag

SEQ ID NO: 47856 - DNA, 18 bp, Artificial Sequence
  Synthetic DNA
taatacccctcccaacag

SEQ ID NO: 47857 - DNA, 18 bp, Artificial Sequence
  Synthetic DNA
taataccgctctcaaaag

SEQ ID NO: 47858 - DNA, 18 bp, Artificial Sequence
  Synthetic DNA
taataccgcttcttatcg

SEQ ID NO: 47859 - DNA, 18 bp, Artificial Sequence
  Synthetic DNA
taataccgttctctaaag

SEQ ID NO: 47860 - DNA, 18 bp, Artificial Sequence
  Synthetic DNA
taatacctcactctctcg

SEQ ID NO: 47861 - DNA, 18 bp, Artificial Sequence
  Synthetic DNA
taatacctcagacagtag

SEQ ID NO: 47862 - DNA, 18 bp, Artificial Sequence
  Synthetic DNA
taatacctctaaacatag

SEQ ID NO: 47863 - DNA, 18 bp, Artificial Sequence
  Synthetic DNA
taatacctctcacttatg

SEQ ID NO: 47864 - DNA, 18 bp, Artificial Sequence
  Synthetic DNA
taatacctgttacttaag

SEQ ID NO: 47865 - DNA, 18 bp, Artificial Sequence
  Synthetic DNA
taataccttttactattg

SEQ ID NO: 47866 - DNA, 18 bp, Artificial Sequence
  Synthetic DNA
taatacgaaaaattggag

SEQ ID NO: 47867 - DNA, 18 bp, Artificial Sequence
  Synthetic DNA
taatacgaaacgcaaaag

SEQ ID NO: 47868 - DNA, 18 bp, Artificial Sequence
  Synthetic DNA
taatacgaaccaataccg

SEQ ID NO: 47869 - DNA, 18 bp, Artificial Sequence
  Synthetic DNA
taatacgaataacaagcg

SEQ ID NO: 47870 - DNA, 18 bp, Artificial Sequence
  Synthetic DNA
taatacgaatcaagttcg

SEQ ID NO: 47871 - DNA, 18 bp, Artificial Sequence
  Synthetic DNA
taatacgaatctcaaatg

SEQ ID NO: 47872 - DNA, 18 bp, Artificial Sequence
  Synthetic DNA
taatacgacactgattag

SEQ ID NO: 47873 - DNA, 18 bp, Artificial Sequence
  Synthetic DNA
taatacgacacttttaag

SEQ ID NO: 47874 - DNA, 18 bp, Artificial Sequence
  Synthetic DNA
taatacgacatacattcg

SEQ ID NO: 47875 - DNA, 18 bp, Artificial Sequence
  Synthetic DNA
taatacgaccctcacaag

SEQ ID NO: 47876 - DNA, 18 bp, Artificial Sequence
  Synthetic DNA
taatacgaccctttaccg

SEQ ID NO: 47877 - DNA, 18 bp, Artificial Sequence
  Synthetic DNA
taatacgacgcatatttg

SEQ ID NO: 47878 - DNA, 18 bp, Artificial Sequence
  Synthetic DNA
taatacgactatgtgttg

SEQ ID NO: 47879 - DNA, 18 bp, Artificial Sequence
  Synthetic DNA
taatacgactcgtttgcg

SEQ ID NO: 47880 - DNA, 18 bp, Artificial Sequence
  Synthetic DNA
taatacgacttttaatcg

SEQ ID NO: 47881 - DNA, 18 bp, Artificial Sequence
  Synthetic DNA
taatacgagactctactg

SEQ ID NO: 47882 - DNA, 18 bp, Artificial Sequence
  Synthetic DNA
taatacgagacttttcag

SEQ ID NO: 47883 - DNA, 18 bp, Artificial Sequence
  Synthetic DNA
taatacgagtctaaatgg

SEQ ID NO: 47884 - DNA, 18 bp, Artificial Sequence
  Synthetic DNA
taatacgagtttgaacgg

SEQ ID NO: 47885 - DNA, 18 bp, Artificial Sequence
  Synthetic DNA
taatacgataaacaattg

SEQ ID NO: 47886 - DNA, 18 bp, Artificial Sequence
  Synthetic DNA
taatacgataaactgcag

SEQ ID NO: 47887 - DNA, 18 bp, Artificial Sequence
  Synthetic DNA
taatacgataaagaatag

SEQ ID NO: 47888 - DNA, 18 bp, Artificial Sequence
  Synthetic DNA
taatacgataatatctag

SEQ ID NO: 47889 - DNA, 18 bp, Artificial Sequence
  Synthetic DNA
taatacgatacagttttg

SEQ ID NO: 47890 - DNA, 18 bp, Artificial Sequence
  Synthetic DNA
taatacgatacgttctag

SEQ ID NO: 47891 - DNA, 18 bp, Artificial Sequence
  Synthetic DNA
taatacgattaaccaatg

SEQ ID NO: 47892 - DNA, 18 bp, Artificial Sequence
  Synthetic DNA
taatacgattacaaattg

SEQ ID NO: 47893 - DNA, 18 bp, Artificial Sequence
  Synthetic DNA
taatacgattatcttttg

SEQ ID NO: 47894 - DNA, 18 bp, Artificial Sequence
  Synthetic DNA
taatacgattcaaacttg

SEQ ID NO: 47895 - DNA, 18 bp, Artificial Sequence
  Synthetic DNA
taatacgattccgattag

SEQ ID NO: 47896 - DNA, 18 bp, Artificial Sequence
  Synthetic DNA
taatacgattctacaacg

SEQ ID NO: 47897 - DNA, 18 bp, Artificial Sequence
  Synthetic DNA
taatacgattgatttgag

SEQ ID NO: 47898 - DNA, 18 bp, Artificial Sequence
  Synthetic DNA
taatacgattgtttatgg

SEQ ID NO: 47899 - DNA, 18 bp, Artificial Sequence
  Synthetic DNA
taatacgattttcttatg

SEQ ID NO: 47900 - DNA, 18 bp, Artificial Sequence
  Synthetic DNA
taatacgattttgttaag

SEQ ID NO: 47901 - DNA, 18 bp, Artificial Sequence
  Synthetic DNA
taatacgccacacttacg

SEQ ID NO: 47902 - DNA, 18 bp, Artificial Sequence
  Synthetic DNA
taatacgccacacttatg

SEQ ID NO: 47903 - DNA, 18 bp, Artificial Sequence
  Synthetic DNA
taatacgcctaccttttg

SEQ ID NO: 47904 - DNA, 18 bp, Artificial Sequence
  Synthetic DNA
taatacgcgccacattag

SEQ ID NO: 47905 - DNA, 18 bp, Artificial Sequence
  Synthetic DNA
taatacgcgtcgataatg

SEQ ID NO: 47906 - DNA, 18 bp, Artificial Sequence
  Synthetic DNA
taatacgcgtctctaatg

SEQ ID NO: 47907 - DNA, 18 bp, Artificial Sequence
  Synthetic DNA
taatacgcttcacaagcg

SEQ ID NO: 47908 - DNA, 18 bp, Artificial Sequence
  Synthetic DNA
taatacggatacctatgg

SEQ ID NO: 47909 - DNA, 18 bp, Artificial Sequence
  Synthetic DNA
taatacggatatatatag

SEQ ID NO: 47910 - DNA, 18 bp, Artificial Sequence
  Synthetic DNA
taatacggcaatctattg

SEQ ID NO: 47911 - DNA, 18 bp, Artificial Sequence
  Synthetic DNA
taatacggccctatagtg

SEQ ID NO: 47912 - DNA, 18 bp, Artificial Sequence
  Synthetic DNA
taatacggcgtccgagag

SEQ ID NO: 47913 - DNA, 18 bp, Artificial Sequence
  Synthetic DNA
taatacggctatcttaag

SEQ ID NO: 47914 - DNA, 18 bp, Artificial Sequence
  Synthetic DNA
taatacgtataaacgtag

SEQ ID NO: 47915 - DNA, 18 bp, Artificial Sequence
  Synthetic DNA
taatacgtatcagtttcg

SEQ ID NO: 47916 - DNA, 18 bp, Artificial Sequence
  Synthetic DNA
taatacgtatctctagtg

SEQ ID NO: 47917 - DNA, 18 bp, Artificial Sequence
  Synthetic DNA
taatacgtcaagcttttg

SEQ ID NO: 47918 - DNA, 18 bp, Artificial Sequence
  Synthetic DNA
taatacgtcaatctttag

SEQ ID NO: 47919 - DNA, 18 bp, Artificial Sequence
  Synthetic DNA
taatacgtcacatactag

SEQ ID NO: 47920 - DNA, 18 bp, Artificial Sequence
  Synthetic DNA
taatacgtcacccgatgg

SEQ ID NO: 47921 - DNA, 18 bp, Artificial Sequence
  Synthetic DNA
taatacgtcatcctagag

SEQ ID NO: 47922 - DNA, 18 bp, Artificial Sequence
  Synthetic DNA
taatacgtcccgatacag

SEQ ID NO: 47923 - DNA, 18 bp, Artificial Sequence
  Synthetic DNA
taatacgtcccgcaacag

SEQ ID NO: 47924 - DNA, 18 bp, Artificial Sequence
  Synthetic DNA
taatacgtctaacgcatg

SEQ ID NO: 47925 - DNA, 18 bp, Artificial Sequence
  Synthetic DNA
taatacgtctcaaatttg

SEQ ID NO: 47926 - DNA, 18 bp, Artificial Sequence
  Synthetic DNA
taatacgtctcaactatg

SEQ ID NO: 47927 - DNA, 18 bp, Artificial Sequence
  Synthetic DNA
taatacgtctcaaggaag

SEQ ID NO: 47928 - DNA, 18 bp, Artificial Sequence
  Synthetic DNA
taatacgtctcacatatg

SEQ ID NO: 47929 - DNA, 18 bp, Artificial Sequence
  Synthetic DNA
taatacgtctcccttatg

SEQ ID NO: 47930 - DNA, 18 bp, Artificial Sequence
  Synthetic DNA
taatacgtctcgttaatg

SEQ ID NO: 47931 - DNA, 18 bp, Artificial Sequence
  Synthetic DNA
taatacgtctctctcctg

SEQ ID NO: 47932 - DNA, 18 bp, Artificial Sequence
  Synthetic DNA
taatacgtctgaaaacag

SEQ ID NO: 47933 - DNA, 18 bp, Artificial Sequence
  Synthetic DNA
taatacgtctgtataaag

SEQ ID NO: 47934 - DNA, 18 bp, Artificial Sequence
  Synthetic DNA
taatacgtgattctatgg

SEQ ID NO: 47935 - DNA, 18 bp, Artificial Sequence
  Synthetic DNA
taatacgtgctattgttg

SEQ ID NO: 47936 - DNA, 18 bp, Artificial Sequence
  Synthetic DNA
taatacgtgtaacttttg

SEQ ID NO: 47937 - DNA, 18 bp, Artificial Sequence
  Synthetic DNA
taatacgtgtaagcatag

SEQ ID NO: 47938 - DNA, 18 bp, Artificial Sequence
  Synthetic DNA
taatacgtgtctttaaag

SEQ ID NO: 47939 - DNA, 18 bp, Artificial Sequence
  Synthetic DNA
taatacgttccaaaatag

SEQ ID NO: 47940 - DNA, 18 bp, Artificial Sequence
  Synthetic DNA
taatacgtttaataagag

SEQ ID NO: 47941 - DNA, 18 bp, Artificial Sequence
  Synthetic DNA
taatacgtttcaacatcg

SEQ ID NO: 47942 - DNA, 18 bp, Artificial Sequence
  Synthetic DNA
taatacgtttcacagaag

SEQ ID NO: 47943 - DNA, 18 bp, Artificial Sequence
  Synthetic DNA
taatacgtttctattttg

SEQ ID NO: 47944 - DNA, 18 bp, Artificial Sequence
  Synthetic DNA
taatacgttttacaaaag

SEQ ID NO: 47945 - DNA, 18 bp, Artificial Sequence
  Synthetic DNA
taatacgttttactctcg

SEQ ID NO: 47946 - DNA, 18 bp, Artificial Sequence
  Synthetic DNA
taatacgttttcccattg

SEQ ID NO: 47947 - DNA, 18 bp, Artificial Sequence
  Synthetic DNA
taatactaagctctaaag

SEQ ID NO: 47948 - DNA, 18 bp, Artificial Sequence
  Synthetic DNA
taatactacacatcatgg

SEQ ID NO: 47949 - DNA, 18 bp, Artificial Sequence
  Synthetic DNA
taatactacactaatatg

SEQ ID NO: 47950 - DNA, 18 bp, Artificial Sequence
  Synthetic DNA
taatactacacttgttag

SEQ ID NO: 47951 - DNA, 18 bp, Artificial Sequence
  Synthetic DNA
taatactacatcctctag

SEQ ID NO: 47952 - DNA, 18 bp, Artificial Sequence
  Synthetic DNA
taatactaccgcgtatag

SEQ ID NO: 47953 - DNA, 18 bp, Artificial Sequence
  Synthetic DNA
taatactaccttcaatag

SEQ ID NO: 47954 - DNA, 18 bp, Artificial Sequence
  Synthetic DNA
taatactacgcacaaacg

SEQ ID NO: 47955 - DNA, 18 bp, Artificial Sequence
  Synthetic DNA
taatactacgcacataag

SEQ ID NO: 47956 - DNA, 18 bp, Artificial Sequence
  Synthetic DNA
taatactactctcttagg

SEQ ID NO: 47957 - DNA, 18 bp, Artificial Sequence
  Synthetic DNA
taatactagaccctgttg

SEQ ID NO: 47958 - DNA, 18 bp, Artificial Sequence
  Synthetic DNA
taatactccaaactttag

SEQ ID NO: 47959 - DNA, 18 bp, Artificial Sequence
  Synthetic DNA
taatactcccaacattcg

SEQ ID NO: 47960 - DNA, 18 bp, Artificial Sequence
  Synthetic DNA
taatactcctaacaatcg

SEQ ID NO: 47961 - DNA, 18 bp, Artificial Sequence
  Synthetic DNA
taatactcctcttaatag

SEQ ID NO: 47962 - DNA, 18 bp, Artificial Sequence
  Synthetic DNA
taatactgccatatatag

SEQ ID NO: 47963 - DNA, 18 bp, Artificial Sequence
  Synthetic DNA
taatactggtcattttag

SEQ ID NO: 47964 - DNA, 18 bp, Artificial Sequence
  Synthetic DNA
taatactgttcaattcag

SEQ ID NO: 47965 - DNA, 18 bp, Artificial Sequence
  Synthetic DNA
taatacttcacacttttg

SEQ ID NO: 47966 - DNA, 18 bp, Artificial Sequence
  Synthetic DNA
taatacttcattctttag

SEQ ID NO: 47967 - DNA, 18 bp, Artificial Sequence
  Synthetic DNA
taatacttccgtctatag

SEQ ID NO: 47968 - DNA, 18 bp, Artificial Sequence
  Synthetic DNA
taatacttctaacctaag

SEQ ID NO: 47969 - DNA, 18 bp, Artificial Sequence
  Synthetic DNA
taatacttgttactaaag

SEQ ID NO: 47970 - DNA, 18 bp, Artificial Sequence
  Synthetic DNA
taatagaactaaatatcg

SEQ ID NO: 47971 - DNA, 18 bp, Artificial Sequence
  Synthetic DNA
taatagaactcgccttag

SEQ ID NO: 47972 - DNA, 18 bp, Artificial Sequence
  Synthetic DNA
taatagcactcaaaaatg

SEQ ID NO: 47973 - DNA, 18 bp, Artificial Sequence
  Synthetic DNA
taatagcactctttagag

SEQ ID NO: 47974 - DNA, 18 bp, Artificial Sequence
  Synthetic DNA
taatagcacttactgaag

SEQ ID NO: 47975 - DNA, 18 bp, Artificial Sequence
  Synthetic DNA
taatagctctcaagattg

SEQ ID NO: 47976 - DNA, 18 bp, Artificial Sequence
  Synthetic DNA
taataggaaatactaatg

SEQ ID NO: 47977 - DNA, 18 bp, Artificial Sequence
  Synthetic DNA
taataggacaatcattag

SEQ ID NO: 47978 - DNA, 18 bp, Artificial Sequence
  Synthetic DNA
taataggacatataatag

SEQ ID NO: 47979 - DNA, 18 bp, Artificial Sequence
  Synthetic DNA
taataggaccctttgaag

SEQ ID NO: 47980 - DNA, 18 bp, Artificial Sequence
  Synthetic DNA
taataggactctctcacg

SEQ ID NO: 47981 - DNA, 18 bp, Artificial Sequence
  Synthetic DNA
taataggagtcacaagtg

SEQ ID NO: 47982 - DNA, 18 bp, Artificial Sequence
  Synthetic DNA
taataggattctctaatg

SEQ ID NO: 47983 - DNA, 18 bp, Artificial Sequence
  Synthetic DNA
taatagggccctttatag

SEQ ID NO: 47984 - DNA, 18 bp, Artificial Sequence
  Synthetic DNA
taatagggctctcaagag

SEQ ID NO: 47985 - DNA, 18 bp, Artificial Sequence
  Synthetic DNA
taataggtcacacgttgg

SEQ ID NO: 47986 - DNA, 18 bp, Artificial Sequence
  Synthetic DNA
taataggtctcactgacg

SEQ ID NO: 47987 - DNA, 18 bp, Artificial Sequence
  Synthetic DNA
taataggttacagtgttg

SEQ ID NO: 47988 - DNA, 18 bp, Artificial Sequence
  Synthetic DNA
taatagtacccactctcg

SEQ ID NO: 47989 - DNA, 18 bp, Artificial Sequence
  Synthetic DNA
taatagtactctatatcg

SEQ ID NO: 47990 - DNA, 18 bp, Artificial Sequence
  Synthetic DNA
taatagtattaactttag

SEQ ID NO: 47991 - DNA, 18 bp, Artificial Sequence
  Synthetic DNA
taatagtattcactacgg

SEQ ID NO: 47992 - DNA, 18 bp, Artificial Sequence
  Synthetic DNA
taatagttctctctgaag

SEQ ID NO: 47993 - DNA, 18 bp, Artificial Sequence
  Synthetic DNA
taatataacgcacaaaag

SEQ ID NO: 47994 - DNA, 18 bp, Artificial Sequence
  Synthetic DNA
taatataactctctgccg

SEQ ID NO: 47995 - DNA, 18 bp, Artificial Sequence
  Synthetic DNA
taatataactgcatcttg

SEQ ID NO: 47996 - DNA, 18 bp, Artificial Sequence
  Synthetic DNA
taatatcataaactcaag

SEQ ID NO: 47997 - DNA, 18 bp, Artificial Sequence
  Synthetic DNA
taatatctcccactctgg

SEQ ID NO: 47998 - DNA, 18 bp, Artificial Sequence
  Synthetic DNA
taatatctcggaaaatgg

SEQ ID NO: 47999 - DNA, 18 bp, Artificial Sequence
  Synthetic DNA
taatatgaatctatttcg

SEQ ID NO: 48000 - DNA, 18 bp, Artificial Sequence
  Synthetic DNA
taatatgacacattcaag

SEQ ID NO: 48001 - DNA, 18 bp, Artificial Sequence
  Synthetic DNA
taatatgacaccatcttg

SEQ ID NO: 48002 - DNA, 18 bp, Artificial Sequence
  Synthetic DNA
taatatgacacctcagag

SEQ ID NO: 48003 - DNA, 18 bp, Artificial Sequence
  Synthetic DNA
taatatgacatacaaatg

SEQ ID NO: 48004 - DNA, 18 bp, Artificial Sequence
  Synthetic DNA
taatatgaccctccatcg

SEQ ID NO: 48005 - DNA, 18 bp, Artificial Sequence
  Synthetic DNA
taatatgacgccatatgg

SEQ ID NO: 48006 - DNA, 18 bp, Artificial Sequence
  Synthetic DNA
taatatgactttctctgg

SEQ ID NO: 48007 - DNA, 18 bp, Artificial Sequence
  Synthetic DNA
taatatgagtacttttag

SEQ ID NO: 48008 - DNA, 18 bp, Artificial Sequence
  Synthetic DNA
taatatgatgcattattg

SEQ ID NO: 48009 - DNA, 18 bp, Artificial Sequence
  Synthetic DNA
taatatgattatttttgg

SEQ ID NO: 48010 - DNA, 18 bp, Artificial Sequence
  Synthetic DNA
taatatgattccccaaag

SEQ ID NO: 48011 - DNA, 18 bp, Artificial Sequence
  Synthetic DNA
taatatgattccccttag

SEQ ID NO: 48012 - DNA, 18 bp, Artificial Sequence
  Synthetic DNA
taatatgattctcattag

SEQ ID NO: 48013 - DNA, 18 bp, Artificial Sequence
  Synthetic DNA
taatatgccactctctag

SEQ ID NO: 48014 - DNA, 18 bp, Artificial Sequence
  Synthetic DNA
taatatgcttcacaattg

SEQ ID NO: 48015 - DNA, 18 bp, Artificial Sequence
  Synthetic DNA
taatatggatcattatgg

SEQ ID NO: 48016 - DNA, 18 bp, Artificial Sequence
  Synthetic DNA
taatatgtatatctatag

SEQ ID NO: 48017 - DNA, 18 bp, Artificial Sequence
  Synthetic DNA
taatatgtatcaatagtg

SEQ ID NO: 48018 - DNA, 18 bp, Artificial Sequence
  Synthetic DNA
taatatgtcactctacag

SEQ ID NO: 48019 - DNA, 18 bp, Artificial Sequence
  Synthetic DNA
taatatgtcccaattaag

SEQ ID NO: 48020 - DNA, 18 bp, Artificial Sequence
  Synthetic DNA
taatatgtgtctctctag

SEQ ID NO: 48021 - DNA, 18 bp, Artificial Sequence
  Synthetic DNA
taatatgtttcacgacag

SEQ ID NO: 48022 - DNA, 18 bp, Artificial Sequence
  Synthetic DNA
taatatgttttattgtag

SEQ ID NO: 48023 - DNA, 18 bp, Artificial Sequence
  Synthetic DNA
taatattaaacacaatag

SEQ ID NO: 48024 - DNA, 18 bp, Artificial Sequence
  Synthetic DNA
taatattaaattcaaaag

SEQ ID NO: 48025 - DNA, 18 bp, Artificial Sequence
  Synthetic DNA
taatattaccctgttttg

SEQ ID NO: 48026 - DNA, 18 bp, Artificial Sequence
  Synthetic DNA
taatattactaacaattg

SEQ ID NO: 48027 - DNA, 18 bp, Artificial Sequence
  Synthetic DNA
taatattactcgcatatg

SEQ ID NO: 48028 - DNA, 18 bp, Artificial Sequence
  Synthetic DNA
taatattactcgcttttg

SEQ ID NO: 48029 - DNA, 18 bp, Artificial Sequence
  Synthetic DNA
taatattactctctgcag

SEQ ID NO: 48030 - DNA, 18 bp, Artificial Sequence
  Synthetic DNA
taatattactgggtttag

SEQ ID NO: 48031 - DNA, 18 bp, Artificial Sequence
  Synthetic DNA
taatattactgtctgcag

SEQ ID NO: 48032 - DNA, 18 bp, Artificial Sequence
  Synthetic DNA
taatattattttcataag

SEQ ID NO: 48033 - DNA, 18 bp, Artificial Sequence
  Synthetic DNA
taatattcatcactattg

SEQ ID NO: 48034 - DNA, 18 bp, Artificial Sequence
  Synthetic DNA
taatattcctaaccatag

SEQ ID NO: 48035 - DNA, 18 bp, Artificial Sequence
  Synthetic DNA
taatatttcccaagatag

SEQ ID NO: 48036 - DNA, 18 bp, Artificial Sequence
  Synthetic DNA
taatatttctcataatag

SEQ ID NO: 48037 - DNA, 18 bp, Artificial Sequence
  Synthetic DNA
taatcacactcacgttag

SEQ ID NO: 48038 - DNA, 18 bp, Artificial Sequence
  Synthetic DNA
taatcactcttctaatcg

SEQ ID NO: 48039 - DNA, 18 bp, Artificial Sequence
  Synthetic DNA
taatcagacagaccatag

SEQ ID NO: 48040 - DNA, 18 bp, Artificial Sequence
  Synthetic DNA
taatcagactaaatattg

SEQ ID NO: 48041 - DNA, 18 bp, Artificial Sequence
  Synthetic DNA
taatcagactcacatcag

SEQ ID NO: 48042 - DNA, 18 bp, Artificial Sequence
  Synthetic DNA
taatcagactcataattg

SEQ ID NO: 48043 - DNA, 18 bp, Artificial Sequence
  Synthetic DNA
taatcagactcatcttag

SEQ ID NO: 48044 - DNA, 18 bp, Artificial Sequence
  Synthetic DNA
taatcagattcacattag

SEQ ID NO: 48045 - DNA, 18 bp, Artificial Sequence
  Synthetic DNA
taatcaggctcactaatg

SEQ ID NO: 48046 - DNA, 18 bp, Artificial Sequence
  Synthetic DNA
taatcagtcccaccatag

SEQ ID NO: 48047 - DNA, 18 bp, Artificial Sequence
  Synthetic DNA
taatcagtctctcaaaag

SEQ ID NO: 48048 - DNA, 18 bp, Artificial Sequence
  Synthetic DNA
taatcatgctctctatag

SEQ ID NO: 48049 - DNA, 18 bp, Artificial Sequence
  Synthetic DNA
taatccaactaatttttg

SEQ ID NO: 48050 - DNA, 18 bp, Artificial Sequence
  Synthetic DNA
taatccaagtcattattg

SEQ ID NO: 48051 - DNA, 18 bp, Artificial Sequence
  Synthetic DNA
taatccatctcgctattg

SEQ ID NO: 48052 - DNA, 18 bp, Artificial Sequence
  Synthetic DNA
taatcccagtctttattg

SEQ ID NO: 48053 - DNA, 18 bp, Artificial Sequence
  Synthetic DNA
taatcccatttgcattag

SEQ ID NO: 48054 - DNA, 18 bp, Artificial Sequence
  Synthetic DNA
taatccctctgactaaag

SEQ ID NO: 48055 - DNA, 18 bp, Artificial Sequence
  Synthetic DNA
taatccctctgacttcag

SEQ ID NO: 48056 - DNA, 18 bp, Artificial Sequence
  Synthetic DNA
taatccgaatttttatag

SEQ ID NO: 48057 - DNA, 18 bp, Artificial Sequence
  Synthetic DNA
taatccgactagttatcg

SEQ ID NO: 48058 - DNA, 18 bp, Artificial Sequence
  Synthetic DNA
taatccgactgtctaatg

SEQ ID NO: 48059 - DNA, 18 bp, Artificial Sequence
  Synthetic DNA
taatccgacttccatttg

SEQ ID NO: 48060 - DNA, 18 bp, Artificial Sequence
  Synthetic DNA
taatccgactttcaaatg

SEQ ID NO: 48061 - DNA, 18 bp, Artificial Sequence
  Synthetic DNA
taatccgagcatctttag

SEQ ID NO: 48062 - DNA, 18 bp, Artificial Sequence
  Synthetic DNA
taatccgatacttcatag

SEQ ID NO: 48063 - DNA, 18 bp, Artificial Sequence
  Synthetic DNA
taatccgattttgcatag

SEQ ID NO: 48064 - DNA, 18 bp, Artificial Sequence
  Synthetic DNA
taatccgcggaacaatag

SEQ ID NO: 48065 - DNA, 18 bp, Artificial Sequence
  Synthetic DNA
taatccgcttcacatttg

SEQ ID NO: 48066 - DNA, 18 bp, Artificial Sequence
  Synthetic DNA
taatccggattattattg

SEQ ID NO: 48067 - DNA, 18 bp, Artificial Sequence
  Synthetic DNA
taatccgtattagtagag

SEQ ID NO: 48068 - DNA, 18 bp, Artificial Sequence
  Synthetic DNA
taatccgtcacattcttg

SEQ ID NO: 48069 - DNA, 18 bp, Artificial Sequence
  Synthetic DNA
taatccgtctaacaaaag

SEQ ID NO: 48070 - DNA, 18 bp, Artificial Sequence
  Synthetic DNA
taatccgtctccctctgg

SEQ ID NO: 48071 - DNA, 18 bp, Artificial Sequence
  Synthetic DNA
taatccgtctcgatgtag

SEQ ID NO: 48072 - DNA, 18 bp, Artificial Sequence
  Synthetic DNA
taatccgtctgtcctcag

SEQ ID NO: 48073 - DNA, 18 bp, Artificial Sequence
  Synthetic DNA
taatccgtcttactaatg

SEQ ID NO: 48074 - DNA, 18 bp, Artificial Sequence
  Synthetic DNA
taatccgtcttactatta

SEQ ID NO: 48075 - DNA, 18 bp, Artificial Sequence
  Synthetic DNA
taatccgtgtcattatgg

SEQ ID NO: 48076 - DNA, 18 bp, Artificial Sequence
  Synthetic DNA
taatcctaattactattg

SEQ ID NO: 48077 - DNA, 18 bp, Artificial Sequence
  Synthetic DNA
taatcctacttacaaaag

SEQ ID NO: 48078 - DNA, 18 bp, Artificial Sequence
  Synthetic DNA
taatcctcctcacaaggg

SEQ ID NO: 48079 - DNA, 18 bp, Artificial Sequence
  Synthetic DNA
taatcctcttcacaatag

SEQ ID NO: 48080 - DNA, 18 bp, Artificial Sequence
  Synthetic DNA
taatcgcacacactaaag

SEQ ID NO: 48081 - DNA, 18 bp, Artificial Sequence
  Synthetic DNA
taatcgggctctctattg

SEQ ID NO: 48082 - DNA, 18 bp, Artificial Sequence
  Synthetic DNA
taatctcattcacttttg

SEQ ID NO: 48083 - DNA, 18 bp, Artificial Sequence
  Synthetic DNA
taatctgacactccatag

SEQ ID NO: 48084 - DNA, 18 bp, Artificial Sequence
  Synthetic DNA
taatctgacattcaattg

SEQ ID NO: 48085 - DNA, 18 bp, Artificial Sequence
  Synthetic DNA
taatctgacgctcaacag

SEQ ID NO: 48086 - DNA, 18 bp, Artificial Sequence
  Synthetic DNA
taatctgactacgtaaag

SEQ ID NO: 48087 - DNA, 18 bp, Artificial Sequence
  Synthetic DNA
taatctgtcacacaacag

SEQ ID NO: 48088 - DNA, 18 bp, Artificial Sequence
  Synthetic DNA
taatctgtcacactaaag

SEQ ID NO: 48089 - DNA, 18 bp, Artificial Sequence
  Synthetic DNA
taatgagaaatattatag

SEQ ID NO: 48090 - DNA, 18 bp, Artificial Sequence
  Synthetic DNA
taatgagactcagataag

SEQ ID NO: 48091 - DNA, 18 bp, Artificial Sequence
  Synthetic DNA
taatgagtcacactaaag

SEQ ID NO: 48092 - DNA, 18 bp, Artificial Sequence
  Synthetic DNA
taatgagtcacactgaag

SEQ ID NO: 48093 - DNA, 18 bp, Artificial Sequence
  Synthetic DNA
taatgagtctcgctattg

SEQ ID NO: 48094 - DNA, 18 bp, Artificial Sequence
  Synthetic DNA
taatgatattgactatag

SEQ ID NO: 48095 - DNA, 18 bp, Artificial Sequence
  Synthetic DNA
taatgatcctctctttag

SEQ ID NO: 48096 - DNA, 18 bp, Artificial Sequence
  Synthetic DNA
taatgcaactatcaatag

SEQ ID NO: 48097 - DNA, 18 bp, Artificial Sequence
  Synthetic DNA
taatgcactgctctcttg

SEQ ID NO: 48098 - DNA, 18 bp, Artificial Sequence
  Synthetic DNA
taatgcatgtcaatatag

SEQ ID NO: 48099 - DNA, 18 bp, Artificial Sequence
  Synthetic DNA
taatgccatacactacag

SEQ ID NO: 48100 - DNA, 18 bp, Artificial Sequence
  Synthetic DNA
taatgcccttcacttaag

SEQ ID NO: 48101 - DNA, 18 bp, Artificial Sequence
  Synthetic DNA
taatgcctatcacactag

SEQ ID NO: 48102 - DNA, 18 bp, Artificial Sequence
  Synthetic DNA
taatgcgaatgactgttg

SEQ ID NO: 48103 - DNA, 18 bp, Artificial Sequence
  Synthetic DNA
taatgcgaattacaaaag

SEQ ID NO: 48104 - DNA, 18 bp, Artificial Sequence
  Synthetic DNA
taatgcgacacatttctg

SEQ ID NO: 48105 - DNA, 18 bp, Artificial Sequence
  Synthetic DNA
taatgcgacaccatcaag

SEQ ID NO: 48106 - DNA, 18 bp, Artificial Sequence
  Synthetic DNA
taatgcgacatgctactg

SEQ ID NO: 48107 - DNA, 18 bp, Artificial Sequence
  Synthetic DNA
taatgcgactcaattatg

SEQ ID NO: 48108 - DNA, 18 bp, Artificial Sequence
  Synthetic DNA
taatgcgactctcataag

SEQ ID NO: 48109 - DNA, 18 bp, Artificial Sequence
  Synthetic DNA
taatgcgacttcatattg

SEQ ID NO: 48110 - DNA, 18 bp, Artificial Sequence
  Synthetic DNA
taatgcgatactccatag

SEQ ID NO: 48111 - DNA, 18 bp, Artificial Sequence
  Synthetic DNA
taatgcgatcatcattag

SEQ ID NO: 48112 - DNA, 18 bp, Artificial Sequence
  Synthetic DNA
taatgcgatgtaccttag

SEQ ID NO: 48113 - DNA, 18 bp, Artificial Sequence
  Synthetic DNA
taatgcgattcacctcag

SEQ ID NO: 48114 - DNA, 18 bp, Artificial Sequence
  Synthetic DNA
taatgcgattctctctcg

SEQ ID NO: 48115 - DNA, 18 bp, Artificial Sequence
  Synthetic DNA
taatgcgccgcgttaaag

SEQ ID NO: 48116 - DNA, 18 bp, Artificial Sequence
  Synthetic DNA
taatgcgcctaaattttg

SEQ ID NO: 48117 - DNA, 18 bp, Artificial Sequence
  Synthetic DNA
taatgcgctacacaatag

SEQ ID NO: 48118 - DNA, 18 bp, Artificial Sequence
  Synthetic DNA
taatgcgtatcacttttg

SEQ ID NO: 48119 - DNA, 18 bp, Artificial Sequence
  Synthetic DNA
taatgcgtccatctattg

SEQ ID NO: 48120 - DNA, 18 bp, Artificial Sequence
  Synthetic DNA
taatgcgtcctactattg

SEQ ID NO: 48121 - DNA, 18 bp, Artificial Sequence
  Synthetic DNA
taatgcgtctagcacttg

SEQ ID NO: 48122 - DNA, 18 bp, Artificial Sequence
  Synthetic DNA
taatgctactaactaccg

SEQ ID NO: 48123 - DNA, 18 bp, Artificial Sequence
  Synthetic DNA
taatgctactctcatctg

SEQ ID NO: 48124 - DNA, 18 bp, Artificial Sequence
  Synthetic DNA
taatgctactctcttgtg

SEQ ID NO: 48125 - DNA, 18 bp, Artificial Sequence
  Synthetic DNA
taatgctacttacaattg

SEQ ID NO: 48126 - DNA, 18 bp, Artificial Sequence
  Synthetic DNA
taatgctacttacttatg

SEQ ID NO: 48127 - DNA, 18 bp, Artificial Sequence
  Synthetic DNA
taatgctatacattaaag

SEQ ID NO: 48128 - DNA, 18 bp, Artificial Sequence
  Synthetic DNA
taatgctatgtactatag

SEQ ID NO: 48129 - DNA, 18 bp, Artificial Sequence
  Synthetic DNA
taatgctattcccaattg

SEQ ID NO: 48130 - DNA, 18 bp, Artificial Sequence
  Synthetic DNA
taatggcaataattatag

SEQ ID NO: 48131 - DNA, 18 bp, Artificial Sequence
  Synthetic DNA
taatggctctccctatag

SEQ ID NO: 48132 - DNA, 18 bp, Artificial Sequence
  Synthetic DNA
taatgggaaacgtaatag

SEQ ID NO: 48133 - DNA, 18 bp, Artificial Sequence
  Synthetic DNA
taatgggcctgactaaag

SEQ ID NO: 48134 - DNA, 18 bp, Artificial Sequence
  Synthetic DNA
taatgtgaatcacttgag

SEQ ID NO: 48135 - DNA, 18 bp, Artificial Sequence
  Synthetic DNA
taatgtgactaacaagag

SEQ ID NO: 48136 - DNA, 18 bp, Artificial Sequence
  Synthetic DNA
taatgtgactcaccgcag

SEQ ID NO: 48137 - DNA, 18 bp, Artificial Sequence
  Synthetic DNA
taatgtgagtctctgttg

SEQ ID NO: 48138 - DNA, 18 bp, Artificial Sequence
  Synthetic DNA
taatgttacactatatag

SEQ ID NO: 48139 - DNA, 18 bp, Artificial Sequence
  Synthetic DNA
taatgttgctctctatag

SEQ ID NO: 48140 - DNA, 18 bp, Artificial Sequence
  Synthetic DNA
taattaatctcactttag

SEQ ID NO: 48141 - DNA, 18 bp, Artificial Sequence
  Synthetic DNA
taattagaaaattacaag

SEQ ID NO: 48142 - DNA, 18 bp, Artificial Sequence
  Synthetic DNA
taattagaccttctatag

SEQ ID NO: 48143 - DNA, 18 bp, Artificial Sequence
  Synthetic DNA
taattagactatctactg

SEQ ID NO: 48144 - DNA, 18 bp, Artificial Sequence
  Synthetic DNA
taattagactcacacacg

SEQ ID NO: 48145 - DNA, 18 bp, Artificial Sequence
  Synthetic DNA
taattagactcacataag

SEQ ID NO: 48146 - DNA, 18 bp, Artificial Sequence
  Synthetic DNA
taattagactcactctca

SEQ ID NO: 48147 - DNA, 18 bp, Artificial Sequence
  Synthetic DNA
taattagattcacatagg

SEQ ID NO: 48148 - DNA, 18 bp, Artificial Sequence
  Synthetic DNA
taattagattgaccatag

SEQ ID NO: 48149 - DNA, 18 bp, Artificial Sequence
  Synthetic DNA
taattaggcacatagtag

SEQ ID NO: 48150 - DNA, 18 bp, Artificial Sequence
  Synthetic DNA
taattagtctaacttcag

SEQ ID NO: 48151 - DNA, 18 bp, Artificial Sequence
  Synthetic DNA
taattagtctcatttaag

SEQ ID NO: 48152 - DNA, 18 bp, Artificial Sequence
  Synthetic DNA
taattagttccactttcg

SEQ ID NO: 48153 - DNA, 18 bp, Artificial Sequence
  Synthetic DNA
taattatactcgcttttg

SEQ ID NO: 48154 - DNA, 18 bp, Artificial Sequence
  Synthetic DNA
taattatactctctttag

SEQ ID NO: 48155 - DNA, 18 bp, Artificial Sequence
  Synthetic DNA
taattcaaattcccaaag

SEQ ID NO: 48156 - DNA, 18 bp, Artificial Sequence
  Synthetic DNA
taattcaacacaccacag

SEQ ID NO: 48157 - DNA, 18 bp, Artificial Sequence
  Synthetic DNA
taattcaactaactttcg

SEQ ID NO: 48158 - DNA, 18 bp, Artificial Sequence
  Synthetic DNA
taattcaactatatattg

SEQ ID NO: 48159 - DNA, 18 bp, Artificial Sequence
  Synthetic DNA
taattcaactcacatagg

SEQ ID NO: 48160 - DNA, 18 bp, Artificial Sequence
  Synthetic DNA
taattcaactctctcttg

SEQ ID NO: 48161 - DNA, 18 bp, Artificial Sequence
  Synthetic DNA
taattcaacttattctcg

SEQ ID NO: 48162 - DNA, 18 bp, Artificial Sequence
  Synthetic DNA
taattcaagacattatag

SEQ ID NO: 48163 - DNA, 18 bp, Artificial Sequence
  Synthetic DNA
taattcaatacgcctaag

SEQ ID NO: 48164 - DNA, 18 bp, Artificial Sequence
  Synthetic DNA
taattcaatatgccaaag

SEQ ID NO: 48165 - DNA, 18 bp, Artificial Sequence
  Synthetic DNA
taattcacttcactatcg

SEQ ID NO: 48166 - DNA, 18 bp, Artificial Sequence
  Synthetic DNA
taattcagctctctttcg

SEQ ID NO: 48167 - DNA, 18 bp, Artificial Sequence
  Synthetic DNA
taattcatcacaccattg

SEQ ID NO: 48168 - DNA, 18 bp, Artificial Sequence
  Synthetic DNA
taattcatcacactagag

SEQ ID NO: 48169 - DNA, 18 bp, Artificial Sequence
  Synthetic DNA
taattcatctcacatctg

SEQ ID NO: 48170 - DNA, 18 bp, Artificial Sequence
  Synthetic DNA
taattccaaaaactattg

SEQ ID NO: 48171 - DNA, 18 bp, Artificial Sequence
  Synthetic DNA
taattccaatgtctatag

SEQ ID NO: 48172 - DNA, 18 bp, Artificial Sequence
  Synthetic DNA
taattccactcatttaag

SEQ ID NO: 48173 - DNA, 18 bp, Artificial Sequence
  Synthetic DNA
taattccactcatttatg

SEQ ID NO: 48174 - DNA, 18 bp, Artificial Sequence
  Synthetic DNA
taattccacttaccacag

SEQ ID NO: 48175 - DNA, 18 bp, Artificial Sequence
  Synthetic DNA
taattccagttattgtag

SEQ ID NO: 48176 - DNA, 18 bp, Artificial Sequence
  Synthetic DNA
taattccattcaaaatag

SEQ ID NO: 48177 - DNA, 18 bp, Artificial Sequence
  Synthetic DNA
taattccattcgcatcag

SEQ ID NO: 48178 - DNA, 18 bp, Artificial Sequence
  Synthetic DNA
taattccattcttagtag

SEQ ID NO: 48179 - DNA, 18 bp, Artificial Sequence
  Synthetic DNA
taattcccctaacaacag

SEQ ID NO: 48180 - DNA, 18 bp, Artificial Sequence
  Synthetic DNA
taattcctcacattactg

SEQ ID NO: 48181 - DNA, 18 bp, Artificial Sequence
  Synthetic DNA
taattcctgtcacaatag

SEQ ID NO: 48182 - DNA, 18 bp, Artificial Sequence
  Synthetic DNA
taattcgaaacaatatcg

SEQ ID NO: 48183 - DNA, 18 bp, Artificial Sequence
  Synthetic DNA
taattcgaaacacattag

SEQ ID NO: 48184 - DNA, 18 bp, Artificial Sequence
  Synthetic DNA
taattcgaaagatttagg

SEQ ID NO: 48185 - DNA, 18 bp, Artificial Sequence
  Synthetic DNA
taattcgaattaatttag

SEQ ID NO: 48186 - DNA, 18 bp, Artificial Sequence
  Synthetic DNA
taattcgacaaagtattg

SEQ ID NO: 48187 - DNA, 18 bp, Artificial Sequence
  Synthetic DNA
taattcgacaatcgatag

SEQ ID NO: 48188 - DNA, 18 bp, Artificial Sequence
  Synthetic DNA
taattcgacacaccaacg

SEQ ID NO: 48189 - DNA, 18 bp, Artificial Sequence
  Synthetic DNA
taattcgacacacttagg

SEQ ID NO: 48190 - DNA, 18 bp, Artificial Sequence
  Synthetic DNA
taattcgacagtctattg

SEQ ID NO: 48191 - DNA, 18 bp, Artificial Sequence
  Synthetic DNA
taattcgacgatcaatag

SEQ ID NO: 48192 - DNA, 18 bp, Artificial Sequence
  Synthetic DNA
taattcgacgcccttttg

SEQ ID NO: 48193 - DNA, 18 bp, Artificial Sequence
  Synthetic DNA
taattcgactcaagtaag

SEQ ID NO: 48194 - DNA, 18 bp, Artificial Sequence
  Synthetic DNA
taattcgactcacatgtg

SEQ ID NO: 48195 - DNA, 18 bp, Artificial Sequence
  Synthetic DNA
taattcgactcccttacg

SEQ ID NO: 48196 - DNA, 18 bp, Artificial Sequence
  Synthetic DNA
taattcgactctgaaaag

SEQ ID NO: 48197 - DNA, 18 bp, Artificial Sequence
  Synthetic DNA
taattcgacttagttatg

SEQ ID NO: 48198 - DNA, 18 bp, Artificial Sequence
  Synthetic DNA
taattcgacttgcaatgg

SEQ ID NO: 48199 - DNA, 18 bp, Artificial Sequence
  Synthetic DNA
taattcgagacactactg

SEQ ID NO: 48200 - DNA, 18 bp, Artificial Sequence
  Synthetic DNA
taattcgaggcacaatgg

SEQ ID NO: 48201 - DNA, 18 bp, Artificial Sequence
  Synthetic DNA
taattcgagtcattgttg

SEQ ID NO: 48202 - DNA, 18 bp, Artificial Sequence
  Synthetic DNA
taattcgagtgacaaaag

SEQ ID NO: 48203 - DNA, 18 bp, Artificial Sequence
  Synthetic DNA
taattcgagttacttaag

SEQ ID NO: 48204 - DNA, 18 bp, Artificial Sequence
  Synthetic DNA
taattcgattcaatctgg

SEQ ID NO: 48205 - DNA, 18 bp, Artificial Sequence
  Synthetic DNA
taattcgattcgcaacag

SEQ ID NO: 48206 - DNA, 18 bp, Artificial Sequence
  Synthetic DNA
taattcgattgtttatag

SEQ ID NO: 48207 - DNA, 18 bp, Artificial Sequence
  Synthetic DNA
taattcgccactctactg

SEQ ID NO: 48208 - DNA, 18 bp, Artificial Sequence
  Synthetic DNA
taattcgcctcacgtaag

SEQ ID NO: 48209 - DNA, 18 bp, Artificial Sequence
  Synthetic DNA
taattcgcctcattcctg

SEQ ID NO: 48210 - DNA, 18 bp, Artificial Sequence
  Synthetic DNA
taattcggctttttttag

SEQ ID NO: 48211 - DNA, 18 bp, Artificial Sequence
  Synthetic DNA
taattcgtaacacaatag

SEQ ID NO: 48212 - DNA, 18 bp, Artificial Sequence
  Synthetic DNA
taattcgtaacactttag

SEQ ID NO: 48213 - DNA, 18 bp, Artificial Sequence
  Synthetic DNA
taattcgtaccacaattg

SEQ ID NO: 48214 - DNA, 18 bp, Artificial Sequence
  Synthetic DNA
taattcgtatctattaag

SEQ ID NO: 48215 - DNA, 18 bp, Artificial Sequence
  Synthetic DNA
taattcgtattaccattg

SEQ ID NO: 48216 - DNA, 18 bp, Artificial Sequence
  Synthetic DNA
taattcgtcatattattg

SEQ ID NO: 48217 - DNA, 18 bp, Artificial Sequence
  Synthetic DNA
taattcgtctgaccttag

SEQ ID NO: 48218 - DNA, 18 bp, Artificial Sequence
  Synthetic DNA
taattcgtctgtatttag

SEQ ID NO: 48219 - DNA, 18 bp, Artificial Sequence
  Synthetic DNA
taattctaaacactattg

SEQ ID NO: 48220 - DNA, 18 bp, Artificial Sequence
  Synthetic DNA
taattctacataccacag

SEQ ID NO: 48221 - DNA, 18 bp, Artificial Sequence
  Synthetic DNA
taattctacgatatatag

SEQ ID NO: 48222 - DNA, 18 bp, Artificial Sequence
  Synthetic DNA
taattctactacgtaaag

SEQ ID NO: 48223 - DNA, 18 bp, Artificial Sequence
  Synthetic DNA
taattctagatgttatag

SEQ ID NO: 48224 - DNA, 18 bp, Artificial Sequence
  Synthetic DNA
taattctagccactatgg

SEQ ID NO: 48225 - DNA, 18 bp, Artificial Sequence
  Synthetic DNA
taattctattaattattg

SEQ ID NO: 48226 - DNA, 18 bp, Artificial Sequence
  Synthetic DNA
taattctatttcatttcg

SEQ ID NO: 48227 - DNA, 18 bp, Artificial Sequence
  Synthetic DNA
taattcttattactattg

SEQ ID NO: 48228 - DNA, 18 bp, Artificial Sequence
  Synthetic DNA
taattcttctcacgctag

SEQ ID NO: 48229 - DNA, 18 bp, Artificial Sequence
  Synthetic DNA
taattcttttgacaacag

SEQ ID NO: 48230 - DNA, 18 bp, Artificial Sequence
  Synthetic DNA
taattgcgctcactaacg

SEQ ID NO: 48231 - DNA, 18 bp, Artificial Sequence
  Synthetic DNA
taattgctttcactatag

SEQ ID NO: 48232 - DNA, 18 bp, Artificial Sequence
  Synthetic DNA
taattggaatctcaatag

SEQ ID NO: 48233 - DNA, 18 bp, Artificial Sequence
  Synthetic DNA
taattggtcttactacag

SEQ ID NO: 48234 - DNA, 18 bp, Artificial Sequence
  Synthetic DNA
taattggtcttgctatag

SEQ ID NO: 48235 - DNA, 18 bp, Artificial Sequence
  Synthetic DNA
taattgtactgaataaag

SEQ ID NO: 48236 - DNA, 18 bp, Artificial Sequence
  Synthetic DNA
taatttaattcactgtag

SEQ ID NO: 48237 - DNA, 18 bp, Artificial Sequence
  Synthetic DNA
taatttagcaacccatag

SEQ ID NO: 48238 - DNA, 18 bp, Artificial Sequence
  Synthetic DNA
taatttatatcactttag

SEQ ID NO: 48239 - DNA, 18 bp, Artificial Sequence
  Synthetic DNA
taatttcacactcaatag

SEQ ID NO: 48240 - DNA, 18 bp, Artificial Sequence
  Synthetic DNA
taatttcacccactattg

SEQ ID NO: 48241 - DNA, 18 bp, Artificial Sequence
  Synthetic DNA
taatttgacttacaaatg

SEQ ID NO: 48242 - DNA, 18 bp, Artificial Sequence
  Synthetic DNA
taatttgacttaccttag

SEQ ID NO: 48243 - DNA, 18 bp, Artificial Sequence
  Synthetic DNA
taatttgacttgtaatag

SEQ ID NO: 48244 - DNA, 18 bp, Artificial Sequence
  Synthetic DNA
taatttgatctactatag

SEQ ID NO: 48245 - DNA, 18 bp, Artificial Sequence
  Synthetic DNA
taatttgtatccgttttg

SEQ ID NO: 48246 - DNA, 18 bp, Artificial Sequence
  Synthetic DNA
taatttgtcctattaaag

SEQ ID NO: 48247 - DNA, 18 bp, Artificial Sequence
  Synthetic DNA
taatttgtctcaatttag

SEQ ID NO: 48248 - DNA, 18 bp, Artificial Sequence
  Synthetic DNA
taatttgtctcacaattg

SEQ ID NO: 48249 - DNA, 18 bp, Artificial Sequence
  Synthetic DNA
taattttaattattatag

SEQ ID NO: 48250 - DNA, 18 bp, Artificial Sequence
  Synthetic DNA
taattttacgcactttag

SEQ ID NO: 48251 - DNA, 18 bp, Artificial Sequence
  Synthetic DNA
taattttactcacactcg

SEQ ID NO: 48252 - DNA, 18 bp, Artificial Sequence
  Synthetic DNA
taattttactgcctatag

SEQ ID NO: 48253 - DNA, 18 bp, Artificial Sequence
  Synthetic DNA
taattttcatcactatag

SEQ ID NO: 48254 - DNA, 18 bp, Artificial Sequence
  Synthetic DNA
taatttttttcactctag

SEQ ID NO: 48255 - DNA, 18 bp, Artificial Sequence
  Synthetic DNA
tacaaagaccctctatag

SEQ ID NO: 48256 - DNA, 18 bp, Artificial Sequence
  Synthetic DNA
tacaaagtgtcagtaaag

SEQ ID NO: 48257 - DNA, 18 bp, Artificial Sequence
  Synthetic DNA
tacaaatactatctatag

SEQ ID NO: 48258 - DNA, 18 bp, Artificial Sequence
  Synthetic DNA
tacaacaatacactattg

SEQ ID NO: 48259 - DNA, 18 bp, Artificial Sequence
  Synthetic DNA
tacaacgaaaaactatag

SEQ ID NO: 48260 - DNA, 18 bp, Artificial Sequence
  Synthetic DNA
tacaacgaaacactattg

SEQ ID NO: 48261 - DNA, 18 bp, Artificial Sequence
  Synthetic DNA
tacaacgaccatctatag

SEQ ID NO: 48262 - DNA, 18 bp, Artificial Sequence
  Synthetic DNA
tacaacgacccaatattg

SEQ ID NO: 48263 - DNA, 18 bp, Artificial Sequence
  Synthetic DNA
tacaacgacccattgtag

SEQ ID NO: 48264 - DNA, 18 bp, Artificial Sequence
  Synthetic DNA
tacaacgactttatcaag

SEQ ID NO: 48265 - DNA, 18 bp, Artificial Sequence
  Synthetic DNA
tacaacggcaaactatag

SEQ ID NO: 48266 - DNA, 18 bp, Artificial Sequence
  Synthetic DNA
tacaacggctcaccaatg

SEQ ID NO: 48267 - DNA, 18 bp, Artificial Sequence
  Synthetic DNA
tacaacggctctctaaag

SEQ ID NO: 48268 - DNA, 18 bp, Artificial Sequence
  Synthetic DNA
tacaacgtaatactatag

SEQ ID NO: 48269 - DNA, 18 bp, Artificial Sequence
  Synthetic DNA
tacaatgattgacttaag

SEQ ID NO: 48270 - DNA, 18 bp, Artificial Sequence
  Synthetic DNA
tacacaggcacactatag

SEQ ID NO: 48271 - DNA, 18 bp, Artificial Sequence
  Synthetic DNA
tacaccgacccactttag

SEQ ID NO: 48272 - DNA, 18 bp, Artificial Sequence
  Synthetic DNA
tacagctactcactaaag

SEQ ID NO: 48273 - DNA, 18 bp, Artificial Sequence
  Synthetic DNA
tacatcaactcacattag

SEQ ID NO: 48274 - DNA, 18 bp, Artificial Sequence
  Synthetic DNA
tacatcgacgcgctatag

SEQ ID NO: 48275 - DNA, 18 bp, Artificial Sequence
  Synthetic DNA
tacatcgactctttttgg

SEQ ID NO: 48276 - DNA, 18 bp, Artificial Sequence
  Synthetic DNA
tacattgactcacttttg

SEQ ID NO: 48277 - DNA, 18 bp, Artificial Sequence
  Synthetic DNA
taccacgtcaatcttttg

SEQ ID NO: 48278 - DNA, 18 bp, Artificial Sequence
  Synthetic DNA
taccacgtctaaatttag

SEQ ID NO: 48279 - DNA, 18 bp, Artificial Sequence
  Synthetic DNA
taccacgtcttacttcag

SEQ ID NO: 48280 - DNA, 18 bp, Artificial Sequence
  Synthetic DNA
taccactacttccttcag

SEQ ID NO: 48281 - DNA, 18 bp, Artificial Sequence
  Synthetic DNA
taccactagtatcttaag

SEQ ID NO: 48282 - DNA, 18 bp, Artificial Sequence
  Synthetic DNA
taccatcgctcaatatag

SEQ ID NO: 48283 - DNA, 18 bp, Artificial Sequence
  Synthetic DNA
taccatgacttacaaaag

SEQ ID NO: 48284 - DNA, 18 bp, Artificial Sequence
  Synthetic DNA
tacctgaactcgctttag

SEQ ID NO: 48285 - DNA, 18 bp, Artificial Sequence
  Synthetic DNA
tacgacatctctcttaag

SEQ ID NO: 48286 - DNA, 18 bp, Artificial Sequence
  Synthetic DNA
tacgagaactaacaatag

SEQ ID NO: 48287 - DNA, 18 bp, Artificial Sequence
  Synthetic DNA
tacgtctcgtcactgttg

SEQ ID NO: 48288 - DNA, 18 bp, Artificial Sequence
  Synthetic DNA
tactaaactctactaaag

SEQ ID NO: 48289 - DNA, 18 bp, Artificial Sequence
  Synthetic DNA
tactaacactttcgatag

SEQ ID NO: 48290 - DNA, 18 bp, Artificial Sequence
  Synthetic DNA
tactaacattcattatag

SEQ ID NO: 48291 - DNA, 18 bp, Artificial Sequence
  Synthetic DNA
tactaactatctctatcg

SEQ ID NO: 48292 - DNA, 18 bp, Artificial Sequence
  Synthetic DNA
tactaagacaaactctag

SEQ ID NO: 48293 - DNA, 18 bp, Artificial Sequence
  Synthetic DNA
tactaagcctgttaattg

SEQ ID NO: 48294 - DNA, 18 bp, Artificial Sequence
  Synthetic DNA
tactacaactcatttttg

SEQ ID NO: 48295 - DNA, 18 bp, Artificial Sequence
  Synthetic DNA
tactacaatttacaatag

SEQ ID NO: 48296 - DNA, 18 bp, Artificial Sequence
  Synthetic DNA
tactacatctcacgattg

SEQ ID NO: 48297 - DNA, 18 bp, Artificial Sequence
  Synthetic DNA
tactacatttcactttag

SEQ ID NO: 48298 - DNA, 18 bp, Artificial Sequence
  Synthetic DNA
tactaccacacacactgg

SEQ ID NO: 48299 - DNA, 18 bp, Artificial Sequence
  Synthetic DNA
tactaccactctccattg

SEQ ID NO: 48300 - DNA, 18 bp, Artificial Sequence
  Synthetic DNA
tactaccattctttaaag

SEQ ID NO: 48301 - DNA, 18 bp, Artificial Sequence
  Synthetic DNA
tactacctcttagtcaag

SEQ ID NO: 48302 - DNA, 18 bp, Artificial Sequence
  Synthetic DNA
tactacgaatgtctcaag

SEQ ID NO: 48303 - DNA, 18 bp, Artificial Sequence
  Synthetic DNA
tactacgacaaaatacag

SEQ ID NO: 48304 - DNA, 18 bp, Artificial Sequence
  Synthetic DNA
tactacgacaaactgttg

SEQ ID NO: 48305 - DNA, 18 bp, Artificial Sequence
  Synthetic DNA
tactacgacacacattgg

SEQ ID NO: 48306 - DNA, 18 bp, Artificial Sequence
  Synthetic DNA
tactacgactaacacttg

SEQ ID NO: 48307 - DNA, 18 bp, Artificial Sequence
  Synthetic DNA
tactacgactacttgaag

SEQ ID NO: 48308 - DNA, 18 bp, Artificial Sequence
  Synthetic DNA
tactacgactcaagaatg

SEQ ID NO: 48309 - DNA, 18 bp, Artificial Sequence
  Synthetic DNA
tactacgactcacctctg

SEQ ID NO: 48310 - DNA, 18 bp, Artificial Sequence
  Synthetic DNA
tactacgactcaggactg

SEQ ID NO: 48311 - DNA, 18 bp, Artificial Sequence
  Synthetic DNA
tactacgactcatcgaag

SEQ ID NO: 48312 - DNA, 18 bp, Artificial Sequence
  Synthetic DNA
tactacgagtaaatatgg

SEQ ID NO: 48313 - DNA, 18 bp, Artificial Sequence
  Synthetic DNA
tactacgattcaccaagg

SEQ ID NO: 48314 - DNA, 18 bp, Artificial Sequence
  Synthetic DNA
tactacgattcccttttg

SEQ ID NO: 48315 - DNA, 18 bp, Artificial Sequence
  Synthetic DNA
tactacgcaacacttaag

SEQ ID NO: 48316 - DNA, 18 bp, Artificial Sequence
  Synthetic DNA
tactacgccacgctgtag

SEQ ID NO: 48317 - DNA, 18 bp, Artificial Sequence
  Synthetic DNA
tactacgcctcggattag

SEQ ID NO: 48318 - DNA, 18 bp, Artificial Sequence
  Synthetic DNA
tactacggtttcccatag

SEQ ID NO: 48319 - DNA, 18 bp, Artificial Sequence
  Synthetic DNA
tactacgtcctagaaaag

SEQ ID NO: 48320 - DNA, 18 bp, Artificial Sequence
  Synthetic DNA
tactacgtctctcaaaag

SEQ ID NO: 48321 - DNA, 18 bp, Artificial Sequence
  Synthetic DNA
tactacgtgtcaccttag

SEQ ID NO: 48322 - DNA, 18 bp, Artificial Sequence
  Synthetic DNA
tactactacacattttag

SEQ ID NO: 48323 - DNA, 18 bp, Artificial Sequence
  Synthetic DNA
tactactagtcacttatg

SEQ ID NO: 48324 - DNA, 18 bp, Artificial Sequence
  Synthetic DNA
tactactgctcacaattg

SEQ ID NO: 48325 - DNA, 18 bp, Artificial Sequence
  Synthetic DNA
tactacttataactactg

SEQ ID NO: 48326 - DNA, 18 bp, Artificial Sequence
  Synthetic DNA
tactacttcacactttag

SEQ ID NO: 48327 - DNA, 18 bp, Artificial Sequence
  Synthetic DNA
tactacttctcgcattag

SEQ ID NO: 48328 - DNA, 18 bp, Artificial Sequence
  Synthetic DNA
tactacttgtcacaatag

SEQ ID NO: 48329 - DNA, 18 bp, Artificial Sequence
  Synthetic DNA
tactagaactcagtaaag

SEQ ID NO: 48330 - DNA, 18 bp, Artificial Sequence
  Synthetic DNA
tactagtactgtttttag

SEQ ID NO: 48331 - DNA, 18 bp, Artificial Sequence
  Synthetic DNA
tactatgaccctctatcg

SEQ ID NO: 48332 - DNA, 18 bp, Artificial Sequence
  Synthetic DNA
tactattacacgctatag

SEQ ID NO: 48333 - DNA, 18 bp, Artificial Sequence
  Synthetic DNA
tactattactcacttaag

SEQ ID NO: 48334 - DNA, 18 bp, Artificial Sequence
  Synthetic DNA
tactcccacccacaacag

SEQ ID NO: 48335 - DNA, 18 bp, Artificial Sequence
  Synthetic DNA
tactcctactggcgacag

SEQ ID NO: 48336 - DNA, 18 bp, Artificial Sequence
  Synthetic DNA
tactctatctcactatag

SEQ ID NO: 48337 - DNA, 18 bp, Artificial Sequence
  Synthetic DNA
tactctgactcagtttag

SEQ ID NO: 48338 - DNA, 18 bp, Artificial Sequence
  Synthetic DNA
tactcttactaattatag

SEQ ID NO: 48339 - DNA, 18 bp, Artificial Sequence
  Synthetic DNA
tactgagtcttactatag

SEQ ID NO: 48340 - DNA, 18 bp, Artificial Sequence
  Synthetic DNA
tactgcgattcagtaaag

SEQ ID NO: 48341 - DNA, 18 bp, Artificial Sequence
  Synthetic DNA
tactgcgattcgcttcag

SEQ ID NO: 48342 - DNA, 18 bp, Artificial Sequence
  Synthetic DNA
tactgcgattgactaaag

SEQ ID NO: 48343 - DNA, 18 bp, Artificial Sequence
  Synthetic DNA
tactgcgcgacactaaag

SEQ ID NO: 48344 - DNA, 18 bp, Artificial Sequence
  Synthetic DNA
tactgcgtctctcgatag

SEQ ID NO: 48345 - DNA, 18 bp, Artificial Sequence
  Synthetic DNA
tactgtgtctaactatag

SEQ ID NO: 48346 - DNA, 18 bp, Artificial Sequence
  Synthetic DNA
tacttagacacacgattg

SEQ ID NO: 48347 - DNA, 18 bp, Artificial Sequence
  Synthetic DNA
tacttcacgtcactatag

SEQ ID NO: 48348 - DNA, 18 bp, Artificial Sequence
  Synthetic DNA
tacttccagccactattg

SEQ ID NO: 48349 - DNA, 18 bp, Artificial Sequence
  Synthetic DNA
tacttccgctcgctatag

SEQ ID NO: 48350 - DNA, 18 bp, Artificial Sequence
  Synthetic DNA
tacttcctctcattatag

SEQ ID NO: 48351 - DNA, 18 bp, Artificial Sequence
  Synthetic DNA
tacttcgaagcactctgg

SEQ ID NO: 48352 - DNA, 18 bp, Artificial Sequence
  Synthetic DNA
tacttcgaataaaattag

SEQ ID NO: 48353 - DNA, 18 bp, Artificial Sequence
  Synthetic DNA
tacttcgacacacatcgg

SEQ ID NO: 48354 - DNA, 18 bp, Artificial Sequence
  Synthetic DNA
tacttcgacataccagtg

SEQ ID NO: 48355 - DNA, 18 bp, Artificial Sequence
  Synthetic DNA
tacttcgactcgggttag

SEQ ID NO: 48356 - DNA, 18 bp, Artificial Sequence
  Synthetic DNA
tacttcgattctcgttag

SEQ ID NO: 48357 - DNA, 18 bp, Artificial Sequence
  Synthetic DNA
tacttcggtccactatag

SEQ ID NO: 48358 - DNA, 18 bp, Artificial Sequence
  Synthetic DNA
tacttcgtatctctacag

SEQ ID NO: 48359 - DNA, 18 bp, Artificial Sequence
  Synthetic DNA
tacttcgtcaccttacag

SEQ ID NO: 48360 - DNA, 18 bp, Artificial Sequence
  Synthetic DNA
tacttcgtctagctaaag

SEQ ID NO: 48361 - DNA, 18 bp, Artificial Sequence
  Synthetic DNA
tacttcgtctctctgtag

SEQ ID NO: 48362 - DNA, 18 bp, Artificial Sequence
  Synthetic DNA
tacttctacccaatatag

SEQ ID NO: 48363 - DNA, 18 bp, Artificial Sequence
  Synthetic DNA
tacttcttctcactacag

SEQ ID NO: 48364 - DNA, 18 bp, Artificial Sequence
  Synthetic DNA
tacttggacgtactatag

SEQ ID NO: 48365 - DNA, 18 bp, Artificial Sequence
  Synthetic DNA
tacttggactcactactg

SEQ ID NO: 48366 - DNA, 18 bp, Artificial Sequence
  Synthetic DNA
tactttgactcactgtcg

SEQ ID NO: 48367 - DNA, 18 bp, Artificial Sequence
  Synthetic DNA
tactttgtcagtctatag

SEQ ID NO: 48368 - DNA, 18 bp, Artificial Sequence
  Synthetic DNA
tagaaccacacactatcg

SEQ ID NO: 48369 - DNA, 18 bp, Artificial Sequence
  Synthetic DNA
tagaacgagtctatattg

SEQ ID NO: 48370 - DNA, 18 bp, Artificial Sequence
  Synthetic DNA
tagaacgcttcactacag

SEQ ID NO: 48371 - DNA, 18 bp, Artificial Sequence
  Synthetic DNA
tagaacggcgaagaattg

SEQ ID NO: 48372 - DNA, 18 bp, Artificial Sequence
  Synthetic DNA
tagaacggttatctatag

SEQ ID NO: 48373 - DNA, 18 bp, Artificial Sequence
  Synthetic DNA
tagaacgtctcagttttg

SEQ ID NO: 48374 - DNA, 18 bp, Artificial Sequence
  Synthetic DNA
tagaactacactttatag

SEQ ID NO: 48375 - DNA, 18 bp, Artificial Sequence
  Synthetic DNA
tagaactactcattttag

SEQ ID NO: 48376 - DNA, 18 bp, Artificial Sequence
  Synthetic DNA
tagaactattcactatcg

SEQ ID NO: 48377 - DNA, 18 bp, Artificial Sequence
  Synthetic DNA
tagaatgacccactttag

SEQ ID NO: 48378 - DNA, 18 bp, Artificial Sequence
  Synthetic DNA
tagaatggcacagtatag

SEQ ID NO: 48379 - DNA, 18 bp, Artificial Sequence
  Synthetic DNA
tagaatgtcacaatagtg

SEQ ID NO: 48380 - DNA, 18 bp, Artificial Sequence
  Synthetic DNA
tagaatttctcactttag

SEQ ID NO: 48381 - DNA, 18 bp, Artificial Sequence
  Synthetic DNA
tagacagaatctgtattg

SEQ ID NO: 48382 - DNA, 18 bp, Artificial Sequence
  Synthetic DNA
tagacggactcacaatag

SEQ ID NO: 48383 - DNA, 18 bp, Artificial Sequence
  Synthetic DNA
tagagcgattcattatag

SEQ ID NO: 48384 - DNA, 18 bp, Artificial Sequence
  Synthetic DNA
tagatcaattcattatag

SEQ ID NO: 48385 - DNA, 18 bp, Artificial Sequence
  Synthetic DNA
tagatcacgtcacttaag

SEQ ID NO: 48386 - DNA, 18 bp, Artificial Sequence
  Synthetic DNA
tagatcgaataacttaag

SEQ ID NO: 48387 - DNA, 18 bp, Artificial Sequence
  Synthetic DNA
tagatcgtcagactacag

SEQ ID NO: 48388 - DNA, 18 bp, Artificial Sequence
  Synthetic DNA
tagattaattaacttttg

SEQ ID NO: 48389 - DNA, 18 bp, Artificial Sequence
  Synthetic DNA
tagatttacttacaagag

SEQ ID NO: 48390 - DNA, 18 bp, Artificial Sequence
  Synthetic DNA
tagcaaaaccaggtatag

SEQ ID NO: 48391 - DNA, 18 bp, Artificial Sequence
  Synthetic DNA
tagcaagtctaacacatg

SEQ ID NO: 48392 - DNA, 18 bp, Artificial Sequence
  Synthetic DNA
tagcacatatcacaaaag

SEQ ID NO: 48393 - DNA, 18 bp, Artificial Sequence
  Synthetic DNA
tagcacgactaactttgg

SEQ ID NO: 48394 - DNA, 18 bp, Artificial Sequence
  Synthetic DNA
tagcacgcatcactatcg

SEQ ID NO: 48395 - DNA, 18 bp, Artificial Sequence
  Synthetic DNA
tagcacgcctctctagag

SEQ ID NO: 48396 - DNA, 18 bp, Artificial Sequence
  Synthetic DNA
tagcactactcaatttag

SEQ ID NO: 48397 - DNA, 18 bp, Artificial Sequence
  Synthetic DNA
tagcagtacactctatag

SEQ ID NO: 48398 - DNA, 18 bp, Artificial Sequence
  Synthetic DNA
tagctcctctcattatag

SEQ ID NO: 48399 - DNA, 18 bp, Artificial Sequence
  Synthetic DNA
tagctggattcactatag

SEQ ID NO: 48400 - DNA, 18 bp, Artificial Sequence
  Synthetic DNA
tagcttgaatcactatag

SEQ ID NO: 48401 - DNA, 18 bp, Artificial Sequence
  Synthetic DNA
taggacgattgtctatag

SEQ ID NO: 48402 - DNA, 18 bp, Artificial Sequence
  Synthetic DNA
taggacgtcacactaaag

SEQ ID NO: 48403 - DNA, 18 bp, Artificial Sequence
  Synthetic DNA
tagtaaagctctttattg

SEQ ID NO: 48404 - DNA, 18 bp, Artificial Sequence
  Synthetic DNA
tagtaagacctactattg

SEQ ID NO: 48405 - DNA, 18 bp, Artificial Sequence
  Synthetic DNA
tagtaagtcacattgtcg

SEQ ID NO: 48406 - DNA, 18 bp, Artificial Sequence
  Synthetic DNA
tagtaatactcaacattg

SEQ ID NO: 48407 - DNA, 18 bp, Artificial Sequence
  Synthetic DNA
tagtaatgctcaccatag

SEQ ID NO: 48408 - DNA, 18 bp, Artificial Sequence
  Synthetic DNA
tagtacaaccctaaatag

SEQ ID NO: 48409 - DNA, 18 bp, Artificial Sequence
  Synthetic DNA
tagtacaactcacgtcag

SEQ ID NO: 48410 - DNA, 18 bp, Artificial Sequence
  Synthetic DNA
tagtaccacaaaccatag

SEQ ID NO: 48411 - DNA, 18 bp, Artificial Sequence
  Synthetic DNA
tagtacctatcacattgg

SEQ ID NO: 48412 - DNA, 18 bp, Artificial Sequence
  Synthetic DNA
tagtacctcacaatatgg

SEQ ID NO: 48413 - DNA, 18 bp, Artificial Sequence
  Synthetic DNA
tagtacctccctcaatag

SEQ ID NO: 48414 - DNA, 18 bp, Artificial Sequence
  Synthetic DNA
tagtacgaatagctactg

SEQ ID NO: 48415 - DNA, 18 bp, Artificial Sequence
  Synthetic DNA
tagtacgaccctttttag

SEQ ID NO: 48416 - DNA, 18 bp, Artificial Sequence
  Synthetic DNA
tagtacgcctcattcttg

SEQ ID NO: 48417 - DNA, 18 bp, Artificial Sequence
  Synthetic DNA
tagtacggctcaacacag

SEQ ID NO: 48418 - DNA, 18 bp, Artificial Sequence
  Synthetic DNA
tagtacgtatacatatag

SEQ ID NO: 48419 - DNA, 18 bp, Artificial Sequence
  Synthetic DNA
tagtacgtcacactagtg

SEQ ID NO: 48420 - DNA, 18 bp, Artificial Sequence
  Synthetic DNA
tagtacgtcactctagtg

SEQ ID NO: 48421 - DNA, 18 bp, Artificial Sequence
  Synthetic DNA
tagtacgtctcagcattg

SEQ ID NO: 48422 - DNA, 18 bp, Artificial Sequence
  Synthetic DNA
tagtacgtgtcgccaaag

SEQ ID NO: 48423 - DNA, 18 bp, Artificial Sequence
  Synthetic DNA
tagtacgtttctagaaag

SEQ ID NO: 48424 - DNA, 18 bp, Artificial Sequence
  Synthetic DNA
tagtactaatcccaatag

SEQ ID NO: 48425 - DNA, 18 bp, Artificial Sequence
  Synthetic DNA
tagtactactaattttag

SEQ ID NO: 48426 - DNA, 18 bp, Artificial Sequence
  Synthetic DNA
tagtactactatcttcag

SEQ ID NO: 48427 - DNA, 18 bp, Artificial Sequence
  Synthetic DNA
tagtactactttctaaag

SEQ ID NO: 48428 - DNA, 18 bp, Artificial Sequence
  Synthetic DNA
tagtactgctctatatag

SEQ ID NO: 48429 - DNA, 18 bp, Artificial Sequence
  Synthetic DNA
tagtagcactaacttttg

SEQ ID NO: 48430 - DNA, 18 bp, Artificial Sequence
  Synthetic DNA
tagtaggacactttacag

SEQ ID NO: 48431 - DNA, 18 bp, Artificial Sequence
  Synthetic DNA
tagtatacctcgctaatg

SEQ ID NO: 48432 - DNA, 18 bp, Artificial Sequence
  Synthetic DNA
tagtatcactcattaatg

SEQ ID NO: 48433 - DNA, 18 bp, Artificial Sequence
  Synthetic DNA
tagtatgaatccccttag

SEQ ID NO: 48434 - DNA, 18 bp, Artificial Sequence
  Synthetic DNA
tagtatgacactcaatag

SEQ ID NO: 48435 - DNA, 18 bp, Artificial Sequence
  Synthetic DNA
tagtatgactttctaaag

SEQ ID NO: 48436 - DNA, 18 bp, Artificial Sequence
  Synthetic DNA
tagtatgactttctttag

SEQ ID NO: 48437 - DNA, 18 bp, Artificial Sequence
  Synthetic DNA
tagtattacatcctatag

SEQ ID NO: 48438 - DNA, 18 bp, Artificial Sequence
  Synthetic DNA
tagtattactcacgtaag

SEQ ID NO: 48439 - DNA, 18 bp, Artificial Sequence
  Synthetic DNA
tagtcagacatactatag

SEQ ID NO: 48440 - DNA, 18 bp, Artificial Sequence
  Synthetic DNA
tagtccgagtatcgatag

SEQ ID NO: 48441 - DNA, 18 bp, Artificial Sequence
  Synthetic DNA
tagtccgattccctaaag

SEQ ID NO: 48442 - DNA, 18 bp, Artificial Sequence
  Synthetic DNA
tagtccgtctcactcttg

SEQ ID NO: 48443 - DNA, 18 bp, Artificial Sequence
  Synthetic DNA
tagtccgtctcacttatg

SEQ ID NO: 48444 - DNA, 18 bp, Artificial Sequence
  Synthetic DNA
tagtcggacttgcttaag

SEQ ID NO: 48445 - DNA, 18 bp, Artificial Sequence
  Synthetic DNA
tagtctggcctagttatg

SEQ ID NO: 48446 - DNA, 18 bp, Artificial Sequence
  Synthetic DNA
tagtgagacccactgtag

SEQ ID NO: 48447 - DNA, 18 bp, Artificial Sequence
  Synthetic DNA
tagtgagactcgctattg

SEQ ID NO: 48448 - DNA, 18 bp, Artificial Sequence
  Synthetic DNA
tagtgagactctaaacag

SEQ ID NO: 48449 - DNA, 18 bp, Artificial Sequence
  Synthetic DNA
tagtgagtcttattatag

SEQ ID NO: 48450 - DNA, 18 bp, Artificial Sequence
  Synthetic DNA
tagtgcgactctgtgtag

SEQ ID NO: 48451 - DNA, 18 bp, Artificial Sequence
  Synthetic DNA
tagtgcgagccactaaag

SEQ ID NO: 48452 - DNA, 18 bp, Artificial Sequence
  Synthetic DNA
tagttagactcacagtag

SEQ ID NO: 48453 - DNA, 18 bp, Artificial Sequence
  Synthetic DNA
tagttcaactcagtttag

SEQ ID NO: 48454 - DNA, 18 bp, Artificial Sequence
  Synthetic DNA
tagttcgaatggccatgg

SEQ ID NO: 48455 - DNA, 18 bp, Artificial Sequence
  Synthetic DNA
tagttcgactatttatag

SEQ ID NO: 48456 - DNA, 18 bp, Artificial Sequence
  Synthetic DNA
tagttcgagactctttag

SEQ ID NO: 48457 - DNA, 18 bp, Artificial Sequence
  Synthetic DNA
tagttcggctctatatag

SEQ ID NO: 48458 - DNA, 18 bp, Artificial Sequence
  Synthetic DNA
tagttcggctctctagag

SEQ ID NO: 48459 - DNA, 18 bp, Artificial Sequence
  Synthetic DNA
tagttcgtatgactaaag

SEQ ID NO: 48460 - DNA, 18 bp, Artificial Sequence
  Synthetic DNA
tagttcgtctatctttcg

SEQ ID NO: 48461 - DNA, 18 bp, Artificial Sequence
  Synthetic DNA
tagttggacacattatag

SEQ ID NO: 48462 - DNA, 18 bp, Artificial Sequence
  Synthetic DNA
tagtttgacttcctatag

SEQ ID NO: 48463 - DNA, 18 bp, Artificial Sequence
  Synthetic DNA
tataaaacctcaatatag

SEQ ID NO: 48464 - DNA, 18 bp, Artificial Sequence
  Synthetic DNA
tataaaagctcactctag

SEQ ID NO: 48465 - DNA, 18 bp, Artificial Sequence
  Synthetic DNA
tataaagactcattcagg

SEQ ID NO: 48466 - DNA, 18 bp, Artificial Sequence
  Synthetic DNA
tataaagactcttaatag

SEQ ID NO: 48467 - DNA, 18 bp, Artificial Sequence
  Synthetic DNA
tataaagagacactgtag

SEQ ID NO: 48468 - DNA, 18 bp, Artificial Sequence
  Synthetic DNA
tataaagattcacgctag

SEQ ID NO: 48469 - DNA, 18 bp, Artificial Sequence
  Synthetic DNA
tataacaaataacaaaag

SEQ ID NO: 48470 - DNA, 18 bp, Artificial Sequence
  Synthetic DNA
tataacaacttacatatg

SEQ ID NO: 48471 - DNA, 18 bp, Artificial Sequence
  Synthetic DNA
tataacagctgactatag

SEQ ID NO: 48472 - DNA, 18 bp, Artificial Sequence
  Synthetic DNA
tataacatcgcactcagg

SEQ ID NO: 48473 - DNA, 18 bp, Artificial Sequence
  Synthetic DNA
tataacatcttaccagag

SEQ ID NO: 48474 - DNA, 18 bp, Artificial Sequence
  Synthetic DNA
tataacatcttgctatag

SEQ ID NO: 48475 - DNA, 18 bp, Artificial Sequence
  Synthetic DNA
tataaccaaacgctatag

SEQ ID NO: 48476 - DNA, 18 bp, Artificial Sequence
  Synthetic DNA
tataaccactctctatgg

SEQ ID NO: 48477 - DNA, 18 bp, Artificial Sequence
  Synthetic DNA
tataacctttcacttacg

SEQ ID NO: 48478 - DNA, 18 bp, Artificial Sequence
  Synthetic DNA
tataacgaaactctaaag

SEQ ID NO: 48479 - DNA, 18 bp, Artificial Sequence
  Synthetic DNA
tataacgaagcacttaag

SEQ ID NO: 48480 - DNA, 18 bp, Artificial Sequence
  Synthetic DNA
tataacgacaaaccatcg

SEQ ID NO: 48481 - DNA, 18 bp, Artificial Sequence
  Synthetic DNA
tataacgactaaatgtag

SEQ ID NO: 48482 - DNA, 18 bp, Artificial Sequence
  Synthetic DNA
tataacgactaactcaag

SEQ ID NO: 48483 - DNA, 18 bp, Artificial Sequence
  Synthetic DNA
tataacgactagccatag

SEQ ID NO: 48484 - DNA, 18 bp, Artificial Sequence
  Synthetic DNA
tataacgacttatttaag

SEQ ID NO: 48485 - DNA, 18 bp, Artificial Sequence
  Synthetic DNA
tataacgattcacaactg

SEQ ID NO: 48486 - DNA, 18 bp, Artificial Sequence
  Synthetic DNA
tataacggctcattaaag

SEQ ID NO: 48487 - DNA, 18 bp, Artificial Sequence
  Synthetic DNA
tataacggttctcaatag

SEQ ID NO: 48488 - DNA, 18 bp, Artificial Sequence
  Synthetic DNA
tataacgtatcaaaaaag

SEQ ID NO: 48489 - DNA, 18 bp, Artificial Sequence
  Synthetic DNA
tataacgtcacaagatag

SEQ ID NO: 48490 - DNA, 18 bp, Artificial Sequence
  Synthetic DNA
tataacgtcacagtatgg

SEQ ID NO: 48491 - DNA, 18 bp, Artificial Sequence
  Synthetic DNA
tataacgtctcacattgg

SEQ ID NO: 48492 - DNA, 18 bp, Artificial Sequence
  Synthetic DNA
tataacgtcttagaatag

SEQ ID NO: 48493 - DNA, 18 bp, Artificial Sequence
  Synthetic DNA
tataacgtctttctcttg

SEQ ID NO: 48494 - DNA, 18 bp, Artificial Sequence
  Synthetic DNA
tataacgttattctctag

SEQ ID NO: 48495 - DNA, 18 bp, Artificial Sequence
  Synthetic DNA
tataacgtttcactctag

SEQ ID NO: 48496 - DNA, 18 bp, Artificial Sequence
  Synthetic DNA
tataactacccagtgtag

SEQ ID NO: 48497 - DNA, 18 bp, Artificial Sequence
  Synthetic DNA
tataactagtccctatag

SEQ ID NO: 48498 - DNA, 18 bp, Artificial Sequence
  Synthetic DNA
tataacttcacacaaaag

SEQ ID NO: 48499 - DNA, 18 bp, Artificial Sequence
  Synthetic DNA
tataacttctctctatag

SEQ ID NO: 48500 - DNA, 18 bp, Artificial Sequence
  Synthetic DNA
tataactttacactatag

SEQ ID NO: 48501 - DNA, 18 bp, Artificial Sequence
  Synthetic DNA
tataaggacaccctgttg

SEQ ID NO: 48502 - DNA, 18 bp, Artificial Sequence
  Synthetic DNA
tataaggtctcagtctag

SEQ ID NO: 48503 - DNA, 18 bp, Artificial Sequence
  Synthetic DNA
tataataacttactacag

SEQ ID NO: 48504 - DNA, 18 bp, Artificial Sequence
  Synthetic DNA
tataatcactctctatag

SEQ ID NO: 48505 - DNA, 18 bp, Artificial Sequence
  Synthetic DNA
tataatgattcactattg

SEQ ID NO: 48506 - DNA, 18 bp, Artificial Sequence
  Synthetic DNA
tatacagtcacacaatcg

SEQ ID NO: 48507 - DNA, 18 bp, Artificial Sequence
  Synthetic DNA
tataccaacacactatcg

SEQ ID NO: 48508 - DNA, 18 bp, Artificial Sequence
  Synthetic DNA
tataccgacacagtatag

SEQ ID NO: 48509 - DNA, 18 bp, Artificial Sequence
  Synthetic DNA
tataccgtcacactaaag

SEQ ID NO: 48510 - DNA, 18 bp, Artificial Sequence
  Synthetic DNA
tataccgtcacctaatag

SEQ ID NO: 48511 - DNA, 18 bp, Artificial Sequence
  Synthetic DNA
tatagacacgaagtaaag

SEQ ID NO: 48512 - DNA, 18 bp, Artificial Sequence
  Synthetic DNA
tatagcgacttataatgg

SEQ ID NO: 48513 - DNA, 18 bp, Artificial Sequence
  Synthetic DNA
tatagctactaacaattg

SEQ ID NO: 48514 - DNA, 18 bp, Artificial Sequence
  Synthetic DNA
tatatacattcactattg

SEQ ID NO: 48515 - DNA, 18 bp, Artificial Sequence
  Synthetic DNA
tatatagatccactcatg

SEQ ID NO: 48516 - DNA, 18 bp, Artificial Sequence
  Synthetic DNA
tatatcaacccactttag

SEQ ID NO: 48517 - DNA, 18 bp, Artificial Sequence
  Synthetic DNA
tatatccacatgttattg

SEQ ID NO: 48518 - DNA, 18 bp, Artificial Sequence
  Synthetic DNA
tatatccgctcgctacag

SEQ ID NO: 48519 - DNA, 18 bp, Artificial Sequence
  Synthetic DNA
tatatcgaatcacataag

SEQ ID NO: 48520 - DNA, 18 bp, Artificial Sequence
  Synthetic DNA
tatatcgaatttctatag

SEQ ID NO: 48521 - DNA, 18 bp, Artificial Sequence
  Synthetic DNA
tatatcgacgaactatag

SEQ ID NO: 48522 - DNA, 18 bp, Artificial Sequence
  Synthetic DNA
tatatcgactaactatgg

SEQ ID NO: 48523 - DNA, 18 bp, Artificial Sequence
  Synthetic DNA
tatatcgactctctatcg

SEQ ID NO: 48524 - DNA, 18 bp, Artificial Sequence
  Synthetic DNA
tatatcgtctcactacag

SEQ ID NO: 48525 - DNA, 18 bp, Artificial Sequence
  Synthetic DNA
tatatcgtctctctttag

SEQ ID NO: 48526 - DNA, 18 bp, Artificial Sequence
  Synthetic DNA
tatatcgtttaacatgag

SEQ ID NO: 48527 - DNA, 18 bp, Artificial Sequence
  Synthetic DNA
tatatcttcacagtacag

SEQ ID NO: 48528 - DNA, 18 bp, Artificial Sequence
  Synthetic DNA
tatatcttcttactctag

SEQ ID NO: 48529 - DNA, 18 bp, Artificial Sequence
  Synthetic DNA
tatatggacgcactaatg

SEQ ID NO: 48530 - DNA, 18 bp, Artificial Sequence
  Synthetic DNA
tatattgactatcaatag

SEQ ID NO: 48531 - DNA, 18 bp, Artificial Sequence
  Synthetic DNA
tatcaacactgactttag

SEQ ID NO: 48532 - DNA, 18 bp, Artificial Sequence
  Synthetic DNA
tatcaagacatactatcg

SEQ ID NO: 48533 - DNA, 18 bp, Artificial Sequence
  Synthetic DNA
tatcacaaaatcctatag

SEQ ID NO: 48534 - DNA, 18 bp, Artificial Sequence
  Synthetic DNA
tatcacgacacgagatag

SEQ ID NO: 48535 - DNA, 18 bp, Artificial Sequence
  Synthetic DNA
tatcacgacccaccaggg

SEQ ID NO: 48536 - DNA, 18 bp, Artificial Sequence
  Synthetic DNA
tatcacgactcatttcag

SEQ ID NO: 48537 - DNA, 18 bp, Artificial Sequence
  Synthetic DNA
tatcacgagtcacactag

SEQ ID NO: 48538 - DNA, 18 bp, Artificial Sequence
  Synthetic DNA
tatcacgagtgcctaatg

SEQ ID NO: 48539 - DNA, 18 bp, Artificial Sequence
  Synthetic DNA
tatcacgcctcactcaag

SEQ ID NO: 48540 - DNA, 18 bp, Artificial Sequence
  Synthetic DNA
tatcactactcgctttag

SEQ ID NO: 48541 - DNA, 18 bp, Artificial Sequence
  Synthetic DNA
tatcactagtcaatatag

SEQ ID NO: 48542 - DNA, 18 bp, Artificial Sequence
  Synthetic DNA
tatcactgctaactatag

SEQ ID NO: 48543 - DNA, 18 bp, Artificial Sequence
  Synthetic DNA
tatcacttctcactaggg

SEQ ID NO: 48544 - DNA, 18 bp, Artificial Sequence
  Synthetic DNA
tatcagaacgcaccttag

SEQ ID NO: 48545 - DNA, 18 bp, Artificial Sequence
  Synthetic DNA
tatcaggtctagctaaag

SEQ ID NO: 48546 - DNA, 18 bp, Artificial Sequence
  Synthetic DNA
tatcatgtcacactattg

SEQ ID NO: 48547 - DNA, 18 bp, Artificial Sequence
  Synthetic DNA
tatcattacttactatag

SEQ ID NO: 48548 - DNA, 18 bp, Artificial Sequence
  Synthetic DNA
tatcctgattttctatag

SEQ ID NO: 48549 - DNA, 18 bp, Artificial Sequence
  Synthetic DNA
tatcggtactcactaaag

SEQ ID NO: 48550 - DNA, 18 bp, Artificial Sequence
  Synthetic DNA
tatctagactctcaatag

SEQ ID NO: 48551 - DNA, 18 bp, Artificial Sequence
  Synthetic DNA
tatctcaattcacataag

SEQ ID NO: 48552 - DNA, 18 bp, Artificial Sequence
  Synthetic DNA
tatctcgacccactgtag

SEQ ID NO: 48553 - DNA, 18 bp, Artificial Sequence
  Synthetic DNA
tatctcgactcactagcg

SEQ ID NO: 48554 - DNA, 18 bp, Artificial Sequence
  Synthetic DNA
tatctcgtcacactgtag

SEQ ID NO: 48555 - DNA, 18 bp, Artificial Sequence
  Synthetic DNA
tatctcgtctctcttaag

SEQ ID NO: 48556 - DNA, 18 bp, Artificial Sequence
  Synthetic DNA
tatctggagtcacaattg

SEQ ID NO: 48557 - DNA, 18 bp, Artificial Sequence
  Synthetic DNA
tatctttactcactaaag

SEQ ID NO: 48558 - DNA, 18 bp, Artificial Sequence
  Synthetic DNA
tatgacaactttctaacg

SEQ ID NO: 48559 - DNA, 18 bp, Artificial Sequence
  Synthetic DNA
tatgacgactcacttatg

SEQ ID NO: 48560 - DNA, 18 bp, Artificial Sequence
  Synthetic DNA
tatgacgactgacaaaag

SEQ ID NO: 48561 - DNA, 18 bp, Artificial Sequence
  Synthetic DNA
tatgactactcacagaag

SEQ ID NO: 48562 - DNA, 18 bp, Artificial Sequence
  Synthetic DNA
tatgaggactctctgttg

SEQ ID NO: 48563 - DNA, 18 bp, Artificial Sequence
  Synthetic DNA
tatgatgactctctttcg

SEQ ID NO: 48564 - DNA, 18 bp, Artificial Sequence
  Synthetic DNA
tatgatggtactccatag

SEQ ID NO: 48565 - DNA, 18 bp, Artificial Sequence
  Synthetic DNA
tatgatgtcttactttgg

SEQ ID NO: 48566 - DNA, 18 bp, Artificial Sequence
  Synthetic DNA
tatgccaaatcaatctag

SEQ ID NO: 48567 - DNA, 18 bp, Artificial Sequence
  Synthetic DNA
tatgccgactctcttcag

SEQ ID NO: 48568 - DNA, 18 bp, Artificial Sequence
  Synthetic DNA
tatggcgacacattttag

SEQ ID NO: 48569 - DNA, 18 bp, Artificial Sequence
  Synthetic DNA
tatggcgacttccttaag

SEQ ID NO: 48570 - DNA, 18 bp, Artificial Sequence
  Synthetic DNA
tatgtcgagtcaacattg

SEQ ID NO: 48571 - DNA, 18 bp, Artificial Sequence
  Synthetic DNA
tatgtcggcacacttaag

SEQ ID NO: 48572 - DNA, 18 bp, Artificial Sequence
  Synthetic DNA
tatgtcttctctctatag

SEQ ID NO: 48573 - DNA, 18 bp, Artificial Sequence
  Synthetic DNA
tattaaaacacactattg

SEQ ID NO: 48574 - DNA, 18 bp, Artificial Sequence
  Synthetic DNA
tattaaaactgactttag

SEQ ID NO: 48575 - DNA, 18 bp, Artificial Sequence
  Synthetic DNA
tattaaaattgactatag

SEQ ID NO: 48576 - DNA, 18 bp, Artificial Sequence
  Synthetic DNA
tattaaacttaactaaag

SEQ ID NO: 48577 - DNA, 18 bp, Artificial Sequence
  Synthetic DNA
tattaaatcacacaatag

SEQ ID NO: 48578 - DNA, 18 bp, Artificial Sequence
  Synthetic DNA
tattaaatcgcaatatcg

SEQ ID NO: 48579 - DNA, 18 bp, Artificial Sequence
  Synthetic DNA
tattaaatctctctaaag

SEQ ID NO: 48580 - DNA, 18 bp, Artificial Sequence
  Synthetic DNA
tattaacactcacttcag

SEQ ID NO: 48581 - DNA, 18 bp, Artificial Sequence
  Synthetic DNA
tattaacactcaggatag

SEQ ID NO: 48582 - DNA, 18 bp, Artificial Sequence
  Synthetic DNA
tattaagaatcaataaag

SEQ ID NO: 48583 - DNA, 18 bp, Artificial Sequence
  Synthetic DNA
tattaagaatcacaattg

SEQ ID NO: 48584 - DNA, 18 bp, Artificial Sequence
  Synthetic DNA
tattaagacacaaattag

SEQ ID NO: 48585 - DNA, 18 bp, Artificial Sequence
  Synthetic DNA
tattaagactaacttttg

SEQ ID NO: 48586 - DNA, 18 bp, Artificial Sequence
  Synthetic DNA
tattaagactcaatagtg

SEQ ID NO: 48587 - DNA, 18 bp, Artificial Sequence
  Synthetic DNA
tattaagactcatattag

SEQ ID NO: 48588 - DNA, 18 bp, Artificial Sequence
  Synthetic DNA
tattaagatcctctatag

SEQ ID NO: 48589 - DNA, 18 bp, Artificial Sequence
  Synthetic DNA
tattaagattcaccatgg

SEQ ID NO: 48590 - DNA, 18 bp, Artificial Sequence
  Synthetic DNA
tattaagattctttttgg

SEQ ID NO: 48591 - DNA, 18 bp, Artificial Sequence
  Synthetic DNA
tattaagccgctctatag

SEQ ID NO: 48592 - DNA, 18 bp, Artificial Sequence
  Synthetic DNA
tattaaggctatcaatag

SEQ ID NO: 48593 - DNA, 18 bp, Artificial Sequence
  Synthetic DNA
tattaaggctcattacag

SEQ ID NO: 48594 - DNA, 18 bp, Artificial Sequence
  Synthetic DNA
tattaaggtacgcaatta

SEQ ID NO: 48595 - DNA, 18 bp, Artificial Sequence
  Synthetic DNA
tattaagtcttcctatag

SEQ ID NO: 48596 - DNA, 18 bp, Artificial Sequence
  Synthetic DNA
tattaagttcttctctag

SEQ ID NO: 48597 - DNA, 18 bp, Artificial Sequence
  Synthetic DNA
tattaataaattctatag

SEQ ID NO: 48598 - DNA, 18 bp, Artificial Sequence
  Synthetic DNA
tattaatactcaatatgg

SEQ ID NO: 48599 - DNA, 18 bp, Artificial Sequence
  Synthetic DNA
tattaatactctctcaag

SEQ ID NO: 48600 - DNA, 18 bp, Artificial Sequence
  Synthetic DNA
tattaatagacagtttag

SEQ ID NO: 48601 - DNA, 18 bp, Artificial Sequence
  Synthetic DNA
tattaatattcactctgg

SEQ ID NO: 48602 - DNA, 18 bp, Artificial Sequence
  Synthetic DNA
tattaatccatatttaag

SEQ ID NO: 48603 - DNA, 18 bp, Artificial Sequence
  Synthetic DNA
tattacaaagctctttag

SEQ ID NO: 48604 - DNA, 18 bp, Artificial Sequence
  Synthetic DNA
tattacaaatcaataagg

SEQ ID NO: 48605 - DNA, 18 bp, Artificial Sequence
  Synthetic DNA
tattacaaatccctattg

SEQ ID NO: 48606 - DNA, 18 bp, Artificial Sequence
  Synthetic DNA
tattacaaatggctaaag

SEQ ID NO: 48607 - DNA, 18 bp, Artificial Sequence
  Synthetic DNA
tattacaaattacaatag

SEQ ID NO: 48608 - DNA, 18 bp, Artificial Sequence
  Synthetic DNA
tattacaacactccttcg

SEQ ID NO: 48609 - DNA, 18 bp, Artificial Sequence
  Synthetic DNA
tattacaacccaatgtag

SEQ ID NO: 48610 - DNA, 18 bp, Artificial Sequence
  Synthetic DNA
tattacaactaactgaag

SEQ ID NO: 48611 - DNA, 18 bp, Artificial Sequence
  Synthetic DNA
tattacaactatccatag

SEQ ID NO: 48612 - DNA, 18 bp, Artificial Sequence
  Synthetic DNA
tattacaactcaataatg

SEQ ID NO: 48613 - DNA, 18 bp, Artificial Sequence
  Synthetic DNA
tattacaactcacatttg

SEQ ID NO: 48614 - DNA, 18 bp, Artificial Sequence
  Synthetic DNA
tattacaactcatcacag

SEQ ID NO: 48615 - DNA, 18 bp, Artificial Sequence
  Synthetic DNA
tattacaatacattatag

SEQ ID NO: 48616 - DNA, 18 bp, Artificial Sequence
  Synthetic DNA
tattacaattcgctattg

SEQ ID NO: 48617 - DNA, 18 bp, Artificial Sequence
  Synthetic DNA
tattacaattctatatcg

SEQ ID NO: 48618 - DNA, 18 bp, Artificial Sequence
  Synthetic DNA
tattacaatttactgcag

SEQ ID NO: 48619 - DNA, 18 bp, Artificial Sequence
  Synthetic DNA
tattacaatttagtaaag

SEQ ID NO: 48620 - DNA, 18 bp, Artificial Sequence
  Synthetic DNA
tattacagctcaagatag

SEQ ID NO: 48621 - DNA, 18 bp, Artificial Sequence
  Synthetic DNA
tattacagctcacagtag

SEQ ID NO: 48622 - DNA, 18 bp, Artificial Sequence
  Synthetic DNA
tattacatatttctcttg

SEQ ID NO: 48623 - DNA, 18 bp, Artificial Sequence
  Synthetic DNA
tattacatccttctatag

SEQ ID NO: 48624 - DNA, 18 bp, Artificial Sequence
  Synthetic DNA
tattacattcaacttaag

SEQ ID NO: 48625 - DNA, 18 bp, Artificial Sequence
  Synthetic DNA
tattaccacacaaaatag

SEQ ID NO: 48626 - DNA, 18 bp, Artificial Sequence
  Synthetic DNA
tattaccacacagtattg

SEQ ID NO: 48627 - DNA, 18 bp, Artificial Sequence
  Synthetic DNA
tattaccacacgctatgg

SEQ ID NO: 48628 - DNA, 18 bp, Artificial Sequence
  Synthetic DNA
tattaccaccctcttaag

SEQ ID NO: 48629 - DNA, 18 bp, Artificial Sequence
  Synthetic DNA
tattaccactcgtcaatg

SEQ ID NO: 48630 - DNA, 18 bp, Artificial Sequence
  Synthetic DNA
tattaccattctctatgg

SEQ ID NO: 48631 - DNA, 18 bp, Artificial Sequence
  Synthetic DNA
tattacccatcattctag

SEQ ID NO: 48632 - DNA, 18 bp, Artificial Sequence
  Synthetic DNA
tattacctctgacactag

SEQ ID NO: 48633 - DNA, 18 bp, Artificial Sequence
  Synthetic DNA
tattacgaaacaccacag

SEQ ID NO: 48634 - DNA, 18 bp, Artificial Sequence
  Synthetic DNA
tattacgaaatccttaag

SEQ ID NO: 48635 - DNA, 18 bp, Artificial Sequence
  Synthetic DNA
tattacgaatgaaacttg

SEQ ID NO: 48636 - DNA, 18 bp, Artificial Sequence
  Synthetic DNA
tattacgacacgaaattg

SEQ ID NO: 48637 - DNA, 18 bp, Artificial Sequence
  Synthetic DNA
tattacgacacgttaaag

SEQ ID NO: 48638 - DNA, 18 bp, Artificial Sequence
  Synthetic DNA
tattacgacagactgttg

SEQ ID NO: 48639 - DNA, 18 bp, Artificial Sequence
  Synthetic DNA
tattacgacatgctaaag

SEQ ID NO: 48640 - DNA, 18 bp, Artificial Sequence
  Synthetic DNA
tattacgacctagtattg

SEQ ID NO: 48641 - DNA, 18 bp, Artificial Sequence
  Synthetic DNA
tattacgacgaacttaag

SEQ ID NO: 48642 - DNA, 18 bp, Artificial Sequence
  Synthetic DNA
tattacgactagctgtcg

SEQ ID NO: 48643 - DNA, 18 bp, Artificial Sequence
  Synthetic DNA
tattacgactcgtttatg

SEQ ID NO: 48644 - DNA, 18 bp, Artificial Sequence
  Synthetic DNA
tattacgactctattaag

SEQ ID NO: 48645 - DNA, 18 bp, Artificial Sequence
  Synthetic DNA
tattacgactctccactg

SEQ ID NO: 48646 - DNA, 18 bp, Artificial Sequence
  Synthetic DNA
tattacgactctcgtatg

SEQ ID NO: 48647 - DNA, 18 bp, Artificial Sequence
  Synthetic DNA
tattacgactctgctttg

SEQ ID NO: 48648 - DNA, 18 bp, Artificial Sequence
  Synthetic DNA
tattacgactctttaacg

SEQ ID NO: 48649 - DNA, 18 bp, Artificial Sequence
  Synthetic DNA
tattacgactgataattg

SEQ ID NO: 48650 - DNA, 18 bp, Artificial Sequence
  Synthetic DNA
tattacgacttgcaaatg

SEQ ID NO: 48651 - DNA, 18 bp, Artificial Sequence
  Synthetic DNA
tattacgagtacccatag

SEQ ID NO: 48652 - DNA, 18 bp, Artificial Sequence
  Synthetic DNA
tattacgagtcacatgag

SEQ ID NO: 48653 - DNA, 18 bp, Artificial Sequence
  Synthetic DNA
tattacgagtctcctaag

SEQ ID NO: 48654 - DNA, 18 bp, Artificial Sequence
  Synthetic DNA
tattacgagttgacatag

SEQ ID NO: 48655 - DNA, 18 bp, Artificial Sequence
  Synthetic DNA
tattacgatacattacgg

SEQ ID NO: 48656 - DNA, 18 bp, Artificial Sequence
  Synthetic DNA
tattacgatactttatag

SEQ ID NO: 48657 - DNA, 18 bp, Artificial Sequence
  Synthetic DNA
tattacgatccagtattg

SEQ ID NO: 48658 - DNA, 18 bp, Artificial Sequence
  Synthetic DNA
tattacgatgctcaatag

SEQ ID NO: 48659 - DNA, 18 bp, Artificial Sequence
  Synthetic DNA
tattacgattcacactcg

SEQ ID NO: 48660 - DNA, 18 bp, Artificial Sequence
  Synthetic DNA
tattacgattctcttgag

SEQ ID NO: 48661 - DNA, 18 bp, Artificial Sequence
  Synthetic DNA
tattacgcatcacttttg

SEQ ID NO: 48662 - DNA, 18 bp, Artificial Sequence
  Synthetic DNA
tattacgccacgttaaag

SEQ ID NO: 48663 - DNA, 18 bp, Artificial Sequence
  Synthetic DNA
tattacgccgctttttag

SEQ ID NO: 48664 - DNA, 18 bp, Artificial Sequence
  Synthetic DNA
tattacgcctctctaagg

SEQ ID NO: 48665 - DNA, 18 bp, Artificial Sequence
  Synthetic DNA
tattacgctacacttaag

SEQ ID NO: 48666 - DNA, 18 bp, Artificial Sequence
  Synthetic DNA
tattacgctatactttag

SEQ ID NO: 48667 - DNA, 18 bp, Artificial Sequence
  Synthetic DNA
tattacggaacattatgg

SEQ ID NO: 48668 - DNA, 18 bp, Artificial Sequence
  Synthetic DNA
tattacggctacatacag

SEQ ID NO: 48669 - DNA, 18 bp, Artificial Sequence
  Synthetic DNA
tattacgtatcacgctag

SEQ ID NO: 48670 - DNA, 18 bp, Artificial Sequence
  Synthetic DNA
tattacgtattactatgg

SEQ ID NO: 48671 - DNA, 18 bp, Artificial Sequence
  Synthetic DNA
tattacgtcacacagttg

SEQ ID NO: 48672 - DNA, 18 bp, Artificial Sequence
  Synthetic DNA
tattacgtccaacaatag

SEQ ID NO: 48673 - DNA, 18 bp, Artificial Sequence
  Synthetic DNA
tattacgtctcaaaattg

SEQ ID NO: 48674 - DNA, 18 bp, Artificial Sequence
  Synthetic DNA
tattacgtctcatgcaag

SEQ ID NO: 48675 - DNA, 18 bp, Artificial Sequence
  Synthetic DNA
tattacgtctctctactg

SEQ ID NO: 48676 - DNA, 18 bp, Artificial Sequence
  Synthetic DNA
tattacgttaaacttgag

SEQ ID NO: 48677 - DNA, 18 bp, Artificial Sequence
  Synthetic DNA
tattacgttacacattag

SEQ ID NO: 48678 - DNA, 18 bp, Artificial Sequence
  Synthetic DNA
tattacgtttcactaacg

SEQ ID NO: 48679 - DNA, 18 bp, Artificial Sequence
  Synthetic DNA
tattactaatcgatatag

SEQ ID NO: 48680 - DNA, 18 bp, Artificial Sequence
  Synthetic DNA
tattactaattacaattg

SEQ ID NO: 48681 - DNA, 18 bp, Artificial Sequence
  Synthetic DNA
tattactaccaactagag

SEQ ID NO: 48682 - DNA, 18 bp, Artificial Sequence
  Synthetic DNA
tattactaccatatctag

SEQ ID NO: 48683 - DNA, 18 bp, Artificial Sequence
  Synthetic DNA
tattactaccctatttgg

SEQ ID NO: 48684 - DNA, 18 bp, Artificial Sequence
  Synthetic DNA
tattactactaattgaag

SEQ ID NO: 48685 - DNA, 18 bp, Artificial Sequence
  Synthetic DNA
tattactactcgcaatcg

SEQ ID NO: 48686 - DNA, 18 bp, Artificial Sequence
  Synthetic DNA
tattactactcgctaatg

SEQ ID NO: 48687 - DNA, 18 bp, Artificial Sequence
  Synthetic DNA
tattactactctttgtag

SEQ ID NO: 48688 - DNA, 18 bp, Artificial Sequence
  Synthetic DNA
tattactattctccttag

SEQ ID NO: 48689 - DNA, 18 bp, Artificial Sequence
  Synthetic DNA
tattactcctctctaatg

SEQ ID NO: 48690 - DNA, 18 bp, Artificial Sequence
  Synthetic DNA
tattactgttcagtttag

SEQ ID NO: 48691 - DNA, 18 bp, Artificial Sequence
  Synthetic DNA
tattacttaacgctgtag

SEQ ID NO: 48692 - DNA, 18 bp, Artificial Sequence
  Synthetic DNA
tattacttatcaatatag

SEQ ID NO: 48693 - DNA, 18 bp, Artificial Sequence
  Synthetic DNA
tattacttctcaatctag

SEQ ID NO: 48694 - DNA, 18 bp, Artificial Sequence
  Synthetic DNA
tattactttactctatag

SEQ ID NO: 48695 - DNA, 18 bp, Artificial Sequence
  Synthetic DNA
tattagaagtctcaatcg

SEQ ID NO: 48696 - DNA, 18 bp, Artificial Sequence
  Synthetic DNA
tattagcactcacataag

SEQ ID NO: 48697 - DNA, 18 bp, Artificial Sequence
  Synthetic DNA
tattaggacactctagag

SEQ ID NO: 48698 - DNA, 18 bp, Artificial Sequence
  Synthetic DNA
tattaggactctcctttg

SEQ ID NO: 48699 - DNA, 18 bp, Artificial Sequence
  Synthetic DNA
tattaggattttctattg

SEQ ID NO: 48700 - DNA, 18 bp, Artificial Sequence
  Synthetic DNA
tattaggtcgctcaattg

SEQ ID NO: 48701 - DNA, 18 bp, Artificial Sequence
  Synthetic DNA
tattagtactcactcaag

SEQ ID NO: 48702 - DNA, 18 bp, Artificial Sequence
  Synthetic DNA
tattagtagtctctaggg

SEQ ID NO: 48703 - DNA, 18 bp, Artificial Sequence
  Synthetic DNA
tattagtattaactaaag

SEQ ID NO: 48704 - DNA, 18 bp, Artificial Sequence
  Synthetic DNA
tattagttctcacaacag

SEQ ID NO: 48705 - DNA, 18 bp, Artificial Sequence
  Synthetic DNA
tattataactaaatattg

SEQ ID NO: 48706 - DNA, 18 bp, Artificial Sequence
  Synthetic DNA
tattataacttaatatag

SEQ ID NO: 48707 - DNA, 18 bp, Artificial Sequence
  Synthetic DNA
tattatagctcaatatag

SEQ ID NO: 48708 - DNA, 18 bp, Artificial Sequence
  Synthetic DNA
tattatatcttactttag

SEQ ID NO: 48709 - DNA, 18 bp, Artificial Sequence
  Synthetic DNA
tattatgacccataagtg

SEQ ID NO: 48710 - DNA, 18 bp, Artificial Sequence
  Synthetic DNA
tattatgactaatttcag

SEQ ID NO: 48711 - DNA, 18 bp, Artificial Sequence
  Synthetic DNA
tattatgacttattagag

SEQ ID NO: 48712 - DNA, 18 bp, Artificial Sequence
  Synthetic DNA
tattatgactttctatcg

SEQ ID NO: 48713 - DNA, 18 bp, Artificial Sequence
  Synthetic DNA
tattatgataccctttag

SEQ ID NO: 48714 - DNA, 18 bp, Artificial Sequence
  Synthetic DNA
tattatgatgatctacag

SEQ ID NO: 48715 - DNA, 18 bp, Artificial Sequence
  Synthetic DNA
tattatgattacatacag

SEQ ID NO: 48716 - DNA, 18 bp, Artificial Sequence
  Synthetic DNA
tattatgattcataatag

SEQ ID NO: 48717 - DNA, 18 bp, Artificial Sequence
  Synthetic DNA
tattatgattggcgatag

SEQ ID NO: 48718 - DNA, 18 bp, Artificial Sequence
  Synthetic DNA
tattatggatcattttag

SEQ ID NO: 48719 - DNA, 18 bp, Artificial Sequence
  Synthetic DNA
tattatgtctcattatcg

SEQ ID NO: 48720 - DNA, 18 bp, Artificial Sequence
  Synthetic DNA
tattatgtttccctattg

SEQ ID NO: 48721 - DNA, 18 bp, Artificial Sequence
  Synthetic DNA
tattattaatccatacag

SEQ ID NO: 48722 - DNA, 18 bp, Artificial Sequence
  Synthetic DNA
tattattactttctatag

SEQ ID NO: 48723 - DNA, 18 bp, Artificial Sequence
  Synthetic DNA
tattatttcttactgttg

SEQ ID NO: 48724 - DNA, 18 bp, Artificial Sequence
  Synthetic DNA
tattcagaatcacataag

SEQ ID NO: 48725 - DNA, 18 bp, Artificial Sequence
  Synthetic DNA
tattcagtaccactaaag

SEQ ID NO: 48726 - DNA, 18 bp, Artificial Sequence
  Synthetic DNA
tattccaactctctttag

SEQ ID NO: 48727 - DNA, 18 bp, Artificial Sequence
  Synthetic DNA
tattccaacttactaaag

SEQ ID NO: 48728 - DNA, 18 bp, Artificial Sequence
  Synthetic DNA
tattccaattcactagag

SEQ ID NO: 48729 - DNA, 18 bp, Artificial Sequence
  Synthetic DNA
tattccatcttactatcg

SEQ ID NO: 48730 - DNA, 18 bp, Artificial Sequence
  Synthetic DNA
tattccatttctgcatag

SEQ ID NO: 48731 - DNA, 18 bp, Artificial Sequence
  Synthetic DNA
tattcccaatcacaatgg

SEQ ID NO: 48732 - DNA, 18 bp, Artificial Sequence
  Synthetic DNA
tattcccacacactaagg

SEQ ID NO: 48733 - DNA, 18 bp, Artificial Sequence
  Synthetic DNA
tattcccactaactgagg

SEQ ID NO: 48734 - DNA, 18 bp, Artificial Sequence
  Synthetic DNA
tattccgaataacaatag

SEQ ID NO: 48735 - DNA, 18 bp, Artificial Sequence
  Synthetic DNA
tattccgaatcacttaag

SEQ ID NO: 48736 - DNA, 18 bp, Artificial Sequence
  Synthetic DNA
tattccgacacaatacag

SEQ ID NO: 48737 - DNA, 18 bp, Artificial Sequence
  Synthetic DNA
tattccgactctctttgg

SEQ ID NO: 48738 - DNA, 18 bp, Artificial Sequence
  Synthetic DNA
tattccgactctcttttg

SEQ ID NO: 48739 - DNA, 18 bp, Artificial Sequence
  Synthetic DNA
tattccgactgacaaatg

SEQ ID NO: 48740 - DNA, 18 bp, Artificial Sequence
  Synthetic DNA
tattccgagagaatatag

SEQ ID NO: 48741 - DNA, 18 bp, Artificial Sequence
  Synthetic DNA
tattccgatttataatag

SEQ ID NO: 48742 - DNA, 18 bp, Artificial Sequence
  Synthetic DNA
tattccgtcatactatgg

SEQ ID NO: 48743 - DNA, 18 bp, Artificial Sequence
  Synthetic DNA
tattccgtctgactcgag

SEQ ID NO: 48744 - DNA, 18 bp, Artificial Sequence
  Synthetic DNA
tattccgtctgcctttag

SEQ ID NO: 48745 - DNA, 18 bp, Artificial Sequence
  Synthetic DNA
tattcgatcttactatag

SEQ ID NO: 48746 - DNA, 18 bp, Artificial Sequence
  Synthetic DNA
tattcgcggtcactatag

SEQ ID NO: 48747 - DNA, 18 bp, Artificial Sequence
  Synthetic DNA
tattcgtcctaaccttag

SEQ ID NO: 48748 - DNA, 18 bp, Artificial Sequence
  Synthetic DNA
tattctggctcaatatag

SEQ ID NO: 48749 - DNA, 18 bp, Artificial Sequence
  Synthetic DNA
tattgaaaatcactaaag

SEQ ID NO: 48750 - DNA, 18 bp, Artificial Sequence
  Synthetic DNA
tattgagacttattttag

SEQ ID NO: 48751 - DNA, 18 bp, Artificial Sequence
  Synthetic DNA
tattgcaactcaataaag

SEQ ID NO: 48752 - DNA, 18 bp, Artificial Sequence
  Synthetic DNA
tattgccactaactagtg

SEQ ID NO: 48753 - DNA, 18 bp, Artificial Sequence
  Synthetic DNA
tattgcgaatcacaaacg

SEQ ID NO: 48754 - DNA, 18 bp, Artificial Sequence
  Synthetic DNA
tattgcgacaacctcaag

SEQ ID NO: 48755 - DNA, 18 bp, Artificial Sequence
  Synthetic DNA
tattgcgaccctttaaag

SEQ ID NO: 48756 - DNA, 18 bp, Artificial Sequence
  Synthetic DNA
tattgcgacgtactgtag

SEQ ID NO: 48757 - DNA, 18 bp, Artificial Sequence
  Synthetic DNA
tattgcgagatactatag

SEQ ID NO: 48758 - DNA, 18 bp, Artificial Sequence
  Synthetic DNA
tattgcgtctaactacag

SEQ ID NO: 48759 - DNA, 18 bp, Artificial Sequence
  Synthetic DNA
tattgctacaccctatag

SEQ ID NO: 48760 - DNA, 18 bp, Artificial Sequence
  Synthetic DNA
tattgctgctcagtaccg

SEQ ID NO: 48761 - DNA, 18 bp, Artificial Sequence
  Synthetic DNA
tattgggattcgctttag

SEQ ID NO: 48762 - DNA, 18 bp, Artificial Sequence
  Synthetic DNA
tatttaagcccactttag

SEQ ID NO: 48763 - DNA, 18 bp, Artificial Sequence
  Synthetic DNA
tatttactctccctatag

SEQ ID NO: 48764 - DNA, 18 bp, Artificial Sequence
  Synthetic DNA
tatttagacacagaatcg

SEQ ID NO: 48765 - DNA, 18 bp, Artificial Sequence
  Synthetic DNA
tatttagacccactaaag

SEQ ID NO: 48766 - DNA, 18 bp, Artificial Sequence
  Synthetic DNA
tatttcaacattttctag

SEQ ID NO: 48767 - DNA, 18 bp, Artificial Sequence
  Synthetic DNA
tatttcaactatccaaag

SEQ ID NO: 48768 - DNA, 18 bp, Artificial Sequence
  Synthetic DNA
tatttcaactctacagag

SEQ ID NO: 48769 - DNA, 18 bp, Artificial Sequence
  Synthetic DNA
tatttcaactgattttag

SEQ ID NO: 48770 - DNA, 18 bp, Artificial Sequence
  Synthetic DNA
tatttcaactgcctaaag

SEQ ID NO: 48771 - DNA, 18 bp, Artificial Sequence
  Synthetic DNA
tatttcatcgcactacag

SEQ ID NO: 48772 - DNA, 18 bp, Artificial Sequence
  Synthetic DNA
tatttccacggacttaag

SEQ ID NO: 48773 - DNA, 18 bp, Artificial Sequence
  Synthetic DNA
tatttccactcacagtag

SEQ ID NO: 48774 - DNA, 18 bp, Artificial Sequence
  Synthetic DNA
tatttcgaatcacttaag

SEQ ID NO: 48775 - DNA, 18 bp, Artificial Sequence
  Synthetic DNA
tatttcgaatctctcaag

SEQ ID NO: 48776 - DNA, 18 bp, Artificial Sequence
  Synthetic DNA
tatttcgaatctttatag

SEQ ID NO: 48777 - DNA, 18 bp, Artificial Sequence
  Synthetic DNA
tatttcgacaaactaatg

SEQ ID NO: 48778 - DNA, 18 bp, Artificial Sequence
  Synthetic DNA
tatttcgacacactgtaa

SEQ ID NO: 48779 - DNA, 18 bp, Artificial Sequence
  Synthetic DNA
tatttcgacaccttatag

SEQ ID NO: 48780 - DNA, 18 bp, Artificial Sequence
  Synthetic DNA
tatttcgacacgatttag

SEQ ID NO: 48781 - DNA, 18 bp, Artificial Sequence
  Synthetic DNA
tatttcgactcacgtttg

SEQ ID NO: 48782 - DNA, 18 bp, Artificial Sequence
  Synthetic DNA
tatttcgacttactgttg

SEQ ID NO: 48783 - DNA, 18 bp, Artificial Sequence
  Synthetic DNA
tatttcgattcaacatag

SEQ ID NO: 48784 - DNA, 18 bp, Artificial Sequence
  Synthetic DNA
tatttcgatttgcttaag

SEQ ID NO: 48785 - DNA, 18 bp, Artificial Sequence
  Synthetic DNA
tatttcgtcacccaatag

SEQ ID NO: 48786 - DNA, 18 bp, Artificial Sequence
  Synthetic DNA
tatttcgtctcatattag

SEQ ID NO: 48787 - DNA, 18 bp, Artificial Sequence
  Synthetic DNA
tatttcgtctccatatag

SEQ ID NO: 48788 - DNA, 18 bp, Artificial Sequence
  Synthetic DNA
tatttcgtctgtctgaag

SEQ ID NO: 48789 - DNA, 18 bp, Artificial Sequence
  Synthetic DNA
tatttcgtttcacaaaag

SEQ ID NO: 48790 - DNA, 18 bp, Artificial Sequence
  Synthetic DNA
tatttctaatcattatag

SEQ ID NO: 48791 - DNA, 18 bp, Artificial Sequence
  Synthetic DNA
tatttctacccacaattg

SEQ ID NO: 48792 - DNA, 18 bp, Artificial Sequence
  Synthetic DNA
tatttctacccactaaag

SEQ ID NO: 48793 - DNA, 18 bp, Artificial Sequence
  Synthetic DNA
tatttctactaacaatag

SEQ ID NO: 48794 - DNA, 18 bp, Artificial Sequence
  Synthetic DNA
tatttctactcgctaaag

SEQ ID NO: 48795 - DNA, 18 bp, Artificial Sequence
  Synthetic DNA
tatttctatatactatag

SEQ ID NO: 48796 - DNA, 18 bp, Artificial Sequence
  Synthetic DNA
tatttgcacactcaatag

SEQ ID NO: 48797 - DNA, 18 bp, Artificial Sequence
  Synthetic DNA
tatttggactcacaatcg

SEQ ID NO: 48798 - DNA, 18 bp, Artificial Sequence
  Synthetic DNA
tatttgtactctaaacag

SEQ ID NO: 48799 - DNA, 18 bp, Artificial Sequence
  Synthetic DNA
tattttgaatcactagag

SEQ ID NO: 48800 - DNA, 18 bp, Artificial Sequence
  Synthetic DNA
tattttgactctaaaaag

SEQ ID NO: 48801 - DNA, 18 bp, Artificial Sequence
  Synthetic DNA
tattttgactctttaaag

SEQ ID NO: 48802 - DNA, 18 bp, Artificial Sequence
  Synthetic DNA
tattttggctcactttag

SEQ ID NO: 48803 - DNA, 18 bp, Artificial Sequence
  Synthetic DNA
tattttgtctcgccaatg

SEQ ID NO: 48804 - DNA, 18 bp, Artificial Sequence
  Synthetic DNA
tattttgtctctctatag

SEQ ID NO: 48805 - DNA, 18 bp, Artificial Sequence
  Synthetic DNA
tcaaaaaacactcaattg

SEQ ID NO: 48806 - DNA, 18 bp, Artificial Sequence
  Synthetic DNA
tcaaaagacacacgagag

SEQ ID NO: 48807 - DNA, 18 bp, Artificial Sequence
  Synthetic DNA
tcaaaagactcactaatg

SEQ ID NO: 48808 - DNA, 18 bp, Artificial Sequence
  Synthetic DNA
tcaaaagactctgtcaag

SEQ ID NO: 48809 - DNA, 18 bp, Artificial Sequence
  Synthetic DNA
tcaaacaacacatcatag

SEQ ID NO: 48810 - DNA, 18 bp, Artificial Sequence
  Synthetic DNA
tcaaacaactcattcaag

SEQ ID NO: 48811 - DNA, 18 bp, Artificial Sequence
  Synthetic DNA
tcaaacgaattacaaaag

SEQ ID NO: 48812 - DNA, 18 bp, Artificial Sequence
  Synthetic DNA
tcaaacgataaacttcag

SEQ ID NO: 48813 - DNA, 18 bp, Artificial Sequence
  Synthetic DNA
tcaaacgatagtctaaag

SEQ ID NO: 48814 - DNA, 18 bp, Artificial Sequence
  Synthetic DNA
tcaaacgattcacgattg

SEQ ID NO: 48815 - DNA, 18 bp, Artificial Sequence
  Synthetic DNA
tcaaacgattgtgtatag

SEQ ID NO: 48816 - DNA, 18 bp, Artificial Sequence
  Synthetic DNA
tcaaacgatttacagtag

SEQ ID NO: 48817 - DNA, 18 bp, Artificial Sequence
  Synthetic DNA
tcaaacgcctcaatctag

SEQ ID NO: 48818 - DNA, 18 bp, Artificial Sequence
  Synthetic DNA
tcaaacgtatcaaattag

SEQ ID NO: 48819 - DNA, 18 bp, Artificial Sequence
  Synthetic DNA
tcaaacgtctcgctttag

SEQ ID NO: 48820 - DNA, 18 bp, Artificial Sequence
  Synthetic DNA
tcaaacgtctctcaaacg

SEQ ID NO: 48821 - DNA, 18 bp, Artificial Sequence
  Synthetic DNA
tcaaacttctcgctatag

SEQ ID NO: 48822 - DNA, 18 bp, Artificial Sequence
  Synthetic DNA
tcaaccgattcactaatg

SEQ ID NO: 48823 - DNA, 18 bp, Artificial Sequence
  Synthetic DNA
tcaagcacctcgcttttg

SEQ ID NO: 48824 - DNA, 18 bp, Artificial Sequence
  Synthetic DNA
tcaatcgacacagcatag

SEQ ID NO: 48825 - DNA, 18 bp, Artificial Sequence
  Synthetic DNA
tcaatcgactttcaaaag

SEQ ID NO: 48826 - DNA, 18 bp, Artificial Sequence
  Synthetic DNA
tcaatcgattggctgtag

SEQ ID NO: 48827 - DNA, 18 bp, Artificial Sequence
  Synthetic DNA
tcaatggactcacaattg

SEQ ID NO: 48828 - DNA, 18 bp, Artificial Sequence
  Synthetic DNA
tcacaccacacactttag

SEQ ID NO: 48829 - DNA, 18 bp, Artificial Sequence
  Synthetic DNA
tcacacgaactactaaag

SEQ ID NO: 48830 - DNA, 18 bp, Artificial Sequence
  Synthetic DNA
tcacacgaatcaccatgg

SEQ ID NO: 48831 - DNA, 18 bp, Artificial Sequence
  Synthetic DNA
tcacacgacactctgtag

SEQ ID NO: 48832 - DNA, 18 bp, Artificial Sequence
  Synthetic DNA
tcacacgacttgcttcag

SEQ ID NO: 48833 - DNA, 18 bp, Artificial Sequence
  Synthetic DNA
tcacatgaccctctgtag

SEQ ID NO: 48834 - DNA, 18 bp, Artificial Sequence
  Synthetic DNA
tcactagaatcactattg

SEQ ID NO: 48835 - DNA, 18 bp, Artificial Sequence
  Synthetic DNA
tcactagtctcactatag

SEQ ID NO: 48836 - DNA, 18 bp, Artificial Sequence
  Synthetic DNA
tcagaagacactatttcg

SEQ ID NO: 48837 - DNA, 18 bp, Artificial Sequence
  Synthetic DNA
tcagactacaaactattg

SEQ ID NO: 48838 - DNA, 18 bp, Artificial Sequence
  Synthetic DNA
tcagacttctcccgattg

SEQ ID NO: 48839 - DNA, 18 bp, Artificial Sequence
  Synthetic DNA
tcagccgatccaacaaag

SEQ ID NO: 48840 - DNA, 18 bp, Artificial Sequence
  Synthetic DNA
tcataaaactctcaattg

SEQ ID NO: 48841 - DNA, 18 bp, Artificial Sequence
  Synthetic DNA
tcataacagttactcttg

SEQ ID NO: 48842 - DNA, 18 bp, Artificial Sequence
  Synthetic DNA
tcataagaatctcaacag

SEQ ID NO: 48843 - DNA, 18 bp, Artificial Sequence
  Synthetic DNA
tcataagacttaatctag

SEQ ID NO: 48844 - DNA, 18 bp, Artificial Sequence
  Synthetic DNA
tcatacaacactcttaag

SEQ ID NO: 48845 - DNA, 18 bp, Artificial Sequence
  Synthetic DNA
tcatacaactctctctgg

SEQ ID NO: 48846 - DNA, 18 bp, Artificial Sequence
  Synthetic DNA
tcatacatatcagtattg

SEQ ID NO: 48847 - DNA, 18 bp, Artificial Sequence
  Synthetic DNA
tcatacatttccctgtcg

SEQ ID NO: 48848 - DNA, 18 bp, Artificial Sequence
  Synthetic DNA
tcataccattcactttcg

SEQ ID NO: 48849 - DNA, 18 bp, Artificial Sequence
  Synthetic DNA
tcatacgaaactatatag

SEQ ID NO: 48850 - DNA, 18 bp, Artificial Sequence
  Synthetic DNA
tcatacgaccattattag

SEQ ID NO: 48851 - DNA, 18 bp, Artificial Sequence
  Synthetic DNA
tcatacgaccctcatcag

SEQ ID NO: 48852 - DNA, 18 bp, Artificial Sequence
  Synthetic DNA
tcatacgatacaccctcg

SEQ ID NO: 48853 - DNA, 18 bp, Artificial Sequence
  Synthetic DNA
tcatacgatcctgtaaag

SEQ ID NO: 48854 - DNA, 18 bp, Artificial Sequence
  Synthetic DNA
tcatacgcacgactcttg

SEQ ID NO: 48855 - DNA, 18 bp, Artificial Sequence
  Synthetic DNA
tcatacggatttctatag

SEQ ID NO: 48856 - DNA, 18 bp, Artificial Sequence
  Synthetic DNA
tcatacggcactctaaag

SEQ ID NO: 48857 - DNA, 18 bp, Artificial Sequence
  Synthetic DNA
tcatacggctgacttaag

SEQ ID NO: 48858 - DNA, 18 bp, Artificial Sequence
  Synthetic DNA
tcatacgtcaaattatag

SEQ ID NO: 48859 - DNA, 18 bp, Artificial Sequence
  Synthetic DNA
tcatactactccacctag

SEQ ID NO: 48860 - DNA, 18 bp, Artificial Sequence
  Synthetic DNA
tcatactactccctgatg

SEQ ID NO: 48861 - DNA, 18 bp, Artificial Sequence
  Synthetic DNA
tcatactactctctaccg

SEQ ID NO: 48862 - DNA, 18 bp, Artificial Sequence
  Synthetic DNA
tcatactagttaaaattg

SEQ ID NO: 48863 - DNA, 18 bp, Artificial Sequence
  Synthetic DNA
tcatactattccctacag

SEQ ID NO: 48864 - DNA, 18 bp, Artificial Sequence
  Synthetic DNA
tcatactgctcaatattg

SEQ ID NO: 48865 - DNA, 18 bp, Artificial Sequence
  Synthetic DNA
tcatactttccactatag

SEQ ID NO: 48866 - DNA, 18 bp, Artificial Sequence
  Synthetic DNA
tcatagatctcgcttaag

SEQ ID NO: 48867 - DNA, 18 bp, Artificial Sequence
  Synthetic DNA
tcatagcaatcacttatg

SEQ ID NO: 48868 - DNA, 18 bp, Artificial Sequence
  Synthetic DNA
tcatagcatacaccatag

SEQ ID NO: 48869 - DNA, 18 bp, Artificial Sequence
  Synthetic DNA
tcataggacttaataagg

SEQ ID NO: 48870 - DNA, 18 bp, Artificial Sequence
  Synthetic DNA
tcataggtctatctatag

SEQ ID NO: 48871 - DNA, 18 bp, Artificial Sequence
  Synthetic DNA
tcatagtacacactattg

SEQ ID NO: 48872 - DNA, 18 bp, Artificial Sequence
  Synthetic DNA
tcatataattcagtatag

SEQ ID NO: 48873 - DNA, 18 bp, Artificial Sequence
  Synthetic DNA
tcatatagatcactatag

SEQ ID NO: 48874 - DNA, 18 bp, Artificial Sequence
  Synthetic DNA
tcatatatctcactaatg

SEQ ID NO: 48875 - DNA, 18 bp, Artificial Sequence
  Synthetic DNA
tcatatcatttgctatag

SEQ ID NO: 48876 - DNA, 18 bp, Artificial Sequence
  Synthetic DNA
tcatatgaaatagtattg

SEQ ID NO: 48877 - DNA, 18 bp, Artificial Sequence
  Synthetic DNA
tcatatgaatcacaactg

SEQ ID NO: 48878 - DNA, 18 bp, Artificial Sequence
  Synthetic DNA
tcatatgacacactcgag

SEQ ID NO: 48879 - DNA, 18 bp, Artificial Sequence
  Synthetic DNA
tcatatgactcattccag

SEQ ID NO: 48880 - DNA, 18 bp, Artificial Sequence
  Synthetic DNA
tcatatgagtctccatag

SEQ ID NO: 48881 - DNA, 18 bp, Artificial Sequence
  Synthetic DNA
tcatatgcctctctacag

SEQ ID NO: 48882 - DNA, 18 bp, Artificial Sequence
  Synthetic DNA
tcatatggcccactttag

SEQ ID NO: 48883 - DNA, 18 bp, Artificial Sequence
  Synthetic DNA
tcatatgtcacactatgg

SEQ ID NO: 48884 - DNA, 18 bp, Artificial Sequence
  Synthetic DNA
tcatattacgcactaaag

SEQ ID NO: 48885 - DNA, 18 bp, Artificial Sequence
  Synthetic DNA
tcatattcttcactatag

SEQ ID NO: 48886 - DNA, 18 bp, Artificial Sequence
  Synthetic DNA
tcatatttttcactatag

SEQ ID NO: 48887 - DNA, 18 bp, Artificial Sequence
  Synthetic DNA
tcatccaacctactatag

SEQ ID NO: 48888 - DNA, 18 bp, Artificial Sequence
  Synthetic DNA
tcatcccaccttgtatag

SEQ ID NO: 48889 - DNA, 18 bp, Artificial Sequence
  Synthetic DNA
tcatccccctcaccatag

SEQ ID NO: 48890 - DNA, 18 bp, Artificial Sequence
  Synthetic DNA
tcatccgacactttatag

SEQ ID NO: 48891 - DNA, 18 bp, Artificial Sequence
  Synthetic DNA
tcatccgagacattattg

SEQ ID NO: 48892 - DNA, 18 bp, Artificial Sequence
  Synthetic DNA
tcatccgtcacactttag

SEQ ID NO: 48893 - DNA, 18 bp, Artificial Sequence
  Synthetic DNA
tcatcggaccaactatcg

SEQ ID NO: 48894 - DNA, 18 bp, Artificial Sequence
  Synthetic DNA
tcatgagactcaaaatag

SEQ ID NO: 48895 - DNA, 18 bp, Artificial Sequence
  Synthetic DNA
tcatgcaacacactacag

SEQ ID NO: 48896 - DNA, 18 bp, Artificial Sequence
  Synthetic DNA
tcatgccactcaaactag

SEQ ID NO: 48897 - DNA, 18 bp, Artificial Sequence
  Synthetic DNA
tcatgcgaaatattaagg

SEQ ID NO: 48898 - DNA, 18 bp, Artificial Sequence
  Synthetic DNA
tcatgcgacacagttttg

SEQ ID NO: 48899 - DNA, 18 bp, Artificial Sequence
  Synthetic DNA
tcatgcgacacgctaaag

SEQ ID NO: 48900 - DNA, 18 bp, Artificial Sequence
  Synthetic DNA
tcatgtgactcgctagag

SEQ ID NO: 48901 - DNA, 18 bp, Artificial Sequence
  Synthetic DNA
tcattagactagctaaag

SEQ ID NO: 48902 - DNA, 18 bp, Artificial Sequence
  Synthetic DNA
tcattagactcaccgtag

SEQ ID NO: 48903 - DNA, 18 bp, Artificial Sequence
  Synthetic DNA
tcattcaaatcccaatag

SEQ ID NO: 48904 - DNA, 18 bp, Artificial Sequence
  Synthetic DNA
tcattcatttcattatag

SEQ ID NO: 48905 - DNA, 18 bp, Artificial Sequence
  Synthetic DNA
tcattccaattaccatag

SEQ ID NO: 48906 - DNA, 18 bp, Artificial Sequence
  Synthetic DNA
tcattcgaattactatgg

SEQ ID NO: 48907 - DNA, 18 bp, Artificial Sequence
  Synthetic DNA
tcattcgactaacagaag

SEQ ID NO: 48908 - DNA, 18 bp, Artificial Sequence
  Synthetic DNA
tcattcgactctgtaatg

SEQ ID NO: 48909 - DNA, 18 bp, Artificial Sequence
  Synthetic DNA
tcattcgactgacaaaag

SEQ ID NO: 48910 - DNA, 18 bp, Artificial Sequence
  Synthetic DNA
tcattcgagccactgttg

SEQ ID NO: 48911 - DNA, 18 bp, Artificial Sequence
  Synthetic DNA
tcattcgcctcaataaag

SEQ ID NO: 48912 - DNA, 18 bp, Artificial Sequence
  Synthetic DNA
tcattcgtctatccataa

SEQ ID NO: 48913 - DNA, 18 bp, Artificial Sequence
  Synthetic DNA
tcattcgtctttatattg

SEQ ID NO: 48914 - DNA, 18 bp, Artificial Sequence
  Synthetic DNA
tcattcgtgatacactag

SEQ ID NO: 48915 - DNA, 18 bp, Artificial Sequence
  Synthetic DNA
tcattggactgactgtag

SEQ ID NO: 48916 - DNA, 18 bp, Artificial Sequence
  Synthetic DNA
tccaccgactcactttcg

SEQ ID NO: 48917 - DNA, 18 bp, Artificial Sequence
  Synthetic DNA
tcccacgactcactgaag

SEQ ID NO: 48918 - DNA, 18 bp, Artificial Sequence
  Synthetic DNA
tcctacaagtcactaatg

SEQ ID NO: 48919 - DNA, 18 bp, Artificial Sequence
  Synthetic DNA
tcctacgaatcacttttg

SEQ ID NO: 48920 - DNA, 18 bp, Artificial Sequence
  Synthetic DNA
tcctacgacttaagatag

SEQ ID NO: 48921 - DNA, 18 bp, Artificial Sequence
  Synthetic DNA
tcctacgtctcaattaag

SEQ ID NO: 48922 - DNA, 18 bp, Artificial Sequence
  Synthetic DNA
tcctactcctctttatag

SEQ ID NO: 48923 - DNA, 18 bp, Artificial Sequence
  Synthetic DNA
tcctactgctctttatag

SEQ ID NO: 48924 - DNA, 18 bp, Artificial Sequence
  Synthetic DNA
tcctatgacgccctaggg

SEQ ID NO: 48925 - DNA, 18 bp, Artificial Sequence
  Synthetic DNA
tcctgagacacactaaag

SEQ ID NO: 48926 - DNA, 18 bp, Artificial Sequence
  Synthetic DNA
tccttcgaatcactaatg

SEQ ID NO: 48927 - DNA, 18 bp, Artificial Sequence
  Synthetic DNA
tccttcgactttattgag

SEQ ID NO: 48928 - DNA, 18 bp, Artificial Sequence
  Synthetic DNA
tcctttcccccgcaatag

SEQ ID NO: 48929 - DNA, 18 bp, Artificial Sequence
  Synthetic DNA
tcctttgtctcattaaag

SEQ ID NO: 48930 - DNA, 18 bp, Artificial Sequence
  Synthetic DNA
tcgaaccatacactttag

SEQ ID NO: 48931 - DNA, 18 bp, Artificial Sequence
  Synthetic DNA
tcgaacgacacactatgg

SEQ ID NO: 48932 - DNA, 18 bp, Artificial Sequence
  Synthetic DNA
tcgcttgactctctatag

SEQ ID NO: 48933 - DNA, 18 bp, Artificial Sequence
  Synthetic DNA
tcgtacaactcacaactg

SEQ ID NO: 48934 - DNA, 18 bp, Artificial Sequence
  Synthetic DNA
tcgtacgaataactaaag

SEQ ID NO: 48935 - DNA, 18 bp, Artificial Sequence
  Synthetic DNA
tcgtacgacttacagtag

SEQ ID NO: 48936 - DNA, 18 bp, Artificial Sequence
  Synthetic DNA
tcgtactgataacctgag

SEQ ID NO: 48937 - DNA, 18 bp, Artificial Sequence
  Synthetic DNA
tcgtatgacttaaattag

SEQ ID NO: 48938 - DNA, 18 bp, Artificial Sequence
  Synthetic DNA
tcgtcctactcattctag

SEQ ID NO: 48939 - DNA, 18 bp, Artificial Sequence
  Synthetic DNA
tcgttcgattaacttttg

SEQ ID NO: 48940 - DNA, 18 bp, Artificial Sequence
  Synthetic DNA
tcgttggactaattatgg

SEQ ID NO: 48941 - DNA, 18 bp, Artificial Sequence
  Synthetic DNA
tctaaatactcataaatg

SEQ ID NO: 48942 - DNA, 18 bp, Artificial Sequence
  Synthetic DNA
tctaacccctcactatag

SEQ ID NO: 48943 - DNA, 18 bp, Artificial Sequence
  Synthetic DNA
tctaacgaccaaatatag

SEQ ID NO: 48944 - DNA, 18 bp, Artificial Sequence
  Synthetic DNA
tctaacgactcaccatcg

SEQ ID NO: 48945 - DNA, 18 bp, Artificial Sequence
  Synthetic DNA
tctaacgactctgtatag

SEQ ID NO: 48946 - DNA, 18 bp, Artificial Sequence
  Synthetic DNA
tctaacgacttatcctag

SEQ ID NO: 48947 - DNA, 18 bp, Artificial Sequence
  Synthetic DNA
tctaacgccgtttaatag

SEQ ID NO: 48948 - DNA, 18 bp, Artificial Sequence
  Synthetic DNA
tctaacgtctcattgtcg

SEQ ID NO: 48949 - DNA, 18 bp, Artificial Sequence
  Synthetic DNA
tctaacgtctctctttag

SEQ ID NO: 48950 - DNA, 18 bp, Artificial Sequence
  Synthetic DNA
tctaccttcagactatag

SEQ ID NO: 48951 - DNA, 18 bp, Artificial Sequence
  Synthetic DNA
tctagcggctctctatag

SEQ ID NO: 48952 - DNA, 18 bp, Artificial Sequence
  Synthetic DNA
tctatcgacttaccaaag

SEQ ID NO: 48953 - DNA, 18 bp, Artificial Sequence
  Synthetic DNA
tctatcgtctaatcattg

SEQ ID NO: 48954 - DNA, 18 bp, Artificial Sequence
  Synthetic DNA
tctcacgactaattacgg

SEQ ID NO: 48955 - DNA, 18 bp, Artificial Sequence
  Synthetic DNA
tctcactactcactattg

SEQ ID NO: 48956 - DNA, 18 bp, Artificial Sequence
  Synthetic DNA
tctcgtgccttatatgag

SEQ ID NO: 48957 - DNA, 18 bp, Artificial Sequence
  Synthetic DNA
tctctcgattccctagag

SEQ ID NO: 48958 - DNA, 18 bp, Artificial Sequence
  Synthetic DNA
tctgacttctctttttag

SEQ ID NO: 48959 - DNA, 18 bp, Artificial Sequence
  Synthetic DNA
tctgcctactcactgtcg

SEQ ID NO: 48960 - DNA, 18 bp, Artificial Sequence
  Synthetic DNA
tcttaagactctacatag

SEQ ID NO: 48961 - DNA, 18 bp, Artificial Sequence
  Synthetic DNA
tcttacaactcacttcag

SEQ ID NO: 48962 - DNA, 18 bp, Artificial Sequence
  Synthetic DNA
tcttacaacttacttaag

SEQ ID NO: 48963 - DNA, 18 bp, Artificial Sequence
  Synthetic DNA
tcttacatctcactttag

SEQ ID NO: 48964 - DNA, 18 bp, Artificial Sequence
  Synthetic DNA
tcttaccactcataattg

SEQ ID NO: 48965 - DNA, 18 bp, Artificial Sequence
  Synthetic DNA
tcttacgactaataatag

SEQ ID NO: 48966 - DNA, 18 bp, Artificial Sequence
  Synthetic DNA
tcttacggctctctccag

SEQ ID NO: 48967 - DNA, 18 bp, Artificial Sequence
  Synthetic DNA
tcttacggcttactattg

SEQ ID NO: 48968 - DNA, 18 bp, Artificial Sequence
  Synthetic DNA
tcttacgtctctctattg

SEQ ID NO: 48969 - DNA, 18 bp, Artificial Sequence
  Synthetic DNA
tcttaggactatctatag

SEQ ID NO: 48970 - DNA, 18 bp, Artificial Sequence
  Synthetic DNA
tcttaggactctcaattg

SEQ ID NO: 48971 - DNA, 18 bp, Artificial Sequence
  Synthetic DNA
tcttaggtctctccatag

SEQ ID NO: 48972 - DNA, 18 bp, Artificial Sequence
  Synthetic DNA
tcttatgactcactccag

SEQ ID NO: 48973 - DNA, 18 bp, Artificial Sequence
  Synthetic DNA
tcttatggttctctatag

SEQ ID NO: 48974 - DNA, 18 bp, Artificial Sequence
  Synthetic DNA
tcttcggattcgcgatag

SEQ ID NO: 48975 - DNA, 18 bp, Artificial Sequence
  Synthetic DNA
tcttgcgtcccactaaag

SEQ ID NO: 48976 - DNA, 18 bp, Artificial Sequence
  Synthetic DNA
tctttcaactcactctag

SEQ ID NO: 48977 - DNA, 18 bp, Artificial Sequence
  Synthetic DNA
tctttccattcactatag

SEQ ID NO: 48978 - DNA, 18 bp, Artificial Sequence
  Synthetic DNA
tctttcgacacacaaaag

SEQ ID NO: 48979 - DNA, 18 bp, Artificial Sequence
  Synthetic DNA
tctttcgacactctatag

SEQ ID NO: 48980 - DNA, 18 bp, Artificial Sequence
  Synthetic DNA
tctttcgactcaagatag

SEQ ID NO: 48981 - DNA, 18 bp, Artificial Sequence
  Synthetic DNA
tctttcgactcaccactg

SEQ ID NO: 48982 - DNA, 18 bp, Artificial Sequence
  Synthetic DNA
tctttcgattcataattg

SEQ ID NO: 48983 - DNA, 18 bp, Artificial Sequence
  Synthetic DNA
tcttttgacacaaaattg

SEQ ID NO: 48984 - DNA, 18 bp, Artificial Sequence
  Synthetic DNA
tcttttgacgcgctatag

SEQ ID NO: 48985 - DNA, 18 bp, Artificial Sequence
  Synthetic DNA
tgaaaactctctcttttg

SEQ ID NO: 48986 - DNA, 18 bp, Artificial Sequence
  Synthetic DNA
tgaaaccaatcatcatag

SEQ ID NO: 48987 - DNA, 18 bp, Artificial Sequence
  Synthetic DNA
tgaaacccatcacagatg

SEQ ID NO: 48988 - DNA, 18 bp, Artificial Sequence
  Synthetic DNA
tgaaacgaatccctatcg

SEQ ID NO: 48989 - DNA, 18 bp, Artificial Sequence
  Synthetic DNA
tgaaacgaattagattag

SEQ ID NO: 48990 - DNA, 18 bp, Artificial Sequence
  Synthetic DNA
tgaaacgaccctatatag

SEQ ID NO: 48991 - DNA, 18 bp, Artificial Sequence
  Synthetic DNA
tgaaacgactaactactg

SEQ ID NO: 48992 - DNA, 18 bp, Artificial Sequence
  Synthetic DNA
tgaaacgagtcaccttag

SEQ ID NO: 48993 - DNA, 18 bp, Artificial Sequence
  Synthetic DNA
tgaaacgatcctttatag

SEQ ID NO: 48994 - DNA, 18 bp, Artificial Sequence
  Synthetic DNA
tgaaacgtctctctgtag

SEQ ID NO: 48995 - DNA, 18 bp, Artificial Sequence
  Synthetic DNA
tgaaactattctcttttg

SEQ ID NO: 48996 - DNA, 18 bp, Artificial Sequence
  Synthetic DNA
tgaaacttatccctgaag

SEQ ID NO: 48997 - DNA, 18 bp, Artificial Sequence
  Synthetic DNA
tgaaaggaaaccctatcg

SEQ ID NO: 48998 - DNA, 18 bp, Artificial Sequence
  Synthetic DNA
tgaaaggactgactttag

SEQ ID NO: 48999 - DNA, 18 bp, Artificial Sequence
  Synthetic DNA
tgaaagggctcatctttg

SEQ ID NO: 49000 - DNA, 18 bp, Artificial Sequence
  Synthetic DNA
tgaaatgacacatttaag

SEQ ID NO: 49001 - DNA, 18 bp, Artificial Sequence
  Synthetic DNA
tgaaatgactcactcaag

SEQ ID NO: 49002 - DNA, 18 bp, Artificial Sequence
  Synthetic DNA
tgaaatgtcgcactttag

SEQ ID NO: 49003 - DNA, 18 bp, Artificial Sequence
  Synthetic DNA
tgaaccgaatctgtattg

SEQ ID NO: 49004 - DNA, 18 bp, Artificial Sequence
  Synthetic DNA
tgaaccgactgtctattg

SEQ ID NO: 49005 - DNA, 18 bp, Artificial Sequence
  Synthetic DNA
tgaacggactagctatag

SEQ ID NO: 49006 - DNA, 18 bp, Artificial Sequence
  Synthetic DNA
tgaagctaatcactatag

SEQ ID NO: 49007 - DNA, 18 bp, Artificial Sequence
  Synthetic DNA
tgaatccacttgctattg

SEQ ID NO: 49008 - DNA, 18 bp, Artificial Sequence
  Synthetic DNA
tgaatcgacacacgatag

SEQ ID NO: 49009 - DNA, 18 bp, Artificial Sequence
  Synthetic DNA
tgaatcgactctaaatag

SEQ ID NO: 49010 - DNA, 18 bp, Artificial Sequence
  Synthetic DNA
tgaatcgtttctcttttg

SEQ ID NO: 49011 - DNA, 18 bp, Artificial Sequence
  Synthetic DNA
tgaatggacacactatag

SEQ ID NO: 49012 - DNA, 18 bp, Artificial Sequence
  Synthetic DNA
tgaatttactcactttag

SEQ ID NO: 49013 - DNA, 18 bp, Artificial Sequence
  Synthetic DNA
tgacaagtcttaatattg

SEQ ID NO: 49014 - DNA, 18 bp, Artificial Sequence
  Synthetic DNA
tgacacatatctcaataa

SEQ ID NO: 49015 - DNA, 18 bp, Artificial Sequence
  Synthetic DNA
tgacaccatgccttaaag

SEQ ID NO: 49016 - DNA, 18 bp, Artificial Sequence
  Synthetic DNA
tgacacgtcagcttatag

SEQ ID NO: 49017 - DNA, 18 bp, Artificial Sequence
  Synthetic DNA
tgacatgcttcacgctag

SEQ ID NO: 49018 - DNA, 18 bp, Artificial Sequence
  Synthetic DNA
tgacatgtctcattatag

SEQ ID NO: 49019 - DNA, 18 bp, Artificial Sequence
  Synthetic DNA
tgactggacacaccctag

SEQ ID NO: 49020 - DNA, 18 bp, Artificial Sequence
  Synthetic DNA
tgagacggctcacgatcg

SEQ ID NO: 49021 - DNA, 18 bp, Artificial Sequence
  Synthetic DNA
tgagacgtaccactatag

SEQ ID NO: 49022 - DNA, 18 bp, Artificial Sequence
  Synthetic DNA
tgataagaatctccatag

SEQ ID NO: 49023 - DNA, 18 bp, Artificial Sequence
  Synthetic DNA
tgataagacaatatgtag

SEQ ID NO: 49024 - DNA, 18 bp, Artificial Sequence
  Synthetic DNA
tgataagacacacagtag

SEQ ID NO: 49025 - DNA, 18 bp, Artificial Sequence
  Synthetic DNA
tgataagactaacaaaag

SEQ ID NO: 49026 - DNA, 18 bp, Artificial Sequence
  Synthetic DNA
tgataagtcacaatatag

SEQ ID NO: 49027 - DNA, 18 bp, Artificial Sequence
  Synthetic DNA
tgataatacaccctgaag

SEQ ID NO: 49028 - DNA, 18 bp, Artificial Sequence
  Synthetic DNA
tgataattattactttag

SEQ ID NO: 49029 - DNA, 18 bp, Artificial Sequence
  Synthetic DNA
tgatacaaatccctatgg

SEQ ID NO: 49030 - DNA, 18 bp, Artificial Sequence
  Synthetic DNA
tgatacaactctatttag

SEQ ID NO: 49031 - DNA, 18 bp, Artificial Sequence
  Synthetic DNA
tgatacaactctcaattg

SEQ ID NO: 49032 - DNA, 18 bp, Artificial Sequence
  Synthetic DNA
tgatacaagttcgtttag

SEQ ID NO: 49033 - DNA, 18 bp, Artificial Sequence
  Synthetic DNA
tgatacaccttaaaatag

SEQ ID NO: 49034 - DNA, 18 bp, Artificial Sequence
  Synthetic DNA
tgatacacttctctatag

SEQ ID NO: 49035 - DNA, 18 bp, Artificial Sequence
  Synthetic DNA
tgatacatctgaccatag

SEQ ID NO: 49036 - DNA, 18 bp, Artificial Sequence
  Synthetic DNA
tgataccacgtactttag

SEQ ID NO: 49037 - DNA, 18 bp, Artificial Sequence
  Synthetic DNA
tgataccactcacagaag

SEQ ID NO: 49038 - DNA, 18 bp, Artificial Sequence
  Synthetic DNA
tgataccactctctcggg

SEQ ID NO: 49039 - DNA, 18 bp, Artificial Sequence
  Synthetic DNA
tgataccacttacaacag

SEQ ID NO: 49040 - DNA, 18 bp, Artificial Sequence
  Synthetic DNA
tgataccagtcacttaag

SEQ ID NO: 49041 - DNA, 18 bp, Artificial Sequence
  Synthetic DNA
tgataccattctcaattg

SEQ ID NO: 49042 - DNA, 18 bp, Artificial Sequence
  Synthetic DNA
tgatacctcacactgttg

SEQ ID NO: 49043 - DNA, 18 bp, Artificial Sequence
  Synthetic DNA
tgatacgaaaaacaatag

SEQ ID NO: 49044 - DNA, 18 bp, Artificial Sequence
  Synthetic DNA
tgatacgacaatcaattg

SEQ ID NO: 49045 - DNA, 18 bp, Artificial Sequence
  Synthetic DNA
tgatacgacctacaaatg

SEQ ID NO: 49046 - DNA, 18 bp, Artificial Sequence
  Synthetic DNA
tgatacgacctcctcttg

SEQ ID NO: 49047 - DNA, 18 bp, Artificial Sequence
  Synthetic DNA
tgatacgactttcactag

SEQ ID NO: 49048 - DNA, 18 bp, Artificial Sequence
  Synthetic DNA
tgatacgagtgacaagag

SEQ ID NO: 49049 - DNA, 18 bp, Artificial Sequence
  Synthetic DNA
tgatacgcaacactaaag

SEQ ID NO: 49050 - DNA, 18 bp, Artificial Sequence
  Synthetic DNA
tgatacgcgtctattaag

SEQ ID NO: 49051 - DNA, 18 bp, Artificial Sequence
  Synthetic DNA
tgatacgcttttcaaaag

SEQ ID NO: 49052 - DNA, 18 bp, Artificial Sequence
  Synthetic DNA
tgatacggctttctattg

SEQ ID NO: 49053 - DNA, 18 bp, Artificial Sequence
  Synthetic DNA
tgatacgtcagaatctag

SEQ ID NO: 49054 - DNA, 18 bp, Artificial Sequence
  Synthetic DNA
tgatacgtctaactaatg

SEQ ID NO: 49055 - DNA, 18 bp, Artificial Sequence
  Synthetic DNA
tgatacgtttcaataaag

SEQ ID NO: 49056 - DNA, 18 bp, Artificial Sequence
  Synthetic DNA
tgatacgtttgactttag

SEQ ID NO: 49057 - DNA, 18 bp, Artificial Sequence
  Synthetic DNA
tgatactactcatcatgg

SEQ ID NO: 49058 - DNA, 18 bp, Artificial Sequence
  Synthetic DNA
tgatactactccacttag

SEQ ID NO: 49059 - DNA, 18 bp, Artificial Sequence
  Synthetic DNA
tgatactattaagtaatg

SEQ ID NO: 49060 - DNA, 18 bp, Artificial Sequence
  Synthetic DNA
tgatacttctcaccttgg

SEQ ID NO: 49061 - DNA, 18 bp, Artificial Sequence
  Synthetic DNA
tgatagctcccaccattg

SEQ ID NO: 49062 - DNA, 18 bp, Artificial Sequence
  Synthetic DNA
tgatagctctcgctatag

SEQ ID NO: 49063 - DNA, 18 bp, Artificial Sequence
  Synthetic DNA
tgataggaccacctatag

SEQ ID NO: 49064 - DNA, 18 bp, Artificial Sequence
  Synthetic DNA
tgataggactcaggatgg

SEQ ID NO: 49065 - DNA, 18 bp, Artificial Sequence
  Synthetic DNA
tgataggtcttactgtag

SEQ ID NO: 49066 - DNA, 18 bp, Artificial Sequence
  Synthetic DNA
tgatataacacacaattg

SEQ ID NO: 49067 - DNA, 18 bp, Artificial Sequence
  Synthetic DNA
tgatatgacaccatacag

SEQ ID NO: 49068 - DNA, 18 bp, Artificial Sequence
  Synthetic DNA
tgatatgactcaacagag

SEQ ID NO: 49069 - DNA, 18 bp, Artificial Sequence
  Synthetic DNA
tgatatgttccactaaag

SEQ ID NO: 49070 - DNA, 18 bp, Artificial Sequence
  Synthetic DNA
tgatattacaaactaaag

SEQ ID NO: 49071 - DNA, 18 bp, Artificial Sequence
  Synthetic DNA
tgatattagtccctttag

SEQ ID NO: 49072 - DNA, 18 bp, Artificial Sequence
  Synthetic DNA
tgatccagttgacattag

SEQ ID NO: 49073 - DNA, 18 bp, Artificial Sequence
  Synthetic DNA
tgatccgtctccgaaaag

SEQ ID NO: 49074 - DNA, 18 bp, Artificial Sequence
  Synthetic DNA
tgatgcgattctcaattg

SEQ ID NO: 49075 - DNA, 18 bp, Artificial Sequence
  Synthetic DNA
tgatgcgtctaactagag

SEQ ID NO: 49076 - DNA, 18 bp, Artificial Sequence
  Synthetic DNA
tgatgcgtttctttaaag

SEQ ID NO: 49077 - DNA, 18 bp, Artificial Sequence
  Synthetic DNA
tgatgctgttcgctatag

SEQ ID NO: 49078 - DNA, 18 bp, Artificial Sequence
  Synthetic DNA
tgattagaatcacaatag

SEQ ID NO: 49079 - DNA, 18 bp, Artificial Sequence
  Synthetic DNA
tgattagactcactttcg

SEQ ID NO: 49080 - DNA, 18 bp, Artificial Sequence
  Synthetic DNA
tgattagattcattatag

SEQ ID NO: 49081 - DNA, 18 bp, Artificial Sequence
  Synthetic DNA
tgattaggcgcactatag

SEQ ID NO: 49082 - DNA, 18 bp, Artificial Sequence
  Synthetic DNA
tgattcaactctctttag

SEQ ID NO: 49083 - DNA, 18 bp, Artificial Sequence
  Synthetic DNA
tgattcaacttattattg

SEQ ID NO: 49084 - DNA, 18 bp, Artificial Sequence
  Synthetic DNA
tgattcgactaactaacg

SEQ ID NO: 49085 - DNA, 18 bp, Artificial Sequence
  Synthetic DNA
tgattcgactaacttaag

SEQ ID NO: 49086 - DNA, 18 bp, Artificial Sequence
  Synthetic DNA
tgattcgactcacggtcg

SEQ ID NO: 49087 - DNA, 18 bp, Artificial Sequence
  Synthetic DNA
tgattcgagacacaatag

SEQ ID NO: 49088 - DNA, 18 bp, Artificial Sequence
  Synthetic DNA
tgattcgagtctcaattg

SEQ ID NO: 49089 - DNA, 18 bp, Artificial Sequence
  Synthetic DNA
tgattcgatacattctag

SEQ ID NO: 49090 - DNA, 18 bp, Artificial Sequence
  Synthetic DNA
tgattcgatatgctatag

SEQ ID NO: 49091 - DNA, 18 bp, Artificial Sequence
  Synthetic DNA
tgattcgtcacactaaag

SEQ ID NO: 49092 - DNA, 18 bp, Artificial Sequence
  Synthetic DNA
tgattcgtttaactattg

SEQ ID NO: 49093 - DNA, 18 bp, Artificial Sequence
  Synthetic DNA
tgattctcctcacatgag

SEQ ID NO: 49094 - DNA, 18 bp, Artificial Sequence
  Synthetic DNA
tgattgaagtctatatag

SEQ ID NO: 49095 - DNA, 18 bp, Artificial Sequence
  Synthetic DNA
tgattggactcaatattg

SEQ ID NO: 49096 - DNA, 18 bp, Artificial Sequence
  Synthetic DNA
tgatttaactcagtatag

SEQ ID NO: 49097 - DNA, 18 bp, Artificial Sequence
  Synthetic DNA
tgatttgactcaaaatag

SEQ ID NO: 49098 - DNA, 18 bp, Artificial Sequence
  Synthetic DNA
tgatttgactcaatcttg

SEQ ID NO: 49099 - DNA, 18 bp, Artificial Sequence
  Synthetic DNA
tgatttgactcatttgag

SEQ ID NO: 49100 - DNA, 18 bp, Artificial Sequence
  Synthetic DNA
tgatttgagtcattattg

SEQ ID NO: 49101 - DNA, 18 bp, Artificial Sequence
  Synthetic DNA
tgattttacccactatag

SEQ ID NO: 49102 - DNA, 18 bp, Artificial Sequence
  Synthetic DNA
tgcaaagactcagtatag

SEQ ID NO: 49103 - DNA, 18 bp, Artificial Sequence
  Synthetic DNA
tgcaaccacacactgatg

SEQ ID NO: 49104 - DNA, 18 bp, Artificial Sequence
  Synthetic DNA
tgcaacgacacactattg

SEQ ID NO: 49105 - DNA, 18 bp, Artificial Sequence
  Synthetic DNA
tgcaacttatcacgatgg

SEQ ID NO: 49106 - DNA, 18 bp, Artificial Sequence
  Synthetic DNA
tgctaagaatcacatatg

SEQ ID NO: 49107 - DNA, 18 bp, Artificial Sequence
  Synthetic DNA
tgctacatttaactattg

SEQ ID NO: 49108 - DNA, 18 bp, Artificial Sequence
  Synthetic DNA
tgctacgacaaatcttag

SEQ ID NO: 49109 - DNA, 18 bp, Artificial Sequence
  Synthetic DNA
tgctacgattcatttaag

SEQ ID NO: 49110 - DNA, 18 bp, Artificial Sequence
  Synthetic DNA
tgctacgtttcaccattg

SEQ ID NO: 49111 - DNA, 18 bp, Artificial Sequence
  Synthetic DNA
tgctatgaataactattg

SEQ ID NO: 49112 - DNA, 18 bp, Artificial Sequence
  Synthetic DNA
tgctgcgattcccattag

SEQ ID NO: 49113 - DNA, 18 bp, Artificial Sequence
  Synthetic DNA
tgctgggactcgctgcag

SEQ ID NO: 49114 - DNA, 18 bp, Artificial Sequence
  Synthetic DNA
tgcttaggttcactatag

SEQ ID NO: 49115 - DNA, 18 bp, Artificial Sequence
  Synthetic DNA
tgcttcgactcagaatag

SEQ ID NO: 49116 - DNA, 18 bp, Artificial Sequence
  Synthetic DNA
tggaacgagtcacttcag

SEQ ID NO: 49117 - DNA, 18 bp, Artificial Sequence
  Synthetic DNA
tggaacgattcactctag

SEQ ID NO: 49118 - DNA, 18 bp, Artificial Sequence
  Synthetic DNA
tggaacggctcactcttg

SEQ ID NO: 49119 - DNA, 18 bp, Artificial Sequence
  Synthetic DNA
tggcacaacccttttatg

SEQ ID NO: 49120 - DNA, 18 bp, Artificial Sequence
  Synthetic DNA
tggtaagaatcactaaag

SEQ ID NO: 49121 - DNA, 18 bp, Artificial Sequence
  Synthetic DNA
tggtacgacacaatgtag

SEQ ID NO: 49122 - DNA, 18 bp, Artificial Sequence
  Synthetic DNA
tggtacgacccaatatgg

SEQ ID NO: 49123 - DNA, 18 bp, Artificial Sequence
  Synthetic DNA
tggtactactcaccattg

SEQ ID NO: 49124 - DNA, 18 bp, Artificial Sequence
  Synthetic DNA
tggtaggaatcactgttg

SEQ ID NO: 49125 - DNA, 18 bp, Artificial Sequence
  Synthetic DNA
tggtaggtctcaaaatag

SEQ ID NO: 49126 - DNA, 18 bp, Artificial Sequence
  Synthetic DNA
tggtccgtctctctatag

SEQ ID NO: 49127 - DNA, 18 bp, Artificial Sequence
  Synthetic DNA
tggtgcgcctcattatgg

SEQ ID NO: 49128 - DNA, 18 bp, Artificial Sequence
  Synthetic DNA
tggttcgacacactgaag

SEQ ID NO: 49129 - DNA, 18 bp, Artificial Sequence
  Synthetic DNA
tggttcgactctcaatag

SEQ ID NO: 49130 - DNA, 18 bp, Artificial Sequence
  Synthetic DNA
tggtttgcctcagtattg

SEQ ID NO: 49131 - DNA, 18 bp, Artificial Sequence
  Synthetic DNA
tgtaacaacttactatag

SEQ ID NO: 49132 - DNA, 18 bp, Artificial Sequence
  Synthetic DNA
tgtaacgacactctatag

SEQ ID NO: 49133 - DNA, 18 bp, Artificial Sequence
  Synthetic DNA
tgtaacgactcactcttg

SEQ ID NO: 49134 - DNA, 18 bp, Artificial Sequence
  Synthetic DNA
tgtaacgattcacaatag

SEQ ID NO: 49135 - DNA, 18 bp, Artificial Sequence
  Synthetic DNA
tgtaacgcctcactacag

SEQ ID NO: 49136 - DNA, 18 bp, Artificial Sequence
  Synthetic DNA
tgtaacgtctcactattg

SEQ ID NO: 49137 - DNA, 18 bp, Artificial Sequence
  Synthetic DNA
tgtaatgaatcactatgg

SEQ ID NO: 49138 - DNA, 18 bp, Artificial Sequence
  Synthetic DNA
tgtaatgacgcacacccg

SEQ ID NO: 49139 - DNA, 18 bp, Artificial Sequence
  Synthetic DNA
tgtaatgactcactattg

SEQ ID NO: 49140 - DNA, 18 bp, Artificial Sequence
  Synthetic DNA
tgtcacgccacactctag

SEQ ID NO: 49141 - DNA, 18 bp, Artificial Sequence
  Synthetic DNA
tgtcacgtctcactgtag

SEQ ID NO: 49142 - DNA, 18 bp, Artificial Sequence
  Synthetic DNA
tgtcaggtctcaataatg

SEQ ID NO: 49143 - DNA, 18 bp, Artificial Sequence
  Synthetic DNA
tgtcccccctccctatag

SEQ ID NO: 49144 - DNA, 18 bp, Artificial Sequence
  Synthetic DNA
tgtgacaactcacttttg

SEQ ID NO: 49145 - DNA, 18 bp, Artificial Sequence
  Synthetic DNA
tgtgacatctcactttag

SEQ ID NO: 49146 - DNA, 18 bp, Artificial Sequence
  Synthetic DNA
tgttaagactcacaatgg

SEQ ID NO: 49147 - DNA, 18 bp, Artificial Sequence
  Synthetic DNA
tgttaataattcctatag

SEQ ID NO: 49148 - DNA, 18 bp, Artificial Sequence
  Synthetic DNA
tgttacaaatcactaaag

SEQ ID NO: 49149 - DNA, 18 bp, Artificial Sequence
  Synthetic DNA
tgttacaacacacgaaag

SEQ ID NO: 49150 - DNA, 18 bp, Artificial Sequence
  Synthetic DNA
tgttacaagccattatcg

SEQ ID NO: 49151 - DNA, 18 bp, Artificial Sequence
  Synthetic DNA
tgttacctccctctattg

SEQ ID NO: 49152 - DNA, 18 bp, Artificial Sequence
  Synthetic DNA
tgttacgaatcaatctag

SEQ ID NO: 49153 - DNA, 18 bp, Artificial Sequence
  Synthetic DNA
tgttacgacacgttcttg

SEQ ID NO: 49154 - DNA, 18 bp, Artificial Sequence
  Synthetic DNA
tgttacgattaactaaag

SEQ ID NO: 49155 - DNA, 18 bp, Artificial Sequence
  Synthetic DNA
tgttacgtaacaccaaag

SEQ ID NO: 49156 - DNA, 18 bp, Artificial Sequence
  Synthetic DNA
tgttacgtcatcctattg

SEQ ID NO: 49157 - DNA, 18 bp, Artificial Sequence
  Synthetic DNA
tgttacgtctcttgatag

SEQ ID NO: 49158 - DNA, 18 bp, Artificial Sequence
  Synthetic DNA
tgttacgtttctctctag

SEQ ID NO: 49159 - DNA, 18 bp, Artificial Sequence
  Synthetic DNA
tgttactacacattatag

SEQ ID NO: 49160 - DNA, 18 bp, Artificial Sequence
  Synthetic DNA
tgttagacatgacattag

SEQ ID NO: 49161 - DNA, 18 bp, Artificial Sequence
  Synthetic DNA
tgttaggtctcaaaattg

SEQ ID NO: 49162 - DNA, 18 bp, Artificial Sequence
  Synthetic DNA
tgttatgacttcctgttg

SEQ ID NO: 49163 - DNA, 18 bp, Artificial Sequence
  Synthetic DNA
tgttatgtttttgtagag

SEQ ID NO: 49164 - DNA, 18 bp, Artificial Sequence
  Synthetic DNA
tgttccaacatactatag

SEQ ID NO: 49165 - DNA, 18 bp, Artificial Sequence
  Synthetic DNA
tgttccgtctcattaaag

SEQ ID NO: 49166 - DNA, 18 bp, Artificial Sequence
  Synthetic DNA
tgttgagactcacaatag

SEQ ID NO: 49167 - DNA, 18 bp, Artificial Sequence
  Synthetic DNA
tgttgcaacacactattg

SEQ ID NO: 49168 - DNA, 18 bp, Artificial Sequence
  Synthetic DNA
tgttgcgactcagtacag

SEQ ID NO: 49169 - DNA, 18 bp, Artificial Sequence
  Synthetic DNA
tgtttcaacggtctatcg

SEQ ID NO: 49170 - DNA, 18 bp, Artificial Sequence
  Synthetic DNA
tgtttcaattctctctag

SEQ ID NO: 49171 - DNA, 18 bp, Artificial Sequence
  Synthetic DNA
tgtttccactcaccatag

SEQ ID NO: 49172 - DNA, 18 bp, Artificial Sequence
  Synthetic DNA
tgtttcgactcattaatg

SEQ ID NO: 49173 - DNA, 18 bp, Artificial Sequence
  Synthetic DNA
tgtttcggctcattatag

SEQ ID NO: 49174 - DNA, 18 bp, Artificial Sequence
  Synthetic DNA
tgtttctatactatatag

SEQ ID NO: 49175 - DNA, 18 bp, Artificial Sequence
  Synthetic DNA
ttaaaatactcgcactag

SEQ ID NO: 49176 - DNA, 18 bp, Artificial Sequence
  Synthetic DNA
ttaaacaaattccaaaag

SEQ ID NO: 49177 - DNA, 18 bp, Artificial Sequence
  Synthetic DNA
ttaaacaacacacattag

SEQ ID NO: 49178 - DNA, 18 bp, Artificial Sequence
  Synthetic DNA
ttaaacatctaagtaaag

SEQ ID NO: 49179 - DNA, 18 bp, Artificial Sequence
  Synthetic DNA
ttaaacatctcactaaag

SEQ ID NO: 49180 - DNA, 18 bp, Artificial Sequence
  Synthetic DNA
ttaaacatgtagctatag

SEQ ID NO: 49181 - DNA, 18 bp, Artificial Sequence
  Synthetic DNA
ttaaaccacacactgttg

SEQ ID NO: 49182 - DNA, 18 bp, Artificial Sequence
  Synthetic DNA
ttaaaccactccatctag

SEQ ID NO: 49183 - DNA, 18 bp, Artificial Sequence
  Synthetic DNA
ttaaacccatcactatag

SEQ ID NO: 49184 - DNA, 18 bp, Artificial Sequence
  Synthetic DNA
ttaaaccgtttactaatg

SEQ ID NO: 49185 - DNA, 18 bp, Artificial Sequence
  Synthetic DNA
ttaaacgaaactctgtag

SEQ ID NO: 49186 - DNA, 18 bp, Artificial Sequence
  Synthetic DNA
ttaaacgaataagtagag

SEQ ID NO: 49187 - DNA, 18 bp, Artificial Sequence
  Synthetic DNA
ttaaacgacaaactaatg

SEQ ID NO: 49188 - DNA, 18 bp, Artificial Sequence
  Synthetic DNA
ttaaacgacacaatacag

SEQ ID NO: 49189 - DNA, 18 bp, Artificial Sequence
  Synthetic DNA
ttaaacgacacgcttaag

SEQ ID NO: 49190 - DNA, 18 bp, Artificial Sequence
  Synthetic DNA
ttaaacgacactctagtg

SEQ ID NO: 49191 - DNA, 18 bp, Artificial Sequence
  Synthetic DNA
ttaaacgacactgtatag

SEQ ID NO: 49192 - DNA, 18 bp, Artificial Sequence
  Synthetic DNA
ttaaacgacactgttatg

SEQ ID NO: 49193 - DNA, 18 bp, Artificial Sequence
  Synthetic DNA
ttaaacgactaataatag

SEQ ID NO: 49194 - DNA, 18 bp, Artificial Sequence
  Synthetic DNA
ttaaacgactcaacaaag

SEQ ID NO: 49195 - DNA, 18 bp, Artificial Sequence
  Synthetic DNA
ttaaacgactcctcatag

SEQ ID NO: 49196 - DNA, 18 bp, Artificial Sequence
  Synthetic DNA
ttaaacgattcagtaaag

SEQ ID NO: 49197 - DNA, 18 bp, Artificial Sequence
  Synthetic DNA
ttaaacgattcccttttg

SEQ ID NO: 49198 - DNA, 18 bp, Artificial Sequence
  Synthetic DNA
ttaaacgattcgctttag

SEQ ID NO: 49199 - DNA, 18 bp, Artificial Sequence
  Synthetic DNA
ttaaacggctcaccattg

SEQ ID NO: 49200 - DNA, 18 bp, Artificial Sequence
  Synthetic DNA
ttaaacgtctcactctcg

SEQ ID NO: 49201 - DNA, 18 bp, Artificial Sequence
  Synthetic DNA
ttaaacgtctcactgtcg

SEQ ID NO: 49202 - DNA, 18 bp, Artificial Sequence
  Synthetic DNA
ttaaactaagcactatag

SEQ ID NO: 49203 - DNA, 18 bp, Artificial Sequence
  Synthetic DNA
ttaaactaatctctatcg

SEQ ID NO: 49204 - DNA, 18 bp, Artificial Sequence
  Synthetic DNA
ttaaactacacactacag

SEQ ID NO: 49205 - DNA, 18 bp, Artificial Sequence
  Synthetic DNA
ttaaaggactcgatattg

SEQ ID NO: 49206 - DNA, 18 bp, Artificial Sequence
  Synthetic DNA
ttaaaggatatactatag

SEQ ID NO: 49207 - DNA, 18 bp, Artificial Sequence
  Synthetic DNA
ttaaaggcttcacaatag

SEQ ID NO: 49208 - DNA, 18 bp, Artificial Sequence
  Synthetic DNA
ttaaaggtatccctatag

SEQ ID NO: 49209 - DNA, 18 bp, Artificial Sequence
  Synthetic DNA
ttaaaggtttcacaatgg

SEQ ID NO: 49210 - DNA, 18 bp, Artificial Sequence
  Synthetic DNA
ttaaatctctccctatag

SEQ ID NO: 49211 - DNA, 18 bp, Artificial Sequence
  Synthetic DNA
ttaaatgaatccctatag

SEQ ID NO: 49212 - DNA, 18 bp, Artificial Sequence
  Synthetic DNA
ttaaatgacagtctttag

SEQ ID NO: 49213 - DNA, 18 bp, Artificial Sequence
  Synthetic DNA
ttaaatgactcacagttg

SEQ ID NO: 49214 - DNA, 18 bp, Artificial Sequence
  Synthetic DNA
ttaaattaatgactttag

SEQ ID NO: 49215 - DNA, 18 bp, Artificial Sequence
  Synthetic DNA
ttaaccaactcacttcag

SEQ ID NO: 49216 - DNA, 18 bp, Artificial Sequence
  Synthetic DNA
ttaaccaagtcactttag

SEQ ID NO: 49217 - DNA, 18 bp, Artificial Sequence
  Synthetic DNA
ttaaccgactcttaaaag

SEQ ID NO: 49218 - DNA, 18 bp, Artificial Sequence
  Synthetic DNA
ttaaccggctcactattg

SEQ ID NO: 49219 - DNA, 18 bp, Artificial Sequence
  Synthetic DNA
ttaacctcctcactatag

SEQ ID NO: 49220 - DNA, 18 bp, Artificial Sequence
  Synthetic DNA
ttaaccttctcactacag

SEQ ID NO: 49221 - DNA, 18 bp, Artificial Sequence
  Synthetic DNA
ttaacggactcacagtag

SEQ ID NO: 49222 - DNA, 18 bp, Artificial Sequence
  Synthetic DNA
ttaagcatctaataatag

SEQ ID NO: 49223 - DNA, 18 bp, Artificial Sequence
  Synthetic DNA
ttaagcgacacactgtag

SEQ ID NO: 49224 - DNA, 18 bp, Artificial Sequence
  Synthetic DNA
ttaagcgtctctccatag

SEQ ID NO: 49225 - DNA, 18 bp, Artificial Sequence
  Synthetic DNA
ttaagggactcacaatcg

SEQ ID NO: 49226 - DNA, 18 bp, Artificial Sequence
  Synthetic DNA
ttaatagacttactcgag

SEQ ID NO: 49227 - DNA, 18 bp, Artificial Sequence
  Synthetic DNA
ttaatcaatttactgtag

SEQ ID NO: 49228 - DNA, 18 bp, Artificial Sequence
  Synthetic DNA
ttaatcgacactctattg

SEQ ID NO: 49229 - DNA, 18 bp, Artificial Sequence
  Synthetic DNA
ttaatcgacactctgtag

SEQ ID NO: 49230 - DNA, 18 bp, Artificial Sequence
  Synthetic DNA
ttaatcgaccctttatag

SEQ ID NO: 49231 - DNA, 18 bp, Artificial Sequence
  Synthetic DNA
ttaatcgacgtaaaaaag

SEQ ID NO: 49232 - DNA, 18 bp, Artificial Sequence
  Synthetic DNA
ttaatcgactcattagag

SEQ ID NO: 49233 - DNA, 18 bp, Artificial Sequence
  Synthetic DNA
ttaatcgactgaacattg

SEQ ID NO: 49234 - DNA, 18 bp, Artificial Sequence
  Synthetic DNA
ttaatcgacttgctaatg

SEQ ID NO: 49235 - DNA, 18 bp, Artificial Sequence
  Synthetic DNA
ttaatcgatatactatag

SEQ ID NO: 49236 - DNA, 18 bp, Artificial Sequence
  Synthetic DNA
ttaatcgattcaatactg

SEQ ID NO: 49237 - DNA, 18 bp, Artificial Sequence
  Synthetic DNA
ttaatcgtcataaaattg

SEQ ID NO: 49238 - DNA, 18 bp, Artificial Sequence
  Synthetic DNA
ttaatctacactcttttg

SEQ ID NO: 49239 - DNA, 18 bp, Artificial Sequence
  Synthetic DNA
ttaatggaatctctttcg

SEQ ID NO: 49240 - DNA, 18 bp, Artificial Sequence
  Synthetic DNA
ttaattgattcaatatag

SEQ ID NO: 49241 - DNA, 18 bp, Artificial Sequence
  Synthetic DNA
ttacaaaactcactatcg

SEQ ID NO: 49242 - DNA, 18 bp, Artificial Sequence
  Synthetic DNA
ttacaacactcaaactag

SEQ ID NO: 49243 - DNA, 18 bp, Artificial Sequence
  Synthetic DNA
ttacaagtctctttattg

SEQ ID NO: 49244 - DNA, 18 bp, Artificial Sequence
  Synthetic DNA
ttacacaactaacaatag

SEQ ID NO: 49245 - DNA, 18 bp, Artificial Sequence
  Synthetic DNA
ttacacgaatcacacttg

SEQ ID NO: 49246 - DNA, 18 bp, Artificial Sequence
  Synthetic DNA
ttacacgacccgctatcg

SEQ ID NO: 49247 - DNA, 18 bp, Artificial Sequence
  Synthetic DNA
ttacacgactaataaaag

SEQ ID NO: 49248 - DNA, 18 bp, Artificial Sequence
  Synthetic DNA
ttacacgactcacaacgg

SEQ ID NO: 49249 - DNA, 18 bp, Artificial Sequence
  Synthetic DNA
ttacacgactcacaactg

SEQ ID NO: 49250 - DNA, 18 bp, Artificial Sequence
  Synthetic DNA
ttacacgactctcatttg

SEQ ID NO: 49251 - DNA, 18 bp, Artificial Sequence
  Synthetic DNA
ttacacgattctatagag

SEQ ID NO: 49252 - DNA, 18 bp, Artificial Sequence
  Synthetic DNA
ttacacgcctagcattag

SEQ ID NO: 49253 - DNA, 18 bp, Artificial Sequence
  Synthetic DNA
ttacacgcctatatattg

SEQ ID NO: 49254 - DNA, 18 bp, Artificial Sequence
  Synthetic DNA
ttacacggccaattatag

SEQ ID NO: 49255 - DNA, 18 bp, Artificial Sequence
  Synthetic DNA
ttacacgtttctcattag

SEQ ID NO: 49256 - DNA, 18 bp, Artificial Sequence
  Synthetic DNA
ttacactactcacttttg

SEQ ID NO: 49257 - DNA, 18 bp, Artificial Sequence
  Synthetic DNA
ttacagaactaactttgg

SEQ ID NO: 49258 - DNA, 18 bp, Artificial Sequence
  Synthetic DNA
ttacataactcactaccg

SEQ ID NO: 49259 - DNA, 18 bp, Artificial Sequence
  Synthetic DNA
ttacatcactcattatag

SEQ ID NO: 49260 - DNA, 18 bp, Artificial Sequence
  Synthetic DNA
ttacatcatccacaatag

SEQ ID NO: 49261 - DNA, 18 bp, Artificial Sequence
  Synthetic DNA
ttacatgactctctaaag

SEQ ID NO: 49262 - DNA, 18 bp, Artificial Sequence
  Synthetic DNA
ttacgcgaatctctatag

SEQ ID NO: 49263 - DNA, 18 bp, Artificial Sequence
  Synthetic DNA
ttacgcgactcacgttag

SEQ ID NO: 49264 - DNA, 18 bp, Artificial Sequence
  Synthetic DNA
ttactcctctcactatag

SEQ ID NO: 49265 - DNA, 18 bp, Artificial Sequence
  Synthetic DNA
ttactcgactaactatcg

SEQ ID NO: 49266 - DNA, 18 bp, Artificial Sequence
  Synthetic DNA
ttactcgacttacgttag

SEQ ID NO: 49267 - DNA, 18 bp, Artificial Sequence
  Synthetic DNA
ttactcttaagaatttag

SEQ ID NO: 49268 - DNA, 18 bp, Artificial Sequence
  Synthetic DNA
ttagaaaactcacaaaag

SEQ ID NO: 49269 - DNA, 18 bp, Artificial Sequence
  Synthetic DNA
ttagaaaactctctatag

SEQ ID NO: 49270 - DNA, 18 bp, Artificial Sequence
  Synthetic DNA
ttagaacattctctattg

SEQ ID NO: 49271 - DNA, 18 bp, Artificial Sequence
  Synthetic DNA
ttagaagacatactatcg

SEQ ID NO: 49272 - DNA, 18 bp, Artificial Sequence
  Synthetic DNA
ttagaagactcacaattg

SEQ ID NO: 49273 - DNA, 18 bp, Artificial Sequence
  Synthetic DNA
ttagacgactttttatag

SEQ ID NO: 49274 - DNA, 18 bp, Artificial Sequence
  Synthetic DNA
ttagactactcaatttag

SEQ ID NO: 49275 - DNA, 18 bp, Artificial Sequence
  Synthetic DNA
ttagaggattcactctag

SEQ ID NO: 49276 - DNA, 18 bp, Artificial Sequence
  Synthetic DNA
ttagtagactaagtattg

SEQ ID NO: 49277 - DNA, 18 bp, Artificial Sequence
  Synthetic DNA
ttagtcgtctttctattg

SEQ ID NO: 49278 - DNA, 18 bp, Artificial Sequence
  Synthetic DNA
ttataaaaattactatgg

SEQ ID NO: 49279 - DNA, 18 bp, Artificial Sequence
  Synthetic DNA
ttataaaacactctatag

SEQ ID NO: 49280 - DNA, 18 bp, Artificial Sequence
  Synthetic DNA
ttataaaactcgcttcag

SEQ ID NO: 49281 - DNA, 18 bp, Artificial Sequence
  Synthetic DNA
ttataaaactttctattg

SEQ ID NO: 49282 - DNA, 18 bp, Artificial Sequence
  Synthetic DNA
ttataaatctaactgtag

SEQ ID NO: 49283 - DNA, 18 bp, Artificial Sequence
  Synthetic DNA
ttataaatctcacatatg

SEQ ID NO: 49284 - DNA, 18 bp, Artificial Sequence
  Synthetic DNA
ttataaatttcactatag

SEQ ID NO: 49285 - DNA, 18 bp, Artificial Sequence
  Synthetic DNA
ttataacactcaaaatag

SEQ ID NO: 49286 - DNA, 18 bp, Artificial Sequence
  Synthetic DNA
ttataacactctttatag

SEQ ID NO: 49287 - DNA, 18 bp, Artificial Sequence
  Synthetic DNA
ttataagaaacacaattg

SEQ ID NO: 49288 - DNA, 18 bp, Artificial Sequence
  Synthetic DNA
ttataagactcagaattg

SEQ ID NO: 49289 - DNA, 18 bp, Artificial Sequence
  Synthetic DNA
ttataagagtcattaaag

SEQ ID NO: 49290 - DNA, 18 bp, Artificial Sequence
  Synthetic DNA
ttataagccgcaccgtag

SEQ ID NO: 49291 - DNA, 18 bp, Artificial Sequence
  Synthetic DNA
ttataagcctaatcctag

SEQ ID NO: 49292 - DNA, 18 bp, Artificial Sequence
  Synthetic DNA
ttataaggcacacaattg

SEQ ID NO: 49293 - DNA, 18 bp, Artificial Sequence
  Synthetic DNA
ttataagtatcaatatag

SEQ ID NO: 49294 - DNA, 18 bp, Artificial Sequence
  Synthetic DNA
ttataagtccccctacag

SEQ ID NO: 49295 - DNA, 18 bp, Artificial Sequence
  Synthetic DNA
ttataagtctaacaatag

SEQ ID NO: 49296 - DNA, 18 bp, Artificial Sequence
  Synthetic DNA
ttataagtctagccttag

SEQ ID NO: 49297 - DNA, 18 bp, Artificial Sequence
  Synthetic DNA
ttataagtctcacttatg

SEQ ID NO: 49298 - DNA, 18 bp, Artificial Sequence
  Synthetic DNA
ttataagtctctctttag

SEQ ID NO: 49299 - DNA, 18 bp, Artificial Sequence
  Synthetic DNA
ttataatacacactatcg

SEQ ID NO: 49300 - DNA, 18 bp, Artificial Sequence
  Synthetic DNA
ttataataccctcaattg

SEQ ID NO: 49301 - DNA, 18 bp, Artificial Sequence
  Synthetic DNA
ttataatacttattatag

SEQ ID NO: 49302 - DNA, 18 bp, Artificial Sequence
  Synthetic DNA
ttataatagtccctatag

SEQ ID NO: 49303 - DNA, 18 bp, Artificial Sequence
  Synthetic DNA
ttataatattcagtacag

SEQ ID NO: 49304 - DNA, 18 bp, Artificial Sequence
  Synthetic DNA
ttatacaacgaactattg

SEQ ID NO: 49305 - DNA, 18 bp, Artificial Sequence
  Synthetic DNA
ttatacaacttaaaatag

SEQ ID NO: 49306 - DNA, 18 bp, Artificial Sequence
  Synthetic DNA
ttatacaagacaatatag

SEQ ID NO: 49307 - DNA, 18 bp, Artificial Sequence
  Synthetic DNA
ttatacaagattctttag

SEQ ID NO: 49308 - DNA, 18 bp, Artificial Sequence
  Synthetic DNA
ttatacacgtcacaaaag

SEQ ID NO: 49309 - DNA, 18 bp, Artificial Sequence
  Synthetic DNA
ttatacagctcattaaag

SEQ ID NO: 49310 - DNA, 18 bp, Artificial Sequence
  Synthetic DNA
ttatacatccccctaaag

SEQ ID NO: 49311 - DNA, 18 bp, Artificial Sequence
  Synthetic DNA
ttatacatctcgcgatag

SEQ ID NO: 49312 - DNA, 18 bp, Artificial Sequence
  Synthetic DNA
ttatacatttcactatcg

SEQ ID NO: 49313 - DNA, 18 bp, Artificial Sequence
  Synthetic DNA
ttataccaagatctatag

SEQ ID NO: 49314 - DNA, 18 bp, Artificial Sequence
  Synthetic DNA
ttataccaataattatag

SEQ ID NO: 49315 - DNA, 18 bp, Artificial Sequence
  Synthetic DNA
ttataccaatcacattag

SEQ ID NO: 49316 - DNA, 18 bp, Artificial Sequence
  Synthetic DNA
ttataccactcccaattg

SEQ ID NO: 49317 - DNA, 18 bp, Artificial Sequence
  Synthetic DNA
ttataccagagaccattg

SEQ ID NO: 49318 - DNA, 18 bp, Artificial Sequence
  Synthetic DNA
ttatacccctatctatag

SEQ ID NO: 49319 - DNA, 18 bp, Artificial Sequence
  Synthetic DNA
ttataccgcactctatag

SEQ ID NO: 49320 - DNA, 18 bp, Artificial Sequence
  Synthetic DNA
ttataccgctcaataacg

SEQ ID NO: 49321 - DNA, 18 bp, Artificial Sequence
  Synthetic DNA
ttatacctatctttattg

SEQ ID NO: 49322 - DNA, 18 bp, Artificial Sequence
  Synthetic DNA
ttatacctctccctttag

SEQ ID NO: 49323 - DNA, 18 bp, Artificial Sequence
  Synthetic DNA
ttatacctttcactattg

SEQ ID NO: 49324 - DNA, 18 bp, Artificial Sequence
  Synthetic DNA
ttatacctttcataatag

SEQ ID NO: 49325 - DNA, 18 bp, Artificial Sequence
  Synthetic DNA
ttatacgaaactatatag

SEQ ID NO: 49326 - DNA, 18 bp, Artificial Sequence
  Synthetic DNA
ttatacgaaccacttagg

SEQ ID NO: 49327 - DNA, 18 bp, Artificial Sequence
  Synthetic DNA
ttatacgaatcacatcag

SEQ ID NO: 49328 - DNA, 18 bp, Artificial Sequence
  Synthetic DNA
ttatacgaatttcaatag

SEQ ID NO: 49329 - DNA, 18 bp, Artificial Sequence
  Synthetic DNA
ttatacgacactaagtag

SEQ ID NO: 49330 - DNA, 18 bp, Artificial Sequence
  Synthetic DNA
ttatacgacactcaaccg

SEQ ID NO: 49331 - DNA, 18 bp, Artificial Sequence
  Synthetic DNA
ttatacgacgcaaaattg

SEQ ID NO: 49332 - DNA, 18 bp, Artificial Sequence
  Synthetic DNA
ttatacgactaacatttg

SEQ ID NO: 49333 - DNA, 18 bp, Artificial Sequence
  Synthetic DNA
ttatacgactaactgatg

SEQ ID NO: 49334 - DNA, 18 bp, Artificial Sequence
  Synthetic DNA
ttatacgactcacccagg

SEQ ID NO: 49335 - DNA, 18 bp, Artificial Sequence
  Synthetic DNA
ttatacgactctacaaag

SEQ ID NO: 49336 - DNA, 18 bp, Artificial Sequence
  Synthetic DNA
ttatacgactctttttgg

SEQ ID NO: 49337 - DNA, 18 bp, Artificial Sequence
  Synthetic DNA
ttatacgactggcaattg

SEQ ID NO: 49338 - DNA, 18 bp, Artificial Sequence
  Synthetic DNA
ttatacgactttcctttg

SEQ ID NO: 49339 - DNA, 18 bp, Artificial Sequence
  Synthetic DNA
ttatacgacttttttaag

SEQ ID NO: 49340 - DNA, 18 bp, Artificial Sequence
  Synthetic DNA
ttatacgagacactaatg

SEQ ID NO: 49341 - DNA, 18 bp, Artificial Sequence
  Synthetic DNA
ttatacgagacactcctg

SEQ ID NO: 49342 - DNA, 18 bp, Artificial Sequence
  Synthetic DNA
ttatacgagtcagcttag

SEQ ID NO: 49343 - DNA, 18 bp, Artificial Sequence
  Synthetic DNA
ttatacgagtttctattg

SEQ ID NO: 49344 - DNA, 18 bp, Artificial Sequence
  Synthetic DNA
ttatacgatacaagacag

SEQ ID NO: 49345 - DNA, 18 bp, Artificial Sequence
  Synthetic DNA
ttatacgatccaatttag

SEQ ID NO: 49346 - DNA, 18 bp, Artificial Sequence
  Synthetic DNA
ttatacgatccgctaatg

SEQ ID NO: 49347 - DNA, 18 bp, Artificial Sequence
  Synthetic DNA
ttatacgattatctattg

SEQ ID NO: 49348 - DNA, 18 bp, Artificial Sequence
  Synthetic DNA
ttatacgattcacagttg

SEQ ID NO: 49349 - DNA, 18 bp, Artificial Sequence
  Synthetic DNA
ttatacgattctagatag

SEQ ID NO: 49350 - DNA, 18 bp, Artificial Sequence
  Synthetic DNA
ttatacgattgaccttag

SEQ ID NO: 49351 - DNA, 18 bp, Artificial Sequence
  Synthetic DNA
ttatacgcattaccattg

SEQ ID NO: 49352 - DNA, 18 bp, Artificial Sequence
  Synthetic DNA
ttatacgccagaatatag

SEQ ID NO: 49353 - DNA, 18 bp, Artificial Sequence
  Synthetic DNA
ttatacgcctctccattg

SEQ ID NO: 49354 - DNA, 18 bp, Artificial Sequence
  Synthetic DNA
ttatacgcgcctatatag

SEQ ID NO: 49355 - DNA, 18 bp, Artificial Sequence
  Synthetic DNA
ttatacgcgtgaccattg

SEQ ID NO: 49356 - DNA, 18 bp, Artificial Sequence
  Synthetic DNA
ttatacggctatcaaaag

SEQ ID NO: 49357 - DNA, 18 bp, Artificial Sequence
  Synthetic DNA
ttatacgtaacactgtag

SEQ ID NO: 49358 - DNA, 18 bp, Artificial Sequence
  Synthetic DNA
ttatacgtacaactatcg

SEQ ID NO: 49359 - DNA, 18 bp, Artificial Sequence
  Synthetic DNA
ttatacgtagcaatttag

SEQ ID NO: 49360 - DNA, 18 bp, Artificial Sequence
  Synthetic DNA
ttatacgtcaccattaag

SEQ ID NO: 49361 - DNA, 18 bp, Artificial Sequence
  Synthetic DNA
ttatacgtcgctctaaag

SEQ ID NO: 49362 - DNA, 18 bp, Artificial Sequence
  Synthetic DNA
ttatacgtcgctttgtag

SEQ ID NO: 49363 - DNA, 18 bp, Artificial Sequence
  Synthetic DNA
ttatacgtctctctagtg

SEQ ID NO: 49364 - DNA, 18 bp, Artificial Sequence
  Synthetic DNA
ttatacgtctgacaaacg

SEQ ID NO: 49365 - DNA, 18 bp, Artificial Sequence
  Synthetic DNA
ttatacgttacaatatag

SEQ ID NO: 49366 - DNA, 18 bp, Artificial Sequence
  Synthetic DNA
ttatacgttatagtatag

SEQ ID NO: 49367 - DNA, 18 bp, Artificial Sequence
  Synthetic DNA
ttatacgtttcagcatag

SEQ ID NO: 49368 - DNA, 18 bp, Artificial Sequence
  Synthetic DNA
ttatacgtttcataacag

SEQ ID NO: 49369 - DNA, 18 bp, Artificial Sequence
  Synthetic DNA
ttatacgtttctctatac

SEQ ID NO: 49370 - DNA, 18 bp, Artificial Sequence
  Synthetic DNA
ttatacgtttctcttcag

SEQ ID NO: 49371 - DNA, 18 bp, Artificial Sequence
  Synthetic DNA
ttatactaaatataatag

SEQ ID NO: 49372 - DNA, 18 bp, Artificial Sequence
  Synthetic DNA
ttatactaaccactaatg

SEQ ID NO: 49373 - DNA, 18 bp, Artificial Sequence
  Synthetic DNA
ttatactaatctctttag

SEQ ID NO: 49374 - DNA, 18 bp, Artificial Sequence
  Synthetic DNA
ttatactacacactaagg

SEQ ID NO: 49375 - DNA, 18 bp, Artificial Sequence
  Synthetic DNA
ttatactacacacttctg

SEQ ID NO: 49376 - DNA, 18 bp, Artificial Sequence
  Synthetic DNA
ttatactacatactatcg

SEQ ID NO: 49377 - DNA, 18 bp, Artificial Sequence
  Synthetic DNA
ttatactactaactcaag

SEQ ID NO: 49378 - DNA, 18 bp, Artificial Sequence
  Synthetic DNA
ttatactacttacgatgg

SEQ ID NO: 49379 - DNA, 18 bp, Artificial Sequence
  Synthetic DNA
ttatactactttgtacag

SEQ ID NO: 49380 - DNA, 18 bp, Artificial Sequence
  Synthetic DNA
ttatactatccactttag

SEQ ID NO: 49381 - DNA, 18 bp, Artificial Sequence
  Synthetic DNA
ttatactatcctttactg

SEQ ID NO: 49382 - DNA, 18 bp, Artificial Sequence
  Synthetic DNA
ttatactattaacaattg

SEQ ID NO: 49383 - DNA, 18 bp, Artificial Sequence
  Synthetic DNA
ttatactattcactagtg

SEQ ID NO: 49384 - DNA, 18 bp, Artificial Sequence
  Synthetic DNA
ttatactgcttacaaaag

SEQ ID NO: 49385 - DNA, 18 bp, Artificial Sequence
  Synthetic DNA
ttatacttatcactaaag

SEQ ID NO: 49386 - DNA, 18 bp, Artificial Sequence
  Synthetic DNA
ttatacttcccactctag

SEQ ID NO: 49387 - DNA, 18 bp, Artificial Sequence
  Synthetic DNA
ttatacttctcacgctgg

SEQ ID NO: 49388 - DNA, 18 bp, Artificial Sequence
  Synthetic DNA
ttatacttctccgtatag

SEQ ID NO: 49389 - DNA, 18 bp, Artificial Sequence
  Synthetic DNA
ttatagaactctcgatag

SEQ ID NO: 49390 - DNA, 18 bp, Artificial Sequence
  Synthetic DNA
ttatagaattcacttttg

SEQ ID NO: 49391 - DNA, 18 bp, Artificial Sequence
  Synthetic DNA
ttatagaattgactatag

SEQ ID NO: 49392 - DNA, 18 bp, Artificial Sequence
  Synthetic DNA
ttataggaatcaccacag

SEQ ID NO: 49393 - DNA, 18 bp, Artificial Sequence
  Synthetic DNA
ttataggaccccatatcg

SEQ ID NO: 49394 - DNA, 18 bp, Artificial Sequence
  Synthetic DNA
ttataggatacattatag

SEQ ID NO: 49395 - DNA, 18 bp, Artificial Sequence
  Synthetic DNA
ttataggcctcactagtg

SEQ ID NO: 49396 - DNA, 18 bp, Artificial Sequence
  Synthetic DNA
ttataggtccgtcaatag

SEQ ID NO: 49397 - DNA, 18 bp, Artificial Sequence
  Synthetic DNA
ttataggtctcagtttag

SEQ ID NO: 49398 - DNA, 18 bp, Artificial Sequence
  Synthetic DNA
ttataggtgacacttcag

SEQ ID NO: 49399 - DNA, 18 bp, Artificial Sequence
  Synthetic DNA
ttataggtttgactatag

SEQ ID NO: 49400 - DNA, 18 bp, Artificial Sequence
  Synthetic DNA
ttatataaccctctatag

SEQ ID NO: 49401 - DNA, 18 bp, Artificial Sequence
  Synthetic DNA
ttatataaccttctctag

SEQ ID NO: 49402 - DNA, 18 bp, Artificial Sequence
  Synthetic DNA
ttatatatctcactaaag

SEQ ID NO: 49403 - DNA, 18 bp, Artificial Sequence
  Synthetic DNA
ttatatcacgctcaatag

SEQ ID NO: 49404 - DNA, 18 bp, Artificial Sequence
  Synthetic DNA
ttatatcactatttttag

SEQ ID NO: 49405 - DNA, 18 bp, Artificial Sequence
  Synthetic DNA
ttatatcagtcacaatag

SEQ ID NO: 49406 - DNA, 18 bp, Artificial Sequence
  Synthetic DNA
ttatatctctctctattg

SEQ ID NO: 49407 - DNA, 18 bp, Artificial Sequence
  Synthetic DNA
ttatatctctgccatttg

SEQ ID NO: 49408 - DNA, 18 bp, Artificial Sequence
  Synthetic DNA
ttatatgaattactatcg

SEQ ID NO: 49409 - DNA, 18 bp, Artificial Sequence
  Synthetic DNA
ttatatgacaaactattg

SEQ ID NO: 49410 - DNA, 18 bp, Artificial Sequence
  Synthetic DNA
ttatatgacacactgttg

SEQ ID NO: 49411 - DNA, 18 bp, Artificial Sequence
  Synthetic DNA
ttatatgacgttctatag

SEQ ID NO: 49412 - DNA, 18 bp, Artificial Sequence
  Synthetic DNA
ttatatgactctatagag

SEQ ID NO: 49413 - DNA, 18 bp, Artificial Sequence
  Synthetic DNA
ttatatgactctcttaag

SEQ ID NO: 49414 - DNA, 18 bp, Artificial Sequence
  Synthetic DNA
ttatatgataaacattag

SEQ ID NO: 49415 - DNA, 18 bp, Artificial Sequence
  Synthetic DNA
ttatatgatccaatatcg

SEQ ID NO: 49416 - DNA, 18 bp, Artificial Sequence
  Synthetic DNA
ttatatgattcccaacag

SEQ ID NO: 49417 - DNA, 18 bp, Artificial Sequence
  Synthetic DNA
ttatatgatttcctatag

SEQ ID NO: 49418 - DNA, 18 bp, Artificial Sequence
  Synthetic DNA
ttatatggttcgctatag

SEQ ID NO: 49419 - DNA, 18 bp, Artificial Sequence
  Synthetic DNA
ttatatgtctaactttag

SEQ ID NO: 49420 - DNA, 18 bp, Artificial Sequence
  Synthetic DNA
ttatatgtctctctacag

SEQ ID NO: 49421 - DNA, 18 bp, Artificial Sequence
  Synthetic DNA
ttatatgttgcgctatcg

SEQ ID NO: 49422 - DNA, 18 bp, Artificial Sequence
  Synthetic DNA
ttatattacacactctag

SEQ ID NO: 49423 - DNA, 18 bp, Artificial Sequence
  Synthetic DNA
ttatattactcactagtg

SEQ ID NO: 49424 - DNA, 18 bp, Artificial Sequence
  Synthetic DNA
ttatattcctcacaaagg

SEQ ID NO: 49425 - DNA, 18 bp, Artificial Sequence
  Synthetic DNA
ttatattcctcactattg

SEQ ID NO: 49426 - DNA, 18 bp, Artificial Sequence
  Synthetic DNA
ttatatttatcagtatag

SEQ ID NO: 49427 - DNA, 18 bp, Artificial Sequence
  Synthetic DNA
ttatatttctctccatag

SEQ ID NO: 49428 - DNA, 18 bp, Artificial Sequence
  Synthetic DNA
ttatcactctcggtgtgg

SEQ ID NO: 49429 - DNA, 18 bp, Artificial Sequence
  Synthetic DNA
ttatccaacactttattg

SEQ ID NO: 49430 - DNA, 18 bp, Artificial Sequence
  Synthetic DNA
ttatccaacttacattag

SEQ ID NO: 49431 - DNA, 18 bp, Artificial Sequence
  Synthetic DNA
ttatccatctcaatatag

SEQ ID NO: 49432 - DNA, 18 bp, Artificial Sequence
  Synthetic DNA
ttatccatcttaattaag

SEQ ID NO: 49433 - DNA, 18 bp, Artificial Sequence
  Synthetic DNA
ttatcccagtcacaagag

SEQ ID NO: 49434 - DNA, 18 bp, Artificial Sequence
  Synthetic DNA
ttatcccagtcattaaag

SEQ ID NO: 49435 - DNA, 18 bp, Artificial Sequence
  Synthetic DNA
ttatccgactcacacttg

SEQ ID NO: 49436 - DNA, 18 bp, Artificial Sequence
  Synthetic DNA
ttatccgacttaatgtag

SEQ ID NO: 49437 - DNA, 18 bp, Artificial Sequence
  Synthetic DNA
ttatccgagtttctctag

SEQ ID NO: 49438 - DNA, 18 bp, Artificial Sequence
  Synthetic DNA
ttatccgatacacgttag

SEQ ID NO: 49439 - DNA, 18 bp, Artificial Sequence
  Synthetic DNA
ttatccgcttgtctagtg

SEQ ID NO: 49440 - DNA, 18 bp, Artificial Sequence
  Synthetic DNA
ttatcctattcacatttg

SEQ ID NO: 49441 - DNA, 18 bp, Artificial Sequence
  Synthetic DNA
ttatcggactctatatag

SEQ ID NO: 49442 - DNA, 18 bp, Artificial Sequence
  Synthetic DNA
ttatctaacacactaacg

SEQ ID NO: 49443 - DNA, 18 bp, Artificial Sequence
  Synthetic DNA
ttatctgacccagtatag

SEQ ID NO: 49444 - DNA, 18 bp, Artificial Sequence
  Synthetic DNA
ttatctgactcgcaattg

SEQ ID NO: 49445 - DNA, 18 bp, Artificial Sequence
  Synthetic DNA
ttatctgactgactattg

SEQ ID NO: 49446 - DNA, 18 bp, Artificial Sequence
  Synthetic DNA
ttatctgtctcgctatag

SEQ ID NO: 49447 - DNA, 18 bp, Artificial Sequence
  Synthetic DNA
ttatctgtgtcactatag

SEQ ID NO: 49448 - DNA, 18 bp, Artificial Sequence
  Synthetic DNA
ttatgagacacgcatttg

SEQ ID NO: 49449 - DNA, 18 bp, Artificial Sequence
  Synthetic DNA
ttatgagactccctctag

SEQ ID NO: 49450 - DNA, 18 bp, Artificial Sequence
  Synthetic DNA
ttatgagtatcactaagg

SEQ ID NO: 49451 - DNA, 18 bp, Artificial Sequence
  Synthetic DNA
ttatgcaactgaccatag

SEQ ID NO: 49452 - DNA, 18 bp, Artificial Sequence
  Synthetic DNA
ttatgcaacttactatgg

SEQ ID NO: 49453 - DNA, 18 bp, Artificial Sequence
  Synthetic DNA
ttatgccacttcctatag

SEQ ID NO: 49454 - DNA, 18 bp, Artificial Sequence
  Synthetic DNA
ttatgcgaacatcttaag

SEQ ID NO: 49455 - DNA, 18 bp, Artificial Sequence
  Synthetic DNA
ttatgcgactatgtgtag

SEQ ID NO: 49456 - DNA, 18 bp, Artificial Sequence
  Synthetic DNA
ttatgcgactctctaatg

SEQ ID NO: 49457 - DNA, 18 bp, Artificial Sequence
  Synthetic DNA
ttatgcgactctttatcg

SEQ ID NO: 49458 - DNA, 18 bp, Artificial Sequence
  Synthetic DNA
ttatgcgatacactaaag

SEQ ID NO: 49459 - DNA, 18 bp, Artificial Sequence
  Synthetic DNA
ttatgcgattcattaaag

SEQ ID NO: 49460 - DNA, 18 bp, Artificial Sequence
  Synthetic DNA
ttatgcgattttaaatag

SEQ ID NO: 49461 - DNA, 18 bp, Artificial Sequence
  Synthetic DNA
ttatgcgcttaactatag

SEQ ID NO: 49462 - DNA, 18 bp, Artificial Sequence
  Synthetic DNA
ttatgctactcaatcctg

SEQ ID NO: 49463 - DNA, 18 bp, Artificial Sequence
  Synthetic DNA
ttatggggttcacaaaag

SEQ ID NO: 49464 - DNA, 18 bp, Artificial Sequence
  Synthetic DNA
ttatgtgaaacacaatag

SEQ ID NO: 49465 - DNA, 18 bp, Artificial Sequence
  Synthetic DNA
ttatgtgacacattaaag

SEQ ID NO: 49466 - DNA, 18 bp, Artificial Sequence
  Synthetic DNA
ttatgtgattcaaaatag

SEQ ID NO: 49467 - DNA, 18 bp, Artificial Sequence
  Synthetic DNA
ttattagactctctttgg

SEQ ID NO: 49468 - DNA, 18 bp, Artificial Sequence
  Synthetic DNA
ttattagattctttatcg

SEQ ID NO: 49469 - DNA, 18 bp, Artificial Sequence
  Synthetic DNA
ttattcaaaacattacag

SEQ ID NO: 49470 - DNA, 18 bp, Artificial Sequence
  Synthetic DNA
ttattcaaaaccctatag

SEQ ID NO: 49471 - DNA, 18 bp, Artificial Sequence
  Synthetic DNA
ttattcaaaccactatag

SEQ ID NO: 49472 - DNA, 18 bp, Artificial Sequence
  Synthetic DNA
ttattcaaatcaatttag

SEQ ID NO: 49473 - DNA, 18 bp, Artificial Sequence
  Synthetic DNA
ttattcaacacacaatcg

SEQ ID NO: 49474 - DNA, 18 bp, Artificial Sequence
  Synthetic DNA
ttattcaactaacaatag

SEQ ID NO: 49475 - DNA, 18 bp, Artificial Sequence
  Synthetic DNA
ttattcaactacttattg

SEQ ID NO: 49476 - DNA, 18 bp, Artificial Sequence
  Synthetic DNA
ttattcaactcaatctag

SEQ ID NO: 49477 - DNA, 18 bp, Artificial Sequence
  Synthetic DNA
ttattcaacttacaaaag

SEQ ID NO: 49478 - DNA, 18 bp, Artificial Sequence
  Synthetic DNA
ttattcaacttagtaaag

SEQ ID NO: 49479 - DNA, 18 bp, Artificial Sequence
  Synthetic DNA
ttattcaattcacgatag

SEQ ID NO: 49480 - DNA, 18 bp, Artificial Sequence
  Synthetic DNA
ttattcaattgagtttag

SEQ ID NO: 49481 - DNA, 18 bp, Artificial Sequence
  Synthetic DNA
ttattcacctcactacag

SEQ ID NO: 49482 - DNA, 18 bp, Artificial Sequence
  Synthetic DNA
ttattcagctctttattg

SEQ ID NO: 49483 - DNA, 18 bp, Artificial Sequence
  Synthetic DNA
ttattccaatctctatag

SEQ ID NO: 49484 - DNA, 18 bp, Artificial Sequence
  Synthetic DNA
ttattccactcacgccag

SEQ ID NO: 49485 - DNA, 18 bp, Artificial Sequence
  Synthetic DNA
ttattccactcgacttag

SEQ ID NO: 49486 - DNA, 18 bp, Artificial Sequence
  Synthetic DNA
ttattccgcacaatgcag

SEQ ID NO: 49487 - DNA, 18 bp, Artificial Sequence
  Synthetic DNA
ttattcgaatcactaacg

SEQ ID NO: 49488 - DNA, 18 bp, Artificial Sequence
  Synthetic DNA
ttattcgaatccctacag

SEQ ID NO: 49489 - DNA, 18 bp, Artificial Sequence
  Synthetic DNA
ttattcgaatctctagag

SEQ ID NO: 49490 - DNA, 18 bp, Artificial Sequence
  Synthetic DNA
ttattcgaatctttacag

SEQ ID NO: 49491 - DNA, 18 bp, Artificial Sequence
  Synthetic DNA
ttattcgaatttccaaag

SEQ ID NO: 49492 - DNA, 18 bp, Artificial Sequence
  Synthetic DNA
ttattcgacacacagttg

SEQ ID NO: 49493 - DNA, 18 bp, Artificial Sequence
  Synthetic DNA
ttattcgacccactcaag

SEQ ID NO: 49494 - DNA, 18 bp, Artificial Sequence
  Synthetic DNA
ttattcgactcaattcag

SEQ ID NO: 49495 - DNA, 18 bp, Artificial Sequence
  Synthetic DNA
ttattcgactctctatta

SEQ ID NO: 49496 - DNA, 18 bp, Artificial Sequence
  Synthetic DNA
ttattcgacttccaaatg

SEQ ID NO: 49497 - DNA, 18 bp, Artificial Sequence
  Synthetic DNA
ttattcgattaactacag

SEQ ID NO: 49498 - DNA, 18 bp, Artificial Sequence
  Synthetic DNA
ttattcgattcacaaatg

SEQ ID NO: 49499 - DNA, 18 bp, Artificial Sequence
  Synthetic DNA
ttattcgatttttagtag

SEQ ID NO: 49500 - DNA, 18 bp, Artificial Sequence
  Synthetic DNA
ttattcgcatcactaaag

SEQ ID NO: 49501 - DNA, 18 bp, Artificial Sequence
  Synthetic DNA
ttattcgcatcactattg

SEQ ID NO: 49502 - DNA, 18 bp, Artificial Sequence
  Synthetic DNA
ttattcgcctaactaaag

SEQ ID NO: 49503 - DNA, 18 bp, Artificial Sequence
  Synthetic DNA
ttattcgcctcaccatcg

SEQ ID NO: 49504 - DNA, 18 bp, Artificial Sequence
  Synthetic DNA
ttattcgcctcactacgg

SEQ ID NO: 49505 - DNA, 18 bp, Artificial Sequence
  Synthetic DNA
ttattcggctgactaaag

SEQ ID NO: 49506 - DNA, 18 bp, Artificial Sequence
  Synthetic DNA
ttattcgtatcccaaaag

SEQ ID NO: 49507 - DNA, 18 bp, Artificial Sequence
  Synthetic DNA
ttattcgtatcggtgtag

SEQ ID NO: 49508 - DNA, 18 bp, Artificial Sequence
  Synthetic DNA
ttattcgtcggacatttg

SEQ ID NO: 49509 - DNA, 18 bp, Artificial Sequence
  Synthetic DNA
ttattcgtctcactcaag

SEQ ID NO: 49510 - DNA, 18 bp, Artificial Sequence
  Synthetic DNA
ttattcgtctcgctgtag

SEQ ID NO: 49511 - DNA, 18 bp, Artificial Sequence
  Synthetic DNA
ttattcgtcttactatgg

SEQ ID NO: 49512 - DNA, 18 bp, Artificial Sequence
  Synthetic DNA
ttattcgtgacgttattg

SEQ ID NO: 49513 - DNA, 18 bp, Artificial Sequence
  Synthetic DNA
ttattctaatctgtatag

SEQ ID NO: 49514 - DNA, 18 bp, Artificial Sequence
  Synthetic DNA
ttattctactcacgattg

SEQ ID NO: 49515 - DNA, 18 bp, Artificial Sequence
  Synthetic DNA
ttattctatacactgtag

SEQ ID NO: 49516 - DNA, 18 bp, Artificial Sequence
  Synthetic DNA
ttattcttcactctatag

SEQ ID NO: 49517 - DNA, 18 bp, Artificial Sequence
  Synthetic DNA
ttattggaccctctatag

SEQ ID NO: 49518 - DNA, 18 bp, Artificial Sequence
  Synthetic DNA
ttattggaccctgtgtag

SEQ ID NO: 49519 - DNA, 18 bp, Artificial Sequence
  Synthetic DNA
ttattggactcactttgg

SEQ ID NO: 49520 - DNA, 18 bp, Artificial Sequence
  Synthetic DNA
ttattggcctcactttag

SEQ ID NO: 49521 - DNA, 18 bp, Artificial Sequence
  Synthetic DNA
ttatttacctcactgtag

SEQ ID NO: 49522 - DNA, 18 bp, Artificial Sequence
  Synthetic DNA
ttatttatcacactagag

SEQ ID NO: 49523 - DNA, 18 bp, Artificial Sequence
  Synthetic DNA
ttatttatttcactctag

SEQ ID NO: 49524 - DNA, 18 bp, Artificial Sequence
  Synthetic DNA
ttatttcattcactatcg

SEQ ID NO: 49525 - DNA, 18 bp, Artificial Sequence
  Synthetic DNA
ttatttgaatgactttag

SEQ ID NO: 49526 - DNA, 18 bp, Artificial Sequence
  Synthetic DNA
ttatttgactcatttaag

SEQ ID NO: 49527 - DNA, 18 bp, Artificial Sequence
  Synthetic DNA
ttatttgtatcgctattg

SEQ ID NO: 49528 - DNA, 18 bp, Artificial Sequence
  Synthetic DNA
ttatttgtgtcaaaatcg

SEQ ID NO: 49529 - DNA, 18 bp, Artificial Sequence
  Synthetic DNA
ttattttactcactatgg

SEQ ID NO: 49530 - DNA, 18 bp, Artificial Sequence
  Synthetic DNA
ttattttactcagtatag

SEQ ID NO: 49531 - DNA, 18 bp, Artificial Sequence
  Synthetic DNA
ttcaaagacaatccttag

SEQ ID NO: 49532 - DNA, 18 bp, Artificial Sequence
  Synthetic DNA
ttcaaagtctcaatatag

SEQ ID NO: 49533 - DNA, 18 bp, Artificial Sequence
  Synthetic DNA
ttcaacaactcccttttg

SEQ ID NO: 49534 - DNA, 18 bp, Artificial Sequence
  Synthetic DNA
ttcaacgacacacaattg

SEQ ID NO: 49535 - DNA, 18 bp, Artificial Sequence
  Synthetic DNA
ttcaacgacgctgattag

SEQ ID NO: 49536 - DNA, 18 bp, Artificial Sequence
  Synthetic DNA
ttcaacgactcaaaacag

SEQ ID NO: 49537 - DNA, 18 bp, Artificial Sequence
  Synthetic DNA
ttcaacgactcaccagag

SEQ ID NO: 49538 - DNA, 18 bp, Artificial Sequence
  Synthetic DNA
ttcaagggctttctatag

SEQ ID NO: 49539 - DNA, 18 bp, Artificial Sequence
  Synthetic DNA
ttcaataattcactatag

SEQ ID NO: 49540 - DNA, 18 bp, Artificial Sequence
  Synthetic DNA
ttccacttttcatatttg

SEQ ID NO: 49541 - DNA, 18 bp, Artificial Sequence
  Synthetic DNA
ttccgctactcgctattg

SEQ ID NO: 49542 - DNA, 18 bp, Artificial Sequence
  Synthetic DNA
ttcgataacttactatag

SEQ ID NO: 49543 - DNA, 18 bp, Artificial Sequence
  Synthetic DNA
ttctaagacacaccttag

SEQ ID NO: 49544 - DNA, 18 bp, Artificial Sequence
  Synthetic DNA
ttctaagcctgtctatag

SEQ ID NO: 49545 - DNA, 18 bp, Artificial Sequence
  Synthetic DNA
ttctacgactctcagtag

SEQ ID NO: 49546 - DNA, 18 bp, Artificial Sequence
  Synthetic DNA
ttctacgactctccttag

SEQ ID NO: 49547 - DNA, 18 bp, Artificial Sequence
  Synthetic DNA
ttctacgacttacacttg

SEQ ID NO: 49548 - DNA, 18 bp, Artificial Sequence
  Synthetic DNA
ttctacgacttattaaag

SEQ ID NO: 49549 - DNA, 18 bp, Artificial Sequence
  Synthetic DNA
ttctacgagtcacttaag

SEQ ID NO: 49550 - DNA, 18 bp, Artificial Sequence
  Synthetic DNA
ttctacgatccactagtg

SEQ ID NO: 49551 - DNA, 18 bp, Artificial Sequence
  Synthetic DNA
ttctacgatgaactatcg

SEQ ID NO: 49552 - DNA, 18 bp, Artificial Sequence
  Synthetic DNA
ttctacgtcccccaaccg

SEQ ID NO: 49553 - DNA, 18 bp, Artificial Sequence
  Synthetic DNA
ttctacgtttaataatag

SEQ ID NO: 49554 - DNA, 18 bp, Artificial Sequence
  Synthetic DNA
ttctacgtttcactattg

SEQ ID NO: 49555 - DNA, 18 bp, Artificial Sequence
  Synthetic DNA
ttctactacacacttttg

SEQ ID NO: 49556 - DNA, 18 bp, Artificial Sequence
  Synthetic DNA
ttctactatttaccctag

SEQ ID NO: 49557 - DNA, 18 bp, Artificial Sequence
  Synthetic DNA
ttctacttctctccatcg

SEQ ID NO: 49558 - DNA, 18 bp, Artificial Sequence
  Synthetic DNA
ttctagaacacactaatg

SEQ ID NO: 49559 - DNA, 18 bp, Artificial Sequence
  Synthetic DNA
ttctaggacatatcatag

SEQ ID NO: 49560 - DNA, 18 bp, Artificial Sequence
  Synthetic DNA
ttctaggaccaattatag

SEQ ID NO: 49561 - DNA, 18 bp, Artificial Sequence
  Synthetic DNA
ttctattacctactacag

SEQ ID NO: 49562 - DNA, 18 bp, Artificial Sequence
  Synthetic DNA
ttctattactcaccttag

SEQ ID NO: 49563 - DNA, 18 bp, Artificial Sequence
  Synthetic DNA
ttctccgcctcacaatag

SEQ ID NO: 49564 - DNA, 18 bp, Artificial Sequence
  Synthetic DNA
ttctgcaacacattatag

SEQ ID NO: 49565 - DNA, 18 bp, Artificial Sequence
  Synthetic DNA
ttctgcgacacaaaagag

SEQ ID NO: 49566 - DNA, 18 bp, Artificial Sequence
  Synthetic DNA
ttctgcttctcactatag

SEQ ID NO: 49567 - DNA, 18 bp, Artificial Sequence
  Synthetic DNA
ttctgttacttagtatag

SEQ ID NO: 49568 - DNA, 18 bp, Artificial Sequence
  Synthetic DNA
ttcttcgactctctctag

SEQ ID NO: 49569 - DNA, 18 bp, Artificial Sequence
  Synthetic DNA
ttcttcgcctccccaaag

SEQ ID NO: 49570 - DNA, 18 bp, Artificial Sequence
  Synthetic DNA
ttctttgtatcaccatag

SEQ ID NO: 49571 - DNA, 18 bp, Artificial Sequence
  Synthetic DNA
ttgaacgactcccaatag

SEQ ID NO: 49572 - DNA, 18 bp, Artificial Sequence
  Synthetic DNA
ttgaatgtcacactatag

SEQ ID NO: 49573 - DNA, 18 bp, Artificial Sequence
  Synthetic DNA
ttgattaactctttttag

SEQ ID NO: 49574 - DNA, 18 bp, Artificial Sequence
  Synthetic DNA
ttgcacgacacaaaattg

SEQ ID NO: 49575 - DNA, 18 bp, Artificial Sequence
  Synthetic DNA
ttggtcgaagcactggag

SEQ ID NO: 49576 - DNA, 18 bp, Artificial Sequence
  Synthetic DNA
ttgtaagaatcacaaaag

SEQ ID NO: 49577 - DNA, 18 bp, Artificial Sequence
  Synthetic DNA
ttgtaagacgcaatgtag

SEQ ID NO: 49578 - DNA, 18 bp, Artificial Sequence
  Synthetic DNA
ttgtaaggttcactaaag

SEQ ID NO: 49579 - DNA, 18 bp, Artificial Sequence
  Synthetic DNA
ttgtaagtctcaatattg

SEQ ID NO: 49580 - DNA, 18 bp, Artificial Sequence
  Synthetic DNA
ttgtacaaccgatccaag

SEQ ID NO: 49581 - DNA, 18 bp, Artificial Sequence
  Synthetic DNA
ttgtacaactcaataaag

SEQ ID NO: 49582 - DNA, 18 bp, Artificial Sequence
  Synthetic DNA
ttgtacaactgcttatag

SEQ ID NO: 49583 - DNA, 18 bp, Artificial Sequence
  Synthetic DNA
ttgtacgaatccgtatag

SEQ ID NO: 49584 - DNA, 18 bp, Artificial Sequence
  Synthetic DNA
ttgtacgaattacaatgg

SEQ ID NO: 49585 - DNA, 18 bp, Artificial Sequence
  Synthetic DNA
ttgtacgactctatattg

SEQ ID NO: 49586 - DNA, 18 bp, Artificial Sequence
  Synthetic DNA
ttgtacgtctcacgaagg

SEQ ID NO: 49587 - DNA, 18 bp, Artificial Sequence
  Synthetic DNA
ttgtacgtcttgcttaag

SEQ ID NO: 49588 - DNA, 18 bp, Artificial Sequence
  Synthetic DNA
ttgtacgtttctaaatag

SEQ ID NO: 49589 - DNA, 18 bp, Artificial Sequence
  Synthetic DNA
ttgtactacctcttatag

SEQ ID NO: 49590 - DNA, 18 bp, Artificial Sequence
  Synthetic DNA
ttgtactactcacaatcg

SEQ ID NO: 49591 - DNA, 18 bp, Artificial Sequence
  Synthetic DNA
ttgtactacttactttag

SEQ ID NO: 49592 - DNA, 18 bp, Artificial Sequence
  Synthetic DNA
ttgtacttctctctaatg

SEQ ID NO: 49593 - DNA, 18 bp, Artificial Sequence
  Synthetic DNA
ttgtagctctctctgtag

SEQ ID NO: 49594 - DNA, 18 bp, Artificial Sequence
  Synthetic DNA
ttgtaggactttctatag

SEQ ID NO: 49595 - DNA, 18 bp, Artificial Sequence
  Synthetic DNA
ttgtaggattctctatag

SEQ ID NO: 49596 - DNA, 18 bp, Artificial Sequence
  Synthetic DNA
ttgtagtattatcttttg

SEQ ID NO: 49597 - DNA, 18 bp, Artificial Sequence
  Synthetic DNA
ttgtatcacaaacaagag

SEQ ID NO: 49598 - DNA, 18 bp, Artificial Sequence
  Synthetic DNA
ttgtatgacaagctaaag

SEQ ID NO: 49599 - DNA, 18 bp, Artificial Sequence
  Synthetic DNA
ttgtatgacactcaacag

SEQ ID NO: 49600 - DNA, 18 bp, Artificial Sequence
  Synthetic DNA
ttgtatgattcaccatag

SEQ ID NO: 49601 - DNA, 18 bp, Artificial Sequence
  Synthetic DNA
ttgtatggcacgctattg

SEQ ID NO: 49602 - DNA, 18 bp, Artificial Sequence
  Synthetic DNA
ttgtattactctctatag

SEQ ID NO: 49603 - DNA, 18 bp, Artificial Sequence
  Synthetic DNA
ttgtccgacaccctgtag

SEQ ID NO: 49604 - DNA, 18 bp, Artificial Sequence
  Synthetic DNA
ttgtgcaactcactatgg

SEQ ID NO: 49605 - DNA, 18 bp, Artificial Sequence
  Synthetic DNA
ttgtgcgacacagtatag

SEQ ID NO: 49606 - DNA, 18 bp, Artificial Sequence
  Synthetic DNA
ttgttaaactcacaatag

SEQ ID NO: 49607 - DNA, 18 bp, Artificial Sequence
  Synthetic DNA
ttgttcaacacactatcg

SEQ ID NO: 49608 - DNA, 18 bp, Artificial Sequence
  Synthetic DNA
ttgttcggcccactaaag

SEQ ID NO: 49609 - DNA, 18 bp, Artificial Sequence
  Synthetic DNA
ttgttcgtctcaatttag

SEQ ID NO: 49610 - DNA, 18 bp, Artificial Sequence
  Synthetic DNA
ttgttctacacactaaag

SEQ ID NO: 49611 - DNA, 18 bp, Artificial Sequence
  Synthetic DNA
tttaaagtttcactaatg

SEQ ID NO: 49612 - DNA, 18 bp, Artificial Sequence
  Synthetic DNA
tttaacgacacacggttg

SEQ ID NO: 49613 - DNA, 18 bp, Artificial Sequence
  Synthetic DNA
tttaacgactaacttttg

SEQ ID NO: 49614 - DNA, 18 bp, Artificial Sequence
  Synthetic DNA
tttaacgactatctaaag

SEQ ID NO: 49615 - DNA, 18 bp, Artificial Sequence
  Synthetic DNA
tttaacgactcagaatag

SEQ ID NO: 49616 - DNA, 18 bp, Artificial Sequence
  Synthetic DNA
tttaacgactccctaaag

SEQ ID NO: 49617 - DNA, 18 bp, Artificial Sequence
  Synthetic DNA
tttaacgactcttctcag

SEQ ID NO: 49618 - DNA, 18 bp, Artificial Sequence
  Synthetic DNA
tttaacgtctcgctattg

SEQ ID NO: 49619 - DNA, 18 bp, Artificial Sequence
  Synthetic DNA
tttaaggacggacaaatg

SEQ ID NO: 49620 - DNA, 18 bp, Artificial Sequence
  Synthetic DNA
tttaataactcactaatg

SEQ ID NO: 49621 - DNA, 18 bp, Artificial Sequence
  Synthetic DNA
tttaatagctcattatgg

SEQ ID NO: 49622 - DNA, 18 bp, Artificial Sequence
  Synthetic DNA
tttaatgtcacagtaaag

SEQ ID NO: 49623 - DNA, 18 bp, Artificial Sequence
  Synthetic DNA
tttaccgaccctgtctag

SEQ ID NO: 49624 - DNA, 18 bp, Artificial Sequence
  Synthetic DNA
tttatcgaatctaattag

SEQ ID NO: 49625 - DNA, 18 bp, Artificial Sequence
  Synthetic DNA
tttatcgacactcgttag

SEQ ID NO: 49626 - DNA, 18 bp, Artificial Sequence
  Synthetic DNA
tttatcgattcattaaag

SEQ ID NO: 49627 - DNA, 18 bp, Artificial Sequence
  Synthetic DNA
tttatcgtctcacaatag

SEQ ID NO: 49628 - DNA, 18 bp, Artificial Sequence
  Synthetic DNA
tttatcttcttactatag

SEQ ID NO: 49629 - DNA, 18 bp, Artificial Sequence
  Synthetic DNA
tttcacaacgaacgttcg

SEQ ID NO: 49630 - DNA, 18 bp, Artificial Sequence
  Synthetic DNA
tttcacgtttctctatag

SEQ ID NO: 49631 - DNA, 18 bp, Artificial Sequence
  Synthetic DNA
tttcattactaactatag

SEQ ID NO: 49632 - DNA, 18 bp, Artificial Sequence
  Synthetic DNA
tttctccaggcactttag

SEQ ID NO: 49633 - DNA, 18 bp, Artificial Sequence
  Synthetic DNA
tttctcgactcactattg

SEQ ID NO: 49634 - DNA, 18 bp, Artificial Sequence
  Synthetic DNA
tttctctacacactgtag

SEQ ID NO: 49635 - DNA, 18 bp, Artificial Sequence
  Synthetic DNA
tttgaagacttacactag

SEQ ID NO: 49636 - DNA, 18 bp, Artificial Sequence
  Synthetic DNA
tttgacaactcactatcg

SEQ ID NO: 49637 - DNA, 18 bp, Artificial Sequence
  Synthetic DNA
tttgacatcttaccatag

SEQ ID NO: 49638 - DNA, 18 bp, Artificial Sequence
  Synthetic DNA
tttgacgtctaattatag

SEQ ID NO: 49639 - DNA, 18 bp, Artificial Sequence
  Synthetic DNA
ttttaaaactaactatag

SEQ ID NO: 49640 - DNA, 18 bp, Artificial Sequence
  Synthetic DNA
ttttaaagctcactatgg

SEQ ID NO: 49641 - DNA, 18 bp, Artificial Sequence
  Synthetic DNA
ttttaaatctcacaattg

SEQ ID NO: 49642 - DNA, 18 bp, Artificial Sequence
  Synthetic DNA
ttttaaatttcactatag

SEQ ID NO: 49643 - DNA, 18 bp, Artificial Sequence
  Synthetic DNA
ttttaactctcactatag

SEQ ID NO: 49644 - DNA, 18 bp, Artificial Sequence
  Synthetic DNA
ttttaagacgcactctag

SEQ ID NO: 49645 - DNA, 18 bp, Artificial Sequence
  Synthetic DNA
ttttaagacgcattatag

SEQ ID NO: 49646 - DNA, 18 bp, Artificial Sequence
  Synthetic DNA
ttttaagactcaacagag

SEQ ID NO: 49647 - DNA, 18 bp, Artificial Sequence
  Synthetic DNA
ttttaagacttattaaag

SEQ ID NO: 49648 - DNA, 18 bp, Artificial Sequence
  Synthetic DNA
ttttaagatccactatcg

SEQ ID NO: 49649 - DNA, 18 bp, Artificial Sequence
  Synthetic DNA
ttttaaggctcactacag

SEQ ID NO: 49650 - DNA, 18 bp, Artificial Sequence
  Synthetic DNA
ttttaagtttctgaattg

SEQ ID NO: 49651 - DNA, 18 bp, Artificial Sequence
  Synthetic DNA
ttttaattgtcactaacg

SEQ ID NO: 49652 - DNA, 18 bp, Artificial Sequence
  Synthetic DNA
ttttacaaattgcccttg

SEQ ID NO: 49653 - DNA, 18 bp, Artificial Sequence
  Synthetic DNA
ttttacaactcactaatg

SEQ ID NO: 49654 - DNA, 18 bp, Artificial Sequence
  Synthetic DNA
ttttacaactgtttatag

SEQ ID NO: 49655 - DNA, 18 bp, Artificial Sequence
  Synthetic DNA
ttttaccactatctatag

SEQ ID NO: 49656 - DNA, 18 bp, Artificial Sequence
  Synthetic DNA
ttttaccactccctaagg

SEQ ID NO: 49657 - DNA, 18 bp, Artificial Sequence
  Synthetic DNA
ttttacgaaactcattag

SEQ ID NO: 49658 - DNA, 18 bp, Artificial Sequence
  Synthetic DNA
ttttacgaatcaccagag

SEQ ID NO: 49659 - DNA, 18 bp, Artificial Sequence
  Synthetic DNA
ttttacgaatcgctttag

SEQ ID NO: 49660 - DNA, 18 bp, Artificial Sequence
  Synthetic DNA
ttttacgacacgttgtag

SEQ ID NO: 49661 - DNA, 18 bp, Artificial Sequence
  Synthetic DNA
ttttacgactaatttttg

SEQ ID NO: 49662 - DNA, 18 bp, Artificial Sequence
  Synthetic DNA
ttttacgactccctaggg

SEQ ID NO: 49663 - DNA, 18 bp, Artificial Sequence
  Synthetic DNA
ttttacgactcgtactag

SEQ ID NO: 49664 - DNA, 18 bp, Artificial Sequence
  Synthetic DNA
ttttacgacttaattttg

SEQ ID NO: 49665 - DNA, 18 bp, Artificial Sequence
  Synthetic DNA
ttttacgacttacctcag

SEQ ID NO: 49666 - DNA, 18 bp, Artificial Sequence
  Synthetic DNA
ttttacgacttattttcg

SEQ ID NO: 49667 - DNA, 18 bp, Artificial Sequence
  Synthetic DNA
ttttacgactttcgatag

SEQ ID NO: 49668 - DNA, 18 bp, Artificial Sequence
  Synthetic DNA
ttttacgatacactacag

SEQ ID NO: 49669 - DNA, 18 bp, Artificial Sequence
  Synthetic DNA
ttttacgatccactaaag

SEQ ID NO: 49670 - DNA, 18 bp, Artificial Sequence
  Synthetic DNA
ttttacgattaactacag

SEQ ID NO: 49671 - DNA, 18 bp, Artificial Sequence
  Synthetic DNA
ttttacgccactctaaag

SEQ ID NO: 49672 - DNA, 18 bp, Artificial Sequence
  Synthetic DNA
ttttacgcttcactttag

SEQ ID NO: 49673 - DNA, 18 bp, Artificial Sequence
  Synthetic DNA
ttttacgtcactctaaag

SEQ ID NO: 49674 - DNA, 18 bp, Artificial Sequence
  Synthetic DNA
ttttacgtctatctaaag

SEQ ID NO: 49675 - DNA, 18 bp, Artificial Sequence
  Synthetic DNA
ttttacgtgtcacaatag

SEQ ID NO: 49676 - DNA, 18 bp, Artificial Sequence
  Synthetic DNA
ttttacgtgtgtctatag

SEQ ID NO: 49677 - DNA, 18 bp, Artificial Sequence
  Synthetic DNA
ttttacgttgtgctatag

SEQ ID NO: 49678 - DNA, 18 bp, Artificial Sequence
  Synthetic DNA
ttttactacgctctgtag

SEQ ID NO: 49679 - DNA, 18 bp, Artificial Sequence
  Synthetic DNA
ttttactactaacaaaag

SEQ ID NO: 49680 - DNA, 18 bp, Artificial Sequence
  Synthetic DNA
ttttactactcataatag

SEQ ID NO: 49681 - DNA, 18 bp, Artificial Sequence
  Synthetic DNA
ttttactactctaaatag

SEQ ID NO: 49682 - DNA, 18 bp, Artificial Sequence
  Synthetic DNA
ttttactacttaccatag

SEQ ID NO: 49683 - DNA, 18 bp, Artificial Sequence
  Synthetic DNA
ttttacttctcactagcg

SEQ ID NO: 49684 - DNA, 18 bp, Artificial Sequence
  Synthetic DNA
ttttacttgtcacaatag

SEQ ID NO: 49685 - DNA, 18 bp, Artificial Sequence
  Synthetic DNA
ttttaggacattcaacag

SEQ ID NO: 49686 - DNA, 18 bp, Artificial Sequence
  Synthetic DNA
ttttagtacacactagag

SEQ ID NO: 49687 - DNA, 18 bp, Artificial Sequence
  Synthetic DNA
ttttataataacgaaaag

SEQ ID NO: 49688 - DNA, 18 bp, Artificial Sequence
  Synthetic DNA
ttttatcactcgttaaag

SEQ ID NO: 49689 - DNA, 18 bp, Artificial Sequence
  Synthetic DNA
ttttatgaatcactagag

SEQ ID NO: 49690 - DNA, 18 bp, Artificial Sequence
  Synthetic DNA
ttttatgacgaaccgttg

SEQ ID NO: 49691 - DNA, 18 bp, Artificial Sequence
  Synthetic DNA
ttttatgactcacaacag

SEQ ID NO: 49692 - DNA, 18 bp, Artificial Sequence
  Synthetic DNA
ttttattccacactttag

SEQ ID NO: 49693 - DNA, 18 bp, Artificial Sequence
  Synthetic DNA
ttttccaattcggtatag

SEQ ID NO: 49694 - DNA, 18 bp, Artificial Sequence
  Synthetic DNA
ttttcggactcacaaaag

SEQ ID NO: 49695 - DNA, 18 bp, Artificial Sequence
  Synthetic DNA
ttttgagtctacatatag

SEQ ID NO: 49696 - DNA, 18 bp, Artificial Sequence
  Synthetic DNA
ttttgcaactccctatag

SEQ ID NO: 49697 - DNA, 18 bp, Artificial Sequence
  Synthetic DNA
ttttgcgacacacaacag

SEQ ID NO: 49698 - DNA, 18 bp, Artificial Sequence
  Synthetic DNA
ttttgcgacttagtatag

SEQ ID NO: 49699 - DNA, 18 bp, Artificial Sequence
  Synthetic DNA
ttttgcggccctattttg

SEQ ID NO: 49700 - DNA, 18 bp, Artificial Sequence
  Synthetic DNA
ttttgtgattctctaaag

SEQ ID NO: 49701 - DNA, 18 bp, Artificial Sequence
  Synthetic DNA
tttttaaactcactaaag

SEQ ID NO: 49702 - DNA, 18 bp, Artificial Sequence
  Synthetic DNA
tttttacacttaatctag

SEQ ID NO: 49703 - DNA, 18 bp, Artificial Sequence
  Synthetic DNA
tttttagactccctatag

SEQ ID NO: 49704 - DNA, 18 bp, Artificial Sequence
  Synthetic DNA
tttttagactctcaatag

SEQ ID NO: 49705 - DNA, 18 bp, Artificial Sequence
  Synthetic DNA
tttttagattccctattg

SEQ ID NO: 49706 - DNA, 18 bp, Artificial Sequence
  Synthetic DNA
tttttatattcactatag

SEQ ID NO: 49707 - DNA, 18 bp, Artificial Sequence
  Synthetic DNA
tttttcaactcaagaagg

SEQ ID NO: 49708 - DNA, 18 bp, Artificial Sequence
  Synthetic DNA
tttttcaactcacgatag

SEQ ID NO: 49709 - DNA, 18 bp, Artificial Sequence
  Synthetic DNA
tttttcacctcacacttg

SEQ ID NO: 49710 - DNA, 18 bp, Artificial Sequence
  Synthetic DNA
tttttcgaccccctattg

SEQ ID NO: 49711 - DNA, 18 bp, Artificial Sequence
  Synthetic DNA
tttttcgactcatgatgg

SEQ ID NO: 49712 - DNA, 18 bp, Artificial Sequence
  Synthetic DNA
tttttcgactcgctatgg

SEQ ID NO: 49713 - DNA, 18 bp, Artificial Sequence
  Synthetic DNA
tttttcgagacacggtag

SEQ ID NO: 49714 - DNA, 18 bp, Artificial Sequence
  Synthetic DNA
tttttcgagtcaccatcg

SEQ ID NO: 49715 - DNA, 18 bp, Artificial Sequence
  Synthetic DNA
tttttcgagtcattatgg

SEQ ID NO: 49716 - DNA, 18 bp, Artificial Sequence
  Synthetic DNA
tttttcgattctcttaag

SEQ ID NO: 49717 - DNA, 18 bp, Artificial Sequence
  Synthetic DNA
tttttggattcaccattg

SEQ ID NO: 49718 - DNA, 18 bp, Artificial Sequence
  Synthetic DNA
tttttttacactatgtag

SEQ ID NO: 49719 - DNA, 18 bp, Artificial Sequence
  Synthetic DNA
tttttttactcactatag

SEQ ID NO: 49720 - DNA, 18 bp, Artificial Sequence
  Synthetic DNA
ttattcgtctcgctaaag

SEQ ID NO: 49721 - DNA, 18 bp, Artificial Sequence
  Synthetic DNA
taaaatgactccatgttg

SEQ ID NO: 49722 - DNA, 18 bp, Artificial Sequence
  Synthetic DNA
taaatagactaactctcg

SEQ ID NO: 49723 - DNA, 18 bp, Artificial Sequence
  Synthetic DNA
aagtacgattcacaacag

SEQ ID NO: 49724 - DNA, 18 bp, Artificial Sequence
  Synthetic DNA
acatacgccttagtacag

SEQ ID NO: 49725 - DNA, 18 bp, Artificial Sequence
  Synthetic DNA
caaaacgccacgcgatag

SEQ ID NO: 49726 - DNA, 18 bp, Artificial Sequence
  Synthetic DNA
caacacgtctctcattag

SEQ ID NO: 49727 - DNA, 18 bp, Artificial Sequence
  Synthetic DNA
caattggactcacgattg

SEQ ID NO: 49728 - DNA, 18 bp, Artificial Sequence
  Synthetic DNA
cggtacaactcactctgg

SEQ ID NO: 49729 - DNA, 18 bp, Artificial Sequence
  Synthetic DNA
taatgcgattcaattaag

SEQ ID NO: 49730 - DNA, 18 bp, Artificial Sequence
  Synthetic DNA
taattctatacactaaag

SEQ ID NO: 49731 - DNA, 18 bp, Artificial Sequence
  Synthetic DNA
tgccaagtctcacattag

SEQ ID NO: 49732 - DNA, 18 bp, Artificial Sequence
  Synthetic DNA
ttattagtctgtcattag

SEQ ID NO: 49733 - DNA, 18 bp, Artificial Sequence
  Synthetic DNA
tttaacgactcactactg

SEQ ID NO: 49734 - DNA, 18 bp, Artificial Sequence
  Synthetic DNA
ttttaaaactccctatag

SEQ ID NO: 49735 - DNA, 18 bp, Artificial Sequence
  Synthetic DNA
tcatgcaactctctatcg

SEQ ID NO: 49736 - DNA, 18 bp, Artificial Sequence
  Synthetic DNA
atatactcctcactattg

SEQ ID NO: 49737 - DNA, 18 bp, Artificial Sequence
  Synthetic DNA
gagtactgctcactgtag

SEQ ID NO: 49738 - DNA, 18 bp, Artificial Sequence
  Synthetic DNA
taaaaacactcacattag

SEQ ID NO: 49739 - DNA, 18 bp, Artificial Sequence
  Synthetic DNA
ttaaacttctcattcttg

SEQ ID NO: 49740 - DNA, 18 bp, Artificial Sequence
  Synthetic DNA
aaaaaatactcactaaag

SEQ ID NO: 49741 - DNA, 18 bp, Artificial Sequence
  Synthetic DNA
aaaaacaactttcaatag

SEQ ID NO: 49742 - DNA, 18 bp, Artificial Sequence
  Synthetic DNA
aaaaacatcttactatag

SEQ ID NO: 49743 - DNA, 18 bp, Artificial Sequence
  Synthetic DNA
aaaaacgatacgctatag

SEQ ID NO: 49744 - DNA, 18 bp, Artificial Sequence
  Synthetic DNA
aaaaactactcactttgg

SEQ ID NO: 49745 - DNA, 18 bp, Artificial Sequence
  Synthetic DNA
aaaactgtcttgttatag

SEQ ID NO: 49746 - DNA, 18 bp, Artificial Sequence
  Synthetic DNA
aaacacggctcataaaag

SEQ ID NO: 49747 - DNA, 18 bp, Artificial Sequence
  Synthetic DNA
aaatacaacctataacag

SEQ ID NO: 49748 - DNA, 18 bp, Artificial Sequence
  Synthetic DNA
aaatacaactcagatttg

SEQ ID NO: 49749 - DNA, 18 bp, Artificial Sequence
  Synthetic DNA
aaatacgcaacgctatag

SEQ ID NO: 49750 - DNA, 18 bp, Artificial Sequence
  Synthetic DNA
aaatacggcactctttag

SEQ ID NO: 49751 - DNA, 18 bp, Artificial Sequence
  Synthetic DNA
aaatacgtcactctattg

SEQ ID NO: 49752 - DNA, 18 bp, Artificial Sequence
  Synthetic DNA
aaatacttcccacaatag

SEQ ID NO: 49753 - DNA, 18 bp, Artificial Sequence
  Synthetic DNA
aaattagtctcaatattg

SEQ ID NO: 49754 - DNA, 18 bp, Artificial Sequence
  Synthetic DNA
aaattcatctgactatag

SEQ ID NO: 49755 - DNA, 18 bp, Artificial Sequence
  Synthetic DNA
aaatttgtctcactattg

SEQ ID NO: 49756 - DNA, 18 bp, Artificial Sequence
  Synthetic DNA
aactacgactcacccttg

SEQ ID NO: 49757 - DNA, 18 bp, Artificial Sequence
  Synthetic DNA
aactacgatgcactaaag

SEQ ID NO: 49758 - DNA, 18 bp, Artificial Sequence
  Synthetic DNA
aactacgattgactacag

SEQ ID NO: 49759 - DNA, 18 bp, Artificial Sequence
  Synthetic DNA
aagatcgcctcactttag

SEQ ID NO: 49760 - DNA, 18 bp, Artificial Sequence
  Synthetic DNA
aaggacgactcaataaag

SEQ ID NO: 49761 - DNA, 18 bp, Artificial Sequence
  Synthetic DNA
aagtacgacactctaaag

SEQ ID NO: 49762 - DNA, 18 bp, Artificial Sequence
  Synthetic DNA
aagtactaatcactctag

SEQ ID NO: 49763 - DNA, 18 bp, Artificial Sequence
  Synthetic DNA
aatacttacccactatag

SEQ ID NO: 49764 - DNA, 18 bp, Artificial Sequence
  Synthetic DNA
aattacgattctctctag

SEQ ID NO: 49765 - DNA, 18 bp, Artificial Sequence
  Synthetic DNA
acacttaacgcactatag

SEQ ID NO: 49766 - DNA, 18 bp, Artificial Sequence
  Synthetic DNA
acatactaccctctaaag

SEQ ID NO: 49767 - DNA, 18 bp, Artificial Sequence
  Synthetic DNA
acatgcgaaatcctatag

SEQ ID NO: 49768 - DNA, 18 bp, Artificial Sequence
  Synthetic DNA
accaagaactcactatgg

SEQ ID NO: 49769 - DNA, 18 bp, Artificial Sequence
  Synthetic DNA
acctacgactctttattg

SEQ ID NO: 49770 - DNA, 18 bp, Artificial Sequence
  Synthetic DNA
acgtacgcctcactttag

SEQ ID NO: 49771 - DNA, 18 bp, Artificial Sequence
  Synthetic DNA
aggaccgacgaacttttg

SEQ ID NO: 49772 - DNA, 18 bp, Artificial Sequence
  Synthetic DNA
agttacggctcagtagag

SEQ ID NO: 49773 - DNA, 18 bp, Artificial Sequence
  Synthetic DNA
atacgcgactctcaatag

SEQ ID NO: 49774 - DNA, 18 bp, Artificial Sequence
  Synthetic DNA
atatacaaatcagtttag

SEQ ID NO: 49775 - DNA, 18 bp, Artificial Sequence
  Synthetic DNA
atatccaactagctctag

SEQ ID NO: 49776 - DNA, 18 bp, Artificial Sequence
  Synthetic DNA
atatgagactaagtttag

SEQ ID NO: 49777 - DNA, 18 bp, Artificial Sequence
  Synthetic DNA
atattctacccactcatg

SEQ ID NO: 49778 - DNA, 18 bp, Artificial Sequence
  Synthetic DNA
atccacgtttctctatag

SEQ ID NO: 49779 - DNA, 18 bp, Artificial Sequence
  Synthetic DNA
atgtaagactcactaaag

SEQ ID NO: 49780 - DNA, 18 bp, Artificial Sequence
  Synthetic DNA
caaaaacacattctatag

SEQ ID NO: 49781 - DNA, 18 bp, Artificial Sequence
  Synthetic DNA
caatacgagtcaaaattg

SEQ ID NO: 49782 - DNA, 18 bp, Artificial Sequence
  Synthetic DNA
caatacgagtctcaagtg

SEQ ID NO: 49783 - DNA, 18 bp, Artificial Sequence
  Synthetic DNA
caatacgatagactttag

SEQ ID NO: 49784 - DNA, 18 bp, Artificial Sequence
  Synthetic DNA
caatactactcattaacg

SEQ ID NO: 49785 - DNA, 18 bp, Artificial Sequence
  Synthetic DNA
caataggaaacacaatag

SEQ ID NO: 49786 - DNA, 18 bp, Artificial Sequence
  Synthetic DNA
caatatgactcataacgg

SEQ ID NO: 49787 - DNA, 18 bp, Artificial Sequence
  Synthetic DNA
caatcctactcaattccg

SEQ ID NO: 49788 - DNA, 18 bp, Artificial Sequence
  Synthetic DNA
caattcgtctctctatcg

SEQ ID NO: 49789 - DNA, 18 bp, Artificial Sequence
  Synthetic DNA
cagttgaagtcactatgg

SEQ ID NO: 49790 - DNA, 18 bp, Artificial Sequence
  Synthetic DNA
catatcgtctcactatag

SEQ ID NO: 49791 - DNA, 18 bp, Artificial Sequence
  Synthetic DNA
catcccgattcaccatag

SEQ ID NO: 49792 - DNA, 18 bp, Artificial Sequence
  Synthetic DNA
ctatacgaatcacataag

SEQ ID NO: 49793 - DNA, 18 bp, Artificial Sequence
  Synthetic DNA
ctatacgactatctttag

SEQ ID NO: 49794 - DNA, 18 bp, Artificial Sequence
  Synthetic DNA
ctatacgactcgttttag

SEQ ID NO: 49795 - DNA, 18 bp, Artificial Sequence
  Synthetic DNA
gattacgtgtttcattag

SEQ ID NO: 49796 - DNA, 18 bp, Artificial Sequence
  Synthetic DNA
gtaatctactagctatag

SEQ ID NO: 49797 - DNA, 18 bp, Artificial Sequence
  Synthetic DNA
gtatacgactcagattag

SEQ ID NO: 49798 - DNA, 18 bp, Artificial Sequence
  Synthetic DNA
taaaaagtttatcaaaag

SEQ ID NO: 49799 - DNA, 18 bp, Artificial Sequence
  Synthetic DNA
taaaacaacttactgcag

SEQ ID NO: 49800 - DNA, 18 bp, Artificial Sequence
  Synthetic DNA
taaaacctctcccgagtg

SEQ ID NO: 49801 - DNA, 18 bp, Artificial Sequence
  Synthetic DNA
taaaacgagccaatcttg

SEQ ID NO: 49802 - DNA, 18 bp, Artificial Sequence
  Synthetic DNA
taaaaggaattactgtag

SEQ ID NO: 49803 - DNA, 18 bp, Artificial Sequence
  Synthetic DNA
taaaatgtctcactttcg

SEQ ID NO: 49804 - DNA, 18 bp, Artificial Sequence
  Synthetic DNA
taaaattactccgtttag

SEQ ID NO: 49805 - DNA, 18 bp, Artificial Sequence
  Synthetic DNA
taaacagacaccctacag

SEQ ID NO: 49806 - DNA, 18 bp, Artificial Sequence
  Synthetic DNA
taaactgactcactaatg

SEQ ID NO: 49807 - DNA, 18 bp, Artificial Sequence
  Synthetic DNA
taaagcctcacactaaag

SEQ ID NO: 49808 - DNA, 18 bp, Artificial Sequence
  Synthetic DNA
taaagcgcatagctatag

SEQ ID NO: 49809 - DNA, 18 bp, Artificial Sequence
  Synthetic DNA
taaataaactcacctatg

SEQ ID NO: 49810 - DNA, 18 bp, Artificial Sequence
  Synthetic DNA
taacacgattccttattg

SEQ ID NO: 49811 - DNA, 18 bp, Artificial Sequence
  Synthetic DNA
taacccgacacaccattg

SEQ ID NO: 49812 - DNA, 18 bp, Artificial Sequence
  Synthetic DNA
taactcgtctcacttgag

SEQ ID NO: 49813 - DNA, 18 bp, Artificial Sequence
  Synthetic DNA
taagaaaactcactagtg

SEQ ID NO: 49814 - DNA, 18 bp, Artificial Sequence
  Synthetic DNA
taagaagactcacttatg

SEQ ID NO: 49815 - DNA, 18 bp, Artificial Sequence
  Synthetic DNA
taagaatactcacctaag

SEQ ID NO: 49816 - DNA, 18 bp, Artificial Sequence
  Synthetic DNA
taagacgccgctttatag

SEQ ID NO: 49817 - DNA, 18 bp, Artificial Sequence
  Synthetic DNA
taagacttcaatcaagag

SEQ ID NO: 49818 - DNA, 18 bp, Artificial Sequence
  Synthetic DNA
taaggctactcactaatg

SEQ ID NO: 49819 - DNA, 18 bp, Artificial Sequence
  Synthetic DNA
taataagtatcagtagag

SEQ ID NO: 49820 - DNA, 18 bp, Artificial Sequence
  Synthetic DNA
taatacaacgttcaatag

SEQ ID NO: 49821 - DNA, 18 bp, Artificial Sequence
  Synthetic DNA
taatacaacttagtaaaa

SEQ ID NO: 49822 - DNA, 18 bp, Artificial Sequence
  Synthetic DNA
taatacatatcacgatcg

SEQ ID NO: 49823 - DNA, 18 bp, Artificial Sequence
  Synthetic DNA
taataccactcccaaacg

SEQ ID NO: 49824 - DNA, 18 bp, Artificial Sequence
  Synthetic DNA
taatacgaataacatttg

SEQ ID NO: 49825 - DNA, 18 bp, Artificial Sequence
  Synthetic DNA
taatacgaataccttttg

SEQ ID NO: 49826 - DNA, 18 bp, Artificial Sequence
  Synthetic DNA
taatacgcctgtccatgg

SEQ ID NO: 49827 - DNA, 18 bp, Artificial Sequence
  Synthetic DNA
taatacgtcagacagtag

SEQ ID NO: 49828 - DNA, 18 bp, Artificial Sequence
  Synthetic DNA
taatacgtctcttattag

SEQ ID NO: 49829 - DNA, 18 bp, Artificial Sequence
  Synthetic DNA
taatacgttacactcaag

SEQ ID NO: 49830 - DNA, 18 bp, Artificial Sequence
  Synthetic DNA
taatacgtttcattcaag

SEQ ID NO: 49831 - DNA, 18 bp, Artificial Sequence
  Synthetic DNA
taatacttcacactttgg

SEQ ID NO: 49832 - DNA, 18 bp, Artificial Sequence
  Synthetic DNA
taatacttcactccatag

SEQ ID NO: 49833 - DNA, 18 bp, Artificial Sequence
  Synthetic DNA
taatagaactccccaaag

SEQ ID NO: 49834 - DNA, 18 bp, Artificial Sequence
  Synthetic DNA
taataggtattactaaag

SEQ ID NO: 49835 - DNA, 18 bp, Artificial Sequence
  Synthetic DNA
taataggtctctctactg

SEQ ID NO: 49836 - DNA, 18 bp, Artificial Sequence
  Synthetic DNA
taatagtgcaaactatag

SEQ ID NO: 49837 - DNA, 18 bp, Artificial Sequence
  Synthetic DNA
taatatctctctctgtag

SEQ ID NO: 49838 - DNA, 18 bp, Artificial Sequence
  Synthetic DNA
taatatgcctctcaagag

SEQ ID NO: 49839 - DNA, 18 bp, Artificial Sequence
  Synthetic DNA
taatattactcatgttag

SEQ ID NO: 49840 - DNA, 18 bp, Artificial Sequence
  Synthetic DNA
taatattactctctaatg

SEQ ID NO: 49841 - DNA, 18 bp, Artificial Sequence
  Synthetic DNA
taatcagaccaactctag

SEQ ID NO: 49842 - DNA, 18 bp, Artificial Sequence
  Synthetic DNA
taatcattttcgctatag

SEQ ID NO: 49843 - DNA, 18 bp, Artificial Sequence
  Synthetic DNA
taatccgcatcactaatg

SEQ ID NO: 49844 - DNA, 18 bp, Artificial Sequence
  Synthetic DNA
taatccggctatcttaag

SEQ ID NO: 49845 - DNA, 18 bp, Artificial Sequence
  Synthetic DNA
taatccgtgacactttag

SEQ ID NO: 49846 - DNA, 18 bp, Artificial Sequence
  Synthetic DNA
taatcctacttccctttg

SEQ ID NO: 49847 - DNA, 18 bp, Artificial Sequence
  Synthetic DNA
taatctgactctgtagag

SEQ ID NO: 49848 - DNA, 18 bp, Artificial Sequence
  Synthetic DNA
taatctgattaactttag

SEQ ID NO: 49849 - DNA, 18 bp, Artificial Sequence
  Synthetic DNA
taatgagaatgacaatag

SEQ ID NO: 49850 - DNA, 18 bp, Artificial Sequence
  Synthetic DNA
taatgcgactcattcatg

SEQ ID NO: 49851 - DNA, 18 bp, Artificial Sequence
  Synthetic DNA
taatgcgatttactaatg

SEQ ID NO: 49852 - DNA, 18 bp, Artificial Sequence
  Synthetic DNA
taatgctactatctatcg

SEQ ID NO: 49853 - DNA, 18 bp, Artificial Sequence
  Synthetic DNA
taatgggaatcgctggag

SEQ ID NO: 49854 - DNA, 18 bp, Artificial Sequence
  Synthetic DNA
taatgtaattcactacag

SEQ ID NO: 49855 - DNA, 18 bp, Artificial Sequence
  Synthetic DNA
taattacaatcactatgg

SEQ ID NO: 49856 - DNA, 18 bp, Artificial Sequence
  Synthetic DNA
taattagactcatactag

SEQ ID NO: 49857 - DNA, 18 bp, Artificial Sequence
  Synthetic DNA
taattcgactatttaacg

SEQ ID NO: 49858 - DNA, 18 bp, Artificial Sequence
  Synthetic DNA
taattcgactctatcgag

SEQ ID NO: 49859 - DNA, 18 bp, Artificial Sequence
  Synthetic DNA
taattcgtctctttattg

SEQ ID NO: 49860 - DNA, 18 bp, Artificial Sequence
  Synthetic DNA
taattctacacccaatag

SEQ ID NO: 49861 - DNA, 18 bp, Artificial Sequence
  Synthetic DNA
taattctacactttattg

SEQ ID NO: 49862 - DNA, 18 bp, Artificial Sequence
  Synthetic DNA
taattctactcgcactag

SEQ ID NO: 49863 - DNA, 18 bp, Artificial Sequence
  Synthetic DNA
taattctactttcaaaag

SEQ ID NO: 49864 - DNA, 18 bp, Artificial Sequence
  Synthetic DNA
taattttagtgattctag

SEQ ID NO: 49865 - DNA, 18 bp, Artificial Sequence
  Synthetic DNA
tacaacgacacacgattg

SEQ ID NO: 49866 - DNA, 18 bp, Artificial Sequence
  Synthetic DNA
tacaacgaccttctatag

SEQ ID NO: 49867 - DNA, 18 bp, Artificial Sequence
  Synthetic DNA
tacaacgatttactttag

SEQ ID NO: 49868 - DNA, 18 bp, Artificial Sequence
  Synthetic DNA
tacaactacacttcatag

SEQ ID NO: 49869 - DNA, 18 bp, Artificial Sequence
  Synthetic DNA
tacatcgcctcacaatag

SEQ ID NO: 49870 - DNA, 18 bp, Artificial Sequence
  Synthetic DNA
taccacaaatcaccatag

SEQ ID NO: 49871 - DNA, 18 bp, Artificial Sequence
  Synthetic DNA
tactaagactctctaacg

SEQ ID NO: 49872 - DNA, 18 bp, Artificial Sequence
  Synthetic DNA
tactacaagtttgtacag

SEQ ID NO: 49873 - DNA, 18 bp, Artificial Sequence
  Synthetic DNA
tactgtgacacactaaag

SEQ ID NO: 49874 - DNA, 18 bp, Artificial Sequence
  Synthetic DNA
tacttcgacacacaatgg

SEQ ID NO: 49875 - DNA, 18 bp, Artificial Sequence
  Synthetic DNA
tagaacgacatactatcg

SEQ ID NO: 49876 - DNA, 18 bp, Artificial Sequence
  Synthetic DNA
tagcacgaatcattatcg

SEQ ID NO: 49877 - DNA, 18 bp, Artificial Sequence
  Synthetic DNA
taggacgactatctacag

SEQ ID NO: 49878 - DNA, 18 bp, Artificial Sequence
  Synthetic DNA
tataaaaactcactctag

SEQ ID NO: 49879 - DNA, 18 bp, Artificial Sequence
  Synthetic DNA
tataacgacccacatacg

SEQ ID NO: 49880 - DNA, 18 bp, Artificial Sequence
  Synthetic DNA
tataacgtcttacaatag

SEQ ID NO: 49881 - DNA, 18 bp, Artificial Sequence
  Synthetic DNA
tataatttctcactttag

SEQ ID NO: 49882 - DNA, 18 bp, Artificial Sequence
  Synthetic DNA
tataccgattcattgtag

SEQ ID NO: 49883 - DNA, 18 bp, Artificial Sequence
  Synthetic DNA
tatcgcaattcactttag

SEQ ID NO: 49884 - DNA, 18 bp, Artificial Sequence
  Synthetic DNA
tatctccactcacaatag

SEQ ID NO: 49885 - DNA, 18 bp, Artificial Sequence
  Synthetic DNA
tatctccagtcataatag

SEQ ID NO: 49886 - DNA, 18 bp, Artificial Sequence
  Synthetic DNA
tatctcgactgacgatag

SEQ ID NO: 49887 - DNA, 18 bp, Artificial Sequence
  Synthetic DNA
tattaagacacacattag

SEQ ID NO: 49888 - DNA, 18 bp, Artificial Sequence
  Synthetic DNA
tattaaggctcgctgtcg

SEQ ID NO: 49889 - DNA, 18 bp, Artificial Sequence
  Synthetic DNA
tattacatcatactttag

SEQ ID NO: 49890 - DNA, 18 bp, Artificial Sequence
  Synthetic DNA
tattacccctgactttag

SEQ ID NO: 49891 - DNA, 18 bp, Artificial Sequence
  Synthetic DNA
tattacctcgcattaaag

SEQ ID NO: 49892 - DNA, 18 bp, Artificial Sequence
  Synthetic DNA
tattacgacactttattg

SEQ ID NO: 49893 - DNA, 18 bp, Artificial Sequence
  Synthetic DNA
tattacgattaattcttg

SEQ ID NO: 49894 - DNA, 18 bp, Artificial Sequence
  Synthetic DNA
tattacgcatctctattg

SEQ ID NO: 49895 - DNA, 18 bp, Artificial Sequence
  Synthetic DNA
tattacgtctcctcatag

SEQ ID NO: 49896 - DNA, 18 bp, Artificial Sequence
  Synthetic DNA
tattagcactcgcgatag

SEQ ID NO: 49897 - DNA, 18 bp, Artificial Sequence
  Synthetic DNA
tattaggactctttttag

SEQ ID NO: 49898 - DNA, 18 bp, Artificial Sequence
  Synthetic DNA
tattaggccacactcaag

SEQ ID NO: 49899 - DNA, 18 bp, Artificial Sequence
  Synthetic DNA
tattatgacacacactag

SEQ ID NO: 49900 - DNA, 18 bp, Artificial Sequence
  Synthetic DNA
tattcggagagactatag

SEQ ID NO: 49901 - DNA, 18 bp, Artificial Sequence
  Synthetic DNA
tattgcgtgtcactaaag

SEQ ID NO: 49902 - DNA, 18 bp, Artificial Sequence
  Synthetic DNA
tattgtgactcaccaaag

SEQ ID NO: 49903 - DNA, 18 bp, Artificial Sequence
  Synthetic DNA
tatttagactcacttaag

SEQ ID NO: 49904 - DNA, 18 bp, Artificial Sequence
  Synthetic DNA
tatttcgactaatcacag

SEQ ID NO: 49905 - DNA, 18 bp, Artificial Sequence
  Synthetic DNA
tattttgactcccaatag

SEQ ID NO: 49906 - DNA, 18 bp, Artificial Sequence
  Synthetic DNA
tcaaacttttcactaaag

SEQ ID NO: 49907 - DNA, 18 bp, Artificial Sequence
  Synthetic DNA
tcaaatgtctcgataccg

SEQ ID NO: 49908 - DNA, 18 bp, Artificial Sequence
  Synthetic DNA
tcaagcgactcacataag

SEQ ID NO: 49909 - DNA, 18 bp, Artificial Sequence
  Synthetic DNA
tcacaagaatcattatgg

SEQ ID NO: 49910 - DNA, 18 bp, Artificial Sequence
  Synthetic DNA
tcacactactcagtagag

SEQ ID NO: 49911 - DNA, 18 bp, Artificial Sequence
  Synthetic DNA
tcatacaactaacaaagg

SEQ ID NO: 49912 - DNA, 18 bp, Artificial Sequence
  Synthetic DNA
tcatactactgactgttg

SEQ ID NO: 49913 - DNA, 18 bp, Artificial Sequence
  Synthetic DNA
tcatagcttccactccag

SEQ ID NO: 49914 - DNA, 18 bp, Artificial Sequence
  Synthetic DNA
tcatatgactttatatag

SEQ ID NO: 49915 - DNA, 18 bp, Artificial Sequence
  Synthetic DNA
tcatatgtcatgctatag

SEQ ID NO: 49916 - DNA, 18 bp, Artificial Sequence
  Synthetic DNA
tcatccgacggattatag

SEQ ID NO: 49917 - DNA, 18 bp, Artificial Sequence
  Synthetic DNA
tcctacaagtcaagatag

SEQ ID NO: 49918 - DNA, 18 bp, Artificial Sequence
  Synthetic DNA
tcctatgaagcctcaaag

SEQ ID NO: 49919 - DNA, 18 bp, Artificial Sequence
  Synthetic DNA
tcttgcgacacattatcg

SEQ ID NO: 49920 - DNA, 18 bp, Artificial Sequence
  Synthetic DNA
tgaaacggcccacaatag

SEQ ID NO: 49921 - DNA, 18 bp, Artificial Sequence
  Synthetic DNA
tgatacctttaaatatag

SEQ ID NO: 49922 - DNA, 18 bp, Artificial Sequence
  Synthetic DNA
tgatacgacttatttatg

SEQ ID NO: 49923 - DNA, 18 bp, Artificial Sequence
  Synthetic DNA
tgatacgattcatacttg

SEQ ID NO: 49924 - DNA, 18 bp, Artificial Sequence
  Synthetic DNA
tgatacgtcacacaattg

SEQ ID NO: 49925 - DNA, 18 bp, Artificial Sequence
  Synthetic DNA
tgataggcttcactaaag

SEQ ID NO: 49926 - DNA, 18 bp, Artificial Sequence
  Synthetic DNA
tgatgcaattctctatag

SEQ ID NO: 49927 - DNA, 18 bp, Artificial Sequence
  Synthetic DNA
tgatgccactcattaatg

SEQ ID NO: 49928 - DNA, 18 bp, Artificial Sequence
  Synthetic DNA
tgatgcgaaggtctccag

SEQ ID NO: 49929 - DNA, 18 bp, Artificial Sequence
  Synthetic DNA
tgatgtttctctctttag

SEQ ID NO: 49930 - DNA, 18 bp, Artificial Sequence
  Synthetic DNA
tgattagcctcactatcg

SEQ ID NO: 49931 - DNA, 18 bp, Artificial Sequence
  Synthetic DNA
tgattcgatgctttatcg

SEQ ID NO: 49932 - DNA, 18 bp, Artificial Sequence
  Synthetic DNA
ttaaaagactctctattg

SEQ ID NO: 49933 - DNA, 18 bp, Artificial Sequence
  Synthetic DNA
ttaaacgactcgcaattg

SEQ ID NO: 49934 - DNA, 18 bp, Artificial Sequence
  Synthetic DNA
ttaaatgactcacatttg

SEQ ID NO: 49935 - DNA, 18 bp, Artificial Sequence
  Synthetic DNA
ttaatcaactctcttttg

SEQ ID NO: 49936 - DNA, 18 bp, Artificial Sequence
  Synthetic DNA
ttaatcgactcactagtg

SEQ ID NO: 49937 - DNA, 18 bp, Artificial Sequence
  Synthetic DNA
ttaattgtaccactattg

SEQ ID NO: 49938 - DNA, 18 bp, Artificial Sequence
  Synthetic DNA
ttaattgtatcactttag

SEQ ID NO: 49939 - DNA, 18 bp, Artificial Sequence
  Synthetic DNA
ttacaaatcttaataagg

SEQ ID NO: 49940 - DNA, 18 bp, Artificial Sequence
  Synthetic DNA
ttacacgacactcgatag

SEQ ID NO: 49941 - DNA, 18 bp, Artificial Sequence
  Synthetic DNA
ttacacgagtcccaatag

SEQ ID NO: 49942 - DNA, 18 bp, Artificial Sequence
  Synthetic DNA
ttacactactcccttttg

SEQ ID NO: 49943 - DNA, 18 bp, Artificial Sequence
  Synthetic DNA
ttacactcctcactatcg

SEQ ID NO: 49944 - DNA, 18 bp, Artificial Sequence
  Synthetic DNA
ttagacgactcataattg

SEQ ID NO: 49945 - DNA, 18 bp, Artificial Sequence
  Synthetic DNA
ttagactactctctttag

SEQ ID NO: 49946 - DNA, 18 bp, Artificial Sequence
  Synthetic DNA
ttataacactcacagaag

SEQ ID NO: 49947 - DNA, 18 bp, Artificial Sequence
  Synthetic DNA
ttataagattcgcaatag

SEQ ID NO: 49948 - DNA, 18 bp, Artificial Sequence
  Synthetic DNA
ttataagattcgctacag

SEQ ID NO: 49949 - DNA, 18 bp, Artificial Sequence
  Synthetic DNA
ttataagccttaccttag

SEQ ID NO: 49950 - DNA, 18 bp, Artificial Sequence
  Synthetic DNA
ttataatacacgctactg

SEQ ID NO: 49951 - DNA, 18 bp, Artificial Sequence
  Synthetic DNA
ttataatactcactaagg

SEQ ID NO: 49952 - DNA, 18 bp, Artificial Sequence
  Synthetic DNA
ttataatattcactaaag

SEQ ID NO: 49953 - DNA, 18 bp, Artificial Sequence
  Synthetic DNA
ttatacaaataactttag

SEQ ID NO: 49954 - DNA, 18 bp, Artificial Sequence
  Synthetic DNA
ttatacatatcacaattg

SEQ ID NO: 49955 - DNA, 18 bp, Artificial Sequence
  Synthetic DNA
ttataccattctctccag

SEQ ID NO: 49956 - DNA, 18 bp, Artificial Sequence
  Synthetic DNA
ttatacctctcactaccg

SEQ ID NO: 49957 - DNA, 18 bp, Artificial Sequence
  Synthetic DNA
ttatacctgcctatatag

SEQ ID NO: 49958 - DNA, 18 bp, Artificial Sequence
  Synthetic DNA
ttatacgaccctttaaag

SEQ ID NO: 49959 - DNA, 18 bp, Artificial Sequence
  Synthetic DNA
ttatacgaccttcaaagg

SEQ ID NO: 49960 - DNA, 18 bp, Artificial Sequence
  Synthetic DNA
ttatacgactaataatgg

SEQ ID NO: 49961 - DNA, 18 bp, Artificial Sequence
  Synthetic DNA
ttatacgccttacgattg

SEQ ID NO: 49962 - DNA, 18 bp, Artificial Sequence
  Synthetic DNA
ttatactgctccatatag

SEQ ID NO: 49963 - DNA, 18 bp, Artificial Sequence
  Synthetic DNA
ttataggaataactttag

SEQ ID NO: 49964 - DNA, 18 bp, Artificial Sequence
  Synthetic DNA
ttatattatgcaccgtcg

SEQ ID NO: 49965 - DNA, 18 bp, Artificial Sequence
  Synthetic DNA
ttatcgaactcactaaag

SEQ ID NO: 49966 - DNA, 18 bp, Artificial Sequence
  Synthetic DNA
ttattccactttctattg

SEQ ID NO: 49967 - DNA, 18 bp, Artificial Sequence
  Synthetic DNA
ttattccattcttaatag

SEQ ID NO: 49968 - DNA, 18 bp, Artificial Sequence
  Synthetic DNA
ttattcgagtcactgttg

SEQ ID NO: 49969 - DNA, 18 bp, Artificial Sequence
  Synthetic DNA
ttcaacgtctcactatgg

SEQ ID NO: 49970 - DNA, 18 bp, Artificial Sequence
  Synthetic DNA
ttctaagacacacaatag

SEQ ID NO: 49971 - DNA, 18 bp, Artificial Sequence
  Synthetic DNA
ttgaaagttttacaatag

SEQ ID NO: 49972 - DNA, 18 bp, Artificial Sequence
  Synthetic DNA
ttgaacgactatctatag

SEQ ID NO: 49973 - DNA, 18 bp, Artificial Sequence
  Synthetic DNA
ttgatcgactaataatag

SEQ ID NO: 49974 - DNA, 18 bp, Artificial Sequence
  Synthetic DNA
ttggtcgtcactctatcg

SEQ ID NO: 49975 - DNA, 18 bp, Artificial Sequence
  Synthetic DNA
ttgtagagcacattttag

SEQ ID NO: 49976 - DNA, 18 bp, Artificial Sequence
  Synthetic DNA
tttaacgactcactctgg

SEQ ID NO: 49977 - DNA, 18 bp, Artificial Sequence
  Synthetic DNA
tttcccgactcttttaag

SEQ ID NO: 49978 - DNA, 18 bp, Artificial Sequence
  Synthetic DNA
ttttaagtcaggctagag

SEQ ID NO: 49979 - DNA, 18 bp, Artificial Sequence
  Synthetic DNA
ttttacgattcacgaaag

SEQ ID NO: 49980 - DNA, 18 bp, Artificial Sequence
  Synthetic DNA
ttttacttcactttatag

SEQ ID NO: 49981 - DNA, 18 bp, Artificial Sequence
  Synthetic DNA
ttttttaactcactatag

SEQ ID NO: 49982 - DNA, 18 bp, Artificial Sequence
  Synthetic DNA
aaccagcacacactatag

SEQ ID NO: 49983 - DNA, 18 bp, Artificial Sequence
  Synthetic DNA
aactacgccttacgattg

SEQ ID NO: 49984 - DNA, 18 bp, Artificial Sequence
  Synthetic DNA
agactcaagccactatag

SEQ ID NO: 49985 - DNA, 18 bp, Artificial Sequence
  Synthetic DNA
atttacgtttcactattg

SEQ ID NO: 49986 - DNA, 18 bp, Artificial Sequence
  Synthetic DNA
ctatacagatcaagatag

SEQ ID NO: 49987 - DNA, 18 bp, Artificial Sequence
  Synthetic DNA
taacacaactgcccatag

SEQ ID NO: 49988 - DNA, 18 bp, Artificial Sequence
  Synthetic DNA
taactcatctaactatag

SEQ ID NO: 49989 - DNA, 18 bp, Artificial Sequence
  Synthetic DNA
taataacactccgtaaag

SEQ ID NO: 49990 - DNA, 18 bp, Artificial Sequence
  Synthetic DNA
taatgtgacacattaaag

SEQ ID NO: 49991 - DNA, 18 bp, Artificial Sequence
  Synthetic DNA
taattcggattattatag

SEQ ID NO: 49992 - DNA, 18 bp, Artificial Sequence
  Synthetic DNA
taatttgactgattattg

SEQ ID NO: 49993 - DNA, 18 bp, Artificial Sequence
  Synthetic DNA
tacaacttctcactaaag

SEQ ID NO: 49994 - DNA, 18 bp, Artificial Sequence
  Synthetic DNA
tataacttatcactttag

SEQ ID NO: 49995 - DNA, 18 bp, Artificial Sequence
  Synthetic DNA
tatcacgacacgttatag

SEQ ID NO: 49996 - DNA, 18 bp, Artificial Sequence
  Synthetic DNA
tcacacatctcactgaag

SEQ ID NO: 49997 - DNA, 18 bp, Artificial Sequence
  Synthetic DNA
tcatacgagtctctccag

SEQ ID NO: 49998 - DNA, 18 bp, Artificial Sequence
  Synthetic DNA
tcttaccactccctagag

SEQ ID NO: 49999 - DNA, 18 bp, Artificial Sequence
  Synthetic DNA
tgattcgtctcacaatcg

SEQ ID NO: 50000 - DNA, 18 bp, Artificial Sequence
  Synthetic DNA
ttaaacgaatctctttag

SEQ ID NO: 50001 - DNA, 18 bp, Artificial Sequence
  Synthetic DNA
ttaaacgactgcccttag

SEQ ID NO: 50002 - DNA, 18 bp, Artificial Sequence
  Synthetic DNA
ttaaacgagtaactatcg

SEQ ID NO: 50003 - DNA, 18 bp, Artificial Sequence
  Synthetic DNA
ttataccactaactaatg

SEQ ID NO: 50004 - DNA, 18 bp, Artificial Sequence
  Synthetic DNA
ttatatgacacacttacg

SEQ ID NO: 50005 - DNA, 18 bp, Artificial Sequence
  Synthetic DNA
ttattcaactcacttcag

SEQ ID NO: 50006 - DNA, 18 bp, Artificial Sequence
  Synthetic DNA
ttattcggcacactattg

SEQ ID NO: 50007 - DNA, 18 bp, Artificial Sequence
  Synthetic DNA
ttgtaagacttcctatag

SEQ ID NO: 50008 - DNA, 18 bp, Artificial Sequence
  Synthetic DNA
ttttacgtctcacaattg

SEQ ID NO: 50009 - DNA, 18 bp, Artificial Sequence
  Synthetic DNA
ttatacttctctctttag

SEQ ID NO: 50010 - DNA, 18 bp, Artificial Sequence
  Synthetic DNA
ttatgcgaccaaccatag

SEQ ID NO: 50011 - DNA, 18 bp, Artificial Sequence
  Synthetic DNA
ttattcgacactccatag

SEQ ID NO: 50012 - DNA, 18 bp, Artificial Sequence
  Synthetic DNA
aatttcgtcagactatag

SEQ ID NO: 50013 - DNA, 18 bp, Artificial Sequence
  Synthetic DNA
taatacgtatcactcccg

SEQ ID NO: 50014 - DNA, 18 bp, Artificial Sequence
  Synthetic DNA
ttatgccacttacaattg

SEQ ID NO: 50015 - DNA, 18 bp, Artificial Sequence
  Synthetic DNA
aaattcgacatacaagag

SEQ ID NO: 50016 - DNA, 18 bp, Artificial Sequence
  Synthetic DNA
aaattcgactcaccactg

SEQ ID NO: 50017 - DNA, 18 bp, Artificial Sequence
  Synthetic DNA
atatacgactcattactg

SEQ ID NO: 50018 - DNA, 18 bp, Artificial Sequence
  Synthetic DNA
atgttcaattcactatag

SEQ ID NO: 50019 - DNA, 18 bp, Artificial Sequence
  Synthetic DNA
cgatacttcacattgtgg

SEQ ID NO: 50020 - DNA, 18 bp, Artificial Sequence
  Synthetic DNA
taaaccgtatcactggag

SEQ ID NO: 50021 - DNA, 18 bp, Artificial Sequence
  Synthetic DNA
taatacgatctaccctag

SEQ ID NO: 50022 - DNA, 18 bp, Artificial Sequence
  Synthetic DNA
taatcttactcacaaaag

SEQ ID NO: 50023 - DNA, 18 bp, Artificial Sequence
  Synthetic DNA
taattcgactgaatactg

SEQ ID NO: 50024 - DNA, 18 bp, Artificial Sequence
  Synthetic DNA
tatatcgactcgctaaag

SEQ ID NO: 50025 - DNA, 18 bp, Artificial Sequence
  Synthetic DNA
tatttcgactctcatttg

SEQ ID NO: 50026 - DNA, 18 bp, Artificial Sequence
  Synthetic DNA
tgatacaacgctttgtag

SEQ ID NO: 50027 - DNA, 18 bp, Artificial Sequence
  Synthetic DNA
tgatacttctaactatcg

SEQ ID NO: 50028 - DNA, 18 bp, Artificial Sequence
  Synthetic DNA
ttaaacctctcactctag

SEQ ID NO: 50029 - DNA, 18 bp, Artificial Sequence
  Synthetic DNA
ttaatggactcactattg

SEQ ID NO: 50030 - DNA, 18 bp, Artificial Sequence
  Synthetic DNA
ttataccaatcaatatcg

SEQ ID NO: 50031 - DNA, 18 bp, Artificial Sequence
  Synthetic DNA
ttatccgtcaagtcatag

SEQ ID NO: 50032 - DNA, 18 bp, Artificial Sequence
  Synthetic DNA
aaaaacgtcactcaatag

SEQ ID NO: 50033 - DNA, 18 bp, Artificial Sequence
  Synthetic DNA
aaaaatgacacacaatag

SEQ ID NO: 50034 - DNA, 18 bp, Artificial Sequence
  Synthetic DNA
aaaaccgactcattattg

SEQ ID NO: 50035 - DNA, 18 bp, Artificial Sequence
  Synthetic DNA
aaaatcgacacattatag

SEQ ID NO: 50036 - DNA, 18 bp, Artificial Sequence
  Synthetic DNA
aaagacgtctcacttgtg

SEQ ID NO: 50037 - DNA, 18 bp, Artificial Sequence
  Synthetic DNA
aaatacctattactgttg

SEQ ID NO: 50038 - DNA, 18 bp, Artificial Sequence
  Synthetic DNA
aaatactacgccctaaag

SEQ ID NO: 50039 - DNA, 18 bp, Artificial Sequence
  Synthetic DNA
aaatactacttgctattg

SEQ ID NO: 50040 - DNA, 18 bp, Artificial Sequence
  Synthetic DNA
aaatatgattcattttag

SEQ ID NO: 50041 - DNA, 18 bp, Artificial Sequence
  Synthetic DNA
aaatccaactgacataag

SEQ ID NO: 50042 - DNA, 18 bp, Artificial Sequence
  Synthetic DNA
aaatccgagtccccatag

SEQ ID NO: 50043 - DNA, 18 bp, Artificial Sequence
  Synthetic DNA
aaatctaactctttaaag

SEQ ID NO: 50044 - DNA, 18 bp, Artificial Sequence
  Synthetic DNA
aaattcatctcacaattg

SEQ ID NO: 50045 - DNA, 18 bp, Artificial Sequence
  Synthetic DNA
aactacttctcactttag

SEQ ID NO: 50046 - DNA, 18 bp, Artificial Sequence
  Synthetic DNA
aagaaagactcactgtag

SEQ ID NO: 50047 - DNA, 18 bp, Artificial Sequence
  Synthetic DNA
aagtatacctcccgttag

SEQ ID NO: 50048 - DNA, 18 bp, Artificial Sequence
  Synthetic DNA
aatagcaactctctacag

SEQ ID NO: 50049 - DNA, 18 bp, Artificial Sequence
  Synthetic DNA
aatcaccgctcattattg

SEQ ID NO: 50050 - DNA, 18 bp, Artificial Sequence
  Synthetic DNA
aatctcgcctctctttag

SEQ ID NO: 50051 - DNA, 18 bp, Artificial Sequence
  Synthetic DNA
aattaagactatgtatag

SEQ ID NO: 50052 - DNA, 18 bp, Artificial Sequence
  Synthetic DNA
aattacgtgttactatag

SEQ ID NO: 50053 - DNA, 18 bp, Artificial Sequence
  Synthetic DNA
aattacttctcactattg

SEQ ID NO: 50054 - DNA, 18 bp, Artificial Sequence
  Synthetic DNA
aattgcaactcactttag

SEQ ID NO: 50055 - DNA, 18 bp, Artificial Sequence
  Synthetic DNA
aattgcgtcttacttgag

SEQ ID NO: 50056 - DNA, 18 bp, Artificial Sequence
  Synthetic DNA
aatttcgtcttactgtag

SEQ ID NO: 50057 - DNA, 18 bp, Artificial Sequence
  Synthetic DNA
acatttgactcactattg

SEQ ID NO: 50058 - DNA, 18 bp, Artificial Sequence
  Synthetic DNA
agctacaactcacattag

SEQ ID NO: 50059 - DNA, 18 bp, Artificial Sequence
  Synthetic DNA
agctacgctttactacag

SEQ ID NO: 50060 - DNA, 18 bp, Artificial Sequence
  Synthetic DNA
ataaacaacttaaaatag

SEQ ID NO: 50061 - DNA, 18 bp, Artificial Sequence
  Synthetic DNA
ataaacgatttactagag

SEQ ID NO: 50062 - DNA, 18 bp, Artificial Sequence
  Synthetic DNA
ataaagatgtcacaaacg

SEQ ID NO: 50063 - DNA, 18 bp, Artificial Sequence
  Synthetic DNA
atacacgacgtagtatcg

SEQ ID NO: 50064 - DNA, 18 bp, Artificial Sequence
  Synthetic DNA
atacactattcacaatag

SEQ ID NO: 50065 - DNA, 18 bp, Artificial Sequence
  Synthetic DNA
atataagactcatttatg

SEQ ID NO: 50066 - DNA, 18 bp, Artificial Sequence
  Synthetic DNA
atatacaaattactatag

SEQ ID NO: 50067 - DNA, 18 bp, Artificial Sequence
  Synthetic DNA
atatacgactgtcaatag

SEQ ID NO: 50068 - DNA, 18 bp, Artificial Sequence
  Synthetic DNA
atcaacgtctcactattg

SEQ ID NO: 50069 - DNA, 18 bp, Artificial Sequence
  Synthetic DNA
attgtcttctctctaaag

SEQ ID NO: 50070 - DNA, 18 bp, Artificial Sequence
  Synthetic DNA
caaaccgttcaactgctg

SEQ ID NO: 50071 - DNA, 18 bp, Artificial Sequence
  Synthetic DNA
caatacgacttaactaag

SEQ ID NO: 50072 - DNA, 18 bp, Artificial Sequence
  Synthetic DNA
caatacgcctttgtaaag

SEQ ID NO: 50073 - DNA, 18 bp, Artificial Sequence
  Synthetic DNA
caatacgttgcactttgg

SEQ ID NO: 50074 - DNA, 18 bp, Artificial Sequence
  Synthetic DNA
caatcagactctcaatag

SEQ ID NO: 50075 - DNA, 18 bp, Artificial Sequence
  Synthetic DNA
cacttcgactctttatag

SEQ ID NO: 50076 - DNA, 18 bp, Artificial Sequence
  Synthetic DNA
ccattcgacactcaagtg

SEQ ID NO: 50077 - DNA, 18 bp, Artificial Sequence
  Synthetic DNA
cgataccacactttttag

SEQ ID NO: 50078 - DNA, 18 bp, Artificial Sequence
  Synthetic DNA
ctacacgcttcgaatttg

SEQ ID NO: 50079 - DNA, 18 bp, Artificial Sequence
  Synthetic DNA
ctcttcgcctaactttag

SEQ ID NO: 50080 - DNA, 18 bp, Artificial Sequence
  Synthetic DNA
ctttacaactcaaattag

SEQ ID NO: 50081 - DNA, 18 bp, Artificial Sequence
  Synthetic DNA
gaataccattcacttttg

SEQ ID NO: 50082 - DNA, 18 bp, Artificial Sequence
  Synthetic DNA
gaatacttcacactaaag

SEQ ID NO: 50083 - DNA, 18 bp, Artificial Sequence
  Synthetic DNA
gaatataactcactaatg

SEQ ID NO: 50084 - DNA, 18 bp, Artificial Sequence
  Synthetic DNA
gaattcgaattaccatag

SEQ ID NO: 50085 - DNA, 18 bp, Artificial Sequence
  Synthetic DNA
gcatacggctaacaaacg

SEQ ID NO: 50086 - DNA, 18 bp, Artificial Sequence
  Synthetic DNA
gtatcagactcacattag

SEQ ID NO: 50087 - DNA, 18 bp, Artificial Sequence
  Synthetic DNA
taaaaaaactcacaattg

SEQ ID NO: 50088 - DNA, 18 bp, Artificial Sequence
  Synthetic DNA
taaaacaactttcctcag

SEQ ID NO: 50089 - DNA, 18 bp, Artificial Sequence
  Synthetic DNA
taaaacagctcacttatg

SEQ ID NO: 50090 - DNA, 18 bp, Artificial Sequence
  Synthetic DNA
taaaacgacacatttttg

SEQ ID NO: 50091 - DNA, 18 bp, Artificial Sequence
  Synthetic DNA
taaaaggtcacgctatag

SEQ ID NO: 50092 - DNA, 18 bp, Artificial Sequence
  Synthetic DNA
taaaccaaatatctgtag

SEQ ID NO: 50093 - DNA, 18 bp, Artificial Sequence
  Synthetic DNA
taaaccaacacactattg

SEQ ID NO: 50094 - DNA, 18 bp, Artificial Sequence
  Synthetic DNA
taaagcgtatctcaaaag

SEQ ID NO: 50095 - DNA, 18 bp, Artificial Sequence
  Synthetic DNA
taaagtgtgtcaatttag

SEQ ID NO: 50096 - DNA, 18 bp, Artificial Sequence
  Synthetic DNA
taacaagactaaccaaag

SEQ ID NO: 50097 - DNA, 18 bp, Artificial Sequence
  Synthetic DNA
taactcaatccaatatag

SEQ ID NO: 50098 - DNA, 18 bp, Artificial Sequence
  Synthetic DNA
taagctggctcacactag

SEQ ID NO: 50099 - DNA, 18 bp, Artificial Sequence
  Synthetic DNA
taataactctcaataaag

SEQ ID NO: 50100 - DNA, 18 bp, Artificial Sequence
  Synthetic DNA
taataagacttacttgtg

SEQ ID NO: 50101 - DNA, 18 bp, Artificial Sequence
  Synthetic DNA
taataagtttcacaatcg

SEQ ID NO: 50102 - DNA, 18 bp, Artificial Sequence
  Synthetic DNA
taataatactcgttttag

SEQ ID NO: 50103 - DNA, 18 bp, Artificial Sequence
  Synthetic DNA
taatacaacacacgtaag

SEQ ID NO: 50104 - DNA, 18 bp, Artificial Sequence
  Synthetic DNA
taatacaactctatttcg

SEQ ID NO: 50105 - DNA, 18 bp, Artificial Sequence
  Synthetic DNA
taatacaagacacttgag

SEQ ID NO: 50106 - DNA, 18 bp, Artificial Sequence
  Synthetic DNA
taatacattgctctatag

SEQ ID NO: 50107 - DNA, 18 bp, Artificial Sequence
  Synthetic DNA
taatacatttctttatag

SEQ ID NO: 50108 - DNA, 18 bp, Artificial Sequence
  Synthetic DNA
taataccaatcacttatg

SEQ ID NO: 50109 - DNA, 18 bp, Artificial Sequence
  Synthetic DNA
taataccacacaaaaaag

SEQ ID NO: 50110 - DNA, 18 bp, Artificial Sequence
  Synthetic DNA
taatacccttaactagag

SEQ ID NO: 50111 - DNA, 18 bp, Artificial Sequence
  Synthetic DNA
taataccgcacacttttg

SEQ ID NO: 50112 - DNA, 18 bp, Artificial Sequence
  Synthetic DNA
taataccgctttcatttg

SEQ ID NO: 50113 - DNA, 18 bp, Artificial Sequence
  Synthetic DNA
taatacgagtttgtgaag

SEQ ID NO: 50114 - DNA, 18 bp, Artificial Sequence
  Synthetic DNA
taatacgcgtcaaaattg

SEQ ID NO: 50115 - DNA, 18 bp, Artificial Sequence
  Synthetic DNA
taatacggctgagtaatg

SEQ ID NO: 50116 - DNA, 18 bp, Artificial Sequence
  Synthetic DNA
taatacgtatcgcttaag

SEQ ID NO: 50117 - DNA, 18 bp, Artificial Sequence
  Synthetic DNA
taatacgtttctcagcag

SEQ ID NO: 50118 - DNA, 18 bp, Artificial Sequence
  Synthetic DNA
taatactacagtctttag

SEQ ID NO: 50119 - DNA, 18 bp, Artificial Sequence
  Synthetic DNA
taatactatgagctatag

SEQ ID NO: 50120 - DNA, 18 bp, Artificial Sequence
  Synthetic DNA
taatactcctcacttctg

SEQ ID NO: 50121 - DNA, 18 bp, Artificial Sequence
  Synthetic DNA
taataggtgtctctttag

SEQ ID NO: 50122 - DNA, 18 bp, Artificial Sequence
  Synthetic DNA
taatatcacttatagtag

SEQ ID NO: 50123 - DNA, 18 bp, Artificial Sequence
  Synthetic DNA
taatatgaacgacaattg

SEQ ID NO: 50124 - DNA, 18 bp, Artificial Sequence
  Synthetic DNA
taatatgacttacgcttg

SEQ ID NO: 50125 - DNA, 18 bp, Artificial Sequence
  Synthetic DNA
taatcagccacagtatag

SEQ ID NO: 50126 - DNA, 18 bp, Artificial Sequence
  Synthetic DNA
taatccgactctttaatg

SEQ ID NO: 50127 - DNA, 18 bp, Artificial Sequence
  Synthetic DNA
taatccttctcttttcag

SEQ ID NO: 50128 - DNA, 18 bp, Artificial Sequence
  Synthetic DNA
taatgccacttccattag

SEQ ID NO: 50129 - DNA, 18 bp, Artificial Sequence
  Synthetic DNA
taattagtcagactactg

SEQ ID NO: 50130 - DNA, 18 bp, Artificial Sequence
  Synthetic DNA
taattcctctcattaaag

SEQ ID NO: 50131 - DNA, 18 bp, Artificial Sequence
  Synthetic DNA
taattcgaataactaatg

SEQ ID NO: 50132 - DNA, 18 bp, Artificial Sequence
  Synthetic DNA
taattcgttaaattatag

SEQ ID NO: 50133 - DNA, 18 bp, Artificial Sequence
  Synthetic DNA
taattctaatcacaaaag

SEQ ID NO: 50134 - DNA, 18 bp, Artificial Sequence
  Synthetic DNA
taattctaattactttag

SEQ ID NO: 50135 - DNA, 18 bp, Artificial Sequence
  Synthetic DNA
taattctacactctacag

SEQ ID NO: 50136 - DNA, 18 bp, Artificial Sequence
  Synthetic DNA
taattttacttacaagag

SEQ ID NO: 50137 - DNA, 18 bp, Artificial Sequence
  Synthetic DNA
tacaacgactcagtcagg

SEQ ID NO: 50138 - DNA, 18 bp, Artificial Sequence
  Synthetic DNA
tacaacgatagactttag

SEQ ID NO: 50139 - DNA, 18 bp, Artificial Sequence
  Synthetic DNA
tacaacgtctctcgatag

SEQ ID NO: 50140 - DNA, 18 bp, Artificial Sequence
  Synthetic DNA
tactacgaccgactcttg

SEQ ID NO: 50141 - DNA, 18 bp, Artificial Sequence
  Synthetic DNA
tactacgactatctttcg

SEQ ID NO: 50142 - DNA, 18 bp, Artificial Sequence
  Synthetic DNA
tactatcagtcagagttg

SEQ ID NO: 50143 - DNA, 18 bp, Artificial Sequence
  Synthetic DNA
tactctgatacaccatag

SEQ ID NO: 50144 - DNA, 18 bp, Artificial Sequence
  Synthetic DNA
tacttcgaaccattatag

SEQ ID NO: 50145 - DNA, 18 bp, Artificial Sequence
  Synthetic DNA
tacttcttatcactactg

SEQ ID NO: 50146 - DNA, 18 bp, Artificial Sequence
  Synthetic DNA
tacttttcctaacgagag

SEQ ID NO: 50147 - DNA, 18 bp, Artificial Sequence
  Synthetic DNA
taggtcgtatcacgctag

SEQ ID NO: 50148 - DNA, 18 bp, Artificial Sequence
  Synthetic DNA
tagtaccactgacaaaag

SEQ ID NO: 50149 - DNA, 18 bp, Artificial Sequence
  Synthetic DNA
tagtacgatataatatag

SEQ ID NO: 50150 - DNA, 18 bp, Artificial Sequence
  Synthetic DNA
tagtacggctaacttttg

SEQ ID NO: 50151 - DNA, 18 bp, Artificial Sequence
  Synthetic DNA
tagttcaacaccttattg

SEQ ID NO: 50152 - DNA, 18 bp, Artificial Sequence
  Synthetic DNA
tagttcgactcttttttg

SEQ ID NO: 50153 - DNA, 18 bp, Artificial Sequence
  Synthetic DNA
tataaaggctcagtatag

SEQ ID NO: 50154 - DNA, 18 bp, Artificial Sequence
  Synthetic DNA
tataaccaccctctatag

SEQ ID NO: 50155 - DNA, 18 bp, Artificial Sequence
  Synthetic DNA
tataacgactaacaaatg

SEQ ID NO: 50156 - DNA, 18 bp, Artificial Sequence
  Synthetic DNA
tataacgataaccaatag

SEQ ID NO: 50157 - DNA, 18 bp, Artificial Sequence
  Synthetic DNA
tataactactcgcaatag

SEQ ID NO: 50158 - DNA, 18 bp, Artificial Sequence
  Synthetic DNA
tatacctactctccaccg

SEQ ID NO: 50159 - DNA, 18 bp, Artificial Sequence
  Synthetic DNA
tatcacgacttactctgg

SEQ ID NO: 50160 - DNA, 18 bp, Artificial Sequence
  Synthetic DNA
tatcacgtccctctatcg

SEQ ID NO: 50161 - DNA, 18 bp, Artificial Sequence
  Synthetic DNA
tattaagaatcactcttg

SEQ ID NO: 50162 - DNA, 18 bp, Artificial Sequence
  Synthetic DNA
tattaatacctacccttg

SEQ ID NO: 50163 - DNA, 18 bp, Artificial Sequence
  Synthetic DNA
tattaccttacacaaatg

SEQ ID NO: 50164 - DNA, 18 bp, Artificial Sequence
  Synthetic DNA
tattacgatatattatag

SEQ ID NO: 50165 - DNA, 18 bp, Artificial Sequence
  Synthetic DNA
tattacgattgactctcg

SEQ ID NO: 50166 - DNA, 18 bp, Artificial Sequence
  Synthetic DNA
tattatgattctttatag

SEQ ID NO: 50167 - DNA, 18 bp, Artificial Sequence
  Synthetic DNA
tattcactctcacttcag

SEQ ID NO: 50168 - DNA, 18 bp, Artificial Sequence
  Synthetic DNA
tattcagatttacgatag

SEQ ID NO: 50169 - DNA, 18 bp, Artificial Sequence
  Synthetic DNA
tattccgtctctccatag

SEQ ID NO: 50170 - DNA, 18 bp, Artificial Sequence
  Synthetic DNA
tattgcgactcgccttag

SEQ ID NO: 50171 - DNA, 18 bp, Artificial Sequence
  Synthetic DNA
tatttagagttacaatag

SEQ ID NO: 50172 - DNA, 18 bp, Artificial Sequence
  Synthetic DNA
tatttatcctctctatag

SEQ ID NO: 50173 - DNA, 18 bp, Artificial Sequence
  Synthetic DNA
tcaaacgattcacttaag

SEQ ID NO: 50174 - DNA, 18 bp, Artificial Sequence
  Synthetic DNA
tcaagcgactcgctacag

SEQ ID NO: 50175 - DNA, 18 bp, Artificial Sequence
  Synthetic DNA
tcaccttactcgcaattg

SEQ ID NO: 50176 - DNA, 18 bp, Artificial Sequence
  Synthetic DNA
tcataccactatcaagag

SEQ ID NO: 50177 - DNA, 18 bp, Artificial Sequence
  Synthetic DNA
tcatacgacatgctttag

SEQ ID NO: 50178 - DNA, 18 bp, Artificial Sequence
  Synthetic DNA
tcataggacacgccatag

SEQ ID NO: 50179 - DNA, 18 bp, Artificial Sequence
  Synthetic DNA
tcatccgtcttactttag

SEQ ID NO: 50180 - DNA, 18 bp, Artificial Sequence
  Synthetic DNA
tcattagcatctctaaag

SEQ ID NO: 50181 - DNA, 18 bp, Artificial Sequence
  Synthetic DNA
tcatttgtctcaatatag

SEQ ID NO: 50182 - DNA, 18 bp, Artificial Sequence
  Synthetic DNA
tcctacatatcactttag

SEQ ID NO: 50183 - DNA, 18 bp, Artificial Sequence
  Synthetic DNA
tcctaccactcacattag

SEQ ID NO: 50184 - DNA, 18 bp, Artificial Sequence
  Synthetic DNA
tcgcacgacacattagag

SEQ ID NO: 50185 - DNA, 18 bp, Artificial Sequence
  Synthetic DNA
tcgcacgattgacaatag

SEQ ID NO: 50186 - DNA, 18 bp, Artificial Sequence
  Synthetic DNA
tctaactgttcactatag

SEQ ID NO: 50187 - DNA, 18 bp, Artificial Sequence
  Synthetic DNA
tcttcggactcactattg

SEQ ID NO: 50188 - DNA, 18 bp, Artificial Sequence
  Synthetic DNA
tgacaggacccattatag

SEQ ID NO: 50189 - DNA, 18 bp, Artificial Sequence
  Synthetic DNA
tgatacaattcaacatag

SEQ ID NO: 50190 - DNA, 18 bp, Artificial Sequence
  Synthetic DNA
tgattcaacttactattg

SEQ ID NO: 50191 - DNA, 18 bp, Artificial Sequence
  Synthetic DNA
tgattcgattcaatattg

SEQ ID NO: 50192 - DNA, 18 bp, Artificial Sequence
  Synthetic DNA
tgattctactccctttag

SEQ ID NO: 50193 - DNA, 18 bp, Artificial Sequence
  Synthetic DNA
tggaataaatcaataaag

SEQ ID NO: 50194 - DNA, 18 bp, Artificial Sequence
  Synthetic DNA
tgtaataactcacctttg

SEQ ID NO: 50195 - DNA, 18 bp, Artificial Sequence
  Synthetic DNA
tgttactgcccaattttg

SEQ ID NO: 50196 - DNA, 18 bp, Artificial Sequence
  Synthetic DNA
ttaaacaacttactattg

SEQ ID NO: 50197 - DNA, 18 bp, Artificial Sequence
  Synthetic DNA
ttaaaccacacagtacag

SEQ ID NO: 50198 - DNA, 18 bp, Artificial Sequence
  Synthetic DNA
ttaaaccactcacattag

SEQ ID NO: 50199 - DNA, 18 bp, Artificial Sequence
  Synthetic DNA
ttaaccaaataactttag

SEQ ID NO: 50200 - DNA, 18 bp, Artificial Sequence
  Synthetic DNA
ttaaccgacttggaattg

SEQ ID NO: 50201 - DNA, 18 bp, Artificial Sequence
  Synthetic DNA
ttatacatctaattatag

SEQ ID NO: 50202 - DNA, 18 bp, Artificial Sequence
  Synthetic DNA
ttatacctttaactttag

SEQ ID NO: 50203 - DNA, 18 bp, Artificial Sequence
  Synthetic DNA
ttatacgaatcatttacg

SEQ ID NO: 50204 - DNA, 18 bp, Artificial Sequence
  Synthetic DNA
ttatacgacaaacaatgg

SEQ ID NO: 50205 - DNA, 18 bp, Artificial Sequence
  Synthetic DNA
ttatacgacccacagcag

SEQ ID NO: 50206 - DNA, 18 bp, Artificial Sequence
  Synthetic DNA
ttatacgactccatagtg

SEQ ID NO: 50207 - DNA, 18 bp, Artificial Sequence
  Synthetic DNA
ttatacgcctcaaaattg

SEQ ID NO: 50208 - DNA, 18 bp, Artificial Sequence
  Synthetic DNA
ttatacgtcaccctatcg

SEQ ID NO: 50209 - DNA, 18 bp, Artificial Sequence
  Synthetic DNA
ttatacgtcaccctattg

SEQ ID NO: 50210 - DNA, 18 bp, Artificial Sequence
  Synthetic DNA
ttatacgtctaacttttg

SEQ ID NO: 50211 - DNA, 18 bp, Artificial Sequence
  Synthetic DNA
ttatactactctccactg

SEQ ID NO: 50212 - DNA, 18 bp, Artificial Sequence
  Synthetic DNA
ttatagtatccactatag

SEQ ID NO: 50213 - DNA, 18 bp, Artificial Sequence
  Synthetic DNA
ttatgctggacactatcg

SEQ ID NO: 50214 - DNA, 18 bp, Artificial Sequence
  Synthetic DNA
ttattagaatcactattg

SEQ ID NO: 50215 - DNA, 18 bp, Artificial Sequence
  Synthetic DNA
ttattctactcgctaaag

SEQ ID NO: 50216 - DNA, 18 bp, Artificial Sequence
  Synthetic DNA
ttattctacttactatgg

SEQ ID NO: 50217 - DNA, 18 bp, Artificial Sequence
  Synthetic DNA
ttattggacttacactag

SEQ ID NO: 50218 - DNA, 18 bp, Artificial Sequence
  Synthetic DNA
ttattgtaatcaatagtg

SEQ ID NO: 50219 - DNA, 18 bp, Artificial Sequence
  Synthetic DNA
ttgaacgtctcactctag

SEQ ID NO: 50220 - DNA, 18 bp, Artificial Sequence
  Synthetic DNA
ttgtacgcatcactacag

SEQ ID NO: 50221 - DNA, 18 bp, Artificial Sequence
  Synthetic DNA
ttgtgttcgtagctatgg

SEQ ID NO: 50222 - DNA, 18 bp, Artificial Sequence
  Synthetic DNA
tttaacgatacactatag

SEQ ID NO: 50223 - DNA, 18 bp, Artificial Sequence
  Synthetic DNA
tttatcggctcgctatag

SEQ ID NO: 50224 - DNA, 18 bp, Artificial Sequence
  Synthetic DNA
ttttacgactcgcaattg

SEQ ID NO: 50225 - DNA, 18 bp, Artificial Sequence
  Synthetic DNA
ttttacgtcactttatag

SEQ ID NO: 50226 - DNA, 18 bp, Artificial Sequence
  Synthetic DNA
ttttcggactctctattg

SEQ ID NO: 50227 - DNA, 18 bp, Artificial Sequence
  Synthetic DNA
tttttaatgtcattaaag

SEQ ID NO: 50228 - DNA, 18 bp, Artificial Sequence
  Synthetic DNA
tttttggactcactatcg

SEQ ID NO: 50229 - DNA, 18 bp, Artificial Sequence
  Synthetic DNA
aaaaaaaactcactaaag

SEQ ID NO: 50230 - DNA, 18 bp, Artificial Sequence
  Synthetic DNA
aaaaaagacaaactatgg

SEQ ID NO: 50231 - DNA, 18 bp, Artificial Sequence
  Synthetic DNA
aaaaaagacactctattg

SEQ ID NO: 50232 - DNA, 18 bp, Artificial Sequence
  Synthetic DNA
aaaaaagacttactttag

SEQ ID NO: 50233 - DNA, 18 bp, Artificial Sequence
  Synthetic DNA
aaaaaaggctcattacgg

SEQ ID NO: 50234 - DNA, 18 bp, Artificial Sequence
  Synthetic DNA
aaaaaatacgcactatag

SEQ ID NO: 50235 - DNA, 18 bp, Artificial Sequence
  Synthetic DNA
aaaaacaaatcactattg

SEQ ID NO: 50236 - DNA, 18 bp, Artificial Sequence
  Synthetic DNA
aaaaacaacaaactaaag

SEQ ID NO: 50237 - DNA, 18 bp, Artificial Sequence
  Synthetic DNA
aaaaacaactcacattcg

SEQ ID NO: 50238 - DNA, 18 bp, Artificial Sequence
  Synthetic DNA
aaaaacaattttatattg

SEQ ID NO: 50239 - DNA, 18 bp, Artificial Sequence
  Synthetic DNA
aaaaacatcacactatag

SEQ ID NO: 50240 - DNA, 18 bp, Artificial Sequence
  Synthetic DNA
aaaaaccaatcaacatgg

SEQ ID NO: 50241 - DNA, 18 bp, Artificial Sequence
  Synthetic DNA
aaaaacctctcacaattg

SEQ ID NO: 50242 - DNA, 18 bp, Artificial Sequence
  Synthetic DNA
aaaaacgacatagactgg

SEQ ID NO: 50243 - DNA, 18 bp, Artificial Sequence
  Synthetic DNA
aaaaacgacttttttgag

SEQ ID NO: 50244 - DNA, 18 bp, Artificial Sequence
  Synthetic DNA
aaaaacgagtcaatatcg

SEQ ID NO: 50245 - DNA, 18 bp, Artificial Sequence
  Synthetic DNA
aaaaacggcgcattttag

SEQ ID NO: 50246 - DNA, 18 bp, Artificial Sequence
  Synthetic DNA
aaaaacgtctcatttaag

SEQ ID NO: 50247 - DNA, 18 bp, Artificial Sequence
  Synthetic DNA
aaaaacgtgtcagttttg

SEQ ID NO: 50248 - DNA, 18 bp, Artificial Sequence
  Synthetic DNA
aaaaaggaatagttacag

SEQ ID NO: 50249 - DNA, 18 bp, Artificial Sequence
  Synthetic DNA
aaaaaggtctcacaatag

SEQ ID NO: 50250 - DNA, 18 bp, Artificial Sequence
  Synthetic DNA
aaaaaggtctcactttag

SEQ ID NO: 50251 - DNA, 18 bp, Artificial Sequence
  Synthetic DNA
aaaaatgactatttaaag

SEQ ID NO: 50252 - DNA, 18 bp, Artificial Sequence
  Synthetic DNA
aaaagcgaatcacaaagg

SEQ ID NO: 50253 - DNA, 18 bp, Artificial Sequence
  Synthetic DNA
aaaagcgtctctctatag

SEQ ID NO: 50254 - DNA, 18 bp, Artificial Sequence
  Synthetic DNA
aaaaggtgctctgaatag

SEQ ID NO: 50255 - DNA, 18 bp, Artificial Sequence
  Synthetic DNA
aaaatacactcactatag

SEQ ID NO: 50256 - DNA, 18 bp, Artificial Sequence
  Synthetic DNA
aaaatagacgaagtatgg

SEQ ID NO: 50257 - DNA, 18 bp, Artificial Sequence
  Synthetic DNA
aaaatatacacgcttaag

SEQ ID NO: 50258 - DNA, 18 bp, Artificial Sequence
  Synthetic DNA
aaaatcaactcattatag

SEQ ID NO: 50259 - DNA, 18 bp, Artificial Sequence
  Synthetic DNA
aaaatccaatcactatag

SEQ ID NO: 50260 - DNA, 18 bp, Artificial Sequence
  Synthetic DNA
aaaatcgaatttcaatag

SEQ ID NO: 50261 - DNA, 18 bp, Artificial Sequence
  Synthetic DNA
aaaatcgactcactactg

SEQ ID NO: 50262 - DNA, 18 bp, Artificial Sequence
  Synthetic DNA
aaaatcgtcacactatag

SEQ ID NO: 50263 - DNA, 18 bp, Artificial Sequence
  Synthetic DNA
aaaatctacacacttaag

SEQ ID NO: 50264 - DNA, 18 bp, Artificial Sequence
  Synthetic DNA
aaaatggactcactcaag

SEQ ID NO: 50265 - DNA, 18 bp, Artificial Sequence
  Synthetic DNA
aaaattaacccactgcgg

SEQ ID NO: 50266 - DNA, 18 bp, Artificial Sequence
  Synthetic DNA
aaacacaaactactatag

SEQ ID NO: 50267 - DNA, 18 bp, Artificial Sequence
  Synthetic DNA
aaacaccacacactagag

SEQ ID NO: 50268 - DNA, 18 bp, Artificial Sequence
  Synthetic DNA
aaacacgaaccacaatag

SEQ ID NO: 50269 - DNA, 18 bp, Artificial Sequence
  Synthetic DNA
aaacacgacacaatttag

SEQ ID NO: 50270 - DNA, 18 bp, Artificial Sequence
  Synthetic DNA
aaacacgacccactgcgg

SEQ ID NO: 50271 - DNA, 18 bp, Artificial Sequence
  Synthetic DNA
aaacacgacttcctctag

SEQ ID NO: 50272 - DNA, 18 bp, Artificial Sequence
  Synthetic DNA
aaacacgatacattatag

SEQ ID NO: 50273 - DNA, 18 bp, Artificial Sequence
  Synthetic DNA
aaacacgccacactcttg

SEQ ID NO: 50274 - DNA, 18 bp, Artificial Sequence
  Synthetic DNA
aaacacgccgccctatag

SEQ ID NO: 50275 - DNA, 18 bp, Artificial Sequence
  Synthetic DNA
aaacacgtatctctagag

SEQ ID NO: 50276 - DNA, 18 bp, Artificial Sequence
  Synthetic DNA
aaacacgtctgattagag

SEQ ID NO: 50277 - DNA, 18 bp, Artificial Sequence
  Synthetic DNA
aaacactaatctctatag

SEQ ID NO: 50278 - DNA, 18 bp, Artificial Sequence
  Synthetic DNA
aaacaggacaccatttag

SEQ ID NO: 50279 - DNA, 18 bp, Artificial Sequence
  Synthetic DNA
aaacatgactggttatcg

SEQ ID NO: 50280 - DNA, 18 bp, Artificial Sequence
  Synthetic DNA
aaactcgactaacttcag

SEQ ID NO: 50281 - DNA, 18 bp, Artificial Sequence
  Synthetic DNA
aaactcgtctcacttaag

SEQ ID NO: 50282 - DNA, 18 bp, Artificial Sequence
  Synthetic DNA
aaactcgtctcattacag

SEQ ID NO: 50283 - DNA, 18 bp, Artificial Sequence
  Synthetic DNA
aaactctacttacttctg

SEQ ID NO: 50284 - DNA, 18 bp, Artificial Sequence
  Synthetic DNA
aaagacgacacccaatag

SEQ ID NO: 50285 - DNA, 18 bp, Artificial Sequence
  Synthetic DNA
aaagacgacgctcaattg

SEQ ID NO: 50286 - DNA, 18 bp, Artificial Sequence
  Synthetic DNA
aaagacgattccctcctg

SEQ ID NO: 50287 - DNA, 18 bp, Artificial Sequence
  Synthetic DNA
aaagagaactctctatag

SEQ ID NO: 50288 - DNA, 18 bp, Artificial Sequence
  Synthetic DNA
aaagcacaaacatattgg

SEQ ID NO: 50289 - DNA, 18 bp, Artificial Sequence
  Synthetic DNA
aaagccgacttccaatag

SEQ ID NO: 50290 - DNA, 18 bp, Artificial Sequence
  Synthetic DNA
aaataaaacacgctacag

SEQ ID NO: 50291 - DNA, 18 bp, Artificial Sequence
  Synthetic DNA
aaataaaactaacaacgg

SEQ ID NO: 50292 - DNA, 18 bp, Artificial Sequence
  Synthetic DNA
aaataaaactcaatattg

SEQ ID NO: 50293 - DNA, 18 bp, Artificial Sequence
  Synthetic DNA
aaataaaactcactaatg

SEQ ID NO: 50294 - DNA, 18 bp, Artificial Sequence
  Synthetic DNA
aaataacattcaccatag

SEQ ID NO: 50295 - DNA, 18 bp, Artificial Sequence
  Synthetic DNA
aaataagaattgctatag

SEQ ID NO: 50296 - DNA, 18 bp, Artificial Sequence
  Synthetic DNA
aaataagactcaataatg

SEQ ID NO: 50297 - DNA, 18 bp, Artificial Sequence
  Synthetic DNA
aaataagactcagaacag

SEQ ID NO: 50298 - DNA, 18 bp, Artificial Sequence
  Synthetic DNA
aaataagactctcaattg

SEQ ID NO: 50299 - DNA, 18 bp, Artificial Sequence
  Synthetic DNA
aaataagatcccctattg

SEQ ID NO: 50300 - DNA, 18 bp, Artificial Sequence
  Synthetic DNA
aaataatacccacaatag

SEQ ID NO: 50301 - DNA, 18 bp, Artificial Sequence
  Synthetic DNA
aaataatactaacttaag

SEQ ID NO: 50302 - DNA, 18 bp, Artificial Sequence
  Synthetic DNA
aaatacaacacattacag

SEQ ID NO: 50303 - DNA, 18 bp, Artificial Sequence
  Synthetic DNA
aaatacaactcagatacg

SEQ ID NO: 50304 - DNA, 18 bp, Artificial Sequence
  Synthetic DNA
aaatacaactctcaaagg

SEQ ID NO: 50305 - DNA, 18 bp, Artificial Sequence
  Synthetic DNA
aaatacaagccgctgttg

SEQ ID NO: 50306 - DNA, 18 bp, Artificial Sequence
  Synthetic DNA
aaatacagcacactgttg

SEQ ID NO: 50307 - DNA, 18 bp, Artificial Sequence
  Synthetic DNA
aaatacatctcaccaagg

SEQ ID NO: 50308 - DNA, 18 bp, Artificial Sequence
  Synthetic DNA
aaataccacttaatattg

SEQ ID NO: 50309 - DNA, 18 bp, Artificial Sequence
  Synthetic DNA
aaataccataccctattg

SEQ ID NO: 50310 - DNA, 18 bp, Artificial Sequence
  Synthetic DNA
aaatacgaatcaatggag

SEQ ID NO: 50311 - DNA, 18 bp, Artificial Sequence
  Synthetic DNA
aaatacgacccacataag

SEQ ID NO: 50312 - DNA, 18 bp, Artificial Sequence
  Synthetic DNA
aaatacgactaattaatg

SEQ ID NO: 50313 - DNA, 18 bp, Artificial Sequence
  Synthetic DNA
aaatacgactaggtacag

SEQ ID NO: 50314 - DNA, 18 bp, Artificial Sequence
  Synthetic DNA
aaatacgactcccccgag

SEQ ID NO: 50315 - DNA, 18 bp, Artificial Sequence
  Synthetic DNA
aaatacgactccggatcg

SEQ ID NO: 50316 - DNA, 18 bp, Artificial Sequence
  Synthetic DNA
aaatacgacttctaatag

SEQ ID NO: 50317 - DNA, 18 bp, Artificial Sequence
  Synthetic DNA
aaatacgagacacttttg

SEQ ID NO: 50318 - DNA, 18 bp, Artificial Sequence
  Synthetic DNA
aaatacgagcctctccag

SEQ ID NO: 50319 - DNA, 18 bp, Artificial Sequence
  Synthetic DNA
aaatacgattcaccttgg

SEQ ID NO: 50320 - DNA, 18 bp, Artificial Sequence
  Synthetic DNA
aaatacgcctagctatcg

SEQ ID NO: 50321 - DNA, 18 bp, Artificial Sequence
  Synthetic DNA
aaatacgcgtacgcatag

SEQ ID NO: 50322 - DNA, 18 bp, Artificial Sequence
  Synthetic DNA
aaatacgcttgtcacatg

SEQ ID NO: 50323 - DNA, 18 bp, Artificial Sequence
  Synthetic DNA
aaatacggcaatctatag

SEQ ID NO: 50324 - DNA, 18 bp, Artificial Sequence
  Synthetic DNA
aaatacggcactttactg

SEQ ID NO: 50325 - DNA, 18 bp, Artificial Sequence
  Synthetic DNA
aaatacggctcgttaatg

SEQ ID NO: 50326 - DNA, 18 bp, Artificial Sequence
  Synthetic DNA
aaatacggctctcaatcg

SEQ ID NO: 50327 - DNA, 18 bp, Artificial Sequence
  Synthetic DNA
aaatacgggtaactgtag

SEQ ID NO: 50328 - DNA, 18 bp, Artificial Sequence
  Synthetic DNA
aaatacggtttttttttg

SEQ ID NO: 50329 - DNA, 18 bp, Artificial Sequence
  Synthetic DNA
aaatacgtctaatcttag

SEQ ID NO: 50330 - DNA, 18 bp, Artificial Sequence
  Synthetic DNA
aaatacgtctatttatag

SEQ ID NO: 50331 - DNA, 18 bp, Artificial Sequence
  Synthetic DNA
aaatacgtctcccagaag

SEQ ID NO: 50332 - DNA, 18 bp, Artificial Sequence
  Synthetic DNA
aaatacgtctgtcattag

SEQ ID NO: 50333 - DNA, 18 bp, Artificial Sequence
  Synthetic DNA
aaatacgtttcacttttg

SEQ ID NO: 50334 - DNA, 18 bp, Artificial Sequence
  Synthetic DNA
aaatactaagcactgatg

SEQ ID NO: 50335 - DNA, 18 bp, Artificial Sequence
  Synthetic DNA
aaatactaatcataatag

SEQ ID NO: 50336 - DNA, 18 bp, Artificial Sequence
  Synthetic DNA
aaatactactcaccactg

SEQ ID NO: 50337 - DNA, 18 bp, Artificial Sequence
  Synthetic DNA
aaatactactcattttcg

SEQ ID NO: 50338 - DNA, 18 bp, Artificial Sequence
  Synthetic DNA
aaatactattcactcttg

SEQ ID NO: 50339 - DNA, 18 bp, Artificial Sequence
  Synthetic DNA
aaatacttatcattccag

SEQ ID NO: 50340 - DNA, 18 bp, Artificial Sequence
  Synthetic DNA
aaatacttctcagtatcg

SEQ ID NO: 50341 - DNA, 18 bp, Artificial Sequence
  Synthetic DNA
aaatacttctctcttttg

SEQ ID NO: 50342 - DNA, 18 bp, Artificial Sequence
  Synthetic DNA
aaatacttctcttcccag

SEQ ID NO: 50343 - DNA, 18 bp, Artificial Sequence
  Synthetic DNA
aaatagccctcactttag

SEQ ID NO: 50344 - DNA, 18 bp, Artificial Sequence
  Synthetic DNA
aaataggacacgctaaag

SEQ ID NO: 50345 - DNA, 18 bp, Artificial Sequence
  Synthetic DNA
aaataggactgtccatag

SEQ ID NO: 50346 - DNA, 18 bp, Artificial Sequence
  Synthetic DNA
aaataggagtgattgtcg

SEQ ID NO: 50347 - DNA, 18 bp, Artificial Sequence
  Synthetic DNA
aaatagtcttcactaaag

SEQ ID NO: 50348 - DNA, 18 bp, Artificial Sequence
  Synthetic DNA
aaatataacacactctgg

SEQ ID NO: 50349 - DNA, 18 bp, Artificial Sequence
  Synthetic DNA
aaatatcacaaactatag

SEQ ID NO: 50350 - DNA, 18 bp, Artificial Sequence
  Synthetic DNA
aaatatctcacaatatag

SEQ ID NO: 50351 - DNA, 18 bp, Artificial Sequence
  Synthetic DNA
aaatatgaatcacaagag

SEQ ID NO: 50352 - DNA, 18 bp, Artificial Sequence
  Synthetic DNA
aaatatgacacacttttg

SEQ ID NO: 50353 - DNA, 18 bp, Artificial Sequence
  Synthetic DNA
aaatatgactatatatag

SEQ ID NO: 50354 - DNA, 18 bp, Artificial Sequence
  Synthetic DNA
aaatatgactcacttagg

SEQ ID NO: 50355 - DNA, 18 bp, Artificial Sequence
  Synthetic DNA
aaatatgtctctctgtag

SEQ ID NO: 50356 - DNA, 18 bp, Artificial Sequence
  Synthetic DNA
aaatatgtctttcaatag

SEQ ID NO: 50357 - DNA, 18 bp, Artificial Sequence
  Synthetic DNA
aaatatgtttctttattg

SEQ ID NO: 50358 - DNA, 18 bp, Artificial Sequence
  Synthetic DNA
aaatattatttactatag

SEQ ID NO: 50359 - DNA, 18 bp, Artificial Sequence
  Synthetic DNA
aaatatttaacccttaag

SEQ ID NO: 50360 - DNA, 18 bp, Artificial Sequence
  Synthetic DNA
aaatcagtcacacattag

SEQ ID NO: 50361 - DNA, 18 bp, Artificial Sequence
  Synthetic DNA
aaatccatgtcactatag

SEQ ID NO: 50362 - DNA, 18 bp, Artificial Sequence
  Synthetic DNA
aaatccctcataacatcg

SEQ ID NO: 50363 - DNA, 18 bp, Artificial Sequence
  Synthetic DNA
aaatccgaatcacaattg

SEQ ID NO: 50364 - DNA, 18 bp, Artificial Sequence
  Synthetic DNA
aaatccgcctcacactag

SEQ ID NO: 50365 - DNA, 18 bp, Artificial Sequence
  Synthetic DNA
aaatccgtcacagaacag

SEQ ID NO: 50366 - DNA, 18 bp, Artificial Sequence
  Synthetic DNA
aaatcctaataactatag

SEQ ID NO: 50367 - DNA, 18 bp, Artificial Sequence
  Synthetic DNA
aaatgcgaacgtctatag

SEQ ID NO: 50368 - DNA, 18 bp, Artificial Sequence
  Synthetic DNA
aaatgcgaatctatattg

SEQ ID NO: 50369 - DNA, 18 bp, Artificial Sequence
  Synthetic DNA
aaatgcgacactctttag

SEQ ID NO: 50370 - DNA, 18 bp, Artificial Sequence
  Synthetic DNA
aaatgcgactaacactcg

SEQ ID NO: 50371 - DNA, 18 bp, Artificial Sequence
  Synthetic DNA
aaatgcgactaattcaag

SEQ ID NO: 50372 - DNA, 18 bp, Artificial Sequence
  Synthetic DNA
aaatgcgataaactattg

SEQ ID NO: 50373 - DNA, 18 bp, Artificial Sequence
  Synthetic DNA
aaatgcgattcggtttag

SEQ ID NO: 50374 - DNA, 18 bp, Artificial Sequence
  Synthetic DNA
aaatgcgtttcacaatag

SEQ ID NO: 50375 - DNA, 18 bp, Artificial Sequence
  Synthetic DNA
aaatgcttctttctattg

SEQ ID NO: 50376 - DNA, 18 bp, Artificial Sequence
  Synthetic DNA
aaatgggactcacaattg

SEQ ID NO: 50377 - DNA, 18 bp, Artificial Sequence
  Synthetic DNA
aaatgtgacactgattag

SEQ ID NO: 50378 - DNA, 18 bp, Artificial Sequence
  Synthetic DNA
aaatgtgactcccaatag

SEQ ID NO: 50379 - DNA, 18 bp, Artificial Sequence
  Synthetic DNA
aaattagattcacattag

SEQ ID NO: 50380 - DNA, 18 bp, Artificial Sequence
  Synthetic DNA
aaattagattcattttag

SEQ ID NO: 50381 - DNA, 18 bp, Artificial Sequence
  Synthetic DNA
aaattagtctcagaatag

SEQ ID NO: 50382 - DNA, 18 bp, Artificial Sequence
  Synthetic DNA
aaattcaacacaagatag

SEQ ID NO: 50383 - DNA, 18 bp, Artificial Sequence
  Synthetic DNA
aaattcaactcaacatag

SEQ ID NO: 50384 - DNA, 18 bp, Artificial Sequence
  Synthetic DNA
aaattccactcactaatg

SEQ ID NO: 50385 - DNA, 18 bp, Artificial Sequence
  Synthetic DNA
aaattcgaaatattgtag

SEQ ID NO: 50386 - DNA, 18 bp, Artificial Sequence
  Synthetic DNA
aaattcgaataaaattag

SEQ ID NO: 50387 - DNA, 18 bp, Artificial Sequence
  Synthetic DNA
aaattcgaatcacaaggg

SEQ ID NO: 50388 - DNA, 18 bp, Artificial Sequence
  Synthetic DNA
aaattcgaatcactactg

SEQ ID NO: 50389 - DNA, 18 bp, Artificial Sequence
  Synthetic DNA
aaattcgaatgcttatag

SEQ ID NO: 50390 - DNA, 18 bp, Artificial Sequence
  Synthetic DNA
aaattcgacacacaaatg

SEQ ID NO: 50391 - DNA, 18 bp, Artificial Sequence
  Synthetic DNA
aaattcgacacattcatg

SEQ ID NO: 50392 - DNA, 18 bp, Artificial Sequence
  Synthetic DNA
aaattcgacgcaaaatag

SEQ ID NO: 50393 - DNA, 18 bp, Artificial Sequence
  Synthetic DNA
aaattcgacgcacaattg

SEQ ID NO: 50394 - DNA, 18 bp, Artificial Sequence
  Synthetic DNA
aaattcgactcaacttcg

SEQ ID NO: 50395 - DNA, 18 bp, Artificial Sequence
  Synthetic DNA
aaattcgactccatttag

SEQ ID NO: 50396 - DNA, 18 bp, Artificial Sequence
  Synthetic DNA
aaattcgactctatagag

SEQ ID NO: 50397 - DNA, 18 bp, Artificial Sequence
  Synthetic DNA
aaattcgactttctttag

SEQ ID NO: 50398 - DNA, 18 bp, Artificial Sequence
  Synthetic DNA
aaattcggttcactttag

SEQ ID NO: 50399 - DNA, 18 bp, Artificial Sequence
  Synthetic DNA
aaattcgtctcagcatag

SEQ ID NO: 50400 - DNA, 18 bp, Artificial Sequence
  Synthetic DNA
aaattcgtctcgcgaaag

SEQ ID NO: 50401 - DNA, 18 bp, Artificial Sequence
  Synthetic DNA
aaattcgtttcacaaaag

SEQ ID NO: 50402 - DNA, 18 bp, Artificial Sequence
  Synthetic DNA
aaattcgtttcattctag

SEQ ID NO: 50403 - DNA, 18 bp, Artificial Sequence
  Synthetic DNA
aaattctctccactatag

SEQ ID NO: 50404 - DNA, 18 bp, Artificial Sequence
  Synthetic DNA
aaattctgctaacaactg

SEQ ID NO: 50405 - DNA, 18 bp, Artificial Sequence
  Synthetic DNA
aaattcttcttactatag

SEQ ID NO: 50406 - DNA, 18 bp, Artificial Sequence
  Synthetic DNA
aaattggagtctctctag

SEQ ID NO: 50407 - DNA, 18 bp, Artificial Sequence
  Synthetic DNA
aaattgggtgcactattg

SEQ ID NO: 50408 - DNA, 18 bp, Artificial Sequence
  Synthetic DNA
aaatttaacacactatag

SEQ ID NO: 50409 - DNA, 18 bp, Artificial Sequence
  Synthetic DNA
aaatttcactcacttcag

SEQ ID NO: 50410 - DNA, 18 bp, Artificial Sequence
  Synthetic DNA
aaatttgacaaccaatag

SEQ ID NO: 50411 - DNA, 18 bp, Artificial Sequence
  Synthetic DNA
aaatttgaccgagtaccg

SEQ ID NO: 50412 - DNA, 18 bp, Artificial Sequence
  Synthetic DNA
aaatttgccttactgtag

SEQ ID NO: 50413 - DNA, 18 bp, Artificial Sequence
  Synthetic DNA
aaatttggccctctttag

SEQ ID NO: 50414 - DNA, 18 bp, Artificial Sequence
  Synthetic DNA
aaatttgtctctctatag

SEQ ID NO: 50415 - DNA, 18 bp, Artificial Sequence
  Synthetic DNA
aaatttttctcattatag

SEQ ID NO: 50416 - DNA, 18 bp, Artificial Sequence
  Synthetic DNA
aacaaatactaaccaaag

SEQ ID NO: 50417 - DNA, 18 bp, Artificial Sequence
  Synthetic DNA
aacaacgaatcactattg

SEQ ID NO: 50418 - DNA, 18 bp, Artificial Sequence
  Synthetic DNA
aacaacgtgactccctag

SEQ ID NO: 50419 - DNA, 18 bp, Artificial Sequence
  Synthetic DNA
aacaatgactcattttag

SEQ ID NO: 50420 - DNA, 18 bp, Artificial Sequence
  Synthetic DNA
aacacagactcaccatag

SEQ ID NO: 50421 - DNA, 18 bp, Artificial Sequence
  Synthetic DNA
aacatagatttataattg

SEQ ID NO: 50422 - DNA, 18 bp, Artificial Sequence
  Synthetic DNA
aacatccactcattattg

SEQ ID NO: 50423 - DNA, 18 bp, Artificial Sequence
  Synthetic DNA
aaccacgacccacaatag

SEQ ID NO: 50424 - DNA, 18 bp, Artificial Sequence
  Synthetic DNA
aaccactacacgatatag

SEQ ID NO: 50425 - DNA, 18 bp, Artificial Sequence
  Synthetic DNA
aacccagactttctataa

SEQ ID NO: 50426 - DNA, 18 bp, Artificial Sequence
  Synthetic DNA
aacctcgtcccaatgtag

SEQ ID NO: 50427 - DNA, 18 bp, Artificial Sequence
  Synthetic DNA
aactaagtcactctatag

SEQ ID NO: 50428 - DNA, 18 bp, Artificial Sequence
  Synthetic DNA
aactaccacacaggatag

SEQ ID NO: 50429 - DNA, 18 bp, Artificial Sequence
  Synthetic DNA
aactacgaatgccttttg

SEQ ID NO: 50430 - DNA, 18 bp, Artificial Sequence
  Synthetic DNA
aactacgactgacaaaag

SEQ ID NO: 50431 - DNA, 18 bp, Artificial Sequence
  Synthetic DNA
aactacgacttaatctag

SEQ ID NO: 50432 - DNA, 18 bp, Artificial Sequence
  Synthetic DNA
aactacgctacactatag

SEQ ID NO: 50433 - DNA, 18 bp, Artificial Sequence
  Synthetic DNA
aactacgtttctaaaccg

SEQ ID NO: 50434 - DNA, 18 bp, Artificial Sequence
  Synthetic DNA
aactaggtctttctatag

SEQ ID NO: 50435 - DNA, 18 bp, Artificial Sequence
  Synthetic DNA
aactatgtaccactatag

SEQ ID NO: 50436 - DNA, 18 bp, Artificial Sequence
  Synthetic DNA
aactccgtgtcactattg

SEQ ID NO: 50437 - DNA, 18 bp, Artificial Sequence
  Synthetic DNA
aactgccacacactatag

SEQ ID NO: 50438 - DNA, 18 bp, Artificial Sequence
  Synthetic DNA
aacttagtcccactttag

SEQ ID NO: 50439 - DNA, 18 bp, Artificial Sequence
  Synthetic DNA
aacttcaactatcattag

SEQ ID NO: 50440 - DNA, 18 bp, Artificial Sequence
  Synthetic DNA
aacttcgcctcactctag

SEQ ID NO: 50441 - DNA, 18 bp, Artificial Sequence
  Synthetic DNA
aagatcaactaactaaag

SEQ ID NO: 50442 - DNA, 18 bp, Artificial Sequence
  Synthetic DNA
aagatcgtaccactaagg

SEQ ID NO: 50443 - DNA, 18 bp, Artificial Sequence
  Synthetic DNA
aagcacgcgtcactatag

SEQ ID NO: 50444 - DNA, 18 bp, Artificial Sequence
  Synthetic DNA
aagccaaactcatcttag

SEQ ID NO: 50445 - DNA, 18 bp, Artificial Sequence
  Synthetic DNA
aaggacgtctctcttttg

SEQ ID NO: 50446 - DNA, 18 bp, Artificial Sequence
  Synthetic DNA
aagtaagacactctctag

SEQ ID NO: 50447 - DNA, 18 bp, Artificial Sequence
  Synthetic DNA
aagtacaattctcttgag

SEQ ID NO: 50448 - DNA, 18 bp, Artificial Sequence
  Synthetic DNA
aagtacgagtgccaattg

SEQ ID NO: 50449 - DNA, 18 bp, Artificial Sequence
  Synthetic DNA
aagtacgattcatctttg

SEQ ID NO: 50450 - DNA, 18 bp, Artificial Sequence
  Synthetic DNA
aagtacgcctaactattg

SEQ ID NO: 50451 - DNA, 18 bp, Artificial Sequence
  Synthetic DNA
aagtacgtctttctattg

SEQ ID NO: 50452 - DNA, 18 bp, Artificial Sequence
  Synthetic DNA
aagtaggacagatgttag

SEQ ID NO: 50453 - DNA, 18 bp, Artificial Sequence
  Synthetic DNA
aagtatatcacacgggag

SEQ ID NO: 50454 - DNA, 18 bp, Artificial Sequence
  Synthetic DNA
aagtatgacacacatcag

SEQ ID NO: 50455 - DNA, 18 bp, Artificial Sequence
  Synthetic DNA
aagtcaaactgccaattg

SEQ ID NO: 50456 - DNA, 18 bp, Artificial Sequence
  Synthetic DNA
aagtccgacatactatag

SEQ ID NO: 50457 - DNA, 18 bp, Artificial Sequence
  Synthetic DNA
aagtgcatctccctatag

SEQ ID NO: 50458 - DNA, 18 bp, Artificial Sequence
  Synthetic DNA
aagtgcgaatctctatag

SEQ ID NO: 50459 - DNA, 18 bp, Artificial Sequence
  Synthetic DNA
aagtgtgagtcagtaaag

SEQ ID NO: 50460 - DNA, 18 bp, Artificial Sequence
  Synthetic DNA
aagttattctcactatag

SEQ ID NO: 50461 - DNA, 18 bp, Artificial Sequence
  Synthetic DNA
aagttcaactctctatag

SEQ ID NO: 50462 - DNA, 18 bp, Artificial Sequence
  Synthetic DNA
aagttccgcactatctag

SEQ ID NO: 50463 - DNA, 18 bp, Artificial Sequence
  Synthetic DNA
aataacgaatttctatag

SEQ ID NO: 50464 - DNA, 18 bp, Artificial Sequence
  Synthetic DNA
aataacgattcagtatag

SEQ ID NO: 50465 - DNA, 18 bp, Artificial Sequence
  Synthetic DNA
aataaggaataaatacag

SEQ ID NO: 50466 - DNA, 18 bp, Artificial Sequence
  Synthetic DNA
aataaggatccactatag

SEQ ID NO: 50467 - DNA, 18 bp, Artificial Sequence
  Synthetic DNA
aataaggtctctgtattg

SEQ ID NO: 50468 - DNA, 18 bp, Artificial Sequence
  Synthetic DNA
aataccgactcgatatag

SEQ ID NO: 50469 - DNA, 18 bp, Artificial Sequence
  Synthetic DNA
aatagcgtgttagtatta

SEQ ID NO: 50470 - DNA, 18 bp, Artificial Sequence
  Synthetic DNA
aatatcttctctctatag

SEQ ID NO: 50471 - DNA, 18 bp, Artificial Sequence
  Synthetic DNA
aatattggctcacatgag

SEQ ID NO: 50472 - DNA, 18 bp, Artificial Sequence
  Synthetic DNA
aatcacgactgtctatag

SEQ ID NO: 50473 - DNA, 18 bp, Artificial Sequence
  Synthetic DNA
aatcaggacacacaatgg

SEQ ID NO: 50474 - DNA, 18 bp, Artificial Sequence
  Synthetic DNA
aatcgcggcactctatcg

SEQ ID NO: 50475 - DNA, 18 bp, Artificial Sequence
  Synthetic DNA
aatctcgacacactaacg

SEQ ID NO: 50476 - DNA, 18 bp, Artificial Sequence
  Synthetic DNA
aatgacaactcacttacg

SEQ ID NO: 50477 - DNA, 18 bp, Artificial Sequence
  Synthetic DNA
aatggctacacagtacag

SEQ ID NO: 50478 - DNA, 18 bp, Artificial Sequence
  Synthetic DNA
aattaagacacacagtag

SEQ ID NO: 50479 - DNA, 18 bp, Artificial Sequence
  Synthetic DNA
aattaagacccactctag

SEQ ID NO: 50480 - DNA, 18 bp, Artificial Sequence
  Synthetic DNA
aattaagcctcacatcag

SEQ ID NO: 50481 - DNA, 18 bp, Artificial Sequence
  Synthetic DNA
aattaagtcccactctag

SEQ ID NO: 50482 - DNA, 18 bp, Artificial Sequence
  Synthetic DNA
aattacaacacactatcg

SEQ ID NO: 50483 - DNA, 18 bp, Artificial Sequence
  Synthetic DNA
aattaccattcgctatag

SEQ ID NO: 50484 - DNA, 18 bp, Artificial Sequence
  Synthetic DNA
aattacctggcactattg

SEQ ID NO: 50485 - DNA, 18 bp, Artificial Sequence
  Synthetic DNA
aattacgaaacaatagag

SEQ ID NO: 50486 - DNA, 18 bp, Artificial Sequence
  Synthetic DNA
aattacgaatctcaaaag

SEQ ID NO: 50487 - DNA, 18 bp, Artificial Sequence
  Synthetic DNA
aattacgacacaccttag

SEQ ID NO: 50488 - DNA, 18 bp, Artificial Sequence
  Synthetic DNA
aattacgactatctattg

SEQ ID NO: 50489 - DNA, 18 bp, Artificial Sequence
  Synthetic DNA
aattacgactcaaatctg

SEQ ID NO: 50490 - DNA, 18 bp, Artificial Sequence
  Synthetic DNA
aattacgactccatttag

SEQ ID NO: 50491 - DNA, 18 bp, Artificial Sequence
  Synthetic DNA
aattacgactcccacttg

SEQ ID NO: 50492 - DNA, 18 bp, Artificial Sequence
  Synthetic DNA
aattacgactcgatattg

SEQ ID NO: 50493 - DNA, 18 bp, Artificial Sequence
  Synthetic DNA
aattacgactcggaatag

SEQ ID NO: 50494 - DNA, 18 bp, Artificial Sequence
  Synthetic DNA
aattacgactctctaatg

SEQ ID NO: 50495 - DNA, 18 bp, Artificial Sequence
  Synthetic DNA
aattacgacttaatattg

SEQ ID NO: 50496 - DNA, 18 bp, Artificial Sequence
  Synthetic DNA
aattacgagcatataaag

SEQ ID NO: 50497 - DNA, 18 bp, Artificial Sequence
  Synthetic DNA
aattacgagtaagcaaag

SEQ ID NO: 50498 - DNA, 18 bp, Artificial Sequence
  Synthetic DNA
aattacgatacgcaacag

SEQ ID NO: 50499 - DNA, 18 bp, Artificial Sequence
  Synthetic DNA
aattacgatccaattttg

SEQ ID NO: 50500 - DNA, 18 bp, Artificial Sequence
  Synthetic DNA
aattacgatgctctttcg

SEQ ID NO: 50501 - DNA, 18 bp, Artificial Sequence
  Synthetic DNA
aattacgattcacaatcg

SEQ ID NO: 50502 - DNA, 18 bp, Artificial Sequence
  Synthetic DNA
aattacgcattactacag

SEQ ID NO: 50503 - DNA, 18 bp, Artificial Sequence
  Synthetic DNA
aattacggctcacaatgg

SEQ ID NO: 50504 - DNA, 18 bp, Artificial Sequence
  Synthetic DNA
aattacgtaacactacaa

SEQ ID NO: 50505 - DNA, 18 bp, Artificial Sequence
  Synthetic DNA
aattacgtatcagtatag

SEQ ID NO: 50506 - DNA, 18 bp, Artificial Sequence
  Synthetic DNA
aattacgtctcacaattg

SEQ ID NO: 50507 - DNA, 18 bp, Artificial Sequence
  Synthetic DNA
aattacgtgacactatag

SEQ ID NO: 50508 - DNA, 18 bp, Artificial Sequence
  Synthetic DNA
aattacgtgttaccatag

SEQ ID NO: 50509 - DNA, 18 bp, Artificial Sequence
  Synthetic DNA
aattactagtaaattaag

SEQ ID NO: 50510 - DNA, 18 bp, Artificial Sequence
  Synthetic DNA
aattagaactcaccctag

SEQ ID NO: 50511 - DNA, 18 bp, Artificial Sequence
  Synthetic DNA
aattagaattctttttag

SEQ ID NO: 50512 - DNA, 18 bp, Artificial Sequence
  Synthetic DNA
aattaggacacagagtag

SEQ ID NO: 50513 - DNA, 18 bp, Artificial Sequence
  Synthetic DNA
aattaggactccatttag

SEQ ID NO: 50514 - DNA, 18 bp, Artificial Sequence
  Synthetic DNA
aattaggccccactttag

SEQ ID NO: 50515 - DNA, 18 bp, Artificial Sequence
  Synthetic DNA
aattaggtctcaatttag

SEQ ID NO: 50516 - DNA, 18 bp, Artificial Sequence
  Synthetic DNA
aattatgaatcactaacg

SEQ ID NO: 50517 - DNA, 18 bp, Artificial Sequence
  Synthetic DNA
aattatgaatctctaatg

SEQ ID NO: 50518 - DNA, 18 bp, Artificial Sequence
  Synthetic DNA
aattatgaccaactatgg

SEQ ID NO: 50519 - DNA, 18 bp, Artificial Sequence
  Synthetic DNA
aattatgacttagtgtag

SEQ ID NO: 50520 - DNA, 18 bp, Artificial Sequence
  Synthetic DNA
aattattgctcaccatag

SEQ ID NO: 50521 - DNA, 18 bp, Artificial Sequence
  Synthetic DNA
aattccgactcataatag

SEQ ID NO: 50522 - DNA, 18 bp, Artificial Sequence
  Synthetic DNA
aattccgccttatcatag

SEQ ID NO: 50523 - DNA, 18 bp, Artificial Sequence
  Synthetic DNA
aattcctaatgataatag

SEQ ID NO: 50524 - DNA, 18 bp, Artificial Sequence
  Synthetic DNA
aattcggactcactattg

SEQ ID NO: 50525 - DNA, 18 bp, Artificial Sequence
  Synthetic DNA
aattgcgaatcactacag

SEQ ID NO: 50526 - DNA, 18 bp, Artificial Sequence
  Synthetic DNA
aattgcgacacattttag

SEQ ID NO: 50527 - DNA, 18 bp, Artificial Sequence
  Synthetic DNA
aattgcgtctccctattg

SEQ ID NO: 50528 - DNA, 18 bp, Artificial Sequence
  Synthetic DNA
aattgctactcatcattg

SEQ ID NO: 50529 - DNA, 18 bp, Artificial Sequence
  Synthetic DNA
aatttagactcaatgtag

SEQ ID NO: 50530 - DNA, 18 bp, Artificial Sequence
  Synthetic DNA
aatttcaacacactatag

SEQ ID NO: 50531 - DNA, 18 bp, Artificial Sequence
  Synthetic DNA
aatttccaatggctttcg

SEQ ID NO: 50532 - DNA, 18 bp, Artificial Sequence
  Synthetic DNA
aatttcgaacaacataag

SEQ ID NO: 50533 - DNA, 18 bp, Artificial Sequence
  Synthetic DNA
aatttcgacccactattg

SEQ ID NO: 50534 - DNA, 18 bp, Artificial Sequence
  Synthetic DNA
aatttcgacgcactatcg

SEQ ID NO: 50535 - DNA, 18 bp, Artificial Sequence
  Synthetic DNA
aatttcgattaactaaag

SEQ ID NO: 50536 - DNA, 18 bp, Artificial Sequence
  Synthetic DNA
aatttcgattcacaatag

SEQ ID NO: 50537 - DNA, 18 bp, Artificial Sequence
  Synthetic DNA
aatttcgtctctctaaag

SEQ ID NO: 50538 - DNA, 18 bp, Artificial Sequence
  Synthetic DNA
aatttcgtctctctattg

SEQ ID NO: 50539 - DNA, 18 bp, Artificial Sequence
  Synthetic DNA
aatttctaataactgtag

SEQ ID NO: 50540 - DNA, 18 bp, Artificial Sequence
  Synthetic DNA
aatttctcctcaatatag

SEQ ID NO: 50541 - DNA, 18 bp, Artificial Sequence
  Synthetic DNA
aatttggacactattttg

SEQ ID NO: 50542 - DNA, 18 bp, Artificial Sequence
  Synthetic DNA
aattttaacaaactatag

SEQ ID NO: 50543 - DNA, 18 bp, Artificial Sequence
  Synthetic DNA
aattttgactgagtatag

SEQ ID NO: 50544 - DNA, 18 bp, Artificial Sequence
  Synthetic DNA
acaaaagattcaccatag

SEQ ID NO: 50545 - DNA, 18 bp, Artificial Sequence
  Synthetic DNA
acaaacgatttactattg

SEQ ID NO: 50546 - DNA, 18 bp, Artificial Sequence
  Synthetic DNA
acaaacgtctcgctattg

SEQ ID NO: 50547 - DNA, 18 bp, Artificial Sequence
  Synthetic DNA
acaaacgtcttactacag

SEQ ID NO: 50548 - DNA, 18 bp, Artificial Sequence
  Synthetic DNA
acaaataactcactatag

SEQ ID NO: 50549 - DNA, 18 bp, Artificial Sequence
  Synthetic DNA
acaaccgaatcactttag

SEQ ID NO: 50550 - DNA, 18 bp, Artificial Sequence
  Synthetic DNA
acaagcaaataattattg

SEQ ID NO: 50551 - DNA, 18 bp, Artificial Sequence
  Synthetic DNA
acaatcgactatctattg

SEQ ID NO: 50552 - DNA, 18 bp, Artificial Sequence
  Synthetic DNA
acaattgcctccatctag

SEQ ID NO: 50553 - DNA, 18 bp, Artificial Sequence
  Synthetic DNA
acactagactcacaatag

SEQ ID NO: 50554 - DNA, 18 bp, Artificial Sequence
  Synthetic DNA
acagacgactcaatgatg

SEQ ID NO: 50555 - DNA, 18 bp, Artificial Sequence
  Synthetic DNA
acataagactatttatag

SEQ ID NO: 50556 - DNA, 18 bp, Artificial Sequence
  Synthetic DNA
acatacaactctctattg

SEQ ID NO: 50557 - DNA, 18 bp, Artificial Sequence
  Synthetic DNA
acatacaagtcacattcg

SEQ ID NO: 50558 - DNA, 18 bp, Artificial Sequence
  Synthetic DNA
acataccactctctagag

SEQ ID NO: 50559 - DNA, 18 bp, Artificial Sequence
  Synthetic DNA
acataccgttcaccatag

SEQ ID NO: 50560 - DNA, 18 bp, Artificial Sequence
  Synthetic DNA
acatacgaataactacag

SEQ ID NO: 50561 - DNA, 18 bp, Artificial Sequence
  Synthetic DNA
acatacgacagattatag

SEQ ID NO: 50562 - DNA, 18 bp, Artificial Sequence
  Synthetic DNA
acatacgaccttctattg

SEQ ID NO: 50563 - DNA, 18 bp, Artificial Sequence
  Synthetic DNA
acatacgactctcaacag

SEQ ID NO: 50564 - DNA, 18 bp, Artificial Sequence
  Synthetic DNA
acatacgactctcgttag

SEQ ID NO: 50565 - DNA, 18 bp, Artificial Sequence
  Synthetic DNA
acatacgacttcatatag

SEQ ID NO: 50566 - DNA, 18 bp, Artificial Sequence
  Synthetic DNA
acatacgagtcacaacag

SEQ ID NO: 50567 - DNA, 18 bp, Artificial Sequence
  Synthetic DNA
acatacgagttacactag

SEQ ID NO: 50568 - DNA, 18 bp, Artificial Sequence
  Synthetic DNA
acatacgtctgaatatag

SEQ ID NO: 50569 - DNA, 18 bp, Artificial Sequence
  Synthetic DNA
acatacgtcttaccaccg

SEQ ID NO: 50570 - DNA, 18 bp, Artificial Sequence
  Synthetic DNA
acataggactccctaatg

SEQ ID NO: 50571 - DNA, 18 bp, Artificial Sequence
  Synthetic DNA
acatagtgttcacatacg

SEQ ID NO: 50572 - DNA, 18 bp, Artificial Sequence
  Synthetic DNA
acatatggaacactatag

SEQ ID NO: 50573 - DNA, 18 bp, Artificial Sequence
  Synthetic DNA
acatatgtctcactttac

SEQ ID NO: 50574 - DNA, 18 bp, Artificial Sequence
  Synthetic DNA
acatgacactctctttag

SEQ ID NO: 50575 - DNA, 18 bp, Artificial Sequence
  Synthetic DNA
acatgcgactaactctag

SEQ ID NO: 50576 - DNA, 18 bp, Artificial Sequence
  Synthetic DNA
acattaggcacacaatag

SEQ ID NO: 50577 - DNA, 18 bp, Artificial Sequence
  Synthetic DNA
acattcgacaccatattg

SEQ ID NO: 50578 - DNA, 18 bp, Artificial Sequence
  Synthetic DNA
acattcgactatatatag

SEQ ID NO: 50579 - DNA, 18 bp, Artificial Sequence
  Synthetic DNA
acattctaatcacaattg

SEQ ID NO: 50580 - DNA, 18 bp, Artificial Sequence
  Synthetic DNA
acctactactcactttag

SEQ ID NO: 50581 - DNA, 18 bp, Artificial Sequence
  Synthetic DNA
acctatgtctcactagag

SEQ ID NO: 50582 - DNA, 18 bp, Artificial Sequence
  Synthetic DNA
acgagtaactaactatag

SEQ ID NO: 50583 - DNA, 18 bp, Artificial Sequence
  Synthetic DNA
acgtgcgaaagactgtag

SEQ ID NO: 50584 - DNA, 18 bp, Artificial Sequence
  Synthetic DNA
acgtgcgactcacgatag

SEQ ID NO: 50585 - DNA, 18 bp, Artificial Sequence
  Synthetic DNA
actctcgactcgcaattg

SEQ ID NO: 50586 - DNA, 18 bp, Artificial Sequence
  Synthetic DNA
acttacgactcaccaaag

SEQ ID NO: 50587 - DNA, 18 bp, Artificial Sequence
  Synthetic DNA
acttacgattccctatag

SEQ ID NO: 50588 - DNA, 18 bp, Artificial Sequence
  Synthetic DNA
acttacggttcacaaaag

SEQ ID NO: 50589 - DNA, 18 bp, Artificial Sequence
  Synthetic DNA
acttatgactctctatag

SEQ ID NO: 50590 - DNA, 18 bp, Artificial Sequence
  Synthetic DNA
actttcgactcacaattg

SEQ ID NO: 50591 - DNA, 18 bp, Artificial Sequence
  Synthetic DNA
agaaacgacataatatag

SEQ ID NO: 50592 - DNA, 18 bp, Artificial Sequence
  Synthetic DNA
agaaactactcaccatag

SEQ ID NO: 50593 - DNA, 18 bp, Artificial Sequence
  Synthetic DNA
agaaatgatcaactatag

SEQ ID NO: 50594 - DNA, 18 bp, Artificial Sequence
  Synthetic DNA
agacaacgccctctatag

SEQ ID NO: 50595 - DNA, 18 bp, Artificial Sequence
  Synthetic DNA
agacacgactttgtaagg

SEQ ID NO: 50596 - DNA, 18 bp, Artificial Sequence
  Synthetic DNA
agacgcgactctctaaag

SEQ ID NO: 50597 - DNA, 18 bp, Artificial Sequence
  Synthetic DNA
agactagactcacattag

SEQ ID NO: 50598 - DNA, 18 bp, Artificial Sequence
  Synthetic DNA
agataagtcacacaatag

SEQ ID NO: 50599 - DNA, 18 bp, Artificial Sequence
  Synthetic DNA
agatacgaatctccatgg

SEQ ID NO: 50600 - DNA, 18 bp, Artificial Sequence
  Synthetic DNA
agatacgaatttctattg

SEQ ID NO: 50601 - DNA, 18 bp, Artificial Sequence
  Synthetic DNA
agatacgaccaattatag

SEQ ID NO: 50602 - DNA, 18 bp, Artificial Sequence
  Synthetic DNA
agatacgacgccctttag

SEQ ID NO: 50603 - DNA, 18 bp, Artificial Sequence
  Synthetic DNA
agatacgactcgttattg

SEQ ID NO: 50604 - DNA, 18 bp, Artificial Sequence
  Synthetic DNA
agatacgactttttatag

SEQ ID NO: 50605 - DNA, 18 bp, Artificial Sequence
  Synthetic DNA
agatacgatacactgtag

SEQ ID NO: 50606 - DNA, 18 bp, Artificial Sequence
  Synthetic DNA
agatacgattcagtacag

SEQ ID NO: 50607 - DNA, 18 bp, Artificial Sequence
  Synthetic DNA
agatacgtctcattattg

SEQ ID NO: 50608 - DNA, 18 bp, Artificial Sequence
  Synthetic DNA
agatacgtctcgctatgg

SEQ ID NO: 50609 - DNA, 18 bp, Artificial Sequence
  Synthetic DNA
agatactaccaagtttgg

SEQ ID NO: 50610 - DNA, 18 bp, Artificial Sequence
  Synthetic DNA
agataggagtcaccattg

SEQ ID NO: 50611 - DNA, 18 bp, Artificial Sequence
  Synthetic DNA
agatataactctttattg

SEQ ID NO: 50612 - DNA, 18 bp, Artificial Sequence
  Synthetic DNA
agatatgtttcagtatgg

SEQ ID NO: 50613 - DNA, 18 bp, Artificial Sequence
  Synthetic DNA
agatattgctccctatag

SEQ ID NO: 50614 - DNA, 18 bp, Artificial Sequence
  Synthetic DNA
agatccaactcactaaag

SEQ ID NO: 50615 - DNA, 18 bp, Artificial Sequence
  Synthetic DNA
agatccgacttacaatgg

SEQ ID NO: 50616 - DNA, 18 bp, Artificial Sequence
  Synthetic DNA
agatgggaattactaacg

SEQ ID NO: 50617 - DNA, 18 bp, Artificial Sequence
  Synthetic DNA
agattcaccttactattg

SEQ ID NO: 50618 - DNA, 18 bp, Artificial Sequence
  Synthetic DNA
agattcgactaactaaag

SEQ ID NO: 50619 - DNA, 18 bp, Artificial Sequence
  Synthetic DNA
agattctctcgaatatag

SEQ ID NO: 50620 - DNA, 18 bp, Artificial Sequence
  Synthetic DNA
agcaacgtctaactattg

SEQ ID NO: 50621 - DNA, 18 bp, Artificial Sequence
  Synthetic DNA
agctacgacatacatttg

SEQ ID NO: 50622 - DNA, 18 bp, Artificial Sequence
  Synthetic DNA
agctccgattcactctag

SEQ ID NO: 50623 - DNA, 18 bp, Artificial Sequence
  Synthetic DNA
aggaaggtctcatgttag

SEQ ID NO: 50624 - DNA, 18 bp, Artificial Sequence
  Synthetic DNA
aggttagactcattattg

SEQ ID NO: 50625 - DNA, 18 bp, Artificial Sequence
  Synthetic DNA
agtaaacactcatatttg

SEQ ID NO: 50626 - DNA, 18 bp, Artificial Sequence
  Synthetic DNA
agtaacaactcactatag

SEQ ID NO: 50627 - DNA, 18 bp, Artificial Sequence
  Synthetic DNA
agtaacgaccctctacag

SEQ ID NO: 50628 - DNA, 18 bp, Artificial Sequence
  Synthetic DNA
agttacgactaattatag

SEQ ID NO: 50629 - DNA, 18 bp, Artificial Sequence
  Synthetic DNA
agttacgactttctgcgg

SEQ ID NO: 50630 - DNA, 18 bp, Artificial Sequence
  Synthetic DNA
agttacgagacactaaag

SEQ ID NO: 50631 - DNA, 18 bp, Artificial Sequence
  Synthetic DNA
agttacgtctctctatcg

SEQ ID NO: 50632 - DNA, 18 bp, Artificial Sequence
  Synthetic DNA
agtttcgcctgactttag

SEQ ID NO: 50633 - DNA, 18 bp, Artificial Sequence
  Synthetic DNA
ataaacaaatcactatcg

SEQ ID NO: 50634 - DNA, 18 bp, Artificial Sequence
  Synthetic DNA
ataaacgacacaatattg

SEQ ID NO: 50635 - DNA, 18 bp, Artificial Sequence
  Synthetic DNA
ataaacgacacactttcg

SEQ ID NO: 50636 - DNA, 18 bp, Artificial Sequence
  Synthetic DNA
ataaacgacatactgtag

SEQ ID NO: 50637 - DNA, 18 bp, Artificial Sequence
  Synthetic DNA
ataaacgactatctatag

SEQ ID NO: 50638 - DNA, 18 bp, Artificial Sequence
  Synthetic DNA
ataaacgactcaaaagag

SEQ ID NO: 50639 - DNA, 18 bp, Artificial Sequence
  Synthetic DNA
ataaacgactcagtattg

SEQ ID NO: 50640 - DNA, 18 bp, Artificial Sequence
  Synthetic DNA
ataaacgagtcagaatag

SEQ ID NO: 50641 - DNA, 18 bp, Artificial Sequence
  Synthetic DNA
ataaacgcctcactaaag

SEQ ID NO: 50642 - DNA, 18 bp, Artificial Sequence
  Synthetic DNA
ataaacggcaaaccatag

SEQ ID NO: 50643 - DNA, 18 bp, Artificial Sequence
  Synthetic DNA
ataaacgtcacaatctcg

SEQ ID NO: 50644 - DNA, 18 bp, Artificial Sequence
  Synthetic DNA
ataaacgtctcaaaacag

SEQ ID NO: 50645 - DNA, 18 bp, Artificial Sequence
  Synthetic DNA
ataaacgtctcactatcg

SEQ ID NO: 50646 - DNA, 18 bp, Artificial Sequence
  Synthetic DNA
ataaatgactctctactg

SEQ ID NO: 50647 - DNA, 18 bp, Artificial Sequence
  Synthetic DNA
ataaatgtctcactacag

SEQ ID NO: 50648 - DNA, 18 bp, Artificial Sequence
  Synthetic DNA
ataacgatataactatag

SEQ ID NO: 50649 - DNA, 18 bp, Artificial Sequence
  Synthetic DNA
ataagcgaacaactatag

SEQ ID NO: 50650 - DNA, 18 bp, Artificial Sequence
  Synthetic DNA
ataagctactccctatag

SEQ ID NO: 50651 - DNA, 18 bp, Artificial Sequence
  Synthetic DNA
ataatcaactacctatag

SEQ ID NO: 50652 - DNA, 18 bp, Artificial Sequence
  Synthetic DNA
ataatcaactcactattg

SEQ ID NO: 50653 - DNA, 18 bp, Artificial Sequence
  Synthetic DNA
ataatcgactcaatatag

SEQ ID NO: 50654 - DNA, 18 bp, Artificial Sequence
  Synthetic DNA
ataatcgtatccctatgg

SEQ ID NO: 50655 - DNA, 18 bp, Artificial Sequence
  Synthetic DNA
atacaaggttcattatag

SEQ ID NO: 50656 - DNA, 18 bp, Artificial Sequence
  Synthetic DNA
atacacgaatctctatag

SEQ ID NO: 50657 - DNA, 18 bp, Artificial Sequence
  Synthetic DNA
atacacgacatactatag

SEQ ID NO: 50658 - DNA, 18 bp, Artificial Sequence
  Synthetic DNA
atacacgacattcactcg

SEQ ID NO: 50659 - DNA, 18 bp, Artificial Sequence
  Synthetic DNA
atacacgactcacattag

SEQ ID NO: 50660 - DNA, 18 bp, Artificial Sequence
  Synthetic DNA
atacacgtctcactttag

SEQ ID NO: 50661 - DNA, 18 bp, Artificial Sequence
  Synthetic DNA
atacataactcactatag

SEQ ID NO: 50662 - DNA, 18 bp, Artificial Sequence
  Synthetic DNA
atacccgactcacgatag

SEQ ID NO: 50663 - DNA, 18 bp, Artificial Sequence
  Synthetic DNA
atataagactcacagcag

SEQ ID NO: 50664 - DNA, 18 bp, Artificial Sequence
  Synthetic DNA
atataagtctacctatag

SEQ ID NO: 50665 - DNA, 18 bp, Artificial Sequence
  Synthetic DNA
atataagtcttgctatag

SEQ ID NO: 50666 - DNA, 18 bp, Artificial Sequence
  Synthetic DNA
atataataatcacaatag

SEQ ID NO: 50667 - DNA, 18 bp, Artificial Sequence
  Synthetic DNA
atatacaaatctcataag

SEQ ID NO: 50668 - DNA, 18 bp, Artificial Sequence
  Synthetic DNA
atatacaactcactcaag

SEQ ID NO: 50669 - DNA, 18 bp, Artificial Sequence
  Synthetic DNA
atatacaagacactttag

SEQ ID NO: 50670 - DNA, 18 bp, Artificial Sequence
  Synthetic DNA
atatacaagtaactttag

SEQ ID NO: 50671 - DNA, 18 bp, Artificial Sequence
  Synthetic DNA
atatacaatactcaagtg

SEQ ID NO: 50672 - DNA, 18 bp, Artificial Sequence
  Synthetic DNA
atatacatctatctctag

SEQ ID NO: 50673 - DNA, 18 bp, Artificial Sequence
  Synthetic DNA
atataccacacaccattg

SEQ ID NO: 50674 - DNA, 18 bp, Artificial Sequence
  Synthetic DNA
atataccacacactatcg

SEQ ID NO: 50675 - DNA, 18 bp, Artificial Sequence
  Synthetic DNA
atataccacccacaatag

SEQ ID NO: 50676 - DNA, 18 bp, Artificial Sequence
  Synthetic DNA
atataccattaacattag

SEQ ID NO: 50677 - DNA, 18 bp, Artificial Sequence
  Synthetic DNA
atataccattaactatag

SEQ ID NO: 50678 - DNA, 18 bp, Artificial Sequence
  Synthetic DNA
atatacctcatgctaaag

SEQ ID NO: 50679 - DNA, 18 bp, Artificial Sequence
  Synthetic DNA
atatacctctcacaattg

SEQ ID NO: 50680 - DNA, 18 bp, Artificial Sequence
  Synthetic DNA
atatacctcttactatgg

SEQ ID NO: 50681 - DNA, 18 bp, Artificial Sequence
  Synthetic DNA
atatacctcttactgtag

SEQ ID NO: 50682 - DNA, 18 bp, Artificial Sequence
  Synthetic DNA
atatacgacaatcattag

SEQ ID NO: 50683 - DNA, 18 bp, Artificial Sequence
  Synthetic DNA
atatacgaccaaattcag

SEQ ID NO: 50684 - DNA, 18 bp, Artificial Sequence
  Synthetic DNA
atatacgaccctctaaag

SEQ ID NO: 50685 - DNA, 18 bp, Artificial Sequence
  Synthetic DNA
atatacgacgcagtagtg

SEQ ID NO: 50686 - DNA, 18 bp, Artificial Sequence
  Synthetic DNA
atatacgactcgattttg

SEQ ID NO: 50687 - DNA, 18 bp, Artificial Sequence
  Synthetic DNA
atatacgactcttgtaag

SEQ ID NO: 50688 - DNA, 18 bp, Artificial Sequence
  Synthetic DNA
atatacgagacaggatag

SEQ ID NO: 50689 - DNA, 18 bp, Artificial Sequence
  Synthetic DNA
atatacgagtctctttag

SEQ ID NO: 50690 - DNA, 18 bp, Artificial Sequence
  Synthetic DNA
atatacgattcaattttg

SEQ ID NO: 50691 - DNA, 18 bp, Artificial Sequence
  Synthetic DNA
atatacgattcgctaaag

SEQ ID NO: 50692 - DNA, 18 bp, Artificial Sequence
  Synthetic DNA
atatacgcgatactatag

SEQ ID NO: 50693 - DNA, 18 bp, Artificial Sequence
  Synthetic DNA
atatacgcttagctatag

SEQ ID NO: 50694 - DNA, 18 bp, Artificial Sequence
  Synthetic DNA
atatacggctgacaatag

SEQ ID NO: 50695 - DNA, 18 bp, Artificial Sequence
  Synthetic DNA
atatacgtcacaccatag

SEQ ID NO: 50696 - DNA, 18 bp, Artificial Sequence
  Synthetic DNA
atatacgtcgcccttttg

SEQ ID NO: 50697 - DNA, 18 bp, Artificial Sequence
  Synthetic DNA
atatacgtctaaatattg

SEQ ID NO: 50698 - DNA, 18 bp, Artificial Sequence
  Synthetic DNA
atatacgtctcacttatg

SEQ ID NO: 50699 - DNA, 18 bp, Artificial Sequence
  Synthetic DNA
atatactactaagtattg

SEQ ID NO: 50700 - DNA, 18 bp, Artificial Sequence
  Synthetic DNA
atatactactgactttag

SEQ ID NO: 50701 - DNA, 18 bp, Artificial Sequence
  Synthetic DNA
atatactattcactactg

SEQ ID NO: 50702 - DNA, 18 bp, Artificial Sequence
  Synthetic DNA
atatacttctcaatatag

SEQ ID NO: 50703 - DNA, 18 bp, Artificial Sequence
  Synthetic DNA
atatacttctcacagtgg

SEQ ID NO: 50704 - DNA, 18 bp, Artificial Sequence
  Synthetic DNA
atatacttctcactatcg

SEQ ID NO: 50705 - DNA, 18 bp, Artificial Sequence
  Synthetic DNA
atatacttctcacttgag

SEQ ID NO: 50706 - DNA, 18 bp, Artificial Sequence
  Synthetic DNA
atatacttgcctctatag

SEQ ID NO: 50707 - DNA, 18 bp, Artificial Sequence
  Synthetic DNA
atatagcattctcttgag

SEQ ID NO: 50708 - DNA, 18 bp, Artificial Sequence
  Synthetic DNA
atatatctctaattattg

SEQ ID NO: 50709 - DNA, 18 bp, Artificial Sequence
  Synthetic DNA
atatatgccacaatatag

SEQ ID NO: 50710 - DNA, 18 bp, Artificial Sequence
  Synthetic DNA
atatatgcctcacgatag

SEQ ID NO: 50711 - DNA, 18 bp, Artificial Sequence
  Synthetic DNA
atatattacactgcatag

SEQ ID NO: 50712 - DNA, 18 bp, Artificial Sequence
  Synthetic DNA
atatattagtcactctag

SEQ ID NO: 50713 - DNA, 18 bp, Artificial Sequence
  Synthetic DNA
atatatttgtcactaaag

SEQ ID NO: 50714 - DNA, 18 bp, Artificial Sequence
  Synthetic DNA
atatcaagctcactaaag

SEQ ID NO: 50715 - DNA, 18 bp, Artificial Sequence
  Synthetic DNA
atatccgaatcaatatag

SEQ ID NO: 50716 - DNA, 18 bp, Artificial Sequence
  Synthetic DNA
atatccgtcagagtaaag

SEQ ID NO: 50717 - DNA, 18 bp, Artificial Sequence
  Synthetic DNA
atatccttcgcactaaag

SEQ ID NO: 50718 - DNA, 18 bp, Artificial Sequence
  Synthetic DNA
atatgaatcccaattacg

SEQ ID NO: 50719 - DNA, 18 bp, Artificial Sequence
  Synthetic DNA
atatgcaactcactattg

SEQ ID NO: 50720 - DNA, 18 bp, Artificial Sequence
  Synthetic DNA
atatgcgattgactgtag

SEQ ID NO: 50721 - DNA, 18 bp, Artificial Sequence
  Synthetic DNA
atatgctactcgcaacag

SEQ ID NO: 50722 - DNA, 18 bp, Artificial Sequence
  Synthetic DNA
atattagactaattattg

SEQ ID NO: 50723 - DNA, 18 bp, Artificial Sequence
  Synthetic DNA
atattagactctctctag

SEQ ID NO: 50724 - DNA, 18 bp, Artificial Sequence
  Synthetic DNA
atattagacttattacgg

SEQ ID NO: 50725 - DNA, 18 bp, Artificial Sequence
  Synthetic DNA
atattatactcactttag

SEQ ID NO: 50726 - DNA, 18 bp, Artificial Sequence
  Synthetic DNA
atattcatctccctgtag

SEQ ID NO: 50727 - DNA, 18 bp, Artificial Sequence
  Synthetic DNA
atattccactcactatgg

SEQ ID NO: 50728 - DNA, 18 bp, Artificial Sequence
  Synthetic DNA
atattcgattcactttcg

SEQ ID NO: 50729 - DNA, 18 bp, Artificial Sequence
  Synthetic DNA
atattcgtgtcactaaag

SEQ ID NO: 50730 - DNA, 18 bp, Artificial Sequence
  Synthetic DNA
atattcgtttcacagcag

SEQ ID NO: 50731 - DNA, 18 bp, Artificial Sequence
  Synthetic DNA
atattctactcaaaatag

SEQ ID NO: 50732 - DNA, 18 bp, Artificial Sequence
  Synthetic DNA
atattctactcaagttag

SEQ ID NO: 50733 - DNA, 18 bp, Artificial Sequence
  Synthetic DNA
atattctatttactgcag

SEQ ID NO: 50734 - DNA, 18 bp, Artificial Sequence
  Synthetic DNA
atattgcatacgttatag

SEQ ID NO: 50735 - DNA, 18 bp, Artificial Sequence
  Synthetic DNA
atattggcctcactttag

SEQ ID NO: 50736 - DNA, 18 bp, Artificial Sequence
  Synthetic DNA
atatttatctccctatag

SEQ ID NO: 50737 - DNA, 18 bp, Artificial Sequence
  Synthetic DNA
atattttactcactattg

SEQ ID NO: 50738 - DNA, 18 bp, Artificial Sequence
  Synthetic DNA
atcatcgactcactttag

SEQ ID NO: 50739 - DNA, 18 bp, Artificial Sequence
  Synthetic DNA
atcatcgattcactatag

SEQ ID NO: 50740 - DNA, 18 bp, Artificial Sequence
  Synthetic DNA
atccatgactccctatag

SEQ ID NO: 50741 - DNA, 18 bp, Artificial Sequence
  Synthetic DNA
atctaaatctcgttatag

SEQ ID NO: 50742 - DNA, 18 bp, Artificial Sequence
  Synthetic DNA
atctaagactcgctatag

SEQ ID NO: 50743 - DNA, 18 bp, Artificial Sequence
  Synthetic DNA
atctacgactctcaatag

SEQ ID NO: 50744 - DNA, 18 bp, Artificial Sequence
  Synthetic DNA
atctacgtcacacattag

SEQ ID NO: 50745 - DNA, 18 bp, Artificial Sequence
  Synthetic DNA
atctgctaatctttatag

SEQ ID NO: 50746 - DNA, 18 bp, Artificial Sequence
  Synthetic DNA
atcttcgaatccctttag

SEQ ID NO: 50747 - DNA, 18 bp, Artificial Sequence
  Synthetic DNA
atcttctaatcactcaag

SEQ ID NO: 50748 - DNA, 18 bp, Artificial Sequence
  Synthetic DNA
atgaacgaattactctag

SEQ ID NO: 50749 - DNA, 18 bp, Artificial Sequence
  Synthetic DNA
atgatcgacgcactatag

SEQ ID NO: 50750 - DNA, 18 bp, Artificial Sequence
  Synthetic DNA
atggacgtattaatattg

SEQ ID NO: 50751 - DNA, 18 bp, Artificial Sequence
  Synthetic DNA
atgtaacacatcctaagg

SEQ ID NO: 50752 - DNA, 18 bp, Artificial Sequence
  Synthetic DNA
atgtaagatccactatag

SEQ ID NO: 50753 - DNA, 18 bp, Artificial Sequence
  Synthetic DNA
atgtacaactctttttag

SEQ ID NO: 50754 - DNA, 18 bp, Artificial Sequence
  Synthetic DNA
atgtacatctcccaatcg

SEQ ID NO: 50755 - DNA, 18 bp, Artificial Sequence
  Synthetic DNA
atgtacgactcactcttg

SEQ ID NO: 50756 - DNA, 18 bp, Artificial Sequence
  Synthetic DNA
atgtacgccaaactatgg

SEQ ID NO: 50757 - DNA, 18 bp, Artificial Sequence
  Synthetic DNA
atgtactactttccatag

SEQ ID NO: 50758 - DNA, 18 bp, Artificial Sequence
  Synthetic DNA
atgtataagtcaatatag

SEQ ID NO: 50759 - DNA, 18 bp, Artificial Sequence
  Synthetic DNA
atgttcaactcactatag

SEQ ID NO: 50760 - DNA, 18 bp, Artificial Sequence
  Synthetic DNA
atgttctgctcccaactg

SEQ ID NO: 50761 - DNA, 18 bp, Artificial Sequence
  Synthetic DNA
attaaaatcacaaggtag

SEQ ID NO: 50762 - DNA, 18 bp, Artificial Sequence
  Synthetic DNA
attaaccactcccaatag

SEQ ID NO: 50763 - DNA, 18 bp, Artificial Sequence
  Synthetic DNA
attaacgcatcacaatag

SEQ ID NO: 50764 - DNA, 18 bp, Artificial Sequence
  Synthetic DNA
attaacgtcccactatag

SEQ ID NO: 50765 - DNA, 18 bp, Artificial Sequence
  Synthetic DNA
attaacgtctcacttatg

SEQ ID NO: 50766 - DNA, 18 bp, Artificial Sequence
  Synthetic DNA
attatagacttagtttag

SEQ ID NO: 50767 - DNA, 18 bp, Artificial Sequence
  Synthetic DNA
attatcaactaactgtgg

SEQ ID NO: 50768 - DNA, 18 bp, Artificial Sequence
  Synthetic DNA
attatcatcaccctatag

SEQ ID NO: 50769 - DNA, 18 bp, Artificial Sequence
  Synthetic DNA
attcacgattaactattg

SEQ ID NO: 50770 - DNA, 18 bp, Artificial Sequence
  Synthetic DNA
attcttgtctgactatag

SEQ ID NO: 50771 - DNA, 18 bp, Artificial Sequence
  Synthetic DNA
attcttttttcacatttg

SEQ ID NO: 50772 - DNA, 18 bp, Artificial Sequence
  Synthetic DNA
attgaagacgaactatag

SEQ ID NO: 50773 - DNA, 18 bp, Artificial Sequence
  Synthetic DNA
attgaccactcaggaaag

SEQ ID NO: 50774 - DNA, 18 bp, Artificial Sequence
  Synthetic DNA
attgaggattgactttag

SEQ ID NO: 50775 - DNA, 18 bp, Artificial Sequence
  Synthetic DNA
atttaagagtcactgtag

SEQ ID NO: 50776 - DNA, 18 bp, Artificial Sequence
  Synthetic DNA
atttaattcacgctacag

SEQ ID NO: 50777 - DNA, 18 bp, Artificial Sequence
  Synthetic DNA
atttacaacccaatttag

SEQ ID NO: 50778 - DNA, 18 bp, Artificial Sequence
  Synthetic DNA
atttacaacttactattg

SEQ ID NO: 50779 - DNA, 18 bp, Artificial Sequence
  Synthetic DNA
atttacaagtctatatag

SEQ ID NO: 50780 - DNA, 18 bp, Artificial Sequence
  Synthetic DNA
atttacatatcactttcg

SEQ ID NO: 50781 - DNA, 18 bp, Artificial Sequence
  Synthetic DNA
atttacatcttacgttag

SEQ ID NO: 50782 - DNA, 18 bp, Artificial Sequence
  Synthetic DNA
atttacgactcgaacgag

SEQ ID NO: 50783 - DNA, 18 bp, Artificial Sequence
  Synthetic DNA
atttacgagttactaaag

SEQ ID NO: 50784 - DNA, 18 bp, Artificial Sequence
  Synthetic DNA
atttacgcctgactaacg

SEQ ID NO: 50785 - DNA, 18 bp, Artificial Sequence
  Synthetic DNA
atttacgtcactctattg

SEQ ID NO: 50786 - DNA, 18 bp, Artificial Sequence
  Synthetic DNA
atttacgtctgactaaag

SEQ ID NO: 50787 - DNA, 18 bp, Artificial Sequence
  Synthetic DNA
atttactactcattaaag

SEQ ID NO: 50788 - DNA, 18 bp, Artificial Sequence
  Synthetic DNA
atttacttctcactttag

SEQ ID NO: 50789 - DNA, 18 bp, Artificial Sequence
  Synthetic DNA
atttatgtctcactaacg

SEQ ID NO: 50790 - DNA, 18 bp, Artificial Sequence
  Synthetic DNA
atttatgtctcctaatag

SEQ ID NO: 50791 - DNA, 18 bp, Artificial Sequence
  Synthetic DNA
atttattgcacaatttag

SEQ ID NO: 50792 - DNA, 18 bp, Artificial Sequence
  Synthetic DNA
atttcctcctcacaatag

SEQ ID NO: 50793 - DNA, 18 bp, Artificial Sequence
  Synthetic DNA
atttctgaatcactaaag

SEQ ID NO: 50794 - DNA, 18 bp, Artificial Sequence
  Synthetic DNA
atttgcgagaaactttag

SEQ ID NO: 50795 - DNA, 18 bp, Artificial Sequence
  Synthetic DNA
attttcatcattctatag

SEQ ID NO: 50796 - DNA, 18 bp, Artificial Sequence
  Synthetic DNA
attttcgactaacaaaag

SEQ ID NO: 50797 - DNA, 18 bp, Artificial Sequence
  Synthetic DNA
attttcgactcgttacag

SEQ ID NO: 50798 - DNA, 18 bp, Artificial Sequence
  Synthetic DNA
attttcgattgcctatag

SEQ ID NO: 50799 - DNA, 18 bp, Artificial Sequence
  Synthetic DNA
attttcgtctttccatag

SEQ ID NO: 50800 - DNA, 18 bp, Artificial Sequence
  Synthetic DNA
attttgcattcaatattg

SEQ ID NO: 50801 - DNA, 18 bp, Artificial Sequence
  Synthetic DNA
caaaaagactgactattg

SEQ ID NO: 50802 - DNA, 18 bp, Artificial Sequence
  Synthetic DNA
caaaaagactttccatag

SEQ ID NO: 50803 - DNA, 18 bp, Artificial Sequence
  Synthetic DNA
caaaacatttcaccatag

SEQ ID NO: 50804 - DNA, 18 bp, Artificial Sequence
  Synthetic DNA
caaaacgaaatactgtag

SEQ ID NO: 50805 - DNA, 18 bp, Artificial Sequence
  Synthetic DNA
caaaacgaccccccaaag

SEQ ID NO: 50806 - DNA, 18 bp, Artificial Sequence
  Synthetic DNA
caaaacgactctgataag

SEQ ID NO: 50807 - DNA, 18 bp, Artificial Sequence
  Synthetic DNA
caaaacgattctctttcg

SEQ ID NO: 50808 - DNA, 18 bp, Artificial Sequence
  Synthetic DNA
caaaacgatttactatcg

SEQ ID NO: 50809 - DNA, 18 bp, Artificial Sequence
  Synthetic DNA
caaaacgcctcagtcaag

SEQ ID NO: 50810 - DNA, 18 bp, Artificial Sequence
  Synthetic DNA
caaaacgtcttacaatag

SEQ ID NO: 50811 - DNA, 18 bp, Artificial Sequence
  Synthetic DNA
caaaacgtttcccaacag

SEQ ID NO: 50812 - DNA, 18 bp, Artificial Sequence
  Synthetic DNA
caaaactacactctatag

SEQ ID NO: 50813 - DNA, 18 bp, Artificial Sequence
  Synthetic DNA
caaaagcactaaatctag

SEQ ID NO: 50814 - DNA, 18 bp, Artificial Sequence
  Synthetic DNA
caaaaggttaccgtatag

SEQ ID NO: 50815 - DNA, 18 bp, Artificial Sequence
  Synthetic DNA
caaaataagtcaataaag

SEQ ID NO: 50816 - DNA, 18 bp, Artificial Sequence
  Synthetic DNA
caaacccaatcgaatcag

SEQ ID NO: 50817 - DNA, 18 bp, Artificial Sequence
  Synthetic DNA
caaaccgccaatctatag

SEQ ID NO: 50818 - DNA, 18 bp, Artificial Sequence
  Synthetic DNA
caaatcctatctcttcag

SEQ ID NO: 50819 - DNA, 18 bp, Artificial Sequence
  Synthetic DNA
caaatcggctctgtttag

SEQ ID NO: 50820 - DNA, 18 bp, Artificial Sequence
  Synthetic DNA
caaatctactcaccaaag

SEQ ID NO: 50821 - DNA, 18 bp, Artificial Sequence
  Synthetic DNA
caaattaactcacagtag

SEQ ID NO: 50822 - DNA, 18 bp, Artificial Sequence
  Synthetic DNA
caacaagtctcacccttg

SEQ ID NO: 50823 - DNA, 18 bp, Artificial Sequence
  Synthetic DNA
caacaccactcgctattg

SEQ ID NO: 50824 - DNA, 18 bp, Artificial Sequence
  Synthetic DNA
caacacgaaacatttaag

SEQ ID NO: 50825 - DNA, 18 bp, Artificial Sequence
  Synthetic DNA
caacacgactaagattag

SEQ ID NO: 50826 - DNA, 18 bp, Artificial Sequence
  Synthetic DNA
caacacgagaaaccatag

SEQ ID NO: 50827 - DNA, 18 bp, Artificial Sequence
  Synthetic DNA
caacacgatactctctag

SEQ ID NO: 50828 - DNA, 18 bp, Artificial Sequence
  Synthetic DNA
caacatcactcacaatag

SEQ ID NO: 50829 - DNA, 18 bp, Artificial Sequence
  Synthetic DNA
caacatgattcactgtag

SEQ ID NO: 50830 - DNA, 18 bp, Artificial Sequence
  Synthetic DNA
caacgcaccttactatag

SEQ ID NO: 50831 - DNA, 18 bp, Artificial Sequence
  Synthetic DNA
caactcaactccctaacg

SEQ ID NO: 50832 - DNA, 18 bp, Artificial Sequence
  Synthetic DNA
caactcgactctttatag

SEQ ID NO: 50833 - DNA, 18 bp, Artificial Sequence
  Synthetic DNA
caactctactaactatag

SEQ ID NO: 50834 - DNA, 18 bp, Artificial Sequence
  Synthetic DNA
caagacggatcacattag

SEQ ID NO: 50835 - DNA, 18 bp, Artificial Sequence
  Synthetic DNA
caagatcactcaataaag

SEQ ID NO: 50836 - DNA, 18 bp, Artificial Sequence
  Synthetic DNA
caagattactttaaattg

SEQ ID NO: 50837 - DNA, 18 bp, Artificial Sequence
  Synthetic DNA
caagttgattcactatag

SEQ ID NO: 50838 - DNA, 18 bp, Artificial Sequence
  Synthetic DNA
caataaaacacactactg

SEQ ID NO: 50839 - DNA, 18 bp, Artificial Sequence
  Synthetic DNA
caataaccctcactttag

SEQ ID NO: 50840 - DNA, 18 bp, Artificial Sequence
  Synthetic DNA
caataagcctctctttag

SEQ ID NO: 50841 - DNA, 18 bp, Artificial Sequence
  Synthetic DNA
caatacaacttagtatcg

SEQ ID NO: 50842 - DNA, 18 bp, Artificial Sequence
  Synthetic DNA
caatacaattaactattg

SEQ ID NO: 50843 - DNA, 18 bp, Artificial Sequence
  Synthetic DNA
caatacatctcacaatgg

SEQ ID NO: 50844 - DNA, 18 bp, Artificial Sequence
  Synthetic DNA
caataccaatatttttag

SEQ ID NO: 50845 - DNA, 18 bp, Artificial Sequence
  Synthetic DNA
caataccactttctattg

SEQ ID NO: 50846 - DNA, 18 bp, Artificial Sequence
  Synthetic DNA
caataccttgcactatgg

SEQ ID NO: 50847 - DNA, 18 bp, Artificial Sequence
  Synthetic DNA
caatacgacacacaaagg

SEQ ID NO: 50848 - DNA, 18 bp, Artificial Sequence
  Synthetic DNA
caatacgacattctatcg

SEQ ID NO: 50849 - DNA, 18 bp, Artificial Sequence
  Synthetic DNA
caatacgactctttctcg

SEQ ID NO: 50850 - DNA, 18 bp, Artificial Sequence
  Synthetic DNA
caatacgagacactggag

SEQ ID NO: 50851 - DNA, 18 bp, Artificial Sequence
  Synthetic DNA
caatacgctacactagag

SEQ ID NO: 50852 - DNA, 18 bp, Artificial Sequence
  Synthetic DNA
caatacggcacattataa

SEQ ID NO: 50853 - DNA, 18 bp, Artificial Sequence
  Synthetic DNA
caatacggcttattgaag

SEQ ID NO: 50854 - DNA, 18 bp, Artificial Sequence
  Synthetic DNA
caatacgtctcgcaccag

SEQ ID NO: 50855 - DNA, 18 bp, Artificial Sequence
  Synthetic DNA
caatacgttacactacag

SEQ ID NO: 50856 - DNA, 18 bp, Artificial Sequence
  Synthetic DNA
caatacgtttccctaatg

SEQ ID NO: 50857 - DNA, 18 bp, Artificial Sequence
  Synthetic DNA
caatactaaacactaaag

SEQ ID NO: 50858 - DNA, 18 bp, Artificial Sequence
  Synthetic DNA
caatactactggctaaag

SEQ ID NO: 50859 - DNA, 18 bp, Artificial Sequence
  Synthetic DNA
caatactaggccctatcg

SEQ ID NO: 50860 - DNA, 18 bp, Artificial Sequence
  Synthetic DNA
caatactagtcccttttg

SEQ ID NO: 50861 - DNA, 18 bp, Artificial Sequence
  Synthetic DNA
caatactatacactgcag

SEQ ID NO: 50862 - DNA, 18 bp, Artificial Sequence
  Synthetic DNA
caatactgctcgctgctg

SEQ ID NO: 50863 - DNA, 18 bp, Artificial Sequence
  Synthetic DNA
caatacttcttactattg

SEQ ID NO: 50864 - DNA, 18 bp, Artificial Sequence
  Synthetic DNA
caatagaatactctatgg

SEQ ID NO: 50865 - DNA, 18 bp, Artificial Sequence
  Synthetic DNA
caataggcatcactttag

SEQ ID NO: 50866 - DNA, 18 bp, Artificial Sequence
  Synthetic DNA
caatagtactcattttag

SEQ ID NO: 50867 - DNA, 18 bp, Artificial Sequence
  Synthetic DNA
caatagtgttcccaatcg

SEQ ID NO: 50868 - DNA, 18 bp, Artificial Sequence
  Synthetic DNA
caatataacccaagatag

SEQ ID NO: 50869 - DNA, 18 bp, Artificial Sequence
  Synthetic DNA
caatatatctgtctatag

SEQ ID NO: 50870 - DNA, 18 bp, Artificial Sequence
  Synthetic DNA
caatatgacaaactatcg

SEQ ID NO: 50871 - DNA, 18 bp, Artificial Sequence
  Synthetic DNA
caatatgactctttaaag

SEQ ID NO: 50872 - DNA, 18 bp, Artificial Sequence
  Synthetic DNA
caatatgcctcacaattg

SEQ ID NO: 50873 - DNA, 18 bp, Artificial Sequence
  Synthetic DNA
caatatgtctcacttaag

SEQ ID NO: 50874 - DNA, 18 bp, Artificial Sequence
  Synthetic DNA
caatatgtctcatcttag

SEQ ID NO: 50875 - DNA, 18 bp, Artificial Sequence
  Synthetic DNA
caatattaatcacttttg

SEQ ID NO: 50876 - DNA, 18 bp, Artificial Sequence
  Synthetic DNA
caatattactcgctaaag

SEQ ID NO: 50877 - DNA, 18 bp, Artificial Sequence
  Synthetic DNA
caatattactctctaaag

SEQ ID NO: 50878 - DNA, 18 bp, Artificial Sequence
  Synthetic DNA
caatcccaatcactctcg

SEQ ID NO: 50879 - DNA, 18 bp, Artificial Sequence
  Synthetic DNA
caatccgactaatactag

SEQ ID NO: 50880 - DNA, 18 bp, Artificial Sequence
  Synthetic DNA
caatccgcgtcgctatag

SEQ ID NO: 50881 - DNA, 18 bp, Artificial Sequence
  Synthetic DNA
caatctaactctctaaag

SEQ ID NO: 50882 - DNA, 18 bp, Artificial Sequence
  Synthetic DNA
caatctctctaattgtag

SEQ ID NO: 50883 - DNA, 18 bp, Artificial Sequence
  Synthetic DNA
caatgcgactaattctag

SEQ ID NO: 50884 - DNA, 18 bp, Artificial Sequence
  Synthetic DNA
caatgcgtctcaacaaag

SEQ ID NO: 50885 - DNA, 18 bp, Artificial Sequence
  Synthetic DNA
caattaaactcaccatcg

SEQ ID NO: 50886 - DNA, 18 bp, Artificial Sequence
  Synthetic DNA
caattagacacaatgttg

SEQ ID NO: 50887 - DNA, 18 bp, Artificial Sequence
  Synthetic DNA
caattccagtcagaaaag

SEQ ID NO: 50888 - DNA, 18 bp, Artificial Sequence
  Synthetic DNA
caattccattaacctttg

SEQ ID NO: 50889 - DNA, 18 bp, Artificial Sequence
  Synthetic DNA
caattccgctcattatag

SEQ ID NO: 50890 - DNA, 18 bp, Artificial Sequence
  Synthetic DNA
caattcctctcactattg

SEQ ID NO: 50891 - DNA, 18 bp, Artificial Sequence
  Synthetic DNA
caattcgactcaaaaacg

SEQ ID NO: 50892 - DNA, 18 bp, Artificial Sequence
  Synthetic DNA
caattcgacttacttttg

SEQ ID NO: 50893 - DNA, 18 bp, Artificial Sequence
  Synthetic DNA
caattcgatatacaatag

SEQ ID NO: 50894 - DNA, 18 bp, Artificial Sequence
  Synthetic DNA
caattcgattttctatgg

SEQ ID NO: 50895 - DNA, 18 bp, Artificial Sequence
  Synthetic DNA
caattcgccccgctatag

SEQ ID NO: 50896 - DNA, 18 bp, Artificial Sequence
  Synthetic DNA
caattcgcgacactaaag

SEQ ID NO: 50897 - DNA, 18 bp, Artificial Sequence
  Synthetic DNA
caattcggcacactacag

SEQ ID NO: 50898 - DNA, 18 bp, Artificial Sequence
  Synthetic DNA
caattcgtgtgattatag

SEQ ID NO: 50899 - DNA, 18 bp, Artificial Sequence
  Synthetic DNA
caattctaatccctatag

SEQ ID NO: 50900 - DNA, 18 bp, Artificial Sequence
  Synthetic DNA
caattctatacactcaag

SEQ ID NO: 50901 - DNA, 18 bp, Artificial Sequence
  Synthetic DNA
caattctatttactaaag

SEQ ID NO: 50902 - DNA, 18 bp, Artificial Sequence
  Synthetic DNA
caattcttctaacgatag

SEQ ID NO: 50903 - DNA, 18 bp, Artificial Sequence
  Synthetic DNA
caattggtctctcactag

SEQ ID NO: 50904 - DNA, 18 bp, Artificial Sequence
  Synthetic DNA
caatttgacactctattg

SEQ ID NO: 50905 - DNA, 18 bp, Artificial Sequence
  Synthetic DNA
cacaacgacacactaagg

SEQ ID NO: 50906 - DNA, 18 bp, Artificial Sequence
  Synthetic DNA
caccccgtcttacaattg

SEQ ID NO: 50907 - DNA, 18 bp, Artificial Sequence
  Synthetic DNA
cactaagactctccatag

SEQ ID NO: 50908 - DNA, 18 bp, Artificial Sequence
  Synthetic DNA
cactaagtttcactatag

SEQ ID NO: 50909 - DNA, 18 bp, Artificial Sequence
  Synthetic DNA
cactactaatctctatag

SEQ ID NO: 50910 - DNA, 18 bp, Artificial Sequence
  Synthetic DNA
cactactatccactatag

SEQ ID NO: 50911 - DNA, 18 bp, Artificial Sequence
  Synthetic DNA
cactcagacccattatag

SEQ ID NO: 50912 - DNA, 18 bp, Artificial Sequence
  Synthetic DNA
cactccgactcaatattg

SEQ ID NO: 50913 - DNA, 18 bp, Artificial Sequence
  Synthetic DNA
cactccgtctaactattg

SEQ ID NO: 50914 - DNA, 18 bp, Artificial Sequence
  Synthetic DNA
cactgccactcactattg

SEQ ID NO: 50915 - DNA, 18 bp, Artificial Sequence
  Synthetic DNA
cacttggtcacattaatg

SEQ ID NO: 50916 - DNA, 18 bp, Artificial Sequence
  Synthetic DNA
cagaaccacttactattg

SEQ ID NO: 50917 - DNA, 18 bp, Artificial Sequence
  Synthetic DNA
cagaatgaatatctatag

SEQ ID NO: 50918 - DNA, 18 bp, Artificial Sequence
  Synthetic DNA
caggccgactcactaatg

SEQ ID NO: 50919 - DNA, 18 bp, Artificial Sequence
  Synthetic DNA
cagtacaactcacaaaag

SEQ ID NO: 50920 - DNA, 18 bp, Artificial Sequence
  Synthetic DNA
cagtacgacagtcaatag

SEQ ID NO: 50921 - DNA, 18 bp, Artificial Sequence
  Synthetic DNA
cagtacgccacacaatag

SEQ ID NO: 50922 - DNA, 18 bp, Artificial Sequence
  Synthetic DNA
cagtacgcctctatacag

SEQ ID NO: 50923 - DNA, 18 bp, Artificial Sequence
  Synthetic DNA
cagtacgttactatttag

SEQ ID NO: 50924 - DNA, 18 bp, Artificial Sequence
  Synthetic DNA
cagtactactaactaaag

SEQ ID NO: 50925 - DNA, 18 bp, Artificial Sequence
  Synthetic DNA
cagtatgactcacaaaag

SEQ ID NO: 50926 - DNA, 18 bp, Artificial Sequence
  Synthetic DNA
cagttccactctctatag

SEQ ID NO: 50927 - DNA, 18 bp, Artificial Sequence
  Synthetic DNA
cagttcgattccctttcg

SEQ ID NO: 50928 - DNA, 18 bp, Artificial Sequence
  Synthetic DNA
cataacaacccgctataa

SEQ ID NO: 50929 - DNA, 18 bp, Artificial Sequence
  Synthetic DNA
cataacaactctctatag

SEQ ID NO: 50930 - DNA, 18 bp, Artificial Sequence
  Synthetic DNA
cataacgaaacactatag

SEQ ID NO: 50931 - DNA, 18 bp, Artificial Sequence
  Synthetic DNA
cataacgacactctttag

SEQ ID NO: 50932 - DNA, 18 bp, Artificial Sequence
  Synthetic DNA
cataacgactcacttttg

SEQ ID NO: 50933 - DNA, 18 bp, Artificial Sequence
  Synthetic DNA
cataacgtttaagtatag

SEQ ID NO: 50934 - DNA, 18 bp, Artificial Sequence
  Synthetic DNA
cataatgactcacaatcg

SEQ ID NO: 50935 - DNA, 18 bp, Artificial Sequence
  Synthetic DNA
catcacagctaactatgg

SEQ ID NO: 50936 - DNA, 18 bp, Artificial Sequence
  Synthetic DNA
catcacgtctcagtgtag

SEQ ID NO: 50937 - DNA, 18 bp, Artificial Sequence
  Synthetic DNA
catgacctcgctctatag

SEQ ID NO: 50938 - DNA, 18 bp, Artificial Sequence
  Synthetic DNA
cattaagactctctacag

SEQ ID NO: 50939 - DNA, 18 bp, Artificial Sequence
  Synthetic DNA
cattacaactcacatttg

SEQ ID NO: 50940 - DNA, 18 bp, Artificial Sequence
  Synthetic DNA
cattacatcatactattg

SEQ ID NO: 50941 - DNA, 18 bp, Artificial Sequence
  Synthetic DNA
cattacgaatgtctaaag

SEQ ID NO: 50942 - DNA, 18 bp, Artificial Sequence
  Synthetic DNA
cattacgacacagtaatg

SEQ ID NO: 50943 - DNA, 18 bp, Artificial Sequence
  Synthetic DNA
cattacgacacagttaag

SEQ ID NO: 50944 - DNA, 18 bp, Artificial Sequence
  Synthetic DNA
cattacgacagactattg

SEQ ID NO: 50945 - DNA, 18 bp, Artificial Sequence
  Synthetic DNA
cattacgactcaaaaaag

SEQ ID NO: 50946 - DNA, 18 bp, Artificial Sequence
  Synthetic DNA
cattacgagtctccatag

SEQ ID NO: 50947 - DNA, 18 bp, Artificial Sequence
  Synthetic DNA
cattacgcctcaatattg

SEQ ID NO: 50948 - DNA, 18 bp, Artificial Sequence
  Synthetic DNA
cattactaatctgcatag

SEQ ID NO: 50949 - DNA, 18 bp, Artificial Sequence
  Synthetic DNA
cattaggaatcatttagg

SEQ ID NO: 50950 - DNA, 18 bp, Artificial Sequence
  Synthetic DNA
cattagtactgagtttag

SEQ ID NO: 50951 - DNA, 18 bp, Artificial Sequence
  Synthetic DNA
cattatgacacactgtag

SEQ ID NO: 50952 - DNA, 18 bp, Artificial Sequence
  Synthetic DNA
cattatgacagactatag

SEQ ID NO: 50953 - DNA, 18 bp, Artificial Sequence
  Synthetic DNA
cattatgactctcaatag

SEQ ID NO: 50954 - DNA, 18 bp, Artificial Sequence
  Synthetic DNA
cattatgactctctatgg

SEQ ID NO: 50955 - DNA, 18 bp, Artificial Sequence
  Synthetic DNA
cattatgactctctttcg

SEQ ID NO: 50956 - DNA, 18 bp, Artificial Sequence
  Synthetic DNA
cattatgattttcactag

SEQ ID NO: 50957 - DNA, 18 bp, Artificial Sequence
  Synthetic DNA
cattatggattactatag

SEQ ID NO: 50958 - DNA, 18 bp, Artificial Sequence
  Synthetic DNA
cattccgacatactatag

SEQ ID NO: 50959 - DNA, 18 bp, Artificial Sequence
  Synthetic DNA
cattcctaatctctattg

SEQ ID NO: 50960 - DNA, 18 bp, Artificial Sequence
  Synthetic DNA
cattgcaacacaccatag

SEQ ID NO: 50961 - DNA, 18 bp, Artificial Sequence
  Synthetic DNA
cattgcgtctcaatatag

SEQ ID NO: 50962 - DNA, 18 bp, Artificial Sequence
  Synthetic DNA
catttcgactcaccctag

SEQ ID NO: 50963 - DNA, 18 bp, Artificial Sequence
  Synthetic DNA
catttcgactcacgttag

SEQ ID NO: 50964 - DNA, 18 bp, Artificial Sequence
  Synthetic DNA
catttcgactcagacaag

SEQ ID NO: 50965 - DNA, 18 bp, Artificial Sequence
  Synthetic DNA
catttcgactcataatag

SEQ ID NO: 50966 - DNA, 18 bp, Artificial Sequence
  Synthetic DNA
ccaaaccaatgactattg

SEQ ID NO: 50967 - DNA, 18 bp, Artificial Sequence
  Synthetic DNA
ccaaacgtcttacttaag

SEQ ID NO: 50968 - DNA, 18 bp, Artificial Sequence
  Synthetic DNA
ccaagcgactcacatttg

SEQ ID NO: 50969 - DNA, 18 bp, Artificial Sequence
  Synthetic DNA
ccagacgacacactaatg

SEQ ID NO: 50970 - DNA, 18 bp, Artificial Sequence
  Synthetic DNA
ccataagattcgctttag

SEQ ID NO: 50971 - DNA, 18 bp, Artificial Sequence
  Synthetic DNA
ccatacgaatcaccattg

SEQ ID NO: 50972 - DNA, 18 bp, Artificial Sequence
  Synthetic DNA
ccatacgactcacagtgg

SEQ ID NO: 50973 - DNA, 18 bp, Artificial Sequence
  Synthetic DNA
ccatacgattttctatag

SEQ ID NO: 50974 - DNA, 18 bp, Artificial Sequence
  Synthetic DNA
ccatagtactcactaaag

SEQ ID NO: 50975 - DNA, 18 bp, Artificial Sequence
  Synthetic DNA
ccatccgactctctatgg

SEQ ID NO: 50976 - DNA, 18 bp, Artificial Sequence
  Synthetic DNA
ccattctactcattatag

SEQ ID NO: 50977 - DNA, 18 bp, Artificial Sequence
  Synthetic DNA
ccgtgtgtctctctatag

SEQ ID NO: 50978 - DNA, 18 bp, Artificial Sequence
  Synthetic DNA
cctaacgactcagtgttg

SEQ ID NO: 50979 - DNA, 18 bp, Artificial Sequence
  Synthetic DNA
ccttacgacttgcgattg

SEQ ID NO: 50980 - DNA, 18 bp, Artificial Sequence
  Synthetic DNA
ccttacggctctatatcg

SEQ ID NO: 50981 - DNA, 18 bp, Artificial Sequence
  Synthetic DNA
cctttcgattcactaaag

SEQ ID NO: 50982 - DNA, 18 bp, Artificial Sequence
  Synthetic DNA
cgaaacgattcactctag

SEQ ID NO: 50983 - DNA, 18 bp, Artificial Sequence
  Synthetic DNA
cgaaagcactcaccatag

SEQ ID NO: 50984 - DNA, 18 bp, Artificial Sequence
  Synthetic DNA
cgataagagttactatcg

SEQ ID NO: 50985 - DNA, 18 bp, Artificial Sequence
  Synthetic DNA
cgatacgctacactatag

SEQ ID NO: 50986 - DNA, 18 bp, Artificial Sequence
  Synthetic DNA
cgatacgtaacactttag

SEQ ID NO: 50987 - DNA, 18 bp, Artificial Sequence
  Synthetic DNA
cgatagtactcccttagg

SEQ ID NO: 50988 - DNA, 18 bp, Artificial Sequence
  Synthetic DNA
cgatatgtctccctatag

SEQ ID NO: 50989 - DNA, 18 bp, Artificial Sequence
  Synthetic DNA
cgatattacactttatag

SEQ ID NO: 50990 - DNA, 18 bp, Artificial Sequence
  Synthetic DNA
cgatctggatcgccgttg

SEQ ID NO: 50991 - DNA, 18 bp, Artificial Sequence
  Synthetic DNA
cgattcgaatcaaagatg

SEQ ID NO: 50992 - DNA, 18 bp, Artificial Sequence
  Synthetic DNA
cgattcgaatcactaatg

SEQ ID NO: 50993 - DNA, 18 bp, Artificial Sequence
  Synthetic DNA
cggtactcctcactatag

SEQ ID NO: 50994 - DNA, 18 bp, Artificial Sequence
  Synthetic DNA
cgtatctactcaccttag

SEQ ID NO: 50995 - DNA, 18 bp, Artificial Sequence
  Synthetic DNA
cgtgatgactcactctag

SEQ ID NO: 50996 - DNA, 18 bp, Artificial Sequence
  Synthetic DNA
cgttaccccacactatag

SEQ ID NO: 50997 - DNA, 18 bp, Artificial Sequence
  Synthetic DNA
cgtttcgtcacactatag

SEQ ID NO: 50998 - DNA, 18 bp, Artificial Sequence
  Synthetic DNA
ctaaaagactcgatttag

SEQ ID NO: 50999 - DNA, 18 bp, Artificial Sequence
  Synthetic DNA
ctaaaccacacactttag

SEQ ID NO: 51000 - DNA, 18 bp, Artificial Sequence
  Synthetic DNA
ctaaacgacacactaatg

SEQ ID NO: 51001 - DNA, 18 bp, Artificial Sequence
  Synthetic DNA
ctaaacgcttaactagag

SEQ ID NO: 51002 - DNA, 18 bp, Artificial Sequence
  Synthetic DNA
ctaaaggtctcactttag

SEQ ID NO: 51003 - DNA, 18 bp, Artificial Sequence
  Synthetic DNA
ctaagctgatctccatag

SEQ ID NO: 51004 - DNA, 18 bp, Artificial Sequence
  Synthetic DNA
ctaagggacacactgtag

SEQ ID NO: 51005 - DNA, 18 bp, Artificial Sequence
  Synthetic DNA
ctaatcggctgcctatcg

SEQ ID NO: 51006 - DNA, 18 bp, Artificial Sequence
  Synthetic DNA
ctaatcgtctcactatag

SEQ ID NO: 51007 - DNA, 18 bp, Artificial Sequence
  Synthetic DNA
ctacacgacaaataaatg

SEQ ID NO: 51008 - DNA, 18 bp, Artificial Sequence
  Synthetic DNA
ctagacaactcactatgg

SEQ ID NO: 51009 - DNA, 18 bp, Artificial Sequence
  Synthetic DNA
ctagacgactcatcttag

SEQ ID NO: 51010 - DNA, 18 bp, Artificial Sequence
  Synthetic DNA
ctagacgactctcgatag

SEQ ID NO: 51011 - DNA, 18 bp, Artificial Sequence
  Synthetic DNA
ctatacaacacattattg

SEQ ID NO: 51012 - DNA, 18 bp, Artificial Sequence
  Synthetic DNA
ctatacaactcaacattg

SEQ ID NO: 51013 - DNA, 18 bp, Artificial Sequence
  Synthetic DNA
ctatacaactcaccatcg

SEQ ID NO: 51014 - DNA, 18 bp, Artificial Sequence
  Synthetic DNA
ctatacatctcaatttag

SEQ ID NO: 51015 - DNA, 18 bp, Artificial Sequence
  Synthetic DNA
ctataccacacactattg

SEQ ID NO: 51016 - DNA, 18 bp, Artificial Sequence
  Synthetic DNA
ctataccactcgctacag

SEQ ID NO: 51017 - DNA, 18 bp, Artificial Sequence
  Synthetic DNA
ctatacctctaacttttg

SEQ ID NO: 51018 - DNA, 18 bp, Artificial Sequence
  Synthetic DNA
ctatacgaatcatcaatg

SEQ ID NO: 51019 - DNA, 18 bp, Artificial Sequence
  Synthetic DNA
ctatacgaatctataatg

SEQ ID NO: 51020 - DNA, 18 bp, Artificial Sequence
  Synthetic DNA
ctatacgaccagctatag

SEQ ID NO: 51021 - DNA, 18 bp, Artificial Sequence
  Synthetic DNA
ctatacgactcgcactag

SEQ ID NO: 51022 - DNA, 18 bp, Artificial Sequence
  Synthetic DNA
ctatacgatagcctattg

SEQ ID NO: 51023 - DNA, 18 bp, Artificial Sequence
  Synthetic DNA
ctatacggctatttatag

SEQ ID NO: 51024 - DNA, 18 bp, Artificial Sequence
  Synthetic DNA
ctatacgtaacacttcag

SEQ ID NO: 51025 - DNA, 18 bp, Artificial Sequence
  Synthetic DNA
ctatacgtctccttatag

SEQ ID NO: 51026 - DNA, 18 bp, Artificial Sequence
  Synthetic DNA
ctatacgtcttaattttg

SEQ ID NO: 51027 - DNA, 18 bp, Artificial Sequence
  Synthetic DNA
ctatactaaacaatttag

SEQ ID NO: 51028 - DNA, 18 bp, Artificial Sequence
  Synthetic DNA
ctatactaacccctatag

SEQ ID NO: 51029 - DNA, 18 bp, Artificial Sequence
  Synthetic DNA
ctatactactcagtttag

SEQ ID NO: 51030 - DNA, 18 bp, Artificial Sequence
  Synthetic DNA
ctatactactctctattg

SEQ ID NO: 51031 - DNA, 18 bp, Artificial Sequence
  Synthetic DNA
ctatactagccactatag

SEQ ID NO: 51032 - DNA, 18 bp, Artificial Sequence
  Synthetic DNA
ctataggactcactcttg

SEQ ID NO: 51033 - DNA, 18 bp, Artificial Sequence
  Synthetic DNA
ctataggactcgcttttg

SEQ ID NO: 51034 - DNA, 18 bp, Artificial Sequence
  Synthetic DNA
ctataggtatcacaaaag

SEQ ID NO: 51035 - DNA, 18 bp, Artificial Sequence
  Synthetic DNA
ctatatagctcaccatag

SEQ ID NO: 51036 - DNA, 18 bp, Artificial Sequence
  Synthetic DNA
ctatatgtcactaataag

SEQ ID NO: 51037 - DNA, 18 bp, Artificial Sequence
  Synthetic DNA
ctatattagtcatcatag

SEQ ID NO: 51038 - DNA, 18 bp, Artificial Sequence
  Synthetic DNA
ctatccaactcaatatag

SEQ ID NO: 51039 - DNA, 18 bp, Artificial Sequence
  Synthetic DNA
ctatctgcctcacttttg

SEQ ID NO: 51040 - DNA, 18 bp, Artificial Sequence
  Synthetic DNA
ctatgcatttcactagag

SEQ ID NO: 51041 - DNA, 18 bp, Artificial Sequence
  Synthetic DNA
ctatgcgattcacgttgg

SEQ ID NO: 51042 - DNA, 18 bp, Artificial Sequence
  Synthetic DNA
ctattccactcactctag

SEQ ID NO: 51043 - DNA, 18 bp, Artificial Sequence
  Synthetic DNA
ctattcgactctcattag

SEQ ID NO: 51044 - DNA, 18 bp, Artificial Sequence
  Synthetic DNA
ctattcgtctcactaata

SEQ ID NO: 51045 - DNA, 18 bp, Artificial Sequence
  Synthetic DNA
ctattcgtctccgtatag

SEQ ID NO: 51046 - DNA, 18 bp, Artificial Sequence
  Synthetic DNA
ctcaacgattcactatag

SEQ ID NO: 51047 - DNA, 18 bp, Artificial Sequence
  Synthetic DNA
ctcagcgaatcacgtaag

SEQ ID NO: 51048 - DNA, 18 bp, Artificial Sequence
  Synthetic DNA
ctctacgactcacaatcg

SEQ ID NO: 51049 - DNA, 18 bp, Artificial Sequence
  Synthetic DNA
ctctacgactcgctattg

SEQ ID NO: 51050 - DNA, 18 bp, Artificial Sequence
  Synthetic DNA
ctctgcgattccttacag

SEQ ID NO: 51051 - DNA, 18 bp, Artificial Sequence
  Synthetic DNA
ctcttcgcttcactatag

SEQ ID NO: 51052 - DNA, 18 bp, Artificial Sequence
  Synthetic DNA
ctgaacgactctctatag

SEQ ID NO: 51053 - DNA, 18 bp, Artificial Sequence
  Synthetic DNA
ctgtacgaatcactgtag

SEQ ID NO: 51054 - DNA, 18 bp, Artificial Sequence
  Synthetic DNA
ctgtactactcaaaagag

SEQ ID NO: 51055 - DNA, 18 bp, Artificial Sequence
  Synthetic DNA
cttaactactcactagag

SEQ ID NO: 51056 - DNA, 18 bp, Artificial Sequence
  Synthetic DNA
cttaaggtctctctattg

SEQ ID NO: 51057 - DNA, 18 bp, Artificial Sequence
  Synthetic DNA
cttagcgacgcattatag

SEQ ID NO: 51058 - DNA, 18 bp, Artificial Sequence
  Synthetic DNA
cttatcgtctctctgtag

SEQ ID NO: 51059 - DNA, 18 bp, Artificial Sequence
  Synthetic DNA
cttcgtgactcactatag

SEQ ID NO: 51060 - DNA, 18 bp, Artificial Sequence
  Synthetic DNA
ctttaccactcaacatag

SEQ ID NO: 51061 - DNA, 18 bp, Artificial Sequence
  Synthetic DNA
ctttacgactcgctattg

SEQ ID NO: 51062 - DNA, 18 bp, Artificial Sequence
  Synthetic DNA
ctttacgactctccatag

SEQ ID NO: 51063 - DNA, 18 bp, Artificial Sequence
  Synthetic DNA
ctttacgtcacactatag

SEQ ID NO: 51064 - DNA, 18 bp, Artificial Sequence
  Synthetic DNA
cttttcgattcactagtg

SEQ ID NO: 51065 - DNA, 18 bp, Artificial Sequence
  Synthetic DNA
gaaaacgactcacccttg

SEQ ID NO: 51066 - DNA, 18 bp, Artificial Sequence
  Synthetic DNA
gaaaacgattcattgtag

SEQ ID NO: 51067 - DNA, 18 bp, Artificial Sequence
  Synthetic DNA
gaaagcgactttctacag

SEQ ID NO: 51068 - DNA, 18 bp, Artificial Sequence
  Synthetic DNA
gaaagcgtctgaatgtag

SEQ ID NO: 51069 - DNA, 18 bp, Artificial Sequence
  Synthetic DNA
gaaatatgcactttatag

SEQ ID NO: 51070 - DNA, 18 bp, Artificial Sequence
  Synthetic DNA
gaacacaactctatattg

SEQ ID NO: 51071 - DNA, 18 bp, Artificial Sequence
  Synthetic DNA
gaacactaatcactgtag

SEQ ID NO: 51072 - DNA, 18 bp, Artificial Sequence
  Synthetic DNA
gaacactactctctttcg

SEQ ID NO: 51073 - DNA, 18 bp, Artificial Sequence
  Synthetic DNA
gaacccgtctcacctttg

SEQ ID NO: 51074 - DNA, 18 bp, Artificial Sequence
  Synthetic DNA
gaaccttactcacttcag

SEQ ID NO: 51075 - DNA, 18 bp, Artificial Sequence
  Synthetic DNA
gaagaggactctctccag

SEQ ID NO: 51076 - DNA, 18 bp, Artificial Sequence
  Synthetic DNA
gaataagactccttaaag

SEQ ID NO: 51077 - DNA, 18 bp, Artificial Sequence
  Synthetic DNA
gaataatactcaacaaag

SEQ ID NO: 51078 - DNA, 18 bp, Artificial Sequence
  Synthetic DNA
gaatacacctcccggacg

SEQ ID NO: 51079 - DNA, 18 bp, Artificial Sequence
  Synthetic DNA
gaatacatttctcaatgg

SEQ ID NO: 51080 - DNA, 18 bp, Artificial Sequence
  Synthetic DNA
gaatacctcgctctatag

SEQ ID NO: 51081 - DNA, 18 bp, Artificial Sequence
  Synthetic DNA
gaatacgaaattcttcag

SEQ ID NO: 51082 - DNA, 18 bp, Artificial Sequence
  Synthetic DNA
gaatacgagaaacttgag

SEQ ID NO: 51083 - DNA, 18 bp, Artificial Sequence
  Synthetic DNA
gaatacgcgtcacttgag

SEQ ID NO: 51084 - DNA, 18 bp, Artificial Sequence
  Synthetic DNA
gaatacgtcacacaaatg

SEQ ID NO: 51085 - DNA, 18 bp, Artificial Sequence
  Synthetic DNA
gaatacgtcactaaatag

SEQ ID NO: 51086 - DNA, 18 bp, Artificial Sequence
  Synthetic DNA
gaatactactatctttag

SEQ ID NO: 51087 - DNA, 18 bp, Artificial Sequence
  Synthetic DNA
gaatagctctcataatag

SEQ ID NO: 51088 - DNA, 18 bp, Artificial Sequence
  Synthetic DNA
gaataggcctatctttag

SEQ ID NO: 51089 - DNA, 18 bp, Artificial Sequence
  Synthetic DNA
gaatatctcacacttatg

SEQ ID NO: 51090 - DNA, 18 bp, Artificial Sequence
  Synthetic DNA
gaatcatactcattattg

SEQ ID NO: 51091 - DNA, 18 bp, Artificial Sequence
  Synthetic DNA
gaatgcggtgcaccatag

SEQ ID NO: 51092 - DNA, 18 bp, Artificial Sequence
  Synthetic DNA
gaatgtaactctatacag

SEQ ID NO: 51093 - DNA, 18 bp, Artificial Sequence
  Synthetic DNA
gaattcaactctcaacag

SEQ ID NO: 51094 - DNA, 18 bp, Artificial Sequence
  Synthetic DNA
gaattccactctctttag

SEQ ID NO: 51095 - DNA, 18 bp, Artificial Sequence
  Synthetic DNA
gaattcgtatcgttttag

SEQ ID NO: 51096 - DNA, 18 bp, Artificial Sequence
  Synthetic DNA
gaattcgtctcactccag

SEQ ID NO: 51097 - DNA, 18 bp, Artificial Sequence
  Synthetic DNA
gaattctattcactttgg

SEQ ID NO: 51098 - DNA, 18 bp, Artificial Sequence
  Synthetic DNA
gactacgatgctctatag

SEQ ID NO: 51099 - DNA, 18 bp, Artificial Sequence
  Synthetic DNA
gactacgattcgctaaag

SEQ ID NO: 51100 - DNA, 18 bp, Artificial Sequence
  Synthetic DNA
gagtacaattcacgagag

SEQ ID NO: 51101 - DNA, 18 bp, Artificial Sequence
  Synthetic DNA
gagtagttctcactttag

SEQ ID NO: 51102 - DNA, 18 bp, Artificial Sequence
  Synthetic DNA
gatatgaacacaccattg

SEQ ID NO: 51103 - DNA, 18 bp, Artificial Sequence
  Synthetic DNA
gatcacgactctcgaaag

SEQ ID NO: 51104 - DNA, 18 bp, Artificial Sequence
  Synthetic DNA
gatcagcactaactatag

SEQ ID NO: 51105 - DNA, 18 bp, Artificial Sequence
  Synthetic DNA
gatcaggacggactctag

SEQ ID NO: 51106 - DNA, 18 bp, Artificial Sequence
  Synthetic DNA
gatgacgatactctatag

SEQ ID NO: 51107 - DNA, 18 bp, Artificial Sequence
  Synthetic DNA
gattacaattcactaatg

SEQ ID NO: 51108 - DNA, 18 bp, Artificial Sequence
  Synthetic DNA
gattacttctcacaatag

SEQ ID NO: 51109 - DNA, 18 bp, Artificial Sequence
  Synthetic DNA
gattctgactcacgttag

SEQ ID NO: 51110 - DNA, 18 bp, Artificial Sequence
  Synthetic DNA
gattgtaactcgctatgg

SEQ ID NO: 51111 - DNA, 18 bp, Artificial Sequence
  Synthetic DNA
gatttatactccgtacag

SEQ ID NO: 51112 - DNA, 18 bp, Artificial Sequence
  Synthetic DNA
gcaatcgtctctcaatag

SEQ ID NO: 51113 - DNA, 18 bp, Artificial Sequence
  Synthetic DNA
gcacgcgagaaattatag

SEQ ID NO: 51114 - DNA, 18 bp, Artificial Sequence
  Synthetic DNA
gcatacaaatcactattg

SEQ ID NO: 51115 - DNA, 18 bp, Artificial Sequence
  Synthetic DNA
gcatacgagacgctaaag

SEQ ID NO: 51116 - DNA, 18 bp, Artificial Sequence
  Synthetic DNA
gcatactaccgagtattg

SEQ ID NO: 51117 - DNA, 18 bp, Artificial Sequence
  Synthetic DNA
gcattagacactttaaag

SEQ ID NO: 51118 - DNA, 18 bp, Artificial Sequence
  Synthetic DNA
gcattcgtctcaatatag

SEQ ID NO: 51119 - DNA, 18 bp, Artificial Sequence
  Synthetic DNA
gcttaccacacactatag

SEQ ID NO: 51120 - DNA, 18 bp, Artificial Sequence
  Synthetic DNA
gcttgggactcaatttag

SEQ ID NO: 51121 - DNA, 18 bp, Artificial Sequence
  Synthetic DNA
ggatacgacacacatgag

SEQ ID NO: 51122 - DNA, 18 bp, Artificial Sequence
  Synthetic DNA
ggattggccacacttgag

SEQ ID NO: 51123 - DNA, 18 bp, Artificial Sequence
  Synthetic DNA
ggctacgtatgactaaag

SEQ ID NO: 51124 - DNA, 18 bp, Artificial Sequence
  Synthetic DNA
gggaacttctcactgcag

SEQ ID NO: 51125 - DNA, 18 bp, Artificial Sequence
  Synthetic DNA
gtaaacgacccattatcg

SEQ ID NO: 51126 - DNA, 18 bp, Artificial Sequence
  Synthetic DNA
gtaatctactcatgaatg

SEQ ID NO: 51127 - DNA, 18 bp, Artificial Sequence
  Synthetic DNA
gtatacgactaaaactaa

SEQ ID NO: 51128 - DNA, 18 bp, Artificial Sequence
  Synthetic DNA
gtatacgagtcacaaatg

SEQ ID NO: 51129 - DNA, 18 bp, Artificial Sequence
  Synthetic DNA
gtatacgtctctcgagtg

SEQ ID NO: 51130 - DNA, 18 bp, Artificial Sequence
  Synthetic DNA
gtatatgattctcagtag

SEQ ID NO: 51131 - DNA, 18 bp, Artificial Sequence
  Synthetic DNA
gtatgcgagtaaccatgg

SEQ ID NO: 51132 - DNA, 18 bp, Artificial Sequence
  Synthetic DNA
gtatgcggcacacaatag

SEQ ID NO: 51133 - DNA, 18 bp, Artificial Sequence
  Synthetic DNA
gtattcaacatactaaag

SEQ ID NO: 51134 - DNA, 18 bp, Artificial Sequence
  Synthetic DNA
gtattccactcgctatag

SEQ ID NO: 51135 - DNA, 18 bp, Artificial Sequence
  Synthetic DNA
gtattccagagataacgg

SEQ ID NO: 51136 - DNA, 18 bp, Artificial Sequence
  Synthetic DNA
gtattcgagtcactaaag

SEQ ID NO: 51137 - DNA, 18 bp, Artificial Sequence
  Synthetic DNA
gtattcgtctcacattag

SEQ ID NO: 51138 - DNA, 18 bp, Artificial Sequence
  Synthetic DNA
gtctacaactaactttgg

SEQ ID NO: 51139 - DNA, 18 bp, Artificial Sequence
  Synthetic DNA
gtctacgtctcattttag

SEQ ID NO: 51140 - DNA, 18 bp, Artificial Sequence
  Synthetic DNA
gtcttcgtttcttgatag

SEQ ID NO: 51141 - DNA, 18 bp, Artificial Sequence
  Synthetic DNA
gtttaagactctcaatag

SEQ ID NO: 51142 - DNA, 18 bp, Artificial Sequence
  Synthetic DNA
gtttacatcacactattg

SEQ ID NO: 51143 - DNA, 18 bp, Artificial Sequence
  Synthetic DNA
gtttacgattcacaatag

SEQ ID NO: 51144 - DNA, 18 bp, Artificial Sequence
  Synthetic DNA
gtttatgtctcaataaag

SEQ ID NO: 51145 - DNA, 18 bp, Artificial Sequence
  Synthetic DNA
taaaaaaactcagtatcg

SEQ ID NO: 51146 - DNA, 18 bp, Artificial Sequence
  Synthetic DNA
taaaaaaacttactattg

SEQ ID NO: 51147 - DNA, 18 bp, Artificial Sequence
  Synthetic DNA
taaaaagaaaaactatag

SEQ ID NO: 51148 - DNA, 18 bp, Artificial Sequence
  Synthetic DNA
taaaaagaacgtctatag

SEQ ID NO: 51149 - DNA, 18 bp, Artificial Sequence
  Synthetic DNA
taaaaagaatcaaaatgg

SEQ ID NO: 51150 - DNA, 18 bp, Artificial Sequence
  Synthetic DNA
taaaaagactcattaatg

SEQ ID NO: 51151 - DNA, 18 bp, Artificial Sequence
  Synthetic DNA
taaaaagactgactactg

SEQ ID NO: 51152 - DNA, 18 bp, Artificial Sequence
  Synthetic DNA
taaaaagatacaaaatag

SEQ ID NO: 51153 - DNA, 18 bp, Artificial Sequence
  Synthetic DNA
taaaaagattcactttgg

SEQ ID NO: 51154 - DNA, 18 bp, Artificial Sequence
  Synthetic DNA
taaaaagcctcactaatg

SEQ ID NO: 51155 - DNA, 18 bp, Artificial Sequence
  Synthetic DNA
taaaaagtatcaggctgg

SEQ ID NO: 51156 - DNA, 18 bp, Artificial Sequence
  Synthetic DNA
taaaaagtatccttcaag

SEQ ID NO: 51157 - DNA, 18 bp, Artificial Sequence
  Synthetic DNA
taaaaagtctcccaaaag

SEQ ID NO: 51158 - DNA, 18 bp, Artificial Sequence
  Synthetic DNA
taaaaagtctcgctgtag

SEQ ID NO: 51159 - DNA, 18 bp, Artificial Sequence
  Synthetic DNA
taaaaagtcttactacag

SEQ ID NO: 51160 - DNA, 18 bp, Artificial Sequence
  Synthetic DNA
taaaaagtcttattaaag

SEQ ID NO: 51161 - DNA, 18 bp, Artificial Sequence
  Synthetic DNA
taaaaataaccaatttag

SEQ ID NO: 51162 - DNA, 18 bp, Artificial Sequence
  Synthetic DNA
taaaaattctcaatatag

SEQ ID NO: 51163 - DNA, 18 bp, Artificial Sequence
  Synthetic DNA
taaaacaaccgtccatag

SEQ ID NO: 51164 - DNA, 18 bp, Artificial Sequence
  Synthetic DNA
taaaacaactctctcaag

SEQ ID NO: 51165 - DNA, 18 bp, Artificial Sequence
  Synthetic DNA
taaaacaactctcttaag

SEQ ID NO: 51166 - DNA, 18 bp, Artificial Sequence
  Synthetic DNA
taaaacaatcaactcaag

SEQ ID NO: 51167 - DNA, 18 bp, Artificial Sequence
  Synthetic DNA
taaaacaatccactattg

SEQ ID NO: 51168 - DNA, 18 bp, Artificial Sequence
  Synthetic DNA
taaaacaattatctattg

SEQ ID NO: 51169 - DNA, 18 bp, Artificial Sequence
  Synthetic DNA
taaaacaattcacgtaag

SEQ ID NO: 51170 - DNA, 18 bp, Artificial Sequence
  Synthetic DNA
taaaacagaacactttag

SEQ ID NO: 51171 - DNA, 18 bp, Artificial Sequence
  Synthetic DNA
taaaacataacacgttcg

SEQ ID NO: 51172 - DNA, 18 bp, Artificial Sequence
  Synthetic DNA
taaaacatctcctttttg

SEQ ID NO: 51173 - DNA, 18 bp, Artificial Sequence
  Synthetic DNA
taaaaccactcacataag

SEQ ID NO: 51174 - DNA, 18 bp, Artificial Sequence
  Synthetic DNA
taaaaccatacactagag

SEQ ID NO: 51175 - DNA, 18 bp, Artificial Sequence
  Synthetic DNA
taaaaccgctcactaatg

SEQ ID NO: 51176 - DNA, 18 bp, Artificial Sequence
  Synthetic DNA
taaaacctctgaataaag

SEQ ID NO: 51177 - DNA, 18 bp, Artificial Sequence
  Synthetic DNA
taaaacgaatgacaattg

SEQ ID NO: 51178 - DNA, 18 bp, Artificial Sequence
  Synthetic DNA
taaaacgacccacaaatg

SEQ ID NO: 51179 - DNA, 18 bp, Artificial Sequence
  Synthetic DNA
taaaacgacctagtttag

SEQ ID NO: 51180 - DNA, 18 bp, Artificial Sequence
  Synthetic DNA
taaaacgacgccgtaatg

SEQ ID NO: 51181 - DNA, 18 bp, Artificial Sequence
  Synthetic DNA
taaaacgactaaattaag

SEQ ID NO: 51182 - DNA, 18 bp, Artificial Sequence
  Synthetic DNA
taaaacgactatacatag

SEQ ID NO: 51183 - DNA, 18 bp, Artificial Sequence
  Synthetic DNA
taaaacgactcataaacg

SEQ ID NO: 51184 - DNA, 18 bp, Artificial Sequence
  Synthetic DNA
taaaacgacttacaaacg

SEQ ID NO: 51185 - DNA, 18 bp, Artificial Sequence
  Synthetic DNA
taaaacgacttctttcag

SEQ ID NO: 51186 - DNA, 18 bp, Artificial Sequence
  Synthetic DNA
taaaacgagtctatattg

SEQ ID NO: 51187 - DNA, 18 bp, Artificial Sequence
  Synthetic DNA
taaaacgattaaccattg

SEQ ID NO: 51188 - DNA, 18 bp, Artificial Sequence
  Synthetic DNA
taaaacgattcattcatg

SEQ ID NO: 51189 - DNA, 18 bp, Artificial Sequence
  Synthetic DNA
taaaacgattgaccatcg

SEQ ID NO: 51190 - DNA, 18 bp, Artificial Sequence
  Synthetic DNA
taaaacgattttctttag

SEQ ID NO: 51191 - DNA, 18 bp, Artificial Sequence
  Synthetic DNA
taaaacgccccactacgg

SEQ ID NO: 51192 - DNA, 18 bp, Artificial Sequence
  Synthetic DNA
taaaacgcgtcacttaag

SEQ ID NO: 51193 - DNA, 18 bp, Artificial Sequence
  Synthetic DNA
taaaacgctttattatag

SEQ ID NO: 51194 - DNA, 18 bp, Artificial Sequence
  Synthetic DNA
taaaacgtacttctaaag

SEQ ID NO: 51195 - DNA, 18 bp, Artificial Sequence
  Synthetic DNA
taaaacgtagaactaaag

SEQ ID NO: 51196 - DNA, 18 bp, Artificial Sequence
  Synthetic DNA
taaaacgtatctctattg

SEQ ID NO: 51197 - DNA, 18 bp, Artificial Sequence
  Synthetic DNA
taaaacgtattactgtag

SEQ ID NO: 51198 - DNA, 18 bp, Artificial Sequence
  Synthetic DNA
taaaacgtatttccattg

SEQ ID NO: 51199 - DNA, 18 bp, Artificial Sequence
  Synthetic DNA
taaaacgtcactctttcg

SEQ ID NO: 51200 - DNA, 18 bp, Artificial Sequence
  Synthetic DNA
taaaacgtctaacattag

SEQ ID NO: 51201 - DNA, 18 bp, Artificial Sequence
  Synthetic DNA
taaaacgtctaactcgag

SEQ ID NO: 51202 - DNA, 18 bp, Artificial Sequence
  Synthetic DNA
taaaacgtctagatatag

SEQ ID NO: 51203 - DNA, 18 bp, Artificial Sequence
  Synthetic DNA
taaaacgtctcaaatttg

SEQ ID NO: 51204 - DNA, 18 bp, Artificial Sequence
  Synthetic DNA
taaaacgtctcaatttgg

SEQ ID NO: 51205 - DNA, 18 bp, Artificial Sequence
  Synthetic DNA
taaaacgtcttactgatg

SEQ ID NO: 51206 - DNA, 18 bp, Artificial Sequence
  Synthetic DNA
taaaacgtgcctctatag

SEQ ID NO: 51207 - DNA, 18 bp, Artificial Sequence
  Synthetic DNA
taaaactaaccactgttg

SEQ ID NO: 51208 - DNA, 18 bp, Artificial Sequence
  Synthetic DNA
taaaactacacattatgg

SEQ ID NO: 51209 - DNA, 18 bp, Artificial Sequence
  Synthetic DNA
taaaactacactcaatag

SEQ ID NO: 51210 - DNA, 18 bp, Artificial Sequence
  Synthetic DNA
taaaactacatacataag

SEQ ID NO: 51211 - DNA, 18 bp, Artificial Sequence
  Synthetic DNA
taaaactaccaaatactg

SEQ ID NO: 51212 - DNA, 18 bp, Artificial Sequence
  Synthetic DNA
taaaactacccactaatg

SEQ ID NO: 51213 - DNA, 18 bp, Artificial Sequence
  Synthetic DNA
taaaactacgtactgtag

SEQ ID NO: 51214 - DNA, 18 bp, Artificial Sequence
  Synthetic DNA
taaaactactatcataag

SEQ ID NO: 51215 - DNA, 18 bp, Artificial Sequence
  Synthetic DNA
taaaactattctctattg

SEQ ID NO: 51216 - DNA, 18 bp, Artificial Sequence
  Synthetic DNA
taaaactattgacaatag

SEQ ID NO: 51217 - DNA, 18 bp, Artificial Sequence
  Synthetic DNA
taaaactctacactagag

SEQ ID NO: 51218 - DNA, 18 bp, Artificial Sequence
  Synthetic DNA
taaaactgcactctatag

SEQ ID NO: 51219 - DNA, 18 bp, Artificial Sequence
  Synthetic DNA
taaaactgctcattattg

SEQ ID NO: 51220 - DNA, 18 bp, Artificial Sequence
  Synthetic DNA
taaaactgctctctctag

SEQ ID NO: 51221 - DNA, 18 bp, Artificial Sequence
  Synthetic DNA
taaaagagctcactaaag

SEQ ID NO: 51222 - DNA, 18 bp, Artificial Sequence
  Synthetic DNA
taaaagcacccactaatg

SEQ ID NO: 51223 - DNA, 18 bp, Artificial Sequence
  Synthetic DNA
taaaagcattcaatatag

SEQ ID NO: 51224 - DNA, 18 bp, Artificial Sequence
  Synthetic DNA
taaaaggacacacgttag

SEQ ID NO: 51225 - DNA, 18 bp, Artificial Sequence
  Synthetic DNA
taaaagggctctgaatag

SEQ ID NO: 51226 - DNA, 18 bp, Artificial Sequence
  Synthetic DNA
taaaagtattcactctag

SEQ ID NO: 51227 - DNA, 18 bp, Artificial Sequence
  Synthetic DNA
taaaataaatcaatatag

SEQ ID NO: 51228 - DNA, 18 bp, Artificial Sequence
  Synthetic DNA
taaaataactgattatgg

SEQ ID NO: 51229 - DNA, 18 bp, Artificial Sequence
  Synthetic DNA
taaaatatcacattatag

SEQ ID NO: 51230 - DNA, 18 bp, Artificial Sequence
  Synthetic DNA
taaaatcacttactacag

SEQ ID NO: 51231 - DNA, 18 bp, Artificial Sequence
  Synthetic DNA
taaaatctcccatacttg

SEQ ID NO: 51232 - DNA, 18 bp, Artificial Sequence
  Synthetic DNA
taaaatgaaaaaaagttg

SEQ ID NO: 51233 - DNA, 18 bp, Artificial Sequence
  Synthetic DNA
taaaatgagacaacatag

SEQ ID NO: 51234 - DNA, 18 bp, Artificial Sequence
  Synthetic DNA
taaaatgctacactatag

SEQ ID NO: 51235 - DNA, 18 bp, Artificial Sequence
  Synthetic DNA
taaaatggcactcaaaag

SEQ ID NO: 51236 - DNA, 18 bp, Artificial Sequence
  Synthetic DNA
taaaatggctccgtatag

SEQ ID NO: 51237 - DNA, 18 bp, Artificial Sequence
  Synthetic DNA
taaaatgtatctctatag

SEQ ID NO: 51238 - DNA, 18 bp, Artificial Sequence
  Synthetic DNA
taaaatgtcagaagagag

SEQ ID NO: 51239 - DNA, 18 bp, Artificial Sequence
  Synthetic DNA
taaaatgtcccataattg

SEQ ID NO: 51240 - DNA, 18 bp, Artificial Sequence
  Synthetic DNA
taaaattacatgcaatag

SEQ ID NO: 51241 - DNA, 18 bp, Artificial Sequence
  Synthetic DNA
taaaattacccactaaag

SEQ ID NO: 51242 - DNA, 18 bp, Artificial Sequence
  Synthetic DNA
taaaattactcactctgg

SEQ ID NO: 51243 - DNA, 18 bp, Artificial Sequence
  Synthetic DNA
taaaattcctctcgatag

SEQ ID NO: 51244 - DNA, 18 bp, Artificial Sequence
  Synthetic DNA
taaaccacctcactcttg

SEQ ID NO: 51245 - DNA, 18 bp, Artificial Sequence
  Synthetic DNA
taaacccacccaataaag

SEQ ID NO: 51246 - DNA, 18 bp, Artificial Sequence
  Synthetic DNA
taaaccgaatcactacgg

SEQ ID NO: 51247 - DNA, 18 bp, Artificial Sequence
  Synthetic DNA
taaaccgacacccaaatg

SEQ ID NO: 51248 - DNA, 18 bp, Artificial Sequence
  Synthetic DNA
taaaccgagtcacattag

SEQ ID NO: 51249 - DNA, 18 bp, Artificial Sequence
  Synthetic DNA
taaaccggcactctattg

SEQ ID NO: 51250 - DNA, 18 bp, Artificial Sequence
  Synthetic DNA
taaaccgtcacgctatag

SEQ ID NO: 51251 - DNA, 18 bp, Artificial Sequence
  Synthetic DNA
taaaccgtctaaccacaa

SEQ ID NO: 51252 - DNA, 18 bp, Artificial Sequence
  Synthetic DNA
taaaccgtctcacaacag

SEQ ID NO: 51253 - DNA, 18 bp, Artificial Sequence
  Synthetic DNA
taaacctacactcaatag

SEQ ID NO: 51254 - DNA, 18 bp, Artificial Sequence
  Synthetic DNA
taaacctactaataatgg

SEQ ID NO: 51255 - DNA, 18 bp, Artificial Sequence
  Synthetic DNA
taaacctactcacttatg

SEQ ID NO: 51256 - DNA, 18 bp, Artificial Sequence
  Synthetic DNA
taaacctcctttcaatag

SEQ ID NO: 51257 - DNA, 18 bp, Artificial Sequence
  Synthetic DNA
taaacctgcgcacttttg

SEQ ID NO: 51258 - DNA, 18 bp, Artificial Sequence
  Synthetic DNA
taaacggaccccccttag

SEQ ID NO: 51259 - DNA, 18 bp, Artificial Sequence
  Synthetic DNA
taaacggtctcactattg

SEQ ID NO: 51260 - DNA, 18 bp, Artificial Sequence
  Synthetic DNA
taaactgactcatttttg

SEQ ID NO: 51261 - DNA, 18 bp, Artificial Sequence
  Synthetic DNA
taaactgacttattatag

SEQ ID NO: 51262 - DNA, 18 bp, Artificial Sequence
  Synthetic DNA
taaactgtatcactatcg

SEQ ID NO: 51263 - DNA, 18 bp, Artificial Sequence
  Synthetic DNA
taaagcaactttctatag

SEQ ID NO: 51264 - DNA, 18 bp, Artificial Sequence
  Synthetic DNA
taaagcaattcattatag

SEQ ID NO: 51265 - DNA, 18 bp, Artificial Sequence
  Synthetic DNA
taaagcctttcaatatag

SEQ ID NO: 51266 - DNA, 18 bp, Artificial Sequence
  Synthetic DNA
taaagcgaaatacgattg

SEQ ID NO: 51267 - DNA, 18 bp, Artificial Sequence
  Synthetic DNA
taaagcgactaatttttg

SEQ ID NO: 51268 - DNA, 18 bp, Artificial Sequence
  Synthetic DNA
taaagcgcctgacaatag

SEQ ID NO: 51269 - DNA, 18 bp, Artificial Sequence
  Synthetic DNA
taaagcgtctccctttag

SEQ ID NO: 51270 - DNA, 18 bp, Artificial Sequence
  Synthetic DNA
taaagcgtctctatatag

SEQ ID NO: 51271 - DNA, 18 bp, Artificial Sequence
  Synthetic DNA
taaagcgtcttaaaattg

SEQ ID NO: 51272 - DNA, 18 bp, Artificial Sequence
  Synthetic DNA
taaagctaatcaccgcag

SEQ ID NO: 51273 - DNA, 18 bp, Artificial Sequence
  Synthetic DNA
taaagctagtcattatgg

SEQ ID NO: 51274 - DNA, 18 bp, Artificial Sequence
  Synthetic DNA
taaagtgaatcactcagg

SEQ ID NO: 51275 - DNA, 18 bp, Artificial Sequence
  Synthetic DNA
taaagtgagttactattg

SEQ ID NO: 51276 - DNA, 18 bp, Artificial Sequence
  Synthetic DNA
taaataaacacaaaatgg

SEQ ID NO: 51277 - DNA, 18 bp, Artificial Sequence
  Synthetic DNA
taaataatctcccagttg

SEQ ID NO: 51278 - DNA, 18 bp, Artificial Sequence
  Synthetic DNA
taaatagactaccatttg

SEQ ID NO: 51279 - DNA, 18 bp, Artificial Sequence
  Synthetic DNA
taaatagactacctttag

SEQ ID NO: 51280 - DNA, 18 bp, Artificial Sequence
  Synthetic DNA
taaatagtaacaatatag

SEQ ID NO: 51281 - DNA, 18 bp, Artificial Sequence
  Synthetic DNA
taaatagtcttacttacg

SEQ ID NO: 51282 - DNA, 18 bp, Artificial Sequence
  Synthetic DNA
taaatcaactcaaaattg

SEQ ID NO: 51283 - DNA, 18 bp, Artificial Sequence
  Synthetic DNA
taaatcaacttacaatag

SEQ ID NO: 51284 - DNA, 18 bp, Artificial Sequence
  Synthetic DNA
taaatccaatcgctcttg

SEQ ID NO: 51285 - DNA, 18 bp, Artificial Sequence
  Synthetic DNA
taaatccacttactaagg

SEQ ID NO: 51286 - DNA, 18 bp, Artificial Sequence
  Synthetic DNA
taaatcgactcgttattg

SEQ ID NO: 51287 - DNA, 18 bp, Artificial Sequence
  Synthetic DNA
taaatcgagacactatgg

SEQ ID NO: 51288 - DNA, 18 bp, Artificial Sequence
  Synthetic DNA
taaatcgattttctttag

SEQ ID NO: 51289 - DNA, 18 bp, Artificial Sequence
  Synthetic DNA
taaatcgccacaccacgg

SEQ ID NO: 51290 - DNA, 18 bp, Artificial Sequence
  Synthetic DNA
taaatcgcctaatcttag

SEQ ID NO: 51291 - DNA, 18 bp, Artificial Sequence
  Synthetic DNA
taaatcggctcgctattg

SEQ ID NO: 51292 - DNA, 18 bp, Artificial Sequence
  Synthetic DNA
taaatcggctctctttcg

SEQ ID NO: 51293 - DNA, 18 bp, Artificial Sequence
  Synthetic DNA
taaatcggcttatttttg

SEQ ID NO: 51294 - DNA, 18 bp, Artificial Sequence
  Synthetic DNA
taaatcgtttcactatcg

SEQ ID NO: 51295 - DNA, 18 bp, Artificial Sequence
  Synthetic DNA
taaatctactcaatattg

SEQ ID NO: 51296 - DNA, 18 bp, Artificial Sequence
  Synthetic DNA
taaatctactctcattag

SEQ ID NO: 51297 - DNA, 18 bp, Artificial Sequence
  Synthetic DNA
taaatctcctcactcttg

SEQ ID NO: 51298 - DNA, 18 bp, Artificial Sequence
  Synthetic DNA
taaatgtacattatatag

SEQ ID NO: 51299 - DNA, 18 bp, Artificial Sequence
  Synthetic DNA
taaattaactcactaaag

SEQ ID NO: 51300 - DNA, 18 bp, Artificial Sequence
  Synthetic DNA
taaattaactctcaatag

SEQ ID NO: 51301 - DNA, 18 bp, Artificial Sequence
  Synthetic DNA
taaattgaatcccaatag

SEQ ID NO: 51302 - DNA, 18 bp, Artificial Sequence
  Synthetic DNA
taaattgagtcattatag

SEQ ID NO: 51303 - DNA, 18 bp, Artificial Sequence
  Synthetic DNA
taaattgcttcactatag

SEQ ID NO: 51304 - DNA, 18 bp, Artificial Sequence
  Synthetic DNA
taaattgtctcactaagg

SEQ ID NO: 51305 - DNA, 18 bp, Artificial Sequence
  Synthetic DNA
taaatttactcacaatcg

SEQ ID NO: 51306 - DNA, 18 bp, Artificial Sequence
  Synthetic DNA
taacaaaactcgcaacag

SEQ ID NO: 51307 - DNA, 18 bp, Artificial Sequence
  Synthetic DNA
taacaaaatatactaagg

SEQ ID NO: 51308 - DNA, 18 bp, Artificial Sequence
  Synthetic DNA
taacaacccacactatcg

SEQ ID NO: 51309 - DNA, 18 bp, Artificial Sequence
  Synthetic DNA
taacaaggctcacactag

SEQ ID NO: 51310 - DNA, 18 bp, Artificial Sequence
  Synthetic DNA
taacaagtttcactgttg

SEQ ID NO: 51311 - DNA, 18 bp, Artificial Sequence
  Synthetic DNA
taacaatactctcataag

SEQ ID NO: 51312 - DNA, 18 bp, Artificial Sequence
  Synthetic DNA
taacaatacttactctag

SEQ ID NO: 51313 - DNA, 18 bp, Artificial Sequence
  Synthetic DNA
taacacaaatccccaatg

SEQ ID NO: 51314 - DNA, 18 bp, Artificial Sequence
  Synthetic DNA
taacacaacttcctaaag

SEQ ID NO: 51315 - DNA, 18 bp, Artificial Sequence
  Synthetic DNA
taacacatctcaatattg

SEQ ID NO: 51316 - DNA, 18 bp, Artificial Sequence
  Synthetic DNA
taacaccacccttaatag

SEQ ID NO: 51317 - DNA, 18 bp, Artificial Sequence
  Synthetic DNA
taacaccactcagatttg

SEQ ID NO: 51318 - DNA, 18 bp, Artificial Sequence
  Synthetic DNA
taacaccagtaaatatag

SEQ ID NO: 51319 - DNA, 18 bp, Artificial Sequence
  Synthetic DNA
taacacccctttctatag

SEQ ID NO: 51320 - DNA, 18 bp, Artificial Sequence
  Synthetic DNA
taacacgaattcctctag

SEQ ID NO: 51321 - DNA, 18 bp, Artificial Sequence
  Synthetic DNA
taacacgacatattttag

SEQ ID NO: 51322 - DNA, 18 bp, Artificial Sequence
  Synthetic DNA
taacacgattcataattg

SEQ ID NO: 51323 - DNA, 18 bp, Artificial Sequence
  Synthetic DNA
taacacgccacattatcg

SEQ ID NO: 51324 - DNA, 18 bp, Artificial Sequence
  Synthetic DNA
taacacgcctagctactg

SEQ ID NO: 51325 - DNA, 18 bp, Artificial Sequence
  Synthetic DNA
taacacgtatctctctag

SEQ ID NO: 51326 - DNA, 18 bp, Artificial Sequence
  Synthetic DNA
taacacgtcactcatttg

SEQ ID NO: 51327 - DNA, 18 bp, Artificial Sequence
  Synthetic DNA
taacacgtccgttcatag

SEQ ID NO: 51328 - DNA, 18 bp, Artificial Sequence
  Synthetic DNA
taacacgtctaatcattg

SEQ ID NO: 51329 - DNA, 18 bp, Artificial Sequence
  Synthetic DNA
taacacgtctgaaaattg

SEQ ID NO: 51330 - DNA, 18 bp, Artificial Sequence
  Synthetic DNA
taacacgttccactacag

SEQ ID NO: 51331 - DNA, 18 bp, Artificial Sequence
  Synthetic DNA
taacactacactctatgg

SEQ ID NO: 51332 - DNA, 18 bp, Artificial Sequence
  Synthetic DNA
taacactactccacaaag

SEQ ID NO: 51333 - DNA, 18 bp, Artificial Sequence
  Synthetic DNA
taacactactctcttttg

SEQ ID NO: 51334 - DNA, 18 bp, Artificial Sequence
  Synthetic DNA
taacactagtcactacgg

SEQ ID NO: 51335 - DNA, 18 bp, Artificial Sequence
  Synthetic DNA
taacacttctcaacatag

SEQ ID NO: 51336 - DNA, 18 bp, Artificial Sequence
  Synthetic DNA
taacacttctctctcaag

SEQ ID NO: 51337 - DNA, 18 bp, Artificial Sequence
  Synthetic DNA
taacaggactttcgctag

SEQ ID NO: 51338 - DNA, 18 bp, Artificial Sequence
  Synthetic DNA
taacaggagtcacaagag

SEQ ID NO: 51339 - DNA, 18 bp, Artificial Sequence
  Synthetic DNA
taacaggtcacgctaaag

SEQ ID NO: 51340 - DNA, 18 bp, Artificial Sequence
  Synthetic DNA
taacaggtctcactcaag

SEQ ID NO: 51341 - DNA, 18 bp, Artificial Sequence
  Synthetic DNA
taacataattcactttag

SEQ ID NO: 51342 - DNA, 18 bp, Artificial Sequence
  Synthetic DNA
taacatcacttacattag

SEQ ID NO: 51343 - DNA, 18 bp, Artificial Sequence
  Synthetic DNA
taacatgagtctcaatag

SEQ ID NO: 51344 - DNA, 18 bp, Artificial Sequence
  Synthetic DNA
taacattactcgctaaag

SEQ ID NO: 51345 - DNA, 18 bp, Artificial Sequence
  Synthetic DNA
taaccacacacacataag

SEQ ID NO: 51346 - DNA, 18 bp, Artificial Sequence
  Synthetic DNA
taacccgactaactaacg

SEQ ID NO: 51347 - DNA, 18 bp, Artificial Sequence
  Synthetic DNA
taacccgattcacaattg

SEQ ID NO: 51348 - DNA, 18 bp, Artificial Sequence
  Synthetic DNA
taacgcaactctctaaag

SEQ ID NO: 51349 - DNA, 18 bp, Artificial Sequence
  Synthetic DNA
taacgcatcactctatag

SEQ ID NO: 51350 - DNA, 18 bp, Artificial Sequence
  Synthetic DNA
taacgcgaacgactatag

SEQ ID NO: 51351 - DNA, 18 bp, Artificial Sequence
  Synthetic DNA
taacgcgtctcgcactag

SEQ ID NO: 51352 - DNA, 18 bp, Artificial Sequence
  Synthetic DNA
taacgtgactgacaatag

SEQ ID NO: 51353 - DNA, 18 bp, Artificial Sequence
  Synthetic DNA
taactagattcactgtag

SEQ ID NO: 51354 - DNA, 18 bp, Artificial Sequence
  Synthetic DNA
taactagtctcactattg

SEQ ID NO: 51355 - DNA, 18 bp, Artificial Sequence
  Synthetic DNA
taactagtctcacttttg

SEQ ID NO: 51356 - DNA, 18 bp, Artificial Sequence
  Synthetic DNA
taactcgaataactaatg

SEQ ID NO: 51357 - DNA, 18 bp, Artificial Sequence
  Synthetic DNA
taactcgactaaccattg

SEQ ID NO: 51358 - DNA, 18 bp, Artificial Sequence
  Synthetic DNA
taactcgactcattaatg

SEQ ID NO: 51359 - DNA, 18 bp, Artificial Sequence
  Synthetic DNA
taactcgactgactctcg

SEQ ID NO: 51360 - DNA, 18 bp, Artificial Sequence
  Synthetic DNA
taactcgatttaatacag

SEQ ID NO: 51361 - DNA, 18 bp, Artificial Sequence
  Synthetic DNA
taactcgtctctctattg

SEQ ID NO: 51362 - DNA, 18 bp, Artificial Sequence
  Synthetic DNA
taactctacttgctatag

SEQ ID NO: 51363 - DNA, 18 bp, Artificial Sequence
  Synthetic DNA
taactcttataactgtag

SEQ ID NO: 51364 - DNA, 18 bp, Artificial Sequence
  Synthetic DNA
taactggacacagaatag

SEQ ID NO: 51365 - DNA, 18 bp, Artificial Sequence
  Synthetic DNA
taactggacccgctatag

SEQ ID NO: 51366 - DNA, 18 bp, Artificial Sequence
  Synthetic DNA
taacttttctatctatag

SEQ ID NO: 51367 - DNA, 18 bp, Artificial Sequence
  Synthetic DNA
taagaagattcacaaatg

SEQ ID NO: 51368 - DNA, 18 bp, Artificial Sequence
  Synthetic DNA
taagaagtctcgcaattg

SEQ ID NO: 51369 - DNA, 18 bp, Artificial Sequence
  Synthetic DNA
taagacaactatcttttg

SEQ ID NO: 51370 - DNA, 18 bp, Artificial Sequence
  Synthetic DNA
taagacaactttcaatag

SEQ ID NO: 51371 - DNA, 18 bp, Artificial Sequence
  Synthetic DNA
taagacaagccccaatag

SEQ ID NO: 51372 - DNA, 18 bp, Artificial Sequence
  Synthetic DNA
taagaccactgacttaag

SEQ ID NO: 51373 - DNA, 18 bp, Artificial Sequence
  Synthetic DNA
taagaccggtcaataaag

SEQ ID NO: 51374 - DNA, 18 bp, Artificial Sequence
  Synthetic DNA
taagacggcccagttaag

SEQ ID NO: 51375 - DNA, 18 bp, Artificial Sequence
  Synthetic DNA
taagacgtcactgtattg

SEQ ID NO: 51376 - DNA, 18 bp, Artificial Sequence
  Synthetic DNA
taagacgtctcatttagg

SEQ ID NO: 51377 - DNA, 18 bp, Artificial Sequence
  Synthetic DNA
taagacgtctctatactg

SEQ ID NO: 51378 - DNA, 18 bp, Artificial Sequence
  Synthetic DNA
taagacgttcgactttag

SEQ ID NO: 51379 - DNA, 18 bp, Artificial Sequence
  Synthetic DNA
taagactactcacttacg

SEQ ID NO: 51380 - DNA, 18 bp, Artificial Sequence
  Synthetic DNA
taagacttctcattaatg

SEQ ID NO: 51381 - DNA, 18 bp, Artificial Sequence
  Synthetic DNA
taagacttgccagtatag

SEQ ID NO: 51382 - DNA, 18 bp, Artificial Sequence
  Synthetic DNA
taagataacaaatcttag

SEQ ID NO: 51383 - DNA, 18 bp, Artificial Sequence
  Synthetic DNA
taagatgatacattatcg

SEQ ID NO: 51384 - DNA, 18 bp, Artificial Sequence
  Synthetic DNA
taagatgtctagatctag

SEQ ID NO: 51385 - DNA, 18 bp, Artificial Sequence
  Synthetic DNA
taagatgttacacaggcg

SEQ ID NO: 51386 - DNA, 18 bp, Artificial Sequence
  Synthetic DNA
taagcatacactctacag

SEQ ID NO: 51387 - DNA, 18 bp, Artificial Sequence
  Synthetic DNA
taagccgatacactgtag

SEQ ID NO: 51388 - DNA, 18 bp, Artificial Sequence
  Synthetic DNA
taaggcctctcaatcttg

SEQ ID NO: 51389 - DNA, 18 bp, Artificial Sequence
  Synthetic DNA
taagtcaattcactaaag

SEQ ID NO: 51390 - DNA, 18 bp, Artificial Sequence
  Synthetic DNA
taagtcctctctctctag

SEQ ID NO: 51391 - DNA, 18 bp, Artificial Sequence
  Synthetic DNA
taagtcgcctcactgagg

SEQ ID NO: 51392 - DNA, 18 bp, Artificial Sequence
  Synthetic DNA
taagtctactctctttag

SEQ ID NO: 51393 - DNA, 18 bp, Artificial Sequence
  Synthetic DNA
taagttgattctctatag

SEQ ID NO: 51394 - DNA, 18 bp, Artificial Sequence
  Synthetic DNA
taagttgtctcactgtag

SEQ ID NO: 51395 - DNA, 18 bp, Artificial Sequence
  Synthetic DNA
taagttgtctcgttatag

SEQ ID NO: 51396 - DNA, 18 bp, Artificial Sequence
  Synthetic DNA
taagttgttacacaattg

SEQ ID NO: 51397 - DNA, 18 bp, Artificial Sequence
  Synthetic DNA
taataaaacccactaacg

SEQ ID NO: 51398 - DNA, 18 bp, Artificial Sequence
  Synthetic DNA
taataaaagtctcaattg

SEQ ID NO: 51399 - DNA, 18 bp, Artificial Sequence
  Synthetic DNA
taataaaatacattatag

SEQ ID NO: 51400 - DNA, 18 bp, Artificial Sequence
  Synthetic DNA
taataaaatctactatag

SEQ ID NO: 51401 - DNA, 18 bp, Artificial Sequence
  Synthetic DNA
taataacaatctctacag

SEQ ID NO: 51402 - DNA, 18 bp, Artificial Sequence
  Synthetic DNA
taataagaatacgaatgg

SEQ ID NO: 51403 - DNA, 18 bp, Artificial Sequence
  Synthetic DNA
taataagacaaacttctg

SEQ ID NO: 51404 - DNA, 18 bp, Artificial Sequence
  Synthetic DNA
taataagacacaagatcg

SEQ ID NO: 51405 - DNA, 18 bp, Artificial Sequence
  Synthetic DNA
taataagacacacaaacg

SEQ ID NO: 51406 - DNA, 18 bp, Artificial Sequence
  Synthetic DNA
taataagacacacctaag

SEQ ID NO: 51407 - DNA, 18 bp, Artificial Sequence
  Synthetic DNA
taataagacacccaaaag

SEQ ID NO: 51408 - DNA, 18 bp, Artificial Sequence
  Synthetic DNA
taataagactcttaatgg

SEQ ID NO: 51409 - DNA, 18 bp, Artificial Sequence
  Synthetic DNA
taataagactgagtccag

SEQ ID NO: 51410 - DNA, 18 bp, Artificial Sequence
  Synthetic DNA
taataagacttgcatccg

SEQ ID NO: 51411 - DNA, 18 bp, Artificial Sequence
  Synthetic DNA
taataagatagtctatag

SEQ ID NO: 51412 - DNA, 18 bp, Artificial Sequence
  Synthetic DNA
taataagattaattttag

SEQ ID NO: 51413 - DNA, 18 bp, Artificial Sequence
  Synthetic DNA
taataagattcacctcag

SEQ ID NO: 51414 - DNA, 18 bp, Artificial Sequence
  Synthetic DNA
taataagccacaggatag

SEQ ID NO: 51415 - DNA, 18 bp, Artificial Sequence
  Synthetic DNA
taataagcctccttaaag

SEQ ID NO: 51416 - DNA, 18 bp, Artificial Sequence
  Synthetic DNA
taataagcctcgttattg

SEQ ID NO: 51417 - DNA, 18 bp, Artificial Sequence
  Synthetic DNA
taataagctacactaaag

SEQ ID NO: 51418 - DNA, 18 bp, Artificial Sequence
  Synthetic DNA
taataaggcaagtaatag

SEQ ID NO: 51419 - DNA, 18 bp, Artificial Sequence
  Synthetic DNA
taataaggcatacataag

SEQ ID NO: 51420 - DNA, 18 bp, Artificial Sequence
  Synthetic DNA
taataaggtttactaaag

SEQ ID NO: 51421 - DNA, 18 bp, Artificial Sequence
  Synthetic DNA
taataagtcacactaggg

SEQ ID NO: 51422 - DNA, 18 bp, Artificial Sequence
  Synthetic DNA
taataagtcctactttag

SEQ ID NO: 51423 - DNA, 18 bp, Artificial Sequence
  Synthetic DNA
taataagtctcaataagg

SEQ ID NO: 51424 - DNA, 18 bp, Artificial Sequence
  Synthetic DNA
taataagtctctaaactg

SEQ ID NO: 51425 - DNA, 18 bp, Artificial Sequence
  Synthetic DNA
taataagtctctttcttg

SEQ ID NO: 51426 - DNA, 18 bp, Artificial Sequence
  Synthetic DNA
taataagtctctttttcg

SEQ ID NO: 51427 - DNA, 18 bp, Artificial Sequence
  Synthetic DNA
taataagtcttacaaacg

SEQ ID NO: 51428 - DNA, 18 bp, Artificial Sequence
  Synthetic DNA
taataagtttcaaaacag

SEQ ID NO: 51429 - DNA, 18 bp, Artificial Sequence
  Synthetic DNA
taataatactaactgatg

SEQ ID NO: 51430 - DNA, 18 bp, Artificial Sequence
  Synthetic DNA
taataatccggactatag

SEQ ID NO: 51431 - DNA, 18 bp, Artificial Sequence
  Synthetic DNA
taataatcctccctttgg

SEQ ID NO: 51432 - DNA, 18 bp, Artificial Sequence
  Synthetic DNA
taataattctctctgtag

SEQ ID NO: 51433 - DNA, 18 bp, Artificial Sequence
  Synthetic DNA
taatacaaagcacttaag

SEQ ID NO: 51434 - DNA, 18 bp, Artificial Sequence
  Synthetic DNA
taatacaaataacaaaag

SEQ ID NO: 51435 - DNA, 18 bp, Artificial Sequence
  Synthetic DNA
taatacaaatctaattag

SEQ ID NO: 51436 - DNA, 18 bp, Artificial Sequence
  Synthetic DNA
taatacaacagcgtatag

SEQ ID NO: 51437 - DNA, 18 bp, Artificial Sequence
  Synthetic DNA
taatacaactaaaagtcg

SEQ ID NO: 51438 - DNA, 18 bp, Artificial Sequence
  Synthetic DNA
taatacaactaaaagttg

SEQ ID NO: 51439 - DNA, 18 bp, Artificial Sequence
  Synthetic DNA
taatacaactaacactcg

SEQ ID NO: 51440 - DNA, 18 bp, Artificial Sequence
  Synthetic DNA
taatacaactaattgaag

SEQ ID NO: 51441 - DNA, 18 bp, Artificial Sequence
  Synthetic DNA
taatacaactccgttgag

SEQ ID NO: 51442 - DNA, 18 bp, Artificial Sequence
  Synthetic DNA
taatacaactgacaactg

SEQ ID NO: 51443 - DNA, 18 bp, Artificial Sequence
  Synthetic DNA
taatacaacttaaatggg

SEQ ID NO: 51444 - DNA, 18 bp, Artificial Sequence
  Synthetic DNA
taatacaacttacaaagg

SEQ ID NO: 51445 - DNA, 18 bp, Artificial Sequence
  Synthetic DNA
taatacaacttacttccg

SEQ ID NO: 51446 - DNA, 18 bp, Artificial Sequence
  Synthetic DNA
taatacaagccagtagag

SEQ ID NO: 51447 - DNA, 18 bp, Artificial Sequence
  Synthetic DNA
taatacaatacaatctag

SEQ ID NO: 51448 - DNA, 18 bp, Artificial Sequence
  Synthetic DNA
taatacaatacacaaaag

SEQ ID NO: 51449 - DNA, 18 bp, Artificial Sequence
  Synthetic DNA
taatacaatacgctatgg

SEQ ID NO: 51450 - DNA, 18 bp, Artificial Sequence
  Synthetic DNA
taatacaatctactttag

SEQ ID NO: 51451 - DNA, 18 bp, Artificial Sequence
  Synthetic DNA
taatacaattcatttgag

SEQ ID NO: 51452 - DNA, 18 bp, Artificial Sequence
  Synthetic DNA
taatacaattcgttaaag

SEQ ID NO: 51453 - DNA, 18 bp, Artificial Sequence
  Synthetic DNA
taatacaatttgcaatag

SEQ ID NO: 51454 - DNA, 18 bp, Artificial Sequence
  Synthetic DNA
taatacaccgcacaaaag

SEQ ID NO: 51455 - DNA, 18 bp, Artificial Sequence
  Synthetic DNA
taatacacgttactttag

SEQ ID NO: 51456 - DNA, 18 bp, Artificial Sequence
  Synthetic DNA
taatacagaccactttag

SEQ ID NO: 51457 - DNA, 18 bp, Artificial Sequence
  Synthetic DNA
taatacataccatattag

SEQ ID NO: 51458 - DNA, 18 bp, Artificial Sequence
  Synthetic DNA
taatacatacttctattg

SEQ ID NO: 51459 - DNA, 18 bp, Artificial Sequence
  Synthetic DNA
taatacatatcagtatcg

SEQ ID NO: 51460 - DNA, 18 bp, Artificial Sequence
  Synthetic DNA
taatacatatcagtcaag

SEQ ID NO: 51461 - DNA, 18 bp, Artificial Sequence
  Synthetic DNA
taatacatcaacttttcg

SEQ ID NO: 51462 - DNA, 18 bp, Artificial Sequence
  Synthetic DNA
taatacatcactatatcg

SEQ ID NO: 51463 - DNA, 18 bp, Artificial Sequence
  Synthetic DNA
taatacatcccactttcg

SEQ ID NO: 51464 - DNA, 18 bp, Artificial Sequence
  Synthetic DNA
taatacatcgcccaatag

SEQ ID NO: 51465 - DNA, 18 bp, Artificial Sequence
  Synthetic DNA
taatacatctacctaaag

SEQ ID NO: 51466 - DNA, 18 bp, Artificial Sequence
  Synthetic DNA
taatacatgtcactaagg

SEQ ID NO: 51467 - DNA, 18 bp, Artificial Sequence
  Synthetic DNA
taataccacacgcattag

SEQ ID NO: 51468 - DNA, 18 bp, Artificial Sequence
  Synthetic DNA
taataccactagatcttg

SEQ ID NO: 51469 - DNA, 18 bp, Artificial Sequence
  Synthetic DNA
taataccacttacagctg

SEQ ID NO: 51470 - DNA, 18 bp, Artificial Sequence
  Synthetic DNA
taataccactttttttag

SEQ ID NO: 51471 - DNA, 18 bp, Artificial Sequence
  Synthetic DNA
taataccatctactcagg

SEQ ID NO: 51472 - DNA, 18 bp, Artificial Sequence
  Synthetic DNA
taataccattctaaatag

SEQ ID NO: 51473 - DNA, 18 bp, Artificial Sequence
  Synthetic DNA
taatacccactactatag

SEQ ID NO: 51474 - DNA, 18 bp, Artificial Sequence
  Synthetic DNA
taatacccccctcaatcg

SEQ ID NO: 51475 - DNA, 18 bp, Artificial Sequence
  Synthetic DNA
taataccccttaatttag

SEQ ID NO: 51476 - DNA, 18 bp, Artificial Sequence
  Synthetic DNA
taataccgctgaaaatag

SEQ ID NO: 51477 - DNA, 18 bp, Artificial Sequence
  Synthetic DNA
taatacctcaaattatag

SEQ ID NO: 51478 - DNA, 18 bp, Artificial Sequence
  Synthetic DNA
taatacctcatactattg

SEQ ID NO: 51479 - DNA, 18 bp, Artificial Sequence
  Synthetic DNA
taatacctctatcaaaag

SEQ ID NO: 51480 - DNA, 18 bp, Artificial Sequence
  Synthetic DNA
taatacctctctctgttg

SEQ ID NO: 51481 - DNA, 18 bp, Artificial Sequence
  Synthetic DNA
taatacctctctgtacag

SEQ ID NO: 51482 - DNA, 18 bp, Artificial Sequence
  Synthetic DNA
taatacctttctatggtg

SEQ ID NO: 51483 - DNA, 18 bp, Artificial Sequence
  Synthetic DNA
taatacctttgtcaatag

SEQ ID NO: 51484 - DNA, 18 bp, Artificial Sequence
  Synthetic DNA
taatacgaaacccaaaag

SEQ ID NO: 51485 - DNA, 18 bp, Artificial Sequence
  Synthetic DNA
taatacgaaacgccattg

SEQ ID NO: 51486 - DNA, 18 bp, Artificial Sequence
  Synthetic DNA
taatacgaaactcagttg

SEQ ID NO: 51487 - DNA, 18 bp, Artificial Sequence
  Synthetic DNA
taatacgaacgtctacag

SEQ ID NO: 51488 - DNA, 18 bp, Artificial Sequence
  Synthetic DNA
taatacgaatatcaatcg

SEQ ID NO: 51489 - DNA, 18 bp, Artificial Sequence
  Synthetic DNA
taatacgaatctcaaagg

SEQ ID NO: 51490 - DNA, 18 bp, Artificial Sequence
  Synthetic DNA
taatacgaattgctcaag

SEQ ID NO: 51491 - DNA, 18 bp, Artificial Sequence
  Synthetic DNA
taatacgacaaattgttg

SEQ ID NO: 51492 - DNA, 18 bp, Artificial Sequence
  Synthetic DNA
taatacgacacaaaaggg

SEQ ID NO: 51493 - DNA, 18 bp, Artificial Sequence
  Synthetic DNA
taatacgacaccgttttg

SEQ ID NO: 51494 - DNA, 18 bp, Artificial Sequence
  Synthetic DNA
taatacgacatataacag

SEQ ID NO: 51495 - DNA, 18 bp, Artificial Sequence
  Synthetic DNA
taatacgaccctgttaag

SEQ ID NO: 51496 - DNA, 18 bp, Artificial Sequence
  Synthetic DNA
taatacgacgctctcctg

SEQ ID NO: 51497 - DNA, 18 bp, Artificial Sequence
  Synthetic DNA
taatacgactaccaaatg

SEQ ID NO: 51498 - DNA, 18 bp, Artificial Sequence
  Synthetic DNA
taatacgactagtaaaag

SEQ ID NO: 51499 - DNA, 18 bp, Artificial Sequence
  Synthetic DNA
taatacgactctgttagg

SEQ ID NO: 51500 - DNA, 18 bp, Artificial Sequence
  Synthetic DNA
taatacgacttaaatttg

SEQ ID NO: 51501 - DNA, 18 bp, Artificial Sequence
  Synthetic DNA
taatacgactttttaatg

SEQ ID NO: 51502 - DNA, 18 bp, Artificial Sequence
  Synthetic DNA
taatacgagactacatag

SEQ ID NO: 51503 - DNA, 18 bp, Artificial Sequence
  Synthetic DNA
taatacgagactatagag

SEQ ID NO: 51504 - DNA, 18 bp, Artificial Sequence
  Synthetic DNA
taatacgagtaaaaattg

SEQ ID NO: 51505 - DNA, 18 bp, Artificial Sequence
  Synthetic DNA
taatacgatacactgcgg

SEQ ID NO: 51506 - DNA, 18 bp, Artificial Sequence
  Synthetic DNA
taatacgatacagttatg

SEQ ID NO: 51507 - DNA, 18 bp, Artificial Sequence
  Synthetic DNA
taatacgatcaaatttag

SEQ ID NO: 51508 - DNA, 18 bp, Artificial Sequence
  Synthetic DNA
taatacgatccgttattg

SEQ ID NO: 51509 - DNA, 18 bp, Artificial Sequence
  Synthetic DNA
taatacgatcgaataaag

SEQ ID NO: 51510 - DNA, 18 bp, Artificial Sequence
  Synthetic DNA
taatacgattcacctatg

SEQ ID NO: 51511 - DNA, 18 bp, Artificial Sequence
  Synthetic DNA
taatacgattcgttgaag

SEQ ID NO: 51512 - DNA, 18 bp, Artificial Sequence
  Synthetic DNA
taatacgattgatattag

SEQ ID NO: 51513 - DNA, 18 bp, Artificial Sequence
  Synthetic DNA
taatacgcatcaaaaaag

SEQ ID NO: 51514 - DNA, 18 bp, Artificial Sequence
  Synthetic DNA
taatacgccacgaattag

SEQ ID NO: 51515 - DNA, 18 bp, Artificial Sequence
  Synthetic DNA
taatacgcctctattaag

SEQ ID NO: 51516 - DNA, 18 bp, Artificial Sequence
  Synthetic DNA
taatacgcctctgaattg

SEQ ID NO: 51517 - DNA, 18 bp, Artificial Sequence
  Synthetic DNA
taatacgcctcttttctg

SEQ ID NO: 51518 - DNA, 18 bp, Artificial Sequence
  Synthetic DNA
taatacgccttattcatg

SEQ ID NO: 51519 - DNA, 18 bp, Artificial Sequence
  Synthetic DNA
taatacgctacaatcaag

SEQ ID NO: 51520 - DNA, 18 bp, Artificial Sequence
  Synthetic DNA
taatacgctccaactgag

SEQ ID NO: 51521 - DNA, 18 bp, Artificial Sequence
  Synthetic DNA
taatacgcttcataaaag

SEQ ID NO: 51522 - DNA, 18 bp, Artificial Sequence
  Synthetic DNA
taatacgcttccatgttg

SEQ ID NO: 51523 - DNA, 18 bp, Artificial Sequence
  Synthetic DNA
taatacggcgctcttaag

SEQ ID NO: 51524 - DNA, 18 bp, Artificial Sequence
  Synthetic DNA
taatacggcgttctcttg

SEQ ID NO: 51525 - DNA, 18 bp, Artificial Sequence
  Synthetic DNA
taatacgggttactccag

SEQ ID NO: 51526 - DNA, 18 bp, Artificial Sequence
  Synthetic DNA
taatacgtatctcctttg

SEQ ID NO: 51527 - DNA, 18 bp, Artificial Sequence
  Synthetic DNA
taatacgtattgcctcag

SEQ ID NO: 51528 - DNA, 18 bp, Artificial Sequence
  Synthetic DNA
taatacgtcaccatattg

SEQ ID NO: 51529 - DNA, 18 bp, Artificial Sequence
  Synthetic DNA
taatacgtcactcttatg

SEQ ID NO: 51530 - DNA, 18 bp, Artificial Sequence
  Synthetic DNA
taatacgtcaggaccatg

SEQ ID NO: 51531 - DNA, 18 bp, Artificial Sequence
  Synthetic DNA
taatacgtcatgataaag

SEQ ID NO: 51532 - DNA, 18 bp, Artificial Sequence
  Synthetic DNA
taatacgtcattatatgg

SEQ ID NO: 51533 - DNA, 18 bp, Artificial Sequence
  Synthetic DNA
taatacgtccaattattg

SEQ ID NO: 51534 - DNA, 18 bp, Artificial Sequence
  Synthetic DNA
taatacgtccccctcttg

SEQ ID NO: 51535 - DNA, 18 bp, Artificial Sequence
  Synthetic DNA
taatacgtctaacagatg

SEQ ID NO: 51536 - DNA, 18 bp, Artificial Sequence
  Synthetic DNA
taatacgtctaggtctag

SEQ ID NO: 51537 - DNA, 18 bp, Artificial Sequence
  Synthetic DNA
taatacgtctctcctttg

SEQ ID NO: 51538 - DNA, 18 bp, Artificial Sequence
  Synthetic DNA
taatacgtctgattttcg

SEQ ID NO: 51539 - DNA, 18 bp, Artificial Sequence
  Synthetic DNA
taatacgtcttacaaagg

SEQ ID NO: 51540 - DNA, 18 bp, Artificial Sequence
  Synthetic DNA
taatacgtcttccataag

SEQ ID NO: 51541 - DNA, 18 bp, Artificial Sequence
  Synthetic DNA
taatacgtgacactctcg

SEQ ID NO: 51542 - DNA, 18 bp, Artificial Sequence
  Synthetic DNA
taatacgtgactttatag

SEQ ID NO: 51543 - DNA, 18 bp, Artificial Sequence
  Synthetic DNA
taatacgtgccacgacag

SEQ ID NO: 51544 - DNA, 18 bp, Artificial Sequence
  Synthetic DNA
taatacgtgtaactcaag

SEQ ID NO: 51545 - DNA, 18 bp, Artificial Sequence
  Synthetic DNA
taatacgttacactaatg

SEQ ID NO: 51546 - DNA, 18 bp, Artificial Sequence
  Synthetic DNA
taatacgttcttctatcg

SEQ ID NO: 51547 - DNA, 18 bp, Artificial Sequence
  Synthetic DNA
taatacgtttatcaagag

SEQ ID NO: 51548 - DNA, 18 bp, Artificial Sequence
  Synthetic DNA
taatacgtttatctaaag

SEQ ID NO: 51549 - DNA, 18 bp, Artificial Sequence
  Synthetic DNA
taatacgtttcttaattg

SEQ ID NO: 51550 - DNA, 18 bp, Artificial Sequence
  Synthetic DNA
taatacgttttacgacag

SEQ ID NO: 51551 - DNA, 18 bp, Artificial Sequence
  Synthetic DNA
taatacgttttgctatcg

SEQ ID NO: 51552 - DNA, 18 bp, Artificial Sequence
  Synthetic DNA
taatactaacaactattg

SEQ ID NO: 51553 - DNA, 18 bp, Artificial Sequence
  Synthetic DNA
taatactaatcaacaaag

SEQ ID NO: 51554 - DNA, 18 bp, Artificial Sequence
  Synthetic DNA
taatactaatgtgtattg

SEQ ID NO: 51555 - DNA, 18 bp, Artificial Sequence
  Synthetic DNA
taatactacacacatcag

SEQ ID NO: 51556 - DNA, 18 bp, Artificial Sequence
  Synthetic DNA
taatactacagaaagtag

SEQ ID NO: 51557 - DNA, 18 bp, Artificial Sequence
  Synthetic DNA
taatactacccaattaag

SEQ ID NO: 51558 - DNA, 18 bp, Artificial Sequence
  Synthetic DNA
taatactactaataaaag

SEQ ID NO: 51559 - DNA, 18 bp, Artificial Sequence
  Synthetic DNA
taatactactacatagag

SEQ ID NO: 51560 - DNA, 18 bp, Artificial Sequence
  Synthetic DNA
taatactactctatttcg

SEQ ID NO: 51561 - DNA, 18 bp, Artificial Sequence
  Synthetic DNA
taatactactgtttcttg

SEQ ID NO: 51562 - DNA, 18 bp, Artificial Sequence
  Synthetic DNA
taatactacttcttatcg

SEQ ID NO: 51563 - DNA, 18 bp, Artificial Sequence
  Synthetic DNA
taatactagtcagtctcg

SEQ ID NO: 51564 - DNA, 18 bp, Artificial Sequence
  Synthetic DNA
taatactagtgactaacg

SEQ ID NO: 51565 - DNA, 18 bp, Artificial Sequence
  Synthetic DNA
taatactataaatattcg

SEQ ID NO: 51566 - DNA, 18 bp, Artificial Sequence
  Synthetic DNA
taatactatatgctacag

SEQ ID NO: 51567 - DNA, 18 bp, Artificial Sequence
  Synthetic DNA
taatactatcctccatgg

SEQ ID NO: 51568 - DNA, 18 bp, Artificial Sequence
  Synthetic DNA
taatactattatttatcg

SEQ ID NO: 51569 - DNA, 18 bp, Artificial Sequence
  Synthetic DNA
taatactattttatatag

SEQ ID NO: 51570 - DNA, 18 bp, Artificial Sequence
  Synthetic DNA
taatactcaacattccag

SEQ ID NO: 51571 - DNA, 18 bp, Artificial Sequence
  Synthetic DNA
taatactcatctcaatgg

SEQ ID NO: 51572 - DNA, 18 bp, Artificial Sequence
  Synthetic DNA
taatactccttacttttg

SEQ ID NO: 51573 - DNA, 18 bp, Artificial Sequence
  Synthetic DNA
taatactcgtaactagag

SEQ ID NO: 51574 - DNA, 18 bp, Artificial Sequence
  Synthetic DNA
taatactctttaaatcag

SEQ ID NO: 51575 - DNA, 18 bp, Artificial Sequence
  Synthetic DNA
taatactgaaaacaaaag

SEQ ID NO: 51576 - DNA, 18 bp, Artificial Sequence
  Synthetic DNA
taatactgatcgctacag

SEQ ID NO: 51577 - DNA, 18 bp, Artificial Sequence
  Synthetic DNA
taatactgctcacataag

SEQ ID NO: 51578 - DNA, 18 bp, Artificial Sequence
  Synthetic DNA
taatactgttatcctaag

SEQ ID NO: 51579 - DNA, 18 bp, Artificial Sequence
  Synthetic DNA
taatacttatgattcttg

SEQ ID NO: 51580 - DNA, 18 bp, Artificial Sequence
  Synthetic DNA
taatacttattactagag

SEQ ID NO: 51581 - DNA, 18 bp, Artificial Sequence
  Synthetic DNA
taatacttcaacctttag

SEQ ID NO: 51582 - DNA, 18 bp, Artificial Sequence
  Synthetic DNA
taatacttcacatatgtg

SEQ ID NO: 51583 - DNA, 18 bp, Artificial Sequence
  Synthetic DNA
taatacttcatacaatag

SEQ ID NO: 51584 - DNA, 18 bp, Artificial Sequence
  Synthetic DNA
taatacttcccttcatag

SEQ ID NO: 51585 - DNA, 18 bp, Artificial Sequence
  Synthetic DNA
taatacttctcataattg

SEQ ID NO: 51586 - DNA, 18 bp, Artificial Sequence
  Synthetic DNA
taatacttctgataatag

SEQ ID NO: 51587 - DNA, 18 bp, Artificial Sequence
  Synthetic DNA
taatacttcttacaacag

SEQ ID NO: 51588 - DNA, 18 bp, Artificial Sequence
  Synthetic DNA
taatacttcttactggag

SEQ ID NO: 51589 - DNA, 18 bp, Artificial Sequence
  Synthetic DNA
taatacttgacgctactg

SEQ ID NO: 51590 - DNA, 18 bp, Artificial Sequence
  Synthetic DNA
taatacttgtctctacag

SEQ ID NO: 51591 - DNA, 18 bp, Artificial Sequence
  Synthetic DNA
taatacttttcacgtaag

SEQ ID NO: 51592 - DNA, 18 bp, Artificial Sequence
  Synthetic DNA
taatacttttctcaacag

SEQ ID NO: 51593 - DNA, 18 bp, Artificial Sequence
  Synthetic DNA
taatacttttgactaaag

SEQ ID NO: 51594 - DNA, 18 bp, Artificial Sequence
  Synthetic DNA
taatagaacatgctctag

SEQ ID NO: 51595 - DNA, 18 bp, Artificial Sequence
  Synthetic DNA
taatagaactaccacttg

SEQ ID NO: 51596 - DNA, 18 bp, Artificial Sequence
  Synthetic DNA
taatagaactctttaaag

SEQ ID NO: 51597 - DNA, 18 bp, Artificial Sequence
  Synthetic DNA
taatagcaatctcaaaag

SEQ ID NO: 51598 - DNA, 18 bp, Artificial Sequence
  Synthetic DNA
taatagcattaacagttg

SEQ ID NO: 51599 - DNA, 18 bp, Artificial Sequence
  Synthetic DNA
taatagctgacagtcaag

SEQ ID NO: 51600 - DNA, 18 bp, Artificial Sequence
  Synthetic DNA
taataggaatcgcaaatg

SEQ ID NO: 51601 - DNA, 18 bp, Artificial Sequence
  Synthetic DNA
taataggaattggtattg

SEQ ID NO: 51602 - DNA, 18 bp, Artificial Sequence
  Synthetic DNA
taataggacaccaaatag

SEQ ID NO: 51603 - DNA, 18 bp, Artificial Sequence
  Synthetic DNA
taataggacagacaaaag

SEQ ID NO: 51604 - DNA, 18 bp, Artificial Sequence
  Synthetic DNA
taataggacgtacagtag

SEQ ID NO: 51605 - DNA, 18 bp, Artificial Sequence
  Synthetic DNA
taataggactcccatatg

SEQ ID NO: 51606 - DNA, 18 bp, Artificial Sequence
  Synthetic DNA
taataggactcgcttacg

SEQ ID NO: 51607 - DNA, 18 bp, Artificial Sequence
  Synthetic DNA
taataggacttacgcttg

SEQ ID NO: 51608 - DNA, 18 bp, Artificial Sequence
  Synthetic DNA
taataggagacacagttg

SEQ ID NO: 51609 - DNA, 18 bp, Artificial Sequence
  Synthetic DNA
taataggagtcacttgtg

SEQ ID NO: 51610 - DNA, 18 bp, Artificial Sequence
  Synthetic DNA
taataggagtctcgattg

SEQ ID NO: 51611 - DNA, 18 bp, Artificial Sequence
  Synthetic DNA
taataggatacgttaaag

SEQ ID NO: 51612 - DNA, 18 bp, Artificial Sequence
  Synthetic DNA
taataggattatcataag

SEQ ID NO: 51613 - DNA, 18 bp, Artificial Sequence
  Synthetic DNA
taataggatttacactcg

SEQ ID NO: 51614 - DNA, 18 bp, Artificial Sequence
  Synthetic DNA
taataggattttcaattg

SEQ ID NO: 51615 - DNA, 18 bp, Artificial Sequence
  Synthetic DNA
taataggattttgtacag

SEQ ID NO: 51616 - DNA, 18 bp, Artificial Sequence
  Synthetic DNA
taataggcataactttcg

SEQ ID NO: 51617 - DNA, 18 bp, Artificial Sequence
  Synthetic DNA
taatagggcactctatgg

SEQ ID NO: 51618 - DNA, 18 bp, Artificial Sequence
  Synthetic DNA
taataggtatcgcaatag

SEQ ID NO: 51619 - DNA, 18 bp, Artificial Sequence
  Synthetic DNA
taataggtcaatcaatag

SEQ ID NO: 51620 - DNA, 18 bp, Artificial Sequence
  Synthetic DNA
taataggtcgtagtatag

SEQ ID NO: 51621 - DNA, 18 bp, Artificial Sequence
  Synthetic DNA
taataggtctaataaaag

SEQ ID NO: 51622 - DNA, 18 bp, Artificial Sequence
  Synthetic DNA
taataggtctcacttatg

SEQ ID NO: 51623 - DNA, 18 bp, Artificial Sequence
  Synthetic DNA
taataggtttaaatatag

SEQ ID NO: 51624 - DNA, 18 bp, Artificial Sequence
  Synthetic DNA
taataggtttcattttag

SEQ ID NO: 51625 - DNA, 18 bp, Artificial Sequence
  Synthetic DNA
taatagtacccacttttg

SEQ ID NO: 51626 - DNA, 18 bp, Artificial Sequence
  Synthetic DNA
taatagtactcagtaatg

SEQ ID NO: 51627 - DNA, 18 bp, Artificial Sequence
  Synthetic DNA
taatagtattctttatag

SEQ ID NO: 51628 - DNA, 18 bp, Artificial Sequence
  Synthetic DNA
taatagtgcttaaactgg

SEQ ID NO: 51629 - DNA, 18 bp, Artificial Sequence
  Synthetic DNA
taatataaattattatag

SEQ ID NO: 51630 - DNA, 18 bp, Artificial Sequence
  Synthetic DNA
taatataacactttatgg

SEQ ID NO: 51631 - DNA, 18 bp, Artificial Sequence
  Synthetic DNA
taatataacatacaagag

SEQ ID NO: 51632 - DNA, 18 bp, Artificial Sequence
  Synthetic DNA
taatataactaatttaag

SEQ ID NO: 51633 - DNA, 18 bp, Artificial Sequence
  Synthetic DNA
taatataactcaaacctg

SEQ ID NO: 51634 - DNA, 18 bp, Artificial Sequence
  Synthetic DNA
taatataactgacttaag

SEQ ID NO: 51635 - DNA, 18 bp, Artificial Sequence
  Synthetic DNA
taatataataaactattg

SEQ ID NO: 51636 - DNA, 18 bp, Artificial Sequence
  Synthetic DNA
taatataattcatcattg

SEQ ID NO: 51637 - DNA, 18 bp, Artificial Sequence
  Synthetic DNA
taatatcaatcactaacg

SEQ ID NO: 51638 - DNA, 18 bp, Artificial Sequence
  Synthetic DNA
taatatcaattacttctg

SEQ ID NO: 51639 - DNA, 18 bp, Artificial Sequence
  Synthetic DNA
taatatcacacaatctag

SEQ ID NO: 51640 - DNA, 18 bp, Artificial Sequence
  Synthetic DNA
taatatcactgataatag

SEQ ID NO: 51641 - DNA, 18 bp, Artificial Sequence
  Synthetic DNA
taatatcactgtcattgg

SEQ ID NO: 51642 - DNA, 18 bp, Artificial Sequence
  Synthetic DNA
taatatctctgaatatag

SEQ ID NO: 51643 - DNA, 18 bp, Artificial Sequence
  Synthetic DNA
taatatgaaccttaatag

SEQ ID NO: 51644 - DNA, 18 bp, Artificial Sequence
  Synthetic DNA
taatatgaactaaactag

SEQ ID NO: 51645 - DNA, 18 bp, Artificial Sequence
  Synthetic DNA
taatatgaagatctctag

SEQ ID NO: 51646 - DNA, 18 bp, Artificial Sequence
  Synthetic DNA
taatatgaatttcaattg

SEQ ID NO: 51647 - DNA, 18 bp, Artificial Sequence
  Synthetic DNA
taatatgacaaaatgtag

SEQ ID NO: 51648 - DNA, 18 bp, Artificial Sequence
  Synthetic DNA
taatatgaccctctaagg

SEQ ID NO: 51649 - DNA, 18 bp, Artificial Sequence
  Synthetic DNA
taatatgactctttaagg

SEQ ID NO: 51650 - DNA, 18 bp, Artificial Sequence
  Synthetic DNA
taatatgactctttcaag

SEQ ID NO: 51651 - DNA, 18 bp, Artificial Sequence
  Synthetic DNA
taatatgagtcgcttgag

SEQ ID NO: 51652 - DNA, 18 bp, Artificial Sequence
  Synthetic DNA
taatatgagtggttatcg

SEQ ID NO: 51653 - DNA, 18 bp, Artificial Sequence
  Synthetic DNA
taatatgatacatttaag

SEQ ID NO: 51654 - DNA, 18 bp, Artificial Sequence
  Synthetic DNA
taatatgattcacatgag

SEQ ID NO: 51655 - DNA, 18 bp, Artificial Sequence
  Synthetic DNA
taatatgattcatcatcg

SEQ ID NO: 51656 - DNA, 18 bp, Artificial Sequence
  Synthetic DNA
taatatgattctcaatgg

SEQ ID NO: 51657 - DNA, 18 bp, Artificial Sequence
  Synthetic DNA
taatatgcctgaccttag

SEQ ID NO: 51658 - DNA, 18 bp, Artificial Sequence
  Synthetic DNA
taatatggcacttaatag

SEQ ID NO: 51659 - DNA, 18 bp, Artificial Sequence
  Synthetic DNA
taatatggctaacttacg

SEQ ID NO: 51660 - DNA, 18 bp, Artificial Sequence
  Synthetic DNA
taatatggctcgcttttg

SEQ ID NO: 51661 - DNA, 18 bp, Artificial Sequence
  Synthetic DNA
taatatgtcatgctatag

SEQ ID NO: 51662 - DNA, 18 bp, Artificial Sequence
  Synthetic DNA
taatatgtcccacactag

SEQ ID NO: 51663 - DNA, 18 bp, Artificial Sequence
  Synthetic DNA
taatatgtctatctattg

SEQ ID NO: 51664 - DNA, 18 bp, Artificial Sequence
  Synthetic DNA
taatatgtgtcgctttag

SEQ ID NO: 51665 - DNA, 18 bp, Artificial Sequence
  Synthetic DNA
taatatgtgttaaatgag

SEQ ID NO: 51666 - DNA, 18 bp, Artificial Sequence
  Synthetic DNA
taatattaataactacag

SEQ ID NO: 51667 - DNA, 18 bp, Artificial Sequence
  Synthetic DNA
taatattacacaatctag

SEQ ID NO: 51668 - DNA, 18 bp, Artificial Sequence
  Synthetic DNA
taatattacacgccaaag

SEQ ID NO: 51669 - DNA, 18 bp, Artificial Sequence
  Synthetic DNA
taatattactctcatttg

SEQ ID NO: 51670 - DNA, 18 bp, Artificial Sequence
  Synthetic DNA
taatattagtcataatag

SEQ ID NO: 51671 - DNA, 18 bp, Artificial Sequence
  Synthetic DNA
taatattcctcatgttgg

SEQ ID NO: 51672 - DNA, 18 bp, Artificial Sequence
  Synthetic DNA
taatatttttctcaattg

SEQ ID NO: 51673 - DNA, 18 bp, Artificial Sequence
  Synthetic DNA
taatcaatctcacctttg

SEQ ID NO: 51674 - DNA, 18 bp, Artificial Sequence
  Synthetic DNA
taatcactctcactatgg

SEQ ID NO: 51675 - DNA, 18 bp, Artificial Sequence
  Synthetic DNA
taatcagaaatacaattg

SEQ ID NO: 51676 - DNA, 18 bp, Artificial Sequence
  Synthetic DNA
taatcagcctaactagag

SEQ ID NO: 51677 - DNA, 18 bp, Artificial Sequence
  Synthetic DNA
taatcagggtgtctatag

SEQ ID NO: 51678 - DNA, 18 bp, Artificial Sequence
  Synthetic DNA
taatcagtctcttaattg

SEQ ID NO: 51679 - DNA, 18 bp, Artificial Sequence
  Synthetic DNA
taatccaattcctaatag

SEQ ID NO: 51680 - DNA, 18 bp, Artificial Sequence
  Synthetic DNA
taatccagcttacaatcg

SEQ ID NO: 51681 - DNA, 18 bp, Artificial Sequence
  Synthetic DNA
taatccatcccactattg

SEQ ID NO: 51682 - DNA, 18 bp, Artificial Sequence
  Synthetic DNA
taatccatctcgctaaag

SEQ ID NO: 51683 - DNA, 18 bp, Artificial Sequence
  Synthetic DNA
taatcccaatttctatag

SEQ ID NO: 51684 - DNA, 18 bp, Artificial Sequence
  Synthetic DNA
taatcccactccacgtag

SEQ ID NO: 51685 - DNA, 18 bp, Artificial Sequence
  Synthetic DNA
taatcccgcacattatag

SEQ ID NO: 51686 - DNA, 18 bp, Artificial Sequence
  Synthetic DNA
taatccctctcacaagag

SEQ ID NO: 51687 - DNA, 18 bp, Artificial Sequence
  Synthetic DNA
taatccgacaaacggtag

SEQ ID NO: 51688 - DNA, 18 bp, Artificial Sequence
  Synthetic DNA
taatccgacactcacttg

SEQ ID NO: 51689 - DNA, 18 bp, Artificial Sequence
  Synthetic DNA
taatccgactcattgatg

SEQ ID NO: 51690 - DNA, 18 bp, Artificial Sequence
  Synthetic DNA
taatccgagctaccttag

SEQ ID NO: 51691 - DNA, 18 bp, Artificial Sequence
  Synthetic DNA
taatccgattcctaattg

SEQ ID NO: 51692 - DNA, 18 bp, Artificial Sequence
  Synthetic DNA
taatccgccacactgaag

SEQ ID NO: 51693 - DNA, 18 bp, Artificial Sequence
  Synthetic DNA
taatccgcctattcttag

SEQ ID NO: 51694 - DNA, 18 bp, Artificial Sequence
  Synthetic DNA
taatccggcacataatag

SEQ ID NO: 51695 - DNA, 18 bp, Artificial Sequence
  Synthetic DNA
taatccggctctcatttg

SEQ ID NO: 51696 - DNA, 18 bp, Artificial Sequence
  Synthetic DNA
taatccggtctgctcttg

SEQ ID NO: 51697 - DNA, 18 bp, Artificial Sequence
  Synthetic DNA
taatccggttcttcatcg

SEQ ID NO: 51698 - DNA, 18 bp, Artificial Sequence
  Synthetic DNA
taatccgtaaccctatag

SEQ ID NO: 51699 - DNA, 18 bp, Artificial Sequence
  Synthetic DNA
taatccgtatctgtatag

SEQ ID NO: 51700 - DNA, 18 bp, Artificial Sequence
  Synthetic DNA
taatccgttccaccatag

SEQ ID NO: 51701 - DNA, 18 bp, Artificial Sequence
  Synthetic DNA
taatcctacccactactg

SEQ ID NO: 51702 - DNA, 18 bp, Artificial Sequence
  Synthetic DNA
taatcctactcaatcaag

SEQ ID NO: 51703 - DNA, 18 bp, Artificial Sequence
  Synthetic DNA
taatcggaaacagaatcg

SEQ ID NO: 51704 - DNA, 18 bp, Artificial Sequence
  Synthetic DNA
taatcggtcttactaaag

SEQ ID NO: 51705 - DNA, 18 bp, Artificial Sequence
  Synthetic DNA
taatctatatcaccttag

SEQ ID NO: 51706 - DNA, 18 bp, Artificial Sequence
  Synthetic DNA
taatctgactctgataag

SEQ ID NO: 51707 - DNA, 18 bp, Artificial Sequence
  Synthetic DNA
taatctgacttactttgg

SEQ ID NO: 51708 - DNA, 18 bp, Artificial Sequence
  Synthetic DNA
taatctgcgagacttaag

SEQ ID NO: 51709 - DNA, 18 bp, Artificial Sequence
  Synthetic DNA
taatctgtcccactaaag

SEQ ID NO: 51710 - DNA, 18 bp, Artificial Sequence
  Synthetic DNA
taatgactctcactaatg

SEQ ID NO: 51711 - DNA, 18 bp, Artificial Sequence
  Synthetic DNA
taatgagactcacagaag

SEQ ID NO: 51712 - DNA, 18 bp, Artificial Sequence
  Synthetic DNA
taatgagcctaactattg

SEQ ID NO: 51713 - DNA, 18 bp, Artificial Sequence
  Synthetic DNA
taatgataatcgctattg

SEQ ID NO: 51714 - DNA, 18 bp, Artificial Sequence
  Synthetic DNA
taatgattttcactcaag

SEQ ID NO: 51715 - DNA, 18 bp, Artificial Sequence
  Synthetic DNA
taatgcaaccaattatag

SEQ ID NO: 51716 - DNA, 18 bp, Artificial Sequence
  Synthetic DNA
taatgcaactcggaatag

SEQ ID NO: 51717 - DNA, 18 bp, Artificial Sequence
  Synthetic DNA
taatgcaactctacatag

SEQ ID NO: 51718 - DNA, 18 bp, Artificial Sequence
  Synthetic DNA
taatgcagctctctagag

SEQ ID NO: 51719 - DNA, 18 bp, Artificial Sequence
  Synthetic DNA
taatgccacactatattg

SEQ ID NO: 51720 - DNA, 18 bp, Artificial Sequence
  Synthetic DNA
taatgccacagccaatag

SEQ ID NO: 51721 - DNA, 18 bp, Artificial Sequence
  Synthetic DNA
taatgccattctcctttg

SEQ ID NO: 51722 - DNA, 18 bp, Artificial Sequence
  Synthetic DNA
taatgcgaatcttggtag

SEQ ID NO: 51723 - DNA, 18 bp, Artificial Sequence
  Synthetic DNA
taatgcgaattacacaag

SEQ ID NO: 51724 - DNA, 18 bp, Artificial Sequence
  Synthetic DNA
taatgcgaattacgttag

SEQ ID NO: 51725 - DNA, 18 bp, Artificial Sequence
  Synthetic DNA
taatgcgacaccttaaag

SEQ ID NO: 51726 - DNA, 18 bp, Artificial Sequence
  Synthetic DNA
taatgcgacactataaag

SEQ ID NO: 51727 - DNA, 18 bp, Artificial Sequence
  Synthetic DNA
taatgcgacactatattg

SEQ ID NO: 51728 - DNA, 18 bp, Artificial Sequence
  Synthetic DNA
taatgcgaccgtctaaag

SEQ ID NO: 51729 - DNA, 18 bp, Artificial Sequence
  Synthetic DNA
taatgcgacctacttatg

SEQ ID NO: 51730 - DNA, 18 bp, Artificial Sequence
  Synthetic DNA
taatgcgacgtacaatcg

SEQ ID NO: 51731 - DNA, 18 bp, Artificial Sequence
  Synthetic DNA
taatgcgagagaccagcg

SEQ ID NO: 51732 - DNA, 18 bp, Artificial Sequence
  Synthetic DNA
taatgcgatagaatttag

SEQ ID NO: 51733 - DNA, 18 bp, Artificial Sequence
  Synthetic DNA
taatgcgatatacaatag

SEQ ID NO: 51734 - DNA, 18 bp, Artificial Sequence
  Synthetic DNA
taatgcgccccacactag

SEQ ID NO: 51735 - DNA, 18 bp, Artificial Sequence
  Synthetic DNA
taatgcgcttcaccatgg

SEQ ID NO: 51736 - DNA, 18 bp, Artificial Sequence
  Synthetic DNA
taatgcgtcgtacaatag

SEQ ID NO: 51737 - DNA, 18 bp, Artificial Sequence
  Synthetic DNA
taatgcgtctaacactgg

SEQ ID NO: 51738 - DNA, 18 bp, Artificial Sequence
  Synthetic DNA
taatgcgtttcaatattg

SEQ ID NO: 51739 - DNA, 18 bp, Artificial Sequence
  Synthetic DNA
taatgctaatctctatgg

SEQ ID NO: 51740 - DNA, 18 bp, Artificial Sequence
  Synthetic DNA
taatgctaccccctattg

SEQ ID NO: 51741 - DNA, 18 bp, Artificial Sequence
  Synthetic DNA
taatgctactcacagagg

SEQ ID NO: 51742 - DNA, 18 bp, Artificial Sequence
  Synthetic DNA
taatgctagttaatcaag

SEQ ID NO: 51743 - DNA, 18 bp, Artificial Sequence
  Synthetic DNA
taatgggacagacaaaag

SEQ ID NO: 51744 - DNA, 18 bp, Artificial Sequence
  Synthetic DNA
taatgggactctccacag

SEQ ID NO: 51745 - DNA, 18 bp, Artificial Sequence
  Synthetic DNA
taatggttcttactatag

SEQ ID NO: 51746 - DNA, 18 bp, Artificial Sequence
  Synthetic DNA
taatgtaacccggtatag

SEQ ID NO: 51747 - DNA, 18 bp, Artificial Sequence
  Synthetic DNA
taatgtaatacacttaag

SEQ ID NO: 51748 - DNA, 18 bp, Artificial Sequence
  Synthetic DNA
taatgtgactcaaaattg

SEQ ID NO: 51749 - DNA, 18 bp, Artificial Sequence
  Synthetic DNA
taatgtgattctctctag

SEQ ID NO: 51750 - DNA, 18 bp, Artificial Sequence
  Synthetic DNA
taatgtgcctcactgttg

SEQ ID NO: 51751 - DNA, 18 bp, Artificial Sequence
  Synthetic DNA
taatgtggcccactctag

SEQ ID NO: 51752 - DNA, 18 bp, Artificial Sequence
  Synthetic DNA
taatgttactgtctaagg

SEQ ID NO: 51753 - DNA, 18 bp, Artificial Sequence
  Synthetic DNA
taatgttattctcaatag

SEQ ID NO: 51754 - DNA, 18 bp, Artificial Sequence
  Synthetic DNA
taattaaacacactctgg

SEQ ID NO: 51755 - DNA, 18 bp, Artificial Sequence
  Synthetic DNA
taattaaacccactaaag

SEQ ID NO: 51756 - DNA, 18 bp, Artificial Sequence
  Synthetic DNA
taattacacactctaaat

SEQ ID NO: 51757 - DNA, 18 bp, Artificial Sequence
  Synthetic DNA
taattacagttagtatag

SEQ ID NO: 51758 - DNA, 18 bp, Artificial Sequence
  Synthetic DNA
taattagaacccctaaag

SEQ ID NO: 51759 - DNA, 18 bp, Artificial Sequence
  Synthetic DNA
taattagaattcctgtag

SEQ ID NO: 51760 - DNA, 18 bp, Artificial Sequence
  Synthetic DNA
taattagacaaaccaagg

SEQ ID NO: 51761 - DNA, 18 bp, Artificial Sequence
  Synthetic DNA
taattagacccgcctgag

SEQ ID NO: 51762 - DNA, 18 bp, Artificial Sequence
  Synthetic DNA
taattagactcaacattg

SEQ ID NO: 51763 - DNA, 18 bp, Artificial Sequence
  Synthetic DNA
taattagactctcttgag

SEQ ID NO: 51764 - DNA, 18 bp, Artificial Sequence
  Synthetic DNA
taattagacttgcgattg

SEQ ID NO: 51765 - DNA, 18 bp, Artificial Sequence
  Synthetic DNA
taattagattccccaaag

SEQ ID NO: 51766 - DNA, 18 bp, Artificial Sequence
  Synthetic DNA
taattagccccaccatag

SEQ ID NO: 51767 - DNA, 18 bp, Artificial Sequence
  Synthetic DNA
taattagcttcgatatag

SEQ ID NO: 51768 - DNA, 18 bp, Artificial Sequence
  Synthetic DNA
taattagtcacacttcag

SEQ ID NO: 51769 - DNA, 18 bp, Artificial Sequence
  Synthetic DNA
taattagtcactcaatag

SEQ ID NO: 51770 - DNA, 18 bp, Artificial Sequence
  Synthetic DNA
taattagtcccaataatg

SEQ ID NO: 51771 - DNA, 18 bp, Artificial Sequence
  Synthetic DNA
taattagtctcgctaaag

SEQ ID NO: 51772 - DNA, 18 bp, Artificial Sequence
  Synthetic DNA
taattagtctctctacag

SEQ ID NO: 51773 - DNA, 18 bp, Artificial Sequence
  Synthetic DNA
taattagtctctcttttg

SEQ ID NO: 51774 - DNA, 18 bp, Artificial Sequence
  Synthetic DNA
taattagtctgaattaag

SEQ ID NO: 51775 - DNA, 18 bp, Artificial Sequence
  Synthetic DNA
taattagttgcactgtag

SEQ ID NO: 51776 - DNA, 18 bp, Artificial Sequence
  Synthetic DNA
taattagtttcgctatag

SEQ ID NO: 51777 - DNA, 18 bp, Artificial Sequence
  Synthetic DNA
taattatattcaataatg

SEQ ID NO: 51778 - DNA, 18 bp, Artificial Sequence
  Synthetic DNA
taattcaacccattatgg

SEQ ID NO: 51779 - DNA, 18 bp, Artificial Sequence
  Synthetic DNA
taattcaactcaaaacgg

SEQ ID NO: 51780 - DNA, 18 bp, Artificial Sequence
  Synthetic DNA
taattcaactctgtattg

SEQ ID NO: 51781 - DNA, 18 bp, Artificial Sequence
  Synthetic DNA
taattcaactttctttcg

SEQ ID NO: 51782 - DNA, 18 bp, Artificial Sequence
  Synthetic DNA
taattcaagttactacag

SEQ ID NO: 51783 - DNA, 18 bp, Artificial Sequence
  Synthetic DNA
taattcaatactcaatag

SEQ ID NO: 51784 - DNA, 18 bp, Artificial Sequence
  Synthetic DNA
taattcacctcactttta

SEQ ID NO: 51785 - DNA, 18 bp, Artificial Sequence
  Synthetic DNA
taattcacttcaatgatg

SEQ ID NO: 51786 - DNA, 18 bp, Artificial Sequence
  Synthetic DNA
taattcagctcaaaatag

SEQ ID NO: 51787 - DNA, 18 bp, Artificial Sequence
  Synthetic DNA
taattcagctcactgttg

SEQ ID NO: 51788 - DNA, 18 bp, Artificial Sequence
  Synthetic DNA
taattcatcactctatgg

SEQ ID NO: 51789 - DNA, 18 bp, Artificial Sequence
  Synthetic DNA
taattcatctcacattct

SEQ ID NO: 51790 - DNA, 18 bp, Artificial Sequence
  Synthetic DNA
taattccaaaaactctag

SEQ ID NO: 51791 - DNA, 18 bp, Artificial Sequence
  Synthetic DNA
taattccaatcacgtgcg

SEQ ID NO: 51792 - DNA, 18 bp, Artificial Sequence
  Synthetic DNA
taattccaatccatatag

SEQ ID NO: 51793 - DNA, 18 bp, Artificial Sequence
  Synthetic DNA
taattccacacactttgg

SEQ ID NO: 51794 - DNA, 18 bp, Artificial Sequence
  Synthetic DNA
taattccactcaccttcg

SEQ ID NO: 51795 - DNA, 18 bp, Artificial Sequence
  Synthetic DNA
taattccactcattttgg

SEQ ID NO: 51796 - DNA, 18 bp, Artificial Sequence
  Synthetic DNA
taattccactcgttaagg

SEQ ID NO: 51797 - DNA, 18 bp, Artificial Sequence
  Synthetic DNA
taattccattcacctttg

SEQ ID NO: 51798 - DNA, 18 bp, Artificial Sequence
  Synthetic DNA
taattcctctcactgtcg

SEQ ID NO: 51799 - DNA, 18 bp, Artificial Sequence
  Synthetic DNA
taattcctctcgcaaaag

SEQ ID NO: 51800 - DNA, 18 bp, Artificial Sequence
  Synthetic DNA
taattcctctctctaccg

SEQ ID NO: 51801 - DNA, 18 bp, Artificial Sequence
  Synthetic DNA
taattcgaaacacaagag

SEQ ID NO: 51802 - DNA, 18 bp, Artificial Sequence
  Synthetic DNA
taattcgaatcatcaaag

SEQ ID NO: 51803 - DNA, 18 bp, Artificial Sequence
  Synthetic DNA
taattcgacactagaacg

SEQ ID NO: 51804 - DNA, 18 bp, Artificial Sequence
  Synthetic DNA
taattcgacactcgttag

SEQ ID NO: 51805 - DNA, 18 bp, Artificial Sequence
  Synthetic DNA
taattcgacatcctagag

SEQ ID NO: 51806 - DNA, 18 bp, Artificial Sequence
  Synthetic DNA
taattcgaccaaccagag

SEQ ID NO: 51807 - DNA, 18 bp, Artificial Sequence
  Synthetic DNA
taattcgaccgagtgtag

SEQ ID NO: 51808 - DNA, 18 bp, Artificial Sequence
  Synthetic DNA
taattcgacgttcaatag

SEQ ID NO: 51809 - DNA, 18 bp, Artificial Sequence
  Synthetic DNA
taattcgactcccgttcg

SEQ ID NO: 51810 - DNA, 18 bp, Artificial Sequence
  Synthetic DNA
taattcgactgacataag

SEQ ID NO: 51811 - DNA, 18 bp, Artificial Sequence
  Synthetic DNA
taattcgactgtggatag

SEQ ID NO: 51812 - DNA, 18 bp, Artificial Sequence
  Synthetic DNA
taattcgagaaattatag

SEQ ID NO: 51813 - DNA, 18 bp, Artificial Sequence
  Synthetic DNA
taattcgagtaaatttag

SEQ ID NO: 51814 - DNA, 18 bp, Artificial Sequence
  Synthetic DNA
taattcgataatctcctg

SEQ ID NO: 51815 - DNA, 18 bp, Artificial Sequence
  Synthetic DNA
taattcgatataatttag

SEQ ID NO: 51816 - DNA, 18 bp, Artificial Sequence
  Synthetic DNA
taattcgattcaaattag

SEQ ID NO: 51817 - DNA, 18 bp, Artificial Sequence
  Synthetic DNA
taattcgattcaacatcg

SEQ ID NO: 51818 - DNA, 18 bp, Artificial Sequence
  Synthetic DNA
taattcgattcacagttg

SEQ ID NO: 51819 - DNA, 18 bp, Artificial Sequence
  Synthetic DNA
taattcgattcattgaag

SEQ ID NO: 51820 - DNA, 18 bp, Artificial Sequence
  Synthetic DNA
taattcgattgcgtatag

SEQ ID NO: 51821 - DNA, 18 bp, Artificial Sequence
  Synthetic DNA
taattcgatttattatcg

SEQ ID NO: 51822 - DNA, 18 bp, Artificial Sequence
  Synthetic DNA
taattcgattttcagtcg

SEQ ID NO: 51823 - DNA, 18 bp, Artificial Sequence
  Synthetic DNA
taattcgcatctatctag

SEQ ID NO: 51824 - DNA, 18 bp, Artificial Sequence
  Synthetic DNA
taattcgcatggctctag

SEQ ID NO: 51825 - DNA, 18 bp, Artificial Sequence
  Synthetic DNA
taattcgccctacaatcg

SEQ ID NO: 51826 - DNA, 18 bp, Artificial Sequence
  Synthetic DNA
taattcgcctgtcttgag

SEQ ID NO: 51827 - DNA, 18 bp, Artificial Sequence
  Synthetic DNA
taattcgctttaatatag

SEQ ID NO: 51828 - DNA, 18 bp, Artificial Sequence
  Synthetic DNA
taattcggcacgcttgag

SEQ ID NO: 51829 - DNA, 18 bp, Artificial Sequence
  Synthetic DNA
taattcgtatcgctaaag

SEQ ID NO: 51830 - DNA, 18 bp, Artificial Sequence
  Synthetic DNA
taattcgtcacgtttttg

SEQ ID NO: 51831 - DNA, 18 bp, Artificial Sequence
  Synthetic DNA
taattcgtcatactatgg

SEQ ID NO: 51832 - DNA, 18 bp, Artificial Sequence
  Synthetic DNA
taattcgtctaacttaag

SEQ ID NO: 51833 - DNA, 18 bp, Artificial Sequence
  Synthetic DNA
taattcgtctaattgttg

SEQ ID NO: 51834 - DNA, 18 bp, Artificial Sequence
  Synthetic DNA
taattcgtctctcaatcg

SEQ ID NO: 51835 - DNA, 18 bp, Artificial Sequence
  Synthetic DNA
taattcgtctctcttaag

SEQ ID NO: 51836 - DNA, 18 bp, Artificial Sequence
  Synthetic DNA
taattcgtcttacttcag

SEQ ID NO: 51837 - DNA, 18 bp, Artificial Sequence
  Synthetic DNA
taattcgtgtaactaaag

SEQ ID NO: 51838 - DNA, 18 bp, Artificial Sequence
  Synthetic DNA
taattcgttttactttag

SEQ ID NO: 51839 - DNA, 18 bp, Artificial Sequence
  Synthetic DNA
taattctaatcgcacttg

SEQ ID NO: 51840 - DNA, 18 bp, Artificial Sequence
  Synthetic DNA
taattctacacacaatgg

SEQ ID NO: 51841 - DNA, 18 bp, Artificial Sequence
  Synthetic DNA
taattctacagaatatag

SEQ ID NO: 51842 - DNA, 18 bp, Artificial Sequence
  Synthetic DNA
taattctacccacaattg

SEQ ID NO: 51843 - DNA, 18 bp, Artificial Sequence
  Synthetic DNA
taattctacccattaatg

SEQ ID NO: 51844 - DNA, 18 bp, Artificial Sequence
  Synthetic DNA
taattctactcgttagag

SEQ ID NO: 51845 - DNA, 18 bp, Artificial Sequence
  Synthetic DNA
taattctactctcttaag

SEQ ID NO: 51846 - DNA, 18 bp, Artificial Sequence
  Synthetic DNA
taattctactgactaatg

SEQ ID NO: 51847 - DNA, 18 bp, Artificial Sequence
  Synthetic DNA
taattctactgacttctg

SEQ ID NO: 51848 - DNA, 18 bp, Artificial Sequence
  Synthetic DNA
taattctattcattttag

SEQ ID NO: 51849 - DNA, 18 bp, Artificial Sequence
  Synthetic DNA
taattctatttctgatag

SEQ ID NO: 51850 - DNA, 18 bp, Artificial Sequence
  Synthetic DNA
taattctccagtctaaag

SEQ ID NO: 51851 - DNA, 18 bp, Artificial Sequence
  Synthetic DNA
taattctcgtgactaaag

SEQ ID NO: 51852 - DNA, 18 bp, Artificial Sequence
  Synthetic DNA
taattctcttcactgcgg

SEQ ID NO: 51853 - DNA, 18 bp, Artificial Sequence
  Synthetic DNA
taattcttcatactatag

SEQ ID NO: 51854 - DNA, 18 bp, Artificial Sequence
  Synthetic DNA
taattcttctctcagtag

SEQ ID NO: 51855 - DNA, 18 bp, Artificial Sequence
  Synthetic DNA
taattcttctgactagtg

SEQ ID NO: 51856 - DNA, 18 bp, Artificial Sequence
  Synthetic DNA
taattctttatacaatag

SEQ ID NO: 51857 - DNA, 18 bp, Artificial Sequence
  Synthetic DNA
taattggaatctcaattg

SEQ ID NO: 51858 - DNA, 18 bp, Artificial Sequence
  Synthetic DNA
taattggactaccattag

SEQ ID NO: 51859 - DNA, 18 bp, Artificial Sequence
  Synthetic DNA
taattggactcgcttttg

SEQ ID NO: 51860 - DNA, 18 bp, Artificial Sequence
  Synthetic DNA
taattggactctttatcg

SEQ ID NO: 51861 - DNA, 18 bp, Artificial Sequence
  Synthetic DNA
taattggactgactttgg

SEQ ID NO: 51862 - DNA, 18 bp, Artificial Sequence
  Synthetic DNA
taattggattcaatttag

SEQ ID NO: 51863 - DNA, 18 bp, Artificial Sequence
  Synthetic DNA
taattggattcacaaaag

SEQ ID NO: 51864 - DNA, 18 bp, Artificial Sequence
  Synthetic DNA
taattgtagttactatag

SEQ ID NO: 51865 - DNA, 18 bp, Artificial Sequence
  Synthetic DNA
taattgttctcacaatag

SEQ ID NO: 51866 - DNA, 18 bp, Artificial Sequence
  Synthetic DNA
taattgttctcattacag

SEQ ID NO: 51867 - DNA, 18 bp, Artificial Sequence
  Synthetic DNA
taatttaacatattattg

SEQ ID NO: 51868 - DNA, 18 bp, Artificial Sequence
  Synthetic DNA
taatttaactcattattg

SEQ ID NO: 51869 - DNA, 18 bp, Artificial Sequence
  Synthetic DNA
taatttaactctcaatcg

SEQ ID NO: 51870 - DNA, 18 bp, Artificial Sequence
  Synthetic DNA
taatttaactctgtatcg

SEQ ID NO: 51871 - DNA, 18 bp, Artificial Sequence
  Synthetic DNA
taatttaattgactatag

SEQ ID NO: 51872 - DNA, 18 bp, Artificial Sequence
  Synthetic DNA
taatttagatcatgagag

SEQ ID NO: 51873 - DNA, 18 bp, Artificial Sequence
  Synthetic DNA
taatttcacatactattg

SEQ ID NO: 51874 - DNA, 18 bp, Artificial Sequence
  Synthetic DNA
taatttcactcgcaatag

SEQ ID NO: 51875 - DNA, 18 bp, Artificial Sequence
  Synthetic DNA
taatttgaatcacttatg

SEQ ID NO: 51876 - DNA, 18 bp, Artificial Sequence
  Synthetic DNA
taatttgaatctatatag

SEQ ID NO: 51877 - DNA, 18 bp, Artificial Sequence
  Synthetic DNA
taatttgaattacaatgg

SEQ ID NO: 51878 - DNA, 18 bp, Artificial Sequence
  Synthetic DNA
taatttgactacccttag

SEQ ID NO: 51879 - DNA, 18 bp, Artificial Sequence
  Synthetic DNA
taatttgactcccatatg

SEQ ID NO: 51880 - DNA, 18 bp, Artificial Sequence
  Synthetic DNA
taatttgactctctactg

SEQ ID NO: 51881 - DNA, 18 bp, Artificial Sequence
  Synthetic DNA
taatttgccccatcattg

SEQ ID NO: 51882 - DNA, 18 bp, Artificial Sequence
  Synthetic DNA
taatttgtcagtctcttg

SEQ ID NO: 51883 - DNA, 18 bp, Artificial Sequence
  Synthetic DNA
taatttgtcgcgttaaag

SEQ ID NO: 51884 - DNA, 18 bp, Artificial Sequence
  Synthetic DNA
taatttgtctcactaacg

SEQ ID NO: 51885 - DNA, 18 bp, Artificial Sequence
  Synthetic DNA
taatttgtctcgcttcag

SEQ ID NO: 51886 - DNA, 18 bp, Artificial Sequence
  Synthetic DNA
taatttgtgtttgtatag

SEQ ID NO: 51887 - DNA, 18 bp, Artificial Sequence
  Synthetic DNA
taattttacactctattg

SEQ ID NO: 51888 - DNA, 18 bp, Artificial Sequence
  Synthetic DNA
taatttttgtcactagag

SEQ ID NO: 51889 - DNA, 18 bp, Artificial Sequence
  Synthetic DNA
tacaaagacacaatgtag

SEQ ID NO: 51890 - DNA, 18 bp, Artificial Sequence
  Synthetic DNA
tacaaagtttcacaattg

SEQ ID NO: 51891 - DNA, 18 bp, Artificial Sequence
  Synthetic DNA
tacaacaacaaaccatag

SEQ ID NO: 51892 - DNA, 18 bp, Artificial Sequence
  Synthetic DNA
tacaacatcccactaaag

SEQ ID NO: 51893 - DNA, 18 bp, Artificial Sequence
  Synthetic DNA
tacaaccactaaaaaatg

SEQ ID NO: 51894 - DNA, 18 bp, Artificial Sequence
  Synthetic DNA
tacaacgactcgttttag

SEQ ID NO: 51895 - DNA, 18 bp, Artificial Sequence
  Synthetic DNA
tacaacgactttctacag

SEQ ID NO: 51896 - DNA, 18 bp, Artificial Sequence
  Synthetic DNA
tacaacgccgcactacag

SEQ ID NO: 51897 - DNA, 18 bp, Artificial Sequence
  Synthetic DNA
tacaactacccattatag

SEQ ID NO: 51898 - DNA, 18 bp, Artificial Sequence
  Synthetic DNA
tacaaggacacaccttag

SEQ ID NO: 51899 - DNA, 18 bp, Artificial Sequence
  Synthetic DNA
tacaatgacccacaattg

SEQ ID NO: 51900 - DNA, 18 bp, Artificial Sequence
  Synthetic DNA
tacaatgacgtactttag

SEQ ID NO: 51901 - DNA, 18 bp, Artificial Sequence
  Synthetic DNA
tacaccgtcactccatta

SEQ ID NO: 51902 - DNA, 18 bp, Artificial Sequence
  Synthetic DNA
tacatatattcactctag

SEQ ID NO: 51903 - DNA, 18 bp, Artificial Sequence
  Synthetic DNA
tacatcgattgataatgg

SEQ ID NO: 51904 - DNA, 18 bp, Artificial Sequence
  Synthetic DNA
tacatggattcacaatag

SEQ ID NO: 51905 - DNA, 18 bp, Artificial Sequence
  Synthetic DNA
tacattgtcttactctag

SEQ ID NO: 51906 - DNA, 18 bp, Artificial Sequence
  Synthetic DNA
taccacgaaccactctag

SEQ ID NO: 51907 - DNA, 18 bp, Artificial Sequence
  Synthetic DNA
taccactacacattatag

SEQ ID NO: 51908 - DNA, 18 bp, Artificial Sequence
  Synthetic DNA
taccaggcaacacaattg

SEQ ID NO: 51909 - DNA, 18 bp, Artificial Sequence
  Synthetic DNA
taccatgttaaactatag

SEQ ID NO: 51910 - DNA, 18 bp, Artificial Sequence
  Synthetic DNA
taccattactgactatgg

SEQ ID NO: 51911 - DNA, 18 bp, Artificial Sequence
  Synthetic DNA
tacctcgacttactacag

SEQ ID NO: 51912 - DNA, 18 bp, Artificial Sequence
  Synthetic DNA
tacgacgattcaatacag

SEQ ID NO: 51913 - DNA, 18 bp, Artificial Sequence
  Synthetic DNA
tacgacgattcacttttg

SEQ ID NO: 51914 - DNA, 18 bp, Artificial Sequence
  Synthetic DNA
tacgacgtaacactaaag

SEQ ID NO: 51915 - DNA, 18 bp, Artificial Sequence
  Synthetic DNA
tacgatgccacacgaaag

SEQ ID NO: 51916 - DNA, 18 bp, Artificial Sequence
  Synthetic DNA
tactaaaactgtttatag

SEQ ID NO: 51917 - DNA, 18 bp, Artificial Sequence
  Synthetic DNA
tactaagactgactctgg

SEQ ID NO: 51918 - DNA, 18 bp, Artificial Sequence
  Synthetic DNA
tactaagatcgaaaatag

SEQ ID NO: 51919 - DNA, 18 bp, Artificial Sequence
  Synthetic DNA
tactacaatacactaagg

SEQ ID NO: 51920 - DNA, 18 bp, Artificial Sequence
  Synthetic DNA
tactacaattcattctag

SEQ ID NO: 51921 - DNA, 18 bp, Artificial Sequence
  Synthetic DNA
tactacatatcagtatag

SEQ ID NO: 51922 - DNA, 18 bp, Artificial Sequence
  Synthetic DNA
tactacatctatcaatag

SEQ ID NO: 51923 - DNA, 18 bp, Artificial Sequence
  Synthetic DNA
tactacatcttactattg

SEQ ID NO: 51924 - DNA, 18 bp, Artificial Sequence
  Synthetic DNA
tactaccacacgctaggg

SEQ ID NO: 51925 - DNA, 18 bp, Artificial Sequence
  Synthetic DNA
tactaccactcataaaag

SEQ ID NO: 51926 - DNA, 18 bp, Artificial Sequence
  Synthetic DNA
tactaccactctttacag

SEQ ID NO: 51927 - DNA, 18 bp, Artificial Sequence
  Synthetic DNA
tactacctcactctattg

SEQ ID NO: 51928 - DNA, 18 bp, Artificial Sequence
  Synthetic DNA
tactacgaatcacttatg

SEQ ID NO: 51929 - DNA, 18 bp, Artificial Sequence
  Synthetic DNA
tactacgaatcatttaag

SEQ ID NO: 51930 - DNA, 18 bp, Artificial Sequence
  Synthetic DNA
tactacgaattaatacag

SEQ ID NO: 51931 - DNA, 18 bp, Artificial Sequence
  Synthetic DNA
tactacgacacccattag

SEQ ID NO: 51932 - DNA, 18 bp, Artificial Sequence
  Synthetic DNA
tactacgactctctcacg

SEQ ID NO: 51933 - DNA, 18 bp, Artificial Sequence
  Synthetic DNA
tactacgactgacttatg

SEQ ID NO: 51934 - DNA, 18 bp, Artificial Sequence
  Synthetic DNA
tactacgacttttactag

SEQ ID NO: 51935 - DNA, 18 bp, Artificial Sequence
  Synthetic DNA
tactacgatcctctaaag

SEQ ID NO: 51936 - DNA, 18 bp, Artificial Sequence
  Synthetic DNA
tactacgcctaaataaag

SEQ ID NO: 51937 - DNA, 18 bp, Artificial Sequence
  Synthetic DNA
tactacgctacacaatag

SEQ ID NO: 51938 - DNA, 18 bp, Artificial Sequence
  Synthetic DNA
tactacggcactcgtcag

SEQ ID NO: 51939 - DNA, 18 bp, Artificial Sequence
  Synthetic DNA
tactacgtctaaatatgg

SEQ ID NO: 51940 - DNA, 18 bp, Artificial Sequence
  Synthetic DNA
tactacgtctgacaacgg

SEQ ID NO: 51941 - DNA, 18 bp, Artificial Sequence
  Synthetic DNA
tactacgtgtcacttaag

SEQ ID NO: 51942 - DNA, 18 bp, Artificial Sequence
  Synthetic DNA
tactacgttataatatag

SEQ ID NO: 51943 - DNA, 18 bp, Artificial Sequence
  Synthetic DNA
tactacgtttctcattag

SEQ ID NO: 51944 - DNA, 18 bp, Artificial Sequence
  Synthetic DNA
tactactactctcaaaag

SEQ ID NO: 51945 - DNA, 18 bp, Artificial Sequence
  Synthetic DNA
tactagcactcaatacag

SEQ ID NO: 51946 - DNA, 18 bp, Artificial Sequence
  Synthetic DNA
tactaggacaaaccgttg

SEQ ID NO: 51947 - DNA, 18 bp, Artificial Sequence
  Synthetic DNA
tactagtccactatagtg

SEQ ID NO: 51948 - DNA, 18 bp, Artificial Sequence
  Synthetic DNA
tactataacactctatag

SEQ ID NO: 51949 - DNA, 18 bp, Artificial Sequence
  Synthetic DNA
tactatctataactatag

SEQ ID NO: 51950 - DNA, 18 bp, Artificial Sequence
  Synthetic DNA
tactatgactctcaattg

SEQ ID NO: 51951 - DNA, 18 bp, Artificial Sequence
  Synthetic DNA
tactattagtctctatag

SEQ ID NO: 51952 - DNA, 18 bp, Artificial Sequence
  Synthetic DNA
tactccgagtcgccatag

SEQ ID NO: 51953 - DNA, 18 bp, Artificial Sequence
  Synthetic DNA
tactccgatccaatatag

SEQ ID NO: 51954 - DNA, 18 bp, Artificial Sequence
  Synthetic DNA
tactctgactctcgttgg

SEQ ID NO: 51955 - DNA, 18 bp, Artificial Sequence
  Synthetic DNA
tactctgactgaatatag

SEQ ID NO: 51956 - DNA, 18 bp, Artificial Sequence
  Synthetic DNA
tactgcaactcatttcag

SEQ ID NO: 51957 - DNA, 18 bp, Artificial Sequence
  Synthetic DNA
tactgtgcatgacaatag

SEQ ID NO: 51958 - DNA, 18 bp, Artificial Sequence
  Synthetic DNA
tacttagactctctaatg

SEQ ID NO: 51959 - DNA, 18 bp, Artificial Sequence
  Synthetic DNA
tacttcgactagccctgg

SEQ ID NO: 51960 - DNA, 18 bp, Artificial Sequence
  Synthetic DNA
tacttcgattctcaacgg

SEQ ID NO: 51961 - DNA, 18 bp, Artificial Sequence
  Synthetic DNA
tacttcgtctcgatatag

SEQ ID NO: 51962 - DNA, 18 bp, Artificial Sequence
  Synthetic DNA
tacttctaatcactagag

SEQ ID NO: 51963 - DNA, 18 bp, Artificial Sequence
  Synthetic DNA
tacttctacgtcctatag

SEQ ID NO: 51964 - DNA, 18 bp, Artificial Sequence
  Synthetic DNA
tacttctactaattatag

SEQ ID NO: 51965 - DNA, 18 bp, Artificial Sequence
  Synthetic DNA
tactttcacactctttag

SEQ ID NO: 51966 - DNA, 18 bp, Artificial Sequence
  Synthetic DNA
tactttgatttacaatag

SEQ ID NO: 51967 - DNA, 18 bp, Artificial Sequence
  Synthetic DNA
tagaaagacacactagtg

SEQ ID NO: 51968 - DNA, 18 bp, Artificial Sequence
  Synthetic DNA
tagaaagactatcaatag

SEQ ID NO: 51969 - DNA, 18 bp, Artificial Sequence
  Synthetic DNA
tagaaagacttactttag

SEQ ID NO: 51970 - DNA, 18 bp, Artificial Sequence
  Synthetic DNA
tagaacgacaagaattag

SEQ ID NO: 51971 - DNA, 18 bp, Artificial Sequence
  Synthetic DNA
tagaacgacacgccatag

SEQ ID NO: 51972 - DNA, 18 bp, Artificial Sequence
  Synthetic DNA
tagaacgacccacaaatg

SEQ ID NO: 51973 - DNA, 18 bp, Artificial Sequence
  Synthetic DNA
tagaacgactctcttcag

SEQ ID NO: 51974 - DNA, 18 bp, Artificial Sequence
  Synthetic DNA
tagaactaatcagaatag

SEQ ID NO: 51975 - DNA, 18 bp, Artificial Sequence
  Synthetic DNA
tagaactactatctattg

SEQ ID NO: 51976 - DNA, 18 bp, Artificial Sequence
  Synthetic DNA
tagaacttctcagtatag

SEQ ID NO: 51977 - DNA, 18 bp, Artificial Sequence
  Synthetic DNA
tagaaggactaaatattg

SEQ ID NO: 51978 - DNA, 18 bp, Artificial Sequence
  Synthetic DNA
tagaaggactaactaaag

SEQ ID NO: 51979 - DNA, 18 bp, Artificial Sequence
  Synthetic DNA
tagaaggtctcagtatag

SEQ ID NO: 51980 - DNA, 18 bp, Artificial Sequence
  Synthetic DNA
tagaagtaatcacaatag

SEQ ID NO: 51981 - DNA, 18 bp, Artificial Sequence
  Synthetic DNA
tagaatgtctaactctag

SEQ ID NO: 51982 - DNA, 18 bp, Artificial Sequence
  Synthetic DNA
tagaccaactcactttag

SEQ ID NO: 51983 - DNA, 18 bp, Artificial Sequence
  Synthetic DNA
tagagccactcagtatgg

SEQ ID NO: 51984 - DNA, 18 bp, Artificial Sequence
  Synthetic DNA
tagagcgacacattattg

SEQ ID NO: 51985 - DNA, 18 bp, Artificial Sequence
  Synthetic DNA
tagagcggcaaactttag

SEQ ID NO: 51986 - DNA, 18 bp, Artificial Sequence
  Synthetic DNA
tagatagcctgatcatag

SEQ ID NO: 51987 - DNA, 18 bp, Artificial Sequence
  Synthetic DNA
tagatcaattcaccatag

SEQ ID NO: 51988 - DNA, 18 bp, Artificial Sequence
  Synthetic DNA
tagatccactttttatag

SEQ ID NO: 51989 - DNA, 18 bp, Artificial Sequence
  Synthetic DNA
tagatcgaattacatttg

SEQ ID NO: 51990 - DNA, 18 bp, Artificial Sequence
  Synthetic DNA
tagatcgaccctcactag

SEQ ID NO: 51991 - DNA, 18 bp, Artificial Sequence
  Synthetic DNA
tagatcgtacctcaatag

SEQ ID NO: 51992 - DNA, 18 bp, Artificial Sequence
  Synthetic DNA
tagatggacaagctagag

SEQ ID NO: 51993 - DNA, 18 bp, Artificial Sequence
  Synthetic DNA
tagcaagacccactatcg

SEQ ID NO: 51994 - DNA, 18 bp, Artificial Sequence
  Synthetic DNA
tagcaagactcacttttg

SEQ ID NO: 51995 - DNA, 18 bp, Artificial Sequence
  Synthetic DNA
tagcaagactgactaaag

SEQ ID NO: 51996 - DNA, 18 bp, Artificial Sequence
  Synthetic DNA
tagcaagatttgctgttg

SEQ ID NO: 51997 - DNA, 18 bp, Artificial Sequence
  Synthetic DNA
tagcacgatactctattg

SEQ ID NO: 51998 - DNA, 18 bp, Artificial Sequence
  Synthetic DNA
tagcacgtcagaccttag

SEQ ID NO: 51999 - DNA, 18 bp, Artificial Sequence
  Synthetic DNA
tagcgcaacacactaaag

SEQ ID NO: 52000 - DNA, 18 bp, Artificial Sequence
  Synthetic DNA
tagctcgactctttaaag

SEQ ID NO: 52001 - DNA, 18 bp, Artificial Sequence
  Synthetic DNA
tagctcgtcttgcaatag

SEQ ID NO: 52002 - DNA, 18 bp, Artificial Sequence
  Synthetic DNA
tagcttgtctcactattg

SEQ ID NO: 52003 - DNA, 18 bp, Artificial Sequence
  Synthetic DNA
taggaatactctctattg

SEQ ID NO: 52004 - DNA, 18 bp, Artificial Sequence
  Synthetic DNA
taggacgtctgactttag

SEQ ID NO: 52005 - DNA, 18 bp, Artificial Sequence
  Synthetic DNA
taggacgttttgtcatcg

SEQ ID NO: 52006 - DNA, 18 bp, Artificial Sequence
  Synthetic DNA
taggatgacttactttag

SEQ ID NO: 52007 - DNA, 18 bp, Artificial Sequence
  Synthetic DNA
taggtagaatctcaatag

SEQ ID NO: 52008 - DNA, 18 bp, Artificial Sequence
  Synthetic DNA
tagtaaattcctctatag

SEQ ID NO: 52009 - DNA, 18 bp, Artificial Sequence
  Synthetic DNA
tagtaagacacaatattg

SEQ ID NO: 52010 - DNA, 18 bp, Artificial Sequence
  Synthetic DNA
tagtaagccacgcttaag

SEQ ID NO: 52011 - DNA, 18 bp, Artificial Sequence
  Synthetic DNA
tagtaaggacgtttatag

SEQ ID NO: 52012 - DNA, 18 bp, Artificial Sequence
  Synthetic DNA
tagtaagtctatccattg

SEQ ID NO: 52013 - DNA, 18 bp, Artificial Sequence
  Synthetic DNA
tagtaatactccttatag

SEQ ID NO: 52014 - DNA, 18 bp, Artificial Sequence
  Synthetic DNA
tagtacaacatacgcgag

SEQ ID NO: 52015 - DNA, 18 bp, Artificial Sequence
  Synthetic DNA
tagtacaactcaaaattg

SEQ ID NO: 52016 - DNA, 18 bp, Artificial Sequence
  Synthetic DNA
tagtacaagtcaagctag

SEQ ID NO: 52017 - DNA, 18 bp, Artificial Sequence
  Synthetic DNA
tagtacaatccactaaag

SEQ ID NO: 52018 - DNA, 18 bp, Artificial Sequence
  Synthetic DNA
tagtacatcccagtatag

SEQ ID NO: 52019 - DNA, 18 bp, Artificial Sequence
  Synthetic DNA
tagtacatctcccttagg

SEQ ID NO: 52020 - DNA, 18 bp, Artificial Sequence
  Synthetic DNA
tagtaccacactcaatag

SEQ ID NO: 52021 - DNA, 18 bp, Artificial Sequence
  Synthetic DNA
tagtaccacgcactaatg

SEQ ID NO: 52022 - DNA, 18 bp, Artificial Sequence
  Synthetic DNA
tagtacgaataaatattg

SEQ ID NO: 52023 - DNA, 18 bp, Artificial Sequence
  Synthetic DNA
tagtacgaattgctttag

SEQ ID NO: 52024 - DNA, 18 bp, Artificial Sequence
  Synthetic DNA
tagtacgacacgttttag

SEQ ID NO: 52025 - DNA, 18 bp, Artificial Sequence
  Synthetic DNA
tagtacgactcatttagg

SEQ ID NO: 52026 - DNA, 18 bp, Artificial Sequence
  Synthetic DNA
tagtacgattagctaaag

SEQ ID NO: 52027 - DNA, 18 bp, Artificial Sequence
  Synthetic DNA
tagtacgtcactcgatgg

SEQ ID NO: 52028 - DNA, 18 bp, Artificial Sequence
  Synthetic DNA
tagtacgtcagattgtag

SEQ ID NO: 52029 - DNA, 18 bp, Artificial Sequence
  Synthetic DNA
tagtacgtcatattaaag

SEQ ID NO: 52030 - DNA, 18 bp, Artificial Sequence
  Synthetic DNA
tagtacgtctcacaaatg

SEQ ID NO: 52031 - DNA, 18 bp, Artificial Sequence
  Synthetic DNA
tagtacgtctctctaagg

SEQ ID NO: 52032 - DNA, 18 bp, Artificial Sequence
  Synthetic DNA
tagtacgtctgtctatgg

SEQ ID NO: 52033 - DNA, 18 bp, Artificial Sequence
  Synthetic DNA
tagtacgtcttaccgtgg

SEQ ID NO: 52034 - DNA, 18 bp, Artificial Sequence
  Synthetic DNA
tagtactaatgaataaag

SEQ ID NO: 52035 - DNA, 18 bp, Artificial Sequence
  Synthetic DNA
tagtactacagtctaatg

SEQ ID NO: 52036 - DNA, 18 bp, Artificial Sequence
  Synthetic DNA
tagtactacttacgaatg

SEQ ID NO: 52037 - DNA, 18 bp, Artificial Sequence
  Synthetic DNA
tagtactattctcaaatg

SEQ ID NO: 52038 - DNA, 18 bp, Artificial Sequence
  Synthetic DNA
tagtacttctcgctgtgg

SEQ ID NO: 52039 - DNA, 18 bp, Artificial Sequence
  Synthetic DNA
tagtacttttcaccatag

SEQ ID NO: 52040 - DNA, 18 bp, Artificial Sequence
  Synthetic DNA
tagtaggacacattgtag

SEQ ID NO: 52041 - DNA, 18 bp, Artificial Sequence
  Synthetic DNA
tagtaggcctcgcattcg

SEQ ID NO: 52042 - DNA, 18 bp, Artificial Sequence
  Synthetic DNA
tagtataaatcgctatag

SEQ ID NO: 52043 - DNA, 18 bp, Artificial Sequence
  Synthetic DNA
tagtatcatacaatatag

SEQ ID NO: 52044 - DNA, 18 bp, Artificial Sequence
  Synthetic DNA
tagtatcattcattatag

SEQ ID NO: 52045 - DNA, 18 bp, Artificial Sequence
  Synthetic DNA
tagtatctctcaatatta

SEQ ID NO: 52046 - DNA, 18 bp, Artificial Sequence
  Synthetic DNA
tagtatgaatcgcaaaag

SEQ ID NO: 52047 - DNA, 18 bp, Artificial Sequence
  Synthetic DNA
tagtatgactaagtctag

SEQ ID NO: 52048 - DNA, 18 bp, Artificial Sequence
  Synthetic DNA
tagtatgagaccctatag

SEQ ID NO: 52049 - DNA, 18 bp, Artificial Sequence
  Synthetic DNA
tagtatgattaaccatag

SEQ ID NO: 52050 - DNA, 18 bp, Artificial Sequence
  Synthetic DNA
tagtatgattttgtatag

SEQ ID NO: 52051 - DNA, 18 bp, Artificial Sequence
  Synthetic DNA
tagtatgcctcaaaatag

SEQ ID NO: 52052 - DNA, 18 bp, Artificial Sequence
  Synthetic DNA
tagtattacactgaatcg

SEQ ID NO: 52053 - DNA, 18 bp, Artificial Sequence
  Synthetic DNA
tagtatttctcagagaag

SEQ ID NO: 52054 - DNA, 18 bp, Artificial Sequence
  Synthetic DNA
tagtcatactaactatag

SEQ ID NO: 52055 - DNA, 18 bp, Artificial Sequence
  Synthetic DNA
tagtcccactcacgattg

SEQ ID NO: 52056 - DNA, 18 bp, Artificial Sequence
  Synthetic DNA
tagtcccacttattatcg

SEQ ID NO: 52057 - DNA, 18 bp, Artificial Sequence
  Synthetic DNA
tagtccgaaacactaatg

SEQ ID NO: 52058 - DNA, 18 bp, Artificial Sequence
  Synthetic DNA
tagtccggctctctgtag

SEQ ID NO: 52059 - DNA, 18 bp, Artificial Sequence
  Synthetic DNA
tagtccgtttcataatag

SEQ ID NO: 52060 - DNA, 18 bp, Artificial Sequence
  Synthetic DNA
tagtcctacacactatcg

SEQ ID NO: 52061 - DNA, 18 bp, Artificial Sequence
  Synthetic DNA
tagtcctactctctatgg

SEQ ID NO: 52062 - DNA, 18 bp, Artificial Sequence
  Synthetic DNA
tagtctaactcgctatag

SEQ ID NO: 52063 - DNA, 18 bp, Artificial Sequence
  Synthetic DNA
tagtcttactctccatag

SEQ ID NO: 52064 - DNA, 18 bp, Artificial Sequence
  Synthetic DNA
tagtgagactcacaattg

SEQ ID NO: 52065 - DNA, 18 bp, Artificial Sequence
  Synthetic DNA
tagtgccactcacattag

SEQ ID NO: 52066 - DNA, 18 bp, Artificial Sequence
  Synthetic DNA
tagtgcgacaaactctgg

SEQ ID NO: 52067 - DNA, 18 bp, Artificial Sequence
  Synthetic DNA
tagtgcttgtctcaatag

SEQ ID NO: 52068 - DNA, 18 bp, Artificial Sequence
  Synthetic DNA
tagtgggaaccactatag

SEQ ID NO: 52069 - DNA, 18 bp, Artificial Sequence
  Synthetic DNA
tagttagactcattctcg

SEQ ID NO: 52070 - DNA, 18 bp, Artificial Sequence
  Synthetic DNA
tagttagactccctatgg

SEQ ID NO: 52071 - DNA, 18 bp, Artificial Sequence
  Synthetic DNA
tagttccacacattattg

SEQ ID NO: 52072 - DNA, 18 bp, Artificial Sequence
  Synthetic DNA
tagttccactcatttacg

SEQ ID NO: 52073 - DNA, 18 bp, Artificial Sequence
  Synthetic DNA
tagttcgacacactaatg

SEQ ID NO: 52074 - DNA, 18 bp, Artificial Sequence
  Synthetic DNA
tagttcgcttcattatag

SEQ ID NO: 52075 - DNA, 18 bp, Artificial Sequence
  Synthetic DNA
tagttcgtctcaataaag

SEQ ID NO: 52076 - DNA, 18 bp, Artificial Sequence
  Synthetic DNA
tagttcgttttgccaaag

SEQ ID NO: 52077 - DNA, 18 bp, Artificial Sequence
  Synthetic DNA
tagttctacgcactttag

SEQ ID NO: 52078 - DNA, 18 bp, Artificial Sequence
  Synthetic DNA
tagttctattaactaaag

SEQ ID NO: 52079 - DNA, 18 bp, Artificial Sequence
  Synthetic DNA
tagttctccttattatag

SEQ ID NO: 52080 - DNA, 18 bp, Artificial Sequence
  Synthetic DNA
tagtttaactcagtaaag

SEQ ID NO: 52081 - DNA, 18 bp, Artificial Sequence
  Synthetic DNA
tagtttcacgcactaaag

SEQ ID NO: 52082 - DNA, 18 bp, Artificial Sequence
  Synthetic DNA
tagtttgactaaccatcg

SEQ ID NO: 52083 - DNA, 18 bp, Artificial Sequence
  Synthetic DNA
tagtttgactcacttttg

SEQ ID NO: 52084 - DNA, 18 bp, Artificial Sequence
  Synthetic DNA
tataaagtcatacaatag

SEQ ID NO: 52085 - DNA, 18 bp, Artificial Sequence
  Synthetic DNA
tataacaaatctctatgg

SEQ ID NO: 52086 - DNA, 18 bp, Artificial Sequence
  Synthetic DNA
tataacaacaccttagtg

SEQ ID NO: 52087 - DNA, 18 bp, Artificial Sequence
  Synthetic DNA
tataacaactcacaagag

SEQ ID NO: 52088 - DNA, 18 bp, Artificial Sequence
  Synthetic DNA
tataacaactcaccatgg

SEQ ID NO: 52089 - DNA, 18 bp, Artificial Sequence
  Synthetic DNA
tataacaactcaccttag

SEQ ID NO: 52090 - DNA, 18 bp, Artificial Sequence
  Synthetic DNA
tataacaactcagttaag

SEQ ID NO: 52091 - DNA, 18 bp, Artificial Sequence
  Synthetic DNA
tataacacctcagcatag

SEQ ID NO: 52092 - DNA, 18 bp, Artificial Sequence
  Synthetic DNA
tataacacctcgcaatgg

SEQ ID NO: 52093 - DNA, 18 bp, Artificial Sequence
  Synthetic DNA
tataacatctcattatcg

SEQ ID NO: 52094 - DNA, 18 bp, Artificial Sequence
  Synthetic DNA
tataaccactctctatcg

SEQ ID NO: 52095 - DNA, 18 bp, Artificial Sequence
  Synthetic DNA
tataaccactttctatag

SEQ ID NO: 52096 - DNA, 18 bp, Artificial Sequence
  Synthetic DNA
tataacctctctatctag

SEQ ID NO: 52097 - DNA, 18 bp, Artificial Sequence
  Synthetic DNA
tataacgaaccactacag

SEQ ID NO: 52098 - DNA, 18 bp, Artificial Sequence
  Synthetic DNA
tataacgaaccactttag

SEQ ID NO: 52099 - DNA, 18 bp, Artificial Sequence
  Synthetic DNA
tataacgaataaatatcg

SEQ ID NO: 52100 - DNA, 18 bp, Artificial Sequence
  Synthetic DNA
tataacgacaaactttag

SEQ ID NO: 52101 - DNA, 18 bp, Artificial Sequence
  Synthetic DNA
tataacgacaagctatag

SEQ ID NO: 52102 - DNA, 18 bp, Artificial Sequence
  Synthetic DNA
tataacgaccccctaaag

SEQ ID NO: 52103 - DNA, 18 bp, Artificial Sequence
  Synthetic DNA
tataacgacgcacatcag

SEQ ID NO: 52104 - DNA, 18 bp, Artificial Sequence
  Synthetic DNA
tataacgactaacaatcg

SEQ ID NO: 52105 - DNA, 18 bp, Artificial Sequence
  Synthetic DNA
tataacgactcacgcttg

SEQ ID NO: 52106 - DNA, 18 bp, Artificial Sequence
  Synthetic DNA
tataacgactgtgtatag

SEQ ID NO: 52107 - DNA, 18 bp, Artificial Sequence
  Synthetic DNA
tataacgacttattatcg

SEQ ID NO: 52108 - DNA, 18 bp, Artificial Sequence
  Synthetic DNA
tataacgatactcactag

SEQ ID NO: 52109 - DNA, 18 bp, Artificial Sequence
  Synthetic DNA
tataacgatccattagag

SEQ ID NO: 52110 - DNA, 18 bp, Artificial Sequence
  Synthetic DNA
tataacgcatcactttag

SEQ ID NO: 52111 - DNA, 18 bp, Artificial Sequence
  Synthetic DNA
tataacgccatactttag

SEQ ID NO: 52112 - DNA, 18 bp, Artificial Sequence
  Synthetic DNA
tataacgtattactttag

SEQ ID NO: 52113 - DNA, 18 bp, Artificial Sequence
  Synthetic DNA
tataacgtcccacaatag

SEQ ID NO: 52114 - DNA, 18 bp, Artificial Sequence
  Synthetic DNA
tataacgtctctctataa

SEQ ID NO: 52115 - DNA, 18 bp, Artificial Sequence
  Synthetic DNA
tataacgtgtcactttag

SEQ ID NO: 52116 - DNA, 18 bp, Artificial Sequence
  Synthetic DNA
tataacgttacattaagg

SEQ ID NO: 52117 - DNA, 18 bp, Artificial Sequence
  Synthetic DNA
tataacgtttcactgtag

SEQ ID NO: 52118 - DNA, 18 bp, Artificial Sequence
  Synthetic DNA
tataacgttttgcaatag

SEQ ID NO: 52119 - DNA, 18 bp, Artificial Sequence
  Synthetic DNA
tataactaaacgctttag

SEQ ID NO: 52120 - DNA, 18 bp, Artificial Sequence
  Synthetic DNA
tataactacgctctatgg

SEQ ID NO: 52121 - DNA, 18 bp, Artificial Sequence
  Synthetic DNA
tataactactaacaaaag

SEQ ID NO: 52122 - DNA, 18 bp, Artificial Sequence
  Synthetic DNA
tataactactcacgatgg

SEQ ID NO: 52123 - DNA, 18 bp, Artificial Sequence
  Synthetic DNA
tataactactcactactg

SEQ ID NO: 52124 - DNA, 18 bp, Artificial Sequence
  Synthetic DNA
tataactacttacaatcg

SEQ ID NO: 52125 - DNA, 18 bp, Artificial Sequence
  Synthetic DNA
tataactatacaatattg

SEQ ID NO: 52126 - DNA, 18 bp, Artificial Sequence
  Synthetic DNA
tataaggcctcactatgg

SEQ ID NO: 52127 - DNA, 18 bp, Artificial Sequence
  Synthetic DNA
tataatctctcattaaag

SEQ ID NO: 52128 - DNA, 18 bp, Artificial Sequence
  Synthetic DNA
tataatgaatcagtatag

SEQ ID NO: 52129 - DNA, 18 bp, Artificial Sequence
  Synthetic DNA
tataatgcatcactagaa

SEQ ID NO: 52130 - DNA, 18 bp, Artificial Sequence
  Synthetic DNA
tataatggctcactaaag

SEQ ID NO: 52131 - DNA, 18 bp, Artificial Sequence
  Synthetic DNA
tataccaacacactattg

SEQ ID NO: 52132 - DNA, 18 bp, Artificial Sequence
  Synthetic DNA
tataccgacatactatag

SEQ ID NO: 52133 - DNA, 18 bp, Artificial Sequence
  Synthetic DNA
tataccgactcgataaag

SEQ ID NO: 52134 - DNA, 18 bp, Artificial Sequence
  Synthetic DNA
tataccgtcttactaaag

SEQ ID NO: 52135 - DNA, 18 bp, Artificial Sequence
  Synthetic DNA
tatagagattcattctag

SEQ ID NO: 52136 - DNA, 18 bp, Artificial Sequence
  Synthetic DNA
tatagcgtctaactatag

SEQ ID NO: 52137 - DNA, 18 bp, Artificial Sequence
  Synthetic DNA
tatatagactaagtgtag

SEQ ID NO: 52138 - DNA, 18 bp, Artificial Sequence
  Synthetic DNA
tatatcaactcattatag

SEQ ID NO: 52139 - DNA, 18 bp, Artificial Sequence
  Synthetic DNA
tatatcaattctctttag

SEQ ID NO: 52140 - DNA, 18 bp, Artificial Sequence
  Synthetic DNA
tatatcgacacaaaatag

SEQ ID NO: 52141 - DNA, 18 bp, Artificial Sequence
  Synthetic DNA
tatatcgtctcattaaag

SEQ ID NO: 52142 - DNA, 18 bp, Artificial Sequence
  Synthetic DNA
tatatcgtttcactaaag

SEQ ID NO: 52143 - DNA, 18 bp, Artificial Sequence
  Synthetic DNA
tatatctacgctttatag

SEQ ID NO: 52144 - DNA, 18 bp, Artificial Sequence
  Synthetic DNA
tatatctactaactctag

SEQ ID NO: 52145 - DNA, 18 bp, Artificial Sequence
  Synthetic DNA
tatatctactaattacag

SEQ ID NO: 52146 - DNA, 18 bp, Artificial Sequence
  Synthetic DNA
tatattctctcactagag

SEQ ID NO: 52147 - DNA, 18 bp, Artificial Sequence
  Synthetic DNA
tatattgaatccctttcg

SEQ ID NO: 52148 - DNA, 18 bp, Artificial Sequence
  Synthetic DNA
tatattgactcactttag

SEQ ID NO: 52149 - DNA, 18 bp, Artificial Sequence
  Synthetic DNA
tatcaagactctctaccg

SEQ ID NO: 52150 - DNA, 18 bp, Artificial Sequence
  Synthetic DNA
tatcaatactctctaaag

SEQ ID NO: 52151 - DNA, 18 bp, Artificial Sequence
  Synthetic DNA
tatcaatccacactatag

SEQ ID NO: 52152 - DNA, 18 bp, Artificial Sequence
  Synthetic DNA
tatcacatctcacttaag

SEQ ID NO: 52153 - DNA, 18 bp, Artificial Sequence
  Synthetic DNA
tatcaccacacattttag

SEQ ID NO: 52154 - DNA, 18 bp, Artificial Sequence
  Synthetic DNA
tatcaccactctctaaag

SEQ ID NO: 52155 - DNA, 18 bp, Artificial Sequence
  Synthetic DNA
tatcaccacttatcttag

SEQ ID NO: 52156 - DNA, 18 bp, Artificial Sequence
  Synthetic DNA
tatcacgaatctctactg

SEQ ID NO: 52157 - DNA, 18 bp, Artificial Sequence
  Synthetic DNA
tatcacgacagacaatgg

SEQ ID NO: 52158 - DNA, 18 bp, Artificial Sequence
  Synthetic DNA
tatcacgacccccttacg

SEQ ID NO: 52159 - DNA, 18 bp, Artificial Sequence
  Synthetic DNA
tatcacgataccctatag

SEQ ID NO: 52160 - DNA, 18 bp, Artificial Sequence
  Synthetic DNA
tatcacgcatcccctaag

SEQ ID NO: 52161 - DNA, 18 bp, Artificial Sequence
  Synthetic DNA
tatcacgccttacaattg

SEQ ID NO: 52162 - DNA, 18 bp, Artificial Sequence
  Synthetic DNA
tatcacgctacactattg

SEQ ID NO: 52163 - DNA, 18 bp, Artificial Sequence
  Synthetic DNA
tatcacgtcacaatatag

SEQ ID NO: 52164 - DNA, 18 bp, Artificial Sequence
  Synthetic DNA
tatcacgtccctctatag

SEQ ID NO: 52165 - DNA, 18 bp, Artificial Sequence
  Synthetic DNA
tatcacgtctaaatactg

SEQ ID NO: 52166 - DNA, 18 bp, Artificial Sequence
  Synthetic DNA
tatcacgtctgactatgg

SEQ ID NO: 52167 - DNA, 18 bp, Artificial Sequence
  Synthetic DNA
tatcacgtgtcacattcg

SEQ ID NO: 52168 - DNA, 18 bp, Artificial Sequence
  Synthetic DNA
tatcacttctcacgatag

SEQ ID NO: 52169 - DNA, 18 bp, Artificial Sequence
  Synthetic DNA
tatcatgacagccaatag

SEQ ID NO: 52170 - DNA, 18 bp, Artificial Sequence
  Synthetic DNA
tatcattattcactatag

SEQ ID NO: 52171 - DNA, 18 bp, Artificial Sequence
  Synthetic DNA
tatcattattccctaaag

SEQ ID NO: 52172 - DNA, 18 bp, Artificial Sequence
  Synthetic DNA
tatcccgactcagtattg

SEQ ID NO: 52173 - DNA, 18 bp, Artificial Sequence
  Synthetic DNA
tatcccgatttactatag

SEQ ID NO: 52174 - DNA, 18 bp, Artificial Sequence
  Synthetic DNA
tatcccgtctcacaattg

SEQ ID NO: 52175 - DNA, 18 bp, Artificial Sequence
  Synthetic DNA
tatcctaccccacttcag

SEQ ID NO: 52176 - DNA, 18 bp, Artificial Sequence
  Synthetic DNA
tatctcaagtcagtacag

SEQ ID NO: 52177 - DNA, 18 bp, Artificial Sequence
  Synthetic DNA
tatctcgaaacacttcag

SEQ ID NO: 52178 - DNA, 18 bp, Artificial Sequence
  Synthetic DNA
tatctcgacacattttag

SEQ ID NO: 52179 - DNA, 18 bp, Artificial Sequence
  Synthetic DNA
tatctcgcctcacaatgg

SEQ ID NO: 52180 - DNA, 18 bp, Artificial Sequence
  Synthetic DNA
tatctcggctggatatcg

SEQ ID NO: 52181 - DNA, 18 bp, Artificial Sequence
  Synthetic DNA
tatcttgcctcactctag

SEQ ID NO: 52182 - DNA, 18 bp, Artificial Sequence
  Synthetic DNA
tatgacattccactgtag

SEQ ID NO: 52183 - DNA, 18 bp, Artificial Sequence
  Synthetic DNA
tatgaccccccacaaaag

SEQ ID NO: 52184 - DNA, 18 bp, Artificial Sequence
  Synthetic DNA
tatgacgagtcacttttg

SEQ ID NO: 52185 - DNA, 18 bp, Artificial Sequence
  Synthetic DNA
tatgattacttactctag

SEQ ID NO: 52186 - DNA, 18 bp, Artificial Sequence
  Synthetic DNA
tattaaaaatccccatag

SEQ ID NO: 52187 - DNA, 18 bp, Artificial Sequence
  Synthetic DNA
tattaaaacacactacag

SEQ ID NO: 52188 - DNA, 18 bp, Artificial Sequence
  Synthetic DNA
tattaaaacccatcaaag

SEQ ID NO: 52189 - DNA, 18 bp, Artificial Sequence
  Synthetic DNA
tattaaaactagctatag

SEQ ID NO: 52190 - DNA, 18 bp, Artificial Sequence
  Synthetic DNA
tattaacactatctgaag

SEQ ID NO: 52191 - DNA, 18 bp, Artificial Sequence
  Synthetic DNA
tattaacactcaataagg

SEQ ID NO: 52192 - DNA, 18 bp, Artificial Sequence
  Synthetic DNA
tattaagaaaatctatag

SEQ ID NO: 52193 - DNA, 18 bp, Artificial Sequence
  Synthetic DNA
tattaagaacgactaaag

SEQ ID NO: 52194 - DNA, 18 bp, Artificial Sequence
  Synthetic DNA
tattaagaataactaaag

SEQ ID NO: 52195 - DNA, 18 bp, Artificial Sequence
  Synthetic DNA
tattaagaatctcgacag

SEQ ID NO: 52196 - DNA, 18 bp, Artificial Sequence
  Synthetic DNA
tattaagactatctttag

SEQ ID NO: 52197 - DNA, 18 bp, Artificial Sequence
  Synthetic DNA
tattaagactcaagttag

SEQ ID NO: 52198 - DNA, 18 bp, Artificial Sequence
  Synthetic DNA
tattaagactcactcatg

SEQ ID NO: 52199 - DNA, 18 bp, Artificial Sequence
  Synthetic DNA
tattaagactctccaaag

SEQ ID NO: 52200 - DNA, 18 bp, Artificial Sequence
  Synthetic DNA
tattaagcctttctatag

SEQ ID NO: 52201 - DNA, 18 bp, Artificial Sequence
  Synthetic DNA
tattaaggctcccaaaag

SEQ ID NO: 52202 - DNA, 18 bp, Artificial Sequence
  Synthetic DNA
tattaaggttatttatag

SEQ ID NO: 52203 - DNA, 18 bp, Artificial Sequence
  Synthetic DNA
tattaagtcttacgtgtg

SEQ ID NO: 52204 - DNA, 18 bp, Artificial Sequence
  Synthetic DNA
tattaagtttcatttaag

SEQ ID NO: 52205 - DNA, 18 bp, Artificial Sequence
  Synthetic DNA
tattaatactcataaaag

SEQ ID NO: 52206 - DNA, 18 bp, Artificial Sequence
  Synthetic DNA
tattaatattctcaatag

SEQ ID NO: 52207 - DNA, 18 bp, Artificial Sequence
  Synthetic DNA
tattaattcttactatag

SEQ ID NO: 52208 - DNA, 18 bp, Artificial Sequence
  Synthetic DNA
tattacaaaacactttag

SEQ ID NO: 52209 - DNA, 18 bp, Artificial Sequence
  Synthetic DNA
tattacaaataactttag

SEQ ID NO: 52210 - DNA, 18 bp, Artificial Sequence
  Synthetic DNA
tattacaacaccctctag

SEQ ID NO: 52211 - DNA, 18 bp, Artificial Sequence
  Synthetic DNA
tattacaactcaaataag

SEQ ID NO: 52212 - DNA, 18 bp, Artificial Sequence
  Synthetic DNA
tattacaactccctctcg

SEQ ID NO: 52213 - DNA, 18 bp, Artificial Sequence
  Synthetic DNA
tattacaactcccttttg

SEQ ID NO: 52214 - DNA, 18 bp, Artificial Sequence
  Synthetic DNA
tattacaactctccttag

SEQ ID NO: 52215 - DNA, 18 bp, Artificial Sequence
  Synthetic DNA
tattacaagggcagatag

SEQ ID NO: 52216 - DNA, 18 bp, Artificial Sequence
  Synthetic DNA
tattacaatgcgctattg

SEQ ID NO: 52217 - DNA, 18 bp, Artificial Sequence
  Synthetic DNA
tattacacctcaccattg

SEQ ID NO: 52218 - DNA, 18 bp, Artificial Sequence
  Synthetic DNA
tattacataaccctaagg

SEQ ID NO: 52219 - DNA, 18 bp, Artificial Sequence
  Synthetic DNA
tattacatagccgaatag

SEQ ID NO: 52220 - DNA, 18 bp, Artificial Sequence
  Synthetic DNA
tattacatctcaatttag

SEQ ID NO: 52221 - DNA, 18 bp, Artificial Sequence
  Synthetic DNA
tattacatctcaccagag

SEQ ID NO: 52222 - DNA, 18 bp, Artificial Sequence
  Synthetic DNA
tattacatctctctgttg

SEQ ID NO: 52223 - DNA, 18 bp, Artificial Sequence
  Synthetic DNA
tattacatgtcactacag

SEQ ID NO: 52224 - DNA, 18 bp, Artificial Sequence
  Synthetic DNA
tattacatgtcactattg

SEQ ID NO: 52225 - DNA, 18 bp, Artificial Sequence
  Synthetic DNA
tattacattccactatag

SEQ ID NO: 52226 - DNA, 18 bp, Artificial Sequence
  Synthetic DNA
tattacatttcagtattg

SEQ ID NO: 52227 - DNA, 18 bp, Artificial Sequence
  Synthetic DNA
tattaccaaaaagtatgg

SEQ ID NO: 52228 - DNA, 18 bp, Artificial Sequence
  Synthetic DNA
tattaccactatctcatg

SEQ ID NO: 52229 - DNA, 18 bp, Artificial Sequence
  Synthetic DNA
tattaccactctcaaaag

SEQ ID NO: 52230 - DNA, 18 bp, Artificial Sequence
  Synthetic DNA
tattaccactctttttag

SEQ ID NO: 52231 - DNA, 18 bp, Artificial Sequence
  Synthetic DNA
tattaccagtctgtattg

SEQ ID NO: 52232 - DNA, 18 bp, Artificial Sequence
  Synthetic DNA
tattaccatacacacttg

SEQ ID NO: 52233 - DNA, 18 bp, Artificial Sequence
  Synthetic DNA
tattacccatcacaatag

SEQ ID NO: 52234 - DNA, 18 bp, Artificial Sequence
  Synthetic DNA
tattacccctcaatatcg

SEQ ID NO: 52235 - DNA, 18 bp, Artificial Sequence
  Synthetic DNA
tattacctctatcatttg

SEQ ID NO: 52236 - DNA, 18 bp, Artificial Sequence
  Synthetic DNA
tattacctctcataaaag

SEQ ID NO: 52237 - DNA, 18 bp, Artificial Sequence
  Synthetic DNA
tattacgaaacactaatg

SEQ ID NO: 52238 - DNA, 18 bp, Artificial Sequence
  Synthetic DNA
tattacgaaaccctaacg

SEQ ID NO: 52239 - DNA, 18 bp, Artificial Sequence
  Synthetic DNA
tattacgaaccgttatag

SEQ ID NO: 52240 - DNA, 18 bp, Artificial Sequence
  Synthetic DNA
tattacgaacctcttaag

SEQ ID NO: 52241 - DNA, 18 bp, Artificial Sequence
  Synthetic DNA
tattacgaataaaaatag

SEQ ID NO: 52242 - DNA, 18 bp, Artificial Sequence
  Synthetic DNA
tattacgacacagattgg

SEQ ID NO: 52243 - DNA, 18 bp, Artificial Sequence
  Synthetic DNA
tattacgacactcaaaag

SEQ ID NO: 52244 - DNA, 18 bp, Artificial Sequence
  Synthetic DNA
tattacgacagacacgag

SEQ ID NO: 52245 - DNA, 18 bp, Artificial Sequence
  Synthetic DNA
tattacgacagacagaag

SEQ ID NO: 52246 - DNA, 18 bp, Artificial Sequence
  Synthetic DNA
tattacgacagactaagg

SEQ ID NO: 52247 - DNA, 18 bp, Artificial Sequence
  Synthetic DNA
tattacgacatcctgtag

SEQ ID NO: 52248 - DNA, 18 bp, Artificial Sequence
  Synthetic DNA
tattacgacattcaatgg

SEQ ID NO: 52249 - DNA, 18 bp, Artificial Sequence
  Synthetic DNA
tattacgacccaataccg

SEQ ID NO: 52250 - DNA, 18 bp, Artificial Sequence
  Synthetic DNA
tattacgaccctctaggg

SEQ ID NO: 52251 - DNA, 18 bp, Artificial Sequence
  Synthetic DNA
tattacgaccgactctgg

SEQ ID NO: 52252 - DNA, 18 bp, Artificial Sequence
  Synthetic DNA
tattacgaccttctattg

SEQ ID NO: 52253 - DNA, 18 bp, Artificial Sequence
  Synthetic DNA
tattacgacgctctgaag

SEQ ID NO: 52254 - DNA, 18 bp, Artificial Sequence
  Synthetic DNA
tattacgacgctgattag

SEQ ID NO: 52255 - DNA, 18 bp, Artificial Sequence
  Synthetic DNA
tattacgactaaattcag

SEQ ID NO: 52256 - DNA, 18 bp, Artificial Sequence
  Synthetic DNA
tattacgactaaccttgg

SEQ ID NO: 52257 - DNA, 18 bp, Artificial Sequence
  Synthetic DNA
tattacgactatgcatag

SEQ ID NO: 52258 - DNA, 18 bp, Artificial Sequence
  Synthetic DNA
tattacgactcacctatg

SEQ ID NO: 52259 - DNA, 18 bp, Artificial Sequence
  Synthetic DNA
tattacgactccgcatgg

SEQ ID NO: 52260 - DNA, 18 bp, Artificial Sequence
  Synthetic DNA
tattacgactctcattcg

SEQ ID NO: 52261 - DNA, 18 bp, Artificial Sequence
  Synthetic DNA
tattacgactcttagttg

SEQ ID NO: 52262 - DNA, 18 bp, Artificial Sequence
  Synthetic DNA
tattacgactgacttatg

SEQ ID NO: 52263 - DNA, 18 bp, Artificial Sequence
  Synthetic DNA
tattacgactgtccctag

SEQ ID NO: 52264 - DNA, 18 bp, Artificial Sequence
  Synthetic DNA
tattacgagcagtataag

SEQ ID NO: 52265 - DNA, 18 bp, Artificial Sequence
  Synthetic DNA
tattacgagtttttaccg

SEQ ID NO: 52266 - DNA, 18 bp, Artificial Sequence
  Synthetic DNA
tattacgagtttttagag

SEQ ID NO: 52267 - DNA, 18 bp, Artificial Sequence
  Synthetic DNA
tattacgatacactaatg

SEQ ID NO: 52268 - DNA, 18 bp, Artificial Sequence
  Synthetic DNA
tattacgatacagtttag

SEQ ID NO: 52269 - DNA, 18 bp, Artificial Sequence
  Synthetic DNA
tattacgatctattgtgg

SEQ ID NO: 52270 - DNA, 18 bp, Artificial Sequence
  Synthetic DNA
tattacgattatctcaag

SEQ ID NO: 52271 - DNA, 18 bp, Artificial Sequence
  Synthetic DNA
tattacgattcaacagag

SEQ ID NO: 52272 - DNA, 18 bp, Artificial Sequence
  Synthetic DNA
tattacgattcattgtcg

SEQ ID NO: 52273 - DNA, 18 bp, Artificial Sequence
  Synthetic DNA
tattacgcaacactattg

SEQ ID NO: 52274 - DNA, 18 bp, Artificial Sequence
  Synthetic DNA
tattacgccccgctatcg

SEQ ID NO: 52275 - DNA, 18 bp, Artificial Sequence
  Synthetic DNA
tattacggcggactattg

SEQ ID NO: 52276 - DNA, 18 bp, Artificial Sequence
  Synthetic DNA
tattacggctcagttaag

SEQ ID NO: 52277 - DNA, 18 bp, Artificial Sequence
  Synthetic DNA
tattacgtagccctatag

SEQ ID NO: 52278 - DNA, 18 bp, Artificial Sequence
  Synthetic DNA
tattacgtatcgtaatag

SEQ ID NO: 52279 - DNA, 18 bp, Artificial Sequence
  Synthetic DNA
tattacgtcacacttacg

SEQ ID NO: 52280 - DNA, 18 bp, Artificial Sequence
  Synthetic DNA
tattacgtctatcggtag

SEQ ID NO: 52281 - DNA, 18 bp, Artificial Sequence
  Synthetic DNA
tattacgtctcatagatg

SEQ ID NO: 52282 - DNA, 18 bp, Artificial Sequence
  Synthetic DNA
tattacgtctcattcacg

SEQ ID NO: 52283 - DNA, 18 bp, Artificial Sequence
  Synthetic DNA
tattacgtctcgctccag

SEQ ID NO: 52284 - DNA, 18 bp, Artificial Sequence
  Synthetic DNA
tattacgtctgaatatgg

SEQ ID NO: 52285 - DNA, 18 bp, Artificial Sequence
  Synthetic DNA
tattacgtctgagaatag

SEQ ID NO: 52286 - DNA, 18 bp, Artificial Sequence
  Synthetic DNA
tattacgttacaacatag

SEQ ID NO: 52287 - DNA, 18 bp, Artificial Sequence
  Synthetic DNA
tattacgttccattcatg

SEQ ID NO: 52288 - DNA, 18 bp, Artificial Sequence
  Synthetic DNA
tattactaataacaatag

SEQ ID NO: 52289 - DNA, 18 bp, Artificial Sequence
  Synthetic DNA
tattactaatcattatcg

SEQ ID NO: 52290 - DNA, 18 bp, Artificial Sequence
  Synthetic DNA
tattactaatctccaatg

SEQ ID NO: 52291 - DNA, 18 bp, Artificial Sequence
  Synthetic DNA
tattactacaaacaatag

SEQ ID NO: 52292 - DNA, 18 bp, Artificial Sequence
  Synthetic DNA
tattactaccatctattg

SEQ ID NO: 52293 - DNA, 18 bp, Artificial Sequence
  Synthetic DNA
tattactactcaaaatcg

SEQ ID NO: 52294 - DNA, 18 bp, Artificial Sequence
  Synthetic DNA
tattactactcaatgaag

SEQ ID NO: 52295 - DNA, 18 bp, Artificial Sequence
  Synthetic DNA
tattactactgcttatag

SEQ ID NO: 52296 - DNA, 18 bp, Artificial Sequence
  Synthetic DNA
tattactacttacactgg

SEQ ID NO: 52297 - DNA, 18 bp, Artificial Sequence
  Synthetic DNA
tattactagacatcgttg

SEQ ID NO: 52298 - DNA, 18 bp, Artificial Sequence
  Synthetic DNA
tattactagtcactaacg

SEQ ID NO: 52299 - DNA, 18 bp, Artificial Sequence
  Synthetic DNA
tattactcctcaatattg

SEQ ID NO: 52300 - DNA, 18 bp, Artificial Sequence
  Synthetic DNA
tattactcctcccacgag

SEQ ID NO: 52301 - DNA, 18 bp, Artificial Sequence
  Synthetic DNA
tattactgcgcatcaatg

SEQ ID NO: 52302 - DNA, 18 bp, Artificial Sequence
  Synthetic DNA
tattacttatcgctatag

SEQ ID NO: 52303 - DNA, 18 bp, Artificial Sequence
  Synthetic DNA
tattacttctcacttcag

SEQ ID NO: 52304 - DNA, 18 bp, Artificial Sequence
  Synthetic DNA
tattacttctctccatgg

SEQ ID NO: 52305 - DNA, 18 bp, Artificial Sequence
  Synthetic DNA
tattagatatcactttag

SEQ ID NO: 52306 - DNA, 18 bp, Artificial Sequence
  Synthetic DNA
tattaggaatcgcttaag

SEQ ID NO: 52307 - DNA, 18 bp, Artificial Sequence
  Synthetic DNA
tattaggactcaatccag

SEQ ID NO: 52308 - DNA, 18 bp, Artificial Sequence
  Synthetic DNA
tattaggactctctttcg

SEQ ID NO: 52309 - DNA, 18 bp, Artificial Sequence
  Synthetic DNA
tattaggagtcaatatcg

SEQ ID NO: 52310 - DNA, 18 bp, Artificial Sequence
  Synthetic DNA
tattaggattcactaatg

SEQ ID NO: 52311 - DNA, 18 bp, Artificial Sequence
  Synthetic DNA
tattaggtcgcactattg

SEQ ID NO: 52312 - DNA, 18 bp, Artificial Sequence
  Synthetic DNA
tattaggtctaacaatag

SEQ ID NO: 52313 - DNA, 18 bp, Artificial Sequence
  Synthetic DNA
tattaggtctcaattacg

SEQ ID NO: 52314 - DNA, 18 bp, Artificial Sequence
  Synthetic DNA
tattataattaactaaag

SEQ ID NO: 52315 - DNA, 18 bp, Artificial Sequence
  Synthetic DNA
tattataatttactttag

SEQ ID NO: 52316 - DNA, 18 bp, Artificial Sequence
  Synthetic DNA
tattatatctcaatatag

SEQ ID NO: 52317 - DNA, 18 bp, Artificial Sequence
  Synthetic DNA
tattatcactcatattcg

SEQ ID NO: 52318 - DNA, 18 bp, Artificial Sequence
  Synthetic DNA
tattatgaataactaaag

SEQ ID NO: 52319 - DNA, 18 bp, Artificial Sequence
  Synthetic DNA
tattatgaatcaataatg

SEQ ID NO: 52320 - DNA, 18 bp, Artificial Sequence
  Synthetic DNA
tattatgaatcacttttg

SEQ ID NO: 52321 - DNA, 18 bp, Artificial Sequence
  Synthetic DNA
tattatgactccctactg

SEQ ID NO: 52322 - DNA, 18 bp, Artificial Sequence
  Synthetic DNA
tattatgactcgcacttg

SEQ ID NO: 52323 - DNA, 18 bp, Artificial Sequence
  Synthetic DNA
tattatgactgaatttag

SEQ ID NO: 52324 - DNA, 18 bp, Artificial Sequence
  Synthetic DNA
tattatgccatagcatcg

SEQ ID NO: 52325 - DNA, 18 bp, Artificial Sequence
  Synthetic DNA
tattatgcctctttatag

SEQ ID NO: 52326 - DNA, 18 bp, Artificial Sequence
  Synthetic DNA
tattatgccttaatatag

SEQ ID NO: 52327 - DNA, 18 bp, Artificial Sequence
  Synthetic DNA
tattatggataacaatag

SEQ ID NO: 52328 - DNA, 18 bp, Artificial Sequence
  Synthetic DNA
tattatgggacactatag

SEQ ID NO: 52329 - DNA, 18 bp, Artificial Sequence
  Synthetic DNA
tattatgtatcagaaatg

SEQ ID NO: 52330 - DNA, 18 bp, Artificial Sequence
  Synthetic DNA
tattatgtcacactctcg

SEQ ID NO: 52331 - DNA, 18 bp, Artificial Sequence
  Synthetic DNA
tattatgtcacattatag

SEQ ID NO: 52332 - DNA, 18 bp, Artificial Sequence
  Synthetic DNA
tattatgtcgcactctag

SEQ ID NO: 52333 - DNA, 18 bp, Artificial Sequence
  Synthetic DNA
tattatgtctcactggag

SEQ ID NO: 52334 - DNA, 18 bp, Artificial Sequence
  Synthetic DNA
tattattactgtgtatag

SEQ ID NO: 52335 - DNA, 18 bp, Artificial Sequence
  Synthetic DNA
tattcagactgacaacag

SEQ ID NO: 52336 - DNA, 18 bp, Artificial Sequence
  Synthetic DNA
tattccaattcactaaag

SEQ ID NO: 52337 - DNA, 18 bp, Artificial Sequence
  Synthetic DNA
tattcccgttgattatag

SEQ ID NO: 52338 - DNA, 18 bp, Artificial Sequence
  Synthetic DNA
tattccgacgccttatag

SEQ ID NO: 52339 - DNA, 18 bp, Artificial Sequence
  Synthetic DNA
tattccgacttactgaag

SEQ ID NO: 52340 - DNA, 18 bp, Artificial Sequence
  Synthetic DNA
tattccgacttgcaatag

SEQ ID NO: 52341 - DNA, 18 bp, Artificial Sequence
  Synthetic DNA
tattccgattcaatttag

SEQ ID NO: 52342 - DNA, 18 bp, Artificial Sequence
  Synthetic DNA
tattccgattgacaaaag

SEQ ID NO: 52343 - DNA, 18 bp, Artificial Sequence
  Synthetic DNA
tattccgatttacactag

SEQ ID NO: 52344 - DNA, 18 bp, Artificial Sequence
  Synthetic DNA
tattccgatttagtatag

SEQ ID NO: 52345 - DNA, 18 bp, Artificial Sequence
  Synthetic DNA
tattccgtctttctatag

SEQ ID NO: 52346 - DNA, 18 bp, Artificial Sequence
  Synthetic DNA
tattccgtttcaatatag

SEQ ID NO: 52347 - DNA, 18 bp, Artificial Sequence
  Synthetic DNA
tattcctacggactatcg

SEQ ID NO: 52348 - DNA, 18 bp, Artificial Sequence
  Synthetic DNA
tattcctattctctatag

SEQ ID NO: 52349 - DNA, 18 bp, Artificial Sequence
  Synthetic DNA
tattcgctcaaactatag

SEQ ID NO: 52350 - DNA, 18 bp, Artificial Sequence
  Synthetic DNA
tattctgactcgcaatag

SEQ ID NO: 52351 - DNA, 18 bp, Artificial Sequence
  Synthetic DNA
tattctgatactcaatgg

SEQ ID NO: 52352 - DNA, 18 bp, Artificial Sequence
  Synthetic DNA
tattctggcttacaaatg

SEQ ID NO: 52353 - DNA, 18 bp, Artificial Sequence
  Synthetic DNA
tattcttactctccatag

SEQ ID NO: 52354 - DNA, 18 bp, Artificial Sequence
  Synthetic DNA
tattgagattgtctagtg

SEQ ID NO: 52355 - DNA, 18 bp, Artificial Sequence
  Synthetic DNA
tattgagtcgtactacag

SEQ ID NO: 52356 - DNA, 18 bp, Artificial Sequence
  Synthetic DNA
tattgcaaaacacctcag

SEQ ID NO: 52357 - DNA, 18 bp, Artificial Sequence
  Synthetic DNA
tattgcaaatcactttag

SEQ ID NO: 52358 - DNA, 18 bp, Artificial Sequence
  Synthetic DNA
tattgcaactaactatgg

SEQ ID NO: 52359 - DNA, 18 bp, Artificial Sequence
  Synthetic DNA
tattgcaagtcactatcg

SEQ ID NO: 52360 - DNA, 18 bp, Artificial Sequence
  Synthetic DNA
tattgcatctcaagatag

SEQ ID NO: 52361 - DNA, 18 bp, Artificial Sequence
  Synthetic DNA
tattgccactcattaaag

SEQ ID NO: 52362 - DNA, 18 bp, Artificial Sequence
  Synthetic DNA
tattgccttccactatag

SEQ ID NO: 52363 - DNA, 18 bp, Artificial Sequence
  Synthetic DNA
tattgcgacacacgcttg

SEQ ID NO: 52364 - DNA, 18 bp, Artificial Sequence
  Synthetic DNA
tattgcgacagtctatgg

SEQ ID NO: 52365 - DNA, 18 bp, Artificial Sequence
  Synthetic DNA
tattgcgactacctaaag

SEQ ID NO: 52366 - DNA, 18 bp, Artificial Sequence
  Synthetic DNA
tattgcgactcagcatgg

SEQ ID NO: 52367 - DNA, 18 bp, Artificial Sequence
  Synthetic DNA
tattgcgactcattcgag

SEQ ID NO: 52368 - DNA, 18 bp, Artificial Sequence
  Synthetic DNA
tattgcgactccccattg

SEQ ID NO: 52369 - DNA, 18 bp, Artificial Sequence
  Synthetic DNA
tattgcgaggcagtatag

SEQ ID NO: 52370 - DNA, 18 bp, Artificial Sequence
  Synthetic DNA
tattgcgagtccctattg

SEQ ID NO: 52371 - DNA, 18 bp, Artificial Sequence
  Synthetic DNA
tattgcgattctctattg

SEQ ID NO: 52372 - DNA, 18 bp, Artificial Sequence
  Synthetic DNA
tattgggacgccataaag

SEQ ID NO: 52373 - DNA, 18 bp, Artificial Sequence
  Synthetic DNA
tattgggacgctctatag

SEQ ID NO: 52374 - DNA, 18 bp, Artificial Sequence
  Synthetic DNA
tatttacactcacttaag

SEQ ID NO: 52375 - DNA, 18 bp, Artificial Sequence
  Synthetic DNA
tatttactctcaccagag

SEQ ID NO: 52376 - DNA, 18 bp, Artificial Sequence
  Synthetic DNA
tatttagactaaatgtag

SEQ ID NO: 52377 - DNA, 18 bp, Artificial Sequence
  Synthetic DNA
tatttagactcactcatg

SEQ ID NO: 52378 - DNA, 18 bp, Artificial Sequence
  Synthetic DNA
tatttagagccactatag

SEQ ID NO: 52379 - DNA, 18 bp, Artificial Sequence
  Synthetic DNA
tatttagtctccctatcg

SEQ ID NO: 52380 - DNA, 18 bp, Artificial Sequence
  Synthetic DNA
tatttcaactcccaacgg

SEQ ID NO: 52381 - DNA, 18 bp, Artificial Sequence
  Synthetic DNA
tatttcaatttccaatag

SEQ ID NO: 52382 - DNA, 18 bp, Artificial Sequence
  Synthetic DNA
tatttcatcacactgtag

SEQ ID NO: 52383 - DNA, 18 bp, Artificial Sequence
  Synthetic DNA
tatttcatctcactagag

SEQ ID NO: 52384 - DNA, 18 bp, Artificial Sequence
  Synthetic DNA
tatttccactctatattg

SEQ ID NO: 52385 - DNA, 18 bp, Artificial Sequence
  Synthetic DNA
tatttccacttaccatag

SEQ ID NO: 52386 - DNA, 18 bp, Artificial Sequence
  Synthetic DNA
tatttcgaacgcatattg

SEQ ID NO: 52387 - DNA, 18 bp, Artificial Sequence
  Synthetic DNA
tatttcgaattacgttag

SEQ ID NO: 52388 - DNA, 18 bp, Artificial Sequence
  Synthetic DNA
tatttcgacacatcaaag

SEQ ID NO: 52389 - DNA, 18 bp, Artificial Sequence
  Synthetic DNA
tatttcgacataccatag

SEQ ID NO: 52390 - DNA, 18 bp, Artificial Sequence
  Synthetic DNA
tatttcgacctattatag

SEQ ID NO: 52391 - DNA, 18 bp, Artificial Sequence
  Synthetic DNA
tatttcgactcacattac

SEQ ID NO: 52392 - DNA, 18 bp, Artificial Sequence
  Synthetic DNA
tatttcgactctgcatag

SEQ ID NO: 52393 - DNA, 18 bp, Artificial Sequence
  Synthetic DNA
tatttcgacttgctttag

SEQ ID NO: 52394 - DNA, 18 bp, Artificial Sequence
  Synthetic DNA
tatttcgagtctctatcg

SEQ ID NO: 52395 - DNA, 18 bp, Artificial Sequence
  Synthetic DNA
tatttcgatacacactag

SEQ ID NO: 52396 - DNA, 18 bp, Artificial Sequence
  Synthetic DNA
tatttcgatacactatcg

SEQ ID NO: 52397 - DNA, 18 bp, Artificial Sequence
  Synthetic DNA
tatttcgatacactattg

SEQ ID NO: 52398 - DNA, 18 bp, Artificial Sequence
  Synthetic DNA
tatttcgatccacaacag

SEQ ID NO: 52399 - DNA, 18 bp, Artificial Sequence
  Synthetic DNA
tatttcgattcaaaatag

SEQ ID NO: 52400 - DNA, 18 bp, Artificial Sequence
  Synthetic DNA
tatttcgcctaactgtcg

SEQ ID NO: 52401 - DNA, 18 bp, Artificial Sequence
  Synthetic DNA
tatttcgtaagactctag

SEQ ID NO: 52402 - DNA, 18 bp, Artificial Sequence
  Synthetic DNA
tatttcgtagcaatatag

SEQ ID NO: 52403 - DNA, 18 bp, Artificial Sequence
  Synthetic DNA
tatttcgtctcactgctg

SEQ ID NO: 52404 - DNA, 18 bp, Artificial Sequence
  Synthetic DNA
tatttcgtctcattattg

SEQ ID NO: 52405 - DNA, 18 bp, Artificial Sequence
  Synthetic DNA
tatttctacaatcttttg

SEQ ID NO: 52406 - DNA, 18 bp, Artificial Sequence
  Synthetic DNA
tatttctacacacaatag

SEQ ID NO: 52407 - DNA, 18 bp, Artificial Sequence
  Synthetic DNA
tatttctactcagtcctg

SEQ ID NO: 52408 - DNA, 18 bp, Artificial Sequence
  Synthetic DNA
tatttctactcgcaatag

SEQ ID NO: 52409 - DNA, 18 bp, Artificial Sequence
  Synthetic DNA
tatttctactgaccatag

SEQ ID NO: 52410 - DNA, 18 bp, Artificial Sequence
  Synthetic DNA
tatttctattcggtattg

SEQ ID NO: 52411 - DNA, 18 bp, Artificial Sequence
  Synthetic DNA
tatttcttctagctatcg

SEQ ID NO: 52412 - DNA, 18 bp, Artificial Sequence
  Synthetic DNA
tatttgaactaactttgg

SEQ ID NO: 52413 - DNA, 18 bp, Artificial Sequence
  Synthetic DNA
tatttggagtcactaaag

SEQ ID NO: 52414 - DNA, 18 bp, Artificial Sequence
  Synthetic DNA
tatttggtctcagaaggg

SEQ ID NO: 52415 - DNA, 18 bp, Artificial Sequence
  Synthetic DNA
tattttaaaacagttttg

SEQ ID NO: 52416 - DNA, 18 bp, Artificial Sequence
  Synthetic DNA
tattttgacgtattatag

SEQ ID NO: 52417 - DNA, 18 bp, Artificial Sequence
  Synthetic DNA
tattttgactcattattg

SEQ ID NO: 52418 - DNA, 18 bp, Artificial Sequence
  Synthetic DNA
tattttgcctcgctttag

SEQ ID NO: 52419 - DNA, 18 bp, Artificial Sequence
  Synthetic DNA
tattttggctcagtatag

SEQ ID NO: 52420 - DNA, 18 bp, Artificial Sequence
  Synthetic DNA
tcaaaagattctttattg

SEQ ID NO: 52421 - DNA, 18 bp, Artificial Sequence
  Synthetic DNA
tcaaaatattcatttaag

SEQ ID NO: 52422 - DNA, 18 bp, Artificial Sequence
  Synthetic DNA
tcaaacaacccacaattg

SEQ ID NO: 52423 - DNA, 18 bp, Artificial Sequence
  Synthetic DNA
tcaaacaactaactttag

SEQ ID NO: 52424 - DNA, 18 bp, Artificial Sequence
  Synthetic DNA
tcaaacatgacagtatag

SEQ ID NO: 52425 - DNA, 18 bp, Artificial Sequence
  Synthetic DNA
tcaaaccactgattatag

SEQ ID NO: 52426 - DNA, 18 bp, Artificial Sequence
  Synthetic DNA
tcaaacgaaatacacttg

SEQ ID NO: 52427 - DNA, 18 bp, Artificial Sequence
  Synthetic DNA
tcaaacgaattacaatcg

SEQ ID NO: 52428 - DNA, 18 bp, Artificial Sequence
  Synthetic DNA
tcaaacgactaacaacag

SEQ ID NO: 52429 - DNA, 18 bp, Artificial Sequence
  Synthetic DNA
tcaaacgattctacgtag

SEQ ID NO: 52430 - DNA, 18 bp, Artificial Sequence
  Synthetic DNA
tcaaacgcatctcaatag

SEQ ID NO: 52431 - DNA, 18 bp, Artificial Sequence
  Synthetic DNA
tcaaacgcccctatatgg

SEQ ID NO: 52432 - DNA, 18 bp, Artificial Sequence
  Synthetic DNA
tcaaacgtatcaccattg

SEQ ID NO: 52433 - DNA, 18 bp, Artificial Sequence
  Synthetic DNA
tcaaacgtctctctgtag

SEQ ID NO: 52434 - DNA, 18 bp, Artificial Sequence
  Synthetic DNA
tcaaagcactcactttag

SEQ ID NO: 52435 - DNA, 18 bp, Artificial Sequence
  Synthetic DNA
tcaaatcaccctcattag

SEQ ID NO: 52436 - DNA, 18 bp, Artificial Sequence
  Synthetic DNA
tcaaatgtctctaaatag

SEQ ID NO: 52437 - DNA, 18 bp, Artificial Sequence
  Synthetic DNA
tcaaccgactcacttaag

SEQ ID NO: 52438 - DNA, 18 bp, Artificial Sequence
  Synthetic DNA
tcaaccgtctcgctttag

SEQ ID NO: 52439 - DNA, 18 bp, Artificial Sequence
  Synthetic DNA
tcaactgatacaccatag

SEQ ID NO: 52440 - DNA, 18 bp, Artificial Sequence
  Synthetic DNA
tcaagcgtctccctatgg

SEQ ID NO: 52441 - DNA, 18 bp, Artificial Sequence
  Synthetic DNA
tcaagtgactatatgtta

SEQ ID NO: 52442 - DNA, 18 bp, Artificial Sequence
  Synthetic DNA
tcaatagactcacaaatg

SEQ ID NO: 52443 - DNA, 18 bp, Artificial Sequence
  Synthetic DNA
tcaatagtcttactattg

SEQ ID NO: 52444 - DNA, 18 bp, Artificial Sequence
  Synthetic DNA
tcaatcctctcacaaacg

SEQ ID NO: 52445 - DNA, 18 bp, Artificial Sequence
  Synthetic DNA
tcaatcgactctcaattg

SEQ ID NO: 52446 - DNA, 18 bp, Artificial Sequence
  Synthetic DNA
tcaatcgcctccaaatag

SEQ ID NO: 52447 - DNA, 18 bp, Artificial Sequence
  Synthetic DNA
tcaatcgcttcactaaag

SEQ ID NO: 52448 - DNA, 18 bp, Artificial Sequence
  Synthetic DNA
tcaatctaacttatctag

SEQ ID NO: 52449 - DNA, 18 bp, Artificial Sequence
  Synthetic DNA
tcaattgacttgctttag

SEQ ID NO: 52450 - DNA, 18 bp, Artificial Sequence
  Synthetic DNA
tcaatttactcactaaag

SEQ ID NO: 52451 - DNA, 18 bp, Artificial Sequence
  Synthetic DNA
tcacaagactctctacag

SEQ ID NO: 52452 - DNA, 18 bp, Artificial Sequence
  Synthetic DNA
tcacaagtctcacaatag

SEQ ID NO: 52453 - DNA, 18 bp, Artificial Sequence
  Synthetic DNA
tcacacgaatccctacag

SEQ ID NO: 52454 - DNA, 18 bp, Artificial Sequence
  Synthetic DNA
tcacacgactccaaatag

SEQ ID NO: 52455 - DNA, 18 bp, Artificial Sequence
  Synthetic DNA
tcacacgacttacaatgg

SEQ ID NO: 52456 - DNA, 18 bp, Artificial Sequence
  Synthetic DNA
tcacacgagaatctattg

SEQ ID NO: 52457 - DNA, 18 bp, Artificial Sequence
  Synthetic DNA
tcacccgacccgcaaatg

SEQ ID NO: 52458 - DNA, 18 bp, Artificial Sequence
  Synthetic DNA
tcacctcgcttactacag

SEQ ID NO: 52459 - DNA, 18 bp, Artificial Sequence
  Synthetic DNA
tcacgctaaccactatag

SEQ ID NO: 52460 - DNA, 18 bp, Artificial Sequence
  Synthetic DNA
tcactcaactaacaaaag

SEQ ID NO: 52461 - DNA, 18 bp, Artificial Sequence
  Synthetic DNA
tcactcgaattactatag

SEQ ID NO: 52462 - DNA, 18 bp, Artificial Sequence
  Synthetic DNA
tcactcgcttcactaaag

SEQ ID NO: 52463 - DNA, 18 bp, Artificial Sequence
  Synthetic DNA
tcacttgacactcttcgg

SEQ ID NO: 52464 - DNA, 18 bp, Artificial Sequence
  Synthetic DNA
tcagtggcatcactatag

SEQ ID NO: 52465 - DNA, 18 bp, Artificial Sequence
  Synthetic DNA
tcataaagttttctatag

SEQ ID NO: 52466 - DNA, 18 bp, Artificial Sequence
  Synthetic DNA
tcataagacttactctcg

SEQ ID NO: 52467 - DNA, 18 bp, Artificial Sequence
  Synthetic DNA
tcataagacttgctaaag

SEQ ID NO: 52468 - DNA, 18 bp, Artificial Sequence
  Synthetic DNA
tcataatactcacgatcg

SEQ ID NO: 52469 - DNA, 18 bp, Artificial Sequence
  Synthetic DNA
tcatacaactatctttag

SEQ ID NO: 52470 - DNA, 18 bp, Artificial Sequence
  Synthetic DNA
tcatacaccttcctattg

SEQ ID NO: 52471 - DNA, 18 bp, Artificial Sequence
  Synthetic DNA
tcatacagctctttacag

SEQ ID NO: 52472 - DNA, 18 bp, Artificial Sequence
  Synthetic DNA
tcatacatatcactattg

SEQ ID NO: 52473 - DNA, 18 bp, Artificial Sequence
  Synthetic DNA
tcatacatcttcctgtgg

SEQ ID NO: 52474 - DNA, 18 bp, Artificial Sequence
  Synthetic DNA
tcataccacacgcaattg

SEQ ID NO: 52475 - DNA, 18 bp, Artificial Sequence
  Synthetic DNA
tcataccacagacgaaag

SEQ ID NO: 52476 - DNA, 18 bp, Artificial Sequence
  Synthetic DNA
tcataccactcatatttg

SEQ ID NO: 52477 - DNA, 18 bp, Artificial Sequence
  Synthetic DNA
tcatacctctccctaacg

SEQ ID NO: 52478 - DNA, 18 bp, Artificial Sequence
  Synthetic DNA
tcatacgaaccacaattg

SEQ ID NO: 52479 - DNA, 18 bp, Artificial Sequence
  Synthetic DNA
tcatacgacacattacga

SEQ ID NO: 52480 - DNA, 18 bp, Artificial Sequence
  Synthetic DNA
tcatacgacccaaaactg

SEQ ID NO: 52481 - DNA, 18 bp, Artificial Sequence
  Synthetic DNA
tcatacgactaacttggg

SEQ ID NO: 52482 - DNA, 18 bp, Artificial Sequence
  Synthetic DNA
tcatacgactgtccgtag

SEQ ID NO: 52483 - DNA, 18 bp, Artificial Sequence
  Synthetic DNA
tcatacgacttataattg

SEQ ID NO: 52484 - DNA, 18 bp, Artificial Sequence
  Synthetic DNA
tcatacgagtgagaatag

SEQ ID NO: 52485 - DNA, 18 bp, Artificial Sequence
  Synthetic DNA
tcatacgattccctcttg

SEQ ID NO: 52486 - DNA, 18 bp, Artificial Sequence
  Synthetic DNA
tcatacgattgtctaatg

SEQ ID NO: 52487 - DNA, 18 bp, Artificial Sequence
  Synthetic DNA
tcatacgatttacactag

SEQ ID NO: 52488 - DNA, 18 bp, Artificial Sequence
  Synthetic DNA
tcatacgattttctcacg

SEQ ID NO: 52489 - DNA, 18 bp, Artificial Sequence
  Synthetic DNA
tcatacgcataactaaag

SEQ ID NO: 52490 - DNA, 18 bp, Artificial Sequence
  Synthetic DNA
tcatacgccttaacttag

SEQ ID NO: 52491 - DNA, 18 bp, Artificial Sequence
  Synthetic DNA
tcatacgcgattctctag

SEQ ID NO: 52492 - DNA, 18 bp, Artificial Sequence
  Synthetic DNA
tcatacgtcacataacag

SEQ ID NO: 52493 - DNA, 18 bp, Artificial Sequence
  Synthetic DNA
tcatacgtctcggtattg

SEQ ID NO: 52494 - DNA, 18 bp, Artificial Sequence
  Synthetic DNA
tcatacgtctctatttag

SEQ ID NO: 52495 - DNA, 18 bp, Artificial Sequence
  Synthetic DNA
tcatacgtctttttaaag

SEQ ID NO: 52496 - DNA, 18 bp, Artificial Sequence
  Synthetic DNA
tcatactactcagtggtg

SEQ ID NO: 52497 - DNA, 18 bp, Artificial Sequence
  Synthetic DNA
tcatactagtatttatag

SEQ ID NO: 52498 - DNA, 18 bp, Artificial Sequence
  Synthetic DNA
tcatacttctaggcaaag

SEQ ID NO: 52499 - DNA, 18 bp, Artificial Sequence
  Synthetic DNA
tcataggacaggtaattg

SEQ ID NO: 52500 - DNA, 18 bp, Artificial Sequence
  Synthetic DNA
tcataggactcactgctg

SEQ ID NO: 52501 - DNA, 18 bp, Artificial Sequence
  Synthetic DNA
tcataggactttgtacag

SEQ ID NO: 52502 - DNA, 18 bp, Artificial Sequence
  Synthetic DNA
tcataggccacactattg

SEQ ID NO: 52503 - DNA, 18 bp, Artificial Sequence
  Synthetic DNA
tcatagtacacactagcg

SEQ ID NO: 52504 - DNA, 18 bp, Artificial Sequence
  Synthetic DNA
tcatataattctcaatag

SEQ ID NO: 52505 - DNA, 18 bp, Artificial Sequence
  Synthetic DNA
tcatatacctgacattag

SEQ ID NO: 52506 - DNA, 18 bp, Artificial Sequence
  Synthetic DNA
tcatatctatgacagtgg

SEQ ID NO: 52507 - DNA, 18 bp, Artificial Sequence
  Synthetic DNA
tcatatctctcactatgg

SEQ ID NO: 52508 - DNA, 18 bp, Artificial Sequence
  Synthetic DNA
tcatatgacgctgtttag

SEQ ID NO: 52509 - DNA, 18 bp, Artificial Sequence
  Synthetic DNA
tcatatgactcacttatg

SEQ ID NO: 52510 - DNA, 18 bp, Artificial Sequence
  Synthetic DNA
tcatatgactctcttctg

SEQ ID NO: 52511 - DNA, 18 bp, Artificial Sequence
  Synthetic DNA
tcatatggattactaaag

SEQ ID NO: 52512 - DNA, 18 bp, Artificial Sequence
  Synthetic DNA
tcatatggctcacattag

SEQ ID NO: 52513 - DNA, 18 bp, Artificial Sequence
  Synthetic DNA
tcatatggctctcaactg

SEQ ID NO: 52514 - DNA, 18 bp, Artificial Sequence
  Synthetic DNA
tcatatgtcagactttag

SEQ ID NO: 52515 - DNA, 18 bp, Artificial Sequence
  Synthetic DNA
tcatatgtctccctacag

SEQ ID NO: 52516 - DNA, 18 bp, Artificial Sequence
  Synthetic DNA
tcatattactcaaaatcg

SEQ ID NO: 52517 - DNA, 18 bp, Artificial Sequence
  Synthetic DNA
tcatcagtctttatatgg

SEQ ID NO: 52518 - DNA, 18 bp, Artificial Sequence
  Synthetic DNA
tcatccgacacacattag

SEQ ID NO: 52519 - DNA, 18 bp, Artificial Sequence
  Synthetic DNA
tcatccgcctgccaacag

SEQ ID NO: 52520 - DNA, 18 bp, Artificial Sequence
  Synthetic DNA
tcatccggctcatgattg

SEQ ID NO: 52521 - DNA, 18 bp, Artificial Sequence
  Synthetic DNA
tcatccgtttcacgaaag

SEQ ID NO: 52522 - DNA, 18 bp, Artificial Sequence
  Synthetic DNA
tcatcctactgactttag

SEQ ID NO: 52523 - DNA, 18 bp, Artificial Sequence
  Synthetic DNA
tcatctgactgacctaag

SEQ ID NO: 52524 - DNA, 18 bp, Artificial Sequence
  Synthetic DNA
tcatgcgacagaatttag

SEQ ID NO: 52525 - DNA, 18 bp, Artificial Sequence
  Synthetic DNA
tcatgcgagacatgatag

SEQ ID NO: 52526 - DNA, 18 bp, Artificial Sequence
  Synthetic DNA
tcatgcgtctcaattgag

SEQ ID NO: 52527 - DNA, 18 bp, Artificial Sequence
  Synthetic DNA
tcatgcgtctcaccaaag

SEQ ID NO: 52528 - DNA, 18 bp, Artificial Sequence
  Synthetic DNA
tcatgtgtgttaccggag

SEQ ID NO: 52529 - DNA, 18 bp, Artificial Sequence
  Synthetic DNA
tcattagactgctcatcg

SEQ ID NO: 52530 - DNA, 18 bp, Artificial Sequence
  Synthetic DNA
tcattagacttactattg

SEQ ID NO: 52531 - DNA, 18 bp, Artificial Sequence
  Synthetic DNA
tcattagttaccctttag

SEQ ID NO: 52532 - DNA, 18 bp, Artificial Sequence
  Synthetic DNA
tcattcaacttatgttag

SEQ ID NO: 52533 - DNA, 18 bp, Artificial Sequence
  Synthetic DNA
tcattcatcacacagagg

SEQ ID NO: 52534 - DNA, 18 bp, Artificial Sequence
  Synthetic DNA
tcattccagtgactatag

SEQ ID NO: 52535 - DNA, 18 bp, Artificial Sequence
  Synthetic DNA
tcattccatacactatag

SEQ ID NO: 52536 - DNA, 18 bp, Artificial Sequence
  Synthetic DNA
tcattcgactcgcttatg

SEQ ID NO: 52537 - DNA, 18 bp, Artificial Sequence
  Synthetic DNA
tcattcgacttacaaaag

SEQ ID NO: 52538 - DNA, 18 bp, Artificial Sequence
  Synthetic DNA
tcattcgatacaatattg

SEQ ID NO: 52539 - DNA, 18 bp, Artificial Sequence
  Synthetic DNA
tcattcgcctcagaattg

SEQ ID NO: 52540 - DNA, 18 bp, Artificial Sequence
  Synthetic DNA
tcattcgtttcacaacag

SEQ ID NO: 52541 - DNA, 18 bp, Artificial Sequence
  Synthetic DNA
tcattgaactcactgtag

SEQ ID NO: 52542 - DNA, 18 bp, Artificial Sequence
  Synthetic DNA
tcattggactcgtcacag

SEQ ID NO: 52543 - DNA, 18 bp, Artificial Sequence
  Synthetic DNA
tcatttcattcactattg

SEQ ID NO: 52544 - DNA, 18 bp, Artificial Sequence
  Synthetic DNA
tcatttgactgactttag

SEQ ID NO: 52545 - DNA, 18 bp, Artificial Sequence
  Synthetic DNA
tcatttgactttctaaag

SEQ ID NO: 52546 - DNA, 18 bp, Artificial Sequence
  Synthetic DNA
tccaaggactccgataag

SEQ ID NO: 52547 - DNA, 18 bp, Artificial Sequence
  Synthetic DNA
tccaccgacttacgatag

SEQ ID NO: 52548 - DNA, 18 bp, Artificial Sequence
  Synthetic DNA
tcccacgtcacactttag

SEQ ID NO: 52549 - DNA, 18 bp, Artificial Sequence
  Synthetic DNA
tcccactactcaccatag

SEQ ID NO: 52550 - DNA, 18 bp, Artificial Sequence
  Synthetic DNA
tcctacgaaacatatttg

SEQ ID NO: 52551 - DNA, 18 bp, Artificial Sequence
  Synthetic DNA
tcctacgactaacataag

SEQ ID NO: 52552 - DNA, 18 bp, Artificial Sequence
  Synthetic DNA
tcctacggtactcttgag

SEQ ID NO: 52553 - DNA, 18 bp, Artificial Sequence
  Synthetic DNA
tcctacgtcacacttcag

SEQ ID NO: 52554 - DNA, 18 bp, Artificial Sequence
  Synthetic DNA
tcctacgtttcaaaaaag

SEQ ID NO: 52555 - DNA, 18 bp, Artificial Sequence
  Synthetic DNA
tcctacttttcaatatag

SEQ ID NO: 52556 - DNA, 18 bp, Artificial Sequence
  Synthetic DNA
tcctatgagagagtatcg

SEQ ID NO: 52557 - DNA, 18 bp, Artificial Sequence
  Synthetic DNA
tcctatgattcactagag

SEQ ID NO: 52558 - DNA, 18 bp, Artificial Sequence
  Synthetic DNA
tccttcaattcactatag

SEQ ID NO: 52559 - DNA, 18 bp, Artificial Sequence
  Synthetic DNA
tcctttgactcaatttag

SEQ ID NO: 52560 - DNA, 18 bp, Artificial Sequence
  Synthetic DNA
tcgcacctctagcgattg

SEQ ID NO: 52561 - DNA, 18 bp, Artificial Sequence
  Synthetic DNA
tcggacgaacgtctccag

SEQ ID NO: 52562 - DNA, 18 bp, Artificial Sequence
  Synthetic DNA
tcgtacgactctcttttg

SEQ ID NO: 52563 - DNA, 18 bp, Artificial Sequence
  Synthetic DNA
tcgttcgagtcaatgctg

SEQ ID NO: 52564 - DNA, 18 bp, Artificial Sequence
  Synthetic DNA
tctaacaactcactatcg

SEQ ID NO: 52565 - DNA, 18 bp, Artificial Sequence
  Synthetic DNA
tctaacgacaaatttaag

SEQ ID NO: 52566 - DNA, 18 bp, Artificial Sequence
  Synthetic DNA
tctaacgacactcgatcg

SEQ ID NO: 52567 - DNA, 18 bp, Artificial Sequence
  Synthetic DNA
tctaacgacgccctatag

SEQ ID NO: 52568 - DNA, 18 bp, Artificial Sequence
  Synthetic DNA
tctaactgctcactttag

SEQ ID NO: 52569 - DNA, 18 bp, Artificial Sequence
  Synthetic DNA
tctaatcaatgactaaag

SEQ ID NO: 52570 - DNA, 18 bp, Artificial Sequence
  Synthetic DNA
tctagcaatatattacag

SEQ ID NO: 52571 - DNA, 18 bp, Artificial Sequence
  Synthetic DNA
tctatcgaataacttaag

SEQ ID NO: 52572 - DNA, 18 bp, Artificial Sequence
  Synthetic DNA
tctcagagctcactaaag

SEQ ID NO: 52573 - DNA, 18 bp, Artificial Sequence
  Synthetic DNA
tctcaggactctctttcg

SEQ ID NO: 52574 - DNA, 18 bp, Artificial Sequence
  Synthetic DNA
tctcaggcgacactatag

SEQ ID NO: 52575 - DNA, 18 bp, Artificial Sequence
  Synthetic DNA
tcttaaggctcacaagag

SEQ ID NO: 52576 - DNA, 18 bp, Artificial Sequence
  Synthetic DNA
tcttaatactcagcatag

SEQ ID NO: 52577 - DNA, 18 bp, Artificial Sequence
  Synthetic DNA
tcttacaactcaatattg

SEQ ID NO: 52578 - DNA, 18 bp, Artificial Sequence
  Synthetic DNA
tcttacagctcgctattg

SEQ ID NO: 52579 - DNA, 18 bp, Artificial Sequence
  Synthetic DNA
tcttacgattatcaaaag

SEQ ID NO: 52580 - DNA, 18 bp, Artificial Sequence
  Synthetic DNA
tcttacgccccactacag

SEQ ID NO: 52581 - DNA, 18 bp, Artificial Sequence
  Synthetic DNA
tcttacgcctctctattg

SEQ ID NO: 52582 - DNA, 18 bp, Artificial Sequence
  Synthetic DNA
tcttactactcagtaatg

SEQ ID NO: 52583 - DNA, 18 bp, Artificial Sequence
  Synthetic DNA
tcttactttttactaaag

SEQ ID NO: 52584 - DNA, 18 bp, Artificial Sequence
  Synthetic DNA
tcttatgactcactcgtg

SEQ ID NO: 52585 - DNA, 18 bp, Artificial Sequence
  Synthetic DNA
tcttatgactcatttaag

SEQ ID NO: 52586 - DNA, 18 bp, Artificial Sequence
  Synthetic DNA
tcttattacccacaatag

SEQ ID NO: 52587 - DNA, 18 bp, Artificial Sequence
  Synthetic DNA
tcttattactcaccactg

SEQ ID NO: 52588 - DNA, 18 bp, Artificial Sequence
  Synthetic DNA
tcttcagagtgactatag

SEQ ID NO: 52589 - DNA, 18 bp, Artificial Sequence
  Synthetic DNA
tcttccgactcacgttgg

SEQ ID NO: 52590 - DNA, 18 bp, Artificial Sequence
  Synthetic DNA
tcttcctagatactctag

SEQ ID NO: 52591 - DNA, 18 bp, Artificial Sequence
  Synthetic DNA
tcttcttattcactatag

SEQ ID NO: 52592 - DNA, 18 bp, Artificial Sequence
  Synthetic DNA
tcttgcaaaactttatag

SEQ ID NO: 52593 - DNA, 18 bp, Artificial Sequence
  Synthetic DNA
tcttgcgacatagtatag

SEQ ID NO: 52594 - DNA, 18 bp, Artificial Sequence
  Synthetic DNA
tctttcatcttaatgaag

SEQ ID NO: 52595 - DNA, 18 bp, Artificial Sequence
  Synthetic DNA
tctttcgactccctaatg

SEQ ID NO: 52596 - DNA, 18 bp, Artificial Sequence
  Synthetic DNA
tctttcgttcctctatag

SEQ ID NO: 52597 - DNA, 18 bp, Artificial Sequence
  Synthetic DNA
tctttgagcccactatag

SEQ ID NO: 52598 - DNA, 18 bp, Artificial Sequence
  Synthetic DNA
tcttttgactcactagag

SEQ ID NO: 52599 - DNA, 18 bp, Artificial Sequence
  Synthetic DNA
tcttttgattcactacag

SEQ ID NO: 52600 - DNA, 18 bp, Artificial Sequence
  Synthetic DNA
tgaaaataatcccggtag

SEQ ID NO: 52601 - DNA, 18 bp, Artificial Sequence
  Synthetic DNA
tgaaacaaaacactatag

SEQ ID NO: 52602 - DNA, 18 bp, Artificial Sequence
  Synthetic DNA
tgaaacaacacagtatag

SEQ ID NO: 52603 - DNA, 18 bp, Artificial Sequence
  Synthetic DNA
tgaaacaactcataatag

SEQ ID NO: 52604 - DNA, 18 bp, Artificial Sequence
  Synthetic DNA
tgaaacgacccaatttag

SEQ ID NO: 52605 - DNA, 18 bp, Artificial Sequence
  Synthetic DNA
tgaaacgactaacatttg

SEQ ID NO: 52606 - DNA, 18 bp, Artificial Sequence
  Synthetic DNA
tgaaacgacttagtctag

SEQ ID NO: 52607 - DNA, 18 bp, Artificial Sequence
  Synthetic DNA
tgaaacgattgacctatg

SEQ ID NO: 52608 - DNA, 18 bp, Artificial Sequence
  Synthetic DNA
tgaaacgtatctcttcag

SEQ ID NO: 52609 - DNA, 18 bp, Artificial Sequence
  Synthetic DNA
tgaaacgtcgcactaaag

SEQ ID NO: 52610 - DNA, 18 bp, Artificial Sequence
  Synthetic DNA
tgaaacgtctcattattg

SEQ ID NO: 52611 - DNA, 18 bp, Artificial Sequence
  Synthetic DNA
tgaaacgtctctaattag

SEQ ID NO: 52612 - DNA, 18 bp, Artificial Sequence
  Synthetic DNA
tgaaactaacctctattg

SEQ ID NO: 52613 - DNA, 18 bp, Artificial Sequence
  Synthetic DNA
tgaaactacacactttag

SEQ ID NO: 52614 - DNA, 18 bp, Artificial Sequence
  Synthetic DNA
tgaaactatcccctattg

SEQ ID NO: 52615 - DNA, 18 bp, Artificial Sequence
  Synthetic DNA
tgaaatgagacactatcg

SEQ ID NO: 52616 - DNA, 18 bp, Artificial Sequence
  Synthetic DNA
tgaaatgtctcaccagag

SEQ ID NO: 52617 - DNA, 18 bp, Artificial Sequence
  Synthetic DNA
tgaaatgtctcgctatag

SEQ ID NO: 52618 - DNA, 18 bp, Artificial Sequence
  Synthetic DNA
tgaaccaattcgcaatag

SEQ ID NO: 52619 - DNA, 18 bp, Artificial Sequence
  Synthetic DNA
tgaaccgaatcagtatag

SEQ ID NO: 52620 - DNA, 18 bp, Artificial Sequence
  Synthetic DNA
tgaagctactcactacag

SEQ ID NO: 52621 - DNA, 18 bp, Artificial Sequence
  Synthetic DNA
tgaatcgactcaacctag

SEQ ID NO: 52622 - DNA, 18 bp, Artificial Sequence
  Synthetic DNA
tgaatcggcttactattg

SEQ ID NO: 52623 - DNA, 18 bp, Artificial Sequence
  Synthetic DNA
tgaatcgtcactctatcg

SEQ ID NO: 52624 - DNA, 18 bp, Artificial Sequence
  Synthetic DNA
tgacacgacacgccatag

SEQ ID NO: 52625 - DNA, 18 bp, Artificial Sequence
  Synthetic DNA
tgacacgactgaatattg

SEQ ID NO: 52626 - DNA, 18 bp, Artificial Sequence
  Synthetic DNA
tgacacgagtatcattag

SEQ ID NO: 52627 - DNA, 18 bp, Artificial Sequence
  Synthetic DNA
tgacacgtcagacttaag

SEQ ID NO: 52628 - DNA, 18 bp, Artificial Sequence
  Synthetic DNA
tgacacgtctcaccaatg

SEQ ID NO: 52629 - DNA, 18 bp, Artificial Sequence
  Synthetic DNA
tgacattacttagtaaag

SEQ ID NO: 52630 - DNA, 18 bp, Artificial Sequence
  Synthetic DNA
tgacgcgagttactatag

SEQ ID NO: 52631 - DNA, 18 bp, Artificial Sequence
  Synthetic DNA
tgagacgaatatcaaaag

SEQ ID NO: 52632 - DNA, 18 bp, Artificial Sequence
  Synthetic DNA
tgagacgactcacatttg

SEQ ID NO: 52633 - DNA, 18 bp, Artificial Sequence
  Synthetic DNA
tgagactagtcaatatag

SEQ ID NO: 52634 - DNA, 18 bp, Artificial Sequence
  Synthetic DNA
tgagtgtacttactctag

SEQ ID NO: 52635 - DNA, 18 bp, Artificial Sequence
  Synthetic DNA
tgataaaactcactaagg

SEQ ID NO: 52636 - DNA, 18 bp, Artificial Sequence
  Synthetic DNA
tgataaatccctctatag

SEQ ID NO: 52637 - DNA, 18 bp, Artificial Sequence
  Synthetic DNA
tgataagaaactcaattg

SEQ ID NO: 52638 - DNA, 18 bp, Artificial Sequence
  Synthetic DNA
tgataagacgcaacatag

SEQ ID NO: 52639 - DNA, 18 bp, Artificial Sequence
  Synthetic DNA
tgataagactgtatatag

SEQ ID NO: 52640 - DNA, 18 bp, Artificial Sequence
  Synthetic DNA
tgataagccgcaccaatg

SEQ ID NO: 52641 - DNA, 18 bp, Artificial Sequence
  Synthetic DNA
tgatacaaacctctatag

SEQ ID NO: 52642 - DNA, 18 bp, Artificial Sequence
  Synthetic DNA
tgatacaactgacaacag

SEQ ID NO: 52643 - DNA, 18 bp, Artificial Sequence
  Synthetic DNA
tgatacaattcatcattg

SEQ ID NO: 52644 - DNA, 18 bp, Artificial Sequence
  Synthetic DNA
tgatacaattctatatag

SEQ ID NO: 52645 - DNA, 18 bp, Artificial Sequence
  Synthetic DNA
tgatacaccttactgtag

SEQ ID NO: 52646 - DNA, 18 bp, Artificial Sequence
  Synthetic DNA
tgatacagctcttttatg

SEQ ID NO: 52647 - DNA, 18 bp, Artificial Sequence
  Synthetic DNA
tgataccagttactatgg

SEQ ID NO: 52648 - DNA, 18 bp, Artificial Sequence
  Synthetic DNA
tgatacctctcattctag

SEQ ID NO: 52649 - DNA, 18 bp, Artificial Sequence
  Synthetic DNA
tgatacgaatatctattg

SEQ ID NO: 52650 - DNA, 18 bp, Artificial Sequence
  Synthetic DNA
tgatacgacacgcaattg

SEQ ID NO: 52651 - DNA, 18 bp, Artificial Sequence
  Synthetic DNA
tgatacgactcatataag

SEQ ID NO: 52652 - DNA, 18 bp, Artificial Sequence
  Synthetic DNA
tgatacgatacactagtg

SEQ ID NO: 52653 - DNA, 18 bp, Artificial Sequence
  Synthetic DNA
tgatacgattccgtacag

SEQ ID NO: 52654 - DNA, 18 bp, Artificial Sequence
  Synthetic DNA
tgatacgcctaagtaacg

SEQ ID NO: 52655 - DNA, 18 bp, Artificial Sequence
  Synthetic DNA
tgatacgctggacttcag

SEQ ID NO: 52656 - DNA, 18 bp, Artificial Sequence
  Synthetic DNA
tgatacgcttattaattg

SEQ ID NO: 52657 - DNA, 18 bp, Artificial Sequence
  Synthetic DNA
tgatacgtattactaacg

SEQ ID NO: 52658 - DNA, 18 bp, Artificial Sequence
  Synthetic DNA
tgatacgtcaaactacag

SEQ ID NO: 52659 - DNA, 18 bp, Artificial Sequence
  Synthetic DNA
tgatacgtcttacactag

SEQ ID NO: 52660 - DNA, 18 bp, Artificial Sequence
  Synthetic DNA
tgatactactaactaacg

SEQ ID NO: 52661 - DNA, 18 bp, Artificial Sequence
  Synthetic DNA
tgatactactgtctttag

SEQ ID NO: 52662 - DNA, 18 bp, Artificial Sequence
  Synthetic DNA
tgatactcctcatattag

SEQ ID NO: 52663 - DNA, 18 bp, Artificial Sequence
  Synthetic DNA
tgatataacacgctattg

SEQ ID NO: 52664 - DNA, 18 bp, Artificial Sequence
  Synthetic DNA
tgatataactttctttag

SEQ ID NO: 52665 - DNA, 18 bp, Artificial Sequence
  Synthetic DNA
tgatatcactctctttag

SEQ ID NO: 52666 - DNA, 18 bp, Artificial Sequence
  Synthetic DNA
tgatatgaacctctatag

SEQ ID NO: 52667 - DNA, 18 bp, Artificial Sequence
  Synthetic DNA
tgatatgactgactttgg

SEQ ID NO: 52668 - DNA, 18 bp, Artificial Sequence
  Synthetic DNA
tgatattacttacagtag

SEQ ID NO: 52669 - DNA, 18 bp, Artificial Sequence
  Synthetic DNA
tgatccatctctatataa

SEQ ID NO: 52670 - DNA, 18 bp, Artificial Sequence
  Synthetic DNA
tgatccgacatattatgg

SEQ ID NO: 52671 - DNA, 18 bp, Artificial Sequence
  Synthetic DNA
tgatccgcgtctctactg

SEQ ID NO: 52672 - DNA, 18 bp, Artificial Sequence
  Synthetic DNA
tgatcctactgactctag

SEQ ID NO: 52673 - DNA, 18 bp, Artificial Sequence
  Synthetic DNA
tgatcctttccactgttg

SEQ ID NO: 52674 - DNA, 18 bp, Artificial Sequence
  Synthetic DNA
tgatctgaaccacaatag

SEQ ID NO: 52675 - DNA, 18 bp, Artificial Sequence
  Synthetic DNA
tgatgcaaataactattg

SEQ ID NO: 52676 - DNA, 18 bp, Artificial Sequence
  Synthetic DNA
tgatgcgactaacaagtg

SEQ ID NO: 52677 - DNA, 18 bp, Artificial Sequence
  Synthetic DNA
tgatgcgactcacaaatg

SEQ ID NO: 52678 - DNA, 18 bp, Artificial Sequence
  Synthetic DNA
tgattaaattcaccatag

SEQ ID NO: 52679 - DNA, 18 bp, Artificial Sequence
  Synthetic DNA
tgattagattcactctag

SEQ ID NO: 52680 - DNA, 18 bp, Artificial Sequence
  Synthetic DNA
tgattaggcacgctatgg

SEQ ID NO: 52681 - DNA, 18 bp, Artificial Sequence
  Synthetic DNA
tgattcaaaacaatctag

SEQ ID NO: 52682 - DNA, 18 bp, Artificial Sequence
  Synthetic DNA
tgattcaacacacgaaag

SEQ ID NO: 52683 - DNA, 18 bp, Artificial Sequence
  Synthetic DNA
tgattcaacacactaaag

SEQ ID NO: 52684 - DNA, 18 bp, Artificial Sequence
  Synthetic DNA
tgattcaactaacattag

SEQ ID NO: 52685 - DNA, 18 bp, Artificial Sequence
  Synthetic DNA
tgattcgaaccactacag

SEQ ID NO: 52686 - DNA, 18 bp, Artificial Sequence
  Synthetic DNA
tgattcgacacagaatag

SEQ ID NO: 52687 - DNA, 18 bp, Artificial Sequence
  Synthetic DNA
tgattcgacataagatag

SEQ ID NO: 52688 - DNA, 18 bp, Artificial Sequence
  Synthetic DNA
tgattcgacttacttttg

SEQ ID NO: 52689 - DNA, 18 bp, Artificial Sequence
  Synthetic DNA
tgattcgatccattatcg

SEQ ID NO: 52690 - DNA, 18 bp, Artificial Sequence
  Synthetic DNA
tgattcgatgctataacg

SEQ ID NO: 52691 - DNA, 18 bp, Artificial Sequence
  Synthetic DNA
tgattcgcgtccctatag

SEQ ID NO: 52692 - DNA, 18 bp, Artificial Sequence
  Synthetic DNA
tgattcggctcactaatg

SEQ ID NO: 52693 - DNA, 18 bp, Artificial Sequence
  Synthetic DNA
tgattcgtcatattcaag

SEQ ID NO: 52694 - DNA, 18 bp, Artificial Sequence
  Synthetic DNA
tgattcgtgtcactatcg

SEQ ID NO: 52695 - DNA, 18 bp, Artificial Sequence
  Synthetic DNA
tgattctgctcaactgag

SEQ ID NO: 52696 - DNA, 18 bp, Artificial Sequence
  Synthetic DNA
tgattcttatcaatcgag

SEQ ID NO: 52697 - DNA, 18 bp, Artificial Sequence
  Synthetic DNA
tgattggacataatatag

SEQ ID NO: 52698 - DNA, 18 bp, Artificial Sequence
  Synthetic DNA
tgatttaacatacaatag

SEQ ID NO: 52699 - DNA, 18 bp, Artificial Sequence
  Synthetic DNA
tgatttgacttattatag

SEQ ID NO: 52700 - DNA, 18 bp, Artificial Sequence
  Synthetic DNA
tgatttggctcattatag

SEQ ID NO: 52701 - DNA, 18 bp, Artificial Sequence
  Synthetic DNA
tgattttacacacgattg

SEQ ID NO: 52702 - DNA, 18 bp, Artificial Sequence
  Synthetic DNA
tgcaacatctcactatag

SEQ ID NO: 52703 - DNA, 18 bp, Artificial Sequence
  Synthetic DNA
tgcaacgtaccactatag

SEQ ID NO: 52704 - DNA, 18 bp, Artificial Sequence
  Synthetic DNA
tgctaagattgactaagg

SEQ ID NO: 52705 - DNA, 18 bp, Artificial Sequence
  Synthetic DNA
tgctacgaatcagaatag

SEQ ID NO: 52706 - DNA, 18 bp, Artificial Sequence
  Synthetic DNA
tgctacgaccgactctag

SEQ ID NO: 52707 - DNA, 18 bp, Artificial Sequence
  Synthetic DNA
tgctacgtgagacagtgg

SEQ ID NO: 52708 - DNA, 18 bp, Artificial Sequence
  Synthetic DNA
tgctaggtctagatatag

SEQ ID NO: 52709 - DNA, 18 bp, Artificial Sequence
  Synthetic DNA
tgctgggaatcactatag

SEQ ID NO: 52710 - DNA, 18 bp, Artificial Sequence
  Synthetic DNA
tgcttaaactcataacag

SEQ ID NO: 52711 - DNA, 18 bp, Artificial Sequence
  Synthetic DNA
tgcttcggctctcaatag

SEQ ID NO: 52712 - DNA, 18 bp, Artificial Sequence
  Synthetic DNA
tgcttcgtcacacaatag

SEQ ID NO: 52713 - DNA, 18 bp, Artificial Sequence
  Synthetic DNA
tgcttctactaacaatag

SEQ ID NO: 52714 - DNA, 18 bp, Artificial Sequence
  Synthetic DNA
tggaacgtcccacgctag

SEQ ID NO: 52715 - DNA, 18 bp, Artificial Sequence
  Synthetic DNA
tggtaacactccctatag

SEQ ID NO: 52716 - DNA, 18 bp, Artificial Sequence
  Synthetic DNA
tggtacaactcactcatg

SEQ ID NO: 52717 - DNA, 18 bp, Artificial Sequence
  Synthetic DNA
tggtaccactcaatacag

SEQ ID NO: 52718 - DNA, 18 bp, Artificial Sequence
  Synthetic DNA
tggtacgacacagtattg

SEQ ID NO: 52719 - DNA, 18 bp, Artificial Sequence
  Synthetic DNA
tggtacgattcgttatag

SEQ ID NO: 52720 - DNA, 18 bp, Artificial Sequence
  Synthetic DNA
tggtacgtctcacactag

SEQ ID NO: 52721 - DNA, 18 bp, Artificial Sequence
  Synthetic DNA
tggtacgtctcagtacag

SEQ ID NO: 52722 - DNA, 18 bp, Artificial Sequence
  Synthetic DNA
tggtacgtctctcaattg

SEQ ID NO: 52723 - DNA, 18 bp, Artificial Sequence
  Synthetic DNA
tggtaggactctatatag

SEQ ID NO: 52724 - DNA, 18 bp, Artificial Sequence
  Synthetic DNA
tggtccgaaccactcgag

SEQ ID NO: 52725 - DNA, 18 bp, Artificial Sequence
  Synthetic DNA
tggtgcgaatcagtattg

SEQ ID NO: 52726 - DNA, 18 bp, Artificial Sequence
  Synthetic DNA
tggttagatgcactatag

SEQ ID NO: 52727 - DNA, 18 bp, Artificial Sequence
  Synthetic DNA
tggttccagtctctatag

SEQ ID NO: 52728 - DNA, 18 bp, Artificial Sequence
  Synthetic DNA
tgtaacgattcacgatag

SEQ ID NO: 52729 - DNA, 18 bp, Artificial Sequence
  Synthetic DNA
tgtaactactcattttag

SEQ ID NO: 52730 - DNA, 18 bp, Artificial Sequence
  Synthetic DNA
tgtaagtattcacttcag

SEQ ID NO: 52731 - DNA, 18 bp, Artificial Sequence
  Synthetic DNA
tgtcaagattaattatag

SEQ ID NO: 52732 - DNA, 18 bp, Artificial Sequence
  Synthetic DNA
tgtcactacccactatag

SEQ ID NO: 52733 - DNA, 18 bp, Artificial Sequence
  Synthetic DNA
tgtcactactaactatag

SEQ ID NO: 52734 - DNA, 18 bp, Artificial Sequence
  Synthetic DNA
tgtcaggacatactatag

SEQ ID NO: 52735 - DNA, 18 bp, Artificial Sequence
  Synthetic DNA
tgtctcgactcaatttag

SEQ ID NO: 52736 - DNA, 18 bp, Artificial Sequence
  Synthetic DNA
tgttaagactacttatag

SEQ ID NO: 52737 - DNA, 18 bp, Artificial Sequence
  Synthetic DNA
tgttacaacctacaatag

SEQ ID NO: 52738 - DNA, 18 bp, Artificial Sequence
  Synthetic DNA
tgttacacatcactaaag

SEQ ID NO: 52739 - DNA, 18 bp, Artificial Sequence
  Synthetic DNA
tgttaccacttcctacag

SEQ ID NO: 52740 - DNA, 18 bp, Artificial Sequence
  Synthetic DNA
tgttacctcccagtagag

SEQ ID NO: 52741 - DNA, 18 bp, Artificial Sequence
  Synthetic DNA
tgttacgactcataacag

SEQ ID NO: 52742 - DNA, 18 bp, Artificial Sequence
  Synthetic DNA
tgttacgactcattgatg

SEQ ID NO: 52743 - DNA, 18 bp, Artificial Sequence
  Synthetic DNA
tgttacgcctgacctagg

SEQ ID NO: 52744 - DNA, 18 bp, Artificial Sequence
  Synthetic DNA
tgttacgtctctctaccg

SEQ ID NO: 52745 - DNA, 18 bp, Artificial Sequence
  Synthetic DNA
tgttacttctgactatag

SEQ ID NO: 52746 - DNA, 18 bp, Artificial Sequence
  Synthetic DNA
tgttaggactttatattg

SEQ ID NO: 52747 - DNA, 18 bp, Artificial Sequence
  Synthetic DNA
tgttatgactcacatttg

SEQ ID NO: 52748 - DNA, 18 bp, Artificial Sequence
  Synthetic DNA
tgttcagactcactacag

SEQ ID NO: 52749 - DNA, 18 bp, Artificial Sequence
  Synthetic DNA
tgttccaactcactctag

SEQ ID NO: 52750 - DNA, 18 bp, Artificial Sequence
  Synthetic DNA
tgttccgacacgctgtag

SEQ ID NO: 52751 - DNA, 18 bp, Artificial Sequence
  Synthetic DNA
tgttgagacttacaaaag

SEQ ID NO: 52752 - DNA, 18 bp, Artificial Sequence
  Synthetic DNA
tgttgccacccacattag

SEQ ID NO: 52753 - DNA, 18 bp, Artificial Sequence
  Synthetic DNA
tgtttcatcacactgtag

SEQ ID NO: 52754 - DNA, 18 bp, Artificial Sequence
  Synthetic DNA
tgtttcgacgcactattg

SEQ ID NO: 52755 - DNA, 18 bp, Artificial Sequence
  Synthetic DNA
tgtttcgactaaccattg

SEQ ID NO: 52756 - DNA, 18 bp, Artificial Sequence
  Synthetic DNA
tgtttctactcaatccag

SEQ ID NO: 52757 - DNA, 18 bp, Artificial Sequence
  Synthetic DNA
ttaaaagacatactgtag

SEQ ID NO: 52758 - DNA, 18 bp, Artificial Sequence
  Synthetic DNA
ttaaaagactaacaatag

SEQ ID NO: 52759 - DNA, 18 bp, Artificial Sequence
  Synthetic DNA
ttaaaagattcacaatag

SEQ ID NO: 52760 - DNA, 18 bp, Artificial Sequence
  Synthetic DNA
ttaaaaggctcaattaag

SEQ ID NO: 52761 - DNA, 18 bp, Artificial Sequence
  Synthetic DNA
ttaaaagtgacactagag

SEQ ID NO: 52762 - DNA, 18 bp, Artificial Sequence
  Synthetic DNA
ttaaacaaatccctaaag

SEQ ID NO: 52763 - DNA, 18 bp, Artificial Sequence
  Synthetic DNA
ttaaacaaatgacaatag

SEQ ID NO: 52764 - DNA, 18 bp, Artificial Sequence
  Synthetic DNA
ttaaacaactaacaaaag

SEQ ID NO: 52765 - DNA, 18 bp, Artificial Sequence
  Synthetic DNA
ttaaacaacttgctatag

SEQ ID NO: 52766 - DNA, 18 bp, Artificial Sequence
  Synthetic DNA
ttaaacagcactcaattg

SEQ ID NO: 52767 - DNA, 18 bp, Artificial Sequence
  Synthetic DNA
ttaaaccacacacgacag

SEQ ID NO: 52768 - DNA, 18 bp, Artificial Sequence
  Synthetic DNA
ttaaacgaaaccaaattg

SEQ ID NO: 52769 - DNA, 18 bp, Artificial Sequence
  Synthetic DNA
ttaaacgacattctaacg

SEQ ID NO: 52770 - DNA, 18 bp, Artificial Sequence
  Synthetic DNA
ttaaacgactaaacttag

SEQ ID NO: 52771 - DNA, 18 bp, Artificial Sequence
  Synthetic DNA
ttaaacgactaacaaaag

SEQ ID NO: 52772 - DNA, 18 bp, Artificial Sequence
  Synthetic DNA
ttaaacgactacctattg

SEQ ID NO: 52773 - DNA, 18 bp, Artificial Sequence
  Synthetic DNA
ttaaacgactctcaatcg

SEQ ID NO: 52774 - DNA, 18 bp, Artificial Sequence
  Synthetic DNA
ttaaacgacttattatga

SEQ ID NO: 52775 - DNA, 18 bp, Artificial Sequence
  Synthetic DNA
ttaaacgacttgctattg

SEQ ID NO: 52776 - DNA, 18 bp, Artificial Sequence
  Synthetic DNA
ttaaacgagattctaaag

SEQ ID NO: 52777 - DNA, 18 bp, Artificial Sequence
  Synthetic DNA
ttaaacgattgtctaatg

SEQ ID NO: 52778 - DNA, 18 bp, Artificial Sequence
  Synthetic DNA
ttaaacgcctcacaaaag

SEQ ID NO: 52779 - DNA, 18 bp, Artificial Sequence
  Synthetic DNA
ttaaacggctgattatag

SEQ ID NO: 52780 - DNA, 18 bp, Artificial Sequence
  Synthetic DNA
ttaaacgtccgtctatag

SEQ ID NO: 52781 - DNA, 18 bp, Artificial Sequence
  Synthetic DNA
ttaaacgtctaaatatag

SEQ ID NO: 52782 - DNA, 18 bp, Artificial Sequence
  Synthetic DNA
ttaaacgttacgcatttg

SEQ ID NO: 52783 - DNA, 18 bp, Artificial Sequence
  Synthetic DNA
ttaaacgttgcaatatag

SEQ ID NO: 52784 - DNA, 18 bp, Artificial Sequence
  Synthetic DNA
ttaaacgtttgattatag

SEQ ID NO: 52785 - DNA, 18 bp, Artificial Sequence
  Synthetic DNA
ttaaactactcacaatcg

SEQ ID NO: 52786 - DNA, 18 bp, Artificial Sequence
  Synthetic DNA
ttaaacttctccctatag

SEQ ID NO: 52787 - DNA, 18 bp, Artificial Sequence
  Synthetic DNA
ttaaacttgcctctgtag

SEQ ID NO: 52788 - DNA, 18 bp, Artificial Sequence
  Synthetic DNA
ttaaactttactctatag

SEQ ID NO: 52789 - DNA, 18 bp, Artificial Sequence
  Synthetic DNA
ttaaaggccacaatttag

SEQ ID NO: 52790 - DNA, 18 bp, Artificial Sequence
  Synthetic DNA
ttaaagttctaactaatg

SEQ ID NO: 52791 - DNA, 18 bp, Artificial Sequence
  Synthetic DNA
ttaaataactggctttag

SEQ ID NO: 52792 - DNA, 18 bp, Artificial Sequence
  Synthetic DNA
ttaaatcactcaatatag

SEQ ID NO: 52793 - DNA, 18 bp, Artificial Sequence
  Synthetic DNA
ttaaatgaaactctttag

SEQ ID NO: 52794 - DNA, 18 bp, Artificial Sequence
  Synthetic DNA
ttaaatgaccaactatcg

SEQ ID NO: 52795 - DNA, 18 bp, Artificial Sequence
  Synthetic DNA
ttaaatgtcactatacag

SEQ ID NO: 52796 - DNA, 18 bp, Artificial Sequence
  Synthetic DNA
ttaaatgtctcacaccag

SEQ ID NO: 52797 - DNA, 18 bp, Artificial Sequence
  Synthetic DNA
ttaaatttctcacaatag

SEQ ID NO: 52798 - DNA, 18 bp, Artificial Sequence
  Synthetic DNA
ttaaccaacacgttttag

SEQ ID NO: 52799 - DNA, 18 bp, Artificial Sequence
  Synthetic DNA
ttaaccgaatcgccaaag

SEQ ID NO: 52800 - DNA, 18 bp, Artificial Sequence
  Synthetic DNA
ttaaccgattcaatatag

SEQ ID NO: 52801 - DNA, 18 bp, Artificial Sequence
  Synthetic DNA
ttaaccggcttaatatag

SEQ ID NO: 52802 - DNA, 18 bp, Artificial Sequence
  Synthetic DNA
ttaacctaatcactatag

SEQ ID NO: 52803 - DNA, 18 bp, Artificial Sequence
  Synthetic DNA
ttaacgcactctctatag

SEQ ID NO: 52804 - DNA, 18 bp, Artificial Sequence
  Synthetic DNA
ttaagcgacacactctag

SEQ ID NO: 52805 - DNA, 18 bp, Artificial Sequence
  Synthetic DNA
ttaagcgagtcattatag

SEQ ID NO: 52806 - DNA, 18 bp, Artificial Sequence
  Synthetic DNA
ttaagcgtccaactacag

SEQ ID NO: 52807 - DNA, 18 bp, Artificial Sequence
  Synthetic DNA
ttaagcgtctcagtacag

SEQ ID NO: 52808 - DNA, 18 bp, Artificial Sequence
  Synthetic DNA
ttaatagactcgctatcg

SEQ ID NO: 52809 - DNA, 18 bp, Artificial Sequence
  Synthetic DNA
ttaatatactcactctag

SEQ ID NO: 52810 - DNA, 18 bp, Artificial Sequence
  Synthetic DNA
ttaatcaactagctattg

SEQ ID NO: 52811 - DNA, 18 bp, Artificial Sequence
  Synthetic DNA
ttaatcccgtcagtgtcg

SEQ ID NO: 52812 - DNA, 18 bp, Artificial Sequence
  Synthetic DNA
ttaatcgactgcctctag

SEQ ID NO: 52813 - DNA, 18 bp, Artificial Sequence
  Synthetic DNA
ttaatcgcatcaatatag

SEQ ID NO: 52814 - DNA, 18 bp, Artificial Sequence
  Synthetic DNA
ttaatcggttcactatag

SEQ ID NO: 52815 - DNA, 18 bp, Artificial Sequence
  Synthetic DNA
ttaatcgtcactctaatg

SEQ ID NO: 52816 - DNA, 18 bp, Artificial Sequence
  Synthetic DNA
ttaatggacactatgtag

SEQ ID NO: 52817 - DNA, 18 bp, Artificial Sequence
  Synthetic DNA
ttaattgactccttattg

SEQ ID NO: 52818 - DNA, 18 bp, Artificial Sequence
  Synthetic DNA
ttaattgtcgctctatag

SEQ ID NO: 52819 - DNA, 18 bp, Artificial Sequence
  Synthetic DNA
ttaatttactctcatcag

SEQ ID NO: 52820 - DNA, 18 bp, Artificial Sequence
  Synthetic DNA
ttacaagtgtcacaatag

SEQ ID NO: 52821 - DNA, 18 bp, Artificial Sequence
  Synthetic DNA
ttacaattaactctacag

SEQ ID NO: 52822 - DNA, 18 bp, Artificial Sequence
  Synthetic DNA
ttacacaactcgttaatg

SEQ ID NO: 52823 - DNA, 18 bp, Artificial Sequence
  Synthetic DNA
ttacacaactctctaagg

SEQ ID NO: 52824 - DNA, 18 bp, Artificial Sequence
  Synthetic DNA
ttacacagctcatattcg

SEQ ID NO: 52825 - DNA, 18 bp, Artificial Sequence
  Synthetic DNA
ttacacgactcgctaacg

SEQ ID NO: 52826 - DNA, 18 bp, Artificial Sequence
  Synthetic DNA
ttacacgactctatattg

SEQ ID NO: 52827 - DNA, 18 bp, Artificial Sequence
  Synthetic DNA
ttacacgagacactactg

SEQ ID NO: 52828 - DNA, 18 bp, Artificial Sequence
  Synthetic DNA
ttacacgagtaacaaaag

SEQ ID NO: 52829 - DNA, 18 bp, Artificial Sequence
  Synthetic DNA
ttacacgattcactcaag

SEQ ID NO: 52830 - DNA, 18 bp, Artificial Sequence
  Synthetic DNA
ttacacgatttactatcg

SEQ ID NO: 52831 - DNA, 18 bp, Artificial Sequence
  Synthetic DNA
ttacacgcaaatctatag

SEQ ID NO: 52832 - DNA, 18 bp, Artificial Sequence
  Synthetic DNA
ttacacgccttgttatag

SEQ ID NO: 52833 - DNA, 18 bp, Artificial Sequence
  Synthetic DNA
ttacacggctctcaatag

SEQ ID NO: 52834 - DNA, 18 bp, Artificial Sequence
  Synthetic DNA
ttacacggcttactattg

SEQ ID NO: 52835 - DNA, 18 bp, Artificial Sequence
  Synthetic DNA
ttacacgtaaatctaatg

SEQ ID NO: 52836 - DNA, 18 bp, Artificial Sequence
  Synthetic DNA
ttacacgtataactgtag

SEQ ID NO: 52837 - DNA, 18 bp, Artificial Sequence
  Synthetic DNA
ttacacgtcttactatcg

SEQ ID NO: 52838 - DNA, 18 bp, Artificial Sequence
  Synthetic DNA
ttacactaaaccctattg

SEQ ID NO: 52839 - DNA, 18 bp, Artificial Sequence
  Synthetic DNA
ttacaggaatcactattg

SEQ ID NO: 52840 - DNA, 18 bp, Artificial Sequence
  Synthetic DNA
ttacatacctcaatattg

SEQ ID NO: 52841 - DNA, 18 bp, Artificial Sequence
  Synthetic DNA
ttacatcattaacatttg

SEQ ID NO: 52842 - DNA, 18 bp, Artificial Sequence
  Synthetic DNA
ttacatgaatcgttggag

SEQ ID NO: 52843 - DNA, 18 bp, Artificial Sequence
  Synthetic DNA
ttacatgatccactctag

SEQ ID NO: 52844 - DNA, 18 bp, Artificial Sequence
  Synthetic DNA
ttacatgtctcactcttg

SEQ ID NO: 52845 - DNA, 18 bp, Artificial Sequence
  Synthetic DNA
ttacattactcactctag

SEQ ID NO: 52846 - DNA, 18 bp, Artificial Sequence
  Synthetic DNA
ttacccgactcacttagg

SEQ ID NO: 52847 - DNA, 18 bp, Artificial Sequence
  Synthetic DNA
ttacccgactcgcactag

SEQ ID NO: 52848 - DNA, 18 bp, Artificial Sequence
  Synthetic DNA
ttaccctacatactaagg

SEQ ID NO: 52849 - DNA, 18 bp, Artificial Sequence
  Synthetic DNA
ttacgcgtatcacattag

SEQ ID NO: 52850 - DNA, 18 bp, Artificial Sequence
  Synthetic DNA
ttacgtgtcgcactattg

SEQ ID NO: 52851 - DNA, 18 bp, Artificial Sequence
  Synthetic DNA
ttactcatctcattgcag

SEQ ID NO: 52852 - DNA, 18 bp, Artificial Sequence
  Synthetic DNA
ttactcgactcaatctag

SEQ ID NO: 52853 - DNA, 18 bp, Artificial Sequence
  Synthetic DNA
ttactcgacttagtctcg

SEQ ID NO: 52854 - DNA, 18 bp, Artificial Sequence
  Synthetic DNA
ttagacaaatcacattag

SEQ ID NO: 52855 - DNA, 18 bp, Artificial Sequence
  Synthetic DNA
ttagacaactcatattag

SEQ ID NO: 52856 - DNA, 18 bp, Artificial Sequence
  Synthetic DNA
ttagacgaaaccctatag

SEQ ID NO: 52857 - DNA, 18 bp, Artificial Sequence
  Synthetic DNA
ttagacgacaaactaaag

SEQ ID NO: 52858 - DNA, 18 bp, Artificial Sequence
  Synthetic DNA
ttagacgactgacattag

SEQ ID NO: 52859 - DNA, 18 bp, Artificial Sequence
  Synthetic DNA
ttagacgactgtcaaaag

SEQ ID NO: 52860 - DNA, 18 bp, Artificial Sequence
  Synthetic DNA
ttagacttctgtctattg

SEQ ID NO: 52861 - DNA, 18 bp, Artificial Sequence
  Synthetic DNA
ttagaggtgtcactttag

SEQ ID NO: 52862 - DNA, 18 bp, Artificial Sequence
  Synthetic DNA
ttagccggctcattatag

SEQ ID NO: 52863 - DNA, 18 bp, Artificial Sequence
  Synthetic DNA
ttagtcgaatcgctccag

SEQ ID NO: 52864 - DNA, 18 bp, Artificial Sequence
  Synthetic DNA
ttagttgacacagtatag

SEQ ID NO: 52865 - DNA, 18 bp, Artificial Sequence
  Synthetic DNA
ttataaaacttagtcaag

SEQ ID NO: 52866 - DNA, 18 bp, Artificial Sequence
  Synthetic DNA
ttataaatctcgccatag

SEQ ID NO: 52867 - DNA, 18 bp, Artificial Sequence
  Synthetic DNA
ttataacactaaatatag

SEQ ID NO: 52868 - DNA, 18 bp, Artificial Sequence
  Synthetic DNA
ttataacactccctattg

SEQ ID NO: 52869 - DNA, 18 bp, Artificial Sequence
  Synthetic DNA
ttataagacactctctag

SEQ ID NO: 52870 - DNA, 18 bp, Artificial Sequence
  Synthetic DNA
ttataagacattcattag

SEQ ID NO: 52871 - DNA, 18 bp, Artificial Sequence
  Synthetic DNA
ttataagacgcaatttag

SEQ ID NO: 52872 - DNA, 18 bp, Artificial Sequence
  Synthetic DNA
ttataagagtcattttag

SEQ ID NO: 52873 - DNA, 18 bp, Artificial Sequence
  Synthetic DNA
ttataagattctctaatg

SEQ ID NO: 52874 - DNA, 18 bp, Artificial Sequence
  Synthetic DNA
ttataagcctaacattag

SEQ ID NO: 52875 - DNA, 18 bp, Artificial Sequence
  Synthetic DNA
ttataagcctcactcttg

SEQ ID NO: 52876 - DNA, 18 bp, Artificial Sequence
  Synthetic DNA
ttataaggcacaatatag

SEQ ID NO: 52877 - DNA, 18 bp, Artificial Sequence
  Synthetic DNA
ttataaggtttacgttag

SEQ ID NO: 52878 - DNA, 18 bp, Artificial Sequence
  Synthetic DNA
ttataagtgtcactttag

SEQ ID NO: 52879 - DNA, 18 bp, Artificial Sequence
  Synthetic DNA
ttataataaccactctag

SEQ ID NO: 52880 - DNA, 18 bp, Artificial Sequence
  Synthetic DNA
ttataataatcagaattg

SEQ ID NO: 52881 - DNA, 18 bp, Artificial Sequence
  Synthetic DNA
ttataatactttctatag

SEQ ID NO: 52882 - DNA, 18 bp, Artificial Sequence
  Synthetic DNA
ttataatcgtcaatatag

SEQ ID NO: 52883 - DNA, 18 bp, Artificial Sequence
  Synthetic DNA
ttataattatcaacatag

SEQ ID NO: 52884 - DNA, 18 bp, Artificial Sequence
  Synthetic DNA
ttataattctcattgttg

SEQ ID NO: 52885 - DNA, 18 bp, Artificial Sequence
  Synthetic DNA
ttataattctcgctcctg

SEQ ID NO: 52886 - DNA, 18 bp, Artificial Sequence
  Synthetic DNA
ttatacaaaccactgtag

SEQ ID NO: 52887 - DNA, 18 bp, Artificial Sequence
  Synthetic DNA
ttatacaacagatcatgg

SEQ ID NO: 52888 - DNA, 18 bp, Artificial Sequence
  Synthetic DNA
ttatacaacattctctag

SEQ ID NO: 52889 - DNA, 18 bp, Artificial Sequence
  Synthetic DNA
ttatacaaccatgtatag

SEQ ID NO: 52890 - DNA, 18 bp, Artificial Sequence
  Synthetic DNA
ttatacaactaaccaaag

SEQ ID NO: 52891 - DNA, 18 bp, Artificial Sequence
  Synthetic DNA
ttatacaactaccaatag

SEQ ID NO: 52892 - DNA, 18 bp, Artificial Sequence
  Synthetic DNA
ttatacaattcaatagag

SEQ ID NO: 52893 - DNA, 18 bp, Artificial Sequence
  Synthetic DNA
ttatacaattctctactg

SEQ ID NO: 52894 - DNA, 18 bp, Artificial Sequence
  Synthetic DNA
ttatacacctcaacgtag

SEQ ID NO: 52895 - DNA, 18 bp, Artificial Sequence
  Synthetic DNA
ttatacacctcaatattg

SEQ ID NO: 52896 - DNA, 18 bp, Artificial Sequence
  Synthetic DNA
ttatacacctccctacag

SEQ ID NO: 52897 - DNA, 18 bp, Artificial Sequence
  Synthetic DNA
ttatacatcctactatag

SEQ ID NO: 52898 - DNA, 18 bp, Artificial Sequence
  Synthetic DNA
ttatacatctaactccag

SEQ ID NO: 52899 - DNA, 18 bp, Artificial Sequence
  Synthetic DNA
ttatacatctccatatag

SEQ ID NO: 52900 - DNA, 18 bp, Artificial Sequence
  Synthetic DNA
ttatacatttcatcatag

SEQ ID NO: 52901 - DNA, 18 bp, Artificial Sequence
  Synthetic DNA
ttataccaatcacttcag

SEQ ID NO: 52902 - DNA, 18 bp, Artificial Sequence
  Synthetic DNA
ttataccacaccctattg

SEQ ID NO: 52903 - DNA, 18 bp, Artificial Sequence
  Synthetic DNA
ttataccactcaattttg

SEQ ID NO: 52904 - DNA, 18 bp, Artificial Sequence
  Synthetic DNA
ttataccactcggataag

SEQ ID NO: 52905 - DNA, 18 bp, Artificial Sequence
  Synthetic DNA
ttatacccatatttatag

SEQ ID NO: 52906 - DNA, 18 bp, Artificial Sequence
  Synthetic DNA
ttatacccctctctaatg

SEQ ID NO: 52907 - DNA, 18 bp, Artificial Sequence
  Synthetic DNA
ttatacctatctctctag

SEQ ID NO: 52908 - DNA, 18 bp, Artificial Sequence
  Synthetic DNA
ttatacctatctctttag

SEQ ID NO: 52909 - DNA, 18 bp, Artificial Sequence
  Synthetic DNA
ttatacctccaactaaag

SEQ ID NO: 52910 - DNA, 18 bp, Artificial Sequence
  Synthetic DNA
ttatacctgtctctatag

SEQ ID NO: 52911 - DNA, 18 bp, Artificial Sequence
  Synthetic DNA
ttatacctttcactttgg

SEQ ID NO: 52912 - DNA, 18 bp, Artificial Sequence
  Synthetic DNA
ttatacgaaaaagtgtag

SEQ ID NO: 52913 - DNA, 18 bp, Artificial Sequence
  Synthetic DNA
ttatacgaatcaataagg

SEQ ID NO: 52914 - DNA, 18 bp, Artificial Sequence
  Synthetic DNA
ttatacgaatcaatcgag

SEQ ID NO: 52915 - DNA, 18 bp, Artificial Sequence
  Synthetic DNA
ttatacgaatctctccag

SEQ ID NO: 52916 - DNA, 18 bp, Artificial Sequence
  Synthetic DNA
ttatacgaattacaatcg

SEQ ID NO: 52917 - DNA, 18 bp, Artificial Sequence
  Synthetic DNA
ttatacgaattatttcag

SEQ ID NO: 52918 - DNA, 18 bp, Artificial Sequence
  Synthetic DNA
ttatacgacaaaccttag

SEQ ID NO: 52919 - DNA, 18 bp, Artificial Sequence
  Synthetic DNA
ttatacgacaaactgaag

SEQ ID NO: 52920 - DNA, 18 bp, Artificial Sequence
  Synthetic DNA
ttatacgacacacacttg

SEQ ID NO: 52921 - DNA, 18 bp, Artificial Sequence
  Synthetic DNA
ttatacgacaccgtgaag

SEQ ID NO: 52922 - DNA, 18 bp, Artificial Sequence
  Synthetic DNA
ttatacgaccaactttcg

SEQ ID NO: 52923 - DNA, 18 bp, Artificial Sequence
  Synthetic DNA
ttatacgacgcacaaacg

SEQ ID NO: 52924 - DNA, 18 bp, Artificial Sequence
  Synthetic DNA
ttatacgactcaaaactg

SEQ ID NO: 52925 - DNA, 18 bp, Artificial Sequence
  Synthetic DNA
ttatacgactcaacttgg

SEQ ID NO: 52926 - DNA, 18 bp, Artificial Sequence
  Synthetic DNA
ttatacgactcccgcttg

SEQ ID NO: 52927 - DNA, 18 bp, Artificial Sequence
  Synthetic DNA
ttatacgacttaacatgg

SEQ ID NO: 52928 - DNA, 18 bp, Artificial Sequence
  Synthetic DNA
ttatacgactttccattg

SEQ ID NO: 52929 - DNA, 18 bp, Artificial Sequence
  Synthetic DNA
ttatacgactttcttacg

SEQ ID NO: 52930 - DNA, 18 bp, Artificial Sequence
  Synthetic DNA
ttatacgagactctacag

SEQ ID NO: 52931 - DNA, 18 bp, Artificial Sequence
  Synthetic DNA
ttatacgagcgaccattg

SEQ ID NO: 52932 - DNA, 18 bp, Artificial Sequence
  Synthetic DNA
ttatacgagtaaatctag

SEQ ID NO: 52933 - DNA, 18 bp, Artificial Sequence
  Synthetic DNA
ttatacgattccatattg

SEQ ID NO: 52934 - DNA, 18 bp, Artificial Sequence
  Synthetic DNA
ttatacgattctttctag

SEQ ID NO: 52935 - DNA, 18 bp, Artificial Sequence
  Synthetic DNA
ttatacgccacactaatg

SEQ ID NO: 52936 - DNA, 18 bp, Artificial Sequence
  Synthetic DNA
ttatacgccagactctag

SEQ ID NO: 52937 - DNA, 18 bp, Artificial Sequence
  Synthetic DNA
ttatacgcccctctttag

SEQ ID NO: 52938 - DNA, 18 bp, Artificial Sequence
  Synthetic DNA
ttatacgcctaagaatag

SEQ ID NO: 52939 - DNA, 18 bp, Artificial Sequence
  Synthetic DNA
ttatacgcctcacactcg

SEQ ID NO: 52940 - DNA, 18 bp, Artificial Sequence
  Synthetic DNA
ttatacgccttaatactg

SEQ ID NO: 52941 - DNA, 18 bp, Artificial Sequence
  Synthetic DNA
ttatacgcgtcactatca

SEQ ID NO: 52942 - DNA, 18 bp, Artificial Sequence
  Synthetic DNA
ttatacggatcacattag

SEQ ID NO: 52943 - DNA, 18 bp, Artificial Sequence
  Synthetic DNA
ttatacggctctatgttg

SEQ ID NO: 52944 - DNA, 18 bp, Artificial Sequence
  Synthetic DNA
ttatacgtcatcctattg

SEQ ID NO: 52945 - DNA, 18 bp, Artificial Sequence
  Synthetic DNA
ttatacgtccctttatag

SEQ ID NO: 52946 - DNA, 18 bp, Artificial Sequence
  Synthetic DNA
ttatacgtcgctcaattg

SEQ ID NO: 52947 - DNA, 18 bp, Artificial Sequence
  Synthetic DNA
ttatacgtctcacgtacg

SEQ ID NO: 52948 - DNA, 18 bp, Artificial Sequence
  Synthetic DNA
ttatacgtctcccaaaag

SEQ ID NO: 52949 - DNA, 18 bp, Artificial Sequence
  Synthetic DNA
ttatacgtctccctgcag

SEQ ID NO: 52950 - DNA, 18 bp, Artificial Sequence
  Synthetic DNA
ttatacgtctctcttacg

SEQ ID NO: 52951 - DNA, 18 bp, Artificial Sequence
  Synthetic DNA
ttatacgtctgacgaaag

SEQ ID NO: 52952 - DNA, 18 bp, Artificial Sequence
  Synthetic DNA
ttatacgtcttacattgg

SEQ ID NO: 52953 - DNA, 18 bp, Artificial Sequence
  Synthetic DNA
ttatacgtcttacttagg

SEQ ID NO: 52954 - DNA, 18 bp, Artificial Sequence
  Synthetic DNA
ttatacgtttcatctaag

SEQ ID NO: 52955 - DNA, 18 bp, Artificial Sequence
  Synthetic DNA
ttatacgtttccctaaag

SEQ ID NO: 52956 - DNA, 18 bp, Artificial Sequence
  Synthetic DNA
ttatacgtttcgcgatcg

SEQ ID NO: 52957 - DNA, 18 bp, Artificial Sequence
  Synthetic DNA
ttatactaacctcttagg

SEQ ID NO: 52958 - DNA, 18 bp, Artificial Sequence
  Synthetic DNA
ttatactacacagcatag

SEQ ID NO: 52959 - DNA, 18 bp, Artificial Sequence
  Synthetic DNA
ttatactacacagtacag

SEQ ID NO: 52960 - DNA, 18 bp, Artificial Sequence
  Synthetic DNA
ttatactacacattatgg

SEQ ID NO: 52961 - DNA, 18 bp, Artificial Sequence
  Synthetic DNA
ttatactacataatatag

SEQ ID NO: 52962 - DNA, 18 bp, Artificial Sequence
  Synthetic DNA
ttatactaccctcttctg

SEQ ID NO: 52963 - DNA, 18 bp, Artificial Sequence
  Synthetic DNA
ttatactactcatcctag

SEQ ID NO: 52964 - DNA, 18 bp, Artificial Sequence
  Synthetic DNA
ttatactactccctcttg

SEQ ID NO: 52965 - DNA, 18 bp, Artificial Sequence
  Synthetic DNA
ttatactactctatatgg

SEQ ID NO: 52966 - DNA, 18 bp, Artificial Sequence
  Synthetic DNA
ttatactactctgataag

SEQ ID NO: 52967 - DNA, 18 bp, Artificial Sequence
  Synthetic DNA
ttatactacttacactag

SEQ ID NO: 52968 - DNA, 18 bp, Artificial Sequence
  Synthetic DNA
ttatactagtaacattag

SEQ ID NO: 52969 - DNA, 18 bp, Artificial Sequence
  Synthetic DNA
ttatactatccacaatag

SEQ ID NO: 52970 - DNA, 18 bp, Artificial Sequence
  Synthetic DNA
ttatactattcacagtag

SEQ ID NO: 52971 - DNA, 18 bp, Artificial Sequence
  Synthetic DNA
ttatactgctctttgtag

SEQ ID NO: 52972 - DNA, 18 bp, Artificial Sequence
  Synthetic DNA
ttatacttcaccatacag

SEQ ID NO: 52973 - DNA, 18 bp, Artificial Sequence
  Synthetic DNA
ttatacttctcgctttag

SEQ ID NO: 52974 - DNA, 18 bp, Artificial Sequence
  Synthetic DNA
ttatacttctttatatag

SEQ ID NO: 52975 - DNA, 18 bp, Artificial Sequence
  Synthetic DNA
ttatacttggcattatgg

SEQ ID NO: 52976 - DNA, 18 bp, Artificial Sequence
  Synthetic DNA
ttatacttttttcaattg

SEQ ID NO: 52977 - DNA, 18 bp, Artificial Sequence
  Synthetic DNA
ttatagagctcgctctag

SEQ ID NO: 52978 - DNA, 18 bp, Artificial Sequence
  Synthetic DNA
ttatagctctatcgatag

SEQ ID NO: 52979 - DNA, 18 bp, Artificial Sequence
  Synthetic DNA
ttataggaatcacttaag

SEQ ID NO: 52980 - DNA, 18 bp, Artificial Sequence
  Synthetic DNA
ttataggactctatttcg

SEQ ID NO: 52981 - DNA, 18 bp, Artificial Sequence
  Synthetic DNA
ttataggagccactattg

SEQ ID NO: 52982 - DNA, 18 bp, Artificial Sequence
  Synthetic DNA
ttataggtagctttatag

SEQ ID NO: 52983 - DNA, 18 bp, Artificial Sequence
  Synthetic DNA
ttataggtctctctgtag

SEQ ID NO: 52984 - DNA, 18 bp, Artificial Sequence
  Synthetic DNA
ttataggtttcagttaag

SEQ ID NO: 52985 - DNA, 18 bp, Artificial Sequence
  Synthetic DNA
ttatagtacacactttgg

SEQ ID NO: 52986 - DNA, 18 bp, Artificial Sequence
  Synthetic DNA
ttatataaattattaagg

SEQ ID NO: 52987 - DNA, 18 bp, Artificial Sequence
  Synthetic DNA
ttatataactcactaagg

SEQ ID NO: 52988 - DNA, 18 bp, Artificial Sequence
  Synthetic DNA
ttatataacttattacag

SEQ ID NO: 52989 - DNA, 18 bp, Artificial Sequence
  Synthetic DNA
ttatatacctcacattag

SEQ ID NO: 52990 - DNA, 18 bp, Artificial Sequence
  Synthetic DNA
ttatatatcttattaacg

SEQ ID NO: 52991 - DNA, 18 bp, Artificial Sequence
  Synthetic DNA
ttatatgaatcaccaaag

SEQ ID NO: 52992 - DNA, 18 bp, Artificial Sequence
  Synthetic DNA
ttatatgacacaatctgg

SEQ ID NO: 52993 - DNA, 18 bp, Artificial Sequence
  Synthetic DNA
ttatatgacactcttatg

SEQ ID NO: 52994 - DNA, 18 bp, Artificial Sequence
  Synthetic DNA
ttatatgacatacaatag

SEQ ID NO: 52995 - DNA, 18 bp, Artificial Sequence
  Synthetic DNA
ttatatgacccatttaag

SEQ ID NO: 52996 - DNA, 18 bp, Artificial Sequence
  Synthetic DNA
ttatatgactaacttcag

SEQ ID NO: 52997 - DNA, 18 bp, Artificial Sequence
  Synthetic DNA
ttatatgactcatgttag

SEQ ID NO: 52998 - DNA, 18 bp, Artificial Sequence
  Synthetic DNA
ttatatgactcgccactg

SEQ ID NO: 52999 - DNA, 18 bp, Artificial Sequence
  Synthetic DNA
ttatatgactctaaatag

SEQ ID NO: 53000 - DNA, 18 bp, Artificial Sequence
  Synthetic DNA
ttatatgacttaaaacag

SEQ ID NO: 53001 - DNA, 18 bp, Artificial Sequence
  Synthetic DNA
ttatatgacttacggtag

SEQ ID NO: 53002 - DNA, 18 bp, Artificial Sequence
  Synthetic DNA
ttatatgagtgtctttag

SEQ ID NO: 53003 - DNA, 18 bp, Artificial Sequence
  Synthetic DNA
ttatatgattaactacag

SEQ ID NO: 53004 - DNA, 18 bp, Artificial Sequence
  Synthetic DNA
ttatatgcctacttaatg

SEQ ID NO: 53005 - DNA, 18 bp, Artificial Sequence
  Synthetic DNA
ttatatgtatctctaaag

SEQ ID NO: 53006 - DNA, 18 bp, Artificial Sequence
  Synthetic DNA
ttatatgtcccactcttg

SEQ ID NO: 53007 - DNA, 18 bp, Artificial Sequence
  Synthetic DNA
ttatatgtctcactcaag

SEQ ID NO: 53008 - DNA, 18 bp, Artificial Sequence
  Synthetic DNA
ttatatgtctgcctggag

SEQ ID NO: 53009 - DNA, 18 bp, Artificial Sequence
  Synthetic DNA
ttatatgtcttacaagag

SEQ ID NO: 53010 - DNA, 18 bp, Artificial Sequence
  Synthetic DNA
ttatattactcatcatgg

SEQ ID NO: 53011 - DNA, 18 bp, Artificial Sequence
  Synthetic DNA
ttatattactcgctacag

SEQ ID NO: 53012 - DNA, 18 bp, Artificial Sequence
  Synthetic DNA
ttatattccagactaaag

SEQ ID NO: 53013 - DNA, 18 bp, Artificial Sequence
  Synthetic DNA
ttatattgcatactatgg

SEQ ID NO: 53014 - DNA, 18 bp, Artificial Sequence
  Synthetic DNA
ttatatttcttactcaag

SEQ ID NO: 53015 - DNA, 18 bp, Artificial Sequence
  Synthetic DNA
ttatcaggcttacatcag

SEQ ID NO: 53016 - DNA, 18 bp, Artificial Sequence
  Synthetic DNA
ttatccaacacacaatag

SEQ ID NO: 53017 - DNA, 18 bp, Artificial Sequence
  Synthetic DNA
ttatccatctcgctaaag

SEQ ID NO: 53018 - DNA, 18 bp, Artificial Sequence
  Synthetic DNA
ttatcccattctctatag

SEQ ID NO: 53019 - DNA, 18 bp, Artificial Sequence
  Synthetic DNA
ttatccgaaacactaaag

SEQ ID NO: 53020 - DNA, 18 bp, Artificial Sequence
  Synthetic DNA
ttatccgaataaccgtag

SEQ ID NO: 53021 - DNA, 18 bp, Artificial Sequence
  Synthetic DNA
ttatccgacacactttaa

SEQ ID NO: 53022 - DNA, 18 bp, Artificial Sequence
  Synthetic DNA
ttatccgacagactttag

SEQ ID NO: 53023 - DNA, 18 bp, Artificial Sequence
  Synthetic DNA
ttatccgaccgtccatag

SEQ ID NO: 53024 - DNA, 18 bp, Artificial Sequence
  Synthetic DNA
ttatccgactcttaatag

SEQ ID NO: 53025 - DNA, 18 bp, Artificial Sequence
  Synthetic DNA
ttatccgactctttaatg

SEQ ID NO: 53026 - DNA, 18 bp, Artificial Sequence
  Synthetic DNA
ttatccgactgaccagag

SEQ ID NO: 53027 - DNA, 18 bp, Artificial Sequence
  Synthetic DNA
ttatccggctcacatttg

SEQ ID NO: 53028 - DNA, 18 bp, Artificial Sequence
  Synthetic DNA
ttatccgtctaactttag

SEQ ID NO: 53029 - DNA, 18 bp, Artificial Sequence
  Synthetic DNA
ttatccgtctcgttatag

SEQ ID NO: 53030 - DNA, 18 bp, Artificial Sequence
  Synthetic DNA
ttatccgtttcattatag

SEQ ID NO: 53031 - DNA, 18 bp, Artificial Sequence
  Synthetic DNA
ttatcctagacacttttg

SEQ ID NO: 53032 - DNA, 18 bp, Artificial Sequence
  Synthetic DNA
ttatccttgtcactattg

SEQ ID NO: 53033 - DNA, 18 bp, Artificial Sequence
  Synthetic DNA
ttatcggtgtcaccatag

SEQ ID NO: 53034 - DNA, 18 bp, Artificial Sequence
  Synthetic DNA
ttatgagtctccctatag

SEQ ID NO: 53035 - DNA, 18 bp, Artificial Sequence
  Synthetic DNA
ttatgcaactaactatgg

SEQ ID NO: 53036 - DNA, 18 bp, Artificial Sequence
  Synthetic DNA
ttatgcaactccctttag

SEQ ID NO: 53037 - DNA, 18 bp, Artificial Sequence
  Synthetic DNA
ttatgccaatctctttag

SEQ ID NO: 53038 - DNA, 18 bp, Artificial Sequence
  Synthetic DNA
ttatgcctaaaattatag

SEQ ID NO: 53039 - DNA, 18 bp, Artificial Sequence
  Synthetic DNA
ttatgcgaataactaaag

SEQ ID NO: 53040 - DNA, 18 bp, Artificial Sequence
  Synthetic DNA
ttatgcgactgcgttatg

SEQ ID NO: 53041 - DNA, 18 bp, Artificial Sequence
  Synthetic DNA
ttatgcgcatcactattg

SEQ ID NO: 53042 - DNA, 18 bp, Artificial Sequence
  Synthetic DNA
ttatgcggctcagcatag

SEQ ID NO: 53043 - DNA, 18 bp, Artificial Sequence
  Synthetic DNA
ttatgcgtcttacattag

SEQ ID NO: 53044 - DNA, 18 bp, Artificial Sequence
  Synthetic DNA
ttatgctactcagtaacg

SEQ ID NO: 53045 - DNA, 18 bp, Artificial Sequence
  Synthetic DNA
ttatgtgaatcaccttcg

SEQ ID NO: 53046 - DNA, 18 bp, Artificial Sequence
  Synthetic DNA
ttatgtgacactatatag

SEQ ID NO: 53047 - DNA, 18 bp, Artificial Sequence
  Synthetic DNA
ttatgtgcctcacaacag

SEQ ID NO: 53048 - DNA, 18 bp, Artificial Sequence
  Synthetic DNA
ttattaagctcacgatag

SEQ ID NO: 53049 - DNA, 18 bp, Artificial Sequence
  Synthetic DNA
ttattagacacagtatcg

SEQ ID NO: 53050 - DNA, 18 bp, Artificial Sequence
  Synthetic DNA
ttattagactgacttcag

SEQ ID NO: 53051 - DNA, 18 bp, Artificial Sequence
  Synthetic DNA
ttattagactgcataacg

SEQ ID NO: 53052 - DNA, 18 bp, Artificial Sequence
  Synthetic DNA
ttattagtctcactctag

SEQ ID NO: 53053 - DNA, 18 bp, Artificial Sequence
  Synthetic DNA
ttattatactcaataaag

SEQ ID NO: 53054 - DNA, 18 bp, Artificial Sequence
  Synthetic DNA
ttattatactcaccttag

SEQ ID NO: 53055 - DNA, 18 bp, Artificial Sequence
  Synthetic DNA
ttattcaaatagcattag

SEQ ID NO: 53056 - DNA, 18 bp, Artificial Sequence
  Synthetic DNA
ttattcaactcactctcg

SEQ ID NO: 53057 - DNA, 18 bp, Artificial Sequence
  Synthetic DNA
ttattcaactgactaaag

SEQ ID NO: 53058 - DNA, 18 bp, Artificial Sequence
  Synthetic DNA
ttattcatcttacttaag

SEQ ID NO: 53059 - DNA, 18 bp, Artificial Sequence
  Synthetic DNA
ttattcatttcactatag

SEQ ID NO: 53060 - DNA, 18 bp, Artificial Sequence
  Synthetic DNA
ttattcatttcgattaag

SEQ ID NO: 53061 - DNA, 18 bp, Artificial Sequence
  Synthetic DNA
ttattccacacactacag

SEQ ID NO: 53062 - DNA, 18 bp, Artificial Sequence
  Synthetic DNA
ttattccactcacaaagg

SEQ ID NO: 53063 - DNA, 18 bp, Artificial Sequence
  Synthetic DNA
ttattcgaccgactttag

SEQ ID NO: 53064 - DNA, 18 bp, Artificial Sequence
  Synthetic DNA
ttattcgacgcgctaaag

SEQ ID NO: 53065 - DNA, 18 bp, Artificial Sequence
  Synthetic DNA
ttattcgactaaaaatag

SEQ ID NO: 53066 - DNA, 18 bp, Artificial Sequence
  Synthetic DNA
ttattcgactccctcttg

SEQ ID NO: 53067 - DNA, 18 bp, Artificial Sequence
  Synthetic DNA
ttattcgactgacaattg

SEQ ID NO: 53068 - DNA, 18 bp, Artificial Sequence
  Synthetic DNA
ttattcgacttgcattag

SEQ ID NO: 53069 - DNA, 18 bp, Artificial Sequence
  Synthetic DNA
ttattcgattccttatag

SEQ ID NO: 53070 - DNA, 18 bp, Artificial Sequence
  Synthetic DNA
ttattcgattcgctggag

SEQ ID NO: 53071 - DNA, 18 bp, Artificial Sequence
  Synthetic DNA
ttattcgcctcacattag

SEQ ID NO: 53072 - DNA, 18 bp, Artificial Sequence
  Synthetic DNA
ttattcgccttacaatag

SEQ ID NO: 53073 - DNA, 18 bp, Artificial Sequence
  Synthetic DNA
ttattcgctttaatatag

SEQ ID NO: 53074 - DNA, 18 bp, Artificial Sequence
  Synthetic DNA
ttattcgtctaaccacag

SEQ ID NO: 53075 - DNA, 18 bp, Artificial Sequence
  Synthetic DNA
ttattcgtctctatatag

SEQ ID NO: 53076 - DNA, 18 bp, Artificial Sequence
  Synthetic DNA
ttattcgtctctcttctg

SEQ ID NO: 53077 - DNA, 18 bp, Artificial Sequence
  Synthetic DNA
ttattctaatcactattg

SEQ ID NO: 53078 - DNA, 18 bp, Artificial Sequence
  Synthetic DNA
ttattctacacattgcag

SEQ ID NO: 53079 - DNA, 18 bp, Artificial Sequence
  Synthetic DNA
ttattctactcactcgag

SEQ ID NO: 53080 - DNA, 18 bp, Artificial Sequence
  Synthetic DNA
ttattctactcagtattg

SEQ ID NO: 53081 - DNA, 18 bp, Artificial Sequence
  Synthetic DNA
ttattctactcatattcg

SEQ ID NO: 53082 - DNA, 18 bp, Artificial Sequence
  Synthetic DNA
ttattctactctcaaaag

SEQ ID NO: 53083 - DNA, 18 bp, Artificial Sequence
  Synthetic DNA
ttattctacttactctag

SEQ ID NO: 53084 - DNA, 18 bp, Artificial Sequence
  Synthetic DNA
ttattctattctctatag

SEQ ID NO: 53085 - DNA, 18 bp, Artificial Sequence
  Synthetic DNA
ttattctcctcacatcag

SEQ ID NO: 53086 - DNA, 18 bp, Artificial Sequence
  Synthetic DNA
ttattctcctctcttttg

SEQ ID NO: 53087 - DNA, 18 bp, Artificial Sequence
  Synthetic DNA
ttattggactcacaatgg

SEQ ID NO: 53088 - DNA, 18 bp, Artificial Sequence
  Synthetic DNA
ttattggtctctctatag

SEQ ID NO: 53089 - DNA, 18 bp, Artificial Sequence
  Synthetic DNA
ttattgtactcgctacag

SEQ ID NO: 53090 - DNA, 18 bp, Artificial Sequence
  Synthetic DNA
ttatttatctcacgttag

SEQ ID NO: 53091 - DNA, 18 bp, Artificial Sequence
  Synthetic DNA
ttatttatctcagtaaag

SEQ ID NO: 53092 - DNA, 18 bp, Artificial Sequence
  Synthetic DNA
ttatttgaatcattaatg

SEQ ID NO: 53093 - DNA, 18 bp, Artificial Sequence
  Synthetic DNA
ttatttgactatctttag

SEQ ID NO: 53094 - DNA, 18 bp, Artificial Sequence
  Synthetic DNA
ttatttttttcactaaag

SEQ ID NO: 53095 - DNA, 18 bp, Artificial Sequence
  Synthetic DNA
ttcaacgactttttatag

SEQ ID NO: 53096 - DNA, 18 bp, Artificial Sequence
  Synthetic DNA
ttcaacgatacggtatag

SEQ ID NO: 53097 - DNA, 18 bp, Artificial Sequence
  Synthetic DNA
ttcaaggtatctctctag

SEQ ID NO: 53098 - DNA, 18 bp, Artificial Sequence
  Synthetic DNA
ttcaatgagtaacaatag

SEQ ID NO: 53099 - DNA, 18 bp, Artificial Sequence
  Synthetic DNA
ttcatggatccacatttg

SEQ ID NO: 53100 - DNA, 18 bp, Artificial Sequence
  Synthetic DNA
ttcattgaaacaccatag

SEQ ID NO: 53101 - DNA, 18 bp, Artificial Sequence
  Synthetic DNA
ttccacgcttcctcaaag

SEQ ID NO: 53102 - DNA, 18 bp, Artificial Sequence
  Synthetic DNA
ttccgcgattcactattg

SEQ ID NO: 53103 - DNA, 18 bp, Artificial Sequence
  Synthetic DNA
ttcgacctctctgtatag

SEQ ID NO: 53104 - DNA, 18 bp, Artificial Sequence
  Synthetic DNA
ttctaaatcttaatatcg

SEQ ID NO: 53105 - DNA, 18 bp, Artificial Sequence
  Synthetic DNA
ttctaagacacacttacg

SEQ ID NO: 53106 - DNA, 18 bp, Artificial Sequence
  Synthetic DNA
ttctaagatccactatag

SEQ ID NO: 53107 - DNA, 18 bp, Artificial Sequence
  Synthetic DNA
ttctacaactcaacatcg

SEQ ID NO: 53108 - DNA, 18 bp, Artificial Sequence
  Synthetic DNA
ttctacaatacaatatag

SEQ ID NO: 53109 - DNA, 18 bp, Artificial Sequence
  Synthetic DNA
ttctacatttcattatag

SEQ ID NO: 53110 - DNA, 18 bp, Artificial Sequence
  Synthetic DNA
ttctacgaatcaacatag

SEQ ID NO: 53111 - DNA, 18 bp, Artificial Sequence
  Synthetic DNA
ttctacgaatctccatgg

SEQ ID NO: 53112 - DNA, 18 bp, Artificial Sequence
  Synthetic DNA
ttctacgacataccatgg

SEQ ID NO: 53113 - DNA, 18 bp, Artificial Sequence
  Synthetic DNA
ttctacgaccctctaaag

SEQ ID NO: 53114 - DNA, 18 bp, Artificial Sequence
  Synthetic DNA
ttctacgatttactttag

SEQ ID NO: 53115 - DNA, 18 bp, Artificial Sequence
  Synthetic DNA
ttctacgtttctctctcg

SEQ ID NO: 53116 - DNA, 18 bp, Artificial Sequence
  Synthetic DNA
ttctactactcacggtag

SEQ ID NO: 53117 - DNA, 18 bp, Artificial Sequence
  Synthetic DNA
ttctactactcagtttag

SEQ ID NO: 53118 - DNA, 18 bp, Artificial Sequence
  Synthetic DNA
ttctactgcacattattg

SEQ ID NO: 53119 - DNA, 18 bp, Artificial Sequence
  Synthetic DNA
ttctaggattgactaaag

SEQ ID NO: 53120 - DNA, 18 bp, Artificial Sequence
  Synthetic DNA
ttctaggcctcacaacag

SEQ ID NO: 53121 - DNA, 18 bp, Artificial Sequence
  Synthetic DNA
ttctatgtctgactatag

SEQ ID NO: 53122 - DNA, 18 bp, Artificial Sequence
  Synthetic DNA
ttctccgagacacaaaag

SEQ ID NO: 53123 - DNA, 18 bp, Artificial Sequence
  Synthetic DNA
ttctctgacatactatag

SEQ ID NO: 53124 - DNA, 18 bp, Artificial Sequence
  Synthetic DNA
ttctctttctcaaaatag

SEQ ID NO: 53125 - DNA, 18 bp, Artificial Sequence
  Synthetic DNA
ttcttccaccctcaagag

SEQ ID NO: 53126 - DNA, 18 bp, Artificial Sequence
  Synthetic DNA
ttcttcgaaacccatatg

SEQ ID NO: 53127 - DNA, 18 bp, Artificial Sequence
  Synthetic DNA
ttcttcgacagtctatag

SEQ ID NO: 53128 - DNA, 18 bp, Artificial Sequence
  Synthetic DNA
ttcttgctctcaatacag

SEQ ID NO: 53129 - DNA, 18 bp, Artificial Sequence
  Synthetic DNA
ttgaaagacgcacagcag

SEQ ID NO: 53130 - DNA, 18 bp, Artificial Sequence
  Synthetic DNA
ttgaaagactcactatgg

SEQ ID NO: 53131 - DNA, 18 bp, Artificial Sequence
  Synthetic DNA
ttgaaagagtcactattg

SEQ ID NO: 53132 - DNA, 18 bp, Artificial Sequence
  Synthetic DNA
ttgaacaactcattatag

SEQ ID NO: 53133 - DNA, 18 bp, Artificial Sequence
  Synthetic DNA
ttgaacgatttgcaatag

SEQ ID NO: 53134 - DNA, 18 bp, Artificial Sequence
  Synthetic DNA
ttgaactacgctcattag

SEQ ID NO: 53135 - DNA, 18 bp, Artificial Sequence
  Synthetic DNA
ttgaatgactcactattg

SEQ ID NO: 53136 - DNA, 18 bp, Artificial Sequence
  Synthetic DNA
ttgatcgactcacgatag

SEQ ID NO: 53137 - DNA, 18 bp, Artificial Sequence
  Synthetic DNA
ttgcacgacttgctattg

SEQ ID NO: 53138 - DNA, 18 bp, Artificial Sequence
  Synthetic DNA
ttgcacgtctccatatag

SEQ ID NO: 53139 - DNA, 18 bp, Artificial Sequence
  Synthetic DNA
ttgcatgacgcactaatg

SEQ ID NO: 53140 - DNA, 18 bp, Artificial Sequence
  Synthetic DNA
ttgcttgaatctctacag

SEQ ID NO: 53141 - DNA, 18 bp, Artificial Sequence
  Synthetic DNA
ttgtaacactctctaaag

SEQ ID NO: 53142 - DNA, 18 bp, Artificial Sequence
  Synthetic DNA
ttgtaagactgtgaattg

SEQ ID NO: 53143 - DNA, 18 bp, Artificial Sequence
  Synthetic DNA
ttgtacctctctctggag

SEQ ID NO: 53144 - DNA, 18 bp, Artificial Sequence
  Synthetic DNA
ttgtacgactaaatttag

SEQ ID NO: 53145 - DNA, 18 bp, Artificial Sequence
  Synthetic DNA
ttgtacgactaactgttg

SEQ ID NO: 53146 - DNA, 18 bp, Artificial Sequence
  Synthetic DNA
ttgtacgactcagaattg

SEQ ID NO: 53147 - DNA, 18 bp, Artificial Sequence
  Synthetic DNA
ttgtacgatttactctag

SEQ ID NO: 53148 - DNA, 18 bp, Artificial Sequence
  Synthetic DNA
ttgtacgggacattatag

SEQ ID NO: 53149 - DNA, 18 bp, Artificial Sequence
  Synthetic DNA
ttgtacggtactctacag

SEQ ID NO: 53150 - DNA, 18 bp, Artificial Sequence
  Synthetic DNA
ttgtacgtatcactattg

SEQ ID NO: 53151 - DNA, 18 bp, Artificial Sequence
  Synthetic DNA
ttgtacgtcacacaattg

SEQ ID NO: 53152 - DNA, 18 bp, Artificial Sequence
  Synthetic DNA
ttgtacgtctccgtactg

SEQ ID NO: 53153 - DNA, 18 bp, Artificial Sequence
  Synthetic DNA
ttgtacgtttcacaaaag

SEQ ID NO: 53154 - DNA, 18 bp, Artificial Sequence
  Synthetic DNA
ttgtactactaactttag

SEQ ID NO: 53155 - DNA, 18 bp, Artificial Sequence
  Synthetic DNA
ttgtatgtatcacaatag

SEQ ID NO: 53156 - DNA, 18 bp, Artificial Sequence
  Synthetic DNA
ttgtatgtcacattatag

SEQ ID NO: 53157 - DNA, 18 bp, Artificial Sequence
  Synthetic DNA
ttgtatgtgtccctattg

SEQ ID NO: 53158 - DNA, 18 bp, Artificial Sequence
  Synthetic DNA
ttgtccgactcattttag

SEQ ID NO: 53159 - DNA, 18 bp, Artificial Sequence
  Synthetic DNA
ttgtctttcttactatag

SEQ ID NO: 53160 - DNA, 18 bp, Artificial Sequence
  Synthetic DNA
ttgtgcctctcactatcg

SEQ ID NO: 53161 - DNA, 18 bp, Artificial Sequence
  Synthetic DNA
ttgtgcgactcacagtgg

SEQ ID NO: 53162 - DNA, 18 bp, Artificial Sequence
  Synthetic DNA
ttgtgcgcctcaatttag

SEQ ID NO: 53163 - DNA, 18 bp, Artificial Sequence
  Synthetic DNA
ttgttcaactcaaaatag

SEQ ID NO: 53164 - DNA, 18 bp, Artificial Sequence
  Synthetic DNA
ttgttcaccacactttag

SEQ ID NO: 53165 - DNA, 18 bp, Artificial Sequence
  Synthetic DNA
ttgttccactagcaatag

SEQ ID NO: 53166 - DNA, 18 bp, Artificial Sequence
  Synthetic DNA
ttgttcgacaaacagaag

SEQ ID NO: 53167 - DNA, 18 bp, Artificial Sequence
  Synthetic DNA
ttgttcgactcacttttg

SEQ ID NO: 53168 - DNA, 18 bp, Artificial Sequence
  Synthetic DNA
ttgttcgactctctttag

SEQ ID NO: 53169 - DNA, 18 bp, Artificial Sequence
  Synthetic DNA
ttgttcgattcactaagg

SEQ ID NO: 53170 - DNA, 18 bp, Artificial Sequence
  Synthetic DNA
ttgttcggctaactctag

SEQ ID NO: 53171 - DNA, 18 bp, Artificial Sequence
  Synthetic DNA
ttgttctcctgattattg

SEQ ID NO: 53172 - DNA, 18 bp, Artificial Sequence
  Synthetic DNA
ttgttggacacacctgag

SEQ ID NO: 53173 - DNA, 18 bp, Artificial Sequence
  Synthetic DNA
tttaaagactttctttag

SEQ ID NO: 53174 - DNA, 18 bp, Artificial Sequence
  Synthetic DNA
tttaacaacttagtatag

SEQ ID NO: 53175 - DNA, 18 bp, Artificial Sequence
  Synthetic DNA
tttaacgaagaactatag

SEQ ID NO: 53176 - DNA, 18 bp, Artificial Sequence
  Synthetic DNA
tttaacgacacaccattg

SEQ ID NO: 53177 - DNA, 18 bp, Artificial Sequence
  Synthetic DNA
tttaacgacccaatatag

SEQ ID NO: 53178 - DNA, 18 bp, Artificial Sequence
  Synthetic DNA
tttaacgactcactcttg

SEQ ID NO: 53179 - DNA, 18 bp, Artificial Sequence
  Synthetic DNA
tttaacgacttgctatag

SEQ ID NO: 53180 - DNA, 18 bp, Artificial Sequence
  Synthetic DNA
tttaactaatcacaatag

SEQ ID NO: 53181 - DNA, 18 bp, Artificial Sequence
  Synthetic DNA
tttaactgatcactattg

SEQ ID NO: 53182 - DNA, 18 bp, Artificial Sequence
  Synthetic DNA
tttaagggctttctattg

SEQ ID NO: 53183 - DNA, 18 bp, Artificial Sequence
  Synthetic DNA
tttagctacactctatag

SEQ ID NO: 53184 - DNA, 18 bp, Artificial Sequence
  Synthetic DNA
tttatagactcgctcaag

SEQ ID NO: 53185 - DNA, 18 bp, Artificial Sequence
  Synthetic DNA
tttatcaagccactatag

SEQ ID NO: 53186 - DNA, 18 bp, Artificial Sequence
  Synthetic DNA
tttatcgatacactaaag

SEQ ID NO: 53187 - DNA, 18 bp, Artificial Sequence
  Synthetic DNA
tttatctacacactatcg

SEQ ID NO: 53188 - DNA, 18 bp, Artificial Sequence
  Synthetic DNA
tttatggactcacgtaag

SEQ ID NO: 53189 - DNA, 18 bp, Artificial Sequence
  Synthetic DNA
tttcacagctccctttag

SEQ ID NO: 53190 - DNA, 18 bp, Artificial Sequence
  Synthetic DNA
tttcacgaatccatactg

SEQ ID NO: 53191 - DNA, 18 bp, Artificial Sequence
  Synthetic DNA
tttcacgactcatcatag

SEQ ID NO: 53192 - DNA, 18 bp, Artificial Sequence
  Synthetic DNA
tttcacgactcccaatag

SEQ ID NO: 53193 - DNA, 18 bp, Artificial Sequence
  Synthetic DNA
tttcacgagtcaccttag

SEQ ID NO: 53194 - DNA, 18 bp, Artificial Sequence
  Synthetic DNA
tttcacgatctagtatag

SEQ ID NO: 53195 - DNA, 18 bp, Artificial Sequence
  Synthetic DNA
tttctaatatctctatag

SEQ ID NO: 53196 - DNA, 18 bp, Artificial Sequence
  Synthetic DNA
tttctcgatacacttaag

SEQ ID NO: 53197 - DNA, 18 bp, Artificial Sequence
  Synthetic DNA
tttctcggctcactatag

SEQ ID NO: 53198 - DNA, 18 bp, Artificial Sequence
  Synthetic DNA
ttttaagacgcattattg

SEQ ID NO: 53199 - DNA, 18 bp, Artificial Sequence
  Synthetic DNA
ttttaaggctcaatatag

SEQ ID NO: 53200 - DNA, 18 bp, Artificial Sequence
  Synthetic DNA
ttttaatactctcactcg

SEQ ID NO: 53201 - DNA, 18 bp, Artificial Sequence
  Synthetic DNA
ttttacaactatctatag

SEQ ID NO: 53202 - DNA, 18 bp, Artificial Sequence
  Synthetic DNA
ttttacaactcactccag

SEQ ID NO: 53203 - DNA, 18 bp, Artificial Sequence
  Synthetic DNA
ttttacaactcagtaatg

SEQ ID NO: 53204 - DNA, 18 bp, Artificial Sequence
  Synthetic DNA
ttttacaactttataaag

SEQ ID NO: 53205 - DNA, 18 bp, Artificial Sequence
  Synthetic DNA
ttttacatctcaccatag

SEQ ID NO: 53206 - DNA, 18 bp, Artificial Sequence
  Synthetic DNA
ttttaccacacactgtag

SEQ ID NO: 53207 - DNA, 18 bp, Artificial Sequence
  Synthetic DNA
ttttaccactaactattg

SEQ ID NO: 53208 - DNA, 18 bp, Artificial Sequence
  Synthetic DNA
ttttacgaaccacaaatg

SEQ ID NO: 53209 - DNA, 18 bp, Artificial Sequence
  Synthetic DNA
ttttacgacacactaatg

SEQ ID NO: 53210 - DNA, 18 bp, Artificial Sequence
  Synthetic DNA
ttttacgacccacacaag

SEQ ID NO: 53211 - DNA, 18 bp, Artificial Sequence
  Synthetic DNA
ttttacgacccgctttag

SEQ ID NO: 53212 - DNA, 18 bp, Artificial Sequence
  Synthetic DNA
ttttacgaccctccatcg

SEQ ID NO: 53213 - DNA, 18 bp, Artificial Sequence
  Synthetic DNA
ttttacgaccctcttaag

SEQ ID NO: 53214 - DNA, 18 bp, Artificial Sequence
  Synthetic DNA
ttttacgactcaaaaaag

SEQ ID NO: 53215 - DNA, 18 bp, Artificial Sequence
  Synthetic DNA
ttttacgactgacttcag

SEQ ID NO: 53216 - DNA, 18 bp, Artificial Sequence
  Synthetic DNA
ttttacgacttaaattag

SEQ ID NO: 53217 - DNA, 18 bp, Artificial Sequence
  Synthetic DNA
ttttacgacttaccctcg

SEQ ID NO: 53218 - DNA, 18 bp, Artificial Sequence
  Synthetic DNA
ttttacgattcaatattg

SEQ ID NO: 53219 - DNA, 18 bp, Artificial Sequence
  Synthetic DNA
ttttacgattcacattcg

SEQ ID NO: 53220 - DNA, 18 bp, Artificial Sequence
  Synthetic DNA
ttttacgattctctattg

SEQ ID NO: 53221 - DNA, 18 bp, Artificial Sequence
  Synthetic DNA
ttttacgatttagctaag

SEQ ID NO: 53222 - DNA, 18 bp, Artificial Sequence
  Synthetic DNA
ttttacgcctctgtaagg

SEQ ID NO: 53223 - DNA, 18 bp, Artificial Sequence
  Synthetic DNA
ttttacgtatctctacag

SEQ ID NO: 53224 - DNA, 18 bp, Artificial Sequence
  Synthetic DNA
ttttacgtcccaacagag

SEQ ID NO: 53225 - DNA, 18 bp, Artificial Sequence
  Synthetic DNA
ttttacgtctcacgagag

SEQ ID NO: 53226 - DNA, 18 bp, Artificial Sequence
  Synthetic DNA
ttttacgtttcacaatag

SEQ ID NO: 53227 - DNA, 18 bp, Artificial Sequence
  Synthetic DNA
ttttactacttacaatcg

SEQ ID NO: 53228 - DNA, 18 bp, Artificial Sequence
  Synthetic DNA
ttttactacttcgtatag

SEQ ID NO: 53229 - DNA, 18 bp, Artificial Sequence
  Synthetic DNA
ttttacttttcactctag

SEQ ID NO: 53230 - DNA, 18 bp, Artificial Sequence
  Synthetic DNA
ttttaggattcacgttag

SEQ ID NO: 53231 - DNA, 18 bp, Artificial Sequence
  Synthetic DNA
ttttaggtcattcaattg

SEQ ID NO: 53232 - DNA, 18 bp, Artificial Sequence
  Synthetic DNA
ttttaggttacactatag

SEQ ID NO: 53233 - DNA, 18 bp, Artificial Sequence
  Synthetic DNA
ttttataacacacatttg

SEQ ID NO: 53234 - DNA, 18 bp, Artificial Sequence
  Synthetic DNA
ttttataactctctctag

SEQ ID NO: 53235 - DNA, 18 bp, Artificial Sequence
  Synthetic DNA
ttttatgactcatttttg

SEQ ID NO: 53236 - DNA, 18 bp, Artificial Sequence
  Synthetic DNA
ttttatgactctctttag

SEQ ID NO: 53237 - DNA, 18 bp, Artificial Sequence
  Synthetic DNA
ttttatgacttacgaaag

SEQ ID NO: 53238 - DNA, 18 bp, Artificial Sequence
  Synthetic DNA
ttttatgacttacttaag

SEQ ID NO: 53239 - DNA, 18 bp, Artificial Sequence
  Synthetic DNA
ttttcaaactcaagctag

SEQ ID NO: 53240 - DNA, 18 bp, Artificial Sequence
  Synthetic DNA
ttttccgactcactgttg

SEQ ID NO: 53241 - DNA, 18 bp, Artificial Sequence
  Synthetic DNA
ttttgagattcactaatg

SEQ ID NO: 53242 - DNA, 18 bp, Artificial Sequence
  Synthetic DNA
ttttgaggctcactatag

SEQ ID NO: 53243 - DNA, 18 bp, Artificial Sequence
  Synthetic DNA
ttttgcgtctcactagag

SEQ ID NO: 53244 - DNA, 18 bp, Artificial Sequence
  Synthetic DNA
ttttgctactcaccaaag

SEQ ID NO: 53245 - DNA, 18 bp, Artificial Sequence
  Synthetic DNA
tttttacattgactttag

SEQ ID NO: 53246 - DNA, 18 bp, Artificial Sequence
  Synthetic DNA
tttttagaaactttgtag

SEQ ID NO: 53247 - DNA, 18 bp, Artificial Sequence
  Synthetic DNA
tttttagagtcactattg

SEQ ID NO: 53248 - DNA, 18 bp, Artificial Sequence
  Synthetic DNA
tttttcgactaactgaag

SEQ ID NO: 53249 - DNA, 18 bp, Artificial Sequence
  Synthetic DNA
tttttcgactaactttaa

SEQ ID NO: 53250 - DNA, 18 bp, Artificial Sequence
  Synthetic DNA
tttttcgactaagaacag

SEQ ID NO: 53251 - DNA, 18 bp, Artificial Sequence
  Synthetic DNA
tttttcgatgcactagag

SEQ ID NO: 53252 - DNA, 18 bp, Artificial Sequence
  Synthetic DNA
tttttcgtctcaatttag

SEQ ID NO: 53253 - DNA, 18 bp, Artificial Sequence
  Synthetic DNA
tttttcgtctctctgttg

SEQ ID NO: 53254 - DNA, 18 bp, Artificial Sequence
  Synthetic DNA
tttttctgctcactatag

SEQ ID NO: 53255 - DNA, 18 bp, Artificial Sequence
  Synthetic DNA
tttttggaataaatatag

SEQ ID NO: 53256 - DNA, 18 bp, Artificial Sequence
  Synthetic DNA
tttttgttctcactatag

SEQ ID NO: 53257 - DNA, 18 bp, Artificial Sequence
  Synthetic DNA
ttttttgatgcactatag

SEQ ID NO: 53258 - DNA, 18 bp, Artificial Sequence
  Synthetic DNA
taatacacaacacactag

SEQ ID NO: 53259 - DNA, 18 bp, Artificial Sequence
  Synthetic DNA
tagcatgacactgtaaag

SEQ ID NO: 53260 - DNA, 18 bp, Artificial Sequence
  Synthetic DNA
aaacacgattcaattaag

SEQ ID NO: 53261 - DNA, 18 bp, Artificial Sequence
  Synthetic DNA
aagaacgcctcactaaag

SEQ ID NO: 53262 - DNA, 18 bp, Artificial Sequence
  Synthetic DNA
cattacgttttactacag

SEQ ID NO: 53263 - DNA, 18 bp, Artificial Sequence
  Synthetic DNA
ctacacacgatattatag

SEQ ID NO: 53264 - DNA, 18 bp, Artificial Sequence
  Synthetic DNA
taaatcgacacattatcg

SEQ ID NO: 53265 - DNA, 18 bp, Artificial Sequence
  Synthetic DNA
taacctgactcaaaattg

SEQ ID NO: 53266 - DNA, 18 bp, Artificial Sequence
  Synthetic DNA
taataccttactcaattg

SEQ ID NO: 53267 - DNA, 18 bp, Artificial Sequence
  Synthetic DNA
tagtaccacttactcctg

SEQ ID NO: 53268 - DNA, 18 bp, Artificial Sequence
  Synthetic DNA
tagtactattgactattg

SEQ ID NO: 53269 - DNA, 18 bp, Artificial Sequence
  Synthetic DNA
tatttcgattcattattg

SEQ ID NO: 53270 - DNA, 18 bp, Artificial Sequence
  Synthetic DNA
tcaaacgatacacgaatg

SEQ ID NO: 53271 - DNA, 18 bp, Artificial Sequence
  Synthetic DNA
tgctacgacaccatatag

SEQ ID NO: 53272 - DNA, 18 bp, Artificial Sequence
  Synthetic DNA
ttataagtctcacgtaag

SEQ ID NO: 53273 - DNA, 18 bp, Artificial Sequence
  Synthetic DNA
ttatacgaatcgttaaag

SEQ ID NO: 53274 - DNA, 18 bp, Artificial Sequence
  Synthetic DNA
ttatacgaattacttaag

SEQ ID NO: 53275 - DNA, 18 bp, Artificial Sequence
  Synthetic DNA
ttattcgacactcaatag

SEQ ID NO: 53276 - DNA, 18 bp, Artificial Sequence
  Synthetic DNA
aaaaccgactcacttttg

SEQ ID NO: 53277 - DNA, 18 bp, Artificial Sequence
  Synthetic DNA
aaatacatctcaataaag

SEQ ID NO: 53278 - DNA, 18 bp, Artificial Sequence
  Synthetic DNA
aaatacgatacactaatg

SEQ ID NO: 53279 - DNA, 18 bp, Artificial Sequence
  Synthetic DNA
aaatacgcctctctgatg

SEQ ID NO: 53280 - DNA, 18 bp, Artificial Sequence
  Synthetic DNA
aaatacgtatagctctgg

SEQ ID NO: 53281 - DNA, 18 bp, Artificial Sequence
  Synthetic DNA
aaatacgtttctctattg

SEQ ID NO: 53282 - DNA, 18 bp, Artificial Sequence
  Synthetic DNA
aaatatgacatattatag

SEQ ID NO: 53283 - DNA, 18 bp, Artificial Sequence
  Synthetic DNA
aaatatgacgcacaaaag

SEQ ID NO: 53284 - DNA, 18 bp, Artificial Sequence
  Synthetic DNA
aaatccaactctctcttg

SEQ ID NO: 53285 - DNA, 18 bp, Artificial Sequence
  Synthetic DNA
aaatccgactcttaacag

SEQ ID NO: 53286 - DNA, 18 bp, Artificial Sequence
  Synthetic DNA
aaattaggctcgctatag

SEQ ID NO: 53287 - DNA, 18 bp, Artificial Sequence
  Synthetic DNA
aaattcgattcaacaaag

SEQ ID NO: 53288 - DNA, 18 bp, Artificial Sequence
  Synthetic DNA
aaattcgtctcaacatag

SEQ ID NO: 53289 - DNA, 18 bp, Artificial Sequence
  Synthetic DNA
aaattgtactcagtatag

SEQ ID NO: 53290 - DNA, 18 bp, Artificial Sequence
  Synthetic DNA
aaatttgattcactatcg

SEQ ID NO: 53291 - DNA, 18 bp, Artificial Sequence
  Synthetic DNA
aacttcagttcactatag

SEQ ID NO: 53292 - DNA, 18 bp, Artificial Sequence
  Synthetic DNA
aagttcgacacactgtag

SEQ ID NO: 53293 - DNA, 18 bp, Artificial Sequence
  Synthetic DNA
aataacatcccactattg

SEQ ID NO: 53294 - DNA, 18 bp, Artificial Sequence
  Synthetic DNA
aataacgtatctctaaag

SEQ ID NO: 53295 - DNA, 18 bp, Artificial Sequence
  Synthetic DNA
aatcacgattcactatgg

SEQ ID NO: 53296 - DNA, 18 bp, Artificial Sequence
  Synthetic DNA
aattaatacacattttgg

SEQ ID NO: 53297 - DNA, 18 bp, Artificial Sequence
  Synthetic DNA
aattaggtctcacgatag

SEQ ID NO: 53298 - DNA, 18 bp, Artificial Sequence
  Synthetic DNA
aattttgactccctatag

SEQ ID NO: 53299 - DNA, 18 bp, Artificial Sequence
  Synthetic DNA
aattttgactctttatag

SEQ ID NO: 53300 - DNA, 18 bp, Artificial Sequence
  Synthetic DNA
acataagaataactaaag

SEQ ID NO: 53301 - DNA, 18 bp, Artificial Sequence
  Synthetic DNA
acatacggcgctctatag

SEQ ID NO: 53302 - DNA, 18 bp, Artificial Sequence
  Synthetic DNA
acatactactctcttttg

SEQ ID NO: 53303 - DNA, 18 bp, Artificial Sequence
  Synthetic DNA
acattcatttcactatcg

SEQ ID NO: 53304 - DNA, 18 bp, Artificial Sequence
  Synthetic DNA
agatccgaatcagtatag

SEQ ID NO: 53305 - DNA, 18 bp, Artificial Sequence
  Synthetic DNA
ataagcgactcagtatag

SEQ ID NO: 53306 - DNA, 18 bp, Artificial Sequence
  Synthetic DNA
atacacgactgacttttg

SEQ ID NO: 53307 - DNA, 18 bp, Artificial Sequence
  Synthetic DNA
atagacgtaactctatag

SEQ ID NO: 53308 - DNA, 18 bp, Artificial Sequence
  Synthetic DNA
atataagcctcatcattg

SEQ ID NO: 53309 - DNA, 18 bp, Artificial Sequence
  Synthetic DNA
atatacaactgactaaag

SEQ ID NO: 53310 - DNA, 18 bp, Artificial Sequence
  Synthetic DNA
atattcaacttgttatag

SEQ ID NO: 53311 - DNA, 18 bp, Artificial Sequence
  Synthetic DNA
atattttaatcaagttag

SEQ ID NO: 53312 - DNA, 18 bp, Artificial Sequence
  Synthetic DNA
atctacatctcactatag

SEQ ID NO: 53313 - DNA, 18 bp, Artificial Sequence
  Synthetic DNA
atttacgactcacacacg

SEQ ID NO: 53314 - DNA, 18 bp, Artificial Sequence
  Synthetic DNA
caactcgactctcaaatg

SEQ ID NO: 53315 - DNA, 18 bp, Artificial Sequence
  Synthetic DNA
caagacgacactctaaag

SEQ ID NO: 53316 - DNA, 18 bp, Artificial Sequence
  Synthetic DNA
caataatacacactattg

SEQ ID NO: 53317 - DNA, 18 bp, Artificial Sequence
  Synthetic DNA
caatacgaaactctattg

SEQ ID NO: 53318 - DNA, 18 bp, Artificial Sequence
  Synthetic DNA
caatacgactggatttag

SEQ ID NO: 53319 - DNA, 18 bp, Artificial Sequence
  Synthetic DNA
caattcttctaactatag

SEQ ID NO: 53320 - DNA, 18 bp, Artificial Sequence
  Synthetic DNA
cactaagtctcacataag

SEQ ID NO: 53321 - DNA, 18 bp, Artificial Sequence
  Synthetic DNA
cactacgtccctcaatag

SEQ ID NO: 53322 - DNA, 18 bp, Artificial Sequence
  Synthetic DNA
cattacgaattaccaaag

SEQ ID NO: 53323 - DNA, 18 bp, Artificial Sequence
  Synthetic DNA
cattatgaatcactctag

SEQ ID NO: 53324 - DNA, 18 bp, Artificial Sequence
  Synthetic DNA
ctaaaagattctctatag

SEQ ID NO: 53325 - DNA, 18 bp, Artificial Sequence
  Synthetic DNA
ctatactaatccctgttg

SEQ ID NO: 53326 - DNA, 18 bp, Artificial Sequence
  Synthetic DNA
ctctacgcgtcatcatag

SEQ ID NO: 53327 - DNA, 18 bp, Artificial Sequence
  Synthetic DNA
ctttccgactcacaatag

SEQ ID NO: 53328 - DNA, 18 bp, Artificial Sequence
  Synthetic DNA
gagtaccattcactaaag

SEQ ID NO: 53329 - DNA, 18 bp, Artificial Sequence
  Synthetic DNA
gcatataactcgccatag

SEQ ID NO: 53330 - DNA, 18 bp, Artificial Sequence
  Synthetic DNA
taaaaagacacggtaaag

SEQ ID NO: 53331 - DNA, 18 bp, Artificial Sequence
  Synthetic DNA
taaaacgccacacttgcg

SEQ ID NO: 53332 - DNA, 18 bp, Artificial Sequence
  Synthetic DNA
taaaacttcactgtctcg

SEQ ID NO: 53333 - DNA, 18 bp, Artificial Sequence
  Synthetic DNA
taaaaggacactcaatag

SEQ ID NO: 53334 - DNA, 18 bp, Artificial Sequence
  Synthetic DNA
taaatcgacacacttcag

SEQ ID NO: 53335 - DNA, 18 bp, Artificial Sequence
  Synthetic DNA
taaatcgacttactaacg

SEQ ID NO: 53336 - DNA, 18 bp, Artificial Sequence
  Synthetic DNA
taaatcgtatcactacag

SEQ ID NO: 53337 - DNA, 18 bp, Artificial Sequence
  Synthetic DNA
taaatcgtctaactacag

SEQ ID NO: 53338 - DNA, 18 bp, Artificial Sequence
  Synthetic DNA
taaatggactcacattag

SEQ ID NO: 53339 - DNA, 18 bp, Artificial Sequence
  Synthetic DNA
taacactgcacacaattg

SEQ ID NO: 53340 - DNA, 18 bp, Artificial Sequence
  Synthetic DNA
taactcgactcaataatg

SEQ ID NO: 53341 - DNA, 18 bp, Artificial Sequence
  Synthetic DNA
taagaaggctctccatag

SEQ ID NO: 53342 - DNA, 18 bp, Artificial Sequence
  Synthetic DNA
taagtcgattcattatcg

SEQ ID NO: 53343 - DNA, 18 bp, Artificial Sequence
  Synthetic DNA
taataacatattttatag

SEQ ID NO: 53344 - DNA, 18 bp, Artificial Sequence
  Synthetic DNA
taataactcactctattg

SEQ ID NO: 53345 - DNA, 18 bp, Artificial Sequence
  Synthetic DNA
taataagttactatatag

SEQ ID NO: 53346 - DNA, 18 bp, Artificial Sequence
  Synthetic DNA
taataatactctcaagag

SEQ ID NO: 53347 - DNA, 18 bp, Artificial Sequence
  Synthetic DNA
taataatgctaaccttag

SEQ ID NO: 53348 - DNA, 18 bp, Artificial Sequence
  Synthetic DNA
taatacaaatctttttag

SEQ ID NO: 53349 - DNA, 18 bp, Artificial Sequence
  Synthetic DNA
taatacaattctatttag

SEQ ID NO: 53350 - DNA, 18 bp, Artificial Sequence
  Synthetic DNA
taatacatcccacttaag

SEQ ID NO: 53351 - DNA, 18 bp, Artificial Sequence
  Synthetic DNA
taataccagtaactcttg

SEQ ID NO: 53352 - DNA, 18 bp, Artificial Sequence
  Synthetic DNA
taataccattaattgtgg

SEQ ID NO: 53353 - DNA, 18 bp, Artificial Sequence
  Synthetic DNA
taatacgtataacaaaag

SEQ ID NO: 53354 - DNA, 18 bp, Artificial Sequence
  Synthetic DNA
taatacgtcacataattg

SEQ ID NO: 53355 - DNA, 18 bp, Artificial Sequence
  Synthetic DNA
taatacgtctgataaaag

SEQ ID NO: 53356 - DNA, 18 bp, Artificial Sequence
  Synthetic DNA
taatactaatctatatgg

SEQ ID NO: 53357 - DNA, 18 bp, Artificial Sequence
  Synthetic DNA
taataggacatactcgcg

SEQ ID NO: 53358 - DNA, 18 bp, Artificial Sequence
  Synthetic DNA
taatatgaattaatattg

SEQ ID NO: 53359 - DNA, 18 bp, Artificial Sequence
  Synthetic DNA
taatatgtcactatagtg

SEQ ID NO: 53360 - DNA, 18 bp, Artificial Sequence
  Synthetic DNA
taatatttctcactttcg

SEQ ID NO: 53361 - DNA, 18 bp, Artificial Sequence
  Synthetic DNA
taatcagattcactcaag

SEQ ID NO: 53362 - DNA, 18 bp, Artificial Sequence
  Synthetic DNA
taatccaacagactctag

SEQ ID NO: 53363 - DNA, 18 bp, Artificial Sequence
  Synthetic DNA
taatccgtctcacttggg

SEQ ID NO: 53364 - DNA, 18 bp, Artificial Sequence
  Synthetic DNA
taatgcaactctctaccg

SEQ ID NO: 53365 - DNA, 18 bp, Artificial Sequence
  Synthetic DNA
taatgcgacatcttatcg

SEQ ID NO: 53366 - DNA, 18 bp, Artificial Sequence
  Synthetic DNA
taattaaagtacacaaag

SEQ ID NO: 53367 - DNA, 18 bp, Artificial Sequence
  Synthetic DNA
taattcaataccctatag

SEQ ID NO: 53368 - DNA, 18 bp, Artificial Sequence
  Synthetic DNA
taattcaattcagtttag

SEQ ID NO: 53369 - DNA, 18 bp, Artificial Sequence
  Synthetic DNA
taattgtactaacttaag

SEQ ID NO: 53370 - DNA, 18 bp, Artificial Sequence
  Synthetic DNA
taatttcactctatactg

SEQ ID NO: 53371 - DNA, 18 bp, Artificial Sequence
  Synthetic DNA
taatttctcacacaatag

SEQ ID NO: 53372 - DNA, 18 bp, Artificial Sequence
  Synthetic DNA
taatttgccacattttag

SEQ ID NO: 53373 - DNA, 18 bp, Artificial Sequence
  Synthetic DNA
taattttactcactttcg

SEQ ID NO: 53374 - DNA, 18 bp, Artificial Sequence
  Synthetic DNA
taattttactctctaacg

SEQ ID NO: 53375 - DNA, 18 bp, Artificial Sequence
  Synthetic DNA
tacaaccactcacttaag

SEQ ID NO: 53376 - DNA, 18 bp, Artificial Sequence
  Synthetic DNA
tacatcgacacattaaag

SEQ ID NO: 53377 - DNA, 18 bp, Artificial Sequence
  Synthetic DNA
tacgacggctttctgtag

SEQ ID NO: 53378 - DNA, 18 bp, Artificial Sequence
  Synthetic DNA
tactaccacaacctattg

SEQ ID NO: 53379 - DNA, 18 bp, Artificial Sequence
  Synthetic DNA
tactacgcagcccttttg

SEQ ID NO: 53380 - DNA, 18 bp, Artificial Sequence
  Synthetic DNA
tactatgtgtcactattg

SEQ ID NO: 53381 - DNA, 18 bp, Artificial Sequence
  Synthetic DNA
tagaacgacttacttcag

SEQ ID NO: 53382 - DNA, 18 bp, Artificial Sequence
  Synthetic DNA
tagaacgccttattatag

SEQ ID NO: 53383 - DNA, 18 bp, Artificial Sequence
  Synthetic DNA
tagcaatacgatctatgg

SEQ ID NO: 53384 - DNA, 18 bp, Artificial Sequence
  Synthetic DNA
tagtacaacaaatgaaag

SEQ ID NO: 53385 - DNA, 18 bp, Artificial Sequence
  Synthetic DNA
tagtacaactccttctag

SEQ ID NO: 53386 - DNA, 18 bp, Artificial Sequence
  Synthetic DNA
tagtacggctctccttag

SEQ ID NO: 53387 - DNA, 18 bp, Artificial Sequence
  Synthetic DNA
tagttcgactcgaaatag

SEQ ID NO: 53388 - DNA, 18 bp, Artificial Sequence
  Synthetic DNA
tataaagtctcactattg

SEQ ID NO: 53389 - DNA, 18 bp, Artificial Sequence
  Synthetic DNA
tataacctctcattatag

SEQ ID NO: 53390 - DNA, 18 bp, Artificial Sequence
  Synthetic DNA
tataacgatccattaaag

SEQ ID NO: 53391 - DNA, 18 bp, Artificial Sequence
  Synthetic DNA
tataatgacttaccatag

SEQ ID NO: 53392 - DNA, 18 bp, Artificial Sequence
  Synthetic DNA
tatatcttctcacttttg

SEQ ID NO: 53393 - DNA, 18 bp, Artificial Sequence
  Synthetic DNA
tatcacatctctctagtg

SEQ ID NO: 53394 - DNA, 18 bp, Artificial Sequence
  Synthetic DNA
tatcaccacacactttgg

SEQ ID NO: 53395 - DNA, 18 bp, Artificial Sequence
  Synthetic DNA
tatcacgattcactaatg

SEQ ID NO: 53396 - DNA, 18 bp, Artificial Sequence
  Synthetic DNA
tatcagtaatcactatag

SEQ ID NO: 53397 - DNA, 18 bp, Artificial Sequence
  Synthetic DNA
tatgacgactcataattg

SEQ ID NO: 53398 - DNA, 18 bp, Artificial Sequence
  Synthetic DNA
tattacgacttatcaaag

SEQ ID NO: 53399 - DNA, 18 bp, Artificial Sequence
  Synthetic DNA
tattacgagtaacattag

SEQ ID NO: 53400 - DNA, 18 bp, Artificial Sequence
  Synthetic DNA
tattacgcttcactactg

SEQ ID NO: 53401 - DNA, 18 bp, Artificial Sequence
  Synthetic DNA
tattacgtcttacaaaag

SEQ ID NO: 53402 - DNA, 18 bp, Artificial Sequence
  Synthetic DNA
tattactactagctttag

SEQ ID NO: 53403 - DNA, 18 bp, Artificial Sequence
  Synthetic DNA
tattactactcatcctag

SEQ ID NO: 53404 - DNA, 18 bp, Artificial Sequence
  Synthetic DNA
tattacttcagtctacag

SEQ ID NO: 53405 - DNA, 18 bp, Artificial Sequence
  Synthetic DNA
tattataactctcaatag

SEQ ID NO: 53406 - DNA, 18 bp, Artificial Sequence
  Synthetic DNA
tattgcgactcagtaatg

SEQ ID NO: 53407 - DNA, 18 bp, Artificial Sequence
  Synthetic DNA
tatttagaatcactaaag

SEQ ID NO: 53408 - DNA, 18 bp, Artificial Sequence
  Synthetic DNA
tcaaccgactcattaaag

SEQ ID NO: 53409 - DNA, 18 bp, Artificial Sequence
  Synthetic DNA
tcaatcaactcacgatag

SEQ ID NO: 53410 - DNA, 18 bp, Artificial Sequence
  Synthetic DNA
tcataccactcaccaatg

SEQ ID NO: 53411 - DNA, 18 bp, Artificial Sequence
  Synthetic DNA
tcatacgactctcgtttg

SEQ ID NO: 53412 - DNA, 18 bp, Artificial Sequence
  Synthetic DNA
tcatagaacacacttttg

SEQ ID NO: 53413 - DNA, 18 bp, Artificial Sequence
  Synthetic DNA
tcatccacctccctatag

SEQ ID NO: 53414 - DNA, 18 bp, Artificial Sequence
  Synthetic DNA
tcattcgccactctatag

SEQ ID NO: 53415 - DNA, 18 bp, Artificial Sequence
  Synthetic DNA
tcattcggctctctaaag

SEQ ID NO: 53416 - DNA, 18 bp, Artificial Sequence
  Synthetic DNA
tcattctacacacaatag

SEQ ID NO: 53417 - DNA, 18 bp, Artificial Sequence
  Synthetic DNA
tcgtaagactcgctaatg

SEQ ID NO: 53418 - DNA, 18 bp, Artificial Sequence
  Synthetic DNA
tcttatgactcgctcttg

SEQ ID NO: 53419 - DNA, 18 bp, Artificial Sequence
  Synthetic DNA
tgaaaagatcccccatag

SEQ ID NO: 53420 - DNA, 18 bp, Artificial Sequence
  Synthetic DNA
tgatacggctatttgtag

SEQ ID NO: 53421 - DNA, 18 bp, Artificial Sequence
  Synthetic DNA
tgatgcgactcacttagg

SEQ ID NO: 53422 - DNA, 18 bp, Artificial Sequence
  Synthetic DNA
tgtggcgactcaaaatag

SEQ ID NO: 53423 - DNA, 18 bp, Artificial Sequence
  Synthetic DNA
tgttacgccttactaatg

SEQ ID NO: 53424 - DNA, 18 bp, Artificial Sequence
  Synthetic DNA
tgttactgctcactgtag

SEQ ID NO: 53425 - DNA, 18 bp, Artificial Sequence
  Synthetic DNA
ttaaacgaatctctaaag

SEQ ID NO: 53426 - DNA, 18 bp, Artificial Sequence
  Synthetic DNA
ttaaacgacttacttaag

SEQ ID NO: 53427 - DNA, 18 bp, Artificial Sequence
  Synthetic DNA
ttaaacgtctctctttgg

SEQ ID NO: 53428 - DNA, 18 bp, Artificial Sequence
  Synthetic DNA
ttaaagggcacactaaag

SEQ ID NO: 53429 - DNA, 18 bp, Artificial Sequence
  Synthetic DNA
ttaaatggctgattatag

SEQ ID NO: 53430 - DNA, 18 bp, Artificial Sequence
  Synthetic DNA
ttacacgcctctctttag

SEQ ID NO: 53431 - DNA, 18 bp, Artificial Sequence
  Synthetic DNA
ttacataactcaattttg

SEQ ID NO: 53432 - DNA, 18 bp, Artificial Sequence
  Synthetic DNA
ttacataactcactactg

SEQ ID NO: 53433 - DNA, 18 bp, Artificial Sequence
  Synthetic DNA
ttacatgacgcgctatag

SEQ ID NO: 53434 - DNA, 18 bp, Artificial Sequence
  Synthetic DNA
ttacgccagtctcaagag

SEQ ID NO: 53435 - DNA, 18 bp, Artificial Sequence
  Synthetic DNA
ttagacctctcacaatag

SEQ ID NO: 53436 - DNA, 18 bp, Artificial Sequence
  Synthetic DNA
ttagacgcctccctaaag

SEQ ID NO: 53437 - DNA, 18 bp, Artificial Sequence
  Synthetic DNA
ttatacagcccaatctag

SEQ ID NO: 53438 - DNA, 18 bp, Artificial Sequence
  Synthetic DNA
ttatacctctcactacgg

SEQ ID NO: 53439 - DNA, 18 bp, Artificial Sequence
  Synthetic DNA
ttatacgaatctctagtg

SEQ ID NO: 53440 - DNA, 18 bp, Artificial Sequence
  Synthetic DNA
ttatacgtcatactatgg

SEQ ID NO: 53441 - DNA, 18 bp, Artificial Sequence
  Synthetic DNA
ttatatcactcattttag

SEQ ID NO: 53442 - DNA, 18 bp, Artificial Sequence
  Synthetic DNA
ttatatggatcactattg

SEQ ID NO: 53443 - DNA, 18 bp, Artificial Sequence
  Synthetic DNA
ttatatttctctctatag

SEQ ID NO: 53444 - DNA, 18 bp, Artificial Sequence
  Synthetic DNA
ttatccgattcataatag

SEQ ID NO: 53445 - DNA, 18 bp, Artificial Sequence
  Synthetic DNA
ttatccggctaactgtag

SEQ ID NO: 53446 - DNA, 18 bp, Artificial Sequence
  Synthetic DNA
ttatctctcttactatag

SEQ ID NO: 53447 - DNA, 18 bp, Artificial Sequence
  Synthetic DNA
ttattcgacctaccatag

SEQ ID NO: 53448 - DNA, 18 bp, Artificial Sequence
  Synthetic DNA
ttattggacacactttag

SEQ ID NO: 53449 - DNA, 18 bp, Artificial Sequence
  Synthetic DNA
ttctacaaccgaccatag

SEQ ID NO: 53450 - DNA, 18 bp, Artificial Sequence
  Synthetic DNA
ttctaccacacactaaag

SEQ ID NO: 53451 - DNA, 18 bp, Artificial Sequence
  Synthetic DNA
ttctacgcatctctatag

SEQ ID NO: 53452 - DNA, 18 bp, Artificial Sequence
  Synthetic DNA
ttcttcgaataccttcag

SEQ ID NO: 53453 - DNA, 18 bp, Artificial Sequence
  Synthetic DNA
ttgaacgactctctattg

SEQ ID NO: 53454 - DNA, 18 bp, Artificial Sequence
  Synthetic DNA
ttgtacaactcacttttg

SEQ ID NO: 53455 - DNA, 18 bp, Artificial Sequence
  Synthetic DNA
ttgtaggactcacaattg

SEQ ID NO: 53456 - DNA, 18 bp, Artificial Sequence
  Synthetic DNA
tttaacgcctcactaaag

SEQ ID NO: 53457 - DNA, 18 bp, Artificial Sequence
  Synthetic DNA
tttcgcgacacagaatcg

SEQ ID NO: 53458 - DNA, 18 bp, Artificial Sequence
  Synthetic DNA
tttctcgacttactatag

SEQ ID NO: 53459 - DNA, 18 bp, Artificial Sequence
  Synthetic DNA
ttttaagtctcactatgg

SEQ ID NO: 53460 - DNA, 18 bp, Artificial Sequence
  Synthetic DNA
ttttacgaatcacattag

SEQ ID NO: 53461 - DNA, 18 bp, Artificial Sequence
  Synthetic DNA
ttttacgactttgtatag

SEQ ID NO: 53462 - DNA, 18 bp, Artificial Sequence
  Synthetic DNA
ttttacgagatgatgtag

SEQ ID NO: 53463 - DNA, 18 bp, Artificial Sequence
  Synthetic DNA
ttttaggactcacgcttg

SEQ ID NO: 53464 - DNA, 18 bp, Artificial Sequence
  Synthetic DNA
ttttaggtctcactttag

SEQ ID NO: 53465 - DNA, 18 bp, Artificial Sequence
  Synthetic DNA
ttttcctacacactatag

SEQ ID NO: 53466 - DNA, 18 bp, Artificial Sequence
  Synthetic DNA
ttttgcgactcacttttg

SEQ ID NO: 53467 - DNA, 18 bp, Artificial Sequence
  Synthetic DNA
taattaaactcacaattg

SEQ ID NO: 53468 - DNA, 18 bp, Artificial Sequence
  Synthetic DNA
aaatcccattctgtatag

SEQ ID NO: 53469 - DNA, 18 bp, Artificial Sequence
  Synthetic DNA
aattatgacttgctatag

SEQ ID NO: 53470 - DNA, 18 bp, Artificial Sequence
  Synthetic DNA
atatacgacactctattg

SEQ ID NO: 53471 - DNA, 18 bp, Artificial Sequence
  Synthetic DNA
caatatgccatactatag

SEQ ID NO: 53472 - DNA, 18 bp, Artificial Sequence
  Synthetic DNA
gaatccgtcccactaaag

SEQ ID NO: 53473 - DNA, 18 bp, Artificial Sequence
  Synthetic DNA
ggatacgaatctctattg

SEQ ID NO: 53474 - DNA, 18 bp, Artificial Sequence
  Synthetic DNA
taaatcgtcacattatag

SEQ ID NO: 53475 - DNA, 18 bp, Artificial Sequence
  Synthetic DNA
taataagactgacttctg

SEQ ID NO: 53476 - DNA, 18 bp, Artificial Sequence
  Synthetic DNA
taatacactttacttttg

SEQ ID NO: 53477 - DNA, 18 bp, Artificial Sequence
  Synthetic DNA
taatcaatctcactttag

SEQ ID NO: 53478 - DNA, 18 bp, Artificial Sequence
  Synthetic DNA
tagtctgtctcactgtag

SEQ ID NO: 53479 - DNA, 18 bp, Artificial Sequence
  Synthetic DNA
tagtttggctctcttaag

SEQ ID NO: 53480 - DNA, 18 bp, Artificial Sequence
  Synthetic DNA
tattacgactaggtctag

SEQ ID NO: 53481 - DNA, 18 bp, Artificial Sequence
  Synthetic DNA
tctttagcatcattttag

SEQ ID NO: 53482 - DNA, 18 bp, Artificial Sequence
  Synthetic DNA
ttatactcttctctatcg

SEQ ID NO: 53483 - DNA, 18 bp, Artificial Sequence
  Synthetic DNA
tataacctcacactatag

SEQ ID NO: 53484 - DNA, 18 bp, Artificial Sequence
  Synthetic DNA
tattacgtatcaattttg

SEQ ID NO: 53485 - DNA, 18 bp, Artificial Sequence
  Synthetic DNA
atatacgacacactaatg

SEQ ID NO: 53486 - DNA, 18 bp, Artificial Sequence
  Synthetic DNA
tataacaactcactcaag

SEQ ID NO: 53487 - DNA, 18 bp, Artificial Sequence
  Synthetic DNA
ctattcgactcacaattg

SEQ ID NO: 53488 - DNA, 18 bp, Artificial Sequence
  Synthetic DNA
ttaaacgacacactttcg

SEQ ID NO: 53489 - DNA, 18 bp, Artificial Sequence
  Synthetic DNA
aaaagagactcagtttag

SEQ ID NO: 53490 - DNA, 18 bp, Artificial Sequence
  Synthetic DNA
atatacgtcacattatag

SEQ ID NO: 53491 - DNA, 18 bp, Artificial Sequence
  Synthetic DNA
taacacgcctcatttaag

SEQ ID NO: 53492 - DNA, 18 bp, Artificial Sequence
  Synthetic DNA
taacgtgcctatctacag

SEQ ID NO: 53493 - DNA, 18 bp, Artificial Sequence
  Synthetic DNA
tattacaactcattaatg

SEQ ID NO: 53494 - DNA, 18 bp, Artificial Sequence
  Synthetic DNA
tcacatgaatcgctgtag

SEQ ID NO: 53495 - DNA, 18 bp, Artificial Sequence
  Synthetic DNA
tcataccacctactatcg

SEQ ID NO: 53496 - DNA, 18 bp, Artificial Sequence
  Synthetic DNA
ttaaacgattctctatgg

SEQ ID NO: 53497 - DNA, 18 bp, Artificial Sequence
  Synthetic DNA
ttatacctctcacaaatg

SEQ ID NO: 53498 - DNA, 18 bp, Artificial Sequence
  Synthetic DNA
ttccaaaactcactaaag

SEQ ID NO: 53499 - DNA, 18 bp, Artificial Sequence
  Synthetic DNA
aaaaacgaaataccctcg

SEQ ID NO: 53500 - DNA, 18 bp, Artificial Sequence
  Synthetic DNA
aaaaacgactcaaaattg

SEQ ID NO: 53501 - DNA, 18 bp, Artificial Sequence
  Synthetic DNA
aaaaacgagttagtcaag

SEQ ID NO: 53502 - DNA, 18 bp, Artificial Sequence
  Synthetic DNA
aaaatcttatccctaaag

SEQ ID NO: 53503 - DNA, 18 bp, Artificial Sequence
  Synthetic DNA
aaataagacacattcttg

SEQ ID NO: 53504 - DNA, 18 bp, Artificial Sequence
  Synthetic DNA
aaatacaactctcaaaag

SEQ ID NO: 53505 - DNA, 18 bp, Artificial Sequence
  Synthetic DNA
aaatacgaacgactagag

SEQ ID NO: 53506 - DNA, 18 bp, Artificial Sequence
  Synthetic DNA
aaatacgacattctattg

SEQ ID NO: 53507 - DNA, 18 bp, Artificial Sequence
  Synthetic DNA
aaatacgtctcataaaag

SEQ ID NO: 53508 - DNA, 18 bp, Artificial Sequence
  Synthetic DNA
aaataggactctttctag

SEQ ID NO: 53509 - DNA, 18 bp, Artificial Sequence
  Synthetic DNA
aaatgagtctcactttag

SEQ ID NO: 53510 - DNA, 18 bp, Artificial Sequence
  Synthetic DNA
aaatgcgcttctctaaag

SEQ ID NO: 53511 - DNA, 18 bp, Artificial Sequence
  Synthetic DNA
aaatgtgactctctaaag

SEQ ID NO: 53512 - DNA, 18 bp, Artificial Sequence
  Synthetic DNA
aaattcgacctaatatag

SEQ ID NO: 53513 - DNA, 18 bp, Artificial Sequence
  Synthetic DNA
aaattcgtctctctaaag

SEQ ID NO: 53514 - DNA, 18 bp, Artificial Sequence
  Synthetic DNA
aaattcgtcttattatag

SEQ ID NO: 53515 - DNA, 18 bp, Artificial Sequence
  Synthetic DNA
aactaactatcactaatg

SEQ ID NO: 53516 - DNA, 18 bp, Artificial Sequence
  Synthetic DNA
aagttctactgacttaag

SEQ ID NO: 53517 - DNA, 18 bp, Artificial Sequence
  Synthetic DNA
aattacaactaaatatcg

SEQ ID NO: 53518 - DNA, 18 bp, Artificial Sequence
  Synthetic DNA
aattcaaactcactattg

SEQ ID NO: 53519 - DNA, 18 bp, Artificial Sequence
  Synthetic DNA
aatttcccctcacaaaag

SEQ ID NO: 53520 - DNA, 18 bp, Artificial Sequence
  Synthetic DNA
acacacgtctcagtaaag

SEQ ID NO: 53521 - DNA, 18 bp, Artificial Sequence
  Synthetic DNA
acatacaacccaccatag

SEQ ID NO: 53522 - DNA, 18 bp, Artificial Sequence
  Synthetic DNA
acatacgactgacttttg

SEQ ID NO: 53523 - DNA, 18 bp, Artificial Sequence
  Synthetic DNA
agatatgactgtctatag

SEQ ID NO: 53524 - DNA, 18 bp, Artificial Sequence
  Synthetic DNA
agatgcgacttgctatcg

SEQ ID NO: 53525 - DNA, 18 bp, Artificial Sequence
  Synthetic DNA
agattcgactctgtatag

SEQ ID NO: 53526 - DNA, 18 bp, Artificial Sequence
  Synthetic DNA
agcttcgattcactatag

SEQ ID NO: 53527 - DNA, 18 bp, Artificial Sequence
  Synthetic DNA
ataaacggatcactatag

SEQ ID NO: 53528 - DNA, 18 bp, Artificial Sequence
  Synthetic DNA
atacacgactcaatctgg

SEQ ID NO: 53529 - DNA, 18 bp, Artificial Sequence
  Synthetic DNA
atacacgactcttaatag

SEQ ID NO: 53530 - DNA, 18 bp, Artificial Sequence
  Synthetic DNA
atatacgactgacaattg

SEQ ID NO: 53531 - DNA, 18 bp, Artificial Sequence
  Synthetic DNA
atattccatattcaaaag

SEQ ID NO: 53532 - DNA, 18 bp, Artificial Sequence
  Synthetic DNA
atattcgattcagtatag

SEQ ID NO: 53533 - DNA, 18 bp, Artificial Sequence
  Synthetic DNA
atatttgtgtcatttttg

SEQ ID NO: 53534 - DNA, 18 bp, Artificial Sequence
  Synthetic DNA
atgtacgaatcataatag

SEQ ID NO: 53535 - DNA, 18 bp, Artificial Sequence
  Synthetic DNA
atgtatgacacacaatag

SEQ ID NO: 53536 - DNA, 18 bp, Artificial Sequence
  Synthetic DNA
attaacctctcactatag

SEQ ID NO: 53537 - DNA, 18 bp, Artificial Sequence
  Synthetic DNA
atttatgtctctctatag

SEQ ID NO: 53538 - DNA, 18 bp, Artificial Sequence
  Synthetic DNA
caaaacgatccattatag

SEQ ID NO: 53539 - DNA, 18 bp, Artificial Sequence
  Synthetic DNA
caacactgtttactatag

SEQ ID NO: 53540 - DNA, 18 bp, Artificial Sequence
  Synthetic DNA
caataacactctcaaaag

SEQ ID NO: 53541 - DNA, 18 bp, Artificial Sequence
  Synthetic DNA
caataagtctcgctattg

SEQ ID NO: 53542 - DNA, 18 bp, Artificial Sequence
  Synthetic DNA
caatacctctacctttag

SEQ ID NO: 53543 - DNA, 18 bp, Artificial Sequence
  Synthetic DNA
caatacgccatactattg

SEQ ID NO: 53544 - DNA, 18 bp, Artificial Sequence
  Synthetic DNA
cactgcaactccctatag

SEQ ID NO: 53545 - DNA, 18 bp, Artificial Sequence
  Synthetic DNA
cagtacaaatcacaatag

SEQ ID NO: 53546 - DNA, 18 bp, Artificial Sequence
  Synthetic DNA
cagtattacgttctatcg

SEQ ID NO: 53547 - DNA, 18 bp, Artificial Sequence
  Synthetic DNA
cataacgacacacgttcg

SEQ ID NO: 53548 - DNA, 18 bp, Artificial Sequence
  Synthetic DNA
cattactaatctctttag

SEQ ID NO: 53549 - DNA, 18 bp, Artificial Sequence
  Synthetic DNA
cattgcgtgtcactatag

SEQ ID NO: 53550 - DNA, 18 bp, Artificial Sequence
  Synthetic DNA
catttcgactcaatgttg

SEQ ID NO: 53551 - DNA, 18 bp, Artificial Sequence
  Synthetic DNA
ccataagtctcactttag

SEQ ID NO: 53552 - DNA, 18 bp, Artificial Sequence
  Synthetic DNA
gactaagtcccattatag

SEQ ID NO: 53553 - DNA, 18 bp, Artificial Sequence
  Synthetic DNA
gagtccgattcacaatcg

SEQ ID NO: 53554 - DNA, 18 bp, Artificial Sequence
  Synthetic DNA
gattatgacacactaaag

SEQ ID NO: 53555 - DNA, 18 bp, Artificial Sequence
  Synthetic DNA
gcgatagagtcgctcaag

SEQ ID NO: 53556 - DNA, 18 bp, Artificial Sequence
  Synthetic DNA
ggaaccgtctcactttag

SEQ ID NO: 53557 - DNA, 18 bp, Artificial Sequence
  Synthetic DNA
taaaaccacttactaatg

SEQ ID NO: 53558 - DNA, 18 bp, Artificial Sequence
  Synthetic DNA
taaaacgactcacacatg

SEQ ID NO: 53559 - DNA, 18 bp, Artificial Sequence
  Synthetic DNA
taaaacggctcagtcaag

SEQ ID NO: 53560 - DNA, 18 bp, Artificial Sequence
  Synthetic DNA
taaaactgtacactgtag

SEQ ID NO: 53561 - DNA, 18 bp, Artificial Sequence
  Synthetic DNA
taaaacttctgaccatag

SEQ ID NO: 53562 - DNA, 18 bp, Artificial Sequence
  Synthetic DNA
taaaatgtttaaatactg

SEQ ID NO: 53563 - DNA, 18 bp, Artificial Sequence
  Synthetic DNA
taaagcgagttaattttg

SEQ ID NO: 53564 - DNA, 18 bp, Artificial Sequence
  Synthetic DNA
taaatcgtctccctttag

SEQ ID NO: 53565 - DNA, 18 bp, Artificial Sequence
  Synthetic DNA
taacacgatttatctaag

SEQ ID NO: 53566 - DNA, 18 bp, Artificial Sequence
  Synthetic DNA
taacacgtcctactacag

SEQ ID NO: 53567 - DNA, 18 bp, Artificial Sequence
  Synthetic DNA
taacactaatcacgattg

SEQ ID NO: 53568 - DNA, 18 bp, Artificial Sequence
  Synthetic DNA
taactctactgcttgcag

SEQ ID NO: 53569 - DNA, 18 bp, Artificial Sequence
  Synthetic DNA
taagaggaatcactgttg

SEQ ID NO: 53570 - DNA, 18 bp, Artificial Sequence
  Synthetic DNA
taagccgactaacatttg

SEQ ID NO: 53571 - DNA, 18 bp, Artificial Sequence
  Synthetic DNA
taataaaacttacatttg

SEQ ID NO: 53572 - DNA, 18 bp, Artificial Sequence
  Synthetic DNA
taataagaatcaattctg

SEQ ID NO: 53573 - DNA, 18 bp, Artificial Sequence
  Synthetic DNA
taataagcgttgctatag

SEQ ID NO: 53574 - DNA, 18 bp, Artificial Sequence
  Synthetic DNA
taataatactaccaatag

SEQ ID NO: 53575 - DNA, 18 bp, Artificial Sequence
  Synthetic DNA
taataatccgcgcttttg

SEQ ID NO: 53576 - DNA, 18 bp, Artificial Sequence
  Synthetic DNA
taatacatcacattacag

SEQ ID NO: 53577 - DNA, 18 bp, Artificial Sequence
  Synthetic DNA
taatacatctctctttgg

SEQ ID NO: 53578 - DNA, 18 bp, Artificial Sequence
  Synthetic DNA
taataccattcacaagcg

SEQ ID NO: 53579 - DNA, 18 bp, Artificial Sequence
  Synthetic DNA
taatacctcgctgaattg

SEQ ID NO: 53580 - DNA, 18 bp, Artificial Sequence
  Synthetic DNA
taatacgaatatctttgg

SEQ ID NO: 53581 - DNA, 18 bp, Artificial Sequence
  Synthetic DNA
taatacgacacgcttatg

SEQ ID NO: 53582 - DNA, 18 bp, Artificial Sequence
  Synthetic DNA
taatacgacagtttaaag

SEQ ID NO: 53583 - DNA, 18 bp, Artificial Sequence
  Synthetic DNA
taatacgaccgacactgg

SEQ ID NO: 53584 - DNA, 18 bp, Artificial Sequence
  Synthetic DNA
taatacgatccagcttag

SEQ ID NO: 53585 - DNA, 18 bp, Artificial Sequence
  Synthetic DNA
taatacgattaaattgag

SEQ ID NO: 53586 - DNA, 18 bp, Artificial Sequence
  Synthetic DNA
taatacgtcactttacag

SEQ ID NO: 53587 - DNA, 18 bp, Artificial Sequence
  Synthetic DNA
taatacgtctcccaaatg

SEQ ID NO: 53588 - DNA, 18 bp, Artificial Sequence
  Synthetic DNA
taatacgtctggcaaagg

SEQ ID NO: 53589 - DNA, 18 bp, Artificial Sequence
  Synthetic DNA
taatactagtctctaatg

SEQ ID NO: 53590 - DNA, 18 bp, Artificial Sequence
  Synthetic DNA
taatccttgtctttatag

SEQ ID NO: 53591 - DNA, 18 bp, Artificial Sequence
  Synthetic DNA
taatcgggcattctttag

SEQ ID NO: 53592 - DNA, 18 bp, Artificial Sequence
  Synthetic DNA
taatgagactctctagcg

SEQ ID NO: 53593 - DNA, 18 bp, Artificial Sequence
  Synthetic DNA
taatgcgataatccgttg

SEQ ID NO: 53594 - DNA, 18 bp, Artificial Sequence
  Synthetic DNA
taattagactcacttatg

SEQ ID NO: 53595 - DNA, 18 bp, Artificial Sequence
  Synthetic DNA
taattcaacagactaaag

SEQ ID NO: 53596 - DNA, 18 bp, Artificial Sequence
  Synthetic DNA
taattcatctgacgatag

SEQ ID NO: 53597 - DNA, 18 bp, Artificial Sequence
  Synthetic DNA
taattcgcgtctcttaag

SEQ ID NO: 53598 - DNA, 18 bp, Artificial Sequence
  Synthetic DNA
taattcgtcccactcaag

SEQ ID NO: 53599 - DNA, 18 bp, Artificial Sequence
  Synthetic DNA
taattctcccctctatag

SEQ ID NO: 53600 - DNA, 18 bp, Artificial Sequence
  Synthetic DNA
taatttgagtttctaaag

SEQ ID NO: 53601 - DNA, 18 bp, Artificial Sequence
  Synthetic DNA
tacaaaaatccagtttag

SEQ ID NO: 53602 - DNA, 18 bp, Artificial Sequence
  Synthetic DNA
tactacatcttactctag

SEQ ID NO: 53603 - DNA, 18 bp, Artificial Sequence
  Synthetic DNA
tactacggctcattttgg

SEQ ID NO: 53604 - DNA, 18 bp, Artificial Sequence
  Synthetic DNA
tagaactactcactaatg

SEQ ID NO: 53605 - DNA, 18 bp, Artificial Sequence
  Synthetic DNA
taggatgcatcactatag

SEQ ID NO: 53606 - DNA, 18 bp, Artificial Sequence
  Synthetic DNA
tagtaccactatcaacag

SEQ ID NO: 53607 - DNA, 18 bp, Artificial Sequence
  Synthetic DNA
tagtatctgtaagttttg

SEQ ID NO: 53608 - DNA, 18 bp, Artificial Sequence
  Synthetic DNA
tagtccaactcacttaag

SEQ ID NO: 53609 - DNA, 18 bp, Artificial Sequence
  Synthetic DNA
tagtcccactccctttcg

SEQ ID NO: 53610 - DNA, 18 bp, Artificial Sequence
  Synthetic DNA
tagtccgactcaaaattg

SEQ ID NO: 53611 - DNA, 18 bp, Artificial Sequence
  Synthetic DNA
tagtgcgccccactaaag

SEQ ID NO: 53612 - DNA, 18 bp, Artificial Sequence
  Synthetic DNA
tagtgtgagtcaccaaag

SEQ ID NO: 53613 - DNA, 18 bp, Artificial Sequence
  Synthetic DNA
tataaggtcttataacag

SEQ ID NO: 53614 - DNA, 18 bp, Artificial Sequence
  Synthetic DNA
tatcacgaatgccataag

SEQ ID NO: 53615 - DNA, 18 bp, Artificial Sequence
  Synthetic DNA
tatgacgatgcactttag

SEQ ID NO: 53616 - DNA, 18 bp, Artificial Sequence
  Synthetic DNA
tatgatgacacaccatag

SEQ ID NO: 53617 - DNA, 18 bp, Artificial Sequence
  Synthetic DNA
tattaagactcaatgttg

SEQ ID NO: 53618 - DNA, 18 bp, Artificial Sequence
  Synthetic DNA
tattaatactcactactg

SEQ ID NO: 53619 - DNA, 18 bp, Artificial Sequence
  Synthetic DNA
tattacaacactcaaaag

SEQ ID NO: 53620 - DNA, 18 bp, Artificial Sequence
  Synthetic DNA
tattacaacattctatag

SEQ ID NO: 53621 - DNA, 18 bp, Artificial Sequence
  Synthetic DNA
tattacaattcaatgaag

SEQ ID NO: 53622 - DNA, 18 bp, Artificial Sequence
  Synthetic DNA
tattacgaatcagagttg

SEQ ID NO: 53623 - DNA, 18 bp, Artificial Sequence
  Synthetic DNA
tattacgcatcaccactg

SEQ ID NO: 53624 - DNA, 18 bp, Artificial Sequence
  Synthetic DNA
tattacgtctcgctaatg

SEQ ID NO: 53625 - DNA, 18 bp, Artificial Sequence
  Synthetic DNA
tattacgtgattctatgg

SEQ ID NO: 53626 - DNA, 18 bp, Artificial Sequence
  Synthetic DNA
tattatcgcactctatag

SEQ ID NO: 53627 - DNA, 18 bp, Artificial Sequence
  Synthetic DNA
tattatgtcatagtttcg

SEQ ID NO: 53628 - DNA, 18 bp, Artificial Sequence
  Synthetic DNA
tattgcgagagactatag

SEQ ID NO: 53629 - DNA, 18 bp, Artificial Sequence
  Synthetic DNA
tattttcacttatcaaag

SEQ ID NO: 53630 - DNA, 18 bp, Artificial Sequence
  Synthetic DNA
tcaatcgtctcactaatg

SEQ ID NO: 53631 - DNA, 18 bp, Artificial Sequence
  Synthetic DNA
tcacacgtctcaccagag

SEQ ID NO: 53632 - DNA, 18 bp, Artificial Sequence
  Synthetic DNA
tcatgtgactcatactag

SEQ ID NO: 53633 - DNA, 18 bp, Artificial Sequence
  Synthetic DNA
tcattagacgctatatgg

SEQ ID NO: 53634 - DNA, 18 bp, Artificial Sequence
  Synthetic DNA
tcattcgactttctttag

SEQ ID NO: 53635 - DNA, 18 bp, Artificial Sequence
  Synthetic DNA
tcgtacgagtatctatag

SEQ ID NO: 53636 - DNA, 18 bp, Artificial Sequence
  Synthetic DNA
tcttacgaatctgtacag

SEQ ID NO: 53637 - DNA, 18 bp, Artificial Sequence
  Synthetic DNA
tcttacgattcagtactg

SEQ ID NO: 53638 - DNA, 18 bp, Artificial Sequence
  Synthetic DNA
tcttacgtttaactatag

SEQ ID NO: 53639 - DNA, 18 bp, Artificial Sequence
  Synthetic DNA
tgactcgacgctctattg

SEQ ID NO: 53640 - DNA, 18 bp, Artificial Sequence
  Synthetic DNA
tgataaaacccacatcag

SEQ ID NO: 53641 - DNA, 18 bp, Artificial Sequence
  Synthetic DNA
tgattcgaatcattaaag

SEQ ID NO: 53642 - DNA, 18 bp, Artificial Sequence
  Synthetic DNA
tgattcgtgcttctatag

SEQ ID NO: 53643 - DNA, 18 bp, Artificial Sequence
  Synthetic DNA
tgcaacgaattaccatag

SEQ ID NO: 53644 - DNA, 18 bp, Artificial Sequence
  Synthetic DNA
tgctaccacactctatag

SEQ ID NO: 53645 - DNA, 18 bp, Artificial Sequence
  Synthetic DNA
tgttacgtctcacttttg

SEQ ID NO: 53646 - DNA, 18 bp, Artificial Sequence
  Synthetic DNA
ttaaaatttacgctgttg

SEQ ID NO: 53647 - DNA, 18 bp, Artificial Sequence
  Synthetic DNA
ttaaacgtctcacaaaag

SEQ ID NO: 53648 - DNA, 18 bp, Artificial Sequence
  Synthetic DNA
ttaaacgtctcttgaaag

SEQ ID NO: 53649 - DNA, 18 bp, Artificial Sequence
  Synthetic DNA
ttacacagctcactctag

SEQ ID NO: 53650 - DNA, 18 bp, Artificial Sequence
  Synthetic DNA
ttacactactcatcattg

SEQ ID NO: 53651 - DNA, 18 bp, Artificial Sequence
  Synthetic DNA
ttactcgcctcactttag

SEQ ID NO: 53652 - DNA, 18 bp, Artificial Sequence
  Synthetic DNA
ttagacaacgcgctttag

SEQ ID NO: 53653 - DNA, 18 bp, Artificial Sequence
  Synthetic DNA
ttagacgtcctactatag

SEQ ID NO: 53654 - DNA, 18 bp, Artificial Sequence
  Synthetic DNA
ttatacaacctactacag

SEQ ID NO: 53655 - DNA, 18 bp, Artificial Sequence
  Synthetic DNA
ttataccactgccgattg

SEQ ID NO: 53656 - DNA, 18 bp, Artificial Sequence
  Synthetic DNA
ttatacgactttatattg

SEQ ID NO: 53657 - DNA, 18 bp, Artificial Sequence
  Synthetic DNA
ttatacgtctcattaagg

SEQ ID NO: 53658 - DNA, 18 bp, Artificial Sequence
  Synthetic DNA
ttatacgtctgacaatgg

SEQ ID NO: 53659 - DNA, 18 bp, Artificial Sequence
  Synthetic DNA
ttatactcgttattttag

SEQ ID NO: 53660 - DNA, 18 bp, Artificial Sequence
  Synthetic DNA
ttattcaactcgctattg

SEQ ID NO: 53661 - DNA, 18 bp, Artificial Sequence
  Synthetic DNA
ttattcatctctattaag

SEQ ID NO: 53662 - DNA, 18 bp, Artificial Sequence
  Synthetic DNA
ttattcgaattgctaaag

SEQ ID NO: 53663 - DNA, 18 bp, Artificial Sequence
  Synthetic DNA
ttattcgacaaaatctag

SEQ ID NO: 53664 - DNA, 18 bp, Artificial Sequence
  Synthetic DNA
ttcttcgactctctaaag

SEQ ID NO: 53665 - DNA, 18 bp, Artificial Sequence
  Synthetic DNA
ttggacgtttctctatag

SEQ ID NO: 53666 - DNA, 18 bp, Artificial Sequence
  Synthetic DNA
ttgtacggcttactttag

SEQ ID NO: 53667 - DNA, 18 bp, Artificial Sequence
  Synthetic DNA
tttaacaactctctatag

SEQ ID NO: 53668 - DNA, 18 bp, Artificial Sequence
  Synthetic DNA
tttaatgtctctctatag

SEQ ID NO: 53669 - DNA, 18 bp, Artificial Sequence
  Synthetic DNA
tttcactatatactaaag

SEQ ID NO: 53670 - DNA, 18 bp, Artificial Sequence
  Synthetic DNA
ttttacgacaaactaaag

SEQ ID NO: 53671 - DNA, 18 bp, Artificial Sequence
  Synthetic DNA
ttttacgactcgttatcg

SEQ ID NO: 53672 - DNA, 18 bp, Artificial Sequence
  Synthetic DNA
ttttacgactctttttag

SEQ ID NO: 53673 - DNA, 18 bp, Artificial Sequence
  Synthetic DNA
ttttactactcactttcg

SEQ ID NO: 53674 - DNA, 18 bp, Artificial Sequence
  Synthetic DNA
aaaaacaacactctatag

SEQ ID NO: 53675 - DNA, 18 bp, Artificial Sequence
  Synthetic DNA
aaaaacaacccattaatg

SEQ ID NO: 53676 - DNA, 18 bp, Artificial Sequence
  Synthetic DNA
aaaaacatctcaatattg

SEQ ID NO: 53677 - DNA, 18 bp, Artificial Sequence
  Synthetic DNA
aaaaaccattcactttag

SEQ ID NO: 53678 - DNA, 18 bp, Artificial Sequence
  Synthetic DNA
aaaaacgaaacactattg

SEQ ID NO: 53679 - DNA, 18 bp, Artificial Sequence
  Synthetic DNA
aaaaacgaatctatttag

SEQ ID NO: 53680 - DNA, 18 bp, Artificial Sequence
  Synthetic DNA
aaaaacgactctttctag

SEQ ID NO: 53681 - DNA, 18 bp, Artificial Sequence
  Synthetic DNA
aaaaacgactgagtttag

SEQ ID NO: 53682 - DNA, 18 bp, Artificial Sequence
  Synthetic DNA
aaaaacgattaaccatag

SEQ ID NO: 53683 - DNA, 18 bp, Artificial Sequence
  Synthetic DNA
aaaaacgtcacgcaattg

SEQ ID NO: 53684 - DNA, 18 bp, Artificial Sequence
  Synthetic DNA
aaaaacgtccgactaaag

SEQ ID NO: 53685 - DNA, 18 bp, Artificial Sequence
  Synthetic DNA
aaaaacgtctcacttttg

SEQ ID NO: 53686 - DNA, 18 bp, Artificial Sequence
  Synthetic DNA
aaaaactactcacaaatg

SEQ ID NO: 53687 - DNA, 18 bp, Artificial Sequence
  Synthetic DNA
aaaaactacttactttag

SEQ ID NO: 53688 - DNA, 18 bp, Artificial Sequence
  Synthetic DNA
aaaaaggtctcacttcag

SEQ ID NO: 53689 - DNA, 18 bp, Artificial Sequence
  Synthetic DNA
aaaaagtactcattagag

SEQ ID NO: 53690 - DNA, 18 bp, Artificial Sequence
  Synthetic DNA
aaaaataacacactatag

SEQ ID NO: 53691 - DNA, 18 bp, Artificial Sequence
  Synthetic DNA
aaaaatatttctccatag

SEQ ID NO: 53692 - DNA, 18 bp, Artificial Sequence
  Synthetic DNA
aaaaatcactctgtttag

SEQ ID NO: 53693 - DNA, 18 bp, Artificial Sequence
  Synthetic DNA
aaaaatgactctctaatg

SEQ ID NO: 53694 - DNA, 18 bp, Artificial Sequence
  Synthetic DNA
aaaagcgaataaatcatg

SEQ ID NO: 53695 - DNA, 18 bp, Artificial Sequence
  Synthetic DNA
aaaagcgcctctcataag

SEQ ID NO: 53696 - DNA, 18 bp, Artificial Sequence
  Synthetic DNA
aaaagctactgcctatag

SEQ ID NO: 53697 - DNA, 18 bp, Artificial Sequence
  Synthetic DNA
aaaatagactcactaatg

SEQ ID NO: 53698 - DNA, 18 bp, Artificial Sequence
  Synthetic DNA
aaaatcaacacaccttag

SEQ ID NO: 53699 - DNA, 18 bp, Artificial Sequence
  Synthetic DNA
aaaatcaacactttatag

SEQ ID NO: 53700 - DNA, 18 bp, Artificial Sequence
  Synthetic DNA
aaaatcaacctgctattg

SEQ ID NO: 53701 - DNA, 18 bp, Artificial Sequence
  Synthetic DNA
aaaatcaactctctctag

SEQ ID NO: 53702 - DNA, 18 bp, Artificial Sequence
  Synthetic DNA
aaaatcgagtcactagcg

SEQ ID NO: 53703 - DNA, 18 bp, Artificial Sequence
  Synthetic DNA
aaaatcgtcttactagag

SEQ ID NO: 53704 - DNA, 18 bp, Artificial Sequence
  Synthetic DNA
aaaatcgtgtcgcattgg

SEQ ID NO: 53705 - DNA, 18 bp, Artificial Sequence
  Synthetic DNA
aaaattgacctgcattag

SEQ ID NO: 53706 - DNA, 18 bp, Artificial Sequence
  Synthetic DNA
aaacaagtctctctatag

SEQ ID NO: 53707 - DNA, 18 bp, Artificial Sequence
  Synthetic DNA
aaacacaacacaataagg

SEQ ID NO: 53708 - DNA, 18 bp, Artificial Sequence
  Synthetic DNA
aaacacatctctgtttag

SEQ ID NO: 53709 - DNA, 18 bp, Artificial Sequence
  Synthetic DNA
aaacacgcctctttatag

SEQ ID NO: 53710 - DNA, 18 bp, Artificial Sequence
  Synthetic DNA
aaacacgtctccatgaag

SEQ ID NO: 53711 - DNA, 18 bp, Artificial Sequence
  Synthetic DNA
aaacactaataactaacg

SEQ ID NO: 53712 - DNA, 18 bp, Artificial Sequence
  Synthetic DNA
aaacaggacccagtctgg

SEQ ID NO: 53713 - DNA, 18 bp, Artificial Sequence
  Synthetic DNA
aaacgcaatacattattg

SEQ ID NO: 53714 - DNA, 18 bp, Artificial Sequence
  Synthetic DNA
aaacgcgtcacaatctgg

SEQ ID NO: 53715 - DNA, 18 bp, Artificial Sequence
  Synthetic DNA
aaacgctatttatttttg

SEQ ID NO: 53716 - DNA, 18 bp, Artificial Sequence
  Synthetic DNA
aaactcaattcactaacg

SEQ ID NO: 53717 - DNA, 18 bp, Artificial Sequence
  Synthetic DNA
aaactccaatcagaatag

SEQ ID NO: 53718 - DNA, 18 bp, Artificial Sequence
  Synthetic DNA
aaactgaacataccttag

SEQ ID NO: 53719 - DNA, 18 bp, Artificial Sequence
  Synthetic DNA
aaagtcgtcccattttag

SEQ ID NO: 53720 - DNA, 18 bp, Artificial Sequence
  Synthetic DNA
aaagtctaccaataatag

SEQ ID NO: 53721 - DNA, 18 bp, Artificial Sequence
  Synthetic DNA
aaataaaaacggctctag

SEQ ID NO: 53722 - DNA, 18 bp, Artificial Sequence
  Synthetic DNA
aaataaaagtcactttag

SEQ ID NO: 53723 - DNA, 18 bp, Artificial Sequence
  Synthetic DNA
aaataaatgtctctatag

SEQ ID NO: 53724 - DNA, 18 bp, Artificial Sequence
  Synthetic DNA
aaataacaatatttgtcg

SEQ ID NO: 53725 - DNA, 18 bp, Artificial Sequence
  Synthetic DNA
aaataagaaactcacttg

SEQ ID NO: 53726 - DNA, 18 bp, Artificial Sequence
  Synthetic DNA
aaataagaattaatatag

SEQ ID NO: 53727 - DNA, 18 bp, Artificial Sequence
  Synthetic DNA
aaataagactcaatgatg

SEQ ID NO: 53728 - DNA, 18 bp, Artificial Sequence
  Synthetic DNA
aaataagatacattttag

SEQ ID NO: 53729 - DNA, 18 bp, Artificial Sequence
  Synthetic DNA
aaataaggcactctatag

SEQ ID NO: 53730 - DNA, 18 bp, Artificial Sequence
  Synthetic DNA
aaataaggcacttgatag

SEQ ID NO: 53731 - DNA, 18 bp, Artificial Sequence
  Synthetic DNA
aaataagtattactatag

SEQ ID NO: 53732 - DNA, 18 bp, Artificial Sequence
  Synthetic DNA
aaataagtgtcactgaag

SEQ ID NO: 53733 - DNA, 18 bp, Artificial Sequence
  Synthetic DNA
aaataatgctcagtatag

SEQ ID NO: 53734 - DNA, 18 bp, Artificial Sequence
  Synthetic DNA
aaataattcacactggag

SEQ ID NO: 53735 - DNA, 18 bp, Artificial Sequence
  Synthetic DNA
aaatacaaatcactaacg

SEQ ID NO: 53736 - DNA, 18 bp, Artificial Sequence
  Synthetic DNA
aaatacaactcacttccg

SEQ ID NO: 53737 - DNA, 18 bp, Artificial Sequence
  Synthetic DNA
aaatacaactggttttag

SEQ ID NO: 53738 - DNA, 18 bp, Artificial Sequence
  Synthetic DNA
aaatacaacttggtctgg

SEQ ID NO: 53739 - DNA, 18 bp, Artificial Sequence
  Synthetic DNA
aaatacaattctatatag

SEQ ID NO: 53740 - DNA, 18 bp, Artificial Sequence
  Synthetic DNA
aaatacacctcactactg

SEQ ID NO: 53741 - DNA, 18 bp, Artificial Sequence
  Synthetic DNA
aaatacatatctctatag

SEQ ID NO: 53742 - DNA, 18 bp, Artificial Sequence
  Synthetic DNA
aaatacatctaaaagtag

SEQ ID NO: 53743 - DNA, 18 bp, Artificial Sequence
  Synthetic DNA
aaatacatctcacgttag

SEQ ID NO: 53744 - DNA, 18 bp, Artificial Sequence
  Synthetic DNA
aaatacatcttaaaatgg

SEQ ID NO: 53745 - DNA, 18 bp, Artificial Sequence
  Synthetic DNA
aaatacatgtctccttag

SEQ ID NO: 53746 - DNA, 18 bp, Artificial Sequence
  Synthetic DNA
aaatacattccgcaatag

SEQ ID NO: 53747 - DNA, 18 bp, Artificial Sequence
  Synthetic DNA
aaataccaatcactgaag

SEQ ID NO: 53748 - DNA, 18 bp, Artificial Sequence
  Synthetic DNA
aaataccactcgctaatg

SEQ ID NO: 53749 - DNA, 18 bp, Artificial Sequence
  Synthetic DNA
aaataccactctccatcg

SEQ ID NO: 53750 - DNA, 18 bp, Artificial Sequence
  Synthetic DNA
aaataccactgacctttg

SEQ ID NO: 53751 - DNA, 18 bp, Artificial Sequence
  Synthetic DNA
aaataccacttatgtttg

SEQ ID NO: 53752 - DNA, 18 bp, Artificial Sequence
  Synthetic DNA
aaatacgaatctctcttg

SEQ ID NO: 53753 - DNA, 18 bp, Artificial Sequence
  Synthetic DNA
aaatacgaattacgaaag

SEQ ID NO: 53754 - DNA, 18 bp, Artificial Sequence
  Synthetic DNA
aaatacgacacaatgttg

SEQ ID NO: 53755 - DNA, 18 bp, Artificial Sequence
  Synthetic DNA
aaatacgacacactgatg

SEQ ID NO: 53756 - DNA, 18 bp, Artificial Sequence
  Synthetic DNA
aaatacgacactatattg

SEQ ID NO: 53757 - DNA, 18 bp, Artificial Sequence
  Synthetic DNA
aaatacgacgtaatctag

SEQ ID NO: 53758 - DNA, 18 bp, Artificial Sequence
  Synthetic DNA
aaatacgactcaaatcgg

SEQ ID NO: 53759 - DNA, 18 bp, Artificial Sequence
  Synthetic DNA
aaatacgactcgctcatg

SEQ ID NO: 53760 - DNA, 18 bp, Artificial Sequence
  Synthetic DNA
aaatacgagcatctatag

SEQ ID NO: 53761 - DNA, 18 bp, Artificial Sequence
  Synthetic DNA
aaatacgagtacaaattg

SEQ ID NO: 53762 - DNA, 18 bp, Artificial Sequence
  Synthetic DNA
aaatacgagttaaaattg

SEQ ID NO: 53763 - DNA, 18 bp, Artificial Sequence
  Synthetic DNA
aaatacgatagactaaag

SEQ ID NO: 53764 - DNA, 18 bp, Artificial Sequence
  Synthetic DNA
aaatacgattaacgttag

SEQ ID NO: 53765 - DNA, 18 bp, Artificial Sequence
  Synthetic DNA
aaatacgcaacacatttg

SEQ ID NO: 53766 - DNA, 18 bp, Artificial Sequence
  Synthetic DNA
aaatacgccactcactag

SEQ ID NO: 53767 - DNA, 18 bp, Artificial Sequence
  Synthetic DNA
aaatacgcctctacatag

SEQ ID NO: 53768 - DNA, 18 bp, Artificial Sequence
  Synthetic DNA
aaatacgcctctcaatgg

SEQ ID NO: 53769 - DNA, 18 bp, Artificial Sequence
  Synthetic DNA
aaatacgcctctgtaaag

SEQ ID NO: 53770 - DNA, 18 bp, Artificial Sequence
  Synthetic DNA
aaatacgcctctttaaag

SEQ ID NO: 53771 - DNA, 18 bp, Artificial Sequence
  Synthetic DNA
aaatacggcacacctaag

SEQ ID NO: 53772 - DNA, 18 bp, Artificial Sequence
  Synthetic DNA
aaatacggcacacttttg

SEQ ID NO: 53773 - DNA, 18 bp, Artificial Sequence
  Synthetic DNA
aaatacggctcccaagcg

SEQ ID NO: 53774 - DNA, 18 bp, Artificial Sequence
  Synthetic DNA
aaatacggttcaggacag

SEQ ID NO: 53775 - DNA, 18 bp, Artificial Sequence
  Synthetic DNA
aaatacggttcgctacag

SEQ ID NO: 53776 - DNA, 18 bp, Artificial Sequence
  Synthetic DNA
aaatacgtatcgcaattg

SEQ ID NO: 53777 - DNA, 18 bp, Artificial Sequence
  Synthetic DNA
aaatacgtctaacatttg

SEQ ID NO: 53778 - DNA, 18 bp, Artificial Sequence
  Synthetic DNA
aaatacgtctcgttttag

SEQ ID NO: 53779 - DNA, 18 bp, Artificial Sequence
  Synthetic DNA
aaatacgtctgacattag

SEQ ID NO: 53780 - DNA, 18 bp, Artificial Sequence
  Synthetic DNA
aaatacgtcttattttag

SEQ ID NO: 53781 - DNA, 18 bp, Artificial Sequence
  Synthetic DNA
aaatacgtctttctcaag

SEQ ID NO: 53782 - DNA, 18 bp, Artificial Sequence
  Synthetic DNA
aaatactacatacaatag

SEQ ID NO: 53783 - DNA, 18 bp, Artificial Sequence
  Synthetic DNA
aaatactacatcttatag

SEQ ID NO: 53784 - DNA, 18 bp, Artificial Sequence
  Synthetic DNA
aaatactactcaataacg

SEQ ID NO: 53785 - DNA, 18 bp, Artificial Sequence
  Synthetic DNA
aaatactgccgcgtttag

SEQ ID NO: 53786 - DNA, 18 bp, Artificial Sequence
  Synthetic DNA
aaatacttcacagtttag

SEQ ID NO: 53787 - DNA, 18 bp, Artificial Sequence
  Synthetic DNA
aaatacttctcaatctcg

SEQ ID NO: 53788 - DNA, 18 bp, Artificial Sequence
  Synthetic DNA
aaataggacccattctag

SEQ ID NO: 53789 - DNA, 18 bp, Artificial Sequence
  Synthetic DNA
aaataggacgtcctatag

SEQ ID NO: 53790 - DNA, 18 bp, Artificial Sequence
  Synthetic DNA
aaataggtttaacttaag

SEQ ID NO: 53791 - DNA, 18 bp, Artificial Sequence
  Synthetic DNA
aaatataacccactatgg

SEQ ID NO: 53792 - DNA, 18 bp, Artificial Sequence
  Synthetic DNA
aaatataactcaaaatag

SEQ ID NO: 53793 - DNA, 18 bp, Artificial Sequence
  Synthetic DNA
aaatataattcactttag

SEQ ID NO: 53794 - DNA, 18 bp, Artificial Sequence
  Synthetic DNA
aaatatcacacactttag

SEQ ID NO: 53795 - DNA, 18 bp, Artificial Sequence
  Synthetic DNA
aaatatgacactcaatag

SEQ ID NO: 53796 - DNA, 18 bp, Artificial Sequence
  Synthetic DNA
aaatatgacactctgtag

SEQ ID NO: 53797 - DNA, 18 bp, Artificial Sequence
  Synthetic DNA
aaatatgacgtgctttag

SEQ ID NO: 53798 - DNA, 18 bp, Artificial Sequence
  Synthetic DNA
aaatatgagacactgtag

SEQ ID NO: 53799 - DNA, 18 bp, Artificial Sequence
  Synthetic DNA
aaatatgagtcccttaag

SEQ ID NO: 53800 - DNA, 18 bp, Artificial Sequence
  Synthetic DNA
aaatatgagtgattctag

SEQ ID NO: 53801 - DNA, 18 bp, Artificial Sequence
  Synthetic DNA
aaatatgatccactctag

SEQ ID NO: 53802 - DNA, 18 bp, Artificial Sequence
  Synthetic DNA
aaatatgattcactttgg

SEQ ID NO: 53803 - DNA, 18 bp, Artificial Sequence
  Synthetic DNA
aaatatgcctcactgtgg

SEQ ID NO: 53804 - DNA, 18 bp, Artificial Sequence
  Synthetic DNA
aaatatggatcacattag

SEQ ID NO: 53805 - DNA, 18 bp, Artificial Sequence
  Synthetic DNA
aaatatgtctcacttttg

SEQ ID NO: 53806 - DNA, 18 bp, Artificial Sequence
  Synthetic DNA
aaatatgtttcactcaag

SEQ ID NO: 53807 - DNA, 18 bp, Artificial Sequence
  Synthetic DNA
aaatatttcgcactttag

SEQ ID NO: 53808 - DNA, 18 bp, Artificial Sequence
  Synthetic DNA
aaatccgattcaacatag

SEQ ID NO: 53809 - DNA, 18 bp, Artificial Sequence
  Synthetic DNA
aaatccgcctctttaatg

SEQ ID NO: 53810 - DNA, 18 bp, Artificial Sequence
  Synthetic DNA
aaatcctactcactaacg

SEQ ID NO: 53811 - DNA, 18 bp, Artificial Sequence
  Synthetic DNA
aaatccttctcactaaag

SEQ ID NO: 53812 - DNA, 18 bp, Artificial Sequence
  Synthetic DNA
aaatctgcctccctaaag

SEQ ID NO: 53813 - DNA, 18 bp, Artificial Sequence
  Synthetic DNA
aaatgcattctactatag

SEQ ID NO: 53814 - DNA, 18 bp, Artificial Sequence
  Synthetic DNA
aaatgccagttactaaag

SEQ ID NO: 53815 - DNA, 18 bp, Artificial Sequence
  Synthetic DNA
aaatgcgaaccactactg

SEQ ID NO: 53816 - DNA, 18 bp, Artificial Sequence
  Synthetic DNA
aaatgcgacacataatag

SEQ ID NO: 53817 - DNA, 18 bp, Artificial Sequence
  Synthetic DNA
aaatgcgattgactttag

SEQ ID NO: 53818 - DNA, 18 bp, Artificial Sequence
  Synthetic DNA
aaatgcgtctccctctag

SEQ ID NO: 53819 - DNA, 18 bp, Artificial Sequence
  Synthetic DNA
aaattagacccaccaaag

SEQ ID NO: 53820 - DNA, 18 bp, Artificial Sequence
  Synthetic DNA
aaattagactgactatgg

SEQ ID NO: 53821 - DNA, 18 bp, Artificial Sequence
  Synthetic DNA
aaattatactcacgttag

SEQ ID NO: 53822 - DNA, 18 bp, Artificial Sequence
  Synthetic DNA
aaattattcttacttttg

SEQ ID NO: 53823 - DNA, 18 bp, Artificial Sequence
  Synthetic DNA
aaattcaacaatctattg

SEQ ID NO: 53824 - DNA, 18 bp, Artificial Sequence
  Synthetic DNA
aaattcaactcatcaaag

SEQ ID NO: 53825 - DNA, 18 bp, Artificial Sequence
  Synthetic DNA
aaattcatatcgctattg

SEQ ID NO: 53826 - DNA, 18 bp, Artificial Sequence
  Synthetic DNA
aaattcgaatgactaatg

SEQ ID NO: 53827 - DNA, 18 bp, Artificial Sequence
  Synthetic DNA
aaattcgacatattattg

SEQ ID NO: 53828 - DNA, 18 bp, Artificial Sequence
  Synthetic DNA
aaattcgacccacatttg

SEQ ID NO: 53829 - DNA, 18 bp, Artificial Sequence
  Synthetic DNA
aaattcgacccacttagg

SEQ ID NO: 53830 - DNA, 18 bp, Artificial Sequence
  Synthetic DNA
aaattcgactcagattag

SEQ ID NO: 53831 - DNA, 18 bp, Artificial Sequence
  Synthetic DNA
aaattcgactcttgattg

SEQ ID NO: 53832 - DNA, 18 bp, Artificial Sequence
  Synthetic DNA
aaattcgcatcgctaaag

SEQ ID NO: 53833 - DNA, 18 bp, Artificial Sequence
  Synthetic DNA
aaattcgctattgcatag

SEQ ID NO: 53834 - DNA, 18 bp, Artificial Sequence
  Synthetic DNA
aaattcgcttcgcttgag

SEQ ID NO: 53835 - DNA, 18 bp, Artificial Sequence
  Synthetic DNA
aaattcgtcacactttag

SEQ ID NO: 53836 - DNA, 18 bp, Artificial Sequence
  Synthetic DNA
aaattcgtgacactatag

SEQ ID NO: 53837 - DNA, 18 bp, Artificial Sequence
  Synthetic DNA
aaattctacccaatatag

SEQ ID NO: 53838 - DNA, 18 bp, Artificial Sequence
  Synthetic DNA
aaattctatacattctgg

SEQ ID NO: 53839 - DNA, 18 bp, Artificial Sequence
  Synthetic DNA
aaattctcctcacaatag

SEQ ID NO: 53840 - DNA, 18 bp, Artificial Sequence
  Synthetic DNA
aaattctcttcataatag

SEQ ID NO: 53841 - DNA, 18 bp, Artificial Sequence
  Synthetic DNA
aaattggactcgcaatag

SEQ ID NO: 53842 - DNA, 18 bp, Artificial Sequence
  Synthetic DNA
aaattggagtatccatcg

SEQ ID NO: 53843 - DNA, 18 bp, Artificial Sequence
  Synthetic DNA
aaatttatctcactagag

SEQ ID NO: 53844 - DNA, 18 bp, Artificial Sequence
  Synthetic DNA
aaatttgagaacttaaag

SEQ ID NO: 53845 - DNA, 18 bp, Artificial Sequence
  Synthetic DNA
aaatttgcctcactaaag

SEQ ID NO: 53846 - DNA, 18 bp, Artificial Sequence
  Synthetic DNA
aacaaagccgtactataa

SEQ ID NO: 53847 - DNA, 18 bp, Artificial Sequence
  Synthetic DNA
aacaaccgtacttaatag

SEQ ID NO: 53848 - DNA, 18 bp, Artificial Sequence
  Synthetic DNA
aaccacgtctgactgtag

SEQ ID NO: 53849 - DNA, 18 bp, Artificial Sequence
  Synthetic DNA
aaccactactcactatgg

SEQ ID NO: 53850 - DNA, 18 bp, Artificial Sequence
  Synthetic DNA
aaccaggacccactattg

SEQ ID NO: 53851 - DNA, 18 bp, Artificial Sequence
  Synthetic DNA
aacctggactgtttattg

SEQ ID NO: 53852 - DNA, 18 bp, Artificial Sequence
  Synthetic DNA
aacggtgactcactatag

SEQ ID NO: 53853 - DNA, 18 bp, Artificial Sequence
  Synthetic DNA
aactaagactcgatattg

SEQ ID NO: 53854 - DNA, 18 bp, Artificial Sequence
  Synthetic DNA
aactaagccccaccatag

SEQ ID NO: 53855 - DNA, 18 bp, Artificial Sequence
  Synthetic DNA
aactacatttatccgtag

SEQ ID NO: 53856 - DNA, 18 bp, Artificial Sequence
  Synthetic DNA
aactacgcctcaataatg

SEQ ID NO: 53857 - DNA, 18 bp, Artificial Sequence
  Synthetic DNA
aacttagacattttctag

SEQ ID NO: 53858 - DNA, 18 bp, Artificial Sequence
  Synthetic DNA
aacttcgactccctattg

SEQ ID NO: 53859 - DNA, 18 bp, Artificial Sequence
  Synthetic DNA
aacttcgcctcacttctg

SEQ ID NO: 53860 - DNA, 18 bp, Artificial Sequence
  Synthetic DNA
aacttcgtctcagaatag

SEQ ID NO: 53861 - DNA, 18 bp, Artificial Sequence
  Synthetic DNA
aacttggacttacttttg

SEQ ID NO: 53862 - DNA, 18 bp, Artificial Sequence
  Synthetic DNA
aactttgacacactagag

SEQ ID NO: 53863 - DNA, 18 bp, Artificial Sequence
  Synthetic DNA
aagaacgacttactattg

SEQ ID NO: 53864 - DNA, 18 bp, Artificial Sequence
  Synthetic DNA
aagatcgattccatatag

SEQ ID NO: 53865 - DNA, 18 bp, Artificial Sequence
  Synthetic DNA
aagcacaacatagcatag

SEQ ID NO: 53866 - DNA, 18 bp, Artificial Sequence
  Synthetic DNA
aagcattactaactatag

SEQ ID NO: 53867 - DNA, 18 bp, Artificial Sequence
  Synthetic DNA
aaggacgattaacaatgg

SEQ ID NO: 53868 - DNA, 18 bp, Artificial Sequence
  Synthetic DNA
aaggtcgattcaccatag

SEQ ID NO: 53869 - DNA, 18 bp, Artificial Sequence
  Synthetic DNA
aagtaatacacactaaag

SEQ ID NO: 53870 - DNA, 18 bp, Artificial Sequence
  Synthetic DNA
aagtacaactcacactag

SEQ ID NO: 53871 - DNA, 18 bp, Artificial Sequence
  Synthetic DNA
aagtacaactcttgatag

SEQ ID NO: 53872 - DNA, 18 bp, Artificial Sequence
  Synthetic DNA
aagtacatcacattatag

SEQ ID NO: 53873 - DNA, 18 bp, Artificial Sequence
  Synthetic DNA
aagtacgacttcctaagg

SEQ ID NO: 53874 - DNA, 18 bp, Artificial Sequence
  Synthetic DNA
aagtacgtataacgatag

SEQ ID NO: 53875 - DNA, 18 bp, Artificial Sequence
  Synthetic DNA
aagtacttggcacaatag

SEQ ID NO: 53876 - DNA, 18 bp, Artificial Sequence
  Synthetic DNA
aagtaggacactctatag

SEQ ID NO: 53877 - DNA, 18 bp, Artificial Sequence
  Synthetic DNA
aagtaggactctctattg

SEQ ID NO: 53878 - DNA, 18 bp, Artificial Sequence
  Synthetic DNA
aagtatgtcactcaatag

SEQ ID NO: 53879 - DNA, 18 bp, Artificial Sequence
  Synthetic DNA
aagtatttctcaaaatag

SEQ ID NO: 53880 - DNA, 18 bp, Artificial Sequence
  Synthetic DNA
aagttcgattcactgtag

SEQ ID NO: 53881 - DNA, 18 bp, Artificial Sequence
  Synthetic DNA
aataaaaacttacataag

SEQ ID NO: 53882 - DNA, 18 bp, Artificial Sequence
  Synthetic DNA
aataacgacacactattg

SEQ ID NO: 53883 - DNA, 18 bp, Artificial Sequence
  Synthetic DNA
aataacgactcataacag

SEQ ID NO: 53884 - DNA, 18 bp, Artificial Sequence
  Synthetic DNA
aataacgactcgcaatag

SEQ ID NO: 53885 - DNA, 18 bp, Artificial Sequence
  Synthetic DNA
aataacgtcacacttaag

SEQ ID NO: 53886 - DNA, 18 bp, Artificial Sequence
  Synthetic DNA
aataatgaatctccaaag

SEQ ID NO: 53887 - DNA, 18 bp, Artificial Sequence
  Synthetic DNA
aatataatctcactaaag

SEQ ID NO: 53888 - DNA, 18 bp, Artificial Sequence
  Synthetic DNA
aatcacgatttactctag

SEQ ID NO: 53889 - DNA, 18 bp, Artificial Sequence
  Synthetic DNA
aatcacgtctacctattg

SEQ ID NO: 53890 - DNA, 18 bp, Artificial Sequence
  Synthetic DNA
aatcattactttctaaag

SEQ ID NO: 53891 - DNA, 18 bp, Artificial Sequence
  Synthetic DNA
aatctcgtctcattacag

SEQ ID NO: 53892 - DNA, 18 bp, Artificial Sequence
  Synthetic DNA
aatgaagttttagaattg

SEQ ID NO: 53893 - DNA, 18 bp, Artificial Sequence
  Synthetic DNA
aatgacctcgcactatag

SEQ ID NO: 53894 - DNA, 18 bp, Artificial Sequence
  Synthetic DNA
aatgacctcttattctag

SEQ ID NO: 53895 - DNA, 18 bp, Artificial Sequence
  Synthetic DNA
aatggcgactcactttag

SEQ ID NO: 53896 - DNA, 18 bp, Artificial Sequence
  Synthetic DNA
aattaaaactaacaatag

SEQ ID NO: 53897 - DNA, 18 bp, Artificial Sequence
  Synthetic DNA
aattaaaactcactgtag

SEQ ID NO: 53898 - DNA, 18 bp, Artificial Sequence
  Synthetic DNA
aattaaaccttactttgg

SEQ ID NO: 53899 - DNA, 18 bp, Artificial Sequence
  Synthetic DNA
aattaacactcacttgag

SEQ ID NO: 53900 - DNA, 18 bp, Artificial Sequence
  Synthetic DNA
aattaacgctagctatag

SEQ ID NO: 53901 - DNA, 18 bp, Artificial Sequence
  Synthetic DNA
aattaagaaccaatatag

SEQ ID NO: 53902 - DNA, 18 bp, Artificial Sequence
  Synthetic DNA
aattaagacacactctag

SEQ ID NO: 53903 - DNA, 18 bp, Artificial Sequence
  Synthetic DNA
aattacaacatactgaag

SEQ ID NO: 53904 - DNA, 18 bp, Artificial Sequence
  Synthetic DNA
aattacagcacactattg

SEQ ID NO: 53905 - DNA, 18 bp, Artificial Sequence
  Synthetic DNA
aattacatttcacaattg

SEQ ID NO: 53906 - DNA, 18 bp, Artificial Sequence
  Synthetic DNA
aattaccaatctctatag

SEQ ID NO: 53907 - DNA, 18 bp, Artificial Sequence
  Synthetic DNA
aattacctctgtatatcg

SEQ ID NO: 53908 - DNA, 18 bp, Artificial Sequence
  Synthetic DNA
aattacgaaccacgatag

SEQ ID NO: 53909 - DNA, 18 bp, Artificial Sequence
  Synthetic DNA
aattacgaatcaccaaag

SEQ ID NO: 53910 - DNA, 18 bp, Artificial Sequence
  Synthetic DNA
aattacgaattcaaatgg

SEQ ID NO: 53911 - DNA, 18 bp, Artificial Sequence
  Synthetic DNA
aattacgacactccatag

SEQ ID NO: 53912 - DNA, 18 bp, Artificial Sequence
  Synthetic DNA
aattacgacactctaaag

SEQ ID NO: 53913 - DNA, 18 bp, Artificial Sequence
  Synthetic DNA
aattacgactacctattg

SEQ ID NO: 53914 - DNA, 18 bp, Artificial Sequence
  Synthetic DNA
aattacgactagctaaag

SEQ ID NO: 53915 - DNA, 18 bp, Artificial Sequence
  Synthetic DNA
aattacgactctgcatcg

SEQ ID NO: 53916 - DNA, 18 bp, Artificial Sequence
  Synthetic DNA
aattacgcctctctaaag

SEQ ID NO: 53917 - DNA, 18 bp, Artificial Sequence
  Synthetic DNA
aattacggcaatctattg

SEQ ID NO: 53918 - DNA, 18 bp, Artificial Sequence
  Synthetic DNA
aattacggcacattatgg

SEQ ID NO: 53919 - DNA, 18 bp, Artificial Sequence
  Synthetic DNA
aattacgtaacgcgttag

SEQ ID NO: 53920 - DNA, 18 bp, Artificial Sequence
  Synthetic DNA
aattacgtattactattg

SEQ ID NO: 53921 - DNA, 18 bp, Artificial Sequence
  Synthetic DNA
aattacgtttcactaaag

SEQ ID NO: 53922 - DNA, 18 bp, Artificial Sequence
  Synthetic DNA
aattactacccacctttg

SEQ ID NO: 53923 - DNA, 18 bp, Artificial Sequence
  Synthetic DNA
aattactattccttcttg

SEQ ID NO: 53924 - DNA, 18 bp, Artificial Sequence
  Synthetic DNA
aattactgctctaaatag

SEQ ID NO: 53925 - DNA, 18 bp, Artificial Sequence
  Synthetic DNA
aattaggactccccatag

SEQ ID NO: 53926 - DNA, 18 bp, Artificial Sequence
  Synthetic DNA
aattatgacacacaatag

SEQ ID NO: 53927 - DNA, 18 bp, Artificial Sequence
  Synthetic DNA
aattatgactctttatag

SEQ ID NO: 53928 - DNA, 18 bp, Artificial Sequence
  Synthetic DNA
aattatgtctcagtatag

SEQ ID NO: 53929 - DNA, 18 bp, Artificial Sequence
  Synthetic DNA
aattcagactctctatag

SEQ ID NO: 53930 - DNA, 18 bp, Artificial Sequence
  Synthetic DNA
aattccaattcgttatag

SEQ ID NO: 53931 - DNA, 18 bp, Artificial Sequence
  Synthetic DNA
aattccgaatctctaatg

SEQ ID NO: 53932 - DNA, 18 bp, Artificial Sequence
  Synthetic DNA
aattccgattctcaatag

SEQ ID NO: 53933 - DNA, 18 bp, Artificial Sequence
  Synthetic DNA
aattgcgtctcccaatgg

SEQ ID NO: 53934 - DNA, 18 bp, Artificial Sequence
  Synthetic DNA
aatttagaatcacaatag

SEQ ID NO: 53935 - DNA, 18 bp, Artificial Sequence
  Synthetic DNA
aatttagacacactatag

SEQ ID NO: 53936 - DNA, 18 bp, Artificial Sequence
  Synthetic DNA
aatttagactcgctcaag

SEQ ID NO: 53937 - DNA, 18 bp, Artificial Sequence
  Synthetic DNA
aatttattaccactaaag

SEQ ID NO: 53938 - DNA, 18 bp, Artificial Sequence
  Synthetic DNA
aatttcatttctctgaag

SEQ ID NO: 53939 - DNA, 18 bp, Artificial Sequence
  Synthetic DNA
aatttccaatttctattg

SEQ ID NO: 53940 - DNA, 18 bp, Artificial Sequence
  Synthetic DNA
aatttcgacgcattatag

SEQ ID NO: 53941 - DNA, 18 bp, Artificial Sequence
  Synthetic DNA
aatttcgacgcattttag

SEQ ID NO: 53942 - DNA, 18 bp, Artificial Sequence
  Synthetic DNA
aatttcgactctctagag

SEQ ID NO: 53943 - DNA, 18 bp, Artificial Sequence
  Synthetic DNA
aatttcgattgactatag

SEQ ID NO: 53944 - DNA, 18 bp, Artificial Sequence
  Synthetic DNA
aatttcgctacaccagag

SEQ ID NO: 53945 - DNA, 18 bp, Artificial Sequence
  Synthetic DNA
aatttgctcacaataaag

SEQ ID NO: 53946 - DNA, 18 bp, Artificial Sequence
  Synthetic DNA
aatttggactcactaaag

SEQ ID NO: 53947 - DNA, 18 bp, Artificial Sequence
  Synthetic DNA
aattttgaatcagtatgg

SEQ ID NO: 53948 - DNA, 18 bp, Artificial Sequence
  Synthetic DNA
aattttgtaaccttatcg

SEQ ID NO: 53949 - DNA, 18 bp, Artificial Sequence
  Synthetic DNA
acaaaccacacacaaaag

SEQ ID NO: 53950 - DNA, 18 bp, Artificial Sequence
  Synthetic DNA
acaaacgaccccatattg

SEQ ID NO: 53951 - DNA, 18 bp, Artificial Sequence
  Synthetic DNA
acaaacgactctcaatag

SEQ ID NO: 53952 - DNA, 18 bp, Artificial Sequence
  Synthetic DNA
acactagacccactctag

SEQ ID NO: 53953 - DNA, 18 bp, Artificial Sequence
  Synthetic DNA
acactctactctctatag

SEQ ID NO: 53954 - DNA, 18 bp, Artificial Sequence
  Synthetic DNA
acagacgactatcttcag

SEQ ID NO: 53955 - DNA, 18 bp, Artificial Sequence
  Synthetic DNA
acataagaatctctatag

SEQ ID NO: 53956 - DNA, 18 bp, Artificial Sequence
  Synthetic DNA
acataagtctgactagag

SEQ ID NO: 53957 - DNA, 18 bp, Artificial Sequence
  Synthetic DNA
acataccagtgaccctag

SEQ ID NO: 53958 - DNA, 18 bp, Artificial Sequence
  Synthetic DNA
acatacgaatgttaacag

SEQ ID NO: 53959 - DNA, 18 bp, Artificial Sequence
  Synthetic DNA
acatacgacactctatgg

SEQ ID NO: 53960 - DNA, 18 bp, Artificial Sequence
  Synthetic DNA
acatacgactaatttaag

SEQ ID NO: 53961 - DNA, 18 bp, Artificial Sequence
  Synthetic DNA
acatacgactcaaattag

SEQ ID NO: 53962 - DNA, 18 bp, Artificial Sequence
  Synthetic DNA
acatacgactgatattag

SEQ ID NO: 53963 - DNA, 18 bp, Artificial Sequence
  Synthetic DNA
acatagaatactctatgg

SEQ ID NO: 53964 - DNA, 18 bp, Artificial Sequence
  Synthetic DNA
acatatctctaactaatg

SEQ ID NO: 53965 - DNA, 18 bp, Artificial Sequence
  Synthetic DNA
acatatgaataactatag

SEQ ID NO: 53966 - DNA, 18 bp, Artificial Sequence
  Synthetic DNA
acatatgcctctccatag

SEQ ID NO: 53967 - DNA, 18 bp, Artificial Sequence
  Synthetic DNA
acatccaactaaatacag

SEQ ID NO: 53968 - DNA, 18 bp, Artificial Sequence
  Synthetic DNA
acattcgtgtcactgttg

SEQ ID NO: 53969 - DNA, 18 bp, Artificial Sequence
  Synthetic DNA
acatttgccacactggag

SEQ ID NO: 53970 - DNA, 18 bp, Artificial Sequence
  Synthetic DNA
acctccgtcttactatgg

SEQ ID NO: 53971 - DNA, 18 bp, Artificial Sequence
  Synthetic DNA
acgaacgacagacaatag

SEQ ID NO: 53972 - DNA, 18 bp, Artificial Sequence
  Synthetic DNA
acgtacgacacaatatag

SEQ ID NO: 53973 - DNA, 18 bp, Artificial Sequence
  Synthetic DNA
acgtccgtctctttaatg

SEQ ID NO: 53974 - DNA, 18 bp, Artificial Sequence
  Synthetic DNA
actgacaacacactatag

SEQ ID NO: 53975 - DNA, 18 bp, Artificial Sequence
  Synthetic DNA
acttacgattaactatag

SEQ ID NO: 53976 - DNA, 18 bp, Artificial Sequence
  Synthetic DNA
acttatgactcactattg

SEQ ID NO: 53977 - DNA, 18 bp, Artificial Sequence
  Synthetic DNA
acttatgtctgactttag

SEQ ID NO: 53978 - DNA, 18 bp, Artificial Sequence
  Synthetic DNA
acttccgactcactgtcg

SEQ ID NO: 53979 - DNA, 18 bp, Artificial Sequence
  Synthetic DNA
acttttgacccacaacag

SEQ ID NO: 53980 - DNA, 18 bp, Artificial Sequence
  Synthetic DNA
agaaacgacactcattag

SEQ ID NO: 53981 - DNA, 18 bp, Artificial Sequence
  Synthetic DNA
agaaacgacccacctaag

SEQ ID NO: 53982 - DNA, 18 bp, Artificial Sequence
  Synthetic DNA
agaaaggacttactagag

SEQ ID NO: 53983 - DNA, 18 bp, Artificial Sequence
  Synthetic DNA
agaaataactaaatatag

SEQ ID NO: 53984 - DNA, 18 bp, Artificial Sequence
  Synthetic DNA
agaagcgactaactaaag

SEQ ID NO: 53985 - DNA, 18 bp, Artificial Sequence
  Synthetic DNA
agacacgatttaccttag

SEQ ID NO: 53986 - DNA, 18 bp, Artificial Sequence
  Synthetic DNA
agacacgtcggactatag

SEQ ID NO: 53987 - DNA, 18 bp, Artificial Sequence
  Synthetic DNA
agacacgtctcactaggg

SEQ ID NO: 53988 - DNA, 18 bp, Artificial Sequence
  Synthetic DNA
agatacaacaccctatag

SEQ ID NO: 53989 - DNA, 18 bp, Artificial Sequence
  Synthetic DNA
agatacacctattaactg

SEQ ID NO: 53990 - DNA, 18 bp, Artificial Sequence
  Synthetic DNA
agatacatcacaaattgg

SEQ ID NO: 53991 - DNA, 18 bp, Artificial Sequence
  Synthetic DNA
agatacgacatactccag

SEQ ID NO: 53992 - DNA, 18 bp, Artificial Sequence
  Synthetic DNA
agatacgactagctaaag

SEQ ID NO: 53993 - DNA, 18 bp, Artificial Sequence
  Synthetic DNA
agatacgacttgcaattg

SEQ ID NO: 53994 - DNA, 18 bp, Artificial Sequence
  Synthetic DNA
agatacgtccaactatag

SEQ ID NO: 53995 - DNA, 18 bp, Artificial Sequence
  Synthetic DNA
agatacgtctcttttaag

SEQ ID NO: 53996 - DNA, 18 bp, Artificial Sequence
  Synthetic DNA
agatatgacaatctatag

SEQ ID NO: 53997 - DNA, 18 bp, Artificial Sequence
  Synthetic DNA
agatatgtcttactatag

SEQ ID NO: 53998 - DNA, 18 bp, Artificial Sequence
  Synthetic DNA
agatcagattcactatag

SEQ ID NO: 53999 - DNA, 18 bp, Artificial Sequence
  Synthetic DNA
agatcatactcactatag

SEQ ID NO: 54000 - DNA, 18 bp, Artificial Sequence
  Synthetic DNA
agatgcgacttatttgag

SEQ ID NO: 54001 - DNA, 18 bp, Artificial Sequence
  Synthetic DNA
agattcgactcacttcag

SEQ ID NO: 54002 - DNA, 18 bp, Artificial Sequence
  Synthetic DNA
agattcgactccctattg

SEQ ID NO: 54003 - DNA, 18 bp, Artificial Sequence
  Synthetic DNA
agattcgactttttacag

SEQ ID NO: 54004 - DNA, 18 bp, Artificial Sequence
  Synthetic DNA
agattcgtcacactaaag

SEQ ID NO: 54005 - DNA, 18 bp, Artificial Sequence
  Synthetic DNA
agattgtacccacttaag

SEQ ID NO: 54006 - DNA, 18 bp, Artificial Sequence
  Synthetic DNA
agcaacgtctatcaatag

SEQ ID NO: 54007 - DNA, 18 bp, Artificial Sequence
  Synthetic DNA
agctatcactcactatag

SEQ ID NO: 54008 - DNA, 18 bp, Artificial Sequence
  Synthetic DNA
aggtacgtatagctaatg

SEQ ID NO: 54009 - DNA, 18 bp, Artificial Sequence
  Synthetic DNA
agtaacgcctcactttag

SEQ ID NO: 54010 - DNA, 18 bp, Artificial Sequence
  Synthetic DNA
agtgatgactcactatag

SEQ ID NO: 54011 - DNA, 18 bp, Artificial Sequence
  Synthetic DNA
agtttcggctttctatag

SEQ ID NO: 54012 - DNA, 18 bp, Artificial Sequence
  Synthetic DNA
ataaaagtctaactccag

SEQ ID NO: 54013 - DNA, 18 bp, Artificial Sequence
  Synthetic DNA
ataaacgactctttttag

SEQ ID NO: 54014 - DNA, 18 bp, Artificial Sequence
  Synthetic DNA
ataaacgacttactacag

SEQ ID NO: 54015 - DNA, 18 bp, Artificial Sequence
  Synthetic DNA
ataaacgattaattgttg

SEQ ID NO: 54016 - DNA, 18 bp, Artificial Sequence
  Synthetic DNA
ataaacgattctctatgg

SEQ ID NO: 54017 - DNA, 18 bp, Artificial Sequence
  Synthetic DNA
ataaacgatttactatcg

SEQ ID NO: 54018 - DNA, 18 bp, Artificial Sequence
  Synthetic DNA
ataaacgatttagtatag

SEQ ID NO: 54019 - DNA, 18 bp, Artificial Sequence
  Synthetic DNA
ataaacggctaactcaag

SEQ ID NO: 54020 - DNA, 18 bp, Artificial Sequence
  Synthetic DNA
ataaactacaaactatcg

SEQ ID NO: 54021 - DNA, 18 bp, Artificial Sequence
  Synthetic DNA
ataaactacctactaaag

SEQ ID NO: 54022 - DNA, 18 bp, Artificial Sequence
  Synthetic DNA
ataaactcctctccatag

SEQ ID NO: 54023 - DNA, 18 bp, Artificial Sequence
  Synthetic DNA
ataaaggactctgtatag

SEQ ID NO: 54024 - DNA, 18 bp, Artificial Sequence
  Synthetic DNA
ataaatggctcactatag

SEQ ID NO: 54025 - DNA, 18 bp, Artificial Sequence
  Synthetic DNA
ataagcgacacactttag

SEQ ID NO: 54026 - DNA, 18 bp, Artificial Sequence
  Synthetic DNA
ataatagactcacttttg

SEQ ID NO: 54027 - DNA, 18 bp, Artificial Sequence
  Synthetic DNA
ataatatactccctatag

SEQ ID NO: 54028 - DNA, 18 bp, Artificial Sequence
  Synthetic DNA
ataatattctcgctatag

SEQ ID NO: 54029 - DNA, 18 bp, Artificial Sequence
  Synthetic DNA
ataatcgactttctatag

SEQ ID NO: 54030 - DNA, 18 bp, Artificial Sequence
  Synthetic DNA
ataatcgcctcactaaag

SEQ ID NO: 54031 - DNA, 18 bp, Artificial Sequence
  Synthetic DNA
ataatcgtctccttaaag

SEQ ID NO: 54032 - DNA, 18 bp, Artificial Sequence
  Synthetic DNA
atacacaattttctatag

SEQ ID NO: 54033 - DNA, 18 bp, Artificial Sequence
  Synthetic DNA
atacacaccactttattg

SEQ ID NO: 54034 - DNA, 18 bp, Artificial Sequence
  Synthetic DNA
atacacatctaactttag

SEQ ID NO: 54035 - DNA, 18 bp, Artificial Sequence
  Synthetic DNA
atacacgactaattaaaa

SEQ ID NO: 54036 - DNA, 18 bp, Artificial Sequence
  Synthetic DNA
atacacgactgtctaaag

SEQ ID NO: 54037 - DNA, 18 bp, Artificial Sequence
  Synthetic DNA
atacacgacttactattg

SEQ ID NO: 54038 - DNA, 18 bp, Artificial Sequence
  Synthetic DNA
atacacgtttggttatgg

SEQ ID NO: 54039 - DNA, 18 bp, Artificial Sequence
  Synthetic DNA
atacactgctcactaagg

SEQ ID NO: 54040 - DNA, 18 bp, Artificial Sequence
  Synthetic DNA
atacatgacttgcttttg

SEQ ID NO: 54041 - DNA, 18 bp, Artificial Sequence
  Synthetic DNA
atacgcgacacataatag

SEQ ID NO: 54042 - DNA, 18 bp, Artificial Sequence
  Synthetic DNA
atactcgactcactaaag

SEQ ID NO: 54043 - DNA, 18 bp, Artificial Sequence
  Synthetic DNA
atagatgacccactgtcg

SEQ ID NO: 54044 - DNA, 18 bp, Artificial Sequence
  Synthetic DNA
ataggcgactcactaaag

SEQ ID NO: 54045 - DNA, 18 bp, Artificial Sequence
  Synthetic DNA
atagtcgaacctcttaag

SEQ ID NO: 54046 - DNA, 18 bp, Artificial Sequence
  Synthetic DNA
atataagaatcattatag

SEQ ID NO: 54047 - DNA, 18 bp, Artificial Sequence
  Synthetic DNA
atataagactcactaatg

SEQ ID NO: 54048 - DNA, 18 bp, Artificial Sequence
  Synthetic DNA
atataagacttgctaaag

SEQ ID NO: 54049 - DNA, 18 bp, Artificial Sequence
  Synthetic DNA
atataagcctcattatcg

SEQ ID NO: 54050 - DNA, 18 bp, Artificial Sequence
  Synthetic DNA
atataatcctctcattag

SEQ ID NO: 54051 - DNA, 18 bp, Artificial Sequence
  Synthetic DNA
atataatgctgacaatag

SEQ ID NO: 54052 - DNA, 18 bp, Artificial Sequence
  Synthetic DNA
atatacaacacttaaaag

SEQ ID NO: 54053 - DNA, 18 bp, Artificial Sequence
  Synthetic DNA
atatacaacgcacgatag

SEQ ID NO: 54054 - DNA, 18 bp, Artificial Sequence
  Synthetic DNA
atatacaactaactattg

SEQ ID NO: 54055 - DNA, 18 bp, Artificial Sequence
  Synthetic DNA
atatacaacttgctatcg

SEQ ID NO: 54056 - DNA, 18 bp, Artificial Sequence
  Synthetic DNA
atatacaatttactatag

SEQ ID NO: 54057 - DNA, 18 bp, Artificial Sequence
  Synthetic DNA
atataccacgtactatag

SEQ ID NO: 54058 - DNA, 18 bp, Artificial Sequence
  Synthetic DNA
atataccactctatgtag

SEQ ID NO: 54059 - DNA, 18 bp, Artificial Sequence
  Synthetic DNA
atataccgctagctttag

SEQ ID NO: 54060 - DNA, 18 bp, Artificial Sequence
  Synthetic DNA
atatacgacacacaaccg

SEQ ID NO: 54061 - DNA, 18 bp, Artificial Sequence
  Synthetic DNA
atatacgacacactagtg

SEQ ID NO: 54062 - DNA, 18 bp, Artificial Sequence
  Synthetic DNA
atatacgacattcaaaag

SEQ ID NO: 54063 - DNA, 18 bp, Artificial Sequence
  Synthetic DNA
atatacgacccagaatag

SEQ ID NO: 54064 - DNA, 18 bp, Artificial Sequence
  Synthetic DNA
atatacgagtcaataaag

SEQ ID NO: 54065 - DNA, 18 bp, Artificial Sequence
  Synthetic DNA
atatacgatacacaacag

SEQ ID NO: 54066 - DNA, 18 bp, Artificial Sequence
  Synthetic DNA
atatacgccacacgtaag

SEQ ID NO: 54067 - DNA, 18 bp, Artificial Sequence
  Synthetic DNA
atatacgccacactatgg

SEQ ID NO: 54068 - DNA, 18 bp, Artificial Sequence
  Synthetic DNA
atatacggctcacatttg

SEQ ID NO: 54069 - DNA, 18 bp, Artificial Sequence
  Synthetic DNA
atatacgtcacaccatgg

SEQ ID NO: 54070 - DNA, 18 bp, Artificial Sequence
  Synthetic DNA
atatacgtcccactacag

SEQ ID NO: 54071 - DNA, 18 bp, Artificial Sequence
  Synthetic DNA
atatacgtctctataaag

SEQ ID NO: 54072 - DNA, 18 bp, Artificial Sequence
  Synthetic DNA
atatacgttacaacatag

SEQ ID NO: 54073 - DNA, 18 bp, Artificial Sequence
  Synthetic DNA
atatacgtttctttaaag

SEQ ID NO: 54074 - DNA, 18 bp, Artificial Sequence
  Synthetic DNA
atatactaatctctaaag

SEQ ID NO: 54075 - DNA, 18 bp, Artificial Sequence
  Synthetic DNA
atatactacgaactattg

SEQ ID NO: 54076 - DNA, 18 bp, Artificial Sequence
  Synthetic DNA
atatactactcatagtag

SEQ ID NO: 54077 - DNA, 18 bp, Artificial Sequence
  Synthetic DNA
atatacttctctctaaag

SEQ ID NO: 54078 - DNA, 18 bp, Artificial Sequence
  Synthetic DNA
atatagaattccctattg

SEQ ID NO: 54079 - DNA, 18 bp, Artificial Sequence
  Synthetic DNA
atatagcacccactgtcg

SEQ ID NO: 54080 - DNA, 18 bp, Artificial Sequence
  Synthetic DNA
atataggacactctatag

SEQ ID NO: 54081 - DNA, 18 bp, Artificial Sequence
  Synthetic DNA
atataggacataatatag

SEQ ID NO: 54082 - DNA, 18 bp, Artificial Sequence
  Synthetic DNA
atataggacccagtatag

SEQ ID NO: 54083 - DNA, 18 bp, Artificial Sequence
  Synthetic DNA
atataggtctcactaaag

SEQ ID NO: 54084 - DNA, 18 bp, Artificial Sequence
  Synthetic DNA
atatagttctcattattg

SEQ ID NO: 54085 - DNA, 18 bp, Artificial Sequence
  Synthetic DNA
atatatgacaaactgttg

SEQ ID NO: 54086 - DNA, 18 bp, Artificial Sequence
  Synthetic DNA
atatatgatacacaatag

SEQ ID NO: 54087 - DNA, 18 bp, Artificial Sequence
  Synthetic DNA
atatatgcctcacaccag

SEQ ID NO: 54088 - DNA, 18 bp, Artificial Sequence
  Synthetic DNA
atatattattcactttag

SEQ ID NO: 54089 - DNA, 18 bp, Artificial Sequence
  Synthetic DNA
atatcagactcactatgg

SEQ ID NO: 54090 - DNA, 18 bp, Artificial Sequence
  Synthetic DNA
atatccaactcactaaag

SEQ ID NO: 54091 - DNA, 18 bp, Artificial Sequence
  Synthetic DNA
atatccaactcactacag

SEQ ID NO: 54092 - DNA, 18 bp, Artificial Sequence
  Synthetic DNA
atatccggcacactcttg

SEQ ID NO: 54093 - DNA, 18 bp, Artificial Sequence
  Synthetic DNA
atatcctaccgacaatag

SEQ ID NO: 54094 - DNA, 18 bp, Artificial Sequence
  Synthetic DNA
atatgagccacactgtag

SEQ ID NO: 54095 - DNA, 18 bp, Artificial Sequence
  Synthetic DNA
atatgataatcattattg

SEQ ID NO: 54096 - DNA, 18 bp, Artificial Sequence
  Synthetic DNA
atatgcgaatcactttag

SEQ ID NO: 54097 - DNA, 18 bp, Artificial Sequence
  Synthetic DNA
atatgcgcctcacaatag

SEQ ID NO: 54098 - DNA, 18 bp, Artificial Sequence
  Synthetic DNA
atattaaagacatgaaag

SEQ ID NO: 54099 - DNA, 18 bp, Artificial Sequence
  Synthetic DNA
atattataatcactatag

SEQ ID NO: 54100 - DNA, 18 bp, Artificial Sequence
  Synthetic DNA
atattcaactctttatag

SEQ ID NO: 54101 - DNA, 18 bp, Artificial Sequence
  Synthetic DNA
atattcgactcaataaag

SEQ ID NO: 54102 - DNA, 18 bp, Artificial Sequence
  Synthetic DNA
atattcgacttattaccg

SEQ ID NO: 54103 - DNA, 18 bp, Artificial Sequence
  Synthetic DNA
atattcgagtcactttag

SEQ ID NO: 54104 - DNA, 18 bp, Artificial Sequence
  Synthetic DNA
atattcgccccaatatag

SEQ ID NO: 54105 - DNA, 18 bp, Artificial Sequence
  Synthetic DNA
atattcgtatcaattaag

SEQ ID NO: 54106 - DNA, 18 bp, Artificial Sequence
  Synthetic DNA
atattcgtctcattacag

SEQ ID NO: 54107 - DNA, 18 bp, Artificial Sequence
  Synthetic DNA
atattctacccacaaaag

SEQ ID NO: 54108 - DNA, 18 bp, Artificial Sequence
  Synthetic DNA
atattggactcacaatag

SEQ ID NO: 54109 - DNA, 18 bp, Artificial Sequence
  Synthetic DNA
atatttgtctcatcaaag

SEQ ID NO: 54110 - DNA, 18 bp, Artificial Sequence
  Synthetic DNA
atcaactcttaactttag

SEQ ID NO: 54111 - DNA, 18 bp, Artificial Sequence
  Synthetic DNA
atccacggctcagtatag

SEQ ID NO: 54112 - DNA, 18 bp, Artificial Sequence
  Synthetic DNA
atctacaattcactatag

SEQ ID NO: 54113 - DNA, 18 bp, Artificial Sequence
  Synthetic DNA
atctacgacactctatag

SEQ ID NO: 54114 - DNA, 18 bp, Artificial Sequence
  Synthetic DNA
atctacgactgacgatag

SEQ ID NO: 54115 - DNA, 18 bp, Artificial Sequence
  Synthetic DNA
atctacgtctcacattag

SEQ ID NO: 54116 - DNA, 18 bp, Artificial Sequence
  Synthetic DNA
atctactactcactaaag

SEQ ID NO: 54117 - DNA, 18 bp, Artificial Sequence
  Synthetic DNA
atctaggtctcactaaag

SEQ ID NO: 54118 - DNA, 18 bp, Artificial Sequence
  Synthetic DNA
atctccgactcactttag

SEQ ID NO: 54119 - DNA, 18 bp, Artificial Sequence
  Synthetic DNA
atcttcgaaacactgtag

SEQ ID NO: 54120 - DNA, 18 bp, Artificial Sequence
  Synthetic DNA
atggacaactctctatag

SEQ ID NO: 54121 - DNA, 18 bp, Artificial Sequence
  Synthetic DNA
atgtaaggcttactatag

SEQ ID NO: 54122 - DNA, 18 bp, Artificial Sequence
  Synthetic DNA
atgtacaactcactcaag

SEQ ID NO: 54123 - DNA, 18 bp, Artificial Sequence
  Synthetic DNA
atgtacaactcgctatag

SEQ ID NO: 54124 - DNA, 18 bp, Artificial Sequence
  Synthetic DNA
atgtacgactccttatag

SEQ ID NO: 54125 - DNA, 18 bp, Artificial Sequence
  Synthetic DNA
atgtacgactgagtattg

SEQ ID NO: 54126 - DNA, 18 bp, Artificial Sequence
  Synthetic DNA
atgtacgacttactattg

SEQ ID NO: 54127 - DNA, 18 bp, Artificial Sequence
  Synthetic DNA
atgtacgacttattctag

SEQ ID NO: 54128 - DNA, 18 bp, Artificial Sequence
  Synthetic DNA
atgttttgatcacaatag

SEQ ID NO: 54129 - DNA, 18 bp, Artificial Sequence
  Synthetic DNA
attaacgactcactagag

SEQ ID NO: 54130 - DNA, 18 bp, Artificial Sequence
  Synthetic DNA
attaaggtcttactatag

SEQ ID NO: 54131 - DNA, 18 bp, Artificial Sequence
  Synthetic DNA
attgacgacttactttag

SEQ ID NO: 54132 - DNA, 18 bp, Artificial Sequence
  Synthetic DNA
atttaagactaactatag

SEQ ID NO: 54133 - DNA, 18 bp, Artificial Sequence
  Synthetic DNA
atttacgaattactatcg

SEQ ID NO: 54134 - DNA, 18 bp, Artificial Sequence
  Synthetic DNA
atttacgacacactgtag

SEQ ID NO: 54135 - DNA, 18 bp, Artificial Sequence
  Synthetic DNA
atttacgactcaccatgg

SEQ ID NO: 54136 - DNA, 18 bp, Artificial Sequence
  Synthetic DNA
atttacgactctccatag

SEQ ID NO: 54137 - DNA, 18 bp, Artificial Sequence
  Synthetic DNA
atttacgccttactatag

SEQ ID NO: 54138 - DNA, 18 bp, Artificial Sequence
  Synthetic DNA
atttactgctctttatag

SEQ ID NO: 54139 - DNA, 18 bp, Artificial Sequence
  Synthetic DNA
atttacttctcactgtag

SEQ ID NO: 54140 - DNA, 18 bp, Artificial Sequence
  Synthetic DNA
atttaggactctttaaag

SEQ ID NO: 54141 - DNA, 18 bp, Artificial Sequence
  Synthetic DNA
atttatgaattactatag

SEQ ID NO: 54142 - DNA, 18 bp, Artificial Sequence
  Synthetic DNA
atttatgactcactattg

SEQ ID NO: 54143 - DNA, 18 bp, Artificial Sequence
  Synthetic DNA
atttatgactcgctatag

SEQ ID NO: 54144 - DNA, 18 bp, Artificial Sequence
  Synthetic DNA
atttcagactcactttcg

SEQ ID NO: 54145 - DNA, 18 bp, Artificial Sequence
  Synthetic DNA
atttcccactcacgttag

SEQ ID NO: 54146 - DNA, 18 bp, Artificial Sequence
  Synthetic DNA
attttcgactcacttttg

SEQ ID NO: 54147 - DNA, 18 bp, Artificial Sequence
  Synthetic DNA
attttcgactgactaaag

SEQ ID NO: 54148 - DNA, 18 bp, Artificial Sequence
  Synthetic DNA
attttcgatacactatag

SEQ ID NO: 54149 - DNA, 18 bp, Artificial Sequence
  Synthetic DNA
attttcgcgtaaccatag

SEQ ID NO: 54150 - DNA, 18 bp, Artificial Sequence
  Synthetic DNA
attttctagtgacttttg

SEQ ID NO: 54151 - DNA, 18 bp, Artificial Sequence
  Synthetic DNA
caaaacgaccctctctag

SEQ ID NO: 54152 - DNA, 18 bp, Artificial Sequence
  Synthetic DNA
caaaacgactctttatcg

SEQ ID NO: 54153 - DNA, 18 bp, Artificial Sequence
  Synthetic DNA
caaaacgagtttccatag

SEQ ID NO: 54154 - DNA, 18 bp, Artificial Sequence
  Synthetic DNA
caaaacggctaacattag

SEQ ID NO: 54155 - DNA, 18 bp, Artificial Sequence
  Synthetic DNA
caaaacggttgaacgtag

SEQ ID NO: 54156 - DNA, 18 bp, Artificial Sequence
  Synthetic DNA
caaaacgttttattatag

SEQ ID NO: 54157 - DNA, 18 bp, Artificial Sequence
  Synthetic DNA
caaaaggattcactattg

SEQ ID NO: 54158 - DNA, 18 bp, Artificial Sequence
  Synthetic DNA
caaaatgtcacactctag

SEQ ID NO: 54159 - DNA, 18 bp, Artificial Sequence
  Synthetic DNA
caaaccgatacagtatag

SEQ ID NO: 54160 - DNA, 18 bp, Artificial Sequence
  Synthetic DNA
caaagagactcacttttg

SEQ ID NO: 54161 - DNA, 18 bp, Artificial Sequence
  Synthetic DNA
caaagagtctcattacag

SEQ ID NO: 54162 - DNA, 18 bp, Artificial Sequence
  Synthetic DNA
caaatagacacactatag

SEQ ID NO: 54163 - DNA, 18 bp, Artificial Sequence
  Synthetic DNA
caaatccacccactatag

SEQ ID NO: 54164 - DNA, 18 bp, Artificial Sequence
  Synthetic DNA
caaatcgataatctatag

SEQ ID NO: 54165 - DNA, 18 bp, Artificial Sequence
  Synthetic DNA
caaatgcacacactatag

SEQ ID NO: 54166 - DNA, 18 bp, Artificial Sequence
  Synthetic DNA
caacaagacaccctatag

SEQ ID NO: 54167 - DNA, 18 bp, Artificial Sequence
  Synthetic DNA
caacaagatgcactctag

SEQ ID NO: 54168 - DNA, 18 bp, Artificial Sequence
  Synthetic DNA
caacaatactctctattg

SEQ ID NO: 54169 - DNA, 18 bp, Artificial Sequence
  Synthetic DNA
caacacaactccacatag

SEQ ID NO: 54170 - DNA, 18 bp, Artificial Sequence
  Synthetic DNA
caacacgactctttagtg

SEQ ID NO: 54171 - DNA, 18 bp, Artificial Sequence
  Synthetic DNA
caacactactcgctaaag

SEQ ID NO: 54172 - DNA, 18 bp, Artificial Sequence
  Synthetic DNA
caacatcaattgttaaag

SEQ ID NO: 54173 - DNA, 18 bp, Artificial Sequence
  Synthetic DNA
caagacgacacaccattg

SEQ ID NO: 54174 - DNA, 18 bp, Artificial Sequence
  Synthetic DNA
caaggcatttagcttaag

SEQ ID NO: 54175 - DNA, 18 bp, Artificial Sequence
  Synthetic DNA
caaggcggctcaccttcg

SEQ ID NO: 54176 - DNA, 18 bp, Artificial Sequence
  Synthetic DNA
caagtcgaatcactattg

SEQ ID NO: 54177 - DNA, 18 bp, Artificial Sequence
  Synthetic DNA
caataaaactcaatcaag

SEQ ID NO: 54178 - DNA, 18 bp, Artificial Sequence
  Synthetic DNA
caataacaatcactatcg

SEQ ID NO: 54179 - DNA, 18 bp, Artificial Sequence
  Synthetic DNA
caataacacacactattg

SEQ ID NO: 54180 - DNA, 18 bp, Artificial Sequence
  Synthetic DNA
caataagaataagtcagg

SEQ ID NO: 54181 - DNA, 18 bp, Artificial Sequence
  Synthetic DNA
caataagactcttaaaag

SEQ ID NO: 54182 - DNA, 18 bp, Artificial Sequence
  Synthetic DNA
caataagcctcactttgg

SEQ ID NO: 54183 - DNA, 18 bp, Artificial Sequence
  Synthetic DNA
caataatacacacgatag

SEQ ID NO: 54184 - DNA, 18 bp, Artificial Sequence
  Synthetic DNA
caatacaacactctttgg

SEQ ID NO: 54185 - DNA, 18 bp, Artificial Sequence
  Synthetic DNA
caatacaactcagcgatg

SEQ ID NO: 54186 - DNA, 18 bp, Artificial Sequence
  Synthetic DNA
caatacaactcatttaag

SEQ ID NO: 54187 - DNA, 18 bp, Artificial Sequence
  Synthetic DNA
caatacataattcaatag

SEQ ID NO: 54188 - DNA, 18 bp, Artificial Sequence
  Synthetic DNA
caatacatcactgtttag

SEQ ID NO: 54189 - DNA, 18 bp, Artificial Sequence
  Synthetic DNA
caatacatctcactcaag

SEQ ID NO: 54190 - DNA, 18 bp, Artificial Sequence
  Synthetic DNA
caatacattagacaatag

SEQ ID NO: 54191 - DNA, 18 bp, Artificial Sequence
  Synthetic DNA
caataccacacattaaag

SEQ ID NO: 54192 - DNA, 18 bp, Artificial Sequence
  Synthetic DNA
caataccattcaaaacag

SEQ ID NO: 54193 - DNA, 18 bp, Artificial Sequence
  Synthetic DNA
caatacgacaaatcttag

SEQ ID NO: 54194 - DNA, 18 bp, Artificial Sequence
  Synthetic DNA
caatacgaccttaatttg

SEQ ID NO: 54195 - DNA, 18 bp, Artificial Sequence
  Synthetic DNA
caatacgatccaattaag

SEQ ID NO: 54196 - DNA, 18 bp, Artificial Sequence
  Synthetic DNA
caatacgattatcttaag

SEQ ID NO: 54197 - DNA, 18 bp, Artificial Sequence
  Synthetic DNA
caatacgattcgccgtag

SEQ ID NO: 54198 - DNA, 18 bp, Artificial Sequence
  Synthetic DNA
caatacgcactactattg

SEQ ID NO: 54199 - DNA, 18 bp, Artificial Sequence
  Synthetic DNA
caatacgcctgactttgg

SEQ ID NO: 54200 - DNA, 18 bp, Artificial Sequence
  Synthetic DNA
caatacgccttagttaag

SEQ ID NO: 54201 - DNA, 18 bp, Artificial Sequence
  Synthetic DNA
caatacgcgacacaatag

SEQ ID NO: 54202 - DNA, 18 bp, Artificial Sequence
  Synthetic DNA
caatacgtaagtccatcg

SEQ ID NO: 54203 - DNA, 18 bp, Artificial Sequence
  Synthetic DNA
caatacgtctcaatgagg

SEQ ID NO: 54204 - DNA, 18 bp, Artificial Sequence
  Synthetic DNA
caatacgtctcgcattag

SEQ ID NO: 54205 - DNA, 18 bp, Artificial Sequence
  Synthetic DNA
caatacgttcaagtatag

SEQ ID NO: 54206 - DNA, 18 bp, Artificial Sequence
  Synthetic DNA
caatactaatcaatattg

SEQ ID NO: 54207 - DNA, 18 bp, Artificial Sequence
  Synthetic DNA
caatactacttacaaaag

SEQ ID NO: 54208 - DNA, 18 bp, Artificial Sequence
  Synthetic DNA
caatactacttacctctg

SEQ ID NO: 54209 - DNA, 18 bp, Artificial Sequence
  Synthetic DNA
caatactacttacttatg

SEQ ID NO: 54210 - DNA, 18 bp, Artificial Sequence
  Synthetic DNA
caatactagtcaaaatag

SEQ ID NO: 54211 - DNA, 18 bp, Artificial Sequence
  Synthetic DNA
caatactagtcaatttag

SEQ ID NO: 54212 - DNA, 18 bp, Artificial Sequence
  Synthetic DNA
caatactatacaaaacag

SEQ ID NO: 54213 - DNA, 18 bp, Artificial Sequence
  Synthetic DNA
caatactccttactaccg

SEQ ID NO: 54214 - DNA, 18 bp, Artificial Sequence
  Synthetic DNA
caatactgttcgcaatag

SEQ ID NO: 54215 - DNA, 18 bp, Artificial Sequence
  Synthetic DNA
caatacttctctaattag

SEQ ID NO: 54216 - DNA, 18 bp, Artificial Sequence
  Synthetic DNA
caatactttttgcaaaag

SEQ ID NO: 54217 - DNA, 18 bp, Artificial Sequence
  Synthetic DNA
caataggacacagctaag

SEQ ID NO: 54218 - DNA, 18 bp, Artificial Sequence
  Synthetic DNA
caataggactcaataacg

SEQ ID NO: 54219 - DNA, 18 bp, Artificial Sequence
  Synthetic DNA
caataggtatcaatatag

SEQ ID NO: 54220 - DNA, 18 bp, Artificial Sequence
  Synthetic DNA
caatatgactaaataatg

SEQ ID NO: 54221 - DNA, 18 bp, Artificial Sequence
  Synthetic DNA
caatatggccctttatag

SEQ ID NO: 54222 - DNA, 18 bp, Artificial Sequence
  Synthetic DNA
caatatggctcacaacag

SEQ ID NO: 54223 - DNA, 18 bp, Artificial Sequence
  Synthetic DNA
caatatgttgaatgagtg

SEQ ID NO: 54224 - DNA, 18 bp, Artificial Sequence
  Synthetic DNA
caatatttctcactatgg

SEQ ID NO: 54225 - DNA, 18 bp, Artificial Sequence
  Synthetic DNA
caatcatactatcattag

SEQ ID NO: 54226 - DNA, 18 bp, Artificial Sequence
  Synthetic DNA
caatccaactcacttaag

SEQ ID NO: 54227 - DNA, 18 bp, Artificial Sequence
  Synthetic DNA
caatccatctaacaattg

SEQ ID NO: 54228 - DNA, 18 bp, Artificial Sequence
  Synthetic DNA
caatgactcacactacag

SEQ ID NO: 54229 - DNA, 18 bp, Artificial Sequence
  Synthetic DNA
caatgagaccctcgagag

SEQ ID NO: 54230 - DNA, 18 bp, Artificial Sequence
  Synthetic DNA
caatgcgactcccatttg

SEQ ID NO: 54231 - DNA, 18 bp, Artificial Sequence
  Synthetic DNA
caatgcgatacactttgg

SEQ ID NO: 54232 - DNA, 18 bp, Artificial Sequence
  Synthetic DNA
caatgctccccaatatag

SEQ ID NO: 54233 - DNA, 18 bp, Artificial Sequence
  Synthetic DNA
caattagactttcattag

SEQ ID NO: 54234 - DNA, 18 bp, Artificial Sequence
  Synthetic DNA
caattagattcactttag

SEQ ID NO: 54235 - DNA, 18 bp, Artificial Sequence
  Synthetic DNA
caattatacaatctagag

SEQ ID NO: 54236 - DNA, 18 bp, Artificial Sequence
  Synthetic DNA
caattattgtcccaagag

SEQ ID NO: 54237 - DNA, 18 bp, Artificial Sequence
  Synthetic DNA
caattcaaatcactacag

SEQ ID NO: 54238 - DNA, 18 bp, Artificial Sequence
  Synthetic DNA
caattcaacatactctag

SEQ ID NO: 54239 - DNA, 18 bp, Artificial Sequence
  Synthetic DNA
caattcaactctcaattg

SEQ ID NO: 54240 - DNA, 18 bp, Artificial Sequence
  Synthetic DNA
caattcatctcattatgg

SEQ ID NO: 54241 - DNA, 18 bp, Artificial Sequence
  Synthetic DNA
caattcgacttaataaag

SEQ ID NO: 54242 - DNA, 18 bp, Artificial Sequence
  Synthetic DNA
caattcgatcatctaagg

SEQ ID NO: 54243 - DNA, 18 bp, Artificial Sequence
  Synthetic DNA
caattcgattctatatag

SEQ ID NO: 54244 - DNA, 18 bp, Artificial Sequence
  Synthetic DNA
caattcgcctcattgtag

SEQ ID NO: 54245 - DNA, 18 bp, Artificial Sequence
  Synthetic DNA
caattcgtcactcaatag

SEQ ID NO: 54246 - DNA, 18 bp, Artificial Sequence
  Synthetic DNA
caattctactttctaaag

SEQ ID NO: 54247 - DNA, 18 bp, Artificial Sequence
  Synthetic DNA
caattctagtcataatag

SEQ ID NO: 54248 - DNA, 18 bp, Artificial Sequence
  Synthetic DNA
caattctcctcattatag

SEQ ID NO: 54249 - DNA, 18 bp, Artificial Sequence
  Synthetic DNA
caatttgcttatcaatag

SEQ ID NO: 54250 - DNA, 18 bp, Artificial Sequence
  Synthetic DNA
caccactactgacattag

SEQ ID NO: 54251 - DNA, 18 bp, Artificial Sequence
  Synthetic DNA
cactaagatccactgtag

SEQ ID NO: 54252 - DNA, 18 bp, Artificial Sequence
  Synthetic DNA
cactaattctcacactag

SEQ ID NO: 54253 - DNA, 18 bp, Artificial Sequence
  Synthetic DNA
cactacgtattactatag

SEQ ID NO: 54254 - DNA, 18 bp, Artificial Sequence
  Synthetic DNA
cactataactcttaatag

SEQ ID NO: 54255 - DNA, 18 bp, Artificial Sequence
  Synthetic DNA
cactgcaacacactagag

SEQ ID NO: 54256 - DNA, 18 bp, Artificial Sequence
  Synthetic DNA
cactgcaacactcgatag

SEQ ID NO: 54257 - DNA, 18 bp, Artificial Sequence
  Synthetic DNA
cactgcaggtcaccattg

SEQ ID NO: 54258 - DNA, 18 bp, Artificial Sequence
  Synthetic DNA
cacttcaaatctctaagg

SEQ ID NO: 54259 - DNA, 18 bp, Artificial Sequence
  Synthetic DNA
cacttcgactaattttta

SEQ ID NO: 54260 - DNA, 18 bp, Artificial Sequence
  Synthetic DNA
cacttcgactgattatgg

SEQ ID NO: 54261 - DNA, 18 bp, Artificial Sequence
  Synthetic DNA
cagaaagtccaactacag

SEQ ID NO: 54262 - DNA, 18 bp, Artificial Sequence
  Synthetic DNA
cagatcttctcacaaaag

SEQ ID NO: 54263 - DNA, 18 bp, Artificial Sequence
  Synthetic DNA
caggacgactaacaacag

SEQ ID NO: 54264 - DNA, 18 bp, Artificial Sequence
  Synthetic DNA
caggatgacacactatag

SEQ ID NO: 54265 - DNA, 18 bp, Artificial Sequence
  Synthetic DNA
cagtactaatcactcttg

SEQ ID NO: 54266 - DNA, 18 bp, Artificial Sequence
  Synthetic DNA
cagtactcgttactatag

SEQ ID NO: 54267 - DNA, 18 bp, Artificial Sequence
  Synthetic DNA
cagtaggaaacattgtag

SEQ ID NO: 54268 - DNA, 18 bp, Artificial Sequence
  Synthetic DNA
cagtgcgatgcactaaag

SEQ ID NO: 54269 - DNA, 18 bp, Artificial Sequence
  Synthetic DNA
cagttcaactcacatttg

SEQ ID NO: 54270 - DNA, 18 bp, Artificial Sequence
  Synthetic DNA
cagttcgtctgtctattg

SEQ ID NO: 54271 - DNA, 18 bp, Artificial Sequence
  Synthetic DNA
cataacgacaaactctag

SEQ ID NO: 54272 - DNA, 18 bp, Artificial Sequence
  Synthetic DNA
cataacgactctctaccg

SEQ ID NO: 54273 - DNA, 18 bp, Artificial Sequence
  Synthetic DNA
cataatgactcactaaag

SEQ ID NO: 54274 - DNA, 18 bp, Artificial Sequence
  Synthetic DNA
cataatgacttcctatag

SEQ ID NO: 54275 - DNA, 18 bp, Artificial Sequence
  Synthetic DNA
catagcgtcccactcttg

SEQ ID NO: 54276 - DNA, 18 bp, Artificial Sequence
  Synthetic DNA
catatatacccgctatag

SEQ ID NO: 54277 - DNA, 18 bp, Artificial Sequence
  Synthetic DNA
catatcggataattactg

SEQ ID NO: 54278 - DNA, 18 bp, Artificial Sequence
  Synthetic DNA
catattgactcactaatg

SEQ ID NO: 54279 - DNA, 18 bp, Artificial Sequence
  Synthetic DNA
catcaggactcaccatag

SEQ ID NO: 54280 - DNA, 18 bp, Artificial Sequence
  Synthetic DNA
catcaggtctcatgatag

SEQ ID NO: 54281 - DNA, 18 bp, Artificial Sequence
  Synthetic DNA
catcatgactcattatag

SEQ ID NO: 54282 - DNA, 18 bp, Artificial Sequence
  Synthetic DNA
catctagtctcataaagg

SEQ ID NO: 54283 - DNA, 18 bp, Artificial Sequence
  Synthetic DNA
catctcgactcagcttag

SEQ ID NO: 54284 - DNA, 18 bp, Artificial Sequence
  Synthetic DNA
catgacgactatcattag

SEQ ID NO: 54285 - DNA, 18 bp, Artificial Sequence
  Synthetic DNA
catgcctacacactatag

SEQ ID NO: 54286 - DNA, 18 bp, Artificial Sequence
  Synthetic DNA
catgtctacttattaaag

SEQ ID NO: 54287 - DNA, 18 bp, Artificial Sequence
  Synthetic DNA
cattaagagccactatag

SEQ ID NO: 54288 - DNA, 18 bp, Artificial Sequence
  Synthetic DNA
cattacaacacactaaag

SEQ ID NO: 54289 - DNA, 18 bp, Artificial Sequence
  Synthetic DNA
cattacagctttaaatag

SEQ ID NO: 54290 - DNA, 18 bp, Artificial Sequence
  Synthetic DNA
cattacgaatccctgatg

SEQ ID NO: 54291 - DNA, 18 bp, Artificial Sequence
  Synthetic DNA
cattacgactcgataatg

SEQ ID NO: 54292 - DNA, 18 bp, Artificial Sequence
  Synthetic DNA
cattacgactcgctcagg

SEQ ID NO: 54293 - DNA, 18 bp, Artificial Sequence
  Synthetic DNA
cattacgagtcacaatcg

SEQ ID NO: 54294 - DNA, 18 bp, Artificial Sequence
  Synthetic DNA
cattacgatttacaatag

SEQ ID NO: 54295 - DNA, 18 bp, Artificial Sequence
  Synthetic DNA
cattacgtcaccctttag

SEQ ID NO: 54296 - DNA, 18 bp, Artificial Sequence
  Synthetic DNA
cattacgtttgaatattg

SEQ ID NO: 54297 - DNA, 18 bp, Artificial Sequence
  Synthetic DNA
cattactactcattattg

SEQ ID NO: 54298 - DNA, 18 bp, Artificial Sequence
  Synthetic DNA
cattacttctaaataaag

SEQ ID NO: 54299 - DNA, 18 bp, Artificial Sequence
  Synthetic DNA
cattaggactcattatgg

SEQ ID NO: 54300 - DNA, 18 bp, Artificial Sequence
  Synthetic DNA
cattaggattcataactg

SEQ ID NO: 54301 - DNA, 18 bp, Artificial Sequence
  Synthetic DNA
cattatgactcattattg

SEQ ID NO: 54302 - DNA, 18 bp, Artificial Sequence
  Synthetic DNA
cattatgatctactatag

SEQ ID NO: 54303 - DNA, 18 bp, Artificial Sequence
  Synthetic DNA
cattatgtctcaccagtg

SEQ ID NO: 54304 - DNA, 18 bp, Artificial Sequence
  Synthetic DNA
cattccaactcacgatgg

SEQ ID NO: 54305 - DNA, 18 bp, Artificial Sequence
  Synthetic DNA
cattcccagtcggtatgg

SEQ ID NO: 54306 - DNA, 18 bp, Artificial Sequence
  Synthetic DNA
catttagagacacaaatg

SEQ ID NO: 54307 - DNA, 18 bp, Artificial Sequence
  Synthetic DNA
catttcaactcagattag

SEQ ID NO: 54308 - DNA, 18 bp, Artificial Sequence
  Synthetic DNA
catttcgactcactgcag

SEQ ID NO: 54309 - DNA, 18 bp, Artificial Sequence
  Synthetic DNA
catttcggtttactacag

SEQ ID NO: 54310 - DNA, 18 bp, Artificial Sequence
  Synthetic DNA
cattttggcactctatag

SEQ ID NO: 54311 - DNA, 18 bp, Artificial Sequence
  Synthetic DNA
cattttgtgtcactgtag

SEQ ID NO: 54312 - DNA, 18 bp, Artificial Sequence
  Synthetic DNA
ccaaacgacttactacgg

SEQ ID NO: 54313 - DNA, 18 bp, Artificial Sequence
  Synthetic DNA
ccaatcgactcactatgg

SEQ ID NO: 54314 - DNA, 18 bp, Artificial Sequence
  Synthetic DNA
ccacacaaatgatttaag

SEQ ID NO: 54315 - DNA, 18 bp, Artificial Sequence
  Synthetic DNA
ccatacgacattctatag

SEQ ID NO: 54316 - DNA, 18 bp, Artificial Sequence
  Synthetic DNA
ccatacgtatcttatttg

SEQ ID NO: 54317 - DNA, 18 bp, Artificial Sequence
  Synthetic DNA
ccatactacacaaaacag

SEQ ID NO: 54318 - DNA, 18 bp, Artificial Sequence
  Synthetic DNA
ccatatgactcaccatcg

SEQ ID NO: 54319 - DNA, 18 bp, Artificial Sequence
  Synthetic DNA
ccatatgactcactcaag

SEQ ID NO: 54320 - DNA, 18 bp, Artificial Sequence
  Synthetic DNA
ccctaagactaactacag

SEQ ID NO: 54321 - DNA, 18 bp, Artificial Sequence
  Synthetic DNA
ccgtacgaatcgctatag

SEQ ID NO: 54322 - DNA, 18 bp, Artificial Sequence
  Synthetic DNA
ccgtatggttcactattg

SEQ ID NO: 54323 - DNA, 18 bp, Artificial Sequence
  Synthetic DNA
ccttacgacacactaaag

SEQ ID NO: 54324 - DNA, 18 bp, Artificial Sequence
  Synthetic DNA
ccttccaactcacaatag

SEQ ID NO: 54325 - DNA, 18 bp, Artificial Sequence
  Synthetic DNA
ccttttggctgattatag

SEQ ID NO: 54326 - DNA, 18 bp, Artificial Sequence
  Synthetic DNA
cgagacgactgactaaag

SEQ ID NO: 54327 - DNA, 18 bp, Artificial Sequence
  Synthetic DNA
cgagacgactgactttag

SEQ ID NO: 54328 - DNA, 18 bp, Artificial Sequence
  Synthetic DNA
cgatacaccacactttag

SEQ ID NO: 54329 - DNA, 18 bp, Artificial Sequence
  Synthetic DNA
cgatacgaaagactatcg

SEQ ID NO: 54330 - DNA, 18 bp, Artificial Sequence
  Synthetic DNA
cgatacgacacgctatgg

SEQ ID NO: 54331 - DNA, 18 bp, Artificial Sequence
  Synthetic DNA
cgatacgatccattaaag

SEQ ID NO: 54332 - DNA, 18 bp, Artificial Sequence
  Synthetic DNA
cgatacgtcttataaaag

SEQ ID NO: 54333 - DNA, 18 bp, Artificial Sequence
  Synthetic DNA
cgatactacatacattag

SEQ ID NO: 54334 - DNA, 18 bp, Artificial Sequence
  Synthetic DNA
cgatactactctgtatag

SEQ ID NO: 54335 - DNA, 18 bp, Artificial Sequence
  Synthetic DNA
cgatagaactgaatatag

SEQ ID NO: 54336 - DNA, 18 bp, Artificial Sequence
  Synthetic DNA
cgattagacaccattaag

SEQ ID NO: 54337 - DNA, 18 bp, Artificial Sequence
  Synthetic DNA
cgattcgactcagattag

SEQ ID NO: 54338 - DNA, 18 bp, Artificial Sequence
  Synthetic DNA
cgcaatcactcaattttg

SEQ ID NO: 54339 - DNA, 18 bp, Artificial Sequence
  Synthetic DNA
cgcttcgacacacttaag

SEQ ID NO: 54340 - DNA, 18 bp, Artificial Sequence
  Synthetic DNA
cggtatgactccctatag

SEQ ID NO: 54341 - DNA, 18 bp, Artificial Sequence
  Synthetic DNA
cgttgcggctcactatag

SEQ ID NO: 54342 - DNA, 18 bp, Artificial Sequence
  Synthetic DNA
cgtttctactgactatag

SEQ ID NO: 54343 - DNA, 18 bp, Artificial Sequence
  Synthetic DNA
ctaaacgaccgaatatag

SEQ ID NO: 54344 - DNA, 18 bp, Artificial Sequence
  Synthetic DNA
ctaaacgactccatatag

SEQ ID NO: 54345 - DNA, 18 bp, Artificial Sequence
  Synthetic DNA
ctaaacgatccactatgg

SEQ ID NO: 54346 - DNA, 18 bp, Artificial Sequence
  Synthetic DNA
ctaaacgattctctattg

SEQ ID NO: 54347 - DNA, 18 bp, Artificial Sequence
  Synthetic DNA
ctaattgacactctatag

SEQ ID NO: 54348 - DNA, 18 bp, Artificial Sequence
  Synthetic DNA
ctacacgatgcgttatag

SEQ ID NO: 54349 - DNA, 18 bp, Artificial Sequence
  Synthetic DNA
ctaccctactcacttcag

SEQ ID NO: 54350 - DNA, 18 bp, Artificial Sequence
  Synthetic DNA
ctagactactctgtacag

SEQ ID NO: 54351 - DNA, 18 bp, Artificial Sequence
  Synthetic DNA
ctataagacacattatag

SEQ ID NO: 54352 - DNA, 18 bp, Artificial Sequence
  Synthetic DNA
ctataagcctgaccattg

SEQ ID NO: 54353 - DNA, 18 bp, Artificial Sequence
  Synthetic DNA
ctatacaactaactcaag

SEQ ID NO: 54354 - DNA, 18 bp, Artificial Sequence
  Synthetic DNA
ctatacgactcccttcag

SEQ ID NO: 54355 - DNA, 18 bp, Artificial Sequence
  Synthetic DNA
ctatacgactctataaag

SEQ ID NO: 54356 - DNA, 18 bp, Artificial Sequence
  Synthetic DNA
ctatacgagcatcatttg

SEQ ID NO: 54357 - DNA, 18 bp, Artificial Sequence
  Synthetic DNA
ctatacgatacgctttag

SEQ ID NO: 54358 - DNA, 18 bp, Artificial Sequence
  Synthetic DNA
ctatacttcaccataaag

SEQ ID NO: 54359 - DNA, 18 bp, Artificial Sequence
  Synthetic DNA
ctatatgactacctatag

SEQ ID NO: 54360 - DNA, 18 bp, Artificial Sequence
  Synthetic DNA
ctatcctgctcactaaag

SEQ ID NO: 54361 - DNA, 18 bp, Artificial Sequence
  Synthetic DNA
ctatcgaactaattaaag

SEQ ID NO: 54362 - DNA, 18 bp, Artificial Sequence
  Synthetic DNA
ctatgctaatgactttag

SEQ ID NO: 54363 - DNA, 18 bp, Artificial Sequence
  Synthetic DNA
ctatgctactcaccaatg

SEQ ID NO: 54364 - DNA, 18 bp, Artificial Sequence
  Synthetic DNA
ctattcgacttaataatg

SEQ ID NO: 54365 - DNA, 18 bp, Artificial Sequence
  Synthetic DNA
ctattcgcttcactatag

SEQ ID NO: 54366 - DNA, 18 bp, Artificial Sequence
  Synthetic DNA
ctattcggtacagtatag

SEQ ID NO: 54367 - DNA, 18 bp, Artificial Sequence
  Synthetic DNA
ctattcgtcacaccattg

SEQ ID NO: 54368 - DNA, 18 bp, Artificial Sequence
  Synthetic DNA
ctctaaacctcactcatg

SEQ ID NO: 54369 - DNA, 18 bp, Artificial Sequence
  Synthetic DNA
ctctaagactcactttag

SEQ ID NO: 54370 - DNA, 18 bp, Artificial Sequence
  Synthetic DNA
ctctacgattaactcaag

SEQ ID NO: 54371 - DNA, 18 bp, Artificial Sequence
  Synthetic DNA
ctgaacgactcactattg

SEQ ID NO: 54372 - DNA, 18 bp, Artificial Sequence
  Synthetic DNA
ctgtacgacccattatag

SEQ ID NO: 54373 - DNA, 18 bp, Artificial Sequence
  Synthetic DNA
ctgtaggactgacaatag

SEQ ID NO: 54374 - DNA, 18 bp, Artificial Sequence
  Synthetic DNA
ctgtatgactcaatatag

SEQ ID NO: 54375 - DNA, 18 bp, Artificial Sequence
  Synthetic DNA
cttaaatactcactagag

SEQ ID NO: 54376 - DNA, 18 bp, Artificial Sequence
  Synthetic DNA
cttaacggctcattaaag

SEQ ID NO: 54377 - DNA, 18 bp, Artificial Sequence
  Synthetic DNA
cttcatgtctcactttag

SEQ ID NO: 54378 - DNA, 18 bp, Artificial Sequence
  Synthetic DNA
ctttacatctcaatcttg

SEQ ID NO: 54379 - DNA, 18 bp, Artificial Sequence
  Synthetic DNA
ctttaccatccatagtag

SEQ ID NO: 54380 - DNA, 18 bp, Artificial Sequence
  Synthetic DNA
ctttacgacccactaaag

SEQ ID NO: 54381 - DNA, 18 bp, Artificial Sequence
  Synthetic DNA
ctttacgagacagtatag

SEQ ID NO: 54382 - DNA, 18 bp, Artificial Sequence
  Synthetic DNA
ctttacgtctccctatag

SEQ ID NO: 54383 - DNA, 18 bp, Artificial Sequence
  Synthetic DNA
ctttactactcactattg

SEQ ID NO: 54384 - DNA, 18 bp, Artificial Sequence
  Synthetic DNA
ctttgcgacacgcagtag

SEQ ID NO: 54385 - DNA, 18 bp, Artificial Sequence
  Synthetic DNA
gaaaacgacccactttcg

SEQ ID NO: 54386 - DNA, 18 bp, Artificial Sequence
  Synthetic DNA
gaaaacgccacccaatag

SEQ ID NO: 54387 - DNA, 18 bp, Artificial Sequence
  Synthetic DNA
gaacatgatggactatag

SEQ ID NO: 54388 - DNA, 18 bp, Artificial Sequence
  Synthetic DNA
gaactcgattcattatag

SEQ ID NO: 54389 - DNA, 18 bp, Artificial Sequence
  Synthetic DNA
gaactctatttattatag

SEQ ID NO: 54390 - DNA, 18 bp, Artificial Sequence
  Synthetic DNA
gaataacaatctcaattg

SEQ ID NO: 54391 - DNA, 18 bp, Artificial Sequence
  Synthetic DNA
gaatacaacactgtatag

SEQ ID NO: 54392 - DNA, 18 bp, Artificial Sequence
  Synthetic DNA
gaatacaactcaaagtgg

SEQ ID NO: 54393 - DNA, 18 bp, Artificial Sequence
  Synthetic DNA
gaatacagcccactttag

SEQ ID NO: 54394 - DNA, 18 bp, Artificial Sequence
  Synthetic DNA
gaataccacacgttagag

SEQ ID NO: 54395 - DNA, 18 bp, Artificial Sequence
  Synthetic DNA
gaatacgactctatttcg

SEQ ID NO: 54396 - DNA, 18 bp, Artificial Sequence
  Synthetic DNA
gaatactactcgctaacg

SEQ ID NO: 54397 - DNA, 18 bp, Artificial Sequence
  Synthetic DNA
gaatagatctcacagtag

SEQ ID NO: 54398 - DNA, 18 bp, Artificial Sequence
  Synthetic DNA
gaatatgaattacacagg

SEQ ID NO: 54399 - DNA, 18 bp, Artificial Sequence
  Synthetic DNA
gaatatgacacacattag

SEQ ID NO: 54400 - DNA, 18 bp, Artificial Sequence
  Synthetic DNA
gaatatggcactctctag

SEQ ID NO: 54401 - DNA, 18 bp, Artificial Sequence
  Synthetic DNA
gaatattactaacttctg

SEQ ID NO: 54402 - DNA, 18 bp, Artificial Sequence
  Synthetic DNA
gaatgcgtctctcaattg

SEQ ID NO: 54403 - DNA, 18 bp, Artificial Sequence
  Synthetic DNA
gaatgtgaccctttatag

SEQ ID NO: 54404 - DNA, 18 bp, Artificial Sequence
  Synthetic DNA
gaattcgactcagttcag

SEQ ID NO: 54405 - DNA, 18 bp, Artificial Sequence
  Synthetic DNA
gaattctactcccattag

SEQ ID NO: 54406 - DNA, 18 bp, Artificial Sequence
  Synthetic DNA
gaattcttcaccctatag

SEQ ID NO: 54407 - DNA, 18 bp, Artificial Sequence
  Synthetic DNA
gaccaagactcactaaag

SEQ ID NO: 54408 - DNA, 18 bp, Artificial Sequence
  Synthetic DNA
gactatgattctttatgg

SEQ ID NO: 54409 - DNA, 18 bp, Artificial Sequence
  Synthetic DNA
gactattactgtcacaag

SEQ ID NO: 54410 - DNA, 18 bp, Artificial Sequence
  Synthetic DNA
gagatcgactcactaaag

SEQ ID NO: 54411 - DNA, 18 bp, Artificial Sequence
  Synthetic DNA
gagcacgattcactactg

SEQ ID NO: 54412 - DNA, 18 bp, Artificial Sequence
  Synthetic DNA
gagtaccactcacaaaag

SEQ ID NO: 54413 - DNA, 18 bp, Artificial Sequence
  Synthetic DNA
gagtatatctcactaagg

SEQ ID NO: 54414 - DNA, 18 bp, Artificial Sequence
  Synthetic DNA
gataaccacacttttatg

SEQ ID NO: 54415 - DNA, 18 bp, Artificial Sequence
  Synthetic DNA
gataacgactcaccgaag

SEQ ID NO: 54416 - DNA, 18 bp, Artificial Sequence
  Synthetic DNA
gataacgccttactttag

SEQ ID NO: 54417 - DNA, 18 bp, Artificial Sequence
  Synthetic DNA
gatcccgactcacagtag

SEQ ID NO: 54418 - DNA, 18 bp, Artificial Sequence
  Synthetic DNA
gattacaacccactttag

SEQ ID NO: 54419 - DNA, 18 bp, Artificial Sequence
  Synthetic DNA
gattacgacacccaatag

SEQ ID NO: 54420 - DNA, 18 bp, Artificial Sequence
  Synthetic DNA
gattacgtttctgctaag

SEQ ID NO: 54421 - DNA, 18 bp, Artificial Sequence
  Synthetic DNA
gattactactcacttttg

SEQ ID NO: 54422 - DNA, 18 bp, Artificial Sequence
  Synthetic DNA
gattactactgtcgatag

SEQ ID NO: 54423 - DNA, 18 bp, Artificial Sequence
  Synthetic DNA
gattacttctctatgcag

SEQ ID NO: 54424 - DNA, 18 bp, Artificial Sequence
  Synthetic DNA
gattatgtcacagtaatg

SEQ ID NO: 54425 - DNA, 18 bp, Artificial Sequence
  Synthetic DNA
gattccgtcacactaaag

SEQ ID NO: 54426 - DNA, 18 bp, Artificial Sequence
  Synthetic DNA
gatttcgactcgttaaag

SEQ ID NO: 54427 - DNA, 18 bp, Artificial Sequence
  Synthetic DNA
gcacttgtcacacttttg

SEQ ID NO: 54428 - DNA, 18 bp, Artificial Sequence
  Synthetic DNA
gcataaaactcacaatag

SEQ ID NO: 54429 - DNA, 18 bp, Artificial Sequence
  Synthetic DNA
gcatacgaattacaacag

SEQ ID NO: 54430 - DNA, 18 bp, Artificial Sequence
  Synthetic DNA
gcatccatcccactattg

SEQ ID NO: 54431 - DNA, 18 bp, Artificial Sequence
  Synthetic DNA
gcgtaggtctcactatcg

SEQ ID NO: 54432 - DNA, 18 bp, Artificial Sequence
  Synthetic DNA
gcttacgactcactttcg

SEQ ID NO: 54433 - DNA, 18 bp, Artificial Sequence
  Synthetic DNA
gcttatgattcattatag

SEQ ID NO: 54434 - DNA, 18 bp, Artificial Sequence
  Synthetic DNA
gctttcgaatttcatttg

SEQ ID NO: 54435 - DNA, 18 bp, Artificial Sequence
  Synthetic DNA
ggaaaagtcacactatag

SEQ ID NO: 54436 - DNA, 18 bp, Artificial Sequence
  Synthetic DNA
ggtaatgattgagtatag

SEQ ID NO: 54437 - DNA, 18 bp, Artificial Sequence
  Synthetic DNA
ggttgcgactcactatgg

SEQ ID NO: 54438 - DNA, 18 bp, Artificial Sequence
  Synthetic DNA
gtaaaagactatctatgg

SEQ ID NO: 54439 - DNA, 18 bp, Artificial Sequence
  Synthetic DNA
gtaaactgctgtgtaaag

SEQ ID NO: 54440 - DNA, 18 bp, Artificial Sequence
  Synthetic DNA
gtaaatgactcaatatag

SEQ ID NO: 54441 - DNA, 18 bp, Artificial Sequence
  Synthetic DNA
gtatacgacacacttgag

SEQ ID NO: 54442 - DNA, 18 bp, Artificial Sequence
  Synthetic DNA
gtatacggctcatttaag

SEQ ID NO: 54443 - DNA, 18 bp, Artificial Sequence
  Synthetic DNA
gtatacgggacactatag

SEQ ID NO: 54444 - DNA, 18 bp, Artificial Sequence
  Synthetic DNA
gtataggacacactcttg

SEQ ID NO: 54445 - DNA, 18 bp, Artificial Sequence
  Synthetic DNA
gtatgctactcaataaag

SEQ ID NO: 54446 - DNA, 18 bp, Artificial Sequence
  Synthetic DNA
gtattcgacacaatttag

SEQ ID NO: 54447 - DNA, 18 bp, Artificial Sequence
  Synthetic DNA
gtgtacaattctccctag

SEQ ID NO: 54448 - DNA, 18 bp, Artificial Sequence
  Synthetic DNA
gttatctactcactaaag

SEQ ID NO: 54449 - DNA, 18 bp, Artificial Sequence
  Synthetic DNA
gtttacgattccctgtag

SEQ ID NO: 54450 - DNA, 18 bp, Artificial Sequence
  Synthetic DNA
gtttccaactcactattg

SEQ ID NO: 54451 - DNA, 18 bp, Artificial Sequence
  Synthetic DNA
gttttccactcacgttag

SEQ ID NO: 54452 - DNA, 18 bp, Artificial Sequence
  Synthetic DNA
taaaaaaacaccctttag

SEQ ID NO: 54453 - DNA, 18 bp, Artificial Sequence
  Synthetic DNA
taaaaaaactcactttcg

SEQ ID NO: 54454 - DNA, 18 bp, Artificial Sequence
  Synthetic DNA
taaaaaaactctcagtag

SEQ ID NO: 54455 - DNA, 18 bp, Artificial Sequence
  Synthetic DNA
taaaaacactatctattg

SEQ ID NO: 54456 - DNA, 18 bp, Artificial Sequence
  Synthetic DNA
taaaaagacaacagaaag

SEQ ID NO: 54457 - DNA, 18 bp, Artificial Sequence
  Synthetic DNA
taaaaagacactcaaaag

SEQ ID NO: 54458 - DNA, 18 bp, Artificial Sequence
  Synthetic DNA
taaaaagaccccctattg

SEQ ID NO: 54459 - DNA, 18 bp, Artificial Sequence
  Synthetic DNA
taaaaagactaactagtg

SEQ ID NO: 54460 - DNA, 18 bp, Artificial Sequence
  Synthetic DNA
taaaaagactctataaag

SEQ ID NO: 54461 - DNA, 18 bp, Artificial Sequence
  Synthetic DNA
taaaaagactttctaaag

SEQ ID NO: 54462 - DNA, 18 bp, Artificial Sequence
  Synthetic DNA
taaaaagatttactaatg

SEQ ID NO: 54463 - DNA, 18 bp, Artificial Sequence
  Synthetic DNA
taaaaagtcacactagtg

SEQ ID NO: 54464 - DNA, 18 bp, Artificial Sequence
  Synthetic DNA
taaaaagtcagacttcag

SEQ ID NO: 54465 - DNA, 18 bp, Artificial Sequence
  Synthetic DNA
taaaaagtctccctattg

SEQ ID NO: 54466 - DNA, 18 bp, Artificial Sequence
  Synthetic DNA
taaaaagtctgtctttag

SEQ ID NO: 54467 - DNA, 18 bp, Artificial Sequence
  Synthetic DNA
taaaaagttcatctatgg

SEQ ID NO: 54468 - DNA, 18 bp, Artificial Sequence
  Synthetic DNA
taaaaatactctcgattg

SEQ ID NO: 54469 - DNA, 18 bp, Artificial Sequence
  Synthetic DNA
taaaaatactctctttag

SEQ ID NO: 54470 - DNA, 18 bp, Artificial Sequence
  Synthetic DNA
taaaaattgccactttag

SEQ ID NO: 54471 - DNA, 18 bp, Artificial Sequence
  Synthetic DNA
taaaacaacagactacag

SEQ ID NO: 54472 - DNA, 18 bp, Artificial Sequence
  Synthetic DNA
taaaacaacccaataatg

SEQ ID NO: 54473 - DNA, 18 bp, Artificial Sequence
  Synthetic DNA
taaaacaactgtcaatag

SEQ ID NO: 54474 - DNA, 18 bp, Artificial Sequence
  Synthetic DNA
taaaacaagtcacactag

SEQ ID NO: 54475 - DNA, 18 bp, Artificial Sequence
  Synthetic DNA
taaaacaccccactaaag

SEQ ID NO: 54476 - DNA, 18 bp, Artificial Sequence
  Synthetic DNA
taaaacacgtcaccaaag

SEQ ID NO: 54477 - DNA, 18 bp, Artificial Sequence
  Synthetic DNA
taaaacagctcaggatag

SEQ ID NO: 54478 - DNA, 18 bp, Artificial Sequence
  Synthetic DNA
taaaacatgtcactctcg

SEQ ID NO: 54479 - DNA, 18 bp, Artificial Sequence
  Synthetic DNA
taaaacatttctatctgg

SEQ ID NO: 54480 - DNA, 18 bp, Artificial Sequence
  Synthetic DNA
taaaacccctctctagag

SEQ ID NO: 54481 - DNA, 18 bp, Artificial Sequence
  Synthetic DNA
taaaacccttgactttag

SEQ ID NO: 54482 - DNA, 18 bp, Artificial Sequence
  Synthetic DNA
taaaacctctcagtaaag

SEQ ID NO: 54483 - DNA, 18 bp, Artificial Sequence
  Synthetic DNA
taaaacgaaactatattg

SEQ ID NO: 54484 - DNA, 18 bp, Artificial Sequence
  Synthetic DNA
taaaacgaatcattactg

SEQ ID NO: 54485 - DNA, 18 bp, Artificial Sequence
  Synthetic DNA
taaaacgaatctcatctg

SEQ ID NO: 54486 - DNA, 18 bp, Artificial Sequence
  Synthetic DNA
taaaacgaatcttaatag

SEQ ID NO: 54487 - DNA, 18 bp, Artificial Sequence
  Synthetic DNA
taaaacgacaaacaaatg

SEQ ID NO: 54488 - DNA, 18 bp, Artificial Sequence
  Synthetic DNA
taaaacgacacaattaag

SEQ ID NO: 54489 - DNA, 18 bp, Artificial Sequence
  Synthetic DNA
taaaacgacacatcaaag

SEQ ID NO: 54490 - DNA, 18 bp, Artificial Sequence
  Synthetic DNA
taaaacgacccgttccag

SEQ ID NO: 54491 - DNA, 18 bp, Artificial Sequence
  Synthetic DNA
taaaacgactcacagccg

SEQ ID NO: 54492 - DNA, 18 bp, Artificial Sequence
  Synthetic DNA
taaaacgactcgctgacg

SEQ ID NO: 54493 - DNA, 18 bp, Artificial Sequence
  Synthetic DNA
taaaacgactcgtttaag

SEQ ID NO: 54494 - DNA, 18 bp, Artificial Sequence
  Synthetic DNA
taaaacgactctatcgag

SEQ ID NO: 54495 - DNA, 18 bp, Artificial Sequence
  Synthetic DNA
taaaacgactgtccctag

SEQ ID NO: 54496 - DNA, 18 bp, Artificial Sequence
  Synthetic DNA
taaaacgactgttatttg

SEQ ID NO: 54497 - DNA, 18 bp, Artificial Sequence
  Synthetic DNA
taaaacgacttaccaacg

SEQ ID NO: 54498 - DNA, 18 bp, Artificial Sequence
  Synthetic DNA
taaaacgagatactattg

SEQ ID NO: 54499 - DNA, 18 bp, Artificial Sequence
  Synthetic DNA
taaaacgagtcatcaaag

SEQ ID NO: 54500 - DNA, 18 bp, Artificial Sequence
  Synthetic DNA
taaaacgagtctcagtag

SEQ ID NO: 54501 - DNA, 18 bp, Artificial Sequence
  Synthetic DNA
taaaacgatacccaatag

SEQ ID NO: 54502 - DNA, 18 bp, Artificial Sequence
  Synthetic DNA
taaaacgatccacataag

SEQ ID NO: 54503 - DNA, 18 bp, Artificial Sequence
  Synthetic DNA
taaaacgattaatttaag

SEQ ID NO: 54504 - DNA, 18 bp, Artificial Sequence
  Synthetic DNA
taaaacgattaattttag

SEQ ID NO: 54505 - DNA, 18 bp, Artificial Sequence
  Synthetic DNA
taaaacgattcaccaacg

SEQ ID NO: 54506 - DNA, 18 bp, Artificial Sequence
  Synthetic DNA
taaaacgatttaccactg

SEQ ID NO: 54507 - DNA, 18 bp, Artificial Sequence
  Synthetic DNA
taaaacgcctaccaatag

SEQ ID NO: 54508 - DNA, 18 bp, Artificial Sequence
  Synthetic DNA
taaaacgcgtcgcaatag

SEQ ID NO: 54509 - DNA, 18 bp, Artificial Sequence
  Synthetic DNA
taaaacgctgcacaaccg

SEQ ID NO: 54510 - DNA, 18 bp, Artificial Sequence
  Synthetic DNA
taaaacgcttcattaaag

SEQ ID NO: 54511 - DNA, 18 bp, Artificial Sequence
  Synthetic DNA
taaaacggatcaattaag

SEQ ID NO: 54512 - DNA, 18 bp, Artificial Sequence
  Synthetic DNA
taaaacggcccaagatag

SEQ ID NO: 54513 - DNA, 18 bp, Artificial Sequence
  Synthetic DNA
taaaacggttaactacag

SEQ ID NO: 54514 - DNA, 18 bp, Artificial Sequence
  Synthetic DNA
taaaacgtatcatactag

SEQ ID NO: 54515 - DNA, 18 bp, Artificial Sequence
  Synthetic DNA
taaaacgtcacacaacag

SEQ ID NO: 54516 - DNA, 18 bp, Artificial Sequence
  Synthetic DNA
taaaacgtcacaccttag

SEQ ID NO: 54517 - DNA, 18 bp, Artificial Sequence
  Synthetic DNA
taaaacgtcactcaatag

SEQ ID NO: 54518 - DNA, 18 bp, Artificial Sequence
  Synthetic DNA
taaaacgtctcacaagtg

SEQ ID NO: 54519 - DNA, 18 bp, Artificial Sequence
  Synthetic DNA
taaaacgtctctcaaatg

SEQ ID NO: 54520 - DNA, 18 bp, Artificial Sequence
  Synthetic DNA
taaaacgtctctcaacag

SEQ ID NO: 54521 - DNA, 18 bp, Artificial Sequence
  Synthetic DNA
taaaacgtctttgtttag

SEQ ID NO: 54522 - DNA, 18 bp, Artificial Sequence
  Synthetic DNA
taaaacgttattttttag

SEQ ID NO: 54523 - DNA, 18 bp, Artificial Sequence
  Synthetic DNA
taaaacgttccactgagg

SEQ ID NO: 54524 - DNA, 18 bp, Artificial Sequence
  Synthetic DNA
taaaacgtttcacattag

SEQ ID NO: 54525 - DNA, 18 bp, Artificial Sequence
  Synthetic DNA
taaaacgttttaataccg

SEQ ID NO: 54526 - DNA, 18 bp, Artificial Sequence
  Synthetic DNA
taaaactactcaaagtag

SEQ ID NO: 54527 - DNA, 18 bp, Artificial Sequence
  Synthetic DNA
taaaactattgccaaatg

SEQ ID NO: 54528 - DNA, 18 bp, Artificial Sequence
  Synthetic DNA
taaaactggtcaatacag

SEQ ID NO: 54529 - DNA, 18 bp, Artificial Sequence
  Synthetic DNA
taaaacttctcaccagag

SEQ ID NO: 54530 - DNA, 18 bp, Artificial Sequence
  Synthetic DNA
taaaacttcttacaatag

SEQ ID NO: 54531 - DNA, 18 bp, Artificial Sequence
  Synthetic DNA
taaaagatataagtatag

SEQ ID NO: 54532 - DNA, 18 bp, Artificial Sequence
  Synthetic DNA
taaaagcactcacactag

SEQ ID NO: 54533 - DNA, 18 bp, Artificial Sequence
  Synthetic DNA
taaaagcattcagttgag

SEQ ID NO: 54534 - DNA, 18 bp, Artificial Sequence
  Synthetic DNA
taaaagctccctctttag

SEQ ID NO: 54535 - DNA, 18 bp, Artificial Sequence
  Synthetic DNA
taaaaggactcaaaaaag

SEQ ID NO: 54536 - DNA, 18 bp, Artificial Sequence
  Synthetic DNA
taaaaggactcacattgg

SEQ ID NO: 54537 - DNA, 18 bp, Artificial Sequence
  Synthetic DNA
taaaaggactcatactag

SEQ ID NO: 54538 - DNA, 18 bp, Artificial Sequence
  Synthetic DNA
taaaaggactcgatattg

SEQ ID NO: 54539 - DNA, 18 bp, Artificial Sequence
  Synthetic DNA
taaaaggattcacttaag

SEQ ID NO: 54540 - DNA, 18 bp, Artificial Sequence
  Synthetic DNA
taaaaggattcattattg

SEQ ID NO: 54541 - DNA, 18 bp, Artificial Sequence
  Synthetic DNA
taaaaggcctaaatattg

SEQ ID NO: 54542 - DNA, 18 bp, Artificial Sequence
  Synthetic DNA
taaaaggtcacaatagag

SEQ ID NO: 54543 - DNA, 18 bp, Artificial Sequence
  Synthetic DNA
taaaagttctcactttag

SEQ ID NO: 54544 - DNA, 18 bp, Artificial Sequence
  Synthetic DNA
taaaataacaccctctgg

SEQ ID NO: 54545 - DNA, 18 bp, Artificial Sequence
  Synthetic DNA
taaaatatttcactatag

SEQ ID NO: 54546 - DNA, 18 bp, Artificial Sequence
  Synthetic DNA
taaaatcaatcacgatag

SEQ ID NO: 54547 - DNA, 18 bp, Artificial Sequence
  Synthetic DNA
taaaatcacatactaatg

SEQ ID NO: 54548 - DNA, 18 bp, Artificial Sequence
  Synthetic DNA
taaaatgacacacagtag

SEQ ID NO: 54549 - DNA, 18 bp, Artificial Sequence
  Synthetic DNA
taaaatgacacagcatag

SEQ ID NO: 54550 - DNA, 18 bp, Artificial Sequence
  Synthetic DNA
taaaatgatagactatag

SEQ ID NO: 54551 - DNA, 18 bp, Artificial Sequence
  Synthetic DNA
taaaatgattaactaaag

SEQ ID NO: 54552 - DNA, 18 bp, Artificial Sequence
  Synthetic DNA
taaaatgattctctcaag

SEQ ID NO: 54553 - DNA, 18 bp, Artificial Sequence
  Synthetic DNA
taaaatgccttacttttg

SEQ ID NO: 54554 - DNA, 18 bp, Artificial Sequence
  Synthetic DNA
taaaatggctcattttag

SEQ ID NO: 54555 - DNA, 18 bp, Artificial Sequence
  Synthetic DNA
taaaatgtcactctattg

SEQ ID NO: 54556 - DNA, 18 bp, Artificial Sequence
  Synthetic DNA
taaaatgtctcaccattg

SEQ ID NO: 54557 - DNA, 18 bp, Artificial Sequence
  Synthetic DNA
taaacataatcactatag

SEQ ID NO: 54558 - DNA, 18 bp, Artificial Sequence
  Synthetic DNA
taaacccacacacaaaag

SEQ ID NO: 54559 - DNA, 18 bp, Artificial Sequence
  Synthetic DNA
taaaccctctcaaaatag

SEQ ID NO: 54560 - DNA, 18 bp, Artificial Sequence
  Synthetic DNA
taaaccgactaggtaaag

SEQ ID NO: 54561 - DNA, 18 bp, Artificial Sequence
  Synthetic DNA
taaaccgacttgctattg

SEQ ID NO: 54562 - DNA, 18 bp, Artificial Sequence
  Synthetic DNA
taaaccgtataactatgg

SEQ ID NO: 54563 - DNA, 18 bp, Artificial Sequence
  Synthetic DNA
taaaccgtctgagtatag

SEQ ID NO: 54564 - DNA, 18 bp, Artificial Sequence
  Synthetic DNA
taaaccttctcacaacag

SEQ ID NO: 54565 - DNA, 18 bp, Artificial Sequence
  Synthetic DNA
taaactaacccactctcg

SEQ ID NO: 54566 - DNA, 18 bp, Artificial Sequence
  Synthetic DNA
taaactgactcaatacag

SEQ ID NO: 54567 - DNA, 18 bp, Artificial Sequence
  Synthetic DNA
taaactgattcattatag

SEQ ID NO: 54568 - DNA, 18 bp, Artificial Sequence
  Synthetic DNA
taaactgcttcactgttg

SEQ ID NO: 54569 - DNA, 18 bp, Artificial Sequence
  Synthetic DNA
taaagagtgtccctatag

SEQ ID NO: 54570 - DNA, 18 bp, Artificial Sequence
  Synthetic DNA
taaagcgaaatactatag

SEQ ID NO: 54571 - DNA, 18 bp, Artificial Sequence
  Synthetic DNA
taaagcgacagtctatag

SEQ ID NO: 54572 - DNA, 18 bp, Artificial Sequence
  Synthetic DNA
taaagcgtctaagtttcg

SEQ ID NO: 54573 - DNA, 18 bp, Artificial Sequence
  Synthetic DNA
taaagggatttactatag

SEQ ID NO: 54574 - DNA, 18 bp, Artificial Sequence
  Synthetic DNA
taaagtgactgactaatg

SEQ ID NO: 54575 - DNA, 18 bp, Artificial Sequence
  Synthetic DNA
taaagtgattctctatag

SEQ ID NO: 54576 - DNA, 18 bp, Artificial Sequence
  Synthetic DNA
taaagttactccaaaaag

SEQ ID NO: 54577 - DNA, 18 bp, Artificial Sequence
  Synthetic DNA
taaatagaatctctatag

SEQ ID NO: 54578 - DNA, 18 bp, Artificial Sequence
  Synthetic DNA
taaatagactctccagtg

SEQ ID NO: 54579 - DNA, 18 bp, Artificial Sequence
  Synthetic DNA
taaatcaactagctatag

SEQ ID NO: 54580 - DNA, 18 bp, Artificial Sequence
  Synthetic DNA
taaatccactaactgtag

SEQ ID NO: 54581 - DNA, 18 bp, Artificial Sequence
  Synthetic DNA
taaatccactcaatgatg

SEQ ID NO: 54582 - DNA, 18 bp, Artificial Sequence
  Synthetic DNA
taaatccactcagtctag

SEQ ID NO: 54583 - DNA, 18 bp, Artificial Sequence
  Synthetic DNA
taaatcctttcactattg

SEQ ID NO: 54584 - DNA, 18 bp, Artificial Sequence
  Synthetic DNA
taaatcgaaccaccatag

SEQ ID NO: 54585 - DNA, 18 bp, Artificial Sequence
  Synthetic DNA
taaatcgaatcgcaatgg

SEQ ID NO: 54586 - DNA, 18 bp, Artificial Sequence
  Synthetic DNA
taaatcgacacaagatag

SEQ ID NO: 54587 - DNA, 18 bp, Artificial Sequence
  Synthetic DNA
taaatcgacacacaacag

SEQ ID NO: 54588 - DNA, 18 bp, Artificial Sequence
  Synthetic DNA
taaatcgacacacaattg

SEQ ID NO: 54589 - DNA, 18 bp, Artificial Sequence
  Synthetic DNA
taaatcgacctaaaatag

SEQ ID NO: 54590 - DNA, 18 bp, Artificial Sequence
  Synthetic DNA
taaatcgactcaatcttg

SEQ ID NO: 54591 - DNA, 18 bp, Artificial Sequence
  Synthetic DNA
taaatcgactctttagag

SEQ ID NO: 54592 - DNA, 18 bp, Artificial Sequence
  Synthetic DNA
taaatcgataccttatag

SEQ ID NO: 54593 - DNA, 18 bp, Artificial Sequence
  Synthetic DNA
taaatcgattcacatgag

SEQ ID NO: 54594 - DNA, 18 bp, Artificial Sequence
  Synthetic DNA
taaatcggctcacgattg

SEQ ID NO: 54595 - DNA, 18 bp, Artificial Sequence
  Synthetic DNA
taaatcggctctcttttg

SEQ ID NO: 54596 - DNA, 18 bp, Artificial Sequence
  Synthetic DNA
taaatcgtaatactttag

SEQ ID NO: 54597 - DNA, 18 bp, Artificial Sequence
  Synthetic DNA
taaatcgtataactattg

SEQ ID NO: 54598 - DNA, 18 bp, Artificial Sequence
  Synthetic DNA
taaatcgtatcatcatgg

SEQ ID NO: 54599 - DNA, 18 bp, Artificial Sequence
  Synthetic DNA
taaatcgtctcaccattg

SEQ ID NO: 54600 - DNA, 18 bp, Artificial Sequence
  Synthetic DNA
taaatcgtctcgctacag

SEQ ID NO: 54601 - DNA, 18 bp, Artificial Sequence
  Synthetic DNA
taaatctaatgtcaattg

SEQ ID NO: 54602 - DNA, 18 bp, Artificial Sequence
  Synthetic DNA
taaatctacacattatgg

SEQ ID NO: 54603 - DNA, 18 bp, Artificial Sequence
  Synthetic DNA
taaatctacacattattg

SEQ ID NO: 54604 - DNA, 18 bp, Artificial Sequence
  Synthetic DNA
taaatctacgaatcatcg

SEQ ID NO: 54605 - DNA, 18 bp, Artificial Sequence
  Synthetic DNA
taaatctcataactatag

SEQ ID NO: 54606 - DNA, 18 bp, Artificial Sequence
  Synthetic DNA
taaatctgcttaccatag

SEQ ID NO: 54607 - DNA, 18 bp, Artificial Sequence
  Synthetic DNA
taaatcttctcccaatag

SEQ ID NO: 54608 - DNA, 18 bp, Artificial Sequence
  Synthetic DNA
taaatcttctcgtcgtag

SEQ ID NO: 54609 - DNA, 18 bp, Artificial Sequence
  Synthetic DNA
taaatggaccggctttag

SEQ ID NO: 54610 - DNA, 18 bp, Artificial Sequence
  Synthetic DNA
taaatggacgctctatag

SEQ ID NO: 54611 - DNA, 18 bp, Artificial Sequence
  Synthetic DNA
taaatggactcgatattg

SEQ ID NO: 54612 - DNA, 18 bp, Artificial Sequence
  Synthetic DNA
taaattaacacactattg

SEQ ID NO: 54613 - DNA, 18 bp, Artificial Sequence
  Synthetic DNA
taaattaacacattattg

SEQ ID NO: 54614 - DNA, 18 bp, Artificial Sequence
  Synthetic DNA
taaattgaatcactattg

SEQ ID NO: 54615 - DNA, 18 bp, Artificial Sequence
  Synthetic DNA
taaattgtctcacactag

SEQ ID NO: 54616 - DNA, 18 bp, Artificial Sequence
  Synthetic DNA
taaattgtctctccatag

SEQ ID NO: 54617 - DNA, 18 bp, Artificial Sequence
  Synthetic DNA
taaatttacccattctag

SEQ ID NO: 54618 - DNA, 18 bp, Artificial Sequence
  Synthetic DNA
taacaaaacacactatgg

SEQ ID NO: 54619 - DNA, 18 bp, Artificial Sequence
  Synthetic DNA
taacaaaactcacaagag

SEQ ID NO: 54620 - DNA, 18 bp, Artificial Sequence
  Synthetic DNA
taacaactatatatatcg

SEQ ID NO: 54621 - DNA, 18 bp, Artificial Sequence
  Synthetic DNA
taacaagacacattaaag

SEQ ID NO: 54622 - DNA, 18 bp, Artificial Sequence
  Synthetic DNA
taacaagacagactacag

SEQ ID NO: 54623 - DNA, 18 bp, Artificial Sequence
  Synthetic DNA
taacaagactcacactcg

SEQ ID NO: 54624 - DNA, 18 bp, Artificial Sequence
  Synthetic DNA
taacaagagatcttatag

SEQ ID NO: 54625 - DNA, 18 bp, Artificial Sequence
  Synthetic DNA
taacaagagtttctacag

SEQ ID NO: 54626 - DNA, 18 bp, Artificial Sequence
  Synthetic DNA
taacaagtcacggtttag

SEQ ID NO: 54627 - DNA, 18 bp, Artificial Sequence
  Synthetic DNA
taacaagttacacagtag

SEQ ID NO: 54628 - DNA, 18 bp, Artificial Sequence
  Synthetic DNA
taacaagtttatctcttg

SEQ ID NO: 54629 - DNA, 18 bp, Artificial Sequence
  Synthetic DNA
taacaatactcacaatcg

SEQ ID NO: 54630 - DNA, 18 bp, Artificial Sequence
  Synthetic DNA
taacacaaatcacaacag

SEQ ID NO: 54631 - DNA, 18 bp, Artificial Sequence
  Synthetic DNA
taacacaaattgttattg

SEQ ID NO: 54632 - DNA, 18 bp, Artificial Sequence
  Synthetic DNA
taacacaacacacaattg

SEQ ID NO: 54633 - DNA, 18 bp, Artificial Sequence
  Synthetic DNA
taacacaacacacttaag

SEQ ID NO: 54634 - DNA, 18 bp, Artificial Sequence
  Synthetic DNA
taacacatcactcataag

SEQ ID NO: 54635 - DNA, 18 bp, Artificial Sequence
  Synthetic DNA
taacacatgtcactagag

SEQ ID NO: 54636 - DNA, 18 bp, Artificial Sequence
  Synthetic DNA
taacacatgtcatcatag

SEQ ID NO: 54637 - DNA, 18 bp, Artificial Sequence
  Synthetic DNA
taacaccagtgtatttag

SEQ ID NO: 54638 - DNA, 18 bp, Artificial Sequence
  Synthetic DNA
taacaccatttacaattg

SEQ ID NO: 54639 - DNA, 18 bp, Artificial Sequence
  Synthetic DNA
taacacctcttacaaccg

SEQ ID NO: 54640 - DNA, 18 bp, Artificial Sequence
  Synthetic DNA
taacacctttaaatttag

SEQ ID NO: 54641 - DNA, 18 bp, Artificial Sequence
  Synthetic DNA
taacacgaataactcctg

SEQ ID NO: 54642 - DNA, 18 bp, Artificial Sequence
  Synthetic DNA
taacacgaatctcttttg

SEQ ID NO: 54643 - DNA, 18 bp, Artificial Sequence
  Synthetic DNA
taacacgacacaatttcg

SEQ ID NO: 54644 - DNA, 18 bp, Artificial Sequence
  Synthetic DNA
taacacgacatcctaaag

SEQ ID NO: 54645 - DNA, 18 bp, Artificial Sequence
  Synthetic DNA
taacacgactcgttccag

SEQ ID NO: 54646 - DNA, 18 bp, Artificial Sequence
  Synthetic DNA
taacacgactctcatgag

SEQ ID NO: 54647 - DNA, 18 bp, Artificial Sequence
  Synthetic DNA
taacacgagccaccattg

SEQ ID NO: 54648 - DNA, 18 bp, Artificial Sequence
  Synthetic DNA
taacacgagtaaaaatag

SEQ ID NO: 54649 - DNA, 18 bp, Artificial Sequence
  Synthetic DNA
taacacgagtgtcaattg

SEQ ID NO: 54650 - DNA, 18 bp, Artificial Sequence
  Synthetic DNA
taacacgattcacaaccg

SEQ ID NO: 54651 - DNA, 18 bp, Artificial Sequence
  Synthetic DNA
taacacgattctcagtag

SEQ ID NO: 54652 - DNA, 18 bp, Artificial Sequence
  Synthetic DNA
taacacgattgggtaaag

SEQ ID NO: 54653 - DNA, 18 bp, Artificial Sequence
  Synthetic DNA
taacacgcgtctctaaag

SEQ ID NO: 54654 - DNA, 18 bp, Artificial Sequence
  Synthetic DNA
taacacgtcacagtctag

SEQ ID NO: 54655 - DNA, 18 bp, Artificial Sequence
  Synthetic DNA
taacacgtctcaattttg

SEQ ID NO: 54656 - DNA, 18 bp, Artificial Sequence
  Synthetic DNA
taacacgtctttccagtg

SEQ ID NO: 54657 - DNA, 18 bp, Artificial Sequence
  Synthetic DNA
taacacgtttaactatcg

SEQ ID NO: 54658 - DNA, 18 bp, Artificial Sequence
  Synthetic DNA
taacacgtttcatcgtag

SEQ ID NO: 54659 - DNA, 18 bp, Artificial Sequence
  Synthetic DNA
taacactacacgttatag

SEQ ID NO: 54660 - DNA, 18 bp, Artificial Sequence
  Synthetic DNA
taacactacttatcctag

SEQ ID NO: 54661 - DNA, 18 bp, Artificial Sequence
  Synthetic DNA
taacactatatcctatag

SEQ ID NO: 54662 - DNA, 18 bp, Artificial Sequence
  Synthetic DNA
taacactgcttactattg

SEQ ID NO: 54663 - DNA, 18 bp, Artificial Sequence
  Synthetic DNA
taacagcgctcacttttg

SEQ ID NO: 54664 - DNA, 18 bp, Artificial Sequence
  Synthetic DNA
taacagggccctctttag

SEQ ID NO: 54665 - DNA, 18 bp, Artificial Sequence
  Synthetic DNA
taacataactcgctagag

SEQ ID NO: 54666 - DNA, 18 bp, Artificial Sequence
  Synthetic DNA
taacatatctaattgtag

SEQ ID NO: 54667 - DNA, 18 bp, Artificial Sequence
  Synthetic DNA
taacatgaattactacag

SEQ ID NO: 54668 - DNA, 18 bp, Artificial Sequence
  Synthetic DNA
taacatgacactcaatag

SEQ ID NO: 54669 - DNA, 18 bp, Artificial Sequence
  Synthetic DNA
taacatgacgctctctag

SEQ ID NO: 54670 - DNA, 18 bp, Artificial Sequence
  Synthetic DNA
taacatgcaacattataa

SEQ ID NO: 54671 - DNA, 18 bp, Artificial Sequence
  Synthetic DNA
taacatgcctcacattag

SEQ ID NO: 54672 - DNA, 18 bp, Artificial Sequence
  Synthetic DNA
taacatggctcaaattag

SEQ ID NO: 54673 - DNA, 18 bp, Artificial Sequence
  Synthetic DNA
taacattacactctatag

SEQ ID NO: 54674 - DNA, 18 bp, Artificial Sequence
  Synthetic DNA
taacattactcagtttag

SEQ ID NO: 54675 - DNA, 18 bp, Artificial Sequence
  Synthetic DNA
taacatttcttactatag

SEQ ID NO: 54676 - DNA, 18 bp, Artificial Sequence
  Synthetic DNA
taaccagactcaacattg

SEQ ID NO: 54677 - DNA, 18 bp, Artificial Sequence
  Synthetic DNA
taacccgacacactaatg

SEQ ID NO: 54678 - DNA, 18 bp, Artificial Sequence
  Synthetic DNA
taacccggctcaatacag

SEQ ID NO: 54679 - DNA, 18 bp, Artificial Sequence
  Synthetic DNA
taaccctacttactaacg

SEQ ID NO: 54680 - DNA, 18 bp, Artificial Sequence
  Synthetic DNA
taacgagactgtccatag

SEQ ID NO: 54681 - DNA, 18 bp, Artificial Sequence
  Synthetic DNA
taacgcacctctgtatag

SEQ ID NO: 54682 - DNA, 18 bp, Artificial Sequence
  Synthetic DNA
taacgccactcaccattg

SEQ ID NO: 54683 - DNA, 18 bp, Artificial Sequence
  Synthetic DNA
taacgtgacccattaaag

SEQ ID NO: 54684 - DNA, 18 bp, Artificial Sequence
  Synthetic DNA
taactagactcatgaaag

SEQ ID NO: 54685 - DNA, 18 bp, Artificial Sequence
  Synthetic DNA
taactagtaactctatag

SEQ ID NO: 54686 - DNA, 18 bp, Artificial Sequence
  Synthetic DNA
taactcctttcactaaag

SEQ ID NO: 54687 - DNA, 18 bp, Artificial Sequence
  Synthetic DNA
taactcgacaaaggatag

SEQ ID NO: 54688 - DNA, 18 bp, Artificial Sequence
  Synthetic DNA
taactcgacacacacttg

SEQ ID NO: 54689 - DNA, 18 bp, Artificial Sequence
  Synthetic DNA
taactcgacacaccaaag

SEQ ID NO: 54690 - DNA, 18 bp, Artificial Sequence
  Synthetic DNA
taactcgaccgacaattg

SEQ ID NO: 54691 - DNA, 18 bp, Artificial Sequence
  Synthetic DNA
taactcgactcaacaaag

SEQ ID NO: 54692 - DNA, 18 bp, Artificial Sequence
  Synthetic DNA
taactcgatattctttag

SEQ ID NO: 54693 - DNA, 18 bp, Artificial Sequence
  Synthetic DNA
taactcgattcacaaaag

SEQ ID NO: 54694 - DNA, 18 bp, Artificial Sequence
  Synthetic DNA
taactcgtctaaatattg

SEQ ID NO: 54695 - DNA, 18 bp, Artificial Sequence
  Synthetic DNA
taactcgtctccaaatag

SEQ ID NO: 54696 - DNA, 18 bp, Artificial Sequence
  Synthetic DNA
taactctacacaattggg

SEQ ID NO: 54697 - DNA, 18 bp, Artificial Sequence
  Synthetic DNA
taactctcctaactaaag

SEQ ID NO: 54698 - DNA, 18 bp, Artificial Sequence
  Synthetic DNA
taactcttctctcttaag

SEQ ID NO: 54699 - DNA, 18 bp, Artificial Sequence
  Synthetic DNA
taacttgactctatatag

SEQ ID NO: 54700 - DNA, 18 bp, Artificial Sequence
  Synthetic DNA
taacttgatttactctag

SEQ ID NO: 54701 - DNA, 18 bp, Artificial Sequence
  Synthetic DNA
taagacaagtctcaatag

SEQ ID NO: 54702 - DNA, 18 bp, Artificial Sequence
  Synthetic DNA
taagacgacactctggtg

SEQ ID NO: 54703 - DNA, 18 bp, Artificial Sequence
  Synthetic DNA
taagacgatcctattacg

SEQ ID NO: 54704 - DNA, 18 bp, Artificial Sequence
  Synthetic DNA
taagacgatttacataag

SEQ ID NO: 54705 - DNA, 18 bp, Artificial Sequence
  Synthetic DNA
taagacggctaaacatag

SEQ ID NO: 54706 - DNA, 18 bp, Artificial Sequence
  Synthetic DNA
taagacgtcttcctattg

SEQ ID NO: 54707 - DNA, 18 bp, Artificial Sequence
  Synthetic DNA
taagacgttacattatag

SEQ ID NO: 54708 - DNA, 18 bp, Artificial Sequence
  Synthetic DNA
taagacgtttcacattag

SEQ ID NO: 54709 - DNA, 18 bp, Artificial Sequence
  Synthetic DNA
taagagaactatctagag

SEQ ID NO: 54710 - DNA, 18 bp, Artificial Sequence
  Synthetic DNA
taagaggcgtcactattg

SEQ ID NO: 54711 - DNA, 18 bp, Artificial Sequence
  Synthetic DNA
taagaggtaatactatag

SEQ ID NO: 54712 - DNA, 18 bp, Artificial Sequence
  Synthetic DNA
taagaggtatcactattg

SEQ ID NO: 54713 - DNA, 18 bp, Artificial Sequence
  Synthetic DNA
taagatgacacgctaaag

SEQ ID NO: 54714 - DNA, 18 bp, Artificial Sequence
  Synthetic DNA
taagatgagtcaataccg

SEQ ID NO: 54715 - DNA, 18 bp, Artificial Sequence
  Synthetic DNA
taagatggctctctaaag

SEQ ID NO: 54716 - DNA, 18 bp, Artificial Sequence
  Synthetic DNA
taagattactcacatgag

SEQ ID NO: 54717 - DNA, 18 bp, Artificial Sequence
  Synthetic DNA
taaggagactgacaatag

SEQ ID NO: 54718 - DNA, 18 bp, Artificial Sequence
  Synthetic DNA
taaggcaactgagtctag

SEQ ID NO: 54719 - DNA, 18 bp, Artificial Sequence
  Synthetic DNA
taaggcgacacactccag

SEQ ID NO: 54720 - DNA, 18 bp, Artificial Sequence
  Synthetic DNA
taaggcgactttcaatag

SEQ ID NO: 54721 - DNA, 18 bp, Artificial Sequence
  Synthetic DNA
taagtgcacactcaatag

SEQ ID NO: 54722 - DNA, 18 bp, Artificial Sequence
  Synthetic DNA
taataaaagtcacataag

SEQ ID NO: 54723 - DNA, 18 bp, Artificial Sequence
  Synthetic DNA
taataaatctaactacag

SEQ ID NO: 54724 - DNA, 18 bp, Artificial Sequence
  Synthetic DNA
taataaatctcacaattg

SEQ ID NO: 54725 - DNA, 18 bp, Artificial Sequence
  Synthetic DNA
taataaatctcaccaaag

SEQ ID NO: 54726 - DNA, 18 bp, Artificial Sequence
  Synthetic DNA
taataaatctgactattg

SEQ ID NO: 54727 - DNA, 18 bp, Artificial Sequence
  Synthetic DNA
taataaatttctttttcg

SEQ ID NO: 54728 - DNA, 18 bp, Artificial Sequence
  Synthetic DNA
taataacacaatttactg

SEQ ID NO: 54729 - DNA, 18 bp, Artificial Sequence
  Synthetic DNA
taataacacagacaatag

SEQ ID NO: 54730 - DNA, 18 bp, Artificial Sequence
  Synthetic DNA
taataacactcttttatg

SEQ ID NO: 54731 - DNA, 18 bp, Artificial Sequence
  Synthetic DNA
taataagaaaggcttaag

SEQ ID NO: 54732 - DNA, 18 bp, Artificial Sequence
  Synthetic DNA
taataagaatcatcattg

SEQ ID NO: 54733 - DNA, 18 bp, Artificial Sequence
  Synthetic DNA
taataagacaaacaatgg

SEQ ID NO: 54734 - DNA, 18 bp, Artificial Sequence
  Synthetic DNA
taataagacacactgctg

SEQ ID NO: 54735 - DNA, 18 bp, Artificial Sequence
  Synthetic DNA
taataagacacgcgttag

SEQ ID NO: 54736 - DNA, 18 bp, Artificial Sequence
  Synthetic DNA
taataagacccactgatg

SEQ ID NO: 54737 - DNA, 18 bp, Artificial Sequence
  Synthetic DNA
taataagacgcacgtaag

SEQ ID NO: 54738 - DNA, 18 bp, Artificial Sequence
  Synthetic DNA
taataagactatatttag

SEQ ID NO: 54739 - DNA, 18 bp, Artificial Sequence
  Synthetic DNA
taataagactcaaatatg

SEQ ID NO: 54740 - DNA, 18 bp, Artificial Sequence
  Synthetic DNA
taataagactcaactaag

SEQ ID NO: 54741 - DNA, 18 bp, Artificial Sequence
  Synthetic DNA
taataagactccccttgg

SEQ ID NO: 54742 - DNA, 18 bp, Artificial Sequence
  Synthetic DNA
taataagactcgctgctg

SEQ ID NO: 54743 - DNA, 18 bp, Artificial Sequence
  Synthetic DNA
taataagactctagttag

SEQ ID NO: 54744 - DNA, 18 bp, Artificial Sequence
  Synthetic DNA
taataagactctcagatg

SEQ ID NO: 54745 - DNA, 18 bp, Artificial Sequence
  Synthetic DNA
taataagacttccagtag

SEQ ID NO: 54746 - DNA, 18 bp, Artificial Sequence
  Synthetic DNA
taataagatactctattg

SEQ ID NO: 54747 - DNA, 18 bp, Artificial Sequence
  Synthetic DNA
taataagatatactttag

SEQ ID NO: 54748 - DNA, 18 bp, Artificial Sequence
  Synthetic DNA
taataagattctatatat

SEQ ID NO: 54749 - DNA, 18 bp, Artificial Sequence
  Synthetic DNA
taataagattctcttatg

SEQ ID NO: 54750 - DNA, 18 bp, Artificial Sequence
  Synthetic DNA
taataaggctaacaattg

SEQ ID NO: 54751 - DNA, 18 bp, Artificial Sequence
  Synthetic DNA
taataagtatgactgcag

SEQ ID NO: 54752 - DNA, 18 bp, Artificial Sequence
  Synthetic DNA
taataagtcaaattgtag

SEQ ID NO: 54753 - DNA, 18 bp, Artificial Sequence
  Synthetic DNA
taataagtcatacctaag

SEQ ID NO: 54754 - DNA, 18 bp, Artificial Sequence
  Synthetic DNA
taataagtccaactaatg

SEQ ID NO: 54755 - DNA, 18 bp, Artificial Sequence
  Synthetic DNA
taataagtctaactccag

SEQ ID NO: 54756 - DNA, 18 bp, Artificial Sequence
  Synthetic DNA
taataagtctcagtctcg

SEQ ID NO: 54757 - DNA, 18 bp, Artificial Sequence
  Synthetic DNA
taataagtctctgttcag

SEQ ID NO: 54758 - DNA, 18 bp, Artificial Sequence
  Synthetic DNA
taataagtgactttatag

SEQ ID NO: 54759 - DNA, 18 bp, Artificial Sequence
  Synthetic DNA
taataagtgtaacaaatg

SEQ ID NO: 54760 - DNA, 18 bp, Artificial Sequence
  Synthetic DNA
taataagttacagtatgg

SEQ ID NO: 54761 - DNA, 18 bp, Artificial Sequence
  Synthetic DNA
taataagttccactgtag

SEQ ID NO: 54762 - DNA, 18 bp, Artificial Sequence
  Synthetic DNA
taataagtttcgctattg

SEQ ID NO: 54763 - DNA, 18 bp, Artificial Sequence
  Synthetic DNA
taataagtttgaccttag

SEQ ID NO: 54764 - DNA, 18 bp, Artificial Sequence
  Synthetic DNA
taataatacaatccatag

SEQ ID NO: 54765 - DNA, 18 bp, Artificial Sequence
  Synthetic DNA
taataatactatctttag

SEQ ID NO: 54766 - DNA, 18 bp, Artificial Sequence
  Synthetic DNA
taataatactcaccgacg

SEQ ID NO: 54767 - DNA, 18 bp, Artificial Sequence
  Synthetic DNA
taataatactcgaaatag

SEQ ID NO: 54768 - DNA, 18 bp, Artificial Sequence
  Synthetic DNA
taataatactgacaatgg

SEQ ID NO: 54769 - DNA, 18 bp, Artificial Sequence
  Synthetic DNA
taataatacttagtattg

SEQ ID NO: 54770 - DNA, 18 bp, Artificial Sequence
  Synthetic DNA
taataatattccgtttag

SEQ ID NO: 54771 - DNA, 18 bp, Artificial Sequence
  Synthetic DNA
taataatcctcacaaaag

SEQ ID NO: 54772 - DNA, 18 bp, Artificial Sequence
  Synthetic DNA
taataatcctccataaag

SEQ ID NO: 54773 - DNA, 18 bp, Artificial Sequence
  Synthetic DNA
taataatcttcacttaag

SEQ ID NO: 54774 - DNA, 18 bp, Artificial Sequence
  Synthetic DNA
taataattatcaagatag

SEQ ID NO: 54775 - DNA, 18 bp, Artificial Sequence
  Synthetic DNA
taataattctaactaaag

SEQ ID NO: 54776 - DNA, 18 bp, Artificial Sequence
  Synthetic DNA
taataattctcaataaag

SEQ ID NO: 54777 - DNA, 18 bp, Artificial Sequence
  Synthetic DNA
taataattctctcttttg

SEQ ID NO: 54778 - DNA, 18 bp, Artificial Sequence
  Synthetic DNA
taataattctgactagcg

SEQ ID NO: 54779 - DNA, 18 bp, Artificial Sequence
  Synthetic DNA
taataattcttactattg

SEQ ID NO: 54780 - DNA, 18 bp, Artificial Sequence
  Synthetic DNA
taatacaaatctatattg

SEQ ID NO: 54781 - DNA, 18 bp, Artificial Sequence
  Synthetic DNA
taatacaacaaaggatag

SEQ ID NO: 54782 - DNA, 18 bp, Artificial Sequence
  Synthetic DNA
taatacaacatccgatag

SEQ ID NO: 54783 - DNA, 18 bp, Artificial Sequence
  Synthetic DNA
taatacaacattctaatg

SEQ ID NO: 54784 - DNA, 18 bp, Artificial Sequence
  Synthetic DNA
taatacaacctgttaagg

SEQ ID NO: 54785 - DNA, 18 bp, Artificial Sequence
  Synthetic DNA
taatacaactagatattg

SEQ ID NO: 54786 - DNA, 18 bp, Artificial Sequence
  Synthetic DNA
taatacaactgcttatcg

SEQ ID NO: 54787 - DNA, 18 bp, Artificial Sequence
  Synthetic DNA
taatacaacttattccag

SEQ ID NO: 54788 - DNA, 18 bp, Artificial Sequence
  Synthetic DNA
taatacaagtatctttag

SEQ ID NO: 54789 - DNA, 18 bp, Artificial Sequence
  Synthetic DNA
taatacaataaactgtag

SEQ ID NO: 54790 - DNA, 18 bp, Artificial Sequence
  Synthetic DNA
taatacaataatttatag

SEQ ID NO: 54791 - DNA, 18 bp, Artificial Sequence
  Synthetic DNA
taatacaatacataaaag

SEQ ID NO: 54792 - DNA, 18 bp, Artificial Sequence
  Synthetic DNA
taatacaatactctctcg

SEQ ID NO: 54793 - DNA, 18 bp, Artificial Sequence
  Synthetic DNA
taatacaattaacaaaag

SEQ ID NO: 54794 - DNA, 18 bp, Artificial Sequence
  Synthetic DNA
taatacaattaactactg

SEQ ID NO: 54795 - DNA, 18 bp, Artificial Sequence
  Synthetic DNA
taatacaccactctattg

SEQ ID NO: 54796 - DNA, 18 bp, Artificial Sequence
  Synthetic DNA
taatacacctaagtaaag

SEQ ID NO: 54797 - DNA, 18 bp, Artificial Sequence
  Synthetic DNA
taatacaccttgttatag

SEQ ID NO: 54798 - DNA, 18 bp, Artificial Sequence
  Synthetic DNA
taatacagattattttag

SEQ ID NO: 54799 - DNA, 18 bp, Artificial Sequence
  Synthetic DNA
taatacagctctgaacag

SEQ ID NO: 54800 - DNA, 18 bp, Artificial Sequence
  Synthetic DNA
taatacagctttctcaag

SEQ ID NO: 54801 - DNA, 18 bp, Artificial Sequence
  Synthetic DNA
taatacataccgttaaag

SEQ ID NO: 54802 - DNA, 18 bp, Artificial Sequence
  Synthetic DNA
taatacatatcccaatag

SEQ ID NO: 54803 - DNA, 18 bp, Artificial Sequence
  Synthetic DNA
taatacatcacaataaag

SEQ ID NO: 54804 - DNA, 18 bp, Artificial Sequence
  Synthetic DNA
taatacatcacatcatag

SEQ ID NO: 54805 - DNA, 18 bp, Artificial Sequence
  Synthetic DNA
taatacatcccaaaatag

SEQ ID NO: 54806 - DNA, 18 bp, Artificial Sequence
  Synthetic DNA
taatacatcccccttatg

SEQ ID NO: 54807 - DNA, 18 bp, Artificial Sequence
  Synthetic DNA
taatacatctcaaataag

SEQ ID NO: 54808 - DNA, 18 bp, Artificial Sequence
  Synthetic DNA
taatacatctccctccag

SEQ ID NO: 54809 - DNA, 18 bp, Artificial Sequence
  Synthetic DNA
taatacatctcttcaaag

SEQ ID NO: 54810 - DNA, 18 bp, Artificial Sequence
  Synthetic DNA
taataccacaatcttaag

SEQ ID NO: 54811 - DNA, 18 bp, Artificial Sequence
  Synthetic DNA
taataccacactcattaa

SEQ ID NO: 54812 - DNA, 18 bp, Artificial Sequence
  Synthetic DNA
taataccacactgaatag

SEQ ID NO: 54813 - DNA, 18 bp, Artificial Sequence
  Synthetic DNA
taataccacccatgattg

SEQ ID NO: 54814 - DNA, 18 bp, Artificial Sequence
  Synthetic DNA
taataccatacagtcagg

SEQ ID NO: 54815 - DNA, 18 bp, Artificial Sequence
  Synthetic DNA
taataccattctcattag

SEQ ID NO: 54816 - DNA, 18 bp, Artificial Sequence
  Synthetic DNA
taataccctacaatatag

SEQ ID NO: 54817 - DNA, 18 bp, Artificial Sequence
  Synthetic DNA
taataccctactcaatag

SEQ ID NO: 54818 - DNA, 18 bp, Artificial Sequence
  Synthetic DNA
taatacctctaattatgg

SEQ ID NO: 54819 - DNA, 18 bp, Artificial Sequence
  Synthetic DNA
taatacctctcaatccag

SEQ ID NO: 54820 - DNA, 18 bp, Artificial Sequence
  Synthetic DNA
taatacctctgacattgg

SEQ ID NO: 54821 - DNA, 18 bp, Artificial Sequence
  Synthetic DNA
taatacctcttcatttag

SEQ ID NO: 54822 - DNA, 18 bp, Artificial Sequence
  Synthetic DNA
taatacctttcgctattg

SEQ ID NO: 54823 - DNA, 18 bp, Artificial Sequence
  Synthetic DNA
taatacctttgactaaag

SEQ ID NO: 54824 - DNA, 18 bp, Artificial Sequence
  Synthetic DNA
taatacgaaacagaaaag

SEQ ID NO: 54825 - DNA, 18 bp, Artificial Sequence
  Synthetic DNA
taatacgaaaccctagtg

SEQ ID NO: 54826 - DNA, 18 bp, Artificial Sequence
  Synthetic DNA
taatacgaaccagaaaag

SEQ ID NO: 54827 - DNA, 18 bp, Artificial Sequence
  Synthetic DNA
taatacgaataatcagag

SEQ ID NO: 54828 - DNA, 18 bp, Artificial Sequence
  Synthetic DNA
taatacgaattacttagg

SEQ ID NO: 54829 - DNA, 18 bp, Artificial Sequence
  Synthetic DNA
taatacgaattctttttg

SEQ ID NO: 54830 - DNA, 18 bp, Artificial Sequence
  Synthetic DNA
taatacgaatttaaaatg

SEQ ID NO: 54831 - DNA, 18 bp, Artificial Sequence
  Synthetic DNA
taatacgacaatacatag

SEQ ID NO: 54832 - DNA, 18 bp, Artificial Sequence
  Synthetic DNA
taatacgacacgctcatg

SEQ ID NO: 54833 - DNA, 18 bp, Artificial Sequence
  Synthetic DNA
taatacgacactcttacg

SEQ ID NO: 54834 - DNA, 18 bp, Artificial Sequence
  Synthetic DNA
taatacgaccctgcgttg

SEQ ID NO: 54835 - DNA, 18 bp, Artificial Sequence
  Synthetic DNA
taatacgacgttgtgctg

SEQ ID NO: 54836 - DNA, 18 bp, Artificial Sequence
  Synthetic DNA
taatacgactagttactg

SEQ ID NO: 54837 - DNA, 18 bp, Artificial Sequence
  Synthetic DNA
taatacgactatgattag

SEQ ID NO: 54838 - DNA, 18 bp, Artificial Sequence
  Synthetic DNA
taatacgactatttttgg

SEQ ID NO: 54839 - DNA, 18 bp, Artificial Sequence
  Synthetic DNA
taatacgactcatagatg

SEQ ID NO: 54840 - DNA, 18 bp, Artificial Sequence
  Synthetic DNA
taatacgactcttggttg

SEQ ID NO: 54841 - DNA, 18 bp, Artificial Sequence
  Synthetic DNA
taatacgagacacttatg

SEQ ID NO: 54842 - DNA, 18 bp, Artificial Sequence
  Synthetic DNA
taatacgagcaactaagg

SEQ ID NO: 54843 - DNA, 18 bp, Artificial Sequence
  Synthetic DNA
taatacgaggctttatgg

SEQ ID NO: 54844 - DNA, 18 bp, Artificial Sequence
  Synthetic DNA
taatacgataaagtatgg

SEQ ID NO: 54845 - DNA, 18 bp, Artificial Sequence
  Synthetic DNA
taatacgataaattgaag

SEQ ID NO: 54846 - DNA, 18 bp, Artificial Sequence
  Synthetic DNA
taatacgatactcttcag

SEQ ID NO: 54847 - DNA, 18 bp, Artificial Sequence
  Synthetic DNA
taatacgatcttctaaag

SEQ ID NO: 54848 - DNA, 18 bp, Artificial Sequence
  Synthetic DNA
taatacgatgcacgactg

SEQ ID NO: 54849 - DNA, 18 bp, Artificial Sequence
  Synthetic DNA
taatacgattaatttctg

SEQ ID NO: 54850 - DNA, 18 bp, Artificial Sequence
  Synthetic DNA
taatacgattatcttcag

SEQ ID NO: 54851 - DNA, 18 bp, Artificial Sequence
  Synthetic DNA
taatacgattatgtacag

SEQ ID NO: 54852 - DNA, 18 bp, Artificial Sequence
  Synthetic DNA
taatacgattttctaacg

SEQ ID NO: 54853 - DNA, 18 bp, Artificial Sequence
  Synthetic DNA
taatacgattttctcttg

SEQ ID NO: 54854 - DNA, 18 bp, Artificial Sequence
  Synthetic DNA
taatacgcatccatattg

SEQ ID NO: 54855 - DNA, 18 bp, Artificial Sequence
  Synthetic DNA
taatacgccatgctttag

SEQ ID NO: 54856 - DNA, 18 bp, Artificial Sequence
  Synthetic DNA
taatacgcgacacaacag

SEQ ID NO: 54857 - DNA, 18 bp, Artificial Sequence
  Synthetic DNA
taatacgctacacttttg

SEQ ID NO: 54858 - DNA, 18 bp, Artificial Sequence
  Synthetic DNA
taatacgcttctctaatg

SEQ ID NO: 54859 - DNA, 18 bp, Artificial Sequence
  Synthetic DNA
taatacggcaaataatcg

SEQ ID NO: 54860 - DNA, 18 bp, Artificial Sequence
  Synthetic DNA
taatacggccgaataaag

SEQ ID NO: 54861 - DNA, 18 bp, Artificial Sequence
  Synthetic DNA
taatacggcttttaatcg

SEQ ID NO: 54862 - DNA, 18 bp, Artificial Sequence
  Synthetic DNA
taatacggtctaacatag

SEQ ID NO: 54863 - DNA, 18 bp, Artificial Sequence
  Synthetic DNA
taatacgtaagactaaag

SEQ ID NO: 54864 - DNA, 18 bp, Artificial Sequence
  Synthetic DNA
taatacgtaagatttgag

SEQ ID NO: 54865 - DNA, 18 bp, Artificial Sequence
  Synthetic DNA
taatacgtaatacattag

SEQ ID NO: 54866 - DNA, 18 bp, Artificial Sequence
  Synthetic DNA
taatacgtataaccacag

SEQ ID NO: 54867 - DNA, 18 bp, Artificial Sequence
  Synthetic DNA
taatacgtatcacctttg

SEQ ID NO: 54868 - DNA, 18 bp, Artificial Sequence
  Synthetic DNA
taatacgtatccatctag

SEQ ID NO: 54869 - DNA, 18 bp, Artificial Sequence
  Synthetic DNA
taatacgtattgctccag

SEQ ID NO: 54870 - DNA, 18 bp, Artificial Sequence
  Synthetic DNA
taatacgtcaccctttcg

SEQ ID NO: 54871 - DNA, 18 bp, Artificial Sequence
  Synthetic DNA
taatacgtcactatattg

SEQ ID NO: 54872 - DNA, 18 bp, Artificial Sequence
  Synthetic DNA
taatacgtcactgtctag

SEQ ID NO: 54873 - DNA, 18 bp, Artificial Sequence
  Synthetic DNA
taatacgtccctatgtag

SEQ ID NO: 54874 - DNA, 18 bp, Artificial Sequence
  Synthetic DNA
taatacgtccttctattg

SEQ ID NO: 54875 - DNA, 18 bp, Artificial Sequence
  Synthetic DNA
taatacgtcgctttttag

SEQ ID NO: 54876 - DNA, 18 bp, Artificial Sequence
  Synthetic DNA
taatacgtcttaggattg

SEQ ID NO: 54877 - DNA, 18 bp, Artificial Sequence
  Synthetic DNA
taatacgtgactctatgg

SEQ ID NO: 54878 - DNA, 18 bp, Artificial Sequence
  Synthetic DNA
taatacgtgtcagcattg

SEQ ID NO: 54879 - DNA, 18 bp, Artificial Sequence
  Synthetic DNA
taatacgtgtctccttag

SEQ ID NO: 54880 - DNA, 18 bp, Artificial Sequence
  Synthetic DNA
taatacgttacaccatgg

SEQ ID NO: 54881 - DNA, 18 bp, Artificial Sequence
  Synthetic DNA
taatacgttagattatag

SEQ ID NO: 54882 - DNA, 18 bp, Artificial Sequence
  Synthetic DNA
taatacgttatattcaag

SEQ ID NO: 54883 - DNA, 18 bp, Artificial Sequence
  Synthetic DNA
taatacgttccgttattg

SEQ ID NO: 54884 - DNA, 18 bp, Artificial Sequence
  Synthetic DNA
taatacgttcttcgtcag

SEQ ID NO: 54885 - DNA, 18 bp, Artificial Sequence
  Synthetic DNA
taatacgttgaacaatag

SEQ ID NO: 54886 - DNA, 18 bp, Artificial Sequence
  Synthetic DNA
taatacgtttcataattg

SEQ ID NO: 54887 - DNA, 18 bp, Artificial Sequence
  Synthetic DNA
taatacgtttcatttagg

SEQ ID NO: 54888 - DNA, 18 bp, Artificial Sequence
  Synthetic DNA
taatactaataattaaag

SEQ ID NO: 54889 - DNA, 18 bp, Artificial Sequence
  Synthetic DNA
taatactacaaacaattg

SEQ ID NO: 54890 - DNA, 18 bp, Artificial Sequence
  Synthetic DNA
taatactacacagttctg

SEQ ID NO: 54891 - DNA, 18 bp, Artificial Sequence
  Synthetic DNA
taatactacacatgttag

SEQ ID NO: 54892 - DNA, 18 bp, Artificial Sequence
  Synthetic DNA
taatactacactcctttg

SEQ ID NO: 54893 - DNA, 18 bp, Artificial Sequence
  Synthetic DNA
taatactacccaaaatgg

SEQ ID NO: 54894 - DNA, 18 bp, Artificial Sequence
  Synthetic DNA
taatactactctattttg

SEQ ID NO: 54895 - DNA, 18 bp, Artificial Sequence
  Synthetic DNA
taatactactgacttctg

SEQ ID NO: 54896 - DNA, 18 bp, Artificial Sequence
  Synthetic DNA
taatactactgtttactg

SEQ ID NO: 54897 - DNA, 18 bp, Artificial Sequence
  Synthetic DNA
taatactagttaatttag

SEQ ID NO: 54898 - DNA, 18 bp, Artificial Sequence
  Synthetic DNA
taatactattaacaatgg

SEQ ID NO: 54899 - DNA, 18 bp, Artificial Sequence
  Synthetic DNA
taatactattatcttatg

SEQ ID NO: 54900 - DNA, 18 bp, Artificial Sequence
  Synthetic DNA
taatactattcacctttg

SEQ ID NO: 54901 - DNA, 18 bp, Artificial Sequence
  Synthetic DNA
taatactattcgttttag

SEQ ID NO: 54902 - DNA, 18 bp, Artificial Sequence
  Synthetic DNA
taatactattgtctattg

SEQ ID NO: 54903 - DNA, 18 bp, Artificial Sequence
  Synthetic DNA
taatactatttactgaag

SEQ ID NO: 54904 - DNA, 18 bp, Artificial Sequence
  Synthetic DNA
taatactccactcaatag

SEQ ID NO: 54905 - DNA, 18 bp, Artificial Sequence
  Synthetic DNA
taatactccttataatag

SEQ ID NO: 54906 - DNA, 18 bp, Artificial Sequence
  Synthetic DNA
taatactgcccaccgtag

SEQ ID NO: 54907 - DNA, 18 bp, Artificial Sequence
  Synthetic DNA
taatactgtacactaaag

SEQ ID NO: 54908 - DNA, 18 bp, Artificial Sequence
  Synthetic DNA
taatacttacccttttag

SEQ ID NO: 54909 - DNA, 18 bp, Artificial Sequence
  Synthetic DNA
taatacttatcgctacag

SEQ ID NO: 54910 - DNA, 18 bp, Artificial Sequence
  Synthetic DNA
taatacttcacaatactg

SEQ ID NO: 54911 - DNA, 18 bp, Artificial Sequence
  Synthetic DNA
taatacttccaactttag

SEQ ID NO: 54912 - DNA, 18 bp, Artificial Sequence
  Synthetic DNA
taatacttcccacttgtg

SEQ ID NO: 54913 - DNA, 18 bp, Artificial Sequence
  Synthetic DNA
taatacttcttaatatgg

SEQ ID NO: 54914 - DNA, 18 bp, Artificial Sequence
  Synthetic DNA
taatacttcttcctaagg

SEQ ID NO: 54915 - DNA, 18 bp, Artificial Sequence
  Synthetic DNA
taatactttacattatag

SEQ ID NO: 54916 - DNA, 18 bp, Artificial Sequence
  Synthetic DNA
taatacttttcagcattg

SEQ ID NO: 54917 - DNA, 18 bp, Artificial Sequence
  Synthetic DNA
taatacttttcatcatag

SEQ ID NO: 54918 - DNA, 18 bp, Artificial Sequence
  Synthetic DNA
taatacttttcgcttaag

SEQ ID NO: 54919 - DNA, 18 bp, Artificial Sequence
  Synthetic DNA
taatagaactaacctttg

SEQ ID NO: 54920 - DNA, 18 bp, Artificial Sequence
  Synthetic DNA
taatagaattctctattg

SEQ ID NO: 54921 - DNA, 18 bp, Artificial Sequence
  Synthetic DNA
taatagatctgtcgattg

SEQ ID NO: 54922 - DNA, 18 bp, Artificial Sequence
  Synthetic DNA
taatagcacactctttag

SEQ ID NO: 54923 - DNA, 18 bp, Artificial Sequence
  Synthetic DNA
taatagcattcataaaag

SEQ ID NO: 54924 - DNA, 18 bp, Artificial Sequence
  Synthetic DNA
taataggaagtactgtag

SEQ ID NO: 54925 - DNA, 18 bp, Artificial Sequence
  Synthetic DNA
taataggaatctccattg

SEQ ID NO: 54926 - DNA, 18 bp, Artificial Sequence
  Synthetic DNA
taataggacacacaactg

SEQ ID NO: 54927 - DNA, 18 bp, Artificial Sequence
  Synthetic DNA
taataggacccatcatgg

SEQ ID NO: 54928 - DNA, 18 bp, Artificial Sequence
  Synthetic DNA
taataggaccccctaagg

SEQ ID NO: 54929 - DNA, 18 bp, Artificial Sequence
  Synthetic DNA
taataggagtcaataacg

SEQ ID NO: 54930 - DNA, 18 bp, Artificial Sequence
  Synthetic DNA
taataggagtctaaatag

SEQ ID NO: 54931 - DNA, 18 bp, Artificial Sequence
  Synthetic DNA
taataggatgctctattg

SEQ ID NO: 54932 - DNA, 18 bp, Artificial Sequence
  Synthetic DNA
taataggattccataaag

SEQ ID NO: 54933 - DNA, 18 bp, Artificial Sequence
  Synthetic DNA
taataggcctctgtattg

SEQ ID NO: 54934 - DNA, 18 bp, Artificial Sequence
  Synthetic DNA
taataggtattactttag

SEQ ID NO: 54935 - DNA, 18 bp, Artificial Sequence
  Synthetic DNA
taataggtttctatatag

SEQ ID NO: 54936 - DNA, 18 bp, Artificial Sequence
  Synthetic DNA
taatataaatctctatcg

SEQ ID NO: 54937 - DNA, 18 bp, Artificial Sequence
  Synthetic DNA
taatataacactttatag

SEQ ID NO: 54938 - DNA, 18 bp, Artificial Sequence
  Synthetic DNA
taatataactaaccctag

SEQ ID NO: 54939 - DNA, 18 bp, Artificial Sequence
  Synthetic DNA
taatataacttgccttag

SEQ ID NO: 54940 - DNA, 18 bp, Artificial Sequence
  Synthetic DNA
taatataattacctttag

SEQ ID NO: 54941 - DNA, 18 bp, Artificial Sequence
  Synthetic DNA
taatataattgcctacag

SEQ ID NO: 54942 - DNA, 18 bp, Artificial Sequence
  Synthetic DNA
taatatacttccgtatgg

SEQ ID NO: 54943 - DNA, 18 bp, Artificial Sequence
  Synthetic DNA
taatatagccctcaatag

SEQ ID NO: 54944 - DNA, 18 bp, Artificial Sequence
  Synthetic DNA
taatatatgacgctatag

SEQ ID NO: 54945 - DNA, 18 bp, Artificial Sequence
  Synthetic DNA
taatatcaattattcttg

SEQ ID NO: 54946 - DNA, 18 bp, Artificial Sequence
  Synthetic DNA
taatatcacacaatattg

SEQ ID NO: 54947 - DNA, 18 bp, Artificial Sequence
  Synthetic DNA
taatatcacttattgtag

SEQ ID NO: 54948 - DNA, 18 bp, Artificial Sequence
  Synthetic DNA
taatatccctctctttag

SEQ ID NO: 54949 - DNA, 18 bp, Artificial Sequence
  Synthetic DNA
taatatctatctctttag

SEQ ID NO: 54950 - DNA, 18 bp, Artificial Sequence
  Synthetic DNA
taatatctctcactaacg

SEQ ID NO: 54951 - DNA, 18 bp, Artificial Sequence
  Synthetic DNA
taatatgaactaaaagag

SEQ ID NO: 54952 - DNA, 18 bp, Artificial Sequence
  Synthetic DNA
taatatgaagctccctag

SEQ ID NO: 54953 - DNA, 18 bp, Artificial Sequence
  Synthetic DNA
taatatgaatccgtttag

SEQ ID NO: 54954 - DNA, 18 bp, Artificial Sequence
  Synthetic DNA
taatatgacaaactaccg

SEQ ID NO: 54955 - DNA, 18 bp, Artificial Sequence
  Synthetic DNA
taatatgacaaataatgg

SEQ ID NO: 54956 - DNA, 18 bp, Artificial Sequence
  Synthetic DNA
taatatgacaaccaatag

SEQ ID NO: 54957 - DNA, 18 bp, Artificial Sequence
  Synthetic DNA
taatatgacgttttgcag

SEQ ID NO: 54958 - DNA, 18 bp, Artificial Sequence
  Synthetic DNA
taatatgactcatctttg

SEQ ID NO: 54959 - DNA, 18 bp, Artificial Sequence
  Synthetic DNA
taatatgactctcttagg

SEQ ID NO: 54960 - DNA, 18 bp, Artificial Sequence
  Synthetic DNA
taatatgactgtctgttg

SEQ ID NO: 54961 - DNA, 18 bp, Artificial Sequence
  Synthetic DNA
taatatgactgtttttag

SEQ ID NO: 54962 - DNA, 18 bp, Artificial Sequence
  Synthetic DNA
taatatgagacattgttg

SEQ ID NO: 54963 - DNA, 18 bp, Artificial Sequence
  Synthetic DNA
taatatgaggaactattg

SEQ ID NO: 54964 - DNA, 18 bp, Artificial Sequence
  Synthetic DNA
taatatgataatcaaaag

SEQ ID NO: 54965 - DNA, 18 bp, Artificial Sequence
  Synthetic DNA
taatatgattcacttggg

SEQ ID NO: 54966 - DNA, 18 bp, Artificial Sequence
  Synthetic DNA
taatatgattcgcttttg

SEQ ID NO: 54967 - DNA, 18 bp, Artificial Sequence
  Synthetic DNA
taatatgattcggtctag

SEQ ID NO: 54968 - DNA, 18 bp, Artificial Sequence
  Synthetic DNA
taatatgattctgtaaag

SEQ ID NO: 54969 - DNA, 18 bp, Artificial Sequence
  Synthetic DNA
taatatgccactcaaacg

SEQ ID NO: 54970 - DNA, 18 bp, Artificial Sequence
  Synthetic DNA
taatatgcctaacttttg

SEQ ID NO: 54971 - DNA, 18 bp, Artificial Sequence
  Synthetic DNA
taatatggtttactaaag

SEQ ID NO: 54972 - DNA, 18 bp, Artificial Sequence
  Synthetic DNA
taatatgtatcataatgg

SEQ ID NO: 54973 - DNA, 18 bp, Artificial Sequence
  Synthetic DNA
taatatgtatcgccatag

SEQ ID NO: 54974 - DNA, 18 bp, Artificial Sequence
  Synthetic DNA
taatatgtcacatcttag

SEQ ID NO: 54975 - DNA, 18 bp, Artificial Sequence
  Synthetic DNA
taatatgtcatattatag

SEQ ID NO: 54976 - DNA, 18 bp, Artificial Sequence
  Synthetic DNA
taatatgtctaagtacag

SEQ ID NO: 54977 - DNA, 18 bp, Artificial Sequence
  Synthetic DNA
taatatgtctcacttacg

SEQ ID NO: 54978 - DNA, 18 bp, Artificial Sequence
  Synthetic DNA
taatatgtctgtgtaatg

SEQ ID NO: 54979 - DNA, 18 bp, Artificial Sequence
  Synthetic DNA
taatatgtttgtccattg

SEQ ID NO: 54980 - DNA, 18 bp, Artificial Sequence
  Synthetic DNA
taatatgttttactatcg

SEQ ID NO: 54981 - DNA, 18 bp, Artificial Sequence
  Synthetic DNA
taatattacaccctgttg

SEQ ID NO: 54982 - DNA, 18 bp, Artificial Sequence
  Synthetic DNA
taatattacagtcactag

SEQ ID NO: 54983 - DNA, 18 bp, Artificial Sequence
  Synthetic DNA
taatattacccttctaag

SEQ ID NO: 54984 - DNA, 18 bp, Artificial Sequence
  Synthetic DNA
taatattactatcaatag

SEQ ID NO: 54985 - DNA, 18 bp, Artificial Sequence
  Synthetic DNA
taatattacttaatatcg

SEQ ID NO: 54986 - DNA, 18 bp, Artificial Sequence
  Synthetic DNA
taatattccttactatgg

SEQ ID NO: 54987 - DNA, 18 bp, Artificial Sequence
  Synthetic DNA
taatatttatcacaatag

SEQ ID NO: 54988 - DNA, 18 bp, Artificial Sequence
  Synthetic DNA
taatatttcacaataaag

SEQ ID NO: 54989 - DNA, 18 bp, Artificial Sequence
  Synthetic DNA
taatatttctcacaatgg

SEQ ID NO: 54990 - DNA, 18 bp, Artificial Sequence
  Synthetic DNA
taatatttctccctatcg

SEQ ID NO: 54991 - DNA, 18 bp, Artificial Sequence
  Synthetic DNA
taatatttcttgccatag

SEQ ID NO: 54992 - DNA, 18 bp, Artificial Sequence
  Synthetic DNA
taatcagattccataaag

SEQ ID NO: 54993 - DNA, 18 bp, Artificial Sequence
  Synthetic DNA
taatcagggcctctatag

SEQ ID NO: 54994 - DNA, 18 bp, Artificial Sequence
  Synthetic DNA
taatcatacacactagtg

SEQ ID NO: 54995 - DNA, 18 bp, Artificial Sequence
  Synthetic DNA
taatccaactcacatttg

SEQ ID NO: 54996 - DNA, 18 bp, Artificial Sequence
  Synthetic DNA
taatccaatacattatag

SEQ ID NO: 54997 - DNA, 18 bp, Artificial Sequence
  Synthetic DNA
taatccaattatctatag

SEQ ID NO: 54998 - DNA, 18 bp, Artificial Sequence
  Synthetic DNA
taatccaggtcacaaaag

SEQ ID NO: 54999 - DNA, 18 bp, Artificial Sequence
  Synthetic DNA
taatccatctctcttttg

SEQ ID NO: 55000 - DNA, 18 bp, Artificial Sequence
  Synthetic DNA
taatcccattctatatag

SEQ ID NO: 55001 - DNA, 18 bp, Artificial Sequence
  Synthetic DNA
taatccctttcattatag

SEQ ID NO: 55002 - DNA, 18 bp, Artificial Sequence
  Synthetic DNA
taatccgaataattgtag

SEQ ID NO: 55003 - DNA, 18 bp, Artificial Sequence
  Synthetic DNA
taatccgacactatgtgg

SEQ ID NO: 55004 - DNA, 18 bp, Artificial Sequence
  Synthetic DNA
taatccgactgaataatg

SEQ ID NO: 55005 - DNA, 18 bp, Artificial Sequence
  Synthetic DNA
taatccgagatacaaatg

SEQ ID NO: 55006 - DNA, 18 bp, Artificial Sequence
  Synthetic DNA
taatccgatacaataaag

SEQ ID NO: 55007 - DNA, 18 bp, Artificial Sequence
  Synthetic DNA
taatccgatagtctagag

SEQ ID NO: 55008 - DNA, 18 bp, Artificial Sequence
  Synthetic DNA
taatccgatatatattag

SEQ ID NO: 55009 - DNA, 18 bp, Artificial Sequence
  Synthetic DNA
taatccgattcttcttag

SEQ ID NO: 55010 - DNA, 18 bp, Artificial Sequence
  Synthetic DNA
taatccgtgtctatattg

SEQ ID NO: 55011 - DNA, 18 bp, Artificial Sequence
  Synthetic DNA
taatcctaataattattg

SEQ ID NO: 55012 - DNA, 18 bp, Artificial Sequence
  Synthetic DNA
taatcctaatctaatttg

SEQ ID NO: 55013 - DNA, 18 bp, Artificial Sequence
  Synthetic DNA
taatccttcacagttttg

SEQ ID NO: 55014 - DNA, 18 bp, Artificial Sequence
  Synthetic DNA
taatcgtcctcacttaag

SEQ ID NO: 55015 - DNA, 18 bp, Artificial Sequence
  Synthetic DNA
taatctaactgattacag

SEQ ID NO: 55016 - DNA, 18 bp, Artificial Sequence
  Synthetic DNA
taatctgaatcgctatgg

SEQ ID NO: 55017 - DNA, 18 bp, Artificial Sequence
  Synthetic DNA
taatctgactctttattg

SEQ ID NO: 55018 - DNA, 18 bp, Artificial Sequence
  Synthetic DNA
taatctgtctcaaaacag

SEQ ID NO: 55019 - DNA, 18 bp, Artificial Sequence
  Synthetic DNA
taatgaaacaaagtatcg

SEQ ID NO: 55020 - DNA, 18 bp, Artificial Sequence
  Synthetic DNA
taatgagactcgctaatg

SEQ ID NO: 55021 - DNA, 18 bp, Artificial Sequence
  Synthetic DNA
taatgagactgactgttg

SEQ ID NO: 55022 - DNA, 18 bp, Artificial Sequence
  Synthetic DNA
taatgagagattcttcag

SEQ ID NO: 55023 - DNA, 18 bp, Artificial Sequence
  Synthetic DNA
taatgagcctcacggtag

SEQ ID NO: 55024 - DNA, 18 bp, Artificial Sequence
  Synthetic DNA
taatgcaacaatcaattg

SEQ ID NO: 55025 - DNA, 18 bp, Artificial Sequence
  Synthetic DNA
taatgcaattaactttag

SEQ ID NO: 55026 - DNA, 18 bp, Artificial Sequence
  Synthetic DNA
taatgcaattcccaatag

SEQ ID NO: 55027 - DNA, 18 bp, Artificial Sequence
  Synthetic DNA
taatgcacctcagctttg

SEQ ID NO: 55028 - DNA, 18 bp, Artificial Sequence
  Synthetic DNA
taatgcacctcattacag

SEQ ID NO: 55029 - DNA, 18 bp, Artificial Sequence
  Synthetic DNA
taatgcaccttattatag

SEQ ID NO: 55030 - DNA, 18 bp, Artificial Sequence
  Synthetic DNA
taatgcagcacaccatag

SEQ ID NO: 55031 - DNA, 18 bp, Artificial Sequence
  Synthetic DNA
taatgcatctcacactag

SEQ ID NO: 55032 - DNA, 18 bp, Artificial Sequence
  Synthetic DNA
taatgcatctcgcaatag

SEQ ID NO: 55033 - DNA, 18 bp, Artificial Sequence
  Synthetic DNA
taatgccactctctaatg

SEQ ID NO: 55034 - DNA, 18 bp, Artificial Sequence
  Synthetic DNA
taatgcgacacacataag

SEQ ID NO: 55035 - DNA, 18 bp, Artificial Sequence
  Synthetic DNA
taatgcgacacattcaag

SEQ ID NO: 55036 - DNA, 18 bp, Artificial Sequence
  Synthetic DNA
taatgcgagtcataagag

SEQ ID NO: 55037 - DNA, 18 bp, Artificial Sequence
  Synthetic DNA
taatgcgatacataatag

SEQ ID NO: 55038 - DNA, 18 bp, Artificial Sequence
  Synthetic DNA
taatgcgatgcagtattg

SEQ ID NO: 55039 - DNA, 18 bp, Artificial Sequence
  Synthetic DNA
taatgcgattccttctag

SEQ ID NO: 55040 - DNA, 18 bp, Artificial Sequence
  Synthetic DNA
taatgcgccacacaacag

SEQ ID NO: 55041 - DNA, 18 bp, Artificial Sequence
  Synthetic DNA
taatgcggatcacaaggg

SEQ ID NO: 55042 - DNA, 18 bp, Artificial Sequence
  Synthetic DNA
taatgcggcactctcatg

SEQ ID NO: 55043 - DNA, 18 bp, Artificial Sequence
  Synthetic DNA
taatgcgtcatcctatag

SEQ ID NO: 55044 - DNA, 18 bp, Artificial Sequence
  Synthetic DNA
taatgcgtcccacaattg

SEQ ID NO: 55045 - DNA, 18 bp, Artificial Sequence
  Synthetic DNA
taatgcgtctctctaacg

SEQ ID NO: 55046 - DNA, 18 bp, Artificial Sequence
  Synthetic DNA
taatgcgtcttaccattg

SEQ ID NO: 55047 - DNA, 18 bp, Artificial Sequence
  Synthetic DNA
taatgctacaaagtctag

SEQ ID NO: 55048 - DNA, 18 bp, Artificial Sequence
  Synthetic DNA
taatgctagtgactaaag

SEQ ID NO: 55049 - DNA, 18 bp, Artificial Sequence
  Synthetic DNA
taatgctattaattaaag

SEQ ID NO: 55050 - DNA, 18 bp, Artificial Sequence
  Synthetic DNA
taatgctattcacaaaag

SEQ ID NO: 55051 - DNA, 18 bp, Artificial Sequence
  Synthetic DNA
taatgctgcacacattag

SEQ ID NO: 55052 - DNA, 18 bp, Artificial Sequence
  Synthetic DNA
taatgctgctcagaatag

SEQ ID NO: 55053 - DNA, 18 bp, Artificial Sequence
  Synthetic DNA
taatgcttcttacaatag

SEQ ID NO: 55054 - DNA, 18 bp, Artificial Sequence
  Synthetic DNA
taatgcttgtgactattg

SEQ ID NO: 55055 - DNA, 18 bp, Artificial Sequence
  Synthetic DNA
taatgggaacaactctag

SEQ ID NO: 55056 - DNA, 18 bp, Artificial Sequence
  Synthetic DNA
taatgggattctctacag

SEQ ID NO: 55057 - DNA, 18 bp, Artificial Sequence
  Synthetic DNA
taatgtaacccatgattg

SEQ ID NO: 55058 - DNA, 18 bp, Artificial Sequence
  Synthetic DNA
taatgtctctcaaaatag

SEQ ID NO: 55059 - DNA, 18 bp, Artificial Sequence
  Synthetic DNA
taatgtgacactcaattg

SEQ ID NO: 55060 - DNA, 18 bp, Artificial Sequence
  Synthetic DNA
taatgtgactcacagaag

SEQ ID NO: 55061 - DNA, 18 bp, Artificial Sequence
  Synthetic DNA
taatgtgaggaactatag

SEQ ID NO: 55062 - DNA, 18 bp, Artificial Sequence
  Synthetic DNA
taatgtgagttactttag

SEQ ID NO: 55063 - DNA, 18 bp, Artificial Sequence
  Synthetic DNA
taatgtggctctctctag

SEQ ID NO: 55064 - DNA, 18 bp, Artificial Sequence
  Synthetic DNA
taatgtgtcttattatgg

SEQ ID NO: 55065 - DNA, 18 bp, Artificial Sequence
  Synthetic DNA
taattaaactgaccattg

SEQ ID NO: 55066 - DNA, 18 bp, Artificial Sequence
  Synthetic DNA
taattaagcactatatag

SEQ ID NO: 55067 - DNA, 18 bp, Artificial Sequence
  Synthetic DNA
taattaatctcacatgag

SEQ ID NO: 55068 - DNA, 18 bp, Artificial Sequence
  Synthetic DNA
taattacactaactacag

SEQ ID NO: 55069 - DNA, 18 bp, Artificial Sequence
  Synthetic DNA
taattacatagcctatag

SEQ ID NO: 55070 - DNA, 18 bp, Artificial Sequence
  Synthetic DNA
taattactctcacaatag

SEQ ID NO: 55071 - DNA, 18 bp, Artificial Sequence
  Synthetic DNA
taattagacactctaaag

SEQ ID NO: 55072 - DNA, 18 bp, Artificial Sequence
  Synthetic DNA
taattagacgtgaattag

SEQ ID NO: 55073 - DNA, 18 bp, Artificial Sequence
  Synthetic DNA
taattagactcacattta

SEQ ID NO: 55074 - DNA, 18 bp, Artificial Sequence
  Synthetic DNA
taattagactgacattag

SEQ ID NO: 55075 - DNA, 18 bp, Artificial Sequence
  Synthetic DNA
taattagacttaatacag

SEQ ID NO: 55076 - DNA, 18 bp, Artificial Sequence
  Synthetic DNA
taattagagccactccgg

SEQ ID NO: 55077 - DNA, 18 bp, Artificial Sequence
  Synthetic DNA
taattagagtctcaaaag

SEQ ID NO: 55078 - DNA, 18 bp, Artificial Sequence
  Synthetic DNA
taattagccaatcattag

SEQ ID NO: 55079 - DNA, 18 bp, Artificial Sequence
  Synthetic DNA
taattagtacgactatag

SEQ ID NO: 55080 - DNA, 18 bp, Artificial Sequence
  Synthetic DNA
taattagtctcatttcag

SEQ ID NO: 55081 - DNA, 18 bp, Artificial Sequence
  Synthetic DNA
taattatactcaccatcg

SEQ ID NO: 55082 - DNA, 18 bp, Artificial Sequence
  Synthetic DNA
taattatagtatctatag

SEQ ID NO: 55083 - DNA, 18 bp, Artificial Sequence
  Synthetic DNA
taattattctaactctag

SEQ ID NO: 55084 - DNA, 18 bp, Artificial Sequence
  Synthetic DNA
taattcaaagcactaatg

SEQ ID NO: 55085 - DNA, 18 bp, Artificial Sequence
  Synthetic DNA
taattcaaattacgatag

SEQ ID NO: 55086 - DNA, 18 bp, Artificial Sequence
  Synthetic DNA
taattcaacgatcaatag

SEQ ID NO: 55087 - DNA, 18 bp, Artificial Sequence
  Synthetic DNA
taattcaactcatcaatg

SEQ ID NO: 55088 - DNA, 18 bp, Artificial Sequence
  Synthetic DNA
taattcaactccatcaag

SEQ ID NO: 55089 - DNA, 18 bp, Artificial Sequence
  Synthetic DNA
taattcaattcattggag

SEQ ID NO: 55090 - DNA, 18 bp, Artificial Sequence
  Synthetic DNA
taattcaattctcttaag

SEQ ID NO: 55091 - DNA, 18 bp, Artificial Sequence
  Synthetic DNA
taattcaatttacaacag

SEQ ID NO: 55092 - DNA, 18 bp, Artificial Sequence
  Synthetic DNA
taattcatctcaccctag

SEQ ID NO: 55093 - DNA, 18 bp, Artificial Sequence
  Synthetic DNA
taattcatctcattatgg

SEQ ID NO: 55094 - DNA, 18 bp, Artificial Sequence
  Synthetic DNA
taattcatctcgaattag

SEQ ID NO: 55095 - DNA, 18 bp, Artificial Sequence
  Synthetic DNA
taattcatctcgccaagg

SEQ ID NO: 55096 - DNA, 18 bp, Artificial Sequence
  Synthetic DNA
taattccactgagaatag

SEQ ID NO: 55097 - DNA, 18 bp, Artificial Sequence
  Synthetic DNA
taattccagttactaaag

SEQ ID NO: 55098 - DNA, 18 bp, Artificial Sequence
  Synthetic DNA
taattccgttgactatgg

SEQ ID NO: 55099 - DNA, 18 bp, Artificial Sequence
  Synthetic DNA
taattcctcacacttttg

SEQ ID NO: 55100 - DNA, 18 bp, Artificial Sequence
  Synthetic DNA
taattcgaatccgtatcg

SEQ ID NO: 55101 - DNA, 18 bp, Artificial Sequence
  Synthetic DNA
taattcgaatcgcttaag

SEQ ID NO: 55102 - DNA, 18 bp, Artificial Sequence
  Synthetic DNA
taattcgaattagtatcg

SEQ ID NO: 55103 - DNA, 18 bp, Artificial Sequence
  Synthetic DNA
taattcgacaaactagtg

SEQ ID NO: 55104 - DNA, 18 bp, Artificial Sequence
  Synthetic DNA
taattcgacatcctttgg

SEQ ID NO: 55105 - DNA, 18 bp, Artificial Sequence
  Synthetic DNA
taattcgaccccttttag

SEQ ID NO: 55106 - DNA, 18 bp, Artificial Sequence
  Synthetic DNA
taattcgactatccaaag

SEQ ID NO: 55107 - DNA, 18 bp, Artificial Sequence
  Synthetic DNA
taattcgactcaactaag

SEQ ID NO: 55108 - DNA, 18 bp, Artificial Sequence
  Synthetic DNA
taattcgactcgattttg

SEQ ID NO: 55109 - DNA, 18 bp, Artificial Sequence
  Synthetic DNA
taattcgacttacatatg

SEQ ID NO: 55110 - DNA, 18 bp, Artificial Sequence
  Synthetic DNA
taattcgagccatacaag

SEQ ID NO: 55111 - DNA, 18 bp, Artificial Sequence
  Synthetic DNA
taattcgagtagctacag

SEQ ID NO: 55112 - DNA, 18 bp, Artificial Sequence
  Synthetic DNA
taattcgagtcacttcgg

SEQ ID NO: 55113 - DNA, 18 bp, Artificial Sequence
  Synthetic DNA
taattcgatacgttattg

SEQ ID NO: 55114 - DNA, 18 bp, Artificial Sequence
  Synthetic DNA
taattcgattcagccttg

SEQ ID NO: 55115 - DNA, 18 bp, Artificial Sequence
  Synthetic DNA
taattcgattctccgttg

SEQ ID NO: 55116 - DNA, 18 bp, Artificial Sequence
  Synthetic DNA
taattcgatttcctattg

SEQ ID NO: 55117 - DNA, 18 bp, Artificial Sequence
  Synthetic DNA
taattcgccacagtctag

SEQ ID NO: 55118 - DNA, 18 bp, Artificial Sequence
  Synthetic DNA
taattcgccttattttag

SEQ ID NO: 55119 - DNA, 18 bp, Artificial Sequence
  Synthetic DNA
taattcgcgtatttatag

SEQ ID NO: 55120 - DNA, 18 bp, Artificial Sequence
  Synthetic DNA
taattcgcgtcagtaaag

SEQ ID NO: 55121 - DNA, 18 bp, Artificial Sequence
  Synthetic DNA
taattcgcgttaccaaag

SEQ ID NO: 55122 - DNA, 18 bp, Artificial Sequence
  Synthetic DNA
taattcggcaaagtatag

SEQ ID NO: 55123 - DNA, 18 bp, Artificial Sequence
  Synthetic DNA
taattcggcacaatttgg

SEQ ID NO: 55124 - DNA, 18 bp, Artificial Sequence
  Synthetic DNA
taattcggcctactgtag

SEQ ID NO: 55125 - DNA, 18 bp, Artificial Sequence
  Synthetic DNA
taattcggctctcaataa

SEQ ID NO: 55126 - DNA, 18 bp, Artificial Sequence
  Synthetic DNA
taattcgtaaaactctag

SEQ ID NO: 55127 - DNA, 18 bp, Artificial Sequence
  Synthetic DNA
taattcgtattacttaag

SEQ ID NO: 55128 - DNA, 18 bp, Artificial Sequence
  Synthetic DNA
taattcgtcaaactatcg

SEQ ID NO: 55129 - DNA, 18 bp, Artificial Sequence
  Synthetic DNA
taattcgtcactatatag

SEQ ID NO: 55130 - DNA, 18 bp, Artificial Sequence
  Synthetic DNA
taattcgtctcacaagtg

SEQ ID NO: 55131 - DNA, 18 bp, Artificial Sequence
  Synthetic DNA
taattcgtctcccattag

SEQ ID NO: 55132 - DNA, 18 bp, Artificial Sequence
  Synthetic DNA
taattcgtctctcactgg

SEQ ID NO: 55133 - DNA, 18 bp, Artificial Sequence
  Synthetic DNA
taattcgtctctcatttg

SEQ ID NO: 55134 - DNA, 18 bp, Artificial Sequence
  Synthetic DNA
taattcgtctctcgattg

SEQ ID NO: 55135 - DNA, 18 bp, Artificial Sequence
  Synthetic DNA
taattcgtgtctcaaaag

SEQ ID NO: 55136 - DNA, 18 bp, Artificial Sequence
  Synthetic DNA
taattcgtttcagtttgg

SEQ ID NO: 55137 - DNA, 18 bp, Artificial Sequence
  Synthetic DNA
taattcgtttgacaatag

SEQ ID NO: 55138 - DNA, 18 bp, Artificial Sequence
  Synthetic DNA
taattcgttttattatcg

SEQ ID NO: 55139 - DNA, 18 bp, Artificial Sequence
  Synthetic DNA
taattctaatcaccctag

SEQ ID NO: 55140 - DNA, 18 bp, Artificial Sequence
  Synthetic DNA
taattctacgcacgctag

SEQ ID NO: 55141 - DNA, 18 bp, Artificial Sequence
  Synthetic DNA
taattctactcgcaattg

SEQ ID NO: 55142 - DNA, 18 bp, Artificial Sequence
  Synthetic DNA
taattctactctcttcag

SEQ ID NO: 55143 - DNA, 18 bp, Artificial Sequence
  Synthetic DNA
taattctattctcaattg

SEQ ID NO: 55144 - DNA, 18 bp, Artificial Sequence
  Synthetic DNA
taattctatttacctaag

SEQ ID NO: 55145 - DNA, 18 bp, Artificial Sequence
  Synthetic DNA
taattctcgtcaccatag

SEQ ID NO: 55146 - DNA, 18 bp, Artificial Sequence
  Synthetic DNA
taattctgctcacaattg

SEQ ID NO: 55147 - DNA, 18 bp, Artificial Sequence
  Synthetic DNA
taattctgcttactaaag

SEQ ID NO: 55148 - DNA, 18 bp, Artificial Sequence
  Synthetic DNA
taattcttcccactttag

SEQ ID NO: 55149 - DNA, 18 bp, Artificial Sequence
  Synthetic DNA
taattcttcgcacaattg

SEQ ID NO: 55150 - DNA, 18 bp, Artificial Sequence
  Synthetic DNA
taattgcaataactatag

SEQ ID NO: 55151 - DNA, 18 bp, Artificial Sequence
  Synthetic DNA
taattggaaactcaatag

SEQ ID NO: 55152 - DNA, 18 bp, Artificial Sequence
  Synthetic DNA
taattggcatctttattg

SEQ ID NO: 55153 - DNA, 18 bp, Artificial Sequence
  Synthetic DNA
taattgggttcaatatcg

SEQ ID NO: 55154 - DNA, 18 bp, Artificial Sequence
  Synthetic DNA
taatttaactgactaaag

SEQ ID NO: 55155 - DNA, 18 bp, Artificial Sequence
  Synthetic DNA
taatttaagtcacatttg

SEQ ID NO: 55156 - DNA, 18 bp, Artificial Sequence
  Synthetic DNA
taatttagctcgctctag

SEQ ID NO: 55157 - DNA, 18 bp, Artificial Sequence
  Synthetic DNA
taatttctctcatgatag

SEQ ID NO: 55158 - DNA, 18 bp, Artificial Sequence
  Synthetic DNA
taatttgaaaaactatag

SEQ ID NO: 55159 - DNA, 18 bp, Artificial Sequence
  Synthetic DNA
taatttgaatccctacag

SEQ ID NO: 55160 - DNA, 18 bp, Artificial Sequence
  Synthetic DNA
taatttgacacaaaatag

SEQ ID NO: 55161 - DNA, 18 bp, Artificial Sequence
  Synthetic DNA
taatttgacaccctattg

SEQ ID NO: 55162 - DNA, 18 bp, Artificial Sequence
  Synthetic DNA
taatttgactattaattg

SEQ ID NO: 55163 - DNA, 18 bp, Artificial Sequence
  Synthetic DNA
taatttgactcaggagcg

SEQ ID NO: 55164 - DNA, 18 bp, Artificial Sequence
  Synthetic DNA
taatttgactttctaaag

SEQ ID NO: 55165 - DNA, 18 bp, Artificial Sequence
  Synthetic DNA
taatttgtctcacgatcg

SEQ ID NO: 55166 - DNA, 18 bp, Artificial Sequence
  Synthetic DNA
taattttattttctcaag

SEQ ID NO: 55167 - DNA, 18 bp, Artificial Sequence
  Synthetic DNA
tacaaaatcacactaaag

SEQ ID NO: 55168 - DNA, 18 bp, Artificial Sequence
  Synthetic DNA
tacaaagacttactatcg

SEQ ID NO: 55169 - DNA, 18 bp, Artificial Sequence
  Synthetic DNA
tacaaaggttcactatag

SEQ ID NO: 55170 - DNA, 18 bp, Artificial Sequence
  Synthetic DNA
tacaacaactcacaaaag

SEQ ID NO: 55171 - DNA, 18 bp, Artificial Sequence
  Synthetic DNA
tacaaccacaaactatag

SEQ ID NO: 55172 - DNA, 18 bp, Artificial Sequence
  Synthetic DNA
tacaaccacttacaatag

SEQ ID NO: 55173 - DNA, 18 bp, Artificial Sequence
  Synthetic DNA
tacaacgactctttattg

SEQ ID NO: 55174 - DNA, 18 bp, Artificial Sequence
  Synthetic DNA
tacaacgagactctatag

SEQ ID NO: 55175 - DNA, 18 bp, Artificial Sequence
  Synthetic DNA
tacaacgattaattatag

SEQ ID NO: 55176 - DNA, 18 bp, Artificial Sequence
  Synthetic DNA
tacaactactcactagcg

SEQ ID NO: 55177 - DNA, 18 bp, Artificial Sequence
  Synthetic DNA
tacaatcactcactacag

SEQ ID NO: 55178 - DNA, 18 bp, Artificial Sequence
  Synthetic DNA
tacaatcactcgatatag

SEQ ID NO: 55179 - DNA, 18 bp, Artificial Sequence
  Synthetic DNA
tacaatgcttcactgtag

SEQ ID NO: 55180 - DNA, 18 bp, Artificial Sequence
  Synthetic DNA
tacaatgtctcagtatag

SEQ ID NO: 55181 - DNA, 18 bp, Artificial Sequence
  Synthetic DNA
tacaattaaaatctatag

SEQ ID NO: 55182 - DNA, 18 bp, Artificial Sequence
  Synthetic DNA
tacaccatctcattatgg

SEQ ID NO: 55183 - DNA, 18 bp, Artificial Sequence
  Synthetic DNA
tacacccacagtctatag

SEQ ID NO: 55184 - DNA, 18 bp, Artificial Sequence
  Synthetic DNA
tacaccgaatctttacag

SEQ ID NO: 55185 - DNA, 18 bp, Artificial Sequence
  Synthetic DNA
tacaccgcctctctatag

SEQ ID NO: 55186 - DNA, 18 bp, Artificial Sequence
  Synthetic DNA
tacactgattcatcttag

SEQ ID NO: 55187 - DNA, 18 bp, Artificial Sequence
  Synthetic DNA
tacagatactcactttag

SEQ ID NO: 55188 - DNA, 18 bp, Artificial Sequence
  Synthetic DNA
tacatatactcactatag

SEQ ID NO: 55189 - DNA, 18 bp, Artificial Sequence
  Synthetic DNA
tacatcgactcgctaatg

SEQ ID NO: 55190 - DNA, 18 bp, Artificial Sequence
  Synthetic DNA
tacatcgagtcgcaatag

SEQ ID NO: 55191 - DNA, 18 bp, Artificial Sequence
  Synthetic DNA
tacatcgtctcactagag

SEQ ID NO: 55192 - DNA, 18 bp, Artificial Sequence
  Synthetic DNA
tacatctgattactatag

SEQ ID NO: 55193 - DNA, 18 bp, Artificial Sequence
  Synthetic DNA
tacattcattctctatag

SEQ ID NO: 55194 - DNA, 18 bp, Artificial Sequence
  Synthetic DNA
tacattgactcactctag

SEQ ID NO: 55195 - DNA, 18 bp, Artificial Sequence
  Synthetic DNA
taccaagactcatttagg

SEQ ID NO: 55196 - DNA, 18 bp, Artificial Sequence
  Synthetic DNA
taccacgcctctctgtag

SEQ ID NO: 55197 - DNA, 18 bp, Artificial Sequence
  Synthetic DNA
taccacgccttactattg

SEQ ID NO: 55198 - DNA, 18 bp, Artificial Sequence
  Synthetic DNA
taccacgcttctttatag

SEQ ID NO: 55199 - DNA, 18 bp, Artificial Sequence
  Synthetic DNA
taccaggacccactattg

SEQ ID NO: 55200 - DNA, 18 bp, Artificial Sequence
  Synthetic DNA
tacccggactaattatag

SEQ ID NO: 55201 - DNA, 18 bp, Artificial Sequence
  Synthetic DNA
taccgcgactccctacag

SEQ ID NO: 55202 - DNA, 18 bp, Artificial Sequence
  Synthetic DNA
taccgcgactgactatcg

SEQ ID NO: 55203 - DNA, 18 bp, Artificial Sequence
  Synthetic DNA
tacgaccactcattacag

SEQ ID NO: 55204 - DNA, 18 bp, Artificial Sequence
  Synthetic DNA
tacgagaaccgactatag

SEQ ID NO: 55205 - DNA, 18 bp, Artificial Sequence
  Synthetic DNA
tactaagacaatctatag

SEQ ID NO: 55206 - DNA, 18 bp, Artificial Sequence
  Synthetic DNA
tactaagacacactttgg

SEQ ID NO: 55207 - DNA, 18 bp, Artificial Sequence
  Synthetic DNA
tactaagagactctttag

SEQ ID NO: 55208 - DNA, 18 bp, Artificial Sequence
  Synthetic DNA
tactaagtatcaattaag

SEQ ID NO: 55209 - DNA, 18 bp, Artificial Sequence
  Synthetic DNA
tactaagtctcacatatg

SEQ ID NO: 55210 - DNA, 18 bp, Artificial Sequence
  Synthetic DNA
tactacaactaacttgcg

SEQ ID NO: 55211 - DNA, 18 bp, Artificial Sequence
  Synthetic DNA
tactacaactcacaaatg

SEQ ID NO: 55212 - DNA, 18 bp, Artificial Sequence
  Synthetic DNA
tactacaactcattgttg

SEQ ID NO: 55213 - DNA, 18 bp, Artificial Sequence
  Synthetic DNA
tactacaactcttaatag

SEQ ID NO: 55214 - DNA, 18 bp, Artificial Sequence
  Synthetic DNA
tactacatatcaggacag

SEQ ID NO: 55215 - DNA, 18 bp, Artificial Sequence
  Synthetic DNA
tactacatcacactttag

SEQ ID NO: 55216 - DNA, 18 bp, Artificial Sequence
  Synthetic DNA
tactacatcacccttgag

SEQ ID NO: 55217 - DNA, 18 bp, Artificial Sequence
  Synthetic DNA
tactacatctcacgtaag

SEQ ID NO: 55218 - DNA, 18 bp, Artificial Sequence
  Synthetic DNA
tactacatctccacatag

SEQ ID NO: 55219 - DNA, 18 bp, Artificial Sequence
  Synthetic DNA
tactaccattcaatgtag

SEQ ID NO: 55220 - DNA, 18 bp, Artificial Sequence
  Synthetic DNA
tactacctttgaccaaag

SEQ ID NO: 55221 - DNA, 18 bp, Artificial Sequence
  Synthetic DNA
tactacgaacaattaatg

SEQ ID NO: 55222 - DNA, 18 bp, Artificial Sequence
  Synthetic DNA
tactacgaatctcgattg

SEQ ID NO: 55223 - DNA, 18 bp, Artificial Sequence
  Synthetic DNA
tactacgacccaacctag

SEQ ID NO: 55224 - DNA, 18 bp, Artificial Sequence
  Synthetic DNA
tactacgactccaaaagg

SEQ ID NO: 55225 - DNA, 18 bp, Artificial Sequence
  Synthetic DNA
tactacgactccacttag

SEQ ID NO: 55226 - DNA, 18 bp, Artificial Sequence
  Synthetic DNA
tactacgagggagtatag

SEQ ID NO: 55227 - DNA, 18 bp, Artificial Sequence
  Synthetic DNA
tactacgatatatcatcg

SEQ ID NO: 55228 - DNA, 18 bp, Artificial Sequence
  Synthetic DNA
tactacgattcgtattag

SEQ ID NO: 55229 - DNA, 18 bp, Artificial Sequence
  Synthetic DNA
tactacgcatcacactag

SEQ ID NO: 55230 - DNA, 18 bp, Artificial Sequence
  Synthetic DNA
tactacgccttagtattg

SEQ ID NO: 55231 - DNA, 18 bp, Artificial Sequence
  Synthetic DNA
tactacggcttatcatag

SEQ ID NO: 55232 - DNA, 18 bp, Artificial Sequence
  Synthetic DNA
tactacgtatcacaattg

SEQ ID NO: 55233 - DNA, 18 bp, Artificial Sequence
  Synthetic DNA
tactacgtctcacatttg

SEQ ID NO: 55234 - DNA, 18 bp, Artificial Sequence
  Synthetic DNA
tactacgtttctttatag

SEQ ID NO: 55235 - DNA, 18 bp, Artificial Sequence
  Synthetic DNA
tactacgttttactaacg

SEQ ID NO: 55236 - DNA, 18 bp, Artificial Sequence
  Synthetic DNA
tactactgtattatatag

SEQ ID NO: 55237 - DNA, 18 bp, Artificial Sequence
  Synthetic DNA
tactacttcccattctag

SEQ ID NO: 55238 - DNA, 18 bp, Artificial Sequence
  Synthetic DNA
tactacttctgtccatag

SEQ ID NO: 55239 - DNA, 18 bp, Artificial Sequence
  Synthetic DNA
tactactttcaactatag

SEQ ID NO: 55240 - DNA, 18 bp, Artificial Sequence
  Synthetic DNA
tactaggacccatcattg

SEQ ID NO: 55241 - DNA, 18 bp, Artificial Sequence
  Synthetic DNA
tactataacacactagag

SEQ ID NO: 55242 - DNA, 18 bp, Artificial Sequence
  Synthetic DNA
tactatctctcataatag

SEQ ID NO: 55243 - DNA, 18 bp, Artificial Sequence
  Synthetic DNA
tactatgaatcacaaaag

SEQ ID NO: 55244 - DNA, 18 bp, Artificial Sequence
  Synthetic DNA
tactatgatacagtattg

SEQ ID NO: 55245 - DNA, 18 bp, Artificial Sequence
  Synthetic DNA
tactatgtctctcaatag

SEQ ID NO: 55246 - DNA, 18 bp, Artificial Sequence
  Synthetic DNA
tactcatacacaaatcag

SEQ ID NO: 55247 - DNA, 18 bp, Artificial Sequence
  Synthetic DNA
tactccggctattaatag

SEQ ID NO: 55248 - DNA, 18 bp, Artificial Sequence
  Synthetic DNA
tactctgactctctctag

SEQ ID NO: 55249 - DNA, 18 bp, Artificial Sequence
  Synthetic DNA
tactctttcttcctatag

SEQ ID NO: 55250 - DNA, 18 bp, Artificial Sequence
  Synthetic DNA
tactgcgattcactttcg

SEQ ID NO: 55251 - DNA, 18 bp, Artificial Sequence
  Synthetic DNA
tactgcgtttcaatgtag

SEQ ID NO: 55252 - DNA, 18 bp, Artificial Sequence
  Synthetic DNA
tactgtaatccactattg

SEQ ID NO: 55253 - DNA, 18 bp, Artificial Sequence
  Synthetic DNA
tactgtatctcactaatg

SEQ ID NO: 55254 - DNA, 18 bp, Artificial Sequence
  Synthetic DNA
tacttagactatctatag

SEQ ID NO: 55255 - DNA, 18 bp, Artificial Sequence
  Synthetic DNA
tacttagtctcactatgg

SEQ ID NO: 55256 - DNA, 18 bp, Artificial Sequence
  Synthetic DNA
tacttagtctcactattg

SEQ ID NO: 55257 - DNA, 18 bp, Artificial Sequence
  Synthetic DNA
tacttcaactcacttcag

SEQ ID NO: 55258 - DNA, 18 bp, Artificial Sequence
  Synthetic DNA
tacttcaagttcctatag

SEQ ID NO: 55259 - DNA, 18 bp, Artificial Sequence
  Synthetic DNA
tacttccatacaccatag

SEQ ID NO: 55260 - DNA, 18 bp, Artificial Sequence
  Synthetic DNA
tacttcctttgactatag

SEQ ID NO: 55261 - DNA, 18 bp, Artificial Sequence
  Synthetic DNA
tacttcgacacacaacag

SEQ ID NO: 55262 - DNA, 18 bp, Artificial Sequence
  Synthetic DNA
tacttcgactcgcggaag

SEQ ID NO: 55263 - DNA, 18 bp, Artificial Sequence
  Synthetic DNA
tacttcgattacctatag

SEQ ID NO: 55264 - DNA, 18 bp, Artificial Sequence
  Synthetic DNA
tacttcggctcaccatcg

SEQ ID NO: 55265 - DNA, 18 bp, Artificial Sequence
  Synthetic DNA
tacttcggttcactattg

SEQ ID NO: 55266 - DNA, 18 bp, Artificial Sequence
  Synthetic DNA
tacttggacacaatctcg

SEQ ID NO: 55267 - DNA, 18 bp, Artificial Sequence
  Synthetic DNA
tacttggactaactattg

SEQ ID NO: 55268 - DNA, 18 bp, Artificial Sequence
  Synthetic DNA
tacttgtactcacttaag

SEQ ID NO: 55269 - DNA, 18 bp, Artificial Sequence
  Synthetic DNA
tactttgactccccattg

SEQ ID NO: 55270 - DNA, 18 bp, Artificial Sequence
  Synthetic DNA
tagaaagactcacttaag

SEQ ID NO: 55271 - DNA, 18 bp, Artificial Sequence
  Synthetic DNA
tagaaagacttactattg

SEQ ID NO: 55272 - DNA, 18 bp, Artificial Sequence
  Synthetic DNA
tagaaagatttgcaaatg

SEQ ID NO: 55273 - DNA, 18 bp, Artificial Sequence
  Synthetic DNA
tagaacatctcaaaaacg

SEQ ID NO: 55274 - DNA, 18 bp, Artificial Sequence
  Synthetic DNA
tagaacgaataactaaag

SEQ ID NO: 55275 - DNA, 18 bp, Artificial Sequence
  Synthetic DNA
tagaacgacaaagtttag

SEQ ID NO: 55276 - DNA, 18 bp, Artificial Sequence
  Synthetic DNA
tagaacgattaactaaag

SEQ ID NO: 55277 - DNA, 18 bp, Artificial Sequence
  Synthetic DNA
tagaacggcctattaaag

SEQ ID NO: 55278 - DNA, 18 bp, Artificial Sequence
  Synthetic DNA
tagaacgtctcaatcaag

SEQ ID NO: 55279 - DNA, 18 bp, Artificial Sequence
  Synthetic DNA
tagaacgtctccccattg

SEQ ID NO: 55280 - DNA, 18 bp, Artificial Sequence
  Synthetic DNA
tagaactacccaccatag

SEQ ID NO: 55281 - DNA, 18 bp, Artificial Sequence
  Synthetic DNA
tagaatgattcacgatag

SEQ ID NO: 55282 - DNA, 18 bp, Artificial Sequence
  Synthetic DNA
tagagcgaataaacatag

SEQ ID NO: 55283 - DNA, 18 bp, Artificial Sequence
  Synthetic DNA
tagatcgtcagaatatcg

SEQ ID NO: 55284 - DNA, 18 bp, Artificial Sequence
  Synthetic DNA
tagcacgccttcctatag

SEQ ID NO: 55285 - DNA, 18 bp, Artificial Sequence
  Synthetic DNA
tagcaggactatttaatg

SEQ ID NO: 55286 - DNA, 18 bp, Artificial Sequence
  Synthetic DNA
taggacgacttacttaag

SEQ ID NO: 55287 - DNA, 18 bp, Artificial Sequence
  Synthetic DNA
taggactagacactaatg

SEQ ID NO: 55288 - DNA, 18 bp, Artificial Sequence
  Synthetic DNA
taggatgtctccctttag

SEQ ID NO: 55289 - DNA, 18 bp, Artificial Sequence
  Synthetic DNA
taggccgtctgcctatag

SEQ ID NO: 55290 - DNA, 18 bp, Artificial Sequence
  Synthetic DNA
tagtaagataccctaaag

SEQ ID NO: 55291 - DNA, 18 bp, Artificial Sequence
  Synthetic DNA
tagtaagattcattgacg

SEQ ID NO: 55292 - DNA, 18 bp, Artificial Sequence
  Synthetic DNA
tagtaagtcatactatag

SEQ ID NO: 55293 - DNA, 18 bp, Artificial Sequence
  Synthetic DNA
tagtaagtctttctatag

SEQ ID NO: 55294 - DNA, 18 bp, Artificial Sequence
  Synthetic DNA
tagtacaactgactcttg

SEQ ID NO: 55295 - DNA, 18 bp, Artificial Sequence
  Synthetic DNA
tagtacaacttacttacg

SEQ ID NO: 55296 - DNA, 18 bp, Artificial Sequence
  Synthetic DNA
tagtacatatcagaattg

SEQ ID NO: 55297 - DNA, 18 bp, Artificial Sequence
  Synthetic DNA
tagtacatctctctttag

SEQ ID NO: 55298 - DNA, 18 bp, Artificial Sequence
  Synthetic DNA
tagtacgaaagtataaag

SEQ ID NO: 55299 - DNA, 18 bp, Artificial Sequence
  Synthetic DNA
tagtacgaaataccaaag

SEQ ID NO: 55300 - DNA, 18 bp, Artificial Sequence
  Synthetic DNA
tagtacgaatcaaaaaag

SEQ ID NO: 55301 - DNA, 18 bp, Artificial Sequence
  Synthetic DNA
tagtacgacccacaagtg

SEQ ID NO: 55302 - DNA, 18 bp, Artificial Sequence
  Synthetic DNA
tagtacgacggacttttg

SEQ ID NO: 55303 - DNA, 18 bp, Artificial Sequence
  Synthetic DNA
tagtacgactcacccctg

SEQ ID NO: 55304 - DNA, 18 bp, Artificial Sequence
  Synthetic DNA
tagtacgcctcacaactg

SEQ ID NO: 55305 - DNA, 18 bp, Artificial Sequence
  Synthetic DNA
tagtacgcttcattactg

SEQ ID NO: 55306 - DNA, 18 bp, Artificial Sequence
  Synthetic DNA
tagtacgtctcacaactg

SEQ ID NO: 55307 - DNA, 18 bp, Artificial Sequence
  Synthetic DNA
tagtacgtctctaaatag

SEQ ID NO: 55308 - DNA, 18 bp, Artificial Sequence
  Synthetic DNA
tagtacgtctctaattag

SEQ ID NO: 55309 - DNA, 18 bp, Artificial Sequence
  Synthetic DNA
tagtactaactactatag

SEQ ID NO: 55310 - DNA, 18 bp, Artificial Sequence
  Synthetic DNA
tagtactactcagttcag

SEQ ID NO: 55311 - DNA, 18 bp, Artificial Sequence
  Synthetic DNA
tagtactagtcattagag

SEQ ID NO: 55312 - DNA, 18 bp, Artificial Sequence
  Synthetic DNA
tagtactccttacgattg

SEQ ID NO: 55313 - DNA, 18 bp, Artificial Sequence
  Synthetic DNA
tagtaggattcgctgtag

SEQ ID NO: 55314 - DNA, 18 bp, Artificial Sequence
  Synthetic DNA
tagtatgaatcacaagtg

SEQ ID NO: 55315 - DNA, 18 bp, Artificial Sequence
  Synthetic DNA
tagtatgactgccgattg

SEQ ID NO: 55316 - DNA, 18 bp, Artificial Sequence
  Synthetic DNA
tagtatgtctctcgatag

SEQ ID NO: 55317 - DNA, 18 bp, Artificial Sequence
  Synthetic DNA
tagtcagactccctttag

SEQ ID NO: 55318 - DNA, 18 bp, Artificial Sequence
  Synthetic DNA
tagtccgacttattttag

SEQ ID NO: 55319 - DNA, 18 bp, Artificial Sequence
  Synthetic DNA
tagtccgagtcataatgg

SEQ ID NO: 55320 - DNA, 18 bp, Artificial Sequence
  Synthetic DNA
tagtccgatacactgtag

SEQ ID NO: 55321 - DNA, 18 bp, Artificial Sequence
  Synthetic DNA
tagtccgtcacactgcag

SEQ ID NO: 55322 - DNA, 18 bp, Artificial Sequence
  Synthetic DNA
tagtcctattcactaaag

SEQ ID NO: 55323 - DNA, 18 bp, Artificial Sequence
  Synthetic DNA
tagtctgactctccgttg

SEQ ID NO: 55324 - DNA, 18 bp, Artificial Sequence
  Synthetic DNA
tagtctgtcccactatag

SEQ ID NO: 55325 - DNA, 18 bp, Artificial Sequence
  Synthetic DNA
tagtctgtgtcactcttg

SEQ ID NO: 55326 - DNA, 18 bp, Artificial Sequence
  Synthetic DNA
tagtgagcttaacataag

SEQ ID NO: 55327 - DNA, 18 bp, Artificial Sequence
  Synthetic DNA
tagtgcgaatcacaattg

SEQ ID NO: 55328 - DNA, 18 bp, Artificial Sequence
  Synthetic DNA
tagtgcgacactcgattg

SEQ ID NO: 55329 - DNA, 18 bp, Artificial Sequence
  Synthetic DNA
tagtgctactctttatag

SEQ ID NO: 55330 - DNA, 18 bp, Artificial Sequence
  Synthetic DNA
tagttaaactcacatttg

SEQ ID NO: 55331 - DNA, 18 bp, Artificial Sequence
  Synthetic DNA
tagttagatcccttaaag

SEQ ID NO: 55332 - DNA, 18 bp, Artificial Sequence
  Synthetic DNA
tagttcaacaaactttag

SEQ ID NO: 55333 - DNA, 18 bp, Artificial Sequence
  Synthetic DNA
tagttcaattttctatag

SEQ ID NO: 55334 - DNA, 18 bp, Artificial Sequence
  Synthetic DNA
tagttcgactcaattatg

SEQ ID NO: 55335 - DNA, 18 bp, Artificial Sequence
  Synthetic DNA
tagttcgactctaattag

SEQ ID NO: 55336 - DNA, 18 bp, Artificial Sequence
  Synthetic DNA
tagttcgattaacttatg

SEQ ID NO: 55337 - DNA, 18 bp, Artificial Sequence
  Synthetic DNA
tagttcgtcatacaatag

SEQ ID NO: 55338 - DNA, 18 bp, Artificial Sequence
  Synthetic DNA
tagttcgtttcactcacg

SEQ ID NO: 55339 - DNA, 18 bp, Artificial Sequence
  Synthetic DNA
tagttctacttactttgg

SEQ ID NO: 55340 - DNA, 18 bp, Artificial Sequence
  Synthetic DNA
tagttctttgcactttag

SEQ ID NO: 55341 - DNA, 18 bp, Artificial Sequence
  Synthetic DNA
tataaagattcacaattg

SEQ ID NO: 55342 - DNA, 18 bp, Artificial Sequence
  Synthetic DNA
tataaagattctgactgg

SEQ ID NO: 55343 - DNA, 18 bp, Artificial Sequence
  Synthetic DNA
tataacaaatttctatag

SEQ ID NO: 55344 - DNA, 18 bp, Artificial Sequence
  Synthetic DNA
tataacatttcactttag

SEQ ID NO: 55345 - DNA, 18 bp, Artificial Sequence
  Synthetic DNA
tataaccactcacgaaag

SEQ ID NO: 55346 - DNA, 18 bp, Artificial Sequence
  Synthetic DNA
tataaccacttactattg

SEQ ID NO: 55347 - DNA, 18 bp, Artificial Sequence
  Synthetic DNA
tataacgaatctcttcag

SEQ ID NO: 55348 - DNA, 18 bp, Artificial Sequence
  Synthetic DNA
tataacgacacttcatag

SEQ ID NO: 55349 - DNA, 18 bp, Artificial Sequence
  Synthetic DNA
tataacgactagcagtag

SEQ ID NO: 55350 - DNA, 18 bp, Artificial Sequence
  Synthetic DNA
tataacgactcataacag

SEQ ID NO: 55351 - DNA, 18 bp, Artificial Sequence
  Synthetic DNA
tataacgactctcataag

SEQ ID NO: 55352 - DNA, 18 bp, Artificial Sequence
  Synthetic DNA
tataacgagacacgatag

SEQ ID NO: 55353 - DNA, 18 bp, Artificial Sequence
  Synthetic DNA
tataacgagtaacaatag

SEQ ID NO: 55354 - DNA, 18 bp, Artificial Sequence
  Synthetic DNA
tataacgagtatcaatag

SEQ ID NO: 55355 - DNA, 18 bp, Artificial Sequence
  Synthetic DNA
tataacgagtcattttag

SEQ ID NO: 55356 - DNA, 18 bp, Artificial Sequence
  Synthetic DNA
tataacgatttaattgtg

SEQ ID NO: 55357 - DNA, 18 bp, Artificial Sequence
  Synthetic DNA
tataacgcctcaataaag

SEQ ID NO: 55358 - DNA, 18 bp, Artificial Sequence
  Synthetic DNA
tataacgcctcccaatag

SEQ ID NO: 55359 - DNA, 18 bp, Artificial Sequence
  Synthetic DNA
tataacggccaactatcg

SEQ ID NO: 55360 - DNA, 18 bp, Artificial Sequence
  Synthetic DNA
tataacggcccactaacg

SEQ ID NO: 55361 - DNA, 18 bp, Artificial Sequence
  Synthetic DNA
tataacgtaacactacag

SEQ ID NO: 55362 - DNA, 18 bp, Artificial Sequence
  Synthetic DNA
tataacgtctctcactag

SEQ ID NO: 55363 - DNA, 18 bp, Artificial Sequence
  Synthetic DNA
tataacgtctctcatttg

SEQ ID NO: 55364 - DNA, 18 bp, Artificial Sequence
  Synthetic DNA
tataacgtctctttatcg

SEQ ID NO: 55365 - DNA, 18 bp, Artificial Sequence
  Synthetic DNA
tataacgtttcactgttg

SEQ ID NO: 55366 - DNA, 18 bp, Artificial Sequence
  Synthetic DNA
tataactaatcactatcg

SEQ ID NO: 55367 - DNA, 18 bp, Artificial Sequence
  Synthetic DNA
tataactaatcattgaag

SEQ ID NO: 55368 - DNA, 18 bp, Artificial Sequence
  Synthetic DNA
tataactattcactaaag

SEQ ID NO: 55369 - DNA, 18 bp, Artificial Sequence
  Synthetic DNA
tataactattcactttag

SEQ ID NO: 55370 - DNA, 18 bp, Artificial Sequence
  Synthetic DNA
tataacttctagctatag

SEQ ID NO: 55371 - DNA, 18 bp, Artificial Sequence
  Synthetic DNA
tataactttgcacaatag

SEQ ID NO: 55372 - DNA, 18 bp, Artificial Sequence
  Synthetic DNA
tataaggactgtctatag

SEQ ID NO: 55373 - DNA, 18 bp, Artificial Sequence
  Synthetic DNA
tataaggcaacactaaag

SEQ ID NO: 55374 - DNA, 18 bp, Artificial Sequence
  Synthetic DNA
tataaggtttctctatag

SEQ ID NO: 55375 - DNA, 18 bp, Artificial Sequence
  Synthetic DNA
tataataccgccctaaag

SEQ ID NO: 55376 - DNA, 18 bp, Artificial Sequence
  Synthetic DNA
tataatgactctctaatg

SEQ ID NO: 55377 - DNA, 18 bp, Artificial Sequence
  Synthetic DNA
tataatgattaacaaaag

SEQ ID NO: 55378 - DNA, 18 bp, Artificial Sequence
  Synthetic DNA
tataatgcctcactttag

SEQ ID NO: 55379 - DNA, 18 bp, Artificial Sequence
  Synthetic DNA
tataatgtcgaaccaaag

SEQ ID NO: 55380 - DNA, 18 bp, Artificial Sequence
  Synthetic DNA
tataccggctcaccgaag

SEQ ID NO: 55381 - DNA, 18 bp, Artificial Sequence
  Synthetic DNA
tataccgtctcactctag

SEQ ID NO: 55382 - DNA, 18 bp, Artificial Sequence
  Synthetic DNA
tatacctactcgctatag

SEQ ID NO: 55383 - DNA, 18 bp, Artificial Sequence
  Synthetic DNA
tatagctacactctctag

SEQ ID NO: 55384 - DNA, 18 bp, Artificial Sequence
  Synthetic DNA
tataggtactctctttag

SEQ ID NO: 55385 - DNA, 18 bp, Artificial Sequence
  Synthetic DNA
tatatagacttcctattg

SEQ ID NO: 55386 - DNA, 18 bp, Artificial Sequence
  Synthetic DNA
tatatcaactcacttatg

SEQ ID NO: 55387 - DNA, 18 bp, Artificial Sequence
  Synthetic DNA
tatatccactcactattg

SEQ ID NO: 55388 - DNA, 18 bp, Artificial Sequence
  Synthetic DNA
tatatccacttactaaag

SEQ ID NO: 55389 - DNA, 18 bp, Artificial Sequence
  Synthetic DNA
tatatcgactctccatag

SEQ ID NO: 55390 - DNA, 18 bp, Artificial Sequence
  Synthetic DNA
tatatcgtctaattatag

SEQ ID NO: 55391 - DNA, 18 bp, Artificial Sequence
  Synthetic DNA
tatatctactcactcaag

SEQ ID NO: 55392 - DNA, 18 bp, Artificial Sequence
  Synthetic DNA
tatatggtctcattctag

SEQ ID NO: 55393 - DNA, 18 bp, Artificial Sequence
  Synthetic DNA
tatattgacacattaatg

SEQ ID NO: 55394 - DNA, 18 bp, Artificial Sequence
  Synthetic DNA
tatattggctcactaatg

SEQ ID NO: 55395 - DNA, 18 bp, Artificial Sequence
  Synthetic DNA
tatcaacactcccagtag

SEQ ID NO: 55396 - DNA, 18 bp, Artificial Sequence
  Synthetic DNA
tatcaagacgcactattg

SEQ ID NO: 55397 - DNA, 18 bp, Artificial Sequence
  Synthetic DNA
tatcaagactctcattag

SEQ ID NO: 55398 - DNA, 18 bp, Artificial Sequence
  Synthetic DNA
tatcaagattaactagtg

SEQ ID NO: 55399 - DNA, 18 bp, Artificial Sequence
  Synthetic DNA
tatcacaacacactcgag

SEQ ID NO: 55400 - DNA, 18 bp, Artificial Sequence
  Synthetic DNA
tatcacgacaaactctag

SEQ ID NO: 55401 - DNA, 18 bp, Artificial Sequence
  Synthetic DNA
tatcacgacagacaatag

SEQ ID NO: 55402 - DNA, 18 bp, Artificial Sequence
  Synthetic DNA
tatcacgactaagtattg

SEQ ID NO: 55403 - DNA, 18 bp, Artificial Sequence
  Synthetic DNA
tatcacgactctcgattg

SEQ ID NO: 55404 - DNA, 18 bp, Artificial Sequence
  Synthetic DNA
tatcacgcttctccatag

SEQ ID NO: 55405 - DNA, 18 bp, Artificial Sequence
  Synthetic DNA
tatcacgtcactccattg

SEQ ID NO: 55406 - DNA, 18 bp, Artificial Sequence
  Synthetic DNA
tatcacgtctcacattag

SEQ ID NO: 55407 - DNA, 18 bp, Artificial Sequence
  Synthetic DNA
tatcacgtctttcagtag

SEQ ID NO: 55408 - DNA, 18 bp, Artificial Sequence
  Synthetic DNA
tatcactacttactaaag

SEQ ID NO: 55409 - DNA, 18 bp, Artificial Sequence
  Synthetic DNA
tatcactcaacactaatg

SEQ ID NO: 55410 - DNA, 18 bp, Artificial Sequence
  Synthetic DNA
tatcacttctcactttag

SEQ ID NO: 55411 - DNA, 18 bp, Artificial Sequence
  Synthetic DNA
tatcaggtctcataatag

SEQ ID NO: 55412 - DNA, 18 bp, Artificial Sequence
  Synthetic DNA
tatcatctctcacactag

SEQ ID NO: 55413 - DNA, 18 bp, Artificial Sequence
  Synthetic DNA
tatcatgactcacagtag

SEQ ID NO: 55414 - DNA, 18 bp, Artificial Sequence
  Synthetic DNA
tatcatgacttagtatag

SEQ ID NO: 55415 - DNA, 18 bp, Artificial Sequence
  Synthetic DNA
tatcatgtctcacaatag

SEQ ID NO: 55416 - DNA, 18 bp, Artificial Sequence
  Synthetic DNA
tatcattaatcactatag

SEQ ID NO: 55417 - DNA, 18 bp, Artificial Sequence
  Synthetic DNA
tatctaaactttctcttg

SEQ ID NO: 55418 - DNA, 18 bp, Artificial Sequence
  Synthetic DNA
tatctagtcccactatag

SEQ ID NO: 55419 - DNA, 18 bp, Artificial Sequence
  Synthetic DNA
tatctcatctctttatgg

SEQ ID NO: 55420 - DNA, 18 bp, Artificial Sequence
  Synthetic DNA
tatctcgactcatttttg

SEQ ID NO: 55421 - DNA, 18 bp, Artificial Sequence
  Synthetic DNA
tatctcgattcactcttg

SEQ ID NO: 55422 - DNA, 18 bp, Artificial Sequence
  Synthetic DNA
tatctctacatattaatg

SEQ ID NO: 55423 - DNA, 18 bp, Artificial Sequence
  Synthetic DNA
tatctcttctcactattg

SEQ ID NO: 55424 - DNA, 18 bp, Artificial Sequence
  Synthetic DNA
tatctggacttactatag

SEQ ID NO: 55425 - DNA, 18 bp, Artificial Sequence
  Synthetic DNA
tatctttccacacttatg

SEQ ID NO: 55426 - DNA, 18 bp, Artificial Sequence
  Synthetic DNA
tatgaactcacactacag

SEQ ID NO: 55427 - DNA, 18 bp, Artificial Sequence
  Synthetic DNA
tatgaagaagcacttttg

SEQ ID NO: 55428 - DNA, 18 bp, Artificial Sequence
  Synthetic DNA
tatgacgacttgatttag

SEQ ID NO: 55429 - DNA, 18 bp, Artificial Sequence
  Synthetic DNA
tatgactactatcactag

SEQ ID NO: 55430 - DNA, 18 bp, Artificial Sequence
  Synthetic DNA
tatgactaggcaatatag

SEQ ID NO: 55431 - DNA, 18 bp, Artificial Sequence
  Synthetic DNA
tatgaggactcacaaaag

SEQ ID NO: 55432 - DNA, 18 bp, Artificial Sequence
  Synthetic DNA
tatgaggactgcctttag

SEQ ID NO: 55433 - DNA, 18 bp, Artificial Sequence
  Synthetic DNA
tatgaggattgtctaaag

SEQ ID NO: 55434 - DNA, 18 bp, Artificial Sequence
  Synthetic DNA
tatgatgtctctctttag

SEQ ID NO: 55435 - DNA, 18 bp, Artificial Sequence
  Synthetic DNA
tatgtcaacacgctatag

SEQ ID NO: 55436 - DNA, 18 bp, Artificial Sequence
  Synthetic DNA
tatgtcgaatcactatcg

SEQ ID NO: 55437 - DNA, 18 bp, Artificial Sequence
  Synthetic DNA
tatgtctactccctttag

SEQ ID NO: 55438 - DNA, 18 bp, Artificial Sequence
  Synthetic DNA
tatgttgacttaataaag

SEQ ID NO: 55439 - DNA, 18 bp, Artificial Sequence
  Synthetic DNA
tattaaaacaaactttag

SEQ ID NO: 55440 - DNA, 18 bp, Artificial Sequence
  Synthetic DNA
tattaaaacccactgtag

SEQ ID NO: 55441 - DNA, 18 bp, Artificial Sequence
  Synthetic DNA
tattaaaagttaccaaag

SEQ ID NO: 55442 - DNA, 18 bp, Artificial Sequence
  Synthetic DNA
tattaaaataaactctcg

SEQ ID NO: 55443 - DNA, 18 bp, Artificial Sequence
  Synthetic DNA
tattaaaattgacaaaag

SEQ ID NO: 55444 - DNA, 18 bp, Artificial Sequence
  Synthetic DNA
tattaaatctcaaaatag

SEQ ID NO: 55445 - DNA, 18 bp, Artificial Sequence
  Synthetic DNA
tattaacactccctattg

SEQ ID NO: 55446 - DNA, 18 bp, Artificial Sequence
  Synthetic DNA
tattaacactctcaaaag

SEQ ID NO: 55447 - DNA, 18 bp, Artificial Sequence
  Synthetic DNA
tattaagaatctctagag

SEQ ID NO: 55448 - DNA, 18 bp, Artificial Sequence
  Synthetic DNA
tattaagaattacttttg

SEQ ID NO: 55449 - DNA, 18 bp, Artificial Sequence
  Synthetic DNA
tattaagacacagtctag

SEQ ID NO: 55450 - DNA, 18 bp, Artificial Sequence
  Synthetic DNA
tattaagactgattaaag

SEQ ID NO: 55451 - DNA, 18 bp, Artificial Sequence
  Synthetic DNA
tattaagatctactatag

SEQ ID NO: 55452 - DNA, 18 bp, Artificial Sequence
  Synthetic DNA
tattaagattctcgatag

SEQ ID NO: 55453 - DNA, 18 bp, Artificial Sequence
  Synthetic DNA
tattaagccacactctag

SEQ ID NO: 55454 - DNA, 18 bp, Artificial Sequence
  Synthetic DNA
tattaagcctctctactg

SEQ ID NO: 55455 - DNA, 18 bp, Artificial Sequence
  Synthetic DNA
tattaagtcccactatgg

SEQ ID NO: 55456 - DNA, 18 bp, Artificial Sequence
  Synthetic DNA
tattaagtctcaccttag

SEQ ID NO: 55457 - DNA, 18 bp, Artificial Sequence
  Synthetic DNA
tattaagtctctcaattg

SEQ ID NO: 55458 - DNA, 18 bp, Artificial Sequence
  Synthetic DNA
tattaataccctccctag

SEQ ID NO: 55459 - DNA, 18 bp, Artificial Sequence
  Synthetic DNA
tattaatattcattgtgg

SEQ ID NO: 55460 - DNA, 18 bp, Artificial Sequence
  Synthetic DNA
tattacaaaacattatag

SEQ ID NO: 55461 - DNA, 18 bp, Artificial Sequence
  Synthetic DNA
tattacaacacaggatag

SEQ ID NO: 55462 - DNA, 18 bp, Artificial Sequence
  Synthetic DNA
tattacaacccaagaaag

SEQ ID NO: 55463 - DNA, 18 bp, Artificial Sequence
  Synthetic DNA
tattacaacctactcttg

SEQ ID NO: 55464 - DNA, 18 bp, Artificial Sequence
  Synthetic DNA
tattacaactcaatttaa

SEQ ID NO: 55465 - DNA, 18 bp, Artificial Sequence
  Synthetic DNA
tattacaactttccaatg

SEQ ID NO: 55466 - DNA, 18 bp, Artificial Sequence
  Synthetic DNA
tattacacctccctatcg

SEQ ID NO: 55467 - DNA, 18 bp, Artificial Sequence
  Synthetic DNA
tattacatcacaatttag

SEQ ID NO: 55468 - DNA, 18 bp, Artificial Sequence
  Synthetic DNA
tattacatcgcactatcg

SEQ ID NO: 55469 - DNA, 18 bp, Artificial Sequence
  Synthetic DNA
tattacatctcacacagg

SEQ ID NO: 55470 - DNA, 18 bp, Artificial Sequence
  Synthetic DNA
tattacatctctgtatag

SEQ ID NO: 55471 - DNA, 18 bp, Artificial Sequence
  Synthetic DNA
tattacatttccctatag

SEQ ID NO: 55472 - DNA, 18 bp, Artificial Sequence
  Synthetic DNA
tattaccaatccctagag

SEQ ID NO: 55473 - DNA, 18 bp, Artificial Sequence
  Synthetic DNA
tattaccactatttatag

SEQ ID NO: 55474 - DNA, 18 bp, Artificial Sequence
  Synthetic DNA
tattaccactcacaaatg

SEQ ID NO: 55475 - DNA, 18 bp, Artificial Sequence
  Synthetic DNA
tattaccactcgttagag

SEQ ID NO: 55476 - DNA, 18 bp, Artificial Sequence
  Synthetic DNA
tattaccacttagtgtag

SEQ ID NO: 55477 - DNA, 18 bp, Artificial Sequence
  Synthetic DNA
tattaccagtcgttgtag

SEQ ID NO: 55478 - DNA, 18 bp, Artificial Sequence
  Synthetic DNA
tattacctatagctttag

SEQ ID NO: 55479 - DNA, 18 bp, Artificial Sequence
  Synthetic DNA
tattacctattactaaag

SEQ ID NO: 55480 - DNA, 18 bp, Artificial Sequence
  Synthetic DNA
tattacctctcagtcaag

SEQ ID NO: 55481 - DNA, 18 bp, Artificial Sequence
  Synthetic DNA
tattacctctctcaatag

SEQ ID NO: 55482 - DNA, 18 bp, Artificial Sequence
  Synthetic DNA
tattacgaagcgactcag

SEQ ID NO: 55483 - DNA, 18 bp, Artificial Sequence
  Synthetic DNA
tattacgacacattcatg

SEQ ID NO: 55484 - DNA, 18 bp, Artificial Sequence
  Synthetic DNA
tattacgacacgacatag

SEQ ID NO: 55485 - DNA, 18 bp, Artificial Sequence
  Synthetic DNA
tattacgacactcatcag

SEQ ID NO: 55486 - DNA, 18 bp, Artificial Sequence
  Synthetic DNA
tattacgacattatttag

SEQ ID NO: 55487 - DNA, 18 bp, Artificial Sequence
  Synthetic DNA
tattacgaccaataatag

SEQ ID NO: 55488 - DNA, 18 bp, Artificial Sequence
  Synthetic DNA
tattacgacgcgctcaag

SEQ ID NO: 55489 - DNA, 18 bp, Artificial Sequence
  Synthetic DNA
tattacgacggaaattag

SEQ ID NO: 55490 - DNA, 18 bp, Artificial Sequence
  Synthetic DNA
tattacgactcacatctg

SEQ ID NO: 55491 - DNA, 18 bp, Artificial Sequence
  Synthetic DNA
tattacgactctacattg

SEQ ID NO: 55492 - DNA, 18 bp, Artificial Sequence
  Synthetic DNA
tattacgactgacactcg

SEQ ID NO: 55493 - DNA, 18 bp, Artificial Sequence
  Synthetic DNA
tattacgacttcctgctg

SEQ ID NO: 55494 - DNA, 18 bp, Artificial Sequence
  Synthetic DNA
tattacgagacacttagg

SEQ ID NO: 55495 - DNA, 18 bp, Artificial Sequence
  Synthetic DNA
tattacgatacacttaag

SEQ ID NO: 55496 - DNA, 18 bp, Artificial Sequence
  Synthetic DNA
tattacgataccctaaag

SEQ ID NO: 55497 - DNA, 18 bp, Artificial Sequence
  Synthetic DNA
tattacgattcatgcaag

SEQ ID NO: 55498 - DNA, 18 bp, Artificial Sequence
  Synthetic DNA
tattacgattctataaag

SEQ ID NO: 55499 - DNA, 18 bp, Artificial Sequence
  Synthetic DNA
tattacgatttacatagg

SEQ ID NO: 55500 - DNA, 18 bp, Artificial Sequence
  Synthetic DNA
tattacgccactttaatg

SEQ ID NO: 55501 - DNA, 18 bp, Artificial Sequence
  Synthetic DNA
tattacgcctctcaacag

SEQ ID NO: 55502 - DNA, 18 bp, Artificial Sequence
  Synthetic DNA
tattacgctatactaatg

SEQ ID NO: 55503 - DNA, 18 bp, Artificial Sequence
  Synthetic DNA
tattacgcttcgctttag

SEQ ID NO: 55504 - DNA, 18 bp, Artificial Sequence
  Synthetic DNA
tattacggaacattatag

SEQ ID NO: 55505 - DNA, 18 bp, Artificial Sequence
  Synthetic DNA
tattacggatcacaaaag

SEQ ID NO: 55506 - DNA, 18 bp, Artificial Sequence
  Synthetic DNA
tattacggcttttaactg

SEQ ID NO: 55507 - DNA, 18 bp, Artificial Sequence
  Synthetic DNA
tattacgggtaactaaag

SEQ ID NO: 55508 - DNA, 18 bp, Artificial Sequence
  Synthetic DNA
tattacggttgtctaaag

SEQ ID NO: 55509 - DNA, 18 bp, Artificial Sequence
  Synthetic DNA
tattacgtatctctgatg

SEQ ID NO: 55510 - DNA, 18 bp, Artificial Sequence
  Synthetic DNA
tattacgtcaaagtaaag

SEQ ID NO: 55511 - DNA, 18 bp, Artificial Sequence
  Synthetic DNA
tattacgtcttattattg

SEQ ID NO: 55512 - DNA, 18 bp, Artificial Sequence
  Synthetic DNA
tattacgtgcaactttag

SEQ ID NO: 55513 - DNA, 18 bp, Artificial Sequence
  Synthetic DNA
tattacgtgtctcaacag

SEQ ID NO: 55514 - DNA, 18 bp, Artificial Sequence
  Synthetic DNA
tattacgtgttaccatag

SEQ ID NO: 55515 - DNA, 18 bp, Artificial Sequence
  Synthetic DNA
tattacgttattcttaag

SEQ ID NO: 55516 - DNA, 18 bp, Artificial Sequence
  Synthetic DNA
tattactaaccactattg

SEQ ID NO: 55517 - DNA, 18 bp, Artificial Sequence
  Synthetic DNA
tattactacaaattattg

SEQ ID NO: 55518 - DNA, 18 bp, Artificial Sequence
  Synthetic DNA
tattactacacacaacag

SEQ ID NO: 55519 - DNA, 18 bp, Artificial Sequence
  Synthetic DNA
tattactacacacagaag

SEQ ID NO: 55520 - DNA, 18 bp, Artificial Sequence
  Synthetic DNA
tattactacacgctcaag

SEQ ID NO: 55521 - DNA, 18 bp, Artificial Sequence
  Synthetic DNA
tattactacactttatag

SEQ ID NO: 55522 - DNA, 18 bp, Artificial Sequence
  Synthetic DNA
tattactacctaatgtag

SEQ ID NO: 55523 - DNA, 18 bp, Artificial Sequence
  Synthetic DNA
tattactagtctcaatag

SEQ ID NO: 55524 - DNA, 18 bp, Artificial Sequence
  Synthetic DNA
tattactattcagtttag

SEQ ID NO: 55525 - DNA, 18 bp, Artificial Sequence
  Synthetic DNA
tattactattgtctatcg

SEQ ID NO: 55526 - DNA, 18 bp, Artificial Sequence
  Synthetic DNA
tattactgctaactaaag

SEQ ID NO: 55527 - DNA, 18 bp, Artificial Sequence
  Synthetic DNA
tattacttatcgcaacag

SEQ ID NO: 55528 - DNA, 18 bp, Artificial Sequence
  Synthetic DNA
tattacttcttaccatag

SEQ ID NO: 55529 - DNA, 18 bp, Artificial Sequence
  Synthetic DNA
tattacttttcacatacg

SEQ ID NO: 55530 - DNA, 18 bp, Artificial Sequence
  Synthetic DNA
tattacttttcatcaagg

SEQ ID NO: 55531 - DNA, 18 bp, Artificial Sequence
  Synthetic DNA
tattagaagacaccaaag

SEQ ID NO: 55532 - DNA, 18 bp, Artificial Sequence
  Synthetic DNA
tattagatctcaatatag

SEQ ID NO: 55533 - DNA, 18 bp, Artificial Sequence
  Synthetic DNA
tattagatcttacagtag

SEQ ID NO: 55534 - DNA, 18 bp, Artificial Sequence
  Synthetic DNA
tattaggaataccatttg

SEQ ID NO: 55535 - DNA, 18 bp, Artificial Sequence
  Synthetic DNA
tattaggacagtttatag

SEQ ID NO: 55536 - DNA, 18 bp, Artificial Sequence
  Synthetic DNA
tattaggactttctaaag

SEQ ID NO: 55537 - DNA, 18 bp, Artificial Sequence
  Synthetic DNA
tattaggattatacatag

SEQ ID NO: 55538 - DNA, 18 bp, Artificial Sequence
  Synthetic DNA
tattaggtcccactaaag

SEQ ID NO: 55539 - DNA, 18 bp, Artificial Sequence
  Synthetic DNA
tattaggtctctcaattg

SEQ ID NO: 55540 - DNA, 18 bp, Artificial Sequence
  Synthetic DNA
tattaggtctctctatcg

SEQ ID NO: 55541 - DNA, 18 bp, Artificial Sequence
  Synthetic DNA
tattaggttacaaaatag

SEQ ID NO: 55542 - DNA, 18 bp, Artificial Sequence
  Synthetic DNA
tattagttctcacaattg

SEQ ID NO: 55543 - DNA, 18 bp, Artificial Sequence
  Synthetic DNA
tattataggtctctttcg

SEQ ID NO: 55544 - DNA, 18 bp, Artificial Sequence
  Synthetic DNA
tattatcttacactttag

SEQ ID NO: 55545 - DNA, 18 bp, Artificial Sequence
  Synthetic DNA
tattatgaatcacttgag

SEQ ID NO: 55546 - DNA, 18 bp, Artificial Sequence
  Synthetic DNA
tattatgaatctccttag

SEQ ID NO: 55547 - DNA, 18 bp, Artificial Sequence
  Synthetic DNA
tattatgacatactttag

SEQ ID NO: 55548 - DNA, 18 bp, Artificial Sequence
  Synthetic DNA
tattatgagtcacaattg

SEQ ID NO: 55549 - DNA, 18 bp, Artificial Sequence
  Synthetic DNA
tattatgatattcaatta

SEQ ID NO: 55550 - DNA, 18 bp, Artificial Sequence
  Synthetic DNA
tattatgattcattaatg

SEQ ID NO: 55551 - DNA, 18 bp, Artificial Sequence
  Synthetic DNA
tattatgcctctctcaag

SEQ ID NO: 55552 - DNA, 18 bp, Artificial Sequence
  Synthetic DNA
tattatggcatattatgg

SEQ ID NO: 55553 - DNA, 18 bp, Artificial Sequence
  Synthetic DNA
tattatggttcacctaag

SEQ ID NO: 55554 - DNA, 18 bp, Artificial Sequence
  Synthetic DNA
tattatgtcacacaatag

SEQ ID NO: 55555 - DNA, 18 bp, Artificial Sequence
  Synthetic DNA
tattatgtctcactaatg

SEQ ID NO: 55556 - DNA, 18 bp, Artificial Sequence
  Synthetic DNA
tattatgtctctctgtcg

SEQ ID NO: 55557 - DNA, 18 bp, Artificial Sequence
  Synthetic DNA
tattatgtttcaatatag

SEQ ID NO: 55558 - DNA, 18 bp, Artificial Sequence
  Synthetic DNA
tattattacagactatag

SEQ ID NO: 55559 - DNA, 18 bp, Artificial Sequence
  Synthetic DNA
tattattactctctctag

SEQ ID NO: 55560 - DNA, 18 bp, Artificial Sequence
  Synthetic DNA
tattattttttactgtag

SEQ ID NO: 55561 - DNA, 18 bp, Artificial Sequence
  Synthetic DNA
tattcagactcacttttg

SEQ ID NO: 55562 - DNA, 18 bp, Artificial Sequence
  Synthetic DNA
tattcagactcgctttag

SEQ ID NO: 55563 - DNA, 18 bp, Artificial Sequence
  Synthetic DNA
tattcagtctcactatcg

SEQ ID NO: 55564 - DNA, 18 bp, Artificial Sequence
  Synthetic DNA
tattccaacacacaatcg

SEQ ID NO: 55565 - DNA, 18 bp, Artificial Sequence
  Synthetic DNA
tattccgacgggctacag

SEQ ID NO: 55566 - DNA, 18 bp, Artificial Sequence
  Synthetic DNA
tattccgactcacaagtg

SEQ ID NO: 55567 - DNA, 18 bp, Artificial Sequence
  Synthetic DNA
tattccgactcgctgttg

SEQ ID NO: 55568 - DNA, 18 bp, Artificial Sequence
  Synthetic DNA
tattccgattctctattg

SEQ ID NO: 55569 - DNA, 18 bp, Artificial Sequence
  Synthetic DNA
tattccgtatctatttag

SEQ ID NO: 55570 - DNA, 18 bp, Artificial Sequence
  Synthetic DNA
tattccgtctgactgaag

SEQ ID NO: 55571 - DNA, 18 bp, Artificial Sequence
  Synthetic DNA
tattcctaatcactaagg

SEQ ID NO: 55572 - DNA, 18 bp, Artificial Sequence
  Synthetic DNA
tattcctatttcccttag

SEQ ID NO: 55573 - DNA, 18 bp, Artificial Sequence
  Synthetic DNA
tattcgcatactcaatag

SEQ ID NO: 55574 - DNA, 18 bp, Artificial Sequence
  Synthetic DNA
tattcggactctcaatag

SEQ ID NO: 55575 - DNA, 18 bp, Artificial Sequence
  Synthetic DNA
tattctaactaactattg

SEQ ID NO: 55576 - DNA, 18 bp, Artificial Sequence
  Synthetic DNA
tattctggcccacaatag

SEQ ID NO: 55577 - DNA, 18 bp, Artificial Sequence
  Synthetic DNA
tattcttactaaatctag

SEQ ID NO: 55578 - DNA, 18 bp, Artificial Sequence
  Synthetic DNA
tattgacactcacagtag

SEQ ID NO: 55579 - DNA, 18 bp, Artificial Sequence
  Synthetic DNA
tattgagtctcattattg

SEQ ID NO: 55580 - DNA, 18 bp, Artificial Sequence
  Synthetic DNA
tattgccagttactatag

SEQ ID NO: 55581 - DNA, 18 bp, Artificial Sequence
  Synthetic DNA
tattgcgaatcactaatg

SEQ ID NO: 55582 - DNA, 18 bp, Artificial Sequence
  Synthetic DNA
tattgcgaatcattgtag

SEQ ID NO: 55583 - DNA, 18 bp, Artificial Sequence
  Synthetic DNA
tattgcgacaaacattag

SEQ ID NO: 55584 - DNA, 18 bp, Artificial Sequence
  Synthetic DNA
tattgcgactgtctaatg

SEQ ID NO: 55585 - DNA, 18 bp, Artificial Sequence
  Synthetic DNA
tattgcgacttgctttag

SEQ ID NO: 55586 - DNA, 18 bp, Artificial Sequence
  Synthetic DNA
tattgcgattcagttttg

SEQ ID NO: 55587 - DNA, 18 bp, Artificial Sequence
  Synthetic DNA
tattgctacttacttccg

SEQ ID NO: 55588 - DNA, 18 bp, Artificial Sequence
  Synthetic DNA
tattgctactttctacag

SEQ ID NO: 55589 - DNA, 18 bp, Artificial Sequence
  Synthetic DNA
tattgcttgtcactaaag

SEQ ID NO: 55590 - DNA, 18 bp, Artificial Sequence
  Synthetic DNA
tattgtgactcactactg

SEQ ID NO: 55591 - DNA, 18 bp, Artificial Sequence
  Synthetic DNA
tattgttgctcactatgg

SEQ ID NO: 55592 - DNA, 18 bp, Artificial Sequence
  Synthetic DNA
tatttactttcaatttag

SEQ ID NO: 55593 - DNA, 18 bp, Artificial Sequence
  Synthetic DNA
tatttagactgacagtag

SEQ ID NO: 55594 - DNA, 18 bp, Artificial Sequence
  Synthetic DNA
tatttagattcataatag

SEQ ID NO: 55595 - DNA, 18 bp, Artificial Sequence
  Synthetic DNA
tatttagcatcacttcag

SEQ ID NO: 55596 - DNA, 18 bp, Artificial Sequence
  Synthetic DNA
tatttagtcacgctattg

SEQ ID NO: 55597 - DNA, 18 bp, Artificial Sequence
  Synthetic DNA
tatttcaaatgatattag

SEQ ID NO: 55598 - DNA, 18 bp, Artificial Sequence
  Synthetic DNA
tatttcaacgcgctattg

SEQ ID NO: 55599 - DNA, 18 bp, Artificial Sequence
  Synthetic DNA
tatttcaactatctatag

SEQ ID NO: 55600 - DNA, 18 bp, Artificial Sequence
  Synthetic DNA
tatttcaactccctacag

SEQ ID NO: 55601 - DNA, 18 bp, Artificial Sequence
  Synthetic DNA
tatttcaacttactatcg

SEQ ID NO: 55602 - DNA, 18 bp, Artificial Sequence
  Synthetic DNA
tatttcaagtcgtaaagg

SEQ ID NO: 55603 - DNA, 18 bp, Artificial Sequence
  Synthetic DNA
tatttcaattcacaacag

SEQ ID NO: 55604 - DNA, 18 bp, Artificial Sequence
  Synthetic DNA
tatttccactcacaaaag

SEQ ID NO: 55605 - DNA, 18 bp, Artificial Sequence
  Synthetic DNA
tatttccactcacggtgg

SEQ ID NO: 55606 - DNA, 18 bp, Artificial Sequence
  Synthetic DNA
tatttcgaatcactcaag

SEQ ID NO: 55607 - DNA, 18 bp, Artificial Sequence
  Synthetic DNA
tatttcgacccacattag

SEQ ID NO: 55608 - DNA, 18 bp, Artificial Sequence
  Synthetic DNA
tatttcgacccactcctg

SEQ ID NO: 55609 - DNA, 18 bp, Artificial Sequence
  Synthetic DNA
tatttcgactaataattg

SEQ ID NO: 55610 - DNA, 18 bp, Artificial Sequence
  Synthetic DNA
tatttcgactcaccaatg

SEQ ID NO: 55611 - DNA, 18 bp, Artificial Sequence
  Synthetic DNA
tatttcgactcacggtgg

SEQ ID NO: 55612 - DNA, 18 bp, Artificial Sequence
  Synthetic DNA
tatttcgactcgccaaag

SEQ ID NO: 55613 - DNA, 18 bp, Artificial Sequence
  Synthetic DNA
tatttcgactcgttttag

SEQ ID NO: 55614 - DNA, 18 bp, Artificial Sequence
  Synthetic DNA
tatttcgagtagctgtag

SEQ ID NO: 55615 - DNA, 18 bp, Artificial Sequence
  Synthetic DNA
tatttcgataaactgtag

SEQ ID NO: 55616 - DNA, 18 bp, Artificial Sequence
  Synthetic DNA
tatttcgatacactaaag

SEQ ID NO: 55617 - DNA, 18 bp, Artificial Sequence
  Synthetic DNA
tatttcggatcacaatag

SEQ ID NO: 55618 - DNA, 18 bp, Artificial Sequence
  Synthetic DNA
tatttcggctccgtaaag

SEQ ID NO: 55619 - DNA, 18 bp, Artificial Sequence
  Synthetic DNA
tatttcggttcacagtag

SEQ ID NO: 55620 - DNA, 18 bp, Artificial Sequence
  Synthetic DNA
tatttcgtcaaaccatag

SEQ ID NO: 55621 - DNA, 18 bp, Artificial Sequence
  Synthetic DNA
tatttctaattcattctg

SEQ ID NO: 55622 - DNA, 18 bp, Artificial Sequence
  Synthetic DNA
tatttctgctcacctcgg

SEQ ID NO: 55623 - DNA, 18 bp, Artificial Sequence
  Synthetic DNA
tatttcttctcactatgg

SEQ ID NO: 55624 - DNA, 18 bp, Artificial Sequence
  Synthetic DNA
tatttggacactccctag

SEQ ID NO: 55625 - DNA, 18 bp, Artificial Sequence
  Synthetic DNA
tatttggaccccctattg

SEQ ID NO: 55626 - DNA, 18 bp, Artificial Sequence
  Synthetic DNA
tatttggactcacttttg

SEQ ID NO: 55627 - DNA, 18 bp, Artificial Sequence
  Synthetic DNA
tatttggcctatctttag

SEQ ID NO: 55628 - DNA, 18 bp, Artificial Sequence
  Synthetic DNA
tatttgtaatcagcatag

SEQ ID NO: 55629 - DNA, 18 bp, Artificial Sequence
  Synthetic DNA
tattttatcaacctatag

SEQ ID NO: 55630 - DNA, 18 bp, Artificial Sequence
  Synthetic DNA
tattttcactcacaattg

SEQ ID NO: 55631 - DNA, 18 bp, Artificial Sequence
  Synthetic DNA
tattttgactctcttttg

SEQ ID NO: 55632 - DNA, 18 bp, Artificial Sequence
  Synthetic DNA
tattttgcaacaccattg

SEQ ID NO: 55633 - DNA, 18 bp, Artificial Sequence
  Synthetic DNA
tattttggttaacaacag

SEQ ID NO: 55634 - DNA, 18 bp, Artificial Sequence
  Synthetic DNA
tattttgtttatctatag

SEQ ID NO: 55635 - DNA, 18 bp, Artificial Sequence
  Synthetic DNA
tatttttactcactttcg

SEQ ID NO: 55636 - DNA, 18 bp, Artificial Sequence
  Synthetic DNA
tcaaaacacttcacaaag

SEQ ID NO: 55637 - DNA, 18 bp, Artificial Sequence
  Synthetic DNA
tcaaaatattcactatag

SEQ ID NO: 55638 - DNA, 18 bp, Artificial Sequence
  Synthetic DNA
tcaaacaacacactacag

SEQ ID NO: 55639 - DNA, 18 bp, Artificial Sequence
  Synthetic DNA
tcaaacaattcactttag

SEQ ID NO: 55640 - DNA, 18 bp, Artificial Sequence
  Synthetic DNA
tcaaacctctcacctttg

SEQ ID NO: 55641 - DNA, 18 bp, Artificial Sequence
  Synthetic DNA
tcaaacctgtgaatagag

SEQ ID NO: 55642 - DNA, 18 bp, Artificial Sequence
  Synthetic DNA
tcaaacgactcacgttgg

SEQ ID NO: 55643 - DNA, 18 bp, Artificial Sequence
  Synthetic DNA
tcaaacgagtcataaaag

SEQ ID NO: 55644 - DNA, 18 bp, Artificial Sequence
  Synthetic DNA
tcaaacgagtctctgtag

SEQ ID NO: 55645 - DNA, 18 bp, Artificial Sequence
  Synthetic DNA
tcaaacgattaactatcg

SEQ ID NO: 55646 - DNA, 18 bp, Artificial Sequence
  Synthetic DNA
tcaaacgcctaacaaaag

SEQ ID NO: 55647 - DNA, 18 bp, Artificial Sequence
  Synthetic DNA
tcaaacgtcacaataaag

SEQ ID NO: 55648 - DNA, 18 bp, Artificial Sequence
  Synthetic DNA
tcaaacgtgtcactaatg

SEQ ID NO: 55649 - DNA, 18 bp, Artificial Sequence
  Synthetic DNA
tcaaacgtgtttttttag

SEQ ID NO: 55650 - DNA, 18 bp, Artificial Sequence
  Synthetic DNA
tcaaaggactgtctatag

SEQ ID NO: 55651 - DNA, 18 bp, Artificial Sequence
  Synthetic DNA
tcaaatgactctcaatcg

SEQ ID NO: 55652 - DNA, 18 bp, Artificial Sequence
  Synthetic DNA
tcaaatgactctctatcg

SEQ ID NO: 55653 - DNA, 18 bp, Artificial Sequence
  Synthetic DNA
tcaaatgttttagatttg

SEQ ID NO: 55654 - DNA, 18 bp, Artificial Sequence
  Synthetic DNA
tcaaccaacttactatag

SEQ ID NO: 55655 - DNA, 18 bp, Artificial Sequence
  Synthetic DNA
tcaagcgtctctctatag

SEQ ID NO: 55656 - DNA, 18 bp, Artificial Sequence
  Synthetic DNA
tcaagctactcattattg

SEQ ID NO: 55657 - DNA, 18 bp, Artificial Sequence
  Synthetic DNA
tcaagctactccctaaag

SEQ ID NO: 55658 - DNA, 18 bp, Artificial Sequence
  Synthetic DNA
tcaatcaactcacttaag

SEQ ID NO: 55659 - DNA, 18 bp, Artificial Sequence
  Synthetic DNA
tcaatcctcttactattg

SEQ ID NO: 55660 - DNA, 18 bp, Artificial Sequence
  Synthetic DNA
tcaatcgacccaccatag

SEQ ID NO: 55661 - DNA, 18 bp, Artificial Sequence
  Synthetic DNA
tcaatcgagtcactagtg

SEQ ID NO: 55662 - DNA, 18 bp, Artificial Sequence
  Synthetic DNA
tcaatcgtcttcctatag

SEQ ID NO: 55663 - DNA, 18 bp, Artificial Sequence
  Synthetic DNA
tcaatctaaatattattg

SEQ ID NO: 55664 - DNA, 18 bp, Artificial Sequence
  Synthetic DNA
tcacacgaaactctaatg

SEQ ID NO: 55665 - DNA, 18 bp, Artificial Sequence
  Synthetic DNA
tcacacgattcgattttg

SEQ ID NO: 55666 - DNA, 18 bp, Artificial Sequence
  Synthetic DNA
tcaccagtctttctatag

SEQ ID NO: 55667 - DNA, 18 bp, Artificial Sequence
  Synthetic DNA
tcactccactcactagag

SEQ ID NO: 55668 - DNA, 18 bp, Artificial Sequence
  Synthetic DNA
tcagacgtctcacgatgg

SEQ ID NO: 55669 - DNA, 18 bp, Artificial Sequence
  Synthetic DNA
tcagatgtcttattatag

SEQ ID NO: 55670 - DNA, 18 bp, Artificial Sequence
  Synthetic DNA
tcataaggctgtccatag

SEQ ID NO: 55671 - DNA, 18 bp, Artificial Sequence
  Synthetic DNA
tcataagtctcattattg

SEQ ID NO: 55672 - DNA, 18 bp, Artificial Sequence
  Synthetic DNA
tcataatactcaatacgg

SEQ ID NO: 55673 - DNA, 18 bp, Artificial Sequence
  Synthetic DNA
tcatacaactctacgtag

SEQ ID NO: 55674 - DNA, 18 bp, Artificial Sequence
  Synthetic DNA
tcatacaactctcagaag

SEQ ID NO: 55675 - DNA, 18 bp, Artificial Sequence
  Synthetic DNA
tcatacatcacactctgg

SEQ ID NO: 55676 - DNA, 18 bp, Artificial Sequence
  Synthetic DNA
tcataccattcactagtg

SEQ ID NO: 55677 - DNA, 18 bp, Artificial Sequence
  Synthetic DNA
tcatacctctcaatattg

SEQ ID NO: 55678 - DNA, 18 bp, Artificial Sequence
  Synthetic DNA
tcatacgacgcacataag

SEQ ID NO: 55679 - DNA, 18 bp, Artificial Sequence
  Synthetic DNA
tcatacgactcagagaag

SEQ ID NO: 55680 - DNA, 18 bp, Artificial Sequence
  Synthetic DNA
tcatacgactctctcatg

SEQ ID NO: 55681 - DNA, 18 bp, Artificial Sequence
  Synthetic DNA
tcatacgactcttgttag

SEQ ID NO: 55682 - DNA, 18 bp, Artificial Sequence
  Synthetic DNA
tcatacgagtctcattag

SEQ ID NO: 55683 - DNA, 18 bp, Artificial Sequence
  Synthetic DNA
tcatacgattaacaatcg

SEQ ID NO: 55684 - DNA, 18 bp, Artificial Sequence
  Synthetic DNA
tcatacgccacagtctag

SEQ ID NO: 55685 - DNA, 18 bp, Artificial Sequence
  Synthetic DNA
tcatacgcttcaatattg

SEQ ID NO: 55686 - DNA, 18 bp, Artificial Sequence
  Synthetic DNA
tcatacggcttgctagag

SEQ ID NO: 55687 - DNA, 18 bp, Artificial Sequence
  Synthetic DNA
tcatacggttcactaatg

SEQ ID NO: 55688 - DNA, 18 bp, Artificial Sequence
  Synthetic DNA
tcatacggttctctacag

SEQ ID NO: 55689 - DNA, 18 bp, Artificial Sequence
  Synthetic DNA
tcatacgtatcgcaatag

SEQ ID NO: 55690 - DNA, 18 bp, Artificial Sequence
  Synthetic DNA
tcatacgtcgcacaattg

SEQ ID NO: 55691 - DNA, 18 bp, Artificial Sequence
  Synthetic DNA
tcatacgtctaaccattg

SEQ ID NO: 55692 - DNA, 18 bp, Artificial Sequence
  Synthetic DNA
tcatacgtctatcattag

SEQ ID NO: 55693 - DNA, 18 bp, Artificial Sequence
  Synthetic DNA
tcatacgtctcatactag

SEQ ID NO: 55694 - DNA, 18 bp, Artificial Sequence
  Synthetic DNA
tcatacgtctcatttttg

SEQ ID NO: 55695 - DNA, 18 bp, Artificial Sequence
  Synthetic DNA
tcatacgtctcttaatag

SEQ ID NO: 55696 - DNA, 18 bp, Artificial Sequence
  Synthetic DNA
tcatacgttacactaaag

SEQ ID NO: 55697 - DNA, 18 bp, Artificial Sequence
  Synthetic DNA
tcatactaagctcaatag

SEQ ID NO: 55698 - DNA, 18 bp, Artificial Sequence
  Synthetic DNA
tcatactaatcacatagg

SEQ ID NO: 55699 - DNA, 18 bp, Artificial Sequence
  Synthetic DNA
tcatactacttacggttg

SEQ ID NO: 55700 - DNA, 18 bp, Artificial Sequence
  Synthetic DNA
tcatactacttccatttg

SEQ ID NO: 55701 - DNA, 18 bp, Artificial Sequence
  Synthetic DNA
tcatactattctcattcg

SEQ ID NO: 55702 - DNA, 18 bp, Artificial Sequence
  Synthetic DNA
tcatactattctctttag

SEQ ID NO: 55703 - DNA, 18 bp, Artificial Sequence
  Synthetic DNA
tcatactcgtcactattg

SEQ ID NO: 55704 - DNA, 18 bp, Artificial Sequence
  Synthetic DNA
tcatacttctcacttcag

SEQ ID NO: 55705 - DNA, 18 bp, Artificial Sequence
  Synthetic DNA
tcatagaacatattatcg

SEQ ID NO: 55706 - DNA, 18 bp, Artificial Sequence
  Synthetic DNA
tcataggaatctcaagag

SEQ ID NO: 55707 - DNA, 18 bp, Artificial Sequence
  Synthetic DNA
tcataggactcaatctgg

SEQ ID NO: 55708 - DNA, 18 bp, Artificial Sequence
  Synthetic DNA
tcataggactctcaattg

SEQ ID NO: 55709 - DNA, 18 bp, Artificial Sequence
  Synthetic DNA
tcataggattctttattg

SEQ ID NO: 55710 - DNA, 18 bp, Artificial Sequence
  Synthetic DNA
tcatagtactcacaaaag

SEQ ID NO: 55711 - DNA, 18 bp, Artificial Sequence
  Synthetic DNA
tcatatcactatttatgg

SEQ ID NO: 55712 - DNA, 18 bp, Artificial Sequence
  Synthetic DNA
tcatatgaatgacttcag

SEQ ID NO: 55713 - DNA, 18 bp, Artificial Sequence
  Synthetic DNA
tcatatgactgacataag

SEQ ID NO: 55714 - DNA, 18 bp, Artificial Sequence
  Synthetic DNA
tcatatgactgcaattag

SEQ ID NO: 55715 - DNA, 18 bp, Artificial Sequence
  Synthetic DNA
tcatatgtatctccaaag

SEQ ID NO: 55716 - DNA, 18 bp, Artificial Sequence
  Synthetic DNA
tcatatgttacactttag

SEQ ID NO: 55717 - DNA, 18 bp, Artificial Sequence
  Synthetic DNA
tcatattactcacagtag

SEQ ID NO: 55718 - DNA, 18 bp, Artificial Sequence
  Synthetic DNA
tcatattactcacttttg

SEQ ID NO: 55719 - DNA, 18 bp, Artificial Sequence
  Synthetic DNA
tcatattcctcactcttg

SEQ ID NO: 55720 - DNA, 18 bp, Artificial Sequence
  Synthetic DNA
tcatcatactggacatag

SEQ ID NO: 55721 - DNA, 18 bp, Artificial Sequence
  Synthetic DNA
tcatccaaatatctatag

SEQ ID NO: 55722 - DNA, 18 bp, Artificial Sequence
  Synthetic DNA
tcatcccactcgcaatag

SEQ ID NO: 55723 - DNA, 18 bp, Artificial Sequence
  Synthetic DNA
tcatccgactcagttaag

SEQ ID NO: 55724 - DNA, 18 bp, Artificial Sequence
  Synthetic DNA
tcatccgagttgcagtag

SEQ ID NO: 55725 - DNA, 18 bp, Artificial Sequence
  Synthetic DNA
tcatccgattcacaatgg

SEQ ID NO: 55726 - DNA, 18 bp, Artificial Sequence
  Synthetic DNA
tcatccgtcactctatag

SEQ ID NO: 55727 - DNA, 18 bp, Artificial Sequence
  Synthetic DNA
tcatctgatccactagag

SEQ ID NO: 55728 - DNA, 18 bp, Artificial Sequence
  Synthetic DNA
tcatcttgtctactatag

SEQ ID NO: 55729 - DNA, 18 bp, Artificial Sequence
  Synthetic DNA
tcatgcgactcacttatg

SEQ ID NO: 55730 - DNA, 18 bp, Artificial Sequence
  Synthetic DNA
tcatgcgccccacttaag

SEQ ID NO: 55731 - DNA, 18 bp, Artificial Sequence
  Synthetic DNA
tcatgcgtctctctttag

SEQ ID NO: 55732 - DNA, 18 bp, Artificial Sequence
  Synthetic DNA
tcatgcttcccaaattag

SEQ ID NO: 55733 - DNA, 18 bp, Artificial Sequence
  Synthetic DNA
tcattcaactagctaaag

SEQ ID NO: 55734 - DNA, 18 bp, Artificial Sequence
  Synthetic DNA
tcattccacatacaaaag

SEQ ID NO: 55735 - DNA, 18 bp, Artificial Sequence
  Synthetic DNA
tcattcgaatccctatgg

SEQ ID NO: 55736 - DNA, 18 bp, Artificial Sequence
  Synthetic DNA
tcattcgacacccaaaag

SEQ ID NO: 55737 - DNA, 18 bp, Artificial Sequence
  Synthetic DNA
tcattcgacccacttcag

SEQ ID NO: 55738 - DNA, 18 bp, Artificial Sequence
  Synthetic DNA
tcattcgccttactaaag

SEQ ID NO: 55739 - DNA, 18 bp, Artificial Sequence
  Synthetic DNA
tcattcgtccatcgttag

SEQ ID NO: 55740 - DNA, 18 bp, Artificial Sequence
  Synthetic DNA
tcattcgtctctcaattg

SEQ ID NO: 55741 - DNA, 18 bp, Artificial Sequence
  Synthetic DNA
tcattcttatccctattg

SEQ ID NO: 55742 - DNA, 18 bp, Artificial Sequence
  Synthetic DNA
tcattcttctcattatcg

SEQ ID NO: 55743 - DNA, 18 bp, Artificial Sequence
  Synthetic DNA
tcattcttctctctatag

SEQ ID NO: 55744 - DNA, 18 bp, Artificial Sequence
  Synthetic DNA
tcattgatctccattaag

SEQ ID NO: 55745 - DNA, 18 bp, Artificial Sequence
  Synthetic DNA
tcatttgactcactaatg

SEQ ID NO: 55746 - DNA, 18 bp, Artificial Sequence
  Synthetic DNA
tccaaccattctcaatag

SEQ ID NO: 55747 - DNA, 18 bp, Artificial Sequence
  Synthetic DNA
tccaacgaatcccattag

SEQ ID NO: 55748 - DNA, 18 bp, Artificial Sequence
  Synthetic DNA
tccaacgactcgcgacag

SEQ ID NO: 55749 - DNA, 18 bp, Artificial Sequence
  Synthetic DNA
tccagatcctcacggtcg

SEQ ID NO: 55750 - DNA, 18 bp, Artificial Sequence
  Synthetic DNA
tccatggactcaagatag

SEQ ID NO: 55751 - DNA, 18 bp, Artificial Sequence
  Synthetic DNA
tcctaagattcataacag

SEQ ID NO: 55752 - DNA, 18 bp, Artificial Sequence
  Synthetic DNA
tcctacgactaacagtgg

SEQ ID NO: 55753 - DNA, 18 bp, Artificial Sequence
  Synthetic DNA
tcctacgataccctatag

SEQ ID NO: 55754 - DNA, 18 bp, Artificial Sequence
  Synthetic DNA
tcctacgattatctatag

SEQ ID NO: 55755 - DNA, 18 bp, Artificial Sequence
  Synthetic DNA
tcctacgtctttcttaag

SEQ ID NO: 55756 - DNA, 18 bp, Artificial Sequence
  Synthetic DNA
tcctactataaacttaag

SEQ ID NO: 55757 - DNA, 18 bp, Artificial Sequence
  Synthetic DNA
tcctactcctaatcatag

SEQ ID NO: 55758 - DNA, 18 bp, Artificial Sequence
  Synthetic DNA
tccttcgtttcattatag

SEQ ID NO: 55759 - DNA, 18 bp, Artificial Sequence
  Synthetic DNA
tcgaccgacttactatag

SEQ ID NO: 55760 - DNA, 18 bp, Artificial Sequence
  Synthetic DNA
tcgatctactcaatatag

SEQ ID NO: 55761 - DNA, 18 bp, Artificial Sequence
  Synthetic DNA
tcggacgactcacactgg

SEQ ID NO: 55762 - DNA, 18 bp, Artificial Sequence
  Synthetic DNA
tcgtacgactctcaattg

SEQ ID NO: 55763 - DNA, 18 bp, Artificial Sequence
  Synthetic DNA
tcgtacgtcatactacgg

SEQ ID NO: 55764 - DNA, 18 bp, Artificial Sequence
  Synthetic DNA
tcgtccaactcacactcg

SEQ ID NO: 55765 - DNA, 18 bp, Artificial Sequence
  Synthetic DNA
tcgttcgtcactttatag

SEQ ID NO: 55766 - DNA, 18 bp, Artificial Sequence
  Synthetic DNA
tcgttcgtgacaacatag

SEQ ID NO: 55767 - DNA, 18 bp, Artificial Sequence
  Synthetic DNA
tctaaagattcactaacg

SEQ ID NO: 55768 - DNA, 18 bp, Artificial Sequence
  Synthetic DNA
tctaacggcactctttag

SEQ ID NO: 55769 - DNA, 18 bp, Artificial Sequence
  Synthetic DNA
tctatcgaacgactagag

SEQ ID NO: 55770 - DNA, 18 bp, Artificial Sequence
  Synthetic DNA
tctatcgactcattttag

SEQ ID NO: 55771 - DNA, 18 bp, Artificial Sequence
  Synthetic DNA
tctcacaatttcctatag

SEQ ID NO: 55772 - DNA, 18 bp, Artificial Sequence
  Synthetic DNA
tctcccgactaacactag

SEQ ID NO: 55773 - DNA, 18 bp, Artificial Sequence
  Synthetic DNA
tctctcaactcactatag

SEQ ID NO: 55774 - DNA, 18 bp, Artificial Sequence
  Synthetic DNA
tctgaagactcactttag

SEQ ID NO: 55775 - DNA, 18 bp, Artificial Sequence
  Synthetic DNA
tctgacggctaccaatag

SEQ ID NO: 55776 - DNA, 18 bp, Artificial Sequence
  Synthetic DNA
tctgccgacccactatag

SEQ ID NO: 55777 - DNA, 18 bp, Artificial Sequence
  Synthetic DNA
tcttaaatcgcgtcaaag

SEQ ID NO: 55778 - DNA, 18 bp, Artificial Sequence
  Synthetic DNA
tcttaagaataacaatcg

SEQ ID NO: 55779 - DNA, 18 bp, Artificial Sequence
  Synthetic DNA
tcttaagactaactcttg

SEQ ID NO: 55780 - DNA, 18 bp, Artificial Sequence
  Synthetic DNA
tcttaagagtaactaatg

SEQ ID NO: 55781 - DNA, 18 bp, Artificial Sequence
  Synthetic DNA
tcttacaactctccatcg

SEQ ID NO: 55782 - DNA, 18 bp, Artificial Sequence
  Synthetic DNA
tcttacatctttctatag

SEQ ID NO: 55783 - DNA, 18 bp, Artificial Sequence
  Synthetic DNA
tcttaccactttctttag

SEQ ID NO: 55784 - DNA, 18 bp, Artificial Sequence
  Synthetic DNA
tcttacctctcacattcg

SEQ ID NO: 55785 - DNA, 18 bp, Artificial Sequence
  Synthetic DNA
tcttacgaatcgctacag

SEQ ID NO: 55786 - DNA, 18 bp, Artificial Sequence
  Synthetic DNA
tcttacgacgtactagtg

SEQ ID NO: 55787 - DNA, 18 bp, Artificial Sequence
  Synthetic DNA
tcttacgactcgatatcg

SEQ ID NO: 55788 - DNA, 18 bp, Artificial Sequence
  Synthetic DNA
tcttacgacttagagttg

SEQ ID NO: 55789 - DNA, 18 bp, Artificial Sequence
  Synthetic DNA
tcttacgatttacaaggg

SEQ ID NO: 55790 - DNA, 18 bp, Artificial Sequence
  Synthetic DNA
tcttacgttcatctacag

SEQ ID NO: 55791 - DNA, 18 bp, Artificial Sequence
  Synthetic DNA
tcttactattctctatag

SEQ ID NO: 55792 - DNA, 18 bp, Artificial Sequence
  Synthetic DNA
tcttagccctcactatag

SEQ ID NO: 55793 - DNA, 18 bp, Artificial Sequence
  Synthetic DNA
tcttaggttacactttcg

SEQ ID NO: 55794 - DNA, 18 bp, Artificial Sequence
  Synthetic DNA
tcttatccctctcaacgg

SEQ ID NO: 55795 - DNA, 18 bp, Artificial Sequence
  Synthetic DNA
tcttatgactctctctag

SEQ ID NO: 55796 - DNA, 18 bp, Artificial Sequence
  Synthetic DNA
tcttgcttctcattatag

SEQ ID NO: 55797 - DNA, 18 bp, Artificial Sequence
  Synthetic DNA
tcttgtcaatcactatag

SEQ ID NO: 55798 - DNA, 18 bp, Artificial Sequence
  Synthetic DNA
tcttgtgactcattatcg

SEQ ID NO: 55799 - DNA, 18 bp, Artificial Sequence
  Synthetic DNA
tctttcaaataactattg

SEQ ID NO: 55800 - DNA, 18 bp, Artificial Sequence
  Synthetic DNA
tctttcgactgaaaatag

SEQ ID NO: 55801 - DNA, 18 bp, Artificial Sequence
  Synthetic DNA
tctttcgacttgctatag

SEQ ID NO: 55802 - DNA, 18 bp, Artificial Sequence
  Synthetic DNA
tctttcgattcactctgg

SEQ ID NO: 55803 - DNA, 18 bp, Artificial Sequence
  Synthetic DNA
tctttcgtcgcagcattg

SEQ ID NO: 55804 - DNA, 18 bp, Artificial Sequence
  Synthetic DNA
tctttctacacactttaa

SEQ ID NO: 55805 - DNA, 18 bp, Artificial Sequence
  Synthetic DNA
tgaaaaaccgcactattg

SEQ ID NO: 55806 - DNA, 18 bp, Artificial Sequence
  Synthetic DNA
tgaaaagtctcactgtgg

SEQ ID NO: 55807 - DNA, 18 bp, Artificial Sequence
  Synthetic DNA
tgaaacctctctctctag

SEQ ID NO: 55808 - DNA, 18 bp, Artificial Sequence
  Synthetic DNA
tgaaacgactaatacaag

SEQ ID NO: 55809 - DNA, 18 bp, Artificial Sequence
  Synthetic DNA
tgaaacgactctcaatcg

SEQ ID NO: 55810 - DNA, 18 bp, Artificial Sequence
  Synthetic DNA
tgaaacgtcactcaatag

SEQ ID NO: 55811 - DNA, 18 bp, Artificial Sequence
  Synthetic DNA
tgaaacgtctcacaacag

SEQ ID NO: 55812 - DNA, 18 bp, Artificial Sequence
  Synthetic DNA
tgaaacgtctctcaatag

SEQ ID NO: 55813 - DNA, 18 bp, Artificial Sequence
  Synthetic DNA
tgaaacgtgccactatag

SEQ ID NO: 55814 - DNA, 18 bp, Artificial Sequence
  Synthetic DNA
tgaaactatcttctatag

SEQ ID NO: 55815 - DNA, 18 bp, Artificial Sequence
  Synthetic DNA
tgaaactcctctgtttag

SEQ ID NO: 55816 - DNA, 18 bp, Artificial Sequence
  Synthetic DNA
tgaaatggtacactacag

SEQ ID NO: 55817 - DNA, 18 bp, Artificial Sequence
  Synthetic DNA
tgaaccggtacacatttg

SEQ ID NO: 55818 - DNA, 18 bp, Artificial Sequence
  Synthetic DNA
tgaaccgttctattaaag

SEQ ID NO: 55819 - DNA, 18 bp, Artificial Sequence
  Synthetic DNA
tgaatagtctcgctatag

SEQ ID NO: 55820 - DNA, 18 bp, Artificial Sequence
  Synthetic DNA
tgaatcgaatcacattag

SEQ ID NO: 55821 - DNA, 18 bp, Artificial Sequence
  Synthetic DNA
tgaatcgactcaatattg

SEQ ID NO: 55822 - DNA, 18 bp, Artificial Sequence
  Synthetic DNA
tgaattgactcagaatcg

SEQ ID NO: 55823 - DNA, 18 bp, Artificial Sequence
  Synthetic DNA
tgacaagattcactgtgg

SEQ ID NO: 55824 - DNA, 18 bp, Artificial Sequence
  Synthetic DNA
tgacacaactttctattg

SEQ ID NO: 55825 - DNA, 18 bp, Artificial Sequence
  Synthetic DNA
tgacacgacacacgattg

SEQ ID NO: 55826 - DNA, 18 bp, Artificial Sequence
  Synthetic DNA
tgacacgactctctgtgg

SEQ ID NO: 55827 - DNA, 18 bp, Artificial Sequence
  Synthetic DNA
tgacacgactgtttatag

SEQ ID NO: 55828 - DNA, 18 bp, Artificial Sequence
  Synthetic DNA
tgacagatcgcacaatcg

SEQ ID NO: 55829 - DNA, 18 bp, Artificial Sequence
  Synthetic DNA
tgacatggcgcactatag

SEQ ID NO: 55830 - DNA, 18 bp, Artificial Sequence
  Synthetic DNA
tgactcgtctcaccatag

SEQ ID NO: 55831 - DNA, 18 bp, Artificial Sequence
  Synthetic DNA
tgactcgtctctgtatag

SEQ ID NO: 55832 - DNA, 18 bp, Artificial Sequence
  Synthetic DNA
tgactctacccactatag

SEQ ID NO: 55833 - DNA, 18 bp, Artificial Sequence
  Synthetic DNA
tgagacaactatctatag

SEQ ID NO: 55834 - DNA, 18 bp, Artificial Sequence
  Synthetic DNA
tgagactgtaatctatag

SEQ ID NO: 55835 - DNA, 18 bp, Artificial Sequence
  Synthetic DNA
tgagatcactcaatattg

SEQ ID NO: 55836 - DNA, 18 bp, Artificial Sequence
  Synthetic DNA
tgagatcactctttatag

SEQ ID NO: 55837 - DNA, 18 bp, Artificial Sequence
  Synthetic DNA
tgagatgacttacaaaag

SEQ ID NO: 55838 - DNA, 18 bp, Artificial Sequence
  Synthetic DNA
tgagattatacacaatag

SEQ ID NO: 55839 - DNA, 18 bp, Artificial Sequence
  Synthetic DNA
tgagtcgctaaacacgag

SEQ ID NO: 55840 - DNA, 18 bp, Artificial Sequence
  Synthetic DNA
tgataagacgaactttag

SEQ ID NO: 55841 - DNA, 18 bp, Artificial Sequence
  Synthetic DNA
tgataagatatactacag

SEQ ID NO: 55842 - DNA, 18 bp, Artificial Sequence
  Synthetic DNA
tgatacaacccacttttg

SEQ ID NO: 55843 - DNA, 18 bp, Artificial Sequence
  Synthetic DNA
tgatacaactcaatgtcg

SEQ ID NO: 55844 - DNA, 18 bp, Artificial Sequence
  Synthetic DNA
tgatacaacttcctttag

SEQ ID NO: 55845 - DNA, 18 bp, Artificial Sequence
  Synthetic DNA
tgatacatttaactaaag

SEQ ID NO: 55846 - DNA, 18 bp, Artificial Sequence
  Synthetic DNA
tgataccactcacctgag

SEQ ID NO: 55847 - DNA, 18 bp, Artificial Sequence
  Synthetic DNA
tgatacctctcagtggag

SEQ ID NO: 55848 - DNA, 18 bp, Artificial Sequence
  Synthetic DNA
tgatacgaaacgctaaag

SEQ ID NO: 55849 - DNA, 18 bp, Artificial Sequence
  Synthetic DNA
tgatacgaaactcaattg

SEQ ID NO: 55850 - DNA, 18 bp, Artificial Sequence
  Synthetic DNA
tgatacgacacgtttttg

SEQ ID NO: 55851 - DNA, 18 bp, Artificial Sequence
  Synthetic DNA
tgatacgactaaattcag

SEQ ID NO: 55852 - DNA, 18 bp, Artificial Sequence
  Synthetic DNA
tgatacgactatcgttag

SEQ ID NO: 55853 - DNA, 18 bp, Artificial Sequence
  Synthetic DNA
tgatacgactcaaatgag

SEQ ID NO: 55854 - DNA, 18 bp, Artificial Sequence
  Synthetic DNA
tgatacgactcgatgaag

SEQ ID NO: 55855 - DNA, 18 bp, Artificial Sequence
  Synthetic DNA
tgatacgactgattaatg

SEQ ID NO: 55856 - DNA, 18 bp, Artificial Sequence
  Synthetic DNA
tgatacgagaaagaatag

SEQ ID NO: 55857 - DNA, 18 bp, Artificial Sequence
  Synthetic DNA
tgatacgatacaatgtag

SEQ ID NO: 55858 - DNA, 18 bp, Artificial Sequence
  Synthetic DNA
tgatacgatcttaattag

SEQ ID NO: 55859 - DNA, 18 bp, Artificial Sequence
  Synthetic DNA
tgatacgattcaaaaacg

SEQ ID NO: 55860 - DNA, 18 bp, Artificial Sequence
  Synthetic DNA
tgatacgattcaaagttg

SEQ ID NO: 55861 - DNA, 18 bp, Artificial Sequence
  Synthetic DNA
tgatacgcctgtctttag

SEQ ID NO: 55862 - DNA, 18 bp, Artificial Sequence
  Synthetic DNA
tgatacggctctcaattg

SEQ ID NO: 55863 - DNA, 18 bp, Artificial Sequence
  Synthetic DNA
tgatacggtacactaatg

SEQ ID NO: 55864 - DNA, 18 bp, Artificial Sequence
  Synthetic DNA
tgatacggttccctctag

SEQ ID NO: 55865 - DNA, 18 bp, Artificial Sequence
  Synthetic DNA
tgatacgttttttctcag

SEQ ID NO: 55866 - DNA, 18 bp, Artificial Sequence
  Synthetic DNA
tgatactacaccccatag

SEQ ID NO: 55867 - DNA, 18 bp, Artificial Sequence
  Synthetic DNA
tgatactactctctacgg

SEQ ID NO: 55868 - DNA, 18 bp, Artificial Sequence
  Synthetic DNA
tgatactcatcactttcg

SEQ ID NO: 55869 - DNA, 18 bp, Artificial Sequence
  Synthetic DNA
tgatacttcacattattg

SEQ ID NO: 55870 - DNA, 18 bp, Artificial Sequence
  Synthetic DNA
tgatagacgcatctatag

SEQ ID NO: 55871 - DNA, 18 bp, Artificial Sequence
  Synthetic DNA
tgatagcaacgactgaag

SEQ ID NO: 55872 - DNA, 18 bp, Artificial Sequence
  Synthetic DNA
tgataggactcacttatg

SEQ ID NO: 55873 - DNA, 18 bp, Artificial Sequence
  Synthetic DNA
tgataggtcaaactaatg

SEQ ID NO: 55874 - DNA, 18 bp, Artificial Sequence
  Synthetic DNA
tgatagtactctcaatag

SEQ ID NO: 55875 - DNA, 18 bp, Artificial Sequence
  Synthetic DNA
tgatatcactcacaattg

SEQ ID NO: 55876 - DNA, 18 bp, Artificial Sequence
  Synthetic DNA
tgatatgacccaccacgg

SEQ ID NO: 55877 - DNA, 18 bp, Artificial Sequence
  Synthetic DNA
tgatatgatacccaatag

SEQ ID NO: 55878 - DNA, 18 bp, Artificial Sequence
  Synthetic DNA
tgatattactcattaatg

SEQ ID NO: 55879 - DNA, 18 bp, Artificial Sequence
  Synthetic DNA
tgatattattcactagtg

SEQ ID NO: 55880 - DNA, 18 bp, Artificial Sequence
  Synthetic DNA
tgatcaggctcccattcg

SEQ ID NO: 55881 - DNA, 18 bp, Artificial Sequence
  Synthetic DNA
tgatccgactctttatgg

SEQ ID NO: 55882 - DNA, 18 bp, Artificial Sequence
  Synthetic DNA
tgatccgcctttctatag

SEQ ID NO: 55883 - DNA, 18 bp, Artificial Sequence
  Synthetic DNA
tgatgcctcgcactatag

SEQ ID NO: 55884 - DNA, 18 bp, Artificial Sequence
  Synthetic DNA
tgatgcgagacttaatag

SEQ ID NO: 55885 - DNA, 18 bp, Artificial Sequence
  Synthetic DNA
tgatgcgatacaatattg

SEQ ID NO: 55886 - DNA, 18 bp, Artificial Sequence
  Synthetic DNA
tgatgcgcatctctattg

SEQ ID NO: 55887 - DNA, 18 bp, Artificial Sequence
  Synthetic DNA
tgatgcggctcacactag

SEQ ID NO: 55888 - DNA, 18 bp, Artificial Sequence
  Synthetic DNA
tgatgctgctcacaatag

SEQ ID NO: 55889 - DNA, 18 bp, Artificial Sequence
  Synthetic DNA
tgatgtgactcagattag

SEQ ID NO: 55890 - DNA, 18 bp, Artificial Sequence
  Synthetic DNA
tgattagactttctaaag

SEQ ID NO: 55891 - DNA, 18 bp, Artificial Sequence
  Synthetic DNA
tgattagtctcaatatag

SEQ ID NO: 55892 - DNA, 18 bp, Artificial Sequence
  Synthetic DNA
tgattcaactgactattg

SEQ ID NO: 55893 - DNA, 18 bp, Artificial Sequence
  Synthetic DNA
tgattcctcccattatag

SEQ ID NO: 55894 - DNA, 18 bp, Artificial Sequence
  Synthetic DNA
tgattcgaatcttcatag

SEQ ID NO: 55895 - DNA, 18 bp, Artificial Sequence
  Synthetic DNA
tgattcgactctgtattg

SEQ ID NO: 55896 - DNA, 18 bp, Artificial Sequence
  Synthetic DNA
tgattcgacttacctttg

SEQ ID NO: 55897 - DNA, 18 bp, Artificial Sequence
  Synthetic DNA
tgattcgactttctattg

SEQ ID NO: 55898 - DNA, 18 bp, Artificial Sequence
  Synthetic DNA
tgattcgccgcaccaatg

SEQ ID NO: 55899 - DNA, 18 bp, Artificial Sequence
  Synthetic DNA
tgattcggctccctctag

SEQ ID NO: 55900 - DNA, 18 bp, Artificial Sequence
  Synthetic DNA
tgattcgtctcaatttag

SEQ ID NO: 55901 - DNA, 18 bp, Artificial Sequence
  Synthetic DNA
tgattcgtctcgtcatag

SEQ ID NO: 55902 - DNA, 18 bp, Artificial Sequence
  Synthetic DNA
tgattctactcgctaaag

SEQ ID NO: 55903 - DNA, 18 bp, Artificial Sequence
  Synthetic DNA
tgattgggctaactatag

SEQ ID NO: 55904 - DNA, 18 bp, Artificial Sequence
  Synthetic DNA
tgatttcacattctgagg

SEQ ID NO: 55905 - DNA, 18 bp, Artificial Sequence
  Synthetic DNA
tgatttgactcaattcag

SEQ ID NO: 55906 - DNA, 18 bp, Artificial Sequence
  Synthetic DNA
tgatttgactcaatttag

SEQ ID NO: 55907 - DNA, 18 bp, Artificial Sequence
  Synthetic DNA
tgatttgactcggttttg

SEQ ID NO: 55908 - DNA, 18 bp, Artificial Sequence
  Synthetic DNA
tgatttgtttcactatag

SEQ ID NO: 55909 - DNA, 18 bp, Artificial Sequence
  Synthetic DNA
tgctaccacttagtatag

SEQ ID NO: 55910 - DNA, 18 bp, Artificial Sequence
  Synthetic DNA
tgctacgaatctctgtag

SEQ ID NO: 55911 - DNA, 18 bp, Artificial Sequence
  Synthetic DNA
tgctacgacttaccttag

SEQ ID NO: 55912 - DNA, 18 bp, Artificial Sequence
  Synthetic DNA
tgctacgtatcatgatag

SEQ ID NO: 55913 - DNA, 18 bp, Artificial Sequence
  Synthetic DNA
tgcttcgtctcaccatag

SEQ ID NO: 55914 - DNA, 18 bp, Artificial Sequence
  Synthetic DNA
tggctccactcactagag

SEQ ID NO: 55915 - DNA, 18 bp, Artificial Sequence
  Synthetic DNA
tggtacaacatattattg

SEQ ID NO: 55916 - DNA, 18 bp, Artificial Sequence
  Synthetic DNA
tggtacgccttacaaaag

SEQ ID NO: 55917 - DNA, 18 bp, Artificial Sequence
  Synthetic DNA
tggtaggtgtctctattg

SEQ ID NO: 55918 - DNA, 18 bp, Artificial Sequence
  Synthetic DNA
tggtgcaaaccactatag

SEQ ID NO: 55919 - DNA, 18 bp, Artificial Sequence
  Synthetic DNA
tggttcgcctcaatatag

SEQ ID NO: 55920 - DNA, 18 bp, Artificial Sequence
  Synthetic DNA
tggttctactccctatag

SEQ ID NO: 55921 - DNA, 18 bp, Artificial Sequence
  Synthetic DNA
tgtaacaactccctttag

SEQ ID NO: 55922 - DNA, 18 bp, Artificial Sequence
  Synthetic DNA
tgtaacgacaccctatag

SEQ ID NO: 55923 - DNA, 18 bp, Artificial Sequence
  Synthetic DNA
tgtaatcactcacttacg

SEQ ID NO: 55924 - DNA, 18 bp, Artificial Sequence
  Synthetic DNA
tgtaatgacggactaaag

SEQ ID NO: 55925 - DNA, 18 bp, Artificial Sequence
  Synthetic DNA
tgtatcgacttaaagtag

SEQ ID NO: 55926 - DNA, 18 bp, Artificial Sequence
  Synthetic DNA
tgtcttaactcactatag

SEQ ID NO: 55927 - DNA, 18 bp, Artificial Sequence
  Synthetic DNA
tgttaagactggctatag

SEQ ID NO: 55928 - DNA, 18 bp, Artificial Sequence
  Synthetic DNA
tgttacaaatcattatag

SEQ ID NO: 55929 - DNA, 18 bp, Artificial Sequence
  Synthetic DNA
tgttaccaatcatcatcg

SEQ ID NO: 55930 - DNA, 18 bp, Artificial Sequence
  Synthetic DNA
tgttacgattcattcttg

SEQ ID NO: 55931 - DNA, 18 bp, Artificial Sequence
  Synthetic DNA
tgttacgatttacttttg

SEQ ID NO: 55932 - DNA, 18 bp, Artificial Sequence
  Synthetic DNA
tgttacgtaacactagag

SEQ ID NO: 55933 - DNA, 18 bp, Artificial Sequence
  Synthetic DNA
tgttacgtcacaatatag

SEQ ID NO: 55934 - DNA, 18 bp, Artificial Sequence
  Synthetic DNA
tgttacgtctaattttag

SEQ ID NO: 55935 - DNA, 18 bp, Artificial Sequence
  Synthetic DNA
tgttacgtttcaccatag

SEQ ID NO: 55936 - DNA, 18 bp, Artificial Sequence
  Synthetic DNA
tgttactaatcactttag

SEQ ID NO: 55937 - DNA, 18 bp, Artificial Sequence
  Synthetic DNA
tgttaggtctcacttaaa

SEQ ID NO: 55938 - DNA, 18 bp, Artificial Sequence
  Synthetic DNA
tgttagtactcaccatag

SEQ ID NO: 55939 - DNA, 18 bp, Artificial Sequence
  Synthetic DNA
tgttcccattgacttaag

SEQ ID NO: 55940 - DNA, 18 bp, Artificial Sequence
  Synthetic DNA
tgttcggactcactaaag

SEQ ID NO: 55941 - DNA, 18 bp, Artificial Sequence
  Synthetic DNA
tgttgagcctcactattg

SEQ ID NO: 55942 - DNA, 18 bp, Artificial Sequence
  Synthetic DNA
tgttgctacccactatag

SEQ ID NO: 55943 - DNA, 18 bp, Artificial Sequence
  Synthetic DNA
tgttgggcctcattatag

SEQ ID NO: 55944 - DNA, 18 bp, Artificial Sequence
  Synthetic DNA
tgtttcgactagcaaaag

SEQ ID NO: 55945 - DNA, 18 bp, Artificial Sequence
  Synthetic DNA
tgtttcgactcactcagg

SEQ ID NO: 55946 - DNA, 18 bp, Artificial Sequence
  Synthetic DNA
tgtttcgactctccatag

SEQ ID NO: 55947 - DNA, 18 bp, Artificial Sequence
  Synthetic DNA
tgtttcggcccactatag

SEQ ID NO: 55948 - DNA, 18 bp, Artificial Sequence
  Synthetic DNA
tgttttgactcactcaag

SEQ ID NO: 55949 - DNA, 18 bp, Artificial Sequence
  Synthetic DNA
ttaaaacacacccattag

SEQ ID NO: 55950 - DNA, 18 bp, Artificial Sequence
  Synthetic DNA
ttaaaagactagctcttg

SEQ ID NO: 55951 - DNA, 18 bp, Artificial Sequence
  Synthetic DNA
ttaaaagacttattatag

SEQ ID NO: 55952 - DNA, 18 bp, Artificial Sequence
  Synthetic DNA
ttaaaagatatactatgg

SEQ ID NO: 55953 - DNA, 18 bp, Artificial Sequence
  Synthetic DNA
ttaaacacctttctgtag

SEQ ID NO: 55954 - DNA, 18 bp, Artificial Sequence
  Synthetic DNA
ttaaacatatcactaaag

SEQ ID NO: 55955 - DNA, 18 bp, Artificial Sequence
  Synthetic DNA
ttaaacatctcacttgag

SEQ ID NO: 55956 - DNA, 18 bp, Artificial Sequence
  Synthetic DNA
ttaaacatctctttattg

SEQ ID NO: 55957 - DNA, 18 bp, Artificial Sequence
  Synthetic DNA
ttaaacccctcactatgg

SEQ ID NO: 55958 - DNA, 18 bp, Artificial Sequence
  Synthetic DNA
ttaaacctcttaccaaag

SEQ ID NO: 55959 - DNA, 18 bp, Artificial Sequence
  Synthetic DNA
ttaaacgacacacaattg

SEQ ID NO: 55960 - DNA, 18 bp, Artificial Sequence
  Synthetic DNA
ttaaacgaccgaacaagg

SEQ ID NO: 55961 - DNA, 18 bp, Artificial Sequence
  Synthetic DNA
ttaaacgacgcactcaag

SEQ ID NO: 55962 - DNA, 18 bp, Artificial Sequence
  Synthetic DNA
ttaaacgactcaaactag

SEQ ID NO: 55963 - DNA, 18 bp, Artificial Sequence
  Synthetic DNA
ttaaacgactcagctcag

SEQ ID NO: 55964 - DNA, 18 bp, Artificial Sequence
  Synthetic DNA
ttaaacgactgagtttag

SEQ ID NO: 55965 - DNA, 18 bp, Artificial Sequence
  Synthetic DNA
ttaaacgattccctttag

SEQ ID NO: 55966 - DNA, 18 bp, Artificial Sequence
  Synthetic DNA
ttaaacgccacacgattg

SEQ ID NO: 55967 - DNA, 18 bp, Artificial Sequence
  Synthetic DNA
ttaaacgcctcacaatcg

SEQ ID NO: 55968 - DNA, 18 bp, Artificial Sequence
  Synthetic DNA
ttaaacggcttcttatag

SEQ ID NO: 55969 - DNA, 18 bp, Artificial Sequence
  Synthetic DNA
ttaaacgtatcactgtag

SEQ ID NO: 55970 - DNA, 18 bp, Artificial Sequence
  Synthetic DNA
ttaaacgtctcaatattg

SEQ ID NO: 55971 - DNA, 18 bp, Artificial Sequence
  Synthetic DNA
ttaaacgtctcactcgag

SEQ ID NO: 55972 - DNA, 18 bp, Artificial Sequence
  Synthetic DNA
ttaaacgtctcacttatg

SEQ ID NO: 55973 - DNA, 18 bp, Artificial Sequence
  Synthetic DNA
ttaaacgtctcccaaatg

SEQ ID NO: 55974 - DNA, 18 bp, Artificial Sequence
  Synthetic DNA
ttaaacgtctccttatag

SEQ ID NO: 55975 - DNA, 18 bp, Artificial Sequence
  Synthetic DNA
ttaaacgtttcactctag

SEQ ID NO: 55976 - DNA, 18 bp, Artificial Sequence
  Synthetic DNA
ttaaactacacctaaaag

SEQ ID NO: 55977 - DNA, 18 bp, Artificial Sequence
  Synthetic DNA
ttaaactactgactgtag

SEQ ID NO: 55978 - DNA, 18 bp, Artificial Sequence
  Synthetic DNA
ttaaactagttaccgttg

SEQ ID NO: 55979 - DNA, 18 bp, Artificial Sequence
  Synthetic DNA
ttaaactcaccttttttg

SEQ ID NO: 55980 - DNA, 18 bp, Artificial Sequence
  Synthetic DNA
ttaaacttctcactggag

SEQ ID NO: 55981 - DNA, 18 bp, Artificial Sequence
  Synthetic DNA
ttaaacttctcagtaaag

SEQ ID NO: 55982 - DNA, 18 bp, Artificial Sequence
  Synthetic DNA
ttaaaggattttctttag

SEQ ID NO: 55983 - DNA, 18 bp, Artificial Sequence
  Synthetic DNA
ttaaatgactttccatag

SEQ ID NO: 55984 - DNA, 18 bp, Artificial Sequence
  Synthetic DNA
ttaaatgtcccagtatag

SEQ ID NO: 55985 - DNA, 18 bp, Artificial Sequence
  Synthetic DNA
ttaaccaactcacaatag

SEQ ID NO: 55986 - DNA, 18 bp, Artificial Sequence
  Synthetic DNA
ttaaccgactgacactag

SEQ ID NO: 55987 - DNA, 18 bp, Artificial Sequence
  Synthetic DNA
ttaaccgtcactctatag

SEQ ID NO: 55988 - DNA, 18 bp, Artificial Sequence
  Synthetic DNA
ttaagcggctccatgtag

SEQ ID NO: 55989 - DNA, 18 bp, Artificial Sequence
  Synthetic DNA
ttacaaaattcactatag

SEQ ID NO: 55990 - DNA, 18 bp, Artificial Sequence
  Synthetic DNA
ttacacaactcaagatag

SEQ ID NO: 55991 - DNA, 18 bp, Artificial Sequence
  Synthetic DNA
ttacacaactcaccaatg

SEQ ID NO: 55992 - DNA, 18 bp, Artificial Sequence
  Synthetic DNA
ttacacacgtaactatag

SEQ ID NO: 55993 - DNA, 18 bp, Artificial Sequence
  Synthetic DNA
ttacacgacactattaag

SEQ ID NO: 55994 - DNA, 18 bp, Artificial Sequence
  Synthetic DNA
ttacacgacgcactgaag

SEQ ID NO: 55995 - DNA, 18 bp, Artificial Sequence
  Synthetic DNA
ttacacgattcacaattg

SEQ ID NO: 55996 - DNA, 18 bp, Artificial Sequence
  Synthetic DNA
ttacacgattcactaatg

SEQ ID NO: 55997 - DNA, 18 bp, Artificial Sequence
  Synthetic DNA
ttacacgtaatactacag

SEQ ID NO: 55998 - DNA, 18 bp, Artificial Sequence
  Synthetic DNA
ttacacgtcaacctttag

SEQ ID NO: 55999 - DNA, 18 bp, Artificial Sequence
  Synthetic DNA
ttacacgtcgtgccatag

SEQ ID NO: 56000 - DNA, 18 bp, Artificial Sequence
  Synthetic DNA
ttacacgtctcactgcag

SEQ ID NO: 56001 - DNA, 18 bp, Artificial Sequence
  Synthetic DNA
ttacactactcatcatag

SEQ ID NO: 56002 - DNA, 18 bp, Artificial Sequence
  Synthetic DNA
ttacactactctatttag

SEQ ID NO: 56003 - DNA, 18 bp, Artificial Sequence
  Synthetic DNA
ttacaggacacaccactg

SEQ ID NO: 56004 - DNA, 18 bp, Artificial Sequence
  Synthetic DNA
ttacaggactcaatttag

SEQ ID NO: 56005 - DNA, 18 bp, Artificial Sequence
  Synthetic DNA
ttacatgactagtttttg

SEQ ID NO: 56006 - DNA, 18 bp, Artificial Sequence
  Synthetic DNA
ttacatgattcattatag

SEQ ID NO: 56007 - DNA, 18 bp, Artificial Sequence
  Synthetic DNA
ttacccaactcaccgtgg

SEQ ID NO: 56008 - DNA, 18 bp, Artificial Sequence
  Synthetic DNA
ttacccaacttattactg

SEQ ID NO: 56009 - DNA, 18 bp, Artificial Sequence
  Synthetic DNA
ttactagactaactcaag

SEQ ID NO: 56010 - DNA, 18 bp, Artificial Sequence
  Synthetic DNA
ttactcgaatcattatgg

SEQ ID NO: 56011 - DNA, 18 bp, Artificial Sequence
  Synthetic DNA
ttactcgtcccactatag

SEQ ID NO: 56012 - DNA, 18 bp, Artificial Sequence
  Synthetic DNA
ttactcgtcttactctag

SEQ ID NO: 56013 - DNA, 18 bp, Artificial Sequence
  Synthetic DNA
ttagacgatagggtatgg

SEQ ID NO: 56014 - DNA, 18 bp, Artificial Sequence
  Synthetic DNA
ttagacggctaaccaaag

SEQ ID NO: 56015 - DNA, 18 bp, Artificial Sequence
  Synthetic DNA
ttagacgtatatctattg

SEQ ID NO: 56016 - DNA, 18 bp, Artificial Sequence
  Synthetic DNA
ttagacgtcccactattg

SEQ ID NO: 56017 - DNA, 18 bp, Artificial Sequence
  Synthetic DNA
ttagacgtctctcaatag

SEQ ID NO: 56018 - DNA, 18 bp, Artificial Sequence
  Synthetic DNA
ttagactaaacgctatcg

SEQ ID NO: 56019 - DNA, 18 bp, Artificial Sequence
  Synthetic DNA
ttagatgactctctgtag

SEQ ID NO: 56020 - DNA, 18 bp, Artificial Sequence
  Synthetic DNA
ttagccgccttactctag

SEQ ID NO: 56021 - DNA, 18 bp, Artificial Sequence
  Synthetic DNA
ttataaacaacacaatcg

SEQ ID NO: 56022 - DNA, 18 bp, Artificial Sequence
  Synthetic DNA
ttataacactcaataatg

SEQ ID NO: 56023 - DNA, 18 bp, Artificial Sequence
  Synthetic DNA
ttataacattcactaaag

SEQ ID NO: 56024 - DNA, 18 bp, Artificial Sequence
  Synthetic DNA
ttataagaaacattatag

SEQ ID NO: 56025 - DNA, 18 bp, Artificial Sequence
  Synthetic DNA
ttataagaataacttgag

SEQ ID NO: 56026 - DNA, 18 bp, Artificial Sequence
  Synthetic DNA
ttataagaatctctcttg

SEQ ID NO: 56027 - DNA, 18 bp, Artificial Sequence
  Synthetic DNA
ttataagacagccaatgg

SEQ ID NO: 56028 - DNA, 18 bp, Artificial Sequence
  Synthetic DNA
ttataagaccctgtttag

SEQ ID NO: 56029 - DNA, 18 bp, Artificial Sequence
  Synthetic DNA
ttataagactaaatctag

SEQ ID NO: 56030 - DNA, 18 bp, Artificial Sequence
  Synthetic DNA
ttataagactcatcttag

SEQ ID NO: 56031 - DNA, 18 bp, Artificial Sequence
  Synthetic DNA
ttataagactcctaattg

SEQ ID NO: 56032 - DNA, 18 bp, Artificial Sequence
  Synthetic DNA
ttataagactctctaatg

SEQ ID NO: 56033 - DNA, 18 bp, Artificial Sequence
  Synthetic DNA
ttataagactgacttaag

SEQ ID NO: 56034 - DNA, 18 bp, Artificial Sequence
  Synthetic DNA
ttataagacttagtaaag

SEQ ID NO: 56035 - DNA, 18 bp, Artificial Sequence
  Synthetic DNA
ttataagagtcactaacg

SEQ ID NO: 56036 - DNA, 18 bp, Artificial Sequence
  Synthetic DNA
ttataagatgcagtagag

SEQ ID NO: 56037 - DNA, 18 bp, Artificial Sequence
  Synthetic DNA
ttataagattctccaaag

SEQ ID NO: 56038 - DNA, 18 bp, Artificial Sequence
  Synthetic DNA
ttatacaacacaccctag

SEQ ID NO: 56039 - DNA, 18 bp, Artificial Sequence
  Synthetic DNA
ttatacaacacactgaag

SEQ ID NO: 56040 - DNA, 18 bp, Artificial Sequence
  Synthetic DNA
ttatacaacactctatgg

SEQ ID NO: 56041 - DNA, 18 bp, Artificial Sequence
  Synthetic DNA
ttatacaacatactatcg

SEQ ID NO: 56042 - DNA, 18 bp, Artificial Sequence
  Synthetic DNA
ttatacaacattctatag

SEQ ID NO: 56043 - DNA, 18 bp, Artificial Sequence
  Synthetic DNA
ttatacaactctcaagag

SEQ ID NO: 56044 - DNA, 18 bp, Artificial Sequence
  Synthetic DNA
ttatacaacttactgatg

SEQ ID NO: 56045 - DNA, 18 bp, Artificial Sequence
  Synthetic DNA
ttatacaagttactcaag

SEQ ID NO: 56046 - DNA, 18 bp, Artificial Sequence
  Synthetic DNA
ttatacaattcaccattg

SEQ ID NO: 56047 - DNA, 18 bp, Artificial Sequence
  Synthetic DNA
ttatacaatttaatatag

SEQ ID NO: 56048 - DNA, 18 bp, Artificial Sequence
  Synthetic DNA
ttatacacctaataattg

SEQ ID NO: 56049 - DNA, 18 bp, Artificial Sequence
  Synthetic DNA
ttatacacctcagtggtg

SEQ ID NO: 56050 - DNA, 18 bp, Artificial Sequence
  Synthetic DNA
ttatacacttcaccatgg

SEQ ID NO: 56051 - DNA, 18 bp, Artificial Sequence
  Synthetic DNA
ttatacatctaagtttag

SEQ ID NO: 56052 - DNA, 18 bp, Artificial Sequence
  Synthetic DNA
ttatacatctcaaaatcg

SEQ ID NO: 56053 - DNA, 18 bp, Artificial Sequence
  Synthetic DNA
ttatacatgtcagtatag

SEQ ID NO: 56054 - DNA, 18 bp, Artificial Sequence
  Synthetic DNA
ttatacattcctctatag

SEQ ID NO: 56055 - DNA, 18 bp, Artificial Sequence
  Synthetic DNA
ttataccaatcagtattg

SEQ ID NO: 56056 - DNA, 18 bp, Artificial Sequence
  Synthetic DNA
ttataccactcacttctg

SEQ ID NO: 56057 - DNA, 18 bp, Artificial Sequence
  Synthetic DNA
ttataccactttctattg

SEQ ID NO: 56058 - DNA, 18 bp, Artificial Sequence
  Synthetic DNA
ttataccagataatacag

SEQ ID NO: 56059 - DNA, 18 bp, Artificial Sequence
  Synthetic DNA
ttataccagtcgctaaag

SEQ ID NO: 56060 - DNA, 18 bp, Artificial Sequence
  Synthetic DNA
ttataccattaacaatag

SEQ ID NO: 56061 - DNA, 18 bp, Artificial Sequence
  Synthetic DNA
ttatacccatcccttaag

SEQ ID NO: 56062 - DNA, 18 bp, Artificial Sequence
  Synthetic DNA
ttataccgcctagtatag

SEQ ID NO: 56063 - DNA, 18 bp, Artificial Sequence
  Synthetic DNA
ttatacctcacattatag

SEQ ID NO: 56064 - DNA, 18 bp, Artificial Sequence
  Synthetic DNA
ttatacctctaactacag

SEQ ID NO: 56065 - DNA, 18 bp, Artificial Sequence
  Synthetic DNA
ttatacctctaactttag

SEQ ID NO: 56066 - DNA, 18 bp, Artificial Sequence
  Synthetic DNA
ttatacctttaactaatg

SEQ ID NO: 56067 - DNA, 18 bp, Artificial Sequence
  Synthetic DNA
ttatacgaacccctgttg

SEQ ID NO: 56068 - DNA, 18 bp, Artificial Sequence
  Synthetic DNA
ttatacgaatatgtatgg

SEQ ID NO: 56069 - DNA, 18 bp, Artificial Sequence
  Synthetic DNA
ttatacgaatcaacttag

SEQ ID NO: 56070 - DNA, 18 bp, Artificial Sequence
  Synthetic DNA
ttatacgaatctgtaacg

SEQ ID NO: 56071 - DNA, 18 bp, Artificial Sequence
  Synthetic DNA
ttatacgaatgactaacg

SEQ ID NO: 56072 - DNA, 18 bp, Artificial Sequence
  Synthetic DNA
ttatacgaattaccgttg

SEQ ID NO: 56073 - DNA, 18 bp, Artificial Sequence
  Synthetic DNA
ttatacgacaccaaatag

SEQ ID NO: 56074 - DNA, 18 bp, Artificial Sequence
  Synthetic DNA
ttatacgacactattttg

SEQ ID NO: 56075 - DNA, 18 bp, Artificial Sequence
  Synthetic DNA
ttatacgacagacctcag

SEQ ID NO: 56076 - DNA, 18 bp, Artificial Sequence
  Synthetic DNA
ttatacgacatatcaaag

SEQ ID NO: 56077 - DNA, 18 bp, Artificial Sequence
  Synthetic DNA
ttatacgaccacatatag

SEQ ID NO: 56078 - DNA, 18 bp, Artificial Sequence
  Synthetic DNA
ttatacgacgaagtttag

SEQ ID NO: 56079 - DNA, 18 bp, Artificial Sequence
  Synthetic DNA
ttatacgacgcgatgtag

SEQ ID NO: 56080 - DNA, 18 bp, Artificial Sequence
  Synthetic DNA
ttatacgacgtaccacag

SEQ ID NO: 56081 - DNA, 18 bp, Artificial Sequence
  Synthetic DNA
ttatacgactatttatcg

SEQ ID NO: 56082 - DNA, 18 bp, Artificial Sequence
  Synthetic DNA
ttatacgactattttttg

SEQ ID NO: 56083 - DNA, 18 bp, Artificial Sequence
  Synthetic DNA
ttatacgactcatggttg

SEQ ID NO: 56084 - DNA, 18 bp, Artificial Sequence
  Synthetic DNA
ttatacgactcatttctg

SEQ ID NO: 56085 - DNA, 18 bp, Artificial Sequence
  Synthetic DNA
ttatacgactccacagag

SEQ ID NO: 56086 - DNA, 18 bp, Artificial Sequence
  Synthetic DNA
ttatacgactctccttgg

SEQ ID NO: 56087 - DNA, 18 bp, Artificial Sequence
  Synthetic DNA
ttatacgactcttttcag

SEQ ID NO: 56088 - DNA, 18 bp, Artificial Sequence
  Synthetic DNA
ttatacgactgatttcag

SEQ ID NO: 56089 - DNA, 18 bp, Artificial Sequence
  Synthetic DNA
ttatacgacttacaactg

SEQ ID NO: 56090 - DNA, 18 bp, Artificial Sequence
  Synthetic DNA
ttatacgacttactcatg

SEQ ID NO: 56091 - DNA, 18 bp, Artificial Sequence
  Synthetic DNA
ttatacgagtctcagttg

SEQ ID NO: 56092 - DNA, 18 bp, Artificial Sequence
  Synthetic DNA
ttatacgagtgtgttgag

SEQ ID NO: 56093 - DNA, 18 bp, Artificial Sequence
  Synthetic DNA
ttatacgatacactgttg

SEQ ID NO: 56094 - DNA, 18 bp, Artificial Sequence
  Synthetic DNA
ttatacgatctacttttg

SEQ ID NO: 56095 - DNA, 18 bp, Artificial Sequence
  Synthetic DNA
ttatacgattaacgattg

SEQ ID NO: 56096 - DNA, 18 bp, Artificial Sequence
  Synthetic DNA
ttatacgattcaccctgg

SEQ ID NO: 56097 - DNA, 18 bp, Artificial Sequence
  Synthetic DNA
ttatacgattgaatagag

SEQ ID NO: 56098 - DNA, 18 bp, Artificial Sequence
  Synthetic DNA
ttatacgattgagattag

SEQ ID NO: 56099 - DNA, 18 bp, Artificial Sequence
  Synthetic DNA
ttatacgccaaactctgg

SEQ ID NO: 56100 - DNA, 18 bp, Artificial Sequence
  Synthetic DNA
ttatacgccactataacg

SEQ ID NO: 56101 - DNA, 18 bp, Artificial Sequence
  Synthetic DNA
ttatacggattttactag

SEQ ID NO: 56102 - DNA, 18 bp, Artificial Sequence
  Synthetic DNA
ttatacggttgactaaag

SEQ ID NO: 56103 - DNA, 18 bp, Artificial Sequence
  Synthetic DNA
ttatacgtatatctttag

SEQ ID NO: 56104 - DNA, 18 bp, Artificial Sequence
  Synthetic DNA
ttatacgtcacttcatcg

SEQ ID NO: 56105 - DNA, 18 bp, Artificial Sequence
  Synthetic DNA
ttatacgtcccatcatag

SEQ ID NO: 56106 - DNA, 18 bp, Artificial Sequence
  Synthetic DNA
ttatacgtctcacatttg

SEQ ID NO: 56107 - DNA, 18 bp, Artificial Sequence
  Synthetic DNA
ttatacgtctcatatttg

SEQ ID NO: 56108 - DNA, 18 bp, Artificial Sequence
  Synthetic DNA
ttatacgtctcgtaatag

SEQ ID NO: 56109 - DNA, 18 bp, Artificial Sequence
  Synthetic DNA
ttatacgttatagtagag

SEQ ID NO: 56110 - DNA, 18 bp, Artificial Sequence
  Synthetic DNA
ttatacgtttcaatttag

SEQ ID NO: 56111 - DNA, 18 bp, Artificial Sequence
  Synthetic DNA
ttatacgtttcactaatg

SEQ ID NO: 56112 - DNA, 18 bp, Artificial Sequence
  Synthetic DNA
ttatacgtttcgatttag

SEQ ID NO: 56113 - DNA, 18 bp, Artificial Sequence
  Synthetic DNA
ttatacgtttcgctataa

SEQ ID NO: 56114 - DNA, 18 bp, Artificial Sequence
  Synthetic DNA
ttatactacacaaatttg

SEQ ID NO: 56115 - DNA, 18 bp, Artificial Sequence
  Synthetic DNA
ttatactacacagtctag

SEQ ID NO: 56116 - DNA, 18 bp, Artificial Sequence
  Synthetic DNA
ttatactaccatgtacag

SEQ ID NO: 56117 - DNA, 18 bp, Artificial Sequence
  Synthetic DNA
ttatactactatttatcg

SEQ ID NO: 56118 - DNA, 18 bp, Artificial Sequence
  Synthetic DNA
ttatactactctagaaag

SEQ ID NO: 56119 - DNA, 18 bp, Artificial Sequence
  Synthetic DNA
ttatactagtcaaaatag

SEQ ID NO: 56120 - DNA, 18 bp, Artificial Sequence
  Synthetic DNA
ttatactagtttctaatg

SEQ ID NO: 56121 - DNA, 18 bp, Artificial Sequence
  Synthetic DNA
ttatactagtttctatag

SEQ ID NO: 56122 - DNA, 18 bp, Artificial Sequence
  Synthetic DNA
ttatactattctccttag

SEQ ID NO: 56123 - DNA, 18 bp, Artificial Sequence
  Synthetic DNA
ttatactatttccaatag

SEQ ID NO: 56124 - DNA, 18 bp, Artificial Sequence
  Synthetic DNA
ttatactccttacaatag

SEQ ID NO: 56125 - DNA, 18 bp, Artificial Sequence
  Synthetic DNA
ttatactgctctctaaag

SEQ ID NO: 56126 - DNA, 18 bp, Artificial Sequence
  Synthetic DNA
ttatacttatctcgtgtg

SEQ ID NO: 56127 - DNA, 18 bp, Artificial Sequence
  Synthetic DNA
ttatacttcgcactcaag

SEQ ID NO: 56128 - DNA, 18 bp, Artificial Sequence
  Synthetic DNA
ttatacttctctctatcg

SEQ ID NO: 56129 - DNA, 18 bp, Artificial Sequence
  Synthetic DNA
ttatacttctctctcatg

SEQ ID NO: 56130 - DNA, 18 bp, Artificial Sequence
  Synthetic DNA
ttatagaactcagaatag

SEQ ID NO: 56131 - DNA, 18 bp, Artificial Sequence
  Synthetic DNA
ttatagatcttacaatag

SEQ ID NO: 56132 - DNA, 18 bp, Artificial Sequence
  Synthetic DNA
ttatagcacatatttaag

SEQ ID NO: 56133 - DNA, 18 bp, Artificial Sequence
  Synthetic DNA
ttataggacacagcttag

SEQ ID NO: 56134 - DNA, 18 bp, Artificial Sequence
  Synthetic DNA
ttataggactcttcacag

SEQ ID NO: 56135 - DNA, 18 bp, Artificial Sequence
  Synthetic DNA
ttataggagtggcgattg

SEQ ID NO: 56136 - DNA, 18 bp, Artificial Sequence
  Synthetic DNA
ttataggatttacaattg

SEQ ID NO: 56137 - DNA, 18 bp, Artificial Sequence
  Synthetic DNA
ttataggccacaccaaag

SEQ ID NO: 56138 - DNA, 18 bp, Artificial Sequence
  Synthetic DNA
ttataggcctacctatag

SEQ ID NO: 56139 - DNA, 18 bp, Artificial Sequence
  Synthetic DNA
ttatagggttcactaaag

SEQ ID NO: 56140 - DNA, 18 bp, Artificial Sequence
  Synthetic DNA
ttataggtcaccctatag

SEQ ID NO: 56141 - DNA, 18 bp, Artificial Sequence
  Synthetic DNA
ttatagtacacattatag

SEQ ID NO: 56142 - DNA, 18 bp, Artificial Sequence
  Synthetic DNA
ttatagtacactatatag

SEQ ID NO: 56143 - DNA, 18 bp, Artificial Sequence
  Synthetic DNA
ttatataccttattatag

SEQ ID NO: 56144 - DNA, 18 bp, Artificial Sequence
  Synthetic DNA
ttatatcacactctattg

SEQ ID NO: 56145 - DNA, 18 bp, Artificial Sequence
  Synthetic DNA
ttatatcacttagcatag

SEQ ID NO: 56146 - DNA, 18 bp, Artificial Sequence
  Synthetic DNA
ttatatgaaacactaagg

SEQ ID NO: 56147 - DNA, 18 bp, Artificial Sequence
  Synthetic DNA
ttatatgaataactatcg

SEQ ID NO: 56148 - DNA, 18 bp, Artificial Sequence
  Synthetic DNA
ttatatgacacacaaaag

SEQ ID NO: 56149 - DNA, 18 bp, Artificial Sequence
  Synthetic DNA
ttatatgacacactactg

SEQ ID NO: 56150 - DNA, 18 bp, Artificial Sequence
  Synthetic DNA
ttatatgactacgcactg

SEQ ID NO: 56151 - DNA, 18 bp, Artificial Sequence
  Synthetic DNA
ttatatgactatctattg

SEQ ID NO: 56152 - DNA, 18 bp, Artificial Sequence
  Synthetic DNA
ttatatgactcacattcg

SEQ ID NO: 56153 - DNA, 18 bp, Artificial Sequence
  Synthetic DNA
ttatatgactctcaatcg

SEQ ID NO: 56154 - DNA, 18 bp, Artificial Sequence
  Synthetic DNA
ttatatgagtatatatag

SEQ ID NO: 56155 - DNA, 18 bp, Artificial Sequence
  Synthetic DNA
ttatatgattcactgtgg

SEQ ID NO: 56156 - DNA, 18 bp, Artificial Sequence
  Synthetic DNA
ttatatgcctcacaattg

SEQ ID NO: 56157 - DNA, 18 bp, Artificial Sequence
  Synthetic DNA
ttatatgtaagactattg

SEQ ID NO: 56158 - DNA, 18 bp, Artificial Sequence
  Synthetic DNA
ttatatgtcacgctatcg

SEQ ID NO: 56159 - DNA, 18 bp, Artificial Sequence
  Synthetic DNA
ttatatgtctcccaattg

SEQ ID NO: 56160 - DNA, 18 bp, Artificial Sequence
  Synthetic DNA
ttatatgtctggctatag

SEQ ID NO: 56161 - DNA, 18 bp, Artificial Sequence
  Synthetic DNA
ttatattattcactaaag

SEQ ID NO: 56162 - DNA, 18 bp, Artificial Sequence
  Synthetic DNA
ttatcaaataaacttttg

SEQ ID NO: 56163 - DNA, 18 bp, Artificial Sequence
  Synthetic DNA
ttatcagacactcttttg

SEQ ID NO: 56164 - DNA, 18 bp, Artificial Sequence
  Synthetic DNA
ttatcagactcacattag

SEQ ID NO: 56165 - DNA, 18 bp, Artificial Sequence
  Synthetic DNA
ttatccgacacatcatag

SEQ ID NO: 56166 - DNA, 18 bp, Artificial Sequence
  Synthetic DNA
ttatccgacgtaataaag

SEQ ID NO: 56167 - DNA, 18 bp, Artificial Sequence
  Synthetic DNA
ttatccgactccttaaag

SEQ ID NO: 56168 - DNA, 18 bp, Artificial Sequence
  Synthetic DNA
ttatccgactgacaaaag

SEQ ID NO: 56169 - DNA, 18 bp, Artificial Sequence
  Synthetic DNA
ttatccgatttattatag

SEQ ID NO: 56170 - DNA, 18 bp, Artificial Sequence
  Synthetic DNA
ttatccggatcactatcg

SEQ ID NO: 56171 - DNA, 18 bp, Artificial Sequence
  Synthetic DNA
ttatccggctcaatatcg

SEQ ID NO: 56172 - DNA, 18 bp, Artificial Sequence
  Synthetic DNA
ttatccgtctcatttttg

SEQ ID NO: 56173 - DNA, 18 bp, Artificial Sequence
  Synthetic DNA
ttatccgtcttactattg

SEQ ID NO: 56174 - DNA, 18 bp, Artificial Sequence
  Synthetic DNA
ttatccgtgtctctatag

SEQ ID NO: 56175 - DNA, 18 bp, Artificial Sequence
  Synthetic DNA
ttatcctcctccctattg

SEQ ID NO: 56176 - DNA, 18 bp, Artificial Sequence
  Synthetic DNA
ttatcctgctatctatag

SEQ ID NO: 56177 - DNA, 18 bp, Artificial Sequence
  Synthetic DNA
ttatcggaaacaatatag

SEQ ID NO: 56178 - DNA, 18 bp, Artificial Sequence
  Synthetic DNA
ttatctcacaatctattg

SEQ ID NO: 56179 - DNA, 18 bp, Artificial Sequence
  Synthetic DNA
ttatctgactcacaaaag

SEQ ID NO: 56180 - DNA, 18 bp, Artificial Sequence
  Synthetic DNA
ttatctgacttattatag

SEQ ID NO: 56181 - DNA, 18 bp, Artificial Sequence
  Synthetic DNA
ttatgcaaaatactatag

SEQ ID NO: 56182 - DNA, 18 bp, Artificial Sequence
  Synthetic DNA
ttatgcaaataactatag

SEQ ID NO: 56183 - DNA, 18 bp, Artificial Sequence
  Synthetic DNA
ttatgcaattgacaaaag

SEQ ID NO: 56184 - DNA, 18 bp, Artificial Sequence
  Synthetic DNA
ttatgcagttcaatcaag

SEQ ID NO: 56185 - DNA, 18 bp, Artificial Sequence
  Synthetic DNA
ttatgcatcttacttgtg

SEQ ID NO: 56186 - DNA, 18 bp, Artificial Sequence
  Synthetic DNA
ttatgccatttactatag

SEQ ID NO: 56187 - DNA, 18 bp, Artificial Sequence
  Synthetic DNA
ttatgcgaaccactattg

SEQ ID NO: 56188 - DNA, 18 bp, Artificial Sequence
  Synthetic DNA
ttatgcgaatccttgatg

SEQ ID NO: 56189 - DNA, 18 bp, Artificial Sequence
  Synthetic DNA
ttatgcgaattactaaag

SEQ ID NO: 56190 - DNA, 18 bp, Artificial Sequence
  Synthetic DNA
ttatgcgacaaacttttg

SEQ ID NO: 56191 - DNA, 18 bp, Artificial Sequence
  Synthetic DNA
ttatgcgactctcaattg

SEQ ID NO: 56192 - DNA, 18 bp, Artificial Sequence
  Synthetic DNA
ttatgcgagtcacaattg

SEQ ID NO: 56193 - DNA, 18 bp, Artificial Sequence
  Synthetic DNA
ttatgcggctaaccctag

SEQ ID NO: 56194 - DNA, 18 bp, Artificial Sequence
  Synthetic DNA
ttatgcgggacactttcg

SEQ ID NO: 56195 - DNA, 18 bp, Artificial Sequence
  Synthetic DNA
ttatgcgtctctccatag

SEQ ID NO: 56196 - DNA, 18 bp, Artificial Sequence
  Synthetic DNA
ttatgctacatactatag

SEQ ID NO: 56197 - DNA, 18 bp, Artificial Sequence
  Synthetic DNA
ttatgctaccctttaaag

SEQ ID NO: 56198 - DNA, 18 bp, Artificial Sequence
  Synthetic DNA
ttatgctactccctaaag

SEQ ID NO: 56199 - DNA, 18 bp, Artificial Sequence
  Synthetic DNA
ttatgctactctcaatag

SEQ ID NO: 56200 - DNA, 18 bp, Artificial Sequence
  Synthetic DNA
ttatgcttcttatcatag

SEQ ID NO: 56201 - DNA, 18 bp, Artificial Sequence
  Synthetic DNA
ttatgggacaccgtatag

SEQ ID NO: 56202 - DNA, 18 bp, Artificial Sequence
  Synthetic DNA
ttatgggagtcaatatag

SEQ ID NO: 56203 - DNA, 18 bp, Artificial Sequence
  Synthetic DNA
ttatgggcctcatttagg

SEQ ID NO: 56204 - DNA, 18 bp, Artificial Sequence
  Synthetic DNA
ttattaaactcacttaag

SEQ ID NO: 56205 - DNA, 18 bp, Artificial Sequence
  Synthetic DNA
ttattacacgcactatag

SEQ ID NO: 56206 - DNA, 18 bp, Artificial Sequence
  Synthetic DNA
ttattagactcactaagg

SEQ ID NO: 56207 - DNA, 18 bp, Artificial Sequence
  Synthetic DNA
ttattagattctctatcg

SEQ ID NO: 56208 - DNA, 18 bp, Artificial Sequence
  Synthetic DNA
ttattagtctcacttaag

SEQ ID NO: 56209 - DNA, 18 bp, Artificial Sequence
  Synthetic DNA
ttattagtctctcgttag

SEQ ID NO: 56210 - DNA, 18 bp, Artificial Sequence
  Synthetic DNA
ttattcaacacactgtaa

SEQ ID NO: 56211 - DNA, 18 bp, Artificial Sequence
  Synthetic DNA
ttattcaacactccgtag

SEQ ID NO: 56212 - DNA, 18 bp, Artificial Sequence
  Synthetic DNA
ttattcaactcaatttag

SEQ ID NO: 56213 - DNA, 18 bp, Artificial Sequence
  Synthetic DNA
ttattcatctccctatag

SEQ ID NO: 56214 - DNA, 18 bp, Artificial Sequence
  Synthetic DNA
ttattcccctttcaatag

SEQ ID NO: 56215 - DNA, 18 bp, Artificial Sequence
  Synthetic DNA
ttattcgaagtactaatg

SEQ ID NO: 56216 - DNA, 18 bp, Artificial Sequence
  Synthetic DNA
ttattcgacaaagtgtag

SEQ ID NO: 56217 - DNA, 18 bp, Artificial Sequence
  Synthetic DNA
ttattcgacacaccacag

SEQ ID NO: 56218 - DNA, 18 bp, Artificial Sequence
  Synthetic DNA
ttattcgacacctcatag

SEQ ID NO: 56219 - DNA, 18 bp, Artificial Sequence
  Synthetic DNA
ttattcgacctactacag

SEQ ID NO: 56220 - DNA, 18 bp, Artificial Sequence
  Synthetic DNA
ttattcgacctagtatag

SEQ ID NO: 56221 - DNA, 18 bp, Artificial Sequence
  Synthetic DNA
ttattcgacgctatcagg

SEQ ID NO: 56222 - DNA, 18 bp, Artificial Sequence
  Synthetic DNA
ttattcgactagctatcg

SEQ ID NO: 56223 - DNA, 18 bp, Artificial Sequence
  Synthetic DNA
ttattcgactctgtttag

SEQ ID NO: 56224 - DNA, 18 bp, Artificial Sequence
  Synthetic DNA
ttattcgacttaatacag

SEQ ID NO: 56225 - DNA, 18 bp, Artificial Sequence
  Synthetic DNA
ttattcgacttacaatcg

SEQ ID NO: 56226 - DNA, 18 bp, Artificial Sequence
  Synthetic DNA
ttattcgacttactactg

SEQ ID NO: 56227 - DNA, 18 bp, Artificial Sequence
  Synthetic DNA
ttattcgagccactaaag

SEQ ID NO: 56228 - DNA, 18 bp, Artificial Sequence
  Synthetic DNA
ttattcgattcaaggttg

SEQ ID NO: 56229 - DNA, 18 bp, Artificial Sequence
  Synthetic DNA
ttattcgatttgctacag

SEQ ID NO: 56230 - DNA, 18 bp, Artificial Sequence
  Synthetic DNA
ttattcgccacagtttcg

SEQ ID NO: 56231 - DNA, 18 bp, Artificial Sequence
  Synthetic DNA
ttattcggaccgctatag

SEQ ID NO: 56232 - DNA, 18 bp, Artificial Sequence
  Synthetic DNA
ttattcggttcaatttgg

SEQ ID NO: 56233 - DNA, 18 bp, Artificial Sequence
  Synthetic DNA
ttattcgtatcgatattg

SEQ ID NO: 56234 - DNA, 18 bp, Artificial Sequence
  Synthetic DNA
ttattcgtctaaatatcg

SEQ ID NO: 56235 - DNA, 18 bp, Artificial Sequence
  Synthetic DNA
ttattcgtgacaccatag

SEQ ID NO: 56236 - DNA, 18 bp, Artificial Sequence
  Synthetic DNA
ttattcgtttcaccatag

SEQ ID NO: 56237 - DNA, 18 bp, Artificial Sequence
  Synthetic DNA
ttattctacagtctaaag

SEQ ID NO: 56238 - DNA, 18 bp, Artificial Sequence
  Synthetic DNA
ttattctaccgtcaatag

SEQ ID NO: 56239 - DNA, 18 bp, Artificial Sequence
  Synthetic DNA
ttattcttctaaaaatag

SEQ ID NO: 56240 - DNA, 18 bp, Artificial Sequence
  Synthetic DNA
ttattggagcctctttag

SEQ ID NO: 56241 - DNA, 18 bp, Artificial Sequence
  Synthetic DNA
ttattggatccactaccg

SEQ ID NO: 56242 - DNA, 18 bp, Artificial Sequence
  Synthetic DNA
ttattggccacataatag

SEQ ID NO: 56243 - DNA, 18 bp, Artificial Sequence
  Synthetic DNA
ttatttgaatcactaaag

SEQ ID NO: 56244 - DNA, 18 bp, Artificial Sequence
  Synthetic DNA
ttatttgacactataaag

SEQ ID NO: 56245 - DNA, 18 bp, Artificial Sequence
  Synthetic DNA
ttatttgactctctttag

SEQ ID NO: 56246 - DNA, 18 bp, Artificial Sequence
  Synthetic DNA
ttatttggaattctaaag

SEQ ID NO: 56247 - DNA, 18 bp, Artificial Sequence
  Synthetic DNA
ttcaacaactcaccatag

SEQ ID NO: 56248 - DNA, 18 bp, Artificial Sequence
  Synthetic DNA
ttcaacgacccgcaatag

SEQ ID NO: 56249 - DNA, 18 bp, Artificial Sequence
  Synthetic DNA
ttcaacgtatcaccatag

SEQ ID NO: 56250 - DNA, 18 bp, Artificial Sequence
  Synthetic DNA
ttcagcgtcccactattg

SEQ ID NO: 56251 - DNA, 18 bp, Artificial Sequence
  Synthetic DNA
ttcatcgactcactatgg

SEQ ID NO: 56252 - DNA, 18 bp, Artificial Sequence
  Synthetic DNA
ttcattgattaacaattg

SEQ ID NO: 56253 - DNA, 18 bp, Artificial Sequence
  Synthetic DNA
ttccacgactcttaatag

SEQ ID NO: 56254 - DNA, 18 bp, Artificial Sequence
  Synthetic DNA
ttcgtagtatcactacag

SEQ ID NO: 56255 - DNA, 18 bp, Artificial Sequence
  Synthetic DNA
ttctacaacttactacag

SEQ ID NO: 56256 - DNA, 18 bp, Artificial Sequence
  Synthetic DNA
ttctacaacttacttttg

SEQ ID NO: 56257 - DNA, 18 bp, Artificial Sequence
  Synthetic DNA
ttctacatctcacaactg

SEQ ID NO: 56258 - DNA, 18 bp, Artificial Sequence
  Synthetic DNA
ttctacatctcacaatag

SEQ ID NO: 56259 - DNA, 18 bp, Artificial Sequence
  Synthetic DNA
ttctaccattcacattag

SEQ ID NO: 56260 - DNA, 18 bp, Artificial Sequence
  Synthetic DNA
ttctacgaatcattttag

SEQ ID NO: 56261 - DNA, 18 bp, Artificial Sequence
  Synthetic DNA
ttctacgacccaccgtag

SEQ ID NO: 56262 - DNA, 18 bp, Artificial Sequence
  Synthetic DNA
ttctacgactcacatgag

SEQ ID NO: 56263 - DNA, 18 bp, Artificial Sequence
  Synthetic DNA
ttctacgactttcaatag

SEQ ID NO: 56264 - DNA, 18 bp, Artificial Sequence
  Synthetic DNA
ttctacgagccggaaaag

SEQ ID NO: 56265 - DNA, 18 bp, Artificial Sequence
  Synthetic DNA
ttctacgattaacaaaag

SEQ ID NO: 56266 - DNA, 18 bp, Artificial Sequence
  Synthetic DNA
ttctacgattcacagtcg

SEQ ID NO: 56267 - DNA, 18 bp, Artificial Sequence
  Synthetic DNA
ttctacgccacgctagag

SEQ ID NO: 56268 - DNA, 18 bp, Artificial Sequence
  Synthetic DNA
ttctacgccttactttag

SEQ ID NO: 56269 - DNA, 18 bp, Artificial Sequence
  Synthetic DNA
ttctacggtacattttgg

SEQ ID NO: 56270 - DNA, 18 bp, Artificial Sequence
  Synthetic DNA
ttctacgtatcacttgag

SEQ ID NO: 56271 - DNA, 18 bp, Artificial Sequence
  Synthetic DNA
ttctaggacacactaaag

SEQ ID NO: 56272 - DNA, 18 bp, Artificial Sequence
  Synthetic DNA
ttctccgaatcactaatg

SEQ ID NO: 56273 - DNA, 18 bp, Artificial Sequence
  Synthetic DNA
ttctccgattcacattag

SEQ ID NO: 56274 - DNA, 18 bp, Artificial Sequence
  Synthetic DNA
ttctctgactcattgtag

SEQ ID NO: 56275 - DNA, 18 bp, Artificial Sequence
  Synthetic DNA
ttcttcaattcactatag

SEQ ID NO: 56276 - DNA, 18 bp, Artificial Sequence
  Synthetic DNA
ttcttcgaaccattaaag

SEQ ID NO: 56277 - DNA, 18 bp, Artificial Sequence
  Synthetic DNA
ttcttcgcctcgctatag

SEQ ID NO: 56278 - DNA, 18 bp, Artificial Sequence
  Synthetic DNA
ttcttgcagacaacatag

SEQ ID NO: 56279 - DNA, 18 bp, Artificial Sequence
  Synthetic DNA
ttctttaactcactatag

SEQ ID NO: 56280 - DNA, 18 bp, Artificial Sequence
  Synthetic DNA
ttctttggcacacaatag

SEQ ID NO: 56281 - DNA, 18 bp, Artificial Sequence
  Synthetic DNA
ttgaacgaattattctag

SEQ ID NO: 56282 - DNA, 18 bp, Artificial Sequence
  Synthetic DNA
ttgaacgacccactgtag

SEQ ID NO: 56283 - DNA, 18 bp, Artificial Sequence
  Synthetic DNA
ttgaacgtcacagtattg

SEQ ID NO: 56284 - DNA, 18 bp, Artificial Sequence
  Synthetic DNA
ttgaactactcgcaatag

SEQ ID NO: 56285 - DNA, 18 bp, Artificial Sequence
  Synthetic DNA
ttgaactactctccttag

SEQ ID NO: 56286 - DNA, 18 bp, Artificial Sequence
  Synthetic DNA
ttgaaggtctcaccatag

SEQ ID NO: 56287 - DNA, 18 bp, Artificial Sequence
  Synthetic DNA
ttgatcgaccctcaatag

SEQ ID NO: 56288 - DNA, 18 bp, Artificial Sequence
  Synthetic DNA
ttgatgtactaactatag

SEQ ID NO: 56289 - DNA, 18 bp, Artificial Sequence
  Synthetic DNA
ttgtacaaatctttgtag

SEQ ID NO: 56290 - DNA, 18 bp, Artificial Sequence
  Synthetic DNA
ttgtacatctcaccattc

SEQ ID NO: 56291 - DNA, 18 bp, Artificial Sequence
  Synthetic DNA
ttgtacatctgacaattg

SEQ ID NO: 56292 - DNA, 18 bp, Artificial Sequence
  Synthetic DNA
ttgtaccgctcactagag

SEQ ID NO: 56293 - DNA, 18 bp, Artificial Sequence
  Synthetic DNA
ttgtacgagtccccattg

SEQ ID NO: 56294 - DNA, 18 bp, Artificial Sequence
  Synthetic DNA
ttgtacgcctcccattaa

SEQ ID NO: 56295 - DNA, 18 bp, Artificial Sequence
  Synthetic DNA
ttgtacgtctctctttag

SEQ ID NO: 56296 - DNA, 18 bp, Artificial Sequence
  Synthetic DNA
ttgtactattcattttag

SEQ ID NO: 56297 - DNA, 18 bp, Artificial Sequence
  Synthetic DNA
ttgtaggtctcaataatg

SEQ ID NO: 56298 - DNA, 18 bp, Artificial Sequence
  Synthetic DNA
ttgtatggctcactacag

SEQ ID NO: 56299 - DNA, 18 bp, Artificial Sequence
  Synthetic DNA
ttgtccgactctcgctag

SEQ ID NO: 56300 - DNA, 18 bp, Artificial Sequence
  Synthetic DNA
ttgtcggactcacaatag

SEQ ID NO: 56301 - DNA, 18 bp, Artificial Sequence
  Synthetic DNA
ttgtgcaactcacaatag

SEQ ID NO: 56302 - DNA, 18 bp, Artificial Sequence
  Synthetic DNA
ttgttcgactccattgag

SEQ ID NO: 56303 - DNA, 18 bp, Artificial Sequence
  Synthetic DNA
ttgttcgactccctaatg

SEQ ID NO: 56304 - DNA, 18 bp, Artificial Sequence
  Synthetic DNA
ttgtttaactcactatag

SEQ ID NO: 56305 - DNA, 18 bp, Artificial Sequence
  Synthetic DNA
tttaaactctcgctatag

SEQ ID NO: 56306 - DNA, 18 bp, Artificial Sequence
  Synthetic DNA
tttaaagactgacaaaag

SEQ ID NO: 56307 - DNA, 18 bp, Artificial Sequence
  Synthetic DNA
tttaaatccactgtatag

SEQ ID NO: 56308 - DNA, 18 bp, Artificial Sequence
  Synthetic DNA
tttaacaactctgaatgg

SEQ ID NO: 56309 - DNA, 18 bp, Artificial Sequence
  Synthetic DNA
tttaacaatgcaatttag

SEQ ID NO: 56310 - DNA, 18 bp, Artificial Sequence
  Synthetic DNA
tttaacgcctctacatag

SEQ ID NO: 56311 - DNA, 18 bp, Artificial Sequence
  Synthetic DNA
tttaacgtctaagtttag

SEQ ID NO: 56312 - DNA, 18 bp, Artificial Sequence
  Synthetic DNA
tttaacgtctatctaacg

SEQ ID NO: 56313 - DNA, 18 bp, Artificial Sequence
  Synthetic DNA
tttaacgtctcacttttg

SEQ ID NO: 56314 - DNA, 18 bp, Artificial Sequence
  Synthetic DNA
tttaacgtctctctatag

SEQ ID NO: 56315 - DNA, 18 bp, Artificial Sequence
  Synthetic DNA
tttaacttttaataaatg

SEQ ID NO: 56316 - DNA, 18 bp, Artificial Sequence
  Synthetic DNA
tttaagaaatccccatag

SEQ ID NO: 56317 - DNA, 18 bp, Artificial Sequence
  Synthetic DNA
tttaaggagtccctatag

SEQ ID NO: 56318 - DNA, 18 bp, Artificial Sequence
  Synthetic DNA
tttaatgaatcagtattg

SEQ ID NO: 56319 - DNA, 18 bp, Artificial Sequence
  Synthetic DNA
tttaatgacacacaatgg

SEQ ID NO: 56320 - DNA, 18 bp, Artificial Sequence
  Synthetic DNA
tttaatgattaactatag

SEQ ID NO: 56321 - DNA, 18 bp, Artificial Sequence
  Synthetic DNA
tttaccaattaaatatag

SEQ ID NO: 56322 - DNA, 18 bp, Artificial Sequence
  Synthetic DNA
tttagcgactcacactag

SEQ ID NO: 56323 - DNA, 18 bp, Artificial Sequence
  Synthetic DNA
tttagggacacactttag

SEQ ID NO: 56324 - DNA, 18 bp, Artificial Sequence
  Synthetic DNA
tttatcgattctcgatag

SEQ ID NO: 56325 - DNA, 18 bp, Artificial Sequence
  Synthetic DNA
tttatctacacactactg

SEQ ID NO: 56326 - DNA, 18 bp, Artificial Sequence
  Synthetic DNA
tttcacaacacactcaag

SEQ ID NO: 56327 - DNA, 18 bp, Artificial Sequence
  Synthetic DNA
tttcacgcctcattatag

SEQ ID NO: 56328 - DNA, 18 bp, Artificial Sequence
  Synthetic DNA
tttcacgtatctataatg

SEQ ID NO: 56329 - DNA, 18 bp, Artificial Sequence
  Synthetic DNA
tttcattactcactatag

SEQ ID NO: 56330 - DNA, 18 bp, Artificial Sequence
  Synthetic DNA
tttcattcctaactatag

SEQ ID NO: 56331 - DNA, 18 bp, Artificial Sequence
  Synthetic DNA
tttctatattcactattg

SEQ ID NO: 56332 - DNA, 18 bp, Artificial Sequence
  Synthetic DNA
tttcttgactgatcatgg

SEQ ID NO: 56333 - DNA, 18 bp, Artificial Sequence
  Synthetic DNA
tttgacgacaccctaaag

SEQ ID NO: 56334 - DNA, 18 bp, Artificial Sequence
  Synthetic DNA
tttggcgactcaccttag

SEQ ID NO: 56335 - DNA, 18 bp, Artificial Sequence
  Synthetic DNA
ttttaagactcacaaaag

SEQ ID NO: 56336 - DNA, 18 bp, Artificial Sequence
  Synthetic DNA
ttttaagactctgtagag

SEQ ID NO: 56337 - DNA, 18 bp, Artificial Sequence
  Synthetic DNA
ttttaatactcacattag

SEQ ID NO: 56338 - DNA, 18 bp, Artificial Sequence
  Synthetic DNA
ttttacaactaaatatag

SEQ ID NO: 56339 - DNA, 18 bp, Artificial Sequence
  Synthetic DNA
ttttacaacttaccatcg

SEQ ID NO: 56340 - DNA, 18 bp, Artificial Sequence
  Synthetic DNA
ttttacaacttagtgtag

SEQ ID NO: 56341 - DNA, 18 bp, Artificial Sequence
  Synthetic DNA
ttttacacctcactattg

SEQ ID NO: 56342 - DNA, 18 bp, Artificial Sequence
  Synthetic DNA
ttttaccaatcactattg

SEQ ID NO: 56343 - DNA, 18 bp, Artificial Sequence
  Synthetic DNA
ttttacgacacaaaatag

SEQ ID NO: 56344 - DNA, 18 bp, Artificial Sequence
  Synthetic DNA
ttttacgacacgatacag

SEQ ID NO: 56345 - DNA, 18 bp, Artificial Sequence
  Synthetic DNA
ttttacgacgcacaaaag

SEQ ID NO: 56346 - DNA, 18 bp, Artificial Sequence
  Synthetic DNA
ttttacgactcaccctgg

SEQ ID NO: 56347 - DNA, 18 bp, Artificial Sequence
  Synthetic DNA
ttttacgactcgtagtag

SEQ ID NO: 56348 - DNA, 18 bp, Artificial Sequence
  Synthetic DNA
ttttacgagtcacagtag

SEQ ID NO: 56349 - DNA, 18 bp, Artificial Sequence
  Synthetic DNA
ttttacgagtctctcaag

SEQ ID NO: 56350 - DNA, 18 bp, Artificial Sequence
  Synthetic DNA
ttttacgagttgctttag

SEQ ID NO: 56351 - DNA, 18 bp, Artificial Sequence
  Synthetic DNA
ttttacgattcagaatag

SEQ ID NO: 56352 - DNA, 18 bp, Artificial Sequence
  Synthetic DNA
ttttacggtccatcatcg

SEQ ID NO: 56353 - DNA, 18 bp, Artificial Sequence
  Synthetic DNA
ttttacgtaataacatag

SEQ ID NO: 56354 - DNA, 18 bp, Artificial Sequence
  Synthetic DNA
ttttacgtctcaccttag

SEQ ID NO: 56355 - DNA, 18 bp, Artificial Sequence
  Synthetic DNA
ttttacgtgacattatag

SEQ ID NO: 56356 - DNA, 18 bp, Artificial Sequence
  Synthetic DNA
ttttactacatactatag

SEQ ID NO: 56357 - DNA, 18 bp, Artificial Sequence
  Synthetic DNA
ttttactacccatttaag

SEQ ID NO: 56358 - DNA, 18 bp, Artificial Sequence
  Synthetic DNA
ttttactacgcattattg

SEQ ID NO: 56359 - DNA, 18 bp, Artificial Sequence
  Synthetic DNA
ttttactactttgtaatg

SEQ ID NO: 56360 - DNA, 18 bp, Artificial Sequence
  Synthetic DNA
ttttagaactcaatatag

SEQ ID NO: 56361 - DNA, 18 bp, Artificial Sequence
  Synthetic DNA
ttttatatttcacttaag

SEQ ID NO: 56362 - DNA, 18 bp, Artificial Sequence
  Synthetic DNA
ttttatgatcaattttcg

SEQ ID NO: 56363 - DNA, 18 bp, Artificial Sequence
  Synthetic DNA
ttttattaatcactaaag

SEQ ID NO: 56364 - DNA, 18 bp, Artificial Sequence
  Synthetic DNA
ttttattaatcactatcg

SEQ ID NO: 56365 - DNA, 18 bp, Artificial Sequence
  Synthetic DNA
ttttcaaactcactgaag

SEQ ID NO: 56366 - DNA, 18 bp, Artificial Sequence
  Synthetic DNA
ttttcatactcactatag

SEQ ID NO: 56367 - DNA, 18 bp, Artificial Sequence
  Synthetic DNA
ttttccaactcactaatg

SEQ ID NO: 56368 - DNA, 18 bp, Artificial Sequence
  Synthetic DNA
ttttccaatttagtattg

SEQ ID NO: 56369 - DNA, 18 bp, Artificial Sequence
  Synthetic DNA
ttttctcaattactaaag

SEQ ID NO: 56370 - DNA, 18 bp, Artificial Sequence
  Synthetic DNA
ttttgagacttactaaag

SEQ ID NO: 56371 - DNA, 18 bp, Artificial Sequence
  Synthetic DNA
ttttgccattttctattg

SEQ ID NO: 56372 - DNA, 18 bp, Artificial Sequence
  Synthetic DNA
ttttgcctctcactattg

SEQ ID NO: 56373 - DNA, 18 bp, Artificial Sequence
  Synthetic DNA
ttttgcgtcatactttag

SEQ ID NO: 56374 - DNA, 18 bp, Artificial Sequence
  Synthetic DNA
ttttgcgtctcattatgg

SEQ ID NO: 56375 - DNA, 18 bp, Artificial Sequence
  Synthetic DNA
ttttgcgtctcatttttg

SEQ ID NO: 56376 - DNA, 18 bp, Artificial Sequence
  Synthetic DNA
ttttgctactcacacttg

SEQ ID NO: 56377 - DNA, 18 bp, Artificial Sequence
  Synthetic DNA
tttttaaatttactatag

SEQ ID NO: 56378 - DNA, 18 bp, Artificial Sequence
  Synthetic DNA
tttttcgacggactatag

SEQ ID NO: 56379 - DNA, 18 bp, Artificial Sequence
  Synthetic DNA
tttttcgactcactcatg

SEQ ID NO: 56380 - DNA, 18 bp, Artificial Sequence
  Synthetic DNA
tttttcgactcccttaag

SEQ ID NO: 56381 - DNA, 18 bp, Artificial Sequence
  Synthetic DNA
tttttcttctcactatag

SEQ ID NO: 56382 - DNA, 18 bp, Artificial Sequence
  Synthetic DNA
ttttttaactcactttcg

SEQ ID NO: 56383 - DNA, 18 bp, Artificial Sequence
  Synthetic DNA
ttttttcactcactatag

SEQ ID NO: 56384 - DNA, 18 bp, Artificial Sequence
  Synthetic DNA
ttaaacaactctctttag

SEQ ID NO: 56385 - DNA, 18 bp, Artificial Sequence
  Synthetic DNA
aattacgtcacactttag

SEQ ID NO: 56386 - DNA, 18 bp, Artificial Sequence
  Synthetic DNA
acatacgaattactaaag

SEQ ID NO: 56387 - DNA, 18 bp, Artificial Sequence
  Synthetic DNA
atatacgtatcactttag

SEQ ID NO: 56388 - DNA, 18 bp, Artificial Sequence
  Synthetic DNA
caattcgtcacacaatag

SEQ ID NO: 56389 - DNA, 18 bp, Artificial Sequence
  Synthetic DNA
cactatgactcacaatgg

SEQ ID NO: 56390 - DNA, 18 bp, Artificial Sequence
  Synthetic DNA
taaatagactcacaattg

SEQ ID NO: 56391 - DNA, 18 bp, Artificial Sequence
  Synthetic DNA
taatacgcaaaacaatag

SEQ ID NO: 56392 - DNA, 18 bp, Artificial Sequence
  Synthetic DNA
taatgcacctaactttag

SEQ ID NO: 56393 - DNA, 18 bp, Artificial Sequence
  Synthetic DNA
ttatgcgtcacacaatag

SEQ ID NO: 56394 - DNA, 18 bp, Artificial Sequence
  Synthetic DNA
ttttacgaccctctttag

SEQ ID NO: 56395 - DNA, 18 bp, Artificial Sequence
  Synthetic DNA
ataatcgactcagtgtag

SEQ ID NO: 56396 - DNA, 18 bp, Artificial Sequence
  Synthetic DNA
aaaaaagtcacactatag

SEQ ID NO: 56397 - DNA, 18 bp, Artificial Sequence
  Synthetic DNA
aaaaacgactcacatcag

SEQ ID NO: 56398 - DNA, 18 bp, Artificial Sequence
  Synthetic DNA
aaaaacgattcaccgtag

SEQ ID NO: 56399 - DNA, 18 bp, Artificial Sequence
  Synthetic DNA
aaaatagacacacaatag

SEQ ID NO: 56400 - DNA, 18 bp, Artificial Sequence
  Synthetic DNA
aaacaagcgtcactatcg

SEQ ID NO: 56401 - DNA, 18 bp, Artificial Sequence
  Synthetic DNA
aaacacgatgcacaatag

SEQ ID NO: 56402 - DNA, 18 bp, Artificial Sequence
  Synthetic DNA
aaatacaagtcactcttg

SEQ ID NO: 56403 - DNA, 18 bp, Artificial Sequence
  Synthetic DNA
aaatacgaccctctaatg

SEQ ID NO: 56404 - DNA, 18 bp, Artificial Sequence
  Synthetic DNA
aaatacttctggctatag

SEQ ID NO: 56405 - DNA, 18 bp, Artificial Sequence
  Synthetic DNA
aaatatgactcaaaattg

SEQ ID NO: 56406 - DNA, 18 bp, Artificial Sequence
  Synthetic DNA
aaatatgagtcaacatag

SEQ ID NO: 56407 - DNA, 18 bp, Artificial Sequence
  Synthetic DNA
aaatcatccagagtttcg

SEQ ID NO: 56408 - DNA, 18 bp, Artificial Sequence
  Synthetic DNA
aaatcgggctgcctaaag

SEQ ID NO: 56409 - DNA, 18 bp, Artificial Sequence
  Synthetic DNA
aaatgcgcctcaatatcg

SEQ ID NO: 56410 - DNA, 18 bp, Artificial Sequence
  Synthetic DNA
aaattcaactcacattag

SEQ ID NO: 56411 - DNA, 18 bp, Artificial Sequence
  Synthetic DNA
aaattcgacccattttag

SEQ ID NO: 56412 - DNA, 18 bp, Artificial Sequence
  Synthetic DNA
aaattgaactcactgatg

SEQ ID NO: 56413 - DNA, 18 bp, Artificial Sequence
  Synthetic DNA
aaattggacaaactattg

SEQ ID NO: 56414 - DNA, 18 bp, Artificial Sequence
  Synthetic DNA
aaatttgactctctttag

SEQ ID NO: 56415 - DNA, 18 bp, Artificial Sequence
  Synthetic DNA
aatatcgactcaacgtag

SEQ ID NO: 56416 - DNA, 18 bp, Artificial Sequence
  Synthetic DNA
aatcaggaatcaaaatag

SEQ ID NO: 56417 - DNA, 18 bp, Artificial Sequence
  Synthetic DNA
acatacgagttacttaag

SEQ ID NO: 56418 - DNA, 18 bp, Artificial Sequence
  Synthetic DNA
agatacgactctcaaaag

SEQ ID NO: 56419 - DNA, 18 bp, Artificial Sequence
  Synthetic DNA
atatactacactcttaag

SEQ ID NO: 56420 - DNA, 18 bp, Artificial Sequence
  Synthetic DNA
atctgcttgtaactatag

SEQ ID NO: 56421 - DNA, 18 bp, Artificial Sequence
  Synthetic DNA
atttacaactcattatag

SEQ ID NO: 56422 - DNA, 18 bp, Artificial Sequence
  Synthetic DNA
atttacgaaacactaatg

SEQ ID NO: 56423 - DNA, 18 bp, Artificial Sequence
  Synthetic DNA
caacaagattaactatag

SEQ ID NO: 56424 - DNA, 18 bp, Artificial Sequence
  Synthetic DNA
caataaaactcacgcaag

SEQ ID NO: 56425 - DNA, 18 bp, Artificial Sequence
  Synthetic DNA
caataccattcgatagag

SEQ ID NO: 56426 - DNA, 18 bp, Artificial Sequence
  Synthetic DNA
caatacgtagcaatctag

SEQ ID NO: 56427 - DNA, 18 bp, Artificial Sequence
  Synthetic DNA
caataggattcacattag

SEQ ID NO: 56428 - DNA, 18 bp, Artificial Sequence
  Synthetic DNA
caattcgattcgttattg

SEQ ID NO: 56429 - DNA, 18 bp, Artificial Sequence
  Synthetic DNA
caattctgctcaagatag

SEQ ID NO: 56430 - DNA, 18 bp, Artificial Sequence
  Synthetic DNA
cagtaagaatgactatgg

SEQ ID NO: 56431 - DNA, 18 bp, Artificial Sequence
  Synthetic DNA
catcacgtaacacaattg

SEQ ID NO: 56432 - DNA, 18 bp, Artificial Sequence
  Synthetic DNA
cattacgaatctatatag

SEQ ID NO: 56433 - DNA, 18 bp, Artificial Sequence
  Synthetic DNA
cattatatctcactatag

SEQ ID NO: 56434 - DNA, 18 bp, Artificial Sequence
  Synthetic DNA
catttctactcactattg

SEQ ID NO: 56435 - DNA, 18 bp, Artificial Sequence
  Synthetic DNA
ccataagtctcaatatag

SEQ ID NO: 56436 - DNA, 18 bp, Artificial Sequence
  Synthetic DNA
ccttactattcagtatag

SEQ ID NO: 56437 - DNA, 18 bp, Artificial Sequence
  Synthetic DNA
ctataggactcacttttg

SEQ ID NO: 56438 - DNA, 18 bp, Artificial Sequence
  Synthetic DNA
gaaaacgtcacgctatag

SEQ ID NO: 56439 - DNA, 18 bp, Artificial Sequence
  Synthetic DNA
gtaagcgactcaatctag

SEQ ID NO: 56440 - DNA, 18 bp, Artificial Sequence
  Synthetic DNA
taaaacatctcgctaaag

SEQ ID NO: 56441 - DNA, 18 bp, Artificial Sequence
  Synthetic DNA
taaaaccacattctatag

SEQ ID NO: 56442 - DNA, 18 bp, Artificial Sequence
  Synthetic DNA
taaaaccattcaataacg

SEQ ID NO: 56443 - DNA, 18 bp, Artificial Sequence
  Synthetic DNA
taaaaccgttcgctatcg

SEQ ID NO: 56444 - DNA, 18 bp, Artificial Sequence
  Synthetic DNA
taaaacgtctatcaaatg

SEQ ID NO: 56445 - DNA, 18 bp, Artificial Sequence
  Synthetic DNA
taaaatgaatctcaatgg

SEQ ID NO: 56446 - DNA, 18 bp, Artificial Sequence
  Synthetic DNA
taaacttacttactatag

SEQ ID NO: 56447 - DNA, 18 bp, Artificial Sequence
  Synthetic DNA
taaagcgtctcattattg

SEQ ID NO: 56448 - DNA, 18 bp, Artificial Sequence
  Synthetic DNA
taaatccgctcagattag

SEQ ID NO: 56449 - DNA, 18 bp, Artificial Sequence
  Synthetic DNA
taaatcgattctctctag

SEQ ID NO: 56450 - DNA, 18 bp, Artificial Sequence
  Synthetic DNA
taaatcgtttaaccgtag

SEQ ID NO: 56451 - DNA, 18 bp, Artificial Sequence
  Synthetic DNA
taaatgaactcactgtag

SEQ ID NO: 56452 - DNA, 18 bp, Artificial Sequence
  Synthetic DNA
taagacttctcattattg

SEQ ID NO: 56453 - DNA, 18 bp, Artificial Sequence
  Synthetic DNA
taataagactagttacag

SEQ ID NO: 56454 - DNA, 18 bp, Artificial Sequence
  Synthetic DNA
taataagatacactgaag

SEQ ID NO: 56455 - DNA, 18 bp, Artificial Sequence
  Synthetic DNA
taatacatttaactatgg

SEQ ID NO: 56456 - DNA, 18 bp, Artificial Sequence
  Synthetic DNA
taatacgtcatattgtag

SEQ ID NO: 56457 - DNA, 18 bp, Artificial Sequence
  Synthetic DNA
taatacgtcccggagaag

SEQ ID NO: 56458 - DNA, 18 bp, Artificial Sequence
  Synthetic DNA
taatacgtctctgtaatg

SEQ ID NO: 56459 - DNA, 18 bp, Artificial Sequence
  Synthetic DNA
taatatcactcgcgaacg

SEQ ID NO: 56460 - DNA, 18 bp, Artificial Sequence
  Synthetic DNA
taatattacccacaaaag

SEQ ID NO: 56461 - DNA, 18 bp, Artificial Sequence
  Synthetic DNA
taatatttctcgcttaag

SEQ ID NO: 56462 - DNA, 18 bp, Artificial Sequence
  Synthetic DNA
taatccaactctaaaaag

SEQ ID NO: 56463 - DNA, 18 bp, Artificial Sequence
  Synthetic DNA
taatccaattctctagag

SEQ ID NO: 56464 - DNA, 18 bp, Artificial Sequence
  Synthetic DNA
taatcggattcacttagg

SEQ ID NO: 56465 - DNA, 18 bp, Artificial Sequence
  Synthetic DNA
taatgccacatacaatag

SEQ ID NO: 56466 - DNA, 18 bp, Artificial Sequence
  Synthetic DNA
taattagaaatactatag

SEQ ID NO: 56467 - DNA, 18 bp, Artificial Sequence
  Synthetic DNA
taattagaattacaatag

SEQ ID NO: 56468 - DNA, 18 bp, Artificial Sequence
  Synthetic DNA
taattcaactctctctcg

SEQ ID NO: 56469 - DNA, 18 bp, Artificial Sequence
  Synthetic DNA
taattcttcttacaatag

SEQ ID NO: 56470 - DNA, 18 bp, Artificial Sequence
  Synthetic DNA
taattcttttcacaatag

SEQ ID NO: 56471 - DNA, 18 bp, Artificial Sequence
  Synthetic DNA
taattttactcataattg

SEQ ID NO: 56472 - DNA, 18 bp, Artificial Sequence
  Synthetic DNA
tacgacctatcacaacag

SEQ ID NO: 56473 - DNA, 18 bp, Artificial Sequence
  Synthetic DNA
tactacacctctctattg

SEQ ID NO: 56474 - DNA, 18 bp, Artificial Sequence
  Synthetic DNA
tactatttttcaccatgg

SEQ ID NO: 56475 - DNA, 18 bp, Artificial Sequence
  Synthetic DNA
tagtacgtttccttaaag

SEQ ID NO: 56476 - DNA, 18 bp, Artificial Sequence
  Synthetic DNA
tagtgcgactcaataacg

SEQ ID NO: 56477 - DNA, 18 bp, Artificial Sequence
  Synthetic DNA
tagttcgactgattttag

SEQ ID NO: 56478 - DNA, 18 bp, Artificial Sequence
  Synthetic DNA
tataaccacaatctctag

SEQ ID NO: 56479 - DNA, 18 bp, Artificial Sequence
  Synthetic DNA
tataacgggccactatag

SEQ ID NO: 56480 - DNA, 18 bp, Artificial Sequence
  Synthetic DNA
tatatcaactcactaaag

SEQ ID NO: 56481 - DNA, 18 bp, Artificial Sequence
  Synthetic DNA
tatcacgcttcattatag

SEQ ID NO: 56482 - DNA, 18 bp, Artificial Sequence
  Synthetic DNA
tatgaccattcacaatag

SEQ ID NO: 56483 - DNA, 18 bp, Artificial Sequence
  Synthetic DNA
tatgacgactctttttcg

SEQ ID NO: 56484 - DNA, 18 bp, Artificial Sequence
  Synthetic DNA
tattaagacttacttttg

SEQ ID NO: 56485 - DNA, 18 bp, Artificial Sequence
  Synthetic DNA
tattaagtctgatcaaag

SEQ ID NO: 56486 - DNA, 18 bp, Artificial Sequence
  Synthetic DNA
tattacaacagactttag

SEQ ID NO: 56487 - DNA, 18 bp, Artificial Sequence
  Synthetic DNA
tattacaacttcctttag

SEQ ID NO: 56488 - DNA, 18 bp, Artificial Sequence
  Synthetic DNA
tattacgtaccactattg

SEQ ID NO: 56489 - DNA, 18 bp, Artificial Sequence
  Synthetic DNA
tattacgtatcatttttg

SEQ ID NO: 56490 - DNA, 18 bp, Artificial Sequence
  Synthetic DNA
tattacgtccctctaacg

SEQ ID NO: 56491 - DNA, 18 bp, Artificial Sequence
  Synthetic DNA
tattacgtcttaatgtag

SEQ ID NO: 56492 - DNA, 18 bp, Artificial Sequence
  Synthetic DNA
tattacgtgtaactcttg

SEQ ID NO: 56493 - DNA, 18 bp, Artificial Sequence
  Synthetic DNA
tattaggattgtaaaatg

SEQ ID NO: 56494 - DNA, 18 bp, Artificial Sequence
  Synthetic DNA
tattgctactcacattag

SEQ ID NO: 56495 - DNA, 18 bp, Artificial Sequence
  Synthetic DNA
tatttccactgattgtag

SEQ ID NO: 56496 - DNA, 18 bp, Artificial Sequence
  Synthetic DNA
tcaatcgactaacactag

SEQ ID NO: 56497 - DNA, 18 bp, Artificial Sequence
  Synthetic DNA
tcacacaccaaactttag

SEQ ID NO: 56498 - DNA, 18 bp, Artificial Sequence
  Synthetic DNA
tcatactactctttaaag

SEQ ID NO: 56499 - DNA, 18 bp, Artificial Sequence
  Synthetic DNA
tcattgaactccctatag

SEQ ID NO: 56500 - DNA, 18 bp, Artificial Sequence
  Synthetic DNA
tcctgccactctttatag

SEQ ID NO: 56501 - DNA, 18 bp, Artificial Sequence
  Synthetic DNA
tgaaacgattcaatatcg

SEQ ID NO: 56502 - DNA, 18 bp, Artificial Sequence
  Synthetic DNA
tgacaccaatttctatag

SEQ ID NO: 56503 - DNA, 18 bp, Artificial Sequence
  Synthetic DNA
tgatacaacacacttaag

SEQ ID NO: 56504 - DNA, 18 bp, Artificial Sequence
  Synthetic DNA
tgataccaccctctctag

SEQ ID NO: 56505 - DNA, 18 bp, Artificial Sequence
  Synthetic DNA
tgatattattcactattg

SEQ ID NO: 56506 - DNA, 18 bp, Artificial Sequence
  Synthetic DNA
tgatccaaagcactacag

SEQ ID NO: 56507 - DNA, 18 bp, Artificial Sequence
  Synthetic DNA
tgatgcgccccactagcg

SEQ ID NO: 56508 - DNA, 18 bp, Artificial Sequence
  Synthetic DNA
ttaaaagacacactttgg

SEQ ID NO: 56509 - DNA, 18 bp, Artificial Sequence
  Synthetic DNA
ttaaaggactaactaggg

SEQ ID NO: 56510 - DNA, 18 bp, Artificial Sequence
  Synthetic DNA
ttaatcgactcactttcg

SEQ ID NO: 56511 - DNA, 18 bp, Artificial Sequence
  Synthetic DNA
ttaatcgtctctctatag

SEQ ID NO: 56512 - DNA, 18 bp, Artificial Sequence
  Synthetic DNA
ttatacacctctatatag

SEQ ID NO: 56513 - DNA, 18 bp, Artificial Sequence
  Synthetic DNA
ttatacagctctctattg

SEQ ID NO: 56514 - DNA, 18 bp, Artificial Sequence
  Synthetic DNA
ttataccattccttatag

SEQ ID NO: 56515 - DNA, 18 bp, Artificial Sequence
  Synthetic DNA
ttatacgacaccctcatg

SEQ ID NO: 56516 - DNA, 18 bp, Artificial Sequence
  Synthetic DNA
ttatacttctgactttag

SEQ ID NO: 56517 - DNA, 18 bp, Artificial Sequence
  Synthetic DNA
ttataggactatctattg

SEQ ID NO: 56518 - DNA, 18 bp, Artificial Sequence
  Synthetic DNA
ttatatgccccccaatag

SEQ ID NO: 56519 - DNA, 18 bp, Artificial Sequence
  Synthetic DNA
ttatatgcgactctttag

SEQ ID NO: 56520 - DNA, 18 bp, Artificial Sequence
  Synthetic DNA
ttattaaactaattctag

SEQ ID NO: 56521 - DNA, 18 bp, Artificial Sequence
  Synthetic DNA
ttccacgttttaccatag

SEQ ID NO: 56522 - DNA, 18 bp, Artificial Sequence
  Synthetic DNA
tttaatgccataccatag

SEQ ID NO: 56523 - DNA, 18 bp, Artificial Sequence
  Synthetic DNA
tttgacgactctgtaatg

SEQ ID NO: 56524 - DNA, 18 bp, Artificial Sequence
  Synthetic DNA
ttttacatttctctttag

SEQ ID NO: 56525 - DNA, 18 bp, Artificial Sequence
  Synthetic DNA
ttttacgcctaacacttg

SEQ ID NO: 56526 - DNA, 18 bp, Artificial Sequence
  Synthetic DNA
aactaggacacactcaag

SEQ ID NO: 56527 - DNA, 18 bp, Artificial Sequence
  Synthetic DNA
taattcagctcactactg

SEQ ID NO: 56528 - DNA, 18 bp, Artificial Sequence
  Synthetic DNA
tactcggtctaactgtag

SEQ ID NO: 56529 - DNA, 18 bp, Artificial Sequence
  Synthetic DNA
tcacgagactcaatgtag

SEQ ID NO: 56530 - DNA, 18 bp, Artificial Sequence
  Synthetic DNA
tcattagactaattatag

SEQ ID NO: 56531 - DNA, 18 bp, Artificial Sequence
  Synthetic DNA
ttattagactcactaatg

SEQ ID NO: 56532 - DNA, 18 bp, Artificial Sequence
  Synthetic DNA
taaatcgactctcgattg

SEQ ID NO: 56533 - DNA, 18 bp, Artificial Sequence
  Synthetic DNA
tattacgccacacttaag

SEQ ID NO: 56534 - DNA, 18 bp, Artificial Sequence
  Synthetic DNA
aggttcgtcttattgtag

SEQ ID NO: 56535 - DNA, 18 bp, Artificial Sequence
  Synthetic DNA
cataacgactcacggtag

SEQ ID NO: 56536 - DNA, 18 bp, Artificial Sequence
  Synthetic DNA
taatgcgtctttattttg

SEQ ID NO: 56537 - DNA, 18 bp, Artificial Sequence
  Synthetic DNA
tactccgaatcacgatcg

SEQ ID NO: 56538 - DNA, 18 bp, Artificial Sequence
  Synthetic DNA
tataacaactaactagtg

SEQ ID NO: 56539 - DNA, 18 bp, Artificial Sequence
  Synthetic DNA
tataattactaactatag

SEQ ID NO: 56540 - DNA, 18 bp, Artificial Sequence
  Synthetic DNA
tcataagactccctaacg

SEQ ID NO: 56541 - DNA, 18 bp, Artificial Sequence
  Synthetic DNA
aaaaacgactcacaaatg

SEQ ID NO: 56542 - DNA, 18 bp, Artificial Sequence
  Synthetic DNA
aaactccactagcaacag

SEQ ID NO: 56543 - DNA, 18 bp, Artificial Sequence
  Synthetic DNA
aaagacgagacattattg

SEQ ID NO: 56544 - DNA, 18 bp, Artificial Sequence
  Synthetic DNA
aaataatagtcaatattg

SEQ ID NO: 56545 - DNA, 18 bp, Artificial Sequence
  Synthetic DNA
aaatacaactcattaatg

SEQ ID NO: 56546 - DNA, 18 bp, Artificial Sequence
  Synthetic DNA
aaatacaattctctattg

SEQ ID NO: 56547 - DNA, 18 bp, Artificial Sequence
  Synthetic DNA
aaatacgattcacttcgg

SEQ ID NO: 56548 - DNA, 18 bp, Artificial Sequence
  Synthetic DNA
aaatacgtgtctcggcag

SEQ ID NO: 56549 - DNA, 18 bp, Artificial Sequence
  Synthetic DNA
aaccacgagtcacaattg

SEQ ID NO: 56550 - DNA, 18 bp, Artificial Sequence
  Synthetic DNA
aactacgactatctattg

SEQ ID NO: 56551 - DNA, 18 bp, Artificial Sequence
  Synthetic DNA
aacttcgtcacaccatag

SEQ ID NO: 56552 - DNA, 18 bp, Artificial Sequence
  Synthetic DNA
aagatcgactctctaaag

SEQ ID NO: 56553 - DNA, 18 bp, Artificial Sequence
  Synthetic DNA
aataacaactcactacag

SEQ ID NO: 56554 - DNA, 18 bp, Artificial Sequence
  Synthetic DNA
aataacgactctctttag

SEQ ID NO: 56555 - DNA, 18 bp, Artificial Sequence
  Synthetic DNA
aattacgccgcgatatag

SEQ ID NO: 56556 - DNA, 18 bp, Artificial Sequence
  Synthetic DNA
aattactaatcactaaag

SEQ ID NO: 56557 - DNA, 18 bp, Artificial Sequence
  Synthetic DNA
aattactgcgcactatag

SEQ ID NO: 56558 - DNA, 18 bp, Artificial Sequence
  Synthetic DNA
aattttgcatcgctaacg

SEQ ID NO: 56559 - DNA, 18 bp, Artificial Sequence
  Synthetic DNA
acatacgactaattttag

SEQ ID NO: 56560 - DNA, 18 bp, Artificial Sequence
  Synthetic DNA
agatacaagacattatag

SEQ ID NO: 56561 - DNA, 18 bp, Artificial Sequence
  Synthetic DNA
agatacgaacgacagttg

SEQ ID NO: 56562 - DNA, 18 bp, Artificial Sequence
  Synthetic DNA
agatgcgaattattatcg

SEQ ID NO: 56563 - DNA, 18 bp, Artificial Sequence
  Synthetic DNA
ataaaggacccactatag

SEQ ID NO: 56564 - DNA, 18 bp, Artificial Sequence
  Synthetic DNA
ataaatgacacactatag

SEQ ID NO: 56565 - DNA, 18 bp, Artificial Sequence
  Synthetic DNA
atatacaattcacaatcg

SEQ ID NO: 56566 - DNA, 18 bp, Artificial Sequence
  Synthetic DNA
atataccacactctatag

SEQ ID NO: 56567 - DNA, 18 bp, Artificial Sequence
  Synthetic DNA
atatacgactatatatag

SEQ ID NO: 56568 - DNA, 18 bp, Artificial Sequence
  Synthetic DNA
atatacttcacactatag

SEQ ID NO: 56569 - DNA, 18 bp, Artificial Sequence
  Synthetic DNA
atatacttctcacttttg

SEQ ID NO: 56570 - DNA, 18 bp, Artificial Sequence
  Synthetic DNA
atattcgtctgtctatag

SEQ ID NO: 56571 - DNA, 18 bp, Artificial Sequence
  Synthetic DNA
atgatttatgctctaaag

SEQ ID NO: 56572 - DNA, 18 bp, Artificial Sequence
  Synthetic DNA
atttacgactcattaaag

SEQ ID NO: 56573 - DNA, 18 bp, Artificial Sequence
  Synthetic DNA
caaaactcccctccatag

SEQ ID NO: 56574 - DNA, 18 bp, Artificial Sequence
  Synthetic DNA
caaaatgactaatcattg

SEQ ID NO: 56575 - DNA, 18 bp, Artificial Sequence
  Synthetic DNA
caataagacccagcatag

SEQ ID NO: 56576 - DNA, 18 bp, Artificial Sequence
  Synthetic DNA
caatacatctcacttttg

SEQ ID NO: 56577 - DNA, 18 bp, Artificial Sequence
  Synthetic DNA
caatacgattcactgatg

SEQ ID NO: 56578 - DNA, 18 bp, Artificial Sequence
  Synthetic DNA
caatatgactcattaagg

SEQ ID NO: 56579 - DNA, 18 bp, Artificial Sequence
  Synthetic DNA
caatccgacccacttaag

SEQ ID NO: 56580 - DNA, 18 bp, Artificial Sequence
  Synthetic DNA
caatttctcttattctag

SEQ ID NO: 56581 - DNA, 18 bp, Artificial Sequence
  Synthetic DNA
cagtatggctcacaatag

SEQ ID NO: 56582 - DNA, 18 bp, Artificial Sequence
  Synthetic DNA
cattacttcacacaatgg

SEQ ID NO: 56583 - DNA, 18 bp, Artificial Sequence
  Synthetic DNA
cgatacgattcacaagtg

SEQ ID NO: 56584 - DNA, 18 bp, Artificial Sequence
  Synthetic DNA
ctacacgactctcaatcg

SEQ ID NO: 56585 - DNA, 18 bp, Artificial Sequence
  Synthetic DNA
ctacttggcatactatag

SEQ ID NO: 56586 - DNA, 18 bp, Artificial Sequence
  Synthetic DNA
ctataagactcacaattg

SEQ ID NO: 56587 - DNA, 18 bp, Artificial Sequence
  Synthetic DNA
ctatccgtttcacttttg

SEQ ID NO: 56588 - DNA, 18 bp, Artificial Sequence
  Synthetic DNA
ctggatgagtcactatag

SEQ ID NO: 56589 - DNA, 18 bp, Artificial Sequence
  Synthetic DNA
gactatgacccaccatag

SEQ ID NO: 56590 - DNA, 18 bp, Artificial Sequence
  Synthetic DNA
gattcagaaaaactatag

SEQ ID NO: 56591 - DNA, 18 bp, Artificial Sequence
  Synthetic DNA
gtatacgactgtccatag

SEQ ID NO: 56592 - DNA, 18 bp, Artificial Sequence
  Synthetic DNA
gtcttcgattaacagtgg

SEQ ID NO: 56593 - DNA, 18 bp, Artificial Sequence
  Synthetic DNA
taaaaagccacattatag

SEQ ID NO: 56594 - DNA, 18 bp, Artificial Sequence
  Synthetic DNA
taaaacgatgcacttaag

SEQ ID NO: 56595 - DNA, 18 bp, Artificial Sequence
  Synthetic DNA
taaaacgtttgacttatg

SEQ ID NO: 56596 - DNA, 18 bp, Artificial Sequence
  Synthetic DNA
taaaactttctactatag

SEQ ID NO: 56597 - DNA, 18 bp, Artificial Sequence
  Synthetic DNA
taaacagagtcactcatg

SEQ ID NO: 56598 - DNA, 18 bp, Artificial Sequence
  Synthetic DNA
taaatccactcgctattg

SEQ ID NO: 56599 - DNA, 18 bp, Artificial Sequence
  Synthetic DNA
taaatcctctcattatag

SEQ ID NO: 56600 - DNA, 18 bp, Artificial Sequence
  Synthetic DNA
taaatcgaccatctactg

SEQ ID NO: 56601 - DNA, 18 bp, Artificial Sequence
  Synthetic DNA
taaatcgtctcacaaaag

SEQ ID NO: 56602 - DNA, 18 bp, Artificial Sequence
  Synthetic DNA
taaattcattcattttcg

SEQ ID NO: 56603 - DNA, 18 bp, Artificial Sequence
  Synthetic DNA
taaattgactcaccctag

SEQ ID NO: 56604 - DNA, 18 bp, Artificial Sequence
  Synthetic DNA
taacacaaatcgttttag

SEQ ID NO: 56605 - DNA, 18 bp, Artificial Sequence
  Synthetic DNA
taacactacgcagtcttg

SEQ ID NO: 56606 - DNA, 18 bp, Artificial Sequence
  Synthetic DNA
taagagcattcaatatag

SEQ ID NO: 56607 - DNA, 18 bp, Artificial Sequence
  Synthetic DNA
taatacgactacttccag

SEQ ID NO: 56608 - DNA, 18 bp, Artificial Sequence
  Synthetic DNA
taatacgacttcactata

SEQ ID NO: 56609 - DNA, 18 bp, Artificial Sequence
  Synthetic DNA
taatacgatacaataagg

SEQ ID NO: 56610 - DNA, 18 bp, Artificial Sequence
  Synthetic DNA
taatacggctatttaaag

SEQ ID NO: 56611 - DNA, 18 bp, Artificial Sequence
  Synthetic DNA
taatacgtcagacaatgg

SEQ ID NO: 56612 - DNA, 18 bp, Artificial Sequence
  Synthetic DNA
taatacgtctttgtagcg

SEQ ID NO: 56613 - DNA, 18 bp, Artificial Sequence
  Synthetic DNA
taatactactaacagaag

SEQ ID NO: 56614 - DNA, 18 bp, Artificial Sequence
  Synthetic DNA
taatacttctttctttag

SEQ ID NO: 56615 - DNA, 18 bp, Artificial Sequence
  Synthetic DNA
taataggactgcccctag

SEQ ID NO: 56616 - DNA, 18 bp, Artificial Sequence
  Synthetic DNA
taatagtattctcttttg

SEQ ID NO: 56617 - DNA, 18 bp, Artificial Sequence
  Synthetic DNA
taatcagatactctatag

SEQ ID NO: 56618 - DNA, 18 bp, Artificial Sequence
  Synthetic DNA
taatgcgagcttgcatgg

SEQ ID NO: 56619 - DNA, 18 bp, Artificial Sequence
  Synthetic DNA
taatgctactcaaatagg

SEQ ID NO: 56620 - DNA, 18 bp, Artificial Sequence
  Synthetic DNA
taatgtaattacctatag

SEQ ID NO: 56621 - DNA, 18 bp, Artificial Sequence
  Synthetic DNA
taattcgtcactccatcg

SEQ ID NO: 56622 - DNA, 18 bp, Artificial Sequence
  Synthetic DNA
taattcgtccttctatag

SEQ ID NO: 56623 - DNA, 18 bp, Artificial Sequence
  Synthetic DNA
tacattgactaattatag

SEQ ID NO: 56624 - DNA, 18 bp, Artificial Sequence
  Synthetic DNA
tactacctttcattatcg

SEQ ID NO: 56625 - DNA, 18 bp, Artificial Sequence
  Synthetic DNA
tagagcgccacactttcg

SEQ ID NO: 56626 - DNA, 18 bp, Artificial Sequence
  Synthetic DNA
tagattgactcactttag

SEQ ID NO: 56627 - DNA, 18 bp, Artificial Sequence
  Synthetic DNA
tagcacaaattatttcag

SEQ ID NO: 56628 - DNA, 18 bp, Artificial Sequence
  Synthetic DNA
tagtccgtctcactgttg

SEQ ID NO: 56629 - DNA, 18 bp, Artificial Sequence
  Synthetic DNA
tatcacaagtcactaatg

SEQ ID NO: 56630 - DNA, 18 bp, Artificial Sequence
  Synthetic DNA
tatctcgaatcacaaaag

SEQ ID NO: 56631 - DNA, 18 bp, Artificial Sequence
  Synthetic DNA
tatgactactcacattag

SEQ ID NO: 56632 - DNA, 18 bp, Artificial Sequence
  Synthetic DNA
tattacaattcactaatg

SEQ ID NO: 56633 - DNA, 18 bp, Artificial Sequence
  Synthetic DNA
tattacgaaaaactaaag

SEQ ID NO: 56634 - DNA, 18 bp, Artificial Sequence
  Synthetic DNA
tattacgaccaactcaag

SEQ ID NO: 56635 - DNA, 18 bp, Artificial Sequence
  Synthetic DNA
tattacgactcttttgag

SEQ ID NO: 56636 - DNA, 18 bp, Artificial Sequence
  Synthetic DNA
tattacgactgtcaaaag

SEQ ID NO: 56637 - DNA, 18 bp, Artificial Sequence
  Synthetic DNA
tattacgatatactgatg

SEQ ID NO: 56638 - DNA, 18 bp, Artificial Sequence
  Synthetic DNA
tattatgcctctctattg

SEQ ID NO: 56639 - DNA, 18 bp, Artificial Sequence
  Synthetic DNA
tattccgactttcaattg

SEQ ID NO: 56640 - DNA, 18 bp, Artificial Sequence
  Synthetic DNA
tattgagacgggctgtag

SEQ ID NO: 56641 - DNA, 18 bp, Artificial Sequence
  Synthetic DNA
tattgcgacattctctag

SEQ ID NO: 56642 - DNA, 18 bp, Artificial Sequence
  Synthetic DNA
tatttagagtcagtatag

SEQ ID NO: 56643 - DNA, 18 bp, Artificial Sequence
  Synthetic DNA
tcaaactaccctctacgg

SEQ ID NO: 56644 - DNA, 18 bp, Artificial Sequence
  Synthetic DNA
tcacacgagtcatcatag

SEQ ID NO: 56645 - DNA, 18 bp, Artificial Sequence
  Synthetic DNA
tcatacatctcatcatag

SEQ ID NO: 56646 - DNA, 18 bp, Artificial Sequence
  Synthetic DNA
tgaaacgactcgccatgg

SEQ ID NO: 56647 - DNA, 18 bp, Artificial Sequence
  Synthetic DNA
tgatactaaatactattg

SEQ ID NO: 56648 - DNA, 18 bp, Artificial Sequence
  Synthetic DNA
tgatatgaatacctatag

SEQ ID NO: 56649 - DNA, 18 bp, Artificial Sequence
  Synthetic DNA
ttaaacgacactcttttg

SEQ ID NO: 56650 - DNA, 18 bp, Artificial Sequence
  Synthetic DNA
ttaaacgtcaatctatag

SEQ ID NO: 56651 - DNA, 18 bp, Artificial Sequence
  Synthetic DNA
ttaaactcgtcactgtag

SEQ ID NO: 56652 - DNA, 18 bp, Artificial Sequence
  Synthetic DNA
ttacatcacacactatag

SEQ ID NO: 56653 - DNA, 18 bp, Artificial Sequence
  Synthetic DNA
ttacatgactaattatag

SEQ ID NO: 56654 - DNA, 18 bp, Artificial Sequence
  Synthetic DNA
ttataacactcacaatcg

SEQ ID NO: 56655 - DNA, 18 bp, Artificial Sequence
  Synthetic DNA
ttatacgacacagattag

SEQ ID NO: 56656 - DNA, 18 bp, Artificial Sequence
  Synthetic DNA
ttatacggctcccattgg

SEQ ID NO: 56657 - DNA, 18 bp, Artificial Sequence
  Synthetic DNA
ttatacgtctccatacag

SEQ ID NO: 56658 - DNA, 18 bp, Artificial Sequence
  Synthetic DNA
ttatactccactccatag

SEQ ID NO: 56659 - DNA, 18 bp, Artificial Sequence
  Synthetic DNA
ttatcctactctcaatag

SEQ ID NO: 56660 - DNA, 18 bp, Artificial Sequence
  Synthetic DNA
ttatgcgacttactaatg

SEQ ID NO: 56661 - DNA, 18 bp, Artificial Sequence
  Synthetic DNA
ttccacaacactctattg

SEQ ID NO: 56662 - DNA, 18 bp, Artificial Sequence
  Synthetic DNA
ttctaccagaaactatag

SEQ ID NO: 56663 - DNA, 18 bp, Artificial Sequence
  Synthetic DNA
ttctacgacttagtatcg

SEQ ID NO: 56664 - DNA, 18 bp, Artificial Sequence
  Synthetic DNA
ttgtaagtcccagtttag

SEQ ID NO: 56665 - DNA, 18 bp, Artificial Sequence
  Synthetic DNA
tttccggattcacaatag

SEQ ID NO: 56666 - DNA, 18 bp, Artificial Sequence
  Synthetic DNA
aaaaaagattcactaatg

SEQ ID NO: 56667 - DNA, 18 bp, Artificial Sequence
  Synthetic DNA
aaaaacaacttattatag

SEQ ID NO: 56668 - DNA, 18 bp, Artificial Sequence
  Synthetic DNA
aaaaacaattcactctag

SEQ ID NO: 56669 - DNA, 18 bp, Artificial Sequence
  Synthetic DNA
aaaaaccacagcttatag

SEQ ID NO: 56670 - DNA, 18 bp, Artificial Sequence
  Synthetic DNA
aaaaaccactaacaaaag

SEQ ID NO: 56671 - DNA, 18 bp, Artificial Sequence
  Synthetic DNA
aaaaaccccaggctttag

SEQ ID NO: 56672 - DNA, 18 bp, Artificial Sequence
  Synthetic DNA
aaaaacccctgtcttttg

SEQ ID NO: 56673 - DNA, 18 bp, Artificial Sequence
  Synthetic DNA
aaaaacgacactctttag

SEQ ID NO: 56674 - DNA, 18 bp, Artificial Sequence
  Synthetic DNA
aaaaacgacccattttag

SEQ ID NO: 56675 - DNA, 18 bp, Artificial Sequence
  Synthetic DNA
aaaaacgagtcacactag

SEQ ID NO: 56676 - DNA, 18 bp, Artificial Sequence
  Synthetic DNA
aaaaacgattcacaacag

SEQ ID NO: 56677 - DNA, 18 bp, Artificial Sequence
  Synthetic DNA
aaaaacgatttactattg

SEQ ID NO: 56678 - DNA, 18 bp, Artificial Sequence
  Synthetic DNA
aaaaacggcgaaatattg

SEQ ID NO: 56679 - DNA, 18 bp, Artificial Sequence
  Synthetic DNA
aaaaacggctcactcttg

SEQ ID NO: 56680 - DNA, 18 bp, Artificial Sequence
  Synthetic DNA
aaaaacgtctttctaacg

SEQ ID NO: 56681 - DNA, 18 bp, Artificial Sequence
  Synthetic DNA
aaaaactactcacaatgg

SEQ ID NO: 56682 - DNA, 18 bp, Artificial Sequence
  Synthetic DNA
aaaaactactcacaattg

SEQ ID NO: 56683 - DNA, 18 bp, Artificial Sequence
  Synthetic DNA
aaaaactgctcactttag

SEQ ID NO: 56684 - DNA, 18 bp, Artificial Sequence
  Synthetic DNA
aaaaactgctttctatag

SEQ ID NO: 56685 - DNA, 18 bp, Artificial Sequence
  Synthetic DNA
aaaaacttctcactatta

SEQ ID NO: 56686 - DNA, 18 bp, Artificial Sequence
  Synthetic DNA
aaaaagaactcactttag

SEQ ID NO: 56687 - DNA, 18 bp, Artificial Sequence
  Synthetic DNA
aaaaaggagtcactagag

SEQ ID NO: 56688 - DNA, 18 bp, Artificial Sequence
  Synthetic DNA
aaaaatatctcattatag

SEQ ID NO: 56689 - DNA, 18 bp, Artificial Sequence
  Synthetic DNA
aaaaatttctcactatag

SEQ ID NO: 56690 - DNA, 18 bp, Artificial Sequence
  Synthetic DNA
aaaacagactcacgatag

SEQ ID NO: 56691 - DNA, 18 bp, Artificial Sequence
  Synthetic DNA
aaaatcaactctcgactg

SEQ ID NO: 56692 - DNA, 18 bp, Artificial Sequence
  Synthetic DNA
aaaatcatctctttattg

SEQ ID NO: 56693 - DNA, 18 bp, Artificial Sequence
  Synthetic DNA
aaaatcgacacaatatag

SEQ ID NO: 56694 - DNA, 18 bp, Artificial Sequence
  Synthetic DNA
aaaatcgacatacgaaag

SEQ ID NO: 56695 - DNA, 18 bp, Artificial Sequence
  Synthetic DNA
aaaatcgacccactctgg

SEQ ID NO: 56696 - DNA, 18 bp, Artificial Sequence
  Synthetic DNA
aaaatcgagccactttag

SEQ ID NO: 56697 - DNA, 18 bp, Artificial Sequence
  Synthetic DNA
aaaatcgatctacaaacg

SEQ ID NO: 56698 - DNA, 18 bp, Artificial Sequence
  Synthetic DNA
aaaatcgtcctactatag

SEQ ID NO: 56699 - DNA, 18 bp, Artificial Sequence
  Synthetic DNA
aaacacgaataacaatgg

SEQ ID NO: 56700 - DNA, 18 bp, Artificial Sequence
  Synthetic DNA
aaacacgacaaactttag

SEQ ID NO: 56701 - DNA, 18 bp, Artificial Sequence
  Synthetic DNA
aaacacgactccccaatg

SEQ ID NO: 56702 - DNA, 18 bp, Artificial Sequence
  Synthetic DNA
aaacacgactccctacgg

SEQ ID NO: 56703 - DNA, 18 bp, Artificial Sequence
  Synthetic DNA
aaacacgagtcatttgag

SEQ ID NO: 56704 - DNA, 18 bp, Artificial Sequence
  Synthetic DNA
aaacacgattctcaatag

SEQ ID NO: 56705 - DNA, 18 bp, Artificial Sequence
  Synthetic DNA
aaacacggatcacagtag

SEQ ID NO: 56706 - DNA, 18 bp, Artificial Sequence
  Synthetic DNA
aaacactactcgcttttg

SEQ ID NO: 56707 - DNA, 18 bp, Artificial Sequence
  Synthetic DNA
aaacactattgtctttag

SEQ ID NO: 56708 - DNA, 18 bp, Artificial Sequence
  Synthetic DNA
aaactccactcattctag

SEQ ID NO: 56709 - DNA, 18 bp, Artificial Sequence
  Synthetic DNA
aaagaagactcattatcg

SEQ ID NO: 56710 - DNA, 18 bp, Artificial Sequence
  Synthetic DNA
aaagaatactaactatag

SEQ ID NO: 56711 - DNA, 18 bp, Artificial Sequence
  Synthetic DNA
aaagacggctcacgagag

SEQ ID NO: 56712 - DNA, 18 bp, Artificial Sequence
  Synthetic DNA
aaagattactgacactag

SEQ ID NO: 56713 - DNA, 18 bp, Artificial Sequence
  Synthetic DNA
aaaggcgactcgctattg

SEQ ID NO: 56714 - DNA, 18 bp, Artificial Sequence
  Synthetic DNA
aaagtctacccactatag

SEQ ID NO: 56715 - DNA, 18 bp, Artificial Sequence
  Synthetic DNA
aaataagaataaccaccg

SEQ ID NO: 56716 - DNA, 18 bp, Artificial Sequence
  Synthetic DNA
aaataagactcatttgtg

SEQ ID NO: 56717 - DNA, 18 bp, Artificial Sequence
  Synthetic DNA
aaataagactcttttttg

SEQ ID NO: 56718 - DNA, 18 bp, Artificial Sequence
  Synthetic DNA
aaataaggctcacattgg

SEQ ID NO: 56719 - DNA, 18 bp, Artificial Sequence
  Synthetic DNA
aaataagtctcattctag

SEQ ID NO: 56720 - DNA, 18 bp, Artificial Sequence
  Synthetic DNA
aaataagtcttacaatag

SEQ ID NO: 56721 - DNA, 18 bp, Artificial Sequence
  Synthetic DNA
aaataagttactgattag

SEQ ID NO: 56722 - DNA, 18 bp, Artificial Sequence
  Synthetic DNA
aaatacaaaactgtatag

SEQ ID NO: 56723 - DNA, 18 bp, Artificial Sequence
  Synthetic DNA
aaatacaacatactattg

SEQ ID NO: 56724 - DNA, 18 bp, Artificial Sequence
  Synthetic DNA
aaatacaactttgtaaag

SEQ ID NO: 56725 - DNA, 18 bp, Artificial Sequence
  Synthetic DNA
aaatacaatacacagtag

SEQ ID NO: 56726 - DNA, 18 bp, Artificial Sequence
  Synthetic DNA
aaatacaatttacaatag

SEQ ID NO: 56727 - DNA, 18 bp, Artificial Sequence
  Synthetic DNA
aaatacagtcaacaaatg

SEQ ID NO: 56728 - DNA, 18 bp, Artificial Sequence
  Synthetic DNA
aaatacatcacatattgg

SEQ ID NO: 56729 - DNA, 18 bp, Artificial Sequence
  Synthetic DNA
aaatacattacactattg

SEQ ID NO: 56730 - DNA, 18 bp, Artificial Sequence
  Synthetic DNA
aaataccactccctttcg

SEQ ID NO: 56731 - DNA, 18 bp, Artificial Sequence
  Synthetic DNA
aaataccactctcattag

SEQ ID NO: 56732 - DNA, 18 bp, Artificial Sequence
  Synthetic DNA
aaataccacttcatatag

SEQ ID NO: 56733 - DNA, 18 bp, Artificial Sequence
  Synthetic DNA
aaataccattcatcatag

SEQ ID NO: 56734 - DNA, 18 bp, Artificial Sequence
  Synthetic DNA
aaatacgaaccattatgg

SEQ ID NO: 56735 - DNA, 18 bp, Artificial Sequence
  Synthetic DNA
aaatacgaatcacatttg

SEQ ID NO: 56736 - DNA, 18 bp, Artificial Sequence
  Synthetic DNA
aaatacgacaaactaatg

SEQ ID NO: 56737 - DNA, 18 bp, Artificial Sequence
  Synthetic DNA
aaatacgacacactgacg

SEQ ID NO: 56738 - DNA, 18 bp, Artificial Sequence
  Synthetic DNA
aaatacgacactgacaag

SEQ ID NO: 56739 - DNA, 18 bp, Artificial Sequence
  Synthetic DNA
aaatacgacatggtttag

SEQ ID NO: 56740 - DNA, 18 bp, Artificial Sequence
  Synthetic DNA
aaatacgactatctgtcg

SEQ ID NO: 56741 - DNA, 18 bp, Artificial Sequence
  Synthetic DNA
aaatacgactctcctaag

SEQ ID NO: 56742 - DNA, 18 bp, Artificial Sequence
  Synthetic DNA
aaatacgactcttaaaag

SEQ ID NO: 56743 - DNA, 18 bp, Artificial Sequence
  Synthetic DNA
aaatacgactggatattg

SEQ ID NO: 56744 - DNA, 18 bp, Artificial Sequence
  Synthetic DNA
aaatacgacttagtgaag

SEQ ID NO: 56745 - DNA, 18 bp, Artificial Sequence
  Synthetic DNA
aaatacgagaatctatag

SEQ ID NO: 56746 - DNA, 18 bp, Artificial Sequence
  Synthetic DNA
aaatacgagttccaatcg

SEQ ID NO: 56747 - DNA, 18 bp, Artificial Sequence
  Synthetic DNA
aaatacgatccactaggg

SEQ ID NO: 56748 - DNA, 18 bp, Artificial Sequence
  Synthetic DNA
aaatacgattcggtgatg

SEQ ID NO: 56749 - DNA, 18 bp, Artificial Sequence
  Synthetic DNA
aaatacgattcttcactg

SEQ ID NO: 56750 - DNA, 18 bp, Artificial Sequence
  Synthetic DNA
aaatacgccctactcagg

SEQ ID NO: 56751 - DNA, 18 bp, Artificial Sequence
  Synthetic DNA
aaatacgccgctgtattg

SEQ ID NO: 56752 - DNA, 18 bp, Artificial Sequence
  Synthetic DNA
aaatacgcgtcacatttg

SEQ ID NO: 56753 - DNA, 18 bp, Artificial Sequence
  Synthetic DNA
aaatacgcttaataatag

SEQ ID NO: 56754 - DNA, 18 bp, Artificial Sequence
  Synthetic DNA
aaatacgcttttctatag

SEQ ID NO: 56755 - DNA, 18 bp, Artificial Sequence
  Synthetic DNA
aaatacggttcaccattg

SEQ ID NO: 56756 - DNA, 18 bp, Artificial Sequence
  Synthetic DNA
aaatacgtatatcttcag

SEQ ID NO: 56757 - DNA, 18 bp, Artificial Sequence
  Synthetic DNA
aaatacgtatggctacag

SEQ ID NO: 56758 - DNA, 18 bp, Artificial Sequence
  Synthetic DNA
aaatacgtcaatctatag

SEQ ID NO: 56759 - DNA, 18 bp, Artificial Sequence
  Synthetic DNA
aaatacgtcacaccacag

SEQ ID NO: 56760 - DNA, 18 bp, Artificial Sequence
  Synthetic DNA
aaatacgtcatacacttg

SEQ ID NO: 56761 - DNA, 18 bp, Artificial Sequence
  Synthetic DNA
aaatacgtcccattatta

SEQ ID NO: 56762 - DNA, 18 bp, Artificial Sequence
  Synthetic DNA
aaatacgtctcaattcag

SEQ ID NO: 56763 - DNA, 18 bp, Artificial Sequence
  Synthetic DNA
aaatacgtctgcctacag

SEQ ID NO: 56764 - DNA, 18 bp, Artificial Sequence
  Synthetic DNA
aaatacgtgtcacctttg

SEQ ID NO: 56765 - DNA, 18 bp, Artificial Sequence
  Synthetic DNA
aaatacgtttcaactgag

SEQ ID NO: 56766 - DNA, 18 bp, Artificial Sequence
  Synthetic DNA
aaatacgtttctctgtag

SEQ ID NO: 56767 - DNA, 18 bp, Artificial Sequence
  Synthetic DNA
aaatactacaacaaatag

SEQ ID NO: 56768 - DNA, 18 bp, Artificial Sequence
  Synthetic DNA
aaatactacacatttaag

SEQ ID NO: 56769 - DNA, 18 bp, Artificial Sequence
  Synthetic DNA
aaatactacattttaaag

SEQ ID NO: 56770 - DNA, 18 bp, Artificial Sequence
  Synthetic DNA
aaatactacccaataaag

SEQ ID NO: 56771 - DNA, 18 bp, Artificial Sequence
  Synthetic DNA
aaatactactacaatttg

SEQ ID NO: 56772 - DNA, 18 bp, Artificial Sequence
  Synthetic DNA
aaatactactatcattcg

SEQ ID NO: 56773 - DNA, 18 bp, Artificial Sequence
  Synthetic DNA
aaatactactctgtttag

SEQ ID NO: 56774 - DNA, 18 bp, Artificial Sequence
  Synthetic DNA
aaatactagtcgttatag

SEQ ID NO: 56775 - DNA, 18 bp, Artificial Sequence
  Synthetic DNA
aaatactattcgcaatag

SEQ ID NO: 56776 - DNA, 18 bp, Artificial Sequence
  Synthetic DNA
aaatactgttccctatag

SEQ ID NO: 56777 - DNA, 18 bp, Artificial Sequence
  Synthetic DNA
aaatactgttctctattg

SEQ ID NO: 56778 - DNA, 18 bp, Artificial Sequence
  Synthetic DNA
aaatacttcttacaattg

SEQ ID NO: 56779 - DNA, 18 bp, Artificial Sequence
  Synthetic DNA
aaatagcaatccctatag

SEQ ID NO: 56780 - DNA, 18 bp, Artificial Sequence
  Synthetic DNA
aaataggagtcacttacg

SEQ ID NO: 56781 - DNA, 18 bp, Artificial Sequence
  Synthetic DNA
aaataggattctgtatag

SEQ ID NO: 56782 - DNA, 18 bp, Artificial Sequence
  Synthetic DNA
aaataggcctcgccttag

SEQ ID NO: 56783 - DNA, 18 bp, Artificial Sequence
  Synthetic DNA
aaatatgaccttgtattg

SEQ ID NO: 56784 - DNA, 18 bp, Artificial Sequence
  Synthetic DNA
aaatatgacgcacgattg

SEQ ID NO: 56785 - DNA, 18 bp, Artificial Sequence
  Synthetic DNA
aaatatgactaaaaaaag

SEQ ID NO: 56786 - DNA, 18 bp, Artificial Sequence
  Synthetic DNA
aaatatgccaaactatgg

SEQ ID NO: 56787 - DNA, 18 bp, Artificial Sequence
  Synthetic DNA
aaatatgttatacttatg

SEQ ID NO: 56788 - DNA, 18 bp, Artificial Sequence
  Synthetic DNA
aaatattaatcactaagg

SEQ ID NO: 56789 - DNA, 18 bp, Artificial Sequence
  Synthetic DNA
aaatattactcagttttg

SEQ ID NO: 56790 - DNA, 18 bp, Artificial Sequence
  Synthetic DNA
aaatattgctcgctatag

SEQ ID NO: 56791 - DNA, 18 bp, Artificial Sequence
  Synthetic DNA
aaatcacattcattatag

SEQ ID NO: 56792 - DNA, 18 bp, Artificial Sequence
  Synthetic DNA
aaatccaacctactatag

SEQ ID NO: 56793 - DNA, 18 bp, Artificial Sequence
  Synthetic DNA
aaatccaactaactttag

SEQ ID NO: 56794 - DNA, 18 bp, Artificial Sequence
  Synthetic DNA
aaatccaactctatattg

SEQ ID NO: 56795 - DNA, 18 bp, Artificial Sequence
  Synthetic DNA
aaatccagctcagttaag

SEQ ID NO: 56796 - DNA, 18 bp, Artificial Sequence
  Synthetic DNA
aaatccatctctctatag

SEQ ID NO: 56797 - DNA, 18 bp, Artificial Sequence
  Synthetic DNA
aaatccctaacactaaag

SEQ ID NO: 56798 - DNA, 18 bp, Artificial Sequence
  Synthetic DNA
aaatccgacactccatag

SEQ ID NO: 56799 - DNA, 18 bp, Artificial Sequence
  Synthetic DNA
aaatccgactgtcaagag

SEQ ID NO: 56800 - DNA, 18 bp, Artificial Sequence
  Synthetic DNA
aaatccgattcacgttag

SEQ ID NO: 56801 - DNA, 18 bp, Artificial Sequence
  Synthetic DNA
aaatcctacacgctatag

SEQ ID NO: 56802 - DNA, 18 bp, Artificial Sequence
  Synthetic DNA
aaatcctactccctttag

SEQ ID NO: 56803 - DNA, 18 bp, Artificial Sequence
  Synthetic DNA
aaatcctacttggtaaag

SEQ ID NO: 56804 - DNA, 18 bp, Artificial Sequence
  Synthetic DNA
aaatccttcacactaggg

SEQ ID NO: 56805 - DNA, 18 bp, Artificial Sequence
  Synthetic DNA
aaatccttcttacttttg

SEQ ID NO: 56806 - DNA, 18 bp, Artificial Sequence
  Synthetic DNA
aaatctgactcaccatgg

SEQ ID NO: 56807 - DNA, 18 bp, Artificial Sequence
  Synthetic DNA
aaatgagactcacttgag

SEQ ID NO: 56808 - DNA, 18 bp, Artificial Sequence
  Synthetic DNA
aaatgagtctcacaaaag

SEQ ID NO: 56809 - DNA, 18 bp, Artificial Sequence
  Synthetic DNA
aaatgcatctctctatag

SEQ ID NO: 56810 - DNA, 18 bp, Artificial Sequence
  Synthetic DNA
aaatgcgaatcatttttg

SEQ ID NO: 56811 - DNA, 18 bp, Artificial Sequence
  Synthetic DNA
aaatgcgacaccctaaag

SEQ ID NO: 56812 - DNA, 18 bp, Artificial Sequence
  Synthetic DNA
aaatgcgactctatctag

SEQ ID NO: 56813 - DNA, 18 bp, Artificial Sequence
  Synthetic DNA
aaatgcgatctacattag

SEQ ID NO: 56814 - DNA, 18 bp, Artificial Sequence
  Synthetic DNA
aaatgcggtacactgtag

SEQ ID NO: 56815 - DNA, 18 bp, Artificial Sequence
  Synthetic DNA
aaatgtgagacacaatag

SEQ ID NO: 56816 - DNA, 18 bp, Artificial Sequence
  Synthetic DNA
aaattaaactaaccatag

SEQ ID NO: 56817 - DNA, 18 bp, Artificial Sequence
  Synthetic DNA
aaattaatctcactacag

SEQ ID NO: 56818 - DNA, 18 bp, Artificial Sequence
  Synthetic DNA
aaattagaatcaccatag

SEQ ID NO: 56819 - DNA, 18 bp, Artificial Sequence
  Synthetic DNA
aaattagacacaatgtcg

SEQ ID NO: 56820 - DNA, 18 bp, Artificial Sequence
  Synthetic DNA
aaattcaactcacatgag

SEQ ID NO: 56821 - DNA, 18 bp, Artificial Sequence
  Synthetic DNA
aaattcaacttactaaag

SEQ ID NO: 56822 - DNA, 18 bp, Artificial Sequence
  Synthetic DNA
aaattcaatccattatag

SEQ ID NO: 56823 - DNA, 18 bp, Artificial Sequence
  Synthetic DNA
aaattcaggtcactatag

SEQ ID NO: 56824 - DNA, 18 bp, Artificial Sequence
  Synthetic DNA
aaattcgacaccctttag

SEQ ID NO: 56825 - DNA, 18 bp, Artificial Sequence
  Synthetic DNA
aaattcgacactcaatag

SEQ ID NO: 56826 - DNA, 18 bp, Artificial Sequence
  Synthetic DNA
aaattcgagtcacaaaag

SEQ ID NO: 56827 - DNA, 18 bp, Artificial Sequence
  Synthetic DNA
aaattcgattcaaaaaag

SEQ ID NO: 56828 - DNA, 18 bp, Artificial Sequence
  Synthetic DNA
aaattcgccttagtatgg

SEQ ID NO: 56829 - DNA, 18 bp, Artificial Sequence
  Synthetic DNA
aaattcggatcaataaag

SEQ ID NO: 56830 - DNA, 18 bp, Artificial Sequence
  Synthetic DNA
aaattcggatcactagag

SEQ ID NO: 56831 - DNA, 18 bp, Artificial Sequence
  Synthetic DNA
aaattcggctatctacag

SEQ ID NO: 56832 - DNA, 18 bp, Artificial Sequence
  Synthetic DNA
aaattcgtataaagtttg

SEQ ID NO: 56833 - DNA, 18 bp, Artificial Sequence
  Synthetic DNA
aaattcgtatctctatag

SEQ ID NO: 56834 - DNA, 18 bp, Artificial Sequence
  Synthetic DNA
aaattcgtctaattaaag

SEQ ID NO: 56835 - DNA, 18 bp, Artificial Sequence
  Synthetic DNA
aaattcgtctcattacag

SEQ ID NO: 56836 - DNA, 18 bp, Artificial Sequence
  Synthetic DNA
aaattcgtctcattagag

SEQ ID NO: 56837 - DNA, 18 bp, Artificial Sequence
  Synthetic DNA
aaattcgtctctatatag

SEQ ID NO: 56838 - DNA, 18 bp, Artificial Sequence
  Synthetic DNA
aaattcgtctctccaaag

SEQ ID NO: 56839 - DNA, 18 bp, Artificial Sequence
  Synthetic DNA
aaattctactcacgattg

SEQ ID NO: 56840 - DNA, 18 bp, Artificial Sequence
  Synthetic DNA
aaattctactcgctttag

SEQ ID NO: 56841 - DNA, 18 bp, Artificial Sequence
  Synthetic DNA
aaattctactctccacag

SEQ ID NO: 56842 - DNA, 18 bp, Artificial Sequence
  Synthetic DNA
aaattctccaaactatag

SEQ ID NO: 56843 - DNA, 18 bp, Artificial Sequence
  Synthetic DNA
aaatttaacacaccatag

SEQ ID NO: 56844 - DNA, 18 bp, Artificial Sequence
  Synthetic DNA
aaatttcactcaccatcg

SEQ ID NO: 56845 - DNA, 18 bp, Artificial Sequence
  Synthetic DNA
aacaaagacccactatag

SEQ ID NO: 56846 - DNA, 18 bp, Artificial Sequence
  Synthetic DNA
aacaacaacttactaaag

SEQ ID NO: 56847 - DNA, 18 bp, Artificial Sequence
  Synthetic DNA
aacaacgactttgtatcg

SEQ ID NO: 56848 - DNA, 18 bp, Artificial Sequence
  Synthetic DNA
aacaatttgtcaaaacag

SEQ ID NO: 56849 - DNA, 18 bp, Artificial Sequence
  Synthetic DNA
aacaccgaatcactatag

SEQ ID NO: 56850 - DNA, 18 bp, Artificial Sequence
  Synthetic DNA
aacaccgaggcgctatag

SEQ ID NO: 56851 - DNA, 18 bp, Artificial Sequence
  Synthetic DNA
aactacaactatcaatag

SEQ ID NO: 56852 - DNA, 18 bp, Artificial Sequence
  Synthetic DNA
aactacgaattactattg

SEQ ID NO: 56853 - DNA, 18 bp, Artificial Sequence
  Synthetic DNA
aactacgactaacattag

SEQ ID NO: 56854 - DNA, 18 bp, Artificial Sequence
  Synthetic DNA
aactacgacttctaattg

SEQ ID NO: 56855 - DNA, 18 bp, Artificial Sequence
  Synthetic DNA
aactacggtccattatag

SEQ ID NO: 56856 - DNA, 18 bp, Artificial Sequence
  Synthetic DNA
aactacgtcaaactatag

SEQ ID NO: 56857 - DNA, 18 bp, Artificial Sequence
  Synthetic DNA
aactacgtctcacattag

SEQ ID NO: 56858 - DNA, 18 bp, Artificial Sequence
  Synthetic DNA
aactacgtctcactttcg

SEQ ID NO: 56859 - DNA, 18 bp, Artificial Sequence
  Synthetic DNA
aactacgtttctcataag

SEQ ID NO: 56860 - DNA, 18 bp, Artificial Sequence
  Synthetic DNA
aactacttcccactttag

SEQ ID NO: 56861 - DNA, 18 bp, Artificial Sequence
  Synthetic DNA
aactatcactctctctag

SEQ ID NO: 56862 - DNA, 18 bp, Artificial Sequence
  Synthetic DNA
aactatgactctctaatg

SEQ ID NO: 56863 - DNA, 18 bp, Artificial Sequence
  Synthetic DNA
aactcagactctctatag

SEQ ID NO: 56864 - DNA, 18 bp, Artificial Sequence
  Synthetic DNA
aacttctagtcaatttag

SEQ ID NO: 56865 - DNA, 18 bp, Artificial Sequence
  Synthetic DNA
aagaacgactcactgccg

SEQ ID NO: 56866 - DNA, 18 bp, Artificial Sequence
  Synthetic DNA
aagaactactcattatag

SEQ ID NO: 56867 - DNA, 18 bp, Artificial Sequence
  Synthetic DNA
aagagcgagtcactgaag

SEQ ID NO: 56868 - DNA, 18 bp, Artificial Sequence
  Synthetic DNA
aagatcgactctctatcg

SEQ ID NO: 56869 - DNA, 18 bp, Artificial Sequence
  Synthetic DNA
aagcatcacacactaccg

SEQ ID NO: 56870 - DNA, 18 bp, Artificial Sequence
  Synthetic DNA
aagtaactctatctatag

SEQ ID NO: 56871 - DNA, 18 bp, Artificial Sequence
  Synthetic DNA
aagtacaactcagtattg

SEQ ID NO: 56872 - DNA, 18 bp, Artificial Sequence
  Synthetic DNA
aagtacaacttaatattg

SEQ ID NO: 56873 - DNA, 18 bp, Artificial Sequence
  Synthetic DNA
aagtacgagccgttatag

SEQ ID NO: 56874 - DNA, 18 bp, Artificial Sequence
  Synthetic DNA
aagtacgtcttaatctgg

SEQ ID NO: 56875 - DNA, 18 bp, Artificial Sequence
  Synthetic DNA
aagtacgtttcgctatag

SEQ ID NO: 56876 - DNA, 18 bp, Artificial Sequence
  Synthetic DNA
aagtaggactctcactgg

SEQ ID NO: 56877 - DNA, 18 bp, Artificial Sequence
  Synthetic DNA
aagtatgtaagactatag

SEQ ID NO: 56878 - DNA, 18 bp, Artificial Sequence
  Synthetic DNA
aagtgcgaaacactgttg

SEQ ID NO: 56879 - DNA, 18 bp, Artificial Sequence
  Synthetic DNA
aagtgcgactcgcgatgg

SEQ ID NO: 56880 - DNA, 18 bp, Artificial Sequence
  Synthetic DNA
aagtgctacttacttggg

SEQ ID NO: 56881 - DNA, 18 bp, Artificial Sequence
  Synthetic DNA
aagttagactcactattg

SEQ ID NO: 56882 - DNA, 18 bp, Artificial Sequence
  Synthetic DNA
aagttccagtcactattg

SEQ ID NO: 56883 - DNA, 18 bp, Artificial Sequence
  Synthetic DNA
aagttctgctcacactag

SEQ ID NO: 56884 - DNA, 18 bp, Artificial Sequence
  Synthetic DNA
aagtttgactcccaaaag

SEQ ID NO: 56885 - DNA, 18 bp, Artificial Sequence
  Synthetic DNA
aataaacacttactatag

SEQ ID NO: 56886 - DNA, 18 bp, Artificial Sequence
  Synthetic DNA
aataaagagttactaaaa

SEQ ID NO: 56887 - DNA, 18 bp, Artificial Sequence
  Synthetic DNA
aataacaactcactgcag

SEQ ID NO: 56888 - DNA, 18 bp, Artificial Sequence
  Synthetic DNA
aataacaactcattttag

SEQ ID NO: 56889 - DNA, 18 bp, Artificial Sequence
  Synthetic DNA
aataacgactaactattg

SEQ ID NO: 56890 - DNA, 18 bp, Artificial Sequence
  Synthetic DNA
aataactgctcactatag

SEQ ID NO: 56891 - DNA, 18 bp, Artificial Sequence
  Synthetic DNA
aataagggttgactagtg

SEQ ID NO: 56892 - DNA, 18 bp, Artificial Sequence
  Synthetic DNA
aatagagactcactatag

SEQ ID NO: 56893 - DNA, 18 bp, Artificial Sequence
  Synthetic DNA
aatatcgcttcactttag

SEQ ID NO: 56894 - DNA, 18 bp, Artificial Sequence
  Synthetic DNA
aatcatgattcactatag

SEQ ID NO: 56895 - DNA, 18 bp, Artificial Sequence
  Synthetic DNA
aatctcctcttactatag

SEQ ID NO: 56896 - DNA, 18 bp, Artificial Sequence
  Synthetic DNA
aatctcgacactgtctag

SEQ ID NO: 56897 - DNA, 18 bp, Artificial Sequence
  Synthetic DNA
aatctcgactcaccattg

SEQ ID NO: 56898 - DNA, 18 bp, Artificial Sequence
  Synthetic DNA
aatgacgacccctgttag

SEQ ID NO: 56899 - DNA, 18 bp, Artificial Sequence
  Synthetic DNA
aatgtcgaatctctaaag

SEQ ID NO: 56900 - DNA, 18 bp, Artificial Sequence
  Synthetic DNA
aattaactctcactagtg

SEQ ID NO: 56901 - DNA, 18 bp, Artificial Sequence
  Synthetic DNA
aattaatacttgcaatag

SEQ ID NO: 56902 - DNA, 18 bp, Artificial Sequence
  Synthetic DNA
aattacaaccctctattg

SEQ ID NO: 56903 - DNA, 18 bp, Artificial Sequence
  Synthetic DNA
aattacaactcactcaag

SEQ ID NO: 56904 - DNA, 18 bp, Artificial Sequence
  Synthetic DNA
aattacaagtcaaaatag

SEQ ID NO: 56905 - DNA, 18 bp, Artificial Sequence
  Synthetic DNA
aattacgacaaattatag

SEQ ID NO: 56906 - DNA, 18 bp, Artificial Sequence
  Synthetic DNA
aattacgacacattatcg

SEQ ID NO: 56907 - DNA, 18 bp, Artificial Sequence
  Synthetic DNA
aattacgaccaactaaag

SEQ ID NO: 56908 - DNA, 18 bp, Artificial Sequence
  Synthetic DNA
aattacgactcaattgag

SEQ ID NO: 56909 - DNA, 18 bp, Artificial Sequence
  Synthetic DNA
aattacgactcatgctag

SEQ ID NO: 56910 - DNA, 18 bp, Artificial Sequence
  Synthetic DNA
aattacgactcattaccg

SEQ ID NO: 56911 - DNA, 18 bp, Artificial Sequence
  Synthetic DNA
aattacgactctttgaag

SEQ ID NO: 56912 - DNA, 18 bp, Artificial Sequence
  Synthetic DNA
aattacgacttacattag

SEQ ID NO: 56913 - DNA, 18 bp, Artificial Sequence
  Synthetic DNA
aattacgagactctttag

SEQ ID NO: 56914 - DNA, 18 bp, Artificial Sequence
  Synthetic DNA
aattacgattcgcaatcg

SEQ ID NO: 56915 - DNA, 18 bp, Artificial Sequence
  Synthetic DNA
aattacgcctgtctatag

SEQ ID NO: 56916 - DNA, 18 bp, Artificial Sequence
  Synthetic DNA
aattacgtccgtctttag

SEQ ID NO: 56917 - DNA, 18 bp, Artificial Sequence
  Synthetic DNA
aattacgtctcatcattg

SEQ ID NO: 56918 - DNA, 18 bp, Artificial Sequence
  Synthetic DNA
aattacgttcctcgacag

SEQ ID NO: 56919 - DNA, 18 bp, Artificial Sequence
  Synthetic DNA
aattactactatcaattg

SEQ ID NO: 56920 - DNA, 18 bp, Artificial Sequence
  Synthetic DNA
aattacttctatctatag

SEQ ID NO: 56921 - DNA, 18 bp, Artificial Sequence
  Synthetic DNA
aattacttctcacaattg

SEQ ID NO: 56922 - DNA, 18 bp, Artificial Sequence
  Synthetic DNA
aattaggtttcaacttag

SEQ ID NO: 56923 - DNA, 18 bp, Artificial Sequence
  Synthetic DNA
aattatcactcataattg

SEQ ID NO: 56924 - DNA, 18 bp, Artificial Sequence
  Synthetic DNA
aattatgactaaatatag

SEQ ID NO: 56925 - DNA, 18 bp, Artificial Sequence
  Synthetic DNA
aattatgactaaccttag

SEQ ID NO: 56926 - DNA, 18 bp, Artificial Sequence
  Synthetic DNA
aattatgactaacgattg

SEQ ID NO: 56927 - DNA, 18 bp, Artificial Sequence
  Synthetic DNA
aattcatactcactatag

SEQ ID NO: 56928 - DNA, 18 bp, Artificial Sequence
  Synthetic DNA
aattccaaccgcttaatg

SEQ ID NO: 56929 - DNA, 18 bp, Artificial Sequence
  Synthetic DNA
aattccgaatcacaatag

SEQ ID NO: 56930 - DNA, 18 bp, Artificial Sequence
  Synthetic DNA
aattccgacccactaaag

SEQ ID NO: 56931 - DNA, 18 bp, Artificial Sequence
  Synthetic DNA
aattccggctcagtatag

SEQ ID NO: 56932 - DNA, 18 bp, Artificial Sequence
  Synthetic DNA
aattgcgaatctctattg

SEQ ID NO: 56933 - DNA, 18 bp, Artificial Sequence
  Synthetic DNA
aattgcgatacactgtag

SEQ ID NO: 56934 - DNA, 18 bp, Artificial Sequence
  Synthetic DNA
aatttagtcacaataaag

SEQ ID NO: 56935 - DNA, 18 bp, Artificial Sequence
  Synthetic DNA
aatttcgaatcgctattg

SEQ ID NO: 56936 - DNA, 18 bp, Artificial Sequence
  Synthetic DNA
aatttcgatctactatag

SEQ ID NO: 56937 - DNA, 18 bp, Artificial Sequence
  Synthetic DNA
aatttcggcacactaaag

SEQ ID NO: 56938 - DNA, 18 bp, Artificial Sequence
  Synthetic DNA
aattttcactcactatag

SEQ ID NO: 56939 - DNA, 18 bp, Artificial Sequence
  Synthetic DNA
aatttttactgaccattg

SEQ ID NO: 56940 - DNA, 18 bp, Artificial Sequence
  Synthetic DNA
acaaactactcacttaag

SEQ ID NO: 56941 - DNA, 18 bp, Artificial Sequence
  Synthetic DNA
acaaatgacaaactatag

SEQ ID NO: 56942 - DNA, 18 bp, Artificial Sequence
  Synthetic DNA
acaaatgtctcactatag

SEQ ID NO: 56943 - DNA, 18 bp, Artificial Sequence
  Synthetic DNA
acaagcaattctctttag

SEQ ID NO: 56944 - DNA, 18 bp, Artificial Sequence
  Synthetic DNA
acaatcgcgcaacaaaag

SEQ ID NO: 56945 - DNA, 18 bp, Artificial Sequence
  Synthetic DNA
acacaagacaaactatag

SEQ ID NO: 56946 - DNA, 18 bp, Artificial Sequence
  Synthetic DNA
acacacgaataacttcag

SEQ ID NO: 56947 - DNA, 18 bp, Artificial Sequence
  Synthetic DNA
acacacgaatgaatatag

SEQ ID NO: 56948 - DNA, 18 bp, Artificial Sequence
  Synthetic DNA
acataaagctcactatgg

SEQ ID NO: 56949 - DNA, 18 bp, Artificial Sequence
  Synthetic DNA
acatacaacaaataatag

SEQ ID NO: 56950 - DNA, 18 bp, Artificial Sequence
  Synthetic DNA
acatacaacccactacag

SEQ ID NO: 56951 - DNA, 18 bp, Artificial Sequence
  Synthetic DNA
acatacagcctaatatag

SEQ ID NO: 56952 - DNA, 18 bp, Artificial Sequence
  Synthetic DNA
acatacgacacaccatcg

SEQ ID NO: 56953 - DNA, 18 bp, Artificial Sequence
  Synthetic DNA
acatacgacactatcttg

SEQ ID NO: 56954 - DNA, 18 bp, Artificial Sequence
  Synthetic DNA
acatacgaccctctatgg

SEQ ID NO: 56955 - DNA, 18 bp, Artificial Sequence
  Synthetic DNA
acatacgactaacttttg

SEQ ID NO: 56956 - DNA, 18 bp, Artificial Sequence
  Synthetic DNA
acatacgactcaaaacag

SEQ ID NO: 56957 - DNA, 18 bp, Artificial Sequence
  Synthetic DNA
acatacgtctccctcttg

SEQ ID NO: 56958 - DNA, 18 bp, Artificial Sequence
  Synthetic DNA
acatacgtttctctattg

SEQ ID NO: 56959 - DNA, 18 bp, Artificial Sequence
  Synthetic DNA
acatatgactcattttgg

SEQ ID NO: 56960 - DNA, 18 bp, Artificial Sequence
  Synthetic DNA
acatatgactctattttg

SEQ ID NO: 56961 - DNA, 18 bp, Artificial Sequence
  Synthetic DNA
acatatgattcactttag

SEQ ID NO: 56962 - DNA, 18 bp, Artificial Sequence
  Synthetic DNA
acatgcgaccctatatag

SEQ ID NO: 56963 - DNA, 18 bp, Artificial Sequence
  Synthetic DNA
acattcgtctcacaacag

SEQ ID NO: 56964 - DNA, 18 bp, Artificial Sequence
  Synthetic DNA
acattggacatattgcag

SEQ ID NO: 56965 - DNA, 18 bp, Artificial Sequence
  Synthetic DNA
acatttgactctcgtgag

SEQ ID NO: 56966 - DNA, 18 bp, Artificial Sequence
  Synthetic DNA
accatcgtctcacaagag

SEQ ID NO: 56967 - DNA, 18 bp, Artificial Sequence
  Synthetic DNA
acctacgtgtaacttaag

SEQ ID NO: 56968 - DNA, 18 bp, Artificial Sequence
  Synthetic DNA
acgaatcactccatttag

SEQ ID NO: 56969 - DNA, 18 bp, Artificial Sequence
  Synthetic DNA
actatagactcaaaatag

SEQ ID NO: 56970 - DNA, 18 bp, Artificial Sequence
  Synthetic DNA
actcaccactcacattag

SEQ ID NO: 56971 - DNA, 18 bp, Artificial Sequence
  Synthetic DNA
acttaggtctcaccattg

SEQ ID NO: 56972 - DNA, 18 bp, Artificial Sequence
  Synthetic DNA
actttagactaactagtg

SEQ ID NO: 56973 - DNA, 18 bp, Artificial Sequence
  Synthetic DNA
actttcgaagatcacaag

SEQ ID NO: 56974 - DNA, 18 bp, Artificial Sequence
  Synthetic DNA
agaaaagatttattatag

SEQ ID NO: 56975 - DNA, 18 bp, Artificial Sequence
  Synthetic DNA
agaaaccacactgtgtag

SEQ ID NO: 56976 - DNA, 18 bp, Artificial Sequence
  Synthetic DNA
agaaacgtcacgctattg

SEQ ID NO: 56977 - DNA, 18 bp, Artificial Sequence
  Synthetic DNA
agaaacgtctaactattg

SEQ ID NO: 56978 - DNA, 18 bp, Artificial Sequence
  Synthetic DNA
agaatcgtttcatttcag

SEQ ID NO: 56979 - DNA, 18 bp, Artificial Sequence
  Synthetic DNA
agacaaaaattacaatag

SEQ ID NO: 56980 - DNA, 18 bp, Artificial Sequence
  Synthetic DNA
agataagtctcactctag

SEQ ID NO: 56981 - DNA, 18 bp, Artificial Sequence
  Synthetic DNA
agataagtctgactacag

SEQ ID NO: 56982 - DNA, 18 bp, Artificial Sequence
  Synthetic DNA
agataagttactctatag

SEQ ID NO: 56983 - DNA, 18 bp, Artificial Sequence
  Synthetic DNA
agataccacccaccatag

SEQ ID NO: 56984 - DNA, 18 bp, Artificial Sequence
  Synthetic DNA
agataccgcttactttag

SEQ ID NO: 56985 - DNA, 18 bp, Artificial Sequence
  Synthetic DNA
agatacgacatacaatag

SEQ ID NO: 56986 - DNA, 18 bp, Artificial Sequence
  Synthetic DNA
agatacgcatcactttag

SEQ ID NO: 56987 - DNA, 18 bp, Artificial Sequence
  Synthetic DNA
agatacgtttcattaaag

SEQ ID NO: 56988 - DNA, 18 bp, Artificial Sequence
  Synthetic DNA
agatccgactcattacag

SEQ ID NO: 56989 - DNA, 18 bp, Artificial Sequence
  Synthetic DNA
agatccgagtcacaatag

SEQ ID NO: 56990 - DNA, 18 bp, Artificial Sequence
  Synthetic DNA
agattcgactcattcacg

SEQ ID NO: 56991 - DNA, 18 bp, Artificial Sequence
  Synthetic DNA
agattgaactcactaatg

SEQ ID NO: 56992 - DNA, 18 bp, Artificial Sequence
  Synthetic DNA
agatttgactcgctatag

SEQ ID NO: 56993 - DNA, 18 bp, Artificial Sequence
  Synthetic DNA
agcatcgattcactatag

SEQ ID NO: 56994 - DNA, 18 bp, Artificial Sequence
  Synthetic DNA
aggtaagtctcaatttag

SEQ ID NO: 56995 - DNA, 18 bp, Artificial Sequence
  Synthetic DNA
aggtacgactctctgtag

SEQ ID NO: 56996 - DNA, 18 bp, Artificial Sequence
  Synthetic DNA
aggtactaatgtcaatag

SEQ ID NO: 56997 - DNA, 18 bp, Artificial Sequence
  Synthetic DNA
aggtatgaatcactattg

SEQ ID NO: 56998 - DNA, 18 bp, Artificial Sequence
  Synthetic DNA
agtaaaggctcactaagg

SEQ ID NO: 56999 - DNA, 18 bp, Artificial Sequence
  Synthetic DNA
agtgactagtccgtatag

SEQ ID NO: 57000 - DNA, 18 bp, Artificial Sequence
  Synthetic DNA
agttaccgatcacaatag

SEQ ID NO: 57001 - DNA, 18 bp, Artificial Sequence
  Synthetic DNA
agttacgactcagtaaag

SEQ ID NO: 57002 - DNA, 18 bp, Artificial Sequence
  Synthetic DNA
agttacgccttccactag

SEQ ID NO: 57003 - DNA, 18 bp, Artificial Sequence
  Synthetic DNA
agttactacccacaacag

SEQ ID NO: 57004 - DNA, 18 bp, Artificial Sequence
  Synthetic DNA
agtttagaatcataagtg

SEQ ID NO: 57005 - DNA, 18 bp, Artificial Sequence
  Synthetic DNA
ataaaacattcactctag

SEQ ID NO: 57006 - DNA, 18 bp, Artificial Sequence
  Synthetic DNA
ataaacaactcaatctag

SEQ ID NO: 57007 - DNA, 18 bp, Artificial Sequence
  Synthetic DNA
ataaacatctcgcagtag

SEQ ID NO: 57008 - DNA, 18 bp, Artificial Sequence
  Synthetic DNA
ataaacgactcacgcttg

SEQ ID NO: 57009 - DNA, 18 bp, Artificial Sequence
  Synthetic DNA
ataaacgagtcacattag

SEQ ID NO: 57010 - DNA, 18 bp, Artificial Sequence
  Synthetic DNA
ataaacgtctctcaattg

SEQ ID NO: 57011 - DNA, 18 bp, Artificial Sequence
  Synthetic DNA
ataaaggtcacactatag

SEQ ID NO: 57012 - DNA, 18 bp, Artificial Sequence
  Synthetic DNA
ataaataacccacaatcg

SEQ ID NO: 57013 - DNA, 18 bp, Artificial Sequence
  Synthetic DNA
ataaccgaaacactaaag

SEQ ID NO: 57014 - DNA, 18 bp, Artificial Sequence
  Synthetic DNA
atacacgactcgctttag

SEQ ID NO: 57015 - DNA, 18 bp, Artificial Sequence
  Synthetic DNA
atacacgcatcactatag

SEQ ID NO: 57016 - DNA, 18 bp, Artificial Sequence
  Synthetic DNA
atacactactcaccttag

SEQ ID NO: 57017 - DNA, 18 bp, Artificial Sequence
  Synthetic DNA
atacccgactcactctag

SEQ ID NO: 57018 - DNA, 18 bp, Artificial Sequence
  Synthetic DNA
atagacgacgcgctttgg

SEQ ID NO: 57019 - DNA, 18 bp, Artificial Sequence
  Synthetic DNA
atataacattcagtacag

SEQ ID NO: 57020 - DNA, 18 bp, Artificial Sequence
  Synthetic DNA
atataagaccaactattg

SEQ ID NO: 57021 - DNA, 18 bp, Artificial Sequence
  Synthetic DNA
atatacatctcaccttag

SEQ ID NO: 57022 - DNA, 18 bp, Artificial Sequence
  Synthetic DNA
atataccactctccatag

SEQ ID NO: 57023 - DNA, 18 bp, Artificial Sequence
  Synthetic DNA
atatacctgtcaatatag

SEQ ID NO: 57024 - DNA, 18 bp, Artificial Sequence
  Synthetic DNA
atatacgaatcacttccg

SEQ ID NO: 57025 - DNA, 18 bp, Artificial Sequence
  Synthetic DNA
atatacgacccattattg

SEQ ID NO: 57026 - DNA, 18 bp, Artificial Sequence
  Synthetic DNA
atatacgactaaccttag

SEQ ID NO: 57027 - DNA, 18 bp, Artificial Sequence
  Synthetic DNA
atatacgactagcaatag

SEQ ID NO: 57028 - DNA, 18 bp, Artificial Sequence
  Synthetic DNA
atatacgactcggtttag

SEQ ID NO: 57029 - DNA, 18 bp, Artificial Sequence
  Synthetic DNA
atatacgactttctagag

SEQ ID NO: 57030 - DNA, 18 bp, Artificial Sequence
  Synthetic DNA
atatacgactttctgtag

SEQ ID NO: 57031 - DNA, 18 bp, Artificial Sequence
  Synthetic DNA
atatacgattctcaatag

SEQ ID NO: 57032 - DNA, 18 bp, Artificial Sequence
  Synthetic DNA
atatacgattctccgtag

SEQ ID NO: 57033 - DNA, 18 bp, Artificial Sequence
  Synthetic DNA
atatacgcctcaatgtag

SEQ ID NO: 57034 - DNA, 18 bp, Artificial Sequence
  Synthetic DNA
atatacggttcactattg

SEQ ID NO: 57035 - DNA, 18 bp, Artificial Sequence
  Synthetic DNA
atatacgtatcactatcg

SEQ ID NO: 57036 - DNA, 18 bp, Artificial Sequence
  Synthetic DNA
atatacgtcaccctatcg

SEQ ID NO: 57037 - DNA, 18 bp, Artificial Sequence
  Synthetic DNA
atatacgtctcgcactag

SEQ ID NO: 57038 - DNA, 18 bp, Artificial Sequence
  Synthetic DNA
atatactactctctttag

SEQ ID NO: 57039 - DNA, 18 bp, Artificial Sequence
  Synthetic DNA
atatactcctcagtaaag

SEQ ID NO: 57040 - DNA, 18 bp, Artificial Sequence
  Synthetic DNA
atatacttctcaaaatag

SEQ ID NO: 57041 - DNA, 18 bp, Artificial Sequence
  Synthetic DNA
atataggacgttctatag

SEQ ID NO: 57042 - DNA, 18 bp, Artificial Sequence
  Synthetic DNA
atatagtactcactttgg

SEQ ID NO: 57043 - DNA, 18 bp, Artificial Sequence
  Synthetic DNA
atatatacctcacaatag

SEQ ID NO: 57044 - DNA, 18 bp, Artificial Sequence
  Synthetic DNA
atatatatcacattatag

SEQ ID NO: 57045 - DNA, 18 bp, Artificial Sequence
  Synthetic DNA
atatatgaatctctatag

SEQ ID NO: 57046 - DNA, 18 bp, Artificial Sequence
  Synthetic DNA
atatatttctctctttag

SEQ ID NO: 57047 - DNA, 18 bp, Artificial Sequence
  Synthetic DNA
atatcaaacatactatag

SEQ ID NO: 57048 - DNA, 18 bp, Artificial Sequence
  Synthetic DNA
atatccgactcactccag

SEQ ID NO: 57049 - DNA, 18 bp, Artificial Sequence
  Synthetic DNA
atatcctacaaactacag

SEQ ID NO: 57050 - DNA, 18 bp, Artificial Sequence
  Synthetic DNA
atatcctactcagtacag

SEQ ID NO: 57051 - DNA, 18 bp, Artificial Sequence
  Synthetic DNA
atatcgaagactcttttg

SEQ ID NO: 57052 - DNA, 18 bp, Artificial Sequence
  Synthetic DNA
atatgcaaataactattg

SEQ ID NO: 57053 - DNA, 18 bp, Artificial Sequence
  Synthetic DNA
atatgcgactcactagtg

SEQ ID NO: 57054 - DNA, 18 bp, Artificial Sequence
  Synthetic DNA
atatgcgacttacaaaag

SEQ ID NO: 57055 - DNA, 18 bp, Artificial Sequence
  Synthetic DNA
atattagactaacaattg

SEQ ID NO: 57056 - DNA, 18 bp, Artificial Sequence
  Synthetic DNA
atattagtctcactatag

SEQ ID NO: 57057 - DNA, 18 bp, Artificial Sequence
  Synthetic DNA
atattcaactcatttgtg

SEQ ID NO: 57058 - DNA, 18 bp, Artificial Sequence
  Synthetic DNA
atattcaactcgctttag

SEQ ID NO: 57059 - DNA, 18 bp, Artificial Sequence
  Synthetic DNA
atattcaagtcagtatag

SEQ ID NO: 57060 - DNA, 18 bp, Artificial Sequence
  Synthetic DNA
atattcgacaaactatag

SEQ ID NO: 57061 - DNA, 18 bp, Artificial Sequence
  Synthetic DNA
atattcgaccaattatag

SEQ ID NO: 57062 - DNA, 18 bp, Artificial Sequence
  Synthetic DNA
atattcgactccctgtag

SEQ ID NO: 57063 - DNA, 18 bp, Artificial Sequence
  Synthetic DNA
atattcgactctcttcag

SEQ ID NO: 57064 - DNA, 18 bp, Artificial Sequence
  Synthetic DNA
atattcgacttacctaag

SEQ ID NO: 57065 - DNA, 18 bp, Artificial Sequence
  Synthetic DNA
atattctactccctatag

SEQ ID NO: 57066 - DNA, 18 bp, Artificial Sequence
  Synthetic DNA
atatttaacatataatag

SEQ ID NO: 57067 - DNA, 18 bp, Artificial Sequence
  Synthetic DNA
atatttgaaacactattg

SEQ ID NO: 57068 - DNA, 18 bp, Artificial Sequence
  Synthetic DNA
atatttgacgcactttag

SEQ ID NO: 57069 - DNA, 18 bp, Artificial Sequence
  Synthetic DNA
atatttggctcgctatag

SEQ ID NO: 57070 - DNA, 18 bp, Artificial Sequence
  Synthetic DNA
atattttactcactatag

SEQ ID NO: 57071 - DNA, 18 bp, Artificial Sequence
  Synthetic DNA
atcaaagtcccattatag

SEQ ID NO: 57072 - DNA, 18 bp, Artificial Sequence
  Synthetic DNA
atccacgactctctatag

SEQ ID NO: 57073 - DNA, 18 bp, Artificial Sequence
  Synthetic DNA
atctacaacacactttag

SEQ ID NO: 57074 - DNA, 18 bp, Artificial Sequence
  Synthetic DNA
atctacttctcactaatg

SEQ ID NO: 57075 - DNA, 18 bp, Artificial Sequence
  Synthetic DNA
atctataactctcgatag

SEQ ID NO: 57076 - DNA, 18 bp, Artificial Sequence
  Synthetic DNA
atctatgactctatatag

SEQ ID NO: 57077 - DNA, 18 bp, Artificial Sequence
  Synthetic DNA
atctatgagccttgatag

SEQ ID NO: 57078 - DNA, 18 bp, Artificial Sequence
  Synthetic DNA
atcttcaactcagtatag

SEQ ID NO: 57079 - DNA, 18 bp, Artificial Sequence
  Synthetic DNA
atcttcgacacaatatag

SEQ ID NO: 57080 - DNA, 18 bp, Artificial Sequence
  Synthetic DNA
atgaacgacactctgtag

SEQ ID NO: 57081 - DNA, 18 bp, Artificial Sequence
  Synthetic DNA
atggacgcctcacactag

SEQ ID NO: 57082 - DNA, 18 bp, Artificial Sequence
  Synthetic DNA
atgtacaactcactttag

SEQ ID NO: 57083 - DNA, 18 bp, Artificial Sequence
  Synthetic DNA
atgtacctctcactactg

SEQ ID NO: 57084 - DNA, 18 bp, Artificial Sequence
  Synthetic DNA
atgtacgactcacaaatg

SEQ ID NO: 57085 - DNA, 18 bp, Artificial Sequence
  Synthetic DNA
atgttcgactcactatgg

SEQ ID NO: 57086 - DNA, 18 bp, Artificial Sequence
  Synthetic DNA
attaaagacacactaggg

SEQ ID NO: 57087 - DNA, 18 bp, Artificial Sequence
  Synthetic DNA
attaaagactcactgtag

SEQ ID NO: 57088 - DNA, 18 bp, Artificial Sequence
  Synthetic DNA
attaacgatgtactatgg

SEQ ID NO: 57089 - DNA, 18 bp, Artificial Sequence
  Synthetic DNA
attaacgccacactatag

SEQ ID NO: 57090 - DNA, 18 bp, Artificial Sequence
  Synthetic DNA
attagcgacacactatag

SEQ ID NO: 57091 - DNA, 18 bp, Artificial Sequence
  Synthetic DNA
attatccaatcactatag

SEQ ID NO: 57092 - DNA, 18 bp, Artificial Sequence
  Synthetic DNA
atttacaagtcaatatag

SEQ ID NO: 57093 - DNA, 18 bp, Artificial Sequence
  Synthetic DNA
atttacgaatcaatatag

SEQ ID NO: 57094 - DNA, 18 bp, Artificial Sequence
  Synthetic DNA
atttacgaatcactcaag

SEQ ID NO: 57095 - DNA, 18 bp, Artificial Sequence
  Synthetic DNA
atttacgacaccctattg

SEQ ID NO: 57096 - DNA, 18 bp, Artificial Sequence
  Synthetic DNA
atttacgactaactatcg

SEQ ID NO: 57097 - DNA, 18 bp, Artificial Sequence
  Synthetic DNA
atttacgactcactgttg

SEQ ID NO: 57098 - DNA, 18 bp, Artificial Sequence
  Synthetic DNA
atttacgactctctattg

SEQ ID NO: 57099 - DNA, 18 bp, Artificial Sequence
  Synthetic DNA
atttacgagtcaatctag

SEQ ID NO: 57100 - DNA, 18 bp, Artificial Sequence
  Synthetic DNA
atttacgtatcaccatag

SEQ ID NO: 57101 - DNA, 18 bp, Artificial Sequence
  Synthetic DNA
atttactacacactgaag

SEQ ID NO: 57102 - DNA, 18 bp, Artificial Sequence
  Synthetic DNA
atttaggactccttacag

SEQ ID NO: 57103 - DNA, 18 bp, Artificial Sequence
  Synthetic DNA
atttatgagtcgctatag

SEQ ID NO: 57104 - DNA, 18 bp, Artificial Sequence
  Synthetic DNA
atttatttatcactatag

SEQ ID NO: 57105 - DNA, 18 bp, Artificial Sequence
  Synthetic DNA
atttgcgactcacttaag

SEQ ID NO: 57106 - DNA, 18 bp, Artificial Sequence
  Synthetic DNA
attttagacactccaatg

SEQ ID NO: 57107 - DNA, 18 bp, Artificial Sequence
  Synthetic DNA
attttcatcacaccatcg

SEQ ID NO: 57108 - DNA, 18 bp, Artificial Sequence
  Synthetic DNA
attttcgactcaccaaag

SEQ ID NO: 57109 - DNA, 18 bp, Artificial Sequence
  Synthetic DNA
attttcgtcacactttag

SEQ ID NO: 57110 - DNA, 18 bp, Artificial Sequence
  Synthetic DNA
caaaaaaactcacgaaag

SEQ ID NO: 57111 - DNA, 18 bp, Artificial Sequence
  Synthetic DNA
caaaaaggtactctaaag

SEQ ID NO: 57112 - DNA, 18 bp, Artificial Sequence
  Synthetic DNA
caaaacaacttattaaag

SEQ ID NO: 57113 - DNA, 18 bp, Artificial Sequence
  Synthetic DNA
caaaaccaatctatatag

SEQ ID NO: 57114 - DNA, 18 bp, Artificial Sequence
  Synthetic DNA
caaaacgaatctcgacag

SEQ ID NO: 57115 - DNA, 18 bp, Artificial Sequence
  Synthetic DNA
caaaacgactaattaaag

SEQ ID NO: 57116 - DNA, 18 bp, Artificial Sequence
  Synthetic DNA
caaaacgactctgactag

SEQ ID NO: 57117 - DNA, 18 bp, Artificial Sequence
  Synthetic DNA
caaaacgtctctcttatg

SEQ ID NO: 57118 - DNA, 18 bp, Artificial Sequence
  Synthetic DNA
caaaacgtcttattatag

SEQ ID NO: 57119 - DNA, 18 bp, Artificial Sequence
  Synthetic DNA
caaaactgcccaccatag

SEQ ID NO: 57120 - DNA, 18 bp, Artificial Sequence
  Synthetic DNA
caaaacttttcaataaag

SEQ ID NO: 57121 - DNA, 18 bp, Artificial Sequence
  Synthetic DNA
caaaaggactcacaattg

SEQ ID NO: 57122 - DNA, 18 bp, Artificial Sequence
  Synthetic DNA
caaaatgagacactaaag

SEQ ID NO: 57123 - DNA, 18 bp, Artificial Sequence
  Synthetic DNA
caaaccgacttactttag

SEQ ID NO: 57124 - DNA, 18 bp, Artificial Sequence
  Synthetic DNA
caaagcgaaccaatgtag

SEQ ID NO: 57125 - DNA, 18 bp, Artificial Sequence
  Synthetic DNA
caaagcgactcactaatg

SEQ ID NO: 57126 - DNA, 18 bp, Artificial Sequence
  Synthetic DNA
caaagctccccacaatag

SEQ ID NO: 57127 - DNA, 18 bp, Artificial Sequence
  Synthetic DNA
caaatcgacactcagtag

SEQ ID NO: 57128 - DNA, 18 bp, Artificial Sequence
  Synthetic DNA
caaatgcacttattacag

SEQ ID NO: 57129 - DNA, 18 bp, Artificial Sequence
  Synthetic DNA
caacaagacacacgctag

SEQ ID NO: 57130 - DNA, 18 bp, Artificial Sequence
  Synthetic DNA
caacacgtctcatttaag

SEQ ID NO: 57131 - DNA, 18 bp, Artificial Sequence
  Synthetic DNA
caacacttctcacattag

SEQ ID NO: 57132 - DNA, 18 bp, Artificial Sequence
  Synthetic DNA
caacataagtcaagaatg

SEQ ID NO: 57133 - DNA, 18 bp, Artificial Sequence
  Synthetic DNA
caacatgactaattactg

SEQ ID NO: 57134 - DNA, 18 bp, Artificial Sequence
  Synthetic DNA
caacctgactccctacag

SEQ ID NO: 57135 - DNA, 18 bp, Artificial Sequence
  Synthetic DNA
caacgcgattaactttag

SEQ ID NO: 57136 - DNA, 18 bp, Artificial Sequence
  Synthetic DNA
caacgcgtcacaattatg

SEQ ID NO: 57137 - DNA, 18 bp, Artificial Sequence
  Synthetic DNA
caactcagcacactatag

SEQ ID NO: 57138 - DNA, 18 bp, Artificial Sequence
  Synthetic DNA
caactcgagacactatag

SEQ ID NO: 57139 - DNA, 18 bp, Artificial Sequence
  Synthetic DNA
caagacgactcaccttgg

SEQ ID NO: 57140 - DNA, 18 bp, Artificial Sequence
  Synthetic DNA
caagtcgattcaatatcg

SEQ ID NO: 57141 - DNA, 18 bp, Artificial Sequence
  Synthetic DNA
caataagacaaagtatag

SEQ ID NO: 57142 - DNA, 18 bp, Artificial Sequence
  Synthetic DNA
caataagacgatttatag

SEQ ID NO: 57143 - DNA, 18 bp, Artificial Sequence
  Synthetic DNA
caataagactccatatcg

SEQ ID NO: 57144 - DNA, 18 bp, Artificial Sequence
  Synthetic DNA
caataagacttaacagag

SEQ ID NO: 57145 - DNA, 18 bp, Artificial Sequence
  Synthetic DNA
caataagagtcagtttcg

SEQ ID NO: 57146 - DNA, 18 bp, Artificial Sequence
  Synthetic DNA
caataagccacacattag

SEQ ID NO: 57147 - DNA, 18 bp, Artificial Sequence
  Synthetic DNA
caataagccttaatatag

SEQ ID NO: 57148 - DNA, 18 bp, Artificial Sequence
  Synthetic DNA
caataagtctctcggtag

SEQ ID NO: 57149 - DNA, 18 bp, Artificial Sequence
  Synthetic DNA
caatacaacttgcataag

SEQ ID NO: 57150 - DNA, 18 bp, Artificial Sequence
  Synthetic DNA
caatacagctcgttacag

SEQ ID NO: 57151 - DNA, 18 bp, Artificial Sequence
  Synthetic DNA
caataccacacaccagag

SEQ ID NO: 57152 - DNA, 18 bp, Artificial Sequence
  Synthetic DNA
caatacctcaccctaaag

SEQ ID NO: 57153 - DNA, 18 bp, Artificial Sequence
  Synthetic DNA
caatacgaatctctgaag

SEQ ID NO: 57154 - DNA, 18 bp, Artificial Sequence
  Synthetic DNA
caatacgacaaagttggg

SEQ ID NO: 57155 - DNA, 18 bp, Artificial Sequence
  Synthetic DNA
caatacgagatactactg

SEQ ID NO: 57156 - DNA, 18 bp, Artificial Sequence
  Synthetic DNA
caatacgagttactccag

SEQ ID NO: 57157 - DNA, 18 bp, Artificial Sequence
  Synthetic DNA
caatacgccacacaattg

SEQ ID NO: 57158 - DNA, 18 bp, Artificial Sequence
  Synthetic DNA
caatacgccatattatag

SEQ ID NO: 57159 - DNA, 18 bp, Artificial Sequence
  Synthetic DNA
caatacgtacctcataag

SEQ ID NO: 57160 - DNA, 18 bp, Artificial Sequence
  Synthetic DNA
caatacgtattagaatag

SEQ ID NO: 57161 - DNA, 18 bp, Artificial Sequence
  Synthetic DNA
caatacgtcttacattag

SEQ ID NO: 57162 - DNA, 18 bp, Artificial Sequence
  Synthetic DNA
caatacgttatacagacg

SEQ ID NO: 57163 - DNA, 18 bp, Artificial Sequence
  Synthetic DNA
caatactacatgctattg

SEQ ID NO: 57164 - DNA, 18 bp, Artificial Sequence
  Synthetic DNA
caatactacccactaatg

SEQ ID NO: 57165 - DNA, 18 bp, Artificial Sequence
  Synthetic DNA
caatactacttaagaaag

SEQ ID NO: 57166 - DNA, 18 bp, Artificial Sequence
  Synthetic DNA
caatactagtaactattg

SEQ ID NO: 57167 - DNA, 18 bp, Artificial Sequence
  Synthetic DNA
caatactgctcgctgtag

SEQ ID NO: 57168 - DNA, 18 bp, Artificial Sequence
  Synthetic DNA
caatactggacgcaagag

SEQ ID NO: 57169 - DNA, 18 bp, Artificial Sequence
  Synthetic DNA
caatacttatcaccatag

SEQ ID NO: 57170 - DNA, 18 bp, Artificial Sequence
  Synthetic DNA
caataggattgactttag

SEQ ID NO: 57171 - DNA, 18 bp, Artificial Sequence
  Synthetic DNA
caataggcctctctttag

SEQ ID NO: 57172 - DNA, 18 bp, Artificial Sequence
  Synthetic DNA
caataggtctgactctag

SEQ ID NO: 57173 - DNA, 18 bp, Artificial Sequence
  Synthetic DNA
caatatcatactctaaag

SEQ ID NO: 57174 - DNA, 18 bp, Artificial Sequence
  Synthetic DNA
caatatgacactctatgg

SEQ ID NO: 57175 - DNA, 18 bp, Artificial Sequence
  Synthetic DNA
caatatgactcatttttg

SEQ ID NO: 57176 - DNA, 18 bp, Artificial Sequence
  Synthetic DNA
caatatggctccctgacg

SEQ ID NO: 57177 - DNA, 18 bp, Artificial Sequence
  Synthetic DNA
caatccatctttctatag

SEQ ID NO: 57178 - DNA, 18 bp, Artificial Sequence
  Synthetic DNA
caatccatgtcactattg

SEQ ID NO: 57179 - DNA, 18 bp, Artificial Sequence
  Synthetic DNA
caatcttactccccaaag

SEQ ID NO: 57180 - DNA, 18 bp, Artificial Sequence
  Synthetic DNA
caatgcatctcactaaag

SEQ ID NO: 57181 - DNA, 18 bp, Artificial Sequence
  Synthetic DNA
caatgcttctgacaatag

SEQ ID NO: 57182 - DNA, 18 bp, Artificial Sequence
  Synthetic DNA
caatgcttctgactatag

SEQ ID NO: 57183 - DNA, 18 bp, Artificial Sequence
  Synthetic DNA
caatggggctcaaaacag

SEQ ID NO: 57184 - DNA, 18 bp, Artificial Sequence
  Synthetic DNA
caatgtgactcaatacag

SEQ ID NO: 57185 - DNA, 18 bp, Artificial Sequence
  Synthetic DNA
caatgtgccacactagtg

SEQ ID NO: 57186 - DNA, 18 bp, Artificial Sequence
  Synthetic DNA
caattagacccattatag

SEQ ID NO: 57187 - DNA, 18 bp, Artificial Sequence
  Synthetic DNA
caattcaaaacactatag

SEQ ID NO: 57188 - DNA, 18 bp, Artificial Sequence
  Synthetic DNA
caattcaacttaactaag

SEQ ID NO: 57189 - DNA, 18 bp, Artificial Sequence
  Synthetic DNA
caattcattccactatag

SEQ ID NO: 57190 - DNA, 18 bp, Artificial Sequence
  Synthetic DNA
caattccaatcacgatag

SEQ ID NO: 57191 - DNA, 18 bp, Artificial Sequence
  Synthetic DNA
caattcgaaaaactatag

SEQ ID NO: 57192 - DNA, 18 bp, Artificial Sequence
  Synthetic DNA
caattcgaatcactgaag

SEQ ID NO: 57193 - DNA, 18 bp, Artificial Sequence
  Synthetic DNA
caattcgactcttattag

SEQ ID NO: 57194 - DNA, 18 bp, Artificial Sequence
  Synthetic DNA
caattcgattaattttag

SEQ ID NO: 57195 - DNA, 18 bp, Artificial Sequence
  Synthetic DNA
caattcgattcaatttag

SEQ ID NO: 57196 - DNA, 18 bp, Artificial Sequence
  Synthetic DNA
caattcgcctcagataag

SEQ ID NO: 57197 - DNA, 18 bp, Artificial Sequence
  Synthetic DNA
caattcgtataactatag

SEQ ID NO: 57198 - DNA, 18 bp, Artificial Sequence
  Synthetic DNA
caattcgtcttactagag

SEQ ID NO: 57199 - DNA, 18 bp, Artificial Sequence
  Synthetic DNA
caattcgtctttctatag

SEQ ID NO: 57200 - DNA, 18 bp, Artificial Sequence
  Synthetic DNA
caattctagtcactttag

SEQ ID NO: 57201 - DNA, 18 bp, Artificial Sequence
  Synthetic DNA
caattgcaatcaatttag

SEQ ID NO: 57202 - DNA, 18 bp, Artificial Sequence
  Synthetic DNA
caattggacttactattg

SEQ ID NO: 57203 - DNA, 18 bp, Artificial Sequence
  Synthetic DNA
caattggattccctattg

SEQ ID NO: 57204 - DNA, 18 bp, Artificial Sequence
  Synthetic DNA
caattggctttactctag

SEQ ID NO: 57205 - DNA, 18 bp, Artificial Sequence
  Synthetic DNA
caatttgactcactctgg

SEQ ID NO: 57206 - DNA, 18 bp, Artificial Sequence
  Synthetic DNA
cactaagattattttttg

SEQ ID NO: 57207 - DNA, 18 bp, Artificial Sequence
  Synthetic DNA
cactacgattaccaatag

SEQ ID NO: 57208 - DNA, 18 bp, Artificial Sequence
  Synthetic DNA
cactacgtatcactattg

SEQ ID NO: 57209 - DNA, 18 bp, Artificial Sequence
  Synthetic DNA
cactagaactctcatttg

SEQ ID NO: 57210 - DNA, 18 bp, Artificial Sequence
  Synthetic DNA
cactaggactctatatag

SEQ ID NO: 57211 - DNA, 18 bp, Artificial Sequence
  Synthetic DNA
cactaggtctaacaatag

SEQ ID NO: 57212 - DNA, 18 bp, Artificial Sequence
  Synthetic DNA
cactatgacagtcaagag

SEQ ID NO: 57213 - DNA, 18 bp, Artificial Sequence
  Synthetic DNA
cactatgactcacgaaag

SEQ ID NO: 57214 - DNA, 18 bp, Artificial Sequence
  Synthetic DNA
cactgcgattcattatag

SEQ ID NO: 57215 - DNA, 18 bp, Artificial Sequence
  Synthetic DNA
cactgtttcttattaaag

SEQ ID NO: 57216 - DNA, 18 bp, Artificial Sequence
  Synthetic DNA
cacttaacttcactaaag

SEQ ID NO: 57217 - DNA, 18 bp, Artificial Sequence
  Synthetic DNA
cactttgactctctcaag

SEQ ID NO: 57218 - DNA, 18 bp, Artificial Sequence
  Synthetic DNA
cagtacgaaacacacccg

SEQ ID NO: 57219 - DNA, 18 bp, Artificial Sequence
  Synthetic DNA
cagtacgattcatttttg

SEQ ID NO: 57220 - DNA, 18 bp, Artificial Sequence
  Synthetic DNA
cagtagttccctctttag

SEQ ID NO: 57221 - DNA, 18 bp, Artificial Sequence
  Synthetic DNA
cagtattattacccatag

SEQ ID NO: 57222 - DNA, 18 bp, Artificial Sequence
  Synthetic DNA
cagtctgaatcactatag

SEQ ID NO: 57223 - DNA, 18 bp, Artificial Sequence
  Synthetic DNA
cataacaattgtttacag

SEQ ID NO: 57224 - DNA, 18 bp, Artificial Sequence
  Synthetic DNA
cataacgactcacgattg

SEQ ID NO: 57225 - DNA, 18 bp, Artificial Sequence
  Synthetic DNA
cataacgactcataaaag

SEQ ID NO: 57226 - DNA, 18 bp, Artificial Sequence
  Synthetic DNA
cataacggcacactaacg

SEQ ID NO: 57227 - DNA, 18 bp, Artificial Sequence
  Synthetic DNA
catatcgtttcactattg

SEQ ID NO: 57228 - DNA, 18 bp, Artificial Sequence
  Synthetic DNA
catcacaacttactattg

SEQ ID NO: 57229 - DNA, 18 bp, Artificial Sequence
  Synthetic DNA
catcacgacacacaatag

SEQ ID NO: 57230 - DNA, 18 bp, Artificial Sequence
  Synthetic DNA
catcgacactcacaattg

SEQ ID NO: 57231 - DNA, 18 bp, Artificial Sequence
  Synthetic DNA
catctcgaactattatag

SEQ ID NO: 57232 - DNA, 18 bp, Artificial Sequence
  Synthetic DNA
catggcgactcactccgg

SEQ ID NO: 57233 - DNA, 18 bp, Artificial Sequence
  Synthetic DNA
cattacaagctactatag

SEQ ID NO: 57234 - DNA, 18 bp, Artificial Sequence
  Synthetic DNA
cattaccactcagtgtag

SEQ ID NO: 57235 - DNA, 18 bp, Artificial Sequence
  Synthetic DNA
cattacgacccacttcag

SEQ ID NO: 57236 - DNA, 18 bp, Artificial Sequence
  Synthetic DNA
cattacgactcaatttgg

SEQ ID NO: 57237 - DNA, 18 bp, Artificial Sequence
  Synthetic DNA
cattacgatactctatag

SEQ ID NO: 57238 - DNA, 18 bp, Artificial Sequence
  Synthetic DNA
cattacgcttcgctatag

SEQ ID NO: 57239 - DNA, 18 bp, Artificial Sequence
  Synthetic DNA
cattacgtcatactatcg

SEQ ID NO: 57240 - DNA, 18 bp, Artificial Sequence
  Synthetic DNA
cattacgtctctctaaag

SEQ ID NO: 57241 - DNA, 18 bp, Artificial Sequence
  Synthetic DNA
cattacgtttctctttag

SEQ ID NO: 57242 - DNA, 18 bp, Artificial Sequence
  Synthetic DNA
cattactacaagcaaaag

SEQ ID NO: 57243 - DNA, 18 bp, Artificial Sequence
  Synthetic DNA
cattactactcacacatg

SEQ ID NO: 57244 - DNA, 18 bp, Artificial Sequence
  Synthetic DNA
cattactcctcaccatag

SEQ ID NO: 57245 - DNA, 18 bp, Artificial Sequence
  Synthetic DNA
cattatgacttactattg

SEQ ID NO: 57246 - DNA, 18 bp, Artificial Sequence
  Synthetic DNA
cattcagcgtccctatcg

SEQ ID NO: 57247 - DNA, 18 bp, Artificial Sequence
  Synthetic DNA
cattccccaagattatag

SEQ ID NO: 57248 - DNA, 18 bp, Artificial Sequence
  Synthetic DNA
cattcggcctcaccgtag

SEQ ID NO: 57249 - DNA, 18 bp, Artificial Sequence
  Synthetic DNA
catttcctgtcccaatcg

SEQ ID NO: 57250 - DNA, 18 bp, Artificial Sequence
  Synthetic DNA
catttcgactctctttag

SEQ ID NO: 57251 - DNA, 18 bp, Artificial Sequence
  Synthetic DNA
catttcgtcaccttaaag

SEQ ID NO: 57252 - DNA, 18 bp, Artificial Sequence
  Synthetic DNA
catttctactaactatag

SEQ ID NO: 57253 - DNA, 18 bp, Artificial Sequence
  Synthetic DNA
ccaaatgagacactatcg

SEQ ID NO: 57254 - DNA, 18 bp, Artificial Sequence
  Synthetic DNA
ccacatgtcttactatag

SEQ ID NO: 57255 - DNA, 18 bp, Artificial Sequence
  Synthetic DNA
ccagacgacacactttag

SEQ ID NO: 57256 - DNA, 18 bp, Artificial Sequence
  Synthetic DNA
ccagacgtgtaacaaatg

SEQ ID NO: 57257 - DNA, 18 bp, Artificial Sequence
  Synthetic DNA
ccatacaactcactaatg

SEQ ID NO: 57258 - DNA, 18 bp, Artificial Sequence
  Synthetic DNA
ccatacgtgtgattatag

SEQ ID NO: 57259 - DNA, 18 bp, Artificial Sequence
  Synthetic DNA
ccatccgtctcaccatag

SEQ ID NO: 57260 - DNA, 18 bp, Artificial Sequence
  Synthetic DNA
ccattcatctccctacgg

SEQ ID NO: 57261 - DNA, 18 bp, Artificial Sequence
  Synthetic DNA
ccattcgaatccctatag

SEQ ID NO: 57262 - DNA, 18 bp, Artificial Sequence
  Synthetic DNA
ccattcgcctcactacag

SEQ ID NO: 57263 - DNA, 18 bp, Artificial Sequence
  Synthetic DNA
ccattctactcagttttg

SEQ ID NO: 57264 - DNA, 18 bp, Artificial Sequence
  Synthetic DNA
ccctgcaaataagtatag

SEQ ID NO: 57265 - DNA, 18 bp, Artificial Sequence
  Synthetic DNA
cctaccgaatcactacta

SEQ ID NO: 57266 - DNA, 18 bp, Artificial Sequence
  Synthetic DNA
ccttacgaatcactaaag

SEQ ID NO: 57267 - DNA, 18 bp, Artificial Sequence
  Synthetic DNA
ccttacgaatccctcaag

SEQ ID NO: 57268 - DNA, 18 bp, Artificial Sequence
  Synthetic DNA
ccttacgattcactacag

SEQ ID NO: 57269 - DNA, 18 bp, Artificial Sequence
  Synthetic DNA
cgaaacgactctgtgtag

SEQ ID NO: 57270 - DNA, 18 bp, Artificial Sequence
  Synthetic DNA
cgaaacgtctctctaaag

SEQ ID NO: 57271 - DNA, 18 bp, Artificial Sequence
  Synthetic DNA
cgaatcgtggcgctatag

SEQ ID NO: 57272 - DNA, 18 bp, Artificial Sequence
  Synthetic DNA
cgacgcgactccacatag

SEQ ID NO: 57273 - DNA, 18 bp, Artificial Sequence
  Synthetic DNA
cgataaaactcacaacag

SEQ ID NO: 57274 - DNA, 18 bp, Artificial Sequence
  Synthetic DNA
cgatacgactctcaaaag

SEQ ID NO: 57275 - DNA, 18 bp, Artificial Sequence
  Synthetic DNA
cgatagaacaccctttag

SEQ ID NO: 57276 - DNA, 18 bp, Artificial Sequence
  Synthetic DNA
cgatcagactctctattg

SEQ ID NO: 57277 - DNA, 18 bp, Artificial Sequence
  Synthetic DNA
cgatcctgatacccacag

SEQ ID NO: 57278 - DNA, 18 bp, Artificial Sequence
  Synthetic DNA
cgctgcgattcgctattg

SEQ ID NO: 57279 - DNA, 18 bp, Artificial Sequence
  Synthetic DNA
cgttacgactaaagattg

SEQ ID NO: 57280 - DNA, 18 bp, Artificial Sequence
  Synthetic DNA
cgttactcctcactttag

SEQ ID NO: 57281 - DNA, 18 bp, Artificial Sequence
  Synthetic DNA
cgttccgtctcacatcag

SEQ ID NO: 57282 - DNA, 18 bp, Artificial Sequence
  Synthetic DNA
ctaaaccactcactaaag

SEQ ID NO: 57283 - DNA, 18 bp, Artificial Sequence
  Synthetic DNA
ctaaacgaatgactaatg

SEQ ID NO: 57284 - DNA, 18 bp, Artificial Sequence
  Synthetic DNA
ctaaacgacacaatgatg

SEQ ID NO: 57285 - DNA, 18 bp, Artificial Sequence
  Synthetic DNA
ctaaacgactcactaagg

SEQ ID NO: 57286 - DNA, 18 bp, Artificial Sequence
  Synthetic DNA
ctaaacgactgacgtttg

SEQ ID NO: 57287 - DNA, 18 bp, Artificial Sequence
  Synthetic DNA
ctaaacgcgtccctaaag

SEQ ID NO: 57288 - DNA, 18 bp, Artificial Sequence
  Synthetic DNA
ctaaactactcactgtag

SEQ ID NO: 57289 - DNA, 18 bp, Artificial Sequence
  Synthetic DNA
ctaaaggactccctacag

SEQ ID NO: 57290 - DNA, 18 bp, Artificial Sequence
  Synthetic DNA
ctaaatcttttactatag

SEQ ID NO: 57291 - DNA, 18 bp, Artificial Sequence
  Synthetic DNA
ctaatccacccaccattg

SEQ ID NO: 57292 - DNA, 18 bp, Artificial Sequence
  Synthetic DNA
ctacacggctcactttag

SEQ ID NO: 57293 - DNA, 18 bp, Artificial Sequence
  Synthetic DNA
ctagacattatcaaatag

SEQ ID NO: 57294 - DNA, 18 bp, Artificial Sequence
  Synthetic DNA
ctataaaacttactatag

SEQ ID NO: 57295 - DNA, 18 bp, Artificial Sequence
  Synthetic DNA
ctataagactctcttaag

SEQ ID NO: 57296 - DNA, 18 bp, Artificial Sequence
  Synthetic DNA
ctataagattcatttaag

SEQ ID NO: 57297 - DNA, 18 bp, Artificial Sequence
  Synthetic DNA
ctataagcctcacgatag

SEQ ID NO: 57298 - DNA, 18 bp, Artificial Sequence
  Synthetic DNA
ctatacaacttactattg

SEQ ID NO: 57299 - DNA, 18 bp, Artificial Sequence
  Synthetic DNA
ctatacaatccattattg

SEQ ID NO: 57300 - DNA, 18 bp, Artificial Sequence
  Synthetic DNA
ctataccacacacaatag

SEQ ID NO: 57301 - DNA, 18 bp, Artificial Sequence
  Synthetic DNA
ctatacctcacagtttcg

SEQ ID NO: 57302 - DNA, 18 bp, Artificial Sequence
  Synthetic DNA
ctatacgccacactatgg

SEQ ID NO: 57303 - DNA, 18 bp, Artificial Sequence
  Synthetic DNA
ctatacgccgcacacttg

SEQ ID NO: 57304 - DNA, 18 bp, Artificial Sequence
  Synthetic DNA
ctatacggctgacaatag

SEQ ID NO: 57305 - DNA, 18 bp, Artificial Sequence
  Synthetic DNA
ctatacgtctcttcatag

SEQ ID NO: 57306 - DNA, 18 bp, Artificial Sequence
  Synthetic DNA
ctatactatacactatag

SEQ ID NO: 57307 - DNA, 18 bp, Artificial Sequence
  Synthetic DNA
ctatactctacaatactg

SEQ ID NO: 57308 - DNA, 18 bp, Artificial Sequence
  Synthetic DNA
ctatacttctaagtacag

SEQ ID NO: 57309 - DNA, 18 bp, Artificial Sequence
  Synthetic DNA
ctataggacttactattg

SEQ ID NO: 57310 - DNA, 18 bp, Artificial Sequence
  Synthetic DNA
ctatatgactcacttaag

SEQ ID NO: 57311 - DNA, 18 bp, Artificial Sequence
  Synthetic DNA
ctatatgtttcacaattg

SEQ ID NO: 57312 - DNA, 18 bp, Artificial Sequence
  Synthetic DNA
ctatccaaccctaaatag

SEQ ID NO: 57313 - DNA, 18 bp, Artificial Sequence
  Synthetic DNA
ctatgcatctttgataag

SEQ ID NO: 57314 - DNA, 18 bp, Artificial Sequence
  Synthetic DNA
ctattacatacggtatag

SEQ ID NO: 57315 - DNA, 18 bp, Artificial Sequence
  Synthetic DNA
ctattccagtcagcatcg

SEQ ID NO: 57316 - DNA, 18 bp, Artificial Sequence
  Synthetic DNA
ctattcgacatactatag

SEQ ID NO: 57317 - DNA, 18 bp, Artificial Sequence
  Synthetic DNA
ctattcgagtcgctattg

SEQ ID NO: 57318 - DNA, 18 bp, Artificial Sequence
  Synthetic DNA
ctattcgattttctaaag

SEQ ID NO: 57319 - DNA, 18 bp, Artificial Sequence
  Synthetic DNA
ctattctagtcactatag

SEQ ID NO: 57320 - DNA, 18 bp, Artificial Sequence
  Synthetic DNA
ctatttgactcacaatag

SEQ ID NO: 57321 - DNA, 18 bp, Artificial Sequence
  Synthetic DNA
ctcatcggcacactatag

SEQ ID NO: 57322 - DNA, 18 bp, Artificial Sequence
  Synthetic DNA
ctccatggctcactaaag

SEQ ID NO: 57323 - DNA, 18 bp, Artificial Sequence
  Synthetic DNA
ctgaacgactcagtatag

SEQ ID NO: 57324 - DNA, 18 bp, Artificial Sequence
  Synthetic DNA
ctgttcgacttactatag

SEQ ID NO: 57325 - DNA, 18 bp, Artificial Sequence
  Synthetic DNA
cttaacgtctcactattg

SEQ ID NO: 57326 - DNA, 18 bp, Artificial Sequence
  Synthetic DNA
cttctcgactcactatag

SEQ ID NO: 57327 - DNA, 18 bp, Artificial Sequence
  Synthetic DNA
ctttacaactcactattg

SEQ ID NO: 57328 - DNA, 18 bp, Artificial Sequence
  Synthetic DNA
ctttacgacttactctcg

SEQ ID NO: 57329 - DNA, 18 bp, Artificial Sequence
  Synthetic DNA
ctttacgtctcactttag

SEQ ID NO: 57330 - DNA, 18 bp, Artificial Sequence
  Synthetic DNA
ctttatgtctcaatattg

SEQ ID NO: 57331 - DNA, 18 bp, Artificial Sequence
  Synthetic DNA
ctttgagactcataatag

SEQ ID NO: 57332 - DNA, 18 bp, Artificial Sequence
  Synthetic DNA
ctttgcgaacaaatatag

SEQ ID NO: 57333 - DNA, 18 bp, Artificial Sequence
  Synthetic DNA
cttttcgtcgcactattg

SEQ ID NO: 57334 - DNA, 18 bp, Artificial Sequence
  Synthetic DNA
gaaaatgaatcactaatg

SEQ ID NO: 57335 - DNA, 18 bp, Artificial Sequence
  Synthetic DNA
gaaaccgactcaaaatag

SEQ ID NO: 57336 - DNA, 18 bp, Artificial Sequence
  Synthetic DNA
gaaatgtactcactattg

SEQ ID NO: 57337 - DNA, 18 bp, Artificial Sequence
  Synthetic DNA
gaacacccctcgctaaag

SEQ ID NO: 57338 - DNA, 18 bp, Artificial Sequence
  Synthetic DNA
gaacatgcctcactaaag

SEQ ID NO: 57339 - DNA, 18 bp, Artificial Sequence
  Synthetic DNA
gaataagaatcacaagag

SEQ ID NO: 57340 - DNA, 18 bp, Artificial Sequence
  Synthetic DNA
gaataagacactgtatag

SEQ ID NO: 57341 - DNA, 18 bp, Artificial Sequence
  Synthetic DNA
gaataaggtacaatgaag

SEQ ID NO: 57342 - DNA, 18 bp, Artificial Sequence
  Synthetic DNA
gaatacaacttacggtag

SEQ ID NO: 57343 - DNA, 18 bp, Artificial Sequence
  Synthetic DNA
gaatacaattcaatactg

SEQ ID NO: 57344 - DNA, 18 bp, Artificial Sequence
  Synthetic DNA
gaatacaattgactattg

SEQ ID NO: 57345 - DNA, 18 bp, Artificial Sequence
  Synthetic DNA
gaatacgaaacacaattg

SEQ ID NO: 57346 - DNA, 18 bp, Artificial Sequence
  Synthetic DNA
gaatacgaatcataagag

SEQ ID NO: 57347 - DNA, 18 bp, Artificial Sequence
  Synthetic DNA
gaatacgccaccgtatag

SEQ ID NO: 57348 - DNA, 18 bp, Artificial Sequence
  Synthetic DNA
gaatactacactctttag

SEQ ID NO: 57349 - DNA, 18 bp, Artificial Sequence
  Synthetic DNA
gaatagaactttttaaag

SEQ ID NO: 57350 - DNA, 18 bp, Artificial Sequence
  Synthetic DNA
gaataggaatcacgctag

SEQ ID NO: 57351 - DNA, 18 bp, Artificial Sequence
  Synthetic DNA
gaatatgagtctctatcg

SEQ ID NO: 57352 - DNA, 18 bp, Artificial Sequence
  Synthetic DNA
gaatccttctcaaagtag

SEQ ID NO: 57353 - DNA, 18 bp, Artificial Sequence
  Synthetic DNA
gaatgtaactcactaaag

SEQ ID NO: 57354 - DNA, 18 bp, Artificial Sequence
  Synthetic DNA
gaattcgagtttctacag

SEQ ID NO: 57355 - DNA, 18 bp, Artificial Sequence
  Synthetic DNA
gaattcgtctcaatagag

SEQ ID NO: 57356 - DNA, 18 bp, Artificial Sequence
  Synthetic DNA
gaattcttctccaaatag

SEQ ID NO: 57357 - DNA, 18 bp, Artificial Sequence
  Synthetic DNA
gacaccaccttataatag

SEQ ID NO: 57358 - DNA, 18 bp, Artificial Sequence
  Synthetic DNA
gactacgactcttcatag

SEQ ID NO: 57359 - DNA, 18 bp, Artificial Sequence
  Synthetic DNA
gactatgactccctctag

SEQ ID NO: 57360 - DNA, 18 bp, Artificial Sequence
  Synthetic DNA
gagtactaatcacaaatg

SEQ ID NO: 57361 - DNA, 18 bp, Artificial Sequence
  Synthetic DNA
gagtatgactagatttag

SEQ ID NO: 57362 - DNA, 18 bp, Artificial Sequence
  Synthetic DNA
gagtatgactctctaaag

SEQ ID NO: 57363 - DNA, 18 bp, Artificial Sequence
  Synthetic DNA
gagtatgattaaccattg

SEQ ID NO: 57364 - DNA, 18 bp, Artificial Sequence
  Synthetic DNA
gagttctattcattaaag

SEQ ID NO: 57365 - DNA, 18 bp, Artificial Sequence
  Synthetic DNA
gattacaaatctctaccg

SEQ ID NO: 57366 - DNA, 18 bp, Artificial Sequence
  Synthetic DNA
gattacctctctcgattg

SEQ ID NO: 57367 - DNA, 18 bp, Artificial Sequence
  Synthetic DNA
gattacgactctcaattg

SEQ ID NO: 57368 - DNA, 18 bp, Artificial Sequence
  Synthetic DNA
gattatagctcacagaag

SEQ ID NO: 57369 - DNA, 18 bp, Artificial Sequence
  Synthetic DNA
gatttcgaatagtaatag

SEQ ID NO: 57370 - DNA, 18 bp, Artificial Sequence
  Synthetic DNA
gatttctactcgctttag

SEQ ID NO: 57371 - DNA, 18 bp, Artificial Sequence
  Synthetic DNA
gatttgcacacactatcg

SEQ ID NO: 57372 - DNA, 18 bp, Artificial Sequence
  Synthetic DNA
gcatacatctggctatag

SEQ ID NO: 57373 - DNA, 18 bp, Artificial Sequence
  Synthetic DNA
gcatacgactcatcaatg

SEQ ID NO: 57374 - DNA, 18 bp, Artificial Sequence
  Synthetic DNA
gcctggtagtctccatag

SEQ ID NO: 57375 - DNA, 18 bp, Artificial Sequence
  Synthetic DNA
gcttacggttcactatag

SEQ ID NO: 57376 - DNA, 18 bp, Artificial Sequence
  Synthetic DNA
gctttccactcaacttag

SEQ ID NO: 57377 - DNA, 18 bp, Artificial Sequence
  Synthetic DNA
ggcaacaactcacttaag

SEQ ID NO: 57378 - DNA, 18 bp, Artificial Sequence
  Synthetic DNA
gggaacggccctctaaag

SEQ ID NO: 57379 - DNA, 18 bp, Artificial Sequence
  Synthetic DNA
ggttccgtctcactatag

SEQ ID NO: 57380 - DNA, 18 bp, Artificial Sequence
  Synthetic DNA
gtaaaagactcattaaag

SEQ ID NO: 57381 - DNA, 18 bp, Artificial Sequence
  Synthetic DNA
gtaaacgattcacgttag

SEQ ID NO: 57382 - DNA, 18 bp, Artificial Sequence
  Synthetic DNA
gtacacgactaactaaag

SEQ ID NO: 57383 - DNA, 18 bp, Artificial Sequence
  Synthetic DNA
gtacacgactcatagtag

SEQ ID NO: 57384 - DNA, 18 bp, Artificial Sequence
  Synthetic DNA
gtataagtctctcattag

SEQ ID NO: 57385 - DNA, 18 bp, Artificial Sequence
  Synthetic DNA
gtatacaatttccttcag

SEQ ID NO: 57386 - DNA, 18 bp, Artificial Sequence
  Synthetic DNA
gtatacgagccactaaag

SEQ ID NO: 57387 - DNA, 18 bp, Artificial Sequence
  Synthetic DNA
gtatacggcacaatatag

SEQ ID NO: 57388 - DNA, 18 bp, Artificial Sequence
  Synthetic DNA
gtatatgactcagtgaag

SEQ ID NO: 57389 - DNA, 18 bp, Artificial Sequence
  Synthetic DNA
gtattcgaatcactctgg

SEQ ID NO: 57390 - DNA, 18 bp, Artificial Sequence
  Synthetic DNA
gtattcgtctcattatag

SEQ ID NO: 57391 - DNA, 18 bp, Artificial Sequence
  Synthetic DNA
gtattcttgtcactattg

SEQ ID NO: 57392 - DNA, 18 bp, Artificial Sequence
  Synthetic DNA
gtatttggctcataatag

SEQ ID NO: 57393 - DNA, 18 bp, Artificial Sequence
  Synthetic DNA
gttaatgatttactatag

SEQ ID NO: 57394 - DNA, 18 bp, Artificial Sequence
  Synthetic DNA
gtttaagaacaactatag

SEQ ID NO: 57395 - DNA, 18 bp, Artificial Sequence
  Synthetic DNA
gtttataactcactatcg

SEQ ID NO: 57396 - DNA, 18 bp, Artificial Sequence
  Synthetic DNA
taaaaacagtcactattg

SEQ ID NO: 57397 - DNA, 18 bp, Artificial Sequence
  Synthetic DNA
taaaaagacaccctaaag

SEQ ID NO: 57398 - DNA, 18 bp, Artificial Sequence
  Synthetic DNA
taaaaagacactttaaag

SEQ ID NO: 57399 - DNA, 18 bp, Artificial Sequence
  Synthetic DNA
taaaaagactcgttaatg

SEQ ID NO: 57400 - DNA, 18 bp, Artificial Sequence
  Synthetic DNA
taaaaagacttactgttg

SEQ ID NO: 57401 - DNA, 18 bp, Artificial Sequence
  Synthetic DNA
taaaaagattatcaatag

SEQ ID NO: 57402 - DNA, 18 bp, Artificial Sequence
  Synthetic DNA
taaaaagattccctaaag

SEQ ID NO: 57403 - DNA, 18 bp, Artificial Sequence
  Synthetic DNA
taaaaagatttacttcag

SEQ ID NO: 57404 - DNA, 18 bp, Artificial Sequence
  Synthetic DNA
taaaaagtatcaatttag

SEQ ID NO: 57405 - DNA, 18 bp, Artificial Sequence
  Synthetic DNA
taaaaatactcggtatag

SEQ ID NO: 57406 - DNA, 18 bp, Artificial Sequence
  Synthetic DNA
taaaaatactctttatag

SEQ ID NO: 57407 - DNA, 18 bp, Artificial Sequence
  Synthetic DNA
taaaaattctctctatag

SEQ ID NO: 57408 - DNA, 18 bp, Artificial Sequence
  Synthetic DNA
taaaacaacacactgttg

SEQ ID NO: 57409 - DNA, 18 bp, Artificial Sequence
  Synthetic DNA
taaaacaacgaacgatag

SEQ ID NO: 57410 - DNA, 18 bp, Artificial Sequence
  Synthetic DNA
taaaacaactcaccttgg

SEQ ID NO: 57411 - DNA, 18 bp, Artificial Sequence
  Synthetic DNA
taaaacaactcttattag

SEQ ID NO: 57412 - DNA, 18 bp, Artificial Sequence
  Synthetic DNA
taaaacatcacaatatag

SEQ ID NO: 57413 - DNA, 18 bp, Artificial Sequence
  Synthetic DNA
taaaacatttctcttaag

SEQ ID NO: 57414 - DNA, 18 bp, Artificial Sequence
  Synthetic DNA
taaaaccacacatttacg

SEQ ID NO: 57415 - DNA, 18 bp, Artificial Sequence
  Synthetic DNA
taaaaccactagccatag

SEQ ID NO: 57416 - DNA, 18 bp, Artificial Sequence
  Synthetic DNA
taaaaccactcaaattag

SEQ ID NO: 57417 - DNA, 18 bp, Artificial Sequence
  Synthetic DNA
taaaaccattaacaatag

SEQ ID NO: 57418 - DNA, 18 bp, Artificial Sequence
  Synthetic DNA
taaaacccctctcaatag

SEQ ID NO: 57419 - DNA, 18 bp, Artificial Sequence
  Synthetic DNA
taaaaccggtcacaagag

SEQ ID NO: 57420 - DNA, 18 bp, Artificial Sequence
  Synthetic DNA
taaaaccgttccgtatag

SEQ ID NO: 57421 - DNA, 18 bp, Artificial Sequence
  Synthetic DNA
taaaacctctctcaacag

SEQ ID NO: 57422 - DNA, 18 bp, Artificial Sequence
  Synthetic DNA
taaaacgaattattttag

SEQ ID NO: 57423 - DNA, 18 bp, Artificial Sequence
  Synthetic DNA
taaaacgacacgcttttg

SEQ ID NO: 57424 - DNA, 18 bp, Artificial Sequence
  Synthetic DNA
taaaacgacagtataaag

SEQ ID NO: 57425 - DNA, 18 bp, Artificial Sequence
  Synthetic DNA
taaaacgacagtcaatag

SEQ ID NO: 57426 - DNA, 18 bp, Artificial Sequence
  Synthetic DNA
taaaacgacatcttatag

SEQ ID NO: 57427 - DNA, 18 bp, Artificial Sequence
  Synthetic DNA
taaaacgactctctgatg

SEQ ID NO: 57428 - DNA, 18 bp, Artificial Sequence
  Synthetic DNA
taaaacgactctgttttg

SEQ ID NO: 57429 - DNA, 18 bp, Artificial Sequence
  Synthetic DNA
taaaacgactgacaagtg

SEQ ID NO: 57430 - DNA, 18 bp, Artificial Sequence
  Synthetic DNA
taaaacgagtgactccag

SEQ ID NO: 57431 - DNA, 18 bp, Artificial Sequence
  Synthetic DNA
taaaacgatacattcttg

SEQ ID NO: 57432 - DNA, 18 bp, Artificial Sequence
  Synthetic DNA
taaaacgattaactaatg

SEQ ID NO: 57433 - DNA, 18 bp, Artificial Sequence
  Synthetic DNA
taaaacgattcaccgaag

SEQ ID NO: 57434 - DNA, 18 bp, Artificial Sequence
  Synthetic DNA
taaaacgattcagtgatg

SEQ ID NO: 57435 - DNA, 18 bp, Artificial Sequence
  Synthetic DNA
taaaacgattcgcagttg

SEQ ID NO: 57436 - DNA, 18 bp, Artificial Sequence
  Synthetic DNA
taaaacgatttcccatag

SEQ ID NO: 57437 - DNA, 18 bp, Artificial Sequence
  Synthetic DNA
taaaacgccaaaccaaag

SEQ ID NO: 57438 - DNA, 18 bp, Artificial Sequence
  Synthetic DNA
taaaacgcccgattatag

SEQ ID NO: 57439 - DNA, 18 bp, Artificial Sequence
  Synthetic DNA
taaaacgcgtcgctattg

SEQ ID NO: 57440 - DNA, 18 bp, Artificial Sequence
  Synthetic DNA
taaaacgcttcactaatg

SEQ ID NO: 57441 - DNA, 18 bp, Artificial Sequence
  Synthetic DNA
taaaacgctttcccatcg

SEQ ID NO: 57442 - DNA, 18 bp, Artificial Sequence
  Synthetic DNA
taaaacggtacaatatag

SEQ ID NO: 57443 - DNA, 18 bp, Artificial Sequence
  Synthetic DNA
taaaacgtcactctaaag

SEQ ID NO: 57444 - DNA, 18 bp, Artificial Sequence
  Synthetic DNA
taaaacgtctaactgtgg

SEQ ID NO: 57445 - DNA, 18 bp, Artificial Sequence
  Synthetic DNA
taaaacgtctccttttag

SEQ ID NO: 57446 - DNA, 18 bp, Artificial Sequence
  Synthetic DNA
taaaacgtctgactcgag

SEQ ID NO: 57447 - DNA, 18 bp, Artificial Sequence
  Synthetic DNA
taaaacgtctttcaatgg

SEQ ID NO: 57448 - DNA, 18 bp, Artificial Sequence
  Synthetic DNA
taaaactacccatttaag

SEQ ID NO: 57449 - DNA, 18 bp, Artificial Sequence
  Synthetic DNA
taaaactagtctcaatag

SEQ ID NO: 57450 - DNA, 18 bp, Artificial Sequence
  Synthetic DNA
taaaactattctcattcg

SEQ ID NO: 57451 - DNA, 18 bp, Artificial Sequence
  Synthetic DNA
taaaactatttattctcg

SEQ ID NO: 57452 - DNA, 18 bp, Artificial Sequence
  Synthetic DNA
taaaactgctaagtaaag

SEQ ID NO: 57453 - DNA, 18 bp, Artificial Sequence
  Synthetic DNA
taaaactgctctttatag

SEQ ID NO: 57454 - DNA, 18 bp, Artificial Sequence
  Synthetic DNA
taaaacttctcactacgg

SEQ ID NO: 57455 - DNA, 18 bp, Artificial Sequence
  Synthetic DNA
taaaaggactatcagtag

SEQ ID NO: 57456 - DNA, 18 bp, Artificial Sequence
  Synthetic DNA
taaaaggactctcaaacg

SEQ ID NO: 57457 - DNA, 18 bp, Artificial Sequence
  Synthetic DNA
taaaagtaataactatag

SEQ ID NO: 57458 - DNA, 18 bp, Artificial Sequence
  Synthetic DNA
taaaataactcaccattg

SEQ ID NO: 57459 - DNA, 18 bp, Artificial Sequence
  Synthetic DNA
taaaataactcatagtag

SEQ ID NO: 57460 - DNA, 18 bp, Artificial Sequence
  Synthetic DNA
taaaatgacaaaacttag

SEQ ID NO: 57461 - DNA, 18 bp, Artificial Sequence
  Synthetic DNA
taaaatgactaaccgtgg

SEQ ID NO: 57462 - DNA, 18 bp, Artificial Sequence
  Synthetic DNA
taaaatgactcaacaaag

SEQ ID NO: 57463 - DNA, 18 bp, Artificial Sequence
  Synthetic DNA
taaaatgactcattcaag

SEQ ID NO: 57464 - DNA, 18 bp, Artificial Sequence
  Synthetic DNA
taaaatgactctgtatgg

SEQ ID NO: 57465 - DNA, 18 bp, Artificial Sequence
  Synthetic DNA
taaaatggctcgttaaag

SEQ ID NO: 57466 - DNA, 18 bp, Artificial Sequence
  Synthetic DNA
taaaatggctgccaaaag

SEQ ID NO: 57467 - DNA, 18 bp, Artificial Sequence
  Synthetic DNA
taaaatgtctcacgattg

SEQ ID NO: 57468 - DNA, 18 bp, Artificial Sequence
  Synthetic DNA
taaaattactcactgaag

SEQ ID NO: 57469 - DNA, 18 bp, Artificial Sequence
  Synthetic DNA
taaacagtctcactaaag

SEQ ID NO: 57470 - DNA, 18 bp, Artificial Sequence
  Synthetic DNA
taaacattctcactatag

SEQ ID NO: 57471 - DNA, 18 bp, Artificial Sequence
  Synthetic DNA
taaacccacacactttcg

SEQ ID NO: 57472 - DNA, 18 bp, Artificial Sequence
  Synthetic DNA
taaacccatttagattag

SEQ ID NO: 57473 - DNA, 18 bp, Artificial Sequence
  Synthetic DNA
taaaccgaatctatattg

SEQ ID NO: 57474 - DNA, 18 bp, Artificial Sequence
  Synthetic DNA
taaaccgaattaatataa

SEQ ID NO: 57475 - DNA, 18 bp, Artificial Sequence
  Synthetic DNA
taaaccgaccatcaatag

SEQ ID NO: 57476 - DNA, 18 bp, Artificial Sequence
  Synthetic DNA
taaaccgactcagtgaag

SEQ ID NO: 57477 - DNA, 18 bp, Artificial Sequence
  Synthetic DNA
taaaccgactctctacgg

SEQ ID NO: 57478 - DNA, 18 bp, Artificial Sequence
  Synthetic DNA
taaaccgattcacttaag

SEQ ID NO: 57479 - DNA, 18 bp, Artificial Sequence
  Synthetic DNA
taaaccgtctgaatattg

SEQ ID NO: 57480 - DNA, 18 bp, Artificial Sequence
  Synthetic DNA
taaacggactctatatag

SEQ ID NO: 57481 - DNA, 18 bp, Artificial Sequence
  Synthetic DNA
taaacggactttctatag

SEQ ID NO: 57482 - DNA, 18 bp, Artificial Sequence
  Synthetic DNA
taaactaacatacaatag

SEQ ID NO: 57483 - DNA, 18 bp, Artificial Sequence
  Synthetic DNA
taaactgactcactcttg

SEQ ID NO: 57484 - DNA, 18 bp, Artificial Sequence
  Synthetic DNA
taaactgacttactattg

SEQ ID NO: 57485 - DNA, 18 bp, Artificial Sequence
  Synthetic DNA
taaagagactaaccatag

SEQ ID NO: 57486 - DNA, 18 bp, Artificial Sequence
  Synthetic DNA
taaagagactcaatcaag

SEQ ID NO: 57487 - DNA, 18 bp, Artificial Sequence
  Synthetic DNA
taaagagatttactatag

SEQ ID NO: 57488 - DNA, 18 bp, Artificial Sequence
  Synthetic DNA
taaagcaaatttaaatag

SEQ ID NO: 57489 - DNA, 18 bp, Artificial Sequence
  Synthetic DNA
taaagcgaaacgatatag

SEQ ID NO: 57490 - DNA, 18 bp, Artificial Sequence
  Synthetic DNA
taaagcgaagcacttcag

SEQ ID NO: 57491 - DNA, 18 bp, Artificial Sequence
  Synthetic DNA
taaagcgacataaaatag

SEQ ID NO: 57492 - DNA, 18 bp, Artificial Sequence
  Synthetic DNA
taaagcgactgacaaaag

SEQ ID NO: 57493 - DNA, 18 bp, Artificial Sequence
  Synthetic DNA
taaagcgatactctctag

SEQ ID NO: 57494 - DNA, 18 bp, Artificial Sequence
  Synthetic DNA
taaagcgtctcactaacg

SEQ ID NO: 57495 - DNA, 18 bp, Artificial Sequence
  Synthetic DNA
taaagcgtgtaactatag

SEQ ID NO: 57496 - DNA, 18 bp, Artificial Sequence
  Synthetic DNA
taaagctactcaccaaag

SEQ ID NO: 57497 - DNA, 18 bp, Artificial Sequence
  Synthetic DNA
taaagctagtgactaatg

SEQ ID NO: 57498 - DNA, 18 bp, Artificial Sequence
  Synthetic DNA
taaagctcatcactatag

SEQ ID NO: 57499 - DNA, 18 bp, Artificial Sequence
  Synthetic DNA
taaagggtttaactttag

SEQ ID NO: 57500 - DNA, 18 bp, Artificial Sequence
  Synthetic DNA
taaagtgtcttgctatgg

SEQ ID NO: 57501 - DNA, 18 bp, Artificial Sequence
  Synthetic DNA
taaataagttcagtatag

SEQ ID NO: 57502 - DNA, 18 bp, Artificial Sequence
  Synthetic DNA
taaatacactcacaatcg

SEQ ID NO: 57503 - DNA, 18 bp, Artificial Sequence
  Synthetic DNA
taaatagactcgctaaag

SEQ ID NO: 57504 - DNA, 18 bp, Artificial Sequence
  Synthetic DNA
taaataggctgtctaaag

SEQ ID NO: 57505 - DNA, 18 bp, Artificial Sequence
  Synthetic DNA
taaatatacactctatag

SEQ ID NO: 57506 - DNA, 18 bp, Artificial Sequence
  Synthetic DNA
taaatcaaccaactttag

SEQ ID NO: 57507 - DNA, 18 bp, Artificial Sequence
  Synthetic DNA
taaatcaactcaatattg

SEQ ID NO: 57508 - DNA, 18 bp, Artificial Sequence
  Synthetic DNA
taaatcaactcttaaaag

SEQ ID NO: 57509 - DNA, 18 bp, Artificial Sequence
  Synthetic DNA
taaatccactaacaacag

SEQ ID NO: 57510 - DNA, 18 bp, Artificial Sequence
  Synthetic DNA
taaatccagtcatttttg

SEQ ID NO: 57511 - DNA, 18 bp, Artificial Sequence
  Synthetic DNA
taaatcctacttctatag

SEQ ID NO: 57512 - DNA, 18 bp, Artificial Sequence
  Synthetic DNA
taaatcgaatcacttaag

SEQ ID NO: 57513 - DNA, 18 bp, Artificial Sequence
  Synthetic DNA
taaatcgaattactaaag

SEQ ID NO: 57514 - DNA, 18 bp, Artificial Sequence
  Synthetic DNA
taaatcgacacacttttg

SEQ ID NO: 57515 - DNA, 18 bp, Artificial Sequence
  Synthetic DNA
taaatcgactcacactcg

SEQ ID NO: 57516 - DNA, 18 bp, Artificial Sequence
  Synthetic DNA
taaatcgactcacttacg

SEQ ID NO: 57517 - DNA, 18 bp, Artificial Sequence
  Synthetic DNA
taaatcgactgattttag

SEQ ID NO: 57518 - DNA, 18 bp, Artificial Sequence
  Synthetic DNA
taaatcgcaacactatcg

SEQ ID NO: 57519 - DNA, 18 bp, Artificial Sequence
  Synthetic DNA
taaatcgccacattaaag

SEQ ID NO: 57520 - DNA, 18 bp, Artificial Sequence
  Synthetic DNA
taaatcggatcactattg

SEQ ID NO: 57521 - DNA, 18 bp, Artificial Sequence
  Synthetic DNA
taaatcggcatactctag

SEQ ID NO: 57522 - DNA, 18 bp, Artificial Sequence
  Synthetic DNA
taaatcggctcaatttag

SEQ ID NO: 57523 - DNA, 18 bp, Artificial Sequence
  Synthetic DNA
taaatcggctcgttatag

SEQ ID NO: 57524 - DNA, 18 bp, Artificial Sequence
  Synthetic DNA
taaatcggttcactaaag

SEQ ID NO: 57525 - DNA, 18 bp, Artificial Sequence
  Synthetic DNA
taaatcgtctaactatgg

SEQ ID NO: 57526 - DNA, 18 bp, Artificial Sequence
  Synthetic DNA
taaatcgtttctatatag

SEQ ID NO: 57527 - DNA, 18 bp, Artificial Sequence
  Synthetic DNA
taaatctatacacttaag

SEQ ID NO: 57528 - DNA, 18 bp, Artificial Sequence
  Synthetic DNA
taaatctcatcactatag

SEQ ID NO: 57529 - DNA, 18 bp, Artificial Sequence
  Synthetic DNA
taaatcttctcactttag

SEQ ID NO: 57530 - DNA, 18 bp, Artificial Sequence
  Synthetic DNA
taaatgaactctgtgtag

SEQ ID NO: 57531 - DNA, 18 bp, Artificial Sequence
  Synthetic DNA
taaatggagtcgcttaag

SEQ ID NO: 57532 - DNA, 18 bp, Artificial Sequence
  Synthetic DNA
taaattgactcaaaatag

SEQ ID NO: 57533 - DNA, 18 bp, Artificial Sequence
  Synthetic DNA
taaattgattctatttag

SEQ ID NO: 57534 - DNA, 18 bp, Artificial Sequence
  Synthetic DNA
taaattgtctcactaaag

SEQ ID NO: 57535 - DNA, 18 bp, Artificial Sequence
  Synthetic DNA
taaattgtcttgatattg

SEQ ID NO: 57536 - DNA, 18 bp, Artificial Sequence
  Synthetic DNA
taacaaaactcactaatg

SEQ ID NO: 57537 - DNA, 18 bp, Artificial Sequence
  Synthetic DNA
taacaacacactctatag

SEQ ID NO: 57538 - DNA, 18 bp, Artificial Sequence
  Synthetic DNA
taacaagactcataacag

SEQ ID NO: 57539 - DNA, 18 bp, Artificial Sequence
  Synthetic DNA
taacaagtcccagtatag

SEQ ID NO: 57540 - DNA, 18 bp, Artificial Sequence
  Synthetic DNA
taacaagtctctatgtag

SEQ ID NO: 57541 - DNA, 18 bp, Artificial Sequence
  Synthetic DNA
taacaagtttcaagattg

SEQ ID NO: 57542 - DNA, 18 bp, Artificial Sequence
  Synthetic DNA
taacacaaataactaatg

SEQ ID NO: 57543 - DNA, 18 bp, Artificial Sequence
  Synthetic DNA
taacacaaattattatag

SEQ ID NO: 57544 - DNA, 18 bp, Artificial Sequence
  Synthetic DNA
taacacaacaccttaaag

SEQ ID NO: 57545 - DNA, 18 bp, Artificial Sequence
  Synthetic DNA
taacacaacatacaattg

SEQ ID NO: 57546 - DNA, 18 bp, Artificial Sequence
  Synthetic DNA
taacacaacctactattg

SEQ ID NO: 57547 - DNA, 18 bp, Artificial Sequence
  Synthetic DNA
taacacaactcgttatgg

SEQ ID NO: 57548 - DNA, 18 bp, Artificial Sequence
  Synthetic DNA
taacaccacccattattg

SEQ ID NO: 57549 - DNA, 18 bp, Artificial Sequence
  Synthetic DNA
taacaccactctcataag

SEQ ID NO: 57550 - DNA, 18 bp, Artificial Sequence
  Synthetic DNA
taacaccactgttcatag

SEQ ID NO: 57551 - DNA, 18 bp, Artificial Sequence
  Synthetic DNA
taacaccactttacatag

SEQ ID NO: 57552 - DNA, 18 bp, Artificial Sequence
  Synthetic DNA
taacaccagtcccaattg

SEQ ID NO: 57553 - DNA, 18 bp, Artificial Sequence
  Synthetic DNA
taacacgaatgatcttag

SEQ ID NO: 57554 - DNA, 18 bp, Artificial Sequence
  Synthetic DNA
taacacgaattagtttag

SEQ ID NO: 57555 - DNA, 18 bp, Artificial Sequence
  Synthetic DNA
taacacgacaagctacag

SEQ ID NO: 57556 - DNA, 18 bp, Artificial Sequence
  Synthetic DNA
taacacgacataataaag

SEQ ID NO: 57557 - DNA, 18 bp, Artificial Sequence
  Synthetic DNA
taacacgacattctacag

SEQ ID NO: 57558 - DNA, 18 bp, Artificial Sequence
  Synthetic DNA
taacacgactgaccaagg

SEQ ID NO: 57559 - DNA, 18 bp, Artificial Sequence
  Synthetic DNA
taacacgacttaataatg

SEQ ID NO: 57560 - DNA, 18 bp, Artificial Sequence
  Synthetic DNA
taacacgagacaaaatag

SEQ ID NO: 57561 - DNA, 18 bp, Artificial Sequence
  Synthetic DNA
taacacgagtctcttttg

SEQ ID NO: 57562 - DNA, 18 bp, Artificial Sequence
  Synthetic DNA
taacacgattctgtttag

SEQ ID NO: 57563 - DNA, 18 bp, Artificial Sequence
  Synthetic DNA
taacacgattttcttttg

SEQ ID NO: 57564 - DNA, 18 bp, Artificial Sequence
  Synthetic DNA
taacacggcatacaattg

SEQ ID NO: 57565 - DNA, 18 bp, Artificial Sequence
  Synthetic DNA
taacacgggtagatcaag

SEQ ID NO: 57566 - DNA, 18 bp, Artificial Sequence
  Synthetic DNA
taacacggttcactcgag

SEQ ID NO: 57567 - DNA, 18 bp, Artificial Sequence
  Synthetic DNA
taacacgtcacaccttag

SEQ ID NO: 57568 - DNA, 18 bp, Artificial Sequence
  Synthetic DNA
taacacgttcctgtatag

SEQ ID NO: 57569 - DNA, 18 bp, Artificial Sequence
  Synthetic DNA
taacactataccctaaag

SEQ ID NO: 57570 - DNA, 18 bp, Artificial Sequence
  Synthetic DNA
taacacttctctatattg

SEQ ID NO: 57571 - DNA, 18 bp, Artificial Sequence
  Synthetic DNA
taacagctctcacactag

SEQ ID NO: 57572 - DNA, 18 bp, Artificial Sequence
  Synthetic DNA
taacagttctcatgatag

SEQ ID NO: 57573 - DNA, 18 bp, Artificial Sequence
  Synthetic DNA
taacataaagctcaatcg

SEQ ID NO: 57574 - DNA, 18 bp, Artificial Sequence
  Synthetic DNA
taacatcttttattatag

SEQ ID NO: 57575 - DNA, 18 bp, Artificial Sequence
  Synthetic DNA
taacatgacttaatacag

SEQ ID NO: 57576 - DNA, 18 bp, Artificial Sequence
  Synthetic DNA
taacatgatacactatgg

SEQ ID NO: 57577 - DNA, 18 bp, Artificial Sequence
  Synthetic DNA
taacatgattaacattag

SEQ ID NO: 57578 - DNA, 18 bp, Artificial Sequence
  Synthetic DNA
taacatgtataactatag

SEQ ID NO: 57579 - DNA, 18 bp, Artificial Sequence
  Synthetic DNA
taacatgtctatgcagtg

SEQ ID NO: 57580 - DNA, 18 bp, Artificial Sequence
  Synthetic DNA
taacatgtgtctaaagag

SEQ ID NO: 57581 - DNA, 18 bp, Artificial Sequence
  Synthetic DNA
taacattatttactttag

SEQ ID NO: 57582 - DNA, 18 bp, Artificial Sequence
  Synthetic DNA
taacatttctcattatag

SEQ ID NO: 57583 - DNA, 18 bp, Artificial Sequence
  Synthetic DNA
taaccagactcactttcg

SEQ ID NO: 57584 - DNA, 18 bp, Artificial Sequence
  Synthetic DNA
taaccagactctgaattg

SEQ ID NO: 57585 - DNA, 18 bp, Artificial Sequence
  Synthetic DNA
taaccagtcaatctatag

SEQ ID NO: 57586 - DNA, 18 bp, Artificial Sequence
  Synthetic DNA
taacccgattcaacatag

SEQ ID NO: 57587 - DNA, 18 bp, Artificial Sequence
  Synthetic DNA
taacccggcttacaattg

SEQ ID NO: 57588 - DNA, 18 bp, Artificial Sequence
  Synthetic DNA
taactagacccacattag

SEQ ID NO: 57589 - DNA, 18 bp, Artificial Sequence
  Synthetic DNA
taactagtttcacaattg

SEQ ID NO: 57590 - DNA, 18 bp, Artificial Sequence
  Synthetic DNA
taactcaccttactactg

SEQ ID NO: 57591 - DNA, 18 bp, Artificial Sequence
  Synthetic DNA
taactcatctcacgtttg

SEQ ID NO: 57592 - DNA, 18 bp, Artificial Sequence
  Synthetic DNA
taactcgaatcattattg

SEQ ID NO: 57593 - DNA, 18 bp, Artificial Sequence
  Synthetic DNA
taactcgactaagtgctg

SEQ ID NO: 57594 - DNA, 18 bp, Artificial Sequence
  Synthetic DNA
taactcgactctcttttg

SEQ ID NO: 57595 - DNA, 18 bp, Artificial Sequence
  Synthetic DNA
taactcgattaaccatag

SEQ ID NO: 57596 - DNA, 18 bp, Artificial Sequence
  Synthetic DNA
taactcgattgactaatg

SEQ ID NO: 57597 - DNA, 18 bp, Artificial Sequence
  Synthetic DNA
taactcgtcccattaaag

SEQ ID NO: 57598 - DNA, 18 bp, Artificial Sequence
  Synthetic DNA
taactcgtctaacattag

SEQ ID NO: 57599 - DNA, 18 bp, Artificial Sequence
  Synthetic DNA
taactcgtctaattatag

SEQ ID NO: 57600 - DNA, 18 bp, Artificial Sequence
  Synthetic DNA
taactcgttttactatag

SEQ ID NO: 57601 - DNA, 18 bp, Artificial Sequence
  Synthetic DNA
taactctactcacaactg

SEQ ID NO: 57602 - DNA, 18 bp, Artificial Sequence
  Synthetic DNA
taactctactcccttaag

SEQ ID NO: 57603 - DNA, 18 bp, Artificial Sequence
  Synthetic DNA
taactctattcattatag

SEQ ID NO: 57604 - DNA, 18 bp, Artificial Sequence
  Synthetic DNA
taactcttctgactaaag

SEQ ID NO: 57605 - DNA, 18 bp, Artificial Sequence
  Synthetic DNA
taactggtctcacaatcg

SEQ ID NO: 57606 - DNA, 18 bp, Artificial Sequence
  Synthetic DNA
taagaagttactctatag

SEQ ID NO: 57607 - DNA, 18 bp, Artificial Sequence
  Synthetic DNA
taagaatactctctacag

SEQ ID NO: 57608 - DNA, 18 bp, Artificial Sequence
  Synthetic DNA
taagacaactttcttaag

SEQ ID NO: 57609 - DNA, 18 bp, Artificial Sequence
  Synthetic DNA
taagaccactgtctttag

SEQ ID NO: 57610 - DNA, 18 bp, Artificial Sequence
  Synthetic DNA
taagacgactccattaag

SEQ ID NO: 57611 - DNA, 18 bp, Artificial Sequence
  Synthetic DNA
taagacgactctacaaag

SEQ ID NO: 57612 - DNA, 18 bp, Artificial Sequence
  Synthetic DNA
taagacgataaacaaaag

SEQ ID NO: 57613 - DNA, 18 bp, Artificial Sequence
  Synthetic DNA
taagacggttctttatcg

SEQ ID NO: 57614 - DNA, 18 bp, Artificial Sequence
  Synthetic DNA
taagacgtatagctatag

SEQ ID NO: 57615 - DNA, 18 bp, Artificial Sequence
  Synthetic DNA
taagacgtatcataatag

SEQ ID NO: 57616 - DNA, 18 bp, Artificial Sequence
  Synthetic DNA
taagacgtatgtcttttg

SEQ ID NO: 57617 - DNA, 18 bp, Artificial Sequence
  Synthetic DNA
taagacgtctcgcacaag

SEQ ID NO: 57618 - DNA, 18 bp, Artificial Sequence
  Synthetic DNA
taagacgtctcgccattg

SEQ ID NO: 57619 - DNA, 18 bp, Artificial Sequence
  Synthetic DNA
taagacgttttactattg

SEQ ID NO: 57620 - DNA, 18 bp, Artificial Sequence
  Synthetic DNA
taagactactcagtaccg

SEQ ID NO: 57621 - DNA, 18 bp, Artificial Sequence
  Synthetic DNA
taagacttcccaatatag

SEQ ID NO: 57622 - DNA, 18 bp, Artificial Sequence
  Synthetic DNA
taagagcactgaccatgg

SEQ ID NO: 57623 - DNA, 18 bp, Artificial Sequence
  Synthetic DNA
taagaggactctatggag

SEQ ID NO: 57624 - DNA, 18 bp, Artificial Sequence
  Synthetic DNA
taagagtcctcactaaag

SEQ ID NO: 57625 - DNA, 18 bp, Artificial Sequence
  Synthetic DNA
taagataactctctattg

SEQ ID NO: 57626 - DNA, 18 bp, Artificial Sequence
  Synthetic DNA
taagatgacgcaatctag

SEQ ID NO: 57627 - DNA, 18 bp, Artificial Sequence
  Synthetic DNA
taagccgaatcataatag

SEQ ID NO: 57628 - DNA, 18 bp, Artificial Sequence
  Synthetic DNA
taagccgacttacttttg

SEQ ID NO: 57629 - DNA, 18 bp, Artificial Sequence
  Synthetic DNA
taagcctattcactattg

SEQ ID NO: 57630 - DNA, 18 bp, Artificial Sequence
  Synthetic DNA
taagctgactcaccattg

SEQ ID NO: 57631 - DNA, 18 bp, Artificial Sequence
  Synthetic DNA
taaggcatctcactgaag

SEQ ID NO: 57632 - DNA, 18 bp, Artificial Sequence
  Synthetic DNA
taagtcatctttctttag

SEQ ID NO: 57633 - DNA, 18 bp, Artificial Sequence
  Synthetic DNA
taagtcgagtcacttttg

SEQ ID NO: 57634 - DNA, 18 bp, Artificial Sequence
  Synthetic DNA
taagtcgatacattatag

SEQ ID NO: 57635 - DNA, 18 bp, Artificial Sequence
  Synthetic DNA
taagtcggctcacttaag

SEQ ID NO: 57636 - DNA, 18 bp, Artificial Sequence
  Synthetic DNA
taagtcgtttaaatatag

SEQ ID NO: 57637 - DNA, 18 bp, Artificial Sequence
  Synthetic DNA
taagtggtctctctaatg

SEQ ID NO: 57638 - DNA, 18 bp, Artificial Sequence
  Synthetic DNA
taataaaactcgcaagag

SEQ ID NO: 57639 - DNA, 18 bp, Artificial Sequence
  Synthetic DNA
taataaaacttataaaag

SEQ ID NO: 57640 - DNA, 18 bp, Artificial Sequence
  Synthetic DNA
taataaatattactatag

SEQ ID NO: 57641 - DNA, 18 bp, Artificial Sequence
  Synthetic DNA
taataaatcacactaaag

SEQ ID NO: 57642 - DNA, 18 bp, Artificial Sequence
  Synthetic DNA
taataacactgattttag

SEQ ID NO: 57643 - DNA, 18 bp, Artificial Sequence
  Synthetic DNA
taataaccctcaatctag

SEQ ID NO: 57644 - DNA, 18 bp, Artificial Sequence
  Synthetic DNA
taataactcacataatag

SEQ ID NO: 57645 - DNA, 18 bp, Artificial Sequence
  Synthetic DNA
taataagaacatctattg

SEQ ID NO: 57646 - DNA, 18 bp, Artificial Sequence
  Synthetic DNA
taataagaatatctaaag

SEQ ID NO: 57647 - DNA, 18 bp, Artificial Sequence
  Synthetic DNA
taataagacacacatttg

SEQ ID NO: 57648 - DNA, 18 bp, Artificial Sequence
  Synthetic DNA
taataagacactcttttg

SEQ ID NO: 57649 - DNA, 18 bp, Artificial Sequence
  Synthetic DNA
taataagacccgtcattg

SEQ ID NO: 57650 - DNA, 18 bp, Artificial Sequence
  Synthetic DNA
taataagaccgactgttg

SEQ ID NO: 57651 - DNA, 18 bp, Artificial Sequence
  Synthetic DNA
taataagactacgtttag

SEQ ID NO: 57652 - DNA, 18 bp, Artificial Sequence
  Synthetic DNA
taataagactctcttatg

SEQ ID NO: 57653 - DNA, 18 bp, Artificial Sequence
  Synthetic DNA
taataagactgaattttg

SEQ ID NO: 57654 - DNA, 18 bp, Artificial Sequence
  Synthetic DNA
taataagacttacccttg

SEQ ID NO: 57655 - DNA, 18 bp, Artificial Sequence
  Synthetic DNA
taataagactttctcaag

SEQ ID NO: 57656 - DNA, 18 bp, Artificial Sequence
  Synthetic DNA
taataagagtcttattag

SEQ ID NO: 57657 - DNA, 18 bp, Artificial Sequence
  Synthetic DNA
taataagattttgtaaag

SEQ ID NO: 57658 - DNA, 18 bp, Artificial Sequence
  Synthetic DNA
taataagcaacacatctg

SEQ ID NO: 57659 - DNA, 18 bp, Artificial Sequence
  Synthetic DNA
taataaggctacgtgaag

SEQ ID NO: 57660 - DNA, 18 bp, Artificial Sequence
  Synthetic DNA
taataaggctcacaaagg

SEQ ID NO: 57661 - DNA, 18 bp, Artificial Sequence
  Synthetic DNA
taataagtcgaaatagag

SEQ ID NO: 57662 - DNA, 18 bp, Artificial Sequence
  Synthetic DNA
taataagtctctcttttg

SEQ ID NO: 57663 - DNA, 18 bp, Artificial Sequence
  Synthetic DNA
taataagtctttcaagtg

SEQ ID NO: 57664 - DNA, 18 bp, Artificial Sequence
  Synthetic DNA
taataataaacacaatag

SEQ ID NO: 57665 - DNA, 18 bp, Artificial Sequence
  Synthetic DNA
taataatacatacaaaag

SEQ ID NO: 57666 - DNA, 18 bp, Artificial Sequence
  Synthetic DNA
taataatactcgcattag

SEQ ID NO: 57667 - DNA, 18 bp, Artificial Sequence
  Synthetic DNA
taataattctatctatag

SEQ ID NO: 57668 - DNA, 18 bp, Artificial Sequence
  Synthetic DNA
taatacaaaacacaaaag

SEQ ID NO: 57669 - DNA, 18 bp, Artificial Sequence
  Synthetic DNA
taatacaacaatctaatg

SEQ ID NO: 57670 - DNA, 18 bp, Artificial Sequence
  Synthetic DNA
taatacaacacaccaatg

SEQ ID NO: 57671 - DNA, 18 bp, Artificial Sequence
  Synthetic DNA
taatacaacattcattag

SEQ ID NO: 57672 - DNA, 18 bp, Artificial Sequence
  Synthetic DNA
taatacaaccgtcaactg

SEQ ID NO: 57673 - DNA, 18 bp, Artificial Sequence
  Synthetic DNA
taatacaactcaagctcg

SEQ ID NO: 57674 - DNA, 18 bp, Artificial Sequence
  Synthetic DNA
taatacaactgacatgag

SEQ ID NO: 57675 - DNA, 18 bp, Artificial Sequence
  Synthetic DNA
taatacaactttcttttg

SEQ ID NO: 57676 - DNA, 18 bp, Artificial Sequence
  Synthetic DNA
taatacaataaattaaag

SEQ ID NO: 57677 - DNA, 18 bp, Artificial Sequence
  Synthetic DNA
taatacaatccactaatg

SEQ ID NO: 57678 - DNA, 18 bp, Artificial Sequence
  Synthetic DNA
taatacaattatcaatag

SEQ ID NO: 57679 - DNA, 18 bp, Artificial Sequence
  Synthetic DNA
taatacaattgtatatag

SEQ ID NO: 57680 - DNA, 18 bp, Artificial Sequence
  Synthetic DNA
taatacacgtaccgctag

SEQ ID NO: 57681 - DNA, 18 bp, Artificial Sequence
  Synthetic DNA
taatacacgtcattacag

SEQ ID NO: 57682 - DNA, 18 bp, Artificial Sequence
  Synthetic DNA
taatacatagcactatcg

SEQ ID NO: 57683 - DNA, 18 bp, Artificial Sequence
  Synthetic DNA
taatacatattaaaatag

SEQ ID NO: 57684 - DNA, 18 bp, Artificial Sequence
  Synthetic DNA
taatacatcacactcttg

SEQ ID NO: 57685 - DNA, 18 bp, Artificial Sequence
  Synthetic DNA
taatacatcatactactg

SEQ ID NO: 57686 - DNA, 18 bp, Artificial Sequence
  Synthetic DNA
taatacatcgctctattg

SEQ ID NO: 57687 - DNA, 18 bp, Artificial Sequence
  Synthetic DNA
taatacatctccacaaag

SEQ ID NO: 57688 - DNA, 18 bp, Artificial Sequence
  Synthetic DNA
taatacatctccctgtcg

SEQ ID NO: 57689 - DNA, 18 bp, Artificial Sequence
  Synthetic DNA
taatacatctctttacag

SEQ ID NO: 57690 - DNA, 18 bp, Artificial Sequence
  Synthetic DNA
taatacatctgacggttg

SEQ ID NO: 57691 - DNA, 18 bp, Artificial Sequence
  Synthetic DNA
taatacatgccactgtag

SEQ ID NO: 57692 - DNA, 18 bp, Artificial Sequence
  Synthetic DNA
taatacatgccataatag

SEQ ID NO: 57693 - DNA, 18 bp, Artificial Sequence
  Synthetic DNA
taatacatttcacaaaag

SEQ ID NO: 57694 - DNA, 18 bp, Artificial Sequence
  Synthetic DNA
taatacatttctatagag

SEQ ID NO: 57695 - DNA, 18 bp, Artificial Sequence
  Synthetic DNA
taataccaaacactgtcg

SEQ ID NO: 57696 - DNA, 18 bp, Artificial Sequence
  Synthetic DNA
taataccacacacccgag

SEQ ID NO: 57697 - DNA, 18 bp, Artificial Sequence
  Synthetic DNA
taataccacacagaatgg

SEQ ID NO: 57698 - DNA, 18 bp, Artificial Sequence
  Synthetic DNA
taataccacatacaattg

SEQ ID NO: 57699 - DNA, 18 bp, Artificial Sequence
  Synthetic DNA
taataccacctaccatgg

SEQ ID NO: 57700 - DNA, 18 bp, Artificial Sequence
  Synthetic DNA
taataccactaatattag

SEQ ID NO: 57701 - DNA, 18 bp, Artificial Sequence
  Synthetic DNA
taataccactctatgtcg

SEQ ID NO: 57702 - DNA, 18 bp, Artificial Sequence
  Synthetic DNA
taataccagtcacatcag

SEQ ID NO: 57703 - DNA, 18 bp, Artificial Sequence
  Synthetic DNA
taataccagtcccctttg

SEQ ID NO: 57704 - DNA, 18 bp, Artificial Sequence
  Synthetic DNA
taataccatccaattaag

SEQ ID NO: 57705 - DNA, 18 bp, Artificial Sequence
  Synthetic DNA
taataccatgtaatatag

SEQ ID NO: 57706 - DNA, 18 bp, Artificial Sequence
  Synthetic DNA
taatacccgatgttaaag

SEQ ID NO: 57707 - DNA, 18 bp, Artificial Sequence
  Synthetic DNA
taatacccttataaaaag

SEQ ID NO: 57708 - DNA, 18 bp, Artificial Sequence
  Synthetic DNA
taatacctatcaattttg

SEQ ID NO: 57709 - DNA, 18 bp, Artificial Sequence
  Synthetic DNA
taatacctcaacctctag

SEQ ID NO: 57710 - DNA, 18 bp, Artificial Sequence
  Synthetic DNA
taatacctctaatcattg

SEQ ID NO: 57711 - DNA, 18 bp, Artificial Sequence
  Synthetic DNA
taatacctctctttttag

SEQ ID NO: 57712 - DNA, 18 bp, Artificial Sequence
  Synthetic DNA
taatacctcttcgtatgg

SEQ ID NO: 57713 - DNA, 18 bp, Artificial Sequence
  Synthetic DNA
taataccttccatgatag

SEQ ID NO: 57714 - DNA, 18 bp, Artificial Sequence
  Synthetic DNA
taatacgaaacaaatcag

SEQ ID NO: 57715 - DNA, 18 bp, Artificial Sequence
  Synthetic DNA
taatacgaaccggaattg

SEQ ID NO: 57716 - DNA, 18 bp, Artificial Sequence
  Synthetic DNA
taatacgaatatctaagg

SEQ ID NO: 57717 - DNA, 18 bp, Artificial Sequence
  Synthetic DNA
taatacgaatccacattg

SEQ ID NO: 57718 - DNA, 18 bp, Artificial Sequence
  Synthetic DNA
taatacgaattacaccag

SEQ ID NO: 57719 - DNA, 18 bp, Artificial Sequence
  Synthetic DNA
taatacgacagaacattg

SEQ ID NO: 57720 - DNA, 18 bp, Artificial Sequence
  Synthetic DNA
taatacgacattgtgtag

SEQ ID NO: 57721 - DNA, 18 bp, Artificial Sequence
  Synthetic DNA
taatacgaccacctaatg

SEQ ID NO: 57722 - DNA, 18 bp, Artificial Sequence
  Synthetic DNA
taatacgacccatagcag

SEQ ID NO: 57723 - DNA, 18 bp, Artificial Sequence
  Synthetic DNA
taatacgaccgacaaacg

SEQ ID NO: 57724 - DNA, 18 bp, Artificial Sequence
  Synthetic DNA
taatacgacctcttattg

SEQ ID NO: 57725 - DNA, 18 bp, Artificial Sequence
  Synthetic DNA
taatacgacgctcaacgg

SEQ ID NO: 57726 - DNA, 18 bp, Artificial Sequence
  Synthetic DNA
taatacgactaaacagcg

SEQ ID NO: 57727 - DNA, 18 bp, Artificial Sequence
  Synthetic DNA
taatacgacttccaaatg

SEQ ID NO: 57728 - DNA, 18 bp, Artificial Sequence
  Synthetic DNA
taatacgactttccgaag

SEQ ID NO: 57729 - DNA, 18 bp, Artificial Sequence
  Synthetic DNA
taatacgaggcacccaag

SEQ ID NO: 57730 - DNA, 18 bp, Artificial Sequence
  Synthetic DNA
taatacgagtaacagttg

SEQ ID NO: 57731 - DNA, 18 bp, Artificial Sequence
  Synthetic DNA
taatacgagtcaaattgg

SEQ ID NO: 57732 - DNA, 18 bp, Artificial Sequence
  Synthetic DNA
taatacgagtcctaccag

SEQ ID NO: 57733 - DNA, 18 bp, Artificial Sequence
  Synthetic DNA
taatacgataaaccaatg

SEQ ID NO: 57734 - DNA, 18 bp, Artificial Sequence
  Synthetic DNA
taatacgatatgctaacg

SEQ ID NO: 57735 - DNA, 18 bp, Artificial Sequence
  Synthetic DNA
taatacgatcagctgtag

SEQ ID NO: 57736 - DNA, 18 bp, Artificial Sequence
  Synthetic DNA
taatacgattatttttag

SEQ ID NO: 57737 - DNA, 18 bp, Artificial Sequence
  Synthetic DNA
taatacgattcaattacg

SEQ ID NO: 57738 - DNA, 18 bp, Artificial Sequence
  Synthetic DNA
taatacgattcaattcgg

SEQ ID NO: 57739 - DNA, 18 bp, Artificial Sequence
  Synthetic DNA
taatacgattcccactgg

SEQ ID NO: 57740 - DNA, 18 bp, Artificial Sequence
  Synthetic DNA
taatacgattcctttaag

SEQ ID NO: 57741 - DNA, 18 bp, Artificial Sequence
  Synthetic DNA
taatacgattcttttttg

SEQ ID NO: 57742 - DNA, 18 bp, Artificial Sequence
  Synthetic DNA
taatacgcataactaatg

SEQ ID NO: 57743 - DNA, 18 bp, Artificial Sequence
  Synthetic DNA
taatacgcatccattttg

SEQ ID NO: 57744 - DNA, 18 bp, Artificial Sequence
  Synthetic DNA
taatacgccagtttatag

SEQ ID NO: 57745 - DNA, 18 bp, Artificial Sequence
  Synthetic DNA
taatacgccccaatgaag

SEQ ID NO: 57746 - DNA, 18 bp, Artificial Sequence
  Synthetic DNA
taatacgcctatttttag

SEQ ID NO: 57747 - DNA, 18 bp, Artificial Sequence
  Synthetic DNA
taatacgcctgagtgcag

SEQ ID NO: 57748 - DNA, 18 bp, Artificial Sequence
  Synthetic DNA
taatacgcgagtttgtag

SEQ ID NO: 57749 - DNA, 18 bp, Artificial Sequence
  Synthetic DNA
taatacgctacgttgtag

SEQ ID NO: 57750 - DNA, 18 bp, Artificial Sequence
  Synthetic DNA
taatacgctccacactag

SEQ ID NO: 57751 - DNA, 18 bp, Artificial Sequence
  Synthetic DNA
taatacgctccacttaag

SEQ ID NO: 57752 - DNA, 18 bp, Artificial Sequence
  Synthetic DNA
taatacgctcctcataag

SEQ ID NO: 57753 - DNA, 18 bp, Artificial Sequence
  Synthetic DNA
taatacgcttatctttag

SEQ ID NO: 57754 - DNA, 18 bp, Artificial Sequence
  Synthetic DNA
taatacgcttcacatgag

SEQ ID NO: 57755 - DNA, 18 bp, Artificial Sequence
  Synthetic DNA
taatacggatcacataag

SEQ ID NO: 57756 - DNA, 18 bp, Artificial Sequence
  Synthetic DNA
taatacggcccatcattg

SEQ ID NO: 57757 - DNA, 18 bp, Artificial Sequence
  Synthetic DNA
taatacggcctacttgag

SEQ ID NO: 57758 - DNA, 18 bp, Artificial Sequence
  Synthetic DNA
taatacggctaccattag

SEQ ID NO: 57759 - DNA, 18 bp, Artificial Sequence
  Synthetic DNA
taatacggcttcaaatag

SEQ ID NO: 57760 - DNA, 18 bp, Artificial Sequence
  Synthetic DNA
taatacgggttgctatcg

SEQ ID NO: 57761 - DNA, 18 bp, Artificial Sequence
  Synthetic DNA
taatacggtctactattg

SEQ ID NO: 57762 - DNA, 18 bp, Artificial Sequence
  Synthetic DNA
taatacggttcaaatagg

SEQ ID NO: 57763 - DNA, 18 bp, Artificial Sequence
  Synthetic DNA
taatacggttgaccttag

SEQ ID NO: 57764 - DNA, 18 bp, Artificial Sequence
  Synthetic DNA
taatacgtaacacaaaag

SEQ ID NO: 57765 - DNA, 18 bp, Artificial Sequence
  Synthetic DNA
taatacgtaatttttagg

SEQ ID NO: 57766 - DNA, 18 bp, Artificial Sequence
  Synthetic DNA
taatacgtatgtcttaag

SEQ ID NO: 57767 - DNA, 18 bp, Artificial Sequence
  Synthetic DNA
taatacgtatttctttcg

SEQ ID NO: 57768 - DNA, 18 bp, Artificial Sequence
  Synthetic DNA
taatacgtcaaaatacag

SEQ ID NO: 57769 - DNA, 18 bp, Artificial Sequence
  Synthetic DNA
taatacgtcaaactctgg

SEQ ID NO: 57770 - DNA, 18 bp, Artificial Sequence
  Synthetic DNA
taatacgtcataaaattg

SEQ ID NO: 57771 - DNA, 18 bp, Artificial Sequence
  Synthetic DNA
taatacgtcccacttctg

SEQ ID NO: 57772 - DNA, 18 bp, Artificial Sequence
  Synthetic DNA
taatacgtccctataaag

SEQ ID NO: 57773 - DNA, 18 bp, Artificial Sequence
  Synthetic DNA
taatacgtcgcattttcg

SEQ ID NO: 57774 - DNA, 18 bp, Artificial Sequence
  Synthetic DNA
taatacgtcggactttgg

SEQ ID NO: 57775 - DNA, 18 bp, Artificial Sequence
  Synthetic DNA
taatacgtctcatatttg

SEQ ID NO: 57776 - DNA, 18 bp, Artificial Sequence
  Synthetic DNA
taatacgtctcgtcaaag

SEQ ID NO: 57777 - DNA, 18 bp, Artificial Sequence
  Synthetic DNA
taatacgtctctatcaag

SEQ ID NO: 57778 - DNA, 18 bp, Artificial Sequence
  Synthetic DNA
taatacgtctctcaaagg

SEQ ID NO: 57779 - DNA, 18 bp, Artificial Sequence
  Synthetic DNA
taatacgtctgaattgag

SEQ ID NO: 57780 - DNA, 18 bp, Artificial Sequence
  Synthetic DNA
taatacgtctgtgtacag

SEQ ID NO: 57781 - DNA, 18 bp, Artificial Sequence
  Synthetic DNA
taatacgtcttacttgtg

SEQ ID NO: 57782 - DNA, 18 bp, Artificial Sequence
  Synthetic DNA
taatacgtgctagtatcg

SEQ ID NO: 57783 - DNA, 18 bp, Artificial Sequence
  Synthetic DNA
taatacgtgtagctctcg

SEQ ID NO: 57784 - DNA, 18 bp, Artificial Sequence
  Synthetic DNA
taatacgttaaacactag

SEQ ID NO: 57785 - DNA, 18 bp, Artificial Sequence
  Synthetic DNA
taatacgttgcaataatg

SEQ ID NO: 57786 - DNA, 18 bp, Artificial Sequence
  Synthetic DNA
taatacgtttatctagag

SEQ ID NO: 57787 - DNA, 18 bp, Artificial Sequence
  Synthetic DNA
taatacgtttcaatgaag

SEQ ID NO: 57788 - DNA, 18 bp, Artificial Sequence
  Synthetic DNA
taatacgtttgacataag

SEQ ID NO: 57789 - DNA, 18 bp, Artificial Sequence
  Synthetic DNA
taatacgttttactactg

SEQ ID NO: 57790 - DNA, 18 bp, Artificial Sequence
  Synthetic DNA
taatactaatctccaaag

SEQ ID NO: 57791 - DNA, 18 bp, Artificial Sequence
  Synthetic DNA
taatactaattcctatcg

SEQ ID NO: 57792 - DNA, 18 bp, Artificial Sequence
  Synthetic DNA
taatactaatttttttag

SEQ ID NO: 57793 - DNA, 18 bp, Artificial Sequence
  Synthetic DNA
taatactacaaattcttg

SEQ ID NO: 57794 - DNA, 18 bp, Artificial Sequence
  Synthetic DNA
taatactacacaaattag

SEQ ID NO: 57795 - DNA, 18 bp, Artificial Sequence
  Synthetic DNA
taatactacacatacttg

SEQ ID NO: 57796 - DNA, 18 bp, Artificial Sequence
  Synthetic DNA
taatactacaccctaacg

SEQ ID NO: 57797 - DNA, 18 bp, Artificial Sequence
  Synthetic DNA
taatactacataatgaag

SEQ ID NO: 57798 - DNA, 18 bp, Artificial Sequence
  Synthetic DNA
taatactacatacttttg

SEQ ID NO: 57799 - DNA, 18 bp, Artificial Sequence
  Synthetic DNA
taatactaccaagtaatg

SEQ ID NO: 57800 - DNA, 18 bp, Artificial Sequence
  Synthetic DNA
taatactaccccttgtag

SEQ ID NO: 57801 - DNA, 18 bp, Artificial Sequence
  Synthetic DNA
taatactaccgagtcaag

SEQ ID NO: 57802 - DNA, 18 bp, Artificial Sequence
  Synthetic DNA
taatactactacgtttag

SEQ ID NO: 57803 - DNA, 18 bp, Artificial Sequence
  Synthetic DNA
taatactactccccctgg

SEQ ID NO: 57804 - DNA, 18 bp, Artificial Sequence
  Synthetic DNA
taatactactgaattttg

SEQ ID NO: 57805 - DNA, 18 bp, Artificial Sequence
  Synthetic DNA
taatactacttattaagg

SEQ ID NO: 57806 - DNA, 18 bp, Artificial Sequence
  Synthetic DNA
taatactactttataatg

SEQ ID NO: 57807 - DNA, 18 bp, Artificial Sequence
  Synthetic DNA
taatactagaaagcattg

SEQ ID NO: 57808 - DNA, 18 bp, Artificial Sequence
  Synthetic DNA
taatactagtgcctattg

SEQ ID NO: 57809 - DNA, 18 bp, Artificial Sequence
  Synthetic DNA
taatactagtttccattg

SEQ ID NO: 57810 - DNA, 18 bp, Artificial Sequence
  Synthetic DNA
taatactatagactttag

SEQ ID NO: 57811 - DNA, 18 bp, Artificial Sequence
  Synthetic DNA
taatactatgacgtgaag

SEQ ID NO: 57812 - DNA, 18 bp, Artificial Sequence
  Synthetic DNA
taatactattctctaatg

SEQ ID NO: 57813 - DNA, 18 bp, Artificial Sequence
  Synthetic DNA
taatactattctctgcag

SEQ ID NO: 57814 - DNA, 18 bp, Artificial Sequence
  Synthetic DNA
taatactatttacaaaag

SEQ ID NO: 57815 - DNA, 18 bp, Artificial Sequence
  Synthetic DNA
taatactccactctttag

SEQ ID NO: 57816 - DNA, 18 bp, Artificial Sequence
  Synthetic DNA
taatactgccctctaaag

SEQ ID NO: 57817 - DNA, 18 bp, Artificial Sequence
  Synthetic DNA
taatacttcaaacacaag

SEQ ID NO: 57818 - DNA, 18 bp, Artificial Sequence
  Synthetic DNA
taatacttccatctaatg

SEQ ID NO: 57819 - DNA, 18 bp, Artificial Sequence
  Synthetic DNA
taatacttctcaattcag

SEQ ID NO: 57820 - DNA, 18 bp, Artificial Sequence
  Synthetic DNA
taatacttctctccattg

SEQ ID NO: 57821 - DNA, 18 bp, Artificial Sequence
  Synthetic DNA
taatacttttcaaaattg

SEQ ID NO: 57822 - DNA, 18 bp, Artificial Sequence
  Synthetic DNA
taatagaaataacctttg

SEQ ID NO: 57823 - DNA, 18 bp, Artificial Sequence
  Synthetic DNA
taatagaaatcaataaag

SEQ ID NO: 57824 - DNA, 18 bp, Artificial Sequence
  Synthetic DNA
taatagaacacgctacag

SEQ ID NO: 57825 - DNA, 18 bp, Artificial Sequence
  Synthetic DNA
taatagaactctttattg

SEQ ID NO: 57826 - DNA, 18 bp, Artificial Sequence
  Synthetic DNA
taatagatcacacgatgg

SEQ ID NO: 57827 - DNA, 18 bp, Artificial Sequence
  Synthetic DNA
taatagctctcgcggatg

SEQ ID NO: 57828 - DNA, 18 bp, Artificial Sequence
  Synthetic DNA
taataggactgtcataag

SEQ ID NO: 57829 - DNA, 18 bp, Artificial Sequence
  Synthetic DNA
taataggatatactacag

SEQ ID NO: 57830 - DNA, 18 bp, Artificial Sequence
  Synthetic DNA
taataggattctctctgg

SEQ ID NO: 57831 - DNA, 18 bp, Artificial Sequence
  Synthetic DNA
taataggatttccttgag

SEQ ID NO: 57832 - DNA, 18 bp, Artificial Sequence
  Synthetic DNA
taatagggcttacattcg

SEQ ID NO: 57833 - DNA, 18 bp, Artificial Sequence
  Synthetic DNA
taataggtactacgatag

SEQ ID NO: 57834 - DNA, 18 bp, Artificial Sequence
  Synthetic DNA
taataggtcactatatag

SEQ ID NO: 57835 - DNA, 18 bp, Artificial Sequence
  Synthetic DNA
taataggtctaacaagag

SEQ ID NO: 57836 - DNA, 18 bp, Artificial Sequence
  Synthetic DNA
taataggtgtcaatatgg

SEQ ID NO: 57837 - DNA, 18 bp, Artificial Sequence
  Synthetic DNA
taatagtaataaacaaag

SEQ ID NO: 57838 - DNA, 18 bp, Artificial Sequence
  Synthetic DNA
taatagtaataattattg

SEQ ID NO: 57839 - DNA, 18 bp, Artificial Sequence
  Synthetic DNA
taatagtactctaaatgg

SEQ ID NO: 57840 - DNA, 18 bp, Artificial Sequence
  Synthetic DNA
taatagtacttaccttag

SEQ ID NO: 57841 - DNA, 18 bp, Artificial Sequence
  Synthetic DNA
taatagtagtcagtattg

SEQ ID NO: 57842 - DNA, 18 bp, Artificial Sequence
  Synthetic DNA
taatataaaacactctag

SEQ ID NO: 57843 - DNA, 18 bp, Artificial Sequence
  Synthetic DNA
taatataaatcaataaag

SEQ ID NO: 57844 - DNA, 18 bp, Artificial Sequence
  Synthetic DNA
taatataaatcaatgcag

SEQ ID NO: 57845 - DNA, 18 bp, Artificial Sequence
  Synthetic DNA
taatataacacacttttg

SEQ ID NO: 57846 - DNA, 18 bp, Artificial Sequence
  Synthetic DNA
taatataacacgatatag

SEQ ID NO: 57847 - DNA, 18 bp, Artificial Sequence
  Synthetic DNA
taatataacttaacttag

SEQ ID NO: 57848 - DNA, 18 bp, Artificial Sequence
  Synthetic DNA
taatataagtcgcaatag

SEQ ID NO: 57849 - DNA, 18 bp, Artificial Sequence
  Synthetic DNA
taatatatctcgatattg

SEQ ID NO: 57850 - DNA, 18 bp, Artificial Sequence
  Synthetic DNA
taatatatcttaccatag

SEQ ID NO: 57851 - DNA, 18 bp, Artificial Sequence
  Synthetic DNA
taatatcacacccttaag

SEQ ID NO: 57852 - DNA, 18 bp, Artificial Sequence
  Synthetic DNA
taatatcacagagtatag

SEQ ID NO: 57853 - DNA, 18 bp, Artificial Sequence
  Synthetic DNA
taatatcatagtttctag

SEQ ID NO: 57854 - DNA, 18 bp, Artificial Sequence
  Synthetic DNA
taatatcccacagtaaag

SEQ ID NO: 57855 - DNA, 18 bp, Artificial Sequence
  Synthetic DNA
taatatgaaccataatag

SEQ ID NO: 57856 - DNA, 18 bp, Artificial Sequence
  Synthetic DNA
taatatgaatcgatattg

SEQ ID NO: 57857 - DNA, 18 bp, Artificial Sequence
  Synthetic DNA
taatatgaatctcaacag

SEQ ID NO: 57858 - DNA, 18 bp, Artificial Sequence
  Synthetic DNA
taatatgacacacagcag

SEQ ID NO: 57859 - DNA, 18 bp, Artificial Sequence
  Synthetic DNA
taatatgacactctcaag

SEQ ID NO: 57860 - DNA, 18 bp, Artificial Sequence
  Synthetic DNA
taatatgacattcgattg

SEQ ID NO: 57861 - DNA, 18 bp, Artificial Sequence
  Synthetic DNA
taatatgaccaacaattg

SEQ ID NO: 57862 - DNA, 18 bp, Artificial Sequence
  Synthetic DNA
taatatgacggagtttcg

SEQ ID NO: 57863 - DNA, 18 bp, Artificial Sequence
  Synthetic DNA
taatatgactcataactg

SEQ ID NO: 57864 - DNA, 18 bp, Artificial Sequence
  Synthetic DNA
taatatgactgagaacag

SEQ ID NO: 57865 - DNA, 18 bp, Artificial Sequence
  Synthetic DNA
taatatgagtctttttag

SEQ ID NO: 57866 - DNA, 18 bp, Artificial Sequence
  Synthetic DNA
taatatgatactctattg

SEQ ID NO: 57867 - DNA, 18 bp, Artificial Sequence
  Synthetic DNA
taatatgattcacaaatg

SEQ ID NO: 57868 - DNA, 18 bp, Artificial Sequence
  Synthetic DNA
taatatgattcataattg

SEQ ID NO: 57869 - DNA, 18 bp, Artificial Sequence
  Synthetic DNA
taatatgccttacggttg

SEQ ID NO: 57870 - DNA, 18 bp, Artificial Sequence
  Synthetic DNA
taatatgtatcacaaatg

SEQ ID NO: 57871 - DNA, 18 bp, Artificial Sequence
  Synthetic DNA
taatatgtatcactttcg

SEQ ID NO: 57872 - DNA, 18 bp, Artificial Sequence
  Synthetic DNA
taatatgtatctccattg

SEQ ID NO: 57873 - DNA, 18 bp, Artificial Sequence
  Synthetic DNA
taatatgtcacaccattg

SEQ ID NO: 57874 - DNA, 18 bp, Artificial Sequence
  Synthetic DNA
taatatgtcactcaaaag

SEQ ID NO: 57875 - DNA, 18 bp, Artificial Sequence
  Synthetic DNA
taatatgtcccattctag

SEQ ID NO: 57876 - DNA, 18 bp, Artificial Sequence
  Synthetic DNA
taatatgtcctattatag

SEQ ID NO: 57877 - DNA, 18 bp, Artificial Sequence
  Synthetic DNA
taatatgtctcacagttg

SEQ ID NO: 57878 - DNA, 18 bp, Artificial Sequence
  Synthetic DNA
taatatgtctcagaatcg

SEQ ID NO: 57879 - DNA, 18 bp, Artificial Sequence
  Synthetic DNA
taatatgtctcatgatcg

SEQ ID NO: 57880 - DNA, 18 bp, Artificial Sequence
  Synthetic DNA
taatatgtctcatttttg

SEQ ID NO: 57881 - DNA, 18 bp, Artificial Sequence
  Synthetic DNA
taatatgtctccctaatg

SEQ ID NO: 57882 - DNA, 18 bp, Artificial Sequence
  Synthetic DNA
taatatgtctttttatag

SEQ ID NO: 57883 - DNA, 18 bp, Artificial Sequence
  Synthetic DNA
taatatgttccacaatag

SEQ ID NO: 57884 - DNA, 18 bp, Artificial Sequence
  Synthetic DNA
taatatgtttccatccag

SEQ ID NO: 57885 - DNA, 18 bp, Artificial Sequence
  Synthetic DNA
taatattactctccaaag

SEQ ID NO: 57886 - DNA, 18 bp, Artificial Sequence
  Synthetic DNA
taatattagagtctttag

SEQ ID NO: 57887 - DNA, 18 bp, Artificial Sequence
  Synthetic DNA
taatatttctctcaatgg

SEQ ID NO: 57888 - DNA, 18 bp, Artificial Sequence
  Synthetic DNA
taatcaaacactctttag

SEQ ID NO: 57889 - DNA, 18 bp, Artificial Sequence
  Synthetic DNA
taatcactctcacaacag

SEQ ID NO: 57890 - DNA, 18 bp, Artificial Sequence
  Synthetic DNA
taatcagaccatcaatag

SEQ ID NO: 57891 - DNA, 18 bp, Artificial Sequence
  Synthetic DNA
taatcagactaactaatg

SEQ ID NO: 57892 - DNA, 18 bp, Artificial Sequence
  Synthetic DNA
taatcagccactctatcg

SEQ ID NO: 57893 - DNA, 18 bp, Artificial Sequence
  Synthetic DNA
taatcatactcataatag

SEQ ID NO: 57894 - DNA, 18 bp, Artificial Sequence
  Synthetic DNA
taatcatcctctctacag

SEQ ID NO: 57895 - DNA, 18 bp, Artificial Sequence
  Synthetic DNA
taatccaaatcaattatg

SEQ ID NO: 57896 - DNA, 18 bp, Artificial Sequence
  Synthetic DNA
taatccaacacaccattg

SEQ ID NO: 57897 - DNA, 18 bp, Artificial Sequence
  Synthetic DNA
taatccaacatactagag

SEQ ID NO: 57898 - DNA, 18 bp, Artificial Sequence
  Synthetic DNA
taatccaagttactgtag

SEQ ID NO: 57899 - DNA, 18 bp, Artificial Sequence
  Synthetic DNA
taatccagctcaataagg

SEQ ID NO: 57900 - DNA, 18 bp, Artificial Sequence
  Synthetic DNA
taatcccaatctctctcg

SEQ ID NO: 57901 - DNA, 18 bp, Artificial Sequence
  Synthetic DNA
taatccctcccattatag

SEQ ID NO: 57902 - DNA, 18 bp, Artificial Sequence
  Synthetic DNA
taatccctctctctttag

SEQ ID NO: 57903 - DNA, 18 bp, Artificial Sequence
  Synthetic DNA
taatccgacacttactag

SEQ ID NO: 57904 - DNA, 18 bp, Artificial Sequence
  Synthetic DNA
taatccgacgctcaaacg

SEQ ID NO: 57905 - DNA, 18 bp, Artificial Sequence
  Synthetic DNA
taatccgactagctcagg

SEQ ID NO: 57906 - DNA, 18 bp, Artificial Sequence
  Synthetic DNA
taatccgagtcaaatttg

SEQ ID NO: 57907 - DNA, 18 bp, Artificial Sequence
  Synthetic DNA
taatccgccaccctagag

SEQ ID NO: 57908 - DNA, 18 bp, Artificial Sequence
  Synthetic DNA
taatccgctttacttttg

SEQ ID NO: 57909 - DNA, 18 bp, Artificial Sequence
  Synthetic DNA
taatccgtaacgatatag

SEQ ID NO: 57910 - DNA, 18 bp, Artificial Sequence
  Synthetic DNA
taatccgtcccattaatg

SEQ ID NO: 57911 - DNA, 18 bp, Artificial Sequence
  Synthetic DNA
taatccgtctaattatcg

SEQ ID NO: 57912 - DNA, 18 bp, Artificial Sequence
  Synthetic DNA
taatccgtggatcaatag

SEQ ID NO: 57913 - DNA, 18 bp, Artificial Sequence
  Synthetic DNA
taatcctaccctctgtag

SEQ ID NO: 57914 - DNA, 18 bp, Artificial Sequence
  Synthetic DNA
taatcctcctccctgaag

SEQ ID NO: 57915 - DNA, 18 bp, Artificial Sequence
  Synthetic DNA
taatcctgtacactagag

SEQ ID NO: 57916 - DNA, 18 bp, Artificial Sequence
  Synthetic DNA
taatccttatgtctatag

SEQ ID NO: 57917 - DNA, 18 bp, Artificial Sequence
  Synthetic DNA
taatccttctaacaaaag

SEQ ID NO: 57918 - DNA, 18 bp, Artificial Sequence
  Synthetic DNA
taatcggactagctctgg

SEQ ID NO: 57919 - DNA, 18 bp, Artificial Sequence
  Synthetic DNA
taatcggacttgctaacg

SEQ ID NO: 57920 - DNA, 18 bp, Artificial Sequence
  Synthetic DNA
taatgaatttcctaaaag

SEQ ID NO: 57921 - DNA, 18 bp, Artificial Sequence
  Synthetic DNA
taatgagtctcaataaag

SEQ ID NO: 57922 - DNA, 18 bp, Artificial Sequence
  Synthetic DNA
taatgatattcactattg

SEQ ID NO: 57923 - DNA, 18 bp, Artificial Sequence
  Synthetic DNA
taatgattctcaattttg

SEQ ID NO: 57924 - DNA, 18 bp, Artificial Sequence
  Synthetic DNA
taatgcaacactcaaaag

SEQ ID NO: 57925 - DNA, 18 bp, Artificial Sequence
  Synthetic DNA
taatgcaactctcttcag

SEQ ID NO: 57926 - DNA, 18 bp, Artificial Sequence
  Synthetic DNA
taatgcaatttaatttcg

SEQ ID NO: 57927 - DNA, 18 bp, Artificial Sequence
  Synthetic DNA
taatgccagtctctaaag

SEQ ID NO: 57928 - DNA, 18 bp, Artificial Sequence
  Synthetic DNA
taatgccattcatcaaag

SEQ ID NO: 57929 - DNA, 18 bp, Artificial Sequence
  Synthetic DNA
taatgcgaatctctttcg

SEQ ID NO: 57930 - DNA, 18 bp, Artificial Sequence
  Synthetic DNA
taatgcgactaaaccgag

SEQ ID NO: 57931 - DNA, 18 bp, Artificial Sequence
  Synthetic DNA
taatgcgacttcctaatg

SEQ ID NO: 57932 - DNA, 18 bp, Artificial Sequence
  Synthetic DNA
taatgcgacttgcaagag

SEQ ID NO: 57933 - DNA, 18 bp, Artificial Sequence
  Synthetic DNA
taatgcgcctcttcatgg

SEQ ID NO: 57934 - DNA, 18 bp, Artificial Sequence
  Synthetic DNA
taatgcggcactctacag

SEQ ID NO: 57935 - DNA, 18 bp, Artificial Sequence
  Synthetic DNA
taatgcggctaattaaag

SEQ ID NO: 57936 - DNA, 18 bp, Artificial Sequence
  Synthetic DNA
taatgcgtcacacagttg

SEQ ID NO: 57937 - DNA, 18 bp, Artificial Sequence
  Synthetic DNA
taatgcgtccctttatag

SEQ ID NO: 57938 - DNA, 18 bp, Artificial Sequence
  Synthetic DNA
taatgcgtttctctttag

SEQ ID NO: 57939 - DNA, 18 bp, Artificial Sequence
  Synthetic DNA
taatgctaaatactatag

SEQ ID NO: 57940 - DNA, 18 bp, Artificial Sequence
  Synthetic DNA
taatgctactacctgtag

SEQ ID NO: 57941 - DNA, 18 bp, Artificial Sequence
  Synthetic DNA
taatgctactcactcatg

SEQ ID NO: 57942 - DNA, 18 bp, Artificial Sequence
  Synthetic DNA
taatgctcatcaccatag

SEQ ID NO: 57943 - DNA, 18 bp, Artificial Sequence
  Synthetic DNA
taatgctcatcacctttg

SEQ ID NO: 57944 - DNA, 18 bp, Artificial Sequence
  Synthetic DNA
taatgcttttcagtatag

SEQ ID NO: 57945 - DNA, 18 bp, Artificial Sequence
  Synthetic DNA
taatggaacatactaagg

SEQ ID NO: 57946 - DNA, 18 bp, Artificial Sequence
  Synthetic DNA
taatggggctgactttcg

SEQ ID NO: 57947 - DNA, 18 bp, Artificial Sequence
  Synthetic DNA
taatgggtttcactatgg

SEQ ID NO: 57948 - DNA, 18 bp, Artificial Sequence
  Synthetic DNA
taatgtatctcataaaag

SEQ ID NO: 57949 - DNA, 18 bp, Artificial Sequence
  Synthetic DNA
taatgtgacattctactg

SEQ ID NO: 57950 - DNA, 18 bp, Artificial Sequence
  Synthetic DNA
taatgttacttacaattg

SEQ ID NO: 57951 - DNA, 18 bp, Artificial Sequence
  Synthetic DNA
taattaaactatctaggg

SEQ ID NO: 57952 - DNA, 18 bp, Artificial Sequence
  Synthetic DNA
taattaaagtcactacag

SEQ ID NO: 57953 - DNA, 18 bp, Artificial Sequence
  Synthetic DNA
taattaagctcttaatag

SEQ ID NO: 57954 - DNA, 18 bp, Artificial Sequence
  Synthetic DNA
taattaatcacactatag

SEQ ID NO: 57955 - DNA, 18 bp, Artificial Sequence
  Synthetic DNA
taattacactcaattaag

SEQ ID NO: 57956 - DNA, 18 bp, Artificial Sequence
  Synthetic DNA
taattacactcacgttag

SEQ ID NO: 57957 - DNA, 18 bp, Artificial Sequence
  Synthetic DNA
taattacactcattatcg

SEQ ID NO: 57958 - DNA, 18 bp, Artificial Sequence
  Synthetic DNA
taattactctcagtgtag

SEQ ID NO: 57959 - DNA, 18 bp, Artificial Sequence
  Synthetic DNA
taattagaaccactttag

SEQ ID NO: 57960 - DNA, 18 bp, Artificial Sequence
  Synthetic DNA
taattagactctctagtg

SEQ ID NO: 57961 - DNA, 18 bp, Artificial Sequence
  Synthetic DNA
taattagcctcacgtaag

SEQ ID NO: 57962 - DNA, 18 bp, Artificial Sequence
  Synthetic DNA
taattaggcttgcttcag

SEQ ID NO: 57963 - DNA, 18 bp, Artificial Sequence
  Synthetic DNA
taattagtctctcaattg

SEQ ID NO: 57964 - DNA, 18 bp, Artificial Sequence
  Synthetic DNA
taattagtctgactttag

SEQ ID NO: 57965 - DNA, 18 bp, Artificial Sequence
  Synthetic DNA
taattagtttcattattg

SEQ ID NO: 57966 - DNA, 18 bp, Artificial Sequence
  Synthetic DNA
taattatgctcacgatag

SEQ ID NO: 57967 - DNA, 18 bp, Artificial Sequence
  Synthetic DNA
taattattctgactatag

SEQ ID NO: 57968 - DNA, 18 bp, Artificial Sequence
  Synthetic DNA
taattcaaatctctattg

SEQ ID NO: 57969 - DNA, 18 bp, Artificial Sequence
  Synthetic DNA
taattcaactctttggtg

SEQ ID NO: 57970 - DNA, 18 bp, Artificial Sequence
  Synthetic DNA
taattcaacttactgaag

SEQ ID NO: 57971 - DNA, 18 bp, Artificial Sequence
  Synthetic DNA
taattcaacttgcgattg

SEQ ID NO: 57972 - DNA, 18 bp, Artificial Sequence
  Synthetic DNA
taattcaactttctattg

SEQ ID NO: 57973 - DNA, 18 bp, Artificial Sequence
  Synthetic DNA
taattcagctcaggttag

SEQ ID NO: 57974 - DNA, 18 bp, Artificial Sequence
  Synthetic DNA
taattcagctgaatttag

SEQ ID NO: 57975 - DNA, 18 bp, Artificial Sequence
  Synthetic DNA
taattccactccccatcg

SEQ ID NO: 57976 - DNA, 18 bp, Artificial Sequence
  Synthetic DNA
taattccatccaccatag

SEQ ID NO: 57977 - DNA, 18 bp, Artificial Sequence
  Synthetic DNA
taattcctcacattagag

SEQ ID NO: 57978 - DNA, 18 bp, Artificial Sequence
  Synthetic DNA
taattcctctcacttcag

SEQ ID NO: 57979 - DNA, 18 bp, Artificial Sequence
  Synthetic DNA
taattcctctcagcaaag

SEQ ID NO: 57980 - DNA, 18 bp, Artificial Sequence
  Synthetic DNA
taattcgaataattatcg

SEQ ID NO: 57981 - DNA, 18 bp, Artificial Sequence
  Synthetic DNA
taattcgaatacctattg

SEQ ID NO: 57982 - DNA, 18 bp, Artificial Sequence
  Synthetic DNA
taattcgaatacctttag

SEQ ID NO: 57983 - DNA, 18 bp, Artificial Sequence
  Synthetic DNA
taattcgaatctctcctg

SEQ ID NO: 57984 - DNA, 18 bp, Artificial Sequence
  Synthetic DNA
taattcgacaaaagaaag

SEQ ID NO: 57985 - DNA, 18 bp, Artificial Sequence
  Synthetic DNA
taattcgacacaaacccg

SEQ ID NO: 57986 - DNA, 18 bp, Artificial Sequence
  Synthetic DNA
taattcgacacaacgtag

SEQ ID NO: 57987 - DNA, 18 bp, Artificial Sequence
  Synthetic DNA
taattcgacaccctcgag

SEQ ID NO: 57988 - DNA, 18 bp, Artificial Sequence
  Synthetic DNA
taattcgacactatttag

SEQ ID NO: 57989 - DNA, 18 bp, Artificial Sequence
  Synthetic DNA
taattcgacactcatttg

SEQ ID NO: 57990 - DNA, 18 bp, Artificial Sequence
  Synthetic DNA
taattcgacgtcatatag

SEQ ID NO: 57991 - DNA, 18 bp, Artificial Sequence
  Synthetic DNA
taattcgactaacattcg

SEQ ID NO: 57992 - DNA, 18 bp, Artificial Sequence
  Synthetic DNA
taattcgactcacctagg

SEQ ID NO: 57993 - DNA, 18 bp, Artificial Sequence
  Synthetic DNA
taattcgactttatctag

SEQ ID NO: 57994 - DNA, 18 bp, Artificial Sequence
  Synthetic DNA
taattcgactttgattag

SEQ ID NO: 57995 - DNA, 18 bp, Artificial Sequence
  Synthetic DNA
taattcgacttttttttg

SEQ ID NO: 57996 - DNA, 18 bp, Artificial Sequence
  Synthetic DNA
taattcgagaggcgacag

SEQ ID NO: 57997 - DNA, 18 bp, Artificial Sequence
  Synthetic DNA
taattcgagtcaaaacag

SEQ ID NO: 57998 - DNA, 18 bp, Artificial Sequence
  Synthetic DNA
taattcgagtctcctgag

SEQ ID NO: 57999 - DNA, 18 bp, Artificial Sequence
  Synthetic DNA
taattcgcatcacattcg

SEQ ID NO: 58000 - DNA, 18 bp, Artificial Sequence
  Synthetic DNA
taattcgcattacaatag

SEQ ID NO: 58001 - DNA, 18 bp, Artificial Sequence
  Synthetic DNA
taattcgccaccccgttg

SEQ ID NO: 58002 - DNA, 18 bp, Artificial Sequence
  Synthetic DNA
taattcgccattctactg

SEQ ID NO: 58003 - DNA, 18 bp, Artificial Sequence
  Synthetic DNA
taattcgcctcgcttgag

SEQ ID NO: 58004 - DNA, 18 bp, Artificial Sequence
  Synthetic DNA
taattcggatcattgttg

SEQ ID NO: 58005 - DNA, 18 bp, Artificial Sequence
  Synthetic DNA
taattcggctccatttcg

SEQ ID NO: 58006 - DNA, 18 bp, Artificial Sequence
  Synthetic DNA
taattcggctccttacag

SEQ ID NO: 58007 - DNA, 18 bp, Artificial Sequence
  Synthetic DNA
taattcggctgaatattg

SEQ ID NO: 58008 - DNA, 18 bp, Artificial Sequence
  Synthetic DNA
taattcgtatacctatag

SEQ ID NO: 58009 - DNA, 18 bp, Artificial Sequence
  Synthetic DNA
taattcgtatcaccattg

SEQ ID NO: 58010 - DNA, 18 bp, Artificial Sequence
  Synthetic DNA
taattcgtctccccttag

SEQ ID NO: 58011 - DNA, 18 bp, Artificial Sequence
  Synthetic DNA
taattcgtctctctaccg

SEQ ID NO: 58012 - DNA, 18 bp, Artificial Sequence
  Synthetic DNA
taattcgtctctgattag

SEQ ID NO: 58013 - DNA, 18 bp, Artificial Sequence
  Synthetic DNA
taattcgttactcaaaag

SEQ ID NO: 58014 - DNA, 18 bp, Artificial Sequence
  Synthetic DNA
taattcgttccatcatag

SEQ ID NO: 58015 - DNA, 18 bp, Artificial Sequence
  Synthetic DNA
taattcgttcctctatag

SEQ ID NO: 58016 - DNA, 18 bp, Artificial Sequence
  Synthetic DNA
taattctacacacgttag

SEQ ID NO: 58017 - DNA, 18 bp, Artificial Sequence
  Synthetic DNA
taattctacacatttgtg

SEQ ID NO: 58018 - DNA, 18 bp, Artificial Sequence
  Synthetic DNA
taattctactcaataagg

SEQ ID NO: 58019 - DNA, 18 bp, Artificial Sequence
  Synthetic DNA
taattctactcacgacgg

SEQ ID NO: 58020 - DNA, 18 bp, Artificial Sequence
  Synthetic DNA
taattctactcgctaacg

SEQ ID NO: 58021 - DNA, 18 bp, Artificial Sequence
  Synthetic DNA
taattctatattctatag

SEQ ID NO: 58022 - DNA, 18 bp, Artificial Sequence
  Synthetic DNA
taattctgctaattatag

SEQ ID NO: 58023 - DNA, 18 bp, Artificial Sequence
  Synthetic DNA
taattctgctctgtatag

SEQ ID NO: 58024 - DNA, 18 bp, Artificial Sequence
  Synthetic DNA
taattcttacttctatag

SEQ ID NO: 58025 - DNA, 18 bp, Artificial Sequence
  Synthetic DNA
taattcttatcaatttag

SEQ ID NO: 58026 - DNA, 18 bp, Artificial Sequence
  Synthetic DNA
taattcttctcacataag

SEQ ID NO: 58027 - DNA, 18 bp, Artificial Sequence
  Synthetic DNA
taattcttctcacgcaag

SEQ ID NO: 58028 - DNA, 18 bp, Artificial Sequence
  Synthetic DNA
taattcttctcactaatg

SEQ ID NO: 58029 - DNA, 18 bp, Artificial Sequence
  Synthetic DNA
taattcttctcattttag

SEQ ID NO: 58030 - DNA, 18 bp, Artificial Sequence
  Synthetic DNA
taattcttctctcacgtg

SEQ ID NO: 58031 - DNA, 18 bp, Artificial Sequence
  Synthetic DNA
taattcttcttactatgg

SEQ ID NO: 58032 - DNA, 18 bp, Artificial Sequence
  Synthetic DNA
taattcttctttccatag

SEQ ID NO: 58033 - DNA, 18 bp, Artificial Sequence
  Synthetic DNA
taattgcaattacttgag

SEQ ID NO: 58034 - DNA, 18 bp, Artificial Sequence
  Synthetic DNA
taattggacacaatgtag

SEQ ID NO: 58035 - DNA, 18 bp, Artificial Sequence
  Synthetic DNA
taattggactctcaatgg

SEQ ID NO: 58036 - DNA, 18 bp, Artificial Sequence
  Synthetic DNA
taattggactttctaatg

SEQ ID NO: 58037 - DNA, 18 bp, Artificial Sequence
  Synthetic DNA
taattggattaattatag

SEQ ID NO: 58038 - DNA, 18 bp, Artificial Sequence
  Synthetic DNA
taattggcatcactaaag

SEQ ID NO: 58039 - DNA, 18 bp, Artificial Sequence
  Synthetic DNA
taattggccacactctag

SEQ ID NO: 58040 - DNA, 18 bp, Artificial Sequence
  Synthetic DNA
taattgggaccactatag

SEQ ID NO: 58041 - DNA, 18 bp, Artificial Sequence
  Synthetic DNA
taattggtctcagatttg

SEQ ID NO: 58042 - DNA, 18 bp, Artificial Sequence
  Synthetic DNA
taattgtactatctatag

SEQ ID NO: 58043 - DNA, 18 bp, Artificial Sequence
  Synthetic DNA
taatttaactcaccttag

SEQ ID NO: 58044 - DNA, 18 bp, Artificial Sequence
  Synthetic DNA
taatttaactcatattag

SEQ ID NO: 58045 - DNA, 18 bp, Artificial Sequence
  Synthetic DNA
taatttcactatctattg

SEQ ID NO: 58046 - DNA, 18 bp, Artificial Sequence
  Synthetic DNA
taatttgacacacgttag

SEQ ID NO: 58047 - DNA, 18 bp, Artificial Sequence
  Synthetic DNA
taatttgactcacagagg

SEQ ID NO: 58048 - DNA, 18 bp, Artificial Sequence
  Synthetic DNA
taatttgactgtattgag

SEQ ID NO: 58049 - DNA, 18 bp, Artificial Sequence
  Synthetic DNA
taatttgactttatatag

SEQ ID NO: 58050 - DNA, 18 bp, Artificial Sequence
  Synthetic DNA
taatttgattgacaatag

SEQ ID NO: 58051 - DNA, 18 bp, Artificial Sequence
  Synthetic DNA
taatttggctccctattg

SEQ ID NO: 58052 - DNA, 18 bp, Artificial Sequence
  Synthetic DNA
taatttggcttacattag

SEQ ID NO: 58053 - DNA, 18 bp, Artificial Sequence
  Synthetic DNA
taatttgggacactatag

SEQ ID NO: 58054 - DNA, 18 bp, Artificial Sequence
  Synthetic DNA
taatttgtatcatcccag

SEQ ID NO: 58055 - DNA, 18 bp, Artificial Sequence
  Synthetic DNA
taatttgtctcaccctag

SEQ ID NO: 58056 - DNA, 18 bp, Artificial Sequence
  Synthetic DNA
taatttgttccactatag

SEQ ID NO: 58057 - DNA, 18 bp, Artificial Sequence
  Synthetic DNA
taattttacacattctag

SEQ ID NO: 58058 - DNA, 18 bp, Artificial Sequence
  Synthetic DNA
taatttttatcaccaaag

SEQ ID NO: 58059 - DNA, 18 bp, Artificial Sequence
  Synthetic DNA
taatttttctcaatatag

SEQ ID NO: 58060 - DNA, 18 bp, Artificial Sequence
  Synthetic DNA
tacaaagacttacaaagg

SEQ ID NO: 58061 - DNA, 18 bp, Artificial Sequence
  Synthetic DNA
tacaacaactcaccaaag

SEQ ID NO: 58062 - DNA, 18 bp, Artificial Sequence
  Synthetic DNA
tacaacaattctttaaag

SEQ ID NO: 58063 - DNA, 18 bp, Artificial Sequence
  Synthetic DNA
tacaacagctcaaaattg

SEQ ID NO: 58064 - DNA, 18 bp, Artificial Sequence
  Synthetic DNA
tacaacgacatacttttg

SEQ ID NO: 58065 - DNA, 18 bp, Artificial Sequence
  Synthetic DNA
tacaacgacccggtatag

SEQ ID NO: 58066 - DNA, 18 bp, Artificial Sequence
  Synthetic DNA
tacaacgacggacactgg

SEQ ID NO: 58067 - DNA, 18 bp, Artificial Sequence
  Synthetic DNA
tacaacgactcaataggg

SEQ ID NO: 58068 - DNA, 18 bp, Artificial Sequence
  Synthetic DNA
tacaacgactccaaaaag

SEQ ID NO: 58069 - DNA, 18 bp, Artificial Sequence
  Synthetic DNA
tacaacgactctgttaag

SEQ ID NO: 58070 - DNA, 18 bp, Artificial Sequence
  Synthetic DNA
tacaactactcattaatg

SEQ ID NO: 58071 - DNA, 18 bp, Artificial Sequence
  Synthetic DNA
tacaaggactcattgcag

SEQ ID NO: 58072 - DNA, 18 bp, Artificial Sequence
  Synthetic DNA
tacaaggattcaatattg

SEQ ID NO: 58073 - DNA, 18 bp, Artificial Sequence
  Synthetic DNA
tacaatcactctatatag

SEQ ID NO: 58074 - DNA, 18 bp, Artificial Sequence
  Synthetic DNA
tacacaaaatcactatag

SEQ ID NO: 58075 - DNA, 18 bp, Artificial Sequence
  Synthetic DNA
tacactaatttatcaaag

SEQ ID NO: 58076 - DNA, 18 bp, Artificial Sequence
  Synthetic DNA
tacagtgactgactatag

SEQ ID NO: 58077 - DNA, 18 bp, Artificial Sequence
  Synthetic DNA
taccacaacacactttag

SEQ ID NO: 58078 - DNA, 18 bp, Artificial Sequence
  Synthetic DNA
taccacgacttacttaag

SEQ ID NO: 58079 - DNA, 18 bp, Artificial Sequence
  Synthetic DNA
taccatgacttactagag

SEQ ID NO: 58080 - DNA, 18 bp, Artificial Sequence
  Synthetic DNA
taccccatcacactaaag

SEQ ID NO: 58081 - DNA, 18 bp, Artificial Sequence
  Synthetic DNA
taccccgaaaaactatcg

SEQ ID NO: 58082 - DNA, 18 bp, Artificial Sequence
  Synthetic DNA
taccccgaatcacttcag

SEQ ID NO: 58083 - DNA, 18 bp, Artificial Sequence
  Synthetic DNA
taccttgactctttatag

SEQ ID NO: 58084 - DNA, 18 bp, Artificial Sequence
  Synthetic DNA
tacgacgacacccaatag

SEQ ID NO: 58085 - DNA, 18 bp, Artificial Sequence
  Synthetic DNA
tacgacgatccaatatag

SEQ ID NO: 58086 - DNA, 18 bp, Artificial Sequence
  Synthetic DNA
tacggtgactcaattatg

SEQ ID NO: 58087 - DNA, 18 bp, Artificial Sequence
  Synthetic DNA
tactaacactttcaatag

SEQ ID NO: 58088 - DNA, 18 bp, Artificial Sequence
  Synthetic DNA
tactaactctcactctag

SEQ ID NO: 58089 - DNA, 18 bp, Artificial Sequence
  Synthetic DNA
tactaagacatactaaag

SEQ ID NO: 58090 - DNA, 18 bp, Artificial Sequence
  Synthetic DNA
tactaagactcccataag

SEQ ID NO: 58091 - DNA, 18 bp, Artificial Sequence
  Synthetic DNA
tactaaggattactatag

SEQ ID NO: 58092 - DNA, 18 bp, Artificial Sequence
  Synthetic DNA
tactacaacacactaatg

SEQ ID NO: 58093 - DNA, 18 bp, Artificial Sequence
  Synthetic DNA
tactacaactcatttcag

SEQ ID NO: 58094 - DNA, 18 bp, Artificial Sequence
  Synthetic DNA
tactaccacaaactattg

SEQ ID NO: 58095 - DNA, 18 bp, Artificial Sequence
  Synthetic DNA
tactaccacatatttttg

SEQ ID NO: 58096 - DNA, 18 bp, Artificial Sequence
  Synthetic DNA
tactacctctctctttcg

SEQ ID NO: 58097 - DNA, 18 bp, Artificial Sequence
  Synthetic DNA
tactacgacaaataacag

SEQ ID NO: 58098 - DNA, 18 bp, Artificial Sequence
  Synthetic DNA
tactacgacacataatcg

SEQ ID NO: 58099 - DNA, 18 bp, Artificial Sequence
  Synthetic DNA
tactacgacctataattg

SEQ ID NO: 58100 - DNA, 18 bp, Artificial Sequence
  Synthetic DNA
tactacgacggattattg

SEQ ID NO: 58101 - DNA, 18 bp, Artificial Sequence
  Synthetic DNA
tactacgagtaactaatg

SEQ ID NO: 58102 - DNA, 18 bp, Artificial Sequence
  Synthetic DNA
tactacgatgctctttag

SEQ ID NO: 58103 - DNA, 18 bp, Artificial Sequence
  Synthetic DNA
tactacgtaatacaatag

SEQ ID NO: 58104 - DNA, 18 bp, Artificial Sequence
  Synthetic DNA
tactacgtctagctctcg

SEQ ID NO: 58105 - DNA, 18 bp, Artificial Sequence
  Synthetic DNA
tactacgtgactctattg

SEQ ID NO: 58106 - DNA, 18 bp, Artificial Sequence
  Synthetic DNA
tactactaccctataaag

SEQ ID NO: 58107 - DNA, 18 bp, Artificial Sequence
  Synthetic DNA
tactactactaataatag

SEQ ID NO: 58108 - DNA, 18 bp, Artificial Sequence
  Synthetic DNA
tactactactctcattag

SEQ ID NO: 58109 - DNA, 18 bp, Artificial Sequence
  Synthetic DNA
tactactacttaagctag

SEQ ID NO: 58110 - DNA, 18 bp, Artificial Sequence
  Synthetic DNA
tactactactttctattg

SEQ ID NO: 58111 - DNA, 18 bp, Artificial Sequence
  Synthetic DNA
tactactgcatactaaag

SEQ ID NO: 58112 - DNA, 18 bp, Artificial Sequence
  Synthetic DNA
tactacttcgtttcaaag

SEQ ID NO: 58113 - DNA, 18 bp, Artificial Sequence
  Synthetic DNA
tactaggactatcattag

SEQ ID NO: 58114 - DNA, 18 bp, Artificial Sequence
  Synthetic DNA
tactaggattgattattg

SEQ ID NO: 58115 - DNA, 18 bp, Artificial Sequence
  Synthetic DNA
tactatcactcaatattg

SEQ ID NO: 58116 - DNA, 18 bp, Artificial Sequence
  Synthetic DNA
tactatccctaattatag

SEQ ID NO: 58117 - DNA, 18 bp, Artificial Sequence
  Synthetic DNA
tactatgaatagctatag

SEQ ID NO: 58118 - DNA, 18 bp, Artificial Sequence
  Synthetic DNA
tactccaattgactatag

SEQ ID NO: 58119 - DNA, 18 bp, Artificial Sequence
  Synthetic DNA
tactccgagacactttag

SEQ ID NO: 58120 - DNA, 18 bp, Artificial Sequence
  Synthetic DNA
tactccgagtgaatcaag

SEQ ID NO: 58121 - DNA, 18 bp, Artificial Sequence
  Synthetic DNA
tactccgattatctatag

SEQ ID NO: 58122 - DNA, 18 bp, Artificial Sequence
  Synthetic DNA
tactccgtctccctctag

SEQ ID NO: 58123 - DNA, 18 bp, Artificial Sequence
  Synthetic DNA
tactcggactcgctaaag

SEQ ID NO: 58124 - DNA, 18 bp, Artificial Sequence
  Synthetic DNA
tactgccaatcggtatag

SEQ ID NO: 58125 - DNA, 18 bp, Artificial Sequence
  Synthetic DNA
tactgcgaatctctatgg

SEQ ID NO: 58126 - DNA, 18 bp, Artificial Sequence
  Synthetic DNA
tactgcgatacactacag

SEQ ID NO: 58127 - DNA, 18 bp, Artificial Sequence
  Synthetic DNA
tactgcgattccttatag

SEQ ID NO: 58128 - DNA, 18 bp, Artificial Sequence
  Synthetic DNA
tactgcgtcttactattg

SEQ ID NO: 58129 - DNA, 18 bp, Artificial Sequence
  Synthetic DNA
tacttccacttactctag

SEQ ID NO: 58130 - DNA, 18 bp, Artificial Sequence
  Synthetic DNA
tacttcgaattaccaaag

SEQ ID NO: 58131 - DNA, 18 bp, Artificial Sequence
  Synthetic DNA
tacttcgacacaatattg

SEQ ID NO: 58132 - DNA, 18 bp, Artificial Sequence
  Synthetic DNA
tacttcgactctatagtg

SEQ ID NO: 58133 - DNA, 18 bp, Artificial Sequence
  Synthetic DNA
tacttcgacttactaacg

SEQ ID NO: 58134 - DNA, 18 bp, Artificial Sequence
  Synthetic DNA
tacttcgatacaccatag

SEQ ID NO: 58135 - DNA, 18 bp, Artificial Sequence
  Synthetic DNA
tacttcttctcgcaatag

SEQ ID NO: 58136 - DNA, 18 bp, Artificial Sequence
  Synthetic DNA
tacttggactaacaattg

SEQ ID NO: 58137 - DNA, 18 bp, Artificial Sequence
  Synthetic DNA
tactttaattcactagag

SEQ ID NO: 58138 - DNA, 18 bp, Artificial Sequence
  Synthetic DNA
tagaacaacttcctatag

SEQ ID NO: 58139 - DNA, 18 bp, Artificial Sequence
  Synthetic DNA
tagaacgattctatattg

SEQ ID NO: 58140 - DNA, 18 bp, Artificial Sequence
  Synthetic DNA
tagaacggccccttatag

SEQ ID NO: 58141 - DNA, 18 bp, Artificial Sequence
  Synthetic DNA
tagaacggcttaatatag

SEQ ID NO: 58142 - DNA, 18 bp, Artificial Sequence
  Synthetic DNA
tagaacgtcgcaatatag

SEQ ID NO: 58143 - DNA, 18 bp, Artificial Sequence
  Synthetic DNA
tagaactactcatcatag

SEQ ID NO: 58144 - DNA, 18 bp, Artificial Sequence
  Synthetic DNA
tagaactactctttatag

SEQ ID NO: 58145 - DNA, 18 bp, Artificial Sequence
  Synthetic DNA
tagaactcattactaatg

SEQ ID NO: 58146 - DNA, 18 bp, Artificial Sequence
  Synthetic DNA
tagaatgacttacaatcg

SEQ ID NO: 58147 - DNA, 18 bp, Artificial Sequence
  Synthetic DNA
tagagcgactctccattg

SEQ ID NO: 58148 - DNA, 18 bp, Artificial Sequence
  Synthetic DNA
tagatcgactatacatag

SEQ ID NO: 58149 - DNA, 18 bp, Artificial Sequence
  Synthetic DNA
tagcaccagacattctag

SEQ ID NO: 58150 - DNA, 18 bp, Artificial Sequence
  Synthetic DNA
tagcacgacactctgtag

SEQ ID NO: 58151 - DNA, 18 bp, Artificial Sequence
  Synthetic DNA
tagcacggcatactatcg

SEQ ID NO: 58152 - DNA, 18 bp, Artificial Sequence
  Synthetic DNA
tagcacggcatatcgtag

SEQ ID NO: 58153 - DNA, 18 bp, Artificial Sequence
  Synthetic DNA
tagcacgtatcactttag

SEQ ID NO: 58154 - DNA, 18 bp, Artificial Sequence
  Synthetic DNA
tagcacgtctcattatgg

SEQ ID NO: 58155 - DNA, 18 bp, Artificial Sequence
  Synthetic DNA
taggctgaatcaccatag

SEQ ID NO: 58156 - DNA, 18 bp, Artificial Sequence
  Synthetic DNA
tagtaaaactctccatag

SEQ ID NO: 58157 - DNA, 18 bp, Artificial Sequence
  Synthetic DNA
tagtaagaccgagcggag

SEQ ID NO: 58158 - DNA, 18 bp, Artificial Sequence
  Synthetic DNA
tagtaagactttctgtag

SEQ ID NO: 58159 - DNA, 18 bp, Artificial Sequence
  Synthetic DNA
tagtaagatacactacag

SEQ ID NO: 58160 - DNA, 18 bp, Artificial Sequence
  Synthetic DNA
tagtacaaaataatttgg

SEQ ID NO: 58161 - DNA, 18 bp, Artificial Sequence
  Synthetic DNA
tagtacaaattactttag

SEQ ID NO: 58162 - DNA, 18 bp, Artificial Sequence
  Synthetic DNA
tagtacaacactatatag

SEQ ID NO: 58163 - DNA, 18 bp, Artificial Sequence
  Synthetic DNA
tagtacaactccccagag

SEQ ID NO: 58164 - DNA, 18 bp, Artificial Sequence
  Synthetic DNA
tagtaccactattcatag

SEQ ID NO: 58165 - DNA, 18 bp, Artificial Sequence
  Synthetic DNA
tagtaccgcgcacgatag

SEQ ID NO: 58166 - DNA, 18 bp, Artificial Sequence
  Synthetic DNA
tagtacgacactccatgg

SEQ ID NO: 58167 - DNA, 18 bp, Artificial Sequence
  Synthetic DNA
tagtacgacatataatcg

SEQ ID NO: 58168 - DNA, 18 bp, Artificial Sequence
  Synthetic DNA
tagtacgacattttatag

SEQ ID NO: 58169 - DNA, 18 bp, Artificial Sequence
  Synthetic DNA
tagtacgactcttaaatg

SEQ ID NO: 58170 - DNA, 18 bp, Artificial Sequence
  Synthetic DNA
tagtacgacttgcttttg

SEQ ID NO: 58171 - DNA, 18 bp, Artificial Sequence
  Synthetic DNA
tagtacgatgcacaatgg

SEQ ID NO: 58172 - DNA, 18 bp, Artificial Sequence
  Synthetic DNA
tagtacgcatgccttaag

SEQ ID NO: 58173 - DNA, 18 bp, Artificial Sequence
  Synthetic DNA
tagtacgccgcacgacag

SEQ ID NO: 58174 - DNA, 18 bp, Artificial Sequence
  Synthetic DNA
tagtacgccttccgtttg

SEQ ID NO: 58175 - DNA, 18 bp, Artificial Sequence
  Synthetic DNA
tagtacggcacattagtg

SEQ ID NO: 58176 - DNA, 18 bp, Artificial Sequence
  Synthetic DNA
tagtacgtaaaactagag

SEQ ID NO: 58177 - DNA, 18 bp, Artificial Sequence
  Synthetic DNA
tagtacgtatcacttatg

SEQ ID NO: 58178 - DNA, 18 bp, Artificial Sequence
  Synthetic DNA
tagtacgtcacacgaaag

SEQ ID NO: 58179 - DNA, 18 bp, Artificial Sequence
  Synthetic DNA
tagtacgtctatctattg

SEQ ID NO: 58180 - DNA, 18 bp, Artificial Sequence
  Synthetic DNA
tagtacgtctctccaaag

SEQ ID NO: 58181 - DNA, 18 bp, Artificial Sequence
  Synthetic DNA
tagtacgtgtctctaaag

SEQ ID NO: 58182 - DNA, 18 bp, Artificial Sequence
  Synthetic DNA
tagtactactcaacacag

SEQ ID NO: 58183 - DNA, 18 bp, Artificial Sequence
  Synthetic DNA
tagtactactcttttacg

SEQ ID NO: 58184 - DNA, 18 bp, Artificial Sequence
  Synthetic DNA
tagtactagttcccatag

SEQ ID NO: 58185 - DNA, 18 bp, Artificial Sequence
  Synthetic DNA
tagtactattgacttaag

SEQ ID NO: 58186 - DNA, 18 bp, Artificial Sequence
  Synthetic DNA
tagtactcaacaaaattg

SEQ ID NO: 58187 - DNA, 18 bp, Artificial Sequence
  Synthetic DNA
tagtaggattcactcttg

SEQ ID NO: 58188 - DNA, 18 bp, Artificial Sequence
  Synthetic DNA
tagtagggcactctatag

SEQ ID NO: 58189 - DNA, 18 bp, Artificial Sequence
  Synthetic DNA
tagtaggtctccatattg

SEQ ID NO: 58190 - DNA, 18 bp, Artificial Sequence
  Synthetic DNA
tagtataactctcaatcg

SEQ ID NO: 58191 - DNA, 18 bp, Artificial Sequence
  Synthetic DNA
tagtatgacagtctatag

SEQ ID NO: 58192 - DNA, 18 bp, Artificial Sequence
  Synthetic DNA
tagtatgtgacactatag

SEQ ID NO: 58193 - DNA, 18 bp, Artificial Sequence
  Synthetic DNA
tagtatttctccctatag

SEQ ID NO: 58194 - DNA, 18 bp, Artificial Sequence
  Synthetic DNA
tagtcagacgcggtacag

SEQ ID NO: 58195 - DNA, 18 bp, Artificial Sequence
  Synthetic DNA
tagtcagttatacaaaag

SEQ ID NO: 58196 - DNA, 18 bp, Artificial Sequence
  Synthetic DNA
tagtcttactcgctttag

SEQ ID NO: 58197 - DNA, 18 bp, Artificial Sequence
  Synthetic DNA
tagtgcaaatcattatag

SEQ ID NO: 58198 - DNA, 18 bp, Artificial Sequence
  Synthetic DNA
tagttagatccactatag

SEQ ID NO: 58199 - DNA, 18 bp, Artificial Sequence
  Synthetic DNA
tagttcaaagctcaatag

SEQ ID NO: 58200 - DNA, 18 bp, Artificial Sequence
  Synthetic DNA
tagttccactctctacag

SEQ ID NO: 58201 - DNA, 18 bp, Artificial Sequence
  Synthetic DNA
tagttcgactatctttag

SEQ ID NO: 58202 - DNA, 18 bp, Artificial Sequence
  Synthetic DNA
tagttcgagtcactgcgg

SEQ ID NO: 58203 - DNA, 18 bp, Artificial Sequence
  Synthetic DNA
tagttcgcgtgactatag

SEQ ID NO: 58204 - DNA, 18 bp, Artificial Sequence
  Synthetic DNA
tagttcggcacaataaag

SEQ ID NO: 58205 - DNA, 18 bp, Artificial Sequence
  Synthetic DNA
tagttcgtttcactgtag

SEQ ID NO: 58206 - DNA, 18 bp, Artificial Sequence
  Synthetic DNA
tagttctactcactaatg

SEQ ID NO: 58207 - DNA, 18 bp, Artificial Sequence
  Synthetic DNA
tagttctattaactatag

SEQ ID NO: 58208 - DNA, 18 bp, Artificial Sequence
  Synthetic DNA
tagtttaaatcccaatag

SEQ ID NO: 58209 - DNA, 18 bp, Artificial Sequence
  Synthetic DNA
tagtttcacctactaaag

SEQ ID NO: 58210 - DNA, 18 bp, Artificial Sequence
  Synthetic DNA
tataaaatctcactatcg

SEQ ID NO: 58211 - DNA, 18 bp, Artificial Sequence
  Synthetic DNA
tataaaatttcttttttg

SEQ ID NO: 58212 - DNA, 18 bp, Artificial Sequence
  Synthetic DNA
tataaagactcactgagg

SEQ ID NO: 58213 - DNA, 18 bp, Artificial Sequence
  Synthetic DNA
tataaagattcctcatag

SEQ ID NO: 58214 - DNA, 18 bp, Artificial Sequence
  Synthetic DNA
tataacaactccctattg

SEQ ID NO: 58215 - DNA, 18 bp, Artificial Sequence
  Synthetic DNA
tataacaattcactttag

SEQ ID NO: 58216 - DNA, 18 bp, Artificial Sequence
  Synthetic DNA
tataacatatcacttaag

SEQ ID NO: 58217 - DNA, 18 bp, Artificial Sequence
  Synthetic DNA
tataaccactcattaaag

SEQ ID NO: 58218 - DNA, 18 bp, Artificial Sequence
  Synthetic DNA
tataaccatatacaatag

SEQ ID NO: 58219 - DNA, 18 bp, Artificial Sequence
  Synthetic DNA
tataacgaattactatgg

SEQ ID NO: 58220 - DNA, 18 bp, Artificial Sequence
  Synthetic DNA
tataacgacaacattcag

SEQ ID NO: 58221 - DNA, 18 bp, Artificial Sequence
  Synthetic DNA
tataacgacacacctcgg

SEQ ID NO: 58222 - DNA, 18 bp, Artificial Sequence
  Synthetic DNA
tataacgacatcatatag

SEQ ID NO: 58223 - DNA, 18 bp, Artificial Sequence
  Synthetic DNA
tataacgactaagtacag

SEQ ID NO: 58224 - DNA, 18 bp, Artificial Sequence
  Synthetic DNA
tataacgactcagactag

SEQ ID NO: 58225 - DNA, 18 bp, Artificial Sequence
  Synthetic DNA
tataacgactcatgaaag

SEQ ID NO: 58226 - DNA, 18 bp, Artificial Sequence
  Synthetic DNA
tataacgactgaatattg

SEQ ID NO: 58227 - DNA, 18 bp, Artificial Sequence
  Synthetic DNA
tataacgagacactaaag

SEQ ID NO: 58228 - DNA, 18 bp, Artificial Sequence
  Synthetic DNA
tataacgagccattatgg

SEQ ID NO: 58229 - DNA, 18 bp, Artificial Sequence
  Synthetic DNA
tataacgattcacaaacg

SEQ ID NO: 58230 - DNA, 18 bp, Artificial Sequence
  Synthetic DNA
tataacgattcaccttag

SEQ ID NO: 58231 - DNA, 18 bp, Artificial Sequence
  Synthetic DNA
tataacgattcacttctg

SEQ ID NO: 58232 - DNA, 18 bp, Artificial Sequence
  Synthetic DNA
tataacgccacactttag

SEQ ID NO: 58233 - DNA, 18 bp, Artificial Sequence
  Synthetic DNA
tataacgccccaccatag

SEQ ID NO: 58234 - DNA, 18 bp, Artificial Sequence
  Synthetic DNA
tataacgcctcgctctag

SEQ ID NO: 58235 - DNA, 18 bp, Artificial Sequence
  Synthetic DNA
tataacggctcgttttag

SEQ ID NO: 58236 - DNA, 18 bp, Artificial Sequence
  Synthetic DNA
tataacgtcacactttag

SEQ ID NO: 58237 - DNA, 18 bp, Artificial Sequence
  Synthetic DNA
tataacgtctcagtctag

SEQ ID NO: 58238 - DNA, 18 bp, Artificial Sequence
  Synthetic DNA
tataactacaccctatag

SEQ ID NO: 58239 - DNA, 18 bp, Artificial Sequence
  Synthetic DNA
tataaggaccaataatcg

SEQ ID NO: 58240 - DNA, 18 bp, Artificial Sequence
  Synthetic DNA
tataatgactccttttag

SEQ ID NO: 58241 - DNA, 18 bp, Artificial Sequence
  Synthetic DNA
tataatgagtgacaatag

SEQ ID NO: 58242 - DNA, 18 bp, Artificial Sequence
  Synthetic DNA
tataatgcctcactgtag

SEQ ID NO: 58243 - DNA, 18 bp, Artificial Sequence
  Synthetic DNA
tatacatactcactcttg

SEQ ID NO: 58244 - DNA, 18 bp, Artificial Sequence
  Synthetic DNA
tatacccattcaataatg

SEQ ID NO: 58245 - DNA, 18 bp, Artificial Sequence
  Synthetic DNA
tataccgaaacactttcg

SEQ ID NO: 58246 - DNA, 18 bp, Artificial Sequence
  Synthetic DNA
tataccgacactcaatag

SEQ ID NO: 58247 - DNA, 18 bp, Artificial Sequence
  Synthetic DNA
tatacctactcacgattg

SEQ ID NO: 58248 - DNA, 18 bp, Artificial Sequence
  Synthetic DNA
tatacgcagtcaacatcg

SEQ ID NO: 58249 - DNA, 18 bp, Artificial Sequence
  Synthetic DNA
tatactgtctcactttag

SEQ ID NO: 58250 - DNA, 18 bp, Artificial Sequence
  Synthetic DNA
tatagccactacaaatag

SEQ ID NO: 58251 - DNA, 18 bp, Artificial Sequence
  Synthetic DNA
tatagcgacacactttag

SEQ ID NO: 58252 - DNA, 18 bp, Artificial Sequence
  Synthetic DNA
tatagcgacacggtatag

SEQ ID NO: 58253 - DNA, 18 bp, Artificial Sequence
  Synthetic DNA
tatagcgactcgtaatag

SEQ ID NO: 58254 - DNA, 18 bp, Artificial Sequence
  Synthetic DNA
tatagcgactgtcaaaag

SEQ ID NO: 58255 - DNA, 18 bp, Artificial Sequence
  Synthetic DNA
tatagcgtttctcaatag

SEQ ID NO: 58256 - DNA, 18 bp, Artificial Sequence
  Synthetic DNA
tatatagacccaccgtag

SEQ ID NO: 58257 - DNA, 18 bp, Artificial Sequence
  Synthetic DNA
tatatcgacacaccacag

SEQ ID NO: 58258 - DNA, 18 bp, Artificial Sequence
  Synthetic DNA
tatatcgagtctgtattg

SEQ ID NO: 58259 - DNA, 18 bp, Artificial Sequence
  Synthetic DNA
tatatcgattccctatag

SEQ ID NO: 58260 - DNA, 18 bp, Artificial Sequence
  Synthetic DNA
tatatcgccacactaaag

SEQ ID NO: 58261 - DNA, 18 bp, Artificial Sequence
  Synthetic DNA
tatatcgtctcactcatg

SEQ ID NO: 58262 - DNA, 18 bp, Artificial Sequence
  Synthetic DNA
tatatctaattactattg

SEQ ID NO: 58263 - DNA, 18 bp, Artificial Sequence
  Synthetic DNA
tatatctcctcattatag

SEQ ID NO: 58264 - DNA, 18 bp, Artificial Sequence
  Synthetic DNA
tatatctgctcaataaag

SEQ ID NO: 58265 - DNA, 18 bp, Artificial Sequence
  Synthetic DNA
tatcaagatacactttag

SEQ ID NO: 58266 - DNA, 18 bp, Artificial Sequence
  Synthetic DNA
tatcacaactcaataaag

SEQ ID NO: 58267 - DNA, 18 bp, Artificial Sequence
  Synthetic DNA
tatcaccaaacactattg

SEQ ID NO: 58268 - DNA, 18 bp, Artificial Sequence
  Synthetic DNA
tatcaccattgactaaag

SEQ ID NO: 58269 - DNA, 18 bp, Artificial Sequence
  Synthetic DNA
tatcacgaacccccatag

SEQ ID NO: 58270 - DNA, 18 bp, Artificial Sequence
  Synthetic DNA
tatcacgaattacgatag

SEQ ID NO: 58271 - DNA, 18 bp, Artificial Sequence
  Synthetic DNA
tatcacgacacacttcag

SEQ ID NO: 58272 - DNA, 18 bp, Artificial Sequence
  Synthetic DNA
tatcacgacactcgatag

SEQ ID NO: 58273 - DNA, 18 bp, Artificial Sequence
  Synthetic DNA
tatcacgactcatcaaag

SEQ ID NO: 58274 - DNA, 18 bp, Artificial Sequence
  Synthetic DNA
tatcacgactcgctgaag

SEQ ID NO: 58275 - DNA, 18 bp, Artificial Sequence
  Synthetic DNA
tatcacgataaactatag

SEQ ID NO: 58276 - DNA, 18 bp, Artificial Sequence
  Synthetic DNA
tatcacgatacaccatag

SEQ ID NO: 58277 - DNA, 18 bp, Artificial Sequence
  Synthetic DNA
tatcacgccaatctctag

SEQ ID NO: 58278 - DNA, 18 bp, Artificial Sequence
  Synthetic DNA
tatcacggcttatttttg

SEQ ID NO: 58279 - DNA, 18 bp, Artificial Sequence
  Synthetic DNA
tatcactactcacttcag

SEQ ID NO: 58280 - DNA, 18 bp, Artificial Sequence
  Synthetic DNA
tatcactactcatcttag

SEQ ID NO: 58281 - DNA, 18 bp, Artificial Sequence
  Synthetic DNA
tatcactactcccactag

SEQ ID NO: 58282 - DNA, 18 bp, Artificial Sequence
  Synthetic DNA
tatcccgactccttttag

SEQ ID NO: 58283 - DNA, 18 bp, Artificial Sequence
  Synthetic DNA
tatctaaactctgtatag

SEQ ID NO: 58284 - DNA, 18 bp, Artificial Sequence
  Synthetic DNA
tatctcaatttactatag

SEQ ID NO: 58285 - DNA, 18 bp, Artificial Sequence
  Synthetic DNA
tatctcgaaccattgttg

SEQ ID NO: 58286 - DNA, 18 bp, Artificial Sequence
  Synthetic DNA
tatctcgaataaaattag

SEQ ID NO: 58287 - DNA, 18 bp, Artificial Sequence
  Synthetic DNA
tatctcgaatcaatatcg

SEQ ID NO: 58288 - DNA, 18 bp, Artificial Sequence
  Synthetic DNA
tatctcgacacactcaag

SEQ ID NO: 58289 - DNA, 18 bp, Artificial Sequence
  Synthetic DNA
tatctcgcctcaattaag

SEQ ID NO: 58290 - DNA, 18 bp, Artificial Sequence
  Synthetic DNA
tatctcgtcttactgtag

SEQ ID NO: 58291 - DNA, 18 bp, Artificial Sequence
  Synthetic DNA
tatcttgacttattatag

SEQ ID NO: 58292 - DNA, 18 bp, Artificial Sequence
  Synthetic DNA
tatgaagacttacttttg

SEQ ID NO: 58293 - DNA, 18 bp, Artificial Sequence
  Synthetic DNA
tatgacataacgctctag

SEQ ID NO: 58294 - DNA, 18 bp, Artificial Sequence
  Synthetic DNA
tatgacctctaactctag

SEQ ID NO: 58295 - DNA, 18 bp, Artificial Sequence
  Synthetic DNA
tatgacgacactcaatag

SEQ ID NO: 58296 - DNA, 18 bp, Artificial Sequence
  Synthetic DNA
tatgacgactcaaccttg

SEQ ID NO: 58297 - DNA, 18 bp, Artificial Sequence
  Synthetic DNA
tatgactactcacaattg

SEQ ID NO: 58298 - DNA, 18 bp, Artificial Sequence
  Synthetic DNA
tatgatgacatacttaag

SEQ ID NO: 58299 - DNA, 18 bp, Artificial Sequence
  Synthetic DNA
tatgatgactaactacag

SEQ ID NO: 58300 - DNA, 18 bp, Artificial Sequence
  Synthetic DNA
tatggccactcactatgg

SEQ ID NO: 58301 - DNA, 18 bp, Artificial Sequence
  Synthetic DNA
tatgtcgtctcactacag

SEQ ID NO: 58302 - DNA, 18 bp, Artificial Sequence
  Synthetic DNA
tatgtggtctcacgctag

SEQ ID NO: 58303 - DNA, 18 bp, Artificial Sequence
  Synthetic DNA
tattaaaactaattatag

SEQ ID NO: 58304 - DNA, 18 bp, Artificial Sequence
  Synthetic DNA
tattaacaatcaatatag

SEQ ID NO: 58305 - DNA, 18 bp, Artificial Sequence
  Synthetic DNA
tattaacacttagtatag

SEQ ID NO: 58306 - DNA, 18 bp, Artificial Sequence
  Synthetic DNA
tattaaccttcgctattg

SEQ ID NO: 58307 - DNA, 18 bp, Artificial Sequence
  Synthetic DNA
tattaagagacactactg

SEQ ID NO: 58308 - DNA, 18 bp, Artificial Sequence
  Synthetic DNA
tattaagattcataattg

SEQ ID NO: 58309 - DNA, 18 bp, Artificial Sequence
  Synthetic DNA
tattaagattctgtgtag

SEQ ID NO: 58310 - DNA, 18 bp, Artificial Sequence
  Synthetic DNA
tattaagcctcacctttg

SEQ ID NO: 58311 - DNA, 18 bp, Artificial Sequence
  Synthetic DNA
tattaagtcttaatttag

SEQ ID NO: 58312 - DNA, 18 bp, Artificial Sequence
  Synthetic DNA
tattaagtgtctctttag

SEQ ID NO: 58313 - DNA, 18 bp, Artificial Sequence
  Synthetic DNA
tattaattctctctattg

SEQ ID NO: 58314 - DNA, 18 bp, Artificial Sequence
  Synthetic DNA
tattaattgtcacaatag

SEQ ID NO: 58315 - DNA, 18 bp, Artificial Sequence
  Synthetic DNA
tattacaaatcacatgag

SEQ ID NO: 58316 - DNA, 18 bp, Artificial Sequence
  Synthetic DNA
tattacaacacaaaatag

SEQ ID NO: 58317 - DNA, 18 bp, Artificial Sequence
  Synthetic DNA
tattacaacacaatatgg

SEQ ID NO: 58318 - DNA, 18 bp, Artificial Sequence
  Synthetic DNA
tattacaacccacaaaag

SEQ ID NO: 58319 - DNA, 18 bp, Artificial Sequence
  Synthetic DNA
tattacaactcacagctg

SEQ ID NO: 58320 - DNA, 18 bp, Artificial Sequence
  Synthetic DNA
tattacaacttatcatag

SEQ ID NO: 58321 - DNA, 18 bp, Artificial Sequence
  Synthetic DNA
tattacaacttattttag

SEQ ID NO: 58322 - DNA, 18 bp, Artificial Sequence
  Synthetic DNA
tattacaacttgtcatag

SEQ ID NO: 58323 - DNA, 18 bp, Artificial Sequence
  Synthetic DNA
tattacaattcactttcg

SEQ ID NO: 58324 - DNA, 18 bp, Artificial Sequence
  Synthetic DNA
tattacaattcagtaaag

SEQ ID NO: 58325 - DNA, 18 bp, Artificial Sequence
  Synthetic DNA
tattacagctcacttctg

SEQ ID NO: 58326 - DNA, 18 bp, Artificial Sequence
  Synthetic DNA
tattacatatcactttag

SEQ ID NO: 58327 - DNA, 18 bp, Artificial Sequence
  Synthetic DNA
tattacatctaaatttag

SEQ ID NO: 58328 - DNA, 18 bp, Artificial Sequence
  Synthetic DNA
tattaccacccaatattg

SEQ ID NO: 58329 - DNA, 18 bp, Artificial Sequence
  Synthetic DNA
tattaccaccctcgatag

SEQ ID NO: 58330 - DNA, 18 bp, Artificial Sequence
  Synthetic DNA
tattaccactcccagtag

SEQ ID NO: 58331 - DNA, 18 bp, Artificial Sequence
  Synthetic DNA
tattaccattttccatag

SEQ ID NO: 58332 - DNA, 18 bp, Artificial Sequence
  Synthetic DNA
tattacccctgtctattg

SEQ ID NO: 58333 - DNA, 18 bp, Artificial Sequence
  Synthetic DNA
tattaccgcatgctatag

SEQ ID NO: 58334 - DNA, 18 bp, Artificial Sequence
  Synthetic DNA
tattacctataaatatag

SEQ ID NO: 58335 - DNA, 18 bp, Artificial Sequence
  Synthetic DNA
tattacctcacacattag

SEQ ID NO: 58336 - DNA, 18 bp, Artificial Sequence
  Synthetic DNA
tattacctctcatcaaag

SEQ ID NO: 58337 - DNA, 18 bp, Artificial Sequence
  Synthetic DNA
tattacgaaacattttag

SEQ ID NO: 58338 - DNA, 18 bp, Artificial Sequence
  Synthetic DNA
tattacgaataattaaag

SEQ ID NO: 58339 - DNA, 18 bp, Artificial Sequence
  Synthetic DNA
tattacgaattaccaagg

SEQ ID NO: 58340 - DNA, 18 bp, Artificial Sequence
  Synthetic DNA
tattacgacaatttgtag

SEQ ID NO: 58341 - DNA, 18 bp, Artificial Sequence
  Synthetic DNA
tattacgacacattctgg

SEQ ID NO: 58342 - DNA, 18 bp, Artificial Sequence
  Synthetic DNA
tattacgacaccgtattg

SEQ ID NO: 58343 - DNA, 18 bp, Artificial Sequence
  Synthetic DNA
tattacgacatccttaag

SEQ ID NO: 58344 - DNA, 18 bp, Artificial Sequence
  Synthetic DNA
tattacgacatgttacag

SEQ ID NO: 58345 - DNA, 18 bp, Artificial Sequence
  Synthetic DNA
tattacgacattattttg

SEQ ID NO: 58346 - DNA, 18 bp, Artificial Sequence
  Synthetic DNA
tattacgacgcagttcag

SEQ ID NO: 58347 - DNA, 18 bp, Artificial Sequence
  Synthetic DNA
tattacgacgcttaaaag

SEQ ID NO: 58348 - DNA, 18 bp, Artificial Sequence
  Synthetic DNA
tattacgactcaaacaag

SEQ ID NO: 58349 - DNA, 18 bp, Artificial Sequence
  Synthetic DNA
tattacgacttatgacag

SEQ ID NO: 58350 - DNA, 18 bp, Artificial Sequence
  Synthetic DNA
tattacgacttgcttaag

SEQ ID NO: 58351 - DNA, 18 bp, Artificial Sequence
  Synthetic DNA
tattacgagtcaaaattg

SEQ ID NO: 58352 - DNA, 18 bp, Artificial Sequence
  Synthetic DNA
tattacgatacacaaaag

SEQ ID NO: 58353 - DNA, 18 bp, Artificial Sequence
  Synthetic DNA
tattacgatgcattctag

SEQ ID NO: 58354 - DNA, 18 bp, Artificial Sequence
  Synthetic DNA
tattacgattctcaacag

SEQ ID NO: 58355 - DNA, 18 bp, Artificial Sequence
  Synthetic DNA
tattacgattttatatag

SEQ ID NO: 58356 - DNA, 18 bp, Artificial Sequence
  Synthetic DNA
tattacgcgtgtctattg

SEQ ID NO: 58357 - DNA, 18 bp, Artificial Sequence
  Synthetic DNA
tattacggcccactactg

SEQ ID NO: 58358 - DNA, 18 bp, Artificial Sequence
  Synthetic DNA
tattacggctaattagtg

SEQ ID NO: 58359 - DNA, 18 bp, Artificial Sequence
  Synthetic DNA
tattacggctctatacag

SEQ ID NO: 58360 - DNA, 18 bp, Artificial Sequence
  Synthetic DNA
tattacgggttataaaag

SEQ ID NO: 58361 - DNA, 18 bp, Artificial Sequence
  Synthetic DNA
tattacgtatctctatcg

SEQ ID NO: 58362 - DNA, 18 bp, Artificial Sequence
  Synthetic DNA
tattacgtatctctattg

SEQ ID NO: 58363 - DNA, 18 bp, Artificial Sequence
  Synthetic DNA
tattacgtcacaccagag

SEQ ID NO: 58364 - DNA, 18 bp, Artificial Sequence
  Synthetic DNA
tattacgtcccacattag

SEQ ID NO: 58365 - DNA, 18 bp, Artificial Sequence
  Synthetic DNA
tattacgtcccactttgg

SEQ ID NO: 58366 - DNA, 18 bp, Artificial Sequence
  Synthetic DNA
tattacgtccgtatatag

SEQ ID NO: 58367 - DNA, 18 bp, Artificial Sequence
  Synthetic DNA
tattacgtcgctttatag

SEQ ID NO: 58368 - DNA, 18 bp, Artificial Sequence
  Synthetic DNA
tattacgtctagccattg

SEQ ID NO: 58369 - DNA, 18 bp, Artificial Sequence
  Synthetic DNA
tattacgtctctttctag

SEQ ID NO: 58370 - DNA, 18 bp, Artificial Sequence
  Synthetic DNA
tattacgtgtctcaatag

SEQ ID NO: 58371 - DNA, 18 bp, Artificial Sequence
  Synthetic DNA
tattacgttatactaaag

SEQ ID NO: 58372 - DNA, 18 bp, Artificial Sequence
  Synthetic DNA
tattacgtttagctaaag

SEQ ID NO: 58373 - DNA, 18 bp, Artificial Sequence
  Synthetic DNA
tattacgtttctttaaag

SEQ ID NO: 58374 - DNA, 18 bp, Artificial Sequence
  Synthetic DNA
tattactaatcactaagg

SEQ ID NO: 58375 - DNA, 18 bp, Artificial Sequence
  Synthetic DNA
tattactacaaactatcg

SEQ ID NO: 58376 - DNA, 18 bp, Artificial Sequence
  Synthetic DNA
tattactacccacaaatg

SEQ ID NO: 58377 - DNA, 18 bp, Artificial Sequence
  Synthetic DNA
tattactactaacttaag

SEQ ID NO: 58378 - DNA, 18 bp, Artificial Sequence
  Synthetic DNA
tattactactcactcatg

SEQ ID NO: 58379 - DNA, 18 bp, Artificial Sequence
  Synthetic DNA
tattactactcataaacg

SEQ ID NO: 58380 - DNA, 18 bp, Artificial Sequence
  Synthetic DNA
tattactactctcaaatg

SEQ ID NO: 58381 - DNA, 18 bp, Artificial Sequence
  Synthetic DNA
tattactataccgtattg

SEQ ID NO: 58382 - DNA, 18 bp, Artificial Sequence
  Synthetic DNA
tattactattgtcattag

SEQ ID NO: 58383 - DNA, 18 bp, Artificial Sequence
  Synthetic DNA
tattactcatctgtattg

SEQ ID NO: 58384 - DNA, 18 bp, Artificial Sequence
  Synthetic DNA
tattacttcagactattg

SEQ ID NO: 58385 - DNA, 18 bp, Artificial Sequence
  Synthetic DNA
tattagaattcactctag

SEQ ID NO: 58386 - DNA, 18 bp, Artificial Sequence
  Synthetic DNA
tattaggaaacacaatag

SEQ ID NO: 58387 - DNA, 18 bp, Artificial Sequence
  Synthetic DNA
tattaggaatccttatag

SEQ ID NO: 58388 - DNA, 18 bp, Artificial Sequence
  Synthetic DNA
tattaggacacattaatg

SEQ ID NO: 58389 - DNA, 18 bp, Artificial Sequence
  Synthetic DNA
tattaggacttaaaatag

SEQ ID NO: 58390 - DNA, 18 bp, Artificial Sequence
  Synthetic DNA
tattaggattcacattag

SEQ ID NO: 58391 - DNA, 18 bp, Artificial Sequence
  Synthetic DNA
tattagggctaactttag

SEQ ID NO: 58392 - DNA, 18 bp, Artificial Sequence
  Synthetic DNA
tattaggtctcaatctag

SEQ ID NO: 58393 - DNA, 18 bp, Artificial Sequence
  Synthetic DNA
tattataactccctgtag

SEQ ID NO: 58394 - DNA, 18 bp, Artificial Sequence
  Synthetic DNA
tattataacttactaacg

SEQ ID NO: 58395 - DNA, 18 bp, Artificial Sequence
  Synthetic DNA
tattatcacactctctag

SEQ ID NO: 58396 - DNA, 18 bp, Artificial Sequence
  Synthetic DNA
tattatcactcaataatg

SEQ ID NO: 58397 - DNA, 18 bp, Artificial Sequence
  Synthetic DNA
tattatgacacaccatgg

SEQ ID NO: 58398 - DNA, 18 bp, Artificial Sequence
  Synthetic DNA
tattatgacacactaccg

SEQ ID NO: 58399 - DNA, 18 bp, Artificial Sequence
  Synthetic DNA
tattatgattccctaaag

SEQ ID NO: 58400 - DNA, 18 bp, Artificial Sequence
  Synthetic DNA
tattatgcctcactgttg

SEQ ID NO: 58401 - DNA, 18 bp, Artificial Sequence
  Synthetic DNA
tattatgtcccactctag

SEQ ID NO: 58402 - DNA, 18 bp, Artificial Sequence
  Synthetic DNA
tattatgtctcactgaag

SEQ ID NO: 58403 - DNA, 18 bp, Artificial Sequence
  Synthetic DNA
tattattaattacaagtg

SEQ ID NO: 58404 - DNA, 18 bp, Artificial Sequence
  Synthetic DNA
tattcaaactcacttttg

SEQ ID NO: 58405 - DNA, 18 bp, Artificial Sequence
  Synthetic DNA
tattccaacacattttag

SEQ ID NO: 58406 - DNA, 18 bp, Artificial Sequence
  Synthetic DNA
tattccaactaaatatag

SEQ ID NO: 58407 - DNA, 18 bp, Artificial Sequence
  Synthetic DNA
tattccaagcctctatag

SEQ ID NO: 58408 - DNA, 18 bp, Artificial Sequence
  Synthetic DNA
tattccaattctcttaag

SEQ ID NO: 58409 - DNA, 18 bp, Artificial Sequence
  Synthetic DNA
tattccgactcagcatgg

SEQ ID NO: 58410 - DNA, 18 bp, Artificial Sequence
  Synthetic DNA
tattccggatctttaaag

SEQ ID NO: 58411 - DNA, 18 bp, Artificial Sequence
  Synthetic DNA
tattccgtatcaccaaag

SEQ ID NO: 58412 - DNA, 18 bp, Artificial Sequence
  Synthetic DNA
tattcctactcactaacg

SEQ ID NO: 58413 - DNA, 18 bp, Artificial Sequence
  Synthetic DNA
tattcctactctttatag

SEQ ID NO: 58414 - DNA, 18 bp, Artificial Sequence
  Synthetic DNA
tattcggagacactatag

SEQ ID NO: 58415 - DNA, 18 bp, Artificial Sequence
  Synthetic DNA
tattgagattcgctatag

SEQ ID NO: 58416 - DNA, 18 bp, Artificial Sequence
  Synthetic DNA
tattgatacgcactgtag

SEQ ID NO: 58417 - DNA, 18 bp, Artificial Sequence
  Synthetic DNA
tattgcaacacaatatcg

SEQ ID NO: 58418 - DNA, 18 bp, Artificial Sequence
  Synthetic DNA
tattgcaactcagtgtag

SEQ ID NO: 58419 - DNA, 18 bp, Artificial Sequence
  Synthetic DNA
tattgcaatccacaaaag

SEQ ID NO: 58420 - DNA, 18 bp, Artificial Sequence
  Synthetic DNA
tattgcgaattacttacg

SEQ ID NO: 58421 - DNA, 18 bp, Artificial Sequence
  Synthetic DNA
tattgcgacccactcatg

SEQ ID NO: 58422 - DNA, 18 bp, Artificial Sequence
  Synthetic DNA
tattgcgactctcagtag

SEQ ID NO: 58423 - DNA, 18 bp, Artificial Sequence
  Synthetic DNA
tattgcgcatcactaaag

SEQ ID NO: 58424 - DNA, 18 bp, Artificial Sequence
  Synthetic DNA
tattgcggcaaacaattg

SEQ ID NO: 58425 - DNA, 18 bp, Artificial Sequence
  Synthetic DNA
tattgcgtatcggtatag

SEQ ID NO: 58426 - DNA, 18 bp, Artificial Sequence
  Synthetic DNA
tattgcgtctcacttttg

SEQ ID NO: 58427 - DNA, 18 bp, Artificial Sequence
  Synthetic DNA
tattgctactaacattag

SEQ ID NO: 58428 - DNA, 18 bp, Artificial Sequence
  Synthetic DNA
tattgggactctcttttg

SEQ ID NO: 58429 - DNA, 18 bp, Artificial Sequence
  Synthetic DNA
tattggtactgactatag

SEQ ID NO: 58430 - DNA, 18 bp, Artificial Sequence
  Synthetic DNA
tattgttaccccatatag

SEQ ID NO: 58431 - DNA, 18 bp, Artificial Sequence
  Synthetic DNA
tattgttattgtctatag

SEQ ID NO: 58432 - DNA, 18 bp, Artificial Sequence
  Synthetic DNA
tatttaatctcatcacgg

SEQ ID NO: 58433 - DNA, 18 bp, Artificial Sequence
  Synthetic DNA
tatttagactctctattg

SEQ ID NO: 58434 - DNA, 18 bp, Artificial Sequence
  Synthetic DNA
tatttcaaatcacaattg

SEQ ID NO: 58435 - DNA, 18 bp, Artificial Sequence
  Synthetic DNA
tatttcaactcagtattg

SEQ ID NO: 58436 - DNA, 18 bp, Artificial Sequence
  Synthetic DNA
tatttcacctcccaatag

SEQ ID NO: 58437 - DNA, 18 bp, Artificial Sequence
  Synthetic DNA
tatttcatccgtctatag

SEQ ID NO: 58438 - DNA, 18 bp, Artificial Sequence
  Synthetic DNA
tatttccaataaatatag

SEQ ID NO: 58439 - DNA, 18 bp, Artificial Sequence
  Synthetic DNA
tatttccaatcacattag

SEQ ID NO: 58440 - DNA, 18 bp, Artificial Sequence
  Synthetic DNA
tatttccattgtctacag

SEQ ID NO: 58441 - DNA, 18 bp, Artificial Sequence
  Synthetic DNA
tatttcctctctcgatag

SEQ ID NO: 58442 - DNA, 18 bp, Artificial Sequence
  Synthetic DNA
tatttcgaatctttattg

SEQ ID NO: 58443 - DNA, 18 bp, Artificial Sequence
  Synthetic DNA
tatttcgacacagaaaag

SEQ ID NO: 58444 - DNA, 18 bp, Artificial Sequence
  Synthetic DNA
tatttcgactcctaatag

SEQ ID NO: 58445 - DNA, 18 bp, Artificial Sequence
  Synthetic DNA
tatttcgatacacaaaag

SEQ ID NO: 58446 - DNA, 18 bp, Artificial Sequence
  Synthetic DNA
tatttcgattaactctag

SEQ ID NO: 58447 - DNA, 18 bp, Artificial Sequence
  Synthetic DNA
tatttcgccacacaattg

SEQ ID NO: 58448 - DNA, 18 bp, Artificial Sequence
  Synthetic DNA
tatttcgcctcacttttg

SEQ ID NO: 58449 - DNA, 18 bp, Artificial Sequence
  Synthetic DNA
tatttcgcttcaaaatag

SEQ ID NO: 58450 - DNA, 18 bp, Artificial Sequence
  Synthetic DNA
tatttcgtataactatag

SEQ ID NO: 58451 - DNA, 18 bp, Artificial Sequence
  Synthetic DNA
tatttcgtatcaatatag

SEQ ID NO: 58452 - DNA, 18 bp, Artificial Sequence
  Synthetic DNA
tatttcgtgtcattatag

SEQ ID NO: 58453 - DNA, 18 bp, Artificial Sequence
  Synthetic DNA
tatttcgttaaagtatcg

SEQ ID NO: 58454 - DNA, 18 bp, Artificial Sequence
  Synthetic DNA
tatttctactaaatatag

SEQ ID NO: 58455 - DNA, 18 bp, Artificial Sequence
  Synthetic DNA
tatttctactaaccatag

SEQ ID NO: 58456 - DNA, 18 bp, Artificial Sequence
  Synthetic DNA
tatttctagactctgcag

SEQ ID NO: 58457 - DNA, 18 bp, Artificial Sequence
  Synthetic DNA
tatttctattctcattag

SEQ ID NO: 58458 - DNA, 18 bp, Artificial Sequence
  Synthetic DNA
tatttctgatctccctag

SEQ ID NO: 58459 - DNA, 18 bp, Artificial Sequence
  Synthetic DNA
tatttctgctcaatatag

SEQ ID NO: 58460 - DNA, 18 bp, Artificial Sequence
  Synthetic DNA
tatttcttctcactgtag

SEQ ID NO: 58461 - DNA, 18 bp, Artificial Sequence
  Synthetic DNA
tatttcttctcatcaatg

SEQ ID NO: 58462 - DNA, 18 bp, Artificial Sequence
  Synthetic DNA
tatttggacccaccatag

SEQ ID NO: 58463 - DNA, 18 bp, Artificial Sequence
  Synthetic DNA
tatttggactcgctaaag

SEQ ID NO: 58464 - DNA, 18 bp, Artificial Sequence
  Synthetic DNA
tattttaactcattaatg

SEQ ID NO: 58465 - DNA, 18 bp, Artificial Sequence
  Synthetic DNA
tattttcactcactattg

SEQ ID NO: 58466 - DNA, 18 bp, Artificial Sequence
  Synthetic DNA
tattttgacacgctttag

SEQ ID NO: 58467 - DNA, 18 bp, Artificial Sequence
  Synthetic DNA
tattttgactccctacag

SEQ ID NO: 58468 - DNA, 18 bp, Artificial Sequence
  Synthetic DNA
tattttgactctaatacg

SEQ ID NO: 58469 - DNA, 18 bp, Artificial Sequence
  Synthetic DNA
tattttgactgagtacag

SEQ ID NO: 58470 - DNA, 18 bp, Artificial Sequence
  Synthetic DNA
tcaaaaatcatatattag

SEQ ID NO: 58471 - DNA, 18 bp, Artificial Sequence
  Synthetic DNA
tcaaaacactcaccattg

SEQ ID NO: 58472 - DNA, 18 bp, Artificial Sequence
  Synthetic DNA
tcaaaagattcacgcttg

SEQ ID NO: 58473 - DNA, 18 bp, Artificial Sequence
  Synthetic DNA
tcaaacaacagtctttag

SEQ ID NO: 58474 - DNA, 18 bp, Artificial Sequence
  Synthetic DNA
tcaaacaactgacactag

SEQ ID NO: 58475 - DNA, 18 bp, Artificial Sequence
  Synthetic DNA
tcaaacacctcacaatag

SEQ ID NO: 58476 - DNA, 18 bp, Artificial Sequence
  Synthetic DNA
tcaaacatatcactatag

SEQ ID NO: 58477 - DNA, 18 bp, Artificial Sequence
  Synthetic DNA
tcaaacgactctcttttg

SEQ ID NO: 58478 - DNA, 18 bp, Artificial Sequence
  Synthetic DNA
tcaaacgattcaataatg

SEQ ID NO: 58479 - DNA, 18 bp, Artificial Sequence
  Synthetic DNA
tcaaacgatttacaaaag

SEQ ID NO: 58480 - DNA, 18 bp, Artificial Sequence
  Synthetic DNA
tcaaacggctgagtatag

SEQ ID NO: 58481 - DNA, 18 bp, Artificial Sequence
  Synthetic DNA
tcaaacgtcagagtatag

SEQ ID NO: 58482 - DNA, 18 bp, Artificial Sequence
  Synthetic DNA
tcaaactaccaactatcg

SEQ ID NO: 58483 - DNA, 18 bp, Artificial Sequence
  Synthetic DNA
tcaaactcctctacatag

SEQ ID NO: 58484 - DNA, 18 bp, Artificial Sequence
  Synthetic DNA
tcaaatgcctcacgacag

SEQ ID NO: 58485 - DNA, 18 bp, Artificial Sequence
  Synthetic DNA
tcaaccgtctcattatag

SEQ ID NO: 58486 - DNA, 18 bp, Artificial Sequence
  Synthetic DNA
tcaaccgtcttacatttg

SEQ ID NO: 58487 - DNA, 18 bp, Artificial Sequence
  Synthetic DNA
tcaactgtctcaatatag

SEQ ID NO: 58488 - DNA, 18 bp, Artificial Sequence
  Synthetic DNA
tcaactttatctcaatag

SEQ ID NO: 58489 - DNA, 18 bp, Artificial Sequence
  Synthetic DNA
tcaagagactcactattg

SEQ ID NO: 58490 - DNA, 18 bp, Artificial Sequence
  Synthetic DNA
tcaagcgactcgctctag

SEQ ID NO: 58491 - DNA, 18 bp, Artificial Sequence
  Synthetic DNA
tcaatagaatcactatag

SEQ ID NO: 58492 - DNA, 18 bp, Artificial Sequence
  Synthetic DNA
tcaatcgtatcacattag

SEQ ID NO: 58493 - DNA, 18 bp, Artificial Sequence
  Synthetic DNA
tcacaaaaatcactatag

SEQ ID NO: 58494 - DNA, 18 bp, Artificial Sequence
  Synthetic DNA
tcacaagacccaacgttg

SEQ ID NO: 58495 - DNA, 18 bp, Artificial Sequence
  Synthetic DNA
tcacacgtcacactaagg

SEQ ID NO: 58496 - DNA, 18 bp, Artificial Sequence
  Synthetic DNA
tcacacgtcccaataaag

SEQ ID NO: 58497 - DNA, 18 bp, Artificial Sequence
  Synthetic DNA
tcacacgtctcgctatcg

SEQ ID NO: 58498 - DNA, 18 bp, Artificial Sequence
  Synthetic DNA
tcacaggacttactctag

SEQ ID NO: 58499 - DNA, 18 bp, Artificial Sequence
  Synthetic DNA
tcacatgacacactttag

SEQ ID NO: 58500 - DNA, 18 bp, Artificial Sequence
  Synthetic DNA
tcactagactctctatag

SEQ ID NO: 58501 - DNA, 18 bp, Artificial Sequence
  Synthetic DNA
tcactagtacaactaaag

SEQ ID NO: 58502 - DNA, 18 bp, Artificial Sequence
  Synthetic DNA
tcactcgtctcaagatag

SEQ ID NO: 58503 - DNA, 18 bp, Artificial Sequence
  Synthetic DNA
tcagaccactgactaagg

SEQ ID NO: 58504 - DNA, 18 bp, Artificial Sequence
  Synthetic DNA
tcataagactatctacag

SEQ ID NO: 58505 - DNA, 18 bp, Artificial Sequence
  Synthetic DNA
tcatacaacacacaaaag

SEQ ID NO: 58506 - DNA, 18 bp, Artificial Sequence
  Synthetic DNA
tcatacaactcacaatta

SEQ ID NO: 58507 - DNA, 18 bp, Artificial Sequence
  Synthetic DNA
tcatacaattgacgatag

SEQ ID NO: 58508 - DNA, 18 bp, Artificial Sequence
  Synthetic DNA
tcatacatatctctatag

SEQ ID NO: 58509 - DNA, 18 bp, Artificial Sequence
  Synthetic DNA
tcataccacttactgttg

SEQ ID NO: 58510 - DNA, 18 bp, Artificial Sequence
  Synthetic DNA
tcatacgaaacagtaacg

SEQ ID NO: 58511 - DNA, 18 bp, Artificial Sequence
  Synthetic DNA
tcatacgaataaatctag

SEQ ID NO: 58512 - DNA, 18 bp, Artificial Sequence
  Synthetic DNA
tcatacgaataccagtag

SEQ ID NO: 58513 - DNA, 18 bp, Artificial Sequence
  Synthetic DNA
tcatacgaatttatatgg

SEQ ID NO: 58514 - DNA, 18 bp, Artificial Sequence
  Synthetic DNA
tcatacgaccgactaacg

SEQ ID NO: 58515 - DNA, 18 bp, Artificial Sequence
  Synthetic DNA
tcatacgacgatctacag

SEQ ID NO: 58516 - DNA, 18 bp, Artificial Sequence
  Synthetic DNA
tcatacgacgcacaaatg

SEQ ID NO: 58517 - DNA, 18 bp, Artificial Sequence
  Synthetic DNA
tcatacgactttcacagg

SEQ ID NO: 58518 - DNA, 18 bp, Artificial Sequence
  Synthetic DNA
tcatacgatctgctatcg

SEQ ID NO: 58519 - DNA, 18 bp, Artificial Sequence
  Synthetic DNA
tcatacgattaaatttag

SEQ ID NO: 58520 - DNA, 18 bp, Artificial Sequence
  Synthetic DNA
tcatacgattggttacag

SEQ ID NO: 58521 - DNA, 18 bp, Artificial Sequence
  Synthetic DNA
tcatacgcaccactattg

SEQ ID NO: 58522 - DNA, 18 bp, Artificial Sequence
  Synthetic DNA
tcatacggctcatcatgg

SEQ ID NO: 58523 - DNA, 18 bp, Artificial Sequence
  Synthetic DNA
tcatacgtagctctatag

SEQ ID NO: 58524 - DNA, 18 bp, Artificial Sequence
  Synthetic DNA
tcatacgtatcaatttcg

SEQ ID NO: 58525 - DNA, 18 bp, Artificial Sequence
  Synthetic DNA
tcatacgtctcatgaaag

SEQ ID NO: 58526 - DNA, 18 bp, Artificial Sequence
  Synthetic DNA
tcatactacccgctattg

SEQ ID NO: 58527 - DNA, 18 bp, Artificial Sequence
  Synthetic DNA
tcatactagatataatag

SEQ ID NO: 58528 - DNA, 18 bp, Artificial Sequence
  Synthetic DNA
tcatactccacacacaag

SEQ ID NO: 58529 - DNA, 18 bp, Artificial Sequence
  Synthetic DNA
tcatagaactcagtaaag

SEQ ID NO: 58530 - DNA, 18 bp, Artificial Sequence
  Synthetic DNA
tcatagagctcactattg

SEQ ID NO: 58531 - DNA, 18 bp, Artificial Sequence
  Synthetic DNA
tcatagctctctcttttg

SEQ ID NO: 58532 - DNA, 18 bp, Artificial Sequence
  Synthetic DNA
tcataggacaagctacag

SEQ ID NO: 58533 - DNA, 18 bp, Artificial Sequence
  Synthetic DNA
tcataggacatactgtag

SEQ ID NO: 58534 - DNA, 18 bp, Artificial Sequence
  Synthetic DNA
tcatataacactccaaag

SEQ ID NO: 58535 - DNA, 18 bp, Artificial Sequence
  Synthetic DNA
tcatatgactcaaaattg

SEQ ID NO: 58536 - DNA, 18 bp, Artificial Sequence
  Synthetic DNA
tcatatggctaacggtag

SEQ ID NO: 58537 - DNA, 18 bp, Artificial Sequence
  Synthetic DNA
tcatatggctcgctactg

SEQ ID NO: 58538 - DNA, 18 bp, Artificial Sequence
  Synthetic DNA
tcatatgtttttctattg

SEQ ID NO: 58539 - DNA, 18 bp, Artificial Sequence
  Synthetic DNA
tcatcagacactctacag

SEQ ID NO: 58540 - DNA, 18 bp, Artificial Sequence
  Synthetic DNA
tcatccgaatcactccag

SEQ ID NO: 58541 - DNA, 18 bp, Artificial Sequence
  Synthetic DNA
tcatccgacaaactaaag

SEQ ID NO: 58542 - DNA, 18 bp, Artificial Sequence
  Synthetic DNA
tcatctgattcactattg

SEQ ID NO: 58543 - DNA, 18 bp, Artificial Sequence
  Synthetic DNA
tcatgcaacaaacctagg

SEQ ID NO: 58544 - DNA, 18 bp, Artificial Sequence
  Synthetic DNA
tcatgcaattcaatatag

SEQ ID NO: 58545 - DNA, 18 bp, Artificial Sequence
  Synthetic DNA
tcatgcgacaccgtatag

SEQ ID NO: 58546 - DNA, 18 bp, Artificial Sequence
  Synthetic DNA
tcatgcgacttattaaag

SEQ ID NO: 58547 - DNA, 18 bp, Artificial Sequence
  Synthetic DNA
tcattagattatatattg

SEQ ID NO: 58548 - DNA, 18 bp, Artificial Sequence
  Synthetic DNA
tcattcaacacactaatg

SEQ ID NO: 58549 - DNA, 18 bp, Artificial Sequence
  Synthetic DNA
tcattcaatttaaaattg

SEQ ID NO: 58550 - DNA, 18 bp, Artificial Sequence
  Synthetic DNA
tcattcatgtctctatag

SEQ ID NO: 58551 - DNA, 18 bp, Artificial Sequence
  Synthetic DNA
tcattcgaattatttcag

SEQ ID NO: 58552 - DNA, 18 bp, Artificial Sequence
  Synthetic DNA
tcattcgacacaatctag

SEQ ID NO: 58553 - DNA, 18 bp, Artificial Sequence
  Synthetic DNA
tcattcgactaatgaaag

SEQ ID NO: 58554 - DNA, 18 bp, Artificial Sequence
  Synthetic DNA
tcattcgactcattcttg

SEQ ID NO: 58555 - DNA, 18 bp, Artificial Sequence
  Synthetic DNA
tcattcgtctgacaaaag

SEQ ID NO: 58556 - DNA, 18 bp, Artificial Sequence
  Synthetic DNA
tcattctaatcaatattg

SEQ ID NO: 58557 - DNA, 18 bp, Artificial Sequence
  Synthetic DNA
tcattctactatctatag

SEQ ID NO: 58558 - DNA, 18 bp, Artificial Sequence
  Synthetic DNA
tcattcttcacgctatag

SEQ ID NO: 58559 - DNA, 18 bp, Artificial Sequence
  Synthetic DNA
tcattggtctctctacag

SEQ ID NO: 58560 - DNA, 18 bp, Artificial Sequence
  Synthetic DNA
tcatttggctcactaaag

SEQ ID NO: 58561 - DNA, 18 bp, Artificial Sequence
  Synthetic DNA
tcatttgtgtcacaatag

SEQ ID NO: 58562 - DNA, 18 bp, Artificial Sequence
  Synthetic DNA
tcattttactgactatag

SEQ ID NO: 58563 - DNA, 18 bp, Artificial Sequence
  Synthetic DNA
tccaacggatctatatgg

SEQ ID NO: 58564 - DNA, 18 bp, Artificial Sequence
  Synthetic DNA
tcctaatacgcaatatag

SEQ ID NO: 58565 - DNA, 18 bp, Artificial Sequence
  Synthetic DNA
tcctacgtaacactatag

SEQ ID NO: 58566 - DNA, 18 bp, Artificial Sequence
  Synthetic DNA
tcctacgtcacacattag

SEQ ID NO: 58567 - DNA, 18 bp, Artificial Sequence
  Synthetic DNA
tcctacgtttgcctatag

SEQ ID NO: 58568 - DNA, 18 bp, Artificial Sequence
  Synthetic DNA
tcctccgaataactattg

SEQ ID NO: 58569 - DNA, 18 bp, Artificial Sequence
  Synthetic DNA
tcctgcgtcccataatag

SEQ ID NO: 58570 - DNA, 18 bp, Artificial Sequence
  Synthetic DNA
tccttcaacacagtcaag

SEQ ID NO: 58571 - DNA, 18 bp, Artificial Sequence
  Synthetic DNA
tcgaacgtctcacttaag

SEQ ID NO: 58572 - DNA, 18 bp, Artificial Sequence
  Synthetic DNA
tcgtacaactctctattg

SEQ ID NO: 58573 - DNA, 18 bp, Artificial Sequence
  Synthetic DNA
tcgtaccccaaactatag

SEQ ID NO: 58574 - DNA, 18 bp, Artificial Sequence
  Synthetic DNA
tcgtactacttccttaag

SEQ ID NO: 58575 - DNA, 18 bp, Artificial Sequence
  Synthetic DNA
tcgttcaactcactgtag

SEQ ID NO: 58576 - DNA, 18 bp, Artificial Sequence
  Synthetic DNA
tcgttggactttctatag

SEQ ID NO: 58577 - DNA, 18 bp, Artificial Sequence
  Synthetic DNA
tctaacctctcaatatag

SEQ ID NO: 58578 - DNA, 18 bp, Artificial Sequence
  Synthetic DNA
tctaacgacattctatag

SEQ ID NO: 58579 - DNA, 18 bp, Artificial Sequence
  Synthetic DNA
tctaacgccccatttcag

SEQ ID NO: 58580 - DNA, 18 bp, Artificial Sequence
  Synthetic DNA
tctaacgtctgactttag

SEQ ID NO: 58581 - DNA, 18 bp, Artificial Sequence
  Synthetic DNA
tctaactaatcaataaag

SEQ ID NO: 58582 - DNA, 18 bp, Artificial Sequence
  Synthetic DNA
tctagggactcattgaag

SEQ ID NO: 58583 - DNA, 18 bp, Artificial Sequence
  Synthetic DNA
tctcacaactcacagtag

SEQ ID NO: 58584 - DNA, 18 bp, Artificial Sequence
  Synthetic DNA
tctctcccctcactaaag

SEQ ID NO: 58585 - DNA, 18 bp, Artificial Sequence
  Synthetic DNA
tctgacgactctcaaaag

SEQ ID NO: 58586 - DNA, 18 bp, Artificial Sequence
  Synthetic DNA
tcttacaacacacgatag

SEQ ID NO: 58587 - DNA, 18 bp, Artificial Sequence
  Synthetic DNA
tcttacaacccaatatag

SEQ ID NO: 58588 - DNA, 18 bp, Artificial Sequence
  Synthetic DNA
tcttacaactaactaaag

SEQ ID NO: 58589 - DNA, 18 bp, Artificial Sequence
  Synthetic DNA
tcttacaactcacaacag

SEQ ID NO: 58590 - DNA, 18 bp, Artificial Sequence
  Synthetic DNA
tcttacgaatcataatag

SEQ ID NO: 58591 - DNA, 18 bp, Artificial Sequence
  Synthetic DNA
tcttacgactaactagtg

SEQ ID NO: 58592 - DNA, 18 bp, Artificial Sequence
  Synthetic DNA
tcttacgactccataaag

SEQ ID NO: 58593 - DNA, 18 bp, Artificial Sequence
  Synthetic DNA
tcttacgactcgcaaaag

SEQ ID NO: 58594 - DNA, 18 bp, Artificial Sequence
  Synthetic DNA
tcttacgattatctatcg

SEQ ID NO: 58595 - DNA, 18 bp, Artificial Sequence
  Synthetic DNA
tcttacgtatcaccatag

SEQ ID NO: 58596 - DNA, 18 bp, Artificial Sequence
  Synthetic DNA
tcttacgttgctctatag

SEQ ID NO: 58597 - DNA, 18 bp, Artificial Sequence
  Synthetic DNA
tcttactactcacattag

SEQ ID NO: 58598 - DNA, 18 bp, Artificial Sequence
  Synthetic DNA
tcttactactctccatag

SEQ ID NO: 58599 - DNA, 18 bp, Artificial Sequence
  Synthetic DNA
tcttagaactcactttag

SEQ ID NO: 58600 - DNA, 18 bp, Artificial Sequence
  Synthetic DNA
tcttaggaaacactcaag

SEQ ID NO: 58601 - DNA, 18 bp, Artificial Sequence
  Synthetic DNA
tcttattactctctatag

SEQ ID NO: 58602 - DNA, 18 bp, Artificial Sequence
  Synthetic DNA
tcttccgaccctctatag

SEQ ID NO: 58603 - DNA, 18 bp, Artificial Sequence
  Synthetic DNA
tcttcttactttctaaag

SEQ ID NO: 58604 - DNA, 18 bp, Artificial Sequence
  Synthetic DNA
tcttgcgacccaatattg

SEQ ID NO: 58605 - DNA, 18 bp, Artificial Sequence
  Synthetic DNA
tctttcgacccactaaag

SEQ ID NO: 58606 - DNA, 18 bp, Artificial Sequence
  Synthetic DNA
tctttcgactcatttatg

SEQ ID NO: 58607 - DNA, 18 bp, Artificial Sequence
  Synthetic DNA
tctttcgactcattttag

SEQ ID NO: 58608 - DNA, 18 bp, Artificial Sequence
  Synthetic DNA
tgaaaaggctcccattag

SEQ ID NO: 58609 - DNA, 18 bp, Artificial Sequence
  Synthetic DNA
tgaaacacatcaatatag

SEQ ID NO: 58610 - DNA, 18 bp, Artificial Sequence
  Synthetic DNA
tgaaacatctaactacag

SEQ ID NO: 58611 - DNA, 18 bp, Artificial Sequence
  Synthetic DNA
tgaaacatctcagtatcg

SEQ ID NO: 58612 - DNA, 18 bp, Artificial Sequence
  Synthetic DNA
tgaaacgacacagtttag

SEQ ID NO: 58613 - DNA, 18 bp, Artificial Sequence
  Synthetic DNA
tgaaacgagactctatag

SEQ ID NO: 58614 - DNA, 18 bp, Artificial Sequence
  Synthetic DNA
tgaaacgattcacttaag

SEQ ID NO: 58615 - DNA, 18 bp, Artificial Sequence
  Synthetic DNA
tgaaacgtttctctatag

SEQ ID NO: 58616 - DNA, 18 bp, Artificial Sequence
  Synthetic DNA
tgaaactactcataaaag

SEQ ID NO: 58617 - DNA, 18 bp, Artificial Sequence
  Synthetic DNA
tgaaactactctcaatag

SEQ ID NO: 58618 - DNA, 18 bp, Artificial Sequence
  Synthetic DNA
tgaaaggacaccatatag

SEQ ID NO: 58619 - DNA, 18 bp, Artificial Sequence
  Synthetic DNA
tgaaaggtaacactatag

SEQ ID NO: 58620 - DNA, 18 bp, Artificial Sequence
  Synthetic DNA
tgaaatgagtgactaaag

SEQ ID NO: 58621 - DNA, 18 bp, Artificial Sequence
  Synthetic DNA
tgaaatgattcactaaag

SEQ ID NO: 58622 - DNA, 18 bp, Artificial Sequence
  Synthetic DNA
tgaagagaataaccatgg

SEQ ID NO: 58623 - DNA, 18 bp, Artificial Sequence
  Synthetic DNA
tgaagctactcactcagg

SEQ ID NO: 58624 - DNA, 18 bp, Artificial Sequence
  Synthetic DNA
tgaatcgacgcgctatgg

SEQ ID NO: 58625 - DNA, 18 bp, Artificial Sequence
  Synthetic DNA
tgaatcgactcacctttg

SEQ ID NO: 58626 - DNA, 18 bp, Artificial Sequence
  Synthetic DNA
tgaatcgactcattaaag

SEQ ID NO: 58627 - DNA, 18 bp, Artificial Sequence
  Synthetic DNA
tgaatcgactgattatag

SEQ ID NO: 58628 - DNA, 18 bp, Artificial Sequence
  Synthetic DNA
tgaatcgactttctatag

SEQ ID NO: 58629 - DNA, 18 bp, Artificial Sequence
  Synthetic DNA
tgaatcgtctcactgtag

SEQ ID NO: 58630 - DNA, 18 bp, Artificial Sequence
  Synthetic DNA
tgaatgtactcactatag

SEQ ID NO: 58631 - DNA, 18 bp, Artificial Sequence
  Synthetic DNA
tgaattaactcactttag

SEQ ID NO: 58632 - DNA, 18 bp, Artificial Sequence
  Synthetic DNA
tgacaaaactcactattg

SEQ ID NO: 58633 - DNA, 18 bp, Artificial Sequence
  Synthetic DNA
tgacacatctcaatatag

SEQ ID NO: 58634 - DNA, 18 bp, Artificial Sequence
  Synthetic DNA
tgacacgacccatcatag

SEQ ID NO: 58635 - DNA, 18 bp, Artificial Sequence
  Synthetic DNA
tgacacggcgcagtgtag

SEQ ID NO: 58636 - DNA, 18 bp, Artificial Sequence
  Synthetic DNA
tgacataactcaccatag

SEQ ID NO: 58637 - DNA, 18 bp, Artificial Sequence
  Synthetic DNA
tgacatgtcacacaatag

SEQ ID NO: 58638 - DNA, 18 bp, Artificial Sequence
  Synthetic DNA
tgacatgtctaactttag

SEQ ID NO: 58639 - DNA, 18 bp, Artificial Sequence
  Synthetic DNA
tgactagactcacttaag

SEQ ID NO: 58640 - DNA, 18 bp, Artificial Sequence
  Synthetic DNA
tgactcgaaccacgatag

SEQ ID NO: 58641 - DNA, 18 bp, Artificial Sequence
  Synthetic DNA
tgagaagactcattaaag

SEQ ID NO: 58642 - DNA, 18 bp, Artificial Sequence
  Synthetic DNA
tgagaccactcacttacg

SEQ ID NO: 58643 - DNA, 18 bp, Artificial Sequence
  Synthetic DNA
tgagacgatacacgttag

SEQ ID NO: 58644 - DNA, 18 bp, Artificial Sequence
  Synthetic DNA
tgagacggctcattaaag

SEQ ID NO: 58645 - DNA, 18 bp, Artificial Sequence
  Synthetic DNA
tgagaggtctatttatag

SEQ ID NO: 58646 - DNA, 18 bp, Artificial Sequence
  Synthetic DNA
tgataaaactcaatattg

SEQ ID NO: 58647 - DNA, 18 bp, Artificial Sequence
  Synthetic DNA
tgataagactctcaaaag

SEQ ID NO: 58648 - DNA, 18 bp, Artificial Sequence
  Synthetic DNA
tgataatactatctatag

SEQ ID NO: 58649 - DNA, 18 bp, Artificial Sequence
  Synthetic DNA
tgatacaaatctctctag

SEQ ID NO: 58650 - DNA, 18 bp, Artificial Sequence
  Synthetic DNA
tgatacaacacacaattg

SEQ ID NO: 58651 - DNA, 18 bp, Artificial Sequence
  Synthetic DNA
tgatacaactctcattag

SEQ ID NO: 58652 - DNA, 18 bp, Artificial Sequence
  Synthetic DNA
tgatacacctctctaaag

SEQ ID NO: 58653 - DNA, 18 bp, Artificial Sequence
  Synthetic DNA
tgatacagatcattatag

SEQ ID NO: 58654 - DNA, 18 bp, Artificial Sequence
  Synthetic DNA
tgatacatcacactgaag

SEQ ID NO: 58655 - DNA, 18 bp, Artificial Sequence
  Synthetic DNA
tgatacatgtaaacatag

SEQ ID NO: 58656 - DNA, 18 bp, Artificial Sequence
  Synthetic DNA
tgatacgaatcccttaag

SEQ ID NO: 58657 - DNA, 18 bp, Artificial Sequence
  Synthetic DNA
tgatacgagttgctttag

SEQ ID NO: 58658 - DNA, 18 bp, Artificial Sequence
  Synthetic DNA
tgatacgatcaacctcag

SEQ ID NO: 58659 - DNA, 18 bp, Artificial Sequence
  Synthetic DNA
tgatacgatctactttag

SEQ ID NO: 58660 - DNA, 18 bp, Artificial Sequence
  Synthetic DNA
tgatacgattaacaattg

SEQ ID NO: 58661 - DNA, 18 bp, Artificial Sequence
  Synthetic DNA
tgatacgattctccttag

SEQ ID NO: 58662 - DNA, 18 bp, Artificial Sequence
  Synthetic DNA
tgatacgcctagcaatag

SEQ ID NO: 58663 - DNA, 18 bp, Artificial Sequence
  Synthetic DNA
tgatacggtccactttag

SEQ ID NO: 58664 - DNA, 18 bp, Artificial Sequence
  Synthetic DNA
tgatacgtctgaatgaag

SEQ ID NO: 58665 - DNA, 18 bp, Artificial Sequence
  Synthetic DNA
tgatacgttttactgtag

SEQ ID NO: 58666 - DNA, 18 bp, Artificial Sequence
  Synthetic DNA
tgatactacacacaatgg

SEQ ID NO: 58667 - DNA, 18 bp, Artificial Sequence
  Synthetic DNA
tgatactactcacatcag

SEQ ID NO: 58668 - DNA, 18 bp, Artificial Sequence
  Synthetic DNA
tgatactccttactaaag

SEQ ID NO: 58669 - DNA, 18 bp, Artificial Sequence
  Synthetic DNA
tgatagaactaactattg

SEQ ID NO: 58670 - DNA, 18 bp, Artificial Sequence
  Synthetic DNA
tgataggactctttttag

SEQ ID NO: 58671 - DNA, 18 bp, Artificial Sequence
  Synthetic DNA
tgataggtttgactgtag

SEQ ID NO: 58672 - DNA, 18 bp, Artificial Sequence
  Synthetic DNA
tgatagtacttacgtttg

SEQ ID NO: 58673 - DNA, 18 bp, Artificial Sequence
  Synthetic DNA
tgatatgaatcggaaaag

SEQ ID NO: 58674 - DNA, 18 bp, Artificial Sequence
  Synthetic DNA
tgatatgactcaaaatcg

SEQ ID NO: 58675 - DNA, 18 bp, Artificial Sequence
  Synthetic DNA
tgatatgactgtcgattg

SEQ ID NO: 58676 - DNA, 18 bp, Artificial Sequence
  Synthetic DNA
tgatatgagtcactgctg

SEQ ID NO: 58677 - DNA, 18 bp, Artificial Sequence
  Synthetic DNA
tgatcatactcacagtag

SEQ ID NO: 58678 - DNA, 18 bp, Artificial Sequence
  Synthetic DNA
tgatccaacacaaaatag

SEQ ID NO: 58679 - DNA, 18 bp, Artificial Sequence
  Synthetic DNA
tgatccaacgaactatgg

SEQ ID NO: 58680 - DNA, 18 bp, Artificial Sequence
  Synthetic DNA
tgatccgacggaccgtag

SEQ ID NO: 58681 - DNA, 18 bp, Artificial Sequence
  Synthetic DNA
tgatccgactcccttatg

SEQ ID NO: 58682 - DNA, 18 bp, Artificial Sequence
  Synthetic DNA
tgatgcaactgactgtag

SEQ ID NO: 58683 - DNA, 18 bp, Artificial Sequence
  Synthetic DNA
tgatgccactcattattg

SEQ ID NO: 58684 - DNA, 18 bp, Artificial Sequence
  Synthetic DNA
tgatgcgaatatctttcg

SEQ ID NO: 58685 - DNA, 18 bp, Artificial Sequence
  Synthetic DNA
tgatgcgataaactattg

SEQ ID NO: 58686 - DNA, 18 bp, Artificial Sequence
  Synthetic DNA
tgatgcgtctgattaaag

SEQ ID NO: 58687 - DNA, 18 bp, Artificial Sequence
  Synthetic DNA
tgatgggactaactaagg

SEQ ID NO: 58688 - DNA, 18 bp, Artificial Sequence
  Synthetic DNA
tgattccagtaaatatag

SEQ ID NO: 58689 - DNA, 18 bp, Artificial Sequence
  Synthetic DNA
tgattcccctcattaaag

SEQ ID NO: 58690 - DNA, 18 bp, Artificial Sequence
  Synthetic DNA
tgattcctcactctttag

SEQ ID NO: 58691 - DNA, 18 bp, Artificial Sequence
  Synthetic DNA
tgattcgaaactctattg

SEQ ID NO: 58692 - DNA, 18 bp, Artificial Sequence
  Synthetic DNA
tgattcgaattacaatag

SEQ ID NO: 58693 - DNA, 18 bp, Artificial Sequence
  Synthetic DNA
tgattcgacaaccaatag

SEQ ID NO: 58694 - DNA, 18 bp, Artificial Sequence
  Synthetic DNA
tgattcgaccaactagag

SEQ ID NO: 58695 - DNA, 18 bp, Artificial Sequence
  Synthetic DNA
tgattcgattaactttag

SEQ ID NO: 58696 - DNA, 18 bp, Artificial Sequence
  Synthetic DNA
tgattcgattcacaaaag

SEQ ID NO: 58697 - DNA, 18 bp, Artificial Sequence
  Synthetic DNA
tgattcgcgtcacaagag

SEQ ID NO: 58698 - DNA, 18 bp, Artificial Sequence
  Synthetic DNA
tgattcgctaacgtatag

SEQ ID NO: 58699 - DNA, 18 bp, Artificial Sequence
  Synthetic DNA
tgattcggcttacactag

SEQ ID NO: 58700 - DNA, 18 bp, Artificial Sequence
  Synthetic DNA
tgattcgtctacctgtag

SEQ ID NO: 58701 - DNA, 18 bp, Artificial Sequence
  Synthetic DNA
tgattcgtctctcaaaag

SEQ ID NO: 58702 - DNA, 18 bp, Artificial Sequence
  Synthetic DNA
tgattcgtcttacgtaag

SEQ ID NO: 58703 - DNA, 18 bp, Artificial Sequence
  Synthetic DNA
tgattctactcaataaag

SEQ ID NO: 58704 - DNA, 18 bp, Artificial Sequence
  Synthetic DNA
tgattggactcccaattg

SEQ ID NO: 58705 - DNA, 18 bp, Artificial Sequence
  Synthetic DNA
tgatttgacacacattag

SEQ ID NO: 58706 - DNA, 18 bp, Artificial Sequence
  Synthetic DNA
tgatttgtatccctatag

SEQ ID NO: 58707 - DNA, 18 bp, Artificial Sequence
  Synthetic DNA
tgcaaatattcactattg

SEQ ID NO: 58708 - DNA, 18 bp, Artificial Sequence
  Synthetic DNA
tgcgactactcactttag

SEQ ID NO: 58709 - DNA, 18 bp, Artificial Sequence
  Synthetic DNA
tgctaattctgtctatag

SEQ ID NO: 58710 - DNA, 18 bp, Artificial Sequence
  Synthetic DNA
tgctacgagtaattatag

SEQ ID NO: 58711 - DNA, 18 bp, Artificial Sequence
  Synthetic DNA
tgctagtacacactaagg

SEQ ID NO: 58712 - DNA, 18 bp, Artificial Sequence
  Synthetic DNA
tgctttgactgactatag

SEQ ID NO: 58713 - DNA, 18 bp, Artificial Sequence
  Synthetic DNA
tgctttgattaacaattg

SEQ ID NO: 58714 - DNA, 18 bp, Artificial Sequence
  Synthetic DNA
tggaaccacatactatag

SEQ ID NO: 58715 - DNA, 18 bp, Artificial Sequence
  Synthetic DNA
tggaacgactcattaagg

SEQ ID NO: 58716 - DNA, 18 bp, Artificial Sequence
  Synthetic DNA
tgggacgcgtcactttag

SEQ ID NO: 58717 - DNA, 18 bp, Artificial Sequence
  Synthetic DNA
tggtacaacaagttagtg

SEQ ID NO: 58718 - DNA, 18 bp, Artificial Sequence
  Synthetic DNA
tggtacgacactataaag

SEQ ID NO: 58719 - DNA, 18 bp, Artificial Sequence
  Synthetic DNA
tggtactacactatatag

SEQ ID NO: 58720 - DNA, 18 bp, Artificial Sequence
  Synthetic DNA
tgtaaccaatgattctag

SEQ ID NO: 58721 - DNA, 18 bp, Artificial Sequence
  Synthetic DNA
tgtaacgactaacaatag

SEQ ID NO: 58722 - DNA, 18 bp, Artificial Sequence
  Synthetic DNA
tgtaacgactaacttttg

SEQ ID NO: 58723 - DNA, 18 bp, Artificial Sequence
  Synthetic DNA
tgtatccaatcactatag

SEQ ID NO: 58724 - DNA, 18 bp, Artificial Sequence
  Synthetic DNA
tgtcacgacacccgaaag

SEQ ID NO: 58725 - DNA, 18 bp, Artificial Sequence
  Synthetic DNA
tgtcatgactcagaatag

SEQ ID NO: 58726 - DNA, 18 bp, Artificial Sequence
  Synthetic DNA
tgtgagaactcactaatg

SEQ ID NO: 58727 - DNA, 18 bp, Artificial Sequence
  Synthetic DNA
tgtgtcgcatcagtagag

SEQ ID NO: 58728 - DNA, 18 bp, Artificial Sequence
  Synthetic DNA
tgttaagaatctcttaag

SEQ ID NO: 58729 - DNA, 18 bp, Artificial Sequence
  Synthetic DNA
tgttaagactctcaacag

SEQ ID NO: 58730 - DNA, 18 bp, Artificial Sequence
  Synthetic DNA
tgttaaggcattctatag

SEQ ID NO: 58731 - DNA, 18 bp, Artificial Sequence
  Synthetic DNA
tgttacaaccctctatag

SEQ ID NO: 58732 - DNA, 18 bp, Artificial Sequence
  Synthetic DNA
tgttacacctcactattg

SEQ ID NO: 58733 - DNA, 18 bp, Artificial Sequence
  Synthetic DNA
tgttacacctcgttatag

SEQ ID NO: 58734 - DNA, 18 bp, Artificial Sequence
  Synthetic DNA
tgttacctaacactgtag

SEQ ID NO: 58735 - DNA, 18 bp, Artificial Sequence
  Synthetic DNA
tgttacgaattcctgtag

SEQ ID NO: 58736 - DNA, 18 bp, Artificial Sequence
  Synthetic DNA
tgttacgactactaatag

SEQ ID NO: 58737 - DNA, 18 bp, Artificial Sequence
  Synthetic DNA
tgttacgactccagatag

SEQ ID NO: 58738 - DNA, 18 bp, Artificial Sequence
  Synthetic DNA
tgttacgattccactaag

SEQ ID NO: 58739 - DNA, 18 bp, Artificial Sequence
  Synthetic DNA
tgttacgtctctctaaag

SEQ ID NO: 58740 - DNA, 18 bp, Artificial Sequence
  Synthetic DNA
tgttactaccaacgatag

SEQ ID NO: 58741 - DNA, 18 bp, Artificial Sequence
  Synthetic DNA
tgttactactcaaattag

SEQ ID NO: 58742 - DNA, 18 bp, Artificial Sequence
  Synthetic DNA
tgttacttctcaacaatg

SEQ ID NO: 58743 - DNA, 18 bp, Artificial Sequence
  Synthetic DNA
tgttaggactcacagtag

SEQ ID NO: 58744 - DNA, 18 bp, Artificial Sequence
  Synthetic DNA
tgttagtactcactatcg

SEQ ID NO: 58745 - DNA, 18 bp, Artificial Sequence
  Synthetic DNA
tgttatgagctacattag

SEQ ID NO: 58746 - DNA, 18 bp, Artificial Sequence
  Synthetic DNA
tgttatgattcatttaag

SEQ ID NO: 58747 - DNA, 18 bp, Artificial Sequence
  Synthetic DNA
tgttatgtctcaccatag

SEQ ID NO: 58748 - DNA, 18 bp, Artificial Sequence
  Synthetic DNA
tgttatgtctcgctctag

SEQ ID NO: 58749 - DNA, 18 bp, Artificial Sequence
  Synthetic DNA
tgttctgactcactattg

SEQ ID NO: 58750 - DNA, 18 bp, Artificial Sequence
  Synthetic DNA
tgttgcgactcacaactg

SEQ ID NO: 58751 - DNA, 18 bp, Artificial Sequence
  Synthetic DNA
tgttgttactcactaaag

SEQ ID NO: 58752 - DNA, 18 bp, Artificial Sequence
  Synthetic DNA
tgtttagactcactatgg

SEQ ID NO: 58753 - DNA, 18 bp, Artificial Sequence
  Synthetic DNA
tgtttcgaatcaccatag

SEQ ID NO: 58754 - DNA, 18 bp, Artificial Sequence
  Synthetic DNA
tgtttcgaccctctatcg

SEQ ID NO: 58755 - DNA, 18 bp, Artificial Sequence
  Synthetic DNA
tgtttcgactcacactag

SEQ ID NO: 58756 - DNA, 18 bp, Artificial Sequence
  Synthetic DNA
tgtttcgactcataattg

SEQ ID NO: 58757 - DNA, 18 bp, Artificial Sequence
  Synthetic DNA
tgtttcgacttgctatgg

SEQ ID NO: 58758 - DNA, 18 bp, Artificial Sequence
  Synthetic DNA
tgtttcggtgctctatag

SEQ ID NO: 58759 - DNA, 18 bp, Artificial Sequence
  Synthetic DNA
tgtttggactcactatcg

SEQ ID NO: 58760 - DNA, 18 bp, Artificial Sequence
  Synthetic DNA
tgtttggactctcaatag

SEQ ID NO: 58761 - DNA, 18 bp, Artificial Sequence
  Synthetic DNA
ttaaaaaattcaccatcg

SEQ ID NO: 58762 - DNA, 18 bp, Artificial Sequence
  Synthetic DNA
ttaaaagacaacctgtcg

SEQ ID NO: 58763 - DNA, 18 bp, Artificial Sequence
  Synthetic DNA
ttaaaagacacacaatag

SEQ ID NO: 58764 - DNA, 18 bp, Artificial Sequence
  Synthetic DNA
ttaaaagatgcactatag

SEQ ID NO: 58765 - DNA, 18 bp, Artificial Sequence
  Synthetic DNA
ttaaaagtttcactatag

SEQ ID NO: 58766 - DNA, 18 bp, Artificial Sequence
  Synthetic DNA
ttaaaatactcactattg

SEQ ID NO: 58767 - DNA, 18 bp, Artificial Sequence
  Synthetic DNA
ttaaacaactatctttag

SEQ ID NO: 58768 - DNA, 18 bp, Artificial Sequence
  Synthetic DNA
ttaaacaactctctacag

SEQ ID NO: 58769 - DNA, 18 bp, Artificial Sequence
  Synthetic DNA
ttaaacaagtcacaattg

SEQ ID NO: 58770 - DNA, 18 bp, Artificial Sequence
  Synthetic DNA
ttaaaccaaccactatag

SEQ ID NO: 58771 - DNA, 18 bp, Artificial Sequence
  Synthetic DNA
ttaaaccacaaacactag

SEQ ID NO: 58772 - DNA, 18 bp, Artificial Sequence
  Synthetic DNA
ttaaaccattcattatag

SEQ ID NO: 58773 - DNA, 18 bp, Artificial Sequence
  Synthetic DNA
ttaaacctctaactatgg

SEQ ID NO: 58774 - DNA, 18 bp, Artificial Sequence
  Synthetic DNA
ttaaacgaatcattttag

SEQ ID NO: 58775 - DNA, 18 bp, Artificial Sequence
  Synthetic DNA
ttaaacgaatccctctag

SEQ ID NO: 58776 - DNA, 18 bp, Artificial Sequence
  Synthetic DNA
ttaaacgacaccctaaag

SEQ ID NO: 58777 - DNA, 18 bp, Artificial Sequence
  Synthetic DNA
ttaaacgactaattaatg

SEQ ID NO: 58778 - DNA, 18 bp, Artificial Sequence
  Synthetic DNA
ttaaacgactcacttgtg

SEQ ID NO: 58779 - DNA, 18 bp, Artificial Sequence
  Synthetic DNA
ttaaacgactcctcattg

SEQ ID NO: 58780 - DNA, 18 bp, Artificial Sequence
  Synthetic DNA
ttaaacgactctcacccg

SEQ ID NO: 58781 - DNA, 18 bp, Artificial Sequence
  Synthetic DNA
ttaaacgactgcctatgg

SEQ ID NO: 58782 - DNA, 18 bp, Artificial Sequence
  Synthetic DNA
ttaaacgtcaccctaaag

SEQ ID NO: 58783 - DNA, 18 bp, Artificial Sequence
  Synthetic DNA
ttaaacgtgtcattagag

SEQ ID NO: 58784 - DNA, 18 bp, Artificial Sequence
  Synthetic DNA
ttaaacgtttttccattg

SEQ ID NO: 58785 - DNA, 18 bp, Artificial Sequence
  Synthetic DNA
ttaaactaatccatttag

SEQ ID NO: 58786 - DNA, 18 bp, Artificial Sequence
  Synthetic DNA
ttaaactacacaccaatg

SEQ ID NO: 58787 - DNA, 18 bp, Artificial Sequence
  Synthetic DNA
ttaaactacattcattag

SEQ ID NO: 58788 - DNA, 18 bp, Artificial Sequence
  Synthetic DNA
ttaaactacttataatgg

SEQ ID NO: 58789 - DNA, 18 bp, Artificial Sequence
  Synthetic DNA
ttaaaggtctctctattg

SEQ ID NO: 58790 - DNA, 18 bp, Artificial Sequence
  Synthetic DNA
ttaaataacttactatag

SEQ ID NO: 58791 - DNA, 18 bp, Artificial Sequence
  Synthetic DNA
ttaaatctctaactatag

SEQ ID NO: 58792 - DNA, 18 bp, Artificial Sequence
  Synthetic DNA
ttaaatgacagactaatg

SEQ ID NO: 58793 - DNA, 18 bp, Artificial Sequence
  Synthetic DNA
ttaaatgacagttctgag

SEQ ID NO: 58794 - DNA, 18 bp, Artificial Sequence
  Synthetic DNA
ttaaatgactttattgtg

SEQ ID NO: 58795 - DNA, 18 bp, Artificial Sequence
  Synthetic DNA
ttaaatgatttactatag

SEQ ID NO: 58796 - DNA, 18 bp, Artificial Sequence
  Synthetic DNA
ttaacagactcacttcag

SEQ ID NO: 58797 - DNA, 18 bp, Artificial Sequence
  Synthetic DNA
ttaacagactctctaaag

SEQ ID NO: 58798 - DNA, 18 bp, Artificial Sequence
  Synthetic DNA
ttaaccatcacgcttttg

SEQ ID NO: 58799 - DNA, 18 bp, Artificial Sequence
  Synthetic DNA
ttaaccgatttactttag

SEQ ID NO: 58800 - DNA, 18 bp, Artificial Sequence
  Synthetic DNA
ttaactgattcactagag

SEQ ID NO: 58801 - DNA, 18 bp, Artificial Sequence
  Synthetic DNA
ttaagcgacacacaatag

SEQ ID NO: 58802 - DNA, 18 bp, Artificial Sequence
  Synthetic DNA
ttaagcgattcactttag

SEQ ID NO: 58803 - DNA, 18 bp, Artificial Sequence
  Synthetic DNA
ttaagtgcatccctatag

SEQ ID NO: 58804 - DNA, 18 bp, Artificial Sequence
  Synthetic DNA
ttaatcaactctctatag

SEQ ID NO: 58805 - DNA, 18 bp, Artificial Sequence
  Synthetic DNA
ttaatcggctaaccttag

SEQ ID NO: 58806 - DNA, 18 bp, Artificial Sequence
  Synthetic DNA
ttaatcggcttacaacag

SEQ ID NO: 58807 - DNA, 18 bp, Artificial Sequence
  Synthetic DNA
ttaatcgtctctctttgg

SEQ ID NO: 58808 - DNA, 18 bp, Artificial Sequence
  Synthetic DNA
ttaatctaatcactatag

SEQ ID NO: 58809 - DNA, 18 bp, Artificial Sequence
  Synthetic DNA
ttaatctacacactctag

SEQ ID NO: 58810 - DNA, 18 bp, Artificial Sequence
  Synthetic DNA
ttaatgacctatttttag

SEQ ID NO: 58811 - DNA, 18 bp, Artificial Sequence
  Synthetic DNA
ttacaacacatattaaag

SEQ ID NO: 58812 - DNA, 18 bp, Artificial Sequence
  Synthetic DNA
ttacaacactaactatag

SEQ ID NO: 58813 - DNA, 18 bp, Artificial Sequence
  Synthetic DNA
ttacaagactcacgaaag

SEQ ID NO: 58814 - DNA, 18 bp, Artificial Sequence
  Synthetic DNA
ttacaagattctcctatg

SEQ ID NO: 58815 - DNA, 18 bp, Artificial Sequence
  Synthetic DNA
ttacaagtcacactataa

SEQ ID NO: 58816 - DNA, 18 bp, Artificial Sequence
  Synthetic DNA
ttacacaaatcactctgg

SEQ ID NO: 58817 - DNA, 18 bp, Artificial Sequence
  Synthetic DNA
ttacacaactagcgttag

SEQ ID NO: 58818 - DNA, 18 bp, Artificial Sequence
  Synthetic DNA
ttacacaattctctaaag

SEQ ID NO: 58819 - DNA, 18 bp, Artificial Sequence
  Synthetic DNA
ttacacacctcactatcg

SEQ ID NO: 58820 - DNA, 18 bp, Artificial Sequence
  Synthetic DNA
ttacaccattcgcaatag

SEQ ID NO: 58821 - DNA, 18 bp, Artificial Sequence
  Synthetic DNA
ttacacccctcactttcg

SEQ ID NO: 58822 - DNA, 18 bp, Artificial Sequence
  Synthetic DNA
ttacacgaaactccatag

SEQ ID NO: 58823 - DNA, 18 bp, Artificial Sequence
  Synthetic DNA
ttacacgacaaactatgg

SEQ ID NO: 58824 - DNA, 18 bp, Artificial Sequence
  Synthetic DNA
ttacacgacactttttag

SEQ ID NO: 58825 - DNA, 18 bp, Artificial Sequence
  Synthetic DNA
ttacacgactctttttag

SEQ ID NO: 58826 - DNA, 18 bp, Artificial Sequence
  Synthetic DNA
ttacacgaggcactaaag

SEQ ID NO: 58827 - DNA, 18 bp, Artificial Sequence
  Synthetic DNA
ttacacgcctaactcatg

SEQ ID NO: 58828 - DNA, 18 bp, Artificial Sequence
  Synthetic DNA
ttacacgcctctctacgg

SEQ ID NO: 58829 - DNA, 18 bp, Artificial Sequence
  Synthetic DNA
ttacacggcaaaataaag

SEQ ID NO: 58830 - DNA, 18 bp, Artificial Sequence
  Synthetic DNA
ttacacgtctcactaatg

SEQ ID NO: 58831 - DNA, 18 bp, Artificial Sequence
  Synthetic DNA
ttacatgactaactattg

SEQ ID NO: 58832 - DNA, 18 bp, Artificial Sequence
  Synthetic DNA
ttacccgactcactcatg

SEQ ID NO: 58833 - DNA, 18 bp, Artificial Sequence
  Synthetic DNA
ttacttgacttactatag

SEQ ID NO: 58834 - DNA, 18 bp, Artificial Sequence
  Synthetic DNA
ttagaagactggctgatg

SEQ ID NO: 58835 - DNA, 18 bp, Artificial Sequence
  Synthetic DNA
ttagacaacacacaacag

SEQ ID NO: 58836 - DNA, 18 bp, Artificial Sequence
  Synthetic DNA
ttagacaacccactactg

SEQ ID NO: 58837 - DNA, 18 bp, Artificial Sequence
  Synthetic DNA
ttagacgactctcaaatg

SEQ ID NO: 58838 - DNA, 18 bp, Artificial Sequence
  Synthetic DNA
ttagacgattgactgttg

SEQ ID NO: 58839 - DNA, 18 bp, Artificial Sequence
  Synthetic DNA
ttagacgtaccataaaag

SEQ ID NO: 58840 - DNA, 18 bp, Artificial Sequence
  Synthetic DNA
ttagacgtctcacttttg

SEQ ID NO: 58841 - DNA, 18 bp, Artificial Sequence
  Synthetic DNA
ttagccgactttctattg

SEQ ID NO: 58842 - DNA, 18 bp, Artificial Sequence
  Synthetic DNA
ttagctgaaccattattg

SEQ ID NO: 58843 - DNA, 18 bp, Artificial Sequence
  Synthetic DNA
ttagtatactcactttag

SEQ ID NO: 58844 - DNA, 18 bp, Artificial Sequence
  Synthetic DNA
ttataaaagttaccaaag

SEQ ID NO: 58845 - DNA, 18 bp, Artificial Sequence
  Synthetic DNA
ttataacacccaccttag

SEQ ID NO: 58846 - DNA, 18 bp, Artificial Sequence
  Synthetic DNA
ttataacactcacaaatg

SEQ ID NO: 58847 - DNA, 18 bp, Artificial Sequence
  Synthetic DNA
ttataacattcactagtg

SEQ ID NO: 58848 - DNA, 18 bp, Artificial Sequence
  Synthetic DNA
ttataaccctcactcaag

SEQ ID NO: 58849 - DNA, 18 bp, Artificial Sequence
  Synthetic DNA
ttataagacttacaattg

SEQ ID NO: 58850 - DNA, 18 bp, Artificial Sequence
  Synthetic DNA
ttataagacttcttatag

SEQ ID NO: 58851 - DNA, 18 bp, Artificial Sequence
  Synthetic DNA
ttataagataccatatag

SEQ ID NO: 58852 - DNA, 18 bp, Artificial Sequence
  Synthetic DNA
ttataagattctatattg

SEQ ID NO: 58853 - DNA, 18 bp, Artificial Sequence
  Synthetic DNA
ttataagccacactttag

SEQ ID NO: 58854 - DNA, 18 bp, Artificial Sequence
  Synthetic DNA
ttataagtattacttatg

SEQ ID NO: 58855 - DNA, 18 bp, Artificial Sequence
  Synthetic DNA
ttataagtcacaataaag

SEQ ID NO: 58856 - DNA, 18 bp, Artificial Sequence
  Synthetic DNA
ttataagtcacattattg

SEQ ID NO: 58857 - DNA, 18 bp, Artificial Sequence
  Synthetic DNA
ttataagtcctaatattg

SEQ ID NO: 58858 - DNA, 18 bp, Artificial Sequence
  Synthetic DNA
ttataagtctaactaaag

SEQ ID NO: 58859 - DNA, 18 bp, Artificial Sequence
  Synthetic DNA
ttataagtctcaatatcg

SEQ ID NO: 58860 - DNA, 18 bp, Artificial Sequence
  Synthetic DNA
ttataagtctccctttcg

SEQ ID NO: 58861 - DNA, 18 bp, Artificial Sequence
  Synthetic DNA
ttataatactccccttgg

SEQ ID NO: 58862 - DNA, 18 bp, Artificial Sequence
  Synthetic DNA
ttataatccccacattag

SEQ ID NO: 58863 - DNA, 18 bp, Artificial Sequence
  Synthetic DNA
ttatacaaatctctaaag

SEQ ID NO: 58864 - DNA, 18 bp, Artificial Sequence
  Synthetic DNA
ttatacaacacgatacag

SEQ ID NO: 58865 - DNA, 18 bp, Artificial Sequence
  Synthetic DNA
ttatacaacctaattatg

SEQ ID NO: 58866 - DNA, 18 bp, Artificial Sequence
  Synthetic DNA
ttatacaacgagccatag

SEQ ID NO: 58867 - DNA, 18 bp, Artificial Sequence
  Synthetic DNA
ttatacaacttccagtag

SEQ ID NO: 58868 - DNA, 18 bp, Artificial Sequence
  Synthetic DNA
ttatacaagtccgtctag

SEQ ID NO: 58869 - DNA, 18 bp, Artificial Sequence
  Synthetic DNA
ttatacaattctctttag

SEQ ID NO: 58870 - DNA, 18 bp, Artificial Sequence
  Synthetic DNA
ttatacaatttacttcag

SEQ ID NO: 58871 - DNA, 18 bp, Artificial Sequence
  Synthetic DNA
ttatacagctgccatctg

SEQ ID NO: 58872 - DNA, 18 bp, Artificial Sequence
  Synthetic DNA
ttatacatatcaccatag

SEQ ID NO: 58873 - DNA, 18 bp, Artificial Sequence
  Synthetic DNA
ttatacatcccaccatag

SEQ ID NO: 58874 - DNA, 18 bp, Artificial Sequence
  Synthetic DNA
ttatacatctcactcgag

SEQ ID NO: 58875 - DNA, 18 bp, Artificial Sequence
  Synthetic DNA
ttatacatctgacaacag

SEQ ID NO: 58876 - DNA, 18 bp, Artificial Sequence
  Synthetic DNA
ttatacatgacactatag

SEQ ID NO: 58877 - DNA, 18 bp, Artificial Sequence
  Synthetic DNA
ttataccattcggtatag

SEQ ID NO: 58878 - DNA, 18 bp, Artificial Sequence
  Synthetic DNA
ttatacctctcagctatg

SEQ ID NO: 58879 - DNA, 18 bp, Artificial Sequence
  Synthetic DNA
ttatacctcttattgttg

SEQ ID NO: 58880 - DNA, 18 bp, Artificial Sequence
  Synthetic DNA
ttatacgaatcacaacgg

SEQ ID NO: 58881 - DNA, 18 bp, Artificial Sequence
  Synthetic DNA
ttatacgacaaacttttg

SEQ ID NO: 58882 - DNA, 18 bp, Artificial Sequence
  Synthetic DNA
ttatacgacacaaattag

SEQ ID NO: 58883 - DNA, 18 bp, Artificial Sequence
  Synthetic DNA
ttatacgacacccttcag

SEQ ID NO: 58884 - DNA, 18 bp, Artificial Sequence
  Synthetic DNA
ttatacgacacccttgag

SEQ ID NO: 58885 - DNA, 18 bp, Artificial Sequence
  Synthetic DNA
ttatacgacactcaatgg

SEQ ID NO: 58886 - DNA, 18 bp, Artificial Sequence
  Synthetic DNA
ttatacgacatagaatag

SEQ ID NO: 58887 - DNA, 18 bp, Artificial Sequence
  Synthetic DNA
ttatacgacattcattag

SEQ ID NO: 58888 - DNA, 18 bp, Artificial Sequence
  Synthetic DNA
ttatacgaccctcaactg

SEQ ID NO: 58889 - DNA, 18 bp, Artificial Sequence
  Synthetic DNA
ttatacgaccctcaattg

SEQ ID NO: 58890 - DNA, 18 bp, Artificial Sequence
  Synthetic DNA
ttatacgactaaatccag

SEQ ID NO: 58891 - DNA, 18 bp, Artificial Sequence
  Synthetic DNA
ttatacgactattgatag

SEQ ID NO: 58892 - DNA, 18 bp, Artificial Sequence
  Synthetic DNA
ttatacgactcacatgtg

SEQ ID NO: 58893 - DNA, 18 bp, Artificial Sequence
  Synthetic DNA
ttatacgactcggttgag

SEQ ID NO: 58894 - DNA, 18 bp, Artificial Sequence
  Synthetic DNA
ttatacgacttattcaag

SEQ ID NO: 58895 - DNA, 18 bp, Artificial Sequence
  Synthetic DNA
ttatacgactttcttctg

SEQ ID NO: 58896 - DNA, 18 bp, Artificial Sequence
  Synthetic DNA
ttatacgagaatctatag

SEQ ID NO: 58897 - DNA, 18 bp, Artificial Sequence
  Synthetic DNA
ttatacgagtcattccgg

SEQ ID NO: 58898 - DNA, 18 bp, Artificial Sequence
  Synthetic DNA
ttatacgatacaattttg

SEQ ID NO: 58899 - DNA, 18 bp, Artificial Sequence
  Synthetic DNA
ttatacgatatactattg

SEQ ID NO: 58900 - DNA, 18 bp, Artificial Sequence
  Synthetic DNA
ttatacgattaaacacag

SEQ ID NO: 58901 - DNA, 18 bp, Artificial Sequence
  Synthetic DNA
ttatacgattccgttttg

SEQ ID NO: 58902 - DNA, 18 bp, Artificial Sequence
  Synthetic DNA
ttatacgatttgctttag

SEQ ID NO: 58903 - DNA, 18 bp, Artificial Sequence
  Synthetic DNA
ttatacgattttccatag

SEQ ID NO: 58904 - DNA, 18 bp, Artificial Sequence
  Synthetic DNA
ttatacgccaaacaaatg

SEQ ID NO: 58905 - DNA, 18 bp, Artificial Sequence
  Synthetic DNA
ttatacgccacaccccag

SEQ ID NO: 58906 - DNA, 18 bp, Artificial Sequence
  Synthetic DNA
ttatacgccactctttag

SEQ ID NO: 58907 - DNA, 18 bp, Artificial Sequence
  Synthetic DNA
ttatacgcctctatattg

SEQ ID NO: 58908 - DNA, 18 bp, Artificial Sequence
  Synthetic DNA
ttatacgcctttatatag

SEQ ID NO: 58909 - DNA, 18 bp, Artificial Sequence
  Synthetic DNA
ttatacgctccacgatag

SEQ ID NO: 58910 - DNA, 18 bp, Artificial Sequence
  Synthetic DNA
ttatacggcccattttag

SEQ ID NO: 58911 - DNA, 18 bp, Artificial Sequence
  Synthetic DNA
ttatacggcttgctattg

SEQ ID NO: 58912 - DNA, 18 bp, Artificial Sequence
  Synthetic DNA
ttatacgtatccttatag

SEQ ID NO: 58913 - DNA, 18 bp, Artificial Sequence
  Synthetic DNA
ttatacgtctaccaatag

SEQ ID NO: 58914 - DNA, 18 bp, Artificial Sequence
  Synthetic DNA
ttatacgtctcggttttg

SEQ ID NO: 58915 - DNA, 18 bp, Artificial Sequence
  Synthetic DNA
ttatacgtcttaatattg

SEQ ID NO: 58916 - DNA, 18 bp, Artificial Sequence
  Synthetic DNA
ttatacgtgtcattgtag

SEQ ID NO: 58917 - DNA, 18 bp, Artificial Sequence
  Synthetic DNA
ttatacgtgttaatatag

SEQ ID NO: 58918 - DNA, 18 bp, Artificial Sequence
  Synthetic DNA
ttatacgttaaactatag

SEQ ID NO: 58919 - DNA, 18 bp, Artificial Sequence
  Synthetic DNA
ttatactaaacacctttg

SEQ ID NO: 58920 - DNA, 18 bp, Artificial Sequence
  Synthetic DNA
ttatactactcacactca

SEQ ID NO: 58921 - DNA, 18 bp, Artificial Sequence
  Synthetic DNA
ttatactactctgacaag

SEQ ID NO: 58922 - DNA, 18 bp, Artificial Sequence
  Synthetic DNA
ttatactactctgtctag

SEQ ID NO: 58923 - DNA, 18 bp, Artificial Sequence
  Synthetic DNA
ttatactactttatatcg

SEQ ID NO: 58924 - DNA, 18 bp, Artificial Sequence
  Synthetic DNA
ttatactagactctatgg

SEQ ID NO: 58925 - DNA, 18 bp, Artificial Sequence
  Synthetic DNA
ttatactagcgactatag

SEQ ID NO: 58926 - DNA, 18 bp, Artificial Sequence
  Synthetic DNA
ttatacttcaaactttag

SEQ ID NO: 58927 - DNA, 18 bp, Artificial Sequence
  Synthetic DNA
ttatacttcccataatag

SEQ ID NO: 58928 - DNA, 18 bp, Artificial Sequence
  Synthetic DNA
ttatacttctcacaagag

SEQ ID NO: 58929 - DNA, 18 bp, Artificial Sequence
  Synthetic DNA
ttatacttctgacacaag

SEQ ID NO: 58930 - DNA, 18 bp, Artificial Sequence
  Synthetic DNA
ttatagaccgctcaatag

SEQ ID NO: 58931 - DNA, 18 bp, Artificial Sequence
  Synthetic DNA
ttatagagctcacaaaag

SEQ ID NO: 58932 - DNA, 18 bp, Artificial Sequence
  Synthetic DNA
ttatagcaatcacaactg

SEQ ID NO: 58933 - DNA, 18 bp, Artificial Sequence
  Synthetic DNA
ttatagcacactttactg

SEQ ID NO: 58934 - DNA, 18 bp, Artificial Sequence
  Synthetic DNA
ttatagcacttactctag

SEQ ID NO: 58935 - DNA, 18 bp, Artificial Sequence
  Synthetic DNA
ttatagcattctctatag

SEQ ID NO: 58936 - DNA, 18 bp, Artificial Sequence
  Synthetic DNA
ttataggagccactctag

SEQ ID NO: 58937 - DNA, 18 bp, Artificial Sequence
  Synthetic DNA
ttataggattaactaaag

SEQ ID NO: 58938 - DNA, 18 bp, Artificial Sequence
  Synthetic DNA
ttataggattcaataaag

SEQ ID NO: 58939 - DNA, 18 bp, Artificial Sequence
  Synthetic DNA
ttataggattcacttctg

SEQ ID NO: 58940 - DNA, 18 bp, Artificial Sequence
  Synthetic DNA
ttataggcccaacaattg

SEQ ID NO: 58941 - DNA, 18 bp, Artificial Sequence
  Synthetic DNA
ttataggctttactttag

SEQ ID NO: 58942 - DNA, 18 bp, Artificial Sequence
  Synthetic DNA
ttatagtactcacaattg

SEQ ID NO: 58943 - DNA, 18 bp, Artificial Sequence
  Synthetic DNA
ttatagtactcattttag

SEQ ID NO: 58944 - DNA, 18 bp, Artificial Sequence
  Synthetic DNA
ttatataacacggtaaag

SEQ ID NO: 58945 - DNA, 18 bp, Artificial Sequence
  Synthetic DNA
ttatataacttacactag

SEQ ID NO: 58946 - DNA, 18 bp, Artificial Sequence
  Synthetic DNA
ttatatatctcaatatag

SEQ ID NO: 58947 - DNA, 18 bp, Artificial Sequence
  Synthetic DNA
ttatatatctcactattg

SEQ ID NO: 58948 - DNA, 18 bp, Artificial Sequence
  Synthetic DNA
ttatatcaatcagtatag

SEQ ID NO: 58949 - DNA, 18 bp, Artificial Sequence
  Synthetic DNA
ttatatcactcacaagag

SEQ ID NO: 58950 - DNA, 18 bp, Artificial Sequence
  Synthetic DNA
ttatatcacttaatattg

SEQ ID NO: 58951 - DNA, 18 bp, Artificial Sequence
  Synthetic DNA
ttatatgacaaactctag

SEQ ID NO: 58952 - DNA, 18 bp, Artificial Sequence
  Synthetic DNA
ttatatgacacccaatcg

SEQ ID NO: 58953 - DNA, 18 bp, Artificial Sequence
  Synthetic DNA
ttatatgacataccaatg

SEQ ID NO: 58954 - DNA, 18 bp, Artificial Sequence
  Synthetic DNA
ttatatgagtgtttaatg

SEQ ID NO: 58955 - DNA, 18 bp, Artificial Sequence
  Synthetic DNA
ttatatgatctactattg

SEQ ID NO: 58956 - DNA, 18 bp, Artificial Sequence
  Synthetic DNA
ttatatgcctctctaacg

SEQ ID NO: 58957 - DNA, 18 bp, Artificial Sequence
  Synthetic DNA
ttatatgcctctttatag

SEQ ID NO: 58958 - DNA, 18 bp, Artificial Sequence
  Synthetic DNA
ttatatgcttcacaattg

SEQ ID NO: 58959 - DNA, 18 bp, Artificial Sequence
  Synthetic DNA
ttatatggctctctgtag

SEQ ID NO: 58960 - DNA, 18 bp, Artificial Sequence
  Synthetic DNA
ttatatgtcacactttgg

SEQ ID NO: 58961 - DNA, 18 bp, Artificial Sequence
  Synthetic DNA
ttatatgtgacactattg

SEQ ID NO: 58962 - DNA, 18 bp, Artificial Sequence
  Synthetic DNA
ttatatgtttcattatag

SEQ ID NO: 58963 - DNA, 18 bp, Artificial Sequence
  Synthetic DNA
ttatattactcattatcg

SEQ ID NO: 58964 - DNA, 18 bp, Artificial Sequence
  Synthetic DNA
ttatattatacactgtag

SEQ ID NO: 58965 - DNA, 18 bp, Artificial Sequence
  Synthetic DNA
ttatattgcagactatag

SEQ ID NO: 58966 - DNA, 18 bp, Artificial Sequence
  Synthetic DNA
ttatatttctcagtatag

SEQ ID NO: 58967 - DNA, 18 bp, Artificial Sequence
  Synthetic DNA
ttatattttactcaaaag

SEQ ID NO: 58968 - DNA, 18 bp, Artificial Sequence
  Synthetic DNA
ttatcagattgtctatag

SEQ ID NO: 58969 - DNA, 18 bp, Artificial Sequence
  Synthetic DNA
ttatcaggctcaccttag

SEQ ID NO: 58970 - DNA, 18 bp, Artificial Sequence
  Synthetic DNA
ttatccaactcaattcag

SEQ ID NO: 58971 - DNA, 18 bp, Artificial Sequence
  Synthetic DNA
ttatccagcacacttcag

SEQ ID NO: 58972 - DNA, 18 bp, Artificial Sequence
  Synthetic DNA
ttatccatcccagcatag

SEQ ID NO: 58973 - DNA, 18 bp, Artificial Sequence
  Synthetic DNA
ttatccgactaactctgg

SEQ ID NO: 58974 - DNA, 18 bp, Artificial Sequence
  Synthetic DNA
ttatccgactcagttcag

SEQ ID NO: 58975 - DNA, 18 bp, Artificial Sequence
  Synthetic DNA
ttatccgagatactttag

SEQ ID NO: 58976 - DNA, 18 bp, Artificial Sequence
  Synthetic DNA
ttatccgccacattatag

SEQ ID NO: 58977 - DNA, 18 bp, Artificial Sequence
  Synthetic DNA
ttatccgtaacacaaaag

SEQ ID NO: 58978 - DNA, 18 bp, Artificial Sequence
  Synthetic DNA
ttatccgtctaaggattg

SEQ ID NO: 58979 - DNA, 18 bp, Artificial Sequence
  Synthetic DNA
ttatcctcctctatatcg

SEQ ID NO: 58980 - DNA, 18 bp, Artificial Sequence
  Synthetic DNA
ttatctcactaattatag

SEQ ID NO: 58981 - DNA, 18 bp, Artificial Sequence
  Synthetic DNA
ttatctgactagatttag

SEQ ID NO: 58982 - DNA, 18 bp, Artificial Sequence
  Synthetic DNA
ttatgatactcccagtag

SEQ ID NO: 58983 - DNA, 18 bp, Artificial Sequence
  Synthetic DNA
ttatgcgacccacaaaag

SEQ ID NO: 58984 - DNA, 18 bp, Artificial Sequence
  Synthetic DNA
ttatgcgacccacttaag

SEQ ID NO: 58985 - DNA, 18 bp, Artificial Sequence
  Synthetic DNA
ttatgcgactaaccattg

SEQ ID NO: 58986 - DNA, 18 bp, Artificial Sequence
  Synthetic DNA
ttatgcgactcaaaatcg

SEQ ID NO: 58987 - DNA, 18 bp, Artificial Sequence
  Synthetic DNA
ttatgcgactgactgatg

SEQ ID NO: 58988 - DNA, 18 bp, Artificial Sequence
  Synthetic DNA
ttatgcgatacacgattg

SEQ ID NO: 58989 - DNA, 18 bp, Artificial Sequence
  Synthetic DNA
ttatgcgtatcactaatg

SEQ ID NO: 58990 - DNA, 18 bp, Artificial Sequence
  Synthetic DNA
ttatgcgtctcacatcag

SEQ ID NO: 58991 - DNA, 18 bp, Artificial Sequence
  Synthetic DNA
ttatgctaatcgctatag

SEQ ID NO: 58992 - DNA, 18 bp, Artificial Sequence
  Synthetic DNA
ttatgctactcactaagg

SEQ ID NO: 58993 - DNA, 18 bp, Artificial Sequence
  Synthetic DNA
ttatgctactctctacag

SEQ ID NO: 58994 - DNA, 18 bp, Artificial Sequence
  Synthetic DNA
ttatgcttctttctaaag

SEQ ID NO: 58995 - DNA, 18 bp, Artificial Sequence
  Synthetic DNA
ttatgggattctcaactg

SEQ ID NO: 58996 - DNA, 18 bp, Artificial Sequence
  Synthetic DNA
ttatgtggcacactttag

SEQ ID NO: 58997 - DNA, 18 bp, Artificial Sequence
  Synthetic DNA
ttatgtttctcataattg

SEQ ID NO: 58998 - DNA, 18 bp, Artificial Sequence
  Synthetic DNA
ttattagacccccaatag

SEQ ID NO: 58999 - DNA, 18 bp, Artificial Sequence
  Synthetic DNA
ttattagactcaccattg

SEQ ID NO: 59000 - DNA, 18 bp, Artificial Sequence
  Synthetic DNA
ttattagtctcgctatgg

SEQ ID NO: 59001 - DNA, 18 bp, Artificial Sequence
  Synthetic DNA
ttattagtctctctattg

SEQ ID NO: 59002 - DNA, 18 bp, Artificial Sequence
  Synthetic DNA
ttattattctcaatatcg

SEQ ID NO: 59003 - DNA, 18 bp, Artificial Sequence
  Synthetic DNA
ttattattctgtctatag

SEQ ID NO: 59004 - DNA, 18 bp, Artificial Sequence
  Synthetic DNA
ttattcaacacaaaatgg

SEQ ID NO: 59005 - DNA, 18 bp, Artificial Sequence
  Synthetic DNA
ttattcaactaactattg

SEQ ID NO: 59006 - DNA, 18 bp, Artificial Sequence
  Synthetic DNA
ttattcaatttacattag

SEQ ID NO: 59007 - DNA, 18 bp, Artificial Sequence
  Synthetic DNA
ttattcctctcattcttg

SEQ ID NO: 59008 - DNA, 18 bp, Artificial Sequence
  Synthetic DNA
ttattcgaaacacaattg

SEQ ID NO: 59009 - DNA, 18 bp, Artificial Sequence
  Synthetic DNA
ttattcgaagcacaaaag

SEQ ID NO: 59010 - DNA, 18 bp, Artificial Sequence
  Synthetic DNA
ttattcgacacacataag

SEQ ID NO: 59011 - DNA, 18 bp, Artificial Sequence
  Synthetic DNA
ttattcgacccacaaaag

SEQ ID NO: 59012 - DNA, 18 bp, Artificial Sequence
  Synthetic DNA
ttattcgacctattaaag

SEQ ID NO: 59013 - DNA, 18 bp, Artificial Sequence
  Synthetic DNA
ttattcgacgctctaacg

SEQ ID NO: 59014 - DNA, 18 bp, Artificial Sequence
  Synthetic DNA
ttattcgactaactgttg

SEQ ID NO: 59015 - DNA, 18 bp, Artificial Sequence
  Synthetic DNA
ttattcgagcaactatag

SEQ ID NO: 59016 - DNA, 18 bp, Artificial Sequence
  Synthetic DNA
ttattcgagcccataaag

SEQ ID NO: 59017 - DNA, 18 bp, Artificial Sequence
  Synthetic DNA
ttattcgattaacgatgg

SEQ ID NO: 59018 - DNA, 18 bp, Artificial Sequence
  Synthetic DNA
ttattcgattcacggtag

SEQ ID NO: 59019 - DNA, 18 bp, Artificial Sequence
  Synthetic DNA
ttattcgcatcattattg

SEQ ID NO: 59020 - DNA, 18 bp, Artificial Sequence
  Synthetic DNA
ttattcgtatctatatag

SEQ ID NO: 59021 - DNA, 18 bp, Artificial Sequence
  Synthetic DNA
ttattcgtctagcaatag

SEQ ID NO: 59022 - DNA, 18 bp, Artificial Sequence
  Synthetic DNA
ttattctaaactctatag

SEQ ID NO: 59023 - DNA, 18 bp, Artificial Sequence
  Synthetic DNA
ttattctacatactatag

SEQ ID NO: 59024 - DNA, 18 bp, Artificial Sequence
  Synthetic DNA
ttattctactttctatag

SEQ ID NO: 59025 - DNA, 18 bp, Artificial Sequence
  Synthetic DNA
ttattctagtaactatag

SEQ ID NO: 59026 - DNA, 18 bp, Artificial Sequence
  Synthetic DNA
ttattctcaccgctgaag

SEQ ID NO: 59027 - DNA, 18 bp, Artificial Sequence
  Synthetic DNA
ttattctcctcacactag

SEQ ID NO: 59028 - DNA, 18 bp, Artificial Sequence
  Synthetic DNA
ttattctcctctctatag

SEQ ID NO: 59029 - DNA, 18 bp, Artificial Sequence
  Synthetic DNA
ttattcttatcccagtag

SEQ ID NO: 59030 - DNA, 18 bp, Artificial Sequence
  Synthetic DNA
ttattggacatactttag

SEQ ID NO: 59031 - DNA, 18 bp, Artificial Sequence
  Synthetic DNA
ttattggactaactattg

SEQ ID NO: 59032 - DNA, 18 bp, Artificial Sequence
  Synthetic DNA
ttattggactcactaatg

SEQ ID NO: 59033 - DNA, 18 bp, Artificial Sequence
  Synthetic DNA
ttattggactcagtttag

SEQ ID NO: 59034 - DNA, 18 bp, Artificial Sequence
  Synthetic DNA
ttattggattcaatatag

SEQ ID NO: 59035 - DNA, 18 bp, Artificial Sequence
  Synthetic DNA
ttattgtactctttatag

SEQ ID NO: 59036 - DNA, 18 bp, Artificial Sequence
  Synthetic DNA
ttatttaactcactttag

SEQ ID NO: 59037 - DNA, 18 bp, Artificial Sequence
  Synthetic DNA
ttatttgacatactctag

SEQ ID NO: 59038 - DNA, 18 bp, Artificial Sequence
  Synthetic DNA
ttatttgacgccctatag

SEQ ID NO: 59039 - DNA, 18 bp, Artificial Sequence
  Synthetic DNA
ttatttgactcaattttg

SEQ ID NO: 59040 - DNA, 18 bp, Artificial Sequence
  Synthetic DNA
ttatttgactcacagatg

SEQ ID NO: 59041 - DNA, 18 bp, Artificial Sequence
  Synthetic DNA
ttatttgactctctatgg

SEQ ID NO: 59042 - DNA, 18 bp, Artificial Sequence
  Synthetic DNA
ttattttacacattgtag

SEQ ID NO: 59043 - DNA, 18 bp, Artificial Sequence
  Synthetic DNA
ttcaacaactcactaaag

SEQ ID NO: 59044 - DNA, 18 bp, Artificial Sequence
  Synthetic DNA
ttcaacgacacacaatag

SEQ ID NO: 59045 - DNA, 18 bp, Artificial Sequence
  Synthetic DNA
ttcaacgactatctatag

SEQ ID NO: 59046 - DNA, 18 bp, Artificial Sequence
  Synthetic DNA
ttcaaggactcactctag

SEQ ID NO: 59047 - DNA, 18 bp, Artificial Sequence
  Synthetic DNA
ttccacgacacaatatag

SEQ ID NO: 59048 - DNA, 18 bp, Artificial Sequence
  Synthetic DNA
ttccacgactccctcttg

SEQ ID NO: 59049 - DNA, 18 bp, Artificial Sequence
  Synthetic DNA
ttcctcgacccacaaaag

SEQ ID NO: 59050 - DNA, 18 bp, Artificial Sequence
  Synthetic DNA
ttcgacgactctgtactg

SEQ ID NO: 59051 - DNA, 18 bp, Artificial Sequence
  Synthetic DNA
ttcgacgtctcactctag

SEQ ID NO: 59052 - DNA, 18 bp, Artificial Sequence
  Synthetic DNA
ttctacagcacactatag

SEQ ID NO: 59053 - DNA, 18 bp, Artificial Sequence
  Synthetic DNA
ttctaccagtcaccatag

SEQ ID NO: 59054 - DNA, 18 bp, Artificial Sequence
  Synthetic DNA
ttctacgactctgtctag

SEQ ID NO: 59055 - DNA, 18 bp, Artificial Sequence
  Synthetic DNA
ttctacgatccactgtag

SEQ ID NO: 59056 - DNA, 18 bp, Artificial Sequence
  Synthetic DNA
ttctactactctctaaag

SEQ ID NO: 59057 - DNA, 18 bp, Artificial Sequence
  Synthetic DNA
ttctatgaatcacttaag

SEQ ID NO: 59058 - DNA, 18 bp, Artificial Sequence
  Synthetic DNA
ttctatgattctccatag

SEQ ID NO: 59059 - DNA, 18 bp, Artificial Sequence
  Synthetic DNA
ttctctgtctaactaaag

SEQ ID NO: 59060 - DNA, 18 bp, Artificial Sequence
  Synthetic DNA
ttcttatttatactatag

SEQ ID NO: 59061 - DNA, 18 bp, Artificial Sequence
  Synthetic DNA
ttcttcgacaaaggatgg

SEQ ID NO: 59062 - DNA, 18 bp, Artificial Sequence
  Synthetic DNA
ttcttcgacatactatag

SEQ ID NO: 59063 - DNA, 18 bp, Artificial Sequence
  Synthetic DNA
ttctttgccacactatag

SEQ ID NO: 59064 - DNA, 18 bp, Artificial Sequence
  Synthetic DNA
ttgaaagttatactatag

SEQ ID NO: 59065 - DNA, 18 bp, Artificial Sequence
  Synthetic DNA
ttgaacaactctcttgtg

SEQ ID NO: 59066 - DNA, 18 bp, Artificial Sequence
  Synthetic DNA
ttgaacgaaccatatttg

SEQ ID NO: 59067 - DNA, 18 bp, Artificial Sequence
  Synthetic DNA
ttgaactactcattattg

SEQ ID NO: 59068 - DNA, 18 bp, Artificial Sequence
  Synthetic DNA
ttgaactgctcgctatag

SEQ ID NO: 59069 - DNA, 18 bp, Artificial Sequence
  Synthetic DNA
ttgcaaaacgcgctgaag

SEQ ID NO: 59070 - DNA, 18 bp, Artificial Sequence
  Synthetic DNA
ttgcacgacttattaagg

SEQ ID NO: 59071 - DNA, 18 bp, Artificial Sequence
  Synthetic DNA
ttgcatgactcagaaatg

SEQ ID NO: 59072 - DNA, 18 bp, Artificial Sequence
  Synthetic DNA
ttggatgacccacttacg

SEQ ID NO: 59073 - DNA, 18 bp, Artificial Sequence
  Synthetic DNA
ttgtaatactcaatatag

SEQ ID NO: 59074 - DNA, 18 bp, Artificial Sequence
  Synthetic DNA
ttgtacgacactctctag

SEQ ID NO: 59075 - DNA, 18 bp, Artificial Sequence
  Synthetic DNA
ttgtacgacatacaatag

SEQ ID NO: 59076 - DNA, 18 bp, Artificial Sequence
  Synthetic DNA
ttgtacgacccacaacag

SEQ ID NO: 59077 - DNA, 18 bp, Artificial Sequence
  Synthetic DNA
ttgtacgtcacaatttag

SEQ ID NO: 59078 - DNA, 18 bp, Artificial Sequence
  Synthetic DNA
ttgtacgtcactcaatag

SEQ ID NO: 59079 - DNA, 18 bp, Artificial Sequence
  Synthetic DNA
ttgtacgtctctctgcag

SEQ ID NO: 59080 - DNA, 18 bp, Artificial Sequence
  Synthetic DNA
ttgtactactctctgtag

SEQ ID NO: 59081 - DNA, 18 bp, Artificial Sequence
  Synthetic DNA
ttgtacttctatctatag

SEQ ID NO: 59082 - DNA, 18 bp, Artificial Sequence
  Synthetic DNA
ttgtaggaaacacgaaag

SEQ ID NO: 59083 - DNA, 18 bp, Artificial Sequence
  Synthetic DNA
ttgtataacacactatag

SEQ ID NO: 59084 - DNA, 18 bp, Artificial Sequence
  Synthetic DNA
ttgtatcaattagtctag

SEQ ID NO: 59085 - DNA, 18 bp, Artificial Sequence
  Synthetic DNA
ttgtatgattgactacag

SEQ ID NO: 59086 - DNA, 18 bp, Artificial Sequence
  Synthetic DNA
ttgtctgactctctatag

SEQ ID NO: 59087 - DNA, 18 bp, Artificial Sequence
  Synthetic DNA
ttgtgtgactcactattg

SEQ ID NO: 59088 - DNA, 18 bp, Artificial Sequence
  Synthetic DNA
ttgttcgtctcattaagg

SEQ ID NO: 59089 - DNA, 18 bp, Artificial Sequence
  Synthetic DNA
tttaacaactcaatgtag

SEQ ID NO: 59090 - DNA, 18 bp, Artificial Sequence
  Synthetic DNA
tttaacaactcagtatag

SEQ ID NO: 59091 - DNA, 18 bp, Artificial Sequence
  Synthetic DNA
tttaaccactttccatag

SEQ ID NO: 59092 - DNA, 18 bp, Artificial Sequence
  Synthetic DNA
tttaacgaatgcctatag

SEQ ID NO: 59093 - DNA, 18 bp, Artificial Sequence
  Synthetic DNA
tttaacgacgcgatatag

SEQ ID NO: 59094 - DNA, 18 bp, Artificial Sequence
  Synthetic DNA
tttaacgagttacaatag

SEQ ID NO: 59095 - DNA, 18 bp, Artificial Sequence
  Synthetic DNA
tttaacgattcgctttag

SEQ ID NO: 59096 - DNA, 18 bp, Artificial Sequence
  Synthetic DNA
tttaacgcctcaatatag

SEQ ID NO: 59097 - DNA, 18 bp, Artificial Sequence
  Synthetic DNA
tttaacggcacgctacag

SEQ ID NO: 59098 - DNA, 18 bp, Artificial Sequence
  Synthetic DNA
tttaacgtctcactatcg

SEQ ID NO: 59099 - DNA, 18 bp, Artificial Sequence
  Synthetic DNA
tttaacgtctctctctag

SEQ ID NO: 59100 - DNA, 18 bp, Artificial Sequence
  Synthetic DNA
tttaacttccctctagtg

SEQ ID NO: 59101 - DNA, 18 bp, Artificial Sequence
  Synthetic DNA
tttaaggtatcactatag

SEQ ID NO: 59102 - DNA, 18 bp, Artificial Sequence
  Synthetic DNA
tttaagtagtcacaattg

SEQ ID NO: 59103 - DNA, 18 bp, Artificial Sequence
  Synthetic DNA
tttaatgactctctaaag

SEQ ID NO: 59104 - DNA, 18 bp, Artificial Sequence
  Synthetic DNA
tttaatgatcagctgaag

SEQ ID NO: 59105 - DNA, 18 bp, Artificial Sequence
  Synthetic DNA
tttagccactcactatag

SEQ ID NO: 59106 - DNA, 18 bp, Artificial Sequence
  Synthetic DNA
tttatcgtctcacaattg

SEQ ID NO: 59107 - DNA, 18 bp, Artificial Sequence
  Synthetic DNA
tttatctacatactatag

SEQ ID NO: 59108 - DNA, 18 bp, Artificial Sequence
  Synthetic DNA
tttattgacatactattg

SEQ ID NO: 59109 - DNA, 18 bp, Artificial Sequence
  Synthetic DNA
tttcacaactctctatag

SEQ ID NO: 59110 - DNA, 18 bp, Artificial Sequence
  Synthetic DNA
tttcaccactctcaatag

SEQ ID NO: 59111 - DNA, 18 bp, Artificial Sequence
  Synthetic DNA
tttcacgatttactattg

SEQ ID NO: 59112 - DNA, 18 bp, Artificial Sequence
  Synthetic DNA
tttcactgctcacaaagg

SEQ ID NO: 59113 - DNA, 18 bp, Artificial Sequence
  Synthetic DNA
tttcaggactaacttttg

SEQ ID NO: 59114 - DNA, 18 bp, Artificial Sequence
  Synthetic DNA
tttgacgactcatattag

SEQ ID NO: 59115 - DNA, 18 bp, Artificial Sequence
  Synthetic DNA
tttgactacttactttag

SEQ ID NO: 59116 - DNA, 18 bp, Artificial Sequence
  Synthetic DNA
ttttaaaattccttatag

SEQ ID NO: 59117 - DNA, 18 bp, Artificial Sequence
  Synthetic DNA
ttttaaatcacactttag

SEQ ID NO: 59118 - DNA, 18 bp, Artificial Sequence
  Synthetic DNA
ttttaagactctctcaag

SEQ ID NO: 59119 - DNA, 18 bp, Artificial Sequence
  Synthetic DNA
ttttaagagtaactagtg

SEQ ID NO: 59120 - DNA, 18 bp, Artificial Sequence
  Synthetic DNA
ttttaagccacaccatag

SEQ ID NO: 59121 - DNA, 18 bp, Artificial Sequence
  Synthetic DNA
ttttaagccacactaccg

SEQ ID NO: 59122 - DNA, 18 bp, Artificial Sequence
  Synthetic DNA
ttttaatactcaccatag

SEQ ID NO: 59123 - DNA, 18 bp, Artificial Sequence
  Synthetic DNA
ttttaatattcactttag

SEQ ID NO: 59124 - DNA, 18 bp, Artificial Sequence
  Synthetic DNA
ttttacaatttactatag

SEQ ID NO: 59125 - DNA, 18 bp, Artificial Sequence
  Synthetic DNA
ttttacatcacatttcag

SEQ ID NO: 59126 - DNA, 18 bp, Artificial Sequence
  Synthetic DNA
ttttacatcttactatag

SEQ ID NO: 59127 - DNA, 18 bp, Artificial Sequence
  Synthetic DNA
ttttacccatctctaaag

SEQ ID NO: 59128 - DNA, 18 bp, Artificial Sequence
  Synthetic DNA
ttttacctctcacattag

SEQ ID NO: 59129 - DNA, 18 bp, Artificial Sequence
  Synthetic DNA
ttttacgacgcccctgag

SEQ ID NO: 59130 - DNA, 18 bp, Artificial Sequence
  Synthetic DNA
ttttacgactcaacagag

SEQ ID NO: 59131 - DNA, 18 bp, Artificial Sequence
  Synthetic DNA
ttttacgactcacaaacg

SEQ ID NO: 59132 - DNA, 18 bp, Artificial Sequence
  Synthetic DNA
ttttacgactctgttcag

SEQ ID NO: 59133 - DNA, 18 bp, Artificial Sequence
  Synthetic DNA
ttttacgactgtcaaaag

SEQ ID NO: 59134 - DNA, 18 bp, Artificial Sequence
  Synthetic DNA
ttttacgacttgcaatag

SEQ ID NO: 59135 - DNA, 18 bp, Artificial Sequence
  Synthetic DNA
ttttacgattctctttag

SEQ ID NO: 59136 - DNA, 18 bp, Artificial Sequence
  Synthetic DNA
ttttacggctcacaatcg

SEQ ID NO: 59137 - DNA, 18 bp, Artificial Sequence
  Synthetic DNA
ttttacgtagcacttaag

SEQ ID NO: 59138 - DNA, 18 bp, Artificial Sequence
  Synthetic DNA
ttttacgtctcgtattag

SEQ ID NO: 59139 - DNA, 18 bp, Artificial Sequence
  Synthetic DNA
ttttacgtctctctaacg

SEQ ID NO: 59140 - DNA, 18 bp, Artificial Sequence
  Synthetic DNA
ttttactaccctctttag

SEQ ID NO: 59141 - DNA, 18 bp, Artificial Sequence
  Synthetic DNA
ttttactactcactactg

SEQ ID NO: 59142 - DNA, 18 bp, Artificial Sequence
  Synthetic DNA
ttttactacttactcttg

SEQ ID NO: 59143 - DNA, 18 bp, Artificial Sequence
  Synthetic DNA
ttttactatccactaaag

SEQ ID NO: 59144 - DNA, 18 bp, Artificial Sequence
  Synthetic DNA
ttttaggtctgactatag

SEQ ID NO: 59145 - DNA, 18 bp, Artificial Sequence
  Synthetic DNA
ttttatgactcacaagag

SEQ ID NO: 59146 - DNA, 18 bp, Artificial Sequence
  Synthetic DNA
ttttatgtctcactaaag

SEQ ID NO: 59147 - DNA, 18 bp, Artificial Sequence
  Synthetic DNA
ttttatgtcttacattag

SEQ ID NO: 59148 - DNA, 18 bp, Artificial Sequence
  Synthetic DNA
ttttcagacaaactttag

SEQ ID NO: 59149 - DNA, 18 bp, Artificial Sequence
  Synthetic DNA
ttttcagacttactatag

SEQ ID NO: 59150 - DNA, 18 bp, Artificial Sequence
  Synthetic DNA
ttttccgaatcattatag

SEQ ID NO: 59151 - DNA, 18 bp, Artificial Sequence
  Synthetic DNA
ttttccgacaaaacctag

SEQ ID NO: 59152 - DNA, 18 bp, Artificial Sequence
  Synthetic DNA
ttttccgacagactatag

SEQ ID NO: 59153 - DNA, 18 bp, Artificial Sequence
  Synthetic DNA
ttttccgatacactatag

SEQ ID NO: 59154 - DNA, 18 bp, Artificial Sequence
  Synthetic DNA
ttttccgtctccctacag

SEQ ID NO: 59155 - DNA, 18 bp, Artificial Sequence
  Synthetic DNA
ttttgccagttcctatag

SEQ ID NO: 59156 - DNA, 18 bp, Artificial Sequence
  Synthetic DNA
ttttgcgaatcactctag

SEQ ID NO: 59157 - DNA, 18 bp, Artificial Sequence
  Synthetic DNA
ttttgcgagtaactatag

SEQ ID NO: 59158 - DNA, 18 bp, Artificial Sequence
  Synthetic DNA
ttttgcgcgccactgatg

SEQ ID NO: 59159 - DNA, 18 bp, Artificial Sequence
  Synthetic DNA
ttttgctacgcactatag

SEQ ID NO: 59160 - DNA, 18 bp, Artificial Sequence
  Synthetic DNA
ttttgctactcgcgctag

SEQ ID NO: 59161 - DNA, 18 bp, Artificial Sequence
  Synthetic DNA
tttttagactgagaatag

SEQ ID NO: 59162 - DNA, 18 bp, Artificial Sequence
  Synthetic DNA
tttttcaactcacaatgg

SEQ ID NO: 59163 - DNA, 18 bp, Artificial Sequence
  Synthetic DNA
tttttcgactctctttag

SEQ ID NO: 59164 - DNA, 18 bp, Artificial Sequence
  Synthetic DNA
tttttgaacactcaatag

SEQ ID NO: 59165 - DNA, 18 bp, Artificial Sequence
  Synthetic DNA
tttttttaatctctatag

SEQ ID NO: 59166 - DNA, 18 bp, Artificial Sequence
  Synthetic DNA
taaaacgatacacaattg

SEQ ID NO: 59167 - DNA, 18 bp, Artificial Sequence
  Synthetic DNA
taaaacgcatcacattag

SEQ ID NO: 59168 - DNA, 18 bp, Artificial Sequence
  Synthetic DNA
taaaacttctctctgtag

SEQ ID NO: 59169 - DNA, 18 bp, Artificial Sequence
  Synthetic DNA
tatcatgaatcaatattg

SEQ ID NO: 59170 - DNA, 18 bp, Artificial Sequence
  Synthetic DNA
tattacttgtcaataaag

SEQ ID NO: 59171 - DNA, 18 bp, Artificial Sequence
  Synthetic DNA
tatttcgtctcgctattg

SEQ ID NO: 59172 - DNA, 18 bp, Artificial Sequence
  Synthetic DNA
ttatacgcaactctatag

SEQ ID NO: 59173 - DNA, 18 bp, Artificial Sequence
  Synthetic DNA
ttcatcgactcactttag

SEQ ID NO: 59174 - DNA, 18 bp, Artificial Sequence
  Synthetic DNA
taatatgaatctcaaaag

SEQ ID NO: 59175 - DNA, 18 bp, Artificial Sequence
  Synthetic DNA
ttaaacttctcactaaag

SEQ ID NO: 59176 - DNA, 18 bp, Artificial Sequence
  Synthetic DNA
tttttcgtctcgctatag

SEQ ID NO: 59177 - DNA, 18 bp, Artificial Sequence
  Synthetic DNA
aaaaacgactctatattg

SEQ ID NO: 59178 - DNA, 18 bp, Artificial Sequence
  Synthetic DNA
aaaaacgattcactcttg

SEQ ID NO: 59179 - DNA, 18 bp, Artificial Sequence
  Synthetic DNA
aaatacgtcaagctatag

SEQ ID NO: 59180 - DNA, 18 bp, Artificial Sequence
  Synthetic DNA
aaatacgtcgcataatag

SEQ ID NO: 59181 - DNA, 18 bp, Artificial Sequence
  Synthetic DNA
aaatacgtctcatttaag

SEQ ID NO: 59182 - DNA, 18 bp, Artificial Sequence
  Synthetic DNA
aaatccgtctcacattag

SEQ ID NO: 59183 - DNA, 18 bp, Artificial Sequence
  Synthetic DNA
aaatcctactctcattag

SEQ ID NO: 59184 - DNA, 18 bp, Artificial Sequence
  Synthetic DNA
aaattagtctcacaatag

SEQ ID NO: 59185 - DNA, 18 bp, Artificial Sequence
  Synthetic DNA
aaattggtctcacttttg

SEQ ID NO: 59186 - DNA, 18 bp, Artificial Sequence
  Synthetic DNA
aactacgacgcacattag

SEQ ID NO: 59187 - DNA, 18 bp, Artificial Sequence
  Synthetic DNA
aagaacgactctctaaag

SEQ ID NO: 59188 - DNA, 18 bp, Artificial Sequence
  Synthetic DNA
aagccctaatctctatag

SEQ ID NO: 59189 - DNA, 18 bp, Artificial Sequence
  Synthetic DNA
aataacaactgactatag

SEQ ID NO: 59190 - DNA, 18 bp, Artificial Sequence
  Synthetic DNA
aattacgaatgtctatag

SEQ ID NO: 59191 - DNA, 18 bp, Artificial Sequence
  Synthetic DNA
acacacgactcacaatgg

SEQ ID NO: 59192 - DNA, 18 bp, Artificial Sequence
  Synthetic DNA
acatacgattccttatag

SEQ ID NO: 59193 - DNA, 18 bp, Artificial Sequence
  Synthetic DNA
actcgcgaccgtccatag

SEQ ID NO: 59194 - DNA, 18 bp, Artificial Sequence
  Synthetic DNA
agaatcgtctcactaagg

SEQ ID NO: 59195 - DNA, 18 bp, Artificial Sequence
  Synthetic DNA
ataaactactctctatag

SEQ ID NO: 59196 - DNA, 18 bp, Artificial Sequence
  Synthetic DNA
atacatgatgtaattttg

SEQ ID NO: 59197 - DNA, 18 bp, Artificial Sequence
  Synthetic DNA
atataccaatcgcaatag

SEQ ID NO: 59198 - DNA, 18 bp, Artificial Sequence
  Synthetic DNA
atatacgacttaatatcg

SEQ ID NO: 59199 - DNA, 18 bp, Artificial Sequence
  Synthetic DNA
atatacgattcacgagag

SEQ ID NO: 59200 - DNA, 18 bp, Artificial Sequence
  Synthetic DNA
atatatgtctcaatagag

SEQ ID NO: 59201 - DNA, 18 bp, Artificial Sequence
  Synthetic DNA
atattcgactgttcatag

SEQ ID NO: 59202 - DNA, 18 bp, Artificial Sequence
  Synthetic DNA
atattcgattcacaatag

SEQ ID NO: 59203 - DNA, 18 bp, Artificial Sequence
  Synthetic DNA
caaaacgattctctatgg

SEQ ID NO: 59204 - DNA, 18 bp, Artificial Sequence
  Synthetic DNA
caatacgtcacacatcag

SEQ ID NO: 59205 - DNA, 18 bp, Artificial Sequence
  Synthetic DNA
caatatcacgctctagag

SEQ ID NO: 59206 - DNA, 18 bp, Artificial Sequence
  Synthetic DNA
caattcgagtcactccag

SEQ ID NO: 59207 - DNA, 18 bp, Artificial Sequence
  Synthetic DNA
cacaacgactccctattg

SEQ ID NO: 59208 - DNA, 18 bp, Artificial Sequence
  Synthetic DNA
cattatttcacactatag

SEQ ID NO: 59209 - DNA, 18 bp, Artificial Sequence
  Synthetic DNA
ctatactacccactaaag

SEQ ID NO: 59210 - DNA, 18 bp, Artificial Sequence
  Synthetic DNA
gaatacgtctcataatcg

SEQ ID NO: 59211 - DNA, 18 bp, Artificial Sequence
  Synthetic DNA
taaaacgactcagatatg

SEQ ID NO: 59212 - DNA, 18 bp, Artificial Sequence
  Synthetic DNA
taaaacgcctcttcatag

SEQ ID NO: 59213 - DNA, 18 bp, Artificial Sequence
  Synthetic DNA
taaaacttctctctatcg

SEQ ID NO: 59214 - DNA, 18 bp, Artificial Sequence
  Synthetic DNA
taaaatgacactcttttg

SEQ ID NO: 59215 - DNA, 18 bp, Artificial Sequence
  Synthetic DNA
taaaattactcaccattg

SEQ ID NO: 59216 - DNA, 18 bp, Artificial Sequence
  Synthetic DNA
taaagcgacaggctattg

SEQ ID NO: 59217 - DNA, 18 bp, Artificial Sequence
  Synthetic DNA
taaatcgacaaactttag

SEQ ID NO: 59218 - DNA, 18 bp, Artificial Sequence
  Synthetic DNA
taaatctactcattaaag

SEQ ID NO: 59219 - DNA, 18 bp, Artificial Sequence
  Synthetic DNA
taacacgttccactattg

SEQ ID NO: 59220 - DNA, 18 bp, Artificial Sequence
  Synthetic DNA
taactcgtcaaactatag

SEQ ID NO: 59221 - DNA, 18 bp, Artificial Sequence
  Synthetic DNA
taagctcattcaccttag

SEQ ID NO: 59222 - DNA, 18 bp, Artificial Sequence
  Synthetic DNA
taataagaaacacatgag

SEQ ID NO: 59223 - DNA, 18 bp, Artificial Sequence
  Synthetic DNA
taatacacctctcttcag

SEQ ID NO: 59224 - DNA, 18 bp, Artificial Sequence
  Synthetic DNA
taatacactacataagcg

SEQ ID NO: 59225 - DNA, 18 bp, Artificial Sequence
  Synthetic DNA
taatacatctaacaaaag

SEQ ID NO: 59226 - DNA, 18 bp, Artificial Sequence
  Synthetic DNA
taataccactagcatttg

SEQ ID NO: 59227 - DNA, 18 bp, Artificial Sequence
  Synthetic DNA
taatacgtttttccatag

SEQ ID NO: 59228 - DNA, 18 bp, Artificial Sequence
  Synthetic DNA
taatactactctcataag

SEQ ID NO: 59229 - DNA, 18 bp, Artificial Sequence
  Synthetic DNA
taatagcgcactctctag

SEQ ID NO: 59230 - DNA, 18 bp, Artificial Sequence
  Synthetic DNA
taatccgactatcaacag

SEQ ID NO: 59231 - DNA, 18 bp, Artificial Sequence
  Synthetic DNA
taatcggactcattgttg

SEQ ID NO: 59232 - DNA, 18 bp, Artificial Sequence
  Synthetic DNA
taatgcgttttactattg

SEQ ID NO: 59233 - DNA, 18 bp, Artificial Sequence
  Synthetic DNA
taatgtgacacacaatgg

SEQ ID NO: 59234 - DNA, 18 bp, Artificial Sequence
  Synthetic DNA
taattagacactctttag

SEQ ID NO: 59235 - DNA, 18 bp, Artificial Sequence
  Synthetic DNA
taattggattgactaaag

SEQ ID NO: 59236 - DNA, 18 bp, Artificial Sequence
  Synthetic DNA
taattggtctcattatcg

SEQ ID NO: 59237 - DNA, 18 bp, Artificial Sequence
  Synthetic DNA
taatttaactcaaaatcg

SEQ ID NO: 59238 - DNA, 18 bp, Artificial Sequence
  Synthetic DNA
tacaatgactcgttaacg

SEQ ID NO: 59239 - DNA, 18 bp, Artificial Sequence
  Synthetic DNA
tactataactctctttag

SEQ ID NO: 59240 - DNA, 18 bp, Artificial Sequence
  Synthetic DNA
tacttctactacctatag

SEQ ID NO: 59241 - DNA, 18 bp, Artificial Sequence
  Synthetic DNA
tagatagactcacaatag

SEQ ID NO: 59242 - DNA, 18 bp, Artificial Sequence
  Synthetic DNA
tagattgactcacattag

SEQ ID NO: 59243 - DNA, 18 bp, Artificial Sequence
  Synthetic DNA
tagcacgactcataattg

SEQ ID NO: 59244 - DNA, 18 bp, Artificial Sequence
  Synthetic DNA
tagtacgactcaaattcg

SEQ ID NO: 59245 - DNA, 18 bp, Artificial Sequence
  Synthetic DNA
tagtattactcgcaatag

SEQ ID NO: 59246 - DNA, 18 bp, Artificial Sequence
  Synthetic DNA
tagttcctcgcactctag

SEQ ID NO: 59247 - DNA, 18 bp, Artificial Sequence
  Synthetic DNA
tagttcgactaaatttag

SEQ ID NO: 59248 - DNA, 18 bp, Artificial Sequence
  Synthetic DNA
tagtttgactccctacag

SEQ ID NO: 59249 - DNA, 18 bp, Artificial Sequence
  Synthetic DNA
tataaccactcgcttaag

SEQ ID NO: 59250 - DNA, 18 bp, Artificial Sequence
  Synthetic DNA
tataaccactctctacag

SEQ ID NO: 59251 - DNA, 18 bp, Artificial Sequence
  Synthetic DNA
tataacttctcactaaag

SEQ ID NO: 59252 - DNA, 18 bp, Artificial Sequence
  Synthetic DNA
tatatcgactcactaccg

SEQ ID NO: 59253 - DNA, 18 bp, Artificial Sequence
  Synthetic DNA
tatcacgtcagactagag

SEQ ID NO: 59254 - DNA, 18 bp, Artificial Sequence
  Synthetic DNA
tattacacctcactcttg

SEQ ID NO: 59255 - DNA, 18 bp, Artificial Sequence
  Synthetic DNA
tattacgccccgcttttg

SEQ ID NO: 59256 - DNA, 18 bp, Artificial Sequence
  Synthetic DNA
tattacggcacaccaaag

SEQ ID NO: 59257 - DNA, 18 bp, Artificial Sequence
  Synthetic DNA
tattactactgacttttg

SEQ ID NO: 59258 - DNA, 18 bp, Artificial Sequence
  Synthetic DNA
tattatgactcattgctg

SEQ ID NO: 59259 - DNA, 18 bp, Artificial Sequence
  Synthetic DNA
tattatgccttcatatag

SEQ ID NO: 59260 - DNA, 18 bp, Artificial Sequence
  Synthetic DNA
tatttcgactcaacttag

SEQ ID NO: 59261 - DNA, 18 bp, Artificial Sequence
  Synthetic DNA
tatttcgagtctctaaag

SEQ ID NO: 59262 - DNA, 18 bp, Artificial Sequence
  Synthetic DNA
tcaatctactattaatag

SEQ ID NO: 59263 - DNA, 18 bp, Artificial Sequence
  Synthetic DNA
tcataggacaatatattg

SEQ ID NO: 59264 - DNA, 18 bp, Artificial Sequence
  Synthetic DNA
tcatccgcgccacgttag

SEQ ID NO: 59265 - DNA, 18 bp, Artificial Sequence
  Synthetic DNA
tctgatcactcacaatag

SEQ ID NO: 59266 - DNA, 18 bp, Artificial Sequence
  Synthetic DNA
tgattccactcagttcag

SEQ ID NO: 59267 - DNA, 18 bp, Artificial Sequence
  Synthetic DNA
tgctcccacactctatag

SEQ ID NO: 59268 - DNA, 18 bp, Artificial Sequence
  Synthetic DNA
tgtttagactcattacag

SEQ ID NO: 59269 - DNA, 18 bp, Artificial Sequence
  Synthetic DNA
ttaaccgccacactaatg

SEQ ID NO: 59270 - DNA, 18 bp, Artificial Sequence
  Synthetic DNA
ttaatcgactcacttttg

SEQ ID NO: 59271 - DNA, 18 bp, Artificial Sequence
  Synthetic DNA
ttactcgactaaatatcg

SEQ ID NO: 59272 - DNA, 18 bp, Artificial Sequence
  Synthetic DNA
ttactcgtcacactatag

SEQ ID NO: 59273 - DNA, 18 bp, Artificial Sequence
  Synthetic DNA
ttagacgtcacactattg

SEQ ID NO: 59274 - DNA, 18 bp, Artificial Sequence
  Synthetic DNA
ttatacgacactctcaag

SEQ ID NO: 59275 - DNA, 18 bp, Artificial Sequence
  Synthetic DNA
ttatacgagtaaatgtag

SEQ ID NO: 59276 - DNA, 18 bp, Artificial Sequence
  Synthetic DNA
ttatacgatcgtttattg

SEQ ID NO: 59277 - DNA, 18 bp, Artificial Sequence
  Synthetic DNA
ttatacgatttattcttg

SEQ ID NO: 59278 - DNA, 18 bp, Artificial Sequence
  Synthetic DNA
ttatagtactcactaacg

SEQ ID NO: 59279 - DNA, 18 bp, Artificial Sequence
  Synthetic DNA
ttatccgagtgtctatag

SEQ ID NO: 59280 - DNA, 18 bp, Artificial Sequence
  Synthetic DNA
ttatgcgcctcaatggag

SEQ ID NO: 59281 - DNA, 18 bp, Artificial Sequence
  Synthetic DNA
ttattcgacccaccatgg

SEQ ID NO: 59282 - DNA, 18 bp, Artificial Sequence
  Synthetic DNA
ttattcgacccacgctag

SEQ ID NO: 59283 - DNA, 18 bp, Artificial Sequence
  Synthetic DNA
ttattcgccacactacag

SEQ ID NO: 59284 - DNA, 18 bp, Artificial Sequence
  Synthetic DNA
ttatttgtctaactatag

SEQ ID NO: 59285 - DNA, 18 bp, Artificial Sequence
  Synthetic DNA
ttcaacgagactctatag

SEQ ID NO: 59286 - DNA, 18 bp, Artificial Sequence
  Synthetic DNA
ttgtatgacacacacacg

SEQ ID NO: 59287 - DNA, 18 bp, Artificial Sequence
  Synthetic DNA
tttcaagactcactattg

SEQ ID NO: 59288 - DNA, 18 bp, Artificial Sequence
  Synthetic DNA
ttttaagtctcactaaag

SEQ ID NO: 59289 - DNA, 18 bp, Artificial Sequence
  Synthetic DNA
ttttacgactctctgaag

SEQ ID NO: 59290 - DNA, 18 bp, Artificial Sequence
  Synthetic DNA
ttttattactcattaaag

SEQ ID NO: 59291 - DNA, 18 bp, Artificial Sequence
  Synthetic DNA
ttttccgacttaatattg

SEQ ID NO: 59292 - DNA, 18 bp, Artificial Sequence
  Synthetic DNA
ttttgcgactgacttttg

SEQ ID NO: 59293 - DNA, 18 bp, Artificial Sequence
  Synthetic DNA
tttttcgcctcacaatag

SEQ ID NO: 59294 - DNA, 18 bp, Artificial Sequence
  Synthetic DNA
tttttcgtctctcaatag

SEQ ID NO: 59295 - DNA, 18 bp, Artificial Sequence
  Synthetic DNA
atatgcaacacactgtag

SEQ ID NO: 59296 - DNA, 18 bp, Artificial Sequence
  Synthetic DNA
tgatatgtctctcaatag

SEQ ID NO: 59297 - DNA, 18 bp, Artificial Sequence
  Synthetic DNA
ttataccacttataatag

SEQ ID NO: 59298 - DNA, 18 bp, Artificial Sequence
  Synthetic DNA
ttatacgaaacactaagg

SEQ ID NO: 59299 - DNA, 18 bp, Artificial Sequence
  Synthetic DNA
taaatcgtctcactaatg

SEQ ID NO: 59300 - DNA, 18 bp, Artificial Sequence
  Synthetic DNA
taatccgatacacgttag

SEQ ID NO: 59301 - DNA, 18 bp, Artificial Sequence
  Synthetic DNA
taatgcgtcgctctattg

SEQ ID NO: 59302 - DNA, 18 bp, Artificial Sequence
  Synthetic DNA
taatgcttctcgccaaag

SEQ ID NO: 59303 - DNA, 18 bp, Artificial Sequence
  Synthetic DNA
tatttcgacactcaatag

SEQ ID NO: 59304 - DNA, 18 bp, Artificial Sequence
  Synthetic DNA
ttatacgtcacattaaag

SEQ ID NO: 59305 - DNA, 18 bp, Artificial Sequence
  Synthetic DNA
ttatacgtcttacttttg

SEQ ID NO: 59306 - DNA, 18 bp, Artificial Sequence
  Synthetic DNA
aaaaacgactcatttcag

SEQ ID NO: 59307 - DNA, 18 bp, Artificial Sequence
  Synthetic DNA
aaaaactccacactaaag

SEQ ID NO: 59308 - DNA, 18 bp, Artificial Sequence
  Synthetic DNA
aaatacctctcaataaag

SEQ ID NO: 59309 - DNA, 18 bp, Artificial Sequence
  Synthetic DNA
aaatactactcacttatg

SEQ ID NO: 59310 - DNA, 18 bp, Artificial Sequence
  Synthetic DNA
aaatacttcatactatag

SEQ ID NO: 59311 - DNA, 18 bp, Artificial Sequence
  Synthetic DNA
aaatatgaccttctttag

SEQ ID NO: 59312 - DNA, 18 bp, Artificial Sequence
  Synthetic DNA
aactatgcctcaccgtag

SEQ ID NO: 59313 - DNA, 18 bp, Artificial Sequence
  Synthetic DNA
aagcacgactcacttcag

SEQ ID NO: 59314 - DNA, 18 bp, Artificial Sequence
  Synthetic DNA
aattaagacttaccgtag

SEQ ID NO: 59315 - DNA, 18 bp, Artificial Sequence
  Synthetic DNA
aattatcattcagcattg

SEQ ID NO: 59316 - DNA, 18 bp, Artificial Sequence
  Synthetic DNA
aattcggactcacgattg

SEQ ID NO: 59317 - DNA, 18 bp, Artificial Sequence
  Synthetic DNA
agataattctctctctag

SEQ ID NO: 59318 - DNA, 18 bp, Artificial Sequence
  Synthetic DNA
ataaacgatacagtgtcg

SEQ ID NO: 59319 - DNA, 18 bp, Artificial Sequence
  Synthetic DNA
atacacggctttctatag

SEQ ID NO: 59320 - DNA, 18 bp, Artificial Sequence
  Synthetic DNA
atatacgacgaacaatag

SEQ ID NO: 59321 - DNA, 18 bp, Artificial Sequence
  Synthetic DNA
atatacgacgcactgttg

SEQ ID NO: 59322 - DNA, 18 bp, Artificial Sequence
  Synthetic DNA
atttacgcgtatctatgg

SEQ ID NO: 59323 - DNA, 18 bp, Artificial Sequence
  Synthetic DNA
caacacgacattctatag

SEQ ID NO: 59324 - DNA, 18 bp, Artificial Sequence
  Synthetic DNA
caatacaaacctatatag

SEQ ID NO: 59325 - DNA, 18 bp, Artificial Sequence
  Synthetic DNA
caatacgattttaaatag

SEQ ID NO: 59326 - DNA, 18 bp, Artificial Sequence
  Synthetic DNA
caatgcccccaactatcg

SEQ ID NO: 59327 - DNA, 18 bp, Artificial Sequence
  Synthetic DNA
cactactacttactaatg

SEQ ID NO: 59328 - DNA, 18 bp, Artificial Sequence
  Synthetic DNA
cattaagtcacaccatag

SEQ ID NO: 59329 - DNA, 18 bp, Artificial Sequence
  Synthetic DNA
cattacgactatctttcg

SEQ ID NO: 59330 - DNA, 18 bp, Artificial Sequence
  Synthetic DNA
gtatattcatcacaatag

SEQ ID NO: 59331 - DNA, 18 bp, Artificial Sequence
  Synthetic DNA
taaaacaacactctaaag

SEQ ID NO: 59332 - DNA, 18 bp, Artificial Sequence
  Synthetic DNA
taaaacgacacacaaccg

SEQ ID NO: 59333 - DNA, 18 bp, Artificial Sequence
  Synthetic DNA
taaaacgtctaataatag

SEQ ID NO: 59334 - DNA, 18 bp, Artificial Sequence
  Synthetic DNA
taaaactactctccaagg

SEQ ID NO: 59335 - DNA, 18 bp, Artificial Sequence
  Synthetic DNA
taaaatgactccgtattg

SEQ ID NO: 59336 - DNA, 18 bp, Artificial Sequence
  Synthetic DNA
taaaccgtctcagaatag

SEQ ID NO: 59337 - DNA, 18 bp, Artificial Sequence
  Synthetic DNA
taaatcgattcgctttag

SEQ ID NO: 59338 - DNA, 18 bp, Artificial Sequence
  Synthetic DNA
taacacgattttctatcg

SEQ ID NO: 59339 - DNA, 18 bp, Artificial Sequence
  Synthetic DNA
taacagtacccaccaaag

SEQ ID NO: 59340 - DNA, 18 bp, Artificial Sequence
  Synthetic DNA
taaccgatctcactctag

SEQ ID NO: 59341 - DNA, 18 bp, Artificial Sequence
  Synthetic DNA
taataagaccctcaattg

SEQ ID NO: 59342 - DNA, 18 bp, Artificial Sequence
  Synthetic DNA
taataagactttctcatg

SEQ ID NO: 59343 - DNA, 18 bp, Artificial Sequence
  Synthetic DNA
taataagatacacactag

SEQ ID NO: 59344 - DNA, 18 bp, Artificial Sequence
  Synthetic DNA
taataagtcgaaaaaatg

SEQ ID NO: 59345 - DNA, 18 bp, Artificial Sequence
  Synthetic DNA
taatacaaattattattg

SEQ ID NO: 59346 - DNA, 18 bp, Artificial Sequence
  Synthetic DNA
taatacatctaaaaatag

SEQ ID NO: 59347 - DNA, 18 bp, Artificial Sequence
  Synthetic DNA
taatacatctctctaacg

SEQ ID NO: 59348 - DNA, 18 bp, Artificial Sequence
  Synthetic DNA
taatacgaccagttttcg

SEQ ID NO: 59349 - DNA, 18 bp, Artificial Sequence
  Synthetic DNA
taatacgtcaggctttcg

SEQ ID NO: 59350 - DNA, 18 bp, Artificial Sequence
  Synthetic DNA
taatacgtctctgcaaag

SEQ ID NO: 59351 - DNA, 18 bp, Artificial Sequence
  Synthetic DNA
taatacgtcttgctaatg

SEQ ID NO: 59352 - DNA, 18 bp, Artificial Sequence
  Synthetic DNA
taataggacaccttaaag

SEQ ID NO: 59353 - DNA, 18 bp, Artificial Sequence
  Synthetic DNA
taatagtacttactttcg

SEQ ID NO: 59354 - DNA, 18 bp, Artificial Sequence
  Synthetic DNA
taatatttctctctattg

SEQ ID NO: 59355 - DNA, 18 bp, Artificial Sequence
  Synthetic DNA
taatcagacatgctagag

SEQ ID NO: 59356 - DNA, 18 bp, Artificial Sequence
  Synthetic DNA
taatccaggttttatagg

SEQ ID NO: 59357 - DNA, 18 bp, Artificial Sequence
  Synthetic DNA
taatgcaacactcttcag

SEQ ID NO: 59358 - DNA, 18 bp, Artificial Sequence
  Synthetic DNA
taatgcatatcacgatcg

SEQ ID NO: 59359 - DNA, 18 bp, Artificial Sequence
  Synthetic DNA
taatgcgtttcaatttag

SEQ ID NO: 59360 - DNA, 18 bp, Artificial Sequence
  Synthetic DNA
taattagttacactatag

SEQ ID NO: 59361 - DNA, 18 bp, Artificial Sequence
  Synthetic DNA
taattcaatacattatag

SEQ ID NO: 59362 - DNA, 18 bp, Artificial Sequence
  Synthetic DNA
taattccacactctaaag

SEQ ID NO: 59363 - DNA, 18 bp, Artificial Sequence
  Synthetic DNA
taattcgacagacaattg

SEQ ID NO: 59364 - DNA, 18 bp, Artificial Sequence
  Synthetic DNA
taattcgacgctcaattg

SEQ ID NO: 59365 - DNA, 18 bp, Artificial Sequence
  Synthetic DNA
taattcgactcaaacggg

SEQ ID NO: 59366 - DNA, 18 bp, Artificial Sequence
  Synthetic DNA
taattcgactctcaatta

SEQ ID NO: 59367 - DNA, 18 bp, Artificial Sequence
  Synthetic DNA
taattcgattatcaatag

SEQ ID NO: 59368 - DNA, 18 bp, Artificial Sequence
  Synthetic DNA
taattcgtctcaattttg

SEQ ID NO: 59369 - DNA, 18 bp, Artificial Sequence
  Synthetic DNA
taattcgtctcacatcag

SEQ ID NO: 59370 - DNA, 18 bp, Artificial Sequence
  Synthetic DNA
tactacgactctcaagtg

SEQ ID NO: 59371 - DNA, 18 bp, Artificial Sequence
  Synthetic DNA
tagaccgacttgctatag

SEQ ID NO: 59372 - DNA, 18 bp, Artificial Sequence
  Synthetic DNA
tagtacgacgtacttttg

SEQ ID NO: 59373 - DNA, 18 bp, Artificial Sequence
  Synthetic DNA
tagtatgacacacaattg

SEQ ID NO: 59374 - DNA, 18 bp, Artificial Sequence
  Synthetic DNA
tagtccgacgaattatag

SEQ ID NO: 59375 - DNA, 18 bp, Artificial Sequence
  Synthetic DNA
tagttcgactctctaatg

SEQ ID NO: 59376 - DNA, 18 bp, Artificial Sequence
  Synthetic DNA
tataacgactcacatgag

SEQ ID NO: 59377 - DNA, 18 bp, Artificial Sequence
  Synthetic DNA
tataactactcaaaatag

SEQ ID NO: 59378 - DNA, 18 bp, Artificial Sequence
  Synthetic DNA
tatagtgactctttttag

SEQ ID NO: 59379 - DNA, 18 bp, Artificial Sequence
  Synthetic DNA
tatatctattcacttaag

SEQ ID NO: 59380 - DNA, 18 bp, Artificial Sequence
  Synthetic DNA
tatcacaactcactaatg

SEQ ID NO: 59381 - DNA, 18 bp, Artificial Sequence
  Synthetic DNA
tatgtcaactcactaaag

SEQ ID NO: 59382 - DNA, 18 bp, Artificial Sequence
  Synthetic DNA
tattacgcctctataaag

SEQ ID NO: 59383 - DNA, 18 bp, Artificial Sequence
  Synthetic DNA
tatttaacatcattatag

SEQ ID NO: 59384 - DNA, 18 bp, Artificial Sequence
  Synthetic DNA
tatttcaacacaatatag

SEQ ID NO: 59385 - DNA, 18 bp, Artificial Sequence
  Synthetic DNA
tatttcaactcgctctag

SEQ ID NO: 59386 - DNA, 18 bp, Artificial Sequence
  Synthetic DNA
tgaatccactttctatag

SEQ ID NO: 59387 - DNA, 18 bp, Artificial Sequence
  Synthetic DNA
tgacaggacactctattg

SEQ ID NO: 59388 - DNA, 18 bp, Artificial Sequence
  Synthetic DNA
tgataagacacaaaacag

SEQ ID NO: 59389 - DNA, 18 bp, Artificial Sequence
  Synthetic DNA
tgatacagctcactaacg

SEQ ID NO: 59390 - DNA, 18 bp, Artificial Sequence
  Synthetic DNA
tgcaaatacactcaatag

SEQ ID NO: 59391 - DNA, 18 bp, Artificial Sequence
  Synthetic DNA
tgctacgacaacttattg

SEQ ID NO: 59392 - DNA, 18 bp, Artificial Sequence
  Synthetic DNA
tggaacgactcacactag

SEQ ID NO: 59393 - DNA, 18 bp, Artificial Sequence
  Synthetic DNA
tgttacgacacactaacg

SEQ ID NO: 59394 - DNA, 18 bp, Artificial Sequence
  Synthetic DNA
ttaaaggactcaataaag

SEQ ID NO: 59395 - DNA, 18 bp, Artificial Sequence
  Synthetic DNA
ttaaatgacacactattg

SEQ ID NO: 59396 - DNA, 18 bp, Artificial Sequence
  Synthetic DNA
ttaaccgtttcgctatag

SEQ ID NO: 59397 - DNA, 18 bp, Artificial Sequence
  Synthetic DNA
ttaatcacctcgcttttg

SEQ ID NO: 59398 - DNA, 18 bp, Artificial Sequence
  Synthetic DNA
ttaatcgtctcactaaag

SEQ ID NO: 59399 - DNA, 18 bp, Artificial Sequence
  Synthetic DNA
ttacatgactttctacag

SEQ ID NO: 59400 - DNA, 18 bp, Artificial Sequence
  Synthetic DNA
ttataccaaacattaaag

SEQ ID NO: 59401 - DNA, 18 bp, Artificial Sequence
  Synthetic DNA
ttataccaatcacttaag

SEQ ID NO: 59402 - DNA, 18 bp, Artificial Sequence
  Synthetic DNA
ttatatgactctcattag

SEQ ID NO: 59403 - DNA, 18 bp, Artificial Sequence
  Synthetic DNA
ttatgcgtctcgctacag

SEQ ID NO: 59404 - DNA, 18 bp, Artificial Sequence
  Synthetic DNA
ttattagtctaactgtag

SEQ ID NO: 59405 - DNA, 18 bp, Artificial Sequence
  Synthetic DNA
ttattcgcttgactatag

SEQ ID NO: 59406 - DNA, 18 bp, Artificial Sequence
  Synthetic DNA
ttctctgacgctctattg

SEQ ID NO: 59407 - DNA, 18 bp, Artificial Sequence
  Synthetic DNA
ttttacaactcacttagg

SEQ ID NO: 59408 - DNA, 18 bp, Artificial Sequence
  Synthetic DNA
ttttaccacttactaaag

SEQ ID NO: 59409 - DNA, 18 bp, Artificial Sequence
  Synthetic DNA
ttttacgactatttatag

SEQ ID NO: 59410 - DNA, 18 bp, Artificial Sequence
  Synthetic DNA
ttttacgactcacccgag

SEQ ID NO: 59411 - DNA, 18 bp, Artificial Sequence
  Synthetic DNA
ttttacgtctcacaatcg

SEQ ID NO: 59412 - DNA, 18 bp, Artificial Sequence
  Synthetic DNA
ttttgcgactcacttatg

SEQ ID NO: 59413 - DNA, 18 bp, Artificial Sequence
  Synthetic DNA
tttttcgcctcacaattg

SEQ ID NO: 59414 - DNA, 18 bp, Artificial Sequence
  Synthetic DNA
tttttctactctcaatgg

SEQ ID NO: 59415 - DNA, 18 bp, Artificial Sequence
  Synthetic DNA
aaaaaagactcatttttg

SEQ ID NO: 59416 - DNA, 18 bp, Artificial Sequence
  Synthetic DNA
aaaaaataatcacgatag

SEQ ID NO: 59417 - DNA, 18 bp, Artificial Sequence
  Synthetic DNA
aaaaaatagttattatag

SEQ ID NO: 59418 - DNA, 18 bp, Artificial Sequence
  Synthetic DNA
aaaaacaacacacaaacg

SEQ ID NO: 59419 - DNA, 18 bp, Artificial Sequence
  Synthetic DNA
aaaaacatatcgctttag

SEQ ID NO: 59420 - DNA, 18 bp, Artificial Sequence
  Synthetic DNA
aaaaaccaccaactggtg

SEQ ID NO: 59421 - DNA, 18 bp, Artificial Sequence
  Synthetic DNA
aaaaaccactcagtctcg

SEQ ID NO: 59422 - DNA, 18 bp, Artificial Sequence
  Synthetic DNA
aaaaacccctcaaattag

SEQ ID NO: 59423 - DNA, 18 bp, Artificial Sequence
  Synthetic DNA
aaaaacctctaactatag

SEQ ID NO: 59424 - DNA, 18 bp, Artificial Sequence
  Synthetic DNA
aaaaacgaataattatag

SEQ ID NO: 59425 - DNA, 18 bp, Artificial Sequence
  Synthetic DNA
aaaaacgacatattacag

SEQ ID NO: 59426 - DNA, 18 bp, Artificial Sequence
  Synthetic DNA
aaaaacgacatgctgtag

SEQ ID NO: 59427 - DNA, 18 bp, Artificial Sequence
  Synthetic DNA
aaaaacgaccgactgtcg

SEQ ID NO: 59428 - DNA, 18 bp, Artificial Sequence
  Synthetic DNA
aaaaacgactcacttgtg

SEQ ID NO: 59429 - DNA, 18 bp, Artificial Sequence
  Synthetic DNA
aaaaacgattcacatttg

SEQ ID NO: 59430 - DNA, 18 bp, Artificial Sequence
  Synthetic DNA
aaaaacgtcgcatttttg

SEQ ID NO: 59431 - DNA, 18 bp, Artificial Sequence
  Synthetic DNA
aaaaacgtcttacatcag

SEQ ID NO: 59432 - DNA, 18 bp, Artificial Sequence
  Synthetic DNA
aaaaacgtgaggctgtag

SEQ ID NO: 59433 - DNA, 18 bp, Artificial Sequence
  Synthetic DNA
aaaaactacttattatag

SEQ ID NO: 59434 - DNA, 18 bp, Artificial Sequence
  Synthetic DNA
aaaaactagacactatcg

SEQ ID NO: 59435 - DNA, 18 bp, Artificial Sequence
  Synthetic DNA
aaaaaggacacacactag

SEQ ID NO: 59436 - DNA, 18 bp, Artificial Sequence
  Synthetic DNA
aaaaatgaatccccatgg

SEQ ID NO: 59437 - DNA, 18 bp, Artificial Sequence
  Synthetic DNA
aaaaatgactcacactag

SEQ ID NO: 59438 - DNA, 18 bp, Artificial Sequence
  Synthetic DNA
aaaaatggtagaatatag

SEQ ID NO: 59439 - DNA, 18 bp, Artificial Sequence
  Synthetic DNA
aaaaccgactcattatgg

SEQ ID NO: 59440 - DNA, 18 bp, Artificial Sequence
  Synthetic DNA
aaaaccgactctctttag

SEQ ID NO: 59441 - DNA, 18 bp, Artificial Sequence
  Synthetic DNA
aaaaggggccctctaaag

SEQ ID NO: 59442 - DNA, 18 bp, Artificial Sequence
  Synthetic DNA
aaaatcgcctcactaagg

SEQ ID NO: 59443 - DNA, 18 bp, Artificial Sequence
  Synthetic DNA
aaaatcgtttcaacattg

SEQ ID NO: 59444 - DNA, 18 bp, Artificial Sequence
  Synthetic DNA
aaaatggactaactatag

SEQ ID NO: 59445 - DNA, 18 bp, Artificial Sequence
  Synthetic DNA
aaaatggtctctctatag

SEQ ID NO: 59446 - DNA, 18 bp, Artificial Sequence
  Synthetic DNA
aaaattgtctcactatcg

SEQ ID NO: 59447 - DNA, 18 bp, Artificial Sequence
  Synthetic DNA
aaacacaactcactctcg

SEQ ID NO: 59448 - DNA, 18 bp, Artificial Sequence
  Synthetic DNA
aaacaccactttctatag

SEQ ID NO: 59449 - DNA, 18 bp, Artificial Sequence
  Synthetic DNA
aaacaccattaactaaag

SEQ ID NO: 59450 - DNA, 18 bp, Artificial Sequence
  Synthetic DNA
aaacacgacttactttcg

SEQ ID NO: 59451 - DNA, 18 bp, Artificial Sequence
  Synthetic DNA
aaacacgcctcgctaaag

SEQ ID NO: 59452 - DNA, 18 bp, Artificial Sequence
  Synthetic DNA
aaacacgtctcaccttag

SEQ ID NO: 59453 - DNA, 18 bp, Artificial Sequence
  Synthetic DNA
aaacacgtcttacaatag

SEQ ID NO: 59454 - DNA, 18 bp, Artificial Sequence
  Synthetic DNA
aaacataacccagcttcg

SEQ ID NO: 59455 - DNA, 18 bp, Artificial Sequence
  Synthetic DNA
aaacatgataaaccattg

SEQ ID NO: 59456 - DNA, 18 bp, Artificial Sequence
  Synthetic DNA
aaacccgactttctatag

SEQ ID NO: 59457 - DNA, 18 bp, Artificial Sequence
  Synthetic DNA
aaaccctacacagtatag

SEQ ID NO: 59458 - DNA, 18 bp, Artificial Sequence
  Synthetic DNA
aaacgcgactcactaagg

SEQ ID NO: 59459 - DNA, 18 bp, Artificial Sequence
  Synthetic DNA
aaacgcgacttcctaccg

SEQ ID NO: 59460 - DNA, 18 bp, Artificial Sequence
  Synthetic DNA
aaactcaactcaccatag

SEQ ID NO: 59461 - DNA, 18 bp, Artificial Sequence
  Synthetic DNA
aaactccacccccaatag

SEQ ID NO: 59462 - DNA, 18 bp, Artificial Sequence
  Synthetic DNA
aaactcgcgtcactatag

SEQ ID NO: 59463 - DNA, 18 bp, Artificial Sequence
  Synthetic DNA
aaagacgacacaccttag

SEQ ID NO: 59464 - DNA, 18 bp, Artificial Sequence
  Synthetic DNA
aaagacgtctcacctaag

SEQ ID NO: 59465 - DNA, 18 bp, Artificial Sequence
  Synthetic DNA
aaagacgtctcactgttg

SEQ ID NO: 59466 - DNA, 18 bp, Artificial Sequence
  Synthetic DNA
aaagatgtctcacttacg

SEQ ID NO: 59467 - DNA, 18 bp, Artificial Sequence
  Synthetic DNA
aaaggtgtctctctatag

SEQ ID NO: 59468 - DNA, 18 bp, Artificial Sequence
  Synthetic DNA
aaataaaacacactacag

SEQ ID NO: 59469 - DNA, 18 bp, Artificial Sequence
  Synthetic DNA
aaataaaattcaccatag

SEQ ID NO: 59470 - DNA, 18 bp, Artificial Sequence
  Synthetic DNA
aaataagaatatcattag

SEQ ID NO: 59471 - DNA, 18 bp, Artificial Sequence
  Synthetic DNA
aaataagaattactgtag

SEQ ID NO: 59472 - DNA, 18 bp, Artificial Sequence
  Synthetic DNA
aaataagacattctatag

SEQ ID NO: 59473 - DNA, 18 bp, Artificial Sequence
  Synthetic DNA
aaataagactcctaatag

SEQ ID NO: 59474 - DNA, 18 bp, Artificial Sequence
  Synthetic DNA
aaataagactgcccatcg

SEQ ID NO: 59475 - DNA, 18 bp, Artificial Sequence
  Synthetic DNA
aaataaggctctcaatag

SEQ ID NO: 59476 - DNA, 18 bp, Artificial Sequence
  Synthetic DNA
aaataagtctcaatttag

SEQ ID NO: 59477 - DNA, 18 bp, Artificial Sequence
  Synthetic DNA
aaataatacaaactatag

SEQ ID NO: 59478 - DNA, 18 bp, Artificial Sequence
  Synthetic DNA
aaataatattctctgtag

SEQ ID NO: 59479 - DNA, 18 bp, Artificial Sequence
  Synthetic DNA
aaataatcatcgcaattg

SEQ ID NO: 59480 - DNA, 18 bp, Artificial Sequence
  Synthetic DNA
aaataattcatactaaag

SEQ ID NO: 59481 - DNA, 18 bp, Artificial Sequence
  Synthetic DNA
aaatacaacatacactag

SEQ ID NO: 59482 - DNA, 18 bp, Artificial Sequence
  Synthetic DNA
aaatacaacccacttttg

SEQ ID NO: 59483 - DNA, 18 bp, Artificial Sequence
  Synthetic DNA
aaatacaactgacattgg

SEQ ID NO: 59484 - DNA, 18 bp, Artificial Sequence
  Synthetic DNA
aaatacaagtcaaaattg

SEQ ID NO: 59485 - DNA, 18 bp, Artificial Sequence
  Synthetic DNA
aaatacacttcacgaccg

SEQ ID NO: 59486 - DNA, 18 bp, Artificial Sequence
  Synthetic DNA
aaatacatcatactttag

SEQ ID NO: 59487 - DNA, 18 bp, Artificial Sequence
  Synthetic DNA
aaataccaattaatattg

SEQ ID NO: 59488 - DNA, 18 bp, Artificial Sequence
  Synthetic DNA
aaataccacattctatag

SEQ ID NO: 59489 - DNA, 18 bp, Artificial Sequence
  Synthetic DNA
aaataccactattaatag

SEQ ID NO: 59490 - DNA, 18 bp, Artificial Sequence
  Synthetic DNA
aaataccactctcaaaag

SEQ ID NO: 59491 - DNA, 18 bp, Artificial Sequence
  Synthetic DNA
aaatacctctcccaatag

SEQ ID NO: 59492 - DNA, 18 bp, Artificial Sequence
  Synthetic DNA
aaataccttaccatatag

SEQ ID NO: 59493 - DNA, 18 bp, Artificial Sequence
  Synthetic DNA
aaatacgaatcagtttgg

SEQ ID NO: 59494 - DNA, 18 bp, Artificial Sequence
  Synthetic DNA
aaatacgaatggttaaag

SEQ ID NO: 59495 - DNA, 18 bp, Artificial Sequence
  Synthetic DNA
aaatacgaattaccaaag

SEQ ID NO: 59496 - DNA, 18 bp, Artificial Sequence
  Synthetic DNA
aaatacgactatctaatg

SEQ ID NO: 59497 - DNA, 18 bp, Artificial Sequence
  Synthetic DNA
aaatacgactcaattctg

SEQ ID NO: 59498 - DNA, 18 bp, Artificial Sequence
  Synthetic DNA
aaatacgactctataatg

SEQ ID NO: 59499 - DNA, 18 bp, Artificial Sequence
  Synthetic DNA
aaatacgactctcaactg

SEQ ID NO: 59500 - DNA, 18 bp, Artificial Sequence
  Synthetic DNA
aaatacgactctctcatg

SEQ ID NO: 59501 - DNA, 18 bp, Artificial Sequence
  Synthetic DNA
aaatacgagtgaccttag

SEQ ID NO: 59502 - DNA, 18 bp, Artificial Sequence
  Synthetic DNA
aaatacgagtttcaatag

SEQ ID NO: 59503 - DNA, 18 bp, Artificial Sequence
  Synthetic DNA
aaatacgagtttgcatag

SEQ ID NO: 59504 - DNA, 18 bp, Artificial Sequence
  Synthetic DNA
aaatacgatttagactag

SEQ ID NO: 59505 - DNA, 18 bp, Artificial Sequence
  Synthetic DNA
aaatacgcctctttctcg

SEQ ID NO: 59506 - DNA, 18 bp, Artificial Sequence
  Synthetic DNA
aaatacgtcacacaaaag

SEQ ID NO: 59507 - DNA, 18 bp, Artificial Sequence
  Synthetic DNA
aaatacgtcacattatcg

SEQ ID NO: 59508 - DNA, 18 bp, Artificial Sequence
  Synthetic DNA
aaatacgtcactctgtag

SEQ ID NO: 59509 - DNA, 18 bp, Artificial Sequence
  Synthetic DNA
aaatacgtcactgtatag

SEQ ID NO: 59510 - DNA, 18 bp, Artificial Sequence
  Synthetic DNA
aaatacgtcatactctag

SEQ ID NO: 59511 - DNA, 18 bp, Artificial Sequence
  Synthetic DNA
aaatacgtctaaatttag

SEQ ID NO: 59512 - DNA, 18 bp, Artificial Sequence
  Synthetic DNA
aaatacgtctacaaaaag

SEQ ID NO: 59513 - DNA, 18 bp, Artificial Sequence
  Synthetic DNA
aaatacgtctatccatag

SEQ ID NO: 59514 - DNA, 18 bp, Artificial Sequence
  Synthetic DNA
aaatacgtctcccgctag

SEQ ID NO: 59515 - DNA, 18 bp, Artificial Sequence
  Synthetic DNA
aaatacgtctctataatg

SEQ ID NO: 59516 - DNA, 18 bp, Artificial Sequence
  Synthetic DNA
aaatacgtctctgtaatg

SEQ ID NO: 59517 - DNA, 18 bp, Artificial Sequence
  Synthetic DNA
aaatacgtgcaactatag

SEQ ID NO: 59518 - DNA, 18 bp, Artificial Sequence
  Synthetic DNA
aaatacgttttactttag

SEQ ID NO: 59519 - DNA, 18 bp, Artificial Sequence
  Synthetic DNA
aaatacgttttcctattg

SEQ ID NO: 59520 - DNA, 18 bp, Artificial Sequence
  Synthetic DNA
aaatactaaagacaatag

SEQ ID NO: 59521 - DNA, 18 bp, Artificial Sequence
  Synthetic DNA
aaatactacacattctag

SEQ ID NO: 59522 - DNA, 18 bp, Artificial Sequence
  Synthetic DNA
aaatactacactcaatag

SEQ ID NO: 59523 - DNA, 18 bp, Artificial Sequence
  Synthetic DNA
aaatactacatactatcg

SEQ ID NO: 59524 - DNA, 18 bp, Artificial Sequence
  Synthetic DNA
aaatactactaaatacag

SEQ ID NO: 59525 - DNA, 18 bp, Artificial Sequence
  Synthetic DNA
aaatactactcaacctag

SEQ ID NO: 59526 - DNA, 18 bp, Artificial Sequence
  Synthetic DNA
aaatactactcatcttag

SEQ ID NO: 59527 - DNA, 18 bp, Artificial Sequence
  Synthetic DNA
aaatactactccgtattg

SEQ ID NO: 59528 - DNA, 18 bp, Artificial Sequence
  Synthetic DNA
aaatactactctaagtag

SEQ ID NO: 59529 - DNA, 18 bp, Artificial Sequence
  Synthetic DNA
aaatactatgcgcaaacg

SEQ ID NO: 59530 - DNA, 18 bp, Artificial Sequence
  Synthetic DNA
aaatactatttacttctg

SEQ ID NO: 59531 - DNA, 18 bp, Artificial Sequence
  Synthetic DNA
aaatacttaacacttaag

SEQ ID NO: 59532 - DNA, 18 bp, Artificial Sequence
  Synthetic DNA
aaatacttctctcgaatg

SEQ ID NO: 59533 - DNA, 18 bp, Artificial Sequence
  Synthetic DNA
aaatacttctctctatcg

SEQ ID NO: 59534 - DNA, 18 bp, Artificial Sequence
  Synthetic DNA
aaataggactcaggtaag

SEQ ID NO: 59535 - DNA, 18 bp, Artificial Sequence
  Synthetic DNA
aaataggattcactttcg

SEQ ID NO: 59536 - DNA, 18 bp, Artificial Sequence
  Synthetic DNA
aaataggtctaattatag

SEQ ID NO: 59537 - DNA, 18 bp, Artificial Sequence
  Synthetic DNA
aaataggtctcaatttag

SEQ ID NO: 59538 - DNA, 18 bp, Artificial Sequence
  Synthetic DNA
aaataggtcttactccag

SEQ ID NO: 59539 - DNA, 18 bp, Artificial Sequence
  Synthetic DNA
aaatagtaatatctattg

SEQ ID NO: 59540 - DNA, 18 bp, Artificial Sequence
  Synthetic DNA
aaatagtacaatatttag

SEQ ID NO: 59541 - DNA, 18 bp, Artificial Sequence
  Synthetic DNA
aaatataactcactactg

SEQ ID NO: 59542 - DNA, 18 bp, Artificial Sequence
  Synthetic DNA
aaatatgacacatttttg

SEQ ID NO: 59543 - DNA, 18 bp, Artificial Sequence
  Synthetic DNA
aaatatgactctcaagcg

SEQ ID NO: 59544 - DNA, 18 bp, Artificial Sequence
  Synthetic DNA
aaatatgagtcacaaaag

SEQ ID NO: 59545 - DNA, 18 bp, Artificial Sequence
  Synthetic DNA
aaatatgccgtactctag

SEQ ID NO: 59546 - DNA, 18 bp, Artificial Sequence
  Synthetic DNA
aaatatggcttcctatag

SEQ ID NO: 59547 - DNA, 18 bp, Artificial Sequence
  Synthetic DNA
aaatatgtctaactttag

SEQ ID NO: 59548 - DNA, 18 bp, Artificial Sequence
  Synthetic DNA
aaatatgtcttgctgttg

SEQ ID NO: 59549 - DNA, 18 bp, Artificial Sequence
  Synthetic DNA
aaatattactctcactag

SEQ ID NO: 59550 - DNA, 18 bp, Artificial Sequence
  Synthetic DNA
aaatccaactcacttttg

SEQ ID NO: 59551 - DNA, 18 bp, Artificial Sequence
  Synthetic DNA
aaatccgtaacataatag

SEQ ID NO: 59552 - DNA, 18 bp, Artificial Sequence
  Synthetic DNA
aaatccgtcacactaaag

SEQ ID NO: 59553 - DNA, 18 bp, Artificial Sequence
  Synthetic DNA
aaatccgtctctctcgag

SEQ ID NO: 59554 - DNA, 18 bp, Artificial Sequence
  Synthetic DNA
aaatcctactctctttag

SEQ ID NO: 59555 - DNA, 18 bp, Artificial Sequence
  Synthetic DNA
aaatcctagacgatatag

SEQ ID NO: 59556 - DNA, 18 bp, Artificial Sequence
  Synthetic DNA
aaatcctatttactttag

SEQ ID NO: 59557 - DNA, 18 bp, Artificial Sequence
  Synthetic DNA
aaatctgtccaactattg

SEQ ID NO: 59558 - DNA, 18 bp, Artificial Sequence
  Synthetic DNA
aaatgagattcgctatag

SEQ ID NO: 59559 - DNA, 18 bp, Artificial Sequence
  Synthetic DNA
aaatgcgacaaacaattg

SEQ ID NO: 59560 - DNA, 18 bp, Artificial Sequence
  Synthetic DNA
aaatgcgactatctatgg

SEQ ID NO: 59561 - DNA, 18 bp, Artificial Sequence
  Synthetic DNA
aaatgcgactcataaaag

SEQ ID NO: 59562 - DNA, 18 bp, Artificial Sequence
  Synthetic DNA
aaatgcgactttataacg

SEQ ID NO: 59563 - DNA, 18 bp, Artificial Sequence
  Synthetic DNA
aaatgcgagattctaaag

SEQ ID NO: 59564 - DNA, 18 bp, Artificial Sequence
  Synthetic DNA
aaatgcgagtagctatag

SEQ ID NO: 59565 - DNA, 18 bp, Artificial Sequence
  Synthetic DNA
aaatgtaacttactaaag

SEQ ID NO: 59566 - DNA, 18 bp, Artificial Sequence
  Synthetic DNA
aaatgtgactcatcgtta

SEQ ID NO: 59567 - DNA, 18 bp, Artificial Sequence
  Synthetic DNA
aaatgtgtctcactatgg

SEQ ID NO: 59568 - DNA, 18 bp, Artificial Sequence
  Synthetic DNA
aaattaaaatggctattg

SEQ ID NO: 59569 - DNA, 18 bp, Artificial Sequence
  Synthetic DNA
aaattagtctcactctag

SEQ ID NO: 59570 - DNA, 18 bp, Artificial Sequence
  Synthetic DNA
aaattataatcactttag

SEQ ID NO: 59571 - DNA, 18 bp, Artificial Sequence
  Synthetic DNA
aaattatactcaccatag

SEQ ID NO: 59572 - DNA, 18 bp, Artificial Sequence
  Synthetic DNA
aaattatactcactttag

SEQ ID NO: 59573 - DNA, 18 bp, Artificial Sequence
  Synthetic DNA
aaattcaactaattatag

SEQ ID NO: 59574 - DNA, 18 bp, Artificial Sequence
  Synthetic DNA
aaattcaattctcattag

SEQ ID NO: 59575 - DNA, 18 bp, Artificial Sequence
  Synthetic DNA
aaattcatctctctatag

SEQ ID NO: 59576 - DNA, 18 bp, Artificial Sequence
  Synthetic DNA
aaattccactcgctactg

SEQ ID NO: 59577 - DNA, 18 bp, Artificial Sequence
  Synthetic DNA
aaattccactctccatag

SEQ ID NO: 59578 - DNA, 18 bp, Artificial Sequence
  Synthetic DNA
aaattcgacacaatgtag

SEQ ID NO: 59579 - DNA, 18 bp, Artificial Sequence
  Synthetic DNA
aaattcgaccctctttcg

SEQ ID NO: 59580 - DNA, 18 bp, Artificial Sequence
  Synthetic DNA
aaattcgacgcgctaaag

SEQ ID NO: 59581 - DNA, 18 bp, Artificial Sequence
  Synthetic DNA
aaattcgactcaaaagtg

SEQ ID NO: 59582 - DNA, 18 bp, Artificial Sequence
  Synthetic DNA
aaattcgactccctgaag

SEQ ID NO: 59583 - DNA, 18 bp, Artificial Sequence
  Synthetic DNA
aaattcgagtcacttttg

SEQ ID NO: 59584 - DNA, 18 bp, Artificial Sequence
  Synthetic DNA
aaattcgatacactttag

SEQ ID NO: 59585 - DNA, 18 bp, Artificial Sequence
  Synthetic DNA
aaattcggcactccatag

SEQ ID NO: 59586 - DNA, 18 bp, Artificial Sequence
  Synthetic DNA
aaattcggctcacaattg

SEQ ID NO: 59587 - DNA, 18 bp, Artificial Sequence
  Synthetic DNA
aaattctactcacaattg

SEQ ID NO: 59588 - DNA, 18 bp, Artificial Sequence
  Synthetic DNA
aaattggacacaccattg

SEQ ID NO: 59589 - DNA, 18 bp, Artificial Sequence
  Synthetic DNA
aaattggactcagcactg

SEQ ID NO: 59590 - DNA, 18 bp, Artificial Sequence
  Synthetic DNA
aaattggactcattatgg

SEQ ID NO: 59591 - DNA, 18 bp, Artificial Sequence
  Synthetic DNA
aaatttaactcacgactg

SEQ ID NO: 59592 - DNA, 18 bp, Artificial Sequence
  Synthetic DNA
aaatttgaccttctttag

SEQ ID NO: 59593 - DNA, 18 bp, Artificial Sequence
  Synthetic DNA
aaatttgactcacgttag

SEQ ID NO: 59594 - DNA, 18 bp, Artificial Sequence
  Synthetic DNA
aacaaagatttactattg

SEQ ID NO: 59595 - DNA, 18 bp, Artificial Sequence
  Synthetic DNA
aacaaagtttcactatag

SEQ ID NO: 59596 - DNA, 18 bp, Artificial Sequence
  Synthetic DNA
aacaactactcaccccag

SEQ ID NO: 59597 - DNA, 18 bp, Artificial Sequence
  Synthetic DNA
aacaatgactcaatatag

SEQ ID NO: 59598 - DNA, 18 bp, Artificial Sequence
  Synthetic DNA
aacattgattcgttatag

SEQ ID NO: 59599 - DNA, 18 bp, Artificial Sequence
  Synthetic DNA
aaccactactaagtgtag

SEQ ID NO: 59600 - DNA, 18 bp, Artificial Sequence
  Synthetic DNA
aactaagtttctttctag

SEQ ID NO: 59601 - DNA, 18 bp, Artificial Sequence
  Synthetic DNA
aactacgaaacactatgg

SEQ ID NO: 59602 - DNA, 18 bp, Artificial Sequence
  Synthetic DNA
aactacgaatcacaaatg

SEQ ID NO: 59603 - DNA, 18 bp, Artificial Sequence
  Synthetic DNA
aactacgaattatcattg

SEQ ID NO: 59604 - DNA, 18 bp, Artificial Sequence
  Synthetic DNA
aactacgactttctctag

SEQ ID NO: 59605 - DNA, 18 bp, Artificial Sequence
  Synthetic DNA
aactaggagtgtatatag

SEQ ID NO: 59606 - DNA, 18 bp, Artificial Sequence
  Synthetic DNA
aactatgtctaactatcg

SEQ ID NO: 59607 - DNA, 18 bp, Artificial Sequence
  Synthetic DNA
aacttaaactcactaatg

SEQ ID NO: 59608 - DNA, 18 bp, Artificial Sequence
  Synthetic DNA
aacttcaacttactttgg

SEQ ID NO: 59609 - DNA, 18 bp, Artificial Sequence
  Synthetic DNA
aacttcgacttattatag

SEQ ID NO: 59610 - DNA, 18 bp, Artificial Sequence
  Synthetic DNA
aacttcgtctttccattg

SEQ ID NO: 59611 - DNA, 18 bp, Artificial Sequence
  Synthetic DNA
aacttcttctcactaggg

SEQ ID NO: 59612 - DNA, 18 bp, Artificial Sequence
  Synthetic DNA
aagaacgaataactatag

SEQ ID NO: 59613 - DNA, 18 bp, Artificial Sequence
  Synthetic DNA
aagaatgaaacaccatag

SEQ ID NO: 59614 - DNA, 18 bp, Artificial Sequence
  Synthetic DNA
aagagcgccttactcttg

SEQ ID NO: 59615 - DNA, 18 bp, Artificial Sequence
  Synthetic DNA
aagcacgcctcgcgtatg

SEQ ID NO: 59616 - DNA, 18 bp, Artificial Sequence
  Synthetic DNA
aaggacgactcccaattg

SEQ ID NO: 59617 - DNA, 18 bp, Artificial Sequence
  Synthetic DNA
aagtaaggctcactattg

SEQ ID NO: 59618 - DNA, 18 bp, Artificial Sequence
  Synthetic DNA
aagtacaacactctatag

SEQ ID NO: 59619 - DNA, 18 bp, Artificial Sequence
  Synthetic DNA
aagtacttctctagtcgg

SEQ ID NO: 59620 - DNA, 18 bp, Artificial Sequence
  Synthetic DNA
aagtccgtttctctatag

SEQ ID NO: 59621 - DNA, 18 bp, Artificial Sequence
  Synthetic DNA
aagtgcggtgcagttcag

SEQ ID NO: 59622 - DNA, 18 bp, Artificial Sequence
  Synthetic DNA
aagttcctctctttgttg

SEQ ID NO: 59623 - DNA, 18 bp, Artificial Sequence
  Synthetic DNA
aagttcgaccctctattg

SEQ ID NO: 59624 - DNA, 18 bp, Artificial Sequence
  Synthetic DNA
aagttctactctctacag

SEQ ID NO: 59625 - DNA, 18 bp, Artificial Sequence
  Synthetic DNA
aataaacacaaactttag

SEQ ID NO: 59626 - DNA, 18 bp, Artificial Sequence
  Synthetic DNA
aataaatactcactatag

SEQ ID NO: 59627 - DNA, 18 bp, Artificial Sequence
  Synthetic DNA
aataacgactctccatag

SEQ ID NO: 59628 - DNA, 18 bp, Artificial Sequence
  Synthetic DNA
aataacgattcactttcg

SEQ ID NO: 59629 - DNA, 18 bp, Artificial Sequence
  Synthetic DNA
aataactactcactaaag

SEQ ID NO: 59630 - DNA, 18 bp, Artificial Sequence
  Synthetic DNA
aatagcgtttcattatgg

SEQ ID NO: 59631 - DNA, 18 bp, Artificial Sequence
  Synthetic DNA
aatcacgactccctaatg

SEQ ID NO: 59632 - DNA, 18 bp, Artificial Sequence
  Synthetic DNA
aatcacgattccctatag

SEQ ID NO: 59633 - DNA, 18 bp, Artificial Sequence
  Synthetic DNA
aatcacgcctcacattag

SEQ ID NO: 59634 - DNA, 18 bp, Artificial Sequence
  Synthetic DNA
aatcacttctaactatag

SEQ ID NO: 59635 - DNA, 18 bp, Artificial Sequence
  Synthetic DNA
aatgaagagtcactatag

SEQ ID NO: 59636 - DNA, 18 bp, Artificial Sequence
  Synthetic DNA
aatgacgacacaccatag

SEQ ID NO: 59637 - DNA, 18 bp, Artificial Sequence
  Synthetic DNA
aattaagacttactagag

SEQ ID NO: 59638 - DNA, 18 bp, Artificial Sequence
  Synthetic DNA
aattaagagtctatacag

SEQ ID NO: 59639 - DNA, 18 bp, Artificial Sequence
  Synthetic DNA
aattaatactacctaagg

SEQ ID NO: 59640 - DNA, 18 bp, Artificial Sequence
  Synthetic DNA
aattacaacacaaaaaag

SEQ ID NO: 59641 - DNA, 18 bp, Artificial Sequence
  Synthetic DNA
aattacaacacactctag

SEQ ID NO: 59642 - DNA, 18 bp, Artificial Sequence
  Synthetic DNA
aattacagcacacaaaag

SEQ ID NO: 59643 - DNA, 18 bp, Artificial Sequence
  Synthetic DNA
aattacagctctcaatag

SEQ ID NO: 59644 - DNA, 18 bp, Artificial Sequence
  Synthetic DNA
aattacatcttttaattg

SEQ ID NO: 59645 - DNA, 18 bp, Artificial Sequence
  Synthetic DNA
aattaccactgactaatg

SEQ ID NO: 59646 - DNA, 18 bp, Artificial Sequence
  Synthetic DNA
aattacgaatcactcaag

SEQ ID NO: 59647 - DNA, 18 bp, Artificial Sequence
  Synthetic DNA
aattacgaattactttag

SEQ ID NO: 59648 - DNA, 18 bp, Artificial Sequence
  Synthetic DNA
aattacgacatacattcg

SEQ ID NO: 59649 - DNA, 18 bp, Artificial Sequence
  Synthetic DNA
aattacgacgctatatag

SEQ ID NO: 59650 - DNA, 18 bp, Artificial Sequence
  Synthetic DNA
aattacgactaataacag

SEQ ID NO: 59651 - DNA, 18 bp, Artificial Sequence
  Synthetic DNA
aattacgatttaatttag

SEQ ID NO: 59652 - DNA, 18 bp, Artificial Sequence
  Synthetic DNA
aattacgattttctttag

SEQ ID NO: 59653 - DNA, 18 bp, Artificial Sequence
  Synthetic DNA
aattacgccacacaacag

SEQ ID NO: 59654 - DNA, 18 bp, Artificial Sequence
  Synthetic DNA
aattactaaaaagtgcag

SEQ ID NO: 59655 - DNA, 18 bp, Artificial Sequence
  Synthetic DNA
aattactacacacaatag

SEQ ID NO: 59656 - DNA, 18 bp, Artificial Sequence
  Synthetic DNA
aattactccttactatag

SEQ ID NO: 59657 - DNA, 18 bp, Artificial Sequence
  Synthetic DNA
aattacttatcactatag

SEQ ID NO: 59658 - DNA, 18 bp, Artificial Sequence
  Synthetic DNA
aattagaacacacaatag

SEQ ID NO: 59659 - DNA, 18 bp, Artificial Sequence
  Synthetic DNA
aattaggactttctactg

SEQ ID NO: 59660 - DNA, 18 bp, Artificial Sequence
  Synthetic DNA
aattaggcatttatgcag

SEQ ID NO: 59661 - DNA, 18 bp, Artificial Sequence
  Synthetic DNA
aattaggcctctctatag

SEQ ID NO: 59662 - DNA, 18 bp, Artificial Sequence
  Synthetic DNA
aattataactcggaaaag

SEQ ID NO: 59663 - DNA, 18 bp, Artificial Sequence
  Synthetic DNA
aattatgacacactattg

SEQ ID NO: 59664 - DNA, 18 bp, Artificial Sequence
  Synthetic DNA
aattatgcctcagtaaag

SEQ ID NO: 59665 - DNA, 18 bp, Artificial Sequence
  Synthetic DNA
aattatgtatcactattg

SEQ ID NO: 59666 - DNA, 18 bp, Artificial Sequence
  Synthetic DNA
aattattaatcagtatag

SEQ ID NO: 59667 - DNA, 18 bp, Artificial Sequence
  Synthetic DNA
aattattactcactattg

SEQ ID NO: 59668 - DNA, 18 bp, Artificial Sequence
  Synthetic DNA
aattattgcttacttttg

SEQ ID NO: 59669 - DNA, 18 bp, Artificial Sequence
  Synthetic DNA
aattccaacgcacataag

SEQ ID NO: 59670 - DNA, 18 bp, Artificial Sequence
  Synthetic DNA
aattcccacttattacag

SEQ ID NO: 59671 - DNA, 18 bp, Artificial Sequence
  Synthetic DNA
aattccgactaactaaag

SEQ ID NO: 59672 - DNA, 18 bp, Artificial Sequence
  Synthetic DNA
aattccgactccccatag

SEQ ID NO: 59673 - DNA, 18 bp, Artificial Sequence
  Synthetic DNA
aattccgactggaaaatg

SEQ ID NO: 59674 - DNA, 18 bp, Artificial Sequence
  Synthetic DNA
aattgagtctaactatag

SEQ ID NO: 59675 - DNA, 18 bp, Artificial Sequence
  Synthetic DNA
aattgctaatcgctaacg

SEQ ID NO: 59676 - DNA, 18 bp, Artificial Sequence
  Synthetic DNA
aattgtaactcagtgtag

SEQ ID NO: 59677 - DNA, 18 bp, Artificial Sequence
  Synthetic DNA
aatttagaccccctttag

SEQ ID NO: 59678 - DNA, 18 bp, Artificial Sequence
  Synthetic DNA
aatttagtcacactatag

SEQ ID NO: 59679 - DNA, 18 bp, Artificial Sequence
  Synthetic DNA
aatttcatctcccttaag

SEQ ID NO: 59680 - DNA, 18 bp, Artificial Sequence
  Synthetic DNA
aatttccacacaccatag

SEQ ID NO: 59681 - DNA, 18 bp, Artificial Sequence
  Synthetic DNA
aatttccattagctattg

SEQ ID NO: 59682 - DNA, 18 bp, Artificial Sequence
  Synthetic DNA
aatttcgaatctcaatcg

SEQ ID NO: 59683 - DNA, 18 bp, Artificial Sequence
  Synthetic DNA
aatttcgactcaatacag

SEQ ID NO: 59684 - DNA, 18 bp, Artificial Sequence
  Synthetic DNA
aatttcgattgacataag

SEQ ID NO: 59685 - DNA, 18 bp, Artificial Sequence
  Synthetic DNA
aatttcgtcacacaaaag

SEQ ID NO: 59686 - DNA, 18 bp, Artificial Sequence
  Synthetic DNA
aattttgaaatattaaag

SEQ ID NO: 59687 - DNA, 18 bp, Artificial Sequence
  Synthetic DNA
aattttgactcaacatag

SEQ ID NO: 59688 - DNA, 18 bp, Artificial Sequence
  Synthetic DNA
acaaacgactatctatag

SEQ ID NO: 59689 - DNA, 18 bp, Artificial Sequence
  Synthetic DNA
acaaacgactcaaatttg

SEQ ID NO: 59690 - DNA, 18 bp, Artificial Sequence
  Synthetic DNA
acaaaggtctcactttag

SEQ ID NO: 59691 - DNA, 18 bp, Artificial Sequence
  Synthetic DNA
acaatcaactcacaatag

SEQ ID NO: 59692 - DNA, 18 bp, Artificial Sequence
  Synthetic DNA
acaattcactcactcgag

SEQ ID NO: 59693 - DNA, 18 bp, Artificial Sequence
  Synthetic DNA
acacacgacacactgtag

SEQ ID NO: 59694 - DNA, 18 bp, Artificial Sequence
  Synthetic DNA
acacacgactctttattg

SEQ ID NO: 59695 - DNA, 18 bp, Artificial Sequence
  Synthetic DNA
acagacgtctatctatag

SEQ ID NO: 59696 - DNA, 18 bp, Artificial Sequence
  Synthetic DNA
acataattcacactaaag

SEQ ID NO: 59697 - DNA, 18 bp, Artificial Sequence
  Synthetic DNA
acatacatgtcactattg

SEQ ID NO: 59698 - DNA, 18 bp, Artificial Sequence
  Synthetic DNA
acataccactcagtctag

SEQ ID NO: 59699 - DNA, 18 bp, Artificial Sequence
  Synthetic DNA
acatacgaattattatcg

SEQ ID NO: 59700 - DNA, 18 bp, Artificial Sequence
  Synthetic DNA
acatacgactccaacaag

SEQ ID NO: 59701 - DNA, 18 bp, Artificial Sequence
  Synthetic DNA
acatacgacttacaatcg

SEQ ID NO: 59702 - DNA, 18 bp, Artificial Sequence
  Synthetic DNA
acatacgcctcatttttg

SEQ ID NO: 59703 - DNA, 18 bp, Artificial Sequence
  Synthetic DNA
acatacggcccattagag

SEQ ID NO: 59704 - DNA, 18 bp, Artificial Sequence
  Synthetic DNA
acatacgtcacacaatag

SEQ ID NO: 59705 - DNA, 18 bp, Artificial Sequence
  Synthetic DNA
acatacttcgcactacag

SEQ ID NO: 59706 - DNA, 18 bp, Artificial Sequence
  Synthetic DNA
acatatgccccattatag

SEQ ID NO: 59707 - DNA, 18 bp, Artificial Sequence
  Synthetic DNA
acatatgtttcaataaag

SEQ ID NO: 59708 - DNA, 18 bp, Artificial Sequence
  Synthetic DNA
acattaatctcactatag

SEQ ID NO: 59709 - DNA, 18 bp, Artificial Sequence
  Synthetic DNA
acattcaatacgcattag

SEQ ID NO: 59710 - DNA, 18 bp, Artificial Sequence
  Synthetic DNA
acattcgactctaaaaag

SEQ ID NO: 59711 - DNA, 18 bp, Artificial Sequence
  Synthetic DNA
acattcgattcattattg

SEQ ID NO: 59712 - DNA, 18 bp, Artificial Sequence
  Synthetic DNA
acattgttgtcactatag

SEQ ID NO: 59713 - DNA, 18 bp, Artificial Sequence
  Synthetic DNA
acattttactcactatag

SEQ ID NO: 59714 - DNA, 18 bp, Artificial Sequence
  Synthetic DNA
accaacaactcaatttag

SEQ ID NO: 59715 - DNA, 18 bp, Artificial Sequence
  Synthetic DNA
accgacgactgattatag

SEQ ID NO: 59716 - DNA, 18 bp, Artificial Sequence
  Synthetic DNA
acctacgactatctacag

SEQ ID NO: 59717 - DNA, 18 bp, Artificial Sequence
  Synthetic DNA
acctgcgactcagtatag

SEQ ID NO: 59718 - DNA, 18 bp, Artificial Sequence
  Synthetic DNA
accttaggctctctaaag

SEQ ID NO: 59719 - DNA, 18 bp, Artificial Sequence
  Synthetic DNA
acgtacgactcacaattg

SEQ ID NO: 59720 - DNA, 18 bp, Artificial Sequence
  Synthetic DNA
actaaagactcactttag

SEQ ID NO: 59721 - DNA, 18 bp, Artificial Sequence
  Synthetic DNA
actcacgactcaataaag

SEQ ID NO: 59722 - DNA, 18 bp, Artificial Sequence
  Synthetic DNA
acttaccgctctctatag

SEQ ID NO: 59723 - DNA, 18 bp, Artificial Sequence
  Synthetic DNA
acttacgactctctatcg

SEQ ID NO: 59724 - DNA, 18 bp, Artificial Sequence
  Synthetic DNA
acttacttctcactatag

SEQ ID NO: 59725 - DNA, 18 bp, Artificial Sequence
  Synthetic DNA
agaaacgaattacaacag

SEQ ID NO: 59726 - DNA, 18 bp, Artificial Sequence
  Synthetic DNA
agaatcgactcgaatcag

SEQ ID NO: 59727 - DNA, 18 bp, Artificial Sequence
  Synthetic DNA
agataagactcactactg

SEQ ID NO: 59728 - DNA, 18 bp, Artificial Sequence
  Synthetic DNA
agatacaactaactaaag

SEQ ID NO: 59729 - DNA, 18 bp, Artificial Sequence
  Synthetic DNA
agatacgacacattaaag

SEQ ID NO: 59730 - DNA, 18 bp, Artificial Sequence
  Synthetic DNA
agatacgattaccaatcg

SEQ ID NO: 59731 - DNA, 18 bp, Artificial Sequence
  Synthetic DNA
agatacggatcgctttgg

SEQ ID NO: 59732 - DNA, 18 bp, Artificial Sequence
  Synthetic DNA
agatacgtcggtcattag

SEQ ID NO: 59733 - DNA, 18 bp, Artificial Sequence
  Synthetic DNA
agatacgtctctctgctg

SEQ ID NO: 59734 - DNA, 18 bp, Artificial Sequence
  Synthetic DNA
agatagaactcacaagag

SEQ ID NO: 59735 - DNA, 18 bp, Artificial Sequence
  Synthetic DNA
agatatgtatcactgatg

SEQ ID NO: 59736 - DNA, 18 bp, Artificial Sequence
  Synthetic DNA
agatccgactcacactag

SEQ ID NO: 59737 - DNA, 18 bp, Artificial Sequence
  Synthetic DNA
agatgagacttactatgg

SEQ ID NO: 59738 - DNA, 18 bp, Artificial Sequence
  Synthetic DNA
agattcaactcattctcg

SEQ ID NO: 59739 - DNA, 18 bp, Artificial Sequence
  Synthetic DNA
agattccattcactctcg

SEQ ID NO: 59740 - DNA, 18 bp, Artificial Sequence
  Synthetic DNA
agctactcctcactattg

SEQ ID NO: 59741 - DNA, 18 bp, Artificial Sequence
  Synthetic DNA
agttacgtctcacattcg

SEQ ID NO: 59742 - DNA, 18 bp, Artificial Sequence
  Synthetic DNA
agttatgacacactatag

SEQ ID NO: 59743 - DNA, 18 bp, Artificial Sequence
  Synthetic DNA
agtttcgtctcactatag

SEQ ID NO: 59744 - DNA, 18 bp, Artificial Sequence
  Synthetic DNA
ataaacaactcaccactg

SEQ ID NO: 59745 - DNA, 18 bp, Artificial Sequence
  Synthetic DNA
ataaaccacttcctatag

SEQ ID NO: 59746 - DNA, 18 bp, Artificial Sequence
  Synthetic DNA
ataaacgacacgctatag

SEQ ID NO: 59747 - DNA, 18 bp, Artificial Sequence
  Synthetic DNA
ataaacgtcacacttttg

SEQ ID NO: 59748 - DNA, 18 bp, Artificial Sequence
  Synthetic DNA
ataaactaatctctgtag

SEQ ID NO: 59749 - DNA, 18 bp, Artificial Sequence
  Synthetic DNA
ataaaggactctctatag

SEQ ID NO: 59750 - DNA, 18 bp, Artificial Sequence
  Synthetic DNA
ataaaggccacactatag

SEQ ID NO: 59751 - DNA, 18 bp, Artificial Sequence
  Synthetic DNA
ataaatgtatcacaatag

SEQ ID NO: 59752 - DNA, 18 bp, Artificial Sequence
  Synthetic DNA
ataatcgactcactaaag

SEQ ID NO: 59753 - DNA, 18 bp, Artificial Sequence
  Synthetic DNA
ataatcgactccccatag

SEQ ID NO: 59754 - DNA, 18 bp, Artificial Sequence
  Synthetic DNA
atacacgactcattgttg

SEQ ID NO: 59755 - DNA, 18 bp, Artificial Sequence
  Synthetic DNA
atacataagtcactatag

SEQ ID NO: 59756 - DNA, 18 bp, Artificial Sequence
  Synthetic DNA
atacatgactcagtaaag

SEQ ID NO: 59757 - DNA, 18 bp, Artificial Sequence
  Synthetic DNA
atactcgactcacaatag

SEQ ID NO: 59758 - DNA, 18 bp, Artificial Sequence
  Synthetic DNA
ataggggacttactatag

SEQ ID NO: 59759 - DNA, 18 bp, Artificial Sequence
  Synthetic DNA
atataaatctccctattg

SEQ ID NO: 59760 - DNA, 18 bp, Artificial Sequence
  Synthetic DNA
atataacactctttatag

SEQ ID NO: 59761 - DNA, 18 bp, Artificial Sequence
  Synthetic DNA
atataatattatctttag

SEQ ID NO: 59762 - DNA, 18 bp, Artificial Sequence
  Synthetic DNA
atatacaacacactaaag

SEQ ID NO: 59763 - DNA, 18 bp, Artificial Sequence
  Synthetic DNA
atatacaactcagtaaag

SEQ ID NO: 59764 - DNA, 18 bp, Artificial Sequence
  Synthetic DNA
atatacaattcaccagag

SEQ ID NO: 59765 - DNA, 18 bp, Artificial Sequence
  Synthetic DNA
atatacaccacattattg

SEQ ID NO: 59766 - DNA, 18 bp, Artificial Sequence
  Synthetic DNA
atatacagctcgccatag

SEQ ID NO: 59767 - DNA, 18 bp, Artificial Sequence
  Synthetic DNA
atatacatctccctatag

SEQ ID NO: 59768 - DNA, 18 bp, Artificial Sequence
  Synthetic DNA
atataccgtactcattag

SEQ ID NO: 59769 - DNA, 18 bp, Artificial Sequence
  Synthetic DNA
atatacgaatctgtatag

SEQ ID NO: 59770 - DNA, 18 bp, Artificial Sequence
  Synthetic DNA
atatacgaccctttatag

SEQ ID NO: 59771 - DNA, 18 bp, Artificial Sequence
  Synthetic DNA
atatacgactctcgaaag

SEQ ID NO: 59772 - DNA, 18 bp, Artificial Sequence
  Synthetic DNA
atatacgatacgcaactg

SEQ ID NO: 59773 - DNA, 18 bp, Artificial Sequence
  Synthetic DNA
atatacgattcactctta

SEQ ID NO: 59774 - DNA, 18 bp, Artificial Sequence
  Synthetic DNA
atatacgattctctcttg

SEQ ID NO: 59775 - DNA, 18 bp, Artificial Sequence
  Synthetic DNA
atatacgcaccacagttg

SEQ ID NO: 59776 - DNA, 18 bp, Artificial Sequence
  Synthetic DNA
atatacgcctcactaatg

SEQ ID NO: 59777 - DNA, 18 bp, Artificial Sequence
  Synthetic DNA
atatacgccttattatag

SEQ ID NO: 59778 - DNA, 18 bp, Artificial Sequence
  Synthetic DNA
atatacggcaaactatag

SEQ ID NO: 59779 - DNA, 18 bp, Artificial Sequence
  Synthetic DNA
atatacgtcatactatcg

SEQ ID NO: 59780 - DNA, 18 bp, Artificial Sequence
  Synthetic DNA
atatacgtctgactaaag

SEQ ID NO: 59781 - DNA, 18 bp, Artificial Sequence
  Synthetic DNA
atatactagtcaccatag

SEQ ID NO: 59782 - DNA, 18 bp, Artificial Sequence
  Synthetic DNA
atatactattctcttaag

SEQ ID NO: 59783 - DNA, 18 bp, Artificial Sequence
  Synthetic DNA
atatagatcactatatag

SEQ ID NO: 59784 - DNA, 18 bp, Artificial Sequence
  Synthetic DNA
atatagcatccacaaaag

SEQ ID NO: 59785 - DNA, 18 bp, Artificial Sequence
  Synthetic DNA
atatagggctcactattg

SEQ ID NO: 59786 - DNA, 18 bp, Artificial Sequence
  Synthetic DNA
atatataagtcattatcg

SEQ ID NO: 59787 - DNA, 18 bp, Artificial Sequence
  Synthetic DNA
atatatgaaactcgctag

SEQ ID NO: 59788 - DNA, 18 bp, Artificial Sequence
  Synthetic DNA
atatatgaaactctcttg

SEQ ID NO: 59789 - DNA, 18 bp, Artificial Sequence
  Synthetic DNA
atatatgacaccgtttag

SEQ ID NO: 59790 - DNA, 18 bp, Artificial Sequence
  Synthetic DNA
atatatgactgattatag

SEQ ID NO: 59791 - DNA, 18 bp, Artificial Sequence
  Synthetic DNA
atatatgatttagtatag

SEQ ID NO: 59792 - DNA, 18 bp, Artificial Sequence
  Synthetic DNA
atatatgtctaaatatag

SEQ ID NO: 59793 - DNA, 18 bp, Artificial Sequence
  Synthetic DNA
atatattactgacaaaag

SEQ ID NO: 59794 - DNA, 18 bp, Artificial Sequence
  Synthetic DNA
atatcagacacacattag

SEQ ID NO: 59795 - DNA, 18 bp, Artificial Sequence
  Synthetic DNA
atatcagcctttcataag

SEQ ID NO: 59796 - DNA, 18 bp, Artificial Sequence
  Synthetic DNA
atatcatactcacaaaag

SEQ ID NO: 59797 - DNA, 18 bp, Artificial Sequence
  Synthetic DNA
atatccgacacatcatag

SEQ ID NO: 59798 - DNA, 18 bp, Artificial Sequence
  Synthetic DNA
atatccgactcaatttcg

SEQ ID NO: 59799 - DNA, 18 bp, Artificial Sequence
  Synthetic DNA
atatgcaactcaattaag

SEQ ID NO: 59800 - DNA, 18 bp, Artificial Sequence
  Synthetic DNA
atatgccacgcactgaag

SEQ ID NO: 59801 - DNA, 18 bp, Artificial Sequence
  Synthetic DNA
atatgcgacccactatgg

SEQ ID NO: 59802 - DNA, 18 bp, Artificial Sequence
  Synthetic DNA
atatgcgactcacgttag

SEQ ID NO: 59803 - DNA, 18 bp, Artificial Sequence
  Synthetic DNA
atatgcgattcactctag

SEQ ID NO: 59804 - DNA, 18 bp, Artificial Sequence
  Synthetic DNA
atatgctacacactctag

SEQ ID NO: 59805 - DNA, 18 bp, Artificial Sequence
  Synthetic DNA
atattcaactcaccaatg

SEQ ID NO: 59806 - DNA, 18 bp, Artificial Sequence
  Synthetic DNA
atattcgactcataatag

SEQ ID NO: 59807 - DNA, 18 bp, Artificial Sequence
  Synthetic DNA
atattcgaggcactatag

SEQ ID NO: 59808 - DNA, 18 bp, Artificial Sequence
  Synthetic DNA
atattcgatcccatacag

SEQ ID NO: 59809 - DNA, 18 bp, Artificial Sequence
  Synthetic DNA
atatttcgctcactatag

SEQ ID NO: 59810 - DNA, 18 bp, Artificial Sequence
  Synthetic DNA
atatttgacatactcgag

SEQ ID NO: 59811 - DNA, 18 bp, Artificial Sequence
  Synthetic DNA
atatttgactcgcttaag

SEQ ID NO: 59812 - DNA, 18 bp, Artificial Sequence
  Synthetic DNA
atccacgtctcactaaag

SEQ ID NO: 59813 - DNA, 18 bp, Artificial Sequence
  Synthetic DNA
atccatgtcacactatag

SEQ ID NO: 59814 - DNA, 18 bp, Artificial Sequence
  Synthetic DNA
atcctctacccactattg

SEQ ID NO: 59815 - DNA, 18 bp, Artificial Sequence
  Synthetic DNA
atctacaactcacacaag

SEQ ID NO: 59816 - DNA, 18 bp, Artificial Sequence
  Synthetic DNA
atctaccactttatttag

SEQ ID NO: 59817 - DNA, 18 bp, Artificial Sequence
  Synthetic DNA
atctacgtaactctttag

SEQ ID NO: 59818 - DNA, 18 bp, Artificial Sequence
  Synthetic DNA
atctactgaactctttag

SEQ ID NO: 59819 - DNA, 18 bp, Artificial Sequence
  Synthetic DNA
atctgtgtccgaatattg

SEQ ID NO: 59820 - DNA, 18 bp, Artificial Sequence
  Synthetic DNA
atgctcgactcagtatgg

SEQ ID NO: 59821 - DNA, 18 bp, Artificial Sequence
  Synthetic DNA
atgtaagactctctatag

SEQ ID NO: 59822 - DNA, 18 bp, Artificial Sequence
  Synthetic DNA
atgtaagtctcacaatag

SEQ ID NO: 59823 - DNA, 18 bp, Artificial Sequence
  Synthetic DNA
atgtacgagtcattgtag

SEQ ID NO: 59824 - DNA, 18 bp, Artificial Sequence
  Synthetic DNA
atgtacgcctcactttag

SEQ ID NO: 59825 - DNA, 18 bp, Artificial Sequence
  Synthetic DNA
atgtacttcctattattg

SEQ ID NO: 59826 - DNA, 18 bp, Artificial Sequence
  Synthetic DNA
atgtatgtatcacaatag

SEQ ID NO: 59827 - DNA, 18 bp, Artificial Sequence
  Synthetic DNA
atgtgagtttcactatag

SEQ ID NO: 59828 - DNA, 18 bp, Artificial Sequence
  Synthetic DNA
atgttcgactctctttag

SEQ ID NO: 59829 - DNA, 18 bp, Artificial Sequence
  Synthetic DNA
attaacgaatcactattg

SEQ ID NO: 59830 - DNA, 18 bp, Artificial Sequence
  Synthetic DNA
attaacgacacactatgg

SEQ ID NO: 59831 - DNA, 18 bp, Artificial Sequence
  Synthetic DNA
attaacgacactctaatg

SEQ ID NO: 59832 - DNA, 18 bp, Artificial Sequence
  Synthetic DNA
attaactactcactattg

SEQ ID NO: 59833 - DNA, 18 bp, Artificial Sequence
  Synthetic DNA
attcgcgagtctgtaaag

SEQ ID NO: 59834 - DNA, 18 bp, Artificial Sequence
  Synthetic DNA
attgacgactctctatag

SEQ ID NO: 59835 - DNA, 18 bp, Artificial Sequence
  Synthetic DNA
atttaaaacactctaaag

SEQ ID NO: 59836 - DNA, 18 bp, Artificial Sequence
  Synthetic DNA
atttaagtctcactatag

SEQ ID NO: 59837 - DNA, 18 bp, Artificial Sequence
  Synthetic DNA
atttacatcttactatag

SEQ ID NO: 59838 - DNA, 18 bp, Artificial Sequence
  Synthetic DNA
atttaccactcagtatag

SEQ ID NO: 59839 - DNA, 18 bp, Artificial Sequence
  Synthetic DNA
atttacgacgcactattg

SEQ ID NO: 59840 - DNA, 18 bp, Artificial Sequence
  Synthetic DNA
atttacgatacattatcg

SEQ ID NO: 59841 - DNA, 18 bp, Artificial Sequence
  Synthetic DNA
atttacgttcgactatag

SEQ ID NO: 59842 - DNA, 18 bp, Artificial Sequence
  Synthetic DNA
atttactactctctatag

SEQ ID NO: 59843 - DNA, 18 bp, Artificial Sequence
  Synthetic DNA
atttactactctctattg

SEQ ID NO: 59844 - DNA, 18 bp, Artificial Sequence
  Synthetic DNA
atttagcactcaatttag

SEQ ID NO: 59845 - DNA, 18 bp, Artificial Sequence
  Synthetic DNA
atttatcacacgttatag

SEQ ID NO: 59846 - DNA, 18 bp, Artificial Sequence
  Synthetic DNA
atttatgacccattatag

SEQ ID NO: 59847 - DNA, 18 bp, Artificial Sequence
  Synthetic DNA
attttagatttgctctag

SEQ ID NO: 59848 - DNA, 18 bp, Artificial Sequence
  Synthetic DNA
attttcgccccactattg

SEQ ID NO: 59849 - DNA, 18 bp, Artificial Sequence
  Synthetic DNA
caaaacatctctccatag

SEQ ID NO: 59850 - DNA, 18 bp, Artificial Sequence
  Synthetic DNA
caaaacgactctccatcg

SEQ ID NO: 59851 - DNA, 18 bp, Artificial Sequence
  Synthetic DNA
caaaacgacttatcaaag

SEQ ID NO: 59852 - DNA, 18 bp, Artificial Sequence
  Synthetic DNA
caaaacgagtttctatag

SEQ ID NO: 59853 - DNA, 18 bp, Artificial Sequence
  Synthetic DNA
caaaacggctcaatacgg

SEQ ID NO: 59854 - DNA, 18 bp, Artificial Sequence
  Synthetic DNA
caaaacgtctcacacttg

SEQ ID NO: 59855 - DNA, 18 bp, Artificial Sequence
  Synthetic DNA
caaaactactgactttag

SEQ ID NO: 59856 - DNA, 18 bp, Artificial Sequence
  Synthetic DNA
caaacagtttcactattg

SEQ ID NO: 59857 - DNA, 18 bp, Artificial Sequence
  Synthetic DNA
caaactgtctcactatcg

SEQ ID NO: 59858 - DNA, 18 bp, Artificial Sequence
  Synthetic DNA
caaagcgactaactattg

SEQ ID NO: 59859 - DNA, 18 bp, Artificial Sequence
  Synthetic DNA
caaagcggcgcactctag

SEQ ID NO: 59860 - DNA, 18 bp, Artificial Sequence
  Synthetic DNA
caaatcgtataactatgg

SEQ ID NO: 59861 - DNA, 18 bp, Artificial Sequence
  Synthetic DNA
caaatcgtctcactattg

SEQ ID NO: 59862 - DNA, 18 bp, Artificial Sequence
  Synthetic DNA
caacaagacttgcacttg

SEQ ID NO: 59863 - DNA, 18 bp, Artificial Sequence
  Synthetic DNA
caacacaactatctaaag

SEQ ID NO: 59864 - DNA, 18 bp, Artificial Sequence
  Synthetic DNA
caacacaacttacaatag

SEQ ID NO: 59865 - DNA, 18 bp, Artificial Sequence
  Synthetic DNA
caacacctctctcttctg

SEQ ID NO: 59866 - DNA, 18 bp, Artificial Sequence
  Synthetic DNA
caacacgactctatcttg

SEQ ID NO: 59867 - DNA, 18 bp, Artificial Sequence
  Synthetic DNA
caacattactctatacag

SEQ ID NO: 59868 - DNA, 18 bp, Artificial Sequence
  Synthetic DNA
caagatgactcactctcg

SEQ ID NO: 59869 - DNA, 18 bp, Artificial Sequence
  Synthetic DNA
caaggctgctccctttag

SEQ ID NO: 59870 - DNA, 18 bp, Artificial Sequence
  Synthetic DNA
caagtcctctcactatag

SEQ ID NO: 59871 - DNA, 18 bp, Artificial Sequence
  Synthetic DNA
caataacactctcattag

SEQ ID NO: 59872 - DNA, 18 bp, Artificial Sequence
  Synthetic DNA
caataagactccatttag

SEQ ID NO: 59873 - DNA, 18 bp, Artificial Sequence
  Synthetic DNA
caataagagacacttaag

SEQ ID NO: 59874 - DNA, 18 bp, Artificial Sequence
  Synthetic DNA
caataagcctcattaccg

SEQ ID NO: 59875 - DNA, 18 bp, Artificial Sequence
  Synthetic DNA
caataattctcaccatag

SEQ ID NO: 59876 - DNA, 18 bp, Artificial Sequence
  Synthetic DNA
caatacaattcaccttag

SEQ ID NO: 59877 - DNA, 18 bp, Artificial Sequence
  Synthetic DNA
caatacacctcattattg

SEQ ID NO: 59878 - DNA, 18 bp, Artificial Sequence
  Synthetic DNA
caataccacacactactg

SEQ ID NO: 59879 - DNA, 18 bp, Artificial Sequence
  Synthetic DNA
caatacctcacactattg

SEQ ID NO: 59880 - DNA, 18 bp, Artificial Sequence
  Synthetic DNA
caatacctcgcacaattg

SEQ ID NO: 59881 - DNA, 18 bp, Artificial Sequence
  Synthetic DNA
caatacgaataatttttg

SEQ ID NO: 59882 - DNA, 18 bp, Artificial Sequence
  Synthetic DNA
caatacgacatactaatg

SEQ ID NO: 59883 - DNA, 18 bp, Artificial Sequence
  Synthetic DNA
caatacgacccacatttg

SEQ ID NO: 59884 - DNA, 18 bp, Artificial Sequence
  Synthetic DNA
caatacgagcaactctag

SEQ ID NO: 59885 - DNA, 18 bp, Artificial Sequence
  Synthetic DNA
caatacgagggactattg

SEQ ID NO: 59886 - DNA, 18 bp, Artificial Sequence
  Synthetic DNA
caatacgatactcaatcg

SEQ ID NO: 59887 - DNA, 18 bp, Artificial Sequence
  Synthetic DNA
caatacgccttttaatag

SEQ ID NO: 59888 - DNA, 18 bp, Artificial Sequence
  Synthetic DNA
caatacggctcacataag

SEQ ID NO: 59889 - DNA, 18 bp, Artificial Sequence
  Synthetic DNA
caatacggtacgctatag

SEQ ID NO: 59890 - DNA, 18 bp, Artificial Sequence
  Synthetic DNA
caatacgtaaatcaatag

SEQ ID NO: 59891 - DNA, 18 bp, Artificial Sequence
  Synthetic DNA
caatacgtcacattatgg

SEQ ID NO: 59892 - DNA, 18 bp, Artificial Sequence
  Synthetic DNA
caatacgtcaggctatag

SEQ ID NO: 59893 - DNA, 18 bp, Artificial Sequence
  Synthetic DNA
caatacgtccccccatag

SEQ ID NO: 59894 - DNA, 18 bp, Artificial Sequence
  Synthetic DNA
caatacgtctcacacaag

SEQ ID NO: 59895 - DNA, 18 bp, Artificial Sequence
  Synthetic DNA
caatacgtttaacaaaag

SEQ ID NO: 59896 - DNA, 18 bp, Artificial Sequence
  Synthetic DNA
caatactacacacattag

SEQ ID NO: 59897 - DNA, 18 bp, Artificial Sequence
  Synthetic DNA
caatactactcacactcg

SEQ ID NO: 59898 - DNA, 18 bp, Artificial Sequence
  Synthetic DNA
caatactattgactatgg

SEQ ID NO: 59899 - DNA, 18 bp, Artificial Sequence
  Synthetic DNA
caatacttctcattgttg

SEQ ID NO: 59900 - DNA, 18 bp, Artificial Sequence
  Synthetic DNA
caatacttcttactaaag

SEQ ID NO: 59901 - DNA, 18 bp, Artificial Sequence
  Synthetic DNA
caatacttttcacaatag

SEQ ID NO: 59902 - DNA, 18 bp, Artificial Sequence
  Synthetic DNA
caataggagtcacaatcg

SEQ ID NO: 59903 - DNA, 18 bp, Artificial Sequence
  Synthetic DNA
caatatgtaacactattg

SEQ ID NO: 59904 - DNA, 18 bp, Artificial Sequence
  Synthetic DNA
caatatgtctctctttag

SEQ ID NO: 59905 - DNA, 18 bp, Artificial Sequence
  Synthetic DNA
caatatttccaactgtag

SEQ ID NO: 59906 - DNA, 18 bp, Artificial Sequence
  Synthetic DNA
caatcagactggatatag

SEQ ID NO: 59907 - DNA, 18 bp, Artificial Sequence
  Synthetic DNA
caatccaactcattaaag

SEQ ID NO: 59908 - DNA, 18 bp, Artificial Sequence
  Synthetic DNA
caatcgaactcactacag

SEQ ID NO: 59909 - DNA, 18 bp, Artificial Sequence
  Synthetic DNA
caatgcgcctcactcgag

SEQ ID NO: 59910 - DNA, 18 bp, Artificial Sequence
  Synthetic DNA
caatgcgtcgctatatag

SEQ ID NO: 59911 - DNA, 18 bp, Artificial Sequence
  Synthetic DNA
caatgcgtttcactatgg

SEQ ID NO: 59912 - DNA, 18 bp, Artificial Sequence
  Synthetic DNA
caatgctactgactttag

SEQ ID NO: 59913 - DNA, 18 bp, Artificial Sequence
  Synthetic DNA
caatgtgcctcacaatag

SEQ ID NO: 59914 - DNA, 18 bp, Artificial Sequence
  Synthetic DNA
caatgttactcattatag

SEQ ID NO: 59915 - DNA, 18 bp, Artificial Sequence
  Synthetic DNA
caattagtctcagaatag

SEQ ID NO: 59916 - DNA, 18 bp, Artificial Sequence
  Synthetic DNA
caattcaacacacttaag

SEQ ID NO: 59917 - DNA, 18 bp, Artificial Sequence
  Synthetic DNA
caattcaacccactattg

SEQ ID NO: 59918 - DNA, 18 bp, Artificial Sequence
  Synthetic DNA
caattcatcacttttaag

SEQ ID NO: 59919 - DNA, 18 bp, Artificial Sequence
  Synthetic DNA
caattccaagcactatag

SEQ ID NO: 59920 - DNA, 18 bp, Artificial Sequence
  Synthetic DNA
caattcctctcactttag

SEQ ID NO: 59921 - DNA, 18 bp, Artificial Sequence
  Synthetic DNA
caattcgaatcactgcag

SEQ ID NO: 59922 - DNA, 18 bp, Artificial Sequence
  Synthetic DNA
caattcgagtcaatattg

SEQ ID NO: 59923 - DNA, 18 bp, Artificial Sequence
  Synthetic DNA
caattctactcacttaag

SEQ ID NO: 59924 - DNA, 18 bp, Artificial Sequence
  Synthetic DNA
caattcttgtcactatag

SEQ ID NO: 59925 - DNA, 18 bp, Artificial Sequence
  Synthetic DNA
caattggattcactgtag

SEQ ID NO: 59926 - DNA, 18 bp, Artificial Sequence
  Synthetic DNA
caatttcaatcactttag

SEQ ID NO: 59927 - DNA, 18 bp, Artificial Sequence
  Synthetic DNA
caatttgacacactttag

SEQ ID NO: 59928 - DNA, 18 bp, Artificial Sequence
  Synthetic DNA
caatttgattcgcattgg

SEQ ID NO: 59929 - DNA, 18 bp, Artificial Sequence
  Synthetic DNA
cacaatgtcagactatag

SEQ ID NO: 59930 - DNA, 18 bp, Artificial Sequence
  Synthetic DNA
cacagcgactcacaaaag

SEQ ID NO: 59931 - DNA, 18 bp, Artificial Sequence
  Synthetic DNA
caccccgactcacaattg

SEQ ID NO: 59932 - DNA, 18 bp, Artificial Sequence
  Synthetic DNA
cacgactaatcactttag

SEQ ID NO: 59933 - DNA, 18 bp, Artificial Sequence
  Synthetic DNA
cactaagattgactattg

SEQ ID NO: 59934 - DNA, 18 bp, Artificial Sequence
  Synthetic DNA
cactacctctatatattg

SEQ ID NO: 59935 - DNA, 18 bp, Artificial Sequence
  Synthetic DNA
cactacggcagtctttag

SEQ ID NO: 59936 - DNA, 18 bp, Artificial Sequence
  Synthetic DNA
cactactaattaccatag

SEQ ID NO: 59937 - DNA, 18 bp, Artificial Sequence
  Synthetic DNA
cacttcgaatcactacag

SEQ ID NO: 59938 - DNA, 18 bp, Artificial Sequence
  Synthetic DNA
cagaactactctctaaag

SEQ ID NO: 59939 - DNA, 18 bp, Artificial Sequence
  Synthetic DNA
caggacgactcaatttag

SEQ ID NO: 59940 - DNA, 18 bp, Artificial Sequence
  Synthetic DNA
cagtaggactaaccatag

SEQ ID NO: 59941 - DNA, 18 bp, Artificial Sequence
  Synthetic DNA
cagtgcgactcataattg

SEQ ID NO: 59942 - DNA, 18 bp, Artificial Sequence
  Synthetic DNA
cagtgcgtcccagtatag

SEQ ID NO: 59943 - DNA, 18 bp, Artificial Sequence
  Synthetic DNA
cagttagcctcactatag

SEQ ID NO: 59944 - DNA, 18 bp, Artificial Sequence
  Synthetic DNA
cagttcgactcccattag

SEQ ID NO: 59945 - DNA, 18 bp, Artificial Sequence
  Synthetic DNA
cataacaacttgctacag

SEQ ID NO: 59946 - DNA, 18 bp, Artificial Sequence
  Synthetic DNA
cataacgactcaatctgg

SEQ ID NO: 59947 - DNA, 18 bp, Artificial Sequence
  Synthetic DNA
cataacgtttcactacag

SEQ ID NO: 59948 - DNA, 18 bp, Artificial Sequence
  Synthetic DNA
cataactactaattagtg

SEQ ID NO: 59949 - DNA, 18 bp, Artificial Sequence
  Synthetic DNA
catatagggttcctatag

SEQ ID NO: 59950 - DNA, 18 bp, Artificial Sequence
  Synthetic DNA
cattacaacagactatcg

SEQ ID NO: 59951 - DNA, 18 bp, Artificial Sequence
  Synthetic DNA
cattacacctctctattg

SEQ ID NO: 59952 - DNA, 18 bp, Artificial Sequence
  Synthetic DNA
cattacatcacactatag

SEQ ID NO: 59953 - DNA, 18 bp, Artificial Sequence
  Synthetic DNA
cattacgactcacgaatg

SEQ ID NO: 59954 - DNA, 18 bp, Artificial Sequence
  Synthetic DNA
cattacgactcatcacag

SEQ ID NO: 59955 - DNA, 18 bp, Artificial Sequence
  Synthetic DNA
cattacgcctgagtattg

SEQ ID NO: 59956 - DNA, 18 bp, Artificial Sequence
  Synthetic DNA
cattacggctcacttatg

SEQ ID NO: 59957 - DNA, 18 bp, Artificial Sequence
  Synthetic DNA
cattaggacgcgctaaag

SEQ ID NO: 59958 - DNA, 18 bp, Artificial Sequence
  Synthetic DNA
cattaggacttactactg

SEQ ID NO: 59959 - DNA, 18 bp, Artificial Sequence
  Synthetic DNA
cattatgacacactattg

SEQ ID NO: 59960 - DNA, 18 bp, Artificial Sequence
  Synthetic DNA
cattatgactgactatcg

SEQ ID NO: 59961 - DNA, 18 bp, Artificial Sequence
  Synthetic DNA
cattatgactttcgatag

SEQ ID NO: 59962 - DNA, 18 bp, Artificial Sequence
  Synthetic DNA
cattctgattcaccatag

SEQ ID NO: 59963 - DNA, 18 bp, Artificial Sequence
  Synthetic DNA
catttccaatcgctactg

SEQ ID NO: 59964 - DNA, 18 bp, Artificial Sequence
  Synthetic DNA
catttccattctctacag

SEQ ID NO: 59965 - DNA, 18 bp, Artificial Sequence
  Synthetic DNA
catttcgactgacaaatg

SEQ ID NO: 59966 - DNA, 18 bp, Artificial Sequence
  Synthetic DNA
ccaaacaactcactattg

SEQ ID NO: 59967 - DNA, 18 bp, Artificial Sequence
  Synthetic DNA
ccagactgcttattaaag

SEQ ID NO: 59968 - DNA, 18 bp, Artificial Sequence
  Synthetic DNA
ccataaaactaactagag

SEQ ID NO: 59969 - DNA, 18 bp, Artificial Sequence
  Synthetic DNA
ccataactatcactatag

SEQ ID NO: 59970 - DNA, 18 bp, Artificial Sequence
  Synthetic DNA
ccataagactcacttttg

SEQ ID NO: 59971 - DNA, 18 bp, Artificial Sequence
  Synthetic DNA
ccatacgactcacaaatg

SEQ ID NO: 59972 - DNA, 18 bp, Artificial Sequence
  Synthetic DNA
ccatacgtcttagtatag

SEQ ID NO: 59973 - DNA, 18 bp, Artificial Sequence
  Synthetic DNA
ccatacttcacactatcg

SEQ ID NO: 59974 - DNA, 18 bp, Artificial Sequence
  Synthetic DNA
cccaacgacactctcaag

SEQ ID NO: 59975 - DNA, 18 bp, Artificial Sequence
  Synthetic DNA
cccagcgtcccacagtag

SEQ ID NO: 59976 - DNA, 18 bp, Artificial Sequence
  Synthetic DNA
ccctaggactcacaattg

SEQ ID NO: 59977 - DNA, 18 bp, Artificial Sequence
  Synthetic DNA
ccttaagcacttatttag

SEQ ID NO: 59978 - DNA, 18 bp, Artificial Sequence
  Synthetic DNA
ccttacgacttactaaag

SEQ ID NO: 59979 - DNA, 18 bp, Artificial Sequence
  Synthetic DNA
ccttgcgacccactatcg

SEQ ID NO: 59980 - DNA, 18 bp, Artificial Sequence
  Synthetic DNA
cgactcgtcacgctatag

SEQ ID NO: 59981 - DNA, 18 bp, Artificial Sequence
  Synthetic DNA
cgataagacccaccattg

SEQ ID NO: 59982 - DNA, 18 bp, Artificial Sequence
  Synthetic DNA
cgataagattctttatag

SEQ ID NO: 59983 - DNA, 18 bp, Artificial Sequence
  Synthetic DNA
cgatagaagtttatatag

SEQ ID NO: 59984 - DNA, 18 bp, Artificial Sequence
  Synthetic DNA
cgataggcctcactttag

SEQ ID NO: 59985 - DNA, 18 bp, Artificial Sequence
  Synthetic DNA
cgatatgactcacatttg

SEQ ID NO: 59986 - DNA, 18 bp, Artificial Sequence
  Synthetic DNA
cgattagactcacttttg

SEQ ID NO: 59987 - DNA, 18 bp, Artificial Sequence
  Synthetic DNA
cgattcgattcacctgag

SEQ ID NO: 59988 - DNA, 18 bp, Artificial Sequence
  Synthetic DNA
cgcaaagtctcacttatg

SEQ ID NO: 59989 - DNA, 18 bp, Artificial Sequence
  Synthetic DNA
cgctaagactcattacag

SEQ ID NO: 59990 - DNA, 18 bp, Artificial Sequence
  Synthetic DNA
cgctactactgacaatag

SEQ ID NO: 59991 - DNA, 18 bp, Artificial Sequence
  Synthetic DNA
ctaaacaactctctattg

SEQ ID NO: 59992 - DNA, 18 bp, Artificial Sequence
  Synthetic DNA
ctaaacgactcgcttatg

SEQ ID NO: 59993 - DNA, 18 bp, Artificial Sequence
  Synthetic DNA
ctaaatgacacactattg

SEQ ID NO: 59994 - DNA, 18 bp, Artificial Sequence
  Synthetic DNA
ctacaagacttactatcg

SEQ ID NO: 59995 - DNA, 18 bp, Artificial Sequence
  Synthetic DNA
ctacacgactctcaatgg

SEQ ID NO: 59996 - DNA, 18 bp, Artificial Sequence
  Synthetic DNA
ctacacgagtcactaaag

SEQ ID NO: 59997 - DNA, 18 bp, Artificial Sequence
  Synthetic DNA
ctacatgactcactatcg

SEQ ID NO: 59998 - DNA, 18 bp, Artificial Sequence
  Synthetic DNA
ctacccgtcacattatag

SEQ ID NO: 59999 - DNA, 18 bp, Artificial Sequence
  Synthetic DNA
ctactcgtctaattatag

SEQ ID NO: 60000 - DNA, 18 bp, Artificial Sequence
  Synthetic DNA
ctataagactcacgctag

SEQ ID NO: 60001 - DNA, 18 bp, Artificial Sequence
  Synthetic DNA
ctatacaactcattattg

SEQ ID NO: 60002 - DNA, 18 bp, Artificial Sequence
  Synthetic DNA
ctatacgactattatttg

SEQ ID NO: 60003 - DNA, 18 bp, Artificial Sequence
  Synthetic DNA
ctatacgactccgtatcg

SEQ ID NO: 60004 - DNA, 18 bp, Artificial Sequence
  Synthetic DNA
ctatacgactctcttaag

SEQ ID NO: 60005 - DNA, 18 bp, Artificial Sequence
  Synthetic DNA
ctatacgagtccctacag

SEQ ID NO: 60006 - DNA, 18 bp, Artificial Sequence
  Synthetic DNA
ctatacggctcaccaatg

SEQ ID NO: 60007 - DNA, 18 bp, Artificial Sequence
  Synthetic DNA
ctatacgtctaactaaag

SEQ ID NO: 60008 - DNA, 18 bp, Artificial Sequence
  Synthetic DNA
ctatacgtctctatataa

SEQ ID NO: 60009 - DNA, 18 bp, Artificial Sequence
  Synthetic DNA
ctatactactacctatag

SEQ ID NO: 60010 - DNA, 18 bp, Artificial Sequence
  Synthetic DNA
ctatactattcacttatg

SEQ ID NO: 60011 - DNA, 18 bp, Artificial Sequence
  Synthetic DNA
ctatacttgtcgctattg

SEQ ID NO: 60012 - DNA, 18 bp, Artificial Sequence
  Synthetic DNA
ctatatgcctgactctag

SEQ ID NO: 60013 - DNA, 18 bp, Artificial Sequence
  Synthetic DNA
ctatattactctccattg

SEQ ID NO: 60014 - DNA, 18 bp, Artificial Sequence
  Synthetic DNA
ctatcctgctcacaattg

SEQ ID NO: 60015 - DNA, 18 bp, Artificial Sequence
  Synthetic DNA
ctatgcgaataatcattg

SEQ ID NO: 60016 - DNA, 18 bp, Artificial Sequence
  Synthetic DNA
ctatgcgactcattttag

SEQ ID NO: 60017 - DNA, 18 bp, Artificial Sequence
  Synthetic DNA
ctattccacacactatag

SEQ ID NO: 60018 - DNA, 18 bp, Artificial Sequence
  Synthetic DNA
ctattcgactcattcttg

SEQ ID NO: 60019 - DNA, 18 bp, Artificial Sequence
  Synthetic DNA
ctctaggactcactaaag

SEQ ID NO: 60020 - DNA, 18 bp, Artificial Sequence
  Synthetic DNA
cttaaagactcattggtg

SEQ ID NO: 60021 - DNA, 18 bp, Artificial Sequence
  Synthetic DNA
cttcatgattatctatag

SEQ ID NO: 60022 - DNA, 18 bp, Artificial Sequence
  Synthetic DNA
ctttacaaatctctcttg

SEQ ID NO: 60023 - DNA, 18 bp, Artificial Sequence
  Synthetic DNA
ctttacgactcacttttg

SEQ ID NO: 60024 - DNA, 18 bp, Artificial Sequence
  Synthetic DNA
ctttacgactccctttag

SEQ ID NO: 60025 - DNA, 18 bp, Artificial Sequence
  Synthetic DNA
ctttatgtctcactatag

SEQ ID NO: 60026 - DNA, 18 bp, Artificial Sequence
  Synthetic DNA
gaaaacgactcaaaattg

SEQ ID NO: 60027 - DNA, 18 bp, Artificial Sequence
  Synthetic DNA
gaaaacggtaaactattg

SEQ ID NO: 60028 - DNA, 18 bp, Artificial Sequence
  Synthetic DNA
gaaaatgacactcttaag

SEQ ID NO: 60029 - DNA, 18 bp, Artificial Sequence
  Synthetic DNA
gaaatcaaaaaatcttag

SEQ ID NO: 60030 - DNA, 18 bp, Artificial Sequence
  Synthetic DNA
gaaatcgtctcactaaag

SEQ ID NO: 60031 - DNA, 18 bp, Artificial Sequence
  Synthetic DNA
gaacacgtctgacaatag

SEQ ID NO: 60032 - DNA, 18 bp, Artificial Sequence
  Synthetic DNA
gaacatgactgactaacg

SEQ ID NO: 60033 - DNA, 18 bp, Artificial Sequence
  Synthetic DNA
gaaccagactcattaaag

SEQ ID NO: 60034 - DNA, 18 bp, Artificial Sequence
  Synthetic DNA
gaacgcaactcacttaag

SEQ ID NO: 60035 - DNA, 18 bp, Artificial Sequence
  Synthetic DNA
gaactcaactcacgatag

SEQ ID NO: 60036 - DNA, 18 bp, Artificial Sequence
  Synthetic DNA
gaactcttctcaatctag

SEQ ID NO: 60037 - DNA, 18 bp, Artificial Sequence
  Synthetic DNA
gaagccgagtgaattcag

SEQ ID NO: 60038 - DNA, 18 bp, Artificial Sequence
  Synthetic DNA
gaatacaaatcaatctag

SEQ ID NO: 60039 - DNA, 18 bp, Artificial Sequence
  Synthetic DNA
gaatacaaatccctgttg

SEQ ID NO: 60040 - DNA, 18 bp, Artificial Sequence
  Synthetic DNA
gaatacgacacacctcag

SEQ ID NO: 60041 - DNA, 18 bp, Artificial Sequence
  Synthetic DNA
gaatacgagtctctaacg

SEQ ID NO: 60042 - DNA, 18 bp, Artificial Sequence
  Synthetic DNA
gaatacgattagctctag

SEQ ID NO: 60043 - DNA, 18 bp, Artificial Sequence
  Synthetic DNA
gaatacggcttaatttag

SEQ ID NO: 60044 - DNA, 18 bp, Artificial Sequence
  Synthetic DNA
gaatacttctacttttag

SEQ ID NO: 60045 - DNA, 18 bp, Artificial Sequence
  Synthetic DNA
gaataggaaacccaaaag

SEQ ID NO: 60046 - DNA, 18 bp, Artificial Sequence
  Synthetic DNA
gaatatatccgactttag

SEQ ID NO: 60047 - DNA, 18 bp, Artificial Sequence
  Synthetic DNA
gaatctgacactctatag

SEQ ID NO: 60048 - DNA, 18 bp, Artificial Sequence
  Synthetic DNA
gaatgacactctcttaag

SEQ ID NO: 60049 - DNA, 18 bp, Artificial Sequence
  Synthetic DNA
gaattcgattccctttgg

SEQ ID NO: 60050 - DNA, 18 bp, Artificial Sequence
  Synthetic DNA
gaattcgcctcatacatg

SEQ ID NO: 60051 - DNA, 18 bp, Artificial Sequence
  Synthetic DNA
gaattcgttccgctatag

SEQ ID NO: 60052 - DNA, 18 bp, Artificial Sequence
  Synthetic DNA
gaattcttcttactatag

SEQ ID NO: 60053 - DNA, 18 bp, Artificial Sequence
  Synthetic DNA
gaatttaactcacgatag

SEQ ID NO: 60054 - DNA, 18 bp, Artificial Sequence
  Synthetic DNA
gaatttgacgcattttag

SEQ ID NO: 60055 - DNA, 18 bp, Artificial Sequence
  Synthetic DNA
gaatttgtcttcctatag

SEQ ID NO: 60056 - DNA, 18 bp, Artificial Sequence
  Synthetic DNA
gactaccactcacttttg

SEQ ID NO: 60057 - DNA, 18 bp, Artificial Sequence
  Synthetic DNA
gactacgacacattatcg

SEQ ID NO: 60058 - DNA, 18 bp, Artificial Sequence
  Synthetic DNA
gagtacgactcacgttcg

SEQ ID NO: 60059 - DNA, 18 bp, Artificial Sequence
  Synthetic DNA
gatatcatcacactttag

SEQ ID NO: 60060 - DNA, 18 bp, Artificial Sequence
  Synthetic DNA
gatctccactcattgtag

SEQ ID NO: 60061 - DNA, 18 bp, Artificial Sequence
  Synthetic DNA
gattacagctgagtatag

SEQ ID NO: 60062 - DNA, 18 bp, Artificial Sequence
  Synthetic DNA
gattaccaccatgtgtag

SEQ ID NO: 60063 - DNA, 18 bp, Artificial Sequence
  Synthetic DNA
gattacccctcaatatgg

SEQ ID NO: 60064 - DNA, 18 bp, Artificial Sequence
  Synthetic DNA
gattactgctcaatatag

SEQ ID NO: 60065 - DNA, 18 bp, Artificial Sequence
  Synthetic DNA
gattcctactaaattttg

SEQ ID NO: 60066 - DNA, 18 bp, Artificial Sequence
  Synthetic DNA
gattgcaattctttttag

SEQ ID NO: 60067 - DNA, 18 bp, Artificial Sequence
  Synthetic DNA
gattgcgtctcactattg

SEQ ID NO: 60068 - DNA, 18 bp, Artificial Sequence
  Synthetic DNA
gattgtgtttcactgtag

SEQ ID NO: 60069 - DNA, 18 bp, Artificial Sequence
  Synthetic DNA
gatttattctctcaattg

SEQ ID NO: 60070 - DNA, 18 bp, Artificial Sequence
  Synthetic DNA
gatttctcatctctatag

SEQ ID NO: 60071 - DNA, 18 bp, Artificial Sequence
  Synthetic DNA
gattttgaatcactatag

SEQ ID NO: 60072 - DNA, 18 bp, Artificial Sequence
  Synthetic DNA
gcaagacacgcacagcag

SEQ ID NO: 60073 - DNA, 18 bp, Artificial Sequence
  Synthetic DNA
gcagacttctcactatgg

SEQ ID NO: 60074 - DNA, 18 bp, Artificial Sequence
  Synthetic DNA
gcataaatctccctatag

SEQ ID NO: 60075 - DNA, 18 bp, Artificial Sequence
  Synthetic DNA
gcatacgtcgcagttttg

SEQ ID NO: 60076 - DNA, 18 bp, Artificial Sequence
  Synthetic DNA
gcataggacacattctag

SEQ ID NO: 60077 - DNA, 18 bp, Artificial Sequence
  Synthetic DNA
gcatgctactctcaaaag

SEQ ID NO: 60078 - DNA, 18 bp, Artificial Sequence
  Synthetic DNA
gcattccacttgctaaag

SEQ ID NO: 60079 - DNA, 18 bp, Artificial Sequence
  Synthetic DNA
gcattcgacttactctag

SEQ ID NO: 60080 - DNA, 18 bp, Artificial Sequence
  Synthetic DNA
gcttacgtcacattttcg

SEQ ID NO: 60081 - DNA, 18 bp, Artificial Sequence
  Synthetic DNA
ggagccgactctcattag

SEQ ID NO: 60082 - DNA, 18 bp, Artificial Sequence
  Synthetic DNA
ggcaacgactcactatcg

SEQ ID NO: 60083 - DNA, 18 bp, Artificial Sequence
  Synthetic DNA
ggcttcgactggctatag

SEQ ID NO: 60084 - DNA, 18 bp, Artificial Sequence
  Synthetic DNA
gggtacgattcaccgtag

SEQ ID NO: 60085 - DNA, 18 bp, Artificial Sequence
  Synthetic DNA
ggtaaatactcacgtaag

SEQ ID NO: 60086 - DNA, 18 bp, Artificial Sequence
  Synthetic DNA
ggttacaactcattattg

SEQ ID NO: 60087 - DNA, 18 bp, Artificial Sequence
  Synthetic DNA
gtaaacaactcagataag

SEQ ID NO: 60088 - DNA, 18 bp, Artificial Sequence
  Synthetic DNA
gtatacgaatctcaatag

SEQ ID NO: 60089 - DNA, 18 bp, Artificial Sequence
  Synthetic DNA
gtatacgactcaccgacg

SEQ ID NO: 60090 - DNA, 18 bp, Artificial Sequence
  Synthetic DNA
gtatacgtatcagtatag

SEQ ID NO: 60091 - DNA, 18 bp, Artificial Sequence
  Synthetic DNA
gtataggactctccatgg

SEQ ID NO: 60092 - DNA, 18 bp, Artificial Sequence
  Synthetic DNA
gtatataactcacattag

SEQ ID NO: 60093 - DNA, 18 bp, Artificial Sequence
  Synthetic DNA
gtgtacaactctctatag

SEQ ID NO: 60094 - DNA, 18 bp, Artificial Sequence
  Synthetic DNA
gttcaatatttactattg

SEQ ID NO: 60095 - DNA, 18 bp, Artificial Sequence
  Synthetic DNA
gttttcgactttctttag

SEQ ID NO: 60096 - DNA, 18 bp, Artificial Sequence
  Synthetic DNA
taaaaaaattcattatag

SEQ ID NO: 60097 - DNA, 18 bp, Artificial Sequence
  Synthetic DNA
taaaaagaaacgctatag

SEQ ID NO: 60098 - DNA, 18 bp, Artificial Sequence
  Synthetic DNA
taaaaagaatctctaaag

SEQ ID NO: 60099 - DNA, 18 bp, Artificial Sequence
  Synthetic DNA
taaaaagacacatttttg

SEQ ID NO: 60100 - DNA, 18 bp, Artificial Sequence
  Synthetic DNA
taaaaagacttactctcg

SEQ ID NO: 60101 - DNA, 18 bp, Artificial Sequence
  Synthetic DNA
taaaaagcctgacaaaag

SEQ ID NO: 60102 - DNA, 18 bp, Artificial Sequence
  Synthetic DNA
taaaaaggcactcaatag

SEQ ID NO: 60103 - DNA, 18 bp, Artificial Sequence
  Synthetic DNA
taaaaagtcaaactatag

SEQ ID NO: 60104 - DNA, 18 bp, Artificial Sequence
  Synthetic DNA
taaaaagtttcgccattg

SEQ ID NO: 60105 - DNA, 18 bp, Artificial Sequence
  Synthetic DNA
taaaacaaaacgctatag

SEQ ID NO: 60106 - DNA, 18 bp, Artificial Sequence
  Synthetic DNA
taaaacaaactacattgg

SEQ ID NO: 60107 - DNA, 18 bp, Artificial Sequence
  Synthetic DNA
taaaacaaatcactaacg

SEQ ID NO: 60108 - DNA, 18 bp, Artificial Sequence
  Synthetic DNA
taaaacaacattctgttg

SEQ ID NO: 60109 - DNA, 18 bp, Artificial Sequence
  Synthetic DNA
taaaacaactatctaaag

SEQ ID NO: 60110 - DNA, 18 bp, Artificial Sequence
  Synthetic DNA
taaaacaactctaaatag

SEQ ID NO: 60111 - DNA, 18 bp, Artificial Sequence
  Synthetic DNA
taaaacaactctcttatg

SEQ ID NO: 60112 - DNA, 18 bp, Artificial Sequence
  Synthetic DNA
taaaacaagccgctttag

SEQ ID NO: 60113 - DNA, 18 bp, Artificial Sequence
  Synthetic DNA
taaaacatcgcacaatag

SEQ ID NO: 60114 - DNA, 18 bp, Artificial Sequence
  Synthetic DNA
taaaaccacaaactaaag

SEQ ID NO: 60115 - DNA, 18 bp, Artificial Sequence
  Synthetic DNA
taaaacgacatattagag

SEQ ID NO: 60116 - DNA, 18 bp, Artificial Sequence
  Synthetic DNA
taaaacgacccaaaaatg

SEQ ID NO: 60117 - DNA, 18 bp, Artificial Sequence
  Synthetic DNA
taaaacgacccagtccag

SEQ ID NO: 60118 - DNA, 18 bp, Artificial Sequence
  Synthetic DNA
taaaacgaccccatttag

SEQ ID NO: 60119 - DNA, 18 bp, Artificial Sequence
  Synthetic DNA
taaaacgactaaatcttg

SEQ ID NO: 60120 - DNA, 18 bp, Artificial Sequence
  Synthetic DNA
taaaacgactgtcttatg

SEQ ID NO: 60121 - DNA, 18 bp, Artificial Sequence
  Synthetic DNA
taaaacgacttatacttg

SEQ ID NO: 60122 - DNA, 18 bp, Artificial Sequence
  Synthetic DNA
taaaacgagtcgcttagg

SEQ ID NO: 60123 - DNA, 18 bp, Artificial Sequence
  Synthetic DNA
taaaacgagttgctagag

SEQ ID NO: 60124 - DNA, 18 bp, Artificial Sequence
  Synthetic DNA
taaaacgatacagtattg

SEQ ID NO: 60125 - DNA, 18 bp, Artificial Sequence
  Synthetic DNA
taaaacgatcatctaaag

SEQ ID NO: 60126 - DNA, 18 bp, Artificial Sequence
  Synthetic DNA
taaaacgattcaacttcg

SEQ ID NO: 60127 - DNA, 18 bp, Artificial Sequence
  Synthetic DNA
taaaacgattcataattg

SEQ ID NO: 60128 - DNA, 18 bp, Artificial Sequence
  Synthetic DNA
taaaacgatttacaacag

SEQ ID NO: 60129 - DNA, 18 bp, Artificial Sequence
  Synthetic DNA
taaaacggaacaagatag

SEQ ID NO: 60130 - DNA, 18 bp, Artificial Sequence
  Synthetic DNA
taaaacgtatgcctagag

SEQ ID NO: 60131 - DNA, 18 bp, Artificial Sequence
  Synthetic DNA
taaaacgtcccaccttag

SEQ ID NO: 60132 - DNA, 18 bp, Artificial Sequence
  Synthetic DNA
taaaacgtcctattacag

SEQ ID NO: 60133 - DNA, 18 bp, Artificial Sequence
  Synthetic DNA
taaaacgtcttaatacag

SEQ ID NO: 60134 - DNA, 18 bp, Artificial Sequence
  Synthetic DNA
taaaacgtcttacagacg

SEQ ID NO: 60135 - DNA, 18 bp, Artificial Sequence
  Synthetic DNA
taaaacgttacactaatg

SEQ ID NO: 60136 - DNA, 18 bp, Artificial Sequence
  Synthetic DNA
taaaacgtttctctctag

SEQ ID NO: 60137 - DNA, 18 bp, Artificial Sequence
  Synthetic DNA
taaaacgtttctcttttg

SEQ ID NO: 60138 - DNA, 18 bp, Artificial Sequence
  Synthetic DNA
taaaactacatactaatg

SEQ ID NO: 60139 - DNA, 18 bp, Artificial Sequence
  Synthetic DNA
taaaactactcattgttg

SEQ ID NO: 60140 - DNA, 18 bp, Artificial Sequence
  Synthetic DNA
taaaactactctcttacg

SEQ ID NO: 60141 - DNA, 18 bp, Artificial Sequence
  Synthetic DNA
taaaactacttgctttag

SEQ ID NO: 60142 - DNA, 18 bp, Artificial Sequence
  Synthetic DNA
taaaacttctcataatcg

SEQ ID NO: 60143 - DNA, 18 bp, Artificial Sequence
  Synthetic DNA
taaaacttctctcttttg

SEQ ID NO: 60144 - DNA, 18 bp, Artificial Sequence
  Synthetic DNA
taaaacttcttactattg

SEQ ID NO: 60145 - DNA, 18 bp, Artificial Sequence
  Synthetic DNA
taaaaggaatcacacttg

SEQ ID NO: 60146 - DNA, 18 bp, Artificial Sequence
  Synthetic DNA
taaaaggaccctgtgttg

SEQ ID NO: 60147 - DNA, 18 bp, Artificial Sequence
  Synthetic DNA
taaaaggattggtcatag

SEQ ID NO: 60148 - DNA, 18 bp, Artificial Sequence
  Synthetic DNA
taaaagtactcacttcag

SEQ ID NO: 60149 - DNA, 18 bp, Artificial Sequence
  Synthetic DNA
taaaagtactgtctatag

SEQ ID NO: 60150 - DNA, 18 bp, Artificial Sequence
  Synthetic DNA
taaaatcacccaatatcg

SEQ ID NO: 60151 - DNA, 18 bp, Artificial Sequence
  Synthetic DNA
taaaatctcactctatag

SEQ ID NO: 60152 - DNA, 18 bp, Artificial Sequence
  Synthetic DNA
taaaatgacacgtttcag

SEQ ID NO: 60153 - DNA, 18 bp, Artificial Sequence
  Synthetic DNA
taaaatgatttccaatcg

SEQ ID NO: 60154 - DNA, 18 bp, Artificial Sequence
  Synthetic DNA
taaaatgcttcacttaag

SEQ ID NO: 60155 - DNA, 18 bp, Artificial Sequence
  Synthetic DNA
taaaatgtctatctatag

SEQ ID NO: 60156 - DNA, 18 bp, Artificial Sequence
  Synthetic DNA
taaaatgtctcacattag

SEQ ID NO: 60157 - DNA, 18 bp, Artificial Sequence
  Synthetic DNA
taaacagacactctatag

SEQ ID NO: 60158 - DNA, 18 bp, Artificial Sequence
  Synthetic DNA
taaacagactcactaagg

SEQ ID NO: 60159 - DNA, 18 bp, Artificial Sequence
  Synthetic DNA
taaaccaaaacactatag

SEQ ID NO: 60160 - DNA, 18 bp, Artificial Sequence
  Synthetic DNA
taaaccatctctcttttg

SEQ ID NO: 60161 - DNA, 18 bp, Artificial Sequence
  Synthetic DNA
taaaccgacaccctttag

SEQ ID NO: 60162 - DNA, 18 bp, Artificial Sequence
  Synthetic DNA
taaaccgattcaccttag

SEQ ID NO: 60163 - DNA, 18 bp, Artificial Sequence
  Synthetic DNA
taaaccgtctcactactg

SEQ ID NO: 60164 - DNA, 18 bp, Artificial Sequence
  Synthetic DNA
taaactgagtccatagag

SEQ ID NO: 60165 - DNA, 18 bp, Artificial Sequence
  Synthetic DNA
taaagaaactcactctag

SEQ ID NO: 60166 - DNA, 18 bp, Artificial Sequence
  Synthetic DNA
taaagcaactcattgtag

SEQ ID NO: 60167 - DNA, 18 bp, Artificial Sequence
  Synthetic DNA
taaagccactctctacag

SEQ ID NO: 60168 - DNA, 18 bp, Artificial Sequence
  Synthetic DNA
taaagcgacacatttgtg

SEQ ID NO: 60169 - DNA, 18 bp, Artificial Sequence
  Synthetic DNA
taaagcgatacattctag

SEQ ID NO: 60170 - DNA, 18 bp, Artificial Sequence
  Synthetic DNA
taaagcgcaacacgatag

SEQ ID NO: 60171 - DNA, 18 bp, Artificial Sequence
  Synthetic DNA
taaagcgtctctctctag

SEQ ID NO: 60172 - DNA, 18 bp, Artificial Sequence
  Synthetic DNA
taaagctaatcactacag

SEQ ID NO: 60173 - DNA, 18 bp, Artificial Sequence
  Synthetic DNA
taaagctactctctattg

SEQ ID NO: 60174 - DNA, 18 bp, Artificial Sequence
  Synthetic DNA
taaaggatcacactatag

SEQ ID NO: 60175 - DNA, 18 bp, Artificial Sequence
  Synthetic DNA
taaaggggctgacaatag

SEQ ID NO: 60176 - DNA, 18 bp, Artificial Sequence
  Synthetic DNA
taaagtgaatctccatag

SEQ ID NO: 60177 - DNA, 18 bp, Artificial Sequence
  Synthetic DNA
taaagtgattcactagag

SEQ ID NO: 60178 - DNA, 18 bp, Artificial Sequence
  Synthetic DNA
taaatagaatcaccatag

SEQ ID NO: 60179 - DNA, 18 bp, Artificial Sequence
  Synthetic DNA
taaatcgacactcattag

SEQ ID NO: 60180 - DNA, 18 bp, Artificial Sequence
  Synthetic DNA
taaatcgactcactgacg

SEQ ID NO: 60181 - DNA, 18 bp, Artificial Sequence
  Synthetic DNA
taaatcgatactctatgg

SEQ ID NO: 60182 - DNA, 18 bp, Artificial Sequence
  Synthetic DNA
taaatcggcagactaaag

SEQ ID NO: 60183 - DNA, 18 bp, Artificial Sequence
  Synthetic DNA
taaatcgtctcagtattg

SEQ ID NO: 60184 - DNA, 18 bp, Artificial Sequence
  Synthetic DNA
taaatcgtttaactttag

SEQ ID NO: 60185 - DNA, 18 bp, Artificial Sequence
  Synthetic DNA
taaatggattcactaatg

SEQ ID NO: 60186 - DNA, 18 bp, Artificial Sequence
  Synthetic DNA
taaatgtacttactattg

SEQ ID NO: 60187 - DNA, 18 bp, Artificial Sequence
  Synthetic DNA
taaatgtcctccctctag

SEQ ID NO: 60188 - DNA, 18 bp, Artificial Sequence
  Synthetic DNA
taaattatcatactatag

SEQ ID NO: 60189 - DNA, 18 bp, Artificial Sequence
  Synthetic DNA
taaattgaaagacaatag

SEQ ID NO: 60190 - DNA, 18 bp, Artificial Sequence
  Synthetic DNA
taaattgactctcaaaag

SEQ ID NO: 60191 - DNA, 18 bp, Artificial Sequence
  Synthetic DNA
taaattgacttacaatgg

SEQ ID NO: 60192 - DNA, 18 bp, Artificial Sequence
  Synthetic DNA
taacaagacttaatattg

SEQ ID NO: 60193 - DNA, 18 bp, Artificial Sequence
  Synthetic DNA
taacaagtctcaatacag

SEQ ID NO: 60194 - DNA, 18 bp, Artificial Sequence
  Synthetic DNA
taacacaactatctcttg

SEQ ID NO: 60195 - DNA, 18 bp, Artificial Sequence
  Synthetic DNA
taacacaactctataaag

SEQ ID NO: 60196 - DNA, 18 bp, Artificial Sequence
  Synthetic DNA
taacacaagtctctatcg

SEQ ID NO: 60197 - DNA, 18 bp, Artificial Sequence
  Synthetic DNA
taacacaattatctaaag

SEQ ID NO: 60198 - DNA, 18 bp, Artificial Sequence
  Synthetic DNA
taacacactttacaacag

SEQ ID NO: 60199 - DNA, 18 bp, Artificial Sequence
  Synthetic DNA
taacaccaaaaactaaag

SEQ ID NO: 60200 - DNA, 18 bp, Artificial Sequence
  Synthetic DNA
taacaccacatactgtag

SEQ ID NO: 60201 - DNA, 18 bp, Artificial Sequence
  Synthetic DNA
taacaccactcacctcag

SEQ ID NO: 60202 - DNA, 18 bp, Artificial Sequence
  Synthetic DNA
taacaccatactatatag

SEQ ID NO: 60203 - DNA, 18 bp, Artificial Sequence
  Synthetic DNA
taacacgaaaaaccttag

SEQ ID NO: 60204 - DNA, 18 bp, Artificial Sequence
  Synthetic DNA
taacacgaaacactaatg

SEQ ID NO: 60205 - DNA, 18 bp, Artificial Sequence
  Synthetic DNA
taacacgacactcaattg

SEQ ID NO: 60206 - DNA, 18 bp, Artificial Sequence
  Synthetic DNA
taacacgacacttcaaag

SEQ ID NO: 60207 - DNA, 18 bp, Artificial Sequence
  Synthetic DNA
taacacgactaacacaag

SEQ ID NO: 60208 - DNA, 18 bp, Artificial Sequence
  Synthetic DNA
taacacgactgtctaacg

SEQ ID NO: 60209 - DNA, 18 bp, Artificial Sequence
  Synthetic DNA
taacacgccacaaaatag

SEQ ID NO: 60210 - DNA, 18 bp, Artificial Sequence
  Synthetic DNA
taacacgccgtactttag

SEQ ID NO: 60211 - DNA, 18 bp, Artificial Sequence
  Synthetic DNA
taacacgcttaaccatag

SEQ ID NO: 60212 - DNA, 18 bp, Artificial Sequence
  Synthetic DNA
taacacgtatcacttttg

SEQ ID NO: 60213 - DNA, 18 bp, Artificial Sequence
  Synthetic DNA
taacacgtctcacaaacg

SEQ ID NO: 60214 - DNA, 18 bp, Artificial Sequence
  Synthetic DNA
taacacgtctcataattg

SEQ ID NO: 60215 - DNA, 18 bp, Artificial Sequence
  Synthetic DNA
taacacgtcttcatacag

SEQ ID NO: 60216 - DNA, 18 bp, Artificial Sequence
  Synthetic DNA
taacactaatcacattag

SEQ ID NO: 60217 - DNA, 18 bp, Artificial Sequence
  Synthetic DNA
taacactactcacattgg

SEQ ID NO: 60218 - DNA, 18 bp, Artificial Sequence
  Synthetic DNA
taacactacttacattag

SEQ ID NO: 60219 - DNA, 18 bp, Artificial Sequence
  Synthetic DNA
taacactagtctttttag

SEQ ID NO: 60220 - DNA, 18 bp, Artificial Sequence
  Synthetic DNA
taacactattcacatttg

SEQ ID NO: 60221 - DNA, 18 bp, Artificial Sequence
  Synthetic DNA
taacacttcacacaaaag

SEQ ID NO: 60222 - DNA, 18 bp, Artificial Sequence
  Synthetic DNA
taacactttttaataatg

SEQ ID NO: 60223 - DNA, 18 bp, Artificial Sequence
  Synthetic DNA
taacagcactatcaatag

SEQ ID NO: 60224 - DNA, 18 bp, Artificial Sequence
  Synthetic DNA
taacaggaatcaacttgg

SEQ ID NO: 60225 - DNA, 18 bp, Artificial Sequence
  Synthetic DNA
taacaggatttaatattg

SEQ ID NO: 60226 - DNA, 18 bp, Artificial Sequence
  Synthetic DNA
taacaggtttctcgatag

SEQ ID NO: 60227 - DNA, 18 bp, Artificial Sequence
  Synthetic DNA
taacataaaaaccaatag

SEQ ID NO: 60228 - DNA, 18 bp, Artificial Sequence
  Synthetic DNA
taacataaatcacttcag

SEQ ID NO: 60229 - DNA, 18 bp, Artificial Sequence
  Synthetic DNA
taacataacactatttag

SEQ ID NO: 60230 - DNA, 18 bp, Artificial Sequence
  Synthetic DNA
taacatgactaaatagcg

SEQ ID NO: 60231 - DNA, 18 bp, Artificial Sequence
  Synthetic DNA
taacatgactctctaatg

SEQ ID NO: 60232 - DNA, 18 bp, Artificial Sequence
  Synthetic DNA
taacatgactctttattg

SEQ ID NO: 60233 - DNA, 18 bp, Artificial Sequence
  Synthetic DNA
taacatggctaactttag

SEQ ID NO: 60234 - DNA, 18 bp, Artificial Sequence
  Synthetic DNA
taacatgtctctcaatag

SEQ ID NO: 60235 - DNA, 18 bp, Artificial Sequence
  Synthetic DNA
taacccaactcactttcg

SEQ ID NO: 60236 - DNA, 18 bp, Artificial Sequence
  Synthetic DNA
taaccccactcacttcag

SEQ ID NO: 60237 - DNA, 18 bp, Artificial Sequence
  Synthetic DNA
taacccgacactctttag

SEQ ID NO: 60238 - DNA, 18 bp, Artificial Sequence
  Synthetic DNA
taacccgactcaattcag

SEQ ID NO: 60239 - DNA, 18 bp, Artificial Sequence
  Synthetic DNA
taacccgaggaactctag

SEQ ID NO: 60240 - DNA, 18 bp, Artificial Sequence
  Synthetic DNA
taacgcgaaacaatagag

SEQ ID NO: 60241 - DNA, 18 bp, Artificial Sequence
  Synthetic DNA
taacgcgacacaatattg

SEQ ID NO: 60242 - DNA, 18 bp, Artificial Sequence
  Synthetic DNA
taacgcgactaattattg

SEQ ID NO: 60243 - DNA, 18 bp, Artificial Sequence
  Synthetic DNA
taacgtcattccgaattg

SEQ ID NO: 60244 - DNA, 18 bp, Artificial Sequence
  Synthetic DNA
taacgtgattcacatatg

SEQ ID NO: 60245 - DNA, 18 bp, Artificial Sequence
  Synthetic DNA
taactcaacacacaatag

SEQ ID NO: 60246 - DNA, 18 bp, Artificial Sequence
  Synthetic DNA
taactccattcacaatag

SEQ ID NO: 60247 - DNA, 18 bp, Artificial Sequence
  Synthetic DNA
taactcctccaactttag

SEQ ID NO: 60248 - DNA, 18 bp, Artificial Sequence
  Synthetic DNA
taactcgaatcatttatg

SEQ ID NO: 60249 - DNA, 18 bp, Artificial Sequence
  Synthetic DNA
taactcgactcccttttg

SEQ ID NO: 60250 - DNA, 18 bp, Artificial Sequence
  Synthetic DNA
taactcgcctctgtatgg

SEQ ID NO: 60251 - DNA, 18 bp, Artificial Sequence
  Synthetic DNA
taactcgtctcttaatag

SEQ ID NO: 60252 - DNA, 18 bp, Artificial Sequence
  Synthetic DNA
taactctattcgttaaag

SEQ ID NO: 60253 - DNA, 18 bp, Artificial Sequence
  Synthetic DNA
taacttcactcactaagg

SEQ ID NO: 60254 - DNA, 18 bp, Artificial Sequence
  Synthetic DNA
taacttgactaattatgg

SEQ ID NO: 60255 - DNA, 18 bp, Artificial Sequence
  Synthetic DNA
taacttgattctcgttag

SEQ ID NO: 60256 - DNA, 18 bp, Artificial Sequence
  Synthetic DNA
taagaagactaacaagag

SEQ ID NO: 60257 - DNA, 18 bp, Artificial Sequence
  Synthetic DNA
taagaagactatctattg

SEQ ID NO: 60258 - DNA, 18 bp, Artificial Sequence
  Synthetic DNA
taagaagattcggtaaag

SEQ ID NO: 60259 - DNA, 18 bp, Artificial Sequence
  Synthetic DNA
taagaccacacattttag

SEQ ID NO: 60260 - DNA, 18 bp, Artificial Sequence
  Synthetic DNA
taagaccacggcctattg

SEQ ID NO: 60261 - DNA, 18 bp, Artificial Sequence
  Synthetic DNA
taagacgaatcaccaatg

SEQ ID NO: 60262 - DNA, 18 bp, Artificial Sequence
  Synthetic DNA
taagacgactcccctaag

SEQ ID NO: 60263 - DNA, 18 bp, Artificial Sequence
  Synthetic DNA
taagacgatactattcag

SEQ ID NO: 60264 - DNA, 18 bp, Artificial Sequence
  Synthetic DNA
taagacgttataatatgg

SEQ ID NO: 60265 - DNA, 18 bp, Artificial Sequence
  Synthetic DNA
taagactacactcaaaag

SEQ ID NO: 60266 - DNA, 18 bp, Artificial Sequence
  Synthetic DNA
taagactattcattttag

SEQ ID NO: 60267 - DNA, 18 bp, Artificial Sequence
  Synthetic DNA
taagagggcacacaatag

SEQ ID NO: 60268 - DNA, 18 bp, Artificial Sequence
  Synthetic DNA
taagatgaatcaccttag

SEQ ID NO: 60269 - DNA, 18 bp, Artificial Sequence
  Synthetic DNA
taaggcgtctaactacag

SEQ ID NO: 60270 - DNA, 18 bp, Artificial Sequence
  Synthetic DNA
taaggcgtctccctaaag

SEQ ID NO: 60271 - DNA, 18 bp, Artificial Sequence
  Synthetic DNA
taagtattctcactattg

SEQ ID NO: 60272 - DNA, 18 bp, Artificial Sequence
  Synthetic DNA
taagtcgtctaacataag

SEQ ID NO: 60273 - DNA, 18 bp, Artificial Sequence
  Synthetic DNA
taagtcgtcttcatttag

SEQ ID NO: 60274 - DNA, 18 bp, Artificial Sequence
  Synthetic DNA
taataaaacctacaatag

SEQ ID NO: 60275 - DNA, 18 bp, Artificial Sequence
  Synthetic DNA
taataaaactcacttatg

SEQ ID NO: 60276 - DNA, 18 bp, Artificial Sequence
  Synthetic DNA
taataaaacttcctttag

SEQ ID NO: 60277 - DNA, 18 bp, Artificial Sequence
  Synthetic DNA
taataaaattggctatag

SEQ ID NO: 60278 - DNA, 18 bp, Artificial Sequence
  Synthetic DNA
taataaatctcacgaaag

SEQ ID NO: 60279 - DNA, 18 bp, Artificial Sequence
  Synthetic DNA
taataacactccctaacg

SEQ ID NO: 60280 - DNA, 18 bp, Artificial Sequence
  Synthetic DNA
taataacacttattgtag

SEQ ID NO: 60281 - DNA, 18 bp, Artificial Sequence
  Synthetic DNA
taataagaacagctatag

SEQ ID NO: 60282 - DNA, 18 bp, Artificial Sequence
  Synthetic DNA
taataagaatcgctaatg

SEQ ID NO: 60283 - DNA, 18 bp, Artificial Sequence
  Synthetic DNA
taataagaattttcatag

SEQ ID NO: 60284 - DNA, 18 bp, Artificial Sequence
  Synthetic DNA
taataagacaaacaatcg

SEQ ID NO: 60285 - DNA, 18 bp, Artificial Sequence
  Synthetic DNA
taataagacattctattg

SEQ ID NO: 60286 - DNA, 18 bp, Artificial Sequence
  Synthetic DNA
taataagacattttatag

SEQ ID NO: 60287 - DNA, 18 bp, Artificial Sequence
  Synthetic DNA
taataagacgctcactag

SEQ ID NO: 60288 - DNA, 18 bp, Artificial Sequence
  Synthetic DNA
taataagactaacaaatg

SEQ ID NO: 60289 - DNA, 18 bp, Artificial Sequence
  Synthetic DNA
taataagactatctgttg

SEQ ID NO: 60290 - DNA, 18 bp, Artificial Sequence
  Synthetic DNA
taataagactttataaag

SEQ ID NO: 60291 - DNA, 18 bp, Artificial Sequence
  Synthetic DNA
taataagatacacatttg

SEQ ID NO: 60292 - DNA, 18 bp, Artificial Sequence
  Synthetic DNA
taataagatcataaaaag

SEQ ID NO: 60293 - DNA, 18 bp, Artificial Sequence
  Synthetic DNA
taataagattcacaaatg

SEQ ID NO: 60294 - DNA, 18 bp, Artificial Sequence
  Synthetic DNA
taataaggctctcaatcg

SEQ ID NO: 60295 - DNA, 18 bp, Artificial Sequence
  Synthetic DNA
taataagtacctcaatag

SEQ ID NO: 60296 - DNA, 18 bp, Artificial Sequence
  Synthetic DNA
taataagtcaaaatcaag

SEQ ID NO: 60297 - DNA, 18 bp, Artificial Sequence
  Synthetic DNA
taataagtcaacatatag

SEQ ID NO: 60298 - DNA, 18 bp, Artificial Sequence
  Synthetic DNA
taataagtctaacagtag

SEQ ID NO: 60299 - DNA, 18 bp, Artificial Sequence
  Synthetic DNA
taataatacccctaatag

SEQ ID NO: 60300 - DNA, 18 bp, Artificial Sequence
  Synthetic DNA
taataatactatccatag

SEQ ID NO: 60301 - DNA, 18 bp, Artificial Sequence
  Synthetic DNA
taataatactctctccag

SEQ ID NO: 60302 - DNA, 18 bp, Artificial Sequence
  Synthetic DNA
taataatactgtcgttag

SEQ ID NO: 60303 - DNA, 18 bp, Artificial Sequence
  Synthetic DNA
taataatagtcaggatgg

SEQ ID NO: 60304 - DNA, 18 bp, Artificial Sequence
  Synthetic DNA
taataatatacatttttg

SEQ ID NO: 60305 - DNA, 18 bp, Artificial Sequence
  Synthetic DNA
taataattccatccatcg

SEQ ID NO: 60306 - DNA, 18 bp, Artificial Sequence
  Synthetic DNA
taatacaaaacaatatgg

SEQ ID NO: 60307 - DNA, 18 bp, Artificial Sequence
  Synthetic DNA
taatacaaagccctctag

SEQ ID NO: 60308 - DNA, 18 bp, Artificial Sequence
  Synthetic DNA
taatacaaattccgatag

SEQ ID NO: 60309 - DNA, 18 bp, Artificial Sequence
  Synthetic DNA
taatacaacacacataag

SEQ ID NO: 60310 - DNA, 18 bp, Artificial Sequence
  Synthetic DNA
taatacaacactaggcag

SEQ ID NO: 60311 - DNA, 18 bp, Artificial Sequence
  Synthetic DNA
taatacaactacctaacg

SEQ ID NO: 60312 - DNA, 18 bp, Artificial Sequence
  Synthetic DNA
taatacaactctaaattg

SEQ ID NO: 60313 - DNA, 18 bp, Artificial Sequence
  Synthetic DNA
taatacaactctcggatg

SEQ ID NO: 60314 - DNA, 18 bp, Artificial Sequence
  Synthetic DNA
taatacacaacaatatag

SEQ ID NO: 60315 - DNA, 18 bp, Artificial Sequence
  Synthetic DNA
taatacacatcgctttcg

SEQ ID NO: 60316 - DNA, 18 bp, Artificial Sequence
  Synthetic DNA
taatacaccaacctatag

SEQ ID NO: 60317 - DNA, 18 bp, Artificial Sequence
  Synthetic DNA
taatacagcataatctag

SEQ ID NO: 60318 - DNA, 18 bp, Artificial Sequence
  Synthetic DNA
taatacagctcccattag

SEQ ID NO: 60319 - DNA, 18 bp, Artificial Sequence
  Synthetic DNA
taatacagctctcattag

SEQ ID NO: 60320 - DNA, 18 bp, Artificial Sequence
  Synthetic DNA
taatacaggacactctcg

SEQ ID NO: 60321 - DNA, 18 bp, Artificial Sequence
  Synthetic DNA
taatacagttcacaaaag

SEQ ID NO: 60322 - DNA, 18 bp, Artificial Sequence
  Synthetic DNA
taatacatcaaacttaag

SEQ ID NO: 60323 - DNA, 18 bp, Artificial Sequence
  Synthetic DNA
taatacatcaccatatag

SEQ ID NO: 60324 - DNA, 18 bp, Artificial Sequence
  Synthetic DNA
taatacatctcacttctg

SEQ ID NO: 60325 - DNA, 18 bp, Artificial Sequence
  Synthetic DNA
taatacatctcatttcag

SEQ ID NO: 60326 - DNA, 18 bp, Artificial Sequence
  Synthetic DNA
taatacatctcgctaccg

SEQ ID NO: 60327 - DNA, 18 bp, Artificial Sequence
  Synthetic DNA
taatacatctctattctg

SEQ ID NO: 60328 - DNA, 18 bp, Artificial Sequence
  Synthetic DNA
taatacatttatctatcg

SEQ ID NO: 60329 - DNA, 18 bp, Artificial Sequence
  Synthetic DNA
taatacatttccctattg

SEQ ID NO: 60330 - DNA, 18 bp, Artificial Sequence
  Synthetic DNA
taataccaaacacttttg

SEQ ID NO: 60331 - DNA, 18 bp, Artificial Sequence
  Synthetic DNA
taataccaatcctaattg

SEQ ID NO: 60332 - DNA, 18 bp, Artificial Sequence
  Synthetic DNA
taataccacacacataag

SEQ ID NO: 60333 - DNA, 18 bp, Artificial Sequence
  Synthetic DNA
taataccacagcgtaaag

SEQ ID NO: 60334 - DNA, 18 bp, Artificial Sequence
  Synthetic DNA
taataccactctattaag

SEQ ID NO: 60335 - DNA, 18 bp, Artificial Sequence
  Synthetic DNA
taataccagtcatcattg

SEQ ID NO: 60336 - DNA, 18 bp, Artificial Sequence
  Synthetic DNA
taataccagttcctattg

SEQ ID NO: 60337 - DNA, 18 bp, Artificial Sequence
  Synthetic DNA
taataccattgattattg

SEQ ID NO: 60338 - DNA, 18 bp, Artificial Sequence
  Synthetic DNA
taataccattggcaatag

SEQ ID NO: 60339 - DNA, 18 bp, Artificial Sequence
  Synthetic DNA
taataccatttgcaaaag

SEQ ID NO: 60340 - DNA, 18 bp, Artificial Sequence
  Synthetic DNA
taataccggtcctcatag

SEQ ID NO: 60341 - DNA, 18 bp, Artificial Sequence
  Synthetic DNA
taatacctctaaatacag

SEQ ID NO: 60342 - DNA, 18 bp, Artificial Sequence
  Synthetic DNA
taatacgaaacatcttag

SEQ ID NO: 60343 - DNA, 18 bp, Artificial Sequence
  Synthetic DNA
taatacgaaaccctcatg

SEQ ID NO: 60344 - DNA, 18 bp, Artificial Sequence
  Synthetic DNA
taatacgaattcaaatag

SEQ ID NO: 60345 - DNA, 18 bp, Artificial Sequence
  Synthetic DNA
taatacgacaaatttttg

SEQ ID NO: 60346 - DNA, 18 bp, Artificial Sequence
  Synthetic DNA
taatacgacaagctgacg

SEQ ID NO: 60347 - DNA, 18 bp, Artificial Sequence
  Synthetic DNA
taatacgacaatccatcg

SEQ ID NO: 60348 - DNA, 18 bp, Artificial Sequence
  Synthetic DNA
taatacgacgccgaaaag

SEQ ID NO: 60349 - DNA, 18 bp, Artificial Sequence
  Synthetic DNA
taatacgactctgatcag

SEQ ID NO: 60350 - DNA, 18 bp, Artificial Sequence
  Synthetic DNA
taatacgagattcaatgg

SEQ ID NO: 60351 - DNA, 18 bp, Artificial Sequence
  Synthetic DNA
taatacgagcttctccag

SEQ ID NO: 60352 - DNA, 18 bp, Artificial Sequence
  Synthetic DNA
taatacgagtgttctttg

SEQ ID NO: 60353 - DNA, 18 bp, Artificial Sequence
  Synthetic DNA
taatacgagtttttcttg

SEQ ID NO: 60354 - DNA, 18 bp, Artificial Sequence
  Synthetic DNA
taatacgatacaattaag

SEQ ID NO: 60355 - DNA, 18 bp, Artificial Sequence
  Synthetic DNA
taatacgatcacccagag

SEQ ID NO: 60356 - DNA, 18 bp, Artificial Sequence
  Synthetic DNA
taatacgatcgaatgtag

SEQ ID NO: 60357 - DNA, 18 bp, Artificial Sequence
  Synthetic DNA
taatacgattaacattgg

SEQ ID NO: 60358 - DNA, 18 bp, Artificial Sequence
  Synthetic DNA
taatacgattagttattg

SEQ ID NO: 60359 - DNA, 18 bp, Artificial Sequence
  Synthetic DNA
taatacgattctcctaag

SEQ ID NO: 60360 - DNA, 18 bp, Artificial Sequence
  Synthetic DNA
taatacgatttaacattg

SEQ ID NO: 60361 - DNA, 18 bp, Artificial Sequence
  Synthetic DNA
taatacgcatatgtatcg

SEQ ID NO: 60362 - DNA, 18 bp, Artificial Sequence
  Synthetic DNA
taatacgcatcattagtg

SEQ ID NO: 60363 - DNA, 18 bp, Artificial Sequence
  Synthetic DNA
taatacgcatctaagtag

SEQ ID NO: 60364 - DNA, 18 bp, Artificial Sequence
  Synthetic DNA
taatacgcattatcatag

SEQ ID NO: 60365 - DNA, 18 bp, Artificial Sequence
  Synthetic DNA
taatacgccacattgtcg

SEQ ID NO: 60366 - DNA, 18 bp, Artificial Sequence
  Synthetic DNA
taatacgccatacttaag

SEQ ID NO: 60367 - DNA, 18 bp, Artificial Sequence
  Synthetic DNA
taatacgcccaactcccg

SEQ ID NO: 60368 - DNA, 18 bp, Artificial Sequence
  Synthetic DNA
taatacgcgtctcattag

SEQ ID NO: 60369 - DNA, 18 bp, Artificial Sequence
  Synthetic DNA
taatacgcttcaaaattg

SEQ ID NO: 60370 - DNA, 18 bp, Artificial Sequence
  Synthetic DNA
taatacgcttcacttatg

SEQ ID NO: 60371 - DNA, 18 bp, Artificial Sequence
  Synthetic DNA
taatacgcttctgtaccg

SEQ ID NO: 60372 - DNA, 18 bp, Artificial Sequence
  Synthetic DNA
taatacggagcatgacag

SEQ ID NO: 60373 - DNA, 18 bp, Artificial Sequence
  Synthetic DNA
taatacggctagcaattg

SEQ ID NO: 60374 - DNA, 18 bp, Artificial Sequence
  Synthetic DNA
taatacggctatcattag

SEQ ID NO: 60375 - DNA, 18 bp, Artificial Sequence
  Synthetic DNA
taatacggcttttttaag

SEQ ID NO: 60376 - DNA, 18 bp, Artificial Sequence
  Synthetic DNA
taatacgggtaacctaag

SEQ ID NO: 60377 - DNA, 18 bp, Artificial Sequence
  Synthetic DNA
taatacggtacacaattg

SEQ ID NO: 60378 - DNA, 18 bp, Artificial Sequence
  Synthetic DNA
taatacgtaattctatag

SEQ ID NO: 60379 - DNA, 18 bp, Artificial Sequence
  Synthetic DNA
taatacgtatatcttttg

SEQ ID NO: 60380 - DNA, 18 bp, Artificial Sequence
  Synthetic DNA
taatacgtatgaatttag

SEQ ID NO: 60381 - DNA, 18 bp, Artificial Sequence
  Synthetic DNA
taatacgtcaaaataaag

SEQ ID NO: 60382 - DNA, 18 bp, Artificial Sequence
  Synthetic DNA
taatacgtcacactcatg

SEQ ID NO: 60383 - DNA, 18 bp, Artificial Sequence
  Synthetic DNA
taatacgtcacccattcg

SEQ ID NO: 60384 - DNA, 18 bp, Artificial Sequence
  Synthetic DNA
taatacgtcacttgaaag

SEQ ID NO: 60385 - DNA, 18 bp, Artificial Sequence
  Synthetic DNA
taatacgtccagctctag

SEQ ID NO: 60386 - DNA, 18 bp, Artificial Sequence
  Synthetic DNA
taatacgtcgtggtatcg

SEQ ID NO: 60387 - DNA, 18 bp, Artificial Sequence
  Synthetic DNA
taatacgtctaccggttg

SEQ ID NO: 60388 - DNA, 18 bp, Artificial Sequence
  Synthetic DNA
taatacgtctcaggaatg

SEQ ID NO: 60389 - DNA, 18 bp, Artificial Sequence
  Synthetic DNA
taatacgtgcttttatag

SEQ ID NO: 60390 - DNA, 18 bp, Artificial Sequence
  Synthetic DNA
taatacgtgtaagttttg

SEQ ID NO: 60391 - DNA, 18 bp, Artificial Sequence
  Synthetic DNA
taatacgtgtcaaatttg

SEQ ID NO: 60392 - DNA, 18 bp, Artificial Sequence
  Synthetic DNA
taatacgtttaaccattg

SEQ ID NO: 60393 - DNA, 18 bp, Artificial Sequence
  Synthetic DNA
taatacgtttaactgcgg

SEQ ID NO: 60394 - DNA, 18 bp, Artificial Sequence
  Synthetic DNA
taatacgtttgtctttcg

SEQ ID NO: 60395 - DNA, 18 bp, Artificial Sequence
  Synthetic DNA
taatactaaaaactattg

SEQ ID NO: 60396 - DNA, 18 bp, Artificial Sequence
  Synthetic DNA
taatactaatcatcctag

SEQ ID NO: 60397 - DNA, 18 bp, Artificial Sequence
  Synthetic DNA
taatactacaagcaatcg

SEQ ID NO: 60398 - DNA, 18 bp, Artificial Sequence
  Synthetic DNA
taatactacacattaagg

SEQ ID NO: 60399 - DNA, 18 bp, Artificial Sequence
  Synthetic DNA
taatactacactccattg

SEQ ID NO: 60400 - DNA, 18 bp, Artificial Sequence
  Synthetic DNA
taatactacatacgcaag

SEQ ID NO: 60401 - DNA, 18 bp, Artificial Sequence
  Synthetic DNA
taatactacccatacaag

SEQ ID NO: 60402 - DNA, 18 bp, Artificial Sequence
  Synthetic DNA
taatactaccttctagag

SEQ ID NO: 60403 - DNA, 18 bp, Artificial Sequence
  Synthetic DNA
taatactacgcatatttg

SEQ ID NO: 60404 - DNA, 18 bp, Artificial Sequence
  Synthetic DNA
taatactactcatctgtg

SEQ ID NO: 60405 - DNA, 18 bp, Artificial Sequence
  Synthetic DNA
taatactactccacaatg

SEQ ID NO: 60406 - DNA, 18 bp, Artificial Sequence
  Synthetic DNA
taatactactctcttatg

SEQ ID NO: 60407 - DNA, 18 bp, Artificial Sequence
  Synthetic DNA
taatactactgatcttgg

SEQ ID NO: 60408 - DNA, 18 bp, Artificial Sequence
  Synthetic DNA
taatactactggcaattg

SEQ ID NO: 60409 - DNA, 18 bp, Artificial Sequence
  Synthetic DNA
taatactacttaccctcg

SEQ ID NO: 60410 - DNA, 18 bp, Artificial Sequence
  Synthetic DNA
taatactagtctcaaaag

SEQ ID NO: 60411 - DNA, 18 bp, Artificial Sequence
  Synthetic DNA
taatactatcctcttgag

SEQ ID NO: 60412 - DNA, 18 bp, Artificial Sequence
  Synthetic DNA
taatactgatcactgtgg

SEQ ID NO: 60413 - DNA, 18 bp, Artificial Sequence
  Synthetic DNA
taatactgctcggttcag

SEQ ID NO: 60414 - DNA, 18 bp, Artificial Sequence
  Synthetic DNA
taatacttcactttcgag

SEQ ID NO: 60415 - DNA, 18 bp, Artificial Sequence
  Synthetic DNA
taatacttcagtttgtag

SEQ ID NO: 60416 - DNA, 18 bp, Artificial Sequence
  Synthetic DNA
taatacttctcaattttg

SEQ ID NO: 60417 - DNA, 18 bp, Artificial Sequence
  Synthetic DNA
taatacttctcccttaag

SEQ ID NO: 60418 - DNA, 18 bp, Artificial Sequence
  Synthetic DNA
taatacttctctttccag

SEQ ID NO: 60419 - DNA, 18 bp, Artificial Sequence
  Synthetic DNA
taatactttttaatatag

SEQ ID NO: 60420 - DNA, 18 bp, Artificial Sequence
  Synthetic DNA
taatagaattcacattag

SEQ ID NO: 60421 - DNA, 18 bp, Artificial Sequence
  Synthetic DNA
taatagaatttactaacg

SEQ ID NO: 60422 - DNA, 18 bp, Artificial Sequence
  Synthetic DNA
taatagacctccttctag

SEQ ID NO: 60423 - DNA, 18 bp, Artificial Sequence
  Synthetic DNA
taatagagctcacaattg

SEQ ID NO: 60424 - DNA, 18 bp, Artificial Sequence
  Synthetic DNA
taatagatcacacataag

SEQ ID NO: 60425 - DNA, 18 bp, Artificial Sequence
  Synthetic DNA
taatagctctgaatgtag

SEQ ID NO: 60426 - DNA, 18 bp, Artificial Sequence
  Synthetic DNA
taataggaatgttattgg

SEQ ID NO: 60427 - DNA, 18 bp, Artificial Sequence
  Synthetic DNA
taataggacacatcattg

SEQ ID NO: 60428 - DNA, 18 bp, Artificial Sequence
  Synthetic DNA
taataggacattctttgg

SEQ ID NO: 60429 - DNA, 18 bp, Artificial Sequence
  Synthetic DNA
taataggaccccttgtcg

SEQ ID NO: 60430 - DNA, 18 bp, Artificial Sequence
  Synthetic DNA
taataggacttaattgag

SEQ ID NO: 60431 - DNA, 18 bp, Artificial Sequence
  Synthetic DNA
taataggatacactaacg

SEQ ID NO: 60432 - DNA, 18 bp, Artificial Sequence
  Synthetic DNA
taataggcacctaaatag

SEQ ID NO: 60433 - DNA, 18 bp, Artificial Sequence
  Synthetic DNA
taataggcgtttcaattg

SEQ ID NO: 60434 - DNA, 18 bp, Artificial Sequence
  Synthetic DNA
taatagggcactatttag

SEQ ID NO: 60435 - DNA, 18 bp, Artificial Sequence
  Synthetic DNA
taataggtatgactttag

SEQ ID NO: 60436 - DNA, 18 bp, Artificial Sequence
  Synthetic DNA
taataggtcacaaaatgg

SEQ ID NO: 60437 - DNA, 18 bp, Artificial Sequence
  Synthetic DNA
taataggtctctccctag

SEQ ID NO: 60438 - DNA, 18 bp, Artificial Sequence
  Synthetic DNA
taataggttacactaatg

SEQ ID NO: 60439 - DNA, 18 bp, Artificial Sequence
  Synthetic DNA
taataggtttcactttcg

SEQ ID NO: 60440 - DNA, 18 bp, Artificial Sequence
  Synthetic DNA
taatagtaattacttttg

SEQ ID NO: 60441 - DNA, 18 bp, Artificial Sequence
  Synthetic DNA
taatagtacacagattag

SEQ ID NO: 60442 - DNA, 18 bp, Artificial Sequence
  Synthetic DNA
taatagtactcacctaag

SEQ ID NO: 60443 - DNA, 18 bp, Artificial Sequence
  Synthetic DNA
taatagtcctgattattg

SEQ ID NO: 60444 - DNA, 18 bp, Artificial Sequence
  Synthetic DNA
taatagttcttattaaag

SEQ ID NO: 60445 - DNA, 18 bp, Artificial Sequence
  Synthetic DNA
taatataacacacaaaag

SEQ ID NO: 60446 - DNA, 18 bp, Artificial Sequence
  Synthetic DNA
taatataactcacctttg

SEQ ID NO: 60447 - DNA, 18 bp, Artificial Sequence
  Synthetic DNA
taatatagccaactgaag

SEQ ID NO: 60448 - DNA, 18 bp, Artificial Sequence
  Synthetic DNA
taatatcacatattatag

SEQ ID NO: 60449 - DNA, 18 bp, Artificial Sequence
  Synthetic DNA
taatatccctccctagag

SEQ ID NO: 60450 - DNA, 18 bp, Artificial Sequence
  Synthetic DNA
taatatctttaactatag

SEQ ID NO: 60451 - DNA, 18 bp, Artificial Sequence
  Synthetic DNA
taatatgaattattaaag

SEQ ID NO: 60452 - DNA, 18 bp, Artificial Sequence
  Synthetic DNA
taatatgacaatatatag

SEQ ID NO: 60453 - DNA, 18 bp, Artificial Sequence
  Synthetic DNA
taatatgacacagtaatg

SEQ ID NO: 60454 - DNA, 18 bp, Artificial Sequence
  Synthetic DNA
taatatgacacatattag

SEQ ID NO: 60455 - DNA, 18 bp, Artificial Sequence
  Synthetic DNA
taatatgactcccaccag

SEQ ID NO: 60456 - DNA, 18 bp, Artificial Sequence
  Synthetic DNA
taatatgactcctttaag

SEQ ID NO: 60457 - DNA, 18 bp, Artificial Sequence
  Synthetic DNA
taatatgactcttactag

SEQ ID NO: 60458 - DNA, 18 bp, Artificial Sequence
  Synthetic DNA
taatatgattctcaagag

SEQ ID NO: 60459 - DNA, 18 bp, Artificial Sequence
  Synthetic DNA
taatatgcatgacattgg

SEQ ID NO: 60460 - DNA, 18 bp, Artificial Sequence
  Synthetic DNA
taatatggctctcaaatg

SEQ ID NO: 60461 - DNA, 18 bp, Artificial Sequence
  Synthetic DNA
taatatgtaactctatag

SEQ ID NO: 60462 - DNA, 18 bp, Artificial Sequence
  Synthetic DNA
taatatgtataacttagg

SEQ ID NO: 60463 - DNA, 18 bp, Artificial Sequence
  Synthetic DNA
taatatgtcaatctaaag

SEQ ID NO: 60464 - DNA, 18 bp, Artificial Sequence
  Synthetic DNA
taatatgtcacctaatag

SEQ ID NO: 60465 - DNA, 18 bp, Artificial Sequence
  Synthetic DNA
taatatgtctaactctcg

SEQ ID NO: 60466 - DNA, 18 bp, Artificial Sequence
  Synthetic DNA
taatatgtctcttaatag

SEQ ID NO: 60467 - DNA, 18 bp, Artificial Sequence
  Synthetic DNA
taatatgtcttaccgaag

SEQ ID NO: 60468 - DNA, 18 bp, Artificial Sequence
  Synthetic DNA
taatatgttacacaatag

SEQ ID NO: 60469 - DNA, 18 bp, Artificial Sequence
  Synthetic DNA
taatattacattctattg

SEQ ID NO: 60470 - DNA, 18 bp, Artificial Sequence
  Synthetic DNA
taatattactaaaggttg

SEQ ID NO: 60471 - DNA, 18 bp, Artificial Sequence
  Synthetic DNA
taatattactttgtttag

SEQ ID NO: 60472 - DNA, 18 bp, Artificial Sequence
  Synthetic DNA
taatattagttagaatag

SEQ ID NO: 60473 - DNA, 18 bp, Artificial Sequence
  Synthetic DNA
taatattctccacaattg

SEQ ID NO: 60474 - DNA, 18 bp, Artificial Sequence
  Synthetic DNA
taatatttctcattatgg

SEQ ID NO: 60475 - DNA, 18 bp, Artificial Sequence
  Synthetic DNA
taatcagaatcgttaaag

SEQ ID NO: 60476 - DNA, 18 bp, Artificial Sequence
  Synthetic DNA
taatcagatttaaaatag

SEQ ID NO: 60477 - DNA, 18 bp, Artificial Sequence
  Synthetic DNA
taatcaggctcaccgtag

SEQ ID NO: 60478 - DNA, 18 bp, Artificial Sequence
  Synthetic DNA
taatcagtcccacctaag

SEQ ID NO: 60479 - DNA, 18 bp, Artificial Sequence
  Synthetic DNA
taatcagtttcccactag

SEQ ID NO: 60480 - DNA, 18 bp, Artificial Sequence
  Synthetic DNA
taatccatttcattatag

SEQ ID NO: 60481 - DNA, 18 bp, Artificial Sequence
  Synthetic DNA
taatcccactttatatag

SEQ ID NO: 60482 - DNA, 18 bp, Artificial Sequence
  Synthetic DNA
taatcccattcacttaag

SEQ ID NO: 60483 - DNA, 18 bp, Artificial Sequence
  Synthetic DNA
taatccccaccactttag

SEQ ID NO: 60484 - DNA, 18 bp, Artificial Sequence
  Synthetic DNA
taatccctcactctatag

SEQ ID NO: 60485 - DNA, 18 bp, Artificial Sequence
  Synthetic DNA
taatccgaaacactaatg

SEQ ID NO: 60486 - DNA, 18 bp, Artificial Sequence
  Synthetic DNA
taatccgacaatcttacg

SEQ ID NO: 60487 - DNA, 18 bp, Artificial Sequence
  Synthetic DNA
taatccgacactgaagtg

SEQ ID NO: 60488 - DNA, 18 bp, Artificial Sequence
  Synthetic DNA
taatccgactcaacaagg

SEQ ID NO: 60489 - DNA, 18 bp, Artificial Sequence
  Synthetic DNA
taatccgattctctaatg

SEQ ID NO: 60490 - DNA, 18 bp, Artificial Sequence
  Synthetic DNA
taatccgatttaacatag

SEQ ID NO: 60491 - DNA, 18 bp, Artificial Sequence
  Synthetic DNA
taatccgccacaccccag

SEQ ID NO: 60492 - DNA, 18 bp, Artificial Sequence
  Synthetic DNA
taatccgtatcaccatcg

SEQ ID NO: 60493 - DNA, 18 bp, Artificial Sequence
  Synthetic DNA
taatccgtatcatttaag

SEQ ID NO: 60494 - DNA, 18 bp, Artificial Sequence
  Synthetic DNA
taatccgtcactctagtg

SEQ ID NO: 60495 - DNA, 18 bp, Artificial Sequence
  Synthetic DNA
taatccgtcagacaatag

SEQ ID NO: 60496 - DNA, 18 bp, Artificial Sequence
  Synthetic DNA
taatccgtccaccaatcg

SEQ ID NO: 60497 - DNA, 18 bp, Artificial Sequence
  Synthetic DNA
taatccgtctcgaagtag

SEQ ID NO: 60498 - DNA, 18 bp, Artificial Sequence
  Synthetic DNA
taatcctacccgatatag

SEQ ID NO: 60499 - DNA, 18 bp, Artificial Sequence
  Synthetic DNA
taatcctactggttatag

SEQ ID NO: 60500 - DNA, 18 bp, Artificial Sequence
  Synthetic DNA
taatcctcccaacttttg

SEQ ID NO: 60501 - DNA, 18 bp, Artificial Sequence
  Synthetic DNA
taatcctgcgcaatatag

SEQ ID NO: 60502 - DNA, 18 bp, Artificial Sequence
  Synthetic DNA
taatcctgctttcaatag

SEQ ID NO: 60503 - DNA, 18 bp, Artificial Sequence
  Synthetic DNA
taatcctgtacaccacag

SEQ ID NO: 60504 - DNA, 18 bp, Artificial Sequence
  Synthetic DNA
taatccttctcactccag

SEQ ID NO: 60505 - DNA, 18 bp, Artificial Sequence
  Synthetic DNA
taatcgaacacacttttg

SEQ ID NO: 60506 - DNA, 18 bp, Artificial Sequence
  Synthetic DNA
taatcggacactccattg

SEQ ID NO: 60507 - DNA, 18 bp, Artificial Sequence
  Synthetic DNA
taatcggtctcacaaaag

SEQ ID NO: 60508 - DNA, 18 bp, Artificial Sequence
  Synthetic DNA
taatcgttcttactatag

SEQ ID NO: 60509 - DNA, 18 bp, Artificial Sequence
  Synthetic DNA
taatctaactacctatag

SEQ ID NO: 60510 - DNA, 18 bp, Artificial Sequence
  Synthetic DNA
taatctgaatctttatag

SEQ ID NO: 60511 - DNA, 18 bp, Artificial Sequence
  Synthetic DNA
taatcttactcactgttg

SEQ ID NO: 60512 - DNA, 18 bp, Artificial Sequence
  Synthetic DNA
taatgagagtgataactg

SEQ ID NO: 60513 - DNA, 18 bp, Artificial Sequence
  Synthetic DNA
taatgaggcaatctatag

SEQ ID NO: 60514 - DNA, 18 bp, Artificial Sequence
  Synthetic DNA
taatgaggttgagtatag

SEQ ID NO: 60515 - DNA, 18 bp, Artificial Sequence
  Synthetic DNA
taatgagtctttcaatag

SEQ ID NO: 60516 - DNA, 18 bp, Artificial Sequence
  Synthetic DNA
taatgcatctatctatag

SEQ ID NO: 60517 - DNA, 18 bp, Artificial Sequence
  Synthetic DNA
taatgccactcccaattg

SEQ ID NO: 60518 - DNA, 18 bp, Artificial Sequence
  Synthetic DNA
taatgccattcaaattag

SEQ ID NO: 60519 - DNA, 18 bp, Artificial Sequence
  Synthetic DNA
taatgccattctctttag

SEQ ID NO: 60520 - DNA, 18 bp, Artificial Sequence
  Synthetic DNA
taatgcgacaaacacaag

SEQ ID NO: 60521 - DNA, 18 bp, Artificial Sequence
  Synthetic DNA
taatgcgacccaaaattg

SEQ ID NO: 60522 - DNA, 18 bp, Artificial Sequence
  Synthetic DNA
taatgcgactaaagagag

SEQ ID NO: 60523 - DNA, 18 bp, Artificial Sequence
  Synthetic DNA
taatgcgactcgattttg

SEQ ID NO: 60524 - DNA, 18 bp, Artificial Sequence
  Synthetic DNA
taatgcgactcgccgttg

SEQ ID NO: 60525 - DNA, 18 bp, Artificial Sequence
  Synthetic DNA
taatgcgacttgcaatcg

SEQ ID NO: 60526 - DNA, 18 bp, Artificial Sequence
  Synthetic DNA
taatgcgattttctaaag

SEQ ID NO: 60527 - DNA, 18 bp, Artificial Sequence
  Synthetic DNA
taatgcgccactcaacag

SEQ ID NO: 60528 - DNA, 18 bp, Artificial Sequence
  Synthetic DNA
taatgcgctacactttag

SEQ ID NO: 60529 - DNA, 18 bp, Artificial Sequence
  Synthetic DNA
taatgcggcactcttttg

SEQ ID NO: 60530 - DNA, 18 bp, Artificial Sequence
  Synthetic DNA
taatgcggcttacgaatg

SEQ ID NO: 60531 - DNA, 18 bp, Artificial Sequence
  Synthetic DNA
taatgcgtatcattgcag

SEQ ID NO: 60532 - DNA, 18 bp, Artificial Sequence
  Synthetic DNA
taatgcgtctatccacgg

SEQ ID NO: 60533 - DNA, 18 bp, Artificial Sequence
  Synthetic DNA
taatgcgtctcaaaacag

SEQ ID NO: 60534 - DNA, 18 bp, Artificial Sequence
  Synthetic DNA
taatgcgtctctctactg

SEQ ID NO: 60535 - DNA, 18 bp, Artificial Sequence
  Synthetic DNA
taatgctacacattctag

SEQ ID NO: 60536 - DNA, 18 bp, Artificial Sequence
  Synthetic DNA
taatgctactctctttgg

SEQ ID NO: 60537 - DNA, 18 bp, Artificial Sequence
  Synthetic DNA
taatggcactcactcaag

SEQ ID NO: 60538 - DNA, 18 bp, Artificial Sequence
  Synthetic DNA
taatgtgactccgattag

SEQ ID NO: 60539 - DNA, 18 bp, Artificial Sequence
  Synthetic DNA
taatgtgactttttatag

SEQ ID NO: 60540 - DNA, 18 bp, Artificial Sequence
  Synthetic DNA
taattaatgttactatgg

SEQ ID NO: 60541 - DNA, 18 bp, Artificial Sequence
  Synthetic DNA
taattacacgcaatatag

SEQ ID NO: 60542 - DNA, 18 bp, Artificial Sequence
  Synthetic DNA
taattagaactacaatcg

SEQ ID NO: 60543 - DNA, 18 bp, Artificial Sequence
  Synthetic DNA
taattagaatcaatattg

SEQ ID NO: 60544 - DNA, 18 bp, Artificial Sequence
  Synthetic DNA
taattagactctatttag

SEQ ID NO: 60545 - DNA, 18 bp, Artificial Sequence
  Synthetic DNA
taattagactgtctaatg

SEQ ID NO: 60546 - DNA, 18 bp, Artificial Sequence
  Synthetic DNA
taattagatttaatatag

SEQ ID NO: 60547 - DNA, 18 bp, Artificial Sequence
  Synthetic DNA
taattagcctcaatctag

SEQ ID NO: 60548 - DNA, 18 bp, Artificial Sequence
  Synthetic DNA
taattagcctctcatttg

SEQ ID NO: 60549 - DNA, 18 bp, Artificial Sequence
  Synthetic DNA
taattagcgtctcattag

SEQ ID NO: 60550 - DNA, 18 bp, Artificial Sequence
  Synthetic DNA
taattcaaattgctatag

SEQ ID NO: 60551 - DNA, 18 bp, Artificial Sequence
  Synthetic DNA
taattcaacgccgtatag

SEQ ID NO: 60552 - DNA, 18 bp, Artificial Sequence
  Synthetic DNA
taattcaactcgttattg

SEQ ID NO: 60553 - DNA, 18 bp, Artificial Sequence
  Synthetic DNA
taattcaactctctactg

SEQ ID NO: 60554 - DNA, 18 bp, Artificial Sequence
  Synthetic DNA
taattcaatactctatag

SEQ ID NO: 60555 - DNA, 18 bp, Artificial Sequence
  Synthetic DNA
taattcaattgtctatag

SEQ ID NO: 60556 - DNA, 18 bp, Artificial Sequence
  Synthetic DNA
taattccaaacactgtag

SEQ ID NO: 60557 - DNA, 18 bp, Artificial Sequence
  Synthetic DNA
taattccaatctctatcg

SEQ ID NO: 60558 - DNA, 18 bp, Artificial Sequence
  Synthetic DNA
taattccacacacttatg

SEQ ID NO: 60559 - DNA, 18 bp, Artificial Sequence
  Synthetic DNA
taattccacccacttttg

SEQ ID NO: 60560 - DNA, 18 bp, Artificial Sequence
  Synthetic DNA
taattccatccactctcg

SEQ ID NO: 60561 - DNA, 18 bp, Artificial Sequence
  Synthetic DNA
taattccattcgctgttg

SEQ ID NO: 60562 - DNA, 18 bp, Artificial Sequence
  Synthetic DNA
taattcgaatagcaaaag

SEQ ID NO: 60563 - DNA, 18 bp, Artificial Sequence
  Synthetic DNA
taattcgacaaacttaag

SEQ ID NO: 60564 - DNA, 18 bp, Artificial Sequence
  Synthetic DNA
taattcgacactatagcg

SEQ ID NO: 60565 - DNA, 18 bp, Artificial Sequence
  Synthetic DNA
taattcgacataatcgag

SEQ ID NO: 60566 - DNA, 18 bp, Artificial Sequence
  Synthetic DNA
taattcgacgctatacag

SEQ ID NO: 60567 - DNA, 18 bp, Artificial Sequence
  Synthetic DNA
taattcgacgtagtaaag

SEQ ID NO: 60568 - DNA, 18 bp, Artificial Sequence
  Synthetic DNA
taattcgactaacaactg

SEQ ID NO: 60569 - DNA, 18 bp, Artificial Sequence
  Synthetic DNA
taattcgactctattctg

SEQ ID NO: 60570 - DNA, 18 bp, Artificial Sequence
  Synthetic DNA
taattcgactctcataag

SEQ ID NO: 60571 - DNA, 18 bp, Artificial Sequence
  Synthetic DNA
taattcgactctcttata

SEQ ID NO: 60572 - DNA, 18 bp, Artificial Sequence
  Synthetic DNA
taattcgagaaactttag

SEQ ID NO: 60573 - DNA, 18 bp, Artificial Sequence
  Synthetic DNA
taattcgataatatatag

SEQ ID NO: 60574 - DNA, 18 bp, Artificial Sequence
  Synthetic DNA
taattcgattcacaaccg

SEQ ID NO: 60575 - DNA, 18 bp, Artificial Sequence
  Synthetic DNA
taattcgattctttgaag

SEQ ID NO: 60576 - DNA, 18 bp, Artificial Sequence
  Synthetic DNA
taattcgattttcaatag

SEQ ID NO: 60577 - DNA, 18 bp, Artificial Sequence
  Synthetic DNA
taattcgcatcactaatg

SEQ ID NO: 60578 - DNA, 18 bp, Artificial Sequence
  Synthetic DNA
taattcgccccattatcg

SEQ ID NO: 60579 - DNA, 18 bp, Artificial Sequence
  Synthetic DNA
taattcgcctatcgttag

SEQ ID NO: 60580 - DNA, 18 bp, Artificial Sequence
  Synthetic DNA
taattcgcgtcacattag

SEQ ID NO: 60581 - DNA, 18 bp, Artificial Sequence
  Synthetic DNA
taattcgcttctcgatag

SEQ ID NO: 60582 - DNA, 18 bp, Artificial Sequence
  Synthetic DNA
taattcggaatgctctag

SEQ ID NO: 60583 - DNA, 18 bp, Artificial Sequence
  Synthetic DNA
taattcggctcacgaagg

SEQ ID NO: 60584 - DNA, 18 bp, Artificial Sequence
  Synthetic DNA
taattcggctccaactag

SEQ ID NO: 60585 - DNA, 18 bp, Artificial Sequence
  Synthetic DNA
taattcgtatttccatag

SEQ ID NO: 60586 - DNA, 18 bp, Artificial Sequence
  Synthetic DNA
taattcgtcacaatttag

SEQ ID NO: 60587 - DNA, 18 bp, Artificial Sequence
  Synthetic DNA
taattcgtcactcattag

SEQ ID NO: 60588 - DNA, 18 bp, Artificial Sequence
  Synthetic DNA
taattcgtcataccttag

SEQ ID NO: 60589 - DNA, 18 bp, Artificial Sequence
  Synthetic DNA
taattcgtcgcaccattg

SEQ ID NO: 60590 - DNA, 18 bp, Artificial Sequence
  Synthetic DNA
taattcgtctcacttctg

SEQ ID NO: 60591 - DNA, 18 bp, Artificial Sequence
  Synthetic DNA
taattcgtctcataattg

SEQ ID NO: 60592 - DNA, 18 bp, Artificial Sequence
  Synthetic DNA
taattcgtcttatattag

SEQ ID NO: 60593 - DNA, 18 bp, Artificial Sequence
  Synthetic DNA
taattcgtgtaacttttg

SEQ ID NO: 60594 - DNA, 18 bp, Artificial Sequence
  Synthetic DNA
taattcgtttcaaaatag

SEQ ID NO: 60595 - DNA, 18 bp, Artificial Sequence
  Synthetic DNA
taattcgtttcgctaaag

SEQ ID NO: 60596 - DNA, 18 bp, Artificial Sequence
  Synthetic DNA
taattctaaattcaatag

SEQ ID NO: 60597 - DNA, 18 bp, Artificial Sequence
  Synthetic DNA
taattctacgctctttag

SEQ ID NO: 60598 - DNA, 18 bp, Artificial Sequence
  Synthetic DNA
taattctactcattaccg

SEQ ID NO: 60599 - DNA, 18 bp, Artificial Sequence
  Synthetic DNA
taattctactttctctag

SEQ ID NO: 60600 - DNA, 18 bp, Artificial Sequence
  Synthetic DNA
taattctagccacaatag

SEQ ID NO: 60601 - DNA, 18 bp, Artificial Sequence
  Synthetic DNA
taattctagtcattattg

SEQ ID NO: 60602 - DNA, 18 bp, Artificial Sequence
  Synthetic DNA
taattctattcattaaag

SEQ ID NO: 60603 - DNA, 18 bp, Artificial Sequence
  Synthetic DNA
taattctcctcacactgg

SEQ ID NO: 60604 - DNA, 18 bp, Artificial Sequence
  Synthetic DNA
taattcttatcaatatag

SEQ ID NO: 60605 - DNA, 18 bp, Artificial Sequence
  Synthetic DNA
taattcttatctccctag

SEQ ID NO: 60606 - DNA, 18 bp, Artificial Sequence
  Synthetic DNA
taattcttcccaaaatag

SEQ ID NO: 60607 - DNA, 18 bp, Artificial Sequence
  Synthetic DNA
taattgatctcatgtaag

SEQ ID NO: 60608 - DNA, 18 bp, Artificial Sequence
  Synthetic DNA
taattgctctcgccttag

SEQ ID NO: 60609 - DNA, 18 bp, Artificial Sequence
  Synthetic DNA
taattggacttatagaag

SEQ ID NO: 60610 - DNA, 18 bp, Artificial Sequence
  Synthetic DNA
taattggggacaatatag

SEQ ID NO: 60611 - DNA, 18 bp, Artificial Sequence
  Synthetic DNA
taattggtctcattttag

SEQ ID NO: 60612 - DNA, 18 bp, Artificial Sequence
  Synthetic DNA
taatttaactccctttag

SEQ ID NO: 60613 - DNA, 18 bp, Artificial Sequence
  Synthetic DNA
taatttgaatcactaatg

SEQ ID NO: 60614 - DNA, 18 bp, Artificial Sequence
  Synthetic DNA
taatttgacacattatcg

SEQ ID NO: 60615 - DNA, 18 bp, Artificial Sequence
  Synthetic DNA
taatttgtcttactaaag

SEQ ID NO: 60616 - DNA, 18 bp, Artificial Sequence
  Synthetic DNA
taattttacactcaaccg

SEQ ID NO: 60617 - DNA, 18 bp, Artificial Sequence
  Synthetic DNA
taattttactctcaatag

SEQ ID NO: 60618 - DNA, 18 bp, Artificial Sequence
  Synthetic DNA
tacaacaagtctgtttag

SEQ ID NO: 60619 - DNA, 18 bp, Artificial Sequence
  Synthetic DNA
tacaaccactcacttctg

SEQ ID NO: 60620 - DNA, 18 bp, Artificial Sequence
  Synthetic DNA
tacaaccactcgatttag

SEQ ID NO: 60621 - DNA, 18 bp, Artificial Sequence
  Synthetic DNA
tacaacggtttactagag

SEQ ID NO: 60622 - DNA, 18 bp, Artificial Sequence
  Synthetic DNA
tacaatgtctcattattg

SEQ ID NO: 60623 - DNA, 18 bp, Artificial Sequence
  Synthetic DNA
tacaatttccctaactag

SEQ ID NO: 60624 - DNA, 18 bp, Artificial Sequence
  Synthetic DNA
tacaccgaattaacatag

SEQ ID NO: 60625 - DNA, 18 bp, Artificial Sequence
  Synthetic DNA
tacattgactctctttag

SEQ ID NO: 60626 - DNA, 18 bp, Artificial Sequence
  Synthetic DNA
tacatttattcactatag

SEQ ID NO: 60627 - DNA, 18 bp, Artificial Sequence
  Synthetic DNA
taccaccgctcactagag

SEQ ID NO: 60628 - DNA, 18 bp, Artificial Sequence
  Synthetic DNA
taccacctctccctatag

SEQ ID NO: 60629 - DNA, 18 bp, Artificial Sequence
  Synthetic DNA
taccacgacaaactcttg

SEQ ID NO: 60630 - DNA, 18 bp, Artificial Sequence
  Synthetic DNA
taccacgacacacaatcg

SEQ ID NO: 60631 - DNA, 18 bp, Artificial Sequence
  Synthetic DNA
taccactacccactttag

SEQ ID NO: 60632 - DNA, 18 bp, Artificial Sequence
  Synthetic DNA
taccagtactcagttaag

SEQ ID NO: 60633 - DNA, 18 bp, Artificial Sequence
  Synthetic DNA
taccatgactctctaaag

SEQ ID NO: 60634 - DNA, 18 bp, Artificial Sequence
  Synthetic DNA
taccatgtctaactaaag

SEQ ID NO: 60635 - DNA, 18 bp, Artificial Sequence
  Synthetic DNA
tacctcgaaaaactcaag

SEQ ID NO: 60636 - DNA, 18 bp, Artificial Sequence
  Synthetic DNA
tacctcgacccactgaag

SEQ ID NO: 60637 - DNA, 18 bp, Artificial Sequence
  Synthetic DNA
tacgtcaactatctatag

SEQ ID NO: 60638 - DNA, 18 bp, Artificial Sequence
  Synthetic DNA
tactaaaagttactacag

SEQ ID NO: 60639 - DNA, 18 bp, Artificial Sequence
  Synthetic DNA
tactaaaccacaaaatag

SEQ ID NO: 60640 - DNA, 18 bp, Artificial Sequence
  Synthetic DNA
tactaacactaactgtag

SEQ ID NO: 60641 - DNA, 18 bp, Artificial Sequence
  Synthetic DNA
tactaagaaatactattg

SEQ ID NO: 60642 - DNA, 18 bp, Artificial Sequence
  Synthetic DNA
tactaagactcacgaatg

SEQ ID NO: 60643 - DNA, 18 bp, Artificial Sequence
  Synthetic DNA
tactaagactcacttatg

SEQ ID NO: 60644 - DNA, 18 bp, Artificial Sequence
  Synthetic DNA
tactaaggctcatgacag

SEQ ID NO: 60645 - DNA, 18 bp, Artificial Sequence
  Synthetic DNA
tactaagtctaactaaag

SEQ ID NO: 60646 - DNA, 18 bp, Artificial Sequence
  Synthetic DNA
tactacaacaccatttcg

SEQ ID NO: 60647 - DNA, 18 bp, Artificial Sequence
  Synthetic DNA
tactacaaccttctaaag

SEQ ID NO: 60648 - DNA, 18 bp, Artificial Sequence
  Synthetic DNA
tactacaactcaagttag

SEQ ID NO: 60649 - DNA, 18 bp, Artificial Sequence
  Synthetic DNA
tactacagccgactatag

SEQ ID NO: 60650 - DNA, 18 bp, Artificial Sequence
  Synthetic DNA
tactacatctctgtatag

SEQ ID NO: 60651 - DNA, 18 bp, Artificial Sequence
  Synthetic DNA
tactaccacacaccagag

SEQ ID NO: 60652 - DNA, 18 bp, Artificial Sequence
  Synthetic DNA
tactacgaatctcttgag

SEQ ID NO: 60653 - DNA, 18 bp, Artificial Sequence
  Synthetic DNA
tactacgacagtctaaag

SEQ ID NO: 60654 - DNA, 18 bp, Artificial Sequence
  Synthetic DNA
tactacgactctcagttg

SEQ ID NO: 60655 - DNA, 18 bp, Artificial Sequence
  Synthetic DNA
tactacgactgagcttag

SEQ ID NO: 60656 - DNA, 18 bp, Artificial Sequence
  Synthetic DNA
tactacgacttagactgg

SEQ ID NO: 60657 - DNA, 18 bp, Artificial Sequence
  Synthetic DNA
tactacgattaacatttg

SEQ ID NO: 60658 - DNA, 18 bp, Artificial Sequence
  Synthetic DNA
tactacgattaactcttg

SEQ ID NO: 60659 - DNA, 18 bp, Artificial Sequence
  Synthetic DNA
tactacgcctaggtatag

SEQ ID NO: 60660 - DNA, 18 bp, Artificial Sequence
  Synthetic DNA
tactacggccctttgtag

SEQ ID NO: 60661 - DNA, 18 bp, Artificial Sequence
  Synthetic DNA
tactacgtattcctatag

SEQ ID NO: 60662 - DNA, 18 bp, Artificial Sequence
  Synthetic DNA
tactacgttaaactatag

SEQ ID NO: 60663 - DNA, 18 bp, Artificial Sequence
  Synthetic DNA
tactacgttttactatcg

SEQ ID NO: 60664 - DNA, 18 bp, Artificial Sequence
  Synthetic DNA
tactactagtccctattg

SEQ ID NO: 60665 - DNA, 18 bp, Artificial Sequence
  Synthetic DNA
tactacttcacacaatcg

SEQ ID NO: 60666 - DNA, 18 bp, Artificial Sequence
  Synthetic DNA
tactacttctaacaacaa

SEQ ID NO: 60667 - DNA, 18 bp, Artificial Sequence
  Synthetic DNA
tactaggacactctaaag

SEQ ID NO: 60668 - DNA, 18 bp, Artificial Sequence
  Synthetic DNA
tactaggttacatacttg

SEQ ID NO: 60669 - DNA, 18 bp, Artificial Sequence
  Synthetic DNA
tactagttatcactgagg

SEQ ID NO: 60670 - DNA, 18 bp, Artificial Sequence
  Synthetic DNA
tactataagtgattatag

SEQ ID NO: 60671 - DNA, 18 bp, Artificial Sequence
  Synthetic DNA
tactatcacacactttag

SEQ ID NO: 60672 - DNA, 18 bp, Artificial Sequence
  Synthetic DNA
tactatgactcatcaaag

SEQ ID NO: 60673 - DNA, 18 bp, Artificial Sequence
  Synthetic DNA
tactatgactcccttatg

SEQ ID NO: 60674 - DNA, 18 bp, Artificial Sequence
  Synthetic DNA
tactatgcatgtctagag

SEQ ID NO: 60675 - DNA, 18 bp, Artificial Sequence
  Synthetic DNA
tactatggctcactactg

SEQ ID NO: 60676 - DNA, 18 bp, Artificial Sequence
  Synthetic DNA
tactatgtctcagtaaag

SEQ ID NO: 60677 - DNA, 18 bp, Artificial Sequence
  Synthetic DNA
tactatgtcttctaatag

SEQ ID NO: 60678 - DNA, 18 bp, Artificial Sequence
  Synthetic DNA
tactattacacgctaaag

SEQ ID NO: 60679 - DNA, 18 bp, Artificial Sequence
  Synthetic DNA
tactattgcatctttaag

SEQ ID NO: 60680 - DNA, 18 bp, Artificial Sequence
  Synthetic DNA
tactcagacttaccatag

SEQ ID NO: 60681 - DNA, 18 bp, Artificial Sequence
  Synthetic DNA
tactcatgctcactattg

SEQ ID NO: 60682 - DNA, 18 bp, Artificial Sequence
  Synthetic DNA
tactctaacttactgtag

SEQ ID NO: 60683 - DNA, 18 bp, Artificial Sequence
  Synthetic DNA
tactgcatctctctatag

SEQ ID NO: 60684 - DNA, 18 bp, Artificial Sequence
  Synthetic DNA
tactgccaccctctttag

SEQ ID NO: 60685 - DNA, 18 bp, Artificial Sequence
  Synthetic DNA
tactgcgactcacaaatg

SEQ ID NO: 60686 - DNA, 18 bp, Artificial Sequence
  Synthetic DNA
tactgcgtctcactctaa

SEQ ID NO: 60687 - DNA, 18 bp, Artificial Sequence
  Synthetic DNA
tactgttactctctattg

SEQ ID NO: 60688 - DNA, 18 bp, Artificial Sequence
  Synthetic DNA
tacttacccgttctatag

SEQ ID NO: 60689 - DNA, 18 bp, Artificial Sequence
  Synthetic DNA
tacttagactcttaatag

SEQ ID NO: 60690 - DNA, 18 bp, Artificial Sequence
  Synthetic DNA
tacttcgacacaccaaag

SEQ ID NO: 60691 - DNA, 18 bp, Artificial Sequence
  Synthetic DNA
tacttcgacactccattg

SEQ ID NO: 60692 - DNA, 18 bp, Artificial Sequence
  Synthetic DNA
tacttcgactcagtgttg

SEQ ID NO: 60693 - DNA, 18 bp, Artificial Sequence
  Synthetic DNA
tacttcgacttacgtttg

SEQ ID NO: 60694 - DNA, 18 bp, Artificial Sequence
  Synthetic DNA
tacttcgacttactttcg

SEQ ID NO: 60695 - DNA, 18 bp, Artificial Sequence
  Synthetic DNA
tacttcgacttataatag

SEQ ID NO: 60696 - DNA, 18 bp, Artificial Sequence
  Synthetic DNA
tacttcgcctcaatgaag

SEQ ID NO: 60697 - DNA, 18 bp, Artificial Sequence
  Synthetic DNA
tacttcgtatcagtgtag

SEQ ID NO: 60698 - DNA, 18 bp, Artificial Sequence
  Synthetic DNA
tacttctcctgtctatag

SEQ ID NO: 60699 - DNA, 18 bp, Artificial Sequence
  Synthetic DNA
tacttcttctcgcaatcg

SEQ ID NO: 60700 - DNA, 18 bp, Artificial Sequence
  Synthetic DNA
tacttgcacacactatag

SEQ ID NO: 60701 - DNA, 18 bp, Artificial Sequence
  Synthetic DNA
tagaacgaataactatgg

SEQ ID NO: 60702 - DNA, 18 bp, Artificial Sequence
  Synthetic DNA
tagaacgactaattattg

SEQ ID NO: 60703 - DNA, 18 bp, Artificial Sequence
  Synthetic DNA
tagaacgtctcacacaag

SEQ ID NO: 60704 - DNA, 18 bp, Artificial Sequence
  Synthetic DNA
tagaacgtctcaccttag

SEQ ID NO: 60705 - DNA, 18 bp, Artificial Sequence
  Synthetic DNA
tagaacgtgtcactttag

SEQ ID NO: 60706 - DNA, 18 bp, Artificial Sequence
  Synthetic DNA
tagaagcactctccaacg

SEQ ID NO: 60707 - DNA, 18 bp, Artificial Sequence
  Synthetic DNA
tagaaggtctcacgttag

SEQ ID NO: 60708 - DNA, 18 bp, Artificial Sequence
  Synthetic DNA
tagaatcacgcacttgag

SEQ ID NO: 60709 - DNA, 18 bp, Artificial Sequence
  Synthetic DNA
tagaccggatcatattag

SEQ ID NO: 60710 - DNA, 18 bp, Artificial Sequence
  Synthetic DNA
tagactgtcgcactatag

SEQ ID NO: 60711 - DNA, 18 bp, Artificial Sequence
  Synthetic DNA
tagagagacaatctatag

SEQ ID NO: 60712 - DNA, 18 bp, Artificial Sequence
  Synthetic DNA
tagatcgactcaatattg

SEQ ID NO: 60713 - DNA, 18 bp, Artificial Sequence
  Synthetic DNA
tagatcgactgactgtag

SEQ ID NO: 60714 - DNA, 18 bp, Artificial Sequence
  Synthetic DNA
tagatttactctctatag

SEQ ID NO: 60715 - DNA, 18 bp, Artificial Sequence
  Synthetic DNA
tagcacatcatactttag

SEQ ID NO: 60716 - DNA, 18 bp, Artificial Sequence
  Synthetic DNA
tagcacgcctcaatatgg

SEQ ID NO: 60717 - DNA, 18 bp, Artificial Sequence
  Synthetic DNA
tagcacgtcatacaatag

SEQ ID NO: 60718 - DNA, 18 bp, Artificial Sequence
  Synthetic DNA
tagcactactaaccatag

SEQ ID NO: 60719 - DNA, 18 bp, Artificial Sequence
  Synthetic DNA
tagcatgcctctctatag

SEQ ID NO: 60720 - DNA, 18 bp, Artificial Sequence
  Synthetic DNA
tagcatgtctaactatag

SEQ ID NO: 60721 - DNA, 18 bp, Artificial Sequence
  Synthetic DNA
tagctcgactcacaagag

SEQ ID NO: 60722 - DNA, 18 bp, Artificial Sequence
  Synthetic DNA
tagctcgactctgtcttg

SEQ ID NO: 60723 - DNA, 18 bp, Artificial Sequence
  Synthetic DNA
tagctcgtacctctgaag

SEQ ID NO: 60724 - DNA, 18 bp, Artificial Sequence
  Synthetic DNA
taggacgaatggctacag

SEQ ID NO: 60725 - DNA, 18 bp, Artificial Sequence
  Synthetic DNA
taggacgtcaccctattg

SEQ ID NO: 60726 - DNA, 18 bp, Artificial Sequence
  Synthetic DNA
taggacgtgccaatatag

SEQ ID NO: 60727 - DNA, 18 bp, Artificial Sequence
  Synthetic DNA
taggatgactttcaatag

SEQ ID NO: 60728 - DNA, 18 bp, Artificial Sequence
  Synthetic DNA
tagggcgactcgacatag

SEQ ID NO: 60729 - DNA, 18 bp, Artificial Sequence
  Synthetic DNA
tagtaagactccgtttag

SEQ ID NO: 60730 - DNA, 18 bp, Artificial Sequence
  Synthetic DNA
tagtaagacttattgttg

SEQ ID NO: 60731 - DNA, 18 bp, Artificial Sequence
  Synthetic DNA
tagtacaactaaccatcg

SEQ ID NO: 60732 - DNA, 18 bp, Artificial Sequence
  Synthetic DNA
tagtacaactatctgtag

SEQ ID NO: 60733 - DNA, 18 bp, Artificial Sequence
  Synthetic DNA
tagtacaactcactgacg

SEQ ID NO: 60734 - DNA, 18 bp, Artificial Sequence
  Synthetic DNA
tagtacaactctataatg

SEQ ID NO: 60735 - DNA, 18 bp, Artificial Sequence
  Synthetic DNA
tagtacaactctcattag

SEQ ID NO: 60736 - DNA, 18 bp, Artificial Sequence
  Synthetic DNA
tagtacagcttttttaag

SEQ ID NO: 60737 - DNA, 18 bp, Artificial Sequence
  Synthetic DNA
tagtaccaataactagcg

SEQ ID NO: 60738 - DNA, 18 bp, Artificial Sequence
  Synthetic DNA
tagtacgacacgcattag

SEQ ID NO: 60739 - DNA, 18 bp, Artificial Sequence
  Synthetic DNA
tagtacgaccctctgttg

SEQ ID NO: 60740 - DNA, 18 bp, Artificial Sequence
  Synthetic DNA
tagtacgcaccaacatag

SEQ ID NO: 60741 - DNA, 18 bp, Artificial Sequence
  Synthetic DNA
tagtacgccacaatattg

SEQ ID NO: 60742 - DNA, 18 bp, Artificial Sequence
  Synthetic DNA
tagtacggtacgctatag

SEQ ID NO: 60743 - DNA, 18 bp, Artificial Sequence
  Synthetic DNA
tagtacgtccctcgatag

SEQ ID NO: 60744 - DNA, 18 bp, Artificial Sequence
  Synthetic DNA
tagtacgtctcgctcaag

SEQ ID NO: 60745 - DNA, 18 bp, Artificial Sequence
  Synthetic DNA
tagtactattttctatag

SEQ ID NO: 60746 - DNA, 18 bp, Artificial Sequence
  Synthetic DNA
tagtactcctcaatttag

SEQ ID NO: 60747 - DNA, 18 bp, Artificial Sequence
  Synthetic DNA
tagtaggtcttactaatg

SEQ ID NO: 60748 - DNA, 18 bp, Artificial Sequence
  Synthetic DNA
tagtatgactcagtccag

SEQ ID NO: 60749 - DNA, 18 bp, Artificial Sequence
  Synthetic DNA
tagtatgactgattattg

SEQ ID NO: 60750 - DNA, 18 bp, Artificial Sequence
  Synthetic DNA
tagtatgtctcaatttag

SEQ ID NO: 60751 - DNA, 18 bp, Artificial Sequence
  Synthetic DNA
tagtatgtctctcttgag

SEQ ID NO: 60752 - DNA, 18 bp, Artificial Sequence
  Synthetic DNA
tagtatgtctttcttaag

SEQ ID NO: 60753 - DNA, 18 bp, Artificial Sequence
  Synthetic DNA
tagtattactcattattg

SEQ ID NO: 60754 - DNA, 18 bp, Artificial Sequence
  Synthetic DNA
tagtattgcgcacattag

SEQ ID NO: 60755 - DNA, 18 bp, Artificial Sequence
  Synthetic DNA
tagtccgaggaactattg

SEQ ID NO: 60756 - DNA, 18 bp, Artificial Sequence
  Synthetic DNA
tagtccggctcgttatag

SEQ ID NO: 60757 - DNA, 18 bp, Artificial Sequence
  Synthetic DNA
tagtctgactctatatag

SEQ ID NO: 60758 - DNA, 18 bp, Artificial Sequence
  Synthetic DNA
tagtgcgccccactgtag

SEQ ID NO: 60759 - DNA, 18 bp, Artificial Sequence
  Synthetic DNA
tagtgcgtcatactatag

SEQ ID NO: 60760 - DNA, 18 bp, Artificial Sequence
  Synthetic DNA
tagtgctactcaccttag

SEQ ID NO: 60761 - DNA, 18 bp, Artificial Sequence
  Synthetic DNA
tagtgctactcttaatag

SEQ ID NO: 60762 - DNA, 18 bp, Artificial Sequence
  Synthetic DNA
tagtgtgactcaaaatag

SEQ ID NO: 60763 - DNA, 18 bp, Artificial Sequence
  Synthetic DNA
tagttagacccaatatag

SEQ ID NO: 60764 - DNA, 18 bp, Artificial Sequence
  Synthetic DNA
tagttagactcatcatag

SEQ ID NO: 60765 - DNA, 18 bp, Artificial Sequence
  Synthetic DNA
tagttaggctcacaattg

SEQ ID NO: 60766 - DNA, 18 bp, Artificial Sequence
  Synthetic DNA
tagttcaactcaataaag

SEQ ID NO: 60767 - DNA, 18 bp, Artificial Sequence
  Synthetic DNA
tagttcgaaacgcctaag

SEQ ID NO: 60768 - DNA, 18 bp, Artificial Sequence
  Synthetic DNA
tagttcgacacaaaatag

SEQ ID NO: 60769 - DNA, 18 bp, Artificial Sequence
  Synthetic DNA
tagttcgactcatttaag

SEQ ID NO: 60770 - DNA, 18 bp, Artificial Sequence
  Synthetic DNA
tagttcgattcttaattg

SEQ ID NO: 60771 - DNA, 18 bp, Artificial Sequence
  Synthetic DNA
tagttcttctcactttag

SEQ ID NO: 60772 - DNA, 18 bp, Artificial Sequence
  Synthetic DNA
tataaagacacattttag

SEQ ID NO: 60773 - DNA, 18 bp, Artificial Sequence
  Synthetic DNA
tataaagtcacactgaag

SEQ ID NO: 60774 - DNA, 18 bp, Artificial Sequence
  Synthetic DNA
tataacaactcaatataa

SEQ ID NO: 60775 - DNA, 18 bp, Artificial Sequence
  Synthetic DNA
tataacatctctcgtacg

SEQ ID NO: 60776 - DNA, 18 bp, Artificial Sequence
  Synthetic DNA
tataaccatgaacaatag

SEQ ID NO: 60777 - DNA, 18 bp, Artificial Sequence
  Synthetic DNA
tataaccattatctccag

SEQ ID NO: 60778 - DNA, 18 bp, Artificial Sequence
  Synthetic DNA
tataacctcccactagag

SEQ ID NO: 60779 - DNA, 18 bp, Artificial Sequence
  Synthetic DNA
tataacctttcaccatag

SEQ ID NO: 60780 - DNA, 18 bp, Artificial Sequence
  Synthetic DNA
tataacgacactcaatag

SEQ ID NO: 60781 - DNA, 18 bp, Artificial Sequence
  Synthetic DNA
tataacgacattctattg

SEQ ID NO: 60782 - DNA, 18 bp, Artificial Sequence
  Synthetic DNA
tataacgactcagaattg

SEQ ID NO: 60783 - DNA, 18 bp, Artificial Sequence
  Synthetic DNA
tataacgactcatcaaag

SEQ ID NO: 60784 - DNA, 18 bp, Artificial Sequence
  Synthetic DNA
tataacgactctttagcg

SEQ ID NO: 60785 - DNA, 18 bp, Artificial Sequence
  Synthetic DNA
tataacgacttattcttg

SEQ ID NO: 60786 - DNA, 18 bp, Artificial Sequence
  Synthetic DNA
tataacgagtgacaatcg

SEQ ID NO: 60787 - DNA, 18 bp, Artificial Sequence
  Synthetic DNA
tataacgagttaatatag

SEQ ID NO: 60788 - DNA, 18 bp, Artificial Sequence
  Synthetic DNA
tataacgatacactctcg

SEQ ID NO: 60789 - DNA, 18 bp, Artificial Sequence
  Synthetic DNA
tataacgcaccactaaag

SEQ ID NO: 60790 - DNA, 18 bp, Artificial Sequence
  Synthetic DNA
tataacgcctcattaacg

SEQ ID NO: 60791 - DNA, 18 bp, Artificial Sequence
  Synthetic DNA
tataacgcctctctattg

SEQ ID NO: 60792 - DNA, 18 bp, Artificial Sequence
  Synthetic DNA
tataacggagcacttcag

SEQ ID NO: 60793 - DNA, 18 bp, Artificial Sequence
  Synthetic DNA
tataacgtcacacaatgg

SEQ ID NO: 60794 - DNA, 18 bp, Artificial Sequence
  Synthetic DNA
tataacgtctaagtaaag

SEQ ID NO: 60795 - DNA, 18 bp, Artificial Sequence
  Synthetic DNA
tataacgtctagctatag

SEQ ID NO: 60796 - DNA, 18 bp, Artificial Sequence
  Synthetic DNA
tataacgtttccctatag

SEQ ID NO: 60797 - DNA, 18 bp, Artificial Sequence
  Synthetic DNA
tataactacacttcatag

SEQ ID NO: 60798 - DNA, 18 bp, Artificial Sequence
  Synthetic DNA
tataactacttactaaag

SEQ ID NO: 60799 - DNA, 18 bp, Artificial Sequence
  Synthetic DNA
tataactacttattcttg

SEQ ID NO: 60800 - DNA, 18 bp, Artificial Sequence
  Synthetic DNA
tataagaacactcatttg

SEQ ID NO: 60801 - DNA, 18 bp, Artificial Sequence
  Synthetic DNA
tataaggactggcaatag

SEQ ID NO: 60802 - DNA, 18 bp, Artificial Sequence
  Synthetic DNA
tataatgaattacaatag

SEQ ID NO: 60803 - DNA, 18 bp, Artificial Sequence
  Synthetic DNA
tataatgactatctgcag

SEQ ID NO: 60804 - DNA, 18 bp, Artificial Sequence
  Synthetic DNA
tataccaaatcgcaattg

SEQ ID NO: 60805 - DNA, 18 bp, Artificial Sequence
  Synthetic DNA
tataccaactcactattg

SEQ ID NO: 60806 - DNA, 18 bp, Artificial Sequence
  Synthetic DNA
tataccgacgcattatag

SEQ ID NO: 60807 - DNA, 18 bp, Artificial Sequence
  Synthetic DNA
tataccgtttgtccatag

SEQ ID NO: 60808 - DNA, 18 bp, Artificial Sequence
  Synthetic DNA
tatactgactcctttaag

SEQ ID NO: 60809 - DNA, 18 bp, Artificial Sequence
  Synthetic DNA
tatagagtcttagactag

SEQ ID NO: 60810 - DNA, 18 bp, Artificial Sequence
  Synthetic DNA
tatagcgaataacttttg

SEQ ID NO: 60811 - DNA, 18 bp, Artificial Sequence
  Synthetic DNA
tatagtgaatcactatag

SEQ ID NO: 60812 - DNA, 18 bp, Artificial Sequence
  Synthetic DNA
tatatagactcacttctg

SEQ ID NO: 60813 - DNA, 18 bp, Artificial Sequence
  Synthetic DNA
tatatcaaaatattaaag

SEQ ID NO: 60814 - DNA, 18 bp, Artificial Sequence
  Synthetic DNA
tatatcaactcacttttg

SEQ ID NO: 60815 - DNA, 18 bp, Artificial Sequence
  Synthetic DNA
tatatcaactctctaatg

SEQ ID NO: 60816 - DNA, 18 bp, Artificial Sequence
  Synthetic DNA
tatatccactcacaatag

SEQ ID NO: 60817 - DNA, 18 bp, Artificial Sequence
  Synthetic DNA
tatatccattcacttatg

SEQ ID NO: 60818 - DNA, 18 bp, Artificial Sequence
  Synthetic DNA
tatatcgaatcaatatag

SEQ ID NO: 60819 - DNA, 18 bp, Artificial Sequence
  Synthetic DNA
tatatcgacaaatgatag

SEQ ID NO: 60820 - DNA, 18 bp, Artificial Sequence
  Synthetic DNA
tatatcgacacactatgg

SEQ ID NO: 60821 - DNA, 18 bp, Artificial Sequence
  Synthetic DNA
tatatcgacatacttttg

SEQ ID NO: 60822 - DNA, 18 bp, Artificial Sequence
  Synthetic DNA
tatatcgacttataattg

SEQ ID NO: 60823 - DNA, 18 bp, Artificial Sequence
  Synthetic DNA
tatatcgtcggattattg

SEQ ID NO: 60824 - DNA, 18 bp, Artificial Sequence
  Synthetic DNA
tatattgactcagtatag

SEQ ID NO: 60825 - DNA, 18 bp, Artificial Sequence
  Synthetic DNA
tatcaagactgaaattag

SEQ ID NO: 60826 - DNA, 18 bp, Artificial Sequence
  Synthetic DNA
tatcaagacttaatatag

SEQ ID NO: 60827 - DNA, 18 bp, Artificial Sequence
  Synthetic DNA
tatcaagattatctatag

SEQ ID NO: 60828 - DNA, 18 bp, Artificial Sequence
  Synthetic DNA
tatcacccctcacgacag

SEQ ID NO: 60829 - DNA, 18 bp, Artificial Sequence
  Synthetic DNA
tatcacgactctaaatgg

SEQ ID NO: 60830 - DNA, 18 bp, Artificial Sequence
  Synthetic DNA
tatcacgactgacagtag

SEQ ID NO: 60831 - DNA, 18 bp, Artificial Sequence
  Synthetic DNA
tatcacgacttattttag

SEQ ID NO: 60832 - DNA, 18 bp, Artificial Sequence
  Synthetic DNA
tatcacgacttgctattg

SEQ ID NO: 60833 - DNA, 18 bp, Artificial Sequence
  Synthetic DNA
tatcacgatgctctaaag

SEQ ID NO: 60834 - DNA, 18 bp, Artificial Sequence
  Synthetic DNA
tatcacgattcaaaaagg

SEQ ID NO: 60835 - DNA, 18 bp, Artificial Sequence
  Synthetic DNA
tatcacggcttaccaaag

SEQ ID NO: 60836 - DNA, 18 bp, Artificial Sequence
  Synthetic DNA
tatcacgtcacactttag

SEQ ID NO: 60837 - DNA, 18 bp, Artificial Sequence
  Synthetic DNA
tatcactaaacacaatag

SEQ ID NO: 60838 - DNA, 18 bp, Artificial Sequence
  Synthetic DNA
tatcatggcttatttttg

SEQ ID NO: 60839 - DNA, 18 bp, Artificial Sequence
  Synthetic DNA
tatcatgtatcactttag

SEQ ID NO: 60840 - DNA, 18 bp, Artificial Sequence
  Synthetic DNA
tatcccgtctcacaatgg

SEQ ID NO: 60841 - DNA, 18 bp, Artificial Sequence
  Synthetic DNA
tatcgctactaactatag

SEQ ID NO: 60842 - DNA, 18 bp, Artificial Sequence
  Synthetic DNA
tatctcaaatcacattag

SEQ ID NO: 60843 - DNA, 18 bp, Artificial Sequence
  Synthetic DNA
tatctcgacccacttaag

SEQ ID NO: 60844 - DNA, 18 bp, Artificial Sequence
  Synthetic DNA
tatctcgcctcactaaag

SEQ ID NO: 60845 - DNA, 18 bp, Artificial Sequence
  Synthetic DNA
tatgccgactcagtaaag

SEQ ID NO: 60846 - DNA, 18 bp, Artificial Sequence
  Synthetic DNA
tatgggcacccactatag

SEQ ID NO: 60847 - DNA, 18 bp, Artificial Sequence
  Synthetic DNA
tatgtagactcaaaatag

SEQ ID NO: 60848 - DNA, 18 bp, Artificial Sequence
  Synthetic DNA
tatgtcatctcaatgtag

SEQ ID NO: 60849 - DNA, 18 bp, Artificial Sequence
  Synthetic DNA
tatgtcgagacattttag

SEQ ID NO: 60850 - DNA, 18 bp, Artificial Sequence
  Synthetic DNA
tatgtctacacactatag

SEQ ID NO: 60851 - DNA, 18 bp, Artificial Sequence
  Synthetic DNA
tatgtctatccactttag

SEQ ID NO: 60852 - DNA, 18 bp, Artificial Sequence
  Synthetic DNA
tattaaaactttctatag

SEQ ID NO: 60853 - DNA, 18 bp, Artificial Sequence
  Synthetic DNA
tattaaagctctcataag

SEQ ID NO: 60854 - DNA, 18 bp, Artificial Sequence
  Synthetic DNA
tattaacacaccctatag

SEQ ID NO: 60855 - DNA, 18 bp, Artificial Sequence
  Synthetic DNA
tattaacactctcaatag

SEQ ID NO: 60856 - DNA, 18 bp, Artificial Sequence
  Synthetic DNA
tattaagaattactttag

SEQ ID NO: 60857 - DNA, 18 bp, Artificial Sequence
  Synthetic DNA
tattaagacacacttaag

SEQ ID NO: 60858 - DNA, 18 bp, Artificial Sequence
  Synthetic DNA
tattaagactaccaatag

SEQ ID NO: 60859 - DNA, 18 bp, Artificial Sequence
  Synthetic DNA
tattaagccaccttatag

SEQ ID NO: 60860 - DNA, 18 bp, Artificial Sequence
  Synthetic DNA
tattaaggctctcaatag

SEQ ID NO: 60861 - DNA, 18 bp, Artificial Sequence
  Synthetic DNA
tattacaaatcacagtag

SEQ ID NO: 60862 - DNA, 18 bp, Artificial Sequence
  Synthetic DNA
tattacaactaaataaag

SEQ ID NO: 60863 - DNA, 18 bp, Artificial Sequence
  Synthetic DNA
tattacaactcacgtaag

SEQ ID NO: 60864 - DNA, 18 bp, Artificial Sequence
  Synthetic DNA
tattacaactctatattg

SEQ ID NO: 60865 - DNA, 18 bp, Artificial Sequence
  Synthetic DNA
tattacaatacgcaatag

SEQ ID NO: 60866 - DNA, 18 bp, Artificial Sequence
  Synthetic DNA
tattacaattgaatggag

SEQ ID NO: 60867 - DNA, 18 bp, Artificial Sequence
  Synthetic DNA
tattacaattggcaatag

SEQ ID NO: 60868 - DNA, 18 bp, Artificial Sequence
  Synthetic DNA
tattacacgtccctatag

SEQ ID NO: 60869 - DNA, 18 bp, Artificial Sequence
  Synthetic DNA
tattacatctcacactag

SEQ ID NO: 60870 - DNA, 18 bp, Artificial Sequence
  Synthetic DNA
tattacatctcactactg

SEQ ID NO: 60871 - DNA, 18 bp, Artificial Sequence
  Synthetic DNA
tattacatctccctttag

SEQ ID NO: 60872 - DNA, 18 bp, Artificial Sequence
  Synthetic DNA
tattaccaatctatctag

SEQ ID NO: 60873 - DNA, 18 bp, Artificial Sequence
  Synthetic DNA
tattaccaatctcaactg

SEQ ID NO: 60874 - DNA, 18 bp, Artificial Sequence
  Synthetic DNA
tattaccacttgcttacg

SEQ ID NO: 60875 - DNA, 18 bp, Artificial Sequence
  Synthetic DNA
tattaccagaaactatag

SEQ ID NO: 60876 - DNA, 18 bp, Artificial Sequence
  Synthetic DNA
tattaccattctttctag

SEQ ID NO: 60877 - DNA, 18 bp, Artificial Sequence
  Synthetic DNA
tattacctccctatatag

SEQ ID NO: 60878 - DNA, 18 bp, Artificial Sequence
  Synthetic DNA
tattacctctcaataaag

SEQ ID NO: 60879 - DNA, 18 bp, Artificial Sequence
  Synthetic DNA
tattacctgacacaatag

SEQ ID NO: 60880 - DNA, 18 bp, Artificial Sequence
  Synthetic DNA
tattacctttcacttaag

SEQ ID NO: 60881 - DNA, 18 bp, Artificial Sequence
  Synthetic DNA
tattacgacacacattcg

SEQ ID NO: 60882 - DNA, 18 bp, Artificial Sequence
  Synthetic DNA
tattacgacacataatcg

SEQ ID NO: 60883 - DNA, 18 bp, Artificial Sequence
  Synthetic DNA
tattacgacattttattg

SEQ ID NO: 60884 - DNA, 18 bp, Artificial Sequence
  Synthetic DNA
tattacgaccctgtttag

SEQ ID NO: 60885 - DNA, 18 bp, Artificial Sequence
  Synthetic DNA
tattacgacgaccttaag

SEQ ID NO: 60886 - DNA, 18 bp, Artificial Sequence
  Synthetic DNA
tattacgacgctaatctg

SEQ ID NO: 60887 - DNA, 18 bp, Artificial Sequence
  Synthetic DNA
tattacgacgctctaggg

SEQ ID NO: 60888 - DNA, 18 bp, Artificial Sequence
  Synthetic DNA
tattacgactaagcattg

SEQ ID NO: 60889 - DNA, 18 bp, Artificial Sequence
  Synthetic DNA
tattacgactttcactag

SEQ ID NO: 60890 - DNA, 18 bp, Artificial Sequence
  Synthetic DNA
tattacgagtcgcaaaag

SEQ ID NO: 60891 - DNA, 18 bp, Artificial Sequence
  Synthetic DNA
tattacgatgcacaaaag

SEQ ID NO: 60892 - DNA, 18 bp, Artificial Sequence
  Synthetic DNA
tattacgattaaataggg

SEQ ID NO: 60893 - DNA, 18 bp, Artificial Sequence
  Synthetic DNA
tattacgattcacgtttg

SEQ ID NO: 60894 - DNA, 18 bp, Artificial Sequence
  Synthetic DNA
tattacgattctttgtag

SEQ ID NO: 60895 - DNA, 18 bp, Artificial Sequence
  Synthetic DNA
tattacgattcttttcag

SEQ ID NO: 60896 - DNA, 18 bp, Artificial Sequence
  Synthetic DNA
tattacgatttagttttg

SEQ ID NO: 60897 - DNA, 18 bp, Artificial Sequence
  Synthetic DNA
tattacgcctcttcctag

SEQ ID NO: 60898 - DNA, 18 bp, Artificial Sequence
  Synthetic DNA
tattacggctcacagttg

SEQ ID NO: 60899 - DNA, 18 bp, Artificial Sequence
  Synthetic DNA
tattacgtatcacatcag

SEQ ID NO: 60900 - DNA, 18 bp, Artificial Sequence
  Synthetic DNA
tattacgtattactaaag

SEQ ID NO: 60901 - DNA, 18 bp, Artificial Sequence
  Synthetic DNA
tattacgtcacacggaag

SEQ ID NO: 60902 - DNA, 18 bp, Artificial Sequence
  Synthetic DNA
tattacgtcacactactg

SEQ ID NO: 60903 - DNA, 18 bp, Artificial Sequence
  Synthetic DNA
tattacgtcacattatgg

SEQ ID NO: 60904 - DNA, 18 bp, Artificial Sequence
  Synthetic DNA
tattacgtcacttatttg

SEQ ID NO: 60905 - DNA, 18 bp, Artificial Sequence
  Synthetic DNA
tattacgtcacttttcag

SEQ ID NO: 60906 - DNA, 18 bp, Artificial Sequence
  Synthetic DNA
tattacgtccaactctag

SEQ ID NO: 60907 - DNA, 18 bp, Artificial Sequence
  Synthetic DNA
tattacgtctcaaaaacg

SEQ ID NO: 60908 - DNA, 18 bp, Artificial Sequence
  Synthetic DNA
tattacgtctcagttatg

SEQ ID NO: 60909 - DNA, 18 bp, Artificial Sequence
  Synthetic DNA
tattacgtctctttacgg

SEQ ID NO: 60910 - DNA, 18 bp, Artificial Sequence
  Synthetic DNA
tattacgtctttctaaag

SEQ ID NO: 60911 - DNA, 18 bp, Artificial Sequence
  Synthetic DNA
tattacgtgtcaaccaag

SEQ ID NO: 60912 - DNA, 18 bp, Artificial Sequence
  Synthetic DNA
tattacgttacgctatag

SEQ ID NO: 60913 - DNA, 18 bp, Artificial Sequence
  Synthetic DNA
tattacgtttggctaaag

SEQ ID NO: 60914 - DNA, 18 bp, Artificial Sequence
  Synthetic DNA
tattactaatctatatcg

SEQ ID NO: 60915 - DNA, 18 bp, Artificial Sequence
  Synthetic DNA
tattactacatactatcg

SEQ ID NO: 60916 - DNA, 18 bp, Artificial Sequence
  Synthetic DNA
tattactacccatcacag

SEQ ID NO: 60917 - DNA, 18 bp, Artificial Sequence
  Synthetic DNA
tattactactaataatag

SEQ ID NO: 60918 - DNA, 18 bp, Artificial Sequence
  Synthetic DNA
tattactactcaatagtg

SEQ ID NO: 60919 - DNA, 18 bp, Artificial Sequence
  Synthetic DNA
tattactactcgttttag

SEQ ID NO: 60920 - DNA, 18 bp, Artificial Sequence
  Synthetic DNA
tattactatacaatatag

SEQ ID NO: 60921 - DNA, 18 bp, Artificial Sequence
  Synthetic DNA
tattactattcaatttag

SEQ ID NO: 60922 - DNA, 18 bp, Artificial Sequence
  Synthetic DNA
tattactccactcagtag

SEQ ID NO: 60923 - DNA, 18 bp, Artificial Sequence
  Synthetic DNA
tattactcccctccatcg

SEQ ID NO: 60924 - DNA, 18 bp, Artificial Sequence
  Synthetic DNA
tattactcctcaatatgg

SEQ ID NO: 60925 - DNA, 18 bp, Artificial Sequence
  Synthetic DNA
tattactgctacctatag

SEQ ID NO: 60926 - DNA, 18 bp, Artificial Sequence
  Synthetic DNA
tattacttattacattag

SEQ ID NO: 60927 - DNA, 18 bp, Artificial Sequence
  Synthetic DNA
tattacttatttcttcag

SEQ ID NO: 60928 - DNA, 18 bp, Artificial Sequence
  Synthetic DNA
tattacttctttctacag

SEQ ID NO: 60929 - DNA, 18 bp, Artificial Sequence
  Synthetic DNA
tattagaactctctctag

SEQ ID NO: 60930 - DNA, 18 bp, Artificial Sequence
  Synthetic DNA
tattagaattttcaatag

SEQ ID NO: 60931 - DNA, 18 bp, Artificial Sequence
  Synthetic DNA
tattagcacacactaaag

SEQ ID NO: 60932 - DNA, 18 bp, Artificial Sequence
  Synthetic DNA
tattagcactcatcttag

SEQ ID NO: 60933 - DNA, 18 bp, Artificial Sequence
  Synthetic DNA
tattaggacaaacaatag

SEQ ID NO: 60934 - DNA, 18 bp, Artificial Sequence
  Synthetic DNA
tattaggactgtgtatgg

SEQ ID NO: 60935 - DNA, 18 bp, Artificial Sequence
  Synthetic DNA
tattaggattcatatcag

SEQ ID NO: 60936 - DNA, 18 bp, Artificial Sequence
  Synthetic DNA
tattaggtctcagttcag

SEQ ID NO: 60937 - DNA, 18 bp, Artificial Sequence
  Synthetic DNA
tattagtacatactatag

SEQ ID NO: 60938 - DNA, 18 bp, Artificial Sequence
  Synthetic DNA
tattagtatacactattg

SEQ ID NO: 60939 - DNA, 18 bp, Artificial Sequence
  Synthetic DNA
tattatacctcaatatag

SEQ ID NO: 60940 - DNA, 18 bp, Artificial Sequence
  Synthetic DNA
tattatgaaaataaatgg

SEQ ID NO: 60941 - DNA, 18 bp, Artificial Sequence
  Synthetic DNA
tattatgaatcactttgg

SEQ ID NO: 60942 - DNA, 18 bp, Artificial Sequence
  Synthetic DNA
tattatgacactttacag

SEQ ID NO: 60943 - DNA, 18 bp, Artificial Sequence
  Synthetic DNA
tattatgactagctttag

SEQ ID NO: 60944 - DNA, 18 bp, Artificial Sequence
  Synthetic DNA
tattatgactttctactg

SEQ ID NO: 60945 - DNA, 18 bp, Artificial Sequence
  Synthetic DNA
tattatgattatctttag

SEQ ID NO: 60946 - DNA, 18 bp, Artificial Sequence
  Synthetic DNA
tattatgctagactatag

SEQ ID NO: 60947 - DNA, 18 bp, Artificial Sequence
  Synthetic DNA
tattatgtcagacattag

SEQ ID NO: 60948 - DNA, 18 bp, Artificial Sequence
  Synthetic DNA
tattatgtctctctattg

SEQ ID NO: 60949 - DNA, 18 bp, Artificial Sequence
  Synthetic DNA
tattattacacaccaaag

SEQ ID NO: 60950 - DNA, 18 bp, Artificial Sequence
  Synthetic DNA
tattattactcactcatg

SEQ ID NO: 60951 - DNA, 18 bp, Artificial Sequence
  Synthetic DNA
tattattgcttacgatag

SEQ ID NO: 60952 - DNA, 18 bp, Artificial Sequence
  Synthetic DNA
tattatttcttcctaacg

SEQ ID NO: 60953 - DNA, 18 bp, Artificial Sequence
  Synthetic DNA
tattcaaactgactttag

SEQ ID NO: 60954 - DNA, 18 bp, Artificial Sequence
  Synthetic DNA
tattcagactcgctattg

SEQ ID NO: 60955 - DNA, 18 bp, Artificial Sequence
  Synthetic DNA
tattccaactcaccagag

SEQ ID NO: 60956 - DNA, 18 bp, Artificial Sequence
  Synthetic DNA
tattccgaaaaacactag

SEQ ID NO: 60957 - DNA, 18 bp, Artificial Sequence
  Synthetic DNA
tattccgattaattgtag

SEQ ID NO: 60958 - DNA, 18 bp, Artificial Sequence
  Synthetic DNA
tattccgattcacaacag

SEQ ID NO: 60959 - DNA, 18 bp, Artificial Sequence
  Synthetic DNA
tattccgattccctaaag

SEQ ID NO: 60960 - DNA, 18 bp, Artificial Sequence
  Synthetic DNA
tattccgtctgactaacg

SEQ ID NO: 60961 - DNA, 18 bp, Artificial Sequence
  Synthetic DNA
tattccgtcttggtttag

SEQ ID NO: 60962 - DNA, 18 bp, Artificial Sequence
  Synthetic DNA
tattccgttacactatag

SEQ ID NO: 60963 - DNA, 18 bp, Artificial Sequence
  Synthetic DNA
tattcctaataacttaag

SEQ ID NO: 60964 - DNA, 18 bp, Artificial Sequence
  Synthetic DNA
tattcctaccctctttag

SEQ ID NO: 60965 - DNA, 18 bp, Artificial Sequence
  Synthetic DNA
tattcctactcacactag

SEQ ID NO: 60966 - DNA, 18 bp, Artificial Sequence
  Synthetic DNA
tattcctgatcaatacgg

SEQ ID NO: 60967 - DNA, 18 bp, Artificial Sequence
  Synthetic DNA
tattccttctatctttag

SEQ ID NO: 60968 - DNA, 18 bp, Artificial Sequence
  Synthetic DNA
tattccttttcactatag

SEQ ID NO: 60969 - DNA, 18 bp, Artificial Sequence
  Synthetic DNA
tattcggacactatttcg

SEQ ID NO: 60970 - DNA, 18 bp, Artificial Sequence
  Synthetic DNA
tattcggactcactgaag

SEQ ID NO: 60971 - DNA, 18 bp, Artificial Sequence
  Synthetic DNA
tattcggacttactactg

SEQ ID NO: 60972 - DNA, 18 bp, Artificial Sequence
  Synthetic DNA
tattgcgactcaattaag

SEQ ID NO: 60973 - DNA, 18 bp, Artificial Sequence
  Synthetic DNA
tattgcgactctgaatag

SEQ ID NO: 60974 - DNA, 18 bp, Artificial Sequence
  Synthetic DNA
tattgcgactctttttag

SEQ ID NO: 60975 - DNA, 18 bp, Artificial Sequence
  Synthetic DNA
tattgcgacttatggtag

SEQ ID NO: 60976 - DNA, 18 bp, Artificial Sequence
  Synthetic DNA
tattgcgactttttattg

SEQ ID NO: 60977 - DNA, 18 bp, Artificial Sequence
  Synthetic DNA
tattgctactcacaccag

SEQ ID NO: 60978 - DNA, 18 bp, Artificial Sequence
  Synthetic DNA
tattgggactcgctattg

SEQ ID NO: 60979 - DNA, 18 bp, Artificial Sequence
  Synthetic DNA
tattgttacacattatag

SEQ ID NO: 60980 - DNA, 18 bp, Artificial Sequence
  Synthetic DNA
tatttagaatgtctggtg

SEQ ID NO: 60981 - DNA, 18 bp, Artificial Sequence
  Synthetic DNA
tatttagactcacatttg

SEQ ID NO: 60982 - DNA, 18 bp, Artificial Sequence
  Synthetic DNA
tatttagactcttaatag

SEQ ID NO: 60983 - DNA, 18 bp, Artificial Sequence
  Synthetic DNA
tatttagacttactatgg

SEQ ID NO: 60984 - DNA, 18 bp, Artificial Sequence
  Synthetic DNA
tatttaggctcatattag

SEQ ID NO: 60985 - DNA, 18 bp, Artificial Sequence
  Synthetic DNA
tatttagtctaacaatag

SEQ ID NO: 60986 - DNA, 18 bp, Artificial Sequence
  Synthetic DNA
tatttcaaatcactattg

SEQ ID NO: 60987 - DNA, 18 bp, Artificial Sequence
  Synthetic DNA
tatttcaactcaataaag

SEQ ID NO: 60988 - DNA, 18 bp, Artificial Sequence
  Synthetic DNA
tatttcaattagctatag

SEQ ID NO: 60989 - DNA, 18 bp, Artificial Sequence
  Synthetic DNA
tatttcaatttactcgcg

SEQ ID NO: 60990 - DNA, 18 bp, Artificial Sequence
  Synthetic DNA
tatttccactcacattag

SEQ ID NO: 60991 - DNA, 18 bp, Artificial Sequence
  Synthetic DNA
tatttcccccaactctag

SEQ ID NO: 60992 - DNA, 18 bp, Artificial Sequence
  Synthetic DNA
tatttcctcacactatag

SEQ ID NO: 60993 - DNA, 18 bp, Artificial Sequence
  Synthetic DNA
tatttcctctcaatgcag

SEQ ID NO: 60994 - DNA, 18 bp, Artificial Sequence
  Synthetic DNA
tatttcgaaaagctaaag

SEQ ID NO: 60995 - DNA, 18 bp, Artificial Sequence
  Synthetic DNA
tatttcgaatcaatacag

SEQ ID NO: 60996 - DNA, 18 bp, Artificial Sequence
  Synthetic DNA
tatttcgaatcataaatg

SEQ ID NO: 60997 - DNA, 18 bp, Artificial Sequence
  Synthetic DNA
tatttcgaccctctggag

SEQ ID NO: 60998 - DNA, 18 bp, Artificial Sequence
  Synthetic DNA
tatttcgactaactaagg

SEQ ID NO: 60999 - DNA, 18 bp, Artificial Sequence
  Synthetic DNA
tatttcgactccataaag

SEQ ID NO: 61000 - DNA, 18 bp, Artificial Sequence
  Synthetic DNA
tatttcgactcccccacg

SEQ ID NO: 61001 - DNA, 18 bp, Artificial Sequence
  Synthetic DNA
tatttcgactctatacag

SEQ ID NO: 61002 - DNA, 18 bp, Artificial Sequence
  Synthetic DNA
tatttcgactctctaacg

SEQ ID NO: 61003 - DNA, 18 bp, Artificial Sequence
  Synthetic DNA
tatttcgccacactatgg

SEQ ID NO: 61004 - DNA, 18 bp, Artificial Sequence
  Synthetic DNA
tatttcggctcactctgg

SEQ ID NO: 61005 - DNA, 18 bp, Artificial Sequence
  Synthetic DNA
tatttcggctttctatag

SEQ ID NO: 61006 - DNA, 18 bp, Artificial Sequence
  Synthetic DNA
tatttcggtttactatag

SEQ ID NO: 61007 - DNA, 18 bp, Artificial Sequence
  Synthetic DNA
tatttcgtcaccgtatag

SEQ ID NO: 61008 - DNA, 18 bp, Artificial Sequence
  Synthetic DNA
tatttcgtctcatcatag

SEQ ID NO: 61009 - DNA, 18 bp, Artificial Sequence
  Synthetic DNA
tatttcgttagactatag

SEQ ID NO: 61010 - DNA, 18 bp, Artificial Sequence
  Synthetic DNA
tatttcgtttcactatgg

SEQ ID NO: 61011 - DNA, 18 bp, Artificial Sequence
  Synthetic DNA
tatttctactatctatag

SEQ ID NO: 61012 - DNA, 18 bp, Artificial Sequence
  Synthetic DNA
tatttctactcacattag

SEQ ID NO: 61013 - DNA, 18 bp, Artificial Sequence
  Synthetic DNA
tatttctactcaccattg

SEQ ID NO: 61014 - DNA, 18 bp, Artificial Sequence
  Synthetic DNA
tatttctacttactaaag

SEQ ID NO: 61015 - DNA, 18 bp, Artificial Sequence
  Synthetic DNA
tatttcttctcgctatag

SEQ ID NO: 61016 - DNA, 18 bp, Artificial Sequence
  Synthetic DNA
tatttggaatctctatag

SEQ ID NO: 61017 - DNA, 18 bp, Artificial Sequence
  Synthetic DNA
tatttggacgctctatgg

SEQ ID NO: 61018 - DNA, 18 bp, Artificial Sequence
  Synthetic DNA
tattttgacatactatgg

SEQ ID NO: 61019 - DNA, 18 bp, Artificial Sequence
  Synthetic DNA
tattttgactaaccatag

SEQ ID NO: 61020 - DNA, 18 bp, Artificial Sequence
  Synthetic DNA
tattttgagactctattg

SEQ ID NO: 61021 - DNA, 18 bp, Artificial Sequence
  Synthetic DNA
tattttgagtctgtatag

SEQ ID NO: 61022 - DNA, 18 bp, Artificial Sequence
  Synthetic DNA
tattttgattctctatag

SEQ ID NO: 61023 - DNA, 18 bp, Artificial Sequence
  Synthetic DNA
tattttgccacactttag

SEQ ID NO: 61024 - DNA, 18 bp, Artificial Sequence
  Synthetic DNA
tcaaacgactcattaccg

SEQ ID NO: 61025 - DNA, 18 bp, Artificial Sequence
  Synthetic DNA
tcaaacgatacgttaacg

SEQ ID NO: 61026 - DNA, 18 bp, Artificial Sequence
  Synthetic DNA
tcaaacgatttactaaag

SEQ ID NO: 61027 - DNA, 18 bp, Artificial Sequence
  Synthetic DNA
tcaaacggcatactgttg

SEQ ID NO: 61028 - DNA, 18 bp, Artificial Sequence
  Synthetic DNA
tcaaacgtattgctatag

SEQ ID NO: 61029 - DNA, 18 bp, Artificial Sequence
  Synthetic DNA
tcaaacgtctcattactg

SEQ ID NO: 61030 - DNA, 18 bp, Artificial Sequence
  Synthetic DNA
tcaaactacccactttag

SEQ ID NO: 61031 - DNA, 18 bp, Artificial Sequence
  Synthetic DNA
tcaaatatctatctatcg

SEQ ID NO: 61032 - DNA, 18 bp, Artificial Sequence
  Synthetic DNA
tcaaatgacttacaaaag

SEQ ID NO: 61033 - DNA, 18 bp, Artificial Sequence
  Synthetic DNA
tcaatagactaagaatgg

SEQ ID NO: 61034 - DNA, 18 bp, Artificial Sequence
  Synthetic DNA
tcaatagtcacacaaatg

SEQ ID NO: 61035 - DNA, 18 bp, Artificial Sequence
  Synthetic DNA
tcaatcgactcaccattg

SEQ ID NO: 61036 - DNA, 18 bp, Artificial Sequence
  Synthetic DNA
tcaatcgattcaccatag

SEQ ID NO: 61037 - DNA, 18 bp, Artificial Sequence
  Synthetic DNA
tcaatcgtcacactacag

SEQ ID NO: 61038 - DNA, 18 bp, Artificial Sequence
  Synthetic DNA
tcaatcgtctcagtatag

SEQ ID NO: 61039 - DNA, 18 bp, Artificial Sequence
  Synthetic DNA
tcaatttactcacaatag

SEQ ID NO: 61040 - DNA, 18 bp, Artificial Sequence
  Synthetic DNA
tcacaagtgtgtctcttg

SEQ ID NO: 61041 - DNA, 18 bp, Artificial Sequence
  Synthetic DNA
tcacacgactaagtgaag

SEQ ID NO: 61042 - DNA, 18 bp, Artificial Sequence
  Synthetic DNA
tcacacgcatctctatag

SEQ ID NO: 61043 - DNA, 18 bp, Artificial Sequence
  Synthetic DNA
tcacacggctcagtatcg

SEQ ID NO: 61044 - DNA, 18 bp, Artificial Sequence
  Synthetic DNA
tcacacgtcgcagtttag

SEQ ID NO: 61045 - DNA, 18 bp, Artificial Sequence
  Synthetic DNA
tcacacgtgtcaatatag

SEQ ID NO: 61046 - DNA, 18 bp, Artificial Sequence
  Synthetic DNA
tcacactactaacttaag

SEQ ID NO: 61047 - DNA, 18 bp, Artificial Sequence
  Synthetic DNA
tcacattactcacactag

SEQ ID NO: 61048 - DNA, 18 bp, Artificial Sequence
  Synthetic DNA
tcagacgactctcttcag

SEQ ID NO: 61049 - DNA, 18 bp, Artificial Sequence
  Synthetic DNA
tcagacgatccactatcg

SEQ ID NO: 61050 - DNA, 18 bp, Artificial Sequence
  Synthetic DNA
tcagatgactcattaacg

SEQ ID NO: 61051 - DNA, 18 bp, Artificial Sequence
  Synthetic DNA
tcagatgacttagttttg

SEQ ID NO: 61052 - DNA, 18 bp, Artificial Sequence
  Synthetic DNA
tcataagaaataacatgg

SEQ ID NO: 61053 - DNA, 18 bp, Artificial Sequence
  Synthetic DNA
tcataagactctttctag

SEQ ID NO: 61054 - DNA, 18 bp, Artificial Sequence
  Synthetic DNA
tcataagactgacattag

SEQ ID NO: 61055 - DNA, 18 bp, Artificial Sequence
  Synthetic DNA
tcataagatacactatgg

SEQ ID NO: 61056 - DNA, 18 bp, Artificial Sequence
  Synthetic DNA
tcataagattctctaaag

SEQ ID NO: 61057 - DNA, 18 bp, Artificial Sequence
  Synthetic DNA
tcataagcctgtctctag

SEQ ID NO: 61058 - DNA, 18 bp, Artificial Sequence
  Synthetic DNA
tcataagtctaactattg

SEQ ID NO: 61059 - DNA, 18 bp, Artificial Sequence
  Synthetic DNA
tcataagtgccattatag

SEQ ID NO: 61060 - DNA, 18 bp, Artificial Sequence
  Synthetic DNA
tcataagtttcaatatag

SEQ ID NO: 61061 - DNA, 18 bp, Artificial Sequence
  Synthetic DNA
tcataatactggatagag

SEQ ID NO: 61062 - DNA, 18 bp, Artificial Sequence
  Synthetic DNA
tcatacaactcccttaag

SEQ ID NO: 61063 - DNA, 18 bp, Artificial Sequence
  Synthetic DNA
tcatacaatccactaaag

SEQ ID NO: 61064 - DNA, 18 bp, Artificial Sequence
  Synthetic DNA
tcatacaattcaatattg

SEQ ID NO: 61065 - DNA, 18 bp, Artificial Sequence
  Synthetic DNA
tcatacaattcatactag

SEQ ID NO: 61066 - DNA, 18 bp, Artificial Sequence
  Synthetic DNA
tcatacaattgcgtgagg

SEQ ID NO: 61067 - DNA, 18 bp, Artificial Sequence
  Synthetic DNA
tcatacacatcaccatag

SEQ ID NO: 61068 - DNA, 18 bp, Artificial Sequence
  Synthetic DNA
tcatacatcacactttgg

SEQ ID NO: 61069 - DNA, 18 bp, Artificial Sequence
  Synthetic DNA
tcatacatttgacataag

SEQ ID NO: 61070 - DNA, 18 bp, Artificial Sequence
  Synthetic DNA
tcataccaatttcaaaag

SEQ ID NO: 61071 - DNA, 18 bp, Artificial Sequence
  Synthetic DNA
tcataccatgcactttcg

SEQ ID NO: 61072 - DNA, 18 bp, Artificial Sequence
  Synthetic DNA
tcatacgaaccaccatgg

SEQ ID NO: 61073 - DNA, 18 bp, Artificial Sequence
  Synthetic DNA
tcatacgaatttttttgg

SEQ ID NO: 61074 - DNA, 18 bp, Artificial Sequence
  Synthetic DNA
tcatacgacactccaaag

SEQ ID NO: 61075 - DNA, 18 bp, Artificial Sequence
  Synthetic DNA
tcatacgacactctcaag

SEQ ID NO: 61076 - DNA, 18 bp, Artificial Sequence
  Synthetic DNA
tcatacgagctaccatag

SEQ ID NO: 61077 - DNA, 18 bp, Artificial Sequence
  Synthetic DNA
tcatacgatccgcactag

SEQ ID NO: 61078 - DNA, 18 bp, Artificial Sequence
  Synthetic DNA
tcatacgatcctctaaag

SEQ ID NO: 61079 - DNA, 18 bp, Artificial Sequence
  Synthetic DNA
tcatacgattacctattg

SEQ ID NO: 61080 - DNA, 18 bp, Artificial Sequence
  Synthetic DNA
tcatacgatttacagtag

SEQ ID NO: 61081 - DNA, 18 bp, Artificial Sequence
  Synthetic DNA
tcatacgccattctatag

SEQ ID NO: 61082 - DNA, 18 bp, Artificial Sequence
  Synthetic DNA
tcatacggatcacactag

SEQ ID NO: 61083 - DNA, 18 bp, Artificial Sequence
  Synthetic DNA
tcatacggctttctaaag

SEQ ID NO: 61084 - DNA, 18 bp, Artificial Sequence
  Synthetic DNA
tcatacgtcaatctatag

SEQ ID NO: 61085 - DNA, 18 bp, Artificial Sequence
  Synthetic DNA
tcatacgtcatacatatg

SEQ ID NO: 61086 - DNA, 18 bp, Artificial Sequence
  Synthetic DNA
tcatacgtttcaccgtag

SEQ ID NO: 61087 - DNA, 18 bp, Artificial Sequence
  Synthetic DNA
tcatacgtttcattctcg

SEQ ID NO: 61088 - DNA, 18 bp, Artificial Sequence
  Synthetic DNA
tcatacgtttcattgtag

SEQ ID NO: 61089 - DNA, 18 bp, Artificial Sequence
  Synthetic DNA
tcatagaacatcccatag

SEQ ID NO: 61090 - DNA, 18 bp, Artificial Sequence
  Synthetic DNA
tcatagcactggctatag

SEQ ID NO: 61091 - DNA, 18 bp, Artificial Sequence
  Synthetic DNA
tcatagggctaactaaag

SEQ ID NO: 61092 - DNA, 18 bp, Artificial Sequence
  Synthetic DNA
tcataggtaacaataaag

SEQ ID NO: 61093 - DNA, 18 bp, Artificial Sequence
  Synthetic DNA
tcataggtctcagtctag

SEQ ID NO: 61094 - DNA, 18 bp, Artificial Sequence
  Synthetic DNA
tcatagtcatgactttcg

SEQ ID NO: 61095 - DNA, 18 bp, Artificial Sequence
  Synthetic DNA
tcatatgacacattaagg

SEQ ID NO: 61096 - DNA, 18 bp, Artificial Sequence
  Synthetic DNA
tcatccaacaatctattg

SEQ ID NO: 61097 - DNA, 18 bp, Artificial Sequence
  Synthetic DNA
tcatccggcccactatcg

SEQ ID NO: 61098 - DNA, 18 bp, Artificial Sequence
  Synthetic DNA
tcatccgttaaactattg

SEQ ID NO: 61099 - DNA, 18 bp, Artificial Sequence
  Synthetic DNA
tcatcgaactcaattttg

SEQ ID NO: 61100 - DNA, 18 bp, Artificial Sequence
  Synthetic DNA
tcatcggactcattttag

SEQ ID NO: 61101 - DNA, 18 bp, Artificial Sequence
  Synthetic DNA
tcatctaattcaggttag

SEQ ID NO: 61102 - DNA, 18 bp, Artificial Sequence
  Synthetic DNA
tcatgcgtccctataaag

SEQ ID NO: 61103 - DNA, 18 bp, Artificial Sequence
  Synthetic DNA
tcatgcgtttcaacatag

SEQ ID NO: 61104 - DNA, 18 bp, Artificial Sequence
  Synthetic DNA
tcatgtgacttattatgg

SEQ ID NO: 61105 - DNA, 18 bp, Artificial Sequence
  Synthetic DNA
tcattcaacaaactatag

SEQ ID NO: 61106 - DNA, 18 bp, Artificial Sequence
  Synthetic DNA
tcattcaactcacctaag

SEQ ID NO: 61107 - DNA, 18 bp, Artificial Sequence
  Synthetic DNA
tcattcaactctctattg

SEQ ID NO: 61108 - DNA, 18 bp, Artificial Sequence
  Synthetic DNA
tcattcctctcaatacag

SEQ ID NO: 61109 - DNA, 18 bp, Artificial Sequence
  Synthetic DNA
tcattcgaaccactttcg

SEQ ID NO: 61110 - DNA, 18 bp, Artificial Sequence
  Synthetic DNA
tcattcgacaatcaacag

SEQ ID NO: 61111 - DNA, 18 bp, Artificial Sequence
  Synthetic DNA
tcattcgacacgatatag

SEQ ID NO: 61112 - DNA, 18 bp, Artificial Sequence
  Synthetic DNA
tcattcgactctcactag

SEQ ID NO: 61113 - DNA, 18 bp, Artificial Sequence
  Synthetic DNA
tcattcgtcaaaccatgg

SEQ ID NO: 61114 - DNA, 18 bp, Artificial Sequence
  Synthetic DNA
tcattcgtcccactatgg

SEQ ID NO: 61115 - DNA, 18 bp, Artificial Sequence
  Synthetic DNA
tcattgatctcactatag

SEQ ID NO: 61116 - DNA, 18 bp, Artificial Sequence
  Synthetic DNA
tcatttgaatcttaaaag

SEQ ID NO: 61117 - DNA, 18 bp, Artificial Sequence
  Synthetic DNA
tcatttgacacatcatag

SEQ ID NO: 61118 - DNA, 18 bp, Artificial Sequence
  Synthetic DNA
tccaacgtttcactatcg

SEQ ID NO: 61119 - DNA, 18 bp, Artificial Sequence
  Synthetic DNA
tccaaggtgtaactaaaa

SEQ ID NO: 61120 - DNA, 18 bp, Artificial Sequence
  Synthetic DNA
tcctaagacaaactgcag

SEQ ID NO: 61121 - DNA, 18 bp, Artificial Sequence
  Synthetic DNA
tcctacaaaactcaaaag

SEQ ID NO: 61122 - DNA, 18 bp, Artificial Sequence
  Synthetic DNA
tcctacgactcaggttag

SEQ ID NO: 61123 - DNA, 18 bp, Artificial Sequence
  Synthetic DNA
tcctacgactccctttgg

SEQ ID NO: 61124 - DNA, 18 bp, Artificial Sequence
  Synthetic DNA
tcctacgccactgattcg

SEQ ID NO: 61125 - DNA, 18 bp, Artificial Sequence
  Synthetic DNA
tcctatgaccaaataatg

SEQ ID NO: 61126 - DNA, 18 bp, Artificial Sequence
  Synthetic DNA
tcctattccacactatag

SEQ ID NO: 61127 - DNA, 18 bp, Artificial Sequence
  Synthetic DNA
tcctgcgacttactattg

SEQ ID NO: 61128 - DNA, 18 bp, Artificial Sequence
  Synthetic DNA
tccttcaactcacagtag

SEQ ID NO: 61129 - DNA, 18 bp, Artificial Sequence
  Synthetic DNA
tccttccactctctatag

SEQ ID NO: 61130 - DNA, 18 bp, Artificial Sequence
  Synthetic DNA
tcgaccgacttataatag

SEQ ID NO: 61131 - DNA, 18 bp, Artificial Sequence
  Synthetic DNA
tcgtacgtttcacaaaag

SEQ ID NO: 61132 - DNA, 18 bp, Artificial Sequence
  Synthetic DNA
tcgtatgtatccctgtag

SEQ ID NO: 61133 - DNA, 18 bp, Artificial Sequence
  Synthetic DNA
tcgtccgcctcactagag

SEQ ID NO: 61134 - DNA, 18 bp, Artificial Sequence
  Synthetic DNA
tcgtgctataccctaaag

SEQ ID NO: 61135 - DNA, 18 bp, Artificial Sequence
  Synthetic DNA
tcgttcgacacactttag

SEQ ID NO: 61136 - DNA, 18 bp, Artificial Sequence
  Synthetic DNA
tctaaagacacacaaaag

SEQ ID NO: 61137 - DNA, 18 bp, Artificial Sequence
  Synthetic DNA
tctaaagatacactatag

SEQ ID NO: 61138 - DNA, 18 bp, Artificial Sequence
  Synthetic DNA
tctaacaactcactaaag

SEQ ID NO: 61139 - DNA, 18 bp, Artificial Sequence
  Synthetic DNA
tctaaccacgtactatag

SEQ ID NO: 61140 - DNA, 18 bp, Artificial Sequence
  Synthetic DNA
tctaacgaattactttgg

SEQ ID NO: 61141 - DNA, 18 bp, Artificial Sequence
  Synthetic DNA
tctaacttctcactacag

SEQ ID NO: 61142 - DNA, 18 bp, Artificial Sequence
  Synthetic DNA
tctagcaacgtactaaag

SEQ ID NO: 61143 - DNA, 18 bp, Artificial Sequence
  Synthetic DNA
tctcactacccattatag

SEQ ID NO: 61144 - DNA, 18 bp, Artificial Sequence
  Synthetic DNA
tctgacgactcaccattg

SEQ ID NO: 61145 - DNA, 18 bp, Artificial Sequence
  Synthetic DNA
tcttaagactctctattg

SEQ ID NO: 61146 - DNA, 18 bp, Artificial Sequence
  Synthetic DNA
tcttaagacttaccgttg

SEQ ID NO: 61147 - DNA, 18 bp, Artificial Sequence
  Synthetic DNA
tcttacaacacatttttg

SEQ ID NO: 61148 - DNA, 18 bp, Artificial Sequence
  Synthetic DNA
tcttacaactaattattg

SEQ ID NO: 61149 - DNA, 18 bp, Artificial Sequence
  Synthetic DNA
tcttacaatactcattag

SEQ ID NO: 61150 - DNA, 18 bp, Artificial Sequence
  Synthetic DNA
tcttacgaataactagag

SEQ ID NO: 61151 - DNA, 18 bp, Artificial Sequence
  Synthetic DNA
tcttacgaatcgtaattg

SEQ ID NO: 61152 - DNA, 18 bp, Artificial Sequence
  Synthetic DNA
tcttacgacactctcttg

SEQ ID NO: 61153 - DNA, 18 bp, Artificial Sequence
  Synthetic DNA
tcttacgacccgtaatag

SEQ ID NO: 61154 - DNA, 18 bp, Artificial Sequence
  Synthetic DNA
tcttacgagttactattg

SEQ ID NO: 61155 - DNA, 18 bp, Artificial Sequence
  Synthetic DNA
tcttacggctcactctaa

SEQ ID NO: 61156 - DNA, 18 bp, Artificial Sequence
  Synthetic DNA
tcttacgtttcattttag

SEQ ID NO: 61157 - DNA, 18 bp, Artificial Sequence
  Synthetic DNA
tcttactactctctttag

SEQ ID NO: 61158 - DNA, 18 bp, Artificial Sequence
  Synthetic DNA
tcttactattgtctatag

SEQ ID NO: 61159 - DNA, 18 bp, Artificial Sequence
  Synthetic DNA
tcttccgactcgccatcg

SEQ ID NO: 61160 - DNA, 18 bp, Artificial Sequence
  Synthetic DNA
tcttcctacatactatag

SEQ ID NO: 61161 - DNA, 18 bp, Artificial Sequence
  Synthetic DNA
tcttctaccccactatcg

SEQ ID NO: 61162 - DNA, 18 bp, Artificial Sequence
  Synthetic DNA
tcttgcgtctttctctag

SEQ ID NO: 61163 - DNA, 18 bp, Artificial Sequence
  Synthetic DNA
tctttcaactcacaaaag

SEQ ID NO: 61164 - DNA, 18 bp, Artificial Sequence
  Synthetic DNA
tctttcgtctcactattg

SEQ ID NO: 61165 - DNA, 18 bp, Artificial Sequence
  Synthetic DNA
tctttctacccactttag

SEQ ID NO: 61166 - DNA, 18 bp, Artificial Sequence
  Synthetic DNA
tctttcttctcactaaag

SEQ ID NO: 61167 - DNA, 18 bp, Artificial Sequence
  Synthetic DNA
tcttttgactctctatag

SEQ ID NO: 61168 - DNA, 18 bp, Artificial Sequence
  Synthetic DNA
tgaaaacacctgctattg

SEQ ID NO: 61169 - DNA, 18 bp, Artificial Sequence
  Synthetic DNA
tgaaacgactctatattg

SEQ ID NO: 61170 - DNA, 18 bp, Artificial Sequence
  Synthetic DNA
tgaaacgagattaaattg

SEQ ID NO: 61171 - DNA, 18 bp, Artificial Sequence
  Synthetic DNA
tgaaacgattccatatag

SEQ ID NO: 61172 - DNA, 18 bp, Artificial Sequence
  Synthetic DNA
tgaaactagaaactttgg

SEQ ID NO: 61173 - DNA, 18 bp, Artificial Sequence
  Synthetic DNA
tgaaagctgtcactattg

SEQ ID NO: 61174 - DNA, 18 bp, Artificial Sequence
  Synthetic DNA
tgaaaggtctaactagag

SEQ ID NO: 61175 - DNA, 18 bp, Artificial Sequence
  Synthetic DNA
tgaaatgacacactaaag

SEQ ID NO: 61176 - DNA, 18 bp, Artificial Sequence
  Synthetic DNA
tgaaatgacacgctatgg

SEQ ID NO: 61177 - DNA, 18 bp, Artificial Sequence
  Synthetic DNA
tgaacagattccctttag

SEQ ID NO: 61178 - DNA, 18 bp, Artificial Sequence
  Synthetic DNA
tgaagagactctctattg

SEQ ID NO: 61179 - DNA, 18 bp, Artificial Sequence
  Synthetic DNA
tgaagccattcattggag

SEQ ID NO: 61180 - DNA, 18 bp, Artificial Sequence
  Synthetic DNA
tgaataaaatctctatag

SEQ ID NO: 61181 - DNA, 18 bp, Artificial Sequence
  Synthetic DNA
tgaatcgagtctctatag

SEQ ID NO: 61182 - DNA, 18 bp, Artificial Sequence
  Synthetic DNA
tgaatcgtctcactaagg

SEQ ID NO: 61183 - DNA, 18 bp, Artificial Sequence
  Synthetic DNA
tgaattgattctctattg

SEQ ID NO: 61184 - DNA, 18 bp, Artificial Sequence
  Synthetic DNA
tgacacatttcactatag

SEQ ID NO: 61185 - DNA, 18 bp, Artificial Sequence
  Synthetic DNA
tgacacgtctctctatgg

SEQ ID NO: 61186 - DNA, 18 bp, Artificial Sequence
  Synthetic DNA
tgacacgtcttagtatcg

SEQ ID NO: 61187 - DNA, 18 bp, Artificial Sequence
  Synthetic DNA
tgacacttaactctattg

SEQ ID NO: 61188 - DNA, 18 bp, Artificial Sequence
  Synthetic DNA
tgacaggactcacacttg

SEQ ID NO: 61189 - DNA, 18 bp, Artificial Sequence
  Synthetic DNA
tgacatgtctatctaaag

SEQ ID NO: 61190 - DNA, 18 bp, Artificial Sequence
  Synthetic DNA
tgacatgtctatctgaag

SEQ ID NO: 61191 - DNA, 18 bp, Artificial Sequence
  Synthetic DNA
tgacccatcgcactatcg

SEQ ID NO: 61192 - DNA, 18 bp, Artificial Sequence
  Synthetic DNA
tgacgtgatagattttag

SEQ ID NO: 61193 - DNA, 18 bp, Artificial Sequence
  Synthetic DNA
tgactcgactatctggtg

SEQ ID NO: 61194 - DNA, 18 bp, Artificial Sequence
  Synthetic DNA
tgactggactcattatag

SEQ ID NO: 61195 - DNA, 18 bp, Artificial Sequence
  Synthetic DNA
tgagacgactctcattag

SEQ ID NO: 61196 - DNA, 18 bp, Artificial Sequence
  Synthetic DNA
tgagacgtttacctaatg

SEQ ID NO: 61197 - DNA, 18 bp, Artificial Sequence
  Synthetic DNA
tgaggcgactctctattg

SEQ ID NO: 61198 - DNA, 18 bp, Artificial Sequence
  Synthetic DNA
tgataagaatcgctaaag

SEQ ID NO: 61199 - DNA, 18 bp, Artificial Sequence
  Synthetic DNA
tgataagacattttatag

SEQ ID NO: 61200 - DNA, 18 bp, Artificial Sequence
  Synthetic DNA
tgataaggcacacaatag

SEQ ID NO: 61201 - DNA, 18 bp, Artificial Sequence
  Synthetic DNA
tgataaggctctctttag

SEQ ID NO: 61202 - DNA, 18 bp, Artificial Sequence
  Synthetic DNA
tgataatactctctgcag

SEQ ID NO: 61203 - DNA, 18 bp, Artificial Sequence
  Synthetic DNA
tgatacaacagaccattg

SEQ ID NO: 61204 - DNA, 18 bp, Artificial Sequence
  Synthetic DNA
tgatacaagttgctatgg

SEQ ID NO: 61205 - DNA, 18 bp, Artificial Sequence
  Synthetic DNA
tgatacaattcacgattg

SEQ ID NO: 61206 - DNA, 18 bp, Artificial Sequence
  Synthetic DNA
tgatacacctctccagtg

SEQ ID NO: 61207 - DNA, 18 bp, Artificial Sequence
  Synthetic DNA
tgatacagctcagtaaag

SEQ ID NO: 61208 - DNA, 18 bp, Artificial Sequence
  Synthetic DNA
tgataccactaattctag

SEQ ID NO: 61209 - DNA, 18 bp, Artificial Sequence
  Synthetic DNA
tgataccggtcactaaag

SEQ ID NO: 61210 - DNA, 18 bp, Artificial Sequence
  Synthetic DNA
tgatacgaaccgatatag

SEQ ID NO: 61211 - DNA, 18 bp, Artificial Sequence
  Synthetic DNA
tgatacgacacataacgg

SEQ ID NO: 61212 - DNA, 18 bp, Artificial Sequence
  Synthetic DNA
tgatacgacatcgtatag

SEQ ID NO: 61213 - DNA, 18 bp, Artificial Sequence
  Synthetic DNA
tgatacgacattttatag

SEQ ID NO: 61214 - DNA, 18 bp, Artificial Sequence
  Synthetic DNA
tgatacgaccctcttcag

SEQ ID NO: 61215 - DNA, 18 bp, Artificial Sequence
  Synthetic DNA
tgatacgatacgttatag

SEQ ID NO: 61216 - DNA, 18 bp, Artificial Sequence
  Synthetic DNA
tgatacgattcacttatg

SEQ ID NO: 61217 - DNA, 18 bp, Artificial Sequence
  Synthetic DNA
tgatacgcctaattatgg

SEQ ID NO: 61218 - DNA, 18 bp, Artificial Sequence
  Synthetic DNA
tgatacgcgtaagtatag

SEQ ID NO: 61219 - DNA, 18 bp, Artificial Sequence
  Synthetic DNA
tgatacgctttgcacgag

SEQ ID NO: 61220 - DNA, 18 bp, Artificial Sequence
  Synthetic DNA
tgatacggcactctctag

SEQ ID NO: 61221 - DNA, 18 bp, Artificial Sequence
  Synthetic DNA
tgatacggcccaataatg

SEQ ID NO: 61222 - DNA, 18 bp, Artificial Sequence
  Synthetic DNA
tgatacggcttacaaaag

SEQ ID NO: 61223 - DNA, 18 bp, Artificial Sequence
  Synthetic DNA
tgatacggttcactaatg

SEQ ID NO: 61224 - DNA, 18 bp, Artificial Sequence
  Synthetic DNA
tgatacgtattactttag

SEQ ID NO: 61225 - DNA, 18 bp, Artificial Sequence
  Synthetic DNA
tgatacgtcagactacag

SEQ ID NO: 61226 - DNA, 18 bp, Artificial Sequence
  Synthetic DNA
tgatacgtcatattaaag

SEQ ID NO: 61227 - DNA, 18 bp, Artificial Sequence
  Synthetic DNA
tgatacgtccatcaatag

SEQ ID NO: 61228 - DNA, 18 bp, Artificial Sequence
  Synthetic DNA
tgatacgtctaacaatcg

SEQ ID NO: 61229 - DNA, 18 bp, Artificial Sequence
  Synthetic DNA
tgatacgtctaagtatgg

SEQ ID NO: 61230 - DNA, 18 bp, Artificial Sequence
  Synthetic DNA
tgatacgtctatttatag

SEQ ID NO: 61231 - DNA, 18 bp, Artificial Sequence
  Synthetic DNA
tgatacgtctcaatgaag

SEQ ID NO: 61232 - DNA, 18 bp, Artificial Sequence
  Synthetic DNA
tgatacgtctccagatag

SEQ ID NO: 61233 - DNA, 18 bp, Artificial Sequence
  Synthetic DNA
tgatacgtctctatctag

SEQ ID NO: 61234 - DNA, 18 bp, Artificial Sequence
  Synthetic DNA
tgatactactccgtcaag

SEQ ID NO: 61235 - DNA, 18 bp, Artificial Sequence
  Synthetic DNA
tgatactactctttaaag

SEQ ID NO: 61236 - DNA, 18 bp, Artificial Sequence
  Synthetic DNA
tgatacttgtaacgattg

SEQ ID NO: 61237 - DNA, 18 bp, Artificial Sequence
  Synthetic DNA
tgataggactaactctgg

SEQ ID NO: 61238 - DNA, 18 bp, Artificial Sequence
  Synthetic DNA
tgataggtctcaaagtag

SEQ ID NO: 61239 - DNA, 18 bp, Artificial Sequence
  Synthetic DNA
tgatataactctttttcg

SEQ ID NO: 61240 - DNA, 18 bp, Artificial Sequence
  Synthetic DNA
tgatatcacgcactatcg

SEQ ID NO: 61241 - DNA, 18 bp, Artificial Sequence
  Synthetic DNA
tgatatgaatgactaagg

SEQ ID NO: 61242 - DNA, 18 bp, Artificial Sequence
  Synthetic DNA
tgatatgattcaaattag

SEQ ID NO: 61243 - DNA, 18 bp, Artificial Sequence
  Synthetic DNA
tgatattatttactaaag

SEQ ID NO: 61244 - DNA, 18 bp, Artificial Sequence
  Synthetic DNA
tgatccaacttacaatag

SEQ ID NO: 61245 - DNA, 18 bp, Artificial Sequence
  Synthetic DNA
tgatccgcaacatattag

SEQ ID NO: 61246 - DNA, 18 bp, Artificial Sequence
  Synthetic DNA
tgatccgtctttgttgtg

SEQ ID NO: 61247 - DNA, 18 bp, Artificial Sequence
  Synthetic DNA
tgatcctaccaactttag

SEQ ID NO: 61248 - DNA, 18 bp, Artificial Sequence
  Synthetic DNA
tgatgagtctctttatcg

SEQ ID NO: 61249 - DNA, 18 bp, Artificial Sequence
  Synthetic DNA
tgatgcgaatcactactg

SEQ ID NO: 61250 - DNA, 18 bp, Artificial Sequence
  Synthetic DNA
tgatgcgagtcaccaaag

SEQ ID NO: 61251 - DNA, 18 bp, Artificial Sequence
  Synthetic DNA
tgattagactcattattg

SEQ ID NO: 61252 - DNA, 18 bp, Artificial Sequence
  Synthetic DNA
tgattagactctcaaaag

SEQ ID NO: 61253 - DNA, 18 bp, Artificial Sequence
  Synthetic DNA
tgattcaactagatgctg

SEQ ID NO: 61254 - DNA, 18 bp, Artificial Sequence
  Synthetic DNA
tgattcaactctcaatag

SEQ ID NO: 61255 - DNA, 18 bp, Artificial Sequence
  Synthetic DNA
tgattcgacagactattg

SEQ ID NO: 61256 - DNA, 18 bp, Artificial Sequence
  Synthetic DNA
tgattcgacatactgtag

SEQ ID NO: 61257 - DNA, 18 bp, Artificial Sequence
  Synthetic DNA
tgattcgactcgcaattg

SEQ ID NO: 61258 - DNA, 18 bp, Artificial Sequence
  Synthetic DNA
tgattcgactctaaatgg

SEQ ID NO: 61259 - DNA, 18 bp, Artificial Sequence
  Synthetic DNA
tgattcgcctctttaccg

SEQ ID NO: 61260 - DNA, 18 bp, Artificial Sequence
  Synthetic DNA
tgattcgcttttctatag

SEQ ID NO: 61261 - DNA, 18 bp, Artificial Sequence
  Synthetic DNA
tgattcgtctcattttag

SEQ ID NO: 61262 - DNA, 18 bp, Artificial Sequence
  Synthetic DNA
tgattcgtgtccatttag

SEQ ID NO: 61263 - DNA, 18 bp, Artificial Sequence
  Synthetic DNA
tgattctactcctcctag

SEQ ID NO: 61264 - DNA, 18 bp, Artificial Sequence
  Synthetic DNA
tgattggacttactaaag

SEQ ID NO: 61265 - DNA, 18 bp, Artificial Sequence
  Synthetic DNA
tgattggtctcgctatgg

SEQ ID NO: 61266 - DNA, 18 bp, Artificial Sequence
  Synthetic DNA
tgcaaagcctccctattg

SEQ ID NO: 61267 - DNA, 18 bp, Artificial Sequence
  Synthetic DNA
tgcaatgtaacacaatag

SEQ ID NO: 61268 - DNA, 18 bp, Artificial Sequence
  Synthetic DNA
tgctaagtctcaccattg

SEQ ID NO: 61269 - DNA, 18 bp, Artificial Sequence
  Synthetic DNA
tgctacacctcacaatag

SEQ ID NO: 61270 - DNA, 18 bp, Artificial Sequence
  Synthetic DNA
tgctaggcctcacttccg

SEQ ID NO: 61271 - DNA, 18 bp, Artificial Sequence
  Synthetic DNA
tgctagtcctaaatatag

SEQ ID NO: 61272 - DNA, 18 bp, Artificial Sequence
  Synthetic DNA
tggaacgactcacattgg

SEQ ID NO: 61273 - DNA, 18 bp, Artificial Sequence
  Synthetic DNA
tggaccgaccctctttag

SEQ ID NO: 61274 - DNA, 18 bp, Artificial Sequence
  Synthetic DNA
tggtaagactctctattg

SEQ ID NO: 61275 - DNA, 18 bp, Artificial Sequence
  Synthetic DNA
tggtacgatttactaatg

SEQ ID NO: 61276 - DNA, 18 bp, Artificial Sequence
  Synthetic DNA
tggtacgccttactattg

SEQ ID NO: 61277 - DNA, 18 bp, Artificial Sequence
  Synthetic DNA
tggtacgccttgctattg

SEQ ID NO: 61278 - DNA, 18 bp, Artificial Sequence
  Synthetic DNA
tggtactactcgttatag

SEQ ID NO: 61279 - DNA, 18 bp, Artificial Sequence
  Synthetic DNA
tggtacttatcactatag

SEQ ID NO: 61280 - DNA, 18 bp, Artificial Sequence
  Synthetic DNA
tggtatgatttgatattg

SEQ ID NO: 61281 - DNA, 18 bp, Artificial Sequence
  Synthetic DNA
tggtattagtcactattg

SEQ ID NO: 61282 - DNA, 18 bp, Artificial Sequence
  Synthetic DNA
tggtcttacaaactctag

SEQ ID NO: 61283 - DNA, 18 bp, Artificial Sequence
  Synthetic DNA
tggtgagaaactcagtag

SEQ ID NO: 61284 - DNA, 18 bp, Artificial Sequence
  Synthetic DNA
tggttcgacttacaattg

SEQ ID NO: 61285 - DNA, 18 bp, Artificial Sequence
  Synthetic DNA
tggttcgattcaccacag

SEQ ID NO: 61286 - DNA, 18 bp, Artificial Sequence
  Synthetic DNA
tggttcgtttgtctagag

SEQ ID NO: 61287 - DNA, 18 bp, Artificial Sequence
  Synthetic DNA
tggttctactctcttttg

SEQ ID NO: 61288 - DNA, 18 bp, Artificial Sequence
  Synthetic DNA
tggtttgacaccctagag

SEQ ID NO: 61289 - DNA, 18 bp, Artificial Sequence
  Synthetic DNA
tgtaaccacacactattg

SEQ ID NO: 61290 - DNA, 18 bp, Artificial Sequence
  Synthetic DNA
tgtaacgcctccctttgg

SEQ ID NO: 61291 - DNA, 18 bp, Artificial Sequence
  Synthetic DNA
tgtaacgcttcaatatag

SEQ ID NO: 61292 - DNA, 18 bp, Artificial Sequence
  Synthetic DNA
tgtatcgactcattatag

SEQ ID NO: 61293 - DNA, 18 bp, Artificial Sequence
  Synthetic DNA
tgtatcgactctctatcg

SEQ ID NO: 61294 - DNA, 18 bp, Artificial Sequence
  Synthetic DNA
tgtcacaacttataaaag

SEQ ID NO: 61295 - DNA, 18 bp, Artificial Sequence
  Synthetic DNA
tgtcttgaatcactcgag

SEQ ID NO: 61296 - DNA, 18 bp, Artificial Sequence
  Synthetic DNA
tgttaataataaatatag

SEQ ID NO: 61297 - DNA, 18 bp, Artificial Sequence
  Synthetic DNA
tgttaattcagactacag

SEQ ID NO: 61298 - DNA, 18 bp, Artificial Sequence
  Synthetic DNA
tgttacaagtaacattag

SEQ ID NO: 61299 - DNA, 18 bp, Artificial Sequence
  Synthetic DNA
tgttaccactctccatgg

SEQ ID NO: 61300 - DNA, 18 bp, Artificial Sequence
  Synthetic DNA
tgttacgaatcactttgg

SEQ ID NO: 61301 - DNA, 18 bp, Artificial Sequence
  Synthetic DNA
tgttacgactcactgcgg

SEQ ID NO: 61302 - DNA, 18 bp, Artificial Sequence
  Synthetic DNA
tgttacgcctcacattag

SEQ ID NO: 61303 - DNA, 18 bp, Artificial Sequence
  Synthetic DNA
tgttactaatatctgtag

SEQ ID NO: 61304 - DNA, 18 bp, Artificial Sequence
  Synthetic DNA
tgttaggacgcacgaaag

SEQ ID NO: 61305 - DNA, 18 bp, Artificial Sequence
  Synthetic DNA
tgttatgactctctttcg

SEQ ID NO: 61306 - DNA, 18 bp, Artificial Sequence
  Synthetic DNA
tgttccaacacactattg

SEQ ID NO: 61307 - DNA, 18 bp, Artificial Sequence
  Synthetic DNA
tgttccgactctcaataa

SEQ ID NO: 61308 - DNA, 18 bp, Artificial Sequence
  Synthetic DNA
tgttgatgctaactatag

SEQ ID NO: 61309 - DNA, 18 bp, Artificial Sequence
  Synthetic DNA
tgttgcgattcactacag

SEQ ID NO: 61310 - DNA, 18 bp, Artificial Sequence
  Synthetic DNA
tgtttcaactttctaaag

SEQ ID NO: 61311 - DNA, 18 bp, Artificial Sequence
  Synthetic DNA
tgtttcgacttactttag

SEQ ID NO: 61312 - DNA, 18 bp, Artificial Sequence
  Synthetic DNA
tgtttcgtacaaatatag

SEQ ID NO: 61313 - DNA, 18 bp, Artificial Sequence
  Synthetic DNA
ttaaaaaactctctttag

SEQ ID NO: 61314 - DNA, 18 bp, Artificial Sequence
  Synthetic DNA
ttaaaagactcagtttag

SEQ ID NO: 61315 - DNA, 18 bp, Artificial Sequence
  Synthetic DNA
ttaaaagactcgttatag

SEQ ID NO: 61316 - DNA, 18 bp, Artificial Sequence
  Synthetic DNA
ttaaaagtctcaccatgg

SEQ ID NO: 61317 - DNA, 18 bp, Artificial Sequence
  Synthetic DNA
ttaaaagtttctcgatgg

SEQ ID NO: 61318 - DNA, 18 bp, Artificial Sequence
  Synthetic DNA
ttaaaccattcagcatag

SEQ ID NO: 61319 - DNA, 18 bp, Artificial Sequence
  Synthetic DNA
ttaaaccattccttgtag

SEQ ID NO: 61320 - DNA, 18 bp, Artificial Sequence
  Synthetic DNA
ttaaacgaatctcaaatg

SEQ ID NO: 61321 - DNA, 18 bp, Artificial Sequence
  Synthetic DNA
ttaaacgaatctttattg

SEQ ID NO: 61322 - DNA, 18 bp, Artificial Sequence
  Synthetic DNA
ttaaacgacacacgtttg

SEQ ID NO: 61323 - DNA, 18 bp, Artificial Sequence
  Synthetic DNA
ttaaacgacacactgaag

SEQ ID NO: 61324 - DNA, 18 bp, Artificial Sequence
  Synthetic DNA
ttaaacgacattctatag

SEQ ID NO: 61325 - DNA, 18 bp, Artificial Sequence
  Synthetic DNA
ttaaacgacttatcttgg

SEQ ID NO: 61326 - DNA, 18 bp, Artificial Sequence
  Synthetic DNA
ttaaacgatacgctattg

SEQ ID NO: 61327 - DNA, 18 bp, Artificial Sequence
  Synthetic DNA
ttaaacgattcaatttag

SEQ ID NO: 61328 - DNA, 18 bp, Artificial Sequence
  Synthetic DNA
ttaaacgccacactagag

SEQ ID NO: 61329 - DNA, 18 bp, Artificial Sequence
  Synthetic DNA
ttaaacgccgttttctag

SEQ ID NO: 61330 - DNA, 18 bp, Artificial Sequence
  Synthetic DNA
ttaaacgcctcagcatag

SEQ ID NO: 61331 - DNA, 18 bp, Artificial Sequence
  Synthetic DNA
ttaaacgcttcaatatag

SEQ ID NO: 61332 - DNA, 18 bp, Artificial Sequence
  Synthetic DNA
ttaaacgtatcataattg

SEQ ID NO: 61333 - DNA, 18 bp, Artificial Sequence
  Synthetic DNA
ttaaacgtggcactattg

SEQ ID NO: 61334 - DNA, 18 bp, Artificial Sequence
  Synthetic DNA
ttaaacgttaaactcaag

SEQ ID NO: 61335 - DNA, 18 bp, Artificial Sequence
  Synthetic DNA
ttaaactacacacaagtg

SEQ ID NO: 61336 - DNA, 18 bp, Artificial Sequence
  Synthetic DNA
ttaaactattccctattg

SEQ ID NO: 61337 - DNA, 18 bp, Artificial Sequence
  Synthetic DNA
ttaaacttatctcgatag

SEQ ID NO: 61338 - DNA, 18 bp, Artificial Sequence
  Synthetic DNA
ttaaacttctcacaaaag

SEQ ID NO: 61339 - DNA, 18 bp, Artificial Sequence
  Synthetic DNA
ttaaacttctcactattg

SEQ ID NO: 61340 - DNA, 18 bp, Artificial Sequence
  Synthetic DNA
ttaaacttttcacttgag

SEQ ID NO: 61341 - DNA, 18 bp, Artificial Sequence
  Synthetic DNA
ttaaaggtctccctttag

SEQ ID NO: 61342 - DNA, 18 bp, Artificial Sequence
  Synthetic DNA
ttaaaggtcttactctag

SEQ ID NO: 61343 - DNA, 18 bp, Artificial Sequence
  Synthetic DNA
ttaaataacttactgatg

SEQ ID NO: 61344 - DNA, 18 bp, Artificial Sequence
  Synthetic DNA
ttaaatgactaactattg

SEQ ID NO: 61345 - DNA, 18 bp, Artificial Sequence
  Synthetic DNA
ttaaatgactcaacttag

SEQ ID NO: 61346 - DNA, 18 bp, Artificial Sequence
  Synthetic DNA
ttaacagtttcacagtag

SEQ ID NO: 61347 - DNA, 18 bp, Artificial Sequence
  Synthetic DNA
ttaacccactcactctag

SEQ ID NO: 61348 - DNA, 18 bp, Artificial Sequence
  Synthetic DNA
ttaagcgaaccactatag

SEQ ID NO: 61349 - DNA, 18 bp, Artificial Sequence
  Synthetic DNA
ttaagcgtcgctctctag

SEQ ID NO: 61350 - DNA, 18 bp, Artificial Sequence
  Synthetic DNA
ttaaggaactaactatag

SEQ ID NO: 61351 - DNA, 18 bp, Artificial Sequence
  Synthetic DNA
ttaatagactcacaatcg

SEQ ID NO: 61352 - DNA, 18 bp, Artificial Sequence
  Synthetic DNA
ttaatcaagaaaccatag

SEQ ID NO: 61353 - DNA, 18 bp, Artificial Sequence
  Synthetic DNA
ttaatcctctcactccag

SEQ ID NO: 61354 - DNA, 18 bp, Artificial Sequence
  Synthetic DNA
ttaatcgacacagaatag

SEQ ID NO: 61355 - DNA, 18 bp, Artificial Sequence
  Synthetic DNA
ttaatcgacaggcttttg

SEQ ID NO: 61356 - DNA, 18 bp, Artificial Sequence
  Synthetic DNA
ttaatcgactctctaaag

SEQ ID NO: 61357 - DNA, 18 bp, Artificial Sequence
  Synthetic DNA
ttaatcgattcagtatag

SEQ ID NO: 61358 - DNA, 18 bp, Artificial Sequence
  Synthetic DNA
ttaatcgccatacaatag

SEQ ID NO: 61359 - DNA, 18 bp, Artificial Sequence
  Synthetic DNA
ttaatctactatctatag

SEQ ID NO: 61360 - DNA, 18 bp, Artificial Sequence
  Synthetic DNA
ttaatctactcatgatag

SEQ ID NO: 61361 - DNA, 18 bp, Artificial Sequence
  Synthetic DNA
ttaatcttctcactatag

SEQ ID NO: 61362 - DNA, 18 bp, Artificial Sequence
  Synthetic DNA
ttaatggtcacacgatag

SEQ ID NO: 61363 - DNA, 18 bp, Artificial Sequence
  Synthetic DNA
ttacaagacttacttatg

SEQ ID NO: 61364 - DNA, 18 bp, Artificial Sequence
  Synthetic DNA
ttacaagtgtcagtctag

SEQ ID NO: 61365 - DNA, 18 bp, Artificial Sequence
  Synthetic DNA
ttacacaactcgctattg

SEQ ID NO: 61366 - DNA, 18 bp, Artificial Sequence
  Synthetic DNA
ttacacaagggactttag

SEQ ID NO: 61367 - DNA, 18 bp, Artificial Sequence
  Synthetic DNA
ttacaccattcactgtag

SEQ ID NO: 61368 - DNA, 18 bp, Artificial Sequence
  Synthetic DNA
ttacaccattcattatag

SEQ ID NO: 61369 - DNA, 18 bp, Artificial Sequence
  Synthetic DNA
ttacacgaattccaatag

SEQ ID NO: 61370 - DNA, 18 bp, Artificial Sequence
  Synthetic DNA
ttacacgacttattattg

SEQ ID NO: 61371 - DNA, 18 bp, Artificial Sequence
  Synthetic DNA
ttacacgcatccctaacg

SEQ ID NO: 61372 - DNA, 18 bp, Artificial Sequence
  Synthetic DNA
ttacacgtctcacaactg

SEQ ID NO: 61373 - DNA, 18 bp, Artificial Sequence
  Synthetic DNA
ttacacgtctcacattcg

SEQ ID NO: 61374 - DNA, 18 bp, Artificial Sequence
  Synthetic DNA
ttacacgtctcaccattg

SEQ ID NO: 61375 - DNA, 18 bp, Artificial Sequence
  Synthetic DNA
ttacacgtttcactgtag

SEQ ID NO: 61376 - DNA, 18 bp, Artificial Sequence
  Synthetic DNA
ttacactactcactttcg

SEQ ID NO: 61377 - DNA, 18 bp, Artificial Sequence
  Synthetic DNA
ttacaggactccgtatag

SEQ ID NO: 61378 - DNA, 18 bp, Artificial Sequence
  Synthetic DNA
ttacatagctcactatag

SEQ ID NO: 61379 - DNA, 18 bp, Artificial Sequence
  Synthetic DNA
ttacatgactgtctatag

SEQ ID NO: 61380 - DNA, 18 bp, Artificial Sequence
  Synthetic DNA
ttacatgatttactatag

SEQ ID NO: 61381 - DNA, 18 bp, Artificial Sequence
  Synthetic DNA
ttacatgtctcacttaag

SEQ ID NO: 61382 - DNA, 18 bp, Artificial Sequence
  Synthetic DNA
ttaccctactctctatcg

SEQ ID NO: 61383 - DNA, 18 bp, Artificial Sequence
  Synthetic DNA
ttactagacccactatag

SEQ ID NO: 61384 - DNA, 18 bp, Artificial Sequence
  Synthetic DNA
ttactcaactcacataag

SEQ ID NO: 61385 - DNA, 18 bp, Artificial Sequence
  Synthetic DNA
ttactcgattcacaatag

SEQ ID NO: 61386 - DNA, 18 bp, Artificial Sequence
  Synthetic DNA
ttacttgacacactatag

SEQ ID NO: 61387 - DNA, 18 bp, Artificial Sequence
  Synthetic DNA
ttagaagactcactgaag

SEQ ID NO: 61388 - DNA, 18 bp, Artificial Sequence
  Synthetic DNA
ttagaatactccctattg

SEQ ID NO: 61389 - DNA, 18 bp, Artificial Sequence
  Synthetic DNA
ttagaccattaatagatg

SEQ ID NO: 61390 - DNA, 18 bp, Artificial Sequence
  Synthetic DNA
ttagacgacacacgagcg

SEQ ID NO: 61391 - DNA, 18 bp, Artificial Sequence
  Synthetic DNA
ttagacgaccaaatatcg

SEQ ID NO: 61392 - DNA, 18 bp, Artificial Sequence
  Synthetic DNA
ttagacgtctttctatcg

SEQ ID NO: 61393 - DNA, 18 bp, Artificial Sequence
  Synthetic DNA
ttagactcgtcccaacag

SEQ ID NO: 61394 - DNA, 18 bp, Artificial Sequence
  Synthetic DNA
ttagatgactgtctatag

SEQ ID NO: 61395 - DNA, 18 bp, Artificial Sequence
  Synthetic DNA
ttagctggctctctatag

SEQ ID NO: 61396 - DNA, 18 bp, Artificial Sequence
  Synthetic DNA
ttagtcgattcattatcg

SEQ ID NO: 61397 - DNA, 18 bp, Artificial Sequence
  Synthetic DNA
ttagtcgtctcactttcg

SEQ ID NO: 61398 - DNA, 18 bp, Artificial Sequence
  Synthetic DNA
ttagttgactcactattg

SEQ ID NO: 61399 - DNA, 18 bp, Artificial Sequence
  Synthetic DNA
ttataaaactcaccatcg

SEQ ID NO: 61400 - DNA, 18 bp, Artificial Sequence
  Synthetic DNA
ttataaatttcgctatag

SEQ ID NO: 61401 - DNA, 18 bp, Artificial Sequence
  Synthetic DNA
ttataagacaacccttag

SEQ ID NO: 61402 - DNA, 18 bp, Artificial Sequence
  Synthetic DNA
ttataagacaaggtaaag

SEQ ID NO: 61403 - DNA, 18 bp, Artificial Sequence
  Synthetic DNA
ttataagaccaactaatg

SEQ ID NO: 61404 - DNA, 18 bp, Artificial Sequence
  Synthetic DNA
ttataagacgcactaatg

SEQ ID NO: 61405 - DNA, 18 bp, Artificial Sequence
  Synthetic DNA
ttataagactcactgatg

SEQ ID NO: 61406 - DNA, 18 bp, Artificial Sequence
  Synthetic DNA
ttataagacttaccttag

SEQ ID NO: 61407 - DNA, 18 bp, Artificial Sequence
  Synthetic DNA
ttataaggcctacaatag

SEQ ID NO: 61408 - DNA, 18 bp, Artificial Sequence
  Synthetic DNA
ttataaggctcagtaaag

SEQ ID NO: 61409 - DNA, 18 bp, Artificial Sequence
  Synthetic DNA
ttataataatcactattg

SEQ ID NO: 61410 - DNA, 18 bp, Artificial Sequence
  Synthetic DNA
ttataatacacaaaatgg

SEQ ID NO: 61411 - DNA, 18 bp, Artificial Sequence
  Synthetic DNA
ttatacaacacattgtag

SEQ ID NO: 61412 - DNA, 18 bp, Artificial Sequence
  Synthetic DNA
ttatacaacattctattg

SEQ ID NO: 61413 - DNA, 18 bp, Artificial Sequence
  Synthetic DNA
ttatacaactcatttaag

SEQ ID NO: 61414 - DNA, 18 bp, Artificial Sequence
  Synthetic DNA
ttatacaactccttattg

SEQ ID NO: 61415 - DNA, 18 bp, Artificial Sequence
  Synthetic DNA
ttatacaactgccttttg

SEQ ID NO: 61416 - DNA, 18 bp, Artificial Sequence
  Synthetic DNA
ttatacaattatctattg

SEQ ID NO: 61417 - DNA, 18 bp, Artificial Sequence
  Synthetic DNA
ttatacacttcattttag

SEQ ID NO: 61418 - DNA, 18 bp, Artificial Sequence
  Synthetic DNA
ttatacagcacactctgg

SEQ ID NO: 61419 - DNA, 18 bp, Artificial Sequence
  Synthetic DNA
ttatacagcttagtttag

SEQ ID NO: 61420 - DNA, 18 bp, Artificial Sequence
  Synthetic DNA
ttatacatcaccctatag

SEQ ID NO: 61421 - DNA, 18 bp, Artificial Sequence
  Synthetic DNA
ttatacatcaccttatag

SEQ ID NO: 61422 - DNA, 18 bp, Artificial Sequence
  Synthetic DNA
ttatacatttcaccctag

SEQ ID NO: 61423 - DNA, 18 bp, Artificial Sequence
  Synthetic DNA
ttataccacagcctttag

SEQ ID NO: 61424 - DNA, 18 bp, Artificial Sequence
  Synthetic DNA
ttataccacccgcaatag

SEQ ID NO: 61425 - DNA, 18 bp, Artificial Sequence
  Synthetic DNA
ttataccactcacctaag

SEQ ID NO: 61426 - DNA, 18 bp, Artificial Sequence
  Synthetic DNA
ttataccacttaataaag

SEQ ID NO: 61427 - DNA, 18 bp, Artificial Sequence
  Synthetic DNA
ttataccacttcctatgg

SEQ ID NO: 61428 - DNA, 18 bp, Artificial Sequence
  Synthetic DNA
ttataccagtcaaaatag

SEQ ID NO: 61429 - DNA, 18 bp, Artificial Sequence
  Synthetic DNA
ttatacctctcaccaaag

SEQ ID NO: 61430 - DNA, 18 bp, Artificial Sequence
  Synthetic DNA
ttatacgaaacattaaag

SEQ ID NO: 61431 - DNA, 18 bp, Artificial Sequence
  Synthetic DNA
ttatacgaatatcaatag

SEQ ID NO: 61432 - DNA, 18 bp, Artificial Sequence
  Synthetic DNA
ttatacgaatcacaaatg

SEQ ID NO: 61433 - DNA, 18 bp, Artificial Sequence
  Synthetic DNA
ttatacgaatcacacaag

SEQ ID NO: 61434 - DNA, 18 bp, Artificial Sequence
  Synthetic DNA
ttatacgaatcccagtag

SEQ ID NO: 61435 - DNA, 18 bp, Artificial Sequence
  Synthetic DNA
ttatacgaatggcaatag

SEQ ID NO: 61436 - DNA, 18 bp, Artificial Sequence
  Synthetic DNA
ttatacgacacaaaattg

SEQ ID NO: 61437 - DNA, 18 bp, Artificial Sequence
  Synthetic DNA
ttatacgacacaacaatg

SEQ ID NO: 61438 - DNA, 18 bp, Artificial Sequence
  Synthetic DNA
ttatacgacacatcattg

SEQ ID NO: 61439 - DNA, 18 bp, Artificial Sequence
  Synthetic DNA
ttatacgacactaaaaag

SEQ ID NO: 61440 - DNA, 18 bp, Artificial Sequence
  Synthetic DNA
ttatacgacactatattg

SEQ ID NO: 61441 - DNA, 18 bp, Artificial Sequence
  Synthetic DNA
ttatacgacactatgttg

SEQ ID NO: 61442 - DNA, 18 bp, Artificial Sequence
  Synthetic DNA
ttatacgacactccagag

SEQ ID NO: 61443 - DNA, 18 bp, Artificial Sequence
  Synthetic DNA
ttatacgacagtttaacg

SEQ ID NO: 61444 - DNA, 18 bp, Artificial Sequence
  Synthetic DNA
ttatacgacataattttg

SEQ ID NO: 61445 - DNA, 18 bp, Artificial Sequence
  Synthetic DNA
ttatacgacgaattatcg

SEQ ID NO: 61446 - DNA, 18 bp, Artificial Sequence
  Synthetic DNA
ttatacgactaactcctg

SEQ ID NO: 61447 - DNA, 18 bp, Artificial Sequence
  Synthetic DNA
ttatacgactcaacctcg

SEQ ID NO: 61448 - DNA, 18 bp, Artificial Sequence
  Synthetic DNA
ttatacgactcgtaaaag

SEQ ID NO: 61449 - DNA, 18 bp, Artificial Sequence
  Synthetic DNA
ttatacgacttagtaggg

SEQ ID NO: 61450 - DNA, 18 bp, Artificial Sequence
  Synthetic DNA
ttatacgactttcagtcg

SEQ ID NO: 61451 - DNA, 18 bp, Artificial Sequence
  Synthetic DNA
ttatacgagtcagcaaag

SEQ ID NO: 61452 - DNA, 18 bp, Artificial Sequence
  Synthetic DNA
ttatacgataacgtatag

SEQ ID NO: 61453 - DNA, 18 bp, Artificial Sequence
  Synthetic DNA
ttatacgatacacgattg

SEQ ID NO: 61454 - DNA, 18 bp, Artificial Sequence
  Synthetic DNA
ttatacgatacagtaatg

SEQ ID NO: 61455 - DNA, 18 bp, Artificial Sequence
  Synthetic DNA
ttatacgattcaccaatg

SEQ ID NO: 61456 - DNA, 18 bp, Artificial Sequence
  Synthetic DNA
ttatacgattccttaaag

SEQ ID NO: 61457 - DNA, 18 bp, Artificial Sequence
  Synthetic DNA
ttatacgatttacagtcg

SEQ ID NO: 61458 - DNA, 18 bp, Artificial Sequence
  Synthetic DNA
ttatacgatttagtatgg

SEQ ID NO: 61459 - DNA, 18 bp, Artificial Sequence
  Synthetic DNA
ttatacgccaatctgaag

SEQ ID NO: 61460 - DNA, 18 bp, Artificial Sequence
  Synthetic DNA
ttatacgccatccaatag

SEQ ID NO: 61461 - DNA, 18 bp, Artificial Sequence
  Synthetic DNA
ttatacgcttccaattcg

SEQ ID NO: 61462 - DNA, 18 bp, Artificial Sequence
  Synthetic DNA
ttatacggcactgtatag

SEQ ID NO: 61463 - DNA, 18 bp, Artificial Sequence
  Synthetic DNA
ttatacggctaagtcttg

SEQ ID NO: 61464 - DNA, 18 bp, Artificial Sequence
  Synthetic DNA
ttatacgtataacaagag

SEQ ID NO: 61465 - DNA, 18 bp, Artificial Sequence
  Synthetic DNA
ttatacgtatcgatatag

SEQ ID NO: 61466 - DNA, 18 bp, Artificial Sequence
  Synthetic DNA
ttatacgtcacgatatag

SEQ ID NO: 61467 - DNA, 18 bp, Artificial Sequence
  Synthetic DNA
ttatacgtccaactattg

SEQ ID NO: 61468 - DNA, 18 bp, Artificial Sequence
  Synthetic DNA
ttatacgtctaacagtag

SEQ ID NO: 61469 - DNA, 18 bp, Artificial Sequence
  Synthetic DNA
ttatacgtctcagaaaag

SEQ ID NO: 61470 - DNA, 18 bp, Artificial Sequence
  Synthetic DNA
ttatacgtctctatattg

SEQ ID NO: 61471 - DNA, 18 bp, Artificial Sequence
  Synthetic DNA
ttatacgtctgattaaag

SEQ ID NO: 61472 - DNA, 18 bp, Artificial Sequence
  Synthetic DNA
ttatactactaaccccag

SEQ ID NO: 61473 - DNA, 18 bp, Artificial Sequence
  Synthetic DNA
ttatactactaacttcag

SEQ ID NO: 61474 - DNA, 18 bp, Artificial Sequence
  Synthetic DNA
ttatactactagctttcg

SEQ ID NO: 61475 - DNA, 18 bp, Artificial Sequence
  Synthetic DNA
ttatactactcatttttg

SEQ ID NO: 61476 - DNA, 18 bp, Artificial Sequence
  Synthetic DNA
ttatactagactatatag

SEQ ID NO: 61477 - DNA, 18 bp, Artificial Sequence
  Synthetic DNA
ttatactatgaactatag

SEQ ID NO: 61478 - DNA, 18 bp, Artificial Sequence
  Synthetic DNA
ttatactattcactaatg

SEQ ID NO: 61479 - DNA, 18 bp, Artificial Sequence
  Synthetic DNA
ttatactatttacaatag

SEQ ID NO: 61480 - DNA, 18 bp, Artificial Sequence
  Synthetic DNA
ttatacttatcattagag

SEQ ID NO: 61481 - DNA, 18 bp, Artificial Sequence
  Synthetic DNA
ttatacttcttactttag

SEQ ID NO: 61482 - DNA, 18 bp, Artificial Sequence
  Synthetic DNA
ttatactttacactatgg

SEQ ID NO: 61483 - DNA, 18 bp, Artificial Sequence
  Synthetic DNA
ttatagcactccctttag

SEQ ID NO: 61484 - DNA, 18 bp, Artificial Sequence
  Synthetic DNA
ttataggaagcacttaag

SEQ ID NO: 61485 - DNA, 18 bp, Artificial Sequence
  Synthetic DNA
ttataggaatcactcttg

SEQ ID NO: 61486 - DNA, 18 bp, Artificial Sequence
  Synthetic DNA
ttataggactcgcaaaag

SEQ ID NO: 61487 - DNA, 18 bp, Artificial Sequence
  Synthetic DNA
ttataggagtcacttttg

SEQ ID NO: 61488 - DNA, 18 bp, Artificial Sequence
  Synthetic DNA
ttataggctccaatatag

SEQ ID NO: 61489 - DNA, 18 bp, Artificial Sequence
  Synthetic DNA
ttataggctttgcttaag

SEQ ID NO: 61490 - DNA, 18 bp, Artificial Sequence
  Synthetic DNA
ttataggtccctctatgg

SEQ ID NO: 61491 - DNA, 18 bp, Artificial Sequence
  Synthetic DNA
ttataggtttcacaatag

SEQ ID NO: 61492 - DNA, 18 bp, Artificial Sequence
  Synthetic DNA
ttatagtacaaactatag

SEQ ID NO: 61493 - DNA, 18 bp, Artificial Sequence
  Synthetic DNA
ttatagtactttatatag

SEQ ID NO: 61494 - DNA, 18 bp, Artificial Sequence
  Synthetic DNA
ttatagttattactatcg

SEQ ID NO: 61495 - DNA, 18 bp, Artificial Sequence
  Synthetic DNA
ttatataacaaactagcg

SEQ ID NO: 61496 - DNA, 18 bp, Artificial Sequence
  Synthetic DNA
ttatataactctttatag

SEQ ID NO: 61497 - DNA, 18 bp, Artificial Sequence
  Synthetic DNA
ttatatatctaactacag

SEQ ID NO: 61498 - DNA, 18 bp, Artificial Sequence
  Synthetic DNA
ttatatcacctactttag

SEQ ID NO: 61499 - DNA, 18 bp, Artificial Sequence
  Synthetic DNA
ttatatgaaacactcaag

SEQ ID NO: 61500 - DNA, 18 bp, Artificial Sequence
  Synthetic DNA
ttatatgactaagaatcg

SEQ ID NO: 61501 - DNA, 18 bp, Artificial Sequence
  Synthetic DNA
ttatatgactgactaacg

SEQ ID NO: 61502 - DNA, 18 bp, Artificial Sequence
  Synthetic DNA
ttatatgacttaatgcag

SEQ ID NO: 61503 - DNA, 18 bp, Artificial Sequence
  Synthetic DNA
ttatatgattcacattag

SEQ ID NO: 61504 - DNA, 18 bp, Artificial Sequence
  Synthetic DNA
ttatatgattctcagtag

SEQ ID NO: 61505 - DNA, 18 bp, Artificial Sequence
  Synthetic DNA
ttatatgattctccatag

SEQ ID NO: 61506 - DNA, 18 bp, Artificial Sequence
  Synthetic DNA
ttatatgtcactatctgg

SEQ ID NO: 61507 - DNA, 18 bp, Artificial Sequence
  Synthetic DNA
ttatatgtcccactctag

SEQ ID NO: 61508 - DNA, 18 bp, Artificial Sequence
  Synthetic DNA
ttatatgtctatctctag

SEQ ID NO: 61509 - DNA, 18 bp, Artificial Sequence
  Synthetic DNA
ttatatgtttcacaaaag

SEQ ID NO: 61510 - DNA, 18 bp, Artificial Sequence
  Synthetic DNA
ttatattaatcactttag

SEQ ID NO: 61511 - DNA, 18 bp, Artificial Sequence
  Synthetic DNA
ttatattaatcgcgtaag

SEQ ID NO: 61512 - DNA, 18 bp, Artificial Sequence
  Synthetic DNA
ttatcagactacgtatag

SEQ ID NO: 61513 - DNA, 18 bp, Artificial Sequence
  Synthetic DNA
ttatcagacttacaattg

SEQ ID NO: 61514 - DNA, 18 bp, Artificial Sequence
  Synthetic DNA
ttatcagtcccacaaaag

SEQ ID NO: 61515 - DNA, 18 bp, Artificial Sequence
  Synthetic DNA
ttatccaagtcgctatcg

SEQ ID NO: 61516 - DNA, 18 bp, Artificial Sequence
  Synthetic DNA
ttatcccacccagtaaag

SEQ ID NO: 61517 - DNA, 18 bp, Artificial Sequence
  Synthetic DNA
ttatccgaactactatag

SEQ ID NO: 61518 - DNA, 18 bp, Artificial Sequence
  Synthetic DNA
ttatccgaatcttgattg

SEQ ID NO: 61519 - DNA, 18 bp, Artificial Sequence
  Synthetic DNA
ttatccgacatactacag

SEQ ID NO: 61520 - DNA, 18 bp, Artificial Sequence
  Synthetic DNA
ttatccgactgaattgag

SEQ ID NO: 61521 - DNA, 18 bp, Artificial Sequence
  Synthetic DNA
ttatccgatttactgttg

SEQ ID NO: 61522 - DNA, 18 bp, Artificial Sequence
  Synthetic DNA
ttatccggcacactttag

SEQ ID NO: 61523 - DNA, 18 bp, Artificial Sequence
  Synthetic DNA
ttatccgtctcactggag

SEQ ID NO: 61524 - DNA, 18 bp, Artificial Sequence
  Synthetic DNA
ttatccgttacacgttag

SEQ ID NO: 61525 - DNA, 18 bp, Artificial Sequence
  Synthetic DNA
ttatcggaatcgctatag

SEQ ID NO: 61526 - DNA, 18 bp, Artificial Sequence
  Synthetic DNA
ttatcggactcgccatat

SEQ ID NO: 61527 - DNA, 18 bp, Artificial Sequence
  Synthetic DNA
ttatcggactcgcttaag

SEQ ID NO: 61528 - DNA, 18 bp, Artificial Sequence
  Synthetic DNA
ttatcggcctggctatag

SEQ ID NO: 61529 - DNA, 18 bp, Artificial Sequence
  Synthetic DNA
ttatcggttttcctattg

SEQ ID NO: 61530 - DNA, 18 bp, Artificial Sequence
  Synthetic DNA
ttatctgtctcaccaaag

SEQ ID NO: 61531 - DNA, 18 bp, Artificial Sequence
  Synthetic DNA
ttatcttactatctacag

SEQ ID NO: 61532 - DNA, 18 bp, Artificial Sequence
  Synthetic DNA
ttatcttcatcactttag

SEQ ID NO: 61533 - DNA, 18 bp, Artificial Sequence
  Synthetic DNA
ttatgagactcagtttag

SEQ ID NO: 61534 - DNA, 18 bp, Artificial Sequence
  Synthetic DNA
ttatgatactaaattaag

SEQ ID NO: 61535 - DNA, 18 bp, Artificial Sequence
  Synthetic DNA
ttatgcaactcatcaaag

SEQ ID NO: 61536 - DNA, 18 bp, Artificial Sequence
  Synthetic DNA
ttatgcgacatactttag

SEQ ID NO: 61537 - DNA, 18 bp, Artificial Sequence
  Synthetic DNA
ttatgcgactaaaaatgg

SEQ ID NO: 61538 - DNA, 18 bp, Artificial Sequence
  Synthetic DNA
ttatgcgactaactgttg

SEQ ID NO: 61539 - DNA, 18 bp, Artificial Sequence
  Synthetic DNA
ttatgcgactcaatgaag

SEQ ID NO: 61540 - DNA, 18 bp, Artificial Sequence
  Synthetic DNA
ttatgcgactcaatgtcg

SEQ ID NO: 61541 - DNA, 18 bp, Artificial Sequence
  Synthetic DNA
ttatgcgactccaattgg

SEQ ID NO: 61542 - DNA, 18 bp, Artificial Sequence
  Synthetic DNA
ttatgcgagtcgctatca

SEQ ID NO: 61543 - DNA, 18 bp, Artificial Sequence
  Synthetic DNA
ttatgcggcttattctag

SEQ ID NO: 61544 - DNA, 18 bp, Artificial Sequence
  Synthetic DNA
ttatgcgtcacccactcg

SEQ ID NO: 61545 - DNA, 18 bp, Artificial Sequence
  Synthetic DNA
ttatgcgtctaacaaaag

SEQ ID NO: 61546 - DNA, 18 bp, Artificial Sequence
  Synthetic DNA
ttatgcgtctctcaatag

SEQ ID NO: 61547 - DNA, 18 bp, Artificial Sequence
  Synthetic DNA
ttatgctacaaactatcg

SEQ ID NO: 61548 - DNA, 18 bp, Artificial Sequence
  Synthetic DNA
ttatgctattaactttag

SEQ ID NO: 61549 - DNA, 18 bp, Artificial Sequence
  Synthetic DNA
ttatgctccttactatag

SEQ ID NO: 61550 - DNA, 18 bp, Artificial Sequence
  Synthetic DNA
ttatgcttctcaataaag

SEQ ID NO: 61551 - DNA, 18 bp, Artificial Sequence
  Synthetic DNA
ttattagagcagccctag

SEQ ID NO: 61552 - DNA, 18 bp, Artificial Sequence
  Synthetic DNA
ttattagattccctatag

SEQ ID NO: 61553 - DNA, 18 bp, Artificial Sequence
  Synthetic DNA
ttattcaacagactatag

SEQ ID NO: 61554 - DNA, 18 bp, Artificial Sequence
  Synthetic DNA
ttattcaactccctttag

SEQ ID NO: 61555 - DNA, 18 bp, Artificial Sequence
  Synthetic DNA
ttattcaagtcaacaaag

SEQ ID NO: 61556 - DNA, 18 bp, Artificial Sequence
  Synthetic DNA
ttattcaattctctatag

SEQ ID NO: 61557 - DNA, 18 bp, Artificial Sequence
  Synthetic DNA
ttattcatctctctctcg

SEQ ID NO: 61558 - DNA, 18 bp, Artificial Sequence
  Synthetic DNA
ttattccacacttaaaag

SEQ ID NO: 61559 - DNA, 18 bp, Artificial Sequence
  Synthetic DNA
ttattccactttctatag

SEQ ID NO: 61560 - DNA, 18 bp, Artificial Sequence
  Synthetic DNA
ttattcgaatctctaaag

SEQ ID NO: 61561 - DNA, 18 bp, Artificial Sequence
  Synthetic DNA
ttattcgaatctcttttg

SEQ ID NO: 61562 - DNA, 18 bp, Artificial Sequence
  Synthetic DNA
ttattcgacaaattattg

SEQ ID NO: 61563 - DNA, 18 bp, Artificial Sequence
  Synthetic DNA
ttattcgactcacttgtg

SEQ ID NO: 61564 - DNA, 18 bp, Artificial Sequence
  Synthetic DNA
ttattcgactcagttcag

SEQ ID NO: 61565 - DNA, 18 bp, Artificial Sequence
  Synthetic DNA
ttattcgactcattcctg

SEQ ID NO: 61566 - DNA, 18 bp, Artificial Sequence
  Synthetic DNA
ttattcgactctgcatag

SEQ ID NO: 61567 - DNA, 18 bp, Artificial Sequence
  Synthetic DNA
ttattcgataccctaaag

SEQ ID NO: 61568 - DNA, 18 bp, Artificial Sequence
  Synthetic DNA
ttattcgattcacatttg

SEQ ID NO: 61569 - DNA, 18 bp, Artificial Sequence
  Synthetic DNA
ttattcgcatcagtattg

SEQ ID NO: 61570 - DNA, 18 bp, Artificial Sequence
  Synthetic DNA
ttattcgtctaattatag

SEQ ID NO: 61571 - DNA, 18 bp, Artificial Sequence
  Synthetic DNA
ttattcgtctctctaaag

SEQ ID NO: 61572 - DNA, 18 bp, Artificial Sequence
  Synthetic DNA
ttattcgtctgactaatg

SEQ ID NO: 61573 - DNA, 18 bp, Artificial Sequence
  Synthetic DNA
ttattctacaaacaatag

SEQ ID NO: 61574 - DNA, 18 bp, Artificial Sequence
  Synthetic DNA
ttattctagtcaccttag

SEQ ID NO: 61575 - DNA, 18 bp, Artificial Sequence
  Synthetic DNA
ttattcttcagcctttag

SEQ ID NO: 61576 - DNA, 18 bp, Artificial Sequence
  Synthetic DNA
ttattgatctgaatctag

SEQ ID NO: 61577 - DNA, 18 bp, Artificial Sequence
  Synthetic DNA
ttattggagtttcaatag

SEQ ID NO: 61578 - DNA, 18 bp, Artificial Sequence
  Synthetic DNA
ttattggattcactgaag

SEQ ID NO: 61579 - DNA, 18 bp, Artificial Sequence
  Synthetic DNA
ttattggctactctattg

SEQ ID NO: 61580 - DNA, 18 bp, Artificial Sequence
  Synthetic DNA
ttattggtcatacactag

SEQ ID NO: 61581 - DNA, 18 bp, Artificial Sequence
  Synthetic DNA
ttattgtacaatcaatgg

SEQ ID NO: 61582 - DNA, 18 bp, Artificial Sequence
  Synthetic DNA
ttattgtgctcccaattg

SEQ ID NO: 61583 - DNA, 18 bp, Artificial Sequence
  Synthetic DNA
ttatttgacatactatag

SEQ ID NO: 61584 - DNA, 18 bp, Artificial Sequence
  Synthetic DNA
ttatttgactctctaaag

SEQ ID NO: 61585 - DNA, 18 bp, Artificial Sequence
  Synthetic DNA
ttatttgtatctctatag

SEQ ID NO: 61586 - DNA, 18 bp, Artificial Sequence
  Synthetic DNA
ttatttgtctctcttttg

SEQ ID NO: 61587 - DNA, 18 bp, Artificial Sequence
  Synthetic DNA
ttattttccacatcatag

SEQ ID NO: 61588 - DNA, 18 bp, Artificial Sequence
  Synthetic DNA
ttcaacgactttctatag

SEQ ID NO: 61589 - DNA, 18 bp, Artificial Sequence
  Synthetic DNA
ttcaatgcctaactatag

SEQ ID NO: 61590 - DNA, 18 bp, Artificial Sequence
  Synthetic DNA
ttcagagaatgtctatag

SEQ ID NO: 61591 - DNA, 18 bp, Artificial Sequence
  Synthetic DNA
ttcatcgtcttacaatag

SEQ ID NO: 61592 - DNA, 18 bp, Artificial Sequence
  Synthetic DNA
ttccacatttccgtatag

SEQ ID NO: 61593 - DNA, 18 bp, Artificial Sequence
  Synthetic DNA
ttccaggacttaatctag

SEQ ID NO: 61594 - DNA, 18 bp, Artificial Sequence
  Synthetic DNA
ttcctcgacttactttag

SEQ ID NO: 61595 - DNA, 18 bp, Artificial Sequence
  Synthetic DNA
ttcgactacacatataag

SEQ ID NO: 61596 - DNA, 18 bp, Artificial Sequence
  Synthetic DNA
ttcgatgactcataatag

SEQ ID NO: 61597 - DNA, 18 bp, Artificial Sequence
  Synthetic DNA
ttctaagactctccatag

SEQ ID NO: 61598 - DNA, 18 bp, Artificial Sequence
  Synthetic DNA
ttctacaacttacagtag

SEQ ID NO: 61599 - DNA, 18 bp, Artificial Sequence
  Synthetic DNA
ttctaccacagccattag

SEQ ID NO: 61600 - DNA, 18 bp, Artificial Sequence
  Synthetic DNA
ttctacgacacactagtg

SEQ ID NO: 61601 - DNA, 18 bp, Artificial Sequence
  Synthetic DNA
ttctactaatcattaatg

SEQ ID NO: 61602 - DNA, 18 bp, Artificial Sequence
  Synthetic DNA
ttctactacccattatag

SEQ ID NO: 61603 - DNA, 18 bp, Artificial Sequence
  Synthetic DNA
ttctactcctatctttag

SEQ ID NO: 61604 - DNA, 18 bp, Artificial Sequence
  Synthetic DNA
ttctactgttcacataag

SEQ ID NO: 61605 - DNA, 18 bp, Artificial Sequence
  Synthetic DNA
ttctacttctctctacag

SEQ ID NO: 61606 - DNA, 18 bp, Artificial Sequence
  Synthetic DNA
ttctaggactcactccag

SEQ ID NO: 61607 - DNA, 18 bp, Artificial Sequence
  Synthetic DNA
ttctatgacacacttaag

SEQ ID NO: 61608 - DNA, 18 bp, Artificial Sequence
  Synthetic DNA
ttctatgtctccctatag

SEQ ID NO: 61609 - DNA, 18 bp, Artificial Sequence
  Synthetic DNA
ttctatgtcttaacattg

SEQ ID NO: 61610 - DNA, 18 bp, Artificial Sequence
  Synthetic DNA
ttcttagtctcactatag

SEQ ID NO: 61611 - DNA, 18 bp, Artificial Sequence
  Synthetic DNA
ttcttcgactcacgaatg

SEQ ID NO: 61612 - DNA, 18 bp, Artificial Sequence
  Synthetic DNA
ttgaacttctcactgttg

SEQ ID NO: 61613 - DNA, 18 bp, Artificial Sequence
  Synthetic DNA
ttgaaggactctctgtag

SEQ ID NO: 61614 - DNA, 18 bp, Artificial Sequence
  Synthetic DNA
ttgacccactctgcatag

SEQ ID NO: 61615 - DNA, 18 bp, Artificial Sequence
  Synthetic DNA
ttgagctacacagttaag

SEQ ID NO: 61616 - DNA, 18 bp, Artificial Sequence
  Synthetic DNA
ttgattgtctcaaaattg

SEQ ID NO: 61617 - DNA, 18 bp, Artificial Sequence
  Synthetic DNA
ttgtaaaactcacctcag

SEQ ID NO: 61618 - DNA, 18 bp, Artificial Sequence
  Synthetic DNA
ttgtaactttgactatag

SEQ ID NO: 61619 - DNA, 18 bp, Artificial Sequence
  Synthetic DNA
ttgtacatcacactatag

SEQ ID NO: 61620 - DNA, 18 bp, Artificial Sequence
  Synthetic DNA
ttgtacgaatctctacag

SEQ ID NO: 61621 - DNA, 18 bp, Artificial Sequence
  Synthetic DNA
ttgtacgactatatatag

SEQ ID NO: 61622 - DNA, 18 bp, Artificial Sequence
  Synthetic DNA
ttgtacgattaactactg

SEQ ID NO: 61623 - DNA, 18 bp, Artificial Sequence
  Synthetic DNA
ttgtacggcttactgttg

SEQ ID NO: 61624 - DNA, 18 bp, Artificial Sequence
  Synthetic DNA
ttgtactgcctaccatag

SEQ ID NO: 61625 - DNA, 18 bp, Artificial Sequence
  Synthetic DNA
ttgtacttcccactatag

SEQ ID NO: 61626 - DNA, 18 bp, Artificial Sequence
  Synthetic DNA
ttgtagcactcactacag

SEQ ID NO: 61627 - DNA, 18 bp, Artificial Sequence
  Synthetic DNA
ttgtaggactctcttttg

SEQ ID NO: 61628 - DNA, 18 bp, Artificial Sequence
  Synthetic DNA
ttgtaggccttgctatag

SEQ ID NO: 61629 - DNA, 18 bp, Artificial Sequence
  Synthetic DNA
ttgtatgtctatctatag

SEQ ID NO: 61630 - DNA, 18 bp, Artificial Sequence
  Synthetic DNA
ttgtatgtctcaatcttg

SEQ ID NO: 61631 - DNA, 18 bp, Artificial Sequence
  Synthetic DNA
ttgtattacttacaatag

SEQ ID NO: 61632 - DNA, 18 bp, Artificial Sequence
  Synthetic DNA
ttgtattcctcgctgtag

SEQ ID NO: 61633 - DNA, 18 bp, Artificial Sequence
  Synthetic DNA
ttgtgccactcactaaag

SEQ ID NO: 61634 - DNA, 18 bp, Artificial Sequence
  Synthetic DNA
ttgtgcgactcgcttgag

SEQ ID NO: 61635 - DNA, 18 bp, Artificial Sequence
  Synthetic DNA
ttgttcgtctcactgtag

SEQ ID NO: 61636 - DNA, 18 bp, Artificial Sequence
  Synthetic DNA
tttaacgaatctctaaag

SEQ ID NO: 61637 - DNA, 18 bp, Artificial Sequence
  Synthetic DNA
tttaacgacccactctag

SEQ ID NO: 61638 - DNA, 18 bp, Artificial Sequence
  Synthetic DNA
tttaacgattcactttcg

SEQ ID NO: 61639 - DNA, 18 bp, Artificial Sequence
  Synthetic DNA
tttaacgattctcgatag

SEQ ID NO: 61640 - DNA, 18 bp, Artificial Sequence
  Synthetic DNA
tttaacgtcacactttag

SEQ ID NO: 61641 - DNA, 18 bp, Artificial Sequence
  Synthetic DNA
tttaacgtctcatataag

SEQ ID NO: 61642 - DNA, 18 bp, Artificial Sequence
  Synthetic DNA
tttaactcctcattttag

SEQ ID NO: 61643 - DNA, 18 bp, Artificial Sequence
  Synthetic DNA
tttaaggacatataattg

SEQ ID NO: 61644 - DNA, 18 bp, Artificial Sequence
  Synthetic DNA
tttaatgaatcacaacag

SEQ ID NO: 61645 - DNA, 18 bp, Artificial Sequence
  Synthetic DNA
tttatcgacacactatag

SEQ ID NO: 61646 - DNA, 18 bp, Artificial Sequence
  Synthetic DNA
tttatcgagtcactatag

SEQ ID NO: 61647 - DNA, 18 bp, Artificial Sequence
  Synthetic DNA
tttcacgattcacaaaag

SEQ ID NO: 61648 - DNA, 18 bp, Artificial Sequence
  Synthetic DNA
tttcacggcttactatag

SEQ ID NO: 61649 - DNA, 18 bp, Artificial Sequence
  Synthetic DNA
tttcacgtctcacaatag

SEQ ID NO: 61650 - DNA, 18 bp, Artificial Sequence
  Synthetic DNA
tttcactacacactttag

SEQ ID NO: 61651 - DNA, 18 bp, Artificial Sequence
  Synthetic DNA
tttcaggtctgactgctg

SEQ ID NO: 61652 - DNA, 18 bp, Artificial Sequence
  Synthetic DNA
tttcatgagtcattaatg

SEQ ID NO: 61653 - DNA, 18 bp, Artificial Sequence
  Synthetic DNA
tttcgctactaccttaag

SEQ ID NO: 61654 - DNA, 18 bp, Artificial Sequence
  Synthetic DNA
tttctagattcactgtag

SEQ ID NO: 61655 - DNA, 18 bp, Artificial Sequence
  Synthetic DNA
tttgacaactcagtatag

SEQ ID NO: 61656 - DNA, 18 bp, Artificial Sequence
  Synthetic DNA
tttgacgacttaatatag

SEQ ID NO: 61657 - DNA, 18 bp, Artificial Sequence
  Synthetic DNA
tttgatgacacaatatag

SEQ ID NO: 61658 - DNA, 18 bp, Artificial Sequence
  Synthetic DNA
tttgttgtttcactttag

SEQ ID NO: 61659 - DNA, 18 bp, Artificial Sequence
  Synthetic DNA
ttttaaaactcaccaaag

SEQ ID NO: 61660 - DNA, 18 bp, Artificial Sequence
  Synthetic DNA
ttttaaaagtaactaacg

SEQ ID NO: 61661 - DNA, 18 bp, Artificial Sequence
  Synthetic DNA
ttttaagacccactattg

SEQ ID NO: 61662 - DNA, 18 bp, Artificial Sequence
  Synthetic DNA
ttttaagactcagttaag

SEQ ID NO: 61663 - DNA, 18 bp, Artificial Sequence
  Synthetic DNA
ttttaagactcattgaag

SEQ ID NO: 61664 - DNA, 18 bp, Artificial Sequence
  Synthetic DNA
ttttaagactctctaaag

SEQ ID NO: 61665 - DNA, 18 bp, Artificial Sequence
  Synthetic DNA
ttttaagattcactttcg

SEQ ID NO: 61666 - DNA, 18 bp, Artificial Sequence
  Synthetic DNA
ttttaagtttcactagag

SEQ ID NO: 61667 - DNA, 18 bp, Artificial Sequence
  Synthetic DNA
ttttacaactcacaattg

SEQ ID NO: 61668 - DNA, 18 bp, Artificial Sequence
  Synthetic DNA
ttttacaactcattaatg

SEQ ID NO: 61669 - DNA, 18 bp, Artificial Sequence
  Synthetic DNA
ttttacagctcactctag

SEQ ID NO: 61670 - DNA, 18 bp, Artificial Sequence
  Synthetic DNA
ttttacagctcactgaag

SEQ ID NO: 61671 - DNA, 18 bp, Artificial Sequence
  Synthetic DNA
ttttacgaagctctttag

SEQ ID NO: 61672 - DNA, 18 bp, Artificial Sequence
  Synthetic DNA
ttttacgaatgtttatag

SEQ ID NO: 61673 - DNA, 18 bp, Artificial Sequence
  Synthetic DNA
ttttacgaatttatatag

SEQ ID NO: 61674 - DNA, 18 bp, Artificial Sequence
  Synthetic DNA
ttttacgacaaactctag

SEQ ID NO: 61675 - DNA, 18 bp, Artificial Sequence
  Synthetic DNA
ttttacgacagactgtcg

SEQ ID NO: 61676 - DNA, 18 bp, Artificial Sequence
  Synthetic DNA
ttttacgactaaatttag

SEQ ID NO: 61677 - DNA, 18 bp, Artificial Sequence
  Synthetic DNA
ttttacgactaactaacg

SEQ ID NO: 61678 - DNA, 18 bp, Artificial Sequence
  Synthetic DNA
ttttacgactaactaatg

SEQ ID NO: 61679 - DNA, 18 bp, Artificial Sequence
  Synthetic DNA
ttttacgactacctgtag

SEQ ID NO: 61680 - DNA, 18 bp, Artificial Sequence
  Synthetic DNA
ttttacgccacaccatag

SEQ ID NO: 61681 - DNA, 18 bp, Artificial Sequence
  Synthetic DNA
ttttacgctacacaatag

SEQ ID NO: 61682 - DNA, 18 bp, Artificial Sequence
  Synthetic DNA
ttttacggctaaccatag

SEQ ID NO: 61683 - DNA, 18 bp, Artificial Sequence
  Synthetic DNA
ttttacggctcacaaagg

SEQ ID NO: 61684 - DNA, 18 bp, Artificial Sequence
  Synthetic DNA
ttttacgtctatctttag

SEQ ID NO: 61685 - DNA, 18 bp, Artificial Sequence
  Synthetic DNA
ttttacgttgctctatag

SEQ ID NO: 61686 - DNA, 18 bp, Artificial Sequence
  Synthetic DNA
ttttactacccacttaag

SEQ ID NO: 61687 - DNA, 18 bp, Artificial Sequence
  Synthetic DNA
ttttactatgcgttatag

SEQ ID NO: 61688 - DNA, 18 bp, Artificial Sequence
  Synthetic DNA
ttttactattcactagag

SEQ ID NO: 61689 - DNA, 18 bp, Artificial Sequence
  Synthetic DNA
ttttactgctctctatag

SEQ ID NO: 61690 - DNA, 18 bp, Artificial Sequence
  Synthetic DNA
ttttactttccacacccg

SEQ ID NO: 61691 - DNA, 18 bp, Artificial Sequence
  Synthetic DNA
ttttagcactcactattg

SEQ ID NO: 61692 - DNA, 18 bp, Artificial Sequence
  Synthetic DNA
ttttatccctcactatag

SEQ ID NO: 61693 - DNA, 18 bp, Artificial Sequence
  Synthetic DNA
ttttattactcattatag

SEQ ID NO: 61694 - DNA, 18 bp, Artificial Sequence
  Synthetic DNA
ttttccatataactatag

SEQ ID NO: 61695 - DNA, 18 bp, Artificial Sequence
  Synthetic DNA
ttttccatcacacattgg

SEQ ID NO: 61696 - DNA, 18 bp, Artificial Sequence
  Synthetic DNA
ttttccgactcactactg

SEQ ID NO: 61697 - DNA, 18 bp, Artificial Sequence
  Synthetic DNA
ttttccttatcactatag

SEQ ID NO: 61698 - DNA, 18 bp, Artificial Sequence
  Synthetic DNA
ttttctgactcactactg

SEQ ID NO: 61699 - DNA, 18 bp, Artificial Sequence
  Synthetic DNA
ttttgagtttcactttgg

SEQ ID NO: 61700 - DNA, 18 bp, Artificial Sequence
  Synthetic DNA
ttttgcaactcggtgtag

SEQ ID NO: 61701 - DNA, 18 bp, Artificial Sequence
  Synthetic DNA
ttttgcgattcacattag

SEQ ID NO: 61702 - DNA, 18 bp, Artificial Sequence
  Synthetic DNA
ttttgtgactcaaacaag

SEQ ID NO: 61703 - DNA, 18 bp, Artificial Sequence
  Synthetic DNA
tttttagcctcaccatag

SEQ ID NO: 61704 - DNA, 18 bp, Artificial Sequence
  Synthetic DNA
tttttcgaatcactattg

SEQ ID NO: 61705 - DNA, 18 bp, Artificial Sequence
  Synthetic DNA
tttttcgacactttaaag

SEQ ID NO: 61706 - DNA, 18 bp, Artificial Sequence
  Synthetic DNA
tttttcgactcacgctag

SEQ ID NO: 61707 - DNA, 18 bp, Artificial Sequence
  Synthetic DNA
tttttcgactctcaatag

SEQ ID NO: 61708 - DNA, 18 bp, Artificial Sequence
  Synthetic DNA
tttttcgcctctctctag

SEQ ID NO: 61709 - DNA, 18 bp, Artificial Sequence
  Synthetic DNA
tttttctcctcacaatag

SEQ ID NO: 61710 - DNA, 18 bp, Artificial Sequence
  Synthetic DNA
tttttgcactcaatatag

SEQ ID NO: 61711 - DNA, 18 bp, Artificial Sequence
  Synthetic DNA
tttttggacttactatag

SEQ ID NO: 61712 - DNA, 18 bp, Artificial Sequence
  Synthetic DNA
tttttggtctcactatag

SEQ ID NO: 61713 - DNA, 18 bp, Artificial Sequence
  Synthetic DNA
aaaatcgacccattattg

SEQ ID NO: 61714 - DNA, 18 bp, Artificial Sequence
  Synthetic DNA
aaaatcgactcacattag

SEQ ID NO: 61715 - DNA, 18 bp, Artificial Sequence
  Synthetic DNA
aaacaccattcagtattg

SEQ ID NO: 61716 - DNA, 18 bp, Artificial Sequence
  Synthetic DNA
aaagaaaacgtactaaag

SEQ ID NO: 61717 - DNA, 18 bp, Artificial Sequence
  Synthetic DNA
aaataagactcacttctg

SEQ ID NO: 61718 - DNA, 18 bp, Artificial Sequence
  Synthetic DNA
aaatacgactcttttttg

SEQ ID NO: 61719 - DNA, 18 bp, Artificial Sequence
  Synthetic DNA
aaatatgactttctattg

SEQ ID NO: 61720 - DNA, 18 bp, Artificial Sequence
  Synthetic DNA
aaattctaccccatatag

SEQ ID NO: 61721 - DNA, 18 bp, Artificial Sequence
  Synthetic DNA
aaattctattctctgcag

SEQ ID NO: 61722 - DNA, 18 bp, Artificial Sequence
  Synthetic DNA
aacaatgagtcactctag

SEQ ID NO: 61723 - DNA, 18 bp, Artificial Sequence
  Synthetic DNA
aactgcgacactctatag

SEQ ID NO: 61724 - DNA, 18 bp, Artificial Sequence
  Synthetic DNA
aattacctctcaatctag

SEQ ID NO: 61725 - DNA, 18 bp, Artificial Sequence
  Synthetic DNA
aattacgactcatcattg

SEQ ID NO: 61726 - DNA, 18 bp, Artificial Sequence
  Synthetic DNA
atacatatcccactctag

SEQ ID NO: 61727 - DNA, 18 bp, Artificial Sequence
  Synthetic DNA
atatactattcactattg

SEQ ID NO: 61728 - DNA, 18 bp, Artificial Sequence
  Synthetic DNA
caaaacgtctcactcttg

SEQ ID NO: 61729 - DNA, 18 bp, Artificial Sequence
  Synthetic DNA
caatacgtctaattattg

SEQ ID NO: 61730 - DNA, 18 bp, Artificial Sequence
  Synthetic DNA
caattacacacactatag

SEQ ID NO: 61731 - DNA, 18 bp, Artificial Sequence
  Synthetic DNA
cattatgactatcattag

SEQ ID NO: 61732 - DNA, 18 bp, Artificial Sequence
  Synthetic DNA
cttaacgactcactattg

SEQ ID NO: 61733 - DNA, 18 bp, Artificial Sequence
  Synthetic DNA
gaataccataccccttag

SEQ ID NO: 61734 - DNA, 18 bp, Artificial Sequence
  Synthetic DNA
gaatatgtttccctattg

SEQ ID NO: 61735 - DNA, 18 bp, Artificial Sequence
  Synthetic DNA
gattacgtctaactagag

SEQ ID NO: 61736 - DNA, 18 bp, Artificial Sequence
  Synthetic DNA
gttttggtctctctattg

SEQ ID NO: 61737 - DNA, 18 bp, Artificial Sequence
  Synthetic DNA
taaaaagacaccctctag

SEQ ID NO: 61738 - DNA, 18 bp, Artificial Sequence
  Synthetic DNA
taaaacgtcatactattg

SEQ ID NO: 61739 - DNA, 18 bp, Artificial Sequence
  Synthetic DNA
taaaacttctcactaatg

SEQ ID NO: 61740 - DNA, 18 bp, Artificial Sequence
  Synthetic DNA
taaatcaaataacaatag

SEQ ID NO: 61741 - DNA, 18 bp, Artificial Sequence
  Synthetic DNA
taacacaatccaataaag

SEQ ID NO: 61742 - DNA, 18 bp, Artificial Sequence
  Synthetic DNA
taacacctcacgctatag

SEQ ID NO: 61743 - DNA, 18 bp, Artificial Sequence
  Synthetic DNA
taagacgacttacagttg

SEQ ID NO: 61744 - DNA, 18 bp, Artificial Sequence
  Synthetic DNA
taataagcctaactaagg

SEQ ID NO: 61745 - DNA, 18 bp, Artificial Sequence
  Synthetic DNA
taataagtctctcaattg

SEQ ID NO: 61746 - DNA, 18 bp, Artificial Sequence
  Synthetic DNA
taatacatctaataatag

SEQ ID NO: 61747 - DNA, 18 bp, Artificial Sequence
  Synthetic DNA
taatacgtccctctaacg

SEQ ID NO: 61748 - DNA, 18 bp, Artificial Sequence
  Synthetic DNA
taatacgtctctcactgg

SEQ ID NO: 61749 - DNA, 18 bp, Artificial Sequence
  Synthetic DNA
taatacttctctcctttg

SEQ ID NO: 61750 - DNA, 18 bp, Artificial Sequence
  Synthetic DNA
taatatgactatcagtag

SEQ ID NO: 61751 - DNA, 18 bp, Artificial Sequence
  Synthetic DNA
taatatggcagactttag

SEQ ID NO: 61752 - DNA, 18 bp, Artificial Sequence
  Synthetic DNA
taatatgtcactcaatag

SEQ ID NO: 61753 - DNA, 18 bp, Artificial Sequence
  Synthetic DNA
taatattacaccgtttag

SEQ ID NO: 61754 - DNA, 18 bp, Artificial Sequence
  Synthetic DNA
taatccgactcatccttg

SEQ ID NO: 61755 - DNA, 18 bp, Artificial Sequence
  Synthetic DNA
taatccgtatcaccttag

SEQ ID NO: 61756 - DNA, 18 bp, Artificial Sequence
  Synthetic DNA
taatgcctatcagtaaag

SEQ ID NO: 61757 - DNA, 18 bp, Artificial Sequence
  Synthetic DNA
taatgcgttacactaaag

SEQ ID NO: 61758 - DNA, 18 bp, Artificial Sequence
  Synthetic DNA
taattcgaaactcaatag

SEQ ID NO: 61759 - DNA, 18 bp, Artificial Sequence
  Synthetic DNA
tacaacagctcactctgg

SEQ ID NO: 61760 - DNA, 18 bp, Artificial Sequence
  Synthetic DNA
tacatggacttactatag

SEQ ID NO: 61761 - DNA, 18 bp, Artificial Sequence
  Synthetic DNA
taccccgattaactaaag

SEQ ID NO: 61762 - DNA, 18 bp, Artificial Sequence
  Synthetic DNA
tactatgactctacatag

SEQ ID NO: 61763 - DNA, 18 bp, Artificial Sequence
  Synthetic DNA
tacttaaacacactatag

SEQ ID NO: 61764 - DNA, 18 bp, Artificial Sequence
  Synthetic DNA
tagaacgattctctaaag

SEQ ID NO: 61765 - DNA, 18 bp, Artificial Sequence
  Synthetic DNA
tagtctgactctctatgg

SEQ ID NO: 61766 - DNA, 18 bp, Artificial Sequence
  Synthetic DNA
tataactactcccaatcg

SEQ ID NO: 61767 - DNA, 18 bp, Artificial Sequence
  Synthetic DNA
tataacttctcactctag

SEQ ID NO: 61768 - DNA, 18 bp, Artificial Sequence
  Synthetic DNA
tatagtgactcactacag

SEQ ID NO: 61769 - DNA, 18 bp, Artificial Sequence
  Synthetic DNA
tatcaagactcacaatcg

SEQ ID NO: 61770 - DNA, 18 bp, Artificial Sequence
  Synthetic DNA
tatcacttatgagtatcg

SEQ ID NO: 61771 - DNA, 18 bp, Artificial Sequence
  Synthetic DNA
tattacgactttcagaag

SEQ ID NO: 61772 - DNA, 18 bp, Artificial Sequence
  Synthetic DNA
tattacgataaactattg

SEQ ID NO: 61773 - DNA, 18 bp, Artificial Sequence
  Synthetic DNA
tattacgatacaatattg

SEQ ID NO: 61774 - DNA, 18 bp, Artificial Sequence
  Synthetic DNA
tattacgattcaaaagag

SEQ ID NO: 61775 - DNA, 18 bp, Artificial Sequence
  Synthetic DNA
tattacgtctgtctattg

SEQ ID NO: 61776 - DNA, 18 bp, Artificial Sequence
  Synthetic DNA
tattacgttacactaaag

SEQ ID NO: 61777 - DNA, 18 bp, Artificial Sequence
  Synthetic DNA
tattaggacactcaatag

SEQ ID NO: 61778 - DNA, 18 bp, Artificial Sequence
  Synthetic DNA
tattataacactctatag

SEQ ID NO: 61779 - DNA, 18 bp, Artificial Sequence
  Synthetic DNA
tattataacagcctatag

SEQ ID NO: 61780 - DNA, 18 bp, Artificial Sequence
  Synthetic DNA
tattatggttcactagag

SEQ ID NO: 61781 - DNA, 18 bp, Artificial Sequence
  Synthetic DNA
tatttcgtctcataatag

SEQ ID NO: 61782 - DNA, 18 bp, Artificial Sequence
  Synthetic DNA
tatttctactctctaaag

SEQ ID NO: 61783 - DNA, 18 bp, Artificial Sequence
  Synthetic DNA
tcatccgacacacaattg

SEQ ID NO: 61784 - DNA, 18 bp, Artificial Sequence
  Synthetic DNA
tcattcgactcacatttg

SEQ ID NO: 61785 - DNA, 18 bp, Artificial Sequence
  Synthetic DNA
tcattcgattcacaattg

SEQ ID NO: 61786 - DNA, 18 bp, Artificial Sequence
  Synthetic DNA
tcattcgtctgtctatag

SEQ ID NO: 61787 - DNA, 18 bp, Artificial Sequence
  Synthetic DNA
tctcatcattccctatag

SEQ ID NO: 61788 - DNA, 18 bp, Artificial Sequence
  Synthetic DNA
tgaatcctttcactatcg

SEQ ID NO: 61789 - DNA, 18 bp, Artificial Sequence
  Synthetic DNA
tgacactgctcgctctag

SEQ ID NO: 61790 - DNA, 18 bp, Artificial Sequence
  Synthetic DNA
ttaaacaactctcaattg

SEQ ID NO: 61791 - DNA, 18 bp, Artificial Sequence
  Synthetic DNA
ttaaacgtctcacttaag

SEQ ID NO: 61792 - DNA, 18 bp, Artificial Sequence
  Synthetic DNA
ttaatccaatcactaaag

SEQ ID NO: 61793 - DNA, 18 bp, Artificial Sequence
  Synthetic DNA
ttataccattcacaaaag

SEQ ID NO: 61794 - DNA, 18 bp, Artificial Sequence
  Synthetic DNA
ttatacgatgcccaatag

SEQ ID NO: 61795 - DNA, 18 bp, Artificial Sequence
  Synthetic DNA
ttatataactctccaaag

SEQ ID NO: 61796 - DNA, 18 bp, Artificial Sequence
  Synthetic DNA
ttatcagtatcactatag

SEQ ID NO: 61797 - DNA, 18 bp, Artificial Sequence
  Synthetic DNA
ttatccgacttaccttag

SEQ ID NO: 61798 - DNA, 18 bp, Artificial Sequence
  Synthetic DNA
ttgctcgacccactatag

SEQ ID NO: 61799 - DNA, 18 bp, Artificial Sequence
  Synthetic DNA
ttttacgactaacttatg

SEQ ID NO: 61800 - DNA, 18 bp, Artificial Sequence
  Synthetic DNA
ttttactacacactttag

SEQ ID NO: 61801 - DNA, 18 bp, Artificial Sequence
  Synthetic DNA
ttttatgattaactatag

SEQ ID NO: 61802 - DNA, 18 bp, Artificial Sequence
  Synthetic DNA
atatacgactctcttaag

SEQ ID NO: 61803 - DNA, 18 bp, Artificial Sequence
  Synthetic DNA
taatacggcactcaagtg

SEQ ID NO: 61804 - DNA, 18 bp, Artificial Sequence
  Synthetic DNA
taattcgtctcacttatg

SEQ ID NO: 61805 - DNA, 18 bp, Artificial Sequence
  Synthetic DNA
ccctacgtctcactaaag

SEQ ID NO: 61806 - DNA, 18 bp, Artificial Sequence
  Synthetic DNA
taaaaccacttacattag

SEQ ID NO: 61807 - DNA, 18 bp, Artificial Sequence
  Synthetic DNA
taatccatatctctatag

SEQ ID NO: 61808 - DNA, 18 bp, Artificial Sequence
  Synthetic DNA
tacttagattcactattg

SEQ ID NO: 61809 - DNA, 18 bp, Artificial Sequence
  Synthetic DNA
ttattaaactcactttag

SEQ ID NO: 61810 - DNA, 18 bp, Artificial Sequence
  Synthetic DNA
ttattcgacactttatag

SEQ ID NO: 61811 - DNA, 18 bp, Artificial Sequence
  Synthetic DNA
aaatacgacaacccaaag

SEQ ID NO: 61812 - DNA, 18 bp, Artificial Sequence
  Synthetic DNA
aaattcgattcacaaaag

SEQ ID NO: 61813 - DNA, 18 bp, Artificial Sequence
  Synthetic DNA
aactacagcacactatag

SEQ ID NO: 61814 - DNA, 18 bp, Artificial Sequence
  Synthetic DNA
aagtacgatgctctatag

SEQ ID NO: 61815 - DNA, 18 bp, Artificial Sequence
  Synthetic DNA
aagtactactcaaattgg

SEQ ID NO: 61816 - DNA, 18 bp, Artificial Sequence
  Synthetic DNA
aattacgattcacaattg

SEQ ID NO: 61817 - DNA, 18 bp, Artificial Sequence
  Synthetic DNA
atatacgattctctattg

SEQ ID NO: 61818 - DNA, 18 bp, Artificial Sequence
  Synthetic DNA
atatacgcctcaaagcag

SEQ ID NO: 61819 - DNA, 18 bp, Artificial Sequence
  Synthetic DNA
atatacgtctcagtttag

SEQ ID NO: 61820 - DNA, 18 bp, Artificial Sequence
  Synthetic DNA
atatagtattcattatag

SEQ ID NO: 61821 - DNA, 18 bp, Artificial Sequence
  Synthetic DNA
atatatgtctcattacag

SEQ ID NO: 61822 - DNA, 18 bp, Artificial Sequence
  Synthetic DNA
atattcgactcactaatg

SEQ ID NO: 61823 - DNA, 18 bp, Artificial Sequence
  Synthetic DNA
atgcacgactggcaaaag

SEQ ID NO: 61824 - DNA, 18 bp, Artificial Sequence
  Synthetic DNA
caaatagactcactttag

SEQ ID NO: 61825 - DNA, 18 bp, Artificial Sequence
  Synthetic DNA
caataagacttgctattg

SEQ ID NO: 61826 - DNA, 18 bp, Artificial Sequence
  Synthetic DNA
cagtccggtttatcatag

SEQ ID NO: 61827 - DNA, 18 bp, Artificial Sequence
  Synthetic DNA
catcaagattcactttag

SEQ ID NO: 61828 - DNA, 18 bp, Artificial Sequence
  Synthetic DNA
ctatacgtctcactaatg

SEQ ID NO: 61829 - DNA, 18 bp, Artificial Sequence
  Synthetic DNA
gaatcggactctatatag

SEQ ID NO: 61830 - DNA, 18 bp, Artificial Sequence
  Synthetic DNA
gagaacgataggctttag

SEQ ID NO: 61831 - DNA, 18 bp, Artificial Sequence
  Synthetic DNA
gcatactttcgaatattg

SEQ ID NO: 61832 - DNA, 18 bp, Artificial Sequence
  Synthetic DNA
taaaacaacactcaatag

SEQ ID NO: 61833 - DNA, 18 bp, Artificial Sequence
  Synthetic DNA
taaaacgcattactttag

SEQ ID NO: 61834 - DNA, 18 bp, Artificial Sequence
  Synthetic DNA
taaaacttctatctatag

SEQ ID NO: 61835 - DNA, 18 bp, Artificial Sequence
  Synthetic DNA
taaagcgtctcacttttg

SEQ ID NO: 61836 - DNA, 18 bp, Artificial Sequence
  Synthetic DNA
taaatcgatacactaaag

SEQ ID NO: 61837 - DNA, 18 bp, Artificial Sequence
  Synthetic DNA
taacacgacacataattg

SEQ ID NO: 61838 - DNA, 18 bp, Artificial Sequence
  Synthetic DNA
taactctatgcaccatag

SEQ ID NO: 61839 - DNA, 18 bp, Artificial Sequence
  Synthetic DNA
taagactattcacaattg

SEQ ID NO: 61840 - DNA, 18 bp, Artificial Sequence
  Synthetic DNA
taataagacttaaggtag

SEQ ID NO: 61841 - DNA, 18 bp, Artificial Sequence
  Synthetic DNA
taataagtcttaatattg

SEQ ID NO: 61842 - DNA, 18 bp, Artificial Sequence
  Synthetic DNA
taatacgacacagccctg

SEQ ID NO: 61843 - DNA, 18 bp, Artificial Sequence
  Synthetic DNA
taatacgtcatacttttg

SEQ ID NO: 61844 - DNA, 18 bp, Artificial Sequence
  Synthetic DNA
taatacttcactcattag

SEQ ID NO: 61845 - DNA, 18 bp, Artificial Sequence
  Synthetic DNA
taatataactcattgttg

SEQ ID NO: 61846 - DNA, 18 bp, Artificial Sequence
  Synthetic DNA
taatataacttcctttag

SEQ ID NO: 61847 - DNA, 18 bp, Artificial Sequence
  Synthetic DNA
taatccacctcgccatag

SEQ ID NO: 61848 - DNA, 18 bp, Artificial Sequence
  Synthetic DNA
taatccgacgaacctcag

SEQ ID NO: 61849 - DNA, 18 bp, Artificial Sequence
  Synthetic DNA
taatgtgcttcaccatag

SEQ ID NO: 61850 - DNA, 18 bp, Artificial Sequence
  Synthetic DNA
taattcgaatcgcaaccg

SEQ ID NO: 61851 - DNA, 18 bp, Artificial Sequence
  Synthetic DNA
taattcgacacagaacag

SEQ ID NO: 61852 - DNA, 18 bp, Artificial Sequence
  Synthetic DNA
taattcgactcttttttg

SEQ ID NO: 61853 - DNA, 18 bp, Artificial Sequence
  Synthetic DNA
taattcgtctcaataatg

SEQ ID NO: 61854 - DNA, 18 bp, Artificial Sequence
  Synthetic DNA
taattcgttatactatag

SEQ ID NO: 61855 - DNA, 18 bp, Artificial Sequence
  Synthetic DNA
taattcgtttcacaattg

SEQ ID NO: 61856 - DNA, 18 bp, Artificial Sequence
  Synthetic DNA
taattcttcccaccttag

SEQ ID NO: 61857 - DNA, 18 bp, Artificial Sequence
  Synthetic DNA
tagaacgactcacttatg

SEQ ID NO: 61858 - DNA, 18 bp, Artificial Sequence
  Synthetic DNA
tagaccgtcttccgacag

SEQ ID NO: 61859 - DNA, 18 bp, Artificial Sequence
  Synthetic DNA
tagcacgagttacgtgag

SEQ ID NO: 61860 - DNA, 18 bp, Artificial Sequence
  Synthetic DNA
tagtccgactgtctacag

SEQ ID NO: 61861 - DNA, 18 bp, Artificial Sequence
  Synthetic DNA
tagttcgacacgctagag

SEQ ID NO: 61862 - DNA, 18 bp, Artificial Sequence
  Synthetic DNA
tagttcggctcactaccg

SEQ ID NO: 61863 - DNA, 18 bp, Artificial Sequence
  Synthetic DNA
tataacgaatcagtttag

SEQ ID NO: 61864 - DNA, 18 bp, Artificial Sequence
  Synthetic DNA
tataacgactaattttag

SEQ ID NO: 61865 - DNA, 18 bp, Artificial Sequence
  Synthetic DNA
tataacgagttgctgtag

SEQ ID NO: 61866 - DNA, 18 bp, Artificial Sequence
  Synthetic DNA
tattaataccggcgatag

SEQ ID NO: 61867 - DNA, 18 bp, Artificial Sequence
  Synthetic DNA
tattacaactatcataag

SEQ ID NO: 61868 - DNA, 18 bp, Artificial Sequence
  Synthetic DNA
tattacatttcacaatag

SEQ ID NO: 61869 - DNA, 18 bp, Artificial Sequence
  Synthetic DNA
tattatgacacatcatag

SEQ ID NO: 61870 - DNA, 18 bp, Artificial Sequence
  Synthetic DNA
tattatgtgtcactctag

SEQ ID NO: 61871 - DNA, 18 bp, Artificial Sequence
  Synthetic DNA
tcacattactcacaacag

SEQ ID NO: 61872 - DNA, 18 bp, Artificial Sequence
  Synthetic DNA
tcataatagcccctttag

SEQ ID NO: 61873 - DNA, 18 bp, Artificial Sequence
  Synthetic DNA
tcatacgtctcgcttaag

SEQ ID NO: 61874 - DNA, 18 bp, Artificial Sequence
  Synthetic DNA
tccaacgacgcacatttg

SEQ ID NO: 61875 - DNA, 18 bp, Artificial Sequence
  Synthetic DNA
tgaaacgactcaccccag

SEQ ID NO: 61876 - DNA, 18 bp, Artificial Sequence
  Synthetic DNA
tgacacatctcacaatag

SEQ ID NO: 61877 - DNA, 18 bp, Artificial Sequence
  Synthetic DNA
tgatacatctcaccatgg

SEQ ID NO: 61878 - DNA, 18 bp, Artificial Sequence
  Synthetic DNA
tgatacgacttccttttg

SEQ ID NO: 61879 - DNA, 18 bp, Artificial Sequence
  Synthetic DNA
tgatatgacaacctatag

SEQ ID NO: 61880 - DNA, 18 bp, Artificial Sequence
  Synthetic DNA
ttaaactactcacattag

SEQ ID NO: 61881 - DNA, 18 bp, Artificial Sequence
  Synthetic DNA
ttatactactcacttatg

SEQ ID NO: 61882 - DNA, 18 bp, Artificial Sequence
  Synthetic DNA
ttataggacttactgttg

SEQ ID NO: 61883 - DNA, 18 bp, Artificial Sequence
  Synthetic DNA
ttatgcgactttcaattg

SEQ ID NO: 61884 - DNA, 18 bp, Artificial Sequence
  Synthetic DNA
ttttacatctcattaaag

SEQ ID NO: 61885 - DNA, 18 bp, Artificial Sequence
  Synthetic DNA
aaaaaaaagtctctattg

SEQ ID NO: 61886 - DNA, 18 bp, Artificial Sequence
  Synthetic DNA
aaaaaaaattctctatag

SEQ ID NO: 61887 - DNA, 18 bp, Artificial Sequence
  Synthetic DNA
aaaaacgacactctaccg

SEQ ID NO: 61888 - DNA, 18 bp, Artificial Sequence
  Synthetic DNA
aaaaacgactcaatactg

SEQ ID NO: 61889 - DNA, 18 bp, Artificial Sequence
  Synthetic DNA
aaaaacgactctacattg

SEQ ID NO: 61890 - DNA, 18 bp, Artificial Sequence
  Synthetic DNA
aaaaacgattctctttag

SEQ ID NO: 61891 - DNA, 18 bp, Artificial Sequence
  Synthetic DNA
aaaaacgccgcgctatag

SEQ ID NO: 61892 - DNA, 18 bp, Artificial Sequence
  Synthetic DNA
aaaaacgcctcacttttg

SEQ ID NO: 61893 - DNA, 18 bp, Artificial Sequence
  Synthetic DNA
aaaaacgcttcactagag

SEQ ID NO: 61894 - DNA, 18 bp, Artificial Sequence
  Synthetic DNA
aaaaactaatctctaaag

SEQ ID NO: 61895 - DNA, 18 bp, Artificial Sequence
  Synthetic DNA
aaaaactgctcagtatcg

SEQ ID NO: 61896 - DNA, 18 bp, Artificial Sequence
  Synthetic DNA
aaaaagaacacactttag

SEQ ID NO: 61897 - DNA, 18 bp, Artificial Sequence
  Synthetic DNA
aaaaagtacatactatag

SEQ ID NO: 61898 - DNA, 18 bp, Artificial Sequence
  Synthetic DNA
aaaaatgacttactttcg

SEQ ID NO: 61899 - DNA, 18 bp, Artificial Sequence
  Synthetic DNA
aaaaatggcgaactatcg

SEQ ID NO: 61900 - DNA, 18 bp, Artificial Sequence
  Synthetic DNA
aaaaatgtctcacttgag

SEQ ID NO: 61901 - DNA, 18 bp, Artificial Sequence
  Synthetic DNA
aaaacctactctctttcg

SEQ ID NO: 61902 - DNA, 18 bp, Artificial Sequence
  Synthetic DNA
aaaaggcacatacaatag

SEQ ID NO: 61903 - DNA, 18 bp, Artificial Sequence
  Synthetic DNA
aaaatcaactcattaatg

SEQ ID NO: 61904 - DNA, 18 bp, Artificial Sequence
  Synthetic DNA
aaaatcgaatcactaatg

SEQ ID NO: 61905 - DNA, 18 bp, Artificial Sequence
  Synthetic DNA
aaaatcgactcactgaag

SEQ ID NO: 61906 - DNA, 18 bp, Artificial Sequence
  Synthetic DNA
aaaatctacttacaattg

SEQ ID NO: 61907 - DNA, 18 bp, Artificial Sequence
  Synthetic DNA
aaaatcttctcattctcg

SEQ ID NO: 61908 - DNA, 18 bp, Artificial Sequence
  Synthetic DNA
aaacacaactctctaaag

SEQ ID NO: 61909 - DNA, 18 bp, Artificial Sequence
  Synthetic DNA
aaacacgactcattaatg

SEQ ID NO: 61910 - DNA, 18 bp, Artificial Sequence
  Synthetic DNA
aaacatgacacattatag

SEQ ID NO: 61911 - DNA, 18 bp, Artificial Sequence
  Synthetic DNA
aaacatgactctcaaatg

SEQ ID NO: 61912 - DNA, 18 bp, Artificial Sequence
  Synthetic DNA
aaacatgactgactaaag

SEQ ID NO: 61913 - DNA, 18 bp, Artificial Sequence
  Synthetic DNA
aaacatgtatagcgacag

SEQ ID NO: 61914 - DNA, 18 bp, Artificial Sequence
  Synthetic DNA
aaactcgactcacaaaag

SEQ ID NO: 61915 - DNA, 18 bp, Artificial Sequence
  Synthetic DNA
aaactcgattcagttttg

SEQ ID NO: 61916 - DNA, 18 bp, Artificial Sequence
  Synthetic DNA
aaactcgtcaaaacatag

SEQ ID NO: 61917 - DNA, 18 bp, Artificial Sequence
  Synthetic DNA
aaactctagtcactaaag

SEQ ID NO: 61918 - DNA, 18 bp, Artificial Sequence
  Synthetic DNA
aaagacaacacaccatag

SEQ ID NO: 61919 - DNA, 18 bp, Artificial Sequence
  Synthetic DNA
aaagacgatacactagtg

SEQ ID NO: 61920 - DNA, 18 bp, Artificial Sequence
  Synthetic DNA
aaagacgttacactcttg

SEQ ID NO: 61921 - DNA, 18 bp, Artificial Sequence
  Synthetic DNA
aaagactagtcaatatag

SEQ ID NO: 61922 - DNA, 18 bp, Artificial Sequence
  Synthetic DNA
aaataaaactcaattttg

SEQ ID NO: 61923 - DNA, 18 bp, Artificial Sequence
  Synthetic DNA
aaataaatttcactattg

SEQ ID NO: 61924 - DNA, 18 bp, Artificial Sequence
  Synthetic DNA
aaataagaaacacaatag

SEQ ID NO: 61925 - DNA, 18 bp, Artificial Sequence
  Synthetic DNA
aaataagaatctccgtag

SEQ ID NO: 61926 - DNA, 18 bp, Artificial Sequence
  Synthetic DNA
aaataagacacactcaag

SEQ ID NO: 61927 - DNA, 18 bp, Artificial Sequence
  Synthetic DNA
aaataagactctccaaag

SEQ ID NO: 61928 - DNA, 18 bp, Artificial Sequence
  Synthetic DNA
aaataaggctcttattgg

SEQ ID NO: 61929 - DNA, 18 bp, Artificial Sequence
  Synthetic DNA
aaataatattcactctag

SEQ ID NO: 61930 - DNA, 18 bp, Artificial Sequence
  Synthetic DNA
aaatacaactaacattag

SEQ ID NO: 61931 - DNA, 18 bp, Artificial Sequence
  Synthetic DNA
aaatacatatcgctatag

SEQ ID NO: 61932 - DNA, 18 bp, Artificial Sequence
  Synthetic DNA
aaatacatcacgctacag

SEQ ID NO: 61933 - DNA, 18 bp, Artificial Sequence
  Synthetic DNA
aaatacatctcaattttg

SEQ ID NO: 61934 - DNA, 18 bp, Artificial Sequence
  Synthetic DNA
aaataccacactccatag

SEQ ID NO: 61935 - DNA, 18 bp, Artificial Sequence
  Synthetic DNA
aaataccactgtctattg

SEQ ID NO: 61936 - DNA, 18 bp, Artificial Sequence
  Synthetic DNA
aaatacccgtctttatag

SEQ ID NO: 61937 - DNA, 18 bp, Artificial Sequence
  Synthetic DNA
aaatacgaaacactaatg

SEQ ID NO: 61938 - DNA, 18 bp, Artificial Sequence
  Synthetic DNA
aaatacgaatagctattg

SEQ ID NO: 61939 - DNA, 18 bp, Artificial Sequence
  Synthetic DNA
aaatacgaatcgcaattg

SEQ ID NO: 61940 - DNA, 18 bp, Artificial Sequence
  Synthetic DNA
aaatacgacaaacttttg

SEQ ID NO: 61941 - DNA, 18 bp, Artificial Sequence
  Synthetic DNA
aaatacgacaacctattg

SEQ ID NO: 61942 - DNA, 18 bp, Artificial Sequence
  Synthetic DNA
aaatacgacacaaagtag

SEQ ID NO: 61943 - DNA, 18 bp, Artificial Sequence
  Synthetic DNA
aaatacgacactatacag

SEQ ID NO: 61944 - DNA, 18 bp, Artificial Sequence
  Synthetic DNA
aaatacgacatacaaaag

SEQ ID NO: 61945 - DNA, 18 bp, Artificial Sequence
  Synthetic DNA
aaatacgactcaattcgg

SEQ ID NO: 61946 - DNA, 18 bp, Artificial Sequence
  Synthetic DNA
aaatacgacttatttaag

SEQ ID NO: 61947 - DNA, 18 bp, Artificial Sequence
  Synthetic DNA
aaatacgactttctgcag

SEQ ID NO: 61948 - DNA, 18 bp, Artificial Sequence
  Synthetic DNA
aaatacgagtaactctcg

SEQ ID NO: 61949 - DNA, 18 bp, Artificial Sequence
  Synthetic DNA
aaatacgatacactcttg

SEQ ID NO: 61950 - DNA, 18 bp, Artificial Sequence
  Synthetic DNA
aaatacgattcgacttag

SEQ ID NO: 61951 - DNA, 18 bp, Artificial Sequence
  Synthetic DNA
aaatacgatttatttaag

SEQ ID NO: 61952 - DNA, 18 bp, Artificial Sequence
  Synthetic DNA
aaatacggctctaaatag

SEQ ID NO: 61953 - DNA, 18 bp, Artificial Sequence
  Synthetic DNA
aaatacggctctctaatg

SEQ ID NO: 61954 - DNA, 18 bp, Artificial Sequence
  Synthetic DNA
aaatacgtacaactatag

SEQ ID NO: 61955 - DNA, 18 bp, Artificial Sequence
  Synthetic DNA
aaatacgtcacacatcag

SEQ ID NO: 61956 - DNA, 18 bp, Artificial Sequence
  Synthetic DNA
aaatacgtcttattacag

SEQ ID NO: 61957 - DNA, 18 bp, Artificial Sequence
  Synthetic DNA
aaatacgtggcataatgg

SEQ ID NO: 61958 - DNA, 18 bp, Artificial Sequence
  Synthetic DNA
aaatacgtgtcaatattg

SEQ ID NO: 61959 - DNA, 18 bp, Artificial Sequence
  Synthetic DNA
aaatacgttaaactatag

SEQ ID NO: 61960 - DNA, 18 bp, Artificial Sequence
  Synthetic DNA
aaatactaatctctaatg

SEQ ID NO: 61961 - DNA, 18 bp, Artificial Sequence
  Synthetic DNA
aaatactactgacaattg

SEQ ID NO: 61962 - DNA, 18 bp, Artificial Sequence
  Synthetic DNA
aaatactattcacaacag

SEQ ID NO: 61963 - DNA, 18 bp, Artificial Sequence
  Synthetic DNA
aaatactgatcataatag

SEQ ID NO: 61964 - DNA, 18 bp, Artificial Sequence
  Synthetic DNA
aaatactgtttactatag

SEQ ID NO: 61965 - DNA, 18 bp, Artificial Sequence
  Synthetic DNA
aaatacttgacattatag

SEQ ID NO: 61966 - DNA, 18 bp, Artificial Sequence
  Synthetic DNA
aaatagaaaacaatcttg

SEQ ID NO: 61967 - DNA, 18 bp, Artificial Sequence
  Synthetic DNA
aaatagcacaccatactg

SEQ ID NO: 61968 - DNA, 18 bp, Artificial Sequence
  Synthetic DNA
aaataggattgtcagtag

SEQ ID NO: 61969 - DNA, 18 bp, Artificial Sequence
  Synthetic DNA
aaatatgaattactaatg

SEQ ID NO: 61970 - DNA, 18 bp, Artificial Sequence
  Synthetic DNA
aaatatgattcacaattg

SEQ ID NO: 61971 - DNA, 18 bp, Artificial Sequence
  Synthetic DNA
aaatatgattcaccattg

SEQ ID NO: 61972 - DNA, 18 bp, Artificial Sequence
  Synthetic DNA
aaatatgtatcactttag

SEQ ID NO: 61973 - DNA, 18 bp, Artificial Sequence
  Synthetic DNA
aaatattacttacttgag

SEQ ID NO: 61974 - DNA, 18 bp, Artificial Sequence
  Synthetic DNA
aaatccatctatctattg

SEQ ID NO: 61975 - DNA, 18 bp, Artificial Sequence
  Synthetic DNA
aaatcctattcacattag

SEQ ID NO: 61976 - DNA, 18 bp, Artificial Sequence
  Synthetic DNA
aaatctgaatcataatgg

SEQ ID NO: 61977 - DNA, 18 bp, Artificial Sequence
  Synthetic DNA
aaatctgactatctattg

SEQ ID NO: 61978 - DNA, 18 bp, Artificial Sequence
  Synthetic DNA
aaatgcgagtcacagtgg

SEQ ID NO: 61979 - DNA, 18 bp, Artificial Sequence
  Synthetic DNA
aaatgcggctcagcatag

SEQ ID NO: 61980 - DNA, 18 bp, Artificial Sequence
  Synthetic DNA
aaattacacagcctattg

SEQ ID NO: 61981 - DNA, 18 bp, Artificial Sequence
  Synthetic DNA
aaattagactcaagctag

SEQ ID NO: 61982 - DNA, 18 bp, Artificial Sequence
  Synthetic DNA
aaattagtcccactatag

SEQ ID NO: 61983 - DNA, 18 bp, Artificial Sequence
  Synthetic DNA
aaattatgctttcaatag

SEQ ID NO: 61984 - DNA, 18 bp, Artificial Sequence
  Synthetic DNA
aaattcattacactaaag

SEQ ID NO: 61985 - DNA, 18 bp, Artificial Sequence
  Synthetic DNA
aaattccacactctatcg

SEQ ID NO: 61986 - DNA, 18 bp, Artificial Sequence
  Synthetic DNA
aaattccatacactatcg

SEQ ID NO: 61987 - DNA, 18 bp, Artificial Sequence
  Synthetic DNA
aaattcccatctctatag

SEQ ID NO: 61988 - DNA, 18 bp, Artificial Sequence
  Synthetic DNA
aaattcgaaattctatag

SEQ ID NO: 61989 - DNA, 18 bp, Artificial Sequence
  Synthetic DNA
aaattcgaatcaaaatag

SEQ ID NO: 61990 - DNA, 18 bp, Artificial Sequence
  Synthetic DNA
aaattcgccaggcaatag

SEQ ID NO: 61991 - DNA, 18 bp, Artificial Sequence
  Synthetic DNA
aaattcggctgagtatag

SEQ ID NO: 61992 - DNA, 18 bp, Artificial Sequence
  Synthetic DNA
aaattcgtctttcaatag

SEQ ID NO: 61993 - DNA, 18 bp, Artificial Sequence
  Synthetic DNA
aaattctacacaaaacag

SEQ ID NO: 61994 - DNA, 18 bp, Artificial Sequence
  Synthetic DNA
aaattctactcaccatcg

SEQ ID NO: 61995 - DNA, 18 bp, Artificial Sequence
  Synthetic DNA
aaattctactcatagtag

SEQ ID NO: 61996 - DNA, 18 bp, Artificial Sequence
  Synthetic DNA
aaatttgaatgtcttaag

SEQ ID NO: 61997 - DNA, 18 bp, Artificial Sequence
  Synthetic DNA
aaatttgactaacaatag

SEQ ID NO: 61998 - DNA, 18 bp, Artificial Sequence
  Synthetic DNA
aaatttgattcacaatag

SEQ ID NO: 61999 - DNA, 18 bp, Artificial Sequence
  Synthetic DNA
aaatttgattctcattag

SEQ ID NO: 62000 - DNA, 18 bp, Artificial Sequence
  Synthetic DNA
aaattttacacactatag

SEQ ID NO: 62001 - DNA, 18 bp, Artificial Sequence
  Synthetic DNA
aacaagaacacactaagg

SEQ ID NO: 62002 - DNA, 18 bp, Artificial Sequence
  Synthetic DNA
aacgccaagtcattaaag

SEQ ID NO: 62003 - DNA, 18 bp, Artificial Sequence
  Synthetic DNA
aactacgactaacgtcag

SEQ ID NO: 62004 - DNA, 18 bp, Artificial Sequence
  Synthetic DNA
aactacgacttacttttg

SEQ ID NO: 62005 - DNA, 18 bp, Artificial Sequence
  Synthetic DNA
aactacgagtccctttag

SEQ ID NO: 62006 - DNA, 18 bp, Artificial Sequence
  Synthetic DNA
aactacggcacgttatag

SEQ ID NO: 62007 - DNA, 18 bp, Artificial Sequence
  Synthetic DNA
aactacgtctcaaaatag

SEQ ID NO: 62008 - DNA, 18 bp, Artificial Sequence
  Synthetic DNA
aactactataccctaaag

SEQ ID NO: 62009 - DNA, 18 bp, Artificial Sequence
  Synthetic DNA
aacttcgacacactatcg

SEQ ID NO: 62010 - DNA, 18 bp, Artificial Sequence
  Synthetic DNA
aacttctacttactttag

SEQ ID NO: 62011 - DNA, 18 bp, Artificial Sequence
  Synthetic DNA
aagcacgacttatgattg

SEQ ID NO: 62012 - DNA, 18 bp, Artificial Sequence
  Synthetic DNA
aagcacgccccactatag

SEQ ID NO: 62013 - DNA, 18 bp, Artificial Sequence
  Synthetic DNA
aagtacgatcctctatag

SEQ ID NO: 62014 - DNA, 18 bp, Artificial Sequence
  Synthetic DNA
aagtacgtctctctaaag

SEQ ID NO: 62015 - DNA, 18 bp, Artificial Sequence
  Synthetic DNA
aagtactacttacaatgg

SEQ ID NO: 62016 - DNA, 18 bp, Artificial Sequence
  Synthetic DNA
aagtacttctcgctgtag

SEQ ID NO: 62017 - DNA, 18 bp, Artificial Sequence
  Synthetic DNA
aagtagaactcactaaag

SEQ ID NO: 62018 - DNA, 18 bp, Artificial Sequence
  Synthetic DNA
aagtatgactcattatcg

SEQ ID NO: 62019 - DNA, 18 bp, Artificial Sequence
  Synthetic DNA
aagtgggaatgactaaag

SEQ ID NO: 62020 - DNA, 18 bp, Artificial Sequence
  Synthetic DNA
aagttcgaatcgcttaag

SEQ ID NO: 62021 - DNA, 18 bp, Artificial Sequence
  Synthetic DNA
aataacgacactctatag

SEQ ID NO: 62022 - DNA, 18 bp, Artificial Sequence
  Synthetic DNA
aataacgactaactttga

SEQ ID NO: 62023 - DNA, 18 bp, Artificial Sequence
  Synthetic DNA
aataacgactcaatacag

SEQ ID NO: 62024 - DNA, 18 bp, Artificial Sequence
  Synthetic DNA
aataacgactcattttag

SEQ ID NO: 62025 - DNA, 18 bp, Artificial Sequence
  Synthetic DNA
aataacgtaacactatag

SEQ ID NO: 62026 - DNA, 18 bp, Artificial Sequence
  Synthetic DNA
aataataagtcactatag

SEQ ID NO: 62027 - DNA, 18 bp, Artificial Sequence
  Synthetic DNA
aataatgaatcactttag

SEQ ID NO: 62028 - DNA, 18 bp, Artificial Sequence
  Synthetic DNA
aataatgactcactttag

SEQ ID NO: 62029 - DNA, 18 bp, Artificial Sequence
  Synthetic DNA
aatactcaatcagtttcg

SEQ ID NO: 62030 - DNA, 18 bp, Artificial Sequence
  Synthetic DNA
aatactgtctctctatag

SEQ ID NO: 62031 - DNA, 18 bp, Artificial Sequence
  Synthetic DNA
aatatcaattccctatag

SEQ ID NO: 62032 - DNA, 18 bp, Artificial Sequence
  Synthetic DNA
aatcaatactcaattatg

SEQ ID NO: 62033 - DNA, 18 bp, Artificial Sequence
  Synthetic DNA
aatcacaattcactatag

SEQ ID NO: 62034 - DNA, 18 bp, Artificial Sequence
  Synthetic DNA
aatcacgaatctcaacag

SEQ ID NO: 62035 - DNA, 18 bp, Artificial Sequence
  Synthetic DNA
aatcacgactcacgtaag

SEQ ID NO: 62036 - DNA, 18 bp, Artificial Sequence
  Synthetic DNA
aatcaggactttctatag

SEQ ID NO: 62037 - DNA, 18 bp, Artificial Sequence
  Synthetic DNA
aatcccgacacagtaaag

SEQ ID NO: 62038 - DNA, 18 bp, Artificial Sequence
  Synthetic DNA
aatcgcgaaccactatag

SEQ ID NO: 62039 - DNA, 18 bp, Artificial Sequence
  Synthetic DNA
aatctcgaatcactatag

SEQ ID NO: 62040 - DNA, 18 bp, Artificial Sequence
  Synthetic DNA
aatgacgactgataatag

SEQ ID NO: 62041 - DNA, 18 bp, Artificial Sequence
  Synthetic DNA
aattacaaatcacaaaag

SEQ ID NO: 62042 - DNA, 18 bp, Artificial Sequence
  Synthetic DNA
aattacaacagactatag

SEQ ID NO: 62043 - DNA, 18 bp, Artificial Sequence
  Synthetic DNA
aattaccactttcagttg

SEQ ID NO: 62044 - DNA, 18 bp, Artificial Sequence
  Synthetic DNA
aattacgaaagactttag

SEQ ID NO: 62045 - DNA, 18 bp, Artificial Sequence
  Synthetic DNA
aattacgaatctccctag

SEQ ID NO: 62046 - DNA, 18 bp, Artificial Sequence
  Synthetic DNA
aattacgacagactagag

SEQ ID NO: 62047 - DNA, 18 bp, Artificial Sequence
  Synthetic DNA
aattacgaccctgtaatg

SEQ ID NO: 62048 - DNA, 18 bp, Artificial Sequence
  Synthetic DNA
aattacgactcgcataag

SEQ ID NO: 62049 - DNA, 18 bp, Artificial Sequence
  Synthetic DNA
aattacgactcttaatag

SEQ ID NO: 62050 - DNA, 18 bp, Artificial Sequence
  Synthetic DNA
aattacgattaacttgag

SEQ ID NO: 62051 - DNA, 18 bp, Artificial Sequence
  Synthetic DNA
aattacgattgactttag

SEQ ID NO: 62052 - DNA, 18 bp, Artificial Sequence
  Synthetic DNA
aattacgcctaactctcg

SEQ ID NO: 62053 - DNA, 18 bp, Artificial Sequence
  Synthetic DNA
aattacggctctttctag

SEQ ID NO: 62054 - DNA, 18 bp, Artificial Sequence
  Synthetic DNA
aattacgtctcaacattg

SEQ ID NO: 62055 - DNA, 18 bp, Artificial Sequence
  Synthetic DNA
aattacgttaaacaattg

SEQ ID NO: 62056 - DNA, 18 bp, Artificial Sequence
  Synthetic DNA
aattacgtttcactttag

SEQ ID NO: 62057 - DNA, 18 bp, Artificial Sequence
  Synthetic DNA
aattactaatcattgtag

SEQ ID NO: 62058 - DNA, 18 bp, Artificial Sequence
  Synthetic DNA
aattactactcgatatag

SEQ ID NO: 62059 - DNA, 18 bp, Artificial Sequence
  Synthetic DNA
aattactatacaccatag

SEQ ID NO: 62060 - DNA, 18 bp, Artificial Sequence
  Synthetic DNA
aattaggacacacaaaag

SEQ ID NO: 62061 - DNA, 18 bp, Artificial Sequence
  Synthetic DNA
aattaggattcacgatag

SEQ ID NO: 62062 - DNA, 18 bp, Artificial Sequence
  Synthetic DNA
aattaggttgcacaatcg

SEQ ID NO: 62063 - DNA, 18 bp, Artificial Sequence
  Synthetic DNA
aattataactcaccatag

SEQ ID NO: 62064 - DNA, 18 bp, Artificial Sequence
  Synthetic DNA
aattatgactaatttgag

SEQ ID NO: 62065 - DNA, 18 bp, Artificial Sequence
  Synthetic DNA
aattccgaccaactacag

SEQ ID NO: 62066 - DNA, 18 bp, Artificial Sequence
  Synthetic DNA
aattccgattcacagtag

SEQ ID NO: 62067 - DNA, 18 bp, Artificial Sequence
  Synthetic DNA
aattctgactcactaaag

SEQ ID NO: 62068 - DNA, 18 bp, Artificial Sequence
  Synthetic DNA
aattgcgactcattaaag

SEQ ID NO: 62069 - DNA, 18 bp, Artificial Sequence
  Synthetic DNA
aattgggactcactaaag

SEQ ID NO: 62070 - DNA, 18 bp, Artificial Sequence
  Synthetic DNA
aatttcctagctctatcg

SEQ ID NO: 62071 - DNA, 18 bp, Artificial Sequence
  Synthetic DNA
aatttcgactctcctttg

SEQ ID NO: 62072 - DNA, 18 bp, Artificial Sequence
  Synthetic DNA
aatttctactgtcaatcg

SEQ ID NO: 62073 - DNA, 18 bp, Artificial Sequence
  Synthetic DNA
aattttgcctcactatag

SEQ ID NO: 62074 - DNA, 18 bp, Artificial Sequence
  Synthetic DNA
acaaacgactctctcaag

SEQ ID NO: 62075 - DNA, 18 bp, Artificial Sequence
  Synthetic DNA
acaaacttctctcttaag

SEQ ID NO: 62076 - DNA, 18 bp, Artificial Sequence
  Synthetic DNA
acaagcatctcacaatag

SEQ ID NO: 62077 - DNA, 18 bp, Artificial Sequence
  Synthetic DNA
acaagcgtctctctattg

SEQ ID NO: 62078 - DNA, 18 bp, Artificial Sequence
  Synthetic DNA
acacacctatcactattg

SEQ ID NO: 62079 - DNA, 18 bp, Artificial Sequence
  Synthetic DNA
acactcaagtcactgtcg

SEQ ID NO: 62080 - DNA, 18 bp, Artificial Sequence
  Synthetic DNA
acactggactgactatag

SEQ ID NO: 62081 - DNA, 18 bp, Artificial Sequence
  Synthetic DNA
acataagtctccctatag

SEQ ID NO: 62082 - DNA, 18 bp, Artificial Sequence
  Synthetic DNA
acatacaactcaatatcg

SEQ ID NO: 62083 - DNA, 18 bp, Artificial Sequence
  Synthetic DNA
acatacgacacaccgtag

SEQ ID NO: 62084 - DNA, 18 bp, Artificial Sequence
  Synthetic DNA
acatacgcctccctacgg

SEQ ID NO: 62085 - DNA, 18 bp, Artificial Sequence
  Synthetic DNA
acatactactcaatttag

SEQ ID NO: 62086 - DNA, 18 bp, Artificial Sequence
  Synthetic DNA
acatactcctcactaaag

SEQ ID NO: 62087 - DNA, 18 bp, Artificial Sequence
  Synthetic DNA
acataggattcactttag

SEQ ID NO: 62088 - DNA, 18 bp, Artificial Sequence
  Synthetic DNA
acataggtttcactgtcg

SEQ ID NO: 62089 - DNA, 18 bp, Artificial Sequence
  Synthetic DNA
acatataactctctattg

SEQ ID NO: 62090 - DNA, 18 bp, Artificial Sequence
  Synthetic DNA
acatataattagttatag

SEQ ID NO: 62091 - DNA, 18 bp, Artificial Sequence
  Synthetic DNA
acatgcgactcagtattg

SEQ ID NO: 62092 - DNA, 18 bp, Artificial Sequence
  Synthetic DNA
acatgcgactcattttag

SEQ ID NO: 62093 - DNA, 18 bp, Artificial Sequence
  Synthetic DNA
acattaccctctcagtag

SEQ ID NO: 62094 - DNA, 18 bp, Artificial Sequence
  Synthetic DNA
acattcctatcactttag

SEQ ID NO: 62095 - DNA, 18 bp, Artificial Sequence
  Synthetic DNA
acattcgactaacaacag

SEQ ID NO: 62096 - DNA, 18 bp, Artificial Sequence
  Synthetic DNA
acattcggctgatttttg

SEQ ID NO: 62097 - DNA, 18 bp, Artificial Sequence
  Synthetic DNA
acattcgtagcactattg

SEQ ID NO: 62098 - DNA, 18 bp, Artificial Sequence
  Synthetic DNA
acgtaaatctcaatatag

SEQ ID NO: 62099 - DNA, 18 bp, Artificial Sequence
  Synthetic DNA
acgtctgacactctattg

SEQ ID NO: 62100 - DNA, 18 bp, Artificial Sequence
  Synthetic DNA
acgtgtcattcactctag

SEQ ID NO: 62101 - DNA, 18 bp, Artificial Sequence
  Synthetic DNA
acgttcgacttactatag

SEQ ID NO: 62102 - DNA, 18 bp, Artificial Sequence
  Synthetic DNA
actaaagactcactatag

SEQ ID NO: 62103 - DNA, 18 bp, Artificial Sequence
  Synthetic DNA
acttaccaatctctatag

SEQ ID NO: 62104 - DNA, 18 bp, Artificial Sequence
  Synthetic DNA
acttacgactctcttttg

SEQ ID NO: 62105 - DNA, 18 bp, Artificial Sequence
  Synthetic DNA
acttacgattcaatacag

SEQ ID NO: 62106 - DNA, 18 bp, Artificial Sequence
  Synthetic DNA
acttccgaaacttattag

SEQ ID NO: 62107 - DNA, 18 bp, Artificial Sequence
  Synthetic DNA
agataaaaaccactttag

SEQ ID NO: 62108 - DNA, 18 bp, Artificial Sequence
  Synthetic DNA
agataagtcacaatttag

SEQ ID NO: 62109 - DNA, 18 bp, Artificial Sequence
  Synthetic DNA
agataccatatacaatag

SEQ ID NO: 62110 - DNA, 18 bp, Artificial Sequence
  Synthetic DNA
agatacgaaatactattg

SEQ ID NO: 62111 - DNA, 18 bp, Artificial Sequence
  Synthetic DNA
agatacgactccccattg

SEQ ID NO: 62112 - DNA, 18 bp, Artificial Sequence
  Synthetic DNA
agatacgatacactagag

SEQ ID NO: 62113 - DNA, 18 bp, Artificial Sequence
  Synthetic DNA
agatacgattctaaatag

SEQ ID NO: 62114 - DNA, 18 bp, Artificial Sequence
  Synthetic DNA
agatactactacatgttg

SEQ ID NO: 62115 - DNA, 18 bp, Artificial Sequence
  Synthetic DNA
agatactgctctctatag

SEQ ID NO: 62116 - DNA, 18 bp, Artificial Sequence
  Synthetic DNA
agatccgactctctgtag

SEQ ID NO: 62117 - DNA, 18 bp, Artificial Sequence
  Synthetic DNA
agatctgacacattacag

SEQ ID NO: 62118 - DNA, 18 bp, Artificial Sequence
  Synthetic DNA
agatgcgactcgcttcag

SEQ ID NO: 62119 - DNA, 18 bp, Artificial Sequence
  Synthetic DNA
agattctattcaccattg

SEQ ID NO: 62120 - DNA, 18 bp, Artificial Sequence
  Synthetic DNA
agattggactcgcaatag

SEQ ID NO: 62121 - DNA, 18 bp, Artificial Sequence
  Synthetic DNA
aggtacgaccctctatag

SEQ ID NO: 62122 - DNA, 18 bp, Artificial Sequence
  Synthetic DNA
agtcatgactcactattg

SEQ ID NO: 62123 - DNA, 18 bp, Artificial Sequence
  Synthetic DNA
agtctagactaacaatag

SEQ ID NO: 62124 - DNA, 18 bp, Artificial Sequence
  Synthetic DNA
agttacgtatacctacag

SEQ ID NO: 62125 - DNA, 18 bp, Artificial Sequence
  Synthetic DNA
agttacgtatcactatag

SEQ ID NO: 62126 - DNA, 18 bp, Artificial Sequence
  Synthetic DNA
agttacgtctcaatatgg

SEQ ID NO: 62127 - DNA, 18 bp, Artificial Sequence
  Synthetic DNA
agttccgacatacttaag

SEQ ID NO: 62128 - DNA, 18 bp, Artificial Sequence
  Synthetic DNA
agtttcaactcatttcag

SEQ ID NO: 62129 - DNA, 18 bp, Artificial Sequence
  Synthetic DNA
agtttcaactcgcttttg

SEQ ID NO: 62130 - DNA, 18 bp, Artificial Sequence
  Synthetic DNA
ataaacaactcattttag

SEQ ID NO: 62131 - DNA, 18 bp, Artificial Sequence
  Synthetic DNA
ataaaccattcactgtag

SEQ ID NO: 62132 - DNA, 18 bp, Artificial Sequence
  Synthetic DNA
ataaaccattcataatag

SEQ ID NO: 62133 - DNA, 18 bp, Artificial Sequence
  Synthetic DNA
ataaacgattttctatcg

SEQ ID NO: 62134 - DNA, 18 bp, Artificial Sequence
  Synthetic DNA
ataaacgtctcactctag

SEQ ID NO: 62135 - DNA, 18 bp, Artificial Sequence
  Synthetic DNA
ataaaggactctctaaag

SEQ ID NO: 62136 - DNA, 18 bp, Artificial Sequence
  Synthetic DNA
ataaaggactgaatatag

SEQ ID NO: 62137 - DNA, 18 bp, Artificial Sequence
  Synthetic DNA
ataaatgactcaatattg

SEQ ID NO: 62138 - DNA, 18 bp, Artificial Sequence
  Synthetic DNA
ataaccgtctcactatag

SEQ ID NO: 62139 - DNA, 18 bp, Artificial Sequence
  Synthetic DNA
ataagcgactcaatatag

SEQ ID NO: 62140 - DNA, 18 bp, Artificial Sequence
  Synthetic DNA
ataatcaactcactatag

SEQ ID NO: 62141 - DNA, 18 bp, Artificial Sequence
  Synthetic DNA
ataatcgactcacttttg

SEQ ID NO: 62142 - DNA, 18 bp, Artificial Sequence
  Synthetic DNA
ataatcgattcactttag

SEQ ID NO: 62143 - DNA, 18 bp, Artificial Sequence
  Synthetic DNA
ataatcggcacactatag

SEQ ID NO: 62144 - DNA, 18 bp, Artificial Sequence
  Synthetic DNA
ataatctacaaattatag

SEQ ID NO: 62145 - DNA, 18 bp, Artificial Sequence
  Synthetic DNA
atacacgactccaaatag

SEQ ID NO: 62146 - DNA, 18 bp, Artificial Sequence
  Synthetic DNA
atacacgactgactctag

SEQ ID NO: 62147 - DNA, 18 bp, Artificial Sequence
  Synthetic DNA
atacacgttaatatattg

SEQ ID NO: 62148 - DNA, 18 bp, Artificial Sequence
  Synthetic DNA
atacatgactcactttag

SEQ ID NO: 62149 - DNA, 18 bp, Artificial Sequence
  Synthetic DNA
atagacgactccatattg

SEQ ID NO: 62150 - DNA, 18 bp, Artificial Sequence
  Synthetic DNA
atagtcgcctcactacag

SEQ ID NO: 62151 - DNA, 18 bp, Artificial Sequence
  Synthetic DNA
atataaaaatcgctatgg

SEQ ID NO: 62152 - DNA, 18 bp, Artificial Sequence
  Synthetic DNA
atataagactatttttag

SEQ ID NO: 62153 - DNA, 18 bp, Artificial Sequence
  Synthetic DNA
atataagacttacaatag

SEQ ID NO: 62154 - DNA, 18 bp, Artificial Sequence
  Synthetic DNA
atatacaacgtaccatag

SEQ ID NO: 62155 - DNA, 18 bp, Artificial Sequence
  Synthetic DNA
atatacaacttatgtttg

SEQ ID NO: 62156 - DNA, 18 bp, Artificial Sequence
  Synthetic DNA
atatacacctcaattgag

SEQ ID NO: 62157 - DNA, 18 bp, Artificial Sequence
  Synthetic DNA
atatacatcacaattttg

SEQ ID NO: 62158 - DNA, 18 bp, Artificial Sequence
  Synthetic DNA
atatacgacaatctttag

SEQ ID NO: 62159 - DNA, 18 bp, Artificial Sequence
  Synthetic DNA
atatacgacactctcttg

SEQ ID NO: 62160 - DNA, 18 bp, Artificial Sequence
  Synthetic DNA
atatacgactatttatag

SEQ ID NO: 62161 - DNA, 18 bp, Artificial Sequence
  Synthetic DNA
atatacgactcaaactag

SEQ ID NO: 62162 - DNA, 18 bp, Artificial Sequence
  Synthetic DNA
atatacgactcaagattg

SEQ ID NO: 62163 - DNA, 18 bp, Artificial Sequence
  Synthetic DNA
atatacgactcactttca

SEQ ID NO: 62164 - DNA, 18 bp, Artificial Sequence
  Synthetic DNA
atatacgactctccagag

SEQ ID NO: 62165 - DNA, 18 bp, Artificial Sequence
  Synthetic DNA
atatacgactgaccaaag

SEQ ID NO: 62166 - DNA, 18 bp, Artificial Sequence
  Synthetic DNA
atatacgattcgctctag

SEQ ID NO: 62167 - DNA, 18 bp, Artificial Sequence
  Synthetic DNA
atatacgtctaacaatag

SEQ ID NO: 62168 - DNA, 18 bp, Artificial Sequence
  Synthetic DNA
atatacgtctccctaaag

SEQ ID NO: 62169 - DNA, 18 bp, Artificial Sequence
  Synthetic DNA
atatacgtctgcgtaaag

SEQ ID NO: 62170 - DNA, 18 bp, Artificial Sequence
  Synthetic DNA
atatacgtggctctatag

SEQ ID NO: 62171 - DNA, 18 bp, Artificial Sequence
  Synthetic DNA
atatacgtgtccctttag

SEQ ID NO: 62172 - DNA, 18 bp, Artificial Sequence
  Synthetic DNA
atatacgtttcattatag

SEQ ID NO: 62173 - DNA, 18 bp, Artificial Sequence
  Synthetic DNA
atatacgtttgacttttg

SEQ ID NO: 62174 - DNA, 18 bp, Artificial Sequence
  Synthetic DNA
atatacgttttactttag

SEQ ID NO: 62175 - DNA, 18 bp, Artificial Sequence
  Synthetic DNA
atatactgcgatctctag

SEQ ID NO: 62176 - DNA, 18 bp, Artificial Sequence
  Synthetic DNA
atataggaatttctatag

SEQ ID NO: 62177 - DNA, 18 bp, Artificial Sequence
  Synthetic DNA
atataggactgactgtag

SEQ ID NO: 62178 - DNA, 18 bp, Artificial Sequence
  Synthetic DNA
atataggtcactctatag

SEQ ID NO: 62179 - DNA, 18 bp, Artificial Sequence
  Synthetic DNA
atatatggctcactacag

SEQ ID NO: 62180 - DNA, 18 bp, Artificial Sequence
  Synthetic DNA
atatccgactcaccattg

SEQ ID NO: 62181 - DNA, 18 bp, Artificial Sequence
  Synthetic DNA
atatccgacttttgttgg

SEQ ID NO: 62182 - DNA, 18 bp, Artificial Sequence
  Synthetic DNA
atatccgtctcactcttg

SEQ ID NO: 62183 - DNA, 18 bp, Artificial Sequence
  Synthetic DNA
atatctgtttcactttgg

SEQ ID NO: 62184 - DNA, 18 bp, Artificial Sequence
  Synthetic DNA
atatgagtcttactatag

SEQ ID NO: 62185 - DNA, 18 bp, Artificial Sequence
  Synthetic DNA
atatgcgaccgactatag

SEQ ID NO: 62186 - DNA, 18 bp, Artificial Sequence
  Synthetic DNA
atatgcgtctcattatag

SEQ ID NO: 62187 - DNA, 18 bp, Artificial Sequence
  Synthetic DNA
atatgggactcattttag

SEQ ID NO: 62188 - DNA, 18 bp, Artificial Sequence
  Synthetic DNA
atattagactgcctttag

SEQ ID NO: 62189 - DNA, 18 bp, Artificial Sequence
  Synthetic DNA
atattcatttcatttcag

SEQ ID NO: 62190 - DNA, 18 bp, Artificial Sequence
  Synthetic DNA
atattcgccttcatgaag

SEQ ID NO: 62191 - DNA, 18 bp, Artificial Sequence
  Synthetic DNA
atattcggctacctaaag

SEQ ID NO: 62192 - DNA, 18 bp, Artificial Sequence
  Synthetic DNA
atattcgtctggcaagag

SEQ ID NO: 62193 - DNA, 18 bp, Artificial Sequence
  Synthetic DNA
atattggactcaccgaag

SEQ ID NO: 62194 - DNA, 18 bp, Artificial Sequence
  Synthetic DNA
atattggactcacttgtg

SEQ ID NO: 62195 - DNA, 18 bp, Artificial Sequence
  Synthetic DNA
atcaacgattaactgtag

SEQ ID NO: 62196 - DNA, 18 bp, Artificial Sequence
  Synthetic DNA
atcaatgactcactaaag

SEQ ID NO: 62197 - DNA, 18 bp, Artificial Sequence
  Synthetic DNA
atcatcgactcactagag

SEQ ID NO: 62198 - DNA, 18 bp, Artificial Sequence
  Synthetic DNA
atctaagactcagtctag

SEQ ID NO: 62199 - DNA, 18 bp, Artificial Sequence
  Synthetic DNA
atctacacctcaccatag

SEQ ID NO: 62200 - DNA, 18 bp, Artificial Sequence
  Synthetic DNA
atctacgactccctattg

SEQ ID NO: 62201 - DNA, 18 bp, Artificial Sequence
  Synthetic DNA
atctacgactgactgtag

SEQ ID NO: 62202 - DNA, 18 bp, Artificial Sequence
  Synthetic DNA
atctacgatacactatag

SEQ ID NO: 62203 - DNA, 18 bp, Artificial Sequence
  Synthetic DNA
atctacggctcactacag

SEQ ID NO: 62204 - DNA, 18 bp, Artificial Sequence
  Synthetic DNA
atgtaccactttttatag

SEQ ID NO: 62205 - DNA, 18 bp, Artificial Sequence
  Synthetic DNA
atgtacgacactcaatag

SEQ ID NO: 62206 - DNA, 18 bp, Artificial Sequence
  Synthetic DNA
atgtactccacactctcg

SEQ ID NO: 62207 - DNA, 18 bp, Artificial Sequence
  Synthetic DNA
atgtatgtcactcaatag

SEQ ID NO: 62208 - DNA, 18 bp, Artificial Sequence
  Synthetic DNA
atgtattactcactatag

SEQ ID NO: 62209 - DNA, 18 bp, Artificial Sequence
  Synthetic DNA
atgttagactctttgttg

SEQ ID NO: 62210 - DNA, 18 bp, Artificial Sequence
  Synthetic DNA
attaacaactctctatag

SEQ ID NO: 62211 - DNA, 18 bp, Artificial Sequence
  Synthetic DNA
attatcgacttataatag

SEQ ID NO: 62212 - DNA, 18 bp, Artificial Sequence
  Synthetic DNA
atttacgaatcacaattg

SEQ ID NO: 62213 - DNA, 18 bp, Artificial Sequence
  Synthetic DNA
atttacgacatactaagg

SEQ ID NO: 62214 - DNA, 18 bp, Artificial Sequence
  Synthetic DNA
atttacgactcattagag

SEQ ID NO: 62215 - DNA, 18 bp, Artificial Sequence
  Synthetic DNA
atttacgactgactcaag

SEQ ID NO: 62216 - DNA, 18 bp, Artificial Sequence
  Synthetic DNA
atttacgattcactattg

SEQ ID NO: 62217 - DNA, 18 bp, Artificial Sequence
  Synthetic DNA
atttatgacttacaatag

SEQ ID NO: 62218 - DNA, 18 bp, Artificial Sequence
  Synthetic DNA
atttattacttagaaaag

SEQ ID NO: 62219 - DNA, 18 bp, Artificial Sequence
  Synthetic DNA
atttccgactcacttatg

SEQ ID NO: 62220 - DNA, 18 bp, Artificial Sequence
  Synthetic DNA
caaaaagactatctatag

SEQ ID NO: 62221 - DNA, 18 bp, Artificial Sequence
  Synthetic DNA
caaaacatttcactatag

SEQ ID NO: 62222 - DNA, 18 bp, Artificial Sequence
  Synthetic DNA
caaaaccactcaccatgg

SEQ ID NO: 62223 - DNA, 18 bp, Artificial Sequence
  Synthetic DNA
caaaacgaaccaccatag

SEQ ID NO: 62224 - DNA, 18 bp, Artificial Sequence
  Synthetic DNA
caaaacgactaaatagag

SEQ ID NO: 62225 - DNA, 18 bp, Artificial Sequence
  Synthetic DNA
caaaacgtctcataatag

SEQ ID NO: 62226 - DNA, 18 bp, Artificial Sequence
  Synthetic DNA
caaaacgtctctcaatag

SEQ ID NO: 62227 - DNA, 18 bp, Artificial Sequence
  Synthetic DNA
caaaacgtgtaactacag

SEQ ID NO: 62228 - DNA, 18 bp, Artificial Sequence
  Synthetic DNA
caaaactcctcagtatag

SEQ ID NO: 62229 - DNA, 18 bp, Artificial Sequence
  Synthetic DNA
caaaacttctcgccatag

SEQ ID NO: 62230 - DNA, 18 bp, Artificial Sequence
  Synthetic DNA
caaaatcacacacaaaag

SEQ ID NO: 62231 - DNA, 18 bp, Artificial Sequence
  Synthetic DNA
caaacggacacattagag

SEQ ID NO: 62232 - DNA, 18 bp, Artificial Sequence
  Synthetic DNA
caaatagacaaactttag

SEQ ID NO: 62233 - DNA, 18 bp, Artificial Sequence
  Synthetic DNA
caaatcaactcagtatag

SEQ ID NO: 62234 - DNA, 18 bp, Artificial Sequence
  Synthetic DNA
caacacgactccctgttg

SEQ ID NO: 62235 - DNA, 18 bp, Artificial Sequence
  Synthetic DNA
caacactaatcaatattg

SEQ ID NO: 62236 - DNA, 18 bp, Artificial Sequence
  Synthetic DNA
caataaaattcattaaag

SEQ ID NO: 62237 - DNA, 18 bp, Artificial Sequence
  Synthetic DNA
caataagactcgcaaaag

SEQ ID NO: 62238 - DNA, 18 bp, Artificial Sequence
  Synthetic DNA
caataagtctaaattatg

SEQ ID NO: 62239 - DNA, 18 bp, Artificial Sequence
  Synthetic DNA
caataataatcactttag

SEQ ID NO: 62240 - DNA, 18 bp, Artificial Sequence
  Synthetic DNA
caataatactcaccattg

SEQ ID NO: 62241 - DNA, 18 bp, Artificial Sequence
  Synthetic DNA
caatacaactcacttatg

SEQ ID NO: 62242 - DNA, 18 bp, Artificial Sequence
  Synthetic DNA
caatacagcttacaatag

SEQ ID NO: 62243 - DNA, 18 bp, Artificial Sequence
  Synthetic DNA
caatacatttcacaatag

SEQ ID NO: 62244 - DNA, 18 bp, Artificial Sequence
  Synthetic DNA
caataccaaactctatag

SEQ ID NO: 62245 - DNA, 18 bp, Artificial Sequence
  Synthetic DNA
caatacctctctttttag

SEQ ID NO: 62246 - DNA, 18 bp, Artificial Sequence
  Synthetic DNA
caatacgactgtttgtag

SEQ ID NO: 62247 - DNA, 18 bp, Artificial Sequence
  Synthetic DNA
caatacgacttaattaag

SEQ ID NO: 62248 - DNA, 18 bp, Artificial Sequence
  Synthetic DNA
caatacgactttatttag

SEQ ID NO: 62249 - DNA, 18 bp, Artificial Sequence
  Synthetic DNA
caatacgatatactcagg

SEQ ID NO: 62250 - DNA, 18 bp, Artificial Sequence
  Synthetic DNA
caatacgatggaaaattg

SEQ ID NO: 62251 - DNA, 18 bp, Artificial Sequence
  Synthetic DNA
caatacgcttcataatag

SEQ ID NO: 62252 - DNA, 18 bp, Artificial Sequence
  Synthetic DNA
caatacggttcaaaatag

SEQ ID NO: 62253 - DNA, 18 bp, Artificial Sequence
  Synthetic DNA
caatacgtctttccatag

SEQ ID NO: 62254 - DNA, 18 bp, Artificial Sequence
  Synthetic DNA
caatactacacgctttag

SEQ ID NO: 62255 - DNA, 18 bp, Artificial Sequence
  Synthetic DNA
caatactacatacaatag

SEQ ID NO: 62256 - DNA, 18 bp, Artificial Sequence
  Synthetic DNA
caatactactttctattg

SEQ ID NO: 62257 - DNA, 18 bp, Artificial Sequence
  Synthetic DNA
caatactagtctacgagg

SEQ ID NO: 62258 - DNA, 18 bp, Artificial Sequence
  Synthetic DNA
caatactagtctctatcg

SEQ ID NO: 62259 - DNA, 18 bp, Artificial Sequence
  Synthetic DNA
caatacttcgtgctctag

SEQ ID NO: 62260 - DNA, 18 bp, Artificial Sequence
  Synthetic DNA
caatacttctcaatgtag

SEQ ID NO: 62261 - DNA, 18 bp, Artificial Sequence
  Synthetic DNA
caataggaaactctattg

SEQ ID NO: 62262 - DNA, 18 bp, Artificial Sequence
  Synthetic DNA
caataggaatcagttttg

SEQ ID NO: 62263 - DNA, 18 bp, Artificial Sequence
  Synthetic DNA
caatagtataccatatag

SEQ ID NO: 62264 - DNA, 18 bp, Artificial Sequence
  Synthetic DNA
caatagttttcaccatag

SEQ ID NO: 62265 - DNA, 18 bp, Artificial Sequence
  Synthetic DNA
caatatgaatctatattg

SEQ ID NO: 62266 - DNA, 18 bp, Artificial Sequence
  Synthetic DNA
caatatgactcgttattg

SEQ ID NO: 62267 - DNA, 18 bp, Artificial Sequence
  Synthetic DNA
caatatgattcaatattg

SEQ ID NO: 62268 - DNA, 18 bp, Artificial Sequence
  Synthetic DNA
caatccgactcacattgg

SEQ ID NO: 62269 - DNA, 18 bp, Artificial Sequence
  Synthetic DNA
caatccgattggcaatag

SEQ ID NO: 62270 - DNA, 18 bp, Artificial Sequence
  Synthetic DNA
caatgagtatcaccatag

SEQ ID NO: 62271 - DNA, 18 bp, Artificial Sequence
  Synthetic DNA
caatgcaaatcgctggtg

SEQ ID NO: 62272 - DNA, 18 bp, Artificial Sequence
  Synthetic DNA
caatgcaactctctatcg

SEQ ID NO: 62273 - DNA, 18 bp, Artificial Sequence
  Synthetic DNA
caatgcgtctgaatatag

SEQ ID NO: 62274 - DNA, 18 bp, Artificial Sequence
  Synthetic DNA
caatgctacttacaattg

SEQ ID NO: 62275 - DNA, 18 bp, Artificial Sequence
  Synthetic DNA
caatgtgagatacttttg

SEQ ID NO: 62276 - DNA, 18 bp, Artificial Sequence
  Synthetic DNA
caatgtgagtcactattg

SEQ ID NO: 62277 - DNA, 18 bp, Artificial Sequence
  Synthetic DNA
caattaaattcactacag

SEQ ID NO: 62278 - DNA, 18 bp, Artificial Sequence
  Synthetic DNA
caattcaactctttcaag

SEQ ID NO: 62279 - DNA, 18 bp, Artificial Sequence
  Synthetic DNA
caattcatctttgtatag

SEQ ID NO: 62280 - DNA, 18 bp, Artificial Sequence
  Synthetic DNA
caattcgaaatacaatag

SEQ ID NO: 62281 - DNA, 18 bp, Artificial Sequence
  Synthetic DNA
caattcgactctctgaag

SEQ ID NO: 62282 - DNA, 18 bp, Artificial Sequence
  Synthetic DNA
caattcgtctcgttatag

SEQ ID NO: 62283 - DNA, 18 bp, Artificial Sequence
  Synthetic DNA
cacaccgaatcactttag

SEQ ID NO: 62284 - DNA, 18 bp, Artificial Sequence
  Synthetic DNA
cacgccaacacactatag

SEQ ID NO: 62285 - DNA, 18 bp, Artificial Sequence
  Synthetic DNA
cagaacgactcttaaaag

SEQ ID NO: 62286 - DNA, 18 bp, Artificial Sequence
  Synthetic DNA
cagaacgtcgcactattg

SEQ ID NO: 62287 - DNA, 18 bp, Artificial Sequence
  Synthetic DNA
cagtacgacgctcaacag

SEQ ID NO: 62288 - DNA, 18 bp, Artificial Sequence
  Synthetic DNA
cagttctactcaattttg

SEQ ID NO: 62289 - DNA, 18 bp, Artificial Sequence
  Synthetic DNA
cataacgtctcactttaa

SEQ ID NO: 62290 - DNA, 18 bp, Artificial Sequence
  Synthetic DNA
cataactattcaccatcg

SEQ ID NO: 62291 - DNA, 18 bp, Artificial Sequence
  Synthetic DNA
cataatgactcactttag

SEQ ID NO: 62292 - DNA, 18 bp, Artificial Sequence
  Synthetic DNA
catcacaaatcactttag

SEQ ID NO: 62293 - DNA, 18 bp, Artificial Sequence
  Synthetic DNA
catctcgactcactctag

SEQ ID NO: 62294 - DNA, 18 bp, Artificial Sequence
  Synthetic DNA
catctctattcactgtag

SEQ ID NO: 62295 - DNA, 18 bp, Artificial Sequence
  Synthetic DNA
catgactacacactttag

SEQ ID NO: 62296 - DNA, 18 bp, Artificial Sequence
  Synthetic DNA
catgcccacttactgtcg

SEQ ID NO: 62297 - DNA, 18 bp, Artificial Sequence
  Synthetic DNA
cattaagactttctattg

SEQ ID NO: 62298 - DNA, 18 bp, Artificial Sequence
  Synthetic DNA
cattaagccgtgctatag

SEQ ID NO: 62299 - DNA, 18 bp, Artificial Sequence
  Synthetic DNA
cattacaactctccatag

SEQ ID NO: 62300 - DNA, 18 bp, Artificial Sequence
  Synthetic DNA
cattacgaatcacaaaag

SEQ ID NO: 62301 - DNA, 18 bp, Artificial Sequence
  Synthetic DNA
cattacgacttcctattg

SEQ ID NO: 62302 - DNA, 18 bp, Artificial Sequence
  Synthetic DNA
cattacgagtcgctcttg

SEQ ID NO: 62303 - DNA, 18 bp, Artificial Sequence
  Synthetic DNA
cattacgattcaatttag

SEQ ID NO: 62304 - DNA, 18 bp, Artificial Sequence
  Synthetic DNA
cattactagttattattg

SEQ ID NO: 62305 - DNA, 18 bp, Artificial Sequence
  Synthetic DNA
cattatgaatgactgtag

SEQ ID NO: 62306 - DNA, 18 bp, Artificial Sequence
  Synthetic DNA
cattatgccatactaaag

SEQ ID NO: 62307 - DNA, 18 bp, Artificial Sequence
  Synthetic DNA
cattattactcacaatag

SEQ ID NO: 62308 - DNA, 18 bp, Artificial Sequence
  Synthetic DNA
cattccaactctctttag

SEQ ID NO: 62309 - DNA, 18 bp, Artificial Sequence
  Synthetic DNA
cattccaactgactatgg

SEQ ID NO: 62310 - DNA, 18 bp, Artificial Sequence
  Synthetic DNA
cattccgacacactctag

SEQ ID NO: 62311 - DNA, 18 bp, Artificial Sequence
  Synthetic DNA
catttcaactctctaatg

SEQ ID NO: 62312 - DNA, 18 bp, Artificial Sequence
  Synthetic DNA
catttcgacatagtatag

SEQ ID NO: 62313 - DNA, 18 bp, Artificial Sequence
  Synthetic DNA
catttcgactcacaaaag

SEQ ID NO: 62314 - DNA, 18 bp, Artificial Sequence
  Synthetic DNA
catttctactcgctatag

SEQ ID NO: 62315 - DNA, 18 bp, Artificial Sequence
  Synthetic DNA
ccaaccgactcaccatag

SEQ ID NO: 62316 - DNA, 18 bp, Artificial Sequence
  Synthetic DNA
ccataagactcacataag

SEQ ID NO: 62317 - DNA, 18 bp, Artificial Sequence
  Synthetic DNA
ccataatactcactacgg

SEQ ID NO: 62318 - DNA, 18 bp, Artificial Sequence
  Synthetic DNA
ccatacgtgcatctaaag

SEQ ID NO: 62319 - DNA, 18 bp, Artificial Sequence
  Synthetic DNA
ccatacttctcagattgg

SEQ ID NO: 62320 - DNA, 18 bp, Artificial Sequence
  Synthetic DNA
ccatatgcctaaccatgg

SEQ ID NO: 62321 - DNA, 18 bp, Artificial Sequence
  Synthetic DNA
ccattcgactcattaatg

SEQ ID NO: 62322 - DNA, 18 bp, Artificial Sequence
  Synthetic DNA
ccattcgactgagttttg

SEQ ID NO: 62323 - DNA, 18 bp, Artificial Sequence
  Synthetic DNA
ccattcgcctcgaattag

SEQ ID NO: 62324 - DNA, 18 bp, Artificial Sequence
  Synthetic DNA
cccacggtctcattgtag

SEQ ID NO: 62325 - DNA, 18 bp, Artificial Sequence
  Synthetic DNA
cccgtagtctcactacag

SEQ ID NO: 62326 - DNA, 18 bp, Artificial Sequence
  Synthetic DNA
cccttttaccaaccattg

SEQ ID NO: 62327 - DNA, 18 bp, Artificial Sequence
  Synthetic DNA
cctatctacccactattg

SEQ ID NO: 62328 - DNA, 18 bp, Artificial Sequence
  Synthetic DNA
cgataagtcttaatttag

SEQ ID NO: 62329 - DNA, 18 bp, Artificial Sequence
  Synthetic DNA
cgatacaactcattacag

SEQ ID NO: 62330 - DNA, 18 bp, Artificial Sequence
  Synthetic DNA
cgatactacccaatttag

SEQ ID NO: 62331 - DNA, 18 bp, Artificial Sequence
  Synthetic DNA
cgatactactaaatacag

SEQ ID NO: 62332 - DNA, 18 bp, Artificial Sequence
  Synthetic DNA
cgatcagactcaaaatag

SEQ ID NO: 62333 - DNA, 18 bp, Artificial Sequence
  Synthetic DNA
ctaaacgatttactatag

SEQ ID NO: 62334 - DNA, 18 bp, Artificial Sequence
  Synthetic DNA
ctaaacgtctcacactag

SEQ ID NO: 62335 - DNA, 18 bp, Artificial Sequence
  Synthetic DNA
ctaaacgtctcactttcg

SEQ ID NO: 62336 - DNA, 18 bp, Artificial Sequence
  Synthetic DNA
ctacacaacttactatag

SEQ ID NO: 62337 - DNA, 18 bp, Artificial Sequence
  Synthetic DNA
ctacacctgttattattg

SEQ ID NO: 62338 - DNA, 18 bp, Artificial Sequence
  Synthetic DNA
ctacactcgtcactttag

SEQ ID NO: 62339 - DNA, 18 bp, Artificial Sequence
  Synthetic DNA
ctacatgagtgactatag

SEQ ID NO: 62340 - DNA, 18 bp, Artificial Sequence
  Synthetic DNA
ctatacaaccctttattg

SEQ ID NO: 62341 - DNA, 18 bp, Artificial Sequence
  Synthetic DNA
ctatacaactcaattttg

SEQ ID NO: 62342 - DNA, 18 bp, Artificial Sequence
  Synthetic DNA
ctatacatctcactctag

SEQ ID NO: 62343 - DNA, 18 bp, Artificial Sequence
  Synthetic DNA
ctataccaaccaattcag

SEQ ID NO: 62344 - DNA, 18 bp, Artificial Sequence
  Synthetic DNA
ctatacctctcagtttag

SEQ ID NO: 62345 - DNA, 18 bp, Artificial Sequence
  Synthetic DNA
ctatacgaatcacaaaag

SEQ ID NO: 62346 - DNA, 18 bp, Artificial Sequence
  Synthetic DNA
ctatacgacccagttttg

SEQ ID NO: 62347 - DNA, 18 bp, Artificial Sequence
  Synthetic DNA
ctatacgattccctgtag

SEQ ID NO: 62348 - DNA, 18 bp, Artificial Sequence
  Synthetic DNA
ctatacgtcacatattag

SEQ ID NO: 62349 - DNA, 18 bp, Artificial Sequence
  Synthetic DNA
ctatactattcactttag

SEQ ID NO: 62350 - DNA, 18 bp, Artificial Sequence
  Synthetic DNA
ctatgcgacacactttcg

SEQ ID NO: 62351 - DNA, 18 bp, Artificial Sequence
  Synthetic DNA
ctattagtcacagtatag

SEQ ID NO: 62352 - DNA, 18 bp, Artificial Sequence
  Synthetic DNA
ctattattttcactaacg

SEQ ID NO: 62353 - DNA, 18 bp, Artificial Sequence
  Synthetic DNA
ctattcaactctctttag

SEQ ID NO: 62354 - DNA, 18 bp, Artificial Sequence
  Synthetic DNA
ctattcgactcaatatcg

SEQ ID NO: 62355 - DNA, 18 bp, Artificial Sequence
  Synthetic DNA
ctattctaatgacaatag

SEQ ID NO: 62356 - DNA, 18 bp, Artificial Sequence
  Synthetic DNA
ctattctactctctacag

SEQ ID NO: 62357 - DNA, 18 bp, Artificial Sequence
  Synthetic DNA
ctcataaactcactatag

SEQ ID NO: 62358 - DNA, 18 bp, Artificial Sequence
  Synthetic DNA
ctctacgactcacttgag

SEQ ID NO: 62359 - DNA, 18 bp, Artificial Sequence
  Synthetic DNA
ctctacgtctcactattg

SEQ ID NO: 62360 - DNA, 18 bp, Artificial Sequence
  Synthetic DNA
ctctgggaccctccatag

SEQ ID NO: 62361 - DNA, 18 bp, Artificial Sequence
  Synthetic DNA
ctgtaaaactcactattg

SEQ ID NO: 62362 - DNA, 18 bp, Artificial Sequence
  Synthetic DNA
ctgtccctctctctatcg

SEQ ID NO: 62363 - DNA, 18 bp, Artificial Sequence
  Synthetic DNA
ctgttctgcacaccatgg

SEQ ID NO: 62364 - DNA, 18 bp, Artificial Sequence
  Synthetic DNA
cttaacgactcgctcaag

SEQ ID NO: 62365 - DNA, 18 bp, Artificial Sequence
  Synthetic DNA
cttaacgtctcactaaag

SEQ ID NO: 62366 - DNA, 18 bp, Artificial Sequence
  Synthetic DNA
cttcccaagtcactatag

SEQ ID NO: 62367 - DNA, 18 bp, Artificial Sequence
  Synthetic DNA
cttcctgactctatatag

SEQ ID NO: 62368 - DNA, 18 bp, Artificial Sequence
  Synthetic DNA
ctttaccacttaccatag

SEQ ID NO: 62369 - DNA, 18 bp, Artificial Sequence
  Synthetic DNA
ctttctaactcatattag

SEQ ID NO: 62370 - DNA, 18 bp, Artificial Sequence
  Synthetic DNA
gaaaaaggctcgctatag

SEQ ID NO: 62371 - DNA, 18 bp, Artificial Sequence
  Synthetic DNA
gaaaacgtatcactgtag

SEQ ID NO: 62372 - DNA, 18 bp, Artificial Sequence
  Synthetic DNA
gaaaacgtcttatcatag

SEQ ID NO: 62373 - DNA, 18 bp, Artificial Sequence
  Synthetic DNA
gaaaacgtgtcaccatag

SEQ ID NO: 62374 - DNA, 18 bp, Artificial Sequence
  Synthetic DNA
gaaaactttccacaatcg

SEQ ID NO: 62375 - DNA, 18 bp, Artificial Sequence
  Synthetic DNA
gaaacggacaccccacag

SEQ ID NO: 62376 - DNA, 18 bp, Artificial Sequence
  Synthetic DNA
gaaagccactcactaatg

SEQ ID NO: 62377 - DNA, 18 bp, Artificial Sequence
  Synthetic DNA
gaaagcctatctgaatgg

SEQ ID NO: 62378 - DNA, 18 bp, Artificial Sequence
  Synthetic DNA
gaacacgaatcatttcag

SEQ ID NO: 62379 - DNA, 18 bp, Artificial Sequence
  Synthetic DNA
gaactcggcgcactatag

SEQ ID NO: 62380 - DNA, 18 bp, Artificial Sequence
  Synthetic DNA
gaagtcgaatcacactcg

SEQ ID NO: 62381 - DNA, 18 bp, Artificial Sequence
  Synthetic DNA
gaataagactaattaacg

SEQ ID NO: 62382 - DNA, 18 bp, Artificial Sequence
  Synthetic DNA
gaataagtctcaccattg

SEQ ID NO: 62383 - DNA, 18 bp, Artificial Sequence
  Synthetic DNA
gaataccacttacggtag

SEQ ID NO: 62384 - DNA, 18 bp, Artificial Sequence
  Synthetic DNA
gaatacgactgtataaag

SEQ ID NO: 62385 - DNA, 18 bp, Artificial Sequence
  Synthetic DNA
gaatacgagtacctaaag

SEQ ID NO: 62386 - DNA, 18 bp, Artificial Sequence
  Synthetic DNA
gaatacgtgacacaatag

SEQ ID NO: 62387 - DNA, 18 bp, Artificial Sequence
  Synthetic DNA
gaatacgtttctctaaag

SEQ ID NO: 62388 - DNA, 18 bp, Artificial Sequence
  Synthetic DNA
gaatactacactctaaag

SEQ ID NO: 62389 - DNA, 18 bp, Artificial Sequence
  Synthetic DNA
gaatactatgcacttaag

SEQ ID NO: 62390 - DNA, 18 bp, Artificial Sequence
  Synthetic DNA
gaatactcttcactgtag

SEQ ID NO: 62391 - DNA, 18 bp, Artificial Sequence
  Synthetic DNA
gaataggtttcccctcag

SEQ ID NO: 62392 - DNA, 18 bp, Artificial Sequence
  Synthetic DNA
gaatatgactcataatgg

SEQ ID NO: 62393 - DNA, 18 bp, Artificial Sequence
  Synthetic DNA
gaatccaactctgtgtag

SEQ ID NO: 62394 - DNA, 18 bp, Artificial Sequence
  Synthetic DNA
gaatccggcagtataaag

SEQ ID NO: 62395 - DNA, 18 bp, Artificial Sequence
  Synthetic DNA
gaatgccactctcttaag

SEQ ID NO: 62396 - DNA, 18 bp, Artificial Sequence
  Synthetic DNA
gaatgcttctcattgttg

SEQ ID NO: 62397 - DNA, 18 bp, Artificial Sequence
  Synthetic DNA
gaattagaatcaccaaag

SEQ ID NO: 62398 - DNA, 18 bp, Artificial Sequence
  Synthetic DNA
gaattcaacacaacattg

SEQ ID NO: 62399 - DNA, 18 bp, Artificial Sequence
  Synthetic DNA
gaattcaactctatatag

SEQ ID NO: 62400 - DNA, 18 bp, Artificial Sequence
  Synthetic DNA
gaattcaagacataattg

SEQ ID NO: 62401 - DNA, 18 bp, Artificial Sequence
  Synthetic DNA
gaattcgacacaccttag

SEQ ID NO: 62402 - DNA, 18 bp, Artificial Sequence
  Synthetic DNA
gaattgttctcactatag

SEQ ID NO: 62403 - DNA, 18 bp, Artificial Sequence
  Synthetic DNA
gagcaagactcgccaaag

SEQ ID NO: 62404 - DNA, 18 bp, Artificial Sequence
  Synthetic DNA
gataacgtctcgcaatag

SEQ ID NO: 62405 - DNA, 18 bp, Artificial Sequence
  Synthetic DNA
gatagcgacacactatag

SEQ ID NO: 62406 - DNA, 18 bp, Artificial Sequence
  Synthetic DNA
gatatagtctctccatag

SEQ ID NO: 62407 - DNA, 18 bp, Artificial Sequence
  Synthetic DNA
gatgaagtgtcacgattg

SEQ ID NO: 62408 - DNA, 18 bp, Artificial Sequence
  Synthetic DNA
gattacgattcacgttgg

SEQ ID NO: 62409 - DNA, 18 bp, Artificial Sequence
  Synthetic DNA
gattacgtctcatattcg

SEQ ID NO: 62410 - DNA, 18 bp, Artificial Sequence
  Synthetic DNA
gattacgtctccttatag

SEQ ID NO: 62411 - DNA, 18 bp, Artificial Sequence
  Synthetic DNA
gattacgtctgattatag

SEQ ID NO: 62412 - DNA, 18 bp, Artificial Sequence
  Synthetic DNA
gattgcgacacattatag

SEQ ID NO: 62413 - DNA, 18 bp, Artificial Sequence
  Synthetic DNA
gatttcggctcactattg

SEQ ID NO: 62414 - DNA, 18 bp, Artificial Sequence
  Synthetic DNA
gatttctacacactatag

SEQ ID NO: 62415 - DNA, 18 bp, Artificial Sequence
  Synthetic DNA
gcatacgactaattctag

SEQ ID NO: 62416 - DNA, 18 bp, Artificial Sequence
  Synthetic DNA
gcatatgactcatgttag

SEQ ID NO: 62417 - DNA, 18 bp, Artificial Sequence
  Synthetic DNA
gcatgggactctcgatag

SEQ ID NO: 62418 - DNA, 18 bp, Artificial Sequence
  Synthetic DNA
gcattcgacacataatcg

SEQ ID NO: 62419 - DNA, 18 bp, Artificial Sequence
  Synthetic DNA
gctcacaactcactttag

SEQ ID NO: 62420 - DNA, 18 bp, Artificial Sequence
  Synthetic DNA
gcttacgactcttcatag

SEQ ID NO: 62421 - DNA, 18 bp, Artificial Sequence
  Synthetic DNA
gctttcgccccactctcg

SEQ ID NO: 62422 - DNA, 18 bp, Artificial Sequence
  Synthetic DNA
ggatgcgacacacaatag

SEQ ID NO: 62423 - DNA, 18 bp, Artificial Sequence
  Synthetic DNA
ggattcgtctcaaaattg

SEQ ID NO: 62424 - DNA, 18 bp, Artificial Sequence
  Synthetic DNA
ggtaacgagacactatcg

SEQ ID NO: 62425 - DNA, 18 bp, Artificial Sequence
  Synthetic DNA
ggttaaaactcacagaag

SEQ ID NO: 62426 - DNA, 18 bp, Artificial Sequence
  Synthetic DNA
gtacacgacacactaaag

SEQ ID NO: 62427 - DNA, 18 bp, Artificial Sequence
  Synthetic DNA
gtacgcgactcaatatgg

SEQ ID NO: 62428 - DNA, 18 bp, Artificial Sequence
  Synthetic DNA
gtatacaataaactttag

SEQ ID NO: 62429 - DNA, 18 bp, Artificial Sequence
  Synthetic DNA
gtatacgaaactctatag

SEQ ID NO: 62430 - DNA, 18 bp, Artificial Sequence
  Synthetic DNA
gtatacgacagatactag

SEQ ID NO: 62431 - DNA, 18 bp, Artificial Sequence
  Synthetic DNA
gtatacgtcagactatag

SEQ ID NO: 62432 - DNA, 18 bp, Artificial Sequence
  Synthetic DNA
gtataggacacgttacag

SEQ ID NO: 62433 - DNA, 18 bp, Artificial Sequence
  Synthetic DNA
gtatgcgagtcactcaag

SEQ ID NO: 62434 - DNA, 18 bp, Artificial Sequence
  Synthetic DNA
gtattcgtttcattctcg

SEQ ID NO: 62435 - DNA, 18 bp, Artificial Sequence
  Synthetic DNA
gtgtacgactcacttatg

SEQ ID NO: 62436 - DNA, 18 bp, Artificial Sequence
  Synthetic DNA
gttgcctactcagtatag

SEQ ID NO: 62437 - DNA, 18 bp, Artificial Sequence
  Synthetic DNA
gtttacaattaactatag

SEQ ID NO: 62438 - DNA, 18 bp, Artificial Sequence
  Synthetic DNA
gtttacgcctctctatag

SEQ ID NO: 62439 - DNA, 18 bp, Artificial Sequence
  Synthetic DNA
taaaaacactcaccttag

SEQ ID NO: 62440 - DNA, 18 bp, Artificial Sequence
  Synthetic DNA
taaaaagactttccattg

SEQ ID NO: 62441 - DNA, 18 bp, Artificial Sequence
  Synthetic DNA
taaaaagtctggctttag

SEQ ID NO: 62442 - DNA, 18 bp, Artificial Sequence
  Synthetic DNA
taaaaatactcacttaag

SEQ ID NO: 62443 - DNA, 18 bp, Artificial Sequence
  Synthetic DNA
taaaacaaaacccgattg

SEQ ID NO: 62444 - DNA, 18 bp, Artificial Sequence
  Synthetic DNA
taaaacaactcccttaag

SEQ ID NO: 62445 - DNA, 18 bp, Artificial Sequence
  Synthetic DNA
taaaacaactctgtttag

SEQ ID NO: 62446 - DNA, 18 bp, Artificial Sequence
  Synthetic DNA
taaaacaatttattaaag

SEQ ID NO: 62447 - DNA, 18 bp, Artificial Sequence
  Synthetic DNA
taaaacagctgtctatag

SEQ ID NO: 62448 - DNA, 18 bp, Artificial Sequence
  Synthetic DNA
taaaacatatctctaatg

SEQ ID NO: 62449 - DNA, 18 bp, Artificial Sequence
  Synthetic DNA
taaaacatctcacttaag

SEQ ID NO: 62450 - DNA, 18 bp, Artificial Sequence
  Synthetic DNA
taaaacatctcgcaatag

SEQ ID NO: 62451 - DNA, 18 bp, Artificial Sequence
  Synthetic DNA
taaaaccacttacaaaag

SEQ ID NO: 62452 - DNA, 18 bp, Artificial Sequence
  Synthetic DNA
taaaacccctcacgacag

SEQ ID NO: 62453 - DNA, 18 bp, Artificial Sequence
  Synthetic DNA
taaaacctatctcaatag

SEQ ID NO: 62454 - DNA, 18 bp, Artificial Sequence
  Synthetic DNA
taaaacgaagctctgtag

SEQ ID NO: 62455 - DNA, 18 bp, Artificial Sequence
  Synthetic DNA
taaaacgacactaaacag

SEQ ID NO: 62456 - DNA, 18 bp, Artificial Sequence
  Synthetic DNA
taaaacgacactctttgg

SEQ ID NO: 62457 - DNA, 18 bp, Artificial Sequence
  Synthetic DNA
taaaacgacagtattaag

SEQ ID NO: 62458 - DNA, 18 bp, Artificial Sequence
  Synthetic DNA
taaaacgacataatattg

SEQ ID NO: 62459 - DNA, 18 bp, Artificial Sequence
  Synthetic DNA
taaaacgactaaatacgg

SEQ ID NO: 62460 - DNA, 18 bp, Artificial Sequence
  Synthetic DNA
taaaacgactaatttacg

SEQ ID NO: 62461 - DNA, 18 bp, Artificial Sequence
  Synthetic DNA
taaaacgactcaaagggg

SEQ ID NO: 62462 - DNA, 18 bp, Artificial Sequence
  Synthetic DNA
taaaacgactcacatacg

SEQ ID NO: 62463 - DNA, 18 bp, Artificial Sequence
  Synthetic DNA
taaaacgactgataaaag

SEQ ID NO: 62464 - DNA, 18 bp, Artificial Sequence
  Synthetic DNA
taaaacgactgtcaatgg

SEQ ID NO: 62465 - DNA, 18 bp, Artificial Sequence
  Synthetic DNA
taaaacgacttagtgaag

SEQ ID NO: 62466 - DNA, 18 bp, Artificial Sequence
  Synthetic DNA
taaaacgacttgatttag

SEQ ID NO: 62467 - DNA, 18 bp, Artificial Sequence
  Synthetic DNA
taaaacgatctacaacag

SEQ ID NO: 62468 - DNA, 18 bp, Artificial Sequence
  Synthetic DNA
taaaacgattatatatag

SEQ ID NO: 62469 - DNA, 18 bp, Artificial Sequence
  Synthetic DNA
taaaacgcctttctacag

SEQ ID NO: 62470 - DNA, 18 bp, Artificial Sequence
  Synthetic DNA
taaaacggctgacacaag

SEQ ID NO: 62471 - DNA, 18 bp, Artificial Sequence
  Synthetic DNA
taaaacggctgcggaaag

SEQ ID NO: 62472 - DNA, 18 bp, Artificial Sequence
  Synthetic DNA
taaaacgtaaatctatag

SEQ ID NO: 62473 - DNA, 18 bp, Artificial Sequence
  Synthetic DNA
taaaacgtatttctatag

SEQ ID NO: 62474 - DNA, 18 bp, Artificial Sequence
  Synthetic DNA
taaaacgtcactctctag

SEQ ID NO: 62475 - DNA, 18 bp, Artificial Sequence
  Synthetic DNA
taaaacgtctcgcttaag

SEQ ID NO: 62476 - DNA, 18 bp, Artificial Sequence
  Synthetic DNA
taaaacgttccacaaatg

SEQ ID NO: 62477 - DNA, 18 bp, Artificial Sequence
  Synthetic DNA
taaaacgttccactattg

SEQ ID NO: 62478 - DNA, 18 bp, Artificial Sequence
  Synthetic DNA
taaaactaatgactatcg

SEQ ID NO: 62479 - DNA, 18 bp, Artificial Sequence
  Synthetic DNA
taaaactacatacttaag

SEQ ID NO: 62480 - DNA, 18 bp, Artificial Sequence
  Synthetic DNA
taaaactaccaacaatag

SEQ ID NO: 62481 - DNA, 18 bp, Artificial Sequence
  Synthetic DNA
taaaactacccggtttag

SEQ ID NO: 62482 - DNA, 18 bp, Artificial Sequence
  Synthetic DNA
taaaactactctttctag

SEQ ID NO: 62483 - DNA, 18 bp, Artificial Sequence
  Synthetic DNA
taaaactcttctatacag

SEQ ID NO: 62484 - DNA, 18 bp, Artificial Sequence
  Synthetic DNA
taaaacttcttactgtag

SEQ ID NO: 62485 - DNA, 18 bp, Artificial Sequence
  Synthetic DNA
taaaacttgtcactttag

SEQ ID NO: 62486 - DNA, 18 bp, Artificial Sequence
  Synthetic DNA
taaaacttgtttctaaag

SEQ ID NO: 62487 - DNA, 18 bp, Artificial Sequence
  Synthetic DNA
taaaaggactgattttag

SEQ ID NO: 62488 - DNA, 18 bp, Artificial Sequence
  Synthetic DNA
taaaaggattcaataatg

SEQ ID NO: 62489 - DNA, 18 bp, Artificial Sequence
  Synthetic DNA
taaaaggcctcataatcg

SEQ ID NO: 62490 - DNA, 18 bp, Artificial Sequence
  Synthetic DNA
taaaagggctcaacatag

SEQ ID NO: 62491 - DNA, 18 bp, Artificial Sequence
  Synthetic DNA
taaaagttcttaatacag

SEQ ID NO: 62492 - DNA, 18 bp, Artificial Sequence
  Synthetic DNA
taaaataacttactccgg

SEQ ID NO: 62493 - DNA, 18 bp, Artificial Sequence
  Synthetic DNA
taaaatatctctctatag

SEQ ID NO: 62494 - DNA, 18 bp, Artificial Sequence
  Synthetic DNA
taaaatgaataacactag

SEQ ID NO: 62495 - DNA, 18 bp, Artificial Sequence
  Synthetic DNA
taaaatgacactctattg

SEQ ID NO: 62496 - DNA, 18 bp, Artificial Sequence
  Synthetic DNA
taaaatgacgcacactag

SEQ ID NO: 62497 - DNA, 18 bp, Artificial Sequence
  Synthetic DNA
taaaatgtctaaatatag

SEQ ID NO: 62498 - DNA, 18 bp, Artificial Sequence
  Synthetic DNA
taaaatgtctcagaatgg

SEQ ID NO: 62499 - DNA, 18 bp, Artificial Sequence
  Synthetic DNA
taaaatgtctctcttcag

SEQ ID NO: 62500 - DNA, 18 bp, Artificial Sequence
  Synthetic DNA
taaacagcctcaaaatag

SEQ ID NO: 62501 - DNA, 18 bp, Artificial Sequence
  Synthetic DNA
taaacatactctcgattg

SEQ ID NO: 62502 - DNA, 18 bp, Artificial Sequence
  Synthetic DNA
taaaccaacactttttag

SEQ ID NO: 62503 - DNA, 18 bp, Artificial Sequence
  Synthetic DNA
taaaccgactctcttttg

SEQ ID NO: 62504 - DNA, 18 bp, Artificial Sequence
  Synthetic DNA
taaaccgattctgaatag

SEQ ID NO: 62505 - DNA, 18 bp, Artificial Sequence
  Synthetic DNA
taaaccgccacactaatg

SEQ ID NO: 62506 - DNA, 18 bp, Artificial Sequence
  Synthetic DNA
taaaccgtatctcaaaag

SEQ ID NO: 62507 - DNA, 18 bp, Artificial Sequence
  Synthetic DNA
taaaccgtctcgctgtag

SEQ ID NO: 62508 - DNA, 18 bp, Artificial Sequence
  Synthetic DNA
taaacctacaaacaatag

SEQ ID NO: 62509 - DNA, 18 bp, Artificial Sequence
  Synthetic DNA
taaacggactatctaaag

SEQ ID NO: 62510 - DNA, 18 bp, Artificial Sequence
  Synthetic DNA
taaagaaattcacgatag

SEQ ID NO: 62511 - DNA, 18 bp, Artificial Sequence
  Synthetic DNA
taaagatattcactaagg

SEQ ID NO: 62512 - DNA, 18 bp, Artificial Sequence
  Synthetic DNA
taaagcgaatgtctgtag

SEQ ID NO: 62513 - DNA, 18 bp, Artificial Sequence
  Synthetic DNA
taaagcgacacaatttag

SEQ ID NO: 62514 - DNA, 18 bp, Artificial Sequence
  Synthetic DNA
taaagcgattatccattg

SEQ ID NO: 62515 - DNA, 18 bp, Artificial Sequence
  Synthetic DNA
taaagcgtctctgtaaag

SEQ ID NO: 62516 - DNA, 18 bp, Artificial Sequence
  Synthetic DNA
taaagcgtttcaacagag

SEQ ID NO: 62517 - DNA, 18 bp, Artificial Sequence
  Synthetic DNA
taaagggatatactctag

SEQ ID NO: 62518 - DNA, 18 bp, Artificial Sequence
  Synthetic DNA
taaagtgactctcaattg

SEQ ID NO: 62519 - DNA, 18 bp, Artificial Sequence
  Synthetic DNA
taaataaaaacactatag

SEQ ID NO: 62520 - DNA, 18 bp, Artificial Sequence
  Synthetic DNA
taaatagacgtaatttag

SEQ ID NO: 62521 - DNA, 18 bp, Artificial Sequence
  Synthetic DNA
taaataggcactcttttg

SEQ ID NO: 62522 - DNA, 18 bp, Artificial Sequence
  Synthetic DNA
taaatcaactatcaaaag

SEQ ID NO: 62523 - DNA, 18 bp, Artificial Sequence
  Synthetic DNA
taaatcatctcacaaaag

SEQ ID NO: 62524 - DNA, 18 bp, Artificial Sequence
  Synthetic DNA
taaatcctatctctatag

SEQ ID NO: 62525 - DNA, 18 bp, Artificial Sequence
  Synthetic DNA
taaatcgaaacatttctg

SEQ ID NO: 62526 - DNA, 18 bp, Artificial Sequence
  Synthetic DNA
taaatcgaatcacttcag

SEQ ID NO: 62527 - DNA, 18 bp, Artificial Sequence
  Synthetic DNA
taaatcgacaccctttag

SEQ ID NO: 62528 - DNA, 18 bp, Artificial Sequence
  Synthetic DNA
taaatcgactccattttg

SEQ ID NO: 62529 - DNA, 18 bp, Artificial Sequence
  Synthetic DNA
taaatcgacttaccttag

SEQ ID NO: 62530 - DNA, 18 bp, Artificial Sequence
  Synthetic DNA
taaatcgatagaatatag

SEQ ID NO: 62531 - DNA, 18 bp, Artificial Sequence
  Synthetic DNA
taaatcgccaaactatcg

SEQ ID NO: 62532 - DNA, 18 bp, Artificial Sequence
  Synthetic DNA
taaatcgcctctcaagag

SEQ ID NO: 62533 - DNA, 18 bp, Artificial Sequence
  Synthetic DNA
taaatcgtccccctaacg

SEQ ID NO: 62534 - DNA, 18 bp, Artificial Sequence
  Synthetic DNA
taaatcgtcccttgatag

SEQ ID NO: 62535 - DNA, 18 bp, Artificial Sequence
  Synthetic DNA
taaatcgtctctctctag

SEQ ID NO: 62536 - DNA, 18 bp, Artificial Sequence
  Synthetic DNA
taaatctagacactatag

SEQ ID NO: 62537 - DNA, 18 bp, Artificial Sequence
  Synthetic DNA
taaatctctacaatttag

SEQ ID NO: 62538 - DNA, 18 bp, Artificial Sequence
  Synthetic DNA
taaatgaccagactttgg

SEQ ID NO: 62539 - DNA, 18 bp, Artificial Sequence
  Synthetic DNA
taaatggtttcactatag

SEQ ID NO: 62540 - DNA, 18 bp, Artificial Sequence
  Synthetic DNA
taaattcactcacttaag

SEQ ID NO: 62541 - DNA, 18 bp, Artificial Sequence
  Synthetic DNA
taaattgactttctttag

SEQ ID NO: 62542 - DNA, 18 bp, Artificial Sequence
  Synthetic DNA
taacaaaattccttaaag

SEQ ID NO: 62543 - DNA, 18 bp, Artificial Sequence
  Synthetic DNA
taacaaggtggattattg

SEQ ID NO: 62544 - DNA, 18 bp, Artificial Sequence
  Synthetic DNA
taacaataatcaataagg

SEQ ID NO: 62545 - DNA, 18 bp, Artificial Sequence
  Synthetic DNA
taacacaacacacaatgg

SEQ ID NO: 62546 - DNA, 18 bp, Artificial Sequence
  Synthetic DNA
taacacaacacaccagag

SEQ ID NO: 62547 - DNA, 18 bp, Artificial Sequence
  Synthetic DNA
taacacaacacacgttag

SEQ ID NO: 62548 - DNA, 18 bp, Artificial Sequence
  Synthetic DNA
taacacctttcattatcg

SEQ ID NO: 62549 - DNA, 18 bp, Artificial Sequence
  Synthetic DNA
taacacgaatcatggatg

SEQ ID NO: 62550 - DNA, 18 bp, Artificial Sequence
  Synthetic DNA
taacacgacacagcaaag

SEQ ID NO: 62551 - DNA, 18 bp, Artificial Sequence
  Synthetic DNA
taacacgaccacctctag

SEQ ID NO: 62552 - DNA, 18 bp, Artificial Sequence
  Synthetic DNA
taacacgaccctttatcg

SEQ ID NO: 62553 - DNA, 18 bp, Artificial Sequence
  Synthetic DNA
taacacgaccgcttatag

SEQ ID NO: 62554 - DNA, 18 bp, Artificial Sequence
  Synthetic DNA
taacacgactcacatatg

SEQ ID NO: 62555 - DNA, 18 bp, Artificial Sequence
  Synthetic DNA
taacacgactcgcatgag

SEQ ID NO: 62556 - DNA, 18 bp, Artificial Sequence
  Synthetic DNA
taacacgagttacaacag

SEQ ID NO: 62557 - DNA, 18 bp, Artificial Sequence
  Synthetic DNA
taacacgatatactaaag

SEQ ID NO: 62558 - DNA, 18 bp, Artificial Sequence
  Synthetic DNA
taacacgattcacttacg

SEQ ID NO: 62559 - DNA, 18 bp, Artificial Sequence
  Synthetic DNA
taacacgcctttgcaaag

SEQ ID NO: 62560 - DNA, 18 bp, Artificial Sequence
  Synthetic DNA
taacacgcgccactaatg

SEQ ID NO: 62561 - DNA, 18 bp, Artificial Sequence
  Synthetic DNA
taacacggttcaacatag

SEQ ID NO: 62562 - DNA, 18 bp, Artificial Sequence
  Synthetic DNA
taacacgtatccttgtag

SEQ ID NO: 62563 - DNA, 18 bp, Artificial Sequence
  Synthetic DNA
taacacgtcattctatag

SEQ ID NO: 62564 - DNA, 18 bp, Artificial Sequence
  Synthetic DNA
taacacgtcgcatttaag

SEQ ID NO: 62565 - DNA, 18 bp, Artificial Sequence
  Synthetic DNA
taacacgtcttattaaag

SEQ ID NO: 62566 - DNA, 18 bp, Artificial Sequence
  Synthetic DNA
taacacgttacactatcg

SEQ ID NO: 62567 - DNA, 18 bp, Artificial Sequence
  Synthetic DNA
taacacgttgcattacag

SEQ ID NO: 62568 - DNA, 18 bp, Artificial Sequence
  Synthetic DNA
taacactactcacatttg

SEQ ID NO: 62569 - DNA, 18 bp, Artificial Sequence
  Synthetic DNA
taacactattgcgcattg

SEQ ID NO: 62570 - DNA, 18 bp, Artificial Sequence
  Synthetic DNA
taacactcgttactttag

SEQ ID NO: 62571 - DNA, 18 bp, Artificial Sequence
  Synthetic DNA
taacactgtttactatag

SEQ ID NO: 62572 - DNA, 18 bp, Artificial Sequence
  Synthetic DNA
taacacttctcacttcag

SEQ ID NO: 62573 - DNA, 18 bp, Artificial Sequence
  Synthetic DNA
taacacttctcattctag

SEQ ID NO: 62574 - DNA, 18 bp, Artificial Sequence
  Synthetic DNA
taacagatctcactttag

SEQ ID NO: 62575 - DNA, 18 bp, Artificial Sequence
  Synthetic DNA
taacaggacatcctaaag

SEQ ID NO: 62576 - DNA, 18 bp, Artificial Sequence
  Synthetic DNA
taacaggccacactttag

SEQ ID NO: 62577 - DNA, 18 bp, Artificial Sequence
  Synthetic DNA
taacagtactctctattg

SEQ ID NO: 62578 - DNA, 18 bp, Artificial Sequence
  Synthetic DNA
taacatgacgcacattag

SEQ ID NO: 62579 - DNA, 18 bp, Artificial Sequence
  Synthetic DNA
taacccaactcactaatg

SEQ ID NO: 62580 - DNA, 18 bp, Artificial Sequence
  Synthetic DNA
taaccccaatcacaacag

SEQ ID NO: 62581 - DNA, 18 bp, Artificial Sequence
  Synthetic DNA
taacgcaatatcctattg

SEQ ID NO: 62582 - DNA, 18 bp, Artificial Sequence
  Synthetic DNA
taacgcccctcactgtag

SEQ ID NO: 62583 - DNA, 18 bp, Artificial Sequence
  Synthetic DNA
taacgcgccaccctatcg

SEQ ID NO: 62584 - DNA, 18 bp, Artificial Sequence
  Synthetic DNA
taacgttccacactattg

SEQ ID NO: 62585 - DNA, 18 bp, Artificial Sequence
  Synthetic DNA
taactcaagtctctatag

SEQ ID NO: 62586 - DNA, 18 bp, Artificial Sequence
  Synthetic DNA
taactcagttcacttttg

SEQ ID NO: 62587 - DNA, 18 bp, Artificial Sequence
  Synthetic DNA
taactccacaatttttag

SEQ ID NO: 62588 - DNA, 18 bp, Artificial Sequence
  Synthetic DNA
taactccactcactttcg

SEQ ID NO: 62589 - DNA, 18 bp, Artificial Sequence
  Synthetic DNA
taactcgactcgccacag

SEQ ID NO: 62590 - DNA, 18 bp, Artificial Sequence
  Synthetic DNA
taactcgactttctattg

SEQ ID NO: 62591 - DNA, 18 bp, Artificial Sequence
  Synthetic DNA
taactcgtctcacttaag

SEQ ID NO: 62592 - DNA, 18 bp, Artificial Sequence
  Synthetic DNA
taactctactttctttag

SEQ ID NO: 62593 - DNA, 18 bp, Artificial Sequence
  Synthetic DNA
taacttgactctctattg

SEQ ID NO: 62594 - DNA, 18 bp, Artificial Sequence
  Synthetic DNA
taacttgactgaatagag

SEQ ID NO: 62595 - DNA, 18 bp, Artificial Sequence
  Synthetic DNA
taacttgcctcactattg

SEQ ID NO: 62596 - DNA, 18 bp, Artificial Sequence
  Synthetic DNA
taagaaggcacattaaag

SEQ ID NO: 62597 - DNA, 18 bp, Artificial Sequence
  Synthetic DNA
taagacaactctataaag

SEQ ID NO: 62598 - DNA, 18 bp, Artificial Sequence
  Synthetic DNA
taagaccaattactaatg

SEQ ID NO: 62599 - DNA, 18 bp, Artificial Sequence
  Synthetic DNA
taagacgacaaactttcg

SEQ ID NO: 62600 - DNA, 18 bp, Artificial Sequence
  Synthetic DNA
taagacgacaacacaacg

SEQ ID NO: 62601 - DNA, 18 bp, Artificial Sequence
  Synthetic DNA
taagacgcttgactttag

SEQ ID NO: 62602 - DNA, 18 bp, Artificial Sequence
  Synthetic DNA
taagacggcttacttcag

SEQ ID NO: 62603 - DNA, 18 bp, Artificial Sequence
  Synthetic DNA
taagacgtgactctattg

SEQ ID NO: 62604 - DNA, 18 bp, Artificial Sequence
  Synthetic DNA
taagacgtgtcactctcg

SEQ ID NO: 62605 - DNA, 18 bp, Artificial Sequence
  Synthetic DNA
taagactacaccctattg

SEQ ID NO: 62606 - DNA, 18 bp, Artificial Sequence
  Synthetic DNA
taagactcttcattattg

SEQ ID NO: 62607 - DNA, 18 bp, Artificial Sequence
  Synthetic DNA
taagaggatttattaaag

SEQ ID NO: 62608 - DNA, 18 bp, Artificial Sequence
  Synthetic DNA
taagatgacaagctatag

SEQ ID NO: 62609 - DNA, 18 bp, Artificial Sequence
  Synthetic DNA
taagatgactggcattag

SEQ ID NO: 62610 - DNA, 18 bp, Artificial Sequence
  Synthetic DNA
taaggcgactctctaatg

SEQ ID NO: 62611 - DNA, 18 bp, Artificial Sequence
  Synthetic DNA
taagtagactcattggag

SEQ ID NO: 62612 - DNA, 18 bp, Artificial Sequence
  Synthetic DNA
taagtcaacaaacaatag

SEQ ID NO: 62613 - DNA, 18 bp, Artificial Sequence
  Synthetic DNA
taagtccactcttaacag

SEQ ID NO: 62614 - DNA, 18 bp, Artificial Sequence
  Synthetic DNA
taagtcgagtcactgcag

SEQ ID NO: 62615 - DNA, 18 bp, Artificial Sequence
  Synthetic DNA
taagtctccacacaattg

SEQ ID NO: 62616 - DNA, 18 bp, Artificial Sequence
  Synthetic DNA
taagttgacactctgtag

SEQ ID NO: 62617 - DNA, 18 bp, Artificial Sequence
  Synthetic DNA
taataaaacactctattg

SEQ ID NO: 62618 - DNA, 18 bp, Artificial Sequence
  Synthetic DNA
taataaaactagcttttg

SEQ ID NO: 62619 - DNA, 18 bp, Artificial Sequence
  Synthetic DNA
taataaaactctcttaag

SEQ ID NO: 62620 - DNA, 18 bp, Artificial Sequence
  Synthetic DNA
taataaaatgctctattg

SEQ ID NO: 62621 - DNA, 18 bp, Artificial Sequence
  Synthetic DNA
taataaaatttattctag

SEQ ID NO: 62622 - DNA, 18 bp, Artificial Sequence
  Synthetic DNA
taataaatataacaagag

SEQ ID NO: 62623 - DNA, 18 bp, Artificial Sequence
  Synthetic DNA
taataaatctgtctatag

SEQ ID NO: 62624 - DNA, 18 bp, Artificial Sequence
  Synthetic DNA
taataacactttatatcg

SEQ ID NO: 62625 - DNA, 18 bp, Artificial Sequence
  Synthetic DNA
taataacatcatttatag

SEQ ID NO: 62626 - DNA, 18 bp, Artificial Sequence
  Synthetic DNA
taataactctccttattg

SEQ ID NO: 62627 - DNA, 18 bp, Artificial Sequence
  Synthetic DNA
taataagacacacagttg

SEQ ID NO: 62628 - DNA, 18 bp, Artificial Sequence
  Synthetic DNA
taataagacccacaactg

SEQ ID NO: 62629 - DNA, 18 bp, Artificial Sequence
  Synthetic DNA
taataagacttaattttg

SEQ ID NO: 62630 - DNA, 18 bp, Artificial Sequence
  Synthetic DNA
taataagccaatcggtag

SEQ ID NO: 62631 - DNA, 18 bp, Artificial Sequence
  Synthetic DNA
taataaggtactctattg

SEQ ID NO: 62632 - DNA, 18 bp, Artificial Sequence
  Synthetic DNA
taataaggttgtcttaag

SEQ ID NO: 62633 - DNA, 18 bp, Artificial Sequence
  Synthetic DNA
taataagtaacacctaag

SEQ ID NO: 62634 - DNA, 18 bp, Artificial Sequence
  Synthetic DNA
taataagtcttactaagg

SEQ ID NO: 62635 - DNA, 18 bp, Artificial Sequence
  Synthetic DNA
taataagtgtctctatgg

SEQ ID NO: 62636 - DNA, 18 bp, Artificial Sequence
  Synthetic DNA
taataatactcttattag

SEQ ID NO: 62637 - DNA, 18 bp, Artificial Sequence
  Synthetic DNA
taatacaacacacttacg

SEQ ID NO: 62638 - DNA, 18 bp, Artificial Sequence
  Synthetic DNA
taatacaacactgtaaag

SEQ ID NO: 62639 - DNA, 18 bp, Artificial Sequence
  Synthetic DNA
taatacaacatacaattg

SEQ ID NO: 62640 - DNA, 18 bp, Artificial Sequence
  Synthetic DNA
taatacaacgctcttttg

SEQ ID NO: 62641 - DNA, 18 bp, Artificial Sequence
  Synthetic DNA
taatacaactccaattag

SEQ ID NO: 62642 - DNA, 18 bp, Artificial Sequence
  Synthetic DNA
taatacaatacaaaatgg

SEQ ID NO: 62643 - DNA, 18 bp, Artificial Sequence
  Synthetic DNA
taatacaattctaaaaag

SEQ ID NO: 62644 - DNA, 18 bp, Artificial Sequence
  Synthetic DNA
taatacaattctctcaag

SEQ ID NO: 62645 - DNA, 18 bp, Artificial Sequence
  Synthetic DNA
taatacacatcaatttag

SEQ ID NO: 62646 - DNA, 18 bp, Artificial Sequence
  Synthetic DNA
taatacaccactctaggg

SEQ ID NO: 62647 - DNA, 18 bp, Artificial Sequence
  Synthetic DNA
taatacacctctctgttg

SEQ ID NO: 62648 - DNA, 18 bp, Artificial Sequence
  Synthetic DNA
taatacacgtcataacag

SEQ ID NO: 62649 - DNA, 18 bp, Artificial Sequence
  Synthetic DNA
taatacagccccgtttag

SEQ ID NO: 62650 - DNA, 18 bp, Artificial Sequence
  Synthetic DNA
taatacagccctcaatag

SEQ ID NO: 62651 - DNA, 18 bp, Artificial Sequence
  Synthetic DNA
taatacagctctttttag

SEQ ID NO: 62652 - DNA, 18 bp, Artificial Sequence
  Synthetic DNA
taatacagtccactttag

SEQ ID NO: 62653 - DNA, 18 bp, Artificial Sequence
  Synthetic DNA
taatacatcacacgttag

SEQ ID NO: 62654 - DNA, 18 bp, Artificial Sequence
  Synthetic DNA
taatacatcacacttcag

SEQ ID NO: 62655 - DNA, 18 bp, Artificial Sequence
  Synthetic DNA
taatacatcccgcagtag

SEQ ID NO: 62656 - DNA, 18 bp, Artificial Sequence
  Synthetic DNA
taatacatctatctacag

SEQ ID NO: 62657 - DNA, 18 bp, Artificial Sequence
  Synthetic DNA
taatacatgtcattacag

SEQ ID NO: 62658 - DNA, 18 bp, Artificial Sequence
  Synthetic DNA
taatacatgtcgctgtag

SEQ ID NO: 62659 - DNA, 18 bp, Artificial Sequence
  Synthetic DNA
taatacattatactattg

SEQ ID NO: 62660 - DNA, 18 bp, Artificial Sequence
  Synthetic DNA
taataccaatctaaatag

SEQ ID NO: 62661 - DNA, 18 bp, Artificial Sequence
  Synthetic DNA
taataccactaacacaag

SEQ ID NO: 62662 - DNA, 18 bp, Artificial Sequence
  Synthetic DNA
taataccactcatgtatg

SEQ ID NO: 62663 - DNA, 18 bp, Artificial Sequence
  Synthetic DNA
taataccactcgcagttg

SEQ ID NO: 62664 - DNA, 18 bp, Artificial Sequence
  Synthetic DNA
taataccactgaacttag

SEQ ID NO: 62665 - DNA, 18 bp, Artificial Sequence
  Synthetic DNA
taataccattcccaattg

SEQ ID NO: 62666 - DNA, 18 bp, Artificial Sequence
  Synthetic DNA
taataccgatcactcttg

SEQ ID NO: 62667 - DNA, 18 bp, Artificial Sequence
  Synthetic DNA
taatacctctccttgtag

SEQ ID NO: 62668 - DNA, 18 bp, Artificial Sequence
  Synthetic DNA
taatacctcttactaatg

SEQ ID NO: 62669 - DNA, 18 bp, Artificial Sequence
  Synthetic DNA
taatacgaaagtctacag

SEQ ID NO: 62670 - DNA, 18 bp, Artificial Sequence
  Synthetic DNA
taatacgaatgtctgaag

SEQ ID NO: 62671 - DNA, 18 bp, Artificial Sequence
  Synthetic DNA
taatacgacaaacatctg

SEQ ID NO: 62672 - DNA, 18 bp, Artificial Sequence
  Synthetic DNA
taatacgacactaagatg

SEQ ID NO: 62673 - DNA, 18 bp, Artificial Sequence
  Synthetic DNA
taatacgacactcctttg

SEQ ID NO: 62674 - DNA, 18 bp, Artificial Sequence
  Synthetic DNA
taatacgaccctcgaatg

SEQ ID NO: 62675 - DNA, 18 bp, Artificial Sequence
  Synthetic DNA
taatacgactaataaatg

SEQ ID NO: 62676 - DNA, 18 bp, Artificial Sequence
  Synthetic DNA
taatacgactaccggaag

SEQ ID NO: 62677 - DNA, 18 bp, Artificial Sequence
  Synthetic DNA
taatacgactcaactgtg

SEQ ID NO: 62678 - DNA, 18 bp, Artificial Sequence
  Synthetic DNA
taatacgactcccatgcg

SEQ ID NO: 62679 - DNA, 18 bp, Artificial Sequence
  Synthetic DNA
taatacgactctgcggag

SEQ ID NO: 62680 - DNA, 18 bp, Artificial Sequence
  Synthetic DNA
taatacgacttacatctg

SEQ ID NO: 62681 - DNA, 18 bp, Artificial Sequence
  Synthetic DNA
taatacgactttaaattg

SEQ ID NO: 62682 - DNA, 18 bp, Artificial Sequence
  Synthetic DNA
taatacgacttttttaag

SEQ ID NO: 62683 - DNA, 18 bp, Artificial Sequence
  Synthetic DNA
taatacgagtctgttagg

SEQ ID NO: 62684 - DNA, 18 bp, Artificial Sequence
  Synthetic DNA
taatacgagttaataatg

SEQ ID NO: 62685 - DNA, 18 bp, Artificial Sequence
  Synthetic DNA
taatacgatacacattgg

SEQ ID NO: 62686 - DNA, 18 bp, Artificial Sequence
  Synthetic DNA
taatacgatatctttgag

SEQ ID NO: 62687 - DNA, 18 bp, Artificial Sequence
  Synthetic DNA
taatacgatatttcaaag

SEQ ID NO: 62688 - DNA, 18 bp, Artificial Sequence
  Synthetic DNA
taatacgattatatattg

SEQ ID NO: 62689 - DNA, 18 bp, Artificial Sequence
  Synthetic DNA
taatacgattatttacag

SEQ ID NO: 62690 - DNA, 18 bp, Artificial Sequence
  Synthetic DNA
taatacgattcctcttag

SEQ ID NO: 62691 - DNA, 18 bp, Artificial Sequence
  Synthetic DNA
taatacgattttctaatg

SEQ ID NO: 62692 - DNA, 18 bp, Artificial Sequence
  Synthetic DNA
taatacgattttttattg

SEQ ID NO: 62693 - DNA, 18 bp, Artificial Sequence
  Synthetic DNA
taatacgcaacactaacg

SEQ ID NO: 62694 - DNA, 18 bp, Artificial Sequence
  Synthetic DNA
taatacgccaagacatag

SEQ ID NO: 62695 - DNA, 18 bp, Artificial Sequence
  Synthetic DNA
taatacgccccacacaag

SEQ ID NO: 62696 - DNA, 18 bp, Artificial Sequence
  Synthetic DNA
taatacgcccggctcaag

SEQ ID NO: 62697 - DNA, 18 bp, Artificial Sequence
  Synthetic DNA
taatacgctccacttttg

SEQ ID NO: 62698 - DNA, 18 bp, Artificial Sequence
  Synthetic DNA
taatacggcacagttttg

SEQ ID NO: 62699 - DNA, 18 bp, Artificial Sequence
  Synthetic DNA
taatacgggacaaaaaag

SEQ ID NO: 62700 - DNA, 18 bp, Artificial Sequence
  Synthetic DNA
taatacgggacatcatgg

SEQ ID NO: 62701 - DNA, 18 bp, Artificial Sequence
  Synthetic DNA
taatacgtaaaacttttg

SEQ ID NO: 62702 - DNA, 18 bp, Artificial Sequence
  Synthetic DNA
taatacgtaatatttagg

SEQ ID NO: 62703 - DNA, 18 bp, Artificial Sequence
  Synthetic DNA
taatacgtataactccag

SEQ ID NO: 62704 - DNA, 18 bp, Artificial Sequence
  Synthetic DNA
taatacgtatcatatttg

SEQ ID NO: 62705 - DNA, 18 bp, Artificial Sequence
  Synthetic DNA
taatacgtatttgtttag

SEQ ID NO: 62706 - DNA, 18 bp, Artificial Sequence
  Synthetic DNA
taatacgtcatagtttag

SEQ ID NO: 62707 - DNA, 18 bp, Artificial Sequence
  Synthetic DNA
taatacgtcgcagttcag

SEQ ID NO: 62708 - DNA, 18 bp, Artificial Sequence
  Synthetic DNA
taatacgtctaaataacg

SEQ ID NO: 62709 - DNA, 18 bp, Artificial Sequence
  Synthetic DNA
taatacgtctatccataa

SEQ ID NO: 62710 - DNA, 18 bp, Artificial Sequence
  Synthetic DNA
taatacgtctctcagaag

SEQ ID NO: 62711 - DNA, 18 bp, Artificial Sequence
  Synthetic DNA
taatacgtctcttttttg

SEQ ID NO: 62712 - DNA, 18 bp, Artificial Sequence
  Synthetic DNA
taatacgtctttcaaaag

SEQ ID NO: 62713 - DNA, 18 bp, Artificial Sequence
  Synthetic DNA
taatacgtgcctcaaaag

SEQ ID NO: 62714 - DNA, 18 bp, Artificial Sequence
  Synthetic DNA
taatacgtgcctctaatg

SEQ ID NO: 62715 - DNA, 18 bp, Artificial Sequence
  Synthetic DNA
taatacgtgtaataatag

SEQ ID NO: 62716 - DNA, 18 bp, Artificial Sequence
  Synthetic DNA
taatacgtgtcagttttg

SEQ ID NO: 62717 - DNA, 18 bp, Artificial Sequence
  Synthetic DNA
taatacgttccaataaag

SEQ ID NO: 62718 - DNA, 18 bp, Artificial Sequence
  Synthetic DNA
taatacgttccacttttg

SEQ ID NO: 62719 - DNA, 18 bp, Artificial Sequence
  Synthetic DNA
taatacgtttaacaagag

SEQ ID NO: 62720 - DNA, 18 bp, Artificial Sequence
  Synthetic DNA
taatacgtttcaatcttg

SEQ ID NO: 62721 - DNA, 18 bp, Artificial Sequence
  Synthetic DNA
taatacgtttgccttaag

SEQ ID NO: 62722 - DNA, 18 bp, Artificial Sequence
  Synthetic DNA
taatactaatcccttcag

SEQ ID NO: 62723 - DNA, 18 bp, Artificial Sequence
  Synthetic DNA
taatactaatctgtattg

SEQ ID NO: 62724 - DNA, 18 bp, Artificial Sequence
  Synthetic DNA
taatactacatacccggg

SEQ ID NO: 62725 - DNA, 18 bp, Artificial Sequence
  Synthetic DNA
taatactacctaccaaag

SEQ ID NO: 62726 - DNA, 18 bp, Artificial Sequence
  Synthetic DNA
taatactacttagccttg

SEQ ID NO: 62727 - DNA, 18 bp, Artificial Sequence
  Synthetic DNA
taatactagacaagatag

SEQ ID NO: 62728 - DNA, 18 bp, Artificial Sequence
  Synthetic DNA
taatactagtaaaaatcg

SEQ ID NO: 62729 - DNA, 18 bp, Artificial Sequence
  Synthetic DNA
taatactagtcaccttgg

SEQ ID NO: 62730 - DNA, 18 bp, Artificial Sequence
  Synthetic DNA
taatactatactcttaag

SEQ ID NO: 62731 - DNA, 18 bp, Artificial Sequence
  Synthetic DNA
taatactgcacaaaatag

SEQ ID NO: 62732 - DNA, 18 bp, Artificial Sequence
  Synthetic DNA
taatactgctcgctttgg

SEQ ID NO: 62733 - DNA, 18 bp, Artificial Sequence
  Synthetic DNA
taatactggtcacactag

SEQ ID NO: 62734 - DNA, 18 bp, Artificial Sequence
  Synthetic DNA
taatacttcataatatag

SEQ ID NO: 62735 - DNA, 18 bp, Artificial Sequence
  Synthetic DNA
taatacttcccactgaag

SEQ ID NO: 62736 - DNA, 18 bp, Artificial Sequence
  Synthetic DNA
taatacttcttacaaagg

SEQ ID NO: 62737 - DNA, 18 bp, Artificial Sequence
  Synthetic DNA
taatagaccaaagtatcg

SEQ ID NO: 62738 - DNA, 18 bp, Artificial Sequence
  Synthetic DNA
taatagcattgtcgttag

SEQ ID NO: 62739 - DNA, 18 bp, Artificial Sequence
  Synthetic DNA
taataggacactatattg

SEQ ID NO: 62740 - DNA, 18 bp, Artificial Sequence
  Synthetic DNA
taataggaccctcttttg

SEQ ID NO: 62741 - DNA, 18 bp, Artificial Sequence
  Synthetic DNA
taataggagtaactcttg

SEQ ID NO: 62742 - DNA, 18 bp, Artificial Sequence
  Synthetic DNA
taataggagtcgcattag

SEQ ID NO: 62743 - DNA, 18 bp, Artificial Sequence
  Synthetic DNA
taatagtacacaatctag

SEQ ID NO: 62744 - DNA, 18 bp, Artificial Sequence
  Synthetic DNA
taatagttcttactactg

SEQ ID NO: 62745 - DNA, 18 bp, Artificial Sequence
  Synthetic DNA
taatataaatctctcttg

SEQ ID NO: 62746 - DNA, 18 bp, Artificial Sequence
  Synthetic DNA
taatataacccaccgtag

SEQ ID NO: 62747 - DNA, 18 bp, Artificial Sequence
  Synthetic DNA
taatataacttaattaag

SEQ ID NO: 62748 - DNA, 18 bp, Artificial Sequence
  Synthetic DNA
taatataattcacaattg

SEQ ID NO: 62749 - DNA, 18 bp, Artificial Sequence
  Synthetic DNA
taatatacatcaccacag

SEQ ID NO: 62750 - DNA, 18 bp, Artificial Sequence
  Synthetic DNA
taatataccgcaaaatcg

SEQ ID NO: 62751 - DNA, 18 bp, Artificial Sequence
  Synthetic DNA
taatatatctcataacag

SEQ ID NO: 62752 - DNA, 18 bp, Artificial Sequence
  Synthetic DNA
taatatcacttactaagg

SEQ ID NO: 62753 - DNA, 18 bp, Artificial Sequence
  Synthetic DNA
taatatctatcactattg

SEQ ID NO: 62754 - DNA, 18 bp, Artificial Sequence
  Synthetic DNA
taatatgaaacacaacag

SEQ ID NO: 62755 - DNA, 18 bp, Artificial Sequence
  Synthetic DNA
taatatgacaatcattag

SEQ ID NO: 62756 - DNA, 18 bp, Artificial Sequence
  Synthetic DNA
taatatgactaatttttg

SEQ ID NO: 62757 - DNA, 18 bp, Artificial Sequence
  Synthetic DNA
taatatgactcattgatg

SEQ ID NO: 62758 - DNA, 18 bp, Artificial Sequence
  Synthetic DNA
taatatgactcatttctg

SEQ ID NO: 62759 - DNA, 18 bp, Artificial Sequence
  Synthetic DNA
taatatgactttcatttg

SEQ ID NO: 62760 - DNA, 18 bp, Artificial Sequence
  Synthetic DNA
taatatgatttactagtg

SEQ ID NO: 62761 - DNA, 18 bp, Artificial Sequence
  Synthetic DNA
taatatgcctaatttaag

SEQ ID NO: 62762 - DNA, 18 bp, Artificial Sequence
  Synthetic DNA
taatatgcctcaaaaaag

SEQ ID NO: 62763 - DNA, 18 bp, Artificial Sequence
  Synthetic DNA
taatatggcacaaaatcg

SEQ ID NO: 62764 - DNA, 18 bp, Artificial Sequence
  Synthetic DNA
taatatggcacaaattag

SEQ ID NO: 62765 - DNA, 18 bp, Artificial Sequence
  Synthetic DNA
taatatggccccctctag

SEQ ID NO: 62766 - DNA, 18 bp, Artificial Sequence
  Synthetic DNA
taatatggccctcaattg

SEQ ID NO: 62767 - DNA, 18 bp, Artificial Sequence
  Synthetic DNA
taatatgtccgactttag

SEQ ID NO: 62768 - DNA, 18 bp, Artificial Sequence
  Synthetic DNA
taatatgtgccactctag

SEQ ID NO: 62769 - DNA, 18 bp, Artificial Sequence
  Synthetic DNA
taatattactaacaacag

SEQ ID NO: 62770 - DNA, 18 bp, Artificial Sequence
  Synthetic DNA
taatattactctaagtag

SEQ ID NO: 62771 - DNA, 18 bp, Artificial Sequence
  Synthetic DNA
taatcagacagactaatg

SEQ ID NO: 62772 - DNA, 18 bp, Artificial Sequence
  Synthetic DNA
taatcagtcacactatgg

SEQ ID NO: 62773 - DNA, 18 bp, Artificial Sequence
  Synthetic DNA
taatcataatcattatag

SEQ ID NO: 62774 - DNA, 18 bp, Artificial Sequence
  Synthetic DNA
taatcattatcagcatag

SEQ ID NO: 62775 - DNA, 18 bp, Artificial Sequence
  Synthetic DNA
taatccaactaactacgg

SEQ ID NO: 62776 - DNA, 18 bp, Artificial Sequence
  Synthetic DNA
taatccatcccacaattg

SEQ ID NO: 62777 - DNA, 18 bp, Artificial Sequence
  Synthetic DNA
taatccatcccactctcg

SEQ ID NO: 62778 - DNA, 18 bp, Artificial Sequence
  Synthetic DNA
taatccatttctcaatcg

SEQ ID NO: 62779 - DNA, 18 bp, Artificial Sequence
  Synthetic DNA
taatcccacacacaatgg

SEQ ID NO: 62780 - DNA, 18 bp, Artificial Sequence
  Synthetic DNA
taatcccactctcattag

SEQ ID NO: 62781 - DNA, 18 bp, Artificial Sequence
  Synthetic DNA
taatcccactgaatgtag

SEQ ID NO: 62782 - DNA, 18 bp, Artificial Sequence
  Synthetic DNA
taatccgaatttctattg

SEQ ID NO: 62783 - DNA, 18 bp, Artificial Sequence
  Synthetic DNA
taatccgaccctgtatcg

SEQ ID NO: 62784 - DNA, 18 bp, Artificial Sequence
  Synthetic DNA
taatccgcctgactttcg

SEQ ID NO: 62785 - DNA, 18 bp, Artificial Sequence
  Synthetic DNA
taatccgcgtcaatttag

SEQ ID NO: 62786 - DNA, 18 bp, Artificial Sequence
  Synthetic DNA
taatccgtctcagttaag

SEQ ID NO: 62787 - DNA, 18 bp, Artificial Sequence
  Synthetic DNA
taatcctacacaccattg

SEQ ID NO: 62788 - DNA, 18 bp, Artificial Sequence
  Synthetic DNA
taatcctactcatgaaag

SEQ ID NO: 62789 - DNA, 18 bp, Artificial Sequence
  Synthetic DNA
taatcctattaactattg

SEQ ID NO: 62790 - DNA, 18 bp, Artificial Sequence
  Synthetic DNA
taatccttctgtcaatcg

SEQ ID NO: 62791 - DNA, 18 bp, Artificial Sequence
  Synthetic DNA
taatcgcacccactaaag

SEQ ID NO: 62792 - DNA, 18 bp, Artificial Sequence
  Synthetic DNA
taatcggtctttctatag

SEQ ID NO: 62793 - DNA, 18 bp, Artificial Sequence
  Synthetic DNA
taatctagctttctatag

SEQ ID NO: 62794 - DNA, 18 bp, Artificial Sequence
  Synthetic DNA
taatctgagtcactactg

SEQ ID NO: 62795 - DNA, 18 bp, Artificial Sequence
  Synthetic DNA
taatctgtaacatcatag

SEQ ID NO: 62796 - DNA, 18 bp, Artificial Sequence
  Synthetic DNA
taatcttactcaagattg

SEQ ID NO: 62797 - DNA, 18 bp, Artificial Sequence
  Synthetic DNA
taatgacctacacatgag

SEQ ID NO: 62798 - DNA, 18 bp, Artificial Sequence
  Synthetic DNA
taatgcaactctatttag

SEQ ID NO: 62799 - DNA, 18 bp, Artificial Sequence
  Synthetic DNA
taatgcaagtttctatag

SEQ ID NO: 62800 - DNA, 18 bp, Artificial Sequence
  Synthetic DNA
taatgcaattacgtattg

SEQ ID NO: 62801 - DNA, 18 bp, Artificial Sequence
  Synthetic DNA
taatgcacctttctatag

SEQ ID NO: 62802 - DNA, 18 bp, Artificial Sequence
  Synthetic DNA
taatgcagatggctgttg

SEQ ID NO: 62803 - DNA, 18 bp, Artificial Sequence
  Synthetic DNA
taatgcatcttacaattg

SEQ ID NO: 62804 - DNA, 18 bp, Artificial Sequence
  Synthetic DNA
taatgccactatctacag

SEQ ID NO: 62805 - DNA, 18 bp, Artificial Sequence
  Synthetic DNA
taatgccactcaaaaaag

SEQ ID NO: 62806 - DNA, 18 bp, Artificial Sequence
  Synthetic DNA
taatgccacttaatagag

SEQ ID NO: 62807 - DNA, 18 bp, Artificial Sequence
  Synthetic DNA
taatgccagtcacaaaag

SEQ ID NO: 62808 - DNA, 18 bp, Artificial Sequence
  Synthetic DNA
taatgcgaccaactgaag

SEQ ID NO: 62809 - DNA, 18 bp, Artificial Sequence
  Synthetic DNA
taatgcgactatcattag

SEQ ID NO: 62810 - DNA, 18 bp, Artificial Sequence
  Synthetic DNA
taatgcgactctgaaaag

SEQ ID NO: 62811 - DNA, 18 bp, Artificial Sequence
  Synthetic DNA
taatgcgatgccctattg

SEQ ID NO: 62812 - DNA, 18 bp, Artificial Sequence
  Synthetic DNA
taatgcgcctccaaattg

SEQ ID NO: 62813 - DNA, 18 bp, Artificial Sequence
  Synthetic DNA
taatgcgcttcatttaag

SEQ ID NO: 62814 - DNA, 18 bp, Artificial Sequence
  Synthetic DNA
taatgcggacaactaaag

SEQ ID NO: 62815 - DNA, 18 bp, Artificial Sequence
  Synthetic DNA
taatgcggcacaccttag

SEQ ID NO: 62816 - DNA, 18 bp, Artificial Sequence
  Synthetic DNA
taatgcgtaacactgtag

SEQ ID NO: 62817 - DNA, 18 bp, Artificial Sequence
  Synthetic DNA
taatgcgtcacacttctg

SEQ ID NO: 62818 - DNA, 18 bp, Artificial Sequence
  Synthetic DNA
taatgcgtctaccccaag

SEQ ID NO: 62819 - DNA, 18 bp, Artificial Sequence
  Synthetic DNA
taatgcgtctctcttaag

SEQ ID NO: 62820 - DNA, 18 bp, Artificial Sequence
  Synthetic DNA
taatgctacaaactattg

SEQ ID NO: 62821 - DNA, 18 bp, Artificial Sequence
  Synthetic DNA
taatgctacttcttttag

SEQ ID NO: 62822 - DNA, 18 bp, Artificial Sequence
  Synthetic DNA
taatgctcctcattctag

SEQ ID NO: 62823 - DNA, 18 bp, Artificial Sequence
  Synthetic DNA
taatgctcctctctctag

SEQ ID NO: 62824 - DNA, 18 bp, Artificial Sequence
  Synthetic DNA
taatgggactctcaaaag

SEQ ID NO: 62825 - DNA, 18 bp, Artificial Sequence
  Synthetic DNA
taatggttgacaatatag

SEQ ID NO: 62826 - DNA, 18 bp, Artificial Sequence
  Synthetic DNA
taattacactatctatag

SEQ ID NO: 62827 - DNA, 18 bp, Artificial Sequence
  Synthetic DNA
taattacactctttattg

SEQ ID NO: 62828 - DNA, 18 bp, Artificial Sequence
  Synthetic DNA
taattactcacactattg

SEQ ID NO: 62829 - DNA, 18 bp, Artificial Sequence
  Synthetic DNA
taattagacatacaaaag

SEQ ID NO: 62830 - DNA, 18 bp, Artificial Sequence
  Synthetic DNA
taattagacgctcataag

SEQ ID NO: 62831 - DNA, 18 bp, Artificial Sequence
  Synthetic DNA
taattagactccctaatg

SEQ ID NO: 62832 - DNA, 18 bp, Artificial Sequence
  Synthetic DNA
taattagactccttctag

SEQ ID NO: 62833 - DNA, 18 bp, Artificial Sequence
  Synthetic DNA
taattagactgactaccg

SEQ ID NO: 62834 - DNA, 18 bp, Artificial Sequence
  Synthetic DNA
taattagacttgttaaag

SEQ ID NO: 62835 - DNA, 18 bp, Artificial Sequence
  Synthetic DNA
taattagatacacaatag

SEQ ID NO: 62836 - DNA, 18 bp, Artificial Sequence
  Synthetic DNA
taattagcctctcatacg

SEQ ID NO: 62837 - DNA, 18 bp, Artificial Sequence
  Synthetic DNA
taattagtctcattagag

SEQ ID NO: 62838 - DNA, 18 bp, Artificial Sequence
  Synthetic DNA
taattattcttactatag

SEQ ID NO: 62839 - DNA, 18 bp, Artificial Sequence
  Synthetic DNA
taattcaacattcaatag

SEQ ID NO: 62840 - DNA, 18 bp, Artificial Sequence
  Synthetic DNA
taattcaactcagattag

SEQ ID NO: 62841 - DNA, 18 bp, Artificial Sequence
  Synthetic DNA
taattcatatcactagag

SEQ ID NO: 62842 - DNA, 18 bp, Artificial Sequence
  Synthetic DNA
taattcatatccctatag

SEQ ID NO: 62843 - DNA, 18 bp, Artificial Sequence
  Synthetic DNA
taattcatcccactatcg

SEQ ID NO: 62844 - DNA, 18 bp, Artificial Sequence
  Synthetic DNA
taattcatctcacattag

SEQ ID NO: 62845 - DNA, 18 bp, Artificial Sequence
  Synthetic DNA
taattcatcttacaattg

SEQ ID NO: 62846 - DNA, 18 bp, Artificial Sequence
  Synthetic DNA
taattccacgttttatag

SEQ ID NO: 62847 - DNA, 18 bp, Artificial Sequence
  Synthetic DNA
taattccactcaaagttg

SEQ ID NO: 62848 - DNA, 18 bp, Artificial Sequence
  Synthetic DNA
taattccactcataaatg

SEQ ID NO: 62849 - DNA, 18 bp, Artificial Sequence
  Synthetic DNA
taattccataaactaaag

SEQ ID NO: 62850 - DNA, 18 bp, Artificial Sequence
  Synthetic DNA
taattccattctcttaag

SEQ ID NO: 62851 - DNA, 18 bp, Artificial Sequence
  Synthetic DNA
taattcgaaataataaag

SEQ ID NO: 62852 - DNA, 18 bp, Artificial Sequence
  Synthetic DNA
taattcgaatagctattg

SEQ ID NO: 62853 - DNA, 18 bp, Artificial Sequence
  Synthetic DNA
taattcgaatccctaagg

SEQ ID NO: 62854 - DNA, 18 bp, Artificial Sequence
  Synthetic DNA
taattcgacacacagttg

SEQ ID NO: 62855 - DNA, 18 bp, Artificial Sequence
  Synthetic DNA
taattcgacaccccattg

SEQ ID NO: 62856 - DNA, 18 bp, Artificial Sequence
  Synthetic DNA
taattcgacacgttaaag

SEQ ID NO: 62857 - DNA, 18 bp, Artificial Sequence
  Synthetic DNA
taattcgacccaatactg

SEQ ID NO: 62858 - DNA, 18 bp, Artificial Sequence
  Synthetic DNA
taattcgacccaccttcg

SEQ ID NO: 62859 - DNA, 18 bp, Artificial Sequence
  Synthetic DNA
taattcgacccattcaag

SEQ ID NO: 62860 - DNA, 18 bp, Artificial Sequence
  Synthetic DNA
taattcgactcaaacagg

SEQ ID NO: 62861 - DNA, 18 bp, Artificial Sequence
  Synthetic DNA
taattcgactcatataag

SEQ ID NO: 62862 - DNA, 18 bp, Artificial Sequence
  Synthetic DNA
taattcgactcgcataag

SEQ ID NO: 62863 - DNA, 18 bp, Artificial Sequence
  Synthetic DNA
taattcgactcgtcttag

SEQ ID NO: 62864 - DNA, 18 bp, Artificial Sequence
  Synthetic DNA
taattcgactctaaaaag

SEQ ID NO: 62865 - DNA, 18 bp, Artificial Sequence
  Synthetic DNA
taattcgacttaaaattg

SEQ ID NO: 62866 - DNA, 18 bp, Artificial Sequence
  Synthetic DNA
taattcgattcatttaag

SEQ ID NO: 62867 - DNA, 18 bp, Artificial Sequence
  Synthetic DNA
taattcgcgtccccatag

SEQ ID NO: 62868 - DNA, 18 bp, Artificial Sequence
  Synthetic DNA
taattcgtaccacaatag

SEQ ID NO: 62869 - DNA, 18 bp, Artificial Sequence
  Synthetic DNA
taattcgtcgatctacag

SEQ ID NO: 62870 - DNA, 18 bp, Artificial Sequence
  Synthetic DNA
taattcgtcttacaaaag

SEQ ID NO: 62871 - DNA, 18 bp, Artificial Sequence
  Synthetic DNA
taattcgtgatactatgg

SEQ ID NO: 62872 - DNA, 18 bp, Artificial Sequence
  Synthetic DNA
taattcgtgtcaaaaatg

SEQ ID NO: 62873 - DNA, 18 bp, Artificial Sequence
  Synthetic DNA
taattcgttgtactttag

SEQ ID NO: 62874 - DNA, 18 bp, Artificial Sequence
  Synthetic DNA
taattcgtttctctctag

SEQ ID NO: 62875 - DNA, 18 bp, Artificial Sequence
  Synthetic DNA
taattctaatccctacag

SEQ ID NO: 62876 - DNA, 18 bp, Artificial Sequence
  Synthetic DNA
taattctactatatacag

SEQ ID NO: 62877 - DNA, 18 bp, Artificial Sequence
  Synthetic DNA
taattctactcacaactg

SEQ ID NO: 62878 - DNA, 18 bp, Artificial Sequence
  Synthetic DNA
taattctactctctttcg

SEQ ID NO: 62879 - DNA, 18 bp, Artificial Sequence
  Synthetic DNA
taattctagttactaatg

SEQ ID NO: 62880 - DNA, 18 bp, Artificial Sequence
  Synthetic DNA
taattctatcattcatag

SEQ ID NO: 62881 - DNA, 18 bp, Artificial Sequence
  Synthetic DNA
taattctatgcactaaag

SEQ ID NO: 62882 - DNA, 18 bp, Artificial Sequence
  Synthetic DNA
taattctattaacaaaag

SEQ ID NO: 62883 - DNA, 18 bp, Artificial Sequence
  Synthetic DNA
taattcttcactctattg

SEQ ID NO: 62884 - DNA, 18 bp, Artificial Sequence
  Synthetic DNA
taattcttcttattatag

SEQ ID NO: 62885 - DNA, 18 bp, Artificial Sequence
  Synthetic DNA
taattggacacaggatag

SEQ ID NO: 62886 - DNA, 18 bp, Artificial Sequence
  Synthetic DNA
taatttaactcaacatag

SEQ ID NO: 62887 - DNA, 18 bp, Artificial Sequence
  Synthetic DNA
taatttaactcaatatcg

SEQ ID NO: 62888 - DNA, 18 bp, Artificial Sequence
  Synthetic DNA
taatttctctcacaatag

SEQ ID NO: 62889 - DNA, 18 bp, Artificial Sequence
  Synthetic DNA
taatttgaatcacaattg

SEQ ID NO: 62890 - DNA, 18 bp, Artificial Sequence
  Synthetic DNA
taatttgacacgcaatag

SEQ ID NO: 62891 - DNA, 18 bp, Artificial Sequence
  Synthetic DNA
taatttgactaagtatcg

SEQ ID NO: 62892 - DNA, 18 bp, Artificial Sequence
  Synthetic DNA
taatttgactcaaagtag

SEQ ID NO: 62893 - DNA, 18 bp, Artificial Sequence
  Synthetic DNA
taatttgcctcgcaatag

SEQ ID NO: 62894 - DNA, 18 bp, Artificial Sequence
  Synthetic DNA
taatttggcttactatgg

SEQ ID NO: 62895 - DNA, 18 bp, Artificial Sequence
  Synthetic DNA
tacaaatactcactcaag

SEQ ID NO: 62896 - DNA, 18 bp, Artificial Sequence
  Synthetic DNA
tacaacaaatgactatag

SEQ ID NO: 62897 - DNA, 18 bp, Artificial Sequence
  Synthetic DNA
tacaacaactctaattag

SEQ ID NO: 62898 - DNA, 18 bp, Artificial Sequence
  Synthetic DNA
tacaacatcacatattcg

SEQ ID NO: 62899 - DNA, 18 bp, Artificial Sequence
  Synthetic DNA
tacaacgactcacatttg

SEQ ID NO: 62900 - DNA, 18 bp, Artificial Sequence
  Synthetic DNA
tacaacgattcacattag

SEQ ID NO: 62901 - DNA, 18 bp, Artificial Sequence
  Synthetic DNA
tacaacgtatctctatag

SEQ ID NO: 62902 - DNA, 18 bp, Artificial Sequence
  Synthetic DNA
tacaacgtttgactttag

SEQ ID NO: 62903 - DNA, 18 bp, Artificial Sequence
  Synthetic DNA
tacaaggactcatactag

SEQ ID NO: 62904 - DNA, 18 bp, Artificial Sequence
  Synthetic DNA
tacaccgcctcaccatag

SEQ ID NO: 62905 - DNA, 18 bp, Artificial Sequence
  Synthetic DNA
tacacctgctcactatag

SEQ ID NO: 62906 - DNA, 18 bp, Artificial Sequence
  Synthetic DNA
tacagcgtctctctatag

SEQ ID NO: 62907 - DNA, 18 bp, Artificial Sequence
  Synthetic DNA
tacatattcacattaatg

SEQ ID NO: 62908 - DNA, 18 bp, Artificial Sequence
  Synthetic DNA
tacatcgattccaaatag

SEQ ID NO: 62909 - DNA, 18 bp, Artificial Sequence
  Synthetic DNA
tacatcgtctctctattg

SEQ ID NO: 62910 - DNA, 18 bp, Artificial Sequence
  Synthetic DNA
taccacaactcaaaatag

SEQ ID NO: 62911 - DNA, 18 bp, Artificial Sequence
  Synthetic DNA
taccacgtttcacaagag

SEQ ID NO: 62912 - DNA, 18 bp, Artificial Sequence
  Synthetic DNA
taccactatttactatag

SEQ ID NO: 62913 - DNA, 18 bp, Artificial Sequence
  Synthetic DNA
tacctcaactcacaattg

SEQ ID NO: 62914 - DNA, 18 bp, Artificial Sequence
  Synthetic DNA
tacctcgactcacttttg

SEQ ID NO: 62915 - DNA, 18 bp, Artificial Sequence
  Synthetic DNA
tacgacgttacactaaag

SEQ ID NO: 62916 - DNA, 18 bp, Artificial Sequence
  Synthetic DNA
tacgattactcaatacag

SEQ ID NO: 62917 - DNA, 18 bp, Artificial Sequence
  Synthetic DNA
tacggagcctccctttag

SEQ ID NO: 62918 - DNA, 18 bp, Artificial Sequence
  Synthetic DNA
tacggctattcactttag

SEQ ID NO: 62919 - DNA, 18 bp, Artificial Sequence
  Synthetic DNA
tactaaaacttagaatag

SEQ ID NO: 62920 - DNA, 18 bp, Artificial Sequence
  Synthetic DNA
tactaaggatcactttag

SEQ ID NO: 62921 - DNA, 18 bp, Artificial Sequence
  Synthetic DNA
tactacaaatcaatttag

SEQ ID NO: 62922 - DNA, 18 bp, Artificial Sequence
  Synthetic DNA
tactacaacaccctgtag

SEQ ID NO: 62923 - DNA, 18 bp, Artificial Sequence
  Synthetic DNA
tactacatgaccatttag

SEQ ID NO: 62924 - DNA, 18 bp, Artificial Sequence
  Synthetic DNA
tactacgaaatattatag

SEQ ID NO: 62925 - DNA, 18 bp, Artificial Sequence
  Synthetic DNA
tactacgaatcatcaaag

SEQ ID NO: 62926 - DNA, 18 bp, Artificial Sequence
  Synthetic DNA
tactacgacatgcaatag

SEQ ID NO: 62927 - DNA, 18 bp, Artificial Sequence
  Synthetic DNA
tactacgaccctccgtag

SEQ ID NO: 62928 - DNA, 18 bp, Artificial Sequence
  Synthetic DNA
tactacgactctcatcgg

SEQ ID NO: 62929 - DNA, 18 bp, Artificial Sequence
  Synthetic DNA
tactacgatccgctacag

SEQ ID NO: 62930 - DNA, 18 bp, Artificial Sequence
  Synthetic DNA
tactacgccagtcattag

SEQ ID NO: 62931 - DNA, 18 bp, Artificial Sequence
  Synthetic DNA
tactacgtcgcaccattg

SEQ ID NO: 62932 - DNA, 18 bp, Artificial Sequence
  Synthetic DNA
tactacgtctctctttcg

SEQ ID NO: 62933 - DNA, 18 bp, Artificial Sequence
  Synthetic DNA
tactacgtctgactaacg

SEQ ID NO: 62934 - DNA, 18 bp, Artificial Sequence
  Synthetic DNA
tactacgttacactaacg

SEQ ID NO: 62935 - DNA, 18 bp, Artificial Sequence
  Synthetic DNA
tactacgtttccctattg

SEQ ID NO: 62936 - DNA, 18 bp, Artificial Sequence
  Synthetic DNA
tactactaaatactctag

SEQ ID NO: 62937 - DNA, 18 bp, Artificial Sequence
  Synthetic DNA
tactactacactcaatag

SEQ ID NO: 62938 - DNA, 18 bp, Artificial Sequence
  Synthetic DNA
tactactactcatattag

SEQ ID NO: 62939 - DNA, 18 bp, Artificial Sequence
  Synthetic DNA
tactactattcattatgg

SEQ ID NO: 62940 - DNA, 18 bp, Artificial Sequence
  Synthetic DNA
tactactggacacttaag

SEQ ID NO: 62941 - DNA, 18 bp, Artificial Sequence
  Synthetic DNA
tactagaactcaccgtag

SEQ ID NO: 62942 - DNA, 18 bp, Artificial Sequence
  Synthetic DNA
tactaggccatacttttg

SEQ ID NO: 62943 - DNA, 18 bp, Artificial Sequence
  Synthetic DNA
tactataagtcaatatag

SEQ ID NO: 62944 - DNA, 18 bp, Artificial Sequence
  Synthetic DNA
tactatcacacaccatag

SEQ ID NO: 62945 - DNA, 18 bp, Artificial Sequence
  Synthetic DNA
tactatgacgcacgacag

SEQ ID NO: 62946 - DNA, 18 bp, Artificial Sequence
  Synthetic DNA
tactatgactttttatag

SEQ ID NO: 62947 - DNA, 18 bp, Artificial Sequence
  Synthetic DNA
tactcagtctctattttg

SEQ ID NO: 62948 - DNA, 18 bp, Artificial Sequence
  Synthetic DNA
tactccgcctcgttctag

SEQ ID NO: 62949 - DNA, 18 bp, Artificial Sequence
  Synthetic DNA
tactccgtttctctttag

SEQ ID NO: 62950 - DNA, 18 bp, Artificial Sequence
  Synthetic DNA
tactcctaccaactattg

SEQ ID NO: 62951 - DNA, 18 bp, Artificial Sequence
  Synthetic DNA
tactgcaacacattatag

SEQ ID NO: 62952 - DNA, 18 bp, Artificial Sequence
  Synthetic DNA
tacttaaagtctctaaag

SEQ ID NO: 62953 - DNA, 18 bp, Artificial Sequence
  Synthetic DNA
tacttcagatgactagtg

SEQ ID NO: 62954 - DNA, 18 bp, Artificial Sequence
  Synthetic DNA
tacttcgaatacctaaag

SEQ ID NO: 62955 - DNA, 18 bp, Artificial Sequence
  Synthetic DNA
tacttcgacgcacaaaag

SEQ ID NO: 62956 - DNA, 18 bp, Artificial Sequence
  Synthetic DNA
tacttcgactcatattag

SEQ ID NO: 62957 - DNA, 18 bp, Artificial Sequence
  Synthetic DNA
tacttcgactctctaatg

SEQ ID NO: 62958 - DNA, 18 bp, Artificial Sequence
  Synthetic DNA
tacttcgtatcacattag

SEQ ID NO: 62959 - DNA, 18 bp, Artificial Sequence
  Synthetic DNA
tacttcgtctcaacatag

SEQ ID NO: 62960 - DNA, 18 bp, Artificial Sequence
  Synthetic DNA
tacttcgtctctcaacag

SEQ ID NO: 62961 - DNA, 18 bp, Artificial Sequence
  Synthetic DNA
tacttctactccctagag

SEQ ID NO: 62962 - DNA, 18 bp, Artificial Sequence
  Synthetic DNA
tagaacatctctctaacg

SEQ ID NO: 62963 - DNA, 18 bp, Artificial Sequence
  Synthetic DNA
tagaacatgttactattg

SEQ ID NO: 62964 - DNA, 18 bp, Artificial Sequence
  Synthetic DNA
tagaacgaatctatatag

SEQ ID NO: 62965 - DNA, 18 bp, Artificial Sequence
  Synthetic DNA
tagaacgactgtgtagcg

SEQ ID NO: 62966 - DNA, 18 bp, Artificial Sequence
  Synthetic DNA
tagaacgcctacctgaag

SEQ ID NO: 62967 - DNA, 18 bp, Artificial Sequence
  Synthetic DNA
tagaacgtctaactaatg

SEQ ID NO: 62968 - DNA, 18 bp, Artificial Sequence
  Synthetic DNA
tagaactactcgcaaaag

SEQ ID NO: 62969 - DNA, 18 bp, Artificial Sequence
  Synthetic DNA
tagaatggtacattatag

SEQ ID NO: 62970 - DNA, 18 bp, Artificial Sequence
  Synthetic DNA
tagagcgaatcacttttg

SEQ ID NO: 62971 - DNA, 18 bp, Artificial Sequence
  Synthetic DNA
tagagcgacaatctatag

SEQ ID NO: 62972 - DNA, 18 bp, Artificial Sequence
  Synthetic DNA
tagagcgacacactaaag

SEQ ID NO: 62973 - DNA, 18 bp, Artificial Sequence
  Synthetic DNA
tagagcgactctcatttg

SEQ ID NO: 62974 - DNA, 18 bp, Artificial Sequence
  Synthetic DNA
tagagcggctcactttag

SEQ ID NO: 62975 - DNA, 18 bp, Artificial Sequence
  Synthetic DNA
tagatagactcgttgtag

SEQ ID NO: 62976 - DNA, 18 bp, Artificial Sequence
  Synthetic DNA
tagatcgactcaatgttg

SEQ ID NO: 62977 - DNA, 18 bp, Artificial Sequence
  Synthetic DNA
tagatcgtctctctattg

SEQ ID NO: 62978 - DNA, 18 bp, Artificial Sequence
  Synthetic DNA
tagcacaactatctatag

SEQ ID NO: 62979 - DNA, 18 bp, Artificial Sequence
  Synthetic DNA
tagcacgattccatatag

SEQ ID NO: 62980 - DNA, 18 bp, Artificial Sequence
  Synthetic DNA
tagcacggctcccatcag

SEQ ID NO: 62981 - DNA, 18 bp, Artificial Sequence
  Synthetic DNA
tagcacgtctcaattaag

SEQ ID NO: 62982 - DNA, 18 bp, Artificial Sequence
  Synthetic DNA
tagcgcacatcacaatcg

SEQ ID NO: 62983 - DNA, 18 bp, Artificial Sequence
  Synthetic DNA
tagcgtctctgattatag

SEQ ID NO: 62984 - DNA, 18 bp, Artificial Sequence
  Synthetic DNA
tagcttgtctcactttag

SEQ ID NO: 62985 - DNA, 18 bp, Artificial Sequence
  Synthetic DNA
taggaactcacactccag

SEQ ID NO: 62986 - DNA, 18 bp, Artificial Sequence
  Synthetic DNA
taggaatactctccaaag

SEQ ID NO: 62987 - DNA, 18 bp, Artificial Sequence
  Synthetic DNA
taggtcgtctcaatatag

SEQ ID NO: 62988 - DNA, 18 bp, Artificial Sequence
  Synthetic DNA
tagtaaaactcataatag

SEQ ID NO: 62989 - DNA, 18 bp, Artificial Sequence
  Synthetic DNA
tagtaacactcaccaaag

SEQ ID NO: 62990 - DNA, 18 bp, Artificial Sequence
  Synthetic DNA
tagtaacctaatctttag

SEQ ID NO: 62991 - DNA, 18 bp, Artificial Sequence
  Synthetic DNA
tagtaagtctacgtttag

SEQ ID NO: 62992 - DNA, 18 bp, Artificial Sequence
  Synthetic DNA
tagtaatcctcactattg

SEQ ID NO: 62993 - DNA, 18 bp, Artificial Sequence
  Synthetic DNA
tagtacaactatcaaccg

SEQ ID NO: 62994 - DNA, 18 bp, Artificial Sequence
  Synthetic DNA
tagtacaactctcctttg

SEQ ID NO: 62995 - DNA, 18 bp, Artificial Sequence
  Synthetic DNA
tagtaccactttctctag

SEQ ID NO: 62996 - DNA, 18 bp, Artificial Sequence
  Synthetic DNA
tagtaccattaactttag

SEQ ID NO: 62997 - DNA, 18 bp, Artificial Sequence
  Synthetic DNA
tagtaccctttactgtcg

SEQ ID NO: 62998 - DNA, 18 bp, Artificial Sequence
  Synthetic DNA
tagtacgacactcaattg

SEQ ID NO: 62999 - DNA, 18 bp, Artificial Sequence
  Synthetic DNA
tagtacgactatcacaag

SEQ ID NO: 63000 - DNA, 18 bp, Artificial Sequence
  Synthetic DNA
tagtacgccaccatttag

SEQ ID NO: 63001 - DNA, 18 bp, Artificial Sequence
  Synthetic DNA
tagtacgcctctttttag

SEQ ID NO: 63002 - DNA, 18 bp, Artificial Sequence
  Synthetic DNA
tagtacgtcactctttgg

SEQ ID NO: 63003 - DNA, 18 bp, Artificial Sequence
  Synthetic DNA
tagtacgtctttctattg

SEQ ID NO: 63004 - DNA, 18 bp, Artificial Sequence
  Synthetic DNA
tagtacgttacactatgg

SEQ ID NO: 63005 - DNA, 18 bp, Artificial Sequence
  Synthetic DNA
tagtacgtttcaccattg

SEQ ID NO: 63006 - DNA, 18 bp, Artificial Sequence
  Synthetic DNA
tagtactaaaaacgatag

SEQ ID NO: 63007 - DNA, 18 bp, Artificial Sequence
  Synthetic DNA
tagtactacttataaaag

SEQ ID NO: 63008 - DNA, 18 bp, Artificial Sequence
  Synthetic DNA
tagtacttctcagtttag

SEQ ID NO: 63009 - DNA, 18 bp, Artificial Sequence
  Synthetic DNA
tagtaggacggtctatag

SEQ ID NO: 63010 - DNA, 18 bp, Artificial Sequence
  Synthetic DNA
tagtaggtacgacgattg

SEQ ID NO: 63011 - DNA, 18 bp, Artificial Sequence
  Synthetic DNA
tagtatcaatcataacag

SEQ ID NO: 63012 - DNA, 18 bp, Artificial Sequence
  Synthetic DNA
tagtatccatctctatag

SEQ ID NO: 63013 - DNA, 18 bp, Artificial Sequence
  Synthetic DNA
tagtatgactcaaaaaag

SEQ ID NO: 63014 - DNA, 18 bp, Artificial Sequence
  Synthetic DNA
tagtatgtctctgtttag

SEQ ID NO: 63015 - DNA, 18 bp, Artificial Sequence
  Synthetic DNA
tagtatgtctctttaaag

SEQ ID NO: 63016 - DNA, 18 bp, Artificial Sequence
  Synthetic DNA
tagtgcgattcacattag

SEQ ID NO: 63017 - DNA, 18 bp, Artificial Sequence
  Synthetic DNA
tagttagactcaaatagg

SEQ ID NO: 63018 - DNA, 18 bp, Artificial Sequence
  Synthetic DNA
tagttaggcgcagtatag

SEQ ID NO: 63019 - DNA, 18 bp, Artificial Sequence
  Synthetic DNA
tagttcaacatactatag

SEQ ID NO: 63020 - DNA, 18 bp, Artificial Sequence
  Synthetic DNA
tagttcaactcacttcag

SEQ ID NO: 63021 - DNA, 18 bp, Artificial Sequence
  Synthetic DNA
tagttcattttattaagg

SEQ ID NO: 63022 - DNA, 18 bp, Artificial Sequence
  Synthetic DNA
tagttccttacaataacg

SEQ ID NO: 63023 - DNA, 18 bp, Artificial Sequence
  Synthetic DNA
tagttcgactcacttgcg

SEQ ID NO: 63024 - DNA, 18 bp, Artificial Sequence
  Synthetic DNA
tagttcgactctatattg

SEQ ID NO: 63025 - DNA, 18 bp, Artificial Sequence
  Synthetic DNA
tagttcgactctctgaag

SEQ ID NO: 63026 - DNA, 18 bp, Artificial Sequence
  Synthetic DNA
tagttcgagacacaaaag

SEQ ID NO: 63027 - DNA, 18 bp, Artificial Sequence
  Synthetic DNA
tagttcgtcttaatattg

SEQ ID NO: 63028 - DNA, 18 bp, Artificial Sequence
  Synthetic DNA
tagttctactcacttcag

SEQ ID NO: 63029 - DNA, 18 bp, Artificial Sequence
  Synthetic DNA
tagttggtctcactacag

SEQ ID NO: 63030 - DNA, 18 bp, Artificial Sequence
  Synthetic DNA
tagtttaattcattattg

SEQ ID NO: 63031 - DNA, 18 bp, Artificial Sequence
  Synthetic DNA
tagtttgtcttgctatgg

SEQ ID NO: 63032 - DNA, 18 bp, Artificial Sequence
  Synthetic DNA
tataaagaatccctaaag

SEQ ID NO: 63033 - DNA, 18 bp, Artificial Sequence
  Synthetic DNA
tataaaggatcactatag

SEQ ID NO: 63034 - DNA, 18 bp, Artificial Sequence
  Synthetic DNA
tataacaactcacttttg

SEQ ID NO: 63035 - DNA, 18 bp, Artificial Sequence
  Synthetic DNA
tataacatatcactaaag

SEQ ID NO: 63036 - DNA, 18 bp, Artificial Sequence
  Synthetic DNA
tataacatttcactatcg

SEQ ID NO: 63037 - DNA, 18 bp, Artificial Sequence
  Synthetic DNA
tataacccctcacaatag

SEQ ID NO: 63038 - DNA, 18 bp, Artificial Sequence
  Synthetic DNA
tataacctctcacttaag

SEQ ID NO: 63039 - DNA, 18 bp, Artificial Sequence
  Synthetic DNA
tataacgactatcaattg

SEQ ID NO: 63040 - DNA, 18 bp, Artificial Sequence
  Synthetic DNA
tataacgactcccttttg

SEQ ID NO: 63041 - DNA, 18 bp, Artificial Sequence
  Synthetic DNA
tataacgacttactaatg

SEQ ID NO: 63042 - DNA, 18 bp, Artificial Sequence
  Synthetic DNA
tataacgacttttcatag

SEQ ID NO: 63043 - DNA, 18 bp, Artificial Sequence
  Synthetic DNA
tataacgagcttctatag

SEQ ID NO: 63044 - DNA, 18 bp, Artificial Sequence
  Synthetic DNA
tataacgagtttctattg

SEQ ID NO: 63045 - DNA, 18 bp, Artificial Sequence
  Synthetic DNA
tataacgcatcacataag

SEQ ID NO: 63046 - DNA, 18 bp, Artificial Sequence
  Synthetic DNA
tataacgccccacgaaag

SEQ ID NO: 63047 - DNA, 18 bp, Artificial Sequence
  Synthetic DNA
tataacgctactttatag

SEQ ID NO: 63048 - DNA, 18 bp, Artificial Sequence
  Synthetic DNA
tataacgtcactctctag

SEQ ID NO: 63049 - DNA, 18 bp, Artificial Sequence
  Synthetic DNA
tataacgtctacctatag

SEQ ID NO: 63050 - DNA, 18 bp, Artificial Sequence
  Synthetic DNA
tataacgtctagctacag

SEQ ID NO: 63051 - DNA, 18 bp, Artificial Sequence
  Synthetic DNA
tataacgtttcacaacag

SEQ ID NO: 63052 - DNA, 18 bp, Artificial Sequence
  Synthetic DNA
tataactactcataatag

SEQ ID NO: 63053 - DNA, 18 bp, Artificial Sequence
  Synthetic DNA
tataaggactcattaaag

SEQ ID NO: 63054 - DNA, 18 bp, Artificial Sequence
  Synthetic DNA
tataaggattcaatatag

SEQ ID NO: 63055 - DNA, 18 bp, Artificial Sequence
  Synthetic DNA
tataaggattcactacag

SEQ ID NO: 63056 - DNA, 18 bp, Artificial Sequence
  Synthetic DNA
tataaggtaaagctatag

SEQ ID NO: 63057 - DNA, 18 bp, Artificial Sequence
  Synthetic DNA
tataaggtctcataaaag

SEQ ID NO: 63058 - DNA, 18 bp, Artificial Sequence
  Synthetic DNA
tataatgaaacactatag

SEQ ID NO: 63059 - DNA, 18 bp, Artificial Sequence
  Synthetic DNA
tataatgacacacacttg

SEQ ID NO: 63060 - DNA, 18 bp, Artificial Sequence
  Synthetic DNA
tataatgacgcactttgg

SEQ ID NO: 63061 - DNA, 18 bp, Artificial Sequence
  Synthetic DNA
tataatgacgccttatag

SEQ ID NO: 63062 - DNA, 18 bp, Artificial Sequence
  Synthetic DNA
tataatgacttaatttag

SEQ ID NO: 63063 - DNA, 18 bp, Artificial Sequence
  Synthetic DNA
tataatgatttacaattg

SEQ ID NO: 63064 - DNA, 18 bp, Artificial Sequence
  Synthetic DNA
tataatgtctcactttag

SEQ ID NO: 63065 - DNA, 18 bp, Artificial Sequence
  Synthetic DNA
tataattactccctattg

SEQ ID NO: 63066 - DNA, 18 bp, Artificial Sequence
  Synthetic DNA
tatacagtatcactacag

SEQ ID NO: 63067 - DNA, 18 bp, Artificial Sequence
  Synthetic DNA
tataccgactaactatgg

SEQ ID NO: 63068 - DNA, 18 bp, Artificial Sequence
  Synthetic DNA
tataccgacttactaatg

SEQ ID NO: 63069 - DNA, 18 bp, Artificial Sequence
  Synthetic DNA
tataccgatttacaaaag

SEQ ID NO: 63070 - DNA, 18 bp, Artificial Sequence
  Synthetic DNA
tatagaaacacacgatag

SEQ ID NO: 63071 - DNA, 18 bp, Artificial Sequence
  Synthetic DNA
tatatagactcataatag

SEQ ID NO: 63072 - DNA, 18 bp, Artificial Sequence
  Synthetic DNA
tatatcgacactcaatag

SEQ ID NO: 63073 - DNA, 18 bp, Artificial Sequence
  Synthetic DNA
tatatcgactaaatatag

SEQ ID NO: 63074 - DNA, 18 bp, Artificial Sequence
  Synthetic DNA
tatatcgattcacaatag

SEQ ID NO: 63075 - DNA, 18 bp, Artificial Sequence
  Synthetic DNA
tatatctactcatcatag

SEQ ID NO: 63076 - DNA, 18 bp, Artificial Sequence
  Synthetic DNA
tatatcttcttactatag

SEQ ID NO: 63077 - DNA, 18 bp, Artificial Sequence
  Synthetic DNA
tatatggaatctcactaa

SEQ ID NO: 63078 - DNA, 18 bp, Artificial Sequence
  Synthetic DNA
tatcaccaataactattg

SEQ ID NO: 63079 - DNA, 18 bp, Artificial Sequence
  Synthetic DNA
tatcacgaatcataatag

SEQ ID NO: 63080 - DNA, 18 bp, Artificial Sequence
  Synthetic DNA
tatcacgacattctatag

SEQ ID NO: 63081 - DNA, 18 bp, Artificial Sequence
  Synthetic DNA
tatcacgatacacttaag

SEQ ID NO: 63082 - DNA, 18 bp, Artificial Sequence
  Synthetic DNA
tatcacgattgatactag

SEQ ID NO: 63083 - DNA, 18 bp, Artificial Sequence
  Synthetic DNA
tatcacgtccatcttttg

SEQ ID NO: 63084 - DNA, 18 bp, Artificial Sequence
  Synthetic DNA
tatcacgtctacacatag

SEQ ID NO: 63085 - DNA, 18 bp, Artificial Sequence
  Synthetic DNA
tatcacttcaaacttttg

SEQ ID NO: 63086 - DNA, 18 bp, Artificial Sequence
  Synthetic DNA
tatcaggactctcactag

SEQ ID NO: 63087 - DNA, 18 bp, Artificial Sequence
  Synthetic DNA
tatcatgacacaatattg

SEQ ID NO: 63088 - DNA, 18 bp, Artificial Sequence
  Synthetic DNA
tatcatggcacactatag

SEQ ID NO: 63089 - DNA, 18 bp, Artificial Sequence
  Synthetic DNA
tatcatggctcatgatag

SEQ ID NO: 63090 - DNA, 18 bp, Artificial Sequence
  Synthetic DNA
tatcatgtcccacaatag

SEQ ID NO: 63091 - DNA, 18 bp, Artificial Sequence
  Synthetic DNA
tatcccgactctctcgag

SEQ ID NO: 63092 - DNA, 18 bp, Artificial Sequence
  Synthetic DNA
tatcctgacttcctatgg

SEQ ID NO: 63093 - DNA, 18 bp, Artificial Sequence
  Synthetic DNA
tatctaaactcgcaacag

SEQ ID NO: 63094 - DNA, 18 bp, Artificial Sequence
  Synthetic DNA
tatctcaactctctatcg

SEQ ID NO: 63095 - DNA, 18 bp, Artificial Sequence
  Synthetic DNA
tatctcgaatcattatag

SEQ ID NO: 63096 - DNA, 18 bp, Artificial Sequence
  Synthetic DNA
tatctcgactcacaaaag

SEQ ID NO: 63097 - DNA, 18 bp, Artificial Sequence
  Synthetic DNA
tatctcgtctcacgtcag

SEQ ID NO: 63098 - DNA, 18 bp, Artificial Sequence
  Synthetic DNA
tatctcgtttcactatag

SEQ ID NO: 63099 - DNA, 18 bp, Artificial Sequence
  Synthetic DNA
tatgacagaaaactaaag

SEQ ID NO: 63100 - DNA, 18 bp, Artificial Sequence
  Synthetic DNA
tatgactactcgccatag

SEQ ID NO: 63101 - DNA, 18 bp, Artificial Sequence
  Synthetic DNA
tatggcttcacggttgag

SEQ ID NO: 63102 - DNA, 18 bp, Artificial Sequence
  Synthetic DNA
tattaaaaatcattatag

SEQ ID NO: 63103 - DNA, 18 bp, Artificial Sequence
  Synthetic DNA
tattaaaacttacttaag

SEQ ID NO: 63104 - DNA, 18 bp, Artificial Sequence
  Synthetic DNA
tattaagacacacaacag

SEQ ID NO: 63105 - DNA, 18 bp, Artificial Sequence
  Synthetic DNA
tattaagactcataacag

SEQ ID NO: 63106 - DNA, 18 bp, Artificial Sequence
  Synthetic DNA
tattaagactctttgatg

SEQ ID NO: 63107 - DNA, 18 bp, Artificial Sequence
  Synthetic DNA
tattaagacttataattg

SEQ ID NO: 63108 - DNA, 18 bp, Artificial Sequence
  Synthetic DNA
tattaagattaaccttag

SEQ ID NO: 63109 - DNA, 18 bp, Artificial Sequence
  Synthetic DNA
tattaagattcccaatag

SEQ ID NO: 63110 - DNA, 18 bp, Artificial Sequence
  Synthetic DNA
tattaagattcgcttagg

SEQ ID NO: 63111 - DNA, 18 bp, Artificial Sequence
  Synthetic DNA
tattaagattctctattg

SEQ ID NO: 63112 - DNA, 18 bp, Artificial Sequence
  Synthetic DNA
tattaagcatcattaatg

SEQ ID NO: 63113 - DNA, 18 bp, Artificial Sequence
  Synthetic DNA
tattaagtcacactaaag

SEQ ID NO: 63114 - DNA, 18 bp, Artificial Sequence
  Synthetic DNA
tattaagtctcacttttg

SEQ ID NO: 63115 - DNA, 18 bp, Artificial Sequence
  Synthetic DNA
tattaatatatcggacag

SEQ ID NO: 63116 - DNA, 18 bp, Artificial Sequence
  Synthetic DNA
tattacaaaactatatag

SEQ ID NO: 63117 - DNA, 18 bp, Artificial Sequence
  Synthetic DNA
tattacaacatcctaaag

SEQ ID NO: 63118 - DNA, 18 bp, Artificial Sequence
  Synthetic DNA
tattacaacgaactaaag

SEQ ID NO: 63119 - DNA, 18 bp, Artificial Sequence
  Synthetic DNA
tattacaactcacttaaa

SEQ ID NO: 63120 - DNA, 18 bp, Artificial Sequence
  Synthetic DNA
tattacaactcgctaatg

SEQ ID NO: 63121 - DNA, 18 bp, Artificial Sequence
  Synthetic DNA
tattacaactctctgaag

SEQ ID NO: 63122 - DNA, 18 bp, Artificial Sequence
  Synthetic DNA
tattacaacttgcaatag

SEQ ID NO: 63123 - DNA, 18 bp, Artificial Sequence
  Synthetic DNA
tattacaccacactattg

SEQ ID NO: 63124 - DNA, 18 bp, Artificial Sequence
  Synthetic DNA
tattacatattactattg

SEQ ID NO: 63125 - DNA, 18 bp, Artificial Sequence
  Synthetic DNA
tattacatcgcacaatag

SEQ ID NO: 63126 - DNA, 18 bp, Artificial Sequence
  Synthetic DNA
tattacatctctctttcg

SEQ ID NO: 63127 - DNA, 18 bp, Artificial Sequence
  Synthetic DNA
tattacattaacttatag

SEQ ID NO: 63128 - DNA, 18 bp, Artificial Sequence
  Synthetic DNA
tattaccactctctttgg

SEQ ID NO: 63129 - DNA, 18 bp, Artificial Sequence
  Synthetic DNA
tattaccattcagtttcg

SEQ ID NO: 63130 - DNA, 18 bp, Artificial Sequence
  Synthetic DNA
tattacctatcactttag

SEQ ID NO: 63131 - DNA, 18 bp, Artificial Sequence
  Synthetic DNA
tattacctcacagttcag

SEQ ID NO: 63132 - DNA, 18 bp, Artificial Sequence
  Synthetic DNA
tattacctctcacttaag

SEQ ID NO: 63133 - DNA, 18 bp, Artificial Sequence
  Synthetic DNA
tattacgaataacaatgg

SEQ ID NO: 63134 - DNA, 18 bp, Artificial Sequence
  Synthetic DNA
tattacgaatcgatatcg

SEQ ID NO: 63135 - DNA, 18 bp, Artificial Sequence
  Synthetic DNA
tattacgaatctcttcag

SEQ ID NO: 63136 - DNA, 18 bp, Artificial Sequence
  Synthetic DNA
tattacgaatggcaatag

SEQ ID NO: 63137 - DNA, 18 bp, Artificial Sequence
  Synthetic DNA
tattacgacacatgttag

SEQ ID NO: 63138 - DNA, 18 bp, Artificial Sequence
  Synthetic DNA
tattacgacactcgttag

SEQ ID NO: 63139 - DNA, 18 bp, Artificial Sequence
  Synthetic DNA
tattacgacacttactag

SEQ ID NO: 63140 - DNA, 18 bp, Artificial Sequence
  Synthetic DNA
tattacgacagacttttg

SEQ ID NO: 63141 - DNA, 18 bp, Artificial Sequence
  Synthetic DNA
tattacgacatccaaatg

SEQ ID NO: 63142 - DNA, 18 bp, Artificial Sequence
  Synthetic DNA
tattacgaccatcaatag

SEQ ID NO: 63143 - DNA, 18 bp, Artificial Sequence
  Synthetic DNA
tattacgacctacttaag

SEQ ID NO: 63144 - DNA, 18 bp, Artificial Sequence
  Synthetic DNA
tattacgactaattaacg

SEQ ID NO: 63145 - DNA, 18 bp, Artificial Sequence
  Synthetic DNA
tattacgactaattaatg

SEQ ID NO: 63146 - DNA, 18 bp, Artificial Sequence
  Synthetic DNA
tattacgactcacatatg

SEQ ID NO: 63147 - DNA, 18 bp, Artificial Sequence
  Synthetic DNA
tattacgactcgcatttg

SEQ ID NO: 63148 - DNA, 18 bp, Artificial Sequence
  Synthetic DNA
tattacgactggtaatgg

SEQ ID NO: 63149 - DNA, 18 bp, Artificial Sequence
  Synthetic DNA
tattacgagacacctaag

SEQ ID NO: 63150 - DNA, 18 bp, Artificial Sequence
  Synthetic DNA
tattacgagtcataaatg

SEQ ID NO: 63151 - DNA, 18 bp, Artificial Sequence
  Synthetic DNA
tattacgagttacaaaag

SEQ ID NO: 63152 - DNA, 18 bp, Artificial Sequence
  Synthetic DNA
tattacgatatcctttag

SEQ ID NO: 63153 - DNA, 18 bp, Artificial Sequence
  Synthetic DNA
tattacgatccaacatag

SEQ ID NO: 63154 - DNA, 18 bp, Artificial Sequence
  Synthetic DNA
tattacgatcctctaaag

SEQ ID NO: 63155 - DNA, 18 bp, Artificial Sequence
  Synthetic DNA
tattacgatttacactcg

SEQ ID NO: 63156 - DNA, 18 bp, Artificial Sequence
  Synthetic DNA
tattacgcctcctaaaag

SEQ ID NO: 63157 - DNA, 18 bp, Artificial Sequence
  Synthetic DNA
tattacggcaatctatag

SEQ ID NO: 63158 - DNA, 18 bp, Artificial Sequence
  Synthetic DNA
tattacggcactccatag

SEQ ID NO: 63159 - DNA, 18 bp, Artificial Sequence
  Synthetic DNA
tattacggctaacgaatg

SEQ ID NO: 63160 - DNA, 18 bp, Artificial Sequence
  Synthetic DNA
tattacgtagctctattg

SEQ ID NO: 63161 - DNA, 18 bp, Artificial Sequence
  Synthetic DNA
tattacgtatcgctgtag

SEQ ID NO: 63162 - DNA, 18 bp, Artificial Sequence
  Synthetic DNA
tattacgtcacacaatgg

SEQ ID NO: 63163 - DNA, 18 bp, Artificial Sequence
  Synthetic DNA
tattacgtcacagtacag

SEQ ID NO: 63164 - DNA, 18 bp, Artificial Sequence
  Synthetic DNA
tattacgtcacattctag

SEQ ID NO: 63165 - DNA, 18 bp, Artificial Sequence
  Synthetic DNA
tattacgtcaccctgaag

SEQ ID NO: 63166 - DNA, 18 bp, Artificial Sequence
  Synthetic DNA
tattacgtcagacaatgg

SEQ ID NO: 63167 - DNA, 18 bp, Artificial Sequence
  Synthetic DNA
tattacgtctcaatactg

SEQ ID NO: 63168 - DNA, 18 bp, Artificial Sequence
  Synthetic DNA
tattacgtctcgcatagg

SEQ ID NO: 63169 - DNA, 18 bp, Artificial Sequence
  Synthetic DNA
tattacgttccactttag

SEQ ID NO: 63170 - DNA, 18 bp, Artificial Sequence
  Synthetic DNA
tattacgtttgaatatag

SEQ ID NO: 63171 - DNA, 18 bp, Artificial Sequence
  Synthetic DNA
tattacgtttgacttttg

SEQ ID NO: 63172 - DNA, 18 bp, Artificial Sequence
  Synthetic DNA
tattactaatcattaagg

SEQ ID NO: 63173 - DNA, 18 bp, Artificial Sequence
  Synthetic DNA
tattactaatctacttag

SEQ ID NO: 63174 - DNA, 18 bp, Artificial Sequence
  Synthetic DNA
tattactacacacttcag

SEQ ID NO: 63175 - DNA, 18 bp, Artificial Sequence
  Synthetic DNA
tattactacacattttag

SEQ ID NO: 63176 - DNA, 18 bp, Artificial Sequence
  Synthetic DNA
tattactacattctatag

SEQ ID NO: 63177 - DNA, 18 bp, Artificial Sequence
  Synthetic DNA
tattactactccccattg

SEQ ID NO: 63178 - DNA, 18 bp, Artificial Sequence
  Synthetic DNA
tattactactcctttcag

SEQ ID NO: 63179 - DNA, 18 bp, Artificial Sequence
  Synthetic DNA
tattactactcgcttaag

SEQ ID NO: 63180 - DNA, 18 bp, Artificial Sequence
  Synthetic DNA
tattactatacacttaag

SEQ ID NO: 63181 - DNA, 18 bp, Artificial Sequence
  Synthetic DNA
tattactatcaaaaatag

SEQ ID NO: 63182 - DNA, 18 bp, Artificial Sequence
  Synthetic DNA
tattactcccctctgttg

SEQ ID NO: 63183 - DNA, 18 bp, Artificial Sequence
  Synthetic DNA
tattactcctcattttag

SEQ ID NO: 63184 - DNA, 18 bp, Artificial Sequence
  Synthetic DNA
tattactcgtctctttag

SEQ ID NO: 63185 - DNA, 18 bp, Artificial Sequence
  Synthetic DNA
tattacttcctattatag

SEQ ID NO: 63186 - DNA, 18 bp, Artificial Sequence
  Synthetic DNA
tattactttttactttag

SEQ ID NO: 63187 - DNA, 18 bp, Artificial Sequence
  Synthetic DNA
tattagatcagattgaag

SEQ ID NO: 63188 - DNA, 18 bp, Artificial Sequence
  Synthetic DNA
tattaggacgaacaatcg

SEQ ID NO: 63189 - DNA, 18 bp, Artificial Sequence
  Synthetic DNA
tattaggactagctaaag

SEQ ID NO: 63190 - DNA, 18 bp, Artificial Sequence
  Synthetic DNA
tattataagtcactaaag

SEQ ID NO: 63191 - DNA, 18 bp, Artificial Sequence
  Synthetic DNA
tattatcactcaaaatag

SEQ ID NO: 63192 - DNA, 18 bp, Artificial Sequence
  Synthetic DNA
tattatcactcaatattg

SEQ ID NO: 63193 - DNA, 18 bp, Artificial Sequence
  Synthetic DNA
tattatgaatcacctaag

SEQ ID NO: 63194 - DNA, 18 bp, Artificial Sequence
  Synthetic DNA
tattatgacacataaaag

SEQ ID NO: 63195 - DNA, 18 bp, Artificial Sequence
  Synthetic DNA
tattatgatttaccatcg

SEQ ID NO: 63196 - DNA, 18 bp, Artificial Sequence
  Synthetic DNA
tattatgtctaaccgtaa

SEQ ID NO: 63197 - DNA, 18 bp, Artificial Sequence
  Synthetic DNA
tattatgtttcactacag

SEQ ID NO: 63198 - DNA, 18 bp, Artificial Sequence
  Synthetic DNA
tattattactaagtacag

SEQ ID NO: 63199 - DNA, 18 bp, Artificial Sequence
  Synthetic DNA
tattattactgaatatag

SEQ ID NO: 63200 - DNA, 18 bp, Artificial Sequence
  Synthetic DNA
tattcagactctcataag

SEQ ID NO: 63201 - DNA, 18 bp, Artificial Sequence
  Synthetic DNA
tattccatgtcactatgg

SEQ ID NO: 63202 - DNA, 18 bp, Artificial Sequence
  Synthetic DNA
tattccgcaactctattg

SEQ ID NO: 63203 - DNA, 18 bp, Artificial Sequence
  Synthetic DNA
tattccgtctcaaaaaag

SEQ ID NO: 63204 - DNA, 18 bp, Artificial Sequence
  Synthetic DNA
tattcctactcattttag

SEQ ID NO: 63205 - DNA, 18 bp, Artificial Sequence
  Synthetic DNA
tattcggacttactttag

SEQ ID NO: 63206 - DNA, 18 bp, Artificial Sequence
  Synthetic DNA
tattctatcccacaatag

SEQ ID NO: 63207 - DNA, 18 bp, Artificial Sequence
  Synthetic DNA
tattgcaacccacttttg

SEQ ID NO: 63208 - DNA, 18 bp, Artificial Sequence
  Synthetic DNA
tattgcaattcacaatag

SEQ ID NO: 63209 - DNA, 18 bp, Artificial Sequence
  Synthetic DNA
tattgcacttcagtatag

SEQ ID NO: 63210 - DNA, 18 bp, Artificial Sequence
  Synthetic DNA
tattgcagctcactttag

SEQ ID NO: 63211 - DNA, 18 bp, Artificial Sequence
  Synthetic DNA
tattgcgactgattgttg

SEQ ID NO: 63212 - DNA, 18 bp, Artificial Sequence
  Synthetic DNA
tattgcgtatggctatag

SEQ ID NO: 63213 - DNA, 18 bp, Artificial Sequence
  Synthetic DNA
tattgcgtctcacaatgg

SEQ ID NO: 63214 - DNA, 18 bp, Artificial Sequence
  Synthetic DNA
tattgcgtctctatatag

SEQ ID NO: 63215 - DNA, 18 bp, Artificial Sequence
  Synthetic DNA
tattgcgtttcattatag

SEQ ID NO: 63216 - DNA, 18 bp, Artificial Sequence
  Synthetic DNA
tattgtaaatctctatag

SEQ ID NO: 63217 - DNA, 18 bp, Artificial Sequence
  Synthetic DNA
tattgtgactcactaatg

SEQ ID NO: 63218 - DNA, 18 bp, Artificial Sequence
  Synthetic DNA
tattgtgtttcactatag

SEQ ID NO: 63219 - DNA, 18 bp, Artificial Sequence
  Synthetic DNA
tatttagtttcactattg

SEQ ID NO: 63220 - DNA, 18 bp, Artificial Sequence
  Synthetic DNA
tatttcaacacactattg

SEQ ID NO: 63221 - DNA, 18 bp, Artificial Sequence
  Synthetic DNA
tatttcaacccattatag

SEQ ID NO: 63222 - DNA, 18 bp, Artificial Sequence
  Synthetic DNA
tatttcaactctctattg

SEQ ID NO: 63223 - DNA, 18 bp, Artificial Sequence
  Synthetic DNA
tatttcaattcacttttg

SEQ ID NO: 63224 - DNA, 18 bp, Artificial Sequence
  Synthetic DNA
tatttcatctcatttcag

SEQ ID NO: 63225 - DNA, 18 bp, Artificial Sequence
  Synthetic DNA
tatttccaatcactttag

SEQ ID NO: 63226 - DNA, 18 bp, Artificial Sequence
  Synthetic DNA
tatttccactcaacatag

SEQ ID NO: 63227 - DNA, 18 bp, Artificial Sequence
  Synthetic DNA
tatttcgaaactttattg

SEQ ID NO: 63228 - DNA, 18 bp, Artificial Sequence
  Synthetic DNA
tatttcgacacaccattg

SEQ ID NO: 63229 - DNA, 18 bp, Artificial Sequence
  Synthetic DNA
tatttcgtatccttatag

SEQ ID NO: 63230 - DNA, 18 bp, Artificial Sequence
  Synthetic DNA
tatttctactcaatgtag

SEQ ID NO: 63231 - DNA, 18 bp, Artificial Sequence
  Synthetic DNA
tatttcttctcaccatag

SEQ ID NO: 63232 - DNA, 18 bp, Artificial Sequence
  Synthetic DNA
tatttgtacttactatag

SEQ ID NO: 63233 - DNA, 18 bp, Artificial Sequence
  Synthetic DNA
tattttaactcactttag

SEQ ID NO: 63234 - DNA, 18 bp, Artificial Sequence
  Synthetic DNA
tattttcgctcatattag

SEQ ID NO: 63235 - DNA, 18 bp, Artificial Sequence
  Synthetic DNA
tattttgacacacaacag

SEQ ID NO: 63236 - DNA, 18 bp, Artificial Sequence
  Synthetic DNA
tattttgcctccctatag

SEQ ID NO: 63237 - DNA, 18 bp, Artificial Sequence
  Synthetic DNA
tatttttactcatttttg

SEQ ID NO: 63238 - DNA, 18 bp, Artificial Sequence
  Synthetic DNA
tatttttactcgccaaag

SEQ ID NO: 63239 - DNA, 18 bp, Artificial Sequence
  Synthetic DNA
tcaaaacacaaactctag

SEQ ID NO: 63240 - DNA, 18 bp, Artificial Sequence
  Synthetic DNA
tcaaacaaaatactatag

SEQ ID NO: 63241 - DNA, 18 bp, Artificial Sequence
  Synthetic DNA
tcaaacgacacaatttag

SEQ ID NO: 63242 - DNA, 18 bp, Artificial Sequence
  Synthetic DNA
tcaaacgactaaacatag

SEQ ID NO: 63243 - DNA, 18 bp, Artificial Sequence
  Synthetic DNA
tcaaacgcctcgtcattg

SEQ ID NO: 63244 - DNA, 18 bp, Artificial Sequence
  Synthetic DNA
tcaaacgtcactccaagg

SEQ ID NO: 63245 - DNA, 18 bp, Artificial Sequence
  Synthetic DNA
tcaaacgtcgcactattg

SEQ ID NO: 63246 - DNA, 18 bp, Artificial Sequence
  Synthetic DNA
tcaaactactcgccatag

SEQ ID NO: 63247 - DNA, 18 bp, Artificial Sequence
  Synthetic DNA
tcaaagaactcactaaag

SEQ ID NO: 63248 - DNA, 18 bp, Artificial Sequence
  Synthetic DNA
tcaaatgccacactgtag

SEQ ID NO: 63249 - DNA, 18 bp, Artificial Sequence
  Synthetic DNA
tcaaattagacactaaag

SEQ ID NO: 63250 - DNA, 18 bp, Artificial Sequence
  Synthetic DNA
tcaatcgaaacactatag

SEQ ID NO: 63251 - DNA, 18 bp, Artificial Sequence
  Synthetic DNA
tcaattgattcaccataa

SEQ ID NO: 63252 - DNA, 18 bp, Artificial Sequence
  Synthetic DNA
tcacacgtctcactaatg

SEQ ID NO: 63253 - DNA, 18 bp, Artificial Sequence
  Synthetic DNA
tcacgcgattctctatag

SEQ ID NO: 63254 - DNA, 18 bp, Artificial Sequence
  Synthetic DNA
tcagacaactctctgtcg

SEQ ID NO: 63255 - DNA, 18 bp, Artificial Sequence
  Synthetic DNA
tcagttgtctcactttag

SEQ ID NO: 63256 - DNA, 18 bp, Artificial Sequence
  Synthetic DNA
tcataacgctcactctag

SEQ ID NO: 63257 - DNA, 18 bp, Artificial Sequence
  Synthetic DNA
tcataagacttacttatg

SEQ ID NO: 63258 - DNA, 18 bp, Artificial Sequence
  Synthetic DNA
tcataagactttccatag

SEQ ID NO: 63259 - DNA, 18 bp, Artificial Sequence
  Synthetic DNA
tcatacaacacacaattg

SEQ ID NO: 63260 - DNA, 18 bp, Artificial Sequence
  Synthetic DNA
tcatacaacactctattg

SEQ ID NO: 63261 - DNA, 18 bp, Artificial Sequence
  Synthetic DNA
tcatacaattctcctctg

SEQ ID NO: 63262 - DNA, 18 bp, Artificial Sequence
  Synthetic DNA
tcatacagctcaaaaatg

SEQ ID NO: 63263 - DNA, 18 bp, Artificial Sequence
  Synthetic DNA
tcatacatcacacaatag

SEQ ID NO: 63264 - DNA, 18 bp, Artificial Sequence
  Synthetic DNA
tcatacatttcgctatcg

SEQ ID NO: 63265 - DNA, 18 bp, Artificial Sequence
  Synthetic DNA
tcataccaatcgctaaag

SEQ ID NO: 63266 - DNA, 18 bp, Artificial Sequence
  Synthetic DNA
tcataccactaactcaag

SEQ ID NO: 63267 - DNA, 18 bp, Artificial Sequence
  Synthetic DNA
tcatacgacacacatttg

SEQ ID NO: 63268 - DNA, 18 bp, Artificial Sequence
  Synthetic DNA
tcatacgacccgctgaag

SEQ ID NO: 63269 - DNA, 18 bp, Artificial Sequence
  Synthetic DNA
tcatacgactatctctcg

SEQ ID NO: 63270 - DNA, 18 bp, Artificial Sequence
  Synthetic DNA
tcatacgagacggctgag

SEQ ID NO: 63271 - DNA, 18 bp, Artificial Sequence
  Synthetic DNA
tcatacgagtaattaaag

SEQ ID NO: 63272 - DNA, 18 bp, Artificial Sequence
  Synthetic DNA
tcatacgattaataatag

SEQ ID NO: 63273 - DNA, 18 bp, Artificial Sequence
  Synthetic DNA
tcatacgccttacaaaag

SEQ ID NO: 63274 - DNA, 18 bp, Artificial Sequence
  Synthetic DNA
tcatacggcatactattg

SEQ ID NO: 63275 - DNA, 18 bp, Artificial Sequence
  Synthetic DNA
tcatacgtcttactcatg

SEQ ID NO: 63276 - DNA, 18 bp, Artificial Sequence
  Synthetic DNA
tcatacgtcttattattg

SEQ ID NO: 63277 - DNA, 18 bp, Artificial Sequence
  Synthetic DNA
tcatacgttactctttag

SEQ ID NO: 63278 - DNA, 18 bp, Artificial Sequence
  Synthetic DNA
tcatacgttttactattg

SEQ ID NO: 63279 - DNA, 18 bp, Artificial Sequence
  Synthetic DNA
tcatactacgcattttag

SEQ ID NO: 63280 - DNA, 18 bp, Artificial Sequence
  Synthetic DNA
tcatacttctcacatttg

SEQ ID NO: 63281 - DNA, 18 bp, Artificial Sequence
  Synthetic DNA
tcatacttctcattaaag

SEQ ID NO: 63282 - DNA, 18 bp, Artificial Sequence
  Synthetic DNA
tcataggactccctaatg

SEQ ID NO: 63283 - DNA, 18 bp, Artificial Sequence
  Synthetic DNA
tcataggactctctgccg

SEQ ID NO: 63284 - DNA, 18 bp, Artificial Sequence
  Synthetic DNA
tcataggatttgcaatag

SEQ ID NO: 63285 - DNA, 18 bp, Artificial Sequence
  Synthetic DNA
tcatatatcccacttcag

SEQ ID NO: 63286 - DNA, 18 bp, Artificial Sequence
  Synthetic DNA
tcatatcactctatatag

SEQ ID NO: 63287 - DNA, 18 bp, Artificial Sequence
  Synthetic DNA
tcatatgtctcacctaag

SEQ ID NO: 63288 - DNA, 18 bp, Artificial Sequence
  Synthetic DNA
tcatattagtcactaaag

SEQ ID NO: 63289 - DNA, 18 bp, Artificial Sequence
  Synthetic DNA
tcatccgactgaatatcg

SEQ ID NO: 63290 - DNA, 18 bp, Artificial Sequence
  Synthetic DNA
tcatccttttcaccagag

SEQ ID NO: 63291 - DNA, 18 bp, Artificial Sequence
  Synthetic DNA
tcatgcgacgcaatttcg

SEQ ID NO: 63292 - DNA, 18 bp, Artificial Sequence
  Synthetic DNA
tcatgcgattcaatattg

SEQ ID NO: 63293 - DNA, 18 bp, Artificial Sequence
  Synthetic DNA
tcatgctactaccaattg

SEQ ID NO: 63294 - DNA, 18 bp, Artificial Sequence
  Synthetic DNA
tcatgtgactaactaacg

SEQ ID NO: 63295 - DNA, 18 bp, Artificial Sequence
  Synthetic DNA
tcattagactcattttcg

SEQ ID NO: 63296 - DNA, 18 bp, Artificial Sequence
  Synthetic DNA
tcattagactctctcatg

SEQ ID NO: 63297 - DNA, 18 bp, Artificial Sequence
  Synthetic DNA
tcattagtctaaatacag

SEQ ID NO: 63298 - DNA, 18 bp, Artificial Sequence
  Synthetic DNA
tcattcaaattacgatag

SEQ ID NO: 63299 - DNA, 18 bp, Artificial Sequence
  Synthetic DNA
tcattcacctcactgaag

SEQ ID NO: 63300 - DNA, 18 bp, Artificial Sequence
  Synthetic DNA
tcattcgaatcacattag

SEQ ID NO: 63301 - DNA, 18 bp, Artificial Sequence
  Synthetic DNA
tcattcgactatatttag

SEQ ID NO: 63302 - DNA, 18 bp, Artificial Sequence
  Synthetic DNA
tcattcgacttaattgag

SEQ ID NO: 63303 - DNA, 18 bp, Artificial Sequence
  Synthetic DNA
tcattcgattctctaaag

SEQ ID NO: 63304 - DNA, 18 bp, Artificial Sequence
  Synthetic DNA
tcattcggctttctatag

SEQ ID NO: 63305 - DNA, 18 bp, Artificial Sequence
  Synthetic DNA
tcattcgtcgcaatattg

SEQ ID NO: 63306 - DNA, 18 bp, Artificial Sequence
  Synthetic DNA
tcattcgtctttttatag

SEQ ID NO: 63307 - DNA, 18 bp, Artificial Sequence
  Synthetic DNA
tcattcgtgtcacttaag

SEQ ID NO: 63308 - DNA, 18 bp, Artificial Sequence
  Synthetic DNA
tcattctactatctactg

SEQ ID NO: 63309 - DNA, 18 bp, Artificial Sequence
  Synthetic DNA
tcattctattcataattg

SEQ ID NO: 63310 - DNA, 18 bp, Artificial Sequence
  Synthetic DNA
tcattcttatcgctatag

SEQ ID NO: 63311 - DNA, 18 bp, Artificial Sequence
  Synthetic DNA
tccaaatatacattaatg

SEQ ID NO: 63312 - DNA, 18 bp, Artificial Sequence
  Synthetic DNA
tccaataactgtctacag

SEQ ID NO: 63313 - DNA, 18 bp, Artificial Sequence
  Synthetic DNA
tcccacatctcactcaag

SEQ ID NO: 63314 - DNA, 18 bp, Artificial Sequence
  Synthetic DNA
tcccactacccactatag

SEQ ID NO: 63315 - DNA, 18 bp, Artificial Sequence
  Synthetic DNA
tcctacgtctcattttag

SEQ ID NO: 63316 - DNA, 18 bp, Artificial Sequence
  Synthetic DNA
tcctaggactcaccaaag

SEQ ID NO: 63317 - DNA, 18 bp, Artificial Sequence
  Synthetic DNA
tcctatgactccctattg

SEQ ID NO: 63318 - DNA, 18 bp, Artificial Sequence
  Synthetic DNA
tcctatgacttaataaag

SEQ ID NO: 63319 - DNA, 18 bp, Artificial Sequence
  Synthetic DNA
tccttcgtcttacaatag

SEQ ID NO: 63320 - DNA, 18 bp, Artificial Sequence
  Synthetic DNA
tcgaacgtaacacgattg

SEQ ID NO: 63321 - DNA, 18 bp, Artificial Sequence
  Synthetic DNA
tcgaacgttttactttag

SEQ ID NO: 63322 - DNA, 18 bp, Artificial Sequence
  Synthetic DNA
tcgcaccatccacttttg

SEQ ID NO: 63323 - DNA, 18 bp, Artificial Sequence
  Synthetic DNA
tcgtaagccttcctaatg

SEQ ID NO: 63324 - DNA, 18 bp, Artificial Sequence
  Synthetic DNA
tcgtacgactgtgtaacg

SEQ ID NO: 63325 - DNA, 18 bp, Artificial Sequence
  Synthetic DNA
tcgtacgattctcaattg

SEQ ID NO: 63326 - DNA, 18 bp, Artificial Sequence
  Synthetic DNA
tcgtactcctcactaatg

SEQ ID NO: 63327 - DNA, 18 bp, Artificial Sequence
  Synthetic DNA
tcgttcgactaactattg

SEQ ID NO: 63328 - DNA, 18 bp, Artificial Sequence
  Synthetic DNA
tcgtttcattctctgtag

SEQ ID NO: 63329 - DNA, 18 bp, Artificial Sequence
  Synthetic DNA
tctaacaaatcactagag

SEQ ID NO: 63330 - DNA, 18 bp, Artificial Sequence
  Synthetic DNA
tctaacgactcacaaatg

SEQ ID NO: 63331 - DNA, 18 bp, Artificial Sequence
  Synthetic DNA
tctaacgagtcaccatag

SEQ ID NO: 63332 - DNA, 18 bp, Artificial Sequence
  Synthetic DNA
tctaacgattcaatatag

SEQ ID NO: 63333 - DNA, 18 bp, Artificial Sequence
  Synthetic DNA
tctcaagactccctatag

SEQ ID NO: 63334 - DNA, 18 bp, Artificial Sequence
  Synthetic DNA
tctgacgactaagtttag

SEQ ID NO: 63335 - DNA, 18 bp, Artificial Sequence
  Synthetic DNA
tctgtcgaatcattttag

SEQ ID NO: 63336 - DNA, 18 bp, Artificial Sequence
  Synthetic DNA
tcttaaaactcactaatg

SEQ ID NO: 63337 - DNA, 18 bp, Artificial Sequence
  Synthetic DNA
tcttaaggctcaccaaag

SEQ ID NO: 63338 - DNA, 18 bp, Artificial Sequence
  Synthetic DNA
tcttaagtcttttaatag

SEQ ID NO: 63339 - DNA, 18 bp, Artificial Sequence
  Synthetic DNA
tcttaattatcacgatag

SEQ ID NO: 63340 - DNA, 18 bp, Artificial Sequence
  Synthetic DNA
tcttacaactaacaatag

SEQ ID NO: 63341 - DNA, 18 bp, Artificial Sequence
  Synthetic DNA
tcttacatctcactattg

SEQ ID NO: 63342 - DNA, 18 bp, Artificial Sequence
  Synthetic DNA
tcttaccactcggtatag

SEQ ID NO: 63343 - DNA, 18 bp, Artificial Sequence
  Synthetic DNA
tcttacgactctttttag

SEQ ID NO: 63344 - DNA, 18 bp, Artificial Sequence
  Synthetic DNA
tcttacgactttctaaag

SEQ ID NO: 63345 - DNA, 18 bp, Artificial Sequence
  Synthetic DNA
tcttacgattaactttag

SEQ ID NO: 63346 - DNA, 18 bp, Artificial Sequence
  Synthetic DNA
tcttacgtctcgctaaag

SEQ ID NO: 63347 - DNA, 18 bp, Artificial Sequence
  Synthetic DNA
tcttactacactcttaag

SEQ ID NO: 63348 - DNA, 18 bp, Artificial Sequence
  Synthetic DNA
tcttagcactgtgtattg

SEQ ID NO: 63349 - DNA, 18 bp, Artificial Sequence
  Synthetic DNA
tcttatgactcgcgatag

SEQ ID NO: 63350 - DNA, 18 bp, Artificial Sequence
  Synthetic DNA
tcttattacactatatag

SEQ ID NO: 63351 - DNA, 18 bp, Artificial Sequence
  Synthetic DNA
tcttccgtgtcactatag

SEQ ID NO: 63352 - DNA, 18 bp, Artificial Sequence
  Synthetic DNA
tcttgcaactcaacacag

SEQ ID NO: 63353 - DNA, 18 bp, Artificial Sequence
  Synthetic DNA
tctttcgtcgcactatag

SEQ ID NO: 63354 - DNA, 18 bp, Artificial Sequence
  Synthetic DNA
tctttctgcctacttttg

SEQ ID NO: 63355 - DNA, 18 bp, Artificial Sequence
  Synthetic DNA
tgaaaagactccctttag

SEQ ID NO: 63356 - DNA, 18 bp, Artificial Sequence
  Synthetic DNA
tgaaaagtatgattatag

SEQ ID NO: 63357 - DNA, 18 bp, Artificial Sequence
  Synthetic DNA
tgaaacgactcttaatag

SEQ ID NO: 63358 - DNA, 18 bp, Artificial Sequence
  Synthetic DNA
tgaaacgtctatatatag

SEQ ID NO: 63359 - DNA, 18 bp, Artificial Sequence
  Synthetic DNA
tgaaacgtttcgctatag

SEQ ID NO: 63360 - DNA, 18 bp, Artificial Sequence
  Synthetic DNA
tgaaatgtcccatcatag

SEQ ID NO: 63361 - DNA, 18 bp, Artificial Sequence
  Synthetic DNA
tgaaatgtcttactatcg

SEQ ID NO: 63362 - DNA, 18 bp, Artificial Sequence
  Synthetic DNA
tgaaattattcactatag

SEQ ID NO: 63363 - DNA, 18 bp, Artificial Sequence
  Synthetic DNA
tgaatcaatccactaaag

SEQ ID NO: 63364 - DNA, 18 bp, Artificial Sequence
  Synthetic DNA
tgaatccgcactatatag

SEQ ID NO: 63365 - DNA, 18 bp, Artificial Sequence
  Synthetic DNA
tgaatcgactcactttgg

SEQ ID NO: 63366 - DNA, 18 bp, Artificial Sequence
  Synthetic DNA
tgaatcgagtcactaagg

SEQ ID NO: 63367 - DNA, 18 bp, Artificial Sequence
  Synthetic DNA
tgacacgtcccactactg

SEQ ID NO: 63368 - DNA, 18 bp, Artificial Sequence
  Synthetic DNA
tgacactacacactattg

SEQ ID NO: 63369 - DNA, 18 bp, Artificial Sequence
  Synthetic DNA
tgacactacacacttccg

SEQ ID NO: 63370 - DNA, 18 bp, Artificial Sequence
  Synthetic DNA
tgacactcatcactatag

SEQ ID NO: 63371 - DNA, 18 bp, Artificial Sequence
  Synthetic DNA
tgacacttctctcttaag

SEQ ID NO: 63372 - DNA, 18 bp, Artificial Sequence
  Synthetic DNA
tgaccagtttcattatcg

SEQ ID NO: 63373 - DNA, 18 bp, Artificial Sequence
  Synthetic DNA
tgactcgacacacaaaag

SEQ ID NO: 63374 - DNA, 18 bp, Artificial Sequence
  Synthetic DNA
tgagatgactctttttag

SEQ ID NO: 63375 - DNA, 18 bp, Artificial Sequence
  Synthetic DNA
tgagatgatacacttctg

SEQ ID NO: 63376 - DNA, 18 bp, Artificial Sequence
  Synthetic DNA
tgagtaggatcactatag

SEQ ID NO: 63377 - DNA, 18 bp, Artificial Sequence
  Synthetic DNA
tgataaaactcacatatg

SEQ ID NO: 63378 - DNA, 18 bp, Artificial Sequence
  Synthetic DNA
tgataacacacactttag

SEQ ID NO: 63379 - DNA, 18 bp, Artificial Sequence
  Synthetic DNA
tgataagacacgatattg

SEQ ID NO: 63380 - DNA, 18 bp, Artificial Sequence
  Synthetic DNA
tgataagacccacaaaag

SEQ ID NO: 63381 - DNA, 18 bp, Artificial Sequence
  Synthetic DNA
tgataagtttctctattg

SEQ ID NO: 63382 - DNA, 18 bp, Artificial Sequence
  Synthetic DNA
tgatacaaatctatttag

SEQ ID NO: 63383 - DNA, 18 bp, Artificial Sequence
  Synthetic DNA
tgatacctgtgactatag

SEQ ID NO: 63384 - DNA, 18 bp, Artificial Sequence
  Synthetic DNA
tgatacgaaccacttaag

SEQ ID NO: 63385 - DNA, 18 bp, Artificial Sequence
  Synthetic DNA
tgatacgaataagagtag

SEQ ID NO: 63386 - DNA, 18 bp, Artificial Sequence
  Synthetic DNA
tgatacgacacatttttg

SEQ ID NO: 63387 - DNA, 18 bp, Artificial Sequence
  Synthetic DNA
tgatacgactaccaattg

SEQ ID NO: 63388 - DNA, 18 bp, Artificial Sequence
  Synthetic DNA
tgatacgccctatcattg

SEQ ID NO: 63389 - DNA, 18 bp, Artificial Sequence
  Synthetic DNA
tgatacggctttccattg

SEQ ID NO: 63390 - DNA, 18 bp, Artificial Sequence
  Synthetic DNA
tgatacgtcatatattcg

SEQ ID NO: 63391 - DNA, 18 bp, Artificial Sequence
  Synthetic DNA
tgatacgtctcaatgttg

SEQ ID NO: 63392 - DNA, 18 bp, Artificial Sequence
  Synthetic DNA
tgatacgtttgaccttag

SEQ ID NO: 63393 - DNA, 18 bp, Artificial Sequence
  Synthetic DNA
tgataggacagtctgttg

SEQ ID NO: 63394 - DNA, 18 bp, Artificial Sequence
  Synthetic DNA
tgataggactcaataagg

SEQ ID NO: 63395 - DNA, 18 bp, Artificial Sequence
  Synthetic DNA
tgataggactctcactag

SEQ ID NO: 63396 - DNA, 18 bp, Artificial Sequence
  Synthetic DNA
tgataggccttactcaag

SEQ ID NO: 63397 - DNA, 18 bp, Artificial Sequence
  Synthetic DNA
tgatatcaatctctatag

SEQ ID NO: 63398 - DNA, 18 bp, Artificial Sequence
  Synthetic DNA
tgatattatatactgtag

SEQ ID NO: 63399 - DNA, 18 bp, Artificial Sequence
  Synthetic DNA
tgatcaaactcactatgg

SEQ ID NO: 63400 - DNA, 18 bp, Artificial Sequence
  Synthetic DNA
tgatcagaatttcaatag

SEQ ID NO: 63401 - DNA, 18 bp, Artificial Sequence
  Synthetic DNA
tgatccgacacagtaaag

SEQ ID NO: 63402 - DNA, 18 bp, Artificial Sequence
  Synthetic DNA
tgatccgacacgctaaag

SEQ ID NO: 63403 - DNA, 18 bp, Artificial Sequence
  Synthetic DNA
tgatccgtctctatatag

SEQ ID NO: 63404 - DNA, 18 bp, Artificial Sequence
  Synthetic DNA
tgatccgtctcttaatag

SEQ ID NO: 63405 - DNA, 18 bp, Artificial Sequence
  Synthetic DNA
tgatctgactcacagtag

SEQ ID NO: 63406 - DNA, 18 bp, Artificial Sequence
  Synthetic DNA
tgatcttgctcacaatgg

SEQ ID NO: 63407 - DNA, 18 bp, Artificial Sequence
  Synthetic DNA
tgatgccattctctttag

SEQ ID NO: 63408 - DNA, 18 bp, Artificial Sequence
  Synthetic DNA
tgatgggactaggtctag

SEQ ID NO: 63409 - DNA, 18 bp, Artificial Sequence
  Synthetic DNA
tgattactctaactatag

SEQ ID NO: 63410 - DNA, 18 bp, Artificial Sequence
  Synthetic DNA
tgattcaaattacttaag

SEQ ID NO: 63411 - DNA, 18 bp, Artificial Sequence
  Synthetic DNA
tgattcaacacaccatag

SEQ ID NO: 63412 - DNA, 18 bp, Artificial Sequence
  Synthetic DNA
tgattccatttactatag

SEQ ID NO: 63413 - DNA, 18 bp, Artificial Sequence
  Synthetic DNA
tgattcgaatatctatcg

SEQ ID NO: 63414 - DNA, 18 bp, Artificial Sequence
  Synthetic DNA
tgattcgacaccatatag

SEQ ID NO: 63415 - DNA, 18 bp, Artificial Sequence
  Synthetic DNA
tgattcgacattctatag

SEQ ID NO: 63416 - DNA, 18 bp, Artificial Sequence
  Synthetic DNA
tgattcgacgccctctgg

SEQ ID NO: 63417 - DNA, 18 bp, Artificial Sequence
  Synthetic DNA
tgattcgactcacacttg

SEQ ID NO: 63418 - DNA, 18 bp, Artificial Sequence
  Synthetic DNA
tgattttactctctatag

SEQ ID NO: 63419 - DNA, 18 bp, Artificial Sequence
  Synthetic DNA
tgctacgacacattaaag

SEQ ID NO: 63420 - DNA, 18 bp, Artificial Sequence
  Synthetic DNA
tgctacgcctaactacag

SEQ ID NO: 63421 - DNA, 18 bp, Artificial Sequence
  Synthetic DNA
tgctacgtaacactatag

SEQ ID NO: 63422 - DNA, 18 bp, Artificial Sequence
  Synthetic DNA
tgctactacacattacag

SEQ ID NO: 63423 - DNA, 18 bp, Artificial Sequence
  Synthetic DNA
tgctactccagagtatag

SEQ ID NO: 63424 - DNA, 18 bp, Artificial Sequence
  Synthetic DNA
tggaaccactcctaatag

SEQ ID NO: 63425 - DNA, 18 bp, Artificial Sequence
  Synthetic DNA
tggaacgacttactgttg

SEQ ID NO: 63426 - DNA, 18 bp, Artificial Sequence
  Synthetic DNA
tggaacgattcgtaaaag

SEQ ID NO: 63427 - DNA, 18 bp, Artificial Sequence
  Synthetic DNA
tggagcgtcttaccatag

SEQ ID NO: 63428 - DNA, 18 bp, Artificial Sequence
  Synthetic DNA
tggtaagattcagtatag

SEQ ID NO: 63429 - DNA, 18 bp, Artificial Sequence
  Synthetic DNA
tggtaccacttccttcag

SEQ ID NO: 63430 - DNA, 18 bp, Artificial Sequence
  Synthetic DNA
tggtatgccgcattccag

SEQ ID NO: 63431 - DNA, 18 bp, Artificial Sequence
  Synthetic DNA
tggttcgactctctttag

SEQ ID NO: 63432 - DNA, 18 bp, Artificial Sequence
  Synthetic DNA
tgtaaagccacactatag

SEQ ID NO: 63433 - DNA, 18 bp, Artificial Sequence
  Synthetic DNA
tgtaacgagtcattatag

SEQ ID NO: 63434 - DNA, 18 bp, Artificial Sequence
  Synthetic DNA
tgtcacaactctctattg

SEQ ID NO: 63435 - DNA, 18 bp, Artificial Sequence
  Synthetic DNA
tgtcacgtctgcttacag

SEQ ID NO: 63436 - DNA, 18 bp, Artificial Sequence
  Synthetic DNA
tgttaagactcgttatag

SEQ ID NO: 63437 - DNA, 18 bp, Artificial Sequence
  Synthetic DNA
tgttaatactcagaatag

SEQ ID NO: 63438 - DNA, 18 bp, Artificial Sequence
  Synthetic DNA
tgttacaactcacaattg

SEQ ID NO: 63439 - DNA, 18 bp, Artificial Sequence
  Synthetic DNA
tgttacaacttactggtg

SEQ ID NO: 63440 - DNA, 18 bp, Artificial Sequence
  Synthetic DNA
tgttaccactaactctag

SEQ ID NO: 63441 - DNA, 18 bp, Artificial Sequence
  Synthetic DNA
tgttacgtatgactaatg

SEQ ID NO: 63442 - DNA, 18 bp, Artificial Sequence
  Synthetic DNA
tgttaggactcattgtag

SEQ ID NO: 63443 - DNA, 18 bp, Artificial Sequence
  Synthetic DNA
tgttaggcatgccttgag

SEQ ID NO: 63444 - DNA, 18 bp, Artificial Sequence
  Synthetic DNA
tgttagggctcactaaag

SEQ ID NO: 63445 - DNA, 18 bp, Artificial Sequence
  Synthetic DNA
tgttatgactctatcttg

SEQ ID NO: 63446 - DNA, 18 bp, Artificial Sequence
  Synthetic DNA
tgttcagacgatctaaag

SEQ ID NO: 63447 - DNA, 18 bp, Artificial Sequence
  Synthetic DNA
tgttcagactcactaaag

SEQ ID NO: 63448 - DNA, 18 bp, Artificial Sequence
  Synthetic DNA
tgttcagacttcctttag

SEQ ID NO: 63449 - DNA, 18 bp, Artificial Sequence
  Synthetic DNA
tgtttcaacaaacaatag

SEQ ID NO: 63450 - DNA, 18 bp, Artificial Sequence
  Synthetic DNA
tgtttcaactcactattg

SEQ ID NO: 63451 - DNA, 18 bp, Artificial Sequence
  Synthetic DNA
tgtttcgactctcaaccg

SEQ ID NO: 63452 - DNA, 18 bp, Artificial Sequence
  Synthetic DNA
tgtttcgatttactatag

SEQ ID NO: 63453 - DNA, 18 bp, Artificial Sequence
  Synthetic DNA
tgtttcttataactatag

SEQ ID NO: 63454 - DNA, 18 bp, Artificial Sequence
  Synthetic DNA
tgttttaactcacaatag

SEQ ID NO: 63455 - DNA, 18 bp, Artificial Sequence
  Synthetic DNA
ttaaaagcctccctacag

SEQ ID NO: 63456 - DNA, 18 bp, Artificial Sequence
  Synthetic DNA
ttaaacaacacagtattg

SEQ ID NO: 63457 - DNA, 18 bp, Artificial Sequence
  Synthetic DNA
ttaaacaattcgctgtag

SEQ ID NO: 63458 - DNA, 18 bp, Artificial Sequence
  Synthetic DNA
ttaaaccactctatatag

SEQ ID NO: 63459 - DNA, 18 bp, Artificial Sequence
  Synthetic DNA
ttaaacgaatcacgatcg

SEQ ID NO: 63460 - DNA, 18 bp, Artificial Sequence
  Synthetic DNA
ttaaacgacccattatgg

SEQ ID NO: 63461 - DNA, 18 bp, Artificial Sequence
  Synthetic DNA
ttaaacgaccgtctcttg

SEQ ID NO: 63462 - DNA, 18 bp, Artificial Sequence
  Synthetic DNA
ttaaacgacgctctaatg

SEQ ID NO: 63463 - DNA, 18 bp, Artificial Sequence
  Synthetic DNA
ttaaacgactaaataaag

SEQ ID NO: 63464 - DNA, 18 bp, Artificial Sequence
  Synthetic DNA
ttaaacgactaactcaag

SEQ ID NO: 63465 - DNA, 18 bp, Artificial Sequence
  Synthetic DNA
ttaaacgactcatgaaag

SEQ ID NO: 63466 - DNA, 18 bp, Artificial Sequence
  Synthetic DNA
ttaaacgactcatttcag

SEQ ID NO: 63467 - DNA, 18 bp, Artificial Sequence
  Synthetic DNA
ttaaacgactcccaacgg

SEQ ID NO: 63468 - DNA, 18 bp, Artificial Sequence
  Synthetic DNA
ttaaacgactctcttatg

SEQ ID NO: 63469 - DNA, 18 bp, Artificial Sequence
  Synthetic DNA
ttaaacgatacactaaag

SEQ ID NO: 63470 - DNA, 18 bp, Artificial Sequence
  Synthetic DNA
ttaaacgccacagtagtg

SEQ ID NO: 63471 - DNA, 18 bp, Artificial Sequence
  Synthetic DNA
ttaaacgccttgctattg

SEQ ID NO: 63472 - DNA, 18 bp, Artificial Sequence
  Synthetic DNA
ttaaacggctcataattg

SEQ ID NO: 63473 - DNA, 18 bp, Artificial Sequence
  Synthetic DNA
ttaaactacttactattg

SEQ ID NO: 63474 - DNA, 18 bp, Artificial Sequence
  Synthetic DNA
ttaaactattcattaatg

SEQ ID NO: 63475 - DNA, 18 bp, Artificial Sequence
  Synthetic DNA
ttaaataactcaatatag

SEQ ID NO: 63476 - DNA, 18 bp, Artificial Sequence
  Synthetic DNA
ttaaatgtctcacgaccg

SEQ ID NO: 63477 - DNA, 18 bp, Artificial Sequence
  Synthetic DNA
ttaaattactcaatttag

SEQ ID NO: 63478 - DNA, 18 bp, Artificial Sequence
  Synthetic DNA
ttaaccgacagactatag

SEQ ID NO: 63479 - DNA, 18 bp, Artificial Sequence
  Synthetic DNA
ttaaccgactcactaatg

SEQ ID NO: 63480 - DNA, 18 bp, Artificial Sequence
  Synthetic DNA
ttaaccgcaccactatag

SEQ ID NO: 63481 - DNA, 18 bp, Artificial Sequence
  Synthetic DNA
ttaagcaacttattatag

SEQ ID NO: 63482 - DNA, 18 bp, Artificial Sequence
  Synthetic DNA
ttaagcgactagctatag

SEQ ID NO: 63483 - DNA, 18 bp, Artificial Sequence
  Synthetic DNA
ttaagcgactcactaagg

SEQ ID NO: 63484 - DNA, 18 bp, Artificial Sequence
  Synthetic DNA
ttaagcgagtctctattg

SEQ ID NO: 63485 - DNA, 18 bp, Artificial Sequence
  Synthetic DNA
ttaatattctcactatcg

SEQ ID NO: 63486 - DNA, 18 bp, Artificial Sequence
  Synthetic DNA
ttaatcatttcactttgg

SEQ ID NO: 63487 - DNA, 18 bp, Artificial Sequence
  Synthetic DNA
ttaatcgaataactacag

SEQ ID NO: 63488 - DNA, 18 bp, Artificial Sequence
  Synthetic DNA
ttaatcgactatctttag

SEQ ID NO: 63489 - DNA, 18 bp, Artificial Sequence
  Synthetic DNA
ttaatcgacttactattg

SEQ ID NO: 63490 - DNA, 18 bp, Artificial Sequence
  Synthetic DNA
ttaatcgagtctctatag

SEQ ID NO: 63491 - DNA, 18 bp, Artificial Sequence
  Synthetic DNA
ttaatctacattcaatag

SEQ ID NO: 63492 - DNA, 18 bp, Artificial Sequence
  Synthetic DNA
ttaattaacccactaaag

SEQ ID NO: 63493 - DNA, 18 bp, Artificial Sequence
  Synthetic DNA
ttacacgaatcactaatg

SEQ ID NO: 63494 - DNA, 18 bp, Artificial Sequence
  Synthetic DNA
ttacacgacacattaaag

SEQ ID NO: 63495 - DNA, 18 bp, Artificial Sequence
  Synthetic DNA
ttacactacacgctatag

SEQ ID NO: 63496 - DNA, 18 bp, Artificial Sequence
  Synthetic DNA
ttacactacttcattttg

SEQ ID NO: 63497 - DNA, 18 bp, Artificial Sequence
  Synthetic DNA
ttacatcactctttaaag

SEQ ID NO: 63498 - DNA, 18 bp, Artificial Sequence
  Synthetic DNA
ttacctgtcactcaaaag

SEQ ID NO: 63499 - DNA, 18 bp, Artificial Sequence
  Synthetic DNA
ttacgagactcactttag

SEQ ID NO: 63500 - DNA, 18 bp, Artificial Sequence
  Synthetic DNA
ttactatagtcactatgg

SEQ ID NO: 63501 - DNA, 18 bp, Artificial Sequence
  Synthetic DNA
ttactccattcactttag

SEQ ID NO: 63502 - DNA, 18 bp, Artificial Sequence
  Synthetic DNA
ttactcgacccacaatgg

SEQ ID NO: 63503 - DNA, 18 bp, Artificial Sequence
  Synthetic DNA
ttagacgacccaatctag

SEQ ID NO: 63504 - DNA, 18 bp, Artificial Sequence
  Synthetic DNA
ttagactagacgcgatag

SEQ ID NO: 63505 - DNA, 18 bp, Artificial Sequence
  Synthetic DNA
ttaggctacacagtgaag

SEQ ID NO: 63506 - DNA, 18 bp, Artificial Sequence
  Synthetic DNA
ttataaaaccaattatag

SEQ ID NO: 63507 - DNA, 18 bp, Artificial Sequence
  Synthetic DNA
ttataaatccaactatag

SEQ ID NO: 63508 - DNA, 18 bp, Artificial Sequence
  Synthetic DNA
ttataacattcacaaaag

SEQ ID NO: 63509 - DNA, 18 bp, Artificial Sequence
  Synthetic DNA
ttataactatgtgaatag

SEQ ID NO: 63510 - DNA, 18 bp, Artificial Sequence
  Synthetic DNA
ttataagacacaaattag

SEQ ID NO: 63511 - DNA, 18 bp, Artificial Sequence
  Synthetic DNA
ttataagacaccatatag

SEQ ID NO: 63512 - DNA, 18 bp, Artificial Sequence
  Synthetic DNA
ttataagagtcaggatag

SEQ ID NO: 63513 - DNA, 18 bp, Artificial Sequence
  Synthetic DNA
ttataagccaccctattg

SEQ ID NO: 63514 - DNA, 18 bp, Artificial Sequence
  Synthetic DNA
ttataagtctcgctttag

SEQ ID NO: 63515 - DNA, 18 bp, Artificial Sequence
  Synthetic DNA
ttataatactccttatag

SEQ ID NO: 63516 - DNA, 18 bp, Artificial Sequence
  Synthetic DNA
ttatacaaatctttatag

SEQ ID NO: 63517 - DNA, 18 bp, Artificial Sequence
  Synthetic DNA
ttatacaacacaatttag

SEQ ID NO: 63518 - DNA, 18 bp, Artificial Sequence
  Synthetic DNA
ttatacaacactctttag

SEQ ID NO: 63519 - DNA, 18 bp, Artificial Sequence
  Synthetic DNA
ttatacaactcaataatg

SEQ ID NO: 63520 - DNA, 18 bp, Artificial Sequence
  Synthetic DNA
ttatacaactgactactg

SEQ ID NO: 63521 - DNA, 18 bp, Artificial Sequence
  Synthetic DNA
ttatacacatcgatatgg

SEQ ID NO: 63522 - DNA, 18 bp, Artificial Sequence
  Synthetic DNA
ttatacacctctctattg

SEQ ID NO: 63523 - DNA, 18 bp, Artificial Sequence
  Synthetic DNA
ttataccacaccccagag

SEQ ID NO: 63524 - DNA, 18 bp, Artificial Sequence
  Synthetic DNA
ttatacctatcactaaag

SEQ ID NO: 63525 - DNA, 18 bp, Artificial Sequence
  Synthetic DNA
ttatacctttctcttgag

SEQ ID NO: 63526 - DNA, 18 bp, Artificial Sequence
  Synthetic DNA
ttatacgaacgactttag

SEQ ID NO: 63527 - DNA, 18 bp, Artificial Sequence
  Synthetic DNA
ttatacgaatcgctctgg

SEQ ID NO: 63528 - DNA, 18 bp, Artificial Sequence
  Synthetic DNA
ttatacgaattcatttcg

SEQ ID NO: 63529 - DNA, 18 bp, Artificial Sequence
  Synthetic DNA
ttatacgacagactttgg

SEQ ID NO: 63530 - DNA, 18 bp, Artificial Sequence
  Synthetic DNA
ttatacgactcgcataaa

SEQ ID NO: 63531 - DNA, 18 bp, Artificial Sequence
  Synthetic DNA
ttatacgactcgcctatg

SEQ ID NO: 63532 - DNA, 18 bp, Artificial Sequence
  Synthetic DNA
ttatacgactctcacttg

SEQ ID NO: 63533 - DNA, 18 bp, Artificial Sequence
  Synthetic DNA
ttatacgactttccctcg

SEQ ID NO: 63534 - DNA, 18 bp, Artificial Sequence
  Synthetic DNA
ttatacgagcctctttag

SEQ ID NO: 63535 - DNA, 18 bp, Artificial Sequence
  Synthetic DNA
ttatacgagtatctttag

SEQ ID NO: 63536 - DNA, 18 bp, Artificial Sequence
  Synthetic DNA
ttatacgataaaccatag

SEQ ID NO: 63537 - DNA, 18 bp, Artificial Sequence
  Synthetic DNA
ttatacgatccgctattg

SEQ ID NO: 63538 - DNA, 18 bp, Artificial Sequence
  Synthetic DNA
ttatacgatcctcaagag

SEQ ID NO: 63539 - DNA, 18 bp, Artificial Sequence
  Synthetic DNA
ttatacgattacatattg

SEQ ID NO: 63540 - DNA, 18 bp, Artificial Sequence
  Synthetic DNA
ttatacgattcaatgaag

SEQ ID NO: 63541 - DNA, 18 bp, Artificial Sequence
  Synthetic DNA
ttatacgattctccattg

SEQ ID NO: 63542 - DNA, 18 bp, Artificial Sequence
  Synthetic DNA
ttatacgcccaattatag

SEQ ID NO: 63543 - DNA, 18 bp, Artificial Sequence
  Synthetic DNA
ttatacgcctcacttatg

SEQ ID NO: 63544 - DNA, 18 bp, Artificial Sequence
  Synthetic DNA
ttatacgcctcagtaatg

SEQ ID NO: 63545 - DNA, 18 bp, Artificial Sequence
  Synthetic DNA
ttatacgccttcctttag

SEQ ID NO: 63546 - DNA, 18 bp, Artificial Sequence
  Synthetic DNA
ttatacggatcacaaatg

SEQ ID NO: 63547 - DNA, 18 bp, Artificial Sequence
  Synthetic DNA
ttatacggcaaactatgg

SEQ ID NO: 63548 - DNA, 18 bp, Artificial Sequence
  Synthetic DNA
ttatacggcttactgttg

SEQ ID NO: 63549 - DNA, 18 bp, Artificial Sequence
  Synthetic DNA
ttatacggctttttatag

SEQ ID NO: 63550 - DNA, 18 bp, Artificial Sequence
  Synthetic DNA
ttatacggtttcctttcg

SEQ ID NO: 63551 - DNA, 18 bp, Artificial Sequence
  Synthetic DNA
ttatacgtatcacttagg

SEQ ID NO: 63552 - DNA, 18 bp, Artificial Sequence
  Synthetic DNA
ttatacgtatcgctatcg

SEQ ID NO: 63553 - DNA, 18 bp, Artificial Sequence
  Synthetic DNA
ttatacgtcacagactag

SEQ ID NO: 63554 - DNA, 18 bp, Artificial Sequence
  Synthetic DNA
ttatacgtcagaccatag

SEQ ID NO: 63555 - DNA, 18 bp, Artificial Sequence
  Synthetic DNA
ttatacgtcatactgtag

SEQ ID NO: 63556 - DNA, 18 bp, Artificial Sequence
  Synthetic DNA
ttatacgtctaaattaag

SEQ ID NO: 63557 - DNA, 18 bp, Artificial Sequence
  Synthetic DNA
ttatacgtctatctacag

SEQ ID NO: 63558 - DNA, 18 bp, Artificial Sequence
  Synthetic DNA
ttatacgtctcagtccag

SEQ ID NO: 63559 - DNA, 18 bp, Artificial Sequence
  Synthetic DNA
ttatacgtctcgcaaaag

SEQ ID NO: 63560 - DNA, 18 bp, Artificial Sequence
  Synthetic DNA
ttatacgtctttcaatcg

SEQ ID NO: 63561 - DNA, 18 bp, Artificial Sequence
  Synthetic DNA
ttatacgtgccatttttg

SEQ ID NO: 63562 - DNA, 18 bp, Artificial Sequence
  Synthetic DNA
ttatacgtttcactatca

SEQ ID NO: 63563 - DNA, 18 bp, Artificial Sequence
  Synthetic DNA
ttatactactaccgatcg

SEQ ID NO: 63564 - DNA, 18 bp, Artificial Sequence
  Synthetic DNA
ttatactactcacttagg

SEQ ID NO: 63565 - DNA, 18 bp, Artificial Sequence
  Synthetic DNA
ttatactactcagttttg

SEQ ID NO: 63566 - DNA, 18 bp, Artificial Sequence
  Synthetic DNA
ttatactactctttattg

SEQ ID NO: 63567 - DNA, 18 bp, Artificial Sequence
  Synthetic DNA
ttatactagtcattgtgg

SEQ ID NO: 63568 - DNA, 18 bp, Artificial Sequence
  Synthetic DNA
ttatactattatataaag

SEQ ID NO: 63569 - DNA, 18 bp, Artificial Sequence
  Synthetic DNA
ttatactattcattaaag

SEQ ID NO: 63570 - DNA, 18 bp, Artificial Sequence
  Synthetic DNA
ttatactattctctaaag

SEQ ID NO: 63571 - DNA, 18 bp, Artificial Sequence
  Synthetic DNA
ttatactcgtcactgtag

SEQ ID NO: 63572 - DNA, 18 bp, Artificial Sequence
  Synthetic DNA
ttatacttcaaactaaag

SEQ ID NO: 63573 - DNA, 18 bp, Artificial Sequence
  Synthetic DNA
ttatacttctcattatcg

SEQ ID NO: 63574 - DNA, 18 bp, Artificial Sequence
  Synthetic DNA
ttatagaactcactgaag

SEQ ID NO: 63575 - DNA, 18 bp, Artificial Sequence
  Synthetic DNA
ttatagagctcactttag

SEQ ID NO: 63576 - DNA, 18 bp, Artificial Sequence
  Synthetic DNA
ttataggacaaactatgg

SEQ ID NO: 63577 - DNA, 18 bp, Artificial Sequence
  Synthetic DNA
ttataggacagacactag

SEQ ID NO: 63578 - DNA, 18 bp, Artificial Sequence
  Synthetic DNA
ttataggacccacattag

SEQ ID NO: 63579 - DNA, 18 bp, Artificial Sequence
  Synthetic DNA
ttataggactagttattg

SEQ ID NO: 63580 - DNA, 18 bp, Artificial Sequence
  Synthetic DNA
ttataggactctcaaaag

SEQ ID NO: 63581 - DNA, 18 bp, Artificial Sequence
  Synthetic DNA
ttataggatactctttag

SEQ ID NO: 63582 - DNA, 18 bp, Artificial Sequence
  Synthetic DNA
ttatataacacgaaatag

SEQ ID NO: 63583 - DNA, 18 bp, Artificial Sequence
  Synthetic DNA
ttatataacactcaattg

SEQ ID NO: 63584 - DNA, 18 bp, Artificial Sequence
  Synthetic DNA
ttatataactcaatttag

SEQ ID NO: 63585 - DNA, 18 bp, Artificial Sequence
  Synthetic DNA
ttatataactctctattg

SEQ ID NO: 63586 - DNA, 18 bp, Artificial Sequence
  Synthetic DNA
ttatataactctctgttg

SEQ ID NO: 63587 - DNA, 18 bp, Artificial Sequence
  Synthetic DNA
ttatataacttatagtag

SEQ ID NO: 63588 - DNA, 18 bp, Artificial Sequence
  Synthetic DNA
ttatatcactaaatatgg

SEQ ID NO: 63589 - DNA, 18 bp, Artificial Sequence
  Synthetic DNA
ttatatctctcactatgg

SEQ ID NO: 63590 - DNA, 18 bp, Artificial Sequence
  Synthetic DNA
ttatatgaagcactaaag

SEQ ID NO: 63591 - DNA, 18 bp, Artificial Sequence
  Synthetic DNA
ttatatgactcacttatg

SEQ ID NO: 63592 - DNA, 18 bp, Artificial Sequence
  Synthetic DNA
ttatatgatctcctatag

SEQ ID NO: 63593 - DNA, 18 bp, Artificial Sequence
  Synthetic DNA
ttatatggctaactaaag

SEQ ID NO: 63594 - DNA, 18 bp, Artificial Sequence
  Synthetic DNA
ttatatgtcttactttag

SEQ ID NO: 63595 - DNA, 18 bp, Artificial Sequence
  Synthetic DNA
ttatatgtttcactacag

SEQ ID NO: 63596 - DNA, 18 bp, Artificial Sequence
  Synthetic DNA
ttatatgtttcagaacag

SEQ ID NO: 63597 - DNA, 18 bp, Artificial Sequence
  Synthetic DNA
ttatattacttacaaaag

SEQ ID NO: 63598 - DNA, 18 bp, Artificial Sequence
  Synthetic DNA
ttatcacactttcaacag

SEQ ID NO: 63599 - DNA, 18 bp, Artificial Sequence
  Synthetic DNA
ttatcagaatcactactg

SEQ ID NO: 63600 - DNA, 18 bp, Artificial Sequence
  Synthetic DNA
ttatcagactaatgtttg

SEQ ID NO: 63601 - DNA, 18 bp, Artificial Sequence
  Synthetic DNA
ttatccatatcacaaaag

SEQ ID NO: 63602 - DNA, 18 bp, Artificial Sequence
  Synthetic DNA
ttatcccaatcacaacgg

SEQ ID NO: 63603 - DNA, 18 bp, Artificial Sequence
  Synthetic DNA
ttatccgactcaatttcg

SEQ ID NO: 63604 - DNA, 18 bp, Artificial Sequence
  Synthetic DNA
ttatccgcctccgttcag

SEQ ID NO: 63605 - DNA, 18 bp, Artificial Sequence
  Synthetic DNA
ttatccgcctgagtatag

SEQ ID NO: 63606 - DNA, 18 bp, Artificial Sequence
  Synthetic DNA
ttatccgcgtcaccaaag

SEQ ID NO: 63607 - DNA, 18 bp, Artificial Sequence
  Synthetic DNA
ttatcctcctcatcattg

SEQ ID NO: 63608 - DNA, 18 bp, Artificial Sequence
  Synthetic DNA
ttatctgaatcactatcg

SEQ ID NO: 63609 - DNA, 18 bp, Artificial Sequence
  Synthetic DNA
ttatcttattcactattg

SEQ ID NO: 63610 - DNA, 18 bp, Artificial Sequence
  Synthetic DNA
ttatgaatcttaccattg

SEQ ID NO: 63611 - DNA, 18 bp, Artificial Sequence
  Synthetic DNA
ttatgagactctttatag

SEQ ID NO: 63612 - DNA, 18 bp, Artificial Sequence
  Synthetic DNA
ttatgcaacacagtatag

SEQ ID NO: 63613 - DNA, 18 bp, Artificial Sequence
  Synthetic DNA
ttatgcgactcgcaactg

SEQ ID NO: 63614 - DNA, 18 bp, Artificial Sequence
  Synthetic DNA
ttatgcgactctaaatag

SEQ ID NO: 63615 - DNA, 18 bp, Artificial Sequence
  Synthetic DNA
ttatgcgacttacttttg

SEQ ID NO: 63616 - DNA, 18 bp, Artificial Sequence
  Synthetic DNA
ttatgcgattcataatag

SEQ ID NO: 63617 - DNA, 18 bp, Artificial Sequence
  Synthetic DNA
ttatgcggctttctaatg

SEQ ID NO: 63618 - DNA, 18 bp, Artificial Sequence
  Synthetic DNA
ttatgcgtatcactaaag

SEQ ID NO: 63619 - DNA, 18 bp, Artificial Sequence
  Synthetic DNA
ttatgcgtcaatctttag

SEQ ID NO: 63620 - DNA, 18 bp, Artificial Sequence
  Synthetic DNA
ttatgctatgcaccttag

SEQ ID NO: 63621 - DNA, 18 bp, Artificial Sequence
  Synthetic DNA
ttatgcttctctctatag

SEQ ID NO: 63622 - DNA, 18 bp, Artificial Sequence
  Synthetic DNA
ttatgtgactcgctattg

SEQ ID NO: 63623 - DNA, 18 bp, Artificial Sequence
  Synthetic DNA
ttattagaatcactaaag

SEQ ID NO: 63624 - DNA, 18 bp, Artificial Sequence
  Synthetic DNA
ttattagacccactaatg

SEQ ID NO: 63625 - DNA, 18 bp, Artificial Sequence
  Synthetic DNA
ttattagagtcatgaaag

SEQ ID NO: 63626 - DNA, 18 bp, Artificial Sequence
  Synthetic DNA
ttattagcctcactaaag

SEQ ID NO: 63627 - DNA, 18 bp, Artificial Sequence
  Synthetic DNA
ttattattctctctatag

SEQ ID NO: 63628 - DNA, 18 bp, Artificial Sequence
  Synthetic DNA
ttattcaattcacaattg

SEQ ID NO: 63629 - DNA, 18 bp, Artificial Sequence
  Synthetic DNA
ttattcacctgactatag

SEQ ID NO: 63630 - DNA, 18 bp, Artificial Sequence
  Synthetic DNA
ttattccactcattagtg

SEQ ID NO: 63631 - DNA, 18 bp, Artificial Sequence
  Synthetic DNA
ttattccactcggtatag

SEQ ID NO: 63632 - DNA, 18 bp, Artificial Sequence
  Synthetic DNA
ttattccacttacaatag

SEQ ID NO: 63633 - DNA, 18 bp, Artificial Sequence
  Synthetic DNA
ttattccagtcaccattg

SEQ ID NO: 63634 - DNA, 18 bp, Artificial Sequence
  Synthetic DNA
ttattcgaaacattatag

SEQ ID NO: 63635 - DNA, 18 bp, Artificial Sequence
  Synthetic DNA
ttattcgacaccctattg

SEQ ID NO: 63636 - DNA, 18 bp, Artificial Sequence
  Synthetic DNA
ttattcgactcatattag

SEQ ID NO: 63637 - DNA, 18 bp, Artificial Sequence
  Synthetic DNA
ttattcgactcgatattg

SEQ ID NO: 63638 - DNA, 18 bp, Artificial Sequence
  Synthetic DNA
ttattcgagcctctccaa

SEQ ID NO: 63639 - DNA, 18 bp, Artificial Sequence
  Synthetic DNA
ttattcgatacacaatag

SEQ ID NO: 63640 - DNA, 18 bp, Artificial Sequence
  Synthetic DNA
ttattcgattcataaatg

SEQ ID NO: 63641 - DNA, 18 bp, Artificial Sequence
  Synthetic DNA
ttattcgattcgttttag

SEQ ID NO: 63642 - DNA, 18 bp, Artificial Sequence
  Synthetic DNA
ttattcgcctcaattgtg

SEQ ID NO: 63643 - DNA, 18 bp, Artificial Sequence
  Synthetic DNA
ttattcgtataaatattg

SEQ ID NO: 63644 - DNA, 18 bp, Artificial Sequence
  Synthetic DNA
ttattcgtatcaatattg

SEQ ID NO: 63645 - DNA, 18 bp, Artificial Sequence
  Synthetic DNA
ttattcgtccaagtatag

SEQ ID NO: 63646 - DNA, 18 bp, Artificial Sequence
  Synthetic DNA
ttattcgtcccactacag

SEQ ID NO: 63647 - DNA, 18 bp, Artificial Sequence
  Synthetic DNA
ttattcgtctatctaaag

SEQ ID NO: 63648 - DNA, 18 bp, Artificial Sequence
  Synthetic DNA
ttattcgtctcatcttag

SEQ ID NO: 63649 - DNA, 18 bp, Artificial Sequence
  Synthetic DNA
ttattcgtttcactagag

SEQ ID NO: 63650 - DNA, 18 bp, Artificial Sequence
  Synthetic DNA
ttattctacacaatattg

SEQ ID NO: 63651 - DNA, 18 bp, Artificial Sequence
  Synthetic DNA
ttattctacgcaatattg

SEQ ID NO: 63652 - DNA, 18 bp, Artificial Sequence
  Synthetic DNA
ttattctactaactaaag

SEQ ID NO: 63653 - DNA, 18 bp, Artificial Sequence
  Synthetic DNA
ttattctagacactaaag

SEQ ID NO: 63654 - DNA, 18 bp, Artificial Sequence
  Synthetic DNA
ttattctatacgcaattg

SEQ ID NO: 63655 - DNA, 18 bp, Artificial Sequence
  Synthetic DNA
ttattctcctcactattg

SEQ ID NO: 63656 - DNA, 18 bp, Artificial Sequence
  Synthetic DNA
ttattcttctaattttag

SEQ ID NO: 63657 - DNA, 18 bp, Artificial Sequence
  Synthetic DNA
ttattggacttattatag

SEQ ID NO: 63658 - DNA, 18 bp, Artificial Sequence
  Synthetic DNA
ttatttcaatcactacag

SEQ ID NO: 63659 - DNA, 18 bp, Artificial Sequence
  Synthetic DNA
ttatttgaatagctttag

SEQ ID NO: 63660 - DNA, 18 bp, Artificial Sequence
  Synthetic DNA
ttatttgacccactattg

SEQ ID NO: 63661 - DNA, 18 bp, Artificial Sequence
  Synthetic DNA
ttatttgtcttactatag

SEQ ID NO: 63662 - DNA, 18 bp, Artificial Sequence
  Synthetic DNA
ttatttttctcactatag

SEQ ID NO: 63663 - DNA, 18 bp, Artificial Sequence
  Synthetic DNA
ttcaacgacacactacag

SEQ ID NO: 63664 - DNA, 18 bp, Artificial Sequence
  Synthetic DNA
ttcatcgtcactcttctg

SEQ ID NO: 63665 - DNA, 18 bp, Artificial Sequence
  Synthetic DNA
ttcattggctcactatag

SEQ ID NO: 63666 - DNA, 18 bp, Artificial Sequence
  Synthetic DNA
ttccggtaccttctacag

SEQ ID NO: 63667 - DNA, 18 bp, Artificial Sequence
  Synthetic DNA
ttctaatactcactagag

SEQ ID NO: 63668 - DNA, 18 bp, Artificial Sequence
  Synthetic DNA
ttctacaactaactttag

SEQ ID NO: 63669 - DNA, 18 bp, Artificial Sequence
  Synthetic DNA
ttctaccccacactaagg

SEQ ID NO: 63670 - DNA, 18 bp, Artificial Sequence
  Synthetic DNA
ttctacgaaactcaatag

SEQ ID NO: 63671 - DNA, 18 bp, Artificial Sequence
  Synthetic DNA
ttctacgacaaccaatag

SEQ ID NO: 63672 - DNA, 18 bp, Artificial Sequence
  Synthetic DNA
ttctacgactctgaatag

SEQ ID NO: 63673 - DNA, 18 bp, Artificial Sequence
  Synthetic DNA
ttctacgatccacattag

SEQ ID NO: 63674 - DNA, 18 bp, Artificial Sequence
  Synthetic DNA
ttctacgattctctaacg

SEQ ID NO: 63675 - DNA, 18 bp, Artificial Sequence
  Synthetic DNA
ttctaggacttcctacag

SEQ ID NO: 63676 - DNA, 18 bp, Artificial Sequence
  Synthetic DNA
ttctgcgtctcactttag

SEQ ID NO: 63677 - DNA, 18 bp, Artificial Sequence
  Synthetic DNA
ttcttcgtctaacattag

SEQ ID NO: 63678 - DNA, 18 bp, Artificial Sequence
  Synthetic DNA
ttcttcgtcttactatag

SEQ ID NO: 63679 - DNA, 18 bp, Artificial Sequence
  Synthetic DNA
ttcttggtctccacatag

SEQ ID NO: 63680 - DNA, 18 bp, Artificial Sequence
  Synthetic DNA
ttgaacgacactctattg

SEQ ID NO: 63681 - DNA, 18 bp, Artificial Sequence
  Synthetic DNA
ttgaacgactcacttttg

SEQ ID NO: 63682 - DNA, 18 bp, Artificial Sequence
  Synthetic DNA
ttgaacgactccctacag

SEQ ID NO: 63683 - DNA, 18 bp, Artificial Sequence
  Synthetic DNA
ttgaacgactctctacag

SEQ ID NO: 63684 - DNA, 18 bp, Artificial Sequence
  Synthetic DNA
ttgaacgctactctatag

SEQ ID NO: 63685 - DNA, 18 bp, Artificial Sequence
  Synthetic DNA
ttgagcgactgtctactg

SEQ ID NO: 63686 - DNA, 18 bp, Artificial Sequence
  Synthetic DNA
ttgatcgtctcattatag

SEQ ID NO: 63687 - DNA, 18 bp, Artificial Sequence
  Synthetic DNA
ttgcacgtttctcaatag

SEQ ID NO: 63688 - DNA, 18 bp, Artificial Sequence
  Synthetic DNA
ttgtaagtttcaatatag

SEQ ID NO: 63689 - DNA, 18 bp, Artificial Sequence
  Synthetic DNA
ttgtacccctcgctttag

SEQ ID NO: 63690 - DNA, 18 bp, Artificial Sequence
  Synthetic DNA
ttgtacgacactctaaag

SEQ ID NO: 63691 - DNA, 18 bp, Artificial Sequence
  Synthetic DNA
ttgtacgactcacaccag

SEQ ID NO: 63692 - DNA, 18 bp, Artificial Sequence
  Synthetic DNA
ttgtacgactcgatttag

SEQ ID NO: 63693 - DNA, 18 bp, Artificial Sequence
  Synthetic DNA
ttgtacgactgaattgag

SEQ ID NO: 63694 - DNA, 18 bp, Artificial Sequence
  Synthetic DNA
ttgtacgacttacttttg

SEQ ID NO: 63695 - DNA, 18 bp, Artificial Sequence
  Synthetic DNA
ttgtacgacttagtagag

SEQ ID NO: 63696 - DNA, 18 bp, Artificial Sequence
  Synthetic DNA
ttgtacgatgcacagttg

SEQ ID NO: 63697 - DNA, 18 bp, Artificial Sequence
  Synthetic DNA
ttgtacgccacataatag

SEQ ID NO: 63698 - DNA, 18 bp, Artificial Sequence
  Synthetic DNA
ttgtacgtctcataattg

SEQ ID NO: 63699 - DNA, 18 bp, Artificial Sequence
  Synthetic DNA
ttgtactactaactgtag

SEQ ID NO: 63700 - DNA, 18 bp, Artificial Sequence
  Synthetic DNA
ttgtagcgctctatgtag

SEQ ID NO: 63701 - DNA, 18 bp, Artificial Sequence
  Synthetic DNA
ttgtatcattcactcttg

SEQ ID NO: 63702 - DNA, 18 bp, Artificial Sequence
  Synthetic DNA
ttgtccgactcactttcg

SEQ ID NO: 63703 - DNA, 18 bp, Artificial Sequence
  Synthetic DNA
ttgtccggctcacaatcg

SEQ ID NO: 63704 - DNA, 18 bp, Artificial Sequence
  Synthetic DNA
ttgtccgttccactatag

SEQ ID NO: 63705 - DNA, 18 bp, Artificial Sequence
  Synthetic DNA
ttgttcgactcacataag

SEQ ID NO: 63706 - DNA, 18 bp, Artificial Sequence
  Synthetic DNA
ttgttcgtctcaggcatg

SEQ ID NO: 63707 - DNA, 18 bp, Artificial Sequence
  Synthetic DNA
ttgtttggctctcataag

SEQ ID NO: 63708 - DNA, 18 bp, Artificial Sequence
  Synthetic DNA
tttaaaaactaactatag

SEQ ID NO: 63709 - DNA, 18 bp, Artificial Sequence
  Synthetic DNA
tttaaagactcattatag

SEQ ID NO: 63710 - DNA, 18 bp, Artificial Sequence
  Synthetic DNA
tttaaatactcacttttg

SEQ ID NO: 63711 - DNA, 18 bp, Artificial Sequence
  Synthetic DNA
tttaacaaatcccaatag

SEQ ID NO: 63712 - DNA, 18 bp, Artificial Sequence
  Synthetic DNA
tttaacaactcagtaaag

SEQ ID NO: 63713 - DNA, 18 bp, Artificial Sequence
  Synthetic DNA
tttaacaactgactatag

SEQ ID NO: 63714 - DNA, 18 bp, Artificial Sequence
  Synthetic DNA
tttaacgactcatgattg

SEQ ID NO: 63715 - DNA, 18 bp, Artificial Sequence
  Synthetic DNA
tttaacgttttacaacgg

SEQ ID NO: 63716 - DNA, 18 bp, Artificial Sequence
  Synthetic DNA
tttaaggactaactatag

SEQ ID NO: 63717 - DNA, 18 bp, Artificial Sequence
  Synthetic DNA
tttaagtactctctgtcg

SEQ ID NO: 63718 - DNA, 18 bp, Artificial Sequence
  Synthetic DNA
tttaatgacagactatgg

SEQ ID NO: 63719 - DNA, 18 bp, Artificial Sequence
  Synthetic DNA
tttaatgactctctatcg

SEQ ID NO: 63720 - DNA, 18 bp, Artificial Sequence
  Synthetic DNA
tttaattacacgctattg

SEQ ID NO: 63721 - DNA, 18 bp, Artificial Sequence
  Synthetic DNA
tttaccgactcgctatag

SEQ ID NO: 63722 - DNA, 18 bp, Artificial Sequence
  Synthetic DNA
tttaccgtttcacagtag

SEQ ID NO: 63723 - DNA, 18 bp, Artificial Sequence
  Synthetic DNA
tttagcaactcacttcag

SEQ ID NO: 63724 - DNA, 18 bp, Artificial Sequence
  Synthetic DNA
tttcaagcctctctaaag

SEQ ID NO: 63725 - DNA, 18 bp, Artificial Sequence
  Synthetic DNA
tttcacgaatttcttcag

SEQ ID NO: 63726 - DNA, 18 bp, Artificial Sequence
  Synthetic DNA
tttcacgagtcataatag

SEQ ID NO: 63727 - DNA, 18 bp, Artificial Sequence
  Synthetic DNA
tttcacgattcaatatcg

SEQ ID NO: 63728 - DNA, 18 bp, Artificial Sequence
  Synthetic DNA
tttcacgattcattatag

SEQ ID NO: 63729 - DNA, 18 bp, Artificial Sequence
  Synthetic DNA
tttcactactctccatag

SEQ ID NO: 63730 - DNA, 18 bp, Artificial Sequence
  Synthetic DNA
tttcatgacacattatag

SEQ ID NO: 63731 - DNA, 18 bp, Artificial Sequence
  Synthetic DNA
tttctaaaattacttcgg

SEQ ID NO: 63732 - DNA, 18 bp, Artificial Sequence
  Synthetic DNA
tttctcaactctctcttg

SEQ ID NO: 63733 - DNA, 18 bp, Artificial Sequence
  Synthetic DNA
tttctcgaatcactttag

SEQ ID NO: 63734 - DNA, 18 bp, Artificial Sequence
  Synthetic DNA
tttgtagactcacattgg

SEQ ID NO: 63735 - DNA, 18 bp, Artificial Sequence
  Synthetic DNA
ttttaagacacattatag

SEQ ID NO: 63736 - DNA, 18 bp, Artificial Sequence
  Synthetic DNA
ttttaagactagctacag

SEQ ID NO: 63737 - DNA, 18 bp, Artificial Sequence
  Synthetic DNA
ttttaatactctgaattg

SEQ ID NO: 63738 - DNA, 18 bp, Artificial Sequence
  Synthetic DNA
ttttacaactgattaaag

SEQ ID NO: 63739 - DNA, 18 bp, Artificial Sequence
  Synthetic DNA
ttttacaagtctctatag

SEQ ID NO: 63740 - DNA, 18 bp, Artificial Sequence
  Synthetic DNA
ttttacacctcactttag

SEQ ID NO: 63741 - DNA, 18 bp, Artificial Sequence
  Synthetic DNA
ttttacatctgaatatag

SEQ ID NO: 63742 - DNA, 18 bp, Artificial Sequence
  Synthetic DNA
ttttaccactctttatag

SEQ ID NO: 63743 - DNA, 18 bp, Artificial Sequence
  Synthetic DNA
ttttaccagcctcaatag

SEQ ID NO: 63744 - DNA, 18 bp, Artificial Sequence
  Synthetic DNA
ttttacgacacaacatag

SEQ ID NO: 63745 - DNA, 18 bp, Artificial Sequence
  Synthetic DNA
ttttacgacactcaatag

SEQ ID NO: 63746 - DNA, 18 bp, Artificial Sequence
  Synthetic DNA
ttttacgaccaaatatag

SEQ ID NO: 63747 - DNA, 18 bp, Artificial Sequence
  Synthetic DNA
ttttacgacttacaaaag

SEQ ID NO: 63748 - DNA, 18 bp, Artificial Sequence
  Synthetic DNA
ttttacgcctcacactag

SEQ ID NO: 63749 - DNA, 18 bp, Artificial Sequence
  Synthetic DNA
ttttacgcctcacattag

SEQ ID NO: 63750 - DNA, 18 bp, Artificial Sequence
  Synthetic DNA
ttttacggctaactactg

SEQ ID NO: 63751 - DNA, 18 bp, Artificial Sequence
  Synthetic DNA
ttttacggctctttatag

SEQ ID NO: 63752 - DNA, 18 bp, Artificial Sequence
  Synthetic DNA
ttttactcattccttttg

SEQ ID NO: 63753 - DNA, 18 bp, Artificial Sequence
  Synthetic DNA
ttttacttgtcaccattg

SEQ ID NO: 63754 - DNA, 18 bp, Artificial Sequence
  Synthetic DNA
ttttatgactcacattag

SEQ ID NO: 63755 - DNA, 18 bp, Artificial Sequence
  Synthetic DNA
ttttatgactgactttag

SEQ ID NO: 63756 - DNA, 18 bp, Artificial Sequence
  Synthetic DNA
ttttatgtctgaatgttg

SEQ ID NO: 63757 - DNA, 18 bp, Artificial Sequence
  Synthetic DNA
ttttattactcactgtag

SEQ ID NO: 63758 - DNA, 18 bp, Artificial Sequence
  Synthetic DNA
ttttatttaacatttttg

SEQ ID NO: 63759 - DNA, 18 bp, Artificial Sequence
  Synthetic DNA
ttttccgacacactattg

SEQ ID NO: 63760 - DNA, 18 bp, Artificial Sequence
  Synthetic DNA
ttttccttcgctaaaatg

SEQ ID NO: 63761 - DNA, 18 bp, Artificial Sequence
  Synthetic DNA
ttttgagactaacaatag

SEQ ID NO: 63762 - DNA, 18 bp, Artificial Sequence
  Synthetic DNA
ttttgcgaaacactatag

SEQ ID NO: 63763 - DNA, 18 bp, Artificial Sequence
  Synthetic DNA
tttttcctcacactatcg

SEQ ID NO: 63764 - DNA, 18 bp, Artificial Sequence
  Synthetic DNA
tttttcgacacactattg

SEQ ID NO: 63765 - DNA, 18 bp, Artificial Sequence
  Synthetic DNA
tttttcgactcactgaag

SEQ ID NO: 63766 - DNA, 18 bp, Artificial Sequence
  Synthetic DNA
tttttcgtctatctatag

SEQ ID NO: 63767 - DNA, 18 bp, Artificial Sequence
  Synthetic DNA
tttttctacaaaattctg

SEQ ID NO: 63768 - DNA, 18 bp, Artificial Sequence
  Synthetic DNA
taatcaggctccctattg

SEQ ID NO: 63769 - DNA, 18 bp, Artificial Sequence
  Synthetic DNA
aaatgcgactcatatttg

SEQ ID NO: 63770 - DNA, 18 bp, Artificial Sequence
  Synthetic DNA
aacacagtgtcactatag

SEQ ID NO: 63771 - DNA, 18 bp, Artificial Sequence
  Synthetic DNA
aattagcacttactaatg

SEQ ID NO: 63772 - DNA, 18 bp, Artificial Sequence
  Synthetic DNA
aatttctacccactatag

SEQ ID NO: 63773 - DNA, 18 bp, Artificial Sequence
  Synthetic DNA
agataccatgcactattg

SEQ ID NO: 63774 - DNA, 18 bp, Artificial Sequence
  Synthetic DNA
agattacactcactatag

SEQ ID NO: 63775 - DNA, 18 bp, Artificial Sequence
  Synthetic DNA
atatacgacttaataaag

SEQ ID NO: 63776 - DNA, 18 bp, Artificial Sequence
  Synthetic DNA
atatacgtcacatgatag

SEQ ID NO: 63777 - DNA, 18 bp, Artificial Sequence
  Synthetic DNA
atttaccaaactttctgg

SEQ ID NO: 63778 - DNA, 18 bp, Artificial Sequence
  Synthetic DNA
atttacgattctctattg

SEQ ID NO: 63779 - DNA, 18 bp, Artificial Sequence
  Synthetic DNA
caatactactcaatgcag

SEQ ID NO: 63780 - DNA, 18 bp, Artificial Sequence
  Synthetic DNA
caatcaaaccctttttag

SEQ ID NO: 63781 - DNA, 18 bp, Artificial Sequence
  Synthetic DNA
cataataactcactatag

SEQ ID NO: 63782 - DNA, 18 bp, Artificial Sequence
  Synthetic DNA
ctatgctagtcgcataag

SEQ ID NO: 63783 - DNA, 18 bp, Artificial Sequence
  Synthetic DNA
taaaaagtctctttatag

SEQ ID NO: 63784 - DNA, 18 bp, Artificial Sequence
  Synthetic DNA
taaacagtttcagtattg

SEQ ID NO: 63785 - DNA, 18 bp, Artificial Sequence
  Synthetic DNA
taaagcaactgtctagag

SEQ ID NO: 63786 - DNA, 18 bp, Artificial Sequence
  Synthetic DNA
taaatgttaccgctatag

SEQ ID NO: 63787 - DNA, 18 bp, Artificial Sequence
  Synthetic DNA
taactcgtgtcactcaag

SEQ ID NO: 63788 - DNA, 18 bp, Artificial Sequence
  Synthetic DNA
taagacgtctgactaatg

SEQ ID NO: 63789 - DNA, 18 bp, Artificial Sequence
  Synthetic DNA
taatacgacattgtaaag

SEQ ID NO: 63790 - DNA, 18 bp, Artificial Sequence
  Synthetic DNA
taatacgtaacactttgg

SEQ ID NO: 63791 - DNA, 18 bp, Artificial Sequence
  Synthetic DNA
taatactattttctttag

SEQ ID NO: 63792 - DNA, 18 bp, Artificial Sequence
  Synthetic DNA
taatatctctcattaaag

SEQ ID NO: 63793 - DNA, 18 bp, Artificial Sequence
  Synthetic DNA
taatatgtctctataacg

SEQ ID NO: 63794 - DNA, 18 bp, Artificial Sequence
  Synthetic DNA
taatctgatccgatatag

SEQ ID NO: 63795 - DNA, 18 bp, Artificial Sequence
  Synthetic DNA
taatgcaactatccatag

SEQ ID NO: 63796 - DNA, 18 bp, Artificial Sequence
  Synthetic DNA
taatgcatctaactgttg

SEQ ID NO: 63797 - DNA, 18 bp, Artificial Sequence
  Synthetic DNA
taattcaacgaaatctag

SEQ ID NO: 63798 - DNA, 18 bp, Artificial Sequence
  Synthetic DNA
taatttttcttactatag

SEQ ID NO: 63799 - DNA, 18 bp, Artificial Sequence
  Synthetic DNA
tacaacgaaccagtttag

SEQ ID NO: 63800 - DNA, 18 bp, Artificial Sequence
  Synthetic DNA
tacttcgacactctattg

SEQ ID NO: 63801 - DNA, 18 bp, Artificial Sequence
  Synthetic DNA
tataacgacacactaacg

SEQ ID NO: 63802 - DNA, 18 bp, Artificial Sequence
  Synthetic DNA
tataatgacgtataatag

SEQ ID NO: 63803 - DNA, 18 bp, Artificial Sequence
  Synthetic DNA
tatatccacacactatag

SEQ ID NO: 63804 - DNA, 18 bp, Artificial Sequence
  Synthetic DNA
tatatcgacaaactatag

SEQ ID NO: 63805 - DNA, 18 bp, Artificial Sequence
  Synthetic DNA
tatatcgactgactctag

SEQ ID NO: 63806 - DNA, 18 bp, Artificial Sequence
  Synthetic DNA
tatctcgaattactattg

SEQ ID NO: 63807 - DNA, 18 bp, Artificial Sequence
  Synthetic DNA
tattacaaatcaatatcg

SEQ ID NO: 63808 - DNA, 18 bp, Artificial Sequence
  Synthetic DNA
tattacatctcagtatcg

SEQ ID NO: 63809 - DNA, 18 bp, Artificial Sequence
  Synthetic DNA
tattacgactccttctcg

SEQ ID NO: 63810 - DNA, 18 bp, Artificial Sequence
  Synthetic DNA
tatttctacttaatatag

SEQ ID NO: 63811 - DNA, 18 bp, Artificial Sequence
  Synthetic DNA
tcacatgacacactaaag

SEQ ID NO: 63812 - DNA, 18 bp, Artificial Sequence
  Synthetic DNA
tcatacgatccacaattg

SEQ ID NO: 63813 - DNA, 18 bp, Artificial Sequence
  Synthetic DNA
tcgtactactcacaattg

SEQ ID NO: 63814 - DNA, 18 bp, Artificial Sequence
  Synthetic DNA
tgatactagtttctatag

SEQ ID NO: 63815 - DNA, 18 bp, Artificial Sequence
  Synthetic DNA
tgatccgccacacaatag

SEQ ID NO: 63816 - DNA, 18 bp, Artificial Sequence
  Synthetic DNA
ttacttgtctcactatag

SEQ ID NO: 63817 - DNA, 18 bp, Artificial Sequence
  Synthetic DNA
ttatacgaaccaccttag

SEQ ID NO: 63818 - DNA, 18 bp, Artificial Sequence
  Synthetic DNA
ttatacgacatgaaatag

SEQ ID NO: 63819 - DNA, 18 bp, Artificial Sequence
  Synthetic DNA
ttatacgattctcttttg

SEQ ID NO: 63820 - DNA, 18 bp, Artificial Sequence
  Synthetic DNA
ttatacgtgtaattattg

SEQ ID NO: 63821 - DNA, 18 bp, Artificial Sequence
  Synthetic DNA
ttatatgacaaactacag

SEQ ID NO: 63822 - DNA, 18 bp, Artificial Sequence
  Synthetic DNA
ttcaacgtctctctatag

SEQ ID NO: 63823 - DNA, 18 bp, Artificial Sequence
  Synthetic DNA
ttttttcactcactttag

SEQ ID NO: 63824 - DNA, 18 bp, Artificial Sequence
  Synthetic DNA
ttttcctactcactttag

SEQ ID NO: 63825 - DNA, 18 bp, Artificial Sequence
  Synthetic DNA
tataactactcattattg

SEQ ID NO: 63826 - DNA, 18 bp, Artificial Sequence
  Synthetic DNA
attaacgactcaaaaaag

SEQ ID NO: 63827 - DNA, 18 bp, Artificial Sequence
  Synthetic DNA
ctatacgtctcacaaaag

SEQ ID NO: 63828 - DNA, 18 bp, Artificial Sequence
  Synthetic DNA
taattcgaatctcttcag

SEQ ID NO: 63829 - DNA, 18 bp, Artificial Sequence
  Synthetic DNA
tcttatctctcactatag

SEQ ID NO: 63830 - DNA, 18 bp, Artificial Sequence
  Synthetic DNA
ttatacgtctctcaaaag

SEQ ID NO: 63831 - DNA, 18 bp, Artificial Sequence
  Synthetic DNA
aaacccgccgcagtatag

SEQ ID NO: 63832 - DNA, 18 bp, Artificial Sequence
  Synthetic DNA
aaatacgattctctaatg

SEQ ID NO: 63833 - DNA, 18 bp, Artificial Sequence
  Synthetic DNA
aaatacgcctctgtatcg

SEQ ID NO: 63834 - DNA, 18 bp, Artificial Sequence
  Synthetic DNA
aaatatatctcactttag

SEQ ID NO: 63835 - DNA, 18 bp, Artificial Sequence
  Synthetic DNA
aaattcgactcgcttttg

SEQ ID NO: 63836 - DNA, 18 bp, Artificial Sequence
  Synthetic DNA
aagtccaactcactgtag

SEQ ID NO: 63837 - DNA, 18 bp, Artificial Sequence
  Synthetic DNA
aatttcgactctttatag

SEQ ID NO: 63838 - DNA, 18 bp, Artificial Sequence
  Synthetic DNA
acattcgactcttaatag

SEQ ID NO: 63839 - DNA, 18 bp, Artificial Sequence
  Synthetic DNA
atatccgactcgctcaag

SEQ ID NO: 63840 - DNA, 18 bp, Artificial Sequence
  Synthetic DNA
atattcgacacactttag

SEQ ID NO: 63841 - DNA, 18 bp, Artificial Sequence
  Synthetic DNA
atgtaccactgactatag

SEQ ID NO: 63842 - DNA, 18 bp, Artificial Sequence
  Synthetic DNA
caatacgacactactaag

SEQ ID NO: 63843 - DNA, 18 bp, Artificial Sequence
  Synthetic DNA
caatacgtcgagctattg

SEQ ID NO: 63844 - DNA, 18 bp, Artificial Sequence
  Synthetic DNA
caatgcgtctctctattg

SEQ ID NO: 63845 - DNA, 18 bp, Artificial Sequence
  Synthetic DNA
ccgaataagtcactatag

SEQ ID NO: 63846 - DNA, 18 bp, Artificial Sequence
  Synthetic DNA
ctttaagactcattaaag

SEQ ID NO: 63847 - DNA, 18 bp, Artificial Sequence
  Synthetic DNA
taaaacgatacacactag

SEQ ID NO: 63848 - DNA, 18 bp, Artificial Sequence
  Synthetic DNA
taacacgtctctcttttg

SEQ ID NO: 63849 - DNA, 18 bp, Artificial Sequence
  Synthetic DNA
taataccaattaatttag

SEQ ID NO: 63850 - DNA, 18 bp, Artificial Sequence
  Synthetic DNA
taatacgtttttctcttg

SEQ ID NO: 63851 - DNA, 18 bp, Artificial Sequence
  Synthetic DNA
taatgcgtaccagttaag

SEQ ID NO: 63852 - DNA, 18 bp, Artificial Sequence
  Synthetic DNA
taattctagtcactaatg

SEQ ID NO: 63853 - DNA, 18 bp, Artificial Sequence
  Synthetic DNA
taatttgtctctatatag

SEQ ID NO: 63854 - DNA, 18 bp, Artificial Sequence
  Synthetic DNA
taattttactctctttag

SEQ ID NO: 63855 - DNA, 18 bp, Artificial Sequence
  Synthetic DNA
tagtacgtcttacaacag

SEQ ID NO: 63856 - DNA, 18 bp, Artificial Sequence
  Synthetic DNA
tataacatctcactttag

SEQ ID NO: 63857 - DNA, 18 bp, Artificial Sequence
  Synthetic DNA
tatagggactctcaatag

SEQ ID NO: 63858 - DNA, 18 bp, Artificial Sequence
  Synthetic DNA
tatatctactaactatag

SEQ ID NO: 63859 - DNA, 18 bp, Artificial Sequence
  Synthetic DNA
tatgtcggcccactaatg

SEQ ID NO: 63860 - DNA, 18 bp, Artificial Sequence
  Synthetic DNA
tattacgtcacactttcg

SEQ ID NO: 63861 - DNA, 18 bp, Artificial Sequence
  Synthetic DNA
tcaaccgactctctattg

SEQ ID NO: 63862 - DNA, 18 bp, Artificial Sequence
  Synthetic DNA
tcataacgacaactcttg

SEQ ID NO: 63863 - DNA, 18 bp, Artificial Sequence
  Synthetic DNA
tcttacgacatactttag

SEQ ID NO: 63864 - DNA, 18 bp, Artificial Sequence
  Synthetic DNA
tctttcgactcactttcg

SEQ ID NO: 63865 - DNA, 18 bp, Artificial Sequence
  Synthetic DNA
tgatacgtcccattaaag

SEQ ID NO: 63866 - DNA, 18 bp, Artificial Sequence
  Synthetic DNA
tgttacgactcacataag

SEQ ID NO: 63867 - DNA, 18 bp, Artificial Sequence
  Synthetic DNA
tgttacgattctctattg

SEQ ID NO: 63868 - DNA, 18 bp, Artificial Sequence
  Synthetic DNA
ttaaacgtctaactatgg

SEQ ID NO: 63869 - DNA, 18 bp, Artificial Sequence
  Synthetic DNA
ttagacttctccctatag

SEQ ID NO: 63870 - DNA, 18 bp, Artificial Sequence
  Synthetic DNA
ttataccattcagtgtag

SEQ ID NO: 63871 - DNA, 18 bp, Artificial Sequence
  Synthetic DNA
ttatacgtcgcacatttg

SEQ ID NO: 63872 - DNA, 18 bp, Artificial Sequence
  Synthetic DNA
ttatactaatcactaatg

SEQ ID NO: 63873 - DNA, 18 bp, Artificial Sequence
  Synthetic DNA
ttattcaacttaccatag

SEQ ID NO: 63874 - DNA, 18 bp, Artificial Sequence
  Synthetic DNA
ttattcgactatcgatag

SEQ ID NO: 63875 - DNA, 18 bp, Artificial Sequence
  Synthetic DNA
ttattcgactcaactttg

SEQ ID NO: 63876 - DNA, 18 bp, Artificial Sequence
  Synthetic DNA
ttattcgactcacaaatg

SEQ ID NO: 63877 - DNA, 18 bp, Artificial Sequence
  Synthetic DNA
ttcgactacttactttag

SEQ ID NO: 63878 - DNA, 18 bp, Artificial Sequence
  Synthetic DNA
ttctaagaatcactaaag

SEQ ID NO: 63879 - DNA, 18 bp, Artificial Sequence
  Synthetic DNA
ttgtacgagtctctgtcg

SEQ ID NO: 63880 - DNA, 18 bp, Artificial Sequence
  Synthetic DNA
tttatcaactctctatag

SEQ ID NO: 63881 - DNA, 18 bp, Artificial Sequence
  Synthetic DNA
tttctcgactctctatag

SEQ ID NO: 63882 - DNA, 18 bp, Artificial Sequence
  Synthetic DNA
ttttacgactcacaactg

SEQ ID NO: 63883 - DNA, 18 bp, Artificial Sequence
  Synthetic DNA
ttttacgttccactaaag

SEQ ID NO: 63884 - DNA, 18 bp, Artificial Sequence
  Synthetic DNA
ttttacgtttctctatag

SEQ ID NO: 63885 - DNA, 18 bp, Artificial Sequence
  Synthetic DNA
aaaaaagatttactatag

SEQ ID NO: 63886 - DNA, 18 bp, Artificial Sequence
  Synthetic DNA
aaaaacgaccctcaaaag

SEQ ID NO: 63887 - DNA, 18 bp, Artificial Sequence
  Synthetic DNA
aaaaacgactctcttgag

SEQ ID NO: 63888 - DNA, 18 bp, Artificial Sequence
  Synthetic DNA
aaaaacgattctcaaaag

SEQ ID NO: 63889 - DNA, 18 bp, Artificial Sequence
  Synthetic DNA
aaaaactacactctattg

SEQ ID NO: 63890 - DNA, 18 bp, Artificial Sequence
  Synthetic DNA
aaaaatcactctctatag

SEQ ID NO: 63891 - DNA, 18 bp, Artificial Sequence
  Synthetic DNA
aaaacacactcactatag

SEQ ID NO: 63892 - DNA, 18 bp, Artificial Sequence
  Synthetic DNA
aaaacagtcttactatag

SEQ ID NO: 63893 - DNA, 18 bp, Artificial Sequence
  Synthetic DNA
aaaaccgattcactcttg

SEQ ID NO: 63894 - DNA, 18 bp, Artificial Sequence
  Synthetic DNA
aaaactgactaactttag

SEQ ID NO: 63895 - DNA, 18 bp, Artificial Sequence
  Synthetic DNA
aaaagcaacacactatag

SEQ ID NO: 63896 - DNA, 18 bp, Artificial Sequence
  Synthetic DNA
aaaagcgactctctaaag

SEQ ID NO: 63897 - DNA, 18 bp, Artificial Sequence
  Synthetic DNA
aaaatcaaatctctatag

SEQ ID NO: 63898 - DNA, 18 bp, Artificial Sequence
  Synthetic DNA
aaaatcgtctaactttag

SEQ ID NO: 63899 - DNA, 18 bp, Artificial Sequence
  Synthetic DNA
aaacacaattcaatgttg

SEQ ID NO: 63900 - DNA, 18 bp, Artificial Sequence
  Synthetic DNA
aaacacatcacactacag

SEQ ID NO: 63901 - DNA, 18 bp, Artificial Sequence
  Synthetic DNA
aaacacgtaatacaattg

SEQ ID NO: 63902 - DNA, 18 bp, Artificial Sequence
  Synthetic DNA
aaacacgtctaagaattg

SEQ ID NO: 63903 - DNA, 18 bp, Artificial Sequence
  Synthetic DNA
aaacacgtttcactacag

SEQ ID NO: 63904 - DNA, 18 bp, Artificial Sequence
  Synthetic DNA
aaacagaactcgctattg

SEQ ID NO: 63905 - DNA, 18 bp, Artificial Sequence
  Synthetic DNA
aaacaggcctcactaaag

SEQ ID NO: 63906 - DNA, 18 bp, Artificial Sequence
  Synthetic DNA
aaacatgcatcatttaag

SEQ ID NO: 63907 - DNA, 18 bp, Artificial Sequence
  Synthetic DNA
aaaccctaatcacttttg

SEQ ID NO: 63908 - DNA, 18 bp, Artificial Sequence
  Synthetic DNA
aaactcgacacaatttag

SEQ ID NO: 63909 - DNA, 18 bp, Artificial Sequence
  Synthetic DNA
aaactcgactcaacattg

SEQ ID NO: 63910 - DNA, 18 bp, Artificial Sequence
  Synthetic DNA
aaactgtactcacaatgg

SEQ ID NO: 63911 - DNA, 18 bp, Artificial Sequence
  Synthetic DNA
aaactttactcgcattag

SEQ ID NO: 63912 - DNA, 18 bp, Artificial Sequence
  Synthetic DNA
aaagacgaacctctatag

SEQ ID NO: 63913 - DNA, 18 bp, Artificial Sequence
  Synthetic DNA
aaagacgagtcacaattg

SEQ ID NO: 63914 - DNA, 18 bp, Artificial Sequence
  Synthetic DNA
aaagacgatttagttaag

SEQ ID NO: 63915 - DNA, 18 bp, Artificial Sequence
  Synthetic DNA
aaagactaatctcgtttg

SEQ ID NO: 63916 - DNA, 18 bp, Artificial Sequence
  Synthetic DNA
aaagactattcaatatag

SEQ ID NO: 63917 - DNA, 18 bp, Artificial Sequence
  Synthetic DNA
aaagtagactatctaaag

SEQ ID NO: 63918 - DNA, 18 bp, Artificial Sequence
  Synthetic DNA
aaataaaactcattattg

SEQ ID NO: 63919 - DNA, 18 bp, Artificial Sequence
  Synthetic DNA
aaataagacacataatcg

SEQ ID NO: 63920 - DNA, 18 bp, Artificial Sequence
  Synthetic DNA
aaataagactcaagaaag

SEQ ID NO: 63921 - DNA, 18 bp, Artificial Sequence
  Synthetic DNA
aaataagattcacttaag

SEQ ID NO: 63922 - DNA, 18 bp, Artificial Sequence
  Synthetic DNA
aaataagtatcactattg

SEQ ID NO: 63923 - DNA, 18 bp, Artificial Sequence
  Synthetic DNA
aaataatacttactttag

SEQ ID NO: 63924 - DNA, 18 bp, Artificial Sequence
  Synthetic DNA
aaataatatacattattg

SEQ ID NO: 63925 - DNA, 18 bp, Artificial Sequence
  Synthetic DNA
aaatacaaatcattacag

SEQ ID NO: 63926 - DNA, 18 bp, Artificial Sequence
  Synthetic DNA
aaatacaaatctctattg

SEQ ID NO: 63927 - DNA, 18 bp, Artificial Sequence
  Synthetic DNA
aaatacaacaaacaatag

SEQ ID NO: 63928 - DNA, 18 bp, Artificial Sequence
  Synthetic DNA
aaatacaacacacttcag

SEQ ID NO: 63929 - DNA, 18 bp, Artificial Sequence
  Synthetic DNA
aaatacaagtcaataaag

SEQ ID NO: 63930 - DNA, 18 bp, Artificial Sequence
  Synthetic DNA
aaatacacatgactatag

SEQ ID NO: 63931 - DNA, 18 bp, Artificial Sequence
  Synthetic DNA
aaatacagctcacgctgg

SEQ ID NO: 63932 - DNA, 18 bp, Artificial Sequence
  Synthetic DNA
aaatacatctcatttttg

SEQ ID NO: 63933 - DNA, 18 bp, Artificial Sequence
  Synthetic DNA
aaataccactcatcattg

SEQ ID NO: 63934 - DNA, 18 bp, Artificial Sequence
  Synthetic DNA
aaatacctctcgctttag

SEQ ID NO: 63935 - DNA, 18 bp, Artificial Sequence
  Synthetic DNA
aaatacgaaactctttag

SEQ ID NO: 63936 - DNA, 18 bp, Artificial Sequence
  Synthetic DNA
aaatacgaatccacacag

SEQ ID NO: 63937 - DNA, 18 bp, Artificial Sequence
  Synthetic DNA
aaatacgaccagctatgg

SEQ ID NO: 63938 - DNA, 18 bp, Artificial Sequence
  Synthetic DNA
aaatacgactatcaattg

SEQ ID NO: 63939 - DNA, 18 bp, Artificial Sequence
  Synthetic DNA
aaatacgactcattgagg

SEQ ID NO: 63940 - DNA, 18 bp, Artificial Sequence
  Synthetic DNA
aaatacgactcatttcgg

SEQ ID NO: 63941 - DNA, 18 bp, Artificial Sequence
  Synthetic DNA
aaatacgactgtcttgag

SEQ ID NO: 63942 - DNA, 18 bp, Artificial Sequence
  Synthetic DNA
aaatacgatctacaatag

SEQ ID NO: 63943 - DNA, 18 bp, Artificial Sequence
  Synthetic DNA
aaatacgattcttttttg

SEQ ID NO: 63944 - DNA, 18 bp, Artificial Sequence
  Synthetic DNA
aaatacgccccacattag

SEQ ID NO: 63945 - DNA, 18 bp, Artificial Sequence
  Synthetic DNA
aaatacggcatacaaaag

SEQ ID NO: 63946 - DNA, 18 bp, Artificial Sequence
  Synthetic DNA
aaatacgtatcaatacag

SEQ ID NO: 63947 - DNA, 18 bp, Artificial Sequence
  Synthetic DNA
aaatacgtctaacattag

SEQ ID NO: 63948 - DNA, 18 bp, Artificial Sequence
  Synthetic DNA
aaatacgtctagcttttg

SEQ ID NO: 63949 - DNA, 18 bp, Artificial Sequence
  Synthetic DNA
aaatacgtctatttatgg

SEQ ID NO: 63950 - DNA, 18 bp, Artificial Sequence
  Synthetic DNA
aaatactaatcacttcag

SEQ ID NO: 63951 - DNA, 18 bp, Artificial Sequence
  Synthetic DNA
aaatactacactatattg

SEQ ID NO: 63952 - DNA, 18 bp, Artificial Sequence
  Synthetic DNA
aaatactactcacattcg

SEQ ID NO: 63953 - DNA, 18 bp, Artificial Sequence
  Synthetic DNA
aaatactacttattaccg

SEQ ID NO: 63954 - DNA, 18 bp, Artificial Sequence
  Synthetic DNA
aaatactcttgtctatag

SEQ ID NO: 63955 - DNA, 18 bp, Artificial Sequence
  Synthetic DNA
aaatactgatcactgttg

SEQ ID NO: 63956 - DNA, 18 bp, Artificial Sequence
  Synthetic DNA
aaatactgcttgctatag

SEQ ID NO: 63957 - DNA, 18 bp, Artificial Sequence
  Synthetic DNA
aaatacttctcagtaaag

SEQ ID NO: 63958 - DNA, 18 bp, Artificial Sequence
  Synthetic DNA
aaatacttttcactaaag

SEQ ID NO: 63959 - DNA, 18 bp, Artificial Sequence
  Synthetic DNA
aaatagctctcccagaag

SEQ ID NO: 63960 - DNA, 18 bp, Artificial Sequence
  Synthetic DNA
aaataggactatgtatag

SEQ ID NO: 63961 - DNA, 18 bp, Artificial Sequence
  Synthetic DNA
aaataggactcgcttttg

SEQ ID NO: 63962 - DNA, 18 bp, Artificial Sequence
  Synthetic DNA
aaatataaaacaattttg

SEQ ID NO: 63963 - DNA, 18 bp, Artificial Sequence
  Synthetic DNA
aaatatgactaaccaaag

SEQ ID NO: 63964 - DNA, 18 bp, Artificial Sequence
  Synthetic DNA
aaatatgactaacttaag

SEQ ID NO: 63965 - DNA, 18 bp, Artificial Sequence
  Synthetic DNA
aaatatgactctcttcag

SEQ ID NO: 63966 - DNA, 18 bp, Artificial Sequence
  Synthetic DNA
aaatatgattcactaatg

SEQ ID NO: 63967 - DNA, 18 bp, Artificial Sequence
  Synthetic DNA
aaatatgattcagaaaag

SEQ ID NO: 63968 - DNA, 18 bp, Artificial Sequence
  Synthetic DNA
aaatatgcctcccattag

SEQ ID NO: 63969 - DNA, 18 bp, Artificial Sequence
  Synthetic DNA
aaatcatactagcaatag

SEQ ID NO: 63970 - DNA, 18 bp, Artificial Sequence
  Synthetic DNA
aaatccgaaccgctacgg

SEQ ID NO: 63971 - DNA, 18 bp, Artificial Sequence
  Synthetic DNA
aaatcctactgactattg

SEQ ID NO: 63972 - DNA, 18 bp, Artificial Sequence
  Synthetic DNA
aaatctgactaactatcg

SEQ ID NO: 63973 - DNA, 18 bp, Artificial Sequence
  Synthetic DNA
aaatgatcatcactaatg

SEQ ID NO: 63974 - DNA, 18 bp, Artificial Sequence
  Synthetic DNA
aaatgcctcactcttttg

SEQ ID NO: 63975 - DNA, 18 bp, Artificial Sequence
  Synthetic DNA
aaatgcgtcacactattg

SEQ ID NO: 63976 - DNA, 18 bp, Artificial Sequence
  Synthetic DNA
aaattagattctctatag

SEQ ID NO: 63977 - DNA, 18 bp, Artificial Sequence
  Synthetic DNA
aaattcaacttagtatag

SEQ ID NO: 63978 - DNA, 18 bp, Artificial Sequence
  Synthetic DNA
aaattccagtcatattag

SEQ ID NO: 63979 - DNA, 18 bp, Artificial Sequence
  Synthetic DNA
aaattcgatacaatatag

SEQ ID NO: 63980 - DNA, 18 bp, Artificial Sequence
  Synthetic DNA
aaattcgcctctctaaag

SEQ ID NO: 63981 - DNA, 18 bp, Artificial Sequence
  Synthetic DNA
aaattcggctccgtatag

SEQ ID NO: 63982 - DNA, 18 bp, Artificial Sequence
  Synthetic DNA
aaattctacacattctag

SEQ ID NO: 63983 - DNA, 18 bp, Artificial Sequence
  Synthetic DNA
aaattctactcactaggg

SEQ ID NO: 63984 - DNA, 18 bp, Artificial Sequence
  Synthetic DNA
aaattgctctgactattg

SEQ ID NO: 63985 - DNA, 18 bp, Artificial Sequence
  Synthetic DNA
aaattggactcaatacag

SEQ ID NO: 63986 - DNA, 18 bp, Artificial Sequence
  Synthetic DNA
aaatttgacacacaatag

SEQ ID NO: 63987 - DNA, 18 bp, Artificial Sequence
  Synthetic DNA
aaatttgactcacaattg

SEQ ID NO: 63988 - DNA, 18 bp, Artificial Sequence
  Synthetic DNA
aaatttgactcaccagag

SEQ ID NO: 63989 - DNA, 18 bp, Artificial Sequence
  Synthetic DNA
aaatttttcttactagag

SEQ ID NO: 63990 - DNA, 18 bp, Artificial Sequence
  Synthetic DNA
aacaaagagaaacaatag

SEQ ID NO: 63991 - DNA, 18 bp, Artificial Sequence
  Synthetic DNA
aacatcggctcactaaag

SEQ ID NO: 63992 - DNA, 18 bp, Artificial Sequence
  Synthetic DNA
aaccaagtctatctggcg

SEQ ID NO: 63993 - DNA, 18 bp, Artificial Sequence
  Synthetic DNA
aactacaattcactaaag

SEQ ID NO: 63994 - DNA, 18 bp, Artificial Sequence
  Synthetic DNA
aactacgtagccctatag

SEQ ID NO: 63995 - DNA, 18 bp, Artificial Sequence
  Synthetic DNA
aactacgtctcacgaaag

SEQ ID NO: 63996 - DNA, 18 bp, Artificial Sequence
  Synthetic DNA
aactactaatcagtatag

SEQ ID NO: 63997 - DNA, 18 bp, Artificial Sequence
  Synthetic DNA
aacttcgtctcaccatcg

SEQ ID NO: 63998 - DNA, 18 bp, Artificial Sequence
  Synthetic DNA
aagaaagactttcaatag

SEQ ID NO: 63999 - DNA, 18 bp, Artificial Sequence
  Synthetic DNA
aagaacgcctcaaaatag

SEQ ID NO: 64000 - DNA, 18 bp, Artificial Sequence
  Synthetic DNA
aagatcgattcactgttg

SEQ ID NO: 64001 - DNA, 18 bp, Artificial Sequence
  Synthetic DNA
aaggccagctatctatag

SEQ ID NO: 64002 - DNA, 18 bp, Artificial Sequence
  Synthetic DNA
aagtaagcctcatctttg

SEQ ID NO: 64003 - DNA, 18 bp, Artificial Sequence
  Synthetic DNA
aagtacaattcagtttag

SEQ ID NO: 64004 - DNA, 18 bp, Artificial Sequence
  Synthetic DNA
aagtacgactcaatgttg

SEQ ID NO: 64005 - DNA, 18 bp, Artificial Sequence
  Synthetic DNA
aagtacgcctccctatgg

SEQ ID NO: 64006 - DNA, 18 bp, Artificial Sequence
  Synthetic DNA
aagtacgtcattccatag

SEQ ID NO: 64007 - DNA, 18 bp, Artificial Sequence
  Synthetic DNA
aagtacgtcctacttttg

SEQ ID NO: 64008 - DNA, 18 bp, Artificial Sequence
  Synthetic DNA
aagtacgtctagctatag

SEQ ID NO: 64009 - DNA, 18 bp, Artificial Sequence
  Synthetic DNA
aagtatgactcgctattg

SEQ ID NO: 64010 - DNA, 18 bp, Artificial Sequence
  Synthetic DNA
aagtgcgtcacactcttg

SEQ ID NO: 64011 - DNA, 18 bp, Artificial Sequence
  Synthetic DNA
aagtggtatccacaaagg

SEQ ID NO: 64012 - DNA, 18 bp, Artificial Sequence
  Synthetic DNA
aagtgtgtctaactatgg

SEQ ID NO: 64013 - DNA, 18 bp, Artificial Sequence
  Synthetic DNA
aagttcttcacaatacag

SEQ ID NO: 64014 - DNA, 18 bp, Artificial Sequence
  Synthetic DNA
aataaattctcacaatag

SEQ ID NO: 64015 - DNA, 18 bp, Artificial Sequence
  Synthetic DNA
aataaccactaactatag

SEQ ID NO: 64016 - DNA, 18 bp, Artificial Sequence
  Synthetic DNA
aataacgactaaccattg

SEQ ID NO: 64017 - DNA, 18 bp, Artificial Sequence
  Synthetic DNA
aataacgattctccccag

SEQ ID NO: 64018 - DNA, 18 bp, Artificial Sequence
  Synthetic DNA
aataacgcctcactattg

SEQ ID NO: 64019 - DNA, 18 bp, Artificial Sequence
  Synthetic DNA
aataacgtcttacgttag

SEQ ID NO: 64020 - DNA, 18 bp, Artificial Sequence
  Synthetic DNA
aatatcgaatcccgttag

SEQ ID NO: 64021 - DNA, 18 bp, Artificial Sequence
  Synthetic DNA
aatcactaatcagtttag

SEQ ID NO: 64022 - DNA, 18 bp, Artificial Sequence
  Synthetic DNA
aatcactgctcacaaaag

SEQ ID NO: 64023 - DNA, 18 bp, Artificial Sequence
  Synthetic DNA
aatcaggaataactatag

SEQ ID NO: 64024 - DNA, 18 bp, Artificial Sequence
  Synthetic DNA
aatgacgacaaacaatag

SEQ ID NO: 64025 - DNA, 18 bp, Artificial Sequence
  Synthetic DNA
aattaagattctatatag

SEQ ID NO: 64026 - DNA, 18 bp, Artificial Sequence
  Synthetic DNA
aattaagcctctctaaag

SEQ ID NO: 64027 - DNA, 18 bp, Artificial Sequence
  Synthetic DNA
aattaagtcccacttaag

SEQ ID NO: 64028 - DNA, 18 bp, Artificial Sequence
  Synthetic DNA
aattacaagtcagcatag

SEQ ID NO: 64029 - DNA, 18 bp, Artificial Sequence
  Synthetic DNA
aattacgaatcgctaaag

SEQ ID NO: 64030 - DNA, 18 bp, Artificial Sequence
  Synthetic DNA
aattacgaatctgtatag

SEQ ID NO: 64031 - DNA, 18 bp, Artificial Sequence
  Synthetic DNA
aattacgacacattaaag

SEQ ID NO: 64032 - DNA, 18 bp, Artificial Sequence
  Synthetic DNA
aattacgacatactgtag

SEQ ID NO: 64033 - DNA, 18 bp, Artificial Sequence
  Synthetic DNA
aattacgactcacagttg

SEQ ID NO: 64034 - DNA, 18 bp, Artificial Sequence
  Synthetic DNA
aattacgactcataagag

SEQ ID NO: 64035 - DNA, 18 bp, Artificial Sequence
  Synthetic DNA
aattacgactctccattg

SEQ ID NO: 64036 - DNA, 18 bp, Artificial Sequence
  Synthetic DNA
aattacgcctctctttag

SEQ ID NO: 64037 - DNA, 18 bp, Artificial Sequence
  Synthetic DNA
aattacgtcacaacatag

SEQ ID NO: 64038 - DNA, 18 bp, Artificial Sequence
  Synthetic DNA
aattactactcaaagtag

SEQ ID NO: 64039 - DNA, 18 bp, Artificial Sequence
  Synthetic DNA
aattactactcagtaaag

SEQ ID NO: 64040 - DNA, 18 bp, Artificial Sequence
  Synthetic DNA
aattactacttactaaag

SEQ ID NO: 64041 - DNA, 18 bp, Artificial Sequence
  Synthetic DNA
aattactcttcgctatag

SEQ ID NO: 64042 - DNA, 18 bp, Artificial Sequence
  Synthetic DNA
aattataactcgctaaag

SEQ ID NO: 64043 - DNA, 18 bp, Artificial Sequence
  Synthetic DNA
aattatacctcactatag

SEQ ID NO: 64044 - DNA, 18 bp, Artificial Sequence
  Synthetic DNA
aattatcactcccgtaag

SEQ ID NO: 64045 - DNA, 18 bp, Artificial Sequence
  Synthetic DNA
aattatgactcacaatgg

SEQ ID NO: 64046 - DNA, 18 bp, Artificial Sequence
  Synthetic DNA
aattatgtctcgctatag

SEQ ID NO: 64047 - DNA, 18 bp, Artificial Sequence
  Synthetic DNA
aattcccactcacatttg

SEQ ID NO: 64048 - DNA, 18 bp, Artificial Sequence
  Synthetic DNA
aattccgactcactagcg

SEQ ID NO: 64049 - DNA, 18 bp, Artificial Sequence
  Synthetic DNA
aattccgactctctctcg

SEQ ID NO: 64050 - DNA, 18 bp, Artificial Sequence
  Synthetic DNA
aatttaggctctctattg

SEQ ID NO: 64051 - DNA, 18 bp, Artificial Sequence
  Synthetic DNA
aatttatacaaactttag

SEQ ID NO: 64052 - DNA, 18 bp, Artificial Sequence
  Synthetic DNA
aatttcaactcacattag

SEQ ID NO: 64053 - DNA, 18 bp, Artificial Sequence
  Synthetic DNA
aatttcgaatctctgcag

SEQ ID NO: 64054 - DNA, 18 bp, Artificial Sequence
  Synthetic DNA
aatttcgtcttccttaag

SEQ ID NO: 64055 - DNA, 18 bp, Artificial Sequence
  Synthetic DNA
aattttgacatactaaag

SEQ ID NO: 64056 - DNA, 18 bp, Artificial Sequence
  Synthetic DNA
acaaatgcaacactatag

SEQ ID NO: 64057 - DNA, 18 bp, Artificial Sequence
  Synthetic DNA
acaatcgactcactctag

SEQ ID NO: 64058 - DNA, 18 bp, Artificial Sequence
  Synthetic DNA
acaattgactcgcttttg

SEQ ID NO: 64059 - DNA, 18 bp, Artificial Sequence
  Synthetic DNA
acacaagttacactgaag

SEQ ID NO: 64060 - DNA, 18 bp, Artificial Sequence
  Synthetic DNA
acacacgactctacatag

SEQ ID NO: 64061 - DNA, 18 bp, Artificial Sequence
  Synthetic DNA
acacacgtttcgttatcg

SEQ ID NO: 64062 - DNA, 18 bp, Artificial Sequence
  Synthetic DNA
acagacgtctcaccattg

SEQ ID NO: 64063 - DNA, 18 bp, Artificial Sequence
  Synthetic DNA
acatacaactcaccactg

SEQ ID NO: 64064 - DNA, 18 bp, Artificial Sequence
  Synthetic DNA
acatacgagtcgctagag

SEQ ID NO: 64065 - DNA, 18 bp, Artificial Sequence
  Synthetic DNA
acatacgatagccaagtg

SEQ ID NO: 64066 - DNA, 18 bp, Artificial Sequence
  Synthetic DNA
acatacgtcaatctgtag

SEQ ID NO: 64067 - DNA, 18 bp, Artificial Sequence
  Synthetic DNA
acatacgtcatcctatag

SEQ ID NO: 64068 - DNA, 18 bp, Artificial Sequence
  Synthetic DNA
acatatgactcacaaaag

SEQ ID NO: 64069 - DNA, 18 bp, Artificial Sequence
  Synthetic DNA
acatatggctcgctatag

SEQ ID NO: 64070 - DNA, 18 bp, Artificial Sequence
  Synthetic DNA
acatccaaatcacaatag

SEQ ID NO: 64071 - DNA, 18 bp, Artificial Sequence
  Synthetic DNA
acatgcgagtatttatag

SEQ ID NO: 64072 - DNA, 18 bp, Artificial Sequence
  Synthetic DNA
acatgtgacactctatag

SEQ ID NO: 64073 - DNA, 18 bp, Artificial Sequence
  Synthetic DNA
acattcgacactctctcg

SEQ ID NO: 64074 - DNA, 18 bp, Artificial Sequence
  Synthetic DNA
acattcgactaactgtag

SEQ ID NO: 64075 - DNA, 18 bp, Artificial Sequence
  Synthetic DNA
acattcgatacactatag

SEQ ID NO: 64076 - DNA, 18 bp, Artificial Sequence
  Synthetic DNA
acctaccattccgtacag

SEQ ID NO: 64077 - DNA, 18 bp, Artificial Sequence
  Synthetic DNA
acctacgactttctagag

SEQ ID NO: 64078 - DNA, 18 bp, Artificial Sequence
  Synthetic DNA
acgaacgactctctatag

SEQ ID NO: 64079 - DNA, 18 bp, Artificial Sequence
  Synthetic DNA
acgtacgactcactaatg

SEQ ID NO: 64080 - DNA, 18 bp, Artificial Sequence
  Synthetic DNA
acgttctacttaatcttg

SEQ ID NO: 64081 - DNA, 18 bp, Artificial Sequence
  Synthetic DNA
actcacgccacacaattg

SEQ ID NO: 64082 - DNA, 18 bp, Artificial Sequence
  Synthetic DNA
acttacattccattgaag

SEQ ID NO: 64083 - DNA, 18 bp, Artificial Sequence
  Synthetic DNA
actttcctctctctatag

SEQ ID NO: 64084 - DNA, 18 bp, Artificial Sequence
  Synthetic DNA
actttcgactcactttag

SEQ ID NO: 64085 - DNA, 18 bp, Artificial Sequence
  Synthetic DNA
agaaacgactcactgatg

SEQ ID NO: 64086 - DNA, 18 bp, Artificial Sequence
  Synthetic DNA
agaaacgactctctattg

SEQ ID NO: 64087 - DNA, 18 bp, Artificial Sequence
  Synthetic DNA
agaatcgtttttgtatag

SEQ ID NO: 64088 - DNA, 18 bp, Artificial Sequence
  Synthetic DNA
agatactactcacttttg

SEQ ID NO: 64089 - DNA, 18 bp, Artificial Sequence
  Synthetic DNA
agataggacacactatgg

SEQ ID NO: 64090 - DNA, 18 bp, Artificial Sequence
  Synthetic DNA
agattcttttcaatttag

SEQ ID NO: 64091 - DNA, 18 bp, Artificial Sequence
  Synthetic DNA
agctaagactcagtgtgg

SEQ ID NO: 64092 - DNA, 18 bp, Artificial Sequence
  Synthetic DNA
agctgcgactcactaaag

SEQ ID NO: 64093 - DNA, 18 bp, Artificial Sequence
  Synthetic DNA
aggtaagattcgctgtcg

SEQ ID NO: 64094 - DNA, 18 bp, Artificial Sequence
  Synthetic DNA
ataaacggctcacaattg

SEQ ID NO: 64095 - DNA, 18 bp, Artificial Sequence
  Synthetic DNA
ataaatcagtctctattg

SEQ ID NO: 64096 - DNA, 18 bp, Artificial Sequence
  Synthetic DNA
ataaatgaccatctatag

SEQ ID NO: 64097 - DNA, 18 bp, Artificial Sequence
  Synthetic DNA
ataaccgactcaatatag

SEQ ID NO: 64098 - DNA, 18 bp, Artificial Sequence
  Synthetic DNA
ataagttactcacaaaag

SEQ ID NO: 64099 - DNA, 18 bp, Artificial Sequence
  Synthetic DNA
atacaagattcacttttg

SEQ ID NO: 64100 - DNA, 18 bp, Artificial Sequence
  Synthetic DNA
atacacaacgcactatag

SEQ ID NO: 64101 - DNA, 18 bp, Artificial Sequence
  Synthetic DNA
atacaccactcactaacg

SEQ ID NO: 64102 - DNA, 18 bp, Artificial Sequence
  Synthetic DNA
atacacgactatctatag

SEQ ID NO: 64103 - DNA, 18 bp, Artificial Sequence
  Synthetic DNA
atacacgattctccatag

SEQ ID NO: 64104 - DNA, 18 bp, Artificial Sequence
  Synthetic DNA
atacacgcctaactgtag

SEQ ID NO: 64105 - DNA, 18 bp, Artificial Sequence
  Synthetic DNA
atacacttcttacagtag

SEQ ID NO: 64106 - DNA, 18 bp, Artificial Sequence
  Synthetic DNA
atactcgttcgacattcg

SEQ ID NO: 64107 - DNA, 18 bp, Artificial Sequence
  Synthetic DNA
atagacgacacaaaatag

SEQ ID NO: 64108 - DNA, 18 bp, Artificial Sequence
  Synthetic DNA
atagacgactcaatttag

SEQ ID NO: 64109 - DNA, 18 bp, Artificial Sequence
  Synthetic DNA
atataaaactcattatag

SEQ ID NO: 64110 - DNA, 18 bp, Artificial Sequence
  Synthetic DNA
atataagactaattatag

SEQ ID NO: 64111 - DNA, 18 bp, Artificial Sequence
  Synthetic DNA
atataagtcactctatag

SEQ ID NO: 64112 - DNA, 18 bp, Artificial Sequence
  Synthetic DNA
atatacaaatcacattag

SEQ ID NO: 64113 - DNA, 18 bp, Artificial Sequence
  Synthetic DNA
atatacaacacactattg

SEQ ID NO: 64114 - DNA, 18 bp, Artificial Sequence
  Synthetic DNA
atatacaactctcactag

SEQ ID NO: 64115 - DNA, 18 bp, Artificial Sequence
  Synthetic DNA
atataccaatccttagag

SEQ ID NO: 64116 - DNA, 18 bp, Artificial Sequence
  Synthetic DNA
atatacgacataccattg

SEQ ID NO: 64117 - DNA, 18 bp, Artificial Sequence
  Synthetic DNA
atatacgactatacaaag

SEQ ID NO: 64118 - DNA, 18 bp, Artificial Sequence
  Synthetic DNA
atatacgattcaatattg

SEQ ID NO: 64119 - DNA, 18 bp, Artificial Sequence
  Synthetic DNA
atatacgattccgtttag

SEQ ID NO: 64120 - DNA, 18 bp, Artificial Sequence
  Synthetic DNA
atatacgccattctatag

SEQ ID NO: 64121 - DNA, 18 bp, Artificial Sequence
  Synthetic DNA
atatacgcctgactaatg

SEQ ID NO: 64122 - DNA, 18 bp, Artificial Sequence
  Synthetic DNA
atatacgtttcaccatcg

SEQ ID NO: 64123 - DNA, 18 bp, Artificial Sequence
  Synthetic DNA
atatactactcaatctag

SEQ ID NO: 64124 - DNA, 18 bp, Artificial Sequence
  Synthetic DNA
atatactactcacaagag

SEQ ID NO: 64125 - DNA, 18 bp, Artificial Sequence
  Synthetic DNA
atatactcttcaatatag

SEQ ID NO: 64126 - DNA, 18 bp, Artificial Sequence
  Synthetic DNA
atatacttcactctatag

SEQ ID NO: 64127 - DNA, 18 bp, Artificial Sequence
  Synthetic DNA
atataggactttctttag

SEQ ID NO: 64128 - DNA, 18 bp, Artificial Sequence
  Synthetic DNA
atatagtacttactaaag

SEQ ID NO: 64129 - DNA, 18 bp, Artificial Sequence
  Synthetic DNA
atatatgaatcactatcg

SEQ ID NO: 64130 - DNA, 18 bp, Artificial Sequence
  Synthetic DNA
atatcccacccactatag

SEQ ID NO: 64131 - DNA, 18 bp, Artificial Sequence
  Synthetic DNA
atatccgcctcaccatag

SEQ ID NO: 64132 - DNA, 18 bp, Artificial Sequence
  Synthetic DNA
atatgagacacactttag

SEQ ID NO: 64133 - DNA, 18 bp, Artificial Sequence
  Synthetic DNA
atatgagactcactgctg

SEQ ID NO: 64134 - DNA, 18 bp, Artificial Sequence
  Synthetic DNA
atatgcggtacattatag

SEQ ID NO: 64135 - DNA, 18 bp, Artificial Sequence
  Synthetic DNA
atatgctagtcacttgag

SEQ ID NO: 64136 - DNA, 18 bp, Artificial Sequence
  Synthetic DNA
atatgcttctcgatatag

SEQ ID NO: 64137 - DNA, 18 bp, Artificial Sequence
  Synthetic DNA
atattagtctgactatag

SEQ ID NO: 64138 - DNA, 18 bp, Artificial Sequence
  Synthetic DNA
atattcatctaaccatag

SEQ ID NO: 64139 - DNA, 18 bp, Artificial Sequence
  Synthetic DNA
atattccactaactatag

SEQ ID NO: 64140 - DNA, 18 bp, Artificial Sequence
  Synthetic DNA
atattcgactcacacaag

SEQ ID NO: 64141 - DNA, 18 bp, Artificial Sequence
  Synthetic DNA
atattcgacttccttatg

SEQ ID NO: 64142 - DNA, 18 bp, Artificial Sequence
  Synthetic DNA
atattctacttacaatag

SEQ ID NO: 64143 - DNA, 18 bp, Artificial Sequence
  Synthetic DNA
atattgaatactctatag

SEQ ID NO: 64144 - DNA, 18 bp, Artificial Sequence
  Synthetic DNA
atattggactgtatgtag

SEQ ID NO: 64145 - DNA, 18 bp, Artificial Sequence
  Synthetic DNA
atattggtctatctattg

SEQ ID NO: 64146 - DNA, 18 bp, Artificial Sequence
  Synthetic DNA
atcaacatctcacaatag

SEQ ID NO: 64147 - DNA, 18 bp, Artificial Sequence
  Synthetic DNA
atccaatacacacattag

SEQ ID NO: 64148 - DNA, 18 bp, Artificial Sequence
  Synthetic DNA
atctacgacttacataag

SEQ ID NO: 64149 - DNA, 18 bp, Artificial Sequence
  Synthetic DNA
atctacgtctcactaaag

SEQ ID NO: 64150 - DNA, 18 bp, Artificial Sequence
  Synthetic DNA
atctacgtcttactaaag

SEQ ID NO: 64151 - DNA, 18 bp, Artificial Sequence
  Synthetic DNA
atcttgggcacactaatg

SEQ ID NO: 64152 - DNA, 18 bp, Artificial Sequence
  Synthetic DNA
atcttgggctctctacag

SEQ ID NO: 64153 - DNA, 18 bp, Artificial Sequence
  Synthetic DNA
atgtacgagtcactattg

SEQ ID NO: 64154 - DNA, 18 bp, Artificial Sequence
  Synthetic DNA
atgtactaagcactatag

SEQ ID NO: 64155 - DNA, 18 bp, Artificial Sequence
  Synthetic DNA
atgtcctactcactattg

SEQ ID NO: 64156 - DNA, 18 bp, Artificial Sequence
  Synthetic DNA
atgttctaccctctaaag

SEQ ID NO: 64157 - DNA, 18 bp, Artificial Sequence
  Synthetic DNA
attaaagattcactatag

SEQ ID NO: 64158 - DNA, 18 bp, Artificial Sequence
  Synthetic DNA
attcacgagcctccatag

SEQ ID NO: 64159 - DNA, 18 bp, Artificial Sequence
  Synthetic DNA
attcattactcatcatag

SEQ ID NO: 64160 - DNA, 18 bp, Artificial Sequence
  Synthetic DNA
atttaagtcttactatag

SEQ ID NO: 64161 - DNA, 18 bp, Artificial Sequence
  Synthetic DNA
atttacatttaactatag

SEQ ID NO: 64162 - DNA, 18 bp, Artificial Sequence
  Synthetic DNA
atttaccactctccatcg

SEQ ID NO: 64163 - DNA, 18 bp, Artificial Sequence
  Synthetic DNA
atttacgactaactaaag

SEQ ID NO: 64164 - DNA, 18 bp, Artificial Sequence
  Synthetic DNA
atttacgtctttcaatag

SEQ ID NO: 64165 - DNA, 18 bp, Artificial Sequence
  Synthetic DNA
atttatgactaattacag

SEQ ID NO: 64166 - DNA, 18 bp, Artificial Sequence
  Synthetic DNA
atttatgattcactaatg

SEQ ID NO: 64167 - DNA, 18 bp, Artificial Sequence
  Synthetic DNA
caaaaccactctgaatag

SEQ ID NO: 64168 - DNA, 18 bp, Artificial Sequence
  Synthetic DNA
caaaacgacacgctgttg

SEQ ID NO: 64169 - DNA, 18 bp, Artificial Sequence
  Synthetic DNA
caaaacgacactatatag

SEQ ID NO: 64170 - DNA, 18 bp, Artificial Sequence
  Synthetic DNA
caaaacgactgattattg

SEQ ID NO: 64171 - DNA, 18 bp, Artificial Sequence
  Synthetic DNA
caaaactactcaaaatag

SEQ ID NO: 64172 - DNA, 18 bp, Artificial Sequence
  Synthetic DNA
caaaatatcttcctatag

SEQ ID NO: 64173 - DNA, 18 bp, Artificial Sequence
  Synthetic DNA
caaaccgactcaatctag

SEQ ID NO: 64174 - DNA, 18 bp, Artificial Sequence
  Synthetic DNA
caaatcaactcaatgtag

SEQ ID NO: 64175 - DNA, 18 bp, Artificial Sequence
  Synthetic DNA
caaattgttagactgctg

SEQ ID NO: 64176 - DNA, 18 bp, Artificial Sequence
  Synthetic DNA
caacaagtcaaactctag

SEQ ID NO: 64177 - DNA, 18 bp, Artificial Sequence
  Synthetic DNA
caacacaaaacactaaag

SEQ ID NO: 64178 - DNA, 18 bp, Artificial Sequence
  Synthetic DNA
caacacatctcactctag

SEQ ID NO: 64179 - DNA, 18 bp, Artificial Sequence
  Synthetic DNA
caacacgcataacaatgg

SEQ ID NO: 64180 - DNA, 18 bp, Artificial Sequence
  Synthetic DNA
caacgcgagccagtatag

SEQ ID NO: 64181 - DNA, 18 bp, Artificial Sequence
  Synthetic DNA
caactggatgcactatag

SEQ ID NO: 64182 - DNA, 18 bp, Artificial Sequence
  Synthetic DNA
caagacggctccctttag

SEQ ID NO: 64183 - DNA, 18 bp, Artificial Sequence
  Synthetic DNA
caagacgtatcattattg

SEQ ID NO: 64184 - DNA, 18 bp, Artificial Sequence
  Synthetic DNA
caataagtctcacttatg

SEQ ID NO: 64185 - DNA, 18 bp, Artificial Sequence
  Synthetic DNA
caataagtctcgctgaag

SEQ ID NO: 64186 - DNA, 18 bp, Artificial Sequence
  Synthetic DNA
caatacaactctttatcg

SEQ ID NO: 64187 - DNA, 18 bp, Artificial Sequence
  Synthetic DNA
caatacaacttcataaag

SEQ ID NO: 64188 - DNA, 18 bp, Artificial Sequence
  Synthetic DNA
caatacatctaactacag

SEQ ID NO: 64189 - DNA, 18 bp, Artificial Sequence
  Synthetic DNA
caataccactccttagtg

SEQ ID NO: 64190 - DNA, 18 bp, Artificial Sequence
  Synthetic DNA
caataccactttctggag

SEQ ID NO: 64191 - DNA, 18 bp, Artificial Sequence
  Synthetic DNA
caatacgaaccactttgg

SEQ ID NO: 64192 - DNA, 18 bp, Artificial Sequence
  Synthetic DNA
caatacgaatcgcacttg

SEQ ID NO: 64193 - DNA, 18 bp, Artificial Sequence
  Synthetic DNA
caatacgactcttaactg

SEQ ID NO: 64194 - DNA, 18 bp, Artificial Sequence
  Synthetic DNA
caatacgattctcttaag

SEQ ID NO: 64195 - DNA, 18 bp, Artificial Sequence
  Synthetic DNA
caatacgccactcaaatg

SEQ ID NO: 64196 - DNA, 18 bp, Artificial Sequence
  Synthetic DNA
caatacggcttacggtag

SEQ ID NO: 64197 - DNA, 18 bp, Artificial Sequence
  Synthetic DNA
caatacgtcaaactttag

SEQ ID NO: 64198 - DNA, 18 bp, Artificial Sequence
  Synthetic DNA
caatacgtcaccattttg

SEQ ID NO: 64199 - DNA, 18 bp, Artificial Sequence
  Synthetic DNA
caatactaatcacacgtg

SEQ ID NO: 64200 - DNA, 18 bp, Artificial Sequence
  Synthetic DNA
caatactactcactgatg

SEQ ID NO: 64201 - DNA, 18 bp, Artificial Sequence
  Synthetic DNA
caatatgacccacaattg

SEQ ID NO: 64202 - DNA, 18 bp, Artificial Sequence
  Synthetic DNA
caatatgacttactgaag

SEQ ID NO: 64203 - DNA, 18 bp, Artificial Sequence
  Synthetic DNA
caatatgagtcctgatag

SEQ ID NO: 64204 - DNA, 18 bp, Artificial Sequence
  Synthetic DNA
caatccgattcactcttg

SEQ ID NO: 64205 - DNA, 18 bp, Artificial Sequence
  Synthetic DNA
caatctgtttcacaatag

SEQ ID NO: 64206 - DNA, 18 bp, Artificial Sequence
  Synthetic DNA
caatgcgtctcacaacag

SEQ ID NO: 64207 - DNA, 18 bp, Artificial Sequence
  Synthetic DNA
caatgcgtctctctaaag

SEQ ID NO: 64208 - DNA, 18 bp, Artificial Sequence
  Synthetic DNA
caattcatctcagtttgg

SEQ ID NO: 64209 - DNA, 18 bp, Artificial Sequence
  Synthetic DNA
caattcgaataaccctag

SEQ ID NO: 64210 - DNA, 18 bp, Artificial Sequence
  Synthetic DNA
caattcgacacactcatg

SEQ ID NO: 64211 - DNA, 18 bp, Artificial Sequence
  Synthetic DNA
caattcgacttacaatcg

SEQ ID NO: 64212 - DNA, 18 bp, Artificial Sequence
  Synthetic DNA
caattcgtatcacaatag

SEQ ID NO: 64213 - DNA, 18 bp, Artificial Sequence
  Synthetic DNA
caatttctctcactactg

SEQ ID NO: 64214 - DNA, 18 bp, Artificial Sequence
  Synthetic DNA
cacatcgactcactattg

SEQ ID NO: 64215 - DNA, 18 bp, Artificial Sequence
  Synthetic DNA
caccaacactcacgcttg

SEQ ID NO: 64216 - DNA, 18 bp, Artificial Sequence
  Synthetic DNA
caccaatactcactaaag

SEQ ID NO: 64217 - DNA, 18 bp, Artificial Sequence
  Synthetic DNA
caccgtcacacactatag

SEQ ID NO: 64218 - DNA, 18 bp, Artificial Sequence
  Synthetic DNA
cactacgtccatcgtaag

SEQ ID NO: 64219 - DNA, 18 bp, Artificial Sequence
  Synthetic DNA
cactgcgattccctagtg

SEQ ID NO: 64220 - DNA, 18 bp, Artificial Sequence
  Synthetic DNA
cacttcaaatcgatttag

SEQ ID NO: 64221 - DNA, 18 bp, Artificial Sequence
  Synthetic DNA
cagtacgaatcactccag

SEQ ID NO: 64222 - DNA, 18 bp, Artificial Sequence
  Synthetic DNA
cagtactactcatcatcg

SEQ ID NO: 64223 - DNA, 18 bp, Artificial Sequence
  Synthetic DNA
cagtactagacagtattg

SEQ ID NO: 64224 - DNA, 18 bp, Artificial Sequence
  Synthetic DNA
cagtccgactcaggaatg

SEQ ID NO: 64225 - DNA, 18 bp, Artificial Sequence
  Synthetic DNA
cagtctgactcacaatag

SEQ ID NO: 64226 - DNA, 18 bp, Artificial Sequence
  Synthetic DNA
cagtgcgactcgctaaag

SEQ ID NO: 64227 - DNA, 18 bp, Artificial Sequence
  Synthetic DNA
cagttcgtatcactacag

SEQ ID NO: 64228 - DNA, 18 bp, Artificial Sequence
  Synthetic DNA
cataacgtctcagtttag

SEQ ID NO: 64229 - DNA, 18 bp, Artificial Sequence
  Synthetic DNA
catatccattcactatag

SEQ ID NO: 64230 - DNA, 18 bp, Artificial Sequence
  Synthetic DNA
catcacggttcaacattg

SEQ ID NO: 64231 - DNA, 18 bp, Artificial Sequence
  Synthetic DNA
catcactacatgcgttgg

SEQ ID NO: 64232 - DNA, 18 bp, Artificial Sequence
  Synthetic DNA
cattaagaatcactattg

SEQ ID NO: 64233 - DNA, 18 bp, Artificial Sequence
  Synthetic DNA
cattaagaattaccaaag

SEQ ID NO: 64234 - DNA, 18 bp, Artificial Sequence
  Synthetic DNA
cattacaactcaccaaag

SEQ ID NO: 64235 - DNA, 18 bp, Artificial Sequence
  Synthetic DNA
cattacaactcgctatcg

SEQ ID NO: 64236 - DNA, 18 bp, Artificial Sequence
  Synthetic DNA
cattacgaatcgatatag

SEQ ID NO: 64237 - DNA, 18 bp, Artificial Sequence
  Synthetic DNA
cattacgattccctttag

SEQ ID NO: 64238 - DNA, 18 bp, Artificial Sequence
  Synthetic DNA
cattacgattctctacag

SEQ ID NO: 64239 - DNA, 18 bp, Artificial Sequence
  Synthetic DNA
cattacgttaaactattg

SEQ ID NO: 64240 - DNA, 18 bp, Artificial Sequence
  Synthetic DNA
cattataaatgccatcag

SEQ ID NO: 64241 - DNA, 18 bp, Artificial Sequence
  Synthetic DNA
cattcagtctcactattg

SEQ ID NO: 64242 - DNA, 18 bp, Artificial Sequence
  Synthetic DNA
cattccgtcaccctaaag

SEQ ID NO: 64243 - DNA, 18 bp, Artificial Sequence
  Synthetic DNA
cattgggcctcactacag

SEQ ID NO: 64244 - DNA, 18 bp, Artificial Sequence
  Synthetic DNA
catttctacacactgttg

SEQ ID NO: 64245 - DNA, 18 bp, Artificial Sequence
  Synthetic DNA
ccaccccactcactatag

SEQ ID NO: 64246 - DNA, 18 bp, Artificial Sequence
  Synthetic DNA
ccatacgaaacacaatag

SEQ ID NO: 64247 - DNA, 18 bp, Artificial Sequence
  Synthetic DNA
ccatactactcacaaggg

SEQ ID NO: 64248 - DNA, 18 bp, Artificial Sequence
  Synthetic DNA
ccatatgcctcagttttg

SEQ ID NO: 64249 - DNA, 18 bp, Artificial Sequence
  Synthetic DNA
ccatgcgagacactttag

SEQ ID NO: 64250 - DNA, 18 bp, Artificial Sequence
  Synthetic DNA
ccattctactcaatatag

SEQ ID NO: 64251 - DNA, 18 bp, Artificial Sequence
  Synthetic DNA
ccatttggctcagtatgg

SEQ ID NO: 64252 - DNA, 18 bp, Artificial Sequence
  Synthetic DNA
ccgtaagacccactatag

SEQ ID NO: 64253 - DNA, 18 bp, Artificial Sequence
  Synthetic DNA
ccgtacgtccacttatag

SEQ ID NO: 64254 - DNA, 18 bp, Artificial Sequence
  Synthetic DNA
ccttactactcaccttag

SEQ ID NO: 64255 - DNA, 18 bp, Artificial Sequence
  Synthetic DNA
cgatacccttctttatag

SEQ ID NO: 64256 - DNA, 18 bp, Artificial Sequence
  Synthetic DNA
cgtaactaatcactatag

SEQ ID NO: 64257 - DNA, 18 bp, Artificial Sequence
  Synthetic DNA
cgtaacttctcgctctag

SEQ ID NO: 64258 - DNA, 18 bp, Artificial Sequence
  Synthetic DNA
ctaaacgaatcacttttg

SEQ ID NO: 64259 - DNA, 18 bp, Artificial Sequence
  Synthetic DNA
ctaaacgactcattaaag

SEQ ID NO: 64260 - DNA, 18 bp, Artificial Sequence
  Synthetic DNA
ctaaacgactttctacag

SEQ ID NO: 64261 - DNA, 18 bp, Artificial Sequence
  Synthetic DNA
ctaagtgaatctctatag

SEQ ID NO: 64262 - DNA, 18 bp, Artificial Sequence
  Synthetic DNA
ctaatcgaatcactatag

SEQ ID NO: 64263 - DNA, 18 bp, Artificial Sequence
  Synthetic DNA
ctacaagtcacagaatcg

SEQ ID NO: 64264 - DNA, 18 bp, Artificial Sequence
  Synthetic DNA
ctacacggttcacaattg

SEQ ID NO: 64265 - DNA, 18 bp, Artificial Sequence
  Synthetic DNA
ctagtcaagcctctatag

SEQ ID NO: 64266 - DNA, 18 bp, Artificial Sequence
  Synthetic DNA
ctataaaaattattatag

SEQ ID NO: 64267 - DNA, 18 bp, Artificial Sequence
  Synthetic DNA
ctatacgacagcccaaag

SEQ ID NO: 64268 - DNA, 18 bp, Artificial Sequence
  Synthetic DNA
ctatacgacccactaacg

SEQ ID NO: 64269 - DNA, 18 bp, Artificial Sequence
  Synthetic DNA
ctatacgactcaacacag

SEQ ID NO: 64270 - DNA, 18 bp, Artificial Sequence
  Synthetic DNA
ctatacgactcacataag

SEQ ID NO: 64271 - DNA, 18 bp, Artificial Sequence
  Synthetic DNA
ctatacgcctctcattag

SEQ ID NO: 64272 - DNA, 18 bp, Artificial Sequence
  Synthetic DNA
ctatacgtctaactatgg

SEQ ID NO: 64273 - DNA, 18 bp, Artificial Sequence
  Synthetic DNA
ctatacgtctccccatcg

SEQ ID NO: 64274 - DNA, 18 bp, Artificial Sequence
  Synthetic DNA
ctatacttgccactgttg

SEQ ID NO: 64275 - DNA, 18 bp, Artificial Sequence
  Synthetic DNA
ctatatcattcagtattg

SEQ ID NO: 64276 - DNA, 18 bp, Artificial Sequence
  Synthetic DNA
ctatatcttccgtgatag

SEQ ID NO: 64277 - DNA, 18 bp, Artificial Sequence
  Synthetic DNA
ctatatgactctctttag

SEQ ID NO: 64278 - DNA, 18 bp, Artificial Sequence
  Synthetic DNA
ctatatgactgagtctag

SEQ ID NO: 64279 - DNA, 18 bp, Artificial Sequence
  Synthetic DNA
ctatccgacatattgtag

SEQ ID NO: 64280 - DNA, 18 bp, Artificial Sequence
  Synthetic DNA
ctatgtcacacactatag

SEQ ID NO: 64281 - DNA, 18 bp, Artificial Sequence
  Synthetic DNA
ctatttgacacactatag

SEQ ID NO: 64282 - DNA, 18 bp, Artificial Sequence
  Synthetic DNA
ctctacggcactttacag

SEQ ID NO: 64283 - DNA, 18 bp, Artificial Sequence
  Synthetic DNA
ctgtacgactcattaccg

SEQ ID NO: 64284 - DNA, 18 bp, Artificial Sequence
  Synthetic DNA
cttaatgagtctcaatag

SEQ ID NO: 64285 - DNA, 18 bp, Artificial Sequence
  Synthetic DNA
cttatcgcctctctatag

SEQ ID NO: 64286 - DNA, 18 bp, Artificial Sequence
  Synthetic DNA
cttcacgacgcactatag

SEQ ID NO: 64287 - DNA, 18 bp, Artificial Sequence
  Synthetic DNA
ctttacaactctctttag

SEQ ID NO: 64288 - DNA, 18 bp, Artificial Sequence
  Synthetic DNA
gaaaacgtctccatacag

SEQ ID NO: 64289 - DNA, 18 bp, Artificial Sequence
  Synthetic DNA
gaaaatgacttactttag

SEQ ID NO: 64290 - DNA, 18 bp, Artificial Sequence
  Synthetic DNA
gaaagcgtcacactatag

SEQ ID NO: 64291 - DNA, 18 bp, Artificial Sequence
  Synthetic DNA
gaacccgtctcatggttg

SEQ ID NO: 64292 - DNA, 18 bp, Artificial Sequence
  Synthetic DNA
gaacttgattcacagtag

SEQ ID NO: 64293 - DNA, 18 bp, Artificial Sequence
  Synthetic DNA
gaatacaattcaatattg

SEQ ID NO: 64294 - DNA, 18 bp, Artificial Sequence
  Synthetic DNA
gaatacatctctctgctg

SEQ ID NO: 64295 - DNA, 18 bp, Artificial Sequence
  Synthetic DNA
gaatacgagacgcttcag

SEQ ID NO: 64296 - DNA, 18 bp, Artificial Sequence
  Synthetic DNA
gaatccgactcgttattg

SEQ ID NO: 64297 - DNA, 18 bp, Artificial Sequence
  Synthetic DNA
gaatgcgcttaaccattg

SEQ ID NO: 64298 - DNA, 18 bp, Artificial Sequence
  Synthetic DNA
gaatgcgtctcgctgtag

SEQ ID NO: 64299 - DNA, 18 bp, Artificial Sequence
  Synthetic DNA
gaatgggagtatctgttg

SEQ ID NO: 64300 - DNA, 18 bp, Artificial Sequence
  Synthetic DNA
gaattcctctcaccattg

SEQ ID NO: 64301 - DNA, 18 bp, Artificial Sequence
  Synthetic DNA
gaattctactccctcttg

SEQ ID NO: 64302 - DNA, 18 bp, Artificial Sequence
  Synthetic DNA
gaatttgagtcaatattg

SEQ ID NO: 64303 - DNA, 18 bp, Artificial Sequence
  Synthetic DNA
gagtacgagtcgcaatag

SEQ ID NO: 64304 - DNA, 18 bp, Artificial Sequence
  Synthetic DNA
gagtgcgttgcactaaag

SEQ ID NO: 64305 - DNA, 18 bp, Artificial Sequence
  Synthetic DNA
gattacgacctaatatag

SEQ ID NO: 64306 - DNA, 18 bp, Artificial Sequence
  Synthetic DNA
gattactactctctttag

SEQ ID NO: 64307 - DNA, 18 bp, Artificial Sequence
  Synthetic DNA
gattatgattcagtttag

SEQ ID NO: 64308 - DNA, 18 bp, Artificial Sequence
  Synthetic DNA
gcatacaattcactttag

SEQ ID NO: 64309 - DNA, 18 bp, Artificial Sequence
  Synthetic DNA
gcatacgtatctcttttg

SEQ ID NO: 64310 - DNA, 18 bp, Artificial Sequence
  Synthetic DNA
gcataggatttactattg

SEQ ID NO: 64311 - DNA, 18 bp, Artificial Sequence
  Synthetic DNA
gcatatgactcaccaaag

SEQ ID NO: 64312 - DNA, 18 bp, Artificial Sequence
  Synthetic DNA
gcccacgattctcgatag

SEQ ID NO: 64313 - DNA, 18 bp, Artificial Sequence
  Synthetic DNA
gcgttacactcactattg

SEQ ID NO: 64314 - DNA, 18 bp, Artificial Sequence
  Synthetic DNA
gcttacgactatctatag

SEQ ID NO: 64315 - DNA, 18 bp, Artificial Sequence
  Synthetic DNA
gcttactactcactgtag

SEQ ID NO: 64316 - DNA, 18 bp, Artificial Sequence
  Synthetic DNA
ggaatcgactcactatcg

SEQ ID NO: 64317 - DNA, 18 bp, Artificial Sequence
  Synthetic DNA
ggagacgtttaactatag

SEQ ID NO: 64318 - DNA, 18 bp, Artificial Sequence
  Synthetic DNA
ggattagacacactttag

SEQ ID NO: 64319 - DNA, 18 bp, Artificial Sequence
  Synthetic DNA
gtataagactcaatagtg

SEQ ID NO: 64320 - DNA, 18 bp, Artificial Sequence
  Synthetic DNA
gtataatgctcactatag

SEQ ID NO: 64321 - DNA, 18 bp, Artificial Sequence
  Synthetic DNA
gtatacgacccactccag

SEQ ID NO: 64322 - DNA, 18 bp, Artificial Sequence
  Synthetic DNA
gtatacgactaacaaatg

SEQ ID NO: 64323 - DNA, 18 bp, Artificial Sequence
  Synthetic DNA
gtatcatactctctattg

SEQ ID NO: 64324 - DNA, 18 bp, Artificial Sequence
  Synthetic DNA
gtatgcgactcacaatcg

SEQ ID NO: 64325 - DNA, 18 bp, Artificial Sequence
  Synthetic DNA
gtattaggctcactagcg

SEQ ID NO: 64326 - DNA, 18 bp, Artificial Sequence
  Synthetic DNA
gttacagactcacttatg

SEQ ID NO: 64327 - DNA, 18 bp, Artificial Sequence
  Synthetic DNA
gttcacctctcactaagg

SEQ ID NO: 64328 - DNA, 18 bp, Artificial Sequence
  Synthetic DNA
gtttacgactcaatattg

SEQ ID NO: 64329 - DNA, 18 bp, Artificial Sequence
  Synthetic DNA
taaaaaaatacactatag

SEQ ID NO: 64330 - DNA, 18 bp, Artificial Sequence
  Synthetic DNA
taaaaagacacacttttg

SEQ ID NO: 64331 - DNA, 18 bp, Artificial Sequence
  Synthetic DNA
taaaaagactaaggatag

SEQ ID NO: 64332 - DNA, 18 bp, Artificial Sequence
  Synthetic DNA
taaaaagactcacaaatg

SEQ ID NO: 64333 - DNA, 18 bp, Artificial Sequence
  Synthetic DNA
taaaaagactgaccattg

SEQ ID NO: 64334 - DNA, 18 bp, Artificial Sequence
  Synthetic DNA
taaaaaggcacaatatag

SEQ ID NO: 64335 - DNA, 18 bp, Artificial Sequence
  Synthetic DNA
taaaaagtatcactaatg

SEQ ID NO: 64336 - DNA, 18 bp, Artificial Sequence
  Synthetic DNA
taaaacaactcacttatg

SEQ ID NO: 64337 - DNA, 18 bp, Artificial Sequence
  Synthetic DNA
taaaacaactctctagtg

SEQ ID NO: 64338 - DNA, 18 bp, Artificial Sequence
  Synthetic DNA
taaaacatctaattggcg

SEQ ID NO: 64339 - DNA, 18 bp, Artificial Sequence
  Synthetic DNA
taaaacatttcccctaag

SEQ ID NO: 64340 - DNA, 18 bp, Artificial Sequence
  Synthetic DNA
taaaacctccgactattg

SEQ ID NO: 64341 - DNA, 18 bp, Artificial Sequence
  Synthetic DNA
taaaacctctcataatag

SEQ ID NO: 64342 - DNA, 18 bp, Artificial Sequence
  Synthetic DNA
taaaacctttcactttag

SEQ ID NO: 64343 - DNA, 18 bp, Artificial Sequence
  Synthetic DNA
taaaacgaaccactaccg

SEQ ID NO: 64344 - DNA, 18 bp, Artificial Sequence
  Synthetic DNA
taaaacgaatacttatag

SEQ ID NO: 64345 - DNA, 18 bp, Artificial Sequence
  Synthetic DNA
taaaacgaatctacatag

SEQ ID NO: 64346 - DNA, 18 bp, Artificial Sequence
  Synthetic DNA
taaaacgacgcaataacg

SEQ ID NO: 64347 - DNA, 18 bp, Artificial Sequence
  Synthetic DNA
taaaacgactgttaaaag

SEQ ID NO: 64348 - DNA, 18 bp, Artificial Sequence
  Synthetic DNA
taaaacgattcacatcag

SEQ ID NO: 64349 - DNA, 18 bp, Artificial Sequence
  Synthetic DNA
taaaacgccttacactag

SEQ ID NO: 64350 - DNA, 18 bp, Artificial Sequence
  Synthetic DNA
taaaacgcgtcgatacag

SEQ ID NO: 64351 - DNA, 18 bp, Artificial Sequence
  Synthetic DNA
taaaacgcttagctatag

SEQ ID NO: 64352 - DNA, 18 bp, Artificial Sequence
  Synthetic DNA
taaaacgcttcattaatg

SEQ ID NO: 64353 - DNA, 18 bp, Artificial Sequence
  Synthetic DNA
taaaacggctcatattag

SEQ ID NO: 64354 - DNA, 18 bp, Artificial Sequence
  Synthetic DNA
taaaacgtcaccctaaag

SEQ ID NO: 64355 - DNA, 18 bp, Artificial Sequence
  Synthetic DNA
taaaacgtcttattaaag

SEQ ID NO: 64356 - DNA, 18 bp, Artificial Sequence
  Synthetic DNA
taaaacgttaacctatag

SEQ ID NO: 64357 - DNA, 18 bp, Artificial Sequence
  Synthetic DNA
taaaacgtttcacttcag

SEQ ID NO: 64358 - DNA, 18 bp, Artificial Sequence
  Synthetic DNA
taaaactacacacgttag

SEQ ID NO: 64359 - DNA, 18 bp, Artificial Sequence
  Synthetic DNA
taaaactacccagaatag

SEQ ID NO: 64360 - DNA, 18 bp, Artificial Sequence
  Synthetic DNA
taaaactatcctttattg

SEQ ID NO: 64361 - DNA, 18 bp, Artificial Sequence
  Synthetic DNA
taaaactattaaatattg

SEQ ID NO: 64362 - DNA, 18 bp, Artificial Sequence
  Synthetic DNA
taaaactattccctattg

SEQ ID NO: 64363 - DNA, 18 bp, Artificial Sequence
  Synthetic DNA
taaaactcctcacactag

SEQ ID NO: 64364 - DNA, 18 bp, Artificial Sequence
  Synthetic DNA
taaaacttatcacaatag

SEQ ID NO: 64365 - DNA, 18 bp, Artificial Sequence
  Synthetic DNA
taaaacttcacaatattg

SEQ ID NO: 64366 - DNA, 18 bp, Artificial Sequence
  Synthetic DNA
taaaacttcccattctag

SEQ ID NO: 64367 - DNA, 18 bp, Artificial Sequence
  Synthetic DNA
taaaacttctttctatag

SEQ ID NO: 64368 - DNA, 18 bp, Artificial Sequence
  Synthetic DNA
taaaagaactcacaaaag

SEQ ID NO: 64369 - DNA, 18 bp, Artificial Sequence
  Synthetic DNA
taaaaggactcaataagg

SEQ ID NO: 64370 - DNA, 18 bp, Artificial Sequence
  Synthetic DNA
taaaaggattcacttttg

SEQ ID NO: 64371 - DNA, 18 bp, Artificial Sequence
  Synthetic DNA
taaaagggctaactaaag

SEQ ID NO: 64372 - DNA, 18 bp, Artificial Sequence
  Synthetic DNA
taaaaggtcacagaatag

SEQ ID NO: 64373 - DNA, 18 bp, Artificial Sequence
  Synthetic DNA
taaaataattccccatag

SEQ ID NO: 64374 - DNA, 18 bp, Artificial Sequence
  Synthetic DNA
taaaatgaccttttatag

SEQ ID NO: 64375 - DNA, 18 bp, Artificial Sequence
  Synthetic DNA
taaaatgactctctaagg

SEQ ID NO: 64376 - DNA, 18 bp, Artificial Sequence
  Synthetic DNA
taaaatgtttcacttttg

SEQ ID NO: 64377 - DNA, 18 bp, Artificial Sequence
  Synthetic DNA
taaaattactctctaaag

SEQ ID NO: 64378 - DNA, 18 bp, Artificial Sequence
  Synthetic DNA
taaaattactctcttgag

SEQ ID NO: 64379 - DNA, 18 bp, Artificial Sequence
  Synthetic DNA
taaaccgacacacaaaag

SEQ ID NO: 64380 - DNA, 18 bp, Artificial Sequence
  Synthetic DNA
taaaccgcctcaccattg

SEQ ID NO: 64381 - DNA, 18 bp, Artificial Sequence
  Synthetic DNA
taaaccgtcatactatag

SEQ ID NO: 64382 - DNA, 18 bp, Artificial Sequence
  Synthetic DNA
taaaccgtctgcctatag

SEQ ID NO: 64383 - DNA, 18 bp, Artificial Sequence
  Synthetic DNA
taaaccgtttttctatag

SEQ ID NO: 64384 - DNA, 18 bp, Artificial Sequence
  Synthetic DNA
taaacctactgtctatag

SEQ ID NO: 64385 - DNA, 18 bp, Artificial Sequence
  Synthetic DNA
taaacctattcactacag

SEQ ID NO: 64386 - DNA, 18 bp, Artificial Sequence
  Synthetic DNA
taaacctgctcaatatcg

SEQ ID NO: 64387 - DNA, 18 bp, Artificial Sequence
  Synthetic DNA
taaaccttatcactatcg

SEQ ID NO: 64388 - DNA, 18 bp, Artificial Sequence
  Synthetic DNA
taaacggccacacttcag

SEQ ID NO: 64389 - DNA, 18 bp, Artificial Sequence
  Synthetic DNA
taaagagtctcactaacg

SEQ ID NO: 64390 - DNA, 18 bp, Artificial Sequence
  Synthetic DNA
taaagcgttacactttag

SEQ ID NO: 64391 - DNA, 18 bp, Artificial Sequence
  Synthetic DNA
taaaggtactctcgatag

SEQ ID NO: 64392 - DNA, 18 bp, Artificial Sequence
  Synthetic DNA
taaatagtctcactatcg

SEQ ID NO: 64393 - DNA, 18 bp, Artificial Sequence
  Synthetic DNA
taaatagtcttatcaaag

SEQ ID NO: 64394 - DNA, 18 bp, Artificial Sequence
  Synthetic DNA
taaatatactcaataaag

SEQ ID NO: 64395 - DNA, 18 bp, Artificial Sequence
  Synthetic DNA
taaatcgaaacattaacg

SEQ ID NO: 64396 - DNA, 18 bp, Artificial Sequence
  Synthetic DNA
taaatcgacaaacaatag

SEQ ID NO: 64397 - DNA, 18 bp, Artificial Sequence
  Synthetic DNA
taaatcgactcacatcag

SEQ ID NO: 64398 - DNA, 18 bp, Artificial Sequence
  Synthetic DNA
taaatcgactcacttagg

SEQ ID NO: 64399 - DNA, 18 bp, Artificial Sequence
  Synthetic DNA
taaatcgactcaggcaag

SEQ ID NO: 64400 - DNA, 18 bp, Artificial Sequence
  Synthetic DNA
taaatcgactcataaaag

SEQ ID NO: 64401 - DNA, 18 bp, Artificial Sequence
  Synthetic DNA
taaatcgactcgtttttg

SEQ ID NO: 64402 - DNA, 18 bp, Artificial Sequence
  Synthetic DNA
taaatcgattaactctag

SEQ ID NO: 64403 - DNA, 18 bp, Artificial Sequence
  Synthetic DNA
taaatctacgcactttag

SEQ ID NO: 64404 - DNA, 18 bp, Artificial Sequence
  Synthetic DNA
taaatggactaacttgag

SEQ ID NO: 64405 - DNA, 18 bp, Artificial Sequence
  Synthetic DNA
taaatggactcattgaag

SEQ ID NO: 64406 - DNA, 18 bp, Artificial Sequence
  Synthetic DNA
taaattgactccttatag

SEQ ID NO: 64407 - DNA, 18 bp, Artificial Sequence
  Synthetic DNA
taacaaagctcataatag

SEQ ID NO: 64408 - DNA, 18 bp, Artificial Sequence
  Synthetic DNA
taacaagaccaagtttag

SEQ ID NO: 64409 - DNA, 18 bp, Artificial Sequence
  Synthetic DNA
taacaagattccttttag

SEQ ID NO: 64410 - DNA, 18 bp, Artificial Sequence
  Synthetic DNA
taacaagctacactttgg

SEQ ID NO: 64411 - DNA, 18 bp, Artificial Sequence
  Synthetic DNA
taacacaaataactacag

SEQ ID NO: 64412 - DNA, 18 bp, Artificial Sequence
  Synthetic DNA
taacacataacactatag

SEQ ID NO: 64413 - DNA, 18 bp, Artificial Sequence
  Synthetic DNA
taacacatctaactatcg

SEQ ID NO: 64414 - DNA, 18 bp, Artificial Sequence
  Synthetic DNA
taacacatctcattctag

SEQ ID NO: 64415 - DNA, 18 bp, Artificial Sequence
  Synthetic DNA
taacacatctcccaatgg

SEQ ID NO: 64416 - DNA, 18 bp, Artificial Sequence
  Synthetic DNA
taacaccactaaaaaatg

SEQ ID NO: 64417 - DNA, 18 bp, Artificial Sequence
  Synthetic DNA
taacacgaagcaaagaag

SEQ ID NO: 64418 - DNA, 18 bp, Artificial Sequence
  Synthetic DNA
taacacgacacattgcaa

SEQ ID NO: 64419 - DNA, 18 bp, Artificial Sequence
  Synthetic DNA
taacacgacagacttaag

SEQ ID NO: 64420 - DNA, 18 bp, Artificial Sequence
  Synthetic DNA
taacacgacggacttcag

SEQ ID NO: 64421 - DNA, 18 bp, Artificial Sequence
  Synthetic DNA
taacacgactatcaattg

SEQ ID NO: 64422 - DNA, 18 bp, Artificial Sequence
  Synthetic DNA
taacacgactcaacaacg

SEQ ID NO: 64423 - DNA, 18 bp, Artificial Sequence
  Synthetic DNA
taacacgactccatgttg

SEQ ID NO: 64424 - DNA, 18 bp, Artificial Sequence
  Synthetic DNA
taacacgactctttaacg

SEQ ID NO: 64425 - DNA, 18 bp, Artificial Sequence
  Synthetic DNA
taacacgagtctatgtag

SEQ ID NO: 64426 - DNA, 18 bp, Artificial Sequence
  Synthetic DNA
taacacgatacgctattg

SEQ ID NO: 64427 - DNA, 18 bp, Artificial Sequence
  Synthetic DNA
taacacgattctctaatg

SEQ ID NO: 64428 - DNA, 18 bp, Artificial Sequence
  Synthetic DNA
taacacgattctttctag

SEQ ID NO: 64429 - DNA, 18 bp, Artificial Sequence
  Synthetic DNA
taacacgccttaccctag

SEQ ID NO: 64430 - DNA, 18 bp, Artificial Sequence
  Synthetic DNA
taacacgtcttgcaatag

SEQ ID NO: 64431 - DNA, 18 bp, Artificial Sequence
  Synthetic DNA
taacactaaccactgtag

SEQ ID NO: 64432 - DNA, 18 bp, Artificial Sequence
  Synthetic DNA
taacactacacaccaagg

SEQ ID NO: 64433 - DNA, 18 bp, Artificial Sequence
  Synthetic DNA
taacactagtcactcccg

SEQ ID NO: 64434 - DNA, 18 bp, Artificial Sequence
  Synthetic DNA
taacacttttcattatag

SEQ ID NO: 64435 - DNA, 18 bp, Artificial Sequence
  Synthetic DNA
taacagcaatcactgtag

SEQ ID NO: 64436 - DNA, 18 bp, Artificial Sequence
  Synthetic DNA
taacaggactatccatag

SEQ ID NO: 64437 - DNA, 18 bp, Artificial Sequence
  Synthetic DNA
taacaggactgtctatcg

SEQ ID NO: 64438 - DNA, 18 bp, Artificial Sequence
  Synthetic DNA
taacataaccaactaaag

SEQ ID NO: 64439 - DNA, 18 bp, Artificial Sequence
  Synthetic DNA
taacatgacacataatag

SEQ ID NO: 64440 - DNA, 18 bp, Artificial Sequence
  Synthetic DNA
taacatgtctctttatag

SEQ ID NO: 64441 - DNA, 18 bp, Artificial Sequence
  Synthetic DNA
taacattactctcttagg

SEQ ID NO: 64442 - DNA, 18 bp, Artificial Sequence
  Synthetic DNA
taacccgacgctatatag

SEQ ID NO: 64443 - DNA, 18 bp, Artificial Sequence
  Synthetic DNA
taacctgatccaccaaag

SEQ ID NO: 64444 - DNA, 18 bp, Artificial Sequence
  Synthetic DNA
taacgcgagacactttag

SEQ ID NO: 64445 - DNA, 18 bp, Artificial Sequence
  Synthetic DNA
taacgcggcttaggatag

SEQ ID NO: 64446 - DNA, 18 bp, Artificial Sequence
  Synthetic DNA
taacgtatctcacacttg

SEQ ID NO: 64447 - DNA, 18 bp, Artificial Sequence
  Synthetic DNA
taactagccacactacag

SEQ ID NO: 64448 - DNA, 18 bp, Artificial Sequence
  Synthetic DNA
taactcaactcactcaag

SEQ ID NO: 64449 - DNA, 18 bp, Artificial Sequence
  Synthetic DNA
taactcaccatacaaaag

SEQ ID NO: 64450 - DNA, 18 bp, Artificial Sequence
  Synthetic DNA
taactcacttgtcgttag

SEQ ID NO: 64451 - DNA, 18 bp, Artificial Sequence
  Synthetic DNA
taactcctcttacactag

SEQ ID NO: 64452 - DNA, 18 bp, Artificial Sequence
  Synthetic DNA
taactcgacactcgatag

SEQ ID NO: 64453 - DNA, 18 bp, Artificial Sequence
  Synthetic DNA
taactcgactcacgaatg

SEQ ID NO: 64454 - DNA, 18 bp, Artificial Sequence
  Synthetic DNA
taactcgactgacgttag

SEQ ID NO: 64455 - DNA, 18 bp, Artificial Sequence
  Synthetic DNA
taactcgccacattacag

SEQ ID NO: 64456 - DNA, 18 bp, Artificial Sequence
  Synthetic DNA
taactcgtcccactagcg

SEQ ID NO: 64457 - DNA, 18 bp, Artificial Sequence
  Synthetic DNA
taactcttctaaatttag

SEQ ID NO: 64458 - DNA, 18 bp, Artificial Sequence
  Synthetic DNA
taactcttctcacaatag

SEQ ID NO: 64459 - DNA, 18 bp, Artificial Sequence
  Synthetic DNA
taagaagatttacaatag

SEQ ID NO: 64460 - DNA, 18 bp, Artificial Sequence
  Synthetic DNA
taagacaattcacttaag

SEQ ID NO: 64461 - DNA, 18 bp, Artificial Sequence
  Synthetic DNA
taagaccattatcaatgg

SEQ ID NO: 64462 - DNA, 18 bp, Artificial Sequence
  Synthetic DNA
taagacgacatacttaag

SEQ ID NO: 64463 - DNA, 18 bp, Artificial Sequence
  Synthetic DNA
taagacgactcttattag

SEQ ID NO: 64464 - DNA, 18 bp, Artificial Sequence
  Synthetic DNA
taagacgatccccagtag

SEQ ID NO: 64465 - DNA, 18 bp, Artificial Sequence
  Synthetic DNA
taagacgatttagtttag

SEQ ID NO: 64466 - DNA, 18 bp, Artificial Sequence
  Synthetic DNA
taagacgatttccaatag

SEQ ID NO: 64467 - DNA, 18 bp, Artificial Sequence
  Synthetic DNA
taagacgcctcacttctg

SEQ ID NO: 64468 - DNA, 18 bp, Artificial Sequence
  Synthetic DNA
taagacggctcatagaag

SEQ ID NO: 64469 - DNA, 18 bp, Artificial Sequence
  Synthetic DNA
taagactattcacttttg

SEQ ID NO: 64470 - DNA, 18 bp, Artificial Sequence
  Synthetic DNA
taagagaacattctatag

SEQ ID NO: 64471 - DNA, 18 bp, Artificial Sequence
  Synthetic DNA
taagagggctttatatag

SEQ ID NO: 64472 - DNA, 18 bp, Artificial Sequence
  Synthetic DNA
taagatcaattactaaag

SEQ ID NO: 64473 - DNA, 18 bp, Artificial Sequence
  Synthetic DNA
taagatgagcccatatag

SEQ ID NO: 64474 - DNA, 18 bp, Artificial Sequence
  Synthetic DNA
taagtccactctattgtg

SEQ ID NO: 64475 - DNA, 18 bp, Artificial Sequence
  Synthetic DNA
taagtcgtataactgtag

SEQ ID NO: 64476 - DNA, 18 bp, Artificial Sequence
  Synthetic DNA
taagtcgtttcaatatag

SEQ ID NO: 64477 - DNA, 18 bp, Artificial Sequence
  Synthetic DNA
taagtctacaccttatcg

SEQ ID NO: 64478 - DNA, 18 bp, Artificial Sequence
  Synthetic DNA
taagtgtagtcacttttg

SEQ ID NO: 64479 - DNA, 18 bp, Artificial Sequence
  Synthetic DNA
taagttgattcattatag

SEQ ID NO: 64480 - DNA, 18 bp, Artificial Sequence
  Synthetic DNA
taagttgtcacactaatg

SEQ ID NO: 64481 - DNA, 18 bp, Artificial Sequence
  Synthetic DNA
taataaaaatctcaatag

SEQ ID NO: 64482 - DNA, 18 bp, Artificial Sequence
  Synthetic DNA
taataaaacgctccatag

SEQ ID NO: 64483 - DNA, 18 bp, Artificial Sequence
  Synthetic DNA
taataacaacctcaatag

SEQ ID NO: 64484 - DNA, 18 bp, Artificial Sequence
  Synthetic DNA
taataacactcacttatg

SEQ ID NO: 64485 - DNA, 18 bp, Artificial Sequence
  Synthetic DNA
taataacattcacattag

SEQ ID NO: 64486 - DNA, 18 bp, Artificial Sequence
  Synthetic DNA
taataagaatcaaattag

SEQ ID NO: 64487 - DNA, 18 bp, Artificial Sequence
  Synthetic DNA
taataagaatcccaaaag

SEQ ID NO: 64488 - DNA, 18 bp, Artificial Sequence
  Synthetic DNA
taataagacacaataatg

SEQ ID NO: 64489 - DNA, 18 bp, Artificial Sequence
  Synthetic DNA
taataagacagtttatag

SEQ ID NO: 64490 - DNA, 18 bp, Artificial Sequence
  Synthetic DNA
taataagaccaatataag

SEQ ID NO: 64491 - DNA, 18 bp, Artificial Sequence
  Synthetic DNA
taataagacccgcaatgg

SEQ ID NO: 64492 - DNA, 18 bp, Artificial Sequence
  Synthetic DNA
taataagaccgattaaag

SEQ ID NO: 64493 - DNA, 18 bp, Artificial Sequence
  Synthetic DNA
taataagactctgcttag

SEQ ID NO: 64494 - DNA, 18 bp, Artificial Sequence
  Synthetic DNA
taataagactgacaactg

SEQ ID NO: 64495 - DNA, 18 bp, Artificial Sequence
  Synthetic DNA
taataagacttcccattg

SEQ ID NO: 64496 - DNA, 18 bp, Artificial Sequence
  Synthetic DNA
taataagattcccattag

SEQ ID NO: 64497 - DNA, 18 bp, Artificial Sequence
  Synthetic DNA
taataagcctgaattaag

SEQ ID NO: 64498 - DNA, 18 bp, Artificial Sequence
  Synthetic DNA
taataagtcggtctatag

SEQ ID NO: 64499 - DNA, 18 bp, Artificial Sequence
  Synthetic DNA
taataatacactccaacg

SEQ ID NO: 64500 - DNA, 18 bp, Artificial Sequence
  Synthetic DNA
taataatactcagtactg

SEQ ID NO: 64501 - DNA, 18 bp, Artificial Sequence
  Synthetic DNA
taataatacttaatatgg

SEQ ID NO: 64502 - DNA, 18 bp, Artificial Sequence
  Synthetic DNA
taataattcgctcataag

SEQ ID NO: 64503 - DNA, 18 bp, Artificial Sequence
  Synthetic DNA
taataattctaattattg

SEQ ID NO: 64504 - DNA, 18 bp, Artificial Sequence
  Synthetic DNA
taataattctcacaattg

SEQ ID NO: 64505 - DNA, 18 bp, Artificial Sequence
  Synthetic DNA
taatacaacactccttag

SEQ ID NO: 64506 - DNA, 18 bp, Artificial Sequence
  Synthetic DNA
taatacaactcaattacg

SEQ ID NO: 64507 - DNA, 18 bp, Artificial Sequence
  Synthetic DNA
taatacaacttacttacg

SEQ ID NO: 64508 - DNA, 18 bp, Artificial Sequence
  Synthetic DNA
taatacaataaactatgg

SEQ ID NO: 64509 - DNA, 18 bp, Artificial Sequence
  Synthetic DNA
taatacaatatacgatag

SEQ ID NO: 64510 - DNA, 18 bp, Artificial Sequence
  Synthetic DNA
taatacaatgtcctatag

SEQ ID NO: 64511 - DNA, 18 bp, Artificial Sequence
  Synthetic DNA
taatacaattcgctaagg

SEQ ID NO: 64512 - DNA, 18 bp, Artificial Sequence
  Synthetic DNA
taatacaattttcttcag

SEQ ID NO: 64513 - DNA, 18 bp, Artificial Sequence
  Synthetic DNA
taatacaccacactaagg

SEQ ID NO: 64514 - DNA, 18 bp, Artificial Sequence
  Synthetic DNA
taatacaccagactccag

SEQ ID NO: 64515 - DNA, 18 bp, Artificial Sequence
  Synthetic DNA
taatacacctcagtaatg

SEQ ID NO: 64516 - DNA, 18 bp, Artificial Sequence
  Synthetic DNA
taatacacgtcataatag

SEQ ID NO: 64517 - DNA, 18 bp, Artificial Sequence
  Synthetic DNA
taatacataacacaatgg

SEQ ID NO: 64518 - DNA, 18 bp, Artificial Sequence
  Synthetic DNA
taatacatcacattaatg

SEQ ID NO: 64519 - DNA, 18 bp, Artificial Sequence
  Synthetic DNA
taatacatctcacctgag

SEQ ID NO: 64520 - DNA, 18 bp, Artificial Sequence
  Synthetic DNA
taatacattaccctatag

SEQ ID NO: 64521 - DNA, 18 bp, Artificial Sequence
  Synthetic DNA
taataccaatcatcaacg

SEQ ID NO: 64522 - DNA, 18 bp, Artificial Sequence
  Synthetic DNA
taataccaatctctgttg

SEQ ID NO: 64523 - DNA, 18 bp, Artificial Sequence
  Synthetic DNA
taataccatacgctaatg

SEQ ID NO: 64524 - DNA, 18 bp, Artificial Sequence
  Synthetic DNA
taataccattgtcttaag

SEQ ID NO: 64525 - DNA, 18 bp, Artificial Sequence
  Synthetic DNA
taataccattttccatag

SEQ ID NO: 64526 - DNA, 18 bp, Artificial Sequence
  Synthetic DNA
taataccgttccttttag

SEQ ID NO: 64527 - DNA, 18 bp, Artificial Sequence
  Synthetic DNA
taatacctatctctacag

SEQ ID NO: 64528 - DNA, 18 bp, Artificial Sequence
  Synthetic DNA
taatacctcataatatcg

SEQ ID NO: 64529 - DNA, 18 bp, Artificial Sequence
  Synthetic DNA
taatacctctgaccatcg

SEQ ID NO: 64530 - DNA, 18 bp, Artificial Sequence
  Synthetic DNA
taatacctctgcttgttg

SEQ ID NO: 64531 - DNA, 18 bp, Artificial Sequence
  Synthetic DNA
taatacgaaacatttaag

SEQ ID NO: 64532 - DNA, 18 bp, Artificial Sequence
  Synthetic DNA
taatacgaaactctcaag

SEQ ID NO: 64533 - DNA, 18 bp, Artificial Sequence
  Synthetic DNA
taatacgaaccaccttgg

SEQ ID NO: 64534 - DNA, 18 bp, Artificial Sequence
  Synthetic DNA
taatacgaataaagaaag

SEQ ID NO: 64535 - DNA, 18 bp, Artificial Sequence
  Synthetic DNA
taatacgaataacataag

SEQ ID NO: 64536 - DNA, 18 bp, Artificial Sequence
  Synthetic DNA
taatacgaatatcagttg

SEQ ID NO: 64537 - DNA, 18 bp, Artificial Sequence
  Synthetic DNA
taatacgacaccttaatg

SEQ ID NO: 64538 - DNA, 18 bp, Artificial Sequence
  Synthetic DNA
taatacgacattcaacag

SEQ ID NO: 64539 - DNA, 18 bp, Artificial Sequence
  Synthetic DNA
taatacgacattcttttg

SEQ ID NO: 64540 - DNA, 18 bp, Artificial Sequence
  Synthetic DNA
taatacgacattttacag

SEQ ID NO: 64541 - DNA, 18 bp, Artificial Sequence
  Synthetic DNA
taatacgaccctaaattg

SEQ ID NO: 64542 - DNA, 18 bp, Artificial Sequence
  Synthetic DNA
taatacgactaagttcgg

SEQ ID NO: 64543 - DNA, 18 bp, Artificial Sequence
  Synthetic DNA
taatacgactatattcag

SEQ ID NO: 64544 - DNA, 18 bp, Artificial Sequence
  Synthetic DNA
taatacgactgtacaaag

SEQ ID NO: 64545 - DNA, 18 bp, Artificial Sequence
  Synthetic DNA
taatacgactttaaaaag

SEQ ID NO: 64546 - DNA, 18 bp, Artificial Sequence
  Synthetic DNA
taatacgactttccctcg

SEQ ID NO: 64547 - DNA, 18 bp, Artificial Sequence
  Synthetic DNA
taatacgagacacaaatg

SEQ ID NO: 64548 - DNA, 18 bp, Artificial Sequence
  Synthetic DNA
taatacgagactcgtttg

SEQ ID NO: 64549 - DNA, 18 bp, Artificial Sequence
  Synthetic DNA
taatacgagcaattatgg

SEQ ID NO: 64550 - DNA, 18 bp, Artificial Sequence
  Synthetic DNA
taatacgagcgtctttag

SEQ ID NO: 64551 - DNA, 18 bp, Artificial Sequence
  Synthetic DNA
taatacgaggcaataacg

SEQ ID NO: 64552 - DNA, 18 bp, Artificial Sequence
  Synthetic DNA
taatacgagtctaaattg

SEQ ID NO: 64553 - DNA, 18 bp, Artificial Sequence
  Synthetic DNA
taatacgagtggttaaag

SEQ ID NO: 64554 - DNA, 18 bp, Artificial Sequence
  Synthetic DNA
taatacgatactcgagcg

SEQ ID NO: 64555 - DNA, 18 bp, Artificial Sequence
  Synthetic DNA
taatacgatataccatcg

SEQ ID NO: 64556 - DNA, 18 bp, Artificial Sequence
  Synthetic DNA
taatacgatatttcatag

SEQ ID NO: 64557 - DNA, 18 bp, Artificial Sequence
  Synthetic DNA
taatacgatcaacgattg

SEQ ID NO: 64558 - DNA, 18 bp, Artificial Sequence
  Synthetic DNA
taatacgatctgctattg

SEQ ID NO: 64559 - DNA, 18 bp, Artificial Sequence
  Synthetic DNA
taatacgattctacattg

SEQ ID NO: 64560 - DNA, 18 bp, Artificial Sequence
  Synthetic DNA
taatacgccactcaattg

SEQ ID NO: 64561 - DNA, 18 bp, Artificial Sequence
  Synthetic DNA
taatacgccactttgtag

SEQ ID NO: 64562 - DNA, 18 bp, Artificial Sequence
  Synthetic DNA
taatacgctcctctattg

SEQ ID NO: 64563 - DNA, 18 bp, Artificial Sequence
  Synthetic DNA
taatacggccccaaacag

SEQ ID NO: 64564 - DNA, 18 bp, Artificial Sequence
  Synthetic DNA
taatacgggtgaccttag

SEQ ID NO: 64565 - DNA, 18 bp, Artificial Sequence
  Synthetic DNA
taatacgggttacttaag

SEQ ID NO: 64566 - DNA, 18 bp, Artificial Sequence
  Synthetic DNA
taatacggtactcataag

SEQ ID NO: 64567 - DNA, 18 bp, Artificial Sequence
  Synthetic DNA
taatacggtgctatattg

SEQ ID NO: 64568 - DNA, 18 bp, Artificial Sequence
  Synthetic DNA
taatacgtataaacatag

SEQ ID NO: 64569 - DNA, 18 bp, Artificial Sequence
  Synthetic DNA
taatacgtattactaatg

SEQ ID NO: 64570 - DNA, 18 bp, Artificial Sequence
  Synthetic DNA
taatacgtcactttctag

SEQ ID NO: 64571 - DNA, 18 bp, Artificial Sequence
  Synthetic DNA
taatacgtcccgctttcg

SEQ ID NO: 64572 - DNA, 18 bp, Artificial Sequence
  Synthetic DNA
taatacgtcccttaatag

SEQ ID NO: 64573 - DNA, 18 bp, Artificial Sequence
  Synthetic DNA
taatacgtcccttcatag

SEQ ID NO: 64574 - DNA, 18 bp, Artificial Sequence
  Synthetic DNA
taatacgtctctatttgg

SEQ ID NO: 64575 - DNA, 18 bp, Artificial Sequence
  Synthetic DNA
taatacgtctctcatgtg

SEQ ID NO: 64576 - DNA, 18 bp, Artificial Sequence
  Synthetic DNA
taatacgtctctgcgtag

SEQ ID NO: 64577 - DNA, 18 bp, Artificial Sequence
  Synthetic DNA
taatacgtctgtttaaag

SEQ ID NO: 64578 - DNA, 18 bp, Artificial Sequence
  Synthetic DNA
taatacgtcttaataatg

SEQ ID NO: 64579 - DNA, 18 bp, Artificial Sequence
  Synthetic DNA
taatacgtctttcctttg

SEQ ID NO: 64580 - DNA, 18 bp, Artificial Sequence
  Synthetic DNA
taatacgtgtcataaagg

SEQ ID NO: 64581 - DNA, 18 bp, Artificial Sequence
  Synthetic DNA
taatacgtgtcattacgg

SEQ ID NO: 64582 - DNA, 18 bp, Artificial Sequence
  Synthetic DNA
taatacgtttcaaaatcg

SEQ ID NO: 64583 - DNA, 18 bp, Artificial Sequence
  Synthetic DNA
taatacgttttacaattg

SEQ ID NO: 64584 - DNA, 18 bp, Artificial Sequence
  Synthetic DNA
taatactacatattattg

SEQ ID NO: 64585 - DNA, 18 bp, Artificial Sequence
  Synthetic DNA
taatactactaactgagg

SEQ ID NO: 64586 - DNA, 18 bp, Artificial Sequence
  Synthetic DNA
taatactactagccaaag

SEQ ID NO: 64587 - DNA, 18 bp, Artificial Sequence
  Synthetic DNA
taatactactatctgttg

SEQ ID NO: 64588 - DNA, 18 bp, Artificial Sequence
  Synthetic DNA
taatactagactctacag

SEQ ID NO: 64589 - DNA, 18 bp, Artificial Sequence
  Synthetic DNA
taatactatactctctag

SEQ ID NO: 64590 - DNA, 18 bp, Artificial Sequence
  Synthetic DNA
taatactatgctttacag

SEQ ID NO: 64591 - DNA, 18 bp, Artificial Sequence
  Synthetic DNA
taatactccatactacag

SEQ ID NO: 64592 - DNA, 18 bp, Artificial Sequence
  Synthetic DNA
taatacttcacacaatgg

SEQ ID NO: 64593 - DNA, 18 bp, Artificial Sequence
  Synthetic DNA
taatacttttcactttgg

SEQ ID NO: 64594 - DNA, 18 bp, Artificial Sequence
  Synthetic DNA
taatactttttctaatag

SEQ ID NO: 64595 - DNA, 18 bp, Artificial Sequence
  Synthetic DNA
taatagcaatctctagag

SEQ ID NO: 64596 - DNA, 18 bp, Artificial Sequence
  Synthetic DNA
taataggaatcttgaaag

SEQ ID NO: 64597 - DNA, 18 bp, Artificial Sequence
  Synthetic DNA
taataggagtagacacag

SEQ ID NO: 64598 - DNA, 18 bp, Artificial Sequence
  Synthetic DNA
taataggatacacttcag

SEQ ID NO: 64599 - DNA, 18 bp, Artificial Sequence
  Synthetic DNA
taataggatccacaagag

SEQ ID NO: 64600 - DNA, 18 bp, Artificial Sequence
  Synthetic DNA
taataggattcaattaag

SEQ ID NO: 64601 - DNA, 18 bp, Artificial Sequence
  Synthetic DNA
taataggtaacactttag

SEQ ID NO: 64602 - DNA, 18 bp, Artificial Sequence
  Synthetic DNA
taataggtctcacatttg

SEQ ID NO: 64603 - DNA, 18 bp, Artificial Sequence
  Synthetic DNA
taataggtctcatttttg

SEQ ID NO: 64604 - DNA, 18 bp, Artificial Sequence
  Synthetic DNA
taatagttctcataattg

SEQ ID NO: 64605 - DNA, 18 bp, Artificial Sequence
  Synthetic DNA
taatataacccattaaag

SEQ ID NO: 64606 - DNA, 18 bp, Artificial Sequence
  Synthetic DNA
taatataagacactttcg

SEQ ID NO: 64607 - DNA, 18 bp, Artificial Sequence
  Synthetic DNA
taatataattcccaatag

SEQ ID NO: 64608 - DNA, 18 bp, Artificial Sequence
  Synthetic DNA
taatataccatacaatcg

SEQ ID NO: 64609 - DNA, 18 bp, Artificial Sequence
  Synthetic DNA
taatatatcttagtatag

SEQ ID NO: 64610 - DNA, 18 bp, Artificial Sequence
  Synthetic DNA
taatatgaaaaacaatag

SEQ ID NO: 64611 - DNA, 18 bp, Artificial Sequence
  Synthetic DNA
taatatgacacaccaatg

SEQ ID NO: 64612 - DNA, 18 bp, Artificial Sequence
  Synthetic DNA
taatatgacacgcattag

SEQ ID NO: 64613 - DNA, 18 bp, Artificial Sequence
  Synthetic DNA
taatatgacgaccaaaag

SEQ ID NO: 64614 - DNA, 18 bp, Artificial Sequence
  Synthetic DNA
taatatgacttacagacg

SEQ ID NO: 64615 - DNA, 18 bp, Artificial Sequence
  Synthetic DNA
taatatgactttctaatg

SEQ ID NO: 64616 - DNA, 18 bp, Artificial Sequence
  Synthetic DNA
taatatgatcctccatag

SEQ ID NO: 64617 - DNA, 18 bp, Artificial Sequence
  Synthetic DNA
taatatgattcacatttg

SEQ ID NO: 64618 - DNA, 18 bp, Artificial Sequence
  Synthetic DNA
taatatgatttacagtag

SEQ ID NO: 64619 - DNA, 18 bp, Artificial Sequence
  Synthetic DNA
taatatgatttgctttag

SEQ ID NO: 64620 - DNA, 18 bp, Artificial Sequence
  Synthetic DNA
taatatgccaccctattg

SEQ ID NO: 64621 - DNA, 18 bp, Artificial Sequence
  Synthetic DNA
taatatgcctcttcatag

SEQ ID NO: 64622 - DNA, 18 bp, Artificial Sequence
  Synthetic DNA
taatatggcttattttag

SEQ ID NO: 64623 - DNA, 18 bp, Artificial Sequence
  Synthetic DNA
taatatgtcacttaatag

SEQ ID NO: 64624 - DNA, 18 bp, Artificial Sequence
  Synthetic DNA
taatatgtccctttgtag

SEQ ID NO: 64625 - DNA, 18 bp, Artificial Sequence
  Synthetic DNA
taatattaatcaatctag

SEQ ID NO: 64626 - DNA, 18 bp, Artificial Sequence
  Synthetic DNA
taatattacaccctaacg

SEQ ID NO: 64627 - DNA, 18 bp, Artificial Sequence
  Synthetic DNA
taatattacactttaaag

SEQ ID NO: 64628 - DNA, 18 bp, Artificial Sequence
  Synthetic DNA
taatattactcatattag

SEQ ID NO: 64629 - DNA, 18 bp, Artificial Sequence
  Synthetic DNA
taatcacactcactcaag

SEQ ID NO: 64630 - DNA, 18 bp, Artificial Sequence
  Synthetic DNA
taatcacctactctttcg

SEQ ID NO: 64631 - DNA, 18 bp, Artificial Sequence
  Synthetic DNA
taatcagaatccctattg

SEQ ID NO: 64632 - DNA, 18 bp, Artificial Sequence
  Synthetic DNA
taatcagaatgactttag

SEQ ID NO: 64633 - DNA, 18 bp, Artificial Sequence
  Synthetic DNA
taatcagacaaatatcag

SEQ ID NO: 64634 - DNA, 18 bp, Artificial Sequence
  Synthetic DNA
taatccacctctcaatcg

SEQ ID NO: 64635 - DNA, 18 bp, Artificial Sequence
  Synthetic DNA
taatcccacccgatatag

SEQ ID NO: 64636 - DNA, 18 bp, Artificial Sequence
  Synthetic DNA
taatcccactaacataag

SEQ ID NO: 64637 - DNA, 18 bp, Artificial Sequence
  Synthetic DNA
taatcccactatcattag

SEQ ID NO: 64638 - DNA, 18 bp, Artificial Sequence
  Synthetic DNA
taatcccactcactgatg

SEQ ID NO: 64639 - DNA, 18 bp, Artificial Sequence
  Synthetic DNA
taatccgaaactatatgg

SEQ ID NO: 64640 - DNA, 18 bp, Artificial Sequence
  Synthetic DNA
taatccgaaactttatag

SEQ ID NO: 64641 - DNA, 18 bp, Artificial Sequence
  Synthetic DNA
taatccgaataaccttag

SEQ ID NO: 64642 - DNA, 18 bp, Artificial Sequence
  Synthetic DNA
taatccgaatcaccaatg

SEQ ID NO: 64643 - DNA, 18 bp, Artificial Sequence
  Synthetic DNA
taatccgactaactcatg

SEQ ID NO: 64644 - DNA, 18 bp, Artificial Sequence
  Synthetic DNA
taatccgactatataaag

SEQ ID NO: 64645 - DNA, 18 bp, Artificial Sequence
  Synthetic DNA
taatccgactttttgtag

SEQ ID NO: 64646 - DNA, 18 bp, Artificial Sequence
  Synthetic DNA
taatccgagtgaaaaaag

SEQ ID NO: 64647 - DNA, 18 bp, Artificial Sequence
  Synthetic DNA
taatccgattccttattg

SEQ ID NO: 64648 - DNA, 18 bp, Artificial Sequence
  Synthetic DNA
taatccgtatctcattag

SEQ ID NO: 64649 - DNA, 18 bp, Artificial Sequence
  Synthetic DNA
taatccgtctaacgctag

SEQ ID NO: 64650 - DNA, 18 bp, Artificial Sequence
  Synthetic DNA
taatccgtctcattaatg

SEQ ID NO: 64651 - DNA, 18 bp, Artificial Sequence
  Synthetic DNA
taatccgtctcccgtagg

SEQ ID NO: 64652 - DNA, 18 bp, Artificial Sequence
  Synthetic DNA
taatccgtttcaccttag

SEQ ID NO: 64653 - DNA, 18 bp, Artificial Sequence
  Synthetic DNA
taatccgtttctctttcg

SEQ ID NO: 64654 - DNA, 18 bp, Artificial Sequence
  Synthetic DNA
taatcctactctcattag

SEQ ID NO: 64655 - DNA, 18 bp, Artificial Sequence
  Synthetic DNA
taatcctactgaagatag

SEQ ID NO: 64656 - DNA, 18 bp, Artificial Sequence
  Synthetic DNA
taatcctatacattatag

SEQ ID NO: 64657 - DNA, 18 bp, Artificial Sequence
  Synthetic DNA
taatcctgctctgtgtag

SEQ ID NO: 64658 - DNA, 18 bp, Artificial Sequence
  Synthetic DNA
taatcggactcaatagtg

SEQ ID NO: 64659 - DNA, 18 bp, Artificial Sequence
  Synthetic DNA
taatctgactaatttcag

SEQ ID NO: 64660 - DNA, 18 bp, Artificial Sequence
  Synthetic DNA
taatctgactcgttatgg

SEQ ID NO: 64661 - DNA, 18 bp, Artificial Sequence
  Synthetic DNA
taatgagactcattcttg

SEQ ID NO: 64662 - DNA, 18 bp, Artificial Sequence
  Synthetic DNA
taatgcatcccaggatgg

SEQ ID NO: 64663 - DNA, 18 bp, Artificial Sequence
  Synthetic DNA
taatgccaatcacattag

SEQ ID NO: 64664 - DNA, 18 bp, Artificial Sequence
  Synthetic DNA
taatgccatttactttag

SEQ ID NO: 64665 - DNA, 18 bp, Artificial Sequence
  Synthetic DNA
taatgcctcacactttag

SEQ ID NO: 64666 - DNA, 18 bp, Artificial Sequence
  Synthetic DNA
taatgcgaaaaactttag

SEQ ID NO: 64667 - DNA, 18 bp, Artificial Sequence
  Synthetic DNA
taatgcgacagtctattg

SEQ ID NO: 64668 - DNA, 18 bp, Artificial Sequence
  Synthetic DNA
taatgcgtatcacattag

SEQ ID NO: 64669 - DNA, 18 bp, Artificial Sequence
  Synthetic DNA
taatgcgtccacctatag

SEQ ID NO: 64670 - DNA, 18 bp, Artificial Sequence
  Synthetic DNA
taatgcgtccttgaattg

SEQ ID NO: 64671 - DNA, 18 bp, Artificial Sequence
  Synthetic DNA
taatgcgtctaaatacag

SEQ ID NO: 64672 - DNA, 18 bp, Artificial Sequence
  Synthetic DNA
taatgctacgcaccattg

SEQ ID NO: 64673 - DNA, 18 bp, Artificial Sequence
  Synthetic DNA
taatgggactccatattg

SEQ ID NO: 64674 - DNA, 18 bp, Artificial Sequence
  Synthetic DNA
taatgggtgaccatatag

SEQ ID NO: 64675 - DNA, 18 bp, Artificial Sequence
  Synthetic DNA
taatggtacccaccatag

SEQ ID NO: 64676 - DNA, 18 bp, Artificial Sequence
  Synthetic DNA
taatgtgacactctttag

SEQ ID NO: 64677 - DNA, 18 bp, Artificial Sequence
  Synthetic DNA
taatgtgacatactttag

SEQ ID NO: 64678 - DNA, 18 bp, Artificial Sequence
  Synthetic DNA
taatgtgactccccaaag

SEQ ID NO: 64679 - DNA, 18 bp, Artificial Sequence
  Synthetic DNA
taatgtgattcattatgg

SEQ ID NO: 64680 - DNA, 18 bp, Artificial Sequence
  Synthetic DNA
taatgttactcatttttg

SEQ ID NO: 64681 - DNA, 18 bp, Artificial Sequence
  Synthetic DNA
taatgtttcttactttgg

SEQ ID NO: 64682 - DNA, 18 bp, Artificial Sequence
  Synthetic DNA
taattaaagtctcaatag

SEQ ID NO: 64683 - DNA, 18 bp, Artificial Sequence
  Synthetic DNA
taattacattctctattg

SEQ ID NO: 64684 - DNA, 18 bp, Artificial Sequence
  Synthetic DNA
taattagacatactctag

SEQ ID NO: 64685 - DNA, 18 bp, Artificial Sequence
  Synthetic DNA
taattagtctcaccattg

SEQ ID NO: 64686 - DNA, 18 bp, Artificial Sequence
  Synthetic DNA
taattcaaataacaatag

SEQ ID NO: 64687 - DNA, 18 bp, Artificial Sequence
  Synthetic DNA
taattcaaatggcgatag

SEQ ID NO: 64688 - DNA, 18 bp, Artificial Sequence
  Synthetic DNA
taattcaacactctttag

SEQ ID NO: 64689 - DNA, 18 bp, Artificial Sequence
  Synthetic DNA
taattcaacagtctacag

SEQ ID NO: 64690 - DNA, 18 bp, Artificial Sequence
  Synthetic DNA
taattcaactcaccaagg

SEQ ID NO: 64691 - DNA, 18 bp, Artificial Sequence
  Synthetic DNA
taattcaactgactaacg

SEQ ID NO: 64692 - DNA, 18 bp, Artificial Sequence
  Synthetic DNA
taattcaactgagattcg

SEQ ID NO: 64693 - DNA, 18 bp, Artificial Sequence
  Synthetic DNA
taattcaactttctgtag

SEQ ID NO: 64694 - DNA, 18 bp, Artificial Sequence
  Synthetic DNA
taattcatacctctttag

SEQ ID NO: 64695 - DNA, 18 bp, Artificial Sequence
  Synthetic DNA
taattcatttcactttag

SEQ ID NO: 64696 - DNA, 18 bp, Artificial Sequence
  Synthetic DNA
taattccaacctcaatag

SEQ ID NO: 64697 - DNA, 18 bp, Artificial Sequence
  Synthetic DNA
taattcctatcattatag

SEQ ID NO: 64698 - DNA, 18 bp, Artificial Sequence
  Synthetic DNA
taattcgaaacactaacg

SEQ ID NO: 64699 - DNA, 18 bp, Artificial Sequence
  Synthetic DNA
taattcgaatctcttttg

SEQ ID NO: 64700 - DNA, 18 bp, Artificial Sequence
  Synthetic DNA
taattcgaattacgattg

SEQ ID NO: 64701 - DNA, 18 bp, Artificial Sequence
  Synthetic DNA
taattcgacataatatgg

SEQ ID NO: 64702 - DNA, 18 bp, Artificial Sequence
  Synthetic DNA
taattcgactccaaagag

SEQ ID NO: 64703 - DNA, 18 bp, Artificial Sequence
  Synthetic DNA
taattcgactttcaaatg

SEQ ID NO: 64704 - DNA, 18 bp, Artificial Sequence
  Synthetic DNA
taattcgagtgacactag

SEQ ID NO: 64705 - DNA, 18 bp, Artificial Sequence
  Synthetic DNA
taattcgatacacaatcg

SEQ ID NO: 64706 - DNA, 18 bp, Artificial Sequence
  Synthetic DNA
taattcgatacatcagag

SEQ ID NO: 64707 - DNA, 18 bp, Artificial Sequence
  Synthetic DNA
taattcgatagatcctgg

SEQ ID NO: 64708 - DNA, 18 bp, Artificial Sequence
  Synthetic DNA
taattcgatatctttaag

SEQ ID NO: 64709 - DNA, 18 bp, Artificial Sequence
  Synthetic DNA
taattcgatgcaaagtag

SEQ ID NO: 64710 - DNA, 18 bp, Artificial Sequence
  Synthetic DNA
taattcgcattactctcg

SEQ ID NO: 64711 - DNA, 18 bp, Artificial Sequence
  Synthetic DNA
taattcgccaagctatag

SEQ ID NO: 64712 - DNA, 18 bp, Artificial Sequence
  Synthetic DNA
taattcgccacagtttag

SEQ ID NO: 64713 - DNA, 18 bp, Artificial Sequence
  Synthetic DNA
taattcggaaaacaacag

SEQ ID NO: 64714 - DNA, 18 bp, Artificial Sequence
  Synthetic DNA
taattcggcaaactacag

SEQ ID NO: 64715 - DNA, 18 bp, Artificial Sequence
  Synthetic DNA
taattcgtaaaacttttg

SEQ ID NO: 64716 - DNA, 18 bp, Artificial Sequence
  Synthetic DNA
taattcgtcaacctagag

SEQ ID NO: 64717 - DNA, 18 bp, Artificial Sequence
  Synthetic DNA
taattcgtcacacaattg

SEQ ID NO: 64718 - DNA, 18 bp, Artificial Sequence
  Synthetic DNA
taattcgtccaaccttag

SEQ ID NO: 64719 - DNA, 18 bp, Artificial Sequence
  Synthetic DNA
taattcgtccatctattg

SEQ ID NO: 64720 - DNA, 18 bp, Artificial Sequence
  Synthetic DNA
taattcgtctaacagtag

SEQ ID NO: 64721 - DNA, 18 bp, Artificial Sequence
  Synthetic DNA
taattcgtctatctaaag

SEQ ID NO: 64722 - DNA, 18 bp, Artificial Sequence
  Synthetic DNA
taattctactatttttag

SEQ ID NO: 64723 - DNA, 18 bp, Artificial Sequence
  Synthetic DNA
taattctattccaaatag

SEQ ID NO: 64724 - DNA, 18 bp, Artificial Sequence
  Synthetic DNA
taattcttatcattatag

SEQ ID NO: 64725 - DNA, 18 bp, Artificial Sequence
  Synthetic DNA
taattctttttaaaagag

SEQ ID NO: 64726 - DNA, 18 bp, Artificial Sequence
  Synthetic DNA
taattggtatcgtaaaag

SEQ ID NO: 64727 - DNA, 18 bp, Artificial Sequence
  Synthetic DNA
taattgtactcaccttgg

SEQ ID NO: 64728 - DNA, 18 bp, Artificial Sequence
  Synthetic DNA
taattgttctctctaatg

SEQ ID NO: 64729 - DNA, 18 bp, Artificial Sequence
  Synthetic DNA
taattgttgtcactaaag

SEQ ID NO: 64730 - DNA, 18 bp, Artificial Sequence
  Synthetic DNA
taatttaattcactcttg

SEQ ID NO: 64731 - DNA, 18 bp, Artificial Sequence
  Synthetic DNA
taatttatctcattatcg

SEQ ID NO: 64732 - DNA, 18 bp, Artificial Sequence
  Synthetic DNA
taatttgacgcgttatag

SEQ ID NO: 64733 - DNA, 18 bp, Artificial Sequence
  Synthetic DNA
taatttgactcatttttg

SEQ ID NO: 64734 - DNA, 18 bp, Artificial Sequence
  Synthetic DNA
taatttgactctcaaaag

SEQ ID NO: 64735 - DNA, 18 bp, Artificial Sequence
  Synthetic DNA
taatttgactctccaaag

SEQ ID NO: 64736 - DNA, 18 bp, Artificial Sequence
  Synthetic DNA
taatttgactctctaatg

SEQ ID NO: 64737 - DNA, 18 bp, Artificial Sequence
  Synthetic DNA
taatttgcttttctatag

SEQ ID NO: 64738 - DNA, 18 bp, Artificial Sequence
  Synthetic DNA
taatttgtatgattattg

SEQ ID NO: 64739 - DNA, 18 bp, Artificial Sequence
  Synthetic DNA
taatttgtctctctattg

SEQ ID NO: 64740 - DNA, 18 bp, Artificial Sequence
  Synthetic DNA
taatttgtcttattatag

SEQ ID NO: 64741 - DNA, 18 bp, Artificial Sequence
  Synthetic DNA
tacaacgacttaagtagg

SEQ ID NO: 64742 - DNA, 18 bp, Artificial Sequence
  Synthetic DNA
tacaacggctcaccaaag

SEQ ID NO: 64743 - DNA, 18 bp, Artificial Sequence
  Synthetic DNA
tacaactaaagactatag

SEQ ID NO: 64744 - DNA, 18 bp, Artificial Sequence
  Synthetic DNA
tacaactaatctctaatg

SEQ ID NO: 64745 - DNA, 18 bp, Artificial Sequence
  Synthetic DNA
tacaactacacacaatag

SEQ ID NO: 64746 - DNA, 18 bp, Artificial Sequence
  Synthetic DNA
tacaattactcactaaag

SEQ ID NO: 64747 - DNA, 18 bp, Artificial Sequence
  Synthetic DNA
tacagccaatcagattag

SEQ ID NO: 64748 - DNA, 18 bp, Artificial Sequence
  Synthetic DNA
tacagctacaatctatag

SEQ ID NO: 64749 - DNA, 18 bp, Artificial Sequence
  Synthetic DNA
tacagttactcactatag

SEQ ID NO: 64750 - DNA, 18 bp, Artificial Sequence
  Synthetic DNA
tacatcgacacactcttg

SEQ ID NO: 64751 - DNA, 18 bp, Artificial Sequence
  Synthetic DNA
tacatcgactcacaaaag

SEQ ID NO: 64752 - DNA, 18 bp, Artificial Sequence
  Synthetic DNA
tacattgactcaataaag

SEQ ID NO: 64753 - DNA, 18 bp, Artificial Sequence
  Synthetic DNA
taccaagaaacatcaaag

SEQ ID NO: 64754 - DNA, 18 bp, Artificial Sequence
  Synthetic DNA
taccacgacccgcttccg

SEQ ID NO: 64755 - DNA, 18 bp, Artificial Sequence
  Synthetic DNA
taccacgactcatttaag

SEQ ID NO: 64756 - DNA, 18 bp, Artificial Sequence
  Synthetic DNA
taccactactcaataacg

SEQ ID NO: 64757 - DNA, 18 bp, Artificial Sequence
  Synthetic DNA
taccgtgactcattatag

SEQ ID NO: 64758 - DNA, 18 bp, Artificial Sequence
  Synthetic DNA
tacgtggacacccaatag

SEQ ID NO: 64759 - DNA, 18 bp, Artificial Sequence
  Synthetic DNA
tactaatactcatttaag

SEQ ID NO: 64760 - DNA, 18 bp, Artificial Sequence
  Synthetic DNA
tactacaacacaaaatag

SEQ ID NO: 64761 - DNA, 18 bp, Artificial Sequence
  Synthetic DNA
tactacatctcactaatg

SEQ ID NO: 64762 - DNA, 18 bp, Artificial Sequence
  Synthetic DNA
tactaccaccgattaccg

SEQ ID NO: 64763 - DNA, 18 bp, Artificial Sequence
  Synthetic DNA
tactaccgttctatatag

SEQ ID NO: 64764 - DNA, 18 bp, Artificial Sequence
  Synthetic DNA
tactacgaatcaaaattg

SEQ ID NO: 64765 - DNA, 18 bp, Artificial Sequence
  Synthetic DNA
tactacgacccataaaag

SEQ ID NO: 64766 - DNA, 18 bp, Artificial Sequence
  Synthetic DNA
tactacgactacctaatg

SEQ ID NO: 64767 - DNA, 18 bp, Artificial Sequence
  Synthetic DNA
tactacgactcaatcatg

SEQ ID NO: 64768 - DNA, 18 bp, Artificial Sequence
  Synthetic DNA
tactacgatataccaatg

SEQ ID NO: 64769 - DNA, 18 bp, Artificial Sequence
  Synthetic DNA
tactacgtcacactaacg

SEQ ID NO: 64770 - DNA, 18 bp, Artificial Sequence
  Synthetic DNA
tactacgtctgattttag

SEQ ID NO: 64771 - DNA, 18 bp, Artificial Sequence
  Synthetic DNA
tactactactctcataag

SEQ ID NO: 64772 - DNA, 18 bp, Artificial Sequence
  Synthetic DNA
tactactactgacgcaag

SEQ ID NO: 64773 - DNA, 18 bp, Artificial Sequence
  Synthetic DNA
tactacttattactattg

SEQ ID NO: 64774 - DNA, 18 bp, Artificial Sequence
  Synthetic DNA
tactagaacttactcttg

SEQ ID NO: 64775 - DNA, 18 bp, Artificial Sequence
  Synthetic DNA
tactaggaccctctatcg

SEQ ID NO: 64776 - DNA, 18 bp, Artificial Sequence
  Synthetic DNA
tactataactcacaatcg

SEQ ID NO: 64777 - DNA, 18 bp, Artificial Sequence
  Synthetic DNA
tactatgaatcactttgg

SEQ ID NO: 64778 - DNA, 18 bp, Artificial Sequence
  Synthetic DNA
tactatgactagcatgag

SEQ ID NO: 64779 - DNA, 18 bp, Artificial Sequence
  Synthetic DNA
tactatgtcacaataaag

SEQ ID NO: 64780 - DNA, 18 bp, Artificial Sequence
  Synthetic DNA
tactccgcccaactatag

SEQ ID NO: 64781 - DNA, 18 bp, Artificial Sequence
  Synthetic DNA
tactgtgacaccctattg

SEQ ID NO: 64782 - DNA, 18 bp, Artificial Sequence
  Synthetic DNA
tacttcaactgaatctag

SEQ ID NO: 64783 - DNA, 18 bp, Artificial Sequence
  Synthetic DNA
tacttcatctcacaatag

SEQ ID NO: 64784 - DNA, 18 bp, Artificial Sequence
  Synthetic DNA
tacttccactaagtatag

SEQ ID NO: 64785 - DNA, 18 bp, Artificial Sequence
  Synthetic DNA
tacttcgacacattattg

SEQ ID NO: 64786 - DNA, 18 bp, Artificial Sequence
  Synthetic DNA
tacttcgactaacagtag

SEQ ID NO: 64787 - DNA, 18 bp, Artificial Sequence
  Synthetic DNA
tacttcgtcaaactattg

SEQ ID NO: 64788 - DNA, 18 bp, Artificial Sequence
  Synthetic DNA
tacttctactccctatcg

SEQ ID NO: 64789 - DNA, 18 bp, Artificial Sequence
  Synthetic DNA
tacttcttctcactctag

SEQ ID NO: 64790 - DNA, 18 bp, Artificial Sequence
  Synthetic DNA
tacttggaccaactgtag

SEQ ID NO: 64791 - DNA, 18 bp, Artificial Sequence
  Synthetic DNA
tactttaactcactcttg

SEQ ID NO: 64792 - DNA, 18 bp, Artificial Sequence
  Synthetic DNA
tactttcacaccctaaag

SEQ ID NO: 64793 - DNA, 18 bp, Artificial Sequence
  Synthetic DNA
tactttgactgcatacag

SEQ ID NO: 64794 - DNA, 18 bp, Artificial Sequence
  Synthetic DNA
tagaaagactaaccttag

SEQ ID NO: 64795 - DNA, 18 bp, Artificial Sequence
  Synthetic DNA
tagaaagacttgctatag

SEQ ID NO: 64796 - DNA, 18 bp, Artificial Sequence
  Synthetic DNA
tagaaaggctcattgaag

SEQ ID NO: 64797 - DNA, 18 bp, Artificial Sequence
  Synthetic DNA
tagaacaacacaatatag

SEQ ID NO: 64798 - DNA, 18 bp, Artificial Sequence
  Synthetic DNA
tagaacgacttacatttg

SEQ ID NO: 64799 - DNA, 18 bp, Artificial Sequence
  Synthetic DNA
tagagattgtcactatag

SEQ ID NO: 64800 - DNA, 18 bp, Artificial Sequence
  Synthetic DNA
tagatccactctctatag

SEQ ID NO: 64801 - DNA, 18 bp, Artificial Sequence
  Synthetic DNA
tagatggactaactatag

SEQ ID NO: 64802 - DNA, 18 bp, Artificial Sequence
  Synthetic DNA
tagcacgaaacacaattg

SEQ ID NO: 64803 - DNA, 18 bp, Artificial Sequence
  Synthetic DNA
tagcacgagtcagtattg

SEQ ID NO: 64804 - DNA, 18 bp, Artificial Sequence
  Synthetic DNA
taggacaactcagtattg

SEQ ID NO: 64805 - DNA, 18 bp, Artificial Sequence
  Synthetic DNA
taggacggctccctttgg

SEQ ID NO: 64806 - DNA, 18 bp, Artificial Sequence
  Synthetic DNA
tagtacaaatcattcttg

SEQ ID NO: 64807 - DNA, 18 bp, Artificial Sequence
  Synthetic DNA
tagtacaacacattttcg

SEQ ID NO: 64808 - DNA, 18 bp, Artificial Sequence
  Synthetic DNA
tagtacaaccgactacag

SEQ ID NO: 64809 - DNA, 18 bp, Artificial Sequence
  Synthetic DNA
tagtacaacttcctgtag

SEQ ID NO: 64810 - DNA, 18 bp, Artificial Sequence
  Synthetic DNA
tagtacgaatctttattg

SEQ ID NO: 64811 - DNA, 18 bp, Artificial Sequence
  Synthetic DNA
tagtacgactctaaagag

SEQ ID NO: 64812 - DNA, 18 bp, Artificial Sequence
  Synthetic DNA
tagtacgatacacttcag

SEQ ID NO: 64813 - DNA, 18 bp, Artificial Sequence
  Synthetic DNA
tagtacgattctcaattg

SEQ ID NO: 64814 - DNA, 18 bp, Artificial Sequence
  Synthetic DNA
tagtacgccacaatctag

SEQ ID NO: 64815 - DNA, 18 bp, Artificial Sequence
  Synthetic DNA
tagtacgccttactttcg

SEQ ID NO: 64816 - DNA, 18 bp, Artificial Sequence
  Synthetic DNA
tagtacgtctgattacag

SEQ ID NO: 64817 - DNA, 18 bp, Artificial Sequence
  Synthetic DNA
tagtacgttttgctatag

SEQ ID NO: 64818 - DNA, 18 bp, Artificial Sequence
  Synthetic DNA
tagtactactctataaag

SEQ ID NO: 64819 - DNA, 18 bp, Artificial Sequence
  Synthetic DNA
tagtagtagagacaatag

SEQ ID NO: 64820 - DNA, 18 bp, Artificial Sequence
  Synthetic DNA
tagtatgactcattcttg

SEQ ID NO: 64821 - DNA, 18 bp, Artificial Sequence
  Synthetic DNA
tagtcagactaacaatag

SEQ ID NO: 64822 - DNA, 18 bp, Artificial Sequence
  Synthetic DNA
tagtccaagtcacaatag

SEQ ID NO: 64823 - DNA, 18 bp, Artificial Sequence
  Synthetic DNA
tagtccggctttctatgg

SEQ ID NO: 64824 - DNA, 18 bp, Artificial Sequence
  Synthetic DNA
tagtgcaactaactatcg

SEQ ID NO: 64825 - DNA, 18 bp, Artificial Sequence
  Synthetic DNA
tagtgcaattcgttattg

SEQ ID NO: 64826 - DNA, 18 bp, Artificial Sequence
  Synthetic DNA
tagtgcgactcacttatg

SEQ ID NO: 64827 - DNA, 18 bp, Artificial Sequence
  Synthetic DNA
tagtgcgcgtcattttag

SEQ ID NO: 64828 - DNA, 18 bp, Artificial Sequence
  Synthetic DNA
tagtgctttatacccaag

SEQ ID NO: 64829 - DNA, 18 bp, Artificial Sequence
  Synthetic DNA
tagtgggattccctactg

SEQ ID NO: 64830 - DNA, 18 bp, Artificial Sequence
  Synthetic DNA
tagttacccttagggtag

SEQ ID NO: 64831 - DNA, 18 bp, Artificial Sequence
  Synthetic DNA
tagttcgactcgatattg

SEQ ID NO: 64832 - DNA, 18 bp, Artificial Sequence
  Synthetic DNA
tagttcgacttcctaaag

SEQ ID NO: 64833 - DNA, 18 bp, Artificial Sequence
  Synthetic DNA
tagttcgatttatactag

SEQ ID NO: 64834 - DNA, 18 bp, Artificial Sequence
  Synthetic DNA
tagttcgtatcactctag

SEQ ID NO: 64835 - DNA, 18 bp, Artificial Sequence
  Synthetic DNA
tagttcgtcatacgatag

SEQ ID NO: 64836 - DNA, 18 bp, Artificial Sequence
  Synthetic DNA
tagttcttctatctatag

SEQ ID NO: 64837 - DNA, 18 bp, Artificial Sequence
  Synthetic DNA
tagtttgtctcgctatag

SEQ ID NO: 64838 - DNA, 18 bp, Artificial Sequence
  Synthetic DNA
tataaaaactcaccattg

SEQ ID NO: 64839 - DNA, 18 bp, Artificial Sequence
  Synthetic DNA
tataaatacacaacatag

SEQ ID NO: 64840 - DNA, 18 bp, Artificial Sequence
  Synthetic DNA
tataaattattactatag

SEQ ID NO: 64841 - DNA, 18 bp, Artificial Sequence
  Synthetic DNA
tataacaagtatctattg

SEQ ID NO: 64842 - DNA, 18 bp, Artificial Sequence
  Synthetic DNA
tataacatctatttaaag

SEQ ID NO: 64843 - DNA, 18 bp, Artificial Sequence
  Synthetic DNA
tataaccagagacttaag

SEQ ID NO: 64844 - DNA, 18 bp, Artificial Sequence
  Synthetic DNA
tataaccagtcacaatag

SEQ ID NO: 64845 - DNA, 18 bp, Artificial Sequence
  Synthetic DNA
tataacgaacctctttag

SEQ ID NO: 64846 - DNA, 18 bp, Artificial Sequence
  Synthetic DNA
tataacgaatcactaatg

SEQ ID NO: 64847 - DNA, 18 bp, Artificial Sequence
  Synthetic DNA
tataacgaatgaatatag

SEQ ID NO: 64848 - DNA, 18 bp, Artificial Sequence
  Synthetic DNA
tataacgacagtctacag

SEQ ID NO: 64849 - DNA, 18 bp, Artificial Sequence
  Synthetic DNA
tataacgacatcttaaag

SEQ ID NO: 64850 - DNA, 18 bp, Artificial Sequence
  Synthetic DNA
tataacgaccctataaag

SEQ ID NO: 64851 - DNA, 18 bp, Artificial Sequence
  Synthetic DNA
tataacgactcactgccg

SEQ ID NO: 64852 - DNA, 18 bp, Artificial Sequence
  Synthetic DNA
tataacgactccttgtag

SEQ ID NO: 64853 - DNA, 18 bp, Artificial Sequence
  Synthetic DNA
tataacgactctccttag

SEQ ID NO: 64854 - DNA, 18 bp, Artificial Sequence
  Synthetic DNA
tataacgactctgtaaag

SEQ ID NO: 64855 - DNA, 18 bp, Artificial Sequence
  Synthetic DNA
tataacgacttacttcag

SEQ ID NO: 64856 - DNA, 18 bp, Artificial Sequence
  Synthetic DNA
tataacgcctcaatgtag

SEQ ID NO: 64857 - DNA, 18 bp, Artificial Sequence
  Synthetic DNA
tataacgtttaactatag

SEQ ID NO: 64858 - DNA, 18 bp, Artificial Sequence
  Synthetic DNA
tataactaataactatag

SEQ ID NO: 64859 - DNA, 18 bp, Artificial Sequence
  Synthetic DNA
tataactactcaccaaag

SEQ ID NO: 64860 - DNA, 18 bp, Artificial Sequence
  Synthetic DNA
tataaggagtcacaatag

SEQ ID NO: 64861 - DNA, 18 bp, Artificial Sequence
  Synthetic DNA
tataaggcacctctaatg

SEQ ID NO: 64862 - DNA, 18 bp, Artificial Sequence
  Synthetic DNA
tataatgtcttacactag

SEQ ID NO: 64863 - DNA, 18 bp, Artificial Sequence
  Synthetic DNA
tataccgactcacaattg

SEQ ID NO: 64864 - DNA, 18 bp, Artificial Sequence
  Synthetic DNA
tatactgtttcacgttag

SEQ ID NO: 64865 - DNA, 18 bp, Artificial Sequence
  Synthetic DNA
tatatatacttacaagag

SEQ ID NO: 64866 - DNA, 18 bp, Artificial Sequence
  Synthetic DNA
tatatcgacacactacag

SEQ ID NO: 64867 - DNA, 18 bp, Artificial Sequence
  Synthetic DNA
tatatcgactcgctattg

SEQ ID NO: 64868 - DNA, 18 bp, Artificial Sequence
  Synthetic DNA
tatatcgacttacttaag

SEQ ID NO: 64869 - DNA, 18 bp, Artificial Sequence
  Synthetic DNA
tatatcgattctctagag

SEQ ID NO: 64870 - DNA, 18 bp, Artificial Sequence
  Synthetic DNA
tatatcgcctgactatag

SEQ ID NO: 64871 - DNA, 18 bp, Artificial Sequence
  Synthetic DNA
tatcaagtgccatccaag

SEQ ID NO: 64872 - DNA, 18 bp, Artificial Sequence
  Synthetic DNA
tatcacgacttactgaag

SEQ ID NO: 64873 - DNA, 18 bp, Artificial Sequence
  Synthetic DNA
tatcacgcatgacttaag

SEQ ID NO: 64874 - DNA, 18 bp, Artificial Sequence
  Synthetic DNA
tatcacgctacacaatgg

SEQ ID NO: 64875 - DNA, 18 bp, Artificial Sequence
  Synthetic DNA
tatcacggctcaaaaatg

SEQ ID NO: 64876 - DNA, 18 bp, Artificial Sequence
  Synthetic DNA
tatcacgtgacaattatg

SEQ ID NO: 64877 - DNA, 18 bp, Artificial Sequence
  Synthetic DNA
tatcactactaattattg

SEQ ID NO: 64878 - DNA, 18 bp, Artificial Sequence
  Synthetic DNA
tatcagggctcataatag

SEQ ID NO: 64879 - DNA, 18 bp, Artificial Sequence
  Synthetic DNA
tatcatgattcactgaag

SEQ ID NO: 64880 - DNA, 18 bp, Artificial Sequence
  Synthetic DNA
tatcccgacatactatag

SEQ ID NO: 64881 - DNA, 18 bp, Artificial Sequence
  Synthetic DNA
tatctcgactccgtatag

SEQ ID NO: 64882 - DNA, 18 bp, Artificial Sequence
  Synthetic DNA
tatgaattctcacactag

SEQ ID NO: 64883 - DNA, 18 bp, Artificial Sequence
  Synthetic DNA
tatgacatctgcctaatg

SEQ ID NO: 64884 - DNA, 18 bp, Artificial Sequence
  Synthetic DNA
tatgacgacgctcaatag

SEQ ID NO: 64885 - DNA, 18 bp, Artificial Sequence
  Synthetic DNA
tattaaatcttagtatag

SEQ ID NO: 64886 - DNA, 18 bp, Artificial Sequence
  Synthetic DNA
tattaagacacattattg

SEQ ID NO: 64887 - DNA, 18 bp, Artificial Sequence
  Synthetic DNA
tattaagactcgctcttg

SEQ ID NO: 64888 - DNA, 18 bp, Artificial Sequence
  Synthetic DNA
tattaagactctcgttag

SEQ ID NO: 64889 - DNA, 18 bp, Artificial Sequence
  Synthetic DNA
tattaagatgcactaatg

SEQ ID NO: 64890 - DNA, 18 bp, Artificial Sequence
  Synthetic DNA
tattaagcatggttattg

SEQ ID NO: 64891 - DNA, 18 bp, Artificial Sequence
  Synthetic DNA
tattaaggcaaggtattg

SEQ ID NO: 64892 - DNA, 18 bp, Artificial Sequence
  Synthetic DNA
tattaagtcatactgttg

SEQ ID NO: 64893 - DNA, 18 bp, Artificial Sequence
  Synthetic DNA
tattaagtctgactaaag

SEQ ID NO: 64894 - DNA, 18 bp, Artificial Sequence
  Synthetic DNA
tattaatacttactagag

SEQ ID NO: 64895 - DNA, 18 bp, Artificial Sequence
  Synthetic DNA
tattaatgcatactaacg

SEQ ID NO: 64896 - DNA, 18 bp, Artificial Sequence
  Synthetic DNA
tattacaaaaggctattg

SEQ ID NO: 64897 - DNA, 18 bp, Artificial Sequence
  Synthetic DNA
tattacaaatttctattg

SEQ ID NO: 64898 - DNA, 18 bp, Artificial Sequence
  Synthetic DNA
tattacaacacacttttg

SEQ ID NO: 64899 - DNA, 18 bp, Artificial Sequence
  Synthetic DNA
tattacaacctactgtag

SEQ ID NO: 64900 - DNA, 18 bp, Artificial Sequence
  Synthetic DNA
tattacaactaacaagag

SEQ ID NO: 64901 - DNA, 18 bp, Artificial Sequence
  Synthetic DNA
tattacaactctgtattg

SEQ ID NO: 64902 - DNA, 18 bp, Artificial Sequence
  Synthetic DNA
tattacaattaaccatag

SEQ ID NO: 64903 - DNA, 18 bp, Artificial Sequence
  Synthetic DNA
tattaccaagcactactg

SEQ ID NO: 64904 - DNA, 18 bp, Artificial Sequence
  Synthetic DNA
tattaccactcatttttg

SEQ ID NO: 64905 - DNA, 18 bp, Artificial Sequence
  Synthetic DNA
tattaccattctacatag

SEQ ID NO: 64906 - DNA, 18 bp, Artificial Sequence
  Synthetic DNA
tattacctatcactattg

SEQ ID NO: 64907 - DNA, 18 bp, Artificial Sequence
  Synthetic DNA
tattacgaaacacaacag

SEQ ID NO: 64908 - DNA, 18 bp, Artificial Sequence
  Synthetic DNA
tattacgaatcgctaacg

SEQ ID NO: 64909 - DNA, 18 bp, Artificial Sequence
  Synthetic DNA
tattacgaatctccttag

SEQ ID NO: 64910 - DNA, 18 bp, Artificial Sequence
  Synthetic DNA
tattacgacccccttaag

SEQ ID NO: 64911 - DNA, 18 bp, Artificial Sequence
  Synthetic DNA
tattacgacccgttaaag

SEQ ID NO: 64912 - DNA, 18 bp, Artificial Sequence
  Synthetic DNA
tattacgaccttcctttg

SEQ ID NO: 64913 - DNA, 18 bp, Artificial Sequence
  Synthetic DNA
tattacgactaatactag

SEQ ID NO: 64914 - DNA, 18 bp, Artificial Sequence
  Synthetic DNA
tattacgactgtttacgg

SEQ ID NO: 64915 - DNA, 18 bp, Artificial Sequence
  Synthetic DNA
tattacgagtaaccttag

SEQ ID NO: 64916 - DNA, 18 bp, Artificial Sequence
  Synthetic DNA
tattacgatagtcacttg

SEQ ID NO: 64917 - DNA, 18 bp, Artificial Sequence
  Synthetic DNA
tattacgattcacaactg

SEQ ID NO: 64918 - DNA, 18 bp, Artificial Sequence
  Synthetic DNA
tattacgattcacagttg

SEQ ID NO: 64919 - DNA, 18 bp, Artificial Sequence
  Synthetic DNA
tattacgcctcatacctg

SEQ ID NO: 64920 - DNA, 18 bp, Artificial Sequence
  Synthetic DNA
tattacgctcctctatag

SEQ ID NO: 64921 - DNA, 18 bp, Artificial Sequence
  Synthetic DNA
tattacggcacgctctag

SEQ ID NO: 64922 - DNA, 18 bp, Artificial Sequence
  Synthetic DNA
tattacggctcacttacg

SEQ ID NO: 64923 - DNA, 18 bp, Artificial Sequence
  Synthetic DNA
tattacgtataaaaattg

SEQ ID NO: 64924 - DNA, 18 bp, Artificial Sequence
  Synthetic DNA
tattacgtataattgtag

SEQ ID NO: 64925 - DNA, 18 bp, Artificial Sequence
  Synthetic DNA
tattacgtcaaactaacg

SEQ ID NO: 64926 - DNA, 18 bp, Artificial Sequence
  Synthetic DNA
tattacgtcacacaatcg

SEQ ID NO: 64927 - DNA, 18 bp, Artificial Sequence
  Synthetic DNA
tattacgtcactcttttg

SEQ ID NO: 64928 - DNA, 18 bp, Artificial Sequence
  Synthetic DNA
tattacgtccctctcttg

SEQ ID NO: 64929 - DNA, 18 bp, Artificial Sequence
  Synthetic DNA
tattacgtcgcagaatag

SEQ ID NO: 64930 - DNA, 18 bp, Artificial Sequence
  Synthetic DNA
tattacgtctcattgaag

SEQ ID NO: 64931 - DNA, 18 bp, Artificial Sequence
  Synthetic DNA
tattacgtcttactcttg

SEQ ID NO: 64932 - DNA, 18 bp, Artificial Sequence
  Synthetic DNA
tattacgtcttgctatgg

SEQ ID NO: 64933 - DNA, 18 bp, Artificial Sequence
  Synthetic DNA
tattactaactactaatg

SEQ ID NO: 64934 - DNA, 18 bp, Artificial Sequence
  Synthetic DNA
tattactaatcacttgtg

SEQ ID NO: 64935 - DNA, 18 bp, Artificial Sequence
  Synthetic DNA
tattactacatactattg

SEQ ID NO: 64936 - DNA, 18 bp, Artificial Sequence
  Synthetic DNA
tattactactaactaagg

SEQ ID NO: 64937 - DNA, 18 bp, Artificial Sequence
  Synthetic DNA
tattactactctctaacg

SEQ ID NO: 64938 - DNA, 18 bp, Artificial Sequence
  Synthetic DNA
tattactactctgtactg

SEQ ID NO: 64939 - DNA, 18 bp, Artificial Sequence
  Synthetic DNA
tattactattaattatag

SEQ ID NO: 64940 - DNA, 18 bp, Artificial Sequence
  Synthetic DNA
tattactcctcacttctg

SEQ ID NO: 64941 - DNA, 18 bp, Artificial Sequence
  Synthetic DNA
tattactcctcatcgtag

SEQ ID NO: 64942 - DNA, 18 bp, Artificial Sequence
  Synthetic DNA
tattactcctcattacag

SEQ ID NO: 64943 - DNA, 18 bp, Artificial Sequence
  Synthetic DNA
tattagagcttactattg

SEQ ID NO: 64944 - DNA, 18 bp, Artificial Sequence
  Synthetic DNA
tattagcattctcaatag

SEQ ID NO: 64945 - DNA, 18 bp, Artificial Sequence
  Synthetic DNA
tattaggaatcagtattg

SEQ ID NO: 64946 - DNA, 18 bp, Artificial Sequence
  Synthetic DNA
tattaggactcgttaaag

SEQ ID NO: 64947 - DNA, 18 bp, Artificial Sequence
  Synthetic DNA
tattaggagttactatcg

SEQ ID NO: 64948 - DNA, 18 bp, Artificial Sequence
  Synthetic DNA
tattaggcatcactatcg

SEQ ID NO: 64949 - DNA, 18 bp, Artificial Sequence
  Synthetic DNA
tattagtactgataattg

SEQ ID NO: 64950 - DNA, 18 bp, Artificial Sequence
  Synthetic DNA
tattagtgcttagtattg

SEQ ID NO: 64951 - DNA, 18 bp, Artificial Sequence
  Synthetic DNA
tattataactcattattg

SEQ ID NO: 64952 - DNA, 18 bp, Artificial Sequence
  Synthetic DNA
tattataattcactttag

SEQ ID NO: 64953 - DNA, 18 bp, Artificial Sequence
  Synthetic DNA
tattatcgctcacaatag

SEQ ID NO: 64954 - DNA, 18 bp, Artificial Sequence
  Synthetic DNA
tattatgacatacaatgg

SEQ ID NO: 64955 - DNA, 18 bp, Artificial Sequence
  Synthetic DNA
tattatgactccctaatg

SEQ ID NO: 64956 - DNA, 18 bp, Artificial Sequence
  Synthetic DNA
tattatgactctataaag

SEQ ID NO: 64957 - DNA, 18 bp, Artificial Sequence
  Synthetic DNA
tattatgactctttaaag

SEQ ID NO: 64958 - DNA, 18 bp, Artificial Sequence
  Synthetic DNA
tattatgatcaactatag

SEQ ID NO: 64959 - DNA, 18 bp, Artificial Sequence
  Synthetic DNA
tattatgtcgatctttag

SEQ ID NO: 64960 - DNA, 18 bp, Artificial Sequence
  Synthetic DNA
tattattactaactaaag

SEQ ID NO: 64961 - DNA, 18 bp, Artificial Sequence
  Synthetic DNA
tattatttctcactatcg

SEQ ID NO: 64962 - DNA, 18 bp, Artificial Sequence
  Synthetic DNA
tattccaactatctgaag

SEQ ID NO: 64963 - DNA, 18 bp, Artificial Sequence
  Synthetic DNA
tattccaactcacgatcg

SEQ ID NO: 64964 - DNA, 18 bp, Artificial Sequence
  Synthetic DNA
tattccgaaacacactag

SEQ ID NO: 64965 - DNA, 18 bp, Artificial Sequence
  Synthetic DNA
tattccgaaacagtatag

SEQ ID NO: 64966 - DNA, 18 bp, Artificial Sequence
  Synthetic DNA
tattccgtctcaataaag

SEQ ID NO: 64967 - DNA, 18 bp, Artificial Sequence
  Synthetic DNA
tattcctactctctctag

SEQ ID NO: 64968 - DNA, 18 bp, Artificial Sequence
  Synthetic DNA
tattctgactcaacatag

SEQ ID NO: 64969 - DNA, 18 bp, Artificial Sequence
  Synthetic DNA
tattcttattcactatag

SEQ ID NO: 64970 - DNA, 18 bp, Artificial Sequence
  Synthetic DNA
tattgagattctcaacag

SEQ ID NO: 64971 - DNA, 18 bp, Artificial Sequence
  Synthetic DNA
tattgagtcattctaatg

SEQ ID NO: 64972 - DNA, 18 bp, Artificial Sequence
  Synthetic DNA
tattgcaactcacgttag

SEQ ID NO: 64973 - DNA, 18 bp, Artificial Sequence
  Synthetic DNA
tattgcaactcactgtcg

SEQ ID NO: 64974 - DNA, 18 bp, Artificial Sequence
  Synthetic DNA
tattgccaaacactattg

SEQ ID NO: 64975 - DNA, 18 bp, Artificial Sequence
  Synthetic DNA
tattgcgacaaaatatag

SEQ ID NO: 64976 - DNA, 18 bp, Artificial Sequence
  Synthetic DNA
tattgcgacccgatatcg

SEQ ID NO: 64977 - DNA, 18 bp, Artificial Sequence
  Synthetic DNA
tattgcgactctctaatg

SEQ ID NO: 64978 - DNA, 18 bp, Artificial Sequence
  Synthetic DNA
tattgcggcacgcattag

SEQ ID NO: 64979 - DNA, 18 bp, Artificial Sequence
  Synthetic DNA
tattgctacacaatttcg

SEQ ID NO: 64980 - DNA, 18 bp, Artificial Sequence
  Synthetic DNA
tatttacacacaataaag

SEQ ID NO: 64981 - DNA, 18 bp, Artificial Sequence
  Synthetic DNA
tatttagaatcactatcg

SEQ ID NO: 64982 - DNA, 18 bp, Artificial Sequence
  Synthetic DNA
tatttagactctcattcg

SEQ ID NO: 64983 - DNA, 18 bp, Artificial Sequence
  Synthetic DNA
tatttagacttactaaag

SEQ ID NO: 64984 - DNA, 18 bp, Artificial Sequence
  Synthetic DNA
tatttagtctcagtatag

SEQ ID NO: 64985 - DNA, 18 bp, Artificial Sequence
  Synthetic DNA
tatttcaactagctatag

SEQ ID NO: 64986 - DNA, 18 bp, Artificial Sequence
  Synthetic DNA
tatttcaactcacttagg

SEQ ID NO: 64987 - DNA, 18 bp, Artificial Sequence
  Synthetic DNA
tatttcaattaactcaag

SEQ ID NO: 64988 - DNA, 18 bp, Artificial Sequence
  Synthetic DNA
tatttcaattaacttcag

SEQ ID NO: 64989 - DNA, 18 bp, Artificial Sequence
  Synthetic DNA
tatttccacttattatag

SEQ ID NO: 64990 - DNA, 18 bp, Artificial Sequence
  Synthetic DNA
tatttcgaactattaaag

SEQ ID NO: 64991 - DNA, 18 bp, Artificial Sequence
  Synthetic DNA
tatttcgaatcacaaaag

SEQ ID NO: 64992 - DNA, 18 bp, Artificial Sequence
  Synthetic DNA
tatttcgacataccatcg

SEQ ID NO: 64993 - DNA, 18 bp, Artificial Sequence
  Synthetic DNA
tatttcgactcacactcg

SEQ ID NO: 64994 - DNA, 18 bp, Artificial Sequence
  Synthetic DNA
tatttcgactcctttttg

SEQ ID NO: 64995 - DNA, 18 bp, Artificial Sequence
  Synthetic DNA
tatttcgagacactcaag

SEQ ID NO: 64996 - DNA, 18 bp, Artificial Sequence
  Synthetic DNA
tatttcgatacaccatag

SEQ ID NO: 64997 - DNA, 18 bp, Artificial Sequence
  Synthetic DNA
tatttcgattaacaatag

SEQ ID NO: 64998 - DNA, 18 bp, Artificial Sequence
  Synthetic DNA
tatttcgcctccctattg

SEQ ID NO: 64999 - DNA, 18 bp, Artificial Sequence
  Synthetic DNA
tatttcgtatcattatag

SEQ ID NO: 65000 - DNA, 18 bp, Artificial Sequence
  Synthetic DNA
tatttctcctcactctag

SEQ ID NO: 65001 - DNA, 18 bp, Artificial Sequence
  Synthetic DNA
tatttcttcccactttgg

SEQ ID NO: 65002 - DNA, 18 bp, Artificial Sequence
  Synthetic DNA
tattttcactccctattg

SEQ ID NO: 65003 - DNA, 18 bp, Artificial Sequence
  Synthetic DNA
tcaaacgaatcaattcag

SEQ ID NO: 65004 - DNA, 18 bp, Artificial Sequence
  Synthetic DNA
tcaaacgacacactcttg

SEQ ID NO: 65005 - DNA, 18 bp, Artificial Sequence
  Synthetic DNA
tcaaacgactttatatcg

SEQ ID NO: 65006 - DNA, 18 bp, Artificial Sequence
  Synthetic DNA
tcaaacgcttcactatgg

SEQ ID NO: 65007 - DNA, 18 bp, Artificial Sequence
  Synthetic DNA
tcaaacgtcccaaaaggg

SEQ ID NO: 65008 - DNA, 18 bp, Artificial Sequence
  Synthetic DNA
tcaaacgtctaactatgg

SEQ ID NO: 65009 - DNA, 18 bp, Artificial Sequence
  Synthetic DNA
tcaaacgtgccacaatag

SEQ ID NO: 65010 - DNA, 18 bp, Artificial Sequence
  Synthetic DNA
tcaaacttcttacttaag

SEQ ID NO: 65011 - DNA, 18 bp, Artificial Sequence
  Synthetic DNA
tcaaatgtctcattatag

SEQ ID NO: 65012 - DNA, 18 bp, Artificial Sequence
  Synthetic DNA
tcaactgtctcgctccag

SEQ ID NO: 65013 - DNA, 18 bp, Artificial Sequence
  Synthetic DNA
tcaagcctctccctatag

SEQ ID NO: 65014 - DNA, 18 bp, Artificial Sequence
  Synthetic DNA
tcaagctccactctaaag

SEQ ID NO: 65015 - DNA, 18 bp, Artificial Sequence
  Synthetic DNA
tcaatccatttactaatg

SEQ ID NO: 65016 - DNA, 18 bp, Artificial Sequence
  Synthetic DNA
tcaatcgaatttctctag

SEQ ID NO: 65017 - DNA, 18 bp, Artificial Sequence
  Synthetic DNA
tcaatcgactcacataag

SEQ ID NO: 65018 - DNA, 18 bp, Artificial Sequence
  Synthetic DNA
tcaatcgattcgctatag

SEQ ID NO: 65019 - DNA, 18 bp, Artificial Sequence
  Synthetic DNA
tcaatcgtcttacaatag

SEQ ID NO: 65020 - DNA, 18 bp, Artificial Sequence
  Synthetic DNA
tcaatctacaccctatag

SEQ ID NO: 65021 - DNA, 18 bp, Artificial Sequence
  Synthetic DNA
tcacaagagtccctctag

SEQ ID NO: 65022 - DNA, 18 bp, Artificial Sequence
  Synthetic DNA
tcacacctctcactgttg

SEQ ID NO: 65023 - DNA, 18 bp, Artificial Sequence
  Synthetic DNA
tcacacgacacgttatag

SEQ ID NO: 65024 - DNA, 18 bp, Artificial Sequence
  Synthetic DNA
tcacacgactatctctag

SEQ ID NO: 65025 - DNA, 18 bp, Artificial Sequence
  Synthetic DNA
tcacacgactctcaaaag

SEQ ID NO: 65026 - DNA, 18 bp, Artificial Sequence
  Synthetic DNA
tcacaggcctctctacag

SEQ ID NO: 65027 - DNA, 18 bp, Artificial Sequence
  Synthetic DNA
tcacccgtcccactagag

SEQ ID NO: 65028 - DNA, 18 bp, Artificial Sequence
  Synthetic DNA
tcaccctactaattatag

SEQ ID NO: 65029 - DNA, 18 bp, Artificial Sequence
  Synthetic DNA
tcacgtatctctctatag

SEQ ID NO: 65030 - DNA, 18 bp, Artificial Sequence
  Synthetic DNA
tcagacgacttactcatg

SEQ ID NO: 65031 - DNA, 18 bp, Artificial Sequence
  Synthetic DNA
tcagaggtctatctattg

SEQ ID NO: 65032 - DNA, 18 bp, Artificial Sequence
  Synthetic DNA
tcataacacgcagtatag

SEQ ID NO: 65033 - DNA, 18 bp, Artificial Sequence
  Synthetic DNA
tcataagacgctcttttg

SEQ ID NO: 65034 - DNA, 18 bp, Artificial Sequence
  Synthetic DNA
tcataagactcagattag

SEQ ID NO: 65035 - DNA, 18 bp, Artificial Sequence
  Synthetic DNA
tcataagactctataaag

SEQ ID NO: 65036 - DNA, 18 bp, Artificial Sequence
  Synthetic DNA
tcatacaacacataatag

SEQ ID NO: 65037 - DNA, 18 bp, Artificial Sequence
  Synthetic DNA
tcatacaagacactttag

SEQ ID NO: 65038 - DNA, 18 bp, Artificial Sequence
  Synthetic DNA
tcatacaccgtactatag

SEQ ID NO: 65039 - DNA, 18 bp, Artificial Sequence
  Synthetic DNA
tcatacccgacactttag

SEQ ID NO: 65040 - DNA, 18 bp, Artificial Sequence
  Synthetic DNA
tcatacctctctctacag

SEQ ID NO: 65041 - DNA, 18 bp, Artificial Sequence
  Synthetic DNA
tcatacgacgaacaacag

SEQ ID NO: 65042 - DNA, 18 bp, Artificial Sequence
  Synthetic DNA
tcatacgaggctctaatg

SEQ ID NO: 65043 - DNA, 18 bp, Artificial Sequence
  Synthetic DNA
tcatacgataccatacag

SEQ ID NO: 65044 - DNA, 18 bp, Artificial Sequence
  Synthetic DNA
tcatacgattcacagaag

SEQ ID NO: 65045 - DNA, 18 bp, Artificial Sequence
  Synthetic DNA
tcatacgtatcactgtcg

SEQ ID NO: 65046 - DNA, 18 bp, Artificial Sequence
  Synthetic DNA
tcatacgtcccaatatcg

SEQ ID NO: 65047 - DNA, 18 bp, Artificial Sequence
  Synthetic DNA
tcatacgtctcaccaatg

SEQ ID NO: 65048 - DNA, 18 bp, Artificial Sequence
  Synthetic DNA
tcatacgtctcagaatcg

SEQ ID NO: 65049 - DNA, 18 bp, Artificial Sequence
  Synthetic DNA
tcatacgtctcgcttacg

SEQ ID NO: 65050 - DNA, 18 bp, Artificial Sequence
  Synthetic DNA
tcatacgtctctatcaag

SEQ ID NO: 65051 - DNA, 18 bp, Artificial Sequence
  Synthetic DNA
tcatacgtctctcttgag

SEQ ID NO: 65052 - DNA, 18 bp, Artificial Sequence
  Synthetic DNA
tcatacgtgttactttag

SEQ ID NO: 65053 - DNA, 18 bp, Artificial Sequence
  Synthetic DNA
tcatactacacacaatcg

SEQ ID NO: 65054 - DNA, 18 bp, Artificial Sequence
  Synthetic DNA
tcatactacacacctaag

SEQ ID NO: 65055 - DNA, 18 bp, Artificial Sequence
  Synthetic DNA
tcatactagtcagtagag

SEQ ID NO: 65056 - DNA, 18 bp, Artificial Sequence
  Synthetic DNA
tcatactattctctttcg

SEQ ID NO: 65057 - DNA, 18 bp, Artificial Sequence
  Synthetic DNA
tcatacttcacacaatag

SEQ ID NO: 65058 - DNA, 18 bp, Artificial Sequence
  Synthetic DNA
tcataggattcgctaaag

SEQ ID NO: 65059 - DNA, 18 bp, Artificial Sequence
  Synthetic DNA
tcatatctcacacgcttg

SEQ ID NO: 65060 - DNA, 18 bp, Artificial Sequence
  Synthetic DNA
tcatatgaatttctctag

SEQ ID NO: 65061 - DNA, 18 bp, Artificial Sequence
  Synthetic DNA
tcatatgactcacttacg

SEQ ID NO: 65062 - DNA, 18 bp, Artificial Sequence
  Synthetic DNA
tcatattactaatgattg

SEQ ID NO: 65063 - DNA, 18 bp, Artificial Sequence
  Synthetic DNA
tcatatttcttacttatg

SEQ ID NO: 65064 - DNA, 18 bp, Artificial Sequence
  Synthetic DNA
tcatgagacacaccaagg

SEQ ID NO: 65065 - DNA, 18 bp, Artificial Sequence
  Synthetic DNA
tcatgccacttacatgag

SEQ ID NO: 65066 - DNA, 18 bp, Artificial Sequence
  Synthetic DNA
tcatgcgactgaccatcg

SEQ ID NO: 65067 - DNA, 18 bp, Artificial Sequence
  Synthetic DNA
tcatgcgtcccgctacag

SEQ ID NO: 65068 - DNA, 18 bp, Artificial Sequence
  Synthetic DNA
tcattcatcccactatag

SEQ ID NO: 65069 - DNA, 18 bp, Artificial Sequence
  Synthetic DNA
tcattcgacactaattag

SEQ ID NO: 65070 - DNA, 18 bp, Artificial Sequence
  Synthetic DNA
tcattcggcacaccaaag

SEQ ID NO: 65071 - DNA, 18 bp, Artificial Sequence
  Synthetic DNA
tcattcggctccccttag

SEQ ID NO: 65072 - DNA, 18 bp, Artificial Sequence
  Synthetic DNA
tcattcgtctcacaaaag

SEQ ID NO: 65073 - DNA, 18 bp, Artificial Sequence
  Synthetic DNA
tcatttgaatcattatag

SEQ ID NO: 65074 - DNA, 18 bp, Artificial Sequence
  Synthetic DNA
tccaaagacgcactatag

SEQ ID NO: 65075 - DNA, 18 bp, Artificial Sequence
  Synthetic DNA
tccaacgtgtgacaatag

SEQ ID NO: 65076 - DNA, 18 bp, Artificial Sequence
  Synthetic DNA
tcccacgacactctacag

SEQ ID NO: 65077 - DNA, 18 bp, Artificial Sequence
  Synthetic DNA
tcctacgacacacactag

SEQ ID NO: 65078 - DNA, 18 bp, Artificial Sequence
  Synthetic DNA
tcctacgatttactaaag

SEQ ID NO: 65079 - DNA, 18 bp, Artificial Sequence
  Synthetic DNA
tcctactactctaaatag

SEQ ID NO: 65080 - DNA, 18 bp, Artificial Sequence
  Synthetic DNA
tcctactactttctattg

SEQ ID NO: 65081 - DNA, 18 bp, Artificial Sequence
  Synthetic DNA
tcctttatatcaatatag

SEQ ID NO: 65082 - DNA, 18 bp, Artificial Sequence
  Synthetic DNA
tcgcatttctctttatag

SEQ ID NO: 65083 - DNA, 18 bp, Artificial Sequence
  Synthetic DNA
tcgtaagattcacctcag

SEQ ID NO: 65084 - DNA, 18 bp, Artificial Sequence
  Synthetic DNA
tcgtaatacttgctttag

SEQ ID NO: 65085 - DNA, 18 bp, Artificial Sequence
  Synthetic DNA
tcgtatgtgtcaattaag

SEQ ID NO: 65086 - DNA, 18 bp, Artificial Sequence
  Synthetic DNA
tcgtttgactcaaaactg

SEQ ID NO: 65087 - DNA, 18 bp, Artificial Sequence
  Synthetic DNA
tctaacaactcatcatag

SEQ ID NO: 65088 - DNA, 18 bp, Artificial Sequence
  Synthetic DNA
tctaacgacactctaatg

SEQ ID NO: 65089 - DNA, 18 bp, Artificial Sequence
  Synthetic DNA
tctaacgactctttagag

SEQ ID NO: 65090 - DNA, 18 bp, Artificial Sequence
  Synthetic DNA
tctaacgtctcaccatag

SEQ ID NO: 65091 - DNA, 18 bp, Artificial Sequence
  Synthetic DNA
tctatggattgacttagg

SEQ ID NO: 65092 - DNA, 18 bp, Artificial Sequence
  Synthetic DNA
tcttacaacttacgttag

SEQ ID NO: 65093 - DNA, 18 bp, Artificial Sequence
  Synthetic DNA
tcttaccaatcactttag

SEQ ID NO: 65094 - DNA, 18 bp, Artificial Sequence
  Synthetic DNA
tcttacgacaaactaaag

SEQ ID NO: 65095 - DNA, 18 bp, Artificial Sequence
  Synthetic DNA
tcttacgactcaataagg

SEQ ID NO: 65096 - DNA, 18 bp, Artificial Sequence
  Synthetic DNA
tcttacgattcagtctag

SEQ ID NO: 65097 - DNA, 18 bp, Artificial Sequence
  Synthetic DNA
tcttacgtatgaatttcg

SEQ ID NO: 65098 - DNA, 18 bp, Artificial Sequence
  Synthetic DNA
tcttacgtcttactaaag

SEQ ID NO: 65099 - DNA, 18 bp, Artificial Sequence
  Synthetic DNA
tcttagggcccactatcg

SEQ ID NO: 65100 - DNA, 18 bp, Artificial Sequence
  Synthetic DNA
tcttatgactttctttag

SEQ ID NO: 65101 - DNA, 18 bp, Artificial Sequence
  Synthetic DNA
tcttccgactcagtaaag

SEQ ID NO: 65102 - DNA, 18 bp, Artificial Sequence
  Synthetic DNA
tcttcctactcaatgttg

SEQ ID NO: 65103 - DNA, 18 bp, Artificial Sequence
  Synthetic DNA
tctttcatctcattatag

SEQ ID NO: 65104 - DNA, 18 bp, Artificial Sequence
  Synthetic DNA
tctttcgtctcaatatag

SEQ ID NO: 65105 - DNA, 18 bp, Artificial Sequence
  Synthetic DNA
tgaaaaaactcactattg

SEQ ID NO: 65106 - DNA, 18 bp, Artificial Sequence
  Synthetic DNA
tgaaaccactaacagtag

SEQ ID NO: 65107 - DNA, 18 bp, Artificial Sequence
  Synthetic DNA
tgaaacgactcagcacag

SEQ ID NO: 65108 - DNA, 18 bp, Artificial Sequence
  Synthetic DNA
tgaaaggagtaactatag

SEQ ID NO: 65109 - DNA, 18 bp, Artificial Sequence
  Synthetic DNA
tgaaatggctttctatag

SEQ ID NO: 65110 - DNA, 18 bp, Artificial Sequence
  Synthetic DNA
tgaaatttctcagtttgg

SEQ ID NO: 65111 - DNA, 18 bp, Artificial Sequence
  Synthetic DNA
tgaaccgtcatactatag

SEQ ID NO: 65112 - DNA, 18 bp, Artificial Sequence
  Synthetic DNA
tgaagcgttcctttatag

SEQ ID NO: 65113 - DNA, 18 bp, Artificial Sequence
  Synthetic DNA
tgacaccactctctatcg

SEQ ID NO: 65114 - DNA, 18 bp, Artificial Sequence
  Synthetic DNA
tgacactactcacagatg

SEQ ID NO: 65115 - DNA, 18 bp, Artificial Sequence
  Synthetic DNA
tgacatgactaattatag

SEQ ID NO: 65116 - DNA, 18 bp, Artificial Sequence
  Synthetic DNA
tgaggctattaactttag

SEQ ID NO: 65117 - DNA, 18 bp, Artificial Sequence
  Synthetic DNA
tgagtcgtctctctatag

SEQ ID NO: 65118 - DNA, 18 bp, Artificial Sequence
  Synthetic DNA
tgataagactaacactag

SEQ ID NO: 65119 - DNA, 18 bp, Artificial Sequence
  Synthetic DNA
tgataagagtcaatattg

SEQ ID NO: 65120 - DNA, 18 bp, Artificial Sequence
  Synthetic DNA
tgataagattgactaatg

SEQ ID NO: 65121 - DNA, 18 bp, Artificial Sequence
  Synthetic DNA
tgatacaacttaaaatag

SEQ ID NO: 65122 - DNA, 18 bp, Artificial Sequence
  Synthetic DNA
tgatacatctctcttttg

SEQ ID NO: 65123 - DNA, 18 bp, Artificial Sequence
  Synthetic DNA
tgataccactaagtatcg

SEQ ID NO: 65124 - DNA, 18 bp, Artificial Sequence
  Synthetic DNA
tgataccattcacttaag

SEQ ID NO: 65125 - DNA, 18 bp, Artificial Sequence
  Synthetic DNA
tgatacgaatccatattg

SEQ ID NO: 65126 - DNA, 18 bp, Artificial Sequence
  Synthetic DNA
tgatacgactctagaaag

SEQ ID NO: 65127 - DNA, 18 bp, Artificial Sequence
  Synthetic DNA
tgatacgactctcagaag

SEQ ID NO: 65128 - DNA, 18 bp, Artificial Sequence
  Synthetic DNA
tgatacgacttttgtatg

SEQ ID NO: 65129 - DNA, 18 bp, Artificial Sequence
  Synthetic DNA
tgatacgagactctcttg

SEQ ID NO: 65130 - DNA, 18 bp, Artificial Sequence
  Synthetic DNA
tgatacgatacactaacg

SEQ ID NO: 65131 - DNA, 18 bp, Artificial Sequence
  Synthetic DNA
tgatacgatacactacgg

SEQ ID NO: 65132 - DNA, 18 bp, Artificial Sequence
  Synthetic DNA
tgatacgatttccaatag

SEQ ID NO: 65133 - DNA, 18 bp, Artificial Sequence
  Synthetic DNA
tgatacgccaaactaaag

SEQ ID NO: 65134 - DNA, 18 bp, Artificial Sequence
  Synthetic DNA
tgatacgtcacactctgg

SEQ ID NO: 65135 - DNA, 18 bp, Artificial Sequence
  Synthetic DNA
tgatacgtttcactggtg

SEQ ID NO: 65136 - DNA, 18 bp, Artificial Sequence
  Synthetic DNA
tgatactactaacattag

SEQ ID NO: 65137 - DNA, 18 bp, Artificial Sequence
  Synthetic DNA
tgatagcactcaatttag

SEQ ID NO: 65138 - DNA, 18 bp, Artificial Sequence
  Synthetic DNA
tgataggaccctatactg

SEQ ID NO: 65139 - DNA, 18 bp, Artificial Sequence
  Synthetic DNA
tgataggtctctcgatag

SEQ ID NO: 65140 - DNA, 18 bp, Artificial Sequence
  Synthetic DNA
tgatatgacttactactg

SEQ ID NO: 65141 - DNA, 18 bp, Artificial Sequence
  Synthetic DNA
tgatatgtcttgcaatag

SEQ ID NO: 65142 - DNA, 18 bp, Artificial Sequence
  Synthetic DNA
tgatccgactggttatag

SEQ ID NO: 65143 - DNA, 18 bp, Artificial Sequence
  Synthetic DNA
tgatccggcttattatag

SEQ ID NO: 65144 - DNA, 18 bp, Artificial Sequence
  Synthetic DNA
tgatctgtttcactatag

SEQ ID NO: 65145 - DNA, 18 bp, Artificial Sequence
  Synthetic DNA
tgatgagacacactatcg

SEQ ID NO: 65146 - DNA, 18 bp, Artificial Sequence
  Synthetic DNA
tgatgctacttaatattg

SEQ ID NO: 65147 - DNA, 18 bp, Artificial Sequence
  Synthetic DNA
tgatgtaactcattatag

SEQ ID NO: 65148 - DNA, 18 bp, Artificial Sequence
  Synthetic DNA
tgattagactcattatcg

SEQ ID NO: 65149 - DNA, 18 bp, Artificial Sequence
  Synthetic DNA
tgattagtcttacaatag

SEQ ID NO: 65150 - DNA, 18 bp, Artificial Sequence
  Synthetic DNA
tgattcctctcaaaacag

SEQ ID NO: 65151 - DNA, 18 bp, Artificial Sequence
  Synthetic DNA
tgattctattcactattg

SEQ ID NO: 65152 - DNA, 18 bp, Artificial Sequence
  Synthetic DNA
tgattctgctcattatgg

SEQ ID NO: 65153 - DNA, 18 bp, Artificial Sequence
  Synthetic DNA
tgattggactcacaacag

SEQ ID NO: 65154 - DNA, 18 bp, Artificial Sequence
  Synthetic DNA
tgcaactactcatgatag

SEQ ID NO: 65155 - DNA, 18 bp, Artificial Sequence
  Synthetic DNA
tgcaaggacacaataaag

SEQ ID NO: 65156 - DNA, 18 bp, Artificial Sequence
  Synthetic DNA
tgctaccacttacttttg

SEQ ID NO: 65157 - DNA, 18 bp, Artificial Sequence
  Synthetic DNA
tgctatgtctctccatag

SEQ ID NO: 65158 - DNA, 18 bp, Artificial Sequence
  Synthetic DNA
tgcttagacttacaaaag

SEQ ID NO: 65159 - DNA, 18 bp, Artificial Sequence
  Synthetic DNA
tggtaccactcacttcag

SEQ ID NO: 65160 - DNA, 18 bp, Artificial Sequence
  Synthetic DNA
tggtacgaaactctctag

SEQ ID NO: 65161 - DNA, 18 bp, Artificial Sequence
  Synthetic DNA
tggtacgactcaccgttg

SEQ ID NO: 65162 - DNA, 18 bp, Artificial Sequence
  Synthetic DNA
tggtacgctgcactatag

SEQ ID NO: 65163 - DNA, 18 bp, Artificial Sequence
  Synthetic DNA
tggtaggtgtaactattg

SEQ ID NO: 65164 - DNA, 18 bp, Artificial Sequence
  Synthetic DNA
tggtatgactccattttg

SEQ ID NO: 65165 - DNA, 18 bp, Artificial Sequence
  Synthetic DNA
tggtcagactcattaatg

SEQ ID NO: 65166 - DNA, 18 bp, Artificial Sequence
  Synthetic DNA
tggttcgattctttatag

SEQ ID NO: 65167 - DNA, 18 bp, Artificial Sequence
  Synthetic DNA
tgtaacgacagacaattg

SEQ ID NO: 65168 - DNA, 18 bp, Artificial Sequence
  Synthetic DNA
tgtaacgactaactacag

SEQ ID NO: 65169 - DNA, 18 bp, Artificial Sequence
  Synthetic DNA
tgtaactacgcactattg

SEQ ID NO: 65170 - DNA, 18 bp, Artificial Sequence
  Synthetic DNA
tgtatcaactcactaagg

SEQ ID NO: 65171 - DNA, 18 bp, Artificial Sequence
  Synthetic DNA
tgtgataactcattttag

SEQ ID NO: 65172 - DNA, 18 bp, Artificial Sequence
  Synthetic DNA
tgttaagtccctctaaag

SEQ ID NO: 65173 - DNA, 18 bp, Artificial Sequence
  Synthetic DNA
tgttacaaatgactaaag

SEQ ID NO: 65174 - DNA, 18 bp, Artificial Sequence
  Synthetic DNA
tgttacaactcactaagg

SEQ ID NO: 65175 - DNA, 18 bp, Artificial Sequence
  Synthetic DNA
tgttacaattcgctagag

SEQ ID NO: 65176 - DNA, 18 bp, Artificial Sequence
  Synthetic DNA
tgttacacctcgcttttg

SEQ ID NO: 65177 - DNA, 18 bp, Artificial Sequence
  Synthetic DNA
tgttacctctcccaattg

SEQ ID NO: 65178 - DNA, 18 bp, Artificial Sequence
  Synthetic DNA
tgttacgaatcactcagg

SEQ ID NO: 65179 - DNA, 18 bp, Artificial Sequence
  Synthetic DNA
tgttacgacactgtatag

SEQ ID NO: 65180 - DNA, 18 bp, Artificial Sequence
  Synthetic DNA
tgttacgacttccaaaag

SEQ ID NO: 65181 - DNA, 18 bp, Artificial Sequence
  Synthetic DNA
tgttacgtctcaatattg

SEQ ID NO: 65182 - DNA, 18 bp, Artificial Sequence
  Synthetic DNA
tgttagaactcattttgg

SEQ ID NO: 65183 - DNA, 18 bp, Artificial Sequence
  Synthetic DNA
tgttaggtgtaactatag

SEQ ID NO: 65184 - DNA, 18 bp, Artificial Sequence
  Synthetic DNA
tgttatgtaacactttag

SEQ ID NO: 65185 - DNA, 18 bp, Artificial Sequence
  Synthetic DNA
tgttcagtctcgctgtag

SEQ ID NO: 65186 - DNA, 18 bp, Artificial Sequence
  Synthetic DNA
tgtttagactcactattg

SEQ ID NO: 65187 - DNA, 18 bp, Artificial Sequence
  Synthetic DNA
tgtttagataaactgtag

SEQ ID NO: 65188 - DNA, 18 bp, Artificial Sequence
  Synthetic DNA
tgtttcgactcattgtag

SEQ ID NO: 65189 - DNA, 18 bp, Artificial Sequence
  Synthetic DNA
tgtttctaatcactatag

SEQ ID NO: 65190 - DNA, 18 bp, Artificial Sequence
  Synthetic DNA
tgttttgacacactaaag

SEQ ID NO: 65191 - DNA, 18 bp, Artificial Sequence
  Synthetic DNA
ttaaaagattcattaaag

SEQ ID NO: 65192 - DNA, 18 bp, Artificial Sequence
  Synthetic DNA
ttaaaatccacactattg

SEQ ID NO: 65193 - DNA, 18 bp, Artificial Sequence
  Synthetic DNA
ttaaacaattcactacag

SEQ ID NO: 65194 - DNA, 18 bp, Artificial Sequence
  Synthetic DNA
ttaaacaattcactttag

SEQ ID NO: 65195 - DNA, 18 bp, Artificial Sequence
  Synthetic DNA
ttaaacatctttctatag

SEQ ID NO: 65196 - DNA, 18 bp, Artificial Sequence
  Synthetic DNA
ttaaacgaaacactatgg

SEQ ID NO: 65197 - DNA, 18 bp, Artificial Sequence
  Synthetic DNA
ttaaacgacacccttttg

SEQ ID NO: 65198 - DNA, 18 bp, Artificial Sequence
  Synthetic DNA
ttaaacgactcgctttcg

SEQ ID NO: 65199 - DNA, 18 bp, Artificial Sequence
  Synthetic DNA
ttaaacgactctcgaaag

SEQ ID NO: 65200 - DNA, 18 bp, Artificial Sequence
  Synthetic DNA
ttaaacgacttacataag

SEQ ID NO: 65201 - DNA, 18 bp, Artificial Sequence
  Synthetic DNA
ttaaacgattgtctatag

SEQ ID NO: 65202 - DNA, 18 bp, Artificial Sequence
  Synthetic DNA
ttaaacggtactctacag

SEQ ID NO: 65203 - DNA, 18 bp, Artificial Sequence
  Synthetic DNA
ttaaacgtctattttacg

SEQ ID NO: 65204 - DNA, 18 bp, Artificial Sequence
  Synthetic DNA
ttaaacgtctcacgaatg

SEQ ID NO: 65205 - DNA, 18 bp, Artificial Sequence
  Synthetic DNA
ttaaactacgatctaaag

SEQ ID NO: 65206 - DNA, 18 bp, Artificial Sequence
  Synthetic DNA
ttaaacttatcactatcg

SEQ ID NO: 65207 - DNA, 18 bp, Artificial Sequence
  Synthetic DNA
ttaaacttctctatatag

SEQ ID NO: 65208 - DNA, 18 bp, Artificial Sequence
  Synthetic DNA
ttaaagttctcattgtag

SEQ ID NO: 65209 - DNA, 18 bp, Artificial Sequence
  Synthetic DNA
ttaaatgcctcagactag

SEQ ID NO: 65210 - DNA, 18 bp, Artificial Sequence
  Synthetic DNA
ttaacccactcactttag

SEQ ID NO: 65211 - DNA, 18 bp, Artificial Sequence
  Synthetic DNA
ttaaccgacgcatgattg

SEQ ID NO: 65212 - DNA, 18 bp, Artificial Sequence
  Synthetic DNA
ttaaccgcctcaaaatag

SEQ ID NO: 65213 - DNA, 18 bp, Artificial Sequence
  Synthetic DNA
ttaagcgatatactatag

SEQ ID NO: 65214 - DNA, 18 bp, Artificial Sequence
  Synthetic DNA
ttaatagacccactacag

SEQ ID NO: 65215 - DNA, 18 bp, Artificial Sequence
  Synthetic DNA
ttaatcaaccatcgtttg

SEQ ID NO: 65216 - DNA, 18 bp, Artificial Sequence
  Synthetic DNA
ttaatcgactcacaaaag

SEQ ID NO: 65217 - DNA, 18 bp, Artificial Sequence
  Synthetic DNA
ttaatcgtctcactctag

SEQ ID NO: 65218 - DNA, 18 bp, Artificial Sequence
  Synthetic DNA
ttaatcgtctctctttag

SEQ ID NO: 65219 - DNA, 18 bp, Artificial Sequence
  Synthetic DNA
ttacacacctcactgtag

SEQ ID NO: 65220 - DNA, 18 bp, Artificial Sequence
  Synthetic DNA
ttacaccactcagaatag

SEQ ID NO: 65221 - DNA, 18 bp, Artificial Sequence
  Synthetic DNA
ttacacgactaacagtag

SEQ ID NO: 65222 - DNA, 18 bp, Artificial Sequence
  Synthetic DNA
ttacacgactcccacatg

SEQ ID NO: 65223 - DNA, 18 bp, Artificial Sequence
  Synthetic DNA
ttacacgtaacactacag

SEQ ID NO: 65224 - DNA, 18 bp, Artificial Sequence
  Synthetic DNA
ttacactactcaatttag

SEQ ID NO: 65225 - DNA, 18 bp, Artificial Sequence
  Synthetic DNA
ttacatgactcgatatgg

SEQ ID NO: 65226 - DNA, 18 bp, Artificial Sequence
  Synthetic DNA
ttacatgactttccatag

SEQ ID NO: 65227 - DNA, 18 bp, Artificial Sequence
  Synthetic DNA
ttaccttactcactaaag

SEQ ID NO: 65228 - DNA, 18 bp, Artificial Sequence
  Synthetic DNA
ttactagactatttaaag

SEQ ID NO: 65229 - DNA, 18 bp, Artificial Sequence
  Synthetic DNA
ttactcgactcacttttg

SEQ ID NO: 65230 - DNA, 18 bp, Artificial Sequence
  Synthetic DNA
ttactcggatcaccacag

SEQ ID NO: 65231 - DNA, 18 bp, Artificial Sequence
  Synthetic DNA
ttagacgacacacattag

SEQ ID NO: 65232 - DNA, 18 bp, Artificial Sequence
  Synthetic DNA
ttagacggttctctttag

SEQ ID NO: 65233 - DNA, 18 bp, Artificial Sequence
  Synthetic DNA
ttagattactcactaaag

SEQ ID NO: 65234 - DNA, 18 bp, Artificial Sequence
  Synthetic DNA
ttagccgacacacattag

SEQ ID NO: 65235 - DNA, 18 bp, Artificial Sequence
  Synthetic DNA
ttataaatcacactatag

SEQ ID NO: 65236 - DNA, 18 bp, Artificial Sequence
  Synthetic DNA
ttataacatacactatag

SEQ ID NO: 65237 - DNA, 18 bp, Artificial Sequence
  Synthetic DNA
ttataactctcacaatag

SEQ ID NO: 65238 - DNA, 18 bp, Artificial Sequence
  Synthetic DNA
ttataagaattactgtag

SEQ ID NO: 65239 - DNA, 18 bp, Artificial Sequence
  Synthetic DNA
ttataagacacgctaaag

SEQ ID NO: 65240 - DNA, 18 bp, Artificial Sequence
  Synthetic DNA
ttataagactaattagtg

SEQ ID NO: 65241 - DNA, 18 bp, Artificial Sequence
  Synthetic DNA
ttataagactgattattg

SEQ ID NO: 65242 - DNA, 18 bp, Artificial Sequence
  Synthetic DNA
ttataagtccctgtatag

SEQ ID NO: 65243 - DNA, 18 bp, Artificial Sequence
  Synthetic DNA
ttataataatctctaaag

SEQ ID NO: 65244 - DNA, 18 bp, Artificial Sequence
  Synthetic DNA
ttataatacccactattg

SEQ ID NO: 65245 - DNA, 18 bp, Artificial Sequence
  Synthetic DNA
ttataatactctctagcg

SEQ ID NO: 65246 - DNA, 18 bp, Artificial Sequence
  Synthetic DNA
ttataatagtaaccattg

SEQ ID NO: 65247 - DNA, 18 bp, Artificial Sequence
  Synthetic DNA
ttataattctctccaaag

SEQ ID NO: 65248 - DNA, 18 bp, Artificial Sequence
  Synthetic DNA
ttatacaaatctcaattg

SEQ ID NO: 65249 - DNA, 18 bp, Artificial Sequence
  Synthetic DNA
ttatacaacacattctag

SEQ ID NO: 65250 - DNA, 18 bp, Artificial Sequence
  Synthetic DNA
ttatacaactaaccattg

SEQ ID NO: 65251 - DNA, 18 bp, Artificial Sequence
  Synthetic DNA
ttatacaactaagtctag

SEQ ID NO: 65252 - DNA, 18 bp, Artificial Sequence
  Synthetic DNA
ttatacaactcatcaaag

SEQ ID NO: 65253 - DNA, 18 bp, Artificial Sequence
  Synthetic DNA
ttatacacctccgtcaag

SEQ ID NO: 65254 - DNA, 18 bp, Artificial Sequence
  Synthetic DNA
ttatacatacctctctag

SEQ ID NO: 65255 - DNA, 18 bp, Artificial Sequence
  Synthetic DNA
ttatacatatcaattttg

SEQ ID NO: 65256 - DNA, 18 bp, Artificial Sequence
  Synthetic DNA
ttatacatcaaccgaaag

SEQ ID NO: 65257 - DNA, 18 bp, Artificial Sequence
  Synthetic DNA
ttatacatctcactaccg

SEQ ID NO: 65258 - DNA, 18 bp, Artificial Sequence
  Synthetic DNA
ttatacatgccactatag

SEQ ID NO: 65259 - DNA, 18 bp, Artificial Sequence
  Synthetic DNA
ttatacatttctctgtag

SEQ ID NO: 65260 - DNA, 18 bp, Artificial Sequence
  Synthetic DNA
ttatacattttattaaag

SEQ ID NO: 65261 - DNA, 18 bp, Artificial Sequence
  Synthetic DNA
ttataccaatcactaacg

SEQ ID NO: 65262 - DNA, 18 bp, Artificial Sequence
  Synthetic DNA
ttataccaatgactaaag

SEQ ID NO: 65263 - DNA, 18 bp, Artificial Sequence
  Synthetic DNA
ttataccactcaattaag

SEQ ID NO: 65264 - DNA, 18 bp, Artificial Sequence
  Synthetic DNA
ttataccatatatgaaag

SEQ ID NO: 65265 - DNA, 18 bp, Artificial Sequence
  Synthetic DNA
ttatacgaaaaactatgg

SEQ ID NO: 65266 - DNA, 18 bp, Artificial Sequence
  Synthetic DNA
ttatacgaaatactaaag

SEQ ID NO: 65267 - DNA, 18 bp, Artificial Sequence
  Synthetic DNA
ttatacgaaccacttaag

SEQ ID NO: 65268 - DNA, 18 bp, Artificial Sequence
  Synthetic DNA
ttatacgaatctctcaag

SEQ ID NO: 65269 - DNA, 18 bp, Artificial Sequence
  Synthetic DNA
ttatacgaattaatgtag

SEQ ID NO: 65270 - DNA, 18 bp, Artificial Sequence
  Synthetic DNA
ttatacgacaccctaggg

SEQ ID NO: 65271 - DNA, 18 bp, Artificial Sequence
  Synthetic DNA
ttatacgacactaaatag

SEQ ID NO: 65272 - DNA, 18 bp, Artificial Sequence
  Synthetic DNA
ttatacgacagattattg

SEQ ID NO: 65273 - DNA, 18 bp, Artificial Sequence
  Synthetic DNA
ttatacgacagtccttcg

SEQ ID NO: 65274 - DNA, 18 bp, Artificial Sequence
  Synthetic DNA
ttatacgacattctctag

SEQ ID NO: 65275 - DNA, 18 bp, Artificial Sequence
  Synthetic DNA
ttatacgacctaccgtag

SEQ ID NO: 65276 - DNA, 18 bp, Artificial Sequence
  Synthetic DNA
ttatacgacgatgttcag

SEQ ID NO: 65277 - DNA, 18 bp, Artificial Sequence
  Synthetic DNA
ttatacgactatatattg

SEQ ID NO: 65278 - DNA, 18 bp, Artificial Sequence
  Synthetic DNA
ttatacgactatccctag

SEQ ID NO: 65279 - DNA, 18 bp, Artificial Sequence
  Synthetic DNA
ttatacgactatctcaag

SEQ ID NO: 65280 - DNA, 18 bp, Artificial Sequence
  Synthetic DNA
ttatacgacttatattag

SEQ ID NO: 65281 - DNA, 18 bp, Artificial Sequence
  Synthetic DNA
ttatacgactttcaaaag

SEQ ID NO: 65282 - DNA, 18 bp, Artificial Sequence
  Synthetic DNA
ttatacgagactgtatag

SEQ ID NO: 65283 - DNA, 18 bp, Artificial Sequence
  Synthetic DNA
ttatacgatactctttag

SEQ ID NO: 65284 - DNA, 18 bp, Artificial Sequence
  Synthetic DNA
ttatacgattccgcatag

SEQ ID NO: 65285 - DNA, 18 bp, Artificial Sequence
  Synthetic DNA
ttatacgattgtccatcg

SEQ ID NO: 65286 - DNA, 18 bp, Artificial Sequence
  Synthetic DNA
ttatacgcattgataaag

SEQ ID NO: 65287 - DNA, 18 bp, Artificial Sequence
  Synthetic DNA
ttatacgctgcattatag

SEQ ID NO: 65288 - DNA, 18 bp, Artificial Sequence
  Synthetic DNA
ttatacggcgccctacag

SEQ ID NO: 65289 - DNA, 18 bp, Artificial Sequence
  Synthetic DNA
ttatacggctagccaaag

SEQ ID NO: 65290 - DNA, 18 bp, Artificial Sequence
  Synthetic DNA
ttatacggctcacctaag

SEQ ID NO: 65291 - DNA, 18 bp, Artificial Sequence
  Synthetic DNA
ttatacggctctccttag

SEQ ID NO: 65292 - DNA, 18 bp, Artificial Sequence
  Synthetic DNA
ttatacgggacacaatag

SEQ ID NO: 65293 - DNA, 18 bp, Artificial Sequence
  Synthetic DNA
ttatacgtatcataacag

SEQ ID NO: 65294 - DNA, 18 bp, Artificial Sequence
  Synthetic DNA
ttatacgtcacactttgg

SEQ ID NO: 65295 - DNA, 18 bp, Artificial Sequence
  Synthetic DNA
ttatacgtcacattaacg

SEQ ID NO: 65296 - DNA, 18 bp, Artificial Sequence
  Synthetic DNA
ttatacgtctcatttctg

SEQ ID NO: 65297 - DNA, 18 bp, Artificial Sequence
  Synthetic DNA
ttatacgtcttagtctag

SEQ ID NO: 65298 - DNA, 18 bp, Artificial Sequence
  Synthetic DNA
ttatacgtttcgttatag

SEQ ID NO: 65299 - DNA, 18 bp, Artificial Sequence
  Synthetic DNA
ttatactaatcgatattg

SEQ ID NO: 65300 - DNA, 18 bp, Artificial Sequence
  Synthetic DNA
ttatactactctccctag

SEQ ID NO: 65301 - DNA, 18 bp, Artificial Sequence
  Synthetic DNA
ttatactatagtcttttg

SEQ ID NO: 65302 - DNA, 18 bp, Artificial Sequence
  Synthetic DNA
ttatactgcttactttag

SEQ ID NO: 65303 - DNA, 18 bp, Artificial Sequence
  Synthetic DNA
ttatactttactctcaag

SEQ ID NO: 65304 - DNA, 18 bp, Artificial Sequence
  Synthetic DNA
ttatacttttcattattg

SEQ ID NO: 65305 - DNA, 18 bp, Artificial Sequence
  Synthetic DNA
ttatactttttattatag

SEQ ID NO: 65306 - DNA, 18 bp, Artificial Sequence
  Synthetic DNA
ttatagcacttactattg

SEQ ID NO: 65307 - DNA, 18 bp, Artificial Sequence
  Synthetic DNA
ttataggacccacgaaag

SEQ ID NO: 65308 - DNA, 18 bp, Artificial Sequence
  Synthetic DNA
ttataggactagctaaag

SEQ ID NO: 65309 - DNA, 18 bp, Artificial Sequence
  Synthetic DNA
ttataggtctcaccaaag

SEQ ID NO: 65310 - DNA, 18 bp, Artificial Sequence
  Synthetic DNA
ttataggtctctctaaag

SEQ ID NO: 65311 - DNA, 18 bp, Artificial Sequence
  Synthetic DNA
ttataggtctctctttag

SEQ ID NO: 65312 - DNA, 18 bp, Artificial Sequence
  Synthetic DNA
ttatataaatcagtatag

SEQ ID NO: 65313 - DNA, 18 bp, Artificial Sequence
  Synthetic DNA
ttatataactcactctcg

SEQ ID NO: 65314 - DNA, 18 bp, Artificial Sequence
  Synthetic DNA
ttatatcactccctcttg

SEQ ID NO: 65315 - DNA, 18 bp, Artificial Sequence
  Synthetic DNA
ttatatgaatcacctaag

SEQ ID NO: 65316 - DNA, 18 bp, Artificial Sequence
  Synthetic DNA
ttatatgacacacttctg

SEQ ID NO: 65317 - DNA, 18 bp, Artificial Sequence
  Synthetic DNA
ttatatgacccaccctag

SEQ ID NO: 65318 - DNA, 18 bp, Artificial Sequence
  Synthetic DNA
ttatatgatttactcttg

SEQ ID NO: 65319 - DNA, 18 bp, Artificial Sequence
  Synthetic DNA
ttatatgcctctttattg

SEQ ID NO: 65320 - DNA, 18 bp, Artificial Sequence
  Synthetic DNA
ttatatggctcaatttag

SEQ ID NO: 65321 - DNA, 18 bp, Artificial Sequence
  Synthetic DNA
ttatattacactcagttg

SEQ ID NO: 65322 - DNA, 18 bp, Artificial Sequence
  Synthetic DNA
ttatattacactctttag

SEQ ID NO: 65323 - DNA, 18 bp, Artificial Sequence
  Synthetic DNA
ttatcagacaccctatag

SEQ ID NO: 65324 - DNA, 18 bp, Artificial Sequence
  Synthetic DNA
ttatccacctcacaatag

SEQ ID NO: 65325 - DNA, 18 bp, Artificial Sequence
  Synthetic DNA
ttatccgaatctatttag

SEQ ID NO: 65326 - DNA, 18 bp, Artificial Sequence
  Synthetic DNA
ttatccgcctcactaacg

SEQ ID NO: 65327 - DNA, 18 bp, Artificial Sequence
  Synthetic DNA
ttatctcactcactattg

SEQ ID NO: 65328 - DNA, 18 bp, Artificial Sequence
  Synthetic DNA
ttatcttaccttctaatg

SEQ ID NO: 65329 - DNA, 18 bp, Artificial Sequence
  Synthetic DNA
ttatgaaccatacatcag

SEQ ID NO: 65330 - DNA, 18 bp, Artificial Sequence
  Synthetic DNA
ttatgcgagtctaccttg

SEQ ID NO: 65331 - DNA, 18 bp, Artificial Sequence
  Synthetic DNA
ttatgcgatttatttaag

SEQ ID NO: 65332 - DNA, 18 bp, Artificial Sequence
  Synthetic DNA
ttatgcgcctccgtatag

SEQ ID NO: 65333 - DNA, 18 bp, Artificial Sequence
  Synthetic DNA
ttatgcgtctcgctggtg

SEQ ID NO: 65334 - DNA, 18 bp, Artificial Sequence
  Synthetic DNA
ttatgctactcgcttttg

SEQ ID NO: 65335 - DNA, 18 bp, Artificial Sequence
  Synthetic DNA
ttatgtgtctcaaaaaag

SEQ ID NO: 65336 - DNA, 18 bp, Artificial Sequence
  Synthetic DNA
ttattagattcactgtag

SEQ ID NO: 65337 - DNA, 18 bp, Artificial Sequence
  Synthetic DNA
ttattcaccactccagcg

SEQ ID NO: 65338 - DNA, 18 bp, Artificial Sequence
  Synthetic DNA
ttattccacacactagtg

SEQ ID NO: 65339 - DNA, 18 bp, Artificial Sequence
  Synthetic DNA
ttattcgacacaccattg

SEQ ID NO: 65340 - DNA, 18 bp, Artificial Sequence
  Synthetic DNA
ttattcgaccaactacag

SEQ ID NO: 65341 - DNA, 18 bp, Artificial Sequence
  Synthetic DNA
ttattcgacgctcttttg

SEQ ID NO: 65342 - DNA, 18 bp, Artificial Sequence
  Synthetic DNA
ttattcgactaactgagg

SEQ ID NO: 65343 - DNA, 18 bp, Artificial Sequence
  Synthetic DNA
ttattcgactcagtactg

SEQ ID NO: 65344 - DNA, 18 bp, Artificial Sequence
  Synthetic DNA
ttattcgacttgctactg

SEQ ID NO: 65345 - DNA, 18 bp, Artificial Sequence
  Synthetic DNA
ttattcgatacgcaaaag

SEQ ID NO: 65346 - DNA, 18 bp, Artificial Sequence
  Synthetic DNA
ttattcgattcgctatcg

SEQ ID NO: 65347 - DNA, 18 bp, Artificial Sequence
  Synthetic DNA
ttattcggttcactttag

SEQ ID NO: 65348 - DNA, 18 bp, Artificial Sequence
  Synthetic DNA
ttattcgtatcaatatag

SEQ ID NO: 65349 - DNA, 18 bp, Artificial Sequence
  Synthetic DNA
ttattcgtcccacaatta

SEQ ID NO: 65350 - DNA, 18 bp, Artificial Sequence
  Synthetic DNA
ttattcgtcttacaatcg

SEQ ID NO: 65351 - DNA, 18 bp, Artificial Sequence
  Synthetic DNA
ttattcgtcttacttttg

SEQ ID NO: 65352 - DNA, 18 bp, Artificial Sequence
  Synthetic DNA
ttattctactaaatttag

SEQ ID NO: 65353 - DNA, 18 bp, Artificial Sequence
  Synthetic DNA
ttattctactcaataaag

SEQ ID NO: 65354 - DNA, 18 bp, Artificial Sequence
  Synthetic DNA
ttattcttctcactacag

SEQ ID NO: 65355 - DNA, 18 bp, Artificial Sequence
  Synthetic DNA
ttattggaatcacaatag

SEQ ID NO: 65356 - DNA, 18 bp, Artificial Sequence
  Synthetic DNA
ttattggattcactgtag

SEQ ID NO: 65357 - DNA, 18 bp, Artificial Sequence
  Synthetic DNA
ttatttaactcactaaag

SEQ ID NO: 65358 - DNA, 18 bp, Artificial Sequence
  Synthetic DNA
ttatttgacacactaatg

SEQ ID NO: 65359 - DNA, 18 bp, Artificial Sequence
  Synthetic DNA
ttatttgatacacattag

SEQ ID NO: 65360 - DNA, 18 bp, Artificial Sequence
  Synthetic DNA
ttatttgcctcacttttg

SEQ ID NO: 65361 - DNA, 18 bp, Artificial Sequence
  Synthetic DNA
ttattttcctcactatag

SEQ ID NO: 65362 - DNA, 18 bp, Artificial Sequence
  Synthetic DNA
ttcaaagaatcacgaaag

SEQ ID NO: 65363 - DNA, 18 bp, Artificial Sequence
  Synthetic DNA
ttcaaattctaactgtcg

SEQ ID NO: 65364 - DNA, 18 bp, Artificial Sequence
  Synthetic DNA
ttcaacgaaccactattg

SEQ ID NO: 65365 - DNA, 18 bp, Artificial Sequence
  Synthetic DNA
ttcaacgacatagtatag

SEQ ID NO: 65366 - DNA, 18 bp, Artificial Sequence
  Synthetic DNA
ttcaacgtttgtttttag

SEQ ID NO: 65367 - DNA, 18 bp, Artificial Sequence
  Synthetic DNA
ttcaactaatctctaaag

SEQ ID NO: 65368 - DNA, 18 bp, Artificial Sequence
  Synthetic DNA
ttccacgactaactacag

SEQ ID NO: 65369 - DNA, 18 bp, Artificial Sequence
  Synthetic DNA
ttccacgactccttatag

SEQ ID NO: 65370 - DNA, 18 bp, Artificial Sequence
  Synthetic DNA
ttccacgactctctcatg

SEQ ID NO: 65371 - DNA, 18 bp, Artificial Sequence
  Synthetic DNA
ttccactactctctatag

SEQ ID NO: 65372 - DNA, 18 bp, Artificial Sequence
  Synthetic DNA
ttccacttatcacgaaag

SEQ ID NO: 65373 - DNA, 18 bp, Artificial Sequence
  Synthetic DNA
ttccatgtcactatatag

SEQ ID NO: 65374 - DNA, 18 bp, Artificial Sequence
  Synthetic DNA
ttcgaagactctcgttcg

SEQ ID NO: 65375 - DNA, 18 bp, Artificial Sequence
  Synthetic DNA
ttctacaaaacattatag

SEQ ID NO: 65376 - DNA, 18 bp, Artificial Sequence
  Synthetic DNA
ttctacgaatttagattg

SEQ ID NO: 65377 - DNA, 18 bp, Artificial Sequence
  Synthetic DNA
ttctacgacacattaaag

SEQ ID NO: 65378 - DNA, 18 bp, Artificial Sequence
  Synthetic DNA
ttctacgacagaccatag

SEQ ID NO: 65379 - DNA, 18 bp, Artificial Sequence
  Synthetic DNA
ttctacgcatctcgatgg

SEQ ID NO: 65380 - DNA, 18 bp, Artificial Sequence
  Synthetic DNA
ttctacgtctaacattag

SEQ ID NO: 65381 - DNA, 18 bp, Artificial Sequence
  Synthetic DNA
ttctacgtctctatttag

SEQ ID NO: 65382 - DNA, 18 bp, Artificial Sequence
  Synthetic DNA
ttctatgtctaactttcg

SEQ ID NO: 65383 - DNA, 18 bp, Artificial Sequence
  Synthetic DNA
ttctccgaatcagtatgg

SEQ ID NO: 65384 - DNA, 18 bp, Artificial Sequence
  Synthetic DNA
ttgaacaacacaatatgg

SEQ ID NO: 65385 - DNA, 18 bp, Artificial Sequence
  Synthetic DNA
ttgaacaactcgctattg

SEQ ID NO: 65386 - DNA, 18 bp, Artificial Sequence
  Synthetic DNA
ttgaaccacactcaatgg

SEQ ID NO: 65387 - DNA, 18 bp, Artificial Sequence
  Synthetic DNA
ttgcacgacacacattag

SEQ ID NO: 65388 - DNA, 18 bp, Artificial Sequence
  Synthetic DNA
ttggagcacactctatag

SEQ ID NO: 65389 - DNA, 18 bp, Artificial Sequence
  Synthetic DNA
ttgtacaacccacaatag

SEQ ID NO: 65390 - DNA, 18 bp, Artificial Sequence
  Synthetic DNA
ttgtacgagtaaatatag

SEQ ID NO: 65391 - DNA, 18 bp, Artificial Sequence
  Synthetic DNA
ttgtacgtctaaccatag

SEQ ID NO: 65392 - DNA, 18 bp, Artificial Sequence
  Synthetic DNA
ttgtactacttattatag

SEQ ID NO: 65393 - DNA, 18 bp, Artificial Sequence
  Synthetic DNA
ttgtagcccgtactatag

SEQ ID NO: 65394 - DNA, 18 bp, Artificial Sequence
  Synthetic DNA
ttgtatgacacactttag

SEQ ID NO: 65395 - DNA, 18 bp, Artificial Sequence
  Synthetic DNA
ttgtatgactcaatatcg

SEQ ID NO: 65396 - DNA, 18 bp, Artificial Sequence
  Synthetic DNA
ttgtatgactcactttgg

SEQ ID NO: 65397 - DNA, 18 bp, Artificial Sequence
  Synthetic DNA
ttgtatgtctctctttag

SEQ ID NO: 65398 - DNA, 18 bp, Artificial Sequence
  Synthetic DNA
ttgtattacttactatag

SEQ ID NO: 65399 - DNA, 18 bp, Artificial Sequence
  Synthetic DNA
ttgtctgactctctacag

SEQ ID NO: 65400 - DNA, 18 bp, Artificial Sequence
  Synthetic DNA
ttgtgcgacttagaatag

SEQ ID NO: 65401 - DNA, 18 bp, Artificial Sequence
  Synthetic DNA
ttgtgcgtgtctctattg

SEQ ID NO: 65402 - DNA, 18 bp, Artificial Sequence
  Synthetic DNA
ttgtgcttcacactatag

SEQ ID NO: 65403 - DNA, 18 bp, Artificial Sequence
  Synthetic DNA
ttgttcgaatcagtatag

SEQ ID NO: 65404 - DNA, 18 bp, Artificial Sequence
  Synthetic DNA
ttgttcgacaaaccattg

SEQ ID NO: 65405 - DNA, 18 bp, Artificial Sequence
  Synthetic DNA
tttaaacacgcactattg

SEQ ID NO: 65406 - DNA, 18 bp, Artificial Sequence
  Synthetic DNA
tttaaagacttactatag

SEQ ID NO: 65407 - DNA, 18 bp, Artificial Sequence
  Synthetic DNA
tttaacaacatactattg

SEQ ID NO: 65408 - DNA, 18 bp, Artificial Sequence
  Synthetic DNA
tttaaccaatcacaatag

SEQ ID NO: 65409 - DNA, 18 bp, Artificial Sequence
  Synthetic DNA
tttaacgacacaccatag

SEQ ID NO: 65410 - DNA, 18 bp, Artificial Sequence
  Synthetic DNA
tttaacgactaacgttag

SEQ ID NO: 65411 - DNA, 18 bp, Artificial Sequence
  Synthetic DNA
tttaacgagttgctatgg

SEQ ID NO: 65412 - DNA, 18 bp, Artificial Sequence
  Synthetic DNA
tttaacgcctcacttttg

SEQ ID NO: 65413 - DNA, 18 bp, Artificial Sequence
  Synthetic DNA
tttaacgtctctcaacag

SEQ ID NO: 65414 - DNA, 18 bp, Artificial Sequence
  Synthetic DNA
tttaacgtctgtctattg

SEQ ID NO: 65415 - DNA, 18 bp, Artificial Sequence
  Synthetic DNA
tttaactagtcactatag

SEQ ID NO: 65416 - DNA, 18 bp, Artificial Sequence
  Synthetic DNA
tttagcgtctcactaaag

SEQ ID NO: 65417 - DNA, 18 bp, Artificial Sequence
  Synthetic DNA
tttatcgactcactttag

SEQ ID NO: 65418 - DNA, 18 bp, Artificial Sequence
  Synthetic DNA
tttatcgattctcaagag

SEQ ID NO: 65419 - DNA, 18 bp, Artificial Sequence
  Synthetic DNA
tttatcgattctctaaag

SEQ ID NO: 65420 - DNA, 18 bp, Artificial Sequence
  Synthetic DNA
tttcacaattcccaatag

SEQ ID NO: 65421 - DNA, 18 bp, Artificial Sequence
  Synthetic DNA
tttcacgactaaccatag

SEQ ID NO: 65422 - DNA, 18 bp, Artificial Sequence
  Synthetic DNA
tttcacgactgactaaag

SEQ ID NO: 65423 - DNA, 18 bp, Artificial Sequence
  Synthetic DNA
tttctagactaattatag

SEQ ID NO: 65424 - DNA, 18 bp, Artificial Sequence
  Synthetic DNA
tttctcgaatccgtttcg

SEQ ID NO: 65425 - DNA, 18 bp, Artificial Sequence
  Synthetic DNA
tttctcgtctcactatag

SEQ ID NO: 65426 - DNA, 18 bp, Artificial Sequence
  Synthetic DNA
tttgaagaatcattacag

SEQ ID NO: 65427 - DNA, 18 bp, Artificial Sequence
  Synthetic DNA
tttgtcgatacactaaag

SEQ ID NO: 65428 - DNA, 18 bp, Artificial Sequence
  Synthetic DNA
ttttacatctcacaatag

SEQ ID NO: 65429 - DNA, 18 bp, Artificial Sequence
  Synthetic DNA
ttttacgactaacacaag

SEQ ID NO: 65430 - DNA, 18 bp, Artificial Sequence
  Synthetic DNA
ttttacgactagcactag

SEQ ID NO: 65431 - DNA, 18 bp, Artificial Sequence
  Synthetic DNA
ttttacgactctcagtag

SEQ ID NO: 65432 - DNA, 18 bp, Artificial Sequence
  Synthetic DNA
ttttacgactctctaagg

SEQ ID NO: 65433 - DNA, 18 bp, Artificial Sequence
  Synthetic DNA
ttttacgacttcataaag

SEQ ID NO: 65434 - DNA, 18 bp, Artificial Sequence
  Synthetic DNA
ttttacgatccactacag

SEQ ID NO: 65435 - DNA, 18 bp, Artificial Sequence
  Synthetic DNA
ttttacgccactctatag

SEQ ID NO: 65436 - DNA, 18 bp, Artificial Sequence
  Synthetic DNA
ttttactactcacaattg

SEQ ID NO: 65437 - DNA, 18 bp, Artificial Sequence
  Synthetic DNA
ttttactactcaccttag

SEQ ID NO: 65438 - DNA, 18 bp, Artificial Sequence
  Synthetic DNA
ttttaggactttctatag

SEQ ID NO: 65439 - DNA, 18 bp, Artificial Sequence
  Synthetic DNA
ttttaggcccaactattg

SEQ ID NO: 65440 - DNA, 18 bp, Artificial Sequence
  Synthetic DNA
ttttatgtctacctacag

SEQ ID NO: 65441 - DNA, 18 bp, Artificial Sequence
  Synthetic DNA
ttttatgtctcacaatag

SEQ ID NO: 65442 - DNA, 18 bp, Artificial Sequence
  Synthetic DNA
ttttccaactcaatatag

SEQ ID NO: 65443 - DNA, 18 bp, Artificial Sequence
  Synthetic DNA
ttttcctactcaccattg

SEQ ID NO: 65444 - DNA, 18 bp, Artificial Sequence
  Synthetic DNA
ttttctgtctcattatag

SEQ ID NO: 65445 - DNA, 18 bp, Artificial Sequence
  Synthetic DNA
ttttgcggatcacttttg

SEQ ID NO: 65446 - DNA, 18 bp, Artificial Sequence
  Synthetic DNA
tttttagaccgcctatag

SEQ ID NO: 65447 - DNA, 18 bp, Artificial Sequence
  Synthetic DNA
tttttcgacttactattg

SEQ ID NO: 65448 - DNA, 18 bp, Artificial Sequence
  Synthetic DNA
tttttcgtcatactatgg

SEQ ID NO: 65449 - DNA, 18 bp, Artificial Sequence
  Synthetic DNA
ttttttgattctcaatag

SEQ ID NO: 65450 - DNA, 18 bp, Artificial Sequence
  Synthetic DNA
ataaacgactctctctag

SEQ ID NO: 65451 - DNA, 18 bp, Artificial Sequence
  Synthetic DNA
taataagacactttttag

SEQ ID NO: 65452 - DNA, 18 bp, Artificial Sequence
  Synthetic DNA
aaatacaacaccctattg

SEQ ID NO: 65453 - DNA, 18 bp, Artificial Sequence
  Synthetic DNA
aaatactacaaactttag

SEQ ID NO: 65454 - DNA, 18 bp, Artificial Sequence
  Synthetic DNA
aagaacgactcaatttag

SEQ ID NO: 65455 - DNA, 18 bp, Artificial Sequence
  Synthetic DNA
aataattgctcactatag

SEQ ID NO: 65456 - DNA, 18 bp, Artificial Sequence
  Synthetic DNA
aattaagactctctattg

SEQ ID NO: 65457 - DNA, 18 bp, Artificial Sequence
  Synthetic DNA
atatacgactttcaatag

SEQ ID NO: 65458 - DNA, 18 bp, Artificial Sequence
  Synthetic DNA
atatattacacactattg

SEQ ID NO: 65459 - DNA, 18 bp, Artificial Sequence
  Synthetic DNA
caatacgcctttcttttg

SEQ ID NO: 65460 - DNA, 18 bp, Artificial Sequence
  Synthetic DNA
caattcgactctcattag

SEQ ID NO: 65461 - DNA, 18 bp, Artificial Sequence
  Synthetic DNA
cattacgatacactatcg

SEQ ID NO: 65462 - DNA, 18 bp, Artificial Sequence
  Synthetic DNA
catttagactcaccatag

SEQ ID NO: 65463 - DNA, 18 bp, Artificial Sequence
  Synthetic DNA
gaattagactcactaatg

SEQ ID NO: 65464 - DNA, 18 bp, Artificial Sequence
  Synthetic DNA
taaaacttctcacttcag

SEQ ID NO: 65465 - DNA, 18 bp, Artificial Sequence
  Synthetic DNA
taactcgactctctcaag

SEQ ID NO: 65466 - DNA, 18 bp, Artificial Sequence
  Synthetic DNA
taatacatttcattattg

SEQ ID NO: 65467 - DNA, 18 bp, Artificial Sequence
  Synthetic DNA
taatacgaacgtcaatag

SEQ ID NO: 65468 - DNA, 18 bp, Artificial Sequence
  Synthetic DNA
taatacgagcctgtattg

SEQ ID NO: 65469 - DNA, 18 bp, Artificial Sequence
  Synthetic DNA
taatacgtctttcattag

SEQ ID NO: 65470 - DNA, 18 bp, Artificial Sequence
  Synthetic DNA
taataggtcattctatag

SEQ ID NO: 65471 - DNA, 18 bp, Artificial Sequence
  Synthetic DNA
taatatgactatctaatg

SEQ ID NO: 65472 - DNA, 18 bp, Artificial Sequence
  Synthetic DNA
taattcgtttcacattag

SEQ ID NO: 65473 - DNA, 18 bp, Artificial Sequence
  Synthetic DNA
tagatactctcaccaacg

SEQ ID NO: 65474 - DNA, 18 bp, Artificial Sequence
  Synthetic DNA
tagtacgaatacgtatcg

SEQ ID NO: 65475 - DNA, 18 bp, Artificial Sequence
  Synthetic DNA
tagttccattcacattag

SEQ ID NO: 65476 - DNA, 18 bp, Artificial Sequence
  Synthetic DNA
tatgaagacttcccacag

SEQ ID NO: 65477 - DNA, 18 bp, Artificial Sequence
  Synthetic DNA
tattaacacatacaatag

SEQ ID NO: 65478 - DNA, 18 bp, Artificial Sequence
  Synthetic DNA
tattagatcttacttgag

SEQ ID NO: 65479 - DNA, 18 bp, Artificial Sequence
  Synthetic DNA
tatttcatctcacaatag

SEQ ID NO: 65480 - DNA, 18 bp, Artificial Sequence
  Synthetic DNA
tcatacatcatactatag

SEQ ID NO: 65481 - DNA, 18 bp, Artificial Sequence
  Synthetic DNA
tcatattactcacaatgg

SEQ ID NO: 65482 - DNA, 18 bp, Artificial Sequence
  Synthetic DNA
tgattcgatttacttcag

SEQ ID NO: 65483 - DNA, 18 bp, Artificial Sequence
  Synthetic DNA
ttataagaatcactcttg

SEQ ID NO: 65484 - DNA, 18 bp, Artificial Sequence
  Synthetic DNA
ttataagactgacttcag

SEQ ID NO: 65485 - DNA, 18 bp, Artificial Sequence
  Synthetic DNA
ttatacgacacagaaatg

SEQ ID NO: 65486 - DNA, 18 bp, Artificial Sequence
  Synthetic DNA
ttatacgtcacggtattg

SEQ ID NO: 65487 - DNA, 18 bp, Artificial Sequence
  Synthetic DNA
ttcttcgactcgctttag

SEQ ID NO: 65488 - DNA, 18 bp, Artificial Sequence
  Synthetic DNA
tttcacgactccaagtag

SEQ ID NO: 65489 - DNA, 18 bp, Artificial Sequence
  Synthetic DNA
ttttacgacttacttttg

SEQ ID NO: 65490 - DNA, 18 bp, Artificial Sequence
  Synthetic DNA
taatacgattctcttatg

SEQ ID NO: 65491 - DNA, 18 bp, Artificial Sequence
  Synthetic DNA
tatttcgactcacttatg

SEQ ID NO: 65492 - DNA, 18 bp, Artificial Sequence
  Synthetic DNA
ttttacgactctctagcg

SEQ ID NO: 65493 - DNA, 18 bp, Artificial Sequence
  Synthetic DNA
aaatacgactgtctctcg

SEQ ID NO: 65494 - DNA, 18 bp, Artificial Sequence
  Synthetic DNA
aaatatgagacacaatag

SEQ ID NO: 65495 - DNA, 18 bp, Artificial Sequence
  Synthetic DNA
aaattcgtctgactacag

SEQ ID NO: 65496 - DNA, 18 bp, Artificial Sequence
  Synthetic DNA
aagaacgactctctattg

SEQ ID NO: 65497 - DNA, 18 bp, Artificial Sequence
  Synthetic DNA
atacacgacttccaatag

SEQ ID NO: 65498 - DNA, 18 bp, Artificial Sequence
  Synthetic DNA
atattcgactctgtattg

SEQ ID NO: 65499 - DNA, 18 bp, Artificial Sequence
  Synthetic DNA
atctacgacttacattag

SEQ ID NO: 65500 - DNA, 18 bp, Artificial Sequence
  Synthetic DNA
attaaagcctcattgaag

SEQ ID NO: 65501 - DNA, 18 bp, Artificial Sequence
  Synthetic DNA
caataaaactcactaatg

SEQ ID NO: 65502 - DNA, 18 bp, Artificial Sequence
  Synthetic DNA
caattcgtctaaatatag

SEQ ID NO: 65503 - DNA, 18 bp, Artificial Sequence
  Synthetic DNA
cgcaacgtcacacaacag

SEQ ID NO: 65504 - DNA, 18 bp, Artificial Sequence
  Synthetic DNA
taaatcgtctcacttttg

SEQ ID NO: 65505 - DNA, 18 bp, Artificial Sequence
  Synthetic DNA
taacacgacaaactaggg

SEQ ID NO: 65506 - DNA, 18 bp, Artificial Sequence
  Synthetic DNA
taacacgtcatactttag

SEQ ID NO: 65507 - DNA, 18 bp, Artificial Sequence
  Synthetic DNA
taatacgactttcatttg

SEQ ID NO: 65508 - DNA, 18 bp, Artificial Sequence
  Synthetic DNA
taatacgattacttttcg

SEQ ID NO: 65509 - DNA, 18 bp, Artificial Sequence
  Synthetic DNA
taatactccccagtattg

SEQ ID NO: 65510 - DNA, 18 bp, Artificial Sequence
  Synthetic DNA
taattcgacacgaaagag

SEQ ID NO: 65511 - DNA, 18 bp, Artificial Sequence
  Synthetic DNA
taattcgactctcaaagg

SEQ ID NO: 65512 - DNA, 18 bp, Artificial Sequence
  Synthetic DNA
taatttaacactctattg

SEQ ID NO: 65513 - DNA, 18 bp, Artificial Sequence
  Synthetic DNA
tataacgattcacaacag

SEQ ID NO: 65514 - DNA, 18 bp, Artificial Sequence
  Synthetic DNA
tataacgtctcacaattg

SEQ ID NO: 65515 - DNA, 18 bp, Artificial Sequence
  Synthetic DNA
tataactactcactaatg

SEQ ID NO: 65516 - DNA, 18 bp, Artificial Sequence
  Synthetic DNA
tataatgactcactgaag

SEQ ID NO: 65517 - DNA, 18 bp, Artificial Sequence
  Synthetic DNA
tatatcgacccactaaag

SEQ ID NO: 65518 - DNA, 18 bp, Artificial Sequence
  Synthetic DNA
tatatcgtctcactaaag

SEQ ID NO: 65519 - DNA, 18 bp, Artificial Sequence
  Synthetic DNA
tatcacgactcacatttg

SEQ ID NO: 65520 - DNA, 18 bp, Artificial Sequence
  Synthetic DNA
tatctcgactcacttttg

SEQ ID NO: 65521 - DNA, 18 bp, Artificial Sequence
  Synthetic DNA
tattaatcctcactatcg

SEQ ID NO: 65522 - DNA, 18 bp, Artificial Sequence
  Synthetic DNA
tattacgtctctcaatcg

SEQ ID NO: 65523 - DNA, 18 bp, Artificial Sequence
  Synthetic DNA
tattactagtcactgatg

SEQ ID NO: 65524 - DNA, 18 bp, Artificial Sequence
  Synthetic DNA
tattccgactcacgaatg

SEQ ID NO: 65525 - DNA, 18 bp, Artificial Sequence
  Synthetic DNA
tattgacactcactattg

SEQ ID NO: 65526 - DNA, 18 bp, Artificial Sequence
  Synthetic DNA
tattttgactcattaaag

SEQ ID NO: 65527 - DNA, 18 bp, Artificial Sequence
  Synthetic DNA
tcaatcgactcattattg

SEQ ID NO: 65528 - DNA, 18 bp, Artificial Sequence
  Synthetic DNA
tcacaggactcgcattag

SEQ ID NO: 65529 - DNA, 18 bp, Artificial Sequence
  Synthetic DNA
tgatgcaactcgctactg

SEQ ID NO: 65530 - DNA, 18 bp, Artificial Sequence
  Synthetic DNA
ttactcgacgctcaatag

SEQ ID NO: 65531 - DNA, 18 bp, Artificial Sequence
  Synthetic DNA
ttataagacttactcaag

SEQ ID NO: 65532 - DNA, 18 bp, Artificial Sequence
  Synthetic DNA
ttatacaaatcactaatg

SEQ ID NO: 65533 - DNA, 18 bp, Artificial Sequence
  Synthetic DNA
ttatacaattcccaatag

SEQ ID NO: 65534 - DNA, 18 bp, Artificial Sequence
  Synthetic DNA
ttataccactctctaagg

SEQ ID NO: 65535 - DNA, 18 bp, Artificial Sequence
  Synthetic DNA
ttatacgatttacttttg

SEQ ID NO: 65536 - DNA, 18 bp, Artificial Sequence
  Synthetic DNA
ttatactcctctctaaag

SEQ ID NO: 65537 - DNA, 18 bp, Artificial Sequence
  Synthetic DNA
ttatacttcaccctatag

SEQ ID NO: 65538 - DNA, 18 bp, Artificial Sequence
  Synthetic DNA
ttatataacatactttcg

SEQ ID NO: 65539 - DNA, 18 bp, Artificial Sequence
  Synthetic DNA
ttatatgatccactaatg

SEQ ID NO: 65540 - DNA, 18 bp, Artificial Sequence
  Synthetic DNA
ttatttgtctcattatag

SEQ ID NO: 65541 - DNA, 18 bp, Artificial Sequence
  Synthetic DNA
ttttactccccactatag

SEQ ID NO: 65542 - DNA, 18 bp, Artificial Sequence
  Synthetic DNA
aaaaaagactctcttaag

SEQ ID NO: 65543 - DNA, 18 bp, Artificial Sequence
  Synthetic DNA
aaaaacgcctctttatgg

SEQ ID NO: 65544 - DNA, 18 bp, Artificial Sequence
  Synthetic DNA
aaaaacgtatcactttag

SEQ ID NO: 65545 - DNA, 18 bp, Artificial Sequence
  Synthetic DNA
aaaaacgtctctatatag

SEQ ID NO: 65546 - DNA, 18 bp, Artificial Sequence
  Synthetic DNA
aaaaacgttttactatag

SEQ ID NO: 65547 - DNA, 18 bp, Artificial Sequence
  Synthetic DNA
aaaaactactcaatttag

SEQ ID NO: 65548 - DNA, 18 bp, Artificial Sequence
  Synthetic DNA
aaaaccggcacactattg

SEQ ID NO: 65549 - DNA, 18 bp, Artificial Sequence
  Synthetic DNA
aaaatcgactcactcttg

SEQ ID NO: 65550 - DNA, 18 bp, Artificial Sequence
  Synthetic DNA
aaaatcgcgcctcaaaag

SEQ ID NO: 65551 - DNA, 18 bp, Artificial Sequence
  Synthetic DNA
aaaatcgtatccattttg

SEQ ID NO: 65552 - DNA, 18 bp, Artificial Sequence
  Synthetic DNA
aaaatcttatcaatatag

SEQ ID NO: 65553 - DNA, 18 bp, Artificial Sequence
  Synthetic DNA
aaacaagactctcaatag

SEQ ID NO: 65554 - DNA, 18 bp, Artificial Sequence
  Synthetic DNA
aaacacgaagcactttag

SEQ ID NO: 65555 - DNA, 18 bp, Artificial Sequence
  Synthetic DNA
aaacacggggcgcaatag

SEQ ID NO: 65556 - DNA, 18 bp, Artificial Sequence
  Synthetic DNA
aaacacgtctgaatatag

SEQ ID NO: 65557 - DNA, 18 bp, Artificial Sequence
  Synthetic DNA
aaacacgtttcacttcag

SEQ ID NO: 65558 - DNA, 18 bp, Artificial Sequence
  Synthetic DNA
aaacatgacttactaaag

SEQ ID NO: 65559 - DNA, 18 bp, Artificial Sequence
  Synthetic DNA
aaacattactcattatcg

SEQ ID NO: 65560 - DNA, 18 bp, Artificial Sequence
  Synthetic DNA
aaacgcgactaactattg

SEQ ID NO: 65561 - DNA, 18 bp, Artificial Sequence
  Synthetic DNA
aaacgtgactatctatcg

SEQ ID NO: 65562 - DNA, 18 bp, Artificial Sequence
  Synthetic DNA
aaactcgaaacattatag

SEQ ID NO: 65563 - DNA, 18 bp, Artificial Sequence
  Synthetic DNA
aaactcgactcaccatcg

SEQ ID NO: 65564 - DNA, 18 bp, Artificial Sequence
  Synthetic DNA
aaactcgactcacttatg

SEQ ID NO: 65565 - DNA, 18 bp, Artificial Sequence
  Synthetic DNA
aaacttgattctctaaag

SEQ ID NO: 65566 - DNA, 18 bp, Artificial Sequence
  Synthetic DNA
aaacttgcaacactatag

SEQ ID NO: 65567 - DNA, 18 bp, Artificial Sequence
  Synthetic DNA
aaagacaattcgttttag

SEQ ID NO: 65568 - DNA, 18 bp, Artificial Sequence
  Synthetic DNA
aaagacgacttttaatag

SEQ ID NO: 65569 - DNA, 18 bp, Artificial Sequence
  Synthetic DNA
aaagacgcatgactattg

SEQ ID NO: 65570 - DNA, 18 bp, Artificial Sequence
  Synthetic DNA
aaagacgtcacataatag

SEQ ID NO: 65571 - DNA, 18 bp, Artificial Sequence
  Synthetic DNA
aaagtcaacactataaag

SEQ ID NO: 65572 - DNA, 18 bp, Artificial Sequence
  Synthetic DNA
aaagtccactccctagtg

SEQ ID NO: 65573 - DNA, 18 bp, Artificial Sequence
  Synthetic DNA
aaagtcgtctccccatag

SEQ ID NO: 65574 - DNA, 18 bp, Artificial Sequence
  Synthetic DNA
aaataacgcagactaatg

SEQ ID NO: 65575 - DNA, 18 bp, Artificial Sequence
  Synthetic DNA
aaataagaatcacaaaag

SEQ ID NO: 65576 - DNA, 18 bp, Artificial Sequence
  Synthetic DNA
aaataagaatcacttaag

SEQ ID NO: 65577 - DNA, 18 bp, Artificial Sequence
  Synthetic DNA
aaataagacttccaaatg

SEQ ID NO: 65578 - DNA, 18 bp, Artificial Sequence
  Synthetic DNA
aaataagcgccactatag

SEQ ID NO: 65579 - DNA, 18 bp, Artificial Sequence
  Synthetic DNA
aaataaggctctttaaag

SEQ ID NO: 65580 - DNA, 18 bp, Artificial Sequence
  Synthetic DNA
aaatacaaatgacttatg

SEQ ID NO: 65581 - DNA, 18 bp, Artificial Sequence
  Synthetic DNA
aaatacaactcccctctg

SEQ ID NO: 65582 - DNA, 18 bp, Artificial Sequence
  Synthetic DNA
aaataccacttcctttag

SEQ ID NO: 65583 - DNA, 18 bp, Artificial Sequence
  Synthetic DNA
aaatacctctcataatag

SEQ ID NO: 65584 - DNA, 18 bp, Artificial Sequence
  Synthetic DNA
aaatacgaaacattcttg

SEQ ID NO: 65585 - DNA, 18 bp, Artificial Sequence
  Synthetic DNA
aaatacgaaactctctgg

SEQ ID NO: 65586 - DNA, 18 bp, Artificial Sequence
  Synthetic DNA
aaatacgaatctttatgg

SEQ ID NO: 65587 - DNA, 18 bp, Artificial Sequence
  Synthetic DNA
aaatacgaatttcaatag

SEQ ID NO: 65588 - DNA, 18 bp, Artificial Sequence
  Synthetic DNA
aaatacgacactcctatg

SEQ ID NO: 65589 - DNA, 18 bp, Artificial Sequence
  Synthetic DNA
aaatacgaccctcaaaag

SEQ ID NO: 65590 - DNA, 18 bp, Artificial Sequence
  Synthetic DNA
aaatacgacgctttcttg

SEQ ID NO: 65591 - DNA, 18 bp, Artificial Sequence
  Synthetic DNA
aaatacgactatctagcg

SEQ ID NO: 65592 - DNA, 18 bp, Artificial Sequence
  Synthetic DNA
aaatacgactatcttttg

SEQ ID NO: 65593 - DNA, 18 bp, Artificial Sequence
  Synthetic DNA
aaatacgactcataactg

SEQ ID NO: 65594 - DNA, 18 bp, Artificial Sequence
  Synthetic DNA
aaatacgagtatctttag

SEQ ID NO: 65595 - DNA, 18 bp, Artificial Sequence
  Synthetic DNA
aaatacgatacagtaaag

SEQ ID NO: 65596 - DNA, 18 bp, Artificial Sequence
  Synthetic DNA
aaatacggatccttattg

SEQ ID NO: 65597 - DNA, 18 bp, Artificial Sequence
  Synthetic DNA
aaatacggcacacctcag

SEQ ID NO: 65598 - DNA, 18 bp, Artificial Sequence
  Synthetic DNA
aaatacggctctcaacag

SEQ ID NO: 65599 - DNA, 18 bp, Artificial Sequence
  Synthetic DNA
aaatacgtatatctattg

SEQ ID NO: 65600 - DNA, 18 bp, Artificial Sequence
  Synthetic DNA
aaatacgtctaattatgg

SEQ ID NO: 65601 - DNA, 18 bp, Artificial Sequence
  Synthetic DNA
aaatacgtctcatcagag

SEQ ID NO: 65602 - DNA, 18 bp, Artificial Sequence
  Synthetic DNA
aaatacgtctcgttaaag

SEQ ID NO: 65603 - DNA, 18 bp, Artificial Sequence
  Synthetic DNA
aaatacgtcttaataatg

SEQ ID NO: 65604 - DNA, 18 bp, Artificial Sequence
  Synthetic DNA
aaatactacactccgtag

SEQ ID NO: 65605 - DNA, 18 bp, Artificial Sequence
  Synthetic DNA
aaatactacccattgtag

SEQ ID NO: 65606 - DNA, 18 bp, Artificial Sequence
  Synthetic DNA
aaatactacgctttaaag

SEQ ID NO: 65607 - DNA, 18 bp, Artificial Sequence
  Synthetic DNA
aaatactactcccatttg

SEQ ID NO: 65608 - DNA, 18 bp, Artificial Sequence
  Synthetic DNA
aaatactacttcctgtag

SEQ ID NO: 65609 - DNA, 18 bp, Artificial Sequence
  Synthetic DNA
aaatactcctcatttaag

SEQ ID NO: 65610 - DNA, 18 bp, Artificial Sequence
  Synthetic DNA
aaatagatcacattaaag

SEQ ID NO: 65611 - DNA, 18 bp, Artificial Sequence
  Synthetic DNA
aaatagggctcgcaatag

SEQ ID NO: 65612 - DNA, 18 bp, Artificial Sequence
  Synthetic DNA
aaatagtaaacacaattg

SEQ ID NO: 65613 - DNA, 18 bp, Artificial Sequence
  Synthetic DNA
aaatagtactcacaaaag

SEQ ID NO: 65614 - DNA, 18 bp, Artificial Sequence
  Synthetic DNA
aaatatgtcactcaactg

SEQ ID NO: 65615 - DNA, 18 bp, Artificial Sequence
  Synthetic DNA
aaatattactaactaaag

SEQ ID NO: 65616 - DNA, 18 bp, Artificial Sequence
  Synthetic DNA
aaatattactcaccaaag

SEQ ID NO: 65617 - DNA, 18 bp, Artificial Sequence
  Synthetic DNA
aaatcagtatcactgtag

SEQ ID NO: 65618 - DNA, 18 bp, Artificial Sequence
  Synthetic DNA
aaatcccactatttattg

SEQ ID NO: 65619 - DNA, 18 bp, Artificial Sequence
  Synthetic DNA
aaatccgacacaaaatgg

SEQ ID NO: 65620 - DNA, 18 bp, Artificial Sequence
  Synthetic DNA
aaatccgactcacccttg

SEQ ID NO: 65621 - DNA, 18 bp, Artificial Sequence
  Synthetic DNA
aaatcctaacatctatcg

SEQ ID NO: 65622 - DNA, 18 bp, Artificial Sequence
  Synthetic DNA
aaatcgtattgatcatag

SEQ ID NO: 65623 - DNA, 18 bp, Artificial Sequence
  Synthetic DNA
aaatgcgactcacaactg

SEQ ID NO: 65624 - DNA, 18 bp, Artificial Sequence
  Synthetic DNA
aaatgcgatttactttag

SEQ ID NO: 65625 - DNA, 18 bp, Artificial Sequence
  Synthetic DNA
aaatgtgattatcaatag

SEQ ID NO: 65626 - DNA, 18 bp, Artificial Sequence
  Synthetic DNA
aaatgtgtgtcgcagtag

SEQ ID NO: 65627 - DNA, 18 bp, Artificial Sequence
  Synthetic DNA
aaattagacatactttag

SEQ ID NO: 65628 - DNA, 18 bp, Artificial Sequence
  Synthetic DNA
aaattcaagtctctaaag

SEQ ID NO: 65629 - DNA, 18 bp, Artificial Sequence
  Synthetic DNA
aaattccaatcacaatag

SEQ ID NO: 65630 - DNA, 18 bp, Artificial Sequence
  Synthetic DNA
aaattccagacactaaag

SEQ ID NO: 65631 - DNA, 18 bp, Artificial Sequence
  Synthetic DNA
aaattcctctcactattg

SEQ ID NO: 65632 - DNA, 18 bp, Artificial Sequence
  Synthetic DNA
aaattcgaatcacaagag

SEQ ID NO: 65633 - DNA, 18 bp, Artificial Sequence
  Synthetic DNA
aaattcgacaaacacttg

SEQ ID NO: 65634 - DNA, 18 bp, Artificial Sequence
  Synthetic DNA
aaattcgacattctatag

SEQ ID NO: 65635 - DNA, 18 bp, Artificial Sequence
  Synthetic DNA
aaattcgactacctacag

SEQ ID NO: 65636 - DNA, 18 bp, Artificial Sequence
  Synthetic DNA
aaattcgagactttacag

SEQ ID NO: 65637 - DNA, 18 bp, Artificial Sequence
  Synthetic DNA
aaattcgtcccaatatgg

SEQ ID NO: 65638 - DNA, 18 bp, Artificial Sequence
  Synthetic DNA
aaattcgtcccactattg

SEQ ID NO: 65639 - DNA, 18 bp, Artificial Sequence
  Synthetic DNA
aaattcgtctctctttag

SEQ ID NO: 65640 - DNA, 18 bp, Artificial Sequence
  Synthetic DNA
aaattctactcactttcg

SEQ ID NO: 65641 - DNA, 18 bp, Artificial Sequence
  Synthetic DNA
aaattctgctagctatag

SEQ ID NO: 65642 - DNA, 18 bp, Artificial Sequence
  Synthetic DNA
aaatttgactcgctaatg

SEQ ID NO: 65643 - DNA, 18 bp, Artificial Sequence
  Synthetic DNA
aaatttgacttacaatag

SEQ ID NO: 65644 - DNA, 18 bp, Artificial Sequence
  Synthetic DNA
aaatttgtttaacattag

SEQ ID NO: 65645 - DNA, 18 bp, Artificial Sequence
  Synthetic DNA
aacaacgacacactaaag

SEQ ID NO: 65646 - DNA, 18 bp, Artificial Sequence
  Synthetic DNA
aacaactacattctatag

SEQ ID NO: 65647 - DNA, 18 bp, Artificial Sequence
  Synthetic DNA
aacaatgacactctatag

SEQ ID NO: 65648 - DNA, 18 bp, Artificial Sequence
  Synthetic DNA
aacatcgtctcactatag

SEQ ID NO: 65649 - DNA, 18 bp, Artificial Sequence
  Synthetic DNA
aacattgactcactatag

SEQ ID NO: 65650 - DNA, 18 bp, Artificial Sequence
  Synthetic DNA
aacgaatgctaagtatag

SEQ ID NO: 65651 - DNA, 18 bp, Artificial Sequence
  Synthetic DNA
aacgactacaaagtatgg

SEQ ID NO: 65652 - DNA, 18 bp, Artificial Sequence
  Synthetic DNA
aactaaaactcacaatag

SEQ ID NO: 65653 - DNA, 18 bp, Artificial Sequence
  Synthetic DNA
aactacagcccactttcg

SEQ ID NO: 65654 - DNA, 18 bp, Artificial Sequence
  Synthetic DNA
aactacgaaagactatag

SEQ ID NO: 65655 - DNA, 18 bp, Artificial Sequence
  Synthetic DNA
aactacgtctctctttag

SEQ ID NO: 65656 - DNA, 18 bp, Artificial Sequence
  Synthetic DNA
aactgcaattcattagag

SEQ ID NO: 65657 - DNA, 18 bp, Artificial Sequence
  Synthetic DNA
aactgtgtctcactattg

SEQ ID NO: 65658 - DNA, 18 bp, Artificial Sequence
  Synthetic DNA
aacttcgaatctctatag

SEQ ID NO: 65659 - DNA, 18 bp, Artificial Sequence
  Synthetic DNA
aagaaagtttccttaaag

SEQ ID NO: 65660 - DNA, 18 bp, Artificial Sequence
  Synthetic DNA
aagaacgaccgactacag

SEQ ID NO: 65661 - DNA, 18 bp, Artificial Sequence
  Synthetic DNA
aagaacgattcaccttag

SEQ ID NO: 65662 - DNA, 18 bp, Artificial Sequence
  Synthetic DNA
aagatcgaaacactaaag

SEQ ID NO: 65663 - DNA, 18 bp, Artificial Sequence
  Synthetic DNA
aagatcgacacacaaagg

SEQ ID NO: 65664 - DNA, 18 bp, Artificial Sequence
  Synthetic DNA
aagatcgattcactatcg

SEQ ID NO: 65665 - DNA, 18 bp, Artificial Sequence
  Synthetic DNA
aagcaccaatcacttttg

SEQ ID NO: 65666 - DNA, 18 bp, Artificial Sequence
  Synthetic DNA
aagtaagattcacacgtg

SEQ ID NO: 65667 - DNA, 18 bp, Artificial Sequence
  Synthetic DNA
aagtaattaatactttag

SEQ ID NO: 65668 - DNA, 18 bp, Artificial Sequence
  Synthetic DNA
aagtacgactcacgtaag

SEQ ID NO: 65669 - DNA, 18 bp, Artificial Sequence
  Synthetic DNA
aagtacgactctcaattg

SEQ ID NO: 65670 - DNA, 18 bp, Artificial Sequence
  Synthetic DNA
aagtacgattcacataag

SEQ ID NO: 65671 - DNA, 18 bp, Artificial Sequence
  Synthetic DNA
aagtacgtctcgttctag

SEQ ID NO: 65672 - DNA, 18 bp, Artificial Sequence
  Synthetic DNA
aagtaggacttggtatag

SEQ ID NO: 65673 - DNA, 18 bp, Artificial Sequence
  Synthetic DNA
aagtgcaacccactatag

SEQ ID NO: 65674 - DNA, 18 bp, Artificial Sequence
  Synthetic DNA
aagttcgaaaatgtatag

SEQ ID NO: 65675 - DNA, 18 bp, Artificial Sequence
  Synthetic DNA
aagttcgactcctgatag

SEQ ID NO: 65676 - DNA, 18 bp, Artificial Sequence
  Synthetic DNA
aataaagactcactacag

SEQ ID NO: 65677 - DNA, 18 bp, Artificial Sequence
  Synthetic DNA
aataacggttcacaatcg

SEQ ID NO: 65678 - DNA, 18 bp, Artificial Sequence
  Synthetic DNA
aataatggctccctttag

SEQ ID NO: 65679 - DNA, 18 bp, Artificial Sequence
  Synthetic DNA
aatatcaagtcactatgg

SEQ ID NO: 65680 - DNA, 18 bp, Artificial Sequence
  Synthetic DNA
aatatcgtctcactctag

SEQ ID NO: 65681 - DNA, 18 bp, Artificial Sequence
  Synthetic DNA
aatcacgactctcttcag

SEQ ID NO: 65682 - DNA, 18 bp, Artificial Sequence
  Synthetic DNA
aattaaaactaactctag

SEQ ID NO: 65683 - DNA, 18 bp, Artificial Sequence
  Synthetic DNA
aattacatccctcaacag

SEQ ID NO: 65684 - DNA, 18 bp, Artificial Sequence
  Synthetic DNA
aattacatctcactaatg

SEQ ID NO: 65685 - DNA, 18 bp, Artificial Sequence
  Synthetic DNA
aattaccgctcacttcag

SEQ ID NO: 65686 - DNA, 18 bp, Artificial Sequence
  Synthetic DNA
aattacgaatcagtaaag

SEQ ID NO: 65687 - DNA, 18 bp, Artificial Sequence
  Synthetic DNA
aattacgacacacataag

SEQ ID NO: 65688 - DNA, 18 bp, Artificial Sequence
  Synthetic DNA
aattacgactaactcttg

SEQ ID NO: 65689 - DNA, 18 bp, Artificial Sequence
  Synthetic DNA
aattacgagtgtttattg

SEQ ID NO: 65690 - DNA, 18 bp, Artificial Sequence
  Synthetic DNA
aattacgatccacaaaag

SEQ ID NO: 65691 - DNA, 18 bp, Artificial Sequence
  Synthetic DNA
aattacgattcattatcg

SEQ ID NO: 65692 - DNA, 18 bp, Artificial Sequence
  Synthetic DNA
aattacgcctgactattg

SEQ ID NO: 65693 - DNA, 18 bp, Artificial Sequence
  Synthetic DNA
aattacgtctaactatcg

SEQ ID NO: 65694 - DNA, 18 bp, Artificial Sequence
  Synthetic DNA
aattactagacactttag

SEQ ID NO: 65695 - DNA, 18 bp, Artificial Sequence
  Synthetic DNA
aattactcctgtctatag

SEQ ID NO: 65696 - DNA, 18 bp, Artificial Sequence
  Synthetic DNA
aattactgcacactatag

SEQ ID NO: 65697 - DNA, 18 bp, Artificial Sequence
  Synthetic DNA
aattataacacactatag

SEQ ID NO: 65698 - DNA, 18 bp, Artificial Sequence
  Synthetic DNA
aattataattcactttag

SEQ ID NO: 65699 - DNA, 18 bp, Artificial Sequence
  Synthetic DNA
aattatcactaacaatag

SEQ ID NO: 65700 - DNA, 18 bp, Artificial Sequence
  Synthetic DNA
aattatgtctaactctag

SEQ ID NO: 65701 - DNA, 18 bp, Artificial Sequence
  Synthetic DNA
aattccgacacactctag

SEQ ID NO: 65702 - DNA, 18 bp, Artificial Sequence
  Synthetic DNA
aattccgactcacaaaag

SEQ ID NO: 65703 - DNA, 18 bp, Artificial Sequence
  Synthetic DNA
aatttagtctctctaaag

SEQ ID NO: 65704 - DNA, 18 bp, Artificial Sequence
  Synthetic DNA
aatttcgacgcacgatag

SEQ ID NO: 65705 - DNA, 18 bp, Artificial Sequence
  Synthetic DNA
aatttcgacgctctatag

SEQ ID NO: 65706 - DNA, 18 bp, Artificial Sequence
  Synthetic DNA
aatttcgagacactatag

SEQ ID NO: 65707 - DNA, 18 bp, Artificial Sequence
  Synthetic DNA
aatttcgtctcaccaatg

SEQ ID NO: 65708 - DNA, 18 bp, Artificial Sequence
  Synthetic DNA
aatttcttcacactttag

SEQ ID NO: 65709 - DNA, 18 bp, Artificial Sequence
  Synthetic DNA
acaataaactcactacag

SEQ ID NO: 65710 - DNA, 18 bp, Artificial Sequence
  Synthetic DNA
acaatggacaccctttag

SEQ ID NO: 65711 - DNA, 18 bp, Artificial Sequence
  Synthetic DNA
acacactactcaccattg

SEQ ID NO: 65712 - DNA, 18 bp, Artificial Sequence
  Synthetic DNA
acacactactctctatag

SEQ ID NO: 65713 - DNA, 18 bp, Artificial Sequence
  Synthetic DNA
acagacgtcactatatag

SEQ ID NO: 65714 - DNA, 18 bp, Artificial Sequence
  Synthetic DNA
acagatgacacgctatag

SEQ ID NO: 65715 - DNA, 18 bp, Artificial Sequence
  Synthetic DNA
acataagactaactaaag

SEQ ID NO: 65716 - DNA, 18 bp, Artificial Sequence
  Synthetic DNA
acataagacttcttatag

SEQ ID NO: 65717 - DNA, 18 bp, Artificial Sequence
  Synthetic DNA
acataagcctcagtattg

SEQ ID NO: 65718 - DNA, 18 bp, Artificial Sequence
  Synthetic DNA
acatacgacacactcctg

SEQ ID NO: 65719 - DNA, 18 bp, Artificial Sequence
  Synthetic DNA
acatacgacacactcgag

SEQ ID NO: 65720 - DNA, 18 bp, Artificial Sequence
  Synthetic DNA
acatacggctttctttag

SEQ ID NO: 65721 - DNA, 18 bp, Artificial Sequence
  Synthetic DNA
acatagtatgcattggag

SEQ ID NO: 65722 - DNA, 18 bp, Artificial Sequence
  Synthetic DNA
acatatggctcagtatgg

SEQ ID NO: 65723 - DNA, 18 bp, Artificial Sequence
  Synthetic DNA
acatatgtcccacaatag

SEQ ID NO: 65724 - DNA, 18 bp, Artificial Sequence
  Synthetic DNA
acatgcaacttactatag

SEQ ID NO: 65725 - DNA, 18 bp, Artificial Sequence
  Synthetic DNA
acattataatgactaaag

SEQ ID NO: 65726 - DNA, 18 bp, Artificial Sequence
  Synthetic DNA
acattcgacacattaaag

SEQ ID NO: 65727 - DNA, 18 bp, Artificial Sequence
  Synthetic DNA
accgacgaatcgatatag

SEQ ID NO: 65728 - DNA, 18 bp, Artificial Sequence
  Synthetic DNA
acctacgaatcccaaaag

SEQ ID NO: 65729 - DNA, 18 bp, Artificial Sequence
  Synthetic DNA
actatggactatcttaag

SEQ ID NO: 65730 - DNA, 18 bp, Artificial Sequence
  Synthetic DNA
actcactactctctaaag

SEQ ID NO: 65731 - DNA, 18 bp, Artificial Sequence
  Synthetic DNA
actcactagtgactttag

SEQ ID NO: 65732 - DNA, 18 bp, Artificial Sequence
  Synthetic DNA
agaatcgactcactctcg

SEQ ID NO: 65733 - DNA, 18 bp, Artificial Sequence
  Synthetic DNA
agacaccagccattatag

SEQ ID NO: 65734 - DNA, 18 bp, Artificial Sequence
  Synthetic DNA
agacacgaaacgcttcag

SEQ ID NO: 65735 - DNA, 18 bp, Artificial Sequence
  Synthetic DNA
agagacgactctctaaag

SEQ ID NO: 65736 - DNA, 18 bp, Artificial Sequence
  Synthetic DNA
agataagagagtctatag

SEQ ID NO: 65737 - DNA, 18 bp, Artificial Sequence
  Synthetic DNA
agataagtctcacaatgg

SEQ ID NO: 65738 - DNA, 18 bp, Artificial Sequence
  Synthetic DNA
agatacaactcacttttg

SEQ ID NO: 65739 - DNA, 18 bp, Artificial Sequence
  Synthetic DNA
agatacgaatcgctctag

SEQ ID NO: 65740 - DNA, 18 bp, Artificial Sequence
  Synthetic DNA
agatacgacccacttatg

SEQ ID NO: 65741 - DNA, 18 bp, Artificial Sequence
  Synthetic DNA
agatacgactcttcctag

SEQ ID NO: 65742 - DNA, 18 bp, Artificial Sequence
  Synthetic DNA
agatatgtcatactatag

SEQ ID NO: 65743 - DNA, 18 bp, Artificial Sequence
  Synthetic DNA
agattcgactcataattg

SEQ ID NO: 65744 - DNA, 18 bp, Artificial Sequence
  Synthetic DNA
agattcggttcactatag

SEQ ID NO: 65745 - DNA, 18 bp, Artificial Sequence
  Synthetic DNA
agattgcactttctatag

SEQ ID NO: 65746 - DNA, 18 bp, Artificial Sequence
  Synthetic DNA
agcgatgtctaacttgag

SEQ ID NO: 65747 - DNA, 18 bp, Artificial Sequence
  Synthetic DNA
agctactacactctatag

SEQ ID NO: 65748 - DNA, 18 bp, Artificial Sequence
  Synthetic DNA
agggacgtcttaatagcg

SEQ ID NO: 65749 - DNA, 18 bp, Artificial Sequence
  Synthetic DNA
aggtccgacactctatag

SEQ ID NO: 65750 - DNA, 18 bp, Artificial Sequence
  Synthetic DNA
ataaacgactgaccatag

SEQ ID NO: 65751 - DNA, 18 bp, Artificial Sequence
  Synthetic DNA
ataaactactcagtttag

SEQ ID NO: 65752 - DNA, 18 bp, Artificial Sequence
  Synthetic DNA
ataaacttctgcgcttag

SEQ ID NO: 65753 - DNA, 18 bp, Artificial Sequence
  Synthetic DNA
atacacgacatagaatag

SEQ ID NO: 65754 - DNA, 18 bp, Artificial Sequence
  Synthetic DNA
atactcgacttaccatag

SEQ ID NO: 65755 - DNA, 18 bp, Artificial Sequence
  Synthetic DNA
atagatgactcactacag

SEQ ID NO: 65756 - DNA, 18 bp, Artificial Sequence
  Synthetic DNA
atataagacacactacag

SEQ ID NO: 65757 - DNA, 18 bp, Artificial Sequence
  Synthetic DNA
atataccaagcacaatgg

SEQ ID NO: 65758 - DNA, 18 bp, Artificial Sequence
  Synthetic DNA
atataccagtcaatttag

SEQ ID NO: 65759 - DNA, 18 bp, Artificial Sequence
  Synthetic DNA
atataccttttacattag

SEQ ID NO: 65760 - DNA, 18 bp, Artificial Sequence
  Synthetic DNA
atatacgacatcctttag

SEQ ID NO: 65761 - DNA, 18 bp, Artificial Sequence
  Synthetic DNA
atatacgacccgcttcag

SEQ ID NO: 65762 - DNA, 18 bp, Artificial Sequence
  Synthetic DNA
atatacgactctgcatag

SEQ ID NO: 65763 - DNA, 18 bp, Artificial Sequence
  Synthetic DNA
atatacgtcactctatag

SEQ ID NO: 65764 - DNA, 18 bp, Artificial Sequence
  Synthetic DNA
atatacgtcatacgatag

SEQ ID NO: 65765 - DNA, 18 bp, Artificial Sequence
  Synthetic DNA
atatataaatccctattg

SEQ ID NO: 65766 - DNA, 18 bp, Artificial Sequence
  Synthetic DNA
atatatgactcattaaag

SEQ ID NO: 65767 - DNA, 18 bp, Artificial Sequence
  Synthetic DNA
atatatgagtcgctgttg

SEQ ID NO: 65768 - DNA, 18 bp, Artificial Sequence
  Synthetic DNA
atatatggctcttgaaag

SEQ ID NO: 65769 - DNA, 18 bp, Artificial Sequence
  Synthetic DNA
atatccgacttactgtag

SEQ ID NO: 65770 - DNA, 18 bp, Artificial Sequence
  Synthetic DNA
atatgagactctctatag

SEQ ID NO: 65771 - DNA, 18 bp, Artificial Sequence
  Synthetic DNA
atatgcgacacgcagtag

SEQ ID NO: 65772 - DNA, 18 bp, Artificial Sequence
  Synthetic DNA
atatgcgacagtaagtgg

SEQ ID NO: 65773 - DNA, 18 bp, Artificial Sequence
  Synthetic DNA
atatgcgattccctatag

SEQ ID NO: 65774 - DNA, 18 bp, Artificial Sequence
  Synthetic DNA
atatgcgtctcacaatag

SEQ ID NO: 65775 - DNA, 18 bp, Artificial Sequence
  Synthetic DNA
atattagactcgctattg

SEQ ID NO: 65776 - DNA, 18 bp, Artificial Sequence
  Synthetic DNA
atattagactctctatag

SEQ ID NO: 65777 - DNA, 18 bp, Artificial Sequence
  Synthetic DNA
atattcgaatctgtccag

SEQ ID NO: 65778 - DNA, 18 bp, Artificial Sequence
  Synthetic DNA
atattcgactctcttttg

SEQ ID NO: 65779 - DNA, 18 bp, Artificial Sequence
  Synthetic DNA
atattcgacttagtattg

SEQ ID NO: 65780 - DNA, 18 bp, Artificial Sequence
  Synthetic DNA
atcagcgactcactatag

SEQ ID NO: 65781 - DNA, 18 bp, Artificial Sequence
  Synthetic DNA
atcatccactcacaaaag

SEQ ID NO: 65782 - DNA, 18 bp, Artificial Sequence
  Synthetic DNA
atcctttactcactatag

SEQ ID NO: 65783 - DNA, 18 bp, Artificial Sequence
  Synthetic DNA
atgaacgtctctctttcg

SEQ ID NO: 65784 - DNA, 18 bp, Artificial Sequence
  Synthetic DNA
atgttcgtctcagtatag

SEQ ID NO: 65785 - DNA, 18 bp, Artificial Sequence
  Synthetic DNA
attaacatctcagtatag

SEQ ID NO: 65786 - DNA, 18 bp, Artificial Sequence
  Synthetic DNA
attgacgacgcacctttg

SEQ ID NO: 65787 - DNA, 18 bp, Artificial Sequence
  Synthetic DNA
atttaccactcaatatag

SEQ ID NO: 65788 - DNA, 18 bp, Artificial Sequence
  Synthetic DNA
atttacgacaaaccttag

SEQ ID NO: 65789 - DNA, 18 bp, Artificial Sequence
  Synthetic DNA
atttacgactcataatag

SEQ ID NO: 65790 - DNA, 18 bp, Artificial Sequence
  Synthetic DNA
atttacgcctcactaaag

SEQ ID NO: 65791 - DNA, 18 bp, Artificial Sequence
  Synthetic DNA
atttactactctttatag

SEQ ID NO: 65792 - DNA, 18 bp, Artificial Sequence
  Synthetic DNA
atttatgactcactttag

SEQ ID NO: 65793 - DNA, 18 bp, Artificial Sequence
  Synthetic DNA
caaaacaactccataaag

SEQ ID NO: 65794 - DNA, 18 bp, Artificial Sequence
  Synthetic DNA
caaaacgtcttgctattg

SEQ ID NO: 65795 - DNA, 18 bp, Artificial Sequence
  Synthetic DNA
caaaaggactcttcaaag

SEQ ID NO: 65796 - DNA, 18 bp, Artificial Sequence
  Synthetic DNA
caaaatgactcacgaaag

SEQ ID NO: 65797 - DNA, 18 bp, Artificial Sequence
  Synthetic DNA
caaacccactcactaaag

SEQ ID NO: 65798 - DNA, 18 bp, Artificial Sequence
  Synthetic DNA
caaatcaactcactttag

SEQ ID NO: 65799 - DNA, 18 bp, Artificial Sequence
  Synthetic DNA
caacacgactcatactag

SEQ ID NO: 65800 - DNA, 18 bp, Artificial Sequence
  Synthetic DNA
caacacgtctctttgtag

SEQ ID NO: 65801 - DNA, 18 bp, Artificial Sequence
  Synthetic DNA
caacactactcactgtcg

SEQ ID NO: 65802 - DNA, 18 bp, Artificial Sequence
  Synthetic DNA
caataacaatcaccaacg

SEQ ID NO: 65803 - DNA, 18 bp, Artificial Sequence
  Synthetic DNA
caataacactcctaatag

SEQ ID NO: 65804 - DNA, 18 bp, Artificial Sequence
  Synthetic DNA
caataagtatctctaaag

SEQ ID NO: 65805 - DNA, 18 bp, Artificial Sequence
  Synthetic DNA
caataatacaaactatcg

SEQ ID NO: 65806 - DNA, 18 bp, Artificial Sequence
  Synthetic DNA
caatacaatttattatag

SEQ ID NO: 65807 - DNA, 18 bp, Artificial Sequence
  Synthetic DNA
caatacaccctactgaag

SEQ ID NO: 65808 - DNA, 18 bp, Artificial Sequence
  Synthetic DNA
caatacgaaaaagtacag

SEQ ID NO: 65809 - DNA, 18 bp, Artificial Sequence
  Synthetic DNA
caatacgaatcagtaatg

SEQ ID NO: 65810 - DNA, 18 bp, Artificial Sequence
  Synthetic DNA
caatacgactcatatacg

SEQ ID NO: 65811 - DNA, 18 bp, Artificial Sequence
  Synthetic DNA
caatacgactccgtaatg

SEQ ID NO: 65812 - DNA, 18 bp, Artificial Sequence
  Synthetic DNA
caatacgacttataattg

SEQ ID NO: 65813 - DNA, 18 bp, Artificial Sequence
  Synthetic DNA
caatacgacttatttaag

SEQ ID NO: 65814 - DNA, 18 bp, Artificial Sequence
  Synthetic DNA
caatacgagattctatag

SEQ ID NO: 65815 - DNA, 18 bp, Artificial Sequence
  Synthetic DNA
caatacgatacaccacag

SEQ ID NO: 65816 - DNA, 18 bp, Artificial Sequence
  Synthetic DNA
caatactaatctcaatag

SEQ ID NO: 65817 - DNA, 18 bp, Artificial Sequence
  Synthetic DNA
caatactactcaactcgg

SEQ ID NO: 65818 - DNA, 18 bp, Artificial Sequence
  Synthetic DNA
caatactagtcacattag

SEQ ID NO: 65819 - DNA, 18 bp, Artificial Sequence
  Synthetic DNA
caatacttttccctattg

SEQ ID NO: 65820 - DNA, 18 bp, Artificial Sequence
  Synthetic DNA
caatgcgcctccttgatg

SEQ ID NO: 65821 - DNA, 18 bp, Artificial Sequence
  Synthetic DNA
caatgcgcttccctatgg

SEQ ID NO: 65822 - DNA, 18 bp, Artificial Sequence
  Synthetic DNA
caattattctcacaatag

SEQ ID NO: 65823 - DNA, 18 bp, Artificial Sequence
  Synthetic DNA
caattcgacacaaattag

SEQ ID NO: 65824 - DNA, 18 bp, Artificial Sequence
  Synthetic DNA
caattcgagcctcaaaag

SEQ ID NO: 65825 - DNA, 18 bp, Artificial Sequence
  Synthetic DNA
caattcgtctcattattg

SEQ ID NO: 65826 - DNA, 18 bp, Artificial Sequence
  Synthetic DNA
caattcgtttcacaacag

SEQ ID NO: 65827 - DNA, 18 bp, Artificial Sequence
  Synthetic DNA
caattggacacgcgaaag

SEQ ID NO: 65828 - DNA, 18 bp, Artificial Sequence
  Synthetic DNA
caatttggcacactatag

SEQ ID NO: 65829 - DNA, 18 bp, Artificial Sequence
  Synthetic DNA
caatttgttaccataaag

SEQ ID NO: 65830 - DNA, 18 bp, Artificial Sequence
  Synthetic DNA
caattttactcactactg

SEQ ID NO: 65831 - DNA, 18 bp, Artificial Sequence
  Synthetic DNA
cacaaccacaaactatag

SEQ ID NO: 65832 - DNA, 18 bp, Artificial Sequence
  Synthetic DNA
cacaacgacttacattag

SEQ ID NO: 65833 - DNA, 18 bp, Artificial Sequence
  Synthetic DNA
cacagcgacaatctacag

SEQ ID NO: 65834 - DNA, 18 bp, Artificial Sequence
  Synthetic DNA
cactaagcctccctattg

SEQ ID NO: 65835 - DNA, 18 bp, Artificial Sequence
  Synthetic DNA
cactacaattcaccttag

SEQ ID NO: 65836 - DNA, 18 bp, Artificial Sequence
  Synthetic DNA
cactacgtctcaacatag

SEQ ID NO: 65837 - DNA, 18 bp, Artificial Sequence
  Synthetic DNA
cactacgtgtaacactag

SEQ ID NO: 65838 - DNA, 18 bp, Artificial Sequence
  Synthetic DNA
cagtacgatttccaattg

SEQ ID NO: 65839 - DNA, 18 bp, Artificial Sequence
  Synthetic DNA
cagtccgactcactacgg

SEQ ID NO: 65840 - DNA, 18 bp, Artificial Sequence
  Synthetic DNA
cagttcgtgtctctatag

SEQ ID NO: 65841 - DNA, 18 bp, Artificial Sequence
  Synthetic DNA
cataaagagtcacttacg

SEQ ID NO: 65842 - DNA, 18 bp, Artificial Sequence
  Synthetic DNA
cataacgactcatttaag

SEQ ID NO: 65843 - DNA, 18 bp, Artificial Sequence
  Synthetic DNA
catcacgactatctatag

SEQ ID NO: 65844 - DNA, 18 bp, Artificial Sequence
  Synthetic DNA
catgccctcttacttttg

SEQ ID NO: 65845 - DNA, 18 bp, Artificial Sequence
  Synthetic DNA
cattaatactcactacag

SEQ ID NO: 65846 - DNA, 18 bp, Artificial Sequence
  Synthetic DNA
cattacatatcactgttg

SEQ ID NO: 65847 - DNA, 18 bp, Artificial Sequence
  Synthetic DNA
cattacgacacaacatag

SEQ ID NO: 65848 - DNA, 18 bp, Artificial Sequence
  Synthetic DNA
cattacgactatctaaag

SEQ ID NO: 65849 - DNA, 18 bp, Artificial Sequence
  Synthetic DNA
cattacgatcctctatag

SEQ ID NO: 65850 - DNA, 18 bp, Artificial Sequence
  Synthetic DNA
cattacgatgcactcaag

SEQ ID NO: 65851 - DNA, 18 bp, Artificial Sequence
  Synthetic DNA
cattacgtcaaaatattg

SEQ ID NO: 65852 - DNA, 18 bp, Artificial Sequence
  Synthetic DNA
cattactactcacaggag

SEQ ID NO: 65853 - DNA, 18 bp, Artificial Sequence
  Synthetic DNA
cattaggagatgctagag

SEQ ID NO: 65854 - DNA, 18 bp, Artificial Sequence
  Synthetic DNA
cattaggtttcaaaatag

SEQ ID NO: 65855 - DNA, 18 bp, Artificial Sequence
  Synthetic DNA
cattatgactcaatctag

SEQ ID NO: 65856 - DNA, 18 bp, Artificial Sequence
  Synthetic DNA
cattccatcacactatag

SEQ ID NO: 65857 - DNA, 18 bp, Artificial Sequence
  Synthetic DNA
cattgcgactctctgtgg

SEQ ID NO: 65858 - DNA, 18 bp, Artificial Sequence
  Synthetic DNA
catttcttcacaccaaag

SEQ ID NO: 65859 - DNA, 18 bp, Artificial Sequence
  Synthetic DNA
ccaaacgtctcaataaag

SEQ ID NO: 65860 - DNA, 18 bp, Artificial Sequence
  Synthetic DNA
ccaaacgtctcgttttgg

SEQ ID NO: 65861 - DNA, 18 bp, Artificial Sequence
  Synthetic DNA
ccatgcgtccccctatag

SEQ ID NO: 65862 - DNA, 18 bp, Artificial Sequence
  Synthetic DNA
cctaaggactccctaatg

SEQ ID NO: 65863 - DNA, 18 bp, Artificial Sequence
  Synthetic DNA
ccttatgactctttaaag

SEQ ID NO: 65864 - DNA, 18 bp, Artificial Sequence
  Synthetic DNA
cgataagactgactttag

SEQ ID NO: 65865 - DNA, 18 bp, Artificial Sequence
  Synthetic DNA
cggtacgacacattatag

SEQ ID NO: 65866 - DNA, 18 bp, Artificial Sequence
  Synthetic DNA
cgtttcaactcgctattg

SEQ ID NO: 65867 - DNA, 18 bp, Artificial Sequence
  Synthetic DNA
ctaaacgacccactagtg

SEQ ID NO: 65868 - DNA, 18 bp, Artificial Sequence
  Synthetic DNA
ctacactactcactctag

SEQ ID NO: 65869 - DNA, 18 bp, Artificial Sequence
  Synthetic DNA
ctataatactctctatag

SEQ ID NO: 65870 - DNA, 18 bp, Artificial Sequence
  Synthetic DNA
ctatacctgtgtccatag

SEQ ID NO: 65871 - DNA, 18 bp, Artificial Sequence
  Synthetic DNA
ctatacgaaaaactcttg

SEQ ID NO: 65872 - DNA, 18 bp, Artificial Sequence
  Synthetic DNA
ctatacgaatctctattg

SEQ ID NO: 65873 - DNA, 18 bp, Artificial Sequence
  Synthetic DNA
ctatacgactaataatag

SEQ ID NO: 65874 - DNA, 18 bp, Artificial Sequence
  Synthetic DNA
ctatacgactcaccttcg

SEQ ID NO: 65875 - DNA, 18 bp, Artificial Sequence
  Synthetic DNA
ctatacgactcctttaag

SEQ ID NO: 65876 - DNA, 18 bp, Artificial Sequence
  Synthetic DNA
ctatacgactctccctag

SEQ ID NO: 65877 - DNA, 18 bp, Artificial Sequence
  Synthetic DNA
ctatacgacttacaattg

SEQ ID NO: 65878 - DNA, 18 bp, Artificial Sequence
  Synthetic DNA
ctatacgtctgacaaaag

SEQ ID NO: 65879 - DNA, 18 bp, Artificial Sequence
  Synthetic DNA
ctatactacacactttag

SEQ ID NO: 65880 - DNA, 18 bp, Artificial Sequence
  Synthetic DNA
ctattcaactcagaatag

SEQ ID NO: 65881 - DNA, 18 bp, Artificial Sequence
  Synthetic DNA
ctccatgattccctttcg

SEQ ID NO: 65882 - DNA, 18 bp, Artificial Sequence
  Synthetic DNA
ctctatgactctacatag

SEQ ID NO: 65883 - DNA, 18 bp, Artificial Sequence
  Synthetic DNA
cttaacgactcattctag

SEQ ID NO: 65884 - DNA, 18 bp, Artificial Sequence
  Synthetic DNA
ctttaaaattcacactag

SEQ ID NO: 65885 - DNA, 18 bp, Artificial Sequence
  Synthetic DNA
ctttaggactacctaaag

SEQ ID NO: 65886 - DNA, 18 bp, Artificial Sequence
  Synthetic DNA
gaaaacgactatccaaag

SEQ ID NO: 65887 - DNA, 18 bp, Artificial Sequence
  Synthetic DNA
gaaagcgtctcacaatag

SEQ ID NO: 65888 - DNA, 18 bp, Artificial Sequence
  Synthetic DNA
gaacacctctcaccgaag

SEQ ID NO: 65889 - DNA, 18 bp, Artificial Sequence
  Synthetic DNA
gaatacaatttactctcg

SEQ ID NO: 65890 - DNA, 18 bp, Artificial Sequence
  Synthetic DNA
gaatacgtcccattaaag

SEQ ID NO: 65891 - DNA, 18 bp, Artificial Sequence
  Synthetic DNA
gaatacgtgtcacctaag

SEQ ID NO: 65892 - DNA, 18 bp, Artificial Sequence
  Synthetic DNA
gaatactaatgtctttag

SEQ ID NO: 65893 - DNA, 18 bp, Artificial Sequence
  Synthetic DNA
gaatacttcaccctatag

SEQ ID NO: 65894 - DNA, 18 bp, Artificial Sequence
  Synthetic DNA
gaattcgacccactgaag

SEQ ID NO: 65895 - DNA, 18 bp, Artificial Sequence
  Synthetic DNA
gaattcgtcacacaatag

SEQ ID NO: 65896 - DNA, 18 bp, Artificial Sequence
  Synthetic DNA
gactaaaactcacttaag

SEQ ID NO: 65897 - DNA, 18 bp, Artificial Sequence
  Synthetic DNA
gactatgaaccactatgg

SEQ ID NO: 65898 - DNA, 18 bp, Artificial Sequence
  Synthetic DNA
gacttcgagtcattttcg

SEQ ID NO: 65899 - DNA, 18 bp, Artificial Sequence
  Synthetic DNA
gatatgtacaaactttag

SEQ ID NO: 65900 - DNA, 18 bp, Artificial Sequence
  Synthetic DNA
gattactactcaatattg

SEQ ID NO: 65901 - DNA, 18 bp, Artificial Sequence
  Synthetic DNA
gattattgcgcgctatag

SEQ ID NO: 65902 - DNA, 18 bp, Artificial Sequence
  Synthetic DNA
gatttggactcaatttag

SEQ ID NO: 65903 - DNA, 18 bp, Artificial Sequence
  Synthetic DNA
gcacacgacatactaaag

SEQ ID NO: 65904 - DNA, 18 bp, Artificial Sequence
  Synthetic DNA
gcatacgactccttttag

SEQ ID NO: 65905 - DNA, 18 bp, Artificial Sequence
  Synthetic DNA
gcatacgactgaccaaag

SEQ ID NO: 65906 - DNA, 18 bp, Artificial Sequence
  Synthetic DNA
gcatacttatctctatag

SEQ ID NO: 65907 - DNA, 18 bp, Artificial Sequence
  Synthetic DNA
gcatatgattctctatag

SEQ ID NO: 65908 - DNA, 18 bp, Artificial Sequence
  Synthetic DNA
gcatccgactcattaatg

SEQ ID NO: 65909 - DNA, 18 bp, Artificial Sequence
  Synthetic DNA
gcattccactcacttttg

SEQ ID NO: 65910 - DNA, 18 bp, Artificial Sequence
  Synthetic DNA
ggattcgcttcactttag

SEQ ID NO: 65911 - DNA, 18 bp, Artificial Sequence
  Synthetic DNA
gtaacggaatagctattg

SEQ ID NO: 65912 - DNA, 18 bp, Artificial Sequence
  Synthetic DNA
gtatacgcctctctttag

SEQ ID NO: 65913 - DNA, 18 bp, Artificial Sequence
  Synthetic DNA
gtatacggctcacaaccg

SEQ ID NO: 65914 - DNA, 18 bp, Artificial Sequence
  Synthetic DNA
gtatatatctcaccatag

SEQ ID NO: 65915 - DNA, 18 bp, Artificial Sequence
  Synthetic DNA
gtatgcgagtcactatgg

SEQ ID NO: 65916 - DNA, 18 bp, Artificial Sequence
  Synthetic DNA
gtgtatgatttactttag

SEQ ID NO: 65917 - DNA, 18 bp, Artificial Sequence
  Synthetic DNA
gtttacgattccctatag

SEQ ID NO: 65918 - DNA, 18 bp, Artificial Sequence
  Synthetic DNA
gtttatgacaggctatag

SEQ ID NO: 65919 - DNA, 18 bp, Artificial Sequence
  Synthetic DNA
taaaaacactcacaaaag

SEQ ID NO: 65920 - DNA, 18 bp, Artificial Sequence
  Synthetic DNA
taaaaagactctaaatag

SEQ ID NO: 65921 - DNA, 18 bp, Artificial Sequence
  Synthetic DNA
taaaaagagaaactagag

SEQ ID NO: 65922 - DNA, 18 bp, Artificial Sequence
  Synthetic DNA
taaaaagattcatttaag

SEQ ID NO: 65923 - DNA, 18 bp, Artificial Sequence
  Synthetic DNA
taaaaagattctcaatag

SEQ ID NO: 65924 - DNA, 18 bp, Artificial Sequence
  Synthetic DNA
taaaaagtcatactttag

SEQ ID NO: 65925 - DNA, 18 bp, Artificial Sequence
  Synthetic DNA
taaaacaactcgcttttg

SEQ ID NO: 65926 - DNA, 18 bp, Artificial Sequence
  Synthetic DNA
taaaacaacttcccatag

SEQ ID NO: 65927 - DNA, 18 bp, Artificial Sequence
  Synthetic DNA
taaaacaacttgctatcg

SEQ ID NO: 65928 - DNA, 18 bp, Artificial Sequence
  Synthetic DNA
taaaacagctctcaattg

SEQ ID NO: 65929 - DNA, 18 bp, Artificial Sequence
  Synthetic DNA
taaaaccattccttattg

SEQ ID NO: 65930 - DNA, 18 bp, Artificial Sequence
  Synthetic DNA
taaaacctatcacattag

SEQ ID NO: 65931 - DNA, 18 bp, Artificial Sequence
  Synthetic DNA
taaaacgacatacttaag

SEQ ID NO: 65932 - DNA, 18 bp, Artificial Sequence
  Synthetic DNA
taaaacgactcgtaaaag

SEQ ID NO: 65933 - DNA, 18 bp, Artificial Sequence
  Synthetic DNA
taaaacgactctacttag

SEQ ID NO: 65934 - DNA, 18 bp, Artificial Sequence
  Synthetic DNA
taaaacgcatcattattg

SEQ ID NO: 65935 - DNA, 18 bp, Artificial Sequence
  Synthetic DNA
taaaacgcatctctctgg

SEQ ID NO: 65936 - DNA, 18 bp, Artificial Sequence
  Synthetic DNA
taaaacgcctcaaggtag

SEQ ID NO: 65937 - DNA, 18 bp, Artificial Sequence
  Synthetic DNA
taaaacggttcacaacag

SEQ ID NO: 65938 - DNA, 18 bp, Artificial Sequence
  Synthetic DNA
taaaacgtaccaccattg

SEQ ID NO: 65939 - DNA, 18 bp, Artificial Sequence
  Synthetic DNA
taaaacgtactactatag

SEQ ID NO: 65940 - DNA, 18 bp, Artificial Sequence
  Synthetic DNA
taaaacgtataactagag

SEQ ID NO: 65941 - DNA, 18 bp, Artificial Sequence
  Synthetic DNA
taaaacgtcccacattag

SEQ ID NO: 65942 - DNA, 18 bp, Artificial Sequence
  Synthetic DNA
taaaacgtccctctaaag

SEQ ID NO: 65943 - DNA, 18 bp, Artificial Sequence
  Synthetic DNA
taaaacgtctctttaaag

SEQ ID NO: 65944 - DNA, 18 bp, Artificial Sequence
  Synthetic DNA
taaaacgtgtcacaattg

SEQ ID NO: 65945 - DNA, 18 bp, Artificial Sequence
  Synthetic DNA
taaaacgtttaacaatag

SEQ ID NO: 65946 - DNA, 18 bp, Artificial Sequence
  Synthetic DNA
taaaactcctaaccctag

SEQ ID NO: 65947 - DNA, 18 bp, Artificial Sequence
  Synthetic DNA
taaaagcaatcagaatag

SEQ ID NO: 65948 - DNA, 18 bp, Artificial Sequence
  Synthetic DNA
taaaaggataaactatcg

SEQ ID NO: 65949 - DNA, 18 bp, Artificial Sequence
  Synthetic DNA
taaaagtacttagtgtag

SEQ ID NO: 65950 - DNA, 18 bp, Artificial Sequence
  Synthetic DNA
taaaataacacactttag

SEQ ID NO: 65951 - DNA, 18 bp, Artificial Sequence
  Synthetic DNA
taaaatcacacaatatag

SEQ ID NO: 65952 - DNA, 18 bp, Artificial Sequence
  Synthetic DNA
taaaatctcacacttgag

SEQ ID NO: 65953 - DNA, 18 bp, Artificial Sequence
  Synthetic DNA
taaaatgcctctcaatag

SEQ ID NO: 65954 - DNA, 18 bp, Artificial Sequence
  Synthetic DNA
taaaatgtcactctatag

SEQ ID NO: 65955 - DNA, 18 bp, Artificial Sequence
  Synthetic DNA
taaaccgacatactatcg

SEQ ID NO: 65956 - DNA, 18 bp, Artificial Sequence
  Synthetic DNA
taaaccgggtgtccatag

SEQ ID NO: 65957 - DNA, 18 bp, Artificial Sequence
  Synthetic DNA
taaaccgtctcacttacg

SEQ ID NO: 65958 - DNA, 18 bp, Artificial Sequence
  Synthetic DNA
taaactggctaaccatcg

SEQ ID NO: 65959 - DNA, 18 bp, Artificial Sequence
  Synthetic DNA
taaagcaactctataatg

SEQ ID NO: 65960 - DNA, 18 bp, Artificial Sequence
  Synthetic DNA
taaagcatcgctctgttg

SEQ ID NO: 65961 - DNA, 18 bp, Artificial Sequence
  Synthetic DNA
taaagtgattcccgatag

SEQ ID NO: 65962 - DNA, 18 bp, Artificial Sequence
  Synthetic DNA
taaataaactcactattg

SEQ ID NO: 65963 - DNA, 18 bp, Artificial Sequence
  Synthetic DNA
taaatagtctcatcatag

SEQ ID NO: 65964 - DNA, 18 bp, Artificial Sequence
  Synthetic DNA
taaatcaaattactatag

SEQ ID NO: 65965 - DNA, 18 bp, Artificial Sequence
  Synthetic DNA
taaatcaacccactctag

SEQ ID NO: 65966 - DNA, 18 bp, Artificial Sequence
  Synthetic DNA
taaatcaactctcaatag

SEQ ID NO: 65967 - DNA, 18 bp, Artificial Sequence
  Synthetic DNA
taaatccattcagcctag

SEQ ID NO: 65968 - DNA, 18 bp, Artificial Sequence
  Synthetic DNA
taaatcgactcatactag

SEQ ID NO: 65969 - DNA, 18 bp, Artificial Sequence
  Synthetic DNA
taaatcgactctcactag

SEQ ID NO: 65970 - DNA, 18 bp, Artificial Sequence
  Synthetic DNA
taaatcgatatactgtag

SEQ ID NO: 65971 - DNA, 18 bp, Artificial Sequence
  Synthetic DNA
taaatcgattctatatag

SEQ ID NO: 65972 - DNA, 18 bp, Artificial Sequence
  Synthetic DNA
taaatcgtctcacaagag

SEQ ID NO: 65973 - DNA, 18 bp, Artificial Sequence
  Synthetic DNA
taaatcgtctttcaacag

SEQ ID NO: 65974 - DNA, 18 bp, Artificial Sequence
  Synthetic DNA
taaatcttcccaatattg

SEQ ID NO: 65975 - DNA, 18 bp, Artificial Sequence
  Synthetic DNA
taaatgaactctttaaag

SEQ ID NO: 65976 - DNA, 18 bp, Artificial Sequence
  Synthetic DNA
taaatggactgacttaag

SEQ ID NO: 65977 - DNA, 18 bp, Artificial Sequence
  Synthetic DNA
taaattcactgaatatag

SEQ ID NO: 65978 - DNA, 18 bp, Artificial Sequence
  Synthetic DNA
taaattgatacactattg

SEQ ID NO: 65979 - DNA, 18 bp, Artificial Sequence
  Synthetic DNA
taacaagacactcaagag

SEQ ID NO: 65980 - DNA, 18 bp, Artificial Sequence
  Synthetic DNA
taacacaacacactgttg

SEQ ID NO: 65981 - DNA, 18 bp, Artificial Sequence
  Synthetic DNA
taacacaactgacaatcg

SEQ ID NO: 65982 - DNA, 18 bp, Artificial Sequence
  Synthetic DNA
taacacactacactgtag

SEQ ID NO: 65983 - DNA, 18 bp, Artificial Sequence
  Synthetic DNA
taacacacttcaagacag

SEQ ID NO: 65984 - DNA, 18 bp, Artificial Sequence
  Synthetic DNA
taacacataacacgatcg

SEQ ID NO: 65985 - DNA, 18 bp, Artificial Sequence
  Synthetic DNA
taacacgaccctgtatcg

SEQ ID NO: 65986 - DNA, 18 bp, Artificial Sequence
  Synthetic DNA
taacacgactctcttgtg

SEQ ID NO: 65987 - DNA, 18 bp, Artificial Sequence
  Synthetic DNA
taacacgataactatttg

SEQ ID NO: 65988 - DNA, 18 bp, Artificial Sequence
  Synthetic DNA
taacacgatcctgtatag

SEQ ID NO: 65989 - DNA, 18 bp, Artificial Sequence
  Synthetic DNA
taacacgatttgttgtag

SEQ ID NO: 65990 - DNA, 18 bp, Artificial Sequence
  Synthetic DNA
taacacggttcacttaag

SEQ ID NO: 65991 - DNA, 18 bp, Artificial Sequence
  Synthetic DNA
taacacgtatctctgtag

SEQ ID NO: 65992 - DNA, 18 bp, Artificial Sequence
  Synthetic DNA
taacacgtttaactaaag

SEQ ID NO: 65993 - DNA, 18 bp, Artificial Sequence
  Synthetic DNA
taacacgtttcaaataag

SEQ ID NO: 65994 - DNA, 18 bp, Artificial Sequence
  Synthetic DNA
taacactaaattctatag

SEQ ID NO: 65995 - DNA, 18 bp, Artificial Sequence
  Synthetic DNA
taacactacacaatttag

SEQ ID NO: 65996 - DNA, 18 bp, Artificial Sequence
  Synthetic DNA
taacactactctgtattg

SEQ ID NO: 65997 - DNA, 18 bp, Artificial Sequence
  Synthetic DNA
taacactcataactatag

SEQ ID NO: 65998 - DNA, 18 bp, Artificial Sequence
  Synthetic DNA
taacacttctcattatcg

SEQ ID NO: 65999 - DNA, 18 bp, Artificial Sequence
  Synthetic DNA
taacatctctcactgtag

SEQ ID NO: 66000 - DNA, 18 bp, Artificial Sequence
  Synthetic DNA
taacatgatttcctatcg

SEQ ID NO: 66001 - DNA, 18 bp, Artificial Sequence
  Synthetic DNA
taacatgcctcacttaag

SEQ ID NO: 66002 - DNA, 18 bp, Artificial Sequence
  Synthetic DNA
taaccaaattcaccacag

SEQ ID NO: 66003 - DNA, 18 bp, Artificial Sequence
  Synthetic DNA
taacccgacttataaatg

SEQ ID NO: 66004 - DNA, 18 bp, Artificial Sequence
  Synthetic DNA
taacccgattccatattg

SEQ ID NO: 66005 - DNA, 18 bp, Artificial Sequence
  Synthetic DNA
taacccttctctttacag

SEQ ID NO: 66006 - DNA, 18 bp, Artificial Sequence
  Synthetic DNA
taacctgaccgtccacag

SEQ ID NO: 66007 - DNA, 18 bp, Artificial Sequence
  Synthetic DNA
taacgatactcacttttg

SEQ ID NO: 66008 - DNA, 18 bp, Artificial Sequence
  Synthetic DNA
taacgatatacactttag

SEQ ID NO: 66009 - DNA, 18 bp, Artificial Sequence
  Synthetic DNA
taacgcgagtctctaaag

SEQ ID NO: 66010 - DNA, 18 bp, Artificial Sequence
  Synthetic DNA
taactagattcactattg

SEQ ID NO: 66011 - DNA, 18 bp, Artificial Sequence
  Synthetic DNA
taactcaacacactgtag

SEQ ID NO: 66012 - DNA, 18 bp, Artificial Sequence
  Synthetic DNA
taactcgacacacattag

SEQ ID NO: 66013 - DNA, 18 bp, Artificial Sequence
  Synthetic DNA
taactcgactgcccatgg

SEQ ID NO: 66014 - DNA, 18 bp, Artificial Sequence
  Synthetic DNA
taactcgacttgaattag

SEQ ID NO: 66015 - DNA, 18 bp, Artificial Sequence
  Synthetic DNA
taactcgattcaacatag

SEQ ID NO: 66016 - DNA, 18 bp, Artificial Sequence
  Synthetic DNA
taacttaactcacaaatg

SEQ ID NO: 66017 - DNA, 18 bp, Artificial Sequence
  Synthetic DNA
taagaagcctccctattg

SEQ ID NO: 66018 - DNA, 18 bp, Artificial Sequence
  Synthetic DNA
taagacaacttacaaacg

SEQ ID NO: 66019 - DNA, 18 bp, Artificial Sequence
  Synthetic DNA
taagacgaccgtcttttg

SEQ ID NO: 66020 - DNA, 18 bp, Artificial Sequence
  Synthetic DNA
taagacgacgctttgtag

SEQ ID NO: 66021 - DNA, 18 bp, Artificial Sequence
  Synthetic DNA
taagacgagtctcaattg

SEQ ID NO: 66022 - DNA, 18 bp, Artificial Sequence
  Synthetic DNA
taagacggcaagctatag

SEQ ID NO: 66023 - DNA, 18 bp, Artificial Sequence
  Synthetic DNA
taagacgtttcaatagag

SEQ ID NO: 66024 - DNA, 18 bp, Artificial Sequence
  Synthetic DNA
taagacttcgcactaaag

SEQ ID NO: 66025 - DNA, 18 bp, Artificial Sequence
  Synthetic DNA
taagagagcttacattag

SEQ ID NO: 66026 - DNA, 18 bp, Artificial Sequence
  Synthetic DNA
taagccgtgtcactataa

SEQ ID NO: 66027 - DNA, 18 bp, Artificial Sequence
  Synthetic DNA
taaggcgtcacactgtag

SEQ ID NO: 66028 - DNA, 18 bp, Artificial Sequence
  Synthetic DNA
taaggtgtttcactatag

SEQ ID NO: 66029 - DNA, 18 bp, Artificial Sequence
  Synthetic DNA
taagtcaactgacgaaag

SEQ ID NO: 66030 - DNA, 18 bp, Artificial Sequence
  Synthetic DNA
taagtcgcctcacttttg

SEQ ID NO: 66031 - DNA, 18 bp, Artificial Sequence
  Synthetic DNA
taataaaaaagtctatag

SEQ ID NO: 66032 - DNA, 18 bp, Artificial Sequence
  Synthetic DNA
taataaaaccgactttag

SEQ ID NO: 66033 - DNA, 18 bp, Artificial Sequence
  Synthetic DNA
taataaaactccccatcg

SEQ ID NO: 66034 - DNA, 18 bp, Artificial Sequence
  Synthetic DNA
taataaattacactatag

SEQ ID NO: 66035 - DNA, 18 bp, Artificial Sequence
  Synthetic DNA
taataacaatcactactg

SEQ ID NO: 66036 - DNA, 18 bp, Artificial Sequence
  Synthetic DNA
taataagacacgcaagag

SEQ ID NO: 66037 - DNA, 18 bp, Artificial Sequence
  Synthetic DNA
taataagacggagaatag

SEQ ID NO: 66038 - DNA, 18 bp, Artificial Sequence
  Synthetic DNA
taataagactctgtccag

SEQ ID NO: 66039 - DNA, 18 bp, Artificial Sequence
  Synthetic DNA
taataagactgtgtatcg

SEQ ID NO: 66040 - DNA, 18 bp, Artificial Sequence
  Synthetic DNA
taataagagacacaacag

SEQ ID NO: 66041 - DNA, 18 bp, Artificial Sequence
  Synthetic DNA
taataagagtcacaaccg

SEQ ID NO: 66042 - DNA, 18 bp, Artificial Sequence
  Synthetic DNA
taataagcctcgtattag

SEQ ID NO: 66043 - DNA, 18 bp, Artificial Sequence
  Synthetic DNA
taataaggcttacttctg

SEQ ID NO: 66044 - DNA, 18 bp, Artificial Sequence
  Synthetic DNA
taataagtcacacattag

SEQ ID NO: 66045 - DNA, 18 bp, Artificial Sequence
  Synthetic DNA
taataagtcacatcttag

SEQ ID NO: 66046 - DNA, 18 bp, Artificial Sequence
  Synthetic DNA
taataagttatttttttg

SEQ ID NO: 66047 - DNA, 18 bp, Artificial Sequence
  Synthetic DNA
taataagtttcacattag

SEQ ID NO: 66048 - DNA, 18 bp, Artificial Sequence
  Synthetic DNA
taataagtttcacttttg

SEQ ID NO: 66049 - DNA, 18 bp, Artificial Sequence
  Synthetic DNA
taataattctcaatattg

SEQ ID NO: 66050 - DNA, 18 bp, Artificial Sequence
  Synthetic DNA
taatacaaaacacgagcg

SEQ ID NO: 66051 - DNA, 18 bp, Artificial Sequence
  Synthetic DNA
taatacaacttccttgag

SEQ ID NO: 66052 - DNA, 18 bp, Artificial Sequence
  Synthetic DNA
taatacaagaccccatcg

SEQ ID NO: 66053 - DNA, 18 bp, Artificial Sequence
  Synthetic DNA
taatacacaccgcattag

SEQ ID NO: 66054 - DNA, 18 bp, Artificial Sequence
  Synthetic DNA
taatacactccacttgcg

SEQ ID NO: 66055 - DNA, 18 bp, Artificial Sequence
  Synthetic DNA
taatacatctaaatacag

SEQ ID NO: 66056 - DNA, 18 bp, Artificial Sequence
  Synthetic DNA
taatacatctctcgatgg

SEQ ID NO: 66057 - DNA, 18 bp, Artificial Sequence
  Synthetic DNA
taatacatgtaactaaag

SEQ ID NO: 66058 - DNA, 18 bp, Artificial Sequence
  Synthetic DNA
taataccaactacaatag

SEQ ID NO: 66059 - DNA, 18 bp, Artificial Sequence
  Synthetic DNA
taataccactcaacaatg

SEQ ID NO: 66060 - DNA, 18 bp, Artificial Sequence
  Synthetic DNA
taataccactctataatg

SEQ ID NO: 66061 - DNA, 18 bp, Artificial Sequence
  Synthetic DNA
taataccagtctacttag

SEQ ID NO: 66062 - DNA, 18 bp, Artificial Sequence
  Synthetic DNA
taataccagtttttatcg

SEQ ID NO: 66063 - DNA, 18 bp, Artificial Sequence
  Synthetic DNA
taataccatacacaaaag

SEQ ID NO: 66064 - DNA, 18 bp, Artificial Sequence
  Synthetic DNA
taataccatacattaaag

SEQ ID NO: 66065 - DNA, 18 bp, Artificial Sequence
  Synthetic DNA
taataccattttcaatag

SEQ ID NO: 66066 - DNA, 18 bp, Artificial Sequence
  Synthetic DNA
taatacccctcataagcg

SEQ ID NO: 66067 - DNA, 18 bp, Artificial Sequence
  Synthetic DNA
taataccctgcactcttg

SEQ ID NO: 66068 - DNA, 18 bp, Artificial Sequence
  Synthetic DNA
taatacctctcaatagcg

SEQ ID NO: 66069 - DNA, 18 bp, Artificial Sequence
  Synthetic DNA
taatacctctcacataag

SEQ ID NO: 66070 - DNA, 18 bp, Artificial Sequence
  Synthetic DNA
taatacctttaatcatag

SEQ ID NO: 66071 - DNA, 18 bp, Artificial Sequence
  Synthetic DNA
taatacgacactaaattg

SEQ ID NO: 66072 - DNA, 18 bp, Artificial Sequence
  Synthetic DNA
taatacgacactcatcag

SEQ ID NO: 66073 - DNA, 18 bp, Artificial Sequence
  Synthetic DNA
taatacgactccattagg

SEQ ID NO: 66074 - DNA, 18 bp, Artificial Sequence
  Synthetic DNA
taatacgactccattatg

SEQ ID NO: 66075 - DNA, 18 bp, Artificial Sequence
  Synthetic DNA
taatacgactccgatttg

SEQ ID NO: 66076 - DNA, 18 bp, Artificial Sequence
  Synthetic DNA
taatacgactcttttatg

SEQ ID NO: 66077 - DNA, 18 bp, Artificial Sequence
  Synthetic DNA
taatacgagtgatttttg

SEQ ID NO: 66078 - DNA, 18 bp, Artificial Sequence
  Synthetic DNA
taatacgcatgacaatgg

SEQ ID NO: 66079 - DNA, 18 bp, Artificial Sequence
  Synthetic DNA
taatacgcatttcaatag

SEQ ID NO: 66080 - DNA, 18 bp, Artificial Sequence
  Synthetic DNA
taatacgcccctccattg

SEQ ID NO: 66081 - DNA, 18 bp, Artificial Sequence
  Synthetic DNA
taatacgcgaaacaagag

SEQ ID NO: 66082 - DNA, 18 bp, Artificial Sequence
  Synthetic DNA
taatacgcttcttaatag

SEQ ID NO: 66083 - DNA, 18 bp, Artificial Sequence
  Synthetic DNA
taatacggctagccatcg

SEQ ID NO: 66084 - DNA, 18 bp, Artificial Sequence
  Synthetic DNA
taatacgtactactccag

SEQ ID NO: 66085 - DNA, 18 bp, Artificial Sequence
  Synthetic DNA
taatacgtatctccaaag

SEQ ID NO: 66086 - DNA, 18 bp, Artificial Sequence
  Synthetic DNA
taatacgtatgaccattg

SEQ ID NO: 66087 - DNA, 18 bp, Artificial Sequence
  Synthetic DNA
taatacgtcaatctaaag

SEQ ID NO: 66088 - DNA, 18 bp, Artificial Sequence
  Synthetic DNA
taatacgtcactctaatg

SEQ ID NO: 66089 - DNA, 18 bp, Artificial Sequence
  Synthetic DNA
taatacgtccgatttggg

SEQ ID NO: 66090 - DNA, 18 bp, Artificial Sequence
  Synthetic DNA
taatacgtccgtttttag

SEQ ID NO: 66091 - DNA, 18 bp, Artificial Sequence
  Synthetic DNA
taatacgtcgcggaatag

SEQ ID NO: 66092 - DNA, 18 bp, Artificial Sequence
  Synthetic DNA
taatacgtctaacttatg

SEQ ID NO: 66093 - DNA, 18 bp, Artificial Sequence
  Synthetic DNA
taatacgtctcatttatg

SEQ ID NO: 66094 - DNA, 18 bp, Artificial Sequence
  Synthetic DNA
taatacgtctttcaaatg

SEQ ID NO: 66095 - DNA, 18 bp, Artificial Sequence
  Synthetic DNA
taatacgtgcaattctag

SEQ ID NO: 66096 - DNA, 18 bp, Artificial Sequence
  Synthetic DNA
taatacgtttcactcatg

SEQ ID NO: 66097 - DNA, 18 bp, Artificial Sequence
  Synthetic DNA
taatactaatcgcaattg

SEQ ID NO: 66098 - DNA, 18 bp, Artificial Sequence
  Synthetic DNA
taatactacgtaatacag

SEQ ID NO: 66099 - DNA, 18 bp, Artificial Sequence
  Synthetic DNA
taatactacttatatacg

SEQ ID NO: 66100 - DNA, 18 bp, Artificial Sequence
  Synthetic DNA
taatactagtcaccactg

SEQ ID NO: 66101 - DNA, 18 bp, Artificial Sequence
  Synthetic DNA
taatactattctatattg

SEQ ID NO: 66102 - DNA, 18 bp, Artificial Sequence
  Synthetic DNA
taatactcctcatcatgg

SEQ ID NO: 66103 - DNA, 18 bp, Artificial Sequence
  Synthetic DNA
taatactcctctacaaag

SEQ ID NO: 66104 - DNA, 18 bp, Artificial Sequence
  Synthetic DNA
taatactccttcctaaag

SEQ ID NO: 66105 - DNA, 18 bp, Artificial Sequence
  Synthetic DNA
taatactcgtctatattg

SEQ ID NO: 66106 - DNA, 18 bp, Artificial Sequence
  Synthetic DNA
taatactcttcgctgtag

SEQ ID NO: 66107 - DNA, 18 bp, Artificial Sequence
  Synthetic DNA
taatactgctcatcatcg

SEQ ID NO: 66108 - DNA, 18 bp, Artificial Sequence
  Synthetic DNA
taatactgcttcctgtag

SEQ ID NO: 66109 - DNA, 18 bp, Artificial Sequence
  Synthetic DNA
taatactggtcagtctag

SEQ ID NO: 66110 - DNA, 18 bp, Artificial Sequence
  Synthetic DNA
taatacttcctactctag

SEQ ID NO: 66111 - DNA, 18 bp, Artificial Sequence
  Synthetic DNA
taatacttctccttattg

SEQ ID NO: 66112 - DNA, 18 bp, Artificial Sequence
  Synthetic DNA
taatacttgacatataag

SEQ ID NO: 66113 - DNA, 18 bp, Artificial Sequence
  Synthetic DNA
taatacttgacattatag

SEQ ID NO: 66114 - DNA, 18 bp, Artificial Sequence
  Synthetic DNA
taatacttggcaatctag

SEQ ID NO: 66115 - DNA, 18 bp, Artificial Sequence
  Synthetic DNA
taatagaactcaatcaag

SEQ ID NO: 66116 - DNA, 18 bp, Artificial Sequence
  Synthetic DNA
taatagagctcacaacag

SEQ ID NO: 66117 - DNA, 18 bp, Artificial Sequence
  Synthetic DNA
taatagcacccactaatg

SEQ ID NO: 66118 - DNA, 18 bp, Artificial Sequence
  Synthetic DNA
taataggaatcaattttg

SEQ ID NO: 66119 - DNA, 18 bp, Artificial Sequence
  Synthetic DNA
taataggacacacagtcg

SEQ ID NO: 66120 - DNA, 18 bp, Artificial Sequence
  Synthetic DNA
taataggacttttgaatg

SEQ ID NO: 66121 - DNA, 18 bp, Artificial Sequence
  Synthetic DNA
taataggtcttacactag

SEQ ID NO: 66122 - DNA, 18 bp, Artificial Sequence
  Synthetic DNA
taatataacacaatgtag

SEQ ID NO: 66123 - DNA, 18 bp, Artificial Sequence
  Synthetic DNA
taatataacacactagcg

SEQ ID NO: 66124 - DNA, 18 bp, Artificial Sequence
  Synthetic DNA
taatataccactttttag

SEQ ID NO: 66125 - DNA, 18 bp, Artificial Sequence
  Synthetic DNA
taatatatttcaccatgg

SEQ ID NO: 66126 - DNA, 18 bp, Artificial Sequence
  Synthetic DNA
taatatatttcattatag

SEQ ID NO: 66127 - DNA, 18 bp, Artificial Sequence
  Synthetic DNA
taatatcaatcactgtgg

SEQ ID NO: 66128 - DNA, 18 bp, Artificial Sequence
  Synthetic DNA
taatatctcacaatatag

SEQ ID NO: 66129 - DNA, 18 bp, Artificial Sequence
  Synthetic DNA
taatatctctctcaatag

SEQ ID NO: 66130 - DNA, 18 bp, Artificial Sequence
  Synthetic DNA
taatatgacaaccataag

SEQ ID NO: 66131 - DNA, 18 bp, Artificial Sequence
  Synthetic DNA
taatatgacactccttcg

SEQ ID NO: 66132 - DNA, 18 bp, Artificial Sequence
  Synthetic DNA
taatatgacatacaaaag

SEQ ID NO: 66133 - DNA, 18 bp, Artificial Sequence
  Synthetic DNA
taatatgacatacaagtg

SEQ ID NO: 66134 - DNA, 18 bp, Artificial Sequence
  Synthetic DNA
taatatgacccattgtcg

SEQ ID NO: 66135 - DNA, 18 bp, Artificial Sequence
  Synthetic DNA
taatatgactaattaatg

SEQ ID NO: 66136 - DNA, 18 bp, Artificial Sequence
  Synthetic DNA
taatatgactggcgaaag

SEQ ID NO: 66137 - DNA, 18 bp, Artificial Sequence
  Synthetic DNA
taatatgagtttttactg

SEQ ID NO: 66138 - DNA, 18 bp, Artificial Sequence
  Synthetic DNA
taatatgatacatactcg

SEQ ID NO: 66139 - DNA, 18 bp, Artificial Sequence
  Synthetic DNA
taatatgattccacctag

SEQ ID NO: 66140 - DNA, 18 bp, Artificial Sequence
  Synthetic DNA
taatatgccacccaatag

SEQ ID NO: 66141 - DNA, 18 bp, Artificial Sequence
  Synthetic DNA
taatatggattactgtag

SEQ ID NO: 66142 - DNA, 18 bp, Artificial Sequence
  Synthetic DNA
taatatgtataactaaag

SEQ ID NO: 66143 - DNA, 18 bp, Artificial Sequence
  Synthetic DNA
taatatgtctcaatttgg

SEQ ID NO: 66144 - DNA, 18 bp, Artificial Sequence
  Synthetic DNA
taatatgtgtccctacag

SEQ ID NO: 66145 - DNA, 18 bp, Artificial Sequence
  Synthetic DNA
taatatgtttcccatatg

SEQ ID NO: 66146 - DNA, 18 bp, Artificial Sequence
  Synthetic DNA
taatattacactatattg

SEQ ID NO: 66147 - DNA, 18 bp, Artificial Sequence
  Synthetic DNA
taatattacatactgttg

SEQ ID NO: 66148 - DNA, 18 bp, Artificial Sequence
  Synthetic DNA
taatattactctctgatg

SEQ ID NO: 66149 - DNA, 18 bp, Artificial Sequence
  Synthetic DNA
taatattgctgacttaag

SEQ ID NO: 66150 - DNA, 18 bp, Artificial Sequence
  Synthetic DNA
taatatttcacgatatag

SEQ ID NO: 66151 - DNA, 18 bp, Artificial Sequence
  Synthetic DNA
taatccaaatcactacgg

SEQ ID NO: 66152 - DNA, 18 bp, Artificial Sequence
  Synthetic DNA
taatccaatacaatatag

SEQ ID NO: 66153 - DNA, 18 bp, Artificial Sequence
  Synthetic DNA
taatccacctcaatattg

SEQ ID NO: 66154 - DNA, 18 bp, Artificial Sequence
  Synthetic DNA
taatcccaattactacag

SEQ ID NO: 66155 - DNA, 18 bp, Artificial Sequence
  Synthetic DNA
taatcccatacaccattg

SEQ ID NO: 66156 - DNA, 18 bp, Artificial Sequence
  Synthetic DNA
taatccccctcacttttg

SEQ ID NO: 66157 - DNA, 18 bp, Artificial Sequence
  Synthetic DNA
taatcccgtactctatcg

SEQ ID NO: 66158 - DNA, 18 bp, Artificial Sequence
  Synthetic DNA
taatccgaaaagctatag

SEQ ID NO: 66159 - DNA, 18 bp, Artificial Sequence
  Synthetic DNA
taatccgattaacttttg

SEQ ID NO: 66160 - DNA, 18 bp, Artificial Sequence
  Synthetic DNA
taatccgtgtatctatag

SEQ ID NO: 66161 - DNA, 18 bp, Artificial Sequence
  Synthetic DNA
taatcctactcaccaacg

SEQ ID NO: 66162 - DNA, 18 bp, Artificial Sequence
  Synthetic DNA
taatccttttcgctttag

SEQ ID NO: 66163 - DNA, 18 bp, Artificial Sequence
  Synthetic DNA
taatcgatttcactgtag

SEQ ID NO: 66164 - DNA, 18 bp, Artificial Sequence
  Synthetic DNA
taatcggacaaacttatg

SEQ ID NO: 66165 - DNA, 18 bp, Artificial Sequence
  Synthetic DNA
taatcggactcacaaacg

SEQ ID NO: 66166 - DNA, 18 bp, Artificial Sequence
  Synthetic DNA
taatcggccacgttatag

SEQ ID NO: 66167 - DNA, 18 bp, Artificial Sequence
  Synthetic DNA
taatctaacacagtatag

SEQ ID NO: 66168 - DNA, 18 bp, Artificial Sequence
  Synthetic DNA
taatctatcgcactttag

SEQ ID NO: 66169 - DNA, 18 bp, Artificial Sequence
  Synthetic DNA
taatctgaaccgctatag

SEQ ID NO: 66170 - DNA, 18 bp, Artificial Sequence
  Synthetic DNA
taatctgtcccattgtag

SEQ ID NO: 66171 - DNA, 18 bp, Artificial Sequence
  Synthetic DNA
taatcttattcactcaag

SEQ ID NO: 66172 - DNA, 18 bp, Artificial Sequence
  Synthetic DNA
taatgagactctcaatcg

SEQ ID NO: 66173 - DNA, 18 bp, Artificial Sequence
  Synthetic DNA
taatgagtcattctatag

SEQ ID NO: 66174 - DNA, 18 bp, Artificial Sequence
  Synthetic DNA
taatgcacttttctatag

SEQ ID NO: 66175 - DNA, 18 bp, Artificial Sequence
  Synthetic DNA
taatgcagctctttatag

SEQ ID NO: 66176 - DNA, 18 bp, Artificial Sequence
  Synthetic DNA
taatgcatttcgcaatag

SEQ ID NO: 66177 - DNA, 18 bp, Artificial Sequence
  Synthetic DNA
taatgcgacatacttaag

SEQ ID NO: 66178 - DNA, 18 bp, Artificial Sequence
  Synthetic DNA
taatgcgattttctattg

SEQ ID NO: 66179 - DNA, 18 bp, Artificial Sequence
  Synthetic DNA
taatgcgcatctttatag

SEQ ID NO: 66180 - DNA, 18 bp, Artificial Sequence
  Synthetic DNA
taatgcgcctcaacttag

SEQ ID NO: 66181 - DNA, 18 bp, Artificial Sequence
  Synthetic DNA
taatgctattaacaatag

SEQ ID NO: 66182 - DNA, 18 bp, Artificial Sequence
  Synthetic DNA
taatggcaacaactaaag

SEQ ID NO: 66183 - DNA, 18 bp, Artificial Sequence
  Synthetic DNA
taatgtgacttaccatgg

SEQ ID NO: 66184 - DNA, 18 bp, Artificial Sequence
  Synthetic DNA
taattaatcacactattg

SEQ ID NO: 66185 - DNA, 18 bp, Artificial Sequence
  Synthetic DNA
taattaatttcactatag

SEQ ID NO: 66186 - DNA, 18 bp, Artificial Sequence
  Synthetic DNA
taattacactcacttcag

SEQ ID NO: 66187 - DNA, 18 bp, Artificial Sequence
  Synthetic DNA
taattacactcgcttaag

SEQ ID NO: 66188 - DNA, 18 bp, Artificial Sequence
  Synthetic DNA
taattagaaactctatag

SEQ ID NO: 66189 - DNA, 18 bp, Artificial Sequence
  Synthetic DNA
taattagacaaactattg

SEQ ID NO: 66190 - DNA, 18 bp, Artificial Sequence
  Synthetic DNA
taattagactcacttgtg

SEQ ID NO: 66191 - DNA, 18 bp, Artificial Sequence
  Synthetic DNA
taattatactcacattag

SEQ ID NO: 66192 - DNA, 18 bp, Artificial Sequence
  Synthetic DNA
taattattctcacaattg

SEQ ID NO: 66193 - DNA, 18 bp, Artificial Sequence
  Synthetic DNA
taattcaactcattttcg

SEQ ID NO: 66194 - DNA, 18 bp, Artificial Sequence
  Synthetic DNA
taattcaactgacaattg

SEQ ID NO: 66195 - DNA, 18 bp, Artificial Sequence
  Synthetic DNA
taattcaattcacaaatg

SEQ ID NO: 66196 - DNA, 18 bp, Artificial Sequence
  Synthetic DNA
taattcaccagactatag

SEQ ID NO: 66197 - DNA, 18 bp, Artificial Sequence
  Synthetic DNA
taattcatattactattg

SEQ ID NO: 66198 - DNA, 18 bp, Artificial Sequence
  Synthetic DNA
taattccaataactctag

SEQ ID NO: 66199 - DNA, 18 bp, Artificial Sequence
  Synthetic DNA
taattccaatgaatatag

SEQ ID NO: 66200 - DNA, 18 bp, Artificial Sequence
  Synthetic DNA
taattccactcacatttg

SEQ ID NO: 66201 - DNA, 18 bp, Artificial Sequence
  Synthetic DNA
taattccactcattctcg

SEQ ID NO: 66202 - DNA, 18 bp, Artificial Sequence
  Synthetic DNA
taattcctctcacttatg

SEQ ID NO: 66203 - DNA, 18 bp, Artificial Sequence
  Synthetic DNA
taattcctctgaccatag

SEQ ID NO: 66204 - DNA, 18 bp, Artificial Sequence
  Synthetic DNA
taattcgaatccctaacg

SEQ ID NO: 66205 - DNA, 18 bp, Artificial Sequence
  Synthetic DNA
taattcgacaagctatgg

SEQ ID NO: 66206 - DNA, 18 bp, Artificial Sequence
  Synthetic DNA
taattcgacattcaaaag

SEQ ID NO: 66207 - DNA, 18 bp, Artificial Sequence
  Synthetic DNA
taattcgacccacagaag

SEQ ID NO: 66208 - DNA, 18 bp, Artificial Sequence
  Synthetic DNA
taattcgactcccctttg

SEQ ID NO: 66209 - DNA, 18 bp, Artificial Sequence
  Synthetic DNA
taattcgactcgcaaacg

SEQ ID NO: 66210 - DNA, 18 bp, Artificial Sequence
  Synthetic DNA
taattcgactctaatttg

SEQ ID NO: 66211 - DNA, 18 bp, Artificial Sequence
  Synthetic DNA
taattcgactgaaaattg

SEQ ID NO: 66212 - DNA, 18 bp, Artificial Sequence
  Synthetic DNA
taattcgactgattttcg

SEQ ID NO: 66213 - DNA, 18 bp, Artificial Sequence
  Synthetic DNA
taattcgatcctatttag

SEQ ID NO: 66214 - DNA, 18 bp, Artificial Sequence
  Synthetic DNA
taattcgattaaatgtag

SEQ ID NO: 66215 - DNA, 18 bp, Artificial Sequence
  Synthetic DNA
taattcgattaattctag

SEQ ID NO: 66216 - DNA, 18 bp, Artificial Sequence
  Synthetic DNA
taattcgccacacattag

SEQ ID NO: 66217 - DNA, 18 bp, Artificial Sequence
  Synthetic DNA
taattcgccatactaaag

SEQ ID NO: 66218 - DNA, 18 bp, Artificial Sequence
  Synthetic DNA
taattcgtccccccatag

SEQ ID NO: 66219 - DNA, 18 bp, Artificial Sequence
  Synthetic DNA
taattcgtcgcactgaag

SEQ ID NO: 66220 - DNA, 18 bp, Artificial Sequence
  Synthetic DNA
taattcgtgttacaatag

SEQ ID NO: 66221 - DNA, 18 bp, Artificial Sequence
  Synthetic DNA
taattcgtttcacagtag

SEQ ID NO: 66222 - DNA, 18 bp, Artificial Sequence
  Synthetic DNA
taattctacacacttaag

SEQ ID NO: 66223 - DNA, 18 bp, Artificial Sequence
  Synthetic DNA
taattctactctcctaag

SEQ ID NO: 66224 - DNA, 18 bp, Artificial Sequence
  Synthetic DNA
taattctagtccctctag

SEQ ID NO: 66225 - DNA, 18 bp, Artificial Sequence
  Synthetic DNA
taattcttcacactacag

SEQ ID NO: 66226 - DNA, 18 bp, Artificial Sequence
  Synthetic DNA
taattcttctcaatattg

SEQ ID NO: 66227 - DNA, 18 bp, Artificial Sequence
  Synthetic DNA
taattcttctcaccttag

SEQ ID NO: 66228 - DNA, 18 bp, Artificial Sequence
  Synthetic DNA
taattgcacttacaatag

SEQ ID NO: 66229 - DNA, 18 bp, Artificial Sequence
  Synthetic DNA
taattggactcacctaag

SEQ ID NO: 66230 - DNA, 18 bp, Artificial Sequence
  Synthetic DNA
taatttaaatgacttctg

SEQ ID NO: 66231 - DNA, 18 bp, Artificial Sequence
  Synthetic DNA
taatttaactccttatag

SEQ ID NO: 66232 - DNA, 18 bp, Artificial Sequence
  Synthetic DNA
taatttatctcacgattg

SEQ ID NO: 66233 - DNA, 18 bp, Artificial Sequence
  Synthetic DNA
taatttctctcaatatag

SEQ ID NO: 66234 - DNA, 18 bp, Artificial Sequence
  Synthetic DNA
taatttgaatcagtctag

SEQ ID NO: 66235 - DNA, 18 bp, Artificial Sequence
  Synthetic DNA
taatttgactcccttttg

SEQ ID NO: 66236 - DNA, 18 bp, Artificial Sequence
  Synthetic DNA
taatttgcctcacaatgg

SEQ ID NO: 66237 - DNA, 18 bp, Artificial Sequence
  Synthetic DNA
taattttactaactattg

SEQ ID NO: 66238 - DNA, 18 bp, Artificial Sequence
  Synthetic DNA
taattttcctcacttaag

SEQ ID NO: 66239 - DNA, 18 bp, Artificial Sequence
  Synthetic DNA
taatttttcacactatag

SEQ ID NO: 66240 - DNA, 18 bp, Artificial Sequence
  Synthetic DNA
tacaaagattcacttacg

SEQ ID NO: 66241 - DNA, 18 bp, Artificial Sequence
  Synthetic DNA
tacaaagtctccctaaag

SEQ ID NO: 66242 - DNA, 18 bp, Artificial Sequence
  Synthetic DNA
tacaaccacacgctatag

SEQ ID NO: 66243 - DNA, 18 bp, Artificial Sequence
  Synthetic DNA
tacaacgactcatattag

SEQ ID NO: 66244 - DNA, 18 bp, Artificial Sequence
  Synthetic DNA
tacaacgactctgcatag

SEQ ID NO: 66245 - DNA, 18 bp, Artificial Sequence
  Synthetic DNA
tacaacgattcaatattg

SEQ ID NO: 66246 - DNA, 18 bp, Artificial Sequence
  Synthetic DNA
tacaacgattcattattg

SEQ ID NO: 66247 - DNA, 18 bp, Artificial Sequence
  Synthetic DNA
tacaccgacccactaatg

SEQ ID NO: 66248 - DNA, 18 bp, Artificial Sequence
  Synthetic DNA
tacatcggctcaccattg

SEQ ID NO: 66249 - DNA, 18 bp, Artificial Sequence
  Synthetic DNA
tacatggaattacttaag

SEQ ID NO: 66250 - DNA, 18 bp, Artificial Sequence
  Synthetic DNA
taccacaactcaattaag

SEQ ID NO: 66251 - DNA, 18 bp, Artificial Sequence
  Synthetic DNA
taccacgactcacacaag

SEQ ID NO: 66252 - DNA, 18 bp, Artificial Sequence
  Synthetic DNA
taccacgacttattgtag

SEQ ID NO: 66253 - DNA, 18 bp, Artificial Sequence
  Synthetic DNA
taccacggatatgttttg

SEQ ID NO: 66254 - DNA, 18 bp, Artificial Sequence
  Synthetic DNA
taccacggatcactaaag

SEQ ID NO: 66255 - DNA, 18 bp, Artificial Sequence
  Synthetic DNA
taccacgtatcactttag

SEQ ID NO: 66256 - DNA, 18 bp, Artificial Sequence
  Synthetic DNA
taccacgtttccctatag

SEQ ID NO: 66257 - DNA, 18 bp, Artificial Sequence
  Synthetic DNA
tactaaaagtcacaaaag

SEQ ID NO: 66258 - DNA, 18 bp, Artificial Sequence
  Synthetic DNA
tactaaatatcgctattg

SEQ ID NO: 66259 - DNA, 18 bp, Artificial Sequence
  Synthetic DNA
tactaagattcacttcag

SEQ ID NO: 66260 - DNA, 18 bp, Artificial Sequence
  Synthetic DNA
tactaagtctccttacag

SEQ ID NO: 66261 - DNA, 18 bp, Artificial Sequence
  Synthetic DNA
tactaattctctccatag

SEQ ID NO: 66262 - DNA, 18 bp, Artificial Sequence
  Synthetic DNA
tactacaaaccacttatg

SEQ ID NO: 66263 - DNA, 18 bp, Artificial Sequence
  Synthetic DNA
tactacacctggctctag

SEQ ID NO: 66264 - DNA, 18 bp, Artificial Sequence
  Synthetic DNA
tactaccacacaccttgg

SEQ ID NO: 66265 - DNA, 18 bp, Artificial Sequence
  Synthetic DNA
tactacgacactcatttg

SEQ ID NO: 66266 - DNA, 18 bp, Artificial Sequence
  Synthetic DNA
tactacgacataatttag

SEQ ID NO: 66267 - DNA, 18 bp, Artificial Sequence
  Synthetic DNA
tactacgactttcaaaag

SEQ ID NO: 66268 - DNA, 18 bp, Artificial Sequence
  Synthetic DNA
tactacgatttgcactag

SEQ ID NO: 66269 - DNA, 18 bp, Artificial Sequence
  Synthetic DNA
tactacgcaccattttag

SEQ ID NO: 66270 - DNA, 18 bp, Artificial Sequence
  Synthetic DNA
tactacggcacaatacag

SEQ ID NO: 66271 - DNA, 18 bp, Artificial Sequence
  Synthetic DNA
tactacgtcacaccttag

SEQ ID NO: 66272 - DNA, 18 bp, Artificial Sequence
  Synthetic DNA
tactacgtctctttttag

SEQ ID NO: 66273 - DNA, 18 bp, Artificial Sequence
  Synthetic DNA
tactactactcttagtgg

SEQ ID NO: 66274 - DNA, 18 bp, Artificial Sequence
  Synthetic DNA
tactactattcacaaaag

SEQ ID NO: 66275 - DNA, 18 bp, Artificial Sequence
  Synthetic DNA
tactactgctccttactg

SEQ ID NO: 66276 - DNA, 18 bp, Artificial Sequence
  Synthetic DNA
tactacttttcacccttg

SEQ ID NO: 66277 - DNA, 18 bp, Artificial Sequence
  Synthetic DNA
tactagaactctctttag

SEQ ID NO: 66278 - DNA, 18 bp, Artificial Sequence
  Synthetic DNA
tactagatgtcactatag

SEQ ID NO: 66279 - DNA, 18 bp, Artificial Sequence
  Synthetic DNA
tactaggactcccaaaag

SEQ ID NO: 66280 - DNA, 18 bp, Artificial Sequence
  Synthetic DNA
tactataagtcactgttg

SEQ ID NO: 66281 - DNA, 18 bp, Artificial Sequence
  Synthetic DNA
tactatgaccaattttag

SEQ ID NO: 66282 - DNA, 18 bp, Artificial Sequence
  Synthetic DNA
tactatgattcacgaaag

SEQ ID NO: 66283 - DNA, 18 bp, Artificial Sequence
  Synthetic DNA
tactatgattctctattg

SEQ ID NO: 66284 - DNA, 18 bp, Artificial Sequence
  Synthetic DNA
tactatgtctctgtatag

SEQ ID NO: 66285 - DNA, 18 bp, Artificial Sequence
  Synthetic DNA
tactccgacaaactacag

SEQ ID NO: 66286 - DNA, 18 bp, Artificial Sequence
  Synthetic DNA
tactccgacactctaatg

SEQ ID NO: 66287 - DNA, 18 bp, Artificial Sequence
  Synthetic DNA
tactccggcttactttag

SEQ ID NO: 66288 - DNA, 18 bp, Artificial Sequence
  Synthetic DNA
tactccgttcgacaaaag

SEQ ID NO: 66289 - DNA, 18 bp, Artificial Sequence
  Synthetic DNA
tactcttcctcagtatag

SEQ ID NO: 66290 - DNA, 18 bp, Artificial Sequence
  Synthetic DNA
tactgcccttcattttgg

SEQ ID NO: 66291 - DNA, 18 bp, Artificial Sequence
  Synthetic DNA
tactgcgactcaccaacg

SEQ ID NO: 66292 - DNA, 18 bp, Artificial Sequence
  Synthetic DNA
tactgcgattccctatgg

SEQ ID NO: 66293 - DNA, 18 bp, Artificial Sequence
  Synthetic DNA
tactgcttttcacaaaag

SEQ ID NO: 66294 - DNA, 18 bp, Artificial Sequence
  Synthetic DNA
tacttcaactggctattg

SEQ ID NO: 66295 - DNA, 18 bp, Artificial Sequence
  Synthetic DNA
tacttcatctatccattg

SEQ ID NO: 66296 - DNA, 18 bp, Artificial Sequence
  Synthetic DNA
tacttcgacacacaaatg

SEQ ID NO: 66297 - DNA, 18 bp, Artificial Sequence
  Synthetic DNA
tacttcgactaatgatag

SEQ ID NO: 66298 - DNA, 18 bp, Artificial Sequence
  Synthetic DNA
tacttcgagtcgcaatcg

SEQ ID NO: 66299 - DNA, 18 bp, Artificial Sequence
  Synthetic DNA
tagaaccacacataaaag

SEQ ID NO: 66300 - DNA, 18 bp, Artificial Sequence
  Synthetic DNA
tagaacgactcacaaccg

SEQ ID NO: 66301 - DNA, 18 bp, Artificial Sequence
  Synthetic DNA
tagaccaacttactatag

SEQ ID NO: 66302 - DNA, 18 bp, Artificial Sequence
  Synthetic DNA
tagatcgtatcactatag

SEQ ID NO: 66303 - DNA, 18 bp, Artificial Sequence
  Synthetic DNA
tagcacttctcacacttg

SEQ ID NO: 66304 - DNA, 18 bp, Artificial Sequence
  Synthetic DNA
tagcaggactcgcaatag

SEQ ID NO: 66305 - DNA, 18 bp, Artificial Sequence
  Synthetic DNA
taggaagtctcgctatcg

SEQ ID NO: 66306 - DNA, 18 bp, Artificial Sequence
  Synthetic DNA
taggactactctctttag

SEQ ID NO: 66307 - DNA, 18 bp, Artificial Sequence
  Synthetic DNA
tagtaagactcactcctg

SEQ ID NO: 66308 - DNA, 18 bp, Artificial Sequence
  Synthetic DNA
tagtaagactctataaag

SEQ ID NO: 66309 - DNA, 18 bp, Artificial Sequence
  Synthetic DNA
tagtacaactcatttaag

SEQ ID NO: 66310 - DNA, 18 bp, Artificial Sequence
  Synthetic DNA
tagtacatctcattgtag

SEQ ID NO: 66311 - DNA, 18 bp, Artificial Sequence
  Synthetic DNA
tagtacgacataccattg

SEQ ID NO: 66312 - DNA, 18 bp, Artificial Sequence
  Synthetic DNA
tagtacgactaatttcag

SEQ ID NO: 66313 - DNA, 18 bp, Artificial Sequence
  Synthetic DNA
tagtacgactcatatcag

SEQ ID NO: 66314 - DNA, 18 bp, Artificial Sequence
  Synthetic DNA
tagtacgactttttaatg

SEQ ID NO: 66315 - DNA, 18 bp, Artificial Sequence
  Synthetic DNA
tagtacgcctttcaaaag

SEQ ID NO: 66316 - DNA, 18 bp, Artificial Sequence
  Synthetic DNA
tagtacgggtatatatag

SEQ ID NO: 66317 - DNA, 18 bp, Artificial Sequence
  Synthetic DNA
tagtacgtcacacaacag

SEQ ID NO: 66318 - DNA, 18 bp, Artificial Sequence
  Synthetic DNA
tagtacgtcacattgtag

SEQ ID NO: 66319 - DNA, 18 bp, Artificial Sequence
  Synthetic DNA
tagtacgtcatatgattg

SEQ ID NO: 66320 - DNA, 18 bp, Artificial Sequence
  Synthetic DNA
tagtacgtctaactcaag

SEQ ID NO: 66321 - DNA, 18 bp, Artificial Sequence
  Synthetic DNA
tagtacgtctttctaaag

SEQ ID NO: 66322 - DNA, 18 bp, Artificial Sequence
  Synthetic DNA
tagtactactcaatcgag

SEQ ID NO: 66323 - DNA, 18 bp, Artificial Sequence
  Synthetic DNA
tagtacttgtcactatgg

SEQ ID NO: 66324 - DNA, 18 bp, Artificial Sequence
  Synthetic DNA
tagtatcaatctctattg

SEQ ID NO: 66325 - DNA, 18 bp, Artificial Sequence
  Synthetic DNA
tagtatgaccctcaatgg

SEQ ID NO: 66326 - DNA, 18 bp, Artificial Sequence
  Synthetic DNA
tagtatgccacaataaag

SEQ ID NO: 66327 - DNA, 18 bp, Artificial Sequence
  Synthetic DNA
tagtattactcaacgtag

SEQ ID NO: 66328 - DNA, 18 bp, Artificial Sequence
  Synthetic DNA
tagtattactctctatcg

SEQ ID NO: 66329 - DNA, 18 bp, Artificial Sequence
  Synthetic DNA
tagtccaactctcagtag

SEQ ID NO: 66330 - DNA, 18 bp, Artificial Sequence
  Synthetic DNA
tagtcccactcacataag

SEQ ID NO: 66331 - DNA, 18 bp, Artificial Sequence
  Synthetic DNA
tagtgcgtctcagattcg

SEQ ID NO: 66332 - DNA, 18 bp, Artificial Sequence
  Synthetic DNA
tagttcaagtctctatag

SEQ ID NO: 66333 - DNA, 18 bp, Artificial Sequence
  Synthetic DNA
tagttcgaatcgcatttg

SEQ ID NO: 66334 - DNA, 18 bp, Artificial Sequence
  Synthetic DNA
tagttcgaattacatcag

SEQ ID NO: 66335 - DNA, 18 bp, Artificial Sequence
  Synthetic DNA
tagttcttctcacagtag

SEQ ID NO: 66336 - DNA, 18 bp, Artificial Sequence
  Synthetic DNA
tagtttcactcacaatag

SEQ ID NO: 66337 - DNA, 18 bp, Artificial Sequence
  Synthetic DNA
tagttttaccctatatcg

SEQ ID NO: 66338 - DNA, 18 bp, Artificial Sequence
  Synthetic DNA
tataaagactcattaaag

SEQ ID NO: 66339 - DNA, 18 bp, Artificial Sequence
  Synthetic DNA
tataaagtgccactatag

SEQ ID NO: 66340 - DNA, 18 bp, Artificial Sequence
  Synthetic DNA
tataacaactccgtacag

SEQ ID NO: 66341 - DNA, 18 bp, Artificial Sequence
  Synthetic DNA
tataaccactctctaatg

SEQ ID NO: 66342 - DNA, 18 bp, Artificial Sequence
  Synthetic DNA
tataacgacacttaatag

SEQ ID NO: 66343 - DNA, 18 bp, Artificial Sequence
  Synthetic DNA
tataacgacgtacaatag

SEQ ID NO: 66344 - DNA, 18 bp, Artificial Sequence
  Synthetic DNA
tataacgactaattaaag

SEQ ID NO: 66345 - DNA, 18 bp, Artificial Sequence
  Synthetic DNA
tataacgactcacttacg

SEQ ID NO: 66346 - DNA, 18 bp, Artificial Sequence
  Synthetic DNA
tataacgactctatttag

SEQ ID NO: 66347 - DNA, 18 bp, Artificial Sequence
  Synthetic DNA
tataacgactctctaatg

SEQ ID NO: 66348 - DNA, 18 bp, Artificial Sequence
  Synthetic DNA
tataacgactgactaatg

SEQ ID NO: 66349 - DNA, 18 bp, Artificial Sequence
  Synthetic DNA
tataacgattaacgatgg

SEQ ID NO: 66350 - DNA, 18 bp, Artificial Sequence
  Synthetic DNA
tataacgattgacattag

SEQ ID NO: 66351 - DNA, 18 bp, Artificial Sequence
  Synthetic DNA
tataacgcctctcaatag

SEQ ID NO: 66352 - DNA, 18 bp, Artificial Sequence
  Synthetic DNA
tataacggctcacattag

SEQ ID NO: 66353 - DNA, 18 bp, Artificial Sequence
  Synthetic DNA
tataacgtaccgctaaag

SEQ ID NO: 66354 - DNA, 18 bp, Artificial Sequence
  Synthetic DNA
tataactatgccatatcg

SEQ ID NO: 66355 - DNA, 18 bp, Artificial Sequence
  Synthetic DNA
tataactcctcactatcg

SEQ ID NO: 66356 - DNA, 18 bp, Artificial Sequence
  Synthetic DNA
tataacttctcaacaaag

SEQ ID NO: 66357 - DNA, 18 bp, Artificial Sequence
  Synthetic DNA
tataacttctcactattg

SEQ ID NO: 66358 - DNA, 18 bp, Artificial Sequence
  Synthetic DNA
tataagttctcactttag

SEQ ID NO: 66359 - DNA, 18 bp, Artificial Sequence
  Synthetic DNA
tataataacatcatattg

SEQ ID NO: 66360 - DNA, 18 bp, Artificial Sequence
  Synthetic DNA
tataatcaatgactatag

SEQ ID NO: 66361 - DNA, 18 bp, Artificial Sequence
  Synthetic DNA
tataatgaaacaccattg

SEQ ID NO: 66362 - DNA, 18 bp, Artificial Sequence
  Synthetic DNA
tataatgactcgatatag

SEQ ID NO: 66363 - DNA, 18 bp, Artificial Sequence
  Synthetic DNA
tataatgtcccattgatg

SEQ ID NO: 66364 - DNA, 18 bp, Artificial Sequence
  Synthetic DNA
tatacccaatctcaatag

SEQ ID NO: 66365 - DNA, 18 bp, Artificial Sequence
  Synthetic DNA
tatactcactcattttag

SEQ ID NO: 66366 - DNA, 18 bp, Artificial Sequence
  Synthetic DNA
tatagcgacactctttag

SEQ ID NO: 66367 - DNA, 18 bp, Artificial Sequence
  Synthetic DNA
tatagcgactcaatgtag

SEQ ID NO: 66368 - DNA, 18 bp, Artificial Sequence
  Synthetic DNA
tatagctactacctaaag

SEQ ID NO: 66369 - DNA, 18 bp, Artificial Sequence
  Synthetic DNA
tatatcaactttcgatag

SEQ ID NO: 66370 - DNA, 18 bp, Artificial Sequence
  Synthetic DNA
tatatcgattcaccatag

SEQ ID NO: 66371 - DNA, 18 bp, Artificial Sequence
  Synthetic DNA
tatatcgattctctacag

SEQ ID NO: 66372 - DNA, 18 bp, Artificial Sequence
  Synthetic DNA
tatatcgcctcattatag

SEQ ID NO: 66373 - DNA, 18 bp, Artificial Sequence
  Synthetic DNA
tatatcgtctcacaatag

SEQ ID NO: 66374 - DNA, 18 bp, Artificial Sequence
  Synthetic DNA
tatatggccaccctatag

SEQ ID NO: 66375 - DNA, 18 bp, Artificial Sequence
  Synthetic DNA
tatatgggctcccaatcg

SEQ ID NO: 66376 - DNA, 18 bp, Artificial Sequence
  Synthetic DNA
tatatttactatctaaag

SEQ ID NO: 66377 - DNA, 18 bp, Artificial Sequence
  Synthetic DNA
tatcaagattcactttag

SEQ ID NO: 66378 - DNA, 18 bp, Artificial Sequence
  Synthetic DNA
tatcacaccttactaaag

SEQ ID NO: 66379 - DNA, 18 bp, Artificial Sequence
  Synthetic DNA
tatcacgacacattttag

SEQ ID NO: 66380 - DNA, 18 bp, Artificial Sequence
  Synthetic DNA
tatcacgactaacaatgg

SEQ ID NO: 66381 - DNA, 18 bp, Artificial Sequence
  Synthetic DNA
tatcacggatccctgtag

SEQ ID NO: 66382 - DNA, 18 bp, Artificial Sequence
  Synthetic DNA
tatcacgtcccagtaaag

SEQ ID NO: 66383 - DNA, 18 bp, Artificial Sequence
  Synthetic DNA
tatcataactcactattg

SEQ ID NO: 66384 - DNA, 18 bp, Artificial Sequence
  Synthetic DNA
tatcatgacaccctctag

SEQ ID NO: 66385 - DNA, 18 bp, Artificial Sequence
  Synthetic DNA
tatcgcgactctctattg

SEQ ID NO: 66386 - DNA, 18 bp, Artificial Sequence
  Synthetic DNA
tatctcgacttgctacag

SEQ ID NO: 66387 - DNA, 18 bp, Artificial Sequence
  Synthetic DNA
tatgaagaatcactgagg

SEQ ID NO: 66388 - DNA, 18 bp, Artificial Sequence
  Synthetic DNA
tatgacgactcggtaaag

SEQ ID NO: 66389 - DNA, 18 bp, Artificial Sequence
  Synthetic DNA
tatgaggacccaatatag

SEQ ID NO: 66390 - DNA, 18 bp, Artificial Sequence
  Synthetic DNA
tatgccgtatttctaaag

SEQ ID NO: 66391 - DNA, 18 bp, Artificial Sequence
  Synthetic DNA
tatgctgtctcactatag

SEQ ID NO: 66392 - DNA, 18 bp, Artificial Sequence
  Synthetic DNA
tatgttgactcgcaattg

SEQ ID NO: 66393 - DNA, 18 bp, Artificial Sequence
  Synthetic DNA
tattaacactctttaaag

SEQ ID NO: 66394 - DNA, 18 bp, Artificial Sequence
  Synthetic DNA
tattaagattcaatttag

SEQ ID NO: 66395 - DNA, 18 bp, Artificial Sequence
  Synthetic DNA
tattaaggctcactaatg

SEQ ID NO: 66396 - DNA, 18 bp, Artificial Sequence
  Synthetic DNA
tattaatactcccataag

SEQ ID NO: 66397 - DNA, 18 bp, Artificial Sequence
  Synthetic DNA
tattaatgatcactatag

SEQ ID NO: 66398 - DNA, 18 bp, Artificial Sequence
  Synthetic DNA
tattaattctcactaaag

SEQ ID NO: 66399 - DNA, 18 bp, Artificial Sequence
  Synthetic DNA
tattacaactcaccaatg

SEQ ID NO: 66400 - DNA, 18 bp, Artificial Sequence
  Synthetic DNA
tattacaactcacttcgg

SEQ ID NO: 66401 - DNA, 18 bp, Artificial Sequence
  Synthetic DNA
tattacaactctccactg

SEQ ID NO: 66402 - DNA, 18 bp, Artificial Sequence
  Synthetic DNA
tattacatctctctctag

SEQ ID NO: 66403 - DNA, 18 bp, Artificial Sequence
  Synthetic DNA
tattacatcttctaatag

SEQ ID NO: 66404 - DNA, 18 bp, Artificial Sequence
  Synthetic DNA
tattaccacccactaccg

SEQ ID NO: 66405 - DNA, 18 bp, Artificial Sequence
  Synthetic DNA
tattaccactcacttatg

SEQ ID NO: 66406 - DNA, 18 bp, Artificial Sequence
  Synthetic DNA
tattacgaaacaatctag

SEQ ID NO: 66407 - DNA, 18 bp, Artificial Sequence
  Synthetic DNA
tattacgaatagctttag

SEQ ID NO: 66408 - DNA, 18 bp, Artificial Sequence
  Synthetic DNA
tattacgaatcactcatg

SEQ ID NO: 66409 - DNA, 18 bp, Artificial Sequence
  Synthetic DNA
tattacgaatctcaattg

SEQ ID NO: 66410 - DNA, 18 bp, Artificial Sequence
  Synthetic DNA
tattacgacacccaacag

SEQ ID NO: 66411 - DNA, 18 bp, Artificial Sequence
  Synthetic DNA
tattacgaccacctacag

SEQ ID NO: 66412 - DNA, 18 bp, Artificial Sequence
  Synthetic DNA
tattacgacttacatttg

SEQ ID NO: 66413 - DNA, 18 bp, Artificial Sequence
  Synthetic DNA
tattacgacttatattag

SEQ ID NO: 66414 - DNA, 18 bp, Artificial Sequence
  Synthetic DNA
tattacgagtaacttatg

SEQ ID NO: 66415 - DNA, 18 bp, Artificial Sequence
  Synthetic DNA
tattacgatcctctattg

SEQ ID NO: 66416 - DNA, 18 bp, Artificial Sequence
  Synthetic DNA
tattacgattgtctaaag

SEQ ID NO: 66417 - DNA, 18 bp, Artificial Sequence
  Synthetic DNA
tattacgcttctttatag

SEQ ID NO: 66418 - DNA, 18 bp, Artificial Sequence
  Synthetic DNA
tattacggatcacttaag

SEQ ID NO: 66419 - DNA, 18 bp, Artificial Sequence
  Synthetic DNA
tattacggcttactagtg

SEQ ID NO: 66420 - DNA, 18 bp, Artificial Sequence
  Synthetic DNA
tattacgtaacactcttg

SEQ ID NO: 66421 - DNA, 18 bp, Artificial Sequence
  Synthetic DNA
tattacgtatcgatattg

SEQ ID NO: 66422 - DNA, 18 bp, Artificial Sequence
  Synthetic DNA
tattacgtcacagtgtag

SEQ ID NO: 66423 - DNA, 18 bp, Artificial Sequence
  Synthetic DNA
tattacgtcccagtttag

SEQ ID NO: 66424 - DNA, 18 bp, Artificial Sequence
  Synthetic DNA
tattacgtcccccaatag

SEQ ID NO: 66425 - DNA, 18 bp, Artificial Sequence
  Synthetic DNA
tattacgtctcacagttg

SEQ ID NO: 66426 - DNA, 18 bp, Artificial Sequence
  Synthetic DNA
tattacgtctcgccaaag

SEQ ID NO: 66427 - DNA, 18 bp, Artificial Sequence
  Synthetic DNA
tattacgtctctatttag

SEQ ID NO: 66428 - DNA, 18 bp, Artificial Sequence
  Synthetic DNA
tattacgtctctctgttg

SEQ ID NO: 66429 - DNA, 18 bp, Artificial Sequence
  Synthetic DNA
tattacgtgtaattacag

SEQ ID NO: 66430 - DNA, 18 bp, Artificial Sequence
  Synthetic DNA
tattacgttactctagtg

SEQ ID NO: 66431 - DNA, 18 bp, Artificial Sequence
  Synthetic DNA
tattacgttcctctatag

SEQ ID NO: 66432 - DNA, 18 bp, Artificial Sequence
  Synthetic DNA
tattacgtttaacactag

SEQ ID NO: 66433 - DNA, 18 bp, Artificial Sequence
  Synthetic DNA
tattacgtttcaccacag

SEQ ID NO: 66434 - DNA, 18 bp, Artificial Sequence
  Synthetic DNA
tattactaatcagttttg

SEQ ID NO: 66435 - DNA, 18 bp, Artificial Sequence
  Synthetic DNA
tattactacacatcatag

SEQ ID NO: 66436 - DNA, 18 bp, Artificial Sequence
  Synthetic DNA
tattactactccctaatg

SEQ ID NO: 66437 - DNA, 18 bp, Artificial Sequence
  Synthetic DNA
tattactacttgctttag

SEQ ID NO: 66438 - DNA, 18 bp, Artificial Sequence
  Synthetic DNA
tattactagacactattg

SEQ ID NO: 66439 - DNA, 18 bp, Artificial Sequence
  Synthetic DNA
tattactaggtttcatag

SEQ ID NO: 66440 - DNA, 18 bp, Artificial Sequence
  Synthetic DNA
tattactattctctaaag

SEQ ID NO: 66441 - DNA, 18 bp, Artificial Sequence
  Synthetic DNA
tattactgctcacgattg

SEQ ID NO: 66442 - DNA, 18 bp, Artificial Sequence
  Synthetic DNA
tattacttcacattatag

SEQ ID NO: 66443 - DNA, 18 bp, Artificial Sequence
  Synthetic DNA
tattacttcactctatag

SEQ ID NO: 66444 - DNA, 18 bp, Artificial Sequence
  Synthetic DNA
tattacttctcattaaag

SEQ ID NO: 66445 - DNA, 18 bp, Artificial Sequence
  Synthetic DNA
tattacttctcgctaacg

SEQ ID NO: 66446 - DNA, 18 bp, Artificial Sequence
  Synthetic DNA
tattaggactaacttaag

SEQ ID NO: 66447 - DNA, 18 bp, Artificial Sequence
  Synthetic DNA
tattaggactcaaaaaag

SEQ ID NO: 66448 - DNA, 18 bp, Artificial Sequence
  Synthetic DNA
tattaggactcctttgag

SEQ ID NO: 66449 - DNA, 18 bp, Artificial Sequence
  Synthetic DNA
tattaggtccgaataatg

SEQ ID NO: 66450 - DNA, 18 bp, Artificial Sequence
  Synthetic DNA
tattataaatctctattg

SEQ ID NO: 66451 - DNA, 18 bp, Artificial Sequence
  Synthetic DNA
tattataactccttttag

SEQ ID NO: 66452 - DNA, 18 bp, Artificial Sequence
  Synthetic DNA
tattatatctcattatag

SEQ ID NO: 66453 - DNA, 18 bp, Artificial Sequence
  Synthetic DNA
tattatctctctcaatag

SEQ ID NO: 66454 - DNA, 18 bp, Artificial Sequence
  Synthetic DNA
tattatgaatatctatcg

SEQ ID NO: 66455 - DNA, 18 bp, Artificial Sequence
  Synthetic DNA
tattatgacgcaccattg

SEQ ID NO: 66456 - DNA, 18 bp, Artificial Sequence
  Synthetic DNA
tattatgactcacatttg

SEQ ID NO: 66457 - DNA, 18 bp, Artificial Sequence
  Synthetic DNA
tattatgactctatttag

SEQ ID NO: 66458 - DNA, 18 bp, Artificial Sequence
  Synthetic DNA
tattattcctcagaatag

SEQ ID NO: 66459 - DNA, 18 bp, Artificial Sequence
  Synthetic DNA
tattcagactcactaatg

SEQ ID NO: 66460 - DNA, 18 bp, Artificial Sequence
  Synthetic DNA
tattccaactcacaatcg

SEQ ID NO: 66461 - DNA, 18 bp, Artificial Sequence
  Synthetic DNA
tattccgaaactctattg

SEQ ID NO: 66462 - DNA, 18 bp, Artificial Sequence
  Synthetic DNA
tattccgtcgcactaaag

SEQ ID NO: 66463 - DNA, 18 bp, Artificial Sequence
  Synthetic DNA
tattcggcctcagacaag

SEQ ID NO: 66464 - DNA, 18 bp, Artificial Sequence
  Synthetic DNA
tattgcaactcacatctg

SEQ ID NO: 66465 - DNA, 18 bp, Artificial Sequence
  Synthetic DNA
tattgcaataaactgtag

SEQ ID NO: 66466 - DNA, 18 bp, Artificial Sequence
  Synthetic DNA
tattgcaatgcagactag

SEQ ID NO: 66467 - DNA, 18 bp, Artificial Sequence
  Synthetic DNA
tattgcatctcactatgg

SEQ ID NO: 66468 - DNA, 18 bp, Artificial Sequence
  Synthetic DNA
tattgcatctcactattg

SEQ ID NO: 66469 - DNA, 18 bp, Artificial Sequence
  Synthetic DNA
tattgcgcttcactgttg

SEQ ID NO: 66470 - DNA, 18 bp, Artificial Sequence
  Synthetic DNA
tattgcggagccctatag

SEQ ID NO: 66471 - DNA, 18 bp, Artificial Sequence
  Synthetic DNA
tattgcgtctcacagtag

SEQ ID NO: 66472 - DNA, 18 bp, Artificial Sequence
  Synthetic DNA
tattgcgtctcggttagg

SEQ ID NO: 66473 - DNA, 18 bp, Artificial Sequence
  Synthetic DNA
tattgcgtttcctcatag

SEQ ID NO: 66474 - DNA, 18 bp, Artificial Sequence
  Synthetic DNA
tattgctactcacactag

SEQ ID NO: 66475 - DNA, 18 bp, Artificial Sequence
  Synthetic DNA
tattgcttctaactatcg

SEQ ID NO: 66476 - DNA, 18 bp, Artificial Sequence
  Synthetic DNA
tattgttacttagcattg

SEQ ID NO: 66477 - DNA, 18 bp, Artificial Sequence
  Synthetic DNA
tatttacaatccctagcg

SEQ ID NO: 66478 - DNA, 18 bp, Artificial Sequence
  Synthetic DNA
tatttagactgaccatag

SEQ ID NO: 66479 - DNA, 18 bp, Artificial Sequence
  Synthetic DNA
tatttagtcttaccatag

SEQ ID NO: 66480 - DNA, 18 bp, Artificial Sequence
  Synthetic DNA
tatttcaactcaccacag

SEQ ID NO: 66481 - DNA, 18 bp, Artificial Sequence
  Synthetic DNA
tatttcatctcactcttg

SEQ ID NO: 66482 - DNA, 18 bp, Artificial Sequence
  Synthetic DNA
tatttccacggaccatag

SEQ ID NO: 66483 - DNA, 18 bp, Artificial Sequence
  Synthetic DNA
tatttcgacaaactaaag

SEQ ID NO: 66484 - DNA, 18 bp, Artificial Sequence
  Synthetic DNA
tatttcgacagtctaaag

SEQ ID NO: 66485 - DNA, 18 bp, Artificial Sequence
  Synthetic DNA
tatttcgactcctcatag

SEQ ID NO: 66486 - DNA, 18 bp, Artificial Sequence
  Synthetic DNA
tatttcgatcgacaaatg

SEQ ID NO: 66487 - DNA, 18 bp, Artificial Sequence
  Synthetic DNA
tatttcgattcactttgg

SEQ ID NO: 66488 - DNA, 18 bp, Artificial Sequence
  Synthetic DNA
tatttcgtatctttatag

SEQ ID NO: 66489 - DNA, 18 bp, Artificial Sequence
  Synthetic DNA
tatttcgtctaactattg

SEQ ID NO: 66490 - DNA, 18 bp, Artificial Sequence
  Synthetic DNA
tatttcgtctcaccttgg

SEQ ID NO: 66491 - DNA, 18 bp, Artificial Sequence
  Synthetic DNA
tatttctaataactatag

SEQ ID NO: 66492 - DNA, 18 bp, Artificial Sequence
  Synthetic DNA
tatttctaccctctatag

SEQ ID NO: 66493 - DNA, 18 bp, Artificial Sequence
  Synthetic DNA
tatttctcctctctatag

SEQ ID NO: 66494 - DNA, 18 bp, Artificial Sequence
  Synthetic DNA
tatttctgctaactaaag

SEQ ID NO: 66495 - DNA, 18 bp, Artificial Sequence
  Synthetic DNA
tatttcttatcgctaaag

SEQ ID NO: 66496 - DNA, 18 bp, Artificial Sequence
  Synthetic DNA
tatttcttcacacaattg

SEQ ID NO: 66497 - DNA, 18 bp, Artificial Sequence
  Synthetic DNA
tatttcttctaactattg

SEQ ID NO: 66498 - DNA, 18 bp, Artificial Sequence
  Synthetic DNA
tatttggtcactctacag

SEQ ID NO: 66499 - DNA, 18 bp, Artificial Sequence
  Synthetic DNA
tattttgaaccaatatag

SEQ ID NO: 66500 - DNA, 18 bp, Artificial Sequence
  Synthetic DNA
tattttgactctctattg

SEQ ID NO: 66501 - DNA, 18 bp, Artificial Sequence
  Synthetic DNA
tattttgtcccactatag

SEQ ID NO: 66502 - DNA, 18 bp, Artificial Sequence
  Synthetic DNA
tattttgtcgccctattg

SEQ ID NO: 66503 - DNA, 18 bp, Artificial Sequence
  Synthetic DNA
tatttttactcactaatg

SEQ ID NO: 66504 - DNA, 18 bp, Artificial Sequence
  Synthetic DNA
tcaaaagcctctctattg

SEQ ID NO: 66505 - DNA, 18 bp, Artificial Sequence
  Synthetic DNA
tcaaaagcggcacaattg

SEQ ID NO: 66506 - DNA, 18 bp, Artificial Sequence
  Synthetic DNA
tcaaaccattcattactg

SEQ ID NO: 66507 - DNA, 18 bp, Artificial Sequence
  Synthetic DNA
tcaaacgacacaccgttg

SEQ ID NO: 66508 - DNA, 18 bp, Artificial Sequence
  Synthetic DNA
tcaaacgaccccctaaag

SEQ ID NO: 66509 - DNA, 18 bp, Artificial Sequence
  Synthetic DNA
tcaaacgattcacatcag

SEQ ID NO: 66510 - DNA, 18 bp, Artificial Sequence
  Synthetic DNA
tcaaaggactcattattg

SEQ ID NO: 66511 - DNA, 18 bp, Artificial Sequence
  Synthetic DNA
tcaaattacacattatag

SEQ ID NO: 66512 - DNA, 18 bp, Artificial Sequence
  Synthetic DNA
tcaagccacgatcaagag

SEQ ID NO: 66513 - DNA, 18 bp, Artificial Sequence
  Synthetic DNA
tcaatcgaatcggtatag

SEQ ID NO: 66514 - DNA, 18 bp, Artificial Sequence
  Synthetic DNA
tcaatcgacacactaatg

SEQ ID NO: 66515 - DNA, 18 bp, Artificial Sequence
  Synthetic DNA
tcaatcgtctgactaatg

SEQ ID NO: 66516 - DNA, 18 bp, Artificial Sequence
  Synthetic DNA
tcaatctactcaattcag

SEQ ID NO: 66517 - DNA, 18 bp, Artificial Sequence
  Synthetic DNA
tcacaagaaacacttttg

SEQ ID NO: 66518 - DNA, 18 bp, Artificial Sequence
  Synthetic DNA
tcacataacccaatatag

SEQ ID NO: 66519 - DNA, 18 bp, Artificial Sequence
  Synthetic DNA
tcagacgacagaccaaag

SEQ ID NO: 66520 - DNA, 18 bp, Artificial Sequence
  Synthetic DNA
tcataagacccactcttg

SEQ ID NO: 66521 - DNA, 18 bp, Artificial Sequence
  Synthetic DNA
tcataagtcacacgattg

SEQ ID NO: 66522 - DNA, 18 bp, Artificial Sequence
  Synthetic DNA
tcataattcatagtcaag

SEQ ID NO: 66523 - DNA, 18 bp, Artificial Sequence
  Synthetic DNA
tcatacaactaaccattg

SEQ ID NO: 66524 - DNA, 18 bp, Artificial Sequence
  Synthetic DNA
tcatacgaattactctgg

SEQ ID NO: 66525 - DNA, 18 bp, Artificial Sequence
  Synthetic DNA
tcatacgaccaacaattg

SEQ ID NO: 66526 - DNA, 18 bp, Artificial Sequence
  Synthetic DNA
tcatacgagtctttatcg

SEQ ID NO: 66527 - DNA, 18 bp, Artificial Sequence
  Synthetic DNA
tcatacgtcactttatag

SEQ ID NO: 66528 - DNA, 18 bp, Artificial Sequence
  Synthetic DNA
tcatactaaacactaacg

SEQ ID NO: 66529 - DNA, 18 bp, Artificial Sequence
  Synthetic DNA
tcatactagccaccttag

SEQ ID NO: 66530 - DNA, 18 bp, Artificial Sequence
  Synthetic DNA
tcatacttctctcaatag

SEQ ID NO: 66531 - DNA, 18 bp, Artificial Sequence
  Synthetic DNA
tcataggactcacatttg

SEQ ID NO: 66532 - DNA, 18 bp, Artificial Sequence
  Synthetic DNA
tcataggattcgctattg

SEQ ID NO: 66533 - DNA, 18 bp, Artificial Sequence
  Synthetic DNA
tcatatcactcgctatcg

SEQ ID NO: 66534 - DNA, 18 bp, Artificial Sequence
  Synthetic DNA
tcatatcactctcattag

SEQ ID NO: 66535 - DNA, 18 bp, Artificial Sequence
  Synthetic DNA
tcatatgactcgcttttg

SEQ ID NO: 66536 - DNA, 18 bp, Artificial Sequence
  Synthetic DNA
tcatattaccctatattg

SEQ ID NO: 66537 - DNA, 18 bp, Artificial Sequence
  Synthetic DNA
tcatccaacttacaaatg

SEQ ID NO: 66538 - DNA, 18 bp, Artificial Sequence
  Synthetic DNA
tcatccgaatcattttag

SEQ ID NO: 66539 - DNA, 18 bp, Artificial Sequence
  Synthetic DNA
tcatccgatcctataacg

SEQ ID NO: 66540 - DNA, 18 bp, Artificial Sequence
  Synthetic DNA
tcatgcgacgcatagaag

SEQ ID NO: 66541 - DNA, 18 bp, Artificial Sequence
  Synthetic DNA
tcatgggacacacaatag

SEQ ID NO: 66542 - DNA, 18 bp, Artificial Sequence
  Synthetic DNA
tcatgtgtctcaatatag

SEQ ID NO: 66543 - DNA, 18 bp, Artificial Sequence
  Synthetic DNA
tcattcgcttcgctatcg

SEQ ID NO: 66544 - DNA, 18 bp, Artificial Sequence
  Synthetic DNA
tcattcgcttctctctag

SEQ ID NO: 66545 - DNA, 18 bp, Artificial Sequence
  Synthetic DNA
tcattcggctcagtatcg

SEQ ID NO: 66546 - DNA, 18 bp, Artificial Sequence
  Synthetic DNA
tcattcgtctcaataacg

SEQ ID NO: 66547 - DNA, 18 bp, Artificial Sequence
  Synthetic DNA
tcattcgtttaactatag

SEQ ID NO: 66548 - DNA, 18 bp, Artificial Sequence
  Synthetic DNA
tcattgaactaactcgtg

SEQ ID NO: 66549 - DNA, 18 bp, Artificial Sequence
  Synthetic DNA
tcccacgactcaagcaag

SEQ ID NO: 66550 - DNA, 18 bp, Artificial Sequence
  Synthetic DNA
tcctactttacactttag

SEQ ID NO: 66551 - DNA, 18 bp, Artificial Sequence
  Synthetic DNA
tccttcaactcgccaaag

SEQ ID NO: 66552 - DNA, 18 bp, Artificial Sequence
  Synthetic DNA
tccttcgattgaatattg

SEQ ID NO: 66553 - DNA, 18 bp, Artificial Sequence
  Synthetic DNA
tcgaaccaaacactattg

SEQ ID NO: 66554 - DNA, 18 bp, Artificial Sequence
  Synthetic DNA
tcggacctcacactatag

SEQ ID NO: 66555 - DNA, 18 bp, Artificial Sequence
  Synthetic DNA
tcgtaccattaacgaatg

SEQ ID NO: 66556 - DNA, 18 bp, Artificial Sequence
  Synthetic DNA
tcgtacgacactctatcg

SEQ ID NO: 66557 - DNA, 18 bp, Artificial Sequence
  Synthetic DNA
tcgtactatttacaatag

SEQ ID NO: 66558 - DNA, 18 bp, Artificial Sequence
  Synthetic DNA
tctaaccactcaccattg

SEQ ID NO: 66559 - DNA, 18 bp, Artificial Sequence
  Synthetic DNA
tcttaccactcactactg

SEQ ID NO: 66560 - DNA, 18 bp, Artificial Sequence
  Synthetic DNA
tcttacgaatctgtatag

SEQ ID NO: 66561 - DNA, 18 bp, Artificial Sequence
  Synthetic DNA
tcttacgacacggtttag

SEQ ID NO: 66562 - DNA, 18 bp, Artificial Sequence
  Synthetic DNA
tcttccaactcagttcag

SEQ ID NO: 66563 - DNA, 18 bp, Artificial Sequence
  Synthetic DNA
tcttcccattcaatatag

SEQ ID NO: 66564 - DNA, 18 bp, Artificial Sequence
  Synthetic DNA
tctttcaactgactaaag

SEQ ID NO: 66565 - DNA, 18 bp, Artificial Sequence
  Synthetic DNA
tctttcgactctatatag

SEQ ID NO: 66566 - DNA, 18 bp, Artificial Sequence
  Synthetic DNA
tctttggtcttactattg

SEQ ID NO: 66567 - DNA, 18 bp, Artificial Sequence
  Synthetic DNA
tgaaacaacacactatgg

SEQ ID NO: 66568 - DNA, 18 bp, Artificial Sequence
  Synthetic DNA
tgaaacaactcactttgg

SEQ ID NO: 66569 - DNA, 18 bp, Artificial Sequence
  Synthetic DNA
tgaaaccactctctggag

SEQ ID NO: 66570 - DNA, 18 bp, Artificial Sequence
  Synthetic DNA
tgaaaccgctcaataaag

SEQ ID NO: 66571 - DNA, 18 bp, Artificial Sequence
  Synthetic DNA
tgaaacgattgactattg

SEQ ID NO: 66572 - DNA, 18 bp, Artificial Sequence
  Synthetic DNA
tgaaacggcacactattg

SEQ ID NO: 66573 - DNA, 18 bp, Artificial Sequence
  Synthetic DNA
tgaaattacccaatttcg

SEQ ID NO: 66574 - DNA, 18 bp, Artificial Sequence
  Synthetic DNA
tgaaattactctctatag

SEQ ID NO: 66575 - DNA, 18 bp, Artificial Sequence
  Synthetic DNA
tgaagcatctcattatag

SEQ ID NO: 66576 - DNA, 18 bp, Artificial Sequence
  Synthetic DNA
tgaagcgattcacaattg

SEQ ID NO: 66577 - DNA, 18 bp, Artificial Sequence
  Synthetic DNA
tgaatcttttaaagatag

SEQ ID NO: 66578 - DNA, 18 bp, Artificial Sequence
  Synthetic DNA
tgacaagactcacaacgg

SEQ ID NO: 66579 - DNA, 18 bp, Artificial Sequence
  Synthetic DNA
tgacacgatttacataag

SEQ ID NO: 66580 - DNA, 18 bp, Artificial Sequence
  Synthetic DNA
tgacacgatttaccttag

SEQ ID NO: 66581 - DNA, 18 bp, Artificial Sequence
  Synthetic DNA
tgactcaactcactattg

SEQ ID NO: 66582 - DNA, 18 bp, Artificial Sequence
  Synthetic DNA
tgatacaacttacttatg

SEQ ID NO: 66583 - DNA, 18 bp, Artificial Sequence
  Synthetic DNA
tgatacgaatctcttcag

SEQ ID NO: 66584 - DNA, 18 bp, Artificial Sequence
  Synthetic DNA
tgatacgacacaccttcg

SEQ ID NO: 66585 - DNA, 18 bp, Artificial Sequence
  Synthetic DNA
tgatacgacgcaccaccg

SEQ ID NO: 66586 - DNA, 18 bp, Artificial Sequence
  Synthetic DNA
tgatacgactctctgagg

SEQ ID NO: 66587 - DNA, 18 bp, Artificial Sequence
  Synthetic DNA
tgatacgatttagtagag

SEQ ID NO: 66588 - DNA, 18 bp, Artificial Sequence
  Synthetic DNA
tgatacgcacaactatcg

SEQ ID NO: 66589 - DNA, 18 bp, Artificial Sequence
  Synthetic DNA
tgatacgcgtcacgtaag

SEQ ID NO: 66590 - DNA, 18 bp, Artificial Sequence
  Synthetic DNA
tgatacgctccacgatag

SEQ ID NO: 66591 - DNA, 18 bp, Artificial Sequence
  Synthetic DNA
tgatacgtctccccattg

SEQ ID NO: 66592 - DNA, 18 bp, Artificial Sequence
  Synthetic DNA
tgatacgtctctccaaag

SEQ ID NO: 66593 - DNA, 18 bp, Artificial Sequence
  Synthetic DNA
tgatactggtcagtatag

SEQ ID NO: 66594 - DNA, 18 bp, Artificial Sequence
  Synthetic DNA
tgatccctttcactaagg

SEQ ID NO: 66595 - DNA, 18 bp, Artificial Sequence
  Synthetic DNA
tgatgctacgctttattg

SEQ ID NO: 66596 - DNA, 18 bp, Artificial Sequence
  Synthetic DNA
tgattagactcactaatg

SEQ ID NO: 66597 - DNA, 18 bp, Artificial Sequence
  Synthetic DNA
tgattcgactcaattcag

SEQ ID NO: 66598 - DNA, 18 bp, Artificial Sequence
  Synthetic DNA
tgattcgtttgacaattg

SEQ ID NO: 66599 - DNA, 18 bp, Artificial Sequence
  Synthetic DNA
tgattgaactaacttctg

SEQ ID NO: 66600 - DNA, 18 bp, Artificial Sequence
  Synthetic DNA
tgcaacgaataactatag

SEQ ID NO: 66601 - DNA, 18 bp, Artificial Sequence
  Synthetic DNA
tgccgtgatttactatcg

SEQ ID NO: 66602 - DNA, 18 bp, Artificial Sequence
  Synthetic DNA
tgcgacgacactctttag

SEQ ID NO: 66603 - DNA, 18 bp, Artificial Sequence
  Synthetic DNA
tgcttcgacacagtgatg

SEQ ID NO: 66604 - DNA, 18 bp, Artificial Sequence
  Synthetic DNA
tggaacgagttactatag

SEQ ID NO: 66605 - DNA, 18 bp, Artificial Sequence
  Synthetic DNA
tggaccgaacctctatag

SEQ ID NO: 66606 - DNA, 18 bp, Artificial Sequence
  Synthetic DNA
tggcgcgatacactattg

SEQ ID NO: 66607 - DNA, 18 bp, Artificial Sequence
  Synthetic DNA
tggtacgtcgcactattg

SEQ ID NO: 66608 - DNA, 18 bp, Artificial Sequence
  Synthetic DNA
tggtactactcacactag

SEQ ID NO: 66609 - DNA, 18 bp, Artificial Sequence
  Synthetic DNA
tgtaacgacactatatag

SEQ ID NO: 66610 - DNA, 18 bp, Artificial Sequence
  Synthetic DNA
tgtaacgactcaacattg

SEQ ID NO: 66611 - DNA, 18 bp, Artificial Sequence
  Synthetic DNA
tgtaacgacttagtatag

SEQ ID NO: 66612 - DNA, 18 bp, Artificial Sequence
  Synthetic DNA
tgtaacgtttaaccttag

SEQ ID NO: 66613 - DNA, 18 bp, Artificial Sequence
  Synthetic DNA
tgtaacttctcactatag

SEQ ID NO: 66614 - DNA, 18 bp, Artificial Sequence
  Synthetic DNA
tgtatcgtcataccattg

SEQ ID NO: 66615 - DNA, 18 bp, Artificial Sequence
  Synthetic DNA
tgtgacgtcttactttag

SEQ ID NO: 66616 - DNA, 18 bp, Artificial Sequence
  Synthetic DNA
tgttaagacactctattg

SEQ ID NO: 66617 - DNA, 18 bp, Artificial Sequence
  Synthetic DNA
tgttaatacacagtatag

SEQ ID NO: 66618 - DNA, 18 bp, Artificial Sequence
  Synthetic DNA
tgttaatactcactgaag

SEQ ID NO: 66619 - DNA, 18 bp, Artificial Sequence
  Synthetic DNA
tgttactaatcaccatag

SEQ ID NO: 66620 - DNA, 18 bp, Artificial Sequence
  Synthetic DNA
tgttactacaagctatag

SEQ ID NO: 66621 - DNA, 18 bp, Artificial Sequence
  Synthetic DNA
tgttgcgtctcacgggag

SEQ ID NO: 66622 - DNA, 18 bp, Artificial Sequence
  Synthetic DNA
tgttgctactcacaatag

SEQ ID NO: 66623 - DNA, 18 bp, Artificial Sequence
  Synthetic DNA
tgtttcgtctcaccatcg

SEQ ID NO: 66624 - DNA, 18 bp, Artificial Sequence
  Synthetic DNA
ttaaaaaattcactatag

SEQ ID NO: 66625 - DNA, 18 bp, Artificial Sequence
  Synthetic DNA
ttaaaagatacactatag

SEQ ID NO: 66626 - DNA, 18 bp, Artificial Sequence
  Synthetic DNA
ttaaacaacatactcatg

SEQ ID NO: 66627 - DNA, 18 bp, Artificial Sequence
  Synthetic DNA
ttaaacgacacactactg

SEQ ID NO: 66628 - DNA, 18 bp, Artificial Sequence
  Synthetic DNA
ttaaacgaccgtatatag

SEQ ID NO: 66629 - DNA, 18 bp, Artificial Sequence
  Synthetic DNA
ttaaacgactctcttcgg

SEQ ID NO: 66630 - DNA, 18 bp, Artificial Sequence
  Synthetic DNA
ttaaacgacttactcaag

SEQ ID NO: 66631 - DNA, 18 bp, Artificial Sequence
  Synthetic DNA
ttaaacggctcaatatgg

SEQ ID NO: 66632 - DNA, 18 bp, Artificial Sequence
  Synthetic DNA
ttaaactactcaatctag

SEQ ID NO: 66633 - DNA, 18 bp, Artificial Sequence
  Synthetic DNA
ttaaactactcacttcag

SEQ ID NO: 66634 - DNA, 18 bp, Artificial Sequence
  Synthetic DNA
ttaaactactctctttag

SEQ ID NO: 66635 - DNA, 18 bp, Artificial Sequence
  Synthetic DNA
ttaaactagtctctacag

SEQ ID NO: 66636 - DNA, 18 bp, Artificial Sequence
  Synthetic DNA
ttaaactgctcactatcg

SEQ ID NO: 66637 - DNA, 18 bp, Artificial Sequence
  Synthetic DNA
ttaaaggtatcactatag

SEQ ID NO: 66638 - DNA, 18 bp, Artificial Sequence
  Synthetic DNA
ttaaatcacctactatag

SEQ ID NO: 66639 - DNA, 18 bp, Artificial Sequence
  Synthetic DNA
ttaaatgcctcactattg

SEQ ID NO: 66640 - DNA, 18 bp, Artificial Sequence
  Synthetic DNA
ttaaatggctcactaatg

SEQ ID NO: 66641 - DNA, 18 bp, Artificial Sequence
  Synthetic DNA
ttaaccgacccacattgg

SEQ ID NO: 66642 - DNA, 18 bp, Artificial Sequence
  Synthetic DNA
ttaaccgactaaatatag

SEQ ID NO: 66643 - DNA, 18 bp, Artificial Sequence
  Synthetic DNA
ttaaccgattctcacaag

SEQ ID NO: 66644 - DNA, 18 bp, Artificial Sequence
  Synthetic DNA
ttaagcgactcgatatag

SEQ ID NO: 66645 - DNA, 18 bp, Artificial Sequence
  Synthetic DNA
ttaagcgactggctgtgg

SEQ ID NO: 66646 - DNA, 18 bp, Artificial Sequence
  Synthetic DNA
ttaatattctatctatag

SEQ ID NO: 66647 - DNA, 18 bp, Artificial Sequence
  Synthetic DNA
ttaatcgactcaatacag

SEQ ID NO: 66648 - DNA, 18 bp, Artificial Sequence
  Synthetic DNA
ttaatcgattaccaatag

SEQ ID NO: 66649 - DNA, 18 bp, Artificial Sequence
  Synthetic DNA
ttaatcgtctgactaaag

SEQ ID NO: 66650 - DNA, 18 bp, Artificial Sequence
  Synthetic DNA
ttaatctactgactttag

SEQ ID NO: 66651 - DNA, 18 bp, Artificial Sequence
  Synthetic DNA
ttaattgactcattaaag

SEQ ID NO: 66652 - DNA, 18 bp, Artificial Sequence
  Synthetic DNA
ttaattgtcacgctaccg

SEQ ID NO: 66653 - DNA, 18 bp, Artificial Sequence
  Synthetic DNA
ttacacagcacattatag

SEQ ID NO: 66654 - DNA, 18 bp, Artificial Sequence
  Synthetic DNA
ttacaccatacactatag

SEQ ID NO: 66655 - DNA, 18 bp, Artificial Sequence
  Synthetic DNA
ttacacgacactgtatcg

SEQ ID NO: 66656 - DNA, 18 bp, Artificial Sequence
  Synthetic DNA
ttacacgactcaagacag

SEQ ID NO: 66657 - DNA, 18 bp, Artificial Sequence
  Synthetic DNA
ttacacgactcataaaag

SEQ ID NO: 66658 - DNA, 18 bp, Artificial Sequence
  Synthetic DNA
ttacacgactctcaattg

SEQ ID NO: 66659 - DNA, 18 bp, Artificial Sequence
  Synthetic DNA
ttacacgattaactcttg

SEQ ID NO: 66660 - DNA, 18 bp, Artificial Sequence
  Synthetic DNA
ttacacgtctccctattg

SEQ ID NO: 66661 - DNA, 18 bp, Artificial Sequence
  Synthetic DNA
ttacactactagctacag

SEQ ID NO: 66662 - DNA, 18 bp, Artificial Sequence
  Synthetic DNA
ttacagggctctgtttag

SEQ ID NO: 66663 - DNA, 18 bp, Artificial Sequence
  Synthetic DNA
ttacatgacttactctag

SEQ ID NO: 66664 - DNA, 18 bp, Artificial Sequence
  Synthetic DNA
ttacctgactccctatag

SEQ ID NO: 66665 - DNA, 18 bp, Artificial Sequence
  Synthetic DNA
ttacgcgagttgctatag

SEQ ID NO: 66666 - DNA, 18 bp, Artificial Sequence
  Synthetic DNA
ttactcgaatcactcttg

SEQ ID NO: 66667 - DNA, 18 bp, Artificial Sequence
  Synthetic DNA
ttactcgatttactatag

SEQ ID NO: 66668 - DNA, 18 bp, Artificial Sequence
  Synthetic DNA
ttacttgactcgctatag

SEQ ID NO: 66669 - DNA, 18 bp, Artificial Sequence
  Synthetic DNA
ttagacgaaaaactgttg

SEQ ID NO: 66670 - DNA, 18 bp, Artificial Sequence
  Synthetic DNA
ttagacgttttactttag

SEQ ID NO: 66671 - DNA, 18 bp, Artificial Sequence
  Synthetic DNA
ttagtagactcaatatag

SEQ ID NO: 66672 - DNA, 18 bp, Artificial Sequence
  Synthetic DNA
ttagttgacgctttatag

SEQ ID NO: 66673 - DNA, 18 bp, Artificial Sequence
  Synthetic DNA
ttataagacatacttaag

SEQ ID NO: 66674 - DNA, 18 bp, Artificial Sequence
  Synthetic DNA
ttataagactctccttag

SEQ ID NO: 66675 - DNA, 18 bp, Artificial Sequence
  Synthetic DNA
ttataagagacattatag

SEQ ID NO: 66676 - DNA, 18 bp, Artificial Sequence
  Synthetic DNA
ttataagagactcaattg

SEQ ID NO: 66677 - DNA, 18 bp, Artificial Sequence
  Synthetic DNA
ttataagattctctattg

SEQ ID NO: 66678 - DNA, 18 bp, Artificial Sequence
  Synthetic DNA
ttataagcctcactcaag

SEQ ID NO: 66679 - DNA, 18 bp, Artificial Sequence
  Synthetic DNA
ttataagtaacattatag

SEQ ID NO: 66680 - DNA, 18 bp, Artificial Sequence
  Synthetic DNA
ttataagtctctctagag

SEQ ID NO: 66681 - DNA, 18 bp, Artificial Sequence
  Synthetic DNA
ttataatgcacactcgag

SEQ ID NO: 66682 - DNA, 18 bp, Artificial Sequence
  Synthetic DNA
ttatacaaatcactgatg

SEQ ID NO: 66683 - DNA, 18 bp, Artificial Sequence
  Synthetic DNA
ttatacaaatctatcaag

SEQ ID NO: 66684 - DNA, 18 bp, Artificial Sequence
  Synthetic DNA
ttatacaacatacacaag

SEQ ID NO: 66685 - DNA, 18 bp, Artificial Sequence
  Synthetic DNA
ttatacaactcacatgag

SEQ ID NO: 66686 - DNA, 18 bp, Artificial Sequence
  Synthetic DNA
ttatacaactctctccag

SEQ ID NO: 66687 - DNA, 18 bp, Artificial Sequence
  Synthetic DNA
ttatacaacttcttatag

SEQ ID NO: 66688 - DNA, 18 bp, Artificial Sequence
  Synthetic DNA
ttatacactacactaagg

SEQ ID NO: 66689 - DNA, 18 bp, Artificial Sequence
  Synthetic DNA
ttatacctctcgctatcg

SEQ ID NO: 66690 - DNA, 18 bp, Artificial Sequence
  Synthetic DNA
ttatacgaaacagcttag

SEQ ID NO: 66691 - DNA, 18 bp, Artificial Sequence
  Synthetic DNA
ttatacgaacctgtattg

SEQ ID NO: 66692 - DNA, 18 bp, Artificial Sequence
  Synthetic DNA
ttatacgaagccaactag

SEQ ID NO: 66693 - DNA, 18 bp, Artificial Sequence
  Synthetic DNA
ttatacgaatcacagttg

SEQ ID NO: 66694 - DNA, 18 bp, Artificial Sequence
  Synthetic DNA
ttatacgacacagtcttg

SEQ ID NO: 66695 - DNA, 18 bp, Artificial Sequence
  Synthetic DNA
ttatacgacattcgttcg

SEQ ID NO: 66696 - DNA, 18 bp, Artificial Sequence
  Synthetic DNA
ttatacgaccatccctag

SEQ ID NO: 66697 - DNA, 18 bp, Artificial Sequence
  Synthetic DNA
ttatacgacgtacttatg

SEQ ID NO: 66698 - DNA, 18 bp, Artificial Sequence
  Synthetic DNA
ttatacgactcatattcg

SEQ ID NO: 66699 - DNA, 18 bp, Artificial Sequence
  Synthetic DNA
ttatacgactcatttagg

SEQ ID NO: 66700 - DNA, 18 bp, Artificial Sequence
  Synthetic DNA
ttatacgactggctctgg

SEQ ID NO: 66701 - DNA, 18 bp, Artificial Sequence
  Synthetic DNA
ttatacgactgtaaatag

SEQ ID NO: 66702 - DNA, 18 bp, Artificial Sequence
  Synthetic DNA
ttatacgactttaaatag

SEQ ID NO: 66703 - DNA, 18 bp, Artificial Sequence
  Synthetic DNA
ttatacgagcctacatag

SEQ ID NO: 66704 - DNA, 18 bp, Artificial Sequence
  Synthetic DNA
ttatacgagtcgagatag

SEQ ID NO: 66705 - DNA, 18 bp, Artificial Sequence
  Synthetic DNA
ttatacgatacaccttag

SEQ ID NO: 66706 - DNA, 18 bp, Artificial Sequence
  Synthetic DNA
ttatacgattcggtctcg

SEQ ID NO: 66707 - DNA, 18 bp, Artificial Sequence
  Synthetic DNA
ttatacgattctttttag

SEQ ID NO: 66708 - DNA, 18 bp, Artificial Sequence
  Synthetic DNA
ttatacggcaagctagag

SEQ ID NO: 66709 - DNA, 18 bp, Artificial Sequence
  Synthetic DNA
ttatacggctccaaaatg

SEQ ID NO: 66710 - DNA, 18 bp, Artificial Sequence
  Synthetic DNA
ttatacgtcagtatatgg

SEQ ID NO: 66711 - DNA, 18 bp, Artificial Sequence
  Synthetic DNA
ttatacgtctagctatgg

SEQ ID NO: 66712 - DNA, 18 bp, Artificial Sequence
  Synthetic DNA
ttatacgtctcataattg

SEQ ID NO: 66713 - DNA, 18 bp, Artificial Sequence
  Synthetic DNA
ttatacgtctcatattag

SEQ ID NO: 66714 - DNA, 18 bp, Artificial Sequence
  Synthetic DNA
ttatacgtctgacactag

SEQ ID NO: 66715 - DNA, 18 bp, Artificial Sequence
  Synthetic DNA
ttatacgtttcagtagag

SEQ ID NO: 66716 - DNA, 18 bp, Artificial Sequence
  Synthetic DNA
ttatacgtttcgctctag

SEQ ID NO: 66717 - DNA, 18 bp, Artificial Sequence
  Synthetic DNA
ttatacgtttctctttag

SEQ ID NO: 66718 - DNA, 18 bp, Artificial Sequence
  Synthetic DNA
ttatactactcttaatag

SEQ ID NO: 66719 - DNA, 18 bp, Artificial Sequence
  Synthetic DNA
ttatactatcaagtattg

SEQ ID NO: 66720 - DNA, 18 bp, Artificial Sequence
  Synthetic DNA
ttatactgcacccaaagg

SEQ ID NO: 66721 - DNA, 18 bp, Artificial Sequence
  Synthetic DNA
ttatacttcccacgagag

SEQ ID NO: 66722 - DNA, 18 bp, Artificial Sequence
  Synthetic DNA
ttatacttctcacttcag

SEQ ID NO: 66723 - DNA, 18 bp, Artificial Sequence
  Synthetic DNA
ttatagaacactctatag

SEQ ID NO: 66724 - DNA, 18 bp, Artificial Sequence
  Synthetic DNA
ttatagatctcacactag

SEQ ID NO: 66725 - DNA, 18 bp, Artificial Sequence
  Synthetic DNA
ttatagcactcaataaag

SEQ ID NO: 66726 - DNA, 18 bp, Artificial Sequence
  Synthetic DNA
ttataggagttactaaag

SEQ ID NO: 66727 - DNA, 18 bp, Artificial Sequence
  Synthetic DNA
ttataggtcattcaatag

SEQ ID NO: 66728 - DNA, 18 bp, Artificial Sequence
  Synthetic DNA
ttataggtctcacagttg

SEQ ID NO: 66729 - DNA, 18 bp, Artificial Sequence
  Synthetic DNA
ttataggtctccgtttag

SEQ ID NO: 66730 - DNA, 18 bp, Artificial Sequence
  Synthetic DNA
ttataggtctctcttttg

SEQ ID NO: 66731 - DNA, 18 bp, Artificial Sequence
  Synthetic DNA
ttatataacgcacattag

SEQ ID NO: 66732 - DNA, 18 bp, Artificial Sequence
  Synthetic DNA
ttatataacttactaaag

SEQ ID NO: 66733 - DNA, 18 bp, Artificial Sequence
  Synthetic DNA
ttatatcgatctgtatcg

SEQ ID NO: 66734 - DNA, 18 bp, Artificial Sequence
  Synthetic DNA
ttatatgaatcattagag

SEQ ID NO: 66735 - DNA, 18 bp, Artificial Sequence
  Synthetic DNA
ttatatgaatcattcaag

SEQ ID NO: 66736 - DNA, 18 bp, Artificial Sequence
  Synthetic DNA
ttatatgacgcccttaag

SEQ ID NO: 66737 - DNA, 18 bp, Artificial Sequence
  Synthetic DNA
ttatatgactcatttttg

SEQ ID NO: 66738 - DNA, 18 bp, Artificial Sequence
  Synthetic DNA
ttatatgactctatttag

SEQ ID NO: 66739 - DNA, 18 bp, Artificial Sequence
  Synthetic DNA
ttatatgacttgctttag

SEQ ID NO: 66740 - DNA, 18 bp, Artificial Sequence
  Synthetic DNA
ttatatgattcgctaagg

SEQ ID NO: 66741 - DNA, 18 bp, Artificial Sequence
  Synthetic DNA
ttatatgccatactatag

SEQ ID NO: 66742 - DNA, 18 bp, Artificial Sequence
  Synthetic DNA
ttatatgtctgtctaaag

SEQ ID NO: 66743 - DNA, 18 bp, Artificial Sequence
  Synthetic DNA
ttatatgtcttgctttag

SEQ ID NO: 66744 - DNA, 18 bp, Artificial Sequence
  Synthetic DNA
ttatattactcagtaaag

SEQ ID NO: 66745 - DNA, 18 bp, Artificial Sequence
  Synthetic DNA
ttatattactctatatag

SEQ ID NO: 66746 - DNA, 18 bp, Artificial Sequence
  Synthetic DNA
ttatcagatctagtattg

SEQ ID NO: 66747 - DNA, 18 bp, Artificial Sequence
  Synthetic DNA
ttatccaacatacttctg

SEQ ID NO: 66748 - DNA, 18 bp, Artificial Sequence
  Synthetic DNA
ttatccgaccctgtatag

SEQ ID NO: 66749 - DNA, 18 bp, Artificial Sequence
  Synthetic DNA
ttatccgactgacaatcg

SEQ ID NO: 66750 - DNA, 18 bp, Artificial Sequence
  Synthetic DNA
ttatcctattcactaaag

SEQ ID NO: 66751 - DNA, 18 bp, Artificial Sequence
  Synthetic DNA
ttatcggtcacactatag

SEQ ID NO: 66752 - DNA, 18 bp, Artificial Sequence
  Synthetic DNA
ttatctaactcactacag

SEQ ID NO: 66753 - DNA, 18 bp, Artificial Sequence
  Synthetic DNA
ttatgagactgacaaaag

SEQ ID NO: 66754 - DNA, 18 bp, Artificial Sequence
  Synthetic DNA
ttatgcaactcactaatg

SEQ ID NO: 66755 - DNA, 18 bp, Artificial Sequence
  Synthetic DNA
ttatgcaacttattatag

SEQ ID NO: 66756 - DNA, 18 bp, Artificial Sequence
  Synthetic DNA
ttatgcgactcatcatcg

SEQ ID NO: 66757 - DNA, 18 bp, Artificial Sequence
  Synthetic DNA
ttatgcgaggcactgtag

SEQ ID NO: 66758 - DNA, 18 bp, Artificial Sequence
  Synthetic DNA
ttatgcgattcacaattg

SEQ ID NO: 66759 - DNA, 18 bp, Artificial Sequence
  Synthetic DNA
ttatgcgtctcactgaag

SEQ ID NO: 66760 - DNA, 18 bp, Artificial Sequence
  Synthetic DNA
ttatgcgtctctctaaag

SEQ ID NO: 66761 - DNA, 18 bp, Artificial Sequence
  Synthetic DNA
ttattagatacgttaaag

SEQ ID NO: 66762 - DNA, 18 bp, Artificial Sequence
  Synthetic DNA
ttattagattcactttag

SEQ ID NO: 66763 - DNA, 18 bp, Artificial Sequence
  Synthetic DNA
ttattattctcactatag

SEQ ID NO: 66764 - DNA, 18 bp, Artificial Sequence
  Synthetic DNA
ttattcaacacactaaag

SEQ ID NO: 66765 - DNA, 18 bp, Artificial Sequence
  Synthetic DNA
ttattcaactcccaatag

SEQ ID NO: 66766 - DNA, 18 bp, Artificial Sequence
  Synthetic DNA
ttattccactcataacag

SEQ ID NO: 66767 - DNA, 18 bp, Artificial Sequence
  Synthetic DNA
ttattccagtaactttag

SEQ ID NO: 66768 - DNA, 18 bp, Artificial Sequence
  Synthetic DNA
ttattcgacacattttag

SEQ ID NO: 66769 - DNA, 18 bp, Artificial Sequence
  Synthetic DNA
ttattcgactaactaatg

SEQ ID NO: 66770 - DNA, 18 bp, Artificial Sequence
  Synthetic DNA
ttattcgacttaatttag

SEQ ID NO: 66771 - DNA, 18 bp, Artificial Sequence
  Synthetic DNA
ttattcgacttgacattg

SEQ ID NO: 66772 - DNA, 18 bp, Artificial Sequence
  Synthetic DNA
ttattcgagacactaaag

SEQ ID NO: 66773 - DNA, 18 bp, Artificial Sequence
  Synthetic DNA
ttattcgccacactattg

SEQ ID NO: 66774 - DNA, 18 bp, Artificial Sequence
  Synthetic DNA
ttattcggtacacttctg

SEQ ID NO: 66775 - DNA, 18 bp, Artificial Sequence
  Synthetic DNA
ttattcgtaccactttag

SEQ ID NO: 66776 - DNA, 18 bp, Artificial Sequence
  Synthetic DNA
ttattctactctctttag

SEQ ID NO: 66777 - DNA, 18 bp, Artificial Sequence
  Synthetic DNA
ttattctgcacactaaag

SEQ ID NO: 66778 - DNA, 18 bp, Artificial Sequence
  Synthetic DNA
ttattcttctcacaatag

SEQ ID NO: 66779 - DNA, 18 bp, Artificial Sequence
  Synthetic DNA
ttattcttttcacaacag

SEQ ID NO: 66780 - DNA, 18 bp, Artificial Sequence
  Synthetic DNA
ttattggactgactaatg

SEQ ID NO: 66781 - DNA, 18 bp, Artificial Sequence
  Synthetic DNA
ttattggtctcactaaag

SEQ ID NO: 66782 - DNA, 18 bp, Artificial Sequence
  Synthetic DNA
ttatttcactcaatattg

SEQ ID NO: 66783 - DNA, 18 bp, Artificial Sequence
  Synthetic DNA
ttatttgaataactatag

SEQ ID NO: 66784 - DNA, 18 bp, Artificial Sequence
  Synthetic DNA
ttatttgtctcactatcg

SEQ ID NO: 66785 - DNA, 18 bp, Artificial Sequence
  Synthetic DNA
ttattttaatctcattag

SEQ ID NO: 66786 - DNA, 18 bp, Artificial Sequence
  Synthetic DNA
ttcaaagactctctatag

SEQ ID NO: 66787 - DNA, 18 bp, Artificial Sequence
  Synthetic DNA
ttccacgagacactacag

SEQ ID NO: 66788 - DNA, 18 bp, Artificial Sequence
  Synthetic DNA
ttctaaggcatacaagcg

SEQ ID NO: 66789 - DNA, 18 bp, Artificial Sequence
  Synthetic DNA
ttctacgtcttactattg

SEQ ID NO: 66790 - DNA, 18 bp, Artificial Sequence
  Synthetic DNA
ttctatatctcacttttg

SEQ ID NO: 66791 - DNA, 18 bp, Artificial Sequence
  Synthetic DNA
ttctatgattctttagag

SEQ ID NO: 66792 - DNA, 18 bp, Artificial Sequence
  Synthetic DNA
ttctattactaagtatag

SEQ ID NO: 66793 - DNA, 18 bp, Artificial Sequence
  Synthetic DNA
ttctcagacacatcttag

SEQ ID NO: 66794 - DNA, 18 bp, Artificial Sequence
  Synthetic DNA
ttctgcgacattcaaccg

SEQ ID NO: 66795 - DNA, 18 bp, Artificial Sequence
  Synthetic DNA
ttcttcaactcactacag

SEQ ID NO: 66796 - DNA, 18 bp, Artificial Sequence
  Synthetic DNA
ttgaaacatttacatttg

SEQ ID NO: 66797 - DNA, 18 bp, Artificial Sequence
  Synthetic DNA
ttgaacaactctcaatag

SEQ ID NO: 66798 - DNA, 18 bp, Artificial Sequence
  Synthetic DNA
ttgaacgactagctatag

SEQ ID NO: 66799 - DNA, 18 bp, Artificial Sequence
  Synthetic DNA
ttgaacgtctcacagtag

SEQ ID NO: 66800 - DNA, 18 bp, Artificial Sequence
  Synthetic DNA
ttgagctactgaataaag

SEQ ID NO: 66801 - DNA, 18 bp, Artificial Sequence
  Synthetic DNA
ttgattgactctctattg

SEQ ID NO: 66802 - DNA, 18 bp, Artificial Sequence
  Synthetic DNA
ttgctctactcactaaag

SEQ ID NO: 66803 - DNA, 18 bp, Artificial Sequence
  Synthetic DNA
ttggaagacttactattg

SEQ ID NO: 66804 - DNA, 18 bp, Artificial Sequence
  Synthetic DNA
ttgtaacaatcattccag

SEQ ID NO: 66805 - DNA, 18 bp, Artificial Sequence
  Synthetic DNA
ttgtaagactctctaaag

SEQ ID NO: 66806 - DNA, 18 bp, Artificial Sequence
  Synthetic DNA
ttgtacgactaacagtag

SEQ ID NO: 66807 - DNA, 18 bp, Artificial Sequence
  Synthetic DNA
ttgtacgtctcattattg

SEQ ID NO: 66808 - DNA, 18 bp, Artificial Sequence
  Synthetic DNA
ttgtactactaacgtttg

SEQ ID NO: 66809 - DNA, 18 bp, Artificial Sequence
  Synthetic DNA
ttgtaggagtgactttag

SEQ ID NO: 66810 - DNA, 18 bp, Artificial Sequence
  Synthetic DNA
ttgtccgtataactgaag

SEQ ID NO: 66811 - DNA, 18 bp, Artificial Sequence
  Synthetic DNA
ttgttcgactcacttatg

SEQ ID NO: 66812 - DNA, 18 bp, Artificial Sequence
  Synthetic DNA
ttgttcgagtcgctatag

SEQ ID NO: 66813 - DNA, 18 bp, Artificial Sequence
  Synthetic DNA
ttgttcgtcttactacag

SEQ ID NO: 66814 - DNA, 18 bp, Artificial Sequence
  Synthetic DNA
tttaaagacacactatag

SEQ ID NO: 66815 - DNA, 18 bp, Artificial Sequence
  Synthetic DNA
tttaaagactcactattg

SEQ ID NO: 66816 - DNA, 18 bp, Artificial Sequence
  Synthetic DNA
tttaacaactgattatag

SEQ ID NO: 66817 - DNA, 18 bp, Artificial Sequence
  Synthetic DNA
tttaacgaatcaatattg

SEQ ID NO: 66818 - DNA, 18 bp, Artificial Sequence
  Synthetic DNA
tttaacgactcaccattg

SEQ ID NO: 66819 - DNA, 18 bp, Artificial Sequence
  Synthetic DNA
tttaacgactgactattg

SEQ ID NO: 66820 - DNA, 18 bp, Artificial Sequence
  Synthetic DNA
tttaacggctcataaggg

SEQ ID NO: 66821 - DNA, 18 bp, Artificial Sequence
  Synthetic DNA
tttaacgtttcactatag

SEQ ID NO: 66822 - DNA, 18 bp, Artificial Sequence
  Synthetic DNA
tttaactacacactatag

SEQ ID NO: 66823 - DNA, 18 bp, Artificial Sequence
  Synthetic DNA
tttaaggattcacaatag

SEQ ID NO: 66824 - DNA, 18 bp, Artificial Sequence
  Synthetic DNA
tttaaggattcattatag

SEQ ID NO: 66825 - DNA, 18 bp, Artificial Sequence
  Synthetic DNA
tttaccgattcaccatag

SEQ ID NO: 66826 - DNA, 18 bp, Artificial Sequence
  Synthetic DNA
tttatcgacttaaaacag

SEQ ID NO: 66827 - DNA, 18 bp, Artificial Sequence
  Synthetic DNA
tttatcgatacactattg

SEQ ID NO: 66828 - DNA, 18 bp, Artificial Sequence
  Synthetic DNA
tttcacgacacactgtag

SEQ ID NO: 66829 - DNA, 18 bp, Artificial Sequence
  Synthetic DNA
tttcacgacttaccatag

SEQ ID NO: 66830 - DNA, 18 bp, Artificial Sequence
  Synthetic DNA
tttcacgtatcattatag

SEQ ID NO: 66831 - DNA, 18 bp, Artificial Sequence
  Synthetic DNA
tttctcgactcattatag

SEQ ID NO: 66832 - DNA, 18 bp, Artificial Sequence
  Synthetic DNA
tttgatgtctcactatag

SEQ ID NO: 66833 - DNA, 18 bp, Artificial Sequence
  Synthetic DNA
tttggaacctccccctgg

SEQ ID NO: 66834 - DNA, 18 bp, Artificial Sequence
  Synthetic DNA
ttttaacacattctaaag

SEQ ID NO: 66835 - DNA, 18 bp, Artificial Sequence
  Synthetic DNA
ttttaacactcactatcg

SEQ ID NO: 66836 - DNA, 18 bp, Artificial Sequence
  Synthetic DNA
ttttaagactccctatgg

SEQ ID NO: 66837 - DNA, 18 bp, Artificial Sequence
  Synthetic DNA
ttttaatactccctagag

SEQ ID NO: 66838 - DNA, 18 bp, Artificial Sequence
  Synthetic DNA
ttttacaacacacttttg

SEQ ID NO: 66839 - DNA, 18 bp, Artificial Sequence
  Synthetic DNA
ttttacaactccagttag

SEQ ID NO: 66840 - DNA, 18 bp, Artificial Sequence
  Synthetic DNA
ttttacaattcactaagg

SEQ ID NO: 66841 - DNA, 18 bp, Artificial Sequence
  Synthetic DNA
ttttacgaataattttag

SEQ ID NO: 66842 - DNA, 18 bp, Artificial Sequence
  Synthetic DNA
ttttacgacacaatttag

SEQ ID NO: 66843 - DNA, 18 bp, Artificial Sequence
  Synthetic DNA
ttttacgacactctatgg

SEQ ID NO: 66844 - DNA, 18 bp, Artificial Sequence
  Synthetic DNA
ttttacgactcacttacg

SEQ ID NO: 66845 - DNA, 18 bp, Artificial Sequence
  Synthetic DNA
ttttacgagtcatagtgg

SEQ ID NO: 66846 - DNA, 18 bp, Artificial Sequence
  Synthetic DNA
ttttacgcctgactattg

SEQ ID NO: 66847 - DNA, 18 bp, Artificial Sequence
  Synthetic DNA
ttttacggcttcctctag

SEQ ID NO: 66848 - DNA, 18 bp, Artificial Sequence
  Synthetic DNA
ttttacgtctcaataaag

SEQ ID NO: 66849 - DNA, 18 bp, Artificial Sequence
  Synthetic DNA
ttttactaaacacttaag

SEQ ID NO: 66850 - DNA, 18 bp, Artificial Sequence
  Synthetic DNA
ttttactactcgctaaag

SEQ ID NO: 66851 - DNA, 18 bp, Artificial Sequence
  Synthetic DNA
ttttactactttctatag

SEQ ID NO: 66852 - DNA, 18 bp, Artificial Sequence
  Synthetic DNA
ttttagtattgacaatag

SEQ ID NO: 66853 - DNA, 18 bp, Artificial Sequence
  Synthetic DNA
ttttagtgataattatag

SEQ ID NO: 66854 - DNA, 18 bp, Artificial Sequence
  Synthetic DNA
ttttatgatacactattg

SEQ ID NO: 66855 - DNA, 18 bp, Artificial Sequence
  Synthetic DNA
ttttattattcactatag

SEQ ID NO: 66856 - DNA, 18 bp, Artificial Sequence
  Synthetic DNA
ttttcagactcactctag

SEQ ID NO: 66857 - DNA, 18 bp, Artificial Sequence
  Synthetic DNA
ttttccgactcagtcttg

SEQ ID NO: 66858 - DNA, 18 bp, Artificial Sequence
  Synthetic DNA
ttttccgtctcactttag

SEQ ID NO: 66859 - DNA, 18 bp, Artificial Sequence
  Synthetic DNA
ttttctcactctctatag

SEQ ID NO: 66860 - DNA, 18 bp, Artificial Sequence
  Synthetic DNA
ttttcttactgtcaatag

SEQ ID NO: 66861 - DNA, 18 bp, Artificial Sequence
  Synthetic DNA
tttttcatcttactttag

SEQ ID NO: 66862 - DNA, 18 bp, Artificial Sequence
  Synthetic DNA
tttttccaatcgctatag

SEQ ID NO: 66863 - DNA, 18 bp, Artificial Sequence
  Synthetic DNA
tttttcgactctctctgg

SEQ ID NO: 66864 - DNA, 18 bp, Artificial Sequence
  Synthetic DNA
tttttctactcgctatag

SEQ ID NO: 66865 - DNA, 18 bp, Artificial Sequence
  Synthetic DNA
aaatacgactttcttaag

SEQ ID NO: 66866 - DNA, 18 bp, Artificial Sequence
  Synthetic DNA
aaatacgaattacttaag

SEQ ID NO: 66867 - DNA, 18 bp, Artificial Sequence
  Synthetic DNA
aacaacgactaactattg

SEQ ID NO: 66868 - DNA, 18 bp, Artificial Sequence
  Synthetic DNA
aactatgagtcattcaag

SEQ ID NO: 66869 - DNA, 18 bp, Artificial Sequence
  Synthetic DNA
aataacgtctctgtatag

SEQ ID NO: 66870 - DNA, 18 bp, Artificial Sequence
  Synthetic DNA
atatactacacactttag

SEQ ID NO: 66871 - DNA, 18 bp, Artificial Sequence
  Synthetic DNA
atctaactctcactatgg

SEQ ID NO: 66872 - DNA, 18 bp, Artificial Sequence
  Synthetic DNA
atctcctactcactatag

SEQ ID NO: 66873 - DNA, 18 bp, Artificial Sequence
  Synthetic DNA
caaatcgacactctattg

SEQ ID NO: 66874 - DNA, 18 bp, Artificial Sequence
  Synthetic DNA
ctattagactcactttag

SEQ ID NO: 66875 - DNA, 18 bp, Artificial Sequence
  Synthetic DNA
taaaacgtcacactttcg

SEQ ID NO: 66876 - DNA, 18 bp, Artificial Sequence
  Synthetic DNA
taataagtcacattaaag

SEQ ID NO: 66877 - DNA, 18 bp, Artificial Sequence
  Synthetic DNA
taatacaagttaatttag

SEQ ID NO: 66878 - DNA, 18 bp, Artificial Sequence
  Synthetic DNA
taatactaaaccctattg

SEQ ID NO: 66879 - DNA, 18 bp, Artificial Sequence
  Synthetic DNA
taatccgactcttaattg

SEQ ID NO: 66880 - DNA, 18 bp, Artificial Sequence
  Synthetic DNA
taatgcgattctatattg

SEQ ID NO: 66881 - DNA, 18 bp, Artificial Sequence
  Synthetic DNA
taattcgaataaccattg

SEQ ID NO: 66882 - DNA, 18 bp, Artificial Sequence
  Synthetic DNA
tatatcgactcacaaaag

SEQ ID NO: 66883 - DNA, 18 bp, Artificial Sequence
  Synthetic DNA
tatatcgttactcgattg

SEQ ID NO: 66884 - DNA, 18 bp, Artificial Sequence
  Synthetic DNA
tattacatctaactttag

SEQ ID NO: 66885 - DNA, 18 bp, Artificial Sequence
  Synthetic DNA
tattacgacttacaaacg

SEQ ID NO: 66886 - DNA, 18 bp, Artificial Sequence
  Synthetic DNA
tattccgactttctattg

SEQ ID NO: 66887 - DNA, 18 bp, Artificial Sequence
  Synthetic DNA
tatttcgacacgctaaag

SEQ ID NO: 66888 - DNA, 18 bp, Artificial Sequence
  Synthetic DNA
tatttcgactcaataatg

SEQ ID NO: 66889 - DNA, 18 bp, Artificial Sequence
  Synthetic DNA
tattttgactcacaaaag

SEQ ID NO: 66890 - DNA, 18 bp, Artificial Sequence
  Synthetic DNA
tcaacccactcacaatag

SEQ ID NO: 66891 - DNA, 18 bp, Artificial Sequence
  Synthetic DNA
tcaatcgacccactattg

SEQ ID NO: 66892 - DNA, 18 bp, Artificial Sequence
  Synthetic DNA
tcgttcaactcactttag

SEQ ID NO: 66893 - DNA, 18 bp, Artificial Sequence
  Synthetic DNA
ttacacgtctctctattg

SEQ ID NO: 66894 - DNA, 18 bp, Artificial Sequence
  Synthetic DNA
ttatacgattatctttag

SEQ ID NO: 66895 - DNA, 18 bp, Artificial Sequence
  Synthetic DNA
ttattagcctctctatag

SEQ ID NO: 66896 - DNA, 18 bp, Artificial Sequence
  Synthetic DNA
tataacatctctctatag

SEQ ID NO: 66897 - DNA, 18 bp, Artificial Sequence
  Synthetic DNA
tattacgtctcacatttg

SEQ ID NO: 66898 - DNA, 18 bp, Artificial Sequence
  Synthetic DNA
aaaaacgacactcaatag

SEQ ID NO: 66899 - DNA, 18 bp, Artificial Sequence
  Synthetic DNA
aaaaacgacccaccttag

SEQ ID NO: 66900 - DNA, 18 bp, Artificial Sequence
  Synthetic DNA
aaatacatctcattattg

SEQ ID NO: 66901 - DNA, 18 bp, Artificial Sequence
  Synthetic DNA
aaatacatctctctattg

SEQ ID NO: 66902 - DNA, 18 bp, Artificial Sequence
  Synthetic DNA
aaattcgacgcactactg

SEQ ID NO: 66903 - DNA, 18 bp, Artificial Sequence
  Synthetic DNA
aagaatgtctcactaaag

SEQ ID NO: 66904 - DNA, 18 bp, Artificial Sequence
  Synthetic DNA
aattacgattcacttaag

SEQ ID NO: 66905 - DNA, 18 bp, Artificial Sequence
  Synthetic DNA
agaaacgactcaccacag

SEQ ID NO: 66906 - DNA, 18 bp, Artificial Sequence
  Synthetic DNA
ataaacgccttactagag

SEQ ID NO: 66907 - DNA, 18 bp, Artificial Sequence
  Synthetic DNA
ctatattacttacaatag

SEQ ID NO: 66908 - DNA, 18 bp, Artificial Sequence
  Synthetic DNA
taaaaccattcactttcg

SEQ ID NO: 66909 - DNA, 18 bp, Artificial Sequence
  Synthetic DNA
taaattgactctcaatag

SEQ ID NO: 66910 - DNA, 18 bp, Artificial Sequence
  Synthetic DNA
taacacatctcgttttag

SEQ ID NO: 66911 - DNA, 18 bp, Artificial Sequence
  Synthetic DNA
taatacaactaacttatg

SEQ ID NO: 66912 - DNA, 18 bp, Artificial Sequence
  Synthetic DNA
taatacgaaacattaatg

SEQ ID NO: 66913 - DNA, 18 bp, Artificial Sequence
  Synthetic DNA
taatacgtttcacttagg

SEQ ID NO: 66914 - DNA, 18 bp, Artificial Sequence
  Synthetic DNA
taatatgaataacattag

SEQ ID NO: 66915 - DNA, 18 bp, Artificial Sequence
  Synthetic DNA
tactacatctcacaattg

SEQ ID NO: 66916 - DNA, 18 bp, Artificial Sequence
  Synthetic DNA
tagtacaactcacaaaaa

SEQ ID NO: 66917 - DNA, 18 bp, Artificial Sequence
  Synthetic DNA
tataacgacacaacatag

SEQ ID NO: 66918 - DNA, 18 bp, Artificial Sequence
  Synthetic DNA
tataacgtctaactattg

SEQ ID NO: 66919 - DNA, 18 bp, Artificial Sequence
  Synthetic DNA
tataacgtttctctatag

SEQ ID NO: 66920 - DNA, 18 bp, Artificial Sequence
  Synthetic DNA
tatcatggctcactattg

SEQ ID NO: 66921 - DNA, 18 bp, Artificial Sequence
  Synthetic DNA
tattacctctctttatag

SEQ ID NO: 66922 - DNA, 18 bp, Artificial Sequence
  Synthetic DNA
tattacgactaacctttg

SEQ ID NO: 66923 - DNA, 18 bp, Artificial Sequence
  Synthetic DNA
tattccgactcgcttttg

SEQ ID NO: 66924 - DNA, 18 bp, Artificial Sequence
  Synthetic DNA
tatttcgacacactcttg

SEQ ID NO: 66925 - DNA, 18 bp, Artificial Sequence
  Synthetic DNA
tatttcgtctcacttcag

SEQ ID NO: 66926 - DNA, 18 bp, Artificial Sequence
  Synthetic DNA
tattttgactctccatag

SEQ ID NO: 66927 - DNA, 18 bp, Artificial Sequence
  Synthetic DNA
tcatccgactttcactag

SEQ ID NO: 66928 - DNA, 18 bp, Artificial Sequence
  Synthetic DNA
tgacacaactcaaaagag

SEQ ID NO: 66929 - DNA, 18 bp, Artificial Sequence
  Synthetic DNA
ttaaaagactcacaaaag

SEQ ID NO: 66930 - DNA, 18 bp, Artificial Sequence
  Synthetic DNA
ttaaacgactctcaattg

SEQ ID NO: 66931 - DNA, 18 bp, Artificial Sequence
  Synthetic DNA
ttaaacgattggctatag

SEQ ID NO: 66932 - DNA, 18 bp, Artificial Sequence
  Synthetic DNA
ttacacgattctctttag

SEQ ID NO: 66933 - DNA, 18 bp, Artificial Sequence
  Synthetic DNA
ttatacgcattacaatag

SEQ ID NO: 66934 - DNA, 18 bp, Artificial Sequence
  Synthetic DNA
ttatataaatctctatag

SEQ ID NO: 66935 - DNA, 18 bp, Artificial Sequence
  Synthetic DNA
ttatcggactctctaaag

SEQ ID NO: 66936 - DNA, 18 bp, Artificial Sequence
  Synthetic DNA
ttattagactcataatag

SEQ ID NO: 66937 - DNA, 18 bp, Artificial Sequence
  Synthetic DNA
ttattcgtcccacaatag

SEQ ID NO: 66938 - DNA, 18 bp, Artificial Sequence
  Synthetic DNA
ttccacttctcactatag

SEQ ID NO: 66939 - DNA, 18 bp, Artificial Sequence
  Synthetic DNA
ttttaagactcacaattg

SEQ ID NO: 66940 - DNA, 18 bp, Artificial Sequence
  Synthetic DNA
aaaaaacgccctctaaag

SEQ ID NO: 66941 - DNA, 18 bp, Artificial Sequence
  Synthetic DNA
aaaaaattctcactgtag

SEQ ID NO: 66942 - DNA, 18 bp, Artificial Sequence
  Synthetic DNA
aaaaacaaatccctaccg

SEQ ID NO: 66943 - DNA, 18 bp, Artificial Sequence
  Synthetic DNA
aaaaaccaaacacttaag

SEQ ID NO: 66944 - DNA, 18 bp, Artificial Sequence
  Synthetic DNA
aaaaacgaatcattatgg

SEQ ID NO: 66945 - DNA, 18 bp, Artificial Sequence
  Synthetic DNA
aaaaacgagtcaaaatag

SEQ ID NO: 66946 - DNA, 18 bp, Artificial Sequence
  Synthetic DNA
aaaaacgtacctttacag

SEQ ID NO: 66947 - DNA, 18 bp, Artificial Sequence
  Synthetic DNA
aaaaactactaaccatag

SEQ ID NO: 66948 - DNA, 18 bp, Artificial Sequence
  Synthetic DNA
aaaaactactcacaaaag

SEQ ID NO: 66949 - DNA, 18 bp, Artificial Sequence
  Synthetic DNA
aaaaactactcacattag

SEQ ID NO: 66950 - DNA, 18 bp, Artificial Sequence
  Synthetic DNA
aaaaaggacttgctttag

SEQ ID NO: 66951 - DNA, 18 bp, Artificial Sequence
  Synthetic DNA
aaaaagggctctccttag

SEQ ID NO: 66952 - DNA, 18 bp, Artificial Sequence
  Synthetic DNA
aaaaattactgtctatag

SEQ ID NO: 66953 - DNA, 18 bp, Artificial Sequence
  Synthetic DNA
aaaaccggcacgatatag

SEQ ID NO: 66954 - DNA, 18 bp, Artificial Sequence
  Synthetic DNA
aaaacctatttacatttg

SEQ ID NO: 66955 - DNA, 18 bp, Artificial Sequence
  Synthetic DNA
aaaagcgacacaatatag

SEQ ID NO: 66956 - DNA, 18 bp, Artificial Sequence
  Synthetic DNA
aaaagggacacccttttg

SEQ ID NO: 66957 - DNA, 18 bp, Artificial Sequence
  Synthetic DNA
aaaataaactcactattg

SEQ ID NO: 66958 - DNA, 18 bp, Artificial Sequence
  Synthetic DNA
aaaatggactcactatcg

SEQ ID NO: 66959 - DNA, 18 bp, Artificial Sequence
  Synthetic DNA
aaacacgagtctttatag

SEQ ID NO: 66960 - DNA, 18 bp, Artificial Sequence
  Synthetic DNA
aaactagactcgctttag

SEQ ID NO: 66961 - DNA, 18 bp, Artificial Sequence
  Synthetic DNA
aaactcgtttctctatag

SEQ ID NO: 66962 - DNA, 18 bp, Artificial Sequence
  Synthetic DNA
aaagacccctgtctaaag

SEQ ID NO: 66963 - DNA, 18 bp, Artificial Sequence
  Synthetic DNA
aaagcatactcaatacag

SEQ ID NO: 66964 - DNA, 18 bp, Artificial Sequence
  Synthetic DNA
aaataacacacacttttg

SEQ ID NO: 66965 - DNA, 18 bp, Artificial Sequence
  Synthetic DNA
aaataagactatctattg

SEQ ID NO: 66966 - DNA, 18 bp, Artificial Sequence
  Synthetic DNA
aaataaggatctcctttg

SEQ ID NO: 66967 - DNA, 18 bp, Artificial Sequence
  Synthetic DNA
aaataatactcacaattg

SEQ ID NO: 66968 - DNA, 18 bp, Artificial Sequence
  Synthetic DNA
aaatacatttcactttag

SEQ ID NO: 66969 - DNA, 18 bp, Artificial Sequence
  Synthetic DNA
aaataccacttactcttg

SEQ ID NO: 66970 - DNA, 18 bp, Artificial Sequence
  Synthetic DNA
aaataccattcaccacgg

SEQ ID NO: 66971 - DNA, 18 bp, Artificial Sequence
  Synthetic DNA
aaatacctctgacaaaag

SEQ ID NO: 66972 - DNA, 18 bp, Artificial Sequence
  Synthetic DNA
aaatacgaaacattaaag

SEQ ID NO: 66973 - DNA, 18 bp, Artificial Sequence
  Synthetic DNA
aaatacgaaacgctttag

SEQ ID NO: 66974 - DNA, 18 bp, Artificial Sequence
  Synthetic DNA
aaatacgacacgataaag

SEQ ID NO: 66975 - DNA, 18 bp, Artificial Sequence
  Synthetic DNA
aaatacgactcccaaatg

SEQ ID NO: 66976 - DNA, 18 bp, Artificial Sequence
  Synthetic DNA
aaatacgactgtcattag

SEQ ID NO: 66977 - DNA, 18 bp, Artificial Sequence
  Synthetic DNA
aaatacgatcccagacag

SEQ ID NO: 66978 - DNA, 18 bp, Artificial Sequence
  Synthetic DNA
aaatacggtccactataa

SEQ ID NO: 66979 - DNA, 18 bp, Artificial Sequence
  Synthetic DNA
aaatacggttcgcttcag

SEQ ID NO: 66980 - DNA, 18 bp, Artificial Sequence
  Synthetic DNA
aaatacgtctaacaacag

SEQ ID NO: 66981 - DNA, 18 bp, Artificial Sequence
  Synthetic DNA
aaatacgtttaactaatg

SEQ ID NO: 66982 - DNA, 18 bp, Artificial Sequence
  Synthetic DNA
aaatactacttattattg

SEQ ID NO: 66983 - DNA, 18 bp, Artificial Sequence
  Synthetic DNA
aaatactgttctcaatag

SEQ ID NO: 66984 - DNA, 18 bp, Artificial Sequence
  Synthetic DNA
aaatacttctgcctatag

SEQ ID NO: 66985 - DNA, 18 bp, Artificial Sequence
  Synthetic DNA
aaatagaatacactattg

SEQ ID NO: 66986 - DNA, 18 bp, Artificial Sequence
  Synthetic DNA
aaataggacttgctgtag

SEQ ID NO: 66987 - DNA, 18 bp, Artificial Sequence
  Synthetic DNA
aaatagggcactctccag

SEQ ID NO: 66988 - DNA, 18 bp, Artificial Sequence
  Synthetic DNA
aaatagtactgtctattg

SEQ ID NO: 66989 - DNA, 18 bp, Artificial Sequence
  Synthetic DNA
aaatataactctttttag

SEQ ID NO: 66990 - DNA, 18 bp, Artificial Sequence
  Synthetic DNA
aaatatccctcaccatag

SEQ ID NO: 66991 - DNA, 18 bp, Artificial Sequence
  Synthetic DNA
aaatatgactacctcagg

SEQ ID NO: 66992 - DNA, 18 bp, Artificial Sequence
  Synthetic DNA
aaatatgattcacttaag

SEQ ID NO: 66993 - DNA, 18 bp, Artificial Sequence
  Synthetic DNA
aaatatgtctcaccattg

SEQ ID NO: 66994 - DNA, 18 bp, Artificial Sequence
  Synthetic DNA
aaatattactctctaaag

SEQ ID NO: 66995 - DNA, 18 bp, Artificial Sequence
  Synthetic DNA
aaatattgctcacaatag

SEQ ID NO: 66996 - DNA, 18 bp, Artificial Sequence
  Synthetic DNA
aaatcaaactaattaaag

SEQ ID NO: 66997 - DNA, 18 bp, Artificial Sequence
  Synthetic DNA
aaatcagactctctaaag

SEQ ID NO: 66998 - DNA, 18 bp, Artificial Sequence
  Synthetic DNA
aaatccaattcactttag

SEQ ID NO: 66999 - DNA, 18 bp, Artificial Sequence
  Synthetic DNA
aaatccgactctccattg

SEQ ID NO: 67000 - DNA, 18 bp, Artificial Sequence
  Synthetic DNA
aaatccgcctcaccaaag

SEQ ID NO: 67001 - DNA, 18 bp, Artificial Sequence
  Synthetic DNA
aaatccgtctctctcatg

SEQ ID NO: 67002 - DNA, 18 bp, Artificial Sequence
  Synthetic DNA
aaatcctactcatcacag

SEQ ID NO: 67003 - DNA, 18 bp, Artificial Sequence
  Synthetic DNA
aaatctgtatcattgtag

SEQ ID NO: 67004 - DNA, 18 bp, Artificial Sequence
  Synthetic DNA
aaatgcgaatgtctcttg

SEQ ID NO: 67005 - DNA, 18 bp, Artificial Sequence
  Synthetic DNA
aaatgcgtaacattctag

SEQ ID NO: 67006 - DNA, 18 bp, Artificial Sequence
  Synthetic DNA
aaattacactaactattg

SEQ ID NO: 67007 - DNA, 18 bp, Artificial Sequence
  Synthetic DNA
aaattagtctaactagag

SEQ ID NO: 67008 - DNA, 18 bp, Artificial Sequence
  Synthetic DNA
aaattcacctccctatag

SEQ ID NO: 67009 - DNA, 18 bp, Artificial Sequence
  Synthetic DNA
aaattcatcttactaaag

SEQ ID NO: 67010 - DNA, 18 bp, Artificial Sequence
  Synthetic DNA
aaattccacttgctatag

SEQ ID NO: 67011 - DNA, 18 bp, Artificial Sequence
  Synthetic DNA
aaattcgacacactaagg

SEQ ID NO: 67012 - DNA, 18 bp, Artificial Sequence
  Synthetic DNA
aaattcgtctcgctacag

SEQ ID NO: 67013 - DNA, 18 bp, Artificial Sequence
  Synthetic DNA
aaattcgtcttactatcg

SEQ ID NO: 67014 - DNA, 18 bp, Artificial Sequence
  Synthetic DNA
aaattctatactctttag

SEQ ID NO: 67015 - DNA, 18 bp, Artificial Sequence
  Synthetic DNA
aaatttaactctctatag

SEQ ID NO: 67016 - DNA, 18 bp, Artificial Sequence
  Synthetic DNA
aacaacgtcgcactatag

SEQ ID NO: 67017 - DNA, 18 bp, Artificial Sequence
  Synthetic DNA
aacctagactcattatag

SEQ ID NO: 67018 - DNA, 18 bp, Artificial Sequence
  Synthetic DNA
aactaaatctcattatag

SEQ ID NO: 67019 - DNA, 18 bp, Artificial Sequence
  Synthetic DNA
aactacgaacgtcaacgg

SEQ ID NO: 67020 - DNA, 18 bp, Artificial Sequence
  Synthetic DNA
aactacgacacttaaaag

SEQ ID NO: 67021 - DNA, 18 bp, Artificial Sequence
  Synthetic DNA
aactacgcatcattatag

SEQ ID NO: 67022 - DNA, 18 bp, Artificial Sequence
  Synthetic DNA
aactactatgcactctag

SEQ ID NO: 67023 - DNA, 18 bp, Artificial Sequence
  Synthetic DNA
aacttcaactcactcttg

SEQ ID NO: 67024 - DNA, 18 bp, Artificial Sequence
  Synthetic DNA
aacttcgaatcaatttag

SEQ ID NO: 67025 - DNA, 18 bp, Artificial Sequence
  Synthetic DNA
aagaatgctagattatgg

SEQ ID NO: 67026 - DNA, 18 bp, Artificial Sequence
  Synthetic DNA
aagcacgacactttatag

SEQ ID NO: 67027 - DNA, 18 bp, Artificial Sequence
  Synthetic DNA
aagcactacactcgaatg

SEQ ID NO: 67028 - DNA, 18 bp, Artificial Sequence
  Synthetic DNA
aagtaagtcttactattg

SEQ ID NO: 67029 - DNA, 18 bp, Artificial Sequence
  Synthetic DNA
aagtacgacactctatcg

SEQ ID NO: 67030 - DNA, 18 bp, Artificial Sequence
  Synthetic DNA
aagtacgactcattgaag

SEQ ID NO: 67031 - DNA, 18 bp, Artificial Sequence
  Synthetic DNA
aagtacgagtcaacatag

SEQ ID NO: 67032 - DNA, 18 bp, Artificial Sequence
  Synthetic DNA
aagtactactcactttgg

SEQ ID NO: 67033 - DNA, 18 bp, Artificial Sequence
  Synthetic DNA
aagttctactctctatag

SEQ ID NO: 67034 - DNA, 18 bp, Artificial Sequence
  Synthetic DNA
aataacgattcacaatag

SEQ ID NO: 67035 - DNA, 18 bp, Artificial Sequence
  Synthetic DNA
aatagcttctcactatag

SEQ ID NO: 67036 - DNA, 18 bp, Artificial Sequence
  Synthetic DNA
aatatcgactcactattg

SEQ ID NO: 67037 - DNA, 18 bp, Artificial Sequence
  Synthetic DNA
aatcacgaaccactaaag

SEQ ID NO: 67038 - DNA, 18 bp, Artificial Sequence
  Synthetic DNA
aatcacgacttaccatag

SEQ ID NO: 67039 - DNA, 18 bp, Artificial Sequence
  Synthetic DNA
aatcatgactcagtgtgg

SEQ ID NO: 67040 - DNA, 18 bp, Artificial Sequence
  Synthetic DNA
aatcttgacccgctctag

SEQ ID NO: 67041 - DNA, 18 bp, Artificial Sequence
  Synthetic DNA
aatgacaaccaactttag

SEQ ID NO: 67042 - DNA, 18 bp, Artificial Sequence
  Synthetic DNA
aatgacgactaactaaag

SEQ ID NO: 67043 - DNA, 18 bp, Artificial Sequence
  Synthetic DNA
aatgtcgtctcacatgag

SEQ ID NO: 67044 - DNA, 18 bp, Artificial Sequence
  Synthetic DNA
aattaaagaacactttag

SEQ ID NO: 67045 - DNA, 18 bp, Artificial Sequence
  Synthetic DNA
aattacaactaacaatag

SEQ ID NO: 67046 - DNA, 18 bp, Artificial Sequence
  Synthetic DNA
aattaccactcagtaaag

SEQ ID NO: 67047 - DNA, 18 bp, Artificial Sequence
  Synthetic DNA
aattacgacccattaaag

SEQ ID NO: 67048 - DNA, 18 bp, Artificial Sequence
  Synthetic DNA
aattacgacgcttcattg

SEQ ID NO: 67049 - DNA, 18 bp, Artificial Sequence
  Synthetic DNA
aattacgcctctctaatg

SEQ ID NO: 67050 - DNA, 18 bp, Artificial Sequence
  Synthetic DNA
aattacggccctcaaaag

SEQ ID NO: 67051 - DNA, 18 bp, Artificial Sequence
  Synthetic DNA
aattacggctcacaattg

SEQ ID NO: 67052 - DNA, 18 bp, Artificial Sequence
  Synthetic DNA
aattacggctcctgacag

SEQ ID NO: 67053 - DNA, 18 bp, Artificial Sequence
  Synthetic DNA
aattacgtcaaaccttag

SEQ ID NO: 67054 - DNA, 18 bp, Artificial Sequence
  Synthetic DNA
aattactcgtgccttaag

SEQ ID NO: 67055 - DNA, 18 bp, Artificial Sequence
  Synthetic DNA
aattaggaatcagcatag

SEQ ID NO: 67056 - DNA, 18 bp, Artificial Sequence
  Synthetic DNA
aattaggacccatcttag

SEQ ID NO: 67057 - DNA, 18 bp, Artificial Sequence
  Synthetic DNA
aattataacttactttag

SEQ ID NO: 67058 - DNA, 18 bp, Artificial Sequence
  Synthetic DNA
aattatgacttattatag

SEQ ID NO: 67059 - DNA, 18 bp, Artificial Sequence
  Synthetic DNA
aattcagtctcaatatag

SEQ ID NO: 67060 - DNA, 18 bp, Artificial Sequence
  Synthetic DNA
aattgggacttccttttg

SEQ ID NO: 67061 - DNA, 18 bp, Artificial Sequence
  Synthetic DNA
aatttccaaactccatag

SEQ ID NO: 67062 - DNA, 18 bp, Artificial Sequence
  Synthetic DNA
aatttcgacacaccattg

SEQ ID NO: 67063 - DNA, 18 bp, Artificial Sequence
  Synthetic DNA
aatttctactccctatag

SEQ ID NO: 67064 - DNA, 18 bp, Artificial Sequence
  Synthetic DNA
aatttctcttcaataaag

SEQ ID NO: 67065 - DNA, 18 bp, Artificial Sequence
  Synthetic DNA
acaaaccactcactacag

SEQ ID NO: 67066 - DNA, 18 bp, Artificial Sequence
  Synthetic DNA
acactccactctctgtag

SEQ ID NO: 67067 - DNA, 18 bp, Artificial Sequence
  Synthetic DNA
acataagcctccctctag

SEQ ID NO: 67068 - DNA, 18 bp, Artificial Sequence
  Synthetic DNA
acatacgactcatttgag

SEQ ID NO: 67069 - DNA, 18 bp, Artificial Sequence
  Synthetic DNA
acatacgtgacactattg

SEQ ID NO: 67070 - DNA, 18 bp, Artificial Sequence
  Synthetic DNA
acatatcaaccgctttag

SEQ ID NO: 67071 - DNA, 18 bp, Artificial Sequence
  Synthetic DNA
acatatgacacacaatag

SEQ ID NO: 67072 - DNA, 18 bp, Artificial Sequence
  Synthetic DNA
acatatgactcacttaag

SEQ ID NO: 67073 - DNA, 18 bp, Artificial Sequence
  Synthetic DNA
acatgggtatcactattg

SEQ ID NO: 67074 - DNA, 18 bp, Artificial Sequence
  Synthetic DNA
acatgtgactctctatcg

SEQ ID NO: 67075 - DNA, 18 bp, Artificial Sequence
  Synthetic DNA
acattccactccctatag

SEQ ID NO: 67076 - DNA, 18 bp, Artificial Sequence
  Synthetic DNA
acgcgcgactcgctaatg

SEQ ID NO: 67077 - DNA, 18 bp, Artificial Sequence
  Synthetic DNA
acgttcaactcactatag

SEQ ID NO: 67078 - DNA, 18 bp, Artificial Sequence
  Synthetic DNA
actcacgatccactattg

SEQ ID NO: 67079 - DNA, 18 bp, Artificial Sequence
  Synthetic DNA
acttacgaatctctattg

SEQ ID NO: 67080 - DNA, 18 bp, Artificial Sequence
  Synthetic DNA
acttatgtctcaaatttg

SEQ ID NO: 67081 - DNA, 18 bp, Artificial Sequence
  Synthetic DNA
agaaacgaccatttacgg

SEQ ID NO: 67082 - DNA, 18 bp, Artificial Sequence
  Synthetic DNA
agacatgactcccaatag

SEQ ID NO: 67083 - DNA, 18 bp, Artificial Sequence
  Synthetic DNA
agacatgagtcactctag

SEQ ID NO: 67084 - DNA, 18 bp, Artificial Sequence
  Synthetic DNA
agacccgacacactacag

SEQ ID NO: 67085 - DNA, 18 bp, Artificial Sequence
  Synthetic DNA
agagaagactcacaatag

SEQ ID NO: 67086 - DNA, 18 bp, Artificial Sequence
  Synthetic DNA
agataagtctcactttag

SEQ ID NO: 67087 - DNA, 18 bp, Artificial Sequence
  Synthetic DNA
agatacaactcatcatag

SEQ ID NO: 67088 - DNA, 18 bp, Artificial Sequence
  Synthetic DNA
agatacggctcacttaag

SEQ ID NO: 67089 - DNA, 18 bp, Artificial Sequence
  Synthetic DNA
agatacgtcttactattg

SEQ ID NO: 67090 - DNA, 18 bp, Artificial Sequence
  Synthetic DNA
agatcagccactgtattg

SEQ ID NO: 67091 - DNA, 18 bp, Artificial Sequence
  Synthetic DNA
agatccacgtccctttag

SEQ ID NO: 67092 - DNA, 18 bp, Artificial Sequence
  Synthetic DNA
agatttgactcattgtcg

SEQ ID NO: 67093 - DNA, 18 bp, Artificial Sequence
  Synthetic DNA
agcaacatctcacaatag

SEQ ID NO: 67094 - DNA, 18 bp, Artificial Sequence
  Synthetic DNA
aggttagactcatcaaag

SEQ ID NO: 67095 - DNA, 18 bp, Artificial Sequence
  Synthetic DNA
aggttcgactctctatag

SEQ ID NO: 67096 - DNA, 18 bp, Artificial Sequence
  Synthetic DNA
agtaacgactcactttag

SEQ ID NO: 67097 - DNA, 18 bp, Artificial Sequence
  Synthetic DNA
agttacaactcagtttag

SEQ ID NO: 67098 - DNA, 18 bp, Artificial Sequence
  Synthetic DNA
agttacgactcacttaag

SEQ ID NO: 67099 - DNA, 18 bp, Artificial Sequence
  Synthetic DNA
agttacgattcactaaag

SEQ ID NO: 67100 - DNA, 18 bp, Artificial Sequence
  Synthetic DNA
agttacgcaaaatgagag

SEQ ID NO: 67101 - DNA, 18 bp, Artificial Sequence
  Synthetic DNA
ataaacgacacactaaag

SEQ ID NO: 67102 - DNA, 18 bp, Artificial Sequence
  Synthetic DNA
ataaactgcccactatag

SEQ ID NO: 67103 - DNA, 18 bp, Artificial Sequence
  Synthetic DNA
ataaatgccttggctcag

SEQ ID NO: 67104 - DNA, 18 bp, Artificial Sequence
  Synthetic DNA
ataatcgactcactaatg

SEQ ID NO: 67105 - DNA, 18 bp, Artificial Sequence
  Synthetic DNA
ataatcgtctcactttag

SEQ ID NO: 67106 - DNA, 18 bp, Artificial Sequence
  Synthetic DNA
ataatttacgtagtaaag

SEQ ID NO: 67107 - DNA, 18 bp, Artificial Sequence
  Synthetic DNA
atacaccataccctatgg

SEQ ID NO: 67108 - DNA, 18 bp, Artificial Sequence
  Synthetic DNA
atacacgaattagtatag

SEQ ID NO: 67109 - DNA, 18 bp, Artificial Sequence
  Synthetic DNA
atacacgtccccctttag

SEQ ID NO: 67110 - DNA, 18 bp, Artificial Sequence
  Synthetic DNA
atacattacacactcgtg

SEQ ID NO: 67111 - DNA, 18 bp, Artificial Sequence
  Synthetic DNA
atacattactcacaatag

SEQ ID NO: 67112 - DNA, 18 bp, Artificial Sequence
  Synthetic DNA
atataatattgtctatag

SEQ ID NO: 67113 - DNA, 18 bp, Artificial Sequence
  Synthetic DNA
atatacaactcattattg

SEQ ID NO: 67114 - DNA, 18 bp, Artificial Sequence
  Synthetic DNA
atataccacagtctatcg

SEQ ID NO: 67115 - DNA, 18 bp, Artificial Sequence
  Synthetic DNA
atatacgaatcagaaagg

SEQ ID NO: 67116 - DNA, 18 bp, Artificial Sequence
  Synthetic DNA
atatacgaattaccatag

SEQ ID NO: 67117 - DNA, 18 bp, Artificial Sequence
  Synthetic DNA
atatacgactaactgttg

SEQ ID NO: 67118 - DNA, 18 bp, Artificial Sequence
  Synthetic DNA
atatacgactctactctg

SEQ ID NO: 67119 - DNA, 18 bp, Artificial Sequence
  Synthetic DNA
atatacgactcttaatcg

SEQ ID NO: 67120 - DNA, 18 bp, Artificial Sequence
  Synthetic DNA
atatacgacttaatttag

SEQ ID NO: 67121 - DNA, 18 bp, Artificial Sequence
  Synthetic DNA
atatacgacttactaatg

SEQ ID NO: 67122 - DNA, 18 bp, Artificial Sequence
  Synthetic DNA
atatacgatacacattag

SEQ ID NO: 67123 - DNA, 18 bp, Artificial Sequence
  Synthetic DNA
atatacgattcataatag

SEQ ID NO: 67124 - DNA, 18 bp, Artificial Sequence
  Synthetic DNA
atatacggaagactattg

SEQ ID NO: 67125 - DNA, 18 bp, Artificial Sequence
  Synthetic DNA
atatacgtatgactatag

SEQ ID NO: 67126 - DNA, 18 bp, Artificial Sequence
  Synthetic DNA
atatacgtctatctattg

SEQ ID NO: 67127 - DNA, 18 bp, Artificial Sequence
  Synthetic DNA
atatactacacaccttgg

SEQ ID NO: 67128 - DNA, 18 bp, Artificial Sequence
  Synthetic DNA
atatactacccactatgg

SEQ ID NO: 67129 - DNA, 18 bp, Artificial Sequence
  Synthetic DNA
atatactactgactaaag

SEQ ID NO: 67130 - DNA, 18 bp, Artificial Sequence
  Synthetic DNA
atatataactctctatag

SEQ ID NO: 67131 - DNA, 18 bp, Artificial Sequence
  Synthetic DNA
atatatgacgcattaatg

SEQ ID NO: 67132 - DNA, 18 bp, Artificial Sequence
  Synthetic DNA
atatccgaatttcaatag

SEQ ID NO: 67133 - DNA, 18 bp, Artificial Sequence
  Synthetic DNA
atatccgactcattatgg

SEQ ID NO: 67134 - DNA, 18 bp, Artificial Sequence
  Synthetic DNA
atatccgactccctaatg

SEQ ID NO: 67135 - DNA, 18 bp, Artificial Sequence
  Synthetic DNA
atatcggtctcactttgg

SEQ ID NO: 67136 - DNA, 18 bp, Artificial Sequence
  Synthetic DNA
atattcgactccgtagag

SEQ ID NO: 67137 - DNA, 18 bp, Artificial Sequence
  Synthetic DNA
atattcggctcactttag

SEQ ID NO: 67138 - DNA, 18 bp, Artificial Sequence
  Synthetic DNA
atattctactcaccctag

SEQ ID NO: 67139 - DNA, 18 bp, Artificial Sequence
  Synthetic DNA
atattggattcactatag

SEQ ID NO: 67140 - DNA, 18 bp, Artificial Sequence
  Synthetic DNA
atatttgtctcactatag

SEQ ID NO: 67141 - DNA, 18 bp, Artificial Sequence
  Synthetic DNA
atcaaccactcgctaccg

SEQ ID NO: 67142 - DNA, 18 bp, Artificial Sequence
  Synthetic DNA
atctaagactcgcattag

SEQ ID NO: 67143 - DNA, 18 bp, Artificial Sequence
  Synthetic DNA
atctacttctcaatatag

SEQ ID NO: 67144 - DNA, 18 bp, Artificial Sequence
  Synthetic DNA
atctccgactctcacttg

SEQ ID NO: 67145 - DNA, 18 bp, Artificial Sequence
  Synthetic DNA
attaatttttgattatag

SEQ ID NO: 67146 - DNA, 18 bp, Artificial Sequence
  Synthetic DNA
atttacatctccatatag

SEQ ID NO: 67147 - DNA, 18 bp, Artificial Sequence
  Synthetic DNA
atttacgacaccctatag

SEQ ID NO: 67148 - DNA, 18 bp, Artificial Sequence
  Synthetic DNA
atttacgactctctcaag

SEQ ID NO: 67149 - DNA, 18 bp, Artificial Sequence
  Synthetic DNA
atttacgactgaacacag

SEQ ID NO: 67150 - DNA, 18 bp, Artificial Sequence
  Synthetic DNA
atttacgtctcgctatgg

SEQ ID NO: 67151 - DNA, 18 bp, Artificial Sequence
  Synthetic DNA
atttacgtttcaaaagag

SEQ ID NO: 67152 - DNA, 18 bp, Artificial Sequence
  Synthetic DNA
attttcgactcacaatag

SEQ ID NO: 67153 - DNA, 18 bp, Artificial Sequence
  Synthetic DNA
atttttaaatacgaattg

SEQ ID NO: 67154 - DNA, 18 bp, Artificial Sequence
  Synthetic DNA
caaaaaccctctctatcg

SEQ ID NO: 67155 - DNA, 18 bp, Artificial Sequence
  Synthetic DNA
caaaaagtcacattatag

SEQ ID NO: 67156 - DNA, 18 bp, Artificial Sequence
  Synthetic DNA
caaaacgactcccattag

SEQ ID NO: 67157 - DNA, 18 bp, Artificial Sequence
  Synthetic DNA
caaaacgactctctaatg

SEQ ID NO: 67158 - DNA, 18 bp, Artificial Sequence
  Synthetic DNA
caaaacgcctcactgtcg

SEQ ID NO: 67159 - DNA, 18 bp, Artificial Sequence
  Synthetic DNA
caaaacggctgtcaaaag

SEQ ID NO: 67160 - DNA, 18 bp, Artificial Sequence
  Synthetic DNA
caaaccgtctttctatag

SEQ ID NO: 67161 - DNA, 18 bp, Artificial Sequence
  Synthetic DNA
caacaaaactccctatgg

SEQ ID NO: 67162 - DNA, 18 bp, Artificial Sequence
  Synthetic DNA
caacgctccttataattg

SEQ ID NO: 67163 - DNA, 18 bp, Artificial Sequence
  Synthetic DNA
caataaaacttagagaag

SEQ ID NO: 67164 - DNA, 18 bp, Artificial Sequence
  Synthetic DNA
caatacacctctgcacag

SEQ ID NO: 67165 - DNA, 18 bp, Artificial Sequence
  Synthetic DNA
caataccattcacaatgg

SEQ ID NO: 67166 - DNA, 18 bp, Artificial Sequence
  Synthetic DNA
caatacctcacactttag

SEQ ID NO: 67167 - DNA, 18 bp, Artificial Sequence
  Synthetic DNA
caatacgagtaacttatg

SEQ ID NO: 67168 - DNA, 18 bp, Artificial Sequence
  Synthetic DNA
caatacgattctcttatg

SEQ ID NO: 67169 - DNA, 18 bp, Artificial Sequence
  Synthetic DNA
caatacgatttactaccg

SEQ ID NO: 67170 - DNA, 18 bp, Artificial Sequence
  Synthetic DNA
caatacgtctcacattcg

SEQ ID NO: 67171 - DNA, 18 bp, Artificial Sequence
  Synthetic DNA
caatacgtctcgctactg

SEQ ID NO: 67172 - DNA, 18 bp, Artificial Sequence
  Synthetic DNA
caatacgtcttaatattg

SEQ ID NO: 67173 - DNA, 18 bp, Artificial Sequence
  Synthetic DNA
caatactaatctcgatag

SEQ ID NO: 67174 - DNA, 18 bp, Artificial Sequence
  Synthetic DNA
caatactactaaccaaag

SEQ ID NO: 67175 - DNA, 18 bp, Artificial Sequence
  Synthetic DNA
caatactattaactacag

SEQ ID NO: 67176 - DNA, 18 bp, Artificial Sequence
  Synthetic DNA
caatacttcacacgatag

SEQ ID NO: 67177 - DNA, 18 bp, Artificial Sequence
  Synthetic DNA
caatctcactcattatgg

SEQ ID NO: 67178 - DNA, 18 bp, Artificial Sequence
  Synthetic DNA
caatgaaacacactaaag

SEQ ID NO: 67179 - DNA, 18 bp, Artificial Sequence
  Synthetic DNA
caatgcgacactctacag

SEQ ID NO: 67180 - DNA, 18 bp, Artificial Sequence
  Synthetic DNA
caattagactctttatcg

SEQ ID NO: 67181 - DNA, 18 bp, Artificial Sequence
  Synthetic DNA
caattcatctcactattg

SEQ ID NO: 67182 - DNA, 18 bp, Artificial Sequence
  Synthetic DNA
caattcatttctttaaag

SEQ ID NO: 67183 - DNA, 18 bp, Artificial Sequence
  Synthetic DNA
caattcgaattactttag

SEQ ID NO: 67184 - DNA, 18 bp, Artificial Sequence
  Synthetic DNA
caattcgagttgctacag

SEQ ID NO: 67185 - DNA, 18 bp, Artificial Sequence
  Synthetic DNA
caattcgattcaagatag

SEQ ID NO: 67186 - DNA, 18 bp, Artificial Sequence
  Synthetic DNA
caattcggcccactattg

SEQ ID NO: 67187 - DNA, 18 bp, Artificial Sequence
  Synthetic DNA
caattggattcactatgg

SEQ ID NO: 67188 - DNA, 18 bp, Artificial Sequence
  Synthetic DNA
caccccgaatctgtatag

SEQ ID NO: 67189 - DNA, 18 bp, Artificial Sequence
  Synthetic DNA
cactacaacttagtatag

SEQ ID NO: 67190 - DNA, 18 bp, Artificial Sequence
  Synthetic DNA
cactacagttcattatgg

SEQ ID NO: 67191 - DNA, 18 bp, Artificial Sequence
  Synthetic DNA
cactacgactatatatag

SEQ ID NO: 67192 - DNA, 18 bp, Artificial Sequence
  Synthetic DNA
cactcagactcacttaag

SEQ ID NO: 67193 - DNA, 18 bp, Artificial Sequence
  Synthetic DNA
cagaaaatctcacaatag

SEQ ID NO: 67194 - DNA, 18 bp, Artificial Sequence
  Synthetic DNA
cagtacaacttattatag

SEQ ID NO: 67195 - DNA, 18 bp, Artificial Sequence
  Synthetic DNA
cagtaggtatcacagcag

SEQ ID NO: 67196 - DNA, 18 bp, Artificial Sequence
  Synthetic DNA
catagcgacttacaatcg

SEQ ID NO: 67197 - DNA, 18 bp, Artificial Sequence
  Synthetic DNA
cattaagactcaaaatag

SEQ ID NO: 67198 - DNA, 18 bp, Artificial Sequence
  Synthetic DNA
cattaccacaaccaattg

SEQ ID NO: 67199 - DNA, 18 bp, Artificial Sequence
  Synthetic DNA
cattacgacacacttaag

SEQ ID NO: 67200 - DNA, 18 bp, Artificial Sequence
  Synthetic DNA
cattacgactctcattag

SEQ ID NO: 67201 - DNA, 18 bp, Artificial Sequence
  Synthetic DNA
cattactactaaatacag

SEQ ID NO: 67202 - DNA, 18 bp, Artificial Sequence
  Synthetic DNA
cattacttctctctaaag

SEQ ID NO: 67203 - DNA, 18 bp, Artificial Sequence
  Synthetic DNA
cattccgtcttacaatag

SEQ ID NO: 67204 - DNA, 18 bp, Artificial Sequence
  Synthetic DNA
catttcgaatcaccatag

SEQ ID NO: 67205 - DNA, 18 bp, Artificial Sequence
  Synthetic DNA
catttcgactcgttatag

SEQ ID NO: 67206 - DNA, 18 bp, Artificial Sequence
  Synthetic DNA
catttcgtcacactaccg

SEQ ID NO: 67207 - DNA, 18 bp, Artificial Sequence
  Synthetic DNA
catttcgtgtcattaatg

SEQ ID NO: 67208 - DNA, 18 bp, Artificial Sequence
  Synthetic DNA
ccacaccactcaatattg

SEQ ID NO: 67209 - DNA, 18 bp, Artificial Sequence
  Synthetic DNA
ccataattctcacaatag

SEQ ID NO: 67210 - DNA, 18 bp, Artificial Sequence
  Synthetic DNA
ccatacgactctttaaag

SEQ ID NO: 67211 - DNA, 18 bp, Artificial Sequence
  Synthetic DNA
ccatacgcatgactacag

SEQ ID NO: 67212 - DNA, 18 bp, Artificial Sequence
  Synthetic DNA
ccatatcactcactattg

SEQ ID NO: 67213 - DNA, 18 bp, Artificial Sequence
  Synthetic DNA
ccatccgtctcatttttg

SEQ ID NO: 67214 - DNA, 18 bp, Artificial Sequence
  Synthetic DNA
cgagatgtttcattttag

SEQ ID NO: 67215 - DNA, 18 bp, Artificial Sequence
  Synthetic DNA
cgatacgtctctcttatg

SEQ ID NO: 67216 - DNA, 18 bp, Artificial Sequence
  Synthetic DNA
ctaaacgactcacttttg

SEQ ID NO: 67217 - DNA, 18 bp, Artificial Sequence
  Synthetic DNA
ctaaacgtatccctaatg

SEQ ID NO: 67218 - DNA, 18 bp, Artificial Sequence
  Synthetic DNA
ctaagcgactcactatcg

SEQ ID NO: 67219 - DNA, 18 bp, Artificial Sequence
  Synthetic DNA
ctagacaacattccatag

SEQ ID NO: 67220 - DNA, 18 bp, Artificial Sequence
  Synthetic DNA
ctatacgacaatctatag

SEQ ID NO: 67221 - DNA, 18 bp, Artificial Sequence
  Synthetic DNA
ctatacgacaccatatgg

SEQ ID NO: 67222 - DNA, 18 bp, Artificial Sequence
  Synthetic DNA
ctatacgattccctctag

SEQ ID NO: 67223 - DNA, 18 bp, Artificial Sequence
  Synthetic DNA
ctatacgattctcaatag

SEQ ID NO: 67224 - DNA, 18 bp, Artificial Sequence
  Synthetic DNA
ctatcctactcataacag

SEQ ID NO: 67225 - DNA, 18 bp, Artificial Sequence
  Synthetic DNA
ctattcgacttactaaag

SEQ ID NO: 67226 - DNA, 18 bp, Artificial Sequence
  Synthetic DNA
ctattcgattctctattg

SEQ ID NO: 67227 - DNA, 18 bp, Artificial Sequence
  Synthetic DNA
ctgtacaacacactatag

SEQ ID NO: 67228 - DNA, 18 bp, Artificial Sequence
  Synthetic DNA
cttatcgactttcaaagg

SEQ ID NO: 67229 - DNA, 18 bp, Artificial Sequence
  Synthetic DNA
ctttacgactcgcaatag

SEQ ID NO: 67230 - DNA, 18 bp, Artificial Sequence
  Synthetic DNA
ctttacgactgactaaag

SEQ ID NO: 67231 - DNA, 18 bp, Artificial Sequence
  Synthetic DNA
ctttacgtctaactatag

SEQ ID NO: 67232 - DNA, 18 bp, Artificial Sequence
  Synthetic DNA
gaacacgtctcattaatg

SEQ ID NO: 67233 - DNA, 18 bp, Artificial Sequence
  Synthetic DNA
gaataaacttcagtttag

SEQ ID NO: 67234 - DNA, 18 bp, Artificial Sequence
  Synthetic DNA
gaatacgaaagactattg

SEQ ID NO: 67235 - DNA, 18 bp, Artificial Sequence
  Synthetic DNA
gaatacgagacactaatg

SEQ ID NO: 67236 - DNA, 18 bp, Artificial Sequence
  Synthetic DNA
gaatatatctctctatag

SEQ ID NO: 67237 - DNA, 18 bp, Artificial Sequence
  Synthetic DNA
gaatattgcgcactattg

SEQ ID NO: 67238 - DNA, 18 bp, Artificial Sequence
  Synthetic DNA
gaatcagtccaactaaag

SEQ ID NO: 67239 - DNA, 18 bp, Artificial Sequence
  Synthetic DNA
gaattcaactgtctagag

SEQ ID NO: 67240 - DNA, 18 bp, Artificial Sequence
  Synthetic DNA
gacgacggctgactaaag

SEQ ID NO: 67241 - DNA, 18 bp, Artificial Sequence
  Synthetic DNA
gataacatctaattaaag

SEQ ID NO: 67242 - DNA, 18 bp, Artificial Sequence
  Synthetic DNA
gataacgactaactaaag

SEQ ID NO: 67243 - DNA, 18 bp, Artificial Sequence
  Synthetic DNA
gatggccactcgatatag

SEQ ID NO: 67244 - DNA, 18 bp, Artificial Sequence
  Synthetic DNA
gattaggactcacaattg

SEQ ID NO: 67245 - DNA, 18 bp, Artificial Sequence
  Synthetic DNA
gattcgacctccctatcg

SEQ ID NO: 67246 - DNA, 18 bp, Artificial Sequence
  Synthetic DNA
gcaatagcctcactatag

SEQ ID NO: 67247 - DNA, 18 bp, Artificial Sequence
  Synthetic DNA
gcacaagacttactatag

SEQ ID NO: 67248 - DNA, 18 bp, Artificial Sequence
  Synthetic DNA
gcatacgatagactaacg

SEQ ID NO: 67249 - DNA, 18 bp, Artificial Sequence
  Synthetic DNA
gcctacgacataccatag

SEQ ID NO: 67250 - DNA, 18 bp, Artificial Sequence
  Synthetic DNA
ggatatgactcactgttg

SEQ ID NO: 67251 - DNA, 18 bp, Artificial Sequence
  Synthetic DNA
gtatacgtcccacttcag

SEQ ID NO: 67252 - DNA, 18 bp, Artificial Sequence
  Synthetic DNA
gtatacgtctcagtaaag

SEQ ID NO: 67253 - DNA, 18 bp, Artificial Sequence
  Synthetic DNA
gtattcgactcaatttag

SEQ ID NO: 67254 - DNA, 18 bp, Artificial Sequence
  Synthetic DNA
gtgtccgactcactatcg

SEQ ID NO: 67255 - DNA, 18 bp, Artificial Sequence
  Synthetic DNA
gtttaagtttaacattag

SEQ ID NO: 67256 - DNA, 18 bp, Artificial Sequence
  Synthetic DNA
taaaaagacacactgcag

SEQ ID NO: 67257 - DNA, 18 bp, Artificial Sequence
  Synthetic DNA
taaaaagagtcgctacag

SEQ ID NO: 67258 - DNA, 18 bp, Artificial Sequence
  Synthetic DNA
taaaacaacacacctttg

SEQ ID NO: 67259 - DNA, 18 bp, Artificial Sequence
  Synthetic DNA
taaaacaacatactattg

SEQ ID NO: 67260 - DNA, 18 bp, Artificial Sequence
  Synthetic DNA
taaaacaaccaaatattg

SEQ ID NO: 67261 - DNA, 18 bp, Artificial Sequence
  Synthetic DNA
taaaacaatacactaatg

SEQ ID NO: 67262 - DNA, 18 bp, Artificial Sequence
  Synthetic DNA
taaaacaattaactattg

SEQ ID NO: 67263 - DNA, 18 bp, Artificial Sequence
  Synthetic DNA
taaaacaattgcctgttg

SEQ ID NO: 67264 - DNA, 18 bp, Artificial Sequence
  Synthetic DNA
taaaacagctcacaattg

SEQ ID NO: 67265 - DNA, 18 bp, Artificial Sequence
  Synthetic DNA
taaaacatcccacttctg

SEQ ID NO: 67266 - DNA, 18 bp, Artificial Sequence
  Synthetic DNA
taaaacatctccttgtcg

SEQ ID NO: 67267 - DNA, 18 bp, Artificial Sequence
  Synthetic DNA
taaaaccactcacttacg

SEQ ID NO: 67268 - DNA, 18 bp, Artificial Sequence
  Synthetic DNA
taaaaccattaactcttg

SEQ ID NO: 67269 - DNA, 18 bp, Artificial Sequence
  Synthetic DNA
taaaacgaattgctttag

SEQ ID NO: 67270 - DNA, 18 bp, Artificial Sequence
  Synthetic DNA
taaaacgacactcatttg

SEQ ID NO: 67271 - DNA, 18 bp, Artificial Sequence
  Synthetic DNA
taaaacgactatcttaag

SEQ ID NO: 67272 - DNA, 18 bp, Artificial Sequence
  Synthetic DNA
taaaacgactctcaagcg

SEQ ID NO: 67273 - DNA, 18 bp, Artificial Sequence
  Synthetic DNA
taaaacgactctctacga

SEQ ID NO: 67274 - DNA, 18 bp, Artificial Sequence
  Synthetic DNA
taaaacgagttacttttg

SEQ ID NO: 67275 - DNA, 18 bp, Artificial Sequence
  Synthetic DNA
taaaacgatccaatggag

SEQ ID NO: 67276 - DNA, 18 bp, Artificial Sequence
  Synthetic DNA
taaaacgattcacatttg

SEQ ID NO: 67277 - DNA, 18 bp, Artificial Sequence
  Synthetic DNA
taaaacgattcatcacgg

SEQ ID NO: 67278 - DNA, 18 bp, Artificial Sequence
  Synthetic DNA
taaaacgcgtaactttag

SEQ ID NO: 67279 - DNA, 18 bp, Artificial Sequence
  Synthetic DNA
taaaacgtcaaactattg

SEQ ID NO: 67280 - DNA, 18 bp, Artificial Sequence
  Synthetic DNA
taaaacgtcacactccag

SEQ ID NO: 67281 - DNA, 18 bp, Artificial Sequence
  Synthetic DNA
taaaacgtcttacaaaag

SEQ ID NO: 67282 - DNA, 18 bp, Artificial Sequence
  Synthetic DNA
taaaactaactattatag

SEQ ID NO: 67283 - DNA, 18 bp, Artificial Sequence
  Synthetic DNA
taaaactaatcaatacag

SEQ ID NO: 67284 - DNA, 18 bp, Artificial Sequence
  Synthetic DNA
taaaactactaacactag

SEQ ID NO: 67285 - DNA, 18 bp, Artificial Sequence
  Synthetic DNA
taaaactactcatcctag

SEQ ID NO: 67286 - DNA, 18 bp, Artificial Sequence
  Synthetic DNA
taaaactatacaatttag

SEQ ID NO: 67287 - DNA, 18 bp, Artificial Sequence
  Synthetic DNA
taaaacttcaaactatag

SEQ ID NO: 67288 - DNA, 18 bp, Artificial Sequence
  Synthetic DNA
taaaacttcacactaaag

SEQ ID NO: 67289 - DNA, 18 bp, Artificial Sequence
  Synthetic DNA
taaaacttctctacatag

SEQ ID NO: 67290 - DNA, 18 bp, Artificial Sequence
  Synthetic DNA
taaaagaaaacataaaag

SEQ ID NO: 67291 - DNA, 18 bp, Artificial Sequence
  Synthetic DNA
taaaagaactccccatag

SEQ ID NO: 67292 - DNA, 18 bp, Artificial Sequence
  Synthetic DNA
taaaagatcccactttag

SEQ ID NO: 67293 - DNA, 18 bp, Artificial Sequence
  Synthetic DNA
taaaaggacactcaaaag

SEQ ID NO: 67294 - DNA, 18 bp, Artificial Sequence
  Synthetic DNA
taaaaggactatttatag

SEQ ID NO: 67295 - DNA, 18 bp, Artificial Sequence
  Synthetic DNA
taaaaggactcaattatg

SEQ ID NO: 67296 - DNA, 18 bp, Artificial Sequence
  Synthetic DNA
taaaataactcagtgatg

SEQ ID NO: 67297 - DNA, 18 bp, Artificial Sequence
  Synthetic DNA
taaaatcattcactctag

SEQ ID NO: 67298 - DNA, 18 bp, Artificial Sequence
  Synthetic DNA
taaaatgaaacattacag

SEQ ID NO: 67299 - DNA, 18 bp, Artificial Sequence
  Synthetic DNA
taaaatgactaacgacag

SEQ ID NO: 67300 - DNA, 18 bp, Artificial Sequence
  Synthetic DNA
taaaatgactctcaaaag

SEQ ID NO: 67301 - DNA, 18 bp, Artificial Sequence
  Synthetic DNA
taaaatgacttacttgag

SEQ ID NO: 67302 - DNA, 18 bp, Artificial Sequence
  Synthetic DNA
taaacagactcaatgcag

SEQ ID NO: 67303 - DNA, 18 bp, Artificial Sequence
  Synthetic DNA
taaacagatttactttag

SEQ ID NO: 67304 - DNA, 18 bp, Artificial Sequence
  Synthetic DNA
taaaccgtcacgcaaaag

SEQ ID NO: 67305 - DNA, 18 bp, Artificial Sequence
  Synthetic DNA
taaagcgactagctttag

SEQ ID NO: 67306 - DNA, 18 bp, Artificial Sequence
  Synthetic DNA
taaagcggatgactatag

SEQ ID NO: 67307 - DNA, 18 bp, Artificial Sequence
  Synthetic DNA
taaagctacacaatatag

SEQ ID NO: 67308 - DNA, 18 bp, Artificial Sequence
  Synthetic DNA
taaaggcacttactatag

SEQ ID NO: 67309 - DNA, 18 bp, Artificial Sequence
  Synthetic DNA
taaatagactatctatag

SEQ ID NO: 67310 - DNA, 18 bp, Artificial Sequence
  Synthetic DNA
taaatcgaaccacttcag

SEQ ID NO: 67311 - DNA, 18 bp, Artificial Sequence
  Synthetic DNA
taaatcgactcacacttg

SEQ ID NO: 67312 - DNA, 18 bp, Artificial Sequence
  Synthetic DNA
taaatcgagtttcctttg

SEQ ID NO: 67313 - DNA, 18 bp, Artificial Sequence
  Synthetic DNA
taaatcgtcccacttgtg

SEQ ID NO: 67314 - DNA, 18 bp, Artificial Sequence
  Synthetic DNA
taaatctactcactgtcg

SEQ ID NO: 67315 - DNA, 18 bp, Artificial Sequence
  Synthetic DNA
taaattgactctccatag

SEQ ID NO: 67316 - DNA, 18 bp, Artificial Sequence
  Synthetic DNA
taaattgacttaccatag

SEQ ID NO: 67317 - DNA, 18 bp, Artificial Sequence
  Synthetic DNA
taacaagacaaaccatag

SEQ ID NO: 67318 - DNA, 18 bp, Artificial Sequence
  Synthetic DNA
taacaagactagatttag

SEQ ID NO: 67319 - DNA, 18 bp, Artificial Sequence
  Synthetic DNA
taacacaaatctcgatag

SEQ ID NO: 67320 - DNA, 18 bp, Artificial Sequence
  Synthetic DNA
taacacagctttctatag

SEQ ID NO: 67321 - DNA, 18 bp, Artificial Sequence
  Synthetic DNA
taacaccaaacaatctag

SEQ ID NO: 67322 - DNA, 18 bp, Artificial Sequence
  Synthetic DNA
taacaccactccttttag

SEQ ID NO: 67323 - DNA, 18 bp, Artificial Sequence
  Synthetic DNA
taacacgacaaaatagtg

SEQ ID NO: 67324 - DNA, 18 bp, Artificial Sequence
  Synthetic DNA
taacacgacagactaatg

SEQ ID NO: 67325 - DNA, 18 bp, Artificial Sequence
  Synthetic DNA
taacacgaccaattattg

SEQ ID NO: 67326 - DNA, 18 bp, Artificial Sequence
  Synthetic DNA
taacacgactttcttcgg

SEQ ID NO: 67327 - DNA, 18 bp, Artificial Sequence
  Synthetic DNA
taacacgagaatctatag

SEQ ID NO: 67328 - DNA, 18 bp, Artificial Sequence
  Synthetic DNA
taacacgataatcgattg

SEQ ID NO: 67329 - DNA, 18 bp, Artificial Sequence
  Synthetic DNA
taacacgcaactctaaag

SEQ ID NO: 67330 - DNA, 18 bp, Artificial Sequence
  Synthetic DNA
taacacgtctcgctttcg

SEQ ID NO: 67331 - DNA, 18 bp, Artificial Sequence
  Synthetic DNA
taacacttctctctaaag

SEQ ID NO: 67332 - DNA, 18 bp, Artificial Sequence
  Synthetic DNA
taacacttcttacaacag

SEQ ID NO: 67333 - DNA, 18 bp, Artificial Sequence
  Synthetic DNA
taacattattcactattg

SEQ ID NO: 67334 - DNA, 18 bp, Artificial Sequence
  Synthetic DNA
taacccgaatcaccaaag

SEQ ID NO: 67335 - DNA, 18 bp, Artificial Sequence
  Synthetic DNA
taaccctactcacttttg

SEQ ID NO: 67336 - DNA, 18 bp, Artificial Sequence
  Synthetic DNA
taacctgatacactaaag

SEQ ID NO: 67337 - DNA, 18 bp, Artificial Sequence
  Synthetic DNA
taacgcgtaactctaaag

SEQ ID NO: 67338 - DNA, 18 bp, Artificial Sequence
  Synthetic DNA
taacgctacactctattg

SEQ ID NO: 67339 - DNA, 18 bp, Artificial Sequence
  Synthetic DNA
taactaaaatcacaatag

SEQ ID NO: 67340 - DNA, 18 bp, Artificial Sequence
  Synthetic DNA
taactcgacacttaatag

SEQ ID NO: 67341 - DNA, 18 bp, Artificial Sequence
  Synthetic DNA
taactcgacgcacttcag

SEQ ID NO: 67342 - DNA, 18 bp, Artificial Sequence
  Synthetic DNA
taactcgtccaactatag

SEQ ID NO: 67343 - DNA, 18 bp, Artificial Sequence
  Synthetic DNA
taactcgtctcacaaaag

SEQ ID NO: 67344 - DNA, 18 bp, Artificial Sequence
  Synthetic DNA
taactcgtctcactactg

SEQ ID NO: 67345 - DNA, 18 bp, Artificial Sequence
  Synthetic DNA
taactcgttataatgaag

SEQ ID NO: 67346 - DNA, 18 bp, Artificial Sequence
  Synthetic DNA
taactctactctcaatag

SEQ ID NO: 67347 - DNA, 18 bp, Artificial Sequence
  Synthetic DNA
taagacatcacactatcg

SEQ ID NO: 67348 - DNA, 18 bp, Artificial Sequence
  Synthetic DNA
taagacgtcttacttaag

SEQ ID NO: 67349 - DNA, 18 bp, Artificial Sequence
  Synthetic DNA
taagaggacacgttatag

SEQ ID NO: 67350 - DNA, 18 bp, Artificial Sequence
  Synthetic DNA
taagatgactgacctatg

SEQ ID NO: 67351 - DNA, 18 bp, Artificial Sequence
  Synthetic DNA
taaggcgactcgcaagcg

SEQ ID NO: 67352 - DNA, 18 bp, Artificial Sequence
  Synthetic DNA
taagtcgattcacttctg

SEQ ID NO: 67353 - DNA, 18 bp, Artificial Sequence
  Synthetic DNA
taagtcgcatctcaactg

SEQ ID NO: 67354 - DNA, 18 bp, Artificial Sequence
  Synthetic DNA
taagtcgtcatactatgg

SEQ ID NO: 67355 - DNA, 18 bp, Artificial Sequence
  Synthetic DNA
taagtcttctctcaatag

SEQ ID NO: 67356 - DNA, 18 bp, Artificial Sequence
  Synthetic DNA
taataaaaatcaatttag

SEQ ID NO: 67357 - DNA, 18 bp, Artificial Sequence
  Synthetic DNA
taataaaactcggtaaag

SEQ ID NO: 67358 - DNA, 18 bp, Artificial Sequence
  Synthetic DNA
taataaatctatctttag

SEQ ID NO: 67359 - DNA, 18 bp, Artificial Sequence
  Synthetic DNA
taataacacaaagtatag

SEQ ID NO: 67360 - DNA, 18 bp, Artificial Sequence
  Synthetic DNA
taataactccccctcaag

SEQ ID NO: 67361 - DNA, 18 bp, Artificial Sequence
  Synthetic DNA
taataagacacactgatg

SEQ ID NO: 67362 - DNA, 18 bp, Artificial Sequence
  Synthetic DNA
taataagacactccattg

SEQ ID NO: 67363 - DNA, 18 bp, Artificial Sequence
  Synthetic DNA
taataagacactgttaag

SEQ ID NO: 67364 - DNA, 18 bp, Artificial Sequence
  Synthetic DNA
taataagaccagcttatg

SEQ ID NO: 67365 - DNA, 18 bp, Artificial Sequence
  Synthetic DNA
taataagactcacatagg

SEQ ID NO: 67366 - DNA, 18 bp, Artificial Sequence
  Synthetic DNA
taataagattatctttag

SEQ ID NO: 67367 - DNA, 18 bp, Artificial Sequence
  Synthetic DNA
taataagattgtcattgg

SEQ ID NO: 67368 - DNA, 18 bp, Artificial Sequence
  Synthetic DNA
taataaggcccaatttag

SEQ ID NO: 67369 - DNA, 18 bp, Artificial Sequence
  Synthetic DNA
taataagtccatctattg

SEQ ID NO: 67370 - DNA, 18 bp, Artificial Sequence
  Synthetic DNA
taataatactcaattaag

SEQ ID NO: 67371 - DNA, 18 bp, Artificial Sequence
  Synthetic DNA
taataatatgcactttag

SEQ ID NO: 67372 - DNA, 18 bp, Artificial Sequence
  Synthetic DNA
taataattctaacataag

SEQ ID NO: 67373 - DNA, 18 bp, Artificial Sequence
  Synthetic DNA
taataattttcacaagtg

SEQ ID NO: 67374 - DNA, 18 bp, Artificial Sequence
  Synthetic DNA
taatacaactcagacttg

SEQ ID NO: 67375 - DNA, 18 bp, Artificial Sequence
  Synthetic DNA
taatacaactctcatacg

SEQ ID NO: 67376 - DNA, 18 bp, Artificial Sequence
  Synthetic DNA
taatacaatatactactg

SEQ ID NO: 67377 - DNA, 18 bp, Artificial Sequence
  Synthetic DNA
taatacaatatgctaaag

SEQ ID NO: 67378 - DNA, 18 bp, Artificial Sequence
  Synthetic DNA
taatacaattctccattg

SEQ ID NO: 67379 - DNA, 18 bp, Artificial Sequence
  Synthetic DNA
taatacaattcttctcgg

SEQ ID NO: 67380 - DNA, 18 bp, Artificial Sequence
  Synthetic DNA
taatacatctctatattg

SEQ ID NO: 67381 - DNA, 18 bp, Artificial Sequence
  Synthetic DNA
taatacatctgtctacag

SEQ ID NO: 67382 - DNA, 18 bp, Artificial Sequence
  Synthetic DNA
taatacatctttctaaag

SEQ ID NO: 67383 - DNA, 18 bp, Artificial Sequence
  Synthetic DNA
taataccaatctctgctg

SEQ ID NO: 67384 - DNA, 18 bp, Artificial Sequence
  Synthetic DNA
taataccacttaacattg

SEQ ID NO: 67385 - DNA, 18 bp, Artificial Sequence
  Synthetic DNA
taatacctataactctag

SEQ ID NO: 67386 - DNA, 18 bp, Artificial Sequence
  Synthetic DNA
taataccttacactttag

SEQ ID NO: 67387 - DNA, 18 bp, Artificial Sequence
  Synthetic DNA
taatacctttctctattg

SEQ ID NO: 67388 - DNA, 18 bp, Artificial Sequence
  Synthetic DNA
taatacgaaaccttttag

SEQ ID NO: 67389 - DNA, 18 bp, Artificial Sequence
  Synthetic DNA
taatacgaatccaaattg

SEQ ID NO: 67390 - DNA, 18 bp, Artificial Sequence
  Synthetic DNA
taatacgacactcaaccg

SEQ ID NO: 67391 - DNA, 18 bp, Artificial Sequence
  Synthetic DNA
taatacgacagacttacg

SEQ ID NO: 67392 - DNA, 18 bp, Artificial Sequence
  Synthetic DNA
taatacgacatacatttg

SEQ ID NO: 67393 - DNA, 18 bp, Artificial Sequence
  Synthetic DNA
taatacgaccaacaaatg

SEQ ID NO: 67394 - DNA, 18 bp, Artificial Sequence
  Synthetic DNA
taatacgacgatctcaag

SEQ ID NO: 67395 - DNA, 18 bp, Artificial Sequence
  Synthetic DNA
taatacgactaatcaacg

SEQ ID NO: 67396 - DNA, 18 bp, Artificial Sequence
  Synthetic DNA
taatacgacttaaacaag

SEQ ID NO: 67397 - DNA, 18 bp, Artificial Sequence
  Synthetic DNA
taatacgacttttaattg

SEQ ID NO: 67398 - DNA, 18 bp, Artificial Sequence
  Synthetic DNA
taatacgagaaattattg

SEQ ID NO: 67399 - DNA, 18 bp, Artificial Sequence
  Synthetic DNA
taatacgagtcgcacaag

SEQ ID NO: 67400 - DNA, 18 bp, Artificial Sequence
  Synthetic DNA
taatacgataccatcaag

SEQ ID NO: 67401 - DNA, 18 bp, Artificial Sequence
  Synthetic DNA
taatacgattacttacgg

SEQ ID NO: 67402 - DNA, 18 bp, Artificial Sequence
  Synthetic DNA
taatacgattcaattagg

SEQ ID NO: 67403 - DNA, 18 bp, Artificial Sequence
  Synthetic DNA
taatacgattcacacatg

SEQ ID NO: 67404 - DNA, 18 bp, Artificial Sequence
  Synthetic DNA
taatacgattctatcaag

SEQ ID NO: 67405 - DNA, 18 bp, Artificial Sequence
  Synthetic DNA
taatacgattgacggtcg

SEQ ID NO: 67406 - DNA, 18 bp, Artificial Sequence
  Synthetic DNA
taatacgattgtatttag

SEQ ID NO: 67407 - DNA, 18 bp, Artificial Sequence
  Synthetic DNA
taatacgatttggaattg

SEQ ID NO: 67408 - DNA, 18 bp, Artificial Sequence
  Synthetic DNA
taatacgcatcaatttcg

SEQ ID NO: 67409 - DNA, 18 bp, Artificial Sequence
  Synthetic DNA
taatacgcatccctttgg

SEQ ID NO: 67410 - DNA, 18 bp, Artificial Sequence
  Synthetic DNA
taatacgcatcgttctag

SEQ ID NO: 67411 - DNA, 18 bp, Artificial Sequence
  Synthetic DNA
taatacgcctcagccttg

SEQ ID NO: 67412 - DNA, 18 bp, Artificial Sequence
  Synthetic DNA
taatacgcgtaactcatg

SEQ ID NO: 67413 - DNA, 18 bp, Artificial Sequence
  Synthetic DNA
taatacggcataatgtag

SEQ ID NO: 67414 - DNA, 18 bp, Artificial Sequence
  Synthetic DNA
taatacggctgtcgtcag

SEQ ID NO: 67415 - DNA, 18 bp, Artificial Sequence
  Synthetic DNA
taatacgtaagtctattg

SEQ ID NO: 67416 - DNA, 18 bp, Artificial Sequence
  Synthetic DNA
taatacgtagcaatagag

SEQ ID NO: 67417 - DNA, 18 bp, Artificial Sequence
  Synthetic DNA
taatacgtcaaacttaag

SEQ ID NO: 67418 - DNA, 18 bp, Artificial Sequence
  Synthetic DNA
taatacgtcacgatgaag

SEQ ID NO: 67419 - DNA, 18 bp, Artificial Sequence
  Synthetic DNA
taatacgtccgacttaag

SEQ ID NO: 67420 - DNA, 18 bp, Artificial Sequence
  Synthetic DNA
taatacgtcttacactgg

SEQ ID NO: 67421 - DNA, 18 bp, Artificial Sequence
  Synthetic DNA
taatacgttgcattatcg

SEQ ID NO: 67422 - DNA, 18 bp, Artificial Sequence
  Synthetic DNA
taatacgtttatgattag

SEQ ID NO: 67423 - DNA, 18 bp, Artificial Sequence
  Synthetic DNA
taatactaaataatatag

SEQ ID NO: 67424 - DNA, 18 bp, Artificial Sequence
  Synthetic DNA
taatactactatagatcg

SEQ ID NO: 67425 - DNA, 18 bp, Artificial Sequence
  Synthetic DNA
taatactactcacccgtg

SEQ ID NO: 67426 - DNA, 18 bp, Artificial Sequence
  Synthetic DNA
taatactactcatattgg

SEQ ID NO: 67427 - DNA, 18 bp, Artificial Sequence
  Synthetic DNA
taatactataataaacag

SEQ ID NO: 67428 - DNA, 18 bp, Artificial Sequence
  Synthetic DNA
taatactattctgtattg

SEQ ID NO: 67429 - DNA, 18 bp, Artificial Sequence
  Synthetic DNA
taatactcatcactttcg

SEQ ID NO: 67430 - DNA, 18 bp, Artificial Sequence
  Synthetic DNA
taatactcctcatcattg

SEQ ID NO: 67431 - DNA, 18 bp, Artificial Sequence
  Synthetic DNA
taatactgtattctatag

SEQ ID NO: 67432 - DNA, 18 bp, Artificial Sequence
  Synthetic DNA
taatacttcacaccattg

SEQ ID NO: 67433 - DNA, 18 bp, Artificial Sequence
  Synthetic DNA
taatacttcccacatttg

SEQ ID NO: 67434 - DNA, 18 bp, Artificial Sequence
  Synthetic DNA
taatacttttcaacatag

SEQ ID NO: 67435 - DNA, 18 bp, Artificial Sequence
  Synthetic DNA
taatagaactcacatttg

SEQ ID NO: 67436 - DNA, 18 bp, Artificial Sequence
  Synthetic DNA
taatagatcacactttag

SEQ ID NO: 67437 - DNA, 18 bp, Artificial Sequence
  Synthetic DNA
taatagatctctcgattg

SEQ ID NO: 67438 - DNA, 18 bp, Artificial Sequence
  Synthetic DNA
taatagcacatacaatag

SEQ ID NO: 67439 - DNA, 18 bp, Artificial Sequence
  Synthetic DNA
taataggaattacttaag

SEQ ID NO: 67440 - DNA, 18 bp, Artificial Sequence
  Synthetic DNA
taataggaatttttatag

SEQ ID NO: 67441 - DNA, 18 bp, Artificial Sequence
  Synthetic DNA
taataggatacaaaatag

SEQ ID NO: 67442 - DNA, 18 bp, Artificial Sequence
  Synthetic DNA
taataggtttcacactag

SEQ ID NO: 67443 - DNA, 18 bp, Artificial Sequence
  Synthetic DNA
taatagtccacaggtttg

SEQ ID NO: 67444 - DNA, 18 bp, Artificial Sequence
  Synthetic DNA
taatagtcctcttaatag

SEQ ID NO: 67445 - DNA, 18 bp, Artificial Sequence
  Synthetic DNA
taatataaatcccgtcag

SEQ ID NO: 67446 - DNA, 18 bp, Artificial Sequence
  Synthetic DNA
taatataactggcattcg

SEQ ID NO: 67447 - DNA, 18 bp, Artificial Sequence
  Synthetic DNA
taatatcgctctcaatag

SEQ ID NO: 67448 - DNA, 18 bp, Artificial Sequence
  Synthetic DNA
taatatctctctttatag

SEQ ID NO: 67449 - DNA, 18 bp, Artificial Sequence
  Synthetic DNA
taatatctttcatcatcg

SEQ ID NO: 67450 - DNA, 18 bp, Artificial Sequence
  Synthetic DNA
taatatgacacaaaattg

SEQ ID NO: 67451 - DNA, 18 bp, Artificial Sequence
  Synthetic DNA
taatatgactctataggg

SEQ ID NO: 67452 - DNA, 18 bp, Artificial Sequence
  Synthetic DNA
taatatgattcaccctgg

SEQ ID NO: 67453 - DNA, 18 bp, Artificial Sequence
  Synthetic DNA
taatatgcatcagtcaag

SEQ ID NO: 67454 - DNA, 18 bp, Artificial Sequence
  Synthetic DNA
taatatgccactctccag

SEQ ID NO: 67455 - DNA, 18 bp, Artificial Sequence
  Synthetic DNA
taatatggctttctattg

SEQ ID NO: 67456 - DNA, 18 bp, Artificial Sequence
  Synthetic DNA
taatatggctttttctag

SEQ ID NO: 67457 - DNA, 18 bp, Artificial Sequence
  Synthetic DNA
taatatgtcgcgttatag

SEQ ID NO: 67458 - DNA, 18 bp, Artificial Sequence
  Synthetic DNA
taatattacacattattg

SEQ ID NO: 67459 - DNA, 18 bp, Artificial Sequence
  Synthetic DNA
taatcagaaccactttag

SEQ ID NO: 67460 - DNA, 18 bp, Artificial Sequence
  Synthetic DNA
taatcagaatctcaatag

SEQ ID NO: 67461 - DNA, 18 bp, Artificial Sequence
  Synthetic DNA
taatcagacacagtagag

SEQ ID NO: 67462 - DNA, 18 bp, Artificial Sequence
  Synthetic DNA
taatcagactccttatgg

SEQ ID NO: 67463 - DNA, 18 bp, Artificial Sequence
  Synthetic DNA
taatcagtttcgctacag

SEQ ID NO: 67464 - DNA, 18 bp, Artificial Sequence
  Synthetic DNA
taatcataatcactattg

SEQ ID NO: 67465 - DNA, 18 bp, Artificial Sequence
  Synthetic DNA
taatccaaacaactatag

SEQ ID NO: 67466 - DNA, 18 bp, Artificial Sequence
  Synthetic DNA
taatccaattgactaatg

SEQ ID NO: 67467 - DNA, 18 bp, Artificial Sequence
  Synthetic DNA
taatcccactcatttaag

SEQ ID NO: 67468 - DNA, 18 bp, Artificial Sequence
  Synthetic DNA
taatccgaattacaactg

SEQ ID NO: 67469 - DNA, 18 bp, Artificial Sequence
  Synthetic DNA
taatccgacttacacaag

SEQ ID NO: 67470 - DNA, 18 bp, Artificial Sequence
  Synthetic DNA
taatccgataccaaatag

SEQ ID NO: 67471 - DNA, 18 bp, Artificial Sequence
  Synthetic DNA
taatccgattctgtaacg

SEQ ID NO: 67472 - DNA, 18 bp, Artificial Sequence
  Synthetic DNA
taatccggctctttaatg

SEQ ID NO: 67473 - DNA, 18 bp, Artificial Sequence
  Synthetic DNA
taatccgtccccccatag

SEQ ID NO: 67474 - DNA, 18 bp, Artificial Sequence
  Synthetic DNA
taatccgtctcatcttag

SEQ ID NO: 67475 - DNA, 18 bp, Artificial Sequence
  Synthetic DNA
taatccgtctcgtattag

SEQ ID NO: 67476 - DNA, 18 bp, Artificial Sequence
  Synthetic DNA
taatccgtcttagcttcg

SEQ ID NO: 67477 - DNA, 18 bp, Artificial Sequence
  Synthetic DNA
taatcctaccctttttag

SEQ ID NO: 67478 - DNA, 18 bp, Artificial Sequence
  Synthetic DNA
taatcctactcacaaacg

SEQ ID NO: 67479 - DNA, 18 bp, Artificial Sequence
  Synthetic DNA
taatcctattcacaatcg

SEQ ID NO: 67480 - DNA, 18 bp, Artificial Sequence
  Synthetic DNA
taatctgacacacttctg

SEQ ID NO: 67481 - DNA, 18 bp, Artificial Sequence
  Synthetic DNA
taatgcaaattactacag

SEQ ID NO: 67482 - DNA, 18 bp, Artificial Sequence
  Synthetic DNA
taatgcaacttgctttag

SEQ ID NO: 67483 - DNA, 18 bp, Artificial Sequence
  Synthetic DNA
taatgcatctcattttag

SEQ ID NO: 67484 - DNA, 18 bp, Artificial Sequence
  Synthetic DNA
taatgccaataactattg

SEQ ID NO: 67485 - DNA, 18 bp, Artificial Sequence
  Synthetic DNA
taatgccacctactattg

SEQ ID NO: 67486 - DNA, 18 bp, Artificial Sequence
  Synthetic DNA
taatgcggctcactcatg

SEQ ID NO: 67487 - DNA, 18 bp, Artificial Sequence
  Synthetic DNA
taatgcggctctctgttg

SEQ ID NO: 67488 - DNA, 18 bp, Artificial Sequence
  Synthetic DNA
taatgcggtactcaatag

SEQ ID NO: 67489 - DNA, 18 bp, Artificial Sequence
  Synthetic DNA
taatgcggttcaatattg

SEQ ID NO: 67490 - DNA, 18 bp, Artificial Sequence
  Synthetic DNA
taatgcgtcccccttttg

SEQ ID NO: 67491 - DNA, 18 bp, Artificial Sequence
  Synthetic DNA
taatgctttacactatag

SEQ ID NO: 67492 - DNA, 18 bp, Artificial Sequence
  Synthetic DNA
taatgggtttctttattg

SEQ ID NO: 67493 - DNA, 18 bp, Artificial Sequence
  Synthetic DNA
taattaaactcattgtag

SEQ ID NO: 67494 - DNA, 18 bp, Artificial Sequence
  Synthetic DNA
taattacaatcactaaag

SEQ ID NO: 67495 - DNA, 18 bp, Artificial Sequence
  Synthetic DNA
taattagacgctctatgg

SEQ ID NO: 67496 - DNA, 18 bp, Artificial Sequence
  Synthetic DNA
taattagactcatattag

SEQ ID NO: 67497 - DNA, 18 bp, Artificial Sequence
  Synthetic DNA
taattagtcgaactatag

SEQ ID NO: 67498 - DNA, 18 bp, Artificial Sequence
  Synthetic DNA
taattagtctttctatag

SEQ ID NO: 67499 - DNA, 18 bp, Artificial Sequence
  Synthetic DNA
taattagtgcccgtaatg

SEQ ID NO: 67500 - DNA, 18 bp, Artificial Sequence
  Synthetic DNA
taattagtttcactttag

SEQ ID NO: 67501 - DNA, 18 bp, Artificial Sequence
  Synthetic DNA
taattatactcagtattg

SEQ ID NO: 67502 - DNA, 18 bp, Artificial Sequence
  Synthetic DNA
taattcaacacacttaag

SEQ ID NO: 67503 - DNA, 18 bp, Artificial Sequence
  Synthetic DNA
taattcaactcaaaattg

SEQ ID NO: 67504 - DNA, 18 bp, Artificial Sequence
  Synthetic DNA
taattcaactcaacgaag

SEQ ID NO: 67505 - DNA, 18 bp, Artificial Sequence
  Synthetic DNA
taattcaactttcttttg

SEQ ID NO: 67506 - DNA, 18 bp, Artificial Sequence
  Synthetic DNA
taattcaattctcaatag

SEQ ID NO: 67507 - DNA, 18 bp, Artificial Sequence
  Synthetic DNA
taattcaattctccaaag

SEQ ID NO: 67508 - DNA, 18 bp, Artificial Sequence
  Synthetic DNA
taattcacctatcaaaag

SEQ ID NO: 67509 - DNA, 18 bp, Artificial Sequence
  Synthetic DNA
taattcatctcgccatag

SEQ ID NO: 67510 - DNA, 18 bp, Artificial Sequence
  Synthetic DNA
taattcatctgactgtag

SEQ ID NO: 67511 - DNA, 18 bp, Artificial Sequence
  Synthetic DNA
taattccaatcattattg

SEQ ID NO: 67512 - DNA, 18 bp, Artificial Sequence
  Synthetic DNA
taattccactctctgttg

SEQ ID NO: 67513 - DNA, 18 bp, Artificial Sequence
  Synthetic DNA
taattcccctcacaattg

SEQ ID NO: 67514 - DNA, 18 bp, Artificial Sequence
  Synthetic DNA
taattcccctgaccaatg

SEQ ID NO: 67515 - DNA, 18 bp, Artificial Sequence
  Synthetic DNA
taattccgcacacttttg

SEQ ID NO: 67516 - DNA, 18 bp, Artificial Sequence
  Synthetic DNA
taattcgaaggacaatag

SEQ ID NO: 67517 - DNA, 18 bp, Artificial Sequence
  Synthetic DNA
taattcgaatcttccatg

SEQ ID NO: 67518 - DNA, 18 bp, Artificial Sequence
  Synthetic DNA
taattcgacaaagtgtag

SEQ ID NO: 67519 - DNA, 18 bp, Artificial Sequence
  Synthetic DNA
taattcgacaattacggg

SEQ ID NO: 67520 - DNA, 18 bp, Artificial Sequence
  Synthetic DNA
taattcgacacactttta

SEQ ID NO: 67521 - DNA, 18 bp, Artificial Sequence
  Synthetic DNA
taattcgaccaacactag

SEQ ID NO: 67522 - DNA, 18 bp, Artificial Sequence
  Synthetic DNA
taattcgacccgcttaag

SEQ ID NO: 67523 - DNA, 18 bp, Artificial Sequence
  Synthetic DNA
taattcgacgcacatcag

SEQ ID NO: 67524 - DNA, 18 bp, Artificial Sequence
  Synthetic DNA
taattcgactctcacgtg

SEQ ID NO: 67525 - DNA, 18 bp, Artificial Sequence
  Synthetic DNA
taattcgactgacaaatg

SEQ ID NO: 67526 - DNA, 18 bp, Artificial Sequence
  Synthetic DNA
taattcgagttatgaaag

SEQ ID NO: 67527 - DNA, 18 bp, Artificial Sequence
  Synthetic DNA
taattcgccttaccaaag

SEQ ID NO: 67528 - DNA, 18 bp, Artificial Sequence
  Synthetic DNA
taattcgtatcacatgag

SEQ ID NO: 67529 - DNA, 18 bp, Artificial Sequence
  Synthetic DNA
taattcgtatcagtatcg

SEQ ID NO: 67530 - DNA, 18 bp, Artificial Sequence
  Synthetic DNA
taattcgtctttcaatag

SEQ ID NO: 67531 - DNA, 18 bp, Artificial Sequence
  Synthetic DNA
taattcgtttatttatag

SEQ ID NO: 67532 - DNA, 18 bp, Artificial Sequence
  Synthetic DNA
taattcgtttcacacttg

SEQ ID NO: 67533 - DNA, 18 bp, Artificial Sequence
  Synthetic DNA
taattctaaacacaatag

SEQ ID NO: 67534 - DNA, 18 bp, Artificial Sequence
  Synthetic DNA
taattctaatcactactg

SEQ ID NO: 67535 - DNA, 18 bp, Artificial Sequence
  Synthetic DNA
taattctaatccctatgg

SEQ ID NO: 67536 - DNA, 18 bp, Artificial Sequence
  Synthetic DNA
taattctacataccatgg

SEQ ID NO: 67537 - DNA, 18 bp, Artificial Sequence
  Synthetic DNA
taattcttcgctctatag

SEQ ID NO: 67538 - DNA, 18 bp, Artificial Sequence
  Synthetic DNA
taattgctctcactaaag

SEQ ID NO: 67539 - DNA, 18 bp, Artificial Sequence
  Synthetic DNA
taattggattcacaatgg

SEQ ID NO: 67540 - DNA, 18 bp, Artificial Sequence
  Synthetic DNA
taattgtactctttatag

SEQ ID NO: 67541 - DNA, 18 bp, Artificial Sequence
  Synthetic DNA
taattgtattcgctatag

SEQ ID NO: 67542 - DNA, 18 bp, Artificial Sequence
  Synthetic DNA
taatttaacacacaattg

SEQ ID NO: 67543 - DNA, 18 bp, Artificial Sequence
  Synthetic DNA
taatttaacacactattg

SEQ ID NO: 67544 - DNA, 18 bp, Artificial Sequence
  Synthetic DNA
taatttgacttccagtag

SEQ ID NO: 67545 - DNA, 18 bp, Artificial Sequence
  Synthetic DNA
taatttgatagactattg

SEQ ID NO: 67546 - DNA, 18 bp, Artificial Sequence
  Synthetic DNA
taatttgattggctatag

SEQ ID NO: 67547 - DNA, 18 bp, Artificial Sequence
  Synthetic DNA
taatttgtcacacgatag

SEQ ID NO: 67548 - DNA, 18 bp, Artificial Sequence
  Synthetic DNA
tacaaaaacaatctttag

SEQ ID NO: 67549 - DNA, 18 bp, Artificial Sequence
  Synthetic DNA
tacaaccactctctgaag

SEQ ID NO: 67550 - DNA, 18 bp, Artificial Sequence
  Synthetic DNA
tacaaccgctccctatag

SEQ ID NO: 67551 - DNA, 18 bp, Artificial Sequence
  Synthetic DNA
tacaaccgcttactttag

SEQ ID NO: 67552 - DNA, 18 bp, Artificial Sequence
  Synthetic DNA
tacaacgactcatcattg

SEQ ID NO: 67553 - DNA, 18 bp, Artificial Sequence
  Synthetic DNA
tacaacgactctacattg

SEQ ID NO: 67554 - DNA, 18 bp, Artificial Sequence
  Synthetic DNA
tacaacgtatccccatag

SEQ ID NO: 67555 - DNA, 18 bp, Artificial Sequence
  Synthetic DNA
tacaacgtctcaataaag

SEQ ID NO: 67556 - DNA, 18 bp, Artificial Sequence
  Synthetic DNA
tacaactactcacttttg

SEQ ID NO: 67557 - DNA, 18 bp, Artificial Sequence
  Synthetic DNA
tacaactattcactaaag

SEQ ID NO: 67558 - DNA, 18 bp, Artificial Sequence
  Synthetic DNA
tacaattactccctatag

SEQ ID NO: 67559 - DNA, 18 bp, Artificial Sequence
  Synthetic DNA
tacaccgagtcaatatgg

SEQ ID NO: 67560 - DNA, 18 bp, Artificial Sequence
  Synthetic DNA
tacactgactccctaaag

SEQ ID NO: 67561 - DNA, 18 bp, Artificial Sequence
  Synthetic DNA
tacatccacttactttag

SEQ ID NO: 67562 - DNA, 18 bp, Artificial Sequence
  Synthetic DNA
tacatcgactcacttaag

SEQ ID NO: 67563 - DNA, 18 bp, Artificial Sequence
  Synthetic DNA
tacatcgattctctattg

SEQ ID NO: 67564 - DNA, 18 bp, Artificial Sequence
  Synthetic DNA
tacattggcttattttag

SEQ ID NO: 67565 - DNA, 18 bp, Artificial Sequence
  Synthetic DNA
taccacgaatctatatag

SEQ ID NO: 67566 - DNA, 18 bp, Artificial Sequence
  Synthetic DNA
taccacgactcgcgttag

SEQ ID NO: 67567 - DNA, 18 bp, Artificial Sequence
  Synthetic DNA
taccatgattaaagatag

SEQ ID NO: 67568 - DNA, 18 bp, Artificial Sequence
  Synthetic DNA
taccgcgattgtctaaag

SEQ ID NO: 67569 - DNA, 18 bp, Artificial Sequence
  Synthetic DNA
tacctcgatacatttgag

SEQ ID NO: 67570 - DNA, 18 bp, Artificial Sequence
  Synthetic DNA
tacctcgtctcattatag

SEQ ID NO: 67571 - DNA, 18 bp, Artificial Sequence
  Synthetic DNA
tactaaaacagactatag

SEQ ID NO: 67572 - DNA, 18 bp, Artificial Sequence
  Synthetic DNA
tactaatgttcacaatag

SEQ ID NO: 67573 - DNA, 18 bp, Artificial Sequence
  Synthetic DNA
tactacaaatcttttaag

SEQ ID NO: 67574 - DNA, 18 bp, Artificial Sequence
  Synthetic DNA
tactacaacacaatattg

SEQ ID NO: 67575 - DNA, 18 bp, Artificial Sequence
  Synthetic DNA
tactacaacccactaagg

SEQ ID NO: 67576 - DNA, 18 bp, Artificial Sequence
  Synthetic DNA
tactacatcacacgctag

SEQ ID NO: 67577 - DNA, 18 bp, Artificial Sequence
  Synthetic DNA
tactaccactcagagtag

SEQ ID NO: 67578 - DNA, 18 bp, Artificial Sequence
  Synthetic DNA
tactaccgcaaactatag

SEQ ID NO: 67579 - DNA, 18 bp, Artificial Sequence
  Synthetic DNA
tactacgaacttctatag

SEQ ID NO: 67580 - DNA, 18 bp, Artificial Sequence
  Synthetic DNA
tactacgaatatctatgg

SEQ ID NO: 67581 - DNA, 18 bp, Artificial Sequence
  Synthetic DNA
tactacgaattacttcag

SEQ ID NO: 67582 - DNA, 18 bp, Artificial Sequence
  Synthetic DNA
tactacgacccaacaatg

SEQ ID NO: 67583 - DNA, 18 bp, Artificial Sequence
  Synthetic DNA
tactacggaacactatcg

SEQ ID NO: 67584 - DNA, 18 bp, Artificial Sequence
  Synthetic DNA
tactacgtcaaactttag

SEQ ID NO: 67585 - DNA, 18 bp, Artificial Sequence
  Synthetic DNA
tactactattccctgatg

SEQ ID NO: 67586 - DNA, 18 bp, Artificial Sequence
  Synthetic DNA
tactaggacatactttcg

SEQ ID NO: 67587 - DNA, 18 bp, Artificial Sequence
  Synthetic DNA
tactatatcacactaaag

SEQ ID NO: 67588 - DNA, 18 bp, Artificial Sequence
  Synthetic DNA
tactatgtctcgcgatag

SEQ ID NO: 67589 - DNA, 18 bp, Artificial Sequence
  Synthetic DNA
tactccgtcacaatatag

SEQ ID NO: 67590 - DNA, 18 bp, Artificial Sequence
  Synthetic DNA
tactgcgtttctttttgg

SEQ ID NO: 67591 - DNA, 18 bp, Artificial Sequence
  Synthetic DNA
tacttccactcataatag

SEQ ID NO: 67592 - DNA, 18 bp, Artificial Sequence
  Synthetic DNA
tacttcgactctgtatgg

SEQ ID NO: 67593 - DNA, 18 bp, Artificial Sequence
  Synthetic DNA
tacttcgatactccatag

SEQ ID NO: 67594 - DNA, 18 bp, Artificial Sequence
  Synthetic DNA
tacttcgtcactctaacg

SEQ ID NO: 67595 - DNA, 18 bp, Artificial Sequence
  Synthetic DNA
tacttcttatcactatag

SEQ ID NO: 67596 - DNA, 18 bp, Artificial Sequence
  Synthetic DNA
tagaaccacatggaattg

SEQ ID NO: 67597 - DNA, 18 bp, Artificial Sequence
  Synthetic DNA
tagaacgattcacttttg

SEQ ID NO: 67598 - DNA, 18 bp, Artificial Sequence
  Synthetic DNA
tagaacgtctcaataaag

SEQ ID NO: 67599 - DNA, 18 bp, Artificial Sequence
  Synthetic DNA
tagaacgtctctttaaag

SEQ ID NO: 67600 - DNA, 18 bp, Artificial Sequence
  Synthetic DNA
tagaactactcaaagttg

SEQ ID NO: 67601 - DNA, 18 bp, Artificial Sequence
  Synthetic DNA
tagacttactcatttttg

SEQ ID NO: 67602 - DNA, 18 bp, Artificial Sequence
  Synthetic DNA
tagatcgctttacttaag

SEQ ID NO: 67603 - DNA, 18 bp, Artificial Sequence
  Synthetic DNA
tagcacgtctcacatacg

SEQ ID NO: 67604 - DNA, 18 bp, Artificial Sequence
  Synthetic DNA
tagcactacttactttag

SEQ ID NO: 67605 - DNA, 18 bp, Artificial Sequence
  Synthetic DNA
tagcatgactcattctag

SEQ ID NO: 67606 - DNA, 18 bp, Artificial Sequence
  Synthetic DNA
tagcttgacacactatag

SEQ ID NO: 67607 - DNA, 18 bp, Artificial Sequence
  Synthetic DNA
taggaggactgacttatg

SEQ ID NO: 67608 - DNA, 18 bp, Artificial Sequence
  Synthetic DNA
taggcctacttaatgtag

SEQ ID NO: 67609 - DNA, 18 bp, Artificial Sequence
  Synthetic DNA
tagtaagagccactgatg

SEQ ID NO: 67610 - DNA, 18 bp, Artificial Sequence
  Synthetic DNA
tagtaagtctcacttttg

SEQ ID NO: 67611 - DNA, 18 bp, Artificial Sequence
  Synthetic DNA
tagtacaacacacaattg

SEQ ID NO: 67612 - DNA, 18 bp, Artificial Sequence
  Synthetic DNA
tagtacaacccaccaaag

SEQ ID NO: 67613 - DNA, 18 bp, Artificial Sequence
  Synthetic DNA
tagtacaactctctgaag

SEQ ID NO: 67614 - DNA, 18 bp, Artificial Sequence
  Synthetic DNA
tagtacaattccctaaag

SEQ ID NO: 67615 - DNA, 18 bp, Artificial Sequence
  Synthetic DNA
tagtacatctcacattag

SEQ ID NO: 67616 - DNA, 18 bp, Artificial Sequence
  Synthetic DNA
tagtaccactccgtacag

SEQ ID NO: 67617 - DNA, 18 bp, Artificial Sequence
  Synthetic DNA
tagtaccatttccttcgg

SEQ ID NO: 67618 - DNA, 18 bp, Artificial Sequence
  Synthetic DNA
tagtacgaaacaatacag

SEQ ID NO: 67619 - DNA, 18 bp, Artificial Sequence
  Synthetic DNA
tagtacgaatgtcaatag

SEQ ID NO: 67620 - DNA, 18 bp, Artificial Sequence
  Synthetic DNA
tagtacgacatacaatgg

SEQ ID NO: 67621 - DNA, 18 bp, Artificial Sequence
  Synthetic DNA
tagtacgtctatctttag

SEQ ID NO: 67622 - DNA, 18 bp, Artificial Sequence
  Synthetic DNA
tagtacgtcttacttttg

SEQ ID NO: 67623 - DNA, 18 bp, Artificial Sequence
  Synthetic DNA
tagtacgtgtcaacatag

SEQ ID NO: 67624 - DNA, 18 bp, Artificial Sequence
  Synthetic DNA
tagtacgttactaaaatg

SEQ ID NO: 67625 - DNA, 18 bp, Artificial Sequence
  Synthetic DNA
tagtacgttactttatag

SEQ ID NO: 67626 - DNA, 18 bp, Artificial Sequence
  Synthetic DNA
tagtactactcattgttg

SEQ ID NO: 67627 - DNA, 18 bp, Artificial Sequence
  Synthetic DNA
tagtactactctgtatgg

SEQ ID NO: 67628 - DNA, 18 bp, Artificial Sequence
  Synthetic DNA
tagtaggacccactaacg

SEQ ID NO: 67629 - DNA, 18 bp, Artificial Sequence
  Synthetic DNA
tagtaggactcacatgag

SEQ ID NO: 67630 - DNA, 18 bp, Artificial Sequence
  Synthetic DNA
tagtaggtttctctacag

SEQ ID NO: 67631 - DNA, 18 bp, Artificial Sequence
  Synthetic DNA
tagtataactcgctattg

SEQ ID NO: 67632 - DNA, 18 bp, Artificial Sequence
  Synthetic DNA
tagtgcgtctctattttg

SEQ ID NO: 67633 - DNA, 18 bp, Artificial Sequence
  Synthetic DNA
tagttcaacacgttaaag

SEQ ID NO: 67634 - DNA, 18 bp, Artificial Sequence
  Synthetic DNA
tagttcgacttataaaag

SEQ ID NO: 67635 - DNA, 18 bp, Artificial Sequence
  Synthetic DNA
tagttcgatcccctatag

SEQ ID NO: 67636 - DNA, 18 bp, Artificial Sequence
  Synthetic DNA
tagttctactccctgtag

SEQ ID NO: 67637 - DNA, 18 bp, Artificial Sequence
  Synthetic DNA
tagtttcattcactctag

SEQ ID NO: 67638 - DNA, 18 bp, Artificial Sequence
  Synthetic DNA
tagtttgacacattatag

SEQ ID NO: 67639 - DNA, 18 bp, Artificial Sequence
  Synthetic DNA
tataacgaaagtctaaag

SEQ ID NO: 67640 - DNA, 18 bp, Artificial Sequence
  Synthetic DNA
tataacgacaatccagag

SEQ ID NO: 67641 - DNA, 18 bp, Artificial Sequence
  Synthetic DNA
tataacgactccttttag

SEQ ID NO: 67642 - DNA, 18 bp, Artificial Sequence
  Synthetic DNA
tataacgagtcacaatcg

SEQ ID NO: 67643 - DNA, 18 bp, Artificial Sequence
  Synthetic DNA
tataacgagtcaccaaag

SEQ ID NO: 67644 - DNA, 18 bp, Artificial Sequence
  Synthetic DNA
tataacgagtttctaaag

SEQ ID NO: 67645 - DNA, 18 bp, Artificial Sequence
  Synthetic DNA
tataacgatacactctag

SEQ ID NO: 67646 - DNA, 18 bp, Artificial Sequence
  Synthetic DNA
tataacgcatccctttag

SEQ ID NO: 67647 - DNA, 18 bp, Artificial Sequence
  Synthetic DNA
tataacgcatctctatag

SEQ ID NO: 67648 - DNA, 18 bp, Artificial Sequence
  Synthetic DNA
tataacggctccctatcg

SEQ ID NO: 67649 - DNA, 18 bp, Artificial Sequence
  Synthetic DNA
tataacgggtgaatgtag

SEQ ID NO: 67650 - DNA, 18 bp, Artificial Sequence
  Synthetic DNA
tataacgtctaacaatgg

SEQ ID NO: 67651 - DNA, 18 bp, Artificial Sequence
  Synthetic DNA
tataacgtctaactttag

SEQ ID NO: 67652 - DNA, 18 bp, Artificial Sequence
  Synthetic DNA
tataacgtctctctttag

SEQ ID NO: 67653 - DNA, 18 bp, Artificial Sequence
  Synthetic DNA
tataattactcgctctag

SEQ ID NO: 67654 - DNA, 18 bp, Artificial Sequence
  Synthetic DNA
tatacagactcactttag

SEQ ID NO: 67655 - DNA, 18 bp, Artificial Sequence
  Synthetic DNA
tatacccactgactaaag

SEQ ID NO: 67656 - DNA, 18 bp, Artificial Sequence
  Synthetic DNA
tatagggacacactgtag

SEQ ID NO: 67657 - DNA, 18 bp, Artificial Sequence
  Synthetic DNA
tatagtgtcatactacag

SEQ ID NO: 67658 - DNA, 18 bp, Artificial Sequence
  Synthetic DNA
tatatcaactcacaatag

SEQ ID NO: 67659 - DNA, 18 bp, Artificial Sequence
  Synthetic DNA
tatatcgacacactatcg

SEQ ID NO: 67660 - DNA, 18 bp, Artificial Sequence
  Synthetic DNA
tatatcgtctaactttag

SEQ ID NO: 67661 - DNA, 18 bp, Artificial Sequence
  Synthetic DNA
tatatcgtctcgttatcg

SEQ ID NO: 67662 - DNA, 18 bp, Artificial Sequence
  Synthetic DNA
tatcacaactcatggaag

SEQ ID NO: 67663 - DNA, 18 bp, Artificial Sequence
  Synthetic DNA
tatcacgacgctctaaag

SEQ ID NO: 67664 - DNA, 18 bp, Artificial Sequence
  Synthetic DNA
tatcacgactcattacgg

SEQ ID NO: 67665 - DNA, 18 bp, Artificial Sequence
  Synthetic DNA
tatcacgattcaacatag

SEQ ID NO: 67666 - DNA, 18 bp, Artificial Sequence
  Synthetic DNA
tatcacgtctcacaacag

SEQ ID NO: 67667 - DNA, 18 bp, Artificial Sequence
  Synthetic DNA
tatcactactcacactag

SEQ ID NO: 67668 - DNA, 18 bp, Artificial Sequence
  Synthetic DNA
tatcatgcctaaatatag

SEQ ID NO: 67669 - DNA, 18 bp, Artificial Sequence
  Synthetic DNA
tatcccgactttctatag

SEQ ID NO: 67670 - DNA, 18 bp, Artificial Sequence
  Synthetic DNA
tatcgctaatcacaaaag

SEQ ID NO: 67671 - DNA, 18 bp, Artificial Sequence
  Synthetic DNA
tatcgctactcattgacg

SEQ ID NO: 67672 - DNA, 18 bp, Artificial Sequence
  Synthetic DNA
tatgactactccctttag

SEQ ID NO: 67673 - DNA, 18 bp, Artificial Sequence
  Synthetic DNA
tatgacttctcactttag

SEQ ID NO: 67674 - DNA, 18 bp, Artificial Sequence
  Synthetic DNA
tatgatgtctcacaaaag

SEQ ID NO: 67675 - DNA, 18 bp, Artificial Sequence
  Synthetic DNA
tattaaatctcaccatag

SEQ ID NO: 67676 - DNA, 18 bp, Artificial Sequence
  Synthetic DNA
tattaacactaacaatag

SEQ ID NO: 67677 - DNA, 18 bp, Artificial Sequence
  Synthetic DNA
tattaacactcaccttag

SEQ ID NO: 67678 - DNA, 18 bp, Artificial Sequence
  Synthetic DNA
tattaacattccctatag

SEQ ID NO: 67679 - DNA, 18 bp, Artificial Sequence
  Synthetic DNA
tattaagacttataatag

SEQ ID NO: 67680 - DNA, 18 bp, Artificial Sequence
  Synthetic DNA
tattaagagtctatataa

SEQ ID NO: 67681 - DNA, 18 bp, Artificial Sequence
  Synthetic DNA
tattaagcctaacaaccg

SEQ ID NO: 67682 - DNA, 18 bp, Artificial Sequence
  Synthetic DNA
tattaagtctcactcttg

SEQ ID NO: 67683 - DNA, 18 bp, Artificial Sequence
  Synthetic DNA
tattaagtctcccttgag

SEQ ID NO: 67684 - DNA, 18 bp, Artificial Sequence
  Synthetic DNA
tattaatactcaatattg

SEQ ID NO: 67685 - DNA, 18 bp, Artificial Sequence
  Synthetic DNA
tattaatacttgcaaaag

SEQ ID NO: 67686 - DNA, 18 bp, Artificial Sequence
  Synthetic DNA
tattaatgttcactttag

SEQ ID NO: 67687 - DNA, 18 bp, Artificial Sequence
  Synthetic DNA
tattaattctcacaatgg

SEQ ID NO: 67688 - DNA, 18 bp, Artificial Sequence
  Synthetic DNA
tattaattctctctaaag

SEQ ID NO: 67689 - DNA, 18 bp, Artificial Sequence
  Synthetic DNA
tattacaaatctctaaag

SEQ ID NO: 67690 - DNA, 18 bp, Artificial Sequence
  Synthetic DNA
tattacaacacactactg

SEQ ID NO: 67691 - DNA, 18 bp, Artificial Sequence
  Synthetic DNA
tattacaactaacaaaag

SEQ ID NO: 67692 - DNA, 18 bp, Artificial Sequence
  Synthetic DNA
tattacaatacactttag

SEQ ID NO: 67693 - DNA, 18 bp, Artificial Sequence
  Synthetic DNA
tattacaattaagtatag

SEQ ID NO: 67694 - DNA, 18 bp, Artificial Sequence
  Synthetic DNA
tattaccacccccaatgg

SEQ ID NO: 67695 - DNA, 18 bp, Artificial Sequence
  Synthetic DNA
tattaccatttaccttcg

SEQ ID NO: 67696 - DNA, 18 bp, Artificial Sequence
  Synthetic DNA
tattacctcgccctaaag

SEQ ID NO: 67697 - DNA, 18 bp, Artificial Sequence
  Synthetic DNA
tattacctttcacaatag

SEQ ID NO: 67698 - DNA, 18 bp, Artificial Sequence
  Synthetic DNA
tattacgaatctcttatg

SEQ ID NO: 67699 - DNA, 18 bp, Artificial Sequence
  Synthetic DNA
tattacgacaagctattg

SEQ ID NO: 67700 - DNA, 18 bp, Artificial Sequence
  Synthetic DNA
tattacgacacattcttg

SEQ ID NO: 67701 - DNA, 18 bp, Artificial Sequence
  Synthetic DNA
tattacgacacgcggatg

SEQ ID NO: 67702 - DNA, 18 bp, Artificial Sequence
  Synthetic DNA
tattacgacactctgttg

SEQ ID NO: 67703 - DNA, 18 bp, Artificial Sequence
  Synthetic DNA
tattacgacattctattg

SEQ ID NO: 67704 - DNA, 18 bp, Artificial Sequence
  Synthetic DNA
tattacgactctttgtcg

SEQ ID NO: 67705 - DNA, 18 bp, Artificial Sequence
  Synthetic DNA
tattacgagctacttcag

SEQ ID NO: 67706 - DNA, 18 bp, Artificial Sequence
  Synthetic DNA
tattacgagtctcacttg

SEQ ID NO: 67707 - DNA, 18 bp, Artificial Sequence
  Synthetic DNA
tattacgcctaacttttg

SEQ ID NO: 67708 - DNA, 18 bp, Artificial Sequence
  Synthetic DNA
tattacgcctcagaattg

SEQ ID NO: 67709 - DNA, 18 bp, Artificial Sequence
  Synthetic DNA
tattacggctcacctcag

SEQ ID NO: 67710 - DNA, 18 bp, Artificial Sequence
  Synthetic DNA
tattacgtaacacttttg

SEQ ID NO: 67711 - DNA, 18 bp, Artificial Sequence
  Synthetic DNA
tattacgtatcactgttg

SEQ ID NO: 67712 - DNA, 18 bp, Artificial Sequence
  Synthetic DNA
tattacgtcatattatag

SEQ ID NO: 67713 - DNA, 18 bp, Artificial Sequence
  Synthetic DNA
tattacgtcattatatag

SEQ ID NO: 67714 - DNA, 18 bp, Artificial Sequence
  Synthetic DNA
tattacgtttcacataag

SEQ ID NO: 67715 - DNA, 18 bp, Artificial Sequence
  Synthetic DNA
tattacgtttcccttatg

SEQ ID NO: 67716 - DNA, 18 bp, Artificial Sequence
  Synthetic DNA
tattactacacagtatcg

SEQ ID NO: 67717 - DNA, 18 bp, Artificial Sequence
  Synthetic DNA
tattactactctcgatcg

SEQ ID NO: 67718 - DNA, 18 bp, Artificial Sequence
  Synthetic DNA
tattactatacactgaag

SEQ ID NO: 67719 - DNA, 18 bp, Artificial Sequence
  Synthetic DNA
tattactcctctctattg

SEQ ID NO: 67720 - DNA, 18 bp, Artificial Sequence
  Synthetic DNA
tattactgctctcaataa

SEQ ID NO: 67721 - DNA, 18 bp, Artificial Sequence
  Synthetic DNA
tattactgttcactgtag

SEQ ID NO: 67722 - DNA, 18 bp, Artificial Sequence
  Synthetic DNA
tattacttcgtactgtag

SEQ ID NO: 67723 - DNA, 18 bp, Artificial Sequence
  Synthetic DNA
tattacttctccctgtag

SEQ ID NO: 67724 - DNA, 18 bp, Artificial Sequence
  Synthetic DNA
tattacttctctctctag

SEQ ID NO: 67725 - DNA, 18 bp, Artificial Sequence
  Synthetic DNA
tattacttgtcactgttg

SEQ ID NO: 67726 - DNA, 18 bp, Artificial Sequence
  Synthetic DNA
tattaggattcaattttg

SEQ ID NO: 67727 - DNA, 18 bp, Artificial Sequence
  Synthetic DNA
tattaggtgtcacaatag

SEQ ID NO: 67728 - DNA, 18 bp, Artificial Sequence
  Synthetic DNA
tattagtttacacgatag

SEQ ID NO: 67729 - DNA, 18 bp, Artificial Sequence
  Synthetic DNA
tattatgaatctctattg

SEQ ID NO: 67730 - DNA, 18 bp, Artificial Sequence
  Synthetic DNA
tattatgacaatctttag

SEQ ID NO: 67731 - DNA, 18 bp, Artificial Sequence
  Synthetic DNA
tattatgactctctgaag

SEQ ID NO: 67732 - DNA, 18 bp, Artificial Sequence
  Synthetic DNA
tattatgactctctttcg

SEQ ID NO: 67733 - DNA, 18 bp, Artificial Sequence
  Synthetic DNA
tattatgcaacaatatag

SEQ ID NO: 67734 - DNA, 18 bp, Artificial Sequence
  Synthetic DNA
tattatgtaacactaatg

SEQ ID NO: 67735 - DNA, 18 bp, Artificial Sequence
  Synthetic DNA
tattatgtctaattatag

SEQ ID NO: 67736 - DNA, 18 bp, Artificial Sequence
  Synthetic DNA
tattatgtctcacagtag

SEQ ID NO: 67737 - DNA, 18 bp, Artificial Sequence
  Synthetic DNA
tattattactcacaatgg

SEQ ID NO: 67738 - DNA, 18 bp, Artificial Sequence
  Synthetic DNA
tattatttctttctattg

SEQ ID NO: 67739 - DNA, 18 bp, Artificial Sequence
  Synthetic DNA
tattcaggttaacccttg

SEQ ID NO: 67740 - DNA, 18 bp, Artificial Sequence
  Synthetic DNA
tattccctctctctttag

SEQ ID NO: 67741 - DNA, 18 bp, Artificial Sequence
  Synthetic DNA
tattccgacactctttag

SEQ ID NO: 67742 - DNA, 18 bp, Artificial Sequence
  Synthetic DNA
tattccgacattcaatag

SEQ ID NO: 67743 - DNA, 18 bp, Artificial Sequence
  Synthetic DNA
tattccgagtcaatacag

SEQ ID NO: 67744 - DNA, 18 bp, Artificial Sequence
  Synthetic DNA
tattccgattcactgttg

SEQ ID NO: 67745 - DNA, 18 bp, Artificial Sequence
  Synthetic DNA
tattccgatttacttgag

SEQ ID NO: 67746 - DNA, 18 bp, Artificial Sequence
  Synthetic DNA
tattcctactctctttag

SEQ ID NO: 67747 - DNA, 18 bp, Artificial Sequence
  Synthetic DNA
tattctaaatcacttgag

SEQ ID NO: 67748 - DNA, 18 bp, Artificial Sequence
  Synthetic DNA
tattgcgactatcatttg

SEQ ID NO: 67749 - DNA, 18 bp, Artificial Sequence
  Synthetic DNA
tattgcgacttacttttg

SEQ ID NO: 67750 - DNA, 18 bp, Artificial Sequence
  Synthetic DNA
tattgtgactcattctag

SEQ ID NO: 67751 - DNA, 18 bp, Artificial Sequence
  Synthetic DNA
tatttagtctcactctag

SEQ ID NO: 67752 - DNA, 18 bp, Artificial Sequence
  Synthetic DNA
tatttagtctcactgtag

SEQ ID NO: 67753 - DNA, 18 bp, Artificial Sequence
  Synthetic DNA
tatttcaacaccctttag

SEQ ID NO: 67754 - DNA, 18 bp, Artificial Sequence
  Synthetic DNA
tatttcaactcacaaatg

SEQ ID NO: 67755 - DNA, 18 bp, Artificial Sequence
  Synthetic DNA
tatttcatctcactattg

SEQ ID NO: 67756 - DNA, 18 bp, Artificial Sequence
  Synthetic DNA
tatttccactcaatattg

SEQ ID NO: 67757 - DNA, 18 bp, Artificial Sequence
  Synthetic DNA
tatttccattaactgaag

SEQ ID NO: 67758 - DNA, 18 bp, Artificial Sequence
  Synthetic DNA
tatttcccctcactaaag

SEQ ID NO: 67759 - DNA, 18 bp, Artificial Sequence
  Synthetic DNA
tatttcgaatcacattag

SEQ ID NO: 67760 - DNA, 18 bp, Artificial Sequence
  Synthetic DNA
tatttcgaatctctaaag

SEQ ID NO: 67761 - DNA, 18 bp, Artificial Sequence
  Synthetic DNA
tatttcgacttattatgg

SEQ ID NO: 67762 - DNA, 18 bp, Artificial Sequence
  Synthetic DNA
tatttcgatacacaatag

SEQ ID NO: 67763 - DNA, 18 bp, Artificial Sequence
  Synthetic DNA
tatttcgatactccttag

SEQ ID NO: 67764 - DNA, 18 bp, Artificial Sequence
  Synthetic DNA
tatttcgtatccctatag

SEQ ID NO: 67765 - DNA, 18 bp, Artificial Sequence
  Synthetic DNA
tatttcgtctcacctttg

SEQ ID NO: 67766 - DNA, 18 bp, Artificial Sequence
  Synthetic DNA
tatttcgtgttactatag

SEQ ID NO: 67767 - DNA, 18 bp, Artificial Sequence
  Synthetic DNA
tatttcgttccactgtag

SEQ ID NO: 67768 - DNA, 18 bp, Artificial Sequence
  Synthetic DNA
tatttcttcgctatattg

SEQ ID NO: 67769 - DNA, 18 bp, Artificial Sequence
  Synthetic DNA
tatttgctctcactatag

SEQ ID NO: 67770 - DNA, 18 bp, Artificial Sequence
  Synthetic DNA
tatttgtactcactatgg

SEQ ID NO: 67771 - DNA, 18 bp, Artificial Sequence
  Synthetic DNA
tattttcactcacttaag

SEQ ID NO: 67772 - DNA, 18 bp, Artificial Sequence
  Synthetic DNA
tattttcgcacactctag

SEQ ID NO: 67773 - DNA, 18 bp, Artificial Sequence
  Synthetic DNA
tattttgactctggatag

SEQ ID NO: 67774 - DNA, 18 bp, Artificial Sequence
  Synthetic DNA
tattttgagccattgaag

SEQ ID NO: 67775 - DNA, 18 bp, Artificial Sequence
  Synthetic DNA
tcaaacaacacgatatag

SEQ ID NO: 67776 - DNA, 18 bp, Artificial Sequence
  Synthetic DNA
tcaaacgacactatatag

SEQ ID NO: 67777 - DNA, 18 bp, Artificial Sequence
  Synthetic DNA
tcaaacgactcacaactg

SEQ ID NO: 67778 - DNA, 18 bp, Artificial Sequence
  Synthetic DNA
tcaaacgacttttcaaag

SEQ ID NO: 67779 - DNA, 18 bp, Artificial Sequence
  Synthetic DNA
tcaaacgtgtcacaatcg

SEQ ID NO: 67780 - DNA, 18 bp, Artificial Sequence
  Synthetic DNA
tcaagggatacactatag

SEQ ID NO: 67781 - DNA, 18 bp, Artificial Sequence
  Synthetic DNA
tcacacgactcattttcg

SEQ ID NO: 67782 - DNA, 18 bp, Artificial Sequence
  Synthetic DNA
tcacacgattcaacgcag

SEQ ID NO: 67783 - DNA, 18 bp, Artificial Sequence
  Synthetic DNA
tcacacgtccatcaatag

SEQ ID NO: 67784 - DNA, 18 bp, Artificial Sequence
  Synthetic DNA
tcacgtcactctctatag

SEQ ID NO: 67785 - DNA, 18 bp, Artificial Sequence
  Synthetic DNA
tcactagacagattctgg

SEQ ID NO: 67786 - DNA, 18 bp, Artificial Sequence
  Synthetic DNA
tcagacgacacagtacag

SEQ ID NO: 67787 - DNA, 18 bp, Artificial Sequence
  Synthetic DNA
tcagacgcctgactagtg

SEQ ID NO: 67788 - DNA, 18 bp, Artificial Sequence
  Synthetic DNA
tcataacgctcactaaag

SEQ ID NO: 67789 - DNA, 18 bp, Artificial Sequence
  Synthetic DNA
tcatacaagtatccatag

SEQ ID NO: 67790 - DNA, 18 bp, Artificial Sequence
  Synthetic DNA
tcatacaattcgatatag

SEQ ID NO: 67791 - DNA, 18 bp, Artificial Sequence
  Synthetic DNA
tcatacatctcattatgg

SEQ ID NO: 67792 - DNA, 18 bp, Artificial Sequence
  Synthetic DNA
tcatacatctctctaacg

SEQ ID NO: 67793 - DNA, 18 bp, Artificial Sequence
  Synthetic DNA
tcatacctcactctctag

SEQ ID NO: 67794 - DNA, 18 bp, Artificial Sequence
  Synthetic DNA
tcatacgaatcacctagg

SEQ ID NO: 67795 - DNA, 18 bp, Artificial Sequence
  Synthetic DNA
tcatacgacactctcatg

SEQ ID NO: 67796 - DNA, 18 bp, Artificial Sequence
  Synthetic DNA
tcatacgacgcactgacg

SEQ ID NO: 67797 - DNA, 18 bp, Artificial Sequence
  Synthetic DNA
tcatacgactattacaag

SEQ ID NO: 67798 - DNA, 18 bp, Artificial Sequence
  Synthetic DNA
tcatacgacttaattttg

SEQ ID NO: 67799 - DNA, 18 bp, Artificial Sequence
  Synthetic DNA
tcatacgacttattcttg

SEQ ID NO: 67800 - DNA, 18 bp, Artificial Sequence
  Synthetic DNA
tcatacgatccacactag

SEQ ID NO: 67801 - DNA, 18 bp, Artificial Sequence
  Synthetic DNA
tcatacgatttgttctcg

SEQ ID NO: 67802 - DNA, 18 bp, Artificial Sequence
  Synthetic DNA
tcatacgccccaaaatag

SEQ ID NO: 67803 - DNA, 18 bp, Artificial Sequence
  Synthetic DNA
tcatacgcctcgacatag

SEQ ID NO: 67804 - DNA, 18 bp, Artificial Sequence
  Synthetic DNA
tcatacggcacccgatag

SEQ ID NO: 67805 - DNA, 18 bp, Artificial Sequence
  Synthetic DNA
tcatacggcccgctgtag

SEQ ID NO: 67806 - DNA, 18 bp, Artificial Sequence
  Synthetic DNA
tcatacggctatctattg

SEQ ID NO: 67807 - DNA, 18 bp, Artificial Sequence
  Synthetic DNA
tcatacggtcaactatag

SEQ ID NO: 67808 - DNA, 18 bp, Artificial Sequence
  Synthetic DNA
tcatacgtatcacttaag

SEQ ID NO: 67809 - DNA, 18 bp, Artificial Sequence
  Synthetic DNA
tcatacgtcatactatcg

SEQ ID NO: 67810 - DNA, 18 bp, Artificial Sequence
  Synthetic DNA
tcatacgtccctctttag

SEQ ID NO: 67811 - DNA, 18 bp, Artificial Sequence
  Synthetic DNA
tcatacgtttctgtatag

SEQ ID NO: 67812 - DNA, 18 bp, Artificial Sequence
  Synthetic DNA
tcatactcctaattaaag

SEQ ID NO: 67813 - DNA, 18 bp, Artificial Sequence
  Synthetic DNA
tcatacttatcactattg

SEQ ID NO: 67814 - DNA, 18 bp, Artificial Sequence
  Synthetic DNA
tcatacttttcactatgg

SEQ ID NO: 67815 - DNA, 18 bp, Artificial Sequence
  Synthetic DNA
tcataggaattccaacag

SEQ ID NO: 67816 - DNA, 18 bp, Artificial Sequence
  Synthetic DNA
tcatatgacatattaaag

SEQ ID NO: 67817 - DNA, 18 bp, Artificial Sequence
  Synthetic DNA
tcatatgtctcccttcag

SEQ ID NO: 67818 - DNA, 18 bp, Artificial Sequence
  Synthetic DNA
tcatattcgtctctaacg

SEQ ID NO: 67819 - DNA, 18 bp, Artificial Sequence
  Synthetic DNA
tcatccgattctctattg

SEQ ID NO: 67820 - DNA, 18 bp, Artificial Sequence
  Synthetic DNA
tcatgcgttacttcgtag

SEQ ID NO: 67821 - DNA, 18 bp, Artificial Sequence
  Synthetic DNA
tcattagacatagtaaag

SEQ ID NO: 67822 - DNA, 18 bp, Artificial Sequence
  Synthetic DNA
tcattagcctcactctag

SEQ ID NO: 67823 - DNA, 18 bp, Artificial Sequence
  Synthetic DNA
tcattccatacacttttg

SEQ ID NO: 67824 - DNA, 18 bp, Artificial Sequence
  Synthetic DNA
tcattcgattctatatag

SEQ ID NO: 67825 - DNA, 18 bp, Artificial Sequence
  Synthetic DNA
tcattcgtttcaaactag

SEQ ID NO: 67826 - DNA, 18 bp, Artificial Sequence
  Synthetic DNA
tccaacatctcactatag

SEQ ID NO: 67827 - DNA, 18 bp, Artificial Sequence
  Synthetic DNA
tccattgattcactattg

SEQ ID NO: 67828 - DNA, 18 bp, Artificial Sequence
  Synthetic DNA
tcctatgccacaatttag

SEQ ID NO: 67829 - DNA, 18 bp, Artificial Sequence
  Synthetic DNA
tcgaacaggacactaaag

SEQ ID NO: 67830 - DNA, 18 bp, Artificial Sequence
  Synthetic DNA
tcgaacgacacaccattg

SEQ ID NO: 67831 - DNA, 18 bp, Artificial Sequence
  Synthetic DNA
tcgaacgactcacttcag

SEQ ID NO: 67832 - DNA, 18 bp, Artificial Sequence
  Synthetic DNA
tcgtactacttaatatag

SEQ ID NO: 67833 - DNA, 18 bp, Artificial Sequence
  Synthetic DNA
tcgtatgactcaatgtcg

SEQ ID NO: 67834 - DNA, 18 bp, Artificial Sequence
  Synthetic DNA
tctaaccactcaatatag

SEQ ID NO: 67835 - DNA, 18 bp, Artificial Sequence
  Synthetic DNA
tctaacgcttaactacag

SEQ ID NO: 67836 - DNA, 18 bp, Artificial Sequence
  Synthetic DNA
tctcatgattcactctag

SEQ ID NO: 67837 - DNA, 18 bp, Artificial Sequence
  Synthetic DNA
tcttaagatacactatag

SEQ ID NO: 67838 - DNA, 18 bp, Artificial Sequence
  Synthetic DNA
tcttaccacttactaaag

SEQ ID NO: 67839 - DNA, 18 bp, Artificial Sequence
  Synthetic DNA
tcttacgaaacacattag

SEQ ID NO: 67840 - DNA, 18 bp, Artificial Sequence
  Synthetic DNA
tcttacgacttattatcg

SEQ ID NO: 67841 - DNA, 18 bp, Artificial Sequence
  Synthetic DNA
tcttacgcctctcaattg

SEQ ID NO: 67842 - DNA, 18 bp, Artificial Sequence
  Synthetic DNA
tcttacttcacactatag

SEQ ID NO: 67843 - DNA, 18 bp, Artificial Sequence
  Synthetic DNA
tgaaacaatttccgttag

SEQ ID NO: 67844 - DNA, 18 bp, Artificial Sequence
  Synthetic DNA
tgaaacgactcataaaag

SEQ ID NO: 67845 - DNA, 18 bp, Artificial Sequence
  Synthetic DNA
tgaaacgatttgctggag

SEQ ID NO: 67846 - DNA, 18 bp, Artificial Sequence
  Synthetic DNA
tgaatctacccactatag

SEQ ID NO: 67847 - DNA, 18 bp, Artificial Sequence
  Synthetic DNA
tgacacagctctctactg

SEQ ID NO: 67848 - DNA, 18 bp, Artificial Sequence
  Synthetic DNA
tgacacatctcacataag

SEQ ID NO: 67849 - DNA, 18 bp, Artificial Sequence
  Synthetic DNA
tgacactactctctagag

SEQ ID NO: 67850 - DNA, 18 bp, Artificial Sequence
  Synthetic DNA
tgacgcgcctcactattg

SEQ ID NO: 67851 - DNA, 18 bp, Artificial Sequence
  Synthetic DNA
tgataacattcacattag

SEQ ID NO: 67852 - DNA, 18 bp, Artificial Sequence
  Synthetic DNA
tgataagactcataatgg

SEQ ID NO: 67853 - DNA, 18 bp, Artificial Sequence
  Synthetic DNA
tgataagacttaatagag

SEQ ID NO: 67854 - DNA, 18 bp, Artificial Sequence
  Synthetic DNA
tgataatactcgttatag

SEQ ID NO: 67855 - DNA, 18 bp, Artificial Sequence
  Synthetic DNA
tgatacaacacacaaaag

SEQ ID NO: 67856 - DNA, 18 bp, Artificial Sequence
  Synthetic DNA
tgatacaactttctattg

SEQ ID NO: 67857 - DNA, 18 bp, Artificial Sequence
  Synthetic DNA
tgatacatctaactatcg

SEQ ID NO: 67858 - DNA, 18 bp, Artificial Sequence
  Synthetic DNA
tgatacgagttatgttag

SEQ ID NO: 67859 - DNA, 18 bp, Artificial Sequence
  Synthetic DNA
tgatacgattctctaatg

SEQ ID NO: 67860 - DNA, 18 bp, Artificial Sequence
  Synthetic DNA
tgatacgccacgctattg

SEQ ID NO: 67861 - DNA, 18 bp, Artificial Sequence
  Synthetic DNA
tgatacgtcacacaatgg

SEQ ID NO: 67862 - DNA, 18 bp, Artificial Sequence
  Synthetic DNA
tgatacgtcttactgaag

SEQ ID NO: 67863 - DNA, 18 bp, Artificial Sequence
  Synthetic DNA
tgatacgtttcaccctag

SEQ ID NO: 67864 - DNA, 18 bp, Artificial Sequence
  Synthetic DNA
tgatactacttaatatcg

SEQ ID NO: 67865 - DNA, 18 bp, Artificial Sequence
  Synthetic DNA
tgatactacttgttataa

SEQ ID NO: 67866 - DNA, 18 bp, Artificial Sequence
  Synthetic DNA
tgatactagtcactaatg

SEQ ID NO: 67867 - DNA, 18 bp, Artificial Sequence
  Synthetic DNA
tgatacttccaaatatag

SEQ ID NO: 67868 - DNA, 18 bp, Artificial Sequence
  Synthetic DNA
tgatacttctcacaattg

SEQ ID NO: 67869 - DNA, 18 bp, Artificial Sequence
  Synthetic DNA
tgatatgacttactgtgg

SEQ ID NO: 67870 - DNA, 18 bp, Artificial Sequence
  Synthetic DNA
tgatctgactccctttag

SEQ ID NO: 67871 - DNA, 18 bp, Artificial Sequence
  Synthetic DNA
tgatgagatccattatag

SEQ ID NO: 67872 - DNA, 18 bp, Artificial Sequence
  Synthetic DNA
tgatgccacacccttttg

SEQ ID NO: 67873 - DNA, 18 bp, Artificial Sequence
  Synthetic DNA
tgattagactccatagag

SEQ ID NO: 67874 - DNA, 18 bp, Artificial Sequence
  Synthetic DNA
tgattcaactcattcttg

SEQ ID NO: 67875 - DNA, 18 bp, Artificial Sequence
  Synthetic DNA
tgattcaattcacgttag

SEQ ID NO: 67876 - DNA, 18 bp, Artificial Sequence
  Synthetic DNA
tgattcgactcacgtttg

SEQ ID NO: 67877 - DNA, 18 bp, Artificial Sequence
  Synthetic DNA
tgattcgactctctgtcg

SEQ ID NO: 67878 - DNA, 18 bp, Artificial Sequence
  Synthetic DNA
tgattgatctcactttag

SEQ ID NO: 67879 - DNA, 18 bp, Artificial Sequence
  Synthetic DNA
tgattggtctacctgtag

SEQ ID NO: 67880 - DNA, 18 bp, Artificial Sequence
  Synthetic DNA
tgcctcgactctatatgg

SEQ ID NO: 67881 - DNA, 18 bp, Artificial Sequence
  Synthetic DNA
tgctactactcaattttg

SEQ ID NO: 67882 - DNA, 18 bp, Artificial Sequence
  Synthetic DNA
tgcttcttttcactatgg

SEQ ID NO: 67883 - DNA, 18 bp, Artificial Sequence
  Synthetic DNA
tggctctattctctattg

SEQ ID NO: 67884 - DNA, 18 bp, Artificial Sequence
  Synthetic DNA
tggtacgactctcaattg

SEQ ID NO: 67885 - DNA, 18 bp, Artificial Sequence
  Synthetic DNA
tggtacgatacaacatag

SEQ ID NO: 67886 - DNA, 18 bp, Artificial Sequence
  Synthetic DNA
tggtacgtttcattaaag

SEQ ID NO: 67887 - DNA, 18 bp, Artificial Sequence
  Synthetic DNA
tgtaaccactgacaattg

SEQ ID NO: 67888 - DNA, 18 bp, Artificial Sequence
  Synthetic DNA
tgtaacgacttactattg

SEQ ID NO: 67889 - DNA, 18 bp, Artificial Sequence
  Synthetic DNA
tgtagcgactcttttaag

SEQ ID NO: 67890 - DNA, 18 bp, Artificial Sequence
  Synthetic DNA
tgtcacgactcaatactg

SEQ ID NO: 67891 - DNA, 18 bp, Artificial Sequence
  Synthetic DNA
tgtcatgattcactattg

SEQ ID NO: 67892 - DNA, 18 bp, Artificial Sequence
  Synthetic DNA
tgttacaagacactgtcg

SEQ ID NO: 67893 - DNA, 18 bp, Artificial Sequence
  Synthetic DNA
tgttaccattcgctatag

SEQ ID NO: 67894 - DNA, 18 bp, Artificial Sequence
  Synthetic DNA
tgttacgacacgcaatag

SEQ ID NO: 67895 - DNA, 18 bp, Artificial Sequence
  Synthetic DNA
tgttacgacacgcttaag

SEQ ID NO: 67896 - DNA, 18 bp, Artificial Sequence
  Synthetic DNA
tgttacgactttttttag

SEQ ID NO: 67897 - DNA, 18 bp, Artificial Sequence
  Synthetic DNA
tgttcagacgcgctgaag

SEQ ID NO: 67898 - DNA, 18 bp, Artificial Sequence
  Synthetic DNA
tgtttctactcattaaag

SEQ ID NO: 67899 - DNA, 18 bp, Artificial Sequence
  Synthetic DNA
ttaaacgatccactggag

SEQ ID NO: 67900 - DNA, 18 bp, Artificial Sequence
  Synthetic DNA
ttaaacgattcattaaag

SEQ ID NO: 67901 - DNA, 18 bp, Artificial Sequence
  Synthetic DNA
ttaaacgcatcaccactg

SEQ ID NO: 67902 - DNA, 18 bp, Artificial Sequence
  Synthetic DNA
ttaaacgtcactctattg

SEQ ID NO: 67903 - DNA, 18 bp, Artificial Sequence
  Synthetic DNA
ttaaacgtcattctatag

SEQ ID NO: 67904 - DNA, 18 bp, Artificial Sequence
  Synthetic DNA
ttaaacgtctcaaaatag

SEQ ID NO: 67905 - DNA, 18 bp, Artificial Sequence
  Synthetic DNA
ttaaactactcagtaaag

SEQ ID NO: 67906 - DNA, 18 bp, Artificial Sequence
  Synthetic DNA
ttaaaggactctctgtag

SEQ ID NO: 67907 - DNA, 18 bp, Artificial Sequence
  Synthetic DNA
ttaaatgactcattgtag

SEQ ID NO: 67908 - DNA, 18 bp, Artificial Sequence
  Synthetic DNA
ttaaatgagtaactatag

SEQ ID NO: 67909 - DNA, 18 bp, Artificial Sequence
  Synthetic DNA
ttaaatgcagttctatag

SEQ ID NO: 67910 - DNA, 18 bp, Artificial Sequence
  Synthetic DNA
ttaaattacactcgattg

SEQ ID NO: 67911 - DNA, 18 bp, Artificial Sequence
  Synthetic DNA
ttaacagactcactatgg

SEQ ID NO: 67912 - DNA, 18 bp, Artificial Sequence
  Synthetic DNA
ttaaccaattcactatag

SEQ ID NO: 67913 - DNA, 18 bp, Artificial Sequence
  Synthetic DNA
ttaagcgtccgactgttg

SEQ ID NO: 67914 - DNA, 18 bp, Artificial Sequence
  Synthetic DNA
ttaagctattcactaaag

SEQ ID NO: 67915 - DNA, 18 bp, Artificial Sequence
  Synthetic DNA
ttaatcgacaccctatag

SEQ ID NO: 67916 - DNA, 18 bp, Artificial Sequence
  Synthetic DNA
ttaatcgtcacgctatag

SEQ ID NO: 67917 - DNA, 18 bp, Artificial Sequence
  Synthetic DNA
ttaatcgtctagctctag

SEQ ID NO: 67918 - DNA, 18 bp, Artificial Sequence
  Synthetic DNA
ttaatcttgtcacaatcg

SEQ ID NO: 67919 - DNA, 18 bp, Artificial Sequence
  Synthetic DNA
ttacacaacccacaatag

SEQ ID NO: 67920 - DNA, 18 bp, Artificial Sequence
  Synthetic DNA
ttacacgaccaactgtag

SEQ ID NO: 67921 - DNA, 18 bp, Artificial Sequence
  Synthetic DNA
ttacacgtgtcattatag

SEQ ID NO: 67922 - DNA, 18 bp, Artificial Sequence
  Synthetic DNA
ttacatgaatcactaaag

SEQ ID NO: 67923 - DNA, 18 bp, Artificial Sequence
  Synthetic DNA
ttacgcgattcattattg

SEQ ID NO: 67924 - DNA, 18 bp, Artificial Sequence
  Synthetic DNA
ttactctactcacaatag

SEQ ID NO: 67925 - DNA, 18 bp, Artificial Sequence
  Synthetic DNA
ttacttgagttactattg

SEQ ID NO: 67926 - DNA, 18 bp, Artificial Sequence
  Synthetic DNA
ttagacgacgctgtttag

SEQ ID NO: 67927 - DNA, 18 bp, Artificial Sequence
  Synthetic DNA
ttagacgattcaagttcg

SEQ ID NO: 67928 - DNA, 18 bp, Artificial Sequence
  Synthetic DNA
ttagactattctctttag

SEQ ID NO: 67929 - DNA, 18 bp, Artificial Sequence
  Synthetic DNA
ttagccgccacataatag

SEQ ID NO: 67930 - DNA, 18 bp, Artificial Sequence
  Synthetic DNA
ttataagacccattgtag

SEQ ID NO: 67931 - DNA, 18 bp, Artificial Sequence
  Synthetic DNA
ttataatgcccacttaag

SEQ ID NO: 67932 - DNA, 18 bp, Artificial Sequence
  Synthetic DNA
ttatacaactgacatttg

SEQ ID NO: 67933 - DNA, 18 bp, Artificial Sequence
  Synthetic DNA
ttatacaacttcataaag

SEQ ID NO: 67934 - DNA, 18 bp, Artificial Sequence
  Synthetic DNA
ttatacaactttctattg

SEQ ID NO: 67935 - DNA, 18 bp, Artificial Sequence
  Synthetic DNA
ttatacaattcaatattg

SEQ ID NO: 67936 - DNA, 18 bp, Artificial Sequence
  Synthetic DNA
ttatacaattcaatttag

SEQ ID NO: 67937 - DNA, 18 bp, Artificial Sequence
  Synthetic DNA
ttatacatttccctattg

SEQ ID NO: 67938 - DNA, 18 bp, Artificial Sequence
  Synthetic DNA
ttatacatttgattatag

SEQ ID NO: 67939 - DNA, 18 bp, Artificial Sequence
  Synthetic DNA
ttatacctcttacaatag

SEQ ID NO: 67940 - DNA, 18 bp, Artificial Sequence
  Synthetic DNA
ttatacgaattataatag

SEQ ID NO: 67941 - DNA, 18 bp, Artificial Sequence
  Synthetic DNA
ttatacgacccttaatag

SEQ ID NO: 67942 - DNA, 18 bp, Artificial Sequence
  Synthetic DNA
ttatacgactcaaaaatg

SEQ ID NO: 67943 - DNA, 18 bp, Artificial Sequence
  Synthetic DNA
ttatacgactgaatttcg

SEQ ID NO: 67944 - DNA, 18 bp, Artificial Sequence
  Synthetic DNA
ttatacgagcaacgtaag

SEQ ID NO: 67945 - DNA, 18 bp, Artificial Sequence
  Synthetic DNA
ttatacgataaactaaag

SEQ ID NO: 67946 - DNA, 18 bp, Artificial Sequence
  Synthetic DNA
ttatacgcacctctgtcg

SEQ ID NO: 67947 - DNA, 18 bp, Artificial Sequence
  Synthetic DNA
ttatacgccaggttatag

SEQ ID NO: 67948 - DNA, 18 bp, Artificial Sequence
  Synthetic DNA
ttatacgcctctccaaag

SEQ ID NO: 67949 - DNA, 18 bp, Artificial Sequence
  Synthetic DNA
ttatacgcctctctgaag

SEQ ID NO: 67950 - DNA, 18 bp, Artificial Sequence
  Synthetic DNA
ttatacgtatcaccgaag

SEQ ID NO: 67951 - DNA, 18 bp, Artificial Sequence
  Synthetic DNA
ttatacgtcacacactcg

SEQ ID NO: 67952 - DNA, 18 bp, Artificial Sequence
  Synthetic DNA
ttatacgtcaccctaaag

SEQ ID NO: 67953 - DNA, 18 bp, Artificial Sequence
  Synthetic DNA
ttatacgtctctcattag

SEQ ID NO: 67954 - DNA, 18 bp, Artificial Sequence
  Synthetic DNA
ttatacgtctgatattag

SEQ ID NO: 67955 - DNA, 18 bp, Artificial Sequence
  Synthetic DNA
ttatacgtcttacactag

SEQ ID NO: 67956 - DNA, 18 bp, Artificial Sequence
  Synthetic DNA
ttatacgtgacacccttg

SEQ ID NO: 67957 - DNA, 18 bp, Artificial Sequence
  Synthetic DNA
ttatacgtgtatcactag

SEQ ID NO: 67958 - DNA, 18 bp, Artificial Sequence
  Synthetic DNA
ttatacgttagacgattg

SEQ ID NO: 67959 - DNA, 18 bp, Artificial Sequence
  Synthetic DNA
ttatactacactcaatag

SEQ ID NO: 67960 - DNA, 18 bp, Artificial Sequence
  Synthetic DNA
ttatactattcacactag

SEQ ID NO: 67961 - DNA, 18 bp, Artificial Sequence
  Synthetic DNA
ttatacttctttccatag

SEQ ID NO: 67962 - DNA, 18 bp, Artificial Sequence
  Synthetic DNA
ttatagcactcactaacg

SEQ ID NO: 67963 - DNA, 18 bp, Artificial Sequence
  Synthetic DNA
ttatagctcccacttaag

SEQ ID NO: 67964 - DNA, 18 bp, Artificial Sequence
  Synthetic DNA
ttataggaatgacaattg

SEQ ID NO: 67965 - DNA, 18 bp, Artificial Sequence
  Synthetic DNA
ttataggactcaaaaaag

SEQ ID NO: 67966 - DNA, 18 bp, Artificial Sequence
  Synthetic DNA
ttataggtaactctaaag

SEQ ID NO: 67967 - DNA, 18 bp, Artificial Sequence
  Synthetic DNA
ttataggtctcattacag

SEQ ID NO: 67968 - DNA, 18 bp, Artificial Sequence
  Synthetic DNA
ttatataactcacattag

SEQ ID NO: 67969 - DNA, 18 bp, Artificial Sequence
  Synthetic DNA
ttatatcactctttcaag

SEQ ID NO: 67970 - DNA, 18 bp, Artificial Sequence
  Synthetic DNA
ttatatgacacactaagg

SEQ ID NO: 67971 - DNA, 18 bp, Artificial Sequence
  Synthetic DNA
ttatatgacatattattg

SEQ ID NO: 67972 - DNA, 18 bp, Artificial Sequence
  Synthetic DNA
ttatatgactctatctag

SEQ ID NO: 67973 - DNA, 18 bp, Artificial Sequence
  Synthetic DNA
ttatatgcattacttagg

SEQ ID NO: 67974 - DNA, 18 bp, Artificial Sequence
  Synthetic DNA
ttatatggcacaatatag

SEQ ID NO: 67975 - DNA, 18 bp, Artificial Sequence
  Synthetic DNA
ttatatgtcacacgaatg

SEQ ID NO: 67976 - DNA, 18 bp, Artificial Sequence
  Synthetic DNA
ttatatgtctcacattag

SEQ ID NO: 67977 - DNA, 18 bp, Artificial Sequence
  Synthetic DNA
ttatatgtctctctcaag

SEQ ID NO: 67978 - DNA, 18 bp, Artificial Sequence
  Synthetic DNA
ttatattactcacaaaag

SEQ ID NO: 67979 - DNA, 18 bp, Artificial Sequence
  Synthetic DNA
ttatattactttctacag

SEQ ID NO: 67980 - DNA, 18 bp, Artificial Sequence
  Synthetic DNA
ttatcaaaattatgaaag

SEQ ID NO: 67981 - DNA, 18 bp, Artificial Sequence
  Synthetic DNA
ttatccgacccacttaag

SEQ ID NO: 67982 - DNA, 18 bp, Artificial Sequence
  Synthetic DNA
ttatccgtcccagtacag

SEQ ID NO: 67983 - DNA, 18 bp, Artificial Sequence
  Synthetic DNA
ttatcctacacacaattg

SEQ ID NO: 67984 - DNA, 18 bp, Artificial Sequence
  Synthetic DNA
ttatccttctcactatgg

SEQ ID NO: 67985 - DNA, 18 bp, Artificial Sequence
  Synthetic DNA
ttatccttctctctatag

SEQ ID NO: 67986 - DNA, 18 bp, Artificial Sequence
  Synthetic DNA
ttatctgtatcactaatg

SEQ ID NO: 67987 - DNA, 18 bp, Artificial Sequence
  Synthetic DNA
ttatgagacaaaaaattg

SEQ ID NO: 67988 - DNA, 18 bp, Artificial Sequence
  Synthetic DNA
ttatgagacacactaaag

SEQ ID NO: 67989 - DNA, 18 bp, Artificial Sequence
  Synthetic DNA
ttatgagtctcaccatag

SEQ ID NO: 67990 - DNA, 18 bp, Artificial Sequence
  Synthetic DNA
ttatgcatcttactatag

SEQ ID NO: 67991 - DNA, 18 bp, Artificial Sequence
  Synthetic DNA
ttatgcgactctcaaccg

SEQ ID NO: 67992 - DNA, 18 bp, Artificial Sequence
  Synthetic DNA
ttatgcgattatctaaag

SEQ ID NO: 67993 - DNA, 18 bp, Artificial Sequence
  Synthetic DNA
ttatgcgtctcacaattg

SEQ ID NO: 67994 - DNA, 18 bp, Artificial Sequence
  Synthetic DNA
ttattaaactcacaatag

SEQ ID NO: 67995 - DNA, 18 bp, Artificial Sequence
  Synthetic DNA
ttattagacttattatag

SEQ ID NO: 67996 - DNA, 18 bp, Artificial Sequence
  Synthetic DNA
ttattatacccacatagg

SEQ ID NO: 67997 - DNA, 18 bp, Artificial Sequence
  Synthetic DNA
ttattattctcactctag

SEQ ID NO: 67998 - DNA, 18 bp, Artificial Sequence
  Synthetic DNA
ttattcaactcagtctag

SEQ ID NO: 67999 - DNA, 18 bp, Artificial Sequence
  Synthetic DNA
ttattcaattcaccatag

SEQ ID NO: 68000 - DNA, 18 bp, Artificial Sequence
  Synthetic DNA
ttattccactcagcaaag

SEQ ID NO: 68001 - DNA, 18 bp, Artificial Sequence
  Synthetic DNA
ttattcgaatcacttttg

SEQ ID NO: 68002 - DNA, 18 bp, Artificial Sequence
  Synthetic DNA
ttattcgaatctctatgg

SEQ ID NO: 68003 - DNA, 18 bp, Artificial Sequence
  Synthetic DNA
ttattcgacaaactacag

SEQ ID NO: 68004 - DNA, 18 bp, Artificial Sequence
  Synthetic DNA
ttattcgacattacattg

SEQ ID NO: 68005 - DNA, 18 bp, Artificial Sequence
  Synthetic DNA
ttattcgactcaataatg

SEQ ID NO: 68006 - DNA, 18 bp, Artificial Sequence
  Synthetic DNA
ttattcgagaaacttaag

SEQ ID NO: 68007 - DNA, 18 bp, Artificial Sequence
  Synthetic DNA
ttattcgatgcactactg

SEQ ID NO: 68008 - DNA, 18 bp, Artificial Sequence
  Synthetic DNA
ttattcgattcacattcg

SEQ ID NO: 68009 - DNA, 18 bp, Artificial Sequence
  Synthetic DNA
ttattcgcctctcttgag

SEQ ID NO: 68010 - DNA, 18 bp, Artificial Sequence
  Synthetic DNA
ttattcgtccatctttag

SEQ ID NO: 68011 - DNA, 18 bp, Artificial Sequence
  Synthetic DNA
ttattcgtttctttattg

SEQ ID NO: 68012 - DNA, 18 bp, Artificial Sequence
  Synthetic DNA
ttattctactacctaaag

SEQ ID NO: 68013 - DNA, 18 bp, Artificial Sequence
  Synthetic DNA
ttattctactcactaatg

SEQ ID NO: 68014 - DNA, 18 bp, Artificial Sequence
  Synthetic DNA
ttattctcgttactatag

SEQ ID NO: 68015 - DNA, 18 bp, Artificial Sequence
  Synthetic DNA
ttattcttctaacaatag

SEQ ID NO: 68016 - DNA, 18 bp, Artificial Sequence
  Synthetic DNA
ttattcttctcccttttg

SEQ ID NO: 68017 - DNA, 18 bp, Artificial Sequence
  Synthetic DNA
ttattgcactaactacag

SEQ ID NO: 68018 - DNA, 18 bp, Artificial Sequence
  Synthetic DNA
ttattggtattactatag

SEQ ID NO: 68019 - DNA, 18 bp, Artificial Sequence
  Synthetic DNA
ttatttgtcacactatag

SEQ ID NO: 68020 - DNA, 18 bp, Artificial Sequence
  Synthetic DNA
ttcagcgtctcaatttag

SEQ ID NO: 68021 - DNA, 18 bp, Artificial Sequence
  Synthetic DNA
ttccctaattcacaattg

SEQ ID NO: 68022 - DNA, 18 bp, Artificial Sequence
  Synthetic DNA
ttcctcgacacaatatag

SEQ ID NO: 68023 - DNA, 18 bp, Artificial Sequence
  Synthetic DNA
ttcctcgattcaatatcg

SEQ ID NO: 68024 - DNA, 18 bp, Artificial Sequence
  Synthetic DNA
ttctaagacacactattg

SEQ ID NO: 68025 - DNA, 18 bp, Artificial Sequence
  Synthetic DNA
ttctacatctcactttag

SEQ ID NO: 68026 - DNA, 18 bp, Artificial Sequence
  Synthetic DNA
ttctacgactgtcaatag

SEQ ID NO: 68027 - DNA, 18 bp, Artificial Sequence
  Synthetic DNA
ttctacgattgcttaaag

SEQ ID NO: 68028 - DNA, 18 bp, Artificial Sequence
  Synthetic DNA
ttctacgtctctcaattg

SEQ ID NO: 68029 - DNA, 18 bp, Artificial Sequence
  Synthetic DNA
ttctaggattcactttag

SEQ ID NO: 68030 - DNA, 18 bp, Artificial Sequence
  Synthetic DNA
ttctttgtatctctatag

SEQ ID NO: 68031 - DNA, 18 bp, Artificial Sequence
  Synthetic DNA
ttgaaagtctcagtattg

SEQ ID NO: 68032 - DNA, 18 bp, Artificial Sequence
  Synthetic DNA
ttgaaccactccctatag

SEQ ID NO: 68033 - DNA, 18 bp, Artificial Sequence
  Synthetic DNA
ttgcacggattactttcg

SEQ ID NO: 68034 - DNA, 18 bp, Artificial Sequence
  Synthetic DNA
ttgctcgactcacaaaag

SEQ ID NO: 68035 - DNA, 18 bp, Artificial Sequence
  Synthetic DNA
ttgcttgacatattatag

SEQ ID NO: 68036 - DNA, 18 bp, Artificial Sequence
  Synthetic DNA
ttgtacgaaacacaaaag

SEQ ID NO: 68037 - DNA, 18 bp, Artificial Sequence
  Synthetic DNA
ttgtacgaatccctattg

SEQ ID NO: 68038 - DNA, 18 bp, Artificial Sequence
  Synthetic DNA
ttgtacgattaacaatag

SEQ ID NO: 68039 - DNA, 18 bp, Artificial Sequence
  Synthetic DNA
ttgtacggctcagcgtag

SEQ ID NO: 68040 - DNA, 18 bp, Artificial Sequence
  Synthetic DNA
ttgtacgtcacactgtag

SEQ ID NO: 68041 - DNA, 18 bp, Artificial Sequence
  Synthetic DNA
ttgtacgtctcacatacg

SEQ ID NO: 68042 - DNA, 18 bp, Artificial Sequence
  Synthetic DNA
ttgtacgtctcactgttg

SEQ ID NO: 68043 - DNA, 18 bp, Artificial Sequence
  Synthetic DNA
ttgtactactcaccattg

SEQ ID NO: 68044 - DNA, 18 bp, Artificial Sequence
  Synthetic DNA
ttgtctgataaactaaag

SEQ ID NO: 68045 - DNA, 18 bp, Artificial Sequence
  Synthetic DNA
ttgtgcaactgacgattg

SEQ ID NO: 68046 - DNA, 18 bp, Artificial Sequence
  Synthetic DNA
ttgttagatatcttatag

SEQ ID NO: 68047 - DNA, 18 bp, Artificial Sequence
  Synthetic DNA
ttgttctattcacaattg

SEQ ID NO: 68048 - DNA, 18 bp, Artificial Sequence
  Synthetic DNA
tttaaatacaaaataaag

SEQ ID NO: 68049 - DNA, 18 bp, Artificial Sequence
  Synthetic DNA
tttaacaactaactatag

SEQ ID NO: 68050 - DNA, 18 bp, Artificial Sequence
  Synthetic DNA
tttaacacctcactatag

SEQ ID NO: 68051 - DNA, 18 bp, Artificial Sequence
  Synthetic DNA
tttaaccacttactatag

SEQ ID NO: 68052 - DNA, 18 bp, Artificial Sequence
  Synthetic DNA
tttaacgactctttgtag

SEQ ID NO: 68053 - DNA, 18 bp, Artificial Sequence
  Synthetic DNA
tttaacgatttactatag

SEQ ID NO: 68054 - DNA, 18 bp, Artificial Sequence
  Synthetic DNA
tttaacgccccaccacag

SEQ ID NO: 68055 - DNA, 18 bp, Artificial Sequence
  Synthetic DNA
tttaactactatatatag

SEQ ID NO: 68056 - DNA, 18 bp, Artificial Sequence
  Synthetic DNA
tttaatgacacactatag

SEQ ID NO: 68057 - DNA, 18 bp, Artificial Sequence
  Synthetic DNA
tttaatgagtagctatag

SEQ ID NO: 68058 - DNA, 18 bp, Artificial Sequence
  Synthetic DNA
tttaatgtcacactaaag

SEQ ID NO: 68059 - DNA, 18 bp, Artificial Sequence
  Synthetic DNA
tttagcaactcactctag

SEQ ID NO: 68060 - DNA, 18 bp, Artificial Sequence
  Synthetic DNA
tttatcgactcacattgg

SEQ ID NO: 68061 - DNA, 18 bp, Artificial Sequence
  Synthetic DNA
tttatcgtctcaatattg

SEQ ID NO: 68062 - DNA, 18 bp, Artificial Sequence
  Synthetic DNA
tttcacgactccctaaag

SEQ ID NO: 68063 - DNA, 18 bp, Artificial Sequence
  Synthetic DNA
tttcacgtctcaatgaag

SEQ ID NO: 68064 - DNA, 18 bp, Artificial Sequence
  Synthetic DNA
tttcccgacttactttag

SEQ ID NO: 68065 - DNA, 18 bp, Artificial Sequence
  Synthetic DNA
tttgatgactctctatag

SEQ ID NO: 68066 - DNA, 18 bp, Artificial Sequence
  Synthetic DNA
ttttaacactcacaaaag

SEQ ID NO: 68067 - DNA, 18 bp, Artificial Sequence
  Synthetic DNA
ttttaatactgcttatag

SEQ ID NO: 68068 - DNA, 18 bp, Artificial Sequence
  Synthetic DNA
ttttacaacacattatag

SEQ ID NO: 68069 - DNA, 18 bp, Artificial Sequence
  Synthetic DNA
ttttacaactatcaatag

SEQ ID NO: 68070 - DNA, 18 bp, Artificial Sequence
  Synthetic DNA
ttttaccactcaactaag

SEQ ID NO: 68071 - DNA, 18 bp, Artificial Sequence
  Synthetic DNA
ttttacgaatcattaaag

SEQ ID NO: 68072 - DNA, 18 bp, Artificial Sequence
  Synthetic DNA
ttttacgacaatttatag

SEQ ID NO: 68073 - DNA, 18 bp, Artificial Sequence
  Synthetic DNA
ttttacgactatctacag

SEQ ID NO: 68074 - DNA, 18 bp, Artificial Sequence
  Synthetic DNA
ttttacgactcattcttg

SEQ ID NO: 68075 - DNA, 18 bp, Artificial Sequence
  Synthetic DNA
ttttacgagtcaatatgg

SEQ ID NO: 68076 - DNA, 18 bp, Artificial Sequence
  Synthetic DNA
ttttacgatgaaccctag

SEQ ID NO: 68077 - DNA, 18 bp, Artificial Sequence
  Synthetic DNA
ttttactactgtataaag

SEQ ID NO: 68078 - DNA, 18 bp, Artificial Sequence
  Synthetic DNA
ttttagtttactcaatag

SEQ ID NO: 68079 - DNA, 18 bp, Artificial Sequence
  Synthetic DNA
ttttatgactcacttgag

SEQ ID NO: 68080 - DNA, 18 bp, Artificial Sequence
  Synthetic DNA
ttttgagactgattattg

SEQ ID NO: 68081 - DNA, 18 bp, Artificial Sequence
  Synthetic DNA
ttttgcaactatccattg

SEQ ID NO: 68082 - DNA, 18 bp, Artificial Sequence
  Synthetic DNA
tttttcgactgactgtag

SEQ ID NO: 68083 - DNA, 18 bp, Artificial Sequence
  Synthetic DNA
tttttctactctccatag

SEQ ID NO: 68084 - DNA, 18 bp, Artificial Sequence
  Synthetic DNA
ttttttgactcactattg

SEQ ID NO: 68085 - DNA, 18 bp, Artificial Sequence
  Synthetic DNA
aaatgggattcacttttg

SEQ ID NO: 68086 - DNA, 18 bp, Artificial Sequence
  Synthetic DNA
atatacgtctcacaattg

SEQ ID NO: 68087 - DNA, 18 bp, Artificial Sequence
  Synthetic DNA
taataagtcacacaattg

SEQ ID NO: 68088 - DNA, 18 bp, Artificial Sequence
  Synthetic DNA
taatacgactctatgatg

SEQ ID NO: 68089 - DNA, 18 bp, Artificial Sequence
  Synthetic DNA
taatatggcactctattg

SEQ ID NO: 68090 - DNA, 18 bp, Artificial Sequence
  Synthetic DNA
taatgagtctcacttcag

SEQ ID NO: 68091 - DNA, 18 bp, Artificial Sequence
  Synthetic DNA
tattacgactgattaatg

SEQ ID NO: 68092 - DNA, 18 bp, Artificial Sequence
  Synthetic DNA
tattacgatacactgaag

SEQ ID NO: 68093 - DNA, 18 bp, Artificial Sequence
  Synthetic DNA
tcatacaaccagctttag

SEQ ID NO: 68094 - DNA, 18 bp, Artificial Sequence
  Synthetic DNA
tgaaacgatttactattg

SEQ ID NO: 68095 - DNA, 18 bp, Artificial Sequence
  Synthetic DNA
tgtagcaacacaattcag

SEQ ID NO: 68096 - DNA, 18 bp, Artificial Sequence
  Synthetic DNA
ttataagagtctcaatag

SEQ ID NO: 68097 - DNA, 18 bp, Artificial Sequence
  Synthetic DNA
ttatacgactaacttatg

SEQ ID NO: 68098 - DNA, 18 bp, Artificial Sequence
  Synthetic DNA
ttattcgactcacattcg

SEQ ID NO: 68099 - DNA, 18 bp, Artificial Sequence
  Synthetic DNA
ttgtacgactctcttaag

SEQ ID NO: 68100 - DNA, 18 bp, Artificial Sequence
  Synthetic DNA
ttgttagacacactttag

SEQ ID NO: 68101 - DNA, 18 bp, Artificial Sequence
  Synthetic DNA
atttacgtctcactttag

SEQ ID NO: 68102 - DNA, 18 bp, Artificial Sequence
  Synthetic DNA
aaatacgacaaacaaaag

SEQ ID NO: 68103 - DNA, 18 bp, Artificial Sequence
  Synthetic DNA
aaatatgcctttttatag

SEQ ID NO: 68104 - DNA, 18 bp, Artificial Sequence
  Synthetic DNA
aattacgactttcaaaag

SEQ ID NO: 68105 - DNA, 18 bp, Artificial Sequence
  Synthetic DNA
gatttctgcttactatag

SEQ ID NO: 68106 - DNA, 18 bp, Artificial Sequence
  Synthetic DNA
taacacttcccactattg

SEQ ID NO: 68107 - DNA, 18 bp, Artificial Sequence
  Synthetic DNA
taataaggctcaaaaccg

SEQ ID NO: 68108 - DNA, 18 bp, Artificial Sequence
  Synthetic DNA
taatacgactcaaatatg

SEQ ID NO: 68109 - DNA, 18 bp, Artificial Sequence
  Synthetic DNA
taatacgtattgttttag

SEQ ID NO: 68110 - DNA, 18 bp, Artificial Sequence
  Synthetic DNA
taatcggcatcacaaatg

SEQ ID NO: 68111 - DNA, 18 bp, Artificial Sequence
  Synthetic DNA
tatcacgactcacttgtg

SEQ ID NO: 68112 - DNA, 18 bp, Artificial Sequence
  Synthetic DNA
tattacgtcactctttag

SEQ ID NO: 68113 - DNA, 18 bp, Artificial Sequence
  Synthetic DNA
tgttacgacgctctattg

SEQ ID NO: 68114 - DNA, 18 bp, Artificial Sequence
  Synthetic DNA
ttaaacgactcattactg

SEQ ID NO: 68115 - DNA, 18 bp, Artificial Sequence
  Synthetic DNA
ttatactatttactaaag

SEQ ID NO: 68116 - DNA, 18 bp, Artificial Sequence
  Synthetic DNA
ttatccgtataacactag

SEQ ID NO: 68117 - DNA, 18 bp, Artificial Sequence
  Synthetic DNA
tttcacggctcattctag

SEQ ID NO: 68118 - DNA, 18 bp, Artificial Sequence
  Synthetic DNA
ttttaccacacactaaag

SEQ ID NO: 68119 - DNA, 18 bp, Artificial Sequence
  Synthetic DNA
ttttacgatatactatag

SEQ ID NO: 68120 - DNA, 18 bp, Artificial Sequence
  Synthetic DNA
tttttcgattcactttag

SEQ ID NO: 68121 - DNA, 18 bp, Artificial Sequence
  Synthetic DNA
aaaaacgaatctaataag

SEQ ID NO: 68122 - DNA, 18 bp, Artificial Sequence
  Synthetic DNA
aaaaacgacacacctcag

SEQ ID NO: 68123 - DNA, 18 bp, Artificial Sequence
  Synthetic DNA
aaaaacgacctattacag

SEQ ID NO: 68124 - DNA, 18 bp, Artificial Sequence
  Synthetic DNA
aaaaacgacttaccaaag

SEQ ID NO: 68125 - DNA, 18 bp, Artificial Sequence
  Synthetic DNA
aaaaaggattcaccatag

SEQ ID NO: 68126 - DNA, 18 bp, Artificial Sequence
  Synthetic DNA
aaaaaggtgatacttaag

SEQ ID NO: 68127 - DNA, 18 bp, Artificial Sequence
  Synthetic DNA
aaaaatgagtcactttag

SEQ ID NO: 68128 - DNA, 18 bp, Artificial Sequence
  Synthetic DNA
aaaaccgactcacgttag

SEQ ID NO: 68129 - DNA, 18 bp, Artificial Sequence
  Synthetic DNA
aaaatagactcactaaag

SEQ ID NO: 68130 - DNA, 18 bp, Artificial Sequence
  Synthetic DNA
aaaatcgactcacaaaag

SEQ ID NO: 68131 - DNA, 18 bp, Artificial Sequence
  Synthetic DNA
aaaatcggatcaatatag

SEQ ID NO: 68132 - DNA, 18 bp, Artificial Sequence
  Synthetic DNA
aaacacgtctcacactag

SEQ ID NO: 68133 - DNA, 18 bp, Artificial Sequence
  Synthetic DNA
aaacacgtctcactactg

SEQ ID NO: 68134 - DNA, 18 bp, Artificial Sequence
  Synthetic DNA
aaacactactcaaaatag

SEQ ID NO: 68135 - DNA, 18 bp, Artificial Sequence
  Synthetic DNA
aaacatgactatcatttg

SEQ ID NO: 68136 - DNA, 18 bp, Artificial Sequence
  Synthetic DNA
aaacatgtctctctatcg

SEQ ID NO: 68137 - DNA, 18 bp, Artificial Sequence
  Synthetic DNA
aaactcgcctcactttcg

SEQ ID NO: 68138 - DNA, 18 bp, Artificial Sequence
  Synthetic DNA
aaagaccattcactagag

SEQ ID NO: 68139 - DNA, 18 bp, Artificial Sequence
  Synthetic DNA
aaagagcaaacgctcttg

SEQ ID NO: 68140 - DNA, 18 bp, Artificial Sequence
  Synthetic DNA
aaagaggtgtcacaatag

SEQ ID NO: 68141 - DNA, 18 bp, Artificial Sequence
  Synthetic DNA
aaagccgactcaccattg

SEQ ID NO: 68142 - DNA, 18 bp, Artificial Sequence
  Synthetic DNA
aaataagaatcgcaatag

SEQ ID NO: 68143 - DNA, 18 bp, Artificial Sequence
  Synthetic DNA
aaataagattctctattg

SEQ ID NO: 68144 - DNA, 18 bp, Artificial Sequence
  Synthetic DNA
aaataattctaagtttcg

SEQ ID NO: 68145 - DNA, 18 bp, Artificial Sequence
  Synthetic DNA
aaatacaatacactttag

SEQ ID NO: 68146 - DNA, 18 bp, Artificial Sequence
  Synthetic DNA
aaatacacctctatcatg

SEQ ID NO: 68147 - DNA, 18 bp, Artificial Sequence
  Synthetic DNA
aaatacatctcacaagag

SEQ ID NO: 68148 - DNA, 18 bp, Artificial Sequence
  Synthetic DNA
aaataccactgacattgg

SEQ ID NO: 68149 - DNA, 18 bp, Artificial Sequence
  Synthetic DNA
aaataccgctaacattag

SEQ ID NO: 68150 - DNA, 18 bp, Artificial Sequence
  Synthetic DNA
aaatacgaataatcatag

SEQ ID NO: 68151 - DNA, 18 bp, Artificial Sequence
  Synthetic DNA
aaatacgaatcatcgtag

SEQ ID NO: 68152 - DNA, 18 bp, Artificial Sequence
  Synthetic DNA
aaatacgactccttaatg

SEQ ID NO: 68153 - DNA, 18 bp, Artificial Sequence
  Synthetic DNA
aaatacgactgatagtag

SEQ ID NO: 68154 - DNA, 18 bp, Artificial Sequence
  Synthetic DNA
aaatacgacttataaaag

SEQ ID NO: 68155 - DNA, 18 bp, Artificial Sequence
  Synthetic DNA
aaatacgagacactgcag

SEQ ID NO: 68156 - DNA, 18 bp, Artificial Sequence
  Synthetic DNA
aaatacgattcacaagtg

SEQ ID NO: 68157 - DNA, 18 bp, Artificial Sequence
  Synthetic DNA
aaatacgattctctcttg

SEQ ID NO: 68158 - DNA, 18 bp, Artificial Sequence
  Synthetic DNA
aaatacggatctcaatag

SEQ ID NO: 68159 - DNA, 18 bp, Artificial Sequence
  Synthetic DNA
aaatacgtatccccaaag

SEQ ID NO: 68160 - DNA, 18 bp, Artificial Sequence
  Synthetic DNA
aaatacgtctcgttgtag

SEQ ID NO: 68161 - DNA, 18 bp, Artificial Sequence
  Synthetic DNA
aaatacgtctgacttcag

SEQ ID NO: 68162 - DNA, 18 bp, Artificial Sequence
  Synthetic DNA
aaatacgtcttacttaag

SEQ ID NO: 68163 - DNA, 18 bp, Artificial Sequence
  Synthetic DNA
aaatacgtttaaccagag

SEQ ID NO: 68164 - DNA, 18 bp, Artificial Sequence
  Synthetic DNA
aaatacgtttcaatagcg

SEQ ID NO: 68165 - DNA, 18 bp, Artificial Sequence
  Synthetic DNA
aaatactactaaataaag

SEQ ID NO: 68166 - DNA, 18 bp, Artificial Sequence
  Synthetic DNA
aaatacttcaaactatag

SEQ ID NO: 68167 - DNA, 18 bp, Artificial Sequence
  Synthetic DNA
aaatacttcacaaaattg

SEQ ID NO: 68168 - DNA, 18 bp, Artificial Sequence
  Synthetic DNA
aaataggacactctttag

SEQ ID NO: 68169 - DNA, 18 bp, Artificial Sequence
  Synthetic DNA
aaatatgagttactaatg

SEQ ID NO: 68170 - DNA, 18 bp, Artificial Sequence
  Synthetic DNA
aaatatgtctcacttaag

SEQ ID NO: 68171 - DNA, 18 bp, Artificial Sequence
  Synthetic DNA
aaatattactcacgattg

SEQ ID NO: 68172 - DNA, 18 bp, Artificial Sequence
  Synthetic DNA
aaatcaatctcactatag

SEQ ID NO: 68173 - DNA, 18 bp, Artificial Sequence
  Synthetic DNA
aaatcccaatccatttag

SEQ ID NO: 68174 - DNA, 18 bp, Artificial Sequence
  Synthetic DNA
aaatccgactagcaatag

SEQ ID NO: 68175 - DNA, 18 bp, Artificial Sequence
  Synthetic DNA
aaatgcatctcactttgg

SEQ ID NO: 68176 - DNA, 18 bp, Artificial Sequence
  Synthetic DNA
aaatgccactcattatgg

SEQ ID NO: 68177 - DNA, 18 bp, Artificial Sequence
  Synthetic DNA
aaatgcgactcagttaag

SEQ ID NO: 68178 - DNA, 18 bp, Artificial Sequence
  Synthetic DNA
aaatgcgacttccgatag

SEQ ID NO: 68179 - DNA, 18 bp, Artificial Sequence
  Synthetic DNA
aaatgcgactttctattg

SEQ ID NO: 68180 - DNA, 18 bp, Artificial Sequence
  Synthetic DNA
aaatgctgctcactactg

SEQ ID NO: 68181 - DNA, 18 bp, Artificial Sequence
  Synthetic DNA
aaattaaagtcactttag

SEQ ID NO: 68182 - DNA, 18 bp, Artificial Sequence
  Synthetic DNA
aaattcgaatcacttttg

SEQ ID NO: 68183 - DNA, 18 bp, Artificial Sequence
  Synthetic DNA
aaattcgactaactcttg

SEQ ID NO: 68184 - DNA, 18 bp, Artificial Sequence
  Synthetic DNA
aaattcgattctcaatag

SEQ ID NO: 68185 - DNA, 18 bp, Artificial Sequence
  Synthetic DNA
aaattcgattttatttag

SEQ ID NO: 68186 - DNA, 18 bp, Artificial Sequence
  Synthetic DNA
aaattcgtaacacaatag

SEQ ID NO: 68187 - DNA, 18 bp, Artificial Sequence
  Synthetic DNA
aaattcgtcacaatctgg

SEQ ID NO: 68188 - DNA, 18 bp, Artificial Sequence
  Synthetic DNA
aaattctacagactatgg

SEQ ID NO: 68189 - DNA, 18 bp, Artificial Sequence
  Synthetic DNA
aaattcttagcacttgag

SEQ ID NO: 68190 - DNA, 18 bp, Artificial Sequence
  Synthetic DNA
aaattgaactctctatag

SEQ ID NO: 68191 - DNA, 18 bp, Artificial Sequence
  Synthetic DNA
aaatttgacacaatattg

SEQ ID NO: 68192 - DNA, 18 bp, Artificial Sequence
  Synthetic DNA
aacaacgaatcaataaag

SEQ ID NO: 68193 - DNA, 18 bp, Artificial Sequence
  Synthetic DNA
aacaacgtatcactatag

SEQ ID NO: 68194 - DNA, 18 bp, Artificial Sequence
  Synthetic DNA
aactacatatcacaaaag

SEQ ID NO: 68195 - DNA, 18 bp, Artificial Sequence
  Synthetic DNA
aactacgactctatatgg

SEQ ID NO: 68196 - DNA, 18 bp, Artificial Sequence
  Synthetic DNA
aactacgactgactccgg

SEQ ID NO: 68197 - DNA, 18 bp, Artificial Sequence
  Synthetic DNA
aactacgatataatatag

SEQ ID NO: 68198 - DNA, 18 bp, Artificial Sequence
  Synthetic DNA
aactacgattaatttttg

SEQ ID NO: 68199 - DNA, 18 bp, Artificial Sequence
  Synthetic DNA
aactacgattcgcgttag

SEQ ID NO: 68200 - DNA, 18 bp, Artificial Sequence
  Synthetic DNA
aactacgtctcatgttag

SEQ ID NO: 68201 - DNA, 18 bp, Artificial Sequence
  Synthetic DNA
aagaacgactgaccaaag

SEQ ID NO: 68202 - DNA, 18 bp, Artificial Sequence
  Synthetic DNA
aagtaagtctcactttag

SEQ ID NO: 68203 - DNA, 18 bp, Artificial Sequence
  Synthetic DNA
aagtacgaatcactcaag

SEQ ID NO: 68204 - DNA, 18 bp, Artificial Sequence
  Synthetic DNA
aagtacgaattactattg

SEQ ID NO: 68205 - DNA, 18 bp, Artificial Sequence
  Synthetic DNA
aagtacgatacactttag

SEQ ID NO: 68206 - DNA, 18 bp, Artificial Sequence
  Synthetic DNA
aagtacgtctcagtttgg

SEQ ID NO: 68207 - DNA, 18 bp, Artificial Sequence
  Synthetic DNA
aagttcgactctcaatag

SEQ ID NO: 68208 - DNA, 18 bp, Artificial Sequence
  Synthetic DNA
aataacgacacattttag

SEQ ID NO: 68209 - DNA, 18 bp, Artificial Sequence
  Synthetic DNA
aataacgactcacatttg

SEQ ID NO: 68210 - DNA, 18 bp, Artificial Sequence
  Synthetic DNA
aataacgagtcactaagg

SEQ ID NO: 68211 - DNA, 18 bp, Artificial Sequence
  Synthetic DNA
aataaggactcactcttg

SEQ ID NO: 68212 - DNA, 18 bp, Artificial Sequence
  Synthetic DNA
aatatagactcatagtag

SEQ ID NO: 68213 - DNA, 18 bp, Artificial Sequence
  Synthetic DNA
aatatcaatacattaaag

SEQ ID NO: 68214 - DNA, 18 bp, Artificial Sequence
  Synthetic DNA
aatcacgtatctataacg

SEQ ID NO: 68215 - DNA, 18 bp, Artificial Sequence
  Synthetic DNA
aatgtctatccacttcag

SEQ ID NO: 68216 - DNA, 18 bp, Artificial Sequence
  Synthetic DNA
aattaaaacacactctag

SEQ ID NO: 68217 - DNA, 18 bp, Artificial Sequence
  Synthetic DNA
aattaagccatactaatg

SEQ ID NO: 68218 - DNA, 18 bp, Artificial Sequence
  Synthetic DNA
aattacaacacactacag

SEQ ID NO: 68219 - DNA, 18 bp, Artificial Sequence
  Synthetic DNA
aattaccactcgctattg

SEQ ID NO: 68220 - DNA, 18 bp, Artificial Sequence
  Synthetic DNA
aattacgaatctgtattg

SEQ ID NO: 68221 - DNA, 18 bp, Artificial Sequence
  Synthetic DNA
aattacgactaacaaatg

SEQ ID NO: 68222 - DNA, 18 bp, Artificial Sequence
  Synthetic DNA
aattacgactaattgtgg

SEQ ID NO: 68223 - DNA, 18 bp, Artificial Sequence
  Synthetic DNA
aattacgagtcactaatg

SEQ ID NO: 68224 - DNA, 18 bp, Artificial Sequence
  Synthetic DNA
aattacggcttactactg

SEQ ID NO: 68225 - DNA, 18 bp, Artificial Sequence
  Synthetic DNA
aattacgtttcacaatag

SEQ ID NO: 68226 - DNA, 18 bp, Artificial Sequence
  Synthetic DNA
aattactcctaactaagg

SEQ ID NO: 68227 - DNA, 18 bp, Artificial Sequence
  Synthetic DNA
aattacttctaagatcag

SEQ ID NO: 68228 - DNA, 18 bp, Artificial Sequence
  Synthetic DNA
aattataactctttattg

SEQ ID NO: 68229 - DNA, 18 bp, Artificial Sequence
  Synthetic DNA
aattataattcattttcg

SEQ ID NO: 68230 - DNA, 18 bp, Artificial Sequence
  Synthetic DNA
aattcagactgcgtatcg

SEQ ID NO: 68231 - DNA, 18 bp, Artificial Sequence
  Synthetic DNA
aattccgacacacacaag

SEQ ID NO: 68232 - DNA, 18 bp, Artificial Sequence
  Synthetic DNA
aattccgacacaccctag

SEQ ID NO: 68233 - DNA, 18 bp, Artificial Sequence
  Synthetic DNA
aattccgtctcagcggag

SEQ ID NO: 68234 - DNA, 18 bp, Artificial Sequence
  Synthetic DNA
aattgcagctcactatag

SEQ ID NO: 68235 - DNA, 18 bp, Artificial Sequence
  Synthetic DNA
aattgcccctcccttcag

SEQ ID NO: 68236 - DNA, 18 bp, Artificial Sequence
  Synthetic DNA
aattgcgacattgtttag

SEQ ID NO: 68237 - DNA, 18 bp, Artificial Sequence
  Synthetic DNA
aatttagactcgttttag

SEQ ID NO: 68238 - DNA, 18 bp, Artificial Sequence
  Synthetic DNA
aatttagccacactttag

SEQ ID NO: 68239 - DNA, 18 bp, Artificial Sequence
  Synthetic DNA
aatttcgacactctatag

SEQ ID NO: 68240 - DNA, 18 bp, Artificial Sequence
  Synthetic DNA
aatttcgacttaccattg

SEQ ID NO: 68241 - DNA, 18 bp, Artificial Sequence
  Synthetic DNA
acatacgactctaaatag

SEQ ID NO: 68242 - DNA, 18 bp, Artificial Sequence
  Synthetic DNA
acatatcactcactaaag

SEQ ID NO: 68243 - DNA, 18 bp, Artificial Sequence
  Synthetic DNA
acatatgcctaacaatgg

SEQ ID NO: 68244 - DNA, 18 bp, Artificial Sequence
  Synthetic DNA
acatccgactggccatag

SEQ ID NO: 68245 - DNA, 18 bp, Artificial Sequence
  Synthetic DNA
acatgcgatacactatag

SEQ ID NO: 68246 - DNA, 18 bp, Artificial Sequence
  Synthetic DNA
acatgcgtttcccttaag

SEQ ID NO: 68247 - DNA, 18 bp, Artificial Sequence
  Synthetic DNA
acttatgattcactatag

SEQ ID NO: 68248 - DNA, 18 bp, Artificial Sequence
  Synthetic DNA
agacacgccacactatag

SEQ ID NO: 68249 - DNA, 18 bp, Artificial Sequence
  Synthetic DNA
agatagaactcaatatag

SEQ ID NO: 68250 - DNA, 18 bp, Artificial Sequence
  Synthetic DNA
agatataactcactttag

SEQ ID NO: 68251 - DNA, 18 bp, Artificial Sequence
  Synthetic DNA
agctacgaatcacaaaag

SEQ ID NO: 68252 - DNA, 18 bp, Artificial Sequence
  Synthetic DNA
aggaacgactccctatag

SEQ ID NO: 68253 - DNA, 18 bp, Artificial Sequence
  Synthetic DNA
agtgcagaccaactatag

SEQ ID NO: 68254 - DNA, 18 bp, Artificial Sequence
  Synthetic DNA
agttaccacccactatag

SEQ ID NO: 68255 - DNA, 18 bp, Artificial Sequence
  Synthetic DNA
agttacttatcactatag

SEQ ID NO: 68256 - DNA, 18 bp, Artificial Sequence
  Synthetic DNA
ataaacgactcgctattg

SEQ ID NO: 68257 - DNA, 18 bp, Artificial Sequence
  Synthetic DNA
ataaacgacttactaaag

SEQ ID NO: 68258 - DNA, 18 bp, Artificial Sequence
  Synthetic DNA
ataaacgtctcattgtag

SEQ ID NO: 68259 - DNA, 18 bp, Artificial Sequence
  Synthetic DNA
atacacaactcgctattg

SEQ ID NO: 68260 - DNA, 18 bp, Artificial Sequence
  Synthetic DNA
atacatgattcactaaag

SEQ ID NO: 68261 - DNA, 18 bp, Artificial Sequence
  Synthetic DNA
atactcgactctgtatag

SEQ ID NO: 68262 - DNA, 18 bp, Artificial Sequence
  Synthetic DNA
atagacgtctcgctatag

SEQ ID NO: 68263 - DNA, 18 bp, Artificial Sequence
  Synthetic DNA
atatacaaaacactatag

SEQ ID NO: 68264 - DNA, 18 bp, Artificial Sequence
  Synthetic DNA
atatacctctttctatag

SEQ ID NO: 68265 - DNA, 18 bp, Artificial Sequence
  Synthetic DNA
atatacgaaattctatag

SEQ ID NO: 68266 - DNA, 18 bp, Artificial Sequence
  Synthetic DNA
atatacgactcaaaaatg

SEQ ID NO: 68267 - DNA, 18 bp, Artificial Sequence
  Synthetic DNA
atatacgactcactgatg

SEQ ID NO: 68268 - DNA, 18 bp, Artificial Sequence
  Synthetic DNA
atatacgactcatcttgg

SEQ ID NO: 68269 - DNA, 18 bp, Artificial Sequence
  Synthetic DNA
atatacgactctcaatgg

SEQ ID NO: 68270 - DNA, 18 bp, Artificial Sequence
  Synthetic DNA
atatacgatttttaaaag

SEQ ID NO: 68271 - DNA, 18 bp, Artificial Sequence
  Synthetic DNA
atatactactcaaaactg

SEQ ID NO: 68272 - DNA, 18 bp, Artificial Sequence
  Synthetic DNA
atatactactcactctgg

SEQ ID NO: 68273 - DNA, 18 bp, Artificial Sequence
  Synthetic DNA
atatactagtcactttag

SEQ ID NO: 68274 - DNA, 18 bp, Artificial Sequence
  Synthetic DNA
atatatgattcactacag

SEQ ID NO: 68275 - DNA, 18 bp, Artificial Sequence
  Synthetic DNA
atatatgctttagtatag

SEQ ID NO: 68276 - DNA, 18 bp, Artificial Sequence
  Synthetic DNA
atatccgagtcgctatag

SEQ ID NO: 68277 - DNA, 18 bp, Artificial Sequence
  Synthetic DNA
atatccgcctcgttattg

SEQ ID NO: 68278 - DNA, 18 bp, Artificial Sequence
  Synthetic DNA
atatgctactctcaaatg

SEQ ID NO: 68279 - DNA, 18 bp, Artificial Sequence
  Synthetic DNA
atattcgacacgatttag

SEQ ID NO: 68280 - DNA, 18 bp, Artificial Sequence
  Synthetic DNA
atattcgactaacaatag

SEQ ID NO: 68281 - DNA, 18 bp, Artificial Sequence
  Synthetic DNA
atattcgactctctattg

SEQ ID NO: 68282 - DNA, 18 bp, Artificial Sequence
  Synthetic DNA
atatttgactgagtttcg

SEQ ID NO: 68283 - DNA, 18 bp, Artificial Sequence
  Synthetic DNA
atctacgactcgctattg

SEQ ID NO: 68284 - DNA, 18 bp, Artificial Sequence
  Synthetic DNA
atctacgtcacattatag

SEQ ID NO: 68285 - DNA, 18 bp, Artificial Sequence
  Synthetic DNA
atctaggactcactaatg

SEQ ID NO: 68286 - DNA, 18 bp, Artificial Sequence
  Synthetic DNA
atgcacaactcaataatg

SEQ ID NO: 68287 - DNA, 18 bp, Artificial Sequence
  Synthetic DNA
atggaagacttaataagg

SEQ ID NO: 68288 - DNA, 18 bp, Artificial Sequence
  Synthetic DNA
atgtacgaatcacaattg

SEQ ID NO: 68289 - DNA, 18 bp, Artificial Sequence
  Synthetic DNA
attaacgtcgcactaatg

SEQ ID NO: 68290 - DNA, 18 bp, Artificial Sequence
  Synthetic DNA
attcgcgattcactatag

SEQ ID NO: 68291 - DNA, 18 bp, Artificial Sequence
  Synthetic DNA
atttacgaaacacggaag

SEQ ID NO: 68292 - DNA, 18 bp, Artificial Sequence
  Synthetic DNA
atttacgaatcccttatg

SEQ ID NO: 68293 - DNA, 18 bp, Artificial Sequence
  Synthetic DNA
atttacgacacattatag

SEQ ID NO: 68294 - DNA, 18 bp, Artificial Sequence
  Synthetic DNA
atttacgactctcagtag

SEQ ID NO: 68295 - DNA, 18 bp, Artificial Sequence
  Synthetic DNA
atttacgactgcctaaag

SEQ ID NO: 68296 - DNA, 18 bp, Artificial Sequence
  Synthetic DNA
atttacttctcactaaag

SEQ ID NO: 68297 - DNA, 18 bp, Artificial Sequence
  Synthetic DNA
atttagaactcagatagg

SEQ ID NO: 68298 - DNA, 18 bp, Artificial Sequence
  Synthetic DNA
caaaacaacttactaaag

SEQ ID NO: 68299 - DNA, 18 bp, Artificial Sequence
  Synthetic DNA
caaaacggttttctatcg

SEQ ID NO: 68300 - DNA, 18 bp, Artificial Sequence
  Synthetic DNA
caaaacgtatcaatatag

SEQ ID NO: 68301 - DNA, 18 bp, Artificial Sequence
  Synthetic DNA
caaaataactcgatcaag

SEQ ID NO: 68302 - DNA, 18 bp, Artificial Sequence
  Synthetic DNA
caacacatctcactttag

SEQ ID NO: 68303 - DNA, 18 bp, Artificial Sequence
  Synthetic DNA
caacatgacacacgaaag

SEQ ID NO: 68304 - DNA, 18 bp, Artificial Sequence
  Synthetic DNA
caactcgatacatcaatg

SEQ ID NO: 68305 - DNA, 18 bp, Artificial Sequence
  Synthetic DNA
caactcgcctcattattg

SEQ ID NO: 68306 - DNA, 18 bp, Artificial Sequence
  Synthetic DNA
caagccgactaactcttg

SEQ ID NO: 68307 - DNA, 18 bp, Artificial Sequence
  Synthetic DNA
caataaaaatcaattgag

SEQ ID NO: 68308 - DNA, 18 bp, Artificial Sequence
  Synthetic DNA
caataagtcacattattg

SEQ ID NO: 68309 - DNA, 18 bp, Artificial Sequence
  Synthetic DNA
caatacgactcctttaag

SEQ ID NO: 68310 - DNA, 18 bp, Artificial Sequence
  Synthetic DNA
caatacgagtcattaacg

SEQ ID NO: 68311 - DNA, 18 bp, Artificial Sequence
  Synthetic DNA
caatacgattcacttatg

SEQ ID NO: 68312 - DNA, 18 bp, Artificial Sequence
  Synthetic DNA
caatacgccactcaatag

SEQ ID NO: 68313 - DNA, 18 bp, Artificial Sequence
  Synthetic DNA
caatacgcctttcttcag

SEQ ID NO: 68314 - DNA, 18 bp, Artificial Sequence
  Synthetic DNA
caatacgtatccttatag

SEQ ID NO: 68315 - DNA, 18 bp, Artificial Sequence
  Synthetic DNA
caatacgtctctccaaag

SEQ ID NO: 68316 - DNA, 18 bp, Artificial Sequence
  Synthetic DNA
caatactaattgttttag

SEQ ID NO: 68317 - DNA, 18 bp, Artificial Sequence
  Synthetic DNA
caatactacatactttag

SEQ ID NO: 68318 - DNA, 18 bp, Artificial Sequence
  Synthetic DNA
caatactcatctcatatg

SEQ ID NO: 68319 - DNA, 18 bp, Artificial Sequence
  Synthetic DNA
caatagctctcccaacag

SEQ ID NO: 68320 - DNA, 18 bp, Artificial Sequence
  Synthetic DNA
caatcatactctcgatag

SEQ ID NO: 68321 - DNA, 18 bp, Artificial Sequence
  Synthetic DNA
caatccaaatcactacag

SEQ ID NO: 68322 - DNA, 18 bp, Artificial Sequence
  Synthetic DNA
caatccgacacaataaag

SEQ ID NO: 68323 - DNA, 18 bp, Artificial Sequence
  Synthetic DNA
caatccgtttcgttttcg

SEQ ID NO: 68324 - DNA, 18 bp, Artificial Sequence
  Synthetic DNA
caatcgggctagcaatag

SEQ ID NO: 68325 - DNA, 18 bp, Artificial Sequence
  Synthetic DNA
caatcggtcattctatag

SEQ ID NO: 68326 - DNA, 18 bp, Artificial Sequence
  Synthetic DNA
caatctgactctatacag

SEQ ID NO: 68327 - DNA, 18 bp, Artificial Sequence
  Synthetic DNA
caattagtctcacttcag

SEQ ID NO: 68328 - DNA, 18 bp, Artificial Sequence
  Synthetic DNA
caattcaactcattttag

SEQ ID NO: 68329 - DNA, 18 bp, Artificial Sequence
  Synthetic DNA
caattccagtctctaaag

SEQ ID NO: 68330 - DNA, 18 bp, Artificial Sequence
  Synthetic DNA
caattcgacactttaaag

SEQ ID NO: 68331 - DNA, 18 bp, Artificial Sequence
  Synthetic DNA
caattcgatacactgtag

SEQ ID NO: 68332 - DNA, 18 bp, Artificial Sequence
  Synthetic DNA
caattcgattcactactg

SEQ ID NO: 68333 - DNA, 18 bp, Artificial Sequence
  Synthetic DNA
caatttgactcacaattg

SEQ ID NO: 68334 - DNA, 18 bp, Artificial Sequence
  Synthetic DNA
cacctccacacgctttcg

SEQ ID NO: 68335 - DNA, 18 bp, Artificial Sequence
  Synthetic DNA
cactaagagtcatcattg

SEQ ID NO: 68336 - DNA, 18 bp, Artificial Sequence
  Synthetic DNA
cactaagtatcactatag

SEQ ID NO: 68337 - DNA, 18 bp, Artificial Sequence
  Synthetic DNA
cactacgacttacttttg

SEQ ID NO: 68338 - DNA, 18 bp, Artificial Sequence
  Synthetic DNA
cactgcgtctcataatag

SEQ ID NO: 68339 - DNA, 18 bp, Artificial Sequence
  Synthetic DNA
cagaaagactcactatgg

SEQ ID NO: 68340 - DNA, 18 bp, Artificial Sequence
  Synthetic DNA
cagtatatatcacttttg

SEQ ID NO: 68341 - DNA, 18 bp, Artificial Sequence
  Synthetic DNA
cataacgtctccctctag

SEQ ID NO: 68342 - DNA, 18 bp, Artificial Sequence
  Synthetic DNA
catcacacctgaattcag

SEQ ID NO: 68343 - DNA, 18 bp, Artificial Sequence
  Synthetic DNA
cattaaaccgcactttag

SEQ ID NO: 68344 - DNA, 18 bp, Artificial Sequence
  Synthetic DNA
cattacgattcagcattg

SEQ ID NO: 68345 - DNA, 18 bp, Artificial Sequence
  Synthetic DNA
cattacgtttcaatttag

SEQ ID NO: 68346 - DNA, 18 bp, Artificial Sequence
  Synthetic DNA
cattactacgcactatgg

SEQ ID NO: 68347 - DNA, 18 bp, Artificial Sequence
  Synthetic DNA
cattatttctcaatatag

SEQ ID NO: 68348 - DNA, 18 bp, Artificial Sequence
  Synthetic DNA
catttcgttttactacga

SEQ ID NO: 68349 - DNA, 18 bp, Artificial Sequence
  Synthetic DNA
ccaaaggactctcaatag

SEQ ID NO: 68350 - DNA, 18 bp, Artificial Sequence
  Synthetic DNA
ccaccttctacactattg

SEQ ID NO: 68351 - DNA, 18 bp, Artificial Sequence
  Synthetic DNA
ccatacatctcactaagg

SEQ ID NO: 68352 - DNA, 18 bp, Artificial Sequence
  Synthetic DNA
cccatggactcactctag

SEQ ID NO: 68353 - DNA, 18 bp, Artificial Sequence
  Synthetic DNA
cgacactactcgttatcg

SEQ ID NO: 68354 - DNA, 18 bp, Artificial Sequence
  Synthetic DNA
cgatacaccatactatag

SEQ ID NO: 68355 - DNA, 18 bp, Artificial Sequence
  Synthetic DNA
cgataccactcacgaaag

SEQ ID NO: 68356 - DNA, 18 bp, Artificial Sequence
  Synthetic DNA
cgatagaacttctaatag

SEQ ID NO: 68357 - DNA, 18 bp, Artificial Sequence
  Synthetic DNA
cgtttcgtctctcaatgg

SEQ ID NO: 68358 - DNA, 18 bp, Artificial Sequence
  Synthetic DNA
ctaaacaactcacaatcg

SEQ ID NO: 68359 - DNA, 18 bp, Artificial Sequence
  Synthetic DNA
ctataagactcacaacag

SEQ ID NO: 68360 - DNA, 18 bp, Artificial Sequence
  Synthetic DNA
ctatacatctcgctttag

SEQ ID NO: 68361 - DNA, 18 bp, Artificial Sequence
  Synthetic DNA
ctatatgacacaccatag

SEQ ID NO: 68362 - DNA, 18 bp, Artificial Sequence
  Synthetic DNA
ctattcatctcaccattg

SEQ ID NO: 68363 - DNA, 18 bp, Artificial Sequence
  Synthetic DNA
ctatttgactgactaaag

SEQ ID NO: 68364 - DNA, 18 bp, Artificial Sequence
  Synthetic DNA
ctcaacgactaacttatg

SEQ ID NO: 68365 - DNA, 18 bp, Artificial Sequence
  Synthetic DNA
ctctacgactaactaaag

SEQ ID NO: 68366 - DNA, 18 bp, Artificial Sequence
  Synthetic DNA
ctctatgacactccaaag

SEQ ID NO: 68367 - DNA, 18 bp, Artificial Sequence
  Synthetic DNA
ctctatgactcactattg

SEQ ID NO: 68368 - DNA, 18 bp, Artificial Sequence
  Synthetic DNA
ctggaagactctttatag

SEQ ID NO: 68369 - DNA, 18 bp, Artificial Sequence
  Synthetic DNA
ctgtacgactcgctaagg

SEQ ID NO: 68370 - DNA, 18 bp, Artificial Sequence
  Synthetic DNA
cttatactctcacttttg

SEQ ID NO: 68371 - DNA, 18 bp, Artificial Sequence
  Synthetic DNA
ctttacgactctctctag

SEQ ID NO: 68372 - DNA, 18 bp, Artificial Sequence
  Synthetic DNA
gaaaaagaaactctaaag

SEQ ID NO: 68373 - DNA, 18 bp, Artificial Sequence
  Synthetic DNA
gaacactacatactagag

SEQ ID NO: 68374 - DNA, 18 bp, Artificial Sequence
  Synthetic DNA
gaacccgactgtctaagg

SEQ ID NO: 68375 - DNA, 18 bp, Artificial Sequence
  Synthetic DNA
gaataagacttacatatg

SEQ ID NO: 68376 - DNA, 18 bp, Artificial Sequence
  Synthetic DNA
gaataatattgtctttcg

SEQ ID NO: 68377 - DNA, 18 bp, Artificial Sequence
  Synthetic DNA
gaatacaattcacaattg

SEQ ID NO: 68378 - DNA, 18 bp, Artificial Sequence
  Synthetic DNA
gaatacaattgaccaaag

SEQ ID NO: 68379 - DNA, 18 bp, Artificial Sequence
  Synthetic DNA
gaataggactctcttttg

SEQ ID NO: 68380 - DNA, 18 bp, Artificial Sequence
  Synthetic DNA
gaatatatcacactacag

SEQ ID NO: 68381 - DNA, 18 bp, Artificial Sequence
  Synthetic DNA
gaatatatctcacaatag

SEQ ID NO: 68382 - DNA, 18 bp, Artificial Sequence
  Synthetic DNA
gaatatgaccctcagtag

SEQ ID NO: 68383 - DNA, 18 bp, Artificial Sequence
  Synthetic DNA
gaatatgtcttcgttttg

SEQ ID NO: 68384 - DNA, 18 bp, Artificial Sequence
  Synthetic DNA
gaattagacactcttcag

SEQ ID NO: 68385 - DNA, 18 bp, Artificial Sequence
  Synthetic DNA
gaattagcctcacaatag

SEQ ID NO: 68386 - DNA, 18 bp, Artificial Sequence
  Synthetic DNA
gaattcgactatttttag

SEQ ID NO: 68387 - DNA, 18 bp, Artificial Sequence
  Synthetic DNA
gactgtgtcactctattg

SEQ ID NO: 68388 - DNA, 18 bp, Artificial Sequence
  Synthetic DNA
gagtacgtctcaatattg

SEQ ID NO: 68389 - DNA, 18 bp, Artificial Sequence
  Synthetic DNA
gagtacgtctcacttcag

SEQ ID NO: 68390 - DNA, 18 bp, Artificial Sequence
  Synthetic DNA
gatatggattctctatag

SEQ ID NO: 68391 - DNA, 18 bp, Artificial Sequence
  Synthetic DNA
gcatactacgctcaatag

SEQ ID NO: 68392 - DNA, 18 bp, Artificial Sequence
  Synthetic DNA
ggctacgactctctaaag

SEQ ID NO: 68393 - DNA, 18 bp, Artificial Sequence
  Synthetic DNA
gtataagactccctaaag

SEQ ID NO: 68394 - DNA, 18 bp, Artificial Sequence
  Synthetic DNA
gtatacgacttagtgtag

SEQ ID NO: 68395 - DNA, 18 bp, Artificial Sequence
  Synthetic DNA
gtatccgcctctcaatag

SEQ ID NO: 68396 - DNA, 18 bp, Artificial Sequence
  Synthetic DNA
gtattcgacacactattg

SEQ ID NO: 68397 - DNA, 18 bp, Artificial Sequence
  Synthetic DNA
gtttaggactcacctaag

SEQ ID NO: 68398 - DNA, 18 bp, Artificial Sequence
  Synthetic DNA
taaaaagactaactgttg

SEQ ID NO: 68399 - DNA, 18 bp, Artificial Sequence
  Synthetic DNA
taaaaagactcgtaatcg

SEQ ID NO: 68400 - DNA, 18 bp, Artificial Sequence
  Synthetic DNA
taaaaagagtcaccttag

SEQ ID NO: 68401 - DNA, 18 bp, Artificial Sequence
  Synthetic DNA
taaaaagattcgctttag

SEQ ID NO: 68402 - DNA, 18 bp, Artificial Sequence
  Synthetic DNA
taaaaaggttcacaatag

SEQ ID NO: 68403 - DNA, 18 bp, Artificial Sequence
  Synthetic DNA
taaaaattctctctacag

SEQ ID NO: 68404 - DNA, 18 bp, Artificial Sequence
  Synthetic DNA
taaaacacctcaataaag

SEQ ID NO: 68405 - DNA, 18 bp, Artificial Sequence
  Synthetic DNA
taaaacagatcacactag

SEQ ID NO: 68406 - DNA, 18 bp, Artificial Sequence
  Synthetic DNA
taaaacctctcacgaaag

SEQ ID NO: 68407 - DNA, 18 bp, Artificial Sequence
  Synthetic DNA
taaaacgacccgataaag

SEQ ID NO: 68408 - DNA, 18 bp, Artificial Sequence
  Synthetic DNA
taaaacgactctcattgg

SEQ ID NO: 68409 - DNA, 18 bp, Artificial Sequence
  Synthetic DNA
taaaacgactgccaatcg

SEQ ID NO: 68410 - DNA, 18 bp, Artificial Sequence
  Synthetic DNA
taaaacgacttcttaaag

SEQ ID NO: 68411 - DNA, 18 bp, Artificial Sequence
  Synthetic DNA
taaaacgattcacttatg

SEQ ID NO: 68412 - DNA, 18 bp, Artificial Sequence
  Synthetic DNA
taaaacgcgtctctaatg

SEQ ID NO: 68413 - DNA, 18 bp, Artificial Sequence
  Synthetic DNA
taaaacgtatcacttttg

SEQ ID NO: 68414 - DNA, 18 bp, Artificial Sequence
  Synthetic DNA
taaaacgtcacacattcg

SEQ ID NO: 68415 - DNA, 18 bp, Artificial Sequence
  Synthetic DNA
taaaacgtcgcacaattg

SEQ ID NO: 68416 - DNA, 18 bp, Artificial Sequence
  Synthetic DNA
taaaacgtctaacctttg

SEQ ID NO: 68417 - DNA, 18 bp, Artificial Sequence
  Synthetic DNA
taaaacgtctcatgttcg

SEQ ID NO: 68418 - DNA, 18 bp, Artificial Sequence
  Synthetic DNA
taaaacgtctgactactg

SEQ ID NO: 68419 - DNA, 18 bp, Artificial Sequence
  Synthetic DNA
taaaactagtcgctttag

SEQ ID NO: 68420 - DNA, 18 bp, Artificial Sequence
  Synthetic DNA
taaaactgcacccaagag

SEQ ID NO: 68421 - DNA, 18 bp, Artificial Sequence
  Synthetic DNA
taaaacttttcacaatag

SEQ ID NO: 68422 - DNA, 18 bp, Artificial Sequence
  Synthetic DNA
taaaaggactcctgattg

SEQ ID NO: 68423 - DNA, 18 bp, Artificial Sequence
  Synthetic DNA
taaaatgacaaatgatag

SEQ ID NO: 68424 - DNA, 18 bp, Artificial Sequence
  Synthetic DNA
taaaatggatctctatag

SEQ ID NO: 68425 - DNA, 18 bp, Artificial Sequence
  Synthetic DNA
taaaattactctctctag

SEQ ID NO: 68426 - DNA, 18 bp, Artificial Sequence
  Synthetic DNA
taaacagacacacaattg

SEQ ID NO: 68427 - DNA, 18 bp, Artificial Sequence
  Synthetic DNA
taaaccgacgcactaatg

SEQ ID NO: 68428 - DNA, 18 bp, Artificial Sequence
  Synthetic DNA
taaaccgactctgattag

SEQ ID NO: 68429 - DNA, 18 bp, Artificial Sequence
  Synthetic DNA
taaaccgtttcaccaaag

SEQ ID NO: 68430 - DNA, 18 bp, Artificial Sequence
  Synthetic DNA
taaagcaactcactaagg

SEQ ID NO: 68431 - DNA, 18 bp, Artificial Sequence
  Synthetic DNA
taaagcaattaactttag

SEQ ID NO: 68432 - DNA, 18 bp, Artificial Sequence
  Synthetic DNA
taaagccactgactttcg

SEQ ID NO: 68433 - DNA, 18 bp, Artificial Sequence
  Synthetic DNA
taaagctactctcaatag

SEQ ID NO: 68434 - DNA, 18 bp, Artificial Sequence
  Synthetic DNA
taaagtgtattactattg

SEQ ID NO: 68435 - DNA, 18 bp, Artificial Sequence
  Synthetic DNA
taaataggcactttatag

SEQ ID NO: 68436 - DNA, 18 bp, Artificial Sequence
  Synthetic DNA
taaatcaaaacactaaag

SEQ ID NO: 68437 - DNA, 18 bp, Artificial Sequence
  Synthetic DNA
taaatcgacatattttag

SEQ ID NO: 68438 - DNA, 18 bp, Artificial Sequence
  Synthetic DNA
taaatcgactcgcaaacg

SEQ ID NO: 68439 - DNA, 18 bp, Artificial Sequence
  Synthetic DNA
taaatcgacttactaatg

SEQ ID NO: 68440 - DNA, 18 bp, Artificial Sequence
  Synthetic DNA
taaatcgactttcgaacg

SEQ ID NO: 68441 - DNA, 18 bp, Artificial Sequence
  Synthetic DNA
taaatcgagtctctaaag

SEQ ID NO: 68442 - DNA, 18 bp, Artificial Sequence
  Synthetic DNA
taaatcggctcacaattg

SEQ ID NO: 68443 - DNA, 18 bp, Artificial Sequence
  Synthetic DNA
taaatctaaacactctag

SEQ ID NO: 68444 - DNA, 18 bp, Artificial Sequence
  Synthetic DNA
taaatctactcattgttg

SEQ ID NO: 68445 - DNA, 18 bp, Artificial Sequence
  Synthetic DNA
taaatcttctcactaaag

SEQ ID NO: 68446 - DNA, 18 bp, Artificial Sequence
  Synthetic DNA
taaatggggccactattg

SEQ ID NO: 68447 - DNA, 18 bp, Artificial Sequence
  Synthetic DNA
taaatggtctcactttcg

SEQ ID NO: 68448 - DNA, 18 bp, Artificial Sequence
  Synthetic DNA
taaattgactcacattag

SEQ ID NO: 68449 - DNA, 18 bp, Artificial Sequence
  Synthetic DNA
taaattgattcacaagag

SEQ ID NO: 68450 - DNA, 18 bp, Artificial Sequence
  Synthetic DNA
taacaagactctttttag

SEQ ID NO: 68451 - DNA, 18 bp, Artificial Sequence
  Synthetic DNA
taacacctgtaaccctag

SEQ ID NO: 68452 - DNA, 18 bp, Artificial Sequence
  Synthetic DNA
taacacgacacacacctg

SEQ ID NO: 68453 - DNA, 18 bp, Artificial Sequence
  Synthetic DNA
taacacgacacatcacag

SEQ ID NO: 68454 - DNA, 18 bp, Artificial Sequence
  Synthetic DNA
taacacggcactccatag

SEQ ID NO: 68455 - DNA, 18 bp, Artificial Sequence
  Synthetic DNA
taacagtactctctctag

SEQ ID NO: 68456 - DNA, 18 bp, Artificial Sequence
  Synthetic DNA
taacatcacactcaaagg

SEQ ID NO: 68457 - DNA, 18 bp, Artificial Sequence
  Synthetic DNA
taacatgaaccgctattg

SEQ ID NO: 68458 - DNA, 18 bp, Artificial Sequence
  Synthetic DNA
taacatgatcgactatag

SEQ ID NO: 68459 - DNA, 18 bp, Artificial Sequence
  Synthetic DNA
taaccagactctctattg

SEQ ID NO: 68460 - DNA, 18 bp, Artificial Sequence
  Synthetic DNA
taacgatacacactatag

SEQ ID NO: 68461 - DNA, 18 bp, Artificial Sequence
  Synthetic DNA
taacgcaactcactgatg

SEQ ID NO: 68462 - DNA, 18 bp, Artificial Sequence
  Synthetic DNA
taactagactcacaacag

SEQ ID NO: 68463 - DNA, 18 bp, Artificial Sequence
  Synthetic DNA
taactatactcacttcgg

SEQ ID NO: 68464 - DNA, 18 bp, Artificial Sequence
  Synthetic DNA
taactcaattcactattg

SEQ ID NO: 68465 - DNA, 18 bp, Artificial Sequence
  Synthetic DNA
taactcgactttctaaag

SEQ ID NO: 68466 - DNA, 18 bp, Artificial Sequence
  Synthetic DNA
taactcgatttactatcg

SEQ ID NO: 68467 - DNA, 18 bp, Artificial Sequence
  Synthetic DNA
taactgtactttcaatag

SEQ ID NO: 68468 - DNA, 18 bp, Artificial Sequence
  Synthetic DNA
taacttgtctgactatag

SEQ ID NO: 68469 - DNA, 18 bp, Artificial Sequence
  Synthetic DNA
taagacgacactcttcag

SEQ ID NO: 68470 - DNA, 18 bp, Artificial Sequence
  Synthetic DNA
taagatgatttactattg

SEQ ID NO: 68471 - DNA, 18 bp, Artificial Sequence
  Synthetic DNA
taagtagactctatttag

SEQ ID NO: 68472 - DNA, 18 bp, Artificial Sequence
  Synthetic DNA
taagtcgtctttctatag

SEQ ID NO: 68473 - DNA, 18 bp, Artificial Sequence
  Synthetic DNA
taataacactcccttaag

SEQ ID NO: 68474 - DNA, 18 bp, Artificial Sequence
  Synthetic DNA
taataagacaatctttag

SEQ ID NO: 68475 - DNA, 18 bp, Artificial Sequence
  Synthetic DNA
taataagacacatgattg

SEQ ID NO: 68476 - DNA, 18 bp, Artificial Sequence
  Synthetic DNA
taataagacgacctaaag

SEQ ID NO: 68477 - DNA, 18 bp, Artificial Sequence
  Synthetic DNA
taataagacttattaacg

SEQ ID NO: 68478 - DNA, 18 bp, Artificial Sequence
  Synthetic DNA
taataagactttttacag

SEQ ID NO: 68479 - DNA, 18 bp, Artificial Sequence
  Synthetic DNA
taataagtcatacgattg

SEQ ID NO: 68480 - DNA, 18 bp, Artificial Sequence
  Synthetic DNA
taataatacactccatag

SEQ ID NO: 68481 - DNA, 18 bp, Artificial Sequence
  Synthetic DNA
taatacaaaactcaaaag

SEQ ID NO: 68482 - DNA, 18 bp, Artificial Sequence
  Synthetic DNA
taatacaaatcctttaag

SEQ ID NO: 68483 - DNA, 18 bp, Artificial Sequence
  Synthetic DNA
taatacaacaatctctag

SEQ ID NO: 68484 - DNA, 18 bp, Artificial Sequence
  Synthetic DNA
taatacaacatactgggg

SEQ ID NO: 68485 - DNA, 18 bp, Artificial Sequence
  Synthetic DNA
taatacaactaagttatg

SEQ ID NO: 68486 - DNA, 18 bp, Artificial Sequence
  Synthetic DNA
taatacaactggtcacgg

SEQ ID NO: 68487 - DNA, 18 bp, Artificial Sequence
  Synthetic DNA
taatacaacttaatagcg

SEQ ID NO: 68488 - DNA, 18 bp, Artificial Sequence
  Synthetic DNA
taatacaacttatttcag

SEQ ID NO: 68489 - DNA, 18 bp, Artificial Sequence
  Synthetic DNA
taatacaacttcgttacg

SEQ ID NO: 68490 - DNA, 18 bp, Artificial Sequence
  Synthetic DNA
taatacaccaaactattg

SEQ ID NO: 68491 - DNA, 18 bp, Artificial Sequence
  Synthetic DNA
taatacataaccatctag

SEQ ID NO: 68492 - DNA, 18 bp, Artificial Sequence
  Synthetic DNA
taatacatcctactatcg

SEQ ID NO: 68493 - DNA, 18 bp, Artificial Sequence
  Synthetic DNA
taatacatctatcaaaag

SEQ ID NO: 68494 - DNA, 18 bp, Artificial Sequence
  Synthetic DNA
taatacatctcacatgag

SEQ ID NO: 68495 - DNA, 18 bp, Artificial Sequence
  Synthetic DNA
taatacatgtctctattg

SEQ ID NO: 68496 - DNA, 18 bp, Artificial Sequence
  Synthetic DNA
taataccactcacaaata

SEQ ID NO: 68497 - DNA, 18 bp, Artificial Sequence
  Synthetic DNA
taataccactctaaaaag

SEQ ID NO: 68498 - DNA, 18 bp, Artificial Sequence
  Synthetic DNA
taataccatccaatattg

SEQ ID NO: 68499 - DNA, 18 bp, Artificial Sequence
  Synthetic DNA
taatacccacaaatatag

SEQ ID NO: 68500 - DNA, 18 bp, Artificial Sequence
  Synthetic DNA
taatacctcacactttgg

SEQ ID NO: 68501 - DNA, 18 bp, Artificial Sequence
  Synthetic DNA
taatacctctccatattg

SEQ ID NO: 68502 - DNA, 18 bp, Artificial Sequence
  Synthetic DNA
taatacctttcaatattg

SEQ ID NO: 68503 - DNA, 18 bp, Artificial Sequence
  Synthetic DNA
taatacgaaatacttttg

SEQ ID NO: 68504 - DNA, 18 bp, Artificial Sequence
  Synthetic DNA
taatacgacacagttccg

SEQ ID NO: 68505 - DNA, 18 bp, Artificial Sequence
  Synthetic DNA
taatacgacacgcagttg

SEQ ID NO: 68506 - DNA, 18 bp, Artificial Sequence
  Synthetic DNA
taatacgacactattaag

SEQ ID NO: 68507 - DNA, 18 bp, Artificial Sequence
  Synthetic DNA
taatacgacctaccaaaa

SEQ ID NO: 68508 - DNA, 18 bp, Artificial Sequence
  Synthetic DNA
taatacgactataaattg

SEQ ID NO: 68509 - DNA, 18 bp, Artificial Sequence
  Synthetic DNA
taatacgactattaattg

SEQ ID NO: 68510 - DNA, 18 bp, Artificial Sequence
  Synthetic DNA
taatacgactcaacggtg

SEQ ID NO: 68511 - DNA, 18 bp, Artificial Sequence
  Synthetic DNA
taatacgactcttgaatg

SEQ ID NO: 68512 - DNA, 18 bp, Artificial Sequence
  Synthetic DNA
taatacgactggcataag

SEQ ID NO: 68513 - DNA, 18 bp, Artificial Sequence
  Synthetic DNA
taatacgactgtcaaggg

SEQ ID NO: 68514 - DNA, 18 bp, Artificial Sequence
  Synthetic DNA
taatacgagtttcattag

SEQ ID NO: 68515 - DNA, 18 bp, Artificial Sequence
  Synthetic DNA
taatacgatccacaaagg

SEQ ID NO: 68516 - DNA, 18 bp, Artificial Sequence
  Synthetic DNA
taatacgatttacataag

SEQ ID NO: 68517 - DNA, 18 bp, Artificial Sequence
  Synthetic DNA
taatacgatttatttttg

SEQ ID NO: 68518 - DNA, 18 bp, Artificial Sequence
  Synthetic DNA
taatacgccatactaccg

SEQ ID NO: 68519 - DNA, 18 bp, Artificial Sequence
  Synthetic DNA
taatacgcctttctcttg

SEQ ID NO: 68520 - DNA, 18 bp, Artificial Sequence
  Synthetic DNA
taatacgctcaacataag

SEQ ID NO: 68521 - DNA, 18 bp, Artificial Sequence
  Synthetic DNA
taatacggaccataatag

SEQ ID NO: 68522 - DNA, 18 bp, Artificial Sequence
  Synthetic DNA
taatacggatcagtaatg

SEQ ID NO: 68523 - DNA, 18 bp, Artificial Sequence
  Synthetic DNA
taatacggatcttaatag

SEQ ID NO: 68524 - DNA, 18 bp, Artificial Sequence
  Synthetic DNA
taatacggggcacagttg

SEQ ID NO: 68525 - DNA, 18 bp, Artificial Sequence
  Synthetic DNA
taatacgtattactcgag

SEQ ID NO: 68526 - DNA, 18 bp, Artificial Sequence
  Synthetic DNA
taatacgtcaatctatcg

SEQ ID NO: 68527 - DNA, 18 bp, Artificial Sequence
  Synthetic DNA
taatacgtcacacaaatg

SEQ ID NO: 68528 - DNA, 18 bp, Artificial Sequence
  Synthetic DNA
taatacgtcgttttgtag

SEQ ID NO: 68529 - DNA, 18 bp, Artificial Sequence
  Synthetic DNA
taatacgtgcaaatattg

SEQ ID NO: 68530 - DNA, 18 bp, Artificial Sequence
  Synthetic DNA
taatacgttttagtattg

SEQ ID NO: 68531 - DNA, 18 bp, Artificial Sequence
  Synthetic DNA
taatactaaacacaagag

SEQ ID NO: 68532 - DNA, 18 bp, Artificial Sequence
  Synthetic DNA
taatactacaaagtaatg

SEQ ID NO: 68533 - DNA, 18 bp, Artificial Sequence
  Synthetic DNA
taatactacatactcaag

SEQ ID NO: 68534 - DNA, 18 bp, Artificial Sequence
  Synthetic DNA
taatactacgcacagttg

SEQ ID NO: 68535 - DNA, 18 bp, Artificial Sequence
  Synthetic DNA
taatactacgcactccgg

SEQ ID NO: 68536 - DNA, 18 bp, Artificial Sequence
  Synthetic DNA
taatactactcaggtaag

SEQ ID NO: 68537 - DNA, 18 bp, Artificial Sequence
  Synthetic DNA
taatactatagattatag

SEQ ID NO: 68538 - DNA, 18 bp, Artificial Sequence
  Synthetic DNA
taatactatgttcctgag

SEQ ID NO: 68539 - DNA, 18 bp, Artificial Sequence
  Synthetic DNA
taatactcttcattttag

SEQ ID NO: 68540 - DNA, 18 bp, Artificial Sequence
  Synthetic DNA
taatactgcaaacctcag

SEQ ID NO: 68541 - DNA, 18 bp, Artificial Sequence
  Synthetic DNA
taatactgctcccactag

SEQ ID NO: 68542 - DNA, 18 bp, Artificial Sequence
  Synthetic DNA
taatacttaactctatag

SEQ ID NO: 68543 - DNA, 18 bp, Artificial Sequence
  Synthetic DNA
taatacttatccccatag

SEQ ID NO: 68544 - DNA, 18 bp, Artificial Sequence
  Synthetic DNA
taatacttatgattaatg

SEQ ID NO: 68545 - DNA, 18 bp, Artificial Sequence
  Synthetic DNA
taatacttcaaagtatag

SEQ ID NO: 68546 - DNA, 18 bp, Artificial Sequence
  Synthetic DNA
taatacttgacactaatg

SEQ ID NO: 68547 - DNA, 18 bp, Artificial Sequence
  Synthetic DNA
taatacttgtcacttaag

SEQ ID NO: 68548 - DNA, 18 bp, Artificial Sequence
  Synthetic DNA
taatagcactcatttatg

SEQ ID NO: 68549 - DNA, 18 bp, Artificial Sequence
  Synthetic DNA
taataggaaatagtatag

SEQ ID NO: 68550 - DNA, 18 bp, Artificial Sequence
  Synthetic DNA
taatagggcacacattag

SEQ ID NO: 68551 - DNA, 18 bp, Artificial Sequence
  Synthetic DNA
taataggtataattatcg

SEQ ID NO: 68552 - DNA, 18 bp, Artificial Sequence
  Synthetic DNA
taataggtgtcaataaag

SEQ ID NO: 68553 - DNA, 18 bp, Artificial Sequence
  Synthetic DNA
taatagttatgaaaatag

SEQ ID NO: 68554 - DNA, 18 bp, Artificial Sequence
  Synthetic DNA
taatataatacataaatg

SEQ ID NO: 68555 - DNA, 18 bp, Artificial Sequence
  Synthetic DNA
taatatcactctcttgcg

SEQ ID NO: 68556 - DNA, 18 bp, Artificial Sequence
  Synthetic DNA
taatatcagactctatag

SEQ ID NO: 68557 - DNA, 18 bp, Artificial Sequence
  Synthetic DNA
taatatctctcatcatag

SEQ ID NO: 68558 - DNA, 18 bp, Artificial Sequence
  Synthetic DNA
taatatgacacaatccag

SEQ ID NO: 68559 - DNA, 18 bp, Artificial Sequence
  Synthetic DNA
taatatgagtcatagtag

SEQ ID NO: 68560 - DNA, 18 bp, Artificial Sequence
  Synthetic DNA
taatatgattaactaatg

SEQ ID NO: 68561 - DNA, 18 bp, Artificial Sequence
  Synthetic DNA
taatatgtttgaatatcg

SEQ ID NO: 68562 - DNA, 18 bp, Artificial Sequence
  Synthetic DNA
taatatgttttaataaag

SEQ ID NO: 68563 - DNA, 18 bp, Artificial Sequence
  Synthetic DNA
taatattaaaaactatag

SEQ ID NO: 68564 - DNA, 18 bp, Artificial Sequence
  Synthetic DNA
taatattacacgctatcg

SEQ ID NO: 68565 - DNA, 18 bp, Artificial Sequence
  Synthetic DNA
taatattacacttcatag

SEQ ID NO: 68566 - DNA, 18 bp, Artificial Sequence
  Synthetic DNA
taatcagaaacactgtag

SEQ ID NO: 68567 - DNA, 18 bp, Artificial Sequence
  Synthetic DNA
taatcagtctcattagag

SEQ ID NO: 68568 - DNA, 18 bp, Artificial Sequence
  Synthetic DNA
taatccaacgccctaaag

SEQ ID NO: 68569 - DNA, 18 bp, Artificial Sequence
  Synthetic DNA
taatccgactcccattgg

SEQ ID NO: 68570 - DNA, 18 bp, Artificial Sequence
  Synthetic DNA
taatccgactcgtaggcg

SEQ ID NO: 68571 - DNA, 18 bp, Artificial Sequence
  Synthetic DNA
taatccgacttacctatg

SEQ ID NO: 68572 - DNA, 18 bp, Artificial Sequence
  Synthetic DNA
taatccgattcaaaaaag

SEQ ID NO: 68573 - DNA, 18 bp, Artificial Sequence
  Synthetic DNA
taatccgccacactaacg

SEQ ID NO: 68574 - DNA, 18 bp, Artificial Sequence
  Synthetic DNA
taatccggctccgtatcg

SEQ ID NO: 68575 - DNA, 18 bp, Artificial Sequence
  Synthetic DNA
taatccgtaacatcatag

SEQ ID NO: 68576 - DNA, 18 bp, Artificial Sequence
  Synthetic DNA
taatccgtcgctccatag

SEQ ID NO: 68577 - DNA, 18 bp, Artificial Sequence
  Synthetic DNA
taatccgtgtcactcatg

SEQ ID NO: 68578 - DNA, 18 bp, Artificial Sequence
  Synthetic DNA
taatcctactgaacatag

SEQ ID NO: 68579 - DNA, 18 bp, Artificial Sequence
  Synthetic DNA
taatcctattcattattg

SEQ ID NO: 68580 - DNA, 18 bp, Artificial Sequence
  Synthetic DNA
taatccttctctctatgg

SEQ ID NO: 68581 - DNA, 18 bp, Artificial Sequence
  Synthetic DNA
taatgaagttcgctattg

SEQ ID NO: 68582 - DNA, 18 bp, Artificial Sequence
  Synthetic DNA
taatgatcttctctgtag

SEQ ID NO: 68583 - DNA, 18 bp, Artificial Sequence
  Synthetic DNA
taatgcaactcaattaag

SEQ ID NO: 68584 - DNA, 18 bp, Artificial Sequence
  Synthetic DNA
taatgcatcttactttag

SEQ ID NO: 68585 - DNA, 18 bp, Artificial Sequence
  Synthetic DNA
taatgcgacttgctcgag

SEQ ID NO: 68586 - DNA, 18 bp, Artificial Sequence
  Synthetic DNA
taatgcgagtctatattg

SEQ ID NO: 68587 - DNA, 18 bp, Artificial Sequence
  Synthetic DNA
taatgcgcatctctaaag

SEQ ID NO: 68588 - DNA, 18 bp, Artificial Sequence
  Synthetic DNA
taatgcggatggagatag

SEQ ID NO: 68589 - DNA, 18 bp, Artificial Sequence
  Synthetic DNA
taatgcgtaacgctgttg

SEQ ID NO: 68590 - DNA, 18 bp, Artificial Sequence
  Synthetic DNA
taatgcgtcactttatag

SEQ ID NO: 68591 - DNA, 18 bp, Artificial Sequence
  Synthetic DNA
taatgcgtcatcctacag

SEQ ID NO: 68592 - DNA, 18 bp, Artificial Sequence
  Synthetic DNA
taatgcgtctctctgttg

SEQ ID NO: 68593 - DNA, 18 bp, Artificial Sequence
  Synthetic DNA
taatgctacacacaattg

SEQ ID NO: 68594 - DNA, 18 bp, Artificial Sequence
  Synthetic DNA
taatgctactgacttaag

SEQ ID NO: 68595 - DNA, 18 bp, Artificial Sequence
  Synthetic DNA
taatgctgatcacttaag

SEQ ID NO: 68596 - DNA, 18 bp, Artificial Sequence
  Synthetic DNA
taatgtcactcctaatag

SEQ ID NO: 68597 - DNA, 18 bp, Artificial Sequence
  Synthetic DNA
taatgtgaatcacaaatg

SEQ ID NO: 68598 - DNA, 18 bp, Artificial Sequence
  Synthetic DNA
taatgtggctcaccaaag

SEQ ID NO: 68599 - DNA, 18 bp, Artificial Sequence
  Synthetic DNA
taatgtggctcaccgtag

SEQ ID NO: 68600 - DNA, 18 bp, Artificial Sequence
  Synthetic DNA
taattaaatctacttaag

SEQ ID NO: 68601 - DNA, 18 bp, Artificial Sequence
  Synthetic DNA
taattagcctctctattg

SEQ ID NO: 68602 - DNA, 18 bp, Artificial Sequence
  Synthetic DNA
taattagtctcagtttag

SEQ ID NO: 68603 - DNA, 18 bp, Artificial Sequence
  Synthetic DNA
taattatataacctatag

SEQ ID NO: 68604 - DNA, 18 bp, Artificial Sequence
  Synthetic DNA
taattcaactcagttttg

SEQ ID NO: 68605 - DNA, 18 bp, Artificial Sequence
  Synthetic DNA
taattccattcacaaaag

SEQ ID NO: 68606 - DNA, 18 bp, Artificial Sequence
  Synthetic DNA
taattccattctcaatag

SEQ ID NO: 68607 - DNA, 18 bp, Artificial Sequence
  Synthetic DNA
taattcctctctctatgg

SEQ ID NO: 68608 - DNA, 18 bp, Artificial Sequence
  Synthetic DNA
taattcgaatcataattg

SEQ ID NO: 68609 - DNA, 18 bp, Artificial Sequence
  Synthetic DNA
taattcgacacgccaaag

SEQ ID NO: 68610 - DNA, 18 bp, Artificial Sequence
  Synthetic DNA
taattcgacgcatcatcg

SEQ ID NO: 68611 - DNA, 18 bp, Artificial Sequence
  Synthetic DNA
taattcgactcacacaaa

SEQ ID NO: 68612 - DNA, 18 bp, Artificial Sequence
  Synthetic DNA
taattcgatattctatag

SEQ ID NO: 68613 - DNA, 18 bp, Artificial Sequence
  Synthetic DNA
taattcgcctgtcgaatg

SEQ ID NO: 68614 - DNA, 18 bp, Artificial Sequence
  Synthetic DNA
taattcggtttcctattg

SEQ ID NO: 68615 - DNA, 18 bp, Artificial Sequence
  Synthetic DNA
taattcgtatcattaggg

SEQ ID NO: 68616 - DNA, 18 bp, Artificial Sequence
  Synthetic DNA
taattcgtatgacaatag

SEQ ID NO: 68617 - DNA, 18 bp, Artificial Sequence
  Synthetic DNA
taattcgtccaaatatag

SEQ ID NO: 68618 - DNA, 18 bp, Artificial Sequence
  Synthetic DNA
taattcgtcgttctcatg

SEQ ID NO: 68619 - DNA, 18 bp, Artificial Sequence
  Synthetic DNA
taattcgtctcacttacg

SEQ ID NO: 68620 - DNA, 18 bp, Artificial Sequence
  Synthetic DNA
taattcgtcttactttcg

SEQ ID NO: 68621 - DNA, 18 bp, Artificial Sequence
  Synthetic DNA
taattcgttacactacag

SEQ ID NO: 68622 - DNA, 18 bp, Artificial Sequence
  Synthetic DNA
taattctactgacaaaag

SEQ ID NO: 68623 - DNA, 18 bp, Artificial Sequence
  Synthetic DNA
taattctattaaccatag

SEQ ID NO: 68624 - DNA, 18 bp, Artificial Sequence
  Synthetic DNA
taattctgctcataatag

SEQ ID NO: 68625 - DNA, 18 bp, Artificial Sequence
  Synthetic DNA
taattgaagtccttatcg

SEQ ID NO: 68626 - DNA, 18 bp, Artificial Sequence
  Synthetic DNA
taattgggcaacctttag

SEQ ID NO: 68627 - DNA, 18 bp, Artificial Sequence
  Synthetic DNA
taattggtcacattgttg

SEQ ID NO: 68628 - DNA, 18 bp, Artificial Sequence
  Synthetic DNA
taattgttcacactatag

SEQ ID NO: 68629 - DNA, 18 bp, Artificial Sequence
  Synthetic DNA
taatttgacactcttttg

SEQ ID NO: 68630 - DNA, 18 bp, Artificial Sequence
  Synthetic DNA
taatttgacagtctatag

SEQ ID NO: 68631 - DNA, 18 bp, Artificial Sequence
  Synthetic DNA
taatttgtctcaatatcg

SEQ ID NO: 68632 - DNA, 18 bp, Artificial Sequence
  Synthetic DNA
tacaaagtctcacaatag

SEQ ID NO: 68633 - DNA, 18 bp, Artificial Sequence
  Synthetic DNA
tacaacaactcacttgag

SEQ ID NO: 68634 - DNA, 18 bp, Artificial Sequence
  Synthetic DNA
tacaacgactcactcggg

SEQ ID NO: 68635 - DNA, 18 bp, Artificial Sequence
  Synthetic DNA
tacactaattcacacaag

SEQ ID NO: 68636 - DNA, 18 bp, Artificial Sequence
  Synthetic DNA
tacacttactccttatag

SEQ ID NO: 68637 - DNA, 18 bp, Artificial Sequence
  Synthetic DNA
tacagcacctcaccgttg

SEQ ID NO: 68638 - DNA, 18 bp, Artificial Sequence
  Synthetic DNA
tacatccactctctttag

SEQ ID NO: 68639 - DNA, 18 bp, Artificial Sequence
  Synthetic DNA
tacatcgaatcacttttg
